United States Patent 7,901,882 (ANALYSIS OF METHYLATION USING NUCLEIC ACID ARRAYS) - sequence listing, part 9

SEQ ID NO: 315476 - DNA, 25 bp, Mus musculus
gaagcacaacgtcgccagtccagga

SEQ ID NO: 315477 - DNA, 25 bp, Mus musculus
ctgccggcgggtaaagaaatagcga

SEQ ID NO: 315478 - DNA, 25 bp, Mus musculus
cagggacctcggagagctgttagaa

SEQ ID NO: 315479 - DNA, 25 bp, Mus musculus
ctcggagagctgttagaagcacaac

SEQ ID NO: 315480 - DNA, 25 bp, Mus musculus
agctgttagaagcacaacgtcgcca

SEQ ID NO: 315481 - DNA, 25 bp, Mus musculus
ttctcattccgggagaaagagaccc

SEQ ID NO: 315482 - DNA, 25 bp, Mus musculus
aataactgggtctcagcgccgcggt

SEQ ID NO: 315483 - DNA, 25 bp, Mus musculus
gcggggctccaataactgggtctca

SEQ ID NO: 315484 - DNA, 25 bp, Mus musculus
tgccgcggtgcagacccaggacgaa

SEQ ID NO: 315485 - DNA, 25 bp, Mus musculus
catcgttccggaggactgcccgaag

SEQ ID NO: 315486 - DNA, 25 bp, Mus musculus
gaacccaggtcgattctcattccgg

SEQ ID NO: 315487 - DNA, 25 bp, Mus musculus
tggccaagctcaaatcccgacgagg

SEQ ID NO: 315488 - DNA, 25 bp, Mus musculus
cccggctacggaagtgactggtcat

SEQ ID NO: 315489 - DNA, 25 bp, Mus musculus
gtcatctattaggagagctcgtgcc

SEQ ID NO: 315490 - DNA, 25 bp, Mus musculus
tagccgcagccgcatagacagcgct

SEQ ID NO: 315491 - DNA, 25 bp, Mus musculus
tgggccttcggatcccgaacgctca

SEQ ID NO: 315492 - DNA, 25 bp, Mus musculus
gatcccgaacgctcagcggcaaata

SEQ ID NO: 315493 - DNA, 25 bp, Mus musculus
ggcctgtgccgactcggaccctgga

SEQ ID NO: 315494 - DNA, 25 bp, Mus musculus
cgaaggcaagcctcgcagccggaga

SEQ ID NO: 315495 - DNA, 25 bp, Mus musculus
tgcagctccgaagagcacacgcaca

SEQ ID NO: 315496 - DNA, 25 bp, Mus musculus
ggtcaacttctattttgtcacagcc

SEQ ID NO: 315497 - DNA, 25 bp, Mus musculus
aaagcaggccaagcctccagcgcag

SEQ ID NO: 315498 - DNA, 25 bp, Mus musculus
agcgcagctcggactgcagctccga

SEQ ID NO: 315499 - DNA, 25 bp, Mus musculus
tttgtcacagccttaatcgtgaccc

SEQ ID NO: 315500 - DNA, 25 bp, Mus musculus
tagatcacgtggctcccaggcagcc

SEQ ID NO: 315501 - DNA, 25 bp, Mus musculus
gcgcctcgcctggtcaacttctatt

SEQ ID NO: 315502 - DNA, 25 bp, Mus musculus
ggcctgggagtctgccgcttacacc

SEQ ID NO: 315503 - DNA, 25 bp, Mus musculus
ttacaccgcccagccatggctctgg

SEQ ID NO: 315504 - DNA, 25 bp, Mus musculus
ggcgcccgccatcatccgtttagat

SEQ ID NO: 315505 - DNA, 25 bp, Mus musculus
ttacctgtaaagcaggccaagcctc

SEQ ID NO: 315506 - DNA, 25 bp, Mus musculus
atccgtttagatcacgtggctccca

SEQ ID NO: 315507 - DNA, 25 bp, Mus musculus
cgccaggacctcacttacctgtaaa

SEQ ID NO: 315508 - DNA, 25 bp, Mus musculus
gagcacacgcacatcttcagcggcg

SEQ ID NO: 315509 - DNA, 25 bp, Mus musculus
ggattctctggcttcagtacgcgtg

SEQ ID NO: 315510 - DNA, 25 bp, Mus musculus
ttgcgtggctcctcgctgagatccc

SEQ ID NO: 315511 - DNA, 25 bp, Mus musculus
gagcgcgagcttgggctcgcaccct

SEQ ID NO: 315512 - DNA, 25 bp, Mus musculus
cgtgaggacgagtgcttcagagcac

SEQ ID NO: 315513 - DNA, 25 bp, Mus musculus
cgagcagtatcttgcgtggctcctc

SEQ ID NO: 315514 - DNA, 25 bp, Mus musculus
ccgtgctagggagaggagtctctct

SEQ ID NO: 315515 - DNA, 25 bp, Mus musculus
gaggagtctctctctcctcgacgcg

SEQ ID NO: 315516 - DNA, 25 bp, Mus musculus
gcatccactgcgctgcgctgagttc

SEQ ID NO: 315517 - DNA, 25 bp, Mus musculus
ccgtccggagttcgggctgctcagt

SEQ ID NO: 315518 - DNA, 25 bp, Mus musculus
ggctgctcagttggctttcctcgcc

SEQ ID NO: 315519 - DNA, 25 bp, Mus musculus
ctctccagtctatcaggattctctg

SEQ ID NO: 315520 - DNA, 25 bp, Mus musculus
ttcagtacgcgtgcgcccggtcagc

SEQ ID NO: 315521 - DNA, 25 bp, Mus musculus
gactcggagacgagccggagacacc

SEQ ID NO: 315522 - DNA, 25 bp, Mus musculus
tgcttcagagcacgcgagcagtatc

SEQ ID NO: 315523 - DNA, 25 bp, Mus musculus
cgctgttccttctacccacggagga

SEQ ID NO: 315524 - DNA, 25 bp, Mus musculus
ggaatgccatgctgggctacttgtc

SEQ ID NO: 315525 - DNA, 25 bp, Mus musculus
ggacacgtgggcaacaagggcaccc

SEQ ID NO: 315526 - DNA, 25 bp, Mus musculus
tgcgcaactgatcgtgggacacgtg

SEQ ID NO: 315527 - DNA, 25 bp, Mus musculus
ggagcggcagactgcgcaactgatc

SEQ ID NO: 315528 - DNA, 25 bp, Mus musculus
cctggagctggtggtcatgttccct

SEQ ID NO: 315529 - DNA, 25 bp, Mus musculus
tacttgtcagcgctgtgccaggctt

SEQ ID NO: 315530 - DNA, 25 bp, Mus musculus
tttgtggcggccagtggaatgccat

SEQ ID NO: 315531 - DNA, 25 bp, Mus musculus
ctaccagacggattgggtttgtggc

SEQ ID NO: 315532 - DNA, 25 bp, Mus musculus
cgcggctctatggtggctaccagac

SEQ ID NO: 315533 - DNA, 25 bp, Mus musculus
ccgctgcctttggtgcttactccgg

SEQ ID NO: 315534 - DNA, 25 bp, Mus musculus
tggtgcctgtggacctcctcaaact

SEQ ID NO: 315535 - DNA, 25 bp, Mus musculus
gcgtccagggcttccaagagttcct

SEQ ID NO: 315536 - DNA, 25 bp, Mus musculus
agagttcctggagaagcgctgtccc

SEQ ID NO: 315537 - DNA, 25 bp, Mus musculus
cacgcaacgcagcagagggagcatc

SEQ ID NO: 315538 - DNA, 25 bp, Mus musculus
cctctgctgggagccgccagtgcag

SEQ ID NO: 315539 - DNA, 25 bp, Mus musculus
gactgcagtcatccgggccggaccg

SEQ ID NO: 315540 - DNA, 25 bp, Mus musculus
cccagaggactgcagtcatccgggc

SEQ ID NO: 315541 - DNA, 25 bp, Mus musculus
acgaccgggccaaggcaccgtgtga

SEQ ID NO: 315542 - DNA, 25 bp, Mus musculus
cgtacgctgagcaaaccgaagggcc

SEQ ID NO: 315543 - DNA, 25 bp, Mus musculus
cgagccggcccgtacgctgagcaaa

SEQ ID NO: 315544 - DNA, 25 bp, Mus musculus
taccttccgtgtgcagagcgccaca

SEQ ID NO: 315545 - DNA, 25 bp, Mus musculus
gtgaaccttaccttccgtgtgcaga

SEQ ID NO: 315546 - DNA, 25 bp, Mus musculus
ctccgactagggtgcgtgaacctta

SEQ ID NO: 315547 - DNA, 25 bp, Mus musculus
ctgttccaagctgggtggccgcact

SEQ ID NO: 315548 - DNA, 25 bp, Mus musculus
gatcacgagggtctgttccaagctg

SEQ ID NO: 315549 - DNA, 25 bp, Mus musculus
ggaagctttcgatcacgagggtctg

SEQ ID NO: 315550 - DNA, 25 bp, Mus musculus
aaggcaccgtgtgacctcgcgcgct

SEQ ID NO: 315551 - DNA, 25 bp, Mus musculus
ctccgcctatcagctcaaggtctta

SEQ ID NO: 315552 - DNA, 25 bp, Mus musculus
caaactaccgcctcgcctaagatgg

SEQ ID NO: 315553 - DNA, 25 bp, Mus musculus
ttacggaagacttacgctccaggcc

SEQ ID NO: 315554 - DNA, 25 bp, Mus musculus
acgcggcatgtggtttctaggagaa

SEQ ID NO: 315555 - DNA, 25 bp, Mus musculus
cgcctcaactgcctcgcgattttga

SEQ ID NO: 315556 - DNA, 25 bp, Mus musculus
ggggcagcgacaaagccacttgcca

SEQ ID NO: 315557 - DNA, 25 bp, Mus musculus
tcaaggtcttatgcgccattgggcc

SEQ ID NO: 315558 - DNA, 25 bp, Mus musculus
gacctcggtctctagaaggctctga

SEQ ID NO: 315559 - DNA, 25 bp, Mus musculus
ggcaagtcagcttcacagtttggca

SEQ ID NO: 315560 - DNA, 25 bp, Mus musculus
ttggcagcggcaatcccagcattca

SEQ ID NO: 315561 - DNA, 25 bp, Mus musculus
gaacgccgccactctcaatatggta

SEQ ID NO: 315562 - DNA, 25 bp, Mus musculus
tcccgtgcccgagcctcgtaagatg

SEQ ID NO: 315563 - DNA, 25 bp, Mus musculus
atcctaggctccctcaaggtgtcgc

SEQ ID NO: 315564 - DNA, 25 bp, Mus musculus
ggccacctagacgaggcgcaacatc

SEQ ID NO: 315565 - DNA, 25 bp, Mus musculus
gctcagtttttcctggtccggtgga

SEQ ID NO: 315566 - DNA, 25 bp, Mus musculus
tgccggtaaatccttcctgagctga

SEQ ID NO: 315567 - DNA, 25 bp, Mus musculus
gacgcttctcaggtaccagacgtta

SEQ ID NO: 315568 - DNA, 25 bp, Mus musculus
ggctgcctgtcttgctcttacacgg

SEQ ID NO: 315569 - DNA, 25 bp, Mus musculus
cctgagctgaagaccatcctgtttc

SEQ ID NO: 315570 - DNA, 25 bp, Mus musculus
acctcgtggtaagcgagatccctaa

SEQ ID NO: 315571 - DNA, 25 bp, Mus musculus
tcgcgatagttcctacggcgcatgc

SEQ ID NO: 315572 - DNA, 25 bp, Mus musculus
cggtctcctgcggtgaattacgaag

SEQ ID NO: 315573 - DNA, 25 bp, Mus musculus
catcgcgaggtttggtagcaagctc

SEQ ID NO: 315574 - DNA, 25 bp, Mus musculus
ccgtgaggttgtgcgtcatttgctt

SEQ ID NO: 315575 - DNA, 25 bp, Mus musculus
atccctaaaggacgagagcttcctc

SEQ ID NO: 315576 - DNA, 25 bp, Mus musculus
tttttaggagcgtgcacctggtctc

SEQ ID NO: 315577 - DNA, 25 bp, Mus musculus
cgcgagatctcatgtttcctaaagg

SEQ ID NO: 315578 - DNA, 25 bp, Mus musculus
ctcggcgaggctgaacgtaatatcg

SEQ ID NO: 315579 - DNA, 25 bp, Mus musculus
cccttttggcatacactgaactcga

SEQ ID NO: 315580 - DNA, 25 bp, Mus musculus
attaaaaccggctgtggccctgcgc

SEQ ID NO: 315581 - DNA, 25 bp, Mus musculus
ccctgcttgtctgcaaagtagtaca

SEQ ID NO: 315582 - DNA, 25 bp, Mus musculus
ccgagacattgtgaaccctgaaatg

SEQ ID NO: 315583 - DNA, 25 bp, Mus musculus
ggggcttggatctgaacttgctttc

SEQ ID NO: 315584 - DNA, 25 bp, Mus musculus
cgttcccgaaatttgctgccagttg

SEQ ID NO: 315585 - DNA, 25 bp, Mus musculus
ttggcggccacttcaacagttgctg

SEQ ID NO: 315586 - DNA, 25 bp, Mus musculus
ggacccaatggctctggtgagatta

SEQ ID NO: 315587 - DNA, 25 bp, Mus musculus
cgccgctgtcatgggtttcctgaaa

SEQ ID NO: 315588 - DNA, 25 bp, Mus musculus
aggcttactgtacacccggcttgca

SEQ ID NO: 315589 - DNA, 25 bp, Mus musculus
cttggacttattatcgcgaggctta

SEQ ID NO: 315590 - DNA, 25 bp, Mus musculus
tatttcaggcggaagtgaccatttc

SEQ ID NO: 315591 - DNA, 25 bp, Mus musculus
tccagccgggcaacaattcaacaaa

SEQ ID NO: 315592 - DNA, 25 bp, Mus musculus
cgagtctcttcccaactgtcagttg

SEQ ID NO: 315593 - DNA, 25 bp, Mus musculus
gcacgggatagtcctggccgcgaaa

SEQ ID NO: 315594 - DNA, 25 bp, Mus musculus
cctgctggagctgaacaacatcatc

SEQ ID NO: 315595 - DNA, 25 bp, Mus musculus
catcatcgagagtcagcagcagctg

SEQ ID NO: 315596 - DNA, 25 bp, Mus musculus
ttcaggacactaccggttacacagc

SEQ ID NO: 315597 - DNA, 25 bp, Mus musculus
ggcgcatccagaagctccagtcctg

SEQ ID NO: 315598 - DNA, 25 bp, Mus musculus
cagttgagtcgtggcgcatccagaa

SEQ ID NO: 315599 - DNA, 25 bp, Mus musculus
cagcagctgttggagacccagcggc

SEQ ID NO: 315600 - DNA, 25 bp, Mus musculus
tacacagcccgcgagcgcgacgtgg

SEQ ID NO: 315601 - DNA, 25 bp, Mus musculus
ttggaccagctcacccaggagaacc

SEQ ID NO: 315602 - DNA, 25 bp, Mus musculus
atcgggataaggagcgagaagcctc

SEQ ID NO: 315603 - DNA, 25 bp, Mus musculus
aaccgggaagctatctatcgggata

SEQ ID NO: 315604 - DNA, 25 bp, Mus musculus
ggatggcgcttaccagaaccgggaa

SEQ ID NO: 315605 - DNA, 25 bp, Mus musculus
accagaacctgcgtgagacccagtt

SEQ ID NO: 315606 - DNA, 25 bp, Mus musculus
gccgcgaaagccagtaccagaacct

SEQ ID NO: 315607 - DNA, 25 bp, Mus musculus
atccgggtagccagtggtgaagtcc

SEQ ID NO: 315608 - DNA, 25 bp, Mus musculus
gagctggggtccgacgatttcctac

SEQ ID NO: 315609 - DNA, 25 bp, Mus musculus
tggccgtcctgcttagggcctagac

SEQ ID NO: 315610 - DNA, 25 bp, Mus musculus
tagggcctagactccgagaagtacc

SEQ ID NO: 315611 - DNA, 25 bp, Mus musculus
aagtacctcggtttcagacagcggc

SEQ ID NO: 315612 - DNA, 25 bp, Mus musculus
ccatgcgtccttaagggcgacctga

SEQ ID NO: 315613 - DNA, 25 bp, Mus musculus
gcccaccatggagctggggtccgac

SEQ ID NO: 315614 - DNA, 25 bp, Mus musculus
ccggagtgtccggtgttcgagccta

SEQ ID NO: 315615 - DNA, 25 bp, Mus musculus
ttcgagcctagctgggccgagttcc

SEQ ID NO: 315616 - DNA, 25 bp, Mus musculus
ccgagttccgagaccctcttggcta

SEQ ID NO: 315617 - DNA, 25 bp, Mus musculus
cctcttggctacatcgcgaaaatca

SEQ ID NO: 315618 - DNA, 25 bp, Mus musculus
gaaaatcagacccatcgccgagaag

SEQ ID NO: 315619 - DNA, 25 bp, Mus musculus
atcgccgagaagtccggcatttgca

SEQ ID NO: 315620 - DNA, 25 bp, Mus musculus
gtccggcatttgcaagatccgccca

SEQ ID NO: 315621 - DNA, 25 bp, Mus musculus
tcgctgcagacggttaccagctcgc

SEQ ID NO: 315622 - DNA, 25 bp, Mus musculus
acgagctggcctcgctaggcggtac

SEQ ID NO: 315623 - DNA, 25 bp, Mus musculus
cgctaggcggtacagggccaagccc

SEQ ID NO: 315624 - DNA, 25 bp, Mus musculus
taggtgcttcgcgtctcagccaaag

SEQ ID NO: 315625 - DNA, 25 bp, Mus musculus
gcgtctcagccaaaggcggccagct

SEQ ID NO: 315626 - DNA, 25 bp, Mus musculus
gggcaattacactcctcgctgcaga

SEQ ID NO: 315627 - DNA, 25 bp, Mus musculus
cgcacaactgcttgctccatcttag

SEQ ID NO: 315628 - DNA, 25 bp, Mus musculus
tgctccatcttagcgagggcgccgc

SEQ ID NO: 315629 - DNA, 25 bp, Mus musculus
ctctggggacttccctaggcttctg

SEQ ID NO: 315630 - DNA, 25 bp, Mus musculus
ctaggcttctggctctccgtgagcc

SEQ ID NO: 315631 - DNA, 25 bp, Mus musculus
caccaccagcctggggagcgatttt

SEQ ID NO: 315632 - DNA, 25 bp, Mus musculus
cgattttgccgatggtgaaagggcc

SEQ ID NO: 315633 - DNA, 25 bp, Mus musculus
gccgatggtgaaagggccgccaaac

SEQ ID NO: 315634 - DNA, 25 bp, Mus musculus
gcccgcggtcacaggggcaattaca

SEQ ID NO: 315635 - DNA, 25 bp, Mus musculus
ggatggcccgcattgctttgacgca

SEQ ID NO: 315636 - DNA, 25 bp, Mus musculus
tttgacgcaatgcttctgcagtctc

SEQ ID NO: 315637 - DNA, 25 bp, Mus musculus
gcttctgcagtctcgcggagctcca

SEQ ID NO: 315638 - DNA, 25 bp, Mus musculus
tccactccgccagtgaaaacgtttg

SEQ ID NO: 315639 - DNA, 25 bp, Mus musculus
tccgccagtgaaaacgtttggtaca

SEQ ID NO: 315640 - DNA, 25 bp, Mus musculus
tttggtacaaccatggtgctggggc

SEQ ID NO: 315641 - DNA, 25 bp, Mus musculus
tgtccagtcattggctaggatggcc

SEQ ID NO: 315642 - DNA, 25 bp, Mus musculus
agctgggtttcttcggtctcggagc

SEQ ID NO: 315643 - DNA, 25 bp, Mus musculus
cttcctagctgggtttcttcggtct

SEQ ID NO: 315644 - DNA, 25 bp, Mus musculus
ggatgctcttttcttcctagctggg

SEQ ID NO: 315645 - DNA, 25 bp, Mus musculus
ggcgtgggatgctcttttcttccta

SEQ ID NO: 315646 - DNA, 25 bp, Mus musculus
cataggaaaggcgtgggatgctctt

SEQ ID NO: 315647 - DNA, 25 bp, Mus musculus
caggcttagcgacggcgcacccagg

SEQ ID NO: 315648 - DNA, 25 bp, Mus musculus
gtcattggctaggatggcccgcatt

SEQ ID NO: 315649 - DNA, 25 bp, Mus musculus
tgctcaccacctcgctctgacgtcc

SEQ ID NO: 315650 - DNA, 25 bp, Mus musculus
tcagacaaggccgtagccaccagtc

SEQ ID NO: 315651 - DNA, 25 bp, Mus musculus
cactccctggcatggcgtctgctct

SEQ ID NO: 315652 - DNA, 25 bp, Mus musculus
ctcccacagcgcctatcgcccaggc

SEQ ID NO: 315653 - DNA, 25 bp, Mus musculus
cgctgacggggttccgagctgctca

SEQ ID NO: 315654 - DNA, 25 bp, Mus musculus
gagctggcggtagcgttccctcagc

SEQ ID NO: 315655 - DNA, 25 bp, Mus musculus
agtcacacttgaagcggagccgcca

SEQ ID NO: 315656 - DNA, 25 bp, Mus musculus
ctcgtccgggcggtccatggtgacc

SEQ ID NO: 315657 - DNA, 25 bp, Mus musculus
cggtccatggtgaccgcactcacaa

SEQ ID NO: 315658 - DNA, 25 bp, Mus musculus
ggtgaccgcactcacaacactggct

SEQ ID NO: 315659 - DNA, 25 bp, Mus musculus
caacactggctctgcggctctcaga

SEQ ID NO: 315660 - DNA, 25 bp, Mus musculus
tctgcggctctcagacaaggccgta

SEQ ID NO: 315661 - DNA, 25 bp, Mus musculus
ggccgtagccaccagtcacacttga

SEQ ID NO: 315662 - DNA, 25 bp, Mus musculus
agccaccagtcacacttgaagcgga

SEQ ID NO: 315663 - DNA, 25 bp, Mus musculus
cggggttttcgcactgactgcgcta

SEQ ID NO: 315664 - DNA, 25 bp, Mus musculus
actatctcaggactgtcacggggca

SEQ ID NO: 315665 - DNA, 25 bp, Mus musculus
ccttggtgatgaccagaggctcgcc

SEQ ID NO: 315666 - DNA, 25 bp, Mus musculus
catgcactccgggaagcacgaaccg

SEQ ID NO: 315667 - DNA, 25 bp, Mus musculus
ttccaactgggagcggaatcgaccc

SEQ ID NO: 315668 - DNA, 25 bp, Mus musculus
agccttctgggtccggactatctca

SEQ ID NO: 315669 - DNA, 25 bp, Mus musculus
gcgcgctcctcttcagcatgggcag

SEQ ID NO: 315670 - DNA, 25 bp, Mus musculus
cggccaccgctgaacttgctttgca

SEQ ID NO: 315671 - DNA, 25 bp, Mus musculus
actgcgctagaggtccaaaggggtt

SEQ ID NO: 315672 - DNA, 25 bp, Mus musculus
caaaggggtttctctagtgcgctca

SEQ ID NO: 315673 - DNA, 25 bp, Mus musculus
cgaaacctgcccgaactggacctgg

SEQ ID NO: 315674 - DNA, 25 bp, Mus musculus
gccaccggggaaagcccttgcaaca

SEQ ID NO: 315675 - DNA, 25 bp, Mus musculus
tggcggaagtgtccaaaccggacta

SEQ ID NO: 315676 - DNA, 25 bp, Mus musculus
tttgcaacttggaaagcgctacgcg

SEQ ID NO: 315677 - DNA, 25 bp, Mus musculus
ctacgtgggacgcagccacacagct

SEQ ID NO: 315678 - DNA, 25 bp, Mus musculus
gaattttctgctgccctacgtggga

SEQ ID NO: 315679 - DNA, 25 bp, Mus musculus
ccacacagctggtgctaagcttcca

SEQ ID NO: 315680 - DNA, 25 bp, Mus musculus
tgctaagcttccaaccgcgggtgtt

SEQ ID NO: 315681 - DNA, 25 bp, Mus musculus
cgcctgggaattttctgctgcccta

SEQ ID NO: 315682 - DNA, 25 bp, Mus musculus
caaccgcgggtgttccatgccctgt

SEQ ID NO: 315683 - DNA, 25 bp, Mus musculus
tccctgagcaagacgaatggcctcc

SEQ ID NO: 315684 - DNA, 25 bp, Mus musculus
gaccggtccctgagcaagacgaatg

SEQ ID NO: 315685 - DNA, 25 bp, Mus musculus
cgcaaaccagagaccggtccctgag

SEQ ID NO: 315686 - DNA, 25 bp, Mus musculus
atcagggcgtcgatctgttggtcac

SEQ ID NO: 315687 - DNA, 25 bp, Mus musculus
aagcggcactctccgcctggtgctt

SEQ ID NO: 315688 - DNA, 25 bp, Mus musculus
tccttcagctcctatcagggcgtcg

SEQ ID NO: 315689 - DNA, 25 bp, Mus musculus
tcgatctgttggtcacagggcgcct

SEQ ID NO: 315690 - DNA, 25 bp, Mus musculus
cgggtgttccatgccctgtgcctgg

SEQ ID NO: 315691 - DNA, 25 bp, Mus musculus
ctttctcgccacgtgcaggcgtgct

SEQ ID NO: 315692 - DNA, 25 bp, Mus musculus
tgggcgaccaccgatgacctcacag

SEQ ID NO: 315693 - DNA, 25 bp, Mus musculus
tcaaactcacagagcgcggtcagcg

SEQ ID NO: 315694 - DNA, 25 bp, Mus musculus
ctcgtcacggaaggcgaatatcctc

SEQ ID NO: 315695 - DNA, 25 bp, Mus musculus
tttacatcctgtgagagcaaggtcg

SEQ ID NO: 315696 - DNA, 25 bp, Mus musculus
tcccagcatgcgctgtgcatttaca

SEQ ID NO: 315697 - DNA, 25 bp, Mus musculus
aggaagatccaccaaagccgccact

SEQ ID NO: 315698 - DNA, 25 bp, Mus musculus
gcatcactactcgtctcccgggagg

SEQ ID NO: 315699 - DNA, 25 bp, Mus musculus
ggcagggtaactctgtccgcctctt

SEQ ID NO: 315700 - DNA, 25 bp, Mus musculus
tccaggtttcggagctgagccaata

SEQ ID NO: 315701 - DNA, 25 bp, Mus musculus
actcaccgatgaggaccgcgttgtc

SEQ ID NO: 315702 - DNA, 25 bp, Mus musculus
tcaagtttgtggaagaaaccaacgc

SEQ ID NO: 315703 - DNA, 25 bp, Mus musculus
cagagccagggatctagagcaagga

SEQ ID NO: 315704 - DNA, 25 bp, Mus musculus
ccgcctcctgccttgaggaaaggaa

SEQ ID NO: 315705 - DNA, 25 bp, Mus musculus
tcatatccgggtggccgggcctctt

SEQ ID NO: 315706 - DNA, 25 bp, Mus musculus
cggctactagagaggagaatttgaa

SEQ ID NO: 315707 - DNA, 25 bp, Mus musculus
ctcggctactagagaggagaatttg

SEQ ID NO: 315708 - DNA, 25 bp, Mus musculus
catcttgctcggctactagagagga

SEQ ID NO: 315709 - DNA, 25 bp, Mus musculus
gggcatcttgctcggctactagaga

SEQ ID NO: 315710 - DNA, 25 bp, Mus musculus
tgggcatcttgctcggctactagag

SEQ ID NO: 315711 - DNA, 25 bp, Mus musculus
tgcttcttgatgaccgcaggggccg

SEQ ID NO: 315712 - DNA, 25 bp, Mus musculus
atgcttcttgatgaccgcaggggcc

SEQ ID NO: 315713 - DNA, 25 bp, Mus musculus
ctcatgcttcttgatgaccgcaggg

SEQ ID NO: 315714 - DNA, 25 bp, Mus musculus
ggcctcatgcttcttgatgaccgca

SEQ ID NO: 315715 - DNA, 25 bp, Mus musculus
cttggcctcatgcttcttgatgacc

SEQ ID NO: 315716 - DNA, 25 bp, Mus musculus
ccgggcctcttcttgaacagagggt

SEQ ID NO: 315717 - DNA, 25 bp, Mus musculus
tcttgctcggctactagagaggaga

SEQ ID NO: 315718 - DNA, 25 bp, Mus musculus
tggccgggcctcttcttgaacagag

SEQ ID NO: 315719 - DNA, 25 bp, Mus musculus
aatcctcctctgagcaatgaagacc

SEQ ID NO: 315720 - DNA, 25 bp, Mus musculus
cgtgcttgccactgaactttttctc

SEQ ID NO: 315721 - DNA, 25 bp, Mus musculus
tgccactgaactttttctccaattc

SEQ ID NO: 315722 - DNA, 25 bp, Mus musculus
tttctccaattcacgaactagccgg

SEQ ID NO: 315723 - DNA, 25 bp, Mus musculus
aattcacgaactagccggacttgga

SEQ ID NO: 315724 - DNA, 25 bp, Mus musculus
gccggacttggattttctggaaaga

SEQ ID NO: 315725 - DNA, 25 bp, Mus musculus
ctggaaagatttaagctgaggaact

SEQ ID NO: 315726 - DNA, 25 bp, Mus musculus
ctgaggaactggtacaaaaattatg

SEQ ID NO: 315727 - DNA, 25 bp, Mus musculus
ttatgatagctttccgaccaccacc

SEQ ID NO: 315728 - DNA, 25 bp, Mus musculus
ccaccaacttcgatttccttggctg

SEQ ID NO: 315729 - DNA, 25 bp, Mus musculus
acttcgatttccttggctgcggtga

SEQ ID NO: 315730 - DNA, 25 bp, Mus musculus
ctcgagcagcgcctgagagatgcca

SEQ ID NO: 315731 - DNA, 25 bp, Mus musculus
tgaagaccacgtgcttgccactgaa

SEQ ID NO: 315732 - DNA, 25 bp, Mus musculus
tcctctgagcaatgaagaccacgtg

SEQ ID NO: 315733 - DNA, 25 bp, Mus musculus
tctatcccggctgcttgtcacacca

SEQ ID NO: 315734 - DNA, 25 bp, Mus musculus
ccacgtcggagaacttaacaagtag

SEQ ID NO: 315735 - DNA, 25 bp, Mus musculus
gcccaagcccacgtcggagaactta

SEQ ID NO: 315736 - DNA, 25 bp, Mus musculus
acacagggagcccaggagatgaagc

SEQ ID NO: 315737 - DNA, 25 bp, Mus musculus
agtgcatcgagatgcggggtacaca

SEQ ID NO: 315738 - DNA, 25 bp, Mus musculus
aggctaacggcaccgcggccatgac

SEQ ID NO: 315739 - DNA, 25 bp, Mus musculus
cacgttcgagaagcgtcccggtcct

SEQ ID NO: 315740 - DNA, 25 bp, Mus musculus
tggccgtccacacgagttcctgtct

SEQ ID NO: 315741 - DNA, 25 bp, Mus musculus
ggcagctatgagaaggtgctccctt

SEQ ID NO: 315742 - DNA, 25 bp, Mus musculus
agccgatggcccacgttcgagaagc

SEQ ID NO: 315743 - DNA, 25 bp, Mus musculus
gacgcgtttcttcccaggcttggga

SEQ ID NO: 315744 - DNA, 25 bp, Mus musculus
agctcattcccagacgcgtttcttc

SEQ ID NO: 315745 - DNA, 25 bp, Mus musculus
cccatagtcatagctcattcccaga

SEQ ID NO: 315746 - DNA, 25 bp, Mus musculus
ctcccgctctgtcgcctgttggagt

SEQ ID NO: 315747 - DNA, 25 bp, Mus musculus
gcgcgcaagaaaccagagcagcatt

SEQ ID NO: 315748 - DNA, 25 bp, Mus musculus
ctggctcttgcgattgttgcgattc

SEQ ID NO: 315749 - DNA, 25 bp, Mus musculus
ttgcgattctcttcagctgcctttg

SEQ ID NO: 315750 - DNA, 25 bp, Mus musculus
aggcatggctcctgcaaagcgatga

SEQ ID NO: 315751 - DNA, 25 bp, Mus musculus
cctgcagcacttggagaaggctatt

SEQ ID NO: 315752 - DNA, 25 bp, Mus musculus
gcagcgtcggagaaaagtggctatc

SEQ ID NO: 315753 - DNA, 25 bp, Mus musculus
agtggctatcttactcagggacggc

SEQ ID NO: 315754 - DNA, 25 bp, Mus musculus
ccagcggagcctttgtggcaaggaa

SEQ ID NO: 315755 - DNA, 25 bp, Mus musculus
aagtgggactctcccgcacaggaac

SEQ ID NO: 315756 - DNA, 25 bp, Mus musculus
agccctttcccaggcaagctgactt

SEQ ID NO: 315757 - DNA, 25 bp, Mus musculus
agaagccgccatcggggtctctgaa

SEQ ID NO: 315758 - DNA, 25 bp, Mus musculus
ctcaggtattcttcgggtgtgctcg

SEQ ID NO: 315759 - DNA, 25 bp, Mus musculus
caggaacttccgctagccgaaagga

SEQ ID NO: 315760 - DNA, 25 bp, Mus musculus
tggcaaggaaccagtcgctttcagc

SEQ ID NO: 315761 - DNA, 25 bp, Mus musculus
atcctcaggcggaccgtgactggca

SEQ ID NO: 315762 - DNA, 25 bp, Mus musculus
gccaatggcgcggaaatgagagccc

SEQ ID NO: 315763 - DNA, 25 bp, Mus musculus
caccaggcagtgaccgctttgcttc

SEQ ID NO: 315764 - DNA, 25 bp, Mus musculus
gggcgcggaagtaagagcatcctca

SEQ ID NO: 315765 - DNA, 25 bp, Mus musculus
tgaccgctttgcttctgcagctccg

SEQ ID NO: 315766 - DNA, 25 bp, Mus musculus
cgcaggccgccctaagggccaatgg

SEQ ID NO: 315767 - DNA, 25 bp, Mus musculus
gggtggcactctggctttcctaaag

SEQ ID NO: 315768 - DNA, 25 bp, Mus musculus
ggctttcctaaagcagtctctatgg

SEQ ID NO: 315769 - DNA, 25 bp, Mus musculus
gcagtctctatggtattcttccaag

SEQ ID NO: 315770 - DNA, 25 bp, Mus musculus
cccaaaagggtagcggcacgtgaca

SEQ ID NO: 315771 - DNA, 25 bp, Mus musculus
gactacggcaggttcccacgtgatc

SEQ ID NO: 315772 - DNA, 25 bp, Mus musculus
ccacgtgatcctggcctgcagtagc

SEQ ID NO: 315773 - DNA, 25 bp, Mus musculus
cggtgaggttcttgcgctcctgaag

SEQ ID NO: 315774 - DNA, 25 bp, Mus musculus
cgcgtccatcagtgtctaggtgccc

SEQ ID NO: 315775 - DNA, 25 bp, Mus musculus
cggctaactcccttatacccttctg

SEQ ID NO: 315776 - DNA, 25 bp, Mus musculus
gtccctttcattttgtccagccagc

SEQ ID NO: 315777 - DNA, 25 bp, Mus musculus
agtaagtccctttcattttgtccag

SEQ ID NO: 315778 - DNA, 25 bp, Mus musculus
ttcggaggcgcagaaccccaaagta

SEQ ID NO: 315779 - DNA, 25 bp, Mus musculus
aggatgccttcggaggcgcagaacc

SEQ ID NO: 315780 - DNA, 25 bp, Mus musculus
gctgcaaggaaaggatgccttcgga

SEQ ID NO: 315781 - DNA, 25 bp, Mus musculus
agcgaagaccccgtgcgtgcgctgc

SEQ ID NO: 315782 - DNA, 25 bp, Mus musculus
ctaagtcttcctgggctcggttcgt

SEQ ID NO: 315783 - DNA, 25 bp, Mus musculus
tagtgtaccggcatctccctaagtc

SEQ ID NO: 315784 - DNA, 25 bp, Mus musculus
cagtaatatctagtgtaccggcatc

SEQ ID NO: 315785 - DNA, 25 bp, Mus musculus
tgtccagccagcacctcgctttcgg

SEQ ID NO: 315786 - DNA, 25 bp, Mus musculus
tatacccttctgtctcgccttaaga

SEQ ID NO: 315787 - DNA, 25 bp, Mus musculus
ttttagatcttaccaccactcccgc

SEQ ID NO: 315788 - DNA, 25 bp, Mus musculus
gtctcgccttaagatcagtaatatc

SEQ ID NO: 315789 - DNA, 25 bp, Mus musculus
tacgccgagccgagtgcgcagccga

SEQ ID NO: 315790 - DNA, 25 bp, Mus musculus
agtgcgcgcgggcagatcacaaggc

SEQ ID NO: 315791 - DNA, 25 bp, Mus musculus
gctcggccgcgagacgctcgctggg

SEQ ID NO: 315792 - DNA, 25 bp, Mus musculus
agcggagacggcctgcaggacctgc

SEQ ID NO: 315793 - DNA, 25 bp, Mus musculus
ctgcggcacctccttccctcgcgcc

SEQ ID NO: 315794 - DNA, 25 bp, Mus musculus
ccctcgcgccctcttcgctcgccag

SEQ ID NO: 315795 - DNA, 25 bp, Mus musculus
agccctcagccgaggcctacgccga

SEQ ID NO: 315796 - DNA, 25 bp, Mus musculus
ccagtccgctgctgcggcacctcct

SEQ ID NO: 315797 - DNA, 25 bp, Mus musculus
aggtactgtgatccgcgctgcccgc

SEQ ID NO: 315798 - DNA, 25 bp, Mus musculus
actctgaggtactgtgatccgcgct

SEQ ID NO: 315799 - DNA, 25 bp, Mus musculus
tcaactctgaggtactgtgatccgc

SEQ ID NO: 315800 - DNA, 25 bp, Mus musculus
ccttcaactctgaggtactgtgatc

SEQ ID NO: 315801 - DNA, 25 bp, Mus musculus
ggaggagccgcagccttcaactctg

SEQ ID NO: 315802 - DNA, 25 bp, Mus musculus
gccttccctgtgagcctgcgtcacc

SEQ ID NO: 315803 - DNA, 25 bp, Mus musculus
tgccgatgctgaccgagtcttccca

SEQ ID NO: 315804 - DNA, 25 bp, Mus musculus
cacgaacacgtaggtccggtgcttg

SEQ ID NO: 315805 - DNA, 25 bp, Mus musculus
cgccgcctgattggaggcgccgctt

SEQ ID NO: 315806 - DNA, 25 bp, Mus musculus
gcttgcggtcctggttctgctcgaa

SEQ ID NO: 315807 - DNA, 25 bp, Mus musculus
tctgctcgaagacgcccagcaagcg

SEQ ID NO: 315808 - DNA, 25 bp, Mus musculus
ctggttcggcttgcacttcatcctc

SEQ ID NO: 315809 - DNA, 25 bp, Mus musculus
tggcatcttcgatcttgaaccactc

SEQ ID NO: 315810 - DNA, 25 bp, Mus musculus
ctctgaggtcgcttgcagctgccta

SEQ ID NO: 315811 - DNA, 25 bp, Mus musculus
actgcaggaccttgatggcatcttc

SEQ ID NO: 315812 - DNA, 25 bp, Mus musculus
agtttctccaggtactcggcgtgca

SEQ ID NO: 315813 - DNA, 25 bp, Mus musculus
gggagccgcccagcttcagtttctc

SEQ ID NO: 315814 - DNA, 25 bp, Mus musculus
ttcccattagtaggggagccgccca

SEQ ID NO: 315815 - DNA, 25 bp, Mus musculus
tgccgccgcgcagccgaggagcaaa

SEQ ID NO: 315816 - DNA, 25 bp, Mus musculus
agctcggtgacggtgagcacgaaca

SEQ ID NO: 315817 - DNA, 25 bp, Mus musculus
cgctcagccggctttggaagcttcc

SEQ ID NO: 315818 - DNA, 25 bp, Mus musculus
gctcagccgagctcttcaagatacc

SEQ ID NO: 315819 - DNA, 25 bp, Mus musculus
tcccagagtgccaggaagccttgga

SEQ ID NO: 315820 - DNA, 25 bp, Mus musculus
cacgtgtcttcagcagagcaggcga

SEQ ID NO: 315821 - DNA, 25 bp, Mus musculus
tgccgagaagacgaggacgaaaacc

SEQ ID NO: 315822 - DNA, 25 bp, Mus musculus
acggcagttgcgaaacaggctcttg

SEQ ID NO: 315823 - DNA, 25 bp, Mus musculus
tggctggaacaatgcgcgctttgtg

SEQ ID NO: 315824 - DNA, 25 bp, Mus musculus
taaatgtcaacagattccgcgcggc

SEQ ID NO: 315825 - DNA, 25 bp, Mus musculus
aatgcacttgtgtcctgtgggtcac

SEQ ID NO: 315826 - DNA, 25 bp, Mus musculus
gctcgggccgtatggcactttaatc

SEQ ID NO: 315827 - DNA, 25 bp, Mus musculus
ttattttccaggcagacggccctcc

SEQ ID NO: 315828 - DNA, 25 bp, Mus musculus
ccggactcctgcgaacaatagtaaa

SEQ ID NO: 315829 - DNA, 25 bp, Mus musculus
ccacggctaggcacaaatgcacttg

SEQ ID NO: 315830 - DNA, 25 bp, Mus musculus
tgtgcgcgctggttgttttctaccc

SEQ ID NO: 315831 - DNA, 25 bp, Mus musculus
tttcccgggagcgtcctcttctcag

SEQ ID NO: 315832 - DNA, 25 bp, Mus musculus
tcttctcagtcaggctggcaccatg

SEQ ID NO: 315833 - DNA, 25 bp, Mus musculus
tgacccggcgaacctcagtataaga

SEQ ID NO: 315834 - DNA, 25 bp, Mus musculus
cagaaaactggcaaacttacttcgg

SEQ ID NO: 315835 - DNA, 25 bp, Mus musculus
ctgcgcagctaagaagtggcaagac

SEQ ID NO: 315836 - DNA, 25 bp, Mus musculus
caagacggtgccttttaagtccgca

SEQ ID NO: 315837 - DNA, 25 bp, Mus musculus
agccggagagatcgcgaccagtaag

SEQ ID NO: 315838 - DNA, 25 bp, Mus musculus
ccagtaaggatgaaagcccgccgaa

SEQ ID NO: 315839 - DNA, 25 bp, Mus musculus
gggctctctcgtgacacccatggcg

SEQ ID NO: 315840 - DNA, 25 bp, Mus musculus
acccatggcgcaaacccggagggcg

SEQ ID NO: 315841 - DNA, 25 bp, Mus musculus
aggcgcgctgctgcctttctagcct

SEQ ID NO: 315842 - DNA, 25 bp, Mus musculus
ttctagcctcatgtcctctagcggc

SEQ ID NO: 315843 - DNA, 25 bp, Mus musculus
ctctagcggcgccttgcggatcctt

SEQ ID NO: 315844 - DNA, 25 bp, Mus musculus
taagtccgcagaagctcctccctgg

SEQ ID NO: 315845 - DNA, 25 bp, Mus musculus
tgtttggaggtgtcctcacgctcac

SEQ ID NO: 315846 - DNA, 25 bp, Mus musculus
ccatgaagcgggcagcgatacggta

SEQ ID NO: 315847 - DNA, 25 bp, Mus musculus
ttggttgtccacccgtgggtaggca

SEQ ID NO: 315848 - DNA, 25 bp, Mus musculus
cgccattctctacgcagaagtcccg

SEQ ID NO: 315849 - DNA, 25 bp, Mus musculus
ttcctgcagtgaggccctccctatc

SEQ ID NO: 315850 - DNA, 25 bp, Mus musculus
tatcccgggccctcttgtggcgtca

SEQ ID NO: 315851 - DNA, 25 bp, Mus musculus
ccctcttgtggcgtcacctagaagg

SEQ ID NO: 315852 - DNA, 25 bp, Mus musculus
cacctagaaggtgggaaccaagatt

SEQ ID NO: 315853 - DNA, 25 bp, Mus musculus
tgggaaccaagattcagtccggcgc

SEQ ID NO: 315854 - DNA, 25 bp, Mus musculus
ccaagattcagtccggcgcggttgc

SEQ ID NO: 315855 - DNA, 25 bp, Mus musculus
ttgccggtgtttggaggtgtcctca

SEQ ID NO: 315856 - DNA, 25 bp, Mus musculus
ctcacgctcttctgctaccggtttg

SEQ ID NO: 315857 - DNA, 25 bp, Mus musculus
cgctcttctgctaccggtttgtctc

SEQ ID NO: 315858 - DNA, 25 bp, Mus musculus
ctgctaccggtttgtctctacccgg

SEQ ID NO: 315859 - DNA, 25 bp, Mus musculus
tccgcctaccaacgcagagagaagg

SEQ ID NO: 315860 - DNA, 25 bp, Mus musculus
cggagcgttctgtagggaatccctc

SEQ ID NO: 315861 - DNA, 25 bp, Mus musculus
catcactcccgggatcgcttcggta

SEQ ID NO: 315862 - DNA, 25 bp, Mus musculus
cttccagccgctgagtgtagcttga

SEQ ID NO: 315863 - DNA, 25 bp, Mus musculus
gagccggtgttaccgccttcttcca

SEQ ID NO: 315864 - DNA, 25 bp, Mus musculus
agaggcaggtctcagtcgattcgga

SEQ ID NO: 315865 - DNA, 25 bp, Mus musculus
ttgacccacggctagccaatcagga

SEQ ID NO: 315866 - DNA, 25 bp, Mus musculus
aatcgcagtggctccttttgaccca

SEQ ID NO: 315867 - DNA, 25 bp, Mus musculus
gaaggaccagttccgtccgccaatc

SEQ ID NO: 315868 - DNA, 25 bp, Mus musculus
tgcgtactcggacagccaccaatcg

SEQ ID NO: 315869 - DNA, 25 bp, Mus musculus
ggcggactcaaagctggccttcagc

SEQ ID NO: 315870 - DNA, 25 bp, Mus musculus
gaggctctggtacgccatctttccc

SEQ ID NO: 315871 - DNA, 25 bp, Mus musculus
tgaagacgcagtcatagctagcctg

SEQ ID NO: 315872 - DNA, 25 bp, Mus musculus
cgccttccttttaccaatcgcagtg

SEQ ID NO: 315873 - DNA, 25 bp, Mus musculus
ggcgaagtaacggtcactaagagtg

SEQ ID NO: 315874 - DNA, 25 bp, Mus musculus
ctgtgatatacttggtacggtggcc

SEQ ID NO: 315875 - DNA, 25 bp, Mus musculus
aagagtgggtacttccggtctgtga

SEQ ID NO: 315876 - DNA, 25 bp, Mus musculus
tgggtacttccggtctgtgatatac

SEQ ID NO: 315877 - DNA, 25 bp, Mus musculus
cttccggtctgtgatatacttggta

SEQ ID NO: 315878 - DNA, 25 bp, Mus musculus
tccggtctgtgatatacttggtacg

SEQ ID NO: 315879 - DNA, 25 bp, Mus musculus
cggtcactaagagtgggtacttccg

SEQ ID NO: 315880 - DNA, 25 bp, Mus musculus
gtgatatacttggtacggtggcctg

SEQ ID NO: 315881 - DNA, 25 bp, Mus musculus
gagatgaggagactcgtcttcctta

SEQ ID NO: 315882 - DNA, 25 bp, Mus musculus
gagtgggtacttccggtctgtgata

SEQ ID NO: 315883 - DNA, 25 bp, Mus musculus
cactaagagtgggtacttccggtct

SEQ ID NO: 315884 - DNA, 25 bp, Mus musculus
aatggaggcgaagtaacggtcacta

SEQ ID NO: 315885 - DNA, 25 bp, Mus musculus
actaagagtgggtacttccggtctg

SEQ ID NO: 315886 - DNA, 25 bp, Mus musculus
aggagactcgtcttccttagcggca

SEQ ID NO: 315887 - DNA, 25 bp, Mus musculus
aacaccagctttcgggtccagcgac

SEQ ID NO: 315888 - DNA, 25 bp, Mus musculus
caccagcgtagaagtggcactcatt

SEQ ID NO: 315889 - DNA, 25 bp, Mus musculus
cgcgggtccggaaccgttcatcact

SEQ ID NO: 315890 - DNA, 25 bp, Mus musculus
ctccaagccttgcagagattcggtc

SEQ ID NO: 315891 - DNA, 25 bp, Mus musculus
ccttgcagagattcggtccgcaaca

SEQ ID NO: 315892 - DNA, 25 bp, Mus musculus
gcggcaggagcaacaccagctttcg

SEQ ID NO: 315893 - DNA, 25 bp, Mus musculus
gccaggcagccagctaaaacggcgc

SEQ ID NO: 315894 - DNA, 25 bp, Mus musculus
cgtggtcccgtccagcagcttggac

SEQ ID NO: 315895 - DNA, 25 bp, Mus musculus
gcctccatgaccaagcaagcgcgaa

SEQ ID NO: 315896 - DNA, 25 bp, Mus musculus
gcgcgaaaacacgtccctctgctaa

SEQ ID NO: 315897 - DNA, 25 bp, Mus musculus
cgtccctctgctaaagcacagagtc

SEQ ID NO: 315898 - DNA, 25 bp, Mus musculus
ggcactcattttcgcgggtccggaa

SEQ ID NO: 315899 - DNA, 25 bp, Mus musculus
cagccagctaaaacggcgcgctgga

SEQ ID NO: 315900 - DNA, 25 bp, Mus musculus
ttcggtccgcaacaggaacagcagc

SEQ ID NO: 315901 - DNA, 25 bp, Mus musculus
ttctggtaggaggtgacaatgaccc

SEQ ID NO: 315902 - DNA, 25 bp, Mus musculus
atcaggtccgtgtgatgttggtcta

SEQ ID NO: 315903 - DNA, 25 bp, Mus musculus
cgccctggtctcacctttaagatca

SEQ ID NO: 315904 - DNA, 25 bp, Mus musculus
gcgcggaaccagcacagccagagca

SEQ ID NO: 315905 - DNA, 25 bp, Mus musculus
ctgttgactaggttgcgctcgatct

SEQ ID NO: 315906 - DNA, 25 bp, Mus musculus
gcccgggacactagaggtggcttct

SEQ ID NO: 315907 - DNA, 25 bp, Mus musculus
ctctgagactctaggttgctgccta

SEQ ID NO: 315908 - DNA, 25 bp, Mus musculus
tgaacgtttcctgcctccgagactc

SEQ ID NO: 315909 - DNA, 25 bp, Mus musculus
ctctcttcgacctggtagcggctga

SEQ ID NO: 315910 - DNA, 25 bp, Mus musculus
caccggcgccgaagcaaagaagacc

SEQ ID NO: 315911 - DNA, 25 bp, Mus musculus
agccgggagaaacacgtcctcaagc

SEQ ID NO: 315912 - DNA, 25 bp, Mus musculus
tgccgcagcatcctagagcagagcg

SEQ ID NO: 315913 - DNA, 25 bp, Mus musculus
aggcaagaccctgagctctcctgga

SEQ ID NO: 315914 - DNA, 25 bp, Mus musculus
agcaggtgctccacgctctcttcga

SEQ ID NO: 315915 - DNA, 25 bp, Mus musculus
gcacaggtacaatttagcgcgttta

SEQ ID NO: 315916 - DNA, 25 bp, Mus musculus
cggggacccttatatcagaacaaga

SEQ ID NO: 315917 - DNA, 25 bp, Mus musculus
gctggcttcggcctgggacagacct

SEQ ID NO: 315918 - DNA, 25 bp, Mus musculus
cctcgggagatttcccgagaaggcg

SEQ ID NO: 315919 - DNA, 25 bp, Mus musculus
ggaacggccacgcacaggtacaatt

SEQ ID NO: 315920 - DNA, 25 bp, Mus musculus
tgcgagtacggggacccttatatca

SEQ ID NO: 315921 - DNA, 25 bp, Mus musculus
tcagaacaagagatgtactggtctc

SEQ ID NO: 315922 - DNA, 25 bp, Mus musculus
caagagatgtactggtctctgagta

SEQ ID NO: 315923 - DNA, 25 bp, Mus musculus
tctctgagtatgtcgagccgcaggg

SEQ ID NO: 315924 - DNA, 25 bp, Mus musculus
ctctgaaggcttggcaaagttgggc

SEQ ID NO: 315925 - DNA, 25 bp, Mus musculus
gtgtgtgcgccagccatagctagca

SEQ ID NO: 315926 - DNA, 25 bp, Mus musculus
agccatagctagcaggcagccactg

SEQ ID NO: 315927 - DNA, 25 bp, Mus musculus
ctagcaggcagccactgtggttccc

SEQ ID NO: 315928 - DNA, 25 bp, Mus musculus
gcgcgtttatttgcgcgctccgagc

SEQ ID NO: 315929 - DNA, 25 bp, Mus musculus
gccgacccgcctcttagaggaggaa

SEQ ID NO: 315930 - DNA, 25 bp, Mus musculus
tccgttaggaggtcacccagcttta

SEQ ID NO: 315931 - DNA, 25 bp, Mus musculus
ccgccattcgccatccgttaggagg

SEQ ID NO: 315932 - DNA, 25 bp, Mus musculus
gcgctaaagctctggccatgctctc

SEQ ID NO: 315933 - DNA, 25 bp, Mus musculus
aatggccgcgccctgcgctaaagct

SEQ ID NO: 315934 - DNA, 25 bp, Mus musculus
gctccctggcatgcgtcaccaatgg

SEQ ID NO: 315935 - DNA, 25 bp, Mus musculus
gctttaaacggctcagcgcgacttc

SEQ ID NO: 315936 - DNA, 25 bp, Mus musculus
tgtgtcttgctgctgccatagtgtg

SEQ ID NO: 315937 - DNA, 25 bp, Mus musculus
agcttgaagtcgagcgtgctgtgtc

SEQ ID NO: 315938 - DNA, 25 bp, Mus musculus
gcggccgtccgcattgttcagcctg

SEQ ID NO: 315939 - DNA, 25 bp, Mus musculus
cagctcagccgaggaccaaacgcgg

SEQ ID NO: 315940 - DNA, 25 bp, Mus musculus
tgcctcgaacgagctaaggcgctcc

SEQ ID NO: 315941 - DNA, 25 bp, Mus musculus
cccgaacttgaagcgctgggtgtga

SEQ ID NO: 315942 - DNA, 25 bp, Mus musculus
gaggcctcgctaatggtggaatcgc

SEQ ID NO: 315943 - DNA, 25 bp, Mus musculus
tgacgaaagccgtgcgcttcggaga

SEQ ID NO: 315944 - DNA, 25 bp, Mus musculus
aaacccgagagagcctgacgaaagc

SEQ ID NO: 315945 - DNA, 25 bp, Mus musculus
cgctggcgtgctggataaaaccaaa

SEQ ID NO: 315946 - DNA, 25 bp, Mus musculus
aaagccgccgtcgtctgaggcacta

SEQ ID NO: 315947 - DNA, 25 bp, Mus musculus
aacgtcactaaactgcgacagaccg

SEQ ID NO: 315948 - DNA, 25 bp, Mus musculus
gcgcgccactggaaacgtcactaaa

SEQ ID NO: 315949 - DNA, 25 bp, Mus musculus
tgtcactggatacgtcactgggcgc

SEQ ID NO: 315950 - DNA, 25 bp, Mus musculus
catgcgttgaacgtgtcactggata

SEQ ID NO: 315951 - DNA, 25 bp, Mus musculus
ccggaggacaagacgcatgcgttga

SEQ ID NO: 315952 - DNA, 25 bp, Mus musculus
agcttataggtgtttccggaggaca

SEQ ID NO: 315953 - DNA, 25 bp, Mus musculus
ttccggaggagcttataggtgtttc

SEQ ID NO: 315954 - DNA, 25 bp, Mus musculus
cactacggtgtttccggaggagctt

SEQ ID NO: 315955 - DNA, 25 bp, Mus musculus
gtcgtctgaggcactacggtgtttc

SEQ ID NO: 315956 - DNA, 25 bp, Mus musculus
tgcgcttcggagaaaagccgccgtc

SEQ ID NO: 315957 - DNA, 25 bp, Mus musculus
aagtgctaccgggttctttgctccg

SEQ ID NO: 315958 - DNA, 25 bp, Mus musculus
ttgctccggtggcaacatttccctc

SEQ ID NO: 315959 - DNA, 25 bp, Mus musculus
atcatcgtagcgacggatggacggc

SEQ ID NO: 315960 - DNA, 25 bp, Mus musculus
tgcctgccctactttctttactcgg

SEQ ID NO: 315961 - DNA, 25 bp, Mus musculus
aaagcgcgcgggcttcttttcctgg

SEQ ID NO: 315962 - DNA, 25 bp, Mus musculus
cggtgaggacactcagccgtttttt

SEQ ID NO: 315963 - DNA, 25 bp, Mus musculus
ctccggaatgctcgaagctcgggtc

SEQ ID NO: 315964 - DNA, 25 bp, Mus musculus
catccgcgcaggaactaaagtgcta

SEQ ID NO: 315965 - DNA, 25 bp, Mus musculus
accagcagcgacaccggaatcatcg

SEQ ID NO: 315966 - DNA, 25 bp, Mus musculus
aggtagacggcagtccaaccaccca

SEQ ID NO: 315967 - DNA, 25 bp, Mus musculus
ttcaacaccaagtcggccaggtaga

SEQ ID NO: 315968 - DNA, 25 bp, Mus musculus
ttgggcgacacaggaccatgcgcac

SEQ ID NO: 315969 - DNA, 25 bp, Mus musculus
ttctttactcggtcggacggatgcg

SEQ ID NO: 315970 - DNA, 25 bp, Mus musculus
gtgcatatgccggaaaaagcgcgcg

SEQ ID NO: 315971 - DNA, 25 bp, Mus musculus
cgacttctagcagactcgcgggcca

SEQ ID NO: 315972 - DNA, 25 bp, Mus musculus
cactacttgactcggagaccatttg

SEQ ID NO: 315973 - DNA, 25 bp, Mus musculus
gaccatttgctcaccggttccatta

SEQ ID NO: 315974 - DNA, 25 bp, Mus musculus
ttccattatcagagccatgggcggc

SEQ ID NO: 315975 - DNA, 25 bp, Mus musculus
acgcggagctcggacagaaagccaa

SEQ ID NO: 315976 - DNA, 25 bp, Mus musculus
agaaagccaagtccgcagcccgctg

SEQ ID NO: 315977 - DNA, 25 bp, Mus musculus
agctcccaggacgtgttatgcccta

SEQ ID NO: 315978 - DNA, 25 bp, Mus musculus
gagagtggctcccagtggccttcca

SEQ ID NO: 315979 - DNA, 25 bp, Mus musculus
gaggggcctcctgccacccaaaata

SEQ ID NO: 315980 - DNA, 25 bp, Mus musculus
ggcttcagtgcatggctcgagccgc

SEQ ID NO: 315981 - DNA, 25 bp, Mus musculus
tttgtgtttcggtcccaaggctgga

SEQ ID NO: 315982 - DNA, 25 bp, Mus musculus
cccacagagggcattacctttcatc

SEQ ID NO: 315983 - DNA, 25 bp, Mus musculus
tggccttccaggagagtcagcgaga

SEQ ID NO: 315984 - DNA, 25 bp, Mus musculus
tacctttcatccagtccactacttg

SEQ ID NO: 315985 - DNA, 25 bp, Mus musculus
ccagctccggccgagttagcattca

SEQ ID NO: 315986 - DNA, 25 bp, Mus musculus
ttaagcatttcacagtccggacctc

SEQ ID NO: 315987 - DNA, 25 bp, Mus musculus
agttagcattcacgcccagccaggg

SEQ ID NO: 315988 - DNA, 25 bp, Mus musculus
cgacggctaggtcggccaacaaatc

SEQ ID NO: 315989 - DNA, 25 bp, Mus musculus
cccttaaggcgctaagagctacgtg

SEQ ID NO: 315990 - DNA, 25 bp, Mus musculus
tcctagggtattggagaccgactcc

SEQ ID NO: 315991 - DNA, 25 bp, Mus musculus
gcaacagtggcagttccgcgccctt

SEQ ID NO: 315992 - DNA, 25 bp, Mus musculus
gcctgagtttctcccagttcttaag

SEQ ID NO: 315993 - DNA, 25 bp, Mus musculus
ggccagtggaggaccgcaattacca

SEQ ID NO: 315994 - DNA, 25 bp, Mus musculus
tatcgagcttctcctacgcaccagg

SEQ ID NO: 315995 - DNA, 25 bp, Mus musculus
cacctcggcctcgtgagagtatctc

SEQ ID NO: 315996 - DNA, 25 bp, Mus musculus
ggcttcaccgttcagcccataaatt

SEQ ID NO: 315997 - DNA, 25 bp, Mus musculus
aacgtcgtgcagatcaaggctcggc

SEQ ID NO: 315998 - DNA, 25 bp, Mus musculus
gcgcccgcagcagttcaatccaatt

SEQ ID NO: 315999 - DNA, 25 bp, Mus musculus
cgcgctgggcagtcctatttttatc

SEQ ID NO: 316000 - DNA, 25 bp, Mus musculus
gcggcccattgatccagagaacact

SEQ ID NO: 316001 - DNA, 25 bp, Mus musculus
gcgacactgcaacccagaccaggta

SEQ ID NO: 316002 - DNA, 25 bp, Mus musculus
ccctgcaaagggctggaaagaatcg

SEQ ID NO: 316003 - DNA, 25 bp, Mus musculus
cacaggcgtcgtgcttagagaacaa

SEQ ID NO: 316004 - DNA, 25 bp, Mus musculus
tcgctaatgagctgtgcggcccatt

SEQ ID NO: 316005 - DNA, 25 bp, Mus musculus
cgcacggttcacagcggaaggagtc

SEQ ID NO: 316006 - DNA, 25 bp, Mus musculus
ctgcatgcctgtctagaccgatcta

SEQ ID NO: 316007 - DNA, 25 bp, Mus musculus
cacctactggtgacagcgcctcaaa

SEQ ID NO: 316008 - DNA, 25 bp, Mus musculus
gcctggtgaccgaaacccgcgtgat

SEQ ID NO: 316009 - DNA, 25 bp, Mus musculus
cgtggtggtgtactccgcacactaa

SEQ ID NO: 316010 - DNA, 25 bp, Mus musculus
gcatattaatcatcccggctccgcg

SEQ ID NO: 316011 - DNA, 25 bp, Mus musculus
cgcgtaggtctacacgacacaattc

SEQ ID NO: 316012 - DNA, 25 bp, Mus musculus
acacacggccctgcgaagttgttct

SEQ ID NO: 316013 - DNA, 25 bp, Mus musculus
agaggctgcaaacttccactcgttc

SEQ ID NO: 316014 - DNA, 25 bp, Mus musculus
taacgccgagacgaggttcccagct

SEQ ID NO: 316015 - DNA, 25 bp, Mus musculus
aacaatgcatctgacctgacgggtc

SEQ ID NO: 316016 - DNA, 25 bp, Mus musculus
gccgcttaggttggctgcattttta

SEQ ID NO: 316017 - DNA, 25 bp, Mus musculus
acgccgtccctaaacaagcagtcta

SEQ ID NO: 316018 - DNA, 25 bp, Mus musculus
tgcagctctgatgtaaaaccgaaag

SEQ ID NO: 316019 - DNA, 25 bp, Mus musculus
cgagcaaggtagctaagcctcccaa

SEQ ID NO: 316020 - DNA, 25 bp, Mus musculus
gcgatccggcgctttgaagttttcc

SEQ ID NO: 316021 - DNA, 25 bp, Mus musculus
cggctctccgctgtttcctagtagg

SEQ ID NO: 316022 - DNA, 25 bp, Mus musculus
ggctccaggaggctccgaacttaaa

SEQ ID NO: 316023 - DNA, 25 bp, Mus musculus
caagcagtctacaagggctccagga

SEQ ID NO: 316024 - DNA, 25 bp, Mus musculus
cttcctgctagcgaggtaacgccga

SEQ ID NO: 316025 - DNA, 25 bp, Mus musculus
tgttccgggcactgacctgaaatcc

SEQ ID NO: 316026 - DNA, 25 bp, Mus musculus
acgtgattcacgctttggggcaagc

SEQ ID NO: 316027 - DNA, 25 bp, Mus musculus
cgctctagagagacaggtatcgctt

SEQ ID NO: 316028 - DNA, 25 bp, Mus musculus
tttgctacagggagacgggcgccca

SEQ ID NO: 316029 - DNA, 25 bp, Mus musculus
ttcaccaggagccaagacttcagtc

SEQ ID NO: 316030 - DNA, 25 bp, Mus musculus
agactttggattcggttcaccagga

SEQ ID NO: 316031 - DNA, 25 bp, Mus musculus
tctccggaatcttagagactttgga

SEQ ID NO: 316032 - DNA, 25 bp, Mus musculus
cggctctagggtcttctccggaatc

SEQ ID NO: 316033 - DNA, 25 bp, Mus musculus
gcctgttttaatcaactttgcgtgg

SEQ ID NO: 316034 - DNA, 25 bp, Mus musculus
tcgcctctccctgcttttggggttg

SEQ ID NO: 316035 - DNA, 25 bp, Mus musculus
ttgggctttgccgatctgtctgtgt

SEQ ID NO: 316036 - DNA, 25 bp, Mus musculus
attctgctttgggtcgttgggcttt

SEQ ID NO: 316037 - DNA, 25 bp, Mus musculus
tgttcccggggcgagattctgcttt

SEQ ID NO: 316038 - DNA, 25 bp, Mus musculus
agcccttccgacagcgcggaggtga

SEQ ID NO: 316039 - DNA, 25 bp, Mus musculus
cttctcggctctgccttggagctcg

SEQ ID NO: 316040 - DNA, 25 bp, Mus musculus
ggtatcgcttagacgccatgttgtg

SEQ ID NO: 316041 - DNA, 25 bp, Mus musculus
tctgagccaacgtcgcaccggtggg

SEQ ID NO: 316042 - DNA, 25 bp, Mus musculus
aaggacagacctcccgagactgccg

SEQ ID NO: 316043 - DNA, 25 bp, Mus musculus
gccaaggacagacctcccgagactg

SEQ ID NO: 316044 - DNA, 25 bp, Mus musculus
agcccgcccgatcgccaaggacaga

SEQ ID NO: 316045 - DNA, 25 bp, Mus musculus
caggagccagccaccgcccgaaagc

SEQ ID NO: 316046 - DNA, 25 bp, Mus musculus
cggacccacggctagaccgccgctc

SEQ ID NO: 316047 - DNA, 25 bp, Mus musculus
cgcagggaaccggacctgcggccac

SEQ ID NO: 316048 - DNA, 25 bp, Mus musculus
aagttctgagccaacgtcgcaccgg

SEQ ID NO: 316049 - DNA, 25 bp, Mus musculus
tctgtcaaagttctgagccaacgtc

SEQ ID NO: 316050 - DNA, 25 bp, Mus musculus
cccgaatctgtcaaagttctgagcc

SEQ ID NO: 316051 - DNA, 25 bp, Mus musculus
tggtaaggcccgaatctgtcaaagt

SEQ ID NO: 316052 - DNA, 25 bp, Mus musculus
cgaaggtggtaaggcccgaatctgt

SEQ ID NO: 316053 - DNA, 25 bp, Mus musculus
cggccacccggagccggcctgcaga

SEQ ID NO: 316054 - DNA, 25 bp, Mus musculus
aggcccgaatctgtcaaagttctga

SEQ ID NO: 316055 - DNA, 25 bp, Mus musculus
actggggatccttgttccctcgcgc

SEQ ID NO: 316056 - DNA, 25 bp, Mus musculus
acccggagacagtgatgggcacgcc

SEQ ID NO: 316057 - DNA, 25 bp, Mus musculus
acacggggcctcagcgccggaagac

SEQ ID NO: 316058 - DNA, 25 bp, Mus musculus
cagcgccggaagacgcgaggaccaa

SEQ ID NO: 316059 - DNA, 25 bp, Mus musculus
cgaggaccaaggaccgctacaggtg

SEQ ID NO: 316060 - DNA, 25 bp, Mus musculus
gaggtcactggggatccttgttccc

SEQ ID NO: 316061 - DNA, 25 bp, Mus musculus
ccctcgcgcggcgtggggtacacta

SEQ ID NO: 316062 - DNA, 25 bp, Mus musculus
ggccgttgcctaggatacttaacgc

SEQ ID NO: 316063 - DNA, 25 bp, Mus musculus
tgcctaggatacttaacgccggtcc

SEQ ID NO: 316064 - DNA, 25 bp, Mus musculus
ggaccaggttcctcgggattcattg

SEQ ID NO: 316065 - DNA, 25 bp, Mus musculus
tcgggattcattgctcctcaatgtc

SEQ ID NO: 316066 - DNA, 25 bp, Mus musculus
tgctcctcaatgtccgctaaatctg

SEQ ID NO: 316067 - DNA, 25 bp, Mus musculus
cgctaaatctgtccgggaagaactt

SEQ ID NO: 316068 - DNA, 25 bp, Mus musculus
ccaaggaccgctacaggtgaggtca

SEQ ID NO: 316069 - DNA, 25 bp, Mus musculus
cctgccagccgaggatgcagactta

SEQ ID NO: 316070 - DNA, 25 bp, Mus musculus
gcagagcacgggcagataagctgct

SEQ ID NO: 316071 - DNA, 25 bp, Mus musculus
aaagggacctttagccatgggcgca

SEQ ID NO: 316072 - DNA, 25 bp, Mus musculus
cagggcttgcgcgaaaagggacctt

SEQ ID NO: 316073 - DNA, 25 bp, Mus musculus
atcgaaatacatctgctctggaccc

SEQ ID NO: 316074 - DNA, 25 bp, Mus musculus
ctcagggtcagaatcgaaatacatc

SEQ ID NO: 316075 - DNA, 25 bp, Mus musculus
ggccctcgtactcagggtcagaatc

SEQ ID NO: 316076 - DNA, 25 bp, Mus musculus
aggcttatcgaacaggccctcgtac

SEQ ID NO: 316077 - DNA, 25 bp, Mus musculus
tgcagacttaggtgcacgcgcagtg

SEQ ID NO: 316078 - DNA, 25 bp, Mus musculus
actcaaacgccgaccagatttcctg

SEQ ID NO: 316079 - DNA, 25 bp, Mus musculus
ataagctgctgagactaagaggcga

SEQ ID NO: 316080 - DNA, 25 bp, Mus musculus
gaagtccctgctgggtcgcagtgca

SEQ ID NO: 316081 - DNA, 25 bp, Mus musculus
tcctccaggggaggcttatcgaaca

SEQ ID NO: 316082 - DNA, 25 bp, Mus musculus
acctttagccatgggcgcagagcac

SEQ ID NO: 316083 - DNA, 25 bp, Mus musculus
ctgtgtgagaatatgggctcgtgcc

SEQ ID NO: 316084 - DNA, 25 bp, Mus musculus
aggctctcgcaagcacgggtgacca

SEQ ID NO: 316085 - DNA, 25 bp, Mus musculus
gggtgaccagcctctcctgagcacg

SEQ ID NO: 316086 - DNA, 25 bp, Mus musculus
ttgcccgtcggagtcaccgcagttc

SEQ ID NO: 316087 - DNA, 25 bp, Mus musculus
tgccagccagtctttgcggccatgc

SEQ ID NO: 316088 - DNA, 25 bp, Mus musculus
gattcgcgccacattgaccgcggcg

SEQ ID NO: 316089 - DNA, 25 bp, Mus musculus
gcggccatgcccaagaataaaggta

SEQ ID NO: 316090 - DNA, 25 bp, Mus musculus
tgaccttcctgccatcttttcttgc

SEQ ID NO: 316091 - DNA, 25 bp, Mus musculus
tcgggctgcattctctgcgtcctac

SEQ ID NO: 316092 - DNA, 25 bp, Mus musculus
tctgcgtcctacttggagctgggca

SEQ ID NO: 316093 - DNA, 25 bp, Mus musculus
gcagggaagttactcctggctccca

SEQ ID NO: 316094 - DNA, 25 bp, Mus musculus
ctggctcccagtttggccacattgg

SEQ ID NO: 316095 - DNA, 25 bp, Mus musculus
ttgtagggcctcctgtgtgagaata

SEQ ID NO: 316096 - DNA, 25 bp, Mus musculus
acgccatttgccactgccgagcgtg

SEQ ID NO: 316097 - DNA, 25 bp, Mus musculus
accaaggtggcccagctttgcggtt

SEQ ID NO: 316098 - DNA, 25 bp, Mus musculus
gcccgctgaggtgtttggactacag

SEQ ID NO: 316099 - DNA, 25 bp, Mus musculus
ctgcgccggctgagcagtgacgcac

SEQ ID NO: 316100 - DNA, 25 bp, Mus musculus
actacagggattgcggctggctcgc

SEQ ID NO: 316101 - DNA, 25 bp, Mus musculus
gctgctgctggccaagtccgcggaa

SEQ ID NO: 316102 - DNA, 25 bp, Mus musculus
gctttgcggtttacttggcctctcg

SEQ ID NO: 316103 - DNA, 25 bp, Mus musculus
ggacttcaggctgcgtctctctttc

SEQ ID NO: 316104 - DNA, 25 bp, Mus musculus
ctgcgtctctctttcggcaggtggc

SEQ ID NO: 316105 - DNA, 25 bp, Mus musculus
agcgggtatccttggccacggctgt

SEQ ID NO: 316106 - DNA, 25 bp, Mus musculus
aaataatgtcgcatcgcccgcgggg

SEQ ID NO: 316107 - DNA, 25 bp, Mus musculus
tgcgcctttcacagcagcccgaggg

SEQ ID NO: 316108 - DNA, 25 bp, Mus musculus
ctgccaagggcttgtcgctgctgct

SEQ ID NO: 316109 - DNA, 25 bp, Mus musculus
tcggggttgggaaaataatgtcgca

SEQ ID NO: 316110 - DNA, 25 bp, Mus musculus
cgcagacggggaagccacagccagc

SEQ ID NO: 316111 - DNA, 25 bp, Mus musculus
tggggccagcgccttccctaagcgg

SEQ ID NO: 316112 - DNA, 25 bp, Mus musculus
cgccaaagatgctctggcctcggga

SEQ ID NO: 316113 - DNA, 25 bp, Mus musculus
ccgcttggctctctgccctgagggg

SEQ ID NO: 316114 - DNA, 25 bp, Mus musculus
gacttggcttctccggggacctcat

SEQ ID NO: 316115 - DNA, 25 bp, Mus musculus
cttctccggttcacgctggggccag

SEQ ID NO: 316116 - DNA, 25 bp, Mus musculus
cgcgagcgcactttagtctctcagg

SEQ ID NO: 316117 - DNA, 25 bp, Mus musculus
tttagtctctcagggaaccgtggga

SEQ ID NO: 316118 - DNA, 25 bp, Mus musculus
tggacccgagcttctcctccttgaa

SEQ ID NO: 316119 - DNA, 25 bp, Mus musculus
ctcctccttgaaggcaagtttgggc

SEQ ID NO: 316120 - DNA, 25 bp, Mus musculus
ttgggaccagaccattccggaagga

SEQ ID NO: 316121 - DNA, 25 bp, Mus musculus
acagcgacgggctctggtgacgact

SEQ ID NO: 316122 - DNA, 25 bp, Mus musculus
ctctggtgacgacttctctgagggg

SEQ ID NO: 316123 - DNA, 25 bp, Mus musculus
cttcgcccacgagtggcggttctca

SEQ ID NO: 316124 - DNA, 25 bp, Mus musculus
tcccggctttgtccgccaaagatgc

SEQ ID NO: 316125 - DNA, 25 bp, Mus musculus
ggttctgccttcgatccaccttttc

SEQ ID NO: 316126 - DNA, 25 bp, Mus musculus
tccagtctcgaggagtctcgcggca

SEQ ID NO: 316127 - DNA, 25 bp, Mus musculus
tctcgcggcatttcccggggcgtga

SEQ ID NO: 316128 - DNA, 25 bp, Mus musculus
cccagagtcgggctggacactgctc

SEQ ID NO: 316129 - DNA, 25 bp, Mus musculus
ttttttcgcaatttccactcgcaga

SEQ ID NO: 316130 - DNA, 25 bp, Mus musculus
gcaatttccactcgcagagagcagg

SEQ ID NO: 316131 - DNA, 25 bp, Mus musculus
cgctgaggacgaagccggcccagca

SEQ ID NO: 316132 - DNA, 25 bp, Mus musculus
ggttccgccaactttcacgctgctt

SEQ ID NO: 316133 - DNA, 25 bp, Mus musculus
agtgcaggggccgttcgaaccttca

SEQ ID NO: 316134 - DNA, 25 bp, Mus musculus
ttcgaaccttcagcccatctgtgtg

SEQ ID NO: 316135 - DNA, 25 bp, Mus musculus
cttcagcccatctgtgtgtaggggt

SEQ ID NO: 316136 - DNA, 25 bp, Mus musculus
taggggtcgactggcgcgcccatcc

SEQ ID NO: 316137 - DNA, 25 bp, Mus musculus
ccattcactctcacttgctttagtg

SEQ ID NO: 316138 - DNA, 25 bp, Mus musculus
ttgctttagtgtccctgcggagccc

SEQ ID NO: 316139 - DNA, 25 bp, Mus musculus
gacggccgtgctcgatgccttctac

SEQ ID NO: 316140 - DNA, 25 bp, Mus musculus
gcctgcttcgggcttgcgaagccga

SEQ ID NO: 316141 - DNA, 25 bp, Mus musculus
gcgctcaagtgcctgcttcgggctt

SEQ ID NO: 316142 - DNA, 25 bp, Mus musculus
tacgtgcgcagcgaaagttcgcagg

SEQ ID NO: 316143 - DNA, 25 bp, Mus musculus
tgtctacgtgcgcagcgaaagttcg

SEQ ID NO: 316144 - DNA, 25 bp, Mus musculus
ctctgcgggctgtctacgtgcgcag

SEQ ID NO: 316145 - DNA, 25 bp, Mus musculus
gagcacctgggcttcgaagccgcca

SEQ ID NO: 316146 - DNA, 25 bp, Mus musculus
tctcggggaagagcacctgggcttc

SEQ ID NO: 316147 - DNA, 25 bp, Mus musculus
atccgcctgtgcagcaggtgtctcg

SEQ ID NO: 316148 - DNA, 25 bp, Mus musculus
gccggagaacccgtggtcacctgcc

SEQ ID NO: 316149 - DNA, 25 bp, Mus musculus
aagccggccctgagctccgctccgc

SEQ ID NO: 316150 - DNA, 25 bp, Mus musculus
ctcgcgggctttcaaagggcgctcg

SEQ ID NO: 316151 - DNA, 25 bp, Mus musculus
ctttctcgcgggctttcaaagggcg

SEQ ID NO: 316152 - DNA, 25 bp, Mus musculus
tccgcccgtcctgacgtcggagccc

SEQ ID NO: 316153 - DNA, 25 bp, Mus musculus
cccaaaacgcagtgacggagtcgcg

SEQ ID NO: 316154 - DNA, 25 bp, Mus musculus
ttgaggcgcccggagccgaagccac

SEQ ID NO: 316155 - DNA, 25 bp, Mus musculus
ccaagtctccttgaggcgcccggag

SEQ ID NO: 316156 - DNA, 25 bp, Mus musculus
gcggcacccaggcactcaaaaggag

SEQ ID NO: 316157 - DNA, 25 bp, Mus musculus
acggagtcgcgacggcatcacacgc

SEQ ID NO: 316158 - DNA, 25 bp, Mus musculus
cctcatggagcgcagcagactcacg

SEQ ID NO: 316159 - DNA, 25 bp, Mus musculus
gcggcaagcatcttcctcatggagc

SEQ ID NO: 316160 - DNA, 25 bp, Mus musculus
aacacgcgggatacagcggcaagca

SEQ ID NO: 316161 - DNA, 25 bp, Mus musculus
agagcctgccaacacgcgggataca

SEQ ID NO: 316162 - DNA, 25 bp, Mus musculus
ggcttctgcgcagagcctgccaaca

SEQ ID NO: 316163 - DNA, 25 bp, Mus musculus
ggatcaggcgacctcaccggcttct

SEQ ID NO: 316164 - DNA, 25 bp, Mus musculus
gactgcgcggaaagcccacccaagt

SEQ ID NO: 316165 - DNA, 25 bp, Mus musculus
aagcacagcggaccgggcccgttct

SEQ ID NO: 316166 - DNA, 25 bp, Mus musculus
tgtcccgtaagggacgagcagttgt

SEQ ID NO: 316167 - DNA, 25 bp, Mus musculus
gccagcagccaaccggtcaccggga

SEQ ID NO: 316168 - DNA, 25 bp, Mus musculus
gcaaagcttggagcccggcggatcc

SEQ ID NO: 316169 - DNA, 25 bp, Mus musculus
aaggcagaggcaaagcttggagccc

SEQ ID NO: 316170 - DNA, 25 bp, Mus musculus
ctcttgggccgtctggaaaggcaga

SEQ ID NO: 316171 - DNA, 25 bp, Mus musculus
agctcttgggccgtctggaaaggca

SEQ ID NO: 316172 - DNA, 25 bp, Mus musculus
ttctgagctggagctcttgggccgt

SEQ ID NO: 316173 - DNA, 25 bp, Mus musculus
ttggcggttctgagctggagctctt

SEQ ID NO: 316174 - DNA, 25 bp, Mus musculus
ctgagccaaggacaggcgacgggcc

SEQ ID NO: 316175 - DNA, 25 bp, Mus musculus
cttaagacctaagccgctgagccaa

SEQ ID NO: 316176 - DNA, 25 bp, Mus musculus
ggggtcttaagacctaagccgctga

SEQ ID NO: 316177 - DNA, 25 bp, Mus musculus
cgagaaagggtatctgaaaccctag

SEQ ID NO: 316178 - DNA, 25 bp, Mus musculus
tggcgccgagaaagggtatctgaaa

SEQ ID NO: 316179 - DNA, 25 bp, Mus musculus
aggacgccagcagccaaccggtcac

SEQ ID NO: 316180 - DNA, 25 bp, Mus musculus
ctccgtaagtgggaaagtgcgtgcg

SEQ ID NO: 316181 - DNA, 25 bp, Mus musculus
cccagtctaggttctgtcgagcatg

SEQ ID NO: 316182 - DNA, 25 bp, Mus musculus
actgcacgggttccgcttcttggtt

SEQ ID NO: 316183 - DNA, 25 bp, Mus musculus
gcgaccgaaggactctgctccttta

SEQ ID NO: 316184 - DNA, 25 bp, Mus musculus
tcctttagcctcagccgcggttgga

SEQ ID NO: 316185 - DNA, 25 bp, Mus musculus
tgaatttccgttaagagcccagctc

SEQ ID NO: 316186 - DNA, 25 bp, Mus musculus
tgtagaccctctccctttaggcgga

SEQ ID NO: 316187 - DNA, 25 bp, Mus musculus
tttctccagcctagtgcccagtcta

SEQ ID NO: 316188 - DNA, 25 bp, Mus musculus
catggtggtgggactagaaaccctc

SEQ ID NO: 316189 - DNA, 25 bp, Mus musculus
gacactctggttggctcgccttgca

SEQ ID NO: 316190 - DNA, 25 bp, Mus musculus
ggctcgccttgcaagtcatactttg

SEQ ID NO: 316191 - DNA, 25 bp, Mus musculus
tttgggtctctcagtttgaaaactc

SEQ ID NO: 316192 - DNA, 25 bp, Mus musculus
cgctgaatgttttgaggaccaggtc

SEQ ID NO: 316193 - DNA, 25 bp, Mus musculus
aggcggcaactttggcggacaccag

SEQ ID NO: 316194 - DNA, 25 bp, Mus musculus
taggtgagctcccaagcaacccgga

SEQ ID NO: 316195 - DNA, 25 bp, Mus musculus
gtaaactctaacggcctggccgctg

SEQ ID NO: 316196 - DNA, 25 bp, Mus musculus
gctgagtctgttgcgcactctcaaa

SEQ ID NO: 316197 - DNA, 25 bp, Mus musculus
gagacgctgagtctgttgcgcactc

SEQ ID NO: 316198 - DNA, 25 bp, Mus musculus
gcaggatttcccgcggagacgctga

SEQ ID NO: 316199 - DNA, 25 bp, Mus musculus
cggctcaaaattcagctttaaactc

SEQ ID NO: 316200 - DNA, 25 bp, Mus musculus
tgaagaactcctgaaccccggctca

SEQ ID NO: 316201 - DNA, 25 bp, Mus musculus
gagtacctgaagaactcctgaaccc

SEQ ID NO: 316202 - DNA, 25 bp, Mus musculus
tcgggtagagtacctgaagaactcc

SEQ ID NO: 316203 - DNA, 25 bp, Mus musculus
ccacggcttcgggtagagtacctga

SEQ ID NO: 316204 - DNA, 25 bp, Mus musculus
ctcaaccacggcttcgggtagagta

SEQ ID NO: 316205 - DNA, 25 bp, Mus musculus
ccggctcaaccacggcttcgggtag

SEQ ID NO: 316206 - DNA, 25 bp, Mus musculus
tcacgaacttagagggacccgggca

SEQ ID NO: 316207 - DNA, 25 bp, Mus musculus
ttggagtcacgaacttagagggacc

SEQ ID NO: 316208 - DNA, 25 bp, Mus musculus
tctgttgcgcactctcaaaaggccg

SEQ ID NO: 316209 - DNA, 25 bp, Mus musculus
caggaaatttctcattgacaatgtg

SEQ ID NO: 316210 - DNA, 25 bp, Mus musculus
cgaaggcgcagtcctctctgcagga

SEQ ID NO: 316211 - DNA, 25 bp, Mus musculus
agctcggcctggcaaagttcctgtg

SEQ ID NO: 316212 - DNA, 25 bp, Mus musculus
gttcctgtggaaactccatgttttg

SEQ ID NO: 316213 - DNA, 25 bp, Mus musculus
atgttttgaaactccagcgccgttg

SEQ ID NO: 316214 - DNA, 25 bp, Mus musculus
gctgagtcttacgaacaggaaattt

SEQ ID NO: 316215 - DNA, 25 bp, Mus musculus
caggacagaaactgcaagctgagtc

SEQ ID NO: 316216 - DNA, 25 bp, Mus musculus
ccgcggagatccacttgtcagttca

SEQ ID NO: 316217 - DNA, 25 bp, Mus musculus
actctcgccgcggagatccacttgt

SEQ ID NO: 316218 - DNA, 25 bp, Mus musculus
accgctcggctcagagctcacgggt

SEQ ID NO: 316219 - DNA, 25 bp, Mus musculus
gagacagttcccaagtcgcctgcct

SEQ ID NO: 316220 - DNA, 25 bp, Mus musculus
cgggtcgaaagagacagttcccaag

SEQ ID NO: 316221 - DNA, 25 bp, Mus musculus
cttgtcagttcaagggcaggacaga

SEQ ID NO: 316222 - DNA, 25 bp, Mus musculus
ggcccggagccacagattagtcacc

SEQ ID NO: 316223 - DNA, 25 bp, Mus musculus
ccattttaggcaaggtccggcgaga

SEQ ID NO: 316224 - DNA, 25 bp, Mus musculus
cggggatcgaggaacaccctgaagc

SEQ ID NO: 316225 - DNA, 25 bp, Mus musculus
tgcgtttcacgtgcccgccatggca

SEQ ID NO: 316226 - DNA, 25 bp, Mus musculus
tcgcggaacagaaatggggcgctcc

SEQ ID NO: 316227 - DNA, 25 bp, Mus musculus
ctgttgtgtacagagatcgcggaac

SEQ ID NO: 316228 - DNA, 25 bp, Mus musculus
acttgggccaggcaggaacacctgc

SEQ ID NO: 316229 - DNA, 25 bp, Mus musculus
gattcctccaggctccaggcgattg

SEQ ID NO: 316230 - DNA, 25 bp, Mus musculus
tggccgtctgtcctcctagattcct

SEQ ID NO: 316231 - DNA, 25 bp, Mus musculus
cctagggcagtcctagacgggagct

SEQ ID NO: 316232 - DNA, 25 bp, Mus musculus
ttggacgagtcgtctggcgtgacct

SEQ ID NO: 316233 - DNA, 25 bp, Mus musculus
gcgtcccattagtcagcccgagttc

SEQ ID NO: 316234 - DNA, 25 bp, Mus musculus
ggaggcccacaagcgtcccattagt

SEQ ID NO: 316235 - DNA, 25 bp, Mus musculus
atcccttcacaaggcgagggcgacg

SEQ ID NO: 316236 - DNA, 25 bp, Mus musculus
ccggggagaagctgtctactgttgt

SEQ ID NO: 316237 - DNA, 25 bp, Mus musculus
tccctcggttcaggagatgccaaac

SEQ ID NO: 316238 - DNA, 25 bp, Mus musculus
gacttttggcactcaatgaccttga

SEQ ID NO: 316239 - DNA, 25 bp, Mus musculus
tccagggcctgcgagatctatttgt

SEQ ID NO: 316240 - DNA, 25 bp, Mus musculus
ccgcgattagtcacaggctcgcttc

SEQ ID NO: 316241 - DNA, 25 bp, Mus musculus
cctgtcagtcgcacatggccttggt

SEQ ID NO: 316242 - DNA, 25 bp, Mus musculus
tcggctagtgtcgatcctgtcagtc

SEQ ID NO: 316243 - DNA, 25 bp, Mus musculus
atccttggtgcgttgacttgacttg

SEQ ID NO: 316244 - DNA, 25 bp, Mus musculus
ttagcatgcctttgggaagaccttg

SEQ ID NO: 316245 - DNA, 25 bp, Mus musculus
cttctttatagagtacggggcaaca

SEQ ID NO: 316246 - DNA, 25 bp, Mus musculus
ggctggctggaaccttactcattta

SEQ ID NO: 316247 - DNA, 25 bp, Mus musculus
gcgtgtgattctccttttcaaaagg

SEQ ID NO: 316248 - DNA, 25 bp, Mus musculus
ggccctgtttctcagtcagtgaata

SEQ ID NO: 316249 - DNA, 25 bp, Mus musculus
cctcttcaggcgagaaatcgggaca

SEQ ID NO: 316250 - DNA, 25 bp, Mus musculus
ctgctcaggcggcaatttttaaagc

SEQ ID NO: 316251 - DNA, 25 bp, Mus musculus
ctcctaggtggagacgttcgtcaga

SEQ ID NO: 316252 - DNA, 25 bp, Mus musculus
tacaggcgtctgagctttgggcact

SEQ ID NO: 316253 - DNA, 25 bp, Mus musculus
caccacgtctggtcttggctggatg

SEQ ID NO: 316254 - DNA, 25 bp, Mus musculus
cggatgtgtgggtagcatctcacca

SEQ ID NO: 316255 - DNA, 25 bp, Mus musculus
agtcctgtcttcgaggtctcccagc

SEQ ID NO: 316256 - DNA, 25 bp, Mus musculus
cccaatcggctgtgatcgctgggtg

SEQ ID NO: 316257 - DNA, 25 bp, Mus musculus
tgcgacccttcctgggagcctagaa

SEQ ID NO: 316258 - DNA, 25 bp, Mus musculus
gcgttgtctcgcaagcccggacaga

SEQ ID NO: 316259 - DNA, 25 bp, Mus musculus
gtcacccgcggtatgtgcgttgtct

SEQ ID NO: 316260 - DNA, 25 bp, Mus musculus
gtcaacgtcttgtcttggcggtggc

SEQ ID NO: 316261 - DNA, 25 bp, Mus musculus
cccagtgtattcctgtgtgcgtctg

SEQ ID NO: 316262 - DNA, 25 bp, Mus musculus
gcacaggcagttgcaccagccgctt

SEQ ID NO: 316263 - DNA, 25 bp, Mus musculus
ggtgcaacagagtggtcaacgtctt

SEQ ID NO: 316264 - DNA, 25 bp, Mus musculus
tctctcgttccattcccaagctagg

SEQ ID NO: 316265 - DNA, 25 bp, Mus musculus
ccgggaagaccctagagactcgtgg

SEQ ID NO: 316266 - DNA, 25 bp, Mus musculus
tggggacaccgcagacctgcagcaa

SEQ ID NO: 316267 - DNA, 25 bp, Mus musculus
ttccttgctgcaagcccggagagcc

SEQ ID NO: 316268 - DNA, 25 bp, Mus musculus
gagactccagcttgggactccctca

SEQ ID NO: 316269 - DNA, 25 bp, Mus musculus
tctgttaccctcctaagtggaccga

SEQ ID NO: 316270 - DNA, 25 bp, Mus musculus
cgactgggttccctctctaaagaca

SEQ ID NO: 316271 - DNA, 25 bp, Mus musculus
gctagtggacacacggccaacatga

SEQ ID NO: 316272 - DNA, 25 bp, Mus musculus
tccctagcggcagcgacaagtaatc

SEQ ID NO: 316273 - DNA, 25 bp, Mus musculus
agcgaacgcgcagcctaatttgatg

SEQ ID NO: 316274 - DNA, 25 bp, Mus musculus
ggcaaactcctctcattccgctagg

SEQ ID NO: 316275 - DNA, 25 bp, Mus musculus
cgccaatgaagagaaagcgctcgtg

SEQ ID NO: 316276 - DNA, 25 bp, Mus musculus
caggatttcttgttctagccctcta

SEQ ID NO: 316277 - DNA, 25 bp, Mus musculus
cctctactacacgaacgcgcttatg

SEQ ID NO: 316278 - DNA, 25 bp, Mus musculus
acctctatcggggaagccttcactc

SEQ ID NO: 316279 - DNA, 25 bp, Mus musculus
acgagatctcgtagctcggggtgtc

SEQ ID NO: 316280 - DNA, 25 bp, Mus musculus
tccgggcccacacgagatctcgtag

SEQ ID NO: 316281 - DNA, 25 bp, Mus musculus
ggcccacacgagatctcgtagctcg

SEQ ID NO: 316282 - DNA, 25 bp, Mus musculus
ttgcttgcgtagttccgggcccaca

SEQ ID NO: 316283 - DNA, 25 bp, Mus musculus
gcctaggccttgcttgcgtagttcc

SEQ ID NO: 316284 - DNA, 25 bp, Mus musculus
agatctcgtagctcggggtgtctta

SEQ ID NO: 316285 - DNA, 25 bp, Mus musculus
tcgtagctcggggtgtcttaggtaa

SEQ ID NO: 316286 - DNA, 25 bp, Mus musculus
tcttaggtaagcgtctggttcctca

SEQ ID NO: 316287 - DNA, 25 bp, Mus musculus
aggctgcagctcgatgcccgcacga

SEQ ID NO: 316288 - DNA, 25 bp, Mus musculus
ccgagactcggcttttgctgcctct

SEQ ID NO: 316289 - DNA, 25 bp, Mus musculus
gagactcggcttttgctgcctctcg

SEQ ID NO: 316290 - DNA, 25 bp, Mus musculus
tgtcccggcctaggccttgcttgcg

SEQ ID NO: 316291 - DNA, 25 bp, Mus musculus
gggtggcatcccttcctgtcccggc

SEQ ID NO: 316292 - DNA, 25 bp, Mus musculus
aagcgtctggttcctcaggctgcag

SEQ ID NO: 316293 - DNA, 25 bp, Mus musculus
gaggctaccacttgtgcggctcgcc

SEQ ID NO: 316294 - DNA, 25 bp, Mus musculus
ggatcttctttgtgccgctgagcaa

SEQ ID NO: 316295 - DNA, 25 bp, Mus musculus
tgccagatcgtgctgggatcttctt

SEQ ID NO: 316296 - DNA, 25 bp, Mus musculus
tggaaagttgggttttgccagatcg

SEQ ID NO: 316297 - DNA, 25 bp, Mus musculus
attctgttgacgtatctggcggccc

SEQ ID NO: 316298 - DNA, 25 bp, Mus musculus
tccaggcccttcgaaagatggattc

SEQ ID NO: 316299 - DNA, 25 bp, Mus musculus
agcctggaaaaccaggcgccttcca

SEQ ID NO: 316300 - DNA, 25 bp, Mus musculus
tgtctcggtatctgccattctgccc

SEQ ID NO: 316301 - DNA, 25 bp, Mus musculus
gacccagagagttcccacactagcg

SEQ ID NO: 316302 - DNA, 25 bp, Mus musculus
cacccgctctggcactgggcataga

SEQ ID NO: 316303 - DNA, 25 bp, Mus musculus
gagcaagtcccgcatcccgctggag

SEQ ID NO: 316304 - DNA, 25 bp, Mus musculus
caccctagtgctggtcggggtcact

SEQ ID NO: 316305 - DNA, 25 bp, Mus musculus
caccgcaccgggcttgtctcggtat

SEQ ID NO: 316306 - DNA, 25 bp, Mus musculus
tagcgacagcggcttggtgacagca

SEQ ID NO: 316307 - DNA, 25 bp, Mus musculus
tgcttcaatgctgcaggctgagcca

SEQ ID NO: 316308 - DNA, 25 bp, Mus musculus
ccgtgcttctttcgccaggtgcaga

SEQ ID NO: 316309 - DNA, 25 bp, Mus musculus
gtgcagaaatcctaccgcccgtgcg

SEQ ID NO: 316310 - DNA, 25 bp, Mus musculus
cctcggtgcgttatgaccgcattcc

SEQ ID NO: 316311 - DNA, 25 bp, Mus musculus
cagtctaactccgtccacaggcaga

SEQ ID NO: 316312 - DNA, 25 bp, Mus musculus
cgcgctccatcaaagcaggggcatt

SEQ ID NO: 316313 - DNA, 25 bp, Mus musculus
ggctgagccacctaattgaccactg

SEQ ID NO: 316314 - DNA, 25 bp, Mus musculus
ttgaccactgggaaatcaggtgccc

SEQ ID NO: 316315 - DNA, 25 bp, Mus musculus
gcccgcgtagacagcttcgatttac

SEQ ID NO: 316316 - DNA, 25 bp, Mus musculus
gcttcgatttacagcccagtgaatg

SEQ ID NO: 316317 - DNA, 25 bp, Mus musculus
acatctccggtttccgctggggtag

SEQ ID NO: 316318 - DNA, 25 bp, Mus musculus
ccgcagtgatctgcaggtctcagcc

SEQ ID NO: 316319 - DNA, 25 bp, Mus musculus
ccggatttcttgtacctgtgcgata

SEQ ID NO: 316320 - DNA, 25 bp, Mus musculus
tgccttctgatgaggaagtcgactg

SEQ ID NO: 316321 - DNA, 25 bp, Mus musculus
tcacttgctttcaaccggggtcagc

SEQ ID NO: 316322 - DNA, 25 bp, Mus musculus
ctccttcacagcttagtctgacctg

SEQ ID NO: 316323 - DNA, 25 bp, Mus musculus
ttgctgaccgcgcacaggtctaaca

SEQ ID NO: 316324 - DNA, 25 bp, Mus musculus
ggtctaacatgagcagcacagcctc

SEQ ID NO: 316325 - DNA, 25 bp, Mus musculus
cacacgaggaggctcttctggctcc

SEQ ID NO: 316326 - DNA, 25 bp, Mus musculus
cggctccacgatccgcttggcgaaa

SEQ ID NO: 316327 - DNA, 25 bp, Mus musculus
cttctcctctgagcgacccttgtga

SEQ ID NO: 316328 - DNA, 25 bp, Mus musculus
gtgcgcgcgcctcagtttgaaagta

SEQ ID NO: 316329 - DNA, 25 bp, Mus musculus
gtccagagacgctgagggctcctct

SEQ ID NO: 316330 - DNA, 25 bp, Mus musculus
gagcacggctgtctaggaaagatga

SEQ ID NO: 316331 - DNA, 25 bp, Mus musculus
gacaagcgctgagcacggaaatctc

SEQ ID NO: 316332 - DNA, 25 bp, Mus musculus
cactgccgccgcctatataaatggg

SEQ ID NO: 316333 - DNA, 25 bp, Mus musculus
aaatctcggagtgtgcttgggtcct

SEQ ID NO: 316334 - DNA, 25 bp, Mus musculus
cgacccttgtgagctagagacctgg

SEQ ID NO: 316335 - DNA, 25 bp, Mus musculus
agagctcagagtagcactgctgctc

SEQ ID NO: 316336 - DNA, 25 bp, Mus musculus
gtaaggaacgcaactctggctgccg

SEQ ID NO: 316337 - DNA, 25 bp, Mus musculus
cttcgccaggtaaggaacgcaactc

SEQ ID NO: 316338 - DNA, 25 bp, Mus musculus
ggcgctgaccaatcacagcccgaaa

SEQ ID NO: 316339 - DNA, 25 bp, Mus musculus
aatgttgtgcctcctctgcgcggca

SEQ ID NO: 316340 - DNA, 25 bp, Mus musculus
cctccgggcttgaatgttgtgcctc

SEQ ID NO: 316341 - DNA, 25 bp, Mus musculus
cttccctggccgaggtgctggtgct

SEQ ID NO: 316342 - DNA, 25 bp, Mus musculus
cgcgcgaagagctcagagtagcact

SEQ ID NO: 316343 - DNA, 25 bp, Mus musculus
agcactgctgctcgctatcgctcag

SEQ ID NO: 316344 - DNA, 25 bp, Mus musculus
tatcgctcagcagcaaaggcggccc

SEQ ID NO: 316345 - DNA, 25 bp, Mus musculus
gctgccacttccatagggccttctg

SEQ ID NO: 316346 - DNA, 25 bp, Mus musculus
atagggccttctgtagcgtccgaac

SEQ ID NO: 316347 - DNA, 25 bp, Mus musculus
gacgctcgaaacagatcagctactg

SEQ ID NO: 316348 - DNA, 25 bp, Mus musculus
atcagctactggaccagcggccgca

SEQ ID NO: 316349 - DNA, 25 bp, Mus musculus
ctcggcacgcgctgacgaaaggcgc

SEQ ID NO: 316350 - DNA, 25 bp, Mus musculus
tctccaatttcccagggcggctgcg

SEQ ID NO: 316351 - DNA, 25 bp, Mus musculus
ctgctgctgttccacgtggattgga

SEQ ID NO: 316352 - DNA, 25 bp, Mus musculus
acgacccgacgcaagatggcgagta

SEQ ID NO: 316353 - DNA, 25 bp, Mus musculus
agagagtaaggatgcctgccctgtg

SEQ ID NO: 316354 - DNA, 25 bp, Mus musculus
ctcttgactagcgagagagaagtcc

SEQ ID NO: 316355 - DNA, 25 bp, Mus musculus
gaactcaggcttttccgagcgagga

SEQ ID NO: 316356 - DNA, 25 bp, Mus musculus
gacggccagaccgaactcaggcttt

SEQ ID NO: 316357 - DNA, 25 bp, Mus musculus
aggagagcggctcagacctcgctac

SEQ ID NO: 316358 - DNA, 25 bp, Mus musculus
gcgcgggttgaaaagtctcgttcca

SEQ ID NO: 316359 - DNA, 25 bp, Mus musculus
atcccgccggactatggctgccgat

SEQ ID NO: 316360 - DNA, 25 bp, Mus musculus
ctattggtccaagccgccgagccgt

SEQ ID NO: 316361 - DNA, 25 bp, Mus musculus
tcccgtcgcacgctattggtccaag

SEQ ID NO: 316362 - DNA, 25 bp, Mus musculus
ctcgttccaagtttggcgagaggga

SEQ ID NO: 316363 - DNA, 25 bp, Mus musculus
ccaatcgtagcgtgagagtcttctc

SEQ ID NO: 316364 - DNA, 25 bp, Mus musculus
agagtcttctcacgtgaccggagga

SEQ ID NO: 316365 - DNA, 25 bp, Mus musculus
tacgagtcccagaagaatgtgcggc

SEQ ID NO: 316366 - DNA, 25 bp, Mus musculus
cggcgtccagccatgaatccggata

SEQ ID NO: 316367 - DNA, 25 bp, Mus musculus
cacggaacctctcaggggcttcagc

SEQ ID NO: 316368 - DNA, 25 bp, Mus musculus
ctcaagccgagtcgccatgaggtga

SEQ ID NO: 316369 - DNA, 25 bp, Mus musculus
gccggatgttcgtcccgtagctaaa

SEQ ID NO: 316370 - DNA, 25 bp, Mus musculus
ccaactatcgtcactcttctgaagg

SEQ ID NO: 316371 - DNA, 25 bp, Mus musculus
ggctgaagactcaacacccggggca

SEQ ID NO: 316372 - DNA, 25 bp, Mus musculus
gcccggtgaccacacaggctgaaga

SEQ ID NO: 316373 - DNA, 25 bp, Mus musculus
cgtcacctccttgggcagcggagtc

SEQ ID NO: 316374 - DNA, 25 bp, Mus musculus
tacgcacctgcccaacacggagagg

SEQ ID NO: 316375 - DNA, 25 bp, Mus musculus
tatcttactgcgcaacagcctcagc

SEQ ID NO: 316376 - DNA, 25 bp, Mus musculus
cggcttctgcgctgttatcttactg

SEQ ID NO: 316377 - DNA, 25 bp, Mus musculus
tggctgatccgactccgctggtctt

SEQ ID NO: 316378 - DNA, 25 bp, Mus musculus
cgtcatgtccggctaaggctccgcc

SEQ ID NO: 316379 - DNA, 25 bp, Mus musculus
tgctgctcctcagtgggctccacgg

SEQ ID NO: 316380 - DNA, 25 bp, Mus musculus
cgctcggggctctcctcagaaggcg

SEQ ID NO: 316381 - DNA, 25 bp, Mus musculus
gggctctcctcagaaggcgcggctc

SEQ ID NO: 316382 - DNA, 25 bp, Mus musculus
tcccggctgggaggctcttctccct

SEQ ID NO: 316383 - DNA, 25 bp, Mus musculus
gggcggcttcaagcccagccaactg

SEQ ID NO: 316384 - DNA, 25 bp, Mus musculus
agccaactgctcaaccctccgaaca

SEQ ID NO: 316385 - DNA, 25 bp, Mus musculus
ttaaccactggctgatccgactccg

SEQ ID NO: 316386 - DNA, 25 bp, Mus musculus
cgactccgctggtcttcgagggaga

SEQ ID NO: 316387 - DNA, 25 bp, Mus musculus
gagactgaccggaaccggagacctc

SEQ ID NO: 316388 - DNA, 25 bp, Mus musculus
ttggcccaccctctctgacggcggc

SEQ ID NO: 316389 - DNA, 25 bp, Mus musculus
tcttcgagggagactgaccggaacc

SEQ ID NO: 316390 - DNA, 25 bp, Mus musculus
agctggccgcgcatgcgtcatgtcc

SEQ ID NO: 316391 - DNA, 25 bp, Mus musculus
ccctccggatcctctccaagcagcg

SEQ ID NO: 316392 - DNA, 25 bp, Mus musculus
ggtcaagctctctccgcggcagatc

SEQ ID NO: 316393 - DNA, 25 bp, Mus musculus
ccaagcagcgctttgggtcaagctc

SEQ ID NO: 316394 - DNA, 25 bp, Mus musculus
aagacgtggtggaggcagattcttc

SEQ ID NO: 316395 - DNA, 25 bp, Mus musculus
cgaccggtagaagcccaaggcgatg

SEQ ID NO: 316396 - DNA, 25 bp, Mus musculus
ccatagtggcgaccggtagaagccc

SEQ ID NO: 316397 - DNA, 25 bp, Mus musculus
tcctcggccatagtggcgaccggta

SEQ ID NO: 316398 - DNA, 25 bp, Mus musculus
gcagattcttcctcggccatagtgg

SEQ ID NO: 316399 - DNA, 25 bp, Mus musculus
tgaagacttcttggcatatcggaca

SEQ ID NO: 316400 - DNA, 25 bp, Mus musculus
cttggcatatcggacagtagaaatc

SEQ ID NO: 316401 - DNA, 25 bp, Mus musculus
gcatatcggacagtagaaatcatct

SEQ ID NO: 316402 - DNA, 25 bp, Mus musculus
agcgctttgggtcaagctctctccg

SEQ ID NO: 316403 - DNA, 25 bp, Mus musculus
catcttcagtataagacgtggtgga

SEQ ID NO: 316404 - DNA, 25 bp, Mus musculus
ccgaactggcgttttgaagacttct

SEQ ID NO: 316405 - DNA, 25 bp, Mus musculus
cccagagtgctcaggatgttaagga

SEQ ID NO: 316406 - DNA, 25 bp, Mus musculus
cgaaggcccagagtgctcaggatgt

SEQ ID NO: 316407 - DNA, 25 bp, Mus musculus
gcacaatgtcgcagtcggcgacaga

SEQ ID NO: 316408 - DNA, 25 bp, Mus musculus
aggcacggcgcacaatgtcgcagtc

SEQ ID NO: 316409 - DNA, 25 bp, Mus musculus
gctttcacaggcacggcgcacaatg

SEQ ID NO: 316410 - DNA, 25 bp, Mus musculus
ggcgcgagtggacacgctttcacag

SEQ ID NO: 316411 - DNA, 25 bp, Mus musculus
cccgctagtcctgctgagcacatgt

SEQ ID NO: 316412 - DNA, 25 bp, Mus musculus
cggctttcgcgcatgcgatttatga

SEQ ID NO: 316413 - DNA, 25 bp, Mus musculus
ctcactgcggctttcgcgcatgcga

SEQ ID NO: 316414 - DNA, 25 bp, Mus musculus
tgatgcgcatcacgtcctcactgcg

SEQ ID NO: 316415 - DNA, 25 bp, Mus musculus
agcttgtacacggagccatccacgc

SEQ ID NO: 316416 - DNA, 25 bp, Mus musculus
ctgacctcgggtgcagcttgtacac

SEQ ID NO: 316417 - DNA, 25 bp, Mus musculus
tagtcctgctgagcacatgtgggcg

SEQ ID NO: 316418 - DNA, 25 bp, Mus musculus
atgttaaggatctgccttcggtccc

SEQ ID NO: 316419 - DNA, 25 bp, Mus musculus
cggtgaaatccgaggagctctcttg

SEQ ID NO: 316420 - DNA, 25 bp, Mus musculus
ggcacctcgccatcgattgtcatta

SEQ ID NO: 316421 - DNA, 25 bp, Mus musculus
gtggcgtggtccctttcactcaacc

SEQ ID NO: 316422 - DNA, 25 bp, Mus musculus
cattaggggctgaaacttgacacta

SEQ ID NO: 316423 - DNA, 25 bp, Mus musculus
gcagcagctctgcacgcgcttcagt

SEQ ID NO: 316424 - DNA, 25 bp, Mus musculus
acaccgcccgcgagtaacaatggca

SEQ ID NO: 316425 - DNA, 25 bp, Mus musculus
ccagagtggaggctctgctcccaca

SEQ ID NO: 316426 - DNA, 25 bp, Mus musculus
ggggctgtcagaggccatttatctc

SEQ ID NO: 316427 - DNA, 25 bp, Mus musculus
tgcgaaagccattaccgccggcgcg

SEQ ID NO: 316428 - DNA, 25 bp, Mus musculus
cggcgcgcgagagacttttaaaata

SEQ ID NO: 316429 - DNA, 25 bp, Mus musculus
ccgcacggtagcctgatccatcttg

SEQ ID NO: 316430 - DNA, 25 bp, Mus musculus
gctgatttaaaggttctcaccggga

SEQ ID NO: 316431 - DNA, 25 bp, Mus musculus
tcaaggagttggaccgtgtttccgc

SEQ ID NO: 316432 - DNA, 25 bp, Mus musculus
ggcagctcgcggcaagtttactttc

SEQ ID NO: 316433 - DNA, 25 bp, Mus musculus
ggtgcggaccatcctttagcctgca

SEQ ID NO: 316434 - DNA, 25 bp, Mus musculus
gagtcactggcgctcggaatcagcc

SEQ ID NO: 316435 - DNA, 25 bp, Mus musculus
atcaccctgccacggaaggagccag

SEQ ID NO: 316436 - DNA, 25 bp, Mus musculus
gcagcacagcccgaagtacgcaagc

SEQ ID NO: 316437 - DNA, 25 bp, Mus musculus
ttccgggtcacgtggccagacttcc

SEQ ID NO: 316438 - DNA, 25 bp, Mus musculus
ctaccctgcggttatttgaccaatc

SEQ ID NO: 316439 - DNA, 25 bp, Mus musculus
ttgaccaatcggcttctcgttcttg

SEQ ID NO: 316440 - DNA, 25 bp, Mus musculus
gttcttgccggcaacagcgctcact

SEQ ID NO: 316441 - DNA, 25 bp, Mus musculus
agcgctcactctagaggcggttggc

SEQ ID NO: 316442 - DNA, 25 bp, Mus musculus
gccgtaagtgctgaaggagtccgct

SEQ ID NO: 316443 - DNA, 25 bp, Mus musculus
ccgaaactcacttctgccggcggta

SEQ ID NO: 316444 - DNA, 25 bp, Mus musculus
gtggttcgctgatcgcctcaagttt

SEQ ID NO: 316445 - DNA, 25 bp, Mus musculus
agcggatgccattgtctctgctcca

SEQ ID NO: 316446 - DNA, 25 bp, Mus musculus
aaccctctggagacccacggagtca

SEQ ID NO: 316447 - DNA, 25 bp, Mus musculus
cgcggcctgagaaaacagaccctca

SEQ ID NO: 316448 - DNA, 25 bp, Mus musculus
atactgctgtcgctgtgttctccca

SEQ ID NO: 316449 - DNA, 25 bp, Mus musculus
cgccgtttccatactgctgtcgctg

SEQ ID NO: 316450 - DNA, 25 bp, Mus musculus
ttcctatacctcagtttctgcggcc

SEQ ID NO: 316451 - DNA, 25 bp, Mus musculus
gcctcgtcatttcctatacctcagt

SEQ ID NO: 316452 - DNA, 25 bp, Mus musculus
tctcccacggcaaggtctcagcgga

SEQ ID NO: 316453 - DNA, 25 bp, Mus musculus
tctcagcggaagcagccacccaggt

SEQ ID NO: 316454 - DNA, 25 bp, Mus musculus
agacggctttcttcccgcagctggt

SEQ ID NO: 316455 - DNA, 25 bp, Mus musculus
agccaccgcggcagacctgagtttt

SEQ ID NO: 316456 - DNA, 25 bp, Mus musculus
catcgcgggctgagaaaatgtctcc

SEQ ID NO: 316457 - DNA, 25 bp, Mus musculus
cccttgcccagaattcaaggcgtta

SEQ ID NO: 316458 - DNA, 25 bp, Mus musculus
tcaaggcgttaaggcctagctccgc

SEQ ID NO: 316459 - DNA, 25 bp, Mus musculus
catctaaattccaaggcgacgcctc

SEQ ID NO: 316460 - DNA, 25 bp, Mus musculus
gcagacctgagttttcctccctcgg

SEQ ID NO: 316461 - DNA, 25 bp, Mus musculus
ccttcttatgggtgatgccgttacc

SEQ ID NO: 316462 - DNA, 25 bp, Mus musculus
tactctcggacctacatctttcggg

SEQ ID NO: 316463 - DNA, 25 bp, Mus musculus
atccgtcgcttagaccacgcctttt

SEQ ID NO: 316464 - DNA, 25 bp, Mus musculus
gcgcctaagaccacaggccgatttt

SEQ ID NO: 316465 - DNA, 25 bp, Mus musculus
cgaacagcggcatgcgatcaccctt

SEQ ID NO: 316466 - DNA, 25 bp, Mus musculus
ttgcccaggcctttgatctcgaaca

SEQ ID NO: 316467 - DNA, 25 bp, Mus musculus
gaccgctgaggagaccctgagaaca

SEQ ID NO: 316468 - DNA, 25 bp, Mus musculus
gctttcgaccgcagctctacaggga

SEQ ID NO: 316469 - DNA, 25 bp, Mus musculus
cggtagctccggttccggctcaatc

SEQ ID NO: 316470 - DNA, 25 bp, Mus musculus
agcctcgcgagaccttgactcctga

SEQ ID NO: 316471 - DNA, 25 bp, Mus musculus
tgccagcctatgaggagcttgctta

SEQ ID NO: 316472 - DNA, 25 bp, Mus musculus
agtcgcccatccttaccgaattcaa

SEQ ID NO: 316473 - DNA, 25 bp, Mus musculus
ccaaggtacctcaagacagtgcgtg

SEQ ID NO: 316474 - DNA, 25 bp, Mus musculus
gccgttaccatggtgccgaagcctg

SEQ ID NO: 316475 - DNA, 25 bp, Mus musculus
cctactctatctgaggcccggaagt

SEQ ID NO: 316476 - DNA, 25 bp, Mus musculus
gctgacgctacaatcccgcgctaga

SEQ ID NO: 316477 - DNA, 25 bp, Mus musculus
tcttaggagacgtgctcctgcgctc

SEQ ID NO: 316478 - DNA, 25 bp, Mus musculus
gggaccttccgcagctcttaggaga

SEQ ID NO: 316479 - DNA, 25 bp, Mus musculus
accgggcttcctgaaaagagacgca

SEQ ID NO: 316480 - DNA, 25 bp, Mus musculus
ttgtgccgttctcacaggaccgtgg

SEQ ID NO: 316481 - DNA, 25 bp, Mus musculus
ttctaacgttctcggtctctctgga

SEQ ID NO: 316482 - DNA, 25 bp, Mus musculus
tacgcgtcttggctgtcctttctaa

SEQ ID NO: 316483 - DNA, 25 bp, Mus musculus
attctgttaactgccgcgggaggtc

SEQ ID NO: 316484 - DNA, 25 bp, Mus musculus
cgcggacgcttctgattggtgcttt

SEQ ID NO: 316485 - DNA, 25 bp, Mus musculus
aacctctgtgtgattggttatcatg

SEQ ID NO: 316486 - DNA, 25 bp, Mus musculus
gggcgtctctcttctacgtaattca

SEQ ID NO: 316487 - DNA, 25 bp, Mus musculus
atcccgcgctagagacttgggcccg

SEQ ID NO: 316488 - DNA, 25 bp, Mus musculus
gacgcagtaactaagcaaccagggc

SEQ ID NO: 316489 - DNA, 25 bp, Mus musculus
ccaccaccagagctaggtccgttgt

SEQ ID NO: 316490 - DNA, 25 bp, Mus musculus
tacgtcacggataaggcgggacttc

SEQ ID NO: 316491 - DNA, 25 bp, Mus musculus
cgcccttgactctgtgtagccactg

SEQ ID NO: 316492 - DNA, 25 bp, Mus musculus
aattcgcttcctgtgccgcccttga

SEQ ID NO: 316493 - DNA, 25 bp, Mus musculus
ctgacacgacgttacgtcacggata

SEQ ID NO: 316494 - DNA, 25 bp, Mus musculus
aaacgaattcgcttcctgtgccgcc

SEQ ID NO: 316495 - DNA, 25 bp, Mus musculus
ctgtgtagccactgacacgacgtta

SEQ ID NO: 316496 - DNA, 25 bp, Mus musculus
ttcaagccccgtaccggaagcgagc

SEQ ID NO: 316497 - DNA, 25 bp, Mus musculus
agctgcgtgcccacgaggtgacttc

SEQ ID NO: 316498 - DNA, 25 bp, Mus musculus
cccaaacaaacgaattcgcttcctg

SEQ ID NO: 316499 - DNA, 25 bp, Mus musculus
agagctaggtccgttgttgcccacc

SEQ ID NO: 316500 - DNA, 25 bp, Mus musculus
cgagcctcccgctctccttgtgtca

SEQ ID NO: 316501 - DNA, 25 bp, Mus musculus
gttgcccaggcaacccgagcctccc

SEQ ID NO: 316502 - DNA, 25 bp, Mus musculus
gcccaccgcccgagatctgccagct

SEQ ID NO: 316503 - DNA, 25 bp, Mus musculus
ccaaccatgggtaagcgatcgcgct

SEQ ID NO: 316504 - DNA, 25 bp, Mus musculus
aggtgtccgctacgcccaagtgcac

SEQ ID NO: 316505 - DNA, 25 bp, Mus musculus
aaacttgtgccaccggctatcctgc

SEQ ID NO: 316506 - DNA, 25 bp, Mus musculus
cctgggtgacccagtccagaccgtt

SEQ ID NO: 316507 - DNA, 25 bp, Mus musculus
tacctgagctacctgggtgacccag

SEQ ID NO: 316508 - DNA, 25 bp, Mus musculus
acccagtccagaccgttgcgggagg

SEQ ID NO: 316509 - DNA, 25 bp, Mus musculus
tcccgtcagtctccaaccatgggta

SEQ ID NO: 316510 - DNA, 25 bp, Mus musculus
tgcccgccagacctgcaaacttgtg

SEQ ID NO: 316511 - DNA, 25 bp, Mus musculus
agcgaagagccaagcggccagccca

SEQ ID NO: 316512 - DNA, 25 bp, Mus musculus
gacgtctccactccagctgcaccta

SEQ ID NO: 316513 - DNA, 25 bp, Mus musculus
ctaagcgcgacgaagggtagcaagc

SEQ ID NO: 316514 - DNA, 25 bp, Mus musculus
ctacactgcaccgtggcgcgtgcta

SEQ ID NO: 316515 - DNA, 25 bp, Mus musculus
caccgtggcgcgtgctaagcgcgac

SEQ ID NO: 316516 - DNA, 25 bp, Mus musculus
cccagctcaggtggcgctacctgag

SEQ ID NO: 316517 - DNA, 25 bp, Mus musculus
tctcgcgagagcatagcctcagatc

SEQ ID NO: 316518 - DNA, 25 bp, Mus musculus
cgcgcttcctcccacggtatgggaa

SEQ ID NO: 316519 - DNA, 25 bp, Mus musculus
agggagcccttgacctcggaatcca

SEQ ID NO: 316520 - DNA, 25 bp, Mus musculus
cctaggggagcaagagagctaaaca

SEQ ID NO: 316521 - DNA, 25 bp, Mus musculus
caggagggactctggacggaataaa

SEQ ID NO: 316522 - DNA, 25 bp, Mus musculus
aagcggccgctcagtcggcagtttt

SEQ ID NO: 316523 - DNA, 25 bp, Mus musculus
acgcctgcgcgctcttaggcgagca

SEQ ID NO: 316524 - DNA, 25 bp, Mus musculus
gctgaggctcccgagcgcagattaa

SEQ ID NO: 316525 - DNA, 25 bp, Mus musculus
ctcgcgagagtgattttgggactcc

SEQ ID NO: 316526 - DNA, 25 bp, Mus musculus
tcctagttggtatagcctccgtgtc

SEQ ID NO: 316527 - DNA, 25 bp, Mus musculus
acagtggtcttctacctctacccag

SEQ ID NO: 316528 - DNA, 25 bp, Mus musculus
ctcccgtgatgcgaacagtggtctt

SEQ ID NO: 316529 - DNA, 25 bp, Mus musculus
cgcagattaaagaggcggccggttc

SEQ ID NO: 316530 - DNA, 25 bp, Mus musculus
ggcagttttccctgctccgtagctc

SEQ ID NO: 316531 - DNA, 25 bp, Mus musculus
agcgactggggcagaagaaccaata

SEQ ID NO: 316532 - DNA, 25 bp, Mus musculus
agagcgcttccaagagggagcgact

SEQ ID NO: 316533 - DNA, 25 bp, Mus musculus
actggggcagaagaaccaatatggc

SEQ ID NO: 316534 - DNA, 25 bp, Mus musculus
aacacgcctgggtgcaaccagggca

SEQ ID NO: 316535 - DNA, 25 bp, Mus musculus
tccggaacgtcgagagcgcttccaa

SEQ ID NO: 316536 - DNA, 25 bp, Mus musculus
ccagagactccggaacgtcgagagc

SEQ ID NO: 316537 - DNA, 25 bp, Mus musculus
caggaagaaggccagagactccgga

SEQ ID NO: 316538 - DNA, 25 bp, Mus musculus
ggctcgccaacacgcctgggtgcaa

SEQ ID NO: 316539 - DNA, 25 bp, Mus musculus
cagacacacactggacgtcctgggg

SEQ ID NO: 316540 - DNA, 25 bp, Mus musculus
ttgcagacacacactggacgtcctg

SEQ ID NO: 316541 - DNA, 25 bp, Mus musculus
cggacctcaaatggaaggatgaccc

SEQ ID NO: 316542 - DNA, 25 bp, Mus musculus
gcgctcttaaccagctctggccgga

SEQ ID NO: 316543 - DNA, 25 bp, Mus musculus
agaagaaccaatatggcgggcggcc

SEQ ID NO: 316544 - DNA, 25 bp, Mus musculus
agctctggccggacctcaaatggaa

SEQ ID NO: 316545 - DNA, 25 bp, Mus musculus
tgctgcgtttcagtggcaacgtttg

SEQ ID NO: 316546 - DNA, 25 bp, Mus musculus
tcccttgagagaggagctaaggccc

SEQ ID NO: 316547 - DNA, 25 bp, Mus musculus
tttaggcagccacgttaggatcccg

SEQ ID NO: 316548 - DNA, 25 bp, Mus musculus
cgaagtgaaactaacccggctgctg

SEQ ID NO: 316549 - DNA, 25 bp, Mus musculus
cctcgcagagtggtcccttgagaga

SEQ ID NO: 316550 - DNA, 25 bp, Mus musculus
tggacgctaaggtgctttggacttg

SEQ ID NO: 316551 - DNA, 25 bp, Mus musculus
cagtcctaaggttccggcgagccaa

SEQ ID NO: 316552 - DNA, 25 bp, Mus musculus
gacgacagagcctgcaccagtccta

SEQ ID NO: 316553 - DNA, 25 bp, Mus musculus
aaatcaaccttcgagcagcctgggc

SEQ ID NO: 316554 - DNA, 25 bp, Mus musculus
cgctccaatgacagcacctaaaggg

SEQ ID NO: 316555 - DNA, 25 bp, Mus musculus
gccctgaggccgtacagccatggcg

SEQ ID NO: 316556 - DNA, 25 bp, Mus musculus
gggttgactactaaacaaagcctgc

SEQ ID NO: 316557 - DNA, 25 bp, Mus musculus
cggcccgcccagagagattcctgtg

SEQ ID NO: 316558 - DNA, 25 bp, Mus musculus
cgccatcggagatgctcggtcactg

SEQ ID NO: 316559 - DNA, 25 bp, Mus musculus
tggccaggccaatcccaaagcagga

SEQ ID NO: 316560 - DNA, 25 bp, Mus musculus
tttacagtcacgagagaaaaagacc

SEQ ID NO: 316561 - DNA, 25 bp, Mus musculus
agtcacgagagaaaaagaccaatcg

SEQ ID NO: 316562 - DNA, 25 bp, Mus musculus
agcaggatttacagtcacgagagaa

SEQ ID NO: 316563 - DNA, 25 bp, Mus musculus
tcccaaagcaggatttacagtcacg

SEQ ID NO: 316564 - DNA, 25 bp, Mus musculus
caggccaatcccaaagcaggattta

SEQ ID NO: 316565 - DNA, 25 bp, Mus musculus
tgggcgtggccaggccaatcccaaa

SEQ ID NO: 316566 - DNA, 25 bp, Mus musculus
tacgaacgatgtatgggcgtggcca

SEQ ID NO: 316567 - DNA, 25 bp, Mus musculus
tctacgaacgatgtatgggcgtggc

SEQ ID NO: 316568 - DNA, 25 bp, Mus musculus
acagtgatccggtggcgacctggac

SEQ ID NO: 316569 - DNA, 25 bp, Mus musculus
cggtaacagtgatccggtggcgacc

SEQ ID NO: 316570 - DNA, 25 bp, Mus musculus
actaggcgcggtcgcctgggaccaa

SEQ ID NO: 316571 - DNA, 25 bp, Mus musculus
agaccaatcgaaatccggggcggcg

SEQ ID NO: 316572 - DNA, 25 bp, Mus musculus
cctgggaccaagcagccgggatgta

SEQ ID NO: 316573 - DNA, 25 bp, Mus musculus
gacgctctgtaactgccccgatttt

SEQ ID NO: 316574 - DNA, 25 bp, Mus musculus
cgattttgtccttccggactgaaga

SEQ ID NO: 316575 - DNA, 25 bp, Mus musculus
tccggactgaagacaccaggcgagc

SEQ ID NO: 316576 - DNA, 25 bp, Mus musculus
agacaccaggcgagccggtgcaaaa

SEQ ID NO: 316577 - DNA, 25 bp, Mus musculus
gcccaagggtcgacaggtcgccgat

SEQ ID NO: 316578 - DNA, 25 bp, Mus musculus
acaggtcgccgatgtccgggtattg

SEQ ID NO: 316579 - DNA, 25 bp, Mus musculus
ggaggcccagccaccagaaggttaa

SEQ ID NO: 316580 - DNA, 25 bp, Mus musculus
caccgaagtgatgcccacagactgc

SEQ ID NO: 316581 - DNA, 25 bp, Mus musculus
ccagaaggttaacagccagaggata

SEQ ID NO: 316582 - DNA, 25 bp, Mus musculus
agccagaggatacgcgtagagactc

SEQ ID NO: 316583 - DNA, 25 bp, Mus musculus
acgcgtagagactccagggtgaccc

SEQ ID NO: 316584 - DNA, 25 bp, Mus musculus
ggtcccttgctgaacttctttctcc

SEQ ID NO: 316585 - DNA, 25 bp, Mus musculus
caccattcccggcaccgaagtgatg

SEQ ID NO: 316586 - DNA, 25 bp, Mus musculus
aagtgatgcccacagactgcgccca

SEQ ID NO: 316587 - DNA, 25 bp, Mus musculus
ggatcaagtttcaggccgcgctaga

SEQ ID NO: 316588 - DNA, 25 bp, Mus musculus
cctctgagtcgcgagtggagtccag

SEQ ID NO: 316589 - DNA, 25 bp, Mus musculus
tccagagagaggcacctctgagtcg

SEQ ID NO: 316590 - DNA, 25 bp, Mus musculus
ctatcgcgtagggtggcaaagacag

SEQ ID NO: 316591 - DNA, 25 bp, Mus musculus
cttggggtgagaagtctatcgcgta

SEQ ID NO: 316592 - DNA, 25 bp, Mus musculus
agcgggatctaaggccgagctgtac

SEQ ID NO: 316593 - DNA, 25 bp, Mus musculus
tccgacacgggatcaagtttcaggc

SEQ ID NO: 316594 - DNA, 25 bp, Mus musculus
gcctggtgtttacatactgtccttc

SEQ ID NO: 316595 - DNA, 25 bp, Mus musculus
tagctgagccaacagggaaggcaga

SEQ ID NO: 316596 - DNA, 25 bp, Mus musculus
gcggcggctccaattagctgagcca

SEQ ID NO: 316597 - DNA, 25 bp, Mus musculus
gaaaattcaacaagaggccgccaca

SEQ ID NO: 316598 - DNA, 25 bp, Mus musculus
ctgaacggttgcgatctagaaaatt

SEQ ID NO: 316599 - DNA, 25 bp, Mus musculus
cgcaggcagccacgactgaacggtt

SEQ ID NO: 316600 - DNA, 25 bp, Mus musculus
ctcgtggtcacagctagcgtagccc

SEQ ID NO: 316601 - DNA, 25 bp, Mus musculus
gcgggcaagcttggcacacgcgcac

SEQ ID NO: 316602 - DNA, 25 bp, Mus musculus
agggtcccacgcaccgaagatcgca

SEQ ID NO: 316603 - DNA, 25 bp, Mus musculus
tgcttcccagcctttggggcccagg

SEQ ID NO: 316604 - DNA, 25 bp, Mus musculus
cgcaccgaagatcgcagactgaacc

SEQ ID NO: 316605 - DNA, 25 bp, Mus musculus
atcgcagactgaaccaggaggcggc

SEQ ID NO: 316606 - DNA, 25 bp, Mus musculus
gccaggcgccctgaggaccagaggc

SEQ ID NO: 316607 - DNA, 25 bp, Mus musculus
ctccggccgtgagctgcgtgtgcat

SEQ ID NO: 316608 - DNA, 25 bp, Mus musculus
gctgcgtgtgcatccccaagcagga

SEQ ID NO: 316609 - DNA, 25 bp, Mus musculus
ccaagcaggaccattgatgggcgcc

SEQ ID NO: 316610 - DNA, 25 bp, Mus musculus
caggaccattgatgggcgcccgctt

SEQ ID NO: 316611 - DNA, 25 bp, Mus musculus
cgcccgcttcgggaaaactcaatgg

SEQ ID NO: 316612 - DNA, 25 bp, Mus musculus
ccgcttcgggaaaactcaatggaga

SEQ ID NO: 316613 - DNA, 25 bp, Mus musculus
cttcgggaaaactcaatggagaagg

SEQ ID NO: 316614 - DNA, 25 bp, Mus musculus
tggctctaaggaccgccaggcgccc

SEQ ID NO: 316615 - DNA, 25 bp, Mus musculus
cgctcgcgctcatttgctcatcgtg

SEQ ID NO: 316616 - DNA, 25 bp, Mus musculus
ggagcaagatccctcgaccgaggtc

SEQ ID NO: 316617 - DNA, 25 bp, Mus musculus
atcgtacagcactcgcgccttggta

SEQ ID NO: 316618 - DNA, 25 bp, Mus musculus
ttgaaatttcatgccctcgctcgcg

SEQ ID NO: 316619 - DNA, 25 bp, Mus musculus
gaggattgctctagggtagtcacca

SEQ ID NO: 316620 - DNA, 25 bp, Mus musculus
gtcaggctcgaagcacagcactttc

SEQ ID NO: 316621 - DNA, 25 bp, Mus musculus
tcgttacaaaagcagaggcctcagg

SEQ ID NO: 316622 - DNA, 25 bp, Mus musculus
tcctacaccggtcgccgggattggc

SEQ ID NO: 316623 - DNA, 25 bp, Mus musculus
gcggaagcatcacgggtcctttcta

SEQ ID NO: 316624 - DNA, 25 bp, Mus musculus
tttctagttagggaagtcgcgcgcc

SEQ ID NO: 316625 - DNA, 25 bp, Mus musculus
tgtccaggactccaggccacttgtc

SEQ ID NO: 316626 - DNA, 25 bp, Mus musculus
gcggcaccttggcatcgtacagcac

SEQ ID NO: 316627 - DNA, 25 bp, Mus musculus
gaggcctcaggcgacagtcctccta

SEQ ID NO: 316628 - DNA, 25 bp, Mus musculus
accgaggtcttccagcagaccgttc

SEQ ID NO: 316629 - DNA, 25 bp, Mus musculus
ggagtcagcaccttcgggctacccg

SEQ ID NO: 316630 - DNA, 25 bp, Mus musculus
tccacagctcttagcagagggtctc

SEQ ID NO: 316631 - DNA, 25 bp, Mus musculus
gcctgctgcacagtgtcttctcctg

SEQ ID NO: 316632 - DNA, 25 bp, Mus musculus
ctcggccaagggattctccaaaagg

SEQ ID NO: 316633 - DNA, 25 bp, Mus musculus
tccgagacctctgtgctcgtctttt

SEQ ID NO: 316634 - DNA, 25 bp, Mus musculus
ctggacccagctctgatcggtggct

SEQ ID NO: 316635 - DNA, 25 bp, Mus musculus
atggcctgggacttgccttctgtcc

SEQ ID NO: 316636 - DNA, 25 bp, Mus musculus
tctcggttcccgcttagcttcttct

SEQ ID NO: 316637 - DNA, 25 bp, Mus musculus
ggctacccggttccagactccgaga

SEQ ID NO: 316638 - DNA, 25 bp, Mus musculus
agaaaagtcgccttctggcagcttc

SEQ ID NO: 316639 - DNA, 25 bp, Mus musculus
ggcagcttccactttgactacgagg

SEQ ID NO: 316640 - DNA, 25 bp, Mus musculus
ctacgaggtcccactgagtcgcagt

SEQ ID NO: 316641 - DNA, 25 bp, Mus musculus
tcgcagtggtctcaagaagagcatg

SEQ ID NO: 316642 - DNA, 25 bp, Mus musculus
tccaaaaggaagctgcgccagacgc

SEQ ID NO: 316643 - DNA, 25 bp, Mus musculus
accagtgttgccttcccgtctatgc

SEQ ID NO: 316644 - DNA, 25 bp, Mus musculus
tcgaaccgcccagccgaagtcgctc

SEQ ID NO: 316645 - DNA, 25 bp, Mus musculus
tcgctcggctgcacccgcggttttt

SEQ ID NO: 316646 - DNA, 25 bp, Mus musculus
gggtcaccgctaacgtccggtcaca

SEQ ID NO: 316647 - DNA, 25 bp, Mus musculus
taacgtccggtcacagccggcgttc

SEQ ID NO: 316648 - DNA, 25 bp, Mus musculus
cagccggcgttctcgggcgccgtta

SEQ ID NO: 316649 - DNA, 25 bp, Mus musculus
ttccgggagcacgaggcaagctcgc

SEQ ID NO: 316650 - DNA, 25 bp, Mus musculus
gtaagccgctcagggtgagaagtta

SEQ ID NO: 316651 - DNA, 25 bp, Mus musculus
gagcgcgtcaacctgcccagccgaa

SEQ ID NO: 316652 - DNA, 25 bp, Mus musculus
agtcacctcgccgactgtcccgcgc

SEQ ID NO: 316653 - DNA, 25 bp, Mus musculus
tgttgccttcccgtctatgcgcgtc

SEQ ID NO: 316654 - DNA, 25 bp, Mus musculus
aggaagccaccagtgttgccttccc

SEQ ID NO: 316655 - DNA, 25 bp, Mus musculus
agtctccgctccgacttgtcccgcg

SEQ ID NO: 316656 - DNA, 25 bp, Mus musculus
gcaccgcggtctgcacagtgcaccg

SEQ ID NO: 316657 - DNA, 25 bp, Mus musculus
aatggtatctgctgctccgctgaca

SEQ ID NO: 316658 - DNA, 25 bp, Mus musculus
acgagctccagtacaccatattcac

SEQ ID NO: 316659 - DNA, 25 bp, Mus musculus
ccatattcaccggacaagccaatgt

SEQ ID NO: 316660 - DNA, 25 bp, Mus musculus
caagccaatgttgtcagtgagtatc

SEQ ID NO: 316661 - DNA, 25 bp, Mus musculus
gtcagtgagtatctctcggctgatt

SEQ ID NO: 316662 - DNA, 25 bp, Mus musculus
gtggtctcctacgagctccagtaca

SEQ ID NO: 316663 - DNA, 25 bp, Mus musculus
tccaaattgtcgtcctaatggtatc

SEQ ID NO: 316664 - DNA, 25 bp, Mus musculus
ttagagaagagctctgcaccgcttc

SEQ ID NO: 316665 - DNA, 25 bp, Mus musculus
tcggctgattcccttccgcgttcga

SEQ ID NO: 316666 - DNA, 25 bp, Mus musculus
cgacagtcgaatacctccaaattgt

SEQ ID NO: 316667 - DNA, 25 bp, Mus musculus
tccactggacctcagaggacgagtt

SEQ ID NO: 316668 - DNA, 25 bp, Mus musculus
ccctcccgcgattagagaagagctc

SEQ ID NO: 316669 - DNA, 25 bp, Mus musculus
cgctgacatgcgtgtgatgtccaca

SEQ ID NO: 316670 - DNA, 25 bp, Mus musculus
aggacgagttcagcgtggtctccta

SEQ ID NO: 316671 - DNA, 25 bp, Mus musculus
tgttcatcgacagcggccgtcacta

SEQ ID NO: 316672 - DNA, 25 bp, Mus musculus
cgcgacgagtcgtcctctaagaaga

SEQ ID NO: 316673 - DNA, 25 bp, Mus musculus
ggtgtcccacgacaacctgactgtc

SEQ ID NO: 316674 - DNA, 25 bp, Mus musculus
cggctcatcgcaagctgaaggtgtc

SEQ ID NO: 316675 - DNA, 25 bp, Mus musculus
agactggatcccaaatcggctcatc

SEQ ID NO: 316676 - DNA, 25 bp, Mus musculus
ctcgccttcaggtcagccgtttaga

SEQ ID NO: 316677 - DNA, 25 bp, Mus musculus
tccagtcaaccgtgctcttggtgtc

SEQ ID NO: 316678 - DNA, 25 bp, Mus musculus
atcgaggttctcaattggggccttc

SEQ ID NO: 316679 - DNA, 25 bp, Mus musculus
tgaggttacgctccctgtcatcttt

SEQ ID NO: 316680 - DNA, 25 bp, Mus musculus
tcagcccttgtttcagactcttaaa

SEQ ID NO: 316681 - DNA, 25 bp, Mus musculus
tgtcggcatttaggcagctctctcc

SEQ ID NO: 316682 - DNA, 25 bp, Mus musculus
gatggctcaccactctttgcatatg

SEQ ID NO: 316683 - DNA, 25 bp, Mus musculus
tttcaaagcatctacgcgcacgttc

SEQ ID NO: 316684 - DNA, 25 bp, Mus musculus
tggtcaccagcggaagcacatggta

SEQ ID NO: 316685 - DNA, 25 bp, Mus musculus
gactgtacggagcagcgaccttgag

SEQ ID NO: 316686 - DNA, 25 bp, Mus musculus
cgagcaaatctcaccgacaggcgat

SEQ ID NO: 316687 - DNA, 25 bp, Mus musculus
ttttctcggcaggtacgccatcggc

SEQ ID NO: 316688 - DNA, 25 bp, Mus musculus
cctggcgtacagatcggcgccgaaa

SEQ ID NO: 316689 - DNA, 25 bp, Mus musculus
ccgacaggcgatgtgattttctttt

SEQ ID NO: 316690 - DNA, 25 bp, Mus musculus
ctgccacaaccactgggcggtgcga

SEQ ID NO: 316691 - DNA, 25 bp, Mus musculus
tcggcgtcctgctggactacgacaa

SEQ ID NO: 316692 - DNA, 25 bp, Mus musculus
tggactacgacaacggctccatcgc

SEQ ID NO: 316693 - DNA, 25 bp, Mus musculus
cttcaccgtgtggaacaagtgtctg

SEQ ID NO: 316694 - DNA, 25 bp, Mus musculus
catcccggaccatctggactgtacg

SEQ ID NO: 316695 - DNA, 25 bp, Mus musculus
atcggcgccgaaacacgagtggatc

SEQ ID NO: 316696 - DNA, 25 bp, Mus musculus
gccgctgtttatggggtcgagaaac

SEQ ID NO: 316697 - DNA, 25 bp, Mus musculus
gagaaactcaggcttccagagcgtc

SEQ ID NO: 316698 - DNA, 25 bp, Mus musculus
aagtgtctgaccatcgtcacgggtc

SEQ ID NO: 316699 - DNA, 25 bp, Mus musculus
ctggcttctagtgccgccaggtgtg

SEQ ID NO: 316700 - DNA, 25 bp, Mus musculus
ctagctgcgcccaccgtactgagca

SEQ ID NO: 316701 - DNA, 25 bp, Mus musculus
ttcagggcaccgactcgaacttagg

SEQ ID NO: 316702 - DNA, 25 bp, Mus musculus
tcgtggtccttgtcggactcgggct

SEQ ID NO: 316703 - DNA, 25 bp, Mus musculus
gtgggtccggctgctgcaccgacat

SEQ ID NO: 316704 - DNA, 25 bp, Mus musculus
tgctgcaccgacatggtcctgcgca

SEQ ID NO: 316705 - DNA, 25 bp, Mus musculus
ccgacatggtcctgcgcaggtggtt

SEQ ID NO: 316706 - DNA, 25 bp, Mus musculus
cagaaattctggctgcgcgtgcagc

SEQ ID NO: 316707 - DNA, 25 bp, Mus musculus
cgcgtgcagcccaaagctgcccttg

SEQ ID NO: 316708 - DNA, 25 bp, Mus musculus
gctgcccttgcgcaggatcatgcgc

SEQ ID NO: 316709 - DNA, 25 bp, Mus musculus
gatcatgcgcgagttgttcttcttg

SEQ ID NO: 316710 - DNA, 25 bp, Mus musculus
atgcgcgagttgttcttcttggggc

SEQ ID NO: 316711 - DNA, 25 bp, Mus musculus
cggtggctggcttctagtgccgcca

SEQ ID NO: 316712 - DNA, 25 bp, Mus musculus
ccgccaggtgtgctgcgtagccttc

SEQ ID NO: 316713 - DNA, 25 bp, Mus musculus
ttcacgttcagagctgagacagggg

SEQ ID NO: 316714 - DNA, 25 bp, Mus musculus
acaggcctggcctgcggaatccctg

SEQ ID NO: 316715 - DNA, 25 bp, Mus musculus
aggagcaccacggatccacagccgg

SEQ ID NO: 316716 - DNA, 25 bp, Mus musculus
ggcctgcggaatccctgagctgaca

SEQ ID NO: 316717 - DNA, 25 bp, Mus musculus
ttcacgttcacgttcagagctgaga

SEQ ID NO: 316718 - DNA, 25 bp, Mus musculus
ctgcctcagacaggcgttcacgttc

SEQ ID NO: 316719 - DNA, 25 bp, Mus musculus
agtcacttagcatcactcacggtca

SEQ ID NO: 316720 - DNA, 25 bp, Mus musculus
tttcattgattcgtctcaggcggga

SEQ ID NO: 316721 - DNA, 25 bp, Mus musculus
gcccgcgctcttcatttcattgatt

SEQ ID NO: 316722 - DNA, 25 bp, Mus musculus
ccgcacacagcgtgaacgaccagga

SEQ ID NO: 316723 - DNA, 25 bp, Mus musculus
ccagccctaggtagcgcagtgagtt

SEQ ID NO: 316724 - DNA, 25 bp, Mus musculus
tagcgcagtgagttcccggcacggc

SEQ ID NO: 316725 - DNA, 25 bp, Mus musculus
tctcaggcgggaaatcccgcggctg

SEQ ID NO: 316726 - DNA, 25 bp, Mus musculus
gggcctggccgcacagacacagaga

SEQ ID NO: 316727 - DNA, 25 bp, Mus musculus
aaatctgccggctttctgggcactg

SEQ ID NO: 316728 - DNA, 25 bp, Mus musculus
ggagccctgacttcctgggccgcag

SEQ ID NO: 316729 - DNA, 25 bp, Mus musculus
acccagggcgcaagagcaaatcgtg

SEQ ID NO: 316730 - DNA, 25 bp, Mus musculus
agagcaaatcgtgctccgcggcggc

SEQ ID NO: 316731 - DNA, 25 bp, Mus musculus
gccacgcttgcagctgaaaatcaac

SEQ ID NO: 316732 - DNA, 25 bp, Mus musculus
cagctgaaaatcaacaaagggaggc

SEQ ID NO: 316733 - DNA, 25 bp, Mus musculus
ggctgctgtggaataataaaaaata

SEQ ID NO: 316734 - DNA, 25 bp, Mus musculus
cactgggtttccgtgcggctgcagc

SEQ ID NO: 316735 - DNA, 25 bp, Mus musculus
ggaagagaaaggtctgcagctgaca

SEQ ID NO: 316736 - DNA, 25 bp, Mus musculus
tgcagctgacaaatattatccattc

SEQ ID NO: 316737 - DNA, 25 bp, Mus musculus
ccatcgatcgcggagtgtacagatg

SEQ ID NO: 316738 - DNA, 25 bp, Mus musculus
tgtacagatgtgagcgcttgatgtg

SEQ ID NO: 316739 - DNA, 25 bp, Mus musculus
agatgtgagcgcttgatgtgcccgc

SEQ ID NO: 316740 - DNA, 25 bp, Mus musculus
ctcgctggctgctgtggaataataa

SEQ ID NO: 316741 - DNA, 25 bp, Mus musculus
taaatgattgtcctccgctccgctc

SEQ ID NO: 316742 - DNA, 25 bp, Mus musculus
ttcggcccataatcgcagacacgca

SEQ ID NO: 316743 - DNA, 25 bp, Mus musculus
gccgccgctagaagtcgtccatcag

SEQ ID NO: 316744 - DNA, 25 bp, Mus musculus
acctcgccgtctgtcacttaaatga

SEQ ID NO: 316745 - DNA, 25 bp, Mus musculus
ccaacctgccagtgataatgtgcga

SEQ ID NO: 316746 - DNA, 25 bp, Mus musculus
caggcagttgcaatcagtttccgaa

SEQ ID NO: 316747 - DNA, 25 bp, Mus musculus
ttccgaaaggtcagccaaggtcctc

SEQ ID NO: 316748 - DNA, 25 bp, Mus musculus
tctcgcagacggaaggcattacgga

SEQ ID NO: 316749 - DNA, 25 bp, Mus musculus
ggaaccgcttttgtatttgcaggca

SEQ ID NO: 316750 - DNA, 25 bp, Mus musculus
gacctaggcccttcgtgttccgatg

SEQ ID NO: 316751 - DNA, 25 bp, Mus musculus
ctctcccgacatgcgtaagtggtga

SEQ ID NO: 316752 - DNA, 25 bp, Mus musculus
accttgtaaagcgagcgaatcaccg

SEQ ID NO: 316753 - DNA, 25 bp, Mus musculus
tcaccgcacggtgtctgaagacgct

SEQ ID NO: 316754 - DNA, 25 bp, Mus musculus
agggcttaaccaggccgctcaactg

SEQ ID NO: 316755 - DNA, 25 bp, Mus musculus
gccgccatcttgaccgggaggcgca

SEQ ID NO: 316756 - DNA, 25 bp, Mus musculus
ccagcacggccagcacagagcgttt

SEQ ID NO: 316757 - DNA, 25 bp, Mus musculus
ttctccgctgcggagacagccagca

SEQ ID NO: 316758 - DNA, 25 bp, Mus musculus
cacctcttgttctccgctgcggaga

SEQ ID NO: 316759 - DNA, 25 bp, Mus musculus
taattccacctcttgttctccgctg

SEQ ID NO: 316760 - DNA, 25 bp, Mus musculus
tcagtgcgggttttaattccacctc

SEQ ID NO: 316761 - DNA, 25 bp, Mus musculus
ccgagtcgtcagtgcgggttttaat

SEQ ID NO: 316762 - DNA, 25 bp, Mus musculus
agctgcgaccctcagggaagccgca

SEQ ID NO: 316763 - DNA, 25 bp, Mus musculus
ggcgacagaagagctgcgaccctca

SEQ ID NO: 316764 - DNA, 25 bp, Mus musculus
cccacaggcgacagaagagctgcga

SEQ ID NO: 316765 - DNA, 25 bp, Mus musculus
cggccagcacagagcgtttggtccc

SEQ ID NO: 316766 - DNA, 25 bp, Mus musculus
catcttgaccgggaggcgcaggccc

SEQ ID NO: 316767 - DNA, 25 bp, Mus musculus
ccggcggtggctccatagagccaca

SEQ ID NO: 316768 - DNA, 25 bp, Mus musculus
ccatagagccacaggctttggtgga

SEQ ID NO: 316769 - DNA, 25 bp, Mus musculus
ggctccaggcgcttagtgccttctg

SEQ ID NO: 316770 - DNA, 25 bp, Mus musculus
ggcgcttagtgccttctggcctacc

SEQ ID NO: 316771 - DNA, 25 bp, Mus musculus
cgccctgcgttgtcagctgaacata

SEQ ID NO: 316772 - DNA, 25 bp, Mus musculus
tgtcagctgaacataatgcaaatta

SEQ ID NO: 316773 - DNA, 25 bp, Mus musculus
tgccttccgggaccatgagcacgga

SEQ ID NO: 316774 - DNA, 25 bp, Mus musculus
agggcggcctctcgcctttcattac

SEQ ID NO: 316775 - DNA, 25 bp, Mus musculus
ttaccgggcctacgaaagcagcagc

SEQ ID NO: 316776 - DNA, 25 bp, Mus musculus
cctacgaaagcagcagcccaggcaa

SEQ ID NO: 316777 - DNA, 25 bp, Mus musculus
caaattatttatgggctgtctgcgc

SEQ ID NO: 316778 - DNA, 25 bp, Mus musculus
gcccaggcaaatatgtagctattaa

SEQ ID NO: 316779 - DNA, 25 bp, Mus musculus
tattaaaattaatcgccctgcgttg

SEQ ID NO: 316780 - DNA, 25 bp, Mus musculus
ggctgtctgcgcaatatttatcatc

SEQ ID NO: 316781 - DNA, 25 bp, Mus musculus
atttatcatcgtgcaggctccaggc

SEQ ID NO: 316782 - DNA, 25 bp, Mus musculus
cccgcggaggccgaagatgaacgca

SEQ ID NO: 316783 - DNA, 25 bp, Mus musculus
aagaccggagcttctggaggcgcca

SEQ ID NO: 316784 - DNA, 25 bp, Mus musculus
gcatctagccagacccaccggagga

SEQ ID NO: 316785 - DNA, 25 bp, Mus musculus
acaatcgccgcgagctttcgaagca

SEQ ID NO: 316786 - DNA, 25 bp, Mus musculus
tttcgaagcaccagagcgagccagg

SEQ ID NO: 316787 - DNA, 25 bp, Mus musculus
taatcgggctggattgagggcaaac

SEQ ID NO: 316788 - DNA, 25 bp, Mus musculus
ttgagggcaaacaaccggatccagc

SEQ ID NO: 316789 - DNA, 25 bp, Mus musculus
aactgggctctccagctccaagcag

SEQ ID NO: 316790 - DNA, 25 bp, Mus musculus
ctccaagcaggggagcttagctcag

SEQ ID NO: 316791 - DNA, 25 bp, Mus musculus
acgaaccagtcaccaccgcgggtgg

SEQ ID NO: 316792 - DNA, 25 bp, Mus musculus
ctggcgcctcaagtggagagaagac

SEQ ID NO: 316793 - DNA, 25 bp, Mus musculus
ggtggccgtttacctaagcctcaca

SEQ ID NO: 316794 - DNA, 25 bp, Mus musculus
aagcctcacaggaccactgaagata

SEQ ID NO: 316795 - DNA, 25 bp, Mus musculus
aggagttcctgagcaatcggctacc

SEQ ID NO: 316796 - DNA, 25 bp, Mus musculus
ctgaagataggcgataaggagttcc

SEQ ID NO: 316797 - DNA, 25 bp, Mus musculus
ctcacggcgtccaacttttgaatgg

SEQ ID NO: 316798 - DNA, 25 bp, Mus musculus
ccagagagatttcttgcacgctgcg

SEQ ID NO: 316799 - DNA, 25 bp, Mus musculus
cccgcgccagagagatttcttgcac

SEQ ID NO: 316800 - DNA, 25 bp, Mus musculus
tgaggcgttgctgctgccggttccc

SEQ ID NO: 316801 - DNA, 25 bp, Mus musculus
cactcgggttcagagctgaggcgtt

SEQ ID NO: 316802 - DNA, 25 bp, Mus musculus
gcccggacgcgtacactcgggttca

SEQ ID NO: 316803 - DNA, 25 bp, Mus musculus
aggcatcgctgggttttccgcaacc

SEQ ID NO: 316804 - DNA, 25 bp, Mus musculus
ccggagctttgcgtgcagtcacact

SEQ ID NO: 316805 - DNA, 25 bp, Mus musculus
cgaagcagactgcagccaagtgtgc

SEQ ID NO: 316806 - DNA, 25 bp, Mus musculus
caacttttgaatgggctagcgggtg

SEQ ID NO: 316807 - DNA, 25 bp, Mus musculus
agccgctcacggtgtcgaaggtaag

SEQ ID NO: 316808 - DNA, 25 bp, Mus musculus
gtccttccagtacgtcccggtgcag

SEQ ID NO: 316809 - DNA, 25 bp, Mus musculus
gcttggagcactgcgagccgctcac

SEQ ID NO: 316810 - DNA, 25 bp, Mus musculus
ccacttggcgacttggccagccgga

SEQ ID NO: 316811 - DNA, 25 bp, Mus musculus
tcgcgctccagggtcatagttaaag

SEQ ID NO: 316812 - DNA, 25 bp, Mus musculus
tgcaccagtcctagcttcgagacta

SEQ ID NO: 316813 - DNA, 25 bp, Mus musculus
gaagagccacccttcctcaactggg

SEQ ID NO: 316814 - DNA, 25 bp, Mus musculus
cgcaagagtattacgcgccactttg

SEQ ID NO: 316815 - DNA, 25 bp, Mus musculus
tcagatctgagcatcgtggactccc

SEQ ID NO: 316816 - DNA, 25 bp, Mus musculus
ctccgcgtggatcaagctcttgcta

SEQ ID NO: 316817 - DNA, 25 bp, Mus musculus
ctgttccagccgttccgggatttgc

SEQ ID NO: 316818 - DNA, 25 bp, Mus musculus
gactcaggcaaggatggctgttcca

SEQ ID NO: 316819 - DNA, 25 bp, Mus musculus
gtgcgcgccactgactcacatcttg

SEQ ID NO: 316820 - DNA, 25 bp, Mus musculus
ggcccaaagtggctagctcgctctc

SEQ ID NO: 316821 - DNA, 25 bp, Mus musculus
tgcaggtggtttctctccagtatcc

SEQ ID NO: 316822 - DNA, 25 bp, Mus musculus
ttgtgcacgtgtacggcccaatcca

SEQ ID NO: 316823 - DNA, 25 bp, Mus musculus
cctaagggttcttggcaggtgacca

SEQ ID NO: 316824 - DNA, 25 bp, Mus musculus
gctgagagcgacaccaaagttccta

SEQ ID NO: 316825 - DNA, 25 bp, Mus musculus
gcaaggcggaggtcactgcaaaata

SEQ ID NO: 316826 - DNA, 25 bp, Mus musculus
cggaaggcaagcgagacaacgcttt

SEQ ID NO: 316827 - DNA, 25 bp, Mus musculus
actgcaaaatagaatcggacactcg

SEQ ID NO: 316828 - DNA, 25 bp, Mus musculus
agatacgggttctctggaattgggc

SEQ ID NO: 316829 - DNA, 25 bp, Mus musculus
gccttccacccgctgaggagatacg

SEQ ID NO: 316830 - DNA, 25 bp, Mus musculus
tctgcagcccaagcgggctagcctt

SEQ ID NO: 316831 - DNA, 25 bp, Mus musculus
aagtgccggaaaaatctgcagccca

SEQ ID NO: 316832 - DNA, 25 bp, Mus musculus
gcgcgcatagcaccggacggctctt

SEQ ID NO: 316833 - DNA, 25 bp, Mus musculus
gcctcaaggagaaagagcgacgctg

SEQ ID NO: 316834 - DNA, 25 bp, Mus musculus
cggattccatctttggcctcaagga

SEQ ID NO: 316835 - DNA, 25 bp, Mus musculus
gacgaaccttcgcattcggattcca

SEQ ID NO: 316836 - DNA, 25 bp, Mus musculus
cagctaactggaaagacgaaccttc

SEQ ID NO: 316837 - DNA, 25 bp, Mus musculus
ctgggtggctcaacacagctaactg

SEQ ID NO: 316838 - DNA, 25 bp, Mus musculus
caacgctttggctctggcgagctga

SEQ ID NO: 316839 - DNA, 25 bp, Mus musculus
cctcactgtgggctttcgagaacct

SEQ ID NO: 316840 - DNA, 25 bp, Mus musculus
acacccgggagtaagcctcactgtg

SEQ ID NO: 316841 - DNA, 25 bp, Mus musculus
ttcgagaacctgcaaccagtggggc

SEQ ID NO: 316842 - DNA, 25 bp, Mus musculus
cccttcatctcgtgaccggtcgttg

SEQ ID NO: 316843 - DNA, 25 bp, Mus musculus
gcagagcatgccattcatcacgttc

SEQ ID NO: 316844 - DNA, 25 bp, Mus musculus
ccaattgctgacgtcgaccaggcta

SEQ ID NO: 316845 - DNA, 25 bp, Mus musculus
gaccaggctacgtctcgctcgtgta

SEQ ID NO: 316846 - DNA, 25 bp, Mus musculus
gtcactcggtcgagctgcagtgctc

SEQ ID NO: 316847 - DNA, 25 bp, Mus musculus
cgtcccttttcgtgtggctcatctc

SEQ ID NO: 316848 - DNA, 25 bp, Mus musculus
cttcagcaaccgtggcaccatggct

SEQ ID NO: 316849 - DNA, 25 bp, Mus musculus
caccatggctgtgctggtcgttctc

SEQ ID NO: 316850 - DNA, 25 bp, Mus musculus
tcttcggggttctggaccttgatct

SEQ ID NO: 316851 - DNA, 25 bp, Mus musculus
gagaccttgtcttggagcggctaaa

SEQ ID NO: 316852 - DNA, 25 bp, Mus musculus
ccgaagcctgggttgaaaatcgtca

SEQ ID NO: 316853 - DNA, 25 bp, Mus musculus
cgccttcggccggagcggactctcc

SEQ ID NO: 316854 - DNA, 25 bp, Mus musculus
atggatcagcgaccgcgggacatcc

SEQ ID NO: 316855 - DNA, 25 bp, Mus musculus
cggagggcagcgacagctccgaact

SEQ ID NO: 316856 - DNA, 25 bp, Mus musculus
agcgacagctccgaactgccgactg

SEQ ID NO: 316857 - DNA, 25 bp, Mus musculus
cagctccgaactgccgactggactg

SEQ ID NO: 316858 - DNA, 25 bp, Mus musculus
tccgaactgccgactggactgagga

SEQ ID NO: 316859 - DNA, 25 bp, Mus musculus
aactgccgactggactgaggagccg

SEQ ID NO: 316860 - DNA, 25 bp, Mus musculus
actgaggagccgtggacctgaccca

SEQ ID NO: 316861 - DNA, 25 bp, Mus musculus
agccgtggacctgacccagtgcagc

SEQ ID NO: 316862 - DNA, 25 bp, Mus musculus
acctgacccagtgcagcggggcaag

SEQ ID NO: 316863 - DNA, 25 bp, Mus musculus
atgcggtgtcccacgaggtgactgg

SEQ ID NO: 316864 - DNA, 25 bp, Mus musculus
cggtcactgtgcctccgcccacctg

SEQ ID NO: 316865 - DNA, 25 bp, Mus musculus
ctcacctgggccgagcgatccctcc

SEQ ID NO: 316866 - DNA, 25 bp, Mus musculus
gcccgccttggccatgtcccgggcg

SEQ ID NO: 316867 - DNA, 25 bp, Mus musculus
ggcagtgtcctgctttcacccagtt

SEQ ID NO: 316868 - DNA, 25 bp, Mus musculus
tccagacgtttagcgtcactgtgcg

SEQ ID NO: 316869 - DNA, 25 bp, Mus musculus
aacgtccagacgtttagcgtcactg

SEQ ID NO: 316870 - DNA, 25 bp, Mus musculus
ccacgcagcgcaggcgtagcccaac

SEQ ID NO: 316871 - DNA, 25 bp, Mus musculus
atgtcttactcctgaaggcggggcc

SEQ ID NO: 316872 - DNA, 25 bp, Mus musculus
caccaccatgtcttactcctgaagg

SEQ ID NO: 316873 - DNA, 25 bp, Mus musculus
tcacccagtttttgtactcggcgca

SEQ ID NO: 316874 - DNA, 25 bp, Mus musculus
ctatgaaaccttgcaggcagctgcg

SEQ ID NO: 316875 - DNA, 25 bp, Mus musculus
cacggtctatgaaaccttgcaggca

SEQ ID NO: 316876 - DNA, 25 bp, Mus musculus
aaggagagcacttcacggtctatga

SEQ ID NO: 316877 - DNA, 25 bp, Mus musculus
gtccacggtgaaaggagagcacttc

SEQ ID NO: 316878 - DNA, 25 bp, Mus musculus
gactgcagccagcagtccacggtga

SEQ ID NO: 316879 - DNA, 25 bp, Mus musculus
cgagttcggggtcagcagctcacct

SEQ ID NO: 316880 - DNA, 25 bp, Mus musculus
cagtttttgtactcggcgcaattga

SEQ ID NO: 316881 - DNA, 25 bp, Mus musculus
ggaagcttccgcgactgctcagcgg

SEQ ID NO: 316882 - DNA, 25 bp, Mus musculus
ttggcggagaaaccacccgtctctc

SEQ ID NO: 316883 - DNA, 25 bp, Mus musculus
gtcagtggtccctaagcgctctttt

SEQ ID NO: 316884 - DNA, 25 bp, Mus musculus
cggccgcgtcacagtaacgtcagtg

SEQ ID NO: 316885 - DNA, 25 bp, Mus musculus
ttccaaaggcaacctgcgaccgttc

SEQ ID NO: 316886 - DNA, 25 bp, Mus musculus
taagccggtatccagggctagctgc

SEQ ID NO: 316887 - DNA, 25 bp, Mus musculus
attcgatgagcgtgctaagccggta

SEQ ID NO: 316888 - DNA, 25 bp, Mus musculus
ggccgccactcaagtggggaagctt

SEQ ID NO: 316889 - DNA, 25 bp, Mus musculus
tctgaacaggaagccgagcccaagc

SEQ ID NO: 316890 - DNA, 25 bp, Mus musculus
ggcaaccgcctgagatgcggccctg

SEQ ID NO: 316891 - DNA, 25 bp, Mus musculus
cgcagcacttacaagtccgtcaaca

SEQ ID NO: 316892 - DNA, 25 bp, Mus musculus
ccgtcaacaccataagctccgagta

SEQ ID NO: 316893 - DNA, 25 bp, Mus musculus
ggttgtccagctgcactggggccat

SEQ ID NO: 316894 - DNA, 25 bp, Mus musculus
tatagcgtccatgttgctgggccga

SEQ ID NO: 316895 - DNA, 25 bp, Mus musculus
gagttcctagcgtccatcttcgacc

SEQ ID NO: 316896 - DNA, 25 bp, Mus musculus
ggggcctctttgcttccacactcgt

SEQ ID NO: 316897 - DNA, 25 bp, Mus musculus
agaggacccaaaaggaaggatgtcg

SEQ ID NO: 316898 - DNA, 25 bp, Mus musculus
gtctcgcggggcctctttgcttcca

SEQ ID NO: 316899 - DNA, 25 bp, Mus musculus
tttgcttccacactcgtctcagagg

SEQ ID NO: 316900 - DNA, 25 bp, Mus musculus
tgcttccacactcgtctcagaggac

SEQ ID NO: 316901 - DNA, 25 bp, Mus musculus
cacactcgtctcagaggacccaaaa

SEQ ID NO: 316902 - DNA, 25 bp, Mus musculus
ctcgtctcagaggacccaaaaggaa

SEQ ID NO: 316903 - DNA, 25 bp, Mus musculus
ctcagaggacccaaaaggaaggatg

SEQ ID NO: 316904 - DNA, 25 bp, Mus musculus
cggccacgctctgcgggtcgcggag

SEQ ID NO: 316905 - DNA, 25 bp, Mus musculus
atgtcgtcggggcttaaggccgagc

SEQ ID NO: 316906 - DNA, 25 bp, Mus musculus
ttcctagcgtccatcttcgaccagg

SEQ ID NO: 316907 - DNA, 25 bp, Mus musculus
tagcgtccatcttcgaccaggacca

SEQ ID NO: 316908 - DNA, 25 bp, Mus musculus
gtccatcttcgaccaggaccacgag

SEQ ID NO: 316909 - DNA, 25 bp, Mus musculus
gatgctcccaggttaggcccggtcc

SEQ ID NO: 316910 - DNA, 25 bp, Mus musculus
agcttgtctgagctcagcgcccgag

SEQ ID NO: 316911 - DNA, 25 bp, Mus musculus
gccatccgcagcctctcatattttt

SEQ ID NO: 316912 - DNA, 25 bp, Mus musculus
actaggggaaggtgaaactgccgct

SEQ ID NO: 316913 - DNA, 25 bp, Mus musculus
tctcatatttttgtccctcgccagc

SEQ ID NO: 316914 - DNA, 25 bp, Mus musculus
gtgtgtgcgtaagcggtcctccctt

SEQ ID NO: 316915 - DNA, 25 bp, Mus musculus
atcgagcttttgcatctcgtctccc

SEQ ID NO: 316916 - DNA, 25 bp, Mus musculus
ttttggactggcagggaaaatggct

SEQ ID NO: 316917 - DNA, 25 bp, Mus musculus
tgacgcaggagaaacgcaccgcccg

SEQ ID NO: 316918 - DNA, 25 bp, Mus musculus
cttcgtaggagactcccgggttgtg

SEQ ID NO: 316919 - DNA, 25 bp, Mus musculus
ttgtgtttggtgagtaccgagcccg

SEQ ID NO: 316920 - DNA, 25 bp, Mus musculus
ccgaacgccattactgaggtggagt

SEQ ID NO: 316921 - DNA, 25 bp, Mus musculus
gaaaatggctgacggctccggccct

SEQ ID NO: 316922 - DNA, 25 bp, Mus musculus
ggcctgttccacttgacaccgaacg

SEQ ID NO: 316923 - DNA, 25 bp, Mus musculus
gacgcagaaatttcagggcggattg

SEQ ID NO: 316924 - DNA, 25 bp, Mus musculus
ccttgtggcgcagctctttaagttc

SEQ ID NO: 316925 - DNA, 25 bp, Mus musculus
ctggttgattagtgacccgcaggtg

SEQ ID NO: 316926 - DNA, 25 bp, Mus musculus
ccgatttctcggtactcttcaggga

SEQ ID NO: 316927 - DNA, 25 bp, Mus musculus
tcctccgagtcggtatataaggtcg

SEQ ID NO: 316928 - DNA, 25 bp, Mus musculus
cccagtggctgtggtttggaaatta

SEQ ID NO: 316929 - DNA, 25 bp, Mus musculus
cccgagcacaatggcggcttttgtg

SEQ ID NO: 316930 - DNA, 25 bp, Mus musculus
gttctgctttttgccttcccgtctc

SEQ ID NO: 316931 - DNA, 25 bp, Mus musculus
tcatgtggcagtggaaaatgcgctc

SEQ ID NO: 316932 - DNA, 25 bp, Mus musculus
ctcagcagcggaagactccgatttc

SEQ ID NO: 316933 - DNA, 25 bp, Mus musculus
gtagaggcagcctttgctcagcagc

SEQ ID NO: 316934 - DNA, 25 bp, Mus musculus
cgcagttctcccgtgagagggcctt

SEQ ID NO: 316935 - DNA, 25 bp, Mus musculus
cgcggtgcgcttcaaagccgcagtt

SEQ ID NO: 316936 - DNA, 25 bp, Mus musculus
cccgagtggaaagttttgtgacgca

SEQ ID NO: 316937 - DNA, 25 bp, Mus musculus
taacccgggctagcgagctgaacta

SEQ ID NO: 316938 - DNA, 25 bp, Mus musculus
cttcaggtgcgtgactaagatttcc

SEQ ID NO: 316939 - DNA, 25 bp, Mus musculus
taagatttccggctcaggcgtgccc

SEQ ID NO: 316940 - DNA, 25 bp, Mus musculus
cttcctggcggggacgataagatag

SEQ ID NO: 316941 - DNA, 25 bp, Mus musculus
cgataagataggttgcggtggcact

SEQ ID NO: 316942 - DNA, 25 bp, Mus musculus
tggcactggtccagcgctggagctt

SEQ ID NO: 316943 - DNA, 25 bp, Mus musculus
ttcagcgccctctgatgggcaagcc

SEQ ID NO: 316944 - DNA, 25 bp, Mus musculus
ctagttttcgaaatccagagaggtg

SEQ ID NO: 316945 - DNA, 25 bp, Mus musculus
taaacgttcatactggggactcgtg

SEQ ID NO: 316946 - DNA, 25 bp, Mus musculus
accgaccgccaaggcacgctttgtg

SEQ ID NO: 316947 - DNA, 25 bp, Mus musculus
acgctttgtgcgcaggacccggaat

SEQ ID NO: 316948 - DNA, 25 bp, Mus musculus
acccggaatccggtacgagcctgca

SEQ ID NO: 316949 - DNA, 25 bp, Mus musculus
tgcgtcacgagtggttgctaacccg

SEQ ID NO: 316950 - DNA, 25 bp, Mus musculus
agtggctgtccaggtttcgcaagga

SEQ ID NO: 316951 - DNA, 25 bp, Mus musculus
gcctccatcgatctggaccggaatg

SEQ ID NO: 316952 - DNA, 25 bp, Mus musculus
caacctgacgcacgctcatttcgag

SEQ ID NO: 316953 - DNA, 25 bp, Mus musculus
ttcgacaatctcttccgccgggtgc

SEQ ID NO: 316954 - DNA, 25 bp, Mus musculus
tgcgcgagctcacggccttcgacaa

SEQ ID NO: 316955 - DNA, 25 bp, Mus musculus
tgcgctacctgcacgtgcggacctt

SEQ ID NO: 316956 - DNA, 25 bp, Mus musculus
cgcacaacggtgagctgcgctacct

SEQ ID NO: 316957 - DNA, 25 bp, Mus musculus
cttcaagggcctgccgcggttggcc

SEQ ID NO: 316958 - DNA, 25 bp, Mus musculus
gcctttggcacgctgccgtcgttgc

SEQ ID NO: 316959 - DNA, 25 bp, Mus musculus
aatggcctgcgcatcctgggcgagc

SEQ ID NO: 316960 - DNA, 25 bp, Mus musculus
tgcacctgcagccacgtggaacgtg

SEQ ID NO: 316961 - DNA, 25 bp, Mus musculus
aacgtggctgctcagtgcgctgtga

SEQ ID NO: 316962 - DNA, 25 bp, Mus musculus
agtttccgtgcgaggcggcctccat

SEQ ID NO: 316963 - DNA, 25 bp, Mus musculus
ggacctgctgctcaacgacaacctg

SEQ ID NO: 316964 - DNA, 25 bp, Mus musculus
tcatttcgagcgcagccgcatcgag

SEQ ID NO: 316965 - DNA, 25 bp, Mus musculus
tccaacctctggaagcagcagctta

SEQ ID NO: 316966 - DNA, 25 bp, Mus musculus
cagcttaagcgcattgggcggcaaa

SEQ ID NO: 316967 - DNA, 25 bp, Mus musculus
agggcgaaaacgcacaccaacttct

SEQ ID NO: 316968 - DNA, 25 bp, Mus musculus
gaccgtctggactgcacttcgctaa

SEQ ID NO: 316969 - DNA, 25 bp, Mus musculus
cgctaagaagccctagaaacctgtg

SEQ ID NO: 316970 - DNA, 25 bp, Mus musculus
gccgcttggcaaggaaacttcgatc

SEQ ID NO: 316971 - DNA, 25 bp, Mus musculus
aacttcgatcggcagcctggggacc

SEQ ID NO: 316972 - DNA, 25 bp, Mus musculus
ggaagcccatttgcctttacctgtc

SEQ ID NO: 316973 - DNA, 25 bp, Mus musculus
ttccacacggcgagtagagctagcg

SEQ ID NO: 316974 - DNA, 25 bp, Mus musculus
cgtagccggcagagcttcattcaca

SEQ ID NO: 316975 - DNA, 25 bp, Mus musculus
ttcattcacacagcccagccgggag

SEQ ID NO: 316976 - DNA, 25 bp, Mus musculus
gacaggcgccttggagtattagctc

SEQ ID NO: 316977 - DNA, 25 bp, Mus musculus
ttagctctgccaagacggcgtctgc

SEQ ID NO: 316978 - DNA, 25 bp, Mus musculus
cggcatgcgcaaccgcaatagggta

SEQ ID NO: 316979 - DNA, 25 bp, Mus musculus
tcgtacacatcctcgaacagcacgt

SEQ ID NO: 316980 - DNA, 25 bp, Mus musculus
ctggcgcggactaaccctcctccct

SEQ ID NO: 316981 - DNA, 25 bp, Mus musculus
tcgcatagctcgtacacatcctcga

SEQ ID NO: 316982 - DNA, 25 bp, Mus musculus
caagagctcagtgcccggctccggg

SEQ ID NO: 316983 - DNA, 25 bp, Mus musculus
atcctcgaacagcacgtcgtcgtcg

SEQ ID NO: 316984 - DNA, 25 bp, Mus musculus
agcacgtcgtcgtcggccatggtcc

SEQ ID NO: 316985 - DNA, 25 bp, Mus musculus
ccgcagcgtggagggttctgaaaac

SEQ ID NO: 316986 - DNA, 25 bp, Mus musculus
tcagtgcccggctccgggctcgtgt

SEQ ID NO: 316987 - DNA, 25 bp, Mus musculus
caacgtcacgaagaaccggcgggcg

SEQ ID NO: 316988 - DNA, 25 bp, Mus musculus
cgggctcgtgtcctccactcaggac

SEQ ID NO: 316989 - DNA, 25 bp, Mus musculus
ccctcggtgctgaggaagctcgact

SEQ ID NO: 316990 - DNA, 25 bp, Mus musculus
tgaggcccggagactgcagcgcctt

SEQ ID NO: 316991 - DNA, 25 bp, Mus musculus
gcagcgcccgcaacgtcacgaagaa

SEQ ID NO: 316992 - DNA, 25 bp, Mus musculus
aaaaagcgctcccagtggcgcctgc

SEQ ID NO: 316993 - DNA, 25 bp, Mus musculus
tcgcgcgagcgctgacgtggactcc

SEQ ID NO: 316994 - DNA, 25 bp, Mus musculus
tcatagtggtatcgcccggcctcaa

SEQ ID NO: 316995 - DNA, 25 bp, Mus musculus
tcaacgggcggcctacaaatgaggc

SEQ ID NO: 316996 - DNA, 25 bp, Mus musculus
gcctacaaatgaggcctgcaggtgg

SEQ ID NO: 316997 - DNA, 25 bp, Mus musculus
aggcttctgagtgcggactggtaac

SEQ ID NO: 316998 - DNA, 25 bp, Mus musculus
actggtaacaaatggctgggccctg

SEQ ID NO: 316999 - DNA, 25 bp, Mus musculus
gccctgaaagcggagcgcccttgat

SEQ ID NO: 317000 - DNA, 25 bp, Mus musculus
tttagggtagccattcgcggcttcc

SEQ ID NO: 317001 - DNA, 25 bp, Mus musculus
tcccgccgctgtgagaattatgtca

SEQ ID NO: 317002 - DNA, 25 bp, Mus musculus
ttatgtcagaaaagaaggccttccc

SEQ ID NO: 317003 - DNA, 25 bp, Mus musculus
ctccgcgtcatagtggtatcgcccg

SEQ ID NO: 317004 - DNA, 25 bp, Mus musculus
gtagctctgccagctcgttcgagtc

SEQ ID NO: 317005 - DNA, 25 bp, Mus musculus
tcccatgcaggcagtagtagctctg

SEQ ID NO: 317006 - DNA, 25 bp, Mus musculus
agtgccatttcccagacccacgtgg

SEQ ID NO: 317007 - DNA, 25 bp, Mus musculus
ctgttgtacccatggccaccttcga

SEQ ID NO: 317008 - DNA, 25 bp, Mus musculus
tgcaacctcagacacgctctctttg

SEQ ID NO: 317009 - DNA, 25 bp, Mus musculus
accaggtcaggcgtctagttgtctg

SEQ ID NO: 317010 - DNA, 25 bp, Mus musculus
gggagccgttgatcttcctgagcca

SEQ ID NO: 317011 - DNA, 25 bp, Mus musculus
gttatggctattcaaggctcccgta

SEQ ID NO: 317012 - DNA, 25 bp, Mus musculus
acgggctttgccgtcactgtccatg

SEQ ID NO: 317013 - DNA, 25 bp, Mus musculus
gcgcggccaccaagagatcgtaagg

SEQ ID NO: 317014 - DNA, 25 bp, Mus musculus
tgccagtgtacacctgcgtagcccg

SEQ ID NO: 317015 - DNA, 25 bp, Mus musculus
tcgcccagtcgtcatggcaacaggc

SEQ ID NO: 317016 - DNA, 25 bp, Mus musculus
actgaagatctcacccggcgcctta

SEQ ID NO: 317017 - DNA, 25 bp, Mus musculus
cgccttactccatagcctcgggata

SEQ ID NO: 317018 - DNA, 25 bp, Mus musculus
agccggcatcttcgctgccagtgta

SEQ ID NO: 317019 - DNA, 25 bp, Mus musculus
tgtctgagggaaactggcgccaaaa

SEQ ID NO: 317020 - DNA, 25 bp, Mus musculus
cggaaccttgtccacgccttacttg

SEQ ID NO: 317021 - DNA, 25 bp, Mus musculus
gaagtttgtgtctcctacgaatccc

SEQ ID NO: 317022 - DNA, 25 bp, Mus musculus
aaatcctgcggagtgtcgctcgcta

SEQ ID NO: 317023 - DNA, 25 bp, Mus musculus
gccagaggctgtcctaggctttctc

SEQ ID NO: 317024 - DNA, 25 bp, Mus musculus
ttcgctgcgtttccatgaaatcctg

SEQ ID NO: 317025 - DNA, 25 bp, Mus musculus
taggatttttcgctgccgcctctcg

SEQ ID NO: 317026 - DNA, 25 bp, Mus musculus
atgtgaccctacagccgagccgtcg

SEQ ID NO: 317027 - DNA, 25 bp, Mus musculus
ccgccgctttcggtgatgaggaaaa

SEQ ID NO: 317028 - DNA, 25 bp, Mus musculus
acaacaactttgtgctggtgccggg

SEQ ID NO: 317029 - DNA, 25 bp, Mus musculus
gagccacgactgacgcgagtcaaca

SEQ ID NO: 317030 - DNA, 25 bp, Mus musculus
tccggacagacgtgcctatcagcca

SEQ ID NO: 317031 - DNA, 25 bp, Mus musculus
gggtgacaaccctactccggacaga

SEQ ID NO: 317032 - DNA, 25 bp, Mus musculus
accggctgctcccactgggtgacaa

SEQ ID NO: 317033 - DNA, 25 bp, Mus musculus
cctccattctctgcctgtgtattta

SEQ ID NO: 317034 - DNA, 25 bp, Mus musculus
tgccttcacctctaccgcgttagga

SEQ ID NO: 317035 - DNA, 25 bp, Mus musculus
ccagcacccggacgttttctacttg

SEQ ID NO: 317036 - DNA, 25 bp, Mus musculus
ctcgtccttcttgggcgaactcttc

SEQ ID NO: 317037 - DNA, 25 bp, Mus musculus
ttctacttgtacgagcccatgtggc

SEQ ID NO: 317038 - DNA, 25 bp, Mus musculus
cctgcagggcgcactaagagacatg

SEQ ID NO: 317039 - DNA, 25 bp, Mus musculus
tgcgctccctcttccgctgtgattt

SEQ ID NO: 317040 - DNA, 25 bp, Mus musculus
gtgatttctctgtgctgcgcctgta

SEQ ID NO: 317041 - DNA, 25 bp, Mus musculus
ccgctggcggaccaacaaggtcatc

SEQ ID NO: 317042 - DNA, 25 bp, Mus musculus
cgtgacccaggcctcaacctaaagg

SEQ ID NO: 317043 - DNA, 25 bp, Mus musculus
cctaaaggtggtgcaactcttccga

SEQ ID NO: 317044 - DNA, 25 bp, Mus musculus
gcgccacgcgctgatttcttcttaa

SEQ ID NO: 317045 - DNA, 25 bp, Mus musculus
gtggcttcgcgacctgctattcacc

SEQ ID NO: 317046 - DNA, 25 bp, Mus musculus
gccgcgcttgatgccttcgcattca

SEQ ID NO: 317047 - DNA, 25 bp, Mus musculus
tcgcattcaatatgacgcggggctc

SEQ ID NO: 317048 - DNA, 25 bp, Mus musculus
tacccggtggtggtcatcaaagacg

SEQ ID NO: 317049 - DNA, 25 bp, Mus musculus
cagctcgcgccgtcggcagcttcca

SEQ ID NO: 317050 - DNA, 25 bp, Mus musculus
tagcccttccactgcgccaccgagc

SEQ ID NO: 317051 - DNA, 25 bp, Mus musculus
caggagggcggctagcccttccact

SEQ ID NO: 317052 - DNA, 25 bp, Mus musculus
tatcctccctctgccaggagggcgg

SEQ ID NO: 317053 - DNA, 25 bp, Mus musculus
tccgggcggggcgagctctatcctc

SEQ ID NO: 317054 - DNA, 25 bp, Mus musculus
cttctcggtggcaagctcctccatg

SEQ ID NO: 317055 - DNA, 25 bp, Mus musculus
cccgcctagaggagcagcaaggcca

SEQ ID NO: 317056 - DNA, 25 bp, Mus musculus
ccgtgcctcttccacgcggggacca

SEQ ID NO: 317057 - DNA, 25 bp, Mus musculus
tcactaggctccatgactccgggtc

SEQ ID NO: 317058 - DNA, 25 bp, Mus musculus
agcagcacaggcaacagtggcagca

SEQ ID NO: 317059 - DNA, 25 bp, Mus musculus
cgacccagcagcacaggcaacagtg

SEQ ID NO: 317060 - DNA, 25 bp, Mus musculus
cggtggcaagctcctccatggcgct

SEQ ID NO: 317061 - DNA, 25 bp, Mus musculus
accgagctgctggccgtgtccaagc

SEQ ID NO: 317062 - DNA, 25 bp, Mus musculus
gagcagcaaggccaccaggctggct

SEQ ID NO: 317063 - DNA, 25 bp, Mus musculus
gctctcgagggtggcctcggcacca

SEQ ID NO: 317064 - DNA, 25 bp, Mus musculus
cgcctagcagggctgggacgcctca

SEQ ID NO: 317065 - DNA, 25 bp, Mus musculus
ggaggagaacccacctgaagcgccg

SEQ ID NO: 317066 - DNA, 25 bp, Mus musculus
cctcgaagccggtggcgctcgtgac

SEQ ID NO: 317067 - DNA, 25 bp, Mus musculus
ccgccagaagatcgcgcggcgagca

SEQ ID NO: 317068 - DNA, 25 bp, Mus musculus
agcgcacagtgtcaggaatacaata

SEQ ID NO: 317069 - DNA, 25 bp, Mus musculus
gcggttaccaccctagccagactcg

SEQ ID NO: 317070 - DNA, 25 bp, Mus musculus
tcgctccagctccacgtagcggttg

SEQ ID NO: 317071 - DNA, 25 bp, Mus musculus
acacggacacacgagctgggctaca

SEQ ID NO: 317072 - DNA, 25 bp, Mus musculus
gagctgggctacagcctcccggaca

SEQ ID NO: 317073 - DNA, 25 bp, Mus musculus
tcccggacacctccggaggcgttga

SEQ ID NO: 317074 - DNA, 25 bp, Mus musculus
tccggaggcgttgagcgccataact

SEQ ID NO: 317075 - DNA, 25 bp, Mus musculus
gcgccataactgtggcggccgttcc

SEQ ID NO: 317076 - DNA, 25 bp, Mus musculus
ggaatacaatagtgctccgcgccgc

SEQ ID NO: 317077 - DNA, 25 bp, Mus musculus
gcctcttaggggtagccaatagcta

SEQ ID NO: 317078 - DNA, 25 bp, Mus musculus
gctctcttctcgtcgccattttgtg

SEQ ID NO: 317079 - DNA, 25 bp, Mus musculus
agcgcgctcccttagtaggtggatg

SEQ ID NO: 317080 - DNA, 25 bp, Mus musculus
acggactgtaccctcggagttcgca

SEQ ID NO: 317081 - DNA, 25 bp, Mus musculus
caaccaatcgtcaaggccggccaga

SEQ ID NO: 317082 - DNA, 25 bp, Mus musculus
tcctgggccgttctcacagggaatg

SEQ ID NO: 317083 - DNA, 25 bp, Mus musculus
gctactcttttttctggactcctgg

SEQ ID NO: 317084 - DNA, 25 bp, Mus musculus
ccatgacagcttgtactgcggagtc

SEQ ID NO: 317085 - DNA, 25 bp, Mus musculus
tgcggttgatcccagcgcgattttt

SEQ ID NO: 317086 - DNA, 25 bp, Mus musculus
aggtggagcttctagttgtctttca

SEQ ID NO: 317087 - DNA, 25 bp, Mus musculus
gccgtgtcgctaccgaatcaacgtt

SEQ ID NO: 317088 - DNA, 25 bp, Mus musculus
gctccgcccttaccttgctaaatag

SEQ ID NO: 317089 - DNA, 25 bp, Mus musculus
caagcttaacagtcgggccgccatg

SEQ ID NO: 317090 - DNA, 25 bp, Mus musculus
tggctcccatttgaactaacagttc

SEQ ID NO: 317091 - DNA, 25 bp, Mus musculus
cacattccctgctgggcacgcaatg

SEQ ID NO: 317092 - DNA, 25 bp, Mus musculus
cccgctgcagaaggctcttttggta

SEQ ID NO: 317093 - DNA, 25 bp, Mus musculus
ttttggtacacgcagtccgaggtga

SEQ ID NO: 317094 - DNA, 25 bp, Mus musculus
ccgttccagggccaacgccacattc

SEQ ID NO: 317095 - DNA, 25 bp, Mus musculus
cagtccgaggtgagtctcctccttc

SEQ ID NO: 317096 - DNA, 25 bp, Mus musculus
ctctgggatatgctgcgtctccgct

SEQ ID NO: 317097 - DNA, 25 bp, Mus musculus
cgtctccgctagctgtctgctgtga

SEQ ID NO: 317098 - DNA, 25 bp, Mus musculus
gctagctgtctgctgtgagtcacga

SEQ ID NO: 317099 - DNA, 25 bp, Mus musculus
gctgtgagtcacgagccgccgtgaa

SEQ ID NO: 317100 - DNA, 25 bp, Mus musculus
acgagccgccgtgaacacccggatt

SEQ ID NO: 317101 - DNA, 25 bp, Mus musculus
atcgcccgcagtggccaagctcatg

SEQ ID NO: 317102 - DNA, 25 bp, Mus musculus
ccgaagactactgggacgggcgcct

SEQ ID NO: 317103 - DNA, 25 bp, Mus musculus
cgcggctctgaggttactcgcgcgc

SEQ ID NO: 317104 - DNA, 25 bp, Mus musculus
gaaggctcttttggtacacgcagtc

SEQ ID NO: 317105 - DNA, 25 bp, Mus musculus
cgtggaagtgctaagtgaatgaatc

SEQ ID NO: 317106 - DNA, 25 bp, Mus musculus
cagtcagccgcctaaggacaaaatg

SEQ ID NO: 317107 - DNA, 25 bp, Mus musculus
cctctgctgaggaccgagacacaca

SEQ ID NO: 317108 - DNA, 25 bp, Mus musculus
cgtccactgcgagctggcgaaagct

SEQ ID NO: 317109 - DNA, 25 bp, Mus musculus
cgtcttggaacctggagcctggaaa

SEQ ID NO: 317110 - DNA, 25 bp, Mus musculus
gaggctggctccgtacttaacgcgg

SEQ ID NO: 317111 - DNA, 25 bp, Mus musculus
cctacaagtactcgaagcgcctgtg

SEQ ID NO: 317112 - DNA, 25 bp, Mus musculus
gtcggttgcaaggaacggcctacaa

SEQ ID NO: 317113 - DNA, 25 bp, Mus musculus
gacagaatccggaagtgccagttga

SEQ ID NO: 317114 - DNA, 25 bp, Mus musculus
gccagttgagggtcgtcttcctatc

SEQ ID NO: 317115 - DNA, 25 bp, Mus musculus
cctggatgaacagtggcgccaaatc

SEQ ID NO: 317116 - DNA, 25 bp, Mus musculus
gttacaaaacgttgcgtcggttgca

SEQ ID NO: 317117 - DNA, 25 bp, Mus musculus
tcctatcttcagttgcgtcggcagt

SEQ ID NO: 317118 - DNA, 25 bp, Mus musculus
tatcgcggggtacttagaaatcaaa

SEQ ID NO: 317119 - DNA, 25 bp, Mus musculus
agaccgaaagctcagctccaagatg

SEQ ID NO: 317120 - DNA, 25 bp, Mus musculus
tgcttccgtctgaatctcagcgttc

SEQ ID NO: 317121 - DNA, 25 bp, Mus musculus
cgggtatgaagtccagaccgaaagc

SEQ ID NO: 317122 - DNA, 25 bp, Mus musculus
ctgcagtggtggtttcgcttgctgc

SEQ ID NO: 317123 - DNA, 25 bp, Mus musculus
aggagtcggcctgcaggctgcagtg

SEQ ID NO: 317124 - DNA, 25 bp, Mus musculus
accgtcgtcatcgaccgtgggagtg

SEQ ID NO: 317125 - DNA, 25 bp, Mus musculus
ggcgagaccgtcgtcatcgaccgtg

SEQ ID NO: 317126 - DNA, 25 bp, Mus musculus
ttgaccagggcgagaccgtcgtcat

SEQ ID NO: 317127 - DNA, 25 bp, Mus musculus
ttccgtctgaatctcagcgttctcc

SEQ ID NO: 317128 - DNA, 25 bp, Mus musculus
aagatgcttccgtctgaatctcagc

SEQ ID NO: 317129 - DNA, 25 bp, Mus musculus
agtccagaccgaaagctcagctcca

SEQ ID NO: 317130 - DNA, 25 bp, Mus musculus
aaagctcagctccaagatgcttccg

SEQ ID NO: 317131 - DNA, 25 bp, Mus musculus
aatctcagcgttctcccgcccggaa

SEQ ID NO: 317132 - DNA, 25 bp, Mus musculus
gacccgggtatgaagtccagaccga

SEQ ID NO: 317133 - DNA, 25 bp, Mus musculus
cacgtgcaccgccttctcgaaggag

SEQ ID NO: 317134 - DNA, 25 bp, Mus musculus
gagagggatcgggaaaagcctcctc

SEQ ID NO: 317135 - DNA, 25 bp, Mus musculus
gtctcatagcgcaccacgaagtcga

SEQ ID NO: 317136 - DNA, 25 bp, Mus musculus
ctagagacaggtacggccaacagcc

SEQ ID NO: 317137 - DNA, 25 bp, Mus musculus
acagccaatggacagccacgcggga

SEQ ID NO: 317138 - DNA, 25 bp, Mus musculus
agtgacgtacaggtgattgacaagc

SEQ ID NO: 317139 - DNA, 25 bp, Mus musculus
aggagcggttcagcacgcgcaccaa

SEQ ID NO: 317140 - DNA, 25 bp, Mus musculus
tagcccaaccgtcgtgtgaggcccg

SEQ ID NO: 317141 - DNA, 25 bp, Mus musculus
tggtcgcagaaggtagcccaaccgt

SEQ ID NO: 317142 - DNA, 25 bp, Mus musculus
gaggggatctcctgctcctgttcct

SEQ ID NO: 317143 - DNA, 25 bp, Mus musculus
aggctgacatctggccagggcccag

SEQ ID NO: 317144 - DNA, 25 bp, Mus musculus
gccaatgagaaagccagaacagggg

SEQ ID NO: 317145 - DNA, 25 bp, Mus musculus
cgccctcagcaaagggcagctggaa

SEQ ID NO: 317146 - DNA, 25 bp, Mus musculus
ggcggcaacgaaaatgtgggcacca

SEQ ID NO: 317147 - DNA, 25 bp, Mus musculus
tctgctgcccgctgcagactgaggc

SEQ ID NO: 317148 - DNA, 25 bp, Mus musculus
ttcgtcgatgaccagcagcaccctg

SEQ ID NO: 317149 - DNA, 25 bp, Mus musculus
ctgtggtttgcttgaccgcgttaga

SEQ ID NO: 317150 - DNA, 25 bp, Mus musculus
accgcgttagacagcgacgagaaga

SEQ ID NO: 317151 - DNA, 25 bp, Mus musculus
gcgctgcaggtctgtcatgtaccca

SEQ ID NO: 317152 - DNA, 25 bp, Mus musculus
gtacccattcggcagattggccatg

SEQ ID NO: 317153 - DNA, 25 bp, Mus musculus
ggccatgaagttgctgtccgacagg

SEQ ID NO: 317154 - DNA, 25 bp, Mus musculus
ttgcacctctcgtggtgcggtccga

SEQ ID NO: 317155 - DNA, 25 bp, Mus musculus
cgcaacagcggcttaccagtcggtg

SEQ ID NO: 317156 - DNA, 25 bp, Mus musculus
tgctgaatccgacagtgcgcatgcg

SEQ ID NO: 317157 - DNA, 25 bp, Mus musculus
ctctgccgccgcagagcgtatggtc

SEQ ID NO: 317158 - DNA, 25 bp, Mus musculus
ctctgaccgcggtgctgaatccgac

SEQ ID NO: 317159 - DNA, 25 bp, Mus musculus
agtgacgtcagtcagcctttggtgc

SEQ ID NO: 317160 - DNA, 25 bp, Mus musculus
ccgactggactcacggcagcatgga

SEQ ID NO: 317161 - DNA, 25 bp, Mus musculus
gcgtaggaccattcccttggggtga

SEQ ID NO: 317162 - DNA, 25 bp, Mus musculus
ggccgcggccataacaatcagagtg

SEQ ID NO: 317163 - DNA, 25 bp, Mus musculus
tcctcgcagtgcacggaaacgtcct

SEQ ID NO: 317164 - DNA, 25 bp, Mus musculus
cgaagcgactccctcagttccttga

SEQ ID NO: 317165 - DNA, 25 bp, Mus musculus
aggaaacgtcatcccaccgcgtgga

SEQ ID NO: 317166 - DNA, 25 bp, Mus musculus
acccgccacaaggagacatcgactg

SEQ ID NO: 317167 - DNA, 25 bp, Mus musculus
ttgtcccacctgaccaaggtgtatg

SEQ ID NO: 317168 - DNA, 25 bp, Mus musculus
agcatgatccttgggcctctttgtc

SEQ ID NO: 317169 - DNA, 25 bp, Mus musculus
tgtgacgtgacgcagagcatgatcc

SEQ ID NO: 317170 - DNA, 25 bp, Mus musculus
ctcggggtgcaagtcacaacgtacc

SEQ ID NO: 317171 - DNA, 25 bp, Mus musculus
cctgacgtcacctttccctgtgtga

SEQ ID NO: 317172 - DNA, 25 bp, Mus musculus
gcggggacaacctcacttatgggaa

SEQ ID NO: 317173 - DNA, 25 bp, Mus musculus
accgcgacttcgattggtgagaatc

SEQ ID NO: 317174 - DNA, 25 bp, Mus musculus
gcgtgccggaggacttctcattttt

SEQ ID NO: 317175 - DNA, 25 bp, Mus musculus
ttccagcaagggagccaaccaaatc

SEQ ID NO: 317176 - DNA, 25 bp, Mus musculus
tccttggaggtagcaggatcctatg

SEQ ID NO: 317177 - DNA, 25 bp, Mus musculus
cgaaagtttggtcggcattctgtcc

SEQ ID NO: 317178 - DNA, 25 bp, Mus musculus
ttgtcactcactgcaagtctcgctg

SEQ ID NO: 317179 - DNA, 25 bp, Mus musculus
ctcaacgttggggatgacttctttc

SEQ ID NO: 317180 - DNA, 25 bp, Mus musculus
cctatggatctagatgggcctggca

SEQ ID NO: 317181 - DNA, 25 bp, Mus musculus
gtctcgctgcagtacgtcactgata

SEQ ID NO: 317182 - DNA, 25 bp, Mus musculus
gttgcttctgcccaacccgattttg

SEQ ID NO: 317183 - DNA, 25 bp, Mus musculus
tggcgcggatggatgatgtaatttc

SEQ ID NO: 317184 - DNA, 25 bp, Mus musculus
ggggcacgttgagcgctctatttaa

SEQ ID NO: 317185 - DNA, 25 bp, Mus musculus
gacttctttcggctcgagctacgga

SEQ ID NO: 317186 - DNA, 25 bp, Mus musculus
aactgttagtatgagccgcggcttc

SEQ ID NO: 317187 - DNA, 25 bp, Mus musculus
gaactcgttcactcaccggtacagg

SEQ ID NO: 317188 - DNA, 25 bp, Mus musculus
gggccaccggcaataactgttagta

SEQ ID NO: 317189 - DNA, 25 bp, Mus musculus
tgcgagacaaccaactctcggaggt

SEQ ID NO: 317190 - DNA, 25 bp, Mus musculus
tgagcgagcgcaaaggtagtgacgc

SEQ ID NO: 317191 - DNA, 25 bp, Mus musculus
cggctttctgcgagacaaccaactc

SEQ ID NO: 317192 - DNA, 25 bp, Mus musculus
ccttgtgctcggctttctgcgagac

SEQ ID NO: 317193 - DNA, 25 bp, Mus musculus
tgacgcgttttacggggagtatggc

SEQ ID NO: 317194 - DNA, 25 bp, Mus musculus
atttgcaaaagcgacaggcgctacg

SEQ ID NO: 317195 - DNA, 25 bp, Mus musculus
gttcctaagtcgtgccgtgctgtga

SEQ ID NO: 317196 - DNA, 25 bp, Mus musculus
ttggagttcctaagtcgtgccgtgc

SEQ ID NO: 317197 - DNA, 25 bp, Mus musculus
ggtcgtgctttggagttcctaagtc

SEQ ID NO: 317198 - DNA, 25 bp, Mus musculus
ccctaccctggtcgtgctttggagt

SEQ ID NO: 317199 - DNA, 25 bp, Mus musculus
tgcgcacgccgagtgacgtgatgac

SEQ ID NO: 317200 - DNA, 25 bp, Mus musculus
gcgacaggcgctacgcagcaagacg

SEQ ID NO: 317201 - DNA, 25 bp, Mus musculus
ctaagtcgtgccgtgctgtgagcga

SEQ ID NO: 317202 - DNA, 25 bp, Mus musculus
gtgacgtgatgacgacactgggccc

SEQ ID NO: 317203 - DNA, 25 bp, Mus musculus
gaagatcgtggagcccccgtgactt

SEQ ID NO: 317204 - DNA, 25 bp, Mus musculus
tggtgcagatcccaactcctaatcg

SEQ ID NO: 317205 - DNA, 25 bp, Mus musculus
ctgcctcaccttgtttgccgattcc

SEQ ID NO: 317206 - DNA, 25 bp, Mus musculus
cccgcctcgccgttttggtgcagat

SEQ ID NO: 317207 - DNA, 25 bp, Mus musculus
agaagcccggtaggcaaagagcgaa

SEQ ID NO: 317208 - DNA, 25 bp, Mus musculus
gccgttttggtgcagatcccaactc

SEQ ID NO: 317209 - DNA, 25 bp, Mus musculus
agatcccaactcctaatcgcgcaga

SEQ ID NO: 317210 - DNA, 25 bp, Mus musculus
ccaactcctaatcgcgcagaaggcg

SEQ ID NO: 317211 - DNA, 25 bp, Mus musculus
cctcgccgttttggtgcagatccca

SEQ ID NO: 317212 - DNA, 25 bp, Mus musculus
tgacttcaggatcctgcctcacctt

SEQ ID NO: 317213 - DNA, 25 bp, Mus musculus
ttgtttgccgattccctgcacccag

SEQ ID NO: 317214 - DNA, 25 bp, Mus musculus
ccgagagcagctgcgctcagaggcc

SEQ ID NO: 317215 - DNA, 25 bp, Mus musculus
cagctgcgctcagaggccaaagagg

SEQ ID NO: 317216 - DNA, 25 bp, Mus musculus
ccctcctgctgcgaggcacgggcgc

SEQ ID NO: 317217 - DNA, 25 bp, Mus musculus
tcacccgcgggtgtgtcctataaat

SEQ ID NO: 317218 - DNA, 25 bp, Mus musculus
gggctagtagctttccctgcaactg

SEQ ID NO: 317219 - DNA, 25 bp, Mus musculus
ggctgctcccgcattagtaatcata

SEQ ID NO: 317220 - DNA, 25 bp, Mus musculus
taagattgcctctctgggaccgccc

SEQ ID NO: 317221 - DNA, 25 bp, Mus musculus
ccggccgcgaaatctcgcgaggtta

SEQ ID NO: 317222 - DNA, 25 bp, Mus musculus
cgcgtcggtattttgcgggctagta

SEQ ID NO: 317223 - DNA, 25 bp, Mus musculus
gcctcggagttttggcagacagctg

SEQ ID NO: 317224 - DNA, 25 bp, Mus musculus
tgcaactgtaattgccgctgcggga

SEQ ID NO: 317225 - DNA, 25 bp, Mus musculus
tcaggcagtcgctctgcaggtcatc

SEQ ID NO: 317226 - DNA, 25 bp, Mus musculus
cttagcccagcaactgagggtggtc

SEQ ID NO: 317227 - DNA, 25 bp, Mus musculus
ggtcccgggttgacttctcactcca

SEQ ID NO: 317228 - DNA, 25 bp, Mus musculus
gtcatctgtgccctcctcagtgtcg

SEQ ID NO: 317229 - DNA, 25 bp, Mus musculus
aggagacgctcagaatcaccctttc

SEQ ID NO: 317230 - DNA, 25 bp, Mus musculus
tccacactcttaactgacgaggagg

SEQ ID NO: 317231 - DNA, 25 bp, Mus musculus
ctgagcaagccaggcacggcagccg

SEQ ID NO: 317232 - DNA, 25 bp, Mus musculus
aaaagaagcagcctcatctcgcctc

SEQ ID NO: 317233 - DNA, 25 bp, Mus musculus
ggctgcaccagcaacatcagctgcg

SEQ ID NO: 317234 - DNA, 25 bp, Mus musculus
aggagacacaccctccttcttaggc

SEQ ID NO: 317235 - DNA, 25 bp, Mus musculus
cccagagcctgcaaaagctagagca

SEQ ID NO: 317236 - DNA, 25 bp, Mus musculus
gcccgtcggcgtgtaaacacaggca

SEQ ID NO: 317237 - DNA, 25 bp, Mus musculus
tgccatggccgaagtgcgcaaattc

SEQ ID NO: 317238 - DNA, 25 bp, Mus musculus
gcgccatacactcggaaaaagaagc

SEQ ID NO: 317239 - DNA, 25 bp, Mus musculus
tgaaagcttcagatcgcacctcccg

SEQ ID NO: 317240 - DNA, 25 bp, Mus musculus
gctaggagctctctttttcctctgt

SEQ ID NO: 317241 - DNA, 25 bp, Mus musculus
ttaagttttcgctctggcaaccggc

SEQ ID NO: 317242 - DNA, 25 bp, Mus musculus
cagcgggtttcacagagctgcggcc

SEQ ID NO: 317243 - DNA, 25 bp, Mus musculus
gtgcgcaaattcaccaagcggctga

SEQ ID NO: 317244 - DNA, 25 bp, Mus musculus
agctgaatggcacagcgggtttcac

SEQ ID NO: 317245 - DNA, 25 bp, Mus musculus
ccaccgctgcctaagatggcgcgga

SEQ ID NO: 317246 - DNA, 25 bp, Mus musculus
ggaatgccctcagactatcaagggg

SEQ ID NO: 317247 - DNA, 25 bp, Mus musculus
cctgcggagaagctgccttaaggca

SEQ ID NO: 317248 - DNA, 25 bp, Mus musculus
ggcgggaatgccctcagactatcaa

SEQ ID NO: 317249 - DNA, 25 bp, Mus musculus
taagatggcgcggaagctctctgag

SEQ ID NO: 317250 - DNA, 25 bp, Mus musculus
tcagactatcaagggggcacgcatg

SEQ ID NO: 317251 - DNA, 25 bp, Mus musculus
atcaagggggcacgcatgcgcaccc

SEQ ID NO: 317252 - DNA, 25 bp, Mus musculus
cgaaaccaaaaagtgctggagcgtg

SEQ ID NO: 317253 - DNA, 25 bp, Mus musculus
aagctgccttaaggcacagtccagc

SEQ ID NO: 317254 - DNA, 25 bp, Mus musculus
cacagtccagcagagcgggtgctga

SEQ ID NO: 317255 - DNA, 25 bp, Mus musculus
gggcaaccgcaacccaccaccgctg

SEQ ID NO: 317256 - DNA, 25 bp, Mus musculus
gagcgtgagggcaaccgcaacccac

SEQ ID NO: 317257 - DNA, 25 bp, Mus musculus
aaccaaaaagtgctggagcgtgagg

SEQ ID NO: 317258 - DNA, 25 bp, Mus musculus
gctgcctaagatggcgcggaagctc

SEQ ID NO: 317259 - DNA, 25 bp, Mus musculus
tcgccttggtcagggtgcgcgcact

SEQ ID NO: 317260 - DNA, 25 bp, Mus musculus
ggaccgccaccgtgggccaagttgc

SEQ ID NO: 317261 - DNA, 25 bp, Mus musculus
actcggtgggagtctcagagccgcc

SEQ ID NO: 317262 - DNA, 25 bp, Mus musculus
cgcccaatcccttccactgcctgcg

SEQ ID NO: 317263 - DNA, 25 bp, Mus musculus
agctgttggtgctgctactgtggac

SEQ ID NO: 317264 - DNA, 25 bp, Mus musculus
tcggcccttcgatgtcccgtgctaa

SEQ ID NO: 317265 - DNA, 25 bp, Mus musculus
tgctactgtggaccgccaccgtggg

SEQ ID NO: 317266 - DNA, 25 bp, Mus musculus
cgtgggccaagttgccgcggccaca

SEQ ID NO: 317267 - DNA, 25 bp, Mus musculus
ccacaggtgagtgtggtccccggct

SEQ ID NO: 317268 - DNA, 25 bp, Mus musculus
gccaggagttcgatcgccttggtca

SEQ ID NO: 317269 - DNA, 25 bp, Mus musculus
agttcgatcgccttggtcagggtgc

SEQ ID NO: 317270 - DNA, 25 bp, Mus musculus
ccaggtgtcactcggtgggagtctc

SEQ ID NO: 317271 - DNA, 25 bp, Mus musculus
cgcgcactgaggtggtcggcccttc

SEQ ID NO: 317272 - DNA, 25 bp, Mus musculus
gcccttcgatgtcccgtgctaagtc

SEQ ID NO: 317273 - DNA, 25 bp, Mus musculus
ctccgcagttccttctctcaatgga

SEQ ID NO: 317274 - DNA, 25 bp, Mus musculus
gtttctctcagacccggtgtccctg

SEQ ID NO: 317275 - DNA, 25 bp, Mus musculus
cccgacaccgctggagtgcaaagtc

SEQ ID NO: 317276 - DNA, 25 bp, Mus musculus
ccgcacagatggtgagcttgtccgc

SEQ ID NO: 317277 - DNA, 25 bp, Mus musculus
ccgagctcggcagcaacaacttgga

SEQ ID NO: 317278 - DNA, 25 bp, Mus musculus
gctcccaagctctcggggctcaaga

SEQ ID NO: 317279 - DNA, 25 bp, Mus musculus
atggattcccttcagaccgcacaga

SEQ ID NO: 317280 - DNA, 25 bp, Mus musculus
aggtgtaccgacagctctccgagag

SEQ ID NO: 317281 - DNA, 25 bp, Mus musculus
cccgaggtatgggatggctttaagt

SEQ ID NO: 317282 - DNA, 25 bp, Mus musculus
ttaacgtggtactcagcggcctcct

SEQ ID NO: 317283 - DNA, 25 bp, Mus musculus
gtgcggccacaccttttgtaaactg

SEQ ID NO: 317284 - DNA, 25 bp, Mus musculus
aggcagctctgctcaagtacaacga

SEQ ID NO: 317285 - DNA, 25 bp, Mus musculus
cctgcaactgcgagttaacgtggta

SEQ ID NO: 317286 - DNA, 25 bp, Mus musculus
acgaggctgttcgtctaggtgagtc

SEQ ID NO: 317287 - DNA, 25 bp, Mus musculus
gagcactggttgcataaggccctcg

SEQ ID NO: 317288 - DNA, 25 bp, Mus musculus
ataaggccctcgagccagcccgggc

SEQ ID NO: 317289 - DNA, 25 bp, Mus musculus
gggattgtgtaacgctgaggtaact

SEQ ID NO: 317290 - DNA, 25 bp, Mus musculus
taacgctgaggtaactgaagtgggc

SEQ ID NO: 317291 - DNA, 25 bp, Mus musculus
ctgaggtaactgaagtgggccacgc

SEQ ID NO: 317292 - DNA, 25 bp, Mus musculus
actgaagtgggccacgctcgcctca

SEQ ID NO: 317293 - DNA, 25 bp, Mus musculus
agtgggccacgctcgcctcagaaac

SEQ ID NO: 317294 - DNA, 25 bp, Mus musculus
ctcagaaaccatcccgcgagcgtgt

SEQ ID NO: 317295 - DNA, 25 bp, Mus musculus
cctggaattaggtcaggagagcact

SEQ ID NO: 317296 - DNA, 25 bp, Mus musculus
gtgggtcccgcctggaattaggtca

SEQ ID NO: 317297 - DNA, 25 bp, Mus musculus
cgcctctgggagttgtcccttccgg

SEQ ID NO: 317298 - DNA, 25 bp, Mus musculus
caggagagcactggttgcataaggc

SEQ ID NO: 317299 - DNA, 25 bp, Mus musculus
aaaccatcccgcgagcgtgtgcggg

SEQ ID NO: 317300 - DNA, 25 bp, Mus musculus
tcccgcctggaattaggtcaggaga

SEQ ID NO: 317301 - DNA, 25 bp, Mus musculus
tggctggaacctgctcgacttcatc

SEQ ID NO: 317302 - DNA, 25 bp, Mus musculus
acagtgctcaagatcgtagcctatg

SEQ ID NO: 317303 - DNA, 25 bp, Mus musculus
tggaacctgctcgacttcatcatcg

SEQ ID NO: 317304 - DNA, 25 bp, Mus musculus
gcctatattcgcaatggctggaacc

SEQ ID NO: 317305 - DNA, 25 bp, Mus musculus
tatgggctggtgctccatcccagcg

SEQ ID NO: 317306 - DNA, 25 bp, Mus musculus
atcgtagcctatgggctggtgctcc

SEQ ID NO: 317307 - DNA, 25 bp, Mus musculus
ttcaccgtggagacagtgctcaaga

SEQ ID NO: 317308 - DNA, 25 bp, Mus musculus
cctggtgattttcaccgtggagaca

SEQ ID NO: 317309 - DNA, 25 bp, Mus musculus
caggtagaatacgtgttcctggtga

SEQ ID NO: 317310 - DNA, 25 bp, Mus musculus
ccctcaggaacaggtagaatacgtg

SEQ ID NO: 317311 - DNA, 25 bp, Mus musculus
cccgaaataaatcgaggccttcacg

SEQ ID NO: 317312 - DNA, 25 bp, Mus musculus
cttcatcatcgtcgtggtcgggtgc

SEQ ID NO: 317313 - DNA, 25 bp, Mus musculus
tgctccgccctcaggaacaggtaga

SEQ ID NO: 317314 - DNA, 25 bp, Mus musculus
atcccagcgcctatattcgcaatgg

SEQ ID NO: 317315 - DNA, 25 bp, Mus musculus
gcgttagcccgactctagacataga

SEQ ID NO: 317316 - DNA, 25 bp, Mus musculus
gtgcgtccctcggattctttgcaga

SEQ ID NO: 317317 - DNA, 25 bp, Mus musculus
ggaccctttgtgtactctcacctgc

SEQ ID NO: 317318 - DNA, 25 bp, Mus musculus
gccagcttaagcgtgaggacccttt

SEQ ID NO: 317319 - DNA, 25 bp, Mus musculus
tgtgccggtcattctgccagcttaa

SEQ ID NO: 317320 - DNA, 25 bp, Mus musculus
tcctcagtaccatgcagggtgtgcc

SEQ ID NO: 317321 - DNA, 25 bp, Mus musculus
gtgcttggcaccagccctctatgga

SEQ ID NO: 317322 - DNA, 25 bp, Mus musculus
cagagtgaggcgtttgcagatttca

SEQ ID NO: 317323 - DNA, 25 bp, Mus musculus
cgccgaatccatcgcgtgaaaggga

SEQ ID NO: 317324 - DNA, 25 bp, Mus musculus
tggtcacacaagtcttcgccgaatc

SEQ ID NO: 317325 - DNA, 25 bp, Mus musculus
tgcccagacacgcaactgaccttgt

SEQ ID NO: 317326 - DNA, 25 bp, Mus musculus
cccgttattgcactgggcacccgga

SEQ ID NO: 317327 - DNA, 25 bp, Mus musculus
cccacggaggaatctatgcgttcca

SEQ ID NO: 317328 - DNA, 25 bp, Mus musculus
tgtcctcgcagaccgaacgactttt

SEQ ID NO: 317329 - DNA, 25 bp, Mus musculus
tgccagtggcgacaacgacgacgac

SEQ ID NO: 317330 - DNA, 25 bp, Mus musculus
ccgcaagttctacgggcctggtacg

SEQ ID NO: 317331 - DNA, 25 bp, Mus musculus
tctcatggccatcaacggcaaggtg

SEQ ID NO: 317332 - DNA, 25 bp, Mus musculus
gatgcccgaatgaggctgagccttg

SEQ ID NO: 317333 - DNA, 25 bp, Mus musculus
tctacaagatcgttcgcggggacca

SEQ ID NO: 317334 - DNA, 25 bp, Mus musculus
ctctgcatcttcctgctctacaaga

SEQ ID NO: 317335 - DNA, 25 bp, Mus musculus
gattttcacgtctcctctcaacctg

SEQ ID NO: 317336 - DNA, 25 bp, Mus musculus
gggctgctgcacgagattttcacgt

SEQ ID NO: 317337 - DNA, 25 bp, Mus musculus
ctccagagatcatggctgccgagga

SEQ ID NO: 317338 - DNA, 25 bp, Mus musculus
gggcccaacctttgctccagagatc

SEQ ID NO: 317339 - DNA, 25 bp, Mus musculus
aagcggactgttccggagctctgcc

SEQ ID NO: 317340 - DNA, 25 bp, Mus musculus
ttcctctgtcaaagaacgctgcgcg

SEQ ID NO: 317341 - DNA, 25 bp, Mus musculus
agaggccgaaccaggcccagcttgc

SEQ ID NO: 317342 - DNA, 25 bp, Mus musculus
cggcaaggtgttcgacgtgaccaaa

SEQ ID NO: 317343 - DNA, 25 bp, Mus musculus
tccgctggggtagcggaaccgctac

SEQ ID NO: 317344 - DNA, 25 bp, Mus musculus
ccaaccgggacgcagaaggacgcag

SEQ ID NO: 317345 - DNA, 25 bp, Mus musculus
cagccgcctggtcgattctcagaaa

SEQ ID NO: 317346 - DNA, 25 bp, Mus musculus
gggagcctcagcagccgctgtacct

SEQ ID NO: 317347 - DNA, 25 bp, Mus musculus
agccgctgtaccttcacgcttagct

SEQ ID NO: 317348 - DNA, 25 bp, Mus musculus
ttcacgcttagctccgctggggtag

SEQ ID NO: 317349 - DNA, 25 bp, Mus musculus
cagccgccgcagtgtcaaggatcaa

SEQ ID NO: 317350 - DNA, 25 bp, Mus musculus
gcgaggccagctgttgaatggctca

SEQ ID NO: 317351 - DNA, 25 bp, Mus musculus
ggtcgcgacacagagtcgtcctcgc

SEQ ID NO: 317352 - DNA, 25 bp, Mus musculus
gcacccaagactccggtaggccagg

SEQ ID NO: 317353 - DNA, 25 bp, Mus musculus
ccgcatccgagaaggcgacgcaggc

SEQ ID NO: 317354 - DNA, 25 bp, Mus musculus
tgtcaaggatcaaccctcctggtcg

SEQ ID NO: 317355 - DNA, 25 bp, Mus musculus
gtcctcgccgcatccgagaaggcga

SEQ ID NO: 317356 - DNA, 25 bp, Mus musculus
ctgttgaatggctcaggtcgcgaca

SEQ ID NO: 317357 - DNA, 25 bp, Mus musculus
agcccagggcaccagccacgaggtg

SEQ ID NO: 317358 - DNA, 25 bp, Mus musculus
cacgggcctgggtcaggatggctac

SEQ ID NO: 317359 - DNA, 25 bp, Mus musculus
tggccggggcgttcagcctcagcct

SEQ ID NO: 317360 - DNA, 25 bp, Mus musculus
cctggagcttgccactgtgctggcc

SEQ ID NO: 317361 - DNA, 25 bp, Mus musculus
ttgccactgtgctggcccaagtcgg

SEQ ID NO: 317362 - DNA, 25 bp, Mus musculus
agctggccgcctaccgaaagtaaga

SEQ ID NO: 317363 - DNA, 25 bp, Mus musculus
gctggcccaagtcggcaaggtgcaa

SEQ ID NO: 317364 - DNA, 25 bp, Mus musculus
cccaagtcggcaaggtgcaaagcca

SEQ ID NO: 317365 - DNA, 25 bp, Mus musculus
gcaaggtgcaaagccactccctggg

SEQ ID NO: 317366 - DNA, 25 bp, Mus musculus
gaatggcgtggcctgcctgcgcctc

SEQ ID NO: 317367 - DNA, 25 bp, Mus musculus
ccctgcagcatggtacagctggccg

SEQ ID NO: 317368 - DNA, 25 bp, Mus musculus
agcatggtacagctggccgcctacc

SEQ ID NO: 317369 - DNA, 25 bp, Mus musculus
ggcctggccggactgctctaactgc

SEQ ID NO: 317370 - DNA, 25 bp, Mus musculus
tggccgcctaccgaaagtaagagcc

SEQ ID NO: 317371 - DNA, 25 bp, Mus musculus
tcaccgcctggctgccgctatataa

SEQ ID NO: 317372 - DNA, 25 bp, Mus musculus
ataagtcggccatttgctttgctcc

SEQ ID NO: 317373 - DNA, 25 bp, Mus musculus
gctttcaacatgacagatgccgctg

SEQ ID NO: 317374 - DNA, 25 bp, Mus musculus
atgccgctgtgtccttcgccaagga

SEQ ID NO: 317375 - DNA, 25 bp, Mus musculus
cgcagccatctccaagacagcggta

SEQ ID NO: 317376 - DNA, 25 bp, Mus musculus
ctgctgctgcaggtacgttctgaga

SEQ ID NO: 317377 - DNA, 25 bp, Mus musculus
cctagcggaaaagtggggctcagtc

SEQ ID NO: 317378 - DNA, 25 bp, Mus musculus
ccagtgtcagatcgaaaggcaaccg

SEQ ID NO: 317379 - DNA, 25 bp, Mus musculus
gcgcctttaaggacctggagtttga

SEQ ID NO: 317380 - DNA, 25 bp, Mus musculus
cccggatttagaggcaagggcaata

SEQ ID NO: 317381 - DNA, 25 bp, Mus musculus
gattacagctttgggcaggccacgc

SEQ ID NO: 317382 - DNA, 25 bp, Mus musculus
agaggctctgtctagcccggattta

SEQ ID NO: 317383 - DNA, 25 bp, Mus musculus
tcaaggtcacggcaaggagattaca

SEQ ID NO: 317384 - DNA, 25 bp, Mus musculus
gtacctggcctgaccgaaaacctca

SEQ ID NO: 317385 - DNA, 25 bp, Mus musculus
tggtggcagacacaatcgccgttcg

SEQ ID NO: 317386 - DNA, 25 bp, Mus musculus
ttcctgaaattacctacagagggcg

SEQ ID NO: 317387 - DNA, 25 bp, Mus musculus
cggcgctttctgtatggtggcagac

SEQ ID NO: 317388 - DNA, 25 bp, Mus musculus
acacaatcgccgttcggagggtggc

SEQ ID NO: 317389 - DNA, 25 bp, Mus musculus
tgctcgccacgcctaaaaccaagga

SEQ ID NO: 317390 - DNA, 25 bp, Mus musculus
ccaaggacaaataggggagaaggct

SEQ ID NO: 317391 - DNA, 25 bp, Mus musculus
cccgagcggaaatcgcaaatgcgat

SEQ ID NO: 317392 - DNA, 25 bp, Mus musculus
atcgcaaatgcgatgggcgtaatgg

SEQ ID NO: 317393 - DNA, 25 bp, Mus musculus
aggcgccttgtgtccgactggacaa

SEQ ID NO: 317394 - DNA, 25 bp, Mus musculus
ggcacagcgtggtgcacccgtagaa

SEQ ID NO: 317395 - DNA, 25 bp, Mus musculus
tttctagccgcccttcctgaaatta

SEQ ID NO: 317396 - DNA, 25 bp, Mus musculus
ggcagcggagtacccgtcacttccg

SEQ ID NO: 317397 - DNA, 25 bp, Mus musculus
aattacctacagagggcgcgctttt

SEQ ID NO: 317398 - DNA, 25 bp, Mus musculus
tgcacccgtagaagcgccggcagcg

SEQ ID NO: 317399 - DNA, 25 bp, Mus musculus
agggtgctgagttgacagaagctca

SEQ ID NO: 317400 - DNA, 25 bp, Mus musculus
gacaccttccgtgttatttgaaata

SEQ ID NO: 317401 - DNA, 25 bp, Mus musculus
cgaccgcgacacgactttcggcata

SEQ ID NO: 317402 - DNA, 25 bp, Mus musculus
tgtctgagcagaccaccgaccgcga

SEQ ID NO: 317403 - DNA, 25 bp, Mus musculus
gctgagacagctttagatatcgaca

SEQ ID NO: 317404 - DNA, 25 bp, Mus musculus
ctttcggcatagctccggcagagca

SEQ ID NO: 317405 - DNA, 25 bp, Mus musculus
gcagccagaaaactcccagaaaatg

SEQ ID NO: 317406 - DNA, 25 bp, Mus musculus
cccagaaaatgaagagtcgcgccga

SEQ ID NO: 317407 - DNA, 25 bp, Mus musculus
cgccgagatggcgtcacagacactc

SEQ ID NO: 317408 - DNA, 25 bp, Mus musculus
gcgccagaccgtttctccacttgat

SEQ ID NO: 317409 - DNA, 25 bp, Mus musculus
tccacttgatcacgtgttgacaccg

SEQ ID NO: 317410 - DNA, 25 bp, Mus musculus
gttgacaccggattgattaacttcc

SEQ ID NO: 317411 - DNA, 25 bp, Mus musculus
atcccgctaaattgcagggagaggc

SEQ ID NO: 317412 - DNA, 25 bp, Mus musculus
gttttgatttattggcgcctccgga

SEQ ID NO: 317413 - DNA, 25 bp, Mus musculus
caacataatggtttggaatgcggtc

SEQ ID NO: 317414 - DNA, 25 bp, Mus musculus
gttacaggaagatcctccggccgga

SEQ ID NO: 317415 - DNA, 25 bp, Mus musculus
gcctcgattagctgccttctctctg

SEQ ID NO: 317416 - DNA, 25 bp, Mus musculus
cccgtctactctggggtggtgctta

SEQ ID NO: 317417 - DNA, 25 bp, Mus musculus
tgagcccgctaaagccatgtcgacc

SEQ ID NO: 317418 - DNA, 25 bp, Mus musculus
ttcaagaggtaacccgcgtccgcga

SEQ ID NO: 317419 - DNA, 25 bp, Mus musculus
atgcccgactgctgagcccgctaaa

SEQ ID NO: 317420 - DNA, 25 bp, Mus musculus
gctccgtcggagaacaacataatgg

SEQ ID NO: 317421 - DNA, 25 bp, Mus musculus
tgcggtcatttttgggtgagtctgc

SEQ ID NO: 317422 - DNA, 25 bp, Mus musculus
gcggaccctggtatatgcccgactg

SEQ ID NO: 317423 - DNA, 25 bp, Mus musculus
ctctgctaggggaactctttggggt

SEQ ID NO: 317424 - DNA, 25 bp, Mus musculus
ggaaaccttgacagagccgccgcct

SEQ ID NO: 317425 - DNA, 25 bp, Mus musculus
ggggaccctctgagccggcactaac

SEQ ID NO: 317426 - DNA, 25 bp, Mus musculus
cgccgcctcatgagggacttcaaga

SEQ ID NO: 317427 - DNA, 25 bp, Mus musculus
ctgccgagtgccgttttgaagtgct

SEQ ID NO: 317428 - DNA, 25 bp, Mus musculus
tacaagccgtcagggacagtgccaa

SEQ ID NO: 317429 - DNA, 25 bp, Mus musculus
tccctcggagtccagttgctcaaga

SEQ ID NO: 317430 - DNA, 25 bp, Mus musculus
tcgcgtcgagatcacagtggcaatc

SEQ ID NO: 317431 - DNA, 25 bp, Mus musculus
ggcggctctgcaaggccatgatatg

SEQ ID NO: 317432 - DNA, 25 bp, Mus musculus
attgcacgattttgccaggcgccgg

SEQ ID NO: 317433 - DNA, 25 bp, Mus musculus
ggcgccacgaggaactcattctatt

SEQ ID NO: 317434 - DNA, 25 bp, Mus musculus
acagcgtcctgcactggctggccaa

SEQ ID NO: 317435 - DNA, 25 bp, Mus musculus
acctgtcccaggagcgaatcttcca

SEQ ID NO: 317436 - DNA, 25 bp, Mus musculus
gacccgcagatcaaggacaaccatt

SEQ ID NO: 317437 - DNA, 25 bp, Mus musculus
ctggaagatcatggcccaggcccta

SEQ ID NO: 317438 - DNA, 25 bp, Mus musculus
ttggaaggccaacgaacgctagacc

SEQ ID NO: 317439 - DNA, 25 bp, Mus musculus
agctccagttcctctccctgtgggg

SEQ ID NO: 317440 - DNA, 25 bp, Mus musculus
cgggaggaccctatcacaggctaca

SEQ ID NO: 317441 - DNA, 25 bp, Mus musculus
ggatggatgactcgcagcgtcctcc

SEQ ID NO: 317442 - DNA, 25 bp, Mus musculus
cgatagtcttaccatggcgagaagc

SEQ ID NO: 317443 - DNA, 25 bp, Mus musculus
gagaacgtaattccgaggcctccgc

SEQ ID NO: 317444 - DNA, 25 bp, Mus musculus
tggcgagaagccgaatcaagaatag

SEQ ID NO: 317445 - DNA, 25 bp, Mus musculus
gccgaatcaagaatagcgcgcacga

SEQ ID NO: 317446 - DNA, 25 bp, Mus musculus
gaatcaagaatagcgcgcacgatgg

SEQ ID NO: 317447 - DNA, 25 bp, Mus musculus
atggcggaggaatggagaagagaaa

SEQ ID NO: 317448 - DNA, 25 bp, Mus musculus
ggaccggaagaacgcgattagaaga

SEQ ID NO: 317449 - DNA, 25 bp, Mus musculus
tttatagagaacgtaattccgaggc

SEQ ID NO: 317450 - DNA, 25 bp, Mus musculus
aagaagtcgctagaggcggagctta

SEQ ID NO: 317451 - DNA, 25 bp, Mus musculus
ggatggcggccgatagtcttaccat

SEQ ID NO: 317452 - DNA, 25 bp, Mus musculus
tggcggccgatagtcttaccatggc

SEQ ID NO: 317453 - DNA, 25 bp, Mus musculus
agaacgcgattagaagaagtcgcta

SEQ ID NO: 317454 - DNA, 25 bp, Mus musculus
cttaccatggcgagaagccgaatca

SEQ ID NO: 317455 - DNA, 25 bp, Mus musculus
cgggcacctacgactctccgggaga

SEQ ID NO: 317456 - DNA, 25 bp, Mus musculus
tctccgggagagacctcaggagctc

SEQ ID NO: 317457 - DNA, 25 bp, Mus musculus
atagccctagtgataagcagagccc

SEQ ID NO: 317458 - DNA, 25 bp, Mus musculus
ccttagcgcgtcattagcaactccg

SEQ ID NO: 317459 - DNA, 25 bp, Mus musculus
atctcgcgagagtttaaggccctcg

SEQ ID NO: 317460 - DNA, 25 bp, Mus musculus
ttccattgggctcccggagatctcg

SEQ ID NO: 317461 - DNA, 25 bp, Mus musculus
aagcagagccctgcgttccattggg

SEQ ID NO: 317462 - DNA, 25 bp, Mus musculus
tgctaagccgttacgccgggcacct

SEQ ID NO: 317463 - DNA, 25 bp, Mus musculus
ctctttagagcggtggcacagctgc

SEQ ID NO: 317464 - DNA, 25 bp, Mus musculus
atggccacggttacgctctttagag

SEQ ID NO: 317465 - DNA, 25 bp, Mus musculus
ggtcactcgtttctccttaggccta

SEQ ID NO: 317466 - DNA, 25 bp, Mus musculus
cgccttcggcagtagcgccaataca

SEQ ID NO: 317467 - DNA, 25 bp, Mus musculus
tgcggcgtaaacagggtcactcgtt

SEQ ID NO: 317468 - DNA, 25 bp, Mus musculus
gtagcgccaatacagccgcctgtgg

SEQ ID NO: 317469 - DNA, 25 bp, Mus musculus
tcctgatgctcttggagtcggcgtg

SEQ ID NO: 317470 - DNA, 25 bp, Mus musculus
agcacagggcgcctctcctgatgct

SEQ ID NO: 317471 - DNA, 25 bp, Mus musculus
gagccgggcgcagcgatccggtaac

SEQ ID NO: 317472 - DNA, 25 bp, Mus musculus
cagcgatccggtaacgggtggcccg

SEQ ID NO: 317473 - DNA, 25 bp, Mus musculus
gaagcacccacgcaccaggagggca

SEQ ID NO: 317474 - DNA, 25 bp, Mus musculus
cacccacgcaccaggagggcagtgg

SEQ ID NO: 317475 - DNA, 25 bp, Mus musculus
cgctgggcccgcatgggaggggcac

SEQ ID NO: 317476 - DNA, 25 bp, Mus musculus
ctctcctgatgctcttggagtcggc

SEQ ID NO: 317477 - DNA, 25 bp, Mus musculus
cgcctctcctgatgctcttggagtc

SEQ ID NO: 317478 - DNA, 25 bp, Mus musculus
cttggccgcagcgagcacagggcgc

SEQ ID NO: 317479 - DNA, 25 bp, Mus musculus
aaaggcggctgtgggcttggccgca

SEQ ID NO: 317480 - DNA, 25 bp, Mus musculus
ctccgcgtccctgcagcccgagccg

SEQ ID NO: 317481 - DNA, 25 bp, Mus musculus
ggcgcctctcctgatgctcttggag

SEQ ID NO: 317482 - DNA, 25 bp, Mus musculus
acagggcgcctctcctgatgctctt

SEQ ID NO: 317483 - DNA, 25 bp, Mus musculus
tggtgaatcaggtacgcgctccagc

SEQ ID NO: 317484 - DNA, 25 bp, Mus musculus
ggtacgcgctccagcaccgtggaca

SEQ ID NO: 317485 - DNA, 25 bp, Mus musculus
tgcgcaggcgcttgctcaaaagata

SEQ ID NO: 317486 - DNA, 25 bp, Mus musculus
caggcgcttgctcaaaagataggca

SEQ ID NO: 317487 - DNA, 25 bp, Mus musculus
cttgctcaaaagataggcagggtgc

SEQ ID NO: 317488 - DNA, 25 bp, Mus musculus
gctcaaaagataggcagggtgcaag

SEQ ID NO: 317489 - DNA, 25 bp, Mus musculus
ccgccgactgggctgttccgacgat

SEQ ID NO: 317490 - DNA, 25 bp, Mus musculus
tgggctgttccgacgatcgcgcacc

SEQ ID NO: 317491 - DNA, 25 bp, Mus musculus
gcccgcccttgctaccaggcacctt

SEQ ID NO: 317492 - DNA, 25 bp, Mus musculus
tggcagacatggacgtggtgaatca

SEQ ID NO: 317493 - DNA, 25 bp, Mus musculus
acgtggtgaatcaggtacgcgctcc

SEQ ID NO: 317494 - DNA, 25 bp, Mus musculus
atcaggtacgcgctccagcaccgtg

SEQ ID NO: 317495 - DNA, 25 bp, Mus musculus
agccatggtgcgcaggcgcttgctc

SEQ ID NO: 317496 - DNA, 25 bp, Mus musculus
catggacgtggtgaatcaggtacgc

SEQ ID NO: 317497 - DNA, 25 bp, Mus musculus
ttgtcccgccccttggtagcttcag

SEQ ID NO: 317498 - DNA, 25 bp, Mus musculus
cccgctctcgatcgcgctctcgcga

SEQ ID NO: 317499 - DNA, 25 bp, Mus musculus
gccaaagctcccgaaaccaatctta

SEQ ID NO: 317500 - DNA, 25 bp, Mus musculus
agtggcttcagccaaagctcccgaa

SEQ ID NO: 317501 - DNA, 25 bp, Mus musculus
ctcagtcattcgctgagtggcttca

SEQ ID NO: 317502 - DNA, 25 bp, Mus musculus
ggcgaccggaatggcctcagtcatt

SEQ ID NO: 317503 - DNA, 25 bp, Mus musculus
tctcgctcgcgctcttgttctcggt

SEQ ID NO: 317504 - DNA, 25 bp, Mus musculus
ctccggggcgaagcgtcgcagtcca

SEQ ID NO: 317505 - DNA, 25 bp, Mus musculus
cgtagccctgaacgggaggcctccg

SEQ ID NO: 317506 - DNA, 25 bp, Mus musculus
caccatggctcctgtatcgggctcg

SEQ ID NO: 317507 - DNA, 25 bp, Mus musculus
gtccgcctattacggcggctactcg

SEQ ID NO: 317508 - DNA, 25 bp, Mus musculus
tcttgttctcggttcggcgaccgga

SEQ ID NO: 317509 - DNA, 25 bp, Mus musculus
ctgtatcgggctcgcgtagccctga

SEQ ID NO: 317510 - DNA, 25 bp, Mus musculus
aagcgtcgcagtccatcgcggagcc

SEQ ID NO: 317511 - DNA, 25 bp, Mus musculus
gcccggagaagaagcaagcgaccca

SEQ ID NO: 317512 - DNA, 25 bp, Mus musculus
ttctacccgtcaggtgtgcacgttc

SEQ ID NO: 317513 - DNA, 25 bp, Mus musculus
ctctaaatggcggagcaactttctc

SEQ ID NO: 317514 - DNA, 25 bp, Mus musculus
tcagaacttggggatctctaaatgg

SEQ ID NO: 317515 - DNA, 25 bp, Mus musculus
ggacgtcgcggcagtttcagaactt

SEQ ID NO: 317516 - DNA, 25 bp, Mus musculus
ctgcatcagagaccaccacggagtg

SEQ ID NO: 317517 - DNA, 25 bp, Mus musculus
gcgttcccggacaggattctttctg

SEQ ID NO: 317518 - DNA, 25 bp, Mus musculus
ccaaaagtgactggcgttcgcggtc

SEQ ID NO: 317519 - DNA, 25 bp, Mus musculus
ctcctcagaggtgacccggctttac

SEQ ID NO: 317520 - DNA, 25 bp, Mus musculus
cccgttggtgaatttgtggatgtac

SEQ ID NO: 317521 - DNA, 25 bp, Mus musculus
gaaggcgcatccaaacggccaccgt

SEQ ID NO: 317522 - DNA, 25 bp, Mus musculus
aaggcaacctatggcggcttgagta

SEQ ID NO: 317523 - DNA, 25 bp, Mus musculus
gcgtggcagcgctaaacagaaggca

SEQ ID NO: 317524 - DNA, 25 bp, Mus musculus
cgtctacaagtctacccgttcggca

SEQ ID NO: 317525 - DNA, 25 bp, Mus musculus
cgactgtgcgagaagtcaggacaga

SEQ ID NO: 317526 - DNA, 25 bp, Mus musculus
gacagccgccaaagcatccaaaagc

SEQ ID NO: 317527 - DNA, 25 bp, Mus musculus
agcagcgtcggatccagagattctc

SEQ ID NO: 317528 - DNA, 25 bp, Mus musculus
ttggaagcctcttcgggagcagcgt

SEQ ID NO: 317529 - DNA, 25 bp, Mus musculus
tgtgaggacacagcgttggaagcct

SEQ ID NO: 317530 - DNA, 25 bp, Mus musculus
caggctccggaactgtgaggacaca

SEQ ID NO: 317531 - DNA, 25 bp, Mus musculus
gagagatatatattcaggctccgga

SEQ ID NO: 317532 - DNA, 25 bp, Mus musculus
tcaaggatcggagcagagagatata

SEQ ID NO: 317533 - DNA, 25 bp, Mus musculus
tgaggcgccagaagaaaaacccttc

SEQ ID NO: 317534 - DNA, 25 bp, Mus musculus
accataatttgggtgaggcgccaga

SEQ ID NO: 317535 - DNA, 25 bp, Mus musculus
gcctctccggacagaccataatttg

SEQ ID NO: 317536 - DNA, 25 bp, Mus musculus
aagtcaggacagaccgcctctccgg

SEQ ID NO: 317537 - DNA, 25 bp, Mus musculus
cggatccagagattctcgctatgga

SEQ ID NO: 317538 - DNA, 25 bp, Mus musculus
aagcatccaaaagcctccgagtccg

SEQ ID NO: 317539 - DNA, 25 bp, Mus musculus
ggactcggaggcttttggatgcttt

SEQ ID NO: 317540 - DNA, 25 bp, Mus musculus
tctgtcctgacttctcgcacagtcg

SEQ ID NO: 317541 - DNA, 25 bp, Mus musculus
aggcggtctgtcctgacttctcgca

SEQ ID NO: 317542 - DNA, 25 bp, Mus musculus
caaattatggtctgtccggagaggc

SEQ ID NO: 317543 - DNA, 25 bp, Mus musculus
tctggcgcctcacccaaattatggt

SEQ ID NO: 317544 - DNA, 25 bp, Mus musculus
gaagggtttttcttctggcgcctca

SEQ ID NO: 317545 - DNA, 25 bp, Mus musculus
tatatctctctgctccgatccttga

SEQ ID NO: 317546 - DNA, 25 bp, Mus musculus
tccggagcctgaatatatatctctc

SEQ ID NO: 317547 - DNA, 25 bp, Mus musculus
gtgtcctcacagttccggagcctga

SEQ ID NO: 317548 - DNA, 25 bp, Mus musculus
aggcttccaacgctgtgtcctcaca

SEQ ID NO: 317549 - DNA, 25 bp, Mus musculus
gacgctgctcccgaagaggcttcca

SEQ ID NO: 317550 - DNA, 25 bp, Mus musculus
cgagaatctctggatccgacgctgc

SEQ ID NO: 317551 - DNA, 25 bp, Mus musculus
tccatagcgagaatctctggatccg

SEQ ID NO: 317552 - DNA, 25 bp, Mus musculus
cttttggatgctttggcggctgtct

SEQ ID NO: 317553 - DNA, 25 bp, Mus musculus
ctgctattcagattccggggccgta

SEQ ID NO: 317554 - DNA, 25 bp, Mus musculus
ctgtcaaggagagtgagagcgactc

SEQ ID NO: 317555 - DNA, 25 bp, Mus musculus
aactgttcctgctgccgctgctatt

SEQ ID NO: 317556 - DNA, 25 bp, Mus musculus
cgtcgaccgtgatacacatggagaa

SEQ ID NO: 317557 - DNA, 25 bp, Mus musculus
cctccgacgagagtgatgacgactc

SEQ ID NO: 317558 - DNA, 25 bp, Mus musculus
agccataggctgtgccactgtcaag

SEQ ID NO: 317559 - DNA, 25 bp, Mus musculus
ccacgacagtggaggagccataggc

SEQ ID NO: 317560 - DNA, 25 bp, Mus musculus
tcggcccggttctagtcatggccca

SEQ ID NO: 317561 - DNA, 25 bp, Mus musculus
accggtaacagacgctgggcttcga

SEQ ID NO: 317562 - DNA, 25 bp, Mus musculus
tccgtctggactggaccggtaacag

SEQ ID NO: 317563 - DNA, 25 bp, Mus musculus
caggtcctcactttcggctggcttc

SEQ ID NO: 317564 - DNA, 25 bp, Mus musculus
ttgtcgtcatcgctcatccaggtcc

SEQ ID NO: 317565 - DNA, 25 bp, Mus musculus
gagcatgcgcacaagttcccggttg

SEQ ID NO: 317566 - DNA, 25 bp, Mus musculus
gcaccagcgacgaggatacttcaga

SEQ ID NO: 317567 - DNA, 25 bp, Mus musculus
cgccccggccctgagctcacgtgac

SEQ ID NO: 317568 - DNA, 25 bp, Mus musculus
cttttccgctgaccgtccagcctcc

SEQ ID NO: 317569 - DNA, 25 bp, Mus musculus
ttttccgctgaccgtccagcctcca

SEQ ID NO: 317570 - DNA, 25 bp, Mus musculus
gacttttccgctgaccgtccagcct

SEQ ID NO: 317571 - DNA, 25 bp, Mus musculus
ggacttttccgctgaccgtccagcc

SEQ ID NO: 317572 - DNA, 25 bp, Mus musculus
gggacttttccgctgaccgtccagc

SEQ ID NO: 317573 - DNA, 25 bp, Mus musculus
cgggacttttccgctgaccgtccag

SEQ ID NO: 317574 - DNA, 25 bp, Mus musculus
agcgacgagccctggtgggggccgg

SEQ ID NO: 317575 - DNA, 25 bp, Mus musculus
gagcgacgagccctggtgggggccg

SEQ ID NO: 317576 - DNA, 25 bp, Mus musculus
ggagcgacgagccctggtgggggcc

SEQ ID NO: 317577 - DNA, 25 bp, Mus musculus
aggagcgacgagccctggtgggggc

SEQ ID NO: 317578 - DNA, 25 bp, Mus musculus
acttttccgctgaccgtccagcctc

SEQ ID NO: 317579 - DNA, 25 bp, Mus musculus
caccatctgcttttgcccgtatggc

SEQ ID NO: 317580 - DNA, 25 bp, Mus musculus
accatctgcttttgcccgtatggcc

SEQ ID NO: 317581 - DNA, 25 bp, Mus musculus
agccgctttcgagaccgctctttct

SEQ ID NO: 317582 - DNA, 25 bp, Mus musculus
tgcccacccagaagcagcctgggag

SEQ ID NO: 317583 - DNA, 25 bp, Mus musculus
caggtcaactccagccgctacaaga

SEQ ID NO: 317584 - DNA, 25 bp, Mus musculus
cttcgaagaaaacggtgcctgtaag

SEQ ID NO: 317585 - DNA, 25 bp, Mus musculus
tgcctgtaagtacggggacaagtgc

SEQ ID NO: 317586 - DNA, 25 bp, Mus musculus
gccacttcattcataacgccgagga

SEQ ID NO: 317587 - DNA, 25 bp, Mus musculus
cttcattcataacgccgaggagcga

SEQ ID NO: 317588 - DNA, 25 bp, Mus musculus
gcctccagcatagctttagctttgc

SEQ ID NO: 317589 - DNA, 25 bp, Mus musculus
agctttagctttgctgggtttccca

SEQ ID NO: 317590 - DNA, 25 bp, Mus musculus
tttgctgggtttcccagtgccgctg

SEQ ID NO: 317591 - DNA, 25 bp, Mus musculus
gacagccgctttcgagaccgctctt

SEQ ID NO: 317592 - DNA, 25 bp, Mus musculus
tcgaagaaaacggtgcctgtaagta

SEQ ID NO: 317593 - DNA, 25 bp, Mus musculus
gctgggtttcccagtgccgctgcca

SEQ ID NO: 317594 - DNA, 25 bp, Mus musculus
gctgccacttcattcataacgccga

SEQ ID NO: 317595 - DNA, 25 bp, Mus musculus
ccttgcataagccttagggcgtggg

SEQ ID NO: 317596 - DNA, 25 bp, Mus musculus
gaaggcgaggaagccacgcctccca

SEQ ID NO: 317597 - DNA, 25 bp, Mus musculus
aggcacccggtacccttgcataagc

SEQ ID NO: 317598 - DNA, 25 bp, Mus musculus
ccttctctgtccagtgccagaggca

SEQ ID NO: 317599 - DNA, 25 bp, Mus musculus
tctaccaagagaaccggtaaggcgc

SEQ ID NO: 317600 - DNA, 25 bp, Mus musculus
gggtcccggagctctaccaagagaa

SEQ ID NO: 317601 - DNA, 25 bp, Mus musculus
ctgctctttctttgtgtgggtcccg

SEQ ID NO: 317602 - DNA, 25 bp, Mus musculus
cttgaaccaggaagcagcggagccc

SEQ ID NO: 317603 - DNA, 25 bp, Mus musculus
gcggccgcctcgcttgaaccaggaa

SEQ ID NO: 317604 - DNA, 25 bp, Mus musculus
ctgcttggggtaggactctgaccct

SEQ ID NO: 317605 - DNA, 25 bp, Mus musculus
agcgacatttaaagcggcagcagcg

SEQ ID NO: 317606 - DNA, 25 bp, Mus musculus
tcggcggaaactggagcgacattta

SEQ ID NO: 317607 - DNA, 25 bp, Mus musculus
gaagccgctttgacgtcggcggaaa

SEQ ID NO: 317608 - DNA, 25 bp, Mus musculus
gccttggctcctctgctctttcttt

SEQ ID NO: 317609 - DNA, 25 bp, Mus musculus
tcttaccggaagtgcctgggcagac

SEQ ID NO: 317610 - DNA, 25 bp, Mus musculus
accggaagtgcctgggcagacactt

SEQ ID NO: 317611 - DNA, 25 bp, Mus musculus
acatcgctcttaccggaagtgcctg

SEQ ID NO: 317612 - DNA, 25 bp, Mus musculus
cttaccggaagtgcctgggcagaca

SEQ ID NO: 317613 - DNA, 25 bp, Mus musculus
ccggaagtgcctgggcagacacttt

SEQ ID NO: 317614 - DNA, 25 bp, Mus musculus
ctcttaccggaagtgcctgggcaga

SEQ ID NO: 317615 - DNA, 25 bp, Mus musculus
gctcttaccggaagtgcctgggcag

SEQ ID NO: 317616 - DNA, 25 bp, Mus musculus
cgctcttaccggaagtgcctgggca

SEQ ID NO: 317617 - DNA, 25 bp, Mus musculus
atcgctcttaccggaagtgcctggg

SEQ ID NO: 317618 - DNA, 25 bp, Mus musculus
catcgctcttaccggaagtgcctgg

SEQ ID NO: 317619 - DNA, 25 bp, Mus musculus
tcgctcttaccggaagtgcctgggc

SEQ ID NO: 317620 - DNA, 25 bp, Mus musculus
cggaagtgcctgggcagacactttt

SEQ ID NO: 317621 - DNA, 25 bp, Mus musculus
taccggaagtgcctgggcagacact

SEQ ID NO: 317622 - DNA, 25 bp, Mus musculus
ggaagtgcctgggcagacacttttc

SEQ ID NO: 317623 - DNA, 25 bp, Mus musculus
tggcgacaccttcggcgctcttgat

SEQ ID NO: 317624 - DNA, 25 bp, Mus musculus
agaggcggcgtcaccctcgcggagt

SEQ ID NO: 317625 - DNA, 25 bp, Mus musculus
tggaagcgcccggaacgctcactcc

SEQ ID NO: 317626 - DNA, 25 bp, Mus musculus
tcactccgggcagctcactcggggt

SEQ ID NO: 317627 - DNA, 25 bp, Mus musculus
ggcagctcactcggggtccggttcc

SEQ ID NO: 317628 - DNA, 25 bp, Mus musculus
ggctccctcaccgtcggccacccga

SEQ ID NO: 317629 - DNA, 25 bp, Mus musculus
caccgtcggccacccgatccttaag

SEQ ID NO: 317630 - DNA, 25 bp, Mus musculus
ggagcttcgcgccacatcgctctta

SEQ ID NO: 317631 - DNA, 25 bp, Mus musculus
ggaccttggcgacaccttcggcgct

SEQ ID NO: 317632 - DNA, 25 bp, Mus musculus
acaccttcggcgctcttgattggag

SEQ ID NO: 317633 - DNA, 25 bp, Mus musculus
ccttcggcgctcttgattggaggtt

SEQ ID NO: 317634 - DNA, 25 bp, Mus musculus
tcggcgctcttgattggaggtttcc

SEQ ID NO: 317635 - DNA, 25 bp, Mus musculus
cgctcttgattggaggtttccgaac

SEQ ID NO: 317636 - DNA, 25 bp, Mus musculus
gcttcgcgccacatcgctcttaccg

SEQ ID NO: 317637 - DNA, 25 bp, Mus musculus
caaggcccactctgttacgctcgga

SEQ ID NO: 317638 - DNA, 25 bp, Mus musculus
acgctcggaaccaggctgctctaga

SEQ ID NO: 317639 - DNA, 25 bp, Mus musculus
tggacgtgagaggtccaaggcccac

SEQ ID NO: 317640 - DNA, 25 bp, Mus musculus
tgctctagacgcaggcggtatcctc

SEQ ID NO: 317641 - DNA, 25 bp, Mus musculus
cggtatcctctcgttggtgtcatta

SEQ ID NO: 317642 - DNA, 25 bp, Mus musculus
cgttggtgtcattaatgacggagca

SEQ ID NO: 317643 - DNA, 25 bp, Mus musculus
tgacggagcaacagaggaagctgac

SEQ ID NO: 317644 - DNA, 25 bp, Mus musculus
ctccgtgagactcggaaagggcccg

SEQ ID NO: 317645 - DNA, 25 bp, Mus musculus
ccgacatgctcagctgtacccaatg

SEQ ID NO: 317646 - DNA, 25 bp, Mus musculus
ctcagctgtacccaatgggatgccc

SEQ ID NO: 317647 - DNA, 25 bp, Mus musculus
gcgtgcgtgttttaaggcccgccca

SEQ ID NO: 317648 - DNA, 25 bp, Mus musculus
tcggtctgcctacgggcgtggaaac

SEQ ID NO: 317649 - DNA, 25 bp, Mus musculus
ctccagggcaggaaagcgctgcctc

SEQ ID NO: 317650 - DNA, 25 bp, Mus musculus
gctgcctcacgaggcttggacgtga

SEQ ID NO: 317651 - DNA, 25 bp, Mus musculus
ggaggccttgtggtcaccagccaca

SEQ ID NO: 317652 - DNA, 25 bp, Mus musculus
tttatctcccgaggaagcaagttgg

SEQ ID NO: 317653 - DNA, 25 bp, Mus musculus
gcaagttgggcagatcgatttatta

SEQ ID NO: 317654 - DNA, 25 bp, Mus musculus
gcctttcttggggttgtatctgtgc

SEQ ID NO: 317655 - DNA, 25 bp, Mus musculus
cgacccacctttgctgggcgaaaga

SEQ ID NO: 317656 - DNA, 25 bp, Mus musculus
agggattgctccttctccacataac

SEQ ID NO: 317657 - DNA, 25 bp, Mus musculus
cacctctaggaggagtcgctcagcc

SEQ ID NO: 317658 - DNA, 25 bp, Mus musculus
ctttcgtggggcttgatgagctatt

SEQ ID NO: 317659 - DNA, 25 bp, Mus musculus
tgcagtggaaccacagggccagttc

SEQ ID NO: 317660 - DNA, 25 bp, Mus musculus
gcatttcggcatcctccctgcttgg

SEQ ID NO: 317661 - DNA, 25 bp, Mus musculus
agccacaggctccagatagctcgac

SEQ ID NO: 317662 - DNA, 25 bp, Mus musculus
tgcactgcccggacaagagggtttt

SEQ ID NO: 317663 - DNA, 25 bp, Mus musculus
tgagctattgtccttctgcagtgga

SEQ ID NO: 317664 - DNA, 25 bp, Mus musculus
tatctgtgcgtgtcaatggcggcaa

SEQ ID NO: 317665 - DNA, 25 bp, Mus musculus
ccatagatgcacagcgggtcggtct

SEQ ID NO: 317666 - DNA, 25 bp, Mus musculus
gtctgatcctgctgagaaaacgtca

SEQ ID NO: 317667 - DNA, 25 bp, Mus musculus
aacgtcaaaacacggggcaggagat

SEQ ID NO: 317668 - DNA, 25 bp, Mus musculus
cccgagtctctgactccatagatgc

SEQ ID NO: 317669 - DNA, 25 bp, Mus musculus
gcgctgtcctgagccgtagatgacc

SEQ ID NO: 317670 - DNA, 25 bp, Mus musculus
gagccgtagatgacccgggaccaca

SEQ ID NO: 317671 - DNA, 25 bp, Mus musculus
gatacacacactgcgttccacgtgg

SEQ ID NO: 317672 - DNA, 25 bp, Mus musculus
taggtggtccgaagtctgatcctgc

SEQ ID NO: 317673 - DNA, 25 bp, Mus musculus
caagacaaagaaagtaggtggtccg

SEQ ID NO: 317674 - DNA, 25 bp, Mus musculus
tgagagtggtgctaaagggtaaccc

SEQ ID NO: 317675 - DNA, 25 bp, Mus musculus
cctagttagaagactgcgcaagcgc

SEQ ID NO: 317676 - DNA, 25 bp, Mus musculus
cggacgcaacgttgccctagttaga

SEQ ID NO: 317677 - DNA, 25 bp, Mus musculus
tctctatggcaaccggacggacgca

SEQ ID NO: 317678 - DNA, 25 bp, Mus musculus
gacccgggaccacagagatacacac

SEQ ID NO: 317679 - DNA, 25 bp, Mus musculus
gaaaatggggcaaagcgtgctccgg

SEQ ID NO: 317680 - DNA, 25 bp, Mus musculus
cagccaggcagaagaaaatggggca

SEQ ID NO: 317681 - DNA, 25 bp, Mus musculus
aggcgtagcacagccaggcagaaga

SEQ ID NO: 317682 - DNA, 25 bp, Mus musculus
cgttttaggcgtagcacagccaggc

SEQ ID NO: 317683 - DNA, 25 bp, Mus musculus
tcagcttcgttttaggcgtagcaca

SEQ ID NO: 317684 - DNA, 25 bp, Mus musculus
tcttgtcagcttcgttttaggcgta

SEQ ID NO: 317685 - DNA, 25 bp, Mus musculus
ccatgctcttgtcagcttcgtttta

SEQ ID NO: 317686 - DNA, 25 bp, Mus musculus
tgcgcccatgctcttgtcagcttcg

SEQ ID NO: 317687 - DNA, 25 bp, Mus musculus
gagttgcgcccatgctcttgtcagc

SEQ ID NO: 317688 - DNA, 25 bp, Mus musculus
tgacgactcccgagttgcgcccatg

SEQ ID NO: 317689 - DNA, 25 bp, Mus musculus
attattttgacgactcccgagttgc

SEQ ID NO: 317690 - DNA, 25 bp, Mus musculus
ctattattattttgacgactcccga

SEQ ID NO: 317691 - DNA, 25 bp, Mus musculus
tgtaagagccggcgaattctttttc

SEQ ID NO: 317692 - DNA, 25 bp, Mus musculus
agtgagcgagcgagagcaagttgag

SEQ ID NO: 317693 - DNA, 25 bp, Mus musculus
agcgcacgcactcagagctgatggg

SEQ ID NO: 317694 - DNA, 25 bp, Mus musculus
tgatgggcggcaccaatttcccaac

SEQ ID NO: 317695 - DNA, 25 bp, Mus musculus
caccgggcttcgaccggacagcgaa

SEQ ID NO: 317696 - DNA, 25 bp, Mus musculus
ccggacagcgaaaaggtggcatgac

SEQ ID NO: 317697 - DNA, 25 bp, Mus musculus
tccacctggcgcgtcaagcgttcga

SEQ ID NO: 317698 - DNA, 25 bp, Mus musculus
aagcgttcgagctgtgcctgcagcc

SEQ ID NO: 317699 - DNA, 25 bp, Mus musculus
tgcagccgctggttgtcccgctgca

SEQ ID NO: 317700 - DNA, 25 bp, Mus musculus
tcggccacagtacgagccaaggggc

SEQ ID NO: 317701 - DNA, 25 bp, Mus musculus
tgcatgtcctcgtgcagcgcacgca

SEQ ID NO: 317702 - DNA, 25 bp, Mus musculus
gctccatggccgagtggggcacacc

SEQ ID NO: 317703 - DNA, 25 bp, Mus musculus
acaccgatcggacagcgggcagaac

SEQ ID NO: 317704 - DNA, 25 bp, Mus musculus
ggagacgttgagagatccgcagctc

SEQ ID NO: 317705 - DNA, 25 bp, Mus musculus
atccgcagctccttgggacgactgg

SEQ ID NO: 317706 - DNA, 25 bp, Mus musculus
ggcgggacagcccattccaggacac

SEQ ID NO: 317707 - DNA, 25 bp, Mus musculus
ttctgggacattgcgaaaccggatc

SEQ ID NO: 317708 - DNA, 25 bp, Mus musculus
cagccgcgagttcttggacttcttc

SEQ ID NO: 317709 - DNA, 25 bp, Mus musculus
aaagcgaccgccacagcctgctgga

SEQ ID NO: 317710 - DNA, 25 bp, Mus musculus
gaaagctgagcctgcgactcccgca

SEQ ID NO: 317711 - DNA, 25 bp, Mus musculus
gcccacgtgtttggctcagcatggc

SEQ ID NO: 317712 - DNA, 25 bp, Mus musculus
tgactgtcttctgagcccacgtgtt

SEQ ID NO: 317713 - DNA, 25 bp, Mus musculus
cgccgagacctgacctggaagtgac

SEQ ID NO: 317714 - DNA, 25 bp, Mus musculus
ggcaaggccgtacggaagccacttc

SEQ ID NO: 317715 - DNA, 25 bp, Mus musculus
cacacgcgcgtgtgagaacactctg

SEQ ID NO: 317716 - DNA, 25 bp, Mus musculus
ctcctccaggttaaaggaagagatc

SEQ ID NO: 317717 - DNA, 25 bp, Mus musculus
tccggtcgtcaggaactcctccagg

SEQ ID NO: 317718 - DNA, 25 bp, Mus musculus
cgtggatttgtttgcacctccggtc

SEQ ID NO: 317719 - DNA, 25 bp, Mus musculus
ccgggtctgggaagagatcatacta

SEQ ID NO: 317720 - DNA, 25 bp, Mus musculus
tagcggatgtctcggactagatcgc

SEQ ID NO: 317721 - DNA, 25 bp, Mus musculus
ctctcgaagggcgagcacggctttg

SEQ ID NO: 317722 - DNA, 25 bp, Mus musculus
agtccagggagtcgagtctctcgaa

SEQ ID NO: 317723 - DNA, 25 bp, Mus musculus
ttccagaggtccaggtaagtgggcc

SEQ ID NO: 317724 - DNA, 25 bp, Mus musculus
ctttagtttcttccagaggtccagg

SEQ ID NO: 317725 - DNA, 25 bp, Mus musculus
gccgcgtacgacgtgtcttccttta

SEQ ID NO: 317726 - DNA, 25 bp, Mus musculus
gggaacctgcgccaaggcactgcca

SEQ ID NO: 317727 - DNA, 25 bp, Mus musculus
tgcggcgccatgaagctgtacagcc

SEQ ID NO: 317728 - DNA, 25 bp, Mus musculus
gccttactctaggaggaagaagccg

SEQ ID NO: 317729 - DNA, 25 bp, Mus musculus
ccggaagtgggccttactctaggag

SEQ ID NO: 317730 - DNA, 25 bp, Mus musculus
gagcaactcgccaccggaaccggaa

SEQ ID NO: 317731 - DNA, 25 bp, Mus musculus
acgcaggcggagaccgagcctcctg

SEQ ID NO: 317732 - DNA, 25 bp, Mus musculus
atccgaaagcggtgctgctcaaggc

SEQ ID NO: 317733 - DNA, 25 bp, Mus musculus
gtgtcctttacaaaggcgatccgaa

SEQ ID NO: 317734 - DNA, 25 bp, Mus musculus
agctgtacagccttagtgtccttta

SEQ ID NO: 317735 - DNA, 25 bp, Mus musculus
cgaggcgcattccaggcacatcatg

SEQ ID NO: 317736 - DNA, 25 bp, Mus musculus
aacgtctgcacctcttcgtcggcgg

SEQ ID NO: 317737 - DNA, 25 bp, Mus musculus
cctaaactcaggatggcagcagctg

SEQ ID NO: 317738 - DNA, 25 bp, Mus musculus
tgtccaggtagttgagcacgttgcc

SEQ ID NO: 317739 - DNA, 25 bp, Mus musculus
ctgccacagtgtacctgtccaggta

SEQ ID NO: 317740 - DNA, 25 bp, Mus musculus
atggggcatttgctcacctgccaca

SEQ ID NO: 317741 - DNA, 25 bp, Mus musculus
cttggatctagggagctggcaacca

SEQ ID NO: 317742 - DNA, 25 bp, Mus musculus
ggactctccagagggcttggatcta

SEQ ID NO: 317743 - DNA, 25 bp, Mus musculus
gcatcgcttgaacagagggtcctta

SEQ ID NO: 317744 - DNA, 25 bp, Mus musculus
tggacccatggaacgccaaagcatc

SEQ ID NO: 317745 - DNA, 25 bp, Mus musculus
ttggcgaaggctcacaagctgctcc

SEQ ID NO: 317746 - DNA, 25 bp, Mus musculus
actctgggaggacaacggatgagcc

SEQ ID NO: 317747 - DNA, 25 bp, Mus musculus
gcaaccaaaagctccctagggcatc

SEQ ID NO: 317748 - DNA, 25 bp, Mus musculus
gtgcaagcacagacggcctggacta

SEQ ID NO: 317749 - DNA, 25 bp, Mus musculus
tgcttctcgggtctcccaagaccgg

SEQ ID NO: 317750 - DNA, 25 bp, Mus musculus
ttcgcggagttagggcagacaacaa

SEQ ID NO: 317751 - DNA, 25 bp, Mus musculus
gaggcgcgccaaacttctggcccgg

SEQ ID NO: 317752 - DNA, 25 bp, Mus musculus
tggcgacactcctggcccggctgtg

SEQ ID NO: 317753 - DNA, 25 bp, Mus musculus
gctgctactgcgaagacagctggca

SEQ ID NO: 317754 - DNA, 25 bp, Mus musculus
ccagtccgtcgaagtcccggtggcg

SEQ ID NO: 317755 - DNA, 25 bp, Mus musculus
ctgcagtcggcgctgctactgcgaa

SEQ ID NO: 317756 - DNA, 25 bp, Mus musculus
agcttgtcgccagtccgtcgaagtc

SEQ ID NO: 317757 - DNA, 25 bp, Mus musculus
caggcaccggcagagcttgtcgcca

SEQ ID NO: 317758 - DNA, 25 bp, Mus musculus
acatctagctccaggcaccggcaga

SEQ ID NO: 317759 - DNA, 25 bp, Mus musculus
gggttcctcaacacacatctagctc

SEQ ID NO: 317760 - DNA, 25 bp, Mus musculus
ggtccgggttcctcaacacacatct

SEQ ID NO: 317761 - DNA, 25 bp, Mus musculus
cagacaacaaaagcgacggcggggc

SEQ ID NO: 317762 - DNA, 25 bp, Mus musculus
agtcgcggcgagctggcgacactcc

SEQ ID NO: 317763 - DNA, 25 bp, Mus musculus
tggcacgggaagacgcgaagcaata

SEQ ID NO: 317764 - DNA, 25 bp, Mus musculus
cccgatcccggtagtctcagaacga

SEQ ID NO: 317765 - DNA, 25 bp, Mus musculus
tcctgcagtctgtcttcactcgtca

SEQ ID NO: 317766 - DNA, 25 bp, Mus musculus
tctcagcgccgttcctatggcaacg

SEQ ID NO: 317767 - DNA, 25 bp, Mus musculus
tcctatgtagcgtttcggggctccc

SEQ ID NO: 317768 - DNA, 25 bp, Mus musculus
tgtctcgcgagccttcctatgtagc

SEQ ID NO: 317769 - DNA, 25 bp, Mus musculus
aagcaataggggtaccactggccgg

SEQ ID NO: 317770 - DNA, 25 bp, Mus musculus
cgccggcatttatcgcgaggctgta

SEQ ID NO: 317771 - DNA, 25 bp, Mus musculus
gatgattcccttgcgccggcattta

SEQ ID NO: 317772 - DNA, 25 bp, Mus musculus
ctcgcgagacttgatgattcccttg

SEQ ID NO: 317773 - DNA, 25 bp, Mus musculus
gtccgcgcttgtcaaaccttccaaa

SEQ ID NO: 317774 - DNA, 25 bp, Mus musculus
tacgagatagcccagtccgcgcttg

SEQ ID NO: 317775 - DNA, 25 bp, Mus musculus
cgatcgcctggagtacgagatagcc

SEQ ID NO: 317776 - DNA, 25 bp, Mus musculus
tcgtacggtgcatcacgtgtctcgc

SEQ ID NO: 317777 - DNA, 25 bp, Mus musculus
gagtccgtcaccctggagcagttcc

SEQ ID NO: 317778 - DNA, 25 bp, Mus musculus
cctgcgaatccctggtgtcgaggca

SEQ ID NO: 317779 - DNA, 25 bp, Mus musculus
cacatcaagattgggctgccgactc

SEQ ID NO: 317780 - DNA, 25 bp, Mus musculus
agggctggagcccacatcaagattg

SEQ ID NO: 317781 - DNA, 25 bp, Mus musculus
catggggaacgctccgagtaacagc

SEQ ID NO: 317782 - DNA, 25 bp, Mus musculus
ctcgacagccaggaagccggaagtc

SEQ ID NO: 317783 - DNA, 25 bp, Mus musculus
ggaatccgcttgacggctccgttgc

SEQ ID NO: 317784 - DNA, 25 bp, Mus musculus
gctgtcgtgagcaaatggaatccgc

SEQ ID NO: 317785 - DNA, 25 bp, Mus musculus
ccagcctagattctgaacgtgaagc

SEQ ID NO: 317786 - DNA, 25 bp, Mus musculus
agcccgcatatcctcagcatctata

SEQ ID NO: 317787 - DNA, 25 bp, Mus musculus
acgcttcggaggtagccacctctta

SEQ ID NO: 317788 - DNA, 25 bp, Mus musculus
ctaagacagcagagacgccggccgt

SEQ ID NO: 317789 - DNA, 25 bp, Mus musculus
ggcagcgcgacactgacagacttca

SEQ ID NO: 317790 - DNA, 25 bp, Mus musculus
tgggttcccgggcttcattaagctg

SEQ ID NO: 317791 - DNA, 25 bp, Mus musculus
caggaagccgggctcagtaagcctc

SEQ ID NO: 317792 - DNA, 25 bp, Mus musculus
tgccatagccactgccgtcggggaa

SEQ ID NO: 317793 - DNA, 25 bp, Mus musculus
tgcgtcgcttctcggtgacagccga

SEQ ID NO: 317794 - DNA, 25 bp, Mus musculus
ccacacagtagccttgaggagaagc

SEQ ID NO: 317795 - DNA, 25 bp, Mus musculus
taagcctctgcaaatgcgcgtgggg

SEQ ID NO: 317796 - DNA, 25 bp, Mus musculus
cgggctcagtaagcctctgcaaatg

SEQ ID NO: 317797 - DNA, 25 bp, Mus musculus
aagctcgcagcactccacacagtag

SEQ ID NO: 317798 - DNA, 25 bp, Mus musculus
gaaggtcccagcgtggtcatggcct

SEQ ID NO: 317799 - DNA, 25 bp, Mus musculus
tgagcgtgggttcctgccctgcagt

SEQ ID NO: 317800 - DNA, 25 bp, Mus musculus
ccaacggtgagcgtgggttcctgcc

SEQ ID NO: 317801 - DNA, 25 bp, Mus musculus
ccagcgtggtcatggcctcccgagg

SEQ ID NO: 317802 - DNA, 25 bp, Mus musculus
atggaggaggcgcacctgctctccg

SEQ ID NO: 317803 - DNA, 25 bp, Mus musculus
ccttgaggagaagcgacctggacgt

SEQ ID NO: 317804 - DNA, 25 bp, Mus musculus
gctgccgacgtgctgcgtcgcttct

SEQ ID NO: 317805 - DNA, 25 bp, Mus musculus
tggtgcccaccgcagagactgtcgc

SEQ ID NO: 317806 - DNA, 25 bp, Mus musculus
acccacgtgtggatctcagcagagc

SEQ ID NO: 317807 - DNA, 25 bp, Mus musculus
ctgtctgtgggactgcatagaagcc

SEQ ID NO: 317808 - DNA, 25 bp, Mus musculus
gcgtttcttccgcagctgctgtctg

SEQ ID NO: 317809 - DNA, 25 bp, Mus musculus
tgtctaagccagctatgcgggtgcc

SEQ ID NO: 317810 - DNA, 25 bp, Mus musculus
gatggttccctgagcccgcatctgt

SEQ ID NO: 317811 - DNA, 25 bp, Mus musculus
gtgtgcagagattcccgctgtgtct

SEQ ID NO: 317812 - DNA, 25 bp, Mus musculus
ccctgtgcagccaacgggctgtaga

SEQ ID NO: 317813 - DNA, 25 bp, Mus musculus
gaggaccggactctgattggacatc

SEQ ID NO: 317814 - DNA, 25 bp, Mus musculus
agactgtcgccaggtgcctaggtag

SEQ ID NO: 317815 - DNA, 25 bp, Mus musculus
ctgcgcggcacagccaatgatcgtg

SEQ ID NO: 317816 - DNA, 25 bp, Mus musculus
agcgagcgacttcagctgctgcgca

SEQ ID NO: 317817 - DNA, 25 bp, Mus musculus
cagccgggacttggagttggaaact

SEQ ID NO: 317818 - DNA, 25 bp, Mus musculus
catcgtacgcttcaggccaggctga

SEQ ID NO: 317819 - DNA, 25 bp, Mus musculus
agagccaccagcagacgcgatcgga

SEQ ID NO: 317820 - DNA, 25 bp, Mus musculus
tgctcgccaaagaggaccgaaaatg

SEQ ID NO: 317821 - DNA, 25 bp, Mus musculus
cgtggctagaggacgtccctttcct

SEQ ID NO: 317822 - DNA, 25 bp, Mus musculus
tccaagaggcgcgatccaaactgag

SEQ ID NO: 317823 - DNA, 25 bp, Mus musculus
tccagcagttggttgactcgtccca

SEQ ID NO: 317824 - DNA, 25 bp, Mus musculus
gggcacaaacctcgtccagcagttg

SEQ ID NO: 317825 - DNA, 25 bp, Mus musculus
acccacagttctaggacaggcaacc

SEQ ID NO: 317826 - DNA, 25 bp, Mus musculus
cgcgatcggagtacgccaaagtaag

SEQ ID NO: 317827 - DNA, 25 bp, Mus musculus
atgttccaagttcggggatctggcc

SEQ ID NO: 317828 - DNA, 25 bp, Mus musculus
ctcttctgcagagttctcgggctgg

SEQ ID NO: 317829 - DNA, 25 bp, Mus musculus
gtccttctgggtgttttgtgtctcc

SEQ ID NO: 317830 - DNA, 25 bp, Mus musculus
attctggcgcctctgtaacttgaca

SEQ ID NO: 317831 - DNA, 25 bp, Mus musculus
cgggcgctacttcccaaactaatct

SEQ ID NO: 317832 - DNA, 25 bp, Mus musculus
tgctctgaatacctggcagctcagc

SEQ ID NO: 317833 - DNA, 25 bp, Mus musculus
cccgaacggaatcagctgtgtttgg

SEQ ID NO: 317834 - DNA, 25 bp, Mus musculus
ataaggacagctttctggtagaaac

SEQ ID NO: 317835 - DNA, 25 bp, Mus musculus
tctggtagaaacagacgacgctcta

SEQ ID NO: 317836 - DNA, 25 bp, Mus musculus
acgacgctctaggtgatagcggtgc

SEQ ID NO: 317837 - DNA, 25 bp, Mus musculus
atagcggtgctcctctgtggtcatc

SEQ ID NO: 317838 - DNA, 25 bp, Mus musculus
tgctcctctgtggtcatcggcgacg

SEQ ID NO: 317839 - DNA, 25 bp, Mus musculus
ttggttggagataaaaaggagccgc

SEQ ID NO: 317840 - DNA, 25 bp, Mus musculus
tccgcggcctgcgagtgtctgtgaa

SEQ ID NO: 317841 - DNA, 25 bp, Mus musculus
gggcgccagagataaggacagcttt

SEQ ID NO: 317842 - DNA, 25 bp, Mus musculus
cttccgtcgcccgaggtggagtccg

SEQ ID NO: 317843 - DNA, 25 bp, Mus musculus
aagaaggcgagctggaaatcgtgcc

SEQ ID NO: 317844 - DNA, 25 bp, Mus musculus
cggtgcggcgctccctaaaggaact

SEQ ID NO: 317845 - DNA, 25 bp, Mus musculus
cgcatgacccggagagcgccagaga

SEQ ID NO: 317846 - DNA, 25 bp, Mus musculus
tcagctgtgtttggttggagataaa

SEQ ID NO: 317847 - DNA, 25 bp, Mus musculus
gagccgaggtcgcagcctttggact

SEQ ID NO: 317848 - DNA, 25 bp, Mus musculus
tcggcggctggaaccattgctcagc

SEQ ID NO: 317849 - DNA, 25 bp, Mus musculus
cctcgccgcgtacgttcgaaagagc

SEQ ID NO: 317850 - DNA, 25 bp, Mus musculus
ccgaccgcgggtgagcctgtgccat

SEQ ID NO: 317851 - DNA, 25 bp, Mus musculus
tgagcctgtgccatagcgagcgccc

SEQ ID NO: 317852 - DNA, 25 bp, Mus musculus
ggcgtttcaaacagaaacaccgcga

SEQ ID NO: 317853 - DNA, 25 bp, Mus musculus
aacaccgcgagactgcggcgagcgc

SEQ ID NO: 317854 - DNA, 25 bp, Mus musculus
actcgttactgtcgctgaggctgct

SEQ ID NO: 317855 - DNA, 25 bp, Mus musculus
cacttctgcgggagccgaggtcgca

SEQ ID NO: 317856 - DNA, 25 bp, Mus musculus
gcagcctttggactcttggagtgtt

SEQ ID NO: 317857 - DNA, 25 bp, Mus musculus
actcttggagtgtttgtcagggtcc

SEQ ID NO: 317858 - DNA, 25 bp, Mus musculus
tgtttgtcagggtccgctggttccg

SEQ ID NO: 317859 - DNA, 25 bp, Mus musculus
cgacagccggcgactcgttactgtc

SEQ ID NO: 317860 - DNA, 25 bp, Mus musculus
gctgcacggggtgctgcacttctgc

SEQ ID NO: 317861 - DNA, 25 bp, Mus musculus
cagcccggtggtgtcaccgtgtcag

SEQ ID NO: 317862 - DNA, 25 bp, Mus musculus
ttcctttcgagcgagtcccgtggga

SEQ ID NO: 317863 - DNA, 25 bp, Mus musculus
ggcgagacgccttggaaagcacctt

SEQ ID NO: 317864 - DNA, 25 bp, Mus musculus
gagacgccttggaaagcaccttccc

SEQ ID NO: 317865 - DNA, 25 bp, Mus musculus
tcctcgcctccgcacacagccagtg

SEQ ID NO: 317866 - DNA, 25 bp, Mus musculus
aggcacagcccggtggtgtcaccgt

SEQ ID NO: 317867 - DNA, 25 bp, Mus musculus
accgtgtcagcggaggcggcctcat

SEQ ID NO: 317868 - DNA, 25 bp, Mus musculus
agcggaggcggcctcatcccaggct

SEQ ID NO: 317869 - DNA, 25 bp, Mus musculus
gcagtcaggctctccgcggcagcag

SEQ ID NO: 317870 - DNA, 25 bp, Mus musculus
tgctctccagctcatgccctttgga

SEQ ID NO: 317871 - DNA, 25 bp, Mus musculus
agctcatgccctttggagccgcgcg

SEQ ID NO: 317872 - DNA, 25 bp, Mus musculus
tgcggcagcgcacacagagtgctcg

SEQ ID NO: 317873 - DNA, 25 bp, Mus musculus
acacagagtgctcggttggctgccg

SEQ ID NO: 317874 - DNA, 25 bp, Mus musculus
cacagccagtggctggaggcacagc

SEQ ID NO: 317875 - DNA, 25 bp, Mus musculus
caccgccgtagtggtgagtgcgctt

SEQ ID NO: 317876 - DNA, 25 bp, Mus musculus
gataccttttactaggcgcagaccg

SEQ ID NO: 317877 - DNA, 25 bp, Mus musculus
agaggccagatcctgtgcactgccg

SEQ ID NO: 317878 - DNA, 25 bp, Mus musculus
cggtggccgtttctgcttaacagtg

SEQ ID NO: 317879 - DNA, 25 bp, Mus musculus
tcctgcgtatattccggtggccgtt

SEQ ID NO: 317880 - DNA, 25 bp, Mus musculus
tcgcagagcggcaaactgacatcta

SEQ ID NO: 317881 - DNA, 25 bp, Mus musculus
ccgggcgctgtctccttgacagatt

SEQ ID NO: 317882 - DNA, 25 bp, Mus musculus
ggaaagcccaacagcgctccagatg

SEQ ID NO: 317883 - DNA, 25 bp, Mus musculus
acaggctcgcggagttacctgagac

SEQ ID NO: 317884 - DNA, 25 bp, Mus musculus
gggacagcagcacatcagcacacgc

SEQ ID NO: 317885 - DNA, 25 bp, Mus musculus
ccgagttacaagtggagcccgaagc

SEQ ID NO: 317886 - DNA, 25 bp, Mus musculus
ctcacgcggagctgtggagaaaacc

SEQ ID NO: 317887 - DNA, 25 bp, Mus musculus
tcgcacggctgcctcgctgatgaac

SEQ ID NO: 317888 - DNA, 25 bp, Mus musculus
tgagaaagtataggacccggggctc

SEQ ID NO: 317889 - DNA, 25 bp, Mus musculus
ccatcgatgtactgtgtgaggcgga

SEQ ID NO: 317890 - DNA, 25 bp, Mus musculus
gccacacacgggtctcttcggactg

SEQ ID NO: 317891 - DNA, 25 bp, Mus musculus
cgggtctcttcggactggctggtac

SEQ ID NO: 317892 - DNA, 25 bp, Mus musculus
ctggtacggggtctgccctggccat

SEQ ID NO: 317893 - DNA, 25 bp, Mus musculus
tctgccctggccatcgatgtactgt

SEQ ID NO: 317894 - DNA, 25 bp, Mus musculus
atgcatgccgcatcctcgccaatga

SEQ ID NO: 317895 - DNA, 25 bp, Mus musculus
tcctcgccaatgacgtgcacgtgcg

SEQ ID NO: 317896 - DNA, 25 bp, Mus musculus
cggcggtgccacacacgggtctctt

SEQ ID NO: 317897 - DNA, 25 bp, Mus musculus
attctgccacttgccgtcgcggcgg

SEQ ID NO: 317898 - DNA, 25 bp, Mus musculus
aatgtacattctgccacttgccgtc

SEQ ID NO: 317899 - DNA, 25 bp, Mus musculus
cgcccgagcagtggaaatgtacatt

SEQ ID NO: 317900 - DNA, 25 bp, Mus musculus
actggagcgcccgagcagtggaaat

SEQ ID NO: 317901 - DNA, 25 bp, Mus musculus
cagggactcacctcactgcagcggg

SEQ ID NO: 317902 - DNA, 25 bp, Mus musculus
cggatgtaggcgatgcatgccgcat

SEQ ID NO: 317903 - DNA, 25 bp, Mus musculus
aaggccgccctattggaggctgcac

SEQ ID NO: 317904 - DNA, 25 bp, Mus musculus
cctcccatccgggttcgtggtgctg

SEQ ID NO: 317905 - DNA, 25 bp, Mus musculus
actgccatggcttcgcgacctgtca

SEQ ID NO: 317906 - DNA, 25 bp, Mus musculus
gagctgtgctgtcaccactgccatg

SEQ ID NO: 317907 - DNA, 25 bp, Mus musculus
tgcggttcaagccaccgagctgtgc

SEQ ID NO: 317908 - DNA, 25 bp, Mus musculus
tactgccctccagagtgaagtgttc

SEQ ID NO: 317909 - DNA, 25 bp, Mus musculus
cgcgacctgtcactctcggtatcga

SEQ ID NO: 317910 - DNA, 25 bp, Mus musculus
aaaagattgacaaggaagctccgcc

SEQ ID NO: 317911 - DNA, 25 bp, Mus musculus
tcgggcaacaccttcccgcgaagaa

SEQ ID NO: 317912 - DNA, 25 bp, Mus musculus
tttcctcgaccaatagaagtggtta

SEQ ID NO: 317913 - DNA, 25 bp, Mus musculus
gcgtggtgtttgctttcctcgacca

SEQ ID NO: 317914 - DNA, 25 bp, Mus musculus
cacctatcaccggaggccgctgtgg

SEQ ID NO: 317915 - DNA, 25 bp, Mus musculus
actctcggtatcgacttgggcacca

SEQ ID NO: 317916 - DNA, 25 bp, Mus musculus
acttgggcaccacgtccgtgaaggc

SEQ ID NO: 317917 - DNA, 25 bp, Mus musculus
agcctcccgcgggttttcagaggcg

SEQ ID NO: 317918 - DNA, 25 bp, Mus musculus
cgttcctttaactctcgcgaggcct

SEQ ID NO: 317919 - DNA, 25 bp, Mus musculus
tcctttaactctcgcgaggccttgc

SEQ ID NO: 317920 - DNA, 25 bp, Mus musculus
ccgcgcttgcttgcgtggttagtag

SEQ ID NO: 317921 - DNA, 25 bp, Mus musculus
cagaaaacagcaagttggtcccgtt

SEQ ID NO: 317922 - DNA, 25 bp, Mus musculus
tggttagtagcgcaggtgctccaga

SEQ ID NO: 317923 - DNA, 25 bp, Mus musculus
gcctttatgggcagaaaacagcaag

SEQ ID NO: 317924 - DNA, 25 bp, Mus musculus
agcttcaggattggtgcgcctgcgc

SEQ ID NO: 317925 - DNA, 25 bp, Mus musculus
ctcacaagcgacaaggcaaagggcg

SEQ ID NO: 317926 - DNA, 25 bp, Mus musculus
tgcgcactgagcttcaggattggtg

SEQ ID NO: 317927 - DNA, 25 bp, Mus musculus
cgacaaggcaaagggcgtcgctttt

SEQ ID NO: 317928 - DNA, 25 bp, Mus musculus
gctttgtacctcacaagcgacaagg

SEQ ID NO: 317929 - DNA, 25 bp, Mus musculus
cgagccggctttgtacctcacaagc

SEQ ID NO: 317930 - DNA, 25 bp, Mus musculus
agggcgtcgcttttgcctttatggg

SEQ ID NO: 317931 - DNA, 25 bp, Mus musculus
ggcgcaggcaactcgaccttagtga

SEQ ID NO: 317932 - DNA, 25 bp, Mus musculus
gatcccactttaggcggtcccgaga

SEQ ID NO: 317933 - DNA, 25 bp, Mus musculus
taaaccgccttttcgagtggccagc

SEQ ID NO: 317934 - DNA, 25 bp, Mus musculus
cacactcggagaagaaacgcgcgtc

SEQ ID NO: 317935 - DNA, 25 bp, Mus musculus
ctgtcactggctttattgcaagagg

SEQ ID NO: 317936 - DNA, 25 bp, Mus musculus
ccgggatacttctctgatgctgtca

SEQ ID NO: 317937 - DNA, 25 bp, Mus musculus
gatccgattcgcactcttctctgag

SEQ ID NO: 317938 - DNA, 25 bp, Mus musculus
agcaaccttagggaactcgaccaga

SEQ ID NO: 317939 - DNA, 25 bp, Mus musculus
ccttagtgagctcaggcgtcagaac

SEQ ID NO: 317940 - DNA, 25 bp, Mus musculus
tgagaccctagggagtacaggcgac

SEQ ID NO: 317941 - DNA, 25 bp, Mus musculus
tgggcgctcacttcctgacgacctt

SEQ ID NO: 317942 - DNA, 25 bp, Mus musculus
agtccgatgagtaccacggcggctc

SEQ ID NO: 317943 - DNA, 25 bp, Mus musculus
cgagatttgtgcaggagtccgatga

SEQ ID NO: 317944 - DNA, 25 bp, Mus musculus
gcgaactaaagaaagcgactggatc

SEQ ID NO: 317945 - DNA, 25 bp, Mus musculus
accggggccatcagtgctttgccaa

SEQ ID NO: 317946 - DNA, 25 bp, Mus musculus
gtcaatagtcagtcctgccggctca

SEQ ID NO: 317947 - DNA, 25 bp, Mus musculus
tcgtcgaacgccctgagggatgctc

SEQ ID NO: 317948 - DNA, 25 bp, Mus musculus
atacggcggtactaatcgtcgaacg

SEQ ID NO: 317949 - DNA, 25 bp, Mus musculus
gcagtctctgccctagtccgctaga

SEQ ID NO: 317950 - DNA, 25 bp, Mus musculus
tacggagcgcgcacacgcagtctct

SEQ ID NO: 317951 - DNA, 25 bp, Mus musculus
cacccggcagggatttctgtggact

SEQ ID NO: 317952 - DNA, 25 bp, Mus musculus
cccaactgcttggtgcgatgggcgc

SEQ ID NO: 317953 - DNA, 25 bp, Mus musculus
tgtccgcgctgtcagggtattgccc

SEQ ID NO: 317954 - DNA, 25 bp, Mus musculus
tcagtgctttgccaacacacacatc

SEQ ID NO: 317955 - DNA, 25 bp, Mus musculus
aggactcgcgtccagatgcacgccg

SEQ ID NO: 317956 - DNA, 25 bp, Mus musculus
tgcacgccggctgtgaaattacaac

SEQ ID NO: 317957 - DNA, 25 bp, Mus musculus
cactcccgacgtggacagaatgtca

SEQ ID NO: 317958 - DNA, 25 bp, Mus musculus
tttctgtggactgtcaccctacctc

SEQ ID NO: 317959 - DNA, 25 bp, Mus musculus
cgctagcagccgtggggacaccgcg

SEQ ID NO: 317960 - DNA, 25 bp, Mus musculus
agcgcaccagctgccagcggttctc

SEQ ID NO: 317961 - DNA, 25 bp, Mus musculus
cggagcccactcaccagcgcaccag

SEQ ID NO: 317962 - DNA, 25 bp, Mus musculus
gtccctatgcctctccgatcggaaa

SEQ ID NO: 317963 - DNA, 25 bp, Mus musculus
caccctcagccgatccgccgggtca

SEQ ID NO: 317964 - DNA, 25 bp, Mus musculus
gcgggacccagtggcgctcatcttt

SEQ ID NO: 317965 - DNA, 25 bp, Mus musculus
tgcctctccgatcggaaagaaactt

SEQ ID NO: 317966 - DNA, 25 bp, Mus musculus
gcccgccatgcctgctccggccgct

SEQ ID NO: 317967 - DNA, 25 bp, Mus musculus
acccagtggcgctcatctttcgggc

SEQ ID NO: 317968 - DNA, 25 bp, Mus musculus
cttctctgctgcagcgcgccggacc

SEQ ID NO: 317969 - DNA, 25 bp, Mus musculus
atccgccgggtcaccgcgcttctct

SEQ ID NO: 317970 - DNA, 25 bp, Mus musculus
agctgcagcaggaccagtgcccagc

SEQ ID NO: 317971 - DNA, 25 bp, Mus musculus
gcgctcatctttcgggcggccgtgt

SEQ ID NO: 317972 - DNA, 25 bp, Mus musculus
tgcagcaggaccagtgcccagcgcg

SEQ ID NO: 317973 - DNA, 25 bp, Mus musculus
gataggcccggcactgtcacccgag

SEQ ID NO: 317974 - DNA, 25 bp, Mus musculus
gccgtttcctcccacctgacctcac

SEQ ID NO: 317975 - DNA, 25 bp, Mus musculus
caccacccacctgcgcgcacggttc

SEQ ID NO: 317976 - DNA, 25 bp, Mus musculus
acccggcgcgaacaccacccacctg

SEQ ID NO: 317977 - DNA, 25 bp, Mus musculus
agcgcctcggtcaggcgtggctcca

SEQ ID NO: 317978 - DNA, 25 bp, Mus musculus
gtgctttgtcatcccgcaggctggc

SEQ ID NO: 317979 - DNA, 25 bp, Mus musculus
gtcccgtgctttgtcatcccgcagg

SEQ ID NO: 317980 - DNA, 25 bp, Mus musculus
gcgcgacgtcccgtgctttgtcatc

SEQ ID NO: 317981 - DNA, 25 bp, Mus musculus
cggttctgcgcgacgtcccgtgctt

SEQ ID NO: 317982 - DNA, 25 bp, Mus musculus
gtgttcatctcaacccgccggggca

SEQ ID NO: 317983 - DNA, 25 bp, Mus musculus
aggcccggcactgtcacccgaggag

SEQ ID NO: 317984 - DNA, 25 bp, Mus musculus
gacctcacaggaagcgcgcaccgca

SEQ ID NO: 317985 - DNA, 25 bp, Mus musculus
cggctgccggggtaactgcagctgc

SEQ ID NO: 317986 - DNA, 25 bp, Mus musculus
aggagcgcctccgtgttcatctcaa

SEQ ID NO: 317987 - DNA, 25 bp, Mus musculus
ttccagagacccagcgaggcccggg

SEQ ID NO: 317988 - DNA, 25 bp, Mus musculus
gccggatccgaggattctgctgctc

SEQ ID NO: 317989 - DNA, 25 bp, Mus musculus
cgcctagtcgtctgtggtgtctcgg

SEQ ID NO: 317990 - DNA, 25 bp, Mus musculus
ctcacttagagaggcggagcggatc

SEQ ID NO: 317991 - DNA, 25 bp, Mus musculus
agcgggcgctgcctcacttagagag

SEQ ID NO: 317992 - DNA, 25 bp, Mus musculus
gctctctcgggtccgcaggtgagca

SEQ ID NO: 317993 - DNA, 25 bp, Mus musculus
ctagcgcgggagaagagctcttcca

SEQ ID NO: 317994 - DNA, 25 bp, Mus musculus
tgcggatccatgagcgcagctagcg

SEQ ID NO: 317995 - DNA, 25 bp, Mus musculus
cgcagcagttgatggcgccgcagcc

SEQ ID NO: 317996 - DNA, 25 bp, Mus musculus
cccacagcctcgcagcagttgatgg

SEQ ID NO: 317997 - DNA, 25 bp, Mus musculus
tgtttacgcccgaagcctgccctag

SEQ ID NO: 317998 - DNA, 25 bp, Mus musculus
ctcgttcgccagttccggtcacgtt

SEQ ID NO: 317999 - DNA, 25 bp, Mus musculus
tcacgttgctgggtgtttacgcccg

SEQ ID NO: 318000 - DNA, 25 bp, Mus musculus
tggcagaagttgtcctccgccgcca

SEQ ID NO: 318001 - DNA, 25 bp, Mus musculus
agccatcgcgccacggtgctgggca

SEQ ID NO: 318002 - DNA, 25 bp, Mus musculus
gcaccgagctgcagaagcacaccga

SEQ ID NO: 318003 - DNA, 25 bp, Mus musculus
agcggccgcctacctctcctgccag

SEQ ID NO: 318004 - DNA, 25 bp, Mus musculus
ggaagacgccgatcccatgccggac

SEQ ID NO: 318005 - DNA, 25 bp, Mus musculus
cgcgctctttctctacccacggagg

SEQ ID NO: 318006 - DNA, 25 bp, Mus musculus
tcgccctctgctacgccaggagatg

SEQ ID NO: 318007 - DNA, 25 bp, Mus musculus
ctgcagaagcacaccgaagcggccg

SEQ ID NO: 318008 - DNA, 25 bp, Mus musculus
tctgctacgccaggagatgccggac

SEQ ID NO: 318009 - DNA, 25 bp, Mus musculus
caggagatgccggaccaagatgccc

SEQ ID NO: 318010 - DNA, 25 bp, Mus musculus
aagtgccgcgcgctagagtcgcagc

SEQ ID NO: 318011 - DNA, 25 bp, Mus musculus
ctgtaccaaggcgacccgcaccctg

SEQ ID NO: 318012 - DNA, 25 bp, Mus musculus
agcgagagcgcagtcgccacgccca

SEQ ID NO: 318013 - DNA, 25 bp, Mus musculus
gcaggccttggcaacagggaaagca

SEQ ID NO: 318014 - DNA, 25 bp, Mus musculus
gccttggcaacagggaaagcaggcc

SEQ ID NO: 318015 - DNA, 25 bp, Mus musculus
cgcagaccgatggaatcggcggccc

SEQ ID NO: 318016 - DNA, 25 bp, Mus musculus
ggacgcgttgcctttaaggctttga

SEQ ID NO: 318017 - DNA, 25 bp, Mus musculus
ggctttgaaagagtcactgaatctg

SEQ ID NO: 318018 - DNA, 25 bp, Mus musculus
tctgtgaactgactacggagtgctc

SEQ ID NO: 318019 - DNA, 25 bp, Mus musculus
ctacggagtgctcggtgttttgtcc

SEQ ID NO: 318020 - DNA, 25 bp, Mus musculus
gtgttttgtccctcgtcgtctgccg

SEQ ID NO: 318021 - DNA, 25 bp, Mus musculus
tcaaaggctaaagcgcgcaccacgt

SEQ ID NO: 318022 - DNA, 25 bp, Mus musculus
tgctcccgccatggtcatcaagacg

SEQ ID NO: 318023 - DNA, 25 bp, Mus musculus
tcttccctccgcgtcagtgtgggcg

SEQ ID NO: 318024 - DNA, 25 bp, Mus musculus
cctggacttcgcacgtggggaccgt

SEQ ID NO: 318025 - DNA, 25 bp, Mus musculus
gaagggcatccacggcggacacact

SEQ ID NO: 318026 - DNA, 25 bp, Mus musculus
ggcggacacactcgcgcaagatcgc

SEQ ID NO: 318027 - DNA, 25 bp, Mus musculus
tcatcaagacggacgagttgccggc

SEQ ID NO: 318028 - DNA, 25 bp, Mus musculus
cacacgcggtttggtttcagggtgc

SEQ ID NO: 318029 - DNA, 25 bp, Mus musculus
cccaagatcagagagcgacctgcta

SEQ ID NO: 318030 - DNA, 25 bp, Mus musculus
agctggcggctgtacccgagccgac

SEQ ID NO: 318031 - DNA, 25 bp, Mus musculus
ggggctcgagccctagcccagcgtt

SEQ ID NO: 318032 - DNA, 25 bp, Mus musculus
agggcgcagagcgtcgccgccttac

SEQ ID NO: 318033 - DNA, 25 bp, Mus musculus
ccacccgagcgcgatggaagagaca

SEQ ID NO: 318034 - DNA, 25 bp, Mus musculus
gggaccggcgcagccacatcgtcag

SEQ ID NO: 318035 - DNA, 25 bp, Mus musculus
agcccactgccagggtcggaggaac

SEQ ID NO: 318036 - DNA, 25 bp, Mus musculus
agcagcctgagtagcccactgccag

SEQ ID NO: 318037 - DNA, 25 bp, Mus musculus
acggcttgaaccctcagcagcctga

SEQ ID NO: 318038 - DNA, 25 bp, Mus musculus
tgccgcccgagaggccacggcttga

SEQ ID NO: 318039 - DNA, 25 bp, Mus musculus
ttcttgctaagtcacggcggcagga

SEQ ID NO: 318040 - DNA, 25 bp, Mus musculus
tcccacccaagaatacttttcttgc

SEQ ID NO: 318041 - DNA, 25 bp, Mus musculus
tcagagagcgacctgctatccacgc

SEQ ID NO: 318042 - DNA, 25 bp, Mus musculus
tgtacccgagccgaccggcgagctt

SEQ ID NO: 318043 - DNA, 25 bp, Mus musculus
gcttggagcgtagcatctgcgtttc

SEQ ID NO: 318044 - DNA, 25 bp, Mus musculus
aggctaagtcaaaagtctcgcgaga

SEQ ID NO: 318045 - DNA, 25 bp, Mus musculus
agtctgtccagtcacggcgcggatt

SEQ ID NO: 318046 - DNA, 25 bp, Mus musculus
atctgcgtttccaggagcttggctg

SEQ ID NO: 318047 - DNA, 25 bp, Mus musculus
gattgcgggcctgtccgcactccgt

SEQ ID NO: 318048 - DNA, 25 bp, Mus musculus
cgcctgctccattggcctgcgaggt

SEQ ID NO: 318049 - DNA, 25 bp, Mus musculus
tgcgaggtgcgtggttcaaaaatct

SEQ ID NO: 318050 - DNA, 25 bp, Mus musculus
aaaatctcttatccggttgcgcaca

SEQ ID NO: 318051 - DNA, 25 bp, Mus musculus
ccggttgcgcacaaggatcgcctaa

SEQ ID NO: 318052 - DNA, 25 bp, Mus musculus
gatcgcctaagaagcggctcacctg

SEQ ID NO: 318053 - DNA, 25 bp, Mus musculus
ttccttctttctttaggctaagtca

SEQ ID NO: 318054 - DNA, 25 bp, Mus musculus
gccgtctccaagtatcgcgatagtt

SEQ ID NO: 318055 - DNA, 25 bp, Mus musculus
ctgcttttctcctccggttctcgga

SEQ ID NO: 318056 - DNA, 25 bp, Mus musculus
tctcgcgagagtagtctgtccagtc

SEQ ID NO: 318057 - DNA, 25 bp, Mus musculus
gcacgcgagatctgctcgctctgtc

SEQ ID NO: 318058 - DNA, 25 bp, Mus musculus
tcgggcactctaggcctggcagccg

SEQ ID NO: 318059 - DNA, 25 bp, Mus musculus
ccgctaagctatggcacccggcagg

SEQ ID NO: 318060 - DNA, 25 bp, Mus musculus
tggcacccggcagggccgtaagcac

SEQ ID NO: 318061 - DNA, 25 bp, Mus musculus
gcgccgaggctcttacttgccaata

SEQ ID NO: 318062 - DNA, 25 bp, Mus musculus
cttgccaatatcctcgtatagctgg

SEQ ID NO: 318063 - DNA, 25 bp, Mus musculus
tagctggtactcgtcggtgaaacgg

SEQ ID NO: 318064 - DNA, 25 bp, Mus musculus
gacagcgtgcccacaccggagacga

SEQ ID NO: 318065 - DNA, 25 bp, Mus musculus
ttgcacgcgcctcactcgcaccgta

SEQ ID NO: 318066 - DNA, 25 bp, Mus musculus
gccttgtacctgcactagcgcccgc

SEQ ID NO: 318067 - DNA, 25 bp, Mus musculus
actgcgcccgcaccatgcaatccca

SEQ ID NO: 318068 - DNA, 25 bp, Mus musculus
atcccagcacatgggctgcaccaca

SEQ ID NO: 318069 - DNA, 25 bp, Mus musculus
atcctcgtatagctggtactcgtcg

SEQ ID NO: 318070 - DNA, 25 bp, Mus musculus
aaatgcgtcacgtctgcccggcgct

SEQ ID NO: 318071 - DNA, 25 bp, Mus musculus
cgggtaccaccctagctgactggca

SEQ ID NO: 318072 - DNA, 25 bp, Mus musculus
cgccgcgatgagcatagagacgcta

SEQ ID NO: 318073 - DNA, 25 bp, Mus musculus
tctcagcaaggcagatcccgccgtg

SEQ ID NO: 318074 - DNA, 25 bp, Mus musculus
cggcccgcttcctggaatggcaagc

SEQ ID NO: 318075 - DNA, 25 bp, Mus musculus
gatccctgaacccactggaaatcgc

SEQ ID NO: 318076 - DNA, 25 bp, Mus musculus
cgttcttttctgaggagtgcgctgc

SEQ ID NO: 318077 - DNA, 25 bp, Mus musculus
gaagaaggcagtgccgcctttttta

SEQ ID NO: 318078 - DNA, 25 bp, Mus musculus
gcaaagccctttcttgtcggcggga

SEQ ID NO: 318079 - DNA, 25 bp, Mus musculus
gtgcctcctcgccatcttgttgcaa

SEQ ID NO: 318080 - DNA, 25 bp, Mus musculus
gctccttcccttgttgtgtgtgtcg

SEQ ID NO: 318081 - DNA, 25 bp, Mus musculus
agcgaggaagcctggttccatcttc

SEQ ID NO: 318082 - DNA, 25 bp, Mus musculus
cccgtttaacttgtggctggccacg

SEQ ID NO: 318083 - DNA, 25 bp, Mus musculus
gatcccgccgtgaatgccctaagca

SEQ ID NO: 318084 - DNA, 25 bp, Mus musculus
tctatggcgcgacctaaaaagccgg

SEQ ID NO: 318085 - DNA, 25 bp, Mus musculus
tggcggtatctcctctcttcgtgga

SEQ ID NO: 318086 - DNA, 25 bp, Mus musculus
tctccacgcgggtgctaagcacatg

SEQ ID NO: 318087 - DNA, 25 bp, Mus musculus
gctgtatcacagcttccgtgggagg

SEQ ID NO: 318088 - DNA, 25 bp, Mus musculus
tcgccctggaaaccgcatagggttc

SEQ ID NO: 318089 - DNA, 25 bp, Mus musculus
tgccctctgctgcagtgcgaagtta

SEQ ID NO: 318090 - DNA, 25 bp, Mus musculus
cggactcaggccaagaggggttact

SEQ ID NO: 318091 - DNA, 25 bp, Mus musculus
tcttcgtggacactgactgccctct

SEQ ID NO: 318092 - DNA, 25 bp, Mus musculus
ttccgcgaatgctgggaagggatcc

SEQ ID NO: 318093 - DNA, 25 bp, Mus musculus
cctggcagtgcttaggattactatc

SEQ ID NO: 318094 - DNA, 25 bp, Mus musculus
gtccagcactttgctatccgcagta

SEQ ID NO: 318095 - DNA, 25 bp, Mus musculus
cagccaggtcacaacccggaggtaa

SEQ ID NO: 318096 - DNA, 25 bp, Mus musculus
ccctgtctgctcagccggcagtttg

SEQ ID NO: 318097 - DNA, 25 bp, Mus musculus
gcacatggcctagctgacgtcagtg

SEQ ID NO: 318098 - DNA, 25 bp, Mus musculus
ccggggcttgaatccctaggccaca

SEQ ID NO: 318099 - DNA, 25 bp, Mus musculus
ccggatcctgtggagtgttcatata

SEQ ID NO: 318100 - DNA, 25 bp, Mus musculus
ctttgtacagttcactgggaccgca

SEQ ID NO: 318101 - DNA, 25 bp, Mus musculus
cagagagcggcgtgcaatagtctac

SEQ ID NO: 318102 - DNA, 25 bp, Mus musculus
tcttcacgttccacagcagcttttc

SEQ ID NO: 318103 - DNA, 25 bp, Mus musculus
gcagcttttctttgaccgcgtcctc

SEQ ID NO: 318104 - DNA, 25 bp, Mus musculus
tgtgcttgtgtctgggcaaacctca

SEQ ID NO: 318105 - DNA, 25 bp, Mus musculus
tcctaagaacaggtgcccgagcgca

SEQ ID NO: 318106 - DNA, 25 bp, Mus musculus
cggctctgcgtcactgtggttcgaa

SEQ ID NO: 318107 - DNA, 25 bp, Mus musculus
gacccgactgtgagctcctaagaac

SEQ ID NO: 318108 - DNA, 25 bp, Mus musculus
gaaaggccactcaggtacaaatgtc

SEQ ID NO: 318109 - DNA, 25 bp, Mus musculus
cccttctaagtgcttcgcgttggaa

SEQ ID NO: 318110 - DNA, 25 bp, Mus musculus
aggagctatacggagccagggtctc

SEQ ID NO: 318111 - DNA, 25 bp, Mus musculus
catccgctttggttcatcttgcaga

SEQ ID NO: 318112 - DNA, 25 bp, Mus musculus
agacattccagagccggtgacacga

SEQ ID NO: 318113 - DNA, 25 bp, Mus musculus
tactggcatccctagacccgaatgc

SEQ ID NO: 318114 - DNA, 25 bp, Mus musculus
tgcggatctccgcatcggaactgcg

SEQ ID NO: 318115 - DNA, 25 bp, Mus musculus
tgaatgcttttgctcccagtgcggc

SEQ ID NO: 318116 - DNA, 25 bp, Mus musculus
ccctagttgaacgtgctgaatgctt

SEQ ID NO: 318117 - DNA, 25 bp, Mus musculus
gagacttcggcctaaaatgatcgga

SEQ ID NO: 318118 - DNA, 25 bp, Mus musculus
cctgagttccagtccggaggagaca

SEQ ID NO: 318119 - DNA, 25 bp, Mus musculus
gagcccaagcgcgagtttcagcctc

SEQ ID NO: 318120 - DNA, 25 bp, Mus musculus
cctgacatgggcgagtcacacctgg

SEQ ID NO: 318121 - DNA, 25 bp, Mus musculus
ggaccgtcctagctttacacctctg

SEQ ID NO: 318122 - DNA, 25 bp, Mus musculus
tggtcaccgcagcaatactggcatc

SEQ ID NO: 318123 - DNA, 25 bp, Mus musculus
ccgggttgtaggatgtctccgtcaa

SEQ ID NO: 318124 - DNA, 25 bp, Mus musculus
tgttcccaaaagaatagtctgtgta

SEQ ID NO: 318125 - DNA, 25 bp, Mus musculus
tgtgtatgtgtacctttccgtagtc

SEQ ID NO: 318126 - DNA, 25 bp, Mus musculus
tcaaaagcagtgtcctcggtggtca

SEQ ID NO: 318127 - DNA, 25 bp, Mus musculus
tgattggcccgtggtgcaggcagca

SEQ ID NO: 318128 - DNA, 25 bp, Mus musculus
gacgggactcttctggctgggcgag

SEQ ID NO: 318129 - DNA, 25 bp, Mus musculus
ggctctttgaggaaccgagagttgc

SEQ ID NO: 318130 - DNA, 25 bp, Mus musculus
aggctctttgaggaaccgagagttg

SEQ ID NO: 318131 - DNA, 25 bp, Mus musculus
cagcccggcaggcacgctcctggcc

SEQ ID NO: 318132 - DNA, 25 bp, Mus musculus
ctctttgaggaaccgagagttgctg

SEQ ID NO: 318133 - DNA, 25 bp, Mus musculus
cctccgctgattggcccgtggtgca

SEQ ID NO: 318134 - DNA, 25 bp, Mus musculus
ctgccctttgtccggaatccagctg

SEQ ID NO: 318135 - DNA, 25 bp, Mus musculus
ccctgccctttgtccggaatccagc

SEQ ID NO: 318136 - DNA, 25 bp, Mus musculus
gaacaaacagagtgctgctcccctc

SEQ ID NO: 318137 - DNA, 25 bp, Mus musculus
ggggaacaaacagagtgctgctccc

SEQ ID NO: 318138 - DNA, 25 bp, Mus musculus
ttgctgggactgagcccgcgacggg

SEQ ID NO: 318139 - DNA, 25 bp, Mus musculus
tgaggaaccgagagttgctgggact

SEQ ID NO: 318140 - DNA, 25 bp, Mus musculus
cggccggacgggactcttctggctg

SEQ ID NO: 318141 - DNA, 25 bp, Mus musculus
gccaggttagcctatctgttccagc

SEQ ID NO: 318142 - DNA, 25 bp, Mus musculus
cccttggtgcgctgattgttgagct

SEQ ID NO: 318143 - DNA, 25 bp, Mus musculus
acaccagctgggtaagagctacgca

SEQ ID NO: 318144 - DNA, 25 bp, Mus musculus
catggagcaccacggcctgaacagt

SEQ ID NO: 318145 - DNA, 25 bp, Mus musculus
ttggacagatccaggccgcaaagcg

SEQ ID NO: 318146 - DNA, 25 bp, Mus musculus
atcgtgtccagcatcgtctgcccag

SEQ ID NO: 318147 - DNA, 25 bp, Mus musculus
gatcacgtcgcacaagaagcccttg

SEQ ID NO: 318148 - DNA, 25 bp, Mus musculus
agggcattctgcaccacgatgatca

SEQ ID NO: 318149 - DNA, 25 bp, Mus musculus
agcacgttcttgtgcgcgcggaaga

SEQ ID NO: 318150 - DNA, 25 bp, Mus musculus
catgcaccaccagggacttgaggta

SEQ ID NO: 318151 - DNA, 25 bp, Mus musculus
catggtccaggtttagcaggttgtc

SEQ ID NO: 318152 - DNA, 25 bp, Mus musculus
ctgctgcggcctcaacactgtcagt

SEQ ID NO: 318153 - DNA, 25 bp, Mus musculus
cttcttgcacagagccacgaggtca

SEQ ID NO: 318154 - DNA, 25 bp, Mus musculus
gcccgggcctgaagcatatagctca

SEQ ID NO: 318155 - DNA, 25 bp, Mus musculus
ggttcccgggatctcatctctcaga

SEQ ID NO: 318156 - DNA, 25 bp, Mus musculus
ataagcaccgttgcaagcaccgcgc

SEQ ID NO: 318157 - DNA, 25 bp, Mus musculus
caaaccgcccacagcttcttattgg

SEQ ID NO: 318158 - DNA, 25 bp, Mus musculus
gcttcttattggctgcgccatcctc

SEQ ID NO: 318159 - DNA, 25 bp, Mus musculus
atcctccgtggccaagccggagagg

SEQ ID NO: 318160 - DNA, 25 bp, Mus musculus
gctggggctcagagttactatggta

SEQ ID NO: 318161 - DNA, 25 bp, Mus musculus
ggcggaggcataagcaccgttgcaa

SEQ ID NO: 318162 - DNA, 25 bp, Mus musculus
tctcatctctcagaggccttggaga

SEQ ID NO: 318163 - DNA, 25 bp, Mus musculus
cagaggccttggagagcttagcaac

SEQ ID NO: 318164 - DNA, 25 bp, Mus musculus
ccttggagagcttagcaaccgcgcg

SEQ ID NO: 318165 - DNA, 25 bp, Mus musculus
ccgcttgaggtagtggctgagtcac

SEQ ID NO: 318166 - DNA, 25 bp, Mus musculus
tgaggtagtggctgagtcactcgcc

SEQ ID NO: 318167 - DNA, 25 bp, Mus musculus
taaccaatgaggttcccgggatctc

SEQ ID NO: 318168 - DNA, 25 bp, Mus musculus
tactatggtaaccaatgaggttccc

SEQ ID NO: 318169 - DNA, 25 bp, Mus musculus
acgaaggttcctttcagcttggtgg

SEQ ID NO: 318170 - DNA, 25 bp, Mus musculus
cagcactctcaactgcgggcgacgg

SEQ ID NO: 318171 - DNA, 25 bp, Mus musculus
cggcaccttggctctagactgctta

SEQ ID NO: 318172 - DNA, 25 bp, Mus musculus
gggccgccttcagtaacagtctcca

SEQ ID NO: 318173 - DNA, 25 bp, Mus musculus
tgctgatgcagtgcaagcgcctccc

SEQ ID NO: 318174 - DNA, 25 bp, Mus musculus
cgcctgttcaaggtccctgtgggtt

SEQ ID NO: 318175 - DNA, 25 bp, Mus musculus
ttcccgcctctgcaagcggagctgt

SEQ ID NO: 318176 - DNA, 25 bp, Mus musculus
atcggactgtcccactgagctcagg

SEQ ID NO: 318177 - DNA, 25 bp, Mus musculus
ccgctgggacatctttgacgtcaca

SEQ ID NO: 318178 - DNA, 25 bp, Mus musculus
gccggcacccaaatgcagacgcaga

SEQ ID NO: 318179 - DNA, 25 bp, Mus musculus
agctcctgcgccatcctttcaagaa

SEQ ID NO: 318180 - DNA, 25 bp, Mus musculus
taaggaccaccaacagtcggagatg

SEQ ID NO: 318181 - DNA, 25 bp, Mus musculus
cagacgcagacactatggagaaaca

SEQ ID NO: 318182 - DNA, 25 bp, Mus musculus
cgcagagcggtgactcagcctagat

SEQ ID NO: 318183 - DNA, 25 bp, Mus musculus
ggctagacacagcactcgcagggtc

SEQ ID NO: 318184 - DNA, 25 bp, Mus musculus
cagggtctgccgtgccgccatactg

SEQ ID NO: 318185 - DNA, 25 bp, Mus musculus
agtctggacacgaaccctcgggagc

SEQ ID NO: 318186 - DNA, 25 bp, Mus musculus
ttcccaggcggaagtagaaccggca

SEQ ID NO: 318187 - DNA, 25 bp, Mus musculus
cgccatactgcagaccgaccggaag

SEQ ID NO: 318188 - DNA, 25 bp, Mus musculus
acagcactcgcagggtctgccgtgc

SEQ ID NO: 318189 - DNA, 25 bp, Mus musculus
ctcgctctgccggaagccggctaga

SEQ ID NO: 318190 - DNA, 25 bp, Mus musculus
ccggaagccggctagacacagcact

SEQ ID NO: 318191 - DNA, 25 bp, Mus musculus
agcgctccggtcttctcacggaagc

SEQ ID NO: 318192 - DNA, 25 bp, Mus musculus
cgcagcgtcttcctcagcgctccgg

SEQ ID NO: 318193 - DNA, 25 bp, Mus musculus
gctgaggcacacaagctctgcccga

SEQ ID NO: 318194 - DNA, 25 bp, Mus musculus
gtccgctgaggcacacaagctctgc

SEQ ID NO: 318195 - DNA, 25 bp, Mus musculus
tgaggtccgctgaggcacacaagct

SEQ ID NO: 318196 - DNA, 25 bp, Mus musculus
gcagaccgaccggaagcaggccttc

SEQ ID NO: 318197 - DNA, 25 bp, Mus musculus
cagagaccagagtgagaaacctttg

SEQ ID NO: 318198 - DNA, 25 bp, Mus musculus
ctcagggatctgtcttgagggttca

SEQ ID NO: 318199 - DNA, 25 bp, Mus musculus
cctgctagatggctggcttttgtca

SEQ ID NO: 318200 - DNA, 25 bp, Mus musculus
gggacctttgcctctccattataaa

SEQ ID NO: 318201 - DNA, 25 bp, Mus musculus
ggaacgcaggcatcttcccagcatc

SEQ ID NO: 318202 - DNA, 25 bp, Mus musculus
ctttgataaaaagggagctgtcctc

SEQ ID NO: 318203 - DNA, 25 bp, Mus musculus
ttcctaactccggaggcgcgccgga

SEQ ID NO: 318204 - DNA, 25 bp, Mus musculus
cggccaacatgcttcgcaaaggtga

SEQ ID NO: 318205 - DNA, 25 bp, Mus musculus
cagctggcgcccagggatttgaatc

SEQ ID NO: 318206 - DNA, 25 bp, Mus musculus
cgacgcgctcggattagctgcagct

SEQ ID NO: 318207 - DNA, 25 bp, Mus musculus
gcactgagtacaacccgcgcttggg

SEQ ID NO: 318208 - DNA, 25 bp, Mus musculus
ctgagcaccgggtttgggctcacca

SEQ ID NO: 318209 - DNA, 25 bp, Mus musculus
ctgtgcgtacgagcgcccttttgca

SEQ ID NO: 318210 - DNA, 25 bp, Mus musculus
caaaaccgcctgcaaagtgtttggg

SEQ ID NO: 318211 - DNA, 25 bp, Mus musculus
gcagctacagatcgatgcgacagcc

SEQ ID NO: 318212 - DNA, 25 bp, Mus musculus
ccggcccggcagctacagatcgatg

SEQ ID NO: 318213 - DNA, 25 bp, Mus musculus
ccggcagctacagatcgatgcgaca

SEQ ID NO: 318214 - DNA, 25 bp, Mus musculus
atcgatgcgacagccctccctgccc

SEQ ID NO: 318215 - DNA, 25 bp, Mus musculus
gcccggcagctacagatcgatgcga

SEQ ID NO: 318216 - DNA, 25 bp, Mus musculus
cggccaaacaaaacatagtaaatat

SEQ ID NO: 318217 - DNA, 25 bp, Mus musculus
ttaatccgggccagggagccaaaga

SEQ ID NO: 318218 - DNA, 25 bp, Mus musculus
cctccacagccgtctggctcctctg

SEQ ID NO: 318219 - DNA, 25 bp, Mus musculus
acagccgtctggctcctctgccagc

SEQ ID NO: 318220 - DNA, 25 bp, Mus musculus
ctgctctctgcggtaatgaggccgg

SEQ ID NO: 318221 - DNA, 25 bp, Mus musculus
tctctgcggtaatgaggccgggaac

SEQ ID NO: 318222 - DNA, 25 bp, Mus musculus
aatgaggccgggaacggcagggatc

SEQ ID NO: 318223 - DNA, 25 bp, Mus musculus
aacggcagggatcgatcgcggcctg

SEQ ID NO: 318224 - DNA, 25 bp, Mus musculus
gctacagatcgatgcgacagccctc

SEQ ID NO: 318225 - DNA, 25 bp, Mus musculus
agtacggttcctacatgcaagaata

SEQ ID NO: 318226 - DNA, 25 bp, Mus musculus
taaccatggtcacgatgcggagagc

SEQ ID NO: 318227 - DNA, 25 bp, Mus musculus
gattggtatgcgctcagtacggttc

SEQ ID NO: 318228 - DNA, 25 bp, Mus musculus
tccgcgcttgttactaccggcggta

SEQ ID NO: 318229 - DNA, 25 bp, Mus musculus
accgatcgtcgttcttgcggctctg

SEQ ID NO: 318230 - DNA, 25 bp, Mus musculus
acaccggctgattggccacttccgg

SEQ ID NO: 318231 - DNA, 25 bp, Mus musculus
cccggacagcgaagacgcggaactt

SEQ ID NO: 318232 - DNA, 25 bp, Mus musculus
ccacgtgctgcaggatgcccaacag

SEQ ID NO: 318233 - DNA, 25 bp, Mus musculus
gaaagtcctggacattgcccacgtg

SEQ ID NO: 318234 - DNA, 25 bp, Mus musculus
agccgaagagcacgcgcagaaagtc

SEQ ID NO: 318235 - DNA, 25 bp, Mus musculus
tagaagtcggtcttgcggtagagaa

SEQ ID NO: 318236 - DNA, 25 bp, Mus musculus
agttcccagacgtaggacgcgagcc

SEQ ID NO: 318237 - DNA, 25 bp, Mus musculus
caacagggcctggtcataaagctca

SEQ ID NO: 318238 - DNA, 25 bp, Mus musculus
cgccgcgacacttgcctaaaggaga

SEQ ID NO: 318239 - DNA, 25 bp, Mus musculus
caacgattggctagagcaactgtgc

SEQ ID NO: 318240 - DNA, 25 bp, Mus musculus
ccgcgggctgctcaacgattggcta

SEQ ID NO: 318241 - DNA, 25 bp, Mus musculus
gcggccgtataatttcctccctgac

SEQ ID NO: 318242 - DNA, 25 bp, Mus musculus
gggtcctctttgcaccgctccaagg

SEQ ID NO: 318243 - DNA, 25 bp, Mus musculus
tccaaggccgcgctgctagggccat

SEQ ID NO: 318244 - DNA, 25 bp, Mus musculus
tgctagggccatcgagcccgctcag

SEQ ID NO: 318245 - DNA, 25 bp, Mus musculus
agcgcggtgctactgagttgttccc

SEQ ID NO: 318246 - DNA, 25 bp, Mus musculus
tagacgccgatagccaccgcattgg

SEQ ID NO: 318247 - DNA, 25 bp, Mus musculus
accgcattggctaccgcgcggcagg

SEQ ID NO: 318248 - DNA, 25 bp, Mus musculus
gctgtcggaactttgcccgcccagt

SEQ ID NO: 318249 - DNA, 25 bp, Mus musculus
tgcgcctgtgtcagcgcggtgctac

SEQ ID NO: 318250 - DNA, 25 bp, Mus musculus
cacgtgactcttccgaggccgggtt

SEQ ID NO: 318251 - DNA, 25 bp, Mus musculus
cggcaggcagagcacgtgactcttc

SEQ ID NO: 318252 - DNA, 25 bp, Mus musculus
gggtcgtctccttacctcgatggcc

SEQ ID NO: 318253 - DNA, 25 bp, Mus musculus
tcagcccatgggcactccgaggcag

SEQ ID NO: 318254 - DNA, 25 bp, Mus musculus
ttcgcactaggtcccgttcccagag

SEQ ID NO: 318255 - DNA, 25 bp, Mus musculus
acgccattgtacgtttcgcactagg

SEQ ID NO: 318256 - DNA, 25 bp, Mus musculus
gtccggtccttgctgccactcagaa

SEQ ID NO: 318257 - DNA, 25 bp, Mus musculus
tgctggctcacaccgatctcgtact

SEQ ID NO: 318258 - DNA, 25 bp, Mus musculus
ccagaggcctggctaaggcacagta

SEQ ID NO: 318259 - DNA, 25 bp, Mus musculus
gtactgccagtacgccagccagttc

SEQ ID NO: 318260 - DNA, 25 bp, Mus musculus
gctgccactcagaaagaagtcttca

SEQ ID NO: 318261 - DNA, 25 bp, Mus musculus
cccatagttgtacagcggccagagg

SEQ ID NO: 318262 - DNA, 25 bp, Mus musculus
gggaagccgtctcattggtcccgtc

SEQ ID NO: 318263 - DNA, 25 bp, Mus musculus
ctggcccacgtagaagacgcttttg

SEQ ID NO: 318264 - DNA, 25 bp, Mus musculus
tcaccacatactgcggggcctcaag

SEQ ID NO: 318265 - DNA, 25 bp, Mus musculus
agccgtcgaacaggcctcacctggg

SEQ ID NO: 318266 - DNA, 25 bp, Mus musculus
aagtcttcactgctcagggcggcca

SEQ ID NO: 318267 - DNA, 25 bp, Mus musculus
cgcgaaccagcgacaaaggaaagaa

SEQ ID NO: 318268 - DNA, 25 bp, Mus musculus
ggtcatgtgatctcccagacacgga

SEQ ID NO: 318269 - DNA, 25 bp, Mus musculus
gatctcccagacacggaaacaaccg

SEQ ID NO: 318270 - DNA, 25 bp, Mus musculus
cacgtgtctctaaagggccgggcga

SEQ ID NO: 318271 - DNA, 25 bp, Mus musculus
aggtgactgcgcgaaccagcgacaa

SEQ ID NO: 318272 - DNA, 25 bp, Mus musculus
accagcgacaaaggaaagaaagcct

SEQ ID NO: 318273 - DNA, 25 bp, Mus musculus
ccctccgcagggtcctgcgctccgg

SEQ ID NO: 318274 - DNA, 25 bp, Mus musculus
agcgcgaagcaccagcgctgagctc

SEQ ID NO: 318275 - DNA, 25 bp, Mus musculus
cgctgagctccaccgtgacgggtca

SEQ ID NO: 318276 - DNA, 25 bp, Mus musculus
ccaccgtgacgggtcagctgatgcg

SEQ ID NO: 318277 - DNA, 25 bp, Mus musculus
cagctgatgcgggtcatgtgatctc

SEQ ID NO: 318278 - DNA, 25 bp, Mus musculus
tgcgggtcatgtgatctcccagaca

SEQ ID NO: 318279 - DNA, 25 bp, Mus musculus
cggaaacaaccgcacgtgtctctaa

SEQ ID NO: 318280 - DNA, 25 bp, Mus musculus
cctcgcagtggcttccggggtgcca

SEQ ID NO: 318281 - DNA, 25 bp, Mus musculus
tcagcaaacagcgaagaagccggcg

SEQ ID NO: 318282 - DNA, 25 bp, Mus musculus
ggcactgactcagacgctgcgcata

SEQ ID NO: 318283 - DNA, 25 bp, Mus musculus
actacatctgggcactgactcagac

SEQ ID NO: 318284 - DNA, 25 bp, Mus musculus
ggatgacgccaaacttacaaagatc

SEQ ID NO: 318285 - DNA, 25 bp, Mus musculus
ctgcgcggtgtcctgcccaccttcc

SEQ ID NO: 318286 - DNA, 25 bp, Mus musculus
ctcaactcggcgctggatgcgctgc

SEQ ID NO: 318287 - DNA, 25 bp, Mus musculus
aaggccaatgatcgggagcgcaatc

SEQ ID NO: 318288 - DNA, 25 bp, Mus musculus
gttggcactcagcaaacagcgaaga

SEQ ID NO: 318289 - DNA, 25 bp, Mus musculus
cccaagagcgagttggcactcagca

SEQ ID NO: 318290 - DNA, 25 bp, Mus musculus
gcgcaacaggcccaagagcgagttg

SEQ ID NO: 318291 - DNA, 25 bp, Mus musculus
agggacctcgaggaagctccgcgcc

SEQ ID NO: 318292 - DNA, 25 bp, Mus musculus
agccggcgcaagaaggccaatgatc

SEQ ID NO: 318293 - DNA, 25 bp, Mus musculus
acaacctcaactcggcgctggatgc

SEQ ID NO: 318294 - DNA, 25 bp, Mus musculus
tgatcgggagcgcaatcgcatgcac

SEQ ID NO: 318295 - DNA, 25 bp, Mus musculus
cccgacgccctttggtttgaggatg

SEQ ID NO: 318296 - DNA, 25 bp, Mus musculus
cagtgattttgctcctctgtccaca

SEQ ID NO: 318297 - DNA, 25 bp, Mus musculus
ttcattcgcagctcgtgcgtcacga

SEQ ID NO: 318298 - DNA, 25 bp, Mus musculus
acgccgccagctgatcggagactgg

SEQ ID NO: 318299 - DNA, 25 bp, Mus musculus
ccgtgcggacaggtcgcagtgattt

SEQ ID NO: 318300 - DNA, 25 bp, Mus musculus
gtgcggaggccttatgcaacccaaa

SEQ ID NO: 318301 - DNA, 25 bp, Mus musculus
ctgggtcagggccagttcaagtccc

SEQ ID NO: 318302 - DNA, 25 bp, Mus musculus
gcattgcctctaccggcgctgactg

SEQ ID NO: 318303 - DNA, 25 bp, Mus musculus
cccagcatcaggtgggtgtgatctg

SEQ ID NO: 318304 - DNA, 25 bp, Mus musculus
gtgtggtcacgttgcccagcaatgg

SEQ ID NO: 318305 - DNA, 25 bp, Mus musculus
aggatgcccgagctgaccatttagc

SEQ ID NO: 318306 - DNA, 25 bp, Mus musculus
cccgagtagtgtgtctggacgttta

SEQ ID NO: 318307 - DNA, 25 bp, Mus musculus
agaggagcctggactctcccgagta

SEQ ID NO: 318308 - DNA, 25 bp, Mus musculus
ccatttagcctagggaggatctgga

SEQ ID NO: 318309 - DNA, 25 bp, Mus musculus
cccgctgccggattatatgtcagag

SEQ ID NO: 318310 - DNA, 25 bp, Mus musculus
ctcgggctgcaacgtcaattggaga

SEQ ID NO: 318311 - DNA, 25 bp, Mus musculus
ttggagatgtcgctaatccatcaga

SEQ ID NO: 318312 - DNA, 25 bp, Mus musculus
atccatcagagcatctcggcgtcta

SEQ ID NO: 318313 - DNA, 25 bp, Mus musculus
cggcgtctattggatgagcttctga

SEQ ID NO: 318314 - DNA, 25 bp, Mus musculus
agcttctgagcctggttgcgcactt

SEQ ID NO: 318315 - DNA, 25 bp, Mus musculus
ggacgtcgtctttccgccattgctc

SEQ ID NO: 318316 - DNA, 25 bp, Mus musculus
cattgctctgcgagcctagccgcta

SEQ ID NO: 318317 - DNA, 25 bp, Mus musculus
gtctgaggctgagcgcaaggtaatc

SEQ ID NO: 318318 - DNA, 25 bp, Mus musculus
gcccgggcctagctcattagttttg

SEQ ID NO: 318319 - DNA, 25 bp, Mus musculus
ttttggcctgcctctctatcccaga

SEQ ID NO: 318320 - DNA, 25 bp, Mus musculus
tctatcccagattctcccggcatgg

SEQ ID NO: 318321 - DNA, 25 bp, Mus musculus
catggccggagtgtttccttaccga

SEQ ID NO: 318322 - DNA, 25 bp, Mus musculus
cctcgccctgaaatccgcttttaga

SEQ ID NO: 318323 - DNA, 25 bp, Mus musculus
gtcagccgccgagctcgtgtaccat

SEQ ID NO: 318324 - DNA, 25 bp, Mus musculus
caaccgagatctgcagcgccgaagc

SEQ ID NO: 318325 - DNA, 25 bp, Mus musculus
gcttcgggcacacaaccgagatctg

SEQ ID NO: 318326 - DNA, 25 bp, Mus musculus
acagcgggatgagcttcgggcacac

SEQ ID NO: 318327 - DNA, 25 bp, Mus musculus
ctgctccgacagctcaaggaggtga

SEQ ID NO: 318328 - DNA, 25 bp, Mus musculus
cccagagatcggtagtgctaaagac

SEQ ID NO: 318329 - DNA, 25 bp, Mus musculus
gagccggcaggcctaaccctgagac

SEQ ID NO: 318330 - DNA, 25 bp, Mus musculus
ccagctgcaggtgtccgcacagcag

SEQ ID NO: 318331 - DNA, 25 bp, Mus musculus
tccggactcggtgagtcaccggctc

SEQ ID NO: 318332 - DNA, 25 bp, Mus musculus
tggagctcttggaaaaggccgccgt

SEQ ID NO: 318333 - DNA, 25 bp, Mus musculus
cactgagctacaggggctggcacgc

SEQ ID NO: 318334 - DNA, 25 bp, Mus musculus
cgagctcgtgtaccatctagcgggg

SEQ ID NO: 318335 - DNA, 25 bp, Mus musculus
agcgccgaagccaagagaccgaagc

SEQ ID NO: 318336 - DNA, 25 bp, Mus musculus
tgtccgcacagcaggcagaagtgga

SEQ ID NO: 318337 - DNA, 25 bp, Mus musculus
cactggaacctgtgtatgcccgccg

SEQ ID NO: 318338 - DNA, 25 bp, Mus musculus
ccagtgtgtgcgaggccaatgcagc

SEQ ID NO: 318339 - DNA, 25 bp, Mus musculus
taagtgccagtgtgtgcgaggccaa

SEQ ID NO: 318340 - DNA, 25 bp, Mus musculus
tccggagtgcagtcgtaagtgccag

SEQ ID NO: 318341 - DNA, 25 bp, Mus musculus
actgccacacctcgccctgcatgca

SEQ ID NO: 318342 - DNA, 25 bp, Mus musculus
tgcagcttcagttgcaactgccaca

SEQ ID NO: 318343 - DNA, 25 bp, Mus musculus
gaacctgtgtatgcccgccgggctg

SEQ ID NO: 318344 - DNA, 25 bp, Mus musculus
ccaggccactggaacctgtgtatgc

SEQ ID NO: 318345 - DNA, 25 bp, Mus musculus
agcctcacgctgtgaccaggccact

SEQ ID NO: 318346 - DNA, 25 bp, Mus musculus
gccagtgcaacccagcctcacgctg

SEQ ID NO: 318347 - DNA, 25 bp, Mus musculus
gtgtcgtcgcccatgccagtgcaac

SEQ ID NO: 318348 - DNA, 25 bp, Mus musculus
ccctgcatgcaggactccggccgct

SEQ ID NO: 318349 - DNA, 25 bp, Mus musculus
gccgccgctgcagcttcagttgcaa

SEQ ID NO: 318350 - DNA, 25 bp, Mus musculus
tgcagtcgtaagtgccagtgtgtgc

SEQ ID NO: 318351 - DNA, 25 bp, Mus musculus
cttctatggaaacgggctaatcgcc

SEQ ID NO: 318352 - DNA, 25 bp, Mus musculus
ttctgatacccgtagacagcgcctg

SEQ ID NO: 318353 - DNA, 25 bp, Mus musculus
tcccgccaatgaaagcgccgtgggc

SEQ ID NO: 318354 - DNA, 25 bp, Mus musculus
gcggtagcgcctagcgacctaaaca

SEQ ID NO: 318355 - DNA, 25 bp, Mus musculus
ggacgggatccgcttctatggaaac

SEQ ID NO: 318356 - DNA, 25 bp, Mus musculus
catacttgtcagagggacgacaccg

SEQ ID NO: 318357 - DNA, 25 bp, Mus musculus
acgggcggcagtgtttttcatctta

SEQ ID NO: 318358 - DNA, 25 bp, Mus musculus
tgtttgtctccaagtccggccggaa

SEQ ID NO: 318359 - DNA, 25 bp, Mus musculus
gtcgaggggcactccagtttaactg

SEQ ID NO: 318360 - DNA, 25 bp, Mus musculus
cctgaaacgctgacccatgaacttg

SEQ ID NO: 318361 - DNA, 25 bp, Mus musculus
tgtggaccaagactccctgaaacgc

SEQ ID NO: 318362 - DNA, 25 bp, Mus musculus
acggtggtctatactgcgggccgaa

SEQ ID NO: 318363 - DNA, 25 bp, Mus musculus
ggagcccggacacaaagcccaagga

SEQ ID NO: 318364 - DNA, 25 bp, Mus musculus
acactaaccaatggcgcggcagttc

SEQ ID NO: 318365 - DNA, 25 bp, Mus musculus
atgacggcggcgaaggcagatcgcc

SEQ ID NO: 318366 - DNA, 25 bp, Mus musculus
cgcgaagcgacatggtgctgctcaa

SEQ ID NO: 318367 - DNA, 25 bp, Mus musculus
ccgagccgcgaagcgacatggtgct

SEQ ID NO: 318368 - DNA, 25 bp, Mus musculus
ccgcgtgaggtcaacgcgcactgct

SEQ ID NO: 318369 - DNA, 25 bp, Mus musculus
aggtcaacgcgcactgctgcgtctg

SEQ ID NO: 318370 - DNA, 25 bp, Mus musculus
gcgcactgctgcgtctgacgctttg

SEQ ID NO: 318371 - DNA, 25 bp, Mus musculus
cgtctgacgctttggttgccgcaga

SEQ ID NO: 318372 - DNA, 25 bp, Mus musculus
ctcaaggagtagtgagtgtcgggtc

SEQ ID NO: 318373 - DNA, 25 bp, Mus musculus
tggagaacaccggatggggctgttg

SEQ ID NO: 318374 - DNA, 25 bp, Mus musculus
ggccagagggtgacagacagcacct

SEQ ID NO: 318375 - DNA, 25 bp, Mus musculus
acagcacctgaggtgggatcgaata

SEQ ID NO: 318376 - DNA, 25 bp, Mus musculus
cacctgaggtgggatcgaataggtc

SEQ ID NO: 318377 - DNA, 25 bp, Mus musculus
agcgacatggtgctgctcaaggagt

SEQ ID NO: 318378 - DNA, 25 bp, Mus musculus
gacgctttggttgccgcagagacgc

SEQ ID NO: 318379 - DNA, 25 bp, Mus musculus
acaatccggagggagcagtgctgct

SEQ ID NO: 318380 - DNA, 25 bp, Mus musculus
tggatgacatgtagagcccgcctct

SEQ ID NO: 318381 - DNA, 25 bp, Mus musculus
gctccggctcgcactagatgcagca

SEQ ID NO: 318382 - DNA, 25 bp, Mus musculus
ggctttgcactcaggtgaggacgca

SEQ ID NO: 318383 - DNA, 25 bp, Mus musculus
aagaccgtacgctgcgggacgatca

SEQ ID NO: 318384 - DNA, 25 bp, Mus musculus
cccttgcgcaaagcaggctgggaat

SEQ ID NO: 318385 - DNA, 25 bp, Mus musculus
ggcggttcgctctgctgtaaagccc

SEQ ID NO: 318386 - DNA, 25 bp, Mus musculus
tggatccacctcctacggaagccga

SEQ ID NO: 318387 - DNA, 25 bp, Mus musculus
agccgaagcgcagtccgaatccgga

SEQ ID NO: 318388 - DNA, 25 bp, Mus musculus
cagtgctgctgagaccggagaccaa

SEQ ID NO: 318389 - DNA, 25 bp, Mus musculus
cacggagacaggaacacaccgggtt

SEQ ID NO: 318390 - DNA, 25 bp, Mus musculus
taccgcgagggaataatgtcggctg

SEQ ID NO: 318391 - DNA, 25 bp, Mus musculus
ccgagcgcaccgaaaggctttgcac

SEQ ID NO: 318392 - DNA, 25 bp, Mus musculus
gatcacgaagcagcccgagtcctcg

SEQ ID NO: 318393 - DNA, 25 bp, Mus musculus
atagcataagctgcggtcttcccgg

SEQ ID NO: 318394 - DNA, 25 bp, Mus musculus
tcagctctggaaggtacgtcacttc

SEQ ID NO: 318395 - DNA, 25 bp, Mus musculus
ggcgggacaaaccaacaactaatca

SEQ ID NO: 318396 - DNA, 25 bp, Mus musculus
cgtgactccacgctgtcagtgcgca

SEQ ID NO: 318397 - DNA, 25 bp, Mus musculus
gatccaggcccatgtgttcaaaacc

SEQ ID NO: 318398 - DNA, 25 bp, Mus musculus
ccagcgccagaggaatggccttttc

SEQ ID NO: 318399 - DNA, 25 bp, Mus musculus
cctaagaaggaagaggacgcagctc

SEQ ID NO: 318400 - DNA, 25 bp, Mus musculus
agcccaaatcggtgacagcctaaga

SEQ ID NO: 318401 - DNA, 25 bp, Mus musculus
tcctggatcaacgtaggtcgcgacc

SEQ ID NO: 318402 - DNA, 25 bp, Mus musculus
ttcttggtcctccatggcgtgactc

SEQ ID NO: 318403 - DNA, 25 bp, Mus musculus
agcgttccgcaatgctgtcccttga

SEQ ID NO: 318404 - DNA, 25 bp, Mus musculus
ggtgtccgacgttgctaccaatttg

SEQ ID NO: 318405 - DNA, 25 bp, Mus musculus
taccaatttgtgctggctctgcgca

SEQ ID NO: 318406 - DNA, 25 bp, Mus musculus
acccaccgccttcttgtggagaagc

SEQ ID NO: 318407 - DNA, 25 bp, Mus musculus
ctctgaggttcagtctcttggggcc

SEQ ID NO: 318408 - DNA, 25 bp, Mus musculus
cggttgagcgtcttcagctagctgc

SEQ ID NO: 318409 - DNA, 25 bp, Mus musculus
tccttgcgaaaatgcagcgggtgcg

SEQ ID NO: 318410 - DNA, 25 bp, Mus musculus
cgcgccggtgatccttgcgaaaatg

SEQ ID NO: 318411 - DNA, 25 bp, Mus musculus
gaggggacgtagtcacatagtccca

SEQ ID NO: 318412 - DNA, 25 bp, Mus musculus
gggatccaggcactccgtgctctct

SEQ ID NO: 318413 - DNA, 25 bp, Mus musculus
gactagtgcagggttccaggacccg

SEQ ID NO: 318414 - DNA, 25 bp, Mus musculus
aggattcgctcagcccgactagtgc

SEQ ID NO: 318415 - DNA, 25 bp, Mus musculus
gctgggtattgctgagacaggattc

SEQ ID NO: 318416 - DNA, 25 bp, Mus musculus
ggtcgtgttgtctctagctgggtat

SEQ ID NO: 318417 - DNA, 25 bp, Mus musculus
cccagctctgggttccggagaaact

SEQ ID NO: 318418 - DNA, 25 bp, Mus musculus
ctgccagagctatggtcgtgttgtc

SEQ ID NO: 318419 - DNA, 25 bp, Mus musculus
cgatcacccgaagaaccaagccggt

SEQ ID NO: 318420 - DNA, 25 bp, Mus musculus
atagtcccagatggccagatggctg

SEQ ID NO: 318421 - DNA, 25 bp, Mus musculus
aagatgtccctgaaagttgctagaa

SEQ ID NO: 318422 - DNA, 25 bp, Mus musculus
gacacgagcccggaagtgagttccg

SEQ ID NO: 318423 - DNA, 25 bp, Mus musculus
aagtgagttccggagctgtgtagac

SEQ ID NO: 318424 - DNA, 25 bp, Mus musculus
cctggaactaacgacgttcctcctg

SEQ ID NO: 318425 - DNA, 25 bp, Mus musculus
aaacctgactcaggcggagcccgcg

SEQ ID NO: 318426 - DNA, 25 bp, Mus musculus
cgccggccgtatttggacatttcgt

SEQ ID NO: 318427 - DNA, 25 bp, Mus musculus
tgcgctaccgggcatcggtgagcat

SEQ ID NO: 318428 - DNA, 25 bp, Mus musculus
caggtttggggtccagggtatctct

SEQ ID NO: 318429 - DNA, 25 bp, Mus musculus
ccaggaatttcggtggaagatgtcc

SEQ ID NO: 318430 - DNA, 25 bp, Mus musculus
aaagttgctagaacaggaggccgag

SEQ ID NO: 318431 - DNA, 25 bp, Mus musculus
tcagccctcgtctcgcgcggggtgt

SEQ ID NO: 318432 - DNA, 25 bp, Mus musculus
cgttcctcctggaaaacctgactca

SEQ ID NO: 318433 - DNA, 25 bp, Mus musculus
tccagggtatctctcggtggcccgc

SEQ ID NO: 318434 - DNA, 25 bp, Mus musculus
tacgccgcggccgagtacagaccaa

SEQ ID NO: 318435 - DNA, 25 bp, Mus musculus
gcgcagtagcgcacctgctccgagt

SEQ ID NO: 318436 - DNA, 25 bp, Mus musculus
tgtcctcgatttgtatctcagcgtg

SEQ ID NO: 318437 - DNA, 25 bp, Mus musculus
agcgctcctgtgcatagatcctgtc

SEQ ID NO: 318438 - DNA, 25 bp, Mus musculus
gtttctattctaggggcgtggctta

SEQ ID NO: 318439 - DNA, 25 bp, Mus musculus
cagccagaggatgcacagcagactc

SEQ ID NO: 318440 - DNA, 25 bp, Mus musculus
gccaaagataggagaagcgcgcgca

SEQ ID NO: 318441 - DNA, 25 bp, Mus musculus
gccatcgaaggagtgtggaccgtcc

SEQ ID NO: 318442 - DNA, 25 bp, Mus musculus
ctctgagtggctgaagctgaaccca

SEQ ID NO: 318443 - DNA, 25 bp, Mus musculus
caacagggctcgaacgctgaggact

SEQ ID NO: 318444 - DNA, 25 bp, Mus musculus
aacaaagtggcgtcctgtgggcaac

SEQ ID NO: 318445 - DNA, 25 bp, Mus musculus
ctcagcagcataggtgaacaaagtg

SEQ ID NO: 318446 - DNA, 25 bp, Mus musculus
cccattaggtaggagctcagcagca

SEQ ID NO: 318447 - DNA, 25 bp, Mus musculus
tgggcgcagtcaacaacgtacccgc

SEQ ID NO: 318448 - DNA, 25 bp, Mus musculus
gagactcaaaaaaggagcgctcctg

SEQ ID NO: 318449 - DNA, 25 bp, Mus musculus
aggctgacaccggagccggtccgct

SEQ ID NO: 318450 - DNA, 25 bp, Mus musculus
ccaggacgccgcatgcgcactgagg

SEQ ID NO: 318451 - DNA, 25 bp, Mus musculus
gcgtctcccactacatcatcaacag

SEQ ID NO: 318452 - DNA, 25 bp, Mus musculus
cactgagggccccaaggactccgtt

SEQ ID NO: 318453 - DNA, 25 bp, Mus musculus
tagcgtctccgaaaactcgcgcgtc

SEQ ID NO: 318454 - DNA, 25 bp, Mus musculus
ttcccggcagcctccctcgggtaga

SEQ ID NO: 318455 - DNA, 25 bp, Mus musculus
ccatggcgggcaacttcgactcgga

SEQ ID NO: 318456 - DNA, 25 bp, Mus musculus
gcgccctccagtgcctccgtcgccc

SEQ ID NO: 318457 - DNA, 25 bp, Mus musculus
ggcgctattgcagggccagcggcac

SEQ ID NO: 318458 - DNA, 25 bp, Mus musculus
ttcctggtgcgggactcgagcacca

SEQ ID NO: 318459 - DNA, 25 bp, Mus musculus
tggtgcgggactcgagcaccagccc

SEQ ID NO: 318460 - DNA, 25 bp, Mus musculus
cccggggactatgtgcttagcgtct

SEQ ID NO: 318461 - DNA, 25 bp, Mus musculus
tgtgcttagcgtctccgaaaactcg

SEQ ID NO: 318462 - DNA, 25 bp, Mus musculus
ccttctcccaatggcgggcgtcggt

SEQ ID NO: 318463 - DNA, 25 bp, Mus musculus
gcgctggttccagccttttctggcg

SEQ ID NO: 318464 - DNA, 25 bp, Mus musculus
ttgccatagagctgagcagttgtcc

SEQ ID NO: 318465 - DNA, 25 bp, Mus musculus
gccgttctccgtcgcagtcgcagtt

SEQ ID NO: 318466 - DNA, 25 bp, Mus musculus
aagtcccggattgaggcgccgccat

SEQ ID NO: 318467 - DNA, 25 bp, Mus musculus
gccatttttcctgctcggacgcgga

SEQ ID NO: 318468 - DNA, 25 bp, Mus musculus
gtcggagacgctatccgcttccatc

SEQ ID NO: 318469 - DNA, 25 bp, Mus musculus
ccgctgccgcaatggatgatcggga

SEQ ID NO: 318470 - DNA, 25 bp, Mus musculus
atgatcgggaggatctggtgtacca

SEQ ID NO: 318471 - DNA, 25 bp, Mus musculus
tctggtgtaccaggcgaagctggca

SEQ ID NO: 318472 - DNA, 25 bp, Mus musculus
atgtgaggaacggtaccggtcgctc

SEQ ID NO: 318473 - DNA, 25 bp, Mus musculus
cgctaggcgcctttcggggaaatat

SEQ ID NO: 318474 - DNA, 25 bp, Mus musculus
ccgtggagcctcacaaaggagaagc

SEQ ID NO: 318475 - DNA, 25 bp, Mus musculus
caaaggagaagcctctggaacggac

SEQ ID NO: 318476 - DNA, 25 bp, Mus musculus
ttttctggcgccgaactccgggatc

SEQ ID NO: 318477 - DNA, 25 bp, Mus musculus
ctggatgctgatggtcgccttctcc

SEQ ID NO: 318478 - DNA, 25 bp, Mus musculus
atctgcttgataggccgaatggggc

SEQ ID NO: 318479 - DNA, 25 bp, Mus musculus
taatcggagatctgcttgataggcc

SEQ ID NO: 318480 - DNA, 25 bp, Mus musculus
agcggggaaaataatcggagatctg

SEQ ID NO: 318481 - DNA, 25 bp, Mus musculus
agctggtccacatcttcgtcgtcgt

SEQ ID NO: 318482 - DNA, 25 bp, Mus musculus
ggctccgaagagctggtccacatct

SEQ ID NO: 318483 - DNA, 25 bp, Mus musculus
gctggctccgtaggctccgaagagc

SEQ ID NO: 318484 - DNA, 25 bp, Mus musculus
tcgtagccgtcgacgtccggctcgt

SEQ ID NO: 318485 - DNA, 25 bp, Mus musculus
cagtcgtctgactcgtagccgtcga

SEQ ID NO: 318486 - DNA, 25 bp, Mus musculus
tgggaaacttactgcagtcgtctga

SEQ ID NO: 318487 - DNA, 25 bp, Mus musculus
gccggcgactgggaaacttactgca

SEQ ID NO: 318488 - DNA, 25 bp, Mus musculus
ccgcagcaactggtgtctctccggg

SEQ ID NO: 318489 - DNA, 25 bp, Mus musculus
gatggccatatgctcctggatgctg

SEQ ID NO: 318490 - DNA, 25 bp, Mus musculus
gccgggacacacgtcgatggccata

SEQ ID NO: 318491 - DNA, 25 bp, Mus musculus
cagtccttttgagccgagcgcccaa

SEQ ID NO: 318492 - DNA, 25 bp, Mus musculus
tctacaggatctgagccctagctcc

SEQ ID NO: 318493 - DNA, 25 bp, Mus musculus
cccaggttccaacatctacaggatc

SEQ ID NO: 318494 - DNA, 25 bp, Mus musculus
ctaaatcccggagtaagagcgcgcc

SEQ ID NO: 318495 - DNA, 25 bp, Mus musculus
cgctccgggctgtaggctaaatccc

SEQ ID NO: 318496 - DNA, 25 bp, Mus musculus
acccaagggctccacgtgctttcga

SEQ ID NO: 318497 - DNA, 25 bp, Mus musculus
cgccagaaaccgaaaacattggatc

SEQ ID NO: 318498 - DNA, 25 bp, Mus musculus
cggaattcgcagacggccggagacc

SEQ ID NO: 318499 - DNA, 25 bp, Mus musculus
tcctgaacgccagccagtccttttg

SEQ ID NO: 318500 - DNA, 25 bp, Mus musculus
cgtgctttcgagttcccactcctga

SEQ ID NO: 318501 - DNA, 25 bp, Mus musculus
cagaaccggctgactcggaggacac

SEQ ID NO: 318502 - DNA, 25 bp, Mus musculus
ttagctacacttacctggggcttcg

SEQ ID NO: 318503 - DNA, 25 bp, Mus musculus
ctgggctccgcacttgttgactcac

SEQ ID NO: 318504 - DNA, 25 bp, Mus musculus
agggtcgccatcctgagctctcggc

SEQ ID NO: 318505 - DNA, 25 bp, Mus musculus
accggtgcggcggagtatggtgagg

SEQ ID NO: 318506 - DNA, 25 bp, Mus musculus
cgccaggtgcgggtcctctgctgtt

SEQ ID NO: 318507 - DNA, 25 bp, Mus musculus
gtcctctgctgtttccgggcacgca

SEQ ID NO: 318508 - DNA, 25 bp, Mus musculus
tggtctgagcaagcagtgagcgcct

SEQ ID NO: 318509 - DNA, 25 bp, Mus musculus
gcaccgcctccgagctggccaaacg

SEQ ID NO: 318510 - DNA, 25 bp, Mus musculus
tcctctgctgtttccgggcacgcag

SEQ ID NO: 318511 - DNA, 25 bp, Mus musculus
cctctgctgtttccgggcacgcagg

SEQ ID NO: 318512 - DNA, 25 bp, Mus musculus
tctgagcaagcagtgagcgcctgga

SEQ ID NO: 318513 - DNA, 25 bp, Mus musculus
acccgcgggcggatggccggccgtg

SEQ ID NO: 318514 - DNA, 25 bp, Mus musculus
ggggtccaagctgcctcccatcgtg

SEQ ID NO: 318515 - DNA, 25 bp, Mus musculus
ggtccaagctgcctcccatcgtggg

SEQ ID NO: 318516 - DNA, 25 bp, Mus musculus
caagctgcctcccatcgtgggcacc

SEQ ID NO: 318517 - DNA, 25 bp, Mus musculus
tcccatcgtgggcaccgcctccgag

SEQ ID NO: 318518 - DNA, 25 bp, Mus musculus
cgggcacgcaggtcggggacccgcg

SEQ ID NO: 318519 - DNA, 25 bp, Mus musculus
ccagcaggaatgtggtcgagccgca

SEQ ID NO: 318520 - DNA, 25 bp, Mus musculus
ccgccacctcgaagggaggagaccg

SEQ ID NO: 318521 - DNA, 25 bp, Mus musculus
gggactataggggtcaccgccgcat

SEQ ID NO: 318522 - DNA, 25 bp, Mus musculus
cgcctcccaggcgatgacaattttc

SEQ ID NO: 318523 - DNA, 25 bp, Mus musculus
gcgatgacaattttccagccactgg

SEQ ID NO: 318524 - DNA, 25 bp, Mus musculus
caccgactgcgaaagctggagactc

SEQ ID NO: 318525 - DNA, 25 bp, Mus musculus
aagtccgcgcgggaggcaactcacc

SEQ ID NO: 318526 - DNA, 25 bp, Mus musculus
gtccctatggtccacggcgatcctt

SEQ ID NO: 318527 - DNA, 25 bp, Mus musculus
actggcaaagctgcgaggcttcgtc

SEQ ID NO: 318528 - DNA, 25 bp, Mus musculus
ccggcatgccgcgactggcaaagct

SEQ ID NO: 318529 - DNA, 25 bp, Mus musculus
ccatagctgcacgtgtggcgggacc

SEQ ID NO: 318530 - DNA, 25 bp, Mus musculus
tccacgagttcagggacatcctgca

SEQ ID NO: 318531 - DNA, 25 bp, Mus musculus
ggcgatccttgctccatgcactgtc

SEQ ID NO: 318532 - DNA, 25 bp, Mus musculus
ggctgtccaggacgccgtcgccttt

SEQ ID NO: 318533 - DNA, 25 bp, Mus musculus
gccgctacttactcggctagcctgg

SEQ ID NO: 318534 - DNA, 25 bp, Mus musculus
tgtcccaatggatgggcaataagcc

SEQ ID NO: 318535 - DNA, 25 bp, Mus musculus
gtagccacggcagtgtcccaatgga

SEQ ID NO: 318536 - DNA, 25 bp, Mus musculus
agattgaaagccctctcttcttcgc

SEQ ID NO: 318537 - DNA, 25 bp, Mus musculus
cacgcggcgggttcttaagattgaa

SEQ ID NO: 318538 - DNA, 25 bp, Mus musculus
taacctcaagttccctgttcgcacg

SEQ ID NO: 318539 - DNA, 25 bp, Mus musculus
gcatggctgtcaagtccctggaaaa

SEQ ID NO: 318540 - DNA, 25 bp, Mus musculus
gctcgcgacctgtctgtcaccagga

SEQ ID NO: 318541 - DNA, 25 bp, Mus musculus
ctagcctggcacttccggagaactg

SEQ ID NO: 318542 - DNA, 25 bp, Mus musculus
gcaagcctccaggtacggggctcga

SEQ ID NO: 318543 - DNA, 25 bp, Mus musculus
ggccatgaagccaacgtgcaacccg

SEQ ID NO: 318544 - DNA, 25 bp, Mus musculus
tggaaaatctccagacaacccttaa

SEQ ID NO: 318545 - DNA, 25 bp, Mus musculus
ctgggatagcggaggactgacttcc

SEQ ID NO: 318546 - DNA, 25 bp, Mus musculus
actgacttccgcaggcatggctgtc

SEQ ID NO: 318547 - DNA, 25 bp, Mus musculus
cccggatggacggaagacgactgcc

SEQ ID NO: 318548 - DNA, 25 bp, Mus musculus
gaagacgactgcctgacggtcggca

SEQ ID NO: 318549 - DNA, 25 bp, Mus musculus
acggtcggcaccaggtatcacactc

SEQ ID NO: 318550 - DNA, 25 bp, Mus musculus
ccctcggttcgcagcggacctggga

SEQ ID NO: 318551 - DNA, 25 bp, Mus musculus
gcgctgcaccgtttgcggcccggat

SEQ ID NO: 318552 - DNA, 25 bp, Mus musculus
tcgcgctcagcatctgggcgctgca

SEQ ID NO: 318553 - DNA, 25 bp, Mus musculus
ggctcttcgcgctcagcatctgggc

SEQ ID NO: 318554 - DNA, 25 bp, Mus musculus
tgactctagccagcggcgcgctctt

SEQ ID NO: 318555 - DNA, 25 bp, Mus musculus
gcatccatgctgctgactctagcca

SEQ ID NO: 318556 - DNA, 25 bp, Mus musculus
tagaaatagggagagccggccaagc

SEQ ID NO: 318557 - DNA, 25 bp, Mus musculus
aggggaccaggcagcctcacaacta

SEQ ID NO: 318558 - DNA, 25 bp, Mus musculus
gctgcccttgctctgggcatcgcgg

SEQ ID NO: 318559 - DNA, 25 bp, Mus musculus
cttgctctgggcatcgcggcgccat

SEQ ID NO: 318560 - DNA, 25 bp, Mus musculus
cgcatcgtgcacgtcctgcagggag

SEQ ID NO: 318561 - DNA, 25 bp, Mus musculus
ggcgggttcctcttcctcataggct

SEQ ID NO: 318562 - DNA, 25 bp, Mus musculus
gggccagagaaacgcactaagagtc

SEQ ID NO: 318563 - DNA, 25 bp, Mus musculus
cactaagagtctcgggcgggttcct

SEQ ID NO: 318564 - DNA, 25 bp, Mus musculus
catcctctgcgagcgcttgtaaaca

SEQ ID NO: 318565 - DNA, 25 bp, Mus musculus
gcattcggagtgagctcatcctctg

SEQ ID NO: 318566 - DNA, 25 bp, Mus musculus
tgtaaacaacggtgggaggcagctt

SEQ ID NO: 318567 - DNA, 25 bp, Mus musculus
ctcataggctgcttctgggacaacg

SEQ ID NO: 318568 - DNA, 25 bp, Mus musculus
gtctccgctgcctcaactggttggc

SEQ ID NO: 318569 - DNA, 25 bp, Mus musculus
ggccctggtgctacatcagcagcga

SEQ ID NO: 318570 - DNA, 25 bp, Mus musculus
cgtccctgaaaagcggccctgcgag

SEQ ID NO: 318571 - DNA, 25 bp, Mus musculus
gcgccgtccgattggccagagctat

SEQ ID NO: 318572 - DNA, 25 bp, Mus musculus
gccagagctatctccaggcagcgga

SEQ ID NO: 318573 - DNA, 25 bp, Mus musculus
aggcagcggagctcaaagcccattg

SEQ ID NO: 318574 - DNA, 25 bp, Mus musculus
acactctgaggtacacagggctttc

SEQ ID NO: 318575 - DNA, 25 bp, Mus musculus
ctttctcaggaccacggcggtattt

SEQ ID NO: 318576 - DNA, 25 bp, Mus musculus
gtattgccgggacagtacaacctgc

SEQ ID NO: 318577 - DNA, 25 bp, Mus musculus
ttacaacgatctcttaaaatgcggg

SEQ ID NO: 318578 - DNA, 25 bp, Mus musculus
cttaaaatgcgggacctggtacctg

SEQ ID NO: 318579 - DNA, 25 bp, Mus musculus
gacctggtacctggggactttctca

SEQ ID NO: 318580 - DNA, 25 bp, Mus musculus
ctctacatgcatgcccaggccgggg

SEQ ID NO: 318581 - DNA, 25 bp, Mus musculus
ccctcggagccgtattgccgggaca

SEQ ID NO: 318582 - DNA, 25 bp, Mus musculus
ggcggtattttccatcccataaaga

SEQ ID NO: 318583 - DNA, 25 bp, Mus musculus
ttccatcccataaagacattaacgg

SEQ ID NO: 318584 - DNA, 25 bp, Mus musculus
agacattaacggacagctggcgcca

SEQ ID NO: 318585 - DNA, 25 bp, Mus musculus
gctggcgccagctagaaccttttta

SEQ ID NO: 318586 - DNA, 25 bp, Mus musculus
gtacaacctgcaaacacgcatcaag

SEQ ID NO: 318587 - DNA, 25 bp, Mus musculus
cgggtccttcacctctacatgcatg

SEQ ID NO: 318588 - DNA, 25 bp, Mus musculus
ctagaacctttttagcgaggtggtg

SEQ ID NO: 318589 - DNA, 25 bp, Mus musculus
ccgggtggtattctatgtgatgctc

SEQ ID NO: 318590 - DNA, 25 bp, Mus musculus
agccgcacgcccacagctgtgataa

SEQ ID NO: 318591 - DNA, 25 bp, Mus musculus
gtagggtctcctctgagccgcacgc

SEQ ID NO: 318592 - DNA, 25 bp, Mus musculus
ttcgtagggtctcctctgagccgca

SEQ ID NO: 318593 - DNA, 25 bp, Mus musculus
ctcttaggcgttcgtagggtctcct

SEQ ID NO: 318594 - DNA, 25 bp, Mus musculus
ggatcctggctcttaggcgttcgta

SEQ ID NO: 318595 - DNA, 25 bp, Mus musculus
cgctccgggtggtattctatgtgat

SEQ ID NO: 318596 - DNA, 25 bp, Mus musculus
gctgggtctcccagcggagcttgct

SEQ ID NO: 318597 - DNA, 25 bp, Mus musculus
cttcctccctctgcggcagagtggg

SEQ ID NO: 318598 - DNA, 25 bp, Mus musculus
ctccctctgcggcagagtgggtgcc

SEQ ID NO: 318599 - DNA, 25 bp, Mus musculus
attctatgtgatgctccgttactgc

SEQ ID NO: 318600 - DNA, 25 bp, Mus musculus
cccacagctgtgataagggcggccc

SEQ ID NO: 318601 - DNA, 25 bp, Mus musculus
gtcgtcggttctagagaggagtgct

SEQ ID NO: 318602 - DNA, 25 bp, Mus musculus
tgtgatgctccgttactgcagtccc

SEQ ID NO: 318603 - DNA, 25 bp, Mus musculus
tcccgagcaccgtaggagcagtgca

SEQ ID NO: 318604 - DNA, 25 bp, Mus musculus
tctccaacaagctcgcagcgtcgaa

SEQ ID NO: 318605 - DNA, 25 bp, Mus musculus
tctgctagccgctgccgttcaaggc

SEQ ID NO: 318606 - DNA, 25 bp, Mus musculus
ccgcttccgtgctgtagtctgctag

SEQ ID NO: 318607 - DNA, 25 bp, Mus musculus
agcgcttctccgcttccgtgctgta

SEQ ID NO: 318608 - DNA, 25 bp, Mus musculus
taggagcagtgcagagcctcagcct

SEQ ID NO: 318609 - DNA, 25 bp, Mus musculus
gaggactctaggagaccgtcatgtg

SEQ ID NO: 318610 - DNA, 25 bp, Mus musculus
ctacgaaggacggaggaggactcta

SEQ ID NO: 318611 - DNA, 25 bp, Mus musculus
tcccactgggaagacactacgaagg

SEQ ID NO: 318612 - DNA, 25 bp, Mus musculus
caaggctatattcgctcccggtttc

SEQ ID NO: 318613 - DNA, 25 bp, Mus musculus
catttccaggagaatcaaggctata

SEQ ID NO: 318614 - DNA, 25 bp, Mus musculus
ttccgaaacacgtgcagtagccctg

SEQ ID NO: 318615 - DNA, 25 bp, Mus musculus
cggcagtcatttaataacgaagaac

SEQ ID NO: 318616 - DNA, 25 bp, Mus musculus
tgggaacccacctaggtccatggcg

SEQ ID NO: 318617 - DNA, 25 bp, Mus musculus
atgcactgtctggaagcggttcttc

SEQ ID NO: 318618 - DNA, 25 bp, Mus musculus
ggggctcgcaaaagctgaaaacacc

SEQ ID NO: 318619 - DNA, 25 bp, Mus musculus
cccaggacatctcgaaagaaatgca

SEQ ID NO: 318620 - DNA, 25 bp, Mus musculus
gttcttcactttgaaaacgaagtgc

SEQ ID NO: 318621 - DNA, 25 bp, Mus musculus
aacgaagtgcagagctcgacgagtg

SEQ ID NO: 318622 - DNA, 25 bp, Mus musculus
gtggccatggctcccaacacgaaaa

SEQ ID NO: 318623 - DNA, 25 bp, Mus musculus
ggatcgtcgggtgacgtcactaaca

SEQ ID NO: 318624 - DNA, 25 bp, Mus musculus
gtgacgtcactaacactcgaccgcg

SEQ ID NO: 318625 - DNA, 25 bp, Mus musculus
atgtggtgctccctgggatcattgc

SEQ ID NO: 318626 - DNA, 25 bp, Mus musculus
tcattgctgcgggtggtccagactc

SEQ ID NO: 318627 - DNA, 25 bp, Mus musculus
tagcccggtgagagtgttgtctccc

SEQ ID NO: 318628 - DNA, 25 bp, Mus musculus
tctccctcgggacaggtggaggaac

SEQ ID NO: 318629 - DNA, 25 bp, Mus musculus
agactcgggacctcaacgctcggcg

SEQ ID NO: 318630 - DNA, 25 bp, Mus musculus
gaaaacaccggcgtggcaacgcgga

SEQ ID NO: 318631 - DNA, 25 bp, Mus musculus
tgtcaaacttcccagcgtgggctca

SEQ ID NO: 318632 - DNA, 25 bp, Mus musculus
tcgcaacagctaccggctcgctggt

SEQ ID NO: 318633 - DNA, 25 bp, Mus musculus
ccctcgcaggcgaccgtagaaggcg

SEQ ID NO: 318634 - DNA, 25 bp, Mus musculus
acgaagacgatctccaggcggtgcc

SEQ ID NO: 318635 - DNA, 25 bp, Mus musculus
ttggtccgaagacacgaagacgatc

SEQ ID NO: 318636 - DNA, 25 bp, Mus musculus
cgcgattcccatcgcgtggaccaga

SEQ ID NO: 318637 - DNA, 25 bp, Mus musculus
ctgccgctggtcttggtccgaagac

SEQ ID NO: 318638 - DNA, 25 bp, Mus musculus
agccatggcatgtcccgcacgaagt

SEQ ID NO: 318639 - DNA, 25 bp, Mus musculus
ttccggtgcttctccttgtagggca

SEQ ID NO: 318640 - DNA, 25 bp, Mus musculus
ccaagatagagatggcaggcctatg

SEQ ID NO: 318641 - DNA, 25 bp, Mus musculus
tgggtactggcacccaggagttgcc

SEQ ID NO: 318642 - DNA, 25 bp, Mus musculus
tggaccagaggggtgtcaaacttcc

SEQ ID NO: 318643 - DNA, 25 bp, Mus musculus
aggtccctagcagctggcgtcttgg

SEQ ID NO: 318644 - DNA, 25 bp, Mus musculus
gcgagcgcctcaacacgacaggatc

SEQ ID NO: 318645 - DNA, 25 bp, Mus musculus
ggcgggatcccgagtcctgccaaga

SEQ ID NO: 318646 - DNA, 25 bp, Mus musculus
gaatctgccgttgtcgtcactctgg

SEQ ID NO: 318647 - DNA, 25 bp, Mus musculus
gtcactctggctggacgcctaggta

SEQ ID NO: 318648 - DNA, 25 bp, Mus musculus
cctaggtaagcgtgtggaatcggct

SEQ ID NO: 318649 - DNA, 25 bp, Mus musculus
tggaatcggctgtgggaaatacgaa

SEQ ID NO: 318650 - DNA, 25 bp, Mus musculus
cggctgtgggaaatacgaagtgaaa

SEQ ID NO: 318651 - DNA, 25 bp, Mus musculus
tacgaagtgaaaggtactagagccc

SEQ ID NO: 318652 - DNA, 25 bp, Mus musculus
ccctacggtcatggcggctaccgcc

SEQ ID NO: 318653 - DNA, 25 bp, Mus musculus
gcagcgggttctgccgaagctccgt

SEQ ID NO: 318654 - DNA, 25 bp, Mus musculus
tgccgaagctccgttgcagtacagc

SEQ ID NO: 318655 - DNA, 25 bp, Mus musculus
gctccgttgcagtacagccttcttc

SEQ ID NO: 318656 - DNA, 25 bp, Mus musculus
tgcagtacagccttcttcttcagta

SEQ ID NO: 318657 - DNA, 25 bp, Mus musculus
cttcagtacctggtgggcgacaagc

SEQ ID NO: 318658 - DNA, 25 bp, Mus musculus
cctggtgggcgacaagcgtcagccc

SEQ ID NO: 318659 - DNA, 25 bp, Mus musculus
agaagcgcacaagcggctctggaga

SEQ ID NO: 318660 - DNA, 25 bp, Mus musculus
gaagcagcttactgcgcactcggcc

SEQ ID NO: 318661 - DNA, 25 bp, Mus musculus
ccagatccgggcagaaaggtggaga

SEQ ID NO: 318662 - DNA, 25 bp, Mus musculus
aggatatccgtcatgccggcggcca

SEQ ID NO: 318663 - DNA, 25 bp, Mus musculus
gctggggcaggatatccgtcatgcc

SEQ ID NO: 318664 - DNA, 25 bp, Mus musculus
gattcgcacactgctttcaggctgc

SEQ ID NO: 318665 - DNA, 25 bp, Mus musculus
tccagggattcgcacactgctttca

SEQ ID NO: 318666 - DNA, 25 bp, Mus musculus
cagcagtgctccagggattcgcaca

SEQ ID NO: 318667 - DNA, 25 bp, Mus musculus
ccagacagcagtgctccagggattc

SEQ ID NO: 318668 - DNA, 25 bp, Mus musculus
tcctccagctgatccagacagcagt

SEQ ID NO: 318669 - DNA, 25 bp, Mus musculus
ccagtattgggcattcgcttgctcc

SEQ ID NO: 318670 - DNA, 25 bp, Mus musculus
cgcacaagcggctctggagagagct

SEQ ID NO: 318671 - DNA, 25 bp, Mus musculus
agtcgggcgccagtattgggcattc

SEQ ID NO: 318672 - DNA, 25 bp, Mus musculus
ctgcacccgcccgagtgcttagccg

SEQ ID NO: 318673 - DNA, 25 bp, Mus musculus
ggctccattatgaaccttttcctgc

SEQ ID NO: 318674 - DNA, 25 bp, Mus musculus
tgaaccttttcctgctgccgctttc

SEQ ID NO: 318675 - DNA, 25 bp, Mus musculus
tccaggcagtcactcgcgggatgaa

SEQ ID NO: 318676 - DNA, 25 bp, Mus musculus
cccggaggcccgattgctccaaatg

SEQ ID NO: 318677 - DNA, 25 bp, Mus musculus
tccaaatgcacaggaaacgcacgtc

SEQ ID NO: 318678 - DNA, 25 bp, Mus musculus
aacgcacgtcttgacttgcgaggtg

SEQ ID NO: 318679 - DNA, 25 bp, Mus musculus
acttgcgaggtggagctgctcgttc

SEQ ID NO: 318680 - DNA, 25 bp, Mus musculus
agctgctcgttcctgctgtggtcac

SEQ ID NO: 318681 - DNA, 25 bp, Mus musculus
gggtgcttcccagagacaagcttta

SEQ ID NO: 318682 - DNA, 25 bp, Mus musculus
gctttatttacaacttctcgccgga

SEQ ID NO: 318683 - DNA, 25 bp, Mus musculus
accggctggcgatgaaaggctccat

SEQ ID NO: 318684 - DNA, 25 bp, Mus musculus
aagagcgcagggcaggcctacacca

SEQ ID NO: 318685 - DNA, 25 bp, Mus musculus
ggcaggcctacaccagcatgctggc

SEQ ID NO: 318686 - DNA, 25 bp, Mus musculus
cgtggaatcgtcacaagacagagcc

SEQ ID NO: 318687 - DNA, 25 bp, Mus musculus
tgggaaaccggaccctcatcgcaca

SEQ ID NO: 318688 - DNA, 25 bp, Mus musculus
tggtcagatgggaaaccggaccctc

SEQ ID NO: 318689 - DNA, 25 bp, Mus musculus
gtggctaagcggctccatgcccgcg

SEQ ID NO: 318690 - DNA, 25 bp, Mus musculus
ggaccctcatcgcacaacaaaggag

SEQ ID NO: 318691 - DNA, 25 bp, Mus musculus
cgcacaacaaaggaggaagggcgcc

SEQ ID NO: 318692 - DNA, 25 bp, Mus musculus
aaacaggtagtagggaggagcaagc

SEQ ID NO: 318693 - DNA, 25 bp, Mus musculus
aggagcaagccgcagctgccaaggt

SEQ ID NO: 318694 - DNA, 25 bp, Mus musculus
caagccgcagctgccaaggtgagga

SEQ ID NO: 318695 - DNA, 25 bp, Mus musculus
ctgtggcagcctaggcgaacccgct

SEQ ID NO: 318696 - DNA, 25 bp, Mus musculus
agcctaggcgaacccgctgcggatc

SEQ ID NO: 318697 - DNA, 25 bp, Mus musculus
cagcccgcgcgccaactagcaactt

SEQ ID NO: 318698 - DNA, 25 bp, Mus musculus
gcggtagccaatccgcgcaaggctc

SEQ ID NO: 318699 - DNA, 25 bp, Mus musculus
aggccagactcggaggtcgaagttg

SEQ ID NO: 318700 - DNA, 25 bp, Mus musculus
cgcggcagaggttccttggtcagat

SEQ ID NO: 318701 - DNA, 25 bp, Mus musculus
aggctagcctcaaagctgacagctc

SEQ ID NO: 318702 - DNA, 25 bp, Mus musculus
tctttccattcaaaggggaaacaca

SEQ ID NO: 318703 - DNA, 25 bp, Mus musculus
cagctctgaaggtggtctcctcagg

SEQ ID NO: 318704 - DNA, 25 bp, Mus musculus
agctgacagctctgaaggtggtctc

SEQ ID NO: 318705 - DNA, 25 bp, Mus musculus
gggaaacacacaagaaatttgtcca

SEQ ID NO: 318706 - DNA, 25 bp, Mus musculus
aattatatatacacagacagacaga

SEQ ID NO: 318707 - DNA, 25 bp, Mus musculus
taaagagacaaacagagagagactg

SEQ ID NO: 318708 - DNA, 25 bp, Mus musculus
gagagactgagactccacatctttc

SEQ ID NO: 318709 - DNA, 25 bp, Mus musculus
gactgagactccacatctttccatt

SEQ ID NO: 318710 - DNA, 25 bp, Mus musculus
aaaaagacaggacctcacctgtagc

SEQ ID NO: 318711 - DNA, 25 bp, Mus musculus
acacaagaaatttgtccattcattc

SEQ ID NO: 318712 - DNA, 25 bp, Mus musculus
cattcagttttttaagacaggacct

SEQ ID NO: 318713 - DNA, 25 bp, Mus musculus
gtccaaggacaagcgttcatcaaga

SEQ ID NO: 318714 - DNA, 25 bp, Mus musculus
ccaaggacaagcgttcatcaagaag

SEQ ID NO: 318715 - DNA, 25 bp, Mus musculus
tgtgctgtcgcagtcgcttgtccct

SEQ ID NO: 318716 - DNA, 25 bp, Mus musculus
cagacgcttcaggttgagtttgcaa

SEQ ID NO: 318717 - DNA, 25 bp, Mus musculus
gcggtccctagctacacggcttggc

SEQ ID NO: 318718 - DNA, 25 bp, Mus musculus
tgggtttcgcctccctgacgtaagc

SEQ ID NO: 318719 - DNA, 25 bp, Mus musculus
tgtccctcgctcagtccctggagga

SEQ ID NO: 318720 - DNA, 25 bp, Mus musculus
gccaggcaggaaggtccaggcacac

SEQ ID NO: 318721 - DNA, 25 bp, Mus musculus
gtccggcaccgattccaacttcatg

SEQ ID NO: 318722 - DNA, 25 bp, Mus musculus
ggcgttcaaactcctgcgggtccca

SEQ ID NO: 318723 - DNA, 25 bp, Mus musculus
tcctctcggagcctgaagagcaggc

SEQ ID NO: 318724 - DNA, 25 bp, Mus musculus
gccgcctgcaggtaccagactttga

SEQ ID NO: 318725 - DNA, 25 bp, Mus musculus
gccaacacctgttgcagacgcttca

SEQ ID NO: 318726 - DNA, 25 bp, Mus musculus
ttgagtttgcaacgctcgagctcgc

SEQ ID NO: 318727 - DNA, 25 bp, Mus musculus
tccaacttcatgaccggagtctcct

SEQ ID NO: 318728 - DNA, 25 bp, Mus musculus
actcggcctgccagtggcgttcaaa

SEQ ID NO: 318729 - DNA, 25 bp, Mus musculus
caggagccaatgatcaagaaagcgc

SEQ ID NO: 318730 - DNA, 25 bp, Mus musculus
atccaggtcggcctgggcgataata

SEQ ID NO: 318731 - DNA, 25 bp, Mus musculus
gctgcggaagcgctttgaagatccc

SEQ ID NO: 318732 - DNA, 25 bp, Mus musculus
ccttaaggatccctacgtgctcgtc

SEQ ID NO: 318733 - DNA, 25 bp, Mus musculus
agcgctttgaagatccctgcgatcc

SEQ ID NO: 318734 - DNA, 25 bp, Mus musculus
gaagatccctgcgatccttaaggat

SEQ ID NO: 318735 - DNA, 25 bp, Mus musculus
cgtgctcgtccaggagccaatgatc

SEQ ID NO: 318736 - DNA, 25 bp, Mus musculus
tccagcgcctcaggtgctgcggaag

SEQ ID NO: 318737 - DNA, 25 bp, Mus musculus
gaggcggttccacggtccagcgcct

SEQ ID NO: 318738 - DNA, 25 bp, Mus musculus
gcccggccctaaatcaccagcagcg

SEQ ID NO: 318739 - DNA, 25 bp, Mus musculus
ggcctgggcgataataggcaccttc

SEQ ID NO: 318740 - DNA, 25 bp, Mus musculus
agaatttctgaaatccaggtcggcc

SEQ ID NO: 318741 - DNA, 25 bp, Mus musculus
cgacgccggagaagagcaagaattt

SEQ ID NO: 318742 - DNA, 25 bp, Mus musculus
taataggcaccttcgcagccgccag

SEQ ID NO: 318743 - DNA, 25 bp, Mus musculus
cgcgctatggctggggcttcccagc

SEQ ID NO: 318744 - DNA, 25 bp, Mus musculus
cagccagagcaggagaatgacggcc

SEQ ID NO: 318745 - DNA, 25 bp, Mus musculus
agccctggtgagcagtggtcctcca

SEQ ID NO: 318746 - DNA, 25 bp, Mus musculus
gcaggagaatgacggccgctccctc

SEQ ID NO: 318747 - DNA, 25 bp, Mus musculus
cgccggaaaggaggcatcaccctgc

SEQ ID NO: 318748 - DNA, 25 bp, Mus musculus
aaggaggcatcaccctgcacgttcc

SEQ ID NO: 318749 - DNA, 25 bp, Mus musculus
cccacgtaaggagcgcgcggtcacg

SEQ ID NO: 318750 - DNA, 25 bp, Mus musculus
agtggtcctccagcggcggatccgc

SEQ ID NO: 318751 - DNA, 25 bp, Mus musculus
gtcatccttcagctcggtgaagtaa

SEQ ID NO: 318752 - DNA, 25 bp, Mus musculus
agctcggtgaagtaatatgccagta

SEQ ID NO: 318753 - DNA, 25 bp, Mus musculus
atatgccagtagttgcgcggcgatc

SEQ ID NO: 318754 - DNA, 25 bp, Mus musculus
tagttgcgcggcgatcatgttgacg

SEQ ID NO: 318755 - DNA, 25 bp, Mus musculus
agtggctcctcagtagccctggtga

SEQ ID NO: 318756 - DNA, 25 bp, Mus musculus
ggggctcacctttttgacttggtca

SEQ ID NO: 318757 - DNA, 25 bp, Mus musculus
gctgtacacccgaccccaagcttgc

SEQ ID NO: 318758 - DNA, 25 bp, Mus musculus
ccaagcttgcattgttctgcgcccg

SEQ ID NO: 318759 - DNA, 25 bp, Mus musculus
caagcttgcattgttctgcgcccga

SEQ ID NO: 318760 - DNA, 25 bp, Mus musculus
aagcttgcattgttctgcgcccgag

SEQ ID NO: 318761 - DNA, 25 bp, Mus musculus
agcttgcattgttctgcgcccgagc

SEQ ID NO: 318762 - DNA, 25 bp, Mus musculus
ttgcattgttctgcgcccgagcgtc

SEQ ID NO: 318763 - DNA, 25 bp, Mus musculus
cgctgtacacccgaccccaagcttg

SEQ ID NO: 318764 - DNA, 25 bp, Mus musculus
ttctgcgcccgagcgtcccctagcg

SEQ ID NO: 318765 - DNA, 25 bp, Mus musculus
cttgcattgttctgcgcccgagcgt

SEQ ID NO: 318766 - DNA, 25 bp, Mus musculus
gcattgttctgcgcccgagcgtccc

SEQ ID NO: 318767 - DNA, 25 bp, Mus musculus
tgttctgcgcccgagcgtcccctag

SEQ ID NO: 318768 - DNA, 25 bp, Mus musculus
gttctgcgcccgagcgtcccctagc

SEQ ID NO: 318769 - DNA, 25 bp, Mus musculus
gcttgcattgttctgcgcccgagcg

SEQ ID NO: 318770 - DNA, 25 bp, Mus musculus
tgcattgttctgcgcccgagcgtcc

SEQ ID NO: 318771 - DNA, 25 bp, Mus musculus
tcagcgtttgcgcacccgcttggaa

SEQ ID NO: 318772 - DNA, 25 bp, Mus musculus
acacttgcgcactgctcagcgtttg

SEQ ID NO: 318773 - DNA, 25 bp, Mus musculus
tgcacatgcgcacacttgcgcactg

SEQ ID NO: 318774 - DNA, 25 bp, Mus musculus
attgcgcctcaaccttgcacatgcg

SEQ ID NO: 318775 - DNA, 25 bp, Mus musculus
gcagcacacacagtaagcaccagca

SEQ ID NO: 318776 - DNA, 25 bp, Mus musculus
cgcacccgcttggaaacggaacatg

SEQ ID NO: 318777 - DNA, 25 bp, Mus musculus
tggaaacggaacatgcgcctgcgca

SEQ ID NO: 318778 - DNA, 25 bp, Mus musculus
tgcgcagtgtcgcagtccctcagct

SEQ ID NO: 318779 - DNA, 25 bp, Mus musculus
gaccatggtctcgtcgggtatttcc

SEQ ID NO: 318780 - DNA, 25 bp, Mus musculus
tatttcctcgatgaagcagcgcttc

SEQ ID NO: 318781 - DNA, 25 bp, Mus musculus
gcagcgcttctcagtctcgccgatg

SEQ ID NO: 318782 - DNA, 25 bp, Mus musculus
cgtcgggtatttcctcgatgaagca

SEQ ID NO: 318783 - DNA, 25 bp, Mus musculus
tctcgccgatgtggaaatagagccc

SEQ ID NO: 318784 - DNA, 25 bp, Mus musculus
gatgtggaaatagagcccacgggca

SEQ ID NO: 318785 - DNA, 25 bp, Mus musculus
atcctggattacaacgaggcgttca

SEQ ID NO: 318786 - DNA, 25 bp, Mus musculus
cgcactcgcacttggggcggcctag

SEQ ID NO: 318787 - DNA, 25 bp, Mus musculus
tagcctaacgcgcagggacatcgcc

SEQ ID NO: 318788 - DNA, 25 bp, Mus musculus
gcggtcagcgccgtctcctatagcg

SEQ ID NO: 318789 - DNA, 25 bp, Mus musculus
ttccagcttcagtgttccgcggtca

SEQ ID NO: 318790 - DNA, 25 bp, Mus musculus
tcgagcacggggaattccagcttca

SEQ ID NO: 318791 - DNA, 25 bp, Mus musculus
ccctgcggacacctggagtgtcacg

SEQ ID NO: 318792 - DNA, 25 bp, Mus musculus
gctctatccttggtcctgcgtgcca

SEQ ID NO: 318793 - DNA, 25 bp, Mus musculus
gaggctctccaagatcgctacgctg

SEQ ID NO: 318794 - DNA, 25 bp, Mus musculus
cgctgcagcatgacctcggaggcaa

SEQ ID NO: 318795 - DNA, 25 bp, Mus musculus
gagcgcaagcgcatcctggattaca

SEQ ID NO: 318796 - DNA, 25 bp, Mus musculus
ggtgatggccgaagtgcccaatttg

SEQ ID NO: 318797 - DNA, 25 bp, Mus musculus
gacctcggaggcaagaggctctcca

SEQ ID NO: 318798 - DNA, 25 bp, Mus musculus
cacacggtccaaggctcggcgcatg

SEQ ID NO: 318799 - DNA, 25 bp, Mus musculus
tcagccttcttgatgtgcgccgcct

SEQ ID NO: 318800 - DNA, 25 bp, Mus musculus
caccgagctgccgatgctgaagaga

SEQ ID NO: 318801 - DNA, 25 bp, Mus musculus
tgggccgagctcctcagtagcagca

SEQ ID NO: 318802 - DNA, 25 bp, Mus musculus
ccgcttcgtggtagtagtggtcaaa

SEQ ID NO: 318803 - DNA, 25 bp, Mus musculus
gcagtcaggcaacgcttacttgttc

SEQ ID NO: 318804 - DNA, 25 bp, Mus musculus
gctcacgtgggaccgaaagcagtca

SEQ ID NO: 318805 - DNA, 25 bp, Mus musculus
agtagtggtcaaactggccctcggc

SEQ ID NO: 318806 - DNA, 25 bp, Mus musculus
gccaacggttgtcgtggtcgcctca

SEQ ID NO: 318807 - DNA, 25 bp, Mus musculus
ggcacgttcgaagccatccgggttc

SEQ ID NO: 318808 - DNA, 25 bp, Mus musculus
gtctcgtcgccgtgcatgttaccca

SEQ ID NO: 318809 - DNA, 25 bp, Mus musculus
aacacctggcgtgacaccgtctcgt

SEQ ID NO: 318810 - DNA, 25 bp, Mus musculus
ggctgggcagcaaatacacgtcggt

SEQ ID NO: 318811 - DNA, 25 bp, Mus musculus
acctcatccagggaaggtggctcgc

SEQ ID NO: 318812 - DNA, 25 bp, Mus musculus
ttgttcctgcggatccagtcgatga

SEQ ID NO: 318813 - DNA, 25 bp, Mus musculus
tccacgaagcagtttgggcgccatg

SEQ ID NO: 318814 - DNA, 25 bp, Mus musculus
caacgcaggtgaggcaccgctggta

SEQ ID NO: 318815 - DNA, 25 bp, Mus musculus
ctgcaatcgtgggtggcttcgccct

SEQ ID NO: 318816 - DNA, 25 bp, Mus musculus
gtttctctcggccaccattgagcgg

SEQ ID NO: 318817 - DNA, 25 bp, Mus musculus
gcaccaggagagagacgacatcacg

SEQ ID NO: 318818 - DNA, 25 bp, Mus musculus
ggccaccattgagcgggtttccttc

SEQ ID NO: 318819 - DNA, 25 bp, Mus musculus
caccgctggtaccacgagtgttttc

SEQ ID NO: 318820 - DNA, 25 bp, Mus musculus
ttgggcgccatgaacaacgcaggtg

SEQ ID NO: 318821 - DNA, 25 bp, Mus musculus
aactaacgtttcctccacgaagcag

SEQ ID NO: 318822 - DNA, 25 bp, Mus musculus
tccggccagctaggcagcggactgt

SEQ ID NO: 318823 - DNA, 25 bp, Mus musculus
tgcgagaaccaggtccggccagcta

SEQ ID NO: 318824 - DNA, 25 bp, Mus musculus
cttcttccggcgcttagggtgcgag

SEQ ID NO: 318825 - DNA, 25 bp, Mus musculus
cgatggcgctgactcagcaacgcga

SEQ ID NO: 318826 - DNA, 25 bp, Mus musculus
cattgagcgggtttccttcttccgg

SEQ ID NO: 318827 - DNA, 25 bp, Mus musculus
gtgaaccaaccagcccttcctggtg

SEQ ID NO: 318828 - DNA, 25 bp, Mus musculus
cccacatcgctagggccgctccttg

SEQ ID NO: 318829 - DNA, 25 bp, Mus musculus
gccctggagcctaggtggcaccaaa

SEQ ID NO: 318830 - DNA, 25 bp, Mus musculus
taggtggcaccaaagcctcgtactg

SEQ ID NO: 318831 - DNA, 25 bp, Mus musculus
aagcctcgtactggtgatccctgcg

SEQ ID NO: 318832 - DNA, 25 bp, Mus musculus
tcgcttggccggatgagaagagaca

SEQ ID NO: 318833 - DNA, 25 bp, Mus musculus
acacctgcggacagtgaaccaacca

SEQ ID NO: 318834 - DNA, 25 bp, Mus musculus
ccctcactcgcttggccggatgaga

SEQ ID NO: 318835 - DNA, 25 bp, Mus musculus
cgcagcccagctgcggcttctgatg

SEQ ID NO: 318836 - DNA, 25 bp, Mus musculus
gcttctgatgtctgggctcgagccc

SEQ ID NO: 318837 - DNA, 25 bp, Mus musculus
ggggctttctcgcagacaccgaact

SEQ ID NO: 318838 - DNA, 25 bp, Mus musculus
gcagacaccgaactcgccattacta

SEQ ID NO: 318839 - DNA, 25 bp, Mus musculus
gccattactacctcttttctagctc

SEQ ID NO: 318840 - DNA, 25 bp, Mus musculus
actggtgatccctgcggccgggaac

SEQ ID NO: 318841 - DNA, 25 bp, Mus musculus
ccgcgcttgactgcctggatttcgg

SEQ ID NO: 318842 - DNA, 25 bp, Mus musculus
caccgcgcagggtcctttcgaggga

SEQ ID NO: 318843 - DNA, 25 bp, Mus musculus
ctgcctggatttcgggtgcctttgt

SEQ ID NO: 318844 - DNA, 25 bp, Mus musculus
gcttctttctagaagccctcggtcc

SEQ ID NO: 318845 - DNA, 25 bp, Mus musculus
tgtctctaacccacgcttctttcta

SEQ ID NO: 318846 - DNA, 25 bp, Mus musculus
tgaggggccgcaagtacaaatagcg

SEQ ID NO: 318847 - DNA, 25 bp, Mus musculus
tcccaccggacagggagcgtggacc

SEQ ID NO: 318848 - DNA, 25 bp, Mus musculus
ctgcggtagcagagaaacaaagttc

SEQ ID NO: 318849 - DNA, 25 bp, Mus musculus
caaagttcttcggtctcaaagtgac

SEQ ID NO: 318850 - DNA, 25 bp, Mus musculus
cggtctcaaagtgacgcaaaaattc

SEQ ID NO: 318851 - DNA, 25 bp, Mus musculus
aattcttgcggagctctttggcggc

SEQ ID NO: 318852 - DNA, 25 bp, Mus musculus
tggcggcggctatctagagatcaga

SEQ ID NO: 318853 - DNA, 25 bp, Mus musculus
agatcagaccatgtgaggggccgca

SEQ ID NO: 318854 - DNA, 25 bp, Mus musculus
tgcctttgtctgcaccgcgcagggt

SEQ ID NO: 318855 - DNA, 25 bp, Mus musculus
gggacgagcctcgtcactggagata

SEQ ID NO: 318856 - DNA, 25 bp, Mus musculus
acctaagtggctcggaattcctcgc

SEQ ID NO: 318857 - DNA, 25 bp, Mus musculus
agacgcctcggcctaaagactcagt

SEQ ID NO: 318858 - DNA, 25 bp, Mus musculus
gggatcgccatcttgttcccgtctc

SEQ ID NO: 318859 - DNA, 25 bp, Mus musculus
ctccgctggacctggtcgacgcgga

SEQ ID NO: 318860 - DNA, 25 bp, Mus musculus
acgagacgctgacgccgacgtgtat

SEQ ID NO: 318861 - DNA, 25 bp, Mus musculus
gccgacgtgtatacgcgcacttccg

SEQ ID NO: 318862 - DNA, 25 bp, Mus musculus
cggttccggtactcgcttagccgct

SEQ ID NO: 318863 - DNA, 25 bp, Mus musculus
gcttagccgctgagcctaccgctgt

SEQ ID NO: 318864 - DNA, 25 bp, Mus musculus
atgcggctcggctcagagtcttaaa

SEQ ID NO: 318865 - DNA, 25 bp, Mus musculus
ggcgatgaccaagttctagtccaga

SEQ ID NO: 318866 - DNA, 25 bp, Mus musculus
aaccgcgacgcctgctgaatccgga

SEQ ID NO: 318867 - DNA, 25 bp, Mus musculus
taccgctgtgtcttgcttaggatgc

SEQ ID NO: 318868 - DNA, 25 bp, Mus musculus
gtgttagagtcacgtccaaccgcga

SEQ ID NO: 318869 - DNA, 25 bp, Mus musculus
ccacactcaggacgagaatgccctg

SEQ ID NO: 318870 - DNA, 25 bp, Mus musculus
cggcgagcagcagcgactgccagac

SEQ ID NO: 318871 - DNA, 25 bp, Mus musculus
caggccttggcactcaggctgctgc

SEQ ID NO: 318872 - DNA, 25 bp, Mus musculus
gcggctccgctttgcctcagcgggt

SEQ ID NO: 318873 - DNA, 25 bp, Mus musculus
agcttctgtcactgcggctccgctt

SEQ ID NO: 318874 - DNA, 25 bp, Mus musculus
ggtgagtccctccaggcggcagctc

SEQ ID NO: 318875 - DNA, 25 bp, Mus musculus
ttgcgcctcggtgagtccctccagg

SEQ ID NO: 318876 - DNA, 25 bp, Mus musculus
tggtcacggtccagcggtcgcctac

SEQ ID NO: 318877 - DNA, 25 bp, Mus musculus
cctagatggctttggtcacggtcca

SEQ ID NO: 318878 - DNA, 25 bp, Mus musculus
cagcagcacctagatggctttggtc

SEQ ID NO: 318879 - DNA, 25 bp, Mus musculus
acgagaatgccctgcccggaacaac

SEQ ID NO: 318880 - DNA, 25 bp, Mus musculus
cctgcgcactgggagcgctcattgt

SEQ ID NO: 318881 - DNA, 25 bp, Mus musculus
cagcagtagggctcgagagctgacc

SEQ ID NO: 318882 - DNA, 25 bp, Mus musculus
ggaacaacccagcagcacctagatg

SEQ ID NO: 318883 - DNA, 25 bp, Mus musculus
cgactgcccagactacacagcggag

SEQ ID NO: 318884 - DNA, 25 bp, Mus musculus
cccgtaagcgttgagggatccgcgc

SEQ ID NO: 318885 - DNA, 25 bp, Mus musculus
tgtgagtccgcctctgcaaatgctc

SEQ ID NO: 318886 - DNA, 25 bp, Mus musculus
tgagtcgacttcatgaccctgagca

SEQ ID NO: 318887 - DNA, 25 bp, Mus musculus
accctgagcactttggcaggcgaaa

SEQ ID NO: 318888 - DNA, 25 bp, Mus musculus
gaaaggaaagcgctccctgccagca

SEQ ID NO: 318889 - DNA, 25 bp, Mus musculus
ctacttctctgccaatgcggtcatc

SEQ ID NO: 318890 - DNA, 25 bp, Mus musculus
gaacgccatcaaccagctgtgagtc

SEQ ID NO: 318891 - DNA, 25 bp, Mus musculus
caagcggcttttccagacattctgg

SEQ ID NO: 318892 - DNA, 25 bp, Mus musculus
tccagacattctggggcgcgaatta

SEQ ID NO: 318893 - DNA, 25 bp, Mus musculus
agggcgaaagcgcagcatgcttgct

SEQ ID NO: 318894 - DNA, 25 bp, Mus musculus
ccggtccaggatgcggagctattca

SEQ ID NO: 318895 - DNA, 25 bp, Mus musculus
agctattcagtgtgagtcgacttca

SEQ ID NO: 318896 - DNA, 25 bp, Mus musculus
gcggtcatctcgcagaacgccatca

SEQ ID NO: 318897 - DNA, 25 bp, Mus musculus
actttcgcgcgctggacagggcgta

SEQ ID NO: 318898 - DNA, 25 bp, Mus musculus
cgcccgctgggaacgactaaattag

SEQ ID NO: 318899 - DNA, 25 bp, Mus musculus
cctcaggttgatggcagcagcagct

SEQ ID NO: 318900 - DNA, 25 bp, Mus musculus
ttacagcggagttgagacgcccgcc

SEQ ID NO: 318901 - DNA, 25 bp, Mus musculus
ttccctttttacagcggagttgaga

SEQ ID NO: 318902 - DNA, 25 bp, Mus musculus
tggcagacacgaggcacgaacaccc

SEQ ID NO: 318903 - DNA, 25 bp, Mus musculus
cccgaacctgtatgcgagggacggt

SEQ ID NO: 318904 - DNA, 25 bp, Mus musculus
tgtctctctttggaccaagcgcctc

SEQ ID NO: 318905 - DNA, 25 bp, Mus musculus
cccattctccgtgtctctctttgga

SEQ ID NO: 318906 - DNA, 25 bp, Mus musculus
gatctcgcgcggtggctcccattct

SEQ ID NO: 318907 - DNA, 25 bp, Mus musculus
actaaattagctgcgcgattgcggc

SEQ ID NO: 318908 - DNA, 25 bp, Mus musculus
gcgcaggcacctgatctcgcgcggt

SEQ ID NO: 318909 - DNA, 25 bp, Mus musculus
aagcgcctcccgaacctgtatgcga

SEQ ID NO: 318910 - DNA, 25 bp, Mus musculus
cagaggagtcgcagcgtgagcaccc

SEQ ID NO: 318911 - DNA, 25 bp, Mus musculus
ccggccgcagagtcagagccataga

SEQ ID NO: 318912 - DNA, 25 bp, Mus musculus
ttgtcagtcactgtcgttcccgggg

SEQ ID NO: 318913 - DNA, 25 bp, Mus musculus
gtgacccggtggctattaagcttcc

SEQ ID NO: 318914 - DNA, 25 bp, Mus musculus
gggtctccgatctgcttgcacactt

SEQ ID NO: 318915 - DNA, 25 bp, Mus musculus
agtgctcgctgcatgtcgctatctg

SEQ ID NO: 318916 - DNA, 25 bp, Mus musculus
tctcccttagtggttaggctccggc

SEQ ID NO: 318917 - DNA, 25 bp, Mus musculus
gcggcaccagttcttgcaactttta

SEQ ID NO: 318918 - DNA, 25 bp, Mus musculus
ctcgccagcgagtacccaagtgaca

SEQ ID NO: 318919 - DNA, 25 bp, Mus musculus
tgcacatggctgagactcggaactc

SEQ ID NO: 318920 - DNA, 25 bp, Mus musculus
cgctttcagccactcgtaaactatg

SEQ ID NO: 318921 - DNA, 25 bp, Mus musculus
tactgtgggagctgtaacgctttca

SEQ ID NO: 318922 - DNA, 25 bp, Mus musculus
tccacgaaggactcagcgtactgtg

SEQ ID NO: 318923 - DNA, 25 bp, Mus musculus
cacttccaggtcatcgtagccatta

SEQ ID NO: 318924 - DNA, 25 bp, Mus musculus
ctggtctgtgcgcttgtcagtcact

SEQ ID NO: 318925 - DNA, 25 bp, Mus musculus
cactaaccctgcgagcaggagcgag

SEQ ID NO: 318926 - DNA, 25 bp, Mus musculus
accgcagacgggaagctgctcagca

SEQ ID NO: 318927 - DNA, 25 bp, Mus musculus
cttcaccgcagacgggaagctgctc

SEQ ID NO: 318928 - DNA, 25 bp, Mus musculus
gggccgtcttcaccgcagacgggaa

SEQ ID NO: 318929 - DNA, 25 bp, Mus musculus
cgggccgtcttcaccgcagacggga

SEQ ID NO: 318930 - DNA, 25 bp, Mus musculus
gcgcccgcccactgcgggccgtctt

SEQ ID NO: 318931 - DNA, 25 bp, Mus musculus
agcgagcccggcctcacgagggcgc

SEQ ID NO: 318932 - DNA, 25 bp, Mus musculus
ctaaccctgcgagcaggagcgagcc

SEQ ID NO: 318933 - DNA, 25 bp, Mus musculus
aacccactaaccctgcgagcaggag

SEQ ID NO: 318934 - DNA, 25 bp, Mus musculus
ggtgggcgggcactctaacccacta

SEQ ID NO: 318935 - DNA, 25 bp, Mus musculus
caccgcagacgggaagctgctcagc

SEQ ID NO: 318936 - DNA, 25 bp, Mus musculus
tgggcgggcactctaacccactaac

SEQ ID NO: 318937 - DNA, 25 bp, Mus musculus
aaccctgcgagcaggagcgagcccg

SEQ ID NO: 318938 - DNA, 25 bp, Mus musculus
gtcttcaccgcagacgggaagctgc

SEQ ID NO: 318939 - DNA, 25 bp, Mus musculus
gacaggtaaccttgtgcggcagacg

SEQ ID NO: 318940 - DNA, 25 bp, Mus musculus
acgccctgaatgtaccaggttctta

SEQ ID NO: 318941 - DNA, 25 bp, Mus musculus
caggttcttaacaagcttcggaagc

SEQ ID NO: 318942 - DNA, 25 bp, Mus musculus
gcgtctcccgtgtaactgctaatga

SEQ ID NO: 318943 - DNA, 25 bp, Mus musculus
ctggctttggccagatgcaaagttc

SEQ ID NO: 318944 - DNA, 25 bp, Mus musculus
caaagttctgcattggcgcgaagcc

SEQ ID NO: 318945 - DNA, 25 bp, Mus musculus
ccgagcgagcgactgaaacccaatt

SEQ ID NO: 318946 - DNA, 25 bp, Mus musculus
aggcctatgcgtccttgcttccgga

SEQ ID NO: 318947 - DNA, 25 bp, Mus musculus
cgagacctgacggacagacgttata

SEQ ID NO: 318948 - DNA, 25 bp, Mus musculus
ccacctgccggtatgaggtaaacca

SEQ ID NO: 318949 - DNA, 25 bp, Mus musculus
tgtcggccaaggtgacactggtttc

SEQ ID NO: 318950 - DNA, 25 bp, Mus musculus
gcttcaattatcagacggcatccca

SEQ ID NO: 318951 - DNA, 25 bp, Mus musculus
gggcctcaaagtcgcagcgctcctg

SEQ ID NO: 318952 - DNA, 25 bp, Mus musculus
ttcggcccgccaaacgcttcaatta

SEQ ID NO: 318953 - DNA, 25 bp, Mus musculus
gcagggtatgcccattccgacaggg

SEQ ID NO: 318954 - DNA, 25 bp, Mus musculus
agacgccctgcacccgcagggtatg

SEQ ID NO: 318955 - DNA, 25 bp, Mus musculus
cgacagggctgaaggttgctgccac

SEQ ID NO: 318956 - DNA, 25 bp, Mus musculus
ggtatgcccattccgacagggctga

SEQ ID NO: 318957 - DNA, 25 bp, Mus musculus
cccattccgacagggctgaaggttg

SEQ ID NO: 318958 - DNA, 25 bp, Mus musculus
attccgacagggctgaaggttgctg

SEQ ID NO: 318959 - DNA, 25 bp, Mus musculus
agggctgaaggttgctgccacctca

SEQ ID NO: 318960 - DNA, 25 bp, Mus musculus
gctgccacctcacacccaacactgc

SEQ ID NO: 318961 - DNA, 25 bp, Mus musculus
caacactgcccagttttgctgcgtc

SEQ ID NO: 318962 - DNA, 25 bp, Mus musculus
gcccagttttgctgcgtcgcctgaa

SEQ ID NO: 318963 - DNA, 25 bp, Mus musculus
cagttttgctgcgtcgcctgaagga

SEQ ID NO: 318964 - DNA, 25 bp, Mus musculus
tgcgtcgcctgaaggagctcgcgct

SEQ ID NO: 318965 - DNA, 25 bp, Mus musculus
taacacagttggaggcttgggatgt

SEQ ID NO: 318966 - DNA, 25 bp, Mus musculus
ggctgaaggttgctgccacctcaca

SEQ ID NO: 318967 - DNA, 25 bp, Mus musculus
caatgcgatggctccagactccagc

SEQ ID NO: 318968 - DNA, 25 bp, Mus musculus
gactccagcagccgctcggcaggtg

SEQ ID NO: 318969 - DNA, 25 bp, Mus musculus
tgctacacccgcaatgcgatggctc

SEQ ID NO: 318970 - DNA, 25 bp, Mus musculus
cagcaggaggcgctactgttcggtc

SEQ ID NO: 318971 - DNA, 25 bp, Mus musculus
aggcgctactgttcggtcagcgaga

SEQ ID NO: 318972 - DNA, 25 bp, Mus musculus
acccgcaatgcgatggctccagact

SEQ ID NO: 318973 - DNA, 25 bp, Mus musculus
ttcggtcagcgagagccgcaggatc

SEQ ID NO: 318974 - DNA, 25 bp, Mus musculus
tgcgatggctccagactccagcagc

SEQ ID NO: 318975 - DNA, 25 bp, Mus musculus
gagagccgcaggatccgctccaact

SEQ ID NO: 318976 - DNA, 25 bp, Mus musculus
tgctcctgagcggacaactccatag

SEQ ID NO: 318977 - DNA, 25 bp, Mus musculus
tgagcggacaactccatagccagcc

SEQ ID NO: 318978 - DNA, 25 bp, Mus musculus
agccgcagctgctcgtcgtagctcc

SEQ ID NO: 318979 - DNA, 25 bp, Mus musculus
tactgttcggtcagcgagagccgca

SEQ ID NO: 318980 - DNA, 25 bp, Mus musculus
cgcagacccgggtcctgcgtggagt

SEQ ID NO: 318981 - DNA, 25 bp, Mus musculus
cgccgtgctgggttagttacagctt

SEQ ID NO: 318982 - DNA, 25 bp, Mus musculus
acaaagacgcctctcggcggaggga

SEQ ID NO: 318983 - DNA, 25 bp, Mus musculus
cgacggcgctcctacctggccggcg

SEQ ID NO: 318984 - DNA, 25 bp, Mus musculus
tgctgggttagttacagcttggccc

SEQ ID NO: 318985 - DNA, 25 bp, Mus musculus
cccgcagcatcatggggcttgtagt

SEQ ID NO: 318986 - DNA, 25 bp, Mus musculus
agcatcatggggcttgtagtccgcc

SEQ ID NO: 318987 - DNA, 25 bp, Mus musculus
cttgtagtccgcctggtagaaccgt

SEQ ID NO: 318988 - DNA, 25 bp, Mus musculus
ttggcggggatcatcgcccgctcct

SEQ ID NO: 318989 - DNA, 25 bp, Mus musculus
tgcagcgggtacttgccctcgggcc

SEQ ID NO: 318990 - DNA, 25 bp, Mus musculus
ccacacgaggtagtgcagcgggtac

SEQ ID NO: 318991 - DNA, 25 bp, Mus musculus
cggttgtgccacacgaggtagtgca

SEQ ID NO: 318992 - DNA, 25 bp, Mus musculus
ccagctcccggtggcggttgtgcca

SEQ ID NO: 318993 - DNA, 25 bp, Mus musculus
tccgcctggtagaaccgtgcgtttc

SEQ ID NO: 318994 - DNA, 25 bp, Mus musculus
atcgcccgctcctcatgccggggcc

SEQ ID NO: 318995 - DNA, 25 bp, Mus musculus
cagctgcctcgacatttaataaatg

SEQ ID NO: 318996 - DNA, 25 bp, Mus musculus
cgcccacacagcgaagaaacaaagg

SEQ ID NO: 318997 - DNA, 25 bp, Mus musculus
ccagcagctgcctcgacatttaata

SEQ ID NO: 318998 - DNA, 25 bp, Mus musculus
ccaagcgacggggctgccagcagct

SEQ ID NO: 318999 - DNA, 25 bp, Mus musculus
aacaaaggcagccaagcgacggggc

SEQ ID NO: 319000 - DNA, 25 bp, Mus musculus
cagacgcgcccacacagcgaagaaa

SEQ ID NO: 319001 - DNA, 25 bp, Mus musculus
ggctgccacgtgctccagacgcgcc

SEQ ID NO: 319002 - DNA, 25 bp, Mus musculus
ggtctcaacgccctggctgccacgt

SEQ ID NO: 319003 - DNA, 25 bp, Mus musculus
gtcgctttccctttggtctcaacgc

SEQ ID NO: 319004 - DNA, 25 bp, Mus musculus
cgaagcccaggtcgctttccctttg

SEQ ID NO: 319005 - DNA, 25 bp, Mus musculus
aacgggcggccactgctcctgggct

SEQ ID NO: 319006 - DNA, 25 bp, Mus musculus
aattccatagctgggggtcgatccg

SEQ ID NO: 319007 - DNA, 25 bp, Mus musculus
ccaggtcgctttccctttggtctca

SEQ ID NO: 319008 - DNA, 25 bp, Mus musculus
aataaatgaaattccatagctgggg

SEQ ID NO: 319009 - DNA, 25 bp, Mus musculus
cgtgtgtctcggttgcagaccaggc

SEQ ID NO: 319010 - DNA, 25 bp, Mus musculus
aagtgctagcgtgtgtctcggttgc

SEQ ID NO: 319011 - DNA, 25 bp, Mus musculus
tgcttcctgcaggagcggcctgggc

SEQ ID NO: 319012 - DNA, 25 bp, Mus musculus
tggaccactccccaatcggaaagtg

SEQ ID NO: 319013 - DNA, 25 bp, Mus musculus
caatcggaaagtgaaggtcaaagtg

SEQ ID NO: 319014 - DNA, 25 bp, Mus musculus
tcggaaagtgaaggtcaaagtgcta

SEQ ID NO: 319015 - DNA, 25 bp, Mus musculus
agtgaaggtcaaagtgctagcgtgt

SEQ ID NO: 319016 - DNA, 25 bp, Mus musculus
cagggctttcactgcttcctgcagg

SEQ ID NO: 319017 - DNA, 25 bp, Mus musculus
agaggctcagccacggagctgagcg

SEQ ID NO: 319018 - DNA, 25 bp, Mus musculus
ggcttcctttctccgagaggctcag

SEQ ID NO: 319019 - DNA, 25 bp, Mus musculus
gcaggcttcctttctccgagaggct

SEQ ID NO: 319020 - DNA, 25 bp, Mus musculus
gcgcaggcttcctttctccgagagg

SEQ ID NO: 319021 - DNA, 25 bp, Mus musculus
tccactcccgcctgcgcgcaggctt

SEQ ID NO: 319022 - DNA, 25 bp, Mus musculus
ctagcgtgtgtctcggttgcagacc

SEQ ID NO: 319023 - DNA, 25 bp, Mus musculus
catcgcggcatccagacggaagcgc

SEQ ID NO: 319024 - DNA, 25 bp, Mus musculus
ctccatcgcggcatccagacggaag

SEQ ID NO: 319025 - DNA, 25 bp, Mus musculus
tccatcgcggcatccagacggaagc

SEQ ID NO: 319026 - DNA, 25 bp, Mus musculus
tgctgctcacatggcccgcgtgccc

SEQ ID NO: 319027 - DNA, 25 bp, Mus musculus
tcgcggcatccagacggaagcgcca

SEQ ID NO: 319028 - DNA, 25 bp, Mus musculus
gcggcatccagacggaagcgccagc

SEQ ID NO: 319029 - DNA, 25 bp, Mus musculus
ccagacggaagcgccagcctggtgt

SEQ ID NO: 319030 - DNA, 25 bp, Mus musculus
ggcgctaggatggtttgtgtcatcc

SEQ ID NO: 319031 - DNA, 25 bp, Mus musculus
cgctaggatggtttgtgtcatccct

SEQ ID NO: 319032 - DNA, 25 bp, Mus musculus
ctaggatggtttgtgtcatccctgc

SEQ ID NO: 319033 - DNA, 25 bp, Mus musculus
aggatggtttgtgtcatccctgcca

SEQ ID NO: 319034 - DNA, 25 bp, Mus musculus
gatggtttgtgtcatccctgccacc

SEQ ID NO: 319035 - DNA, 25 bp, Mus musculus
cccgcgtcttgcacctgctgctcac

SEQ ID NO: 319036 - DNA, 25 bp, Mus musculus
aagcgccagcctggtgtggcaggag

SEQ ID NO: 319037 - DNA, 25 bp, Mus musculus
gccaaggatctcctggtctccaagc

SEQ ID NO: 319038 - DNA, 25 bp, Mus musculus
cggccctacagggttcctacctgtg

SEQ ID NO: 319039 - DNA, 25 bp, Mus musculus
cctacctgtggaggcacaggccaca

SEQ ID NO: 319040 - DNA, 25 bp, Mus musculus
cacaggccttcaggacaaggggttc

SEQ ID NO: 319041 - DNA, 25 bp, Mus musculus
accacctgtgggtccaaggcgaaga

SEQ ID NO: 319042 - DNA, 25 bp, Mus musculus
cgccctttcggttctaggagtagag

SEQ ID NO: 319043 - DNA, 25 bp, Mus musculus
gcgcgccactctttccaggacaaag

SEQ ID NO: 319044 - DNA, 25 bp, Mus musculus
ttacctcgcgaaggctcaggagccc

SEQ ID NO: 319045 - DNA, 25 bp, Mus musculus
cagggctaccagaagcaaccggggc

SEQ ID NO: 319046 - DNA, 25 bp, Mus musculus
tcccggagcgtttgtgcgaccatca

SEQ ID NO: 319047 - DNA, 25 bp, Mus musculus
cggaaaagttagtcgccaaggatct

SEQ ID NO: 319048 - DNA, 25 bp, Mus musculus
gcgaccatcagagcgcaactgtatc

SEQ ID NO: 319049 - DNA, 25 bp, Mus musculus
gcagcgaggccgttcaaacccttct

SEQ ID NO: 319050 - DNA, 25 bp, Mus musculus
atgaaccatttcagctgggccagca

SEQ ID NO: 319051 - DNA, 25 bp, Mus musculus
gtcataggaccttgtgccaggggcc

SEQ ID NO: 319052 - DNA, 25 bp, Mus musculus
ggggacgcctcactcgcaatgtact

SEQ ID NO: 319053 - DNA, 25 bp, Mus musculus
tggctctggattgggtcataggacc

SEQ ID NO: 319054 - DNA, 25 bp, Mus musculus
agcccgtgagtacctgcagctggca

SEQ ID NO: 319055 - DNA, 25 bp, Mus musculus
tgcagcctcatttgcaagccgtcgg

SEQ ID NO: 319056 - DNA, 25 bp, Mus musculus
gagcgcgaacctcagtccgggacca

SEQ ID NO: 319057 - DNA, 25 bp, Mus musculus
ctgcttgggaggactcttgacagcc

SEQ ID NO: 319058 - DNA, 25 bp, Mus musculus
ggagctcgacccgaactggctgtct

SEQ ID NO: 319059 - DNA, 25 bp, Mus musculus
tgtcgcaatcgctgtacaaagggct

SEQ ID NO: 319060 - DNA, 25 bp, Mus musculus
gagcctccctccagtgctgttggta

SEQ ID NO: 319061 - DNA, 25 bp, Mus musculus
ctcaaggaggcggtgacttacattc

SEQ ID NO: 319062 - DNA, 25 bp, Mus musculus
cagactacagcctttcggggacccg

SEQ ID NO: 319063 - DNA, 25 bp, Mus musculus
agcgcggctactacccggtcatctt

SEQ ID NO: 319064 - DNA, 25 bp, Mus musculus
tcgcaatgtactggggctctgcctg

SEQ ID NO: 319065 - DNA, 25 bp, Mus musculus
cgcgtgcttcagtgaatctcggatg

SEQ ID NO: 319066 - DNA, 25 bp, Mus musculus
taaaccacgtttgtcgcccagagca

SEQ ID NO: 319067 - DNA, 25 bp, Mus musculus
cattctgcgctcgatgtgtctggtc

SEQ ID NO: 319068 - DNA, 25 bp, Mus musculus
cgcctggcagagaggcatcgccatt

SEQ ID NO: 319069 - DNA, 25 bp, Mus musculus
ctttgctggcttctgatggagacgc

SEQ ID NO: 319070 - DNA, 25 bp, Mus musculus
cgttcgggaaggacagctactgccc

SEQ ID NO: 319071 - DNA, 25 bp, Mus musculus
agttcgactcatcgcgcctggaatg

SEQ ID NO: 319072 - DNA, 25 bp, Mus musculus
acgcctggcacggattgctgagaaa

SEQ ID NO: 319073 - DNA, 25 bp, Mus musculus
gtaatctgtcatcgtggcccgcgtt

SEQ ID NO: 319074 - DNA, 25 bp, Mus musculus
ttgcgttgttcctcgccgtaatctg

SEQ ID NO: 319075 - DNA, 25 bp, Mus musculus
ggactccagagcctccaactcgttg

SEQ ID NO: 319076 - DNA, 25 bp, Mus musculus
aggccgccaaagtcacctgtgaagg

SEQ ID NO: 319077 - DNA, 25 bp, Mus musculus
gagccacccggaccttcggatttca

SEQ ID NO: 319078 - DNA, 25 bp, Mus musculus
ggaccaattccagggcctccgcaga

SEQ ID NO: 319079 - DNA, 25 bp, Mus musculus
gaggcttcaccgtcagcggcacgaa

SEQ ID NO: 319080 - DNA, 25 bp, Mus musculus
atgcgcggaagggaaccgtacaagc

SEQ ID NO: 319081 - DNA, 25 bp, Mus musculus
ctcactctttctgcggcaattggca

SEQ ID NO: 319082 - DNA, 25 bp, Mus musculus
tggcagaaacgagctcccatcctct

SEQ ID NO: 319083 - DNA, 25 bp, Mus musculus
gtgggagcacgacctctgtacgtta

SEQ ID NO: 319084 - DNA, 25 bp, Mus musculus
cccgcgtgcgcctgaaggaaaagga

SEQ ID NO: 319085 - DNA, 25 bp, Mus musculus
cggagcgaaaggacccagagagaca

SEQ ID NO: 319086 - DNA, 25 bp, Mus musculus
ggaaaatccggaccactggcgccgc

SEQ ID NO: 319087 - DNA, 25 bp, Mus musculus
tacaccgaggcaaggacattgaggc

SEQ ID NO: 319088 - DNA, 25 bp, Mus musculus
gagccgagcccacagcaaggtacac

SEQ ID NO: 319089 - DNA, 25 bp, Mus musculus
ggccaagcagggaacgcgtcctgaa

SEQ ID NO: 319090 - DNA, 25 bp, Mus musculus
gcaattggcagcgtctttctcgaaa

SEQ ID NO: 319091 - DNA, 25 bp, Mus musculus
cagcggcacgaacaaggacgtgttc

SEQ ID NO: 319092 - DNA, 25 bp, Mus musculus
ctttggagccaccagaggcagagga

SEQ ID NO: 319093 - DNA, 25 bp, Mus musculus
atacttaaagctgggcggagtggcc

SEQ ID NO: 319094 - DNA, 25 bp, Mus musculus
gtgcgtgctagtcagtcccggaaat

SEQ ID NO: 319095 - DNA, 25 bp, Mus musculus
aggaggcgcccttaacgctccggct

SEQ ID NO: 319096 - DNA, 25 bp, Mus musculus
aacgctccggctcagttaagatggc

SEQ ID NO: 319097 - DNA, 25 bp, Mus musculus
gaggttcgcgactgctccgcgctct

SEQ ID NO: 319098 - DNA, 25 bp, Mus musculus
ctctcagcccgcgaagggcgcaagg

SEQ ID NO: 319099 - DNA, 25 bp, Mus musculus
ttccaagccctgaagccacagagct

SEQ ID NO: 319100 - DNA, 25 bp, Mus musculus
cgacagacatctcagcctcagatct

SEQ ID NO: 319101 - DNA, 25 bp, Mus musculus
tcgcgagagttcttgcctgacaggc

SEQ ID NO: 319102 - DNA, 25 bp, Mus musculus
tcgggagtgcgcgaatacttaaagc

SEQ ID NO: 319103 - DNA, 25 bp, Mus musculus
agtgctaggcttggtccagtcccac

SEQ ID NO: 319104 - DNA, 25 bp, Mus musculus
tcgccttcgctacgcgggcgtcagg

SEQ ID NO: 319105 - DNA, 25 bp, Mus musculus
ccagcccaggctctacgacaagggg

SEQ ID NO: 319106 - DNA, 25 bp, Mus musculus
cgaccctgcgcgagacaggacagta

SEQ ID NO: 319107 - DNA, 25 bp, Mus musculus
gccgcttcctgtccgccatgttgga

SEQ ID NO: 319108 - DNA, 25 bp, Mus musculus
ttctctgccacaggaatctcatctc

SEQ ID NO: 319109 - DNA, 25 bp, Mus musculus
ggtcacgagtttctctgccacagga

SEQ ID NO: 319110 - DNA, 25 bp, Mus musculus
ccaagctcccgggtcacgagtttct

SEQ ID NO: 319111 - DNA, 25 bp, Mus musculus
cagcgggaaccaagctcccgggtca

SEQ ID NO: 319112 - DNA, 25 bp, Mus musculus
cgtggccgtagcgttccgctggcct

SEQ ID NO: 319113 - DNA, 25 bp, Mus musculus
gtccgccatgttggaagctgattcc

SEQ ID NO: 319114 - DNA, 25 bp, Mus musculus
tggaatgttctctcctcctcgcggg

SEQ ID NO: 319115 - DNA, 25 bp, Mus musculus
gtctgtccgcgagggcttctccgca

SEQ ID NO: 319116 - DNA, 25 bp, Mus musculus
taaacgcccgtcttgcgcgtccgga

SEQ ID NO: 319117 - DNA, 25 bp, Mus musculus
ggaatctcatctcctgccaggttcg

SEQ ID NO: 319118 - DNA, 25 bp, Mus musculus
cgagcccacctgtggccttggggtt

SEQ ID NO: 319119 - DNA, 25 bp, Mus musculus
ctaagttgaggaagcgtcctcgctc

SEQ ID NO: 319120 - DNA, 25 bp, Mus musculus
agctgattcctgtcaccgactccgg

SEQ ID NO: 319121 - DNA, 25 bp, Mus musculus
tgctcaccatctgggcgatttgggg

SEQ ID NO: 319122 - DNA, 25 bp, Mus musculus
gcgccgtgctatccgactctctcac

SEQ ID NO: 319123 - DNA, 25 bp, Mus musculus
acgtgctcaccatctgggcgatttg

SEQ ID NO: 319124 - DNA, 25 bp, Mus musculus
ttactggccggacaaggagccgcgc

SEQ ID NO: 319125 - DNA, 25 bp, Mus musculus
ccctaggctgaggacgctgacctgt

SEQ ID NO: 319126 - DNA, 25 bp, Mus musculus
acttacgtgctcaccatctgggcga

SEQ ID NO: 319127 - DNA, 25 bp, Mus musculus
ctgagcctttgttggggttggccca

SEQ ID NO: 319128 - DNA, 25 bp, Mus musculus
cagcctgtcgttccagctctggagc

SEQ ID NO: 319129 - DNA, 25 bp, Mus musculus
gggttcccacttacgtgctcaccat

SEQ ID NO: 319130 - DNA, 25 bp, Mus musculus
tggagcggggcaggttcaccttcac

SEQ ID NO: 319131 - DNA, 25 bp, Mus musculus
ggcaggttcaccttcacggagcacc

SEQ ID NO: 319132 - DNA, 25 bp, Mus musculus
cctccgctgagcctttgttggggtt

SEQ ID NO: 319133 - DNA, 25 bp, Mus musculus
ctgggcccggctctaccgcccacct

SEQ ID NO: 319134 - DNA, 25 bp, Mus musculus
ggacgctgacctgtcagtccctggc

SEQ ID NO: 319135 - DNA, 25 bp, Mus musculus
tggatgccgcgtctccgctcctgct

SEQ ID NO: 319136 - DNA, 25 bp, Mus musculus
gcggctagcgcggacaaaatctcca

SEQ ID NO: 319137 - DNA, 25 bp, Mus musculus
gcgcggacaaaatctccaggcatgg

SEQ ID NO: 319138 - DNA, 25 bp, Mus musculus
ggacaaaatctccaggcatggcctc

SEQ ID NO: 319139 - DNA, 25 bp, Mus musculus
atctccaggcatggcctctgggaca

SEQ ID NO: 319140 - DNA, 25 bp, Mus musculus
caggcatggcctctgggacatggcc

SEQ ID NO: 319141 - DNA, 25 bp, Mus musculus
gggtccttggagtccatcgcggaca

SEQ ID NO: 319142 - DNA, 25 bp, Mus musculus
cttggagtccatcgcggacagtgtt

SEQ ID NO: 319143 - DNA, 25 bp, Mus musculus
tccatcgcggacagtgtttgggcag

SEQ ID NO: 319144 - DNA, 25 bp, Mus musculus
ggctccagcttggcccaaggctggc

SEQ ID NO: 319145 - DNA, 25 bp, Mus musculus
tggcatcagaccggccggcgtctat

SEQ ID NO: 319146 - DNA, 25 bp, Mus musculus
cgtctatgccgccagccgccagcag

SEQ ID NO: 319147 - DNA, 25 bp, Mus musculus
ggcagccttcggttcgctcggctcg

SEQ ID NO: 319148 - DNA, 25 bp, Mus musculus
tctccagcggctagcgcggacaaaa

SEQ ID NO: 319149 - DNA, 25 bp, Mus musculus
cccagataagctccgtgtgacctga

SEQ ID NO: 319150 - DNA, 25 bp, Mus musculus
ctccgtgtgacctgacagtgagtca

SEQ ID NO: 319151 - DNA, 25 bp, Mus musculus
tcacgcggcgctgcggagctcagca

SEQ ID NO: 319152 - DNA, 25 bp, Mus musculus
agctcagcagaaccgacgggcgcgg

SEQ ID NO: 319153 - DNA, 25 bp, Mus musculus
ggccggctggcgaggaaacacagag

SEQ ID NO: 319154 - DNA, 25 bp, Mus musculus
aaacacagagggccgcggggctact

SEQ ID NO: 319155 - DNA, 25 bp, Mus musculus
cgagccggctgatgtcatgtgagaa

SEQ ID NO: 319156 - DNA, 25 bp, Mus musculus
gctgatgtcatgtgagaagcctgca

SEQ ID NO: 319157 - DNA, 25 bp, Mus musculus
gtcatgtgagaagcctgcacacctg

SEQ ID NO: 319158 - DNA, 25 bp, Mus musculus
tgagaagcctgcacacctggagccc

SEQ ID NO: 319159 - DNA, 25 bp, Mus musculus
gcctgcacacctggagcccagataa

SEQ ID NO: 319160 - DNA, 25 bp, Mus musculus
ctggagcccagataagctccgtgtg

SEQ ID NO: 319161 - DNA, 25 bp, Mus musculus
acctgacagtgagtcacgcggcgct

SEQ ID NO: 319162 - DNA, 25 bp, Mus musculus
taagctccgtgtgacctgacagtga

SEQ ID NO: 319163 - DNA, 25 bp, Mus musculus
tcgctccactccaggcgtctagggg

SEQ ID NO: 319164 - DNA, 25 bp, Mus musculus
gggtccctcgtatcctcactgcaga

SEQ ID NO: 319165 - DNA, 25 bp, Mus musculus
tttgccgcttattctgggtccctcg

SEQ ID NO: 319166 - DNA, 25 bp, Mus musculus
aaacttcgctcgactttgccgctta

SEQ ID NO: 319167 - DNA, 25 bp, Mus musculus
cgtggtgctgattctgtcaggcgct

SEQ ID NO: 319168 - DNA, 25 bp, Mus musculus
tgcagagtccggacagcccagctac

SEQ ID NO: 319169 - DNA, 25 bp, Mus musculus
gggatttctctgctgcaattcatca

SEQ ID NO: 319170 - DNA, 25 bp, Mus musculus
cccggatctaatgggatttctctgc

SEQ ID NO: 319171 - DNA, 25 bp, Mus musculus
cggccgagacctcgcctttaatcat

SEQ ID NO: 319172 - DNA, 25 bp, Mus musculus
taggaaagcaagaccatcccggcgc

SEQ ID NO: 319173 - DNA, 25 bp, Mus musculus
gctcctggctcacggtaagggaccc

SEQ ID NO: 319174 - DNA, 25 bp, Mus musculus
tcccaggggtaggaaagcaagacca

SEQ ID NO: 319175 - DNA, 25 bp, Mus musculus
gctggtctccaaacttcgctcgact

SEQ ID NO: 319176 - DNA, 25 bp, Mus musculus
tgcgtcctgttgttcctcccaagca

SEQ ID NO: 319177 - DNA, 25 bp, Mus musculus
agggtggcgacccaacacgcctgcg

SEQ ID NO: 319178 - DNA, 25 bp, Mus musculus
aatggagaccaagacgatcgtgtac

SEQ ID NO: 319179 - DNA, 25 bp, Mus musculus
atgaatgtgggagaaaatggagacc

SEQ ID NO: 319180 - DNA, 25 bp, Mus musculus
cccagcccgagaggtggatgaatgt

SEQ ID NO: 319181 - DNA, 25 bp, Mus musculus
atccactgtgcagccagccgctggg

SEQ ID NO: 319182 - DNA, 25 bp, Mus musculus
agctttagcctgtgggcctaggccc

SEQ ID NO: 319183 - DNA, 25 bp, Mus musculus
gtcgccagcgccagctttagcctgt

SEQ ID NO: 319184 - DNA, 25 bp, Mus musculus
ctcgcggtaagtttgcgccaagtgc

SEQ ID NO: 319185 - DNA, 25 bp, Mus musculus
taagcgaggcctcaggttccgccct

SEQ ID NO: 319186 - DNA, 25 bp, Mus musculus
tttcccaggcgcctaagcgaggcct

SEQ ID NO: 319187 - DNA, 25 bp, Mus musculus
aatgggtgatgcgtcttccagttcc

SEQ ID NO: 319188 - DNA, 25 bp, Mus musculus
gtccgcacacaaacaccaatgggtg

SEQ ID NO: 319189 - DNA, 25 bp, Mus musculus
cgatcgtgtacgacttggacacgtc

SEQ ID NO: 319190 - DNA, 25 bp, Mus musculus
agagcccgtggtccgcacacaaaca

SEQ ID NO: 319191 - DNA, 25 bp, Mus musculus
tctgcgcccttggtatttgccggga

SEQ ID NO: 319192 - DNA, 25 bp, Mus musculus
gtgtgtgcagcaaatccaagctctg

SEQ ID NO: 319193 - DNA, 25 bp, Mus musculus
cccaagacggacgaggcagaaaagc

SEQ ID NO: 319194 - DNA, 25 bp, Mus musculus
cagaaaagcggagtcggaagcccga

SEQ ID NO: 319195 - DNA, 25 bp, Mus musculus
acgacagctgcgatagctgcaagga

SEQ ID NO: 319196 - DNA, 25 bp, Mus musculus
ggatctcttgtgctgcgatcactgc

SEQ ID NO: 319197 - DNA, 25 bp, Mus musculus
ccacctccagtgctggtaagggctg

SEQ ID NO: 319198 - DNA, 25 bp, Mus musculus
ttggcagaccctactcagcacattc

SEQ ID NO: 319199 - DNA, 25 bp, Mus musculus
tacccgggagctccgaatgtgcaca

SEQ ID NO: 319200 - DNA, 25 bp, Mus musculus
ttgcagccgctagccgactctctag

SEQ ID NO: 319201 - DNA, 25 bp, Mus musculus
aatgtgcacacatgccgtctgtatg

SEQ ID NO: 319202 - DNA, 25 bp, Mus musculus
cgactctctagtcgctggggcgagc

SEQ ID NO: 319203 - DNA, 25 bp, Mus musculus
ttcaccaggcctgtagaaataacgg

SEQ ID NO: 319204 - DNA, 25 bp, Mus musculus
atttgccgggatccggccaatttgc

SEQ ID NO: 319205 - DNA, 25 bp, Mus musculus
caggcgccaatagcggcatcggaaa

SEQ ID NO: 319206 - DNA, 25 bp, Mus musculus
tctcagggccctaggcatgcacaca

SEQ ID NO: 319207 - DNA, 25 bp, Mus musculus
tcaggcagatgtttccgggtactta

SEQ ID NO: 319208 - DNA, 25 bp, Mus musculus
ttcccgggagttcgcaagcctagag

SEQ ID NO: 319209 - DNA, 25 bp, Mus musculus
ctagagggcgctcccaggactccaa

SEQ ID NO: 319210 - DNA, 25 bp, Mus musculus
ccaaggtgtttctcctaggcacgcc

SEQ ID NO: 319211 - DNA, 25 bp, Mus musculus
ctccgtcaggtgagaccatagggga

SEQ ID NO: 319212 - DNA, 25 bp, Mus musculus
ggcgcctacgtgcttgtctactaca

SEQ ID NO: 319213 - DNA, 25 bp, Mus musculus
atcggaaagatgacagcgctggagc

SEQ ID NO: 319214 - DNA, 25 bp, Mus musculus
gccgctttcgacctccgtcaggtga

SEQ ID NO: 319215 - DNA, 25 bp, Mus musculus
cgcccaaagcctgagcggagatctc

SEQ ID NO: 319216 - DNA, 25 bp, Mus musculus
cagaatccagaagcacgcccaaagc

SEQ ID NO: 319217 - DNA, 25 bp, Mus musculus
gatgggcacagacacctacgcagtg

SEQ ID NO: 319218 - DNA, 25 bp, Mus musculus
gcactgccggcatggagatgctgct

SEQ ID NO: 319219 - DNA, 25 bp, Mus musculus
gtgcgggtccctcggacgcacctga

SEQ ID NO: 319220 - DNA, 25 bp, Mus musculus
ctgcggacccgccacagccctcccg

SEQ ID NO: 319221 - DNA, 25 bp, Mus musculus
tccctcccacagcacggcctcaggc

SEQ ID NO: 319222 - DNA, 25 bp, Mus musculus
ccagccctccggagagcggtcctcc

SEQ ID NO: 319223 - DNA, 25 bp, Mus musculus
ctcggacgcacctgagccagccctc

SEQ ID NO: 319224 - DNA, 25 bp, Mus musculus
acagccctcccggtcgctgcggacc

SEQ ID NO: 319225 - DNA, 25 bp, Mus musculus
gtggtctcaggtgaggagaaggcga

SEQ ID NO: 319226 - DNA, 25 bp, Mus musculus
cccaacgaggcgctggtggtctcag

SEQ ID NO: 319227 - DNA, 25 bp, Mus musculus
cgccatgggcaactgccacacggtg

SEQ ID NO: 319228 - DNA, 25 bp, Mus musculus
ggcgccatgggcaactgccacacgg

SEQ ID NO: 319229 - DNA, 25 bp, Mus musculus
tgccaacggcgccatgggcaactgc

SEQ ID NO: 319230 - DNA, 25 bp, Mus musculus
tcgctgcggacccaaggcctgctgg

SEQ ID NO: 319231 - DNA, 25 bp, Mus musculus
ggtcgctgcggacccaaggcctgct

SEQ ID NO: 319232 - DNA, 25 bp, Mus musculus
ctgagccagccctccggagagcggt

SEQ ID NO: 319233 - DNA, 25 bp, Mus musculus
ggcttgctgcagttccgacctttgc

SEQ ID NO: 319234 - DNA, 25 bp, Mus musculus
ggcagtactctcaaatcggttccgc

SEQ ID NO: 319235 - DNA, 25 bp, Mus musculus
cttccaagccggagaggcagtactc

SEQ ID NO: 319236 - DNA, 25 bp, Mus musculus
tagctcgtgacgcagccttccaagc

SEQ ID NO: 319237 - DNA, 25 bp, Mus musculus
tcctttgcagtccacggatagctcg

SEQ ID NO: 319238 - DNA, 25 bp, Mus musculus
cgacctttgcgcctgatctgtttcc

SEQ ID NO: 319239 - DNA, 25 bp, Mus musculus
acgagccgtgcgctgtcaaactcct

SEQ ID NO: 319240 - DNA, 25 bp, Mus musculus
agtccagcaaccctagagctagttg

SEQ ID NO: 319241 - DNA, 25 bp, Mus musculus
tgggaggagtcaaagatctgtcttc

SEQ ID NO: 319242 - DNA, 25 bp, Mus musculus
cgtcacgtgaccgtaggccatcagc

SEQ ID NO: 319243 - DNA, 25 bp, Mus musculus
tccactcggctttccctcagaagaa

SEQ ID NO: 319244 - DNA, 25 bp, Mus musculus
actgactgtcctcggctaccttgga

SEQ ID NO: 319245 - DNA, 25 bp, Mus musculus
agcaggtctcgccagagtccggaac

SEQ ID NO: 319246 - DNA, 25 bp, Mus musculus
cccgagaattgttggcctccgaaga

SEQ ID NO: 319247 - DNA, 25 bp, Mus musculus
cgacgcgattggaccgagaagccca

SEQ ID NO: 319248 - DNA, 25 bp, Mus musculus
cattttgccgcaatgcaccctggta

SEQ ID NO: 319249 - DNA, 25 bp, Mus musculus
ggacgctcggaaccaacgaactgtc

SEQ ID NO: 319250 - DNA, 25 bp, Mus musculus
cggaaccaacgaactgtcaggctga

SEQ ID NO: 319251 - DNA, 25 bp, Mus musculus
gtcaggctgagaaaatccaaggata

SEQ ID NO: 319252 - DNA, 25 bp, Mus musculus
caaggatacggtccaaggcggagtc

SEQ ID NO: 319253 - DNA, 25 bp, Mus musculus
ggcggagtcctgaccataacgacta

SEQ ID NO: 319254 - DNA, 25 bp, Mus musculus
ccataacgactagaggccgaggcca

SEQ ID NO: 319255 - DNA, 25 bp, Mus musculus
ggaccagagaaagtggagcccacga

SEQ ID NO: 319256 - DNA, 25 bp, Mus musculus
tggagcccacgacacaggacacgca

SEQ ID NO: 319257 - DNA, 25 bp, Mus musculus
acgcacctcgcctggttacctagaa

SEQ ID NO: 319258 - DNA, 25 bp, Mus musculus
taccgatcagaagcgcgacgcgatt

SEQ ID NO: 319259 - DNA, 25 bp, Mus musculus
ttacctagaagacagccgggcggag

SEQ ID NO: 319260 - DNA, 25 bp, Mus musculus
tgcaccctggtaccgatcagaagcg

SEQ ID NO: 319261 - DNA, 25 bp, Mus musculus
gggtcgcacctgagaaactcctgca

SEQ ID NO: 319262 - DNA, 25 bp, Mus musculus
ggccacaagtagacacctgcacagg

SEQ ID NO: 319263 - DNA, 25 bp, Mus musculus
ccttgacatcatggtgggcgctcct

SEQ ID NO: 319264 - DNA, 25 bp, Mus musculus
gcttgggcttctccaggaacttgta

SEQ ID NO: 319265 - DNA, 25 bp, Mus musculus
aacttgtagtcgaagccgggcatgg

SEQ ID NO: 319266 - DNA, 25 bp, Mus musculus
gaatgctgtcgcactccgaactctg

SEQ ID NO: 319267 - DNA, 25 bp, Mus musculus
ccgaactctgccctggctttgaaag

SEQ ID NO: 319268 - DNA, 25 bp, Mus musculus
aattaggcttctctttcccgctgga

SEQ ID NO: 319269 - DNA, 25 bp, Mus musculus
ttcccgctggaactccgagtgtggc

SEQ ID NO: 319270 - DNA, 25 bp, Mus musculus
ccttgcgttacgatggtgcctatca

SEQ ID NO: 319271 - DNA, 25 bp, Mus musculus
tatcaggtcgcaccacaaagacttg

SEQ ID NO: 319272 - DNA, 25 bp, Mus musculus
acttgacactttagaggccacctta

SEQ ID NO: 319273 - DNA, 25 bp, Mus musculus
ggaggcagtttttcctacctggagc

SEQ ID NO: 319274 - DNA, 25 bp, Mus musculus
ctacgcttgggtgcgtaaggtcctc

SEQ ID NO: 319275 - DNA, 25 bp, Mus musculus
cgtggtctcttggttgtaacaacta

SEQ ID NO: 319276 - DNA, 25 bp, Mus musculus
cctgaagagtacatgacgtggtctc

SEQ ID NO: 319277 - DNA, 25 bp, Mus musculus
aagggattctcatgattggcacgta

SEQ ID NO: 319278 - DNA, 25 bp, Mus musculus
acgagttggcactacctcagaaaga

SEQ ID NO: 319279 - DNA, 25 bp, Mus musculus
cgcccacttatgttgcccggcaaaa

SEQ ID NO: 319280 - DNA, 25 bp, Mus musculus
actggagcgataaggcgcccactta

SEQ ID NO: 319281 - DNA, 25 bp, Mus musculus
atcgcacacgcgtgacttgggcata

SEQ ID NO: 319282 - DNA, 25 bp, Mus musculus
gagtccctcagtgctcagaaccgta

SEQ ID NO: 319283 - DNA, 25 bp, Mus musculus
tctgggtttcttgacgagtccctca

SEQ ID NO: 319284 - DNA, 25 bp, Mus musculus
cccaacgagggatcagagaatagtc

SEQ ID NO: 319285 - DNA, 25 bp, Mus musculus
caacctagaggctaagtcgtgtttc

SEQ ID NO: 319286 - DNA, 25 bp, Mus musculus
gtccggcgtctttctctgactttga

SEQ ID NO: 319287 - DNA, 25 bp, Mus musculus
tgtaaaacttttgcagggcggagcc

SEQ ID NO: 319288 - DNA, 25 bp, Mus musculus
cagttacgcttctggaatcccggtg

SEQ ID NO: 319289 - DNA, 25 bp, Mus musculus
ccatttcctgacgaggggccatttt

SEQ ID NO: 319290 - DNA, 25 bp, Mus musculus
gaccatgtttgcctcagttacttgc

SEQ ID NO: 319291 - DNA, 25 bp, Mus musculus
ctgtgcaatgggaagatacgcggta

SEQ ID NO: 319292 - DNA, 25 bp, Mus musculus
tacgcggtaccactggggaagacca

SEQ ID NO: 319293 - DNA, 25 bp, Mus musculus
ttcctaaggacagccagattgcgtg

SEQ ID NO: 319294 - DNA, 25 bp, Mus musculus
accgcgccgcaaccatctagtagga

SEQ ID NO: 319295 - DNA, 25 bp, Mus musculus
tcactccgtttggaaagcagttgtg

SEQ ID NO: 319296 - DNA, 25 bp, Mus musculus
agcagttgtgattgatccaggtccg

SEQ ID NO: 319297 - DNA, 25 bp, Mus musculus
ttgcagacgccactgtcgcttttcg

SEQ ID NO: 319298 - DNA, 25 bp, Mus musculus
gtgttcttcgacatcacggccgatg

SEQ ID NO: 319299 - DNA, 25 bp, Mus musculus
agcagggaccctgcctaaggtctca

SEQ ID NO: 319300 - DNA, 25 bp, Mus musculus
gccgctcgaccttgaggaccatgtt

SEQ ID NO: 319301 - DNA, 25 bp, Mus musculus
acagccttttactcggatctgagca

SEQ ID NO: 319302 - DNA, 25 bp, Mus musculus
gccgcttgctgcagccatggtcaac

SEQ ID NO: 319303 - DNA, 25 bp, Mus musculus
acctggcgttggcacaacctactcg

SEQ ID NO: 319304 - DNA, 25 bp, Mus musculus
cgcgggagaagcaggtaaacacgtc

SEQ ID NO: 319305 - DNA, 25 bp, Mus musculus
taaacacgtcgatcccggtccaaga

SEQ ID NO: 319306 - DNA, 25 bp, Mus musculus
tttagcgttcagcagcccggtctgt

SEQ ID NO: 319307 - DNA, 25 bp, Mus musculus
gagagaggagcgttctcgcagaacc

SEQ ID NO: 319308 - DNA, 25 bp, Mus musculus
ttctcgcagaacctgcccagggtgt

SEQ ID NO: 319309 - DNA, 25 bp, Mus musculus
gcgccagacagggtgcctcggcaac

SEQ ID NO: 319310 - DNA, 25 bp, Mus musculus
tgcctcggcaacgatggcgaggaca

SEQ ID NO: 319311 - DNA, 25 bp, Mus musculus
ccttcgcgctcgaagtcggccgatt

SEQ ID NO: 319312 - DNA, 25 bp, Mus musculus
ggccttgagggctccgcgaaactgt

SEQ ID NO: 319313 - DNA, 25 bp, Mus musculus
agaaacgatcgtggcgcgctggcca

SEQ ID NO: 319314 - DNA, 25 bp, Mus musculus
tggccagagaaggaacggtgttccc

SEQ ID NO: 319315 - DNA, 25 bp, Mus musculus
tcccagaactgtcggaggagacggc

SEQ ID NO: 319316 - DNA, 25 bp, Mus musculus
cccggtccaagagaggaatcgagtc

SEQ ID NO: 319317 - DNA, 25 bp, Mus musculus
ggcttagccgggcattcttcttccc

SEQ ID NO: 319318 - DNA, 25 bp, Mus musculus
tgacagattcccataccgcaacata

SEQ ID NO: 319319 - DNA, 25 bp, Mus musculus
gacctgacagattcccataccgcaa

SEQ ID NO: 319320 - DNA, 25 bp, Mus musculus
tatccaagaccgacctgacagattc

SEQ ID NO: 319321 - DNA, 25 bp, Mus musculus
ctgcgggtatccaagaccgacctga

SEQ ID NO: 319322 - DNA, 25 bp, Mus musculus
ttcgctctgcgggtatccaagaccg

SEQ ID NO: 319323 - DNA, 25 bp, Mus musculus
ggcattcttcttccccgcgagttcg

SEQ ID NO: 319324 - DNA, 25 bp, Mus musculus
cctagtcgcgacagtagccacagaa

SEQ ID NO: 319325 - DNA, 25 bp, Mus musculus
gggcctagtcgcgacagtagccaca

SEQ ID NO: 319326 - DNA, 25 bp, Mus musculus
tggaaccagcccatgcggcttggcc

SEQ ID NO: 319327 - DNA, 25 bp, Mus musculus
tgcactggaaccagcccatgcggct

SEQ ID NO: 319328 - DNA, 25 bp, Mus musculus
tggctttgccaatcccctgcactgg

SEQ ID NO: 319329 - DNA, 25 bp, Mus musculus
taccgcaacataccttccttcttcg

SEQ ID NO: 319330 - DNA, 25 bp, Mus musculus
gcgagttcgctctgcgggtatccaa

SEQ ID NO: 319331 - DNA, 25 bp, Mus musculus
cccgtgtcattgtaggatccgcgcg

SEQ ID NO: 319332 - DNA, 25 bp, Mus musculus
tgttgcaacgctcgcagagtgggac

SEQ ID NO: 319333 - DNA, 25 bp, Mus musculus
ctcgctgcgcgtctagggttgtcgc

SEQ ID NO: 319334 - DNA, 25 bp, Mus musculus
tcctctcaccggtcgagggcgtcgg

SEQ ID NO: 319335 - DNA, 25 bp, Mus musculus
ccaggcctctctgttatggtagggc

SEQ ID NO: 319336 - DNA, 25 bp, Mus musculus
cccgagttgtcgtcgggtctccgcg

SEQ ID NO: 319337 - DNA, 25 bp, Mus musculus
aatttccggggatcgtgttgcaacg

SEQ ID NO: 319338 - DNA, 25 bp, Mus musculus
agatgaacattctggcgcccgtgcg

SEQ ID NO: 319339 - DNA, 25 bp, Mus musculus
gtgattgtgggctctcccagacccg

SEQ ID NO: 319340 - DNA, 25 bp, Mus musculus
cccagacccggggtgattgtctcgt

SEQ ID NO: 319341 - DNA, 25 bp, Mus musculus
tggtcgtagcgtctccaaggccgag

SEQ ID NO: 319342 - DNA, 25 bp, Mus musculus
ccgcggataatcgtcgggtctccac

SEQ ID NO: 319343 - DNA, 25 bp, Mus musculus
cccgcaaggccgcagacaagatgaa

SEQ ID NO: 319344 - DNA, 25 bp, Mus musculus
tctgttatggtagggccatcccagc

SEQ ID NO: 319345 - DNA, 25 bp, Mus musculus
ggagcgtccaacatggctgtcgtta

SEQ ID NO: 319346 - DNA, 25 bp, Mus musculus
ttctctcggatctaggatggctgtc

SEQ ID NO: 319347 - DNA, 25 bp, Mus musculus
ggacgggcctaattttcttggatga

SEQ ID NO: 319348 - DNA, 25 bp, Mus musculus
aggagtcttctcttccatcttggcg

SEQ ID NO: 319349 - DNA, 25 bp, Mus musculus
ttggcgtagttctaccctcggcttc

SEQ ID NO: 319350 - DNA, 25 bp, Mus musculus
gtctgggaaagttagccgtgcccta

SEQ ID NO: 319351 - DNA, 25 bp, Mus musculus
ttctcacgacgtgcgctatgggtca

SEQ ID NO: 319352 - DNA, 25 bp, Mus musculus
agccgctctcgccaaaggaaccata

SEQ ID NO: 319353 - DNA, 25 bp, Mus musculus
cgggccagcgtgttctttaagccgc

SEQ ID NO: 319354 - DNA, 25 bp, Mus musculus
cccagtacaaagtgaggtcccgaag

SEQ ID NO: 319355 - DNA, 25 bp, Mus musculus
gcctaaggaacgcagccgccacaga

SEQ ID NO: 319356 - DNA, 25 bp, Mus musculus
ttccgagtccgcgaacgcctaagga

SEQ ID NO: 319357 - DNA, 25 bp, Mus musculus
gccgtgccctatttcttgaagagga

SEQ ID NO: 319358 - DNA, 25 bp, Mus musculus
ggctccgtggtgaagctactcaata

SEQ ID NO: 319359 - DNA, 25 bp, Mus musculus
cagagcggtgtttgagcagttccga

SEQ ID NO: 319360 - DNA, 25 bp, Mus musculus
cggacccggacctaaatgcctctat

SEQ ID NO: 319361 - DNA, 25 bp, Mus musculus
cctctaaggagtgtgcgatgacgta

SEQ ID NO: 319362 - DNA, 25 bp, Mus musculus
ggggacgcagacagggaccctctaa

SEQ ID NO: 319363 - DNA, 25 bp, Mus musculus
tgagcagttccgagagtgacctctg

SEQ ID NO: 319364 - DNA, 25 bp, Mus musculus
tcccagattgcgaagggcacctgca

SEQ ID NO: 319365 - DNA, 25 bp, Mus musculus
tccgtgtcctcttcccagattgcga

SEQ ID NO: 319366 - DNA, 25 bp, Mus musculus
tccgggaaccgaatgtttgcgtgtg

SEQ ID NO: 319367 - DNA, 25 bp, Mus musculus
cgaagcaatgtccagtccgggaacc

SEQ ID NO: 319368 - DNA, 25 bp, Mus musculus
gctgaagcatctggctggacccgaa

SEQ ID NO: 319369 - DNA, 25 bp, Mus musculus
tagcgcactcttcctaggccggtga

SEQ ID NO: 319370 - DNA, 25 bp, Mus musculus
gcctctatttctctccgcgctgttg

SEQ ID NO: 319371 - DNA, 25 bp, Mus musculus
ctaacgcttcctcgccgtgcgtgtg

SEQ ID NO: 319372 - DNA, 25 bp, Mus musculus
gtgacctctgccttctcggaaacgg

SEQ ID NO: 319373 - DNA, 25 bp, Mus musculus
taagtgatcgagttgaaaatgtgga

SEQ ID NO: 319374 - DNA, 25 bp, Mus musculus
gcagccaatcccgaagtgcgtattg

SEQ ID NO: 319375 - DNA, 25 bp, Mus musculus
caggtcccgcccaccatacgtaccg

SEQ ID NO: 319376 - DNA, 25 bp, Mus musculus
ccgaagtgcgtattgggttcaaata

SEQ ID NO: 319377 - DNA, 25 bp, Mus musculus
cgtattgggttcaaatagaggcggc

SEQ ID NO: 319378 - DNA, 25 bp, Mus musculus
gcgggtgaaagtggccatttcgact

SEQ ID NO: 319379 - DNA, 25 bp, Mus musculus
gcctagcggttgtgggaaaacactc

SEQ ID NO: 319380 - DNA, 25 bp, Mus musculus
tggtctggttaagtgatcgagttga

SEQ ID NO: 319381 - DNA, 25 bp, Mus musculus
gtggagggtgaaaacactgaatctc

SEQ ID NO: 319382 - DNA, 25 bp, Mus musculus
aaacactgaatctcggtttgtcgcc

SEQ ID NO: 319383 - DNA, 25 bp, Mus musculus
cccaaaaggtgaggagagaactccg

SEQ ID NO: 319384 - DNA, 25 bp, Mus musculus
agagaactccggcagacagggcgct

SEQ ID NO: 319385 - DNA, 25 bp, Mus musculus
actccggcagacagggcgctacctg

SEQ ID NO: 319386 - DNA, 25 bp, Mus musculus
ggccatttcgacttggtctggttaa

SEQ ID NO: 319387 - DNA, 25 bp, Mus musculus
gttttggatgcagaactcccgcctc

SEQ ID NO: 319388 - DNA, 25 bp, Mus musculus
gtcgccacaacagccgtcgtcaagg

SEQ ID NO: 319389 - DNA, 25 bp, Mus musculus
ggaggatgttctggtcgccacaaca

SEQ ID NO: 319390 - DNA, 25 bp, Mus musculus
ctagacgctcggcagcagccaatgg

SEQ ID NO: 319391 - DNA, 25 bp, Mus musculus
tgtggagcgccgaccaatgaagtcg

SEQ ID NO: 319392 - DNA, 25 bp, Mus musculus
cctccgcgttgcgacacttcattta

SEQ ID NO: 319393 - DNA, 25 bp, Mus musculus
tggaccagcagccactggaggcctc

SEQ ID NO: 319394 - DNA, 25 bp, Mus musculus
ctgcctggaacttctcgcggatctc

SEQ ID NO: 319395 - DNA, 25 bp, Mus musculus
ctccttctccgggttcttgtgcagc

SEQ ID NO: 319396 - DNA, 25 bp, Mus musculus
acttggacttgtacggctccttctc

SEQ ID NO: 319397 - DNA, 25 bp, Mus musculus
agttcctccgtgtcgatgtggttca

SEQ ID NO: 319398 - DNA, 25 bp, Mus musculus
tgaccagatgctcctcgccggcaga

SEQ ID NO: 319399 - DNA, 25 bp, Mus musculus
tagagagacacacagccgagcgaca

SEQ ID NO: 319400 - DNA, 25 bp, Mus musculus
acctgcgcctggatgtagagagaca

SEQ ID NO: 319401 - DNA, 25 bp, Mus musculus
tgtggcgggcatcgcaccctagttc

SEQ ID NO: 319402 - DNA, 25 bp, Mus musculus
cactggcgtgcgtcagcagtgttgc

SEQ ID NO: 319403 - DNA, 25 bp, Mus musculus
ctcgtgattggcagcggtcgcgcac

SEQ ID NO: 319404 - DNA, 25 bp, Mus musculus
cctcattctggagtttccgattgga

SEQ ID NO: 319405 - DNA, 25 bp, Mus musculus
cgattggagaaagctcatgaggccc

SEQ ID NO: 319406 - DNA, 25 bp, Mus musculus
ccatcggcgacctgggcagccggaa

SEQ ID NO: 319407 - DNA, 25 bp, Mus musculus
tccacgatcccggtgtggcgggcat

SEQ ID NO: 319408 - DNA, 25 bp, Mus musculus
ctctgtgccctcagaggtggtccgg

SEQ ID NO: 319409 - DNA, 25 bp, Mus musculus
cggggcaagcgttccgcgcttttct

SEQ ID NO: 319410 - DNA, 25 bp, Mus musculus
tccgcgcttttcttcgccgcggtgg

SEQ ID NO: 319411 - DNA, 25 bp, Mus musculus
tggccatccttctgggactgccgct

SEQ ID NO: 319412 - DNA, 25 bp, Mus musculus
tggtggaagacgacggagacttacc

SEQ ID NO: 319413 - DNA, 25 bp, Mus musculus
gactgccgctctggtggaagacgac

SEQ ID NO: 319414 - DNA, 25 bp, Mus musculus
ccacggacctaggtgcggtggattt

SEQ ID NO: 319415 - DNA, 25 bp, Mus musculus
cctggctccagccggcgcaagcagc

SEQ ID NO: 319416 - DNA, 25 bp, Mus musculus
tgagcaccggcgagggagcgccacc

SEQ ID NO: 319417 - DNA, 25 bp, Mus musculus
agcggatcacgggtggtgagcaccg

SEQ ID NO: 319418 - DNA, 25 bp, Mus musculus
cggaggatgtgctggggctgcagcg

SEQ ID NO: 319419 - DNA, 25 bp, Mus musculus
ctgcagggcaagcagcccatcgggc

SEQ ID NO: 319420 - DNA, 25 bp, Mus musculus
cgctgcagggcaagcagcccatcgg

SEQ ID NO: 319421 - DNA, 25 bp, Mus musculus
ggcggaagctgagtccgggtccgag

SEQ ID NO: 319422 - DNA, 25 bp, Mus musculus
gcgcggagcccacgcgggagcctgg

SEQ ID NO: 319423 - DNA, 25 bp, Mus musculus
gcggagcccgttccaggggcctcga

SEQ ID NO: 319424 - DNA, 25 bp, Mus musculus
tgaccaaggcgggacggcacctggg

SEQ ID NO: 319425 - DNA, 25 bp, Mus musculus
cctcccgtgggcgtgaccaaggcgg

SEQ ID NO: 319426 - DNA, 25 bp, Mus musculus
gcggggtatgtgtgacccgcctccc

SEQ ID NO: 319427 - DNA, 25 bp, Mus musculus
gggtatgtgtgacccgcctcccgtg

SEQ ID NO: 319428 - DNA, 25 bp, Mus musculus
ttccaggggcctcgaaccggagcgc

SEQ ID NO: 319429 - DNA, 25 bp, Mus musculus
tcctcttcaccggagagcacacata

SEQ ID NO: 319430 - DNA, 25 bp, Mus musculus
cctctcctggctccgaggagtggca

SEQ ID NO: 319431 - DNA, 25 bp, Mus musculus
cctctgtcccgggacttggagtttg

SEQ ID NO: 319432 - DNA, 25 bp, Mus musculus
gattctgcacctctgtcccgggact

SEQ ID NO: 319433 - DNA, 25 bp, Mus musculus
ttcgcatgcgccagccgattctgca

SEQ ID NO: 319434 - DNA, 25 bp, Mus musculus
acatgatttcgcatgcgccagccga

SEQ ID NO: 319435 - DNA, 25 bp, Mus musculus
catgcatacaactactgaggagccc

SEQ ID NO: 319436 - DNA, 25 bp, Mus musculus
ggagacacgagcatcttcctcttca

SEQ ID NO: 319437 - DNA, 25 bp, Mus musculus
ttcaccggagagcacacatacagga

SEQ ID NO: 319438 - DNA, 25 bp, Mus musculus
catacaggatgtaggcaaacacacg

SEQ ID NO: 319439 - DNA, 25 bp, Mus musculus
ggcaaacacacgaatacatgatttc

SEQ ID NO: 319440 - DNA, 25 bp, Mus musculus
cctggctccgaggagtggcaccagc

SEQ ID NO: 319441 - DNA, 25 bp, Mus musculus
ggcgcggttgccatgcatacaacta

SEQ ID NO: 319442 - DNA, 25 bp, Mus musculus
caccacacggagacacgagcatctt

SEQ ID NO: 319443 - DNA, 25 bp, Mus musculus
ttcagcacggagctcggctacaatg

SEQ ID NO: 319444 - DNA, 25 bp, Mus musculus
tttggcaccggttcagcacggagct

SEQ ID NO: 319445 - DNA, 25 bp, Mus musculus
cacacagtacctttggcaccggttc

SEQ ID NO: 319446 - DNA, 25 bp, Mus musculus
tgcagggaccgctcaccacacagta

SEQ ID NO: 319447 - DNA, 25 bp, Mus musculus
tggttctgcagggaccgctcaccac

SEQ ID NO: 319448 - DNA, 25 bp, Mus musculus
ctggccaactttgccctggttctgc

SEQ ID NO: 319449 - DNA, 25 bp, Mus musculus
agtcttcctggccaactttgccctg

SEQ ID NO: 319450 - DNA, 25 bp, Mus musculus
tcccgcagctggttccgaggtgcta

SEQ ID NO: 319451 - DNA, 25 bp, Mus musculus
agaagcacccgaagccggcgcaggc

SEQ ID NO: 319452 - DNA, 25 bp, Mus musculus
tttaacagaagcacccgaagccggc

SEQ ID NO: 319453 - DNA, 25 bp, Mus musculus
ggagctcggctacaatggcacccgc

SEQ ID NO: 319454 - DNA, 25 bp, Mus musculus
cctcatgaaggtagcagggaccaga

SEQ ID NO: 319455 - DNA, 25 bp, Mus musculus
gcagggaccagagcagctgtgaata

SEQ ID NO: 319456 - DNA, 25 bp, Mus musculus
cagctgtgaatacggagcgcggcac

SEQ ID NO: 319457 - DNA, 25 bp, Mus musculus
ccggccaattgtacgcttccttcta

SEQ ID NO: 319458 - DNA, 25 bp, Mus musculus
agaactcctccgatcctcagcgggg

SEQ ID NO: 319459 - DNA, 25 bp, Mus musculus
tgaaaacattgtcggccgcacgggg

SEQ ID NO: 319460 - DNA, 25 bp, Mus musculus
tccttgcgcggacttctgatgaaca

SEQ ID NO: 319461 - DNA, 25 bp, Mus musculus
tgggccctccgaccaaacattgaca

SEQ ID NO: 319462 - DNA, 25 bp, Mus musculus
tgaaccaatagactggagcgattcg

SEQ ID NO: 319463 - DNA, 25 bp, Mus musculus
ggaacaacagctcggtgaaccaata

SEQ ID NO: 319464 - DNA, 25 bp, Mus musculus
agccgctcacgttgttcgtttgaac

SEQ ID NO: 319465 - DNA, 25 bp, Mus musculus
cggagtccggaacagcgggcactcc

SEQ ID NO: 319466 - DNA, 25 bp, Mus musculus
gggctacagccggacctcctctgtg

SEQ ID NO: 319467 - DNA, 25 bp, Mus musculus
ctcagaactcgcagggctacagccg

SEQ ID NO: 319468 - DNA, 25 bp, Mus musculus
ttacgtaaccctgagccgaagcctc

SEQ ID NO: 319469 - DNA, 25 bp, Mus musculus
tctggtgggcaggatcagaactcct

SEQ ID NO: 319470 - DNA, 25 bp, Mus musculus
ttgttttttgcacacggcccttgga

SEQ ID NO: 319471 - DNA, 25 bp, Mus musculus
gtgctcgggacacccgcagaggcca

SEQ ID NO: 319472 - DNA, 25 bp, Mus musculus
accctcggggatgcgccctttctgt

SEQ ID NO: 319473 - DNA, 25 bp, Mus musculus
gcagctctacccgaaagttctcgca

SEQ ID NO: 319474 - DNA, 25 bp, Mus musculus
cccgaaagttctcgcagtactggga

SEQ ID NO: 319475 - DNA, 25 bp, Mus musculus
cgcagtactgggagaagccgatctg

SEQ ID NO: 319476 - DNA, 25 bp, Mus musculus
agccgatctgctgtagccaggtctg

SEQ ID NO: 319477 - DNA, 25 bp, Mus musculus
gccaggtctggacctcagcttcctt

SEQ ID NO: 319478 - DNA, 25 bp, Mus musculus
ggcaggatgcgccttggcacctcct

SEQ ID NO: 319479 - DNA, 25 bp, Mus musculus
ttggcacctcctcgcccaataggcg

SEQ ID NO: 319480 - DNA, 25 bp, Mus musculus
ttggccagcgccgacgtggtgccat

SEQ ID NO: 319481 - DNA, 25 bp, Mus musculus
tggtgccattcgtagagtaagaaac

SEQ ID NO: 319482 - DNA, 25 bp, Mus musculus
cattcgtagagtaagaaaccaggcg

SEQ ID NO: 319483 - DNA, 25 bp, Mus musculus
ttcaggctctggatagcgccgatgt

SEQ ID NO: 319484 - DNA, 25 bp, Mus musculus
aaccaggcgtttcaggctctggata

SEQ ID NO: 319485 - DNA, 25 bp, Mus musculus
gcgctccttcgccaggttcaagatc

SEQ ID NO: 319486 - DNA, 25 bp, Mus musculus
tctgcaggtcgtctggtccacgacc

SEQ ID NO: 319487 - DNA, 25 bp, Mus musculus
aagatcacgcctagaccgatgcgcg

SEQ ID NO: 319488 - DNA, 25 bp, Mus musculus
acgaccctggcttgtgtcactggca

SEQ ID NO: 319489 - DNA, 25 bp, Mus musculus
tccagcgatgccacgagcggctcga

SEQ ID NO: 319490 - DNA, 25 bp, Mus musculus
cgcgacgaatcgagcaacagcacca

SEQ ID NO: 319491 - DNA, 25 bp, Mus musculus
ttcgtgccagttccacaggctcgcg

SEQ ID NO: 319492 - DNA, 25 bp, Mus musculus
agcggctcgacaagcgccaatgtgc

SEQ ID NO: 319493 - DNA, 25 bp, Mus musculus
gtgccagaatgctcgacctcgcgtt

SEQ ID NO: 319494 - DNA, 25 bp, Mus musculus
ctcgcgttccacctccttgttggta

SEQ ID NO: 319495 - DNA, 25 bp, Mus musculus
cagcgcgcagttcgccagcgcaaga

SEQ ID NO: 319496 - DNA, 25 bp, Mus musculus
tctcctccgagtgcttgaacatgtg

SEQ ID NO: 319497 - DNA, 25 bp, Mus musculus
tgaacatgtgctccaagatgcccgc

SEQ ID NO: 319498 - DNA, 25 bp, Mus musculus
ggcaccagtacagcaccgcgtcgag

SEQ ID NO: 319499 - DNA, 25 bp, Mus musculus
ccgtccagacgtatagcatcgcata

SEQ ID NO: 319500 - DNA, 25 bp, Mus musculus
agctcaggcagcgaacgctccaggg

SEQ ID NO: 319501 - DNA, 25 bp, Mus musculus
agcgaacgctccagggcgccttgca

SEQ ID NO: 319502 - DNA, 25 bp, Mus musculus
atccggtccgggcactgtcagccga

SEQ ID NO: 319503 - DNA, 25 bp, Mus musculus
cctgacatggtgaagaagcggcaca

SEQ ID NO: 319504 - DNA, 25 bp, Mus musculus
tgaagaagcggcacagtttgtaggc

SEQ ID NO: 319505 - DNA, 25 bp, Mus musculus
gcgcttgcctgtttcagctcggaca

SEQ ID NO: 319506 - DNA, 25 bp, Mus musculus
gacgtatagcatcgcatagaccttg

SEQ ID NO: 319507 - DNA, 25 bp, Mus musculus
gtcgaggccaccgtccagacgtata

SEQ ID NO: 319508 - DNA, 25 bp, Mus musculus
aagcagccgcaacagcaagtcgagg

SEQ ID NO: 319509 - DNA, 25 bp, Mus musculus
tctctagctccggtgcctgaagcag

SEQ ID NO: 319510 - DNA, 25 bp, Mus musculus
gcggcctgcacacgggtctctagct

SEQ ID NO: 319511 - DNA, 25 bp, Mus musculus
agcgcctgctgcagctcaggcagcg

SEQ ID NO: 319512 - DNA, 25 bp, Mus musculus
atcgcatagaccttgggccacctcg

SEQ ID NO: 319513 - DNA, 25 bp, Mus musculus
gcccgcgtgtttctttcccagagca

SEQ ID NO: 319514 - DNA, 25 bp, Mus musculus
gtggcattatcactgcccgcgtgtt

SEQ ID NO: 319515 - DNA, 25 bp, Mus musculus
ctcaggtgctgatgcagatctcgga

SEQ ID NO: 319516 - DNA, 25 bp, Mus musculus
ggaccgctcacttctttctctcagg

SEQ ID NO: 319517 - DNA, 25 bp, Mus musculus
ctcttgaatggggaccgctcacttc

SEQ ID NO: 319518 - DNA, 25 bp, Mus musculus
tctcggatgagacggaatgaaacca

SEQ ID NO: 319519 - DNA, 25 bp, Mus musculus
gaaccagtcgttcgccggcaagcaa

SEQ ID NO: 319520 - DNA, 25 bp, Mus musculus
ttcgccggcaagcaaggaagacgcc

SEQ ID NO: 319521 - DNA, 25 bp, Mus musculus
ttctgcctcacgctctgatcaggtg

SEQ ID NO: 319522 - DNA, 25 bp, Mus musculus
tcaggtgatcccaaactcggacttc

SEQ ID NO: 319523 - DNA, 25 bp, Mus musculus
cagcgacgacccgaaggcatctgtc

SEQ ID NO: 319524 - DNA, 25 bp, Mus musculus
cagcctcgagctgggcacgcagctt

SEQ ID NO: 319525 - DNA, 25 bp, Mus musculus
gccaggacccaaagcgcgaaccagt

SEQ ID NO: 319526 - DNA, 25 bp, Mus musculus
gacttccgctcacaggcgccggatg

SEQ ID NO: 319527 - DNA, 25 bp, Mus musculus
agagaagcttctaccgacagtcgtc

SEQ ID NO: 319528 - DNA, 25 bp, Mus musculus
tgccttttgcccaggactcagcaga

SEQ ID NO: 319529 - DNA, 25 bp, Mus musculus
cgagtctcagtcaagtagcaagcgg

SEQ ID NO: 319530 - DNA, 25 bp, Mus musculus
gcaatctcggctgtgagctcacatc

SEQ ID NO: 319531 - DNA, 25 bp, Mus musculus
ggagttacagcccaaccctacagat

SEQ ID NO: 319532 - DNA, 25 bp, Mus musculus
cctacagatcgggaaagagactaca

SEQ ID NO: 319533 - DNA, 25 bp, Mus musculus
tacaagacccggcatgcacagcgcg

SEQ ID NO: 319534 - DNA, 25 bp, Mus musculus
cgagctagcagtgggtcgaaaactt

SEQ ID NO: 319535 - DNA, 25 bp, Mus musculus
gaacaaatctacttcccgtgtcgta

SEQ ID NO: 319536 - DNA, 25 bp, Mus musculus
atcgcgtgttgcatctatttcccag

SEQ ID NO: 319537 - DNA, 25 bp, Mus musculus
tagatcttgtctccgtggcagcagc

SEQ ID NO: 319538 - DNA, 25 bp, Mus musculus
tagggatcgggtttacactcagctc

SEQ ID NO: 319539 - DNA, 25 bp, Mus musculus
ggctccctcgatgtcaccggtgaac

SEQ ID NO: 319540 - DNA, 25 bp, Mus musculus
gtgacgtgtggctcctagatcttgt

SEQ ID NO: 319541 - DNA, 25 bp, Mus musculus
actttgccgtcttcggctctggtcc

SEQ ID NO: 319542 - DNA, 25 bp, Mus musculus
ccactgcggagttttcccggcatta

SEQ ID NO: 319543 - DNA, 25 bp, Mus musculus
ttctcgcttggcttcggcagcgtct

SEQ ID NO: 319544 - DNA, 25 bp, Mus musculus
cgaccatgtgcgcaagtttcagact

SEQ ID NO: 319545 - DNA, 25 bp, Mus musculus
cccggcattattcagcagcagcttc

SEQ ID NO: 319546 - DNA, 25 bp, Mus musculus
gggcctattcgtcacttccgcagcg

SEQ ID NO: 319547 - DNA, 25 bp, Mus musculus
cggcttcctcaaccgcgtgctagga

SEQ ID NO: 319548 - DNA, 25 bp, Mus musculus
aagtagcgtgtaccggcaaggctgc

SEQ ID NO: 319549 - DNA, 25 bp, Mus musculus
agcagcagcttctcaggcctaccgg

SEQ ID NO: 319550 - DNA, 25 bp, Mus musculus
gctctggtccgcactgtgacgcgat

SEQ ID NO: 319551 - DNA, 25 bp, Mus musculus
tgcatccggcggaagtagcgtgtac

SEQ ID NO: 319552 - DNA, 25 bp, Mus musculus
cggtctaacgacagcgggatcgcca

SEQ ID NO: 319553 - DNA, 25 bp, Mus musculus
acttccgcagcggagtgcatccggc

SEQ ID NO: 319554 - DNA, 25 bp, Mus musculus
tgaccagccgacacggcgtgtcaga

SEQ ID NO: 319555 - DNA, 25 bp, Mus musculus
tccgttgggctacgactggcaagcc

SEQ ID NO: 319556 - DNA, 25 bp, Mus musculus
tgcgagacgaagtagaggcccaaga

SEQ ID NO: 319557 - DNA, 25 bp, Mus musculus
acacaggccgtacctattggtcgaa

SEQ ID NO: 319558 - DNA, 25 bp, Mus musculus
aagagccactcgacacagcgcctag

SEQ ID NO: 319559 - DNA, 25 bp, Mus musculus
ggcccgcccatatagcggggctata

SEQ ID NO: 319560 - DNA, 25 bp, Mus musculus
agtttgaatgatggcctacctgttg

SEQ ID NO: 319561 - DNA, 25 bp, Mus musculus
tacctgttgtttccattggctgctg

SEQ ID NO: 319562 - DNA, 25 bp, Mus musculus
tggtcttccctgtgccacgagtgtt

SEQ ID NO: 319563 - DNA, 25 bp, Mus musculus
attcgctgggttctgttccgtattg

SEQ ID NO: 319564 - DNA, 25 bp, Mus musculus
aagcctgctacgtggttagaagccc

SEQ ID NO: 319565 - DNA, 25 bp, Mus musculus
cacctcctgcgggtatagttcgggc

SEQ ID NO: 319566 - DNA, 25 bp, Mus musculus
gccgaagtcaggcacggagccaaca

SEQ ID NO: 319567 - DNA, 25 bp, Mus musculus
gcaagccggtgatagaagcctgcta

SEQ ID NO: 319568 - DNA, 25 bp, Mus musculus
gcctgcaggtcgatgaacagcgtga

SEQ ID NO: 319569 - DNA, 25 bp, Mus musculus
caaagccggatagagcggagccagc

SEQ ID NO: 319570 - DNA, 25 bp, Mus musculus
gccggaagcttcagacaggcgcact

SEQ ID NO: 319571 - DNA, 25 bp, Mus musculus
aagcttcagacaggcgcactggtcg

SEQ ID NO: 319572 - DNA, 25 bp, Mus musculus
gtcgctttctccacagccgccgtga

SEQ ID NO: 319573 - DNA, 25 bp, Mus musculus
ggcttccgtgcccacggtcgctttc

SEQ ID NO: 319574 - DNA, 25 bp, Mus musculus
tgcagggctcaaggctgctccgtct

SEQ ID NO: 319575 - DNA, 25 bp, Mus musculus
ctagcaaagccggatagagcggagc

SEQ ID NO: 319576 - DNA, 25 bp, Mus musculus
cggacacgcgcaaccagccgccgag

SEQ ID NO: 319577 - DNA, 25 bp, Mus musculus
gcctcacactgaccggctgccctag

SEQ ID NO: 319578 - DNA, 25 bp, Mus musculus
cctagccaatccacgcccacctgtc

SEQ ID NO: 319579 - DNA, 25 bp, Mus musculus
acggtcggaagcaggctgactcctg

SEQ ID NO: 319580 - DNA, 25 bp, Mus musculus
aatccctggccggaagcttcagaca

SEQ ID NO: 319581 - DNA, 25 bp, Mus musculus
ggcagtactcggacgcccagacaca

SEQ ID NO: 319582 - DNA, 25 bp, Mus musculus
gtgaccgctttctcttcagccgccg

SEQ ID NO: 319583 - DNA, 25 bp, Mus musculus
tctggccgaacagcctccatgaggc

SEQ ID NO: 319584 - DNA, 25 bp, Mus musculus
cttatggtaaatggtgcaagcggtg

SEQ ID NO: 319585 - DNA, 25 bp, Mus musculus
cgacacgttgatgatgtcacgagta

SEQ ID NO: 319586 - DNA, 25 bp, Mus musculus
gtcacgagtacgcaagtgttgctcc

SEQ ID NO: 319587 - DNA, 25 bp, Mus musculus
agtgttgctcctccactttgccggc

SEQ ID NO: 319588 - DNA, 25 bp, Mus musculus
ctttgccggccaagtaaatggaaga

SEQ ID NO: 319589 - DNA, 25 bp, Mus musculus
acatggcgaccaggtagaggtcata

SEQ ID NO: 319590 - DNA, 25 bp, Mus musculus
tccaggttgatctcgcagaagaact

SEQ ID NO: 319591 - DNA, 25 bp, Mus musculus
gactgcatgcctagcttgacgcctg

SEQ ID NO: 319592 - DNA, 25 bp, Mus musculus
cctgcctccatgataaaccgggtta

SEQ ID NO: 319593 - DNA, 25 bp, Mus musculus
gttactcggaagtgcaccctcgcct

SEQ ID NO: 319594 - DNA, 25 bp, Mus musculus
ccgctttcgcagctgtctggccgaa

SEQ ID NO: 319595 - DNA, 25 bp, Mus musculus
aaggagaaacgctccggcgcgccga

SEQ ID NO: 319596 - DNA, 25 bp, Mus musculus
tagaggtcatatgcgtccaggttga

SEQ ID NO: 319597 - DNA, 25 bp, Mus musculus
tctccagttggcgtccgccgggaag

SEQ ID NO: 319598 - DNA, 25 bp, Mus musculus
acctgtcgcagccatagttgccgcg

SEQ ID NO: 319599 - DNA, 25 bp, Mus musculus
gccgcgcaggcgcaatcgtgtcgct

SEQ ID NO: 319600 - DNA, 25 bp, Mus musculus
caggcgcaatcgtgtcgctcgcggt

SEQ ID NO: 319601 - DNA, 25 bp, Mus musculus
tgcgcttgcttctgccgcgcaggcg

SEQ ID NO: 319602 - DNA, 25 bp, Mus musculus
tcggatcaggaagcccgcacccagt

SEQ ID NO: 319603 - DNA, 25 bp, Mus musculus
ctggggattaccgaggctgcctgca

SEQ ID NO: 319604 - DNA, 25 bp, Mus musculus
cagggccgggatatgtggaagccct

SEQ ID NO: 319605 - DNA, 25 bp, Mus musculus
gatctgcgggctctccaggctttcc

SEQ ID NO: 319606 - DNA, 25 bp, Mus musculus
tagtgccagcgacacctgtcgcagc

SEQ ID NO: 319607 - DNA, 25 bp, Mus musculus
tcaggaagcccgcacccagtaggac

SEQ ID NO: 319608 - DNA, 25 bp, Mus musculus
cgacacctgtcgcagccatagttgc

SEQ ID NO: 319609 - DNA, 25 bp, Mus musculus
gcagccatagttgccgcgccgcgga

SEQ ID NO: 319610 - DNA, 25 bp, Mus musculus
cgctcgcggtgtctccagttggcgt

SEQ ID NO: 319611 - DNA, 25 bp, Mus musculus
tcccttcgagaggaatacacaaacg

SEQ ID NO: 319612 - DNA, 25 bp, Mus musculus
tttcgcggcgataaagggacagcgc

SEQ ID NO: 319613 - DNA, 25 bp, Mus musculus
taagagctgagtcctgcccgcagca

SEQ ID NO: 319614 - DNA, 25 bp, Mus musculus
cgcgatccttactgtcccttcgaga

SEQ ID NO: 319615 - DNA, 25 bp, Mus musculus
tcctgcttgtcctgggccactaaga

SEQ ID NO: 319616 - DNA, 25 bp, Mus musculus
atacacaaacgaggcactcgcgcgc

SEQ ID NO: 319617 - DNA, 25 bp, Mus musculus
tcctgggccactaagagctgagtcc

SEQ ID NO: 319618 - DNA, 25 bp, Mus musculus
agcgccaaagaggagcgctggccca

SEQ ID NO: 319619 - DNA, 25 bp, Mus musculus
ggctctgtcgcttcctgcgcaggat

SEQ ID NO: 319620 - DNA, 25 bp, Mus musculus
atcttcggcccgaaggtcgccagtc

SEQ ID NO: 319621 - DNA, 25 bp, Mus musculus
tctgggtcgcgatccttactgtccc

SEQ ID NO: 319622 - DNA, 25 bp, Mus musculus
ccagccaggtacagagcgcgggacc

SEQ ID NO: 319623 - DNA, 25 bp, Mus musculus
gtcgccagtcgtgtgggcccagcca

SEQ ID NO: 319624 - DNA, 25 bp, Mus musculus
tgcgcaggatcttcggcccgaaggt

SEQ ID NO: 319625 - DNA, 25 bp, Mus musculus
gagcgttgttatagcatctgtaaag

SEQ ID NO: 319626 - DNA, 25 bp, Mus musculus
gcgttgttatagcatctgtaaaggt

SEQ ID NO: 319627 - DNA, 25 bp, Mus musculus
ttcgaggcacacgtgagcgttgtta

SEQ ID NO: 319628 - DNA, 25 bp, Mus musculus
acacgtgagcgttgttatagcatct

SEQ ID NO: 319629 - DNA, 25 bp, Mus musculus
tgagcgttgttatagcatctgtaaa

SEQ ID NO: 319630 - DNA, 25 bp, Mus musculus
ttatagcatctgtaaaggtatccga

SEQ ID NO: 319631 - DNA, 25 bp, Mus musculus
cgaggcacacgtgagcgttgttata

SEQ ID NO: 319632 - DNA, 25 bp, Mus musculus
cgtgagcgttgttatagcatctgta

SEQ ID NO: 319633 - DNA, 25 bp, Mus musculus
gcatctgtaaaggtatccgattcgg

SEQ ID NO: 319634 - DNA, 25 bp, Mus musculus
cacacgtgagcgttgttatagcatc

SEQ ID NO: 319635 - DNA, 25 bp, Mus musculus
agcgttgttatagcatctgtaaagg

SEQ ID NO: 319636 - DNA, 25 bp, Mus musculus
catctgtaaaggtatccgattcggg

SEQ ID NO: 319637 - DNA, 25 bp, Mus musculus
tccgattcgggggttcgaggcacac

SEQ ID NO: 319638 - DNA, 25 bp, Mus musculus
atctgtaaaggtatccgattcgggg

SEQ ID NO: 319639 - DNA, 25 bp, Mus musculus
ggcgtgatgaagctgtgcagggccc

SEQ ID NO: 319640 - DNA, 25 bp, Mus musculus
atacaggagtccgagaggccctcac

SEQ ID NO: 319641 - DNA, 25 bp, Mus musculus
acacggagatggaacggggtccctg

SEQ ID NO: 319642 - DNA, 25 bp, Mus musculus
tccgagaggccctcactgaggccgg

SEQ ID NO: 319643 - DNA, 25 bp, Mus musculus
tcagcttggcgtgccgtcgtagctg

SEQ ID NO: 319644 - DNA, 25 bp, Mus musculus
tgagtgctggcacccgctctgccca

SEQ ID NO: 319645 - DNA, 25 bp, Mus musculus
ctggaagaccttgcggcttggcggt

SEQ ID NO: 319646 - DNA, 25 bp, Mus musculus
actcgtgggacttgctccgtgtgag

SEQ ID NO: 319647 - DNA, 25 bp, Mus musculus
tcgattcggtttcccagctgggact

SEQ ID NO: 319648 - DNA, 25 bp, Mus musculus
gacgtcgtcgattcggtttcccagc

SEQ ID NO: 319649 - DNA, 25 bp, Mus musculus
tacttcatcggggtgacgtcgtcga

SEQ ID NO: 319650 - DNA, 25 bp, Mus musculus
ttcccagctgggactcgtgggactt

SEQ ID NO: 319651 - DNA, 25 bp, Mus musculus
cgacttacttcatcggggtgacgtc

SEQ ID NO: 319652 - DNA, 25 bp, Mus musculus
tggcttcagcttggcgtgccgtcgt

SEQ ID NO: 319653 - DNA, 25 bp, Mus musculus
tcttccaaagtgagagctggtcgta

SEQ ID NO: 319654 - DNA, 25 bp, Mus musculus
gtccgcgcatcgcatctgctttctg

SEQ ID NO: 319655 - DNA, 25 bp, Mus musculus
ctaagcctgcagtcccgaaagcctg

SEQ ID NO: 319656 - DNA, 25 bp, Mus musculus
tcgttagacactgagcacttggtgc

SEQ ID NO: 319657 - DNA, 25 bp, Mus musculus
tcctgctgtgtgaggtcgttagaca

SEQ ID NO: 319658 - DNA, 25 bp, Mus musculus
ttacctctagggtccggatctcctg

SEQ ID NO: 319659 - DNA, 25 bp, Mus musculus
cctgacgtctagaaggggctgctct

SEQ ID NO: 319660 - DNA, 25 bp, Mus musculus
ctgccgcatcagagagctcgggaaa

SEQ ID NO: 319661 - DNA, 25 bp, Mus musculus
ggcggcaaagcgaaagcctccacta

SEQ ID NO: 319662 - DNA, 25 bp, Mus musculus
cgagactcgatccagttccacgcta

SEQ ID NO: 319663 - DNA, 25 bp, Mus musculus
ggtgccctgtgcatcctactcggca

SEQ ID NO: 319664 - DNA, 25 bp, Mus musculus
cgcgtgattcagtgggacaatgact

SEQ ID NO: 319665 - DNA, 25 bp, Mus musculus
ctgcaggatgcaactcgggaaggaa

SEQ ID NO: 319666 - DNA, 25 bp, Mus musculus
cccgcgcagactgccgatggagata

SEQ ID NO: 319667 - DNA, 25 bp, Mus musculus
ccatctatggggcaccgtctgattc

SEQ ID NO: 319668 - DNA, 25 bp, Mus musculus
tcagacaaaagagccggcgcgcctt

SEQ ID NO: 319669 - DNA, 25 bp, Mus musculus
cgggagaatcccaggacgtccgatc

SEQ ID NO: 319670 - DNA, 25 bp, Mus musculus
tgatggtgtcactagggtttgcccg

SEQ ID NO: 319671 - DNA, 25 bp, Mus musculus
gcgtgagccctcaaagcgcgacctg

SEQ ID NO: 319672 - DNA, 25 bp, Mus musculus
gccaccgggtcacactcagacaaaa

SEQ ID NO: 319673 - DNA, 25 bp, Mus musculus
acctgcgggcattttcgaagtcgaa

SEQ ID NO: 319674 - DNA, 25 bp, Mus musculus
ccgggaactcgattcggacgcgaca

SEQ ID NO: 319675 - DNA, 25 bp, Mus musculus
agtcgaaggctcattgccaagggca

SEQ ID NO: 319676 - DNA, 25 bp, Mus musculus
cttctgcggactgcccggaggaaat

SEQ ID NO: 319677 - DNA, 25 bp, Mus musculus
gggcaagcccgggattatataatgc

SEQ ID NO: 319678 - DNA, 25 bp, Mus musculus
tatataatgcacgtgaccgaaccgg

SEQ ID NO: 319679 - DNA, 25 bp, Mus musculus
agcctcaccgatctctttctcgtta

SEQ ID NO: 319680 - DNA, 25 bp, Mus musculus
tcaccggaatgcctggaacaaagcc

SEQ ID NO: 319681 - DNA, 25 bp, Mus musculus
aggtgacgtcacctccaggaggact

SEQ ID NO: 319682 - DNA, 25 bp, Mus musculus
gcaatgacagcctacgcaccggagt

SEQ ID NO: 319683 - DNA, 25 bp, Mus musculus
gaaagcctagcctcaggacacccta

SEQ ID NO: 319684 - DNA, 25 bp, Mus musculus
atcagcggtcggagagaaagcctag

SEQ ID NO: 319685 - DNA, 25 bp, Mus musculus
ccgggacagatcagcgacagagatc

SEQ ID NO: 319686 - DNA, 25 bp, Mus musculus
ccggaggagttaggtgacgtcacct

SEQ ID NO: 319687 - DNA, 25 bp, Mus musculus
aggaggactcgctttttcattaatg

SEQ ID NO: 319688 - DNA, 25 bp, Mus musculus
ttcattaatgaaaccggccggccgc

SEQ ID NO: 319689 - DNA, 25 bp, Mus musculus
ccgagccgtggaaaggatcccactt

SEQ ID NO: 319690 - DNA, 25 bp, Mus musculus
cgtgggaacgctagctgcccgcact

SEQ ID NO: 319691 - DNA, 25 bp, Mus musculus
catggccgcacacaggccggtggaa

SEQ ID NO: 319692 - DNA, 25 bp, Mus musculus
tcagccgcttcgacgagcaggtaac

SEQ ID NO: 319693 - DNA, 25 bp, Mus musculus
agagactgactccagcctccgggac

SEQ ID NO: 319694 - DNA, 25 bp, Mus musculus
caccggagtcggctcagattctctg

SEQ ID NO: 319695 - DNA, 25 bp, Mus musculus
tctcggactcttccaagggtgcctc

SEQ ID NO: 319696 - DNA, 25 bp, Mus musculus
tcaagtctgcccatctctcgggaga

SEQ ID NO: 319697 - DNA, 25 bp, Mus musculus
catctctgtctcaactcttcgaagg

SEQ ID NO: 319698 - DNA, 25 bp, Mus musculus
accaaatgaagggactcgccgccta

SEQ ID NO: 319699 - DNA, 25 bp, Mus musculus
ccagaggagtttcccgggcattact

SEQ ID NO: 319700 - DNA, 25 bp, Mus musculus
acacgagcagattccacggcgatgg

SEQ ID NO: 319701 - DNA, 25 bp, Mus musculus
gggtgcctcgagctccattatgtct

SEQ ID NO: 319702 - DNA, 25 bp, Mus musculus
gcgggagcaaagcaagccggaactc

SEQ ID NO: 319703 - DNA, 25 bp, Mus musculus
gccggaactctacaggaggaaactc

SEQ ID NO: 319704 - DNA, 25 bp, Mus musculus
gcggcacgcagaattccaagtgttc

SEQ ID NO: 319705 - DNA, 25 bp, Mus musculus
cccacggtctgaagtgacaggcttc

SEQ ID NO: 319706 - DNA, 25 bp, Mus musculus
ggcttctccagagcacgggccaatc

SEQ ID NO: 319707 - DNA, 25 bp, Mus musculus
aatctccaggaaggacgctcgcctc

SEQ ID NO: 319708 - DNA, 25 bp, Mus musculus
ccctcggccaatgaaaacctgagtg

SEQ ID NO: 319709 - DNA, 25 bp, Mus musculus
gcctctctgtggatcacatggcatg

SEQ ID NO: 319710 - DNA, 25 bp, Mus musculus
gcagcaatcgaatactaggcaagga

SEQ ID NO: 319711 - DNA, 25 bp, Mus musculus
taggcaaggaacacctgcaacaccc

SEQ ID NO: 319712 - DNA, 25 bp, Mus musculus
caacacccagcgctgacaaaggacg

SEQ ID NO: 319713 - DNA, 25 bp, Mus musculus
acgcggccggtgcacactggctagc

SEQ ID NO: 319714 - DNA, 25 bp, Mus musculus
cccaactccagctcaggtctaggag

SEQ ID NO: 319715 - DNA, 25 bp, Mus musculus
cgcggcagacacgagcggctgacac

SEQ ID NO: 319716 - DNA, 25 bp, Mus musculus
gaacggcttctcaggggtctccgct

SEQ ID NO: 319717 - DNA, 25 bp, Mus musculus
acacgagcggctgacacgagcggcc

SEQ ID NO: 319718 - DNA, 25 bp, Mus musculus
acattccgggcctctctgtggatca

SEQ ID NO: 319719 - DNA, 25 bp, Mus musculus
atcacatggcatgcccgcggtggcc

SEQ ID NO: 319720 - DNA, 25 bp, Mus musculus
gcttccagggaagcgaaagcagcaa

SEQ ID NO: 319721 - DNA, 25 bp, Mus musculus
caggggtctccgcttccagggaagc

SEQ ID NO: 319722 - DNA, 25 bp, Mus musculus
cccgacggctttctacgcgtggagc

SEQ ID NO: 319723 - DNA, 25 bp, Mus musculus
tgatgtcacggcagctttgatacaa

SEQ ID NO: 319724 - DNA, 25 bp, Mus musculus
agcgtgagcggaaccaacttggtgc

SEQ ID NO: 319725 - DNA, 25 bp, Mus musculus
gagtaccttcgcaaaaccactgacc

SEQ ID NO: 319726 - DNA, 25 bp, Mus musculus
tggccagggagatcagagtaccttc

SEQ ID NO: 319727 - DNA, 25 bp, Mus musculus
agttggtggattcgcctctaccctc

SEQ ID NO: 319728 - DNA, 25 bp, Mus musculus
acctagcttgcaccaggagtgggaa

SEQ ID NO: 319729 - DNA, 25 bp, Mus musculus
gaccgcgggacgcacctagcttgca

SEQ ID NO: 319730 - DNA, 25 bp, Mus musculus
ctcccggatgccaggtaagcggcga

SEQ ID NO: 319731 - DNA, 25 bp, Mus musculus
tgttcatctacagcggcccgacctg

SEQ ID NO: 319732 - DNA, 25 bp, Mus musculus
cagccgctggcttcttgttcatcta

SEQ ID NO: 319733 - DNA, 25 bp, Mus musculus
ttctgagcacggtgctggcttcgtc

SEQ ID NO: 319734 - DNA, 25 bp, Mus musculus
gcgcgcctcccggattgttttctga

SEQ ID NO: 319735 - DNA, 25 bp, Mus musculus
gagcttgggcgcctcgtgatgtcac

SEQ ID NO: 319736 - DNA, 25 bp, Mus musculus
cggattgttttctgagcacggtgct

SEQ ID NO: 319737 - DNA, 25 bp, Mus musculus
cgacgtaaacgtcgacgaaatggag

SEQ ID NO: 319738 - DNA, 25 bp, Mus musculus
agctctgaggcctctcccggctgtg

SEQ ID NO: 319739 - DNA, 25 bp, Mus musculus
aggccgggacccgtcagtcagagcc

SEQ ID NO: 319740 - DNA, 25 bp, Mus musculus
tccgctaagctgacgccgggcggaa

SEQ ID NO: 319741 - DNA, 25 bp, Mus musculus
agcactgtccgctaagctgacgccg

SEQ ID NO: 319742 - DNA, 25 bp, Mus musculus
agctttcccgtgtcctcagggcttc

SEQ ID NO: 319743 - DNA, 25 bp, Mus musculus
tctcccggctgtgtgaggcccgagc

SEQ ID NO: 319744 - DNA, 25 bp, Mus musculus
gccctcttggcctccgttattctcc

SEQ ID NO: 319745 - DNA, 25 bp, Mus musculus
gatgaccgccctccgtctcggtagt

SEQ ID NO: 319746 - DNA, 25 bp, Mus musculus
ttaaagtcccgtctgtccctcaatc

SEQ ID NO: 319747 - DNA, 25 bp, Mus musculus
ctaaagcgaattaaagtcccgtctg

SEQ ID NO: 319748 - DNA, 25 bp, Mus musculus
acccgtcagtcagagccgctcggtg

SEQ ID NO: 319749 - DNA, 25 bp, Mus musculus
aacgtcgacgaaatggaggaccgag

SEQ ID NO: 319750 - DNA, 25 bp, Mus musculus
ctcgcctagaactaaacctaaagcg

SEQ ID NO: 319751 - DNA, 25 bp, Mus musculus
caagactgccctctcggtcagggtg

SEQ ID NO: 319752 - DNA, 25 bp, Mus musculus
tggcctacaaagtcccagtcctcgg

SEQ ID NO: 319753 - DNA, 25 bp, Mus musculus
tctttgcgggcaagatgagagtgtc

SEQ ID NO: 319754 - DNA, 25 bp, Mus musculus
gcacggcatccggaactccaagacg

SEQ ID NO: 319755 - DNA, 25 bp, Mus musculus
aaactgtcctcgagccaagagcggg

SEQ ID NO: 319756 - DNA, 25 bp, Mus musculus
ctgcgcgtcgtgtaaaccttcgagg

SEQ ID NO: 319757 - DNA, 25 bp, Mus musculus
cctcgccgagctgagcgcaggtaac

SEQ ID NO: 319758 - DNA, 25 bp, Mus musculus
agcgcacgaagctgcgggaacattg

SEQ ID NO: 319759 - DNA, 25 bp, Mus musculus
agcagcgcacatgtcttccggggcg

SEQ ID NO: 319760 - DNA, 25 bp, Mus musculus
tgtcaccagcacgtggagccagata

SEQ ID NO: 319761 - DNA, 25 bp, Mus musculus
gcgcagccttcctgatgtgtcacca

SEQ ID NO: 319762 - DNA, 25 bp, Mus musculus
ggtctttccgcccagattgtgagcg

SEQ ID NO: 319763 - DNA, 25 bp, Mus musculus
ggaaggcacttgagactgtctagtc

SEQ ID NO: 319764 - DNA, 25 bp, Mus musculus
aggtggcttctttgagaaactgtcc

SEQ ID NO: 319765 - DNA, 25 bp, Mus musculus
cccagtctctctctgaggcgccatg

SEQ ID NO: 319766 - DNA, 25 bp, Mus musculus
atgcgccagtctctctctgaggcgc

SEQ ID NO: 319767 - DNA, 25 bp, Mus musculus
cagtctctctctgaggcgccatgcg

SEQ ID NO: 319768 - DNA, 25 bp, Mus musculus
atgcgcccagtctctctctgaggcg

SEQ ID NO: 319769 - DNA, 25 bp, Mus musculus
gcgccatgcgccagtctctctctga

SEQ ID NO: 319770 - DNA, 25 bp, Mus musculus
ccagtctctctctgaggcgccatgc

SEQ ID NO: 319771 - DNA, 25 bp, Mus musculus
cgccatgcgcccagtctctctctga

SEQ ID NO: 319772 - DNA, 25 bp, Mus musculus
cgcccagtctctctctgaggcgcca

SEQ ID NO: 319773 - DNA, 25 bp, Mus musculus
gcgccatgcgcccagtctctctctg

SEQ ID NO: 319774 - DNA, 25 bp, Mus musculus
gccatgcgccagtctctctctgagg

SEQ ID NO: 319775 - DNA, 25 bp, Mus musculus
gccatgcgcccagtctctctctgag

SEQ ID NO: 319776 - DNA, 25 bp, Mus musculus
catgcgccagtctctctctgaggcg

SEQ ID NO: 319777 - DNA, 25 bp, Mus musculus
gcccagtctctctctgaggcgccat

SEQ ID NO: 319778 - DNA, 25 bp, Mus musculus
gccagtctctctctgaggcgccatg

SEQ ID NO: 319779 - DNA, 25 bp, Mus musculus
tccgccatgaggctggaacttcaca

SEQ ID NO: 319780 - DNA, 25 bp, Mus musculus
tgctcctgtcgcaggttctcgcttc

SEQ ID NO: 319781 - DNA, 25 bp, Mus musculus
gtacgctacctggaagtcatttgtt

SEQ ID NO: 319782 - DNA, 25 bp, Mus musculus
cccggaatacctgataggagcttta

SEQ ID NO: 319783 - DNA, 25 bp, Mus musculus
gggctaaatcctcgcgcctcggaga

SEQ ID NO: 319784 - DNA, 25 bp, Mus musculus
accttttccggtctgggaatgcatc

SEQ ID NO: 319785 - DNA, 25 bp, Mus musculus
cctccctgtggttgactataggatt

SEQ ID NO: 319786 - DNA, 25 bp, Mus musculus
taagcgtagagaacagccacctttc

SEQ ID NO: 319787 - DNA, 25 bp, Mus musculus
cgttcctgaattatctccgccatga

SEQ ID NO: 319788 - DNA, 25 bp, Mus musculus
ccgggattcgatcttctatacgttc

SEQ ID NO: 319789 - DNA, 25 bp, Mus musculus
ccagctgttccaactccgggattcg

SEQ ID NO: 319790 - DNA, 25 bp, Mus musculus
gaagagtccgatgcgctccagctgt

SEQ ID NO: 319791 - DNA, 25 bp, Mus musculus
ttaatctccgcgtgactgaagagtc

SEQ ID NO: 319792 - DNA, 25 bp, Mus musculus
cttagtgattgactgaacgtgcttc

SEQ ID NO: 319793 - DNA, 25 bp, Mus musculus
ccgcggttcaccgtctggcggatgc

SEQ ID NO: 319794 - DNA, 25 bp, Mus musculus
cgccgcgtcgctcgtaaagcttatc

SEQ ID NO: 319795 - DNA, 25 bp, Mus musculus
gtccaggtagtacttgcggttctcg

SEQ ID NO: 319796 - DNA, 25 bp, Mus musculus
ccgtacttgttgcagccgacgtcga

SEQ ID NO: 319797 - DNA, 25 bp, Mus musculus
gtcgcggaactcgatgaggccctgc

SEQ ID NO: 319798 - DNA, 25 bp, Mus musculus
aagaagcgcttcgagtccacggtga

SEQ ID NO: 319799 - DNA, 25 bp, Mus musculus
tgcagccgacgtcgaagaagaagcg

SEQ ID NO: 319800 - DNA, 25 bp, Mus musculus
gtaggacggcttcacctcgctcact

SEQ ID NO: 319801 - DNA, 25 bp, Mus musculus
ccttgaagggcacggtgatggcatt

SEQ ID NO: 319802 - DNA, 25 bp, Mus musculus
gacagaaggcgcctccaaacttgcc

SEQ ID NO: 319803 - DNA, 25 bp, Mus musculus
tttcatctgcataccgacagaaggc

SEQ ID NO: 319804 - DNA, 25 bp, Mus musculus
agcttatccctctgtcgctcctgga

SEQ ID NO: 319805 - DNA, 25 bp, Mus musculus
ggccaccgccatcgacagcgtgagg

SEQ ID NO: 319806 - DNA, 25 bp, Mus musculus
gtcgctcctggatctctttcatttc

SEQ ID NO: 319807 - DNA, 25 bp, Mus musculus
ctggcgaacggacaggtcttagtta

SEQ ID NO: 319808 - DNA, 25 bp, Mus musculus
aggtcttagttagctgggtgtcgca

SEQ ID NO: 319809 - DNA, 25 bp, Mus musculus
tgatccttctccgagcgagcgacgg

SEQ ID NO: 319810 - DNA, 25 bp, Mus musculus
ttctccgagcgagcgacggaccggc

SEQ ID NO: 319811 - DNA, 25 bp, Mus musculus
tcgcgacaacaggaccgggtcacca

SEQ ID NO: 319812 - DNA, 25 bp, Mus musculus
gggtccgcgactgcgctcgcgacaa

SEQ ID NO: 319813 - DNA, 25 bp, Mus musculus
gcaggcaccgccctaaggaagtctc

SEQ ID NO: 319814 - DNA, 25 bp, Mus musculus
tcacggagcaggcaccgccctaagg

SEQ ID NO: 319815 - DNA, 25 bp, Mus musculus
gaaccgatgctttcctcacggagca

SEQ ID NO: 319816 - DNA, 25 bp, Mus musculus
gtgcaggaatggaaccgatgctttc

SEQ ID NO: 319817 - DNA, 25 bp, Mus musculus
tgcccaccacacgttccttgtgaaa

SEQ ID NO: 319818 - DNA, 25 bp, Mus musculus
ttccttgtgaaagcaggccgtgggc

SEQ ID NO: 319819 - DNA, 25 bp, Mus musculus
cagctccgggtgcaggaatggaacc

SEQ ID NO: 319820 - DNA, 25 bp, Mus musculus
tagttagctgggtgtcgcagctccg

SEQ ID NO: 319821 - DNA, 25 bp, Mus musculus
tcctccaggcctttgagagtgagtg

SEQ ID NO: 319822 - DNA, 25 bp, Mus musculus
accacacagtctcgggatccgcggt

SEQ ID NO: 319823 - DNA, 25 bp, Mus musculus
gtccaggctgaccacgagcttttcc

SEQ ID NO: 319824 - DNA, 25 bp, Mus musculus
gtggacctccgctcctttcaaaggc

SEQ ID NO: 319825 - DNA, 25 bp, Mus musculus
cggcgactgacgaagctctcaaggc

SEQ ID NO: 319826 - DNA, 25 bp, Mus musculus
aggcggcggcagttactcggcctcc

SEQ ID NO: 319827 - DNA, 25 bp, Mus musculus
tctcaaggcgagaaacggctcccaa

SEQ ID NO: 319828 - DNA, 25 bp, Mus musculus
acaatgcaccgggacgagcaggaag

SEQ ID NO: 319829 - DNA, 25 bp, Mus musculus
ttcccgcgaattcagttcaaagagg

SEQ ID NO: 319830 - DNA, 25 bp, Mus musculus
ttcagttcaaagaggcgtccgggcc

SEQ ID NO: 319831 - DNA, 25 bp, Mus musculus
cgagaagcgcctccgcgtgactgac

SEQ ID NO: 319832 - DNA, 25 bp, Mus musculus
caggaaccgcgatggcgcctcagaa

SEQ ID NO: 319833 - DNA, 25 bp, Mus musculus
gttgccggtgaagaagccgaaaatg

SEQ ID NO: 319834 - DNA, 25 bp, Mus musculus
ccgaaaatggagcacgtccaggctg

SEQ ID NO: 319835 - DNA, 25 bp, Mus musculus
agcggccctccgacctgcctctgcg

SEQ ID NO: 319836 - DNA, 25 bp, Mus musculus
cagctcccgccggtagctctgcgcc

SEQ ID NO: 319837 - DNA, 25 bp, Mus musculus
tccacgttctcgcgggcttcctgaa

SEQ ID NO: 319838 - DNA, 25 bp, Mus musculus
ggcttcctgaagcagcacctcgggc

SEQ ID NO: 319839 - DNA, 25 bp, Mus musculus
gcttcctgaagcagcacctcgggct

SEQ ID NO: 319840 - DNA, 25 bp, Mus musculus
ccgctgccgcttgattgacagacgc

SEQ ID NO: 319841 - DNA, 25 bp, Mus musculus
cctgaagcagcacctcgggctccgg

SEQ ID NO: 319842 - DNA, 25 bp, Mus musculus
ccgccctgccctgtccttcacgccc

SEQ ID NO: 319843 - DNA, 25 bp, Mus musculus
actgcgcctagctcccgcgagcgac

SEQ ID NO: 319844 - DNA, 25 bp, Mus musculus
gcccgccggattcccgactgcgcct

SEQ ID NO: 319845 - DNA, 25 bp, Mus musculus
cgcccttcatctggtcgcgcggccc

SEQ ID NO: 319846 - DNA, 25 bp, Mus musculus
cccgctgccgcttgattgacagacg

SEQ ID NO: 319847 - DNA, 25 bp, Mus musculus
ctccatcgcgcccttcatctggtcg

SEQ ID NO: 319848 - DNA, 25 bp, Mus musculus
gctgccgcttgattgacagacgccg

SEQ ID NO: 319849 - DNA, 25 bp, Mus musculus
tcgcgggactcgagatcactgagcc

SEQ ID NO: 319850 - DNA, 25 bp, Mus musculus
agcgaacccggtgccagctgcacgg

SEQ ID NO: 319851 - DNA, 25 bp, Mus musculus
agcaccaacgccagcgaacccggtg

SEQ ID NO: 319852 - DNA, 25 bp, Mus musculus
cgttccagaagcagcgcgcgttggc

SEQ ID NO: 319853 - DNA, 25 bp, Mus musculus
cgccagccgtgcgttccagaagcag

SEQ ID NO: 319854 - DNA, 25 bp, Mus musculus
gacgccacgcatcccgcagcacctg

SEQ ID NO: 319855 - DNA, 25 bp, Mus musculus
ccaccgcggtgatgcggaagcctcg

SEQ ID NO: 319856 - DNA, 25 bp, Mus musculus
gggacctgttgctatgaccccgggc

SEQ ID NO: 319857 - DNA, 25 bp, Mus musculus
ttcccacagcaaccagaagagccgg

SEQ ID NO: 319858 - DNA, 25 bp, Mus musculus
agggcgtcgctgtcactcccggttc

SEQ ID NO: 319859 - DNA, 25 bp, Mus musculus
gctttctagggcgtcgctgtcactc

SEQ ID NO: 319860 - DNA, 25 bp, Mus musculus
ggactcgagatcactgagcccacct

SEQ ID NO: 319861 - DNA, 25 bp, Mus musculus
gcaaccagaagagccggtggcatcg

SEQ ID NO: 319862 - DNA, 25 bp, Mus musculus
tcacccaccgcggtgatgcggaagc

SEQ ID NO: 319863 - DNA, 25 bp, Mus musculus
gtctctacgagacccgagacgggct

SEQ ID NO: 319864 - DNA, 25 bp, Mus musculus
ccgatctgcgttctgtggggctcga

SEQ ID NO: 319865 - DNA, 25 bp, Mus musculus
cccactagtccgatctgcgttctgt

SEQ ID NO: 319866 - DNA, 25 bp, Mus musculus
aattgacagaactcccgccgaagcc

SEQ ID NO: 319867 - DNA, 25 bp, Mus musculus
gcagcctccgacagcggtcgtaggc

SEQ ID NO: 319868 - DNA, 25 bp, Mus musculus
agtagtttgtccttcgcggctcacc

SEQ ID NO: 319869 - DNA, 25 bp, Mus musculus
gattcgccaaaggaagtagtttgtc

SEQ ID NO: 319870 - DNA, 25 bp, Mus musculus
cgcgcgcagattcgccaaaggaagt

SEQ ID NO: 319871 - DNA, 25 bp, Mus musculus
ggggcaccttgtattgtcccgccgc

SEQ ID NO: 319872 - DNA, 25 bp, Mus musculus
gggcttcccgtacatctctgtctga

SEQ ID NO: 319873 - DNA, 25 bp, Mus musculus
acatctctgtctgagtctgactcgg

SEQ ID NO: 319874 - DNA, 25 bp, Mus musculus
tgtctgagtctgactcggcggccct

SEQ ID NO: 319875 - DNA, 25 bp, Mus musculus
tccggccggtggtctctacgagacc

SEQ ID NO: 319876 - DNA, 25 bp, Mus musculus
gctcgagcgcttattctggagaatc

SEQ ID NO: 319877 - DNA, 25 bp, Mus musculus
ggagccttggggatctgaatccttc

SEQ ID NO: 319878 - DNA, 25 bp, Mus musculus
atcagatgcggtccatgccctgggt

SEQ ID NO: 319879 - DNA, 25 bp, Mus musculus
tctgaatccttctccggcggacagg

SEQ ID NO: 319880 - DNA, 25 bp, Mus musculus
aacgccggaccatgggcgtccagga

SEQ ID NO: 319881 - DNA, 25 bp, Mus musculus
cgaccgcgagcgcaacaagaagcgg

SEQ ID NO: 319882 - DNA, 25 bp, Mus musculus
agcgcaacaagaagcggctgctgga

SEQ ID NO: 319883 - DNA, 25 bp, Mus musculus
ttccctaggagcacgtcaacgcgct

SEQ ID NO: 319884 - DNA, 25 bp, Mus musculus
ggagcacgtcaacgcgctactcaga

SEQ ID NO: 319885 - DNA, 25 bp, Mus musculus
actcagactcgctctcgcttggaac

SEQ ID NO: 319886 - DNA, 25 bp, Mus musculus
ccagtccttctcactggagagtttc

SEQ ID NO: 319887 - DNA, 25 bp, Mus musculus
ctcactggagagtttcgggcggccc

SEQ ID NO: 319888 - DNA, 25 bp, Mus musculus
cgctccgcatcagatgcggtccatg

SEQ ID NO: 319889 - DNA, 25 bp, Mus musculus
aggaccctgctctggacaccatttc

SEQ ID NO: 319890 - DNA, 25 bp, Mus musculus
gcgaccgaactgtcctggagccttg

SEQ ID NO: 319891 - DNA, 25 bp, Mus musculus
cccggctcccaagcggagcggtaga

SEQ ID NO: 319892 - DNA, 25 bp, Mus musculus
ggcctcagcgtttgtcgggccacct

SEQ ID NO: 319893 - DNA, 25 bp, Mus musculus
ggttttgcgctaccgtctgccttcc

SEQ ID NO: 319894 - DNA, 25 bp, Mus musculus
taccgtctgccttcctgcaggggcg

SEQ ID NO: 319895 - DNA, 25 bp, Mus musculus
tgcaggggcgctgttcaagatacga

SEQ ID NO: 319896 - DNA, 25 bp, Mus musculus
caagatacgagagcgttgaggttcc

SEQ ID NO: 319897 - DNA, 25 bp, Mus musculus
ttgaggttccgaaagctcttgtccc

SEQ ID NO: 319898 - DNA, 25 bp, Mus musculus
atgaagaaagacgtgaggatcctgc

SEQ ID NO: 319899 - DNA, 25 bp, Mus musculus
ggagaacgtgagtccgcgccctgcc

SEQ ID NO: 319900 - DNA, 25 bp, Mus musculus
ccggtcctctcgctgcgaaagctgt

SEQ ID NO: 319901 - DNA, 25 bp, Mus musculus
tcgctgcgaaagctgtcgccgtcgc

SEQ ID NO: 319902 - DNA, 25 bp, Mus musculus
acctcctcgagttctttcctcttgg

SEQ ID NO: 319903 - DNA, 25 bp, Mus musculus
agttctttcctcttgggcctcagcg

SEQ ID NO: 319904 - DNA, 25 bp, Mus musculus
tgcgagcctccgacatgaagaaaga

SEQ ID NO: 319905 - DNA, 25 bp, Mus musculus
gcttcactgcgggacacagcccggg

SEQ ID NO: 319906 - DNA, 25 bp, Mus musculus
tctgatcagcgcagaccgctctgga

SEQ ID NO: 319907 - DNA, 25 bp, Mus musculus
gccgcagatgcccagtctctgatca

SEQ ID NO: 319908 - DNA, 25 bp, Mus musculus
ctgcggactctgcaagcccggggaa

SEQ ID NO: 319909 - DNA, 25 bp, Mus musculus
gcggccgcgtcactgtagtgacttc

SEQ ID NO: 319910 - DNA, 25 bp, Mus musculus
cagtctgggccatgggcgagcaccc

SEQ ID NO: 319911 - DNA, 25 bp, Mus musculus
cgccgcgccagaagacgtgagtgcc

SEQ ID NO: 319912 - DNA, 25 bp, Mus musculus
tcctgtgtccctcaaactttctggg

SEQ ID NO: 319913 - DNA, 25 bp, Mus musculus
ttctcggctgccagattagctcccg

SEQ ID NO: 319914 - DNA, 25 bp, Mus musculus
gcccgcgacagaggccaagaagttt

SEQ ID NO: 319915 - DNA, 25 bp, Mus musculus
cccgcagacaacttagaggcttcaa

SEQ ID NO: 319916 - DNA, 25 bp, Mus musculus
ggcgcagctagctcctggagcagca

SEQ ID NO: 319917 - DNA, 25 bp, Mus musculus
ttcaaggttatgtcaccggagcgtc

SEQ ID NO: 319918 - DNA, 25 bp, Mus musculus
ggacacggcgttttcctgcagaggc

SEQ ID NO: 319919 - DNA, 25 bp, Mus musculus
cccgccctcgcacatctgagttccg

SEQ ID NO: 319920 - DNA, 25 bp, Mus musculus
ccatccagcgattcctgcaaagacg

SEQ ID NO: 319921 - DNA, 25 bp, Mus musculus
gagcatcgcggcaacctcctcgggg

SEQ ID NO: 319922 - DNA, 25 bp, Mus musculus
ttgtgcgccggctcgacttcctccc

SEQ ID NO: 319923 - DNA, 25 bp, Mus musculus
gctgtcctttgtgcgccggctcgac

SEQ ID NO: 319924 - DNA, 25 bp, Mus musculus
ccgggctgtcctttgtgcgccggct

SEQ ID NO: 319925 - DNA, 25 bp, Mus musculus
cggcaacctcctcggggccctgtgt

SEQ ID NO: 319926 - DNA, 25 bp, Mus musculus
agacgggagcatcgcggcaacctcc

SEQ ID NO: 319927 - DNA, 25 bp, Mus musculus
caaagacgggagcatcgcggcaacc

SEQ ID NO: 319928 - DNA, 25 bp, Mus musculus
ctgcaaagacgggagcatcgcggca

SEQ ID NO: 319929 - DNA, 25 bp, Mus musculus
ttcctgcaaagacgggagcatcgcg

SEQ ID NO: 319930 - DNA, 25 bp, Mus musculus
cgattcctgcaaagacgggagcatc

SEQ ID NO: 319931 - DNA, 25 bp, Mus musculus
tccagcgattcctgcaaagacggga

SEQ ID NO: 319932 - DNA, 25 bp, Mus musculus
cagcgattcctgcaaagacgggagc

SEQ ID NO: 319933 - DNA, 25 bp, Mus musculus
actcagggccgaagcctgcgtcacg

SEQ ID NO: 319934 - DNA, 25 bp, Mus musculus
tgtctgtttcctgcgggacgcgctg

SEQ ID NO: 319935 - DNA, 25 bp, Mus musculus
cgggatagccgacgtactggatgac

SEQ ID NO: 319936 - DNA, 25 bp, Mus musculus
agccgacgtactggatgacccaagc

SEQ ID NO: 319937 - DNA, 25 bp, Mus musculus
gacgtactggatgacccaagctcta

SEQ ID NO: 319938 - DNA, 25 bp, Mus musculus
tggatgacccaagctctaaaggatc

SEQ ID NO: 319939 - DNA, 25 bp, Mus musculus
cccaagctctaaaggatcagcgtcc

SEQ ID NO: 319940 - DNA, 25 bp, Mus musculus
ctctaaaggatcagcgtcctcagcc

SEQ ID NO: 319941 - DNA, 25 bp, Mus musculus
cagcgcccgctcagccactcagggc

SEQ ID NO: 319942 - DNA, 25 bp, Mus musculus
tgcgtcacgtgacccgcacagctct

SEQ ID NO: 319943 - DNA, 25 bp, Mus musculus
gatagaacgagggtgtcggccattt

SEQ ID NO: 319944 - DNA, 25 bp, Mus musculus
agaacgagggtgtcggccattttgt

SEQ ID NO: 319945 - DNA, 25 bp, Mus musculus
gcacagctctcaccgcggtggctga

SEQ ID NO: 319946 - DNA, 25 bp, Mus musculus
cattttgtgtctgtttcctgcggga

SEQ ID NO: 319947 - DNA, 25 bp, Mus musculus
agccggctatggtgctgctgactca

SEQ ID NO: 319948 - DNA, 25 bp, Mus musculus
cccatggcttccaatcgggcgggaa

SEQ ID NO: 319949 - DNA, 25 bp, Mus musculus
acctgctgcctgctgactcacggtg

SEQ ID NO: 319950 - DNA, 25 bp, Mus musculus
cgactgccgcgcaggactgacattt

SEQ ID NO: 319951 - DNA, 25 bp, Mus musculus
ccgccgttgttatcagcacaggttg

SEQ ID NO: 319952 - DNA, 25 bp, Mus musculus
tctctactcagcaccgaccgggagg

SEQ ID NO: 319953 - DNA, 25 bp, Mus musculus
acaactcccggggtgctcggagaag

SEQ ID NO: 319954 - DNA, 25 bp, Mus musculus
tccactccatcggtaaagggcctgg

SEQ ID NO: 319955 - DNA, 25 bp, Mus musculus
tcctgggccacccacggggcagaga

SEQ ID NO: 319956 - DNA, 25 bp, Mus musculus
ctcgtttgtcgcttgcgggacgctc

SEQ ID NO: 319957 - DNA, 25 bp, Mus musculus
ggactgacatttcccgccgttgtta

SEQ ID NO: 319958 - DNA, 25 bp, Mus musculus
tgggagctgtcgcttacagccagcc

SEQ ID NO: 319959 - DNA, 25 bp, Mus musculus
cgcgagcgcttctcttggagttttc

SEQ ID NO: 319960 - DNA, 25 bp, Mus musculus
ttccagagagcccagtctctactca

SEQ ID NO: 319961 - DNA, 25 bp, Mus musculus
tgctccaccgcaggctgatctcctg

SEQ ID NO: 319962 - DNA, 25 bp, Mus musculus
gaatagccctgcacggcgcctgtgc

SEQ ID NO: 319963 - DNA, 25 bp, Mus musculus
gcctgtgccctgatgacggaagata

SEQ ID NO: 319964 - DNA, 25 bp, Mus musculus
tgagggccgcagcacatgctaggaa

SEQ ID NO: 319965 - DNA, 25 bp, Mus musculus
agcacatgctaggaaggacccgcca

SEQ ID NO: 319966 - DNA, 25 bp, Mus musculus
tgctaggaaggacccgccagccatg

SEQ ID NO: 319967 - DNA, 25 bp, Mus musculus
gccagccatggctgccagctgagga

SEQ ID NO: 319968 - DNA, 25 bp, Mus musculus
agctgaggacgctcacgtgtgctta

SEQ ID NO: 319969 - DNA, 25 bp, Mus musculus
ctcacgtgtgcttaaagttacggtc

SEQ ID NO: 319970 - DNA, 25 bp, Mus musculus
aaagttacggtcacagcagcgagcc

SEQ ID NO: 319971 - DNA, 25 bp, Mus musculus
cgcgggctccaagacactgacgtca

SEQ ID NO: 319972 - DNA, 25 bp, Mus musculus
gagctcagccatctctacctggact

SEQ ID NO: 319973 - DNA, 25 bp, Mus musculus
tacctggactcggaatagccctgca

SEQ ID NO: 319974 - DNA, 25 bp, Mus musculus
gccctgatgacggaagataaggtga

SEQ ID NO: 319975 - DNA, 25 bp, Mus musculus
aggccactgcggctctttgaccggt

SEQ ID NO: 319976 - DNA, 25 bp, Mus musculus
tccgcaggactaaacgcgtcgtgtc

SEQ ID NO: 319977 - DNA, 25 bp, Mus musculus
ccgctacaggctcggtaagccttta

SEQ ID NO: 319978 - DNA, 25 bp, Mus musculus
ttgttttccacgcagatccgcagga

SEQ ID NO: 319979 - DNA, 25 bp, Mus musculus
ccagctatcggaaggccacactgtt

SEQ ID NO: 319980 - DNA, 25 bp, Mus musculus
ccacactgtttgaggatggcgcggc

SEQ ID NO: 319981 - DNA, 25 bp, Mus musculus
tacacggccgtgcagaacagcaaga

SEQ ID NO: 319982 - DNA, 25 bp, Mus musculus
tgaagcggcactccatcatctcggt

SEQ ID NO: 319983 - DNA, 25 bp, Mus musculus
atcatctcggtgctgccttggaaga

SEQ ID NO: 319984 - DNA, 25 bp, Mus musculus
cggtgtcagcgaagaagaagaactc

SEQ ID NO: 319985 - DNA, 25 bp, Mus musculus
ccggggctgagaaccatcttgtttt

SEQ ID NO: 319986 - DNA, 25 bp, Mus musculus
cggcgtctgcagaaccttggacaga

SEQ ID NO: 319987 - DNA, 25 bp, Mus musculus
tgaagaagtcgctgtcctgtgccaa

SEQ ID NO: 319988 - DNA, 25 bp, Mus musculus
agctaccagagcaacatcgcgcatc

SEQ ID NO: 319989 - DNA, 25 bp, Mus musculus
acgaagtccgccttgccgaactcaa

SEQ ID NO: 319990 - DNA, 25 bp, Mus musculus
cgccgcactcactcgcgggagctgc

SEQ ID NO: 319991 - DNA, 25 bp, Mus musculus
cccggcatggctgtcgagacgcgct

SEQ ID NO: 319992 - DNA, 25 bp, Mus musculus
tggctgtcgagacgcgctcacctga

SEQ ID NO: 319993 - DNA, 25 bp, Mus musculus
tcacctgagcctaaggttggccatg

SEQ ID NO: 319994 - DNA, 25 bp, Mus musculus
ctaaggttggccatgaactcgggca

SEQ ID NO: 319995 - DNA, 25 bp, Mus musculus
aactcgggcatggagacggtgtcca

SEQ ID NO: 319996 - DNA, 25 bp, Mus musculus
gtccatcagcacgaagtccgccttg

SEQ ID NO: 319997 - DNA, 25 bp, Mus musculus
ttgccgaactcaaggctctcctgct

SEQ ID NO: 319998 - DNA, 25 bp, Mus musculus
agagcgagagagacggccgccactc

SEQ ID NO: 319999 - DNA, 25 bp, Mus musculus
actcctcagagctccagccggcgcg

SEQ ID NO: 320000 - DNA, 25 bp, Mus musculus
tggtcccgcctctagcctgggtccc

SEQ ID NO: 320001 - DNA, 25 bp, Mus musculus
ctaaagacaggcacgggcatctagc

SEQ ID NO: 320002 - DNA, 25 bp, Mus musculus
agacggtgtccatcagcacgaagtc

SEQ ID NO: 320003 - DNA, 25 bp, Mus musculus
tgaccggctgccaacgaacggaagc

SEQ ID NO: 320004 - DNA, 25 bp, Mus musculus
ggccggtctgagagaacctccaagc

SEQ ID NO: 320005 - DNA, 25 bp, Mus musculus
atcccggggtgaggacactcatctt

SEQ ID NO: 320006 - DNA, 25 bp, Mus musculus
cacgcgccggccgtgaaagatggaa

SEQ ID NO: 320007 - DNA, 25 bp, Mus musculus
gcggctccaaaagaaccactgcgaa

SEQ ID NO: 320008 - DNA, 25 bp, Mus musculus
agaagccatttcaaacccgtcaagc

SEQ ID NO: 320009 - DNA, 25 bp, Mus musculus
ccgtgaaagatggaaggcagcgccc

SEQ ID NO: 320010 - DNA, 25 bp, Mus musculus
aacccgtcaagctcaggcgcatgcg

SEQ ID NO: 320011 - DNA, 25 bp, Mus musculus
cgtgcgcgaaaaaagttcggcgtgc

SEQ ID NO: 320012 - DNA, 25 bp, Mus musculus
gccgggttaccttgacttcgctgaa

SEQ ID NO: 320013 - DNA, 25 bp, Mus musculus
ttcgctgaacaatgagctggctgtc

SEQ ID NO: 320014 - DNA, 25 bp, Mus musculus
aggccaacgctgtccttccctggga

SEQ ID NO: 320015 - DNA, 25 bp, Mus musculus
ttcacctgagtctggcccgggttaa

SEQ ID NO: 320016 - DNA, 25 bp, Mus musculus
aacctccaagcgctggaaacgctcg

SEQ ID NO: 320017 - DNA, 25 bp, Mus musculus
tcgtcagtgactgtctcccagctgc

SEQ ID NO: 320018 - DNA, 25 bp, Mus musculus
tgcgggcagcactcggacttggcct

SEQ ID NO: 320019 - DNA, 25 bp, Mus musculus
cggcgtaccccggagctgcaattga

SEQ ID NO: 320020 - DNA, 25 bp, Mus musculus
ctgcaattgaggtgggtgagcacgc

SEQ ID NO: 320021 - DNA, 25 bp, Mus musculus
ctgctgggacactgctttgttctgc

SEQ ID NO: 320022 - DNA, 25 bp, Mus musculus
acactgctttgttctgccctgcgga

SEQ ID NO: 320023 - DNA, 25 bp, Mus musculus
ctttgttctgccctgcggaaacgga

SEQ ID NO: 320024 - DNA, 25 bp, Mus musculus
ttctgccctgcggaaacggagcagc

SEQ ID NO: 320025 - DNA, 25 bp, Mus musculus
cctgcggaaacggagcagcgcgcaa

SEQ ID NO: 320026 - DNA, 25 bp, Mus musculus
cagcgcgcaagttggggaccaaagt

SEQ ID NO: 320027 - DNA, 25 bp, Mus musculus
ggaccaaagttgagcgcgcgtacca

SEQ ID NO: 320028 - DNA, 25 bp, Mus musculus
agttgagcgcgcgtaccagccttcc

SEQ ID NO: 320029 - DNA, 25 bp, Mus musculus
aggggtcctccgatcgtcagtgact

SEQ ID NO: 320030 - DNA, 25 bp, Mus musculus
tcctccgatcgtcagtgactgtctc

SEQ ID NO: 320031 - DNA, 25 bp, Mus musculus
tgatcctgagagagagaccactggg

SEQ ID NO: 320032 - DNA, 25 bp, Mus musculus
tttctgctgagacgctcccaggctt

SEQ ID NO: 320033 - DNA, 25 bp, Mus musculus
agtggcgacttgcaccttccctttc

SEQ ID NO: 320034 - DNA, 25 bp, Mus musculus
accatgcctggtttggccagtcccg

SEQ ID NO: 320035 - DNA, 25 bp, Mus musculus
tgccggagctgctttctgctgagac

SEQ ID NO: 320036 - DNA, 25 bp, Mus musculus
tgccgcagcccgtgcaatttagtgc

SEQ ID NO: 320037 - DNA, 25 bp, Mus musculus
ccagtttttacgctgatcctgagag

SEQ ID NO: 320038 - DNA, 25 bp, Mus musculus
agagtcactgggcactacctccgga

SEQ ID NO: 320039 - DNA, 25 bp, Mus musculus
tcttccagaaggacgagagtcactg

SEQ ID NO: 320040 - DNA, 25 bp, Mus musculus
ctgctcccgacaggagctccggtgg

SEQ ID NO: 320041 - DNA, 25 bp, Mus musculus
cagcttgtgccagggaagcctgctc

SEQ ID NO: 320042 - DNA, 25 bp, Mus musculus
ggctcattcattcagcccgaggctg

SEQ ID NO: 320043 - DNA, 25 bp, Mus musculus
aatttagtgcgactcagggacggcc

SEQ ID NO: 320044 - DNA, 25 bp, Mus musculus
agtctggcccttagcccagtggtgc

SEQ ID NO: 320045 - DNA, 25 bp, Mus musculus
tccgcctccgagagaagcaaggatg

SEQ ID NO: 320046 - DNA, 25 bp, Mus musculus
agcatcctagcagccaacacgctta

SEQ ID NO: 320047 - DNA, 25 bp, Mus musculus
acacgcttagcttcttcccgggatg

SEQ ID NO: 320048 - DNA, 25 bp, Mus musculus
tcagccacgctgatgcagtgcggtg

SEQ ID NO: 320049 - DNA, 25 bp, Mus musculus
ggggatgtcagctcagccacgctga

SEQ ID NO: 320050 - DNA, 25 bp, Mus musculus
tcctgttaaccagcgcataatgccc

SEQ ID NO: 320051 - DNA, 25 bp, Mus musculus
tcttcccgggatgtatgggaccctg

SEQ ID NO: 320052 - DNA, 25 bp, Mus musculus
atgtatgggaccctggccgctgctt

SEQ ID NO: 320053 - DNA, 25 bp, Mus musculus
cagaattccaattgcgggctgcggc

SEQ ID NO: 320054 - DNA, 25 bp, Mus musculus
cttaaaacaagtcgctgagcagctc

SEQ ID NO: 320055 - DNA, 25 bp, Mus musculus
ctcggatcctgttaaccagcgcata

SEQ ID NO: 320056 - DNA, 25 bp, Mus musculus
ctgagcagctcggatcctgttaacc

SEQ ID NO: 320057 - DNA, 25 bp, Mus musculus
cgagagcgagggagaaaatgcttaa

SEQ ID NO: 320058 - DNA, 25 bp, Mus musculus
ctccctttagggacagaattccaat

SEQ ID NO: 320059 - DNA, 25 bp, Mus musculus
tgcatgtggggttaccaccgaaacc

SEQ ID NO: 320060 - DNA, 25 bp, Mus musculus
agcgagtgcctagagctccaccctt

SEQ ID NO: 320061 - DNA, 25 bp, Mus musculus
tgagacagcgacaccctaccggaga

SEQ ID NO: 320062 - DNA, 25 bp, Mus musculus
ggggttctgtacctacgagcgagta

SEQ ID NO: 320063 - DNA, 25 bp, Mus musculus
cctagcttcatctccatggggcagc

SEQ ID NO: 320064 - DNA, 25 bp, Mus musculus
tgctggagtccaagaccgagcactg

SEQ ID NO: 320065 - DNA, 25 bp, Mus musculus
cgagcactgcgaagggacaaacatc

SEQ ID NO: 320066 - DNA, 25 bp, Mus musculus
cgcctgtctcatccctgcaaggaaa

SEQ ID NO: 320067 - DNA, 25 bp, Mus musculus
cccggatggattaaagttgcctgga

SEQ ID NO: 320068 - DNA, 25 bp, Mus musculus
ctggattttctctctttgcgaaaga

SEQ ID NO: 320069 - DNA, 25 bp, Mus musculus
ctgggattttccctactgctgcagg

SEQ ID NO: 320070 - DNA, 25 bp, Mus musculus
cctacaacgcttacgggctggatac

SEQ ID NO: 320071 - DNA, 25 bp, Mus musculus
caccgaaaccgaggcgattcgagtt

SEQ ID NO: 320072 - DNA, 25 bp, Mus musculus
cggagactgtgaacctcggaaaagt

SEQ ID NO: 320073 - DNA, 25 bp, Mus musculus
agccagcaggttgagctctactata

SEQ ID NO: 320074 - DNA, 25 bp, Mus musculus
cccgggaactcaggctagccctata

SEQ ID NO: 320075 - DNA, 25 bp, Mus musculus
taccggttagctaccgcctgtcgca

SEQ ID NO: 320076 - DNA, 25 bp, Mus musculus
ttcctaaaggaagcgcggccactga

SEQ ID NO: 320077 - DNA, 25 bp, Mus musculus
ggcagcgatcaacggctccctacag

SEQ ID NO: 320078 - DNA, 25 bp, Mus musculus
tcggagcccttcgtggtgttccaaa

SEQ ID NO: 320079 - DNA, 25 bp, Mus musculus
caaaccaaggagttgccggtcctca

SEQ ID NO: 320080 - DNA, 25 bp, Mus musculus
tgcgcatcggcagcatcagtctgtt

SEQ ID NO: 320081 - DNA, 25 bp, Mus musculus
caggtgcttttctatgtggccggcc

SEQ ID NO: 320082 - DNA, 25 bp, Mus musculus
tcgcagcccgtagcacaggtgcttt

SEQ ID NO: 320083 - DNA, 25 bp, Mus musculus
gttaactggaaagtgcgcgccttca

SEQ ID NO: 320084 - DNA, 25 bp, Mus musculus
cccgagcgcttgacggttaactgga

SEQ ID NO: 320085 - DNA, 25 bp, Mus musculus
gggagcttttgcagccgtccagcac

SEQ ID NO: 320086 - DNA, 25 bp, Mus musculus
agacagcaacctgatgatccgcctg

SEQ ID NO: 320087 - DNA, 25 bp, Mus musculus
gcgcgcacaaggctaacagtttcta

SEQ ID NO: 320088 - DNA, 25 bp, Mus musculus
tatcacgcctcggaagctagactcg

SEQ ID NO: 320089 - DNA, 25 bp, Mus musculus
cgccataacaggaagtgacgctatc

SEQ ID NO: 320090 - DNA, 25 bp, Mus musculus
tgatcgcagccatggttcaacagtc

SEQ ID NO: 320091 - DNA, 25 bp, Mus musculus
agcgccagggttagcgattttgatc

SEQ ID NO: 320092 - DNA, 25 bp, Mus musculus
ctcacatttttagcgcgcccttagg

SEQ ID NO: 320093 - DNA, 25 bp, Mus musculus
cgcagcattgctcacaggttttcac

SEQ ID NO: 320094 - DNA, 25 bp, Mus musculus
aaccgggtgtctaaatgtcgcagca

SEQ ID NO: 320095 - DNA, 25 bp, Mus musculus
aggcgctctcttcctcggctagaga

SEQ ID NO: 320096 - DNA, 25 bp, Mus musculus
ctcgcctgagtcctgggcgcaaaca

SEQ ID NO: 320097 - DNA, 25 bp, Mus musculus
cctgagcaccaaccggaagaggatc

SEQ ID NO: 320098 - DNA, 25 bp, Mus musculus
gctgagctgcgcactgtgtaacacc

SEQ ID NO: 320099 - DNA, 25 bp, Mus musculus
gagctcctgtggcagacccatgttc

SEQ ID NO: 320100 - DNA, 25 bp, Mus musculus
tccgccaacttggatgccgctaggg

SEQ ID NO: 320101 - DNA, 25 bp, Mus musculus
agacaggcggtctattcatcgtgcg

SEQ ID NO: 320102 - DNA, 25 bp, Mus musculus
tccaacccaacactcagttcaagat

SEQ ID NO: 320103 - DNA, 25 bp, Mus musculus
caggatgccagagtgggcattctca

SEQ ID NO: 320104 - DNA, 25 bp, Mus musculus
gtctattcatcgtgcgggacccgtg

SEQ ID NO: 320105 - DNA, 25 bp, Mus musculus
cgtatttaaagagacaggcggtcta

SEQ ID NO: 320106 - DNA, 25 bp, Mus musculus
gctggagtacccgtatttaaagaga

SEQ ID NO: 320107 - DNA, 25 bp, Mus musculus
ctcagttcaagatttccgggtagga

SEQ ID NO: 320108 - DNA, 25 bp, Mus musculus
tccgggtaggaatagaacagcgacc

SEQ ID NO: 320109 - DNA, 25 bp, Mus musculus
aacagcgacccacgtggcgaccgga

SEQ ID NO: 320110 - DNA, 25 bp, Mus musculus
tccgagggcgcaagtcggttactgc

SEQ ID NO: 320111 - DNA, 25 bp, Mus musculus
tagttatttgtcgtatcccgggatg

SEQ ID NO: 320112 - DNA, 25 bp, Mus musculus
ccgcacagcctgtgggcagaacggc

SEQ ID NO: 320113 - DNA, 25 bp, Mus musculus
tgctgcttgctcttcgggctcccgg

SEQ ID NO: 320114 - DNA, 25 bp, Mus musculus
gcagaacggcgtgctgcttgctctt

SEQ ID NO: 320115 - DNA, 25 bp, Mus musculus
cgtcccgggttacggcgcacacaga

SEQ ID NO: 320116 - DNA, 25 bp, Mus musculus
cggcgcacacagacgaaatgctttg

SEQ ID NO: 320117 - DNA, 25 bp, Mus musculus
agacgaaatgctttgcggcactttc

SEQ ID NO: 320118 - DNA, 25 bp, Mus musculus
tgctttgcggcactttcatgggaca

SEQ ID NO: 320119 - DNA, 25 bp, Mus musculus
tgcggcactttcatgggacaggtgt

SEQ ID NO: 320120 - DNA, 25 bp, Mus musculus
gagttcctggaaagggctgccccac

SEQ ID NO: 320121 - DNA, 25 bp, Mus musculus
ggagcgcagctggatcctcacaccc

SEQ ID NO: 320122 - DNA, 25 bp, Mus musculus
agcacagcctgaagcaccggatcct

SEQ ID NO: 320123 - DNA, 25 bp, Mus musculus
gccacacctgggacggcagaggcca

SEQ ID NO: 320124 - DNA, 25 bp, Mus musculus
gggtgcccgaaccacatcctcacgg

SEQ ID NO: 320125 - DNA, 25 bp, Mus musculus
ccgccaccatagagaggaatcgggc

SEQ ID NO: 320126 - DNA, 25 bp, Mus musculus
caccatagagaggaatcgggcgcgc

SEQ ID NO: 320127 - DNA, 25 bp, Mus musculus
cgcggcggtctagagtgcaagcctc

SEQ ID NO: 320128 - DNA, 25 bp, Mus musculus
tagagtgcaagcctccgcgagcgcc

SEQ ID NO: 320129 - DNA, 25 bp, Mus musculus
gtccagtaaaagcaaagatggactt

SEQ ID NO: 320130 - DNA, 25 bp, Mus musculus
tggatgtccagtaaaagcaaagatg

SEQ ID NO: 320131 - DNA, 25 bp, Mus musculus
ggtgagcgctcaccggcgcgtcctg

SEQ ID NO: 320132 - DNA, 25 bp, Mus musculus
ccacttggctttgtttttggatgtc

SEQ ID NO: 320133 - DNA, 25 bp, Mus musculus
cgaggcttttgctgcccacttggct

SEQ ID NO: 320134 - DNA, 25 bp, Mus musculus
tgaccggcgaggcttttgctgccca

SEQ ID NO: 320135 - DNA, 25 bp, Mus musculus
aacttgggccactgggctgtgccgt

SEQ ID NO: 320136 - DNA, 25 bp, Mus musculus
gcctggggccacaaaggaagtgggc

SEQ ID NO: 320137 - DNA, 25 bp, Mus musculus
tggctttgtttttggatgtccagta

SEQ ID NO: 320138 - DNA, 25 bp, Mus musculus
gcctgctccagacggcctgtcaggg

SEQ ID NO: 320139 - DNA, 25 bp, Mus musculus
ccggaggaagtgccgcgcctttccg

SEQ ID NO: 320140 - DNA, 25 bp, Mus musculus
ccagagcgagcatgtagcggccgct

SEQ ID NO: 320141 - DNA, 25 bp, Mus musculus
ccgcacgcggcgacatggaggagga

SEQ ID NO: 320142 - DNA, 25 bp, Mus musculus
tggcctgggctggaacttgggccac

SEQ ID NO: 320143 - DNA, 25 bp, Mus musculus
agcgtcttttgtaggccaggcctgc

SEQ ID NO: 320144 - DNA, 25 bp, Mus musculus
tcgaggtgagggacactaacccttc

SEQ ID NO: 320145 - DNA, 25 bp, Mus musculus
ctgcagcgccatctgctgaccatga

SEQ ID NO: 320146 - DNA, 25 bp, Mus musculus
atgcaagtcgaggtgagggacacta

SEQ ID NO: 320147 - DNA, 25 bp, Mus musculus
ttcccaactcgcaagactctaggcg

SEQ ID NO: 320148 - DNA, 25 bp, Mus musculus
aactcgcaagactctaggcgcccta

SEQ ID NO: 320149 - DNA, 25 bp, Mus musculus
tcgcaagactctaggcgccctaggc

SEQ ID NO: 320150 - DNA, 25 bp, Mus musculus
tccgggactggagcgtcttttgtag

SEQ ID NO: 320151 - DNA, 25 bp, Mus musculus
tggagcgtcttttgtaggccaggcc

SEQ ID NO: 320152 - DNA, 25 bp, Mus musculus
cttttgtaggccaggcctgcagcgc

SEQ ID NO: 320153 - DNA, 25 bp, Mus musculus
cgccatctgctgaccatgagggcaa

SEQ ID NO: 320154 - DNA, 25 bp, Mus musculus
tctgctgaccatgagggcaaacaca

SEQ ID NO: 320155 - DNA, 25 bp, Mus musculus
ccatgagggcaaacacagaggcttt

SEQ ID NO: 320156 - DNA, 25 bp, Mus musculus
aaacacagaggctttgcgactcgcg

SEQ ID NO: 320157 - DNA, 25 bp, Mus musculus
catcgcggcgtgcaaagtcctagcc

SEQ ID NO: 320158 - DNA, 25 bp, Mus musculus
agctcaccctaaactgcctctggat

SEQ ID NO: 320159 - DNA, 25 bp, Mus musculus
ttgcagagtgcagtgttccacgagc

SEQ ID NO: 320160 - DNA, 25 bp, Mus musculus
cccgggattgtacaaaccagttgca

SEQ ID NO: 320161 - DNA, 25 bp, Mus musculus
gctgctccgcgaatgttcccgtaga

SEQ ID NO: 320162 - DNA, 25 bp, Mus musculus
tggacaaactttccagcgggtcttg

SEQ ID NO: 320163 - DNA, 25 bp, Mus musculus
aagtcctagcccgatcgagatccgc

SEQ ID NO: 320164 - DNA, 25 bp, Mus musculus
gactcgcacgagtcatcaccaagca

SEQ ID NO: 320165 - DNA, 25 bp, Mus musculus
gagcattgttagtcacccgccacga

SEQ ID NO: 320166 - DNA, 25 bp, Mus musculus
gcgggcctaggatggacacttacca

SEQ ID NO: 320167 - DNA, 25 bp, Mus musculus
tccggcacgcgccaaggagttcagg

SEQ ID NO: 320168 - DNA, 25 bp, Mus musculus
tccgtgcaactttggagcctgaggc

SEQ ID NO: 320169 - DNA, 25 bp, Mus musculus
tgctagaagcctgcaccaatccttg

SEQ ID NO: 320170 - DNA, 25 bp, Mus musculus
ggacacttaccatccggcacggtca

SEQ ID NO: 320171 - DNA, 25 bp, Mus musculus
acagcgccctctcgtgttcggagga

SEQ ID NO: 320172 - DNA, 25 bp, Mus musculus
tgaccgccctcatcctggaactgta

SEQ ID NO: 320173 - DNA, 25 bp, Mus musculus
actggcacgtcgaacggggagccca

SEQ ID NO: 320174 - DNA, 25 bp, Mus musculus
tccggcgtgatgtccactggcacgt

SEQ ID NO: 320175 - DNA, 25 bp, Mus musculus
cgcgttgcacaccagctgcagcttg

SEQ ID NO: 320176 - DNA, 25 bp, Mus musculus
tggcttcgttttggggtgctcacct

SEQ ID NO: 320177 - DNA, 25 bp, Mus musculus
gagaacatttttcctggggccgatc

SEQ ID NO: 320178 - DNA, 25 bp, Mus musculus
ctcttcctgcagaatcaagccgcga

SEQ ID NO: 320179 - DNA, 25 bp, Mus musculus
aatcaagccgcgagactgtcagtcc

SEQ ID NO: 320180 - DNA, 25 bp, Mus musculus
ggattgccaatggtggcctcccttc

SEQ ID NO: 320181 - DNA, 25 bp, Mus musculus
cgttaaatccatgtcgcgccgggca

SEQ ID NO: 320182 - DNA, 25 bp, Mus musculus
gtgttcggaggagtcaagccgctct

SEQ ID NO: 320183 - DNA, 25 bp, Mus musculus
tggaactgtacgagcagccgctgca

SEQ ID NO: 320184 - DNA, 25 bp, Mus musculus
gcggaaagacggagcgttaaatcca

SEQ ID NO: 320185 - DNA, 25 bp, Mus musculus
cactcgatccggacccccgctcgct

SEQ ID NO: 320186 - DNA, 25 bp, Mus musculus
gctcctgacccccactcgctccgga

SEQ ID NO: 320187 - DNA, 25 bp, Mus musculus
tccggactcccgctcgctcctgacc

SEQ ID NO: 320188 - DNA, 25 bp, Mus musculus
gactcccgctcgctcctgacccccg

SEQ ID NO: 320189 - DNA, 25 bp, Mus musculus
gctccggactcccgctcgctacgga

SEQ ID NO: 320190 - DNA, 25 bp, Mus musculus
gctcgctccagacccccgctcgctc

SEQ ID NO: 320191 - DNA, 25 bp, Mus musculus
ccggactcccgctcgctcctgaccc

SEQ ID NO: 320192 - DNA, 25 bp, Mus musculus
acccgctcgctctggacccccgctc

SEQ ID NO: 320193 - DNA, 25 bp, Mus musculus
cgctcgctccagacccccgctcgct

SEQ ID NO: 320194 - DNA, 25 bp, Mus musculus
actcgatccggacccccgctcgctc

SEQ ID NO: 320195 - DNA, 25 bp, Mus musculus
gctcgctcctgacccccactcgctc

SEQ ID NO: 320196 - DNA, 25 bp, Mus musculus
gctcgctcctgacccccactcgatc

SEQ ID NO: 320197 - DNA, 25 bp, Mus musculus
tccggatccctgctcgctccggaca

SEQ ID NO: 320198 - DNA, 25 bp, Mus musculus
gatccctgctcgctccggacacccg

SEQ ID NO: 320199 - DNA, 25 bp, Mus musculus
tgggccaagaaacgtgtcgctcgaa

SEQ ID NO: 320200 - DNA, 25 bp, Mus musculus
tactcgagcctctgtgccgagctgg

SEQ ID NO: 320201 - DNA, 25 bp, Mus musculus
cctggttagctctgagcgaagcttc

SEQ ID NO: 320202 - DNA, 25 bp, Mus musculus
tgagtgcattctgttcctggttagc

SEQ ID NO: 320203 - DNA, 25 bp, Mus musculus
tctatgaccaactgggacttccgtt

SEQ ID NO: 320204 - DNA, 25 bp, Mus musculus
gccggaactcgggaactctatgacc

SEQ ID NO: 320205 - DNA, 25 bp, Mus musculus
cgaatgtagccctgagccggaactc

SEQ ID NO: 320206 - DNA, 25 bp, Mus musculus
caggcgctctagcatcgaatgtagc

SEQ ID NO: 320207 - DNA, 25 bp, Mus musculus
aacagaagctccgaggacctccaca

SEQ ID NO: 320208 - DNA, 25 bp, Mus musculus
tctcggctttgtgaccgaaaccgta

SEQ ID NO: 320209 - DNA, 25 bp, Mus musculus
acctgcgaaaggaggtctcggcttt

SEQ ID NO: 320210 - DNA, 25 bp, Mus musculus
acccgtgacgccacctgcgaaagga

SEQ ID NO: 320211 - DNA, 25 bp, Mus musculus
tcgctcgaaccgcagtccgggagct

SEQ ID NO: 320212 - DNA, 25 bp, Mus musculus
agaagcgcccgtccttgcttgctga

SEQ ID NO: 320213 - DNA, 25 bp, Mus musculus
aagaagctccgacgtgtctccacga

SEQ ID NO: 320214 - DNA, 25 bp, Mus musculus
ttgcctccggtgagttcaaggcggc

SEQ ID NO: 320215 - DNA, 25 bp, Mus musculus
attctcttacgccaaagcttccggc

SEQ ID NO: 320216 - DNA, 25 bp, Mus musculus
tcactgaaacctctcttgtcgcacg

SEQ ID NO: 320217 - DNA, 25 bp, Mus musculus
tccctggcaaattgggttttgcgca

SEQ ID NO: 320218 - DNA, 25 bp, Mus musculus
ttgcgcagtggcttagatctagaga

SEQ ID NO: 320219 - DNA, 25 bp, Mus musculus
cagctctcccgtttgacatctgttc

SEQ ID NO: 320220 - DNA, 25 bp, Mus musculus
aagtgcctccatcgtagtgaccgtg

SEQ ID NO: 320221 - DNA, 25 bp, Mus musculus
cccaagccgggtcataggctcagga

SEQ ID NO: 320222 - DNA, 25 bp, Mus musculus
ggctcaccatctttgtccctggcaa

SEQ ID NO: 320223 - DNA, 25 bp, Mus musculus
cgggcaggaaaccattacaccacca

SEQ ID NO: 320224 - DNA, 25 bp, Mus musculus
tcccgcgaccgtttggtcactgaaa

SEQ ID NO: 320225 - DNA, 25 bp, Mus musculus
acgtcaggcggcgagattctcttac

SEQ ID NO: 320226 - DNA, 25 bp, Mus musculus
ggcgacagacacgacctggccgttt

SEQ ID NO: 320227 - DNA, 25 bp, Mus musculus
tcgtccaggctcgagctaatttctc

SEQ ID NO: 320228 - DNA, 25 bp, Mus musculus
cccacgcggacgtggtagggactca

SEQ ID NO: 320229 - DNA, 25 bp, Mus musculus
tcgggtcactgggagcccggcatcc

SEQ ID NO: 320230 - DNA, 25 bp, Mus musculus
acctgccaccgatcgggtcactggg

SEQ ID NO: 320231 - DNA, 25 bp, Mus musculus
gcagctgagcgaccctcggtgctgc

SEQ ID NO: 320232 - DNA, 25 bp, Mus musculus
cagggcgagcagctgagcgaccctc

SEQ ID NO: 320233 - DNA, 25 bp, Mus musculus
tgaatccgtcgggctcggggaccca

SEQ ID NO: 320234 - DNA, 25 bp, Mus musculus
taatttctcccaggggagagtcgcg

SEQ ID NO: 320235 - DNA, 25 bp, Mus musculus
tcgagctaatttctcccaggggaga

SEQ ID NO: 320236 - DNA, 25 bp, Mus musculus
ccaactcgtccaggctcgagctaat

SEQ ID NO: 320237 - DNA, 25 bp, Mus musculus
agtcgcaatgaaggcagaggctccg

SEQ ID NO: 320238 - DNA, 25 bp, Mus musculus
gacgtggtagggactcaccacccga

SEQ ID NO: 320239 - DNA, 25 bp, Mus musculus
aggctcgagctaatttctcccaggg

SEQ ID NO: 320240 - DNA, 25 bp, Mus musculus
cagaggctccggggcctttctcgtc

SEQ ID NO: 320241 - DNA, 25 bp, Mus musculus
tgctgctcttcagcgagctgctcaa

SEQ ID NO: 320242 - DNA, 25 bp, Mus musculus
tgatcggcacctcggagacgcccat

SEQ ID NO: 320243 - DNA, 25 bp, Mus musculus
tcggagacgcccatcatcatcgtgg

SEQ ID NO: 320244 - DNA, 25 bp, Mus musculus
tcatcgtgggcaacaagcgcgacct

SEQ ID NO: 320245 - DNA, 25 bp, Mus musculus
cctgcaacgcggacgcgtgattcca

SEQ ID NO: 320246 - DNA, 25 bp, Mus musculus
ttccacgctggaacgtgtcgcactt

SEQ ID NO: 320247 - DNA, 25 bp, Mus musculus
tgtcgcacttggtgcgcaagacctg

SEQ ID NO: 320248 - DNA, 25 bp, Mus musculus
gcaagacctggaagtgcggctacgt

SEQ ID NO: 320249 - DNA, 25 bp, Mus musculus
gtacaactggcacatcctgctgctc

SEQ ID NO: 320250 - DNA, 25 bp, Mus musculus
ctgctcaagagtgtgggctgcgccc

SEQ ID NO: 320251 - DNA, 25 bp, Mus musculus
tgccctgcgcttccagggagcgctg

SEQ ID NO: 320252 - DNA, 25 bp, Mus musculus
ctgcgccatcatgtgacgccgcgtg

SEQ ID NO: 320253 - DNA, 25 bp, Mus musculus
tgcagcagcactgtcccagcgaaag

SEQ ID NO: 320254 - DNA, 25 bp, Mus musculus
ggagtgctcggccaagtacaactgg

SEQ ID NO: 320255 - DNA, 25 bp, Mus musculus
acagcagcttctggggttggcttag

SEQ ID NO: 320256 - DNA, 25 bp, Mus musculus
actcccgagacgcggaagagcgcga

SEQ ID NO: 320257 - DNA, 25 bp, Mus musculus
tcgtcttcgtcgtcggtggaagaga

SEQ ID NO: 320258 - DNA, 25 bp, Mus musculus
tcagaccccgagagcgcgaccgaga

SEQ ID NO: 320259 - DNA, 25 bp, Mus musculus
cgaggcccgctctgtgtcctacagt

SEQ ID NO: 320260 - DNA, 25 bp, Mus musculus
tgtgtcctacagtccgctgcgccag

SEQ ID NO: 320261 - DNA, 25 bp, Mus musculus
gccaggagtccagcagccagcaggt

SEQ ID NO: 320262 - DNA, 25 bp, Mus musculus
gcgctgctgcgacgctcagacagca

SEQ ID NO: 320263 - DNA, 25 bp, Mus musculus
ttggcttagcccgttcgctctgctg

SEQ ID NO: 320264 - DNA, 25 bp, Mus musculus
cccgttcgctctgctgggtggcctg

SEQ ID NO: 320265 - DNA, 25 bp, Mus musculus
gcagacaggtgagacggaaagaacc

SEQ ID NO: 320266 - DNA, 25 bp, Mus musculus
tgagacggaaagaacctgggaccga

SEQ ID NO: 320267 - DNA, 25 bp, Mus musculus
agggtctccgggttctgagcactca

SEQ ID NO: 320268 - DNA, 25 bp, Mus musculus
tgcgacgctcagacagcagcttctg

SEQ ID NO: 320269 - DNA, 25 bp, Mus musculus
tgtcggggtagaccacctgcccggc

SEQ ID NO: 320270 - DNA, 25 bp, Mus musculus
cacctgcccggcagagctgtgcgaa

SEQ ID NO: 320271 - DNA, 25 bp, Mus musculus
gggatagtagggctccacttgcatc

SEQ ID NO: 320272 - DNA, 25 bp, Mus musculus
agagctgtgcgaacccccacacgga

SEQ ID NO: 320273 - DNA, 25 bp, Mus musculus
tagtagggctccacttgcatccctc

SEQ ID NO: 320274 - DNA, 25 bp, Mus musculus
ttgcatccctccttgagctagcacg

SEQ ID NO: 320275 - DNA, 25 bp, Mus musculus
tccctccttgagctagcacgtagta

SEQ ID NO: 320276 - DNA, 25 bp, Mus musculus
ctagcacgtagtagcgggaaccctt

SEQ ID NO: 320277 - DNA, 25 bp, Mus musculus
gggtagaccacctgcccggcagagc

SEQ ID NO: 320278 - DNA, 25 bp, Mus musculus
acccttgaagaggactaggcggcgc

SEQ ID NO: 320279 - DNA, 25 bp, Mus musculus
ggacaccggcccagtctcgcaggct

SEQ ID NO: 320280 - DNA, 25 bp, Mus musculus
cgctgacctcctcggggacaccggc

SEQ ID NO: 320281 - DNA, 25 bp, Mus musculus
tagcgggaacccttgaagaggacta

SEQ ID NO: 320282 - DNA, 25 bp, Mus musculus
ctgcggggatagtagggctccactt

SEQ ID NO: 320283 - DNA, 25 bp, Mus musculus
tagtagggcgccataagcgcccgtg

SEQ ID NO: 320284 - DNA, 25 bp, Mus musculus
tgcaccgccagcacatcgtcccagc

SEQ ID NO: 320285 - DNA, 25 bp, Mus musculus
tgagcaaggcgtcgcggcccagctt

SEQ ID NO: 320286 - DNA, 25 bp, Mus musculus
cttcttgtagtagggcgccataagc

SEQ ID NO: 320287 - DNA, 25 bp, Mus musculus
tggccgatttcgtgcgccagcacca

SEQ ID NO: 320288 - DNA, 25 bp, Mus musculus
cacgaacaagttgcgcccacggcgg

SEQ ID NO: 320289 - DNA, 25 bp, Mus musculus
ccacggcggcggctcagagaccagc

SEQ ID NO: 320290 - DNA, 25 bp, Mus musculus
agagaccagcgctcgtctccgtcga

SEQ ID NO: 320291 - DNA, 25 bp, Mus musculus
accagcgctcgtctccgtcgaaatg

SEQ ID NO: 320292 - DNA, 25 bp, Mus musculus
cagcgctcgtctccgtcgaaatgcg

SEQ ID NO: 320293 - DNA, 25 bp, Mus musculus
gctcgtctccgtcgaaatgcgcttc

SEQ ID NO: 320294 - DNA, 25 bp, Mus musculus
tcgtctccgtcgaaatgcgcttcgc

SEQ ID NO: 320295 - DNA, 25 bp, Mus musculus
cgtcccagctgagcaaggcgtcgcg

SEQ ID NO: 320296 - DNA, 25 bp, Mus musculus
agcgtgtggccgatttcgtgcgcca

SEQ ID NO: 320297 - DNA, 25 bp, Mus musculus
acacaggaaggaccacccggcagca

SEQ ID NO: 320298 - DNA, 25 bp, Mus musculus
gctggacggaatgggcccttcttac

SEQ ID NO: 320299 - DNA, 25 bp, Mus musculus
tccagagtcccaagaccttcaagtc

SEQ ID NO: 320300 - DNA, 25 bp, Mus musculus
agtcccgagggaaccattgtgttcg

SEQ ID NO: 320301 - DNA, 25 bp, Mus musculus
ggctctcgctgaggattccggaccc

SEQ ID NO: 320302 - DNA, 25 bp, Mus musculus
tccagggcgcggacaacacaggaag

SEQ ID NO: 320303 - DNA, 25 bp, Mus musculus
cccgcctgcggtctagagaagaggc

SEQ ID NO: 320304 - DNA, 25 bp, Mus musculus
cgactggcgacctctagaggcgttc

SEQ ID NO: 320305 - DNA, 25 bp, Mus musculus
gaacgactgcgctcggacttccaga

SEQ ID NO: 320306 - DNA, 25 bp, Mus musculus
tgggaggaccaaaccgcacctggca

SEQ ID NO: 320307 - DNA, 25 bp, Mus musculus
agccggaaggatgcaccgcctacgg

SEQ ID NO: 320308 - DNA, 25 bp, Mus musculus
ccgcaaggagccctcagtcttagaa

SEQ ID NO: 320309 - DNA, 25 bp, Mus musculus
gaggatccacctcgcgggaattcgc

SEQ ID NO: 320310 - DNA, 25 bp, Mus musculus
cagacagccagaaacccgcgagcgg

SEQ ID NO: 320311 - DNA, 25 bp, Mus musculus
tctactggctgcgttccttcttggc

SEQ ID NO: 320312 - DNA, 25 bp, Mus musculus
tgggctcctgtcagagccggctcca

SEQ ID NO: 320313 - DNA, 25 bp, Mus musculus
agacagtcccgagcttctcctgctg

SEQ ID NO: 320314 - DNA, 25 bp, Mus musculus
tgtcagagccggctccagccatggt

SEQ ID NO: 320315 - DNA, 25 bp, Mus musculus
ggccgatcagacagtcccgagcttc

SEQ ID NO: 320316 - DNA, 25 bp, Mus musculus
ccgagacttctactggctgcgttcc

SEQ ID NO: 320317 - DNA, 25 bp, Mus musculus
ttcttggccggaggtcagtatccgc

SEQ ID NO: 320318 - DNA, 25 bp, Mus musculus
gacctcacgccgagacttctactgg

SEQ ID NO: 320319 - DNA, 25 bp, Mus musculus
tccagccatggtgctgcccagtgtt

SEQ ID NO: 320320 - DNA, 25 bp, Mus musculus
ggctgcgtgcgtcatcattcctcgc

SEQ ID NO: 320321 - DNA, 25 bp, Mus musculus
gtgctgcccagtgttttgtaagttg

SEQ ID NO: 320322 - DNA, 25 bp, Mus musculus
cagtgttttgtaagttggcagcgga

SEQ ID NO: 320323 - DNA, 25 bp, Mus musculus
ccttgctctcttggacgggtcccag

SEQ ID NO: 320324 - DNA, 25 bp, Mus musculus
ggtccgcgggccgatcagacagtcc

SEQ ID NO: 320325 - DNA, 25 bp, Mus musculus
gcccgcctatcaagccgagtgagcg

SEQ ID NO: 320326 - DNA, 25 bp, Mus musculus
gcctggacgtgtgcctgccgatacc

SEQ ID NO: 320327 - DNA, 25 bp, Mus musculus
tcacctgtgcgggatccaggccctc

SEQ ID NO: 320328 - DNA, 25 bp, Mus musculus
cctggcatggcctggacgtgtgcct

SEQ ID NO: 320329 - DNA, 25 bp, Mus musculus
gagcactgcggagcgccagagggag

SEQ ID NO: 320330 - DNA, 25 bp, Mus musculus
tcaatgcgctcggagtagccagcac

SEQ ID NO: 320331 - DNA, 25 bp, Mus musculus
cctctgtccgtcaatgcgctcggag

SEQ ID NO: 320332 - DNA, 25 bp, Mus musculus
ccagagggagggcgctcattccctt

SEQ ID NO: 320333 - DNA, 25 bp, Mus musculus
tcaagccgagtgagcgtgcgccagc

SEQ ID NO: 320334 - DNA, 25 bp, Mus musculus
tatcaagccgagtgagcgtgcgcca

SEQ ID NO: 320335 - DNA, 25 bp, Mus musculus
gcctatcaagccgagtgagcgtgcg

SEQ ID NO: 320336 - DNA, 25 bp, Mus musculus
atgcgctcggagtagccagcacggc

SEQ ID NO: 320337 - DNA, 25 bp, Mus musculus
tccgtcaatgcgctcggagtagcca

SEQ ID NO: 320338 - DNA, 25 bp, Mus musculus
tctgtccgtcaatgcgctcggagta

SEQ ID NO: 320339 - DNA, 25 bp, Mus musculus
ggtacctctgcctcctggcgcagct

SEQ ID NO: 320340 - DNA, 25 bp, Mus musculus
ccagggtccctagcgcctggttcca

SEQ ID NO: 320341 - DNA, 25 bp, Mus musculus
cccacccaccaacccggctgccagc

SEQ ID NO: 320342 - DNA, 25 bp, Mus musculus
ctgtgggtcagtcaaccggaggacc

SEQ ID NO: 320343 - DNA, 25 bp, Mus musculus
aggttgtccggcacccgcgatgcct

SEQ ID NO: 320344 - DNA, 25 bp, Mus musculus
agcgcctggttccaccgccgcccga

SEQ ID NO: 320345 - DNA, 25 bp, Mus musculus
tagcctcttccgccagcggtgtagc

SEQ ID NO: 320346 - DNA, 25 bp, Mus musculus
gcccgcgtgcggacccaccaggtcc

SEQ ID NO: 320347 - DNA, 25 bp, Mus musculus
gatgccagttcgtcgcggcccgcgt

SEQ ID NO: 320348 - DNA, 25 bp, Mus musculus
gactcccacggatgccagttcgtcg

SEQ ID NO: 320349 - DNA, 25 bp, Mus musculus
agccaccatcgcagcgagctgctgg

SEQ ID NO: 320350 - DNA, 25 bp, Mus musculus
cggctgccagccctagcctcttccg

SEQ ID NO: 320351 - DNA, 25 bp, Mus musculus
tccgccaggcacacccggtacctct

SEQ ID NO: 320352 - DNA, 25 bp, Mus musculus
ggtggtcagctgtgcccgactccca

SEQ ID NO: 320353 - DNA, 25 bp, Mus musculus
agttctgcagcaagagcccgagcga

SEQ ID NO: 320354 - DNA, 25 bp, Mus musculus
gaagaatcgactttcccaggcatta

SEQ ID NO: 320355 - DNA, 25 bp, Mus musculus
ccgcggctgttagtcatgtcgggta

SEQ ID NO: 320356 - DNA, 25 bp, Mus musculus
ggaggcccgtctacgccatcgtaag

SEQ ID NO: 320357 - DNA, 25 bp, Mus musculus
ctctcaataatggtacggtcgcgga

SEQ ID NO: 320358 - DNA, 25 bp, Mus musculus
agccgagatctgagcatcagcctga

SEQ ID NO: 320359 - DNA, 25 bp, Mus musculus
gggagcctcgtctttcgcttcatag

SEQ ID NO: 320360 - DNA, 25 bp, Mus musculus
cccttggaacctggggagatgagca

SEQ ID NO: 320361 - DNA, 25 bp, Mus musculus
gagctcttttgatcctgcccttgga

SEQ ID NO: 320362 - DNA, 25 bp, Mus musculus
aacgctccctggctacaaatcacgg

SEQ ID NO: 320363 - DNA, 25 bp, Mus musculus
agatccgggaggactctaaggctcg

SEQ ID NO: 320364 - DNA, 25 bp, Mus musculus
ccaggagggcattggtactttcctc

SEQ ID NO: 320365 - DNA, 25 bp, Mus musculus
gcttcaaagtctaccagacccggta

SEQ ID NO: 320366 - DNA, 25 bp, Mus musculus
tcagatctctcagcgaggcctccgg

SEQ ID NO: 320367 - DNA, 25 bp, Mus musculus
gcagccggatgacagcaccgtgtcc

SEQ ID NO: 320368 - DNA, 25 bp, Mus musculus
ggcggtgcaggtcgccgcctctctt

SEQ ID NO: 320369 - DNA, 25 bp, Mus musculus
ctctcttccttgtgggcagccgcga

SEQ ID NO: 320370 - DNA, 25 bp, Mus musculus
caggacgatgggttccgccgcttgt

SEQ ID NO: 320371 - DNA, 25 bp, Mus musculus
tttctcacggaggaaaaatggcggc

SEQ ID NO: 320372 - DNA, 25 bp, Mus musculus
ggttccgccgcttgtctgccaggct

SEQ ID NO: 320373 - DNA, 25 bp, Mus musculus
cgctgcagccggatgacagcaccgt

SEQ ID NO: 320374 - DNA, 25 bp, Mus musculus
gtgtcccgcatggagattcacctgc

SEQ ID NO: 320375 - DNA, 25 bp, Mus musculus
gcatggagattcacctgctcttcga

SEQ ID NO: 320376 - DNA, 25 bp, Mus musculus
gagattcacctgctcttcgaccagc

SEQ ID NO: 320377 - DNA, 25 bp, Mus musculus
ctccgagaactacagcgagggcggc

SEQ ID NO: 320378 - DNA, 25 bp, Mus musculus
tcgaccagctcatctccgagaacta

SEQ ID NO: 320379 - DNA, 25 bp, Mus musculus
caccgtgtcccgcatggagattcac

SEQ ID NO: 320380 - DNA, 25 bp, Mus musculus
catcctgcccggacaacggctggtt

SEQ ID NO: 320381 - DNA, 25 bp, Mus musculus
accaagccggttttccatactctca

SEQ ID NO: 320382 - DNA, 25 bp, Mus musculus
gagcccgagcagtctctggagtccc

SEQ ID NO: 320383 - DNA, 25 bp, Mus musculus
agcggggcggatctcgacaccaagc

SEQ ID NO: 320384 - DNA, 25 bp, Mus musculus
aatttcggggtgaagctggagacac

SEQ ID NO: 320385 - DNA, 25 bp, Mus musculus
cggttttccatactctcaccaatgg

SEQ ID NO: 320386 - DNA, 25 bp, Mus musculus
tcaccaatggccacgccaagggccg

SEQ ID NO: 320387 - DNA, 25 bp, Mus musculus
ccaagggccgcttgtctggggacga

SEQ ID NO: 320388 - DNA, 25 bp, Mus musculus
gacggcgacgactatgacactcctc

SEQ ID NO: 320389 - DNA, 25 bp, Mus musculus
tgacactcctcccatcctcaaagag

SEQ ID NO: 320390 - DNA, 25 bp, Mus musculus
atcctcaaagagctccaggcgctca

SEQ ID NO: 320391 - DNA, 25 bp, Mus musculus
aggcgctcaacaccgaggaggccgc

SEQ ID NO: 320392 - DNA, 25 bp, Mus musculus
accggatgctcaggtaggcaagcga

SEQ ID NO: 320393 - DNA, 25 bp, Mus musculus
cgaggtacgccctggagcccgagca

SEQ ID NO: 320394 - DNA, 25 bp, Mus musculus
ggatctcgacaccaagccggttttc

SEQ ID NO: 320395 - DNA, 25 bp, Mus musculus
tagactgcgcgtcgctccggggcca

SEQ ID NO: 320396 - DNA, 25 bp, Mus musculus
ctctgactcttaagccctgcggctt

SEQ ID NO: 320397 - DNA, 25 bp, Mus musculus
ttgcgctttggggacccggccgctc

SEQ ID NO: 320398 - DNA, 25 bp, Mus musculus
tgcatttgaatttgcgctttgggga

SEQ ID NO: 320399 - DNA, 25 bp, Mus musculus
tgggatatgaccttgcatttgaatt

SEQ ID NO: 320400 - DNA, 25 bp, Mus musculus
cttggggtgggatatgaccttgcat

SEQ ID NO: 320401 - DNA, 25 bp, Mus musculus
caaagtttcagagttccggagtgac

SEQ ID NO: 320402 - DNA, 25 bp, Mus musculus
aagcggctcccttagactgcgcgtc

SEQ ID NO: 320403 - DNA, 25 bp, Mus musculus
aattatccaaggagccaagcggctc

SEQ ID NO: 320404 - DNA, 25 bp, Mus musculus
ctagttactaattatccaaggagcc

SEQ ID NO: 320405 - DNA, 25 bp, Mus musculus
cgctttgacagctagttactaatta

SEQ ID NO: 320406 - DNA, 25 bp, Mus musculus
ctgggatcacttgccggtcctctcg

SEQ ID NO: 320407 - DNA, 25 bp, Mus musculus
agccctgcggcttcaaagtttcaga

SEQ ID NO: 320408 - DNA, 25 bp, Mus musculus
tccctccggtggctgggatcacttg

SEQ ID NO: 320409 - DNA, 25 bp, Mus musculus
taccctggctggaagaacctggcca

SEQ ID NO: 320410 - DNA, 25 bp, Mus musculus
ttgcaaacggcggtgtcgcgcgctc

SEQ ID NO: 320411 - DNA, 25 bp, Mus musculus
ctggccagagtggagggttgcaaac

SEQ ID NO: 320412 - DNA, 25 bp, Mus musculus
ccctggctggaagaacctggccaga

SEQ ID NO: 320413 - DNA, 25 bp, Mus musculus
tttaccctggctggaagaacctggc

SEQ ID NO: 320414 - DNA, 25 bp, Mus musculus
cctttaccctggctggaagaacctg

SEQ ID NO: 320415 - DNA, 25 bp, Mus musculus
gtcgcctttaccctggctggaagaa

SEQ ID NO: 320416 - DNA, 25 bp, Mus musculus
ctggtcgcctttaccctggctggaa

SEQ ID NO: 320417 - DNA, 25 bp, Mus musculus
tcggtggcgcgcctggtcgccttta

SEQ ID NO: 320418 - DNA, 25 bp, Mus musculus
ccttgttcccctgtaagtcagaaag

SEQ ID NO: 320419 - DNA, 25 bp, Mus musculus
cagggtaccgggcactctcttttgt

SEQ ID NO: 320420 - DNA, 25 bp, Mus musculus
gactgcagggtaccgggcactctct

SEQ ID NO: 320421 - DNA, 25 bp, Mus musculus
cagccgactgcagggtaccgggcac

SEQ ID NO: 320422 - DNA, 25 bp, Mus musculus
tcaccgcgcagccgactgcagggta

SEQ ID NO: 320423 - DNA, 25 bp, Mus musculus
cggtaaccgaaaatgcagaatattg

SEQ ID NO: 320424 - DNA, 25 bp, Mus musculus
caggtactttctgtacgcggggagc

SEQ ID NO: 320425 - DNA, 25 bp, Mus musculus
agcagacgctactcgattccaggta

SEQ ID NO: 320426 - DNA, 25 bp, Mus musculus
gttcgacgtgaagcgcttctcagca

SEQ ID NO: 320427 - DNA, 25 bp, Mus musculus
cccacgcacaagaagcgtcgatttt

SEQ ID NO: 320428 - DNA, 25 bp, Mus musculus
tcctacgacctgtttcgccggcttg

SEQ ID NO: 320429 - DNA, 25 bp, Mus musculus
ccttctgggtaaagatggattccta

SEQ ID NO: 320430 - DNA, 25 bp, Mus musculus
cagtcgcggatagaaagtggtaaac

SEQ ID NO: 320431 - DNA, 25 bp, Mus musculus
gagcgacttccgctacggcctgtgc

SEQ ID NO: 320432 - DNA, 25 bp, Mus musculus
gttttccacgcctatcacagccagg

SEQ ID NO: 320433 - DNA, 25 bp, Mus musculus
gaattcccagctcacacgttttcca

SEQ ID NO: 320434 - DNA, 25 bp, Mus musculus
tggattttgtgaacgaattcccagc

SEQ ID NO: 320435 - DNA, 25 bp, Mus musculus
ttggcgtgttgctcatcaaactatc

SEQ ID NO: 320436 - DNA, 25 bp, Mus musculus
ggatccggagattgagaccgccgcc

SEQ ID NO: 320437 - DNA, 25 bp, Mus musculus
ctgtgacggtctagtcgcaaagctg

SEQ ID NO: 320438 - DNA, 25 bp, Mus musculus
acggtctagtcgcaaagctggagga

SEQ ID NO: 320439 - DNA, 25 bp, Mus musculus
aaggctgtgacggtctagtcgcaaa

SEQ ID NO: 320440 - DNA, 25 bp, Mus musculus
tcgagctgctgtcggagcgaaggct

SEQ ID NO: 320441 - DNA, 25 bp, Mus musculus
ctgctaggcttgctgggctcgagct

SEQ ID NO: 320442 - DNA, 25 bp, Mus musculus
tccctgctaggcttgctgggctcga

SEQ ID NO: 320443 - DNA, 25 bp, Mus musculus
tcgagcgcccgcgagtccctgctag

SEQ ID NO: 320444 - DNA, 25 bp, Mus musculus
tcttcggctgacagctgctggcgcg

SEQ ID NO: 320445 - DNA, 25 bp, Mus musculus
cctgtcttcggctgacagctgctgg

SEQ ID NO: 320446 - DNA, 25 bp, Mus musculus
agtgcctgtcttcggctgacagctg

SEQ ID NO: 320447 - DNA, 25 bp, Mus musculus
tctagtcgcaaagctggaggaaccg

SEQ ID NO: 320448 - DNA, 25 bp, Mus musculus
cggaagtgcctgtcttcggctgaca

SEQ ID NO: 320449 - DNA, 25 bp, Mus musculus
ggggccatgaagtcacgtgggcgcg

SEQ ID NO: 320450 - DNA, 25 bp, Mus musculus
cccgagcaagatggcgctgcggccg

SEQ ID NO: 320451 - DNA, 25 bp, Mus musculus
tactcacctggacttactcgcagac

SEQ ID NO: 320452 - DNA, 25 bp, Mus musculus
ggtcgccgagcacccgcacaaagtt

SEQ ID NO: 320453 - DNA, 25 bp, Mus musculus
atgctgacgcctgccggcttgggtt

SEQ ID NO: 320454 - DNA, 25 bp, Mus musculus
ggtgcatgctgacgcctgccggctt

SEQ ID NO: 320455 - DNA, 25 bp, Mus musculus
gtttgcagagccgagggtcgcatgc

SEQ ID NO: 320456 - DNA, 25 bp, Mus musculus
gcaccccgtaccgagtgtgccggtg

SEQ ID NO: 320457 - DNA, 25 bp, Mus musculus
gtcctccggcccagcttctgagctg

SEQ ID NO: 320458 - DNA, 25 bp, Mus musculus
gctctcgggtccgtgctgctgcgag

SEQ ID NO: 320459 - DNA, 25 bp, Mus musculus
ctgctgcgaggctcgcggcttctgc

SEQ ID NO: 320460 - DNA, 25 bp, Mus musculus
tccttgaagccgcgttgtcctccgg

SEQ ID NO: 320461 - DNA, 25 bp, Mus musculus
cggttcctactcacctggacttact

SEQ ID NO: 320462 - DNA, 25 bp, Mus musculus
ccctgctccttgaagccgcgttgtc

SEQ ID NO: 320463 - DNA, 25 bp, Mus musculus
cttgggttcggggatcccagcctct

SEQ ID NO: 320464 - DNA, 25 bp, Mus musculus
gccctcttccgagcgcgggcccgca

SEQ ID NO: 320465 - DNA, 25 bp, Mus musculus
tagcgccgcgagttacggctgcccg

SEQ ID NO: 320466 - DNA, 25 bp, Mus musculus
cgctggacgagctggacctgctgct

SEQ ID NO: 320467 - DNA, 25 bp, Mus musculus
agccgctggacgagctggacctgct

SEQ ID NO: 320468 - DNA, 25 bp, Mus musculus
ttcggcaggaatggagccgctggac

SEQ ID NO: 320469 - DNA, 25 bp, Mus musculus
tctcccggcgggcttcggcaggaat

SEQ ID NO: 320470 - DNA, 25 bp, Mus musculus
ctctagcgccgcgagttacggctgc

SEQ ID NO: 320471 - DNA, 25 bp, Mus musculus
ggcgcttctctagcgccgcgagtta

SEQ ID NO: 320472 - DNA, 25 bp, Mus musculus
catgcgcagcgagctggcgcttctc

SEQ ID NO: 320473 - DNA, 25 bp, Mus musculus
aaagcgcctccggtccggcgctgtg

SEQ ID NO: 320474 - DNA, 25 bp, Mus musculus
gtggagacggcggaaaagcgcctcc

SEQ ID NO: 320475 - DNA, 25 bp, Mus musculus
tcatgcaggcatccggtcctggagt

SEQ ID NO: 320476 - DNA, 25 bp, Mus musculus
agcaggttcatgcaggcatccggtc

SEQ ID NO: 320477 - DNA, 25 bp, Mus musculus
agcccagcaggttcatgcaggcatc

SEQ ID NO: 320478 - DNA, 25 bp, Mus musculus
attgctatgagacgcgtgcagttgc

SEQ ID NO: 320479 - DNA, 25 bp, Mus musculus
gtgcgcggcctcgactcacgtgcgc

SEQ ID NO: 320480 - DNA, 25 bp, Mus musculus
tagtcggtgggctctgaagtctgac

SEQ ID NO: 320481 - DNA, 25 bp, Mus musculus
gtctgacctgctgtcactttctccg

SEQ ID NO: 320482 - DNA, 25 bp, Mus musculus
cgcctcctccagtctggcagcgggc

SEQ ID NO: 320483 - DNA, 25 bp, Mus musculus
ctcgactcacgtgcgcggtcccgtg

SEQ ID NO: 320484 - DNA, 25 bp, Mus musculus
gtggcatgtgctaaggcggcttccg

SEQ ID NO: 320485 - DNA, 25 bp, Mus musculus
tgacctgctgtcactttctccgtcg

SEQ ID NO: 320486 - DNA, 25 bp, Mus musculus
caagcggcccggtggcatgtgctaa

SEQ ID NO: 320487 - DNA, 25 bp, Mus musculus
tgaagtctgacctgctgtcactttc

SEQ ID NO: 320488 - DNA, 25 bp, Mus musculus
ctctgaagtctgacctgctgtcact

SEQ ID NO: 320489 - DNA, 25 bp, Mus musculus
ggctctgaagtctgacctgctgtca

SEQ ID NO: 320490 - DNA, 25 bp, Mus musculus
tgggctctgaagtctgacctgctgt

SEQ ID NO: 320491 - DNA, 25 bp, Mus musculus
tacctggctgctagtcggtgggctc

SEQ ID NO: 320492 - DNA, 25 bp, Mus musculus
tttctccgtcgccacaagcggcccg

SEQ ID NO: 320493 - DNA, 25 bp, Mus musculus
tagcgactctgatgtcagcccgttc

SEQ ID NO: 320494 - DNA, 25 bp, Mus musculus
ccttgggcctttcacaggtcctgta

SEQ ID NO: 320495 - DNA, 25 bp, Mus musculus
cctacttgtgcggagtttgggtagc

SEQ ID NO: 320496 - DNA, 25 bp, Mus musculus
agggtgaattctacacggcagggca

SEQ ID NO: 320497 - DNA, 25 bp, Mus musculus
tgagatcctggtcgtgggaaacgta

SEQ ID NO: 320498 - DNA, 25 bp, Mus musculus
gtcgccatctttgttgcgctcaggc

SEQ ID NO: 320499 - DNA, 25 bp, Mus musculus
tctcggatacccacgttcagaaacc

SEQ ID NO: 320500 - DNA, 25 bp, Mus musculus
gcacggtgtcgagagtccctttcct

SEQ ID NO: 320501 - DNA, 25 bp, Mus musculus
tttgcaaccgaacagcgcccttggg

SEQ ID NO: 320502 - DNA, 25 bp, Mus musculus
cttcccgggataggcctcgtgtcta

SEQ ID NO: 320503 - DNA, 25 bp, Mus musculus
gcgctcaggcttccggtactgggaa

SEQ ID NO: 320504 - DNA, 25 bp, Mus musculus
tcgggccagagtctcctacttgtgc

SEQ ID NO: 320505 - DNA, 25 bp, Mus musculus
cagcccggaaccgaatttgcaaccg

SEQ ID NO: 320506 - DNA, 25 bp, Mus musculus
tcagaaacccggtctctccaggacg

SEQ ID NO: 320507 - DNA, 25 bp, Mus musculus
agggtctcagcgaccgtcggtccct

SEQ ID NO: 320508 - DNA, 25 bp, Mus musculus
aagtctcggtcctctcttgcggaga

SEQ ID NO: 320509 - DNA, 25 bp, Mus musculus
ctggttgcacggaaagtctcggtcc

SEQ ID NO: 320510 - DNA, 25 bp, Mus musculus
gggtctgattctttgcgtcggttcc

SEQ ID NO: 320511 - DNA, 25 bp, Mus musculus
ttgctgcctacttgcgggtctgatt

SEQ ID NO: 320512 - DNA, 25 bp, Mus musculus
aatcagtgagtctgcccggtgcttg

SEQ ID NO: 320513 - DNA, 25 bp, Mus musculus
gtggggctccatccaatgcagaccc

SEQ ID NO: 320514 - DNA, 25 bp, Mus musculus
cacatctcggcgcagggtctcagcg

SEQ ID NO: 320515 - DNA, 25 bp, Mus musculus
tgagcgcctgtcagccatcgccgag

SEQ ID NO: 320516 - DNA, 25 bp, Mus musculus
atggcagagccgcactcggaccatc

SEQ ID NO: 320517 - DNA, 25 bp, Mus musculus
cagacagaaggggaacccaccacgt

SEQ ID NO: 320518 - DNA, 25 bp, Mus musculus
gagtttcgagcggaaccatagcttc

SEQ ID NO: 320519 - DNA, 25 bp, Mus musculus
ccagcaggtccttgaggggagtttc

SEQ ID NO: 320520 - DNA, 25 bp, Mus musculus
gcccagggcccttagggaggaatca

SEQ ID NO: 320521 - DNA, 25 bp, Mus musculus
aggatccgcctcacgcggtctcgga

SEQ ID NO: 320522 - DNA, 25 bp, Mus musculus
aaggttgattgtgctctgagctgcc

SEQ ID NO: 320523 - DNA, 25 bp, Mus musculus
ccgcttggagcgagaaaggttgatt

SEQ ID NO: 320524 - DNA, 25 bp, Mus musculus
agcacgtgaccgcttggagcgagaa

SEQ ID NO: 320525 - DNA, 25 bp, Mus musculus
taagctgagacgcaggcgcccgaaa

SEQ ID NO: 320526 - DNA, 25 bp, Mus musculus
tcaccactgggctgctaagctgaga

SEQ ID NO: 320527 - DNA, 25 bp, Mus musculus
tcccagtaggcaacttccgggaggc

SEQ ID NO: 320528 - DNA, 25 bp, Mus musculus
gcggcgtttagaatcccagtaggca

SEQ ID NO: 320529 - DNA, 25 bp, Mus musculus
ttggcaactcaaggcggagacctcg

SEQ ID NO: 320530 - DNA, 25 bp, Mus musculus
gcgctacggcccagactctacttgg

SEQ ID NO: 320531 - DNA, 25 bp, Mus musculus
tgcgctcgtgaacctgcactgcagc

SEQ ID NO: 320532 - DNA, 25 bp, Mus musculus
gccatggtcaccaggtcactgccgg

SEQ ID NO: 320533 - DNA, 25 bp, Mus musculus
gcggtctcggattcagcaactgttc

SEQ ID NO: 320534 - DNA, 25 bp, Mus musculus
cgaaataacgcctcgagctttgtgc

SEQ ID NO: 320535 - DNA, 25 bp, Mus musculus
acactcactcacctccgtaaaagga

SEQ ID NO: 320536 - DNA, 25 bp, Mus musculus
agaccgcgggaaactccactgggca

SEQ ID NO: 320537 - DNA, 25 bp, Mus musculus
cacaatgtcagaccgcgggaaactc

SEQ ID NO: 320538 - DNA, 25 bp, Mus musculus
agcgcacaggcacaatgtcagaccg

SEQ ID NO: 320539 - DNA, 25 bp, Mus musculus
ggaaccagacctgaagcgcacaggc

SEQ ID NO: 320540 - DNA, 25 bp, Mus musculus
gctccttggagcgtcgattctggaa

SEQ ID NO: 320541 - DNA, 25 bp, Mus musculus
gctgtttcatccttcgctccttgga

SEQ ID NO: 320542 - DNA, 25 bp, Mus musculus
gcctagcgcgcttagctgtttcatc

SEQ ID NO: 320543 - DNA, 25 bp, Mus musculus
ttggggatgagttcgcccggctcca

SEQ ID NO: 320544 - DNA, 25 bp, Mus musculus
ctcgacggaaagcaagaggtacctc

SEQ ID NO: 320545 - DNA, 25 bp, Mus musculus
ctccactgggcagccggtgtacaaa

SEQ ID NO: 320546 - DNA, 25 bp, Mus musculus
aagcaagaggtacctcccgcactgc

SEQ ID NO: 320547 - DNA, 25 bp, Mus musculus
cgcatccgacgaggactgcggaaaa

SEQ ID NO: 320548 - DNA, 25 bp, Mus musculus
gcccttacacctcgacggaaagcaa

SEQ ID NO: 320549 - DNA, 25 bp, Mus musculus
gctcttgccacgctcttgcgcaaaa

SEQ ID NO: 320550 - DNA, 25 bp, Mus musculus
tctcgcggtgagtaaacaaaccctg

SEQ ID NO: 320551 - DNA, 25 bp, Mus musculus
agctttgcggttagcgaggcctcaa

SEQ ID NO: 320552 - DNA, 25 bp, Mus musculus
cggggagttggcaaagtccgatctc

SEQ ID NO: 320553 - DNA, 25 bp, Mus musculus
gcaaagtccgatctcgcggtgagta

SEQ ID NO: 320554 - DNA, 25 bp, Mus musculus
ccctgctgagctttgcggttagcga

SEQ ID NO: 320555 - DNA, 25 bp, Mus musculus
ctttaggtgccctgctgagctttgc

SEQ ID NO: 320556 - DNA, 25 bp, Mus musculus
ttgagccggctttaggtgccctgct

SEQ ID NO: 320557 - DNA, 25 bp, Mus musculus
ctgacgccgggttgagccggcttta

SEQ ID NO: 320558 - DNA, 25 bp, Mus musculus
cgctcttgcgcaaaagcctggcaga

SEQ ID NO: 320559 - DNA, 25 bp, Mus musculus
gtgcccgtagctgggctcttgccac

SEQ ID NO: 320560 - DNA, 25 bp, Mus musculus
cgagagcctccgtgcccgtagctgg

SEQ ID NO: 320561 - DNA, 25 bp, Mus musculus
aaagcctggcagattggcgcaagcg

SEQ ID NO: 320562 - DNA, 25 bp, Mus musculus
taaacaaaccctgactccgagagcc

SEQ ID NO: 320563 - DNA, 25 bp, Mus musculus
ttcagtcacaactcgcggccgcttg

SEQ ID NO: 320564 - DNA, 25 bp, Mus musculus
ctggaacagtttggcgcggattgcc

SEQ ID NO: 320565 - DNA, 25 bp, Mus musculus
gattgccggtgtcgctgtccggccc

SEQ ID NO: 320566 - DNA, 25 bp, Mus musculus
ctgcggctatagaaggccagcggct

SEQ ID NO: 320567 - DNA, 25 bp, Mus musculus
agctttagaatgtcctggggctgcg

SEQ ID NO: 320568 - DNA, 25 bp, Mus musculus
ttttccttggtcaacgcgagaagcc

SEQ ID NO: 320569 - DNA, 25 bp, Mus musculus
gcccgcgggttccttgttggctctc

SEQ ID NO: 320570 - DNA, 25 bp, Mus musculus
acctctctttttgtgcggtggcaaa

SEQ ID NO: 320571 - DNA, 25 bp, Mus musculus
gacgagcatcctggcttcagtcaca

SEQ ID NO: 320572 - DNA, 25 bp, Mus musculus
ttcactgcgcctggacgagcatcct

SEQ ID NO: 320573 - DNA, 25 bp, Mus musculus
aacacggtctggctcttcactgcgc

SEQ ID NO: 320574 - DNA, 25 bp, Mus musculus
gcttggactcctggggaggcaacac

SEQ ID NO: 320575 - DNA, 25 bp, Mus musculus
tggcctgccaggcagtctgccgcgt

SEQ ID NO: 320576 - DNA, 25 bp, Mus musculus
tgcggtggcaaatctgggttttctt

SEQ ID NO: 320577 - DNA, 25 bp, Mus musculus
agtctgggagacacgagtgtcgatc

SEQ ID NO: 320578 - DNA, 25 bp, Mus musculus
ttgattcgggcgatttcctgatggg

SEQ ID NO: 320579 - DNA, 25 bp, Mus musculus
cttgcaaagttgattcgggcgattt

SEQ ID NO: 320580 - DNA, 25 bp, Mus musculus
ccgctgcgctcacttgcaaagttga

SEQ ID NO: 320581 - DNA, 25 bp, Mus musculus
agacacgagtgtcgatctcccgctg

SEQ ID NO: 320582 - DNA, 25 bp, Mus musculus
aaagtccacccggcagggagtctgg

SEQ ID NO: 320583 - DNA, 25 bp, Mus musculus
ttctgtctgtttcggtgcctcctcc

SEQ ID NO: 320584 - DNA, 25 bp, Mus musculus
atctcgccttctgtctgtttcggtg

SEQ ID NO: 320585 - DNA, 25 bp, Mus musculus
tggcagcgtaatctcgccttctgtc

SEQ ID NO: 320586 - DNA, 25 bp, Mus musculus
gcgcttggcagcgtaatctcgcctt

SEQ ID NO: 320587 - DNA, 25 bp, Mus musculus
cgtagctcgagtctaaggagaggta

SEQ ID NO: 320588 - DNA, 25 bp, Mus musculus
cccggcgtagctcgagtctaaggag

SEQ ID NO: 320589 - DNA, 25 bp, Mus musculus
ccttgttcgtttggcctggaaattg

SEQ ID NO: 320590 - DNA, 25 bp, Mus musculus
gagtgtcgatctcccgctgcgctca

SEQ ID NO: 320591 - DNA, 25 bp, Mus musculus
gcccttagccaacggccatctccta

SEQ ID NO: 320592 - DNA, 25 bp, Mus musculus
acacactgatgccaggtgacctgcc

SEQ ID NO: 320593 - DNA, 25 bp, Mus musculus
acacacccggtcttagtttgatgga

SEQ ID NO: 320594 - DNA, 25 bp, Mus musculus
cggtcttagtttgatggagacgcca

SEQ ID NO: 320595 - DNA, 25 bp, Mus musculus
atggagacgccagaagcaaaatatc

SEQ ID NO: 320596 - DNA, 25 bp, Mus musculus
agcaaaatatctcgcctgcggggcg

SEQ ID NO: 320597 - DNA, 25 bp, Mus musculus
ggcccggccgtatcgggcaatctgc

SEQ ID NO: 320598 - DNA, 25 bp, Mus musculus
tatcgggcaatctgcgggctaattc

SEQ ID NO: 320599 - DNA, 25 bp, Mus musculus
taattcgtgtcagggcccgtctcct

SEQ ID NO: 320600 - DNA, 25 bp, Mus musculus
ccgtctcctatctccagcgtggctc

SEQ ID NO: 320601 - DNA, 25 bp, Mus musculus
cccagccgctgataaaattgaagtg

SEQ ID NO: 320602 - DNA, 25 bp, Mus musculus
aaatgaagttggatggtccggagca

SEQ ID NO: 320603 - DNA, 25 bp, Mus musculus
gtagtcgcccttggcgctgcccttg

SEQ ID NO: 320604 - DNA, 25 bp, Mus musculus
gcagctgcgccctccgtagtcgccc

SEQ ID NO: 320605 - DNA, 25 bp, Mus musculus
ccctggtgcacttggtagccgcaca

SEQ ID NO: 320606 - DNA, 25 bp, Mus musculus
gccgcacaaggcatccagtttctga

SEQ ID NO: 320607 - DNA, 25 bp, Mus musculus
agtttctgacgcctgggcctcaaga

SEQ ID NO: 320608 - DNA, 25 bp, Mus musculus
caaatagacgttccagccgctgggc

SEQ ID NO: 320609 - DNA, 25 bp, Mus musculus
cggcgccaggtcatccagaagcaag

SEQ ID NO: 320610 - DNA, 25 bp, Mus musculus
atcaggcgactgaagcacccgaccg

SEQ ID NO: 320611 - DNA, 25 bp, Mus musculus
cagagtcgccgcattgctccagcag

SEQ ID NO: 320612 - DNA, 25 bp, Mus musculus
cacatgtgcgcttggcggcaaccac

SEQ ID NO: 320613 - DNA, 25 bp, Mus musculus
ctacaggagtgagtcgcactgcctc

SEQ ID NO: 320614 - DNA, 25 bp, Mus musculus
gtgatgactctgtctacgccgagga

SEQ ID NO: 320615 - DNA, 25 bp, Mus musculus
ctgtttctctggctggtgatgactc

SEQ ID NO: 320616 - DNA, 25 bp, Mus musculus
ctgaattaagggacgtccgtgcctg

SEQ ID NO: 320617 - DNA, 25 bp, Mus musculus
gctccgcctccagattgggcgtaaa

SEQ ID NO: 320618 - DNA, 25 bp, Mus musculus
gcccagtgcttaggagcttggctcc

SEQ ID NO: 320619 - DNA, 25 bp, Mus musculus
ccgaactgaatcgcgcgctccggga

SEQ ID NO: 320620 - DNA, 25 bp, Mus musculus
gtcgcggcccttgcacaggtatggc

SEQ ID NO: 320621 - DNA, 25 bp, Mus musculus
cttgcacaggtatggcgccaagcgc

SEQ ID NO: 320622 - DNA, 25 bp, Mus musculus
cgcatatcccaggaggaaaagcgcg

SEQ ID NO: 320623 - DNA, 25 bp, Mus musculus
ctcagcgcatatcccaggaggaaaa

SEQ ID NO: 320624 - DNA, 25 bp, Mus musculus
cccgctgacagcacattggtagaaa

SEQ ID NO: 320625 - DNA, 25 bp, Mus musculus
agcaggcgccatgtgcgcgcgctca

SEQ ID NO: 320626 - DNA, 25 bp, Mus musculus
tgggcgcacacgaacgcgctgcgca

SEQ ID NO: 320627 - DNA, 25 bp, Mus musculus
cggtcatgctgagctgggcgcacac

SEQ ID NO: 320628 - DNA, 25 bp, Mus musculus
gcgaatgccgcggtcatgctgagct

SEQ ID NO: 320629 - DNA, 25 bp, Mus musculus
aaagagccctcgagcagcgccacgg

SEQ ID NO: 320630 - DNA, 25 bp, Mus musculus
ttggtagaaagagccctcgagcagc

SEQ ID NO: 320631 - DNA, 25 bp, Mus musculus
gcacattggtagaaagagccctcga

SEQ ID NO: 320632 - DNA, 25 bp, Mus musculus
gcgcgctcagcgcatatcccaggag

SEQ ID NO: 320633 - DNA, 25 bp, Mus musculus
agataatcccaacaggaagggctgc

SEQ ID NO: 320634 - DNA, 25 bp, Mus musculus
gctcccttcaccttgcagagttgga

SEQ ID NO: 320635 - DNA, 25 bp, Mus musculus
cttgcagagttggaagtgttcggac

SEQ ID NO: 320636 - DNA, 25 bp, Mus musculus
tcggactggagcgtctcctggatct

SEQ ID NO: 320637 - DNA, 25 bp, Mus musculus
ggccgtccagcaccttcctgatgtt

SEQ ID NO: 320638 - DNA, 25 bp, Mus musculus
cctgatgttgaatttcctcatggtc

SEQ ID NO: 320639 - DNA, 25 bp, Mus musculus
ttcctcatggtctcgcccaagggtc

SEQ ID NO: 320640 - DNA, 25 bp, Mus musculus
atcttcccacgacagcttggccggg

SEQ ID NO: 320641 - DNA, 25 bp, Mus musculus
gcagcggggagcagaagataatccc

SEQ ID NO: 320642 - DNA, 25 bp, Mus musculus
tggccctcaacgctcggtagagcag

SEQ ID NO: 320643 - DNA, 25 bp, Mus musculus
gctgagctccattggcgcgctctgc

SEQ ID NO: 320644 - DNA, 25 bp, Mus musculus
cgccttcttggagcgctgagctcca

SEQ ID NO: 320645 - DNA, 25 bp, Mus musculus
ggcttaaatcatcctccgccgagga

SEQ ID NO: 320646 - DNA, 25 bp, Mus musculus
caccggctgcgaaggagtccgagcc

SEQ ID NO: 320647 - DNA, 25 bp, Mus musculus
acagccttgaggataggggcccacc

SEQ ID NO: 320648 - DNA, 25 bp, Mus musculus
cggaaaccgcacagccttgaggata

SEQ ID NO: 320649 - DNA, 25 bp, Mus musculus
cgagtggccaccttttccggacacg

SEQ ID NO: 320650 - DNA, 25 bp, Mus musculus
tcgggacctccgcattgggccacat

SEQ ID NO: 320651 - DNA, 25 bp, Mus musculus
caacttggagttgcgcctagaccca

SEQ ID NO: 320652 - DNA, 25 bp, Mus musculus
gttactgaagatcggtggctccctg

SEQ ID NO: 320653 - DNA, 25 bp, Mus musculus
acctcgttcggcgaaccaggcactg

SEQ ID NO: 320654 - DNA, 25 bp, Mus musculus
atgccagctctagtcatggtcccga

SEQ ID NO: 320655 - DNA, 25 bp, Mus musculus
tcagtccctgctggactaatgcccg

SEQ ID NO: 320656 - DNA, 25 bp, Mus musculus
tgttgccaacggtgcgggcacaacc

SEQ ID NO: 320657 - DNA, 25 bp, Mus musculus
gcggagccttacctcgatgttgcca

SEQ ID NO: 320658 - DNA, 25 bp, Mus musculus
cccaccgcggaagtggggcctgaca

SEQ ID NO: 320659 - DNA, 25 bp, Mus musculus
ctgacagccggtggagttgctttta

SEQ ID NO: 320660 - DNA, 25 bp, Mus musculus
cttttaccgtgagcgcttccctttg

SEQ ID NO: 320661 - DNA, 25 bp, Mus musculus
tcgctcaccgtcagggtgtcgtcta

SEQ ID NO: 320662 - DNA, 25 bp, Mus musculus
accgtcagggtgtcgtctatgtaga

SEQ ID NO: 320663 - DNA, 25 bp, Mus musculus
ggatctgcctcctctcgaaggggaa

SEQ ID NO: 320664 - DNA, 25 bp, Mus musculus
tcgcagcacattcgccacgggtgaa

SEQ ID NO: 320665 - DNA, 25 bp, Mus musculus
gagagccgcgctgcgtttcccatca

SEQ ID NO: 320666 - DNA, 25 bp, Mus musculus
ctgaccttcactgacttcgaggacg

SEQ ID NO: 320667 - DNA, 25 bp, Mus musculus
agagagctctcggttctgaccttca

SEQ ID NO: 320668 - DNA, 25 bp, Mus musculus
tcctcacccgggtcggagagagaga

SEQ ID NO: 320669 - DNA, 25 bp, Mus musculus
gaggggtcgaccctgcctcggctct

SEQ ID NO: 320670 - DNA, 25 bp, Mus musculus
ttaccggctgacgaggcccgcgtca

SEQ ID NO: 320671 - DNA, 25 bp, Mus musculus
cggcctccagtcagggtccaaagga

SEQ ID NO: 320672 - DNA, 25 bp, Mus musculus
agcgcggctgcgattgccgtttcct

SEQ ID NO: 320673 - DNA, 25 bp, Mus musculus
actgacttcgaggacgcctccctga

SEQ ID NO: 320674 - DNA, 25 bp, Mus musculus
gattgccgtttcctctccaggctca

SEQ ID NO: 320675 - DNA, 25 bp, Mus musculus
tgttccgcggctacacgttgcggct

SEQ ID NO: 320676 - DNA, 25 bp, Mus musculus
gtcaccttcgtgtcctatgccttgc

SEQ ID NO: 320677 - DNA, 25 bp, Mus musculus
tgcgcagcctactggccatcggctt

SEQ ID NO: 320678 - DNA, 25 bp, Mus musculus
ggctgcctcgcacttactggtcaca

SEQ ID NO: 320679 - DNA, 25 bp, Mus musculus
cttactggtcacagccgccttggtc

SEQ ID NO: 320680 - DNA, 25 bp, Mus musculus
cgcccacgtctctggaggacggtaa

SEQ ID NO: 320681 - DNA, 25 bp, Mus musculus
cagctggcgctgttcttcagcctca

SEQ ID NO: 320682 - DNA, 25 bp, Mus musculus
gatccctgcaggtgtcccagctgca

SEQ ID NO: 320683 - DNA, 25 bp, Mus musculus
tggtcaccaatgtccgatccctgca

SEQ ID NO: 320684 - DNA, 25 bp, Mus musculus
catccttttcctggcgctgttcgtg

SEQ ID NO: 320685 - DNA, 25 bp, Mus musculus
agtgcactgcatccttttcctggcg

SEQ ID NO: 320686 - DNA, 25 bp, Mus musculus
gccaaggggtcgcacccagtgcact

SEQ ID NO: 320687 - DNA, 25 bp, Mus musculus
tggcaactccttttggtcaccttcg

SEQ ID NO: 320688 - DNA, 25 bp, Mus musculus
acgctgaaagcgctggctgtgctca

SEQ ID NO: 320689 - DNA, 25 bp, Mus musculus
cgccggggatggcaacagtccgcac

SEQ ID NO: 320690 - DNA, 25 bp, Mus musculus
ggactcaatagacctcacctcgcga

SEQ ID NO: 320691 - DNA, 25 bp, Mus musculus
ctcgggaggccacggaaacgccaca

SEQ ID NO: 320692 - DNA, 25 bp, Mus musculus
cagaactcgggaggccacggaaacg

SEQ ID NO: 320693 - DNA, 25 bp, Mus musculus
tgcagcagagcagcgcaagggctct

SEQ ID NO: 320694 - DNA, 25 bp, Mus musculus
gggcaccgcgacctgcagcagagca

SEQ ID NO: 320695 - DNA, 25 bp, Mus musculus
tccgggccatcgagccgcggttgca

SEQ ID NO: 320696 - DNA, 25 bp, Mus musculus
ccacgcccttcagggtcttgagctg

SEQ ID NO: 320697 - DNA, 25 bp, Mus musculus
gcggctcagcctgttcttccgggac

SEQ ID NO: 320698 - DNA, 25 bp, Mus musculus
gcccttcagggtcttgagctgggtt

SEQ ID NO: 320699 - DNA, 25 bp, Mus musculus
ccggcgtggacagaacaggctccca

SEQ ID NO: 320700 - DNA, 25 bp, Mus musculus
tcaatagacctcacctcgcgaacag

SEQ ID NO: 320701 - DNA, 25 bp, Mus musculus
tgttcttccgggaccgcagattccg

SEQ ID NO: 320702 - DNA, 25 bp, Mus musculus
tgcccacgactgagggtctccggcg

SEQ ID NO: 320703 - DNA, 25 bp, Mus musculus
cggtatttcggcttctccaaacaga

SEQ ID NO: 320704 - DNA, 25 bp, Mus musculus
tttcggcttctccaaacagaccaca

SEQ ID NO: 320705 - DNA, 25 bp, Mus musculus
acacagaccgcagtcctacaattca

SEQ ID NO: 320706 - DNA, 25 bp, Mus musculus
agaccgcagtcctacaattcagcga

SEQ ID NO: 320707 - DNA, 25 bp, Mus musculus
gtcctacaattcagcgacgccatga

SEQ ID NO: 320708 - DNA, 25 bp, Mus musculus
ttcagcgacgccatgacttcccaga

SEQ ID NO: 320709 - DNA, 25 bp, Mus musculus
gacgccatgacttcccagaagacac

SEQ ID NO: 320710 - DNA, 25 bp, Mus musculus
gctcactagggcacgcggcaagtcg

SEQ ID NO: 320711 - DNA, 25 bp, Mus musculus
cacgcggcaagtcgggcaacggtat

SEQ ID NO: 320712 - DNA, 25 bp, Mus musculus
cgctctggctcactagggcacgcgg

SEQ ID NO: 320713 - DNA, 25 bp, Mus musculus
tcgggcaacggtatttcggcttctc

SEQ ID NO: 320714 - DNA, 25 bp, Mus musculus
ccctccgaacccactacccgctctg

SEQ ID NO: 320715 - DNA, 25 bp, Mus musculus
gcaacggtatttcggcttctccaaa

SEQ ID NO: 320716 - DNA, 25 bp, Mus musculus
agcgacgccatgacttcccagaaga

SEQ ID NO: 320717 - DNA, 25 bp, Mus musculus
taaagcctccaccagcatgatcgcg

SEQ ID NO: 320718 - DNA, 25 bp, Mus musculus
cccttaggtcgtggctctgctataa

SEQ ID NO: 320719 - DNA, 25 bp, Mus musculus
cagcatgatcgcgacgcctagggtg

SEQ ID NO: 320720 - DNA, 25 bp, Mus musculus
attggtgattgaccctaggctgggc

SEQ ID NO: 320721 - DNA, 25 bp, Mus musculus
tcaagcaccatgcagctccttcttg

SEQ ID NO: 320722 - DNA, 25 bp, Mus musculus
aggtatcctcgggtgaccctctgcg

SEQ ID NO: 320723 - DNA, 25 bp, Mus musculus
ctgcgcgttgttcgtgcagggaacc

SEQ ID NO: 320724 - DNA, 25 bp, Mus musculus
cgcctacacgtgtccgcgggaggct

SEQ ID NO: 320725 - DNA, 25 bp, Mus musculus
cgtgttggacgctcgtgtgatctgt

SEQ ID NO: 320726 - DNA, 25 bp, Mus musculus
tggtgaggatgcttctctgacccgc

SEQ ID NO: 320727 - DNA, 25 bp, Mus musculus
gatccacggtccttttcgcaccttg

SEQ ID NO: 320728 - DNA, 25 bp, Mus musculus
cttttcgcaccttggttctcctggg

SEQ ID NO: 320729 - DNA, 25 bp, Mus musculus
ggaggagccgactcccacgtctagc

SEQ ID NO: 320730 - DNA, 25 bp, Mus musculus
gcctagggtggcttcattggtgatt

SEQ ID NO: 320731 - DNA, 25 bp, Mus musculus
ctgccctcgatattcccacggctgg

SEQ ID NO: 320732 - DNA, 25 bp, Mus musculus
cccaccttggaagactaggggaatg

SEQ ID NO: 320733 - DNA, 25 bp, Mus musculus
ggccgcgacccaccttggaagacta

SEQ ID NO: 320734 - DNA, 25 bp, Mus musculus
ctggccaagagggcagtgacttccg

SEQ ID NO: 320735 - DNA, 25 bp, Mus musculus
ttcctgccaatcctaggcctcgaat

SEQ ID NO: 320736 - DNA, 25 bp, Mus musculus
cggcctcgccacacgtagcacgtca

SEQ ID NO: 320737 - DNA, 25 bp, Mus musculus
tcctcccttcgcgtctcgcctcact

SEQ ID NO: 320738 - DNA, 25 bp, Mus musculus
cgcctccatgccgagtcacgtgacc

SEQ ID NO: 320739 - DNA, 25 bp, Mus musculus
acactaacaagtgcggcttctgccc

SEQ ID NO: 320740 - DNA, 25 bp, Mus musculus
gatccgtgactccttggcgcccatg

SEQ ID NO: 320741 - DNA, 25 bp, Mus musculus
gaatccgatccgtgactccttggcg

SEQ ID NO: 320742 - DNA, 25 bp, Mus musculus
cgtagctgaggaatccgatccgtga

SEQ ID NO: 320743 - DNA, 25 bp, Mus musculus
ccttggaagactaggggaatgttag

SEQ ID NO: 320744 - DNA, 25 bp, Mus musculus
gcctcctcgtagctgaggaatccga

SEQ ID NO: 320745 - DNA, 25 bp, Mus musculus
aacgtcgaactggatattctccggc

SEQ ID NO: 320746 - DNA, 25 bp, Mus musculus
gcagccgacgctacctcgagagcta

SEQ ID NO: 320747 - DNA, 25 bp, Mus musculus
tcgcctgtaccttgtagtaaacgtc

SEQ ID NO: 320748 - DNA, 25 bp, Mus musculus
ccaggctctcagctctgcatgggcg

SEQ ID NO: 320749 - DNA, 25 bp, Mus musculus
tattctccggcaaggagcggatgtc

SEQ ID NO: 320750 - DNA, 25 bp, Mus musculus
atgtagttgtccacgacagcggaga

SEQ ID NO: 320751 - DNA, 25 bp, Mus musculus
ttgtagagcgtctccgggatccact

SEQ ID NO: 320752 - DNA, 25 bp, Mus musculus
tccctccgtagcgaacccgtgtgag

SEQ ID NO: 320753 - DNA, 25 bp, Mus musculus
agatccggacgaacgcagaccacga

SEQ ID NO: 320754 - DNA, 25 bp, Mus musculus
acgaccgtaccgagagcctcacatt

SEQ ID NO: 320755 - DNA, 25 bp, Mus musculus
ttcccaacaggagagcgagcccagt

SEQ ID NO: 320756 - DNA, 25 bp, Mus musculus
ctgcgtgtgtgcgtcatgacgtcaa

SEQ ID NO: 320757 - DNA, 25 bp, Mus musculus
ggtccgatagaacagatcgcctgta

SEQ ID NO: 320758 - DNA, 25 bp, Mus musculus
cgctgggtgcttgttcctaaaggac

SEQ ID NO: 320759 - DNA, 25 bp, Mus musculus
ctacgctggtctagcgcacggacca

SEQ ID NO: 320760 - DNA, 25 bp, Mus musculus
gtgcaactggcggtggaaaattcca

SEQ ID NO: 320761 - DNA, 25 bp, Mus musculus
tggcggtggaaaattccaagtcttc

SEQ ID NO: 320762 - DNA, 25 bp, Mus musculus
cgacaggtctccgacctaacgttat

SEQ ID NO: 320763 - DNA, 25 bp, Mus musculus
ctgcttcccttaactcccagccgga

SEQ ID NO: 320764 - DNA, 25 bp, Mus musculus
agccggacaagtcccacccaagcca

SEQ ID NO: 320765 - DNA, 25 bp, Mus musculus
tgcagggcattttcgcgccatttcg

SEQ ID NO: 320766 - DNA, 25 bp, Mus musculus
ttcacgcgtgctacgctggtctagc

SEQ ID NO: 320767 - DNA, 25 bp, Mus musculus
tctagcgcacggaccaacgactttg

SEQ ID NO: 320768 - DNA, 25 bp, Mus musculus
cggaccaacgactttgcagggcatt

SEQ ID NO: 320769 - DNA, 25 bp, Mus musculus
aaaacagggctgtgcaactggcggt

SEQ ID NO: 320770 - DNA, 25 bp, Mus musculus
ttatcgcggaaaacagggctgtgca

SEQ ID NO: 320771 - DNA, 25 bp, Mus musculus
gtctccgacctaacgttatcgcgga

SEQ ID NO: 320772 - DNA, 25 bp, Mus musculus
caagccagttcacgcgtgctacgct

SEQ ID NO: 320773 - DNA, 25 bp, Mus musculus
gtacatggaggacgtaactcagatc

SEQ ID NO: 320774 - DNA, 25 bp, Mus musculus
tactcgctgggagtgagcgtcttct

SEQ ID NO: 320775 - DNA, 25 bp, Mus musculus
ttcactctcggcttcgtcgaagata

SEQ ID NO: 320776 - DNA, 25 bp, Mus musculus
tcttcggtggccttctttgcagtgt

SEQ ID NO: 320777 - DNA, 25 bp, Mus musculus
gggagcacttgtggggtttcatcaa

SEQ ID NO: 320778 - DNA, 25 bp, Mus musculus
agcagaaaggcttcacctcgtccga

SEQ ID NO: 320779 - DNA, 25 bp, Mus musculus
caaggtgtgcgctgccatccgcaaa

SEQ ID NO: 320780 - DNA, 25 bp, Mus musculus
tccgcaaaggtttcctcgcctgtca

SEQ ID NO: 320781 - DNA, 25 bp, Mus musculus
tcacctcgccatgtggaagaaactg

SEQ ID NO: 320782 - DNA, 25 bp, Mus musculus
ttttatagcatcagcaccgcgtggg

SEQ ID NO: 320783 - DNA, 25 bp, Mus musculus
gataaacaatagttggccggcgagc

SEQ ID NO: 320784 - DNA, 25 bp, Mus musculus
ccggtaccaagagcgctatccatca

SEQ ID NO: 320785 - DNA, 25 bp, Mus musculus
tgtgtctcccgcctcggaattcggc

SEQ ID NO: 320786 - DNA, 25 bp, Mus musculus
taactcagatcgtggtggagcccga

SEQ ID NO: 320787 - DNA, 25 bp, Mus musculus
ctagctgttgagacctcgcagaatg

SEQ ID NO: 320788 - DNA, 25 bp, Mus musculus
ggcggacgctttgtttccagagaca

SEQ ID NO: 320789 - DNA, 25 bp, Mus musculus
tcacggcgtcccaggaccgagagca

SEQ ID NO: 320790 - DNA, 25 bp, Mus musculus
cgcggctctgataggatggtttcta

SEQ ID NO: 320791 - DNA, 25 bp, Mus musculus
ggatggtttctatgttttcgattta

SEQ ID NO: 320792 - DNA, 25 bp, Mus musculus
agccgaggagaagcgcttgcacgtc

SEQ ID NO: 320793 - DNA, 25 bp, Mus musculus
agacttcggaagaaggcggacgctt

SEQ ID NO: 320794 - DNA, 25 bp, Mus musculus
gtttccagagacagttctgagccga

SEQ ID NO: 320795 - DNA, 25 bp, Mus musculus
gttctgagccgaggagtggataacc

SEQ ID NO: 320796 - DNA, 25 bp, Mus musculus
agtggataaccggtacctggtgcta

SEQ ID NO: 320797 - DNA, 25 bp, Mus musculus
cctggtgctagctgttgagacctcg

SEQ ID NO: 320798 - DNA, 25 bp, Mus musculus
cctcgcagaatgaaagaggagccga

SEQ ID NO: 320799 - DNA, 25 bp, Mus musculus
agaagcgcttgcacgtcacggcgtc

SEQ ID NO: 320800 - DNA, 25 bp, Mus musculus
ctatgttttcgatttagacttcgga

SEQ ID NO: 320801 - DNA, 25 bp, Mus musculus
ccacgtccacgtgcttttagcttca

SEQ ID NO: 320802 - DNA, 25 bp, Mus musculus
ttcaaatcagctgtcgcgagaattc

SEQ ID NO: 320803 - DNA, 25 bp, Mus musculus
cgcgagaattcgatgtaaacacacc

SEQ ID NO: 320804 - DNA, 25 bp, Mus musculus
cagtatacctggcttcgggctcctc

SEQ ID NO: 320805 - DNA, 25 bp, Mus musculus
tccgcaggtatttggtgcatgtagc

SEQ ID NO: 320806 - DNA, 25 bp, Mus musculus
aaggtgcctcttccaggcccgcaga

SEQ ID NO: 320807 - DNA, 25 bp, Mus musculus
cccagcggattggatggattctgaa

SEQ ID NO: 320808 - DNA, 25 bp, Mus musculus
cgcctctttcctactcgctggttgg

SEQ ID NO: 320809 - DNA, 25 bp, Mus musculus
gctggttggcgaagctgacctccaa

SEQ ID NO: 320810 - DNA, 25 bp, Mus musculus
ccagtttgctcctgggattggctga

SEQ ID NO: 320811 - DNA, 25 bp, Mus musculus
tggtaggaagtgctagccgtcaatc

SEQ ID NO: 320812 - DNA, 25 bp, Mus musculus
gccgtcaatcacgagggagactcca

SEQ ID NO: 320813 - DNA, 25 bp, Mus musculus
ctccaaacagtgagcctgaagctgg

SEQ ID NO: 320814 - DNA, 25 bp, Mus musculus
ctggagaacagcgtttaccggcgga

SEQ ID NO: 320815 - DNA, 25 bp, Mus musculus
gctagctggcgccaaggctctggaa

SEQ ID NO: 320816 - DNA, 25 bp, Mus musculus
gcttaaccgggctagctggcgccaa

SEQ ID NO: 320817 - DNA, 25 bp, Mus musculus
ccctactgcttaaccgggctagctg

SEQ ID NO: 320818 - DNA, 25 bp, Mus musculus
caatttgtttaagtggacgggacag

SEQ ID NO: 320819 - DNA, 25 bp, Mus musculus
ctgtcagccacaatttgtttaagtg

SEQ ID NO: 320820 - DNA, 25 bp, Mus musculus
agggagactgcaagcctgtcagcca

SEQ ID NO: 320821 - DNA, 25 bp, Mus musculus
agcggctccagggagactgcaagcc

SEQ ID NO: 320822 - DNA, 25 bp, Mus musculus
ccctgcgctgggtaattgggacgaa

SEQ ID NO: 320823 - DNA, 25 bp, Mus musculus
tggccagaccctgcgctgggtaatt

SEQ ID NO: 320824 - DNA, 25 bp, Mus musculus
agaaggtcgggcagcccactcttcc

SEQ ID NO: 320825 - DNA, 25 bp, Mus musculus
tcaccagaaagaaggtcgggcagcc

SEQ ID NO: 320826 - DNA, 25 bp, Mus musculus
actaggggcacagcgtcaccagaaa

SEQ ID NO: 320827 - DNA, 25 bp, Mus musculus
gtcctggcaccagactaggggcaca

SEQ ID NO: 320828 - DNA, 25 bp, Mus musculus
gcggctggtcctggcaccagactag

SEQ ID NO: 320829 - DNA, 25 bp, Mus musculus
acgtgtcaatgctttgcacttgggg

SEQ ID NO: 320830 - DNA, 25 bp, Mus musculus
agatcggtcctctgcgctttccagc

SEQ ID NO: 320831 - DNA, 25 bp, Mus musculus
atgtcccgatgagagagccggcgct

SEQ ID NO: 320832 - DNA, 25 bp, Mus musculus
tgacatgttttcttactgctgaggc

SEQ ID NO: 320833 - DNA, 25 bp, Mus musculus
tactgctgaggcttccgacaccttc

SEQ ID NO: 320834 - DNA, 25 bp, Mus musculus
agacccacaattggtccaaaaagcg

SEQ ID NO: 320835 - DNA, 25 bp, Mus musculus
tccaaaaagcgtaaaatcagcaatc

SEQ ID NO: 320836 - DNA, 25 bp, Mus musculus
ctcgttagcgcaggggatccgaaca

SEQ ID NO: 320837 - DNA, 25 bp, Mus musculus
gggcaggacatgtgagatagtcaca

SEQ ID NO: 320838 - DNA, 25 bp, Mus musculus
tagtcacagttttccagagatcagg

SEQ ID NO: 320839 - DNA, 25 bp, Mus musculus
gacaagatctaaccagtcgcgcgtg

SEQ ID NO: 320840 - DNA, 25 bp, Mus musculus
gcgcgctaggcaagcctctgccgga

SEQ ID NO: 320841 - DNA, 25 bp, Mus musculus
ctctcctctccggaacgtgtcaatg

SEQ ID NO: 320842 - DNA, 25 bp, Mus musculus
ctcaggcccttacggcgggtcagat

SEQ ID NO: 320843 - DNA, 25 bp, Mus musculus
tggcagggacagcttacctggagca

SEQ ID NO: 320844 - DNA, 25 bp, Mus musculus
gcgcctcccgacgaagcgggaacga

SEQ ID NO: 320845 - DNA, 25 bp, Mus musculus
caggccgatatatagaagccggggt

SEQ ID NO: 320846 - DNA, 25 bp, Mus musculus
ggcgcgcaggccgatatatagaagc

SEQ ID NO: 320847 - DNA, 25 bp, Mus musculus
tctaagctcgcatctgggcagcccg

SEQ ID NO: 320848 - DNA, 25 bp, Mus musculus
agtcgccgctctaagctcgcatctg

SEQ ID NO: 320849 - DNA, 25 bp, Mus musculus
gcaagcaggtcctcagcgcccagtc

SEQ ID NO: 320850 - DNA, 25 bp, Mus musculus
gcgcacgtggcagggacagcttacc

SEQ ID NO: 320851 - DNA, 25 bp, Mus musculus
actgggacagcgcacgcgcgtcgca

SEQ ID NO: 320852 - DNA, 25 bp, Mus musculus
taggtgcttaggctgcctgcagcgc

SEQ ID NO: 320853 - DNA, 25 bp, Mus musculus
cgcgcagcgcgcaagtcaggcagca

SEQ ID NO: 320854 - DNA, 25 bp, Mus musculus
tcttcaccgggcacctgctctctgt

SEQ ID NO: 320855 - DNA, 25 bp, Mus musculus
ttcagcagcgccctcagcgggtact

SEQ ID NO: 320856 - DNA, 25 bp, Mus musculus
cagcgctggcgttggcgcagaaccc

SEQ ID NO: 320857 - DNA, 25 bp, Mus musculus
cccgcagattacacagctgaagatc

SEQ ID NO: 320858 - DNA, 25 bp, Mus musculus
cacagctgaagatcgacaacaaccc

SEQ ID NO: 320859 - DNA, 25 bp, Mus musculus
ctttgccaagggcttccgggacact

SEQ ID NO: 320860 - DNA, 25 bp, Mus musculus
ctctctactgtgtagcttgtagccg

SEQ ID NO: 320861 - DNA, 25 bp, Mus musculus
tatgaggagcactgtaagccggagc

SEQ ID NO: 320862 - DNA, 25 bp, Mus musculus
agccgatggcctgttgtgcgtaccc

SEQ ID NO: 320863 - DNA, 25 bp, Mus musculus
ccttgaagaatcaggtcttgactta

SEQ ID NO: 320864 - DNA, 25 bp, Mus musculus
atgcaatggtggctgaccgctccct

SEQ ID NO: 320865 - DNA, 25 bp, Mus musculus
aggaagcagctaacgctgcccactc

SEQ ID NO: 320866 - DNA, 25 bp, Mus musculus
cgctgcccactctccgtttgtatga

SEQ ID NO: 320867 - DNA, 25 bp, Mus musculus
ctccgtttgtatgaggagcactgta

SEQ ID NO: 320868 - DNA, 25 bp, Mus musculus
gtgtagcttgtagccgctgacctcg

SEQ ID NO: 320869 - DNA, 25 bp, Mus musculus
tcttgacttagtaccgcttcctcgg

SEQ ID NO: 320870 - DNA, 25 bp, Mus musculus
ccggccagccttgaagaatcaggtc

SEQ ID NO: 320871 - DNA, 25 bp, Mus musculus
cacctgcatgggcagcagttctttg

SEQ ID NO: 320872 - DNA, 25 bp, Mus musculus
acggcccgtttagcctgcggagcct

SEQ ID NO: 320873 - DNA, 25 bp, Mus musculus
catctgcctggcctggccttctcca

SEQ ID NO: 320874 - DNA, 25 bp, Mus musculus
tccagccacctgcatgggcagcagt

SEQ ID NO: 320875 - DNA, 25 bp, Mus musculus
cggagaggtgcagcaaggaaccgac

SEQ ID NO: 320876 - DNA, 25 bp, Mus musculus
cccgtttagcctgcggagcctggag

SEQ ID NO: 320877 - DNA, 25 bp, Mus musculus
atgggcagcagttctttgggccgct

SEQ ID NO: 320878 - DNA, 25 bp, Mus musculus
cctgcacccaggacaattcgccatg

SEQ ID NO: 320879 - DNA, 25 bp, Mus musculus
agccttctccgccatgggcatgggt

SEQ ID NO: 320880 - DNA, 25 bp, Mus musculus
tccgccatgggcatgggtcatctgc

SEQ ID NO: 320881 - DNA, 25 bp, Mus musculus
gcatgggtcatctgctagcctcggt

SEQ ID NO: 320882 - DNA, 25 bp, Mus musculus
tcgcttgaccgaacccgaacgctcc

SEQ ID NO: 320883 - DNA, 25 bp, Mus musculus
tcatctgctagcctcggtggcaggc

SEQ ID NO: 320884 - DNA, 25 bp, Mus musculus
gtggtgcagacagacagtgcgtccc

SEQ ID NO: 320885 - DNA, 25 bp, Mus musculus
gagtcgcccaagtgaggggctgctt

SEQ ID NO: 320886 - DNA, 25 bp, Mus musculus
ggctagagagccagcgagccctctc

SEQ ID NO: 320887 - DNA, 25 bp, Mus musculus
cagagcatccagagactggtgagtg

SEQ ID NO: 320888 - DNA, 25 bp, Mus musculus
tgaactgcagagcatccagagactg

SEQ ID NO: 320889 - DNA, 25 bp, Mus musculus
ggcggccagtgaactgcagagcatc

SEQ ID NO: 320890 - DNA, 25 bp, Mus musculus
ctcagccaaagaggcggccagtgaa

SEQ ID NO: 320891 - DNA, 25 bp, Mus musculus
agcggctcagccaaagaggcggcca

SEQ ID NO: 320892 - DNA, 25 bp, Mus musculus
ctgagctggctctccgaaaagtggg

SEQ ID NO: 320893 - DNA, 25 bp, Mus musculus
tgcctgagctggctctccgaaaagt

SEQ ID NO: 320894 - DNA, 25 bp, Mus musculus
gagcccagtccgctgcctgagctgg

SEQ ID NO: 320895 - DNA, 25 bp, Mus musculus
aaatagccgtgagcccagtccgctg

SEQ ID NO: 320896 - DNA, 25 bp, Mus musculus
gctccaagggcggaaatagccgtga

SEQ ID NO: 320897 - DNA, 25 bp, Mus musculus
gctgcttggctgctgcgctgccaca

SEQ ID NO: 320898 - DNA, 25 bp, Mus musculus
ttggctgctgcgctgccacacgagc

SEQ ID NO: 320899 - DNA, 25 bp, Mus musculus
acgctatcatgcgatttgacccgcg

SEQ ID NO: 320900 - DNA, 25 bp, Mus musculus
tcggcgcccggctcaggccaggcct

SEQ ID NO: 320901 - DNA, 25 bp, Mus musculus
atccgcgaggctccgaggcgccgac

SEQ ID NO: 320902 - DNA, 25 bp, Mus musculus
ggcctcgagcagatccgcgaggctc

SEQ ID NO: 320903 - DNA, 25 bp, Mus musculus
tcagctgcacctcggcgatggcggc

SEQ ID NO: 320904 - DNA, 25 bp, Mus musculus
ccctttctggccctcagctgcacct

SEQ ID NO: 320905 - DNA, 25 bp, Mus musculus
ttgacccgcgctgtgcgctctgtgg

SEQ ID NO: 320906 - DNA, 25 bp, Mus musculus
tcatgcgatttgacccgcgctgtgc

SEQ ID NO: 320907 - DNA, 25 bp, Mus musculus
ggagaacgaagcgagaaaataataa

SEQ ID NO: 320908 - DNA, 25 bp, Mus musculus
cagagggagaacgaagcgagaaaat

SEQ ID NO: 320909 - DNA, 25 bp, Mus musculus
gttttcactttttgctccagaggga

SEQ ID NO: 320910 - DNA, 25 bp, Mus musculus
aggttttcactttttgctccagagg

SEQ ID NO: 320911 - DNA, 25 bp, Mus musculus
ccacctcaggttttcactttttgct

SEQ ID NO: 320912 - DNA, 25 bp, Mus musculus
atttgacccgcgctgtgcgctctgt

SEQ ID NO: 320913 - DNA, 25 bp, Mus musculus
ctgtcctcctggagggcgttgaacc

SEQ ID NO: 320914 - DNA, 25 bp, Mus musculus
cgagaagtttggaacactctcccgg

SEQ ID NO: 320915 - DNA, 25 bp, Mus musculus
gaattgcaactctgagccctccttc

SEQ ID NO: 320916 - DNA, 25 bp, Mus musculus
tccgggtgatctcagggcattgtgt

SEQ ID NO: 320917 - DNA, 25 bp, Mus musculus
acgatcaagagtcagcggggagaac

SEQ ID NO: 320918 - DNA, 25 bp, Mus musculus
ttgggagagatcagaattgcaactc

SEQ ID NO: 320919 - DNA, 25 bp, Mus musculus
actctcccggtaggctgagtccagc

SEQ ID NO: 320920 - DNA, 25 bp, Mus musculus
tctccgcccttgaccgagaagtttg

SEQ ID NO: 320921 - DNA, 25 bp, Mus musculus
tgggagcgaccctaaatccaacttc

SEQ ID NO: 320922 - DNA, 25 bp, Mus musculus
gaggcttccgaaccctcgagccatt

SEQ ID NO: 320923 - DNA, 25 bp, Mus musculus
ccaaacttcccgctgcggtgcagag

SEQ ID NO: 320924 - DNA, 25 bp, Mus musculus
gagcctcggcagaaggccctgtcct

SEQ ID NO: 320925 - DNA, 25 bp, Mus musculus
agcccactgtggattcactgacgcg

SEQ ID NO: 320926 - DNA, 25 bp, Mus musculus
gctgagtccagccaacgatcaagag

SEQ ID NO: 320927 - DNA, 25 bp, Mus musculus
ttcctctaggacctgagctggttgc

SEQ ID NO: 320928 - DNA, 25 bp, Mus musculus
ttgacagctgcgacgtcagcacgga

SEQ ID NO: 320929 - DNA, 25 bp, Mus musculus
gcctccgcatgctgcggcgcagtta

SEQ ID NO: 320930 - DNA, 25 bp, Mus musculus
agaggcccaggcagactccctgcgg

SEQ ID NO: 320931 - DNA, 25 bp, Mus musculus
cagccggacggtgacccagaggccc

SEQ ID NO: 320932 - DNA, 25 bp, Mus musculus
aggacctgagctggttgcagacctg

SEQ ID NO: 320933 - DNA, 25 bp, Mus musculus
tgagtgtgggctccagcccgtcgcc

SEQ ID NO: 320934 - DNA, 25 bp, Mus musculus
ctctacacccgggatgtgctgggcc

SEQ ID NO: 320935 - DNA, 25 bp, Mus musculus
agggcccgctctacacccgggatgt

SEQ ID NO: 320936 - DNA, 25 bp, Mus musculus
ctcggagatcaagggcccgctctac

SEQ ID NO: 320937 - DNA, 25 bp, Mus musculus
ccaaagtgcagcctcggagatcaag

SEQ ID NO: 320938 - DNA, 25 bp, Mus musculus
cggcaggcgagaactgattgacagc

SEQ ID NO: 320939 - DNA, 25 bp, Mus musculus
caggcgagaactgattgacagctgc

SEQ ID NO: 320940 - DNA, 25 bp, Mus musculus
tgcggtcccgttcctctaggacctg

SEQ ID NO: 320941 - DNA, 25 bp, Mus musculus
tgcacagccgctgtcctaggctcct

SEQ ID NO: 320942 - DNA, 25 bp, Mus musculus
cgtcaggtggtttcacttcgggagc

SEQ ID NO: 320943 - DNA, 25 bp, Mus musculus
caccgccgccatgggtaagggcagc

SEQ ID NO: 320944 - DNA, 25 bp, Mus musculus
ttcgcttgggtcacgcagtcacccg

SEQ ID NO: 320945 - DNA, 25 bp, Mus musculus
tgccgattattaaacgtcaggtggt

SEQ ID NO: 320946 - DNA, 25 bp, Mus musculus
agaattctgccgattattaaacgtc

SEQ ID NO: 320947 - DNA, 25 bp, Mus musculus
gggtcaccatccttcgcttgggtca

SEQ ID NO: 320948 - DNA, 25 bp, Mus musculus
caggttgtgatgaacactcttaaaa

SEQ ID NO: 320949 - DNA, 25 bp, Mus musculus
taggctcctccggtgcaggttacag

SEQ ID NO: 320950 - DNA, 25 bp, Mus musculus
ccgcctctagggactgccgaggagc

SEQ ID NO: 320951 - DNA, 25 bp, Mus musculus
gcttcccagtcacgcggatgcaggg

SEQ ID NO: 320952 - DNA, 25 bp, Mus musculus
agggacagggatggcttcccagtca

SEQ ID NO: 320953 - DNA, 25 bp, Mus musculus
tggacggagggaatcacacctcgac

SEQ ID NO: 320954 - DNA, 25 bp, Mus musculus
gcaggttacaggttgtgatgaacac

SEQ ID NO: 320955 - DNA, 25 bp, Mus musculus
tcgcgagtacgaaagtcctccctca

SEQ ID NO: 320956 - DNA, 25 bp, Mus musculus
cttaacgctgcggtaacgaagagtc

SEQ ID NO: 320957 - DNA, 25 bp, Mus musculus
ccctctattttgagtcggctgcaag

SEQ ID NO: 320958 - DNA, 25 bp, Mus musculus
gcgtctattccgtctgttccctcta

SEQ ID NO: 320959 - DNA, 25 bp, Mus musculus
cgtgcgtctattccgcgcgtctatt

SEQ ID NO: 320960 - DNA, 25 bp, Mus musculus
acgggtcttacatttggtgcattga

SEQ ID NO: 320961 - DNA, 25 bp, Mus musculus
ggctcccgctcccagagaaaaggaa

SEQ ID NO: 320962 - DNA, 25 bp, Mus musculus
gactgggacaagttccgcacatttg

SEQ ID NO: 320963 - DNA, 25 bp, Mus musculus
aaatcaaccctcgagtacttggcgg

SEQ ID NO: 320964 - DNA, 25 bp, Mus musculus
ggccaacgctataccgcccaatggg

SEQ ID NO: 320965 - DNA, 25 bp, Mus musculus
tccgcagcgccacacagatgaattc

SEQ ID NO: 320966 - DNA, 25 bp, Mus musculus
tgttccgacgctgccaggtaccaag

SEQ ID NO: 320967 - DNA, 25 bp, Mus musculus
gaggacgctccagactctcagagtg

SEQ ID NO: 320968 - DNA, 25 bp, Mus musculus
cgcggagccgacctacaaggaaagc

SEQ ID NO: 320969 - DNA, 25 bp, Mus musculus
acaaagcggcacttgggcccgagaa

SEQ ID NO: 320970 - DNA, 25 bp, Mus musculus
gcacttgggcccgagaagccgacgc

SEQ ID NO: 320971 - DNA, 25 bp, Mus musculus
agccgacgcttcataccttaagatc

SEQ ID NO: 320972 - DNA, 25 bp, Mus musculus
taagatcaaccctccagcctcaagg

SEQ ID NO: 320973 - DNA, 25 bp, Mus musculus
agcctcaagggacccactcggattc

SEQ ID NO: 320974 - DNA, 25 bp, Mus musculus
ctccgagagccagacgaggcagaaa

SEQ ID NO: 320975 - DNA, 25 bp, Mus musculus
ccgaagttgggcctaggtgattatc

SEQ ID NO: 320976 - DNA, 25 bp, Mus musculus
tgggcctaggtgattatccagatcc

SEQ ID NO: 320977 - DNA, 25 bp, Mus musculus
gcaatgcccggagtcgactcaggca

SEQ ID NO: 320978 - DNA, 25 bp, Mus musculus
gtcgactcaggcaccaagaactctg

SEQ ID NO: 320979 - DNA, 25 bp, Mus musculus
ggcaccaagaactctgacgctggca

SEQ ID NO: 320980 - DNA, 25 bp, Mus musculus
tgacgctggcaccaacagtgccgtc

SEQ ID NO: 320981 - DNA, 25 bp, Mus musculus
tggcaccaacagtgccgtcgacaga

SEQ ID NO: 320982 - DNA, 25 bp, Mus musculus
tcaggcggacttcagacaaagcggc

SEQ ID NO: 320983 - DNA, 25 bp, Mus musculus
gccggccaccgtacagcactgagaa

SEQ ID NO: 320984 - DNA, 25 bp, Mus musculus
caccgtacagcactgagaagacgtc

SEQ ID NO: 320985 - DNA, 25 bp, Mus musculus
actgagaagacgtcggcggcgataa

SEQ ID NO: 320986 - DNA, 25 bp, Mus musculus
ggcggcgataagaaaagccagctta

SEQ ID NO: 320987 - DNA, 25 bp, Mus musculus
ataagaaaagccagcttagggccgc

SEQ ID NO: 320988 - DNA, 25 bp, Mus musculus
ccgaaagcgtggagtgttacacttt

SEQ ID NO: 320989 - DNA, 25 bp, Mus musculus
gcttttctcttggaaccttgtcaga

SEQ ID NO: 320990 - DNA, 25 bp, Mus musculus
ccgcttccgaaagcgtggagtgtta

SEQ ID NO: 320991 - DNA, 25 bp, Mus musculus
ctcttggaaccttgtcagatgagtt

SEQ ID NO: 320992 - DNA, 25 bp, Mus musculus
tgtcagatgagttcctaaacggtca

SEQ ID NO: 320993 - DNA, 25 bp, Mus musculus
tcctaaacggtcagagcgaaatccc

SEQ ID NO: 320994 - DNA, 25 bp, Mus musculus
taaacggtcagagcgaaatcccgac

SEQ ID NO: 320995 - DNA, 25 bp, Mus musculus
ccagagcttttctcttggaaccttg

SEQ ID NO: 320996 - DNA, 25 bp, Mus musculus
gagtgttacactttcttgttttcca

SEQ ID NO: 320997 - DNA, 25 bp, Mus musculus
ccgcactcaccaggcagaagaggtt

SEQ ID NO: 320998 - DNA, 25 bp, Mus musculus
gaggaactcatcgtccctcacagca

SEQ ID NO: 320999 - DNA, 25 bp, Mus musculus
acagtgacaatcttccaggctggcc

SEQ ID NO: 321000 - DNA, 25 bp, Mus musculus
tcccttcgctttaatggcggccaca

SEQ ID NO: 321001 - DNA, 25 bp, Mus musculus
caccggcatctggatgcgacccaga

SEQ ID NO: 321002 - DNA, 25 bp, Mus musculus
ggcagaagaggttacagtgacaatc

SEQ ID NO: 321003 - DNA, 25 bp, Mus musculus
cgccgcctccgaccagagagagaaa

SEQ ID NO: 321004 - DNA, 25 bp, Mus musculus
gagagagaaacacagacaccgggga

SEQ ID NO: 321005 - DNA, 25 bp, Mus musculus
cgataaatagtcagagcccgagtcc

SEQ ID NO: 321006 - DNA, 25 bp, Mus musculus
gcgatgtccttaagcccagagtctc

SEQ ID NO: 321007 - DNA, 25 bp, Mus musculus
gcgtctgtgggctcagtccattctc

SEQ ID NO: 321008 - DNA, 25 bp, Mus musculus
tccattctccggctgtgtcctcgtg

SEQ ID NO: 321009 - DNA, 25 bp, Mus musculus
tgtcctcgtgttgtccctgggccaa

SEQ ID NO: 321010 - DNA, 25 bp, Mus musculus
ctgggccaagcctgcctaacgtctg

SEQ ID NO: 321011 - DNA, 25 bp, Mus musculus
gagggagcacaatccgccgcactca

SEQ ID NO: 321012 - DNA, 25 bp, Mus musculus
accagcaagaacacgcgcacgctta

SEQ ID NO: 321013 - DNA, 25 bp, Mus musculus
gagaagtgggcgaagaaacgccttc

SEQ ID NO: 321014 - DNA, 25 bp, Mus musculus
caccgctgctcaggcagacgcggga

SEQ ID NO: 321015 - DNA, 25 bp, Mus musculus
actccgggaacaaaagccaggcgcg

SEQ ID NO: 321016 - DNA, 25 bp, Mus musculus
actgccgtcagaagtcagactccgg

SEQ ID NO: 321017 - DNA, 25 bp, Mus musculus
ccctgccgccatctgactggaatta

SEQ ID NO: 321018 - DNA, 25 bp, Mus musculus
gcgcacgcttacaggcccacaagta

SEQ ID NO: 321019 - DNA, 25 bp, Mus musculus
caggacgtccacgtgggtgtcaacc

SEQ ID NO: 321020 - DNA, 25 bp, Mus musculus
ggtgtcaacccgagggagcacaatc

SEQ ID NO: 321021 - DNA, 25 bp, Mus musculus
ggctctgcaaaagctactgccgtca

SEQ ID NO: 321022 - DNA, 25 bp, Mus musculus
tcacgtcctagccaggctctgcaaa

SEQ ID NO: 321023 - DNA, 25 bp, Mus musculus
ggcaccgacgccttgagatcctgcg

SEQ ID NO: 321024 - DNA, 25 bp, Mus musculus
cgaggtccgtatcacgtcctagcca

SEQ ID NO: 321025 - DNA, 25 bp, Mus musculus
gtcctgtcccaagtcgctcttcaga

SEQ ID NO: 321026 - DNA, 25 bp, Mus musculus
ctaaaggttcccttctctgctggga

SEQ ID NO: 321027 - DNA, 25 bp, Mus musculus
tggagaactctgtcctcgcggattc

SEQ ID NO: 321028 - DNA, 25 bp, Mus musculus
tagcaacacgcagccggaagccaga

SEQ ID NO: 321029 - DNA, 25 bp, Mus musculus
cttcagagagtgaggcgatagagcc

SEQ ID NO: 321030 - DNA, 25 bp, Mus musculus
ctgtggcttccgagcctcttcgaaa

SEQ ID NO: 321031 - DNA, 25 bp, Mus musculus
tcttcgaaacgtcacacagtaactg

SEQ ID NO: 321032 - DNA, 25 bp, Mus musculus
aactgcacggtttcagccagccagc

SEQ ID NO: 321033 - DNA, 25 bp, Mus musculus
gggcctagaggctccttcttccact

SEQ ID NO: 321034 - DNA, 25 bp, Mus musculus
ggactccgaagcgtgtgactgatca

SEQ ID NO: 321035 - DNA, 25 bp, Mus musculus
taacatcaccaacagggccacaggg

SEQ ID NO: 321036 - DNA, 25 bp, Mus musculus
tgacagccacgcagacttaattagc

SEQ ID NO: 321037 - DNA, 25 bp, Mus musculus
tgatcactaatacacgcaagacgtg

SEQ ID NO: 321038 - DNA, 25 bp, Mus musculus
gagcaggttcctggacctacccatt

SEQ ID NO: 321039 - DNA, 25 bp, Mus musculus
gcgcatgcgtacaaagtcttctgaa

SEQ ID NO: 321040 - DNA, 25 bp, Mus musculus
cgcgtttctgtctaaggcgtttgcc

SEQ ID NO: 321041 - DNA, 25 bp, Mus musculus
ccgggaaagtacagcttgcgcgttt

SEQ ID NO: 321042 - DNA, 25 bp, Mus musculus
atgcgcagaacaccgtccgaagcca

SEQ ID NO: 321043 - DNA, 25 bp, Mus musculus
gtcttctgaagccatacagtgggca

SEQ ID NO: 321044 - DNA, 25 bp, Mus musculus
tcctcggcgctccagaaacacattg

SEQ ID NO: 321045 - DNA, 25 bp, Mus musculus
taagctcaatgcgtctgcgcctagg

SEQ ID NO: 321046 - DNA, 25 bp, Mus musculus
gccatcaccggctgcttaagctcaa

SEQ ID NO: 321047 - DNA, 25 bp, Mus musculus
tcaggcgctaggtaaaagccgtccc

SEQ ID NO: 321048 - DNA, 25 bp, Mus musculus
atgtcctcagcttccctgtgtcgga

SEQ ID NO: 321049 - DNA, 25 bp, Mus musculus
tggctggtccaggtctatgtcaaac

SEQ ID NO: 321050 - DNA, 25 bp, Mus musculus
agaaacacattgctccggggcagcg

SEQ ID NO: 321051 - DNA, 25 bp, Mus musculus
tcctcaagttcagctccggcgcatg

SEQ ID NO: 321052 - DNA, 25 bp, Mus musculus
atgcgtagcattagctcccggggcc

SEQ ID NO: 321053 - DNA, 25 bp, Mus musculus
agcgagacgagctccaggtaagtct

SEQ ID NO: 321054 - DNA, 25 bp, Mus musculus
ggcttctccggatcgcaggatcctg

SEQ ID NO: 321055 - DNA, 25 bp, Mus musculus
gtaagtctcgactccttctaggacg

SEQ ID NO: 321056 - DNA, 25 bp, Mus musculus
gttccttgttctggcttggagacct

SEQ ID NO: 321057 - DNA, 25 bp, Mus musculus
cgcgaagcgtgttccttgttctggc

SEQ ID NO: 321058 - DNA, 25 bp, Mus musculus
tttctgatccggaactagtttttca

SEQ ID NO: 321059 - DNA, 25 bp, Mus musculus
tgcgcttcgtagtttctgatccgga

SEQ ID NO: 321060 - DNA, 25 bp, Mus musculus
agaagaaggatgactgcgcttcgta

SEQ ID NO: 321061 - DNA, 25 bp, Mus musculus
tcgcaggatcctggaagcggctcac

SEQ ID NO: 321062 - DNA, 25 bp, Mus musculus
catcacccaagtgcgggagctgcgg

SEQ ID NO: 321063 - DNA, 25 bp, Mus musculus
gttctgcgtctgcatcacccaagtg

SEQ ID NO: 321064 - DNA, 25 bp, Mus musculus
taaggagcccgcctccaaaagagaa

SEQ ID NO: 321065 - DNA, 25 bp, Mus musculus
agccaaccggaactcgctcgcgtca

SEQ ID NO: 321066 - DNA, 25 bp, Mus musculus
ggaagcggctcacaacaccgactct

SEQ ID NO: 321067 - DNA, 25 bp, Mus musculus
agactccggaaacggctgagccctg

SEQ ID NO: 321068 - DNA, 25 bp, Mus musculus
aactggcaggcagacgagagagctt

SEQ ID NO: 321069 - DNA, 25 bp, Mus musculus
cggaaggatcccgaggcagaactcc

SEQ ID NO: 321070 - DNA, 25 bp, Mus musculus
tatgtagccttccacagacgccgcg

SEQ ID NO: 321071 - DNA, 25 bp, Mus musculus
cgagggactactttttctagactca

SEQ ID NO: 321072 - DNA, 25 bp, Mus musculus
ttttgccacatcatgcgactcgggg

SEQ ID NO: 321073 - DNA, 25 bp, Mus musculus
cgactcggggcgaactacgtcattt

SEQ ID NO: 321074 - DNA, 25 bp, Mus musculus
acgcacttcccggtgcacgtgatgc

SEQ ID NO: 321075 - DNA, 25 bp, Mus musculus
agaggcaagatactggccgctgctc

SEQ ID NO: 321076 - DNA, 25 bp, Mus musculus
acaccgagtgcctgaggagaaggcc

SEQ ID NO: 321077 - DNA, 25 bp, Mus musculus
gggaccgtactgagctgcaagcttc

SEQ ID NO: 321078 - DNA, 25 bp, Mus musculus
agctgcaagcttccttgccctgacg

SEQ ID NO: 321079 - DNA, 25 bp, Mus musculus
gcacgcccttctgacgccaggagag

SEQ ID NO: 321080 - DNA, 25 bp, Mus musculus
cgtcatttccgtaggcgctgtaaga

SEQ ID NO: 321081 - DNA, 25 bp, Mus musculus
tcgtcgtctggcttaaaagaccaaa

SEQ ID NO: 321082 - DNA, 25 bp, Mus musculus
gtccggagaagaagcgaacacgtcc

SEQ ID NO: 321083 - DNA, 25 bp, Mus musculus
tggcggcctctgcttggacgcgcac

SEQ ID NO: 321084 - DNA, 25 bp, Mus musculus
gggtgtttacttccgcgcgtgcgac

SEQ ID NO: 321085 - DNA, 25 bp, Mus musculus
cgccctgatgacgtaggggtgttta

SEQ ID NO: 321086 - DNA, 25 bp, Mus musculus
acacgtccacggagccgaggagatg

SEQ ID NO: 321087 - DNA, 25 bp, Mus musculus
catagacccggtccggagaagaagc

SEQ ID NO: 321088 - DNA, 25 bp, Mus musculus
tggagctctattggccgctcgcctt

SEQ ID NO: 321089 - DNA, 25 bp, Mus musculus
ctcttcctggagctctattggccgc

SEQ ID NO: 321090 - DNA, 25 bp, Mus musculus
atgcgaacagctgacggccgctctt

SEQ ID NO: 321091 - DNA, 25 bp, Mus musculus
cggaccgtacctctgtcagcgatgc

SEQ ID NO: 321092 - DNA, 25 bp, Mus musculus
ctgccgcccacagatgtacttttcg

SEQ ID NO: 321093 - DNA, 25 bp, Mus musculus
cgcaaagttcgtcgtctggcttaaa

SEQ ID NO: 321094 - DNA, 25 bp, Mus musculus
aaataactccctccgggtgccacag

SEQ ID NO: 321095 - DNA, 25 bp, Mus musculus
taagccggaggcgacaaagtagccc

SEQ ID NO: 321096 - DNA, 25 bp, Mus musculus
gacctgcccggttgccaccgtggtg

SEQ ID NO: 321097 - DNA, 25 bp, Mus musculus
ggccaaggccatcgcaaccgagcgg

SEQ ID NO: 321098 - DNA, 25 bp, Mus musculus
accgagcggcggaattacaaaggag

SEQ ID NO: 321099 - DNA, 25 bp, Mus musculus
cctttgtcctgcatctggcatcgga

SEQ ID NO: 321100 - DNA, 25 bp, Mus musculus
ggagcgccctcgtcgtcactggctt

SEQ ID NO: 321101 - DNA, 25 bp, Mus musculus
ctcaaccctggagtctgcgtcagca

SEQ ID NO: 321102 - DNA, 25 bp, Mus musculus
tcatccctaccggagagctcggatc

SEQ ID NO: 321103 - DNA, 25 bp, Mus musculus
tctacttcagataccctgtggggcg

SEQ ID NO: 321104 - DNA, 25 bp, Mus musculus
gagcgctcgccacaacggttcggct

SEQ ID NO: 321105 - DNA, 25 bp, Mus musculus
agctgcgcagccgagcgactgccga

SEQ ID NO: 321106 - DNA, 25 bp, Mus musculus
gctgctctcgcgatacttgagtgac

SEQ ID NO: 321107 - DNA, 25 bp, Mus musculus
ccctgtggggcgtaagcaacgccta

SEQ ID NO: 321108 - DNA, 25 bp, Mus musculus
acttgagtgacagcgtggtctccca

SEQ ID NO: 321109 - DNA, 25 bp, Mus musculus
tcgagatccctcatacctggcggta

SEQ ID NO: 321110 - DNA, 25 bp, Mus musculus
agcgcgcgccagtgtttgtaaacaa

SEQ ID NO: 321111 - DNA, 25 bp, Mus musculus
agccaatcactggaggacggaactc

SEQ ID NO: 321112 - DNA, 25 bp, Mus musculus
gcacatagcaacacgccactggttg

SEQ ID NO: 321113 - DNA, 25 bp, Mus musculus
tatcccatcggctcagcacatagca

SEQ ID NO: 321114 - DNA, 25 bp, Mus musculus
tgcgcgctcttaaagccacagtctc

SEQ ID NO: 321115 - DNA, 25 bp, Mus musculus
acaaaccggtcacgtggctgcagca

SEQ ID NO: 321116 - DNA, 25 bp, Mus musculus
agcccgaactggagcggaatgcgcc

SEQ ID NO: 321117 - DNA, 25 bp, Mus musculus
cccatatttgccaggcggctcgtcg

SEQ ID NO: 321118 - DNA, 25 bp, Mus musculus
gagacatcgaccatacagccgggtg

SEQ ID NO: 321119 - DNA, 25 bp, Mus musculus
ccagacccaactatctcaatggaga

SEQ ID NO: 321120 - DNA, 25 bp, Mus musculus
tccaggcaggaactcgctgtggttc

SEQ ID NO: 321121 - DNA, 25 bp, Mus musculus
cgcagcgagtctggcaacagagttc

SEQ ID NO: 321122 - DNA, 25 bp, Mus musculus
atgaaggactgcacggctgactcta

SEQ ID NO: 321123 - DNA, 25 bp, Mus musculus
tgccctcggcgtagcgcacttgttc

SEQ ID NO: 321124 - DNA, 25 bp, Mus musculus
gcggtggacgacatcctcggtcacc

SEQ ID NO: 321125 - DNA, 25 bp, Mus musculus
cccgactgtgctgtgatggtagcaa

SEQ ID NO: 321126 - DNA, 25 bp, Mus musculus
tgctgtgatggtagcaacggccgca

SEQ ID NO: 321127 - DNA, 25 bp, Mus musculus
ggcagctgctcgaggtctgctcgcc

SEQ ID NO: 321128 - DNA, 25 bp, Mus musculus
tcaccgccttctgggcctgagaccc

SEQ ID NO: 321129 - DNA, 25 bp, Mus musculus
cgcacttgttcgtgcggactcagca

SEQ ID NO: 321130 - DNA, 25 bp, Mus musculus
ttcgtgcggactcagcacgcaggcg

SEQ ID NO: 321131 - DNA, 25 bp, Mus musculus
cgcccgagcaacaaaggggctcaga

SEQ ID NO: 321132 - DNA, 25 bp, Mus musculus
gggctcagatacgcaggcgcgctac

SEQ ID NO: 321133 - DNA, 25 bp, Mus musculus
ctggcagctgtggtcccacgcgcag

SEQ ID NO: 321134 - DNA, 25 bp, Mus musculus
tcccacgcgcaggtgcttcgaagaa

SEQ ID NO: 321135 - DNA, 25 bp, Mus musculus
cgcgcaggtgcttcgaagaagaccc

SEQ ID NO: 321136 - DNA, 25 bp, Mus musculus
cagcgccggcagctgctcgaggtct

SEQ ID NO: 321137 - DNA, 25 bp, Mus musculus
ccgtagccatacctccgcgaagtga

SEQ ID NO: 321138 - DNA, 25 bp, Mus musculus
agagcttcctctagcgttcttccgg

SEQ ID NO: 321139 - DNA, 25 bp, Mus musculus
acttctcggagttgaggcgcagagc

SEQ ID NO: 321140 - DNA, 25 bp, Mus musculus
cgccatggcggagaaagagcttcct

SEQ ID NO: 321141 - DNA, 25 bp, Mus musculus
cccatgagcagctcgcgcaagctga

SEQ ID NO: 321142 - DNA, 25 bp, Mus musculus
ttgccgaagattcccaccacgcaga

SEQ ID NO: 321143 - DNA, 25 bp, Mus musculus
cgcagagccgtcttgccgaagattc

SEQ ID NO: 321144 - DNA, 25 bp, Mus musculus
gtcgatcgcacacagtattcaccag

SEQ ID NO: 321145 - DNA, 25 bp, Mus musculus
agagtgggaaaacctgtcgatcgca

SEQ ID NO: 321146 - DNA, 25 bp, Mus musculus
ccaggatcctgatggtgaaagagtg

SEQ ID NO: 321147 - DNA, 25 bp, Mus musculus
ttccagttcctggatctccaggatc

SEQ ID NO: 321148 - DNA, 25 bp, Mus musculus
gcctctccgacagagacagctttgg

SEQ ID NO: 321149 - DNA, 25 bp, Mus musculus
cagctttggtcttgattccagttcc

SEQ ID NO: 321150 - DNA, 25 bp, Mus musculus
gtattcaccagagagaacttctcgg

SEQ ID NO: 321151 - DNA, 25 bp, Mus musculus
ggtctctacagggttcgttgtcttg

SEQ ID NO: 321152 - DNA, 25 bp, Mus musculus
aggtgtgtcacgtcgcctaggcccg

SEQ ID NO: 321153 - DNA, 25 bp, Mus musculus
aaaaggaggtgtgtcacgtcgccta

SEQ ID NO: 321154 - DNA, 25 bp, Mus musculus
cttgtatgaataaggaaaggcgggc

SEQ ID NO: 321155 - DNA, 25 bp, Mus musculus
aactgaggcgcttcttgtatgaata

SEQ ID NO: 321156 - DNA, 25 bp, Mus musculus
tggccaatcggaactgaggcgcttc

SEQ ID NO: 321157 - DNA, 25 bp, Mus musculus
agagcatcacatcctggccaatcgg

SEQ ID NO: 321158 - DNA, 25 bp, Mus musculus
ttggccaaaagagcatcacatcctg

SEQ ID NO: 321159 - DNA, 25 bp, Mus musculus
ttggactacgattggccaaaagagc

SEQ ID NO: 321160 - DNA, 25 bp, Mus musculus
agcacagcttggactacgattggcc

SEQ ID NO: 321161 - DNA, 25 bp, Mus musculus
cgacgagcgaccaatcgtagacgtg

SEQ ID NO: 321162 - DNA, 25 bp, Mus musculus
cagggttcgttgtcttgaaaggatc

SEQ ID NO: 321163 - DNA, 25 bp, Mus musculus
accaatcgtagacgtggtctctaca

SEQ ID NO: 321164 - DNA, 25 bp, Mus musculus
cttgaaaggatcaaagcacagcttg

SEQ ID NO: 321165 - DNA, 25 bp, Mus musculus
ggttttctccttcatcggctccagg

SEQ ID NO: 321166 - DNA, 25 bp, Mus musculus
tacatccggggaactcgtgagggaa

SEQ ID NO: 321167 - DNA, 25 bp, Mus musculus
cggtctttaatagctcggaggagga

SEQ ID NO: 321168 - DNA, 25 bp, Mus musculus
tgggacagtctgaaagaagatgcta

SEQ ID NO: 321169 - DNA, 25 bp, Mus musculus
cggttccgcagactgggctctttgc

SEQ ID NO: 321170 - DNA, 25 bp, Mus musculus
tgctagacttgcacgagaaacttgc

SEQ ID NO: 321171 - DNA, 25 bp, Mus musculus
catgcacctactcgcaggcgagctg

SEQ ID NO: 321172 - DNA, 25 bp, Mus musculus
cgcggagaaattcaagtccaccatg

SEQ ID NO: 321173 - DNA, 25 bp, Mus musculus
gagagaggtcgtttacgtctcccga

SEQ ID NO: 321174 - DNA, 25 bp, Mus musculus
acagataccgcctcacgaatttcta

SEQ ID NO: 321175 - DNA, 25 bp, Mus musculus
ccaagcgtgactggaacggtcttta

SEQ ID NO: 321176 - DNA, 25 bp, Mus musculus
accttccttgcccaagcgtgactgg

SEQ ID NO: 321177 - DNA, 25 bp, Mus musculus
gcctcacgaatttctaccttccttg

SEQ ID NO: 321178 - DNA, 25 bp, Mus musculus
aacttgcccgcggttccgcagactg

SEQ ID NO: 321179 - DNA, 25 bp, Mus musculus
aggtttggtgtctgctcggctgcaa

SEQ ID NO: 321180 - DNA, 25 bp, Mus musculus
ccgccctcctagctaggcgccgggc

SEQ ID NO: 321181 - DNA, 25 bp, Mus musculus
ccagactcccgatcgccgcagaccc

SEQ ID NO: 321182 - DNA, 25 bp, Mus musculus
tcagtcctggatcccaagcgccctt

SEQ ID NO: 321183 - DNA, 25 bp, Mus musculus
cccaaacaaagagtgtggcggcgtg

SEQ ID NO: 321184 - DNA, 25 bp, Mus musculus
gtctccgcgcccaggtttggtgtct

SEQ ID NO: 321185 - DNA, 25 bp, Mus musculus
ggcgatagtgtggttccgcccccgc

SEQ ID NO: 321186 - DNA, 25 bp, Mus musculus
gctcggctgcaacccagttccaaga

SEQ ID NO: 321187 - DNA, 25 bp, Mus musculus
aatcgctacggaccgcccgcgcacc

SEQ ID NO: 321188 - DNA, 25 bp, Mus musculus
ggcggctccggcaatcgctacggac

SEQ ID NO: 321189 - DNA, 25 bp, Mus musculus
ctcgaggcggctccggcaatcgcta

SEQ ID NO: 321190 - DNA, 25 bp, Mus musculus
gatggccgaagcgaagctgggctcc

SEQ ID NO: 321191 - DNA, 25 bp, Mus musculus
gctcccgaccctggtacctgggcga

SEQ ID NO: 321192 - DNA, 25 bp, Mus musculus
gtccctacaccctcaactgtctccg

SEQ ID NO: 321193 - DNA, 25 bp, Mus musculus
aatctgttccgcagtcaggtgctgc

SEQ ID NO: 321194 - DNA, 25 bp, Mus musculus
tctagctgccctggttaccgttggt

SEQ ID NO: 321195 - DNA, 25 bp, Mus musculus
gcatgcccggtgctgaatctgttcc

SEQ ID NO: 321196 - DNA, 25 bp, Mus musculus
ggtagtgcttccagccctcagcatg

SEQ ID NO: 321197 - DNA, 25 bp, Mus musculus
ctgacagcgcagacacggactccga

SEQ ID NO: 321198 - DNA, 25 bp, Mus musculus
cgaattctctgtggcgcctgttccg

SEQ ID NO: 321199 - DNA, 25 bp, Mus musculus
agctccagcgatgccttggcacctg

SEQ ID NO: 321200 - DNA, 25 bp, Mus musculus
ccgttggtgtttgcgaattctctgt

SEQ ID NO: 321201 - DNA, 25 bp, Mus musculus
gcctctccaagtctcgtgtgctgcg

SEQ ID NO: 321202 - DNA, 25 bp, Mus musculus
taaaatctgcgaggcgaagggcacc

SEQ ID NO: 321203 - DNA, 25 bp, Mus musculus
ggagcctacatcactggcggtaaaa

SEQ ID NO: 321204 - DNA, 25 bp, Mus musculus
ccaattaggacgcaccaaggagcct

SEQ ID NO: 321205 - DNA, 25 bp, Mus musculus
ggagcgtggcttcttccaattagga

SEQ ID NO: 321206 - DNA, 25 bp, Mus musculus
ccttcctaatactcgggagcgtggc

SEQ ID NO: 321207 - DNA, 25 bp, Mus musculus
actcgcccaggaacagctccaggaa

SEQ ID NO: 321208 - DNA, 25 bp, Mus musculus
ctatttgtagagctgctgcaggcac

SEQ ID NO: 321209 - DNA, 25 bp, Mus musculus
ctgcaggcacaggtccaggctctcg

SEQ ID NO: 321210 - DNA, 25 bp, Mus musculus
tcctctcgggtgatgcgctccgaca

SEQ ID NO: 321211 - DNA, 25 bp, Mus musculus
tcgcctctaccgtcgcagcgtcctc

SEQ ID NO: 321212 - DNA, 25 bp, Mus musculus
tcagccgcgactagctcggcttcgg

SEQ ID NO: 321213 - DNA, 25 bp, Mus musculus
ggtccgcggaactcgcccaggaaca

SEQ ID NO: 321214 - DNA, 25 bp, Mus musculus
gaagcgccggtaagttttctcctca

SEQ ID NO: 321215 - DNA, 25 bp, Mus musculus
gttttctcctcagggatgcagcccg

SEQ ID NO: 321216 - DNA, 25 bp, Mus musculus
atgcagcccgccatcgttgctcatg

SEQ ID NO: 321217 - DNA, 25 bp, Mus musculus
accggcgatcagcactgggttgcct

SEQ ID NO: 321218 - DNA, 25 bp, Mus musculus
ggcccacccgcaatccctaccgaga

SEQ ID NO: 321219 - DNA, 25 bp, Mus musculus
cccgctacttaactatttgtagagc

SEQ ID NO: 321220 - DNA, 25 bp, Mus musculus
ccggtaagttttctcctcagggatg

SEQ ID NO: 321221 - DNA, 25 bp, Mus musculus
ggagacagcggataacccaccaact

SEQ ID NO: 321222 - DNA, 25 bp, Mus musculus
cgtttcggatatagcctgacagtga

SEQ ID NO: 321223 - DNA, 25 bp, Mus musculus
tcactcgtccgagtcacgtttcgga

SEQ ID NO: 321224 - DNA, 25 bp, Mus musculus
ggttgtcttctagtttcactcgtcc

SEQ ID NO: 321225 - DNA, 25 bp, Mus musculus
actggtttcatgtaaggttgtcttc

SEQ ID NO: 321226 - DNA, 25 bp, Mus musculus
ctgaggaaatcccacacactggttt

SEQ ID NO: 321227 - DNA, 25 bp, Mus musculus
ctagactcacgaggccttgctgctg

SEQ ID NO: 321228 - DNA, 25 bp, Mus musculus
gcgtgacgtcacacgcgcggcgtaa

SEQ ID NO: 321229 - DNA, 25 bp, Mus musculus
ttttttgagagctcggcggctacgc

SEQ ID NO: 321230 - DNA, 25 bp, Mus musculus
ctaggacgtcctccgccgtctgaaa

SEQ ID NO: 321231 - DNA, 25 bp, Mus musculus
cggagggcttcacctctaggacgtc

SEQ ID NO: 321232 - DNA, 25 bp, Mus musculus
agtcgttacctttgctgagctcgga

SEQ ID NO: 321233 - DNA, 25 bp, Mus musculus
atcagctggcagctgggagtcgtta

SEQ ID NO: 321234 - DNA, 25 bp, Mus musculus
ggcgcgaaagcgctggaaacccaaa

SEQ ID NO: 321235 - DNA, 25 bp, Mus musculus
ctgaacacggcgttcgaccggctgc

SEQ ID NO: 321236 - DNA, 25 bp, Mus musculus
acacggcgttcgaccggctgcgcag

SEQ ID NO: 321237 - DNA, 25 bp, Mus musculus
cagtggggccaggacaagaagctgt

SEQ ID NO: 321238 - DNA, 25 bp, Mus musculus
gtccaagtacgagacactgcagatg

SEQ ID NO: 321239 - DNA, 25 bp, Mus musculus
tacgagacactgcagatggcgctca

SEQ ID NO: 321240 - DNA, 25 bp, Mus musculus
agacactgcagatggcgctcagcta

SEQ ID NO: 321241 - DNA, 25 bp, Mus musculus
ctgcagatggcgctcagctacatca

SEQ ID NO: 321242 - DNA, 25 bp, Mus musculus
agatggcgctcagctacatcatcgc

SEQ ID NO: 321243 - DNA, 25 bp, Mus musculus
tggcgctcagctacatcatcgcgct

SEQ ID NO: 321244 - DNA, 25 bp, Mus musculus
atcatcgcgctcacccgcatcctag

SEQ ID NO: 321245 - DNA, 25 bp, Mus musculus
cgcatcctagccgaagccgagcggg

SEQ ID NO: 321246 - DNA, 25 bp, Mus musculus
atcctagccgaagccgagcgggact

SEQ ID NO: 321247 - DNA, 25 bp, Mus musculus
catgcaggggctgaacacggcgttc

SEQ ID NO: 321248 - DNA, 25 bp, Mus musculus
caagaagctgtccaagtacgagaca

SEQ ID NO: 321249 - DNA, 25 bp, Mus musculus
taaaccggcgcgcatctgcgaactc

SEQ ID NO: 321250 - DNA, 25 bp, Mus musculus
catctgcgaactcgcgtgcgcctag

SEQ ID NO: 321251 - DNA, 25 bp, Mus musculus
agcccgaggtctaaaccggcgcgca

SEQ ID NO: 321252 - DNA, 25 bp, Mus musculus
gcccgaggtctaaaccggcgcgcat

SEQ ID NO: 321253 - DNA, 25 bp, Mus musculus
ccgaggtctaaaccggcgcgcatct

SEQ ID NO: 321254 - DNA, 25 bp, Mus musculus
cgaggtctaaaccggcgcgcatctg

SEQ ID NO: 321255 - DNA, 25 bp, Mus musculus
gaggtctaaaccggcgcgcatctgc

SEQ ID NO: 321256 - DNA, 25 bp, Mus musculus
aaaccggcgcgcatctgcgaactcg

SEQ ID NO: 321257 - DNA, 25 bp, Mus musculus
cggcgcgcatctgcgaactcgcgtg

SEQ ID NO: 321258 - DNA, 25 bp, Mus musculus
aaccggcgcgcatctgcgaactcgc

SEQ ID NO: 321259 - DNA, 25 bp, Mus musculus
gcatctgcgaactcgcgtgcgccta

SEQ ID NO: 321260 - DNA, 25 bp, Mus musculus
ctgcgaactcgcgtgcgcctaggcg

SEQ ID NO: 321261 - DNA, 25 bp, Mus musculus
gcgaactcgcgtgcgcctaggcggc

SEQ ID NO: 321262 - DNA, 25 bp, Mus musculus
gcgcgcatctgcgaactcgcgtgcg

SEQ ID NO: 321263 - DNA, 25 bp, Mus musculus
cgcgaagcttacgcatggcagaagc

SEQ ID NO: 321264 - DNA, 25 bp, Mus musculus
ttgcggcttcgcgaagcttacgcat

SEQ ID NO: 321265 - DNA, 25 bp, Mus musculus
tgcggcttcgcgaagcttacgcatg

SEQ ID NO: 321266 - DNA, 25 bp, Mus musculus
cttgcggcttcgcgaagcttacgca

SEQ ID NO: 321267 - DNA, 25 bp, Mus musculus
gcggcttcgcgaagcttacgcatgg

SEQ ID NO: 321268 - DNA, 25 bp, Mus musculus
tcgcgaagcttacgcatggcagaag

SEQ ID NO: 321269 - DNA, 25 bp, Mus musculus
cggcttcgcgaagcttacgcatggc

SEQ ID NO: 321270 - DNA, 25 bp, Mus musculus
ggcttcgcgaagcttacgcatggca

SEQ ID NO: 321271 - DNA, 25 bp, Mus musculus
gcttcgcgaagcttacgcatggcag

SEQ ID NO: 321272 - DNA, 25 bp, Mus musculus
cttcgcgaagcttacgcatggcaga

SEQ ID NO: 321273 - DNA, 25 bp, Mus musculus
ttcgcgaagcttacgcatggcagaa

SEQ ID NO: 321274 - DNA, 25 bp, Mus musculus
aacttgcggcttcgcgaagcttacg

SEQ ID NO: 321275 - DNA, 25 bp, Mus musculus
gcgaagcttacgcatggcagaagcg

SEQ ID NO: 321276 - DNA, 25 bp, Mus musculus
acttgcggcttcgcgaagcttacgc

SEQ ID NO: 321277 - DNA, 25 bp, Mus musculus
gctgttcggcgaccgtatgctaatc

SEQ ID NO: 321278 - DNA, 25 bp, Mus musculus
gtcggtctgtcagagaaggtgtccc

SEQ ID NO: 321279 - DNA, 25 bp, Mus musculus
tagcgactcaaaatgccccgtggac

SEQ ID NO: 321280 - DNA, 25 bp, Mus musculus
gacacggtagcgactcaaaatgccc

SEQ ID NO: 321281 - DNA, 25 bp, Mus musculus
tctgtgcgtcagtcgccgtgactaa

SEQ ID NO: 321282 - DNA, 25 bp, Mus musculus
tcagtcgccgtgactaagatgtggg

SEQ ID NO: 321283 - DNA, 25 bp, Mus musculus
taatcgcggtgacagtctgcgtggt

SEQ ID NO: 321284 - DNA, 25 bp, Mus musculus
atgctaatcgcggtgacagtctgcg

SEQ ID NO: 321285 - DNA, 25 bp, Mus musculus
cagacgcggtgtgagatagaggcgc

SEQ ID NO: 321286 - DNA, 25 bp, Mus musculus
tcggcgaccgtatgctaatcgcggt

SEQ ID NO: 321287 - DNA, 25 bp, Mus musculus
gatgtcacgggtcgtctgtgcgtca

SEQ ID NO: 321288 - DNA, 25 bp, Mus musculus
tgtagggacacggtagcgactcaaa

SEQ ID NO: 321289 - DNA, 25 bp, Mus musculus
atccgattggctgttcggcgaccgt

SEQ ID NO: 321290 - DNA, 25 bp, Mus musculus
ccgtatgctaatcgcggtgacagtc

SEQ ID NO: 321291 - DNA, 25 bp, Mus musculus
ttgatccagtagtccaaactgtcgc

SEQ ID NO: 321292 - DNA, 25 bp, Mus musculus
ttcgcaaaacttacagccgcatggc

SEQ ID NO: 321293 - DNA, 25 bp, Mus musculus
gcttcgcaaaacttacagccgcatg

SEQ ID NO: 321294 - DNA, 25 bp, Mus musculus
ttgcggcttcgcaaaacttacagcc

SEQ ID NO: 321295 - DNA, 25 bp, Mus musculus
aacttgcggcttcgcaaaacttaca

SEQ ID NO: 321296 - DNA, 25 bp, Mus musculus
tcgcaaaacttacagccgcatggca

SEQ ID NO: 321297 - DNA, 25 bp, Mus musculus
atccagtagtccaaactgtcgcgcg

SEQ ID NO: 321298 - DNA, 25 bp, Mus musculus
aacttacagccgcatggcagaagcg

SEQ ID NO: 321299 - DNA, 25 bp, Mus musculus
ggcttgatccagtagtccaaactgt

SEQ ID NO: 321300 - DNA, 25 bp, Mus musculus
gaaggcttgatccagtagtccaaac

SEQ ID NO: 321301 - DNA, 25 bp, Mus musculus
cggaaggcttgatccagtagtccaa

SEQ ID NO: 321302 - DNA, 25 bp, Mus musculus
cgcggaaggcttgatccagtagtcc

SEQ ID NO: 321303 - DNA, 25 bp, Mus musculus
gcaaaacttacagccgcatggcaga

SEQ ID NO: 321304 - DNA, 25 bp, Mus musculus
ccagtagtccaaactgtcgcgcgtc

SEQ ID NO: 321305 - DNA, 25 bp, Mus musculus
gctcgggctgcaaccatggtaagga

SEQ ID NO: 321306 - DNA, 25 bp, Mus musculus
gttccgaaatgcactgctggcgcta

SEQ ID NO: 321307 - DNA, 25 bp, Mus musculus
accagcggaccgcactcttgcaagg

SEQ ID NO: 321308 - DNA, 25 bp, Mus musculus
gaggtcggtgcgcagctcgcatcac

SEQ ID NO: 321309 - DNA, 25 bp, Mus musculus
ccgaaatgcactgctggcgctaggc

SEQ ID NO: 321310 - DNA, 25 bp, Mus musculus
ctccgggttccgaaatgcactgctg

SEQ ID NO: 321311 - DNA, 25 bp, Mus musculus
ccggctccgggttccgaaatgcact

SEQ ID NO: 321312 - DNA, 25 bp, Mus musculus
gacagccagaaacgcagggcctgcc

SEQ ID NO: 321313 - DNA, 25 bp, Mus musculus
agaggacagccagaaacgcagggcc

SEQ ID NO: 321314 - DNA, 25 bp, Mus musculus
ctgcaaccatggtaaggagagagga

SEQ ID NO: 321315 - DNA, 25 bp, Mus musculus
tcgggctgcaaccatggtaaggaga

SEQ ID NO: 321316 - DNA, 25 bp, Mus musculus
cagctcgcatcacgggtgactgggg

SEQ ID NO: 321317 - DNA, 25 bp, Mus musculus
caaagaggtcggtgcgcagctcgca

SEQ ID NO: 321318 - DNA, 25 bp, Mus musculus
aaatgcactgctggcgctaggcgcg

SEQ ID NO: 321319 - DNA, 25 bp, Mus musculus
ctagagatacgattggttggggaca

SEQ ID NO: 321320 - DNA, 25 bp, Mus musculus
atttgcgaactacctctcgggcggg

SEQ ID NO: 321321 - DNA, 25 bp, Mus musculus
ccgggcgacgaaacacgagagtgat

SEQ ID NO: 321322 - DNA, 25 bp, Mus musculus
tacccttcctttctcgcattactgg

SEQ ID NO: 321323 - DNA, 25 bp, Mus musculus
cactgggttaaaacgctgagccacc

SEQ ID NO: 321324 - DNA, 25 bp, Mus musculus
tgggaaccacaacgaccaagtcctg

SEQ ID NO: 321325 - DNA, 25 bp, Mus musculus
ccaccgcgaggtcatttgcgaacta

SEQ ID NO: 321326 - DNA, 25 bp, Mus musculus
gtgactgctaccattccctgcaatg

SEQ ID NO: 321327 - DNA, 25 bp, Mus musculus
cccagttgcgctaccagtaggcgac

SEQ ID NO: 321328 - DNA, 25 bp, Mus musculus
agggacgcgctgtgatttcctattg

SEQ ID NO: 321329 - DNA, 25 bp, Mus musculus
tttcctattggtcgtgtctgctctc

SEQ ID NO: 321330 - DNA, 25 bp, Mus musculus
tacaagctgagagggcgtctgccca

SEQ ID NO: 321331 - DNA, 25 bp, Mus musculus
acgccgcctgggtgagtcactgtac

SEQ ID NO: 321332 - DNA, 25 bp, Mus musculus
ctccgggtgccggataggttacaag

SEQ ID NO: 321333 - DNA, 25 bp, Mus musculus
acatgtgcgctggtccagacagccc

SEQ ID NO: 321334 - DNA, 25 bp, Mus musculus
ctccggggacatgtgcgctggtcca

SEQ ID NO: 321335 - DNA, 25 bp, Mus musculus
tgcgctggtccagacagcccgtgac

SEQ ID NO: 321336 - DNA, 25 bp, Mus musculus
ctggtccagacagcccgtgaccatg

SEQ ID NO: 321337 - DNA, 25 bp, Mus musculus
agacagcccgtgaccatgagcctga

SEQ ID NO: 321338 - DNA, 25 bp, Mus musculus
gtgaccatgagcctgaccgcccgcg

SEQ ID NO: 321339 - DNA, 25 bp, Mus musculus
gcgcttgcttctggccgtggctgca

SEQ ID NO: 321340 - DNA, 25 bp, Mus musculus
gtcctggcgccagggcgcttgcttc

SEQ ID NO: 321341 - DNA, 25 bp, Mus musculus
ccgagcccgctccattgtggagagg

SEQ ID NO: 321342 - DNA, 25 bp, Mus musculus
cctcccttcgctcttgccagagggc

SEQ ID NO: 321343 - DNA, 25 bp, Mus musculus
tcctgggctctcctgtcgctgagct

SEQ ID NO: 321344 - DNA, 25 bp, Mus musculus
tcggcggagtcctgggctctcctgt

SEQ ID NO: 321345 - DNA, 25 bp, Mus musculus
agccgagcccgctccattgtggaga

SEQ ID NO: 321346 - DNA, 25 bp, Mus musculus
ttgcttctggccgtggctgcatcag

SEQ ID NO: 321347 - DNA, 25 bp, Mus musculus
cgatcttggcgcgaaacttcatggc

SEQ ID NO: 321348 - DNA, 25 bp, Mus musculus
tccctggtagccgtggctcttctca

SEQ ID NO: 321349 - DNA, 25 bp, Mus musculus
tagccgtggctcttctcagggccgc

SEQ ID NO: 321350 - DNA, 25 bp, Mus musculus
gtcctctcacaagggccgcactctc

SEQ ID NO: 321351 - DNA, 25 bp, Mus musculus
gcagccctgccagctcacgtgtgaa

SEQ ID NO: 321352 - DNA, 25 bp, Mus musculus
cacgtgtgaaatgattcagacaagc

SEQ ID NO: 321353 - DNA, 25 bp, Mus musculus
ggacaaaagtccctccctgagcgtc

SEQ ID NO: 321354 - DNA, 25 bp, Mus musculus
ggtccacgatcttggcgcgaaactt

SEQ ID NO: 321355 - DNA, 25 bp, Mus musculus
caccgcctgcccaggacaaaggttc

SEQ ID NO: 321356 - DNA, 25 bp, Mus musculus
gcgcgaaacttcatggcggatacca

SEQ ID NO: 321357 - DNA, 25 bp, Mus musculus
cttcatggcggataccaggccgacg

SEQ ID NO: 321358 - DNA, 25 bp, Mus musculus
ggcggacaaaagtccctccctgagc

SEQ ID NO: 321359 - DNA, 25 bp, Mus musculus
ggctgcaaaaggaaggtccctggta

SEQ ID NO: 321360 - DNA, 25 bp, Mus musculus
tcagacaagccaggtccacgatctt

SEQ ID NO: 321361 - DNA, 25 bp, Mus musculus
cccattggccacaccggagggcgtg

SEQ ID NO: 321362 - DNA, 25 bp, Mus musculus
ctgccctcctgggaacagacagaga

SEQ ID NO: 321363 - DNA, 25 bp, Mus musculus
cctcggccagagcagcatggtgagt

SEQ ID NO: 321364 - DNA, 25 bp, Mus musculus
ttctggaaggcacgcgaaggtagcc

SEQ ID NO: 321365 - DNA, 25 bp, Mus musculus
gtgtgccacctagatcctcgctttc

SEQ ID NO: 321366 - DNA, 25 bp, Mus musculus
tcgaaggcgtgcatcccaaccgagg

SEQ ID NO: 321367 - DNA, 25 bp, Mus musculus
tggtgaacagccctcggtaccgctc

SEQ ID NO: 321368 - DNA, 25 bp, Mus musculus
ggtaccgctccatccgctgggacgg

SEQ ID NO: 321369 - DNA, 25 bp, Mus musculus
ggagctcttcaaaaccaccaacttc

SEQ ID NO: 321370 - DNA, 25 bp, Mus musculus
aacctctacggcttccgcaaggtgg

SEQ ID NO: 321371 - DNA, 25 bp, Mus musculus
tcagctgctcgttcacctcaagagg

SEQ ID NO: 321372 - DNA, 25 bp, Mus musculus
gttcacctcaagaggctcaccagtg

SEQ ID NO: 321373 - DNA, 25 bp, Mus musculus
caccagtgccaacaaggccaagctg

SEQ ID NO: 321374 - DNA, 25 bp, Mus musculus
aaggtagccttgtgtcgcagtgtcc

SEQ ID NO: 321375 - DNA, 25 bp, Mus musculus
gctcgctgcctgtgtgccttcgtcg

SEQ ID NO: 321376 - DNA, 25 bp, Mus musculus
gctagtcgtccgctgtcgccggctt

SEQ ID NO: 321377 - DNA, 25 bp, Mus musculus
tccggttccgcaatgccgcgcggag

SEQ ID NO: 321378 - DNA, 25 bp, Mus musculus
ctagcctctaaggaggcgcggcctg

SEQ ID NO: 321379 - DNA, 25 bp, Mus musculus
tccctagcctctaaggaggcgcggc

SEQ ID NO: 321380 - DNA, 25 bp, Mus musculus
ctccctagcctctaaggaggcgcgg

SEQ ID NO: 321381 - DNA, 25 bp, Mus musculus
gcgggcttctgcagccctgccctgg

SEQ ID NO: 321382 - DNA, 25 bp, Mus musculus
tcatcgcgcgggcttctgcagccct

SEQ ID NO: 321383 - DNA, 25 bp, Mus musculus
cgctgcgatcatcgcgcgggcttct

SEQ ID NO: 321384 - DNA, 25 bp, Mus musculus
tcgctgcgatcatcgcgcgggcttc

SEQ ID NO: 321385 - DNA, 25 bp, Mus musculus
gctgttctcgctgcgatcatcgcgc

SEQ ID NO: 321386 - DNA, 25 bp, Mus musculus
cgctgttctcgctgcgatcatcgcg

SEQ ID NO: 321387 - DNA, 25 bp, Mus musculus
tggcccggcccggtcacgctcgctg

SEQ ID NO: 321388 - DNA, 25 bp, Mus musculus
acgctcgctgcctgtgtgccttcgt

SEQ ID NO: 321389 - DNA, 25 bp, Mus musculus
tacaaagcgtaaattatgagccagg

SEQ ID NO: 321390 - DNA, 25 bp, Mus musculus
tcgagaggcttttaggaggaattaa

SEQ ID NO: 321391 - DNA, 25 bp, Mus musculus
atcgagaggcttttaggaggaatta

SEQ ID NO: 321392 - DNA, 25 bp, Mus musculus
gcaatcgagaggcttttaggaggaa

SEQ ID NO: 321393 - DNA, 25 bp, Mus musculus
cgcgcaatcgagaggcttttaggag

SEQ ID NO: 321394 - DNA, 25 bp, Mus musculus
gcgcgcaatcgagaggcttttagga

SEQ ID NO: 321395 - DNA, 25 bp, Mus musculus
aggcgcgcaatcgagaggcttttag

SEQ ID NO: 321396 - DNA, 25 bp, Mus musculus
ccaggcgcgcaatcgagaggctttt

SEQ ID NO: 321397 - DNA, 25 bp, Mus musculus
agccaggcgcgcaatcgagaggctt

SEQ ID NO: 321398 - DNA, 25 bp, Mus musculus
aattatgagccaggcgcgcaatcga

SEQ ID NO: 321399 - DNA, 25 bp, Mus musculus
taaattatgagccaggcgcgcaatc

SEQ ID NO: 321400 - DNA, 25 bp, Mus musculus
gcgtaaattatgagccaggcgcgca

SEQ ID NO: 321401 - DNA, 25 bp, Mus musculus
caaagcgtaaattatgagccaggcg

SEQ ID NO: 321402 - DNA, 25 bp, Mus musculus
agagttttacaaagcgtaaattatg

SEQ ID NO: 321403 - DNA, 25 bp, Mus musculus
ttttgtctctgcaggcgtccagaaa

SEQ ID NO: 321404 - DNA, 25 bp, Mus musculus
attctgagcattccggacactgaga

SEQ ID NO: 321405 - DNA, 25 bp, Mus musculus
taaatacgcgtttccctctatccaa

SEQ ID NO: 321406 - DNA, 25 bp, Mus musculus
gtcggcacggctcaagctagcattc

SEQ ID NO: 321407 - DNA, 25 bp, Mus musculus
ctcaagctagcattcctggggaccg

SEQ ID NO: 321408 - DNA, 25 bp, Mus musculus
gcattcctggggaccgcaaacgaaa

SEQ ID NO: 321409 - DNA, 25 bp, Mus musculus
ctatcacgctctcccagttacaaga

SEQ ID NO: 321410 - DNA, 25 bp, Mus musculus
ctctcccagttacaagaaggggtgg

SEQ ID NO: 321411 - DNA, 25 bp, Mus musculus
cctcgtcgggtttttgtctctgcag

SEQ ID NO: 321412 - DNA, 25 bp, Mus musculus
ggcgtccagaaaggcaagactcatt

SEQ ID NO: 321413 - DNA, 25 bp, Mus musculus
tcgagccttaaaacaacctagcgcg

SEQ ID NO: 321414 - DNA, 25 bp, Mus musculus
taaaacaacctagcgcgaagcggcg

SEQ ID NO: 321415 - DNA, 25 bp, Mus musculus
gcaagactcattgcctcgagcctta

SEQ ID NO: 321416 - DNA, 25 bp, Mus musculus
cggcgggcttgtattctgagcattc

SEQ ID NO: 321417 - DNA, 25 bp, Mus musculus
caggggtgctgtctccagccgcagc

SEQ ID NO: 321418 - DNA, 25 bp, Mus musculus
ccctgctgtccgcagggatgggaat

SEQ ID NO: 321419 - DNA, 25 bp, Mus musculus
gaatggggaccgatgctctctctcg

SEQ ID NO: 321420 - DNA, 25 bp, Mus musculus
agcgtggttcagctcgttatccctg

SEQ ID NO: 321421 - DNA, 25 bp, Mus musculus
ctgttcaatagcgtggttcagctcg

SEQ ID NO: 321422 - DNA, 25 bp, Mus musculus
ttcagctcgttatccctgctgtccg

SEQ ID NO: 321423 - DNA, 25 bp, Mus musculus
agccaactcggcttccctcctcttg

SEQ ID NO: 321424 - DNA, 25 bp, Mus musculus
aagagccaggggtgctgtctccagc

SEQ ID NO: 321425 - DNA, 25 bp, Mus musculus
ctcttcgtagtatagggatgaaggc

SEQ ID NO: 321426 - DNA, 25 bp, Mus musculus
ctccgtaacttttgtgtgaagcggg

SEQ ID NO: 321427 - DNA, 25 bp, Mus musculus
ttctcggctccgtaacttttgtgtg

SEQ ID NO: 321428 - DNA, 25 bp, Mus musculus
ggctgccttccggaacttctcggct

SEQ ID NO: 321429 - DNA, 25 bp, Mus musculus
ccagaggctcttcgtagtataggga

SEQ ID NO: 321430 - DNA, 25 bp, Mus musculus
tggcttctcgctgttcaatagcgtg

SEQ ID NO: 321431 - DNA, 25 bp, Mus musculus
ggtaccaaaggacctgcggcatctg

SEQ ID NO: 321432 - DNA, 25 bp, Mus musculus
ggctgcgttgcagttctcggcataa

SEQ ID NO: 321433 - DNA, 25 bp, Mus musculus
cgacgcgtctggcattctgggtaat

SEQ ID NO: 321434 - DNA, 25 bp, Mus musculus
gcattctgggtaatggtctgtttac

SEQ ID NO: 321435 - DNA, 25 bp, Mus musculus
atggtctgtttacttcctgcggctg

SEQ ID NO: 321436 - DNA, 25 bp, Mus musculus
tggaggaacctgtgttgtcgtatcg

SEQ ID NO: 321437 - DNA, 25 bp, Mus musculus
ttgtcgtatcggtgaggatggccct

SEQ ID NO: 321438 - DNA, 25 bp, Mus musculus
gatggccctggagacggtaccaaag

SEQ ID NO: 321439 - DNA, 25 bp, Mus musculus
acctgcggcatctgcgggcttgttt

SEQ ID NO: 321440 - DNA, 25 bp, Mus musculus
tgctcgttagtcaaggtgtccgttg

SEQ ID NO: 321441 - DNA, 25 bp, Mus musculus
ggcttgtttgctgtgctcgttagtc

SEQ ID NO: 321442 - DNA, 25 bp, Mus musculus
ttgtttccgtccacggaacgcgagc

SEQ ID NO: 321443 - DNA, 25 bp, Mus musculus
ctcggcataactgagcacaagtttg

SEQ ID NO: 321444 - DNA, 25 bp, Mus musculus
aaatggggccagacacaggaaagga

SEQ ID NO: 321445 - DNA, 25 bp, Mus musculus
cctgcccgatactctgatggggacc

SEQ ID NO: 321446 - DNA, 25 bp, Mus musculus
cctgactagacaacaggaacttgtc

SEQ ID NO: 321447 - DNA, 25 bp, Mus musculus
tgctggaggtgatcagggtccaaaa

SEQ ID NO: 321448 - DNA, 25 bp, Mus musculus
ttaggactgactcggctcctggtcg

SEQ ID NO: 321449 - DNA, 25 bp, Mus musculus
cccagtggctgcatatgcgggactt

SEQ ID NO: 321450 - DNA, 25 bp, Mus musculus
atatgcgggacttcgaccggttgct

SEQ ID NO: 321451 - DNA, 25 bp, Mus musculus
ggtcagggtgatccgggaatctccc

SEQ ID NO: 321452 - DNA, 25 bp, Mus musculus
tgcagaggcagatcgccctgcgcaa

SEQ ID NO: 321453 - DNA, 25 bp, Mus musculus
aatgctcgctttcccagggtctagg

SEQ ID NO: 321454 - DNA, 25 bp, Mus musculus
agggtctagggagccttcctgacta

SEQ ID NO: 321455 - DNA, 25 bp, Mus musculus
gcagccgaaccgacccagtatggta

SEQ ID NO: 321456 - DNA, 25 bp, Mus musculus
tgccatgtcgatagtggtacagccc

SEQ ID NO: 321457 - DNA, 25 bp, Mus musculus
gcaaatccctggttgccctggcagc

SEQ ID NO: 321458 - DNA, 25 bp, Mus musculus
ggtgcatacgactcagttccaggta

SEQ ID NO: 321459 - DNA, 25 bp, Mus musculus
agtgcgatgtttatgcgtttggctc

SEQ ID NO: 321460 - DNA, 25 bp, Mus musculus
gtttatgcgtttggctctttccctc

SEQ ID NO: 321461 - DNA, 25 bp, Mus musculus
tggctctttccctcccatcctgtac

SEQ ID NO: 321462 - DNA, 25 bp, Mus musculus
tccttttctgagtgcgatgtttatg

SEQ ID NO: 321463 - DNA, 25 bp, Mus musculus
gagggagagcccgtcctcgtattct

SEQ ID NO: 321464 - DNA, 25 bp, Mus musculus
ggaacatatcgttagagcgcaaatc

SEQ ID NO: 321465 - DNA, 25 bp, Mus musculus
gagagggaagccgttccgcatcttc

SEQ ID NO: 321466 - DNA, 25 bp, Mus musculus
cgcgcctcttattttccttttctga

SEQ ID NO: 321467 - DNA, 25 bp, Mus musculus
tcgttagagcgcaaatcctaatctc

SEQ ID NO: 321468 - DNA, 25 bp, Mus musculus
cggcagtttggggaacatatcgtta

SEQ ID NO: 321469 - DNA, 25 bp, Mus musculus
gagccagcgccctgttggcggatcc

SEQ ID NO: 321470 - DNA, 25 bp, Mus musculus
tcctcgtattctgcgggcagccatc

SEQ ID NO: 321471 - DNA, 25 bp, Mus musculus
ccctcgcggcagtttggggaacata

SEQ ID NO: 321472 - DNA, 25 bp, Mus musculus
atcctaatctcagtcgcgcctctta

SEQ ID NO: 321473 - DNA, 25 bp, Mus musculus
ctttccggcgcggtcgcagcgcgaa

SEQ ID NO: 321474 - DNA, 25 bp, Mus musculus
gaggccgtgtatcgctcccgggacc

SEQ ID NO: 321475 - DNA, 25 bp, Mus musculus
ccgtgcgcaacctgcgcctccggta

SEQ ID NO: 321476 - DNA, 25 bp, Mus musculus
actgacaccggcgaggccgtgtatc

SEQ ID NO: 321477 - DNA, 25 bp, Mus musculus
cggtctggagcactgacaccggcga

SEQ ID NO: 321478 - DNA, 25 bp, Mus musculus
cggaagcggtctggagcactgacac

SEQ ID NO: 321479 - DNA, 25 bp, Mus musculus
tcgcagcgcgaagcagctgtcatgg

SEQ ID NO: 321480 - DNA, 25 bp, Mus musculus
gaggcaccacgctttccggcgcggt

SEQ ID NO: 321481 - DNA, 25 bp, Mus musculus
ggaacgaggcaccacgctttccggc

SEQ ID NO: 321482 - DNA, 25 bp, Mus musculus
tctccgttgccaggggaacgaggca

SEQ ID NO: 321483 - DNA, 25 bp, Mus musculus
ccagcgtctccgttgccaggggaac

SEQ ID NO: 321484 - DNA, 25 bp, Mus musculus
aagaagccagcgtctccgttgccag

SEQ ID NO: 321485 - DNA, 25 bp, Mus musculus
tcccttgcctaagaagccagcgtct

SEQ ID NO: 321486 - DNA, 25 bp, Mus musculus
tgcctaagaagccagcgtctccgtt

SEQ ID NO: 321487 - DNA, 25 bp, Mus musculus
atacaccatgctggcgtccacgaag

SEQ ID NO: 321488 - DNA, 25 bp, Mus musculus
tcctggaatcgctggttcgtggcca

SEQ ID NO: 321489 - DNA, 25 bp, Mus musculus
cacgaaggatgtaagtgcgttgatc

SEQ ID NO: 321490 - DNA, 25 bp, Mus musculus
cgaccgttgtcctggaatcgctggt

SEQ ID NO: 321491 - DNA, 25 bp, Mus musculus
atcgctggttcgtggccagcagccc

SEQ ID NO: 321492 - DNA, 25 bp, Mus musculus
caggaagttggtcctattacggagc

SEQ ID NO: 321493 - DNA, 25 bp, Mus musculus
gtcctattacggagccgcagggcga

SEQ ID NO: 321494 - DNA, 25 bp, Mus musculus
gcgagggtcacctcgctgccataca

SEQ ID NO: 321495 - DNA, 25 bp, Mus musculus
ctggcgtccacgaaggatgtaagtg

SEQ ID NO: 321496 - DNA, 25 bp, Mus musculus
taagtgcgttgatctggttgcggac

SEQ ID NO: 321497 - DNA, 25 bp, Mus musculus
gttgatctggttgcggactttgttc

SEQ ID NO: 321498 - DNA, 25 bp, Mus musculus
ctggttgcggactttgttcctgttt

SEQ ID NO: 321499 - DNA, 25 bp, Mus musculus
atgcagtcgcgctggttcttgatgc

SEQ ID NO: 321500 - DNA, 25 bp, Mus musculus
gctggttcttgatgcggggatcatt

SEQ ID NO: 321501 - DNA, 25 bp, Mus musculus
cctgggaaatgagaaagcatccacc

SEQ ID NO: 321502 - DNA, 25 bp, Mus musculus
gccgctctcgctccacatcttgttt

SEQ ID NO: 321503 - DNA, 25 bp, Mus musculus
cgacgcgcggccctgaaatagagcc

SEQ ID NO: 321504 - DNA, 25 bp, Mus musculus
ggccgaccgcctgtctcggctgata

SEQ ID NO: 321505 - DNA, 25 bp, Mus musculus
cgctgggctgaagcaaagctcgagc

SEQ ID NO: 321506 - DNA, 25 bp, Mus musculus
cgtcacgcaggcgagtccgcacagg

SEQ ID NO: 321507 - DNA, 25 bp, Mus musculus
tctccagagcctgggccgagtcgag

SEQ ID NO: 321508 - DNA, 25 bp, Mus musculus
tgacccggcgacctcgctgcaggaa

SEQ ID NO: 321509 - DNA, 25 bp, Mus musculus
tcttttcctctagcgggcagggacc

SEQ ID NO: 321510 - DNA, 25 bp, Mus musculus
caccatcttttcctctagcgggcag

SEQ ID NO: 321511 - DNA, 25 bp, Mus musculus
taacacgtacaaacgttattgcctc

SEQ ID NO: 321512 - DNA, 25 bp, Mus musculus
attgcctcgtttcggatttccaaag

SEQ ID NO: 321513 - DNA, 25 bp, Mus musculus
gccctgcaccattctttaacacgta

SEQ ID NO: 321514 - DNA, 25 bp, Mus musculus
cacgagggtctccagagcctgggcc

SEQ ID NO: 321515 - DNA, 25 bp, Mus musculus
gccgcatctacgtgggtaacctacc

SEQ ID NO: 321516 - DNA, 25 bp, Mus musculus
cggggaacaacgactgccgcatcta

SEQ ID NO: 321517 - DNA, 25 bp, Mus musculus
ccgctttaaccagagcatgtgattt

SEQ ID NO: 321518 - DNA, 25 bp, Mus musculus
cctggacgttccagcagccagtcaa

SEQ ID NO: 321519 - DNA, 25 bp, Mus musculus
ccggccctattatgcggcgcatgtg

SEQ ID NO: 321520 - DNA, 25 bp, Mus musculus
gctcggaggccttggaacataatgg

SEQ ID NO: 321521 - DNA, 25 bp, Mus musculus
cgcccttcgccttcgttgagttcga

SEQ ID NO: 321522 - DNA, 25 bp, Mus musculus
gccatccgcgacatcgacctgaaga

SEQ ID NO: 321523 - DNA, 25 bp, Mus musculus
gtgttttacaaatacggcgccatcc

SEQ ID NO: 321524 - DNA, 25 bp, Mus musculus
ccaaggacatcgaggacgtgtttta

SEQ ID NO: 321525 - DNA, 25 bp, Mus musculus
gctcgctctgccgtacgctaggctt

SEQ ID NO: 321526 - DNA, 25 bp, Mus musculus
ccgagctgataaaggcgccattttg

SEQ ID NO: 321527 - DNA, 25 bp, Mus musculus
agcgtgcttctcagcacccgttaga

SEQ ID NO: 321528 - DNA, 25 bp, Mus musculus
acgattctggactcagtggggatta

SEQ ID NO: 321529 - DNA, 25 bp, Mus musculus
acctctgcgatgaagaccctccgaa

SEQ ID NO: 321530 - DNA, 25 bp, Mus musculus
gggcacctctgcgatgaagaccctc

SEQ ID NO: 321531 - DNA, 25 bp, Mus musculus
agaccctccgaatggaattggccac

SEQ ID NO: 321532 - DNA, 25 bp, Mus musculus
cgccaggtccgtgttctcgataatg

SEQ ID NO: 321533 - DNA, 25 bp, Mus musculus
ccaggtccgtgttctcgataatgaa

SEQ ID NO: 321534 - DNA, 25 bp, Mus musculus
ctgcgatgaagaccctccgaatgga

SEQ ID NO: 321535 - DNA, 25 bp, Mus musculus
gtccgtgttctcgataatgaacttg

SEQ ID NO: 321536 - DNA, 25 bp, Mus musculus
gttctcgataatgaacttgacgttc

SEQ ID NO: 321537 - DNA, 25 bp, Mus musculus
acttgacgttctcttcggtgagttc

SEQ ID NO: 321538 - DNA, 25 bp, Mus musculus
acggcatcgcgaccctccgccaggc

SEQ ID NO: 321539 - DNA, 25 bp, Mus musculus
tgaagaccctccgaatggaattggc

SEQ ID NO: 321540 - DNA, 25 bp, Mus musculus
ctattatgggcacctctgcgatgaa

SEQ ID NO: 321541 - DNA, 25 bp, Mus musculus
cgatgaagaccctccgaatggaatt

SEQ ID NO: 321542 - DNA, 25 bp, Mus musculus
tatgggcacctctgcgatgaagacc

SEQ ID NO: 321543 - DNA, 25 bp, Mus musculus
cgcgttcctgttccaggatctgggg

SEQ ID NO: 321544 - DNA, 25 bp, Mus musculus
tggaccgcgttcctgttccaggatc

SEQ ID NO: 321545 - DNA, 25 bp, Mus musculus
atccatctttcgcttgcgcttttcg

SEQ ID NO: 321546 - DNA, 25 bp, Mus musculus
tttcgcttgcgcttttcgcgtcacc

SEQ ID NO: 321547 - DNA, 25 bp, Mus musculus
ttcgcgtcacctctctctttttgtg

SEQ ID NO: 321548 - DNA, 25 bp, Mus musculus
gtgcttgtgtgttgactttctgacc

SEQ ID NO: 321549 - DNA, 25 bp, Mus musculus
ccacatcccgcgaatagcgggtatc

SEQ ID NO: 321550 - DNA, 25 bp, Mus musculus
aatagcgggtatctctggcttcgcc

SEQ ID NO: 321551 - DNA, 25 bp, Mus musculus
gggtatctctggcttcgccgccact

SEQ ID NO: 321552 - DNA, 25 bp, Mus musculus
tctgcaaacttttctccgctcctag

SEQ ID NO: 321553 - DNA, 25 bp, Mus musculus
tctccgctcctagcccaagtcctgg

SEQ ID NO: 321554 - DNA, 25 bp, Mus musculus
cgcagccatggaggccaactggacc

SEQ ID NO: 321555 - DNA, 25 bp, Mus musculus
ttgtgtgttgactttctgaccctcc

SEQ ID NO: 321556 - DNA, 25 bp, Mus musculus
aggccaactggaccgcgttcctgtt

SEQ ID NO: 321557 - DNA, 25 bp, Mus musculus
gcggtgctcggtaagaccccgattc

SEQ ID NO: 321558 - DNA, 25 bp, Mus musculus
ggccgtcgcgagtttgagtcctcgc

SEQ ID NO: 321559 - DNA, 25 bp, Mus musculus
gcctcgttcctggtcctgggcacag

SEQ ID NO: 321560 - DNA, 25 bp, Mus musculus
gccttggggagcctgctcaacccgg

SEQ ID NO: 321561 - DNA, 25 bp, Mus musculus
gggagcctgctcaacccgggtctct

SEQ ID NO: 321562 - DNA, 25 bp, Mus musculus
ctttgtgtggacaccctcccggctt

SEQ ID NO: 321563 - DNA, 25 bp, Mus musculus
cctgggttgggagctgaactccttt

SEQ ID NO: 321564 - DNA, 25 bp, Mus musculus
gtcggttcagccttttctggtccca

SEQ ID NO: 321565 - DNA, 25 bp, Mus musculus
tccgcgacccggctggagaaagttc

SEQ ID NO: 321566 - DNA, 25 bp, Mus musculus
gagaaagttcagaatgcgctgtccc

SEQ ID NO: 321567 - DNA, 25 bp, Mus musculus
ggagaatcgtttcctgctcccgccg

SEQ ID NO: 321568 - DNA, 25 bp, Mus musculus
tcgcagggacagctgcatttctcgc

SEQ ID NO: 321569 - DNA, 25 bp, Mus musculus
agggacagctgcatttctcgccgcc

SEQ ID NO: 321570 - DNA, 25 bp, Mus musculus
ccgccgtggtcaccggtcggttcag

SEQ ID NO: 321571 - DNA, 25 bp, Mus musculus
tcgctgacggcttgtctctcggtcc

SEQ ID NO: 321572 - DNA, 25 bp, Mus musculus
ttgtctctcggtccggagagtgctg

SEQ ID NO: 321573 - DNA, 25 bp, Mus musculus
tcggaggagcctgggaaagtttcac

SEQ ID NO: 321574 - DNA, 25 bp, Mus musculus
aggagccgtggtaatcgccgcggcc

SEQ ID NO: 321575 - DNA, 25 bp, Mus musculus
cagaggtccagggagcgtccgtcct

SEQ ID NO: 321576 - DNA, 25 bp, Mus musculus
tagggctctccctgccctgagagac

SEQ ID NO: 321577 - DNA, 25 bp, Mus musculus
gcttagggctctccctgccctgaga

SEQ ID NO: 321578 - DNA, 25 bp, Mus musculus
tagtgtgacggaggcgagctccgct

SEQ ID NO: 321579 - DNA, 25 bp, Mus musculus
agggcgccagcgtcctcaacgtttt

SEQ ID NO: 321580 - DNA, 25 bp, Mus musculus
cgcccataggtagctgcgggagttt

SEQ ID NO: 321581 - DNA, 25 bp, Mus musculus
ctgggtgtgtgcagaccattcctct

SEQ ID NO: 321582 - DNA, 25 bp, Mus musculus
gtgtgtgcagaccattcctctgccc

SEQ ID NO: 321583 - DNA, 25 bp, Mus musculus
agcgtccgtcctccatcgcttaggg

SEQ ID NO: 321584 - DNA, 25 bp, Mus musculus
ctgagagacccggtgagtcgttgcc

SEQ ID NO: 321585 - DNA, 25 bp, Mus musculus
atttctgcacgtgggctcgagagct

SEQ ID NO: 321586 - DNA, 25 bp, Mus musculus
ggtccactcctagcaccatggcttg

SEQ ID NO: 321587 - DNA, 25 bp, Mus musculus
tactgttatttctgcacgtgggctc

SEQ ID NO: 321588 - DNA, 25 bp, Mus musculus
agctttctgagtgcttccgtgtctc

SEQ ID NO: 321589 - DNA, 25 bp, Mus musculus
agtgcttccgtgtctcattcctaga

SEQ ID NO: 321590 - DNA, 25 bp, Mus musculus
tgtctcattcctagaaggtgtcgga

SEQ ID NO: 321591 - DNA, 25 bp, Mus musculus
ggacgtctcgcgtttgccacagaca

SEQ ID NO: 321592 - DNA, 25 bp, Mus musculus
tttgccacagacagaacgagttcct

SEQ ID NO: 321593 - DNA, 25 bp, Mus musculus
cgagttcctttgatagttactgtta

SEQ ID NO: 321594 - DNA, 25 bp, Mus musculus
ctcggtctgactctgaagctttctg

SEQ ID NO: 321595 - DNA, 25 bp, Mus musculus
ttcccagaacatgcttagacatccc

SEQ ID NO: 321596 - DNA, 25 bp, Mus musculus
ttgcaggattcccagaacatgctta

SEQ ID NO: 321597 - DNA, 25 bp, Mus musculus
caccatggcttgcaggattcccaga

SEQ ID NO: 321598 - DNA, 25 bp, Mus musculus
cgtgctaactaagcgcacgtctgcc

SEQ ID NO: 321599 - DNA, 25 bp, Mus musculus
caggccatggacgacttcaagacta

SEQ ID NO: 321600 - DNA, 25 bp, Mus musculus
gttttccgagcctgcggagcaagca

SEQ ID NO: 321601 - DNA, 25 bp, Mus musculus
cagcggcttcttggtttgttggaaa

SEQ ID NO: 321602 - DNA, 25 bp, Mus musculus
tggaaacattctcccgcagtggctc

SEQ ID NO: 321603 - DNA, 25 bp, Mus musculus
gctctgcaagatgaccagcctgttt

SEQ ID NO: 321604 - DNA, 25 bp, Mus musculus
accagcctgtttcgcaggagcagca

SEQ ID NO: 321605 - DNA, 25 bp, Mus musculus
tcaggagctcaacaacagccggccg

SEQ ID NO: 321606 - DNA, 25 bp, Mus musculus
aggtgcgccgcctcgagttcaacca

SEQ ID NO: 321607 - DNA, 25 bp, Mus musculus
acatcattgagtgcgtgctgcgtgc

SEQ ID NO: 321608 - DNA, 25 bp, Mus musculus
ctcgagttcaaccaggccatggacg

SEQ ID NO: 321609 - DNA, 25 bp, Mus musculus
gtttcctaacatggactacgacatc

SEQ ID NO: 321610 - DNA, 25 bp, Mus musculus
cgggccgtgcattccctccaggagg

SEQ ID NO: 321611 - DNA, 25 bp, Mus musculus
cggagcaagcaagtggcccacgacg

SEQ ID NO: 321612 - DNA, 25 bp, Mus musculus
agcactgcagtgagttttccgagcc

SEQ ID NO: 321613 - DNA, 25 bp, Mus musculus
cacgacctgggaacgcgctgaccat

SEQ ID NO: 321614 - DNA, 25 bp, Mus musculus
agaggtgtacgcagagagtgaccaa

SEQ ID NO: 321615 - DNA, 25 bp, Mus musculus
caagttgccgaagttgccagcctcg

SEQ ID NO: 321616 - DNA, 25 bp, Mus musculus
gccagcctcggcagagcggcaagca

SEQ ID NO: 321617 - DNA, 25 bp, Mus musculus
gcggcaagcacctagaacgagaact

SEQ ID NO: 321618 - DNA, 25 bp, Mus musculus
gaacgagaacttgccgggtgcctca

SEQ ID NO: 321619 - DNA, 25 bp, Mus musculus
gagaccagaggcgatttaaggaacc

SEQ ID NO: 321620 - DNA, 25 bp, Mus musculus
tttaaggaacctgcaccaaccactg

SEQ ID NO: 321621 - DNA, 25 bp, Mus musculus
accaaccactgccacgggacggagg

SEQ ID NO: 321622 - DNA, 25 bp, Mus musculus
cgcgctgaccatttagagagatctg

SEQ ID NO: 321623 - DNA, 25 bp, Mus musculus
ggctgctaaggactggcagaaaatg

SEQ ID NO: 321624 - DNA, 25 bp, Mus musculus
gcatgggaccgcaaacgcctcaact

SEQ ID NO: 321625 - DNA, 25 bp, Mus musculus
cctggttgagaatgggatccgatgc

SEQ ID NO: 321626 - DNA, 25 bp, Mus musculus
gcctcaactcctgcgggtcagtcga

SEQ ID NO: 321627 - DNA, 25 bp, Mus musculus
cagcccatcgtttgcttctgcctgg

SEQ ID NO: 321628 - DNA, 25 bp, Mus musculus
cctcctggcatatccttaggggatg

SEQ ID NO: 321629 - DNA, 25 bp, Mus musculus
tgttctcccggtgcgtgctccgagt

SEQ ID NO: 321630 - DNA, 25 bp, Mus musculus
ttctagcccaagtggccatggcggg

SEQ ID NO: 321631 - DNA, 25 bp, Mus musculus
agcccgaggctttctagcccaagtg

SEQ ID NO: 321632 - DNA, 25 bp, Mus musculus
cgcttccggtaacagcccgaggctt

SEQ ID NO: 321633 - DNA, 25 bp, Mus musculus
actcttgcgcagctttggcgcgctc

SEQ ID NO: 321634 - DNA, 25 bp, Mus musculus
ttctgcctggttccgccgtccggat

SEQ ID NO: 321635 - DNA, 25 bp, Mus musculus
aggacctgagggctcctgctcagcc

SEQ ID NO: 321636 - DNA, 25 bp, Mus musculus
gctcttttggctcgggaatcgatta

SEQ ID NO: 321637 - DNA, 25 bp, Mus musculus
cggtcgtttgctactcttgcgcagc

SEQ ID NO: 321638 - DNA, 25 bp, Mus musculus
atcgattattcgtatctgaccaccc

SEQ ID NO: 321639 - DNA, 25 bp, Mus musculus
caggtgatgcccttggcacggaatc

SEQ ID NO: 321640 - DNA, 25 bp, Mus musculus
ggactgtcatcctcggctcggccag

SEQ ID NO: 321641 - DNA, 25 bp, Mus musculus
ttggtcaggagccacaacccgctgc

SEQ ID NO: 321642 - DNA, 25 bp, Mus musculus
ccgcgcccgagtgtgcgcccgagct

SEQ ID NO: 321643 - DNA, 25 bp, Mus musculus
aagagccaggcggactgagcggccc

SEQ ID NO: 321644 - DNA, 25 bp, Mus musculus
gtcaggagccacaacccgctgcgag

SEQ ID NO: 321645 - DNA, 25 bp, Mus musculus
ttggagaacatgttggtcaggagcc

SEQ ID NO: 321646 - DNA, 25 bp, Mus musculus
caacccgctgcgagccatcaggaag

SEQ ID NO: 321647 - DNA, 25 bp, Mus musculus
cagcggttggagaacatgttggtca

SEQ ID NO: 321648 - DNA, 25 bp, Mus musculus
ggcatcgtccgcaacaaggtcctca

SEQ ID NO: 321649 - DNA, 25 bp, Mus musculus
cccgggagaagcagcttcgtgaaca

SEQ ID NO: 321650 - DNA, 25 bp, Mus musculus
gcttcgtgaacactgccagcggttg

SEQ ID NO: 321651 - DNA, 25 bp, Mus musculus
tgaacactgccagcggttggagaac

SEQ ID NO: 321652 - DNA, 25 bp, Mus musculus
ctgccagcggttggagaacatgttg

SEQ ID NO: 321653 - DNA, 25 bp, Mus musculus
gaggaccgaggcatcgtccgcaaca

SEQ ID NO: 321654 - DNA, 25 bp, Mus musculus
gaccgaggcatcgtccgcaacaagg

SEQ ID NO: 321655 - DNA, 25 bp, Mus musculus
ttcattcaagttcctggggccctgc

SEQ ID NO: 321656 - DNA, 25 bp, Mus musculus
gcgagagcccgtcacacgtgggctc

SEQ ID NO: 321657 - DNA, 25 bp, Mus musculus
gcggagttctagaacgtcgtgtaac

SEQ ID NO: 321658 - DNA, 25 bp, Mus musculus
tcgtgtaaccaatgcggtgacgtca

SEQ ID NO: 321659 - DNA, 25 bp, Mus musculus
cccgagtcggctcagatcacatggg

SEQ ID NO: 321660 - DNA, 25 bp, Mus musculus
ccctagttcggactattcattcaag

SEQ ID NO: 321661 - DNA, 25 bp, Mus musculus
tggaggagaccctcctgcacgaaca

SEQ ID NO: 321662 - DNA, 25 bp, Mus musculus
cctgcgcccgattcggaggtggcac

SEQ ID NO: 321663 - DNA, 25 bp, Mus musculus
gccaccgcgcggaaatttaggtcaa

SEQ ID NO: 321664 - DNA, 25 bp, Mus musculus
atttaggtcaaggacgccgggagca

SEQ ID NO: 321665 - DNA, 25 bp, Mus musculus
gcgctcccagggcagtcctcgagaa

SEQ ID NO: 321666 - DNA, 25 bp, Mus musculus
gcttgcggatggaggagaccctcct

SEQ ID NO: 321667 - DNA, 25 bp, Mus musculus
ccttcgcgcggcaagttctctggct

SEQ ID NO: 321668 - DNA, 25 bp, Mus musculus
tcggctcagatcacatgggctgggt

SEQ ID NO: 321669 - DNA, 25 bp, Mus musculus
ctgggtacacacgacctttgaaaag

SEQ ID NO: 321670 - DNA, 25 bp, Mus musculus
agtaacaatattcacggcgggcatg

SEQ ID NO: 321671 - DNA, 25 bp, Mus musculus
tggcgctctcgcgagagtaacaata

SEQ ID NO: 321672 - DNA, 25 bp, Mus musculus
aggagctctccgctgacatcccgga

SEQ ID NO: 321673 - DNA, 25 bp, Mus musculus
ttaaatactgaggacgcgcaacgac

SEQ ID NO: 321674 - DNA, 25 bp, Mus musculus
ccaggccgggcgaacacagagacat

SEQ ID NO: 321675 - DNA, 25 bp, Mus musculus
ggcgaccgtctaggcactcaatcct

SEQ ID NO: 321676 - DNA, 25 bp, Mus musculus
cgcgcgggtcatcaaggcacagacc

SEQ ID NO: 321677 - DNA, 25 bp, Mus musculus
tcagcgcacgcgatctgtcagcagc

SEQ ID NO: 321678 - DNA, 25 bp, Mus musculus
ctccatcctagaggccagtgacgtg

SEQ ID NO: 321679 - DNA, 25 bp, Mus musculus
ccagcattgggaaagttgaggcgca

SEQ ID NO: 321680 - DNA, 25 bp, Mus musculus
acgcgctcgggcaggctacccagaa

SEQ ID NO: 321681 - DNA, 25 bp, Mus musculus
cctttgaaaagtaaacgctagcgag

SEQ ID NO: 321682 - DNA, 25 bp, Mus musculus
ctagcgagactagacgaccttggtt

SEQ ID NO: 321683 - DNA, 25 bp, Mus musculus
ggcacccaccgttggtgcgtctttc

SEQ ID NO: 321684 - DNA, 25 bp, Mus musculus
aacaaattcgagaaggaggcaccca

SEQ ID NO: 321685 - DNA, 25 bp, Mus musculus
tgggccctgacactcctaaggattc

SEQ ID NO: 321686 - DNA, 25 bp, Mus musculus
ttggtgcgtctttctcacgaaccta

SEQ ID NO: 321687 - DNA, 25 bp, Mus musculus
ctacccgcgctgaagcccagtaaga

SEQ ID NO: 321688 - DNA, 25 bp, Mus musculus
cccagtaagaacgataggagcagca

SEQ ID NO: 321689 - DNA, 25 bp, Mus musculus
agcagccacagtcgcacgagacaga

SEQ ID NO: 321690 - DNA, 25 bp, Mus musculus
cacgagacagatccgccgcgagagc

SEQ ID NO: 321691 - DNA, 25 bp, Mus musculus
ccgcgagagctccatgatgaaaacc

SEQ ID NO: 321692 - DNA, 25 bp, Mus musculus
cgccgcaacatcagcaacaggcagg

SEQ ID NO: 321693 - DNA, 25 bp, Mus musculus
tcagcaacaggcaggagccaaaggc

SEQ ID NO: 321694 - DNA, 25 bp, Mus musculus
gccaaaggccatcgcgtgacggctt

SEQ ID NO: 321695 - DNA, 25 bp, Mus musculus
cggagcctaagtgggccctgacact

SEQ ID NO: 321696 - DNA, 25 bp, Mus musculus
cgcgaacgcatcaacaaattcgaga

SEQ ID NO: 321697 - DNA, 25 bp, Mus musculus
ttcctacccaccgagggcagggcaa

SEQ ID NO: 321698 - DNA, 25 bp, Mus musculus
cctgcgtcctgagctcatgtatgta

SEQ ID NO: 321699 - DNA, 25 bp, Mus musculus
tgctctagctaggtgcatgcgcctg

SEQ ID NO: 321700 - DNA, 25 bp, Mus musculus
tgaacaggctgggtcaaatgctcta

SEQ ID NO: 321701 - DNA, 25 bp, Mus musculus
cacgggcactgacaggactccaaga

SEQ ID NO: 321702 - DNA, 25 bp, Mus musculus
acgcttcatggtggagactcaggga

SEQ ID NO: 321703 - DNA, 25 bp, Mus musculus
cctggctagcaaggagagcaagact

SEQ ID NO: 321704 - DNA, 25 bp, Mus musculus
ccgcgagctcggtttggagaaattc

SEQ ID NO: 321705 - DNA, 25 bp, Mus musculus
gtgtgagccctacgctaggcagctg

SEQ ID NO: 321706 - DNA, 25 bp, Mus musculus
atgtatgtaggtgccactccgccgg

SEQ ID NO: 321707 - DNA, 25 bp, Mus musculus
gcgtgctgctcaggtttcctaccca

SEQ ID NO: 321708 - DNA, 25 bp, Mus musculus
acaggcagaaggcaacacgggcact

SEQ ID NO: 321709 - DNA, 25 bp, Mus musculus
gtgcggctctcagccagcctgaatc

SEQ ID NO: 321710 - DNA, 25 bp, Mus musculus
tctggcgactccctagagcacgctt

SEQ ID NO: 321711 - DNA, 25 bp, Mus musculus
acggttaggctacggcttcaatttg

SEQ ID NO: 321712 - DNA, 25 bp, Mus musculus
gctgcgaaagcccttggaacctctc

SEQ ID NO: 321713 - DNA, 25 bp, Mus musculus
gcttccgtcgagcatgagcaagatg

SEQ ID NO: 321714 - DNA, 25 bp, Mus musculus
atggcagcctccgagacggttaggc

SEQ ID NO: 321715 - DNA, 25 bp, Mus musculus
cgcgaggggagccttacagacctac

SEQ ID NO: 321716 - DNA, 25 bp, Mus musculus
acactgcacggtcttctggcttctg

SEQ ID NO: 321717 - DNA, 25 bp, Mus musculus
aacagatgtcgagttgtcacggatc

SEQ ID NO: 321718 - DNA, 25 bp, Mus musculus
tgtcacggatctcatcagtctcatc

SEQ ID NO: 321719 - DNA, 25 bp, Mus musculus
ccagcgcttcggcttcagttccggg

SEQ ID NO: 321720 - DNA, 25 bp, Mus musculus
gcgctcctgggcctctatctggaag

SEQ ID NO: 321721 - DNA, 25 bp, Mus musculus
tgagagacaacgacagcctcaggtg

SEQ ID NO: 321722 - DNA, 25 bp, Mus musculus
cttgctggaccgcaggatgcaggat

SEQ ID NO: 321723 - DNA, 25 bp, Mus musculus
caggatccgggtagcgagctagcca

SEQ ID NO: 321724 - DNA, 25 bp, Mus musculus
tagccagctgcggaaaggcaggttc

SEQ ID NO: 321725 - DNA, 25 bp, Mus musculus
cagcgcgagaggactcacctcggta

SEQ ID NO: 321726 - DNA, 25 bp, Mus musculus
taacgccaaactgcgagaaccgcgg

SEQ ID NO: 321727 - DNA, 25 bp, Mus musculus
ctgggcaacctgggaccgggtcaca

SEQ ID NO: 321728 - DNA, 25 bp, Mus musculus
gactcacctcggtagccgatcgctg

SEQ ID NO: 321729 - DNA, 25 bp, Mus musculus
tcgaagtcgtcagccgccctcggct

SEQ ID NO: 321730 - DNA, 25 bp, Mus musculus
gcaggccggacccattgtctccgtc

SEQ ID NO: 321731 - DNA, 25 bp, Mus musculus
ggaccacaacacgccgggtcacgtg

SEQ ID NO: 321732 - DNA, 25 bp, Mus musculus
gcctgaagggcgagcgccacctcgt

SEQ ID NO: 321733 - DNA, 25 bp, Mus musculus
gtccgccatcttccaactgcctctc

SEQ ID NO: 321734 - DNA, 25 bp, Mus musculus
ctcgcctcctctgctccgctcgacg

SEQ ID NO: 321735 - DNA, 25 bp, Mus musculus
ccacgcgggccggaccacaacacgc

SEQ ID NO: 321736 - DNA, 25 bp, Mus musculus
gctcgcttgctcgtccgggatcgcc

SEQ ID NO: 321737 - DNA, 25 bp, Mus musculus
gcctcttgcggagcggctcgtccgc

SEQ ID NO: 321738 - DNA, 25 bp, Mus musculus
caaactgcgagaaccgcggtcccgg

SEQ ID NO: 321739 - DNA, 25 bp, Mus musculus
ttgaggcctcacttcgacagtccgg

SEQ ID NO: 321740 - DNA, 25 bp, Mus musculus
ctgcttcttaagtaccgcgcggtag

SEQ ID NO: 321741 - DNA, 25 bp, Mus musculus
cctcctgttcagtttcgattccttc

SEQ ID NO: 321742 - DNA, 25 bp, Mus musculus
agggacccacgtgacttcctgaagc

SEQ ID NO: 321743 - DNA, 25 bp, Mus musculus
ctttggcttccagcaccaggaggga

SEQ ID NO: 321744 - DNA, 25 bp, Mus musculus
ttcgtgaccttctgcgccgcaaatg

SEQ ID NO: 321745 - DNA, 25 bp, Mus musculus
gcctctttctgccaggagcacttga

SEQ ID NO: 321746 - DNA, 25 bp, Mus musculus
tgcctcgtgtgcatggcctctttct

SEQ ID NO: 321747 - DNA, 25 bp, Mus musculus
tgcgaccactgcctgacggagatcg

SEQ ID NO: 321748 - DNA, 25 bp, Mus musculus
gtgcgcccgcagctgcaaaagaaca

SEQ ID NO: 321749 - DNA, 25 bp, Mus musculus
tgcccgcaatgtcgcaaagtgtacc

SEQ ID NO: 321750 - DNA, 25 bp, Mus musculus
tccgtgcggccacaatttctgcatg

SEQ ID NO: 321751 - DNA, 25 bp, Mus musculus
ccgtctgcctggagctcttcaagga

SEQ ID NO: 321752 - DNA, 25 bp, Mus musculus
cagcacaaccgccttcgggaattgt

SEQ ID NO: 321753 - DNA, 25 bp, Mus musculus
aaggcttgccttcggattcactgcg

SEQ ID NO: 321754 - DNA, 25 bp, Mus musculus
cggagtctgcgctgataaaatttgt

SEQ ID NO: 321755 - DNA, 25 bp, Mus musculus
gttcacaacggctgtcgcgctgagc

SEQ ID NO: 321756 - DNA, 25 bp, Mus musculus
tcttctcaggcccaggcgtggccta

SEQ ID NO: 321757 - DNA, 25 bp, Mus musculus
gcgtccataggaccaagtggccatc

SEQ ID NO: 321758 - DNA, 25 bp, Mus musculus
aacagcacggagcacagcgtccata

SEQ ID NO: 321759 - DNA, 25 bp, Mus musculus
cgctgcaggctacaccataaagtga

SEQ ID NO: 321760 - DNA, 25 bp, Mus musculus
cggtgtcacgccagcaatgcttgct

SEQ ID NO: 321761 - DNA, 25 bp, Mus musculus
cagcagtcgcagaaggctccttgca

SEQ ID NO: 321762 - DNA, 25 bp, Mus musculus
tgtcgaccttcttgaggcagccctc

SEQ ID NO: 321763 - DNA, 25 bp, Mus musculus
tgatctccttgcacgggaagcgctt

SEQ ID NO: 321764 - DNA, 25 bp, Mus musculus
ggccttgtcgttcttgagcatgatc

SEQ ID NO: 321765 - DNA, 25 bp, Mus musculus
cggaagatatccctgcggtgcagct

SEQ ID NO: 321766 - DNA, 25 bp, Mus musculus
aagccaatggcggtgctttccgatg

SEQ ID NO: 321767 - DNA, 25 bp, Mus musculus
gctgggaataactctcttcgcataa

SEQ ID NO: 321768 - DNA, 25 bp, Mus musculus
aataactctcttcgcataattcgcg

SEQ ID NO: 321769 - DNA, 25 bp, Mus musculus
agcccgtcacgtctgcagcgcgggt

SEQ ID NO: 321770 - DNA, 25 bp, Mus musculus
tcgcggagggaagacctcgcattgt

SEQ ID NO: 321771 - DNA, 25 bp, Mus musculus
cgcccagctgggaataactctcttc

SEQ ID NO: 321772 - DNA, 25 bp, Mus musculus
gcgcgctctccgagttttggctgcc

SEQ ID NO: 321773 - DNA, 25 bp, Mus musculus
atccaatgacattaccaacgtgggg

SEQ ID NO: 321774 - DNA, 25 bp, Mus musculus
gaagacctcgcattgtaatccaatg

SEQ ID NO: 321775 - DNA, 25 bp, Mus musculus
ctgcgtccggtagggttctccgtgc

SEQ ID NO: 321776 - DNA, 25 bp, Mus musculus
gggtcctcccagctcactctggctc

SEQ ID NO: 321777 - DNA, 25 bp, Mus musculus
gtctgtagcccgtcacgtctgcagc

SEQ ID NO: 321778 - DNA, 25 bp, Mus musculus
tctgtcagtgcggtggtctgtagcc

SEQ ID NO: 321779 - DNA, 25 bp, Mus musculus
cgccggctgcgagcgggttttccaa

SEQ ID NO: 321780 - DNA, 25 bp, Mus musculus
cctggctctgaaagccgagaagctc

SEQ ID NO: 321781 - DNA, 25 bp, Mus musculus
gcgcaggtttgaaataattagcata

SEQ ID NO: 321782 - DNA, 25 bp, Mus musculus
ccgggccaggctattgaaatgagga

SEQ ID NO: 321783 - DNA, 25 bp, Mus musculus
caggctattgaaatgaggagccacc

SEQ ID NO: 321784 - DNA, 25 bp, Mus musculus
tattgaaatgaggagccaccgaggc

SEQ ID NO: 321785 - DNA, 25 bp, Mus musculus
ttgaaatgaggagccaccgaggctg

SEQ ID NO: 321786 - DNA, 25 bp, Mus musculus
aatgaggagccaccgaggctgcgtc

SEQ ID NO: 321787 - DNA, 25 bp, Mus musculus
ctgtcccacggctgacggaggcagc

SEQ ID NO: 321788 - DNA, 25 bp, Mus musculus
cccggggcattgagactgagctggg

SEQ ID NO: 321789 - DNA, 25 bp, Mus musculus
ggactcggcgcaggtttgaaataat

SEQ ID NO: 321790 - DNA, 25 bp, Mus musculus
cggcgcaggtttgaaataattagca

SEQ ID NO: 321791 - DNA, 25 bp, Mus musculus
tcccgggccaggctattgaaatgag

SEQ ID NO: 321792 - DNA, 25 bp, Mus musculus
aaataattagcatagattcgctgcg

SEQ ID NO: 321793 - DNA, 25 bp, Mus musculus
actcggcgcaggtttgaaataatta

SEQ ID NO: 321794 - DNA, 25 bp, Mus musculus
tttgaaataattagcatagattcgc

SEQ ID NO: 321795 - DNA, 25 bp, Mus musculus
ctcggagaactccagccctttgatc

SEQ ID NO: 321796 - DNA, 25 bp, Mus musculus
ggtttgtctgtctcgcagggtccaa

SEQ ID NO: 321797 - DNA, 25 bp, Mus musculus
tcttgtttctctgtgcggagcctcc

SEQ ID NO: 321798 - DNA, 25 bp, Mus musculus
cgagattactccagcgcgaccgtgg

SEQ ID NO: 321799 - DNA, 25 bp, Mus musculus
ggtccaagcctttaaatttcctgca

SEQ ID NO: 321800 - DNA, 25 bp, Mus musculus
caccaccagggcgtagagggtgacc

SEQ ID NO: 321801 - DNA, 25 bp, Mus musculus
ggcgctgtttcttgccttgggccaa

SEQ ID NO: 321802 - DNA, 25 bp, Mus musculus
agtagccataaagcccgggtcgtag

SEQ ID NO: 321803 - DNA, 25 bp, Mus musculus
cgcagcagcgtctcgttcagatcct

SEQ ID NO: 321804 - DNA, 25 bp, Mus musculus
cgttcagatccttctccttagggtc

SEQ ID NO: 321805 - DNA, 25 bp, Mus musculus
tccttagggtcaaagatagggtctg

SEQ ID NO: 321806 - DNA, 25 bp, Mus musculus
gcggtcgggcatccgagattactcc

SEQ ID NO: 321807 - DNA, 25 bp, Mus musculus
gacgcgcacgagttggtcgcaattc

SEQ ID NO: 321808 - DNA, 25 bp, Mus musculus
gctcacccgaggctgagcaggcgca

SEQ ID NO: 321809 - DNA, 25 bp, Mus musculus
tacagcgcccggagcgcaggtcact

SEQ ID NO: 321810 - DNA, 25 bp, Mus musculus
gagttcagcacaagcctcccggaac

SEQ ID NO: 321811 - DNA, 25 bp, Mus musculus
cgccggtttctggagttcagcacaa

SEQ ID NO: 321812 - DNA, 25 bp, Mus musculus
aagcctcccggaactgctcgtccga

SEQ ID NO: 321813 - DNA, 25 bp, Mus musculus
gctcgtccgagaagcagcatgcggc

SEQ ID NO: 321814 - DNA, 25 bp, Mus musculus
gtttctggagttcagcacaagcctc

SEQ ID NO: 321815 - DNA, 25 bp, Mus musculus
tcgtccgagaagcagcatgcggccc

SEQ ID NO: 321816 - DNA, 25 bp, Mus musculus
gccatccttccgcagccaggataca

SEQ ID NO: 321817 - DNA, 25 bp, Mus musculus
ggtcagcgccggtttctggagttca

SEQ ID NO: 321818 - DNA, 25 bp, Mus musculus
cgcagccaggatacagcgcccggag

SEQ ID NO: 321819 - DNA, 25 bp, Mus musculus
cgcaggtcactcactggcccttaga

SEQ ID NO: 321820 - DNA, 25 bp, Mus musculus
aggtcactcactggcccttagagag

SEQ ID NO: 321821 - DNA, 25 bp, Mus musculus
cccaacctgattggcagggaagaga

SEQ ID NO: 321822 - DNA, 25 bp, Mus musculus
tcactggcccttagagagatcgggg

SEQ ID NO: 321823 - DNA, 25 bp, Mus musculus
accggctcccgggaagactcgcagt

SEQ ID NO: 321824 - DNA, 25 bp, Mus musculus
cacctaccgagcttcaagggaaatg

SEQ ID NO: 321825 - DNA, 25 bp, Mus musculus
agcttcaagggaaatgaatggcagc

SEQ ID NO: 321826 - DNA, 25 bp, Mus musculus
gccctgccgccggtgcaaaagagac

SEQ ID NO: 321827 - DNA, 25 bp, Mus musculus
tcccgggaagactcgcagttctgcg

SEQ ID NO: 321828 - DNA, 25 bp, Mus musculus
ttctgcggggaacgtgctccgtccc

SEQ ID NO: 321829 - DNA, 25 bp, Mus musculus
tcgattccagcggtgagagttctgc

SEQ ID NO: 321830 - DNA, 25 bp, Mus musculus
caatgcggttcaggaatcgattcca

SEQ ID NO: 321831 - DNA, 25 bp, Mus musculus
cgctccggacactgattggccactg

SEQ ID NO: 321832 - DNA, 25 bp, Mus musculus
gtgcaaaagagacggagctcccggc

SEQ ID NO: 321833 - DNA, 25 bp, Mus musculus
agctcaagcccatgaggccggcgcg

SEQ ID NO: 321834 - DNA, 25 bp, Mus musculus
tcggagcagctcaagcccatgaggc

SEQ ID NO: 321835 - DNA, 25 bp, Mus musculus
acactgattggccactgggcgcggt

SEQ ID NO: 321836 - DNA, 25 bp, Mus musculus
cggtggatcaatgcggttcaggaat

SEQ ID NO: 321837 - DNA, 25 bp, Mus musculus
caacacaaaacactaacacgatccg

SEQ ID NO: 321838 - DNA, 25 bp, Mus musculus
taacacgatccgaatattcaggctg

SEQ ID NO: 321839 - DNA, 25 bp, Mus musculus
ccgcttcccgccgacagaccactcc

SEQ ID NO: 321840 - DNA, 25 bp, Mus musculus
cgtgagttcacaacacaaaacacta

SEQ ID NO: 321841 - DNA, 25 bp, Mus musculus
tgccgcgtgagttcacaacacaaaa

SEQ ID NO: 321842 - DNA, 25 bp, Mus musculus
cgctcatgccgcgtgagttcacaac

SEQ ID NO: 321843 - DNA, 25 bp, Mus musculus
ggtctgcgggagaaagcgcctctcc

SEQ ID NO: 321844 - DNA, 25 bp, Mus musculus
ccgctttgtgaattgcgggtctgcg

SEQ ID NO: 321845 - DNA, 25 bp, Mus musculus
cgcggttacacgtgagcctgctcag

SEQ ID NO: 321846 - DNA, 25 bp, Mus musculus
ttacacgtgagcctgctcagctctc

SEQ ID NO: 321847 - DNA, 25 bp, Mus musculus
agcaccgggaaagtgtcagcgctgg

SEQ ID NO: 321848 - DNA, 25 bp, Mus musculus
agcgctggaggcgtgcaccgcttcc

SEQ ID NO: 321849 - DNA, 25 bp, Mus musculus
ggagaaagcgcctctccgctcatgc

SEQ ID NO: 321850 - DNA, 25 bp, Mus musculus
gatccgaatattcaggctgccgccg

SEQ ID NO: 321851 - DNA, 25 bp, Mus musculus
cgcgcgctaactctcaccctgactc

SEQ ID NO: 321852 - DNA, 25 bp, Mus musculus
gctcagcgcatcaggcagtccatgt

SEQ ID NO: 321853 - DNA, 25 bp, Mus musculus
ggcagtccatgtgccgctgccctga

SEQ ID NO: 321854 - DNA, 25 bp, Mus musculus
cgctgccctgacaagagtgacgtca

SEQ ID NO: 321855 - DNA, 25 bp, Mus musculus
ggctgcgtgtgtagcatcgccgcac

SEQ ID NO: 321856 - DNA, 25 bp, Mus musculus
tagcatcgccgcacgcgctgttttt

SEQ ID NO: 321857 - DNA, 25 bp, Mus musculus
acgcgctgtttttccggcccttgcg

SEQ ID NO: 321858 - DNA, 25 bp, Mus musculus
tgggctgcgaaaagcacaggtgcca

SEQ ID NO: 321859 - DNA, 25 bp, Mus musculus
gcacaggtgccagatttcctgcttc

SEQ ID NO: 321860 - DNA, 25 bp, Mus musculus
aggtgccagatttcctgcttcactc

SEQ ID NO: 321861 - DNA, 25 bp, Mus musculus
tgcttcactctctgccttgcgctgg

SEQ ID NO: 321862 - DNA, 25 bp, Mus musculus
actctctgccttgcgctgggaataa

SEQ ID NO: 321863 - DNA, 25 bp, Mus musculus
cgctgggaataacgcgcgctaactc

SEQ ID NO: 321864 - DNA, 25 bp, Mus musculus
tgactccttttgcacgcgagccctt

SEQ ID NO: 321865 - DNA, 25 bp, Mus musculus
cgagagtggcttcgtgtatgcgatc

SEQ ID NO: 321866 - DNA, 25 bp, Mus musculus
cagcctgcccgtgtctgtgtacgga

SEQ ID NO: 321867 - DNA, 25 bp, Mus musculus
tatgcgatcggggagaagttcgccc

SEQ ID NO: 321868 - DNA, 25 bp, Mus musculus
agctgcctgaggaatacgcctaccc

SEQ ID NO: 321869 - DNA, 25 bp, Mus musculus
ggaactcgttcccacaccggagctg

SEQ ID NO: 321870 - DNA, 25 bp, Mus musculus
ccgcccaggaagctatcagcctgga

SEQ ID NO: 321871 - DNA, 25 bp, Mus musculus
gaagctggcccaagctcctgagcaa

SEQ ID NO: 321872 - DNA, 25 bp, Mus musculus
cagtccgagcatcccgctggagaag

SEQ ID NO: 321873 - DNA, 25 bp, Mus musculus
cctcttggtcacctgctgcctgatg

SEQ ID NO: 321874 - DNA, 25 bp, Mus musculus
gcctagctcctctgcgatggcagtt

SEQ ID NO: 321875 - DNA, 25 bp, Mus musculus
cgggctgtgaatgcgactcgctcat

SEQ ID NO: 321876 - DNA, 25 bp, Mus musculus
agccgcggagctcagttgtactgct

SEQ ID NO: 321877 - DNA, 25 bp, Mus musculus
tttgcgcacagccagagtgcccacg

SEQ ID NO: 321878 - DNA, 25 bp, Mus musculus
cccggcgtccagctcgttaatctag

SEQ ID NO: 321879 - DNA, 25 bp, Mus musculus
gtgcgcgttagctctgcgttcgtta

SEQ ID NO: 321880 - DNA, 25 bp, Mus musculus
tggacgcgctcaaacccgtcggacg

SEQ ID NO: 321881 - DNA, 25 bp, Mus musculus
tgggagccgccctgcgtgatttttt

SEQ ID NO: 321882 - DNA, 25 bp, Mus musculus
ctgcgttcgttacccttcagcgcga

SEQ ID NO: 321883 - DNA, 25 bp, Mus musculus
tcgcggctctctccggtgcgcgtta

SEQ ID NO: 321884 - DNA, 25 bp, Mus musculus
tggccgtgaaccatagggttgtctc

SEQ ID NO: 321885 - DNA, 25 bp, Mus musculus
tttcccagcggcgttacgggatggc

SEQ ID NO: 321886 - DNA, 25 bp, Mus musculus
tttctggtcgcagacctggcttttg

SEQ ID NO: 321887 - DNA, 25 bp, Mus musculus
atctgccgcctaacctggtttctgg

SEQ ID NO: 321888 - DNA, 25 bp, Mus musculus
ggtccttcgctgtgttcggggatct

SEQ ID NO: 321889 - DNA, 25 bp, Mus musculus
cctgcagcggcttgcagctccgtag

SEQ ID NO: 321890 - DNA, 25 bp, Mus musculus
tttagggtatcagccagtgcacgcg

SEQ ID NO: 321891 - DNA, 25 bp, Mus musculus
aaggcggagacactttagggtatca

SEQ ID NO: 321892 - DNA, 25 bp, Mus musculus
acccttcagcgcgaacgtgggagcc

SEQ ID NO: 321893 - DNA, 25 bp, Mus musculus
atgcgtactgggctcctgcgctccg

SEQ ID NO: 321894 - DNA, 25 bp, Mus musculus
tccgggacagggctgcacagcccag

SEQ ID NO: 321895 - DNA, 25 bp, Mus musculus
tggaatcgcacgtgcccgggcgtcc

SEQ ID NO: 321896 - DNA, 25 bp, Mus musculus
agctctgaagggaggataacctaca

SEQ ID NO: 321897 - DNA, 25 bp, Mus musculus
catcacgttgactgccgagcgcatc

SEQ ID NO: 321898 - DNA, 25 bp, Mus musculus
gactgccgagcgcatctcggctgcg

SEQ ID NO: 321899 - DNA, 25 bp, Mus musculus
gaggctcacgtggaatcgcacgtgc

SEQ ID NO: 321900 - DNA, 25 bp, Mus musculus
aggagcctgacctactttcagtggc

SEQ ID NO: 321901 - DNA, 25 bp, Mus musculus
acctactttcagtggcgggaggcgc

SEQ ID NO: 321902 - DNA, 25 bp, Mus musculus
aggcgcatgcgtactgggctcctgc

SEQ ID NO: 321903 - DNA, 25 bp, Mus musculus
cgactcccgatcaagagctctgaag

SEQ ID NO: 321904 - DNA, 25 bp, Mus musculus
agaggaggagcctgacctactttca

SEQ ID NO: 321905 - DNA, 25 bp, Mus musculus
acagcccaggggctgcactgcagga

SEQ ID NO: 321906 - DNA, 25 bp, Mus musculus
aggataacctacaaatcctcccgcg

SEQ ID NO: 321907 - DNA, 25 bp, Mus musculus
gccgaggagcagcaaccctttccag

SEQ ID NO: 321908 - DNA, 25 bp, Mus musculus
cccagtgaggagcttgcacgccgaa

SEQ ID NO: 321909 - DNA, 25 bp, Mus musculus
gtctgagacgcctcgggacatggaa

SEQ ID NO: 321910 - DNA, 25 bp, Mus musculus
tgaacgcagagctggtgcttaggcc

SEQ ID NO: 321911 - DNA, 25 bp, Mus musculus
atctggtagtcaaggcagcagcgga

SEQ ID NO: 321912 - DNA, 25 bp, Mus musculus
tagcgccactgctaactgtggaatc

SEQ ID NO: 321913 - DNA, 25 bp, Mus musculus
ggcacagtcacttagcaagaaaacg

SEQ ID NO: 321914 - DNA, 25 bp, Mus musculus
tgcgctcagtcagcggcggaaagca

SEQ ID NO: 321915 - DNA, 25 bp, Mus musculus
acgccgaaggcccaaatgcattttc

SEQ ID NO: 321916 - DNA, 25 bp, Mus musculus
ggcggaacaagacggtgctcaccta

SEQ ID NO: 321917 - DNA, 25 bp, Mus musculus
cgtcgcctcggatccagaccgggaa

SEQ ID NO: 321918 - DNA, 25 bp, Mus musculus
cctctatcggctctactgccaggta

SEQ ID NO: 321919 - DNA, 25 bp, Mus musculus
ccgctaggtcgagacaaaggctggc

SEQ ID NO: 321920 - DNA, 25 bp, Mus musculus
tcccaaggaaacaaaagtgcgaggc

SEQ ID NO: 321921 - DNA, 25 bp, Mus musculus
ttcccgcacctcgtgactctaggtg

SEQ ID NO: 321922 - DNA, 25 bp, Mus musculus
aacgccatggtagctccagagagcc

SEQ ID NO: 321923 - DNA, 25 bp, Mus musculus
tcccaaacgccatggtagctccaga

SEQ ID NO: 321924 - DNA, 25 bp, Mus musculus
ggatcgcggtgactcttcccaaacg

SEQ ID NO: 321925 - DNA, 25 bp, Mus musculus
ggtggagtgatgtgactccgcaccc

SEQ ID NO: 321926 - DNA, 25 bp, Mus musculus
tagcgtaaggatcgcggtgactctt

SEQ ID NO: 321927 - DNA, 25 bp, Mus musculus
acccacagaggtagcgtaaggatcg

SEQ ID NO: 321928 - DNA, 25 bp, Mus musculus
ccttacctatgaggtgacccacaga

SEQ ID NO: 321929 - DNA, 25 bp, Mus musculus
ggatgttactccctgcgcctcctta

SEQ ID NO: 321930 - DNA, 25 bp, Mus musculus
caatcgagaatggagtggaaccggc

SEQ ID NO: 321931 - DNA, 25 bp, Mus musculus
cccaccctccaatcgagaatggagt

SEQ ID NO: 321932 - DNA, 25 bp, Mus musculus
atttcctccgacttggtccaactcg

SEQ ID NO: 321933 - DNA, 25 bp, Mus musculus
gggtagcatttcctccgacttggtc

SEQ ID NO: 321934 - DNA, 25 bp, Mus musculus
agtggaaccggcaaagctcccacgg

SEQ ID NO: 321935 - DNA, 25 bp, Mus musculus
gtcctggaagcatcgcctgaagcca

SEQ ID NO: 321936 - DNA, 25 bp, Mus musculus
cagtggcctgaagtgctgactccca

SEQ ID NO: 321937 - DNA, 25 bp, Mus musculus
atccttcaaattccgctgcagaggg

SEQ ID NO: 321938 - DNA, 25 bp, Mus musculus
gcacagcgcagtccttccaagatga

SEQ ID NO: 321939 - DNA, 25 bp, Mus musculus
tccaagatgagtcccgcacggcttt

SEQ ID NO: 321940 - DNA, 25 bp, Mus musculus
tttctttctctgtgtgcggtgtctg

SEQ ID NO: 321941 - DNA, 25 bp, Mus musculus
gcgaacagccgagaagttcttttta

SEQ ID NO: 321942 - DNA, 25 bp, Mus musculus
tgactcccagctactgctccttatg

SEQ ID NO: 321943 - DNA, 25 bp, Mus musculus
tcctcctctccaagtgggaaggcgt

SEQ ID NO: 321944 - DNA, 25 bp, Mus musculus
ccctgcagttgcattgcggaaaatc

SEQ ID NO: 321945 - DNA, 25 bp, Mus musculus
tgacctgtgtttgcgggcaataatc

SEQ ID NO: 321946 - DNA, 25 bp, Mus musculus
ctggcctgatcagagacagcagtca

SEQ ID NO: 321947 - DNA, 25 bp, Mus musculus
agggcaacttgtcgcggactacctg

SEQ ID NO: 321948 - DNA, 25 bp, Mus musculus
gcacggcttttctgtagtgagcgaa

SEQ ID NO: 321949 - DNA, 25 bp, Mus musculus
agacgagctgctccaggcaacgctc

SEQ ID NO: 321950 - DNA, 25 bp, Mus musculus
gccgacgttcacgtggagtaccact

SEQ ID NO: 321951 - DNA, 25 bp, Mus musculus
agttcctcagggaaggccgatcttc

SEQ ID NO: 321952 - DNA, 25 bp, Mus musculus
cggcgtgactggagtggaaattttt

SEQ ID NO: 321953 - DNA, 25 bp, Mus musculus
acttctcggaggcaacatattggaa

SEQ ID NO: 321954 - DNA, 25 bp, Mus musculus
ccggagtccaaatggaagtggctga

SEQ ID NO: 321955 - DNA, 25 bp, Mus musculus
aaacttctcgccctgctgattctga

SEQ ID NO: 321956 - DNA, 25 bp, Mus musculus
tcaattacctcatcgacttgtggtc

SEQ ID NO: 321957 - DNA, 25 bp, Mus musculus
ttgtggtcttggtacggtccttaga

SEQ ID NO: 321958 - DNA, 25 bp, Mus musculus
gtccttagagtacggcgcctgccga

SEQ ID NO: 321959 - DNA, 25 bp, Mus musculus
tcgtcgtcctcgacatcgccgaaga

SEQ ID NO: 321960 - DNA, 25 bp, Mus musculus
gggctatgctaatgttgttgatatc

SEQ ID NO: 321961 - DNA, 25 bp, Mus musculus
gccggcttatcgtcctctagcgtca

SEQ ID NO: 321962 - DNA, 25 bp, Mus musculus
tcctcagggctgaggggaaaacgcc

SEQ ID NO: 321963 - DNA, 25 bp, Mus musculus
gtttgatgatctcgcccaccaggcc

SEQ ID NO: 321964 - DNA, 25 bp, Mus musculus
gcgctgcacgccatctggcttgatg

SEQ ID NO: 321965 - DNA, 25 bp, Mus musculus
gcttgatggcaatgaaggtacgctc

SEQ ID NO: 321966 - DNA, 25 bp, Mus musculus
ccatggtcctgtggaggcaagaagt

SEQ ID NO: 321967 - DNA, 25 bp, Mus musculus
gcaagaagtgtagtcgatgaggccc

SEQ ID NO: 321968 - DNA, 25 bp, Mus musculus
ggacacgtggctttccagatacttc

SEQ ID NO: 321969 - DNA, 25 bp, Mus musculus
ggggagtgcatcttagccttaccga

SEQ ID NO: 321970 - DNA, 25 bp, Mus musculus
ggccaaactactggcgggcgaacca

SEQ ID NO: 321971 - DNA, 25 bp, Mus musculus
ctggtgtctgcgatgagcgacagaa

SEQ ID NO: 321972 - DNA, 25 bp, Mus musculus
agaatagaacgaccaccagccggcg

SEQ ID NO: 321973 - DNA, 25 bp, Mus musculus
cctggtcttgccagtcgtctctgtc

SEQ ID NO: 321974 - DNA, 25 bp, Mus musculus
cccttctgctcgaaccgtttgatga

SEQ ID NO: 321975 - DNA, 25 bp, Mus musculus
cgaaggaacttcatggccaccaggc

SEQ ID NO: 321976 - DNA, 25 bp, Mus musculus
tccaaaaggcgacgcggccaaacta

SEQ ID NO: 321977 - DNA, 25 bp, Mus musculus
tgatgccactggtggtggccgtgct

SEQ ID NO: 321978 - DNA, 25 bp, Mus musculus
agttcgagcggctcatcgggcgcta

SEQ ID NO: 321979 - DNA, 25 bp, Mus musculus
tggccgtgctggagaacctggactc

SEQ ID NO: 321980 - DNA, 25 bp, Mus musculus
agaacctggactcggtgttcgcgca

SEQ ID NO: 321981 - DNA, 25 bp, Mus musculus
tggactcggtgttcgcgcaggacca

SEQ ID NO: 321982 - DNA, 25 bp, Mus musculus
agctgctgcgggacgacaacgagca

SEQ ID NO: 321983 - DNA, 25 bp, Mus musculus
cgggacgacaacgagcagctcatca

SEQ ID NO: 321984 - DNA, 25 bp, Mus musculus
acgagcagctcatcacccagtacga

SEQ ID NO: 321985 - DNA, 25 bp, Mus musculus
tcacccagtacgagcgggagaaggc

SEQ ID NO: 321986 - DNA, 25 bp, Mus musculus
gcgcgccaggcgcaccaacgcgcca

SEQ ID NO: 321987 - DNA, 25 bp, Mus musculus
caacgcgccagggtggactcctgaa

SEQ ID NO: 321988 - DNA, 25 bp, Mus musculus
tggactcctgaagggcaggcccgaa

SEQ ID NO: 321989 - DNA, 25 bp, Mus musculus
ctcctgaagggcaggcccgaatcca

SEQ ID NO: 321990 - DNA, 25 bp, Mus musculus
cgagcggctcatcgggcgctacgat

SEQ ID NO: 321991 - DNA, 25 bp, Mus musculus
cccggttacacagccgtgactgcgg

SEQ ID NO: 321992 - DNA, 25 bp, Mus musculus
gttccattggctcggttacgtaagc

SEQ ID NO: 321993 - DNA, 25 bp, Mus musculus
ttgagcggcaagaggatggtttcct

SEQ ID NO: 321994 - DNA, 25 bp, Mus musculus
cagagacagggattaagcgagttga

SEQ ID NO: 321995 - DNA, 25 bp, Mus musculus
ctggaacgcgctcaagaccttcgga

SEQ ID NO: 321996 - DNA, 25 bp, Mus musculus
cgaaattagaaatctggaacgcgct

SEQ ID NO: 321997 - DNA, 25 bp, Mus musculus
ttggttgcacaagcaaacgaaatta

SEQ ID NO: 321998 - DNA, 25 bp, Mus musculus
acgcggccatcatatttttggttgc

SEQ ID NO: 321999 - DNA, 25 bp, Mus musculus
gggaaacgcggccatcatatttttg

SEQ ID NO: 322000 - DNA, 25 bp, Mus musculus
tggagcggggagtacagactccatc

SEQ ID NO: 322001 - DNA, 25 bp, Mus musculus
cgctgccgtttttagcgcgcctgga

SEQ ID NO: 322002 - DNA, 25 bp, Mus musculus
agcagcccggcgctgccgtttttag

SEQ ID NO: 322003 - DNA, 25 bp, Mus musculus
cgtaagcccggttacacagccgtga

SEQ ID NO: 322004 - DNA, 25 bp, Mus musculus
gcacgcgggtgaaagatgcactccc

SEQ ID NO: 322005 - DNA, 25 bp, Mus musculus
ccacaggctagctcgcccaggagtg

SEQ ID NO: 322006 - DNA, 25 bp, Mus musculus
tacggtctcaagcaaccctcatgtc

SEQ ID NO: 322007 - DNA, 25 bp, Mus musculus
cctcatgtccgagctgctgccaggt

SEQ ID NO: 322008 - DNA, 25 bp, Mus musculus
aactgtcacctgtgcgggaggtgca

SEQ ID NO: 322009 - DNA, 25 bp, Mus musculus
ttctgcagttgtcactctcggggtg

SEQ ID NO: 322010 - DNA, 25 bp, Mus musculus
tcaatgaatcgggagcacgagtccc

SEQ ID NO: 322011 - DNA, 25 bp, Mus musculus
cacagtcgcactcgctcggaagcag

SEQ ID NO: 322012 - DNA, 25 bp, Mus musculus
cggaagcagccttttccgtgtactc

SEQ ID NO: 322013 - DNA, 25 bp, Mus musculus
ctctcgggactctcagctcattggt

SEQ ID NO: 322014 - DNA, 25 bp, Mus musculus
agctcattggtcacagcggcgttca

SEQ ID NO: 322015 - DNA, 25 bp, Mus musculus
gttcaggaggcgtgaccatctatca

SEQ ID NO: 322016 - DNA, 25 bp, Mus musculus
gaccatctatcagcggccgtctgga

SEQ ID NO: 322017 - DNA, 25 bp, Mus musculus
agcgcgctcgtgtaagcttgccgtc

SEQ ID NO: 322018 - DNA, 25 bp, Mus musculus
gccctgcggggattaatactcaatg

SEQ ID NO: 322019 - DNA, 25 bp, Mus musculus
tctcgtggtcccagcgcacgttgct

SEQ ID NO: 322020 - DNA, 25 bp, Mus musculus
gtgccttccacccaacggagcggtg

SEQ ID NO: 322021 - DNA, 25 bp, Mus musculus
cgtttctcggcctcaccaaggtgct

SEQ ID NO: 322022 - DNA, 25 bp, Mus musculus
tcaccaaggtgcttcttcttctgcc

SEQ ID NO: 322023 - DNA, 25 bp, Mus musculus
gattggcgcggaatcctccctccgt

SEQ ID NO: 322024 - DNA, 25 bp, Mus musculus
tccgccgtcaggtgcttcagtcggc

SEQ ID NO: 322025 - DNA, 25 bp, Mus musculus
aggcccacgggacttacgctctcgt

SEQ ID NO: 322026 - DNA, 25 bp, Mus musculus
ggcccattaactcatccagcaactg

SEQ ID NO: 322027 - DNA, 25 bp, Mus musculus
tgcgcggcagaaatcatggtgcttc

SEQ ID NO: 322028 - DNA, 25 bp, Mus musculus
tcggcccactctcaagctcgaaaag

SEQ ID NO: 322029 - DNA, 25 bp, Mus musculus
ttccagagaggagccgagaagacaa

SEQ ID NO: 322030 - DNA, 25 bp, Mus musculus
tggacgctctaacggctgccggtgt

SEQ ID NO: 322031 - DNA, 25 bp, Mus musculus
ttgctgcgcttctcatccggggcga

SEQ ID NO: 322032 - DNA, 25 bp, Mus musculus
agctcgaaaagcctcttccagagag

SEQ ID NO: 322033 - DNA, 25 bp, Mus musculus
atgtagaccatccttgctgctgcca

SEQ ID NO: 322034 - DNA, 25 bp, Mus musculus
tctcattagcgcgtttccggtgacg

SEQ ID NO: 322035 - DNA, 25 bp, Mus musculus
cgcgtttccggtgacggtgattaga

SEQ ID NO: 322036 - DNA, 25 bp, Mus musculus
ggtgacggtgattagattctagtac

SEQ ID NO: 322037 - DNA, 25 bp, Mus musculus
agattctagtacttccagggcgggc

SEQ ID NO: 322038 - DNA, 25 bp, Mus musculus
acgtgtgcatgtatgtagaccatcc

SEQ ID NO: 322039 - DNA, 25 bp, Mus musculus
cgaccctttctcattagcgcgtttc

SEQ ID NO: 322040 - DNA, 25 bp, Mus musculus
atccttgctgctgccacgcactgtg

SEQ ID NO: 322041 - DNA, 25 bp, Mus musculus
ctgccacgcactgtggcacagagta

SEQ ID NO: 322042 - DNA, 25 bp, Mus musculus
ctgtggcacagagtaggactaaacc

SEQ ID NO: 322043 - DNA, 25 bp, Mus musculus
catttttgaaccgagtcactaaacg

SEQ ID NO: 322044 - DNA, 25 bp, Mus musculus
cgagtcactaaacgtcgtcgtagca

SEQ ID NO: 322045 - DNA, 25 bp, Mus musculus
cgtcgtcgtagcagtaccgtagggt

SEQ ID NO: 322046 - DNA, 25 bp, Mus musculus
tggtgcctgtgaacgtgtgcatgta

SEQ ID NO: 322047 - DNA, 25 bp, Mus musculus
caatgtcgttttcgaagcaggcttg

SEQ ID NO: 322048 - DNA, 25 bp, Mus musculus
gggtcagaacttcaatgtcgttttc

SEQ ID NO: 322049 - DNA, 25 bp, Mus musculus
cccggagtagccgagccagtcttag

SEQ ID NO: 322050 - DNA, 25 bp, Mus musculus
gccagtcttagagacgcgtcagtca

SEQ ID NO: 322051 - DNA, 25 bp, Mus musculus
gcgtcagtcagaaagattgaacctc

SEQ ID NO: 322052 - DNA, 25 bp, Mus musculus
tcctaccgggaacttggtcacctga

SEQ ID NO: 322053 - DNA, 25 bp, Mus musculus
cgcggagccgcctctagtagaacaa

SEQ ID NO: 322054 - DNA, 25 bp, Mus musculus
cgcctctagtagaacaacttccggt

SEQ ID NO: 322055 - DNA, 25 bp, Mus musculus
ttccagccggaaaaggctggtgtgc

SEQ ID NO: 322056 - DNA, 25 bp, Mus musculus
cgtagggtttcctagcgctggaaga

SEQ ID NO: 322057 - DNA, 25 bp, Mus musculus
ggaccgtgtcgcaaaaataatgggc

SEQ ID NO: 322058 - DNA, 25 bp, Mus musculus
cattcgggtgatgggtcagaacttc

SEQ ID NO: 322059 - DNA, 25 bp, Mus musculus
aagcaggcttgggatacatgggacc

SEQ ID NO: 322060 - DNA, 25 bp, Mus musculus
ggaataaatatgtgcgtacccgcca

SEQ ID NO: 322061 - DNA, 25 bp, Mus musculus
gacggaccgacggacgcgccacttc

SEQ ID NO: 322062 - DNA, 25 bp, Mus musculus
caattctcgtgaggagccgcggcag

SEQ ID NO: 322063 - DNA, 25 bp, Mus musculus
gcagccagagctcccgccatgcggc

SEQ ID NO: 322064 - DNA, 25 bp, Mus musculus
cgcccgcagcaaggcgcagagcagg

SEQ ID NO: 322065 - DNA, 25 bp, Mus musculus
cgacagcggcgagagcacggagccc

SEQ ID NO: 322066 - DNA, 25 bp, Mus musculus
cgccacttccgctcgggtgatgtgc

SEQ ID NO: 322067 - DNA, 25 bp, Mus musculus
ggggccaaggcctccatccacacgc

SEQ ID NO: 322068 - DNA, 25 bp, Mus musculus
cctcggcgcagaaggtcgttacctg

SEQ ID NO: 322069 - DNA, 25 bp, Mus musculus
aaggtcgttacctggcgcgcgccca

SEQ ID NO: 322070 - DNA, 25 bp, Mus musculus
acccgccgccggaagttggcagacg

SEQ ID NO: 322071 - DNA, 25 bp, Mus musculus
cggagtcacgtgacacggggccaac

SEQ ID NO: 322072 - DNA, 25 bp, Mus musculus
ggggccaacgcaattctcgtgagga

SEQ ID NO: 322073 - DNA, 25 bp, Mus musculus
gacacggggccaacgcaattctcgt

SEQ ID NO: 322074 - DNA, 25 bp, Mus musculus
caacgcaattctcgtgaggagccgc

SEQ ID NO: 322075 - DNA, 25 bp, Mus musculus
ctcccattgcctggtgcagtcagga

SEQ ID NO: 322076 - DNA, 25 bp, Mus musculus
accttcttctgtggttgaccgcggc

SEQ ID NO: 322077 - DNA, 25 bp, Mus musculus
acattcgggaggtgcagaaactggt

SEQ ID NO: 322078 - DNA, 25 bp, Mus musculus
cggggtggatgtgaactcgcaaaat

SEQ ID NO: 322079 - DNA, 25 bp, Mus musculus
actcgcaaaatgaggtcaacggctg

SEQ ID NO: 322080 - DNA, 25 bp, Mus musculus
aaatgaggtcaacggctggtaagtg

SEQ ID NO: 322081 - DNA, 25 bp, Mus musculus
gcgtggagcagtcagccgtgaccca

SEQ ID NO: 322082 - DNA, 25 bp, Mus musculus
agtcagccgtgacccaggacgcagg

SEQ ID NO: 322083 - DNA, 25 bp, Mus musculus
aggcctctcaggtcgtggccctttc

SEQ ID NO: 322084 - DNA, 25 bp, Mus musculus
gtcgtggccctttcgagactggccc

SEQ ID NO: 322085 - DNA, 25 bp, Mus musculus
tggtgcagtcaggagcgcatcctcc

SEQ ID NO: 322086 - DNA, 25 bp, Mus musculus
ttctgtggttgaccgcggccagcgc

SEQ ID NO: 322087 - DNA, 25 bp, Mus musculus
caaaccataccttcttctgtggttg

SEQ ID NO: 322088 - DNA, 25 bp, Mus musculus
ccgatctcccattgcctggtgcagt

SEQ ID NO: 322089 - DNA, 25 bp, Mus musculus
gggctctagagagcttgctgagccc

SEQ ID NO: 322090 - DNA, 25 bp, Mus musculus
aggtcgttgagctgcgtgaagctcc

SEQ ID NO: 322091 - DNA, 25 bp, Mus musculus
ctgcgtgaagctccggggctgtccc

SEQ ID NO: 322092 - DNA, 25 bp, Mus musculus
aggaggtgtcctcacacaaccgggg

SEQ ID NO: 322093 - DNA, 25 bp, Mus musculus
cccggcgcacaccacagctggatcc

SEQ ID NO: 322094 - DNA, 25 bp, Mus musculus
tccggttgcccgaatgggcgctacc

SEQ ID NO: 322095 - DNA, 25 bp, Mus musculus
aatgggcgctaccttcggtgaagca

SEQ ID NO: 322096 - DNA, 25 bp, Mus musculus
cgtgcgtcaccggtccagaaccgcc

SEQ ID NO: 322097 - DNA, 25 bp, Mus musculus
aggggtcagcatcgtcccggctcca

SEQ ID NO: 322098 - DNA, 25 bp, Mus musculus
ccgtggctgccgttgccgtagctgt

SEQ ID NO: 322099 - DNA, 25 bp, Mus musculus
gttgccgtagctgtcgccggcgcca

SEQ ID NO: 322100 - DNA, 25 bp, Mus musculus
cccagacaggtcgttgagctgcgtg

SEQ ID NO: 322101 - DNA, 25 bp, Mus musculus
gagcaggatctaaggggtcagcatc

SEQ ID NO: 322102 - DNA, 25 bp, Mus musculus
ctcatccatcctctggccagctggg

SEQ ID NO: 322103 - DNA, 25 bp, Mus musculus
tcgccaagtctctggccctgtggct

SEQ ID NO: 322104 - DNA, 25 bp, Mus musculus
tatagctgctccaattcgggcggta

SEQ ID NO: 322105 - DNA, 25 bp, Mus musculus
agtcccacactcttcagtatagctg

SEQ ID NO: 322106 - DNA, 25 bp, Mus musculus
agtgtcttgctcatacctgccgcta

SEQ ID NO: 322107 - DNA, 25 bp, Mus musculus
tgaaagacggactgccgcggcgcca

SEQ ID NO: 322108 - DNA, 25 bp, Mus musculus
gagcagacatcgcagactatgcctg

SEQ ID NO: 322109 - DNA, 25 bp, Mus musculus
aggttggggtccagacagtcccaca

SEQ ID NO: 322110 - DNA, 25 bp, Mus musculus
ctgtggctggtctccgagcgccgct

SEQ ID NO: 322111 - DNA, 25 bp, Mus musculus
ctatgcctgaaagacggactgccgc

SEQ ID NO: 322112 - DNA, 25 bp, Mus musculus
gaactacagccctgccgtgcctttg

SEQ ID NO: 322113 - DNA, 25 bp, Mus musculus
ccgtgcctttgaagatccaaccgtc

SEQ ID NO: 322114 - DNA, 25 bp, Mus musculus
ccaaccgtctcagcgcttaaaattc

SEQ ID NO: 322115 - DNA, 25 bp, Mus musculus
cgcggcgccaggcatattgtagtgt

SEQ ID NO: 322116 - DNA, 25 bp, Mus musculus
cggtagagcgcggaactacagccct

SEQ ID NO: 322117 - DNA, 25 bp, Mus musculus
ttggggacggaacacccagacctgc

SEQ ID NO: 322118 - DNA, 25 bp, Mus musculus
ccgcttgcgggaagacgctgaccga

SEQ ID NO: 322119 - DNA, 25 bp, Mus musculus
ctgatcgcccgcgccaaacgggttg

SEQ ID NO: 322120 - DNA, 25 bp, Mus musculus
cgcgcaggcgctaaagcgtctcaga

SEQ ID NO: 322121 - DNA, 25 bp, Mus musculus
gaggcgctgtaggtcatagagccca

SEQ ID NO: 322122 - DNA, 25 bp, Mus musculus
ttagggtcggcctgccctgatcgcc

SEQ ID NO: 322123 - DNA, 25 bp, Mus musculus
gcttcgcgcgcaggcgctaaagcgt

SEQ ID NO: 322124 - DNA, 25 bp, Mus musculus
aggcgctaaagcgtctcagaggaag

SEQ ID NO: 322125 - DNA, 25 bp, Mus musculus
tcagaggaagggattagtgccagcc

SEQ ID NO: 322126 - DNA, 25 bp, Mus musculus
cgaaggctcccgcttgcgggaagac

SEQ ID NO: 322127 - DNA, 25 bp, Mus musculus
cgcgcctaccggcacgctgctgagc

SEQ ID NO: 322128 - DNA, 25 bp, Mus musculus
tgtaggtcatagagcccacgggcgc

SEQ ID NO: 322129 - DNA, 25 bp, Mus musculus
agccggtacgcatctggtttagggt

SEQ ID NO: 322130 - DNA, 25 bp, Mus musculus
tacgcatctggtttagggtcggcct

SEQ ID NO: 322131 - DNA, 25 bp, Mus musculus
ctcagcagtaacaggacacaggatg

SEQ ID NO: 322132 - DNA, 25 bp, Mus musculus
tgcctcctcgactcctgccggccag

SEQ ID NO: 322133 - DNA, 25 bp, Mus musculus
cggccagcactctcgggaggaaagt

SEQ ID NO: 322134 - DNA, 25 bp, Mus musculus
actctcgggaggaaagttgttcagc

SEQ ID NO: 322135 - DNA, 25 bp, Mus musculus
ggaaagttgttcagctggccaggca

SEQ ID NO: 322136 - DNA, 25 bp, Mus musculus
aggcaggtctgcctcagcagtaaca

SEQ ID NO: 322137 - DNA, 25 bp, Mus musculus
cgctcagactctcgcggctgcctcc

SEQ ID NO: 322138 - DNA, 25 bp, Mus musculus
tctctcggaaggaccgcagggtccc

SEQ ID NO: 322139 - DNA, 25 bp, Mus musculus
agctctctctcggaaggaccgcagg

SEQ ID NO: 322140 - DNA, 25 bp, Mus musculus
gaaaggcacagagctctctctcgga

SEQ ID NO: 322141 - DNA, 25 bp, Mus musculus
taccttggaccgaaaggcacagagc

SEQ ID NO: 322142 - DNA, 25 bp, Mus musculus
cgcgggagctctaccttggaccgaa

SEQ ID NO: 322143 - DNA, 25 bp, Mus musculus
cgtgtttaaccccttcctgctgtct

SEQ ID NO: 322144 - DNA, 25 bp, Mus musculus
ttcagctggccaggcaggtctgcct

SEQ ID NO: 322145 - DNA, 25 bp, Mus musculus
gtcagactcttgacgtcacaggagg

SEQ ID NO: 322146 - DNA, 25 bp, Mus musculus
cccggtcagactcttgacgtcacag

SEQ ID NO: 322147 - DNA, 25 bp, Mus musculus
cttgttcgcagaccccgagaatgcc

SEQ ID NO: 322148 - DNA, 25 bp, Mus musculus
gctccttaggcttgttcgcagaccc

SEQ ID NO: 322149 - DNA, 25 bp, Mus musculus
ctcctgcaccgcaagcggctcctta

SEQ ID NO: 322150 - DNA, 25 bp, Mus musculus
tcttcttcatcatgacgcgctcctg

SEQ ID NO: 322151 - DNA, 25 bp, Mus musculus
cagtaatcttcttcatcatgacgcg

SEQ ID NO: 322152 - DNA, 25 bp, Mus musculus
ggggcgcgcacccaccgagcaactt

SEQ ID NO: 322153 - DNA, 25 bp, Mus musculus
tcacaggaggcgctaaagagcgcca

SEQ ID NO: 322154 - DNA, 25 bp, Mus musculus
gcggccgccgtagcgtccatagcaa

SEQ ID NO: 322155 - DNA, 25 bp, Mus musculus
ccctaagatgactgcgcagcgcggc

SEQ ID NO: 322156 - DNA, 25 bp, Mus musculus
ccgagcaacttgagcggggactgcc

SEQ ID NO: 322157 - DNA, 25 bp, Mus musculus
cggggactgcctttcagtaatcttc

SEQ ID NO: 322158 - DNA, 25 bp, Mus musculus
tagcaaccagcgccacgcgcagggg

SEQ ID NO: 322159 - DNA, 25 bp, Mus musculus
acagcgtgcccagcaggggtgtacc

SEQ ID NO: 322160 - DNA, 25 bp, Mus musculus
cgggcagatgttgtaccagatgtaa

SEQ ID NO: 322161 - DNA, 25 bp, Mus musculus
gtgacctcgtattgcctctcccgga

SEQ ID NO: 322162 - DNA, 25 bp, Mus musculus
atgcgagacctcgacagcgtgccca

SEQ ID NO: 322163 - DNA, 25 bp, Mus musculus
aaccatggcgcgcaaggcggcagaa

SEQ ID NO: 322164 - DNA, 25 bp, Mus musculus
aggctgtcccaagctgtccacacgg

SEQ ID NO: 322165 - DNA, 25 bp, Mus musculus
actcaggactcggaggctgtcccaa

SEQ ID NO: 322166 - DNA, 25 bp, Mus musculus
cgcacgcgtgctcgcggactcagga

SEQ ID NO: 322167 - DNA, 25 bp, Mus musculus
tcacgtgcacgtaaagcgccgcacg

SEQ ID NO: 322168 - DNA, 25 bp, Mus musculus
tatgaacggaacagccacggccacc

SEQ ID NO: 322169 - DNA, 25 bp, Mus musculus
ccagatgtaatgttaggcacggaca

SEQ ID NO: 322170 - DNA, 25 bp, Mus musculus
aatgacgcgggcagatgttgtacca

SEQ ID NO: 322171 - DNA, 25 bp, Mus musculus
ctcccggagtggctagagagcccac

SEQ ID NO: 322172 - DNA, 25 bp, Mus musculus
acagcgtgcatgtgggctatgaacg

SEQ ID NO: 322173 - DNA, 25 bp, Mus musculus
gaagcgcagcatcccgtgatagaca

SEQ ID NO: 322174 - DNA, 25 bp, Mus musculus
cccaggctcgcgatacacagcctcc

SEQ ID NO: 322175 - DNA, 25 bp, Mus musculus
ctgcaacttcgagttcggccgaggg

SEQ ID NO: 322176 - DNA, 25 bp, Mus musculus
gggtacctgagagcgcggacactct

SEQ ID NO: 322177 - DNA, 25 bp, Mus musculus
tcccgtgatagacagccatggctcg

SEQ ID NO: 322178 - DNA, 25 bp, Mus musculus
cagcatcccgtgatagacagccatg

SEQ ID NO: 322179 - DNA, 25 bp, Mus musculus
tgagagcgcggacactctgcaactt

SEQ ID NO: 322180 - DNA, 25 bp, Mus musculus
gagcgcggacactctgcaacttcga

SEQ ID NO: 322181 - DNA, 25 bp, Mus musculus
cgcggacactctgcaacttcgagtt

SEQ ID NO: 322182 - DNA, 25 bp, Mus musculus
tcccgaagcgcagcatcccgtgata

SEQ ID NO: 322183 - DNA, 25 bp, Mus musculus
gatagacagccatggctcgcttccg

SEQ ID NO: 322184 - DNA, 25 bp, Mus musculus
actctgcaacttcgagttcggccga

SEQ ID NO: 322185 - DNA, 25 bp, Mus musculus
aactttgaaagtgaacgaggcgagg

SEQ ID NO: 322186 - DNA, 25 bp, Mus musculus
tgaacgaggcgagggtaattaagaa

SEQ ID NO: 322187 - DNA, 25 bp, Mus musculus
cattcgctcctgatctcggtgctgc

SEQ ID NO: 322188 - DNA, 25 bp, Mus musculus
agatcacggctccacgcgaggctct

SEQ ID NO: 322189 - DNA, 25 bp, Mus musculus
aggaagccgcaacgtcagcagagcc

SEQ ID NO: 322190 - DNA, 25 bp, Mus musculus
cgagccatccgagctcagggcgctg

SEQ ID NO: 322191 - DNA, 25 bp, Mus musculus
tagcttcctggagcgtggcccagag

SEQ ID NO: 322192 - DNA, 25 bp, Mus musculus
ccatggagccacaggagggtagctt

SEQ ID NO: 322193 - DNA, 25 bp, Mus musculus
tcaagctggtccgtagggaccggtc

SEQ ID NO: 322194 - DNA, 25 bp, Mus musculus
ccgagatgctcagtccacagggaaa

SEQ ID NO: 322195 - DNA, 25 bp, Mus musculus
agccagcagagctggcccgagatgc

SEQ ID NO: 322196 - DNA, 25 bp, Mus musculus
aggctctgccttccggtcgctgcgg

SEQ ID NO: 322197 - DNA, 25 bp, Mus musculus
tgctgctgtctgagctgggtacccg

SEQ ID NO: 322198 - DNA, 25 bp, Mus musculus
gggaccggtccagtgtagacccatg

SEQ ID NO: 322199 - DNA, 25 bp, Mus musculus
acccgggtaggagatcacggagcca

SEQ ID NO: 322200 - DNA, 25 bp, Mus musculus
tccacagggaaatcgacgcgcagcg

SEQ ID NO: 322201 - DNA, 25 bp, Mus musculus
caccgcaacgcggtagacctggtga

SEQ ID NO: 322202 - DNA, 25 bp, Mus musculus
aaggctcgggcgcatccggagtccc

SEQ ID NO: 322203 - DNA, 25 bp, Mus musculus
agagcccaccgcctgccagtccgtt

SEQ ID NO: 322204 - DNA, 25 bp, Mus musculus
ggcccgtgagcttggctccggcaac

SEQ ID NO: 322205 - DNA, 25 bp, Mus musculus
cgtacttacaccacggctcgggaga

SEQ ID NO: 322206 - DNA, 25 bp, Mus musculus
ttacaccacggctcgggagatcatc

SEQ ID NO: 322207 - DNA, 25 bp, Mus musculus
acggctcgggagatcatccaggaca

SEQ ID NO: 322208 - DNA, 25 bp, Mus musculus
atccaggacaccatcttttcggccg

SEQ ID NO: 322209 - DNA, 25 bp, Mus musculus
atcttttcggccgatgggccgctga

SEQ ID NO: 322210 - DNA, 25 bp, Mus musculus
gctccaccgagctgcgcggtcacct

SEQ ID NO: 322211 - DNA, 25 bp, Mus musculus
gccgggattgtgaagtgtctggcta

SEQ ID NO: 322212 - DNA, 25 bp, Mus musculus
gctaggtgcggctccggtgctcacc

SEQ ID NO: 322213 - DNA, 25 bp, Mus musculus
tcacgtttggagtgatgggtttgca

SEQ ID NO: 322214 - DNA, 25 bp, Mus musculus
gcggtagacctggtgacaaaggctc

SEQ ID NO: 322215 - DNA, 25 bp, Mus musculus
ggactgccacgtctagcaactcagc

SEQ ID NO: 322216 - DNA, 25 bp, Mus musculus
aactcagctcctcccggcggaggtg

SEQ ID NO: 322217 - DNA, 25 bp, Mus musculus
cccgcagatgcagtttgccagcctg

SEQ ID NO: 322218 - DNA, 25 bp, Mus musculus
cagcccatctcagtggccgcggaag

SEQ ID NO: 322219 - DNA, 25 bp, Mus musculus
tgtgagtccgccgagcccacgagcg

SEQ ID NO: 322220 - DNA, 25 bp, Mus musculus
ctgcccgtcggaaaccgggagccag

SEQ ID NO: 322221 - DNA, 25 bp, Mus musculus
cagggacccgcttagccggcgtcat

SEQ ID NO: 322222 - DNA, 25 bp, Mus musculus
cgcttagccggcgtcatcatgacca

SEQ ID NO: 322223 - DNA, 25 bp, Mus musculus
gtcatcatgaccaaggccggtagca

SEQ ID NO: 322224 - DNA, 25 bp, Mus musculus
gcaagggcgggaacctccgcgacaa

SEQ ID NO: 322225 - DNA, 25 bp, Mus musculus
tccgcgacaagctggacggcaatga

SEQ ID NO: 322226 - DNA, 25 bp, Mus musculus
cggcaatgagctggacctgagcctc

SEQ ID NO: 322227 - DNA, 25 bp, Mus musculus
gacctgagcctcagcgacctgaatg

SEQ ID NO: 322228 - DNA, 25 bp, Mus musculus
gcctcagcgacctgaatgaagtccc

SEQ ID NO: 322229 - DNA, 25 bp, Mus musculus
tccggtcacgtgacacgttgtgggc

SEQ ID NO: 322230 - DNA, 25 bp, Mus musculus
cgcaagacccggaagtagatctatc

SEQ ID NO: 322231 - DNA, 25 bp, Mus musculus
cggaagtagatctatcccggtagcg

SEQ ID NO: 322232 - DNA, 25 bp, Mus musculus
atcccggtagcggaagcagacttcc

SEQ ID NO: 322233 - DNA, 25 bp, Mus musculus
cggaagcagacttcccagcctggaa

SEQ ID NO: 322234 - DNA, 25 bp, Mus musculus
cccagcctggaagtgaacgtgaagc

SEQ ID NO: 322235 - DNA, 25 bp, Mus musculus
cctggaagtgaacgtgaagcaaata

SEQ ID NO: 322236 - DNA, 25 bp, Mus musculus
aacgtgaagcaaatatggcggcggc

SEQ ID NO: 322237 - DNA, 25 bp, Mus musculus
actgtggctattgcgaggcgagaca

SEQ ID NO: 322238 - DNA, 25 bp, Mus musculus
ctgggagatggaaactggagcccat

SEQ ID NO: 322239 - DNA, 25 bp, Mus musculus
ctggagcccatggtgaacctagata

SEQ ID NO: 322240 - DNA, 25 bp, Mus musculus
tgaacctagatacggggaagaagtg

SEQ ID NO: 322241 - DNA, 25 bp, Mus musculus
cgactgtctccggtcacgtgacacg

SEQ ID NO: 322242 - DNA, 25 bp, Mus musculus
ctccggacctttggagggcgactgt

SEQ ID NO: 322243 - DNA, 25 bp, Mus musculus
actctaacaagtgcctgcgcggccg

SEQ ID NO: 322244 - DNA, 25 bp, Mus musculus
aaatggggaacaatgcgagtgagca

SEQ ID NO: 322245 - DNA, 25 bp, Mus musculus
atgctgcgctggaatgaggaagctt

SEQ ID NO: 322246 - DNA, 25 bp, Mus musculus
gcgagtgagcctgtgtcccgaccgc

SEQ ID NO: 322247 - DNA, 25 bp, Mus musculus
ctggaatgaggaagcttggcgccaa

SEQ ID NO: 322248 - DNA, 25 bp, Mus musculus
agtcgcaagcgccaacccaaagttt

SEQ ID NO: 322249 - DNA, 25 bp, Mus musculus
caacccaaagtttgcacggtgcggg

SEQ ID NO: 322250 - DNA, 25 bp, Mus musculus
ccgtgcggctgcaaactttgtgtgc

SEQ ID NO: 322251 - DNA, 25 bp, Mus musculus
tgcgagtgagcaacttgaggaagtc

SEQ ID NO: 322252 - DNA, 25 bp, Mus musculus
gcaacttgaggaagtcattgtgaaa

SEQ ID NO: 322253 - DNA, 25 bp, Mus musculus
tcattgtgaaagaaagctgggaatt

SEQ ID NO: 322254 - DNA, 25 bp, Mus musculus
gctgggaattgctccgcagccaact

SEQ ID NO: 322255 - DNA, 25 bp, Mus musculus
gcagccaacttagcagggcactcta

SEQ ID NO: 322256 - DNA, 25 bp, Mus musculus
ctgcaaactttgtgtgcgcggcccg

SEQ ID NO: 322257 - DNA, 25 bp, Mus musculus
cagccaggccctccagtaaagggag

SEQ ID NO: 322258 - DNA, 25 bp, Mus musculus
cgcgtccggccctgcaaaccggccg

SEQ ID NO: 322259 - DNA, 25 bp, Mus musculus
accagcttctgcacccgcgcgctcg

SEQ ID NO: 322260 - DNA, 25 bp, Mus musculus
agcttgtagcgccgcaccagcttct

SEQ ID NO: 322261 - DNA, 25 bp, Mus musculus
gtggcgatcgccagcttgtagcgcc

SEQ ID NO: 322262 - DNA, 25 bp, Mus musculus
aggccgctgaagctccacaccacca

SEQ ID NO: 322263 - DNA, 25 bp, Mus musculus
aggccctccagtaaagggagcgttg

SEQ ID NO: 322264 - DNA, 25 bp, Mus musculus
agtcacgcaccgctccctcacgcag

SEQ ID NO: 322265 - DNA, 25 bp, Mus musculus
ggccgcctcgacctccgagtcacgc

SEQ ID NO: 322266 - DNA, 25 bp, Mus musculus
accatgtcccgctcatcccttcgcg

SEQ ID NO: 322267 - DNA, 25 bp, Mus musculus
cccgggacggagaccatcccaccat

SEQ ID NO: 322268 - DNA, 25 bp, Mus musculus
caccatcttcctgcccgggacgcgg

SEQ ID NO: 322269 - DNA, 25 bp, Mus musculus
agcaggctgcctgcgccttgctcgc

SEQ ID NO: 322270 - DNA, 25 bp, Mus musculus
cccaccctctcgtgggctgggcgtg

SEQ ID NO: 322271 - DNA, 25 bp, Mus musculus
ccgctgttagccgagcgacacagga

SEQ ID NO: 322272 - DNA, 25 bp, Mus musculus
ggcgccttcacaggctccagccgtc

SEQ ID NO: 322273 - DNA, 25 bp, Mus musculus
acttaagggccacaagcctatcgcg

SEQ ID NO: 322274 - DNA, 25 bp, Mus musculus
ggaggacacttaagggccacaagcc

SEQ ID NO: 322275 - DNA, 25 bp, Mus musculus
ccgagcgacacaggaggacacttaa

SEQ ID NO: 322276 - DNA, 25 bp, Mus musculus
ggccacaagcctatcgcgcatgtcg

SEQ ID NO: 322277 - DNA, 25 bp, Mus musculus
gcatgcgtgctagaccccgctgtta

SEQ ID NO: 322278 - DNA, 25 bp, Mus musculus
accaaggggcatgcgtgctagaccc

SEQ ID NO: 322279 - DNA, 25 bp, Mus musculus
aagtatgaccaaggggcatgcgtgc

SEQ ID NO: 322280 - DNA, 25 bp, Mus musculus
ctgggaaagtatgaccaaggggcat

SEQ ID NO: 322281 - DNA, 25 bp, Mus musculus
cttgcgcaacaacggggctgatggc

SEQ ID NO: 322282 - DNA, 25 bp, Mus musculus
cctgcgcttgcgcaacaacggggct

SEQ ID NO: 322283 - DNA, 25 bp, Mus musculus
caggctccagccgtccctgcgcttg

SEQ ID NO: 322284 - DNA, 25 bp, Mus musculus
cacaggaggacacttaagggccaca

SEQ ID NO: 322285 - DNA, 25 bp, Mus musculus
aaggcggcccaccataagaaatatg

SEQ ID NO: 322286 - DNA, 25 bp, Mus musculus
acgaagcgggcatccaggcactaaa

SEQ ID NO: 322287 - DNA, 25 bp, Mus musculus
gaaatatggctccaacgtccaccgc

SEQ ID NO: 322288 - DNA, 25 bp, Mus musculus
tatgttcctgcagatgggcaccacc

SEQ ID NO: 322289 - DNA, 25 bp, Mus musculus
ggccagcagcctgaacgagaacgta

SEQ ID NO: 322290 - DNA, 25 bp, Mus musculus
cgagaacgtagaccacagtgccctg

SEQ ID NO: 322291 - DNA, 25 bp, Mus musculus
cctgctcaagctgggcaccagtgtg

SEQ ID NO: 322292 - DNA, 25 bp, Mus musculus
cggaagctgttcgaacggagcgtcc

SEQ ID NO: 322293 - DNA, 25 bp, Mus musculus
cgctggacaagctggatgctgacgc

SEQ ID NO: 322294 - DNA, 25 bp, Mus musculus
agccagctcagtgcggtcttcgaga

SEQ ID NO: 322295 - DNA, 25 bp, Mus musculus
aagccgactcgaggaccggccttca

SEQ ID NO: 322296 - DNA, 25 bp, Mus musculus
ggtcaactcgaagctggtcactaag

SEQ ID NO: 322297 - DNA, 25 bp, Mus musculus
ccaaccatgatgaagacggagcctc

SEQ ID NO: 322298 - DNA, 25 bp, Mus musculus
cgtccaccgcatcaaaagtatgttc

SEQ ID NO: 322299 - DNA, 25 bp, Mus musculus
cgtgcgtcctaaggcgggaccgcct

SEQ ID NO: 322300 - DNA, 25 bp, Mus musculus
tggaatggagcgactccagccagcc

SEQ ID NO: 322301 - DNA, 25 bp, Mus musculus
acaacaccctggaatggagcgactc

SEQ ID NO: 322302 - DNA, 25 bp, Mus musculus
acggagcatcctcccgtcaggtttc

SEQ ID NO: 322303 - DNA, 25 bp, Mus musculus
gaggtggcgttcaggttctctctct

SEQ ID NO: 322304 - DNA, 25 bp, Mus musculus
cgctacacaaatcggccggtggcgc

SEQ ID NO: 322305 - DNA, 25 bp, Mus musculus
tagccactgcgacgctacacaaatc

SEQ ID NO: 322306 - DNA, 25 bp, Mus musculus
cgttctttgtctcccgggcgctcgg

SEQ ID NO: 322307 - DNA, 25 bp, Mus musculus
agaagtagcggcaattgggatcccg

SEQ ID NO: 322308 - DNA, 25 bp, Mus musculus
cgcggtccgagaagtagcggcaatt

SEQ ID NO: 322309 - DNA, 25 bp, Mus musculus
tagcgctgagactcccgcggtccga

SEQ ID NO: 322310 - DNA, 25 bp, Mus musculus
gcgcagactccctagcgctgagact

SEQ ID NO: 322311 - DNA, 25 bp, Mus musculus
cccgaacaccatgggcctgaggggt

SEQ ID NO: 322312 - DNA, 25 bp, Mus musculus
cgcttccctgccattcgcgcgcaga

SEQ ID NO: 322313 - DNA, 25 bp, Mus musculus
gctcgcctctacattcgggtccagg

SEQ ID NO: 322314 - DNA, 25 bp, Mus musculus
ccctcttctaggtgaccgacggctg

SEQ ID NO: 322315 - DNA, 25 bp, Mus musculus
ggctgcgctcgcctctacattcggg

SEQ ID NO: 322316 - DNA, 25 bp, Mus musculus
ccgcacagcgaaggtgagctcggta

SEQ ID NO: 322317 - DNA, 25 bp, Mus musculus
cccagccagtggatctttctgcctg

SEQ ID NO: 322318 - DNA, 25 bp, Mus musculus
cgcagtctggatgaggacgaaccgc

SEQ ID NO: 322319 - DNA, 25 bp, Mus musculus
tggatgaggacgaaccgccgccctc

SEQ ID NO: 322320 - DNA, 25 bp, Mus musculus
aacgccgcctcgcatgagggcctgg

SEQ ID NO: 322321 - DNA, 25 bp, Mus musculus
cagcttcgtgcgtcgttaccctcga

SEQ ID NO: 322322 - DNA, 25 bp, Mus musculus
tgcgtcgttaccctcgagcagagcc

SEQ ID NO: 322323 - DNA, 25 bp, Mus musculus
gttaccctcgagcagagccgcacag

SEQ ID NO: 322324 - DNA, 25 bp, Mus musculus
gcgctgcctgccaacgagcatcgag

SEQ ID NO: 322325 - DNA, 25 bp, Mus musculus
tgaccgacggctgcggtagcccgct

SEQ ID NO: 322326 - DNA, 25 bp, Mus musculus
ccaacgagcatcgagcatcagaatc

SEQ ID NO: 322327 - DNA, 25 bp, Mus musculus
tacgccgactccgtaccgaagtcta

SEQ ID NO: 322328 - DNA, 25 bp, Mus musculus
aatagccttgcgcttcgacacgtgg

SEQ ID NO: 322329 - DNA, 25 bp, Mus musculus
ctctgggagaaccaatagccttgcg

SEQ ID NO: 322330 - DNA, 25 bp, Mus musculus
ggcgcgcacaaacaactctgggaga

SEQ ID NO: 322331 - DNA, 25 bp, Mus musculus
cgacgtcgccaatgggcgcgcacaa

SEQ ID NO: 322332 - DNA, 25 bp, Mus musculus
tcagctcggcccagcttagccggga

SEQ ID NO: 322333 - DNA, 25 bp, Mus musculus
cgggcttggatctcgctgctgtccc

SEQ ID NO: 322334 - DNA, 25 bp, Mus musculus
gacgcattcttcaacagcgcccgga

SEQ ID NO: 322335 - DNA, 25 bp, Mus musculus
tgccagggacgcattcttcaacagc

SEQ ID NO: 322336 - DNA, 25 bp, Mus musculus
aagtgctcgatgtacttgggtgccc

SEQ ID NO: 322337 - DNA, 25 bp, Mus musculus
acggggagaacttgctgaagtgctc

SEQ ID NO: 322338 - DNA, 25 bp, Mus musculus
gaaactgcttcatggacaacgggga

SEQ ID NO: 322339 - DNA, 25 bp, Mus musculus
gccttgcgcttcgacacgtggctct

SEQ ID NO: 322340 - DNA, 25 bp, Mus musculus
ccgtaccgaagtctagaaactgctt

SEQ ID NO: 322341 - DNA, 25 bp, Mus musculus
gcaccggtagtcaggcaatttttta

SEQ ID NO: 322342 - DNA, 25 bp, Mus musculus
cgctggacaaaccaggcgttggctc

SEQ ID NO: 322343 - DNA, 25 bp, Mus musculus
ggctgctactggaaaggccgttcaa

SEQ ID NO: 322344 - DNA, 25 bp, Mus musculus
cgccttcggtacaagacggattgga

SEQ ID NO: 322345 - DNA, 25 bp, Mus musculus
cttcttcctaggagcgtcgccttcg

SEQ ID NO: 322346 - DNA, 25 bp, Mus musculus
ccttccagcggagagcttcttccta

SEQ ID NO: 322347 - DNA, 25 bp, Mus musculus
aacggcaagccctcgatcaccagga

SEQ ID NO: 322348 - DNA, 25 bp, Mus musculus
ctcggctaggtggaggatttagaac

SEQ ID NO: 322349 - DNA, 25 bp, Mus musculus
cccttggaggtgttagctctttgga

SEQ ID NO: 322350 - DNA, 25 bp, Mus musculus
tggatctactctcacgttggttcgg

SEQ ID NO: 322351 - DNA, 25 bp, Mus musculus
tagtccgggtcactttcacgtctgc

SEQ ID NO: 322352 - DNA, 25 bp, Mus musculus
caggtagcgctgttgtcgctcagtc

SEQ ID NO: 322353 - DNA, 25 bp, Mus musculus
cgccaggctgacttacaggtagcgc

SEQ ID NO: 322354 - DNA, 25 bp, Mus musculus
cgtctgctccgggtgcttttccaat

SEQ ID NO: 322355 - DNA, 25 bp, Mus musculus
gatatcccacagctgcaggcgcacg

SEQ ID NO: 322356 - DNA, 25 bp, Mus musculus
cacgtagcgcttgatgatgctcgtc

SEQ ID NO: 322357 - DNA, 25 bp, Mus musculus
atgatgctcgtcttacccacgccga

SEQ ID NO: 322358 - DNA, 25 bp, Mus musculus
tcgccgatgaccagcaccttaaaga

SEQ ID NO: 322359 - DNA, 25 bp, Mus musculus
ccttaaagaggtgctctcgggtctc

SEQ ID NO: 322360 - DNA, 25 bp, Mus musculus
tgccacggcctagggaacttcttcc

SEQ ID NO: 322361 - DNA, 25 bp, Mus musculus
ccaaaggccgacctgacagatactc

SEQ ID NO: 322362 - DNA, 25 bp, Mus musculus
gacagatactccgtccgcgcagtca

SEQ ID NO: 322363 - DNA, 25 bp, Mus musculus
gtcacgcgagtcaccggacccggaa

SEQ ID NO: 322364 - DNA, 25 bp, Mus musculus
tccacgccaatggtggcgcggtagt

SEQ ID NO: 322365 - DNA, 25 bp, Mus musculus
aactttgagggcgaagtccacgcca

SEQ ID NO: 322366 - DNA, 25 bp, Mus musculus
tcctgctgtcccagttgagaacttt

SEQ ID NO: 322367 - DNA, 25 bp, Mus musculus
agaagagctggtgcacgtagcgctt

SEQ ID NO: 322368 - DNA, 25 bp, Mus musculus
gcaggcgcacgagcgtcctgctgtc

SEQ ID NO: 322369 - DNA, 25 bp, Mus musculus
cagaagaacagagggcatccagagc

SEQ ID NO: 322370 - DNA, 25 bp, Mus musculus
gagcgggtggcaactcgtcccgcca

SEQ ID NO: 322371 - DNA, 25 bp, Mus musculus
tccagagcgggtggcaactcgtccc

SEQ ID NO: 322372 - DNA, 25 bp, Mus musculus
tcgtcccgccacgagctcgcagcgg

SEQ ID NO: 322373 - DNA, 25 bp, Mus musculus
gggcgccctcttggcagaagaacag

SEQ ID NO: 322374 - DNA, 25 bp, Mus musculus
tagacagacagatagcgttcccctc

SEQ ID NO: 322375 - DNA, 25 bp, Mus musculus
ggcagaagaacagagggcatccaga

SEQ ID NO: 322376 - DNA, 25 bp, Mus musculus
cttgggcgccctcttggcagaagaa

SEQ ID NO: 322377 - DNA, 25 bp, Mus musculus
gggtggcaactcgtcccgccacgag

SEQ ID NO: 322378 - DNA, 25 bp, Mus musculus
gcgccctcttggcagaagaacagag

SEQ ID NO: 322379 - DNA, 25 bp, Mus musculus
cttgcatcctgggaggggaaccggc

SEQ ID NO: 322380 - DNA, 25 bp, Mus musculus
aggggaaccggcagcccaatgccct

SEQ ID NO: 322381 - DNA, 25 bp, Mus musculus
cttggcagaagaacagagggcatcc

SEQ ID NO: 322382 - DNA, 25 bp, Mus musculus
catccagagcgggtggcaactcgtc

SEQ ID NO: 322383 - DNA, 25 bp, Mus musculus
gcttactcgcccaagtcggaatata

SEQ ID NO: 322384 - DNA, 25 bp, Mus musculus
tcctataggcagtacggagcgtacc

SEQ ID NO: 322385 - DNA, 25 bp, Mus musculus
ttcaatctcaatgggctcgcaggca

SEQ ID NO: 322386 - DNA, 25 bp, Mus musculus
ctgaaatctagggaaactcgaggtt

SEQ ID NO: 322387 - DNA, 25 bp, Mus musculus
gagaccgggttagatgacctccaga

SEQ ID NO: 322388 - DNA, 25 bp, Mus musculus
acctccagaggggtgaacgacactc

SEQ ID NO: 322389 - DNA, 25 bp, Mus musculus
gacactccgaagaggcgcgcactgt

SEQ ID NO: 322390 - DNA, 25 bp, Mus musculus
cgccgcggtctcttggagattccag

SEQ ID NO: 322391 - DNA, 25 bp, Mus musculus
accgggagctccttctgagtgatca

SEQ ID NO: 322392 - DNA, 25 bp, Mus musculus
cttgagccggagacgaaagacggtc

SEQ ID NO: 322393 - DNA, 25 bp, Mus musculus
agggcccttcttttggatgccgtca

SEQ ID NO: 322394 - DNA, 25 bp, Mus musculus
agagaaaacgcttgtactgtccttg

SEQ ID NO: 322395 - DNA, 25 bp, Mus musculus
tgggctattacagcgctcctcagca

SEQ ID NO: 322396 - DNA, 25 bp, Mus musculus
atgactactactcgggccagcccta

SEQ ID NO: 322397 - DNA, 25 bp, Mus musculus
ggatctaccccggtcggtcgcgata

SEQ ID NO: 322398 - DNA, 25 bp, Mus musculus
tggcaagtcacaactggatctaccc

SEQ ID NO: 322399 - DNA, 25 bp, Mus musculus
tccacactagttttggcaagtcaca

SEQ ID NO: 322400 - DNA, 25 bp, Mus musculus
gctgcctttttccacactagttttg

SEQ ID NO: 322401 - DNA, 25 bp, Mus musculus
tgccttccggaacagctgccttttt

SEQ ID NO: 322402 - DNA, 25 bp, Mus musculus
gatcaccttccaggtgccttccgga

SEQ ID NO: 322403 - DNA, 25 bp, Mus musculus
gctgaactcgcagagcagatcacct

SEQ ID NO: 322404 - DNA, 25 bp, Mus musculus
tggactgctgaactcgcagagcaga

SEQ ID NO: 322405 - DNA, 25 bp, Mus musculus
aaggaagacagcctggactgctgaa

SEQ ID NO: 322406 - DNA, 25 bp, Mus musculus
taatagcgagcagagcgcgaaggaa

SEQ ID NO: 322407 - DNA, 25 bp, Mus musculus
cagttcgggtaatagcgagcagagc

SEQ ID NO: 322408 - DNA, 25 bp, Mus musculus
tggaccgcgcagttcgggtaatagc

SEQ ID NO: 322409 - DNA, 25 bp, Mus musculus
cttcttggctgcctggaccgcgcag

SEQ ID NO: 322410 - DNA, 25 bp, Mus musculus
aagcgacaacccatgccttcttggc

SEQ ID NO: 322411 - DNA, 25 bp, Mus musculus
aggccaccctctccgacaacccgag

SEQ ID NO: 322412 - DNA, 25 bp, Mus musculus
ggccaagaacggacagaagaaaaca

SEQ ID NO: 322413 - DNA, 25 bp, Mus musculus
agtacacccggcatggcaaccacag

SEQ ID NO: 322414 - DNA, 25 bp, Mus musculus
cggcttagcggcgaacagcagccta

SEQ ID NO: 322415 - DNA, 25 bp, Mus musculus
ttagcggcgaacagcagcctaccgg

SEQ ID NO: 322416 - DNA, 25 bp, Mus musculus
tgccgggaccgcagccaccgaaaag

SEQ ID NO: 322417 - DNA, 25 bp, Mus musculus
agccaccgaaaagcgcgcctttcga

SEQ ID NO: 322418 - DNA, 25 bp, Mus musculus
agcgcgcctttcgaagtgcgcctgc

SEQ ID NO: 322419 - DNA, 25 bp, Mus musculus
tctcggaaggcctgaggtcaccgcc

SEQ ID NO: 322420 - DNA, 25 bp, Mus musculus
aggtcaccgcccaggccttaacgcg

SEQ ID NO: 322421 - DNA, 25 bp, Mus musculus
gcccgcgctctatgagggagattta

SEQ ID NO: 322422 - DNA, 25 bp, Mus musculus
ctatgagggagatttagcccgcgcg

SEQ ID NO: 322423 - DNA, 25 bp, Mus musculus
acaaaaccaaagtacacccggcatg

SEQ ID NO: 322424 - DNA, 25 bp, Mus musculus
caacccgaggccaagaacggacaga

SEQ ID NO: 322425 - DNA, 25 bp, Mus musculus
ccggattggctattccttggtgacc

SEQ ID NO: 322426 - DNA, 25 bp, Mus musculus
cttattcagcgcgtcggaatgcgta

SEQ ID NO: 322427 - DNA, 25 bp, Mus musculus
acttacctgcttcgagctcctgcgg

SEQ ID NO: 322428 - DNA, 25 bp, Mus musculus
gcaagccactcttacacttcagatg

SEQ ID NO: 322429 - DNA, 25 bp, Mus musculus
ttgttggtaaacagacgctggggcc

SEQ ID NO: 322430 - DNA, 25 bp, Mus musculus
agcctcttccggcagagaactcgca

SEQ ID NO: 322431 - DNA, 25 bp, Mus musculus
ttggtgacctcaagctgagcccgcc

SEQ ID NO: 322432 - DNA, 25 bp, Mus musculus
cctcgtgttagcgtgcaccgggaaa

SEQ ID NO: 322433 - DNA, 25 bp, Mus musculus
tcaactccgagttcctggggaatcg

SEQ ID NO: 322434 - DNA, 25 bp, Mus musculus
ctcagtaacgatgttcaaggtgcta

SEQ ID NO: 322435 - DNA, 25 bp, Mus musculus
ctgcgcggtaactagagacgctttg

SEQ ID NO: 322436 - DNA, 25 bp, Mus musculus
tttggagactcagaacctgtgtgcg

SEQ ID NO: 322437 - DNA, 25 bp, Mus musculus
ctgagatggcgccaccaattgttgc

SEQ ID NO: 322438 - DNA, 25 bp, Mus musculus
cttcagatgcctggaaaaatgtctc

SEQ ID NO: 322439 - DNA, 25 bp, Mus musculus
ctgggagtggttctggaccccgcac

SEQ ID NO: 322440 - DNA, 25 bp, Mus musculus
ggagacggcgcccagacagccttgc

SEQ ID NO: 322441 - DNA, 25 bp, Mus musculus
ggagctgaccggctcaaacgcggcc

SEQ ID NO: 322442 - DNA, 25 bp, Mus musculus
gtaatttccgcagggagctgaccgg

SEQ ID NO: 322443 - DNA, 25 bp, Mus musculus
ctgtaatttccgcagggagctgacc

SEQ ID NO: 322444 - DNA, 25 bp, Mus musculus
cagtgccgagcgcccctgtaatttc

SEQ ID NO: 322445 - DNA, 25 bp, Mus musculus
gaaccggctgggagtggttctggac

SEQ ID NO: 322446 - DNA, 25 bp, Mus musculus
aaacgcctccaaccagcgggtgctg

SEQ ID NO: 322447 - DNA, 25 bp, Mus musculus
ttaaacgcctccaaccagcgggtgc

SEQ ID NO: 322448 - DNA, 25 bp, Mus musculus
gctgctttcaatttaaacgcctcca

SEQ ID NO: 322449 - DNA, 25 bp, Mus musculus
cccaaagctgctttcaatttaaacg

SEQ ID NO: 322450 - DNA, 25 bp, Mus musculus
cgcagacaatggggtcgctgtgccc

SEQ ID NO: 322451 - DNA, 25 bp, Mus musculus
ccttgcccgggtcgtgggagcgcca

SEQ ID NO: 322452 - DNA, 25 bp, Mus musculus
gcgccgccgtgcttaccgcaggatt

SEQ ID NO: 322453 - DNA, 25 bp, Mus musculus
gtggacccaacgctcctggcctcgc

SEQ ID NO: 322454 - DNA, 25 bp, Mus musculus
gggactgggactcccgcacgtgcca

SEQ ID NO: 322455 - DNA, 25 bp, Mus musculus
cgggccaggactaggttagggactg

SEQ ID NO: 322456 - DNA, 25 bp, Mus musculus
attagaggtcgctcccctcgggacg

SEQ ID NO: 322457 - DNA, 25 bp, Mus musculus
tgcctaatggttttccgaggagccc

SEQ ID NO: 322458 - DNA, 25 bp, Mus musculus
gtcccgctgcctaatggttttccga

SEQ ID NO: 322459 - DNA, 25 bp, Mus musculus
cgcggtcccgctgcctaatggtttt

SEQ ID NO: 322460 - DNA, 25 bp, Mus musculus
ctgcggtagatatccggcgacgatg

SEQ ID NO: 322461 - DNA, 25 bp, Mus musculus
cagacagtcgctgcggtagatatcc

SEQ ID NO: 322462 - DNA, 25 bp, Mus musculus
tcccgggttcgagcagacagtcgct

SEQ ID NO: 322463 - DNA, 25 bp, Mus musculus
ccagccttgcggtcccgggttcgag

SEQ ID NO: 322464 - DNA, 25 bp, Mus musculus
ctagaggccagccttgcggtcccgg

SEQ ID NO: 322465 - DNA, 25 bp, Mus musculus
gacaggcacggcaggctagaggcca

SEQ ID NO: 322466 - DNA, 25 bp, Mus musculus
gggactcccgcacgtgccaagagcg

SEQ ID NO: 322467 - DNA, 25 bp, Mus musculus
cgcggcatctagtgtttcccttttc

SEQ ID NO: 322468 - DNA, 25 bp, Mus musculus
cacgtgcagttgttccggagctcaa

SEQ ID NO: 322469 - DNA, 25 bp, Mus musculus
aatcctggccaaaccgcagccttta

SEQ ID NO: 322470 - DNA, 25 bp, Mus musculus
catctttttcttctcggctccgcaa

SEQ ID NO: 322471 - DNA, 25 bp, Mus musculus
gcgctagtaccgaagtcccatcctg

SEQ ID NO: 322472 - DNA, 25 bp, Mus musculus
cgggtccgacctcaaccggaatctg

SEQ ID NO: 322473 - DNA, 25 bp, Mus musculus
ccggtggccttgtcatccatctggc

SEQ ID NO: 322474 - DNA, 25 bp, Mus musculus
cttgatctaggaggtgaacgaaaca

SEQ ID NO: 322475 - DNA, 25 bp, Mus musculus
ctcaacattgcagcgaaggggactc

SEQ ID NO: 322476 - DNA, 25 bp, Mus musculus
cttccgcaagtgtctccacggggca

SEQ ID NO: 322477 - DNA, 25 bp, Mus musculus
tcaatctgccctcctgagtcggtga

SEQ ID NO: 322478 - DNA, 25 bp, Mus musculus
caagagccgaatgcagacccaggtt

SEQ ID NO: 322479 - DNA, 25 bp, Mus musculus
tgagtcggtcaaaagcttccacgtg

SEQ ID NO: 322480 - DNA, 25 bp, Mus musculus
cttaccctacgaggacagagcggtc

SEQ ID NO: 322481 - DNA, 25 bp, Mus musculus
tggcggcctctgtagctgtcccaaa

SEQ ID NO: 322482 - DNA, 25 bp, Mus musculus
agagcattcgccacagccagtcgga

SEQ ID NO: 322483 - DNA, 25 bp, Mus musculus
ggcggcgtcaccatccaatcaatac

SEQ ID NO: 322484 - DNA, 25 bp, Mus musculus
ttctagacatttccgcgaccaatta

SEQ ID NO: 322485 - DNA, 25 bp, Mus musculus
agaacgcctccgatccgggcaagca

SEQ ID NO: 322486 - DNA, 25 bp, Mus musculus
gcgggaatagttacaggcataggcc

SEQ ID NO: 322487 - DNA, 25 bp, Mus musculus
cgggcccacatttttctgtctggta

SEQ ID NO: 322488 - DNA, 25 bp, Mus musculus
ttggaacccaagcacgacgaggcgt

SEQ ID NO: 322489 - DNA, 25 bp, Mus musculus
tttctcaccttccttcgcggcattg

SEQ ID NO: 322490 - DNA, 25 bp, Mus musculus
cagactgcaaagctgggccaataaa

SEQ ID NO: 322491 - DNA, 25 bp, Mus musculus
tgcggacgatcccaagtgcctccta

SEQ ID NO: 322492 - DNA, 25 bp, Mus musculus
cgtctagagccttctgcgcaagcgc

SEQ ID NO: 322493 - DNA, 25 bp, Mus musculus
ggctggaagcgcctattccttaact

SEQ ID NO: 322494 - DNA, 25 bp, Mus musculus
gtggccaaccgcgtcacgttactca

SEQ ID NO: 322495 - DNA, 25 bp, Mus musculus
tctgcagccactcagggctacggtc

SEQ ID NO: 322496 - DNA, 25 bp, Mus musculus
cccgtagggcagataagtagcggcc

SEQ ID NO: 322497 - DNA, 25 bp, Mus musculus
tcggtctgcagccactcagggctac

SEQ ID NO: 322498 - DNA, 25 bp, Mus musculus
tccgcgcccgtagggcagataagta

SEQ ID NO: 322499 - DNA, 25 bp, Mus musculus
ccttccagctgcagcagcctcacca

SEQ ID NO: 322500 - DNA, 25 bp, Mus musculus
aaaaaggggcgctcagagttcgcga

SEQ ID NO: 322501 - DNA, 25 bp, Mus musculus
agcgaaggcgagcagctgcgaacct

SEQ ID NO: 322502 - DNA, 25 bp, Mus musculus
agctgcgaacctgcggtgcaactcc

SEQ ID NO: 322503 - DNA, 25 bp, Mus musculus
aacctgcggtgcaactccgggacgg

SEQ ID NO: 322504 - DNA, 25 bp, Mus musculus
gacctggcagatggaagctagcttt

SEQ ID NO: 322505 - DNA, 25 bp, Mus musculus
cctggcagatggaagctagctttgg

SEQ ID NO: 322506 - DNA, 25 bp, Mus musculus
tgctagagtgcgtgcaaggagtgtt

SEQ ID NO: 322507 - DNA, 25 bp, Mus musculus
tcgagggcttcactgggagccagaa

SEQ ID NO: 322508 - DNA, 25 bp, Mus musculus
gcttcactgggagccagaaccggtg

SEQ ID NO: 322509 - DNA, 25 bp, Mus musculus
ggcggcactacttggcgcgcccgcc

SEQ ID NO: 322510 - DNA, 25 bp, Mus musculus
gctccttgacgacggcgctatgtgt

SEQ ID NO: 322511 - DNA, 25 bp, Mus musculus
ttgacgacggcgctatgtgttcgca

SEQ ID NO: 322512 - DNA, 25 bp, Mus musculus
acggcgctatgtgttcgcacggccg

SEQ ID NO: 322513 - DNA, 25 bp, Mus musculus
ctatgtgttcgcacggccgtcgctc

SEQ ID NO: 322514 - DNA, 25 bp, Mus musculus
acggccgtcgctcctgacatgcgga

SEQ ID NO: 322515 - DNA, 25 bp, Mus musculus
cctgacatgcggacctccgggagtt

SEQ ID NO: 322516 - DNA, 25 bp, Mus musculus
acctccgggagttggctctgcgacc

SEQ ID NO: 322517 - DNA, 25 bp, Mus musculus
cagacggagcggcagaagcagcctg

SEQ ID NO: 322518 - DNA, 25 bp, Mus musculus
tctcgaggccgcagcgcagtccgtg

SEQ ID NO: 322519 - DNA, 25 bp, Mus musculus
ggccgcgcgctcattcctgtcagtt

SEQ ID NO: 322520 - DNA, 25 bp, Mus musculus
gcgcgctcattcctgtcagtttgcc

SEQ ID NO: 322521 - DNA, 25 bp, Mus musculus
tcatccgagccgtgtcccaccgcga

SEQ ID NO: 322522 - DNA, 25 bp, Mus musculus
cctcggcggccacctctcgaggccg

SEQ ID NO: 322523 - DNA, 25 bp, Mus musculus
catctgtctattttcgctctgcgga

SEQ ID NO: 322524 - DNA, 25 bp, Mus musculus
tacctgctctgaacggatcttcggc

SEQ ID NO: 322525 - DNA, 25 bp, Mus musculus
gcacgcagctcctatgaggtccctg

SEQ ID NO: 322526 - DNA, 25 bp, Mus musculus
ctctgagctggcatatctggaggta

SEQ ID NO: 322527 - DNA, 25 bp, Mus musculus
ggcatttccctctcggaagctctga

SEQ ID NO: 322528 - DNA, 25 bp, Mus musculus
tctttcctagaacgctcctgccggg

SEQ ID NO: 322529 - DNA, 25 bp, Mus musculus
acctcgatatggctggctttcctgg

SEQ ID NO: 322530 - DNA, 25 bp, Mus musculus
gctacggctctatgaagcgttcttg

SEQ ID NO: 322531 - DNA, 25 bp, Mus musculus
ctctgcggagccaattgataacatc

SEQ ID NO: 322532 - DNA, 25 bp, Mus musculus
ccgctagtagatccctggtgcctga

SEQ ID NO: 322533 - DNA, 25 bp, Mus musculus
agcgttcttggcgttaggacccagc

SEQ ID NO: 322534 - DNA, 25 bp, Mus musculus
ggccaccaggaatggagccaagatc

SEQ ID NO: 322535 - DNA, 25 bp, Mus musculus
cgagctccagcttgtagatgtcctc

SEQ ID NO: 322536 - DNA, 25 bp, Mus musculus
ctcggcgttgcctgatcggaaaaac

SEQ ID NO: 322537 - DNA, 25 bp, Mus musculus
cccgcctctttccactctggctccg

SEQ ID NO: 322538 - DNA, 25 bp, Mus musculus
ggagctggagagtcttgagcgggac

SEQ ID NO: 322539 - DNA, 25 bp, Mus musculus
tgctgacgacaggacgcccaggccg

SEQ ID NO: 322540 - DNA, 25 bp, Mus musculus
acgtgctgacgacaggacgcccagg

SEQ ID NO: 322541 - DNA, 25 bp, Mus musculus
gtcgacgtgctgacgacaggacgcc

SEQ ID NO: 322542 - DNA, 25 bp, Mus musculus
tacgcgctcgctgcgtcgacgtgct

SEQ ID NO: 322543 - DNA, 25 bp, Mus musculus
taggcggagtcttaaaagaggagga

SEQ ID NO: 322544 - DNA, 25 bp, Mus musculus
cactagggaaggtaggcggagtctt

SEQ ID NO: 322545 - DNA, 25 bp, Mus musculus
cgacgcttgcgcactagggaaggta

SEQ ID NO: 322546 - DNA, 25 bp, Mus musculus
ctcgcgacgcttgcgcactagggaa

SEQ ID NO: 322547 - DNA, 25 bp, Mus musculus
acctcgcgacgcttgcgcactaggg

SEQ ID NO: 322548 - DNA, 25 bp, Mus musculus
tggctccgccttccgcccaaattcc

SEQ ID NO: 322549 - DNA, 25 bp, Mus musculus
tcagcgcgaacttctgcgcgctgca

SEQ ID NO: 322550 - DNA, 25 bp, Mus musculus
attcccgggccctggcaccacctcg

SEQ ID NO: 322551 - DNA, 25 bp, Mus musculus
ggctcggctctcacccagatgtgct

SEQ ID NO: 322552 - DNA, 25 bp, Mus musculus
ccagggcccacagttcgggattctc

SEQ ID NO: 322553 - DNA, 25 bp, Mus musculus
cccagaggtcaaagaagaataccgc

SEQ ID NO: 322554 - DNA, 25 bp, Mus musculus
cgcgtcctgggatgctgctacgaga

SEQ ID NO: 322555 - DNA, 25 bp, Mus musculus
tgctacgagaggtcgggtaatcctt

SEQ ID NO: 322556 - DNA, 25 bp, Mus musculus
ggtaatccttggctactcagcttgg

SEQ ID NO: 322557 - DNA, 25 bp, Mus musculus
aaagtttcagggctccgcagcttcc

SEQ ID NO: 322558 - DNA, 25 bp, Mus musculus
tagaggctgccctgcactaggaaca

SEQ ID NO: 322559 - DNA, 25 bp, Mus musculus
taggaacacgaagcagcaacgggtc

SEQ ID NO: 322560 - DNA, 25 bp, Mus musculus
gggtcagttgcatcttcctcctttg

SEQ ID NO: 322561 - DNA, 25 bp, Mus musculus
agtcccagatgtgcgcccggagcgt

SEQ ID NO: 322562 - DNA, 25 bp, Mus musculus
agcggtgactctgccgctccagaca

SEQ ID NO: 322563 - DNA, 25 bp, Mus musculus
ccggcttgtttccagaggctcggct

SEQ ID NO: 322564 - DNA, 25 bp, Mus musculus
ccgcggaccactcaccagatagagg

SEQ ID NO: 322565 - DNA, 25 bp, Mus musculus
tgtcctggcaggagaacacgagtcc

SEQ ID NO: 322566 - DNA, 25 bp, Mus musculus
gagaacgtaacacctgcggacaaca

SEQ ID NO: 322567 - DNA, 25 bp, Mus musculus
ggcgctcaccacgtcagagaacgta

SEQ ID NO: 322568 - DNA, 25 bp, Mus musculus
agcggacatactctgcaggcccagg

SEQ ID NO: 322569 - DNA, 25 bp, Mus musculus
tgcctccacacagggagcggacata

SEQ ID NO: 322570 - DNA, 25 bp, Mus musculus
tcagcggcagaacttagtcacaagg

SEQ ID NO: 322571 - DNA, 25 bp, Mus musculus
agtctcctcgtcctggtagtagcca

SEQ ID NO: 322572 - DNA, 25 bp, Mus musculus
cacacacacggggaagcatcagcgg

SEQ ID NO: 322573 - DNA, 25 bp, Mus musculus
acactgtgttctgtttgtcctggca

SEQ ID NO: 322574 - DNA, 25 bp, Mus musculus
catctgagtatgtgccctctgggca

SEQ ID NO: 322575 - DNA, 25 bp, Mus musculus
gtgtcctcgcacaccgtgcagggta

SEQ ID NO: 322576 - DNA, 25 bp, Mus musculus
gcgtgcactcgcgtaactggcgctc

SEQ ID NO: 322577 - DNA, 25 bp, Mus musculus
ggtccacgtggttggcttcatctga

SEQ ID NO: 322578 - DNA, 25 bp, Mus musculus
agcatcggcacacggcatcgtctgc

SEQ ID NO: 322579 - DNA, 25 bp, Mus musculus
tgcagatttcgggaggtgaaccctt

SEQ ID NO: 322580 - DNA, 25 bp, Mus musculus
aaccggcacagcgaactagctccta

SEQ ID NO: 322581 - DNA, 25 bp, Mus musculus
tgttacatgcgccaacactggccca

SEQ ID NO: 322582 - DNA, 25 bp, Mus musculus
acgcgccaacatacgtgttacatgc

SEQ ID NO: 322583 - DNA, 25 bp, Mus musculus
tgacacgcagcaacacgggccaaca

SEQ ID NO: 322584 - DNA, 25 bp, Mus musculus
gcaagcaagcgagccgacagccagc

SEQ ID NO: 322585 - DNA, 25 bp, Mus musculus
accgacatgcggcaacatgcgctga

SEQ ID NO: 322586 - DNA, 25 bp, Mus musculus
caccacttggaccattgcagatttc

SEQ ID NO: 322587 - DNA, 25 bp, Mus musculus
ccgtgccgctcagagacgaatgatc

SEQ ID NO: 322588 - DNA, 25 bp, Mus musculus
cggagcccacctgcgtacctggaga

SEQ ID NO: 322589 - DNA, 25 bp, Mus musculus
tagcacagacttcgccacacggggt

SEQ ID NO: 322590 - DNA, 25 bp, Mus musculus
gcctacggctcagaaaaagggctct

SEQ ID NO: 322591 - DNA, 25 bp, Mus musculus
ctagctcctaaacgaaccgacaggg

SEQ ID NO: 322592 - DNA, 25 bp, Mus musculus
agcccgaggccattcgtgctcgcga

SEQ ID NO: 322593 - DNA, 25 bp, Mus musculus
gacgtctgaatgacaaagtgcctcc

SEQ ID NO: 322594 - DNA, 25 bp, Mus musculus
gagcattagccagccgggcggctcc

SEQ ID NO: 322595 - DNA, 25 bp, Mus musculus
tccctattaggagcattagccagcc

SEQ ID NO: 322596 - DNA, 25 bp, Mus musculus
ctacgctgctgcatccctattagga

SEQ ID NO: 322597 - DNA, 25 bp, Mus musculus
catttgttgcctacgctgctgcatc

SEQ ID NO: 322598 - DNA, 25 bp, Mus musculus
tgctgcccatttgttgcctacgctg

SEQ ID NO: 322599 - DNA, 25 bp, Mus musculus
cgcagccgcttcatcacccacccac

SEQ ID NO: 322600 - DNA, 25 bp, Mus musculus
aaagtgcctccattaccggcgcggc

SEQ ID NO: 322601 - DNA, 25 bp, Mus musculus
cggccggccagcagactctggttgc

SEQ ID NO: 322602 - DNA, 25 bp, Mus musculus
actctggttgcgctctggtttcaga

SEQ ID NO: 322603 - DNA, 25 bp, Mus musculus
tctggtttcagaactctcgcagcgg

SEQ ID NO: 322604 - DNA, 25 bp, Mus musculus
cggctccggttacagacgtctgaat

SEQ ID NO: 322605 - DNA, 25 bp, Mus musculus
cggtccgcggcggaacacagaaccg

SEQ ID NO: 322606 - DNA, 25 bp, Mus musculus
ccgacgctcatgctgcccatttgtt

SEQ ID NO: 322607 - DNA, 25 bp, Mus musculus
atgcccagacgcaattcccggactg

SEQ ID NO: 322608 - DNA, 25 bp, Mus musculus
ttgccatagtgaagtgagcgctctc

SEQ ID NO: 322609 - DNA, 25 bp, Mus musculus
tggcggcttaacttagaagggactc

SEQ ID NO: 322610 - DNA, 25 bp, Mus musculus
tgtgcgctgccggaaccatcacagc

SEQ ID NO: 322611 - DNA, 25 bp, Mus musculus
catcacagccttgagagtcccagcg

SEQ ID NO: 322612 - DNA, 25 bp, Mus musculus
tccgggtccactgagttgcttcaaa

SEQ ID NO: 322613 - DNA, 25 bp, Mus musculus
tttgtcaaggaactaccctagaagc

SEQ ID NO: 322614 - DNA, 25 bp, Mus musculus
gaacccacgcgggaaacgtctgtga

SEQ ID NO: 322615 - DNA, 25 bp, Mus musculus
ccctagaagcggatttgccatagtg

SEQ ID NO: 322616 - DNA, 25 bp, Mus musculus
gagcgctctcttccctgcctgggat

SEQ ID NO: 322617 - DNA, 25 bp, Mus musculus
ggccgctagaaagagcgctagaacc

SEQ ID NO: 322618 - DNA, 25 bp, Mus musculus
aacgtctgtgactgggctgtcctca

SEQ ID NO: 322619 - DNA, 25 bp, Mus musculus
ggctgtcctcatcgcatcgtccttg

SEQ ID NO: 322620 - DNA, 25 bp, Mus musculus
catcgtccttgagtagacagacagg

SEQ ID NO: 322621 - DNA, 25 bp, Mus musculus
cgcctcgtccctgatctcccgagcc

SEQ ID NO: 322622 - DNA, 25 bp, Mus musculus
ctgtggccaggcacgggcgggttgc

SEQ ID NO: 322623 - DNA, 25 bp, Mus musculus
ctctgcccacacacgatcccagctc

SEQ ID NO: 322624 - DNA, 25 bp, Mus musculus
tggctctgcccacacacgatcccag

SEQ ID NO: 322625 - DNA, 25 bp, Mus musculus
agagctggctctgcccacacacgat

SEQ ID NO: 322626 - DNA, 25 bp, Mus musculus
gtccaggccgccagagctggctctg

SEQ ID NO: 322627 - DNA, 25 bp, Mus musculus
ggtccaggccgccagagctggctct

SEQ ID NO: 322628 - DNA, 25 bp, Mus musculus
cctccaggaagcccgccgggtccag

SEQ ID NO: 322629 - DNA, 25 bp, Mus musculus
gcttcaccaacgggtgctgagctcc

SEQ ID NO: 322630 - DNA, 25 bp, Mus musculus
gcgggttgcggagggcacacaaaga

SEQ ID NO: 322631 - DNA, 25 bp, Mus musculus
gcgcttcaccaacgggtgctgagct

SEQ ID NO: 322632 - DNA, 25 bp, Mus musculus
ctgatctcccgagccccggtccttt

SEQ ID NO: 322633 - DNA, 25 bp, Mus musculus
ggcacacaaagacgcgggctgcccc

SEQ ID NO: 322634 - DNA, 25 bp, Mus musculus
cgcagccctgagcatcgcagccggg

SEQ ID NO: 322635 - DNA, 25 bp, Mus musculus
ctcacattgtggcaggagggagaaa

SEQ ID NO: 322636 - DNA, 25 bp, Mus musculus
cttcgcgcacgacatccctacagca

SEQ ID NO: 322637 - DNA, 25 bp, Mus musculus
tcggctgagcgctcacattgtggca

SEQ ID NO: 322638 - DNA, 25 bp, Mus musculus
atctgctcggctgagcgctcacatt

SEQ ID NO: 322639 - DNA, 25 bp, Mus musculus
agccggcggttatctgctcggctga

SEQ ID NO: 322640 - DNA, 25 bp, Mus musculus
acgactttacctgggcgctcgggag

SEQ ID NO: 322641 - DNA, 25 bp, Mus musculus
atgcgcagcccacgactttacctgg

SEQ ID NO: 322642 - DNA, 25 bp, Mus musculus
ccacgactttacctgggcgctcggg

SEQ ID NO: 322643 - DNA, 25 bp, Mus musculus
ctgcagttttgcagcgagtgggttc

SEQ ID NO: 322644 - DNA, 25 bp, Mus musculus
cgcgtctgccgctctcagcttggcc

SEQ ID NO: 322645 - DNA, 25 bp, Mus musculus
cctggcagccgcgtttcctctgcgc

SEQ ID NO: 322646 - DNA, 25 bp, Mus musculus
tctgaggatcggcccagagcgcaga

SEQ ID NO: 322647 - DNA, 25 bp, Mus musculus
agaaaaggtgcgcccaggccgagcc

SEQ ID NO: 322648 - DNA, 25 bp, Mus musculus
tttgcagcgagtgggttcgcctcga

SEQ ID NO: 322649 - DNA, 25 bp, Mus musculus
tcgttgcctacccaagagacgaggg

SEQ ID NO: 322650 - DNA, 25 bp, Mus musculus
acatggcgccttccgaggcgtgacc

SEQ ID NO: 322651 - DNA, 25 bp, Mus musculus
tgggtggaggtcgttgcctacccaa

SEQ ID NO: 322652 - DNA, 25 bp, Mus musculus
aggtcgttgcctacccaagagacga

SEQ ID NO: 322653 - DNA, 25 bp, Mus musculus
gatccagggcccttctcggacaagc

SEQ ID NO: 322654 - DNA, 25 bp, Mus musculus
tgcctacccaagagacgagggtccc

SEQ ID NO: 322655 - DNA, 25 bp, Mus musculus
agagacgagggtccccgccacggat

SEQ ID NO: 322656 - DNA, 25 bp, Mus musculus
tcggacaagccacgctcagcactcg

SEQ ID NO: 322657 - DNA, 25 bp, Mus musculus
ccattgaggccaccgccggaacgcc

SEQ ID NO: 322658 - DNA, 25 bp, Mus musculus
aacgcccagggaagccgcggcacgt

SEQ ID NO: 322659 - DNA, 25 bp, Mus musculus
ccgcgtctgccgctgtctcggagga

SEQ ID NO: 322660 - DNA, 25 bp, Mus musculus
gtctgccgctgtctcggaggagccc

SEQ ID NO: 322661 - DNA, 25 bp, Mus musculus
ggaggtcgttgcctacccaagagac

SEQ ID NO: 322662 - DNA, 25 bp, Mus musculus
cactcgcccgcccattgaggccacc

SEQ ID NO: 322663 - DNA, 25 bp, Mus musculus
actggggttccgatccagctgtttc

SEQ ID NO: 322664 - DNA, 25 bp, Mus musculus
atccagctgtttcagaggggccttc

SEQ ID NO: 322665 - DNA, 25 bp, Mus musculus
cccggagccggcagtgagagcccaa

SEQ ID NO: 322666 - DNA, 25 bp, Mus musculus
ggggcagcagctaagtgacaaaaac

SEQ ID NO: 322667 - DNA, 25 bp, Mus musculus
ggggtccttccatcacttccataaa

SEQ ID NO: 322668 - DNA, 25 bp, Mus musculus
ctctcctcgcgagagggagctctgc

SEQ ID NO: 322669 - DNA, 25 bp, Mus musculus
tttcagaggggccttcgctagccca

SEQ ID NO: 322670 - DNA, 25 bp, Mus musculus
tgagagcccaagagcgacagccgcg

SEQ ID NO: 322671 - DNA, 25 bp, Mus musculus
tcgcagaacccggagccggcagtga

SEQ ID NO: 322672 - DNA, 25 bp, Mus musculus
ctcacaaggttgaggggtccttcca

SEQ ID NO: 322673 - DNA, 25 bp, Mus musculus
gcccgcgaccactcacaaggttgag

SEQ ID NO: 322674 - DNA, 25 bp, Mus musculus
gcggtcccagcagggcagatgccac

SEQ ID NO: 322675 - DNA, 25 bp, Mus musculus
cttcgctagcccagctgcgagggca

SEQ ID NO: 322676 - DNA, 25 bp, Mus musculus
agctctgctagacttcggcggcggc

SEQ ID NO: 322677 - DNA, 25 bp, Mus musculus
ttttccatcggcaagcccgagtacc

SEQ ID NO: 322678 - DNA, 25 bp, Mus musculus
atccacagtccctcggggctggagg

SEQ ID NO: 322679 - DNA, 25 bp, Mus musculus
gagcagaagcacatcatccacagtc

SEQ ID NO: 322680 - DNA, 25 bp, Mus musculus
agggacggagcagaagcacatcatc

SEQ ID NO: 322681 - DNA, 25 bp, Mus musculus
ccgcacccacgctcctcggacggga

SEQ ID NO: 322682 - DNA, 25 bp, Mus musculus
gtgtgacactgactcacgcacgtgc

SEQ ID NO: 322683 - DNA, 25 bp, Mus musculus
aggcgggcagtgtgacactgactca

SEQ ID NO: 322684 - DNA, 25 bp, Mus musculus
actccgagtttaggcggtgctggat

SEQ ID NO: 322685 - DNA, 25 bp, Mus musculus
aggactcggcaggatgccgcgactc

SEQ ID NO: 322686 - DNA, 25 bp, Mus musculus
tgggagagcttttccatcggcaagc

SEQ ID NO: 322687 - DNA, 25 bp, Mus musculus
tccaactccgagtttaggcggtgct

SEQ ID NO: 322688 - DNA, 25 bp, Mus musculus
ttcgtgagccggagctcagaaatcc

SEQ ID NO: 322689 - DNA, 25 bp, Mus musculus
ctgtcccgcgacaaggagggaagcc

SEQ ID NO: 322690 - DNA, 25 bp, Mus musculus
atcatccacagtccctcggggctgg

SEQ ID NO: 322691 - DNA, 25 bp, Mus musculus
gccacctatcgcgagggctactaca

SEQ ID NO: 322692 - DNA, 25 bp, Mus musculus
tcgtggacgagaacagcgacgactc

SEQ ID NO: 322693 - DNA, 25 bp, Mus musculus
cgagtctttaagtacctgggtgagc

SEQ ID NO: 322694 - DNA, 25 bp, Mus musculus
catgggcgatttgttgcagttcata

SEQ ID NO: 322695 - DNA, 25 bp, Mus musculus
cagggctcctgcttcgaggttattc

SEQ ID NO: 322696 - DNA, 25 bp, Mus musculus
atttcggatgccaacaccttcggtg

SEQ ID NO: 322697 - DNA, 25 bp, Mus musculus
gtgccgctggccaccacagtttatt

SEQ ID NO: 322698 - DNA, 25 bp, Mus musculus
tgcccggccaacatgtgcaagcaca

SEQ ID NO: 322699 - DNA, 25 bp, Mus musculus
aggtgctcagcgaatacctgcgtga

SEQ ID NO: 322700 - DNA, 25 bp, Mus musculus
gcgtgcacttcgagcgcctcttcta

SEQ ID NO: 322701 - DNA, 25 bp, Mus musculus
cctcttctacgtgggtgatggtgca

SEQ ID NO: 322702 - DNA, 25 bp, Mus musculus
tgcgccaacatctgcaacaggtgct

SEQ ID NO: 322703 - DNA, 25 bp, Mus musculus
tgtgttgaagaccatcgcctgccag

SEQ ID NO: 322704 - DNA, 25 bp, Mus musculus
aaacagccgccgatgtgcgccaaca

SEQ ID NO: 322705 - DNA, 25 bp, Mus musculus
gcgcgttctgcacagcagccaatca

SEQ ID NO: 322706 - DNA, 25 bp, Mus musculus
gccttctcaagccacatgacgttgg

SEQ ID NO: 322707 - DNA, 25 bp, Mus musculus
tgcagcggtactcagacaggaaagc

SEQ ID NO: 322708 - DNA, 25 bp, Mus musculus
gggcaaccttttctaagcttcgcta

SEQ ID NO: 322709 - DNA, 25 bp, Mus musculus
ggagggaagctgaacgtccattcta

SEQ ID NO: 322710 - DNA, 25 bp, Mus musculus
gtccattctacaggtcagtgcattc

SEQ ID NO: 322711 - DNA, 25 bp, Mus musculus
tccctcctgggtaaagttatgttca

SEQ ID NO: 322712 - DNA, 25 bp, Mus musculus
cccaggctgttcctgaaatgtaatc

SEQ ID NO: 322713 - DNA, 25 bp, Mus musculus
tcttccggtgatcctccaagggtcc

SEQ ID NO: 322714 - DNA, 25 bp, Mus musculus
cctgggctttctacttgttttctgc

SEQ ID NO: 322715 - DNA, 25 bp, Mus musculus
acgtggtggcacagccgttcaaacc

SEQ ID NO: 322716 - DNA, 25 bp, Mus musculus
tgctccgcgctatgcaaattatctg

SEQ ID NO: 322717 - DNA, 25 bp, Mus musculus
agcttcgctacacttggcttgggcc

SEQ ID NO: 322718 - DNA, 25 bp, Mus musculus
ttggcgcttccaattcagcacttcc

SEQ ID NO: 322719 - DNA, 25 bp, Mus musculus
acctggaagtcatcgcagctcgctc

SEQ ID NO: 322720 - DNA, 25 bp, Mus musculus
actatttaagttggtccactgtggc

SEQ ID NO: 322721 - DNA, 25 bp, Mus musculus
cactgtgccgggagatccttgtcac

SEQ ID NO: 322722 - DNA, 25 bp, Mus musculus
gagatccttgtcacccacgcgaaga

SEQ ID NO: 322723 - DNA, 25 bp, Mus musculus
cccagggacactcactacctggaag

SEQ ID NO: 322724 - DNA, 25 bp, Mus musculus
tgtctagccaggaaggcacgcactg

SEQ ID NO: 322725 - DNA, 25 bp, Mus musculus
acttctgcagactgcctaccgcagg

SEQ ID NO: 322726 - DNA, 25 bp, Mus musculus
cctaccgcaggtctggacgcgagca

SEQ ID NO: 322727 - DNA, 25 bp, Mus musculus
ctccaagtcggattttcccatggga

SEQ ID NO: 322728 - DNA, 25 bp, Mus musculus
tggaccttgcctcgcgtccaggatg

SEQ ID NO: 322729 - DNA, 25 bp, Mus musculus
ccaggatgtgttccaacggttttga

SEQ ID NO: 322730 - DNA, 25 bp, Mus musculus
tacatgatccctccggtgaccaacg

SEQ ID NO: 322731 - DNA, 25 bp, Mus musculus
ccaggagcctatgtcccggtacatg

SEQ ID NO: 322732 - DNA, 25 bp, Mus musculus
cgagcaggaatgagctgcgagtccc

SEQ ID NO: 322733 - DNA, 25 bp, Mus musculus
tccccgtgctcagggccgtgactga

SEQ ID NO: 322734 - DNA, 25 bp, Mus musculus
gaggcggcaatcctaagagacaccg

SEQ ID NO: 322735 - DNA, 25 bp, Mus musculus
cctgggtgggctgctgcactgcaca

SEQ ID NO: 322736 - DNA, 25 bp, Mus musculus
ctggaggcggcaatcctaagagaca

SEQ ID NO: 322737 - DNA, 25 bp, Mus musculus
ctggggaggagaaaatggccctgga

SEQ ID NO: 322738 - DNA, 25 bp, Mus musculus
ctgcaaacatttaagggggagccgg

SEQ ID NO: 322739 - DNA, 25 bp, Mus musculus
tctagaatgttcacgcaccaaggcg

SEQ ID NO: 322740 - DNA, 25 bp, Mus musculus
ccctgccacagtctagaatgttcac

SEQ ID NO: 322741 - DNA, 25 bp, Mus musculus
tcccgagttctttagtaaatccaga

SEQ ID NO: 322742 - DNA, 25 bp, Mus musculus
tccctctgcagagccaccggccgaa

SEQ ID NO: 322743 - DNA, 25 bp, Mus musculus
ggactttgccctttgtctccctctc

SEQ ID NO: 322744 - DNA, 25 bp, Mus musculus
gacgctcagccgatcctgaggggcc

SEQ ID NO: 322745 - DNA, 25 bp, Mus musculus
atgttcacgcaccaaggcgccctgg

SEQ ID NO: 322746 - DNA, 25 bp, Mus musculus
ctgctaaccggcctgcaaacattta

SEQ ID NO: 322747 - DNA, 25 bp, Mus musculus
gacctgtcccgagggccattcggaa

SEQ ID NO: 322748 - DNA, 25 bp, Mus musculus
ggccattcggaagggaattgttcga

SEQ ID NO: 322749 - DNA, 25 bp, Mus musculus
tcgatgggctttaaactctccgggc

SEQ ID NO: 322750 - DNA, 25 bp, Mus musculus
tgggtctcggaacgcgaatcccgcc

SEQ ID NO: 322751 - DNA, 25 bp, Mus musculus
aaacttcgtgctcccgtgggtctcg

SEQ ID NO: 322752 - DNA, 25 bp, Mus musculus
tcccagtcgccgtgcgtgagacggt

SEQ ID NO: 322753 - DNA, 25 bp, Mus musculus
aaaccgaaggcaaagccggacactg

SEQ ID NO: 322754 - DNA, 25 bp, Mus musculus
gcacgagtcacaacggagaaaaacc

SEQ ID NO: 322755 - DNA, 25 bp, Mus musculus
cgctggccacacgttgcacgagtca

SEQ ID NO: 322756 - DNA, 25 bp, Mus musculus
ggcgcggaccacaaaagtaacttgc

SEQ ID NO: 322757 - DNA, 25 bp, Mus musculus
gctcaagaatgtgccgctcggggcc

SEQ ID NO: 322758 - DNA, 25 bp, Mus musculus
cgtcggacaagacggctcaagaatg

SEQ ID NO: 322759 - DNA, 25 bp, Mus musculus
agccggacactggacggtcccagtc

SEQ ID NO: 322760 - DNA, 25 bp, Mus musculus
tgttcgaaactcagaaagtactccc

SEQ ID NO: 322761 - DNA, 25 bp, Mus musculus
ctgccgagacagacaaagagaagct

SEQ ID NO: 322762 - DNA, 25 bp, Mus musculus
cctggcgccgcctctaaataaaatc

SEQ ID NO: 322763 - DNA, 25 bp, Mus musculus
agcgcctgaaaacgagggacccgca

SEQ ID NO: 322764 - DNA, 25 bp, Mus musculus
gggacccgcaggaaatcatgtttcg

SEQ ID NO: 322765 - DNA, 25 bp, Mus musculus
gggagccgcaaactttctacgcacc

SEQ ID NO: 322766 - DNA, 25 bp, Mus musculus
ccctgaagttgtccggagctccggg

SEQ ID NO: 322767 - DNA, 25 bp, Mus musculus
ctggtgtgtcacgtttctccgcggc

SEQ ID NO: 322768 - DNA, 25 bp, Mus musculus
aaaggcgaagccacgtggtgacagc

SEQ ID NO: 322769 - DNA, 25 bp, Mus musculus
ccagttcttaggaataaaatgtacg

SEQ ID NO: 322770 - DNA, 25 bp, Mus musculus
cccggcaaactgctagcgactgaca

SEQ ID NO: 322771 - DNA, 25 bp, Mus musculus
ggggtcactgtctttcccgctacac

SEQ ID NO: 322772 - DNA, 25 bp, Mus musculus
gcctcccgggtcctgattcagggga

SEQ ID NO: 322773 - DNA, 25 bp, Mus musculus
acacgggacacgagagacagcgcct

SEQ ID NO: 322774 - DNA, 25 bp, Mus musculus
tttattcgttttgtggagactgggc

SEQ ID NO: 322775 - DNA, 25 bp, Mus musculus
tccggcgcgctcaaatgacgcacgg

SEQ ID NO: 322776 - DNA, 25 bp, Mus musculus
cgtgttgggagctggcgacagaacc

SEQ ID NO: 322777 - DNA, 25 bp, Mus musculus
gctggcgccattgccaagaagaaac

SEQ ID NO: 322778 - DNA, 25 bp, Mus musculus
ccgcggcaggaagtgaatatcgaga

SEQ ID NO: 322779 - DNA, 25 bp, Mus musculus
cggcaggaagtgaatatcgagactt

SEQ ID NO: 322780 - DNA, 25 bp, Mus musculus
tgaatatcgagacttccggcgcgct

SEQ ID NO: 322781 - DNA, 25 bp, Mus musculus
cacccggcttccgtgttgggagctg

SEQ ID NO: 322782 - DNA, 25 bp, Mus musculus
gacagaacctgggacgcggagagct

SEQ ID NO: 322783 - DNA, 25 bp, Mus musculus
gactccgcggcaggaagtgaatatc

SEQ ID NO: 322784 - DNA, 25 bp, Mus musculus
actcgcagaggtgagcgcgaaagaa

SEQ ID NO: 322785 - DNA, 25 bp, Mus musculus
ggagctggcgccattgccaagaaga

SEQ ID NO: 322786 - DNA, 25 bp, Mus musculus
gccaagaagaaactcgcagaggtga

SEQ ID NO: 322787 - DNA, 25 bp, Mus musculus
tcaaatgacgcacggcacccggctt

SEQ ID NO: 322788 - DNA, 25 bp, Mus musculus
cacggcacccggcttccgtgttggg

SEQ ID NO: 322789 - DNA, 25 bp, Mus musculus
cacatccggcagaaaaggcggcccg

SEQ ID NO: 322790 - DNA, 25 bp, Mus musculus
cgggaccgagcgttacagaagagca

SEQ ID NO: 322791 - DNA, 25 bp, Mus musculus
cagaagagcaaaagggtcaggtttc

SEQ ID NO: 322792 - DNA, 25 bp, Mus musculus
atccggaacggagctgcagggctca

SEQ ID NO: 322793 - DNA, 25 bp, Mus musculus
taggcccgagggcaatcgcggatct

SEQ ID NO: 322794 - DNA, 25 bp, Mus musculus
caatcgcggatctgtttgggctgta

SEQ ID NO: 322795 - DNA, 25 bp, Mus musculus
ggctcaccgcttaatccgaagtaga

SEQ ID NO: 322796 - DNA, 25 bp, Mus musculus
cgaagtagacactgtggcgcggttc

SEQ ID NO: 322797 - DNA, 25 bp, Mus musculus
gctagcggactagctggcgctccag

SEQ ID NO: 322798 - DNA, 25 bp, Mus musculus
gtcccaatggctaagcagcgcggcc

SEQ ID NO: 322799 - DNA, 25 bp, Mus musculus
atcgctgcttcgcttccgggactgc

SEQ ID NO: 322800 - DNA, 25 bp, Mus musculus
gaggcgtgctgccagagcgtccacc

SEQ ID NO: 322801 - DNA, 25 bp, Mus musculus
ttccgggactgctcagcagcacgtc

SEQ ID NO: 322802 - DNA, 25 bp, Mus musculus
agcgtggggtcccaatggctaagca

SEQ ID NO: 322803 - DNA, 25 bp, Mus musculus
ttacgattggtcgaatcccgaaatg

SEQ ID NO: 322804 - DNA, 25 bp, Mus musculus
tgacacgtgataagggctccaggcc

SEQ ID NO: 322805 - DNA, 25 bp, Mus musculus
cgaccaaggtgcaagcggaagaaaa

SEQ ID NO: 322806 - DNA, 25 bp, Mus musculus
acacaaaatggcgaccaaggtgcaa

SEQ ID NO: 322807 - DNA, 25 bp, Mus musculus
ttctacaaccttcaacacaaaatgg

SEQ ID NO: 322808 - DNA, 25 bp, Mus musculus
gacgagactcagaggttctacaacc

SEQ ID NO: 322809 - DNA, 25 bp, Mus musculus
agggctccaggccttcattcggccg

SEQ ID NO: 322810 - DNA, 25 bp, Mus musculus
ctccttgcggataaaggcgggttct

SEQ ID NO: 322811 - DNA, 25 bp, Mus musculus
tcccgaaatgcttgaccatagagtc

SEQ ID NO: 322812 - DNA, 25 bp, Mus musculus
ttcattcggccgcttggaccttggg

SEQ ID NO: 322813 - DNA, 25 bp, Mus musculus
gacaaccggccgcttgacgcaagct

SEQ ID NO: 322814 - DNA, 25 bp, Mus musculus
cttgaccatagagtcgacgagactc

SEQ ID NO: 322815 - DNA, 25 bp, Mus musculus
gcttgacgcaagctgacacgtgata

SEQ ID NO: 322816 - DNA, 25 bp, Mus musculus
ggcaattcccgcctccttgcggata

SEQ ID NO: 322817 - DNA, 25 bp, Mus musculus
agcctagcccggtctgaatcccttt

SEQ ID NO: 322818 - DNA, 25 bp, Mus musculus
gaccaccgtactccaatagggcagg

SEQ ID NO: 322819 - DNA, 25 bp, Mus musculus
cttttctgcgggactttgaagctga

SEQ ID NO: 322820 - DNA, 25 bp, Mus musculus
agtttcccagcttgcgtctgctatc

SEQ ID NO: 322821 - DNA, 25 bp, Mus musculus
cgtctgctatcccaggctacgtaga

SEQ ID NO: 322822 - DNA, 25 bp, Mus musculus
taccctgcagtagccagagcgcatc

SEQ ID NO: 322823 - DNA, 25 bp, Mus musculus
gggccagcagttttagctctcttaa

SEQ ID NO: 322824 - DNA, 25 bp, Mus musculus
ggggccatggctaccagaaactgtg

SEQ ID NO: 322825 - DNA, 25 bp, Mus musculus
gccatttgttgtcactcagcgcaga

SEQ ID NO: 322826 - DNA, 25 bp, Mus musculus
tattcctggggtagaccttaggcgc

SEQ ID NO: 322827 - DNA, 25 bp, Mus musculus
aaggcagtgtcttcctaggatatcc

SEQ ID NO: 322828 - DNA, 25 bp, Mus musculus
ggtgagtgtccaagcctccatctgg

SEQ ID NO: 322829 - DNA, 25 bp, Mus musculus
atatcctgactgtcgccaggcaggc

SEQ ID NO: 322830 - DNA, 25 bp, Mus musculus
ggtcatttagcaggaagctttctcc

SEQ ID NO: 322831 - DNA, 25 bp, Mus musculus
ttaatcagattcctgaccgaggggc

SEQ ID NO: 322832 - DNA, 25 bp, Mus musculus
tcagcccgcccgtgcgtaggggaca

SEQ ID NO: 322833 - DNA, 25 bp, Mus musculus
tcagattcctgaccgaggggcatgg

SEQ ID NO: 322834 - DNA, 25 bp, Mus musculus
gacggttaatcagattcctgaccga

SEQ ID NO: 322835 - DNA, 25 bp, Mus musculus
cggcgacggttaatcagattcctga

SEQ ID NO: 322836 - DNA, 25 bp, Mus musculus
cgcggcgacggttaatcagattcct

SEQ ID NO: 322837 - DNA, 25 bp, Mus musculus
accttggcactaccctctgcgggcg

SEQ ID NO: 322838 - DNA, 25 bp, Mus musculus
agggacaaccttggcactaccctct

SEQ ID NO: 322839 - DNA, 25 bp, Mus musculus
tctccagggacaaccttggcactac

SEQ ID NO: 322840 - DNA, 25 bp, Mus musculus
cgtctccagggacaaccttggcact

SEQ ID NO: 322841 - DNA, 25 bp, Mus musculus
cgcagcctgagcgtcctccgcgtct

SEQ ID NO: 322842 - DNA, 25 bp, Mus musculus
aagcggaaactagccctctccgtgc

SEQ ID NO: 322843 - DNA, 25 bp, Mus musculus
caagcggaaactagccctctccgtg

SEQ ID NO: 322844 - DNA, 25 bp, Mus musculus
attcctgaccgaggggcatggccgc

SEQ ID NO: 322845 - DNA, 25 bp, Mus musculus
agggctggcgaacgcgttctttctc

SEQ ID NO: 322846 - DNA, 25 bp, Mus musculus
gcggacttggcactccagcccaatg

SEQ ID NO: 322847 - DNA, 25 bp, Mus musculus
acttggcactccagcccaatgcttg

SEQ ID NO: 322848 - DNA, 25 bp, Mus musculus
ctccagcccaatgcttgctgtcgta

SEQ ID NO: 322849 - DNA, 25 bp, Mus musculus
caatgcttgctgtcgtactcccgta

SEQ ID NO: 322850 - DNA, 25 bp, Mus musculus
tcagacgctgcccactctcagagaa

SEQ ID NO: 322851 - DNA, 25 bp, Mus musculus
gctgcccactctcagagaacacgta

SEQ ID NO: 322852 - DNA, 25 bp, Mus musculus
cacgtacgtgaatggagggctgaat

SEQ ID NO: 322853 - DNA, 25 bp, Mus musculus
ggcgaacgcgttctttctccttcac

SEQ ID NO: 322854 - DNA, 25 bp, Mus musculus
tccttcactgagaactggagtccaa

SEQ ID NO: 322855 - DNA, 25 bp, Mus musculus
cactgagaactggagtccaatgggg

SEQ ID NO: 322856 - DNA, 25 bp, Mus musculus
tccaatgggggaatctccgcgacct

SEQ ID NO: 322857 - DNA, 25 bp, Mus musculus
ccgcgaccttccatccgggtacacg

SEQ ID NO: 322858 - DNA, 25 bp, Mus musculus
ccactctcagagaacacgtacgtga

SEQ ID NO: 322859 - DNA, 25 bp, Mus musculus
taggctccgcgtgactagcgttttc

SEQ ID NO: 322860 - DNA, 25 bp, Mus musculus
ggcgaagtgcgtctttcccagagat

SEQ ID NO: 322861 - DNA, 25 bp, Mus musculus
ctttgtctcaggacgagggtgcaga

SEQ ID NO: 322862 - DNA, 25 bp, Mus musculus
ctcgcatgtgctcgatctttgtctc

SEQ ID NO: 322863 - DNA, 25 bp, Mus musculus
gagcgaccaccaaacctcgcatgtg

SEQ ID NO: 322864 - DNA, 25 bp, Mus musculus
tacccttgttgcagcccggaaggtc

SEQ ID NO: 322865 - DNA, 25 bp, Mus musculus
cgtcgttgaggccttagagcaaatg

SEQ ID NO: 322866 - DNA, 25 bp, Mus musculus
caaatgaggccgatgccttaggctc

SEQ ID NO: 322867 - DNA, 25 bp, Mus musculus
ctagcgttttcgttctcgcgcactc

SEQ ID NO: 322868 - DNA, 25 bp, Mus musculus
ttaccttgggttaagcagtcagccc

SEQ ID NO: 322869 - DNA, 25 bp, Mus musculus
cctagtatcttttctcgccatcaag

SEQ ID NO: 322870 - DNA, 25 bp, Mus musculus
cagctccagctagcgctcaatcaga

SEQ ID NO: 322871 - DNA, 25 bp, Mus musculus
cgccatcaagataaacacgtgcata

SEQ ID NO: 322872 - DNA, 25 bp, Mus musculus
tgctcggtcctcactacccttgttg

SEQ ID NO: 322873 - DNA, 25 bp, Mus musculus
ctcatcttgggtaggattgcgccga

SEQ ID NO: 322874 - DNA, 25 bp, Mus musculus
acctaggtttctggttgagaattca

SEQ ID NO: 322875 - DNA, 25 bp, Mus musculus
tggcatgagcttcgatcaccgacta

SEQ ID NO: 322876 - DNA, 25 bp, Mus musculus
cccgcccttgagctcatcttgggta

SEQ ID NO: 322877 - DNA, 25 bp, Mus musculus
tccaagaggtaggtgatacggtccc

SEQ ID NO: 322878 - DNA, 25 bp, Mus musculus
acttcaggatctcgcaacggatgga

SEQ ID NO: 322879 - DNA, 25 bp, Mus musculus
tttggtcccaagacacttcaggatc

SEQ ID NO: 322880 - DNA, 25 bp, Mus musculus
ccgactctcgggtgaccgccaattt

SEQ ID NO: 322881 - DNA, 25 bp, Mus musculus
agagttctccagatcctccaagcgc

SEQ ID NO: 322882 - DNA, 25 bp, Mus musculus
ccggtataggctggtaagactgctc

SEQ ID NO: 322883 - DNA, 25 bp, Mus musculus
accgactaagggtgaccgagcaagc

SEQ ID NO: 322884 - DNA, 25 bp, Mus musculus
ttgcggccaccagcttaaccttgag

SEQ ID NO: 322885 - DNA, 25 bp, Mus musculus
ttgagctccagaccgacctaggttt

SEQ ID NO: 322886 - DNA, 25 bp, Mus musculus
tgttcacgaggcctcaaagcgtgga

SEQ ID NO: 322887 - DNA, 25 bp, Mus musculus
tgggctgtcgctctccaagagcgtg

SEQ ID NO: 322888 - DNA, 25 bp, Mus musculus
cgctgtttggttccggatctgctgg

SEQ ID NO: 322889 - DNA, 25 bp, Mus musculus
ctccaagagcgtgggtggaattgaa

SEQ ID NO: 322890 - DNA, 25 bp, Mus musculus
ctgggcgcccgcattgatctttaaa

SEQ ID NO: 322891 - DNA, 25 bp, Mus musculus
ggcgcccgcattgatctttaaaaaa

SEQ ID NO: 322892 - DNA, 25 bp, Mus musculus
atcattttgaaatcgccataatgtg

SEQ ID NO: 322893 - DNA, 25 bp, Mus musculus
gaaatcgccataatgtgaagaaata

SEQ ID NO: 322894 - DNA, 25 bp, Mus musculus
tggcgcttcgccctcgtatttcaca

SEQ ID NO: 322895 - DNA, 25 bp, Mus musculus
cgccctcgtatttcacacgtaatga

SEQ ID NO: 322896 - DNA, 25 bp, Mus musculus
acacgtaatgacacgagatggcttc

SEQ ID NO: 322897 - DNA, 25 bp, Mus musculus
cacgagatggcttcatttagaaaga

SEQ ID NO: 322898 - DNA, 25 bp, Mus musculus
catttagaaagacaagcgggcggga

SEQ ID NO: 322899 - DNA, 25 bp, Mus musculus
tgtgaagaaatatggcgcttcgccc

SEQ ID NO: 322900 - DNA, 25 bp, Mus musculus
gatctgctgggctgtcgctctccaa

SEQ ID NO: 322901 - DNA, 25 bp, Mus musculus
ccatttctgggacgcttagcagcta

SEQ ID NO: 322902 - DNA, 25 bp, Mus musculus
gcttccagcccaaagcgccggtgtt

SEQ ID NO: 322903 - DNA, 25 bp, Mus musculus
aggtacctccgcacctggctagagc

SEQ ID NO: 322904 - DNA, 25 bp, Mus musculus
ggaggctgtcctgtctaatcaaaga

SEQ ID NO: 322905 - DNA, 25 bp, Mus musculus
ctggctacggggacaataaaatttg

SEQ ID NO: 322906 - DNA, 25 bp, Mus musculus
agaggccggatcaaagtaagttata

SEQ ID NO: 322907 - DNA, 25 bp, Mus musculus
agggaccaagtctctctagtccttc

SEQ ID NO: 322908 - DNA, 25 bp, Mus musculus
acctgcgatagaactgtaggaggcc

SEQ ID NO: 322909 - DNA, 25 bp, Mus musculus
agcagctattatgtcgactcgatca

SEQ ID NO: 322910 - DNA, 25 bp, Mus musculus
cgcgcggataatgtctgagaatgtc

SEQ ID NO: 322911 - DNA, 25 bp, Mus musculus
cagccaagtttccttcgggccagta

SEQ ID NO: 322912 - DNA, 25 bp, Mus musculus
aaagccctctgcaccgggtccgtgt

SEQ ID NO: 322913 - DNA, 25 bp, Mus musculus
tcataagtcacgagagcgaggacgc

SEQ ID NO: 322914 - DNA, 25 bp, Mus musculus
gtgtgccaccttttccctgcttggg

SEQ ID NO: 322915 - DNA, 25 bp, Mus musculus
gtcctcaacacctcgggaagagcca

SEQ ID NO: 322916 - DNA, 25 bp, Mus musculus
ccgtgccgagaggacggaagcgacc

SEQ ID NO: 322917 - DNA, 25 bp, Mus musculus
ctcccacgcggggctagcgaggaca

SEQ ID NO: 322918 - DNA, 25 bp, Mus musculus
gctgacccatcgtcctcccacgcgg

SEQ ID NO: 322919 - DNA, 25 bp, Mus musculus
cggagagagacggacgcggctaccc

SEQ ID NO: 322920 - DNA, 25 bp, Mus musculus
cattcactttttccgcgctgaccca

SEQ ID NO: 322921 - DNA, 25 bp, Mus musculus
ctcgtgggcccgcttaccctgtggg

SEQ ID NO: 322922 - DNA, 25 bp, Mus musculus
gttaccggagcaacgacccaggcgc

SEQ ID NO: 322923 - DNA, 25 bp, Mus musculus
cacggttaccggagcaacgacccag

SEQ ID NO: 322924 - DNA, 25 bp, Mus musculus
cctgccacggttaccggagcaacga

SEQ ID NO: 322925 - DNA, 25 bp, Mus musculus
agcaaggcctgccacggttaccgga

SEQ ID NO: 322926 - DNA, 25 bp, Mus musculus
aagtgttcccgagcaaggcctgcca

SEQ ID NO: 322927 - DNA, 25 bp, Mus musculus
cgcagaaagtgttcccgagcaaggc

SEQ ID NO: 322928 - DNA, 25 bp, Mus musculus
ccaagtcctcaacacctcgggaaga

SEQ ID NO: 322929 - DNA, 25 bp, Mus musculus
ctttccctggatgcgccctcaaggt

SEQ ID NO: 322930 - DNA, 25 bp, Mus musculus
aggagttctaccacgggccatcgtc

SEQ ID NO: 322931 - DNA, 25 bp, Mus musculus
tctgcagcgccagagcctgttcggt

SEQ ID NO: 322932 - DNA, 25 bp, Mus musculus
atgcgccctcaaggtgagctcccgt

SEQ ID NO: 322933 - DNA, 25 bp, Mus musculus
ccaattattatgactgcggcttcgc

SEQ ID NO: 322934 - DNA, 25 bp, Mus musculus
cgccgcctcaaaattcaataaaatg

SEQ ID NO: 322935 - DNA, 25 bp, Mus musculus
tgttcggtgcgcaggatccagacct

SEQ ID NO: 322936 - DNA, 25 bp, Mus musculus
atccagacctggtgcagtacgcaga

SEQ ID NO: 322937 - DNA, 25 bp, Mus musculus
cagcagaacccgtgcgccgtggcgt

SEQ ID NO: 322938 - DNA, 25 bp, Mus musculus
acccttcgcaaatccaggagttcta

SEQ ID NO: 322939 - DNA, 25 bp, Mus musculus
caccgtggtgtacggtcccagcagc

SEQ ID NO: 322940 - DNA, 25 bp, Mus musculus
gagctcttatttcgtcaactcactg

SEQ ID NO: 322941 - DNA, 25 bp, Mus musculus
gtacgcagactgcaagctcgcggca

SEQ ID NO: 322942 - DNA, 25 bp, Mus musculus
gtcaactcactgttctccaaataca

SEQ ID NO: 322943 - DNA, 25 bp, Mus musculus
tgacaagaagtaggctccagctggg

SEQ ID NO: 322944 - DNA, 25 bp, Mus musculus
atcgaggtatcgcacgcgctgggac

SEQ ID NO: 322945 - DNA, 25 bp, Mus musculus
tttcccagcagtaaatgcgagcagg

SEQ ID NO: 322946 - DNA, 25 bp, Mus musculus
caacaaagacaagtttcccagcagt

SEQ ID NO: 322947 - DNA, 25 bp, Mus musculus
ctgacagagagacaggtcaaaatct

SEQ ID NO: 322948 - DNA, 25 bp, Mus musculus
atgcgcagaagggtgacaagaagta

SEQ ID NO: 322949 - DNA, 25 bp, Mus musculus
ctcgcaagcggaggatcgaggtatc

SEQ ID NO: 322950 - DNA, 25 bp, Mus musculus
ttaatccctatctgactcgcaagcg

SEQ ID NO: 322951 - DNA, 25 bp, Mus musculus
tggagaaggagttcctatttaatcc

SEQ ID NO: 322952 - DNA, 25 bp, Mus musculus
ctcctaggctggttcacgaatcttc

SEQ ID NO: 322953 - DNA, 25 bp, Mus musculus
tatcctggtctcctaggctggttca

SEQ ID NO: 322954 - DNA, 25 bp, Mus musculus
ctgcccttattatcctggtctccta

SEQ ID NO: 322955 - DNA, 25 bp, Mus musculus
acgcgctgggactgacagagagaca

SEQ ID NO: 322956 - DNA, 25 bp, Mus musculus
ttcacgaatcttccaaccttctctg

SEQ ID NO: 322957 - DNA, 25 bp, Mus musculus
agatcggccattgccacgccgttta

SEQ ID NO: 322958 - DNA, 25 bp, Mus musculus
atatttatcagcagcgccggcacgg

SEQ ID NO: 322959 - DNA, 25 bp, Mus musculus
ttgccgacgccacagagctcaaagc

SEQ ID NO: 322960 - DNA, 25 bp, Mus musculus
gccctagcggatctctttttgccga

SEQ ID NO: 322961 - DNA, 25 bp, Mus musculus
gccgtttaagtctgggctgggacca

SEQ ID NO: 322962 - DNA, 25 bp, Mus musculus
tgtccaggttattcccggctgcaga

SEQ ID NO: 322963 - DNA, 25 bp, Mus musculus
ctggatgcgaagctcaggtaaagcc

SEQ ID NO: 322964 - DNA, 25 bp, Mus musculus
cggccgagagtaacttccggatcta

SEQ ID NO: 322965 - DNA, 25 bp, Mus musculus
tgcgcgccctttgagcagaacctct

SEQ ID NO: 322966 - DNA, 25 bp, Mus musculus
agttccttcaacatgcactgcgcgc

SEQ ID NO: 322967 - DNA, 25 bp, Mus musculus
tacgggctcgaaccgagttccttca

SEQ ID NO: 322968 - DNA, 25 bp, Mus musculus
cgcaagttcggttttcgctccagga

SEQ ID NO: 322969 - DNA, 25 bp, Mus musculus
ccggccaaattatgagttcattgta

SEQ ID NO: 322970 - DNA, 25 bp, Mus musculus
ttttgctcagtgctctcaggcccta

SEQ ID NO: 322971 - DNA, 25 bp, Mus musculus
gcgcgccagcagatgcacctggtca

SEQ ID NO: 322972 - DNA, 25 bp, Mus musculus
gccttcctagaagcgcagcctctta

SEQ ID NO: 322973 - DNA, 25 bp, Mus musculus
tgtgtaaagtcgtcttcctcagccc

SEQ ID NO: 322974 - DNA, 25 bp, Mus musculus
cggttccttggcgatgctgtgtaaa

SEQ ID NO: 322975 - DNA, 25 bp, Mus musculus
aggatctcccgagcgcgttgtcctt

SEQ ID NO: 322976 - DNA, 25 bp, Mus musculus
ttcatcagtcgggttagagctgcgc

SEQ ID NO: 322977 - DNA, 25 bp, Mus musculus
cgctactgggctagggtcaaagaga

SEQ ID NO: 322978 - DNA, 25 bp, Mus musculus
ccttgaagcaggtccatcagccgga

SEQ ID NO: 322979 - DNA, 25 bp, Mus musculus
cctttgaccagatgaacggagtggc

SEQ ID NO: 322980 - DNA, 25 bp, Mus musculus
aggcgcagggttgaagcatcatctc

SEQ ID NO: 322981 - DNA, 25 bp, Mus musculus
gcgctgaccacactggctctgaaga

SEQ ID NO: 322982 - DNA, 25 bp, Mus musculus
agccgcgtgtcttcttcggagcttg

SEQ ID NO: 322983 - DNA, 25 bp, Mus musculus
tcttaggctaagacagggatgcgcg

SEQ ID NO: 322984 - DNA, 25 bp, Mus musculus
gcatcatctcctggtccttgaagca

SEQ ID NO: 322985 - DNA, 25 bp, Mus musculus
agtgagtgagacttcccgctgtccc

SEQ ID NO: 322986 - DNA, 25 bp, Mus musculus
cgcggcgctcggactataaaacaca

SEQ ID NO: 322987 - DNA, 25 bp, Mus musculus
caacaaatcataaacccggcggagc

SEQ ID NO: 322988 - DNA, 25 bp, Mus musculus
cctcccgatgagttcctatttcgtg

SEQ ID NO: 322989 - DNA, 25 bp, Mus musculus
agctgccgctctactcgtctggcta

SEQ ID NO: 322990 - DNA, 25 bp, Mus musculus
acccggccaggacaagggctttgcg

SEQ ID NO: 322991 - DNA, 25 bp, Mus musculus
ggctttgcggcgtcctcctattacc

SEQ ID NO: 322992 - DNA, 25 bp, Mus musculus
cgccctgtgattatgggccggcgcc

SEQ ID NO: 322993 - DNA, 25 bp, Mus musculus
cggcgcctgccttctaccgggagaa

SEQ ID NO: 322994 - DNA, 25 bp, Mus musculus
cgcaagtccgactgcgcacaggaca

SEQ ID NO: 322995 - DNA, 25 bp, Mus musculus
ctgcgcacaggacaagagcgtgttc

SEQ ID NO: 322996 - DNA, 25 bp, Mus musculus
agcagaagtgctccacgcccgtcta

SEQ ID NO: 322997 - DNA, 25 bp, Mus musculus
catgaattcgtgcaacagtgagtga

SEQ ID NO: 322998 - DNA, 25 bp, Mus musculus
acccgtggatgcagcgcatgaattc

SEQ ID NO: 322999 - DNA, 25 bp, Mus musculus
agctccagcgccaatttcaccgaaa

SEQ ID NO: 323000 - DNA, 25 bp, Mus musculus
atgggatggatctcagcgtcaaccg

SEQ ID NO: 323001 - DNA, 25 bp, Mus musculus
ggctcttacggctacaattacaatg

SEQ ID NO: 323002 - DNA, 25 bp, Mus musculus
tcttacagggatcccgctgccatgc

SEQ ID NO: 323003 - DNA, 25 bp, Mus musculus
tgctcagaggccaacgtcaaccttc

SEQ ID NO: 323004 - DNA, 25 bp, Mus musculus
gctcgcattgaatcggccctaacga

SEQ ID NO: 323005 - DNA, 25 bp, Mus musculus
tctccgatcgtcattatttgtaacc

SEQ ID NO: 323006 - DNA, 25 bp, Mus musculus
cctcttgaggtcatcagtgagaatt

SEQ ID NO: 323007 - DNA, 25 bp, Mus musculus
actggtcaacaaaagcacgtgattc

SEQ ID NO: 323008 - DNA, 25 bp, Mus musculus
ggccgcatacatagcaaaacgaagt

SEQ ID NO: 323009 - DNA, 25 bp, Mus musculus
gcacagggttataacgaccacgatc

SEQ ID NO: 323010 - DNA, 25 bp, Mus musculus
cttctcggggcgttatccaaatggc

SEQ ID NO: 323011 - DNA, 25 bp, Mus musculus
gcccggactatcagttgctaaatta

SEQ ID NO: 323012 - DNA, 25 bp, Mus musculus
ttcaccgaaatagacgaggccagcg

SEQ ID NO: 323013 - DNA, 25 bp, Mus musculus
aaccttgagcccatccggaggagcc

SEQ ID NO: 323014 - DNA, 25 bp, Mus musculus
ggcccggaccgcctatactcgctac

SEQ ID NO: 323015 - DNA, 25 bp, Mus musculus
ccctggagctggaaaaggaattcca

SEQ ID NO: 323016 - DNA, 25 bp, Mus musculus
cggcgacgtatcgagatcgcccacg

SEQ ID NO: 323017 - DNA, 25 bp, Mus musculus
gcgacgtatcgagatcgcccacgcg

SEQ ID NO: 323018 - DNA, 25 bp, Mus musculus
gaaagacaacaaactgaaaagtatg

SEQ ID NO: 323019 - DNA, 25 bp, Mus musculus
aactgaaaagtatgagtctggctac

SEQ ID NO: 323020 - DNA, 25 bp, Mus musculus
gaaaagtatgagtctggctacagcc

SEQ ID NO: 323021 - DNA, 25 bp, Mus musculus
ggctacagccggcagcgccttccaa

SEQ ID NO: 323022 - DNA, 25 bp, Mus musculus
ttccaaccttgagcccatccggagg

SEQ ID NO: 323023 - DNA, 25 bp, Mus musculus
cccagctcgacccttccaatcttcc

SEQ ID NO: 323024 - DNA, 25 bp, Mus musculus
tccaatcttccctgcactgccgctg

SEQ ID NO: 323025 - DNA, 25 bp, Mus musculus
agccggcagcgccttccaaccttga

SEQ ID NO: 323026 - DNA, 25 bp, Mus musculus
ggaccgcctatactcgctaccagac

SEQ ID NO: 323027 - DNA, 25 bp, Mus musculus
gagcgagctccgctgttgctcagcg

SEQ ID NO: 323028 - DNA, 25 bp, Mus musculus
ctagagactgacctccggttggccc

SEQ ID NO: 323029 - DNA, 25 bp, Mus musculus
attatactaactgcctgctcgtggg

SEQ ID NO: 323030 - DNA, 25 bp, Mus musculus
gtgaaccgcaggtcacggcgtctaa

SEQ ID NO: 323031 - DNA, 25 bp, Mus musculus
caggtcacggcgtctaaaaattatt

SEQ ID NO: 323032 - DNA, 25 bp, Mus musculus
atgttcgagaacctcgtgacgcgcc

SEQ ID NO: 323033 - DNA, 25 bp, Mus musculus
ttgctatgctcaacgcgcttggggt

SEQ ID NO: 323034 - DNA, 25 bp, Mus musculus
tgacgcgcctgctgtttaacaaaga

SEQ ID NO: 323035 - DNA, 25 bp, Mus musculus
gctcaggcccttgctatgctcaacg

SEQ ID NO: 323036 - DNA, 25 bp, Mus musculus
gagcgaactgcgtgagcatattata

SEQ ID NO: 323037 - DNA, 25 bp, Mus musculus
caaagactgccaaagtatgagatta

SEQ ID NO: 323038 - DNA, 25 bp, Mus musculus
agattaatacgaaaacttgctcttc

SEQ ID NO: 323039 - DNA, 25 bp, Mus musculus
tcggttttccggatacacaatagtg

SEQ ID NO: 323040 - DNA, 25 bp, Mus musculus
cacaatagtggacaggagcgagctc

SEQ ID NO: 323041 - DNA, 25 bp, Mus musculus
ccctggatgcgcaaagttcacgtga

SEQ ID NO: 323042 - DNA, 25 bp, Mus musculus
gatgcgcaaagttcacgtgagcacg

SEQ ID NO: 323043 - DNA, 25 bp, Mus musculus
agagcccgtcgtctacccctggatg

SEQ ID NO: 323044 - DNA, 25 bp, Mus musculus
cgcgtgcaaagagcccgtcgtctac

SEQ ID NO: 323045 - DNA, 25 bp, Mus musculus
actccgcgtgcaaagagcccgtcgt

SEQ ID NO: 323046 - DNA, 25 bp, Mus musculus
gggctccagtgcagccaacagccgg

SEQ ID NO: 323047 - DNA, 25 bp, Mus musculus
gtgcactgtgcagcgctacgcggcc

SEQ ID NO: 323048 - DNA, 25 bp, Mus musculus
ccagcgaccactcgcccgggtacta

SEQ ID NO: 323049 - DNA, 25 bp, Mus musculus
agagcgattacctacccagcgacca

SEQ ID NO: 323050 - DNA, 25 bp, Mus musculus
tcacagagcgattacctacccagcg

SEQ ID NO: 323051 - DNA, 25 bp, Mus musculus
gcgaggagtattcacagagcgatta

SEQ ID NO: 323052 - DNA, 25 bp, Mus musculus
cctccgtgcgaggagtattcacaga

SEQ ID NO: 323053 - DNA, 25 bp, Mus musculus
agttccctccgtgcgaggagtattc

SEQ ID NO: 323054 - DNA, 25 bp, Mus musculus
ggcgccgtgcactgtgcagcgctac

SEQ ID NO: 323055 - DNA, 25 bp, Mus musculus
cccaagcaggagttcgaacatgggg

SEQ ID NO: 323056 - DNA, 25 bp, Mus musculus
aagcgctctcggaccgcctacactc

SEQ ID NO: 323057 - DNA, 25 bp, Mus musculus
ggaccgcctacactcgccagcaggt

SEQ ID NO: 323058 - DNA, 25 bp, Mus musculus
gagttggagaaggagtttcactaca

SEQ ID NO: 323059 - DNA, 25 bp, Mus musculus
ttggagaaggagtttcactacaatc

SEQ ID NO: 323060 - DNA, 25 bp, Mus musculus
ggagaaggagtttcactacaatcgc

SEQ ID NO: 323061 - DNA, 25 bp, Mus musculus
agaaggagtttcactacaatcgcta

SEQ ID NO: 323062 - DNA, 25 bp, Mus musculus
ggagtttcactacaatcgctacctg

SEQ ID NO: 323063 - DNA, 25 bp, Mus musculus
tttcactacaatcgctacctgacgc

SEQ ID NO: 323064 - DNA, 25 bp, Mus musculus
ctacaatcgctacctgacgcgccgc

SEQ ID NO: 323065 - DNA, 25 bp, Mus musculus
aagttgcccaacaccaagatccgct

SEQ ID NO: 323066 - DNA, 25 bp, Mus musculus
cccaacaccaagatccgctcgggtg

SEQ ID NO: 323067 - DNA, 25 bp, Mus musculus
tctagtgccccccaagcaggagttc

SEQ ID NO: 323068 - DNA, 25 bp, Mus musculus
ggagcccaagcgctctcggaccgcc

SEQ ID NO: 323069 - DNA, 25 bp, Mus musculus
cgggcccggacatatggaacccatt

SEQ ID NO: 323070 - DNA, 25 bp, Mus musculus
ccgcgacccagtgaatgtggagaga

SEQ ID NO: 323071 - DNA, 25 bp, Mus musculus
acaggtaagtgtgcggtgctcagtc

SEQ ID NO: 323072 - DNA, 25 bp, Mus musculus
gtctgagaccgcacaggtaagtgtg

SEQ ID NO: 323073 - DNA, 25 bp, Mus musculus
gcaccctagtctgagaccgcacagg

SEQ ID NO: 323074 - DNA, 25 bp, Mus musculus
agggtcccaggaccggccatcagct

SEQ ID NO: 323075 - DNA, 25 bp, Mus musculus
ggctccgcaggctgaacaaagccgg

SEQ ID NO: 323076 - DNA, 25 bp, Mus musculus
catccctagcaggagctgtgcggcc

SEQ ID NO: 323077 - DNA, 25 bp, Mus musculus
tcggagcatccctagcaggagctgt

SEQ ID NO: 323078 - DNA, 25 bp, Mus musculus
ctgggtttctcgtagcccggcgccg

SEQ ID NO: 323079 - DNA, 25 bp, Mus musculus
tggccctgccagtcgccacttcttt

SEQ ID NO: 323080 - DNA, 25 bp, Mus musculus
tgacattgaagagccgctggtgcgc

SEQ ID NO: 323081 - DNA, 25 bp, Mus musculus
tatggaacccatttcgctggtgaca

SEQ ID NO: 323082 - DNA, 25 bp, Mus musculus
cccatttcgctggtgacattgaaga

SEQ ID NO: 323083 - DNA, 25 bp, Mus musculus
agcgactgacgtgggacgaactgcc

SEQ ID NO: 323084 - DNA, 25 bp, Mus musculus
gcagcatgcgtgcagtatcgcgccc

SEQ ID NO: 323085 - DNA, 25 bp, Mus musculus
ctctttgctatgagcggcagcatgc

SEQ ID NO: 323086 - DNA, 25 bp, Mus musculus
tgaagcctccggatcgcagccagct

SEQ ID NO: 323087 - DNA, 25 bp, Mus musculus
ggtctgtgccttgaagcctccggat

SEQ ID NO: 323088 - DNA, 25 bp, Mus musculus
tcacggcgtggcaacccgggtctgt

SEQ ID NO: 323089 - DNA, 25 bp, Mus musculus
aactgccaggtagcggaagcagcca

SEQ ID NO: 323090 - DNA, 25 bp, Mus musculus
cccggcgctcagagagttaaaggca

SEQ ID NO: 323091 - DNA, 25 bp, Mus musculus
gcgagcacgcaagccgagcgactga

SEQ ID NO: 323092 - DNA, 25 bp, Mus musculus
cattagaggcaaagttgggcgccgc

SEQ ID NO: 323093 - DNA, 25 bp, Mus musculus
ggcatcattgcagccattagaggca

SEQ ID NO: 323094 - DNA, 25 bp, Mus musculus
ctcagagagttaaaggcatcattgc

SEQ ID NO: 323095 - DNA, 25 bp, Mus musculus
cctgtgtccaagctactctttgcta

SEQ ID NO: 323096 - DNA, 25 bp, Mus musculus
gcggagacacttcacggcgtggcaa

SEQ ID NO: 323097 - DNA, 25 bp, Mus musculus
cgcagctttaaacagtggtcttttt

SEQ ID NO: 323098 - DNA, 25 bp, Mus musculus
gggcgacgcagctttaaacagtggt

SEQ ID NO: 323099 - DNA, 25 bp, Mus musculus
tgccttcaaggaggggagatttctc

SEQ ID NO: 323100 - DNA, 25 bp, Mus musculus
agcccggagccggattctcggcgag

SEQ ID NO: 323101 - DNA, 25 bp, Mus musculus
gattctcggcgagccgagccgccca

SEQ ID NO: 323102 - DNA, 25 bp, Mus musculus
gcacctttcggtctgctattttctc

SEQ ID NO: 323103 - DNA, 25 bp, Mus musculus
cgctctaaagccgagtgaattgaag

SEQ ID NO: 323104 - DNA, 25 bp, Mus musculus
agccgagtgaattgaagcggacgcc

SEQ ID NO: 323105 - DNA, 25 bp, Mus musculus
ctcgggctccctagccggggtggct

SEQ ID NO: 323106 - DNA, 25 bp, Mus musculus
ttcctttgccttcaaggaggggaga

SEQ ID NO: 323107 - DNA, 25 bp, Mus musculus
cttcaaggaggggagatttctcgcc

SEQ ID NO: 323108 - DNA, 25 bp, Mus musculus
caaggaggggagatttctcgcctgc

SEQ ID NO: 323109 - DNA, 25 bp, Mus musculus
aggggagatttctcgcctgccgctc

SEQ ID NO: 323110 - DNA, 25 bp, Mus musculus
gaattgaagcggacgccgcgcggct

SEQ ID NO: 323111 - DNA, 25 bp, Mus musculus
ctgagcaggaggtcggtaactcctc

SEQ ID NO: 323112 - DNA, 25 bp, Mus musculus
atggtttcgtttcgggcttattgct

SEQ ID NO: 323113 - DNA, 25 bp, Mus musculus
ctctgtcctgcgatggtttcgtttc

SEQ ID NO: 323114 - DNA, 25 bp, Mus musculus
cattctttcctatcacgtctctggc

SEQ ID NO: 323115 - DNA, 25 bp, Mus musculus
ccgccagaggagtctccattctttc

SEQ ID NO: 323116 - DNA, 25 bp, Mus musculus
ttgtctcaccgccagaggagtctcc

SEQ ID NO: 323117 - DNA, 25 bp, Mus musculus
ggcagctggaggctctccgaatcca

SEQ ID NO: 323118 - DNA, 25 bp, Mus musculus
ccagttcggcgtcccgatcagtttc

SEQ ID NO: 323119 - DNA, 25 bp, Mus musculus
tgagcttggaacctgccgccgctaa

SEQ ID NO: 323120 - DNA, 25 bp, Mus musculus
gcccggcctggtgagcttggaacct

SEQ ID NO: 323121 - DNA, 25 bp, Mus musculus
gccaaacttgctgccgtggagctcg

SEQ ID NO: 323122 - DNA, 25 bp, Mus musculus
tcggttacctcctgcgccaaacttg

SEQ ID NO: 323123 - DNA, 25 bp, Mus musculus
gaatccacaaaccttcctggccttg

SEQ ID NO: 323124 - DNA, 25 bp, Mus musculus
ctcgcctccttgagcctgagcagga

SEQ ID NO: 323125 - DNA, 25 bp, Mus musculus
tgaagccctccgtctcgtagatgtg

SEQ ID NO: 323126 - DNA, 25 bp, Mus musculus
tccaggaaggcagctggcccgtcca

SEQ ID NO: 323127 - DNA, 25 bp, Mus musculus
tcaatctggtgcaggttgtcccggt

SEQ ID NO: 323128 - DNA, 25 bp, Mus musculus
agcttgtccatgcagctgatgcgga

SEQ ID NO: 323129 - DNA, 25 bp, Mus musculus
cgtgccgtacagcaccttgagcata

SEQ ID NO: 323130 - DNA, 25 bp, Mus musculus
ttgagcataccgtgcatgcccgggt

SEQ ID NO: 323131 - DNA, 25 bp, Mus musculus
tgagcaggaacacgcccaggctgaa

SEQ ID NO: 323132 - DNA, 25 bp, Mus musculus
taatagtggcagtcccggccgtcct

SEQ ID NO: 323133 - DNA, 25 bp, Mus musculus
ctcgtagatgtgcatgtaggtgacc

SEQ ID NO: 323134 - DNA, 25 bp, Mus musculus
cacctgggtcagcaggctcttgagc

SEQ ID NO: 323135 - DNA, 25 bp, Mus musculus
caggctcaggttctccgggaagccc

SEQ ID NO: 323136 - DNA, 25 bp, Mus musculus
gtcgcccgcttagcgcgccaatggt

SEQ ID NO: 323137 - DNA, 25 bp, Mus musculus
tgcacgtgccgctcttgagcaggaa

SEQ ID NO: 323138 - DNA, 25 bp, Mus musculus
gcccgtccacggcatcaatctggtg

SEQ ID NO: 323139 - DNA, 25 bp, Mus musculus
tcgtgagggtatcaggcccttgcaa

SEQ ID NO: 323140 - DNA, 25 bp, Mus musculus
tttcaggccgccacgcacctggagg

SEQ ID NO: 323141 - DNA, 25 bp, Mus musculus
caatggtttcggctacgacgggcct

SEQ ID NO: 323142 - DNA, 25 bp, Mus musculus
ctcgtaccctggcagcaatggtttc

SEQ ID NO: 323143 - DNA, 25 bp, Mus musculus
ttcggaggctactcctcgtaccctg

SEQ ID NO: 323144 - DNA, 25 bp, Mus musculus
aacaccgcagctgcgctcttcggag

SEQ ID NO: 323145 - DNA, 25 bp, Mus musculus
cagcgatgcagaaagccacctacta

SEQ ID NO: 323146 - DNA, 25 bp, Mus musculus
ccacgcacctggagggtgactacca

SEQ ID NO: 323147 - DNA, 25 bp, Mus musculus
tatcaggcccttgcaagttgccacc

SEQ ID NO: 323148 - DNA, 25 bp, Mus musculus
tgccaatgtccggtcgtgagggtat

SEQ ID NO: 323149 - DNA, 25 bp, Mus musculus
gggtgactaccagcgctcagcgtgt

SEQ ID NO: 323150 - DNA, 25 bp, Mus musculus
ctcagcgtgttctctgcagtccctg

SEQ ID NO: 323151 - DNA, 25 bp, Mus musculus
tcagccgcttggaacagacccgaga

SEQ ID NO: 323152 - DNA, 25 bp, Mus musculus
cgggcctcgcccagcgatgcagaaa

SEQ ID NO: 323153 - DNA, 25 bp, Mus musculus
ttcatgaacgccttacactccatga

SEQ ID NO: 323154 - DNA, 25 bp, Mus musculus
cacggcgtacacaagcgcgcagctg

SEQ ID NO: 323155 - DNA, 25 bp, Mus musculus
caccatgcagggcagtccggtgtat

SEQ ID NO: 323156 - DNA, 25 bp, Mus musculus
tacgggacgcccaccatgcagggca

SEQ ID NO: 323157 - DNA, 25 bp, Mus musculus
tcctccaagctaacgggggcgccta

SEQ ID NO: 323158 - DNA, 25 bp, Mus musculus
acacaagcgcgcagctggtggagct

SEQ ID NO: 323159 - DNA, 25 bp, Mus musculus
ccagctttcggcaaaggccaccaga

SEQ ID NO: 323160 - DNA, 25 bp, Mus musculus
cacggccggcttcatgaacgcctta

SEQ ID NO: 323161 - DNA, 25 bp, Mus musculus
ggccaaggggctggcctcgtcctct

SEQ ID NO: 323162 - DNA, 25 bp, Mus musculus
caagaaagaccagaaggccaagggg

SEQ ID NO: 323163 - DNA, 25 bp, Mus musculus
tctgctgaacctcagcgagcgccag

SEQ ID NO: 323164 - DNA, 25 bp, Mus musculus
ggtcgagatggccaatctgctgaac

SEQ ID NO: 323165 - DNA, 25 bp, Mus musculus
cgcgccgggtcgagatggccaatct

SEQ ID NO: 323166 - DNA, 25 bp, Mus musculus
aggccaccagaatgcctacgcgctg

SEQ ID NO: 323167 - DNA, 25 bp, Mus musculus
cgagcggcaggattcgccttttcta

SEQ ID NO: 323168 - DNA, 25 bp, Mus musculus
gattcgccttttctaccggacctca

SEQ ID NO: 323169 - DNA, 25 bp, Mus musculus
ccaacacgcaactgctggagctgga

SEQ ID NO: 323170 - DNA, 25 bp, Mus musculus
agacgcagcatcgagagccgcccga

SEQ ID NO: 323171 - DNA, 25 bp, Mus musculus
cccggattgccagaatgcggcggca

SEQ ID NO: 323172 - DNA, 25 bp, Mus musculus
ggagttccacttcaataagtacctg

SEQ ID NO: 323173 - DNA, 25 bp, Mus musculus
caataagtacctgtgccggccgcgt

SEQ ID NO: 323174 - DNA, 25 bp, Mus musculus
gagatcgctgccttgctggacctca

SEQ ID NO: 323175 - DNA, 25 bp, Mus musculus
ttgctggacctcaccgaaaggcagg

SEQ ID NO: 323176 - DNA, 25 bp, Mus musculus
aaaggcaggtcaaagtctggttcca

SEQ ID NO: 323177 - DNA, 25 bp, Mus musculus
ccagaaccgacgcatgaaacacaag

SEQ ID NO: 323178 - DNA, 25 bp, Mus musculus
gcatgaaacacaagcggcagacgca

SEQ ID NO: 323179 - DNA, 25 bp, Mus musculus
tgcctgccaccaccctggagagtgt

SEQ ID NO: 323180 - DNA, 25 bp, Mus musculus
tgcacaatgctcagagccggaggcc

SEQ ID NO: 323181 - DNA, 25 bp, Mus musculus
ttgcccgacagctatggagcgggtg

SEQ ID NO: 323182 - DNA, 25 bp, Mus musculus
cagctacgcaggggagagccgctat

SEQ ID NO: 323183 - DNA, 25 bp, Mus musculus
agctcagcgctccaacaaaactcgg

SEQ ID NO: 323184 - DNA, 25 bp, Mus musculus
gggtatcctgtccagcagccgccgt

SEQ ID NO: 323185 - DNA, 25 bp, Mus musculus
gcgctccaacaaaactcggggtatc

SEQ ID NO: 323186 - DNA, 25 bp, Mus musculus
ctcagtattattctgtgggtcagtc

SEQ ID NO: 323187 - DNA, 25 bp, Mus musculus
tccgtcgagctacggagcccagcta

SEQ ID NO: 323188 - DNA, 25 bp, Mus musculus
tggaagctattttcatccgtcgagc

SEQ ID NO: 323189 - DNA, 25 bp, Mus musculus
aaactcggggtatcctgtccagcag

SEQ ID NO: 323190 - DNA, 25 bp, Mus musculus
cagtcggaaggagatggaagctatt

SEQ ID NO: 323191 - DNA, 25 bp, Mus musculus
ttattctgtgggtcagtcggaagga

SEQ ID NO: 323192 - DNA, 25 bp, Mus musculus
agctccggccgttgacagctacgca

SEQ ID NO: 323193 - DNA, 25 bp, Mus musculus
ccagctatgggccttctcagtatta

SEQ ID NO: 323194 - DNA, 25 bp, Mus musculus
tggagtcggctcagggccatatcct

SEQ ID NO: 323195 - DNA, 25 bp, Mus musculus
aatacctgagccgtgcccggagggt

SEQ ID NO: 323196 - DNA, 25 bp, Mus musculus
ggcggtctccgcacaaacttcacca

SEQ ID NO: 323197 - DNA, 25 bp, Mus musculus
gcgctcccggcggtctccgcacaaa

SEQ ID NO: 323198 - DNA, 25 bp, Mus musculus
ggagaaggaatttcatttcaacaaa

SEQ ID NO: 323199 - DNA, 25 bp, Mus musculus
aacaaatacctgagccgtgcccgga

SEQ ID NO: 323200 - DNA, 25 bp, Mus musculus
accacgcgccagctgacggagctgg

SEQ ID NO: 323201 - DNA, 25 bp, Mus musculus
cgccaccctggagctcaatgaaacg

SEQ ID NO: 323202 - DNA, 25 bp, Mus musculus
ccaccctggagctcaatgaaacgca

SEQ ID NO: 323203 - DNA, 25 bp, Mus musculus
ctggagctcaatgaaacgcaggtga

SEQ ID NO: 323204 - DNA, 25 bp, Mus musculus
gagctcaatgaaacgcaggtgaaga

SEQ ID NO: 323205 - DNA, 25 bp, Mus musculus
cacaaacttcaccacgcgccagctg

SEQ ID NO: 323206 - DNA, 25 bp, Mus musculus
cgcccctagcgaaggtgtccgagct

SEQ ID NO: 323207 - DNA, 25 bp, Mus musculus
tagcgaaggtgtccgagctgggact

SEQ ID NO: 323208 - DNA, 25 bp, Mus musculus
tttcaacaaatacctgagccgtgcc

SEQ ID NO: 323209 - DNA, 25 bp, Mus musculus
cgataccggcttctccttccgggtg

SEQ ID NO: 323210 - DNA, 25 bp, Mus musculus
ccaggcctaagctgaaatccgcatc

SEQ ID NO: 323211 - DNA, 25 bp, Mus musculus
gctgaaatccgcatctttccggaaa

SEQ ID NO: 323212 - DNA, 25 bp, Mus musculus
gcatctttccggaaatcgctagggg

SEQ ID NO: 323213 - DNA, 25 bp, Mus musculus
cattaggcgggccaatcagcgctca

SEQ ID NO: 323214 - DNA, 25 bp, Mus musculus
gcgggccaatcagcgctcagggaac

SEQ ID NO: 323215 - DNA, 25 bp, Mus musculus
ctcagggaacgtgtttgaaggccga

SEQ ID NO: 323216 - DNA, 25 bp, Mus musculus
tcgctggtcagaggaggctctccat

SEQ ID NO: 323217 - DNA, 25 bp, Mus musculus
aagaccagggctctcagtggcgatc

SEQ ID NO: 323218 - DNA, 25 bp, Mus musculus
cggcttctccttccgggtgagtcgc

SEQ ID NO: 323219 - DNA, 25 bp, Mus musculus
cgcaccatatagtccgataccggct

SEQ ID NO: 323220 - DNA, 25 bp, Mus musculus
cagcaccgcaccatatagtccgata

SEQ ID NO: 323221 - DNA, 25 bp, Mus musculus
ggtcagaggaggctctccatcccgc

SEQ ID NO: 323222 - DNA, 25 bp, Mus musculus
ggctcccgacgggccaatcctgagt

SEQ ID NO: 323223 - DNA, 25 bp, Mus musculus
tggcagggaccacgacttcgtactc

SEQ ID NO: 323224 - DNA, 25 bp, Mus musculus
atctgtagtttctggccgactctta

SEQ ID NO: 323225 - DNA, 25 bp, Mus musculus
gactcttaatcccaaggtgccctgc

SEQ ID NO: 323226 - DNA, 25 bp, Mus musculus
gtgagaggctcttttgttcggctga

SEQ ID NO: 323227 - DNA, 25 bp, Mus musculus
tacgccgcttcagcgggacggtcga

SEQ ID NO: 323228 - DNA, 25 bp, Mus musculus
tcgacttgtggccacacggctcttt

SEQ ID NO: 323229 - DNA, 25 bp, Mus musculus
acacggctctttgctcctctgggcg

SEQ ID NO: 323230 - DNA, 25 bp, Mus musculus
tagcgcggcaccgattcctctcgga

SEQ ID NO: 323231 - DNA, 25 bp, Mus musculus
ccagcggagggttagcttttcaaga

SEQ ID NO: 323232 - DNA, 25 bp, Mus musculus
gaactggaccaagagcgtttgaccc

SEQ ID NO: 323233 - DNA, 25 bp, Mus musculus
cgtttgacccgagtgagggactcta

SEQ ID NO: 323234 - DNA, 25 bp, Mus musculus
cgcgcggtactttgggatctgtagt

SEQ ID NO: 323235 - DNA, 25 bp, Mus musculus
cggacacggtggcaatcgcaagcaa

SEQ ID NO: 323236 - DNA, 25 bp, Mus musculus
cgacttcgtactctcgaggtttaga

SEQ ID NO: 323237 - DNA, 25 bp, Mus musculus
ccggagcccgagattccgtccttga

SEQ ID NO: 323238 - DNA, 25 bp, Mus musculus
ataatggagcattgacgccggagcc

SEQ ID NO: 323239 - DNA, 25 bp, Mus musculus
cgacgcgcctccaagctttctggga

SEQ ID NO: 323240 - DNA, 25 bp, Mus musculus
acacggagcgacaagtgctactttg

SEQ ID NO: 323241 - DNA, 25 bp, Mus musculus
tgctggccttgacccacccttaaaa

SEQ ID NO: 323242 - DNA, 25 bp, Mus musculus
atcccacaagctttcggccctgttg

SEQ ID NO: 323243 - DNA, 25 bp, Mus musculus
tacccgctgctgaggtcacagtctg

SEQ ID NO: 323244 - DNA, 25 bp, Mus musculus
gagtcgtcaccggatgtcactttga

SEQ ID NO: 323245 - DNA, 25 bp, Mus musculus
aatagtcgagtttgtgtctgcccac

SEQ ID NO: 323246 - DNA, 25 bp, Mus musculus
aagtccaatgagtgtgcaggcccgc

SEQ ID NO: 323247 - DNA, 25 bp, Mus musculus
ccggtatggacccaccaatgagtga

SEQ ID NO: 323248 - DNA, 25 bp, Mus musculus
cgaaggccctagtgtccggcattct

SEQ ID NO: 323249 - DNA, 25 bp, Mus musculus
ttctgaacctctccgctgcgggttg

SEQ ID NO: 323250 - DNA, 25 bp, Mus musculus
gtgtgcctaggaatgcggtccttta

SEQ ID NO: 323251 - DNA, 25 bp, Mus musculus
cctacctaccactcatgagaaaatc

SEQ ID NO: 323252 - DNA, 25 bp, Mus musculus
gtgccatgaaccctagaccagcttt

SEQ ID NO: 323253 - DNA, 25 bp, Mus musculus
ggaaccggaagctggcaacccacag

SEQ ID NO: 323254 - DNA, 25 bp, Mus musculus
cctttcaattggctcttcacgcaga

SEQ ID NO: 323255 - DNA, 25 bp, Mus musculus
ttcacgcagagacgtcactacgccg

SEQ ID NO: 323256 - DNA, 25 bp, Mus musculus
actacgccggcgcagtgctacgtgt

SEQ ID NO: 323257 - DNA, 25 bp, Mus musculus
cagtgctacgtgtgtttctcccggc

SEQ ID NO: 323258 - DNA, 25 bp, Mus musculus
gcttcccgagcagaggccgacctga

SEQ ID NO: 323259 - DNA, 25 bp, Mus musculus
acctgagcgattcgggtctctccag

SEQ ID NO: 323260 - DNA, 25 bp, Mus musculus
cggtgtgggatcttggttcccgatt

SEQ ID NO: 323261 - DNA, 25 bp, Mus musculus
tcttggttcccgattgttcgcctcc

SEQ ID NO: 323262 - DNA, 25 bp, Mus musculus
ccttacttactggatggcggattga

SEQ ID NO: 323263 - DNA, 25 bp, Mus musculus
gcgtagagacacgtagctcaggaga

SEQ ID NO: 323264 - DNA, 25 bp, Mus musculus
cctttgtgccatgaaccctagacca

SEQ ID NO: 323265 - DNA, 25 bp, Mus musculus
acccgagccacggaacagcgggtag

SEQ ID NO: 323266 - DNA, 25 bp, Mus musculus
gcctaggttctgtgatacactccga

SEQ ID NO: 323267 - DNA, 25 bp, Mus musculus
gctggacataaggaggctcgtcgcc

SEQ ID NO: 323268 - DNA, 25 bp, Mus musculus
tcagctggacataaggaggctcgtc

SEQ ID NO: 323269 - DNA, 25 bp, Mus musculus
ctccagaatgatggccgcgcgcatc

SEQ ID NO: 323270 - DNA, 25 bp, Mus musculus
tgggttcccttgctccagaatgatg

SEQ ID NO: 323271 - DNA, 25 bp, Mus musculus
tggtctggttgggttcccttgctcc

SEQ ID NO: 323272 - DNA, 25 bp, Mus musculus
cagttataaccgacttgggtggccg

SEQ ID NO: 323273 - DNA, 25 bp, Mus musculus
actcgccgcagttataaccgacttg

SEQ ID NO: 323274 - DNA, 25 bp, Mus musculus
tgaagttctggggaactcgccgcag

SEQ ID NO: 323275 - DNA, 25 bp, Mus musculus
gaaaaagtttgtcctggagcgcacg

SEQ ID NO: 323276 - DNA, 25 bp, Mus musculus
ttacctcgggcttctaagctgggaa

SEQ ID NO: 323277 - DNA, 25 bp, Mus musculus
gggcaactgatttacctcgggcttc

SEQ ID NO: 323278 - DNA, 25 bp, Mus musculus
aggttctgtgatacactccgactcg

SEQ ID NO: 323279 - DNA, 25 bp, Mus musculus
gcggttttcagcagagccgtaaatc

SEQ ID NO: 323280 - DNA, 25 bp, Mus musculus
ggtgactgcgtggattcgtgctcac

SEQ ID NO: 323281 - DNA, 25 bp, Mus musculus
tgcaagtggctgtggggaagccaac

SEQ ID NO: 323282 - DNA, 25 bp, Mus musculus
cgctcccgctggtgactgcgtggat

SEQ ID NO: 323283 - DNA, 25 bp, Mus musculus
ttcagcagagccgtaaatcaggctg

SEQ ID NO: 323284 - DNA, 25 bp, Mus musculus
ccgtgcgagcggttttcagcagagc

SEQ ID NO: 323285 - DNA, 25 bp, Mus musculus
cttaccggacttgttgctgccgctg

SEQ ID NO: 323286 - DNA, 25 bp, Mus musculus
cgagcccacttaccggacttgttgc

SEQ ID NO: 323287 - DNA, 25 bp, Mus musculus
ggcgcacggctccagccgagcccac

SEQ ID NO: 323288 - DNA, 25 bp, Mus musculus
ggatgctgcgcatccgggaccacct

SEQ ID NO: 323289 - DNA, 25 bp, Mus musculus
cgtggattcgtgctcacgcgagttc

SEQ ID NO: 323290 - DNA, 25 bp, Mus musculus
gtgctcacgcgagttcgtgcaagtg

SEQ ID NO: 323291 - DNA, 25 bp, Mus musculus
cacgcgagttcgtgcaagtggctgt

SEQ ID NO: 323292 - DNA, 25 bp, Mus musculus
aaatcaggctgagccgggtcggctc

SEQ ID NO: 323293 - DNA, 25 bp, Mus musculus
ctctcacaggagcatcgcgcagcag

SEQ ID NO: 323294 - DNA, 25 bp, Mus musculus
gtcccaatctctgaactttctctcg

SEQ ID NO: 323295 - DNA, 25 bp, Mus musculus
cacctggaggtactacgggcacacc

SEQ ID NO: 323296 - DNA, 25 bp, Mus musculus
aacgcagagctttttggcagccgcc

SEQ ID NO: 323297 - DNA, 25 bp, Mus musculus
tccgtgtacctacgaggaggcgaag

SEQ ID NO: 323298 - DNA, 25 bp, Mus musculus
ttcacggcgacacatctcaaggatg

SEQ ID NO: 323299 - DNA, 25 bp, Mus musculus
cgtgtgtgtagagcatccgtgtacc

SEQ ID NO: 323300 - DNA, 25 bp, Mus musculus
tttcctgtgacccatacgctttcgg

SEQ ID NO: 323301 - DNA, 25 bp, Mus musculus
ctggaggttttcagcggctcccacg

SEQ ID NO: 323302 - DNA, 25 bp, Mus musculus
atccgtggtcctagagcgccacctg

SEQ ID NO: 323303 - DNA, 25 bp, Mus musculus
acctcagggtcctgggcctcgataa

SEQ ID NO: 323304 - DNA, 25 bp, Mus musculus
cccggtgtttctcactgatctctga

SEQ ID NO: 323305 - DNA, 25 bp, Mus musculus
acaccagagccagtgcgttgccctg

SEQ ID NO: 323306 - DNA, 25 bp, Mus musculus
aggcgacagacggaaggagattcac

SEQ ID NO: 323307 - DNA, 25 bp, Mus musculus
ttacacttgcacgatggcggtaggg

SEQ ID NO: 323308 - DNA, 25 bp, Mus musculus
gccgttttaggctgctttttcatca

SEQ ID NO: 323309 - DNA, 25 bp, Mus musculus
tgctttttcatcagcctggcgcgga

SEQ ID NO: 323310 - DNA, 25 bp, Mus musculus
cccagctagagaacgaacacatgcg

SEQ ID NO: 323311 - DNA, 25 bp, Mus musculus
gtcctagcaccttcccgatggcgtt

SEQ ID NO: 323312 - DNA, 25 bp, Mus musculus
ctccaggaagggatgttacacttgc

SEQ ID NO: 323313 - DNA, 25 bp, Mus musculus
cccgcccatcacgatgttctgattg

SEQ ID NO: 323314 - DNA, 25 bp, Mus musculus
agcagcttgctggtctggatgtcga

SEQ ID NO: 323315 - DNA, 25 bp, Mus musculus
ctgatggtcctggtgggaaatacga

SEQ ID NO: 323316 - DNA, 25 bp, Mus musculus
ggaatcccagagaagacccagtttc

SEQ ID NO: 323317 - DNA, 25 bp, Mus musculus
caccaatcctgagcggctgtgcttg

SEQ ID NO: 323318 - DNA, 25 bp, Mus musculus
gcttgagcctcagttccgaaacaaa

SEQ ID NO: 323319 - DNA, 25 bp, Mus musculus
acgtcgccgtcttcagcggagccaa

SEQ ID NO: 323320 - DNA, 25 bp, Mus musculus
acacatgcgcggaacaggtcctagc

SEQ ID NO: 323321 - DNA, 25 bp, Mus musculus
aacgtcacagtgacgctcagcagcc

SEQ ID NO: 323322 - DNA, 25 bp, Mus musculus
ggcagcggcagcacctctcgatccc

SEQ ID NO: 323323 - DNA, 25 bp, Mus musculus
catgtaagcagtcggccacgtgacc

SEQ ID NO: 323324 - DNA, 25 bp, Mus musculus
gcagcccgcacgtcatgtaagcagt

SEQ ID NO: 323325 - DNA, 25 bp, Mus musculus
agcagtcggccacgtgacccagcgt

SEQ ID NO: 323326 - DNA, 25 bp, Mus musculus
aggtctcctgaacgtcacagtgacg

SEQ ID NO: 323327 - DNA, 25 bp, Mus musculus
cgcaggtctcctgaacgtcacagtg

SEQ ID NO: 323328 - DNA, 25 bp, Mus musculus
gtccacttcgcaggtctcctgaacg

SEQ ID NO: 323329 - DNA, 25 bp, Mus musculus
gtgacggaggtagcccgtccacttc

SEQ ID NO: 323330 - DNA, 25 bp, Mus musculus
cccgacagcacaggtgacggaggta

SEQ ID NO: 323331 - DNA, 25 bp, Mus musculus
ctcttgcgcattggtcccaggtcca

SEQ ID NO: 323332 - DNA, 25 bp, Mus musculus
gtaactcttgcgcattggtcccagg

SEQ ID NO: 323333 - DNA, 25 bp, Mus musculus
cccgcggtaactcttgcgcattggt

SEQ ID NO: 323334 - DNA, 25 bp, Mus musculus
cgcacgtcatgtaagcagtcggcca

SEQ ID NO: 323335 - DNA, 25 bp, Mus musculus
aggacccaccgctcattacgacatc

SEQ ID NO: 323336 - DNA, 25 bp, Mus musculus
gagagcctgacaccgcccgcctagc

SEQ ID NO: 323337 - DNA, 25 bp, Mus musculus
ccgccgccaccgagagcctgacacc

SEQ ID NO: 323338 - DNA, 25 bp, Mus musculus
gctcattacgacatcttcctccctg

SEQ ID NO: 323339 - DNA, 25 bp, Mus musculus
cgtcggccgcctgcgtggagcaaac

SEQ ID NO: 323340 - DNA, 25 bp, Mus musculus
ccggcagacgccaggacccaccgct

SEQ ID NO: 323341 - DNA, 25 bp, Mus musculus
tctgtccgtcttcccgacccttgag

SEQ ID NO: 323342 - DNA, 25 bp, Mus musculus
cgaagggggttatcaggctcgccct

SEQ ID NO: 323343 - DNA, 25 bp, Mus musculus
aaggcccggcgcgacccaagctgag

SEQ ID NO: 323344 - DNA, 25 bp, Mus musculus
aaactcgggcgcaggctgaaggccc

SEQ ID NO: 323345 - DNA, 25 bp, Mus musculus
ccgcctgcgtggagcaaactcgggc

SEQ ID NO: 323346 - DNA, 25 bp, Mus musculus
tcggccgcctgcgtggagcaaactc

SEQ ID NO: 323347 - DNA, 25 bp, Mus musculus
accgcccgcctagcacccgccaatc

SEQ ID NO: 323348 - DNA, 25 bp, Mus musculus
cgacatcttcctccctggcctccgc

SEQ ID NO: 323349 - DNA, 25 bp, Mus musculus
gagccaaataattgcctcctgcttt

SEQ ID NO: 323350 - DNA, 25 bp, Mus musculus
aggcaactccctcccggtccaagct

SEQ ID NO: 323351 - DNA, 25 bp, Mus musculus
tgagagtggaccctgaaccccaact

SEQ ID NO: 323352 - DNA, 25 bp, Mus musculus
cgccctctgcaaggccggggtgttc

SEQ ID NO: 323353 - DNA, 25 bp, Mus musculus
ccctcccactggagccaaataattg

SEQ ID NO: 323354 - DNA, 25 bp, Mus musculus
ctcctgctttgttgtgtggtgtctg

SEQ ID NO: 323355 - DNA, 25 bp, Mus musculus
cctctcatttgtggggacgtgctgt

SEQ ID NO: 323356 - DNA, 25 bp, Mus musculus
acgtgctgtggcgagagcctccctg

SEQ ID NO: 323357 - DNA, 25 bp, Mus musculus
gcgagagcctccctgcgtaattacc

SEQ ID NO: 323358 - DNA, 25 bp, Mus musculus
gagagcctccctgcgtaattaccct

SEQ ID NO: 323359 - DNA, 25 bp, Mus musculus
cggcccagacgcaggcaactccctc

SEQ ID NO: 323360 - DNA, 25 bp, Mus musculus
aattgcctcctgctttgttgtgtgg

SEQ ID NO: 323361 - DNA, 25 bp, Mus musculus
ccaagctgtcctttcccggcagaga

SEQ ID NO: 323362 - DNA, 25 bp, Mus musculus
cctgcgtccgctgggccttactcac

SEQ ID NO: 323363 - DNA, 25 bp, Mus musculus
tcccacgccgctgagagccggccag

SEQ ID NO: 323364 - DNA, 25 bp, Mus musculus
ccaagcctgcaagggttaaaggcgg

SEQ ID NO: 323365 - DNA, 25 bp, Mus musculus
tcgcttactcgctcaccggcgcccg

SEQ ID NO: 323366 - DNA, 25 bp, Mus musculus
cgccggctctcactgcctccaccgt

SEQ ID NO: 323367 - DNA, 25 bp, Mus musculus
tgcctccaccgtcgcggatcaccca

SEQ ID NO: 323368 - DNA, 25 bp, Mus musculus
tgccctcggctcctgtcccacgccg

SEQ ID NO: 323369 - DNA, 25 bp, Mus musculus
gcctccagccaagcctgcaagggtt

SEQ ID NO: 323370 - DNA, 25 bp, Mus musculus
atgagcgcccgtctgtagcgcgcca

SEQ ID NO: 323371 - DNA, 25 bp, Mus musculus
gtgttcggaacaccgcagcctaagc

SEQ ID NO: 323372 - DNA, 25 bp, Mus musculus
caccgcagcctaagctggcttcttg

SEQ ID NO: 323373 - DNA, 25 bp, Mus musculus
gcagcctaagctggcttcttgggga

SEQ ID NO: 323374 - DNA, 25 bp, Mus musculus
acgtcctaaaggatccgaagggctg

SEQ ID NO: 323375 - DNA, 25 bp, Mus musculus
ccagccaagcctgcaagggttaaag

SEQ ID NO: 323376 - DNA, 25 bp, Mus musculus
cagggcccatgagcgcccgtctgta

SEQ ID NO: 323377 - DNA, 25 bp, Mus musculus
ggccgactcacccaggcacagagga

SEQ ID NO: 323378 - DNA, 25 bp, Mus musculus
tgcgaggacctggaaagtgacagtc

SEQ ID NO: 323379 - DNA, 25 bp, Mus musculus
gggacccttttccaagctcctgcag

SEQ ID NO: 323380 - DNA, 25 bp, Mus musculus
gccggacatgtcacaccactatgaa

SEQ ID NO: 323381 - DNA, 25 bp, Mus musculus
tatgaatcgtggttccggccgactc

SEQ ID NO: 323382 - DNA, 25 bp, Mus musculus
ccatactcagggagcgctgacctca

SEQ ID NO: 323383 - DNA, 25 bp, Mus musculus
tacgtcggagaccatcagctctgtg

SEQ ID NO: 323384 - DNA, 25 bp, Mus musculus
cacaagagtcccaagggctggattc

SEQ ID NO: 323385 - DNA, 25 bp, Mus musculus
attccagtctggatgcagcgtcccg

SEQ ID NO: 323386 - DNA, 25 bp, Mus musculus
ggcatacgctaagacgtcgcatctg

SEQ ID NO: 323387 - DNA, 25 bp, Mus musculus
cggtgaccgacccttcgtgtgcaac

SEQ ID NO: 323388 - DNA, 25 bp, Mus musculus
gtctgcagccgagtcttcatgcgca

SEQ ID NO: 323389 - DNA, 25 bp, Mus musculus
cggaggtagacttttcacagggcta

SEQ ID NO: 323390 - DNA, 25 bp, Mus musculus
tcagcctgctttgggaggatacgtc

SEQ ID NO: 323391 - DNA, 25 bp, Mus musculus
gtctcgcgtcgttgctaggagactg

SEQ ID NO: 323392 - DNA, 25 bp, Mus musculus
taaggagtggcccagggcctccctg

SEQ ID NO: 323393 - DNA, 25 bp, Mus musculus
gggatcctccgtggaggtctcccgc

SEQ ID NO: 323394 - DNA, 25 bp, Mus musculus
acttcctgtagcgatggctgcggcg

SEQ ID NO: 323395 - DNA, 25 bp, Mus musculus
tgggaacttcctgtagcgatggctg

SEQ ID NO: 323396 - DNA, 25 bp, Mus musculus
cgcgcagcgcgcatgggaacttcct

SEQ ID NO: 323397 - DNA, 25 bp, Mus musculus
ttagctacttccgtctccgcgcagc

SEQ ID NO: 323398 - DNA, 25 bp, Mus musculus
aggcgccacgcccactatttccggg

SEQ ID NO: 323399 - DNA, 25 bp, Mus musculus
acgcatgcgcatagcggccctatca

SEQ ID NO: 323400 - DNA, 25 bp, Mus musculus
gcaggatggcgctctctagccctcg

SEQ ID NO: 323401 - DNA, 25 bp, Mus musculus
gactggacgccaggtctgacggaac

SEQ ID NO: 323402 - DNA, 25 bp, Mus musculus
ttccttgaggtctcgcgtcgttgct

SEQ ID NO: 323403 - DNA, 25 bp, Mus musculus
cctgcacgcaggatggcgctctcta

SEQ ID NO: 323404 - DNA, 25 bp, Mus musculus
agaaagaggcccagctccacgcatg

SEQ ID NO: 323405 - DNA, 25 bp, Mus musculus
cggcgtccgaagaccaatgaaactt

SEQ ID NO: 323406 - DNA, 25 bp, Mus musculus
gatgatcatctctgtctggtgctgg

SEQ ID NO: 323407 - DNA, 25 bp, Mus musculus
tgctggttgaacttggaccacaaca

SEQ ID NO: 323408 - DNA, 25 bp, Mus musculus
cacaacaggtggttgctgagcgcga

SEQ ID NO: 323409 - DNA, 25 bp, Mus musculus
gaaggatccaaggaagcgacccggc

SEQ ID NO: 323410 - DNA, 25 bp, Mus musculus
tgaaacttcactggagcgggagctg

SEQ ID NO: 323411 - DNA, 25 bp, Mus musculus
agaaacgatgctgttggtccgctcc

SEQ ID NO: 323412 - DNA, 25 bp, Mus musculus
gtgccggtcagcatgtctccgcagc

SEQ ID NO: 323413 - DNA, 25 bp, Mus musculus
tccagcagccgtcgaagagacccga

SEQ ID NO: 323414 - DNA, 25 bp, Mus musculus
ccgtccttgcttagtgatgatcatc

SEQ ID NO: 323415 - DNA, 25 bp, Mus musculus
aggcccgggaaagccagccacctga

SEQ ID NO: 323416 - DNA, 25 bp, Mus musculus
cacgatgcccatccgaggcgggctg

SEQ ID NO: 323417 - DNA, 25 bp, Mus musculus
gcccggctcgggatagaagaaacga

SEQ ID NO: 323418 - DNA, 25 bp, Mus musculus
gcagctgctcctgggctttctctgc

SEQ ID NO: 323419 - DNA, 25 bp, Mus musculus
tccggggctcttgactgctgccaac

SEQ ID NO: 323420 - DNA, 25 bp, Mus musculus
cacgtgcgcccagtactgtcaggga

SEQ ID NO: 323421 - DNA, 25 bp, Mus musculus
cgagctaactagacgtctgggcagc

SEQ ID NO: 323422 - DNA, 25 bp, Mus musculus
tcccagacagacgacaggtcacctg

SEQ ID NO: 323423 - DNA, 25 bp, Mus musculus
cggcgcagtcactgggcacaaccgt

SEQ ID NO: 323424 - DNA, 25 bp, Mus musculus
gcacaaccgtgggactccgtctgtc

SEQ ID NO: 323425 - DNA, 25 bp, Mus musculus
ccgtctgtctcggattaatcccgga

SEQ ID NO: 323426 - DNA, 25 bp, Mus musculus
accacactgctggtgttgctgaccg

SEQ ID NO: 323427 - DNA, 25 bp, Mus musculus
agttgcctcactttcctgcgctcag

SEQ ID NO: 323428 - DNA, 25 bp, Mus musculus
ctcagtaggcgttcggagcagaaac

SEQ ID NO: 323429 - DNA, 25 bp, Mus musculus
cccacccgctcagtgtgagagttga

SEQ ID NO: 323430 - DNA, 25 bp, Mus musculus
ccctggtcaaggtcggaacctctga

SEQ ID NO: 323431 - DNA, 25 bp, Mus musculus
tcccggtcagagatgcgaccctcag

SEQ ID NO: 323432 - DNA, 25 bp, Mus musculus
gactggagtgcgaaccaacgcgccc

SEQ ID NO: 323433 - DNA, 25 bp, Mus musculus
ctcgcttaagccctgcggtagcaga

SEQ ID NO: 323434 - DNA, 25 bp, Mus musculus
tgtagccgtgtgagccagcatcaaa

SEQ ID NO: 323435 - DNA, 25 bp, Mus musculus
cgtgtaatgcaaggtgctgcttgta

SEQ ID NO: 323436 - DNA, 25 bp, Mus musculus
acctgccggtcttccaaggcttgca

SEQ ID NO: 323437 - DNA, 25 bp, Mus musculus
cacgcctgaagggtgcaccgaagga

SEQ ID NO: 323438 - DNA, 25 bp, Mus musculus
cgcttttcaaatcggccgtgccttg

SEQ ID NO: 323439 - DNA, 25 bp, Mus musculus
agaccagacttggtacggccgagcg

SEQ ID NO: 323440 - DNA, 25 bp, Mus musculus
tctcgggtctccgtgctgttttaaa

SEQ ID NO: 323441 - DNA, 25 bp, Mus musculus
gcggttggtgcaatctgcagctgca

SEQ ID NO: 323442 - DNA, 25 bp, Mus musculus
cactagccgacaaaacccaggcggg

SEQ ID NO: 323443 - DNA, 25 bp, Mus musculus
cccggacttgctcttcgtatttagg

SEQ ID NO: 323444 - DNA, 25 bp, Mus musculus
ggtctgttcagagtctcgggtctcc

SEQ ID NO: 323445 - DNA, 25 bp, Mus musculus
cagcatcaaactgtggggcgccgcg

SEQ ID NO: 323446 - DNA, 25 bp, Mus musculus
agagaggctcctagtacgcttgcgc

SEQ ID NO: 323447 - DNA, 25 bp, Mus musculus
aaagcgcaggcggatgccctcaaag

SEQ ID NO: 323448 - DNA, 25 bp, Mus musculus
ggaagcccgcacagaatgaagcgca

SEQ ID NO: 323449 - DNA, 25 bp, Mus musculus
cgcacagaatgaagcgcagcggatg

SEQ ID NO: 323450 - DNA, 25 bp, Mus musculus
gccggcatagcccactcctcttctt

SEQ ID NO: 323451 - DNA, 25 bp, Mus musculus
ctgcttctcaaagcgcaggcggatg

SEQ ID NO: 323452 - DNA, 25 bp, Mus musculus
aagcgcagcggatggtgcccgcttc

SEQ ID NO: 323453 - DNA, 25 bp, Mus musculus
aggcggatgccctcaaaggctcggc

SEQ ID NO: 323454 - DNA, 25 bp, Mus musculus
tgccgtagagctcgccgccataggc

SEQ ID NO: 323455 - DNA, 25 bp, Mus musculus
aagtgtggcagcctcggcctgtagc

SEQ ID NO: 323456 - DNA, 25 bp, Mus musculus
agctccgagtagctgcggcggccct

SEQ ID NO: 323457 - DNA, 25 bp, Mus musculus
cggcttggcgtagacacgctcggcc

SEQ ID NO: 323458 - DNA, 25 bp, Mus musculus
ggcgtagacacgctcggccagcgtc

SEQ ID NO: 323459 - DNA, 25 bp, Mus musculus
tcagatggctgcttctcaaagcgca

SEQ ID NO: 323460 - DNA, 25 bp, Mus musculus
ctcttcttcagatggctgcttctca

SEQ ID NO: 323461 - DNA, 25 bp, Mus musculus
tctgccgaccagagctcactacaca

SEQ ID NO: 323462 - DNA, 25 bp, Mus musculus
ctttaaccctctcttgcccacgcca

SEQ ID NO: 323463 - DNA, 25 bp, Mus musculus
cccactctcgaggactccgtgtccc

SEQ ID NO: 323464 - DNA, 25 bp, Mus musculus
tccctgcccacgatctccggccatc

SEQ ID NO: 323465 - DNA, 25 bp, Mus musculus
acaggtctgagtaaggagcgtgtgc

SEQ ID NO: 323466 - DNA, 25 bp, Mus musculus
agcgacagacgcgtgtgacaggtct

SEQ ID NO: 323467 - DNA, 25 bp, Mus musculus
cgcgtgtttgaagggctggccccac

SEQ ID NO: 323468 - DNA, 25 bp, Mus musculus
cagcctcggctaagtgccggagcga

SEQ ID NO: 323469 - DNA, 25 bp, Mus musculus
cggttgccaccaccacgtggcgagg

SEQ ID NO: 323470 - DNA, 25 bp, Mus musculus
ggtctctccagctggaccggcgccc

SEQ ID NO: 323471 - DNA, 25 bp, Mus musculus
ggctcggcggacagaaactgtcgcc

SEQ ID NO: 323472 - DNA, 25 bp, Mus musculus
ctaagtgccggagcgacagacgcgt

SEQ ID NO: 323473 - DNA, 25 bp, Mus musculus
tgccttcctccgcatcctggggccg

SEQ ID NO: 323474 - DNA, 25 bp, Mus musculus
cgagttccgacagtgcaggcctcgg

SEQ ID NO: 323475 - DNA, 25 bp, Mus musculus
ctgggatcctggacgttgataggac

SEQ ID NO: 323476 - DNA, 25 bp, Mus musculus
gtaaaggctccaggcgcgtcggatt

SEQ ID NO: 323477 - DNA, 25 bp, Mus musculus
cttctcgaggatggttatgagctcc

SEQ ID NO: 323478 - DNA, 25 bp, Mus musculus
ctacccggagacacggtcttctcga

SEQ ID NO: 323479 - DNA, 25 bp, Mus musculus
cagctccagccgatctgccgggaga

SEQ ID NO: 323480 - DNA, 25 bp, Mus musculus
tcgaggaacttctgcgccgcttcca

SEQ ID NO: 323481 - DNA, 25 bp, Mus musculus
ggggcggcacgcaccagattctcca

SEQ ID NO: 323482 - DNA, 25 bp, Mus musculus
cctcctaatgtgctaggcggcagca

SEQ ID NO: 323483 - DNA, 25 bp, Mus musculus
ccgctgattgggctggcccggtaaa

SEQ ID NO: 323484 - DNA, 25 bp, Mus musculus
cgcccattggcctgcgggcttcaag

SEQ ID NO: 323485 - DNA, 25 bp, Mus musculus
gcgctgcccagcgattggctacggc

SEQ ID NO: 323486 - DNA, 25 bp, Mus musculus
cggagggatatccttgccggacctc

SEQ ID NO: 323487 - DNA, 25 bp, Mus musculus
ttatgagctccatggcggaggtgac

SEQ ID NO: 323488 - DNA, 25 bp, Mus musculus
acggccgcacgctcgaggaacttct

SEQ ID NO: 323489 - DNA, 25 bp, Mus musculus
gggacggcggctgccagccacattc

SEQ ID NO: 323490 - DNA, 25 bp, Mus musculus
cctcgaaggtgaagtccagcaaatc

SEQ ID NO: 323491 - DNA, 25 bp, Mus musculus
aggctgtagttgatgggcgacacct

SEQ ID NO: 323492 - DNA, 25 bp, Mus musculus
ctcctcgctctcaagtgcctgatga

SEQ ID NO: 323493 - DNA, 25 bp, Mus musculus
ggcagccgctcgaagggccgcttct

SEQ ID NO: 323494 - DNA, 25 bp, Mus musculus
agtccagcaaatcgggcttgaggca

SEQ ID NO: 323495 - DNA, 25 bp, Mus musculus
ccagcttgccctcgaaggtgaagtc

SEQ ID NO: 323496 - DNA, 25 bp, Mus musculus
ggcctccagcttgccctcgaaggtg

SEQ ID NO: 323497 - DNA, 25 bp, Mus musculus
cccacccagcctctcccggagctcg

SEQ ID NO: 323498 - DNA, 25 bp, Mus musculus
gagcaggcagtcctagccccttcta

SEQ ID NO: 323499 - DNA, 25 bp, Mus musculus
cagtccgcaggggtgccaccgagca

SEQ ID NO: 323500 - DNA, 25 bp, Mus musculus
aaagaacgcagtccgcaggggtgcc

SEQ ID NO: 323501 - DNA, 25 bp, Mus musculus
gggacgaccaggaaagaacgcagtc

SEQ ID NO: 323502 - DNA, 25 bp, Mus musculus
tcgctctcaagtgcctgatgaccgc

SEQ ID NO: 323503 - DNA, 25 bp, Mus musculus
cgtgacagccgtgcggtttacccta

SEQ ID NO: 323504 - DNA, 25 bp, Mus musculus
ctttgcgcgagcaaaatggcggccc

SEQ ID NO: 323505 - DNA, 25 bp, Mus musculus
atcccggcggcctttgcgcgagcaa

SEQ ID NO: 323506 - DNA, 25 bp, Mus musculus
ctaggctagcatcccggcggccttt

SEQ ID NO: 323507 - DNA, 25 bp, Mus musculus
tgatctgcggctaggctagcatccc

SEQ ID NO: 323508 - DNA, 25 bp, Mus musculus
cttttctccggctcggtgatctgcg

SEQ ID NO: 323509 - DNA, 25 bp, Mus musculus
tgcgccttttctccggctcggtgat

SEQ ID NO: 323510 - DNA, 25 bp, Mus musculus
gcgcgactcacctttcggcctgggg

SEQ ID NO: 323511 - DNA, 25 bp, Mus musculus
cgcgaacccactgcgcgtgcccgcg

SEQ ID NO: 323512 - DNA, 25 bp, Mus musculus
ccctacttccaaagtggtttcattg

SEQ ID NO: 323513 - DNA, 25 bp, Mus musculus
tccgactggcgcgtgacagccgtgc

SEQ ID NO: 323514 - DNA, 25 bp, Mus musculus
gtttcattgcgcacgcgcgaaccca

SEQ ID NO: 323515 - DNA, 25 bp, Mus musculus
agtggtttcattgcgcacgcgcgaa

SEQ ID NO: 323516 - DNA, 25 bp, Mus musculus
tccaaagtggtttcattgcgcacgc

SEQ ID NO: 323517 - DNA, 25 bp, Mus musculus
ttcttggacagggtccgtctcagcg

SEQ ID NO: 323518 - DNA, 25 bp, Mus musculus
gaagccttcttggacagggtccgtc

SEQ ID NO: 323519 - DNA, 25 bp, Mus musculus
acagggtccgtctcagcgtggagtc

SEQ ID NO: 323520 - DNA, 25 bp, Mus musculus
tcgaaggggagagtgttatgttccc

SEQ ID NO: 323521 - DNA, 25 bp, Mus musculus
gagtgttatgttccctgtggtggtc

SEQ ID NO: 323522 - DNA, 25 bp, Mus musculus
ttccctgtggtggtcataagtgctg

SEQ ID NO: 323523 - DNA, 25 bp, Mus musculus
tggtcataagtgctgcgggtcttgc

SEQ ID NO: 323524 - DNA, 25 bp, Mus musculus
gcttctccgtttcttgaaggctgga

SEQ ID NO: 323525 - DNA, 25 bp, Mus musculus
ctccgtttcttgaaggctggagctg

SEQ ID NO: 323526 - DNA, 25 bp, Mus musculus
agctgaggagccttcgtcgggaaga

SEQ ID NO: 323527 - DNA, 25 bp, Mus musculus
ccgagagagcccgagtcccgagagt

SEQ ID NO: 323528 - DNA, 25 bp, Mus musculus
agagagcccgagtcccgagagtgct

SEQ ID NO: 323529 - DNA, 25 bp, Mus musculus
ggtggcttctccgtttcttgaaggc

SEQ ID NO: 323530 - DNA, 25 bp, Mus musculus
tctgccaacgactctcggccgtctg

SEQ ID NO: 323531 - DNA, 25 bp, Mus musculus
tgagccgcctcctcggctatggaga

SEQ ID NO: 323532 - DNA, 25 bp, Mus musculus
gcctcctcggctatggagaggccgc

SEQ ID NO: 323533 - DNA, 25 bp, Mus musculus
cgcctcagctgatggtgttccgcaa

SEQ ID NO: 323534 - DNA, 25 bp, Mus musculus
tcagctgatggtgttccgcaacgtg

SEQ ID NO: 323535 - DNA, 25 bp, Mus musculus
gctggatcccaaggccctcccgccg

SEQ ID NO: 323536 - DNA, 25 bp, Mus musculus
atcaagactgccggcggaggctgct

SEQ ID NO: 323537 - DNA, 25 bp, Mus musculus
acccgacggagacgagcgacgcgct

SEQ ID NO: 323538 - DNA, 25 bp, Mus musculus
cttggaatcggaggccgagagcctg

SEQ ID NO: 323539 - DNA, 25 bp, Mus musculus
gcctggagactaacagctgctcgga

SEQ ID NO: 323540 - DNA, 25 bp, Mus musculus
aacagctgctcggaagaggagctca

SEQ ID NO: 323541 - DNA, 25 bp, Mus musculus
gctcggaagaggagctcagcagccc

SEQ ID NO: 323542 - DNA, 25 bp, Mus musculus
aggacttggtccctccagggcgctt

SEQ ID NO: 323543 - DNA, 25 bp, Mus musculus
cggccgcttcgtaccgggtcctgag

SEQ ID NO: 323544 - DNA, 25 bp, Mus musculus
ttggtccctccagggcgcttgagcc

SEQ ID NO: 323545 - DNA, 25 bp, Mus musculus
ggccacacagctggtggtggtgcca

SEQ ID NO: 323546 - DNA, 25 bp, Mus musculus
cttttctatggagcgcgtgaggagc

SEQ ID NO: 323547 - DNA, 25 bp, Mus musculus
cgccgtcgtttcctctgcccaagtt

SEQ ID NO: 323548 - DNA, 25 bp, Mus musculus
aacagctgcgctaggcaagggcttt

SEQ ID NO: 323549 - DNA, 25 bp, Mus musculus
tcccgctggaagaacagctgcgcta

SEQ ID NO: 323550 - DNA, 25 bp, Mus musculus
cttgctgtcccgctggaagaacagc

SEQ ID NO: 323551 - DNA, 25 bp, Mus musculus
gcactgccgtgggagcttgctgtcc

SEQ ID NO: 323552 - DNA, 25 bp, Mus musculus
tttctgcctggtcgggatcccgccg

SEQ ID NO: 323553 - DNA, 25 bp, Mus musculus
cggcccgatgaatggagtcgctttc

SEQ ID NO: 323554 - DNA, 25 bp, Mus musculus
ccactgcggcccgatgaatggagtc

SEQ ID NO: 323555 - DNA, 25 bp, Mus musculus
cctttacttttctatggagcgcgtg

SEQ ID NO: 323556 - DNA, 25 bp, Mus musculus
tctgggggcggagctattagaaccc

SEQ ID NO: 323557 - DNA, 25 bp, Mus musculus
gcctggtctggagtttggcttctac

SEQ ID NO: 323558 - DNA, 25 bp, Mus musculus
gaatggagtcgctttctgcctggtc

SEQ ID NO: 323559 - DNA, 25 bp, Mus musculus
gtctgtccaagcgacttgttggctt

SEQ ID NO: 323560 - DNA, 25 bp, Mus musculus
atcgggttacccactctcgagttga

SEQ ID NO: 323561 - DNA, 25 bp, Mus musculus
gctgtgggcgatcgggttacccact

SEQ ID NO: 323562 - DNA, 25 bp, Mus musculus
tgtgcctgagcagggaccgctcgaa

SEQ ID NO: 323563 - DNA, 25 bp, Mus musculus
ccagggtgagcaatagctttggagc

SEQ ID NO: 323564 - DNA, 25 bp, Mus musculus
tgtctgagccacagcgaccgctgca

SEQ ID NO: 323565 - DNA, 25 bp, Mus musculus
accgcacgtccagctccggaagcca

SEQ ID NO: 323566 - DNA, 25 bp, Mus musculus
cgagccttggagtcccgcaccgcac

SEQ ID NO: 323567 - DNA, 25 bp, Mus musculus
gctccagccgtcctgccgccgtccg

SEQ ID NO: 323568 - DNA, 25 bp, Mus musculus
cgctccggcggttgccttcacccgg

SEQ ID NO: 323569 - DNA, 25 bp, Mus musculus
gcgacttgttggcttgtccctgccc

SEQ ID NO: 323570 - DNA, 25 bp, Mus musculus
agggaccgctcgaagcctctggcgt

SEQ ID NO: 323571 - DNA, 25 bp, Mus musculus
ggaggtgtctgtccaagcgacttgt

SEQ ID NO: 323572 - DNA, 25 bp, Mus musculus
cgggttacccactctcgagttgacg

SEQ ID NO: 323573 - DNA, 25 bp, Mus musculus
cctgcgccagtggaagcgcgtctat

SEQ ID NO: 323574 - DNA, 25 bp, Mus musculus
tcctgcctggtggacatctcctaca

SEQ ID NO: 323575 - DNA, 25 bp, Mus musculus
gcctggtggacatctcctacagcga

SEQ ID NO: 323576 - DNA, 25 bp, Mus musculus
gtctatgccgtcctgcgggcgcgct

SEQ ID NO: 323577 - DNA, 25 bp, Mus musculus
ggtggacatctcctacagcgagacc

SEQ ID NO: 323578 - DNA, 25 bp, Mus musculus
atctcctacagcgagaccaaaagga

SEQ ID NO: 323579 - DNA, 25 bp, Mus musculus
aaaaggaggcacgtgttccggctga

SEQ ID NO: 323580 - DNA, 25 bp, Mus musculus
cgagaccaaaaggaggcacgtgttc

SEQ ID NO: 323581 - DNA, 25 bp, Mus musculus
cgctcgctctcgttgagcaaggagc

SEQ ID NO: 323582 - DNA, 25 bp, Mus musculus
aggcggcgcccgtctgcatcggctc

SEQ ID NO: 323583 - DNA, 25 bp, Mus musculus
aagcgcgtctatgccgtcctgcggg

SEQ ID NO: 323584 - DNA, 25 bp, Mus musculus
tcgctctcgttgagcaaggagcggc

SEQ ID NO: 323585 - DNA, 25 bp, Mus musculus
gaggcacgtgttccggctgaccacc

SEQ ID NO: 323586 - DNA, 25 bp, Mus musculus
agtggaagcgcgtctatgccgtcct

SEQ ID NO: 323587 - DNA, 25 bp, Mus musculus
cggagagaccaaccgacagttcctc

SEQ ID NO: 323588 - DNA, 25 bp, Mus musculus
gacagcgcaacccaggctggggtct

SEQ ID NO: 323589 - DNA, 25 bp, Mus musculus
accgacagttcctcattggtcggga

SEQ ID NO: 323590 - DNA, 25 bp, Mus musculus
gtcgggatgaccaatccgcagcacc

SEQ ID NO: 323591 - DNA, 25 bp, Mus musculus
tgggccgctgtctttgatggcaatc

SEQ ID NO: 323592 - DNA, 25 bp, Mus musculus
ccgctgtctttgatggcaatcacga

SEQ ID NO: 323593 - DNA, 25 bp, Mus musculus
cccaataggcgaaccggctccggat

SEQ ID NO: 323594 - DNA, 25 bp, Mus musculus
taggcgaaccggctccggatggaaa

SEQ ID NO: 323595 - DNA, 25 bp, Mus musculus
cgatcagccgcccttctgcataaaa

SEQ ID NO: 323596 - DNA, 25 bp, Mus musculus
cttctgcataaaaacccagggtaga

SEQ ID NO: 323597 - DNA, 25 bp, Mus musculus
acccagggtagagcgaatcagtcca

SEQ ID NO: 323598 - DNA, 25 bp, Mus musculus
cagtccaaggacagcgcaacccagg

SEQ ID NO: 323599 - DNA, 25 bp, Mus musculus
tagagcgaatcagtccaaggacagc

SEQ ID NO: 323600 - DNA, 25 bp, Mus musculus
tggcaatcacgaaatggtcatagag

SEQ ID NO: 323601 - DNA, 25 bp, Mus musculus
taccaaagcactttgggagtcccgc

SEQ ID NO: 323602 - DNA, 25 bp, Mus musculus
cttcccttacggtgatgaaacgcag

SEQ ID NO: 323603 - DNA, 25 bp, Mus musculus
cgctcaaactctcggccgtctcaaa

SEQ ID NO: 323604 - DNA, 25 bp, Mus musculus
tcaaatccggaggactgaaatcgcg

SEQ ID NO: 323605 - DNA, 25 bp, Mus musculus
catgaaggccttccggaaaagattc

SEQ ID NO: 323606 - DNA, 25 bp, Mus musculus
gcgggacatgaaggccttccggaaa

SEQ ID NO: 323607 - DNA, 25 bp, Mus musculus
caccgcgcatgcaaatgggtggagc

SEQ ID NO: 323608 - DNA, 25 bp, Mus musculus
tgaaacgcagggtaaactaccaatc

SEQ ID NO: 323609 - DNA, 25 bp, Mus musculus
tcaaagccctcgctagctaccaaag

SEQ ID NO: 323610 - DNA, 25 bp, Mus musculus
ttgcagtgacttgggcctcctttct

SEQ ID NO: 323611 - DNA, 25 bp, Mus musculus
gacgctggaccttgcagtgacttgg

SEQ ID NO: 323612 - DNA, 25 bp, Mus musculus
tgtgcccgctgtcactcagcgggga

SEQ ID NO: 323613 - DNA, 25 bp, Mus musculus
tgcaagtcccgccctttgtaagtcc

SEQ ID NO: 323614 - DNA, 25 bp, Mus musculus
cactttgggagtcccgccctttgca

SEQ ID NO: 323615 - DNA, 25 bp, Mus musculus
gtggcaccgccgacgacatgctggc

SEQ ID NO: 323616 - DNA, 25 bp, Mus musculus
cccgggagatgctggcgatctcctt

SEQ ID NO: 323617 - DNA, 25 bp, Mus musculus
cgatctccttcatctctgcggtcaa

SEQ ID NO: 323618 - DNA, 25 bp, Mus musculus
tgcggtcaaccgcaaacggaagaag

SEQ ID NO: 323619 - DNA, 25 bp, Mus musculus
cctgggcagcagcaccgacgatgac

SEQ ID NO: 323620 - DNA, 25 bp, Mus musculus
gcaccgacgatgactccgagcagga

SEQ ID NO: 323621 - DNA, 25 bp, Mus musculus
ccaccatggaccgtagcgtgtgctc

SEQ ID NO: 323622 - DNA, 25 bp, Mus musculus
acgacgaacgcagcgagctgagcca

SEQ ID NO: 323623 - DNA, 25 bp, Mus musculus
agctgagccacgtggagacggacac

SEQ ID NO: 323624 - DNA, 25 bp, Mus musculus
tcggcatcgtccagcagccaggagt

SEQ ID NO: 323625 - DNA, 25 bp, Mus musculus
cggctcacgaccttcgcgcgtggaa

SEQ ID NO: 323626 - DNA, 25 bp, Mus musculus
tgaccgacctcaacttcaacgagtg

SEQ ID NO: 323627 - DNA, 25 bp, Mus musculus
gaagccctgcggctacgtctccgtg

SEQ ID NO: 323628 - DNA, 25 bp, Mus musculus
atctcatgccatgcgacactctggc

SEQ ID NO: 323629 - DNA, 25 bp, Mus musculus
caccgactcctggttctggagctgc

SEQ ID NO: 323630 - DNA, 25 bp, Mus musculus
agctgcggaacgcaagaatgctcgc

SEQ ID NO: 323631 - DNA, 25 bp, Mus musculus
accgggtggaaggaggacgcatgtt

SEQ ID NO: 323632 - DNA, 25 bp, Mus musculus
tgcggaacgcaagaatgctcgcgtg

SEQ ID NO: 323633 - DNA, 25 bp, Mus musculus
cgtcgttgaggtaacgcaaacgctc

SEQ ID NO: 323634 - DNA, 25 bp, Mus musculus
actcctggttctggagctgcggaac

SEQ ID NO: 323635 - DNA, 25 bp, Mus musculus
tctggagctgcggaacgcaagaatg

SEQ ID NO: 323636 - DNA, 25 bp, Mus musculus
gcgcgcaccgactcctggttctgga

SEQ ID NO: 323637 - DNA, 25 bp, Mus musculus
tcggtgcgcttcagcagcgcgcgca

SEQ ID NO: 323638 - DNA, 25 bp, Mus musculus
tcagctccgcctcggtgcgcttcag

SEQ ID NO: 323639 - DNA, 25 bp, Mus musculus
gcgccgcctccgacacgcgcatgct

SEQ ID NO: 323640 - DNA, 25 bp, Mus musculus
ccgctgcagcgggtcctcctgccgc

SEQ ID NO: 323641 - DNA, 25 bp, Mus musculus
tgaggtaacgcaaacgctcctcctc

SEQ ID NO: 323642 - DNA, 25 bp, Mus musculus
acgcaagaatgctcgcgtggaccgg

SEQ ID NO: 323643 - DNA, 25 bp, Mus musculus
gcgccgagacgtcggccagcttctg

SEQ ID NO: 323644 - DNA, 25 bp, Mus musculus
gcggcagacggaagccatagccgtc

SEQ ID NO: 323645 - DNA, 25 bp, Mus musculus
atctttgcggaaggactggcgcacc

SEQ ID NO: 323646 - DNA, 25 bp, Mus musculus
acgaggagcccgaatctttgcggaa

SEQ ID NO: 323647 - DNA, 25 bp, Mus musculus
tgctgcgggccttgcctccaggact

SEQ ID NO: 323648 - DNA, 25 bp, Mus musculus
caaagaccgacgaggagcccgaatc

SEQ ID NO: 323649 - DNA, 25 bp, Mus musculus
aagccatagccgtctccgtagagcg

SEQ ID NO: 323650 - DNA, 25 bp, Mus musculus
cgagtcctccaggtcggactgcagc

SEQ ID NO: 323651 - DNA, 25 bp, Mus musculus
cccgggtatgcgaatgggtctcccg

SEQ ID NO: 323652 - DNA, 25 bp, Mus musculus
ctccaggactctcagcaaagaccga

SEQ ID NO: 323653 - DNA, 25 bp, Mus musculus
gatcggcatagaggccctcgccctt

SEQ ID NO: 323654 - DNA, 25 bp, Mus musculus
aggtcctcatctggcttcacgtcgc

SEQ ID NO: 323655 - DNA, 25 bp, Mus musculus
agcccgatggcagtcccgaaggcag

SEQ ID NO: 323656 - DNA, 25 bp, Mus musculus
tgcagcagcccgtagggatcggcat

SEQ ID NO: 323657 - DNA, 25 bp, Mus musculus
caccggacgtcttccagctcgtaga

SEQ ID NO: 323658 - DNA, 25 bp, Mus musculus
ttgcgagcctcgtccttgatgagga

SEQ ID NO: 323659 - DNA, 25 bp, Mus musculus
ggcgacttaagcatgcccatggtga

SEQ ID NO: 323660 - DNA, 25 bp, Mus musculus
cccatggtgagcttctgagggaaca

SEQ ID NO: 323661 - DNA, 25 bp, Mus musculus
aacatgtgcgcgatgagtgcgtgca

SEQ ID NO: 323662 - DNA, 25 bp, Mus musculus
agtgcgtgcagcgtgtccaagctgc

SEQ ID NO: 323663 - DNA, 25 bp, Mus musculus
tccaagctgctgacctcatgcgtga

SEQ ID NO: 323664 - DNA, 25 bp, Mus musculus
cctcatgcgtgatgtgtacacgtcg

SEQ ID NO: 323665 - DNA, 25 bp, Mus musculus
gtacacgtcgtgtctcctctccaaa

SEQ ID NO: 323666 - DNA, 25 bp, Mus musculus
ctgcgaaggagacgcgcccatcacg

SEQ ID NO: 323667 - DNA, 25 bp, Mus musculus
tgccaatgcacctcacgccaggaga

SEQ ID NO: 323668 - DNA, 25 bp, Mus musculus
gagcggcatccgtcccacaatgaca

SEQ ID NO: 323669 - DNA, 25 bp, Mus musculus
cacaatgacaaggtctgaggccaga

SEQ ID NO: 323670 - DNA, 25 bp, Mus musculus
ttccagctcgtagaagacattgcga

SEQ ID NO: 323671 - DNA, 25 bp, Mus musculus
cggtaaccgcgactccacctggcgc

SEQ ID NO: 323672 - DNA, 25 bp, Mus musculus
tgtgaacccgagtccgtgtaaacgc

SEQ ID NO: 323673 - DNA, 25 bp, Mus musculus
ttagggctacgccacgcaccctgtg

SEQ ID NO: 323674 - DNA, 25 bp, Mus musculus
gggtttgcagcgacacccgcagctc

SEQ ID NO: 323675 - DNA, 25 bp, Mus musculus
cccgggaaggtcatgactttctgag

SEQ ID NO: 323676 - DNA, 25 bp, Mus musculus
aaggtcatgactttctgaggttggg

SEQ ID NO: 323677 - DNA, 25 bp, Mus musculus
acacacgtggaaggcacctgctgcg

SEQ ID NO: 323678 - DNA, 25 bp, Mus musculus
aaggcacctgctgcggtaaggaaag

SEQ ID NO: 323679 - DNA, 25 bp, Mus musculus
tttctccgagattgggaacccgctg

SEQ ID NO: 323680 - DNA, 25 bp, Mus musculus
cctagactagtcctcggagccgcgg

SEQ ID NO: 323681 - DNA, 25 bp, Mus musculus
ggatcgggacccgatctccaggtcc

SEQ ID NO: 323682 - DNA, 25 bp, Mus musculus
tgcggccacaggtgcacgctcctgg

SEQ ID NO: 323683 - DNA, 25 bp, Mus musculus
acttcccaactcgtgtgaacccgag

SEQ ID NO: 323684 - DNA, 25 bp, Mus musculus
ctttgctgcagtgcgagagccgccg

SEQ ID NO: 323685 - DNA, 25 bp, Mus musculus
tgccggcgctccgaggtgtgcacca

SEQ ID NO: 323686 - DNA, 25 bp, Mus musculus
cggtactcccgagggtactcggcat

SEQ ID NO: 323687 - DNA, 25 bp, Mus musculus
tctcgcttgcggtcagcatccgctt

SEQ ID NO: 323688 - DNA, 25 bp, Mus musculus
ttgcggtcagcatccgctttctgga

SEQ ID NO: 323689 - DNA, 25 bp, Mus musculus
catccgctttctggagcccgctgag

SEQ ID NO: 323690 - DNA, 25 bp, Mus musculus
ccgctttctggagcccgctgagggc

SEQ ID NO: 323691 - DNA, 25 bp, Mus musculus
caggctctgggcagcgatcaccgtg

SEQ ID NO: 323692 - DNA, 25 bp, Mus musculus
gcagcgatcaccgtgtgccggcgct

SEQ ID NO: 323693 - DNA, 25 bp, Mus musculus
ctcggcatcgtctgcagacagcatg

SEQ ID NO: 323694 - DNA, 25 bp, Mus musculus
tgcaccagccccacgttggagaagc

SEQ ID NO: 323695 - DNA, 25 bp, Mus musculus
tcccgagggtactcggcatcgtctg

SEQ ID NO: 323696 - DNA, 25 bp, Mus musculus
gtactcggcatcgtctgcagacagc

SEQ ID NO: 323697 - DNA, 25 bp, Mus musculus
ctctgggcagcgatcaccgtgtgcc

SEQ ID NO: 323698 - DNA, 25 bp, Mus musculus
agggtactcggcatcgtctgcagac

SEQ ID NO: 323699 - DNA, 25 bp, Mus musculus
agaaataccttccacttaagcatgg

SEQ ID NO: 323700 - DNA, 25 bp, Mus musculus
gaggtgactctttgggtctccaagc

SEQ ID NO: 323701 - DNA, 25 bp, Mus musculus
cccagagtggcctcgaaagaggcac

SEQ ID NO: 323702 - DNA, 25 bp, Mus musculus
tgcggtagagacaaatgcgttgacc

SEQ ID NO: 323703 - DNA, 25 bp, Mus musculus
tcctgctgcggtagagacaaatgcg

SEQ ID NO: 323704 - DNA, 25 bp, Mus musculus
ggtcctcctgctgcggtagagacaa

SEQ ID NO: 323705 - DNA, 25 bp, Mus musculus
tccagcagcacacccggatcccgca

SEQ ID NO: 323706 - DNA, 25 bp, Mus musculus
aagggaaggggcactgcgcctcctc

SEQ ID NO: 323707 - DNA, 25 bp, Mus musculus
tggccggatggtacaaagggccgcc

SEQ ID NO: 323708 - DNA, 25 bp, Mus musculus
tgtcaccgagtgtgcgagagcgagt

SEQ ID NO: 323709 - DNA, 25 bp, Mus musculus
acatgccttgggacggagcgttccc

SEQ ID NO: 323710 - DNA, 25 bp, Mus musculus
cttaagcatggaggcacattaggga

SEQ ID NO: 323711 - DNA, 25 bp, Mus musculus
ttccacttaagcatggaggcacatt

SEQ ID NO: 323712 - DNA, 25 bp, Mus musculus
tttgggtctccaagcaccctcaacg

SEQ ID NO: 323713 - DNA, 25 bp, Mus musculus
aaccagcgccgaagtgcgggaagcc

SEQ ID NO: 323714 - DNA, 25 bp, Mus musculus
tgtcccccgaggtgcttcaggccgt

SEQ ID NO: 323715 - DNA, 25 bp, Mus musculus
tcaaggggcggactgctagctgcat

SEQ ID NO: 323716 - DNA, 25 bp, Mus musculus
cggactgctagctgcatcaagaccc

SEQ ID NO: 323717 - DNA, 25 bp, Mus musculus
gcacaccgcgacgtctgcatcctcg

SEQ ID NO: 323718 - DNA, 25 bp, Mus musculus
tctccaccgcctgggcacaccgcga

SEQ ID NO: 323719 - DNA, 25 bp, Mus musculus
gcccagcctcctgtgcatggcgagg

SEQ ID NO: 323720 - DNA, 25 bp, Mus musculus
gaggacacagagtctccatggagca

SEQ ID NO: 323721 - DNA, 25 bp, Mus musculus
agagtctccatggagcagccttggg

SEQ ID NO: 323722 - DNA, 25 bp, Mus musculus
ggcccaccaccaagagcccgcggcg

SEQ ID NO: 323723 - DNA, 25 bp, Mus musculus
tctctcctcggtatcgtcacgcggc

SEQ ID NO: 323724 - DNA, 25 bp, Mus musculus
ggtgcgatcggtcgcgcttcctgcc

SEQ ID NO: 323725 - DNA, 25 bp, Mus musculus
tcccggcgcaatgcccggcacgatc

SEQ ID NO: 323726 - DNA, 25 bp, Mus musculus
tgcgcaggaaccagcgccgaagtgc

SEQ ID NO: 323727 - DNA, 25 bp, Mus musculus
cgcgcgcagcccgttcttccagccc

SEQ ID NO: 323728 - DNA, 25 bp, Mus musculus
ccgagagggcggaaataattttctg

SEQ ID NO: 323729 - DNA, 25 bp, Mus musculus
taattttctgtttcgccctctctgc

SEQ ID NO: 323730 - DNA, 25 bp, Mus musculus
cgtgagccagacttcgcggaagcgc

SEQ ID NO: 323731 - DNA, 25 bp, Mus musculus
aacccgtgagccagacttcgcggaa

SEQ ID NO: 323732 - DNA, 25 bp, Mus musculus
ttcagcctcccacgcaccgttccgg

SEQ ID NO: 323733 - DNA, 25 bp, Mus musculus
agcgaaacccgccacactcttcagc

SEQ ID NO: 323734 - DNA, 25 bp, Mus musculus
gaccgacgaaagcaaacgtagggca

SEQ ID NO: 323735 - DNA, 25 bp, Mus musculus
taagcccagaggagaggtcgcaccc

SEQ ID NO: 323736 - DNA, 25 bp, Mus musculus
tctactaagcccagaggagaggtcg

SEQ ID NO: 323737 - DNA, 25 bp, Mus musculus
ggtctgtctactaagcccagaggag

SEQ ID NO: 323738 - DNA, 25 bp, Mus musculus
cccagtccctttgcagcggggacgt

SEQ ID NO: 323739 - DNA, 25 bp, Mus musculus
agacttcgcggaagcgcgtcccgcg

SEQ ID NO: 323740 - DNA, 25 bp, Mus musculus
cagtccctttgcagcggggacgtgc

SEQ ID NO: 323741 - DNA, 25 bp, Mus musculus
tcctgccggcgacaaagcaaacttc

SEQ ID NO: 323742 - DNA, 25 bp, Mus musculus
tgcgcctgctccgatcggtttcttt

SEQ ID NO: 323743 - DNA, 25 bp, Mus musculus
tgcgtctctttctggtgcgcctgct

SEQ ID NO: 323744 - DNA, 25 bp, Mus musculus
gcaaacttctactgagcggcttgtg

SEQ ID NO: 323745 - DNA, 25 bp, Mus musculus
agaaaccggagtctacgtcatcgcg

SEQ ID NO: 323746 - DNA, 25 bp, Mus musculus
cgccgagcggagcagaaactttgca

SEQ ID NO: 323747 - DNA, 25 bp, Mus musculus
gagggccagccgacctagaagttcc

SEQ ID NO: 323748 - DNA, 25 bp, Mus musculus
gaagttcccggccagaagagtccca

SEQ ID NO: 323749 - DNA, 25 bp, Mus musculus
ttgaggttgcaacctgctcccgctg

SEQ ID NO: 323750 - DNA, 25 bp, Mus musculus
actgcatctggacagcggtagctgc

SEQ ID NO: 323751 - DNA, 25 bp, Mus musculus
ggactcctgtcgattgcctagccca

SEQ ID NO: 323752 - DNA, 25 bp, Mus musculus
gcccagcggacagcgaagctgctta

SEQ ID NO: 323753 - DNA, 25 bp, Mus musculus
aagctgcttaccatggagcccgtga

SEQ ID NO: 323754 - DNA, 25 bp, Mus musculus
cccaaacaagtggtggactggacta

SEQ ID NO: 323755 - DNA, 25 bp, Mus musculus
agtcccaggcccgtgacgtgaagac

SEQ ID NO: 323756 - DNA, 25 bp, Mus musculus
cggaaaagtcagaagtggccacgcc

SEQ ID NO: 323757 - DNA, 25 bp, Mus musculus
caccgaaatatgtggagaaggccca

SEQ ID NO: 323758 - DNA, 25 bp, Mus musculus
cagcggtgttcgtgacaccgaaata

SEQ ID NO: 323759 - DNA, 25 bp, Mus musculus
ctaggcagggagagtcacctccttc

SEQ ID NO: 323760 - DNA, 25 bp, Mus musculus
cccagattcgggtggccgcagctag

SEQ ID NO: 323761 - DNA, 25 bp, Mus musculus
cccgagatgtcgagggccttgtccc

SEQ ID NO: 323762 - DNA, 25 bp, Mus musculus
ctgcgcgactagacccgacatgagc

SEQ ID NO: 323763 - DNA, 25 bp, Mus musculus
cgctgcaggttctcgcgagacttgc

SEQ ID NO: 323764 - DNA, 25 bp, Mus musculus
ctgaagaaccaatcaggtgcgctgc

SEQ ID NO: 323765 - DNA, 25 bp, Mus musculus
agccaaacaaatacggaagtcacga

SEQ ID NO: 323766 - DNA, 25 bp, Mus musculus
aaccgctatccgctacatttacaga

SEQ ID NO: 323767 - DNA, 25 bp, Mus musculus
ggccactgcgatgctgacactgtct

SEQ ID NO: 323768 - DNA, 25 bp, Mus musculus
ggaaacaaacgtgacaaccgctatc

SEQ ID NO: 323769 - DNA, 25 bp, Mus musculus
ccgctttgaaatccgcccgggcaga

SEQ ID NO: 323770 - DNA, 25 bp, Mus musculus
ttacacgaccgctttgaaatccgcc

SEQ ID NO: 323771 - DNA, 25 bp, Mus musculus
gccgaacgtgtttgtgccggttaca

SEQ ID NO: 323772 - DNA, 25 bp, Mus musculus
gagatagttcttaatgccgaacgtg

SEQ ID NO: 323773 - DNA, 25 bp, Mus musculus
agtgggcgcgagatagttcttaatg

SEQ ID NO: 323774 - DNA, 25 bp, Mus musculus
agaacatcaaatggctccgggagga

SEQ ID NO: 323775 - DNA, 25 bp, Mus musculus
tggagtcactggaaaccagaacatc

SEQ ID NO: 323776 - DNA, 25 bp, Mus musculus
cttcgcgtggagtcactggaaacca

SEQ ID NO: 323777 - DNA, 25 bp, Mus musculus
ctggaagacgtccacttcgcgtgga

SEQ ID NO: 323778 - DNA, 25 bp, Mus musculus
acaccctactggaagacgtccactt

SEQ ID NO: 323779 - DNA, 25 bp, Mus musculus
acccgcagtgacagagcccgaggga

SEQ ID NO: 323780 - DNA, 25 bp, Mus musculus
aggtgcggtcacacccgcagtgaca

SEQ ID NO: 323781 - DNA, 25 bp, Mus musculus
gagcccatagaggtgcggtcacacc

SEQ ID NO: 323782 - DNA, 25 bp, Mus musculus
ttgtgccggttacacgaccgctttg

SEQ ID NO: 323783 - DNA, 25 bp, Mus musculus
gacgagcctgcatgctgtggtcatg

SEQ ID NO: 323784 - DNA, 25 bp, Mus musculus
tccaccggcccaggtcagactccac

SEQ ID NO: 323785 - DNA, 25 bp, Mus musculus
catctttggtgacccctggccgttc

SEQ ID NO: 323786 - DNA, 25 bp, Mus musculus
gtgagcgtcccatctttggtgaccc

SEQ ID NO: 323787 - DNA, 25 bp, Mus musculus
tctgggtgagcgtcccatctttggt

SEQ ID NO: 323788 - DNA, 25 bp, Mus musculus
gcgtctgggtgagcgtcccatcttt

SEQ ID NO: 323789 - DNA, 25 bp, Mus musculus
cgagtagatgccaagatccgcagcg

SEQ ID NO: 323790 - DNA, 25 bp, Mus musculus
cctgcatgctgtggtcatgcgcggc

SEQ ID NO: 323791 - DNA, 25 bp, Mus musculus
gctacgcgcagagcggccatgcgca

SEQ ID NO: 323792 - DNA, 25 bp, Mus musculus
ggccgtgcccatcctgtgcgggcct

SEQ ID NO: 323793 - DNA, 25 bp, Mus musculus
cagtctttccggagggagctcccga

SEQ ID NO: 323794 - DNA, 25 bp, Mus musculus
ctcccgagtagatgccaagatccgc

SEQ ID NO: 323795 - DNA, 25 bp, Mus musculus
gagctcccgagtagatgccaagatc

SEQ ID NO: 323796 - DNA, 25 bp, Mus musculus
catgctgtggtcatgcgcggcgtct

SEQ ID NO: 323797 - DNA, 25 bp, Mus musculus
gctggtacaggagctcggcttctac

SEQ ID NO: 323798 - DNA, 25 bp, Mus musculus
ctgtagccccgagccacagtggagc

SEQ ID NO: 323799 - DNA, 25 bp, Mus musculus
ttcagaacacgacgacctgtagccc

SEQ ID NO: 323800 - DNA, 25 bp, Mus musculus
cccgaggaagcttcagaacacgacg

SEQ ID NO: 323801 - DNA, 25 bp, Mus musculus
agaatgaagcgctcagtatcccggg

SEQ ID NO: 323802 - DNA, 25 bp, Mus musculus
agtatcccgggagcatctcccttgc

SEQ ID NO: 323803 - DNA, 25 bp, Mus musculus
cggaagctcaggtgccccccgagta

SEQ ID NO: 323804 - DNA, 25 bp, Mus musculus
cccggagacagaatgaagcgctcag

SEQ ID NO: 323805 - DNA, 25 bp, Mus musculus
aggagctcggcttctaccgcaagtc

SEQ ID NO: 323806 - DNA, 25 bp, Mus musculus
ccgagtacctgtgggcgcccgctaa

SEQ ID NO: 323807 - DNA, 25 bp, Mus musculus
atcaatgcgctggtacaggagctcg

SEQ ID NO: 323808 - DNA, 25 bp, Mus musculus
cgggacgagatcaatgcgctggtac

SEQ ID NO: 323809 - DNA, 25 bp, Mus musculus
gcatctcccttgctgagggccgacg

SEQ ID NO: 323810 - DNA, 25 bp, Mus musculus
ttctaccgcaagtcggcgccggaag

SEQ ID NO: 323811 - DNA, 25 bp, Mus musculus
gagcgtgaggctgcaaccctctcct

SEQ ID NO: 323812 - DNA, 25 bp, Mus musculus
agcaagatggtgagacctcggttcc

SEQ ID NO: 323813 - DNA, 25 bp, Mus musculus
ggcgtcctctcggatagaaaattcc

SEQ ID NO: 323814 - DNA, 25 bp, Mus musculus
tgctgggtttcaagtcctcggctac

SEQ ID NO: 323815 - DNA, 25 bp, Mus musculus
cgggccgctgcaaggcccttgcaag

SEQ ID NO: 323816 - DNA, 25 bp, Mus musculus
cggtcagcgcgagccgctgcaacga

SEQ ID NO: 323817 - DNA, 25 bp, Mus musculus
ggccttccttcggtcacatgacagg

SEQ ID NO: 323818 - DNA, 25 bp, Mus musculus
caatccggttggagagcgtgtgcac

SEQ ID NO: 323819 - DNA, 25 bp, Mus musculus
gtcacatgacaggaagcgcggctct

SEQ ID NO: 323820 - DNA, 25 bp, Mus musculus
ggaagcgcggctctcccaacgtcaa

SEQ ID NO: 323821 - DNA, 25 bp, Mus musculus
cccggcgcacggtacgcaaaaagcg

SEQ ID NO: 323822 - DNA, 25 bp, Mus musculus
gtctggctcgttcggccttttctga

SEQ ID NO: 323823 - DNA, 25 bp, Mus musculus
gctagcggggctctgcgagcaatcc

SEQ ID NO: 323824 - DNA, 25 bp, Mus musculus
gcgccctgttccgtgccttgaggtt

SEQ ID NO: 323825 - DNA, 25 bp, Mus musculus
cctattgtgttaccttcagtcatga

SEQ ID NO: 323826 - DNA, 25 bp, Mus musculus
ttgggattcctaagtgcgtgtgtga

SEQ ID NO: 323827 - DNA, 25 bp, Mus musculus
acgcgtccgagtgaggttcgctcac

SEQ ID NO: 323828 - DNA, 25 bp, Mus musculus
cgtcgccgctaccaaagggcgcttg

SEQ ID NO: 323829 - DNA, 25 bp, Mus musculus
cagactgggcggaaatgtgtctcgc

SEQ ID NO: 323830 - DNA, 25 bp, Mus musculus
atccctaccctagctggggagcttg

SEQ ID NO: 323831 - DNA, 25 bp, Mus musculus
gcagatcccttgaacccggaggaaa

SEQ ID NO: 323832 - DNA, 25 bp, Mus musculus
ggtcgccagccctagacgcttacga

SEQ ID NO: 323833 - DNA, 25 bp, Mus musculus
ggagaccacctcttatccaagcaga

SEQ ID NO: 323834 - DNA, 25 bp, Mus musculus
cacgtgacctcattccttcaggatg

SEQ ID NO: 323835 - DNA, 25 bp, Mus musculus
tccagacaagagtaggtcccgccca

SEQ ID NO: 323836 - DNA, 25 bp, Mus musculus
gctcactccagctgaatcccttggg

SEQ ID NO: 323837 - DNA, 25 bp, Mus musculus
cttacgaggtagcaaggaggcaagc

SEQ ID NO: 323838 - DNA, 25 bp, Mus musculus
aaatggcttttttcctccagacaag

SEQ ID NO: 323839 - DNA, 25 bp, Mus musculus
gcactcggcaagaagggctccctac

SEQ ID NO: 323840 - DNA, 25 bp, Mus musculus
gactttgcctccacatgaagtacta

SEQ ID NO: 323841 - DNA, 25 bp, Mus musculus
tgaagtactaaaatggcggcagcgc

SEQ ID NO: 323842 - DNA, 25 bp, Mus musculus
gaagaagctggaacataccatctcc

SEQ ID NO: 323843 - DNA, 25 bp, Mus musculus
tcctgcctagaaaaccagggaccgc

SEQ ID NO: 323844 - DNA, 25 bp, Mus musculus
ggacaccctcaaggccgggctttga

SEQ ID NO: 323845 - DNA, 25 bp, Mus musculus
gctggtgcagttggacgacatgccc

SEQ ID NO: 323846 - DNA, 25 bp, Mus musculus
tttctggcacacgaaatgcttcttc

SEQ ID NO: 323847 - DNA, 25 bp, Mus musculus
cggaatagcttcactttctggcaca

SEQ ID NO: 323848 - DNA, 25 bp, Mus musculus
aatcggctcgctggcccggaatagc

SEQ ID NO: 323849 - DNA, 25 bp, Mus musculus
atcaggacgctgagaatcggctcgc

SEQ ID NO: 323850 - DNA, 25 bp, Mus musculus
ggaagctggttaccgtgtggttcac

SEQ ID NO: 323851 - DNA, 25 bp, Mus musculus
atggacagcctcgaggcactcggca

SEQ ID NO: 323852 - DNA, 25 bp, Mus musculus
caaggccgggctttgactttgcctc

SEQ ID NO: 323853 - DNA, 25 bp, Mus musculus
cggctaccacgcacttgtcacggga

SEQ ID NO: 323854 - DNA, 25 bp, Mus musculus
gacaagggtccacattcggtctcac

SEQ ID NO: 323855 - DNA, 25 bp, Mus musculus
tgcccattatttgcatcctcctgcg

SEQ ID NO: 323856 - DNA, 25 bp, Mus musculus
gaggctccaacctcgtctgcatttg

SEQ ID NO: 323857 - DNA, 25 bp, Mus musculus
gcagatatcgcgcagtcccgtcgac

SEQ ID NO: 323858 - DNA, 25 bp, Mus musculus
actgtaaactatcaccgccgccggg

SEQ ID NO: 323859 - DNA, 25 bp, Mus musculus
tcccgcgcggcagatgccaacggat

SEQ ID NO: 323860 - DNA, 25 bp, Mus musculus
tcgacatcttgaacgcccggaaagg

SEQ ID NO: 323861 - DNA, 25 bp, Mus musculus
acactgggatatgaacgggaggccc

SEQ ID NO: 323862 - DNA, 25 bp, Mus musculus
ccgggtcgcagctagatgacgtaaa

SEQ ID NO: 323863 - DNA, 25 bp, Mus musculus
agatgacgtaaaaggcctgggcctc

SEQ ID NO: 323864 - DNA, 25 bp, Mus musculus
ggctacacccaacgcctcggaagta

SEQ ID NO: 323865 - DNA, 25 bp, Mus musculus
acagttgatcacagctccgaccgga

SEQ ID NO: 323866 - DNA, 25 bp, Mus musculus
tcctcctgcggaagaaggagactgc

SEQ ID NO: 323867 - DNA, 25 bp, Mus musculus
cgcgtctgtttctccagcgcgggaa

SEQ ID NO: 323868 - DNA, 25 bp, Mus musculus
tgctagtgcagctctccatcagggg

SEQ ID NO: 323869 - DNA, 25 bp, Mus musculus
cccagtctggaacctgggaggtcca

SEQ ID NO: 323870 - DNA, 25 bp, Mus musculus
ccaccgctggagatgggtggcctct

SEQ ID NO: 323871 - DNA, 25 bp, Mus musculus
tggcctctgtgcatcgaggttagga

SEQ ID NO: 323872 - DNA, 25 bp, Mus musculus
tctggataaggtgagctcgggtacc

SEQ ID NO: 323873 - DNA, 25 bp, Mus musculus
cccggtgcggcaagatcgtgtaccc

SEQ ID NO: 323874 - DNA, 25 bp, Mus musculus
catgaaccctaactgtgcccggtgc

SEQ ID NO: 323875 - DNA, 25 bp, Mus musculus
cccggaaccatgaaccctaactgtg

SEQ ID NO: 323876 - DNA, 25 bp, Mus musculus
gaacgcgcgcgaatacgggcgtccc

SEQ ID NO: 323877 - DNA, 25 bp, Mus musculus
caaggaaaagggaacgcgcgcgaat

SEQ ID NO: 323878 - DNA, 25 bp, Mus musculus
gtcgccgtcgcctgcacagttgcag

SEQ ID NO: 323879 - DNA, 25 bp, Mus musculus
ctgcgagctagccagtgctagtgca

SEQ ID NO: 323880 - DNA, 25 bp, Mus musculus
ccactgtgtttattaggggaaggag

SEQ ID NO: 323881 - DNA, 25 bp, Mus musculus
attcagagatctcccgggaaccctg

SEQ ID NO: 323882 - DNA, 25 bp, Mus musculus
tcttaacgttcctttgccagcgcta

SEQ ID NO: 323883 - DNA, 25 bp, Mus musculus
tgccagcgctaaacaccgccaaaga

SEQ ID NO: 323884 - DNA, 25 bp, Mus musculus
ctggcccgcataaaaatcaaatagg

SEQ ID NO: 323885 - DNA, 25 bp, Mus musculus
ggacctgctgaaaaacacgcaatta

SEQ ID NO: 323886 - DNA, 25 bp, Mus musculus
tctaccggaagtactggggaatata

SEQ ID NO: 323887 - DNA, 25 bp, Mus musculus
ttcgacagtttttccggctacagta

SEQ ID NO: 323888 - DNA, 25 bp, Mus musculus
ccggctacagtatcacaggaaagtg

SEQ ID NO: 323889 - DNA, 25 bp, Mus musculus
gggatttagtcgtctcgtcccacca

SEQ ID NO: 323890 - DNA, 25 bp, Mus musculus
tcctcaggcttttcccgccagataa

SEQ ID NO: 323891 - DNA, 25 bp, Mus musculus
cccgtcgcctcaagtagattttaga

SEQ ID NO: 323892 - DNA, 25 bp, Mus musculus
tgcctcctctcttgaatcgctcgga

SEQ ID NO: 323893 - DNA, 25 bp, Mus musculus
gtcaccgcgctttgtcttaacgttc

SEQ ID NO: 323894 - DNA, 25 bp, Mus musculus
ccctcgcgaatagaaagaaacctcg

SEQ ID NO: 323895 - DNA, 25 bp, Mus musculus
gcgccgggacatctctggttaccga

SEQ ID NO: 323896 - DNA, 25 bp, Mus musculus
tgcagcaaccagagctgagctcgca

SEQ ID NO: 323897 - DNA, 25 bp, Mus musculus
aaccagagctgagctcgcatggtgg

SEQ ID NO: 323898 - DNA, 25 bp, Mus musculus
gccgcgcgtcctacctgcgggtgtt

SEQ ID NO: 323899 - DNA, 25 bp, Mus musculus
agctcgcatggtgggcgcggacgac

SEQ ID NO: 323900 - DNA, 25 bp, Mus musculus
gacgacctccgggtctgcgcggcgg

SEQ ID NO: 323901 - DNA, 25 bp, Mus musculus
acatctctggttaccgagagaaccc

SEQ ID NO: 323902 - DNA, 25 bp, Mus musculus
accgcgccgggacatctctggttac

SEQ ID NO: 323903 - DNA, 25 bp, Mus musculus
gccgggacatctctggttaccgaga

SEQ ID NO: 323904 - DNA, 25 bp, Mus musculus
cgggacatctctggttaccgagaga

SEQ ID NO: 323905 - DNA, 25 bp, Mus musculus
caactgcagcaaccagagctgagct

SEQ ID NO: 323906 - DNA, 25 bp, Mus musculus
cccgcggagtagcagcaactgcagc

SEQ ID NO: 323907 - DNA, 25 bp, Mus musculus
tcctacctgcgggtgttgcgggact

SEQ ID NO: 323908 - DNA, 25 bp, Mus musculus
cagggcgagcgaagcacggcgctgc

SEQ ID NO: 323909 - DNA, 25 bp, Mus musculus
gggacatgccgctcttctggaccat

SEQ ID NO: 323910 - DNA, 25 bp, Mus musculus
ggtcgaagacctccatagggatctc

SEQ ID NO: 323911 - DNA, 25 bp, Mus musculus
cacctcgccttacctgtgggctggg

SEQ ID NO: 323912 - DNA, 25 bp, Mus musculus
caagatccgtaggagcggccctttc

SEQ ID NO: 323913 - DNA, 25 bp, Mus musculus
tccacgcggggcatataaccctttc

SEQ ID NO: 323914 - DNA, 25 bp, Mus musculus
atcgatcattaaccctcgagaatgg

SEQ ID NO: 323915 - DNA, 25 bp, Mus musculus
cggaccaatagtccatcgatcatta

SEQ ID NO: 323916 - DNA, 25 bp, Mus musculus
aggcgaggttgacaggcattccaac

SEQ ID NO: 323917 - DNA, 25 bp, Mus musculus
actccgcttctcaaggcctggattc

SEQ ID NO: 323918 - DNA, 25 bp, Mus musculus
ctccagaacgtggaggggctcgatc

SEQ ID NO: 323919 - DNA, 25 bp, Mus musculus
cttctggaccatggagaggatcctc

SEQ ID NO: 323920 - DNA, 25 bp, Mus musculus
accgggtgcagtctcccagctggac

SEQ ID NO: 323921 - DNA, 25 bp, Mus musculus
agacaatggccgagtggcgtagccc

SEQ ID NO: 323922 - DNA, 25 bp, Mus musculus
tgtcagcctgctggagccagtaccc

SEQ ID NO: 323923 - DNA, 25 bp, Mus musculus
gacaacacgtacaacaggcacctta

SEQ ID NO: 323924 - DNA, 25 bp, Mus musculus
ccctaacttgtagcggcagacaaca

SEQ ID NO: 323925 - DNA, 25 bp, Mus musculus
aagagatgtggaagagcacccgccc

SEQ ID NO: 323926 - DNA, 25 bp, Mus musculus
cccagcaacgtttgcgagagtgagc

SEQ ID NO: 323927 - DNA, 25 bp, Mus musculus
ctgggccatgctgcctttgtgccac

SEQ ID NO: 323928 - DNA, 25 bp, Mus musculus
cgacagcgacctggggacgagtccc

SEQ ID NO: 323929 - DNA, 25 bp, Mus musculus
ccaaggctgctcacgtcacggtgga

SEQ ID NO: 323930 - DNA, 25 bp, Mus musculus
caatcgtgtggttataaatagccgc

SEQ ID NO: 323931 - DNA, 25 bp, Mus musculus
ccaggccctggtttcatgaatgaaa

SEQ ID NO: 323932 - DNA, 25 bp, Mus musculus
ctctgatctccgcttggcttaaggc

SEQ ID NO: 323933 - DNA, 25 bp, Mus musculus
ccaacttacttttcctgagcccagg

SEQ ID NO: 323934 - DNA, 25 bp, Mus musculus
agctatgctgcccagccggttagtg

SEQ ID NO: 323935 - DNA, 25 bp, Mus musculus
aaagccaatgtcctccctcggagtc

SEQ ID NO: 323936 - DNA, 25 bp, Mus musculus
gcaccttagcagtccggttgcacca

SEQ ID NO: 323937 - DNA, 25 bp, Mus musculus
aagctctttcctttcgctgctgcgg

SEQ ID NO: 323938 - DNA, 25 bp, Mus musculus
gagctactactctctgggagcgaaa

SEQ ID NO: 323939 - DNA, 25 bp, Mus musculus
agaaacctttcacagaccgctagcc

SEQ ID NO: 323940 - DNA, 25 bp, Mus musculus
acaagtctcgggcaaggccaggcct

SEQ ID NO: 323941 - DNA, 25 bp, Mus musculus
tctctgcctgtcacgcgttgtgagg

SEQ ID NO: 323942 - DNA, 25 bp, Mus musculus
cttcgcagataatgggcggagcctg

SEQ ID NO: 323943 - DNA, 25 bp, Mus musculus
tacagacaatcatggagtggggctt

SEQ ID NO: 323944 - DNA, 25 bp, Mus musculus
tagcgtagcgtaaatacagacaatc

SEQ ID NO: 323945 - DNA, 25 bp, Mus musculus
tgattctcgatctccagtatctagg

SEQ ID NO: 323946 - DNA, 25 bp, Mus musculus
ctgaaccattttgcccgacgaaagg

SEQ ID NO: 323947 - DNA, 25 bp, Mus musculus
ccgcggagtcggactgaaccatttt

SEQ ID NO: 323948 - DNA, 25 bp, Mus musculus
tgacttccggctacccagaggacca

SEQ ID NO: 323949 - DNA, 25 bp, Mus musculus
gcctgcgcgacttagcgtgacttcc

SEQ ID NO: 323950 - DNA, 25 bp, Mus musculus
taccatgtaacgtgggacaagtctc

SEQ ID NO: 323951 - DNA, 25 bp, Mus musculus
ccggagacacacagaggagcacgta

SEQ ID NO: 323952 - DNA, 25 bp, Mus musculus
agacggttgtggctaggaattcaga

SEQ ID NO: 323953 - DNA, 25 bp, Mus musculus
gattccctccaacaaagccgagtta

SEQ ID NO: 323954 - DNA, 25 bp, Mus musculus
agccgagttacaaccgcccaggagg

SEQ ID NO: 323955 - DNA, 25 bp, Mus musculus
acggcgcgcagccttaggaatcacg

SEQ ID NO: 323956 - DNA, 25 bp, Mus musculus
ccaaagggacccagccactgtgatc

SEQ ID NO: 323957 - DNA, 25 bp, Mus musculus
ccactgtgatcagcgctccaagtca

SEQ ID NO: 323958 - DNA, 25 bp, Mus musculus
ctccaagtcagagatgcccgggcgg

SEQ ID NO: 323959 - DNA, 25 bp, Mus musculus
cacgacttaccttggtttcttggag

SEQ ID NO: 323960 - DNA, 25 bp, Mus musculus
tggccgcgtcatccggttcattctc

SEQ ID NO: 323961 - DNA, 25 bp, Mus musculus
ttctcgctcatttcggtcatggttg

SEQ ID NO: 323962 - DNA, 25 bp, Mus musculus
gggcgtctctttgggactctcaagc

SEQ ID NO: 323963 - DNA, 25 bp, Mus musculus
tcaagcctttctccaggggcagctc

SEQ ID NO: 323964 - DNA, 25 bp, Mus musculus
aaagccagggaacgaccgagctgtc

SEQ ID NO: 323965 - DNA, 25 bp, Mus musculus
atggctctcagtgccaggctccaga

SEQ ID NO: 323966 - DNA, 25 bp, Mus musculus
ccggtgaattgcattacggggtgct

SEQ ID NO: 323967 - DNA, 25 bp, Mus musculus
ttctagacgtctctaggttggggca

SEQ ID NO: 323968 - DNA, 25 bp, Mus musculus
gccattttcctcctctttctagacg

SEQ ID NO: 323969 - DNA, 25 bp, Mus musculus
gcggtccctgctcggagccattttc

SEQ ID NO: 323970 - DNA, 25 bp, Mus musculus
actgtcgccttgaacccaaagtgca

SEQ ID NO: 323971 - DNA, 25 bp, Mus musculus
tgagctggcacccacgtctttctga

SEQ ID NO: 323972 - DNA, 25 bp, Mus musculus
gacccacgcggaacctgagctttca

SEQ ID NO: 323973 - DNA, 25 bp, Mus musculus
gggctcactggcacgtagcgaccca

SEQ ID NO: 323974 - DNA, 25 bp, Mus musculus
ctccagcactgcgagggctcactgg

SEQ ID NO: 323975 - DNA, 25 bp, Mus musculus
acagggacaggaacatcaccggatc

SEQ ID NO: 323976 - DNA, 25 bp, Mus musculus
aagtgcccaagtgcgcgcctgcttc

SEQ ID NO: 323977 - DNA, 25 bp, Mus musculus
gcgccagcccaccaggacaaggaga

SEQ ID NO: 323978 - DNA, 25 bp, Mus musculus
gtcgctagctcggtcctctccaaag

SEQ ID NO: 323979 - DNA, 25 bp, Mus musculus
acagtagggccgcacgcagcatcat

SEQ ID NO: 323980 - DNA, 25 bp, Mus musculus
agcatcatacagcagggccgcacgc

SEQ ID NO: 323981 - DNA, 25 bp, Mus musculus
gggccgcacgcagcatcatacagca

SEQ ID NO: 323982 - DNA, 25 bp, Mus musculus
catcatacagcagggccgcacgcag

SEQ ID NO: 323983 - DNA, 25 bp, Mus musculus
acgcagcatcatacagcagggccgc

SEQ ID NO: 323984 - DNA, 25 bp, Mus musculus
tagggccgcacgcagcatcatacag

SEQ ID NO: 323985 - DNA, 25 bp, Mus musculus
cgcacgcagcatcccacagtagggc

SEQ ID NO: 323986 - DNA, 25 bp, Mus musculus
ggccgcacgcagcatcatacagcag

SEQ ID NO: 323987 - DNA, 25 bp, Mus musculus
gcatcatacagcagggccgcacgca

SEQ ID NO: 323988 - DNA, 25 bp, Mus musculus
cgcagcatcatacagcagggccgca

SEQ ID NO: 323989 - DNA, 25 bp, Mus musculus
agcagggccgcacgcagcatcatac

SEQ ID NO: 323990 - DNA, 25 bp, Mus musculus
cgcagcatcccacagtagggccgca

SEQ ID NO: 323991 - DNA, 25 bp, Mus musculus
gccgcacgcagcatcatacagcagg

SEQ ID NO: 323992 - DNA, 25 bp, Mus musculus
atacagcagggccgcacgcagcatc

SEQ ID NO: 323993 - DNA, 25 bp, Mus musculus
ccactcagaggggaaccaagttagc

SEQ ID NO: 323994 - DNA, 25 bp, Mus musculus
aggcgctccagcatctgtagggctc

SEQ ID NO: 323995 - DNA, 25 bp, Mus musculus
gcggaggttggctgatttcgtcctc

SEQ ID NO: 323996 - DNA, 25 bp, Mus musculus
ccgcaccaaagtctcgcggaggttg

SEQ ID NO: 323997 - DNA, 25 bp, Mus musculus
gacggaggaagaaggaaccgcacca

SEQ ID NO: 323998 - DNA, 25 bp, Mus musculus
gatcgcgagattaatcgtgttcctg

SEQ ID NO: 323999 - DNA, 25 bp, Mus musculus
ccggggaaggctcagtctgaagtcc

SEQ ID NO: 324000 - DNA, 25 bp, Mus musculus
cgcaggatctctagcaggcccggct

SEQ ID NO: 324001 - DNA, 25 bp, Mus musculus
attggctcgccgcagcggtgtaccg

SEQ ID NO: 324002 - DNA, 25 bp, Mus musculus
aggatccggtcccacgcacggtggc

SEQ ID NO: 324003 - DNA, 25 bp, Mus musculus
ccgcagaaaacctttcacgagtgga

SEQ ID NO: 324004 - DNA, 25 bp, Mus musculus
agatgcacattccaccaggatccgg

SEQ ID NO: 324005 - DNA, 25 bp, Mus musculus
gctcggtcgggatctaagatgcaca

SEQ ID NO: 324006 - DNA, 25 bp, Mus musculus
acggaacttcccaaagatcgcgaga

SEQ ID NO: 324007 - DNA, 25 bp, Mus musculus
agtctcgcgatacttgcggcattcg

SEQ ID NO: 324008 - DNA, 25 bp, Mus musculus
tgccgtttcggtttaatctagtgtg

SEQ ID NO: 324009 - DNA, 25 bp, Mus musculus
ggcggacgccttcctacttccttga

SEQ ID NO: 324010 - DNA, 25 bp, Mus musculus
ccgtgccgaggaactcttggtttct

SEQ ID NO: 324011 - DNA, 25 bp, Mus musculus
cccacctcatgtaggagggcgctga

SEQ ID NO: 324012 - DNA, 25 bp, Mus musculus
tccaacagcagggagcgtcaccgct

SEQ ID NO: 324013 - DNA, 25 bp, Mus musculus
cgtcaccgcttggtgtcgaagcaca

SEQ ID NO: 324014 - DNA, 25 bp, Mus musculus
tgtcgaagcacaagcggcataagtc

SEQ ID NO: 324015 - DNA, 25 bp, Mus musculus
cgaagcggcatctttgggtaccata

SEQ ID NO: 324016 - DNA, 25 bp, Mus musculus
ccactggtggagtacgatgacatca

SEQ ID NO: 324017 - DNA, 25 bp, Mus musculus
gctctgattcagacaccttctccga

SEQ ID NO: 324018 - DNA, 25 bp, Mus musculus
tctccgatgacacggccttcaaatc

SEQ ID NO: 324019 - DNA, 25 bp, Mus musculus
tctggaacttcgcagccgtcatcgg

SEQ ID NO: 324020 - DNA, 25 bp, Mus musculus
tccaagcactccaaagacgtggggc

SEQ ID NO: 324021 - DNA, 25 bp, Mus musculus
ggaaagtggcgctgccgctttaaga

SEQ ID NO: 324022 - DNA, 25 bp, Mus musculus
tgcccggctaccgaccctcggcgcc

SEQ ID NO: 324023 - DNA, 25 bp, Mus musculus
acccagccgctcctcgggctgcccg

SEQ ID NO: 324024 - DNA, 25 bp, Mus musculus
cccgttcctccacccagccgctcct

SEQ ID NO: 324025 - DNA, 25 bp, Mus musculus
atctgcggggcccattcccgttcct

SEQ ID NO: 324026 - DNA, 25 bp, Mus musculus
gcttcattatcctgattgattcctc

SEQ ID NO: 324027 - DNA, 25 bp, Mus musculus
gtggcttcattatcctgattgattc

SEQ ID NO: 324028 - DNA, 25 bp, Mus musculus
ggctgtggcttcattatcctgattg

SEQ ID NO: 324029 - DNA, 25 bp, Mus musculus
ctccgaaccgtctggcggacttggc

SEQ ID NO: 324030 - DNA, 25 bp, Mus musculus
tcctccgaaccgtctggcggacttg

SEQ ID NO: 324031 - DNA, 25 bp, Mus musculus
gagcgccgtccagccttcccgcgcg

SEQ ID NO: 324032 - DNA, 25 bp, Mus musculus
ctgggttgccaaggcgcggttgcca

SEQ ID NO: 324033 - DNA, 25 bp, Mus musculus
ggcgctgccgctttaagattctccc

SEQ ID NO: 324034 - DNA, 25 bp, Mus musculus
gtggcgctgccgctttaagattctc

SEQ ID NO: 324035 - DNA, 25 bp, Mus musculus
tcagacagatacaaacacgcagatg

SEQ ID NO: 324036 - DNA, 25 bp, Mus musculus
tagcacagacacaggcgttcacaca

SEQ ID NO: 324037 - DNA, 25 bp, Mus musculus
agatgcacccagaaacgcccacggg

SEQ ID NO: 324038 - DNA, 25 bp, Mus musculus
aacacgcagatgcacccagaaacgc

SEQ ID NO: 324039 - DNA, 25 bp, Mus musculus
ggaaaggagtctcccaccgctggtg

SEQ ID NO: 324040 - DNA, 25 bp, Mus musculus
agtctcccaccgctggtgtctctgt

SEQ ID NO: 324041 - DNA, 25 bp, Mus musculus
cagacacaggcgttcacacagactc

SEQ ID NO: 324042 - DNA, 25 bp, Mus musculus
cgctcgcacaaatccggaaaggagt

SEQ ID NO: 324043 - DNA, 25 bp, Mus musculus
agtcaccgctcgcacaaatccggaa

SEQ ID NO: 324044 - DNA, 25 bp, Mus musculus
aaagaaccgcacgagtcaccgctcg

SEQ ID NO: 324045 - DNA, 25 bp, Mus musculus
ttcacacagactcgggtatgcgccc

SEQ ID NO: 324046 - DNA, 25 bp, Mus musculus
aggcgttcacacagactcgggtatg

SEQ ID NO: 324047 - DNA, 25 bp, Mus musculus
cacaaatccggaaaggagtctccca

SEQ ID NO: 324048 - DNA, 25 bp, Mus musculus
ggggacacggctcagacagatacaa

SEQ ID NO: 324049 - DNA, 25 bp, Mus musculus
tcctccacgaagagacactggcttg

SEQ ID NO: 324050 - DNA, 25 bp, Mus musculus
gaccctcgtactcggagctgttgta

SEQ ID NO: 324051 - DNA, 25 bp, Mus musculus
cccagctggcgaacttgggcacgtc

SEQ ID NO: 324052 - DNA, 25 bp, Mus musculus
gtgggttcagggatctcttctcctc

SEQ ID NO: 324053 - DNA, 25 bp, Mus musculus
cttgacctcagccaacgtgggttca

SEQ ID NO: 324054 - DNA, 25 bp, Mus musculus
gccttggtcatcttgcgtttcttcg

SEQ ID NO: 324055 - DNA, 25 bp, Mus musculus
ctgcgtcttggagtagcagggcacc

SEQ ID NO: 324056 - DNA, 25 bp, Mus musculus
cgcaagatctccgagagagcccaga

SEQ ID NO: 324057 - DNA, 25 bp, Mus musculus
ggccgcttcccggagcgcaagatct

SEQ ID NO: 324058 - DNA, 25 bp, Mus musculus
cgtaggacaccagatccggccgctt

SEQ ID NO: 324059 - DNA, 25 bp, Mus musculus
gcacagagtctgcacgtaggacacc

SEQ ID NO: 324060 - DNA, 25 bp, Mus musculus
accagattcgtggtgggctgtgaca

SEQ ID NO: 324061 - DNA, 25 bp, Mus musculus
ggtctcgatcttggacagcttctgc

SEQ ID NO: 324062 - DNA, 25 bp, Mus musculus
ttacgagagtttagctgcaggcagc

SEQ ID NO: 324063 - DNA, 25 bp, Mus musculus
ccgcggagcgagtgtggcatctcta

SEQ ID NO: 324064 - DNA, 25 bp, Mus musculus
gtcacgggcagcagctatcacatga

SEQ ID NO: 324065 - DNA, 25 bp, Mus musculus
cgggcagcagctatcacatgagaga

SEQ ID NO: 324066 - DNA, 25 bp, Mus musculus
agcagctatcacatgagagacggtg

SEQ ID NO: 324067 - DNA, 25 bp, Mus musculus
tatcacatgagagacggtgattggc

SEQ ID NO: 324068 - DNA, 25 bp, Mus musculus
gtaccagcctctatgccaggccata

SEQ ID NO: 324069 - DNA, 25 bp, Mus musculus
taccaggcggggtaccagcctctat

SEQ ID NO: 324070 - DNA, 25 bp, Mus musculus
ccggcgtcttcagagcgccatgcga

SEQ ID NO: 324071 - DNA, 25 bp, Mus musculus
agcgagtgtggcatctctaccaggc

SEQ ID NO: 324072 - DNA, 25 bp, Mus musculus
ttcagagcgccatgcgagccgcgga

SEQ ID NO: 324073 - DNA, 25 bp, Mus musculus
ggccatatgggcttggcacgtcacg

SEQ ID NO: 324074 - DNA, 25 bp, Mus musculus
tctatgccaggccatatgggcttgg

SEQ ID NO: 324075 - DNA, 25 bp, Mus musculus
tggcatctctaccaggcggggtacc

SEQ ID NO: 324076 - DNA, 25 bp, Mus musculus
acggtgattggcatgcgtctgcatt

SEQ ID NO: 324077 - DNA, 25 bp, Mus musculus
gaacctctcgctgctgtcatcatcg

SEQ ID NO: 324078 - DNA, 25 bp, Mus musculus
gtacagggagcgcagcccgttccct

SEQ ID NO: 324079 - DNA, 25 bp, Mus musculus
caacatctgcaggtgttgcggtgga

SEQ ID NO: 324080 - DNA, 25 bp, Mus musculus
tgcaggggcaacatctgcaggtgtt

SEQ ID NO: 324081 - DNA, 25 bp, Mus musculus
cctctcggaaggtgctcagctgcag

SEQ ID NO: 324082 - DNA, 25 bp, Mus musculus
ggctcctctcggaaggtgctcagct

SEQ ID NO: 324083 - DNA, 25 bp, Mus musculus
agatgggctcctctcggaaggtgct

SEQ ID NO: 324084 - DNA, 25 bp, Mus musculus
tctcgctgctgtcatcatcgtcgtc

SEQ ID NO: 324085 - DNA, 25 bp, Mus musculus
gtgttcccttcacgctcatacacga

SEQ ID NO: 324086 - DNA, 25 bp, Mus musculus
cgctcatacacgaactcctgcagga

SEQ ID NO: 324087 - DNA, 25 bp, Mus musculus
atacacgaactcctgcaggagcttg

SEQ ID NO: 324088 - DNA, 25 bp, Mus musculus
aactcctgcaggagcttgaacctct

SEQ ID NO: 324089 - DNA, 25 bp, Mus musculus
ctgcaggagcttgaacctctcgctg

SEQ ID NO: 324090 - DNA, 25 bp, Mus musculus
gagcttgaacctctcgctgctgtca

SEQ ID NO: 324091 - DNA, 25 bp, Mus musculus
ccagcactgggagggcctagcagga

SEQ ID NO: 324092 - DNA, 25 bp, Mus musculus
tgcactttctcaggccgcgccctag

SEQ ID NO: 324093 - DNA, 25 bp, Mus musculus
tcactgtcccgttctcctgcacttt

SEQ ID NO: 324094 - DNA, 25 bp, Mus musculus
cggctgcgtgcctcgtggtgccact

SEQ ID NO: 324095 - DNA, 25 bp, Mus musculus
cacgggtgatatgcggctgcgtgcc

SEQ ID NO: 324096 - DNA, 25 bp, Mus musculus
tgagaatgcggcgacgttgccggga

SEQ ID NO: 324097 - DNA, 25 bp, Mus musculus
acgccagatggcgtggctgagaatg

SEQ ID NO: 324098 - DNA, 25 bp, Mus musculus
gggctttggtcccacccagcactgg

SEQ ID NO: 324099 - DNA, 25 bp, Mus musculus
gcctagcaggagctgaatgagtgtc

SEQ ID NO: 324100 - DNA, 25 bp, Mus musculus
aggagctgaatgagtgtcgcgcatc

SEQ ID NO: 324101 - DNA, 25 bp, Mus musculus
ctgaatgagtgtcgcgcatcagacc

SEQ ID NO: 324102 - DNA, 25 bp, Mus musculus
gtgtcgcgcatcagaccgcagctgc

SEQ ID NO: 324103 - DNA, 25 bp, Mus musculus
ctaggctgggctttggtcccaccca

SEQ ID NO: 324104 - DNA, 25 bp, Mus musculus
caggccgcgccctaggctgggcttt

SEQ ID NO: 324105 - DNA, 25 bp, Mus musculus
gcagggagacagcttgtgccagccc

SEQ ID NO: 324106 - DNA, 25 bp, Mus musculus
tgacctccagaggtcgcctggggac

SEQ ID NO: 324107 - DNA, 25 bp, Mus musculus
ctttaaggtgccaccgccgcgtggc

SEQ ID NO: 324108 - DNA, 25 bp, Mus musculus
acgctgcgcctttaaggtgccaccg

SEQ ID NO: 324109 - DNA, 25 bp, Mus musculus
aggacgctgcgcctttaaggtgcca

SEQ ID NO: 324110 - DNA, 25 bp, Mus musculus
tccaggtggcctccgcgcccaccct

SEQ ID NO: 324111 - DNA, 25 bp, Mus musculus
atcgcgctcgcagctccgacttctt

SEQ ID NO: 324112 - DNA, 25 bp, Mus musculus
tgcataacaatcaggcgcgcgcttg

SEQ ID NO: 324113 - DNA, 25 bp, Mus musculus
gcgacgagaaacacaatgcataaca

SEQ ID NO: 324114 - DNA, 25 bp, Mus musculus
ctcgcgacgagaaacacaatgcata

SEQ ID NO: 324115 - DNA, 25 bp, Mus musculus
tccgctcgcgacgagaaacacaatg

SEQ ID NO: 324116 - DNA, 25 bp, Mus musculus
ggctccgctcgcgacgagaaacaca

SEQ ID NO: 324117 - DNA, 25 bp, Mus musculus
tccttcgtctgcctagctccgggtt

SEQ ID NO: 324118 - DNA, 25 bp, Mus musculus
tagctccgggttctcgcctcaccac

SEQ ID NO: 324119 - DNA, 25 bp, Mus musculus
gcgaagaggttaaagccagagtccc

SEQ ID NO: 324120 - DNA, 25 bp, Mus musculus
agattcagttctctgtgcccgcgcc

SEQ ID NO: 324121 - DNA, 25 bp, Mus musculus
ggaccgcaagaagattcagttctct

SEQ ID NO: 324122 - DNA, 25 bp, Mus musculus
agccgagcagggctcagccagacac

SEQ ID NO: 324123 - DNA, 25 bp, Mus musculus
cagctccggacagccgagcagggct

SEQ ID NO: 324124 - DNA, 25 bp, Mus musculus
gtgcggggacagtgctcctcctcct

SEQ ID NO: 324125 - DNA, 25 bp, Mus musculus
cgttctcctcgtggagcgcgggatt

SEQ ID NO: 324126 - DNA, 25 bp, Mus musculus
gatcctgagctctgacctggggacg

SEQ ID NO: 324127 - DNA, 25 bp, Mus musculus
ccgagatagctcaggccggcagcca

SEQ ID NO: 324128 - DNA, 25 bp, Mus musculus
acagaagctggtagagcaaggccga

SEQ ID NO: 324129 - DNA, 25 bp, Mus musculus
ttctcgatgctcattggccgctttc

SEQ ID NO: 324130 - DNA, 25 bp, Mus musculus
cagcccgggagaacacgcttctcga

SEQ ID NO: 324131 - DNA, 25 bp, Mus musculus
gcgtcaccgctggacttcattaata

SEQ ID NO: 324132 - DNA, 25 bp, Mus musculus
tacaacgccgagttctggggatact

SEQ ID NO: 324133 - DNA, 25 bp, Mus musculus
ggtcacacgaatcccgattggcttt

SEQ ID NO: 324134 - DNA, 25 bp, Mus musculus
cggagcttcagggtcacacgaatcc

SEQ ID NO: 324135 - DNA, 25 bp, Mus musculus
tagcgccgccgggagctctccttcc

SEQ ID NO: 324136 - DNA, 25 bp, Mus musculus
tggttcggtccgacccagcccacac

SEQ ID NO: 324137 - DNA, 25 bp, Mus musculus
cccttcctctccactcgctgctgcg

SEQ ID NO: 324138 - DNA, 25 bp, Mus musculus
ttccggacctcgtctccgagagagg

SEQ ID NO: 324139 - DNA, 25 bp, Mus musculus
ttcagggtcacacgaatcccgattg

SEQ ID NO: 324140 - DNA, 25 bp, Mus musculus
acacgaatcccgattggctttgggg

SEQ ID NO: 324141 - DNA, 25 bp, Mus musculus
ccttccgctctgaggagttgccagg

SEQ ID NO: 324142 - DNA, 25 bp, Mus musculus
ggcggtggtacaagagctgtctcta

SEQ ID NO: 324143 - DNA, 25 bp, Mus musculus
agagctgtctctacccgacggatcc

SEQ ID NO: 324144 - DNA, 25 bp, Mus musculus
acggatcccgctttcctgcccggtg

SEQ ID NO: 324145 - DNA, 25 bp, Mus musculus
ctgcccggtgtccgtctttggttcg

SEQ ID NO: 324146 - DNA, 25 bp, Mus musculus
ttgtggctccgcttccggacctcgt

SEQ ID NO: 324147 - DNA, 25 bp, Mus musculus
cggccaagatcaatcccggcaagta

SEQ ID NO: 324148 - DNA, 25 bp, Mus musculus
gccagcctccaccaatcgatttgaa

SEQ ID NO: 324149 - DNA, 25 bp, Mus musculus
atgcctgtttgctaatgtctccgtg

SEQ ID NO: 324150 - DNA, 25 bp, Mus musculus
gctgtcctgggatatgcctgtttgc

SEQ ID NO: 324151 - DNA, 25 bp, Mus musculus
gtccgcgtttcggaattgctgtcct

SEQ ID NO: 324152 - DNA, 25 bp, Mus musculus
catgccaggggcctaaggctggatt

SEQ ID NO: 324153 - DNA, 25 bp, Mus musculus
aacacgtgcgtggttgtacagcgca

SEQ ID NO: 324154 - DNA, 25 bp, Mus musculus
cccggcaagtacgactagaggaaca

SEQ ID NO: 324155 - DNA, 25 bp, Mus musculus
ctttgcgtctccatctcggccaaga

SEQ ID NO: 324156 - DNA, 25 bp, Mus musculus
taatgtctccgtgccctcatacgct

SEQ ID NO: 324157 - DNA, 25 bp, Mus musculus
ccctctgtgcgtgacgggagtaaag

SEQ ID NO: 324158 - DNA, 25 bp, Mus musculus
gtgtccatgcgtccggcttctccat

SEQ ID NO: 324159 - DNA, 25 bp, Mus musculus
gactgctcagcctgtcgtttcttcg

SEQ ID NO: 324160 - DNA, 25 bp, Mus musculus
tcctccgttccggtgctttgcgtct

SEQ ID NO: 324161 - DNA, 25 bp, Mus musculus
tcttcacgcccaccaaggtgggggc

SEQ ID NO: 324162 - DNA, 25 bp, Mus musculus
ggagacccccatccagcttcgggag

SEQ ID NO: 324163 - DNA, 25 bp, Mus musculus
cagctgccgtaccagcgggtgctgc

SEQ ID NO: 324164 - DNA, 25 bp, Mus musculus
ataccagctgccgtaccagcgggtg

SEQ ID NO: 324165 - DNA, 25 bp, Mus musculus
aggaataccagctgccgtaccagcg

SEQ ID NO: 324166 - DNA, 25 bp, Mus musculus
ggctacaggaataccagctgccgta

SEQ ID NO: 324167 - DNA, 25 bp, Mus musculus
ccgtgggctacaggaataccagctg

SEQ ID NO: 324168 - DNA, 25 bp, Mus musculus
ctcggccgtgggctacaggaatacc

SEQ ID NO: 324169 - DNA, 25 bp, Mus musculus
atgcgcctgggtatcctcggccgtg

SEQ ID NO: 324170 - DNA, 25 bp, Mus musculus
ctggtgatgcgcctgggtatcctcg

SEQ ID NO: 324171 - DNA, 25 bp, Mus musculus
gctcaccatggctggtgatgcgcct

SEQ ID NO: 324172 - DNA, 25 bp, Mus musculus
ggtacagcgctcaccatggctggtg

SEQ ID NO: 324173 - DNA, 25 bp, Mus musculus
ggtggtacagcgctcaccatggctg

SEQ ID NO: 324174 - DNA, 25 bp, Mus musculus
cggccagtgcgtggagcgccaggac

SEQ ID NO: 324175 - DNA, 25 bp, Mus musculus
cgctgcatggcacaagtctttgcta

SEQ ID NO: 324176 - DNA, 25 bp, Mus musculus
cgaagcacgctgcagagatggaccc

SEQ ID NO: 324177 - DNA, 25 bp, Mus musculus
ttggaagctgcgctgcatggcacaa

SEQ ID NO: 324178 - DNA, 25 bp, Mus musculus
agcaaccctgatggcgtcgggcctt

SEQ ID NO: 324179 - DNA, 25 bp, Mus musculus
tggagacctgagcaaccctgatggc

SEQ ID NO: 324180 - DNA, 25 bp, Mus musculus
gcgcctcctcgtggagacctgagca

SEQ ID NO: 324181 - DNA, 25 bp, Mus musculus
acaactacgcgcctcctcgtggaga

SEQ ID NO: 324182 - DNA, 25 bp, Mus musculus
ttgctaccggtgagcaccggaaacg

SEQ ID NO: 324183 - DNA, 25 bp, Mus musculus
cccgcgcctatctccgcaacaacta

SEQ ID NO: 324184 - DNA, 25 bp, Mus musculus
gccttggcttaccagcgcttcgagc

SEQ ID NO: 324185 - DNA, 25 bp, Mus musculus
gccaggtagctgtcgccttggctta

SEQ ID NO: 324186 - DNA, 25 bp, Mus musculus
tgactccgacgctggccaggtagct

SEQ ID NO: 324187 - DNA, 25 bp, Mus musculus
cagagatggaccctgactccgacgc

SEQ ID NO: 324188 - DNA, 25 bp, Mus musculus
atggcacaagtctttgctaccggtg

SEQ ID NO: 324189 - DNA, 25 bp, Mus musculus
gcgagtcccactgccaaggttagca

SEQ ID NO: 324190 - DNA, 25 bp, Mus musculus
attctgtcactgtgcccggccgctg

SEQ ID NO: 324191 - DNA, 25 bp, Mus musculus
ccaagacgaacaggcggggctttca

SEQ ID NO: 324192 - DNA, 25 bp, Mus musculus
ggggcttaccagctaggctcatgta

SEQ ID NO: 324193 - DNA, 25 bp, Mus musculus
ctaggctcatgtagattggctggcg

SEQ ID NO: 324194 - DNA, 25 bp, Mus musculus
ggcgccgtccgcttggccattctgt

SEQ ID NO: 324195 - DNA, 25 bp, Mus musculus
ttgggagaagacgaagtcccacttc

SEQ ID NO: 324196 - DNA, 25 bp, Mus musculus
ccggaagtacctgtgttcatcgttg

SEQ ID NO: 324197 - DNA, 25 bp, Mus musculus
ttcatcgttgcatcctccgctgacg

SEQ ID NO: 324198 - DNA, 25 bp, Mus musculus
cttcagtgcgtctcccgaacagttc

SEQ ID NO: 324199 - DNA, 25 bp, Mus musculus
gaacagttccgttcctcgcatcgga

SEQ ID NO: 324200 - DNA, 25 bp, Mus musculus
ttcctcgcatcggagcacgcagtcg

SEQ ID NO: 324201 - DNA, 25 bp, Mus musculus
acgcagtcgcggtacacgggctcgc

SEQ ID NO: 324202 - DNA, 25 bp, Mus musculus
tgccaaggttagcagcagcagcggc

SEQ ID NO: 324203 - DNA, 25 bp, Mus musculus
tgggagcagccactcccagtcttgc

SEQ ID NO: 324204 - DNA, 25 bp, Mus musculus
cgggctccaggagactccgggaact

SEQ ID NO: 324205 - DNA, 25 bp, Mus musculus
ggaactccttgggaaagttctctga

SEQ ID NO: 324206 - DNA, 25 bp, Mus musculus
tgggaaagttctctgaaactagtcg

SEQ ID NO: 324207 - DNA, 25 bp, Mus musculus
ttttcctccggagggtgtgtgaagc

SEQ ID NO: 324208 - DNA, 25 bp, Mus musculus
cgctttctcagagctcttccagttg

SEQ ID NO: 324209 - DNA, 25 bp, Mus musculus
gagctcttccagttggcagcctccg

SEQ ID NO: 324210 - DNA, 25 bp, Mus musculus
agaaccacactggaggtccggaccg

SEQ ID NO: 324211 - DNA, 25 bp, Mus musculus
cactcggagaaccacactggaggtc

SEQ ID NO: 324212 - DNA, 25 bp, Mus musculus
gatgggacagtcactcggagaacca

SEQ ID NO: 324213 - DNA, 25 bp, Mus musculus
ccgcagtgatcatcatggagctggc

SEQ ID NO: 324214 - DNA, 25 bp, Mus musculus
ccggagccgcagtgatcatcatgga

SEQ ID NO: 324215 - DNA, 25 bp, Mus musculus
cttctcgctacaccggagcctcccg

SEQ ID NO: 324216 - DNA, 25 bp, Mus musculus
ccagtcttgctggaatgcagttgga

SEQ ID NO: 324217 - DNA, 25 bp, Mus musculus
ccagctccaggtaggtcgcctcaaa

SEQ ID NO: 324218 - DNA, 25 bp, Mus musculus
gcgactcaatctcaatgcccggata

SEQ ID NO: 324219 - DNA, 25 bp, Mus musculus
aggtcgcctcaaagccgcagggttt

SEQ ID NO: 324220 - DNA, 25 bp, Mus musculus
cgggcgagcacaagaggctcctttt

SEQ ID NO: 324221 - DNA, 25 bp, Mus musculus
agaggctccttttcaacccgagtgg

SEQ ID NO: 324222 - DNA, 25 bp, Mus musculus
tttcaacccgagtggcttaccagta

SEQ ID NO: 324223 - DNA, 25 bp, Mus musculus
ggcttaccagtactccaccacgatg

SEQ ID NO: 324224 - DNA, 25 bp, Mus musculus
gtactccaccacgatgtggactcca

SEQ ID NO: 324225 - DNA, 25 bp, Mus musculus
atgtggactccactgcctgcttcca

SEQ ID NO: 324226 - DNA, 25 bp, Mus musculus
cttccgggtgtgacgccacgccaaa

SEQ ID NO: 324227 - DNA, 25 bp, Mus musculus
tgacgccacgccaaagtcacgtggg

SEQ ID NO: 324228 - DNA, 25 bp, Mus musculus
gcgtgtccggacctcgctttgcgtc

SEQ ID NO: 324229 - DNA, 25 bp, Mus musculus
cgagtcgcgactcaatctcaatgcc

SEQ ID NO: 324230 - DNA, 25 bp, Mus musculus
ctcaaagccgcagggtttactgggg

SEQ ID NO: 324231 - DNA, 25 bp, Mus musculus
gcagttctggaaatcccacttgaaa

SEQ ID NO: 324232 - DNA, 25 bp, Mus musculus
ggagcacatctttgcgcaccgcatt

SEQ ID NO: 324233 - DNA, 25 bp, Mus musculus
tccatgacgaggagcacatctttgc

SEQ ID NO: 324234 - DNA, 25 bp, Mus musculus
acgtcctcttcgttctccatgacga

SEQ ID NO: 324235 - DNA, 25 bp, Mus musculus
tgtgcgccgacgtcctcttcgttct

SEQ ID NO: 324236 - DNA, 25 bp, Mus musculus
atgctgcctgtttactggacaaccc

SEQ ID NO: 324237 - DNA, 25 bp, Mus musculus
gggaccagcgatgctgcctgtttac

SEQ ID NO: 324238 - DNA, 25 bp, Mus musculus
cttgaaaaaagtccagaagcctctg

SEQ ID NO: 324239 - DNA, 25 bp, Mus musculus
tttggcatcaaggacgtgttcgaca

SEQ ID NO: 324240 - DNA, 25 bp, Mus musculus
aggtggcgaaggaacttggcatccc

SEQ ID NO: 324241 - DNA, 25 bp, Mus musculus
aggaacttggcatcccgtactacga

SEQ ID NO: 324242 - DNA, 25 bp, Mus musculus
cccgagtgtccgtctgcggggacca

SEQ ID NO: 324243 - DNA, 25 bp, Mus musculus
cagcgtgtttgaccagtttggcatc

SEQ ID NO: 324244 - DNA, 25 bp, Mus musculus
ccgtactacgagaccagcgtgtttg

SEQ ID NO: 324245 - DNA, 25 bp, Mus musculus
cgcctgcacgacaacacaattgctg

SEQ ID NO: 324246 - DNA, 25 bp, Mus musculus
cccagatctgttgcgtgtccgcagc

SEQ ID NO: 324247 - DNA, 25 bp, Mus musculus
tcacttctggatcccgctttgctgg

SEQ ID NO: 324248 - DNA, 25 bp, Mus musculus
tgaccctggcggtttcacttctgga

SEQ ID NO: 324249 - DNA, 25 bp, Mus musculus
gggagctcctacctcgctgcagtgc

SEQ ID NO: 324250 - DNA, 25 bp, Mus musculus
ggaactacaggcgacacctcccgag

SEQ ID NO: 324251 - DNA, 25 bp, Mus musculus
cagcggccattcctggaactacagg

SEQ ID NO: 324252 - DNA, 25 bp, Mus musculus
gctgcagtgtcacccagcggccatt

SEQ ID NO: 324253 - DNA, 25 bp, Mus musculus
gggtctgcagcgacatcacatcttg

SEQ ID NO: 324254 - DNA, 25 bp, Mus musculus
caaatactcgccgtcggtccctgga

SEQ ID NO: 324255 - DNA, 25 bp, Mus musculus
tttgaacgaggacccaaatactcgc

SEQ ID NO: 324256 - DNA, 25 bp, Mus musculus
cacaattgctgacaacctgacgttt

SEQ ID NO: 324257 - DNA, 25 bp, Mus musculus
gagtcccacccacacagatgtgtgc

SEQ ID NO: 324258 - DNA, 25 bp, Mus musculus
gtgtgcaaggtgatccggtgtccat

SEQ ID NO: 324259 - DNA, 25 bp, Mus musculus
cacccacttttgaatgtcaagcctg

SEQ ID NO: 324260 - DNA, 25 bp, Mus musculus
ctcaccttccatgtcgccgcgggcc

SEQ ID NO: 324261 - DNA, 25 bp, Mus musculus
ctccacgtgctgctgccgtggggac

SEQ ID NO: 324262 - DNA, 25 bp, Mus musculus
tcgggacgtctacttgagaaacacc

SEQ ID NO: 324263 - DNA, 25 bp, Mus musculus
ctggcggccgctttaaagcacgctc

SEQ ID NO: 324264 - DNA, 25 bp, Mus musculus
ttaaagcacgctccgagtgccgcgg

SEQ ID NO: 324265 - DNA, 25 bp, Mus musculus
agcacgctccgagtgccgcgggttc

SEQ ID NO: 324266 - DNA, 25 bp, Mus musculus
ctgaggaaccctgatcgcgtggaaa

SEQ ID NO: 324267 - DNA, 25 bp, Mus musculus
accgtctcgggacgtctacttgaga

SEQ ID NO: 324268 - DNA, 25 bp, Mus musculus
tttgaatgtcaagcctgaggaaccc

SEQ ID NO: 324269 - DNA, 25 bp, Mus musculus
ctcagcgaccgtctcgggacgtcta

SEQ ID NO: 324270 - DNA, 25 bp, Mus musculus
tggaaacagtgcctcagcgaccgtc

SEQ ID NO: 324271 - DNA, 25 bp, Mus musculus
ctgatcgcgtggaaacagtgcctca

SEQ ID NO: 324272 - DNA, 25 bp, Mus musculus
ggttccgcacccacttttgaatgtc

SEQ ID NO: 324273 - DNA, 25 bp, Mus musculus
gtcgccactagtgcctgagccgtga

SEQ ID NO: 324274 - DNA, 25 bp, Mus musculus
gtttcctttactcgtcacaccacca

SEQ ID NO: 324275 - DNA, 25 bp, Mus musculus
ggccctactctacgcggtgctctgg

SEQ ID NO: 324276 - DNA, 25 bp, Mus musculus
actagtgcctgagccgtgatgcttg

SEQ ID NO: 324277 - DNA, 25 bp, Mus musculus
tgcttcgctctgtagaggagcgatg

SEQ ID NO: 324278 - DNA, 25 bp, Mus musculus
ttggcggtttgcttcgctctgtaga

SEQ ID NO: 324279 - DNA, 25 bp, Mus musculus
gaagatgcccttggcggtttgcttc

SEQ ID NO: 324280 - DNA, 25 bp, Mus musculus
aacacgcaggcgctctcgggcacag

SEQ ID NO: 324281 - DNA, 25 bp, Mus musculus
tgccaagccggaacacgcaggcgct

SEQ ID NO: 324282 - DNA, 25 bp, Mus musculus
agggtgcagcgctccgcaactgcgc

SEQ ID NO: 324283 - DNA, 25 bp, Mus musculus
acccaaggagaggtgcgaaaggctc

SEQ ID NO: 324284 - DNA, 25 bp, Mus musculus
caccaccaggccgactagagctaga

SEQ ID NO: 324285 - DNA, 25 bp, Mus musculus
actagagctagagagcgggaacacg

SEQ ID NO: 324286 - DNA, 25 bp, Mus musculus
tgatgcttgcgtgggccctactcta

SEQ ID NO: 324287 - DNA, 25 bp, Mus musculus
cttttgatcccaccgcgagctttgg

SEQ ID NO: 324288 - DNA, 25 bp, Mus musculus
gagccttcgggcttcaccactccga

SEQ ID NO: 324289 - DNA, 25 bp, Mus musculus
cgctccagcagctgtaacaaaccag

SEQ ID NO: 324290 - DNA, 25 bp, Mus musculus
ggtgacgtcactaccacgcgcctat

SEQ ID NO: 324291 - DNA, 25 bp, Mus musculus
actaccacgcgcctatcacgttgtg

SEQ ID NO: 324292 - DNA, 25 bp, Mus musculus
gcctatcacgttgtgcctcttggga

SEQ ID NO: 324293 - DNA, 25 bp, Mus musculus
cacgttgtgcctcttgggaagtgta

SEQ ID NO: 324294 - DNA, 25 bp, Mus musculus
ggaagtgtagtttctaggctgcctc

SEQ ID NO: 324295 - DNA, 25 bp, Mus musculus
agtttctaggctgcctcctcaccgg

SEQ ID NO: 324296 - DNA, 25 bp, Mus musculus
gagttgtaggcttttccctggtcta

SEQ ID NO: 324297 - DNA, 25 bp, Mus musculus
gtctagcttttgatcccaccgcgag

SEQ ID NO: 324298 - DNA, 25 bp, Mus musculus
ccgtctggactcaccgcgcggggtt

SEQ ID NO: 324299 - DNA, 25 bp, Mus musculus
ggcttttccctggtctagcttttga

SEQ ID NO: 324300 - DNA, 25 bp, Mus musculus
tgtaacaaaccagcggcggtggcta

SEQ ID NO: 324301 - DNA, 25 bp, Mus musculus
acggcaaggcagctgcgaccgagca

SEQ ID NO: 324302 - DNA, 25 bp, Mus musculus
gtttgcagctgctcggtcatcgtgc

SEQ ID NO: 324303 - DNA, 25 bp, Mus musculus
tgctcggtcatcgtgcggcccgacg

SEQ ID NO: 324304 - DNA, 25 bp, Mus musculus
gcccggctctgtgcctggtctctgg

SEQ ID NO: 324305 - DNA, 25 bp, Mus musculus
cctggtctctggtgtgagggtttac

SEQ ID NO: 324306 - DNA, 25 bp, Mus musculus
cgcgatcaccggtgacagcggccag

SEQ ID NO: 324307 - DNA, 25 bp, Mus musculus
tcgtgccgcgatcaccggtgacagc

SEQ ID NO: 324308 - DNA, 25 bp, Mus musculus
ccacgtcggggtcgtgccgcgatca

SEQ ID NO: 324309 - DNA, 25 bp, Mus musculus
tggacactgtcaccttagaaggtac

SEQ ID NO: 324310 - DNA, 25 bp, Mus musculus
ctgcgaccgagcactcccagagaga

SEQ ID NO: 324311 - DNA, 25 bp, Mus musculus
aggcgccgacaaggcaaagccgccg

SEQ ID NO: 324312 - DNA, 25 bp, Mus musculus
cgccgaggcgccgacaaggcaaagc

SEQ ID NO: 324313 - DNA, 25 bp, Mus musculus
gcgccatgaagcaggagggctcggc

SEQ ID NO: 324314 - DNA, 25 bp, Mus musculus
gagcactcccagagagagctggaca

SEQ ID NO: 324315 - DNA, 25 bp, Mus musculus
caagcctcgggactgaagtgcgcac

SEQ ID NO: 324316 - DNA, 25 bp, Mus musculus
catggcgtcatcatcgtgcgaccta

SEQ ID NO: 324317 - DNA, 25 bp, Mus musculus
agcgggactgctcgcttctagcgta

SEQ ID NO: 324318 - DNA, 25 bp, Mus musculus
gatcacgtccgtcctgtggccgact

SEQ ID NO: 324319 - DNA, 25 bp, Mus musculus
gtcgtgctcccgtcacagtctcttt

SEQ ID NO: 324320 - DNA, 25 bp, Mus musculus
cgggtgcttgtcgtgctcccgtcac

SEQ ID NO: 324321 - DNA, 25 bp, Mus musculus
tgcagaaccgcgttcgggtgcttgt

SEQ ID NO: 324322 - DNA, 25 bp, Mus musculus
tgaggtattgtgcagaaccgcgttc

SEQ ID NO: 324323 - DNA, 25 bp, Mus musculus
ccacggtattgaggtattgtgcaga

SEQ ID NO: 324324 - DNA, 25 bp, Mus musculus
caggcgtccacggtattgaggtatt

SEQ ID NO: 324325 - DNA, 25 bp, Mus musculus
tatttcccggagacaggcgtccacg

SEQ ID NO: 324326 - DNA, 25 bp, Mus musculus
tcgtgcgacctatttcccggagaca

SEQ ID NO: 324327 - DNA, 25 bp, Mus musculus
cagaagccgtgtcatggcgtcatca

SEQ ID NO: 324328 - DNA, 25 bp, Mus musculus
cgcttctagcgtagtccctgcagtg

SEQ ID NO: 324329 - DNA, 25 bp, Mus musculus
gagcaagggggcattaatatgcaaa

SEQ ID NO: 324330 - DNA, 25 bp, Mus musculus
cgggtgaccctgtcacagcccgaga

SEQ ID NO: 324331 - DNA, 25 bp, Mus musculus
tcagtcttttccggcgcccgggtga

SEQ ID NO: 324332 - DNA, 25 bp, Mus musculus
tcccgccgccgacctcagtcttttc

SEQ ID NO: 324333 - DNA, 25 bp, Mus musculus
aaagccgcgggtctctggccagctt

SEQ ID NO: 324334 - DNA, 25 bp, Mus musculus
gcgattgattatgcaaagccgcggg

SEQ ID NO: 324335 - DNA, 25 bp, Mus musculus
catcgcgattgattatgcaaagccg

SEQ ID NO: 324336 - DNA, 25 bp, Mus musculus
tatgcaaatgcatcgcgattgatta

SEQ ID NO: 324337 - DNA, 25 bp, Mus musculus
cgcgccaagccgaggtaaggaggag

SEQ ID NO: 324338 - DNA, 25 bp, Mus musculus
cgcgtcgttgctcagctcggaccag

SEQ ID NO: 324339 - DNA, 25 bp, Mus musculus
cggtctgctgcgcattcccgggttg

SEQ ID NO: 324340 - DNA, 25 bp, Mus musculus
gctagccacttacgccctggggaaa

SEQ ID NO: 324341 - DNA, 25 bp, Mus musculus
acagcccgagagctagccacttacg

SEQ ID NO: 324342 - DNA, 25 bp, Mus musculus
gaccctgtcacagcccgagagctag

SEQ ID NO: 324343 - DNA, 25 bp, Mus musculus
cacccggaaggacagcagcttctcg

SEQ ID NO: 324344 - DNA, 25 bp, Mus musculus
tgcatgttgttcagggtccgcaggt

SEQ ID NO: 324345 - DNA, 25 bp, Mus musculus
tcactgggcgtccacccggaaggac

SEQ ID NO: 324346 - DNA, 25 bp, Mus musculus
cagcttctcggaatgcatgttgttc

SEQ ID NO: 324347 - DNA, 25 bp, Mus musculus
cgtctcgtaaaggagagagaagtgc

SEQ ID NO: 324348 - DNA, 25 bp, Mus musculus
cagcttggtgaagcgggaagtctcc

SEQ ID NO: 324349 - DNA, 25 bp, Mus musculus
cggttcttcagcaccagagcccgaa

SEQ ID NO: 324350 - DNA, 25 bp, Mus musculus
gtgcagagttcgattctgtacaagg

SEQ ID NO: 324351 - DNA, 25 bp, Mus musculus
gctgctccaccgaagcggaattctc

SEQ ID NO: 324352 - DNA, 25 bp, Mus musculus
gaattctccattcccgagcggtctg

SEQ ID NO: 324353 - DNA, 25 bp, Mus musculus
tgagctcctcctctgacacggagga

SEQ ID NO: 324354 - DNA, 25 bp, Mus musculus
acgacagcagtgaggcgagctccct

SEQ ID NO: 324355 - DNA, 25 bp, Mus musculus
tctgacacggaggacacggaggtct

SEQ ID NO: 324356 - DNA, 25 bp, Mus musculus
ccggcagcttgagcagcagcttggt

SEQ ID NO: 324357 - DNA, 25 bp, Mus musculus
gacaagcgttgctccggcaacttga

SEQ ID NO: 324358 - DNA, 25 bp, Mus musculus
tcgcacgtggcaccccaacgaggaa

SEQ ID NO: 324359 - DNA, 25 bp, Mus musculus
cccggaactcgaagcaccgccttct

SEQ ID NO: 324360 - DNA, 25 bp, Mus musculus
cgcttcccttctgtcgcaaggaaaa

SEQ ID NO: 324361 - DNA, 25 bp, Mus musculus
tcctgggtcgtaggctggccctaaa

SEQ ID NO: 324362 - DNA, 25 bp, Mus musculus
taggctggccctaaaaccaagctgg

SEQ ID NO: 324363 - DNA, 25 bp, Mus musculus
ctggccctaaaaccaagctgggccg

SEQ ID NO: 324364 - DNA, 25 bp, Mus musculus
aaccaagctgggccgggacaactga

SEQ ID NO: 324365 - DNA, 25 bp, Mus musculus
aaggcgacaagcgttgctccggcaa

SEQ ID NO: 324366 - DNA, 25 bp, Mus musculus
tgaggggcggagctcattatgtaac

SEQ ID NO: 324367 - DNA, 25 bp, Mus musculus
gcggagctcattatgtaacgaggcc

SEQ ID NO: 324368 - DNA, 25 bp, Mus musculus
tcattatgtaacgaggccgggaggc

SEQ ID NO: 324369 - DNA, 25 bp, Mus musculus
aatgaccaatgagatggcggccacg

SEQ ID NO: 324370 - DNA, 25 bp, Mus musculus
gagagaaggcgacaagcgttgctcc

SEQ ID NO: 324371 - DNA, 25 bp, Mus musculus
tctgctgagccgagcccgccaaact

SEQ ID NO: 324372 - DNA, 25 bp, Mus musculus
tcgtaagctcaaggagccggggccc

SEQ ID NO: 324373 - DNA, 25 bp, Mus musculus
cccggcatcgtaagctcaaggagcc

SEQ ID NO: 324374 - DNA, 25 bp, Mus musculus
cccgagcagcgactggactacgagc

SEQ ID NO: 324375 - DNA, 25 bp, Mus musculus
atccgcagtgttcaaggcggccgcg

SEQ ID NO: 324376 - DNA, 25 bp, Mus musculus
ccatgagatccgcagtgttcaaggc

SEQ ID NO: 324377 - DNA, 25 bp, Mus musculus
gctgctccggaccactatgaccatg

SEQ ID NO: 324378 - DNA, 25 bp, Mus musculus
agaagccgcgttagcggaggcctgc

SEQ ID NO: 324379 - DNA, 25 bp, Mus musculus
ctcagctgcggcctccacttctccg

SEQ ID NO: 324380 - DNA, 25 bp, Mus musculus
tcctgcctctgcggcgaaggcgacg

SEQ ID NO: 324381 - DNA, 25 bp, Mus musculus
cggctgggtgcgagctcctgcctct

SEQ ID NO: 324382 - DNA, 25 bp, Mus musculus
ccctcccggagtaggagggctctgg

SEQ ID NO: 324383 - DNA, 25 bp, Mus musculus
ccctttcacaatagcgctacccgcc

SEQ ID NO: 324384 - DNA, 25 bp, Mus musculus
tatgaccatgagatccgcagtgttc

SEQ ID NO: 324385 - DNA, 25 bp, Mus musculus
aggccgagtgccagcagtttcaaac

SEQ ID NO: 324386 - DNA, 25 bp, Mus musculus
gcaactccaggagcttagaggccga

SEQ ID NO: 324387 - DNA, 25 bp, Mus musculus
cgggatccgccaatccgattgcacg

SEQ ID NO: 324388 - DNA, 25 bp, Mus musculus
gcagtttcaaactcgccgcggtaaa

SEQ ID NO: 324389 - DNA, 25 bp, Mus musculus
ctcgccgcggtaaagctcccgggat

SEQ ID NO: 324390 - DNA, 25 bp, Mus musculus
actgcgcggacgcagcaactccagg

SEQ ID NO: 324391 - DNA, 25 bp, Mus musculus
cgccatacctctctgtcccggctgg

SEQ ID NO: 324392 - DNA, 25 bp, Mus musculus
cagttccggactgcgcggacgcagc

SEQ ID NO: 324393 - DNA, 25 bp, Mus musculus
aaaccgcggccagaggaattgcagg

SEQ ID NO: 324394 - DNA, 25 bp, Mus musculus
atcagagctgagctacgcttgggcg

SEQ ID NO: 324395 - DNA, 25 bp, Mus musculus
gacgttcaaaggagccaatcagagc

SEQ ID NO: 324396 - DNA, 25 bp, Mus musculus
acgtagacgttcaaaggagccaatc

SEQ ID NO: 324397 - DNA, 25 bp, Mus musculus
ccaatccgattgcacgtagacgttc

SEQ ID NO: 324398 - DNA, 25 bp, Mus musculus
ggggccacaccgcagttccggactg

SEQ ID NO: 324399 - DNA, 25 bp, Mus musculus
cagcgcgcttcccaggacacggagg

SEQ ID NO: 324400 - DNA, 25 bp, Mus musculus
aaataaagcgctaggccacgcctcc

SEQ ID NO: 324401 - DNA, 25 bp, Mus musculus
ccgttctccgtaagatggcggaccg

SEQ ID NO: 324402 - DNA, 25 bp, Mus musculus
agctgaccagcggtggccgttctcc

SEQ ID NO: 324403 - DNA, 25 bp, Mus musculus
tccggagtctcgagcttcccggcag

SEQ ID NO: 324404 - DNA, 25 bp, Mus musculus
ctgggactccggagtctcgagcttc

SEQ ID NO: 324405 - DNA, 25 bp, Mus musculus
acgtgaagcacgctgggactccgga

SEQ ID NO: 324406 - DNA, 25 bp, Mus musculus
tctccagaaaacgtgccgcagggtg

SEQ ID NO: 324407 - DNA, 25 bp, Mus musculus
gtcatctcgctctccagaaaacgtg

SEQ ID NO: 324408 - DNA, 25 bp, Mus musculus
tacatcaccgacagacgtcatctcg

SEQ ID NO: 324409 - DNA, 25 bp, Mus musculus
gcagtggctcgctgccttctcagcg

SEQ ID NO: 324410 - DNA, 25 bp, Mus musculus
tgtggggaaataaagcgctaggcca

SEQ ID NO: 324411 - DNA, 25 bp, Mus musculus
gaacccgaagaggatgcaatagccc

SEQ ID NO: 324412 - DNA, 25 bp, Mus musculus
gcttcgggttccgacagcggctctc

SEQ ID NO: 324413 - DNA, 25 bp, Mus musculus
ggccacctctcgctcgcagtccgac

SEQ ID NO: 324414 - DNA, 25 bp, Mus musculus
gctcccagctttcctccgagagccc

SEQ ID NO: 324415 - DNA, 25 bp, Mus musculus
tcagagcgtgtctcgcctgctgctc

SEQ ID NO: 324416 - DNA, 25 bp, Mus musculus
cactgcagcggcgtcagagcgtgtc

SEQ ID NO: 324417 - DNA, 25 bp, Mus musculus
aaatttttgaagaagcagacgtctc

SEQ ID NO: 324418 - DNA, 25 bp, Mus musculus
aagccactggagaaatttttgaaga

SEQ ID NO: 324419 - DNA, 25 bp, Mus musculus
gcagtccgacgcctggcacggccct

SEQ ID NO: 324420 - DNA, 25 bp, Mus musculus
ccactggactctggccagcgaggct

SEQ ID NO: 324421 - DNA, 25 bp, Mus musculus
tgagagcgagctcctcttccctctg

SEQ ID NO: 324422 - DNA, 25 bp, Mus musculus
ctgccaacccttcggccgcagccgg

SEQ ID NO: 324423 - DNA, 25 bp, Mus musculus
cccggagcgctgagacggggacacc

SEQ ID NO: 324424 - DNA, 25 bp, Mus musculus
gcgtcctcagccttgcgctccgccc

SEQ ID NO: 324425 - DNA, 25 bp, Mus musculus
cgcggtctcaattctgccaccttcc

SEQ ID NO: 324426 - DNA, 25 bp, Mus musculus
ggcatgaagccactggagaaatttt

SEQ ID NO: 324427 - DNA, 25 bp, Mus musculus
tgcgccggtagagggcaggcttccc

SEQ ID NO: 324428 - DNA, 25 bp, Mus musculus
ggcgaacgagcaggactaaaccagg

SEQ ID NO: 324429 - DNA, 25 bp, Mus musculus
acgagcaggactaaaccaggactga

SEQ ID NO: 324430 - DNA, 25 bp, Mus musculus
caggactaaaccaggactgaggtga

SEQ ID NO: 324431 - DNA, 25 bp, Mus musculus
actaaaccaggactgaggtgacgga

SEQ ID NO: 324432 - DNA, 25 bp, Mus musculus
actgaggtgacggaggattcgctcc

SEQ ID NO: 324433 - DNA, 25 bp, Mus musculus
tgacggaggattcgctcccggagca

SEQ ID NO: 324434 - DNA, 25 bp, Mus musculus
ggaggattcgctcccggagcagccc

SEQ ID NO: 324435 - DNA, 25 bp, Mus musculus
ccgctgaggtgacctgcggacctga

SEQ ID NO: 324436 - DNA, 25 bp, Mus musculus
gggacttccaactgcggactcgcga

SEQ ID NO: 324437 - DNA, 25 bp, Mus musculus
gcaggcttccctgagcgcatgcgtc

SEQ ID NO: 324438 - DNA, 25 bp, Mus musculus
tgcggactcgcgaccttctcaagat

SEQ ID NO: 324439 - DNA, 25 bp, Mus musculus
ctccattttgttcgcggacgctggg

SEQ ID NO: 324440 - DNA, 25 bp, Mus musculus
gcctccattttgttcgcggacgctg

SEQ ID NO: 324441 - DNA, 25 bp, Mus musculus
aaagctccgcgaggtctggtgtcca

SEQ ID NO: 324442 - DNA, 25 bp, Mus musculus
tgtcctattggctgccggccgtcac

SEQ ID NO: 324443 - DNA, 25 bp, Mus musculus
cgccaggctttacggcgtgacgcgc

SEQ ID NO: 324444 - DNA, 25 bp, Mus musculus
gacgcgctcgtaaacgcgcgccttt

SEQ ID NO: 324445 - DNA, 25 bp, Mus musculus
gacttcgtggtggtcgctgagacct

SEQ ID NO: 324446 - DNA, 25 bp, Mus musculus
gcgtggtgatgagtgacaactaatc

SEQ ID NO: 324447 - DNA, 25 bp, Mus musculus
tgacaactaatcagaagcctggctg

SEQ ID NO: 324448 - DNA, 25 bp, Mus musculus
gctttggcgcgagttgactttgcag

SEQ ID NO: 324449 - DNA, 25 bp, Mus musculus
ttgcagctgctgtagaatttgtggc

SEQ ID NO: 324450 - DNA, 25 bp, Mus musculus
agtgtgcactgagcgacacggccct

SEQ ID NO: 324451 - DNA, 25 bp, Mus musculus
cacggccctgaagagtgcaaagctc

SEQ ID NO: 324452 - DNA, 25 bp, Mus musculus
tctagaagcggttcgagcacgccgc

SEQ ID NO: 324453 - DNA, 25 bp, Mus musculus
tttttacggtggtgatcgagacgcg

SEQ ID NO: 324454 - DNA, 25 bp, Mus musculus
cgcctttcctccgaggtctcaaaag

SEQ ID NO: 324455 - DNA, 25 bp, Mus musculus
acatctgggagccattgacgcattc

SEQ ID NO: 324456 - DNA, 25 bp, Mus musculus
ttaagcggcggcctccacatctggg

SEQ ID NO: 324457 - DNA, 25 bp, Mus musculus
tgggagccattgacgcattcttgcc

SEQ ID NO: 324458 - DNA, 25 bp, Mus musculus
attgacgcattcttgcctgctgagc

SEQ ID NO: 324459 - DNA, 25 bp, Mus musculus
cgcattcttgcctgctgagcgcatg

SEQ ID NO: 324460 - DNA, 25 bp, Mus musculus
cttgcctgctgagcgcatgtttgtg

SEQ ID NO: 324461 - DNA, 25 bp, Mus musculus
ctgagcgcatgtttgtggatggatc

SEQ ID NO: 324462 - DNA, 25 bp, Mus musculus
cgcatgtttgtggatggatctggac

SEQ ID NO: 324463 - DNA, 25 bp, Mus musculus
aaatccagacgggagcgggagactg

SEQ ID NO: 324464 - DNA, 25 bp, Mus musculus
ctgcgctagcccagcggggcggcaa

SEQ ID NO: 324465 - DNA, 25 bp, Mus musculus
agcgctgcaccgctttgcggagttt

SEQ ID NO: 324466 - DNA, 25 bp, Mus musculus
caccgctttgcggagttttcccttg

SEQ ID NO: 324467 - DNA, 25 bp, Mus musculus
gctttgcggagttttcccttgcgtc

SEQ ID NO: 324468 - DNA, 25 bp, Mus musculus
ggcctccacatctgggagccattga

SEQ ID NO: 324469 - DNA, 25 bp, Mus musculus
acagccttgaggcttctgcggccgc

SEQ ID NO: 324470 - DNA, 25 bp, Mus musculus
accctgaggttcgttcaccgccgag

SEQ ID NO: 324471 - DNA, 25 bp, Mus musculus
caccgccgagtcgtaatttattctt

SEQ ID NO: 324472 - DNA, 25 bp, Mus musculus
cccgaatctctttctggcgtgttga

SEQ ID NO: 324473 - DNA, 25 bp, Mus musculus
taagactcgcccttccctgggtcta

SEQ ID NO: 324474 - DNA, 25 bp, Mus musculus
ccacggtccggccactagctggaag

SEQ ID NO: 324475 - DNA, 25 bp, Mus musculus
ccactagctggaagcgtctccttta

SEQ ID NO: 324476 - DNA, 25 bp, Mus musculus
gtggcccactctggatgggaactgc

SEQ ID NO: 324477 - DNA, 25 bp, Mus musculus
gattctctcacacttcggggcccgg

SEQ ID NO: 324478 - DNA, 25 bp, Mus musculus
cgcagacacgcagacgggttgcatc

SEQ ID NO: 324479 - DNA, 25 bp, Mus musculus
agcctctgcacgtgactcgccatgg

SEQ ID NO: 324480 - DNA, 25 bp, Mus musculus
ctccgggtaaagtttcagcctctgc

SEQ ID NO: 324481 - DNA, 25 bp, Mus musculus
cttccctgggtctattaaggagaga

SEQ ID NO: 324482 - DNA, 25 bp, Mus musculus
ccggttagtgattggcccgtggcat

SEQ ID NO: 324483 - DNA, 25 bp, Mus musculus
gcttctaattggctgcctccgtcta

SEQ ID NO: 324484 - DNA, 25 bp, Mus musculus
gcgccatcggtttgctgggctaacc

SEQ ID NO: 324485 - DNA, 25 bp, Mus musculus
cgggttactacgcatggtgcggatt

SEQ ID NO: 324486 - DNA, 25 bp, Mus musculus
gggcgcgcaaaatacgctgcttcta

SEQ ID NO: 324487 - DNA, 25 bp, Mus musculus
gccatctttgcaagtcgggcgcgca

SEQ ID NO: 324488 - DNA, 25 bp, Mus musculus
cattttgctacagcggagcagggca

SEQ ID NO: 324489 - DNA, 25 bp, Mus musculus
gcagttcttagcagccgccctgtgc

SEQ ID NO: 324490 - DNA, 25 bp, Mus musculus
gtttaccggactcggctctgcagcc

SEQ ID NO: 324491 - DNA, 25 bp, Mus musculus
acaaccagcgtaggtgcccagtttc

SEQ ID NO: 324492 - DNA, 25 bp, Mus musculus
ctgaggtggccctttttgcaaaaca

SEQ ID NO: 324493 - DNA, 25 bp, Mus musculus
tccgggagcacactacggtttctga

SEQ ID NO: 324494 - DNA, 25 bp, Mus musculus
ttacacctagcaagttccgggagca

SEQ ID NO: 324495 - DNA, 25 bp, Mus musculus
ctgggctaaccggatgttacaccta

SEQ ID NO: 324496 - DNA, 25 bp, Mus musculus
agtttccggaacacagtccacggca

SEQ ID NO: 324497 - DNA, 25 bp, Mus musculus
tgctaacagctcagttctgccgtgt

SEQ ID NO: 324498 - DNA, 25 bp, Mus musculus
agttctgccgtgtcgtcttattccg

SEQ ID NO: 324499 - DNA, 25 bp, Mus musculus
gcctactgcccgtgtgttcggagtt

SEQ ID NO: 324500 - DNA, 25 bp, Mus musculus
tgcaattgggccctgtgcctactgc

SEQ ID NO: 324501 - DNA, 25 bp, Mus musculus
tggttctaacgctgggccacctgca

SEQ ID NO: 324502 - DNA, 25 bp, Mus musculus
agcatgctgcattcgtggttctaac

SEQ ID NO: 324503 - DNA, 25 bp, Mus musculus
cgggacacccagcatgctgcattcg

SEQ ID NO: 324504 - DNA, 25 bp, Mus musculus
gctgcacaatgtcacacccgggaca

SEQ ID NO: 324505 - DNA, 25 bp, Mus musculus
tttgctcgccggaagcacgcagagt

SEQ ID NO: 324506 - DNA, 25 bp, Mus musculus
agccggagtctcacatgatgtcaca

SEQ ID NO: 324507 - DNA, 25 bp, Mus musculus
tggatgtctcattccgacacagcgc

SEQ ID NO: 324508 - DNA, 25 bp, Mus musculus
gacacagcgcccaagctgcacaatg

SEQ ID NO: 324509 - DNA, 25 bp, Mus musculus
gacagtgacacaagctggatgtctc

SEQ ID NO: 324510 - DNA, 25 bp, Mus musculus
cccgcttgtgtttgtgctaacagct

SEQ ID NO: 324511 - DNA, 25 bp, Mus musculus
tggagtgacctgcagacttaggcgc

SEQ ID NO: 324512 - DNA, 25 bp, Mus musculus
atttgcacggatggcgcctccagca

SEQ ID NO: 324513 - DNA, 25 bp, Mus musculus
acttggggagccgttggactctgcc

SEQ ID NO: 324514 - DNA, 25 bp, Mus musculus
cgagatgtacgagagtgtggaagtc

SEQ ID NO: 324515 - DNA, 25 bp, Mus musculus
cgcctccagcagagtgacgagatcc

SEQ ID NO: 324516 - DNA, 25 bp, Mus musculus
cctgcagacttaggcgcgggcaatt

SEQ ID NO: 324517 - DNA, 25 bp, Mus musculus
accggtggagtgacctgcagactta

SEQ ID NO: 324518 - DNA, 25 bp, Mus musculus
aacctgcacaacttcccgcttttca

SEQ ID NO: 324519 - DNA, 25 bp, Mus musculus
agggagcgccgagggacctcctcct

SEQ ID NO: 324520 - DNA, 25 bp, Mus musculus
agcctcgagttcttgggccaccggg

SEQ ID NO: 324521 - DNA, 25 bp, Mus musculus
cgcttttcacctgggaccggtggag

SEQ ID NO: 324522 - DNA, 25 bp, Mus musculus
acaccggagcctcgagttcttgggc

SEQ ID NO: 324523 - DNA, 25 bp, Mus musculus
gactctgcctgggacaccggagcct

SEQ ID NO: 324524 - DNA, 25 bp, Mus musculus
atctccggccttcgtggggcgagat

SEQ ID NO: 324525 - DNA, 25 bp, Mus musculus
gcacggtagccagcgacgctttgct

SEQ ID NO: 324526 - DNA, 25 bp, Mus musculus
tggcgacccttccagagcaggtgac

SEQ ID NO: 324527 - DNA, 25 bp, Mus musculus
gcccgacggcgaagtagaagaccac

SEQ ID NO: 324528 - DNA, 25 bp, Mus musculus
gggccggctcacgaaacagtcgacc

SEQ ID NO: 324529 - DNA, 25 bp, Mus musculus
gtccacgcggaagccgtagagcagc

SEQ ID NO: 324530 - DNA, 25 bp, Mus musculus
cccaggaaagccagctcggcgagca

SEQ ID NO: 324531 - DNA, 25 bp, Mus musculus
gtagatgacgaacagcaccggcggc

SEQ ID NO: 324532 - DNA, 25 bp, Mus musculus
acagcagcaggatgtggaagagcca

SEQ ID NO: 324533 - DNA, 25 bp, Mus musculus
agccgggctgcaacgtgttacacac

SEQ ID NO: 324534 - DNA, 25 bp, Mus musculus
cagcaccaggatgcggaagatcagc

SEQ ID NO: 324535 - DNA, 25 bp, Mus musculus
cagcatgatcaccagccagagacga

SEQ ID NO: 324536 - DNA, 25 bp, Mus musculus
ccagcagggagcctaggaacgccca

SEQ ID NO: 324537 - DNA, 25 bp, Mus musculus
agagccacgctcagcaggtagcagc

SEQ ID NO: 324538 - DNA, 25 bp, Mus musculus
cgatctcgccgctagatggccaggt

SEQ ID NO: 324539 - DNA, 25 bp, Mus musculus
gtgtctgcagttaccgtacctggtg

SEQ ID NO: 324540 - DNA, 25 bp, Mus musculus
ctctcttttgaggagtgtgtctgca

SEQ ID NO: 324541 - DNA, 25 bp, Mus musculus
tacctggtggattttacgctctaaa

SEQ ID NO: 324542 - DNA, 25 bp, Mus musculus
gctgcccagtgctctcctaagttca

SEQ ID NO: 324543 - DNA, 25 bp, Mus musculus
gcccaatcactagggaggacatcgt

SEQ ID NO: 324544 - DNA, 25 bp, Mus musculus
ggtgtacctcgctgttgctccgcac

SEQ ID NO: 324545 - DNA, 25 bp, Mus musculus
cccgatcttgagcaggtgagagccc

SEQ ID NO: 324546 - DNA, 25 bp, Mus musculus
aggggacattgactctgcttatcgc

SEQ ID NO: 324547 - DNA, 25 bp, Mus musculus
cgggtcttgctactcccagactgga

SEQ ID NO: 324548 - DNA, 25 bp, Mus musculus
agactggaccggagtttggcacccg

SEQ ID NO: 324549 - DNA, 25 bp, Mus musculus
gcggggcttctaccgcgagcattct

SEQ ID NO: 324550 - DNA, 25 bp, Mus musculus
cgcgagcattctctccggaaaagca

SEQ ID NO: 324551 - DNA, 25 bp, Mus musculus
gacccgagactggaactctcttttg

SEQ ID NO: 324552 - DNA, 25 bp, Mus musculus
gcgaaagctacaccgctgcccagtg

SEQ ID NO: 324553 - DNA, 25 bp, Mus musculus
tcgagaatccggaaagcgacaaaac

SEQ ID NO: 324554 - DNA, 25 bp, Mus musculus
tggaacctcaactctcgccgtcagc

SEQ ID NO: 324555 - DNA, 25 bp, Mus musculus
tcgccgtcagccatgaacgcagagg

SEQ ID NO: 324556 - DNA, 25 bp, Mus musculus
cagccatgaacgcagaggccacgta

SEQ ID NO: 324557 - DNA, 25 bp, Mus musculus
acgcagaggccacgtaaaggctcta

SEQ ID NO: 324558 - DNA, 25 bp, Mus musculus
gaggccacgtaaaggctctactacc

SEQ ID NO: 324559 - DNA, 25 bp, Mus musculus
catccgcgagctgtacctgcagcgg

SEQ ID NO: 324560 - DNA, 25 bp, Mus musculus
gcagcggtgacaactccatggtgac

SEQ ID NO: 324561 - DNA, 25 bp, Mus musculus
acaactccatggtgacggtcctgaa

SEQ ID NO: 324562 - DNA, 25 bp, Mus musculus
ctgaagaggctcgagaatccggaaa

SEQ ID NO: 324563 - DNA, 25 bp, Mus musculus
gaaacgctaggcgacccgcgacgcg

SEQ ID NO: 324564 - DNA, 25 bp, Mus musculus
cagcgctcggccctggaacctcaac

SEQ ID NO: 324565 - DNA, 25 bp, Mus musculus
gcgacaaaaccagcgggaaacgcta

SEQ ID NO: 324566 - DNA, 25 bp, Mus musculus
acggtcctgaagaggctcgagaatc

SEQ ID NO: 324567 - DNA, 25 bp, Mus musculus
ctccgggtctggttctctaagctct

SEQ ID NO: 324568 - DNA, 25 bp, Mus musculus
tacattgatgcacgggcaaggcgtg

SEQ ID NO: 324569 - DNA, 25 bp, Mus musculus
ccctgcgtacattgatgcacgggca

SEQ ID NO: 324570 - DNA, 25 bp, Mus musculus
tggctcaggcatgcgctgctaccct

SEQ ID NO: 324571 - DNA, 25 bp, Mus musculus
ccacgctgtggctcaggcatgcgct

SEQ ID NO: 324572 - DNA, 25 bp, Mus musculus
ggttgttgcgccacttgcgccctgg

SEQ ID NO: 324573 - DNA, 25 bp, Mus musculus
aaactgcgtcgctttcttcggcggg

SEQ ID NO: 324574 - DNA, 25 bp, Mus musculus
ccaggctgcggttgttgcgccactt

SEQ ID NO: 324575 - DNA, 25 bp, Mus musculus
ccttgctccgaggagaagctggcgc

SEQ ID NO: 324576 - DNA, 25 bp, Mus musculus
tcggcggggcaaaggactttcagat

SEQ ID NO: 324577 - DNA, 25 bp, Mus musculus
tctctaagctctctgggcgctgcct

SEQ ID NO: 324578 - DNA, 25 bp, Mus musculus
actttcagatgttgtagcggtggcg

SEQ ID NO: 324579 - DNA, 25 bp, Mus musculus
cgtgtgcacggagctgtcggaaatc

SEQ ID NO: 324580 - DNA, 25 bp, Mus musculus
agcctgggcgacgaagccatccact

SEQ ID NO: 324581 - DNA, 25 bp, Mus musculus
ttccaatttggatcccgtcccagtc

SEQ ID NO: 324582 - DNA, 25 bp, Mus musculus
ccagatgtttctagaggtcgagtga

SEQ ID NO: 324583 - DNA, 25 bp, Mus musculus
ctaagcgaaaagcaacacgggagtt

SEQ ID NO: 324584 - DNA, 25 bp, Mus musculus
gcgtttaggtccttgctggcgccca

SEQ ID NO: 324585 - DNA, 25 bp, Mus musculus
tcctccgctgatggacgtatgaatg

SEQ ID NO: 324586 - DNA, 25 bp, Mus musculus
gctctggtcttcagtcctccgctga

SEQ ID NO: 324587 - DNA, 25 bp, Mus musculus
tgggacgcagttcccacacaccatg

SEQ ID NO: 324588 - DNA, 25 bp, Mus musculus
ctgggtttcctcagaagtcttccaa

SEQ ID NO: 324589 - DNA, 25 bp, Mus musculus
gaacagcccttccagtgagcacgcg

SEQ ID NO: 324590 - DNA, 25 bp, Mus musculus
tttccacacgctcccgggaattgtc

SEQ ID NO: 324591 - DNA, 25 bp, Mus musculus
tgggaaacactcacccgcgggccga

SEQ ID NO: 324592 - DNA, 25 bp, Mus musculus
ggttgggcccactgggaaacactca

SEQ ID NO: 324593 - DNA, 25 bp, Mus musculus
ggggtcccgccaagcagaaacacca

SEQ ID NO: 324594 - DNA, 25 bp, Mus musculus
ctggcttttcccttcgctctggtct

SEQ ID NO: 324595 - DNA, 25 bp, Mus musculus
aaaggtaatccaatcactggtcata

SEQ ID NO: 324596 - DNA, 25 bp, Mus musculus
caatcactggtcatattatttgaag

SEQ ID NO: 324597 - DNA, 25 bp, Mus musculus
tcactggtcatattatttgaagacc

SEQ ID NO: 324598 - DNA, 25 bp, Mus musculus
ctggtcatattatttgaagaccttt

SEQ ID NO: 324599 - DNA, 25 bp, Mus musculus
gtcatattatttgaagaccttttaa

SEQ ID NO: 324600 - DNA, 25 bp, Mus musculus
tgattaaaagaatacatgggagttc

SEQ ID NO: 324601 - DNA, 25 bp, Mus musculus
taaaagaatacatgggagttcgatc

SEQ ID NO: 324602 - DNA, 25 bp, Mus musculus
aaaagaatacatgggagttcgatcg

SEQ ID NO: 324603 - DNA, 25 bp, Mus musculus
aatacatgggagttcgatcggtagc

SEQ ID NO: 324604 - DNA, 25 bp, Mus musculus
ggtaatccaatcactggtcatatta

SEQ ID NO: 324605 - DNA, 25 bp, Mus musculus
atccaatcactggtcatattatttg

SEQ ID NO: 324606 - DNA, 25 bp, Mus musculus
taaaaaggtaatccaatcactggtc

SEQ ID NO: 324607 - DNA, 25 bp, Mus musculus
tccaatcactggtcatattatttga

SEQ ID NO: 324608 - DNA, 25 bp, Mus musculus
agaatacatgggagttcgatcggta

SEQ ID NO: 324609 - DNA, 25 bp, Mus musculus
ctatcgcaggcgaaggttcccacct

SEQ ID NO: 324610 - DNA, 25 bp, Mus musculus
ttactacatgcggagaccctatgcg

SEQ ID NO: 324611 - DNA, 25 bp, Mus musculus
tatcgcaggcgaaggttcccacctt

SEQ ID NO: 324612 - DNA, 25 bp, Mus musculus
tcgcaggcgaaggttcccaccttac

SEQ ID NO: 324613 - DNA, 25 bp, Mus musculus
gcaggcgaaggttcccaccttacta

SEQ ID NO: 324614 - DNA, 25 bp, Mus musculus
gcgaaggttcccaccttactacatg

SEQ ID NO: 324615 - DNA, 25 bp, Mus musculus
gaaggttcccaccttactacatgcg

SEQ ID NO: 324616 - DNA, 25 bp, Mus musculus
aggttcccaccttactacatgcgga

SEQ ID NO: 324617 - DNA, 25 bp, Mus musculus
ggttcccaccttactacatgcggag

SEQ ID NO: 324618 - DNA, 25 bp, Mus musculus
gttcccaccttactacatgcggaga

SEQ ID NO: 324619 - DNA, 25 bp, Mus musculus
ttcccaccttactacatgcggagac

SEQ ID NO: 324620 - DNA, 25 bp, Mus musculus
caccttactacatgcggagacccta

SEQ ID NO: 324621 - DNA, 25 bp, Mus musculus
atcgcaggcgaaggttcccacctta

SEQ ID NO: 324622 - DNA, 25 bp, Mus musculus
accttactacatgcggagaccctat

SEQ ID NO: 324623 - DNA, 25 bp, Mus musculus
aacaggtgcacctcccagggcctgg

SEQ ID NO: 324624 - DNA, 25 bp, Mus musculus
agtcctcgatggtcttaaagtagtg

SEQ ID NO: 324625 - DNA, 25 bp, Mus musculus
taaagtagtggttgtaatctcggga

SEQ ID NO: 324626 - DNA, 25 bp, Mus musculus
ttctggtaccagtcgcggatcttca

SEQ ID NO: 324627 - DNA, 25 bp, Mus musculus
ctcccggaggacgaggtcacgaagc

SEQ ID NO: 324628 - DNA, 25 bp, Mus musculus
gggcgcgcaccttgtccaagtagga

SEQ ID NO: 324629 - DNA, 25 bp, Mus musculus
accttgtcgcgcaagtcctcgatgg

SEQ ID NO: 324630 - DNA, 25 bp, Mus musculus
tgtccaagtaggaggcgagacgatc

SEQ ID NO: 324631 - DNA, 25 bp, Mus musculus
gcgagacgatcattgaggttttgca

SEQ ID NO: 324632 - DNA, 25 bp, Mus musculus
attgaggttttgcatggtgatcttc

SEQ ID NO: 324633 - DNA, 25 bp, Mus musculus
ggtgatcttctcattgccagacagc

SEQ ID NO: 324634 - DNA, 25 bp, Mus musculus
ttgccagacagcagcccatcagaca

SEQ ID NO: 324635 - DNA, 25 bp, Mus musculus
atcagacacagccagggtcccacta

SEQ ID NO: 324636 - DNA, 25 bp, Mus musculus
cagctcgccattggcctgctctagg

SEQ ID NO: 324637 - DNA, 25 bp, Mus musculus
gcggcgtccatctccacattgacgt

SEQ ID NO: 324638 - DNA, 25 bp, Mus musculus
ctcgttcaggatgcggctcaggtcc

SEQ ID NO: 324639 - DNA, 25 bp, Mus musculus
acgtgagcacacgtgccgcacacgg

SEQ ID NO: 324640 - DNA, 25 bp, Mus musculus
catctcgttcaggatgcggctcagg

SEQ ID NO: 324641 - DNA, 25 bp, Mus musculus
ctgatcccgcatctcgttcaggatg

SEQ ID NO: 324642 - DNA, 25 bp, Mus musculus
atcttctcatactgatcccgcatct

SEQ ID NO: 324643 - DNA, 25 bp, Mus musculus
tcctcagcatccttgcggttcttct

SEQ ID NO: 324644 - DNA, 25 bp, Mus musculus
gaaccattcctcagcatccttgcgg

SEQ ID NO: 324645 - DNA, 25 bp, Mus musculus
tggtgaagaaccattcctcagcatc

SEQ ID NO: 324646 - DNA, 25 bp, Mus musculus
cacccaccttggtgaagaaccattc

SEQ ID NO: 324647 - DNA, 25 bp, Mus musculus
acacggccacccaccttggtgaaga

SEQ ID NO: 324648 - DNA, 25 bp, Mus musculus
ggcggatagcatccacaaccacacg

SEQ ID NO: 324649 - DNA, 25 bp, Mus musculus
tagcatccacaaccacacgtgagca

SEQ ID NO: 324650 - DNA, 25 bp, Mus musculus
gggcggcgtccatctccacattgac

SEQ ID NO: 324651 - DNA, 25 bp, Mus musculus
cgcgtgaggccaagtccagtcctcg

SEQ ID NO: 324652 - DNA, 25 bp, Mus musculus
gaaaggacttcgagcgtccctcgga

SEQ ID NO: 324653 - DNA, 25 bp, Mus musculus
tccctgcagctccaaaagtgacgcg

SEQ ID NO: 324654 - DNA, 25 bp, Mus musculus
caatcatacttgttctccctgcagc

SEQ ID NO: 324655 - DNA, 25 bp, Mus musculus
gggcaaggagctgagccaccgaccc

SEQ ID NO: 324656 - DNA, 25 bp, Mus musculus
tcggtcgcagacctagcagctactc

SEQ ID NO: 324657 - DNA, 25 bp, Mus musculus
aactcgtgctggtttctcggtcgca

SEQ ID NO: 324658 - DNA, 25 bp, Mus musculus
agctccctgggaactcgtgctggtt

SEQ ID NO: 324659 - DNA, 25 bp, Mus musculus
tgcgttcacacctgagctccctggg

SEQ ID NO: 324660 - DNA, 25 bp, Mus musculus
tcgactgctggctgcgttcacacct

SEQ ID NO: 324661 - DNA, 25 bp, Mus musculus
tgggaaatcggacctcgccacaccg

SEQ ID NO: 324662 - DNA, 25 bp, Mus musculus
gcgtggacacgaacgccggcagcct

SEQ ID NO: 324663 - DNA, 25 bp, Mus musculus
cacagtgcgccacgcgtggacacga

SEQ ID NO: 324664 - DNA, 25 bp, Mus musculus
gacccgccggcgctttttcaaagca

SEQ ID NO: 324665 - DNA, 25 bp, Mus musculus
tgcgtcatgtcctctacgtcaccgt

SEQ ID NO: 324666 - DNA, 25 bp, Mus musculus
tccctgagtcaacagaacatccttt

SEQ ID NO: 324667 - DNA, 25 bp, Mus musculus
cctggcttccggtaggttgcatcag

SEQ ID NO: 324668 - DNA, 25 bp, Mus musculus
ttttcgcggccgctcagacaactac

SEQ ID NO: 324669 - DNA, 25 bp, Mus musculus
gtgcgcacgcgtcaagccttgactc

SEQ ID NO: 324670 - DNA, 25 bp, Mus musculus
atataagtgaatacaggcgccgccc

SEQ ID NO: 324671 - DNA, 25 bp, Mus musculus
ttccgcaggccgtttccaccgagga

SEQ ID NO: 324672 - DNA, 25 bp, Mus musculus
tccaccgaggaaaaggaatcgtatc

SEQ ID NO: 324673 - DNA, 25 bp, Mus musculus
tcgtatcgtatgtccgctatccaga

SEQ ID NO: 324674 - DNA, 25 bp, Mus musculus
ccactctttcggtgagcctggggaa

SEQ ID NO: 324675 - DNA, 25 bp, Mus musculus
tgatgcccgtggaaccgagatctgc

SEQ ID NO: 324676 - DNA, 25 bp, Mus musculus
tctcgggtggcgcatttactaatgg

SEQ ID NO: 324677 - DNA, 25 bp, Mus musculus
actaatggctcctgcctctcggcga

SEQ ID NO: 324678 - DNA, 25 bp, Mus musculus
cgtcaccgtcgttgtctcggagctg

SEQ ID NO: 324679 - DNA, 25 bp, Mus musculus
ggcctttccagtgcccaggccagtg

SEQ ID NO: 324680 - DNA, 25 bp, Mus musculus
ccaaatagtgcccaatgcgggatcc

SEQ ID NO: 324681 - DNA, 25 bp, Mus musculus
gagactcagtttaccttcctgcagc

SEQ ID NO: 324682 - DNA, 25 bp, Mus musculus
aaaccggcaccgcagactgtggtct

SEQ ID NO: 324683 - DNA, 25 bp, Mus musculus
cctacctggagatgcccaaatagtg

SEQ ID NO: 324684 - DNA, 25 bp, Mus musculus
aagcttcctgtcttggttcgggatc

SEQ ID NO: 324685 - DNA, 25 bp, Mus musculus
tgcgtccgaatcaccaatgatcatg

SEQ ID NO: 324686 - DNA, 25 bp, Mus musculus
tgatcatggaccgacaaaagcttcc

SEQ ID NO: 324687 - DNA, 25 bp, Mus musculus
tcgggatcctgatttttgtccggac

SEQ ID NO: 324688 - DNA, 25 bp, Mus musculus
tcctgcagctctcgaataaacgccg

SEQ ID NO: 324689 - DNA, 25 bp, Mus musculus
ccctggaatacgtagcgggtccatg

SEQ ID NO: 324690 - DNA, 25 bp, Mus musculus
ggacctgacgcacccacaataatcg

SEQ ID NO: 324691 - DNA, 25 bp, Mus musculus
actgagagtgcgcagatctgccaca

SEQ ID NO: 324692 - DNA, 25 bp, Mus musculus
tggtgtcttccagattccctcggcc

SEQ ID NO: 324693 - DNA, 25 bp, Mus musculus
caaggtcatgaccaagtcgtgtccc

SEQ ID NO: 324694 - DNA, 25 bp, Mus musculus
caaaggtagggccagatcgatcgtg

SEQ ID NO: 324695 - DNA, 25 bp, Mus musculus
caaacgcggacgtggagtcaaaggt

SEQ ID NO: 324696 - DNA, 25 bp, Mus musculus
tgcagaatgacacaaacgcggacgt

SEQ ID NO: 324697 - DNA, 25 bp, Mus musculus
cgtggctctgcaacaaggtcatgac

SEQ ID NO: 324698 - DNA, 25 bp, Mus musculus
tgctcctgcagaatgacacaaacgc

SEQ ID NO: 324699 - DNA, 25 bp, Mus musculus
aaggcagcagctctgctcctgcaga

SEQ ID NO: 324700 - DNA, 25 bp, Mus musculus
cccggaaagacgacaccaaggcagc

SEQ ID NO: 324701 - DNA, 25 bp, Mus musculus
atcgcagcccggaaagacgacacca

SEQ ID NO: 324702 - DNA, 25 bp, Mus musculus
gaagggaaaagtgcgcctcccagcc

SEQ ID NO: 324703 - DNA, 25 bp, Mus musculus
cgacacgaagggaaaagtgcgcctc

SEQ ID NO: 324704 - DNA, 25 bp, Mus musculus
gccagatcgatcgtgtcagcctttc

SEQ ID NO: 324705 - DNA, 25 bp, Mus musculus
aagtcgtgtccctcctgctcgagaa

SEQ ID NO: 324706 - DNA, 25 bp, Mus musculus
tcctgctcgagaacgacacgaaggg

SEQ ID NO: 324707 - DNA, 25 bp, Mus musculus
tacagaccgaggtgacctgagaatc

SEQ ID NO: 324708 - DNA, 25 bp, Mus musculus
ctccggtatggctttcaacgtgttg

SEQ ID NO: 324709 - DNA, 25 bp, Mus musculus
acctgagaatcgaggcagtacgcct

SEQ ID NO: 324710 - DNA, 25 bp, Mus musculus
cgcctgtgccttcccaggtagacta

SEQ ID NO: 324711 - DNA, 25 bp, Mus musculus
tcccaggtagactaagcgagaaatc

SEQ ID NO: 324712 - DNA, 25 bp, Mus musculus
agcgagaaatccaaactccggtatg

SEQ ID NO: 324713 - DNA, 25 bp, Mus musculus
gctttcaacgtgttgcgtgtcatcc

SEQ ID NO: 324714 - DNA, 25 bp, Mus musculus
ttgcgtgtcatccacaggtccctct

SEQ ID NO: 324715 - DNA, 25 bp, Mus musculus
cctggacgtcttccatcttagtgcg

SEQ ID NO: 324716 - DNA, 25 bp, Mus musculus
gtcttccatcttagtgcgttcactc

SEQ ID NO: 324717 - DNA, 25 bp, Mus musculus
tgccctacccaacattgtgtacaga

SEQ ID NO: 324718 - DNA, 25 bp, Mus musculus
agcttccaggggctttctgtgttgc

SEQ ID NO: 324719 - DNA, 25 bp, Mus musculus
acattgtgtacagaccgaggtgacc

SEQ ID NO: 324720 - DNA, 25 bp, Mus musculus
ggggctttctgtgttgccctaccca

SEQ ID NO: 324721 - DNA, 25 bp, Mus musculus
ggtaaattcctgtcaccgtgagctc

SEQ ID NO: 324722 - DNA, 25 bp, Mus musculus
agacctgcggttcaccgagcctgga

SEQ ID NO: 324723 - DNA, 25 bp, Mus musculus
ctggaggggcgctccaacccagatt

SEQ ID NO: 324724 - DNA, 25 bp, Mus musculus
ccagattgcttgtcccaagggtccc

SEQ ID NO: 324725 - DNA, 25 bp, Mus musculus
ccctgtcgctggtgtaggatgcgct

SEQ ID NO: 324726 - DNA, 25 bp, Mus musculus
gcagcgaactgagctcggcgcactc

SEQ ID NO: 324727 - DNA, 25 bp, Mus musculus
ggcagcaactcagtaaccgaacaaa

SEQ ID NO: 324728 - DNA, 25 bp, Mus musculus
gggagactcccaccctctgaggcta

SEQ ID NO: 324729 - DNA, 25 bp, Mus musculus
gaggctatctcactggctgcccagc

SEQ ID NO: 324730 - DNA, 25 bp, Mus musculus
cagcctgactatcccatcgaggggc

SEQ ID NO: 324731 - DNA, 25 bp, Mus musculus
taccacggccgcctctgtttatgcg

SEQ ID NO: 324732 - DNA, 25 bp, Mus musculus
aaagtctgctcggtcagctccaggg

SEQ ID NO: 324733 - DNA, 25 bp, Mus musculus
ccggactctggccaaggcagcaact

SEQ ID NO: 324734 - DNA, 25 bp, Mus musculus
ccaaagagactaggcagcaagtttc

SEQ ID NO: 324735 - DNA, 25 bp, Mus musculus
cttctccagtcggttcgcctggtga

SEQ ID NO: 324736 - DNA, 25 bp, Mus musculus
ggcctcacgttctagggaaactcga

SEQ ID NO: 324737 - DNA, 25 bp, Mus musculus
cccaccttgaagtgcgcgtagtgca

SEQ ID NO: 324738 - DNA, 25 bp, Mus musculus
gcagcgtcttcttgcagcgccgcag

SEQ ID NO: 324739 - DNA, 25 bp, Mus musculus
ctccaggacgtgaccgaagagccgc

SEQ ID NO: 324740 - DNA, 25 bp, Mus musculus
actacagttggcgtggcagaaggcc

SEQ ID NO: 324741 - DNA, 25 bp, Mus musculus
cgcgccagctttcgccttcgtattg

SEQ ID NO: 324742 - DNA, 25 bp, Mus musculus
ggcatcaggtcctccggagggaatc

SEQ ID NO: 324743 - DNA, 25 bp, Mus musculus
gagtccactacgtgggctggccctc

SEQ ID NO: 324744 - DNA, 25 bp, Mus musculus
agggaatcctcggaagctgtatttc

SEQ ID NO: 324745 - DNA, 25 bp, Mus musculus
aagctgtatttctcgtactgggccc

SEQ ID NO: 324746 - DNA, 25 bp, Mus musculus
atgcctctctaggaccgtcagttga

SEQ ID NO: 324747 - DNA, 25 bp, Mus musculus
cgtcagttgacgctcgagtccacta

SEQ ID NO: 324748 - DNA, 25 bp, Mus musculus
cgtattgctccagagcgtggccgta

SEQ ID NO: 324749 - DNA, 25 bp, Mus musculus
aggcgtcgcctcgcactagtcgcgt

SEQ ID NO: 324750 - DNA, 25 bp, Mus musculus
accgtggccttcatcaggctgctta

SEQ ID NO: 324751 - DNA, 25 bp, Mus musculus
agcgcccgccttacagccacactgc

SEQ ID NO: 324752 - DNA, 25 bp, Mus musculus
cgcgatcccgccacgcgggaccgtc

SEQ ID NO: 324753 - DNA, 25 bp, Mus musculus
agccgcgatgggcatcaggacagct

SEQ ID NO: 324754 - DNA, 25 bp, Mus musculus
aagagacccgctgacccgagagccg

SEQ ID NO: 324755 - DNA, 25 bp, Mus musculus
ttacctgtcgtgagacccaagagac

SEQ ID NO: 324756 - DNA, 25 bp, Mus musculus
gctgcttacctgtcgtgagacccaa

SEQ ID NO: 324757 - DNA, 25 bp, Mus musculus
cccggtacctgcaggcggtctcctc

SEQ ID NO: 324758 - DNA, 25 bp, Mus musculus
ttcatcaggctgcttacctgtcgtg

SEQ ID NO: 324759 - DNA, 25 bp, Mus musculus
cgcatcaggaccgtggccttcatca

SEQ ID NO: 324760 - DNA, 25 bp, Mus musculus
tccgggctgccgcatcaggaccgtg

SEQ ID NO: 324761 - DNA, 25 bp, Mus musculus
cgaagggcgcccacaatttcctgca

SEQ ID NO: 324762 - DNA, 25 bp, Mus musculus
ctcgcagagcgcgaaccccagttgg

SEQ ID NO: 324763 - DNA, 25 bp, Mus musculus
ttacgccctctagcgaggcaagcgc

SEQ ID NO: 324764 - DNA, 25 bp, Mus musculus
cacagaggcattctgggattaaata

SEQ ID NO: 324765 - DNA, 25 bp, Mus musculus
cttccgaacggtgcggcaagtctga

SEQ ID NO: 324766 - DNA, 25 bp, Mus musculus
cgttctgccgccaggacaactcgga

SEQ ID NO: 324767 - DNA, 25 bp, Mus musculus
atgtcgcagaacaggccttgacgcc

SEQ ID NO: 324768 - DNA, 25 bp, Mus musculus
gcccgagcgcgattccgaaaactga

SEQ ID NO: 324769 - DNA, 25 bp, Mus musculus
ggctctgagctccacttgcgcatct

SEQ ID NO: 324770 - DNA, 25 bp, Mus musculus
taacggcttccaccgtgtcaggttc

SEQ ID NO: 324771 - DNA, 25 bp, Mus musculus
gcggccggtgtacatgtactcgata

SEQ ID NO: 324772 - DNA, 25 bp, Mus musculus
tgcaatgcgcacaagctagactctc

SEQ ID NO: 324773 - DNA, 25 bp, Mus musculus
ttgtccctaccacctgaaatctgcg

SEQ ID NO: 324774 - DNA, 25 bp, Mus musculus
gtcatcatcacaggagtcgaacacg

SEQ ID NO: 324775 - DNA, 25 bp, Mus musculus
gatccgtagctagcccttcaccgtt

SEQ ID NO: 324776 - DNA, 25 bp, Mus musculus
gagtgctgcactcgaagtcctcggc

SEQ ID NO: 324777 - DNA, 25 bp, Mus musculus
ctcttcgagaaagcctgagtgtggc

SEQ ID NO: 324778 - DNA, 25 bp, Mus musculus
tgtggctctctgtccgtaagcacca

SEQ ID NO: 324779 - DNA, 25 bp, Mus musculus
gggattcaccacagaactaacagga

SEQ ID NO: 324780 - DNA, 25 bp, Mus musculus
cgacatagagcttaagggattcacc

SEQ ID NO: 324781 - DNA, 25 bp, Mus musculus
aggcctcaggcactctgaagcagca

SEQ ID NO: 324782 - DNA, 25 bp, Mus musculus
tccggagccaagtcctcgcagcaag

SEQ ID NO: 324783 - DNA, 25 bp, Mus musculus
cgactagactcgagagctggccctg

SEQ ID NO: 324784 - DNA, 25 bp, Mus musculus
taaggtcggtggcaagcaatgtgca

SEQ ID NO: 324785 - DNA, 25 bp, Mus musculus
gcaatgtgcaaactcccaggaacta

SEQ ID NO: 324786 - DNA, 25 bp, Mus musculus
cggctggggagaagactactataaa

SEQ ID NO: 324787 - DNA, 25 bp, Mus musculus
acaaaacttccgagcaggtgcaggg

SEQ ID NO: 324788 - DNA, 25 bp, Mus musculus
gactgccgtactcacctcttcgaga

SEQ ID NO: 324789 - DNA, 25 bp, Mus musculus
cgtggagagagtagccaccgccatc

SEQ ID NO: 324790 - DNA, 25 bp, Mus musculus
cacaggctaagcagcccggcgattg

SEQ ID NO: 324791 - DNA, 25 bp, Mus musculus
caggctatgaaagggaccctgcgtg

SEQ ID NO: 324792 - DNA, 25 bp, Mus musculus
cccaggctatgaaagggaccctgcg

SEQ ID NO: 324793 - DNA, 25 bp, Mus musculus
tagtacccgcaaaggcggtgacggc

SEQ ID NO: 324794 - DNA, 25 bp, Mus musculus
cggagacgcccgtgtccctcacgca

SEQ ID NO: 324795 - DNA, 25 bp, Mus musculus
tgtccctcacgcaggcgggcggccc

SEQ ID NO: 324796 - DNA, 25 bp, Mus musculus
cccggagacatagtacccgcaaagg

SEQ ID NO: 324797 - DNA, 25 bp, Mus musculus
ggagacatagtacccgcaaaggcgg

SEQ ID NO: 324798 - DNA, 25 bp, Mus musculus
cggcggtgcgcccactcatcatggt

SEQ ID NO: 324799 - DNA, 25 bp, Mus musculus
cggtgcgcccactcatcatggtgag

SEQ ID NO: 324800 - DNA, 25 bp, Mus musculus
gtgcgcccactcatcatggtgagcg

SEQ ID NO: 324801 - DNA, 25 bp, Mus musculus
gcccactcatcatggtgagcgcagc

SEQ ID NO: 324802 - DNA, 25 bp, Mus musculus
tcatcatggtgagcgcagcgcgtgc

SEQ ID NO: 324803 - DNA, 25 bp, Mus musculus
cgtgcgcagaggctcgggctgaccc

SEQ ID NO: 324804 - DNA, 25 bp, Mus musculus
cactcatcatggtgagcgcagcgcg

SEQ ID NO: 324805 - DNA, 25 bp, Mus musculus
ccaagatggtgtccgctgatgctta

SEQ ID NO: 324806 - DNA, 25 bp, Mus musculus
cgggacatcagggttcttgtgcttg

SEQ ID NO: 324807 - DNA, 25 bp, Mus musculus
cggtggctaccctccacgagtgcaa

SEQ ID NO: 324808 - DNA, 25 bp, Mus musculus
cctccacgagtgcaagacgctattc

SEQ ID NO: 324809 - DNA, 25 bp, Mus musculus
gacgctattcatcctgcgcggcctg

SEQ ID NO: 324810 - DNA, 25 bp, Mus musculus
ggcagcggcaagtccacactggctc

SEQ ID NO: 324811 - DNA, 25 bp, Mus musculus
acactggctcggctcatcctggaga

SEQ ID NO: 324812 - DNA, 25 bp, Mus musculus
cctggagaagtaccacgacggcacc

SEQ ID NO: 324813 - DNA, 25 bp, Mus musculus
cttgatgataccaaccacgagcggg

SEQ ID NO: 324814 - DNA, 25 bp, Mus musculus
ctgatgcttacaagatcatccctgg

SEQ ID NO: 324815 - DNA, 25 bp, Mus musculus
gggcagacttctccgaggcgtacaa

SEQ ID NO: 324816 - DNA, 25 bp, Mus musculus
ccgaggcgtacaagcgtctagacga

SEQ ID NO: 324817 - DNA, 25 bp, Mus musculus
tggctggctactgccgccgggacat

SEQ ID NO: 324818 - DNA, 25 bp, Mus musculus
tcatccctggctctcgggcagactt

SEQ ID NO: 324819 - DNA, 25 bp, Mus musculus
cgtgtgtaaagtgtgtgttgcacag

SEQ ID NO: 324820 - DNA, 25 bp, Mus musculus
ggtcgcgtcttacacaatgcattgg

SEQ ID NO: 324821 - DNA, 25 bp, Mus musculus
acacaatgcattgggctgcagcaag

SEQ ID NO: 324822 - DNA, 25 bp, Mus musculus
ctgcagcaagtaggctcctcggcag

SEQ ID NO: 324823 - DNA, 25 bp, Mus musculus
ggcagaaagacactccacaaattcg

SEQ ID NO: 324824 - DNA, 25 bp, Mus musculus
cacaaattcgcacgcccaggcacta

SEQ ID NO: 324825 - DNA, 25 bp, Mus musculus
cacccagggcacatgcacacaaata

SEQ ID NO: 324826 - DNA, 25 bp, Mus musculus
cttgcagtcgccgtgcgtgtgtaaa

SEQ ID NO: 324827 - DNA, 25 bp, Mus musculus
gatgctgcccgcttgcagtcgccgt

SEQ ID NO: 324828 - DNA, 25 bp, Mus musculus
gaggtggattccgaccagaatgcta

SEQ ID NO: 324829 - DNA, 25 bp, Mus musculus
cccggaagtagtggtggccataaca

SEQ ID NO: 324830 - DNA, 25 bp, Mus musculus
tggtggccataacaggtcgcgtctt

SEQ ID NO: 324831 - DNA, 25 bp, Mus musculus
cgaccagaatgctagaacccggaag

SEQ ID NO: 324832 - DNA, 25 bp, Mus musculus
ggcacatgcacacaaatacaggctg

SEQ ID NO: 324833 - DNA, 25 bp, Mus musculus
cgtctaccaacgagaggctccgctt

SEQ ID NO: 324834 - DNA, 25 bp, Mus musculus
agctgcaagctcgtctcctccatga

SEQ ID NO: 324835 - DNA, 25 bp, Mus musculus
tctcggtcgactccagctcagatgg

SEQ ID NO: 324836 - DNA, 25 bp, Mus musculus
ccttcagagggatctcggtcgactc

SEQ ID NO: 324837 - DNA, 25 bp, Mus musculus
ctcaagctccctgctaggcggaagc

SEQ ID NO: 324838 - DNA, 25 bp, Mus musculus
cgcggcagaacaagaccatgcctca

SEQ ID NO: 324839 - DNA, 25 bp, Mus musculus
ctctgttaaggaagtcgtcattgtc

SEQ ID NO: 324840 - DNA, 25 bp, Mus musculus
tcttggcgtcttcgtcctccagcag

SEQ ID NO: 324841 - DNA, 25 bp, Mus musculus
gtgtagagcacttccggtcggagca

SEQ ID NO: 324842 - DNA, 25 bp, Mus musculus
catgactctaccacccggttggtta

SEQ ID NO: 324843 - DNA, 25 bp, Mus musculus
cttccatccctggaggtccacggtg

SEQ ID NO: 324844 - DNA, 25 bp, Mus musculus
cgaccagtcaggacgggcaacaatg

SEQ ID NO: 324845 - DNA, 25 bp, Mus musculus
tgcacacaagttaaccagagcgggc

SEQ ID NO: 324846 - DNA, 25 bp, Mus musculus
gtgtctgcaggagagccatcgtctc

SEQ ID NO: 324847 - DNA, 25 bp, Mus musculus
aatctggcattcagcctgaggcggg

SEQ ID NO: 324848 - DNA, 25 bp, Mus musculus
cgcgtgactctttgacccgtggcga

SEQ ID NO: 324849 - DNA, 25 bp, Mus musculus
attccgagcatccatgtaatctggc

SEQ ID NO: 324850 - DNA, 25 bp, Mus musculus
tgtaaatcgtaggtccgcagagtcc

SEQ ID NO: 324851 - DNA, 25 bp, Mus musculus
gggtgacagacgaatcccttgcgta

SEQ ID NO: 324852 - DNA, 25 bp, Mus musculus
cccttgcgtaggtgactaggacaca

SEQ ID NO: 324853 - DNA, 25 bp, Mus musculus
ctgagtacacagcattagtaatgtc

SEQ ID NO: 324854 - DNA, 25 bp, Mus musculus
agtaatgtcagtctctgtaagagcc

SEQ ID NO: 324855 - DNA, 25 bp, Mus musculus
taagagccgagtaccgcgaaaagca

SEQ ID NO: 324856 - DNA, 25 bp, Mus musculus
aaaagcaattttccagtggcgtgtc

SEQ ID NO: 324857 - DNA, 25 bp, Mus musculus
tggcgtgtcttacctggcgatttgt

SEQ ID NO: 324858 - DNA, 25 bp, Mus musculus
cagagtccttgtgagcggacggata

SEQ ID NO: 324859 - DNA, 25 bp, Mus musculus
cgccagcatgttcgatctcattaca

SEQ ID NO: 324860 - DNA, 25 bp, Mus musculus
cggatatcaggatggcgatagtagc

SEQ ID NO: 324861 - DNA, 25 bp, Mus musculus
cgccgccggaagttgtcttgaaggc

SEQ ID NO: 324862 - DNA, 25 bp, Mus musculus
gacccgggaggtatggagctgggag

SEQ ID NO: 324863 - DNA, 25 bp, Mus musculus
gcgctcactttacgccgccggaagt

SEQ ID NO: 324864 - DNA, 25 bp, Mus musculus
tacgccgccggaagttgtcttgaag

SEQ ID NO: 324865 - DNA, 25 bp, Mus musculus
gcgctgtgcgatccgcgctcacttt

SEQ ID NO: 324866 - DNA, 25 bp, Mus musculus
cgggacctctgggtcagtccttcca

SEQ ID NO: 324867 - DNA, 25 bp, Mus musculus
gggacctctgggtcagtccttccac

SEQ ID NO: 324868 - DNA, 25 bp, Mus musculus
ctgggtcagtccttccacccagagg

SEQ ID NO: 324869 - DNA, 25 bp, Mus musculus
ggtcagtccttccacccagaggaag

SEQ ID NO: 324870 - DNA, 25 bp, Mus musculus
gtcagtccttccacccagaggaaga

SEQ ID NO: 324871 - DNA, 25 bp, Mus musculus
agagggccgtctttacggtcgagct

SEQ ID NO: 324872 - DNA, 25 bp, Mus musculus
gggccgtctttacggtcgagctgcc

SEQ ID NO: 324873 - DNA, 25 bp, Mus musculus
ccctcccatggtccggcccactccg

SEQ ID NO: 324874 - DNA, 25 bp, Mus musculus
tttacgccgccggaagttgtcttga

SEQ ID NO: 324875 - DNA, 25 bp, Mus musculus
tgggtgcagcccaccttgaccagca

SEQ ID NO: 324876 - DNA, 25 bp, Mus musculus
tgcagcaaggcaaggtccggttctt

SEQ ID NO: 324877 - DNA, 25 bp, Mus musculus
tcgccagttccttcgggaagccatg

SEQ ID NO: 324878 - DNA, 25 bp, Mus musculus
cggactcggagatcgccagttcctt

SEQ ID NO: 324879 - DNA, 25 bp, Mus musculus
ctatagtaggtgcagcgttcgtccg

SEQ ID NO: 324880 - DNA, 25 bp, Mus musculus
ccaagcagctccacactatagtagg

SEQ ID NO: 324881 - DNA, 25 bp, Mus musculus
gcctcgcagcgtagcctctgagtac

SEQ ID NO: 324882 - DNA, 25 bp, Mus musculus
ggaaagccttttggtggcgctccaa

SEQ ID NO: 324883 - DNA, 25 bp, Mus musculus
acggccatcgcatcctgcgagggtc

SEQ ID NO: 324884 - DNA, 25 bp, Mus musculus
acagttcctcaggtgcctgcgggta

SEQ ID NO: 324885 - DNA, 25 bp, Mus musculus
ataccggtcgcgcacagttcctcag

SEQ ID NO: 324886 - DNA, 25 bp, Mus musculus
gcccgaggctccaagaacgccaagt

SEQ ID NO: 324887 - DNA, 25 bp, Mus musculus
gggaaagagttcctgcagctccgaa

SEQ ID NO: 324888 - DNA, 25 bp, Mus musculus
ccacgagcagcactaaggtcagggt

SEQ ID NO: 324889 - DNA, 25 bp, Mus musculus
attccttgggcattcttggcagctg

SEQ ID NO: 324890 - DNA, 25 bp, Mus musculus
agccgtctcatctcgagctgcgttg

SEQ ID NO: 324891 - DNA, 25 bp, Mus musculus
gtctcatctcgagctgcgttggccg

SEQ ID NO: 324892 - DNA, 25 bp, Mus musculus
acgaggcgggcgatatattccttgg

SEQ ID NO: 324893 - DNA, 25 bp, Mus musculus
cgggcgatatattccttgggcattc

SEQ ID NO: 324894 - DNA, 25 bp, Mus musculus
gcattcttggcagctggtgggaaaa

SEQ ID NO: 324895 - DNA, 25 bp, Mus musculus
cagctggtgggaaaagacattctgc

SEQ ID NO: 324896 - DNA, 25 bp, Mus musculus
ggtgggaaaagacattctgcagccc

SEQ ID NO: 324897 - DNA, 25 bp, Mus musculus
ccttgggcgtcagggagttgccaat

SEQ ID NO: 324898 - DNA, 25 bp, Mus musculus
cagggagttgccaatgacgtggaac

SEQ ID NO: 324899 - DNA, 25 bp, Mus musculus
ccaatgacgtggaactcgatgattc

SEQ ID NO: 324900 - DNA, 25 bp, Mus musculus
actcgatgattcctcgccgttcttc

SEQ ID NO: 324901 - DNA, 25 bp, Mus musculus
gattcctcgccgttcttccaggcga

SEQ ID NO: 324902 - DNA, 25 bp, Mus musculus
gttcttccaggcgagccgtctcatc

SEQ ID NO: 324903 - DNA, 25 bp, Mus musculus
caagtggccactctaccagtgaggc

SEQ ID NO: 324904 - DNA, 25 bp, Mus musculus
ctcaggcagcagttgcactctcgga

SEQ ID NO: 324905 - DNA, 25 bp, Mus musculus
cacgagtcgaatgacccgagcaggg

SEQ ID NO: 324906 - DNA, 25 bp, Mus musculus
accggccagcggcaacacgagtcga

SEQ ID NO: 324907 - DNA, 25 bp, Mus musculus
gccagaatctgacggtgaccggcca

SEQ ID NO: 324908 - DNA, 25 bp, Mus musculus
tggtgcggatagacggccagaatct

SEQ ID NO: 324909 - DNA, 25 bp, Mus musculus
ccaaggtttcgctccggaggacttg

SEQ ID NO: 324910 - DNA, 25 bp, Mus musculus
taccgcatggagcagagtgttcacc

SEQ ID NO: 324911 - DNA, 25 bp, Mus musculus
tgttcaccgacaaatgcagctcccg

SEQ ID NO: 324912 - DNA, 25 bp, Mus musculus
cgtggcccttgctgaacggaatcaa

SEQ ID NO: 324913 - DNA, 25 bp, Mus musculus
gggtagcttcccgatgtcccagcgt

SEQ ID NO: 324914 - DNA, 25 bp, Mus musculus
gttgcactctcggatgcagcgggta

SEQ ID NO: 324915 - DNA, 25 bp, Mus musculus
ctgtgagcaaccaagtttccaaata

SEQ ID NO: 324916 - DNA, 25 bp, Mus musculus
aaggtggatgcccaaggtttcgctc

SEQ ID NO: 324917 - DNA, 25 bp, Mus musculus
tatgatgttcacgtagccgcgcaga

SEQ ID NO: 324918 - DNA, 25 bp, Mus musculus
gctttccaagagagcagacagaggg

SEQ ID NO: 324919 - DNA, 25 bp, Mus musculus
gcgtgtggctgagctttccaagaga

SEQ ID NO: 324920 - DNA, 25 bp, Mus musculus
gccagttccaagtgccgcgagggaa

SEQ ID NO: 324921 - DNA, 25 bp, Mus musculus
ccgggcagcagcgttactttgggcc

SEQ ID NO: 324922 - DNA, 25 bp, Mus musculus
cagagggctgttcatgcagaattga

SEQ ID NO: 324923 - DNA, 25 bp, Mus musculus
gtccaggcctgcttatcgcgtcact

SEQ ID NO: 324924 - DNA, 25 bp, Mus musculus
tgtagttctccgcacagggaggagc

SEQ ID NO: 324925 - DNA, 25 bp, Mus musculus
tacccacaatcaacgcgggaaagga

SEQ ID NO: 324926 - DNA, 25 bp, Mus musculus
accaatgggagacactccgatccta

SEQ ID NO: 324927 - DNA, 25 bp, Mus musculus
tcccaggtgactgacagaaagaaca

SEQ ID NO: 324928 - DNA, 25 bp, Mus musculus
gcctctctatattcccaggtgactg

SEQ ID NO: 324929 - DNA, 25 bp, Mus musculus
tccggatccggatcttcagctctgc

SEQ ID NO: 324930 - DNA, 25 bp, Mus musculus
gcttatcgcgtcactgccagttcca

SEQ ID NO: 324931 - DNA, 25 bp, Mus musculus
aggggccgccagagacacccgaagc

SEQ ID NO: 324932 - DNA, 25 bp, Mus musculus
gactggaacggtagccacgcccttc

SEQ ID NO: 324933 - DNA, 25 bp, Mus musculus
agctctgctccgcagcacttcgaga

SEQ ID NO: 324934 - DNA, 25 bp, Mus musculus
gtgtgctctgaacctgttagttcta

SEQ ID NO: 324935 - DNA, 25 bp, Mus musculus
tgcctgtgtgctctgaacctgttag

SEQ ID NO: 324936 - DNA, 25 bp, Mus musculus
gccgccgctgcctgtgtgctctgaa

SEQ ID NO: 324937 - DNA, 25 bp, Mus musculus
ttagttctaagctctgctccgcagc

SEQ ID NO: 324938 - DNA, 25 bp, Mus musculus
caactcacgcgtgccgtcaaagcgg

SEQ ID NO: 324939 - DNA, 25 bp, Mus musculus
catccaggcttgaggtgatgaagtg

SEQ ID NO: 324940 - DNA, 25 bp, Mus musculus
acgcccaccatccaggcttgaggtg

SEQ ID NO: 324941 - DNA, 25 bp, Mus musculus
gagagactcggagacacgcccacca

SEQ ID NO: 324942 - DNA, 25 bp, Mus musculus
tctgtggccctcctcccagagggga

SEQ ID NO: 324943 - DNA, 25 bp, Mus musculus
ccacgcccttctttcagggtgatca

SEQ ID NO: 324944 - DNA, 25 bp, Mus musculus
gcccttctttcagggtgatcacgcc

SEQ ID NO: 324945 - DNA, 25 bp, Mus musculus
tgctaaagcggtggtagttacggtc

SEQ ID NO: 324946 - DNA, 25 bp, Mus musculus
tgccagctccgtgcaacagttcgta

SEQ ID NO: 324947 - DNA, 25 bp, Mus musculus
atacccgcagcgtggttgccagctc

SEQ ID NO: 324948 - DNA, 25 bp, Mus musculus
ttcccagagtcaggatacccgcagc

SEQ ID NO: 324949 - DNA, 25 bp, Mus musculus
ctgcagccgtccctggaggcctgga

SEQ ID NO: 324950 - DNA, 25 bp, Mus musculus
ccagctgcgtggttaccgttggcct

SEQ ID NO: 324951 - DNA, 25 bp, Mus musculus
agttacggtcggacagccgcgacca

SEQ ID NO: 324952 - DNA, 25 bp, Mus musculus
cgtgcaacagttcgtagagacggca

SEQ ID NO: 324953 - DNA, 25 bp, Mus musculus
ttaccgttggcctgaaggaggcgct

SEQ ID NO: 324954 - DNA, 25 bp, Mus musculus
acagccgcgaccagagcagggatgt

SEQ ID NO: 324955 - DNA, 25 bp, Mus musculus
aggaacacgtcttctggcgacagca

SEQ ID NO: 324956 - DNA, 25 bp, Mus musculus
gtcttctggcgacagcagtcgggca

SEQ ID NO: 324957 - DNA, 25 bp, Mus musculus
cccatggtcaggatgccagctgcgt

SEQ ID NO: 324958 - DNA, 25 bp, Mus musculus
tcgtagagacggcaggaacacgtct

SEQ ID NO: 324959 - DNA, 25 bp, Mus musculus
gcagggcgcagctcctacctcgttc

SEQ ID NO: 324960 - DNA, 25 bp, Mus musculus
tcgtgacacgcacgcgccaatactt

SEQ ID NO: 324961 - DNA, 25 bp, Mus musculus
ggatcggctctgtcggcgtccctca

SEQ ID NO: 324962 - DNA, 25 bp, Mus musculus
tcgctcccaggggatcggctctgtc

SEQ ID NO: 324963 - DNA, 25 bp, Mus musculus
tacttttcacggtatccacggcgcc

SEQ ID NO: 324964 - DNA, 25 bp, Mus musculus
ccctctcgtagccaccaccagcgcc

SEQ ID NO: 324965 - DNA, 25 bp, Mus musculus
cttctagacagcaggagcacggggc

SEQ ID NO: 324966 - DNA, 25 bp, Mus musculus
gcacgcgccaatacttttcacggta

SEQ ID NO: 324967 - DNA, 25 bp, Mus musculus
tggtcttggagattgggacaccccc

SEQ ID NO: 324968 - DNA, 25 bp, Mus musculus
ccaccagagccagcggtctctccgg

SEQ ID NO: 324969 - DNA, 25 bp, Mus musculus
gagagatccccgtttaagggcacga

SEQ ID NO: 324970 - DNA, 25 bp, Mus musculus
tccgggacccctaacacatgctgtt

SEQ ID NO: 324971 - DNA, 25 bp, Mus musculus
tctccggtcccgcacgctctctcgc

SEQ ID NO: 324972 - DNA, 25 bp, Mus musculus
tgcccagcttctagacagcaggagc

SEQ ID NO: 324973 - DNA, 25 bp, Mus musculus
gccgcccagcctagtggtcggtctt

SEQ ID NO: 324974 - DNA, 25 bp, Mus musculus
acctttgaggaggaaatcgctgctc

SEQ ID NO: 324975 - DNA, 25 bp, Mus musculus
agctcgcgcgctgtgtttggtctat

SEQ ID NO: 324976 - DNA, 25 bp, Mus musculus
ctgtgtttggtctatcggaggcagc

SEQ ID NO: 324977 - DNA, 25 bp, Mus musculus
gtctatcggaggcagctgacctttg

SEQ ID NO: 324978 - DNA, 25 bp, Mus musculus
tatcggaggcagctgacctttgagg

SEQ ID NO: 324979 - DNA, 25 bp, Mus musculus
cgccggtaatcgagggcggaggcaa

SEQ ID NO: 324980 - DNA, 25 bp, Mus musculus
aggaggaaatcgctgctctctgctc

SEQ ID NO: 324981 - DNA, 25 bp, Mus musculus
ctctgctccttcctgtagtaacagc

SEQ ID NO: 324982 - DNA, 25 bp, Mus musculus
tgctccttcctgtagtaacagcctc

SEQ ID NO: 324983 - DNA, 25 bp, Mus musculus
caagagccgtcaggagccgtcagaa

SEQ ID NO: 324984 - DNA, 25 bp, Mus musculus
cctggagcgacagccgcaggcgctc

SEQ ID NO: 324985 - DNA, 25 bp, Mus musculus
ccagcctagtggtcggtcttgtaag

SEQ ID NO: 324986 - DNA, 25 bp, Mus musculus
gagccgtcaggagccgtcagaagcc

SEQ ID NO: 324987 - DNA, 25 bp, Mus musculus
ccgaggctctttctcgattgcgcta

SEQ ID NO: 324988 - DNA, 25 bp, Mus musculus
accggcaagtttagccgtgcgcccg

SEQ ID NO: 324989 - DNA, 25 bp, Mus musculus
agctatttatgaccgctggagaacg

SEQ ID NO: 324990 - DNA, 25 bp, Mus musculus
aagcagccagaccttgcgggcggcc

SEQ ID NO: 324991 - DNA, 25 bp, Mus musculus
ctgcctttgtctgggcgacgccgag

SEQ ID NO: 324992 - DNA, 25 bp, Mus musculus
tgcgctaccggcaagtttagccgtg

SEQ ID NO: 324993 - DNA, 25 bp, Mus musculus
ctcgattgcgctaccggcaagttta

SEQ ID NO: 324994 - DNA, 25 bp, Mus musculus
ctctttctcgattgcgctaccggca

SEQ ID NO: 324995 - DNA, 25 bp, Mus musculus
aggctctttctcgattgcgctaccg

SEQ ID NO: 324996 - DNA, 25 bp, Mus musculus
ggacccgaggctctttctcgattgc

SEQ ID NO: 324997 - DNA, 25 bp, Mus musculus
gcaccaagcagccagaccttgcggg

SEQ ID NO: 324998 - DNA, 25 bp, Mus musculus
aacgaaactcaacgcgggcaccaag

SEQ ID NO: 324999 - DNA, 25 bp, Mus musculus
agaacgaaactcaacgcgggcacca

SEQ ID NO: 325000 - DNA, 25 bp, Mus musculus
tttatgaccgctggagaacgaaact

SEQ ID NO: 325001 - DNA, 25 bp, Mus musculus
ctcgagcgtctgtgtgcagctgcta

SEQ ID NO: 325002 - DNA, 25 bp, Mus musculus
tgggactttctcaaccctagggtgc

SEQ ID NO: 325003 - DNA, 25 bp, Mus musculus
ctcccttgaggtgttggaggtgcct

SEQ ID NO: 325004 - DNA, 25 bp, Mus musculus
ccagcgtgaccatcgtgagtgcacc

SEQ ID NO: 325005 - DNA, 25 bp, Mus musculus
cgcgacctgcgcaaagccagcgtga

SEQ ID NO: 325006 - DNA, 25 bp, Mus musculus
aactcaagtgcaaggcgctgcagga

SEQ ID NO: 325007 - DNA, 25 bp, Mus musculus
ctggagacctacaaactcaagtgca

SEQ ID NO: 325008 - DNA, 25 bp, Mus musculus
tgctcaagatagagctggagaccta

SEQ ID NO: 325009 - DNA, 25 bp, Mus musculus
ctgcagcaggagaacaaggtgctca

SEQ ID NO: 325010 - DNA, 25 bp, Mus musculus
gttccgcctggaggagctcaccaac

SEQ ID NO: 325011 - DNA, 25 bp, Mus musculus
gggcattgtcatctcgccgttccgc

SEQ ID NO: 325012 - DNA, 25 bp, Mus musculus
ggcagccatgcagtcgtcctgctcg

SEQ ID NO: 325013 - DNA, 25 bp, Mus musculus
tcaaccctagggtgcctgaaggctc

SEQ ID NO: 325014 - DNA, 25 bp, Mus musculus
agagtcccggcgctgcagtactgcc

SEQ ID NO: 325015 - DNA, 25 bp, Mus musculus
actccaggcgcgagctgctgggctc

SEQ ID NO: 325016 - DNA, 25 bp, Mus musculus
cagcgatccggttagggctcgttcc

SEQ ID NO: 325017 - DNA, 25 bp, Mus musculus
ccttcacctgtctccggggctgagg

SEQ ID NO: 325018 - DNA, 25 bp, Mus musculus
tacctcagcgatccggttagggctc

SEQ ID NO: 325019 - DNA, 25 bp, Mus musculus
ttgtacctcagcgatccggttaggg

SEQ ID NO: 325020 - DNA, 25 bp, Mus musculus
gggttgtacctcagcgatccggtta

SEQ ID NO: 325021 - DNA, 25 bp, Mus musculus
acaccgagcggggttgtacctcagc

SEQ ID NO: 325022 - DNA, 25 bp, Mus musculus
agccgacgcggtcaggcgacaccga

SEQ ID NO: 325023 - DNA, 25 bp, Mus musculus
gggccgcctggcctctcctagccga

SEQ ID NO: 325024 - DNA, 25 bp, Mus musculus
gcgctgactccaggcgcgagctgct

SEQ ID NO: 325025 - DNA, 25 bp, Mus musculus
ctgcgctgactccaggcgcgagctg

SEQ ID NO: 325026 - DNA, 25 bp, Mus musculus
ggctcgttccctccgccgcgacgtc

SEQ ID NO: 325027 - DNA, 25 bp, Mus musculus
tctcctagccgacgcggtcaggcga

SEQ ID NO: 325028 - DNA, 25 bp, Mus musculus
ctcagcgatccggttagggctcgtt

SEQ ID NO: 325029 - DNA, 25 bp, Mus musculus
ccctcgcggatcttcttgacgtgga

SEQ ID NO: 325030 - DNA, 25 bp, Mus musculus
ctccgactctttcagcgacttgctg

SEQ ID NO: 325031 - DNA, 25 bp, Mus musculus
gcctcgtcggacgacagctcgatcg

SEQ ID NO: 325032 - DNA, 25 bp, Mus musculus
ggccttcttgaagtcgtccacgcgc

SEQ ID NO: 325033 - DNA, 25 bp, Mus musculus
tgcgcaccttggtcttctccatctt

SEQ ID NO: 325034 - DNA, 25 bp, Mus musculus
tccaggttctccttggtcttcaggc

SEQ ID NO: 325035 - DNA, 25 bp, Mus musculus
tgcccagcttgttcatgcgcttctc

SEQ ID NO: 325036 - DNA, 25 bp, Mus musculus
cgggatgtcttcagcttctctcgtc

SEQ ID NO: 325037 - DNA, 25 bp, Mus musculus
acggcgtccgactcctcggtgatct

SEQ ID NO: 325038 - DNA, 25 bp, Mus musculus
gcggcaccttgtagacagcggtctt

SEQ ID NO: 325039 - DNA, 25 bp, Mus musculus
tgatctccagcagcgtgtgcacgtc

SEQ ID NO: 325040 - DNA, 25 bp, Mus musculus
agagccctgcgagtcctgctcagtc

SEQ ID NO: 325041 - DNA, 25 bp, Mus musculus
tcgctgtcgctcttgtccaccagga

SEQ ID NO: 325042 - DNA, 25 bp, Mus musculus
tggagcgcgcatacaccacatggtc

SEQ ID NO: 325043 - DNA, 25 bp, Mus musculus
tcctccaagtggaaaggcgtttgac

SEQ ID NO: 325044 - DNA, 25 bp, Mus musculus
cgcacggtcttcacgttgacgctga

SEQ ID NO: 325045 - DNA, 25 bp, Mus musculus
actgcgtgcctgagccctgaatcac

SEQ ID NO: 325046 - DNA, 25 bp, Mus musculus
ctgacgatcgtgtcccttgcatggc

SEQ ID NO: 325047 - DNA, 25 bp, Mus musculus
cctggtccgacttgatcagctcgtc

SEQ ID NO: 325048 - DNA, 25 bp, Mus musculus
agcttgctcagctctccctggatgc

SEQ ID NO: 325049 - DNA, 25 bp, Mus musculus
cccacctttagtgtctgcttacaga

SEQ ID NO: 325050 - DNA, 25 bp, Mus musculus
agtttctttatctggccggcctggc

SEQ ID NO: 325051 - DNA, 25 bp, Mus musculus
gcctcgttgacctccagtttcttta

SEQ ID NO: 325052 - DNA, 25 bp, Mus musculus
catgactttgaagttgcggcgcctc

SEQ ID NO: 325053 - DNA, 25 bp, Mus musculus
agcccgctaacttttccgataggag

SEQ ID NO: 325054 - DNA, 25 bp, Mus musculus
ggagcattcagcgttcccaagtcta

SEQ ID NO: 325055 - DNA, 25 bp, Mus musculus
gctcacctggtagatcatgactttg

SEQ ID NO: 325056 - DNA, 25 bp, Mus musculus
aacggcgccgatgattttatccaga

SEQ ID NO: 325057 - DNA, 25 bp, Mus musculus
ctggggttgtagaaagagcgcttcc

SEQ ID NO: 325058 - DNA, 25 bp, Mus musculus
cttgcgtacgctggtcggcgactct

SEQ ID NO: 325059 - DNA, 25 bp, Mus musculus
acgtggagcgcactcggatacctcg

SEQ ID NO: 325060 - DNA, 25 bp, Mus musculus
ggacgtggagcgcactcggatacct

SEQ ID NO: 325061 - DNA, 25 bp, Mus musculus
agccttgcttgcgtacgctggtcgg

SEQ ID NO: 325062 - DNA, 25 bp, Mus musculus
cccgagtggctttcgaggggacgtg

SEQ ID NO: 325063 - DNA, 25 bp, Mus musculus
agcgcttccccgagtggctttcgag

SEQ ID NO: 325064 - DNA, 25 bp, Mus musculus
tggggttgtagaaagagcgcttccc

SEQ ID NO: 325065 - DNA, 25 bp, Mus musculus
ccggggtcgctttgctgcggcggct

SEQ ID NO: 325066 - DNA, 25 bp, Mus musculus
acgctggtcggcgactctgctcagc

SEQ ID NO: 325067 - DNA, 25 bp, Mus musculus
cttgcttgcgtacgctggtcggcga

SEQ ID NO: 325068 - DNA, 25 bp, Mus musculus
gcgtacgctggtcggcgactctgct

SEQ ID NO: 325069 - DNA, 25 bp, Mus musculus
cggagccttgcttgcgtacgctggt

SEQ ID NO: 325070 - DNA, 25 bp, Mus musculus
tgctcagcctgagccggggtcgctt

SEQ ID NO: 325071 - DNA, 25 bp, Mus musculus
ctcatcgggccgaggatgtttcata

SEQ ID NO: 325072 - DNA, 25 bp, Mus musculus
tctgagtccggaaaccaggttctcc

SEQ ID NO: 325073 - DNA, 25 bp, Mus musculus
ggtagcaggagccaaccttcaggtc

SEQ ID NO: 325074 - DNA, 25 bp, Mus musculus
caaccttcaggtcacgtggcccgag

SEQ ID NO: 325075 - DNA, 25 bp, Mus musculus
gtgcccgacgggctgaccgaaacca

SEQ ID NO: 325076 - DNA, 25 bp, Mus musculus
tggcctggtccagcgctcagctgca

SEQ ID NO: 325077 - DNA, 25 bp, Mus musculus
ggctgcaccgctacctgcgtgactt

SEQ ID NO: 325078 - DNA, 25 bp, Mus musculus
tgccagtgcttgtgcgcggctccac

SEQ ID NO: 325079 - DNA, 25 bp, Mus musculus
aggatgtttcatagggtcacgcacc

SEQ ID NO: 325080 - DNA, 25 bp, Mus musculus
agtcgggcctggacacctacagcct

SEQ ID NO: 325081 - DNA, 25 bp, Mus musculus
aatttcttggtgtccgtggagcgcg

SEQ ID NO: 325082 - DNA, 25 bp, Mus musculus
gattctggggttcctactcctggct

SEQ ID NO: 325083 - DNA, 25 bp, Mus musculus
ccgattggatgctggcagccctgcc

SEQ ID NO: 325084 - DNA, 25 bp, Mus musculus
accctgaccagtgtctgagtccgga

SEQ ID NO: 325085 - DNA, 25 bp, Mus musculus
cctgcgtggttatgagcaagccctg

SEQ ID NO: 325086 - DNA, 25 bp, Mus musculus
ccctggcccgaatgcgcacagagga

SEQ ID NO: 325087 - DNA, 25 bp, Mus musculus
gcgctgcgctacttctccacgaacc

SEQ ID NO: 325088 - DNA, 25 bp, Mus musculus
ctcttcttgactgcaatgcgagccc

SEQ ID NO: 325089 - DNA, 25 bp, Mus musculus
ttcagctcttcttgactgcaatgcg

SEQ ID NO: 325090 - DNA, 25 bp, Mus musculus
cacagacacgcgctgctcttcctgc

SEQ ID NO: 325091 - DNA, 25 bp, Mus musculus
tgcaaacggagtctcgggcaccgtt

SEQ ID NO: 325092 - DNA, 25 bp, Mus musculus
ggcccgaatgcgcacagaggatccc

SEQ ID NO: 325093 - DNA, 25 bp, Mus musculus
agccctgagcgaggcgcaggaccca

SEQ ID NO: 325094 - DNA, 25 bp, Mus musculus
ggaacgagcagatgcccagacccgc

SEQ ID NO: 325095 - DNA, 25 bp, Mus musculus
tatgagcaagccctgagcgaggcgc

SEQ ID NO: 325096 - DNA, 25 bp, Mus musculus
gggctctggaacgagcagatgccca

SEQ ID NO: 325097 - DNA, 25 bp, Mus musculus
cgcactacctgcgtggttatgagca

SEQ ID NO: 325098 - DNA, 25 bp, Mus musculus
acctctttgcgcactacctgcgtgg

SEQ ID NO: 325099 - DNA, 25 bp, Mus musculus
tcggcgatgctttgtttgattgctc

SEQ ID NO: 325100 - DNA, 25 bp, Mus musculus
agaactcactgagtagggaagcagc

SEQ ID NO: 325101 - DNA, 25 bp, Mus musculus
gaagcagaatcccaagaactcactg

SEQ ID NO: 325102 - DNA, 25 bp, Mus musculus
cggcggtgtaagtagaagcagaatc

SEQ ID NO: 325103 - DNA, 25 bp, Mus musculus
ctaggacgcctccacggcggtgtaa

SEQ ID NO: 325104 - DNA, 25 bp, Mus musculus
tttgcagctctctctgctcgcttcg

SEQ ID NO: 325105 - DNA, 25 bp, Mus musculus
tttgattgctctgagttcccgtagc

SEQ ID NO: 325106 - DNA, 25 bp, Mus musculus
cccaggagtctctcggcgatgcttt

SEQ ID NO: 325107 - DNA, 25 bp, Mus musculus
gccagggtttcgctcagcccggaag

SEQ ID NO: 325108 - DNA, 25 bp, Mus musculus
tctaagtggattcggtgccagggtt

SEQ ID NO: 325109 - DNA, 25 bp, Mus musculus
tgctcgcttcgtctaagtggattcg

SEQ ID NO: 325110 - DNA, 25 bp, Mus musculus
gttcccgtagctccacgctttgagg

SEQ ID NO: 325111 - DNA, 25 bp, Mus musculus
cgcgaaaagggctttgcagctctct

SEQ ID NO: 325112 - DNA, 25 bp, Mus musculus
ctcgcctccgagtcttcgcagatgg

SEQ ID NO: 325113 - DNA, 25 bp, Mus musculus
ccggggctgcagagaagacagctct

SEQ ID NO: 325114 - DNA, 25 bp, Mus musculus
aaggcaagcttcgcggacgcgcacg

SEQ ID NO: 325115 - DNA, 25 bp, Mus musculus
acccttgggtcaaggcaagcttcgc

SEQ ID NO: 325116 - DNA, 25 bp, Mus musculus
gcctctccggaggacccttgggtca

SEQ ID NO: 325117 - DNA, 25 bp, Mus musculus
ccagtccgctggcttgtttccggtt

SEQ ID NO: 325118 - DNA, 25 bp, Mus musculus
atcacgtgactgagcctcgcctctt

SEQ ID NO: 325119 - DNA, 25 bp, Mus musculus
tcacgactacaattgcggattggtg

SEQ ID NO: 325120 - DNA, 25 bp, Mus musculus
atcacaccgctcacgactacaattg

SEQ ID NO: 325121 - DNA, 25 bp, Mus musculus
gcaagcgcagcgctatcacaccgct

SEQ ID NO: 325122 - DNA, 25 bp, Mus musculus
cctgtgccaaggtggggagacaaac

SEQ ID NO: 325123 - DNA, 25 bp, Mus musculus
tgcagagaagacagctctcacccgg

SEQ ID NO: 325124 - DNA, 25 bp, Mus musculus
cgctggcttgtttccggttcggtag

SEQ ID NO: 325125 - DNA, 25 bp, Mus musculus
ttccggttcggtaggttcacgatga

SEQ ID NO: 325126 - DNA, 25 bp, Mus musculus
tcggtaggttcacgatgacggagcc

SEQ ID NO: 325127 - DNA, 25 bp, Mus musculus
ccttgagctaaacccgcgtggtgtg

SEQ ID NO: 325128 - DNA, 25 bp, Mus musculus
gttttgttcttgcaggtacctcagg

SEQ ID NO: 325129 - DNA, 25 bp, Mus musculus
cttgcgggctttgccgttacctcca

SEQ ID NO: 325130 - DNA, 25 bp, Mus musculus
gcccggcttttactcatggcctttc

SEQ ID NO: 325131 - DNA, 25 bp, Mus musculus
ccaaactcgagagctggactggtcg

SEQ ID NO: 325132 - DNA, 25 bp, Mus musculus
aggcgggaccttaacgctgattggc

SEQ ID NO: 325133 - DNA, 25 bp, Mus musculus
ctgattggctaaggaagaagcctgc

SEQ ID NO: 325134 - DNA, 25 bp, Mus musculus
gaagcctgccggaagagtacccgga

SEQ ID NO: 325135 - DNA, 25 bp, Mus musculus
ccctagtagcggctgtcaagaagtc

SEQ ID NO: 325136 - DNA, 25 bp, Mus musculus
cttagtgacaggtcagcggccgcct

SEQ ID NO: 325137 - DNA, 25 bp, Mus musculus
tggtgagcggtcctttctataagcc

SEQ ID NO: 325138 - DNA, 25 bp, Mus musculus
ctataagccgccagaccctgttagg

SEQ ID NO: 325139 - DNA, 25 bp, Mus musculus
tttgagcactcgtgaccttgagcta

SEQ ID NO: 325140 - DNA, 25 bp, Mus musculus
ccctgttaggccgagtttgagcact

SEQ ID NO: 325141 - DNA, 25 bp, Mus musculus
gtgtctcaccagaacgccgcgttca

SEQ ID NO: 325142 - DNA, 25 bp, Mus musculus
tcccaggagccggacatagctcggc

SEQ ID NO: 325143 - DNA, 25 bp, Mus musculus
ccgggagtcacaataacaccgactg

SEQ ID NO: 325144 - DNA, 25 bp, Mus musculus
accgactgcgcagaagcacgatttg

SEQ ID NO: 325145 - DNA, 25 bp, Mus musculus
cagacgctccggtgcgcattcatca

SEQ ID NO: 325146 - DNA, 25 bp, Mus musculus
tcatcagacggaagagaacactgcg

SEQ ID NO: 325147 - DNA, 25 bp, Mus musculus
acactgcgtcgaaatgcgttcccgg

SEQ ID NO: 325148 - DNA, 25 bp, Mus musculus
cgcacgactgaagcccgatgaagga

SEQ ID NO: 325149 - DNA, 25 bp, Mus musculus
aggaggaaatttcatctgcagaacc

SEQ ID NO: 325150 - DNA, 25 bp, Mus musculus
tctgcagaacccagctcccattgga

SEQ ID NO: 325151 - DNA, 25 bp, Mus musculus
cccattggagcggagaacgattagg

SEQ ID NO: 325152 - DNA, 25 bp, Mus musculus
agcgcattgtctggcgcctgcgtct

SEQ ID NO: 325153 - DNA, 25 bp, Mus musculus
actgcaacgccgatgtctgaggagc

SEQ ID NO: 325154 - DNA, 25 bp, Mus musculus
ctcagcagaggctcgtaagggccca

SEQ ID NO: 325155 - DNA, 25 bp, Mus musculus
gtgggttccgccctctgattcatgc

SEQ ID NO: 325156 - DNA, 25 bp, Mus musculus
tctcccggcgtacttggatctgacg

SEQ ID NO: 325157 - DNA, 25 bp, Mus musculus
gcagcagccctgacaagtttaaacg

SEQ ID NO: 325158 - DNA, 25 bp, Mus musculus
ctcccagccttaatgcatgagctta

SEQ ID NO: 325159 - DNA, 25 bp, Mus musculus
gcttagtcagaatctccagttggga

SEQ ID NO: 325160 - DNA, 25 bp, Mus musculus
ggactcgtctgatggagccaccttc

SEQ ID NO: 325161 - DNA, 25 bp, Mus musculus
ggagccaccttctcaacgccaaagg

SEQ ID NO: 325162 - DNA, 25 bp, Mus musculus
cgcgtttgcattgaggttacctatc

SEQ ID NO: 325163 - DNA, 25 bp, Mus musculus
ccctcctcgtcgtgtcgtgaatgtt

SEQ ID NO: 325164 - DNA, 25 bp, Mus musculus
cgtgaatgttcgtcggaaacgcagc

SEQ ID NO: 325165 - DNA, 25 bp, Mus musculus
ttgcgggtccgcaacactaaccaga

SEQ ID NO: 325166 - DNA, 25 bp, Mus musculus
gacgactttctccaccagtgtttta

SEQ ID NO: 325167 - DNA, 25 bp, Mus musculus
tgttttacttgaatctccgcgtctg

SEQ ID NO: 325168 - DNA, 25 bp, Mus musculus
cgcgtctgtcattccctggctggaa

SEQ ID NO: 325169 - DNA, 25 bp, Mus musculus
ccatcccaccgccagctgcggaccg

SEQ ID NO: 325170 - DNA, 25 bp, Mus musculus
gctgcggggaaaatcaattatcaaa

SEQ ID NO: 325171 - DNA, 25 bp, Mus musculus
ggggaaaatcaattatcaaataatc

SEQ ID NO: 325172 - DNA, 25 bp, Mus musculus
tcaaataatcgatcagcagggagct

SEQ ID NO: 325173 - DNA, 25 bp, Mus musculus
aataatcgatcagcagggagcttcg

SEQ ID NO: 325174 - DNA, 25 bp, Mus musculus
tcgatcagcagggagcttcgatctg

SEQ ID NO: 325175 - DNA, 25 bp, Mus musculus
cagggagcttcgatctgctgggaat

SEQ ID NO: 325176 - DNA, 25 bp, Mus musculus
ggagcttcgatctgctgggaatgca

SEQ ID NO: 325177 - DNA, 25 bp, Mus musculus
gcttcgatctgctgggaatgcaaac

SEQ ID NO: 325178 - DNA, 25 bp, Mus musculus
ctgggaatgcaaactgccattccgg

SEQ ID NO: 325179 - DNA, 25 bp, Mus musculus
tgcaaactgccattccggattcccg

SEQ ID NO: 325180 - DNA, 25 bp, Mus musculus
gattcccgccctgaaggtggccaaa

SEQ ID NO: 325181 - DNA, 25 bp, Mus musculus
ttggctgcggggaaaatcaattatc

SEQ ID NO: 325182 - DNA, 25 bp, Mus musculus
aagcagccagcctacgctcccaacg

SEQ ID NO: 325183 - DNA, 25 bp, Mus musculus
attgctaagagagaaaatgatgccc

SEQ ID NO: 325184 - DNA, 25 bp, Mus musculus
gagtgagcaagcgaccacggtgccc

SEQ ID NO: 325185 - DNA, 25 bp, Mus musculus
tgcgcaagcgcacatagtgacagga

SEQ ID NO: 325186 - DNA, 25 bp, Mus musculus
agcgcacatagtgacaggaagcgtg

SEQ ID NO: 325187 - DNA, 25 bp, Mus musculus
tgaattccagctgcaattgctaaga

SEQ ID NO: 325188 - DNA, 25 bp, Mus musculus
aatgatgcccaggatgggctctgcc

SEQ ID NO: 325189 - DNA, 25 bp, Mus musculus
agcgcccgcgtcaaaacatcagtcg

SEQ ID NO: 325190 - DNA, 25 bp, Mus musculus
aaacatcagtcgacagcgcgttccc

SEQ ID NO: 325191 - DNA, 25 bp, Mus musculus
tccggctggcaggagttcctctcag

SEQ ID NO: 325192 - DNA, 25 bp, Mus musculus
gcaggagttcctctcagtcgtgacc

SEQ ID NO: 325193 - DNA, 25 bp, Mus musculus
acgagctaggtctgatcggcgatgc

SEQ ID NO: 325194 - DNA, 25 bp, Mus musculus
gggagatcatcaccctgcagctggg

SEQ ID NO: 325195 - DNA, 25 bp, Mus musculus
cggcaaccagagtgagcaagcgacc

SEQ ID NO: 325196 - DNA, 25 bp, Mus musculus
gctctgcgcctgtgctgaattccag

SEQ ID NO: 325197 - DNA, 25 bp, Mus musculus
cgtgctcagctccagaacgtcatac

SEQ ID NO: 325198 - DNA, 25 bp, Mus musculus
agtggagaagctgtaaagacacctc

SEQ ID NO: 325199 - DNA, 25 bp, Mus musculus
aacgtcataccgagcagcgccgaac

SEQ ID NO: 325200 - DNA, 25 bp, Mus musculus
acactgcgccgctagagccaggtag

SEQ ID NO: 325201 - DNA, 25 bp, Mus musculus
cgctagagccaggtaggcagccatg

SEQ ID NO: 325202 - DNA, 25 bp, Mus musculus
catggcttcagcttggcccatgccc

SEQ ID NO: 325203 - DNA, 25 bp, Mus musculus
cacctgggccgtgcttcccgtagag

SEQ ID NO: 325204 - DNA, 25 bp, Mus musculus
tccagaacgtcataccgagcagcgc

SEQ ID NO: 325205 - DNA, 25 bp, Mus musculus
tgcttcccgtagagcggccggttcc

SEQ ID NO: 325206 - DNA, 25 bp, Mus musculus
ggaaaagtcccggtgcaaactctgc

SEQ ID NO: 325207 - DNA, 25 bp, Mus musculus
ccggtgcaaactctgcaggcgcagc

SEQ ID NO: 325208 - DNA, 25 bp, Mus musculus
cgcagcagcagagcgtgagcctgca

SEQ ID NO: 325209 - DNA, 25 bp, Mus musculus
cgtcagtggagaagctgtaaagaca

SEQ ID NO: 325210 - DNA, 25 bp, Mus musculus
cgcccagcaccgcagccgtcgtgct

SEQ ID NO: 325211 - DNA, 25 bp, Mus musculus
agcagtgtctggtgcagcaatcgtg

SEQ ID NO: 325212 - DNA, 25 bp, Mus musculus
aaaggactatcaccagagcccgctg

SEQ ID NO: 325213 - DNA, 25 bp, Mus musculus
caagaggactgcgtttggcccaagt

SEQ ID NO: 325214 - DNA, 25 bp, Mus musculus
ttggcccaagtatggagcaggctca

SEQ ID NO: 325215 - DNA, 25 bp, Mus musculus
acggccggttgtagtgagaaagatt

SEQ ID NO: 325216 - DNA, 25 bp, Mus musculus
ttgaactcggttctaaatccctgta

SEQ ID NO: 325217 - DNA, 25 bp, Mus musculus
agcccacaggcgcatccctagtagg

SEQ ID NO: 325218 - DNA, 25 bp, Mus musculus
ccacatttgcagttggccaagagga

SEQ ID NO: 325219 - DNA, 25 bp, Mus musculus
tagctcaaaggtctcgtcgtcctcg

SEQ ID NO: 325220 - DNA, 25 bp, Mus musculus
actggaggtactccgacccgaactg

SEQ ID NO: 325221 - DNA, 25 bp, Mus musculus
agcgctgaggtgcaaaaggactatc

SEQ ID NO: 325222 - DNA, 25 bp, Mus musculus
gttcgttgtagtgtccagctctgta

SEQ ID NO: 325223 - DNA, 25 bp, Mus musculus
cggttgtccaagctccaaggagggt

SEQ ID NO: 325224 - DNA, 25 bp, Mus musculus
ctggactcggggtccttagctcaaa

SEQ ID NO: 325225 - DNA, 25 bp, Mus musculus
gctgccagtagatcggctgtatcca

SEQ ID NO: 325226 - DNA, 25 bp, Mus musculus
aaagcaccggattgaggctgcaacg

SEQ ID NO: 325227 - DNA, 25 bp, Mus musculus
tgcaacggaccagggtcaagccgcc

SEQ ID NO: 325228 - DNA, 25 bp, Mus musculus
aagctagatccttgcgcttgctgga

SEQ ID NO: 325229 - DNA, 25 bp, Mus musculus
ctgtatccagcagcagggcaaggct

SEQ ID NO: 325230 - DNA, 25 bp, Mus musculus
ctgtagggcaactgcagcaccacga

SEQ ID NO: 325231 - DNA, 25 bp, Mus musculus
cccaggagcgcataacaggctgcca

SEQ ID NO: 325232 - DNA, 25 bp, Mus musculus
gtctgcgtgaggctttcgggaaaaa

SEQ ID NO: 325233 - DNA, 25 bp, Mus musculus
tcgggaaaaatgagccgacagcgtc

SEQ ID NO: 325234 - DNA, 25 bp, Mus musculus
tcccggctgaaaaggagcgcaggta

SEQ ID NO: 325235 - DNA, 25 bp, Mus musculus
gcgacaacagccacacgaagactga

SEQ ID NO: 325236 - DNA, 25 bp, Mus musculus
gactgaaaccaagtgcgctcggcta

SEQ ID NO: 325237 - DNA, 25 bp, Mus musculus
agagctcgtgcgatggccacatagc

SEQ ID NO: 325238 - DNA, 25 bp, Mus musculus
cgccggtgaccagcaaagctagatc

SEQ ID NO: 325239 - DNA, 25 bp, Mus musculus
cggtcttcgcaggtgtgtgttttcg

SEQ ID NO: 325240 - DNA, 25 bp, Mus musculus
gtgaggcgagttagaccagcgacaa

SEQ ID NO: 325241 - DNA, 25 bp, Mus musculus
ccagcgacaaggtccgggagcaaaa

SEQ ID NO: 325242 - DNA, 25 bp, Mus musculus
ccgggaatctcgaccctgacacttg

SEQ ID NO: 325243 - DNA, 25 bp, Mus musculus
tgacacttgggcgtcttaagaacct

SEQ ID NO: 325244 - DNA, 25 bp, Mus musculus
ttaagaacctctcacacttggcggg

SEQ ID NO: 325245 - DNA, 25 bp, Mus musculus
acacttggcgggcatctcggcctgg

SEQ ID NO: 325246 - DNA, 25 bp, Mus musculus
atcacctgggctgcggtcttcgcag

SEQ ID NO: 325247 - DNA, 25 bp, Mus musculus
accacactcgggacgacaggcttcg

SEQ ID NO: 325248 - DNA, 25 bp, Mus musculus
tcaggcaatggtgtggccctcagtt

SEQ ID NO: 325249 - DNA, 25 bp, Mus musculus
ccagccctgaggttcaagcgtcacg

SEQ ID NO: 325250 - DNA, 25 bp, Mus musculus
gttcaagcgtcacgccaagcccagg

SEQ ID NO: 325251 - DNA, 25 bp, Mus musculus
tgcgcactctgagggtggatcacct

SEQ ID NO: 325252 - DNA, 25 bp, Mus musculus
ggccctcccgcttacaagagtcagg

SEQ ID NO: 325253 - DNA, 25 bp, Mus musculus
cgacagcgttgtgcctccctccgct

SEQ ID NO: 325254 - DNA, 25 bp, Mus musculus
cccagcggccgacagcgttgtgcct

SEQ ID NO: 325255 - DNA, 25 bp, Mus musculus
tcggcttggtgtgacccgcgcccag

SEQ ID NO: 325256 - DNA, 25 bp, Mus musculus
atctcggcttggtgtgacccgcgcc

SEQ ID NO: 325257 - DNA, 25 bp, Mus musculus
tggatctcggcttggtgtgacccgc

SEQ ID NO: 325258 - DNA, 25 bp, Mus musculus
cgccatctcacccaaggcgtgatgg

SEQ ID NO: 325259 - DNA, 25 bp, Mus musculus
gctcgggccggggatataggcgccc

SEQ ID NO: 325260 - DNA, 25 bp, Mus musculus
acgggaccaccctgcgagtaccaat

SEQ ID NO: 325261 - DNA, 25 bp, Mus musculus
cgcagcccgagctggaagcgagagt

SEQ ID NO: 325262 - DNA, 25 bp, Mus musculus
gacatcgaggccagcacgggaccac

SEQ ID NO: 325263 - DNA, 25 bp, Mus musculus
gctgctgggcggtgagcaccgtgtc

SEQ ID NO: 325264 - DNA, 25 bp, Mus musculus
ggtgcggcagtgactccccctgcag

SEQ ID NO: 325265 - DNA, 25 bp, Mus musculus
ccctccgaggaagcggcgcagcttc

SEQ ID NO: 325266 - DNA, 25 bp, Mus musculus
aagcggcgcagcttcctgcggctcg

SEQ ID NO: 325267 - DNA, 25 bp, Mus musculus
ccctaacgtgctgctaggctggtgc

SEQ ID NO: 325268 - DNA, 25 bp, Mus musculus
ccgaacgtggacacccggcagaagc

SEQ ID NO: 325269 - DNA, 25 bp, Mus musculus
gcgcctcccgagaggagtccggaac

SEQ ID NO: 325270 - DNA, 25 bp, Mus musculus
ttccacgctttaattcctcgtcctg

SEQ ID NO: 325271 - DNA, 25 bp, Mus musculus
ctgatgattcacttggggttccggg

SEQ ID NO: 325272 - DNA, 25 bp, Mus musculus
gggctcagccctgatgattcacttg

SEQ ID NO: 325273 - DNA, 25 bp, Mus musculus
ctcagaccctgagaagcccagtgta

SEQ ID NO: 325274 - DNA, 25 bp, Mus musculus
tgagaagcccagtgtagctccctcc

SEQ ID NO: 325275 - DNA, 25 bp, Mus musculus
gctgtgctgtcagcccggacatgct

SEQ ID NO: 325276 - DNA, 25 bp, Mus musculus
gggttttctgggctactacgatggc

SEQ ID NO: 325277 - DNA, 25 bp, Mus musculus
ctacgatggcgatgagtttcgagtg

SEQ ID NO: 325278 - DNA, 25 bp, Mus musculus
cgcccttctttacgtgaggctcaga

SEQ ID NO: 325279 - DNA, 25 bp, Mus musculus
ccggaacctttctgctgtgctgtca

SEQ ID NO: 325280 - DNA, 25 bp, Mus musculus
ttcgcccggcaggttacagccgaac

SEQ ID NO: 325281 - DNA, 25 bp, Mus musculus
tgtacccagccggtctgcctgtcag

SEQ ID NO: 325282 - DNA, 25 bp, Mus musculus
ggtctgcctgtcaggcagcaacctc

SEQ ID NO: 325283 - DNA, 25 bp, Mus musculus
ttctgcggcgcctggcccttcccat

SEQ ID NO: 325284 - DNA, 25 bp, Mus musculus
cttcccatgctagcacctcgaaata

SEQ ID NO: 325285 - DNA, 25 bp, Mus musculus
tgctagcacctcgaaatacggagac

SEQ ID NO: 325286 - DNA, 25 bp, Mus musculus
cacctcgaaatacggagactggggt

SEQ ID NO: 325287 - DNA, 25 bp, Mus musculus
aaaccgaggctgacctggctctgcg

SEQ ID NO: 325288 - DNA, 25 bp, Mus musculus
ccgcttctctgggaaggctgagcct

SEQ ID NO: 325289 - DNA, 25 bp, Mus musculus
tctctgggaaggctgagcctcggcc

SEQ ID NO: 325290 - DNA, 25 bp, Mus musculus
gctcttcgagacctagccgccgcag

SEQ ID NO: 325291 - DNA, 25 bp, Mus musculus
atgtcccaaaccgaggctgacctgg

SEQ ID NO: 325292 - DNA, 25 bp, Mus musculus
tccgctggagcgcggtgtacccagc

SEQ ID NO: 325293 - DNA, 25 bp, Mus musculus
cacctcctcgccgagtgcgccgctt

SEQ ID NO: 325294 - DNA, 25 bp, Mus musculus
atctccggctctcacctctacgggg

SEQ ID NO: 325295 - DNA, 25 bp, Mus musculus
agacctcggactggccacgctcaag

SEQ ID NO: 325296 - DNA, 25 bp, Mus musculus
ccgagatctcaagtgtgacaacgtc

SEQ ID NO: 325297 - DNA, 25 bp, Mus musculus
atcctgcaccgagatctcaagtgtg

SEQ ID NO: 325298 - DNA, 25 bp, Mus musculus
tcatttccttcattcccgagtgccc

SEQ ID NO: 325299 - DNA, 25 bp, Mus musculus
ctggagtcgccagattctacgggga

SEQ ID NO: 325300 - DNA, 25 bp, Mus musculus
ccgagtccttcagcgctggagtcgc

SEQ ID NO: 325301 - DNA, 25 bp, Mus musculus
gttccgcgaaatgaagccccgagtc

SEQ ID NO: 325302 - DNA, 25 bp, Mus musculus
tgtcaaaatcggagacctcggactg

SEQ ID NO: 325303 - DNA, 25 bp, Mus musculus
tcaagcgcgcctcctttgccaagag

SEQ ID NO: 325304 - DNA, 25 bp, Mus musculus
gcctcctttgccaagagcgtcattg

SEQ ID NO: 325305 - DNA, 25 bp, Mus musculus
cctttgccaagagcgtcattggtgc

SEQ ID NO: 325306 - DNA, 25 bp, Mus musculus
tgtgacaacgtcttcattactggcc

SEQ ID NO: 325307 - DNA, 25 bp, Mus musculus
acgtcttcattactggcccttcagg

SEQ ID NO: 325308 - DNA, 25 bp, Mus musculus
tggcccttcaggctctgtcaaaatc

SEQ ID NO: 325309 - DNA, 25 bp, Mus musculus
ctgagaatagttgtgctgcggcagc

SEQ ID NO: 325310 - DNA, 25 bp, Mus musculus
agaggtctggaggatgctccgtctc

SEQ ID NO: 325311 - DNA, 25 bp, Mus musculus
aacgagctatctctcgctaacacca

SEQ ID NO: 325312 - DNA, 25 bp, Mus musculus
tccgagtggctgagaatagttgtgc

SEQ ID NO: 325313 - DNA, 25 bp, Mus musculus
ctctgcttccgagtggctgagaata

SEQ ID NO: 325314 - DNA, 25 bp, Mus musculus
ggcgcgtctccggattccgagcact

SEQ ID NO: 325315 - DNA, 25 bp, Mus musculus
aaaccgacacagtgcgggagatgga

SEQ ID NO: 325316 - DNA, 25 bp, Mus musculus
gctccaagaggaaaccgacacagtg

SEQ ID NO: 325317 - DNA, 25 bp, Mus musculus
caggaccaggggctccaagaggaaa

SEQ ID NO: 325318 - DNA, 25 bp, Mus musculus
cctccgaagatctggatctgaagca

SEQ ID NO: 325319 - DNA, 25 bp, Mus musculus
tcccatgcctccgaagatctggatc

SEQ ID NO: 325320 - DNA, 25 bp, Mus musculus
ggaagggaacaacgagctatctctc

SEQ ID NO: 325321 - DNA, 25 bp, Mus musculus
tccgtctccatcaaagggcggggac

SEQ ID NO: 325322 - DNA, 25 bp, Mus musculus
ggatgctccgtctccatcaaagggc

SEQ ID NO: 325323 - DNA, 25 bp, Mus musculus
tcaccctgcaaactgcaccgaaagg

SEQ ID NO: 325324 - DNA, 25 bp, Mus musculus
ctgcaaactgcaccgaaaggaggcg

SEQ ID NO: 325325 - DNA, 25 bp, Mus musculus
cgcaaatgcacacggtgcttggcgg

SEQ ID NO: 325326 - DNA, 25 bp, Mus musculus
gcactccatgtgtcccgagggcaga

SEQ ID NO: 325327 - DNA, 25 bp, Mus musculus
gctgaaagcgtcctgagagcgccgc

SEQ ID NO: 325328 - DNA, 25 bp, Mus musculus
cgggtgcacagctaccggccggctt

SEQ ID NO: 325329 - DNA, 25 bp, Mus musculus
tatattgcgcgcagcgggactgctc

SEQ ID NO: 325330 - DNA, 25 bp, Mus musculus
gcgggctgcactccatgtgtcccga

SEQ ID NO: 325331 - DNA, 25 bp, Mus musculus
aggagatctgagagtgggaccaccc

SEQ ID NO: 325332 - DNA, 25 bp, Mus musculus
tcagccggttcagactggccagggt

SEQ ID NO: 325333 - DNA, 25 bp, Mus musculus
gcgtgcagtctcagccggttcagac

SEQ ID NO: 325334 - DNA, 25 bp, Mus musculus
taagctacgggtgtagacgcagcgc

SEQ ID NO: 325335 - DNA, 25 bp, Mus musculus
ctagccgggccttaagctacgggtg

SEQ ID NO: 325336 - DNA, 25 bp, Mus musculus
ggcttctggtctgcccgggctgaaa

SEQ ID NO: 325337 - DNA, 25 bp, Mus musculus
cgcacggataagaacgagaggtggg

SEQ ID NO: 325338 - DNA, 25 bp, Mus musculus
gtctccgctcactgtccgccggtcc

SEQ ID NO: 325339 - DNA, 25 bp, Mus musculus
tccaggatctcctggcccatgcgtt

SEQ ID NO: 325340 - DNA, 25 bp, Mus musculus
ggcccatgcgttcttccgcgaggaa

SEQ ID NO: 325341 - DNA, 25 bp, Mus musculus
gtccacgagacaaccaggccatcga

SEQ ID NO: 325342 - DNA, 25 bp, Mus musculus
ccatgcgttcttccgcgaggaacga

SEQ ID NO: 325343 - DNA, 25 bp, Mus musculus
ttcttccgcgaggaacgaggtgtgc

SEQ ID NO: 325344 - DNA, 25 bp, Mus musculus
cttccgcgaggaacgaggtgtgcac

SEQ ID NO: 325345 - DNA, 25 bp, Mus musculus
tgcacgtggagctggcagaggaaga

SEQ ID NO: 325346 - DNA, 25 bp, Mus musculus
atgatggagagaagccgggcctcaa

SEQ ID NO: 325347 - DNA, 25 bp, Mus musculus
agaagccgggcctcaagctctggct

SEQ ID NO: 325348 - DNA, 25 bp, Mus musculus
ctctggctgcgcatggaggatgcgc

SEQ ID NO: 325349 - DNA, 25 bp, Mus musculus
gggcgtccacgagacaaccaggcca

SEQ ID NO: 325350 - DNA, 25 bp, Mus musculus
acgagacaaccaggccatcgagttc

SEQ ID NO: 325351 - DNA, 25 bp, Mus musculus
cctagacgctgccacggcgggaaat

SEQ ID NO: 325352 - DNA, 25 bp, Mus musculus
ctggctgggctcgtccctagacgct

SEQ ID NO: 325353 - DNA, 25 bp, Mus musculus
ccacggcgggaaatgagcgtgtccc

SEQ ID NO: 325354 - DNA, 25 bp, Mus musculus
gagcgtgtccccttccgcgcgagat

SEQ ID NO: 325355 - DNA, 25 bp, Mus musculus
ctggagtcagactctggctgggctc

SEQ ID NO: 325356 - DNA, 25 bp, Mus musculus
ctcagagtcccgcttaaagctggag

SEQ ID NO: 325357 - DNA, 25 bp, Mus musculus
ggaccctggacccagagactcagag

SEQ ID NO: 325358 - DNA, 25 bp, Mus musculus
cagggaacagcagagccgggcaagc

SEQ ID NO: 325359 - DNA, 25 bp, Mus musculus
gtcgagtcgcacagcgccgcgtgca

SEQ ID NO: 325360 - DNA, 25 bp, Mus musculus
ttcgcgcgtgtcctcacttcagctt

SEQ ID NO: 325361 - DNA, 25 bp, Mus musculus
gagattcgcgcgtgtcctcacttca

SEQ ID NO: 325362 - DNA, 25 bp, Mus musculus
ccgtgggaccctggacccagagact

SEQ ID NO: 325363 - DNA, 25 bp, Mus musculus
cccgcttaaagctggagtcagactc

SEQ ID NO: 325364 - DNA, 25 bp, Mus musculus
actcagagggcctcagactcagagt

SEQ ID NO: 325365 - DNA, 25 bp, Mus musculus
cggtcttcagctacttcccggtcgg

SEQ ID NO: 325366 - DNA, 25 bp, Mus musculus
cgacagcggagaaaagacgacgtta

SEQ ID NO: 325367 - DNA, 25 bp, Mus musculus
agcgagacctccagagttcccatcg

SEQ ID NO: 325368 - DNA, 25 bp, Mus musculus
ccggtcggctagctgaagacttccg

SEQ ID NO: 325369 - DNA, 25 bp, Mus musculus
ttccgcccaggaccagaagtgacgt

SEQ ID NO: 325370 - DNA, 25 bp, Mus musculus
cagatccctgtttacccggctcgga

SEQ ID NO: 325371 - DNA, 25 bp, Mus musculus
tcggagcgccatccaaaggccgagc

SEQ ID NO: 325372 - DNA, 25 bp, Mus musculus
gcagtctagtctcccgagcggggaa

SEQ ID NO: 325373 - DNA, 25 bp, Mus musculus
ggcttcttcctaaggtctcacttca

SEQ ID NO: 325374 - DNA, 25 bp, Mus musculus
ggcagagcccagctaaggcagtcta

SEQ ID NO: 325375 - DNA, 25 bp, Mus musculus
ggatgacaccaagaggacccgcttc

SEQ ID NO: 325376 - DNA, 25 bp, Mus musculus
tccctctgggagtgggatgacacca

SEQ ID NO: 325377 - DNA, 25 bp, Mus musculus
gccagggactctaggcttcttccta

SEQ ID NO: 325378 - DNA, 25 bp, Mus musculus
agaatcggctcctttgaacctcggg

SEQ ID NO: 325379 - DNA, 25 bp, Mus musculus
gggcttctccggctcacgtcactag

SEQ ID NO: 325380 - DNA, 25 bp, Mus musculus
aactgagtatcagagcggctgcgca

SEQ ID NO: 325381 - DNA, 25 bp, Mus musculus
gcacaaggcccggaagctccgacag

SEQ ID NO: 325382 - DNA, 25 bp, Mus musculus
aggttgaccaccacagggcacaagg

SEQ ID NO: 325383 - DNA, 25 bp, Mus musculus
cagcatccctgtcctaggttgacca

SEQ ID NO: 325384 - DNA, 25 bp, Mus musculus
cccaggaggtttggatctcagcatc

SEQ ID NO: 325385 - DNA, 25 bp, Mus musculus
agttccgggacaataagacacatca

SEQ ID NO: 325386 - DNA, 25 bp, Mus musculus
cacggtgaagtcgagttccgggaca

SEQ ID NO: 325387 - DNA, 25 bp, Mus musculus
aagcccggtgcaatggaacgcgtct

SEQ ID NO: 325388 - DNA, 25 bp, Mus musculus
gggcgcgacgcctactcttccagaa

SEQ ID NO: 325389 - DNA, 25 bp, Mus musculus
ggaacgcgtcttcggtttgacacta

SEQ ID NO: 325390 - DNA, 25 bp, Mus musculus
ctccaggaacctgtagaactgagta

SEQ ID NO: 325391 - DNA, 25 bp, Mus musculus
ccggcacatgaggtcccacggtgaa

SEQ ID NO: 325392 - DNA, 25 bp, Mus musculus
ttggctgtgacgcaacttccggcgt

SEQ ID NO: 325393 - DNA, 25 bp, Mus musculus
cgaacgcatttttctgcaggagcga

SEQ ID NO: 325394 - DNA, 25 bp, Mus musculus
gctgaggctgctcctaatacctgtc

SEQ ID NO: 325395 - DNA, 25 bp, Mus musculus
ccctcggggaaaagcagcgtgtctt

SEQ ID NO: 325396 - DNA, 25 bp, Mus musculus
agcgtgtcttccagaaccacatgga

SEQ ID NO: 325397 - DNA, 25 bp, Mus musculus
atggaatccgctcaacacttctttc

SEQ ID NO: 325398 - DNA, 25 bp, Mus musculus
aggggtgcgagcattatccctctta

SEQ ID NO: 325399 - DNA, 25 bp, Mus musculus
ttatccctcttacgccgagactgga

SEQ ID NO: 325400 - DNA, 25 bp, Mus musculus
gtcgcgctgacacaggaacgccatc

SEQ ID NO: 325401 - DNA, 25 bp, Mus musculus
acaggaacgccatcgcggtctccta

SEQ ID NO: 325402 - DNA, 25 bp, Mus musculus
tcgcggtctcctaggccggagagac

SEQ ID NO: 325403 - DNA, 25 bp, Mus musculus
gagcgatgtgggacaaattttctta

SEQ ID NO: 325404 - DNA, 25 bp, Mus musculus
ttcttaagcgttaccgcgctcggca

SEQ ID NO: 325405 - DNA, 25 bp, Mus musculus
ctcccgtgcgtagctgtcgcgctga

SEQ ID NO: 325406 - DNA, 25 bp, Mus musculus
ttctgcaggagcgaactggaatgtg

SEQ ID NO: 325407 - DNA, 25 bp, Mus musculus
cccgagattggaggagtgcaagacc

SEQ ID NO: 325408 - DNA, 25 bp, Mus musculus
tccggatgcggatgaagatgatgca

SEQ ID NO: 325409 - DNA, 25 bp, Mus musculus
agtgtctgccgctagttccggatgc

SEQ ID NO: 325410 - DNA, 25 bp, Mus musculus
gcagacccttgtggcggtgacgaaa

SEQ ID NO: 325411 - DNA, 25 bp, Mus musculus
gctgtcctcacgtcctgggttacga

SEQ ID NO: 325412 - DNA, 25 bp, Mus musculus
ctcgaagactttgccttccgcggct

SEQ ID NO: 325413 - DNA, 25 bp, Mus musculus
tctcctgcgcgagctcgaagacttt

SEQ ID NO: 325414 - DNA, 25 bp, Mus musculus
tgcagttccgtctgcgccaggtagt

SEQ ID NO: 325415 - DNA, 25 bp, Mus musculus
tcgcacttcgcgcaggtgcagttcc

SEQ ID NO: 325416 - DNA, 25 bp, Mus musculus
cgacgcgactgtccgcacgctgagg

SEQ ID NO: 325417 - DNA, 25 bp, Mus musculus
gtcgctgccaccatgcgagactgtg

SEQ ID NO: 325418 - DNA, 25 bp, Mus musculus
ctgtggtgaccgctgtcgggcctaa

SEQ ID NO: 325419 - DNA, 25 bp, Mus musculus
atgctgacacggaccgaggtagaaa

SEQ ID NO: 325420 - DNA, 25 bp, Mus musculus
ctacggagctaggaactgtggtgac

SEQ ID NO: 325421 - DNA, 25 bp, Mus musculus
gagtcgcatccctcgagcaggacct

SEQ ID NO: 325422 - DNA, 25 bp, Mus musculus
tcggcagcgggtgatctaaagtcgc

SEQ ID NO: 325423 - DNA, 25 bp, Mus musculus
agactgcttgcatgtgcggatttcg

SEQ ID NO: 325424 - DNA, 25 bp, Mus musculus
ctacgaccggggctcgcaggtagac

SEQ ID NO: 325425 - DNA, 25 bp, Mus musculus
gggccttccgctttacacacttgtg

SEQ ID NO: 325426 - DNA, 25 bp, Mus musculus
ttacacacttgtgagcggctccttc

SEQ ID NO: 325427 - DNA, 25 bp, Mus musculus
tgtctctgcagagatgggcaagttc

SEQ ID NO: 325428 - DNA, 25 bp, Mus musculus
cagagatgggcaagttcatgaaacc

SEQ ID NO: 325429 - DNA, 25 bp, Mus musculus
ctccggacgcaaagccgtcatcgtg

SEQ ID NO: 325430 - DNA, 25 bp, Mus musculus
caaagccgtcatcgtgaaggtacca

SEQ ID NO: 325431 - DNA, 25 bp, Mus musculus
ccgtcatcgtgaaggtaccagaccc

SEQ ID NO: 325432 - DNA, 25 bp, Mus musculus
ccggggctcttgagactgcttgcat

SEQ ID NO: 325433 - DNA, 25 bp, Mus musculus
cggcttcacggggagtcgcatccct

SEQ ID NO: 325434 - DNA, 25 bp, Mus musculus
ggtgatctaaagtcgcgggcctacg

SEQ ID NO: 325435 - DNA, 25 bp, Mus musculus
ctagactcgcgacgtgcgttcccag

SEQ ID NO: 325436 - DNA, 25 bp, Mus musculus
tcgtacagcccttggcggcccatga

SEQ ID NO: 325437 - DNA, 25 bp, Mus musculus
tcggcgaagttgagcccacaggctc

SEQ ID NO: 325438 - DNA, 25 bp, Mus musculus
ggctcgcacgcgcagcgtcaattga

SEQ ID NO: 325439 - DNA, 25 bp, Mus musculus
cagcgtcaattgacccggacccggg

SEQ ID NO: 325440 - DNA, 25 bp, Mus musculus
ctctgcagcttcaccttatcgtagc

SEQ ID NO: 325441 - DNA, 25 bp, Mus musculus
cttatcgtagccaccgaagccggtg

SEQ ID NO: 325442 - DNA, 25 bp, Mus musculus
caccgaagccggtgagtaccaggca

SEQ ID NO: 325443 - DNA, 25 bp, Mus musculus
gtgccgaagcggatgctgacgcttc

SEQ ID NO: 325444 - DNA, 25 bp, Mus musculus
gtcgcttgccacctcgactgtcggg

SEQ ID NO: 325445 - DNA, 25 bp, Mus musculus
tctccgcggacatggctagactcgc

SEQ ID NO: 325446 - DNA, 25 bp, Mus musculus
tgtacagaaccggtgcacagctggg

SEQ ID NO: 325447 - DNA, 25 bp, Mus musculus
aggcggtagtcggtcgtacagccct

SEQ ID NO: 325448 - DNA, 25 bp, Mus musculus
aagggctagtccctctgctgaccga

SEQ ID NO: 325449 - DNA, 25 bp, Mus musculus
tcgggaaatagattgctgccgccgc

SEQ ID NO: 325450 - DNA, 25 bp, Mus musculus
cacagctgcgcgctagagtctaact

SEQ ID NO: 325451 - DNA, 25 bp, Mus musculus
ctcaggcgctcctggggtcacagct

SEQ ID NO: 325452 - DNA, 25 bp, Mus musculus
gaactcaaataaacggggctcgctg

SEQ ID NO: 325453 - DNA, 25 bp, Mus musculus
cctccatgcccgaggaactcaaata

SEQ ID NO: 325454 - DNA, 25 bp, Mus musculus
tcgcagctgacccttcagaacttcg

SEQ ID NO: 325455 - DNA, 25 bp, Mus musculus
ggagcttcgcagctgacccttcaga

SEQ ID NO: 325456 - DNA, 25 bp, Mus musculus
cccgtgtatggagcttcgcagctga

SEQ ID NO: 325457 - DNA, 25 bp, Mus musculus
aggctcaggccttgcgcccgtgtat

SEQ ID NO: 325458 - DNA, 25 bp, Mus musculus
cgtgggcacacagaaggctcaggcc

SEQ ID NO: 325459 - DNA, 25 bp, Mus musculus
acacctgcgtgcacgcgtgggcaca

SEQ ID NO: 325460 - DNA, 25 bp, Mus musculus
ccctgtgttcgggaaatagattgct

SEQ ID NO: 325461 - DNA, 25 bp, Mus musculus
cgcgctagagtctaactcgggtccc

SEQ ID NO: 325462 - DNA, 25 bp, Mus musculus
actagcacacctgcgtgcacgcgtg

SEQ ID NO: 325463 - DNA, 25 bp, Mus musculus
ctccaggctgaggttcttgatctcc

SEQ ID NO: 325464 - DNA, 25 bp, Mus musculus
gaggttcttgatctcctcacacgga

SEQ ID NO: 325465 - DNA, 25 bp, Mus musculus
atcacggtcgcacagctggatggcc

SEQ ID NO: 325466 - DNA, 25 bp, Mus musculus
tcacacggactactggggctgctga

SEQ ID NO: 325467 - DNA, 25 bp, Mus musculus
agcggcggcagaagctccttcgagt

SEQ ID NO: 325468 - DNA, 25 bp, Mus musculus
cagaagctccttcgagtgcgcggct

SEQ ID NO: 325469 - DNA, 25 bp, Mus musculus
tgcgcggctcgtagactgaacgccg

SEQ ID NO: 325470 - DNA, 25 bp, Mus musculus
tcgtagactgaacgccggccggcgc

SEQ ID NO: 325471 - DNA, 25 bp, Mus musculus
aagagcgcgctctcgcctgaaggga

SEQ ID NO: 325472 - DNA, 25 bp, Mus musculus
atcgctgcccttgtcctggggcgcg

SEQ ID NO: 325473 - DNA, 25 bp, Mus musculus
cgcaacctacctgcgggcgcgtaga

SEQ ID NO: 325474 - DNA, 25 bp, Mus musculus
gccttctcccgctggaagcgaagga

SEQ ID NO: 325475 - DNA, 25 bp, Mus musculus
ccggtgcctccgttcctcaccatca

SEQ ID NO: 325476 - DNA, 25 bp, Mus musculus
tcaccatcacggtcgcacagctgga

SEQ ID NO: 325477 - DNA, 25 bp, Mus musculus
ccgcgctctccgtcgccaaggaaac

SEQ ID NO: 325478 - DNA, 25 bp, Mus musculus
atctatctaaaattcccgcgctctc

SEQ ID NO: 325479 - DNA, 25 bp, Mus musculus
aacacaagatccagacacgtcagcg

SEQ ID NO: 325480 - DNA, 25 bp, Mus musculus
agcctttcggaacacaagatccaga

SEQ ID NO: 325481 - DNA, 25 bp, Mus musculus
agcgctagcctttcggaacacaaga

SEQ ID NO: 325482 - DNA, 25 bp, Mus musculus
ggaaaccggccgcttggcgcctagc

SEQ ID NO: 325483 - DNA, 25 bp, Mus musculus
gccgcgcagccgcaattacaatcta

SEQ ID NO: 325484 - DNA, 25 bp, Mus musculus
atcctctggctgcacgggcagcggc

SEQ ID NO: 325485 - DNA, 25 bp, Mus musculus
gaggtgctggatcctctggctgcac

SEQ ID NO: 325486 - DNA, 25 bp, Mus musculus
ccaagcgccgaggacggagaagccc

SEQ ID NO: 325487 - DNA, 25 bp, Mus musculus
tccgtacttccaagcgccgaggacg

SEQ ID NO: 325488 - DNA, 25 bp, Mus musculus
aaaagatccgtacttccaagcgccg

SEQ ID NO: 325489 - DNA, 25 bp, Mus musculus
gcagccgcaattacaatctatctaa

SEQ ID NO: 325490 - DNA, 25 bp, Mus musculus
ggcgcctagcgctagcctttcggaa

SEQ ID NO: 325491 - DNA, 25 bp, Mus musculus
gagtgttgccagttcagtgcctgaa

SEQ ID NO: 325492 - DNA, 25 bp, Mus musculus
ccccttgaggggatgagatccggtc

SEQ ID NO: 325493 - DNA, 25 bp, Mus musculus
gggccgccaaatacttagatagata

SEQ ID NO: 325494 - DNA, 25 bp, Mus musculus
ccgccaaatacttagatagataaga

SEQ ID NO: 325495 - DNA, 25 bp, Mus musculus
tgtgtggcccggtctaggtttcctc

SEQ ID NO: 325496 - DNA, 25 bp, Mus musculus
ctcttgctgtgagtgttgccagttc

SEQ ID NO: 325497 - DNA, 25 bp, Mus musculus
tgccagttcagtgcctgaaagattg

SEQ ID NO: 325498 - DNA, 25 bp, Mus musculus
gcctgaaagattgtgaagaggagcc

SEQ ID NO: 325499 - DNA, 25 bp, Mus musculus
tcggacaccgggtccgtacagcgtc

SEQ ID NO: 325500 - DNA, 25 bp, Mus musculus
gtacagcgtcgctctagcggcgcca

SEQ ID NO: 325501 - DNA, 25 bp, Mus musculus
agcgtcgctctagcggcgccaggca

SEQ ID NO: 325502 - DNA, 25 bp, Mus musculus
tcctgggccgccaaatacttagata

SEQ ID NO: 325503 - DNA, 25 bp, Mus musculus
cgggtccgtacagcgtcgctctagc

SEQ ID NO: 325504 - DNA, 25 bp, Mus musculus
aggtttcctcttgctgtgagtgttg

SEQ ID NO: 325505 - DNA, 25 bp, Mus musculus
ctggctcagcgccagcgtaggaggc

SEQ ID NO: 325506 - DNA, 25 bp, Mus musculus
tgggaacggactggccagcctctcc

SEQ ID NO: 325507 - DNA, 25 bp, Mus musculus
gccctgggaacggactggccagcct

SEQ ID NO: 325508 - DNA, 25 bp, Mus musculus
agcgggctgtcccatagagctggct

SEQ ID NO: 325509 - DNA, 25 bp, Mus musculus
agcagagcgggctgtcccatagagc

SEQ ID NO: 325510 - DNA, 25 bp, Mus musculus
cacgcaccctgcctccctcaaggtc

SEQ ID NO: 325511 - DNA, 25 bp, Mus musculus
tcctgtcccaccaccgctgctctgg

SEQ ID NO: 325512 - DNA, 25 bp, Mus musculus
tcaggctgtctgaagccagcgctcc

SEQ ID NO: 325513 - DNA, 25 bp, Mus musculus
cccggactctcaggctgtctgaagc

SEQ ID NO: 325514 - DNA, 25 bp, Mus musculus
gtaaacttgctagcgcgctctcgca

SEQ ID NO: 325515 - DNA, 25 bp, Mus musculus
tctgtaaacttgctagcgcgctctc

SEQ ID NO: 325516 - DNA, 25 bp, Mus musculus
gcctcatctctaatctgtaaacttg

SEQ ID NO: 325517 - DNA, 25 bp, Mus musculus
ctccgagcctcatctctaatctgta

SEQ ID NO: 325518 - DNA, 25 bp, Mus musculus
gtttccgtaaactccgagcctcatc

SEQ ID NO: 325519 - DNA, 25 bp, Mus musculus
tcctggacatgtgacttctggtctc

SEQ ID NO: 325520 - DNA, 25 bp, Mus musculus
tgctgggcttaaacccaagagaagc

SEQ ID NO: 325521 - DNA, 25 bp, Mus musculus
tcacacaggaaactcagcactaatg

SEQ ID NO: 325522 - DNA, 25 bp, Mus musculus
ctcagcactaatgctcagagcagta

SEQ ID NO: 325523 - DNA, 25 bp, Mus musculus
gcagtactgctcatgacagctaagt

SEQ ID NO: 325524 - DNA, 25 bp, Mus musculus
acagctaagtgaggaacagctcaga

SEQ ID NO: 325525 - DNA, 25 bp, Mus musculus
ctcagatacatgaataagataggcc

SEQ ID NO: 325526 - DNA, 25 bp, Mus musculus
aaagcccggcgttggcacgtgagct

SEQ ID NO: 325527 - DNA, 25 bp, Mus musculus
agggcaatgactctcaggcacattc

SEQ ID NO: 325528 - DNA, 25 bp, Mus musculus
aggcacattctgtctggcacacata

SEQ ID NO: 325529 - DNA, 25 bp, Mus musculus
tgtctggcacacataattaagagta

SEQ ID NO: 325530 - DNA, 25 bp, Mus musculus
ggtggctctcaactgcctacaattc

SEQ ID NO: 325531 - DNA, 25 bp, Mus musculus
taggccatgcagtgaagttttattc

SEQ ID NO: 325532 - DNA, 25 bp, Mus musculus
cctacaattcctgctcctggacatg

SEQ ID NO: 325533 - DNA, 25 bp, Mus musculus
caggctctgggtctgatctctctca

SEQ ID NO: 325534 - DNA, 25 bp, Mus musculus
gcccacgaaggcgatcaggtttaga

SEQ ID NO: 325535 - DNA, 25 bp, Mus musculus
ccaagatggcgatgcaagcggctaa

SEQ ID NO: 325536 - DNA, 25 bp, Mus musculus
cggccttccgagcaaagttcagatt

SEQ ID NO: 325537 - DNA, 25 bp, Mus musculus
tccagagggatcttacggtaaccta

SEQ ID NO: 325538 - DNA, 25 bp, Mus musculus
tccggaagcgttctggagcttgcta

SEQ ID NO: 325539 - DNA, 25 bp, Mus musculus
atactctgtatctgacgccgtgtcg

SEQ ID NO: 325540 - DNA, 25 bp, Mus musculus
ccggcgctacctggctgtaaatact

SEQ ID NO: 325541 - DNA, 25 bp, Mus musculus
ttgctgtaaaagcttccggcgctac

SEQ ID NO: 325542 - DNA, 25 bp, Mus musculus
cggactttccggcattgctgtaaaa

SEQ ID NO: 325543 - DNA, 25 bp, Mus musculus
tcctaatttgagacgcggactttcc

SEQ ID NO: 325544 - DNA, 25 bp, Mus musculus
ccggcttgagaatgcgttctctgta

SEQ ID NO: 325545 - DNA, 25 bp, Mus musculus
cttgctagttcgctttccggcttga

SEQ ID NO: 325546 - DNA, 25 bp, Mus musculus
ggtaacctacatcagcccgccaaga

SEQ ID NO: 325547 - DNA, 25 bp, Mus musculus
caggcctggtatatggacgagtcca

SEQ ID NO: 325548 - DNA, 25 bp, Mus musculus
ccaccgttggggctccttcaagcaa

SEQ ID NO: 325549 - DNA, 25 bp, Mus musculus
tcgcgcgcgttcacagctagtgttt

SEQ ID NO: 325550 - DNA, 25 bp, Mus musculus
gccaccatggtgcaggcctggtata

SEQ ID NO: 325551 - DNA, 25 bp, Mus musculus
cacagctagtgtttgcaaacgcacg

SEQ ID NO: 325552 - DNA, 25 bp, Mus musculus
tatatggacgagtccaccgccgacc

SEQ ID NO: 325553 - DNA, 25 bp, Mus musculus
cgcacgctcggagtgctctattgga

SEQ ID NO: 325554 - DNA, 25 bp, Mus musculus
ctattggaaggtacgagtgcaggcc

SEQ ID NO: 325555 - DNA, 25 bp, Mus musculus
tagggtgctgcgcaagctcagcaag

SEQ ID NO: 325556 - DNA, 25 bp, Mus musculus
agcaaggccgccgtttccagagatt

SEQ ID NO: 325557 - DNA, 25 bp, Mus musculus
ccagagatttccataactgcagaga

SEQ ID NO: 325558 - DNA, 25 bp, Mus musculus
tggcgcctgctttcctcttggtact

SEQ ID NO: 325559 - DNA, 25 bp, Mus musculus
ctttcctcttggtactcgcgcgcgt

SEQ ID NO: 325560 - DNA, 25 bp, Mus musculus
cttccagccagttagtggaagccgc

SEQ ID NO: 325561 - DNA, 25 bp, Mus musculus
cctcgtggggctactctgcgtggcc

SEQ ID NO: 325562 - DNA, 25 bp, Mus musculus
acgccgccctctgtgggaaggtcaa

SEQ ID NO: 325563 - DNA, 25 bp, Mus musculus
ggcgaccctcctcactgcgacccgc

SEQ ID NO: 325564 - DNA, 25 bp, Mus musculus
gaggtcgggtcacccacaggcgaaa

SEQ ID NO: 325565 - DNA, 25 bp, Mus musculus
cacaggcgaaaagggtccgaagaga

SEQ ID NO: 325566 - DNA, 25 bp, Mus musculus
tccgaagagatgacggaagaccgga

SEQ ID NO: 325567 - DNA, 25 bp, Mus musculus
gaagaccggaagtaaactcaagatc

SEQ ID NO: 325568 - DNA, 25 bp, Mus musculus
agtaaactcaagatccaaggtcccg

SEQ ID NO: 325569 - DNA, 25 bp, Mus musculus
aagatccaaggtcccgcgcgtttgt

SEQ ID NO: 325570 - DNA, 25 bp, Mus musculus
cccgcgcgtttgtgcgtctgcgtgt

SEQ ID NO: 325571 - DNA, 25 bp, Mus musculus
gttgattacgcgaggacgccgccct

SEQ ID NO: 325572 - DNA, 25 bp, Mus musculus
tctccactggaagccgggcgcatat

SEQ ID NO: 325573 - DNA, 25 bp, Mus musculus
ggagccgctaagctctccactggaa

SEQ ID NO: 325574 - DNA, 25 bp, Mus musculus
cacatgctcagtttgggagccgcta

SEQ ID NO: 325575 - DNA, 25 bp, Mus musculus
cagagtatcatggaagacgacgccc

SEQ ID NO: 325576 - DNA, 25 bp, Mus musculus
ttgatgacgcgacgaagaaaacagg

SEQ ID NO: 325577 - DNA, 25 bp, Mus musculus
cgacgaagaaaacaggaagtgagcc

SEQ ID NO: 325578 - DNA, 25 bp, Mus musculus
aaaacaggaagtgagccgtcaggga

SEQ ID NO: 325579 - DNA, 25 bp, Mus musculus
cggtctgggtctcgtagtccatttt

SEQ ID NO: 325580 - DNA, 25 bp, Mus musculus
gtccatttttcaggcggggaatgaa

SEQ ID NO: 325581 - DNA, 25 bp, Mus musculus
aatgggttctgagcgatccctggtg

SEQ ID NO: 325582 - DNA, 25 bp, Mus musculus
aattccaggtgagcatggcggagtc

SEQ ID NO: 325583 - DNA, 25 bp, Mus musculus
agtagctgggtaggcagagtatcat

SEQ ID NO: 325584 - DNA, 25 bp, Mus musculus
gtgatttacgggctggaattccagg

SEQ ID NO: 325585 - DNA, 25 bp, Mus musculus
aggagcgtattgatgacgcgacgaa

SEQ ID NO: 325586 - DNA, 25 bp, Mus musculus
tctcgtagtccatttttcaggcggg

SEQ ID NO: 325587 - DNA, 25 bp, Mus musculus
ctcgagctctgaggcgtgagtagct

SEQ ID NO: 325588 - DNA, 25 bp, Mus musculus
ggaatgaatgggttctgagcgatcc

SEQ ID NO: 325589 - DNA, 25 bp, Mus musculus
aagccgctgcctgtgtttccgtacc

SEQ ID NO: 325590 - DNA, 25 bp, Mus musculus
gctgttcacgcgtgccagctcctgt

SEQ ID NO: 325591 - DNA, 25 bp, Mus musculus
cgcgccatctgccatggccgtgcgc

SEQ ID NO: 325592 - DNA, 25 bp, Mus musculus
gtgccagctcctgtccgcgccatct

SEQ ID NO: 325593 - DNA, 25 bp, Mus musculus
ctggcgctcctgctgtgctttgcct

SEQ ID NO: 325594 - DNA, 25 bp, Mus musculus
gcggagccacgcgcatgtgcacagc

SEQ ID NO: 325595 - DNA, 25 bp, Mus musculus
cgcctcgaagcaaggggcaggctgt

SEQ ID NO: 325596 - DNA, 25 bp, Mus musculus
ctgctgtgctttgcctggtgggcca

SEQ ID NO: 325597 - DNA, 25 bp, Mus musculus
ctgcctgtgtttccgtaccaccgtg

SEQ ID NO: 325598 - DNA, 25 bp, Mus musculus
cagacctccatcctgtgagtgcggc

SEQ ID NO: 325599 - DNA, 25 bp, Mus musculus
tgtttccgtaccaccgtgcgctgca

SEQ ID NO: 325600 - DNA, 25 bp, Mus musculus
taccaccgtgcgctgcatgcatctg

SEQ ID NO: 325601 - DNA, 25 bp, Mus musculus
tgcatgcatctgttgctggaggccg

SEQ ID NO: 325602 - DNA, 25 bp, Mus musculus
atctgttgctggaggccgtgcccgc

SEQ ID NO: 325603 - DNA, 25 bp, Mus musculus
tctgtgtaccctcgagagcagatca

SEQ ID NO: 325604 - DNA, 25 bp, Mus musculus
gcatgcatacgctgtggttccggga

SEQ ID NO: 325605 - DNA, 25 bp, Mus musculus
cagcttggcctgaccagcatgcata

SEQ ID NO: 325606 - DNA, 25 bp, Mus musculus
gaccaccgtgccaacgagcagcttg

SEQ ID NO: 325607 - DNA, 25 bp, Mus musculus
taccatgctttctggccggcgacca

SEQ ID NO: 325608 - DNA, 25 bp, Mus musculus
cgcgatgagaacgagagcccgatac

SEQ ID NO: 325609 - DNA, 25 bp, Mus musculus
cccactgagtgcatgcgcgatgaga

SEQ ID NO: 325610 - DNA, 25 bp, Mus musculus
cattgtgcagaggtctggcaagccc

SEQ ID NO: 325611 - DNA, 25 bp, Mus musculus
gaagcccgcagcatccgggacctgg

SEQ ID NO: 325612 - DNA, 25 bp, Mus musculus
catcgatgcctccaatgtgtacggc

SEQ ID NO: 325613 - DNA, 25 bp, Mus musculus
cgtccctgctcatgaactctgtgta

SEQ ID NO: 325614 - DNA, 25 bp, Mus musculus
ggcgcccgatgcatgttcttcgtgc

SEQ ID NO: 325615 - DNA, 25 bp, Mus musculus
tgtacggcagcacagaccacgaagc

SEQ ID NO: 325616 - DNA, 25 bp, Mus musculus
gcatgttcttcgtgcgatcgagccc

SEQ ID NO: 325617 - DNA, 25 bp, Mus musculus
gaatgcctgacccatcgcgtggacc

SEQ ID NO: 325618 - DNA, 25 bp, Mus musculus
tcgagtttcttcctgtccacgcgga

SEQ ID NO: 325619 - DNA, 25 bp, Mus musculus
tgcctaccttggagcatggcctcga

SEQ ID NO: 325620 - DNA, 25 bp, Mus musculus
ctgagagacgatcctgtggcggact

SEQ ID NO: 325621 - DNA, 25 bp, Mus musculus
cctcggatccgagcaagctgacaaa

SEQ ID NO: 325622 - DNA, 25 bp, Mus musculus
aacttcggagctgcagcacaaactc

SEQ ID NO: 325623 - DNA, 25 bp, Mus musculus
ccgcggtcctaacagcaacttcgga

SEQ ID NO: 325624 - DNA, 25 bp, Mus musculus
gcccagatgtcccagctgcagctgg

SEQ ID NO: 325625 - DNA, 25 bp, Mus musculus
cgtagtgtaaggatgccacggccca

SEQ ID NO: 325626 - DNA, 25 bp, Mus musculus
cacactgggcggtcccgtagtgtaa

SEQ ID NO: 325627 - DNA, 25 bp, Mus musculus
agccgggcaaagtcccgcacactgg

SEQ ID NO: 325628 - DNA, 25 bp, Mus musculus
cttttccaggcgacgagagcaggcc

SEQ ID NO: 325629 - DNA, 25 bp, Mus musculus
ttgacatctgcagcgcttttccagg

SEQ ID NO: 325630 - DNA, 25 bp, Mus musculus
cccagctgaagccttgacatctgca

SEQ ID NO: 325631 - DNA, 25 bp, Mus musculus
ctactactctgctcaccgcccacca

SEQ ID NO: 325632 - DNA, 25 bp, Mus musculus
cccgcccattaccatcaagccacgc

SEQ ID NO: 325633 - DNA, 25 bp, Mus musculus
agcaagcagggcaggcacggaaccc

SEQ ID NO: 325634 - DNA, 25 bp, Mus musculus
agcagccactgcgctagcaagcagg

SEQ ID NO: 325635 - DNA, 25 bp, Mus musculus
agccagcagccactgcgctagcaag

SEQ ID NO: 325636 - DNA, 25 bp, Mus musculus
acagagccagcagccactgcgctag

SEQ ID NO: 325637 - DNA, 25 bp, Mus musculus
ggagctcctaagtccagcgccagca

SEQ ID NO: 325638 - DNA, 25 bp, Mus musculus
cgcccacgcggctaggcgtgcgctt

SEQ ID NO: 325639 - DNA, 25 bp, Mus musculus
ctcggcgctcatcgccgcccacgcg

SEQ ID NO: 325640 - DNA, 25 bp, Mus musculus
agggactgcgatccctcggcgctca

SEQ ID NO: 325641 - DNA, 25 bp, Mus musculus
ccagtaggtgactaggacgcccgcg

SEQ ID NO: 325642 - DNA, 25 bp, Mus musculus
gcaccagtaggtgactaggacgccc

SEQ ID NO: 325643 - DNA, 25 bp, Mus musculus
gggctccggagctcctaagtccagc

SEQ ID NO: 325644 - DNA, 25 bp, Mus musculus
aagccacgcctcatgcccggtaacc

SEQ ID NO: 325645 - DNA, 25 bp, Mus musculus
atccctggcgcgatgtcgtccgcat

SEQ ID NO: 325646 - DNA, 25 bp, Mus musculus
cgcgagaagagccaagcgccaggtt

SEQ ID NO: 325647 - DNA, 25 bp, Mus musculus
agcgccaggttcgtacccgtagatc

SEQ ID NO: 325648 - DNA, 25 bp, Mus musculus
cgtacccgtagatctcgcgagaagt

SEQ ID NO: 325649 - DNA, 25 bp, Mus musculus
tcgcgagaagtctaagcgcctttcc

SEQ ID NO: 325650 - DNA, 25 bp, Mus musculus
aagctgcggactcgtcccggctgtt

SEQ ID NO: 325651 - DNA, 25 bp, Mus musculus
tggggtttgctagttcttgcgagaa

SEQ ID NO: 325652 - DNA, 25 bp, Mus musculus
tgtcgtccgcatactcagtccgatc

SEQ ID NO: 325653 - DNA, 25 bp, Mus musculus
ttcccagtcagcatccctgcggtga

SEQ ID NO: 325654 - DNA, 25 bp, Mus musculus
ccctgcggtgatcatggtaactcgc

SEQ ID NO: 325655 - DNA, 25 bp, Mus musculus
tggtaactcgcaggctctaagtggc

SEQ ID NO: 325656 - DNA, 25 bp, Mus musculus
caggctctaagtggcgccggcgttt

SEQ ID NO: 325657 - DNA, 25 bp, Mus musculus
ctccctgctccgctggatggggcag

SEQ ID NO: 325658 - DNA, 25 bp, Mus musculus
cgcctttcccggctgtcggaagctg

SEQ ID NO: 325659 - DNA, 25 bp, Mus musculus
cccgtaggagctgcgcgtcctgtgt

SEQ ID NO: 325660 - DNA, 25 bp, Mus musculus
tcaagtccagggctgcccatctgct

SEQ ID NO: 325661 - DNA, 25 bp, Mus musculus
ggcgctccgtggttctaattaaagc

SEQ ID NO: 325662 - DNA, 25 bp, Mus musculus
ggttctaattaaagcggcgctcgga

SEQ ID NO: 325663 - DNA, 25 bp, Mus musculus
cgggaataagaagcgcccgaggaca

SEQ ID NO: 325664 - DNA, 25 bp, Mus musculus
cctggactccgcgtgcgggaaactt

SEQ ID NO: 325665 - DNA, 25 bp, Mus musculus
gggctggagctcatcaagtagtgtc

SEQ ID NO: 325666 - DNA, 25 bp, Mus musculus
ctcatcaagtagtgtcgggactggg

SEQ ID NO: 325667 - DNA, 25 bp, Mus musculus
ggacctctggtgatcaggtgcccga

SEQ ID NO: 325668 - DNA, 25 bp, Mus musculus
aggtgcccggacctctcaagtccag

SEQ ID NO: 325669 - DNA, 25 bp, Mus musculus
cacctgtggcctcgcatctcaaaga

SEQ ID NO: 325670 - DNA, 25 bp, Mus musculus
atctcaaagaggtgtccaaagaccc

SEQ ID NO: 325671 - DNA, 25 bp, Mus musculus
cgtcctgtgtccctgcgctggacaa

SEQ ID NO: 325672 - DNA, 25 bp, Mus musculus
tgcccgaggacgacgcgggatccac

SEQ ID NO: 325673 - DNA, 25 bp, Mus musculus
cgctttggcaaaaacagggcataca

SEQ ID NO: 325674 - DNA, 25 bp, Mus musculus
gctttcctcttcctggactggagtg

SEQ ID NO: 325675 - DNA, 25 bp, Mus musculus
gaacagcactgacttggacccaacc

SEQ ID NO: 325676 - DNA, 25 bp, Mus musculus
ggcatacacctattcccttacctgg

SEQ ID NO: 325677 - DNA, 25 bp, Mus musculus
gcggcaactcttcctcttgcgatgg

SEQ ID NO: 325678 - DNA, 25 bp, Mus musculus
acgcagatgagctacgttctgagca

SEQ ID NO: 325679 - DNA, 25 bp, Mus musculus
gccacggtacttagcagtgggtttc

SEQ ID NO: 325680 - DNA, 25 bp, Mus musculus
tgtgccagggcagccaatgaactca

SEQ ID NO: 325681 - DNA, 25 bp, Mus musculus
cccaggtcgcacgtctaaggagtga

SEQ ID NO: 325682 - DNA, 25 bp, Mus musculus
ggctagcgttcactctgagctctgc

SEQ ID NO: 325683 - DNA, 25 bp, Mus musculus
cactgccagggttctgaccgtggac

SEQ ID NO: 325684 - DNA, 25 bp, Mus musculus
tgccatgtttcggtgcagaccctgg

SEQ ID NO: 325685 - DNA, 25 bp, Mus musculus
ggcgagtccttaccgagacacacga

SEQ ID NO: 325686 - DNA, 25 bp, Mus musculus
gcggaccaaggagaacgctttcctc

SEQ ID NO: 325687 - DNA, 25 bp, Mus musculus
ccttgcggacttcggaacggactcg

SEQ ID NO: 325688 - DNA, 25 bp, Mus musculus
acaccagcctggtgggttcgagtcc

SEQ ID NO: 325689 - DNA, 25 bp, Mus musculus
ttcgagtcctgcaagaatgcgcgcc

SEQ ID NO: 325690 - DNA, 25 bp, Mus musculus
ccgaccctggactcgcttgctagaa

SEQ ID NO: 325691 - DNA, 25 bp, Mus musculus
gcttgctagaatgcggccacctctc

SEQ ID NO: 325692 - DNA, 25 bp, Mus musculus
cgaacaagagcgctgtggagagact

SEQ ID NO: 325693 - DNA, 25 bp, Mus musculus
gcggaccgcgccaagtatgttcgca

SEQ ID NO: 325694 - DNA, 25 bp, Mus musculus
gttcgcagcacgctgggatctagcc

SEQ ID NO: 325695 - DNA, 25 bp, Mus musculus
tagccggggtcctgtatctgaacac

SEQ ID NO: 325696 - DNA, 25 bp, Mus musculus
tcctgtagcacgcagggctatcgct

SEQ ID NO: 325697 - DNA, 25 bp, Mus musculus
ggcgccggaacttaagtagtctcta

SEQ ID NO: 325698 - DNA, 25 bp, Mus musculus
cgttggtcatctatcggcagaaatg

SEQ ID NO: 325699 - DNA, 25 bp, Mus musculus
aagcctctgagacctgattcgttgg

SEQ ID NO: 325700 - DNA, 25 bp, Mus musculus
ggctatcgctcgaaagcctctgaga

SEQ ID NO: 325701 - DNA, 25 bp, Mus musculus
ggagccacctcggaatcagatccca

SEQ ID NO: 325702 - DNA, 25 bp, Mus musculus
aagcgaccctgacgtggctgctccg

SEQ ID NO: 325703 - DNA, 25 bp, Mus musculus
agcccgagggaagcgaccctgacgt

SEQ ID NO: 325704 - DNA, 25 bp, Mus musculus
gctcgccttcttgccgccactgcag

SEQ ID NO: 325705 - DNA, 25 bp, Mus musculus
cccgcaggcactcccgctcgccttc

SEQ ID NO: 325706 - DNA, 25 bp, Mus musculus
tccacgcccatcacggtcccacagg

SEQ ID NO: 325707 - DNA, 25 bp, Mus musculus
ggaatcagatcccagcccgcggact

SEQ ID NO: 325708 - DNA, 25 bp, Mus musculus
tgtcgcccgcatctttgaccctctc

SEQ ID NO: 325709 - DNA, 25 bp, Mus musculus
tcggggaaggaggtctcctcctgtc

SEQ ID NO: 325710 - DNA, 25 bp, Mus musculus
cctctgaaacccacaagaatcgggg

SEQ ID NO: 325711 - DNA, 25 bp, Mus musculus
cagaatgggatggtgcgttgtcctc

SEQ ID NO: 325712 - DNA, 25 bp, Mus musculus
caagaatcggggaaggaggtctcct

SEQ ID NO: 325713 - DNA, 25 bp, Mus musculus
cccggtaccgtctcctggggagatg

SEQ ID NO: 325714 - DNA, 25 bp, Mus musculus
ggtgcgttgtcctctgaaacccaca

SEQ ID NO: 325715 - DNA, 25 bp, Mus musculus
ctttgctggaatggcgaagcgttga

SEQ ID NO: 325716 - DNA, 25 bp, Mus musculus
ttcgacttgggaacagattggagcc

SEQ ID NO: 325717 - DNA, 25 bp, Mus musculus
gcgttgaagccactacagagacaca

SEQ ID NO: 325718 - DNA, 25 bp, Mus musculus
tctcggggtggcaccatgaacagtt

SEQ ID NO: 325719 - DNA, 25 bp, Mus musculus
aaccatccttgtttgtctcggggtg

SEQ ID NO: 325720 - DNA, 25 bp, Mus musculus
aaatgacgccgtgagatcgccaccg

SEQ ID NO: 325721 - DNA, 25 bp, Mus musculus
tcgctccagggctttgcacctttta

SEQ ID NO: 325722 - DNA, 25 bp, Mus musculus
gcaggtttccgaggtgatcgctcca

SEQ ID NO: 325723 - DNA, 25 bp, Mus musculus
ttacgcacaaaagtgtcggggccca

SEQ ID NO: 325724 - DNA, 25 bp, Mus musculus
gcatccactgggttctgcgcacaga

SEQ ID NO: 325725 - DNA, 25 bp, Mus musculus
tcgcctttggtgtcctaggtaactc

SEQ ID NO: 325726 - DNA, 25 bp, Mus musculus
cccgctacctctccagaaaggaaga

SEQ ID NO: 325727 - DNA, 25 bp, Mus musculus
cgctctccatgtgcgcatgagcaga

SEQ ID NO: 325728 - DNA, 25 bp, Mus musculus
acaccagtcgtctctagctcagggc

SEQ ID NO: 325729 - DNA, 25 bp, Mus musculus
agaggctttccggtcgcttcgtcgt

SEQ ID NO: 325730 - DNA, 25 bp, Mus musculus
gccagtcgggcctcaaggttacttc

SEQ ID NO: 325731 - DNA, 25 bp, Mus musculus
gcgtggcaagggtcatttactcctc

SEQ ID NO: 325732 - DNA, 25 bp, Mus musculus
tggtaagacttatccaaggtctccc

SEQ ID NO: 325733 - DNA, 25 bp, Mus musculus
cgggcagtcattccgcagcagggcc

SEQ ID NO: 325734 - DNA, 25 bp, Mus musculus
cccacagcgggcgtctaagtgcctg

SEQ ID NO: 325735 - DNA, 25 bp, Mus musculus
taagtgcctgtggtccagcatcatc

SEQ ID NO: 325736 - DNA, 25 bp, Mus musculus
cccgggtcattaggatgaggcgaaa

SEQ ID NO: 325737 - DNA, 25 bp, Mus musculus
tccgctgaacgcctggtaagactta

SEQ ID NO: 325738 - DNA, 25 bp, Mus musculus
caccttggccaaggagcggtacaca

SEQ ID NO: 325739 - DNA, 25 bp, Mus musculus
caggggttttcacctccgctgaacg

SEQ ID NO: 325740 - DNA, 25 bp, Mus musculus
agcggtacacacgactccagctctg

SEQ ID NO: 325741 - DNA, 25 bp, Mus musculus
gcaacatatacgtcatcgccgagga

SEQ ID NO: 325742 - DNA, 25 bp, Mus musculus
cgattggcccgaaaggcagaggctt

SEQ ID NO: 325743 - DNA, 25 bp, Mus musculus
ccctcagctgtaggaatgatacttc

SEQ ID NO: 325744 - DNA, 25 bp, Mus musculus
aagtgcgcccgaactgctctcacgg

SEQ ID NO: 325745 - DNA, 25 bp, Mus musculus
tgtaaacacgcacgctccgtgggtg

SEQ ID NO: 325746 - DNA, 25 bp, Mus musculus
cgccgggtgtagagaagtgtaaaca

SEQ ID NO: 325747 - DNA, 25 bp, Mus musculus
aaccacaggcggtgaccactgcagc

SEQ ID NO: 325748 - DNA, 25 bp, Mus musculus
tcgcagtgagaaagcaataggaacc

SEQ ID NO: 325749 - DNA, 25 bp, Mus musculus
aagtcagtcgctccggagtcgcagt

SEQ ID NO: 325750 - DNA, 25 bp, Mus musculus
ctccggcgaaggagtcagacatagc

SEQ ID NO: 325751 - DNA, 25 bp, Mus musculus
cgcctccttaccagtgtgatccatg

SEQ ID NO: 325752 - DNA, 25 bp, Mus musculus
ctttccaacaagtctgcgcggagga

SEQ ID NO: 325753 - DNA, 25 bp, Mus musculus
ccgagagtggaaaacgcccgcctat

SEQ ID NO: 325754 - DNA, 25 bp, Mus musculus
ggacgcttctccaattccgagagtg

SEQ ID NO: 325755 - DNA, 25 bp, Mus musculus
ggcagcaggaagtctccaacccact

SEQ ID NO: 325756 - DNA, 25 bp, Mus musculus
ttgtagtccgcccagagcgcagtct

SEQ ID NO: 325757 - DNA, 25 bp, Mus musculus
tcactcgatcggagacacagctcca

SEQ ID NO: 325758 - DNA, 25 bp, Mus musculus
gcgacaccgtgtaactgcagctgta

SEQ ID NO: 325759 - DNA, 25 bp, Mus musculus
ttcggaaacgcggagcgagcaaacg

SEQ ID NO: 325760 - DNA, 25 bp, Mus musculus
cggcgctggcaacaaactgtccctg

SEQ ID NO: 325761 - DNA, 25 bp, Mus musculus
tccctgggcaattcagggcgctgtc

SEQ ID NO: 325762 - DNA, 25 bp, Mus musculus
cctgtggcagcgacttcggaaagcc

SEQ ID NO: 325763 - DNA, 25 bp, Mus musculus
gctgcagcagggcagtcccatttaa

SEQ ID NO: 325764 - DNA, 25 bp, Mus musculus
ccatttaaggacaggtgcgagtttc

SEQ ID NO: 325765 - DNA, 25 bp, Mus musculus
cggtctgacccttagcttcctcttg

SEQ ID NO: 325766 - DNA, 25 bp, Mus musculus
gtctcgctttttctggtgtctgtcc

SEQ ID NO: 325767 - DNA, 25 bp, Mus musculus
gcctgaccagtaccttccctagaga

SEQ ID NO: 325768 - DNA, 25 bp, Mus musculus
ttccctagagagttacgacagagcg

SEQ ID NO: 325769 - DNA, 25 bp, Mus musculus
ggactgcagtctcccgtaccagata

SEQ ID NO: 325770 - DNA, 25 bp, Mus musculus
ccacctgcaggacggtacccgagga

SEQ ID NO: 325771 - DNA, 25 bp, Mus musculus
agcgtcccgactggtcctgcgcgtt

SEQ ID NO: 325772 - DNA, 25 bp, Mus musculus
cggggaaaagagagaggcacaacca

SEQ ID NO: 325773 - DNA, 25 bp, Mus musculus
catgcgcagaggtgctttttgaagc

SEQ ID NO: 325774 - DNA, 25 bp, Mus musculus
ttccggcctgggtgccaggcttcac

SEQ ID NO: 325775 - DNA, 25 bp, Mus musculus
gcatgcgcaactcccgcaggtgagt

SEQ ID NO: 325776 - DNA, 25 bp, Mus musculus
ctctgcgcgtcagggaaactccgag

SEQ ID NO: 325777 - DNA, 25 bp, Mus musculus
tgcatttgctaaagccacgggaggc

SEQ ID NO: 325778 - DNA, 25 bp, Mus musculus
aaactccgagggctcctgcgcagct

SEQ ID NO: 325779 - DNA, 25 bp, Mus musculus
ttgctgcccacgcttgcgtgctgag

SEQ ID NO: 325780 - DNA, 25 bp, Mus musculus
tgaggccctgtcacgagctgtccct

SEQ ID NO: 325781 - DNA, 25 bp, Mus musculus
ctccggctccttcttcgaggataac

SEQ ID NO: 325782 - DNA, 25 bp, Mus musculus
gaggcacaaccaccgcgagacttaa

SEQ ID NO: 325783 - DNA, 25 bp, Mus musculus
cgaggataacttgccttgcaggctg

SEQ ID NO: 325784 - DNA, 25 bp, Mus musculus
ctccgggatccggagtgatcggccc

SEQ ID NO: 325785 - DNA, 25 bp, Mus musculus
tgaggtcacactggcgcgaccgcgc

SEQ ID NO: 325786 - DNA, 25 bp, Mus musculus
agttcgcctaactccgggtgacgag

SEQ ID NO: 325787 - DNA, 25 bp, Mus musculus
ggcctgccgggagttcgcctaactc

SEQ ID NO: 325788 - DNA, 25 bp, Mus musculus
cgcggcccttgtttcctggtgcgcg

SEQ ID NO: 325789 - DNA, 25 bp, Mus musculus
ctaactccgggtgacgaggcagtgc

SEQ ID NO: 325790 - DNA, 25 bp, Mus musculus
aggctcctccacgtgggctcggtat

SEQ ID NO: 325791 - DNA, 25 bp, Mus musculus
cgcgcacgtcccacgccgccgggag

SEQ ID NO: 325792 - DNA, 25 bp, Mus musculus
ccttgtttcctggtgcgcggcgtga

SEQ ID NO: 325793 - DNA, 25 bp, Mus musculus
tcggtatccccggagggctgatccc

SEQ ID NO: 325794 - DNA, 25 bp, Mus musculus
gctgaggtcacactggcgcgaccgc

SEQ ID NO: 325795 - DNA, 25 bp, Mus musculus
cccgatgcggctgatgccggatgac

SEQ ID NO: 325796 - DNA, 25 bp, Mus musculus
cccgtcaggcttacccgccgccgat

SEQ ID NO: 325797 - DNA, 25 bp, Mus musculus
cgagccgccggacgcgaggtcagca

SEQ ID NO: 325798 - DNA, 25 bp, Mus musculus
tggctcgggccgcagaacgccgcgg

SEQ ID NO: 325799 - DNA, 25 bp, Mus musculus
ctgccttgcgcagagtccgagaatc

SEQ ID NO: 325800 - DNA, 25 bp, Mus musculus
tggaaggtggagacagcacaatttc

SEQ ID NO: 325801 - DNA, 25 bp, Mus musculus
ccggcacttgccaacatggaaggtg

SEQ ID NO: 325802 - DNA, 25 bp, Mus musculus
cggggcgattgcaagacgtcatcaa

SEQ ID NO: 325803 - DNA, 25 bp, Mus musculus
gcgccttgattctgcgtcacttgga

SEQ ID NO: 325804 - DNA, 25 bp, Mus musculus
gcacaatttccgtagcaggccgtgg

SEQ ID NO: 325805 - DNA, 25 bp, Mus musculus
tttgcactggatcatgatgcgcccg

SEQ ID NO: 325806 - DNA, 25 bp, Mus musculus
ctgtctttccttgcacgtaggattg

SEQ ID NO: 325807 - DNA, 25 bp, Mus musculus
ccgggacatcgctgtagttcctgca

SEQ ID NO: 325808 - DNA, 25 bp, Mus musculus
cgccggagttctcaggcccaatact

SEQ ID NO: 325809 - DNA, 25 bp, Mus musculus
tgtagtacttaggttcccaaacgca

SEQ ID NO: 325810 - DNA, 25 bp, Mus musculus
tcctctcttcccgtgggtgtcttgg

SEQ ID NO: 325811 - DNA, 25 bp, Mus musculus
tccgagaatcctaccggtcactttg

SEQ ID NO: 325812 - DNA, 25 bp, Mus musculus
tgtcttggggaaaacacctggtgtc

SEQ ID NO: 325813 - DNA, 25 bp, Mus musculus
cgcgtttactcctcagccgaaactt

SEQ ID NO: 325814 - DNA, 25 bp, Mus musculus
attcgaactgcgtaacaatgagccc

SEQ ID NO: 325815 - DNA, 25 bp, Mus musculus
cctttctcgtctttaattggtctga

SEQ ID NO: 325816 - DNA, 25 bp, Mus musculus
ttccgcgcaggggatccagtgccca

SEQ ID NO: 325817 - DNA, 25 bp, Mus musculus
tccagtgcccagagtcccaagggtc

SEQ ID NO: 325818 - DNA, 25 bp, Mus musculus
agagtcccaagggtctccgctctcg

SEQ ID NO: 325819 - DNA, 25 bp, Mus musculus
cctcggagcccattcattcgaactg

SEQ ID NO: 325820 - DNA, 25 bp, Mus musculus
tctgtcgcgacagcgtcgccagctg

SEQ ID NO: 325821 - DNA, 25 bp, Mus musculus
gcctggacgccaggcttgtttttcc

SEQ ID NO: 325822 - DNA, 25 bp, Mus musculus
accaagtctttcaagcttcgtcttc

SEQ ID NO: 325823 - DNA, 25 bp, Mus musculus
gggctgagccttcgtccacctttct

SEQ ID NO: 325824 - DNA, 25 bp, Mus musculus
tgttttgtttaaatcggcctgcaga

SEQ ID NO: 325825 - DNA, 25 bp, Mus musculus
ctcagcgccgggagcacgcgaaagc

SEQ ID NO: 325826 - DNA, 25 bp, Mus musculus
cgaccacacagagtcaggacgcagg

SEQ ID NO: 325827 - DNA, 25 bp, Mus musculus
gatctcgatgctcatcctgcccgtg

SEQ ID NO: 325828 - DNA, 25 bp, Mus musculus
ccgcggggatctcgatgctcatcct

SEQ ID NO: 325829 - DNA, 25 bp, Mus musculus
cgccgttctcggagtcggagcgcat

SEQ ID NO: 325830 - DNA, 25 bp, Mus musculus
agcgcatgggctcctcggcgaagtt

SEQ ID NO: 325831 - DNA, 25 bp, Mus musculus
ctcctcggcgaagttgacaccctta

SEQ ID NO: 325832 - DNA, 25 bp, Mus musculus
tcggcgaagttgacacccttactgg

SEQ ID NO: 325833 - DNA, 25 bp, Mus musculus
tgacacccttactggggatgccgcc

SEQ ID NO: 325834 - DNA, 25 bp, Mus musculus
aggtcctgccctcatggccgaagcg

SEQ ID NO: 325835 - DNA, 25 bp, Mus musculus
ccttgcgctcgttctcctgctgcag

SEQ ID NO: 325836 - DNA, 25 bp, Mus musculus
tgctgcagccgcgtgaagtgctgca

SEQ ID NO: 325837 - DNA, 25 bp, Mus musculus
tgaagtgctgcagcgcgaactccag

SEQ ID NO: 325838 - DNA, 25 bp, Mus musculus
gcagcgcgaactccagcaggtcggc

SEQ ID NO: 325839 - DNA, 25 bp, Mus musculus
tcagcacctccaccgtgaagccctg

SEQ ID NO: 325840 - DNA, 25 bp, Mus musculus
ctcctcgccgttctcggagtcggag

SEQ ID NO: 325841 - DNA, 25 bp, Mus musculus
tgcatagatcggtacagaacgactc

SEQ ID NO: 325842 - DNA, 25 bp, Mus musculus
ggtgcactttatgcgcgaactaggc

SEQ ID NO: 325843 - DNA, 25 bp, Mus musculus
cgactctgatgcacacagagcgtta

SEQ ID NO: 325844 - DNA, 25 bp, Mus musculus
cagagcgttaagagctgcgagcgca

SEQ ID NO: 325845 - DNA, 25 bp, Mus musculus
ccgctgaagagaaaggtggtgtact

SEQ ID NO: 325846 - DNA, 25 bp, Mus musculus
ggtgtactagcggtcgcaactgtcg

SEQ ID NO: 325847 - DNA, 25 bp, Mus musculus
cgcaactgtcgctggccggaagcac

SEQ ID NO: 325848 - DNA, 25 bp, Mus musculus
ttcaagctcttcatgcccagcagca

SEQ ID NO: 325849 - DNA, 25 bp, Mus musculus
ccagcagcacggagttcatgagctc

SEQ ID NO: 325850 - DNA, 25 bp, Mus musculus
aagcggagctctggagcttcctctg

SEQ ID NO: 325851 - DNA, 25 bp, Mus musculus
acatcctgcgcagcaaggacgtcta

SEQ ID NO: 325852 - DNA, 25 bp, Mus musculus
ggacgtctacggctactcctcgtgc

SEQ ID NO: 325853 - DNA, 25 bp, Mus musculus
tccgcgcgctggaacggacttatgt

SEQ ID NO: 325854 - DNA, 25 bp, Mus musculus
tcagtcgaatgtttacagaaccggc

SEQ ID NO: 325855 - DNA, 25 bp, Mus musculus
agattccatccatcgtccaagcggg

SEQ ID NO: 325856 - DNA, 25 bp, Mus musculus
accgactcgtacaaggtggagttgc

SEQ ID NO: 325857 - DNA, 25 bp, Mus musculus
agttcaacatcctgctggccaccga

SEQ ID NO: 325858 - DNA, 25 bp, Mus musculus
gcggcagaagccgagttcaacatcc

SEQ ID NO: 325859 - DNA, 25 bp, Mus musculus
ccggcccgagatgaatgctgcggca

SEQ ID NO: 325860 - DNA, 25 bp, Mus musculus
atttttctccttgctcgcagccgcg

SEQ ID NO: 325861 - DNA, 25 bp, Mus musculus
ggagcgcagcgaagcccatttttct

SEQ ID NO: 325862 - DNA, 25 bp, Mus musculus
cgagcggtgacttaagcaacggagc

SEQ ID NO: 325863 - DNA, 25 bp, Mus musculus
agactctcaggacgagcagggactg

SEQ ID NO: 325864 - DNA, 25 bp, Mus musculus
gcgtgactccaacaagactctcagg

SEQ ID NO: 325865 - DNA, 25 bp, Mus musculus
gccttagctggtggcgtgactccaa

SEQ ID NO: 325866 - DNA, 25 bp, Mus musculus
tggggaccaaagattccatccatcg

SEQ ID NO: 325867 - DNA, 25 bp, Mus musculus
tccaagcgggagacaaaggtaattc

SEQ ID NO: 325868 - DNA, 25 bp, Mus musculus
caaaggtaattcagcgcgtgcggga

SEQ ID NO: 325869 - DNA, 25 bp, Mus musculus
tcccgtggctgttaagctccgactg

SEQ ID NO: 325870 - DNA, 25 bp, Mus musculus
ggtccatggggcaccgacatcccgt

SEQ ID NO: 325871 - DNA, 25 bp, Mus musculus
ctcctgggtgtgaggctctgcgaca

SEQ ID NO: 325872 - DNA, 25 bp, Mus musculus
tgacgctcaccgagcctggctcctg

SEQ ID NO: 325873 - DNA, 25 bp, Mus musculus
tccctcttcccaccctgacgctcac

SEQ ID NO: 325874 - DNA, 25 bp, Mus musculus
gacatcccgtggctgttaagctccg

SEQ ID NO: 325875 - DNA, 25 bp, Mus musculus
gtggctgttaagctccgactgctgc

SEQ ID NO: 325876 - DNA, 25 bp, Mus musculus
gttaagctccgactgctgccgcagc

SEQ ID NO: 325877 - DNA, 25 bp, Mus musculus
gctgccgcagcgcagtcactatcgg

SEQ ID NO: 325878 - DNA, 25 bp, Mus musculus
ccgcagcgcagtcactatcgggagg

SEQ ID NO: 325879 - DNA, 25 bp, Mus musculus
ccctccgggagctctagtagccgcg

SEQ ID NO: 325880 - DNA, 25 bp, Mus musculus
caccgacatcccgtggctgttaagc

SEQ ID NO: 325881 - DNA, 25 bp, Mus musculus
caagtgggcgtggtcccattgtgca

SEQ ID NO: 325882 - DNA, 25 bp, Mus musculus
ctatcgggagggtggatctggccaa

SEQ ID NO: 325883 - DNA, 25 bp, Mus musculus
ttcatcaagatcctcgagtgggtga

SEQ ID NO: 325884 - DNA, 25 bp, Mus musculus
gacgcattaaattgtcggcccattt

SEQ ID NO: 325885 - DNA, 25 bp, Mus musculus
ccatttaacgcctggcctggacgtc

SEQ ID NO: 325886 - DNA, 25 bp, Mus musculus
tttccctcagaggatgtccgccttc

SEQ ID NO: 325887 - DNA, 25 bp, Mus musculus
ggatttcctgctgcggtccaactga

SEQ ID NO: 325888 - DNA, 25 bp, Mus musculus
gagccgctcggcttcatcaagatcc

SEQ ID NO: 325889 - DNA, 25 bp, Mus musculus
ggcgtggaagctcgctcgctttttt

SEQ ID NO: 325890 - DNA, 25 bp, Mus musculus
catccgcaaaggaagacaggatttc

SEQ ID NO: 325891 - DNA, 25 bp, Mus musculus
atgggctcctgttaaaaatagtgtg

SEQ ID NO: 325892 - DNA, 25 bp, Mus musculus
tcagagaagccgaggcaaagccctt

SEQ ID NO: 325893 - DNA, 25 bp, Mus musculus
gcgcggcacacgcatggcttccaaa

SEQ ID NO: 325894 - DNA, 25 bp, Mus musculus
cgcgttagagacagagctaggcttt

SEQ ID NO: 325895 - DNA, 25 bp, Mus musculus
tcgcaaaggccggaaaagagtctgg

SEQ ID NO: 325896 - DNA, 25 bp, Mus musculus
agccaacatggttcgtcagcggttc

SEQ ID NO: 325897 - DNA, 25 bp, Mus musculus
ctgctgctgccgaaggaacagggaa

SEQ ID NO: 325898 - DNA, 25 bp, Mus musculus
agcaatggcgacactgcaccgcaaa

SEQ ID NO: 325899 - DNA, 25 bp, Mus musculus
tgacgtcggagcgttctcgaatccc

SEQ ID NO: 325900 - DNA, 25 bp, Mus musculus
gcaaaccctggtcctcctggatcga

SEQ ID NO: 325901 - DNA, 25 bp, Mus musculus
tgcaccgcaaagtgcccagtccgga

SEQ ID NO: 325902 - DNA, 25 bp, Mus musculus
ctaagcctccgggatccttctggga

SEQ ID NO: 325903 - DNA, 25 bp, Mus musculus
cgaatcccgtgtctctcggctgctg

SEQ ID NO: 325904 - DNA, 25 bp, Mus musculus
tcggaacgttccgaagatgacgtcg

SEQ ID NO: 325905 - DNA, 25 bp, Mus musculus
tcagaacactcaatgtcggaacgtt

SEQ ID NO: 325906 - DNA, 25 bp, Mus musculus
cggcgactggacgaaagaacctgtg

SEQ ID NO: 325907 - DNA, 25 bp, Mus musculus
aactttcggtcctccagcggcgact

SEQ ID NO: 325908 - DNA, 25 bp, Mus musculus
gagacttgcagcgagcaaaactttc

SEQ ID NO: 325909 - DNA, 25 bp, Mus musculus
ggatccttctgggacgtcgcatggt

SEQ ID NO: 325910 - DNA, 25 bp, Mus musculus
cagtccggaggcgtttctgggcaaa

SEQ ID NO: 325911 - DNA, 25 bp, Mus musculus
cggcgtctaccgtcgccttcggcgc

SEQ ID NO: 325912 - DNA, 25 bp, Mus musculus
ctactccgagaggtaagatgtcgcc

SEQ ID NO: 325913 - DNA, 25 bp, Mus musculus
ggtcggtcgccttttgatgatgtca

SEQ ID NO: 325914 - DNA, 25 bp, Mus musculus
gtcagccatcatcaacactcagagg

SEQ ID NO: 325915 - DNA, 25 bp, Mus musculus
atcaacactcagaggtgaggcggga

SEQ ID NO: 325916 - DNA, 25 bp, Mus musculus
ggaggaatgcttgcgtcatccgtgc

SEQ ID NO: 325917 - DNA, 25 bp, Mus musculus
gccgctattcgtgcttggtggctgc

SEQ ID NO: 325918 - DNA, 25 bp, Mus musculus
agaggtaagatgtcgccgcgtcctc

SEQ ID NO: 325919 - DNA, 25 bp, Mus musculus
agatgtcgccgcgtcctcccgggag

SEQ ID NO: 325920 - DNA, 25 bp, Mus musculus
ggccaacgggccctcagctccgtaa

SEQ ID NO: 325921 - DNA, 25 bp, Mus musculus
cacggcgccgcggaagtaaagtcgc

SEQ ID NO: 325922 - DNA, 25 bp, Mus musculus
cgcggaagtaaagtcgcacgagctt

SEQ ID NO: 325923 - DNA, 25 bp, Mus musculus
gcacgagcttcgtgaaccttagccc

SEQ ID NO: 325924 - DNA, 25 bp, Mus musculus
agtcgcacgagcttcgtgaacctta

SEQ ID NO: 325925 - DNA, 25 bp, Mus musculus
agcgccctaggcgccgaaaggtaga

SEQ ID NO: 325926 - DNA, 25 bp, Mus musculus
acggtgcctatggactgccacacta

SEQ ID NO: 325927 - DNA, 25 bp, Mus musculus
tatggactgccacactaccagcgtg

SEQ ID NO: 325928 - DNA, 25 bp, Mus musculus
cgtctcacgcaatacggtgcctatg

SEQ ID NO: 325929 - DNA, 25 bp, Mus musculus
gccgtccggttcgtctcacgcaata

SEQ ID NO: 325930 - DNA, 25 bp, Mus musculus
ccgacgaatgatggcccggcgccgt

SEQ ID NO: 325931 - DNA, 25 bp, Mus musculus
agcgccatcgctcgggccgacgaat

SEQ ID NO: 325932 - DNA, 25 bp, Mus musculus
gtgcttttagcacgctccacattcc

SEQ ID NO: 325933 - DNA, 25 bp, Mus musculus
cctgatagacgaggggatgcgaccc

SEQ ID NO: 325934 - DNA, 25 bp, Mus musculus
cccgcggcctacctgatagacgagg

SEQ ID NO: 325935 - DNA, 25 bp, Mus musculus
agcgttccgcgccacaacttcaggg

SEQ ID NO: 325936 - DNA, 25 bp, Mus musculus
gggcttgttatcatgcccgccgcgc

SEQ ID NO: 325937 - DNA, 25 bp, Mus musculus
gcagacggacgcctgaacgaacggc

SEQ ID NO: 325938 - DNA, 25 bp, Mus musculus
ctgccacactaccagcgtgggaact

SEQ ID NO: 325939 - DNA, 25 bp, Mus musculus
ggacgtgtccagctcgccagtctct

SEQ ID NO: 325940 - DNA, 25 bp, Mus musculus
ttttgaatggttcgcaggacgaatt

SEQ ID NO: 325941 - DNA, 25 bp, Mus musculus
gttcgcaggacgaattgttagaccc

SEQ ID NO: 325942 - DNA, 25 bp, Mus musculus
tttccgcccgcacggaggtataaga

SEQ ID NO: 325943 - DNA, 25 bp, Mus musculus
cggaggtataagagccgccaagtcc

SEQ ID NO: 325944 - DNA, 25 bp, Mus musculus
cgagatgatgcaggacgtgtccagc

SEQ ID NO: 325945 - DNA, 25 bp, Mus musculus
cgctcgggccaggtcggttttgaat

SEQ ID NO: 325946 - DNA, 25 bp, Mus musculus
acgacagcctgagcaacagcgagga

SEQ ID NO: 325947 - DNA, 25 bp, Mus musculus
gctcgcaagagacgcagcagtcggc

SEQ ID NO: 325948 - DNA, 25 bp, Mus musculus
caagcgcggcaagaaatctgcgggc

SEQ ID NO: 325949 - DNA, 25 bp, Mus musculus
agcccgcagtcgtacgaggagctgc

SEQ ID NO: 325950 - DNA, 25 bp, Mus musculus
cagtcgtacgaggagctgcagaccc

SEQ ID NO: 325951 - DNA, 25 bp, Mus musculus
agctgcagacccagcgggtcatggc

SEQ ID NO: 325952 - DNA, 25 bp, Mus musculus
tcgccgcccgcgagatgatgcagga

SEQ ID NO: 325953 - DNA, 25 bp, Mus musculus
gttggaaagctggaatgcgcaccgc

SEQ ID NO: 325954 - DNA, 25 bp, Mus musculus
gaaaccggcagcgtccagaagctgc

SEQ ID NO: 325955 - DNA, 25 bp, Mus musculus
gaaagctggaatgcgcaccgcggca

SEQ ID NO: 325956 - DNA, 25 bp, Mus musculus
tgcgaggtcctgattcccgcagggt

SEQ ID NO: 325957 - DNA, 25 bp, Mus musculus
gactcatttactgcaaactgcacgg

SEQ ID NO: 325958 - DNA, 25 bp, Mus musculus
ccagaagctgctcaggcttgggttt

SEQ ID NO: 325959 - DNA, 25 bp, Mus musculus
ggggtgatgtctttcggaaagctcc

SEQ ID NO: 325960 - DNA, 25 bp, Mus musculus
tctttcggaaagctccctgcaggct

SEQ ID NO: 325961 - DNA, 25 bp, Mus musculus
gacagcgatgcgaggccaggaaaaa

SEQ ID NO: 325962 - DNA, 25 bp, Mus musculus
tgcgaggccaggaaaaataatccta

SEQ ID NO: 325963 - DNA, 25 bp, Mus musculus
ggaaaaataatcctagcgactcatt

SEQ ID NO: 325964 - DNA, 25 bp, Mus musculus
ctagcgactcatttactgcaaactg

SEQ ID NO: 325965 - DNA, 25 bp, Mus musculus
aactgcacggtgaggttggaaagct

SEQ ID NO: 325966 - DNA, 25 bp, Mus musculus
cagagtggtgcgaggtcctgattcc

SEQ ID NO: 325967 - DNA, 25 bp, Mus musculus
gcggaggacgggctaaaaatagcgc

SEQ ID NO: 325968 - DNA, 25 bp, Mus musculus
ttcccagggctttcccgggcagagc

SEQ ID NO: 325969 - DNA, 25 bp, Mus musculus
agcggagcaccctgagaacggagaa

SEQ ID NO: 325970 - DNA, 25 bp, Mus musculus
cccggctgcggtgccactcacctcc

SEQ ID NO: 325971 - DNA, 25 bp, Mus musculus
tgccactcacctccgcccgctcccg

SEQ ID NO: 325972 - DNA, 25 bp, Mus musculus
aaacagccatcttccgcagcgcagg

SEQ ID NO: 325973 - DNA, 25 bp, Mus musculus
ccatcttccgcagcgcaggagggaa

SEQ ID NO: 325974 - DNA, 25 bp, Mus musculus
aggcgccaggtgacaggcaggcgac

SEQ ID NO: 325975 - DNA, 25 bp, Mus musculus
ggtcgctcaggtgcgcgcctggccg

SEQ ID NO: 325976 - DNA, 25 bp, Mus musculus
cgcctggccgcgcagactgtaggga

SEQ ID NO: 325977 - DNA, 25 bp, Mus musculus
cagactgtagggagcggagcaccct

SEQ ID NO: 325978 - DNA, 25 bp, Mus musculus
ggagcaccctgagaacggagaaccg

SEQ ID NO: 325979 - DNA, 25 bp, Mus musculus
caattcccagggctttcccgggcag

SEQ ID NO: 325980 - DNA, 25 bp, Mus musculus
acctgggagacggacagaggcggca

SEQ ID NO: 325981 - DNA, 25 bp, Mus musculus
cgagatgccagtttctccgccggca

SEQ ID NO: 325982 - DNA, 25 bp, Mus musculus
caggacttactgagcgctgggagca

SEQ ID NO: 325983 - DNA, 25 bp, Mus musculus
cggcgccatggagacagtcacaaga

SEQ ID NO: 325984 - DNA, 25 bp, Mus musculus
acgcggacgtcgctcttccaagatg

SEQ ID NO: 325985 - DNA, 25 bp, Mus musculus
ccgggacaggactgaagcagcagtt

SEQ ID NO: 325986 - DNA, 25 bp, Mus musculus
tccgctgctgctacggctattgcca

SEQ ID NO: 325987 - DNA, 25 bp, Mus musculus
cccggggtgtaatgatgttaacaga

SEQ ID NO: 325988 - DNA, 25 bp, Mus musculus
tgttaacagaggtaagcggcgccca

SEQ ID NO: 325989 - DNA, 25 bp, Mus musculus
gcggcgcccactgtttacctgagag

SEQ ID NO: 325990 - DNA, 25 bp, Mus musculus
gggttcccacaagtgccaccgagtg

SEQ ID NO: 325991 - DNA, 25 bp, Mus musculus
tgctgactcggcagagttccacctc

SEQ ID NO: 325992 - DNA, 25 bp, Mus musculus
gagctgtcgctccttcctggagtcc

SEQ ID NO: 325993 - DNA, 25 bp, Mus musculus
ctacattggctgctccgcgaagtga

SEQ ID NO: 325994 - DNA, 25 bp, Mus musculus
gctgggagcaacagaggcaagtttc

SEQ ID NO: 325995 - DNA, 25 bp, Mus musculus
ccgcggaggagaaacccgcacgcta

SEQ ID NO: 325996 - DNA, 25 bp, Mus musculus
cgcctgcccgccgtcactcacgttt

SEQ ID NO: 325997 - DNA, 25 bp, Mus musculus
actcacgttttctgcaccggcttgc

SEQ ID NO: 325998 - DNA, 25 bp, Mus musculus
tttctgcaccggcttgcgccgcttg

SEQ ID NO: 325999 - DNA, 25 bp, Mus musculus
tgcccgctccacctgcgtcccggag

SEQ ID NO: 326000 - DNA, 25 bp, Mus musculus
ctggcataggtgatgttggcgccgc

SEQ ID NO: 326001 - DNA, 25 bp, Mus musculus
ttggcgccgctgctcatggtgcccg

SEQ ID NO: 326002 - DNA, 25 bp, Mus musculus
gcgtcaaagggagcgcacacacacg

SEQ ID NO: 326003 - DNA, 25 bp, Mus musculus
caccgagcgtcaaagggagcgcaca

SEQ ID NO: 326004 - DNA, 25 bp, Mus musculus
ggctgagcctctccgggacacgcgt

SEQ ID NO: 326005 - DNA, 25 bp, Mus musculus
ccgagtccgtccaccagttcgtcct

SEQ ID NO: 326006 - DNA, 25 bp, Mus musculus
gcgtcgctcacaaccctgcctggca

SEQ ID NO: 326007 - DNA, 25 bp, Mus musculus
cgcagtgctctagggcttcccggct

SEQ ID NO: 326008 - DNA, 25 bp, Mus musculus
aggagaaacccgcacgctagccgcg

SEQ ID NO: 326009 - DNA, 25 bp, Mus musculus
atacagcaggttgagcgcgcacagg

SEQ ID NO: 326010 - DNA, 25 bp, Mus musculus
gccgcagcggatccgccgatcgcgc

SEQ ID NO: 326011 - DNA, 25 bp, Mus musculus
agcttctggatcctggcctcctgag

SEQ ID NO: 326012 - DNA, 25 bp, Mus musculus
cgagtagcttctggatcctggcctc

SEQ ID NO: 326013 - DNA, 25 bp, Mus musculus
gctgggcgagtagcttctggatcct

SEQ ID NO: 326014 - DNA, 25 bp, Mus musculus
gcacaccatcgtggcgcgtgggcta

SEQ ID NO: 326015 - DNA, 25 bp, Mus musculus
gcagttcttggagcacgagaagccc

SEQ ID NO: 326016 - DNA, 25 bp, Mus musculus
ccacaatgaaggacgggcggagact

SEQ ID NO: 326017 - DNA, 25 bp, Mus musculus
cgcgcacaggcagttcttggagcac

SEQ ID NO: 326018 - DNA, 25 bp, Mus musculus
ctactcacggtatacagcaggttga

SEQ ID NO: 326019 - DNA, 25 bp, Mus musculus
gcgggctactcacggtatacagcag

SEQ ID NO: 326020 - DNA, 25 bp, Mus musculus
cgcaggcgaatactcaggcggggag

SEQ ID NO: 326021 - DNA, 25 bp, Mus musculus
ggcggagactgcgacaagcaggctc

SEQ ID NO: 326022 - DNA, 25 bp, Mus musculus
cacaggcagttcttggagcacgaga

SEQ ID NO: 326023 - DNA, 25 bp, Mus musculus
ggatcgccacgcacgagaccatgtg

SEQ ID NO: 326024 - DNA, 25 bp, Mus musculus
acacagtacgtgcatggatgatggc

SEQ ID NO: 326025 - DNA, 25 bp, Mus musculus
gctcgagaggcactaatacacagta

SEQ ID NO: 326026 - DNA, 25 bp, Mus musculus
tctaggtctcgctcgagaggcacta

SEQ ID NO: 326027 - DNA, 25 bp, Mus musculus
acaaacgtagcgaggtctaggtctc

SEQ ID NO: 326028 - DNA, 25 bp, Mus musculus
ctcttggggcggacaaacgtagcga

SEQ ID NO: 326029 - DNA, 25 bp, Mus musculus
gcagtgcagcccgtctagctgcatc

SEQ ID NO: 326030 - DNA, 25 bp, Mus musculus
actcttaggggcagtgcagcccgtc

SEQ ID NO: 326031 - DNA, 25 bp, Mus musculus
cgaaccgcgccactcttaggggcag

SEQ ID NO: 326032 - DNA, 25 bp, Mus musculus
agacacacagaacccggtgtagctc

SEQ ID NO: 326033 - DNA, 25 bp, Mus musculus
tgaaggacagacacattgacacaga

SEQ ID NO: 326034 - DNA, 25 bp, Mus musculus
acctgtccaaggagggagcgacgac

SEQ ID NO: 326035 - DNA, 25 bp, Mus musculus
ggtcactgctcgctcaactctcagg

SEQ ID NO: 326036 - DNA, 25 bp, Mus musculus
tgatcacctcttacctgtccaagga

SEQ ID NO: 326037 - DNA, 25 bp, Mus musculus
tggcgacttactgcggaacagacgt

SEQ ID NO: 326038 - DNA, 25 bp, Mus musculus
ttcgccttcgaaatggagatgtctc

SEQ ID NO: 326039 - DNA, 25 bp, Mus musculus
acagacgtcgccgtcgcaggcgaca

SEQ ID NO: 326040 - DNA, 25 bp, Mus musculus
gctatgtccttctacccagttccga

SEQ ID NO: 326041 - DNA, 25 bp, Mus musculus
ctccagagagagaagcgctatgtcc

SEQ ID NO: 326042 - DNA, 25 bp, Mus musculus
gtttctagacgcctccagagagaga

SEQ ID NO: 326043 - DNA, 25 bp, Mus musculus
tggagatgtctcgacagcacctaac

SEQ ID NO: 326044 - DNA, 25 bp, Mus musculus
gcttttcgcagcgttcgccttcgaa

SEQ ID NO: 326045 - DNA, 25 bp, Mus musculus
acctggagccgggaaactcacctca

SEQ ID NO: 326046 - DNA, 25 bp, Mus musculus
cgggaaaccctgtcgcgaccagcgg

SEQ ID NO: 326047 - DNA, 25 bp, Mus musculus
ccgtgaggaaattgtctggctgaaa

SEQ ID NO: 326048 - DNA, 25 bp, Mus musculus
gttttcctaggctgccgcaaggcgc

SEQ ID NO: 326049 - DNA, 25 bp, Mus musculus
gtcacccaccgaacatgacctggag

SEQ ID NO: 326050 - DNA, 25 bp, Mus musculus
gacagcacctaacccgaagtttcta

SEQ ID NO: 326051 - DNA, 25 bp, Mus musculus
ggcagcacgcgcacctacaaaatca

SEQ ID NO: 326052 - DNA, 25 bp, Mus musculus
cacccagaggatccagctgcagtgt

SEQ ID NO: 326053 - DNA, 25 bp, Mus musculus
gccggtgcttcccaactggatcgga

SEQ ID NO: 326054 - DNA, 25 bp, Mus musculus
ttcccaactggatcggaggaggcta

SEQ ID NO: 326055 - DNA, 25 bp, Mus musculus
tcggaggaggctatggaacaaagta

SEQ ID NO: 326056 - DNA, 25 bp, Mus musculus
ctatggaacaaagtactggagccgg

SEQ ID NO: 326057 - DNA, 25 bp, Mus musculus
tggcggtgtgtcaacgacaagacgc

SEQ ID NO: 326058 - DNA, 25 bp, Mus musculus
cgcgcacctacaaaatcaccgtggt

SEQ ID NO: 326059 - DNA, 25 bp, Mus musculus
tcaccgtggtcacggcgtgcaagtg

SEQ ID NO: 326060 - DNA, 25 bp, Mus musculus
tgcaagtgcaagaggtacacccgtc

SEQ ID NO: 326061 - DNA, 25 bp, Mus musculus
ggtacacccgtcagcacaacgagtc

SEQ ID NO: 326062 - DNA, 25 bp, Mus musculus
cgagtccagccacaactttgaaagc

SEQ ID NO: 326063 - DNA, 25 bp, Mus musculus
tttgaaagcgtgtcgcccgccaagc

SEQ ID NO: 326064 - DNA, 25 bp, Mus musculus
cgacaagacgcgcacccagaggatc

SEQ ID NO: 326065 - DNA, 25 bp, Mus musculus
ggccgctcatcagctacactttgca

SEQ ID NO: 326066 - DNA, 25 bp, Mus musculus
ctggggcacagtgccaccgcgcatg

SEQ ID NO: 326067 - DNA, 25 bp, Mus musculus
aatacctgctctaggagcgcctggg

SEQ ID NO: 326068 - DNA, 25 bp, Mus musculus
ggcccgaggaatacctgctctagga

SEQ ID NO: 326069 - DNA, 25 bp, Mus musculus
cagggactttcggttcccacgcagg

SEQ ID NO: 326070 - DNA, 25 bp, Mus musculus
gctaaccagtgcatggggacccagg

SEQ ID NO: 326071 - DNA, 25 bp, Mus musculus
ctggggccctggctaaccagtgcat

SEQ ID NO: 326072 - DNA, 25 bp, Mus musculus
gttcctggcccagtgcgacccttga

SEQ ID NO: 326073 - DNA, 25 bp, Mus musculus
cactttgcaggctatggagaggtaa

SEQ ID NO: 326074 - DNA, 25 bp, Mus musculus
gtgcgacccttgatctcgtcccagg

SEQ ID NO: 326075 - DNA, 25 bp, Mus musculus
cccgaagcagttctgccgggttctg

SEQ ID NO: 326076 - DNA, 25 bp, Mus musculus
gcgtctcgctctcggtttccatctg

SEQ ID NO: 326077 - DNA, 25 bp, Mus musculus
ggagaggtaactggcgccagccatc

SEQ ID NO: 326078 - DNA, 25 bp, Mus musculus
tttccatctgcacctcgagcttctg

SEQ ID NO: 326079 - DNA, 25 bp, Mus musculus
cttgcggatgcacgcctcacctgtg

SEQ ID NO: 326080 - DNA, 25 bp, Mus musculus
ctgcggcggatcttaacttcctttg

SEQ ID NO: 326081 - DNA, 25 bp, Mus musculus
cgctcctaggagctgctgtgaacca

SEQ ID NO: 326082 - DNA, 25 bp, Mus musculus
tctgcagagcaaggtctcgaatctg

SEQ ID NO: 326083 - DNA, 25 bp, Mus musculus
cccgcctggcacactgggaagtgta

SEQ ID NO: 326084 - DNA, 25 bp, Mus musculus
ttgtttccgccttcgcttgctggga

SEQ ID NO: 326085 - DNA, 25 bp, Mus musculus
ctggcagccactcactttctggatc

SEQ ID NO: 326086 - DNA, 25 bp, Mus musculus
cgaggttccaagtacccagaccttg

SEQ ID NO: 326087 - DNA, 25 bp, Mus musculus
tcatcctggaaagggcacgaccgga

SEQ ID NO: 326088 - DNA, 25 bp, Mus musculus
cccgaggttctaggctcatcctgga

SEQ ID NO: 326089 - DNA, 25 bp, Mus musculus
tccggggacattgtgaggacgcaca

SEQ ID NO: 326090 - DNA, 25 bp, Mus musculus
gtgcgaacacagcaaggagggctcc

SEQ ID NO: 326091 - DNA, 25 bp, Mus musculus
ttctggatccgcttcagcgccatgg

SEQ ID NO: 326092 - DNA, 25 bp, Mus musculus
aaggccgcccgttgcagagcaagcc

SEQ ID NO: 326093 - DNA, 25 bp, Mus musculus
tgtgccctggaagactacacttttc

SEQ ID NO: 326094 - DNA, 25 bp, Mus musculus
tgctcgaaagcatccaatccgctgg

SEQ ID NO: 326095 - DNA, 25 bp, Mus musculus
gcggggtcagcaataaacaacaatg

SEQ ID NO: 326096 - DNA, 25 bp, Mus musculus
tggaaatccacggttcctcattggc

SEQ ID NO: 326097 - DNA, 25 bp, Mus musculus
cctcattggcttcagggacaagctc

SEQ ID NO: 326098 - DNA, 25 bp, Mus musculus
tgctctggatacctgtcccgctctg

SEQ ID NO: 326099 - DNA, 25 bp, Mus musculus
ttggaaactgttaccgccttgtctg

SEQ ID NO: 326100 - DNA, 25 bp, Mus musculus
tcttcgggttgcaccctcacaaagt

SEQ ID NO: 326101 - DNA, 25 bp, Mus musculus
acaaagtctagtagcgttcgaacgc

SEQ ID NO: 326102 - DNA, 25 bp, Mus musculus
ctctctcaaagaggacgcgcgcggc

SEQ ID NO: 326103 - DNA, 25 bp, Mus musculus
ttttcccttggtgaagcgcagagtg

SEQ ID NO: 326104 - DNA, 25 bp, Mus musculus
agcgcagagtggttttgtcataaac

SEQ ID NO: 326105 - DNA, 25 bp, Mus musculus
actacgctctttctcggcgggtccg

SEQ ID NO: 326106 - DNA, 25 bp, Mus musculus
cgggctctgatactgtcctctctca

SEQ ID NO: 326107 - DNA, 25 bp, Mus musculus
gccgcaggcctcttctccaacatga

SEQ ID NO: 326108 - DNA, 25 bp, Mus musculus
cagccgggctaacggtgctcgccag

SEQ ID NO: 326109 - DNA, 25 bp, Mus musculus
aggcatcgcaaaggacgccgagccc

SEQ ID NO: 326110 - DNA, 25 bp, Mus musculus
aacgagcaggcatcgcaaaggacgc

SEQ ID NO: 326111 - DNA, 25 bp, Mus musculus
cctgagtgggaaacgagcaggcatc

SEQ ID NO: 326112 - DNA, 25 bp, Mus musculus
tggcaagggtgcctgccactcccag

SEQ ID NO: 326113 - DNA, 25 bp, Mus musculus
cccggcgccctaattggcaagggtg

SEQ ID NO: 326114 - DNA, 25 bp, Mus musculus
atcccattggtcagcgcgtcagggc

SEQ ID NO: 326115 - DNA, 25 bp, Mus musculus
acagggaagcccagactcggcctct

SEQ ID NO: 326116 - DNA, 25 bp, Mus musculus
atgggccacggtgacgcggccctac

SEQ ID NO: 326117 - DNA, 25 bp, Mus musculus
gcgggttctcggtctttctgccgcc

SEQ ID NO: 326118 - DNA, 25 bp, Mus musculus
acgccacagctcctctcaaccgaga

SEQ ID NO: 326119 - DNA, 25 bp, Mus musculus
gcgcacctgcagcatgggccacggt

SEQ ID NO: 326120 - DNA, 25 bp, Mus musculus
tagcaacgcccaaacaaggtcacgt

SEQ ID NO: 326121 - DNA, 25 bp, Mus musculus
gcgaacctgctctcccggctttaaa

SEQ ID NO: 326122 - DNA, 25 bp, Mus musculus
agggaagccaacagccacgcccgaa

SEQ ID NO: 326123 - DNA, 25 bp, Mus musculus
tggaagggaagccaacagccacgcc

SEQ ID NO: 326124 - DNA, 25 bp, Mus musculus
tttaaagcggctcgccagaagcgga

SEQ ID NO: 326125 - DNA, 25 bp, Mus musculus
aggacttgatccgtgccctgagccc

SEQ ID NO: 326126 - DNA, 25 bp, Mus musculus
tgctctcccggctttaaagcggctc

SEQ ID NO: 326127 - DNA, 25 bp, Mus musculus
gatgaccggtgaccgcgaacctgct

SEQ ID NO: 326128 - DNA, 25 bp, Mus musculus
aggaagagcccgatgaccggtgacc

SEQ ID NO: 326129 - DNA, 25 bp, Mus musculus
gcccaaggaagagcccgatgaccgg

SEQ ID NO: 326130 - DNA, 25 bp, Mus musculus
atccgtgccctgagcccaaggaaga

SEQ ID NO: 326131 - DNA, 25 bp, Mus musculus
cgagcgagccgaggacttgatccgt

SEQ ID NO: 326132 - DNA, 25 bp, Mus musculus
agctcctgcgccatggtgccgcgat

SEQ ID NO: 326133 - DNA, 25 bp, Mus musculus
aactcggggtgctgcagctcctgcg

SEQ ID NO: 326134 - DNA, 25 bp, Mus musculus
cccggctttaaagcggctcgccaga

SEQ ID NO: 326135 - DNA, 25 bp, Mus musculus
ggaactgcagttcagccgtaccacg

SEQ ID NO: 326136 - DNA, 25 bp, Mus musculus
agctcaggcctcgtgacgcaaaagc

SEQ ID NO: 326137 - DNA, 25 bp, Mus musculus
ccaagcccgctggacgtttgacact

SEQ ID NO: 326138 - DNA, 25 bp, Mus musculus
tgacactcccgagaactccatgttg

SEQ ID NO: 326139 - DNA, 25 bp, Mus musculus
gaacgccaagtcctggtcaccctta

SEQ ID NO: 326140 - DNA, 25 bp, Mus musculus
tgccagctcaagaagcgcgagtccc

SEQ ID NO: 326141 - DNA, 25 bp, Mus musculus
ggcgtccgaagcgaagaccgaacta

SEQ ID NO: 326142 - DNA, 25 bp, Mus musculus
cgcttcttgttcttcggcatcgtgg

SEQ ID NO: 326143 - DNA, 25 bp, Mus musculus
ctacacttggagctcagcgaggatc

SEQ ID NO: 326144 - DNA, 25 bp, Mus musculus
tggccagaccacgacgccttaagta

SEQ ID NO: 326145 - DNA, 25 bp, Mus musculus
gccgatggagctgcactgtctactc

SEQ ID NO: 326146 - DNA, 25 bp, Mus musculus
gctgcgagcggaaacgatacatgtt

SEQ ID NO: 326147 - DNA, 25 bp, Mus musculus
gatacatgtttctctctagcgcggg

SEQ ID NO: 326148 - DNA, 25 bp, Mus musculus
ccgtaccacgcgctatgcagacttg

SEQ ID NO: 326149 - DNA, 25 bp, Mus musculus
gcgggcgaacttttaccacgctctg

SEQ ID NO: 326150 - DNA, 25 bp, Mus musculus
ggcggagcggtgatacaccaataaa

SEQ ID NO: 326151 - DNA, 25 bp, Mus musculus
taaaaacgcgcctggggtcgcatgc

SEQ ID NO: 326152 - DNA, 25 bp, Mus musculus
ccgcctcactgagggagttcctaca

SEQ ID NO: 326153 - DNA, 25 bp, Mus musculus
tacacgcctatgctgtgccgtcaca

SEQ ID NO: 326154 - DNA, 25 bp, Mus musculus
tgccgtcacattttggaccaatcga

SEQ ID NO: 326155 - DNA, 25 bp, Mus musculus
accaatcgattgtggcgagcctaac

SEQ ID NO: 326156 - DNA, 25 bp, Mus musculus
acaacttccagcatgccgcgaggca

SEQ ID NO: 326157 - DNA, 25 bp, Mus musculus
ccggcgtgttcgcttagttcagtga

SEQ ID NO: 326158 - DNA, 25 bp, Mus musculus
tcagaacaatgactgcgccgccggg

SEQ ID NO: 326159 - DNA, 25 bp, Mus musculus
agcggtgcattgttgtgagccactg

SEQ ID NO: 326160 - DNA, 25 bp, Mus musculus
aacgcccttcatagccatgtggata

SEQ ID NO: 326161 - DNA, 25 bp, Mus musculus
ccatgtggatacctacggagcacga

SEQ ID NO: 326162 - DNA, 25 bp, Mus musculus
ggacctcactagcagccattacctg

SEQ ID NO: 326163 - DNA, 25 bp, Mus musculus
cacgcgggtgggcttaagcagaccc

SEQ ID NO: 326164 - DNA, 25 bp, Mus musculus
cgatccgggcgggtagccgacctct

SEQ ID NO: 326165 - DNA, 25 bp, Mus musculus
ggtgggcttaagcagaccctctgtg

SEQ ID NO: 326166 - DNA, 25 bp, Mus musculus
cggcagggtctcttatctccggctt

SEQ ID NO: 326167 - DNA, 25 bp, Mus musculus
agggtctcttatctccggcttctcc

SEQ ID NO: 326168 - DNA, 25 bp, Mus musculus
tccggcttctcctccgtcgagtggg

SEQ ID NO: 326169 - DNA, 25 bp, Mus musculus
tctcctccgtcgagtgggcgttgct

SEQ ID NO: 326170 - DNA, 25 bp, Mus musculus
ctcggccgctatccgcgcgatggta

SEQ ID NO: 326171 - DNA, 25 bp, Mus musculus
ctatccgcgcgatggtagcgagcat

SEQ ID NO: 326172 - DNA, 25 bp, Mus musculus
tgcgcgtgttccagtgaggccgcgc

SEQ ID NO: 326173 - DNA, 25 bp, Mus musculus
agttcgtcctcttgtctccctcagt

SEQ ID NO: 326174 - DNA, 25 bp, Mus musculus
gtcctcttgtctccctcagttaggg

SEQ ID NO: 326175 - DNA, 25 bp, Mus musculus
ggcttaagcagaccctctgtgtccc

SEQ ID NO: 326176 - DNA, 25 bp, Mus musculus
tgtctccctcagttagggaacccga

SEQ ID NO: 326177 - DNA, 25 bp, Mus musculus
cctgcagaaagcttcgctgttgagc

SEQ ID NO: 326178 - DNA, 25 bp, Mus musculus
agcatgtccgatgatggtcgccaga

SEQ ID NO: 326179 - DNA, 25 bp, Mus musculus
gttcgctagtcaaagggctggtcca

SEQ ID NO: 326180 - DNA, 25 bp, Mus musculus
tccacaactgacagcaaggcggctc

SEQ ID NO: 326181 - DNA, 25 bp, Mus musculus
ggtgacaaacgagatcccgccgctt

SEQ ID NO: 326182 - DNA, 25 bp, Mus musculus
ccctggagatgtttttagtgcccga

SEQ ID NO: 326183 - DNA, 25 bp, Mus musculus
caccgcaagcacgagctgtgacgca

SEQ ID NO: 326184 - DNA, 25 bp, Mus musculus
tgacgcagccatctcggggtacagt

SEQ ID NO: 326185 - DNA, 25 bp, Mus musculus
acagtcgcgtcgcttggcttcccaa

SEQ ID NO: 326186 - DNA, 25 bp, Mus musculus
ttcccaacgcggctgataggtggta

SEQ ID NO: 326187 - DNA, 25 bp, Mus musculus
ctggcgcgaccgcttatagagccga

SEQ ID NO: 326188 - DNA, 25 bp, Mus musculus
acgcgcacgtggaaaactgttgttg

SEQ ID NO: 326189 - DNA, 25 bp, Mus musculus
gacgatttcctcatccttccctggg

SEQ ID NO: 326190 - DNA, 25 bp, Mus musculus
ttgccgtttggtccttgcgtcactt

SEQ ID NO: 326191 - DNA, 25 bp, Mus musculus
ccaggggtcggcagcttcgccgcca

SEQ ID NO: 326192 - DNA, 25 bp, Mus musculus
gcgccctgggctgcgccatggaggt

SEQ ID NO: 326193 - DNA, 25 bp, Mus musculus
ggatcccagcggaagatcgccgccg

SEQ ID NO: 326194 - DNA, 25 bp, Mus musculus
gccgccacctcaggagcgccgggag

SEQ ID NO: 326195 - DNA, 25 bp, Mus musculus
atcccagcggaagatcgccgccgcc

SEQ ID NO: 326196 - DNA, 25 bp, Mus musculus
cggccgcgttggctagctcggcttc

SEQ ID NO: 326197 - DNA, 25 bp, Mus musculus
tgctctgcgccctgggctgcgccat

SEQ ID NO: 326198 - DNA, 25 bp, Mus musculus
ggagcccaccgagcaactgcagacg

SEQ ID NO: 326199 - DNA, 25 bp, Mus musculus
gagcccaccgagcaactgcagacgc

SEQ ID NO: 326200 - DNA, 25 bp, Mus musculus
ggggtcggcagcttcgccgccacct

SEQ ID NO: 326201 - DNA, 25 bp, Mus musculus
ggcggaagaccgacgccgctagccc

SEQ ID NO: 326202 - DNA, 25 bp, Mus musculus
gaccgacgccgctagccccgagctc

SEQ ID NO: 326203 - DNA, 25 bp, Mus musculus
gctcggatcccagcggaagatcgcc

SEQ ID NO: 326204 - DNA, 25 bp, Mus musculus
cgttggctagctcggcttctgaggg

SEQ ID NO: 326205 - DNA, 25 bp, Mus musculus
ccagtctagacagggcagcaaaagc

SEQ ID NO: 326206 - DNA, 25 bp, Mus musculus
aagggccgcgactccagcaccttag

SEQ ID NO: 326207 - DNA, 25 bp, Mus musculus
tttgtctggccggagaccgtcttgc

SEQ ID NO: 326208 - DNA, 25 bp, Mus musculus
ccacggccgaggcttgaaagtgctg

SEQ ID NO: 326209 - DNA, 25 bp, Mus musculus
tggaccatggtgaacacccggaaga

SEQ ID NO: 326210 - DNA, 25 bp, Mus musculus
cctgcgtcccggagaggcaacgcga

SEQ ID NO: 326211 - DNA, 25 bp, Mus musculus
ttctgctccgctctagcctgtcggg

SEQ ID NO: 326212 - DNA, 25 bp, Mus musculus
cacggagctcgatagagagagaacg

SEQ ID NO: 326213 - DNA, 25 bp, Mus musculus
cgccagagacctgacgcacggagct

SEQ ID NO: 326214 - DNA, 25 bp, Mus musculus
tccagaagcggccttgtcggccctg

SEQ ID NO: 326215 - DNA, 25 bp, Mus musculus
aagggctgcgcgtccttgcagcgcc

SEQ ID NO: 326216 - DNA, 25 bp, Mus musculus
ccgccgatgctgacgtcacgtcgag

SEQ ID NO: 326217 - DNA, 25 bp, Mus musculus
gccactgtggggttcacagcccaga

SEQ ID NO: 326218 - DNA, 25 bp, Mus musculus
agggcagcaaaagctggccactgtg

SEQ ID NO: 326219 - DNA, 25 bp, Mus musculus
gcccgatacgcaggcctcggggtcc

SEQ ID NO: 326220 - DNA, 25 bp, Mus musculus
ctctggcagatcactggagacgcga

SEQ ID NO: 326221 - DNA, 25 bp, Mus musculus
ctgttctctggcagatcactggaga

SEQ ID NO: 326222 - DNA, 25 bp, Mus musculus
gaatgggctgttctctggcagatca

SEQ ID NO: 326223 - DNA, 25 bp, Mus musculus
cctgaatgggctgttctctggcaga

SEQ ID NO: 326224 - DNA, 25 bp, Mus musculus
gtcctgaatgggctgttctctggca

SEQ ID NO: 326225 - DNA, 25 bp, Mus musculus
tctctgcagtggcacgccgggtcct

SEQ ID NO: 326226 - DNA, 25 bp, Mus musculus
tttcggaggcccgatacgcaggcct

SEQ ID NO: 326227 - DNA, 25 bp, Mus musculus
gtgactactgcctgcgtcccggtga

SEQ ID NO: 326228 - DNA, 25 bp, Mus musculus
gccgcggcgcccgtgactactgcct

SEQ ID NO: 326229 - DNA, 25 bp, Mus musculus
gccgatgcggacctcagagctggcg

SEQ ID NO: 326230 - DNA, 25 bp, Mus musculus
ctggcagatcactggagacgcgacg

SEQ ID NO: 326231 - DNA, 25 bp, Mus musculus
cacgccgggtcctgaatgggctgtt

SEQ ID NO: 326232 - DNA, 25 bp, Mus musculus
ctggtcacgccagtgtttggggtcc

SEQ ID NO: 326233 - DNA, 25 bp, Mus musculus
agccttaggcgccaaggcggtgact

SEQ ID NO: 326234 - DNA, 25 bp, Mus musculus
ctgcaggactgtcggccgatggcct

SEQ ID NO: 326235 - DNA, 25 bp, Mus musculus
tctcaggaagcgcaggagcgttttg

SEQ ID NO: 326236 - DNA, 25 bp, Mus musculus
tgactcaggacaagtacctgcagga

SEQ ID NO: 326237 - DNA, 25 bp, Mus musculus
tttaccgtcggtccagttgagagcg

SEQ ID NO: 326238 - DNA, 25 bp, Mus musculus
tgacaaccgcgggatagccttaggc

SEQ ID NO: 326239 - DNA, 25 bp, Mus musculus
gcagacgggtgaggatttgacaacc

SEQ ID NO: 326240 - DNA, 25 bp, Mus musculus
atgcgcagctggtccaacccggcag

SEQ ID NO: 326241 - DNA, 25 bp, Mus musculus
gagacttgggcaagacgcgacctcg

SEQ ID NO: 326242 - DNA, 25 bp, Mus musculus
gctcacctcgcacagcggagttgga

SEQ ID NO: 326243 - DNA, 25 bp, Mus musculus
cttgtgctggtcaaggtgacagtcc

SEQ ID NO: 326244 - DNA, 25 bp, Mus musculus
ctgcgcctgcccttgtgctggtcaa

SEQ ID NO: 326245 - DNA, 25 bp, Mus musculus
ttggttgctcacagcgtggctggcc

SEQ ID NO: 326246 - DNA, 25 bp, Mus musculus
cagttgagagcgtttcaggtgactc

SEQ ID NO: 326247 - DNA, 25 bp, Mus musculus
gaccggcattacacagctttctggg

SEQ ID NO: 326248 - DNA, 25 bp, Mus musculus
tctggcggttgcattagtgacattc

SEQ ID NO: 326249 - DNA, 25 bp, Mus musculus
atgtgctcacacctgggcgaatcgc

SEQ ID NO: 326250 - DNA, 25 bp, Mus musculus
cgtgggctttgttcagatgtgctca

SEQ ID NO: 326251 - DNA, 25 bp, Mus musculus
gcttcggaagcttcggaaacacgca

SEQ ID NO: 326252 - DNA, 25 bp, Mus musculus
cacgaaaacgtgagtagccctgggt

SEQ ID NO: 326253 - DNA, 25 bp, Mus musculus
ctcaacccgagctcttgtgggagtc

SEQ ID NO: 326254 - DNA, 25 bp, Mus musculus
cagcacttgcagcttgggagaaaga

SEQ ID NO: 326255 - DNA, 25 bp, Mus musculus
ggcgacttcgttttctcttgcaagc

SEQ ID NO: 326256 - DNA, 25 bp, Mus musculus
ttggaaaaaggagacgcacgccctg

SEQ ID NO: 326257 - DNA, 25 bp, Mus musculus
tcccgggttaacttcagcctctctg

SEQ ID NO: 326258 - DNA, 25 bp, Mus musculus
agccctgactagaggtctgcctgtg

SEQ ID NO: 326259 - DNA, 25 bp, Mus musculus
tctgcctgtggacagaccggcatta

SEQ ID NO: 326260 - DNA, 25 bp, Mus musculus
ggagcccattcgctgcagcctaagc

SEQ ID NO: 326261 - DNA, 25 bp, Mus musculus
tagctgcaactgtacgccgggtagc

SEQ ID NO: 326262 - DNA, 25 bp, Mus musculus
tgcgagctagcaaaaccaacctgcc

SEQ ID NO: 326263 - DNA, 25 bp, Mus musculus
gcaaagatcggtagcccagggctcc

SEQ ID NO: 326264 - DNA, 25 bp, Mus musculus
aacgacctggcctggggcaaagatc

SEQ ID NO: 326265 - DNA, 25 bp, Mus musculus
tgctgtgggcgagccacaacgacct

SEQ ID NO: 326266 - DNA, 25 bp, Mus musculus
gccgctgcctgtgagcatgcccagt

SEQ ID NO: 326267 - DNA, 25 bp, Mus musculus
gccgccgagtgcgagctagcaaaac

SEQ ID NO: 326268 - DNA, 25 bp, Mus musculus
tcggggaaactcctggcaactccaa

SEQ ID NO: 326269 - DNA, 25 bp, Mus musculus
ctcggcttctggctgatcgcggctc

SEQ ID NO: 326270 - DNA, 25 bp, Mus musculus
ggcacgcgtcccaaccgaagacagg

SEQ ID NO: 326271 - DNA, 25 bp, Mus musculus
actgtacgccgggtagcctggcctc

SEQ ID NO: 326272 - DNA, 25 bp, Mus musculus
cgcagccgcgatagctgcaactgta

SEQ ID NO: 326273 - DNA, 25 bp, Mus musculus
ttccgcgcgcacaaagcagctgagc

SEQ ID NO: 326274 - DNA, 25 bp, Mus musculus
aggaacctaccgtgcagcctggctc

SEQ ID NO: 326275 - DNA, 25 bp, Mus musculus
ggagagtgtgtatgtgctcttttta

SEQ ID NO: 326276 - DNA, 25 bp, Mus musculus
ttcaaaaaacgcgtgagaggcgtca

SEQ ID NO: 326277 - DNA, 25 bp, Mus musculus
aaaaaacgcgtgagaggcgtcacgg

SEQ ID NO: 326278 - DNA, 25 bp, Mus musculus
cgagagtgttatgcgcgtgttttta

SEQ ID NO: 326279 - DNA, 25 bp, Mus musculus
cgagttcaaaaaacgcgtgagaggc

SEQ ID NO: 326280 - DNA, 25 bp, Mus musculus
agtgtgtatgtgctctttttatacc

SEQ ID NO: 326281 - DNA, 25 bp, Mus musculus
gtgctctttttataccgagttcaaa

SEQ ID NO: 326282 - DNA, 25 bp, Mus musculus
cctttagagcgcctataaagagggg

SEQ ID NO: 326283 - DNA, 25 bp, Mus musculus
agaaataagaggcacgcgaagcgcc

SEQ ID NO: 326284 - DNA, 25 bp, Mus musculus
ggggtgcgcttcacagaggaggaaa

SEQ ID NO: 326285 - DNA, 25 bp, Mus musculus
tgcgcgtgtttttactctcaaaacc

SEQ ID NO: 326286 - DNA, 25 bp, Mus musculus
gttatgcgcgtgtttttactctcaa

SEQ ID NO: 326287 - DNA, 25 bp, Mus musculus
gtgttatgcgcgtgtttttactctc

SEQ ID NO: 326288 - DNA, 25 bp, Mus musculus
tatgtgctctttttataccgagttc

SEQ ID NO: 326289 - DNA, 25 bp, Mus musculus
gttgcagcttttgctacatgccttg

SEQ ID NO: 326290 - DNA, 25 bp, Mus musculus
ctctaattcttgaggggtggttgca

SEQ ID NO: 326291 - DNA, 25 bp, Mus musculus
gctcggaaaattaattgtggctata

SEQ ID NO: 326292 - DNA, 25 bp, Mus musculus
tgtgcgcctgtagctcggaaaatta

SEQ ID NO: 326293 - DNA, 25 bp, Mus musculus
ttgctacatgccttgccagcgccgg

SEQ ID NO: 326294 - DNA, 25 bp, Mus musculus
cactgattggttcggcagtaggaaa

SEQ ID NO: 326295 - DNA, 25 bp, Mus musculus
tcgttcagcatcaacagcctggtcc

SEQ ID NO: 326296 - DNA, 25 bp, Mus musculus
tttttacagccctagtgtgcgcctg

SEQ ID NO: 326297 - DNA, 25 bp, Mus musculus
atgattcccaagtcctcgttcagca

SEQ ID NO: 326298 - DNA, 25 bp, Mus musculus
agcagccgacgacgacaagggtccc

SEQ ID NO: 326299 - DNA, 25 bp, Mus musculus
caaggctgacgcacttggagccaaa

SEQ ID NO: 326300 - DNA, 25 bp, Mus musculus
ggcaagtacgagaagccgccgttca

SEQ ID NO: 326301 - DNA, 25 bp, Mus musculus
gaagccgccgttcagctacaacgcg

SEQ ID NO: 326302 - DNA, 25 bp, Mus musculus
gagcctgcggtccaactgcgctgct

SEQ ID NO: 326303 - DNA, 25 bp, Mus musculus
catggaccaggcagtagagctagct

SEQ ID NO: 326304 - DNA, 25 bp, Mus musculus
agactctggctgactcctcccgaag

SEQ ID NO: 326305 - DNA, 25 bp, Mus musculus
tcctcccgaagctccggagagaggc

SEQ ID NO: 326306 - DNA, 25 bp, Mus musculus
atggcctgccctgggactatggact

SEQ ID NO: 326307 - DNA, 25 bp, Mus musculus
tatggactcggactggctttgtcga

SEQ ID NO: 326308 - DNA, 25 bp, Mus musculus
actccaagtagagcggcaggactcg

SEQ ID NO: 326309 - DNA, 25 bp, Mus musculus
catgctattagaacatggaccaggc

SEQ ID NO: 326310 - DNA, 25 bp, Mus musculus
gctgctcggctgcaaggcctgttct

SEQ ID NO: 326311 - DNA, 25 bp, Mus musculus
ttctgggcccgcgttcagatagcac

SEQ ID NO: 326312 - DNA, 25 bp, Mus musculus
ttcagatagcacttgcgggcctccc

SEQ ID NO: 326313 - DNA, 25 bp, Mus musculus
agccgcgctgctggcgagcagcaac

SEQ ID NO: 326314 - DNA, 25 bp, Mus musculus
gagggcgctctagcccaggacaccg

SEQ ID NO: 326315 - DNA, 25 bp, Mus musculus
tggggaactggtttcccagagctgc

SEQ ID NO: 326316 - DNA, 25 bp, Mus musculus
ttagggactaacaacagaacatgct

SEQ ID NO: 326317 - DNA, 25 bp, Mus musculus
ctgtctgccaagtgccgggagaccc

SEQ ID NO: 326318 - DNA, 25 bp, Mus musculus
gtcctcaccggaccttcggccagcc

SEQ ID NO: 326319 - DNA, 25 bp, Mus musculus
ctccgcaaggaggaaccgctgggaa

SEQ ID NO: 326320 - DNA, 25 bp, Mus musculus
aggcgcctggcgctgtctgccaagt

SEQ ID NO: 326321 - DNA, 25 bp, Mus musculus
tcgctaaggcgcctggcgctgtctg

SEQ ID NO: 326322 - DNA, 25 bp, Mus musculus
tcggacgcagctcgctaaggcgcct

SEQ ID NO: 326323 - DNA, 25 bp, Mus musculus
cgagctcggacgcagctcgctaagg

SEQ ID NO: 326324 - DNA, 25 bp, Mus musculus
tggacccaaggaccctcgcggcgga

SEQ ID NO: 326325 - DNA, 25 bp, Mus musculus
gctggacggtccctggacccaagga

SEQ ID NO: 326326 - DNA, 25 bp, Mus musculus
ggcgctggacggtccctggacccaa

SEQ ID NO: 326327 - DNA, 25 bp, Mus musculus
tcctcgcggcccttggggagcctcc

SEQ ID NO: 326328 - DNA, 25 bp, Mus musculus
ttgcgctctaccgcgcctcgggaag

SEQ ID NO: 326329 - DNA, 25 bp, Mus musculus
gagcccgcgcgctcttgcgctctac

SEQ ID NO: 326330 - DNA, 25 bp, Mus musculus
gcttctcggtcgtctagcggcaccg

SEQ ID NO: 326331 - DNA, 25 bp, Mus musculus
gcggactctaaagccgcggacccgc

SEQ ID NO: 326332 - DNA, 25 bp, Mus musculus
cccattcagggcagtcctgaccacc

SEQ ID NO: 326333 - DNA, 25 bp, Mus musculus
gggcagtcctgaccacccccttcca

SEQ ID NO: 326334 - DNA, 25 bp, Mus musculus
tccaagcgcccgcacaggagtggac

SEQ ID NO: 326335 - DNA, 25 bp, Mus musculus
tcggcggactctaaagccgcggacc

SEQ ID NO: 326336 - DNA, 25 bp, Mus musculus
cgctcatcgcgccagtgagccccaa

SEQ ID NO: 326337 - DNA, 25 bp, Mus musculus
gacagggcgcgcgaccggagctggt

SEQ ID NO: 326338 - DNA, 25 bp, Mus musculus
agccgcgaagatggccgagcggagc

SEQ ID NO: 326339 - DNA, 25 bp, Mus musculus
gggaggcgcccagctactgcggccg

SEQ ID NO: 326340 - DNA, 25 bp, Mus musculus
cactcggcggactctaaagccgcgg

SEQ ID NO: 326341 - DNA, 25 bp, Mus musculus
caagcgcccgcacaggagtggaccg

SEQ ID NO: 326342 - DNA, 25 bp, Mus musculus
gcgcccgcacaggagtggaccggga

SEQ ID NO: 326343 - DNA, 25 bp, Mus musculus
actcggcggactctaaagccgcgga

SEQ ID NO: 326344 - DNA, 25 bp, Mus musculus
acccgcccattcagggcagtcctga

SEQ ID NO: 326345 - DNA, 25 bp, Mus musculus
tttgaattgtgcgagccgttggatg

SEQ ID NO: 326346 - DNA, 25 bp, Mus musculus
gccgggagaattcgccttcgcgcgc

SEQ ID NO: 326347 - DNA, 25 bp, Mus musculus
cttcgcgcgccttctcattagcatg

SEQ ID NO: 326348 - DNA, 25 bp, Mus musculus
ttctcattagcatgggcaagcctcc

SEQ ID NO: 326349 - DNA, 25 bp, Mus musculus
atgggcaagcctcctcccagcgtgt

SEQ ID NO: 326350 - DNA, 25 bp, Mus musculus
tcctcccagcgtgtggcctgttggg

SEQ ID NO: 326351 - DNA, 25 bp, Mus musculus
cacgcctccgcggacgtgcaggacc

SEQ ID NO: 326352 - DNA, 25 bp, Mus musculus
tgcaggaccgggagttgttttcctg

SEQ ID NO: 326353 - DNA, 25 bp, Mus musculus
gcgcgcacgcccgaacttcattccc

SEQ ID NO: 326354 - DNA, 25 bp, Mus musculus
aaagccaaggcgcagacgcagcctc

SEQ ID NO: 326355 - DNA, 25 bp, Mus musculus
cgcaaacggaagtggacgacgaatt

SEQ ID NO: 326356 - DNA, 25 bp, Mus musculus
cggaagtggacgacgaatttgaatt

SEQ ID NO: 326357 - DNA, 25 bp, Mus musculus
cgaatttgaattgtgcgagccgttg

SEQ ID NO: 326358 - DNA, 25 bp, Mus musculus
ggggcttctccacgcgctggacgtc

SEQ ID NO: 326359 - DNA, 25 bp, Mus musculus
tagggccacgtcatcttcgggctcc

SEQ ID NO: 326360 - DNA, 25 bp, Mus musculus
cgcccatgccctgagaagcggttta

SEQ ID NO: 326361 - DNA, 25 bp, Mus musculus
tcctggttctgcttccggcgcggga

SEQ ID NO: 326362 - DNA, 25 bp, Mus musculus
ggctgccgccatagcccgcctcctg

SEQ ID NO: 326363 - DNA, 25 bp, Mus musculus
accaatgtctgtgaggaaaggcgag

SEQ ID NO: 326364 - DNA, 25 bp, Mus musculus
ctgcaaacaccaatgtctgtgagga

SEQ ID NO: 326365 - DNA, 25 bp, Mus musculus
tgggaaatctgcaaacaccaatgtc

SEQ ID NO: 326366 - DNA, 25 bp, Mus musculus
cgctgctgggaaatctgcaaacacc

SEQ ID NO: 326367 - DNA, 25 bp, Mus musculus
ttagaaacgctgctgggaaatctgc

SEQ ID NO: 326368 - DNA, 25 bp, Mus musculus
cccgattagttagaaacgctgctgg

SEQ ID NO: 326369 - DNA, 25 bp, Mus musculus
agcggtttaagagtagcgacctcgg

SEQ ID NO: 326370 - DNA, 25 bp, Mus musculus
ccctgagaagcggtttaagagtagc

SEQ ID NO: 326371 - DNA, 25 bp, Mus musculus
ccatgccctgagaagcggtttaaga

SEQ ID NO: 326372 - DNA, 25 bp, Mus musculus
ctcccagtgccagccgggcagtgga

SEQ ID NO: 326373 - DNA, 25 bp, Mus musculus
tggtgcctggacatctcggtgggcc

SEQ ID NO: 326374 - DNA, 25 bp, Mus musculus
atctctttcgaagcggctgtggtgc

SEQ ID NO: 326375 - DNA, 25 bp, Mus musculus
ggtaatctctttcgaagcggctgtg

SEQ ID NO: 326376 - DNA, 25 bp, Mus musculus
atgcggtaatctctttcgaagcggc

SEQ ID NO: 326377 - DNA, 25 bp, Mus musculus
ccagcctatgcggtaatctctttcg

SEQ ID NO: 326378 - DNA, 25 bp, Mus musculus
ttgcgctgagactgctggctgtgct

SEQ ID NO: 326379 - DNA, 25 bp, Mus musculus
gcggtcccagcctatgcggtaatct

SEQ ID NO: 326380 - DNA, 25 bp, Mus musculus
gacgctccactcacggcggtcccag

SEQ ID NO: 326381 - DNA, 25 bp, Mus musculus
gtgggtcccattgacgctccactca

SEQ ID NO: 326382 - DNA, 25 bp, Mus musculus
caccggaggtgacgctgcagacgct

SEQ ID NO: 326383 - DNA, 25 bp, Mus musculus
caccagcaccggaggtgacgctgca

SEQ ID NO: 326384 - DNA, 25 bp, Mus musculus
tggctgtgctgccaccagcaccgga

SEQ ID NO: 326385 - DNA, 25 bp, Mus musculus
taccacaggcagtggtaggaggccc

SEQ ID NO: 326386 - DNA, 25 bp, Mus musculus
aggcccggtcttgcgctgagactgc

SEQ ID NO: 326387 - DNA, 25 bp, Mus musculus
ccacatgtacggcaaggacaaagtg

SEQ ID NO: 326388 - DNA, 25 bp, Mus musculus
cgcatcaggtggctggccacatgta

SEQ ID NO: 326389 - DNA, 25 bp, Mus musculus
cccgatccagtagggtagcctctgg

SEQ ID NO: 326390 - DNA, 25 bp, Mus musculus
gatcctggcgagtagctgttgcgca

SEQ ID NO: 326391 - DNA, 25 bp, Mus musculus
catgctcagagtggagctcgcccgg

SEQ ID NO: 326392 - DNA, 25 bp, Mus musculus
gctgcgtgccgctgtcgcatcaggt

SEQ ID NO: 326393 - DNA, 25 bp, Mus musculus
tccggtagcttctgcgcatgatcag

SEQ ID NO: 326394 - DNA, 25 bp, Mus musculus
cgagtagctgttgcgcatgctcaga

SEQ ID NO: 326395 - DNA, 25 bp, Mus musculus
acccgctcagtttggcgctggtcta

SEQ ID NO: 326396 - DNA, 25 bp, Mus musculus
tgggactctagacccgctcagtttg

SEQ ID NO: 326397 - DNA, 25 bp, Mus musculus
cgcatgatcagtgtggagctggccc

SEQ ID NO: 326398 - DNA, 25 bp, Mus musculus
cgctggtctaccttctggacgtgtt

SEQ ID NO: 326399 - DNA, 25 bp, Mus musculus
taccttctggacgtgttccgtggaa

SEQ ID NO: 326400 - DNA, 25 bp, Mus musculus
tgagcaggtctggtccggtagcttc

SEQ ID NO: 326401 - DNA, 25 bp, Mus musculus
tcagttcccgcaggctagggacctg

SEQ ID NO: 326402 - DNA, 25 bp, Mus musculus
aggacagggtcagttcccgcaggct

SEQ ID NO: 326403 - DNA, 25 bp, Mus musculus
ttgcctgtttttccacgccagggtc

SEQ ID NO: 326404 - DNA, 25 bp, Mus musculus
tctctccgcaggtgcgtggctgctg

SEQ ID NO: 326405 - DNA, 25 bp, Mus musculus
tgctctctgcctcggtgggtacact

SEQ ID NO: 326406 - DNA, 25 bp, Mus musculus
gcgctccgacgccttttcccatcaa

SEQ ID NO: 326407 - DNA, 25 bp, Mus musculus
ccattcgtcccgagttactccgttg

SEQ ID NO: 326408 - DNA, 25 bp, Mus musculus
gaagaggcgccagtccgctggcctc

SEQ ID NO: 326409 - DNA, 25 bp, Mus musculus
ccacgctggtccgaggtggcacagc

SEQ ID NO: 326410 - DNA, 25 bp, Mus musculus
cacagcgcgtctggagctgctcgaa

SEQ ID NO: 326411 - DNA, 25 bp, Mus musculus
ctgctcgaactgcagcggtcgggtt

SEQ ID NO: 326412 - DNA, 25 bp, Mus musculus
aggtccacggagatcctcgccatgc

SEQ ID NO: 326413 - DNA, 25 bp, Mus musculus
gccgctaagtgtccctaggcgtttc

SEQ ID NO: 326414 - DNA, 25 bp, Mus musculus
gcagccctcgggcttgcctgttttt

SEQ ID NO: 326415 - DNA, 25 bp, Mus musculus
gcccactcgtgctggatgtagtgta

SEQ ID NO: 326416 - DNA, 25 bp, Mus musculus
tgccgtgtgcttgccgcggatcaga

SEQ ID NO: 326417 - DNA, 25 bp, Mus musculus
ggcgcagtgccagacgccgacagct

SEQ ID NO: 326418 - DNA, 25 bp, Mus musculus
cagctcgtccattgtgtgtggggcc

SEQ ID NO: 326419 - DNA, 25 bp, Mus musculus
cgtgctggatgtagtgtaggatccc

SEQ ID NO: 326420 - DNA, 25 bp, Mus musculus
atctcgaagcgagcccactcgtgct

SEQ ID NO: 326421 - DNA, 25 bp, Mus musculus
acgggtgacgtacctgcagctcggc

SEQ ID NO: 326422 - DNA, 25 bp, Mus musculus
atgctaaaagccaaaatggctgccc

SEQ ID NO: 326423 - DNA, 25 bp, Mus musculus
ctgcggacgccatgctaaaagccaa

SEQ ID NO: 326424 - DNA, 25 bp, Mus musculus
aaactcagtgcctagcgggcccacg

SEQ ID NO: 326425 - DNA, 25 bp, Mus musculus
ggggacccacaagcgcaaactcagt

SEQ ID NO: 326426 - DNA, 25 bp, Mus musculus
gaggcaaagacgctcatcccaggcc

SEQ ID NO: 326427 - DNA, 25 bp, Mus musculus
agccaggaggcaaagacgctcatcc

SEQ ID NO: 326428 - DNA, 25 bp, Mus musculus
atcgtgtactgttgcggccgggaca

SEQ ID NO: 326429 - DNA, 25 bp, Mus musculus
gccgcggccctcgagttcctaggaa

SEQ ID NO: 326430 - DNA, 25 bp, Mus musculus
cggaacggaggccaccgtctcgcag

SEQ ID NO: 326431 - DNA, 25 bp, Mus musculus
ggcggtcggctacggctctcctcag

SEQ ID NO: 326432 - DNA, 25 bp, Mus musculus
caggaaaagccgtgtctcgtccctc

SEQ ID NO: 326433 - DNA, 25 bp, Mus musculus
ccaggcaggcggcacaggaaaagcc

SEQ ID NO: 326434 - DNA, 25 bp, Mus musculus
cctcgagttcctaggaaaccgcagg

SEQ ID NO: 326435 - DNA, 25 bp, Mus musculus
tggctcgccgtaccaaacagctccg

SEQ ID NO: 326436 - DNA, 25 bp, Mus musculus
aagaccgacctcaccgcgctggggt

SEQ ID NO: 326437 - DNA, 25 bp, Mus musculus
caaagggcccgatacgcagaggcga

SEQ ID NO: 326438 - DNA, 25 bp, Mus musculus
gagctccgaagccaacaagccaagc

SEQ ID NO: 326439 - DNA, 25 bp, Mus musculus
tgagccttaccaaggacaaggagcg

SEQ ID NO: 326440 - DNA, 25 bp, Mus musculus
ggcggctgagccttaccaaggacaa

SEQ ID NO: 326441 - DNA, 25 bp, Mus musculus
acaaggagcgcgtagccggagctcc

SEQ ID NO: 326442 - DNA, 25 bp, Mus musculus
cgtagccggagctccgaagccaaca

SEQ ID NO: 326443 - DNA, 25 bp, Mus musculus
gcgtgactactccaccgccgagaga

SEQ ID NO: 326444 - DNA, 25 bp, Mus musculus
gctttccttcttaagaagacctgga

SEQ ID NO: 326445 - DNA, 25 bp, Mus musculus
gcacactgtggcaggcgtgactact

SEQ ID NO: 326446 - DNA, 25 bp, Mus musculus
cgacgagccagggagcgcacactgt

SEQ ID NO: 326447 - DNA, 25 bp, Mus musculus
tgcctgcagagacgccctgagctca

SEQ ID NO: 326448 - DNA, 25 bp, Mus musculus
cggcttgcctgcagagacgccctga

SEQ ID NO: 326449 - DNA, 25 bp, Mus musculus
ttcctctccggatctcccggcttgc

SEQ ID NO: 326450 - DNA, 25 bp, Mus musculus
agacctggaaacttctggcaacgtc

SEQ ID NO: 326451 - DNA, 25 bp, Mus musculus
aggaaacccgccacgccgcagtcag

SEQ ID NO: 326452 - DNA, 25 bp, Mus musculus
tacctgttgggctgaggaggaaacc

SEQ ID NO: 326453 - DNA, 25 bp, Mus musculus
cccgcctacctgttgggctgaggag

SEQ ID NO: 326454 - DNA, 25 bp, Mus musculus
caacgtccactctctgctgctgggg

SEQ ID NO: 326455 - DNA, 25 bp, Mus musculus
aacttctggcaacgtccactctctg

SEQ ID NO: 326456 - DNA, 25 bp, Mus musculus
tgtcccgtctgtgcctgcagccggg

SEQ ID NO: 326457 - DNA, 25 bp, Mus musculus
aggcgcctcccactgctcgtggccc

SEQ ID NO: 326458 - DNA, 25 bp, Mus musculus
gggtaggcgcctcccactgctcgtg

SEQ ID NO: 326459 - DNA, 25 bp, Mus musculus
ctgcgcatgctcgggtaggcgcctc

SEQ ID NO: 326460 - DNA, 25 bp, Mus musculus
catggcgcgggtccgcactgcgcat

SEQ ID NO: 326461 - DNA, 25 bp, Mus musculus
ggccacacgaccaccgtccgccatg

SEQ ID NO: 326462 - DNA, 25 bp, Mus musculus
gcctgggccacacgaccaccgtccg

SEQ ID NO: 326463 - DNA, 25 bp, Mus musculus
actgctgcaggagcgcacgagcctg

SEQ ID NO: 326464 - DNA, 25 bp, Mus musculus
cacttgcaggcgagcgtgcaggcac

SEQ ID NO: 326465 - DNA, 25 bp, Mus musculus
tccatcggccgggcgcacttgcagg

SEQ ID NO: 326466 - DNA, 25 bp, Mus musculus
ggcgttacctccacccactgcgccg

SEQ ID NO: 326467 - DNA, 25 bp, Mus musculus
gccgggcgttacctccacccactgc

SEQ ID NO: 326468 - DNA, 25 bp, Mus musculus
tgctcgtggccccacctaagtgggc

SEQ ID NO: 326469 - DNA, 25 bp, Mus musculus
acttgcaggcgagcgtgcaggcact

SEQ ID NO: 326470 - DNA, 25 bp, Mus musculus
gcactgctgcaggagcgcacgagcc

SEQ ID NO: 326471 - DNA, 25 bp, Mus musculus
gccacgtgacgtcatttttccgcgc

SEQ ID NO: 326472 - DNA, 25 bp, Mus musculus
tgccacgtgacgtcatttttccgcg

SEQ ID NO: 326473 - DNA, 25 bp, Mus musculus
acgtgacgtcatttttccgcgccgg

SEQ ID NO: 326474 - DNA, 25 bp, Mus musculus
tgacgtcatttttccgcgccggacg

SEQ ID NO: 326475 - DNA, 25 bp, Mus musculus
cgcgccggacgccaagtgcttccat

SEQ ID NO: 326476 - DNA, 25 bp, Mus musculus
gccaagtgcttccatcccggcccga

SEQ ID NO: 326477 - DNA, 25 bp, Mus musculus
tgggcgccaggtgtgtgccgagcgc

SEQ ID NO: 326478 - DNA, 25 bp, Mus musculus
caagagccgcgcgccatggggacct

SEQ ID NO: 326479 - DNA, 25 bp, Mus musculus
acctggcggcgtttgctgctctttg

SEQ ID NO: 326480 - DNA, 25 bp, Mus musculus
ttgctgctctttggcggggtgtcac

SEQ ID NO: 326481 - DNA, 25 bp, Mus musculus
tgtcactccggggtggtggcgcggc

SEQ ID NO: 326482 - DNA, 25 bp, Mus musculus
gccgagctttgggttgtgggcgcca

SEQ ID NO: 326483 - DNA, 25 bp, Mus musculus
atcccggcccgagcaagagccgcgc

SEQ ID NO: 326484 - DNA, 25 bp, Mus musculus
ggttgccacgtgacgtcatttttcc

SEQ ID NO: 326485 - DNA, 25 bp, Mus musculus
cagggaaggctcggcgaccatgctc

SEQ ID NO: 326486 - DNA, 25 bp, Mus musculus
caaataccgaaggaaggcaagggag

SEQ ID NO: 326487 - DNA, 25 bp, Mus musculus
tacggccaaataccgaaggaaggca

SEQ ID NO: 326488 - DNA, 25 bp, Mus musculus
caggactccgagttacggccaaata

SEQ ID NO: 326489 - DNA, 25 bp, Mus musculus
ctttgcaggactccgagttacggcc

SEQ ID NO: 326490 - DNA, 25 bp, Mus musculus
agttcctttgcaggactccgagtta

SEQ ID NO: 326491 - DNA, 25 bp, Mus musculus
cacaacattgagttcctttgcagga

SEQ ID NO: 326492 - DNA, 25 bp, Mus musculus
gccatgccttgcaacggctaacaca

SEQ ID NO: 326493 - DNA, 25 bp, Mus musculus
cgatcggcgcccaagccatgccttg

SEQ ID NO: 326494 - DNA, 25 bp, Mus musculus
accatgctcggcgtgaggcgcctga

SEQ ID NO: 326495 - DNA, 25 bp, Mus musculus
acattgagttcctttgcaggactcc

SEQ ID NO: 326496 - DNA, 25 bp, Mus musculus
ccttgcaacggctaacacaacattg

SEQ ID NO: 326497 - DNA, 25 bp, Mus musculus
tgcaacggctaacacaacattgagt

SEQ ID NO: 326498 - DNA, 25 bp, Mus musculus
ggagagcggaggaaaaccactcacg

SEQ ID NO: 326499 - DNA, 25 bp, Mus musculus
tgctgatcgccgagctcgtgccggc

SEQ ID NO: 326500 - DNA, 25 bp, Mus musculus
cttttttcttatctcctcggctcct

SEQ ID NO: 326501 - DNA, 25 bp, Mus musculus
caggaccgcggcttgcaaacttaac

SEQ ID NO: 326502 - DNA, 25 bp, Mus musculus
tccgcagacacaggaccgcggcttg

SEQ ID NO: 326503 - DNA, 25 bp, Mus musculus
ggcgcggatccgcagacacaggacc

SEQ ID NO: 326504 - DNA, 25 bp, Mus musculus
tgctaacgagttccacctggaaggg

SEQ ID NO: 326505 - DNA, 25 bp, Mus musculus
tgctgctaacgagttccacctggaa

SEQ ID NO: 326506 - DNA, 25 bp, Mus musculus
gccaccttcacttgtccggggcttg

SEQ ID NO: 326507 - DNA, 25 bp, Mus musculus
cggaggcctgctgatcgccgagctc

SEQ ID NO: 326508 - DNA, 25 bp, Mus musculus
ggccgctttctccacaggtgaccgg

SEQ ID NO: 326509 - DNA, 25 bp, Mus musculus
cggttgtaaccagttgaaggggctg

SEQ ID NO: 326510 - DNA, 25 bp, Mus musculus
aggacctcggagagcccgctgcgcg

SEQ ID NO: 326511 - DNA, 25 bp, Mus musculus
ggagcgctccccaggaatgtcgctg

SEQ ID NO: 326512 - DNA, 25 bp, Mus musculus
accttcacttgtccggggcttggag

SEQ ID NO: 326513 - DNA, 25 bp, Mus musculus
tcccgtccgagctgggatagtgccc

SEQ ID NO: 326514 - DNA, 25 bp, Mus musculus
cggcgatgatccgaatctttccgga

SEQ ID NO: 326515 - DNA, 25 bp, Mus musculus
gcccgctgcgcgcacatcaaagcgc

SEQ ID NO: 326516 - DNA, 25 bp, Mus musculus
tcaaagcgcctctccgccgcgcaca

SEQ ID NO: 326517 - DNA, 25 bp, Mus musculus
agtggccgcggctcactaatgggat

SEQ ID NO: 326518 - DNA, 25 bp, Mus musculus
cgcggctcactaatgggattgcagg

SEQ ID NO: 326519 - DNA, 25 bp, Mus musculus
ccaagccgcggcgatgatccgaatc

SEQ ID NO: 326520 - DNA, 25 bp, Mus musculus
gccgcggcgatgatccgaatctttc

SEQ ID NO: 326521 - DNA, 25 bp, Mus musculus
gagtagtcccgtccgagctgggata

SEQ ID NO: 326522 - DNA, 25 bp, Mus musculus
gaatctttccggatttcagcgtgca

SEQ ID NO: 326523 - DNA, 25 bp, Mus musculus
tttccggatttcagcgtgcaggtga

SEQ ID NO: 326524 - DNA, 25 bp, Mus musculus
cccgcagaacgtccagggcatcacc

SEQ ID NO: 326525 - DNA, 25 bp, Mus musculus
cacctcctaccagcagcggtgagta

SEQ ID NO: 326526 - DNA, 25 bp, Mus musculus
taccagcagcggtgagtagtcccgt

SEQ ID NO: 326527 - DNA, 25 bp, Mus musculus
cagactggatgcatcgctgacccac

SEQ ID NO: 326528 - DNA, 25 bp, Mus musculus
tgcagactggatgcatcgctgaccc

SEQ ID NO: 326529 - DNA, 25 bp, Mus musculus
actggatgcatcgctgacccacgcg

SEQ ID NO: 326530 - DNA, 25 bp, Mus musculus
gactggatgcatcgctgacccacgc

SEQ ID NO: 326531 - DNA, 25 bp, Mus musculus
ctgcagactggatgcatcgctgacc

SEQ ID NO: 326532 - DNA, 25 bp, Mus musculus
gcagactggatgcatcgctgaccca

SEQ ID NO: 326533 - DNA, 25 bp, Mus musculus
ctgctgcagactggatgcatcgctg

SEQ ID NO: 326534 - DNA, 25 bp, Mus musculus
cactgctgcagactggatgcatcgc

SEQ ID NO: 326535 - DNA, 25 bp, Mus musculus
ccactgctgcagactggatgcatcg

SEQ ID NO: 326536 - DNA, 25 bp, Mus musculus
gctgcagactggatgcatcgctgac

SEQ ID NO: 326537 - DNA, 25 bp, Mus musculus
agactggatgcatcgctgacccacg

SEQ ID NO: 326538 - DNA, 25 bp, Mus musculus
ccactgctgcagactggatgcgtcg

SEQ ID NO: 326539 - DNA, 25 bp, Mus musculus
tggatgcatcgctgacccacgcgcc

SEQ ID NO: 326540 - DNA, 25 bp, Mus musculus
actgctgcagactggatgcatcgct

SEQ ID NO: 326541 - DNA, 25 bp, Mus musculus
aaacgctggagcaagacaacgggtg

SEQ ID NO: 326542 - DNA, 25 bp, Mus musculus
agactttgctcacgtgttccctagc

SEQ ID NO: 326543 - DNA, 25 bp, Mus musculus
tgttccctagcaacacagtcgatga

SEQ ID NO: 326544 - DNA, 25 bp, Mus musculus
ggtctgaagcatctaattgccgtgc

SEQ ID NO: 326545 - DNA, 25 bp, Mus musculus
cccggaagcggaagtacggatgata

SEQ ID NO: 326546 - DNA, 25 bp, Mus musculus
tgcccaactggaaaaggtgttctac

SEQ ID NO: 326547 - DNA, 25 bp, Mus musculus
cacagtcgatgaggggtatgtttac

SEQ ID NO: 326548 - DNA, 25 bp, Mus musculus
acaacgggtggagaagcatgtccca

SEQ ID NO: 326549 - DNA, 25 bp, Mus musculus
cttccctgaaagtcgaaacgctgga

SEQ ID NO: 326550 - DNA, 25 bp, Mus musculus
cgaaggcgtactcgaggcacagaaa

SEQ ID NO: 326551 - DNA, 25 bp, Mus musculus
atgtcggtgggcaagagcttatcga

SEQ ID NO: 326552 - DNA, 25 bp, Mus musculus
ataacaacttccacctgttcggcgc

SEQ ID NO: 326553 - DNA, 25 bp, Mus musculus
cggacggcctggagtgcaataacaa

SEQ ID NO: 326554 - DNA, 25 bp, Mus musculus
aacggaaacgtgcttgcccaactgg

SEQ ID NO: 326555 - DNA, 25 bp, Mus musculus
tgggatccagtgaagaaacccggtc

SEQ ID NO: 326556 - DNA, 25 bp, Mus musculus
ggagaaacggatccaggtccacctc

SEQ ID NO: 326557 - DNA, 25 bp, Mus musculus
aacctgatccggctcttacctgcgg

SEQ ID NO: 326558 - DNA, 25 bp, Mus musculus
tggcccagaagctaccaggaccctg

SEQ ID NO: 326559 - DNA, 25 bp, Mus musculus
aagggcttctgcaggcttgcgagct

SEQ ID NO: 326560 - DNA, 25 bp, Mus musculus
ttgcttctagcaccttcgaccactg

SEQ ID NO: 326561 - DNA, 25 bp, Mus musculus
gactctggtgtcgtatttgcttcta

SEQ ID NO: 326562 - DNA, 25 bp, Mus musculus
gtcatctagcttcccttggcacaca

SEQ ID NO: 326563 - DNA, 25 bp, Mus musculus
cagtctttctgcctgtcagcctgcg

SEQ ID NO: 326564 - DNA, 25 bp, Mus musculus
gctcttccacctcgaaagttacttg

SEQ ID NO: 326565 - DNA, 25 bp, Mus musculus
acacggtctgtgtgggttccattca

SEQ ID NO: 326566 - DNA, 25 bp, Mus musculus
cccgctggaaaccacaaggtgtcaa

SEQ ID NO: 326567 - DNA, 25 bp, Mus musculus
cccaaatgctgggtctaagaacgcg

SEQ ID NO: 326568 - DNA, 25 bp, Mus musculus
cgagtggcagaacccgtcatctagc

SEQ ID NO: 326569 - DNA, 25 bp, Mus musculus
agggtctacaccacgggcactatcc

SEQ ID NO: 326570 - DNA, 25 bp, Mus musculus
ctcacgtcggacagcgccaaggact

SEQ ID NO: 326571 - DNA, 25 bp, Mus musculus
agcgcctctgtgctcaagatcaaga

SEQ ID NO: 326572 - DNA, 25 bp, Mus musculus
acttcgacaacgacagcagcatctg

SEQ ID NO: 326573 - DNA, 25 bp, Mus musculus
ccgggagatctccaggaacgaatcc

SEQ ID NO: 326574 - DNA, 25 bp, Mus musculus
gcaagactcagttcagcggcacagc

SEQ ID NO: 326575 - DNA, 25 bp, Mus musculus
agcacagccgcacagagggtctaca

SEQ ID NO: 326576 - DNA, 25 bp, Mus musculus
tccttgctgtacactggggacctgg

SEQ ID NO: 326577 - DNA, 25 bp, Mus musculus
cgtgcaccgactcaacatgtcagga

SEQ ID NO: 326578 - DNA, 25 bp, Mus musculus
atggagatgctctaccaccacgtgc

SEQ ID NO: 326579 - DNA, 25 bp, Mus musculus
cgtggacgttaacagcccaggcttt

SEQ ID NO: 326580 - DNA, 25 bp, Mus musculus
acgcgcatgctgttaacttcgtgga

SEQ ID NO: 326581 - DNA, 25 bp, Mus musculus
ctggtgcatccaactccttgctgta

SEQ ID NO: 326582 - DNA, 25 bp, Mus musculus
tatccgctacgcacccgctgaggtg

SEQ ID NO: 326583 - DNA, 25 bp, Mus musculus
agcagaagccgacctcgtgcagaca

SEQ ID NO: 326584 - DNA, 25 bp, Mus musculus
atccacgtgatctggtcgcctcgca

SEQ ID NO: 326585 - DNA, 25 bp, Mus musculus
cccgttgtagtgcagctgcttgact

SEQ ID NO: 326586 - DNA, 25 bp, Mus musculus
cgaaggcgacacaacactccgaatg

SEQ ID NO: 326587 - DNA, 25 bp, Mus musculus
cctcgcctaggaagttgtccaggta

SEQ ID NO: 326588 - DNA, 25 bp, Mus musculus
ttgacatagtatttgcccagccggc

SEQ ID NO: 326589 - DNA, 25 bp, Mus musculus
gtactccagggcgatcttctccaga

SEQ ID NO: 326590 - DNA, 25 bp, Mus musculus
tccagatccagcctcatgatgtgtc

SEQ ID NO: 326591 - DNA, 25 bp, Mus musculus
ccactttagctccagaggcggggaa

SEQ ID NO: 326592 - DNA, 25 bp, Mus musculus
cggggaaagttgctcgaaactctga

SEQ ID NO: 326593 - DNA, 25 bp, Mus musculus
ctctgaagagaagggatcccggctc

SEQ ID NO: 326594 - DNA, 25 bp, Mus musculus
ccctttttggagatgcagagccacc

SEQ ID NO: 326595 - DNA, 25 bp, Mus musculus
ggaacgagagaaagcaccgccttga

SEQ ID NO: 326596 - DNA, 25 bp, Mus musculus
ccttggaccgctccttgacatagta

SEQ ID NO: 326597 - DNA, 25 bp, Mus musculus
gcgagagcgtgagtcagcaccatct

SEQ ID NO: 326598 - DNA, 25 bp, Mus musculus
ctgctcggtgaaccctgcccacctc

SEQ ID NO: 326599 - DNA, 25 bp, Mus musculus
agcaccatctgctcggtgaaccctg

SEQ ID NO: 326600 - DNA, 25 bp, Mus musculus
gtcagcaccatctgctcggtgaacc

SEQ ID NO: 326601 - DNA, 25 bp, Mus musculus
tgagtcagcaccatctgctcggtga

SEQ ID NO: 326602 - DNA, 25 bp, Mus musculus
gcttagcccgcctgcgggttccaca

SEQ ID NO: 326603 - DNA, 25 bp, Mus musculus
agagcgtgagtcagcaccatctgct

SEQ ID NO: 326604 - DNA, 25 bp, Mus musculus
ccaaggctcacgtagcgagagcgtg

SEQ ID NO: 326605 - DNA, 25 bp, Mus musculus
ccaccaaggctcacgtagcgagagc

SEQ ID NO: 326606 - DNA, 25 bp, Mus musculus
tgccaccaaggctcacgtagcgaga

SEQ ID NO: 326607 - DNA, 25 bp, Mus musculus
cgggcaggtagccaggcaccaggca

SEQ ID NO: 326608 - DNA, 25 bp, Mus musculus
gcgtgagtcagcaccatctgctcgg

SEQ ID NO: 326609 - DNA, 25 bp, Mus musculus
agtccctcggggtgagccgcgggca

SEQ ID NO: 326610 - DNA, 25 bp, Mus musculus
aggcaggactcagtcccggtcccgc

SEQ ID NO: 326611 - DNA, 25 bp, Mus musculus
attgcgtacaagacccggatctccg

SEQ ID NO: 326612 - DNA, 25 bp, Mus musculus
tggccaagcggccacttcgtgtgct

SEQ ID NO: 326613 - DNA, 25 bp, Mus musculus
cggtctgggtttaagtgctagttct

SEQ ID NO: 326614 - DNA, 25 bp, Mus musculus
tgctagttctgcatctccacgcgca

SEQ ID NO: 326615 - DNA, 25 bp, Mus musculus
ccacgcgcacgcatggcggttgcaa

SEQ ID NO: 326616 - DNA, 25 bp, Mus musculus
aggacatctgcttccatgctcgcgc

SEQ ID NO: 326617 - DNA, 25 bp, Mus musculus
ccagcaggtactggtagtagaacca

SEQ ID NO: 326618 - DNA, 25 bp, Mus musculus
tcctcctggcttgcgcttattggcc

SEQ ID NO: 326619 - DNA, 25 bp, Mus musculus
gccaggccaggacacacaggatact

SEQ ID NO: 326620 - DNA, 25 bp, Mus musculus
tgcctccaccttgggcaggggaatt

SEQ ID NO: 326621 - DNA, 25 bp, Mus musculus
tactgaacacggttcgctcccaggg

SEQ ID NO: 326622 - DNA, 25 bp, Mus musculus
tccagcatgtagagcgcagtgacca

SEQ ID NO: 326623 - DNA, 25 bp, Mus musculus
ttgcagaaatcaggatgcctccacc

SEQ ID NO: 326624 - DNA, 25 bp, Mus musculus
ccgaagcgggacaaggatagcacca

SEQ ID NO: 326625 - DNA, 25 bp, Mus musculus
tgcggagggtcaatgttaacacgtc

SEQ ID NO: 326626 - DNA, 25 bp, Mus musculus
ttccaccgcgtacgggtcatagtca

SEQ ID NO: 326627 - DNA, 25 bp, Mus musculus
ccgctgaaaatagcagttgtctttg

SEQ ID NO: 326628 - DNA, 25 bp, Mus musculus
atggcgacctgaggacgcctacacc

SEQ ID NO: 326629 - DNA, 25 bp, Mus musculus
tcctggagtcggttcatggcgacct

SEQ ID NO: 326630 - DNA, 25 bp, Mus musculus
tacgggtcatagtcatcctggagtc

SEQ ID NO: 326631 - DNA, 25 bp, Mus musculus
ggcgcgaacaacacaacggcctcag

SEQ ID NO: 326632 - DNA, 25 bp, Mus musculus
agtgaagcggacgacactgcgccca

SEQ ID NO: 326633 - DNA, 25 bp, Mus musculus
ccgaggctcccgcaagtgaagcgga

SEQ ID NO: 326634 - DNA, 25 bp, Mus musculus
gtactgcgagtccttcctgtgcgcc

SEQ ID NO: 326635 - DNA, 25 bp, Mus musculus
cctgcgcaagccgtccagtgacaag

SEQ ID NO: 326636 - DNA, 25 bp, Mus musculus
ccagtgacaaggatgcaagagacgg

SEQ ID NO: 326637 - DNA, 25 bp, Mus musculus
gtctctacgttttcttttccgctga

SEQ ID NO: 326638 - DNA, 25 bp, Mus musculus
tgtgcatttttcttctcgccgccgc

SEQ ID NO: 326639 - DNA, 25 bp, Mus musculus
gcttcattcacttgcgctttccacg

SEQ ID NO: 326640 - DNA, 25 bp, Mus musculus
taaaaaccttaagccgcgcagggca

SEQ ID NO: 326641 - DNA, 25 bp, Mus musculus
atccgggttcaacgctcgagcggtt

SEQ ID NO: 326642 - DNA, 25 bp, Mus musculus
ggtagagagctctttgcttcattca

SEQ ID NO: 326643 - DNA, 25 bp, Mus musculus
accttaccatagtgcccgcggctga

SEQ ID NO: 326644 - DNA, 25 bp, Mus musculus
gtaccaaccttacagcgcgcgagtt

SEQ ID NO: 326645 - DNA, 25 bp, Mus musculus
aggctgctggccacgtaccaacctt

SEQ ID NO: 326646 - DNA, 25 bp, Mus musculus
tagaccctcacccagaggctgctgg

SEQ ID NO: 326647 - DNA, 25 bp, Mus musculus
atctcctcggaacggcgttatggcc

SEQ ID NO: 326648 - DNA, 25 bp, Mus musculus
acagatcccgtgaaaaggctcccta

SEQ ID NO: 326649 - DNA, 25 bp, Mus musculus
gccgctttgaaactaacagatcccg

SEQ ID NO: 326650 - DNA, 25 bp, Mus musculus
accgcccattggcagccgctttgaa

SEQ ID NO: 326651 - DNA, 25 bp, Mus musculus
gtttctacctgttcaatctcctcgg

SEQ ID NO: 326652 - DNA, 25 bp, Mus musculus
tggtcgtagcgaccaatccgggttc

SEQ ID NO: 326653 - DNA, 25 bp, Mus musculus
ttctgcctcacgaaaggctttcggt

SEQ ID NO: 326654 - DNA, 25 bp, Mus musculus
ggactcgcaacgtgctcgacgcatc

SEQ ID NO: 326655 - DNA, 25 bp, Mus musculus
tcgggctcggagaatccctctccgg

SEQ ID NO: 326656 - DNA, 25 bp, Mus musculus
gagaatccctctccgggctgaggca

SEQ ID NO: 326657 - DNA, 25 bp, Mus musculus
cggccttactcgtagtggcggaaga

SEQ ID NO: 326658 - DNA, 25 bp, Mus musculus
gcggaagatctcgttggtgacttta

SEQ ID NO: 326659 - DNA, 25 bp, Mus musculus
ctgccttttgtgtgacagacgagtc

SEQ ID NO: 326660 - DNA, 25 bp, Mus musculus
tgactttacagtagaaaacttcctc

SEQ ID NO: 326661 - DNA, 25 bp, Mus musculus
tgtgacagacgagtccggtcctccc

SEQ ID NO: 326662 - DNA, 25 bp, Mus musculus
ccggcggcttctgcctcacgaaagg

SEQ ID NO: 326663 - DNA, 25 bp, Mus musculus
cctagcaaattggagggaaaggaga

SEQ ID NO: 326664 - DNA, 25 bp, Mus musculus
gctttcggtgaagcagcggcatctc

SEQ ID NO: 326665 - DNA, 25 bp, Mus musculus
taccaaacgtcagaagccacgcgcg

SEQ ID NO: 326666 - DNA, 25 bp, Mus musculus
agaaaacttcctcgtccggccgcag

SEQ ID NO: 326667 - DNA, 25 bp, Mus musculus
agcttgccgcggcagtgacgtacag

SEQ ID NO: 326668 - DNA, 25 bp, Mus musculus
ggacatctgcgggagccgtagttcc

SEQ ID NO: 326669 - DNA, 25 bp, Mus musculus
taagtcctgacttttcctcgaggtc

SEQ ID NO: 326670 - DNA, 25 bp, Mus musculus
gacttttcctcgaggtcgcacccga

SEQ ID NO: 326671 - DNA, 25 bp, Mus musculus
tctcgctgctagcttgccgcggcag

SEQ ID NO: 326672 - DNA, 25 bp, Mus musculus
gcggcttcagaagccctaggccgcg

SEQ ID NO: 326673 - DNA, 25 bp, Mus musculus
acgtacagggagaacactaaggtca

SEQ ID NO: 326674 - DNA, 25 bp, Mus musculus
ctaaggtcaaaggtcagctccagca

SEQ ID NO: 326675 - DNA, 25 bp, Mus musculus
ggtcagctccagcaaagaaacaccc

SEQ ID NO: 326676 - DNA, 25 bp, Mus musculus
cagatcgtccaatcccgagagccga

SEQ ID NO: 326677 - DNA, 25 bp, Mus musculus
cggactgaaagtccatggcgaagtg

SEQ ID NO: 326678 - DNA, 25 bp, Mus musculus
gtacagctctccgagcggactgaaa

SEQ ID NO: 326679 - DNA, 25 bp, Mus musculus
gccgtagttccgagcaactgaagta

SEQ ID NO: 326680 - DNA, 25 bp, Mus musculus
gcacccgaggaggtcctgtctcgct

SEQ ID NO: 326681 - DNA, 25 bp, Mus musculus
gcagccgctggatatttcgaggtta

SEQ ID NO: 326682 - DNA, 25 bp, Mus musculus
gctttccggggtgacactccagcca

SEQ ID NO: 326683 - DNA, 25 bp, Mus musculus
cctcattttgctcgggcaaggagtg

SEQ ID NO: 326684 - DNA, 25 bp, Mus musculus
gggtgacactccagccaccggttgc

SEQ ID NO: 326685 - DNA, 25 bp, Mus musculus
tcggtgtcctcattttgctcgggca

SEQ ID NO: 326686 - DNA, 25 bp, Mus musculus
ttcgaggttactttcggtgtcctca

SEQ ID NO: 326687 - DNA, 25 bp, Mus musculus
cgctggatatttcgaggttactttc

SEQ ID NO: 326688 - DNA, 25 bp, Mus musculus
cacggcgttccgagacgcgacacgg

SEQ ID NO: 326689 - DNA, 25 bp, Mus musculus
ggactaacctccgtgtcgtcgctgc

SEQ ID NO: 326690 - DNA, 25 bp, Mus musculus
tccagccaccggttgccagagagaa

SEQ ID NO: 326691 - DNA, 25 bp, Mus musculus
gcgacccggtaggatccttcctgcg

SEQ ID NO: 326692 - DNA, 25 bp, Mus musculus
cccgcgtgatcatccggcgcaggta

SEQ ID NO: 326693 - DNA, 25 bp, Mus musculus
ttccgagacgcgacacggcaggtag

SEQ ID NO: 326694 - DNA, 25 bp, Mus musculus
ccaccggttgccagagagaaaacag

SEQ ID NO: 326695 - DNA, 25 bp, Mus musculus
ccggccaatgaaaagaggtgacgtc

SEQ ID NO: 326696 - DNA, 25 bp, Mus musculus
ttgcggagaaaaacaacgctgttgc

SEQ ID NO: 326697 - DNA, 25 bp, Mus musculus
acgctgttgcggagaaaaacaacgc

SEQ ID NO: 326698 - DNA, 25 bp, Mus musculus
cggacgcggagaaaaacgctgttgc

SEQ ID NO: 326699 - DNA, 25 bp, Mus musculus
tccaaaggcgtggtgagcgacagaa

SEQ ID NO: 326700 - DNA, 25 bp, Mus musculus
ggcgggcagtccaggagaatccaaa

SEQ ID NO: 326701 - DNA, 25 bp, Mus musculus
acccagaaaccaatctcgacctagg

SEQ ID NO: 326702 - DNA, 25 bp, Mus musculus
taaagtcctgcccacttacccagaa

SEQ ID NO: 326703 - DNA, 25 bp, Mus musculus
aggtgacgtcatttaaagtcctgcc

SEQ ID NO: 326704 - DNA, 25 bp, Mus musculus
ggaccggaatcgactccggccaatg

SEQ ID NO: 326705 - DNA, 25 bp, Mus musculus
acgctgttgcgacgaaagagtgagt

SEQ ID NO: 326706 - DNA, 25 bp, Mus musculus
ccaggagaatccaaaggcgtggtga

SEQ ID NO: 326707 - DNA, 25 bp, Mus musculus
cgtcatttaaagtcctgcccactta

SEQ ID NO: 326708 - DNA, 25 bp, Mus musculus
aatctcgacctaggcgggcagtcca

SEQ ID NO: 326709 - DNA, 25 bp, Mus musculus
cctcccggagttctgtactctttca

SEQ ID NO: 326710 - DNA, 25 bp, Mus musculus
gacacgggccttagtgcctcggaag

SEQ ID NO: 326711 - DNA, 25 bp, Mus musculus
agacacgggccttagtgcctcggaa

SEQ ID NO: 326712 - DNA, 25 bp, Mus musculus
tagacacgggccttagtgcctcgga

SEQ ID NO: 326713 - DNA, 25 bp, Mus musculus
atagacacgggccttagtgcctcgg

SEQ ID NO: 326714 - DNA, 25 bp, Mus musculus
tctacccttatcggggggagccata

SEQ ID NO: 326715 - DNA, 25 bp, Mus musculus
tcccggagttctgtactctttcacg

SEQ ID NO: 326716 - DNA, 25 bp, Mus musculus
ctcccggagttctgtactctttcac

SEQ ID NO: 326717 - DNA, 25 bp, Mus musculus
acacgggccttagtgcctcggaagc

SEQ ID NO: 326718 - DNA, 25 bp, Mus musculus
cacgggccttagtgcctcggaagcg

SEQ ID NO: 326719 - DNA, 25 bp, Mus musculus
gccttagtgcctcggaagcggaagt

SEQ ID NO: 326720 - DNA, 25 bp, Mus musculus
tgcggaagtcttccccgttcgccac

SEQ ID NO: 326721 - DNA, 25 bp, Mus musculus
ttccccgttcgccacgggcagtgat

SEQ ID NO: 326722 - DNA, 25 bp, Mus musculus
ccttatcggggggagccatagacac

SEQ ID NO: 326723 - DNA, 25 bp, Mus musculus
gtgacgtcagtacaggcggaacttc

SEQ ID NO: 326724 - DNA, 25 bp, Mus musculus
ctttgccgagacgtcggcggacgac

SEQ ID NO: 326725 - DNA, 25 bp, Mus musculus
ggcggacgaccccaataccttgtga

SEQ ID NO: 326726 - DNA, 25 bp, Mus musculus
ccaataccttgtgagtgggcaggtg

SEQ ID NO: 326727 - DNA, 25 bp, Mus musculus
caggtgaggtgatgctgccagtact

SEQ ID NO: 326728 - DNA, 25 bp, Mus musculus
tgctgccagtactgtgtggtttgtc

SEQ ID NO: 326729 - DNA, 25 bp, Mus musculus
agtactgtgtggtttgtctgaggaa

SEQ ID NO: 326730 - DNA, 25 bp, Mus musculus
gtggtgctaggataactgagctgcc

SEQ ID NO: 326731 - DNA, 25 bp, Mus musculus
taggataactgagctgccatcaccc

SEQ ID NO: 326732 - DNA, 25 bp, Mus musculus
gcacagccgctaggccgtgcggtac

SEQ ID NO: 326733 - DNA, 25 bp, Mus musculus
cgtgcggtacgcgatggcactacac

SEQ ID NO: 326734 - DNA, 25 bp, Mus musculus
ggtacgcgatggcactacactcgcc

SEQ ID NO: 326735 - DNA, 25 bp, Mus musculus
tacactcgcccgacctgtggccagg

SEQ ID NO: 326736 - DNA, 25 bp, Mus musculus
agtacaggcggaacttccgggtctg

SEQ ID NO: 326737 - DNA, 25 bp, Mus musculus
ctaccaagtaggtgagtgactcagg

SEQ ID NO: 326738 - DNA, 25 bp, Mus musculus
gggtgcagactgtgtttaaaatagc

SEQ ID NO: 326739 - DNA, 25 bp, Mus musculus
tcctgcgggacctccgaattgctct

SEQ ID NO: 326740 - DNA, 25 bp, Mus musculus
cccgagggccgactctaccaagtag

SEQ ID NO: 326741 - DNA, 25 bp, Mus musculus
acattactatcttctctcccgaggg

SEQ ID NO: 326742 - DNA, 25 bp, Mus musculus
agcgccggttttgaccgtcacatta

SEQ ID NO: 326743 - DNA, 25 bp, Mus musculus
aaatagcaggaacgccatgtcccgg

SEQ ID NO: 326744 - DNA, 25 bp, Mus musculus
tgctccggaagcagtagccataact

SEQ ID NO: 326745 - DNA, 25 bp, Mus musculus
agtccctcaccagagcggaagcagc

SEQ ID NO: 326746 - DNA, 25 bp, Mus musculus
gcagtgctttgggacgtcccgtccc

SEQ ID NO: 326747 - DNA, 25 bp, Mus musculus
cccgcctactcaggggcagtgcttt

SEQ ID NO: 326748 - DNA, 25 bp, Mus musculus
actaacggccggctgcgacccagag

SEQ ID NO: 326749 - DNA, 25 bp, Mus musculus
cagtagccataacttccgggagggg

SEQ ID NO: 326750 - DNA, 25 bp, Mus musculus
aattgctctgtcatgcttcggcctg

SEQ ID NO: 326751 - DNA, 25 bp, Mus musculus
gcgcccattaattctaccgtccgta

SEQ ID NO: 326752 - DNA, 25 bp, Mus musculus
gtggggtccacgcagattatttctg

SEQ ID NO: 326753 - DNA, 25 bp, Mus musculus
tggactcgaagtttctccgctgggc

SEQ ID NO: 326754 - DNA, 25 bp, Mus musculus
gtgagcgattttgccgtgccagacc

SEQ ID NO: 326755 - DNA, 25 bp, Mus musculus
tgccagaccggcatttttagctaaa

SEQ ID NO: 326756 - DNA, 25 bp, Mus musculus
tcagccaattacaactagggcggtc

SEQ ID NO: 326757 - DNA, 25 bp, Mus musculus
agggcggtccacacattatttcata

SEQ ID NO: 326758 - DNA, 25 bp, Mus musculus
tcgcacgcactcaaacgctctggtt

SEQ ID NO: 326759 - DNA, 25 bp, Mus musculus
ctttgctgtctagcagtggatgtcc

SEQ ID NO: 326760 - DNA, 25 bp, Mus musculus
agttcttaatcgctcgcgcccatta

SEQ ID NO: 326761 - DNA, 25 bp, Mus musculus
cggtgggcatgagttcttaatcgct

SEQ ID NO: 326762 - DNA, 25 bp, Mus musculus
tctaccgtccgtatttgcatccgca

SEQ ID NO: 326763 - DNA, 25 bp, Mus musculus
ttcatagttatctagggccgcgggc

SEQ ID NO: 326764 - DNA, 25 bp, Mus musculus
atgtccgtgtccacgtggggtccac

SEQ ID NO: 326765 - DNA, 25 bp, Mus musculus
tgctcgtactcctcgtccttcatgg

SEQ ID NO: 326766 - DNA, 25 bp, Mus musculus
ggtgcccggcgccacttacgagtct

SEQ ID NO: 326767 - DNA, 25 bp, Mus musculus
ttacgagtctccgtcctccgtgagc

SEQ ID NO: 326768 - DNA, 25 bp, Mus musculus
gtcctccgtgagctgctgcttccag

SEQ ID NO: 326769 - DNA, 25 bp, Mus musculus
gcagctccttcaccatttgctcgta

SEQ ID NO: 326770 - DNA, 25 bp, Mus musculus
tcgtccttcatggagtccaggccgc

SEQ ID NO: 326771 - DNA, 25 bp, Mus musculus
tccaggccgctgtcgtggcgatcgt

SEQ ID NO: 326772 - DNA, 25 bp, Mus musculus
ggcgatcgtccaccaagcgctcctt

SEQ ID NO: 326773 - DNA, 25 bp, Mus musculus
agcgctccttcttgaggccatcccg

SEQ ID NO: 326774 - DNA, 25 bp, Mus musculus
agtcctggccgtgcccagctggctg

SEQ ID NO: 326775 - DNA, 25 bp, Mus musculus
cccagctggctgaaacatggctgtg

SEQ ID NO: 326776 - DNA, 25 bp, Mus musculus
cgcggcgccctataaacgctggcag

SEQ ID NO: 326777 - DNA, 25 bp, Mus musculus
ataaacgctggcaggggatttctca

SEQ ID NO: 326778 - DNA, 25 bp, Mus musculus
tgagctgctgcttccagggctcggc

SEQ ID NO: 326779 - DNA, 25 bp, Mus musculus
tcgcggcgcaatcctcaccggagga

SEQ ID NO: 326780 - DNA, 25 bp, Mus musculus
gcccggcgtctcagctataaagcgg

SEQ ID NO: 326781 - DNA, 25 bp, Mus musculus
tgtgcaagcaccagtacgcggaccc

SEQ ID NO: 326782 - DNA, 25 bp, Mus musculus
gctgtcccgagtgcgacaaggtctt

SEQ ID NO: 326783 - DNA, 25 bp, Mus musculus
cttccctggcgacgggcaaggagaa

SEQ ID NO: 326784 - DNA, 25 bp, Mus musculus
tgcgcgtcgagtaccgctgtcccga

SEQ ID NO: 326785 - DNA, 25 bp, Mus musculus
acctccgcaggacgacgccgagtgg

SEQ ID NO: 326786 - DNA, 25 bp, Mus musculus
gcaggtccctgtatccgttccaatt

SEQ ID NO: 326787 - DNA, 25 bp, Mus musculus
ccggcagccgtcaggaaacctaagg

SEQ ID NO: 326788 - DNA, 25 bp, Mus musculus
tgagaaggctgagcttcgcagatga

SEQ ID NO: 326789 - DNA, 25 bp, Mus musculus
ttcgcagatgaggtgaccacgtccc

SEQ ID NO: 326790 - DNA, 25 bp, Mus musculus
cggtgctgggtctgaagatcaaaga

SEQ ID NO: 326791 - DNA, 25 bp, Mus musculus
tcctggtgaagcgaaccaagcgctc

SEQ ID NO: 326792 - DNA, 25 bp, Mus musculus
ccaccatgccgaggggcttcctggt

SEQ ID NO: 326793 - DNA, 25 bp, Mus musculus
cgtggcaaccgccttctgacgtcaa

SEQ ID NO: 326794 - DNA, 25 bp, Mus musculus
caagtgctcgtgacgtcatgtcagc

SEQ ID NO: 326795 - DNA, 25 bp, Mus musculus
gccttctgacgtcaagtgctcgtga

SEQ ID NO: 326796 - DNA, 25 bp, Mus musculus
cacgactctgccgtcggtggcgaac

SEQ ID NO: 326797 - DNA, 25 bp, Mus musculus
tggtgatggagtttcacgactctgc

SEQ ID NO: 326798 - DNA, 25 bp, Mus musculus
caaaaccgagtcgtgtggtgatgga

SEQ ID NO: 326799 - DNA, 25 bp, Mus musculus
cgcggaggccaaaaccgagtcgtgt

SEQ ID NO: 326800 - DNA, 25 bp, Mus musculus
aggttgaagcgtctctagcagcttc

SEQ ID NO: 326801 - DNA, 25 bp, Mus musculus
cccggctccaatatggcggatccgc

SEQ ID NO: 326802 - DNA, 25 bp, Mus musculus
cttagagaacatcctgcggccgccg

SEQ ID NO: 326803 - DNA, 25 bp, Mus musculus
cccgtgcggcttcttagagaacatc

SEQ ID NO: 326804 - DNA, 25 bp, Mus musculus
caccttctgggtggacttcttcacg

SEQ ID NO: 326805 - DNA, 25 bp, Mus musculus
ccctcaccgatgacgatgcgcaggt

SEQ ID NO: 326806 - DNA, 25 bp, Mus musculus
cccttaaggttgaagcgtctctagc

SEQ ID NO: 326807 - DNA, 25 bp, Mus musculus
agctccgggacagccttgaccaatg

SEQ ID NO: 326808 - DNA, 25 bp, Mus musculus
gacagttcaggtgcgctacccagct

SEQ ID NO: 326809 - DNA, 25 bp, Mus musculus
gcagttccgaagacgaggacaccga

SEQ ID NO: 326810 - DNA, 25 bp, Mus musculus
tcacgatgagatggaggtggactac

SEQ ID NO: 326811 - DNA, 25 bp, Mus musculus
agaaggagacgaatcatcacgatga

SEQ ID NO: 326812 - DNA, 25 bp, Mus musculus
ccggtccattctcgaggggataaga

SEQ ID NO: 326813 - DNA, 25 bp, Mus musculus
gaaggccgcgccgtaatcaccggta

SEQ ID NO: 326814 - DNA, 25 bp, Mus musculus
cgaggttggaaaatgccggtccatt

SEQ ID NO: 326815 - DNA, 25 bp, Mus musculus
gcgcccttcaccgaagcggcagtgg

SEQ ID NO: 326816 - DNA, 25 bp, Mus musculus
ttcgcttgcaagacaagccacgcct

SEQ ID NO: 326817 - DNA, 25 bp, Mus musculus
ttgaccaatggcagagctcgcagcg

SEQ ID NO: 326818 - DNA, 25 bp, Mus musculus
aggacaccgagagctcgtcggtctc

SEQ ID NO: 326819 - DNA, 25 bp, Mus musculus
accggtaaccaatcgttcgcttgca

SEQ ID NO: 326820 - DNA, 25 bp, Mus musculus
agtcgagggtttcggatccagctcg

SEQ ID NO: 326821 - DNA, 25 bp, Mus musculus
gagcttcagtcacggaaaaagagga

SEQ ID NO: 326822 - DNA, 25 bp, Mus musculus
gaaaaagaggaaggatccgttcagc

SEQ ID NO: 326823 - DNA, 25 bp, Mus musculus
tcagatatcctttccgcactctggg

SEQ ID NO: 326824 - DNA, 25 bp, Mus musculus
gctgtggaacgacgagcttcagtca

SEQ ID NO: 326825 - DNA, 25 bp, Mus musculus
cccttgcagagctgtggaacgacga

SEQ ID NO: 326826 - DNA, 25 bp, Mus musculus
gcgctgattcccttgcagagctgtg

SEQ ID NO: 326827 - DNA, 25 bp, Mus musculus
gagctcacgcgctgattcccttgca

SEQ ID NO: 326828 - DNA, 25 bp, Mus musculus
ctggaaaggagctcacgcgctgatt

SEQ ID NO: 326829 - DNA, 25 bp, Mus musculus
ccgttcttcctgtggccgctggaaa

SEQ ID NO: 326830 - DNA, 25 bp, Mus musculus
gcactctgggtttccacactgtgga

SEQ ID NO: 326831 - DNA, 25 bp, Mus musculus
aagccggtcgttgtctcagatatcc

SEQ ID NO: 326832 - DNA, 25 bp, Mus musculus
tccacactgtggaaaccatttcggc

SEQ ID NO: 326833 - DNA, 25 bp, Mus musculus
ctgtggaaaccatttcggcacgggg

SEQ ID NO: 326834 - DNA, 25 bp, Mus musculus
cccgacaagaagaagccggtcgttg

SEQ ID NO: 326835 - DNA, 25 bp, Mus musculus
ccggtagagcatgcgagaagttgcc

SEQ ID NO: 326836 - DNA, 25 bp, Mus musculus
atgcgagaagttgccgggactctac

SEQ ID NO: 326837 - DNA, 25 bp, Mus musculus
ccggctcggtcttgcgctatcttct

SEQ ID NO: 326838 - DNA, 25 bp, Mus musculus
tggcttcctcctcaagaccgcagaa

SEQ ID NO: 326839 - DNA, 25 bp, Mus musculus
cggggacctacgacactctacacag

SEQ ID NO: 326840 - DNA, 25 bp, Mus musculus
gacactctacacagccgcctttaga

SEQ ID NO: 326841 - DNA, 25 bp, Mus musculus
agccgcctttagaggctgtccgtgc

SEQ ID NO: 326842 - DNA, 25 bp, Mus musculus
tcacccgggcgctctcgggcaggtt

SEQ ID NO: 326843 - DNA, 25 bp, Mus musculus
ctctcgggcaggttgtagcggcaca

SEQ ID NO: 326844 - DNA, 25 bp, Mus musculus
agatcgaagccgaccacgtcgcagg

SEQ ID NO: 326845 - DNA, 25 bp, Mus musculus
cgcccagggagaagtgctgagccat

SEQ ID NO: 326846 - DNA, 25 bp, Mus musculus
tgccgggactctacaagcgtaactc

SEQ ID NO: 326847 - DNA, 25 bp, Mus musculus
taacgcagaccggaaggccggtaga

SEQ ID NO: 326848 - DNA, 25 bp, Mus musculus
acagcgtgtggtcgagatcgaagcc

SEQ ID NO: 326849 - DNA, 25 bp, Mus musculus
accgggtgccagcatcctaagcagc

SEQ ID NO: 326850 - DNA, 25 bp, Mus musculus
ttggctactcgcgtctgacagtgga

SEQ ID NO: 326851 - DNA, 25 bp, Mus musculus
tgcacaagcagatcagggaccgcga

SEQ ID NO: 326852 - DNA, 25 bp, Mus musculus
ggcgccgggtgatttttctcccagc

SEQ ID NO: 326853 - DNA, 25 bp, Mus musculus
tgaacccgcacctgcaacttgtttg

SEQ ID NO: 326854 - DNA, 25 bp, Mus musculus
cttgtttggtttcctctcccgcagc

SEQ ID NO: 326855 - DNA, 25 bp, Mus musculus
gcagcggcggcatcaaagtttctct

SEQ ID NO: 326856 - DNA, 25 bp, Mus musculus
ggggaatctgccgtttggatcgatc

SEQ ID NO: 326857 - DNA, 25 bp, Mus musculus
cacgactttggagcagtcactttgc

SEQ ID NO: 326858 - DNA, 25 bp, Mus musculus
aaagcctctccgcttgggcaggcga

SEQ ID NO: 326859 - DNA, 25 bp, Mus musculus
tgggtcccatcagtaccgggtgcca

SEQ ID NO: 326860 - DNA, 25 bp, Mus musculus
ttgcctctcaattgggaactagtgg

SEQ ID NO: 326861 - DNA, 25 bp, Mus musculus
ggcgacagcttggaagcctttgttc

SEQ ID NO: 326862 - DNA, 25 bp, Mus musculus
ggtgcccgcacagtggatgttaatc

SEQ ID NO: 326863 - DNA, 25 bp, Mus musculus
cagcagccatgacaccttcaaagca

SEQ ID NO: 326864 - DNA, 25 bp, Mus musculus
tcgcggacttcgtcgcactgagatg

SEQ ID NO: 326865 - DNA, 25 bp, Mus musculus
gcccagggtcttccgggtgtcacag

SEQ ID NO: 326866 - DNA, 25 bp, Mus musculus
cgcctccgagagaactaaggggaca

SEQ ID NO: 326867 - DNA, 25 bp, Mus musculus
gacaaggaccgggatgctctccctc

SEQ ID NO: 326868 - DNA, 25 bp, Mus musculus
cttacctgtcttgtcagggtgtgca

SEQ ID NO: 326869 - DNA, 25 bp, Mus musculus
cctgtcttgtcagggtgtgcaagga

SEQ ID NO: 326870 - DNA, 25 bp, Mus musculus
tgtgcaaggagcgaaagacttcgca

SEQ ID NO: 326871 - DNA, 25 bp, Mus musculus
cgaaagacttcgcagaggacctcgc

SEQ ID NO: 326872 - DNA, 25 bp, Mus musculus
acttcgcagaggacctcgcgggtga

SEQ ID NO: 326873 - DNA, 25 bp, Mus musculus
ctggagcattgctccaggctcctct

SEQ ID NO: 326874 - DNA, 25 bp, Mus musculus
ctctcgctgccgcttgaggaactaa

SEQ ID NO: 326875 - DNA, 25 bp, Mus musculus
tgaggaactaagctccgcagcagca

SEQ ID NO: 326876 - DNA, 25 bp, Mus musculus
cgcactgagatgacgtaaaactaga

SEQ ID NO: 326877 - DNA, 25 bp, Mus musculus
tctacggtcctgagctacgatgatg

SEQ ID NO: 326878 - DNA, 25 bp, Mus musculus
cctctctgctggtatcctctggacg

SEQ ID NO: 326879 - DNA, 25 bp, Mus musculus
agcaggcgccctggttgggactccc

SEQ ID NO: 326880 - DNA, 25 bp, Mus musculus
taaactccacgtggagctgggagca

SEQ ID NO: 326881 - DNA, 25 bp, Mus musculus
ctagcgagtaaactccacgtggagc

SEQ ID NO: 326882 - DNA, 25 bp, Mus musculus
ccttcggcgcgcactagcgagtaaa

SEQ ID NO: 326883 - DNA, 25 bp, Mus musculus
tgtccactgcctggggcttacgcag

SEQ ID NO: 326884 - DNA, 25 bp, Mus musculus
cgggactgtgagaaccggtcctcta

SEQ ID NO: 326885 - DNA, 25 bp, Mus musculus
agctacgatgatggtaccctgatcc

SEQ ID NO: 326886 - DNA, 25 bp, Mus musculus
accggtcctctacggtcctgagcta

SEQ ID NO: 326887 - DNA, 25 bp, Mus musculus
gtatcctctggacgcggtccgtcgc

SEQ ID NO: 326888 - DNA, 25 bp, Mus musculus
gcttacgcaggcagcagccttcggc

SEQ ID NO: 326889 - DNA, 25 bp, Mus musculus
tggtaccctgatccatcgtaagagg

SEQ ID NO: 326890 - DNA, 25 bp, Mus musculus
atccatcgtaagaggaccggcgcgg

SEQ ID NO: 326891 - DNA, 25 bp, Mus musculus
ttggcggcatcgatgtagagaatgc

SEQ ID NO: 326892 - DNA, 25 bp, Mus musculus
tggatacgtcgaacaggaagctctg

SEQ ID NO: 326893 - DNA, 25 bp, Mus musculus
ttcaccacctcatcggcttcggaga

SEQ ID NO: 326894 - DNA, 25 bp, Mus musculus
cactgtccctgtctggttccggaga

SEQ ID NO: 326895 - DNA, 25 bp, Mus musculus
aagcccagtcgtctcagggccagcg

SEQ ID NO: 326896 - DNA, 25 bp, Mus musculus
gaggagatcaccaacagcgcgcgct

SEQ ID NO: 326897 - DNA, 25 bp, Mus musculus
gactctctttcctttgcgtacggga

SEQ ID NO: 326898 - DNA, 25 bp, Mus musculus
ggatctcccggaacagactctcttt

SEQ ID NO: 326899 - DNA, 25 bp, Mus musculus
cagtgacttgcgactgcagcggctc

SEQ ID NO: 326900 - DNA, 25 bp, Mus musculus
gctccttaaagtccacgtgcagtga

SEQ ID NO: 326901 - DNA, 25 bp, Mus musculus
tcgtagtctaatggcgcgatgatcc

SEQ ID NO: 326902 - DNA, 25 bp, Mus musculus
tcgcagtggtatgcctcgtagtcta

SEQ ID NO: 326903 - DNA, 25 bp, Mus musculus
cgccatggagttgagcagcgtctga

SEQ ID NO: 326904 - DNA, 25 bp, Mus musculus
gtcgcaaacgccctcgcagtggtat

SEQ ID NO: 326905 - DNA, 25 bp, Mus musculus
caggccactggagctgagcggaagg

SEQ ID NO: 326906 - DNA, 25 bp, Mus musculus
cccaagcgtctcaaatgagcacttc

SEQ ID NO: 326907 - DNA, 25 bp, Mus musculus
gccgcccaagcgtctcaaatgagca

SEQ ID NO: 326908 - DNA, 25 bp, Mus musculus
acagccgcccaagcgtctcaaatga

SEQ ID NO: 326909 - DNA, 25 bp, Mus musculus
gagcgagccggtgcttcacagccgc

SEQ ID NO: 326910 - DNA, 25 bp, Mus musculus
cctcccggagacctcaccctgctgg

SEQ ID NO: 326911 - DNA, 25 bp, Mus musculus
ttccctccttcccagatcggccagc

SEQ ID NO: 326912 - DNA, 25 bp, Mus musculus
ccgcagcctggaccacttccctcct

SEQ ID NO: 326913 - DNA, 25 bp, Mus musculus
agctgagcggaagggcgcccacggc

SEQ ID NO: 326914 - DNA, 25 bp, Mus musculus
acgcgcacgacctcaggccactgga

SEQ ID NO: 326915 - DNA, 25 bp, Mus musculus
gcgtctcaaatgagcacttcggccg

SEQ ID NO: 326916 - DNA, 25 bp, Mus musculus
cagagcgagccggtgcttcacagcc

SEQ ID NO: 326917 - DNA, 25 bp, Mus musculus
ccacggcccgcagcctggaccactt

SEQ ID NO: 326918 - DNA, 25 bp, Mus musculus
tccttcccagatcggccagcaccgc

SEQ ID NO: 326919 - DNA, 25 bp, Mus musculus
cttttagaaatcgaggcagcccgac

SEQ ID NO: 326920 - DNA, 25 bp, Mus musculus
tccctgaagtcttgagcatcaagtc

SEQ ID NO: 326921 - DNA, 25 bp, Mus musculus
ctacacaaggctgttcggctgccca

SEQ ID NO: 326922 - DNA, 25 bp, Mus musculus
ctttagacccagaatgtgcagtgag

SEQ ID NO: 326923 - DNA, 25 bp, Mus musculus
aacgtcgctcgagctcgtacacctg

SEQ ID NO: 326924 - DNA, 25 bp, Mus musculus
cctcattggtatcagtgtcccttta

SEQ ID NO: 326925 - DNA, 25 bp, Mus musculus
gccacccagagggagacttttagaa

SEQ ID NO: 326926 - DNA, 25 bp, Mus musculus
acgtagagcctcctccagagctgtg

SEQ ID NO: 326927 - DNA, 25 bp, Mus musculus
gggtttaaagtctagctactcctca

SEQ ID NO: 326928 - DNA, 25 bp, Mus musculus
tttcccaaaagaggcccagctagcg

SEQ ID NO: 326929 - DNA, 25 bp, Mus musculus
cgggagactgtaagcgacaaacgca

SEQ ID NO: 326930 - DNA, 25 bp, Mus musculus
actcatattcatgccgctcgccggg

SEQ ID NO: 326931 - DNA, 25 bp, Mus musculus
ggggccatgttcttgctcacgtccc

SEQ ID NO: 326932 - DNA, 25 bp, Mus musculus
tgactcctttcatgcccaagccagg

SEQ ID NO: 326933 - DNA, 25 bp, Mus musculus
tgcggagtggaactgagtctgaacc

SEQ ID NO: 326934 - DNA, 25 bp, Mus musculus
gggctgcactgttggtctatgtgtc

SEQ ID NO: 326935 - DNA, 25 bp, Mus musculus
gctgagtaagggaacgactgcctcc

SEQ ID NO: 326936 - DNA, 25 bp, Mus musculus
gcaagtacaccgctggccctctgag

SEQ ID NO: 326937 - DNA, 25 bp, Mus musculus
ctctgagctacgaggctaagggtgc

SEQ ID NO: 326938 - DNA, 25 bp, Mus musculus
caggagagtccaccacggaagttgc

SEQ ID NO: 326939 - DNA, 25 bp, Mus musculus
acccttgcccatggcctggatactt

SEQ ID NO: 326940 - DNA, 25 bp, Mus musculus
tggatacttcggcttcggaagctga

SEQ ID NO: 326941 - DNA, 25 bp, Mus musculus
gttttcccttccgatgcttcagtga

SEQ ID NO: 326942 - DNA, 25 bp, Mus musculus
accaccaaaagagtgtgcgagtctg

SEQ ID NO: 326943 - DNA, 25 bp, Mus musculus
tggcgaatatctcgacgcccgcagc

SEQ ID NO: 326944 - DNA, 25 bp, Mus musculus
ccggagctcagccatgcaaaagtgc

SEQ ID NO: 326945 - DNA, 25 bp, Mus musculus
tctttgtctaaagtggcggcgtaaa

SEQ ID NO: 326946 - DNA, 25 bp, Mus musculus
gaagctgatgctgtctttccgagga

SEQ ID NO: 326947 - DNA, 25 bp, Mus musculus
cgctctcgtccgaggctgggaacca

SEQ ID NO: 326948 - DNA, 25 bp, Mus musculus
caggtagcgctgctgccgaaagcgt

SEQ ID NO: 326949 - DNA, 25 bp, Mus musculus
gtccgaggctgggaaccacaaagca

SEQ ID NO: 326950 - DNA, 25 bp, Mus musculus
gacgagtctgcagggcttgtctcca

SEQ ID NO: 326951 - DNA, 25 bp, Mus musculus
agcgaagccagctgcgacgagtctg

SEQ ID NO: 326952 - DNA, 25 bp, Mus musculus
ggggactcccgcctgagcgaagcca

SEQ ID NO: 326953 - DNA, 25 bp, Mus musculus
tccaaggtctggtttttggagaaca

SEQ ID NO: 326954 - DNA, 25 bp, Mus musculus
agcgtttttccaactccaaggtctg

SEQ ID NO: 326955 - DNA, 25 bp, Mus musculus
cgctgctgccgaaagcgtttttcca

SEQ ID NO: 326956 - DNA, 25 bp, Mus musculus
gccctcgcttcagcttgtagcggtg

SEQ ID NO: 326957 - DNA, 25 bp, Mus musculus
gcgcaggagtcgagccatttgttcc

SEQ ID NO: 326958 - DNA, 25 bp, Mus musculus
ggtctggtttttggagaacagcacc

SEQ ID NO: 326959 - DNA, 25 bp, Mus musculus
ggaaccacaaagcaaagcagacgtc

SEQ ID NO: 326960 - DNA, 25 bp, Mus musculus
gtcgagccatttgttcccgctccgg

SEQ ID NO: 326961 - DNA, 25 bp, Mus musculus
aagtgcgaggcgctcgccatgcgct

SEQ ID NO: 326962 - DNA, 25 bp, Mus musculus
gttgctcgcgcctcaccctaggctt

SEQ ID NO: 326963 - DNA, 25 bp, Mus musculus
ccctaggcttcgcatcctgttcagg

SEQ ID NO: 326964 - DNA, 25 bp, Mus musculus
taggcttcgcatcctgttcaggtaa

SEQ ID NO: 326965 - DNA, 25 bp, Mus musculus
cgcatcctgttcaggtaaattcagg

SEQ ID NO: 326966 - DNA, 25 bp, Mus musculus
tcaggtaaattcaggaggctgcgca

SEQ ID NO: 326967 - DNA, 25 bp, Mus musculus
aattcaggaggctgcgcaccgtgaa

SEQ ID NO: 326968 - DNA, 25 bp, Mus musculus
agccgaggcgtccagaggtggccat

SEQ ID NO: 326969 - DNA, 25 bp, Mus musculus
ggacagctggggacgccgctcctaa

SEQ ID NO: 326970 - DNA, 25 bp, Mus musculus
acgccgctcctaaggatggaagtgc

SEQ ID NO: 326971 - DNA, 25 bp, Mus musculus
ccgctcctaaggatggaagtgcgag

SEQ ID NO: 326972 - DNA, 25 bp, Mus musculus
ccatgcgctggccttgagacgccag

SEQ ID NO: 326973 - DNA, 25 bp, Mus musculus
cgcacgtctgttgctcgcgcctcac

SEQ ID NO: 326974 - DNA, 25 bp, Mus musculus
tgcgctggccttgagacgccagcac

SEQ ID NO: 326975 - DNA, 25 bp, Mus musculus
agctgcgatggagcaggtttcctcg

SEQ ID NO: 326976 - DNA, 25 bp, Mus musculus
aggatctcagccacgggatctcagc

SEQ ID NO: 326977 - DNA, 25 bp, Mus musculus
cacgcagcttcgcttgctctgtaga

SEQ ID NO: 326978 - DNA, 25 bp, Mus musculus
cgcttgctctgtagagtttgaccta

SEQ ID NO: 326979 - DNA, 25 bp, Mus musculus
ctgtagagtttgacctataggcatc

SEQ ID NO: 326980 - DNA, 25 bp, Mus musculus
tgacctataggcatctcagaatcta

SEQ ID NO: 326981 - DNA, 25 bp, Mus musculus
tctcagaatctagcgagtgcccatc

SEQ ID NO: 326982 - DNA, 25 bp, Mus musculus
gagtgcccatcactcagcggtcttc

SEQ ID NO: 326983 - DNA, 25 bp, Mus musculus
ggtcttccagcctgcacctgtgcgt

SEQ ID NO: 326984 - DNA, 25 bp, Mus musculus
acctgtgcgtccttgtcctgatgct

SEQ ID NO: 326985 - DNA, 25 bp, Mus musculus
ttgtcctgatgctccagccgctagt

SEQ ID NO: 326986 - DNA, 25 bp, Mus musculus
gcgccacagcccactccctcagtca

SEQ ID NO: 326987 - DNA, 25 bp, Mus musculus
gtcagccgcccgcagctcaaagccc

SEQ ID NO: 326988 - DNA, 25 bp, Mus musculus
gtttcctcgggagatggcgccacag

SEQ ID NO: 326989 - DNA, 25 bp, Mus musculus
gtcagtgggctccaattgaagtccc

SEQ ID NO: 326990 - DNA, 25 bp, Mus musculus
gctaagcgctcgctggactccagca

SEQ ID NO: 326991 - DNA, 25 bp, Mus musculus
ggactccagcactggcatctcgcga

SEQ ID NO: 326992 - DNA, 25 bp, Mus musculus
agaggaggaagccttctcggtatgc

SEQ ID NO: 326993 - DNA, 25 bp, Mus musculus
ccagcgagccaagggcaacaggtca

SEQ ID NO: 326994 - DNA, 25 bp, Mus musculus
gccttctcggtatgcgaggttcctc

SEQ ID NO: 326995 - DNA, 25 bp, Mus musculus
tgcgaggttcctccatctggcggaa

SEQ ID NO: 326996 - DNA, 25 bp, Mus musculus
tccatctggcggaaggctgaacagc

SEQ ID NO: 326997 - DNA, 25 bp, Mus musculus
ctgaacagccagtaagcaacgcttc

SEQ ID NO: 326998 - DNA, 25 bp, Mus musculus
ttcggtagtcagtgggctccaattg

SEQ ID NO: 326999 - DNA, 25 bp, Mus musculus
ccctgaagcttctggctgcgcgggt

SEQ ID NO: 327000 - DNA, 25 bp, Mus musculus
ggttcgtccacagcgtcgtcgtcgc

SEQ ID NO: 327001 - DNA, 25 bp, Mus musculus
gtcgtcgccagcgagccaagggcaa

SEQ ID NO: 327002 - DNA, 25 bp, Mus musculus
gtaagcaacgcttcggtagtcagtg

SEQ ID NO: 327003 - DNA, 25 bp, Mus musculus
ccgtattacggtacaaggatacctg

SEQ ID NO: 327004 - DNA, 25 bp, Mus musculus
cgtgttccaggctgccacgtttgtc

SEQ ID NO: 327005 - DNA, 25 bp, Mus musculus
gtttgcaagtctgggttccggcact

SEQ ID NO: 327006 - DNA, 25 bp, Mus musculus
caggaccgtttgcaagtctgggttc

SEQ ID NO: 327007 - DNA, 25 bp, Mus musculus
ggatacctgtttgcgtgcctcgcca

SEQ ID NO: 327008 - DNA, 25 bp, Mus musculus
ttccggcactgggtactggcagcgt

SEQ ID NO: 327009 - DNA, 25 bp, Mus musculus
tgcctgcaacgtcagtgccaccgta

SEQ ID NO: 327010 - DNA, 25 bp, Mus musculus
gcgtgtctgttttcgtgcctgcaac

SEQ ID NO: 327011 - DNA, 25 bp, Mus musculus
cgttatgatgggcacaggcgtgtct

SEQ ID NO: 327012 - DNA, 25 bp, Mus musculus
catctgctgaatcctagtgtgggcg

SEQ ID NO: 327013 - DNA, 25 bp, Mus musculus
ccagcactgaaatgtggcacatctg

SEQ ID NO: 327014 - DNA, 25 bp, Mus musculus
cctgcggtgtgccagcactgaaatg

SEQ ID NO: 327015 - DNA, 25 bp, Mus musculus
cacgtttgtccggacgtgcgcctgc

SEQ ID NO: 327016 - DNA, 25 bp, Mus musculus
tgcctcgccaacacgtggtggaatg

SEQ ID NO: 327017 - DNA, 25 bp, Mus musculus
agcctagagtgctgccttccgatgg

SEQ ID NO: 327018 - DNA, 25 bp, Mus musculus
agctagattccacttcctgcgcatc

SEQ ID NO: 327019 - DNA, 25 bp, Mus musculus
cgtgttcacctcaaccgcgagtaga

SEQ ID NO: 327020 - DNA, 25 bp, Mus musculus
tcaaccgcgagtagaaaaagagacc

SEQ ID NO: 327021 - DNA, 25 bp, Mus musculus
aaaagagacccttccattctcgcgc

SEQ ID NO: 327022 - DNA, 25 bp, Mus musculus
ctttctcttccacggtcgcagtcga

SEQ ID NO: 327023 - DNA, 25 bp, Mus musculus
cgcagtcgacctccagggacacaga

SEQ ID NO: 327024 - DNA, 25 bp, Mus musculus
cagacgctgagtactcaccgagatc

SEQ ID NO: 327025 - DNA, 25 bp, Mus musculus
caccgagatcaagtgagtgctcaca

SEQ ID NO: 327026 - DNA, 25 bp, Mus musculus
tcacacacagcctagagtgctgcct

SEQ ID NO: 327027 - DNA, 25 bp, Mus musculus
ctgccttccgatggcggcggcgact

SEQ ID NO: 327028 - DNA, 25 bp, Mus musculus
gcccggatactctgtgagccgccgt

SEQ ID NO: 327029 - DNA, 25 bp, Mus musculus
gcgactgcccggatactctgtgagc

SEQ ID NO: 327030 - DNA, 25 bp, Mus musculus
ccgccgtgggaagagctagattcca

SEQ ID NO: 327031 - DNA, 25 bp, Mus musculus
acgccattcggcttcgcatcgtgga

SEQ ID NO: 327032 - DNA, 25 bp, Mus musculus
tcgcatcgtggaattagcccaactg

SEQ ID NO: 327033 - DNA, 25 bp, Mus musculus
cccaactgggcatccgaccttgtga

SEQ ID NO: 327034 - DNA, 25 bp, Mus musculus
accttgtgacatcagccgccagcta

SEQ ID NO: 327035 - DNA, 25 bp, Mus musculus
cggttcgattttgccgggagctatt

SEQ ID NO: 327036 - DNA, 25 bp, Mus musculus
gtggtgaaacacatccggacttaca

SEQ ID NO: 327037 - DNA, 25 bp, Mus musculus
ccggacttacaagcagagggaccca

SEQ ID NO: 327038 - DNA, 25 bp, Mus musculus
cccaggcatcttcgcttgggagatc

SEQ ID NO: 327039 - DNA, 25 bp, Mus musculus
ggtgagttccatcagccgtattctg

SEQ ID NO: 327040 - DNA, 25 bp, Mus musculus
cgtattctgcgcaacaagatcggca

SEQ ID NO: 327041 - DNA, 25 bp, Mus musculus
tggcccagcagggtcattacgactc

SEQ ID NO: 327042 - DNA, 25 bp, Mus musculus
ggcggcagcagctaaggtgcctaca

SEQ ID NO: 327043 - DNA, 25 bp, Mus musculus
ggacattctgggcatccgctccatc

SEQ ID NO: 327044 - DNA, 25 bp, Mus musculus
cgaccaaggtaaggagctcagaggc

SEQ ID NO: 327045 - DNA, 25 bp, Mus musculus
taaggctgccctttccaccggggca

SEQ ID NO: 327046 - DNA, 25 bp, Mus musculus
ggggtccgaacttgcccagcgctgc

SEQ ID NO: 327047 - DNA, 25 bp, Mus musculus
ctgcgatccagctaaaggcggcggt

SEQ ID NO: 327048 - DNA, 25 bp, Mus musculus
gaactcttcccggtgtggctgcgat

SEQ ID NO: 327049 - DNA, 25 bp, Mus musculus
gagcgagctcctctgaaggccgccg

SEQ ID NO: 327050 - DNA, 25 bp, Mus musculus
ggtgaccaagttgcccgagcgagct

SEQ ID NO: 327051 - DNA, 25 bp, Mus musculus
tggaggccgacatcttcgcgaccag

SEQ ID NO: 327052 - DNA, 25 bp, Mus musculus
cagtaagctgacgttggaggccgac

SEQ ID NO: 327053 - DNA, 25 bp, Mus musculus
cctgcctggaggtctcgtgcagtaa

SEQ ID NO: 327054 - DNA, 25 bp, Mus musculus
gagcggacagccttacctgcagacc

SEQ ID NO: 327055 - DNA, 25 bp, Mus musculus
aaacttcggttggaaggcgagcctg

SEQ ID NO: 327056 - DNA, 25 bp, Mus musculus
gcactcgcacacaaaacttcggttg

SEQ ID NO: 327057 - DNA, 25 bp, Mus musculus
gtagaagatttaggaggacgcactc

SEQ ID NO: 327058 - DNA, 25 bp, Mus musculus
ctcggctcttcgcagaggagtcaga

SEQ ID NO: 327059 - DNA, 25 bp, Mus musculus
cagcgctcaggtccatgggctcctt

SEQ ID NO: 327060 - DNA, 25 bp, Mus musculus
caactcaggcctatcgcgcagtgca

SEQ ID NO: 327061 - DNA, 25 bp, Mus musculus
cagcgcactccttggctggaagatg

SEQ ID NO: 327062 - DNA, 25 bp, Mus musculus
ttgtccttgccaagagaaggccatc

SEQ ID NO: 327063 - DNA, 25 bp, Mus musculus
gctgtagtgcctggtccttgtcctt

SEQ ID NO: 327064 - DNA, 25 bp, Mus musculus
cagtgcagggtagaagtcgcctccc

SEQ ID NO: 327065 - DNA, 25 bp, Mus musculus
ccttgagttgcttggtctgtgaagc

SEQ ID NO: 327066 - DNA, 25 bp, Mus musculus
cgacatcatgaagtggtgtggcacc

SEQ ID NO: 327067 - DNA, 25 bp, Mus musculus
gccaggctcctgtaaagcgacatca

SEQ ID NO: 327068 - DNA, 25 bp, Mus musculus
tgaagccggtgattgtgtccacacg

SEQ ID NO: 327069 - DNA, 25 bp, Mus musculus
cgcagaagacgcgtaaagtaccttg

SEQ ID NO: 327070 - DNA, 25 bp, Mus musculus
cccggctcgtctccagtcaagagta

SEQ ID NO: 327071 - DNA, 25 bp, Mus musculus
gctgaacgttcaacccgcagcgctg

SEQ ID NO: 327072 - DNA, 25 bp, Mus musculus
cccgacgccttttgaacatagtgtt

SEQ ID NO: 327073 - DNA, 25 bp, Mus musculus
ctttttggttactcaggggcacgcg

SEQ ID NO: 327074 - DNA, 25 bp, Mus musculus
gaccgcggatccactctgtgctttt

SEQ ID NO: 327075 - DNA, 25 bp, Mus musculus
gacgagttagggtttcagtcctggc

SEQ ID NO: 327076 - DNA, 25 bp, Mus musculus
agtgtgggctgtttttcctctaagc

SEQ ID NO: 327077 - DNA, 25 bp, Mus musculus
ggcctcatggcgtcatagtctttca

SEQ ID NO: 327078 - DNA, 25 bp, Mus musculus
ccttctccaggtttcggcctcatgg

SEQ ID NO: 327079 - DNA, 25 bp, Mus musculus
ggcgtcctcaggtgacaacaccgct

SEQ ID NO: 327080 - DNA, 25 bp, Mus musculus
ctcctcaggtaacggcgtggaccgg

SEQ ID NO: 327081 - DNA, 25 bp, Mus musculus
agaacctcagggtggcctgcagccc

SEQ ID NO: 327082 - DNA, 25 bp, Mus musculus
cgcgcagcgtttcgcgcgacgattg

SEQ ID NO: 327083 - DNA, 25 bp, Mus musculus
tcgcccgctctgctctttttggtta

SEQ ID NO: 327084 - DNA, 25 bp, Mus musculus
ctctgtgcttttgcgggacacttga

SEQ ID NO: 327085 - DNA, 25 bp, Mus musculus
cacaggaccgggcaactacgcgagc

SEQ ID NO: 327086 - DNA, 25 bp, Mus musculus
ggcgcttaaggatcccgcggctcct

SEQ ID NO: 327087 - DNA, 25 bp, Mus musculus
gcagaacccggtgcgaagcccacgg

SEQ ID NO: 327088 - DNA, 25 bp, Mus musculus
tcgctaggaggggaaaatgcccaaa

SEQ ID NO: 327089 - DNA, 25 bp, Mus musculus
atccggcgtttgtgtgtcagggttt

SEQ ID NO: 327090 - DNA, 25 bp, Mus musculus
gtttccgaggaagggattacgcagc

SEQ ID NO: 327091 - DNA, 25 bp, Mus musculus
tgacttttaggtctgtagctcaaca

SEQ ID NO: 327092 - DNA, 25 bp, Mus musculus
ctcaacagaagatttattcgctagg

SEQ ID NO: 327093 - DNA, 25 bp, Mus musculus
tgcccaaacaatgaagaactaactg

SEQ ID NO: 327094 - DNA, 25 bp, Mus musculus
taactgcatttgtcacctcgggatg

SEQ ID NO: 327095 - DNA, 25 bp, Mus musculus
tgcgtgcatctataggcgcgccttg

SEQ ID NO: 327096 - DNA, 25 bp, Mus musculus
gcacagagagcgtagacgcagaacc

SEQ ID NO: 327097 - DNA, 25 bp, Mus musculus
cgcgccgctggaagcacagatgttt

SEQ ID NO: 327098 - DNA, 25 bp, Mus musculus
agcacagcccgcaggcgcctgtgag

SEQ ID NO: 327099 - DNA, 25 bp, Mus musculus
gcctgtgagccaagcaggactcgcc

SEQ ID NO: 327100 - DNA, 25 bp, Mus musculus
ccttgtcccgaggtggcacagagag

SEQ ID NO: 327101 - DNA, 25 bp, Mus musculus
tgccaccttgacgaaacaatcgttg

SEQ ID NO: 327102 - DNA, 25 bp, Mus musculus
acatgttgaaggaagccggggtcat

SEQ ID NO: 327103 - DNA, 25 bp, Mus musculus
aagacgctggagacttcaactccga

SEQ ID NO: 327104 - DNA, 25 bp, Mus musculus
tagctggctagcctttccgtgcaca

SEQ ID NO: 327105 - DNA, 25 bp, Mus musculus
gcctgaggggtccttgcgactttct

SEQ ID NO: 327106 - DNA, 25 bp, Mus musculus
cggggatcgtgccaccttgacgaaa

SEQ ID NO: 327107 - DNA, 25 bp, Mus musculus
agggtagctgcgcttgaatgtcttg

SEQ ID NO: 327108 - DNA, 25 bp, Mus musculus
gcgcgtacgccatgggactcatgca

SEQ ID NO: 327109 - DNA, 25 bp, Mus musculus
actcatgcacgggttcatggcggcg

SEQ ID NO: 327110 - DNA, 25 bp, Mus musculus
tgacgcccgccgcagtcatgctgtt

SEQ ID NO: 327111 - DNA, 25 bp, Mus musculus
tcatgctgttcatggcgcctgcaga

SEQ ID NO: 327112 - DNA, 25 bp, Mus musculus
taagcccgtgttggcgtaggacatg

SEQ ID NO: 327113 - DNA, 25 bp, Mus musculus
tcagcgtgagcatcttgctgggcgc

SEQ ID NO: 327114 - DNA, 25 bp, Mus musculus
tggcatgccagccacagcaccggga

SEQ ID NO: 327115 - DNA, 25 bp, Mus musculus
ctacaaagcccgaggtgcacctgtg

SEQ ID NO: 327116 - DNA, 25 bp, Mus musculus
ctgttccagtcgttgctctcatgcc

SEQ ID NO: 327117 - DNA, 25 bp, Mus musculus
ttacatggtgtgaccgagaggcctc

SEQ ID NO: 327118 - DNA, 25 bp, Mus musculus
tttgtccgccgcacaaagacgctcg

SEQ ID NO: 327119 - DNA, 25 bp, Mus musculus
catccaaccctgtgcggagcgacgg

SEQ ID NO: 327120 - DNA, 25 bp, Mus musculus
tgtccgcgtagtagctgttccagtc

SEQ ID NO: 327121 - DNA, 25 bp, Mus musculus
ctgatgtggatcttacgtcgccgga

SEQ ID NO: 327122 - DNA, 25 bp, Mus musculus
aggcctcccggtaagcgagcaccga

SEQ ID NO: 327123 - DNA, 25 bp, Mus musculus
tcacctcctgcgtgtccgcgtagta

SEQ ID NO: 327124 - DNA, 25 bp, Mus musculus
ttcccaaaactctccgctggttgca

SEQ ID NO: 327125 - DNA, 25 bp, Mus musculus
ggagcccgtgttttcaaagcccaga

SEQ ID NO: 327126 - DNA, 25 bp, Mus musculus
aagacaagtgcttcccttccggagc

SEQ ID NO: 327127 - DNA, 25 bp, Mus musculus
cccggctctctagcgggcaaagaca

SEQ ID NO: 327128 - DNA, 25 bp, Mus musculus
cgagcaccgactctctcagttattc

SEQ ID NO: 327129 - DNA, 25 bp, Mus musculus
gtgcgatggcaccacaagccctcat

SEQ ID NO: 327130 - DNA, 25 bp, Mus musculus
tctgctggggatacgctacttgccc

SEQ ID NO: 327131 - DNA, 25 bp, Mus musculus
ggagatcatcgcctctctgcagtcc

SEQ ID NO: 327132 - DNA, 25 bp, Mus musculus
ggctgcggattcgtacccacttcca

SEQ ID NO: 327133 - DNA, 25 bp, Mus musculus
aggcacgttatgaagaccaggagaa

SEQ ID NO: 327134 - DNA, 25 bp, Mus musculus
ccaggccgactttgaaggcacgtta

SEQ ID NO: 327135 - DNA, 25 bp, Mus musculus
cagcggttcagtccgcgggacttct

SEQ ID NO: 327136 - DNA, 25 bp, Mus musculus
gcgggacttctacatgcggagctcc

SEQ ID NO: 327137 - DNA, 25 bp, Mus musculus
cggcggcatcctccctacaaggagg

SEQ ID NO: 327138 - DNA, 25 bp, Mus musculus
aggttggcaccacccgaccggtgat

SEQ ID NO: 327139 - DNA, 25 bp, Mus musculus
agaatcgcccgtgctcgacgtaacc

SEQ ID NO: 327140 - DNA, 25 bp, Mus musculus
agcctgagcagcgatattgacgaca

SEQ ID NO: 327141 - DNA, 25 bp, Mus musculus
acttccagcgcgatctcgtgcgatg

SEQ ID NO: 327142 - DNA, 25 bp, Mus musculus
gccggtgaccacacgcgtgtccaag

SEQ ID NO: 327143 - DNA, 25 bp, Mus musculus
catgctcagcgtgccctttctggtc

SEQ ID NO: 327144 - DNA, 25 bp, Mus musculus
aagagcctggacgaaacgcttccca

SEQ ID NO: 327145 - DNA, 25 bp, Mus musculus
tcccagaatgggaccttaagcgagg

SEQ ID NO: 327146 - DNA, 25 bp, Mus musculus
gggtagcgccattctcatctctttc

SEQ ID NO: 327147 - DNA, 25 bp, Mus musculus
catctctttcatctactccgtggta

SEQ ID NO: 327148 - DNA, 25 bp, Mus musculus
actgtgtgggaactctatggtcatc

SEQ ID NO: 327149 - DNA, 25 bp, Mus musculus
cctggctattgctgatgagctgctc

SEQ ID NO: 327150 - DNA, 25 bp, Mus musculus
tctggtcacttccacgctgttgcgc

SEQ ID NO: 327151 - DNA, 25 bp, Mus musculus
atctacattctaaacctggctattg

SEQ ID NO: 327152 - DNA, 25 bp, Mus musculus
ccggcccacttcagctgggatgttc

SEQ ID NO: 327153 - DNA, 25 bp, Mus musculus
tatggtcatctatgtgatcctgcgc

SEQ ID NO: 327154 - DNA, 25 bp, Mus musculus
tgtgatcctgcgctacgccaagatg

SEQ ID NO: 327155 - DNA, 25 bp, Mus musculus
gaagaccgctaccaacatctacatt

SEQ ID NO: 327156 - DNA, 25 bp, Mus musculus
actccgtggtatgcttggtgggact

SEQ ID NO: 327157 - DNA, 25 bp, Mus musculus
gtcggcagttatcgcccaatggaaa

SEQ ID NO: 327158 - DNA, 25 bp, Mus musculus
aaggctcggcgcagtgcagtgccac

SEQ ID NO: 327159 - DNA, 25 bp, Mus musculus
agtgccacagtagctggagccagca

SEQ ID NO: 327160 - DNA, 25 bp, Mus musculus
ccctgtctgtcgttattggactact

SEQ ID NO: 327161 - DNA, 25 bp, Mus musculus
gtcgttattggactactcgcacgtc

SEQ ID NO: 327162 - DNA, 25 bp, Mus musculus
actcgcacgtccgtcggcagttatc

SEQ ID NO: 327163 - DNA, 25 bp, Mus musculus
gtccgtcggcagttatcgcccaatg

SEQ ID NO: 327164 - DNA, 25 bp, Mus musculus
cccaatggaaaacgagccggagcta

SEQ ID NO: 327165 - DNA, 25 bp, Mus musculus
ttggcctggcaacggactgcgctcg

SEQ ID NO: 327166 - DNA, 25 bp, Mus musculus
tggcaacggactgcgctcgcgactc

SEQ ID NO: 327167 - DNA, 25 bp, Mus musculus
ggcacccgcttcgtgcagaaccagg

SEQ ID NO: 327168 - DNA, 25 bp, Mus musculus
gcagtgcagtgccacagtagctgga

SEQ ID NO: 327169 - DNA, 25 bp, Mus musculus
gggtgcagctcgaccgacgcacgaa

SEQ ID NO: 327170 - DNA, 25 bp, Mus musculus
tcgtgcagaaccagggcgccacagc

SEQ ID NO: 327171 - DNA, 25 bp, Mus musculus
ctgcggaggaaccagtcgactacta

SEQ ID NO: 327172 - DNA, 25 bp, Mus musculus
gtcgactactatgccactgccctga

SEQ ID NO: 327173 - DNA, 25 bp, Mus musculus
gtcggacaacttcaagcgctctttc

SEQ ID NO: 327174 - DNA, 25 bp, Mus musculus
tgttcgccgagcaagacgacgccac

SEQ ID NO: 327175 - DNA, 25 bp, Mus musculus
cgacgccaccgtgagccagttgtct

SEQ ID NO: 327176 - DNA, 25 bp, Mus musculus
aatctggagtctggaggcgttttcc

SEQ ID NO: 327177 - DNA, 25 bp, Mus musculus
ctctacggcttcctgtcggacaact

SEQ ID NO: 327178 - DNA, 25 bp, Mus musculus
actgccctgaagagtcgagcctaca

SEQ ID NO: 327179 - DNA, 25 bp, Mus musculus
agcgctctttccagcgcatcctgtg

SEQ ID NO: 327180 - DNA, 25 bp, Mus musculus
cctgtgcctcagctggatggataac

SEQ ID NO: 327181 - DNA, 25 bp, Mus musculus
ggcgttttccgtaatggcacctgcg

SEQ ID NO: 327182 - DNA, 25 bp, Mus musculus
ggaggacttccagcccgagaatctg

SEQ ID NO: 327183 - DNA, 25 bp, Mus musculus
cgagcctacagcgtggaggacttcc

SEQ ID NO: 327184 - DNA, 25 bp, Mus musculus
cagttgtctgtcatcctgggctatg

SEQ ID NO: 327185 - DNA, 25 bp, Mus musculus
cgggacagagccaacaatcctgaca

SEQ ID NO: 327186 - DNA, 25 bp, Mus musculus
cgttgagtggcggaaaagatgaacc

SEQ ID NO: 327187 - DNA, 25 bp, Mus musculus
cgtcgccatgacaagcacagggttc

SEQ ID NO: 327188 - DNA, 25 bp, Mus musculus
aagcacagggttcagcgatctcggt

SEQ ID NO: 327189 - DNA, 25 bp, Mus musculus
cccgctgcttatgcgagagcacagc

SEQ ID NO: 327190 - DNA, 25 bp, Mus musculus
gtacctacctagaagctccgtgacg

SEQ ID NO: 327191 - DNA, 25 bp, Mus musculus
gcacagtcgtcagtccgctccaaag

SEQ ID NO: 327192 - DNA, 25 bp, Mus musculus
gctccaaagccctgtagcagccgtg

SEQ ID NO: 327193 - DNA, 25 bp, Mus musculus
tagcagccgtggcaccgcaatcagg

SEQ ID NO: 327194 - DNA, 25 bp, Mus musculus
ccgcctctgccacgtcaaaggggag

SEQ ID NO: 327195 - DNA, 25 bp, Mus musculus
tgccacgctagtccttaccacagta

SEQ ID NO: 327196 - DNA, 25 bp, Mus musculus
cgagcgtgaaagacggccaagcaaa

SEQ ID NO: 327197 - DNA, 25 bp, Mus musculus
ctagcaggaagcgatgcgatagcca

SEQ ID NO: 327198 - DNA, 25 bp, Mus musculus
cctgggccaggacaacatggctggt

SEQ ID NO: 327199 - DNA, 25 bp, Mus musculus
ttccagccgagtctgcggtggaaga

SEQ ID NO: 327200 - DNA, 25 bp, Mus musculus
gagagtgcagtgagtgatttcgccc

SEQ ID NO: 327201 - DNA, 25 bp, Mus musculus
caggaatatctgaggagagtgcagt

SEQ ID NO: 327202 - DNA, 25 bp, Mus musculus
gacgcctcaggaatatctgaggaga

SEQ ID NO: 327203 - DNA, 25 bp, Mus musculus
cttgacggaaggtttcgatccctcg

SEQ ID NO: 327204 - DNA, 25 bp, Mus musculus
gccctgtgacttgacggaaggtttc

SEQ ID NO: 327205 - DNA, 25 bp, Mus musculus
tgtggagccctgtgacttgacggaa

SEQ ID NO: 327206 - DNA, 25 bp, Mus musculus
cacggttgttacctgtggagccctg

SEQ ID NO: 327207 - DNA, 25 bp, Mus musculus
ggaagagttgatgccacggttgtta

SEQ ID NO: 327208 - DNA, 25 bp, Mus musculus
agcgagaaccatggcgtgggttcca

SEQ ID NO: 327209 - DNA, 25 bp, Mus musculus
actctgggcgccgattgagactggc

SEQ ID NO: 327210 - DNA, 25 bp, Mus musculus
gccgtgcctactctgggcgccgatt

SEQ ID NO: 327211 - DNA, 25 bp, Mus musculus
cttgcgcctgtagccggtggcctcg

SEQ ID NO: 327212 - DNA, 25 bp, Mus musculus
gttgatgccacggttgttacctgtg

SEQ ID NO: 327213 - DNA, 25 bp, Mus musculus
cgtctacgtcagcagggcgggagag

SEQ ID NO: 327214 - DNA, 25 bp, Mus musculus
taccgggcgtctacgtcagcagggc

SEQ ID NO: 327215 - DNA, 25 bp, Mus musculus
ctcagcggcctacccgggtcctaag

SEQ ID NO: 327216 - DNA, 25 bp, Mus musculus
aggaatggaggcaagtgtcaccgca

SEQ ID NO: 327217 - DNA, 25 bp, Mus musculus
atggaggcaagtgtcaccgcaggac

SEQ ID NO: 327218 - DNA, 25 bp, Mus musculus
ggaggcaagtgtcaccgcaggaccc

SEQ ID NO: 327219 - DNA, 25 bp, Mus musculus
aagtgtcaccgcaggaccccagggt

SEQ ID NO: 327220 - DNA, 25 bp, Mus musculus
ggtgcgtggcggcactcaccacttc

SEQ ID NO: 327221 - DNA, 25 bp, Mus musculus
ctgctcggcggacttgtacactccg

SEQ ID NO: 327222 - DNA, 25 bp, Mus musculus
gctcggcggacttgtacactccgga

SEQ ID NO: 327223 - DNA, 25 bp, Mus musculus
cgcgcccaccgcacgccgtgctcag

SEQ ID NO: 327224 - DNA, 25 bp, Mus musculus
accgcacgccgtgctcagcggccta

SEQ ID NO: 327225 - DNA, 25 bp, Mus musculus
aagctaccgggcgtctacgtcagca

SEQ ID NO: 327226 - DNA, 25 bp, Mus musculus
ctcggcggacttgtacactccggac

SEQ ID NO: 327227 - DNA, 25 bp, Mus musculus
atgacctccgagaagagccagacgc

SEQ ID NO: 327228 - DNA, 25 bp, Mus musculus
atggcagtccagagccgagtccacg

SEQ ID NO: 327229 - DNA, 25 bp, Mus musculus
agggcaagcgctcctactccatgga

SEQ ID NO: 327230 - DNA, 25 bp, Mus musculus
acctctcgctggagacgcccgtgtt

SEQ ID NO: 327231 - DNA, 25 bp, Mus musculus
ggtgacgctcttcaagaacgccatc

SEQ ID NO: 327232 - DNA, 25 bp, Mus musculus
caagcgttacggtggcttcatgacc

SEQ ID NO: 327233 - DNA, 25 bp, Mus musculus
gcaacccgcccaaggacaagcgtta

SEQ ID NO: 327234 - DNA, 25 bp, Mus musculus
ctactccatggagcacttccgctgg

SEQ ID NO: 327235 - DNA, 25 bp, Mus musculus
gccattaggcttggagcaggtcctg

SEQ ID NO: 327236 - DNA, 25 bp, Mus musculus
cccaggaacagcagcagtgctggca

SEQ ID NO: 327237 - DNA, 25 bp, Mus musculus
gggcttgcaaactcgacctctcgct

SEQ ID NO: 327238 - DNA, 25 bp, Mus musculus
cgcccgtgtttcctggcaacggaga

SEQ ID NO: 327239 - DNA, 25 bp, Mus musculus
tcctggcaacggagatgaacagccc

SEQ ID NO: 327240 - DNA, 25 bp, Mus musculus
agtacgtcatgggtcacttccgctg

SEQ ID NO: 327241 - DNA, 25 bp, Mus musculus
cggcctgcagctccttcatcttctc

SEQ ID NO: 327242 - DNA, 25 bp, Mus musculus
tgcagcttggtcttgagctccgtga

SEQ ID NO: 327243 - DNA, 25 bp, Mus musculus
accaggaccgcgtgcttgcgctgtt

SEQ ID NO: 327244 - DNA, 25 bp, Mus musculus
tgtcgcaacagtgcctcgcgcacgg

SEQ ID NO: 327245 - DNA, 25 bp, Mus musculus
tcgtgctgtcgcaacagtgcctcgc

SEQ ID NO: 327246 - DNA, 25 bp, Mus musculus
agctcggcctcgtgctgtcgcaaca

SEQ ID NO: 327247 - DNA, 25 bp, Mus musculus
tcccgcagggtgttgagcaaggcct

SEQ ID NO: 327248 - DNA, 25 bp, Mus musculus
cgccatcccgcagggtgttgagcaa

SEQ ID NO: 327249 - DNA, 25 bp, Mus musculus
cttgatgaccctcaggagctcggcc

SEQ ID NO: 327250 - DNA, 25 bp, Mus musculus
gtccttaatcttgatgaccctcagg

SEQ ID NO: 327251 - DNA, 25 bp, Mus musculus
ctggttctcgttgtccttaatcttg

SEQ ID NO: 327252 - DNA, 25 bp, Mus musculus
agccgctggttctcgttgtccttaa

SEQ ID NO: 327253 - DNA, 25 bp, Mus musculus
gtcttcaccttgtcgggcgcgccat

SEQ ID NO: 327254 - DNA, 25 bp, Mus musculus
tcttgagctccgtgaccaggaccgc

SEQ ID NO: 327255 - DNA, 25 bp, Mus musculus
ccggctgtcagtccttccgcgtgga

SEQ ID NO: 327256 - DNA, 25 bp, Mus musculus
cgcgaagcctgctgcagagagaaga

SEQ ID NO: 327257 - DNA, 25 bp, Mus musculus
acccgaatgatgtgaggtacggatc

SEQ ID NO: 327258 - DNA, 25 bp, Mus musculus
agacgccatgcctgcgcctagggca

SEQ ID NO: 327259 - DNA, 25 bp, Mus musculus
tgcggctccgaacccttgtcaagtc

SEQ ID NO: 327260 - DNA, 25 bp, Mus musculus
agaatatccgcaagctcaccgggcg

SEQ ID NO: 327261 - DNA, 25 bp, Mus musculus
gcccgagaagaagcccgcgatcatt

SEQ ID NO: 327262 - DNA, 25 bp, Mus musculus
gaatcacggatcgacaagcttcttc

SEQ ID NO: 327263 - DNA, 25 bp, Mus musculus
ggcttctcattggtccagaatcacg

SEQ ID NO: 327264 - DNA, 25 bp, Mus musculus
agctgagtgacttgccggcttctca

SEQ ID NO: 327265 - DNA, 25 bp, Mus musculus
cgcaagcagcggagcgcaaccacgg

SEQ ID NO: 327266 - DNA, 25 bp, Mus musculus
cctcaagaatgtggacgagaatatc

SEQ ID NO: 327267 - DNA, 25 bp, Mus musculus
agagctttgcaggagcagctagaga

SEQ ID NO: 327268 - DNA, 25 bp, Mus musculus
cttgcgaatggaaggaaggcccgcc

SEQ ID NO: 327269 - DNA, 25 bp, Mus musculus
agcaggagtgcacacgggctccatc

SEQ ID NO: 327270 - DNA, 25 bp, Mus musculus
cggtccctagggctaatgcagtttc

SEQ ID NO: 327271 - DNA, 25 bp, Mus musculus
acgaggaccgacgtgtgctcgccca

SEQ ID NO: 327272 - DNA, 25 bp, Mus musculus
tgaccagaccacacagttgacccgg

SEQ ID NO: 327273 - DNA, 25 bp, Mus musculus
tgcggactcgcaaagcaggacgcgt

SEQ ID NO: 327274 - DNA, 25 bp, Mus musculus
atgcagtttcagactggggcgcctg

SEQ ID NO: 327275 - DNA, 25 bp, Mus musculus
gcgtcgcgggccatttttctggcca

SEQ ID NO: 327276 - DNA, 25 bp, Mus musculus
ttctggccacaattatggcggaggc

SEQ ID NO: 327277 - DNA, 25 bp, Mus musculus
ctcaggctctagacgctcgtggcgt

SEQ ID NO: 327278 - DNA, 25 bp, Mus musculus
tcctcgtgctccgaagttggaggcc

SEQ ID NO: 327279 - DNA, 25 bp, Mus musculus
gccgctagtgcgttcgcgttcccag

SEQ ID NO: 327280 - DNA, 25 bp, Mus musculus
cgtcccaaaggagagcgtgtttttg

SEQ ID NO: 327281 - DNA, 25 bp, Mus musculus
gacgccttcgtgtccagagtccgaa

SEQ ID NO: 327282 - DNA, 25 bp, Mus musculus
tgctcgcccaggacaggttaaactc

SEQ ID NO: 327283 - DNA, 25 bp, Mus musculus
ctgggtagaagaggcactcccgcca

SEQ ID NO: 327284 - DNA, 25 bp, Mus musculus
tcggcggaaccaagtgcactcggac

SEQ ID NO: 327285 - DNA, 25 bp, Mus musculus
tgactttccgtaccgcaagcaagtg

SEQ ID NO: 327286 - DNA, 25 bp, Mus musculus
cgcggctttgcgagacttccggaac

SEQ ID NO: 327287 - DNA, 25 bp, Mus musculus
tcctctctcgaacggaccagggatg

SEQ ID NO: 327288 - DNA, 25 bp, Mus musculus
gggcaacgacctcgaaatcctctct

SEQ ID NO: 327289 - DNA, 25 bp, Mus musculus
tgcggcactgacaagaacaacaaca

SEQ ID NO: 327290 - DNA, 25 bp, Mus musculus
tgcttccgaggaaaccgtggttctc

SEQ ID NO: 327291 - DNA, 25 bp, Mus musculus
acgtgaccgttgacgtcagcgaccc

SEQ ID NO: 327292 - DNA, 25 bp, Mus musculus
tgctgcgctaagtcccgacgctttc

SEQ ID NO: 327293 - DNA, 25 bp, Mus musculus
gacgctttctcattcgctgggctga

SEQ ID NO: 327294 - DNA, 25 bp, Mus musculus
cgcacgccggcttctttttacatct

SEQ ID NO: 327295 - DNA, 25 bp, Mus musculus
tttacatcttgttcagagcaggaca

SEQ ID NO: 327296 - DNA, 25 bp, Mus musculus
gcaggacaaaatcggcttcccagga

SEQ ID NO: 327297 - DNA, 25 bp, Mus musculus
gctgaggactcgtcccagggcctca

SEQ ID NO: 327298 - DNA, 25 bp, Mus musculus
tcaaaggccgagagcacagctgcta

SEQ ID NO: 327299 - DNA, 25 bp, Mus musculus
cacagctgctactgcttggggtgtc

SEQ ID NO: 327300 - DNA, 25 bp, Mus musculus
cttggggtgtctcctgtttctaggg

SEQ ID NO: 327301 - DNA, 25 bp, Mus musculus
tcactgcagctagggaccggctctc

SEQ ID NO: 327302 - DNA, 25 bp, Mus musculus
tcgcaccacgctggggagcggctct

SEQ ID NO: 327303 - DNA, 25 bp, Mus musculus
tccagcccgaagtctcaaaggccga

SEQ ID NO: 327304 - DNA, 25 bp, Mus musculus
tgcggccgttctcgtcactgcagct

SEQ ID NO: 327305 - DNA, 25 bp, Mus musculus
ggttctctgaacacatccagcccga

SEQ ID NO: 327306 - DNA, 25 bp, Mus musculus
ttgcgcccgcggaaaatcggttctc

SEQ ID NO: 327307 - DNA, 25 bp, Mus musculus
gatttgtaggcacggcgctaaccct

SEQ ID NO: 327308 - DNA, 25 bp, Mus musculus
cctctgcttagggatttgtaggcac

SEQ ID NO: 327309 - DNA, 25 bp, Mus musculus
cgcgcctcctctgcttagggatttg

SEQ ID NO: 327310 - DNA, 25 bp, Mus musculus
cttgagcctgagctgaggactcgtc

SEQ ID NO: 327311 - DNA, 25 bp, Mus musculus
gtcggcaaagctcagaggaaaaaga

SEQ ID NO: 327312 - DNA, 25 bp, Mus musculus
atcgatttccacaaccctgaccgtg

SEQ ID NO: 327313 - DNA, 25 bp, Mus musculus
tgccctcaagatcgatttccacaac

SEQ ID NO: 327314 - DNA, 25 bp, Mus musculus
atctacaacgccatcgactcgctga

SEQ ID NO: 327315 - DNA, 25 bp, Mus musculus
tggacgcctgcaaggagtacaagcc

SEQ ID NO: 327316 - DNA, 25 bp, Mus musculus
ggggcttcaacctggacgcctgcaa

SEQ ID NO: 327317 - DNA, 25 bp, Mus musculus
catcgtcaagcagatgaagatcatc

SEQ ID NO: 327318 - DNA, 25 bp, Mus musculus
tcgggcaagagcaccatcgtcaagc

SEQ ID NO: 327319 - DNA, 25 bp, Mus musculus
ctgggcaccagcaactcgggcaaga

SEQ ID NO: 327320 - DNA, 25 bp, Mus musculus
cggcagcgccgtgaaatcaaacttc

SEQ ID NO: 327321 - DNA, 25 bp, Mus musculus
gtcccggagaattgaccgccacctg

SEQ ID NO: 327322 - DNA, 25 bp, Mus musculus
cgctgctgccggaccatgggatgtc

SEQ ID NO: 327323 - DNA, 25 bp, Mus musculus
gaccatgggatgtcggcaaagctca

SEQ ID NO: 327324 - DNA, 25 bp, Mus musculus
tgcgctccgaaagccagcggcagcg

SEQ ID NO: 327325 - DNA, 25 bp, Mus musculus
ttcccgcgacaggtggtcgagtcct

SEQ ID NO: 327326 - DNA, 25 bp, Mus musculus
gattgggcaagtccgaaggctgtac

SEQ ID NO: 327327 - DNA, 25 bp, Mus musculus
ccgcgacaggtggtcgagtcctccg

SEQ ID NO: 327328 - DNA, 25 bp, Mus musculus
tgggcaagtccgaaggctgtacaca

SEQ ID NO: 327329 - DNA, 25 bp, Mus musculus
tagtgcggtgttcggttcccgcgac

SEQ ID NO: 327330 - DNA, 25 bp, Mus musculus
tcccgtgcccctcggtagtgcggtg

SEQ ID NO: 327331 - DNA, 25 bp, Mus musculus
aactccgcaggacagcgggtcccgt

SEQ ID NO: 327332 - DNA, 25 bp, Mus musculus
gcgtggattccccaactccgcagga

SEQ ID NO: 327333 - DNA, 25 bp, Mus musculus
tgctccgtaacaagcgacgcgccgc

SEQ ID NO: 327334 - DNA, 25 bp, Mus musculus
tggcccgcggaatcctgctccgtaa

SEQ ID NO: 327335 - DNA, 25 bp, Mus musculus
acacaacccgacacgcgcacgctgg

SEQ ID NO: 327336 - DNA, 25 bp, Mus musculus
aaggctgtacacaacccgacacgcg

SEQ ID NO: 327337 - DNA, 25 bp, Mus musculus
agtccgaaggctgtacacaacccga

SEQ ID NO: 327338 - DNA, 25 bp, Mus musculus
cccgggctctccatgagcgagcggc

SEQ ID NO: 327339 - DNA, 25 bp, Mus musculus
tgtttcaactagctggtccgggcct

SEQ ID NO: 327340 - DNA, 25 bp, Mus musculus
taaccctgccctacggaaagatgcg

SEQ ID NO: 327341 - DNA, 25 bp, Mus musculus
tctcgttacgagaagataaccctgc

SEQ ID NO: 327342 - DNA, 25 bp, Mus musculus
tttgcctcagctcgttgtctcgtta

SEQ ID NO: 327343 - DNA, 25 bp, Mus musculus
agaggccttcagtttagcgcttttg

SEQ ID NO: 327344 - DNA, 25 bp, Mus musculus
gcttgcagcttctctcggacgttct

SEQ ID NO: 327345 - DNA, 25 bp, Mus musculus
cccgccgcaaggaagccttatatcg

SEQ ID NO: 327346 - DNA, 25 bp, Mus musculus
ttccaggctttgcaggctgccttgc

SEQ ID NO: 327347 - DNA, 25 bp, Mus musculus
agccctcccaagacggcaatggttc

SEQ ID NO: 327348 - DNA, 25 bp, Mus musculus
agactcggcttcttcaactcctgcg

SEQ ID NO: 327349 - DNA, 25 bp, Mus musculus
aaaaactattactgccgtggggctg

SEQ ID NO: 327350 - DNA, 25 bp, Mus musculus
cggcagattggtttccgggtcaaga

SEQ ID NO: 327351 - DNA, 25 bp, Mus musculus
ggatccttccgaggcgttccaggct

SEQ ID NO: 327352 - DNA, 25 bp, Mus musculus
tgggtgcatcaccatggaagcgctc

SEQ ID NO: 327353 - DNA, 25 bp, Mus musculus
cggcttcgctatggtttgggaagct

SEQ ID NO: 327354 - DNA, 25 bp, Mus musculus
ctatggtttgggaagctaagtttgc

SEQ ID NO: 327355 - DNA, 25 bp, Mus musculus
ctaagtttgcgactggaggccaccc

SEQ ID NO: 327356 - DNA, 25 bp, Mus musculus
tcacgtgaccgctgcgccttcggag

SEQ ID NO: 327357 - DNA, 25 bp, Mus musculus
cgcgtgcgcagtgtgatcccgaaga

SEQ ID NO: 327358 - DNA, 25 bp, Mus musculus
tggcaccgagcagcatccatagtga

SEQ ID NO: 327359 - DNA, 25 bp, Mus musculus
caggcccacctttggcgatcttggc

SEQ ID NO: 327360 - DNA, 25 bp, Mus musculus
tcggctcatggcaccgagcagcatc

SEQ ID NO: 327361 - DNA, 25 bp, Mus musculus
cctttggcgatcttggcccaggctt

SEQ ID NO: 327362 - DNA, 25 bp, Mus musculus
gatcttggcccaggcttcggctcat

SEQ ID NO: 327363 - DNA, 25 bp, Mus musculus
ccgagcagcatccatagtgaggtaa

SEQ ID NO: 327364 - DNA, 25 bp, Mus musculus
agcatccatagtgaggtaactgggg

SEQ ID NO: 327365 - DNA, 25 bp, Mus musculus
aggcttcggctcatggcaccgagca

SEQ ID NO: 327366 - DNA, 25 bp, Mus musculus
tggcaggcccacctttggcgatctt

SEQ ID NO: 327367 - DNA, 25 bp, Mus musculus
tttcagggtccttctcctcaggtcc

SEQ ID NO: 327368 - DNA, 25 bp, Mus musculus
taatgtccttcttgggcagctgctc

SEQ ID NO: 327369 - DNA, 25 bp, Mus musculus
acagatcctgtctgggatttaaatc

SEQ ID NO: 327370 - DNA, 25 bp, Mus musculus
ttggaatcagcccacactttctacg

SEQ ID NO: 327371 - DNA, 25 bp, Mus musculus
cacggtccatgcacgctgcggaaca

SEQ ID NO: 327372 - DNA, 25 bp, Mus musculus
gccgccatggtcctaaaccggattg

SEQ ID NO: 327373 - DNA, 25 bp, Mus musculus
cctgcagaaacttgataatgtcctt

SEQ ID NO: 327374 - DNA, 25 bp, Mus musculus
tgaaccgtgatcctgcagaaacttg

SEQ ID NO: 327375 - DNA, 25 bp, Mus musculus
ctttggtaccgaatctgaaccgtga

SEQ ID NO: 327376 - DNA, 25 bp, Mus musculus
ctggccgcccagatgcctttggtac

SEQ ID NO: 327377 - DNA, 25 bp, Mus musculus
cgaggaatccggtatgtaaggcatc

SEQ ID NO: 327378 - DNA, 25 bp, Mus musculus
gctccagggcctgccctaggaaata

SEQ ID NO: 327379 - DNA, 25 bp, Mus musculus
ggatttaaatctacggccgcagctc

SEQ ID NO: 327380 - DNA, 25 bp, Mus musculus
cgggcttacgccacgctctaggggt

SEQ ID NO: 327381 - DNA, 25 bp, Mus musculus
taccagctggacatctcccggagcg

SEQ ID NO: 327382 - DNA, 25 bp, Mus musculus
cactgtgtcgctggcgggagactaa

SEQ ID NO: 327383 - DNA, 25 bp, Mus musculus
tgcgctgccatccaggcgggttcct

SEQ ID NO: 327384 - DNA, 25 bp, Mus musculus
accatgagcggacggcagagaacgc

SEQ ID NO: 327385 - DNA, 25 bp, Mus musculus
cagagaacgctcttccagacgtggg

SEQ ID NO: 327386 - DNA, 25 bp, Mus musculus
tcttccagacgtggggcccgagcct

SEQ ID NO: 327387 - DNA, 25 bp, Mus musculus
tgcgcgactaccagctggacatctc

SEQ ID NO: 327388 - DNA, 25 bp, Mus musculus
gaatggcaaccaatcatcttcccgc

SEQ ID NO: 327389 - DNA, 25 bp, Mus musculus
tgcgcttcttctgatttccggaatg

SEQ ID NO: 327390 - DNA, 25 bp, Mus musculus
tacgcatgcgcttcttctgatttcc

SEQ ID NO: 327391 - DNA, 25 bp, Mus musculus
acacacttcgcgcaatacgcatgcg

SEQ ID NO: 327392 - DNA, 25 bp, Mus musculus
ctgcgggagccctgtggatctaccc

SEQ ID NO: 327393 - DNA, 25 bp, Mus musculus
ctgatttccggaatggcaaccaatc

SEQ ID NO: 327394 - DNA, 25 bp, Mus musculus
agtcgcggcggttgcgctgccatcc

SEQ ID NO: 327395 - DNA, 25 bp, Mus musculus
ctgtgagagcggaaagcgtccgacc

SEQ ID NO: 327396 - DNA, 25 bp, Mus musculus
aaacaggagcacagcccagagcggc

SEQ ID NO: 327397 - DNA, 25 bp, Mus musculus
gcgcgtcttccggaactccaggaaa

SEQ ID NO: 327398 - DNA, 25 bp, Mus musculus
gtttgtttctctccacaaggcgggc

SEQ ID NO: 327399 - DNA, 25 bp, Mus musculus
cctcacggagacttcggattttaga

SEQ ID NO: 327400 - DNA, 25 bp, Mus musculus
tggatttcaaatcccgagagcccgc

SEQ ID NO: 327401 - DNA, 25 bp, Mus musculus
cgctagggcagcaatgttaacgagc

SEQ ID NO: 327402 - DNA, 25 bp, Mus musculus
gcacggacaaatagcgctggatttc

SEQ ID NO: 327403 - DNA, 25 bp, Mus musculus
tagaacaaatctcgggcgctagggc

SEQ ID NO: 327404 - DNA, 25 bp, Mus musculus
cacgcgtgtccgcagactgaaactc

SEQ ID NO: 327405 - DNA, 25 bp, Mus musculus
cagaggacctaccttggtgaggaca

SEQ ID NO: 327406 - DNA, 25 bp, Mus musculus
gcagaagttagacgcccgagaagag

SEQ ID NO: 327407 - DNA, 25 bp, Mus musculus
cctcggttgctcgtggagtttgttt

SEQ ID NO: 327408 - DNA, 25 bp, Mus musculus
ctcccgtgatgctccgcggggagaa

SEQ ID NO: 327409 - DNA, 25 bp, Mus musculus
gggcgcagacgacgacaaccgaact

SEQ ID NO: 327410 - DNA, 25 bp, Mus musculus
aaacgatcgtagtcctcctggcctg

SEQ ID NO: 327411 - DNA, 25 bp, Mus musculus
ggccaccaggatgatgggcacattg

SEQ ID NO: 327412 - DNA, 25 bp, Mus musculus
gggcagaagtgctttacctcgggca

SEQ ID NO: 327413 - DNA, 25 bp, Mus musculus
gagtccggccactttcttaatatag

SEQ ID NO: 327414 - DNA, 25 bp, Mus musculus
gggctgtccaccgagaagcacataa

SEQ ID NO: 327415 - DNA, 25 bp, Mus musculus
ttagcttgattgactgccctgtccg

SEQ ID NO: 327416 - DNA, 25 bp, Mus musculus
cgatgtccgccacatagttctcgaa

SEQ ID NO: 327417 - DNA, 25 bp, Mus musculus
ttctcgaacacggtgggcacgtaca

SEQ ID NO: 327418 - DNA, 25 bp, Mus musculus
cacctcggggaattcgtctttactg

SEQ ID NO: 327419 - DNA, 25 bp, Mus musculus
accaccagcttcttgcggatggccg

SEQ ID NO: 327420 - DNA, 25 bp, Mus musculus
gctaggctcgctaactgcacctgga

SEQ ID NO: 327421 - DNA, 25 bp, Mus musculus
tagcgcccgctatttaaagagtccg

SEQ ID NO: 327422 - DNA, 25 bp, Mus musculus
cgggcacccacttctcggggatgtt

SEQ ID NO: 327423 - DNA, 25 bp, Mus musculus
tggcaaccgcctgtgcttcagtgtg

SEQ ID NO: 327424 - DNA, 25 bp, Mus musculus
cgaccagactggtaatggcaaccgc

SEQ ID NO: 327425 - DNA, 25 bp, Mus musculus
gcaggcaggatgaacgcggcttccc

SEQ ID NO: 327426 - DNA, 25 bp, Mus musculus
aggcaggatgaacgcggcttcccaa

SEQ ID NO: 327427 - DNA, 25 bp, Mus musculus
agaggaaaggagacgaacgagatta

SEQ ID NO: 327428 - DNA, 25 bp, Mus musculus
aacctcaacgaccagactggtaatg

SEQ ID NO: 327429 - DNA, 25 bp, Mus musculus
ctcaacgaccagactggtaatggca

SEQ ID NO: 327430 - DNA, 25 bp, Mus musculus
ccagactggtaatggcaaccgcctg

SEQ ID NO: 327431 - DNA, 25 bp, Mus musculus
gactggtaatggcaaccgcctgtgc

SEQ ID NO: 327432 - DNA, 25 bp, Mus musculus
ctggtaatggcaaccgcctgtgctt

SEQ ID NO: 327433 - DNA, 25 bp, Mus musculus
tggtaatggcaaccgcctgtgcttc

SEQ ID NO: 327434 - DNA, 25 bp, Mus musculus
gcaaccgcctgtgcttcagtgtggg

SEQ ID NO: 327435 - DNA, 25 bp, Mus musculus
aatggcaaccgcctgtgcttcagtg

SEQ ID NO: 327436 - DNA, 25 bp, Mus musculus
gaccagactggtaatggcaaccgcc

SEQ ID NO: 327437 - DNA, 25 bp, Mus musculus
cttacagtaccggtaacagcgagcc

SEQ ID NO: 327438 - DNA, 25 bp, Mus musculus
agggcctcgatcacgtgctccttgt

SEQ ID NO: 327439 - DNA, 25 bp, Mus musculus
aaggcgcctcgcatgccggtctgga

SEQ ID NO: 327440 - DNA, 25 bp, Mus musculus
acccatggcgacagcaggaacctca

SEQ ID NO: 327441 - DNA, 25 bp, Mus musculus
tgctccttgttctgcagcttggtgc

SEQ ID NO: 327442 - DNA, 25 bp, Mus musculus
gtggtttcccgaaggcgcctcgcat

SEQ ID NO: 327443 - DNA, 25 bp, Mus musculus
gcacctgcgcacgacagcatcttgt

SEQ ID NO: 327444 - DNA, 25 bp, Mus musculus
cgacagcatcttgttgatgcggatg

SEQ ID NO: 327445 - DNA, 25 bp, Mus musculus
ttgccacagctcttcaccatgtact

SEQ ID NO: 327446 - DNA, 25 bp, Mus musculus
accatgtacttgttggcgcagatgc

SEQ ID NO: 327447 - DNA, 25 bp, Mus musculus
catgtggccgcagagtggaaactca

SEQ ID NO: 327448 - DNA, 25 bp, Mus musculus
gccttcttccgacccaggtcaaaga

SEQ ID NO: 327449 - DNA, 25 bp, Mus musculus
tgggtacggcttgttcttacagtac

SEQ ID NO: 327450 - DNA, 25 bp, Mus musculus
gacatgatgacctggccgatgtgga

SEQ ID NO: 327451 - DNA, 25 bp, Mus musculus
cacgtataagcacacacacgcggga

SEQ ID NO: 327452 - DNA, 25 bp, Mus musculus
agcagagtccgagcaccaccacttg

SEQ ID NO: 327453 - DNA, 25 bp, Mus musculus
tctccggagccaaaagcagagtccg

SEQ ID NO: 327454 - DNA, 25 bp, Mus musculus
ggcagcaccaatctccggagccaaa

SEQ ID NO: 327455 - DNA, 25 bp, Mus musculus
cccgccagcaaagagggtgctcctg

SEQ ID NO: 327456 - DNA, 25 bp, Mus musculus
accaccacttgcaggagagggagga

SEQ ID NO: 327457 - DNA, 25 bp, Mus musculus
acggctcttccaaacagccttgagc

SEQ ID NO: 327458 - DNA, 25 bp, Mus musculus
tgttacacgacagagactcgcatcg

SEQ ID NO: 327459 - DNA, 25 bp, Mus musculus
ttgcaacgccaatcctgttacacga

SEQ ID NO: 327460 - DNA, 25 bp, Mus musculus
cccattccatcagttgccattgcaa

SEQ ID NO: 327461 - DNA, 25 bp, Mus musculus
cgcctttacaaagtaactcgcgaag

SEQ ID NO: 327462 - DNA, 25 bp, Mus musculus
acgcgaaccgcgctggacagccagg

SEQ ID NO: 327463 - DNA, 25 bp, Mus musculus
caagtgttcttcagggaagcggctc

SEQ ID NO: 327464 - DNA, 25 bp, Mus musculus
agagctgtgaggacaagtgttcttc

SEQ ID NO: 327465 - DNA, 25 bp, Mus musculus
cagacctgtcccatttggaggagga

SEQ ID NO: 327466 - DNA, 25 bp, Mus musculus
cggagaccttcctagagtgtttgta

SEQ ID NO: 327467 - DNA, 25 bp, Mus musculus
gaacatttctggatcggagaccttc

SEQ ID NO: 327468 - DNA, 25 bp, Mus musculus
cgctttgccggaagttctcgtaaca

SEQ ID NO: 327469 - DNA, 25 bp, Mus musculus
gacctccaggctgtactacgctttg

SEQ ID NO: 327470 - DNA, 25 bp, Mus musculus
ccgctctagtgggttcggaagccat

SEQ ID NO: 327471 - DNA, 25 bp, Mus musculus
tgcccgcttgccttttgactttaga

SEQ ID NO: 327472 - DNA, 25 bp, Mus musculus
ggcagcagagctcgcccactagaag

SEQ ID NO: 327473 - DNA, 25 bp, Mus musculus
tggaggcactcgctatctcaaggtc

SEQ ID NO: 327474 - DNA, 25 bp, Mus musculus
agctcttccctagaggccggtctga

SEQ ID NO: 327475 - DNA, 25 bp, Mus musculus
agccgcgcttttggagtttcctttg

SEQ ID NO: 327476 - DNA, 25 bp, Mus musculus
gaggcgttaaagctccttccctaga

SEQ ID NO: 327477 - DNA, 25 bp, Mus musculus
cggagtcattgctgcacggtaagcc

SEQ ID NO: 327478 - DNA, 25 bp, Mus musculus
tatattttctgctaggtgggcggcc

SEQ ID NO: 327479 - DNA, 25 bp, Mus musculus
cccggcctagctaagcccgtaatgg

SEQ ID NO: 327480 - DNA, 25 bp, Mus musculus
gacaacattggtccgcgtgctctga

SEQ ID NO: 327481 - DNA, 25 bp, Mus musculus
caaagttttttggagctacacgcta

SEQ ID NO: 327482 - DNA, 25 bp, Mus musculus
cgcgcaggcgctcttcaaagttttt

SEQ ID NO: 327483 - DNA, 25 bp, Mus musculus
cttgccttcagacgcccaacgagga

SEQ ID NO: 327484 - DNA, 25 bp, Mus musculus
tagagctgctggtgacccatcttgc

SEQ ID NO: 327485 - DNA, 25 bp, Mus musculus
acgcgtacgccgtgcgacaacattg

SEQ ID NO: 327486 - DNA, 25 bp, Mus musculus
ggccttgaatttccgacacccagtc

SEQ ID NO: 327487 - DNA, 25 bp, Mus musculus
gccgccacagtaaggtacagcactc

SEQ ID NO: 327488 - DNA, 25 bp, Mus musculus
tggccttaatggagccgccacagta

SEQ ID NO: 327489 - DNA, 25 bp, Mus musculus
gcggcacatgttcagcccgtatttg

SEQ ID NO: 327490 - DNA, 25 bp, Mus musculus
agcctatgtccttcgcgtactgccg

SEQ ID NO: 327491 - DNA, 25 bp, Mus musculus
cgcgcgtaccttaatgaagcctatg

SEQ ID NO: 327492 - DNA, 25 bp, Mus musculus
ccgaacttccgtgggtgactccagt

SEQ ID NO: 327493 - DNA, 25 bp, Mus musculus
tgggcattccaccattctacgtgga

SEQ ID NO: 327494 - DNA, 25 bp, Mus musculus
ggagcacgcagaggttctgtcatta

SEQ ID NO: 327495 - DNA, 25 bp, Mus musculus
ggactccgagaagccacaaagccga

SEQ ID NO: 327496 - DNA, 25 bp, Mus musculus
caaagccgatgggtttaggcgcacc

SEQ ID NO: 327497 - DNA, 25 bp, Mus musculus
catggacacctctatcgcgaggacc

SEQ ID NO: 327498 - DNA, 25 bp, Mus musculus
aagttttaaagcctgcgggccagcg

SEQ ID NO: 327499 - DNA, 25 bp, Mus musculus
ttagctgcaagatgaggctgccctg

SEQ ID NO: 327500 - DNA, 25 bp, Mus musculus
gaggtccgtagctgtcatttgccaa

SEQ ID NO: 327501 - DNA, 25 bp, Mus musculus
ttgccaaccttagggctcaagagcc

SEQ ID NO: 327502 - DNA, 25 bp, Mus musculus
ctgctggtctccaccatgaaggaca

SEQ ID NO: 327503 - DNA, 25 bp, Mus musculus
caggcagggaaccagctacaaggta

SEQ ID NO: 327504 - DNA, 25 bp, Mus musculus
tactttagctgctggcttctgcggg

SEQ ID NO: 327505 - DNA, 25 bp, Mus musculus
tatgagttggtagacagcgatcccg

SEQ ID NO: 327506 - DNA, 25 bp, Mus musculus
cccagcttaaggacatggtgccctc

SEQ ID NO: 327507 - DNA, 25 bp, Mus musculus
tgagcgacgggaatgcgaaccaata

SEQ ID NO: 327508 - DNA, 25 bp, Mus musculus
gtgtcgttagcagccagcacgcctc

SEQ ID NO: 327509 - DNA, 25 bp, Mus musculus
ttccgacgcctcaaagagctaggtc

SEQ ID NO: 327510 - DNA, 25 bp, Mus musculus
tgctccagacttaccgagagaccgg

SEQ ID NO: 327511 - DNA, 25 bp, Mus musculus
gagcggaagtcggaactgaacctga

SEQ ID NO: 327512 - DNA, 25 bp, Mus musculus
gcgaaccaataagcagcggcctcct

SEQ ID NO: 327513 - DNA, 25 bp, Mus musculus
ctcctccggaggcttctgagaagcg

SEQ ID NO: 327514 - DNA, 25 bp, Mus musculus
gcgcaggtaaaggaatcacggtgtc

SEQ ID NO: 327515 - DNA, 25 bp, Mus musculus
agaggccgccagcttcttttccgcg

SEQ ID NO: 327516 - DNA, 25 bp, Mus musculus
tggagaccatgaggttccgcatcta

SEQ ID NO: 327517 - DNA, 25 bp, Mus musculus
ccgcatctacaaacggaaggtgcta

SEQ ID NO: 327518 - DNA, 25 bp, Mus musculus
ctaatcctgacgctcgtggtggccg

SEQ ID NO: 327519 - DNA, 25 bp, Mus musculus
tcctctggagtagcaatgggcgaca

SEQ ID NO: 327520 - DNA, 25 bp, Mus musculus
cacgcgccgaacaggaaagggacga

SEQ ID NO: 327521 - DNA, 25 bp, Mus musculus
atcttcagggtcttggcgttcctgc

SEQ ID NO: 327522 - DNA, 25 bp, Mus musculus
taccagtgagttgctgcacacgttc

SEQ ID NO: 327523 - DNA, 25 bp, Mus musculus
ccgctgcaaaatcgcccgcggaagt

SEQ ID NO: 327524 - DNA, 25 bp, Mus musculus
gctacgtcgtcagttccggtctcct

SEQ ID NO: 327525 - DNA, 25 bp, Mus musculus
cgcgccttgttgtactgtgccttgc

SEQ ID NO: 327526 - DNA, 25 bp, Mus musculus
ttctcgagtccaggcacagcagctt

SEQ ID NO: 327527 - DNA, 25 bp, Mus musculus
cggcagctcgatggtgaccaccagc

SEQ ID NO: 327528 - DNA, 25 bp, Mus musculus
ggtccagcctgacgccgaactgctg

SEQ ID NO: 327529 - DNA, 25 bp, Mus musculus
tgaccaccagctcgtgcggcacggt

SEQ ID NO: 327530 - DNA, 25 bp, Mus musculus
agcagcggtaatcctggaggtctac

SEQ ID NO: 327531 - DNA, 25 bp, Mus musculus
cgtccagcatttcgcggaagcgctc

SEQ ID NO: 327532 - DNA, 25 bp, Mus musculus
ggtcagctccggttccatctgcaga

SEQ ID NO: 327533 - DNA, 25 bp, Mus musculus
cggctgctaggtacgcctaccagtg

SEQ ID NO: 327534 - DNA, 25 bp, Mus musculus
ggaagaccacgtcgtagacggtgta

SEQ ID NO: 327535 - DNA, 25 bp, Mus musculus
cgctccggcgccatgttcgcgattt

SEQ ID NO: 327536 - DNA, 25 bp, Mus musculus
tcgcctcttatgacagaatgttcta

SEQ ID NO: 327537 - DNA, 25 bp, Mus musculus
catgttcgcgatttggcgccaccgc

SEQ ID NO: 327538 - DNA, 25 bp, Mus musculus
agcttgaaagctgagaccgtgcggc

SEQ ID NO: 327539 - DNA, 25 bp, Mus musculus
ggttacctcgagactcacctcctga

SEQ ID NO: 327540 - DNA, 25 bp, Mus musculus
gcgggtcaggttacctcgagactca

SEQ ID NO: 327541 - DNA, 25 bp, Mus musculus
atgttctagatagggcattgcggcg

SEQ ID NO: 327542 - DNA, 25 bp, Mus musculus
gctctgcagcctcaaatgcaccgga

SEQ ID NO: 327543 - DNA, 25 bp, Mus musculus
atcgcggaaacccaggtaggctctg

SEQ ID NO: 327544 - DNA, 25 bp, Mus musculus
gcacccggcgccaggatcgcggaaa

SEQ ID NO: 327545 - DNA, 25 bp, Mus musculus
tggaagtaacattcgcacccggcgc

SEQ ID NO: 327546 - DNA, 25 bp, Mus musculus
gctcagttcggcgtcagcgcgcagc

SEQ ID NO: 327547 - DNA, 25 bp, Mus musculus
ggggacctccgttgatcagaagcca

SEQ ID NO: 327548 - DNA, 25 bp, Mus musculus
tgcaccggagagacatcgcctctta

SEQ ID NO: 327549 - DNA, 25 bp, Mus musculus
tttcggggtgcgtgacccctccagc

SEQ ID NO: 327550 - DNA, 25 bp, Mus musculus
ccgtgctgcccacatcgctcccgct

SEQ ID NO: 327551 - DNA, 25 bp, Mus musculus
tggccgcgcagacgcgcaggttcct

SEQ ID NO: 327552 - DNA, 25 bp, Mus musculus
cagcctccgtggctcaggactggag

SEQ ID NO: 327553 - DNA, 25 bp, Mus musculus
acccgcaggcgttctgcgtggccga

SEQ ID NO: 327554 - DNA, 25 bp, Mus musculus
agaggaccccagaacgtcgtgccgc

SEQ ID NO: 327555 - DNA, 25 bp, Mus musculus
agacgcgcaggttcctcggttccgc

SEQ ID NO: 327556 - DNA, 25 bp, Mus musculus
cacaggctcccaggcgagccgcctg

SEQ ID NO: 327557 - DNA, 25 bp, Mus musculus
ctcgcgttccgttcgcgcgtgcgag

SEQ ID NO: 327558 - DNA, 25 bp, Mus musculus
cagtggtggacggacacttcctcta

SEQ ID NO: 327559 - DNA, 25 bp, Mus musculus
tggacggacacttcctctacgtgtg

SEQ ID NO: 327560 - DNA, 25 bp, Mus musculus
acggacacttcctctacgtgtgggg

SEQ ID NO: 327561 - DNA, 25 bp, Mus musculus
ggcgacgcagcactcccacaggctc

SEQ ID NO: 327562 - DNA, 25 bp, Mus musculus
cgccaatctggaccctcctcgcgtt

SEQ ID NO: 327563 - DNA, 25 bp, Mus musculus
gctttcctttgtctcccgtctgcgg

SEQ ID NO: 327564 - DNA, 25 bp, Mus musculus
aggttctgttattgtgggtcgcgta

SEQ ID NO: 327565 - DNA, 25 bp, Mus musculus
gggatcctgggctattgtcaccgct

SEQ ID NO: 327566 - DNA, 25 bp, Mus musculus
tgactgtggcccgaggtacggaaaa

SEQ ID NO: 327567 - DNA, 25 bp, Mus musculus
cctacgcattgtctttggagtgagc

SEQ ID NO: 327568 - DNA, 25 bp, Mus musculus
tgtcaccgctctcttgaacttatga

SEQ ID NO: 327569 - DNA, 25 bp, Mus musculus
ttcaggagagcatcttcccgccctg

SEQ ID NO: 327570 - DNA, 25 bp, Mus musculus
ccgcggctcttgctcattcaggaga

SEQ ID NO: 327571 - DNA, 25 bp, Mus musculus
acatgttcgtctggggcggctacaa

SEQ ID NO: 327572 - DNA, 25 bp, Mus musculus
gcctcaagatggctgatggcaacga

SEQ ID NO: 327573 - DNA, 25 bp, Mus musculus
ttccggcggcggcataaacaaggcc

SEQ ID NO: 327574 - DNA, 25 bp, Mus musculus
ttatgagtcagcctatcccacgcac

SEQ ID NO: 327575 - DNA, 25 bp, Mus musculus
tcatatacctttgggcccggtcgcc

SEQ ID NO: 327576 - DNA, 25 bp, Mus musculus
ttcgagaactacgaggccatggagc

SEQ ID NO: 327577 - DNA, 25 bp, Mus musculus
gcagcggcgggaaaacaggaggctc

SEQ ID NO: 327578 - DNA, 25 bp, Mus musculus
tgactgacagccccagagactgaaa

SEQ ID NO: 327579 - DNA, 25 bp, Mus musculus
gatccgcgtctgcaaagacaagggc

SEQ ID NO: 327580 - DNA, 25 bp, Mus musculus
agatccgcgtctgcaaagacaaggg

SEQ ID NO: 327581 - DNA, 25 bp, Mus musculus
ctggcgggccgttttcgggtggcag

SEQ ID NO: 327582 - DNA, 25 bp, Mus musculus
aaaacaggaggctcgggtctgtgca

SEQ ID NO: 327583 - DNA, 25 bp, Mus musculus
aaacaggaggctcgggtctgtgcac

SEQ ID NO: 327584 - DNA, 25 bp, Mus musculus
cgctctgcttgagagtgctggtctg

SEQ ID NO: 327585 - DNA, 25 bp, Mus musculus
agtgctggtctgtggcgggaagtcc

SEQ ID NO: 327586 - DNA, 25 bp, Mus musculus
ctctgcttgagagtgctggtctgtg

SEQ ID NO: 327587 - DNA, 25 bp, Mus musculus
aggctcgggtctgtgcacgcgctct

SEQ ID NO: 327588 - DNA, 25 bp, Mus musculus
cgcgctctgcttgagagtgctggtc

SEQ ID NO: 327589 - DNA, 25 bp, Mus musculus
cacgcgctctgcttgagagtgctgg

SEQ ID NO: 327590 - DNA, 25 bp, Mus musculus
gcacgcgctctgcttgagagtgctg

SEQ ID NO: 327591 - DNA, 25 bp, Mus musculus
gaccgtgaggctctccgtctcgcga

SEQ ID NO: 327592 - DNA, 25 bp, Mus musculus
ggtcaaccgtgctgaaccggctctt

SEQ ID NO: 327593 - DNA, 25 bp, Mus musculus
gcatgagcgcttggcttgtgtctac

SEQ ID NO: 327594 - DNA, 25 bp, Mus musculus
ccactatgcttctgcgcatgagcgc

SEQ ID NO: 327595 - DNA, 25 bp, Mus musculus
agccgacgcaggaccactatgcttc

SEQ ID NO: 327596 - DNA, 25 bp, Mus musculus
tcctttcagggactgagccgacgca

SEQ ID NO: 327597 - DNA, 25 bp, Mus musculus
tcgcattcagttccgcgagcactgc

SEQ ID NO: 327598 - DNA, 25 bp, Mus musculus
gagatgcagcatcaggcacggtccc

SEQ ID NO: 327599 - DNA, 25 bp, Mus musculus
tccctctgctgtgaacgagcctgtc

SEQ ID NO: 327600 - DNA, 25 bp, Mus musculus
gaaccggctcttcatggctaggctg

SEQ ID NO: 327601 - DNA, 25 bp, Mus musculus
gaatcagcgccagggagatgcagca

SEQ ID NO: 327602 - DNA, 25 bp, Mus musculus
tgtcgctaccgcagtcctttcaggg

SEQ ID NO: 327603 - DNA, 25 bp, Mus musculus
cggcaagacctctcggaatcagcgc

SEQ ID NO: 327604 - DNA, 25 bp, Mus musculus
accaaacgctcgctgcgggactcag

SEQ ID NO: 327605 - DNA, 25 bp, Mus musculus
gagagggcctcaaacggttcctctg

SEQ ID NO: 327606 - DNA, 25 bp, Mus musculus
cgccttcttccgctggagcctggag

SEQ ID NO: 327607 - DNA, 25 bp, Mus musculus
caaatcgttcgtattctctcaaaaa

SEQ ID NO: 327608 - DNA, 25 bp, Mus musculus
tctcaaaaactggtcgcgaagggga

SEQ ID NO: 327609 - DNA, 25 bp, Mus musculus
ggcctcaaacggttcctctgcatcg

SEQ ID NO: 327610 - DNA, 25 bp, Mus musculus
gatgtcacctgggtccgccttcttc

SEQ ID NO: 327611 - DNA, 25 bp, Mus musculus
cagagactgtgatgtcacctgggtc

SEQ ID NO: 327612 - DNA, 25 bp, Mus musculus
gacacgccctgacacgcccagctcg

SEQ ID NO: 327613 - DNA, 25 bp, Mus musculus
aagccttcgctgacacgccctgaca

SEQ ID NO: 327614 - DNA, 25 bp, Mus musculus
ccggaggcagggcaaagccttcgct

SEQ ID NO: 327615 - DNA, 25 bp, Mus musculus
cgtcaccggaggcagggcaaagcct

SEQ ID NO: 327616 - DNA, 25 bp, Mus musculus
cttgtgttttattacaaatcgttcg

SEQ ID NO: 327617 - DNA, 25 bp, Mus musculus
ccagctcgggcggtccagagactgt

SEQ ID NO: 327618 - DNA, 25 bp, Mus musculus
gtattctctcaaaaactggtcgcga

SEQ ID NO: 327619 - DNA, 25 bp, Mus musculus
ggcatctccaagtgtctccgcggga

SEQ ID NO: 327620 - DNA, 25 bp, Mus musculus
gctgacgagcagcagagcccttaca

SEQ ID NO: 327621 - DNA, 25 bp, Mus musculus
tcacagagcagagcggtcaccgagt

SEQ ID NO: 327622 - DNA, 25 bp, Mus musculus
tggtggcagttaccaccgacaacgg

SEQ ID NO: 327623 - DNA, 25 bp, Mus musculus
gggctgacctatttcctgcgagtgc

SEQ ID NO: 327624 - DNA, 25 bp, Mus musculus
ctccacagtgccacaggggctcgga

SEQ ID NO: 327625 - DNA, 25 bp, Mus musculus
ggctcggagagtccttccaaaaaca

SEQ ID NO: 327626 - DNA, 25 bp, Mus musculus
accggcacaggacagcgtgcgcatc

SEQ ID NO: 327627 - DNA, 25 bp, Mus musculus
tcggcgcagttcagaggcttccgtc

SEQ ID NO: 327628 - DNA, 25 bp, Mus musculus
tgcccttgaggctcccggcaaatgg

SEQ ID NO: 327629 - DNA, 25 bp, Mus musculus
ggaatgcgtggctcgcaccctctgc

SEQ ID NO: 327630 - DNA, 25 bp, Mus musculus
ttaaaggacggcgaggcatctccaa

SEQ ID NO: 327631 - DNA, 25 bp, Mus musculus
ctccgcgggataagcgaagttggta

SEQ ID NO: 327632 - DNA, 25 bp, Mus musculus
ctctgcctcgtagggacttgaggag

SEQ ID NO: 327633 - DNA, 25 bp, Mus musculus
cgctcttccgaacggtcgggccgag

SEQ ID NO: 327634 - DNA, 25 bp, Mus musculus
aagctgggccaatcggtgaccacca

SEQ ID NO: 327635 - DNA, 25 bp, Mus musculus
atcctgtacaagttgaagctgggcc

SEQ ID NO: 327636 - DNA, 25 bp, Mus musculus
gccggcaagacaacgatcctgtaca

SEQ ID NO: 327637 - DNA, 25 bp, Mus musculus
aaatgcggatcctcatgctgggcct

SEQ ID NO: 327638 - DNA, 25 bp, Mus musculus
cttcgggaacaaggaaatgcggatc

SEQ ID NO: 327639 - DNA, 25 bp, Mus musculus
tggggaaggtgctatccaagatctt

SEQ ID NO: 327640 - DNA, 25 bp, Mus musculus
ccggctcttccgacgcgatggggaa

SEQ ID NO: 327641 - DNA, 25 bp, Mus musculus
gttcccgcgaggatccatgacctga

SEQ ID NO: 327642 - DNA, 25 bp, Mus musculus
tggaggtaacctcaagggccgagcc

SEQ ID NO: 327643 - DNA, 25 bp, Mus musculus
agcgcgggccactctcctttcagag

SEQ ID NO: 327644 - DNA, 25 bp, Mus musculus
gcttcaacgtggagacggtgactta

SEQ ID NO: 327645 - DNA, 25 bp, Mus musculus
cctttcagaggtcgcgctcttccga

SEQ ID NO: 327646 - DNA, 25 bp, Mus musculus
tctctgtgtccctgcaggcgagcac

SEQ ID NO: 327647 - DNA, 25 bp, Mus musculus
aggtacaggcgcaaggctgcacgcc

SEQ ID NO: 327648 - DNA, 25 bp, Mus musculus
ctgcccaaggcgcatgcgtgactct

SEQ ID NO: 327649 - DNA, 25 bp, Mus musculus
gcagcacccgtacctcccagcggca

SEQ ID NO: 327650 - DNA, 25 bp, Mus musculus
caggctgcggcacgcggtaacgtca

SEQ ID NO: 327651 - DNA, 25 bp, Mus musculus
gcacaaagctccacagcgggtcctc

SEQ ID NO: 327652 - DNA, 25 bp, Mus musculus
tgtcccatcccgcttctccagaacc

SEQ ID NO: 327653 - DNA, 25 bp, Mus musculus
tgctgcagccgaagcactgtcccat

SEQ ID NO: 327654 - DNA, 25 bp, Mus musculus
gacgatggcggcgtcccacacaacg

SEQ ID NO: 327655 - DNA, 25 bp, Mus musculus
ccggcgtctccaggtatttggaaag

SEQ ID NO: 327656 - DNA, 25 bp, Mus musculus
tgatgctgggcgaccagcgccttcc

SEQ ID NO: 327657 - DNA, 25 bp, Mus musculus
gctgcacgccggtgacctgatgctg

SEQ ID NO: 327658 - DNA, 25 bp, Mus musculus
gcgcatgcgtgactctcaaagtccg

SEQ ID NO: 327659 - DNA, 25 bp, Mus musculus
tcttacccgagggtcgcagccatga

SEQ ID NO: 327660 - DNA, 25 bp, Mus musculus
ccaggtatttggaaaggacgatggc

SEQ ID NO: 327661 - DNA, 25 bp, Mus musculus
gagtcacctccagagggccctcggg

SEQ ID NO: 327662 - DNA, 25 bp, Mus musculus
ctcggcagcgttccgagtcctggca

SEQ ID NO: 327663 - DNA, 25 bp, Mus musculus
tgaccttccgcagggccgggaccaa

SEQ ID NO: 327664 - DNA, 25 bp, Mus musculus
cgttacaagttgtgcgagctccggg

SEQ ID NO: 327665 - DNA, 25 bp, Mus musculus
ccgggagggtaatcggtctctcctg

SEQ ID NO: 327666 - DNA, 25 bp, Mus musculus
tcccgagtctctggagaagaccagc

SEQ ID NO: 327667 - DNA, 25 bp, Mus musculus
cgccatttcgggctgttttcttcgc

SEQ ID NO: 327668 - DNA, 25 bp, Mus musculus
ttcgggctgttttcttcgctgaaga

SEQ ID NO: 327669 - DNA, 25 bp, Mus musculus
tcctcctcctttgtctgggtgcgca

SEQ ID NO: 327670 - DNA, 25 bp, Mus musculus
aatcggtctctcctgggaacgtgca

SEQ ID NO: 327671 - DNA, 25 bp, Mus musculus
ttcgctgaagaactcgtagggctgc

SEQ ID NO: 327672 - DNA, 25 bp, Mus musculus
ttccagacgaactcggcagcgttcc

SEQ ID NO: 327673 - DNA, 25 bp, Mus musculus
gtggctcttccagacgaactcggca

SEQ ID NO: 327674 - DNA, 25 bp, Mus musculus
ctctggagaagaccagcacggagca

SEQ ID NO: 327675 - DNA, 25 bp, Mus musculus
acgccggcgctgttccgccagagaa

SEQ ID NO: 327676 - DNA, 25 bp, Mus musculus
ggctggaccacagaatcaggacttc

SEQ ID NO: 327677 - DNA, 25 bp, Mus musculus
aatcaggacttcctcgccggggaca

SEQ ID NO: 327678 - DNA, 25 bp, Mus musculus
cacagacaggttcagttggagatcc

SEQ ID NO: 327679 - DNA, 25 bp, Mus musculus
atccctgagcggaacagcaagtgca

SEQ ID NO: 327680 - DNA, 25 bp, Mus musculus
cgcctctcacttacctggtgctgga

SEQ ID NO: 327681 - DNA, 25 bp, Mus musculus
gcagtaccgggccagtccgcagaca

SEQ ID NO: 327682 - DNA, 25 bp, Mus musculus
gcagacaccgcctacgtagcgcagg

SEQ ID NO: 327683 - DNA, 25 bp, Mus musculus
cctgaacggactctaagggtgaagc

SEQ ID NO: 327684 - DNA, 25 bp, Mus musculus
cgagagccaatgaaacacgcgcgtt

SEQ ID NO: 327685 - DNA, 25 bp, Mus musculus
aacacgcgcgtttgcctgacgtggg

SEQ ID NO: 327686 - DNA, 25 bp, Mus musculus
gtggtctccgctggccaatgagcga

SEQ ID NO: 327687 - DNA, 25 bp, Mus musculus
agcacgccgtgagtaagaggagcta

SEQ ID NO: 327688 - DNA, 25 bp, Mus musculus
gcacaaacgcagtggacgaaccctg

SEQ ID NO: 327689 - DNA, 25 bp, Mus musculus
tctcggcccagctctagcacagcag

SEQ ID NO: 327690 - DNA, 25 bp, Mus musculus
tctagtttcgggtctcaattccctc

SEQ ID NO: 327691 - DNA, 25 bp, Mus musculus
gccctccgccctgctgtacccgcag

SEQ ID NO: 327692 - DNA, 25 bp, Mus musculus
atccccatgggaaccgcgccggttg

SEQ ID NO: 327693 - DNA, 25 bp, Mus musculus
tcggctgggtgactgctgcgatccc

SEQ ID NO: 327694 - DNA, 25 bp, Mus musculus
cccagctctagcacagcagcctgca

SEQ ID NO: 327695 - DNA, 25 bp, Mus musculus
cctgcagctcggctgggtgactgct

SEQ ID NO: 327696 - DNA, 25 bp, Mus musculus
accctgactcctgaggcgcctctcg

SEQ ID NO: 327697 - DNA, 25 bp, Mus musculus
cggaagaggacaccggctgggcaac

SEQ ID NO: 327698 - DNA, 25 bp, Mus musculus
tccctccggaagaggacaccggctg

SEQ ID NO: 327699 - DNA, 25 bp, Mus musculus
tctcaattccctccggaagaggaca

SEQ ID NO: 327700 - DNA, 25 bp, Mus musculus
ggtctcaattccctccggaagagga

SEQ ID NO: 327701 - DNA, 25 bp, Mus musculus
tgctgtacccgcagccacttggccg

SEQ ID NO: 327702 - DNA, 25 bp, Mus musculus
tcgggtctcaattccctccggaaga

SEQ ID NO: 327703 - DNA, 25 bp, Mus musculus
gttccacacactgttcccggtggta

SEQ ID NO: 327704 - DNA, 25 bp, Mus musculus
cgctagccttagaaccgatggggaa

SEQ ID NO: 327705 - DNA, 25 bp, Mus musculus
agaggccgtccgttcttggccgagc

SEQ ID NO: 327706 - DNA, 25 bp, Mus musculus
tctgcaccagctcgtagtcgtgctg

SEQ ID NO: 327707 - DNA, 25 bp, Mus musculus
ttccgtctcaggatgtcggcggcag

SEQ ID NO: 327708 - DNA, 25 bp, Mus musculus
gcgcgcggcgcttcccaacatggag

SEQ ID NO: 327709 - DNA, 25 bp, Mus musculus
ggagacccgcgtcttctccgagacg

SEQ ID NO: 327710 - DNA, 25 bp, Mus musculus
ctgcgtcaccgggagacacgttcgc

SEQ ID NO: 327711 - DNA, 25 bp, Mus musculus
agcctcggccaggattcgcccagtg

SEQ ID NO: 327712 - DNA, 25 bp, Mus musculus
cgctgccttctgcttcctttcggta

SEQ ID NO: 327713 - DNA, 25 bp, Mus musculus
gccgggttaactaaatgccggcaca

SEQ ID NO: 327714 - DNA, 25 bp, Mus musculus
gtggtaccagttccgaggctggacc

SEQ ID NO: 327715 - DNA, 25 bp, Mus musculus
ttaagtctgccggtcgctagcctta

SEQ ID NO: 327716 - DNA, 25 bp, Mus musculus
tctgcttcctttcggtacaggtaaa

SEQ ID NO: 327717 - DNA, 25 bp, Mus musculus
tccgccgcatgttggccgcgctaag

SEQ ID NO: 327718 - DNA, 25 bp, Mus musculus
agcggctctcgccttggacttgcct

SEQ ID NO: 327719 - DNA, 25 bp, Mus musculus
tgtggcgaccatcgcggccctcagt

SEQ ID NO: 327720 - DNA, 25 bp, Mus musculus
aaccgcagccgcgtgtcctggttgc

SEQ ID NO: 327721 - DNA, 25 bp, Mus musculus
cccgggaagtcagccggctcaacga

SEQ ID NO: 327722 - DNA, 25 bp, Mus musculus
gggacagcatcctcgcggacgactc

SEQ ID NO: 327723 - DNA, 25 bp, Mus musculus
tttggttttcttgcgggacagcatc

SEQ ID NO: 327724 - DNA, 25 bp, Mus musculus
ggggcgacgtctccttcttcacgta

SEQ ID NO: 327725 - DNA, 25 bp, Mus musculus
actcactccgcagcaggggcgacgt

SEQ ID NO: 327726 - DNA, 25 bp, Mus musculus
atttcccagagtcggtcttccagca

SEQ ID NO: 327727 - DNA, 25 bp, Mus musculus
cacggacagccatgcatttcccaga

SEQ ID NO: 327728 - DNA, 25 bp, Mus musculus
agaggtgcccgggtcgaagcacttt

SEQ ID NO: 327729 - DNA, 25 bp, Mus musculus
ccggacgtacccagcagagaggtgc

SEQ ID NO: 327730 - DNA, 25 bp, Mus musculus
gaatgctgggaaagccgacgcgcac

SEQ ID NO: 327731 - DNA, 25 bp, Mus musculus
gcacagaccatgaccgcgggactct

SEQ ID NO: 327732 - DNA, 25 bp, Mus musculus
ctccggagctctgcaagcaaagggc

SEQ ID NO: 327733 - DNA, 25 bp, Mus musculus
cgggcacgcgtccttccagaggacg

SEQ ID NO: 327734 - DNA, 25 bp, Mus musculus
ttccagaggacgcaactagggaccc

SEQ ID NO: 327735 - DNA, 25 bp, Mus musculus
gcgggcgtcatttccatatgtaagg

SEQ ID NO: 327736 - DNA, 25 bp, Mus musculus
ggtcgcctcagcgtaccagctggca

SEQ ID NO: 327737 - DNA, 25 bp, Mus musculus
ttccatatgtaaggggccagcgctc

SEQ ID NO: 327738 - DNA, 25 bp, Mus musculus
agcgaggcacagtggcagctttcac

SEQ ID NO: 327739 - DNA, 25 bp, Mus musculus
ggtccctcgtagaccgcgcattggc

SEQ ID NO: 327740 - DNA, 25 bp, Mus musculus
gcgggccagcccaggttcctagcaa

SEQ ID NO: 327741 - DNA, 25 bp, Mus musculus
cagcttgtcgcttaccgagtcccgg

SEQ ID NO: 327742 - DNA, 25 bp, Mus musculus
ttgaatttgggaacgccctggctcc

SEQ ID NO: 327743 - DNA, 25 bp, Mus musculus
tgcacccagaggtcgcctcagcgta

SEQ ID NO: 327744 - DNA, 25 bp, Mus musculus
cccgccagggagatttgaatttggg

SEQ ID NO: 327745 - DNA, 25 bp, Mus musculus
cctttgccggccttagtgaccagat

SEQ ID NO: 327746 - DNA, 25 bp, Mus musculus
tacgcacttcactgcgaggcgtcgc

SEQ ID NO: 327747 - DNA, 25 bp, Mus musculus
tttctcccgcagtgctttgcgcgcg

SEQ ID NO: 327748 - DNA, 25 bp, Mus musculus
cgcgcgggagaagtacgcacttcac

SEQ ID NO: 327749 - DNA, 25 bp, Mus musculus
cggcagccatgttgttgtgagtctc

SEQ ID NO: 327750 - DNA, 25 bp, Mus musculus
tgtgagtctctgtgcctcaccctcg

SEQ ID NO: 327751 - DNA, 25 bp, Mus musculus
gtgcctcaccctcggtacttcggtg

SEQ ID NO: 327752 - DNA, 25 bp, Mus musculus
taaaggccgggaagtgcacgcccga

SEQ ID NO: 327753 - DNA, 25 bp, Mus musculus
ggagaaagaagacgtcgccgccacc

SEQ ID NO: 327754 - DNA, 25 bp, Mus musculus
cagtctggaagaagcacggtgaatc

SEQ ID NO: 327755 - DNA, 25 bp, Mus musculus
tagtgaccagatccgtgtgggtgcc

SEQ ID NO: 327756 - DNA, 25 bp, Mus musculus
cctcggtgcccacagtctggaagaa

SEQ ID NO: 327757 - DNA, 25 bp, Mus musculus
aggccagccctgatcccagaaggta

SEQ ID NO: 327758 - DNA, 25 bp, Mus musculus
tgaatccagagaaacgtgcgaggtg

SEQ ID NO: 327759 - DNA, 25 bp, Mus musculus
cacgtagtgcgcaaaggctctgacc

SEQ ID NO: 327760 - DNA, 25 bp, Mus musculus
gcccttcgcctggtaccttgggaca

SEQ ID NO: 327761 - DNA, 25 bp, Mus musculus
ctggtaccttgggacacttgtcgta

SEQ ID NO: 327762 - DNA, 25 bp, Mus musculus
cttgtcgtagtagtgctgctgtgta

SEQ ID NO: 327763 - DNA, 25 bp, Mus musculus
tgctgctgtgtacggatccagcgcc

SEQ ID NO: 327764 - DNA, 25 bp, Mus musculus
cttgaccagagtgaagtgcaggtga

SEQ ID NO: 327765 - DNA, 25 bp, Mus musculus
aagtgcaggtgacggttgaaaccct

SEQ ID NO: 327766 - DNA, 25 bp, Mus musculus
gaaaccctttttcagctcggccaca

SEQ ID NO: 327767 - DNA, 25 bp, Mus musculus
tttcagctcggccacattctctacg

SEQ ID NO: 327768 - DNA, 25 bp, Mus musculus
acgatgcctcggatgctgatctgcc

SEQ ID NO: 327769 - DNA, 25 bp, Mus musculus
ctgatctgccgtcgcttctcctggt

SEQ ID NO: 327770 - DNA, 25 bp, Mus musculus
agcacagaacggtctccgggctgca

SEQ ID NO: 327771 - DNA, 25 bp, Mus musculus
tcccagaacgtccaggtcacgtagt

SEQ ID NO: 327772 - DNA, 25 bp, Mus musculus
tctgaccgcgtctctcggtgtggaa

SEQ ID NO: 327773 - DNA, 25 bp, Mus musculus
cggaagtctctgagcaagcagtgca

SEQ ID NO: 327774 - DNA, 25 bp, Mus musculus
agtggagtccggaagtctctgagca

SEQ ID NO: 327775 - DNA, 25 bp, Mus musculus
acgctttggttgtcatggtgagccc

SEQ ID NO: 327776 - DNA, 25 bp, Mus musculus
cgcctgctcatctacgctttggttg

SEQ ID NO: 327777 - DNA, 25 bp, Mus musculus
aagagtgaaccttgagccaaccgca

SEQ ID NO: 327778 - DNA, 25 bp, Mus musculus
gaggctctcgttgctatggtgatga

SEQ ID NO: 327779 - DNA, 25 bp, Mus musculus
agccagtcccgcgaggccactgttg

SEQ ID NO: 327780 - DNA, 25 bp, Mus musculus
cgttgctatggtgatgactccgcga

SEQ ID NO: 327781 - DNA, 25 bp, Mus musculus
gccactgttgctgtggtgatttgca

SEQ ID NO: 327782 - DNA, 25 bp, Mus musculus
gacccgacccaccaaagtagcaaga

SEQ ID NO: 327783 - DNA, 25 bp, Mus musculus
ctcgtgccagcgttatcggaggact

SEQ ID NO: 327784 - DNA, 25 bp, Mus musculus
gattcgggagctacgagccagtccc

SEQ ID NO: 327785 - DNA, 25 bp, Mus musculus
caagcagtgcaaagctcgaggtccc

SEQ ID NO: 327786 - DNA, 25 bp, Mus musculus
atgactccgcgagggcctcgtgcca

SEQ ID NO: 327787 - DNA, 25 bp, Mus musculus
actgttcacacatgaccgtggcttc

SEQ ID NO: 327788 - DNA, 25 bp, Mus musculus
cgctggcgaaacctccgtaggagcc

SEQ ID NO: 327789 - DNA, 25 bp, Mus musculus
ttccttgggcgccttctcgcagagc

SEQ ID NO: 327790 - DNA, 25 bp, Mus musculus
gggcgggatgattcatcctttccta

SEQ ID NO: 327791 - DNA, 25 bp, Mus musculus
tcctctcctctgcaggtcgctgagg

SEQ ID NO: 327792 - DNA, 25 bp, Mus musculus
agctgctttcttattggcctcccgc

SEQ ID NO: 327793 - DNA, 25 bp, Mus musculus
gctttgctctgttggtagcggtcga

SEQ ID NO: 327794 - DNA, 25 bp, Mus musculus
catctcttccatggggacctggctg

SEQ ID NO: 327795 - DNA, 25 bp, Mus musculus
agggcattttaactcttcttccatc

SEQ ID NO: 327796 - DNA, 25 bp, Mus musculus
aaggagccacacacagggcatttta

SEQ ID NO: 327797 - DNA, 25 bp, Mus musculus
agggcaagatgatgggctcccgata

SEQ ID NO: 327798 - DNA, 25 bp, Mus musculus
cgggcgcacgcctgacataaattgt

SEQ ID NO: 327799 - DNA, 25 bp, Mus musculus
tgtccaggtccagataatcatagtc

SEQ ID NO: 327800 - DNA, 25 bp, Mus musculus
cctcgctgtacaggctcatcttgtc

SEQ ID NO: 327801 - DNA, 25 bp, Mus musculus
ccacggacggcggaataacgtgcgc

SEQ ID NO: 327802 - DNA, 25 bp, Mus musculus
ggcttttcgagggaccacagccggc

SEQ ID NO: 327803 - DNA, 25 bp, Mus musculus
cggcaagcgcctcttcagtcgtgag

SEQ ID NO: 327804 - DNA, 25 bp, Mus musculus
ctcttcagtcgtgagctccgagata

SEQ ID NO: 327805 - DNA, 25 bp, Mus musculus
agctccgagatagacgcatttcccg

SEQ ID NO: 327806 - DNA, 25 bp, Mus musculus
gatagacgcatttcccgctttccct

SEQ ID NO: 327807 - DNA, 25 bp, Mus musculus
aacagggcccggacatgcgcactga

SEQ ID NO: 327808 - DNA, 25 bp, Mus musculus
ctggctccttgtgcgcatgagcgga

SEQ ID NO: 327809 - DNA, 25 bp, Mus musculus
gcacttggggcgtcttatggttccc

SEQ ID NO: 327810 - DNA, 25 bp, Mus musculus
tgagaactggacgtcgttgctggaa

SEQ ID NO: 327811 - DNA, 25 bp, Mus musculus
ataacgtgcgcgtcctcaccgatga

SEQ ID NO: 327812 - DNA, 25 bp, Mus musculus
tcctcaccgatgagaactggacgtc

SEQ ID NO: 327813 - DNA, 25 bp, Mus musculus
ttctagggcttttcgagggaccaca

SEQ ID NO: 327814 - DNA, 25 bp, Mus musculus
acatggcgcacttggggcgtcttat

SEQ ID NO: 327815 - DNA, 25 bp, Mus musculus
ctggtctaaagtgcgattcccggct

SEQ ID NO: 327816 - DNA, 25 bp, Mus musculus
gcgtctttcttctttctcacggggc

SEQ ID NO: 327817 - DNA, 25 bp, Mus musculus
agtcggaagcctggcgctgtcgact

SEQ ID NO: 327818 - DNA, 25 bp, Mus musculus
agtgctgggagctgcgagtaggctc

SEQ ID NO: 327819 - DNA, 25 bp, Mus musculus
cggctttgccgctctcggcgtcttt

SEQ ID NO: 327820 - DNA, 25 bp, Mus musculus
ccgatctccgagactctggctcgag

SEQ ID NO: 327821 - DNA, 25 bp, Mus musculus
tttcttctttctcacggggctctgg

SEQ ID NO: 327822 - DNA, 25 bp, Mus musculus
agcagacgccggttgtgagtcggaa

SEQ ID NO: 327823 - DNA, 25 bp, Mus musculus
ctttgccgctctcggcgtctttctt

SEQ ID NO: 327824 - DNA, 25 bp, Mus musculus
taaagtgcgattcccggctttgccg

SEQ ID NO: 327825 - DNA, 25 bp, Mus musculus
ccctgctggtctaaagtgcgattcc

SEQ ID NO: 327826 - DNA, 25 bp, Mus musculus
cgctgtcgactttggaggtacgcgc

SEQ ID NO: 327827 - DNA, 25 bp, Mus musculus
aagcctggcgctgtcgactttggag

SEQ ID NO: 327828 - DNA, 25 bp, Mus musculus
tcttctttctcacggggctctgggc

SEQ ID NO: 327829 - DNA, 25 bp, Mus musculus
gactggcaaccgtctttaggcccgc

SEQ ID NO: 327830 - DNA, 25 bp, Mus musculus
atcccgcgaatgctagctcacatcg

SEQ ID NO: 327831 - DNA, 25 bp, Mus musculus
cctctaaggtgtccggcgcgcctga

SEQ ID NO: 327832 - DNA, 25 bp, Mus musculus
gcgacgtcaggcctctccttggcca

SEQ ID NO: 327833 - DNA, 25 bp, Mus musculus
tctctacgtcggtctctcaaagatg

SEQ ID NO: 327834 - DNA, 25 bp, Mus musculus
ggtctctcaaagatgccgctctacg

SEQ ID NO: 327835 - DNA, 25 bp, Mus musculus
atgccgctctacgagggccttggga

SEQ ID NO: 327836 - DNA, 25 bp, Mus musculus
cggcgagaagacagcagtcgtgatc

SEQ ID NO: 327837 - DNA, 25 bp, Mus musculus
gaagacagcagtcgtgatcgaccta

SEQ ID NO: 327838 - DNA, 25 bp, Mus musculus
cgtgatcgacctaggagaagctttc

SEQ ID NO: 327839 - DNA, 25 bp, Mus musculus
cctaggagaagctttcaccaagtga

SEQ ID NO: 327840 - DNA, 25 bp, Mus musculus
tttcaccaagtgagtggccatgggc

SEQ ID NO: 327841 - DNA, 25 bp, Mus musculus
ggcgatcccgcgaatgctagctcac

SEQ ID NO: 327842 - DNA, 25 bp, Mus musculus
caaccgtctttaggcccgctgggca

SEQ ID NO: 327843 - DNA, 25 bp, Mus musculus
tcacacatccgtcagttccaggcga

SEQ ID NO: 327844 - DNA, 25 bp, Mus musculus
ccaggagcctctggcgacagtcggt

SEQ ID NO: 327845 - DNA, 25 bp, Mus musculus
cccgttatcagacgctaaagcagaa

SEQ ID NO: 327846 - DNA, 25 bp, Mus musculus
tctcagagggcagcccaaggctcca

SEQ ID NO: 327847 - DNA, 25 bp, Mus musculus
aaggctccacgtcccgagaactcgg

SEQ ID NO: 327848 - DNA, 25 bp, Mus musculus
cgagaactcgggaaagacgatgctc

SEQ ID NO: 327849 - DNA, 25 bp, Mus musculus
ggaaagacgatgctcgggtgctccc

SEQ ID NO: 327850 - DNA, 25 bp, Mus musculus
cagttccaggcgagtgagtctcaga

SEQ ID NO: 327851 - DNA, 25 bp, Mus musculus
gatgctttcggttcgctttgggata

SEQ ID NO: 327852 - DNA, 25 bp, Mus musculus
gctttgggataaacagcagaatctc

SEQ ID NO: 327853 - DNA, 25 bp, Mus musculus
gcagaatctcggcacgctgaaggga

SEQ ID NO: 327854 - DNA, 25 bp, Mus musculus
cgctgaagggaaggaccatcagtca

SEQ ID NO: 327855 - DNA, 25 bp, Mus musculus
ggaccatcagtcaggaaattcgatc

SEQ ID NO: 327856 - DNA, 25 bp, Mus musculus
aattcgatcggtttagtgaaggaga

SEQ ID NO: 327857 - DNA, 25 bp, Mus musculus
gccgggtcagcaccatgagctccat

SEQ ID NO: 327858 - DNA, 25 bp, Mus musculus
ccatgagctccatcggcactggggt

SEQ ID NO: 327859 - DNA, 25 bp, Mus musculus
cgcctctatggtttctgcgcacgcg

SEQ ID NO: 327860 - DNA, 25 bp, Mus musculus
tacagttttcgtcccagcccacgga

SEQ ID NO: 327861 - DNA, 25 bp, Mus musculus
cagcccacggaacaagccgcaagag

SEQ ID NO: 327862 - DNA, 25 bp, Mus musculus
caagccgcaagaggaaaggctattg

SEQ ID NO: 327863 - DNA, 25 bp, Mus musculus
caatgggcgagcctgttactagcct

SEQ ID NO: 327864 - DNA, 25 bp, Mus musculus
agcctgttactagcctgcgccgtgt

SEQ ID NO: 327865 - DNA, 25 bp, Mus musculus
gccgtctcttccagttcggggttga

SEQ ID NO: 327866 - DNA, 25 bp, Mus musculus
cgcttgaggcctggaagcgttccgc

SEQ ID NO: 327867 - DNA, 25 bp, Mus musculus
cccgggtgctgagtcactttagtct

SEQ ID NO: 327868 - DNA, 25 bp, Mus musculus
tttagtctcatgcttaaggaaactg

SEQ ID NO: 327869 - DNA, 25 bp, Mus musculus
aactgaaagtggagactcgcgggcc

SEQ ID NO: 327870 - DNA, 25 bp, Mus musculus
gctggtcgcaatgcctcggccggat

SEQ ID NO: 327871 - DNA, 25 bp, Mus musculus
cacccttcgctaggcgttgtcctgg

SEQ ID NO: 327872 - DNA, 25 bp, Mus musculus
gggtaagccggtgccacactgaaat

SEQ ID NO: 327873 - DNA, 25 bp, Mus musculus
ccgtgaaaaaccctggctgcagttc

SEQ ID NO: 327874 - DNA, 25 bp, Mus musculus
gattccgtttccatgggacacgcca

SEQ ID NO: 327875 - DNA, 25 bp, Mus musculus
ttcagtcaagcacatccggagtcgg

SEQ ID NO: 327876 - DNA, 25 bp, Mus musculus
tctatcctccaataacgtgcgtgtt

SEQ ID NO: 327877 - DNA, 25 bp, Mus musculus
gaagtttcccagctacatccaatga

SEQ ID NO: 327878 - DNA, 25 bp, Mus musculus
gtcggctcctccaatcaaatttttg

SEQ ID NO: 327879 - DNA, 25 bp, Mus musculus
gacagcgagctccaatccgaagcta

SEQ ID NO: 327880 - DNA, 25 bp, Mus musculus
agctattcggcgtcatgagcagcca

SEQ ID NO: 327881 - DNA, 25 bp, Mus musculus
agcgagtctgctcaacagcttgtta

SEQ ID NO: 327882 - DNA, 25 bp, Mus musculus
ctgcacccgcagtaggtaggtagtc

SEQ ID NO: 327883 - DNA, 25 bp, Mus musculus
gtggaagctatcctacctgctgttt

SEQ ID NO: 327884 - DNA, 25 bp, Mus musculus
cgtgcgtgttcggatacagccaatc

SEQ ID NO: 327885 - DNA, 25 bp, Mus musculus
aacgtcaggtgagccgtgaagctgt

SEQ ID NO: 327886 - DNA, 25 bp, Mus musculus
ccgtgaagctgtgcgcttacaaggc

SEQ ID NO: 327887 - DNA, 25 bp, Mus musculus
gacgaggaggacgacacagagccct

SEQ ID NO: 327888 - DNA, 25 bp, Mus musculus
ctacggatggaacgtcaggtgagcc

SEQ ID NO: 327889 - DNA, 25 bp, Mus musculus
ctagtgcactactacggatggaacg

SEQ ID NO: 327890 - DNA, 25 bp, Mus musculus
gggagattctgtacctagtgcacta

SEQ ID NO: 327891 - DNA, 25 bp, Mus musculus
atggacgacggggagattctgtacc

SEQ ID NO: 327892 - DNA, 25 bp, Mus musculus
gaagccagcatcaaaagcacggaga

SEQ ID NO: 327893 - DNA, 25 bp, Mus musculus
actcagaaaatttatgaagccagca

SEQ ID NO: 327894 - DNA, 25 bp, Mus musculus
tcaagtacggacgaggaaaaactca

SEQ ID NO: 327895 - DNA, 25 bp, Mus musculus
ccaaagtgaaggtcaagtacggacg

SEQ ID NO: 327896 - DNA, 25 bp, Mus musculus
cctgcctgacgggaaccaaagtgaa

SEQ ID NO: 327897 - DNA, 25 bp, Mus musculus
gaggacgacacagagccctgcctga

SEQ ID NO: 327898 - DNA, 25 bp, Mus musculus
tcaaaagcacggagatggacgacgg

SEQ ID NO: 327899 - DNA, 25 bp, Mus musculus
acccggggtttgctcacgtgtggct

SEQ ID NO: 327900 - DNA, 25 bp, Mus musculus
cggtcgtcctactcagctactgcgt

SEQ ID NO: 327901 - DNA, 25 bp, Mus musculus
tcgtcctactcagctactgcgtcta

SEQ ID NO: 327902 - DNA, 25 bp, Mus musculus
ctactcagctactgcgtctacctgg

SEQ ID NO: 327903 - DNA, 25 bp, Mus musculus
agctactgcgtctacctggactgga

SEQ ID NO: 327904 - DNA, 25 bp, Mus musculus
actgcgtctacctggactggaggcg

SEQ ID NO: 327905 - DNA, 25 bp, Mus musculus
tccgtcttggcgtcggtctcctggc

SEQ ID NO: 327906 - DNA, 25 bp, Mus musculus
tcacgtgtggctggcccgtgcccaa

SEQ ID NO: 327907 - DNA, 25 bp, Mus musculus
gcccgtgcccaacgctcgcagggca

SEQ ID NO: 327908 - DNA, 25 bp, Mus musculus
gctcgcagggcaacccaatgcccag

SEQ ID NO: 327909 - DNA, 25 bp, Mus musculus
caatgcccagcgtccgtcttggcgt

SEQ ID NO: 327910 - DNA, 25 bp, Mus musculus
cctgcaggacagtgagtgccagtgc

SEQ ID NO: 327911 - DNA, 25 bp, Mus musculus
ggaggcggcaccgagaccccgcatt

SEQ ID NO: 327912 - DNA, 25 bp, Mus musculus
ccagcgtccgtcttggcgtcggtct

SEQ ID NO: 327913 - DNA, 25 bp, Mus musculus
gatcctgggatggtgagccctttaa

SEQ ID NO: 327914 - DNA, 25 bp, Mus musculus
gtggccatggccacaacgccttttc

SEQ ID NO: 327915 - DNA, 25 bp, Mus musculus
ttcaaaccagactgcaggctgcacc

SEQ ID NO: 327916 - DNA, 25 bp, Mus musculus
ggaccttcggtttttctctggctgc

SEQ ID NO: 327917 - DNA, 25 bp, Mus musculus
ttccgggaagttggcttcagaacgc

SEQ ID NO: 327918 - DNA, 25 bp, Mus musculus
cagaacgctgaagaccctaagaacc

SEQ ID NO: 327919 - DNA, 25 bp, Mus musculus
atgccaggaggctatcccagctcgt

SEQ ID NO: 327920 - DNA, 25 bp, Mus musculus
agccctttaatgaggactcctgtcc

SEQ ID NO: 327921 - DNA, 25 bp, Mus musculus
tgcaaccggcaactcggatccacga

SEQ ID NO: 327922 - DNA, 25 bp, Mus musculus
tgggacagcaaagcgcagagcaatc

SEQ ID NO: 327923 - DNA, 25 bp, Mus musculus
tacagccctcgctcgagagagcagc

SEQ ID NO: 327924 - DNA, 25 bp, Mus musculus
actccacatgggtctgagtccgccg

SEQ ID NO: 327925 - DNA, 25 bp, Mus musculus
tgtcccaattcctctacggtccgtg

SEQ ID NO: 327926 - DNA, 25 bp, Mus musculus
ggagttgctctctcccgttgctgtc

SEQ ID NO: 327927 - DNA, 25 bp, Mus musculus
agcgtggcggcgctcagatccaact

SEQ ID NO: 327928 - DNA, 25 bp, Mus musculus
gctcagatccaacttcgagaagatc

SEQ ID NO: 327929 - DNA, 25 bp, Mus musculus
acttcgagaagatccgcaagggacc

SEQ ID NO: 327930 - DNA, 25 bp, Mus musculus
cgagaagcccttctacgtgaacgtc

SEQ ID NO: 327931 - DNA, 25 bp, Mus musculus
caggaggtgaaccaggagcgcttcc

SEQ ID NO: 327932 - DNA, 25 bp, Mus musculus
tacgtgaacgtcgagttccaccacg

SEQ ID NO: 327933 - DNA, 25 bp, Mus musculus
agaagatccgcaagggacctgccca

SEQ ID NO: 327934 - DNA, 25 bp, Mus musculus
ctacgatcggcagcgctggggcttc

SEQ ID NO: 327935 - DNA, 25 bp, Mus musculus
gaagaagagctacgatcggcagcgc

SEQ ID NO: 327936 - DNA, 25 bp, Mus musculus
ggagcgcttccgcatgatctacctg

SEQ ID NO: 327937 - DNA, 25 bp, Mus musculus
aggcctccattaggcgcttggagca

SEQ ID NO: 327938 - DNA, 25 bp, Mus musculus
ctggagcgctgcaaggcctccatta

SEQ ID NO: 327939 - DNA, 25 bp, Mus musculus
atccgcggggccatggtagccaccg

SEQ ID NO: 327940 - DNA, 25 bp, Mus musculus
catgatctacctgcagacgctgctg

SEQ ID NO: 327941 - DNA, 25 bp, Mus musculus
aaggcctccgggacacggctggcct

SEQ ID NO: 327942 - DNA, 25 bp, Mus musculus
acgacccgcgtgcacgcggcgtctc

SEQ ID NO: 327943 - DNA, 25 bp, Mus musculus
ctccctttcccgagtgaaggctgtc

SEQ ID NO: 327944 - DNA, 25 bp, Mus musculus
ccgcgaacccgggattatgaaagca

SEQ ID NO: 327945 - DNA, 25 bp, Mus musculus
cccgggattatgaaagcagaggaaa

SEQ ID NO: 327946 - DNA, 25 bp, Mus musculus
aggaaagggaccatacttagccaca

SEQ ID NO: 327947 - DNA, 25 bp, Mus musculus
cttagccacaggatctcgcctctga

SEQ ID NO: 327948 - DNA, 25 bp, Mus musculus
cccaagcgatccagtcccgggtggg

SEQ ID NO: 327949 - DNA, 25 bp, Mus musculus
agggtcagtacagagcgagcgccgc

SEQ ID NO: 327950 - DNA, 25 bp, Mus musculus
ccgcgccgcggaaagctgagaacac

SEQ ID NO: 327951 - DNA, 25 bp, Mus musculus
gtgacaaggcctccgggacacggct

SEQ ID NO: 327952 - DNA, 25 bp, Mus musculus
agggaccatacttagccacaggatc

SEQ ID NO: 327953 - DNA, 25 bp, Mus musculus
tctgacaccgggaccgggctgaaga

SEQ ID NO: 327954 - DNA, 25 bp, Mus musculus
aggatctcgcctctgacaccgggac

SEQ ID NO: 327955 - DNA, 25 bp, Mus musculus
ggtgtctcggatgcccgctgcccat

SEQ ID NO: 327956 - DNA, 25 bp, Mus musculus
tgtaacaagatgctcggccctcacc

SEQ ID NO: 327957 - DNA, 25 bp, Mus musculus
ccaccgctgccggagatggagccga

SEQ ID NO: 327958 - DNA, 25 bp, Mus musculus
atggagccgagccaatcggcgccga

SEQ ID NO: 327959 - DNA, 25 bp, Mus musculus
ccggcgcctgacaggagctgatcgc

SEQ ID NO: 327960 - DNA, 25 bp, Mus musculus
gggccctagcgtgtgctgctgctcc

SEQ ID NO: 327961 - DNA, 25 bp, Mus musculus
tcatgaagccggacgcagcgcgcga

SEQ ID NO: 327962 - DNA, 25 bp, Mus musculus
acacggagcggcagcgtacccgcga

SEQ ID NO: 327963 - DNA, 25 bp, Mus musculus
tacctgcggcaacgccaagagctgc

SEQ ID NO: 327964 - DNA, 25 bp, Mus musculus
agagaacatcttgctgctgcgaagg

SEQ ID NO: 327965 - DNA, 25 bp, Mus musculus
ctcgattttccctgagcccgtggtg

SEQ ID NO: 327966 - DNA, 25 bp, Mus musculus
gcccatgacttccacgcgttgctgg

SEQ ID NO: 327967 - DNA, 25 bp, Mus musculus
gccctcggggctggctgtaacaaga

SEQ ID NO: 327968 - DNA, 25 bp, Mus musculus
ctgatggcctctggctgtgggatcc

SEQ ID NO: 327969 - DNA, 25 bp, Mus musculus
ggtctcctacgaagaagccctgcgg

SEQ ID NO: 327970 - DNA, 25 bp, Mus musculus
tctcaaagcctcgaggaagggcatc

SEQ ID NO: 327971 - DNA, 25 bp, Mus musculus
agggcatctggtgaaagctcagttc

SEQ ID NO: 327972 - DNA, 25 bp, Mus musculus
aagctcagttcattccggggcagca

SEQ ID NO: 327973 - DNA, 25 bp, Mus musculus
ccgtgcacacaggaacccgggtgtc

SEQ ID NO: 327974 - DNA, 25 bp, Mus musculus
tgcccaccgtcagggagaaaccgcg

SEQ ID NO: 327975 - DNA, 25 bp, Mus musculus
tgccgtttcccagacgactcggata

SEQ ID NO: 327976 - DNA, 25 bp, Mus musculus
ggtggaaatcgtcagccgaggtctc

SEQ ID NO: 327977 - DNA, 25 bp, Mus musculus
gagtcgctcttccactccacggtgg

SEQ ID NO: 327978 - DNA, 25 bp, Mus musculus
agcgaggacgagcagagcaactaca

SEQ ID NO: 327979 - DNA, 25 bp, Mus musculus
aactgcttcggcgacagcgagtcca

SEQ ID NO: 327980 - DNA, 25 bp, Mus musculus
tggtcccagtttgtccagactctcc

SEQ ID NO: 327981 - DNA, 25 bp, Mus musculus
caggccggccttggacttcaaaagc

SEQ ID NO: 327982 - DNA, 25 bp, Mus musculus
ccgtggtggccaaaccgaagcacaa

SEQ ID NO: 327983 - DNA, 25 bp, Mus musculus
agcggctgtgaagggaactgtttaa

SEQ ID NO: 327984 - DNA, 25 bp, Mus musculus
cggatcccattgtaccgggagcgca

SEQ ID NO: 327985 - DNA, 25 bp, Mus musculus
agcggcctttccagcatgcagcggc

SEQ ID NO: 327986 - DNA, 25 bp, Mus musculus
gcactcattcattagcggcaccgca

SEQ ID NO: 327987 - DNA, 25 bp, Mus musculus
agctccggggccagtaggtaaatat

SEQ ID NO: 327988 - DNA, 25 bp, Mus musculus
acgagctgccaatctaggctttgga

SEQ ID NO: 327989 - DNA, 25 bp, Mus musculus
agttggtaacctacgagcggctgtg

SEQ ID NO: 327990 - DNA, 25 bp, Mus musculus
ttggaaaatggctgcagcacggctc

SEQ ID NO: 327991 - DNA, 25 bp, Mus musculus
agccggccgggtacatctctcttct

SEQ ID NO: 327992 - DNA, 25 bp, Mus musculus
tcctgggccgctggctctgtaagat

SEQ ID NO: 327993 - DNA, 25 bp, Mus musculus
tcaccttcgggtcaagtcatactca

SEQ ID NO: 327994 - DNA, 25 bp, Mus musculus
agtctccgagtttactgtgtgcaga

SEQ ID NO: 327995 - DNA, 25 bp, Mus musculus
ggggctgactaatccaggcagtctc

SEQ ID NO: 327996 - DNA, 25 bp, Mus musculus
gggaacaggaccgagacagctacga

SEQ ID NO: 327997 - DNA, 25 bp, Mus musculus
tggtagcggcagaaacacatcagta

SEQ ID NO: 327998 - DNA, 25 bp, Mus musculus
cgcagctgccgatgcttcacgatca

SEQ ID NO: 327999 - DNA, 25 bp, Mus musculus
acatcagtaggaagggcagcaagta

SEQ ID NO: 328000 - DNA, 25 bp, Mus musculus
agcaagtagcaagccaccaccagtc

SEQ ID NO: 328001 - DNA, 25 bp, Mus musculus
tctgtaaaggcagcggtggaagctc

SEQ ID NO: 328002 - DNA, 25 bp, Mus musculus
acgctgaacgtggatacgattccga

SEQ ID NO: 328003 - DNA, 25 bp, Mus musculus
cacgaactgaagaagcggctggctg

SEQ ID NO: 328004 - DNA, 25 bp, Mus musculus
gcgcagttgcccaggctagacagca

SEQ ID NO: 328005 - DNA, 25 bp, Mus musculus
ttcccagcgttaccgtggctacgga

SEQ ID NO: 328006 - DNA, 25 bp, Mus musculus
atgcgcgctaccctgcaaggttgca

SEQ ID NO: 328007 - DNA, 25 bp, Mus musculus
catcccgcagcagggtgaaaggttg

SEQ ID NO: 328008 - DNA, 25 bp, Mus musculus
ccactcgggactggtggaaccttga

SEQ ID NO: 328009 - DNA, 25 bp, Mus musculus
cgcacggtcttgcagatgtggtagc

SEQ ID NO: 328010 - DNA, 25 bp, Mus musculus
tgcccgcatcgctttggtttcccag

SEQ ID NO: 328011 - DNA, 25 bp, Mus musculus
tcctcggagacctcaatgcagggta

SEQ ID NO: 328012 - DNA, 25 bp, Mus musculus
cgcctccattgtctgcgtccaggga

SEQ ID NO: 328013 - DNA, 25 bp, Mus musculus
tctgggaatcctaggcctggaagtc

SEQ ID NO: 328014 - DNA, 25 bp, Mus musculus
tctgagctcaaacccggaagcgaga

SEQ ID NO: 328015 - DNA, 25 bp, Mus musculus
ctacgagcttcgtctaggaaacggg

SEQ ID NO: 328016 - DNA, 25 bp, Mus musculus
gggcttcggaacttgctccagcagc

SEQ ID NO: 328017 - DNA, 25 bp, Mus musculus
tcagagttagactcccaacaggggc

SEQ ID NO: 328018 - DNA, 25 bp, Mus musculus
cccgagctagcaggattcagagtta

SEQ ID NO: 328019 - DNA, 25 bp, Mus musculus
agcgaccagcgtccggaatcttaga

SEQ ID NO: 328020 - DNA, 25 bp, Mus musculus
gcgagcagagatcacccagcgacca

SEQ ID NO: 328021 - DNA, 25 bp, Mus musculus
gcgtggctccagaggtttgaacaca

SEQ ID NO: 328022 - DNA, 25 bp, Mus musculus
tccaagcagggagaaagcgccaaac

SEQ ID NO: 328023 - DNA, 25 bp, Mus musculus
gtgtgcatgtccaccaccgacagtg

SEQ ID NO: 328024 - DNA, 25 bp, Mus musculus
cgcgcagaaccggtggcaatctcag

SEQ ID NO: 328025 - DNA, 25 bp, Mus musculus
gagaataccctgacttttccagttg

SEQ ID NO: 328026 - DNA, 25 bp, Mus musculus
gtccagatcgcggttccgcgtgcgc

SEQ ID NO: 328027 - DNA, 25 bp, Mus musculus
ctaccgaaataaagagaataccctg

SEQ ID NO: 328028 - DNA, 25 bp, Mus musculus
taccctgacttttccagttgctcca

SEQ ID NO: 328029 - DNA, 25 bp, Mus musculus
gttgctccacacacagtccatcttg

SEQ ID NO: 328030 - DNA, 25 bp, Mus musculus
ccatcttggtggaatcggcagtggc

SEQ ID NO: 328031 - DNA, 25 bp, Mus musculus
gacagcgaatcagcgcggtcccgga

SEQ ID NO: 328032 - DNA, 25 bp, Mus musculus
gctgagcttgcactccgcgtcgctg

SEQ ID NO: 328033 - DNA, 25 bp, Mus musculus
ctctggtggcctcgcggctgcagac

SEQ ID NO: 328034 - DNA, 25 bp, Mus musculus
tcgcggctgcagactgaagcggccc

SEQ ID NO: 328035 - DNA, 25 bp, Mus musculus
cgcagagcgcgacagcgaatcagcg

SEQ ID NO: 328036 - DNA, 25 bp, Mus musculus
tggctctcctccaggcgctgagctt

SEQ ID NO: 328037 - DNA, 25 bp, Mus musculus
caggcatgcactaccgaaataaaga

SEQ ID NO: 328038 - DNA, 25 bp, Mus musculus
tgctgcggctgctctatgcgaccgc

SEQ ID NO: 328039 - DNA, 25 bp, Mus musculus
ctcatcttgcagatccggcggtgcg

SEQ ID NO: 328040 - DNA, 25 bp, Mus musculus
gctagggacgcggacgctccctgct

SEQ ID NO: 328041 - DNA, 25 bp, Mus musculus
ggacgcggacgctccctgctgctgt

SEQ ID NO: 328042 - DNA, 25 bp, Mus musculus
gccggcttacctgtggatgcagttt

SEQ ID NO: 328043 - DNA, 25 bp, Mus musculus
ggactccggactccagaaggctgca

SEQ ID NO: 328044 - DNA, 25 bp, Mus musculus
ggatgcagtttccatggcgacggga

SEQ ID NO: 328045 - DNA, 25 bp, Mus musculus
tccggactccagaaggctgcagagt

SEQ ID NO: 328046 - DNA, 25 bp, Mus musculus
gccaccgtcgctgcttttgctgcaa

SEQ ID NO: 328047 - DNA, 25 bp, Mus musculus
agacagcggctcatcttgcagatcc

SEQ ID NO: 328048 - DNA, 25 bp, Mus musculus
ggggctacccagagacagcggctca

SEQ ID NO: 328049 - DNA, 25 bp, Mus musculus
tgggacccggggctacccagagaca

SEQ ID NO: 328050 - DNA, 25 bp, Mus musculus
cccatcaccgccgtcgcttcgtctt

SEQ ID NO: 328051 - DNA, 25 bp, Mus musculus
cggagcacagttcccgcgacgacgt

SEQ ID NO: 328052 - DNA, 25 bp, Mus musculus
ccgcggctgctgttctgggcgcttc

SEQ ID NO: 328053 - DNA, 25 bp, Mus musculus
agaagtctgggcgtctcccacaaca

SEQ ID NO: 328054 - DNA, 25 bp, Mus musculus
aggttgccaaacgatggactcgtca

SEQ ID NO: 328055 - DNA, 25 bp, Mus musculus
aaacgatggactcgtcaccaaggca

SEQ ID NO: 328056 - DNA, 25 bp, Mus musculus
aggcaaccacgttccttcgtctggg

SEQ ID NO: 328057 - DNA, 25 bp, Mus musculus
gtgcttaggccgctcaagaaccaga

SEQ ID NO: 328058 - DNA, 25 bp, Mus musculus
ccagagcaccagtgcggaagaagtc

SEQ ID NO: 328059 - DNA, 25 bp, Mus musculus
ctgcgctgctgtgccgcacacatga

SEQ ID NO: 328060 - DNA, 25 bp, Mus musculus
atgaatccgcctccggcagaaccag

SEQ ID NO: 328061 - DNA, 25 bp, Mus musculus
agatgtggtcccaggacgccctcgc

SEQ ID NO: 328062 - DNA, 25 bp, Mus musculus
caaccgacttcagctggggagatgt

SEQ ID NO: 328063 - DNA, 25 bp, Mus musculus
tccatcctcgggcaggagttcccaa

SEQ ID NO: 328064 - DNA, 25 bp, Mus musculus
tcctggaggcctccggtcagctgct

SEQ ID NO: 328065 - DNA, 25 bp, Mus musculus
aggcacgagcgcagttgatcttagc

SEQ ID NO: 328066 - DNA, 25 bp, Mus musculus
tgatcttagccatgggaacgggagc

SEQ ID NO: 328067 - DNA, 25 bp, Mus musculus
ctgcaccacggcgtctctgcgcgtc

SEQ ID NO: 328068 - DNA, 25 bp, Mus musculus
tggggctccatctgtgtcccgggct

SEQ ID NO: 328069 - DNA, 25 bp, Mus musculus
tccgcctagcgagtccccgaaggtg

SEQ ID NO: 328070 - DNA, 25 bp, Mus musculus
aagcggaagacagtcggcgcccgcc

SEQ ID NO: 328071 - DNA, 25 bp, Mus musculus
ctgccgcaagcggaagacagtcggc

SEQ ID NO: 328072 - DNA, 25 bp, Mus musculus
ccgactctgccgcaagcggaagaca

SEQ ID NO: 328073 - DNA, 25 bp, Mus musculus
ctgtcccttgcctacccgactctgc

SEQ ID NO: 328074 - DNA, 25 bp, Mus musculus
agctcatcgctgtcccttgcctacc

SEQ ID NO: 328075 - DNA, 25 bp, Mus musculus
agccacaacagcagctcccagctca

SEQ ID NO: 328076 - DNA, 25 bp, Mus musculus
acaaggggcaggatcagcgcgcaca

SEQ ID NO: 328077 - DNA, 25 bp, Mus musculus
caagagctgcacaaggggcaggatc

SEQ ID NO: 328078 - DNA, 25 bp, Mus musculus
tctgcgcgtccctactgcgtgcaag

SEQ ID NO: 328079 - DNA, 25 bp, Mus musculus
gcatccgcccgcaaaaagcgcaaga

SEQ ID NO: 328080 - DNA, 25 bp, Mus musculus
ccgcaaaaagcgcaagagctgcaca

SEQ ID NO: 328081 - DNA, 25 bp, Mus musculus
agccggggcagggtcttctccgctt

SEQ ID NO: 328082 - DNA, 25 bp, Mus musculus
cccgggcggacctcacagcttgccc

SEQ ID NO: 328083 - DNA, 25 bp, Mus musculus
agcgcgaagaggaggtgtgacagct

SEQ ID NO: 328084 - DNA, 25 bp, Mus musculus
catcccgcgcctgcgccgtctcctg

SEQ ID NO: 328085 - DNA, 25 bp, Mus musculus
gtccagaactcagcgcgaagaggag

SEQ ID NO: 328086 - DNA, 25 bp, Mus musculus
gtcttctccgcttgtgccgcgggca

SEQ ID NO: 328087 - DNA, 25 bp, Mus musculus
aggcgccgatcacggcacatgcgcg

SEQ ID NO: 328088 - DNA, 25 bp, Mus musculus
cgcggtccagaactcagcgcgaaga

SEQ ID NO: 328089 - DNA, 25 bp, Mus musculus
agcacagcgcgtgcgcggtccagaa

SEQ ID NO: 328090 - DNA, 25 bp, Mus musculus
ccgactagcacagcgcgtgcgcggt

SEQ ID NO: 328091 - DNA, 25 bp, Mus musculus
ctgcgcagtagcagcccagggaggc

SEQ ID NO: 328092 - DNA, 25 bp, Mus musculus
ctgttgccctgaggccggactcaac

SEQ ID NO: 328093 - DNA, 25 bp, Mus musculus
cagggaggcgccgatcacggcacat

SEQ ID NO: 328094 - DNA, 25 bp, Mus musculus
tgtgccgcgggcacgttcgtctcct

SEQ ID NO: 328095 - DNA, 25 bp, Mus musculus
tgtccgcaccgggacgatcatcctg

SEQ ID NO: 328096 - DNA, 25 bp, Mus musculus
tgggcctcgcagtgacaaagacaac

SEQ ID NO: 328097 - DNA, 25 bp, Mus musculus
aaaaatctccgtgcccgctgtctgc

SEQ ID NO: 328098 - DNA, 25 bp, Mus musculus
tgtctgccaccaactccgtcttgtt

SEQ ID NO: 328099 - DNA, 25 bp, Mus musculus
cagcgccggagagagttgaactttt

SEQ ID NO: 328100 - DNA, 25 bp, Mus musculus
tgggcgtgatctgtttcaatctcca

SEQ ID NO: 328101 - DNA, 25 bp, Mus musculus
ctccaatcagaagccaggtagcccg

SEQ ID NO: 328102 - DNA, 25 bp, Mus musculus
gccttccgctcttcgttggtctgta

SEQ ID NO: 328103 - DNA, 25 bp, Mus musculus
accgctgggccgaaagcttttgtca

SEQ ID NO: 328104 - DNA, 25 bp, Mus musculus
ccggatggtgtccatgactttcaaa

SEQ ID NO: 328105 - DNA, 25 bp, Mus musculus
gatcatcctggggacctggtacatg

SEQ ID NO: 328106 - DNA, 25 bp, Mus musculus
ctgaggctttacgagatggggctcc

SEQ ID NO: 328107 - DNA, 25 bp, Mus musculus
atgcagccagttcggacgttttgtc

SEQ ID NO: 328108 - DNA, 25 bp, Mus musculus
tcggggtgcttttaactgtgaactg

SEQ ID NO: 328109 - DNA, 25 bp, Mus musculus
tcccaaggcgtgaacggtttgcaca

SEQ ID NO: 328110 - DNA, 25 bp, Mus musculus
ggtttgcacacgcacgtctgcggta

SEQ ID NO: 328111 - DNA, 25 bp, Mus musculus
ggcgctaaccgagactgcacctgga

SEQ ID NO: 328112 - DNA, 25 bp, Mus musculus
actgcacctggagaccggcgtccgt

SEQ ID NO: 328113 - DNA, 25 bp, Mus musculus
atccctgcagggactcggggacaac

SEQ ID NO: 328114 - DNA, 25 bp, Mus musculus
tttggagaggccctctgcgccctag

SEQ ID NO: 328115 - DNA, 25 bp, Mus musculus
aggacgtccacgctccctagggatc

SEQ ID NO: 328116 - DNA, 25 bp, Mus musculus
agcagcgcagggcagtgacgtcacc

SEQ ID NO: 328117 - DNA, 25 bp, Mus musculus
gacaacccgcgagaagctctagcta

SEQ ID NO: 328118 - DNA, 25 bp, Mus musculus
acgcccggatgatctgagccgcgag

SEQ ID NO: 328119 - DNA, 25 bp, Mus musculus
caggagctagaacgccgtggtctcc

SEQ ID NO: 328120 - DNA, 25 bp, Mus musculus
tctagctaggcacgtgtcccaaggc

SEQ ID NO: 328121 - DNA, 25 bp, Mus musculus
gaaagcgatgagtcctcggcgcctc

SEQ ID NO: 328122 - DNA, 25 bp, Mus musculus
atacaattcggaatccctgcaggga

SEQ ID NO: 328123 - DNA, 25 bp, Mus musculus
tggtaggccacagttctcgcgagat

SEQ ID NO: 328124 - DNA, 25 bp, Mus musculus
gccaggccctggcacgtggctctgt

SEQ ID NO: 328125 - DNA, 25 bp, Mus musculus
gagcgcggcggcctcttcagacctg

SEQ ID NO: 328126 - DNA, 25 bp, Mus musculus
gacccgcagctttctcctcagaccg

SEQ ID NO: 328127 - DNA, 25 bp, Mus musculus
ctcagaccgctcttccaccagcgtc

SEQ ID NO: 328128 - DNA, 25 bp, Mus musculus
tgggaacaccaccagaccttctgag

SEQ ID NO: 328129 - DNA, 25 bp, Mus musculus
tttaagagtctaagccctttggctg

SEQ ID NO: 328130 - DNA, 25 bp, Mus musculus
agttctcgcgagatcacattgacgc

SEQ ID NO: 328131 - DNA, 25 bp, Mus musculus
gcgcaccacgtggtaggccacagtt

SEQ ID NO: 328132 - DNA, 25 bp, Mus musculus
aagccctttggctggggccttgaga

SEQ ID NO: 328133 - DNA, 25 bp, Mus musculus
tcgcgagatcacattgacgcggggt

SEQ ID NO: 328134 - DNA, 25 bp, Mus musculus
ccaccagaccttctgaggtttaaga

SEQ ID NO: 328135 - DNA, 25 bp, Mus musculus
ccttctgaggtttaagagtctaagc

SEQ ID NO: 328136 - DNA, 25 bp, Mus musculus
gcggggttctgggaacaccaccaga

SEQ ID NO: 328137 - DNA, 25 bp, Mus musculus
gcccttaacaagaatgagtcggtgc

SEQ ID NO: 328138 - DNA, 25 bp, Mus musculus
acggtggcaactaccgcgagcttta

SEQ ID NO: 328139 - DNA, 25 bp, Mus musculus
ctaaggaatcgcacgccaagctgca

SEQ ID NO: 328140 - DNA, 25 bp, Mus musculus
cgctgtggctcgaagcgcattacca

SEQ ID NO: 328141 - DNA, 25 bp, Mus musculus
cctagggccagtagacaagtaccga

SEQ ID NO: 328142 - DNA, 25 bp, Mus musculus
ttgggatggcgaacagaagactcac

SEQ ID NO: 328143 - DNA, 25 bp, Mus musculus
gcgagctttatcatatcctggaaaa

SEQ ID NO: 328144 - DNA, 25 bp, Mus musculus
ccagcagcttgtgaagcccttaaca

SEQ ID NO: 328145 - DNA, 25 bp, Mus musculus
gcggatttcgtgtgcgttccagcca

SEQ ID NO: 328146 - DNA, 25 bp, Mus musculus
ttcattcttcaggttcagcagtctc

SEQ ID NO: 328147 - DNA, 25 bp, Mus musculus
gggcgctctagtcgcagccttgatt

SEQ ID NO: 328148 - DNA, 25 bp, Mus musculus
ggctggcttttcctagctgagcaag

SEQ ID NO: 328149 - DNA, 25 bp, Mus musculus
ctcgatgttccagctgcccattttg

SEQ ID NO: 328150 - DNA, 25 bp, Mus musculus
tcactgcttcaaggagcgcacgcgg

SEQ ID NO: 328151 - DNA, 25 bp, Mus musculus
tggaggccttgagccgctcctgcca

SEQ ID NO: 328152 - DNA, 25 bp, Mus musculus
tttccgctcccattgtgaggcgggc

SEQ ID NO: 328153 - DNA, 25 bp, Mus musculus
ggcggctcagcgtaatcagggctaa

SEQ ID NO: 328154 - DNA, 25 bp, Mus musculus
ctcagcgtaatcagggctaatgaca

SEQ ID NO: 328155 - DNA, 25 bp, Mus musculus
gcacccaccgatggaggccttgagc

SEQ ID NO: 328156 - DNA, 25 bp, Mus musculus
tcagggctaatgacagcggcccagg

SEQ ID NO: 328157 - DNA, 25 bp, Mus musculus
gctttgtcggcctgaatggctaatg

SEQ ID NO: 328158 - DNA, 25 bp, Mus musculus
atgctccgcgacctcggggacagaa

SEQ ID NO: 328159 - DNA, 25 bp, Mus musculus
aatggctaatgggtttgcccgcggg

SEQ ID NO: 328160 - DNA, 25 bp, Mus musculus
agcttctcgctctattcagccggga

SEQ ID NO: 328161 - DNA, 25 bp, Mus musculus
cccaaacccggtgagggcagaggct

SEQ ID NO: 328162 - DNA, 25 bp, Mus musculus
gcagaggctccaaggtccgccacag

SEQ ID NO: 328163 - DNA, 25 bp, Mus musculus
gacccgagatcctcccgcgagtccc

SEQ ID NO: 328164 - DNA, 25 bp, Mus musculus
ccggccacatccgaagctgcgggga

SEQ ID NO: 328165 - DNA, 25 bp, Mus musculus
gcctcttcgccctgggacccaggca

SEQ ID NO: 328166 - DNA, 25 bp, Mus musculus
acgagccaccgatggaggaccgcgt

SEQ ID NO: 328167 - DNA, 25 bp, Mus musculus
aggccggggctttcctgcctcttcg

SEQ ID NO: 328168 - DNA, 25 bp, Mus musculus
ccagggccgcgaggcagacagaggc

SEQ ID NO: 328169 - DNA, 25 bp, Mus musculus
ctggaagcttccaccgccagggccg

SEQ ID NO: 328170 - DNA, 25 bp, Mus musculus
acccggcacccgctggaagcttcca

SEQ ID NO: 328171 - DNA, 25 bp, Mus musculus
tcggctttgcttctcccattacctc

SEQ ID NO: 328172 - DNA, 25 bp, Mus musculus
agcgtcaacttttcggctttgcttc

SEQ ID NO: 328173 - DNA, 25 bp, Mus musculus
tcagagcaagcgtcaacttttcggc

SEQ ID NO: 328174 - DNA, 25 bp, Mus musculus
tggggctcagagcaagcgtcaactt

SEQ ID NO: 328175 - DNA, 25 bp, Mus musculus
gagcctacgagccaccgatggagga

SEQ ID NO: 328176 - DNA, 25 bp, Mus musculus
tgacaggagcctacgagccaccgat

SEQ ID NO: 328177 - DNA, 25 bp, Mus musculus
attgacaggagcctacgagccaccg

SEQ ID NO: 328178 - DNA, 25 bp, Mus musculus
ggctcagagcaagcgtcaacttttc

SEQ ID NO: 328179 - DNA, 25 bp, Mus musculus
aagtttctcggcctccacgtagtgc

SEQ ID NO: 328180 - DNA, 25 bp, Mus musculus
ggggcctctgataggacacccagca

SEQ ID NO: 328181 - DNA, 25 bp, Mus musculus
gtccctaacaggcaacctcaagagt

SEQ ID NO: 328182 - DNA, 25 bp, Mus musculus
tgaaccttcacagcagcgtcgccga

SEQ ID NO: 328183 - DNA, 25 bp, Mus musculus
aagcacgccgcgtacctttccttgg

SEQ ID NO: 328184 - DNA, 25 bp, Mus musculus
cgatatttgcccacggcacccaggg

SEQ ID NO: 328185 - DNA, 25 bp, Mus musculus
gtagtgcgctttcagccacagctgc

SEQ ID NO: 328186 - DNA, 25 bp, Mus musculus
ttcctctgatctacaaactccctgg

SEQ ID NO: 328187 - DNA, 25 bp, Mus musculus
gcttccctcgcgataccaagcaata

SEQ ID NO: 328188 - DNA, 25 bp, Mus musculus
ccgagcgttcgactcagaccagctt

SEQ ID NO: 328189 - DNA, 25 bp, Mus musculus
gaactctcctccatagactagccgg

SEQ ID NO: 328190 - DNA, 25 bp, Mus musculus
tagcgcgaaatgaagcagaactctc

SEQ ID NO: 328191 - DNA, 25 bp, Mus musculus
gcccggagggcatgaaacaaaccca

SEQ ID NO: 328192 - DNA, 25 bp, Mus musculus
ccctttgtccaactagcgcgaaatg

SEQ ID NO: 328193 - DNA, 25 bp, Mus musculus
tcttcctggcaaagcagcattcggc

SEQ ID NO: 328194 - DNA, 25 bp, Mus musculus
ccggatccttaggtgcgctcagtta

SEQ ID NO: 328195 - DNA, 25 bp, Mus musculus
ctgatgccgccgcagtgcggagaca

SEQ ID NO: 328196 - DNA, 25 bp, Mus musculus
gacagctccgcccagttgtgcagag

SEQ ID NO: 328197 - DNA, 25 bp, Mus musculus
aggcgtgctctcaggccgctgctct

SEQ ID NO: 328198 - DNA, 25 bp, Mus musculus
ctctccagctctccaggtctgatgg

SEQ ID NO: 328199 - DNA, 25 bp, Mus musculus
agagagggcgctgtcttcctggcaa

SEQ ID NO: 328200 - DNA, 25 bp, Mus musculus
cgtgcagactgggtcccggatcctt

SEQ ID NO: 328201 - DNA, 25 bp, Mus musculus
ttaggtgcgctcagttaggtgcgca

SEQ ID NO: 328202 - DNA, 25 bp, Mus musculus
caaagcagcattcggcctgcaggaa

SEQ ID NO: 328203 - DNA, 25 bp, Mus musculus
caagtgttcccatggggaccgcaga

SEQ ID NO: 328204 - DNA, 25 bp, Mus musculus
gggagcagattcttagctgtgagcc

SEQ ID NO: 328205 - DNA, 25 bp, Mus musculus
attcttagctgtgagccacggagcc

SEQ ID NO: 328206 - DNA, 25 bp, Mus musculus
ctccaggtctgatggacgaatagaa

SEQ ID NO: 328207 - DNA, 25 bp, Mus musculus
tgcctgcccagaagttccgagtgga

SEQ ID NO: 328208 - DNA, 25 bp, Mus musculus
tggcaacttcaaaggcagcaggatg

SEQ ID NO: 328209 - DNA, 25 bp, Mus musculus
cctaagagggcgaccagaaacttct

SEQ ID NO: 328210 - DNA, 25 bp, Mus musculus
gccatgttttcgagcgctaggagga

SEQ ID NO: 328211 - DNA, 25 bp, Mus musculus
agaaggctctcgttgccacgtagca

SEQ ID NO: 328212 - DNA, 25 bp, Mus musculus
gctgtacaactcagggtagatgccc

SEQ ID NO: 328213 - DNA, 25 bp, Mus musculus
tggctctcgaggatgctgtacaact

SEQ ID NO: 328214 - DNA, 25 bp, Mus musculus
gccgactcgaagctgtggctctcga

SEQ ID NO: 328215 - DNA, 25 bp, Mus musculus
gccttgtaccagagctgctgcagca

SEQ ID NO: 328216 - DNA, 25 bp, Mus musculus
tgcgcgacttctccttgaaacaata

SEQ ID NO: 328217 - DNA, 25 bp, Mus musculus
cgattctgcttgtagagctccttga

SEQ ID NO: 328218 - DNA, 25 bp, Mus musculus
aagttggcgctcaccttttggactg

SEQ ID NO: 328219 - DNA, 25 bp, Mus musculus
aaccaaggcgagagtggcaacttca

SEQ ID NO: 328220 - DNA, 25 bp, Mus musculus
tggagttgtacctgatctgccgctc

SEQ ID NO: 328221 - DNA, 25 bp, Mus musculus
tgtggactcgcacctctcttccggg

SEQ ID NO: 328222 - DNA, 25 bp, Mus musculus
caggctggtacgtctctgcccagca

SEQ ID NO: 328223 - DNA, 25 bp, Mus musculus
cgtaagtgggctttactggctgcgc

SEQ ID NO: 328224 - DNA, 25 bp, Mus musculus
cacagcatccaagcggagccaggct

SEQ ID NO: 328225 - DNA, 25 bp, Mus musculus
tttacttagcagtcggtcgcggagc

SEQ ID NO: 328226 - DNA, 25 bp, Mus musculus
gcccgcgatttgctacgagagcccg

SEQ ID NO: 328227 - DNA, 25 bp, Mus musculus
ccggtggacaaggagatgaatgacc

SEQ ID NO: 328228 - DNA, 25 bp, Mus musculus
cgaaggcagcgtagagtccgaccct

SEQ ID NO: 328229 - DNA, 25 bp, Mus musculus
tgacgtcatcactgctggccgcgaa

SEQ ID NO: 328230 - DNA, 25 bp, Mus musculus
gttttctacatcacccgggacacta

SEQ ID NO: 328231 - DNA, 25 bp, Mus musculus
tgggcaagaaagaagagcacgagtc

SEQ ID NO: 328232 - DNA, 25 bp, Mus musculus
acctggtggcctttttgcgctcatt

SEQ ID NO: 328233 - DNA, 25 bp, Mus musculus
gacgagtggagtccgttgctaagca

SEQ ID NO: 328234 - DNA, 25 bp, Mus musculus
gaagcggctccgtgatttacttagc

SEQ ID NO: 328235 - DNA, 25 bp, Mus musculus
tagcgggatgccttacagtcgtcta

SEQ ID NO: 328236 - DNA, 25 bp, Mus musculus
cgcgtggacctgaagcgcccacgtt

SEQ ID NO: 328237 - DNA, 25 bp, Mus musculus
aagggtgctttgctgccggacccat

SEQ ID NO: 328238 - DNA, 25 bp, Mus musculus
aggtctgagcgaaccagggtcctcc

SEQ ID NO: 328239 - DNA, 25 bp, Mus musculus
ctcggcgcggtcacatctcaagtgt

SEQ ID NO: 328240 - DNA, 25 bp, Mus musculus
accggaaagtgctcaagggcagcta

SEQ ID NO: 328241 - DNA, 25 bp, Mus musculus
agcgctggtttcgaagtcgcctgca

SEQ ID NO: 328242 - DNA, 25 bp, Mus musculus
tacagtcgtctagacccgccggcga

SEQ ID NO: 328243 - DNA, 25 bp, Mus musculus
tacagccgtcgatttgtcgccgcgc

SEQ ID NO: 328244 - DNA, 25 bp, Mus musculus
aggggactgaacctgcaagcacaca

SEQ ID NO: 328245 - DNA, 25 bp, Mus musculus
tgcaagcacacaagtccctttaggg

SEQ ID NO: 328246 - DNA, 25 bp, Mus musculus
accaaagctaggctgcggacgtcga

SEQ ID NO: 328247 - DNA, 25 bp, Mus musculus
atctcaagtgtggtgccatcggggc

SEQ ID NO: 328248 - DNA, 25 bp, Mus musculus
gccacttcgggagcggtagcagccc

SEQ ID NO: 328249 - DNA, 25 bp, Mus musculus
gctgagctcataaaccggccggtgc

SEQ ID NO: 328250 - DNA, 25 bp, Mus musculus
cgggcagcgtaaagctccaggagca

SEQ ID NO: 328251 - DNA, 25 bp, Mus musculus
ggtagaagttggacagctcgtagta

SEQ ID NO: 328252 - DNA, 25 bp, Mus musculus
tagcgccggttgttctggtagaagt

SEQ ID NO: 328253 - DNA, 25 bp, Mus musculus
acttgacgtggtagtcggtccacca

SEQ ID NO: 328254 - DNA, 25 bp, Mus musculus
cacgaagtcctggttgatgaagccg

SEQ ID NO: 328255 - DNA, 25 bp, Mus musculus
ttggcggcgcacaccgagcaatcgc

SEQ ID NO: 328256 - DNA, 25 bp, Mus musculus
gcggtgcgcatccacaccacgaagt

SEQ ID NO: 328257 - DNA, 25 bp, Mus musculus
tgcgcgcatagagcttgcggaacgt

SEQ ID NO: 328258 - DNA, 25 bp, Mus musculus
agaatgatgagcttgtggccgccga

SEQ ID NO: 328259 - DNA, 25 bp, Mus musculus
ggtgtagtcgtactccagctccttg

SEQ ID NO: 328260 - DNA, 25 bp, Mus musculus
ccagctccttgatgccgttggagga

SEQ ID NO: 328261 - DNA, 25 bp, Mus musculus
actctcaacccaggatcagcggcga

SEQ ID NO: 328262 - DNA, 25 bp, Mus musculus
ataggcagaccgtcggagcggaact

SEQ ID NO: 328263 - DNA, 25 bp, Mus musculus
cgactattagcgtgatgttgtaaca

SEQ ID NO: 328264 - DNA, 25 bp, Mus musculus
agtgagtttctcctggggaccgccg

SEQ ID NO: 328265 - DNA, 25 bp, Mus musculus
ctacctgagcaagaaagtgagtttc

SEQ ID NO: 328266 - DNA, 25 bp, Mus musculus
cccacgatgttcttctacctgagca

SEQ ID NO: 328267 - DNA, 25 bp, Mus musculus
gtcttctccgagttcccacgatgtt

SEQ ID NO: 328268 - DNA, 25 bp, Mus musculus
ccttgaccgctgtgggtcgtcttct

SEQ ID NO: 328269 - DNA, 25 bp, Mus musculus
cccgttatatattagcgtgccttga

SEQ ID NO: 328270 - DNA, 25 bp, Mus musculus
ctcgcaaatggaggtgtagaacccg

SEQ ID NO: 328271 - DNA, 25 bp, Mus musculus
tccgatccaccagtgctcgcaaatg

SEQ ID NO: 328272 - DNA, 25 bp, Mus musculus
aggcgacgggagcttctccgatcca

SEQ ID NO: 328273 - DNA, 25 bp, Mus musculus
gcaggcgcacgacgaccaacacggg

SEQ ID NO: 328274 - DNA, 25 bp, Mus musculus
agccaaggcattgaagaactgatca

SEQ ID NO: 328275 - DNA, 25 bp, Mus musculus
cagaaaggctcgaagccaaggcatt

SEQ ID NO: 328276 - DNA, 25 bp, Mus musculus
tacgcatggcagatcgctaaactga

SEQ ID NO: 328277 - DNA, 25 bp, Mus musculus
gcacgctgcagttccaggagctgtt

SEQ ID NO: 328278 - DNA, 25 bp, Mus musculus
acccacctacaacgaggagttctgc

SEQ ID NO: 328279 - DNA, 25 bp, Mus musculus
gtgggccagaccagcacaaagcaga

SEQ ID NO: 328280 - DNA, 25 bp, Mus musculus
tgcggcactcgctcttcaaaaaggg

SEQ ID NO: 328281 - DNA, 25 bp, Mus musculus
caatggctatctgagggtccgcatc

SEQ ID NO: 328282 - DNA, 25 bp, Mus musculus
tcgtccggcacgatgaagttcaatg

SEQ ID NO: 328283 - DNA, 25 bp, Mus musculus
ttcctggttctcagctcaccgagtg

SEQ ID NO: 328284 - DNA, 25 bp, Mus musculus
gcccgcaccgggcttctgagaactt

SEQ ID NO: 328285 - DNA, 25 bp, Mus musculus
gagttctgcgccaatgtcaccgacg

SEQ ID NO: 328286 - DNA, 25 bp, Mus musculus
gtctgctggaccttccctcctttta

SEQ ID NO: 328287 - DNA, 25 bp, Mus musculus
tgggtaagtagcgatcgcctcactc

SEQ ID NO: 328288 - DNA, 25 bp, Mus musculus
actttgtggccaactgcacgctgca

SEQ ID NO: 328289 - DNA, 25 bp, Mus musculus
ccctgggttatgaccactttgtggc

SEQ ID NO: 328290 - DNA, 25 bp, Mus musculus
tggagctagccgtcttccacgagac

SEQ ID NO: 328291 - DNA, 25 bp, Mus musculus
ccgggaagacaacgcgggcaccgat

SEQ ID NO: 328292 - DNA, 25 bp, Mus musculus
gcctctggacttgtctctttctccg

SEQ ID NO: 328293 - DNA, 25 bp, Mus musculus
ctagccggaggagcgcctaggaacc

SEQ ID NO: 328294 - DNA, 25 bp, Mus musculus
aggccttgacaagctagccggagga

SEQ ID NO: 328295 - DNA, 25 bp, Mus musculus
gcagtgtctagccaggccttgacaa

SEQ ID NO: 328296 - DNA, 25 bp, Mus musculus
cgccgtcgcgggcagtgtctagcca

SEQ ID NO: 328297 - DNA, 25 bp, Mus musculus
ctgcttcagcgcctcagtgcacaga

SEQ ID NO: 328298 - DNA, 25 bp, Mus musculus
gggctcagctgacctcctcctgatt

SEQ ID NO: 328299 - DNA, 25 bp, Mus musculus
cacagacaagcacgtgagcggggca

SEQ ID NO: 328300 - DNA, 25 bp, Mus musculus
gccagggccgagtacgcctctagct

SEQ ID NO: 328301 - DNA, 25 bp, Mus musculus
gcaccgattcgccatggagggcgcc

SEQ ID NO: 328302 - DNA, 25 bp, Mus musculus
cgccgcgttccgtggactggctttt

SEQ ID NO: 328303 - DNA, 25 bp, Mus musculus
ggacttgtctctttctccgcgcgcg

SEQ ID NO: 328304 - DNA, 25 bp, Mus musculus
acagagccggcgtttaggcccgagc

SEQ ID NO: 328305 - DNA, 25 bp, Mus musculus
tcttggccgcattccggaacgcaga

SEQ ID NO: 328306 - DNA, 25 bp, Mus musculus
cctacgtgttcgagtgcatgtgcga

SEQ ID NO: 328307 - DNA, 25 bp, Mus musculus
gctcccgcctacgtgttcgagtgca

SEQ ID NO: 328308 - DNA, 25 bp, Mus musculus
ccagctacggccagcctgtgtgcgg

SEQ ID NO: 328309 - DNA, 25 bp, Mus musculus
aaacgcagcccgagtcgggctggcc

SEQ ID NO: 328310 - DNA, 25 bp, Mus musculus
tacctgctgcgggtggaaacgcagc

SEQ ID NO: 328311 - DNA, 25 bp, Mus musculus
gcccgcggacaacccagtactcctg

SEQ ID NO: 328312 - DNA, 25 bp, Mus musculus
tagagcgagcctgaccgtctctggc

SEQ ID NO: 328313 - DNA, 25 bp, Mus musculus
ttccggaacgcagagaaaggcaggt

SEQ ID NO: 328314 - DNA, 25 bp, Mus musculus
ttattcggtcttggccgcattccgg

SEQ ID NO: 328315 - DNA, 25 bp, Mus musculus
atgtaatttcctttattcggtcttg

SEQ ID NO: 328316 - DNA, 25 bp, Mus musculus
cgatctccgcttactatgtaatttc

SEQ ID NO: 328317 - DNA, 25 bp, Mus musculus
aacgcagagaaaggcaggtgcctga

SEQ ID NO: 328318 - DNA, 25 bp, Mus musculus
agacacccgatctccgcttactatg

SEQ ID NO: 328319 - DNA, 25 bp, Mus musculus
aggcgccaggtaagacccggatgaa

SEQ ID NO: 328320 - DNA, 25 bp, Mus musculus
tgaatccgcggttagaaacaaagta

SEQ ID NO: 328321 - DNA, 25 bp, Mus musculus
atcttgattgccgaatgaatccgcg

SEQ ID NO: 328322 - DNA, 25 bp, Mus musculus
gaggccaaacctcctccaatcttga

SEQ ID NO: 328323 - DNA, 25 bp, Mus musculus
cctgtctctcctgtggggaacgcag

SEQ ID NO: 328324 - DNA, 25 bp, Mus musculus
gaccatcttctggtgggtgtgcctc

SEQ ID NO: 328325 - DNA, 25 bp, Mus musculus
gcgcagcatgaagttcgcgaccatc

SEQ ID NO: 328326 - DNA, 25 bp, Mus musculus
ttcgaggacttcacggagctctggc

SEQ ID NO: 328327 - DNA, 25 bp, Mus musculus
ctcagccgcttccaagagatggaca

SEQ ID NO: 328328 - DNA, 25 bp, Mus musculus
tcccacgggcgctggaactgttgaa

SEQ ID NO: 328329 - DNA, 25 bp, Mus musculus
ttgaggtcccggatagtacgtcacg

SEQ ID NO: 328330 - DNA, 25 bp, Mus musculus
tgcgcgtacgtgatgtgacgtgact

SEQ ID NO: 328331 - DNA, 25 bp, Mus musculus
accgacacagggtcctctacgaacg

SEQ ID NO: 328332 - DNA, 25 bp, Mus musculus
gcctgcagactgactacgagacgct

SEQ ID NO: 328333 - DNA, 25 bp, Mus musculus
ggcagcgaccgggtaccccatctcc

SEQ ID NO: 328334 - DNA, 25 bp, Mus musculus
acccagctggcagccaccacggggc

SEQ ID NO: 328335 - DNA, 25 bp, Mus musculus
ggcctgtcgagaacgcgcgcggccg

SEQ ID NO: 328336 - DNA, 25 bp, Mus musculus
ccgacgcgaccatggcgactgacag

SEQ ID NO: 328337 - DNA, 25 bp, Mus musculus
cgcgaccatggcgactgacagtaag

SEQ ID NO: 328338 - DNA, 25 bp, Mus musculus
cgaccatggcgactgacagtaagtg

SEQ ID NO: 328339 - DNA, 25 bp, Mus musculus
gtcggctccgctagggtgtggggac

SEQ ID NO: 328340 - DNA, 25 bp, Mus musculus
ccatggcgactgacagtaagtgcgg

SEQ ID NO: 328341 - DNA, 25 bp, Mus musculus
aaggcatccggggtggcaagttctc

SEQ ID NO: 328342 - DNA, 25 bp, Mus musculus
catccggggtggcaagttctcctcc

SEQ ID NO: 328343 - DNA, 25 bp, Mus musculus
ctgcctttgtgcccagctcgcgggg

SEQ ID NO: 328344 - DNA, 25 bp, Mus musculus
gtctgtgcgcgtcgcggccctcgag

SEQ ID NO: 328345 - DNA, 25 bp, Mus musculus
cccatctccggagcccgcccttgtt

SEQ ID NO: 328346 - DNA, 25 bp, Mus musculus
gggtggcaagttctcctcccgcgcg

SEQ ID NO: 328347 - DNA, 25 bp, Mus musculus
agctctcctggaccaagtcagtgtg

SEQ ID NO: 328348 - DNA, 25 bp, Mus musculus
tagcaacgctcctagcaaccggata

SEQ ID NO: 328349 - DNA, 25 bp, Mus musculus
accttcaggaaagttgcttcgggcg

SEQ ID NO: 328350 - DNA, 25 bp, Mus musculus
tctggcgcccgagaccttcaggaaa

SEQ ID NO: 328351 - DNA, 25 bp, Mus musculus
agctcccagtctggctctcagtagc

SEQ ID NO: 328352 - DNA, 25 bp, Mus musculus
cttcccggtagagctcccagtctgg

SEQ ID NO: 328353 - DNA, 25 bp, Mus musculus
ctggaccaagtcagtgtgacccgtg

SEQ ID NO: 328354 - DNA, 25 bp, Mus musculus
ctttggtccaatgcgcgcctagaaa

SEQ ID NO: 328355 - DNA, 25 bp, Mus musculus
gtgtcgccagctctcctggaccaag

SEQ ID NO: 328356 - DNA, 25 bp, Mus musculus
gcgagactcctcttaacgctcaggc

SEQ ID NO: 328357 - DNA, 25 bp, Mus musculus
gacgcgagactcctcttaacgctca

SEQ ID NO: 328358 - DNA, 25 bp, Mus musculus
cgctcctagcaaccggataacatct

SEQ ID NO: 328359 - DNA, 25 bp, Mus musculus
cggataacatctgctccctttggtc

SEQ ID NO: 328360 - DNA, 25 bp, Mus musculus
aagtcagtgtgacccgtggctggac

SEQ ID NO: 328361 - DNA, 25 bp, Mus musculus
ctctgggagagagcgaggagcaact

SEQ ID NO: 328362 - DNA, 25 bp, Mus musculus
agcccgacccggatgagcagctctg

SEQ ID NO: 328363 - DNA, 25 bp, Mus musculus
cgacccggatgagcagctctgggaa

SEQ ID NO: 328364 - DNA, 25 bp, Mus musculus
ctctgggaaggaggaccaagcagtt

SEQ ID NO: 328365 - DNA, 25 bp, Mus musculus
aaggaggaccaagcagttcatggta

SEQ ID NO: 328366 - DNA, 25 bp, Mus musculus
ggaccaagcagttcatggtagtagc

SEQ ID NO: 328367 - DNA, 25 bp, Mus musculus
caagcagttcatggtagtagcgctc

SEQ ID NO: 328368 - DNA, 25 bp, Mus musculus
agcagttcatggtagtagcgctccc

SEQ ID NO: 328369 - DNA, 25 bp, Mus musculus
ttcatggtagtagcgctcccccggc

SEQ ID NO: 328370 - DNA, 25 bp, Mus musculus
tgcccagactgtggcggtgccgcac

SEQ ID NO: 328371 - DNA, 25 bp, Mus musculus
ggctggggaactgcaggctccgccg

SEQ ID NO: 328372 - DNA, 25 bp, Mus musculus
ccggtgctgatgctgaggctgctgc

SEQ ID NO: 328373 - DNA, 25 bp, Mus musculus
ggacgcgggctcagcatttctccct

SEQ ID NO: 328374 - DNA, 25 bp, Mus musculus
ctgctgctgaagatgctgccgggga

SEQ ID NO: 328375 - DNA, 25 bp, Mus musculus
ttccgccaggcggaaccctgtggac

SEQ ID NO: 328376 - DNA, 25 bp, Mus musculus
aagcgagacttcattggccggcgcg

SEQ ID NO: 328377 - DNA, 25 bp, Mus musculus
accgcgagcgtcttcacccgggtat

SEQ ID NO: 328378 - DNA, 25 bp, Mus musculus
cagcacgttcggctgagagctggtc

SEQ ID NO: 328379 - DNA, 25 bp, Mus musculus
ggacccgaagctgaagttaccttga

SEQ ID NO: 328380 - DNA, 25 bp, Mus musculus
accttgaagctcctgggaaagaatc

SEQ ID NO: 328381 - DNA, 25 bp, Mus musculus
tagcggcagtgtttctaggcctctc

SEQ ID NO: 328382 - DNA, 25 bp, Mus musculus
catcaaatcggcaccgacccggttg

SEQ ID NO: 328383 - DNA, 25 bp, Mus musculus
gccggtggctcttcgttcacattcc

SEQ ID NO: 328384 - DNA, 25 bp, Mus musculus
aagcctggatttgcagcggcagcaa

SEQ ID NO: 328385 - DNA, 25 bp, Mus musculus
agtccatggcacaggcgcaaccgaa

SEQ ID NO: 328386 - DNA, 25 bp, Mus musculus
gcaaccgaacctcctggctagcaga

SEQ ID NO: 328387 - DNA, 25 bp, Mus musculus
cgcccactggagacttcaaacggga

SEQ ID NO: 328388 - DNA, 25 bp, Mus musculus
ccgtttccgccagggcgcctgaagt

SEQ ID NO: 328389 - DNA, 25 bp, Mus musculus
gccggcttgctcctagctgagcatc

SEQ ID NO: 328390 - DNA, 25 bp, Mus musculus
cgaggctgtcaccactagggacgaa

SEQ ID NO: 328391 - DNA, 25 bp, Mus musculus
tgggccaccactttccaagccgagg

SEQ ID NO: 328392 - DNA, 25 bp, Mus musculus
gctgagcatcccaaactactggaca

SEQ ID NO: 328393 - DNA, 25 bp, Mus musculus
aagcccgggtactgtgctgcttgtt

SEQ ID NO: 328394 - DNA, 25 bp, Mus musculus
tgcgggaaacgtgccctaaactcca

SEQ ID NO: 328395 - DNA, 25 bp, Mus musculus
atcttcttagacatacgcgcgcgcg

SEQ ID NO: 328396 - DNA, 25 bp, Mus musculus
ttcactgcgcgaactaaggctcccg

SEQ ID NO: 328397 - DNA, 25 bp, Mus musculus
gagaatgcgaacctcctcccgcaga

SEQ ID NO: 328398 - DNA, 25 bp, Mus musculus
ccgagctttctgagattgtcactgc

SEQ ID NO: 328399 - DNA, 25 bp, Mus musculus
aggcatctccaaggaccgagctttc

SEQ ID NO: 328400 - DNA, 25 bp, Mus musculus
cctcactgactgttgctcttttgga

SEQ ID NO: 328401 - DNA, 25 bp, Mus musculus
ctggctccagtctcctagggaagtg

SEQ ID NO: 328402 - DNA, 25 bp, Mus musculus
gacaactgccactgcgatcgcggga

SEQ ID NO: 328403 - DNA, 25 bp, Mus musculus
gcggtggctaggccgcctcaagcca

SEQ ID NO: 328404 - DNA, 25 bp, Mus musculus
ccgtcctcatgacccggatggcgca

SEQ ID NO: 328405 - DNA, 25 bp, Mus musculus
caggtctgggcgctggaaacccgcc

SEQ ID NO: 328406 - DNA, 25 bp, Mus musculus
cacgcctaatcccttccaggtctgg

SEQ ID NO: 328407 - DNA, 25 bp, Mus musculus
accctgcccggctctagggcggagt

SEQ ID NO: 328408 - DNA, 25 bp, Mus musculus
cgcggccagtgagcgcagagttcct

SEQ ID NO: 328409 - DNA, 25 bp, Mus musculus
ctggagctgattgcagcggcgactt

SEQ ID NO: 328410 - DNA, 25 bp, Mus musculus
ctgcctctgcctccgtcctcatgac

SEQ ID NO: 328411 - DNA, 25 bp, Mus musculus
gcaaggccctgaagagaggcactga

SEQ ID NO: 328412 - DNA, 25 bp, Mus musculus
cccggttgaaggcaaggccctgaag

SEQ ID NO: 328413 - DNA, 25 bp, Mus musculus
cgccaccgcggttcagagccgggta

SEQ ID NO: 328414 - DNA, 25 bp, Mus musculus
ttgcagcggcgacttctgctgggca

SEQ ID NO: 328415 - DNA, 25 bp, Mus musculus
gacgacccaaggtcgcgcgcggcca

SEQ ID NO: 328416 - DNA, 25 bp, Mus musculus
ttccataagccacgcctcttccctt

SEQ ID NO: 328417 - DNA, 25 bp, Mus musculus
ccatagcacagaggccggaccataa

SEQ ID NO: 328418 - DNA, 25 bp, Mus musculus
tccgcttcctcggactcgggtgtaa

SEQ ID NO: 328419 - DNA, 25 bp, Mus musculus
gcggatgtggctttgcagtttcttc

SEQ ID NO: 328420 - DNA, 25 bp, Mus musculus
ctccggctctgattgggtaaaaata

SEQ ID NO: 328421 - DNA, 25 bp, Mus musculus
ctgaagcggattggtccatagcaca

SEQ ID NO: 328422 - DNA, 25 bp, Mus musculus
ggaccataaccagcgggctcttctg

SEQ ID NO: 328423 - DNA, 25 bp, Mus musculus
ctttgcttgctaccttccgattgga

SEQ ID NO: 328424 - DNA, 25 bp, Mus musculus
gcgcatgcgtaactcggtctacgga

SEQ ID NO: 328425 - DNA, 25 bp, Mus musculus
ggtctacggaccacgccatacaaca

SEQ ID NO: 328426 - DNA, 25 bp, Mus musculus
cacctccctctaggtcaggttaacg

SEQ ID NO: 328427 - DNA, 25 bp, Mus musculus
cttcctggacgtgtggccaataaaa

SEQ ID NO: 328428 - DNA, 25 bp, Mus musculus
tcgtcaccgattccgccttttcatg

SEQ ID NO: 328429 - DNA, 25 bp, Mus musculus
gcagaaagtacctccgcagcaaacc

SEQ ID NO: 328430 - DNA, 25 bp, Mus musculus
ccacactggagctggagaaaacgca

SEQ ID NO: 328431 - DNA, 25 bp, Mus musculus
tcgactcgctcgaggctgccggcga

SEQ ID NO: 328432 - DNA, 25 bp, Mus musculus
tggaggcaaagtaaccgccgcgaaa

SEQ ID NO: 328433 - DNA, 25 bp, Mus musculus
cgtgatgaatggaggcaaagtaacc

SEQ ID NO: 328434 - DNA, 25 bp, Mus musculus
ctggaatcaattggggcgtgatgaa

SEQ ID NO: 328435 - DNA, 25 bp, Mus musculus
ccgcggcttttattagcctggaatc

SEQ ID NO: 328436 - DNA, 25 bp, Mus musculus
tcctggttgctgtgcgaagaacagt

SEQ ID NO: 328437 - DNA, 25 bp, Mus musculus
acggtgcctagctcgactcgctcga

SEQ ID NO: 328438 - DNA, 25 bp, Mus musculus
actcgggaattgatccggccacgcg

SEQ ID NO: 328439 - DNA, 25 bp, Mus musculus
tcgcgggccactcgggaattgatcc

SEQ ID NO: 328440 - DNA, 25 bp, Mus musculus
tcctgcagacggctggccagcagag

SEQ ID NO: 328441 - DNA, 25 bp, Mus musculus
ggggctccgcgaacctcggtctctg

SEQ ID NO: 328442 - DNA, 25 bp, Mus musculus
ccgtcaacgagttgcggcgctgcga

SEQ ID NO: 328443 - DNA, 25 bp, Mus musculus
cgcgaaaccggaatcgtccgactca

SEQ ID NO: 328444 - DNA, 25 bp, Mus musculus
ctgtgcgaagaacagtgcgggtcta

SEQ ID NO: 328445 - DNA, 25 bp, Mus musculus
aggcgctaccagttgtctcgcgata

SEQ ID NO: 328446 - DNA, 25 bp, Mus musculus
ccagctgtcccgttagtgtttacca

SEQ ID NO: 328447 - DNA, 25 bp, Mus musculus
taagcacagtcgctgcacccagctg

SEQ ID NO: 328448 - DNA, 25 bp, Mus musculus
tccggttcagcacccgcttaagcta

SEQ ID NO: 328449 - DNA, 25 bp, Mus musculus
acgcctttgtgttccggacgcgaag

SEQ ID NO: 328450 - DNA, 25 bp, Mus musculus
ctcggaaccacagcgacgcctttgt

SEQ ID NO: 328451 - DNA, 25 bp, Mus musculus
ccaggcggcaggaagccgctgttct

SEQ ID NO: 328452 - DNA, 25 bp, Mus musculus
gcgcgtcacgggaggtaactatcgc

SEQ ID NO: 328453 - DNA, 25 bp, Mus musculus
cttcattggccagtgcgcgcgtcac

SEQ ID NO: 328454 - DNA, 25 bp, Mus musculus
cgggagctgtactccgccttcattg

SEQ ID NO: 328455 - DNA, 25 bp, Mus musculus
ctcgcttctccaggggcgagtttgc

SEQ ID NO: 328456 - DNA, 25 bp, Mus musculus
agcggtagctgtggttccgcttcca

SEQ ID NO: 328457 - DNA, 25 bp, Mus musculus
ctcgcgatactacgggtcttcaaac

SEQ ID NO: 328458 - DNA, 25 bp, Mus musculus
tcctttagccaacgaagtcccgtga

SEQ ID NO: 328459 - DNA, 25 bp, Mus musculus
aaagtgttctaggagagtcggcctc

SEQ ID NO: 328460 - DNA, 25 bp, Mus musculus
cacactgtggacaggacgcgggacc

SEQ ID NO: 328461 - DNA, 25 bp, Mus musculus
cagagattgcaaaaccacgggcggc

SEQ ID NO: 328462 - DNA, 25 bp, Mus musculus
agccgcggcgcagagattgcaaaac

SEQ ID NO: 328463 - DNA, 25 bp, Mus musculus
tgttagaacactgaagccgcggcgc

SEQ ID NO: 328464 - DNA, 25 bp, Mus musculus
gtttgcattcctcgcgtcacgcctg

SEQ ID NO: 328465 - DNA, 25 bp, Mus musculus
gcgctcggctgattgtttgcattcc

SEQ ID NO: 328466 - DNA, 25 bp, Mus musculus
cgggcttctttgtgtcacctccggg

SEQ ID NO: 328467 - DNA, 25 bp, Mus musculus
gcccacgggagtctctggatgcccg

SEQ ID NO: 328468 - DNA, 25 bp, Mus musculus
agccttcggccgcacggaagagcga

SEQ ID NO: 328469 - DNA, 25 bp, Mus musculus
gtggtctgtagcctccagtccagag

SEQ ID NO: 328470 - DNA, 25 bp, Mus musculus
tcccgccacctgcaagggtctgtaa

SEQ ID NO: 328471 - DNA, 25 bp, Mus musculus
acctgcgttcggagttagttcctca

SEQ ID NO: 328472 - DNA, 25 bp, Mus musculus
acccttgcgttggaagagaagaggc

SEQ ID NO: 328473 - DNA, 25 bp, Mus musculus
acaaaaactggtggggtgctcagcc

SEQ ID NO: 328474 - DNA, 25 bp, Mus musculus
gctgatcagaaagcagagaacaaaa

SEQ ID NO: 328475 - DNA, 25 bp, Mus musculus
agttcacagctgatcagaaagcaga

SEQ ID NO: 328476 - DNA, 25 bp, Mus musculus
gctgctaccaccacacgaacttctg

SEQ ID NO: 328477 - DNA, 25 bp, Mus musculus
cggatgaaaccggattggagccaat

SEQ ID NO: 328478 - DNA, 25 bp, Mus musculus
gccaagccgccaccgctgctaccac

SEQ ID NO: 328479 - DNA, 25 bp, Mus musculus
aaccggattggagccaatgtctatc

SEQ ID NO: 328480 - DNA, 25 bp, Mus musculus
attggagccaatgtctatccttata

SEQ ID NO: 328481 - DNA, 25 bp, Mus musculus
ttatacccacagataaccttagtcc

SEQ ID NO: 328482 - DNA, 25 bp, Mus musculus
ccttagtcctcaccattcatcaatg

SEQ ID NO: 328483 - DNA, 25 bp, Mus musculus
cctcaccattcatcaatgaaacttc

SEQ ID NO: 328484 - DNA, 25 bp, Mus musculus
tcattttacaatagacagacgatta

SEQ ID NO: 328485 - DNA, 25 bp, Mus musculus
acagacgattacagaagttcacagc

SEQ ID NO: 328486 - DNA, 25 bp, Mus musculus
acacgaacttctgcgaccccgttgt

SEQ ID NO: 328487 - DNA, 25 bp, Mus musculus
gccgcaacctaggtcacgcaaactt

SEQ ID NO: 328488 - DNA, 25 bp, Mus musculus
tgcgcaccttcgctgctgagcgcga

SEQ ID NO: 328489 - DNA, 25 bp, Mus musculus
tcacgacgtctttccgggtcgcctg

SEQ ID NO: 328490 - DNA, 25 bp, Mus musculus
ccagtctttggtgacaaccctcttg

SEQ ID NO: 328491 - DNA, 25 bp, Mus musculus
aggctctttccgcagccagtcattg

SEQ ID NO: 328492 - DNA, 25 bp, Mus musculus
aggcgggctccacacaggctctttc

SEQ ID NO: 328493 - DNA, 25 bp, Mus musculus
aggcgggaagctcccggctcatcag

SEQ ID NO: 328494 - DNA, 25 bp, Mus musculus
gcaaacttgctcagacaggcccatt

SEQ ID NO: 328495 - DNA, 25 bp, Mus musculus
cgacgcaggcgcactagctgatttc

SEQ ID NO: 328496 - DNA, 25 bp, Mus musculus
ggcctcctctgtcagcgggtcacga

SEQ ID NO: 328497 - DNA, 25 bp, Mus musculus
cctacacactatctctgattggcta

SEQ ID NO: 328498 - DNA, 25 bp, Mus musculus
ccctgagcacgtgggttgtgctgtc

SEQ ID NO: 328499 - DNA, 25 bp, Mus musculus
agtcattgccgccaaccagtctttg

SEQ ID NO: 328500 - DNA, 25 bp, Mus musculus
actagctgatttctcccgggaggtc

SEQ ID NO: 328501 - DNA, 25 bp, Mus musculus
cgcattggcgcgaccagctgtctct

SEQ ID NO: 328502 - DNA, 25 bp, Mus musculus
acgactgcaaggtcgccgatcctca

SEQ ID NO: 328503 - DNA, 25 bp, Mus musculus
accagattgtgagggacacgactgc

SEQ ID NO: 328504 - DNA, 25 bp, Mus musculus
cccgggtcctggtcaccagattgtg

SEQ ID NO: 328505 - DNA, 25 bp, Mus musculus
atctggtgcactgagccctggtaac

SEQ ID NO: 328506 - DNA, 25 bp, Mus musculus
aggctctgggtcagaatctggtgca

SEQ ID NO: 328507 - DNA, 25 bp, Mus musculus
taagtagaggcaagactagaggctc

SEQ ID NO: 328508 - DNA, 25 bp, Mus musculus
gaccgcgacgatctgggtaagtaga

SEQ ID NO: 328509 - DNA, 25 bp, Mus musculus
gaggtctctcccaggccgctgggca

SEQ ID NO: 328510 - DNA, 25 bp, Mus musculus
cagctgtctctctccgcgctgggga

SEQ ID NO: 328511 - DNA, 25 bp, Mus musculus
ctgcggtccctctgcagagggctgc

SEQ ID NO: 328512 - DNA, 25 bp, Mus musculus
tgctcctcgacctcgggagcagagc

SEQ ID NO: 328513 - DNA, 25 bp, Mus musculus
ccgatcctcagacggctccaggtgg

SEQ ID NO: 328514 - DNA, 25 bp, Mus musculus
ctctccgttgtttgggcccgtgctc

SEQ ID NO: 328515 - DNA, 25 bp, Mus musculus
gcggcagcggaagtcctttgttgca

SEQ ID NO: 328516 - DNA, 25 bp, Mus musculus
acaagttcgagcgtcactggctccc

SEQ ID NO: 328517 - DNA, 25 bp, Mus musculus
acacgtcttggcgtgacctgggaac

SEQ ID NO: 328518 - DNA, 25 bp, Mus musculus
gtcttggcgtgacctgggaactttc

SEQ ID NO: 328519 - DNA, 25 bp, Mus musculus
tctgacatctgggtagagggcgatc

SEQ ID NO: 328520 - DNA, 25 bp, Mus musculus
gtagagggcgatcggcatccagccc

SEQ ID NO: 328521 - DNA, 25 bp, Mus musculus
cccagtggcgtccagctgtgcaaac

SEQ ID NO: 328522 - DNA, 25 bp, Mus musculus
gcgtccagctgtgcaaacaggagga

SEQ ID NO: 328523 - DNA, 25 bp, Mus musculus
ccggcccgacgcagaaacttgttgc

SEQ ID NO: 328524 - DNA, 25 bp, Mus musculus
aacttgttgcaaccaacaggcgacc

SEQ ID NO: 328525 - DNA, 25 bp, Mus musculus
gcagacccggagtcgccgcgtaagc

SEQ ID NO: 328526 - DNA, 25 bp, Mus musculus
ggaagtcctttgttgcagcgcagtc

SEQ ID NO: 328527 - DNA, 25 bp, Mus musculus
tgtggggacaagttcgagcgtcact

SEQ ID NO: 328528 - DNA, 25 bp, Mus musculus
ttgttgcagcgcagtccctggcaga

SEQ ID NO: 328529 - DNA, 25 bp, Mus musculus
gggcaccttcgatgtgtccatcctg

SEQ ID NO: 328530 - DNA, 25 bp, Mus musculus
gtgcagagcgcagtcatcactgttc

SEQ ID NO: 328531 - DNA, 25 bp, Mus musculus
tatttcaacgactcgcagcgccagg

SEQ ID NO: 328532 - DNA, 25 bp, Mus musculus
gggaccgattggctctgagagtttc

SEQ ID NO: 328533 - DNA, 25 bp, Mus musculus
ggccaccaaggatgcgggcaccatc

SEQ ID NO: 328534 - DNA, 25 bp, Mus musculus
ggcctcaacgtgttgcgcatcatca

SEQ ID NO: 328535 - DNA, 25 bp, Mus musculus
gacaaccgtatggtcagccacctgg

SEQ ID NO: 328536 - DNA, 25 bp, Mus musculus
gcggcgagaagaacgtgctcatctt

SEQ ID NO: 328537 - DNA, 25 bp, Mus musculus
catctttgaggtgaagtccacggcc

SEQ ID NO: 328538 - DNA, 25 bp, Mus musculus
acccacctgggtggcgaagacttcg

SEQ ID NO: 328539 - DNA, 25 bp, Mus musculus
acgccacagtgcagtccgatatgaa

SEQ ID NO: 328540 - DNA, 25 bp, Mus musculus
acgctttcgtcctaacgttgctttg

SEQ ID NO: 328541 - DNA, 25 bp, Mus musculus
ttgcgcttgcctctcctgacgcttt

SEQ ID NO: 328542 - DNA, 25 bp, Mus musculus
atcgcctacggcctggataagaagg

SEQ ID NO: 328543 - DNA, 25 bp, Mus musculus
cccgttctcggcgtgtagcaggcac

SEQ ID NO: 328544 - DNA, 25 bp, Mus musculus
ctacccggctggacgtaagtgcagc

SEQ ID NO: 328545 - DNA, 25 bp, Mus musculus
caagtccgggctggccgcgagcaca

SEQ ID NO: 328546 - DNA, 25 bp, Mus musculus
ggacacccagagtgctcggggtccc

SEQ ID NO: 328547 - DNA, 25 bp, Mus musculus
atggtcaagagtgaggccatgttca

SEQ ID NO: 328548 - DNA, 25 bp, Mus musculus
gccatgttcaccgtcccagagtttt

SEQ ID NO: 328549 - DNA, 25 bp, Mus musculus
tggtcctgttctctgcgctcctgct

SEQ ID NO: 328550 - DNA, 25 bp, Mus musculus
cagcgcttggcgtcctggtcctgtt

SEQ ID NO: 328551 - DNA, 25 bp, Mus musculus
ccagtagggactctatagggaggcc

SEQ ID NO: 328552 - DNA, 25 bp, Mus musculus
cccagagttttactccaggagaaag

SEQ ID NO: 328553 - DNA, 25 bp, Mus musculus
cagtttgtcgggcaatcctctaccc

SEQ ID NO: 328554 - DNA, 25 bp, Mus musculus
gggcaatcctctacccggctggacg

SEQ ID NO: 328555 - DNA, 25 bp, Mus musculus
taagtgcagcctggtcgcacgctcc

SEQ ID NO: 328556 - DNA, 25 bp, Mus musculus
ctggtcgcacgctcctgggccgagt

SEQ ID NO: 328557 - DNA, 25 bp, Mus musculus
tcatctcccgaacccttgaacagtt

SEQ ID NO: 328558 - DNA, 25 bp, Mus musculus
tgaacagttattaatttacgcctag

SEQ ID NO: 328559 - DNA, 25 bp, Mus musculus
ttacgcctagtctgcacgttcggtg

SEQ ID NO: 328560 - DNA, 25 bp, Mus musculus
agtctgcacgttcggtgccttctca

SEQ ID NO: 328561 - DNA, 25 bp, Mus musculus
cacgttcggtgccttctcaggtcac

SEQ ID NO: 328562 - DNA, 25 bp, Mus musculus
tcaggtcaccgatttccgaagctta

SEQ ID NO: 328563 - DNA, 25 bp, Mus musculus
aggtcaccgatttccgaagcttacg

SEQ ID NO: 328564 - DNA, 25 bp, Mus musculus
gccagggcctatccaaagctcatct

SEQ ID NO: 328565 - DNA, 25 bp, Mus musculus
ggtgccttctcaggtcaccgatttc

SEQ ID NO: 328566 - DNA, 25 bp, Mus musculus
agctcagcggggcttgcttagcgga

SEQ ID NO: 328567 - DNA, 25 bp, Mus musculus
agcctgcagttaattggtgaggaga

SEQ ID NO: 328568 - DNA, 25 bp, Mus musculus
tctaacgtttgtgccagaaccggaa

SEQ ID NO: 328569 - DNA, 25 bp, Mus musculus
aataaagcctgcagttaattggtga

SEQ ID NO: 328570 - DNA, 25 bp, Mus musculus
ggaagccagggcctatccaaagctc

SEQ ID NO: 328571 - DNA, 25 bp, Mus musculus
tcgtggtgacctgctccagtaggac

SEQ ID NO: 328572 - DNA, 25 bp, Mus musculus
cccaggctagccctctgtgggatga

SEQ ID NO: 328573 - DNA, 25 bp, Mus musculus
cccatgctcgattggctgagtggca

SEQ ID NO: 328574 - DNA, 25 bp, Mus musculus
ggccaccgcttggtgagtgtcccta

SEQ ID NO: 328575 - DNA, 25 bp, Mus musculus
gactttcaaactcgagcccgcttcg

SEQ ID NO: 328576 - DNA, 25 bp, Mus musculus
gccgcttccgagagcgactttcaaa

SEQ ID NO: 328577 - DNA, 25 bp, Mus musculus
gagcgcagtctccacccactggaaa

SEQ ID NO: 328578 - DNA, 25 bp, Mus musculus
cagagccgccaattgctggatcgca

SEQ ID NO: 328579 - DNA, 25 bp, Mus musculus
cgggccacgcgcgttaatcattagc

SEQ ID NO: 328580 - DNA, 25 bp, Mus musculus
tgggatcccagagttccaggtggca

SEQ ID NO: 328581 - DNA, 25 bp, Mus musculus
ttcgttgccctctcggcgtgatatc

SEQ ID NO: 328582 - DNA, 25 bp, Mus musculus
ctagacctgcgcttctcctgggaaa

SEQ ID NO: 328583 - DNA, 25 bp, Mus musculus
gcgaggaattcgagacgtgcctttc

SEQ ID NO: 328584 - DNA, 25 bp, Mus musculus
agtcctctctggtcggaacctggtc

SEQ ID NO: 328585 - DNA, 25 bp, Mus musculus
catccaggtagtactgctgtgcctc

SEQ ID NO: 328586 - DNA, 25 bp, Mus musculus
caggtagtactgctgtgcctcgtga

SEQ ID NO: 328587 - DNA, 25 bp, Mus musculus
gcctgcatccaggtagtactgctgt

SEQ ID NO: 328588 - DNA, 25 bp, Mus musculus
gtagtactgctgtgcctcgtgagca

SEQ ID NO: 328589 - DNA, 25 bp, Mus musculus
gcctcgtgagcatcccgcaggcgct

SEQ ID NO: 328590 - DNA, 25 bp, Mus musculus
tcccgcagcgtgtcccacgagctct

SEQ ID NO: 328591 - DNA, 25 bp, Mus musculus
cgctcctcgatgtcttggcagtcga

SEQ ID NO: 328592 - DNA, 25 bp, Mus musculus
cctcgatgtcttggcagtcgatctc

SEQ ID NO: 328593 - DNA, 25 bp, Mus musculus
atgtcttggcagtcgatctcggctg

SEQ ID NO: 328594 - DNA, 25 bp, Mus musculus
agtcgatctcggctgccttcaccag

SEQ ID NO: 328595 - DNA, 25 bp, Mus musculus
ttcaccagctcctgccctcgacgta

SEQ ID NO: 328596 - DNA, 25 bp, Mus musculus
gacgtagcacatcctccacccgtgg

SEQ ID NO: 328597 - DNA, 25 bp, Mus musculus
cgctgatccaggcttcggcctcgcc

SEQ ID NO: 328598 - DNA, 25 bp, Mus musculus
cggcctcgcctgcatccaggtagta

SEQ ID NO: 328599 - DNA, 25 bp, Mus musculus
taggctggaagggacagattgttcc

SEQ ID NO: 328600 - DNA, 25 bp, Mus musculus
tagcgtccctgcagactacgatctg

SEQ ID NO: 328601 - DNA, 25 bp, Mus musculus
ctggcggcgaaaaggagtcctccca

SEQ ID NO: 328602 - DNA, 25 bp, Mus musculus
tgctgctccggcctaatttgtgtgc

SEQ ID NO: 328603 - DNA, 25 bp, Mus musculus
aagaggactcgactctgctgctccg

SEQ ID NO: 328604 - DNA, 25 bp, Mus musculus
ccttgccacgggaagaggactcgac

SEQ ID NO: 328605 - DNA, 25 bp, Mus musculus
tgctgccgggaccagatagtcccgc

SEQ ID NO: 328606 - DNA, 25 bp, Mus musculus
taacattatctgaggagggacattc

SEQ ID NO: 328607 - DNA, 25 bp, Mus musculus
gcggacccgcccagagatataaata

SEQ ID NO: 328608 - DNA, 25 bp, Mus musculus
actcacctgcgctggggctgaagcg

SEQ ID NO: 328609 - DNA, 25 bp, Mus musculus
tagctggcttcccaaagctagcgcc

SEQ ID NO: 328610 - DNA, 25 bp, Mus musculus
cggcgacactctactagctggcttc

SEQ ID NO: 328611 - DNA, 25 bp, Mus musculus
gggaggcggccaagagcacaaaccc

SEQ ID NO: 328612 - DNA, 25 bp, Mus musculus
caactttgctcccaggcgagggtcc

SEQ ID NO: 328613 - DNA, 25 bp, Mus musculus
cgcagctacagaagcgtcagaagtc

SEQ ID NO: 328614 - DNA, 25 bp, Mus musculus
aactccggggctgtgaagcgctccc

SEQ ID NO: 328615 - DNA, 25 bp, Mus musculus
ttcagattcagaaagggagccagga

SEQ ID NO: 328616 - DNA, 25 bp, Mus musculus
tctcgccggcactggttcagattca

SEQ ID NO: 328617 - DNA, 25 bp, Mus musculus
cccgcgtgtccgactcttggagtca

SEQ ID NO: 328618 - DNA, 25 bp, Mus musculus
ctcttggagtcaccgcagctacaga

SEQ ID NO: 328619 - DNA, 25 bp, Mus musculus
ctaagggatgagtgagacgtagctc

SEQ ID NO: 328620 - DNA, 25 bp, Mus musculus
cagaagtctagttcgccaggggtgc

SEQ ID NO: 328621 - DNA, 25 bp, Mus musculus
tgccagtcggctccagagtctctgg

SEQ ID NO: 328622 - DNA, 25 bp, Mus musculus
tccagagtctctggtcactcaagtc

SEQ ID NO: 328623 - DNA, 25 bp, Mus musculus
tggtcactcaagtccagcgcagcga

SEQ ID NO: 328624 - DNA, 25 bp, Mus musculus
aacaaggtaactgcagccctggggc

SEQ ID NO: 328625 - DNA, 25 bp, Mus musculus
accgcggcggaacaaggtaactgca

SEQ ID NO: 328626 - DNA, 25 bp, Mus musculus
agtgagacgtagctcggcctctccc

SEQ ID NO: 328627 - DNA, 25 bp, Mus musculus
tcgtgtgcgacaaaatcgatatctc

SEQ ID NO: 328628 - DNA, 25 bp, Mus musculus
tagccagctgtggagtccttagatc

SEQ ID NO: 328629 - DNA, 25 bp, Mus musculus
ggagaccgcctaacaaccgttgcta

SEQ ID NO: 328630 - DNA, 25 bp, Mus musculus
gcggagacttttagccagctgtgga

SEQ ID NO: 328631 - DNA, 25 bp, Mus musculus
tgtcgctggggtcgttctccgaaaa

SEQ ID NO: 328632 - DNA, 25 bp, Mus musculus
aatcgatatctcaactctcgcgagg

SEQ ID NO: 328633 - DNA, 25 bp, Mus musculus
gcctctcgcaggctcggtgttcgac

SEQ ID NO: 328634 - DNA, 25 bp, Mus musculus
ctctcgcgaggtttcgccttccggg

SEQ ID NO: 328635 - DNA, 25 bp, Mus musculus
aggtttcgccttccgggtgtcgctg

SEQ ID NO: 328636 - DNA, 25 bp, Mus musculus
aagtgggcgcgaagagcctctcgca

SEQ ID NO: 328637 - DNA, 25 bp, Mus musculus
ggagtccttagatcgtgtgcgacaa

SEQ ID NO: 328638 - DNA, 25 bp, Mus musculus
caaccgttgctatgggcggagactt

SEQ ID NO: 328639 - DNA, 25 bp, Mus musculus
tctccgaaaactgcgtgacgatgtg

SEQ ID NO: 328640 - DNA, 25 bp, Mus musculus
gggtcgttctccgaaaactgcgtga

SEQ ID NO: 328641 - DNA, 25 bp, Mus musculus
ctggggataaagaagcaaccaccgg

SEQ ID NO: 328642 - DNA, 25 bp, Mus musculus
tctttccgccgacgatctgagaggc

SEQ ID NO: 328643 - DNA, 25 bp, Mus musculus
ggatacgtctgcatctttccgccga

SEQ ID NO: 328644 - DNA, 25 bp, Mus musculus
gttcggaagggatacgtctgcatct

SEQ ID NO: 328645 - DNA, 25 bp, Mus musculus
gctctcaagccctggggtgcccgga

SEQ ID NO: 328646 - DNA, 25 bp, Mus musculus
tcagcctctgccatcgcggctggag

SEQ ID NO: 328647 - DNA, 25 bp, Mus musculus
catcgtactgtttcgccatggcagg

SEQ ID NO: 328648 - DNA, 25 bp, Mus musculus
gtagccggaacagcacatcgtactg

SEQ ID NO: 328649 - DNA, 25 bp, Mus musculus
cccgatcagcagtagccggaacagc

SEQ ID NO: 328650 - DNA, 25 bp, Mus musculus
aactcgttgtcggtgaagcggcaca

SEQ ID NO: 328651 - DNA, 25 bp, Mus musculus
ggggcgcacaatcccttccgggctg

SEQ ID NO: 328652 - DNA, 25 bp, Mus musculus
cgcctctaccttaaggggcgcacaa

SEQ ID NO: 328653 - DNA, 25 bp, Mus musculus
gcaggcatgtcttgccaaccccgga

SEQ ID NO: 328654 - DNA, 25 bp, Mus musculus
tccgggctggggataaagaagcaac

SEQ ID NO: 328655 - DNA, 25 bp, Mus musculus
gaaccgctgtatagtctgagacctg

SEQ ID NO: 328656 - DNA, 25 bp, Mus musculus
tacggactttccgtagcgccttagc

SEQ ID NO: 328657 - DNA, 25 bp, Mus musculus
ctctaggcgcccagactggggcttc

SEQ ID NO: 328658 - DNA, 25 bp, Mus musculus
cggggcaaaactctccatggaacta

SEQ ID NO: 328659 - DNA, 25 bp, Mus musculus
cttctgggagtaggagtcccttttg

SEQ ID NO: 328660 - DNA, 25 bp, Mus musculus
ctcagtggaaacagtcacatccata

SEQ ID NO: 328661 - DNA, 25 bp, Mus musculus
atagtctgagacctgagcacgtgcg

SEQ ID NO: 328662 - DNA, 25 bp, Mus musculus
cctgtttggtcagaaccgctgtata

SEQ ID NO: 328663 - DNA, 25 bp, Mus musculus
cttcgagttccttcacctattattg

SEQ ID NO: 328664 - DNA, 25 bp, Mus musculus
tcccgatcatggcttcttcgagttc

SEQ ID NO: 328665 - DNA, 25 bp, Mus musculus
tgagtcctatacagcgctcgcagct

SEQ ID NO: 328666 - DNA, 25 bp, Mus musculus
aatgcgcgttgttgctggatgaagc

SEQ ID NO: 328667 - DNA, 25 bp, Mus musculus
gccttagcccgctcgagtttcaatg

SEQ ID NO: 328668 - DNA, 25 bp, Mus musculus
cggttgcaagacgactcagtggaaa

SEQ ID NO: 328669 - DNA, 25 bp, Mus musculus
agccggccacaattccgagctctgg

SEQ ID NO: 328670 - DNA, 25 bp, Mus musculus
gcttcgccagactcgcttgttgaca

SEQ ID NO: 328671 - DNA, 25 bp, Mus musculus
gatgtagtccacagaccgcgagttg

SEQ ID NO: 328672 - DNA, 25 bp, Mus musculus
accgcgagttgtcaggagattttcc

SEQ ID NO: 328673 - DNA, 25 bp, Mus musculus
acttgtagtcctcgagcgtcggatg

SEQ ID NO: 328674 - DNA, 25 bp, Mus musculus
agcaccggatcaacggcggcacgca

SEQ ID NO: 328675 - DNA, 25 bp, Mus musculus
gtcaccgacaacaacaagccgagtg

SEQ ID NO: 328676 - DNA, 25 bp, Mus musculus
ctggctgccaaaataacactgtctc

SEQ ID NO: 328677 - DNA, 25 bp, Mus musculus
gctctccacctcgatgtcatcgtta

SEQ ID NO: 328678 - DNA, 25 bp, Mus musculus
catcaggaaccgcacacaggcttcg

SEQ ID NO: 328679 - DNA, 25 bp, Mus musculus
tctcttcttggctagactgctttta

SEQ ID NO: 328680 - DNA, 25 bp, Mus musculus
tctcgtttaatgcttgagtcgctcc

SEQ ID NO: 328681 - DNA, 25 bp, Mus musculus
gaaggaatcacgctgtggctgacca

SEQ ID NO: 328682 - DNA, 25 bp, Mus musculus
tatcgctcatttcctacggcccagg

SEQ ID NO: 328683 - DNA, 25 bp, Mus musculus
cctgtagagaccaaagccggagccc

SEQ ID NO: 328684 - DNA, 25 bp, Mus musculus
cccttcagtcgggagtagcatcctc

SEQ ID NO: 328685 - DNA, 25 bp, Mus musculus
agtggcgccgaaggctccgttaagc

SEQ ID NO: 328686 - DNA, 25 bp, Mus musculus
ctttccctcagtcagtggcgccgaa

SEQ ID NO: 328687 - DNA, 25 bp, Mus musculus
ctttcctcacggaatggggccggcg

SEQ ID NO: 328688 - DNA, 25 bp, Mus musculus
ctgtgcacatgccagggtcgctgga

SEQ ID NO: 328689 - DNA, 25 bp, Mus musculus
tggatgctgcagctccgctgtccac

SEQ ID NO: 328690 - DNA, 25 bp, Mus musculus
ccgaaactagtacagagccctattg

SEQ ID NO: 328691 - DNA, 25 bp, Mus musculus
agcggatgagcagcagagagtaccc

SEQ ID NO: 328692 - DNA, 25 bp, Mus musculus
tgcctcagcggatgagcagcagaga

SEQ ID NO: 328693 - DNA, 25 bp, Mus musculus
ttcagatgaagacagagcccgcagg

SEQ ID NO: 328694 - DNA, 25 bp, Mus musculus
ttcgaactcgggctctgcggggttc

SEQ ID NO: 328695 - DNA, 25 bp, Mus musculus
ggcggccttcgcctgtagagaccaa

SEQ ID NO: 328696 - DNA, 25 bp, Mus musculus
gctctgcggggttctttctcttcag

SEQ ID NO: 328697 - DNA, 25 bp, Mus musculus
atccgcgacttgctggaggtttctc

SEQ ID NO: 328698 - DNA, 25 bp, Mus musculus
ggagccctagcagccaaagtctctg

SEQ ID NO: 328699 - DNA, 25 bp, Mus musculus
ttttacaaccgctgagagctgctga

SEQ ID NO: 328700 - DNA, 25 bp, Mus musculus
gagccgcaacggctactatccgcga

SEQ ID NO: 328701 - DNA, 25 bp, Mus musculus
tgtcggagtcctcacaggtaacggg

SEQ ID NO: 328702 - DNA, 25 bp, Mus musculus
cgaccatcaaatccgtgtcggagtc

SEQ ID NO: 328703 - DNA, 25 bp, Mus musculus
tggcgaccgagggaatgatcctcac

SEQ ID NO: 328704 - DNA, 25 bp, Mus musculus
actgcgctgggaaacatggcgaccg

SEQ ID NO: 328705 - DNA, 25 bp, Mus musculus
tcttgggtctcactccgcagagcct

SEQ ID NO: 328706 - DNA, 25 bp, Mus musculus
gtctcttgccatccaggcgtcttgg

SEQ ID NO: 328707 - DNA, 25 bp, Mus musculus
acctccagagcgtgtgctccctttt

SEQ ID NO: 328708 - DNA, 25 bp, Mus musculus
ggtcccactctaggctgggccggct

SEQ ID NO: 328709 - DNA, 25 bp, Mus musculus
aggattcgggtgttcccgtgtgctc

SEQ ID NO: 328710 - DNA, 25 bp, Mus musculus
tctccacgagttgcacgcctcgggg

SEQ ID NO: 328711 - DNA, 25 bp, Mus musculus
ctcccgaagcgtggactggatctct

SEQ ID NO: 328712 - DNA, 25 bp, Mus musculus
acgacctggtgttggagctcttccc

SEQ ID NO: 328713 - DNA, 25 bp, Mus musculus
cgcccgcgtacgacctggtgttgga

SEQ ID NO: 328714 - DNA, 25 bp, Mus musculus
tctttggcagaggtttcgttgtcga

SEQ ID NO: 328715 - DNA, 25 bp, Mus musculus
ccagggtcactcctctttggcagag

SEQ ID NO: 328716 - DNA, 25 bp, Mus musculus
tggagcccagggtcactcctctttg

SEQ ID NO: 328717 - DNA, 25 bp, Mus musculus
ctgcgcgcccaagcactggccgcca

SEQ ID NO: 328718 - DNA, 25 bp, Mus musculus
caatgccgggtctacggctgcgcgc

SEQ ID NO: 328719 - DNA, 25 bp, Mus musculus
actcggcgccgcaggggcatctgct

SEQ ID NO: 328720 - DNA, 25 bp, Mus musculus
agcgtggactggatctctcgcagcc

SEQ ID NO: 328721 - DNA, 25 bp, Mus musculus
agctcttcccgggagcagccagggc

SEQ ID NO: 328722 - DNA, 25 bp, Mus musculus
tctttctctcgcctggcgcaggagg

SEQ ID NO: 328723 - DNA, 25 bp, Mus musculus
ccgcgtgccgctagaaacgcaccca

SEQ ID NO: 328724 - DNA, 25 bp, Mus musculus
gactggatctctcgcagccagcgca

SEQ ID NO: 328725 - DNA, 25 bp, Mus musculus
tccgtctcagggaagcacggcgacc

SEQ ID NO: 328726 - DNA, 25 bp, Mus musculus
ttagcggcttccgagtccgtctcag

SEQ ID NO: 328727 - DNA, 25 bp, Mus musculus
cagcgaagcgactcagcggttagaa

SEQ ID NO: 328728 - DNA, 25 bp, Mus musculus
ggttagaacgaacgcttcgcagttc

SEQ ID NO: 328729 - DNA, 25 bp, Mus musculus
gcgctcaggattggacgatccgttc

SEQ ID NO: 328730 - DNA, 25 bp, Mus musculus
atcgggagtttctggattctttatc

SEQ ID NO: 328731 - DNA, 25 bp, Mus musculus
ttatccagtgttttgagggccgcca

SEQ ID NO: 328732 - DNA, 25 bp, Mus musculus
ttaatcaacaggttcccgggagcgc

SEQ ID NO: 328733 - DNA, 25 bp, Mus musculus
gcagggagtcgtctcgctgcgccca

SEQ ID NO: 328734 - DNA, 25 bp, Mus musculus
gcgagtctctgggactcttccctca

SEQ ID NO: 328735 - DNA, 25 bp, Mus musculus
ccagcctgggaaacactttcccgtg

SEQ ID NO: 328736 - DNA, 25 bp, Mus musculus
ttcccgtggaagacggaatgcagcc

SEQ ID NO: 328737 - DNA, 25 bp, Mus musculus
cgggctgtggcgatcttaatcaaca

SEQ ID NO: 328738 - DNA, 25 bp, Mus musculus
ccgtcgagccttagcggcttccgag

SEQ ID NO: 328739 - DNA, 25 bp, Mus musculus
ttgcccgacatcctgacggtgactc

SEQ ID NO: 328740 - DNA, 25 bp, Mus musculus
agctgaccgggtcacttgacaactg

SEQ ID NO: 328741 - DNA, 25 bp, Mus musculus
agcgccctctcttggttgactaaaa

SEQ ID NO: 328742 - DNA, 25 bp, Mus musculus
ataccaggggcagtgactcttcagc

SEQ ID NO: 328743 - DNA, 25 bp, Mus musculus
actcttcagctcgtcccttggttca

SEQ ID NO: 328744 - DNA, 25 bp, Mus musculus
cgcccatattaggaggaccaagact

SEQ ID NO: 328745 - DNA, 25 bp, Mus musculus
caagactctatggttagtggcaacg

SEQ ID NO: 328746 - DNA, 25 bp, Mus musculus
cggttgtcgcttgtcctagtcttta

SEQ ID NO: 328747 - DNA, 25 bp, Mus musculus
cgaaggatccttttctgtcggcgcc

SEQ ID NO: 328748 - DNA, 25 bp, Mus musculus
gcgtgggaccctacttcgggattca

SEQ ID NO: 328749 - DNA, 25 bp, Mus musculus
gggattcacacatccacttcaggtg

SEQ ID NO: 328750 - DNA, 25 bp, Mus musculus
gccttggttttgtccagtgcggcta

SEQ ID NO: 328751 - DNA, 25 bp, Mus musculus
cttacattcgcgaagggaagatttc

SEQ ID NO: 328752 - DNA, 25 bp, Mus musculus
cgagtctcctcgttgccactaagca

SEQ ID NO: 328753 - DNA, 25 bp, Mus musculus
gagcctcccgccctgcgggcaggaa

SEQ ID NO: 328754 - DNA, 25 bp, Mus musculus
tcaccctcttgacgaggaagccttc

SEQ ID NO: 328755 - DNA, 25 bp, Mus musculus
agctcgtcaccttgtccaacacttg

SEQ ID NO: 328756 - DNA, 25 bp, Mus musculus
cgggacttctgctccgaccttccca

SEQ ID NO: 328757 - DNA, 25 bp, Mus musculus
agaacacactcaccctcttgacgag

SEQ ID NO: 328758 - DNA, 25 bp, Mus musculus
ggcccgcggtgatcgcccaagaaca

SEQ ID NO: 328759 - DNA, 25 bp, Mus musculus
cctcttgacgaggaagccttccttg

SEQ ID NO: 328760 - DNA, 25 bp, Mus musculus
cttgacgaggaagccttccttgagc

SEQ ID NO: 328761 - DNA, 25 bp, Mus musculus
accttcccacgccaggtgcccagtg

SEQ ID NO: 328762 - DNA, 25 bp, Mus musculus
gtcgccagtccaggtgagctgtccc

SEQ ID NO: 328763 - DNA, 25 bp, Mus musculus
tggcgcacatccagtgccagagcct

SEQ ID NO: 328764 - DNA, 25 bp, Mus musculus
aagtctggcccggtcgggacttctg

SEQ ID NO: 328765 - DNA, 25 bp, Mus musculus
cctccatgtcgccagtccaggtgag

SEQ ID NO: 328766 - DNA, 25 bp, Mus musculus
gggcgcgaggccagaacacactcac

SEQ ID NO: 328767 - DNA, 25 bp, Mus musculus
aggcaagggcgttgaactctgattc

SEQ ID NO: 328768 - DNA, 25 bp, Mus musculus
tcctaaagctaaaaatcgggagaga

SEQ ID NO: 328769 - DNA, 25 bp, Mus musculus
actctgattcatgtccatcgctccg

SEQ ID NO: 328770 - DNA, 25 bp, Mus musculus
ccgactagaaattcccagggcgaat

SEQ ID NO: 328771 - DNA, 25 bp, Mus musculus
ttcccagggcgaatttgatgcttcc

SEQ ID NO: 328772 - DNA, 25 bp, Mus musculus
gcgaatttgatgcttccgaggctga

SEQ ID NO: 328773 - DNA, 25 bp, Mus musculus
ttccgaggctgagagatgctaagca

SEQ ID NO: 328774 - DNA, 25 bp, Mus musculus
atgctaagcagcgttcgcagacgtc

SEQ ID NO: 328775 - DNA, 25 bp, Mus musculus
ttcgcagacgtcttccaggctaaca

SEQ ID NO: 328776 - DNA, 25 bp, Mus musculus
tccaggctaacacaagcgccaaata

SEQ ID NO: 328777 - DNA, 25 bp, Mus musculus
agcgccaaataattgagacaaccca

SEQ ID NO: 328778 - DNA, 25 bp, Mus musculus
ttgagacaacccacaaactccagct

SEQ ID NO: 328779 - DNA, 25 bp, Mus musculus
ttgggcagaggcgactgcagacttc

SEQ ID NO: 328780 - DNA, 25 bp, Mus musculus
catcgctccgcttttggggttcctt

SEQ ID NO: 328781 - DNA, 25 bp, Mus musculus
gggtgctcccgctgacctacagctt

SEQ ID NO: 328782 - DNA, 25 bp, Mus musculus
ctcccgctgacctacagcttcgggc

SEQ ID NO: 328783 - DNA, 25 bp, Mus musculus
gcggaaacccggctgagaaccaggc

SEQ ID NO: 328784 - DNA, 25 bp, Mus musculus
gaaacccggctgagaaccaggcgcc

SEQ ID NO: 328785 - DNA, 25 bp, Mus musculus
ctgagaaccaggcgcccggggctaa

SEQ ID NO: 328786 - DNA, 25 bp, Mus musculus
cctccgctcctctgttccaacgctg

SEQ ID NO: 328787 - DNA, 25 bp, Mus musculus
aacgctgcgcgcgagccagcagccg

SEQ ID NO: 328788 - DNA, 25 bp, Mus musculus
ccgggcgttgtattgcgactggcac

SEQ ID NO: 328789 - DNA, 25 bp, Mus musculus
gcgttgtattgcgactggcacttta

SEQ ID NO: 328790 - DNA, 25 bp, Mus musculus
ttgtattgcgactggcactttatgc

SEQ ID NO: 328791 - DNA, 25 bp, Mus musculus
ttgcgactggcactttatgctgacc

SEQ ID NO: 328792 - DNA, 25 bp, Mus musculus
cgactggcactttatgctgaccatc

SEQ ID NO: 328793 - DNA, 25 bp, Mus musculus
tggcactttatgctgaccatcggta

SEQ ID NO: 328794 - DNA, 25 bp, Mus musculus
cactttatgctgaccatcggtaacg

SEQ ID NO: 328795 - DNA, 25 bp, Mus musculus
cgaaaccgaaagcaaagaggaagcg

SEQ ID NO: 328796 - DNA, 25 bp, Mus musculus
ctctccgcggcggaaaggcctctgt

SEQ ID NO: 328797 - DNA, 25 bp, Mus musculus
cccatagtacggatgcggtgcaaac

SEQ ID NO: 328798 - DNA, 25 bp, Mus musculus
tctgtgcgggcatcgtgggcaccta

SEQ ID NO: 328799 - DNA, 25 bp, Mus musculus
cgcgccgagtgaccggacgagactc

SEQ ID NO: 328800 - DNA, 25 bp, Mus musculus
cccgcgactattcccgcatccagtg

SEQ ID NO: 328801 - DNA, 25 bp, Mus musculus
gccgcactcacccatagtacggatg

SEQ ID NO: 328802 - DNA, 25 bp, Mus musculus
gcctctccgaaaccgaaagcaaaga

SEQ ID NO: 328803 - DNA, 25 bp, Mus musculus
gccgcccacgccaacccagacgact

SEQ ID NO: 328804 - DNA, 25 bp, Mus musculus
atgctcgcttctgacaggcgctctg

SEQ ID NO: 328805 - DNA, 25 bp, Mus musculus
tgtttaactccttcagcgcccgcgt

SEQ ID NO: 328806 - DNA, 25 bp, Mus musculus
gtacggatgcggtgcaaactgcaca

SEQ ID NO: 328807 - DNA, 25 bp, Mus musculus
actgcacatgctcgcttctgacagg

SEQ ID NO: 328808 - DNA, 25 bp, Mus musculus
ggtgcaaactgcacatgctcgcttc

SEQ ID NO: 328809 - DNA, 25 bp, Mus musculus
ccggcagctcactcaggtgagccgg

SEQ ID NO: 328810 - DNA, 25 bp, Mus musculus
ctttgtgcggagctccggggacctt

SEQ ID NO: 328811 - DNA, 25 bp, Mus musculus
atttcctgtgcctggccgcgagctg

SEQ ID NO: 328812 - DNA, 25 bp, Mus musculus
gctgcggctgctgaggtcatttcct

SEQ ID NO: 328813 - DNA, 25 bp, Mus musculus
atcccacgctgtctgggggtcgcag

SEQ ID NO: 328814 - DNA, 25 bp, Mus musculus
tctggtgagcatcccgccggggatc

SEQ ID NO: 328815 - DNA, 25 bp, Mus musculus
gagggtccagtctggtgagcatccc

SEQ ID NO: 328816 - DNA, 25 bp, Mus musculus
ctgggacctccttccgcggagggag

SEQ ID NO: 328817 - DNA, 25 bp, Mus musculus
gactcccggcagctcactcaggtga

SEQ ID NO: 328818 - DNA, 25 bp, Mus musculus
acggacagggctgactcctcgcggc

SEQ ID NO: 328819 - DNA, 25 bp, Mus musculus
ggagggcaactctggagcaggtgcc

SEQ ID NO: 328820 - DNA, 25 bp, Mus musculus
agcaggtgcctctctacctgggagc

SEQ ID NO: 328821 - DNA, 25 bp, Mus musculus
ggaccttccaggctccgacctcggc

SEQ ID NO: 328822 - DNA, 25 bp, Mus musculus
tccgcactcggggagagccactgtg

SEQ ID NO: 328823 - DNA, 25 bp, Mus musculus
aacggcgaccctgatccagggagtc

SEQ ID NO: 328824 - DNA, 25 bp, Mus musculus
ccgcctttacctcgcacagggtgaa

SEQ ID NO: 328825 - DNA, 25 bp, Mus musculus
ttacctcgcacagggtgaagagccc

SEQ ID NO: 328826 - DNA, 25 bp, Mus musculus
tgaagagcccgtaggccgccagcca

SEQ ID NO: 328827 - DNA, 25 bp, Mus musculus
agcacagcgacagccgagccgagct

SEQ ID NO: 328828 - DNA, 25 bp, Mus musculus
agctgaggccgaactcgcggcagta

SEQ ID NO: 328829 - DNA, 25 bp, Mus musculus
actcgcggcagtacggtgagtagta

SEQ ID NO: 328830 - DNA, 25 bp, Mus musculus
cgccgcagatatcggagaagctctt

SEQ ID NO: 328831 - DNA, 25 bp, Mus musculus
gagaagctcttctcgtcctccatgg

SEQ ID NO: 328832 - DNA, 25 bp, Mus musculus
tccatggccgcacacacctgaatgt

SEQ ID NO: 328833 - DNA, 25 bp, Mus musculus
acacctgaatgtcgcgccgctctag

SEQ ID NO: 328834 - DNA, 25 bp, Mus musculus
tagcccacccggaggctcgaagtct

SEQ ID NO: 328835 - DNA, 25 bp, Mus musculus
tcgaagtctcgttggctcccgacca

SEQ ID NO: 328836 - DNA, 25 bp, Mus musculus
ccggaagcggctgagccctgcctgt

SEQ ID NO: 328837 - DNA, 25 bp, Mus musculus
cctagagagtttcttggggccagga

SEQ ID NO: 328838 - DNA, 25 bp, Mus musculus
gtcctgacgagatccgtccactctg

SEQ ID NO: 328839 - DNA, 25 bp, Mus musculus
gggcaaattccttgcgtcctgacga

SEQ ID NO: 328840 - DNA, 25 bp, Mus musculus
atgttcctgaggagcagcgcctccc

SEQ ID NO: 328841 - DNA, 25 bp, Mus musculus
ctccctgccaatcatgttcctgagg

SEQ ID NO: 328842 - DNA, 25 bp, Mus musculus
ccactctgtagctatagtcggagcc

SEQ ID NO: 328843 - DNA, 25 bp, Mus musculus
acgggacactaagcctagagagttt

SEQ ID NO: 328844 - DNA, 25 bp, Mus musculus
tgcgacccgagctgacgggacacta

SEQ ID NO: 328845 - DNA, 25 bp, Mus musculus
gagttgcaccgagccggttctccta

SEQ ID NO: 328846 - DNA, 25 bp, Mus musculus
aggctgcactcactcgaggtcctga

SEQ ID NO: 328847 - DNA, 25 bp, Mus musculus
ctcgcctagtgaagcatcgaagctg

SEQ ID NO: 328848 - DNA, 25 bp, Mus musculus
ccgagagatgctgacgtcacagggc

SEQ ID NO: 328849 - DNA, 25 bp, Mus musculus
ctgtagtcctccgagaaggtgcgcc

SEQ ID NO: 328850 - DNA, 25 bp, Mus musculus
gccctggagagctgtagtcctccga

SEQ ID NO: 328851 - DNA, 25 bp, Mus musculus
ctgcttgtcactgcacgggcgccgg

SEQ ID NO: 328852 - DNA, 25 bp, Mus musculus
ttgtaagtcttcaaggaggccgcgg

SEQ ID NO: 328853 - DNA, 25 bp, Mus musculus
cgtgcagcttctcgaaatgctcgga

SEQ ID NO: 328854 - DNA, 25 bp, Mus musculus
gccgggcgccaaagcctgacaagaa

SEQ ID NO: 328855 - DNA, 25 bp, Mus musculus
tcggtgtttgggatcctgcaccctg

SEQ ID NO: 328856 - DNA, 25 bp, Mus musculus
cggggacgacactcagctactacag

SEQ ID NO: 328857 - DNA, 25 bp, Mus musculus
gccgcggaagatctcgtgcagcttc

SEQ ID NO: 328858 - DNA, 25 bp, Mus musculus
cactcagctactacaggggcgcggt

SEQ ID NO: 328859 - DNA, 25 bp, Mus musculus
ccggtggctccgacctggagacaaa

SEQ ID NO: 328860 - DNA, 25 bp, Mus musculus
cctggagacaaacagtgggcacaga

SEQ ID NO: 328861 - DNA, 25 bp, Mus musculus
gtcctgcagtgcatactgggaattg

SEQ ID NO: 328862 - DNA, 25 bp, Mus musculus
tgttgcgcagactggctagcacacg

SEQ ID NO: 328863 - DNA, 25 bp, Mus musculus
caaagcctgacaagaagccggggcg

SEQ ID NO: 328864 - DNA, 25 bp, Mus musculus
ggaatcaggcgcttccggggtcctc

SEQ ID NO: 328865 - DNA, 25 bp, Mus musculus
aagttgttgcagctagtggctttcg

SEQ ID NO: 328866 - DNA, 25 bp, Mus musculus
acaggcaagttcctacccgctggcg

SEQ ID NO: 328867 - DNA, 25 bp, Mus musculus
cgttcggtagaacgccagcccagtc

SEQ ID NO: 328868 - DNA, 25 bp, Mus musculus
ctggactcccacctgacgttcggta

SEQ ID NO: 328869 - DNA, 25 bp, Mus musculus
gtgccactacctaggccggtctgga

SEQ ID NO: 328870 - DNA, 25 bp, Mus musculus
gggcgcagtacagactccaccagca

SEQ ID NO: 328871 - DNA, 25 bp, Mus musculus
tggctttcgttttcgcaggcgcaca

SEQ ID NO: 328872 - DNA, 25 bp, Mus musculus
agcgccttctgctgcgaagttgttg

SEQ ID NO: 328873 - DNA, 25 bp, Mus musculus
ggcaccgcgcagcttttcgtcagcg

SEQ ID NO: 328874 - DNA, 25 bp, Mus musculus
ttttagctagggaagcaccgcgccc

SEQ ID NO: 328875 - DNA, 25 bp, Mus musculus
cttgcaaagcgctggcaccatcttc

SEQ ID NO: 328876 - DNA, 25 bp, Mus musculus
cctccgcctactcttgagtgctgag

SEQ ID NO: 328877 - DNA, 25 bp, Mus musculus
accgtcggcgacttcctctgtagaa

SEQ ID NO: 328878 - DNA, 25 bp, Mus musculus
ttccgagccggaccgcacttgcaaa

SEQ ID NO: 328879 - DNA, 25 bp, Mus musculus
ggacggtcagcggagaggtctcggc

SEQ ID NO: 328880 - DNA, 25 bp, Mus musculus
tcgcgtgagctcagggacggggccg

SEQ ID NO: 328881 - DNA, 25 bp, Mus musculus
gtcgcgtgagctcagggacggggcc

SEQ ID NO: 328882 - DNA, 25 bp, Mus musculus
cccgtacgggcaaaagccgatggtg

SEQ ID NO: 328883 - DNA, 25 bp, Mus musculus
cagcggagaggtctcggccccccgc

SEQ ID NO: 328884 - DNA, 25 bp, Mus musculus
tcagcggagaggtctcggccccccg

SEQ ID NO: 328885 - DNA, 25 bp, Mus musculus
gtcagcggagaggtctcggcccccc

SEQ ID NO: 328886 - DNA, 25 bp, Mus musculus
ggtcagcggagaggtctcggccccc

SEQ ID NO: 328887 - DNA, 25 bp, Mus musculus
cggtcagcggagaggtctcggcccc

SEQ ID NO: 328888 - DNA, 25 bp, Mus musculus
gacggtcagcggagaggtctcggcc

SEQ ID NO: 328889 - DNA, 25 bp, Mus musculus
gcggggacggtcagcggagaggtct

SEQ ID NO: 328890 - DNA, 25 bp, Mus musculus
aggcggggacggtcagcggagaggt

SEQ ID NO: 328891 - DNA, 25 bp, Mus musculus
cggggacggtcagcggagaggtctc

SEQ ID NO: 328892 - DNA, 25 bp, Mus musculus
acggtcagcggagaggtctcggccc

SEQ ID NO: 328893 - DNA, 25 bp, Mus musculus
tcggcgttatgaatgaagtggcagc

SEQ ID NO: 328894 - DNA, 25 bp, Mus musculus
aagagcggtctcgaaagcggctgtc

SEQ ID NO: 328895 - DNA, 25 bp, Mus musculus
agaaagagcggtctcgaaagcggct

SEQ ID NO: 328896 - DNA, 25 bp, Mus musculus
ctcccaggctgcttctgggtgggca

SEQ ID NO: 328897 - DNA, 25 bp, Mus musculus
gtcttgtagcggctggagttgacct

SEQ ID NO: 328898 - DNA, 25 bp, Mus musculus
cttacaggcaccgttttcttcgaag

SEQ ID NO: 328899 - DNA, 25 bp, Mus musculus
tacttacaggcaccgttttcttcga

SEQ ID NO: 328900 - DNA, 25 bp, Mus musculus
tcctcggcgttatgaatgaagtggc

SEQ ID NO: 328901 - DNA, 25 bp, Mus musculus
tggcagcggcactgggaaacccagc

SEQ ID NO: 328902 - DNA, 25 bp, Mus musculus
gcacttgtccccgtacttacaggca

SEQ ID NO: 328903 - DNA, 25 bp, Mus musculus
cgctcctcggcgttatgaatgaagt

SEQ ID NO: 328904 - DNA, 25 bp, Mus musculus
gcaaagctaaagctatgctggaggc

SEQ ID NO: 328905 - DNA, 25 bp, Mus musculus
gggaaacccagcaaagctaaagcta

SEQ ID NO: 328906 - DNA, 25 bp, Mus musculus
ctgggaaacccagcaaagctaaagc

SEQ ID NO: 328907 - DNA, 25 bp, Mus musculus
ggtcaggagtcccacacgcctgctc

SEQ ID NO: 328908 - DNA, 25 bp, Mus musculus
cgccctgctttaccttgcataaaac

SEQ ID NO: 328909 - DNA, 25 bp, Mus musculus
ccgccctgctttaccttgcataaaa

SEQ ID NO: 328910 - DNA, 25 bp, Mus musculus
tccgccctgctttaccttgcataaa

SEQ ID NO: 328911 - DNA, 25 bp, Mus musculus
aggagtcccacacgcctgctcccgg

SEQ ID NO: 328912 - DNA, 25 bp, Mus musculus
gccctgctttaccttgcataaaact

SEQ ID NO: 328913 - DNA, 25 bp, Mus musculus
ctctccggtcaggagtcccacacgc

SEQ ID NO: 328914 - DNA, 25 bp, Mus musculus
tgtcgtgaaggtcccggtgcgggga

SEQ ID NO: 328915 - DNA, 25 bp, Mus musculus
aggatctggtgtgtcgtgaaggtcc

SEQ ID NO: 328916 - DNA, 25 bp, Mus musculus
caaggactaggatctggtgtgtcgt

SEQ ID NO: 328917 - DNA, 25 bp, Mus musculus
tcgcacggggcaaggactaggatct

SEQ ID NO: 328918 - DNA, 25 bp, Mus musculus
ttcgcacggggcaaggactaggatc

SEQ ID NO: 328919 - DNA, 25 bp, Mus musculus
cacgagggtggtggtcatcgtgggc

SEQ ID NO: 328920 - DNA, 25 bp, Mus musculus
ccctgctttaccttgcataaaactt

SEQ ID NO: 328921 - DNA, 25 bp, Mus musculus
cgagtggctaccagcgagttccatt

SEQ ID NO: 328922 - DNA, 25 bp, Mus musculus
tacgagtacgtttctctggaaagga

SEQ ID NO: 328923 - DNA, 25 bp, Mus musculus
cccattacgagtacgtttctctgga

SEQ ID NO: 328924 - DNA, 25 bp, Mus musculus
ccattgcgatgtaattaggtcaccc

SEQ ID NO: 328925 - DNA, 25 bp, Mus musculus
agcgagttccattgcgatgtaatta

SEQ ID NO: 328926 - DNA, 25 bp, Mus musculus
gctaccagcgagttccattgcgatg

SEQ ID NO: 328927 - DNA, 25 bp, Mus musculus
acgtttctctggaaaggacggagcg

SEQ ID NO: 328928 - DNA, 25 bp, Mus musculus
ggtctgttatgaaacccggtgctcc

SEQ ID NO: 328929 - DNA, 25 bp, Mus musculus
gaggccgccgggtctgttatgaaac

SEQ ID NO: 328930 - DNA, 25 bp, Mus musculus
ttcccagcattcgaggccgccgggt

SEQ ID NO: 328931 - DNA, 25 bp, Mus musculus
gtttcttcccagcattcgaggccgc

SEQ ID NO: 328932 - DNA, 25 bp, Mus musculus
accgcccaggcctcgcacgtttctt

SEQ ID NO: 328933 - DNA, 25 bp, Mus musculus
acccggtgctccgagtggctaccag

SEQ ID NO: 328934 - DNA, 25 bp, Mus musculus
cgcacgtttcttcccagcattcgag

SEQ ID NO: 328935 - DNA, 25 bp, Mus musculus
caggcgacgcctcagagcgcctaga

SEQ ID NO: 328936 - DNA, 25 bp, Mus musculus
tgcgtccgccaaagccgagccgaag

SEQ ID NO: 328937 - DNA, 25 bp, Mus musculus
cccagacggcggaaccggtcaatgg

SEQ ID NO: 328938 - DNA, 25 bp, Mus musculus
tctaattgtcgggttgcgacgtcat

SEQ ID NO: 328939 - DNA, 25 bp, Mus musculus
gtcaatggcgccaggcgacgcctca

SEQ ID NO: 328940 - DNA, 25 bp, Mus musculus
gagccgaagcagtcgaccttgttga

SEQ ID NO: 328941 - DNA, 25 bp, Mus musculus
gagacgacggtgtgcgtccgccaaa

SEQ ID NO: 328942 - DNA, 25 bp, Mus musculus
gcgactcgggaaagtgaaagtcctc

SEQ ID NO: 328943 - DNA, 25 bp, Mus musculus
gcgcgtcctccgctacgcaggtatt

SEQ ID NO: 328944 - DNA, 25 bp, Mus musculus
gtccggagcttgcacaggccgccgt

SEQ ID NO: 328945 - DNA, 25 bp, Mus musculus
taggcctcccgagcgtccggagctt

SEQ ID NO: 328946 - DNA, 25 bp, Mus musculus
cgaagctcacgggactcaagcctag

SEQ ID NO: 328947 - DNA, 25 bp, Mus musculus
ttcgctaaccctgcgtccgggacag

SEQ ID NO: 328948 - DNA, 25 bp, Mus musculus
tgcgacgtcatttaggggactttcc

SEQ ID NO: 328949 - DNA, 25 bp, Mus musculus
cacgcccatggcattacggtttcca

SEQ ID NO: 328950 - DNA, 25 bp, Mus musculus
ctggagcctcgcgaaccttcgagac

SEQ ID NO: 328951 - DNA, 25 bp, Mus musculus
ttaagggcgccaagatggccggctt

SEQ ID NO: 328952 - DNA, 25 bp, Mus musculus
agatggccggcttgttttgctcgcc

SEQ ID NO: 328953 - DNA, 25 bp, Mus musculus
gttttgctcgccgaggcatcacgcg

SEQ ID NO: 328954 - DNA, 25 bp, Mus musculus
atcacgcggaggctgccctttgcct

SEQ ID NO: 328955 - DNA, 25 bp, Mus musculus
gcattacggtttccaaatcccaggc

SEQ ID NO: 328956 - DNA, 25 bp, Mus musculus
ttcggcatctcggagcgtctgtcgc

SEQ ID NO: 328957 - DNA, 25 bp, Mus musculus
tttcacgccgctcaagcagccgagg

SEQ ID NO: 328958 - DNA, 25 bp, Mus musculus
tcaagcagccgaggtcgttcgatgg

SEQ ID NO: 328959 - DNA, 25 bp, Mus musculus
atgggcgtggcaacactgccctcca

SEQ ID NO: 328960 - DNA, 25 bp, Mus musculus
cctccactggccagtgtgccgaatg

SEQ ID NO: 328961 - DNA, 25 bp, Mus musculus
cgtgccagggcctcgagttttcttc

SEQ ID NO: 328962 - DNA, 25 bp, Mus musculus
cactggccagtgtgccgaatggcac

SEQ ID NO: 328963 - DNA, 25 bp, Mus musculus
gataggacttccacgatgccggcgc

SEQ ID NO: 328964 - DNA, 25 bp, Mus musculus
agctgccgcagcagggtgttgaaca

SEQ ID NO: 328965 - DNA, 25 bp, Mus musculus
gcagcgataattgcagcttccgata

SEQ ID NO: 328966 - DNA, 25 bp, Mus musculus
cgtcgtagctcccagttagcgcgta

SEQ ID NO: 328967 - DNA, 25 bp, Mus musculus
tagcgcgtagtcgatgctgagccgc

SEQ ID NO: 328968 - DNA, 25 bp, Mus musculus
gcagcttccgataggacttccacga

SEQ ID NO: 328969 - DNA, 25 bp, Mus musculus
tgttgaacatctccagtaccgtggg

SEQ ID NO: 328970 - DNA, 25 bp, Mus musculus
atctccagtaccgtgggccctgggc

SEQ ID NO: 328971 - DNA, 25 bp, Mus musculus
ggggagggacccacaaatcatgaca

SEQ ID NO: 328972 - DNA, 25 bp, Mus musculus
ccacaaatcatgacaggaatccctc

SEQ ID NO: 328973 - DNA, 25 bp, Mus musculus
cgcgcagccaatcggctctaaatct

SEQ ID NO: 328974 - DNA, 25 bp, Mus musculus
gctctaaatctaacgcctgcacaca

SEQ ID NO: 328975 - DNA, 25 bp, Mus musculus
gagcccgtggcagcgataattgcag

SEQ ID NO: 328976 - DNA, 25 bp, Mus musculus
cccagttagcgcgtagtcgatgctg

SEQ ID NO: 328977 - DNA, 25 bp, Mus musculus
tagtgtggccgcagcgctcctggcc

SEQ ID NO: 328978 - DNA, 25 bp, Mus musculus
caccgatggccagctggtcgttaag

SEQ ID NO: 328979 - DNA, 25 bp, Mus musculus
gtcgttaaggagctggaccttgcct

SEQ ID NO: 328980 - DNA, 25 bp, Mus musculus
atagcactccggaacctgtgcgcta

SEQ ID NO: 328981 - DNA, 25 bp, Mus musculus
aacctgtgcgctaggcccagtgcac

SEQ ID NO: 328982 - DNA, 25 bp, Mus musculus
gcccggaaggttatggcagtggcta

SEQ ID NO: 328983 - DNA, 25 bp, Mus musculus
tcatcatgggatgtcgggaccgcgc

SEQ ID NO: 328984 - DNA, 25 bp, Mus musculus
ttctctgggccaagaaaccagcggc

SEQ ID NO: 328985 - DNA, 25 bp, Mus musculus
gctcaggcaggagctctgtcaggct

SEQ ID NO: 328986 - DNA, 25 bp, Mus musculus
cccagagtccttcgcgtgtaggtgg

SEQ ID NO: 328987 - DNA, 25 bp, Mus musculus
atcaccggagcaaacagcggcctgg

SEQ ID NO: 328988 - DNA, 25 bp, Mus musculus
agacagtgctgatcaccggagcaaa

SEQ ID NO: 328989 - DNA, 25 bp, Mus musculus
catgcacgggaagacagtgctgatc

SEQ ID NO: 328990 - DNA, 25 bp, Mus musculus
gacccgggcctcatgcacgggaaga

SEQ ID NO: 328991 - DNA, 25 bp, Mus musculus
aaccattaatgcagcagcgtcttca

SEQ ID NO: 328992 - DNA, 25 bp, Mus musculus
cacttcggaagagcagagacggatt

SEQ ID NO: 328993 - DNA, 25 bp, Mus musculus
agagacggattcgtactgtaccttc

SEQ ID NO: 328994 - DNA, 25 bp, Mus musculus
agcaccttgcgattactgggatgcg

SEQ ID NO: 328995 - DNA, 25 bp, Mus musculus
ctcgggtaaaaaccattaatgcagc

SEQ ID NO: 328996 - DNA, 25 bp, Mus musculus
cagcagcgtcttcatagagctaggc

SEQ ID NO: 328997 - DNA, 25 bp, Mus musculus
gcgtcttcatagagctaggctgagc

SEQ ID NO: 328998 - DNA, 25 bp, Mus musculus
gcctacctgtttccggtgcgatttg

SEQ ID NO: 328999 - DNA, 25 bp, Mus musculus
tttccggtgcgatttgtcctgaact

SEQ ID NO: 329000 - DNA, 25 bp, Mus musculus
tgtcctgaactcacgattgttcctc

SEQ ID NO: 329001 - DNA, 25 bp, Mus musculus
tgaactcacgattgttcctcccatc

SEQ ID NO: 329002 - DNA, 25 bp, Mus musculus
tcctccgagcaccttgcgattactg

SEQ ID NO: 329003 - DNA, 25 bp, Mus musculus
tctctacgcctacctgtttccggtg

SEQ ID NO: 329004 - DNA, 25 bp, Mus musculus
gcatccgaccctttcctctcgggta

SEQ ID NO: 329005 - DNA, 25 bp, Mus musculus
ccgcaactattaggtcgtaaacttg

SEQ ID NO: 329006 - DNA, 25 bp, Mus musculus
ggggccattcttgcgatgcagtact

SEQ ID NO: 329007 - DNA, 25 bp, Mus musculus
cgatgcagtactcggcttggtcagg

SEQ ID NO: 329008 - DNA, 25 bp, Mus musculus
cctctgtgatgtaattctgcggaga

SEQ ID NO: 329009 - DNA, 25 bp, Mus musculus
attctgcggagaaagcatggtcagg

SEQ ID NO: 329010 - DNA, 25 bp, Mus musculus
agcatggtcagggtcggaaacctcg

SEQ ID NO: 329011 - DNA, 25 bp, Mus musculus
cgctctcgccatacagtgccgtgga

SEQ ID NO: 329012 - DNA, 25 bp, Mus musculus
gaaacctcggcagcggccggaaagc

SEQ ID NO: 329013 - DNA, 25 bp, Mus musculus
caacgcggcgttgccgcaactatta

SEQ ID NO: 329014 - DNA, 25 bp, Mus musculus
cccgtgttctaatttcctcgctcta

SEQ ID NO: 329015 - DNA, 25 bp, Mus musculus
atttcctcgctctacttgatctgta

SEQ ID NO: 329016 - DNA, 25 bp, Mus musculus
ctacttgatctgtagaatacgtgcg

SEQ ID NO: 329017 - DNA, 25 bp, Mus musculus
tgtagtctaaagcaccgggcacgga

SEQ ID NO: 329018 - DNA, 25 bp, Mus musculus
gccgtggagaaggacatgtagtcta

SEQ ID NO: 329019 - DNA, 25 bp, Mus musculus
atcgatcccgagtaagcagccatgg

SEQ ID NO: 329020 - DNA, 25 bp, Mus musculus
tgcgcgccgggaattggtttccaac

SEQ ID NO: 329021 - DNA, 25 bp, Mus musculus
cccagtcctcttcaggctgcatgta

SEQ ID NO: 329022 - DNA, 25 bp, Mus musculus
tggtctgctgggaatcataatggtc

SEQ ID NO: 329023 - DNA, 25 bp, Mus musculus
cgggtctctgtgcatataggtggac

SEQ ID NO: 329024 - DNA, 25 bp, Mus musculus
tgcgtgctaggagctggatttcttc

SEQ ID NO: 329025 - DNA, 25 bp, Mus musculus
atccaggagcaggtcccgatcccag

SEQ ID NO: 329026 - DNA, 25 bp, Mus musculus
ctcccgaggttctccattggccagg

SEQ ID NO: 329027 - DNA, 25 bp, Mus musculus
ctcagtgaacactcgcgctgcggga

SEQ ID NO: 329028 - DNA, 25 bp, Mus musculus
ttggccaggccgagttgcccaaact

SEQ ID NO: 329029 - DNA, 25 bp, Mus musculus
gtggctgctaaccttcctctgctgc

SEQ ID NO: 329030 - DNA, 25 bp, Mus musculus
agcgcctctcattgggaattcctgg

SEQ ID NO: 329031 - DNA, 25 bp, Mus musculus
ggaccacccgctctgaggcgatttg

SEQ ID NO: 329032 - DNA, 25 bp, Mus musculus
agcagccatggagcctaagtctcag

SEQ ID NO: 329033 - DNA, 25 bp, Mus musculus
gtgtcagccttatcagccaatcgga

SEQ ID NO: 329034 - DNA, 25 bp, Mus musculus
tcctgcgcgcgacaaaccaacaagg

SEQ ID NO: 329035 - DNA, 25 bp, Mus musculus
gacccacgggttcgctgtgcgctgt

SEQ ID NO: 329036 - DNA, 25 bp, Mus musculus
ctgtgcgctgtgtctttgactcgcg

SEQ ID NO: 329037 - DNA, 25 bp, Mus musculus
tcagccaatcggagtaggctgtttg

SEQ ID NO: 329038 - DNA, 25 bp, Mus musculus
caaggaacgctctcattggctgaag

SEQ ID NO: 329039 - DNA, 25 bp, Mus musculus
gggcaacggccggagctcccagact

SEQ ID NO: 329040 - DNA, 25 bp, Mus musculus
aactcgaccggcgtctccagggcaa

SEQ ID NO: 329041 - DNA, 25 bp, Mus musculus
gagccgtgcgcacacttagcagaca

SEQ ID NO: 329042 - DNA, 25 bp, Mus musculus
gggtcttctcgcgtggttccacctc

SEQ ID NO: 329043 - DNA, 25 bp, Mus musculus
tgccttcgggtctcgagcctggctt

SEQ ID NO: 329044 - DNA, 25 bp, Mus musculus
aagaagccagcgtgggcagaagacc

SEQ ID NO: 329045 - DNA, 25 bp, Mus musculus
tgcggtcactgtgacccaccctagg

SEQ ID NO: 329046 - DNA, 25 bp, Mus musculus
cattggctgaagtgtcagccttatc

SEQ ID NO: 329047 - DNA, 25 bp, Mus musculus
ttgtcctggtaacgcctcagagcag

SEQ ID NO: 329048 - DNA, 25 bp, Mus musculus
atagtgctctcgctgaggtcgctgt

SEQ ID NO: 329049 - DNA, 25 bp, Mus musculus
cgtgcagctggaggatagtgctctc

SEQ ID NO: 329050 - DNA, 25 bp, Mus musculus
agtgtagcctgagcgctcactgacc

SEQ ID NO: 329051 - DNA, 25 bp, Mus musculus
gaagattccgagtcagtgtagcctg

SEQ ID NO: 329052 - DNA, 25 bp, Mus musculus
gcagtgaggctgaagattccgagtc

SEQ ID NO: 329053 - DNA, 25 bp, Mus musculus
cgcagactcgtctactgtgggaggt

SEQ ID NO: 329054 - DNA, 25 bp, Mus musculus
aggcgttgtccgcagactcgtctac

SEQ ID NO: 329055 - DNA, 25 bp, Mus musculus
actgcatttgtggtagtgacgcgca

SEQ ID NO: 329056 - DNA, 25 bp, Mus musculus
tgctggggttgacgccactgcattt

SEQ ID NO: 329057 - DNA, 25 bp, Mus musculus
catcctcacatgttggcgttgctgg

SEQ ID NO: 329058 - DNA, 25 bp, Mus musculus
ctgctgccgagaggacgcatcctca

SEQ ID NO: 329059 - DNA, 25 bp, Mus musculus
tcgctgtccgagtctgagctccagc

SEQ ID NO: 329060 - DNA, 25 bp, Mus musculus
ctcagagcagacaggcgctgctgcc

SEQ ID NO: 329061 - DNA, 25 bp, Mus musculus
gaacgcccgatctggtctaggccct

SEQ ID NO: 329062 - DNA, 25 bp, Mus musculus
aggcccttcacagcgcagccgggtt

SEQ ID NO: 329063 - DNA, 25 bp, Mus musculus
cccggagcaataggctatcgattca

SEQ ID NO: 329064 - DNA, 25 bp, Mus musculus
aggctatcgattcagctgcctgtcg

SEQ ID NO: 329065 - DNA, 25 bp, Mus musculus
agagagcaaggcctacaccgcccgg

SEQ ID NO: 329066 - DNA, 25 bp, Mus musculus
gaggggacgcctctctgctacccgt

SEQ ID NO: 329067 - DNA, 25 bp, Mus musculus
tcccgaacagcgcatccaagttcag

SEQ ID NO: 329068 - DNA, 25 bp, Mus musculus
ggcgagcagccctgcaacaggagcc

SEQ ID NO: 329069 - DNA, 25 bp, Mus musculus
gtgtccctaggtcgctagagccctc

SEQ ID NO: 329070 - DNA, 25 bp, Mus musculus
tcgccactctcggaaccataataaa

SEQ ID NO: 329071 - DNA, 25 bp, Mus musculus
gctgaagaggctaccactgcgtgct

SEQ ID NO: 329072 - DNA, 25 bp, Mus musculus
tggaggcaagtaggcccagctgaac

SEQ ID NO: 329073 - DNA, 25 bp, Mus musculus
aagttcaggctggttggtgtcccta

SEQ ID NO: 329074 - DNA, 25 bp, Mus musculus
acaccgaggactggggctcgagctt

SEQ ID NO: 329075 - DNA, 25 bp, Mus musculus
cagcgagccggaggcttctttaacc

SEQ ID NO: 329076 - DNA, 25 bp, Mus musculus
aacaatcagagtggcagccggcctg

SEQ ID NO: 329077 - DNA, 25 bp, Mus musculus
ttggacacgcgtaacaatcagagtg

SEQ ID NO: 329078 - DNA, 25 bp, Mus musculus
ctgaagttggacacgcgtaacaatc

SEQ ID NO: 329079 - DNA, 25 bp, Mus musculus
cgcactctgaagttggacacgcgta

SEQ ID NO: 329080 - DNA, 25 bp, Mus musculus
gcacgccgcactctgaagttggaca

SEQ ID NO: 329081 - DNA, 25 bp, Mus musculus
gccgaaccacggttggctcaggatg

SEQ ID NO: 329082 - DNA, 25 bp, Mus musculus
tgaccgcgccgaaccacggttggct

SEQ ID NO: 329083 - DNA, 25 bp, Mus musculus
ggcgttcgcggcttcctcacggtcg

SEQ ID NO: 329084 - DNA, 25 bp, Mus musculus
ttaaccagccatggcagacggagcg

SEQ ID NO: 329085 - DNA, 25 bp, Mus musculus
agccggaggcttctttaaccagcca

SEQ ID NO: 329086 - DNA, 25 bp, Mus musculus
acgcgtaacaatcagagtggcagcc

SEQ ID NO: 329087 - DNA, 25 bp, Mus musculus
tccttccctggagggacagcggctc

SEQ ID NO: 329088 - DNA, 25 bp, Mus musculus
ggcttctttaaccagccatggcaga

SEQ ID NO: 329089 - DNA, 25 bp, Mus musculus
cctcactctcggtgtgggcggttga

SEQ ID NO: 329090 - DNA, 25 bp, Mus musculus
gggaggactcgtcccgccattggtc

SEQ ID NO: 329091 - DNA, 25 bp, Mus musculus
aggagcatccaccaacccttcaagg

SEQ ID NO: 329092 - DNA, 25 bp, Mus musculus
aacccttcaaggctttctgacctcg

SEQ ID NO: 329093 - DNA, 25 bp, Mus musculus
ctgacctcgtcagttaaaaagcagc

SEQ ID NO: 329094 - DNA, 25 bp, Mus musculus
accactttgcgcgtgggcgactgtt

SEQ ID NO: 329095 - DNA, 25 bp, Mus musculus
aatggcgcggcccataggcacacac

SEQ ID NO: 329096 - DNA, 25 bp, Mus musculus
ggtgatgctgaagggaccactttgc

SEQ ID NO: 329097 - DNA, 25 bp, Mus musculus
aaagtcctctctggggttgtgtggc

SEQ ID NO: 329098 - DNA, 25 bp, Mus musculus
tacggcttttatgcatccgggtggg

SEQ ID NO: 329099 - DNA, 25 bp, Mus musculus
cggaagtggctacggcttttatgca

SEQ ID NO: 329100 - DNA, 25 bp, Mus musculus
gttgtatcctcctggccagccactg

SEQ ID NO: 329101 - DNA, 25 bp, Mus musculus
gtgcccaggcgttgttggcactgcc

SEQ ID NO: 329102 - DNA, 25 bp, Mus musculus
ctcgggttggcaaagtcctctctgg

SEQ ID NO: 329103 - DNA, 25 bp, Mus musculus
ttatggcaggacaaccgagcccatg

SEQ ID NO: 329104 - DNA, 25 bp, Mus musculus
gtccgcccaccatgaggaagatccg

SEQ ID NO: 329105 - DNA, 25 bp, Mus musculus
cggcgcaagcgacaacaaacggctg

SEQ ID NO: 329106 - DNA, 25 bp, Mus musculus
attaggaccgtgaggatcgctctgc

SEQ ID NO: 329107 - DNA, 25 bp, Mus musculus
gaccagctctggttcatcgccattc

SEQ ID NO: 329108 - DNA, 25 bp, Mus musculus
ttgttatggcaacctgtgcggggcc

SEQ ID NO: 329109 - DNA, 25 bp, Mus musculus
attggagaattcctgctcgttgtta

SEQ ID NO: 329110 - DNA, 25 bp, Mus musculus
ccgagcaccgttcgggctttgtata

SEQ ID NO: 329111 - DNA, 25 bp, Mus musculus
ccgtagcctggatcctgggcacttt

SEQ ID NO: 329112 - DNA, 25 bp, Mus musculus
gaggaccgcaccattccgctcattg

SEQ ID NO: 329113 - DNA, 25 bp, Mus musculus
aatgccatcgccatcctgaccgtag

SEQ ID NO: 329114 - DNA, 25 bp, Mus musculus
ctgggcactttctactacttatggc

SEQ ID NO: 329115 - DNA, 25 bp, Mus musculus
aaagtgctgcaagtttggtgggccc

SEQ ID NO: 329116 - DNA, 25 bp, Mus musculus
gctcattgtgagtacgctctgcgca

SEQ ID NO: 329117 - DNA, 25 bp, Mus musculus
agctcagccgcaacgccgccaacag

SEQ ID NO: 329118 - DNA, 25 bp, Mus musculus
gacgggtgtgtcagtttcaggaaac

SEQ ID NO: 329119 - DNA, 25 bp, Mus musculus
cgccggaagtcgtcgaaagcgcgac

SEQ ID NO: 329120 - DNA, 25 bp, Mus musculus
gctaacacctctgctgccgcacacg

SEQ ID NO: 329121 - DNA, 25 bp, Mus musculus
taaggactcaccatcgcgccaaacg

SEQ ID NO: 329122 - DNA, 25 bp, Mus musculus
ggcaaccgctaaggactcaccatcg

SEQ ID NO: 329123 - DNA, 25 bp, Mus musculus
atgtaccgagcaggggtggccctct

SEQ ID NO: 329124 - DNA, 25 bp, Mus musculus
ccctcgctcgcgctagaagggcagg

SEQ ID NO: 329125 - DNA, 25 bp, Mus musculus
ctcttccaggcagcgatcggcaggg

SEQ ID NO: 329126 - DNA, 25 bp, Mus musculus
atctgatgagaaatgaacggcaccc

SEQ ID NO: 329127 - DNA, 25 bp, Mus musculus
cagtcggctagtgcatctgatgaga

SEQ ID NO: 329128 - DNA, 25 bp, Mus musculus
cggccattgttcctacagtcggcta

SEQ ID NO: 329129 - DNA, 25 bp, Mus musculus
cagtttcaggaaacgtctaacacgt

SEQ ID NO: 329130 - DNA, 25 bp, Mus musculus
agggagggcatcgtctgcccaccgc

SEQ ID NO: 329131 - DNA, 25 bp, Mus musculus
ggccagggcacagtcttcgagatac

SEQ ID NO: 329132 - DNA, 25 bp, Mus musculus
ctggacatcagcaccaaagtgcagc

SEQ ID NO: 329133 - DNA, 25 bp, Mus musculus
aagtgcagctctacggggttctgtg

SEQ ID NO: 329134 - DNA, 25 bp, Mus musculus
acgcggacgcgctggacatcagcac

SEQ ID NO: 329135 - DNA, 25 bp, Mus musculus
atcgccgtccctggagcaggcggac

SEQ ID NO: 329136 - DNA, 25 bp, Mus musculus
gttcacatccaagtccaactccgtg

SEQ ID NO: 329137 - DNA, 25 bp, Mus musculus
tcttcgagatacgatgttcacatcc

SEQ ID NO: 329138 - DNA, 25 bp, Mus musculus
ccttccagtcccacgaagggagtgg

SEQ ID NO: 329139 - DNA, 25 bp, Mus musculus
cccagccgctggctaagcttcccgc

SEQ ID NO: 329140 - DNA, 25 bp, Mus musculus
cggccaacagcgctctggagcttcg

SEQ ID NO: 329141 - DNA, 25 bp, Mus musculus
cgcggagttccctcccggccaacag

SEQ ID NO: 329142 - DNA, 25 bp, Mus musculus
gccgttcgggagatcctcggccaag

SEQ ID NO: 329143 - DNA, 25 bp, Mus musculus
agatcctcggccaagtggtcccggc

SEQ ID NO: 329144 - DNA, 25 bp, Mus musculus
agctctacggggttctgtggaaacg

SEQ ID NO: 329145 - DNA, 25 bp, Mus musculus
cgcatggagaagtgtcacgggcgcg

SEQ ID NO: 329146 - DNA, 25 bp, Mus musculus
ctcccgccgcctggcgtgcagctct

SEQ ID NO: 329147 - DNA, 25 bp, Mus musculus
gagacccgatcaggtacctgcagga

SEQ ID NO: 329148 - DNA, 25 bp, Mus musculus
cgcacggaccgccgcaaactgaggg

SEQ ID NO: 329149 - DNA, 25 bp, Mus musculus
ggcgtgcagctctccgccagggttc

SEQ ID NO: 329150 - DNA, 25 bp, Mus musculus
agtcaacgccctgctgctctctgct

SEQ ID NO: 329151 - DNA, 25 bp, Mus musculus
agtctctcagtcaacgccctgctgc

SEQ ID NO: 329152 - DNA, 25 bp, Mus musculus
gcggggccagtctctcagtcaacgc

SEQ ID NO: 329153 - DNA, 25 bp, Mus musculus
ggctagcccgcacgggtcgccgagt

SEQ ID NO: 329154 - DNA, 25 bp, Mus musculus
cgccgcctgtccgtgctgcagggat

SEQ ID NO: 329155 - DNA, 25 bp, Mus musculus
acctgcaggagtcgggagtcttggc

SEQ ID NO: 329156 - DNA, 25 bp, Mus musculus
cccgatcaggtacctgcaggagtcg

SEQ ID NO: 329157 - DNA, 25 bp, Mus musculus
gtggagacccgatcaggtacctgca

SEQ ID NO: 329158 - DNA, 25 bp, Mus musculus
cgctcgcgcacggaccgccgcaaac

SEQ ID NO: 329159 - DNA, 25 bp, Mus musculus
agttggccctcttgccgctctcggg

SEQ ID NO: 329160 - DNA, 25 bp, Mus musculus
caacaggcgctcttcctggtgccgg

SEQ ID NO: 329161 - DNA, 25 bp, Mus musculus
tcggcctctaagcagcgcctcgtgg

SEQ ID NO: 329162 - DNA, 25 bp, Mus musculus
tgcttcaggttctgctcctgctgca

SEQ ID NO: 329163 - DNA, 25 bp, Mus musculus
gcagctgttcctggcggaagctcga

SEQ ID NO: 329164 - DNA, 25 bp, Mus musculus
tcctgctgcagcttgcgcagccggt

SEQ ID NO: 329165 - DNA, 25 bp, Mus musculus
atgcgctccacatgctgggctgtct

SEQ ID NO: 329166 - DNA, 25 bp, Mus musculus
tcgaggtggccagcgaagctcccga

SEQ ID NO: 329167 - DNA, 25 bp, Mus musculus
ccggactcggagctcagggcaccgt

SEQ ID NO: 329168 - DNA, 25 bp, Mus musculus
cgagtccagcgagtggctctttcta

SEQ ID NO: 329169 - DNA, 25 bp, Mus musculus
ctttctacctgtccgagaaccggcg

SEQ ID NO: 329170 - DNA, 25 bp, Mus musculus
ggagaagtccttcgagcaactcgcg

SEQ ID NO: 329171 - DNA, 25 bp, Mus musculus
cgcacttggcggacgatgcgctcca

SEQ ID NO: 329172 - DNA, 25 bp, Mus musculus
ctcaggtctccgaggctgaagctgc

SEQ ID NO: 329173 - DNA, 25 bp, Mus musculus
tgggagcacacatcccagacgctac

SEQ ID NO: 329174 - DNA, 25 bp, Mus musculus
agactacgaactgggagcacacatc

SEQ ID NO: 329175 - DNA, 25 bp, Mus musculus
ctctccatgggagactacgaactgg

SEQ ID NO: 329176 - DNA, 25 bp, Mus musculus
gccagcgtctctccatgggagacta

SEQ ID NO: 329177 - DNA, 25 bp, Mus musculus
agcagccagcgtctctccatgggag

SEQ ID NO: 329178 - DNA, 25 bp, Mus musculus
tcgggttactgccggctgcagcagc

SEQ ID NO: 329179 - DNA, 25 bp, Mus musculus
gcgcctcttcagtccctgcgccggc

SEQ ID NO: 329180 - DNA, 25 bp, Mus musculus
gcttttgttcgcctctcgctgctct

SEQ ID NO: 329181 - DNA, 25 bp, Mus musculus
ctaggtctccgagcgggttcactta

SEQ ID NO: 329182 - DNA, 25 bp, Mus musculus
taaaccctgccgctccattctggga

SEQ ID NO: 329183 - DNA, 25 bp, Mus musculus
tgggctcttagagcgccgtaaaccc

SEQ ID NO: 329184 - DNA, 25 bp, Mus musculus
caccgcatctcaggggagtgggctc

SEQ ID NO: 329185 - DNA, 25 bp, Mus musculus
agggcttttgttcgcctctcgctgc

SEQ ID NO: 329186 - DNA, 25 bp, Mus musculus
catctcaggggagtgggctcttaga

SEQ ID NO: 329187 - DNA, 25 bp, Mus musculus
ctgctcacgcgagcaacgggcgtga

SEQ ID NO: 329188 - DNA, 25 bp, Mus musculus
tgggcgtccgagagttaccctcggc

SEQ ID NO: 329189 - DNA, 25 bp, Mus musculus
catacctaccaccagggtgggcgtc

SEQ ID NO: 329190 - DNA, 25 bp, Mus musculus
agagtcagcggcctgttggttgcct

SEQ ID NO: 329191 - DNA, 25 bp, Mus musculus
tgctgggaatcctacactgcaggga

SEQ ID NO: 329192 - DNA, 25 bp, Mus musculus
cgtcacacagccgtacctcagtgaa

SEQ ID NO: 329193 - DNA, 25 bp, Mus musculus
tcctccgagagtccgctgcgcaaag

SEQ ID NO: 329194 - DNA, 25 bp, Mus musculus
gttgccttggcaactgctcacgcga

SEQ ID NO: 329195 - DNA, 25 bp, Mus musculus
acaagaattttggacagccgctctc

SEQ ID NO: 329196 - DNA, 25 bp, Mus musculus
cacgaaaccagctacaagaattttg

SEQ ID NO: 329197 - DNA, 25 bp, Mus musculus
gcgcaaacgcaaaccacgaaaccag

SEQ ID NO: 329198 - DNA, 25 bp, Mus musculus
gtacctcagtgaacagcgcaaacgc

SEQ ID NO: 329199 - DNA, 25 bp, Mus musculus
ttggacagccgctctcctctgaacg

SEQ ID NO: 329200 - DNA, 25 bp, Mus musculus
gtccgctgcgcaaagcatgctggga

SEQ ID NO: 329201 - DNA, 25 bp, Mus musculus
cgcttgttgcgtgcgtgcctgaccc

SEQ ID NO: 329202 - DNA, 25 bp, Mus musculus
ctgaggaaaccttgcagccgctcgc

SEQ ID NO: 329203 - DNA, 25 bp, Mus musculus
tttcctgaggaaaccttgcagccgc

SEQ ID NO: 329204 - DNA, 25 bp, Mus musculus
gcggaggccctccagtccagcgaag

SEQ ID NO: 329205 - DNA, 25 bp, Mus musculus
cgctgcaaggcggaggccctccagt

SEQ ID NO: 329206 - DNA, 25 bp, Mus musculus
cgggcaagcacttcctcagggacgc

SEQ ID NO: 329207 - DNA, 25 bp, Mus musculus
tgtcagacaaggtcagaggcgcgtg

SEQ ID NO: 329208 - DNA, 25 bp, Mus musculus
gcactggcgggcaagcacttcctca

SEQ ID NO: 329209 - DNA, 25 bp, Mus musculus
gccgctcccgggtgagttgtcaccg

SEQ ID NO: 329210 - DNA, 25 bp, Mus musculus
gcgttccatcctcaggagccggcca

SEQ ID NO: 329211 - DNA, 25 bp, Mus musculus
cgtcgtacagctgggccagtgacgc

SEQ ID NO: 329212 - DNA, 25 bp, Mus musculus
gcccgcgtcgtacagctgggccagt

SEQ ID NO: 329213 - DNA, 25 bp, Mus musculus
cgacgcctgcgcttgttgcgtgcgt

SEQ ID NO: 329214 - DNA, 25 bp, Mus musculus
acttcctcagggacgcgggccttct

SEQ ID NO: 329215 - DNA, 25 bp, Mus musculus
ggcacgctttgagggcaaggcttct

SEQ ID NO: 329216 - DNA, 25 bp, Mus musculus
tgccgcccttaatggctctcatcga

SEQ ID NO: 329217 - DNA, 25 bp, Mus musculus
ggcctggccttaactgcggcagatg

SEQ ID NO: 329218 - DNA, 25 bp, Mus musculus
ctgctattggaccaggcctggcaga

SEQ ID NO: 329219 - DNA, 25 bp, Mus musculus
cgccattttgtgctgcgaacgcgcc

SEQ ID NO: 329220 - DNA, 25 bp, Mus musculus
ggcttctcggatcgaggcttcttca

SEQ ID NO: 329221 - DNA, 25 bp, Mus musculus
agccgccaaagaccctgtccggtag

SEQ ID NO: 329222 - DNA, 25 bp, Mus musculus
gactacggacctctccggggtctca

SEQ ID NO: 329223 - DNA, 25 bp, Mus musculus
aggcagacagctccgtcgcagacta

SEQ ID NO: 329224 - DNA, 25 bp, Mus musculus
tccgagctgctaagtgcgtcagttg

SEQ ID NO: 329225 - DNA, 25 bp, Mus musculus
tccattttgtgcaacgtccgagctg

SEQ ID NO: 329226 - DNA, 25 bp, Mus musculus
acgccaggacgtcccttccattttg

SEQ ID NO: 329227 - DNA, 25 bp, Mus musculus
ctactagaacttccggctcccagga

SEQ ID NO: 329228 - DNA, 25 bp, Mus musculus
gcgactcagagagcgcagttgattt

SEQ ID NO: 329229 - DNA, 25 bp, Mus musculus
ctgctcgtgttggtgcagctgtccc

SEQ ID NO: 329230 - DNA, 25 bp, Mus musculus
gtaagtgcgtctcccagctgcgcgc

SEQ ID NO: 329231 - DNA, 25 bp, Mus musculus
ggtcggctgctacaggcctctcgac

SEQ ID NO: 329232 - DNA, 25 bp, Mus musculus
acacgctcgcactccagctccgggc

SEQ ID NO: 329233 - DNA, 25 bp, Mus musculus
tcgacccgtcagtcagcctctccgg

SEQ ID NO: 329234 - DNA, 25 bp, Mus musculus
acgggaattcccatggcccgagctc

SEQ ID NO: 329235 - DNA, 25 bp, Mus musculus
agctcccgcatccaacctgctgtcg

SEQ ID NO: 329236 - DNA, 25 bp, Mus musculus
cagggtaagtgcgtctcccagctgc

SEQ ID NO: 329237 - DNA, 25 bp, Mus musculus
cagcaggcgccacgcgcagagcaca

SEQ ID NO: 329238 - DNA, 25 bp, Mus musculus
tataacgggaattcccatggcccga

SEQ ID NO: 329239 - DNA, 25 bp, Mus musculus
gggcctccgccgttcatgaccgtga

SEQ ID NO: 329240 - DNA, 25 bp, Mus musculus
ggccactcccagctgctgcaagggt

SEQ ID NO: 329241 - DNA, 25 bp, Mus musculus
cccaagtgctttgaagctagcctga

SEQ ID NO: 329242 - DNA, 25 bp, Mus musculus
cccacttgctgctcgtgttggtgca

SEQ ID NO: 329243 - DNA, 25 bp, Mus musculus
cgtccagggcatggcagtccgccgc

SEQ ID NO: 329244 - DNA, 25 bp, Mus musculus
ggctaccaggcagcgcatctggagc

SEQ ID NO: 329245 - DNA, 25 bp, Mus musculus
ctaggaaggtgcacgatgcccgcgc

SEQ ID NO: 329246 - DNA, 25 bp, Mus musculus
atctggagcaggatcgctggggcca

SEQ ID NO: 329247 - DNA, 25 bp, Mus musculus
cgcagggagcgttgtacagaccctc

SEQ ID NO: 329248 - DNA, 25 bp, Mus musculus
cccagctcctcacgggccgcagcgg

SEQ ID NO: 329249 - DNA, 25 bp, Mus musculus
gcgttgtacagaccctcggcggcgt

SEQ ID NO: 329250 - DNA, 25 bp, Mus musculus
ctagcagctgtcagggggctaccag

SEQ ID NO: 329251 - DNA, 25 bp, Mus musculus
tccagccaaggagcagagactgccc

SEQ ID NO: 329252 - DNA, 25 bp, Mus musculus
gagactgcccgagtggcccaagcaa

SEQ ID NO: 329253 - DNA, 25 bp, Mus musculus
agtggcccaagcaaggcccggagtc

SEQ ID NO: 329254 - DNA, 25 bp, Mus musculus
actgtcaccaccggagacgtctcgg

SEQ ID NO: 329255 - DNA, 25 bp, Mus musculus
cggcgtccagccaaggagcagagac

SEQ ID NO: 329256 - DNA, 25 bp, Mus musculus
gcggctcagccttgcccactgtcac

SEQ ID NO: 329257 - DNA, 25 bp, Mus musculus
cccgaggtacacttttgagcgtgaa

SEQ ID NO: 329258 - DNA, 25 bp, Mus musculus
cctagtcagcagtatccgaaagaca

SEQ ID NO: 329259 - DNA, 25 bp, Mus musculus
gtcacagccgctcaccaacatggga

SEQ ID NO: 329260 - DNA, 25 bp, Mus musculus
catgggaactccatagcgtagagtc

SEQ ID NO: 329261 - DNA, 25 bp, Mus musculus
gtcttgttcttacgcagagctcgca

SEQ ID NO: 329262 - DNA, 25 bp, Mus musculus
acacagcgggcgcaatcatggcaga

SEQ ID NO: 329263 - DNA, 25 bp, Mus musculus
gctctggttccgtgacctcaggata

SEQ ID NO: 329264 - DNA, 25 bp, Mus musculus
gcctgcttagtcagccgcttccaga

SEQ ID NO: 329265 - DNA, 25 bp, Mus musculus
cccgcaacacgtctcaggcgaagtt

SEQ ID NO: 329266 - DNA, 25 bp, Mus musculus
agttgtagactcagcgcaggctttg

SEQ ID NO: 329267 - DNA, 25 bp, Mus musculus
ggtgccaggtccacgcctgataagc

SEQ ID NO: 329268 - DNA, 25 bp, Mus musculus
acgattggccttaacgcacttctgc

SEQ ID NO: 329269 - DNA, 25 bp, Mus musculus
cccggaagtcgaggcttctgagctc

SEQ ID NO: 329270 - DNA, 25 bp, Mus musculus
cggggatagtaacacgcgcgttcac

SEQ ID NO: 329271 - DNA, 25 bp, Mus musculus
tgcccgatagcgttctgggaagccg

SEQ ID NO: 329272 - DNA, 25 bp, Mus musculus
cgccgttcgctgctcctgtttttac

SEQ ID NO: 329273 - DNA, 25 bp, Mus musculus
ggccctcggcgaagaaacaaggatg

SEQ ID NO: 329274 - DNA, 25 bp, Mus musculus
ctgaataacggatacggcggctccc

SEQ ID NO: 329275 - DNA, 25 bp, Mus musculus
gtcctggccataaacgcctgtggta

SEQ ID NO: 329276 - DNA, 25 bp, Mus musculus
cgcctgtggtaatccgactggatta

SEQ ID NO: 329277 - DNA, 25 bp, Mus musculus
tggactctttgctccgtgcccgata

SEQ ID NO: 329278 - DNA, 25 bp, Mus musculus
gccaaagcaagggacgcagcaatta

SEQ ID NO: 329279 - DNA, 25 bp, Mus musculus
cccgaaggtcctctcgtcaggttga

SEQ ID NO: 329280 - DNA, 25 bp, Mus musculus
aggttgatctcttcctccgtgacta

SEQ ID NO: 329281 - DNA, 25 bp, Mus musculus
catatctgactgctctccggccgga

SEQ ID NO: 329282 - DNA, 25 bp, Mus musculus
tgaaggtgaatcaagctccgcgctg

SEQ ID NO: 329283 - DNA, 25 bp, Mus musculus
tacagtttcctcagcggtcagaccg

SEQ ID NO: 329284 - DNA, 25 bp, Mus musculus
gtccttgggtccgttatctagctaa

SEQ ID NO: 329285 - DNA, 25 bp, Mus musculus
gcgggaaagaagaaggcgtgtcaca

SEQ ID NO: 329286 - DNA, 25 bp, Mus musculus
cgccgccataattccaaaagcgcta

SEQ ID NO: 329287 - DNA, 25 bp, Mus musculus
ttccaaaagcgctataagagcctcc

SEQ ID NO: 329288 - DNA, 25 bp, Mus musculus
aagcgctataagagcctccttccgg

SEQ ID NO: 329289 - DNA, 25 bp, Mus musculus
tataagagcctccttccggcgcaca

SEQ ID NO: 329290 - DNA, 25 bp, Mus musculus
tccttccggcgcacagtaaaggcga

SEQ ID NO: 329291 - DNA, 25 bp, Mus musculus
cggcgcacagtaaaggcgatgacta

SEQ ID NO: 329292 - DNA, 25 bp, Mus musculus
acagtaaaggcgatgactaccgcga

SEQ ID NO: 329293 - DNA, 25 bp, Mus musculus
aggcgatgactaccgcgacggaagc

SEQ ID NO: 329294 - DNA, 25 bp, Mus musculus
ttagcggggaggtcaaaagtattca

SEQ ID NO: 329295 - DNA, 25 bp, Mus musculus
tcaaaagtattcacgcggagcgcgg

SEQ ID NO: 329296 - DNA, 25 bp, Mus musculus
ggttgagctttggtcgttggacacg

SEQ ID NO: 329297 - DNA, 25 bp, Mus musculus
ttgggacacgcagaaggatggcgca

SEQ ID NO: 329298 - DNA, 25 bp, Mus musculus
gatgagacctaaagtgggtggagcc

SEQ ID NO: 329299 - DNA, 25 bp, Mus musculus
catcggcaaataccaccgggcgttg

SEQ ID NO: 329300 - DNA, 25 bp, Mus musculus
gcgaagccagcgctccgcgctttta

SEQ ID NO: 329301 - DNA, 25 bp, Mus musculus
ggcaggggttcccaaatccagccgc

SEQ ID NO: 329302 - DNA, 25 bp, Mus musculus
gactgttacaacagcctggcaggta

SEQ ID NO: 329303 - DNA, 25 bp, Mus musculus
cggttgaagccattgagatcgactg

SEQ ID NO: 329304 - DNA, 25 bp, Mus musculus
ctcagaggagcagagcaagacggtt

SEQ ID NO: 329305 - DNA, 25 bp, Mus musculus
aaatccagccgcctctcagaggagc

SEQ ID NO: 329306 - DNA, 25 bp, Mus musculus
tgaagggattgctgccgtcacaaga

SEQ ID NO: 329307 - DNA, 25 bp, Mus musculus
ggacaagaaattccgcgaagccatc

SEQ ID NO: 329308 - DNA, 25 bp, Mus musculus
ggcgcagtgctacaaggacaagaaa

SEQ ID NO: 329309 - DNA, 25 bp, Mus musculus
ttcaagagccaaggggcgcagtgct

SEQ ID NO: 329310 - DNA, 25 bp, Mus musculus
atccggcgcgcacacgagttcaaga

SEQ ID NO: 329311 - DNA, 25 bp, Mus musculus
cgcgcttttaaagcccggatcgcga

SEQ ID NO: 329312 - DNA, 25 bp, Mus musculus
caacctagtctctctggatcccaga

SEQ ID NO: 329313 - DNA, 25 bp, Mus musculus
aggtccgacgccctcagggtggcct

SEQ ID NO: 329314 - DNA, 25 bp, Mus musculus
cggcagtaatttcgaatccagcgcc

SEQ ID NO: 329315 - DNA, 25 bp, Mus musculus
gttacacgcgcaggcaccgtgtgtc

SEQ ID NO: 329316 - DNA, 25 bp, Mus musculus
ctccgccgcgggaaacttggccgtg

SEQ ID NO: 329317 - DNA, 25 bp, Mus musculus
tcggccctcttggaagctgcgggct

SEQ ID NO: 329318 - DNA, 25 bp, Mus musculus
gtggccttcgtgtcgtgacagccgc

SEQ ID NO: 329319 - DNA, 25 bp, Mus musculus
gtctgcagggctcccgcctgcattt

SEQ ID NO: 329320 - DNA, 25 bp, Mus musculus
ttccggttctctctggctgaccaga

SEQ ID NO: 329321 - DNA, 25 bp, Mus musculus
gctgagcgcacttccggttctctct

SEQ ID NO: 329322 - DNA, 25 bp, Mus musculus
cgctgtctagatccgccgcagcggg

SEQ ID NO: 329323 - DNA, 25 bp, Mus musculus
atgcgtagacctgttgccaaggcgc

SEQ ID NO: 329324 - DNA, 25 bp, Mus musculus
gccgggcagacgcatgcgtagacct

SEQ ID NO: 329325 - DNA, 25 bp, Mus musculus
gcgagcagccttcggccctcttgga

SEQ ID NO: 329326 - DNA, 25 bp, Mus musculus
gaatccagcgccttctccattagtc

SEQ ID NO: 329327 - DNA, 25 bp, Mus musculus
cttttcctggcacagctggtggatg

SEQ ID NO: 329328 - DNA, 25 bp, Mus musculus
ctggcacagctggtggatgatgata

SEQ ID NO: 329329 - DNA, 25 bp, Mus musculus
cacagctggtggatgatgatattga

SEQ ID NO: 329330 - DNA, 25 bp, Mus musculus
ggatgatgatattgagctctcgctc

SEQ ID NO: 329331 - DNA, 25 bp, Mus musculus
ctcttcctgaacttgcccttgcgtt

SEQ ID NO: 329332 - DNA, 25 bp, Mus musculus
atgatattgagctctcgctccagga

SEQ ID NO: 329333 - DNA, 25 bp, Mus musculus
gctctcgctccaggatgtcgatctc

SEQ ID NO: 329334 - DNA, 25 bp, Mus musculus
gttgccgtccttgagcttcagccgg

SEQ ID NO: 329335 - DNA, 25 bp, Mus musculus
gtccttgagcttcagccggctcttc

SEQ ID NO: 329336 - DNA, 25 bp, Mus musculus
tgctcgctctgccactgaccggagg

SEQ ID NO: 329337 - DNA, 25 bp, Mus musculus
tcgctctgccactgaccggagggga

SEQ ID NO: 329338 - DNA, 25 bp, Mus musculus
aggctgatgcggttgccgtccttga

SEQ ID NO: 329339 - DNA, 25 bp, Mus musculus
cccggggcttttcctggcacagctg

SEQ ID NO: 329340 - DNA, 25 bp, Mus musculus
gaacttgcccttgcgtttcttcacc

SEQ ID NO: 329341 - DNA, 25 bp, Mus musculus
gaccgggccacaaacgcgcggcgct

SEQ ID NO: 329342 - DNA, 25 bp, Mus musculus
tacccggttgcacagcgatgccctg

SEQ ID NO: 329343 - DNA, 25 bp, Mus musculus
gaccctacccggttgcacagcgatg

SEQ ID NO: 329344 - DNA, 25 bp, Mus musculus
atcttgaccctacccggttgcacag

SEQ ID NO: 329345 - DNA, 25 bp, Mus musculus
gcacttaactgttggccaccgctcg

SEQ ID NO: 329346 - DNA, 25 bp, Mus musculus
ctcccgtgcacttaactgttggcca

SEQ ID NO: 329347 - DNA, 25 bp, Mus musculus
agtctcccgtgcacttaactgttgg

SEQ ID NO: 329348 - DNA, 25 bp, Mus musculus
gcgcagtctcccgtgcacttaactg

SEQ ID NO: 329349 - DNA, 25 bp, Mus musculus
cggcctcctcgtacggcctcaggct

SEQ ID NO: 329350 - DNA, 25 bp, Mus musculus
catgctcttccgcttcggcgtggtg

SEQ ID NO: 329351 - DNA, 25 bp, Mus musculus
gaaccctgatcccacggccgcgtga

SEQ ID NO: 329352 - DNA, 25 bp, Mus musculus
ggttgcacagcgatgccctggtccg

SEQ ID NO: 329353 - DNA, 25 bp, Mus musculus
cggcgctgcacgtctcgcgccgccc

SEQ ID NO: 329354 - DNA, 25 bp, Mus musculus
aggctcacctcggagagccacaggc

SEQ ID NO: 329355 - DNA, 25 bp, Mus musculus
gagtccttggacagcacctctacca

SEQ ID NO: 329356 - DNA, 25 bp, Mus musculus
tcccggttcagatggatctgctgtt

SEQ ID NO: 329357 - DNA, 25 bp, Mus musculus
acgggctgcgccaattcccggttca

SEQ ID NO: 329358 - DNA, 25 bp, Mus musculus
ggagccctctgtcttttgtccgcgc

SEQ ID NO: 329359 - DNA, 25 bp, Mus musculus
gacccagcgtgcgttcggacagtcc

SEQ ID NO: 329360 - DNA, 25 bp, Mus musculus
agacctcattgggtggctcccgaag

SEQ ID NO: 329361 - DNA, 25 bp, Mus musculus
ccgagaagcgatctggaggactcca

SEQ ID NO: 329362 - DNA, 25 bp, Mus musculus
atcgccggacacctgcgagtccttg

SEQ ID NO: 329363 - DNA, 25 bp, Mus musculus
tggttcagctgtccggtccaccagc

SEQ ID NO: 329364 - DNA, 25 bp, Mus musculus
ggaagatgcccacccgctggttcag

SEQ ID NO: 329365 - DNA, 25 bp, Mus musculus
cgctacgcggggtcacgtagttgct

SEQ ID NO: 329366 - DNA, 25 bp, Mus musculus
tcgtactcgaacacagccgtccagt

SEQ ID NO: 329367 - DNA, 25 bp, Mus musculus
cgcctattgttcatgcggctcggca

SEQ ID NO: 329368 - DNA, 25 bp, Mus musculus
aggactccatggagcggctggtcca

SEQ ID NO: 329369 - DNA, 25 bp, Mus musculus
atggggtcgcagacgctgcagatcc

SEQ ID NO: 329370 - DNA, 25 bp, Mus musculus
agacgctgcagatcctccggcaggg

SEQ ID NO: 329371 - DNA, 25 bp, Mus musculus
ctcagcggcggctggtactacgacc

SEQ ID NO: 329372 - DNA, 25 bp, Mus musculus
ggctggtactacgacccgcaccagg

SEQ ID NO: 329373 - DNA, 25 bp, Mus musculus
tctacctgtggctctttctgctcgg

SEQ ID NO: 329374 - DNA, 25 bp, Mus musculus
ggcctgcccttcacgctttacatgg

SEQ ID NO: 329375 - DNA, 25 bp, Mus musculus
tcctagcgcctctcgtgcgggtctg

SEQ ID NO: 329376 - DNA, 25 bp, Mus musculus
cctctcgtgcgggtctgcgtaactg

SEQ ID NO: 329377 - DNA, 25 bp, Mus musculus
tgcgcgctccggcagaaacggagtc

SEQ ID NO: 329378 - DNA, 25 bp, Mus musculus
cagaaacggagtcgcagggtgtccc

SEQ ID NO: 329379 - DNA, 25 bp, Mus musculus
agggtgtcccggctcgtactcgctt

SEQ ID NO: 329380 - DNA, 25 bp, Mus musculus
tccgcaaaccgctgatcggttgagt

SEQ ID NO: 329381 - DNA, 25 bp, Mus musculus
cttcacgctttacatggtgagtggg

SEQ ID NO: 329382 - DNA, 25 bp, Mus musculus
gctcggagctcgaagacaagatggc

SEQ ID NO: 329383 - DNA, 25 bp, Mus musculus
cacaatagttgatgcccggggacca

SEQ ID NO: 329384 - DNA, 25 bp, Mus musculus
ccaccgccggcaactttgtgagcga

SEQ ID NO: 329385 - DNA, 25 bp, Mus musculus
ggcgagtctgcgcttcaccgtgcac

SEQ ID NO: 329386 - DNA, 25 bp, Mus musculus
agaagggccagtgcagcgccgccac

SEQ ID NO: 329387 - DNA, 25 bp, Mus musculus
atctcacccgagactgaaggaggga

SEQ ID NO: 329388 - DNA, 25 bp, Mus musculus
actccgggctcctgcacaatagttg

SEQ ID NO: 329389 - DNA, 25 bp, Mus musculus
ctttgtgagcgagttcagtacgtgc

SEQ ID NO: 329390 - DNA, 25 bp, Mus musculus
agcctcggatctccgcagaggaggc

SEQ ID NO: 329391 - DNA, 25 bp, Mus musculus
aagcccaggccaagcggtaagtggc

SEQ ID NO: 329392 - DNA, 25 bp, Mus musculus
agctggacggttacagccgctgaaa

SEQ ID NO: 329393 - DNA, 25 bp, Mus musculus
cagccgctgaaagtttgatttccga

SEQ ID NO: 329394 - DNA, 25 bp, Mus musculus
tgatttccgatttggtggcgtgctg

SEQ ID NO: 329395 - DNA, 25 bp, Mus musculus
gcacgttctcacctcaggatccgga

SEQ ID NO: 329396 - DNA, 25 bp, Mus musculus
ccgcggtgatctcacccgagactga

SEQ ID NO: 329397 - DNA, 25 bp, Mus musculus
aaaggaatggaagccgcacccgcgc

SEQ ID NO: 329398 - DNA, 25 bp, Mus musculus
ccggagcgagtcgagacaattcttt

SEQ ID NO: 329399 - DNA, 25 bp, Mus musculus
ttaggagaaactgagacgccggagc

SEQ ID NO: 329400 - DNA, 25 bp, Mus musculus
tccatttcggatgcgtgacaggtgc

SEQ ID NO: 329401 - DNA, 25 bp, Mus musculus
agccttatcatgagccgggcgccag

SEQ ID NO: 329402 - DNA, 25 bp, Mus musculus
cgccagccgggctttaggagaaact

SEQ ID NO: 329403 - DNA, 25 bp, Mus musculus
tgtgtctgcagtttgggactgtgca

SEQ ID NO: 329404 - DNA, 25 bp, Mus musculus
cttacgtaagtgactcggcgagctg

SEQ ID NO: 329405 - DNA, 25 bp, Mus musculus
caggtctgcgtggaaatcgccttcc

SEQ ID NO: 329406 - DNA, 25 bp, Mus musculus
agctgtacagtgtgctcgctgagcc

SEQ ID NO: 329407 - DNA, 25 bp, Mus musculus
gtcccgctcatagcgcgtggctcag

SEQ ID NO: 329408 - DNA, 25 bp, Mus musculus
cgacctaagaacgtgctcaggtgtc

SEQ ID NO: 329409 - DNA, 25 bp, Mus musculus
tgcccggacagatttggccgctcct

SEQ ID NO: 329410 - DNA, 25 bp, Mus musculus
gccgcctcgtagagtggcaccaaga

SEQ ID NO: 329411 - DNA, 25 bp, Mus musculus
gaacggtgttttcgactcccatagc

SEQ ID NO: 329412 - DNA, 25 bp, Mus musculus
ggtttacacaaactccctgcgagag

SEQ ID NO: 329413 - DNA, 25 bp, Mus musculus
ccggatcgttaatttactagagcca

SEQ ID NO: 329414 - DNA, 25 bp, Mus musculus
gcaggcaagcacaccatttataaga

SEQ ID NO: 329415 - DNA, 25 bp, Mus musculus
ctcggcttttcacccagagcaggca

SEQ ID NO: 329416 - DNA, 25 bp, Mus musculus
ctgtgtccgctcaaagtctccggga

SEQ ID NO: 329417 - DNA, 25 bp, Mus musculus
ggcttcatattcagtccaccgactg

SEQ ID NO: 329418 - DNA, 25 bp, Mus musculus
tcacccgcggacttgcggcttcata

SEQ ID NO: 329419 - DNA, 25 bp, Mus musculus
cccttgagagccacactagttttcc

SEQ ID NO: 329420 - DNA, 25 bp, Mus musculus
gaagtcctagtacaccgggcaccca

SEQ ID NO: 329421 - DNA, 25 bp, Mus musculus
tcccactggctttcatcagggcggg

SEQ ID NO: 329422 - DNA, 25 bp, Mus musculus
gcgcgcagctaaaagagccaagatc

SEQ ID NO: 329423 - DNA, 25 bp, Mus musculus
ctcccatagccagggacgctgtagc

SEQ ID NO: 329424 - DNA, 25 bp, Mus musculus
agagcgaacgccctgcaaaactccg

SEQ ID NO: 329425 - DNA, 25 bp, Mus musculus
caggcagaagcctaattcaatgaga

SEQ ID NO: 329426 - DNA, 25 bp, Mus musculus
tacccacgcagaggacagagaaggc

SEQ ID NO: 329427 - DNA, 25 bp, Mus musculus
gagggtgccgctgtacccacgcaga

SEQ ID NO: 329428 - DNA, 25 bp, Mus musculus
ctgttcccatgcgtggcgtgcatct

SEQ ID NO: 329429 - DNA, 25 bp, Mus musculus
ccatctgtgcaggtaaggctgttcc

SEQ ID NO: 329430 - DNA, 25 bp, Mus musculus
tcgtagctgagaggaccatctgtgc

SEQ ID NO: 329431 - DNA, 25 bp, Mus musculus
gtgctccagcccagaagtgtcgtag

SEQ ID NO: 329432 - DNA, 25 bp, Mus musculus
agggtctttccggatctttgcacgc

SEQ ID NO: 329433 - DNA, 25 bp, Mus musculus
tgcgacaacacaacatgagggtctt

SEQ ID NO: 329434 - DNA, 25 bp, Mus musculus
agaaccggccgctttagtcctatgg

SEQ ID NO: 329435 - DNA, 25 bp, Mus musculus
tgagcgtgccatacaaggccggagt

SEQ ID NO: 329436 - DNA, 25 bp, Mus musculus
cctactgacatggacaggcagaagc

SEQ ID NO: 329437 - DNA, 25 bp, Mus musculus
gctcgaccaggacaaggcggaaatc

SEQ ID NO: 329438 - DNA, 25 bp, Mus musculus
tagtcctatggggtgcgacaacaca

SEQ ID NO: 329439 - DNA, 25 bp, Mus musculus
cgggacagacaagcctgaaagcatt

SEQ ID NO: 329440 - DNA, 25 bp, Mus musculus
ttcccgatggaagcatcgtcgttgc

SEQ ID NO: 329441 - DNA, 25 bp, Mus musculus
atcgtcgttgcgaataggcgggaca

SEQ ID NO: 329442 - DNA, 25 bp, Mus musculus
aaagcatttcgggacttagagtctc

SEQ ID NO: 329443 - DNA, 25 bp, Mus musculus
agctccacatgactacaattcccga

SEQ ID NO: 329444 - DNA, 25 bp, Mus musculus
cccttcctcctaggagcgactggag

SEQ ID NO: 329445 - DNA, 25 bp, Mus musculus
tgtcgttctgccctacagccctgaa

SEQ ID NO: 329446 - DNA, 25 bp, Mus musculus
gcatgaacagcgcagcccagctagg

SEQ ID NO: 329447 - DNA, 25 bp, Mus musculus
tcccagctcagaccaacaggaaggc

SEQ ID NO: 329448 - DNA, 25 bp, Mus musculus
tcagctgatcagagtgaacttctcc

SEQ ID NO: 329449 - DNA, 25 bp, Mus musculus
gccctgaaatacaagctccacatga

SEQ ID NO: 329450 - DNA, 25 bp, Mus musculus
ggcttcctcctctcttgttgtcagt

SEQ ID NO: 329451 - DNA, 25 bp, Mus musculus
agccgaatccattgtttatgccacc

SEQ ID NO: 329452 - DNA, 25 bp, Mus musculus
tgttgtcagttggaatcagctgatc

SEQ ID NO: 329453 - DNA, 25 bp, Mus musculus
gtcgatggaatacagcccaaaggga

SEQ ID NO: 329454 - DNA, 25 bp, Mus musculus
tgtcgatggaatacagcccaaaggg

SEQ ID NO: 329455 - DNA, 25 bp, Mus musculus
tttcaggtgtcgatggaatacagcc

SEQ ID NO: 329456 - DNA, 25 bp, Mus musculus
ttcaggtgtcgatggaatacagccc

SEQ ID NO: 329457 - DNA, 25 bp, Mus musculus
tcaggtgtcgatggaatacagccca

SEQ ID NO: 329458 - DNA, 25 bp, Mus musculus
caggtgtcgatggaatacagcccaa

SEQ ID NO: 329459 - DNA, 25 bp, Mus musculus
aggtgtcgatggaatacagcccaaa

SEQ ID NO: 329460 - DNA, 25 bp, Mus musculus
cagcccaaagggaactacaagccgg

SEQ ID NO: 329461 - DNA, 25 bp, Mus musculus
tcaaactgccccatctgagcttctg

SEQ ID NO: 329462 - DNA, 25 bp, Mus musculus
cccatctgagcttctgttttttcct

SEQ ID NO: 329463 - DNA, 25 bp, Mus musculus
catctgagcttctgttttttcctcc

SEQ ID NO: 329464 - DNA, 25 bp, Mus musculus
tctgagcttctgttttttcctcctt

SEQ ID NO: 329465 - DNA, 25 bp, Mus musculus
tgagcttctgttttttcctcctttc

SEQ ID NO: 329466 - DNA, 25 bp, Mus musculus
gtgtcgatggaatacagcccaaagg

SEQ ID NO: 329467 - DNA, 25 bp, Mus musculus
ccagagccacctctcagtaggtttc

SEQ ID NO: 329468 - DNA, 25 bp, Mus musculus
ctaggcatcaccttctctatggtta

SEQ ID NO: 329469 - DNA, 25 bp, Mus musculus
aggcgcttcggaaccagtctctaga

SEQ ID NO: 329470 - DNA, 25 bp, Mus musculus
cgcgcagacacctcgaaccggtgga

SEQ ID NO: 329471 - DNA, 25 bp, Mus musculus
agaggccgcgaagacagtaccgttt

SEQ ID NO: 329472 - DNA, 25 bp, Mus musculus
ttccgaacgcgtgaggaaaccgctc

SEQ ID NO: 329473 - DNA, 25 bp, Mus musculus
tcgacctgctacctcagctgcggga

SEQ ID NO: 329474 - DNA, 25 bp, Mus musculus
tccaaggcctcggaaaaaccagtga

SEQ ID NO: 329475 - DNA, 25 bp, Mus musculus
ttttgtcgcccactttgtctattgg

SEQ ID NO: 329476 - DNA, 25 bp, Mus musculus
tgaaagtagcctgcgcccactcttg

SEQ ID NO: 329477 - DNA, 25 bp, Mus musculus
tttcagtttgggagcgaatcgcctc

SEQ ID NO: 329478 - DNA, 25 bp, Mus musculus
agtgcctccaggctgcgccttgaaa

SEQ ID NO: 329479 - DNA, 25 bp, Mus musculus
gacggcggagactatctaggcatca

SEQ ID NO: 329480 - DNA, 25 bp, Mus musculus
gtctattggcttccgtttcagtttg

SEQ ID NO: 329481 - DNA, 25 bp, Mus musculus
tttctaggagctccgggctgcttaa

SEQ ID NO: 329482 - DNA, 25 bp, Mus musculus
gaccaaaagccgcttggcgatggcg

SEQ ID NO: 329483 - DNA, 25 bp, Mus musculus
ggttctctctcgctccttttctagg

SEQ ID NO: 329484 - DNA, 25 bp, Mus musculus
ccgggctgcttaaatctctcttgga

SEQ ID NO: 329485 - DNA, 25 bp, Mus musculus
ctctcttggattgcgccctgcaagc

SEQ ID NO: 329486 - DNA, 25 bp, Mus musculus
cgctgcaacacgctcgggtgaatct

SEQ ID NO: 329487 - DNA, 25 bp, Mus musculus
acacgctcgggtgaatctctgctgc

SEQ ID NO: 329488 - DNA, 25 bp, Mus musculus
attgggaatcccatagaaaacctag

SEQ ID NO: 329489 - DNA, 25 bp, Mus musculus
gcgcgcgagcctccacctctctact

SEQ ID NO: 329490 - DNA, 25 bp, Mus musculus
gcttcgcagcccagcctggatagtt

SEQ ID NO: 329491 - DNA, 25 bp, Mus musculus
cccagcctggatagttgtgaccaaa

SEQ ID NO: 329492 - DNA, 25 bp, Mus musculus
tagttgtgaccaaaagccgcttggc

SEQ ID NO: 329493 - DNA, 25 bp, Mus musculus
tctctgctgcagattgggaatccca

SEQ ID NO: 329494 - DNA, 25 bp, Mus musculus
cgtctctgcgagtggttctctctcg

SEQ ID NO: 329495 - DNA, 25 bp, Mus musculus
ctacgtcccaaaggggcggtgactg

SEQ ID NO: 329496 - DNA, 25 bp, Mus musculus
cgggagggatacagacacactgtta

SEQ ID NO: 329497 - DNA, 25 bp, Mus musculus
aaaggggcggtgactgcccttcagc

SEQ ID NO: 329498 - DNA, 25 bp, Mus musculus
cgtcagactacgtcccaaaggggcg

SEQ ID NO: 329499 - DNA, 25 bp, Mus musculus
cgctgacgtcagactacgtcccaaa

SEQ ID NO: 329500 - DNA, 25 bp, Mus musculus
tacgtgacccagctcagtaccgccc

SEQ ID NO: 329501 - DNA, 25 bp, Mus musculus
tccctgcaaacctgtgcgggcttgc

SEQ ID NO: 329502 - DNA, 25 bp, Mus musculus
acccgccggcacaccttggcttcca

SEQ ID NO: 329503 - DNA, 25 bp, Mus musculus
aggtcttccggagagctccagccgc

SEQ ID NO: 329504 - DNA, 25 bp, Mus musculus
cctacagggccacaggtcttccgga

SEQ ID NO: 329505 - DNA, 25 bp, Mus musculus
ctgaaagactgcctacagggccaca

SEQ ID NO: 329506 - DNA, 25 bp, Mus musculus
agacacactgttagaccgcctgaaa

SEQ ID NO: 329507 - DNA, 25 bp, Mus musculus
tgtcctccctgcaaacctgtgcggg

SEQ ID NO: 329508 - DNA, 25 bp, Mus musculus
gttagaccgcctgaaagactgccta

SEQ ID NO: 329509 - DNA, 25 bp, Mus musculus
gagcagccttctccgagctttggta

SEQ ID NO: 329510 - DNA, 25 bp, Mus musculus
tgtcacttgtagactggaagaacgc

SEQ ID NO: 329511 - DNA, 25 bp, Mus musculus
ggaagaacgctagacgcgcctcaaa

SEQ ID NO: 329512 - DNA, 25 bp, Mus musculus
tcaaaccctagagaggcctcaggtc

SEQ ID NO: 329513 - DNA, 25 bp, Mus musculus
ggtcgcgcacatccttacatctatg

SEQ ID NO: 329514 - DNA, 25 bp, Mus musculus
ctatgcgagtggattaggccagctc

SEQ ID NO: 329515 - DNA, 25 bp, Mus musculus
tcgccgaggccggaagttgcgacac

SEQ ID NO: 329516 - DNA, 25 bp, Mus musculus
gttgcgacaccggtgagacctctag

SEQ ID NO: 329517 - DNA, 25 bp, Mus musculus
gggccgcgagtattcgtcggaaaca

SEQ ID NO: 329518 - DNA, 25 bp, Mus musculus
gtcggaaacaaaacagcggcagctg

SEQ ID NO: 329519 - DNA, 25 bp, Mus musculus
tgtctctgccggtcgtgttcaccgt

SEQ ID NO: 329520 - DNA, 25 bp, Mus musculus
tgaagccggtttctcggaacccagc

SEQ ID NO: 329521 - DNA, 25 bp, Mus musculus
ccggggccagactgagagcagcctt

SEQ ID NO: 329522 - DNA, 25 bp, Mus musculus
cgctcgaatcgcagtctcaaccaaa

SEQ ID NO: 329523 - DNA, 25 bp, Mus musculus
tgcagagttcgacggcaccgacttc

SEQ ID NO: 329524 - DNA, 25 bp, Mus musculus
tgccctactacgcaggtaagcagca

SEQ ID NO: 329525 - DNA, 25 bp, Mus musculus
acgctggcacccatgttctctgaca

SEQ ID NO: 329526 - DNA, 25 bp, Mus musculus
gttctctgacatacatgttctcgtg

SEQ ID NO: 329527 - DNA, 25 bp, Mus musculus
ggctccaggacacggaagatggata

SEQ ID NO: 329528 - DNA, 25 bp, Mus musculus
ataggggaggtccttagccgcctca

SEQ ID NO: 329529 - DNA, 25 bp, Mus musculus
gcaccgacttccagggtcggcgcta

SEQ ID NO: 329530 - DNA, 25 bp, Mus musculus
ggcgctaccggtggctgccctacta

SEQ ID NO: 329531 - DNA, 25 bp, Mus musculus
gcacctagggagagcaagaagcctc

SEQ ID NO: 329532 - DNA, 25 bp, Mus musculus
cggaggtaaagcctgcgtgtccctc

SEQ ID NO: 329533 - DNA, 25 bp, Mus musculus
accgcacctgccacacggaggtaaa

SEQ ID NO: 329534 - DNA, 25 bp, Mus musculus
tgatgctctcgctctgcaggagaga

SEQ ID NO: 329535 - DNA, 25 bp, Mus musculus
aacgttggggtcttcctgatgctct

SEQ ID NO: 329536 - DNA, 25 bp, Mus musculus
acatgttctcgtgcagagctgccca

SEQ ID NO: 329537 - DNA, 25 bp, Mus musculus
tccgcctccggagcgcaaagctaga

SEQ ID NO: 329538 - DNA, 25 bp, Mus musculus
ggtcgcgccgtactcggtgcctttc

SEQ ID NO: 329539 - DNA, 25 bp, Mus musculus
ttcaggaagtctcgcacacaccggc

SEQ ID NO: 329540 - DNA, 25 bp, Mus musculus
ccagctccaactctgccggcaggaa

SEQ ID NO: 329541 - DNA, 25 bp, Mus musculus
tccggagcgcaaagctagagtttcc

SEQ ID NO: 329542 - DNA, 25 bp, Mus musculus
ccgctcgggtctcttcaggaagtct

SEQ ID NO: 329543 - DNA, 25 bp, Mus musculus
tcagactctacctccgccgccagta

SEQ ID NO: 329544 - DNA, 25 bp, Mus musculus
cgacaggggccactcccagttttgt

SEQ ID NO: 329545 - DNA, 25 bp, Mus musculus
acttccaacttatccattgggtgga

SEQ ID NO: 329546 - DNA, 25 bp, Mus musculus
caacttatccattgggtggaggggc

SEQ ID NO: 329547 - DNA, 25 bp, Mus musculus
ctctgctgcgattggttgactcttc

SEQ ID NO: 329548 - DNA, 25 bp, Mus musculus
tggttgactcttcctgtccgtcatc

SEQ ID NO: 329549 - DNA, 25 bp, Mus musculus
tggttcaaggtctccaccccgcaga

SEQ ID NO: 329550 - DNA, 25 bp, Mus musculus
tcacctgccgctggccctgaacaac

SEQ ID NO: 329551 - DNA, 25 bp, Mus musculus
ggaccacttctaccggcggctgtgg

SEQ ID NO: 329552 - DNA, 25 bp, Mus musculus
atggcgggctccaacgtctacctca

SEQ ID NO: 329553 - DNA, 25 bp, Mus musculus
agggctttgctcctcactacgatga

SEQ ID NO: 329554 - DNA, 25 bp, Mus musculus
tactgacggagctgaacggcatccc

SEQ ID NO: 329555 - DNA, 25 bp, Mus musculus
accgcagctactacgagggtctctt

SEQ ID NO: 329556 - DNA, 25 bp, Mus musculus
acctggactcgatgctgcgctacga

SEQ ID NO: 329557 - DNA, 25 bp, Mus musculus
tgcgctacgaggacgtgcaattcgg

SEQ ID NO: 329558 - DNA, 25 bp, Mus musculus
tgcaattcgggcagcatctggacgc

SEQ ID NO: 329559 - DNA, 25 bp, Mus musculus
cccgctatggacgagctaccgaatg

SEQ ID NO: 329560 - DNA, 25 bp, Mus musculus
ggtccttgtaccgagccggctgctc

SEQ ID NO: 329561 - DNA, 25 bp, Mus musculus
agtttctggccgtgctccaggagca

SEQ ID NO: 329562 - DNA, 25 bp, Mus musculus
catcgaggctttcgtgttgcagctg

SEQ ID NO: 329563 - DNA, 25 bp, Mus musculus
ctaccgaatggcaacggtgcggcgc

SEQ ID NO: 329564 - DNA, 25 bp, Mus musculus
cgctgcagcaggtactgacggagct

SEQ ID NO: 329565 - DNA, 25 bp, Mus musculus
ggcgcggctgtttgtacctccgccg

SEQ ID NO: 329566 - DNA, 25 bp, Mus musculus
atgcgacgctgagcgtagagcccga

SEQ ID NO: 329567 - DNA, 25 bp, Mus musculus
gcggacaaatgcgacgctgagcgta

SEQ ID NO: 329568 - DNA, 25 bp, Mus musculus
ctcagcactggtggccggaccactt

SEQ ID NO: 329569 - DNA, 25 bp, Mus musculus
agctgggcgcggctgtttgtacctc

SEQ ID NO: 329570 - DNA, 25 bp, Mus musculus
tgtgccaacaggattggaagagctg

SEQ ID NO: 329571 - DNA, 25 bp, Mus musculus
gcaagcaggttgtgccaacaggatt

SEQ ID NO: 329572 - DNA, 25 bp, Mus musculus
ttcgctgtcctgagagcaagcaggt

SEQ ID NO: 329573 - DNA, 25 bp, Mus musculus
cgtctttcgctgtcctgagagcaag

SEQ ID NO: 329574 - DNA, 25 bp, Mus musculus
ggcctcgtctttcgctgtcctgaga

SEQ ID NO: 329575 - DNA, 25 bp, Mus musculus
aaaatggtggcctcgtctttcgctg

SEQ ID NO: 329576 - DNA, 25 bp, Mus musculus
gtcaacgacgcaaaatggtggcctc

SEQ ID NO: 329577 - DNA, 25 bp, Mus musculus
gggctgaagtcaacgacgcaaaatg

SEQ ID NO: 329578 - DNA, 25 bp, Mus musculus
gccggaccacttgggcgcggacaaa

SEQ ID NO: 329579 - DNA, 25 bp, Mus musculus
gcctttttggcgatgtggtcaagcg

SEQ ID NO: 329580 - DNA, 25 bp, Mus musculus
gggcagcggcttgcacatgcggtgc

SEQ ID NO: 329581 - DNA, 25 bp, Mus musculus
ccgatcggcctttttggcgatgtgg

SEQ ID NO: 329582 - DNA, 25 bp, Mus musculus
cgatcggcctttttggcgatgtggt

SEQ ID NO: 329583 - DNA, 25 bp, Mus musculus
gatcggcctttttggcgatgtggtc

SEQ ID NO: 329584 - DNA, 25 bp, Mus musculus
ggcctttttggcgatgtggtcaagc

SEQ ID NO: 329585 - DNA, 25 bp, Mus musculus
cctttttggcgatgtggtcaagcgc

SEQ ID NO: 329586 - DNA, 25 bp, Mus musculus
cgagatggaggcgacgctgaacctt

SEQ ID NO: 329587 - DNA, 25 bp, Mus musculus
aggcgacgctgaaccttgagccctc

SEQ ID NO: 329588 - DNA, 25 bp, Mus musculus
ggcgacgctgaaccttgagccctcg

SEQ ID NO: 329589 - DNA, 25 bp, Mus musculus
gcgacgctgaaccttgagccctcgg

SEQ ID NO: 329590 - DNA, 25 bp, Mus musculus
gcccgatcggcctttttggcgatgt

SEQ ID NO: 329591 - DNA, 25 bp, Mus musculus
cccgatcggcctttttggcgatgtg

SEQ ID NO: 329592 - DNA, 25 bp, Mus musculus
atcggcctttttggcgatgtggtca

SEQ ID NO: 329593 - DNA, 25 bp, Mus musculus
ctattggccatttcagtggtcactc

SEQ ID NO: 329594 - DNA, 25 bp, Mus musculus
tcagtggtcactcaaacaggttggg

SEQ ID NO: 329595 - DNA, 25 bp, Mus musculus
caggttgggggattttcatacatta

SEQ ID NO: 329596 - DNA, 25 bp, Mus musculus
agatcatggttcctctcttgtctgg

SEQ ID NO: 329597 - DNA, 25 bp, Mus musculus
tttcctaggaaggtgctattggcca

SEQ ID NO: 329598 - DNA, 25 bp, Mus musculus
ttgtctgggtcctagagacgcacta

SEQ ID NO: 329599 - DNA, 25 bp, Mus musculus
gtgcccaaattgctgacagatcatg

SEQ ID NO: 329600 - DNA, 25 bp, Mus musculus
gttcctctcttgtctgggtcctaga

SEQ ID NO: 329601 - DNA, 25 bp, Mus musculus
gtgtcatcaccaatcactttcacaa

SEQ ID NO: 329602 - DNA, 25 bp, Mus musculus
tttcacaacaccacgtgggagtggc

SEQ ID NO: 329603 - DNA, 25 bp, Mus musculus
agaatcctataacctggctcagccc

SEQ ID NO: 329604 - DNA, 25 bp, Mus musculus
cccgaagcatgacctttggccggtc

SEQ ID NO: 329605 - DNA, 25 bp, Mus musculus
ttggccggtctgtgcccaaattgct

SEQ ID NO: 329606 - DNA, 25 bp, Mus musculus
gtcctagagacgcactaggtcggct

SEQ ID NO: 329607 - DNA, 25 bp, Mus musculus
cgaaccggatggcacctactgtgat

SEQ ID NO: 329608 - DNA, 25 bp, Mus musculus
ttgtgaccagccggtgcacatcgct

SEQ ID NO: 329609 - DNA, 25 bp, Mus musculus
gttgcctttgtgaccagccggtgca

SEQ ID NO: 329610 - DNA, 25 bp, Mus musculus
aaccggatggcacctactgtgatcc

SEQ ID NO: 329611 - DNA, 25 bp, Mus musculus
ccggatggcacctactgtgatcctg

SEQ ID NO: 329612 - DNA, 25 bp, Mus musculus
ggatggcacctactgtgatcctgga

SEQ ID NO: 329613 - DNA, 25 bp, Mus musculus
gcacctactgtgatcctggagcccg

SEQ ID NO: 329614 - DNA, 25 bp, Mus musculus
acctactgtgatcctggagcccgcg

SEQ ID NO: 329615 - DNA, 25 bp, Mus musculus
ctactgtgatcctggagcccgcggg

SEQ ID NO: 329616 - DNA, 25 bp, Mus musculus
ccgcgggtggttgcctttgtgacca

SEQ ID NO: 329617 - DNA, 25 bp, Mus musculus
cgggtggttgcctttgtgaccagcc

SEQ ID NO: 329618 - DNA, 25 bp, Mus musculus
gtggttgcctttgtgaccagccggt

SEQ ID NO: 329619 - DNA, 25 bp, Mus musculus
atggcacctactgtgatcctggagc

SEQ ID NO: 329620 - DNA, 25 bp, Mus musculus
cctttgtgaccagccggtgcacatc

SEQ ID NO: 329621 - DNA, 25 bp, Mus musculus
ctccagaagtcgagagacactattc

SEQ ID NO: 329622 - DNA, 25 bp, Mus musculus
tcactttgtcaggatggtgccaaca

SEQ ID NO: 329623 - DNA, 25 bp, Mus musculus
attgccaacgcagacaagtaggata

SEQ ID NO: 329624 - DNA, 25 bp, Mus musculus
cgcagacaagtaggataagggttca

SEQ ID NO: 329625 - DNA, 25 bp, Mus musculus
ataagggttcatggtcacagcctcc

SEQ ID NO: 329626 - DNA, 25 bp, Mus musculus
tcacagcctccagaagtcgagagac

SEQ ID NO: 329627 - DNA, 25 bp, Mus musculus
catttaggacttgggtttgtggcta

SEQ ID NO: 329628 - DNA, 25 bp, Mus musculus
cagtatcctgatttttcactttgtc

SEQ ID NO: 329629 - DNA, 25 bp, Mus musculus
gcccgtcacactgcgcactgccctg

SEQ ID NO: 329630 - DNA, 25 bp, Mus musculus
tgtcaggatggtgccaacagtaagc

SEQ ID NO: 329631 - DNA, 25 bp, Mus musculus
acagtaagcctggagcccacgggcc

SEQ ID NO: 329632 - DNA, 25 bp, Mus musculus
tggtgccaacagtaagcctggagcc

SEQ ID NO: 329633 - DNA, 25 bp, Mus musculus
tcacccgacagtatcctgatttttc

SEQ ID NO: 329634 - DNA, 25 bp, Mus musculus
gagagacactattcacccgacagta

SEQ ID NO: 329635 - DNA, 25 bp, Mus musculus
cgcgatgtgcagatacccttcgtgg

SEQ ID NO: 329636 - DNA, 25 bp, Mus musculus
tgtgcagatacccttcgtggtggag

SEQ ID NO: 329637 - DNA, 25 bp, Mus musculus
gatgtgcagatacccttcgtggtgg

SEQ ID NO: 329638 - DNA, 25 bp, Mus musculus
gcgatgtgcagatacccttcgtggt

SEQ ID NO: 329639 - DNA, 25 bp, Mus musculus
gcgcgatgtgcagatacccttcgtg

SEQ ID NO: 329640 - DNA, 25 bp, Mus musculus
agcgcgatgtgcagatacccttcgt

SEQ ID NO: 329641 - DNA, 25 bp, Mus musculus
aagcgcgatgtgcagatacccttcg

SEQ ID NO: 329642 - DNA, 25 bp, Mus musculus
caagcgcgatgtgcagatacccttc

SEQ ID NO: 329643 - DNA, 25 bp, Mus musculus
tcaagcgcgatgtgcagataccctt

SEQ ID NO: 329644 - DNA, 25 bp, Mus musculus
gatcaagcgcgatgtgcagataccc

SEQ ID NO: 329645 - DNA, 25 bp, Mus musculus
tgatcaagcgcgatgtgcagatacc

SEQ ID NO: 329646 - DNA, 25 bp, Mus musculus
ctgatcaagcgcgatgtgcagatac

SEQ ID NO: 329647 - DNA, 25 bp, Mus musculus
gggtcgggaactcccagagacgcac

SEQ ID NO: 329648 - DNA, 25 bp, Mus musculus
cgatgtgcagatacccttcgtggtg

SEQ ID NO: 329649 - DNA, 25 bp, Mus musculus
cgcgcgcgctaaggatttttcgatg

SEQ ID NO: 329650 - DNA, 25 bp, Mus musculus
ttggctagccgcctcggatacacct

SEQ ID NO: 329651 - DNA, 25 bp, Mus musculus
tcggatacacctggccgtcccgctt

SEQ ID NO: 329652 - DNA, 25 bp, Mus musculus
ttcctcttcccattggctttccagt

SEQ ID NO: 329653 - DNA, 25 bp, Mus musculus
tcggacgctgattggcccccagaga

SEQ ID NO: 329654 - DNA, 25 bp, Mus musculus
ccagcgcgcgcgctaaggatttttc

SEQ ID NO: 329655 - DNA, 25 bp, Mus musculus
ctaaggatttttcgatggctgggca

SEQ ID NO: 329656 - DNA, 25 bp, Mus musculus
cttcctgcaggtgcccgcggtgaca

SEQ ID NO: 329657 - DNA, 25 bp, Mus musculus
aggtgcccgcggtgacacgcgccta

SEQ ID NO: 329658 - DNA, 25 bp, Mus musculus
cacgcgcctacaccgcggcctgcgt

SEQ ID NO: 329659 - DNA, 25 bp, Mus musculus
tgcgtcctcaccacggccgcagtgg

SEQ ID NO: 329660 - DNA, 25 bp, Mus musculus
gtggcggcaccatggttacagtccc

SEQ ID NO: 329661 - DNA, 25 bp, Mus musculus
gccacgtgctctaccgtgggacttc

SEQ ID NO: 329662 - DNA, 25 bp, Mus musculus
atttttcgatggctgggcagaggct

SEQ ID NO: 329663 - DNA, 25 bp, Mus musculus
gcggagcctgctcgcgccctttaaa

SEQ ID NO: 329664 - DNA, 25 bp, Mus musculus
tggtaggcgctcatgtctctgtcgc

SEQ ID NO: 329665 - DNA, 25 bp, Mus musculus
aggcgggaatctccgacagatgctc

SEQ ID NO: 329666 - DNA, 25 bp, Mus musculus
tgctcgcgccctttaaaaggccgga

SEQ ID NO: 329667 - DNA, 25 bp, Mus musculus
attgcctaagtctggcctcgagggg

SEQ ID NO: 329668 - DNA, 25 bp, Mus musculus
gggcgagacctggattgcctaagtc

SEQ ID NO: 329669 - DNA, 25 bp, Mus musculus
acactcactggtggaggtgggacta

SEQ ID NO: 329670 - DNA, 25 bp, Mus musculus
gctaagggcttggacactcactggt

SEQ ID NO: 329671 - DNA, 25 bp, Mus musculus
cgctaaacctcggtgtaacggtcag

SEQ ID NO: 329672 - DNA, 25 bp, Mus musculus
gtcttcaaaacagcgctaaacctcg

SEQ ID NO: 329673 - DNA, 25 bp, Mus musculus
cagctgatgtttctgtcttcaaaac

SEQ ID NO: 329674 - DNA, 25 bp, Mus musculus
ggccggagacgcatagaacagctga

SEQ ID NO: 329675 - DNA, 25 bp, Mus musculus
taacggtcaggagcgctaagggctt

SEQ ID NO: 329676 - DNA, 25 bp, Mus musculus
tccgacagatgctcctggtaggcgc

SEQ ID NO: 329677 - DNA, 25 bp, Mus musculus
caaacccgaaaggagattaagagtg

SEQ ID NO: 329678 - DNA, 25 bp, Mus musculus
caaaaggcggagagaaaggaccgct

SEQ ID NO: 329679 - DNA, 25 bp, Mus musculus
aggaccgctgccagtgcaggcaaga

SEQ ID NO: 329680 - DNA, 25 bp, Mus musculus
cgctgccagtgcaggcaagaggatt

SEQ ID NO: 329681 - DNA, 25 bp, Mus musculus
caagaggattgctccagaggcgcgc

SEQ ID NO: 329682 - DNA, 25 bp, Mus musculus
aggattgctccagaggcgcgcctgc

SEQ ID NO: 329683 - DNA, 25 bp, Mus musculus
cgggccctagcaaccagagcagtga

SEQ ID NO: 329684 - DNA, 25 bp, Mus musculus
aaccagagcagtgacggtagcaacc

SEQ ID NO: 329685 - DNA, 25 bp, Mus musculus
agtgacggtagcaaccgccggaatg

SEQ ID NO: 329686 - DNA, 25 bp, Mus musculus
agcaaccgccggaatggtgagtacc

SEQ ID NO: 329687 - DNA, 25 bp, Mus musculus
gaatggtgagtaccctccaggcctc

SEQ ID NO: 329688 - DNA, 25 bp, Mus musculus
aggcctcgcagccaaacccgaaagg

SEQ ID NO: 329689 - DNA, 25 bp, Mus musculus
gcagccaaacccgaaaggagattaa

SEQ ID NO: 329690 - DNA, 25 bp, Mus musculus
gctagcgccacccaaaaggcggaga

SEQ ID NO: 329691 - DNA, 25 bp, Mus musculus
tgtgtccatgacgacgcgagatacg

SEQ ID NO: 329692 - DNA, 25 bp, Mus musculus
aaactcggctggaggcagctctgcc

SEQ ID NO: 329693 - DNA, 25 bp, Mus musculus
gggagccacgggacactccgcctat

SEQ ID NO: 329694 - DNA, 25 bp, Mus musculus
tgtcaccgtgacaactgtgtccatg

SEQ ID NO: 329695 - DNA, 25 bp, Mus musculus
ggcagctctgcctagcgcttatgtc

SEQ ID NO: 329696 - DNA, 25 bp, Mus musculus
aacccaagcggcaggaagcacggga

SEQ ID NO: 329697 - DNA, 25 bp, Mus musculus
aggcggcactccgagcaccgggaac

SEQ ID NO: 329698 - DNA, 25 bp, Mus musculus
ctcaagactgatgactccgggcggg

SEQ ID NO: 329699 - DNA, 25 bp, Mus musculus
agcaaggtgggctcaagactgatga

SEQ ID NO: 329700 - DNA, 25 bp, Mus musculus
caccgcttaaagagagggagcaagg

SEQ ID NO: 329701 - DNA, 25 bp, Mus musculus
gctgtgtctggcgtcaccgcttaaa

SEQ ID NO: 329702 - DNA, 25 bp, Mus musculus
gctgaactggctgcagctgtgtctg

SEQ ID NO: 329703 - DNA, 25 bp, Mus musculus
ggacactccgcctatcactcgaatg

SEQ ID NO: 329704 - DNA, 25 bp, Mus musculus
tgcctagcgcttatgtccgcgcgct

SEQ ID NO: 329705 - DNA, 25 bp, Mus musculus
aaacacgacgggactgagctgcaca

SEQ ID NO: 329706 - DNA, 25 bp, Mus musculus
ctctcttaagttctcgcggctcgcg

SEQ ID NO: 329707 - DNA, 25 bp, Mus musculus
gcaagccaacgagtccctgcggtca

SEQ ID NO: 329708 - DNA, 25 bp, Mus musculus
gagtccctgcggtcaccacgtttct

SEQ ID NO: 329709 - DNA, 25 bp, Mus musculus
gagctgcgtggctgcacaaacacga

SEQ ID NO: 329710 - DNA, 25 bp, Mus musculus
ccgcctttgggtcgcctccgaagag

SEQ ID NO: 329711 - DNA, 25 bp, Mus musculus
ctcccgaagcctggaagtttgctgg

SEQ ID NO: 329712 - DNA, 25 bp, Mus musculus
cgcgcccttacagtctgcctggaga

SEQ ID NO: 329713 - DNA, 25 bp, Mus musculus
cccagtcctgcgatgcagtgtcagg

SEQ ID NO: 329714 - DNA, 25 bp, Mus musculus
tgcagtgtcaggattgcacggctct

SEQ ID NO: 329715 - DNA, 25 bp, Mus musculus
tgcacggctctgactcatcggttga

SEQ ID NO: 329716 - DNA, 25 bp, Mus musculus
catcggttgagctcacagcttgaaa

SEQ ID NO: 329717 - DNA, 25 bp, Mus musculus
agaaggtgtgccctctcttaagttc

SEQ ID NO: 329718 - DNA, 25 bp, Mus musculus
gcctgcacgcactcccggatttttt

SEQ ID NO: 329719 - DNA, 25 bp, Mus musculus
agcagctgcacgcaacccgaagaga

SEQ ID NO: 329720 - DNA, 25 bp, Mus musculus
cacgcaacccgaagagatggggcgc

SEQ ID NO: 329721 - DNA, 25 bp, Mus musculus
catcgctgcgctcaggggtggctcc

SEQ ID NO: 329722 - DNA, 25 bp, Mus musculus
ctcgggacggcgcagtcgtcacttc

SEQ ID NO: 329723 - DNA, 25 bp, Mus musculus
ccctgagagggctaggctgcagcca

SEQ ID NO: 329724 - DNA, 25 bp, Mus musculus
caggccggtctaagtcccgagtcaa

SEQ ID NO: 329725 - DNA, 25 bp, Mus musculus
agggctggaaaagcagctgcacgca

SEQ ID NO: 329726 - DNA, 25 bp, Mus musculus
cgagtcaaaacaaccacctcagggg

SEQ ID NO: 329727 - DNA, 25 bp, Mus musculus
aaacaaccacctcaggggcgcaaca

SEQ ID NO: 329728 - DNA, 25 bp, Mus musculus
aggggcgcaacaccggccgagatct

SEQ ID NO: 329729 - DNA, 25 bp, Mus musculus
ggacgcaattcgagcgcgaccagca

SEQ ID NO: 329730 - DNA, 25 bp, Mus musculus
tcaaactttgttgctctcgggacgg

SEQ ID NO: 329731 - DNA, 25 bp, Mus musculus
gcgcgaccagcagactcaaactttg

SEQ ID NO: 329732 - DNA, 25 bp, Mus musculus
agtcgtcacttcctcgccgagcagg

SEQ ID NO: 329733 - DNA, 25 bp, Mus musculus
ccggcttagtcctgcgcttgcgcag

SEQ ID NO: 329734 - DNA, 25 bp, Mus musculus
cccgtaacaggtgctctccgttttg

SEQ ID NO: 329735 - DNA, 25 bp, Mus musculus
ttgggacgctagactagggaatgcc

SEQ ID NO: 329736 - DNA, 25 bp, Mus musculus
acaccggcggtatagcttgggacgc

SEQ ID NO: 329737 - DNA, 25 bp, Mus musculus
ttgcgcagtgtggtcctagggctaa

SEQ ID NO: 329738 - DNA, 25 bp, Mus musculus
gctctccgttttgtaagaattccga

SEQ ID NO: 329739 - DNA, 25 bp, Mus musculus
gacctgtgggcgtcctcctcgagct

SEQ ID NO: 329740 - DNA, 25 bp, Mus musculus
ggattaagcccgcagaaaaggagga

SEQ ID NO: 329741 - DNA, 25 bp, Mus musculus
ctgcaccggaagctggattaagccc

SEQ ID NO: 329742 - DNA, 25 bp, Mus musculus
gggccactgtatcgctgcaccggaa

SEQ ID NO: 329743 - DNA, 25 bp, Mus musculus
tctcaaactgacagacacgcagggg

SEQ ID NO: 329744 - DNA, 25 bp, Mus musculus
tcaaatcccgcgagatctcaaactg

SEQ ID NO: 329745 - DNA, 25 bp, Mus musculus
gctgacccttcgctgttcatcaaat

SEQ ID NO: 329746 - DNA, 25 bp, Mus musculus
tcctagggctaaggtcgtgccgcca

SEQ ID NO: 329747 - DNA, 25 bp, Mus musculus
cctaagggccttcggctgaggcctt

SEQ ID NO: 329748 - DNA, 25 bp, Mus musculus
tggtcccgccgagaaaggaagccac

SEQ ID NO: 329749 - DNA, 25 bp, Mus musculus
gaaaggaagccacttatggggtctg

SEQ ID NO: 329750 - DNA, 25 bp, Mus musculus
gccacttatggggtctggggatcta

SEQ ID NO: 329751 - DNA, 25 bp, Mus musculus
ggatctggggcgcaccgtttctcct

SEQ ID NO: 329752 - DNA, 25 bp, Mus musculus
gtttctcctcctttgcttgttcttg

SEQ ID NO: 329753 - DNA, 25 bp, Mus musculus
cctttgcttgttcttgagggaggga

SEQ ID NO: 329754 - DNA, 25 bp, Mus musculus
aaggtgagctccaggctagtgtagc

SEQ ID NO: 329755 - DNA, 25 bp, Mus musculus
gagctccaggctagtgtagccaccc

SEQ ID NO: 329756 - DNA, 25 bp, Mus musculus
aagggttgacagcggtgccctgccc

SEQ ID NO: 329757 - DNA, 25 bp, Mus musculus
ctgcccgagactggaaggtgagctc

SEQ ID NO: 329758 - DNA, 25 bp, Mus musculus
aagacgccgtgtgtggacgggattc

SEQ ID NO: 329759 - DNA, 25 bp, Mus musculus
ccgcagacctaagggccttcggctg

SEQ ID NO: 329760 - DNA, 25 bp, Mus musculus
agggagcttggagaccagcctgccc

SEQ ID NO: 329761 - DNA, 25 bp, Mus musculus
ggtggcggccaccaggacaccagca

SEQ ID NO: 329762 - DNA, 25 bp, Mus musculus
aggcttggaagatccgcccgcccga

SEQ ID NO: 329763 - DNA, 25 bp, Mus musculus
gcggaccctcggaggctgacagcct

SEQ ID NO: 329764 - DNA, 25 bp, Mus musculus
ctcggaaaagtcaactgcctccctg

SEQ ID NO: 329765 - DNA, 25 bp, Mus musculus
tgcctccctgaaagcgtttggcctg

SEQ ID NO: 329766 - DNA, 25 bp, Mus musculus
gccaccgagacagaagcagggatgc

SEQ ID NO: 329767 - DNA, 25 bp, Mus musculus
ggaagcgcttcaagcctcactggcg

SEQ ID NO: 329768 - DNA, 25 bp, Mus musculus
acaagtcgtgggaggctaagacgcc

SEQ ID NO: 329769 - DNA, 25 bp, Mus musculus
tttccttagagacggagtcggccca

SEQ ID NO: 329770 - DNA, 25 bp, Mus musculus
aagcacctgccacctagatccgggg

SEQ ID NO: 329771 - DNA, 25 bp, Mus musculus
accagcacggtgagactcccgcaga

SEQ ID NO: 329772 - DNA, 25 bp, Mus musculus
ctcccgcagaagtcaagatgccggc

SEQ ID NO: 329773 - DNA, 25 bp, Mus musculus
gtcggctggagccaagcacctgcca

SEQ ID NO: 329774 - DNA, 25 bp, Mus musculus
ctcaacggcgcggaggacgttagcc

SEQ ID NO: 329775 - DNA, 25 bp, Mus musculus
gcgctgcttagcagtgacgcagcag

SEQ ID NO: 329776 - DNA, 25 bp, Mus musculus
gtctacaagtccacgcgctcggcga

SEQ ID NO: 329777 - DNA, 25 bp, Mus musculus
aatgagagtctaggcgtcgtctaca

SEQ ID NO: 329778 - DNA, 25 bp, Mus musculus
aaaggggcctactgtgatctgagca

SEQ ID NO: 329779 - DNA, 25 bp, Mus musculus
tcgcagctccgcagtgacgtagccg

SEQ ID NO: 329780 - DNA, 25 bp, Mus musculus
cgcagtgacgtagccgcgctgctta

SEQ ID NO: 329781 - DNA, 25 bp, Mus musculus
ctccggagtcgaagatggcagaaca

SEQ ID NO: 329782 - DNA, 25 bp, Mus musculus
cgaagatggcagaacaagtttctca

SEQ ID NO: 329783 - DNA, 25 bp, Mus musculus
tttctcagggaaagtcggaggatca

SEQ ID NO: 329784 - DNA, 25 bp, Mus musculus
tcggaggatcaggtgtgcaccttcc

SEQ ID NO: 329785 - DNA, 25 bp, Mus musculus
gcagcggtaaacagaaaggggccta

SEQ ID NO: 329786 - DNA, 25 bp, Mus musculus
aagcgggcggcccacaatccgatga

SEQ ID NO: 329787 - DNA, 25 bp, Mus musculus
gcagctactgccagccgtttcggcg

SEQ ID NO: 329788 - DNA, 25 bp, Mus musculus
cagtagcgacgaaggatgctcggtt

SEQ ID NO: 329789 - DNA, 25 bp, Mus musculus
ctgtccggcagaagcatggtttaga

SEQ ID NO: 329790 - DNA, 25 bp, Mus musculus
agtgacagccctgacgcacgggtct

SEQ ID NO: 329791 - DNA, 25 bp, Mus musculus
gctgggccaagaagtctgtccggca

SEQ ID NO: 329792 - DNA, 25 bp, Mus musculus
ccggcagaagcatggtttagagacg

SEQ ID NO: 329793 - DNA, 25 bp, Mus musculus
gcggaaaggacccatttctaacatc

SEQ ID NO: 329794 - DNA, 25 bp, Mus musculus
ttctaacatcatggtccctcgtcgc

SEQ ID NO: 329795 - DNA, 25 bp, Mus musculus
tcgccaccctcactcgcctgcagga

SEQ ID NO: 329796 - DNA, 25 bp, Mus musculus
tgcaggatccgggaccgcattgctg

SEQ ID NO: 329797 - DNA, 25 bp, Mus musculus
atccgggaccgcattgctgccgctg

SEQ ID NO: 329798 - DNA, 25 bp, Mus musculus
gctgccagtgcctcccttgaagcaa

SEQ ID NO: 329799 - DNA, 25 bp, Mus musculus
gcctcccttgaagcaacaccgttaa

SEQ ID NO: 329800 - DNA, 25 bp, Mus musculus
tgaagcaacaccgttaagccacgcc

SEQ ID NO: 329801 - DNA, 25 bp, Mus musculus
ttaagccacgcccagaacacgaccg

SEQ ID NO: 329802 - DNA, 25 bp, Mus musculus
tctggtggaacacaaggggctgcaa

SEQ ID NO: 329803 - DNA, 25 bp, Mus musculus
cctcggagccgatcatgtagaactc

SEQ ID NO: 329804 - DNA, 25 bp, Mus musculus
aggaccgctctatctggaagcccga

SEQ ID NO: 329805 - DNA, 25 bp, Mus musculus
ttcctagtcgcatagccagagctgg

SEQ ID NO: 329806 - DNA, 25 bp, Mus musculus
ctcaggcggtagctttcctagtcgc

SEQ ID NO: 329807 - DNA, 25 bp, Mus musculus
accgaaatagccactgaggccctga

SEQ ID NO: 329808 - DNA, 25 bp, Mus musculus
ggaaaacctctcagcgaccgaaata

SEQ ID NO: 329809 - DNA, 25 bp, Mus musculus
agcgcgttcccgcaagcccttaaag

SEQ ID NO: 329810 - DNA, 25 bp, Mus musculus
cgcatgcgtggagaagctgacgcta

SEQ ID NO: 329811 - DNA, 25 bp, Mus musculus
gctccttggccgtctctgcaacgag

SEQ ID NO: 329812 - DNA, 25 bp, Mus musculus
cgctcgtgtcactactgggctcctt

SEQ ID NO: 329813 - DNA, 25 bp, Mus musculus
ccgaaggtcttgctcaacgccatca

SEQ ID NO: 329814 - DNA, 25 bp, Mus musculus
gctgaaacttgacgggcttctgccc

SEQ ID NO: 329815 - DNA, 25 bp, Mus musculus
ctcaggttttccacccgaaagtgcg

SEQ ID NO: 329816 - DNA, 25 bp, Mus musculus
ccgtcgtcctccagctgaaacttga

SEQ ID NO: 329817 - DNA, 25 bp, Mus musculus
ctgggcatttgttagctgcgcgctc

SEQ ID NO: 329818 - DNA, 25 bp, Mus musculus
tcggcatccaggagatcctaggctt

SEQ ID NO: 329819 - DNA, 25 bp, Mus musculus
ccagacggccagctccggtaggtga

SEQ ID NO: 329820 - DNA, 25 bp, Mus musculus
tcggggccgctggacaccagccaga

SEQ ID NO: 329821 - DNA, 25 bp, Mus musculus
caggtgcacagggttcggcatccag

SEQ ID NO: 329822 - DNA, 25 bp, Mus musculus
agagcgtccacttgcagccactagg

SEQ ID NO: 329823 - DNA, 25 bp, Mus musculus
tcctaggcttgaacaaggagcctcc

SEQ ID NO: 329824 - DNA, 25 bp, Mus musculus
gtccgatccgcagagcgtccacttg

SEQ ID NO: 329825 - DNA, 25 bp, Mus musculus
gggagcaaaagacccgcggcctcag

SEQ ID NO: 329826 - DNA, 25 bp, Mus musculus
gggaagcgctgagcaagcccaaatc

SEQ ID NO: 329827 - DNA, 25 bp, Mus musculus
cccaaatccgagacagtggccaaga

SEQ ID NO: 329828 - DNA, 25 bp, Mus musculus
tcttggaagtgctgtccgatccgca

SEQ ID NO: 329829 - DNA, 25 bp, Mus musculus
cacacagcccaccttcttggaagtg

SEQ ID NO: 329830 - DNA, 25 bp, Mus musculus
ttgcagccactaggcagagcgtcgg

SEQ ID NO: 329831 - DNA, 25 bp, Mus musculus
actccggtgagcgtggtgcggactc

SEQ ID NO: 329832 - DNA, 25 bp, Mus musculus
cgactgtggctctcttcgtccggct

SEQ ID NO: 329833 - DNA, 25 bp, Mus musculus
cggggcgactgtggctctcttcgtc

SEQ ID NO: 329834 - DNA, 25 bp, Mus musculus
agggaaaggcgctgcggaggcacaa

SEQ ID NO: 329835 - DNA, 25 bp, Mus musculus
gcgacagcggctgcgactccggtga

SEQ ID NO: 329836 - DNA, 25 bp, Mus musculus
gccgagcaggaacgaggcggcgaca

SEQ ID NO: 329837 - DNA, 25 bp, Mus musculus
aggcatccacagcagcggagcgggc

SEQ ID NO: 329838 - DNA, 25 bp, Mus musculus
tgccgccggagaggcatccacagca

SEQ ID NO: 329839 - DNA, 25 bp, Mus musculus
agggagggaggcagctagctcacga

SEQ ID NO: 329840 - DNA, 25 bp, Mus musculus
cgactctcgggctgaggctgccgcc

SEQ ID NO: 329841 - DNA, 25 bp, Mus musculus
gtggctctcttcgtccggctcgcga

SEQ ID NO: 329842 - DNA, 25 bp, Mus musculus
ccggagaggcatccacagcagcgga

SEQ ID NO: 329843 - DNA, 25 bp, Mus musculus
ctcttcgtccggctcgcgacgccct

SEQ ID NO: 329844 - DNA, 25 bp, Mus musculus
tcccgggcgccggatttggtggagc

SEQ ID NO: 329845 - DNA, 25 bp, Mus musculus
ggggtaccagcaacgccgtgcctgc

SEQ ID NO: 329846 - DNA, 25 bp, Mus musculus
tcggctttaaaccagaccaagaagc

SEQ ID NO: 329847 - DNA, 25 bp, Mus musculus
gattccgaagatgtttcctccagtg

SEQ ID NO: 329848 - DNA, 25 bp, Mus musculus
agccgacctggagaaggtcagcctg

SEQ ID NO: 329849 - DNA, 25 bp, Mus musculus
atctgtggtttcaagagccgacctg

SEQ ID NO: 329850 - DNA, 25 bp, Mus musculus
attctcacacgtccctgcgtgcagg

SEQ ID NO: 329851 - DNA, 25 bp, Mus musculus
atctcgaagcttggagcaccgccgg

SEQ ID NO: 329852 - DNA, 25 bp, Mus musculus
ttcctccagtgaccgaaaaatgtcc

SEQ ID NO: 329853 - DNA, 25 bp, Mus musculus
ccaagaagcgtaagaagcggcgaca

SEQ ID NO: 329854 - DNA, 25 bp, Mus musculus
cctctcttgcaacgaaatttatcca

SEQ ID NO: 329855 - DNA, 25 bp, Mus musculus
taagggccgcacagtcctttcctgc

SEQ ID NO: 329856 - DNA, 25 bp, Mus musculus
ccgggtgacccagatgtcgttttct

SEQ ID NO: 329857 - DNA, 25 bp, Mus musculus
cttcagtggagaccacaggcccgcg

SEQ ID NO: 329858 - DNA, 25 bp, Mus musculus
cgacacaggtaagggccgcacagtc

SEQ ID NO: 329859 - DNA, 25 bp, Mus musculus
tgtcagcggcgcgaagttaaacagg

SEQ ID NO: 329860 - DNA, 25 bp, Mus musculus
agcgccattgagcaaggcctctgga

SEQ ID NO: 329861 - DNA, 25 bp, Mus musculus
cgagccttggctcctgggtgcccag

SEQ ID NO: 329862 - DNA, 25 bp, Mus musculus
ctaagggttaagctgtcagcggcgc

SEQ ID NO: 329863 - DNA, 25 bp, Mus musculus
attgcagagtgaccggggcagccat

SEQ ID NO: 329864 - DNA, 25 bp, Mus musculus
gaagttaaacaggtgtcaaaggcgc

SEQ ID NO: 329865 - DNA, 25 bp, Mus musculus
cccatatatctgcagattgaaatca

SEQ ID NO: 329866 - DNA, 25 bp, Mus musculus
gaaatcaaattctttgccgtataaa

SEQ ID NO: 329867 - DNA, 25 bp, Mus musculus
gataaattacccaggcgctgccgcg

SEQ ID NO: 329868 - DNA, 25 bp, Mus musculus
cctctgcgccatctgccggtgatgg

SEQ ID NO: 329869 - DNA, 25 bp, Mus musculus
agcgccagacggcaagcaatttttt

SEQ ID NO: 329870 - DNA, 25 bp, Mus musculus
tttttaatgtgctaacgacctaatc

SEQ ID NO: 329871 - DNA, 25 bp, Mus musculus
cctaatcaagcaatcaagtcggaga

SEQ ID NO: 329872 - DNA, 25 bp, Mus musculus
tgcccaggcagctaagggttaagct

SEQ ID NO: 329873 - DNA, 25 bp, Mus musculus
ctagccctgctcacctggcaccagc

SEQ ID NO: 329874 - DNA, 25 bp, Mus musculus
tgctcacctggcaccagctcgggcc

SEQ ID NO: 329875 - DNA, 25 bp, Mus musculus
cgggaccgccatgacccgggatgca

SEQ ID NO: 329876 - DNA, 25 bp, Mus musculus
gtccctgacaacccggccgtcctca

SEQ ID NO: 329877 - DNA, 25 bp, Mus musculus
ggaccgccatgacccgggatgcaag

SEQ ID NO: 329878 - DNA, 25 bp, Mus musculus
atgcaagcgacgaggcgaccgagca

SEQ ID NO: 329879 - DNA, 25 bp, Mus musculus
ggcgaccgagcaagcccggtgtcct

SEQ ID NO: 329880 - DNA, 25 bp, Mus musculus
agatagagaagacggctccggcgct

SEQ ID NO: 329881 - DNA, 25 bp, Mus musculus
ggccgtcctcactagccctgctcac

SEQ ID NO: 329882 - DNA, 25 bp, Mus musculus
cacagagacgcgctagatagagaag

SEQ ID NO: 329883 - DNA, 25 bp, Mus musculus
cgcgctagatagagaagacggctcc

SEQ ID NO: 329884 - DNA, 25 bp, Mus musculus
aagcgacgaggcgaccgagcaagcc

SEQ ID NO: 329885 - DNA, 25 bp, Mus musculus
tgggactctggcgaccacagagacg

SEQ ID NO: 329886 - DNA, 25 bp, Mus musculus
gctagatagagaagacggctccggc

SEQ ID NO: 329887 - DNA, 25 bp, Mus musculus
ggctccttacctgtcgctctgcgga

SEQ ID NO: 329888 - DNA, 25 bp, Mus musculus
gcgctcagctctcagcccggcccga

SEQ ID NO: 329889 - DNA, 25 bp, Mus musculus
aagcttccaggagagctccctgctc

SEQ ID NO: 329890 - DNA, 25 bp, Mus musculus
ggagccaaaccctcttctccagctt

SEQ ID NO: 329891 - DNA, 25 bp, Mus musculus
tttctgcttcctggagccaaaccct

SEQ ID NO: 329892 - DNA, 25 bp, Mus musculus
aaccggcttttctgcttcctggagc

SEQ ID NO: 329893 - DNA, 25 bp, Mus musculus
gcgcgcagctggaaccggcttttct

SEQ ID NO: 329894 - DNA, 25 bp, Mus musculus
ccaccaggcactccggacccagctc

SEQ ID NO: 329895 - DNA, 25 bp, Mus musculus
ccgtgctcccttccacgctccagaa

SEQ ID NO: 329896 - DNA, 25 bp, Mus musculus
ccgccgctgcttcagaaccgtggac

SEQ ID NO: 329897 - DNA, 25 bp, Mus musculus
ccgcggtgaagcttccaggagagct

SEQ ID NO: 329898 - DNA, 25 bp, Mus musculus
agacggctccttacctgtcgctctg

SEQ ID NO: 329899 - DNA, 25 bp, Mus musculus
gtgcctagctctgcgctcccgctgc

SEQ ID NO: 329900 - DNA, 25 bp, Mus musculus
cgctccagaaccagcccaccaggca

SEQ ID NO: 329901 - DNA, 25 bp, Mus musculus
tggtaccgacccacttcggcaagtg

SEQ ID NO: 329902 - DNA, 25 bp, Mus musculus
gggcctacggagaactcgctctttg

SEQ ID NO: 329903 - DNA, 25 bp, Mus musculus
tcatctggtgccatttcccgggttc

SEQ ID NO: 329904 - DNA, 25 bp, Mus musculus
ggaagcgttctctgtcaatcaaagc

SEQ ID NO: 329905 - DNA, 25 bp, Mus musculus
tcgctatacccaataggcacgcttg

SEQ ID NO: 329906 - DNA, 25 bp, Mus musculus
agggccttgtccctaactgccgagg

SEQ ID NO: 329907 - DNA, 25 bp, Mus musculus
ggtatcgagggtggaacgtcactta

SEQ ID NO: 329908 - DNA, 25 bp, Mus musculus
ggttcgtctcccttctttacatcgc

SEQ ID NO: 329909 - DNA, 25 bp, Mus musculus
ttgggttctgcgtcttcaggataga

SEQ ID NO: 329910 - DNA, 25 bp, Mus musculus
cttggcagttcagaagaaagtgtcc

SEQ ID NO: 329911 - DNA, 25 bp, Mus musculus
tacgaggtgtccatagagggtcatc

SEQ ID NO: 329912 - DNA, 25 bp, Mus musculus
gcccaggagggctctagaagacttc

SEQ ID NO: 329913 - DNA, 25 bp, Mus musculus
cctcacagacagctgcgtccaggta

SEQ ID NO: 329914 - DNA, 25 bp, Mus musculus
tgacccgctgggaaacaacatcttc

SEQ ID NO: 329915 - DNA, 25 bp, Mus musculus
tgaaggcgtaactgtccgggatacc

SEQ ID NO: 329916 - DNA, 25 bp, Mus musculus
aggggacctctgaaacagccgtttg

SEQ ID NO: 329917 - DNA, 25 bp, Mus musculus
gaggtgctttccatcgttcgctcca

SEQ ID NO: 329918 - DNA, 25 bp, Mus musculus
cccatcaagacagccaggacaagtg

SEQ ID NO: 329919 - DNA, 25 bp, Mus musculus
ctggttcgtatctccctatggaatc

SEQ ID NO: 329920 - DNA, 25 bp, Mus musculus
tcgcatccctgctagctggttcgta

SEQ ID NO: 329921 - DNA, 25 bp, Mus musculus
acggggtgccacaaccgattcgcat

SEQ ID NO: 329922 - DNA, 25 bp, Mus musculus
agactgtacaccttggctgcagccg

SEQ ID NO: 329923 - DNA, 25 bp, Mus musculus
ttactgaggacaaagggacaggacc

SEQ ID NO: 329924 - DNA, 25 bp, Mus musculus
cttctccgagtctggacaggtggct

SEQ ID NO: 329925 - DNA, 25 bp, Mus musculus
caccctctttggcaccgagaagcga

SEQ ID NO: 329926 - DNA, 25 bp, Mus musculus
gacaggacccgcactccactgaagg

SEQ ID NO: 329927 - DNA, 25 bp, Mus musculus
tttcgcctcttttatccacgccatg

SEQ ID NO: 329928 - DNA, 25 bp, Mus musculus
tcaggctctcggaacagactgtaca

SEQ ID NO: 329929 - DNA, 25 bp, Mus musculus
gctgcgagcgattccggaagaaaca

SEQ ID NO: 329930 - DNA, 25 bp, Mus musculus
caattctggtgcctacggtcggctg

SEQ ID NO: 329931 - DNA, 25 bp, Mus musculus
gcctacggtcggctgggctctgcct

SEQ ID NO: 329932 - DNA, 25 bp, Mus musculus
tcgctcgccttcagcaattctggtg

SEQ ID NO: 329933 - DNA, 25 bp, Mus musculus
aagaaacaggagtgcggcgtgaaca

SEQ ID NO: 329934 - DNA, 25 bp, Mus musculus
taaagtgtcgcgctgcgagcgattc

SEQ ID NO: 329935 - DNA, 25 bp, Mus musculus
aggatgacgtaaagtgtcgcgctgc

SEQ ID NO: 329936 - DNA, 25 bp, Mus musculus
cctttgccggaaagagcgtgaggat

SEQ ID NO: 329937 - DNA, 25 bp, Mus musculus
ttaggagccggctcggagcttttac

SEQ ID NO: 329938 - DNA, 25 bp, Mus musculus
tcgatctccgccagcgttaggagcc

SEQ ID NO: 329939 - DNA, 25 bp, Mus musculus
aaaaatctccagtgtcgatctccgc

SEQ ID NO: 329940 - DNA, 25 bp, Mus musculus
caagtcctagttctggggtccgagg

SEQ ID NO: 329941 - DNA, 25 bp, Mus musculus
ctgcaacgtggccaagtcctagttc

SEQ ID NO: 329942 - DNA, 25 bp, Mus musculus
cggctgcggcgtgaagaaaaacgtt

SEQ ID NO: 329943 - DNA, 25 bp, Mus musculus
ttccgagagcaacacttggcgcagc

SEQ ID NO: 329944 - DNA, 25 bp, Mus musculus
ctcgatggtactgcgcatgcgtagt

SEQ ID NO: 329945 - DNA, 25 bp, Mus musculus
gaaggcggcaacagcgagtacctgc

SEQ ID NO: 329946 - DNA, 25 bp, Mus musculus
agtacctgcgccaaggttccctcta

SEQ ID NO: 329947 - DNA, 25 bp, Mus musculus
ggttccctctatctggcctttgttc

SEQ ID NO: 329948 - DNA, 25 bp, Mus musculus
tggcctttgttctccgctcgatggt

SEQ ID NO: 329949 - DNA, 25 bp, Mus musculus
atgcgtagttgcctcagcacggtcc

SEQ ID NO: 329950 - DNA, 25 bp, Mus musculus
cggcctgtaaggcaccgcgagttcc

SEQ ID NO: 329951 - DNA, 25 bp, Mus musculus
cccgcgccttcgtttcctatatgta

SEQ ID NO: 329952 - DNA, 25 bp, Mus musculus
tcctatatgtatccgaattggggcc

SEQ ID NO: 329953 - DNA, 25 bp, Mus musculus
tcaggcttcatgagcttccgagagc

SEQ ID NO: 329954 - DNA, 25 bp, Mus musculus
agcaaatgcagtgcgtgctccaacc

SEQ ID NO: 329955 - DNA, 25 bp, Mus musculus
cggctacggagactggcagccgcct

SEQ ID NO: 329956 - DNA, 25 bp, Mus musculus
tatggcgggagcagccactatccgc

SEQ ID NO: 329957 - DNA, 25 bp, Mus musculus
tagactgcccgggattcgtttgagc

SEQ ID NO: 329958 - DNA, 25 bp, Mus musculus
tcctctcgggcacacgcaggtttag

SEQ ID NO: 329959 - DNA, 25 bp, Mus musculus
aggtttagggtgcactgcctctgac

SEQ ID NO: 329960 - DNA, 25 bp, Mus musculus
tgcctctgaccggtctcccgaggaa

SEQ ID NO: 329961 - DNA, 25 bp, Mus musculus
gcaccctgggcctgactgcacaaag

SEQ ID NO: 329962 - DNA, 25 bp, Mus musculus
accgaggggtgaacctcactgctgc

SEQ ID NO: 329963 - DNA, 25 bp, Mus musculus
tccctcccgaccgtagttgtggtgc

SEQ ID NO: 329964 - DNA, 25 bp, Mus musculus
cacaaagctggcgtcctggagctcc

SEQ ID NO: 329965 - DNA, 25 bp, Mus musculus
aaacactactgtcgccctggccggt

SEQ ID NO: 329966 - DNA, 25 bp, Mus musculus
tccggactgtgtgtgactacccgta

SEQ ID NO: 329967 - DNA, 25 bp, Mus musculus
taaagtccgcttgtgcgcacctccg

SEQ ID NO: 329968 - DNA, 25 bp, Mus musculus
gtctctgagcaaggggctaaagtcc

SEQ ID NO: 329969 - DNA, 25 bp, Mus musculus
tgagcccatggcgtacagtcaagga

SEQ ID NO: 329970 - DNA, 25 bp, Mus musculus
gcggcaagaagaaagtgtgctacta

SEQ ID NO: 329971 - DNA, 25 bp, Mus musculus
caccgcagtcatgcctcggggaagc

SEQ ID NO: 329972 - DNA, 25 bp, Mus musculus
tgactctaaggacgctgccgtgtta

SEQ ID NO: 329973 - DNA, 25 bp, Mus musculus
cgtccgcagaatgaccttggagtct

SEQ ID NO: 329974 - DNA, 25 bp, Mus musculus
tgagggaaacgtgggtgctctccca

SEQ ID NO: 329975 - DNA, 25 bp, Mus musculus
accttggagtctgctgcgccatgtt

SEQ ID NO: 329976 - DNA, 25 bp, Mus musculus
cgtgagtctaaacgagggtcccact

SEQ ID NO: 329977 - DNA, 25 bp, Mus musculus
ggtcccactggaccctggagtagag

SEQ ID NO: 329978 - DNA, 25 bp, Mus musculus
tcccggagcattaaccttgtttctc

SEQ ID NO: 329979 - DNA, 25 bp, Mus musculus
cgggtcttatggctcagatggcatc

SEQ ID NO: 329980 - DNA, 25 bp, Mus musculus
agatggcatccaccgccgcaggcgt

SEQ ID NO: 329981 - DNA, 25 bp, Mus musculus
tctcccaagggcgtccgcagaatga

SEQ ID NO: 329982 - DNA, 25 bp, Mus musculus
cgcttcttactcagctccaacttga

SEQ ID NO: 329983 - DNA, 25 bp, Mus musculus
gctgctacggtccacgcttcttact

SEQ ID NO: 329984 - DNA, 25 bp, Mus musculus
tgccgtgttagttgcccggcactga

SEQ ID NO: 329985 - DNA, 25 bp, Mus musculus
ggccggtctcacttccggttgctgc

SEQ ID NO: 329986 - DNA, 25 bp, Mus musculus
ttacctgtcagcagcacgataaacg

SEQ ID NO: 329987 - DNA, 25 bp, Mus musculus
tcggagttaagagcacgataaacgt

SEQ ID NO: 329988 - DNA, 25 bp, Mus musculus
tcggtgttttgcgtctactttcgga

SEQ ID NO: 329989 - DNA, 25 bp, Mus musculus
atgacagagtttggccgactcggtg

SEQ ID NO: 329990 - DNA, 25 bp, Mus musculus
ggtctccaaactagcgcctggcagg

SEQ ID NO: 329991 - DNA, 25 bp, Mus musculus
ggcctgtctcttcgcggtctccaaa

SEQ ID NO: 329992 - DNA, 25 bp, Mus musculus
cgctcgctttctgccttccagaagg

SEQ ID NO: 329993 - DNA, 25 bp, Mus musculus
cacggttagtggttcgctccgaaca

SEQ ID NO: 329994 - DNA, 25 bp, Mus musculus
ccggcacccagcacggttagtggtt

SEQ ID NO: 329995 - DNA, 25 bp, Mus musculus
ggccttctcttgacagcgccacaga

SEQ ID NO: 329996 - DNA, 25 bp, Mus musculus
tcgaagaatactaacccaagttggc

SEQ ID NO: 329997 - DNA, 25 bp, Mus musculus
gccggatggttgtcctcgaagaata

SEQ ID NO: 329998 - DNA, 25 bp, Mus musculus
ccgcagcgacattgacttagagtta

SEQ ID NO: 329999 - DNA, 25 bp, Mus musculus
ggccgctggttttcaagaccgtgta

SEQ ID NO: 330000 - DNA, 25 bp, Mus musculus
tggttttcaagaccgtgtatggggc

SEQ ID NO: 330001 - DNA, 25 bp, Mus musculus
tagtcggccgctggttttcaagacc

SEQ ID NO: 330002 - DNA, 25 bp, Mus musculus
acgaactgaagctagtcggccgctg

SEQ ID NO: 330003 - DNA, 25 bp, Mus musculus
gcagcttccctacgaactgaagcta

SEQ ID NO: 330004 - DNA, 25 bp, Mus musculus
cggtttccttctcagactgcagctt

SEQ ID NO: 330005 - DNA, 25 bp, Mus musculus
agatgcggtttccttctcagactgc

SEQ ID NO: 330006 - DNA, 25 bp, Mus musculus
ccctcggagctaggcgttcattagc

SEQ ID NO: 330007 - DNA, 25 bp, Mus musculus
cgatgtgaaaggatcttaggggtcc

SEQ ID NO: 330008 - DNA, 25 bp, Mus musculus
ttaggggtccgatgaccctagctcc

SEQ ID NO: 330009 - DNA, 25 bp, Mus musculus
atgaccctagctcctctcgtgagtg

SEQ ID NO: 330010 - DNA, 25 bp, Mus musculus
tcctctcgtgagtgagcagaagtct

SEQ ID NO: 330011 - DNA, 25 bp, Mus musculus
gcagaagtctgaagatgcggtttcc

SEQ ID NO: 330012 - DNA, 25 bp, Mus musculus
gtcggagcgatgtgaaaggatctta

SEQ ID NO: 330013 - DNA, 25 bp, Mus musculus
ggagctcgagaatcggcaccaactg

SEQ ID NO: 330014 - DNA, 25 bp, Mus musculus
gttgaatgacactttcacaggggtc

SEQ ID NO: 330015 - DNA, 25 bp, Mus musculus
ggggataaccactaggcagttcctg

SEQ ID NO: 330016 - DNA, 25 bp, Mus musculus
cccatgaaggtcagactggagctca

SEQ ID NO: 330017 - DNA, 25 bp, Mus musculus
agactggagctcagccctcggctgt

SEQ ID NO: 330018 - DNA, 25 bp, Mus musculus
tgtcctgtgctcaccggaagcactg

SEQ ID NO: 330019 - DNA, 25 bp, Mus musculus
tctagtccctagttgccaaatttta

SEQ ID NO: 330020 - DNA, 25 bp, Mus musculus
agattctgcagctaccagggagctc

SEQ ID NO: 330021 - DNA, 25 bp, Mus musculus
ttcaagataagaaggggataaccac

SEQ ID NO: 330022 - DNA, 25 bp, Mus musculus
ggcaccaactgagagatagcgttta

SEQ ID NO: 330023 - DNA, 25 bp, Mus musculus
tagcgtttaacacagcgcttctcag

SEQ ID NO: 330024 - DNA, 25 bp, Mus musculus
gcgcttctcagcctgtgaaccagga

SEQ ID NO: 330025 - DNA, 25 bp, Mus musculus
actgcggtgaatgagaagattctgc

SEQ ID NO: 330026 - DNA, 25 bp, Mus musculus
taggcagttcctgctcaaactgagc

SEQ ID NO: 330027 - DNA, 25 bp, Mus musculus
tgcacgtgggagccgatgtgctcat

SEQ ID NO: 330028 - DNA, 25 bp, Mus musculus
ggggaagccgatgtgttcatgggca

SEQ ID NO: 330029 - DNA, 25 bp, Mus musculus
aagccgatgtgctcatgggcacggg

SEQ ID NO: 330030 - DNA, 25 bp, Mus musculus
ccgatgtgttcatgggcacgggaaa

SEQ ID NO: 330031 - DNA, 25 bp, Mus musculus
ggaagccgatgtgctcatgggcacg

SEQ ID NO: 330032 - DNA, 25 bp, Mus musculus
tgttcatgggcacgggaaagctgat

SEQ ID NO: 330033 - DNA, 25 bp, Mus musculus
cacgtgggagccgatgtgctcatgt

SEQ ID NO: 330034 - DNA, 25 bp, Mus musculus
ccgatgtgctcatgtgcacgtggga

SEQ ID NO: 330035 - DNA, 25 bp, Mus musculus
gagccgatgtgctcatgtgcacgtg

SEQ ID NO: 330036 - DNA, 25 bp, Mus musculus
tgggagccgatgtgctcatgtgcac

SEQ ID NO: 330037 - DNA, 25 bp, Mus musculus
agccgatgtgctcatgtgcacgtgg

SEQ ID NO: 330038 - DNA, 25 bp, Mus musculus
ggaagccgatgtgctcatgtgcacg

SEQ ID NO: 330039 - DNA, 25 bp, Mus musculus
ggcacgggaaagctgatgtgttcaa

SEQ ID NO: 330040 - DNA, 25 bp, Mus musculus
atgtgctcatgtgcacgtgggagcc

SEQ ID NO: 330041 - DNA, 25 bp, Mus musculus
ctcttgggtttcaggggaccttatg

SEQ ID NO: 330042 - DNA, 25 bp, Mus musculus
tcgcactcatggaggcgtctgccaa

SEQ ID NO: 330043 - DNA, 25 bp, Mus musculus
aggaaagccacttctgctggtcgca

SEQ ID NO: 330044 - DNA, 25 bp, Mus musculus
gagccgctcgctgttcccatagcaa

SEQ ID NO: 330045 - DNA, 25 bp, Mus musculus
aacacgtttctgattggcctcagca

SEQ ID NO: 330046 - DNA, 25 bp, Mus musculus
ggcgggcttacaactccacgaactc

SEQ ID NO: 330047 - DNA, 25 bp, Mus musculus
ttcaccgagcggaagttgacctctc

SEQ ID NO: 330048 - DNA, 25 bp, Mus musculus
cggcccggaagtgaaacagtgcttt

SEQ ID NO: 330049 - DNA, 25 bp, Mus musculus
tgctttggcaattgaggcttctgta

SEQ ID NO: 330050 - DNA, 25 bp, Mus musculus
cggcttatcacggaccaccactgga

SEQ ID NO: 330051 - DNA, 25 bp, Mus musculus
gtgcggcaactcatcctcgttcttg

SEQ ID NO: 330052 - DNA, 25 bp, Mus musculus
gatattcactttcaccgcgcgcctg

SEQ ID NO: 330053 - DNA, 25 bp, Mus musculus
agcagcacttttctgggcgtctcga

SEQ ID NO: 330054 - DNA, 25 bp, Mus musculus
ccgttcactcggtctctcttgggtt

SEQ ID NO: 330055 - DNA, 25 bp, Mus musculus
ggtggccaagctgcgcgtcccttca

SEQ ID NO: 330056 - DNA, 25 bp, Mus musculus
ccgcgcctgcgcaatccacccaccc

SEQ ID NO: 330057 - DNA, 25 bp, Mus musculus
agacaggcccgcggcagtcaccatt

SEQ ID NO: 330058 - DNA, 25 bp, Mus musculus
agtcaccattgctcctgtccagtta

SEQ ID NO: 330059 - DNA, 25 bp, Mus musculus
tgctcctgtccagttagacaagctc

SEQ ID NO: 330060 - DNA, 25 bp, Mus musculus
gctctctggaccacatttcatcacg

SEQ ID NO: 330061 - DNA, 25 bp, Mus musculus
cgctaaggtggccaagctgcgcgtc

SEQ ID NO: 330062 - DNA, 25 bp, Mus musculus
ctgcacgacgtctcagtgcgcaggc

SEQ ID NO: 330063 - DNA, 25 bp, Mus musculus
acggcgtctgcacgacgtctcagtg

SEQ ID NO: 330064 - DNA, 25 bp, Mus musculus
gagacaccgccagacggcgtctgca

SEQ ID NO: 330065 - DNA, 25 bp, Mus musculus
ggaccacatttcatcacgtgctttc

SEQ ID NO: 330066 - DNA, 25 bp, Mus musculus
gaccaaccacctccaacgccgagcg

SEQ ID NO: 330067 - DNA, 25 bp, Mus musculus
gctcccgagcatgcgcttccgagac

SEQ ID NO: 330068 - DNA, 25 bp, Mus musculus
agttagacaagctctctggaccaca

SEQ ID NO: 330069 - DNA, 25 bp, Mus musculus
caacgctgccctgcacgcccatcac

SEQ ID NO: 330070 - DNA, 25 bp, Mus musculus
ccggaagtttagagctcggcttctc

SEQ ID NO: 330071 - DNA, 25 bp, Mus musculus
tggtcggggagccttcgcctgctca

SEQ ID NO: 330072 - DNA, 25 bp, Mus musculus
aagaccttcagatcaaccgcccgag

SEQ ID NO: 330073 - DNA, 25 bp, Mus musculus
ccgccacttccggaagtttagagct

SEQ ID NO: 330074 - DNA, 25 bp, Mus musculus
tcccgctgcccttgcagccctgaag

SEQ ID NO: 330075 - DNA, 25 bp, Mus musculus
cgcccgagccgtgttaaccgccact

SEQ ID NO: 330076 - DNA, 25 bp, Mus musculus
aggagccgctgaacagccccgaaga

SEQ ID NO: 330077 - DNA, 25 bp, Mus musculus
gaagctcgagtttctggggcttccc

SEQ ID NO: 330078 - DNA, 25 bp, Mus musculus
ccgagcggcggaagctcgagtttct

SEQ ID NO: 330079 - DNA, 25 bp, Mus musculus
acacttggatgatccgagcggcgga

SEQ ID NO: 330080 - DNA, 25 bp, Mus musculus
ctccactgacacttggatgatccga

SEQ ID NO: 330081 - DNA, 25 bp, Mus musculus
ctgaagccgccatccatcctatccc

SEQ ID NO: 330082 - DNA, 25 bp, Mus musculus
tagagctcggcttctccaacgctgc

SEQ ID NO: 330083 - DNA, 25 bp, Mus musculus
tgcgcacatctggagctaaaagttc

SEQ ID NO: 330084 - DNA, 25 bp, Mus musculus
gcggctttcggattgcttgtggact

SEQ ID NO: 330085 - DNA, 25 bp, Mus musculus
cggattgcttgtggactgcgcctgc

SEQ ID NO: 330086 - DNA, 25 bp, Mus musculus
tcaggtgtggaaaactaggtcttgg

SEQ ID NO: 330087 - DNA, 25 bp, Mus musculus
gcacatctggagctaaaagttctca

SEQ ID NO: 330088 - DNA, 25 bp, Mus musculus
taaaagttctcaaccagaggcggtg

SEQ ID NO: 330089 - DNA, 25 bp, Mus musculus
gttctcaaccagaggcggtgctctg

SEQ ID NO: 330090 - DNA, 25 bp, Mus musculus
gctctggtctccaggcaacgggata

SEQ ID NO: 330091 - DNA, 25 bp, Mus musculus
ggtctccaggcaacgggataacaga

SEQ ID NO: 330092 - DNA, 25 bp, Mus musculus
caacgggataacagaggtggacaga

SEQ ID NO: 330093 - DNA, 25 bp, Mus musculus
ttagtcaggtgtggaaaactaggtc

SEQ ID NO: 330094 - DNA, 25 bp, Mus musculus
taggtcttggggattttccctgagc

SEQ ID NO: 330095 - DNA, 25 bp, Mus musculus
ctttcggattgcttgtggactgcgc

SEQ ID NO: 330096 - DNA, 25 bp, Mus musculus
gtcttggggattttccctgagctgg

SEQ ID NO: 330097 - DNA, 25 bp, Mus musculus
cggaaccgggagcacccacgtgacg

SEQ ID NO: 330098 - DNA, 25 bp, Mus musculus
cgcgcagacttagcgttcagggatg

SEQ ID NO: 330099 - DNA, 25 bp, Mus musculus
accgcgcagacttagcgttcaggga

SEQ ID NO: 330100 - DNA, 25 bp, Mus musculus
ccaccgcgcagacttagcgttcagg

SEQ ID NO: 330101 - DNA, 25 bp, Mus musculus
cgccgccgcaccttgaggtgggtgc

SEQ ID NO: 330102 - DNA, 25 bp, Mus musculus
cgccgcaccttgaggtgggtgcgca

SEQ ID NO: 330103 - DNA, 25 bp, Mus musculus
ctctgccctggcgaggccgtccgcg

SEQ ID NO: 330104 - DNA, 25 bp, Mus musculus
gccggaaccgggagcacccacgtga

SEQ ID NO: 330105 - DNA, 25 bp, Mus musculus
gaaccgggagcacccacgtgacgcg

SEQ ID NO: 330106 - DNA, 25 bp, Mus musculus
gagcacccacgtgacgcgcctctgc

SEQ ID NO: 330107 - DNA, 25 bp, Mus musculus
cccggactacgcctgccttcctgcc

SEQ ID NO: 330108 - DNA, 25 bp, Mus musculus
acgtgacgcgcctctgccctggcga

SEQ ID NO: 330109 - DNA, 25 bp, Mus musculus
cgcagacttagcgttcagggatgag

SEQ ID NO: 330110 - DNA, 25 bp, Mus musculus
accacccggggcctctagcgcgccg

SEQ ID NO: 330111 - DNA, 25 bp, Mus musculus
gagggatgacgtttgctctgtcgtc

SEQ ID NO: 330112 - DNA, 25 bp, Mus musculus
cggagcttcggctcccgcccgctct

SEQ ID NO: 330113 - DNA, 25 bp, Mus musculus
tgctctgtcgtctccatggctaaaa

SEQ ID NO: 330114 - DNA, 25 bp, Mus musculus
tggctaaaacgcatagacgtcaacg

SEQ ID NO: 330115 - DNA, 25 bp, Mus musculus
ctaaaacgcatagacgtcaacgccc

SEQ ID NO: 330116 - DNA, 25 bp, Mus musculus
cccagtgtttagtgtgtaatgttct

SEQ ID NO: 330117 - DNA, 25 bp, Mus musculus
gtgtaatgttctttggtctctatgg

SEQ ID NO: 330118 - DNA, 25 bp, Mus musculus
ttctttggtctctatgggaacgtca

SEQ ID NO: 330119 - DNA, 25 bp, Mus musculus
gtctctatgggaacgtcaggctgcc

SEQ ID NO: 330120 - DNA, 25 bp, Mus musculus
tatgggaacgtcaggctgcccaaca

SEQ ID NO: 330121 - DNA, 25 bp, Mus musculus
gaacgtcaggctgcccaacacagga

SEQ ID NO: 330122 - DNA, 25 bp, Mus musculus
caggaccccggcaacaggcttctga

SEQ ID NO: 330123 - DNA, 25 bp, Mus musculus
cgtctccatggctaaaacgcataga

SEQ ID NO: 330124 - DNA, 25 bp, Mus musculus
aggcttctgattggtcggaggctag

SEQ ID NO: 330125 - DNA, 25 bp, Mus musculus
gacgccgggtgagggccttctgcga

SEQ ID NO: 330126 - DNA, 25 bp, Mus musculus
agtcccggggaagcgagcgtggcta

SEQ ID NO: 330127 - DNA, 25 bp, Mus musculus
cccgcggcagtcactaggggcgccc

SEQ ID NO: 330128 - DNA, 25 bp, Mus musculus
ggcgcccgagtgagagaacgcgccc

SEQ ID NO: 330129 - DNA, 25 bp, Mus musculus
cgcccaggggccttgaggaaccaat

SEQ ID NO: 330130 - DNA, 25 bp, Mus musculus
ccttctgcgagtcccggggaagcga

SEQ ID NO: 330131 - DNA, 25 bp, Mus musculus
tgctggtgacctctgcgggagcgac

SEQ ID NO: 330132 - DNA, 25 bp, Mus musculus
gaggctcaggtacgcctgccgggag

SEQ ID NO: 330133 - DNA, 25 bp, Mus musculus
ccaatcacaggtcgccgtgggctag

SEQ ID NO: 330134 - DNA, 25 bp, Mus musculus
cagccaatcacaggtcgccgtgggc

SEQ ID NO: 330135 - DNA, 25 bp, Mus musculus
ccttgaggaaccaatcagatcggcg

SEQ ID NO: 330136 - DNA, 25 bp, Mus musculus
ggggccttgaggaaccaatcagatc

SEQ ID NO: 330137 - DNA, 25 bp, Mus musculus
caggggccttgaggaaccaatcaga

SEQ ID NO: 330138 - DNA, 25 bp, Mus musculus
cccaggggccttgaggaaccaatca

SEQ ID NO: 330139 - DNA, 25 bp, Mus musculus
gctcccgctgggtttggatctctaa

SEQ ID NO: 330140 - DNA, 25 bp, Mus musculus
cccgctgggtttggatctctaagaa

SEQ ID NO: 330141 - DNA, 25 bp, Mus musculus
tttggatctctaagaatggaggcta

SEQ ID NO: 330142 - DNA, 25 bp, Mus musculus
ctctaagaatggaggctaacgcaga

SEQ ID NO: 330143 - DNA, 25 bp, Mus musculus
aagaatggaggctaacgcagaggca

SEQ ID NO: 330144 - DNA, 25 bp, Mus musculus
ccgaacccgagggtgatgtcagtcg

SEQ ID NO: 330145 - DNA, 25 bp, Mus musculus
cgctccgtcgcctggagacggccct

SEQ ID NO: 330146 - DNA, 25 bp, Mus musculus
gcggcgctgtgttgctgtaaacagc

SEQ ID NO: 330147 - DNA, 25 bp, Mus musculus
ctgtgttgctgtaaacagccgcttc

SEQ ID NO: 330148 - DNA, 25 bp, Mus musculus
gttgctgtaaacagccgcttcgctg

SEQ ID NO: 330149 - DNA, 25 bp, Mus musculus
agccgcttcgctgttactatctata

SEQ ID NO: 330150 - DNA, 25 bp, Mus musculus
gcttcgctgttactatctatagaaa

SEQ ID NO: 330151 - DNA, 25 bp, Mus musculus
tctatagaaagatcgcctagctccc

SEQ ID NO: 330152 - DNA, 25 bp, Mus musculus
aaagatcgcctagctcccgggtgcg

SEQ ID NO: 330153 - DNA, 25 bp, Mus musculus
ggggccaacaagtctcgagcaaaga

SEQ ID NO: 330154 - DNA, 25 bp, Mus musculus
cggccgacttgtttctgagatcagc

SEQ ID NO: 330155 - DNA, 25 bp, Mus musculus
ctgcattcttctctcggccgacttg

SEQ ID NO: 330156 - DNA, 25 bp, Mus musculus
gtttattctgagtggcctgcctgca

SEQ ID NO: 330157 - DNA, 25 bp, Mus musculus
tctgagcgcgtgcacacttgtcata

SEQ ID NO: 330158 - DNA, 25 bp, Mus musculus
agagcagccttagcctgggaaccca

SEQ ID NO: 330159 - DNA, 25 bp, Mus musculus
cttcctttttcgctctggagggaga

SEQ ID NO: 330160 - DNA, 25 bp, Mus musculus
gcatgggctctcctgtcaacacaca

SEQ ID NO: 330161 - DNA, 25 bp, Mus musculus
gggacagcctttcctactaccattc

SEQ ID NO: 330162 - DNA, 25 bp, Mus musculus
aggcgtcatcctcccgctgcagtag

SEQ ID NO: 330163 - DNA, 25 bp, Mus musculus
ccatgatgttctcgggtttcaacgc

SEQ ID NO: 330164 - DNA, 25 bp, Mus musculus
ctgcagcgagcaactgagaagactg

SEQ ID NO: 330165 - DNA, 25 bp, Mus musculus
cgcccagtgacgtaggaagtccatc

SEQ ID NO: 330166 - DNA, 25 bp, Mus musculus
cgaaatcctacacgcggaaggtcta

SEQ ID NO: 330167 - DNA, 25 bp, Mus musculus
ttccgttctgcccatatttggaaag

SEQ ID NO: 330168 - DNA, 25 bp, Mus musculus
cgcttccgttctgcccatatttgga

SEQ ID NO: 330169 - DNA, 25 bp, Mus musculus
taggcgccgtcagcgcctcccgtca

SEQ ID NO: 330170 - DNA, 25 bp, Mus musculus
cggcgccgtgacgtctgcccgccgc

SEQ ID NO: 330171 - DNA, 25 bp, Mus musculus
cggtgacacgtaggcgccgtcagcg

SEQ ID NO: 330172 - DNA, 25 bp, Mus musculus
ccgtcagcgcctcccgtcagcggcc

SEQ ID NO: 330173 - DNA, 25 bp, Mus musculus
gccgcttccgttctgcccatatttg

SEQ ID NO: 330174 - DNA, 25 bp, Mus musculus
ccgttctgcccatatttggaaaggc

SEQ ID NO: 330175 - DNA, 25 bp, Mus musculus
ccgcttccgttctgcccatatttgg

SEQ ID NO: 330176 - DNA, 25 bp, Mus musculus
tctgcccatatttggaaaggcgccg

SEQ ID NO: 330177 - DNA, 25 bp, Mus musculus
tgcccatatttggaaaggcgccgcg

SEQ ID NO: 330178 - DNA, 25 bp, Mus musculus
cccgcaccgacccgaggagccatgg

SEQ ID NO: 330179 - DNA, 25 bp, Mus musculus
ttctgcccatatttggaaaggcgcc

SEQ ID NO: 330180 - DNA, 25 bp, Mus musculus
gcccatatttggaaaggcgccgcgg

SEQ ID NO: 330181 - DNA, 25 bp, Mus musculus
aagcttagggcctggctcctctgtt

SEQ ID NO: 330182 - DNA, 25 bp, Mus musculus
gggatcacgattttcgctttctgtg

SEQ ID NO: 330183 - DNA, 25 bp, Mus musculus
cagtcaaagcttagggcctggctcc

SEQ ID NO: 330184 - DNA, 25 bp, Mus musculus
ggctcctctgttcccggtggacgat

SEQ ID NO: 330185 - DNA, 25 bp, Mus musculus
cctctgttcccggtggacgatccgg

SEQ ID NO: 330186 - DNA, 25 bp, Mus musculus
cccggtggacgatccgggatcacga

SEQ ID NO: 330187 - DNA, 25 bp, Mus musculus
tggacgatccgggatcacgattttc

SEQ ID NO: 330188 - DNA, 25 bp, Mus musculus
gctagtggaggctgcagtcaaagct

SEQ ID NO: 330189 - DNA, 25 bp, Mus musculus
catcactgggctagtggaggctgca

SEQ ID NO: 330190 - DNA, 25 bp, Mus musculus
tcacgattttcgctttctgtgcccg

SEQ ID NO: 330191 - DNA, 25 bp, Mus musculus
ctgcagtcaaagcttagggcctggc

SEQ ID NO: 330192 - DNA, 25 bp, Mus musculus
atccgggatcacgattttcgctttc

SEQ ID NO: 330193 - DNA, 25 bp, Mus musculus
cgatccgggatcacgattttcgctt

SEQ ID NO: 330194 - DNA, 25 bp, Mus musculus
ccgggatcacgattttcgctttctg

SEQ ID NO: 330195 - DNA, 25 bp, Mus musculus
tcaggtatacacatggccgtacacc

SEQ ID NO: 330196 - DNA, 25 bp, Mus musculus
gcatgaatgcccataatcaggtata

SEQ ID NO: 330197 - DNA, 25 bp, Mus musculus
caccacgccataatttaaaaactgt

SEQ ID NO: 330198 - DNA, 25 bp, Mus musculus
gaagctatatcaatgtgtctattcc

SEQ ID NO: 330199 - DNA, 25 bp, Mus musculus
tttgaatattccttgaagctatatc

SEQ ID NO: 330200 - DNA, 25 bp, Mus musculus
aggcccacctaagcctttgaatatt

SEQ ID NO: 330201 - DNA, 25 bp, Mus musculus
tggacaggattgttaaaggtcctta

SEQ ID NO: 330202 - DNA, 25 bp, Mus musculus
aaaactgtttcaatggacaggattg

SEQ ID NO: 330203 - DNA, 25 bp, Mus musculus
tggccgtacaccacgccataattta

SEQ ID NO: 330204 - DNA, 25 bp, Mus musculus
agctttgaactactgcatgaatgcc

SEQ ID NO: 330205 - DNA, 25 bp, Mus musculus
tccagacatcagctttgaactactg

SEQ ID NO: 330206 - DNA, 25 bp, Mus musculus
ttgaaataagattccagacatcagc

SEQ ID NO: 330207 - DNA, 25 bp, Mus musculus
atacataaataatggtggagggtta

SEQ ID NO: 330208 - DNA, 25 bp, Mus musculus
tggagggttattgaaataagattcc

SEQ ID NO: 330209 - DNA, 25 bp, Mus musculus
acatgcggatgtaaaggaatctatc

SEQ ID NO: 330210 - DNA, 25 bp, Mus musculus
gctgggtactccgtagcaattaacg

SEQ ID NO: 330211 - DNA, 25 bp, Mus musculus
accgctgggtactccgtagcaatta

SEQ ID NO: 330212 - DNA, 25 bp, Mus musculus
agtgactaccgctgggtactccgta

SEQ ID NO: 330213 - DNA, 25 bp, Mus musculus
ccgcagtgactaccgctgggtactc

SEQ ID NO: 330214 - DNA, 25 bp, Mus musculus
agggcagtgccgcagtgactaccgc

SEQ ID NO: 330215 - DNA, 25 bp, Mus musculus
ctgatgtaaagcgatttgcggatgt

SEQ ID NO: 330216 - DNA, 25 bp, Mus musculus
ctctaaggagccgtgggtgtgtgca

SEQ ID NO: 330217 - DNA, 25 bp, Mus musculus
ttccagaagtctctaaggagccgtg

SEQ ID NO: 330218 - DNA, 25 bp, Mus musculus
gcggatgtaaaggaatctatcgaga

SEQ ID NO: 330219 - DNA, 25 bp, Mus musculus
gtaaagggcaataaacatgcggatg

SEQ ID NO: 330220 - DNA, 25 bp, Mus musculus
ttgcggatgtaaagggcaataaaca

SEQ ID NO: 330221 - DNA, 25 bp, Mus musculus
aagcgatttgcggatgtaaagggca

SEQ ID NO: 330222 - DNA, 25 bp, Mus musculus
tctatcgagattccagaagtctcta

SEQ ID NO: 330223 - DNA, 25 bp, Mus musculus
cgagatcctgcagcgtccgaagaca

SEQ ID NO: 330224 - DNA, 25 bp, Mus musculus
tgcctcccgggctgtgtagcatttt

SEQ ID NO: 330225 - DNA, 25 bp, Mus musculus
ggaccgcaatgctgccgggaccagc

SEQ ID NO: 330226 - DNA, 25 bp, Mus musculus
cgagcaggggatgcgcttacataac

SEQ ID NO: 330227 - DNA, 25 bp, Mus musculus
ctggaaggggttctctgctcatccg

SEQ ID NO: 330228 - DNA, 25 bp, Mus musculus
gcggaaccctcgctctggatttggg

SEQ ID NO: 330229 - DNA, 25 bp, Mus musculus
cccagggccggaatactctatcgga

SEQ ID NO: 330230 - DNA, 25 bp, Mus musculus
gacagtcctgtctgtggccgggaca

SEQ ID NO: 330231 - DNA, 25 bp, Mus musculus
cgtccgaagacaccactgcgcggaa

SEQ ID NO: 330232 - DNA, 25 bp, Mus musculus
agcggcttctgcacggtgggttcac

SEQ ID NO: 330233 - DNA, 25 bp, Mus musculus
actctatcggatggctgcagccgct

SEQ ID NO: 330234 - DNA, 25 bp, Mus musculus
tgctcctccgcggaaaaacaaaaca

SEQ ID NO: 330235 - DNA, 25 bp, Mus musculus
acaaaacaagcttgcgagatcctgc

SEQ ID NO: 330236 - DNA, 25 bp, Mus musculus
ttacataaccgctcgccgtgtcctg

SEQ ID NO: 330237 - DNA, 25 bp, Mus musculus
agttccgagacttgccgccgggccg

SEQ ID NO: 330238 - DNA, 25 bp, Mus musculus
actctctccggcctgcgttttgcga

SEQ ID NO: 330239 - DNA, 25 bp, Mus musculus
ccctttggagttccgagacttgccg

SEQ ID NO: 330240 - DNA, 25 bp, Mus musculus
atcacatggctagacccggagcggc

SEQ ID NO: 330241 - DNA, 25 bp, Mus musculus
tggccacgggcccaggatcacatgg

SEQ ID NO: 330242 - DNA, 25 bp, Mus musculus
gacttcccggacagcgtttgcgccg

SEQ ID NO: 330243 - DNA, 25 bp, Mus musculus
agcagccgtgctcctcccgaaccga

SEQ ID NO: 330244 - DNA, 25 bp, Mus musculus
ttagcaggactgtgtgcttgcgact

SEQ ID NO: 330245 - DNA, 25 bp, Mus musculus
cttccaagttgactttgcgggtgga

SEQ ID NO: 330246 - DNA, 25 bp, Mus musculus
ccggcctgcgttttgcgagtgtagc

SEQ ID NO: 330247 - DNA, 25 bp, Mus musculus
ggtgggcgtcctccactctctccgg

SEQ ID NO: 330248 - DNA, 25 bp, Mus musculus
tcctggagttagcaggactgtgtgc

SEQ ID NO: 330249 - DNA, 25 bp, Mus musculus
atggcggacggcctggaaccctttg

SEQ ID NO: 330250 - DNA, 25 bp, Mus musculus
ccaggatcacatggctagacccgga

SEQ ID NO: 330251 - DNA, 25 bp, Mus musculus
tttctccgctaacagaggtgcgctc

SEQ ID NO: 330252 - DNA, 25 bp, Mus musculus
cgtaggaacctgagatctcgatttc

SEQ ID NO: 330253 - DNA, 25 bp, Mus musculus
acaacagtttgctagggagtgatcg

SEQ ID NO: 330254 - DNA, 25 bp, Mus musculus
caacgcttcatctggacagcctgga

SEQ ID NO: 330255 - DNA, 25 bp, Mus musculus
tttccaggacggtcaacgcttcatc

SEQ ID NO: 330256 - DNA, 25 bp, Mus musculus
cgctgttcaggagtcaaactttttc

SEQ ID NO: 330257 - DNA, 25 bp, Mus musculus
aggcgaagtcctcatttaccaacga

SEQ ID NO: 330258 - DNA, 25 bp, Mus musculus
ttaccaacgaagacctctgggagtg

SEQ ID NO: 330259 - DNA, 25 bp, Mus musculus
ggacgtcggagaggaatgtacaccc

SEQ ID NO: 330260 - DNA, 25 bp, Mus musculus
caacctatggcgaaacaagagcggc

SEQ ID NO: 330261 - DNA, 25 bp, Mus musculus
cccgctcaaggaggcaggggatcct

SEQ ID NO: 330262 - DNA, 25 bp, Mus musculus
gccctgccacagttcgctgttcagg

SEQ ID NO: 330263 - DNA, 25 bp, Mus musculus
gctaaccgggcggtttccatgacac

SEQ ID NO: 330264 - DNA, 25 bp, Mus musculus
agactctgacctcggaagggcgtga

SEQ ID NO: 330265 - DNA, 25 bp, Mus musculus
acagcctgggttggctctggtgtct

SEQ ID NO: 330266 - DNA, 25 bp, Mus musculus
agaaaccttctggtgacagcctggg

SEQ ID NO: 330267 - DNA, 25 bp, Mus musculus
aaaggagccaagaaaccttctggtg

SEQ ID NO: 330268 - DNA, 25 bp, Mus musculus
gaaaacgcagagagaaaaaggagcc

SEQ ID NO: 330269 - DNA, 25 bp, Mus musculus
gcgccgtggtgacgccatccgtcag

SEQ ID NO: 330270 - DNA, 25 bp, Mus musculus
ctctgagtttggagtcagtctttta

SEQ ID NO: 330271 - DNA, 25 bp, Mus musculus
cggaactctgagtttggagtcagtc

SEQ ID NO: 330272 - DNA, 25 bp, Mus musculus
cttctgtcgagcgtggcggaactct

SEQ ID NO: 330273 - DNA, 25 bp, Mus musculus
gctcacgcggtaaacccttctgtcg

SEQ ID NO: 330274 - DNA, 25 bp, Mus musculus
gcagccgagcgttgttcgcgccgct

SEQ ID NO: 330275 - DNA, 25 bp, Mus musculus
tgagacaggtaaacgcctgcgccgg

SEQ ID NO: 330276 - DNA, 25 bp, Mus musculus
ccgtgagaagatgagacaggtaaac

SEQ ID NO: 330277 - DNA, 25 bp, Mus musculus
cggttgcttgttggttgttgtagta

SEQ ID NO: 330278 - DNA, 25 bp, Mus musculus
taaacccttctgtcgagcgtggcgg

SEQ ID NO: 330279 - DNA, 25 bp, Mus musculus
tcaggctccacgcaagagcaagggc

SEQ ID NO: 330280 - DNA, 25 bp, Mus musculus
cgcaagcaccaagatcgtgtccacg

SEQ ID NO: 330281 - DNA, 25 bp, Mus musculus
cgccagtgacagaggcatggaggct

SEQ ID NO: 330282 - DNA, 25 bp, Mus musculus
acagaccggggacacacgctaggtt

SEQ ID NO: 330283 - DNA, 25 bp, Mus musculus
acacgctaggttcgctaggggagca

SEQ ID NO: 330284 - DNA, 25 bp, Mus musculus
gcgatcgggccactctcattccagg

SEQ ID NO: 330285 - DNA, 25 bp, Mus musculus
ctcggccgcgatcctggcagcggtt

SEQ ID NO: 330286 - DNA, 25 bp, Mus musculus
tggcagcggttcttcattgaccatc

SEQ ID NO: 330287 - DNA, 25 bp, Mus musculus
ttgaccatcccgatccgagcggctg

SEQ ID NO: 330288 - DNA, 25 bp, Mus musculus
atcccgatccgagcggctgctgctg

SEQ ID NO: 330289 - DNA, 25 bp, Mus musculus
tgctggggtaaacgacagcgctttc

SEQ ID NO: 330290 - DNA, 25 bp, Mus musculus
agatcgtgtccacggctcaggctcc

SEQ ID NO: 330291 - DNA, 25 bp, Mus musculus
acgacagcgctttctggaaggccga

SEQ ID NO: 330292 - DNA, 25 bp, Mus musculus
ttctggaaggccgagggtgccctct

SEQ ID NO: 330293 - DNA, 25 bp, Mus musculus
ctctaagagcttgtcactcagcgca

SEQ ID NO: 330294 - DNA, 25 bp, Mus musculus
agcgcaagcgcattttctgtccctg

SEQ ID NO: 330295 - DNA, 25 bp, Mus musculus
gccggtcgcattgggccttaaggct

SEQ ID NO: 330296 - DNA, 25 bp, Mus musculus
tgctggtagctgtagatagtcttga

SEQ ID NO: 330297 - DNA, 25 bp, Mus musculus
tgtgtataaactcggtgctggtagc

SEQ ID NO: 330298 - DNA, 25 bp, Mus musculus
tgcgcaagcgcagtgtgtataaact

SEQ ID NO: 330299 - DNA, 25 bp, Mus musculus
gagcactccagctggccgaagagca

SEQ ID NO: 330300 - DNA, 25 bp, Mus musculus
tggacctgcgcaagcgcggagcact

SEQ ID NO: 330301 - DNA, 25 bp, Mus musculus
agacgatgcccacccgaagcctgag

SEQ ID NO: 330302 - DNA, 25 bp, Mus musculus
acgcaggtgagaaagtgtaaggatc

SEQ ID NO: 330303 - DNA, 25 bp, Mus musculus
gtaaggatcgacttaccgggagatc

SEQ ID NO: 330304 - DNA, 25 bp, Mus musculus
agatctgtgggaagactggactccg

SEQ ID NO: 330305 - DNA, 25 bp, Mus musculus
ccttaaggctgcaagacgcaggtga

SEQ ID NO: 330306 - DNA, 25 bp, Mus musculus
ctccgctgaattctaggctatacca

SEQ ID NO: 330307 - DNA, 25 bp, Mus musculus
tctagtcccggaagttctgaaaggc

SEQ ID NO: 330308 - DNA, 25 bp, Mus musculus
agtgcgaatcccaccttagcggagg

SEQ ID NO: 330309 - DNA, 25 bp, Mus musculus
gggctcaaccgcctaagtgcgaatc

SEQ ID NO: 330310 - DNA, 25 bp, Mus musculus
aaatccgggctcaaccgcctaagtg

SEQ ID NO: 330311 - DNA, 25 bp, Mus musculus
gggagtctggacaaatccgggctca

SEQ ID NO: 330312 - DNA, 25 bp, Mus musculus
atggcacggctctctgagaagctgg

SEQ ID NO: 330313 - DNA, 25 bp, Mus musculus
ggacaaatggcacggctctctgaga

SEQ ID NO: 330314 - DNA, 25 bp, Mus musculus
acgatttactggacctgggcgagga

SEQ ID NO: 330315 - DNA, 25 bp, Mus musculus
aatcccaccttagcggagggtctgc

SEQ ID NO: 330316 - DNA, 25 bp, Mus musculus
ccacctccgtgaggagcgatgctgg

SEQ ID NO: 330317 - DNA, 25 bp, Mus musculus
ctgccgcggcgatggacgatttact

SEQ ID NO: 330318 - DNA, 25 bp, Mus musculus
gagagacgtcgcagctcggccacct

SEQ ID NO: 330319 - DNA, 25 bp, Mus musculus
aggaagtgacatcagctgccgcggc

SEQ ID NO: 330320 - DNA, 25 bp, Mus musculus
agacgccggtttccaggaagtgaca

SEQ ID NO: 330321 - DNA, 25 bp, Mus musculus
ctgacccgtgtattaggggcctgta

SEQ ID NO: 330322 - DNA, 25 bp, Mus musculus
gccggagagaattacttaaccctga

SEQ ID NO: 330323 - DNA, 25 bp, Mus musculus
ttcgcttaagttgccggagagaatt

SEQ ID NO: 330324 - DNA, 25 bp, Mus musculus
gcctcttacggcagagaacaattta

SEQ ID NO: 330325 - DNA, 25 bp, Mus musculus
cggcagagaacaatttattagcgcc

SEQ ID NO: 330326 - DNA, 25 bp, Mus musculus
agccgctgccagcttcattattcgc

SEQ ID NO: 330327 - DNA, 25 bp, Mus musculus
caggcgcctcttacggcagagaaca

SEQ ID NO: 330328 - DNA, 25 bp, Mus musculus
taaatgaagacaaagtgccggcggc

SEQ ID NO: 330329 - DNA, 25 bp, Mus musculus
ccgccgctggcataataaatgaaga

SEQ ID NO: 330330 - DNA, 25 bp, Mus musculus
tatctcctcgcggaggcttccagtc

SEQ ID NO: 330331 - DNA, 25 bp, Mus musculus
cgaaatgaagcgatatctcctcgcg

SEQ ID NO: 330332 - DNA, 25 bp, Mus musculus
aggggcctgtattaatgccgcgaca

SEQ ID NO: 330333 - DNA, 25 bp, Mus musculus
taatgccgcgacaggcgcctcttac

SEQ ID NO: 330334 - DNA, 25 bp, Mus musculus
ttcattattcgcttaagttgccgga

SEQ ID NO: 330335 - DNA, 25 bp, Mus musculus
gggccgcctccgtggcgacagtccc

SEQ ID NO: 330336 - DNA, 25 bp, Mus musculus
ctgtctcttcggtgggcgacagcga

SEQ ID NO: 330337 - DNA, 25 bp, Mus musculus
cactctgtctcttcggtgggcgaca

SEQ ID NO: 330338 - DNA, 25 bp, Mus musculus
agcgagagcttaggcttggtgtccc

SEQ ID NO: 330339 - DNA, 25 bp, Mus musculus
cccgcctaccgtggagcggaagtgg

SEQ ID NO: 330340 - DNA, 25 bp, Mus musculus
tgccctaggcgcgtcttcccagcct

SEQ ID NO: 330341 - DNA, 25 bp, Mus musculus
ttgtgtcagggcgaccgagggcaca

SEQ ID NO: 330342 - DNA, 25 bp, Mus musculus
ccgggtgcaagcgactgcggcagcc

SEQ ID NO: 330343 - DNA, 25 bp, Mus musculus
acctcttaggcccagaccggaaatg

SEQ ID NO: 330344 - DNA, 25 bp, Mus musculus
ggcgctcgtcctttcttgtagcccg

SEQ ID NO: 330345 - DNA, 25 bp, Mus musculus
ccaggctgggagctacggccccgaa

SEQ ID NO: 330346 - DNA, 25 bp, Mus musculus
cttaggcccagaccggaaatgaggt

SEQ ID NO: 330347 - DNA, 25 bp, Mus musculus
ggcccagaccggaaatgaggtcaga

SEQ ID NO: 330348 - DNA, 25 bp, Mus musculus
aaatgaggtcagagagggaaaccca

SEQ ID NO: 330349 - DNA, 25 bp, Mus musculus
gtctgactcctttacggaaaacgca

SEQ ID NO: 330350 - DNA, 25 bp, Mus musculus
ctcaccaacttcagtgactctgatg

SEQ ID NO: 330351 - DNA, 25 bp, Mus musculus
cgagaagtggctccgctcaccaact

SEQ ID NO: 330352 - DNA, 25 bp, Mus musculus
agccaccaaggactgccgagaagtg

SEQ ID NO: 330353 - DNA, 25 bp, Mus musculus
ggcctctgagtcaagtctggatgaa

SEQ ID NO: 330354 - DNA, 25 bp, Mus musculus
tgctgcttcagcgaggcctctgagt

SEQ ID NO: 330355 - DNA, 25 bp, Mus musculus
ttactcacctggcagagcacgcctg

SEQ ID NO: 330356 - DNA, 25 bp, Mus musculus
gtggtggccaaacggcacccagctc

SEQ ID NO: 330357 - DNA, 25 bp, Mus musculus
cagcttcgcaaacgccgaggacgga

SEQ ID NO: 330358 - DNA, 25 bp, Mus musculus
ccatcattaggggtaagcaacattc

SEQ ID NO: 330359 - DNA, 25 bp, Mus musculus
gactctgatgacacggtggtggcca

SEQ ID NO: 330360 - DNA, 25 bp, Mus musculus
gctctcagtgccatcattaggggta

SEQ ID NO: 330361 - DNA, 25 bp, Mus musculus
agcaacattcttggcccgagtctga

SEQ ID NO: 330362 - DNA, 25 bp, Mus musculus
gaagcgccggtctgactttactcac

SEQ ID NO: 330363 - DNA, 25 bp, Mus musculus
ttccggcgttgacgctccaggatgt

SEQ ID NO: 330364 - DNA, 25 bp, Mus musculus
ctttttcaagatgaccaccttggcg

SEQ ID NO: 330365 - DNA, 25 bp, Mus musculus
acgtttagcaagtccgagcgtgttc

SEQ ID NO: 330366 - DNA, 25 bp, Mus musculus
cgagcgtgttcgatcttctttagca

SEQ ID NO: 330367 - DNA, 25 bp, Mus musculus
actgctgctgcctcgcctgcagttt

SEQ ID NO: 330368 - DNA, 25 bp, Mus musculus
caggctcttcgcttttgctggaaca

SEQ ID NO: 330369 - DNA, 25 bp, Mus musculus
gcacgtactcggtggcctttttcaa

SEQ ID NO: 330370 - DNA, 25 bp, Mus musculus
tcgctcttgatctttttctgcgggg

SEQ ID NO: 330371 - DNA, 25 bp, Mus musculus
tggcggccttctcgttcttcaccag

SEQ ID NO: 330372 - DNA, 25 bp, Mus musculus
ggcacatggtccctgagcgtcagga

SEQ ID NO: 330373 - DNA, 25 bp, Mus musculus
tcgctgtcctccgagtctgagtttc

SEQ ID NO: 330374 - DNA, 25 bp, Mus musculus
tttgctggaacaacacttttgaggg

SEQ ID NO: 330375 - DNA, 25 bp, Mus musculus
cgtggagaagcctcgctcttgatct

SEQ ID NO: 330376 - DNA, 25 bp, Mus musculus
tttccagcaggagctggtgctcgtt

SEQ ID NO: 330377 - DNA, 25 bp, Mus musculus
ccttggctaccacaaccagtaggtg

SEQ ID NO: 330378 - DNA, 25 bp, Mus musculus
gttctgtcccgtcctaggaatcctc

SEQ ID NO: 330379 - DNA, 25 bp, Mus musculus
acacgactctgggtagctcctggtt

SEQ ID NO: 330380 - DNA, 25 bp, Mus musculus
actgggaatgctaaaacgggactga

SEQ ID NO: 330381 - DNA, 25 bp, Mus musculus
gactgtccttctgcccatccaagtg

SEQ ID NO: 330382 - DNA, 25 bp, Mus musculus
cctggatgtcgcagttcctcttcta

SEQ ID NO: 330383 - DNA, 25 bp, Mus musculus
cgcacacttgctccgggtttcttaa

SEQ ID NO: 330384 - DNA, 25 bp, Mus musculus
ctgagcaacgccagtacgtcggtta

SEQ ID NO: 330385 - DNA, 25 bp, Mus musculus
ggcgctttgctttctatcctgggta

SEQ ID NO: 330386 - DNA, 25 bp, Mus musculus
ttcagccagggccagaaaaatcagg

SEQ ID NO: 330387 - DNA, 25 bp, Mus musculus
acttttagacaacagcggcgctttc

SEQ ID NO: 330388 - DNA, 25 bp, Mus musculus
ggcgctttctcgctcactctgaatt

SEQ ID NO: 330389 - DNA, 25 bp, Mus musculus
actctgaatttgctccgcggtgaca

SEQ ID NO: 330390 - DNA, 25 bp, Mus musculus
cgcctttctcctccaactgggaatg

SEQ ID NO: 330391 - DNA, 25 bp, Mus musculus
ctcacttagaactgactcccgcgtt

SEQ ID NO: 330392 - DNA, 25 bp, Mus musculus
tttggcattgccctgagcacccacg

SEQ ID NO: 330393 - DNA, 25 bp, Mus musculus
tgcgagtacatgcttaacgccatcc

SEQ ID NO: 330394 - DNA, 25 bp, Mus musculus
ctccgccatcaaatgcgagtacatg

SEQ ID NO: 330395 - DNA, 25 bp, Mus musculus
tactagtggtatcatggaggactcc

SEQ ID NO: 330396 - DNA, 25 bp, Mus musculus
tgccgcaagagctacgaggactgta

SEQ ID NO: 330397 - DNA, 25 bp, Mus musculus
actcgccgcctatgttcgcaggtgc

SEQ ID NO: 330398 - DNA, 25 bp, Mus musculus
tccagcccgtcctcgggcattgatg

SEQ ID NO: 330399 - DNA, 25 bp, Mus musculus
agttgcggctccttcatcaagacgg

SEQ ID NO: 330400 - DNA, 25 bp, Mus musculus
tgtcgtccgaagacaggcacctggg

SEQ ID NO: 330401 - DNA, 25 bp, Mus musculus
actcccgcgttctgtgttcgcaggc

SEQ ID NO: 330402 - DNA, 25 bp, Mus musculus
atgtggcccgcccactaggccatag

SEQ ID NO: 330403 - DNA, 25 bp, Mus musculus
atacccgtagacacgcccatgtggc

SEQ ID NO: 330404 - DNA, 25 bp, Mus musculus
caggctgctgaaccgaatgtcgtcc

SEQ ID NO: 330405 - DNA, 25 bp, Mus musculus
gtaataaacttcctccgcaactctg

SEQ ID NO: 330406 - DNA, 25 bp, Mus musculus
cttttgcccgctcatgctgcagctg

SEQ ID NO: 330407 - DNA, 25 bp, Mus musculus
gccacaattccttccgcgctaggaa

SEQ ID NO: 330408 - DNA, 25 bp, Mus musculus
tgggaccgtttagcgccaggtgcac

SEQ ID NO: 330409 - DNA, 25 bp, Mus musculus
ccgctctccacgatggctgagcttg

SEQ ID NO: 330410 - DNA, 25 bp, Mus musculus
ggaaccctagcgcagcatccttttg

SEQ ID NO: 330411 - DNA, 25 bp, Mus musculus
gccctcgctttgtcagtggattcca

SEQ ID NO: 330412 - DNA, 25 bp, Mus musculus
atgggctgcaccttctcaggctgtt

SEQ ID NO: 330413 - DNA, 25 bp, Mus musculus
acccggtgcgaaagcgctggccctt

SEQ ID NO: 330414 - DNA, 25 bp, Mus musculus
cagcagcaggacgacgacccggtgc

SEQ ID NO: 330415 - DNA, 25 bp, Mus musculus
ataacttgtagctaggggcttcggg

SEQ ID NO: 330416 - DNA, 25 bp, Mus musculus
cagggcatccctgcaataacttgta

SEQ ID NO: 330417 - DNA, 25 bp, Mus musculus
cgctgtgtggcgagtaataaacttc

SEQ ID NO: 330418 - DNA, 25 bp, Mus musculus
tctttagctcagctgggaccgttta

SEQ ID NO: 330419 - DNA, 25 bp, Mus musculus
agtgtgtgtcccacgacccgcacag

SEQ ID NO: 330420 - DNA, 25 bp, Mus musculus
cagattgaatggaagcactcggtgc

SEQ ID NO: 330421 - DNA, 25 bp, Mus musculus
agctggagcgtcatgcccgagacat

SEQ ID NO: 330422 - DNA, 25 bp, Mus musculus
tgcccgagacatgcggctcaaggtt

SEQ ID NO: 330423 - DNA, 25 bp, Mus musculus
cggctcaaggttagcatcggcaatg

SEQ ID NO: 330424 - DNA, 25 bp, Mus musculus
tagcatcggcaatgggtccacgaga

SEQ ID NO: 330425 - DNA, 25 bp, Mus musculus
cccgcacagtgtggaacagattgaa

SEQ ID NO: 330426 - DNA, 25 bp, Mus musculus
ctatggcgccctgggtatgagccga

SEQ ID NO: 330427 - DNA, 25 bp, Mus musculus
agccgaagggaggacctgatgtaca

SEQ ID NO: 330428 - DNA, 25 bp, Mus musculus
aggacctgatgtacaaaccgcccgc

SEQ ID NO: 330429 - DNA, 25 bp, Mus musculus
cttccgcacgctcagtgagctcgtg

SEQ ID NO: 330430 - DNA, 25 bp, Mus musculus
ctcagtgagctcgtgctggactacg

SEQ ID NO: 330431 - DNA, 25 bp, Mus musculus
gccgctgctggcacgtgctgaagaa

SEQ ID NO: 330432 - DNA, 25 bp, Mus musculus
ctggactacgaagcggcctacggcc

SEQ ID NO: 330433 - DNA, 25 bp, Mus musculus
gcggctggcagcagcaggtaataca

SEQ ID NO: 330434 - DNA, 25 bp, Mus musculus
actcccgggagtatttcagcctgcc

SEQ ID NO: 330435 - DNA, 25 bp, Mus musculus
ccaggaccaccgctactgtcaagga

SEQ ID NO: 330436 - DNA, 25 bp, Mus musculus
accgctactgtcaaggaggacgccc

SEQ ID NO: 330437 - DNA, 25 bp, Mus musculus
cagccctaggtccacgttaaccgtg

SEQ ID NO: 330438 - DNA, 25 bp, Mus musculus
acgtcaccagaccacagcgtgagga

SEQ ID NO: 330439 - DNA, 25 bp, Mus musculus
gcctcacactttgcctctaagcaga

SEQ ID NO: 330440 - DNA, 25 bp, Mus musculus
agaggactgcggtcctgaggcctca

SEQ ID NO: 330441 - DNA, 25 bp, Mus musculus
gcgcaaggccggtacctgagagaaa

SEQ ID NO: 330442 - DNA, 25 bp, Mus musculus
gtaatacaggcacgacgcgatcatg

SEQ ID NO: 330443 - DNA, 25 bp, Mus musculus
ccacgctagcaaggctctgccttga

SEQ ID NO: 330444 - DNA, 25 bp, Mus musculus
ggctctgccttgagccgcctaggct

SEQ ID NO: 330445 - DNA, 25 bp, Mus musculus
aaaagcacatccgtccctaactcta

SEQ ID NO: 330446 - DNA, 25 bp, Mus musculus
cgtggagctcaacaggggcagccct

SEQ ID NO: 330447 - DNA, 25 bp, Mus musculus
gcggctcaccttcggacagctccag

SEQ ID NO: 330448 - DNA, 25 bp, Mus musculus
tccagagggcatccgcggtcggcca

SEQ ID NO: 330449 - DNA, 25 bp, Mus musculus
cgcccagcaactttaaaggctcggt

SEQ ID NO: 330450 - DNA, 25 bp, Mus musculus
aaaggctcggttccattggccaata

SEQ ID NO: 330451 - DNA, 25 bp, Mus musculus
ttggccaataagacacgccggagca

SEQ ID NO: 330452 - DNA, 25 bp, Mus musculus
gagcagcccggagctttactccgct

SEQ ID NO: 330453 - DNA, 25 bp, Mus musculus
ctttactccgcttcggggtgcgaga

SEQ ID NO: 330454 - DNA, 25 bp, Mus musculus
ggcacccgccagtctgcagaagctg

SEQ ID NO: 330455 - DNA, 25 bp, Mus musculus
ggcagcaagagtgcgcctaggccca

SEQ ID NO: 330456 - DNA, 25 bp, Mus musculus
gacctggaccgtggccttgacggtc

SEQ ID NO: 330457 - DNA, 25 bp, Mus musculus
cgtatgagggtacccgcaggttccg

SEQ ID NO: 330458 - DNA, 25 bp, Mus musculus
gccgacaggctgcagggcacacgct

SEQ ID NO: 330459 - DNA, 25 bp, Mus musculus
gggatcccgtatgagggtacccgca

SEQ ID NO: 330460 - DNA, 25 bp, Mus musculus
cacacgctggaagcccggacctgga

SEQ ID NO: 330461 - DNA, 25 bp, Mus musculus
gcgaccgtcttggaagcaaccgtga

SEQ ID NO: 330462 - DNA, 25 bp, Mus musculus
ccttggcggacaaggccaccgtctt

SEQ ID NO: 330463 - DNA, 25 bp, Mus musculus
tcagctctgccaaggcctcagcgtt

SEQ ID NO: 330464 - DNA, 25 bp, Mus musculus
ccgttaagcagcgtctgcggcaata

SEQ ID NO: 330465 - DNA, 25 bp, Mus musculus
ccaccgatgttgctgctgaggatga

SEQ ID NO: 330466 - DNA, 25 bp, Mus musculus
gcggatactcgaaccggctgcgttg

SEQ ID NO: 330467 - DNA, 25 bp, Mus musculus
tgcgctcaggccataacgctccaga

SEQ ID NO: 330468 - DNA, 25 bp, Mus musculus
tcacgaattctatgcggtcggcgcc

SEQ ID NO: 330469 - DNA, 25 bp, Mus musculus
accatcgacgtggttgagctgctgc

SEQ ID NO: 330470 - DNA, 25 bp, Mus musculus
ggcgtgctgtctcgatcacgaattc

SEQ ID NO: 330471 - DNA, 25 bp, Mus musculus
ggtcggcgccttcgtaattgacgca

SEQ ID NO: 330472 - DNA, 25 bp, Mus musculus
aattgacgcaaccacggcatacggg

SEQ ID NO: 330473 - DNA, 25 bp, Mus musculus
tacgggttcggagaagtcccagatc

SEQ ID NO: 330474 - DNA, 25 bp, Mus musculus
acactgcaggtttggtggaaccatc

SEQ ID NO: 330475 - DNA, 25 bp, Mus musculus
aaaaactgtgagtgagccgccggga

SEQ ID NO: 330476 - DNA, 25 bp, Mus musculus
agtgcccttctaggagcacagcgtg

SEQ ID NO: 330477 - DNA, 25 bp, Mus musculus
cggtctggggaatcgacaggaaatc

SEQ ID NO: 330478 - DNA, 25 bp, Mus musculus
caggaaatcaaaccaggcgacaagc

SEQ ID NO: 330479 - DNA, 25 bp, Mus musculus
ggccacgtgactggcgaaagctgtc

SEQ ID NO: 330480 - DNA, 25 bp, Mus musculus
agcacagcgtgcagtctccatggtg

SEQ ID NO: 330481 - DNA, 25 bp, Mus musculus
agtgagtcccaactcctgccgtgtg

SEQ ID NO: 330482 - DNA, 25 bp, Mus musculus
cctgccgtgtggctacaagccacta

SEQ ID NO: 330483 - DNA, 25 bp, Mus musculus
acgcctctgaaacccaatcgtgaga

SEQ ID NO: 330484 - DNA, 25 bp, Mus musculus
tgagaccttgccctccacacaataa

SEQ ID NO: 330485 - DNA, 25 bp, Mus musculus
ggcgaagccttacgtgccaaccatc

SEQ ID NO: 330486 - DNA, 25 bp, Mus musculus
ccaaccatcgagaggagcatcgctg

SEQ ID NO: 330487 - DNA, 25 bp, Mus musculus
ccttcccgctagagcggcgaggtga

SEQ ID NO: 330488 - DNA, 25 bp, Mus musculus
ggcgacaagcgtagcaaaaaactgt

SEQ ID NO: 330489 - DNA, 25 bp, Mus musculus
tttactggtcatttctcctggctgg

SEQ ID NO: 330490 - DNA, 25 bp, Mus musculus
acaggtgcaccgtctattgcagagg

SEQ ID NO: 330491 - DNA, 25 bp, Mus musculus
atttctcctggctggttggctagcc

SEQ ID NO: 330492 - DNA, 25 bp, Mus musculus
ctcctggctggttggctagccaggc

SEQ ID NO: 330493 - DNA, 25 bp, Mus musculus
gctagccaggcgcggtgccaacgat

SEQ ID NO: 330494 - DNA, 25 bp, Mus musculus
cggtcgcctacttttactggtcatt

SEQ ID NO: 330495 - DNA, 25 bp, Mus musculus
gccagacacaggtgcaccgtctatt

SEQ ID NO: 330496 - DNA, 25 bp, Mus musculus
gtgcaccgtctattgcagaggcctg

SEQ ID NO: 330497 - DNA, 25 bp, Mus musculus
ccgtctattgcagaggcctgcggtc

SEQ ID NO: 330498 - DNA, 25 bp, Mus musculus
gtctattgcagaggcctgcggtcgc

SEQ ID NO: 330499 - DNA, 25 bp, Mus musculus
ctgcggtcgcctacttttactggtc

SEQ ID NO: 330500 - DNA, 25 bp, Mus musculus
cgcctacttttactggtcatttctc

SEQ ID NO: 330501 - DNA, 25 bp, Mus musculus
actggtcatttctcctggctggttg

SEQ ID NO: 330502 - DNA, 25 bp, Mus musculus
gtcatttctcctggctggttggcta

SEQ ID NO: 330503 - DNA, 25 bp, Mus musculus
agcagcctccagatgcgccgcggct

SEQ ID NO: 330504 - DNA, 25 bp, Mus musculus
gctctagtcgcgacaggaggagccc

SEQ ID NO: 330505 - DNA, 25 bp, Mus musculus
cccgaggctgcaaagttgtgggctc

SEQ ID NO: 330506 - DNA, 25 bp, Mus musculus
ctgcaaagttgtgggctcgcccgac

SEQ ID NO: 330507 - DNA, 25 bp, Mus musculus
tgcccactctacagaaccctaggta

SEQ ID NO: 330508 - DNA, 25 bp, Mus musculus
aagttgtgggctcgcccgactggct

SEQ ID NO: 330509 - DNA, 25 bp, Mus musculus
tccagcgagggaagcaagtgtcttc

SEQ ID NO: 330510 - DNA, 25 bp, Mus musculus
cctgtgtcccgcaacgatctgcaga

SEQ ID NO: 330511 - DNA, 25 bp, Mus musculus
tggggaaagaactcaccgagctcta

SEQ ID NO: 330512 - DNA, 25 bp, Mus musculus
tcaccgagctctagtcgcgacagga

SEQ ID NO: 330513 - DNA, 25 bp, Mus musculus
cagaaccctaggtaccgggctccag

SEQ ID NO: 330514 - DNA, 25 bp, Mus musculus
cccgcaacgatctgcagagagtggc

SEQ ID NO: 330515 - DNA, 25 bp, Mus musculus
agctgtccgctcagcaccggcgtcc

SEQ ID NO: 330516 - DNA, 25 bp, Mus musculus
ttcctcagccactgcctcctggacg

SEQ ID NO: 330517 - DNA, 25 bp, Mus musculus
actggtccagcccagaggatgcgca

SEQ ID NO: 330518 - DNA, 25 bp, Mus musculus
cgtgggtgcagtcaacgcacatgca

SEQ ID NO: 330519 - DNA, 25 bp, Mus musculus
tctctctcccaggagactcgcggga

SEQ ID NO: 330520 - DNA, 25 bp, Mus musculus
ggatcagctctgactccgggcgctc

SEQ ID NO: 330521 - DNA, 25 bp, Mus musculus
cctccaggcccagtgccttagttgg

SEQ ID NO: 330522 - DNA, 25 bp, Mus musculus
acagtgccatgttccagagggctgc

SEQ ID NO: 330523 - DNA, 25 bp, Mus musculus
tcacctggcgaacaggacagtgcca

SEQ ID NO: 330524 - DNA, 25 bp, Mus musculus
cgcccattaaagctacggtggctcc

SEQ ID NO: 330525 - DNA, 25 bp, Mus musculus
gaagctcccagagaaccgcccatta

SEQ ID NO: 330526 - DNA, 25 bp, Mus musculus
cagcaactgcgcctttactggtcca

SEQ ID NO: 330527 - DNA, 25 bp, Mus musculus
atgcgcacggccagcttggcctcgg

SEQ ID NO: 330528 - DNA, 25 bp, Mus musculus
cgcagctctcacctggcgaacagga

SEQ ID NO: 330529 - DNA, 25 bp, Mus musculus
cactctggcccagtgaggcttgcgc

SEQ ID NO: 330530 - DNA, 25 bp, Mus musculus
agctctgccggatcagctctgactc

SEQ ID NO: 330531 - DNA, 25 bp, Mus musculus
ggtgtggctagcactcgacgaccca

SEQ ID NO: 330532 - DNA, 25 bp, Mus musculus
ggcagtagctggaacagacacacta

SEQ ID NO: 330533 - DNA, 25 bp, Mus musculus
gacacactagtgaccgcagcgctgg

SEQ ID NO: 330534 - DNA, 25 bp, Mus musculus
gactctcgcttgttcaccgggaagg

SEQ ID NO: 330535 - DNA, 25 bp, Mus musculus
ggtccacacattcggcagccgggtg

SEQ ID NO: 330536 - DNA, 25 bp, Mus musculus
tggccgtgctgtagtttttcgttca

SEQ ID NO: 330537 - DNA, 25 bp, Mus musculus
cgctctagcttctcgcgggcagaga

SEQ ID NO: 330538 - DNA, 25 bp, Mus musculus
agtcctgaaggatgaccggattagg

SEQ ID NO: 330539 - DNA, 25 bp, Mus musculus
accggattaggagtgaggccaccca

SEQ ID NO: 330540 - DNA, 25 bp, Mus musculus
agcagcatctccgtagcccaattcg

SEQ ID NO: 330541 - DNA, 25 bp, Mus musculus
gcccaattcgaaggctccgggctgt

SEQ ID NO: 330542 - DNA, 25 bp, Mus musculus
cgggaccgccgaagtagaagtcatc

SEQ ID NO: 330543 - DNA, 25 bp, Mus musculus
ctgcacgagcaggagcagccaccgg

SEQ ID NO: 330544 - DNA, 25 bp, Mus musculus
tttttcgttcactgcgcgctctagc

SEQ ID NO: 330545 - DNA, 25 bp, Mus musculus
agggtggcgtcactccctctcagtt

SEQ ID NO: 330546 - DNA, 25 bp, Mus musculus
ggaagcttttgaggggcgtccaatc

SEQ ID NO: 330547 - DNA, 25 bp, Mus musculus
ctggccgctgaaccttatggtggtg

SEQ ID NO: 330548 - DNA, 25 bp, Mus musculus
gcttcttcgcgtggcgccacaacga

SEQ ID NO: 330549 - DNA, 25 bp, Mus musculus
gatgagggtctctcctgagaaacgc

SEQ ID NO: 330550 - DNA, 25 bp, Mus musculus
ctagtcccgagagctgactttcttg

SEQ ID NO: 330551 - DNA, 25 bp, Mus musculus
ggcctcagtcatcttctagtcccga

SEQ ID NO: 330552 - DNA, 25 bp, Mus musculus
agggaggccatctagtccaaccttc

SEQ ID NO: 330553 - DNA, 25 bp, Mus musculus
ctcgagtcggctcatgaactacaac

SEQ ID NO: 330554 - DNA, 25 bp, Mus musculus
tcaaggggtcataagaaggcgtctc

SEQ ID NO: 330555 - DNA, 25 bp, Mus musculus
ccgtttaagtttccgtgctgcagcc

SEQ ID NO: 330556 - DNA, 25 bp, Mus musculus
cctttccgccacttaccagatgtga

SEQ ID NO: 330557 - DNA, 25 bp, Mus musculus
cgcgcttttccctgcttcgggtaga

SEQ ID NO: 330558 - DNA, 25 bp, Mus musculus
tctcagttgccatggtgcccgccaa

SEQ ID NO: 330559 - DNA, 25 bp, Mus musculus
tcgacaaaatctcgggaagagtctg

SEQ ID NO: 330560 - DNA, 25 bp, Mus musculus
acgctgtcggaagttgaggttgcta

SEQ ID NO: 330561 - DNA, 25 bp, Mus musculus
ccatagagacgctgtcggaagttga

SEQ ID NO: 330562 - DNA, 25 bp, Mus musculus
tcgtggtatccatagagacgctgtc

SEQ ID NO: 330563 - DNA, 25 bp, Mus musculus
cccgccggaaatcgtggtatccata

SEQ ID NO: 330564 - DNA, 25 bp, Mus musculus
agccggactgccaagccgggtgctc

SEQ ID NO: 330565 - DNA, 25 bp, Mus musculus
accgcgtagaaaacgacctcgagcg

SEQ ID NO: 330566 - DNA, 25 bp, Mus musculus
tccgcacttggaaggatcgacaaaa

SEQ ID NO: 330567 - DNA, 25 bp, Mus musculus
ctacgctagggcaaagcggggttct

SEQ ID NO: 330568 - DNA, 25 bp, Mus musculus
agcgggactggaaccagggcatttc

SEQ ID NO: 330569 - DNA, 25 bp, Mus musculus
ccagggcatttccaaaccgcgtaga

SEQ ID NO: 330570 - DNA, 25 bp, Mus musculus
cgccggtttttacagtccgcacttg

SEQ ID NO: 330571 - DNA, 25 bp, Mus musculus
cttgcgtacctgaggcggccgcctg

SEQ ID NO: 330572 - DNA, 25 bp, Mus musculus
aaaacgacctcgagcgcagccgcgg

SEQ ID NO: 330573 - DNA, 25 bp, Mus musculus
tagtagtttccaggcgctgccaggc

SEQ ID NO: 330574 - DNA, 25 bp, Mus musculus
ttacggaacctacggctcggcgagc

SEQ ID NO: 330575 - DNA, 25 bp, Mus musculus
gaacctacggctcggcgagctggaa

SEQ ID NO: 330576 - DNA, 25 bp, Mus musculus
tacccggtaagagcgaggaggagcc

SEQ ID NO: 330577 - DNA, 25 bp, Mus musculus
aaaagcaagccaggaggtgctgtgc

SEQ ID NO: 330578 - DNA, 25 bp, Mus musculus
agtttccaggcgctgccaggcggct

SEQ ID NO: 330579 - DNA, 25 bp, Mus musculus
tgctgtgctgcttctagtagtttcc

SEQ ID NO: 330580 - DNA, 25 bp, Mus musculus
gtgcgataagtgagctgatggccaa

SEQ ID NO: 330581 - DNA, 25 bp, Mus musculus
cagaagttacggaacctacggctcg

SEQ ID NO: 330582 - DNA, 25 bp, Mus musculus
cgataagtgagctgatggccaagtg

SEQ ID NO: 330583 - DNA, 25 bp, Mus musculus
accgagcggtcctcaggctgtggct

SEQ ID NO: 330584 - DNA, 25 bp, Mus musculus
tgagggagacccacgctggatcgtg

SEQ ID NO: 330585 - DNA, 25 bp, Mus musculus
ttgggagctggtagcggtgcgataa

SEQ ID NO: 330586 - DNA, 25 bp, Mus musculus
caagccaggaggtgctgtgctgctt

SEQ ID NO: 330587 - DNA, 25 bp, Mus musculus
tcgcttcctcagtgggagccctcgg

SEQ ID NO: 330588 - DNA, 25 bp, Mus musculus
ggagcaggcaccacagtcaactttt

SEQ ID NO: 330589 - DNA, 25 bp, Mus musculus
tttggaagttcaacagcgtcgcctg

SEQ ID NO: 330590 - DNA, 25 bp, Mus musculus
cttaggcaaaagtgtgcgtgcagcc

SEQ ID NO: 330591 - DNA, 25 bp, Mus musculus
tgggagactttggaacttaggcaaa

SEQ ID NO: 330592 - DNA, 25 bp, Mus musculus
gcctcacaggcagggacgcgcgact

SEQ ID NO: 330593 - DNA, 25 bp, Mus musculus
caagcgaattcctgtcccgggaaag

SEQ ID NO: 330594 - DNA, 25 bp, Mus musculus
cagcagcatcaaggcgcgcgggaac

SEQ ID NO: 330595 - DNA, 25 bp, Mus musculus
agtgctcctggccatcgtccagtgc

SEQ ID NO: 330596 - DNA, 25 bp, Mus musculus
agtgtaaactcctgcgggctcagtg

SEQ ID NO: 330597 - DNA, 25 bp, Mus musculus
tccctctgcagccagtacgttacgg

SEQ ID NO: 330598 - DNA, 25 bp, Mus musculus
gcggctcctttgatctggcggccac

SEQ ID NO: 330599 - DNA, 25 bp, Mus musculus
cggccacgcgtggagagtgtaaact

SEQ ID NO: 330600 - DNA, 25 bp, Mus musculus
gccagtacgttacggcgccaccagg

SEQ ID NO: 330601 - DNA, 25 bp, Mus musculus
tgctctgtcaggaggcgctcgtgct

SEQ ID NO: 330602 - DNA, 25 bp, Mus musculus
tgcaggttgtctttggccgcacgct

SEQ ID NO: 330603 - DNA, 25 bp, Mus musculus
cagctccttctgcaggttgtctttg

SEQ ID NO: 330604 - DNA, 25 bp, Mus musculus
gaggcctcgatctgcagctccttct

SEQ ID NO: 330605 - DNA, 25 bp, Mus musculus
gcttcgcagcgcgaggcctcgatct

SEQ ID NO: 330606 - DNA, 25 bp, Mus musculus
tgccagcaacgcttcgcagcgcgag

SEQ ID NO: 330607 - DNA, 25 bp, Mus musculus
gagctcgagtgagcggctccgctca

SEQ ID NO: 330608 - DNA, 25 bp, Mus musculus
ctctgccttcagctttcgcagcaga

SEQ ID NO: 330609 - DNA, 25 bp, Mus musculus
cgctcgtgctgtagggcctctgaga

SEQ ID NO: 330610 - DNA, 25 bp, Mus musculus
agttgcggctcagctgctctgtcag

SEQ ID NO: 330611 - DNA, 25 bp, Mus musculus
cacaggcctcctgcgagttgcggct

SEQ ID NO: 330612 - DNA, 25 bp, Mus musculus
gcacttgtgtctcttggcgggcaca

SEQ ID NO: 330613 - DNA, 25 bp, Mus musculus
cagcagagcgtgctgcacttgtgtc

SEQ ID NO: 330614 - DNA, 25 bp, Mus musculus
ctgtagggcctctgagagctcgagt

SEQ ID NO: 330615 - DNA, 25 bp, Mus musculus
atcggctattgaccaatccaaaggc

SEQ ID NO: 330616 - DNA, 25 bp, Mus musculus
tactgggaaggctcgaataactgga

SEQ ID NO: 330617 - DNA, 25 bp, Mus musculus
gctcgaataactggagaagcgggca

SEQ ID NO: 330618 - DNA, 25 bp, Mus musculus
ccacatagttgtagagtcccgcgct

SEQ ID NO: 330619 - DNA, 25 bp, Mus musculus
agagtcccgcgctgcccttgagtct

SEQ ID NO: 330620 - DNA, 25 bp, Mus musculus
tcgatcccatcgtacctggccggca

SEQ ID NO: 330621 - DNA, 25 bp, Mus musculus
cttgagtctccctcccgctcagggg

SEQ ID NO: 330622 - DNA, 25 bp, Mus musculus
tcagcacacctgagccgcgcccagc

SEQ ID NO: 330623 - DNA, 25 bp, Mus musculus
cgaaaccggaaatggctgcagcgcc

SEQ ID NO: 330624 - DNA, 25 bp, Mus musculus
acctctccgaaaccggaaatggctg

SEQ ID NO: 330625 - DNA, 25 bp, Mus musculus
ggtgctgctcctcaagtacccgttc

SEQ ID NO: 330626 - DNA, 25 bp, Mus musculus
ggcggggtctatcggctattgacca

SEQ ID NO: 330627 - DNA, 25 bp, Mus musculus
tgaccaatccaaaggcgagaggggc

SEQ ID NO: 330628 - DNA, 25 bp, Mus musculus
tgcagcgccgctgccaattcccggt

SEQ ID NO: 330629 - DNA, 25 bp, Mus musculus
cgcggtagattgacgagcgccttgt

SEQ ID NO: 330630 - DNA, 25 bp, Mus musculus
gtacacatcttttcctttctgcccg

SEQ ID NO: 330631 - DNA, 25 bp, Mus musculus
tcacatgtgcttcgcgtaagcggcg

SEQ ID NO: 330632 - DNA, 25 bp, Mus musculus
ccgcgaggacctcacatgtgcttcg

SEQ ID NO: 330633 - DNA, 25 bp, Mus musculus
gttccgagagccctgacatggcctc

SEQ ID NO: 330634 - DNA, 25 bp, Mus musculus
tagtcaaaaccgtggctggaacctc

SEQ ID NO: 330635 - DNA, 25 bp, Mus musculus
ttgcactgcgaagccgcggcttatt

SEQ ID NO: 330636 - DNA, 25 bp, Mus musculus
tacggaagggtctggagtacacatc

SEQ ID NO: 330637 - DNA, 25 bp, Mus musculus
tgatttgggtcctcgatacggaagg

SEQ ID NO: 330638 - DNA, 25 bp, Mus musculus
cgctcaccaggtgggttgttgattt

SEQ ID NO: 330639 - DNA, 25 bp, Mus musculus
aagcggaagaagatggcgctcacca

SEQ ID NO: 330640 - DNA, 25 bp, Mus musculus
attgtgttcctcgttcccgggcaag

SEQ ID NO: 330641 - DNA, 25 bp, Mus musculus
ggcgcagaagtaacttagtcaaaac

SEQ ID NO: 330642 - DNA, 25 bp, Mus musculus
tgcccgtactgttcgggctgtgacc

SEQ ID NO: 330643 - DNA, 25 bp, Mus musculus
ccagtactggaacgcagtgcgctta

SEQ ID NO: 330644 - DNA, 25 bp, Mus musculus
aacgctctggccacggcttgtgcct

SEQ ID NO: 330645 - DNA, 25 bp, Mus musculus
tccagtgagctgtaatgtcgagcga

SEQ ID NO: 330646 - DNA, 25 bp, Mus musculus
tgggagccgtcatcgacttctcaga

SEQ ID NO: 330647 - DNA, 25 bp, Mus musculus
aagcttttccgcttctaccggcaga

SEQ ID NO: 330648 - DNA, 25 bp, Mus musculus
agcccagagaggatgctttccggaa

SEQ ID NO: 330649 - DNA, 25 bp, Mus musculus
ggcttcattagccacgctggctgca

SEQ ID NO: 330650 - DNA, 25 bp, Mus musculus
ccaaactgttggcagcctcgagatg

SEQ ID NO: 330651 - DNA, 25 bp, Mus musculus
ttctgacaaacgcaataggccgacc

SEQ ID NO: 330652 - DNA, 25 bp, Mus musculus
ttcgagttctgcttccgggccaaac

SEQ ID NO: 330653 - DNA, 25 bp, Mus musculus
gcggaggctgccatgttaaaacgga

SEQ ID NO: 330654 - DNA, 25 bp, Mus musculus
cggaatgaatcgaaaccctggagtc

SEQ ID NO: 330655 - DNA, 25 bp, Mus musculus
ctgccagagccggaatttcgagttc

SEQ ID NO: 330656 - DNA, 25 bp, Mus musculus
gctgccgcggtccaaggaatttttc

SEQ ID NO: 330657 - DNA, 25 bp, Mus musculus
ctccggagcgaaatctcggcgtgaa

SEQ ID NO: 330658 - DNA, 25 bp, Mus musculus
gaccacaaggcgcaggcactgaaaa

SEQ ID NO: 330659 - DNA, 25 bp, Mus musculus
aataaaatgagctccgcacgccggc

SEQ ID NO: 330660 - DNA, 25 bp, Mus musculus
caacggtatagtgtcgggcagccgc

SEQ ID NO: 330661 - DNA, 25 bp, Mus musculus
cagccatgatggatcgacccgagtc

SEQ ID NO: 330662 - DNA, 25 bp, Mus musculus
cggcaatggctctatataaacaggg

SEQ ID NO: 330663 - DNA, 25 bp, Mus musculus
gtctatattagagagcggcaatggc

SEQ ID NO: 330664 - DNA, 25 bp, Mus musculus
tcccatcctggcagagtctatatta

SEQ ID NO: 330665 - DNA, 25 bp, Mus musculus
tgacgtaggcctgaaaagcaccttc

SEQ ID NO: 330666 - DNA, 25 bp, Mus musculus
gccggatctggtgtttaaatggaga

SEQ ID NO: 330667 - DNA, 25 bp, Mus musculus
ctctcactatttaaagccggatctg

SEQ ID NO: 330668 - DNA, 25 bp, Mus musculus
cgcgctcagcagctctcactattta

SEQ ID NO: 330669 - DNA, 25 bp, Mus musculus
tcggcgtgaaaggagcctagaaata

SEQ ID NO: 330670 - DNA, 25 bp, Mus musculus
gacccgagtcgccaacggtatagtg

SEQ ID NO: 330671 - DNA, 25 bp, Mus musculus
ggtcttctcggcaaatacggtccta

SEQ ID NO: 330672 - DNA, 25 bp, Mus musculus
gctgtccctgcggaagtttttcacc

SEQ ID NO: 330673 - DNA, 25 bp, Mus musculus
gcggaccattacgttctcacaggga

SEQ ID NO: 330674 - DNA, 25 bp, Mus musculus
ggggacatcctcagccagctctgca

SEQ ID NO: 330675 - DNA, 25 bp, Mus musculus
cggcatgcgtccaaagggttgaaca

SEQ ID NO: 330676 - DNA, 25 bp, Mus musculus
ctggtaaatccatgagacggtcctg

SEQ ID NO: 330677 - DNA, 25 bp, Mus musculus
ctcagtatgtggatccgtgtcaaga

SEQ ID NO: 330678 - DNA, 25 bp, Mus musculus
taagccgactgtgctcaggtccatg

SEQ ID NO: 330679 - DNA, 25 bp, Mus musculus
ccaccgtgatctcctcttcgaggta

SEQ ID NO: 330680 - DNA, 25 bp, Mus musculus
tgcccactgtgccagagaactcgtc

SEQ ID NO: 330681 - DNA, 25 bp, Mus musculus
aagatctggttgtctcccttgccca

SEQ ID NO: 330682 - DNA, 25 bp, Mus musculus
aacgatttcgttccctttgatgagg

SEQ ID NO: 330683 - DNA, 25 bp, Mus musculus
tcctgaaccgcatggatgaagctcc

SEQ ID NO: 330684 - DNA, 25 bp, Mus musculus
aaacggcactcgtggagcttgatcc

SEQ ID NO: 330685 - DNA, 25 bp, Mus musculus
ccgctcaggacaacgaagtggccct

SEQ ID NO: 330686 - DNA, 25 bp, Mus musculus
atcggcggtgagatccgcgccaccg

SEQ ID NO: 330687 - DNA, 25 bp, Mus musculus
gtcgtactcaccagcagcgggctga

SEQ ID NO: 330688 - DNA, 25 bp, Mus musculus
agatgctcggcgctaggacctcgcg

SEQ ID NO: 330689 - DNA, 25 bp, Mus musculus
aatacccggtgctcggagatgctcg

SEQ ID NO: 330690 - DNA, 25 bp, Mus musculus
tggcgctccgctttggctcaatacc

SEQ ID NO: 330691 - DNA, 25 bp, Mus musculus
tggggcaaggcaccatctccaagga

SEQ ID NO: 330692 - DNA, 25 bp, Mus musculus
ggctggggtcccgactcagaacacc

SEQ ID NO: 330693 - DNA, 25 bp, Mus musculus
tgtccagcgggcaaagagcctgaga

SEQ ID NO: 330694 - DNA, 25 bp, Mus musculus
gttcaggaaactccatccaaggccc

SEQ ID NO: 330695 - DNA, 25 bp, Mus musculus
gcttggcaacgcgttcaggaaactc

SEQ ID NO: 330696 - DNA, 25 bp, Mus musculus
gaggcggtgtccagcaaattgcttg

SEQ ID NO: 330697 - DNA, 25 bp, Mus musculus
gctttggctcaatacccggtgctcg

SEQ ID NO: 330698 - DNA, 25 bp, Mus musculus
atctccaaggacacctgttgtcgcc

SEQ ID NO: 330699 - DNA, 25 bp, Mus musculus
tgcctttcattcacagcccggcggg

SEQ ID NO: 330700 - DNA, 25 bp, Mus musculus
gctcagctcttacgcgggtcgctga

SEQ ID NO: 330701 - DNA, 25 bp, Mus musculus
gcccaggttcttcgttcactcagta

SEQ ID NO: 330702 - DNA, 25 bp, Mus musculus
gcgagcctttttacctacctgacgc

SEQ ID NO: 330703 - DNA, 25 bp, Mus musculus
cgcccattcagcgacgaggttggct

SEQ ID NO: 330704 - DNA, 25 bp, Mus musculus
ggctcagctccgaagatactcgctt

SEQ ID NO: 330705 - DNA, 25 bp, Mus musculus
ctagcctggcaccaagtcggcattc

SEQ ID NO: 330706 - DNA, 25 bp, Mus musculus
tctcggcacagacgtacgcacaggc

SEQ ID NO: 330707 - DNA, 25 bp, Mus musculus
aaggcatctttgtcctctcggcaca

SEQ ID NO: 330708 - DNA, 25 bp, Mus musculus
acacgcctgcccgagggatctcagg

SEQ ID NO: 330709 - DNA, 25 bp, Mus musculus
atcagagtccctacctggcgacgga

SEQ ID NO: 330710 - DNA, 25 bp, Mus musculus
cgggtgcctctcagccatcagagtc

SEQ ID NO: 330711 - DNA, 25 bp, Mus musculus
cttaccgtacatctccgcggggagc

SEQ ID NO: 330712 - DNA, 25 bp, Mus musculus
tttcctcagtatggggcgagccttt

SEQ ID NO: 330713 - DNA, 25 bp, Mus musculus
gctgggaaacccgaggagtgcttcc

SEQ ID NO: 330714 - DNA, 25 bp, Mus musculus
agcctttcgcgccaaaagccatttg

SEQ ID NO: 330715 - DNA, 25 bp, Mus musculus
ttccataaaaatcaggggaggcgcc

SEQ ID NO: 330716 - DNA, 25 bp, Mus musculus
tcactggctgcgctttgaagctcgg

SEQ ID NO: 330717 - DNA, 25 bp, Mus musculus
cccagcgcgtccagacagatgactg

SEQ ID NO: 330718 - DNA, 25 bp, Mus musculus
cgacacctcgcggagaccaagcaga

SEQ ID NO: 330719 - DNA, 25 bp, Mus musculus
tgcacccgctgcactccgtgttttt

SEQ ID NO: 330720 - DNA, 25 bp, Mus musculus
tttgtgtgaaagatgagctccaggc

SEQ ID NO: 330721 - DNA, 25 bp, Mus musculus
ctccaggctaaagtggaacaaggcc

SEQ ID NO: 330722 - DNA, 25 bp, Mus musculus
cgcccacgtagaaacagaccgcagg

SEQ ID NO: 330723 - DNA, 25 bp, Mus musculus
ccctctcgtttttcagactgcaagc

SEQ ID NO: 330724 - DNA, 25 bp, Mus musculus
taccgctttcttcggccgaaggcga

SEQ ID NO: 330725 - DNA, 25 bp, Mus musculus
ccgcaggaggtttctagtttcaaat

SEQ ID NO: 330726 - DNA, 25 bp, Mus musculus
aggtttctagcccagtccctgcgtg

SEQ ID NO: 330727 - DNA, 25 bp, Mus musculus
acctgcatcctgctctcgaaggtcg

SEQ ID NO: 330728 - DNA, 25 bp, Mus musculus
cggacctgcatcctgctctcgaagg

SEQ ID NO: 330729 - DNA, 25 bp, Mus musculus
aacgacagcctgacgcggacctgca

SEQ ID NO: 330730 - DNA, 25 bp, Mus musculus
ccgcgcagagcagcagcaacgacag

SEQ ID NO: 330731 - DNA, 25 bp, Mus musculus
ggagcaccgcgcagagcagcagcaa

SEQ ID NO: 330732 - DNA, 25 bp, Mus musculus
atactgacccgaggtcgcggctgcc

SEQ ID NO: 330733 - DNA, 25 bp, Mus musculus
cgaggctcgatactgacccgaggtc

SEQ ID NO: 330734 - DNA, 25 bp, Mus musculus
tgctgcccgaggctcgatactgacc

SEQ ID NO: 330735 - DNA, 25 bp, Mus musculus
ggcctgctgcccgaggctcgatact

SEQ ID NO: 330736 - DNA, 25 bp, Mus musculus
cccgtggccctgtctccaccgcggt

SEQ ID NO: 330737 - DNA, 25 bp, Mus musculus
gagcagtgcccgagaccgctgagcc

SEQ ID NO: 330738 - DNA, 25 bp, Mus musculus
gcgagtgacagtcagggcgagcagt

SEQ ID NO: 330739 - DNA, 25 bp, Mus musculus
aggctaaccgatgcccaaggcaaga

SEQ ID NO: 330740 - DNA, 25 bp, Mus musculus
ggcccaggctaaccgatgcccaagg

SEQ ID NO: 330741 - DNA, 25 bp, Mus musculus
cattacagtaaacatttcccaagag

SEQ ID NO: 330742 - DNA, 25 bp, Mus musculus
ggagaccgagctcggttccagccac

SEQ ID NO: 330743 - DNA, 25 bp, Mus musculus
cctagagaaagtggcatgcccgacc

SEQ ID NO: 330744 - DNA, 25 bp, Mus musculus
gcagcagaccgagcctagagaaagt

SEQ ID NO: 330745 - DNA, 25 bp, Mus musculus
aagaccggagctgcggcagcagacc

SEQ ID NO: 330746 - DNA, 25 bp, Mus musculus
cgccctacttttgtcggggcgccag

SEQ ID NO: 330747 - DNA, 25 bp, Mus musculus
gccctcttagatcgccctacttttg

SEQ ID NO: 330748 - DNA, 25 bp, Mus musculus
gtccgggactcgctcggacgctctt

SEQ ID NO: 330749 - DNA, 25 bp, Mus musculus
cgtagccctgggtctctcggcagtc

SEQ ID NO: 330750 - DNA, 25 bp, Mus musculus
acgctgcacttggagtcagccgcgc

SEQ ID NO: 330751 - DNA, 25 bp, Mus musculus
cccgcagacgctgcacttggagtca

SEQ ID NO: 330752 - DNA, 25 bp, Mus musculus
ttagctgacccggtcggatcaaggc

SEQ ID NO: 330753 - DNA, 25 bp, Mus musculus
ccgactccgcgaattcattacagta

SEQ ID NO: 330754 - DNA, 25 bp, Mus musculus
aggagcccagccgactccgcgaatt

SEQ ID NO: 330755 - DNA, 25 bp, Mus musculus
tcccgacaggaggaggacttacata

SEQ ID NO: 330756 - DNA, 25 bp, Mus musculus
ggatgctaccgtctaaccttggctc

SEQ ID NO: 330757 - DNA, 25 bp, Mus musculus
acgtctctgacgctgattggctgtg

SEQ ID NO: 330758 - DNA, 25 bp, Mus musculus
cggcgcctaggaagtgaattccgca

SEQ ID NO: 330759 - DNA, 25 bp, Mus musculus
ccgcttgtgtcaagcggcggtctga

SEQ ID NO: 330760 - DNA, 25 bp, Mus musculus
tctgagcaccggaaccgctttagga

SEQ ID NO: 330761 - DNA, 25 bp, Mus musculus
gctgagagaaggatgctaccgtcta

SEQ ID NO: 330762 - DNA, 25 bp, Mus musculus
ggcgacaccgccttcgctctattta

SEQ ID NO: 330763 - DNA, 25 bp, Mus musculus
gctccaagggcggagagccatctct

SEQ ID NO: 330764 - DNA, 25 bp, Mus musculus
gaggcggtgctacctatcgccctct

SEQ ID NO: 330765 - DNA, 25 bp, Mus musculus
ccacctacaagtcgtacgtctctga

SEQ ID NO: 330766 - DNA, 25 bp, Mus musculus
ggacttacataccagcggctctcca

SEQ ID NO: 330767 - DNA, 25 bp, Mus musculus
gccaaagtcgttttttctgtcgcga

SEQ ID NO: 330768 - DNA, 25 bp, Mus musculus
cttcatccacgccaatgagcgaggc

SEQ ID NO: 330769 - DNA, 25 bp, Mus musculus
attgcaatctaaccgccagcccggg

SEQ ID NO: 330770 - DNA, 25 bp, Mus musculus
ggcccagcccgtcggagtcgtctag

SEQ ID NO: 330771 - DNA, 25 bp, Mus musculus
agtcgtctagcacgtaggcgccacc

SEQ ID NO: 330772 - DNA, 25 bp, Mus musculus
acttgactgcagcagacgcctgtcc

SEQ ID NO: 330773 - DNA, 25 bp, Mus musculus
gcgatccagaacgagggctccctcg

SEQ ID NO: 330774 - DNA, 25 bp, Mus musculus
ttccagcgcggcaaggacagccctg

SEQ ID NO: 330775 - DNA, 25 bp, Mus musculus
ctctctggctttttccggaggcgac

SEQ ID NO: 330776 - DNA, 25 bp, Mus musculus
ggctgaggaagctttcgccatctta

SEQ ID NO: 330777 - DNA, 25 bp, Mus musculus
ttggctgttagccattgtgcgggtc

SEQ ID NO: 330778 - DNA, 25 bp, Mus musculus
cggtcatgacttttgcttggcgttg

SEQ ID NO: 330779 - DNA, 25 bp, Mus musculus
ataagggcaccgcaacacggctcgc

SEQ ID NO: 330780 - DNA, 25 bp, Mus musculus
cgggcactagcagcgcacacaacaa

SEQ ID NO: 330781 - DNA, 25 bp, Mus musculus
tgaggcttcgcagtccctctctggc

SEQ ID NO: 330782 - DNA, 25 bp, Mus musculus
gctgactgcgccgatgccatcgaac

SEQ ID NO: 330783 - DNA, 25 bp, Mus musculus
caccagccatgagccttttgttctg

SEQ ID NO: 330784 - DNA, 25 bp, Mus musculus
ggacacgtcagcctcgctcgtctga

SEQ ID NO: 330785 - DNA, 25 bp, Mus musculus
gctcgtctgagcacagagcactcgc

SEQ ID NO: 330786 - DNA, 25 bp, Mus musculus
cacccgctgaaagccattggacaga

SEQ ID NO: 330787 - DNA, 25 bp, Mus musculus
ggagctcgcggctaaggcgaccctc

SEQ ID NO: 330788 - DNA, 25 bp, Mus musculus
tgctacttactgacgcggccgcagc

SEQ ID NO: 330789 - DNA, 25 bp, Mus musculus
gttgcagccggagacacgcttggct

SEQ ID NO: 330790 - DNA, 25 bp, Mus musculus
cgggtgcctgctctttctctcttgt

SEQ ID NO: 330791 - DNA, 25 bp, Mus musculus
gtcacttcatttttggtactccact

SEQ ID NO: 330792 - DNA, 25 bp, Mus musculus
gtgaaggaagctaacaccagccatg

SEQ ID NO: 330793 - DNA, 25 bp, Mus musculus
gccttttgttctgggaccgcttggc

SEQ ID NO: 330794 - DNA, 25 bp, Mus musculus
ttggcgctggctgcgatctcatcgc

SEQ ID NO: 330795 - DNA, 25 bp, Mus musculus
aggccggagtgaagcccaccgcagc

SEQ ID NO: 330796 - DNA, 25 bp, Mus musculus
cccacggcgctcctgagtgaaggaa

SEQ ID NO: 330797 - DNA, 25 bp, Mus musculus
cggctgctggcactttcggtaagca

SEQ ID NO: 330798 - DNA, 25 bp, Mus musculus
ggcctaggagcacaggtccctgtgt

SEQ ID NO: 330799 - DNA, 25 bp, Mus musculus
gtccctgtgttgtgacgtcataatc

SEQ ID NO: 330800 - DNA, 25 bp, Mus musculus
acgtcataatctgcagccgcggagc

SEQ ID NO: 330801 - DNA, 25 bp, Mus musculus
tcataatctgcagccgcggagctcg

SEQ ID NO: 330802 - DNA, 25 bp, Mus musculus
ttagcaaccgccctggcgactgtcg

SEQ ID NO: 330803 - DNA, 25 bp, Mus musculus
aaccgccctggcgactgtcgctgtg

SEQ ID NO: 330804 - DNA, 25 bp, Mus musculus
gactgtcgctgtgaccctttgcgcc

SEQ ID NO: 330805 - DNA, 25 bp, Mus musculus
tccttttcacctccgctgcggggga

SEQ ID NO: 330806 - DNA, 25 bp, Mus musculus
gctcggcttcatcccagtaagaacc

SEQ ID NO: 330807 - DNA, 25 bp, Mus musculus
tcccagtaagaaccaaggggataca

SEQ ID NO: 330808 - DNA, 25 bp, Mus musculus
actaagcatggatggcagccggaga

SEQ ID NO: 330809 - DNA, 25 bp, Mus musculus
actttcggtaagcaggagtgcctgg

SEQ ID NO: 330810 - DNA, 25 bp, Mus musculus
caggtccctgtgttgtgacgtcata

SEQ ID NO: 330811 - DNA, 25 bp, Mus musculus
atgcctctgttgagctgcttcatca

SEQ ID NO: 330812 - DNA, 25 bp, Mus musculus
agaccaaggcgtcgggccggctgta

SEQ ID NO: 330813 - DNA, 25 bp, Mus musculus
catcacggtctcgtagtcaggggtc

SEQ ID NO: 330814 - DNA, 25 bp, Mus musculus
tgttgagctgcttcatcacggtctc

SEQ ID NO: 330815 - DNA, 25 bp, Mus musculus
aatgagcgcactgtgccggtgggac

SEQ ID NO: 330816 - DNA, 25 bp, Mus musculus
gtgcaccatgcctctgttgagctgc

SEQ ID NO: 330817 - DNA, 25 bp, Mus musculus
ctgtgccggtctgcgtgcaccatgc

SEQ ID NO: 330818 - DNA, 25 bp, Mus musculus
ttcctcagcgagtggctgtgccggt

SEQ ID NO: 330819 - DNA, 25 bp, Mus musculus
ttgaggttcctcagcgagtggctgt

SEQ ID NO: 330820 - DNA, 25 bp, Mus musculus
actgccaatgttgaggttcctcagc

SEQ ID NO: 330821 - DNA, 25 bp, Mus musculus
cgcataggaactgccaatgttgagg

SEQ ID NO: 330822 - DNA, 25 bp, Mus musculus
ctgtacgcataggaactgccaatgt

SEQ ID NO: 330823 - DNA, 25 bp, Mus musculus
tctcgggctggctgtagaccaaggc

SEQ ID NO: 330824 - DNA, 25 bp, Mus musculus
gctgcttcatcacggtctcgtagtc

SEQ ID NO: 330825 - DNA, 25 bp, Mus musculus
cgagcaagggaagacttcgctcttt

SEQ ID NO: 330826 - DNA, 25 bp, Mus musculus
gggcgcgccgctgctgtttttaacc

SEQ ID NO: 330827 - DNA, 25 bp, Mus musculus
ggcgcgccgctgctgtttttaaccg

SEQ ID NO: 330828 - DNA, 25 bp, Mus musculus
cgtgacctcagagagttggaatgcg

SEQ ID NO: 330829 - DNA, 25 bp, Mus musculus
cgcgtgacctcagagagttggaatg

SEQ ID NO: 330830 - DNA, 25 bp, Mus musculus
cgaccgcacgccttgcccgcactgg

SEQ ID NO: 330831 - DNA, 25 bp, Mus musculus
ggcccgcgcgccgaccgcacgcctt

SEQ ID NO: 330832 - DNA, 25 bp, Mus musculus
tccggctctgcgtcccgcctccctg

SEQ ID NO: 330833 - DNA, 25 bp, Mus musculus
cgcgctccggctctgcgtcccgcct

SEQ ID NO: 330834 - DNA, 25 bp, Mus musculus
gacttcgctctttgttacgcccctg

SEQ ID NO: 330835 - DNA, 25 bp, Mus musculus
gaagacttcgctctttgttacgccc

SEQ ID NO: 330836 - DNA, 25 bp, Mus musculus
acctcagagagttggaatgcgggcg

SEQ ID NO: 330837 - DNA, 25 bp, Mus musculus
caagggaagacttcgctctttgtta

SEQ ID NO: 330838 - DNA, 25 bp, Mus musculus
gggaagacttcgctctttgttacgc

SEQ ID NO: 330839 - DNA, 25 bp, Mus musculus
atcgtcctatgagccaccagcagtg

SEQ ID NO: 330840 - DNA, 25 bp, Mus musculus
gccgccgagccatggaaatcggcac

SEQ ID NO: 330841 - DNA, 25 bp, Mus musculus
gggctccaggtaaccgaggcgccgc

SEQ ID NO: 330842 - DNA, 25 bp, Mus musculus
atgcgcgttggctcccacttgcacg

SEQ ID NO: 330843 - DNA, 25 bp, Mus musculus
gcgcatgcgtgtgtgctcagacgca

SEQ ID NO: 330844 - DNA, 25 bp, Mus musculus
acacgcgcgcgcgattgcgcgcatg

SEQ ID NO: 330845 - DNA, 25 bp, Mus musculus
caccagcagtggtcgccagagcaca

SEQ ID NO: 330846 - DNA, 25 bp, Mus musculus
cgtaggccatcgtcctatgagccac

SEQ ID NO: 330847 - DNA, 25 bp, Mus musculus
agccatggaaatcggcaccgagatc

SEQ ID NO: 330848 - DNA, 25 bp, Mus musculus
cggcaccgagatcagccgcaagatc

SEQ ID NO: 330849 - DNA, 25 bp, Mus musculus
agatcagccgcaagatccgggtgag

SEQ ID NO: 330850 - DNA, 25 bp, Mus musculus
tccagcgggcccgtgagaggcacct

SEQ ID NO: 330851 - DNA, 25 bp, Mus musculus
cgcggggcggctctttcactgtcgc

SEQ ID NO: 330852 - DNA, 25 bp, Mus musculus
gtcgccagagcacaggttccggacc

SEQ ID NO: 330853 - DNA, 25 bp, Mus musculus
gggctccgaaccagatagatgcaca

SEQ ID NO: 330854 - DNA, 25 bp, Mus musculus
gcgggagtaaaagcctcgcctcacc

SEQ ID NO: 330855 - DNA, 25 bp, Mus musculus
ctgggtgacgaaagctctcccgctg

SEQ ID NO: 330856 - DNA, 25 bp, Mus musculus
gtacacccactcgagccgcaggtgg

SEQ ID NO: 330857 - DNA, 25 bp, Mus musculus
aagtacacgatctccttggccgccg

SEQ ID NO: 330858 - DNA, 25 bp, Mus musculus
gaacttctgccgatgctcccgcgga

SEQ ID NO: 330859 - DNA, 25 bp, Mus musculus
agcccgtacctgatgatgtcgtcgc

SEQ ID NO: 330860 - DNA, 25 bp, Mus musculus
acaggcagctgcaaactccgagggc

SEQ ID NO: 330861 - DNA, 25 bp, Mus musculus
cacgacttccagaaggacaggcagc

SEQ ID NO: 330862 - DNA, 25 bp, Mus musculus
agatgcacatcgctgtcctgggtga

SEQ ID NO: 330863 - DNA, 25 bp, Mus musculus
tgcggagcatccgtaggctcgctcc

SEQ ID NO: 330864 - DNA, 25 bp, Mus musculus
tcaccgaacatgctgagggccgcga

SEQ ID NO: 330865 - DNA, 25 bp, Mus musculus
cagtgccttaggctggaagacaacc

SEQ ID NO: 330866 - DNA, 25 bp, Mus musculus
cctttgcgtgaacggccacgacttc

SEQ ID NO: 330867 - DNA, 25 bp, Mus musculus
ccgagcggcgagaaattgtttccac

SEQ ID NO: 330868 - DNA, 25 bp, Mus musculus
cactgctggtcagatgtcataaacc

SEQ ID NO: 330869 - DNA, 25 bp, Mus musculus
taaaccttttattggccgcagcgtg

SEQ ID NO: 330870 - DNA, 25 bp, Mus musculus
cagcgtggcgagactaaaacaaatc

SEQ ID NO: 330871 - DNA, 25 bp, Mus musculus
tcacgcgaggcccagaaaggcttgc

SEQ ID NO: 330872 - DNA, 25 bp, Mus musculus
gagttgatcggcaccctctgccaga

SEQ ID NO: 330873 - DNA, 25 bp, Mus musculus
ccagactcgaattgctgaggatgcc

SEQ ID NO: 330874 - DNA, 25 bp, Mus musculus
gaggatgcctgttccgcagacaata

SEQ ID NO: 330875 - DNA, 25 bp, Mus musculus
caactctgtcgctctccgagtcgga

SEQ ID NO: 330876 - DNA, 25 bp, Mus musculus
aggcacgagaagcagccagcacgtc

SEQ ID NO: 330877 - DNA, 25 bp, Mus musculus
caggaaactcctgggcgggcaactt

SEQ ID NO: 330878 - DNA, 25 bp, Mus musculus
gcaacttcccggctcaggactgggg

SEQ ID NO: 330879 - DNA, 25 bp, Mus musculus
tgccttcagcgcagccgacaaagtt

SEQ ID NO: 330880 - DNA, 25 bp, Mus musculus
ttgggagcacacataccttcactgc

SEQ ID NO: 330881 - DNA, 25 bp, Mus musculus
ttccggacgaggatacagacccagg

SEQ ID NO: 330882 - DNA, 25 bp, Mus musculus
ttccgattccggacgaggatacaga

SEQ ID NO: 330883 - DNA, 25 bp, Mus musculus
tcgagctcttcggtgttccgattcc

SEQ ID NO: 330884 - DNA, 25 bp, Mus musculus
gcgcttccggctcgagctcttcggt

SEQ ID NO: 330885 - DNA, 25 bp, Mus musculus
tccctccttccagacacgccggggc

SEQ ID NO: 330886 - DNA, 25 bp, Mus musculus
cgaaccggagaaggccgccatcttc

SEQ ID NO: 330887 - DNA, 25 bp, Mus musculus
ttagcttcccacaacgaaccggaga

SEQ ID NO: 330888 - DNA, 25 bp, Mus musculus
tgggtcgaggcgactcgttcgtaac

SEQ ID NO: 330889 - DNA, 25 bp, Mus musculus
acccgctccctgtgggtcgaggcga

SEQ ID NO: 330890 - DNA, 25 bp, Mus musculus
cttagcaaagactcccgggcgctgc

SEQ ID NO: 330891 - DNA, 25 bp, Mus musculus
aggagaagccgcttagcaaagactc

SEQ ID NO: 330892 - DNA, 25 bp, Mus musculus
tggaccaggcgagcgcagacgccac

SEQ ID NO: 330893 - DNA, 25 bp, Mus musculus
agaggcagaaaactggaccaggcga

SEQ ID NO: 330894 - DNA, 25 bp, Mus musculus
gatacagacccaggagaaaggttcc

SEQ ID NO: 330895 - DNA, 25 bp, Mus musculus
agcctgcacgtactgaggggcagcc

SEQ ID NO: 330896 - DNA, 25 bp, Mus musculus
gggtgacaatgctaacccgggcaga

SEQ ID NO: 330897 - DNA, 25 bp, Mus musculus
tgacaatgctaacccgggcagaggc

SEQ ID NO: 330898 - DNA, 25 bp, Mus musculus
tgctaacccgggcagaggctcgcta

SEQ ID NO: 330899 - DNA, 25 bp, Mus musculus
cagaggctcgctaggcagccagaga

SEQ ID NO: 330900 - DNA, 25 bp, Mus musculus
gccagagagccgcattttccttacc

SEQ ID NO: 330901 - DNA, 25 bp, Mus musculus
agagccgcattttccttaccttcga

SEQ ID NO: 330902 - DNA, 25 bp, Mus musculus
gccgcattttccttaccttcgatcg

SEQ ID NO: 330903 - DNA, 25 bp, Mus musculus
agctgcttctcgcggccgcattggg

SEQ ID NO: 330904 - DNA, 25 bp, Mus musculus
tcccagccgagctgcaccgaccgcg

SEQ ID NO: 330905 - DNA, 25 bp, Mus musculus
ctctgcagcctgcacgtactgaggg

SEQ ID NO: 330906 - DNA, 25 bp, Mus musculus
aggctcggggtgacaatgctaaccc

SEQ ID NO: 330907 - DNA, 25 bp, Mus musculus
gccctgggaaagcacgagcgggaaa

SEQ ID NO: 330908 - DNA, 25 bp, Mus musculus
cgcggccggaacacccggctccagc

SEQ ID NO: 330909 - DNA, 25 bp, Mus musculus
gctgtcccttgtgtctttgccgagt

SEQ ID NO: 330910 - DNA, 25 bp, Mus musculus
atccacgcacgaacgaggggcttcc

SEQ ID NO: 330911 - DNA, 25 bp, Mus musculus
acaatgcgggatcgccgtgcactta

SEQ ID NO: 330912 - DNA, 25 bp, Mus musculus
cactcaggctggaggatccacgcac

SEQ ID NO: 330913 - DNA, 25 bp, Mus musculus
gtgcacttaccgaatccgaccgtga

SEQ ID NO: 330914 - DNA, 25 bp, Mus musculus
gccggaagatcagcagcagcacacc

SEQ ID NO: 330915 - DNA, 25 bp, Mus musculus
atgtccgtagcgcacacccaagagc

SEQ ID NO: 330916 - DNA, 25 bp, Mus musculus
aaggccttcactagtcttcgctcga

SEQ ID NO: 330917 - DNA, 25 bp, Mus musculus
tcttcgctcgaaggcgtctgttaac

SEQ ID NO: 330918 - DNA, 25 bp, Mus musculus
cgtctgttaacctagcggccggctt

SEQ ID NO: 330919 - DNA, 25 bp, Mus musculus
gccggcttccggagtgttaagcatc

SEQ ID NO: 330920 - DNA, 25 bp, Mus musculus
ccagggcatcgcaagttcgagttac

SEQ ID NO: 330921 - DNA, 25 bp, Mus musculus
tttgccgagttgctgaaggccttca

SEQ ID NO: 330922 - DNA, 25 bp, Mus musculus
gctattatttctagaccagggcatc

SEQ ID NO: 330923 - DNA, 25 bp, Mus musculus
catggcaaccatggcctgccggtcc

SEQ ID NO: 330924 - DNA, 25 bp, Mus musculus
cccaggaactgaaagtctccaagcc

SEQ ID NO: 330925 - DNA, 25 bp, Mus musculus
agacattgccgggaagatcaactcg

SEQ ID NO: 330926 - DNA, 25 bp, Mus musculus
ccgagtttagacattgccgggaaga

SEQ ID NO: 330927 - DNA, 25 bp, Mus musculus
ttctgccgagtttagacattgccgg

SEQ ID NO: 330928 - DNA, 25 bp, Mus musculus
gcgcacgcacgtttctgccgagttt

SEQ ID NO: 330929 - DNA, 25 bp, Mus musculus
gagcgcgcacgcacgtttctgccga

SEQ ID NO: 330930 - DNA, 25 bp, Mus musculus
tgaaagtctccaagccgtgacccgc

SEQ ID NO: 330931 - DNA, 25 bp, Mus musculus
ttgccgggaagatcaactcggtccc

SEQ ID NO: 330932 - DNA, 25 bp, Mus musculus
cgttgctaggagacctgcagcgggc

SEQ ID NO: 330933 - DNA, 25 bp, Mus musculus
gcagaagccgccagcatcaggcgcg

SEQ ID NO: 330934 - DNA, 25 bp, Mus musculus
cacacggggctcagggcccgagctt

SEQ ID NO: 330935 - DNA, 25 bp, Mus musculus
accggagcacgggatccggctacgc

SEQ ID NO: 330936 - DNA, 25 bp, Mus musculus
gcccccgtagacgtggaccggagca

SEQ ID NO: 330937 - DNA, 25 bp, Mus musculus
ccctgcttcatgaatccactatcgt

SEQ ID NO: 330938 - DNA, 25 bp, Mus musculus
tgctactcataaagccctaaatgtt

SEQ ID NO: 330939 - DNA, 25 bp, Mus musculus
cctggccagggattgttggctgtgc

SEQ ID NO: 330940 - DNA, 25 bp, Mus musculus
ttggctgtgccttgcattgggagcc

SEQ ID NO: 330941 - DNA, 25 bp, Mus musculus
gctgtgccttgcattgggagcctct

SEQ ID NO: 330942 - DNA, 25 bp, Mus musculus
gccttgcattgggagcctcttggcc

SEQ ID NO: 330943 - DNA, 25 bp, Mus musculus
tgcttcatgaatccactatcgtccc

SEQ ID NO: 330944 - DNA, 25 bp, Mus musculus
ccctcccaagataattgtagttaca

SEQ ID NO: 330945 - DNA, 25 bp, Mus musculus
tcccaagataattgtagttacacgg

SEQ ID NO: 330946 - DNA, 25 bp, Mus musculus
aattgtagttacacggaccaaggag

SEQ ID NO: 330947 - DNA, 25 bp, Mus musculus
caagataattgtagttacacggacc

SEQ ID NO: 330948 - DNA, 25 bp, Mus musculus
ctggcgctctcactcttacccgaca

SEQ ID NO: 330949 - DNA, 25 bp, Mus musculus
gtgttgctactcataaagccctaaa

SEQ ID NO: 330950 - DNA, 25 bp, Mus musculus
actcttacccgacacacgcagtttt

SEQ ID NO: 330951 - DNA, 25 bp, Mus musculus
tcgtactgtcattggttaaaggcgc

SEQ ID NO: 330952 - DNA, 25 bp, Mus musculus
actttcacccatttcctgcgttctg

SEQ ID NO: 330953 - DNA, 25 bp, Mus musculus
tgcgcctgcctctgacaagaacatc

SEQ ID NO: 330954 - DNA, 25 bp, Mus musculus
aagaacatcgccaccgacacggaga

SEQ ID NO: 330955 - DNA, 25 bp, Mus musculus
cgctgtttaacgatggggcgtatgc

SEQ ID NO: 330956 - DNA, 25 bp, Mus musculus
cgacacggagaccaagccaggcgtc

SEQ ID NO: 330957 - DNA, 25 bp, Mus musculus
tcctccgctgcagcgagaacacaga

SEQ ID NO: 330958 - DNA, 25 bp, Mus musculus
cgagaacacagaccagccactgcgg

SEQ ID NO: 330959 - DNA, 25 bp, Mus musculus
tgggactcaacttcgccgcgcaact

SEQ ID NO: 330960 - DNA, 25 bp, Mus musculus
ttctgaggcgctggcttcgcctgct

SEQ ID NO: 330961 - DNA, 25 bp, Mus musculus
ccactggcgttgatttcgtactgtc

SEQ ID NO: 330962 - DNA, 25 bp, Mus musculus
agctccttgctgcaacgcgcctttg

SEQ ID NO: 330963 - DNA, 25 bp, Mus musculus
ggcgtatgccggacagctccttgct

SEQ ID NO: 330964 - DNA, 25 bp, Mus musculus
aacgtctcctcccattggtcagtct

SEQ ID NO: 330965 - DNA, 25 bp, Mus musculus
gacgcgctgcagagccgctggcctt

SEQ ID NO: 330966 - DNA, 25 bp, Mus musculus
catcagatgtggtagtggaaggcca

SEQ ID NO: 330967 - DNA, 25 bp, Mus musculus
cctaacccttgggacgcgctgcaga

SEQ ID NO: 330968 - DNA, 25 bp, Mus musculus
ccggaccctgcgctcctaacccttg

SEQ ID NO: 330969 - DNA, 25 bp, Mus musculus
tccttgggcagggttcctccgctct

SEQ ID NO: 330970 - DNA, 25 bp, Mus musculus
cgctgccatcagatgtggtagtgga

SEQ ID NO: 330971 - DNA, 25 bp, Mus musculus
atggccgctgccatcagatgtggta

SEQ ID NO: 330972 - DNA, 25 bp, Mus musculus
gcccgccctcctcatggcggcgcga

SEQ ID NO: 330973 - DNA, 25 bp, Mus musculus
cggcggcggtaactctgcgcccgcc

SEQ ID NO: 330974 - DNA, 25 bp, Mus musculus
gcgggtcaggtaggtgtctgccgct

SEQ ID NO: 330975 - DNA, 25 bp, Mus musculus
tggaccacgctccacaccagggaca

SEQ ID NO: 330976 - DNA, 25 bp, Mus musculus
gcgagtttgaactgcgcgcatgcgc

SEQ ID NO: 330977 - DNA, 25 bp, Mus musculus
cgccggcgagtttgaactgcgcgca

SEQ ID NO: 330978 - DNA, 25 bp, Mus musculus
agggttcctccgctctgagtcccgg

SEQ ID NO: 330979 - DNA, 25 bp, Mus musculus
cccagcggttcacaaaagaaccttg

SEQ ID NO: 330980 - DNA, 25 bp, Mus musculus
tgtccttggccggttctccgggaga

SEQ ID NO: 330981 - DNA, 25 bp, Mus musculus
agatggaactcttctggccgctgtc

SEQ ID NO: 330982 - DNA, 25 bp, Mus musculus
accgggtgaaagagatggaactctt

SEQ ID NO: 330983 - DNA, 25 bp, Mus musculus
gccgaggcgatcaaaaccgggtgaa

SEQ ID NO: 330984 - DNA, 25 bp, Mus musculus
caagaactacagagccgaggcgatc

SEQ ID NO: 330985 - DNA, 25 bp, Mus musculus
gctcagcgccactgactgcgcaaga

SEQ ID NO: 330986 - DNA, 25 bp, Mus musculus
tacatgttgtagcttggagttctca

SEQ ID NO: 330987 - DNA, 25 bp, Mus musculus
aagaaccttgttgccggcttacatg

SEQ ID NO: 330988 - DNA, 25 bp, Mus musculus
ctccagagctcatggcaagttgggg

SEQ ID NO: 330989 - DNA, 25 bp, Mus musculus
ccactgactgcgcaagaactacaga

SEQ ID NO: 330990 - DNA, 25 bp, Mus musculus
ccggcacgtgtggacagagaacgcc

SEQ ID NO: 330991 - DNA, 25 bp, Mus musculus
ccttgttgccggcttacatgttgta

SEQ ID NO: 330992 - DNA, 25 bp, Mus musculus
tagcttggagttctcagctcagcgc

SEQ ID NO: 330993 - DNA, 25 bp, Mus musculus
gctaaggtcggcagagcacatcctc

SEQ ID NO: 330994 - DNA, 25 bp, Mus musculus
cgccactacgaggaagccaccaggg

SEQ ID NO: 330995 - DNA, 25 bp, Mus musculus
tgcgaggtttcctccgccactacga

SEQ ID NO: 330996 - DNA, 25 bp, Mus musculus
ggggccacaacctgagccgtgaaga

SEQ ID NO: 330997 - DNA, 25 bp, Mus musculus
agctagcgcaggagttgcaggccaa

SEQ ID NO: 330998 - DNA, 25 bp, Mus musculus
ggctcatcctgctctacctgctggg

SEQ ID NO: 330999 - DNA, 25 bp, Mus musculus
acctgaacgaggacaacgcgcgctt

SEQ ID NO: 331000 - DNA, 25 bp, Mus musculus
ggagctgtcctccagtgccatggct

SEQ ID NO: 331001 - DNA, 25 bp, Mus musculus
cccgcacgcagagcaggctaaggtc

SEQ ID NO: 331002 - DNA, 25 bp, Mus musculus
ctggctacacaggaaccaccgagga

SEQ ID NO: 331003 - DNA, 25 bp, Mus musculus
caaagcggattcgaaaccacgagtc

SEQ ID NO: 331004 - DNA, 25 bp, Mus musculus
gaccctctggtcttcagccttaagg

SEQ ID NO: 331005 - DNA, 25 bp, Mus musculus
aagcagattctgtgtcccgaccctc

SEQ ID NO: 331006 - DNA, 25 bp, Mus musculus
cctcgcaccaagtcgaagcagattc

SEQ ID NO: 331007 - DNA, 25 bp, Mus musculus
tcccgataggcttccgtagcctgtt

SEQ ID NO: 331008 - DNA, 25 bp, Mus musculus
tcgtgctcaacttcgcccgtgagga

SEQ ID NO: 331009 - DNA, 25 bp, Mus musculus
cccgtgaggaagttggtcccgatag

SEQ ID NO: 331010 - DNA, 25 bp, Mus musculus
cttccgttctgtccgggtcgctttg

SEQ ID NO: 331011 - DNA, 25 bp, Mus musculus
tcgctttggtggatgcacttccggc

SEQ ID NO: 331012 - DNA, 25 bp, Mus musculus
tttcggctggtcgtctcaaacatcc

SEQ ID NO: 331013 - DNA, 25 bp, Mus musculus
agtgtttctccgcagacggctcagc

SEQ ID NO: 331014 - DNA, 25 bp, Mus musculus
cgatgtgacgctcgggttcatcgcg

SEQ ID NO: 331015 - DNA, 25 bp, Mus musculus
agcggatctcactccctggcggacg

SEQ ID NO: 331016 - DNA, 25 bp, Mus musculus
tgaaccgctcgagtaggcaggcgct

SEQ ID NO: 331017 - DNA, 25 bp, Mus musculus
ttcagatgtaggcacggaggttacc

SEQ ID NO: 331018 - DNA, 25 bp, Mus musculus
ctctccggtttggttggttgagccg

SEQ ID NO: 331019 - DNA, 25 bp, Mus musculus
agccgcagagccagcgtagtgtttc

SEQ ID NO: 331020 - DNA, 25 bp, Mus musculus
ctgaaggaagatggtgagtgactaa

SEQ ID NO: 331021 - DNA, 25 bp, Mus musculus
gttaatatgtggaccgctcggcctg

SEQ ID NO: 331022 - DNA, 25 bp, Mus musculus
agttccatctccagctcggcataga

SEQ ID NO: 331023 - DNA, 25 bp, Mus musculus
ctcggcatagagcagactgagctcg

SEQ ID NO: 331024 - DNA, 25 bp, Mus musculus
agcagactgagctcgcagagttcac

SEQ ID NO: 331025 - DNA, 25 bp, Mus musculus
tcgcagagttcacggtccttcagct

SEQ ID NO: 331026 - DNA, 25 bp, Mus musculus
agtccggcgacagttccatctccag

SEQ ID NO: 331027 - DNA, 25 bp, Mus musculus
tgtagggcccgtagggactgctctc

SEQ ID NO: 331028 - DNA, 25 bp, Mus musculus
cgcgagctcgtaagccttccgagct

SEQ ID NO: 331029 - DNA, 25 bp, Mus musculus
gctcctctcgagtccggcgacagtt

SEQ ID NO: 331030 - DNA, 25 bp, Mus musculus
ttcagcacctgggtggacgagacct

SEQ ID NO: 331031 - DNA, 25 bp, Mus musculus
tcggcctgtggtggctcctctcgag

SEQ ID NO: 331032 - DNA, 25 bp, Mus musculus
gactgctctccgtcagccgtgttaa

SEQ ID NO: 331033 - DNA, 25 bp, Mus musculus
tctccgtcagccgtgttaatatgtg

SEQ ID NO: 331034 - DNA, 25 bp, Mus musculus
agccttccgagctttcagcacctgg

SEQ ID NO: 331035 - DNA, 25 bp, Mus musculus
gcgccagccggagcatttagctttc

SEQ ID NO: 331036 - DNA, 25 bp, Mus musculus
ggcgtgaacccaaacaaaactgctc

SEQ ID NO: 331037 - DNA, 25 bp, Mus musculus
cgcagagcctttttcgactggtcaa

SEQ ID NO: 331038 - DNA, 25 bp, Mus musculus
ggccaaccaggaccattcacgcgga

SEQ ID NO: 331039 - DNA, 25 bp, Mus musculus
ggccaatcaggcagctcgactcttt

SEQ ID NO: 331040 - DNA, 25 bp, Mus musculus
aaacgcattaggagcccgcgggatc

SEQ ID NO: 331041 - DNA, 25 bp, Mus musculus
ccaggacgcaaaccaagcagcttta

SEQ ID NO: 331042 - DNA, 25 bp, Mus musculus
gaatcgaatcctgtcccgggtgccc

SEQ ID NO: 331043 - DNA, 25 bp, Mus musculus
ctgctggtagagacggaatcgaatc

SEQ ID NO: 331044 - DNA, 25 bp, Mus musculus
agcgagtctcctttctgctggtaga

SEQ ID NO: 331045 - DNA, 25 bp, Mus musculus
tcgtgcacagcgtgagcaaaaaatg

SEQ ID NO: 331046 - DNA, 25 bp, Mus musculus
aggaccctgcagctcgagcaagatg

SEQ ID NO: 331047 - DNA, 25 bp, Mus musculus
gcggccgtttggagcacagttaaaa

SEQ ID NO: 331048 - DNA, 25 bp, Mus musculus
ggcgagctttccagaaggaccctgc

SEQ ID NO: 331049 - DNA, 25 bp, Mus musculus
cgaagctctcggagttcgtccagca

SEQ ID NO: 331050 - DNA, 25 bp, Mus musculus
tgtcgtccacaaagtcctcaagctc

SEQ ID NO: 331051 - DNA, 25 bp, Mus musculus
ctgaggctactccttgtcgtccaca

SEQ ID NO: 331052 - DNA, 25 bp, Mus musculus
cctccagatgcactttgagataata

SEQ ID NO: 331053 - DNA, 25 bp, Mus musculus
tttccaaagcggcaccaggcagcga

SEQ ID NO: 331054 - DNA, 25 bp, Mus musculus
cgtgtggactttgttctcctccaga

SEQ ID NO: 331055 - DNA, 25 bp, Mus musculus
gtccagcagatctcctcgctcttga

SEQ ID NO: 331056 - DNA, 25 bp, Mus musculus
acaggcgttctgcaccactagctcg

SEQ ID NO: 331057 - DNA, 25 bp, Mus musculus
gccggctgtagccacaagagctcta

SEQ ID NO: 331058 - DNA, 25 bp, Mus musculus
gtagacactcaagtcggcgccctga

SEQ ID NO: 331059 - DNA, 25 bp, Mus musculus
gccgccggtcactttggaaaagatg

SEQ ID NO: 331060 - DNA, 25 bp, Mus musculus
ctcatccgagaagaagtaggcaacc

SEQ ID NO: 331061 - DNA, 25 bp, Mus musculus
cagccttgaactcgcgctttccaaa

SEQ ID NO: 331062 - DNA, 25 bp, Mus musculus
ataatactgctgttgcggcggctgc

SEQ ID NO: 331063 - DNA, 25 bp, Mus musculus
gaccaccagcacagctggacacatg

SEQ ID NO: 331064 - DNA, 25 bp, Mus musculus
ttccctggtgctcctgcaaaagtcg

SEQ ID NO: 331065 - DNA, 25 bp, Mus musculus
ccagagaggaaataaggacatctcc

SEQ ID NO: 331066 - DNA, 25 bp, Mus musculus
agaggaaataaggacatctcccgtt

SEQ ID NO: 331067 - DNA, 25 bp, Mus musculus
atagccacggtggaagtacgcctgg

SEQ ID NO: 331068 - DNA, 25 bp, Mus musculus
tggcggcggccggtcaccaaccaga

SEQ ID NO: 331069 - DNA, 25 bp, Mus musculus
tcctgcaaaagtcgttgcccttcct

SEQ ID NO: 331070 - DNA, 25 bp, Mus musculus
acagctggacacatgccgccgggtt

SEQ ID NO: 331071 - DNA, 25 bp, Mus musculus
ctccgggcagactgcatggaccaca

SEQ ID NO: 331072 - DNA, 25 bp, Mus musculus
agactgcatggaccacacccgttta

SEQ ID NO: 331073 - DNA, 25 bp, Mus musculus
ttttcttgcgcgagccttctttttc

SEQ ID NO: 331074 - DNA, 25 bp, Mus musculus
gaatcctccgggcagactgcatgga

SEQ ID NO: 331075 - DNA, 25 bp, Mus musculus
tcttgcgcgagccttctttttcatt

SEQ ID NO: 331076 - DNA, 25 bp, Mus musculus
ctggtgctcctgcaaaagtcgttgc

SEQ ID NO: 331077 - DNA, 25 bp, Mus musculus
ggctgccagagaacctcctctgagt

SEQ ID NO: 331078 - DNA, 25 bp, Mus musculus
cccgagctttctgaacagatttgta

SEQ ID NO: 331079 - DNA, 25 bp, Mus musculus
cagacgtagcagctgcccgagcttt

SEQ ID NO: 331080 - DNA, 25 bp, Mus musculus
ccttcgctcgcaccatggtaggttg

SEQ ID NO: 331081 - DNA, 25 bp, Mus musculus
aggtagcgcgttagcagcagcagaa

SEQ ID NO: 331082 - DNA, 25 bp, Mus musculus
cggctgaggctcagcgcacaacgca

SEQ ID NO: 331083 - DNA, 25 bp, Mus musculus
ccgtggtgccgttactcgaagtcgg

SEQ ID NO: 331084 - DNA, 25 bp, Mus musculus
tttcgggtttgcatctccgctctgg

SEQ ID NO: 331085 - DNA, 25 bp, Mus musculus
cagctgcagtgaaaggggatgtatt

SEQ ID NO: 331086 - DNA, 25 bp, Mus musculus
ccattttgccaggtgttacgcagca

SEQ ID NO: 331087 - DNA, 25 bp, Mus musculus
cggggtgtcctcagccaccttcaga

SEQ ID NO: 331088 - DNA, 25 bp, Mus musculus
cctcctctgagttttgggcgcctct

SEQ ID NO: 331089 - DNA, 25 bp, Mus musculus
ctggactctacagtgggctgtgcgc

SEQ ID NO: 331090 - DNA, 25 bp, Mus musculus
cccgaccgcggagaatgaatgggtc

SEQ ID NO: 331091 - DNA, 25 bp, Mus musculus
gcacgtcaggactccaaggctccga

SEQ ID NO: 331092 - DNA, 25 bp, Mus musculus
tctctggggtcggtgaacctctcca

SEQ ID NO: 331093 - DNA, 25 bp, Mus musculus
cagcctgcacgtcaggactccaagg

SEQ ID NO: 331094 - DNA, 25 bp, Mus musculus
ggggtcggtgaacctctccagcctg

SEQ ID NO: 331095 - DNA, 25 bp, Mus musculus
tctccagccgcgagcccgccttcct

SEQ ID NO: 331096 - DNA, 25 bp, Mus musculus
gagcggcagcgctcgatctccgtct

SEQ ID NO: 331097 - DNA, 25 bp, Mus musculus
tcccattggcactcggagcggcagc

SEQ ID NO: 331098 - DNA, 25 bp, Mus musculus
acgagctcggggatccgctcccatt

SEQ ID NO: 331099 - DNA, 25 bp, Mus musculus
agctgcttgacgagctcggggatcc

SEQ ID NO: 331100 - DNA, 25 bp, Mus musculus
taccgttggcgatgagcttggccga

SEQ ID NO: 331101 - DNA, 25 bp, Mus musculus
tgcgtccgcgcgtaccgttggcgat

SEQ ID NO: 331102 - DNA, 25 bp, Mus musculus
gggatccgctcccattggcactcgg

SEQ ID NO: 331103 - DNA, 25 bp, Mus musculus
agcttggccgacagctgcttgacga

SEQ ID NO: 331104 - DNA, 25 bp, Mus musculus
aaggctccgacaggcacagcccgcc

SEQ ID NO: 331105 - DNA, 25 bp, Mus musculus
cttgacagtaaggagctgctcgccg

SEQ ID NO: 331106 - DNA, 25 bp, Mus musculus
tgtcacccacgtgtttgcgctcgcg

SEQ ID NO: 331107 - DNA, 25 bp, Mus musculus
cttaggggaacctgatgggacagca

SEQ ID NO: 331108 - DNA, 25 bp, Mus musculus
ctccgacactgaggcgagtctcttt

SEQ ID NO: 331109 - DNA, 25 bp, Mus musculus
agcgggcaccgctagtacggcacaa

SEQ ID NO: 331110 - DNA, 25 bp, Mus musculus
gtccgcagctcgtgcttgacagtaa

SEQ ID NO: 331111 - DNA, 25 bp, Mus musculus
cccgctgctcgaattgttgttgctt

SEQ ID NO: 331112 - DNA, 25 bp, Mus musculus
cgcgaacgctccgattggcaagacc

SEQ ID NO: 331113 - DNA, 25 bp, Mus musculus
acctactcgctttggtgcgcacgcg

SEQ ID NO: 331114 - DNA, 25 bp, Mus musculus
tcctggagggaagcacttgtcaccc

SEQ ID NO: 331115 - DNA, 25 bp, Mus musculus
tatctagtagtcaggaggcgctccg

SEQ ID NO: 331116 - DNA, 25 bp, Mus musculus
gctccggacctctgattggctactg

SEQ ID NO: 331117 - DNA, 25 bp, Mus musculus
ggaccgcttggtccgccaatcacag

SEQ ID NO: 331118 - DNA, 25 bp, Mus musculus
cccagcttcgatctgttagtaaaca

SEQ ID NO: 331119 - DNA, 25 bp, Mus musculus
gcggctgctaaacccagtggcgacc

SEQ ID NO: 331120 - DNA, 25 bp, Mus musculus
agacattccctgctgacttcggtca

SEQ ID NO: 331121 - DNA, 25 bp, Mus musculus
cggtcacagtcaattctgcgggttc

SEQ ID NO: 331122 - DNA, 25 bp, Mus musculus
gcgggttcaccgcacgcatacggtg

SEQ ID NO: 331123 - DNA, 25 bp, Mus musculus
tccggagcaggactcagaacccagc

SEQ ID NO: 331124 - DNA, 25 bp, Mus musculus
ggtaagccagcgaccagtaaccatg

SEQ ID NO: 331125 - DNA, 25 bp, Mus musculus
gccacgttgtgcgagattcctcccg

SEQ ID NO: 331126 - DNA, 25 bp, Mus musculus
cctgatgtcctctggtgcagtgcgt

SEQ ID NO: 331127 - DNA, 25 bp, Mus musculus
tcaggcacagccagacctgtcggtc

SEQ ID NO: 331128 - DNA, 25 bp, Mus musculus
tgcaaggcacgcaggtccctttctc

SEQ ID NO: 331129 - DNA, 25 bp, Mus musculus
tcacactgaccgcaagccacagatg

SEQ ID NO: 331130 - DNA, 25 bp, Mus musculus
agccacagatgaggcgcctgctaga

SEQ ID NO: 331131 - DNA, 25 bp, Mus musculus
tcctagccactctgggccacgttgt

SEQ ID NO: 331132 - DNA, 25 bp, Mus musculus
ggctcgcgggaacacatacctgtgc

SEQ ID NO: 331133 - DNA, 25 bp, Mus musculus
gctttcccggactgcgtccactcta

SEQ ID NO: 331134 - DNA, 25 bp, Mus musculus
accgaccggacctgagtgagcgcag

SEQ ID NO: 331135 - DNA, 25 bp, Mus musculus
cgcaccgaccggacctgagtgagcg

SEQ ID NO: 331136 - DNA, 25 bp, Mus musculus
atggaggcatggcatccacccgcac

SEQ ID NO: 331137 - DNA, 25 bp, Mus musculus
aggtccgatggaggcatggcatcca

SEQ ID NO: 331138 - DNA, 25 bp, Mus musculus
acggaaggcacgcagctcgcaaggc

SEQ ID NO: 331139 - DNA, 25 bp, Mus musculus
ggcacggaaggcacgcagctcgcaa

SEQ ID NO: 331140 - DNA, 25 bp, Mus musculus
gagccactcacctctctctggtggg

SEQ ID NO: 331141 - DNA, 25 bp, Mus musculus
gtggagccactcacctctctctggt

SEQ ID NO: 331142 - DNA, 25 bp, Mus musculus
actctacccgcgagcggtggagcca

SEQ ID NO: 331143 - DNA, 25 bp, Mus musculus
ggcatggcatccacccgcaccgacc

SEQ ID NO: 331144 - DNA, 25 bp, Mus musculus
cctgagtgagcgcaggccccacgtg

SEQ ID NO: 331145 - DNA, 25 bp, Mus musculus
gagcggtggagccactcacctctct

SEQ ID NO: 331146 - DNA, 25 bp, Mus musculus
tccgatggaggcatggcatccaccc

SEQ ID NO: 331147 - DNA, 25 bp, Mus musculus
caccagagggctctgcagaaacagc

SEQ ID NO: 331148 - DNA, 25 bp, Mus musculus
ttccttcaggatggatgctggcggt

SEQ ID NO: 331149 - DNA, 25 bp, Mus musculus
cgcatcagtgcatctgctttgccga

SEQ ID NO: 331150 - DNA, 25 bp, Mus musculus
tctctgagcttcaggaggggtcacc

SEQ ID NO: 331151 - DNA, 25 bp, Mus musculus
cttggtgtaagcctcagactgcagg

SEQ ID NO: 331152 - DNA, 25 bp, Mus musculus
cgcctccggacaggacttctggcta

SEQ ID NO: 331153 - DNA, 25 bp, Mus musculus
cagcctagcggagaggagccgcacc

SEQ ID NO: 331154 - DNA, 25 bp, Mus musculus
aggacttctggctaacttttctcca

SEQ ID NO: 331155 - DNA, 25 bp, Mus musculus
agctcaacgagctgcgacaccgtca

SEQ ID NO: 331156 - DNA, 25 bp, Mus musculus
agcgtcccagaacgcgaggaaaata

SEQ ID NO: 331157 - DNA, 25 bp, Mus musculus
cgtctcagacgcacaggaaggcagc

SEQ ID NO: 331158 - DNA, 25 bp, Mus musculus
gagcgctcacccaggtcaccagagg

SEQ ID NO: 331159 - DNA, 25 bp, Mus musculus
tgcgacaccgtcacgtccatgctga

SEQ ID NO: 331160 - DNA, 25 bp, Mus musculus
cctcagactgcagggttgcgcatca

SEQ ID NO: 331161 - DNA, 25 bp, Mus musculus
agccggaggacacatggccagtacc

SEQ ID NO: 331162 - DNA, 25 bp, Mus musculus
gcgtccgtcgcactttgaattcgtc

SEQ ID NO: 331163 - DNA, 25 bp, Mus musculus
ttaaagcgacaagacgggagccggc

SEQ ID NO: 331164 - DNA, 25 bp, Mus musculus
ttccgtcttcctcacagagccaaag

SEQ ID NO: 331165 - DNA, 25 bp, Mus musculus
ctggctcttcttagaagccgccttc

SEQ ID NO: 331166 - DNA, 25 bp, Mus musculus
gaggtagcacttcccgggagactcc

SEQ ID NO: 331167 - DNA, 25 bp, Mus musculus
cgcttaaagcatccgaagccggtga

SEQ ID NO: 331168 - DNA, 25 bp, Mus musculus
gccatgttttcctcccttgtacctg

SEQ ID NO: 331169 - DNA, 25 bp, Mus musculus
ttccaacgaggtgcggctcggttca

SEQ ID NO: 331170 - DNA, 25 bp, Mus musculus
ttcagcctctccacgtagccggagg

SEQ ID NO: 331171 - DNA, 25 bp, Mus musculus
ggaacgcgcagcactacgcagccta

SEQ ID NO: 331172 - DNA, 25 bp, Mus musculus
tggcccagggacagtgtccagaaaa

SEQ ID NO: 331173 - DNA, 25 bp, Mus musculus
aattcgtcatcacctcggctccggg

SEQ ID NO: 331174 - DNA, 25 bp, Mus musculus
tcctcgttgagcgtgtagaccttca

SEQ ID NO: 331175 - DNA, 25 bp, Mus musculus
tctcacagaccggagcgcacctgag

SEQ ID NO: 331176 - DNA, 25 bp, Mus musculus
tcgcaggtaaagtcccgaggctgct

SEQ ID NO: 331177 - DNA, 25 bp, Mus musculus
cggagcgcacctgaggctcgcgaac

SEQ ID NO: 331178 - DNA, 25 bp, Mus musculus
gcaccgcaggcgtccgatgggctct

SEQ ID NO: 331179 - DNA, 25 bp, Mus musculus
tccgatgggctctcgggaacagccg

SEQ ID NO: 331180 - DNA, 25 bp, Mus musculus
agactgaaagcacccggctgcgttg

SEQ ID NO: 331181 - DNA, 25 bp, Mus musculus
cggctgcgttgcacctcggccagaa

SEQ ID NO: 331182 - DNA, 25 bp, Mus musculus
cccggagcgagagacacacctgcgt

SEQ ID NO: 331183 - DNA, 25 bp, Mus musculus
agagacacacctgcgtcgccgcggt

SEQ ID NO: 331184 - DNA, 25 bp, Mus musculus
aaggaggagtcccaccgctccggct

SEQ ID NO: 331185 - DNA, 25 bp, Mus musculus
tccggctgcctacctgtaactgaca

SEQ ID NO: 331186 - DNA, 25 bp, Mus musculus
tgtaactgacacagcagcgctcagc

SEQ ID NO: 331187 - DNA, 25 bp, Mus musculus
gctccaaagcttcgcaggtaaagtc

SEQ ID NO: 331188 - DNA, 25 bp, Mus musculus
tgaggctcgcgaacccgagcggaca

SEQ ID NO: 331189 - DNA, 25 bp, Mus musculus
ctcggtctggacacagctggttcag

SEQ ID NO: 331190 - DNA, 25 bp, Mus musculus
cgaggcttaaatcacgggctggaac

SEQ ID NO: 331191 - DNA, 25 bp, Mus musculus
tgagcaattgggaacccgaggctta

SEQ ID NO: 331192 - DNA, 25 bp, Mus musculus
acggacgaaagacgcgtgagcaatt

SEQ ID NO: 331193 - DNA, 25 bp, Mus musculus
caccaaggcggcttcacggacgaaa

SEQ ID NO: 331194 - DNA, 25 bp, Mus musculus
gaacttgaactcacaccaaggcggc

SEQ ID NO: 331195 - DNA, 25 bp, Mus musculus
aggctctgtggcagcacgaacttga

SEQ ID NO: 331196 - DNA, 25 bp, Mus musculus
ggctagactcctcacaacaatcttg

SEQ ID NO: 331197 - DNA, 25 bp, Mus musculus
gctggttcagattacagcgctcacc

SEQ ID NO: 331198 - DNA, 25 bp, Mus musculus
cccttcagtaattcagcattaagcc

SEQ ID NO: 331199 - DNA, 25 bp, Mus musculus
gccgccggcacctggtttcgcttaa

SEQ ID NO: 331200 - DNA, 25 bp, Mus musculus
tgttaaacaatgcaaatggggcctc

SEQ ID NO: 331201 - DNA, 25 bp, Mus musculus
gccaattggaggaggaatgttaaaa

SEQ ID NO: 331202 - DNA, 25 bp, Mus musculus
ttacagcgctcaccaactggctaga

SEQ ID NO: 331203 - DNA, 25 bp, Mus musculus
cttcgcgatagcgtagaagggccgc

SEQ ID NO: 331204 - DNA, 25 bp, Mus musculus
gcggcagtgaccatagagaagcttc

SEQ ID NO: 331205 - DNA, 25 bp, Mus musculus
tcgtgggccagtcctgccaactcaa

SEQ ID NO: 331206 - DNA, 25 bp, Mus musculus
cagccagatccgtgacttccgcgta

SEQ ID NO: 331207 - DNA, 25 bp, Mus musculus
tccaacagcatatccttcgtgaagt

SEQ ID NO: 331208 - DNA, 25 bp, Mus musculus
tcgcggaggaccaagtaaatgggcc

SEQ ID NO: 331209 - DNA, 25 bp, Mus musculus
tgactttcctcagtttcgtgggcca

SEQ ID NO: 331210 - DNA, 25 bp, Mus musculus
gtgcggctgcactacttctttctca

SEQ ID NO: 331211 - DNA, 25 bp, Mus musculus
ccggcctgacgcttcaccaagggtt

SEQ ID NO: 331212 - DNA, 25 bp, Mus musculus
cggatccagacgctgaggactcgca

SEQ ID NO: 331213 - DNA, 25 bp, Mus musculus
aaatgtccctggacgccgaagctgg

SEQ ID NO: 331214 - DNA, 25 bp, Mus musculus
ggtggacacgtcctctccaaatgtc

SEQ ID NO: 331215 - DNA, 25 bp, Mus musculus
cctacttgaccgagagactggccca

SEQ ID NO: 331216 - DNA, 25 bp, Mus musculus
cgtgaagttcgaaatctggccagtg

SEQ ID NO: 331217 - DNA, 25 bp, Mus musculus
tgtcatgactgagggcacgtgagtc

SEQ ID NO: 331218 - DNA, 25 bp, Mus musculus
tgcccacctggtgatgctctgattg

SEQ ID NO: 331219 - DNA, 25 bp, Mus musculus
ggtgcgtctctcgtgcccacctggt

SEQ ID NO: 331220 - DNA, 25 bp, Mus musculus
agccactgtggtcgcggtgcgtctc

SEQ ID NO: 331221 - DNA, 25 bp, Mus musculus
tgcgcccagccactgtggtcgcggt

SEQ ID NO: 331222 - DNA, 25 bp, Mus musculus
tcctcgcccacaggccggcctcttt

SEQ ID NO: 331223 - DNA, 25 bp, Mus musculus
acctggtgatgctctgattggccga

SEQ ID NO: 331224 - DNA, 25 bp, Mus musculus
acgtgagtcgcggaccctgggcttc

SEQ ID NO: 331225 - DNA, 25 bp, Mus musculus
tgctgtcatgactgagggcacgtga

SEQ ID NO: 331226 - DNA, 25 bp, Mus musculus
tggcagagagtagtgctgtcatgac

SEQ ID NO: 331227 - DNA, 25 bp, Mus musculus
cactaggctgtcaggtaaagggctg

SEQ ID NO: 331228 - DNA, 25 bp, Mus musculus
gcctgcgcagtgcactaggctgtca

SEQ ID NO: 331229 - DNA, 25 bp, Mus musculus
cacccagtagttccggtcggccgag

SEQ ID NO: 331230 - DNA, 25 bp, Mus musculus
tctgattggccgagctcgcatcggc

SEQ ID NO: 331231 - DNA, 25 bp, Mus musculus
gggtttcctttgtgctccgccctgc

SEQ ID NO: 331232 - DNA, 25 bp, Mus musculus
ttgaacagccgttttccaggcccgc

SEQ ID NO: 331233 - DNA, 25 bp, Mus musculus
tgggactgcggttccgatctatccg

SEQ ID NO: 331234 - DNA, 25 bp, Mus musculus
cgatctatccggagacgagcagtga

SEQ ID NO: 331235 - DNA, 25 bp, Mus musculus
atgcgctccgtgtctacgctggctt

SEQ ID NO: 331236 - DNA, 25 bp, Mus musculus
gtctgctccacctggcaagtcctgg

SEQ ID NO: 331237 - DNA, 25 bp, Mus musculus
agccgcgcggacgactcttaaatcc

SEQ ID NO: 331238 - DNA, 25 bp, Mus musculus
ggaacgcgcccattggctaggactc

SEQ ID NO: 331239 - DNA, 25 bp, Mus musculus
tgagaacacagtccgcccgcgttcg

SEQ ID NO: 331240 - DNA, 25 bp, Mus musculus
cgagtccctagtaactgagaacaca

SEQ ID NO: 331241 - DNA, 25 bp, Mus musculus
tgctcctttgcaaccgagtccctag

SEQ ID NO: 331242 - DNA, 25 bp, Mus musculus
cgagccctgccaatctcggctgggg

SEQ ID NO: 331243 - DNA, 25 bp, Mus musculus
ccagcctcaacgcattgggagcgta

SEQ ID NO: 331244 - DNA, 25 bp, Mus musculus
gcgtggctagtacacccagctgctc

SEQ ID NO: 331245 - DNA, 25 bp, Mus musculus
ccgcctgagttcctgaagcggcgtc

SEQ ID NO: 331246 - DNA, 25 bp, Mus musculus
acgaggcacgcgaacccgggagcac

SEQ ID NO: 331247 - DNA, 25 bp, Mus musculus
cacactcactttctcgtggaagatg

SEQ ID NO: 331248 - DNA, 25 bp, Mus musculus
ctgctgtgcggaggaacttctctac

SEQ ID NO: 331249 - DNA, 25 bp, Mus musculus
ggcgcacgtcacgaggcacgcgaac

SEQ ID NO: 331250 - DNA, 25 bp, Mus musculus
aaccaatcactactgcgggcgcacg

SEQ ID NO: 331251 - DNA, 25 bp, Mus musculus
tagccacgtgcctctcgccaaccaa

SEQ ID NO: 331252 - DNA, 25 bp, Mus musculus
tttatttgtctggagccaacggccc

SEQ ID NO: 331253 - DNA, 25 bp, Mus musculus
cctcacccagccaggtcgggatggg

SEQ ID NO: 331254 - DNA, 25 bp, Mus musculus
gcccgcgctaatcctccgggtgaag

SEQ ID NO: 331255 - DNA, 25 bp, Mus musculus
tgagttcctgaagcggcgtcgctgc

SEQ ID NO: 331256 - DNA, 25 bp, Mus musculus
tttctcgtggaagatggactccatg

SEQ ID NO: 331257 - DNA, 25 bp, Mus musculus
gatggactccatgtttatttgtctg

SEQ ID NO: 331258 - DNA, 25 bp, Mus musculus
aacgcatgcgggaggcttcacgagc

SEQ ID NO: 331259 - DNA, 25 bp, Mus musculus
gccgtgacctaaggagctgccactc

SEQ ID NO: 331260 - DNA, 25 bp, Mus musculus
tgcgggtttcacaatcaggagagtt

SEQ ID NO: 331261 - DNA, 25 bp, Mus musculus
cgagagccaggccatcagatcgtcc

SEQ ID NO: 331262 - DNA, 25 bp, Mus musculus
cccagagcagtctttgtaaaaggcg

SEQ ID NO: 331263 - DNA, 25 bp, Mus musculus
gacagtctccgtggttcctggaaca

SEQ ID NO: 331264 - DNA, 25 bp, Mus musculus
tgtgggctcaagagtcggatccttg

SEQ ID NO: 331265 - DNA, 25 bp, Mus musculus
tcttaagctgtgaatgatcgcgaca

SEQ ID NO: 331266 - DNA, 25 bp, Mus musculus
gatcgcgacacgttttgaataagac

SEQ ID NO: 331267 - DNA, 25 bp, Mus musculus
cgtggatccaggctgacaaggtttg

SEQ ID NO: 331268 - DNA, 25 bp, Mus musculus
ttgcgagcttttgcgctgtcctctt

SEQ ID NO: 331269 - DNA, 25 bp, Mus musculus
tctccgacctgcgttccactagggg

SEQ ID NO: 331270 - DNA, 25 bp, Mus musculus
cccgcggtttcggttgtgacagtct

SEQ ID NO: 331271 - DNA, 25 bp, Mus musculus
agctgcattccctattgtgggctca

SEQ ID NO: 331272 - DNA, 25 bp, Mus musculus
cgcgcgaatcccgtacatcttaagc

SEQ ID NO: 331273 - DNA, 25 bp, Mus musculus
gactgccttgttcgcggaccatgaa

SEQ ID NO: 331274 - DNA, 25 bp, Mus musculus
ggactcatccggcagagcaaagttc

SEQ ID NO: 331275 - DNA, 25 bp, Mus musculus
agacacaggctctggccgcctaaga

SEQ ID NO: 331276 - DNA, 25 bp, Mus musculus
atgctgccgcagcaagttggcttcg

SEQ ID NO: 331277 - DNA, 25 bp, Mus musculus
ggaactctgagctccggccgtgcat

SEQ ID NO: 331278 - DNA, 25 bp, Mus musculus
ggagatggctctccgtggactcatc

SEQ ID NO: 331279 - DNA, 25 bp, Mus musculus
aagctcgggatcttcttccaggggc

SEQ ID NO: 331280 - DNA, 25 bp, Mus musculus
ttctgcacgcacttagctgccaggg

SEQ ID NO: 331281 - DNA, 25 bp, Mus musculus
acagacagcgctccaacccttgaag

SEQ ID NO: 331282 - DNA, 25 bp, Mus musculus
tttccgagagaagcagaggagcctc

SEQ ID NO: 331283 - DNA, 25 bp, Mus musculus
taaacttggacgaggaggatgctgc

SEQ ID NO: 331284 - DNA, 25 bp, Mus musculus
ggcgctcgccaagcactgattgctc

SEQ ID NO: 331285 - DNA, 25 bp, Mus musculus
gtctcctcgccacggagtcatggtg

SEQ ID NO: 331286 - DNA, 25 bp, Mus musculus
ggaccatgaagctatctcccagagc

SEQ ID NO: 331287 - DNA, 25 bp, Mus musculus
acgtcgtggatgtcatgctgaaatg

SEQ ID NO: 331288 - DNA, 25 bp, Mus musculus
ctacgggacgtcgtggatgtcatgc

SEQ ID NO: 331289 - DNA, 25 bp, Mus musculus
cccgagagccctgggtgctccggat

SEQ ID NO: 331290 - DNA, 25 bp, Mus musculus
tgcctcttttgctcagcttgatccc

SEQ ID NO: 331291 - DNA, 25 bp, Mus musculus
gtcctgcctcttttgctcagcttga

SEQ ID NO: 331292 - DNA, 25 bp, Mus musculus
aggtggcccgcgtcctgcctctttt

SEQ ID NO: 331293 - DNA, 25 bp, Mus musculus
aagtggcaacccgtgcccgccgctc

SEQ ID NO: 331294 - DNA, 25 bp, Mus musculus
cgcgctgcgatccaggaagtggaag

SEQ ID NO: 331295 - DNA, 25 bp, Mus musculus
atggcttctgacaaaaaacccttga

SEQ ID NO: 331296 - DNA, 25 bp, Mus musculus
ggatgtcatgctgaaatgaacaccc

SEQ ID NO: 331297 - DNA, 25 bp, Mus musculus
gggcggccacagtccgtgctgtcct

SEQ ID NO: 331298 - DNA, 25 bp, Mus musculus
ctgctacgagcagccacggccgaat

SEQ ID NO: 331299 - DNA, 25 bp, Mus musculus
acggccgaatggcttctgacaaaaa

SEQ ID NO: 331300 - DNA, 25 bp, Mus musculus
cttgaccaccaaggccggcctcttc

SEQ ID NO: 331301 - DNA, 25 bp, Mus musculus
acacagatcgctgagcccgggctac

SEQ ID NO: 331302 - DNA, 25 bp, Mus musculus
gtgactgcagaaccgtgggaattcc

SEQ ID NO: 331303 - DNA, 25 bp, Mus musculus
cggcaagccagaaagactacgaatc

SEQ ID NO: 331304 - DNA, 25 bp, Mus musculus
ctgaggccggcaagccagaaagact

SEQ ID NO: 331305 - DNA, 25 bp, Mus musculus
ggaaaccaatagaagctgagactga

SEQ ID NO: 331306 - DNA, 25 bp, Mus musculus
tcggagtgtggcgtataaggaaacc

SEQ ID NO: 331307 - DNA, 25 bp, Mus musculus
ctgatttgtgcagcctcggagtgtg

SEQ ID NO: 331308 - DNA, 25 bp, Mus musculus
tgcgcagcctgatttgtgcagcctc

SEQ ID NO: 331309 - DNA, 25 bp, Mus musculus
tgagctgcggcaacacagatcgctg

SEQ ID NO: 331310 - DNA, 25 bp, Mus musculus
ccgctgtgattgagctgcggcaaca

SEQ ID NO: 331311 - DNA, 25 bp, Mus musculus
actcagagcagccacctctagagtc

SEQ ID NO: 331312 - DNA, 25 bp, Mus musculus
gcagactcagagcagccacctctag

SEQ ID NO: 331313 - DNA, 25 bp, Mus musculus
ctacgaatcccagtgtgcgtgggcg

SEQ ID NO: 331314 - DNA, 25 bp, Mus musculus
gaattccgggcgtcgcgcagactca

SEQ ID NO: 331315 - DNA, 25 bp, Mus musculus
tgccggcggcgttacgtcacacgca

SEQ ID NO: 331316 - DNA, 25 bp, Mus musculus
gtacgatgtgttctcgcctctcggg

SEQ ID NO: 331317 - DNA, 25 bp, Mus musculus
ctctggggacccagtacgatgtgtt

SEQ ID NO: 331318 - DNA, 25 bp, Mus musculus
cgtagcctccggataccgaggctga

SEQ ID NO: 331319 - DNA, 25 bp, Mus musculus
cgtcttcgctcagggacaaggaagg

SEQ ID NO: 331320 - DNA, 25 bp, Mus musculus
cgtgctcgtcttcgctcagggacaa

SEQ ID NO: 331321 - DNA, 25 bp, Mus musculus
tttcccgagcgctgtcgtgctcgtc

SEQ ID NO: 331322 - DNA, 25 bp, Mus musculus
tgttttgaggtcctcgccgcccttc

SEQ ID NO: 331323 - DNA, 25 bp, Mus musculus
actcaggcagctcgttggccactct

SEQ ID NO: 331324 - DNA, 25 bp, Mus musculus
ttacgtcacacgcacgctggcgcgg

SEQ ID NO: 331325 - DNA, 25 bp, Mus musculus
ttgtgggcgtgctccgcaatgttgt

SEQ ID NO: 331326 - DNA, 25 bp, Mus musculus
tggccactctgttttgaggtcctcg

SEQ ID NO: 331327 - DNA, 25 bp, Mus musculus
cgccgcctgagtgacctgctaggcg

SEQ ID NO: 331328 - DNA, 25 bp, Mus musculus
tcccggaagagctagccggcaggtc

SEQ ID NO: 331329 - DNA, 25 bp, Mus musculus
ccagggggcgccaatgagtcttaaa

SEQ ID NO: 331330 - DNA, 25 bp, Mus musculus
gacggccagggatctcccggcacga

SEQ ID NO: 331331 - DNA, 25 bp, Mus musculus
agtgcacctgagagccgcggtccga

SEQ ID NO: 331332 - DNA, 25 bp, Mus musculus
gcggccaccttgctgctccgaacca

SEQ ID NO: 331333 - DNA, 25 bp, Mus musculus
gcacagctccgcgaaggcctggaaa

SEQ ID NO: 331334 - DNA, 25 bp, Mus musculus
ccgcgaaggcctggaaattgagctt

SEQ ID NO: 331335 - DNA, 25 bp, Mus musculus
cctggaaattgagcttcttgacttt

SEQ ID NO: 331336 - DNA, 25 bp, Mus musculus
tgactttcttctcgctcagccagta

SEQ ID NO: 331337 - DNA, 25 bp, Mus musculus
ttcttctcgctcagccagtagccaa

SEQ ID NO: 331338 - DNA, 25 bp, Mus musculus
tagccaactctcttccctttcagga

SEQ ID NO: 331339 - DNA, 25 bp, Mus musculus
tccctttcaggaaggtctgcatctt

SEQ ID NO: 331340 - DNA, 25 bp, Mus musculus
ctgggtccggaggaaattgcccaca

SEQ ID NO: 331341 - DNA, 25 bp, Mus musculus
aaattgcccacaggccgagcgtgtg

SEQ ID NO: 331342 - DNA, 25 bp, Mus musculus
accgtgcgccgctcgaggactctag

SEQ ID NO: 331343 - DNA, 25 bp, Mus musculus
tccgggagcctgagaaaacagagca

SEQ ID NO: 331344 - DNA, 25 bp, Mus musculus
taatcactactagctcgtgctcccg

SEQ ID NO: 331345 - DNA, 25 bp, Mus musculus
gccgtagtcacgctgagcttaatca

SEQ ID NO: 331346 - DNA, 25 bp, Mus musculus
cggccctagacggaagctctgaatg

SEQ ID NO: 331347 - DNA, 25 bp, Mus musculus
aagctgacagcctgacgtcatgaga

SEQ ID NO: 331348 - DNA, 25 bp, Mus musculus
tcagggaacagacaaccgcctctgg

SEQ ID NO: 331349 - DNA, 25 bp, Mus musculus
gaacgaccgcagcaaacgcctcagg

SEQ ID NO: 331350 - DNA, 25 bp, Mus musculus
gtagatacatcgcttgggtcccgga

SEQ ID NO: 331351 - DNA, 25 bp, Mus musculus
tcaggatcacctgcccgtagataca

SEQ ID NO: 331352 - DNA, 25 bp, Mus musculus
cttagaaacgaacgccatcaggatc

SEQ ID NO: 331353 - DNA, 25 bp, Mus musculus
ccgccacaggcgcttagaaacgaac

SEQ ID NO: 331354 - DNA, 25 bp, Mus musculus
aagttaaccgtgtctgactcccgag

SEQ ID NO: 331355 - DNA, 25 bp, Mus musculus
acagagcatccacgttaagttaacc

SEQ ID NO: 331356 - DNA, 25 bp, Mus musculus
tttaacacgcagaggtccgggagcc

SEQ ID NO: 331357 - DNA, 25 bp, Mus musculus
catccaaagcgtcgtccggatcttc

SEQ ID NO: 331358 - DNA, 25 bp, Mus musculus
aagcgattgctcctcttctccgggg

SEQ ID NO: 331359 - DNA, 25 bp, Mus musculus
tcctgctccactagggtcccgaaga

SEQ ID NO: 331360 - DNA, 25 bp, Mus musculus
tcacaggacactcgtagccgctgcg

SEQ ID NO: 331361 - DNA, 25 bp, Mus musculus
acgtactcgcccgaaagctccatgg

SEQ ID NO: 331362 - DNA, 25 bp, Mus musculus
tggcgaccactcagcttcaacagcg

SEQ ID NO: 331363 - DNA, 25 bp, Mus musculus
tcaacagcgcgcctcggagaaacgc

SEQ ID NO: 331364 - DNA, 25 bp, Mus musculus
tccttccttaggattggctgtctgg

SEQ ID NO: 331365 - DNA, 25 bp, Mus musculus
agaagtgctcctactcgcaggtgcg

SEQ ID NO: 331366 - DNA, 25 bp, Mus musculus
ggcggccctttactctgtgcttcta

SEQ ID NO: 331367 - DNA, 25 bp, Mus musculus
attggcccgcccattttcttccgtg

SEQ ID NO: 331368 - DNA, 25 bp, Mus musculus
ctagtccaacgctcgccacggtttt

SEQ ID NO: 331369 - DNA, 25 bp, Mus musculus
cggctgccatttcatcctcagcttg

SEQ ID NO: 331370 - DNA, 25 bp, Mus musculus
atcagacaaagagggcagcgagttc

SEQ ID NO: 331371 - DNA, 25 bp, Mus musculus
cgcaccacgttgttgatggcgtgta

SEQ ID NO: 331372 - DNA, 25 bp, Mus musculus
accttgtggaagttctgctcgccca

SEQ ID NO: 331373 - DNA, 25 bp, Mus musculus
cctgttgctgattctggctgccata

SEQ ID NO: 331374 - DNA, 25 bp, Mus musculus
agtgggcaccacgttctgcttacgc

SEQ ID NO: 331375 - DNA, 25 bp, Mus musculus
tctgcttacgcatagagtgcactga

SEQ ID NO: 331376 - DNA, 25 bp, Mus musculus
agtgcactgactcctccaggctgtc

SEQ ID NO: 331377 - DNA, 25 bp, Mus musculus
cggtgacaccgtccgtgaggaagac

SEQ ID NO: 331378 - DNA, 25 bp, Mus musculus
ttgagtgggtcatcatccctccggg

SEQ ID NO: 331379 - DNA, 25 bp, Mus musculus
tacgatgcccgtgcccacgtgagaa

SEQ ID NO: 331380 - DNA, 25 bp, Mus musculus
gaattgaggtaggtggccctctcca

SEQ ID NO: 331381 - DNA, 25 bp, Mus musculus
ccaggctgtcattgccggtgacacc

SEQ ID NO: 331382 - DNA, 25 bp, Mus musculus
tgggaaggccacctgttgctgattc

SEQ ID NO: 331383 - DNA, 25 bp, Mus musculus
cgctccgagccatccagcaggaaga

SEQ ID NO: 331384 - DNA, 25 bp, Mus musculus
gctgccatattgcaacagagccatg

SEQ ID NO: 331385 - DNA, 25 bp, Mus musculus
aggtaggcacgcctttcgccaagtc

SEQ ID NO: 331386 - DNA, 25 bp, Mus musculus
attttgactccgacagggagcagga

SEQ ID NO: 331387 - DNA, 25 bp, Mus musculus
cgtcgccattttgactccgacaggg

SEQ ID NO: 331388 - DNA, 25 bp, Mus musculus
agtggcttaggctccgggaccactc

SEQ ID NO: 331389 - DNA, 25 bp, Mus musculus
ctctcctgtcagtggcttaggctcc

SEQ ID NO: 331390 - DNA, 25 bp, Mus musculus
gagggacactcacctcggaggctcc

SEQ ID NO: 331391 - DNA, 25 bp, Mus musculus
aagcctcggacaccgagggacactc

SEQ ID NO: 331392 - DNA, 25 bp, Mus musculus
tcctcccgggagctaagctagctta

SEQ ID NO: 331393 - DNA, 25 bp, Mus musculus
tgtcaaagctcaacgccagtctcgg

SEQ ID NO: 331394 - DNA, 25 bp, Mus musculus
cgaagctccgctccgtattgtctcc

SEQ ID NO: 331395 - DNA, 25 bp, Mus musculus
gcgagacggctcctcaagcctcgga

SEQ ID NO: 331396 - DNA, 25 bp, Mus musculus
tagacggccgagctggccagcgcct

SEQ ID NO: 331397 - DNA, 25 bp, Mus musculus
cgcagcccgtaaacaggagtccgcg

SEQ ID NO: 331398 - DNA, 25 bp, Mus musculus
gacgctttcacttcgcccgcgggga

SEQ ID NO: 331399 - DNA, 25 bp, Mus musculus
ctctgcggacaactcgggtcctttt

SEQ ID NO: 331400 - DNA, 25 bp, Mus musculus
ctgcacaactgggtcttgagccttg

SEQ ID NO: 331401 - DNA, 25 bp, Mus musculus
gactcagtgggtctctgttcgcagc

SEQ ID NO: 331402 - DNA, 25 bp, Mus musculus
ggcgcctcggtgctaccgacttaaa

SEQ ID NO: 331403 - DNA, 25 bp, Mus musculus
ggtccttttgttacccagaagctgc

SEQ ID NO: 331404 - DNA, 25 bp, Mus musculus
cctgcgtggagtttgtgcagtcttc

SEQ ID NO: 331405 - DNA, 25 bp, Mus musculus
ataagctcgggtctaccggctcacg

SEQ ID NO: 331406 - DNA, 25 bp, Mus musculus
ttttccaaaaaatcgcagagctgtc

SEQ ID NO: 331407 - DNA, 25 bp, Mus musculus
cgcttttaacttggggcggtcagca

SEQ ID NO: 331408 - DNA, 25 bp, Mus musculus
aggtaccgcgacaaagcccaaggca

SEQ ID NO: 331409 - DNA, 25 bp, Mus musculus
cactagctcttgctgtcgctgctca

SEQ ID NO: 331410 - DNA, 25 bp, Mus musculus
tcctcctccgatgaagcaagaagtg

SEQ ID NO: 331411 - DNA, 25 bp, Mus musculus
ggcgttccttttccgctgcacaact

SEQ ID NO: 331412 - DNA, 25 bp, Mus musculus
gtaccagcagcaggagctttccggg

SEQ ID NO: 331413 - DNA, 25 bp, Mus musculus
cctccgtgcgccttatgaatggaaa

SEQ ID NO: 331414 - DNA, 25 bp, Mus musculus
gggcaaagcctttccatctggacag

SEQ ID NO: 331415 - DNA, 25 bp, Mus musculus
gggagctcacacgacacagattttg

SEQ ID NO: 331416 - DNA, 25 bp, Mus musculus
ttcctcgcaacatcgctggcggagc

SEQ ID NO: 331417 - DNA, 25 bp, Mus musculus
ggggtatgcgctcttttcctcgcaa

SEQ ID NO: 331418 - DNA, 25 bp, Mus musculus
ccgaatggtagcgacacgggcctaa

SEQ ID NO: 331419 - DNA, 25 bp, Mus musculus
ccaccaaagcggagcagtgtaagta

SEQ ID NO: 331420 - DNA, 25 bp, Mus musculus
cggtcgagcccattttcccatttca

SEQ ID NO: 331421 - DNA, 25 bp, Mus musculus
tccggcactttaagaggcttttctc

SEQ ID NO: 331422 - DNA, 25 bp, Mus musculus
cctggagaacgccaatggggagatc

SEQ ID NO: 331423 - DNA, 25 bp, Mus musculus
cttcgctcgcaggatctacgggcct

SEQ ID NO: 331424 - DNA, 25 bp, Mus musculus
aagccatgcagagggttacttctcc

SEQ ID NO: 331425 - DNA, 25 bp, Mus musculus
cagtcctctggagcactgtcgtcgc

SEQ ID NO: 331426 - DNA, 25 bp, Mus musculus
cgggaccgaattctgcaatttgatg

SEQ ID NO: 331427 - DNA, 25 bp, Mus musculus
gtccgcacacttgactctgcttgca

SEQ ID NO: 331428 - DNA, 25 bp, Mus musculus
cactcgctgcatgtagtctttctgc

SEQ ID NO: 331429 - DNA, 25 bp, Mus musculus
cagggacttcagtgcgcacactgtc

SEQ ID NO: 331430 - DNA, 25 bp, Mus musculus
tgtctcataggcacctccgtacgtg

SEQ ID NO: 331431 - DNA, 25 bp, Mus musculus
ccaccgatcgtcgacacggagaagg

SEQ ID NO: 331432 - DNA, 25 bp, Mus musculus
agctctgctctcagcagccggacgg

SEQ ID NO: 331433 - DNA, 25 bp, Mus musculus
gcttcacttgcagaggacgagcgcg

SEQ ID NO: 331434 - DNA, 25 bp, Mus musculus
gagcaaaagtttgcgcgctgcttgg

SEQ ID NO: 331435 - DNA, 25 bp, Mus musculus
agcgggccgcaggagtcctccttca

SEQ ID NO: 331436 - DNA, 25 bp, Mus musculus
ggcggaggcgaaataaataatgcac

SEQ ID NO: 331437 - DNA, 25 bp, Mus musculus
aggaaaacagacgtgagcggagcca

SEQ ID NO: 331438 - DNA, 25 bp, Mus musculus
gctgcagtgattcctcgtctccatc

SEQ ID NO: 331439 - DNA, 25 bp, Mus musculus
tctgcttgcacagtaccaccaaatc

SEQ ID NO: 331440 - DNA, 25 bp, Mus musculus
gtaccaccaaatcactcgctgcatg

SEQ ID NO: 331441 - DNA, 25 bp, Mus musculus
gcaacagctcggtggcgtacacatt

SEQ ID NO: 331442 - DNA, 25 bp, Mus musculus
gcccgttgccgtacaggcaggagaa

SEQ ID NO: 331443 - DNA, 25 bp, Mus musculus
cgcagccgaggtccataaggaactt

SEQ ID NO: 331444 - DNA, 25 bp, Mus musculus
ggaacttgagtaacgacaggcactt

SEQ ID NO: 331445 - DNA, 25 bp, Mus musculus
cgacaggcacttcatggcaaacatg

SEQ ID NO: 331446 - DNA, 25 bp, Mus musculus
caaacatgatggtggctggaaaggc

SEQ ID NO: 331447 - DNA, 25 bp, Mus musculus
ttggcgccatggtccaacagcagct

SEQ ID NO: 331448 - DNA, 25 bp, Mus musculus
acagcagctgcatggtgcgcaggca

SEQ ID NO: 331449 - DNA, 25 bp, Mus musculus
cgtacacattgttgttgaccacagc

SEQ ID NO: 331450 - DNA, 25 bp, Mus musculus
ccacagcgaagtagagcgcagaact

SEQ ID NO: 331451 - DNA, 25 bp, Mus musculus
agccagaggtgcgttcacgtcgaag

SEQ ID NO: 331452 - DNA, 25 bp, Mus musculus
cggctggtcacaggcagcagcatct

SEQ ID NO: 331453 - DNA, 25 bp, Mus musculus
gcagcatctgcactattctgtaaga

SEQ ID NO: 331454 - DNA, 25 bp, Mus musculus
gcaggagcaggtcagtacaggatac

SEQ ID NO: 331455 - DNA, 25 bp, Mus musculus
caccctcgggattaacaccgggatg

SEQ ID NO: 331456 - DNA, 25 bp, Mus musculus
cgggtgtattctgcgctcacccaca

SEQ ID NO: 331457 - DNA, 25 bp, Mus musculus
gggcgcgaggcttagccctttccac

SEQ ID NO: 331458 - DNA, 25 bp, Mus musculus
acagtggaggtctgcgctccggtct

SEQ ID NO: 331459 - DNA, 25 bp, Mus musculus
gaggcccgacggctccggtcactat

SEQ ID NO: 331460 - DNA, 25 bp, Mus musculus
gattaacaccgggatgcgccgccgc

SEQ ID NO: 331461 - DNA, 25 bp, Mus musculus
aggcgagtgcagtcccacccacttt

SEQ ID NO: 331462 - DNA, 25 bp, Mus musculus
agtgcagtcccacccactttctgtg

SEQ ID NO: 331463 - DNA, 25 bp, Mus musculus
acgtctcgcgtccaggcctctgatt

SEQ ID NO: 331464 - DNA, 25 bp, Mus musculus
aggcctctgattgccggcttccgac

SEQ ID NO: 331465 - DNA, 25 bp, Mus musculus
ggcttccgacgtcaatcgcagggtg

SEQ ID NO: 331466 - DNA, 25 bp, Mus musculus
caatcgcagggtgtgcgtcttgctg

SEQ ID NO: 331467 - DNA, 25 bp, Mus musculus
tcttgctgggacacagtggaggtct

SEQ ID NO: 331468 - DNA, 25 bp, Mus musculus
tccggtcactatggtcagtggtggc

SEQ ID NO: 331469 - DNA, 25 bp, Mus musculus
acgcttcctgtttatggtttaggca

SEQ ID NO: 331470 - DNA, 25 bp, Mus musculus
agtgacctgtgccttctgccagagt

SEQ ID NO: 331471 - DNA, 25 bp, Mus musculus
caatgtttcggagctccttcctgga

SEQ ID NO: 331472 - DNA, 25 bp, Mus musculus
ttctgccagagtcccacgagggctt

SEQ ID NO: 331473 - DNA, 25 bp, Mus musculus
ctgtgtggcctaggttacgcttcct

SEQ ID NO: 331474 - DNA, 25 bp, Mus musculus
tctctcaggactttggctggaactc

SEQ ID NO: 331475 - DNA, 25 bp, Mus musculus
cgtctatctgattggcactctctca

SEQ ID NO: 331476 - DNA, 25 bp, Mus musculus
cgcctctgtgcggaagcgtctatct

SEQ ID NO: 331477 - DNA, 25 bp, Mus musculus
cgtgcgcgctaaggaaggaagttcc

SEQ ID NO: 331478 - DNA, 25 bp, Mus musculus
agcagcttcagtactgcagttccgg

SEQ ID NO: 331479 - DNA, 25 bp, Mus musculus
atgcttcgaagacaccggggagccc

SEQ ID NO: 331480 - DNA, 25 bp, Mus musculus
acaccggtgagccacgatgcttcga

SEQ ID NO: 331481 - DNA, 25 bp, Mus musculus
ttgccgggccttgatgcccacagca

SEQ ID NO: 331482 - DNA, 25 bp, Mus musculus
ccttcctggacgctagggagcgcaa

SEQ ID NO: 331483 - DNA, 25 bp, Mus musculus
tttggctacatggaggacctgcagg

SEQ ID NO: 331484 - DNA, 25 bp, Mus musculus
cctcggcgctccagcgccagtcgcc

SEQ ID NO: 331485 - DNA, 25 bp, Mus musculus
tcaccatcatcgagaggccggtccg

SEQ ID NO: 331486 - DNA, 25 bp, Mus musculus
caggagctcaccatcatcgagaggc

SEQ ID NO: 331487 - DNA, 25 bp, Mus musculus
acctgcaggagctcaccatcatcga

SEQ ID NO: 331488 - DNA, 25 bp, Mus musculus
agcctgtttggctacatggaggacc

SEQ ID NO: 331489 - DNA, 25 bp, Mus musculus
gccagtcgccctgtcaccgcagccg

SEQ ID NO: 331490 - DNA, 25 bp, Mus musculus
gatttcgggcagaacagcctgtttg

SEQ ID NO: 331491 - DNA, 25 bp, Mus musculus
cccgacgccggcgtcgcgatggatt

SEQ ID NO: 331492 - DNA, 25 bp, Mus musculus
gccgagagcgggaccagagagtcct

SEQ ID NO: 331493 - DNA, 25 bp, Mus musculus
tgttctcgtcgcctgcggcctcttg

SEQ ID NO: 331494 - DNA, 25 bp, Mus musculus
gcgctcgtgttctcgtcgcctgcgg

SEQ ID NO: 331495 - DNA, 25 bp, Mus musculus
cgctgaggcggctccctgttctggt

SEQ ID NO: 331496 - DNA, 25 bp, Mus musculus
agttgcgtcctacctcgcgcgcaga

SEQ ID NO: 331497 - DNA, 25 bp, Mus musculus
gctgggaaggctccttttgaacatc

SEQ ID NO: 331498 - DNA, 25 bp, Mus musculus
agccggtgctgggaaggctcctttt

SEQ ID NO: 331499 - DNA, 25 bp, Mus musculus
atttgcctcttgtggctgcggagga

SEQ ID NO: 331500 - DNA, 25 bp, Mus musculus
gttgccggctctagaatgtgcttct

SEQ ID NO: 331501 - DNA, 25 bp, Mus musculus
ccggctctagaatgtgcttctcatt

SEQ ID NO: 331502 - DNA, 25 bp, Mus musculus
acatcttcgccttgaagtaaggggc

SEQ ID NO: 331503 - DNA, 25 bp, Mus musculus
accctcccgggacatctgtttgaca

SEQ ID NO: 331504 - DNA, 25 bp, Mus musculus
tgaagtaaggggcacaaatgttcgg

SEQ ID NO: 331505 - DNA, 25 bp, Mus musculus
gacatttgcctcttgtggctgcgga

SEQ ID NO: 331506 - DNA, 25 bp, Mus musculus
atgtgcttctcatttctcttctcca

SEQ ID NO: 331507 - DNA, 25 bp, Mus musculus
cccgggacatctgtttgacatttgc

SEQ ID NO: 331508 - DNA, 25 bp, Mus musculus
cagcggccggctcagtccgcaccgc

SEQ ID NO: 331509 - DNA, 25 bp, Mus musculus
ctgtttgacatttgcctcttgtggc

SEQ ID NO: 331510 - DNA, 25 bp, Mus musculus
aaggctccttttgaacatcttcgcc

SEQ ID NO: 331511 - DNA, 25 bp, Mus musculus
tgcgcgacagcgtgcccacgttcat

SEQ ID NO: 331512 - DNA, 25 bp, Mus musculus
aaagcaagcaaaccgcgcgtccatg

SEQ ID NO: 331513 - DNA, 25 bp, Mus musculus
tgctgaacatgctggcgggcatccc

SEQ ID NO: 331514 - DNA, 25 bp, Mus musculus
gctgcccgtagaagtagctgttgta

SEQ ID NO: 331515 - DNA, 25 bp, Mus musculus
gccagttcaggcactttagaatctc

SEQ ID NO: 331516 - DNA, 25 bp, Mus musculus
aggagcgtctgcctgcacacatcca

SEQ ID NO: 331517 - DNA, 25 bp, Mus musculus
aaaagtctgcaaggggcgctatgtc

SEQ ID NO: 331518 - DNA, 25 bp, Mus musculus
cgctgccctcgctcacttaaaaata

SEQ ID NO: 331519 - DNA, 25 bp, Mus musculus
gggagtcagtcatcctccctcggca

SEQ ID NO: 331520 - DNA, 25 bp, Mus musculus
cttgcaaagggagaaagttggtgcc

SEQ ID NO: 331521 - DNA, 25 bp, Mus musculus
gccctcgtagcctgcgacagagaga

SEQ ID NO: 331522 - DNA, 25 bp, Mus musculus
cggcaccggagacaccagtacagaa

SEQ ID NO: 331523 - DNA, 25 bp, Mus musculus
ccacgttcatgtagggcagcatctg

SEQ ID NO: 331524 - DNA, 25 bp, Mus musculus
gccaggatgttgtcgatgctgaaca

SEQ ID NO: 331525 - DNA, 25 bp, Mus musculus
cccaggcgccgagatgcggctgcaa

SEQ ID NO: 331526 - DNA, 25 bp, Mus musculus
cgagatgcggctgcaagttcttccc

SEQ ID NO: 331527 - DNA, 25 bp, Mus musculus
gctgcaagttcttccccgggctggc

SEQ ID NO: 331528 - DNA, 25 bp, Mus musculus
gctgcttctgctgcctgagcgacac

SEQ ID NO: 331529 - DNA, 25 bp, Mus musculus
ttctgctgcctgagcgacacagctc

SEQ ID NO: 331530 - DNA, 25 bp, Mus musculus
tgctgcctgagcgacacagctcacg

SEQ ID NO: 331531 - DNA, 25 bp, Mus musculus
agcgacacagctcacggaggcgaca

SEQ ID NO: 331532 - DNA, 25 bp, Mus musculus
cgacacagctcacggaggcgacacg

SEQ ID NO: 331533 - DNA, 25 bp, Mus musculus
acagctcacggaggcgacacgccgg

SEQ ID NO: 331534 - DNA, 25 bp, Mus musculus
ccgagctggcgaagcaggagaggga

SEQ ID NO: 331535 - DNA, 25 bp, Mus musculus
gcggacgctcatgctgctgcagagt

SEQ ID NO: 331536 - DNA, 25 bp, Mus musculus
acgctcatgctgctgcagagtgcgg

SEQ ID NO: 331537 - DNA, 25 bp, Mus musculus
agtgcggggtgactggttatcccca

SEQ ID NO: 331538 - DNA, 25 bp, Mus musculus
ccgagatgcggctgcaagttcttcc

SEQ ID NO: 331539 - DNA, 25 bp, Mus musculus
gccacagcgaagagccggatgccct

SEQ ID NO: 331540 - DNA, 25 bp, Mus musculus
tggcgtagttgttacggtagagctc

SEQ ID NO: 331541 - DNA, 25 bp, Mus musculus
acggtagagctcatgtggagagtta

SEQ ID NO: 331542 - DNA, 25 bp, Mus musculus
tgtggagagttagcgatgtccctca

SEQ ID NO: 331543 - DNA, 25 bp, Mus musculus
tgtccctcaggccttgttcgtttag

SEQ ID NO: 331544 - DNA, 25 bp, Mus musculus
caggccttgttcgtttaggttcctg

SEQ ID NO: 331545 - DNA, 25 bp, Mus musculus
gagccggatgccctcttcacgggca

SEQ ID NO: 331546 - DNA, 25 bp, Mus musculus
ttaggttcctgttaggggccacagc

SEQ ID NO: 331547 - DNA, 25 bp, Mus musculus
ttgcctacgtgctgccggatctgct

SEQ ID NO: 331548 - DNA, 25 bp, Mus musculus
atgaccacggcgaagttgaccaccc

SEQ ID NO: 331549 - DNA, 25 bp, Mus musculus
cgtcagtgatgaccacggcgaagtt

SEQ ID NO: 331550 - DNA, 25 bp, Mus musculus
cgtgacgtggccgtcagtgatgacc

SEQ ID NO: 331551 - DNA, 25 bp, Mus musculus
cacggactgcccgtgacgtggccgt

SEQ ID NO: 331552 - DNA, 25 bp, Mus musculus
ggcacgctcagcctgcatcttgatg

SEQ ID NO: 331553 - DNA, 25 bp, Mus musculus
cagcctagatctgcgcgctggcggc

SEQ ID NO: 331554 - DNA, 25 bp, Mus musculus
cccagcggcctggacaaaagtcggg

SEQ ID NO: 331555 - DNA, 25 bp, Mus musculus
cggccgtgatgatttgcgggattct

SEQ ID NO: 331556 - DNA, 25 bp, Mus musculus
atttgcgggattctccgtgaggcac

SEQ ID NO: 331557 - DNA, 25 bp, Mus musculus
cctggacaaaagtcgggccactgcg

SEQ ID NO: 331558 - DNA, 25 bp, Mus musculus
gcgggaggcgcagccagcctagatc

SEQ ID NO: 331559 - DNA, 25 bp, Mus musculus
aggtaggcgaccctctgggcagaac

SEQ ID NO: 331560 - DNA, 25 bp, Mus musculus
cgaccctctgggcagaacgaaaaca

SEQ ID NO: 331561 - DNA, 25 bp, Mus musculus
tctgggcagaacgaaaacagaggcc

SEQ ID NO: 331562 - DNA, 25 bp, Mus musculus
aacagaggcccaaagtcgtgcgtcc

SEQ ID NO: 331563 - DNA, 25 bp, Mus musculus
aggcccaaagtcgtgcgtcccggtg

SEQ ID NO: 331564 - DNA, 25 bp, Mus musculus
aaagtcgtgcgtcccggtgccagcc

SEQ ID NO: 331565 - DNA, 25 bp, Mus musculus
ggtgccagcccgggaattgcaccgc

SEQ ID NO: 331566 - DNA, 25 bp, Mus musculus
ttctccgtgaggcacggccgaaccg

SEQ ID NO: 331567 - DNA, 25 bp, Mus musculus
aacatttgtgatcctgcccattagg

SEQ ID NO: 331568 - DNA, 25 bp, Mus musculus
ttcaagattgtgtccagaagcccgg

SEQ ID NO: 331569 - DNA, 25 bp, Mus musculus
cctctaacggcttaattatgattca

SEQ ID NO: 331570 - DNA, 25 bp, Mus musculus
cagcgagctttcctctaacggctta

SEQ ID NO: 331571 - DNA, 25 bp, Mus musculus
ctgaccgttgccagcagcgagcttt

SEQ ID NO: 331572 - DNA, 25 bp, Mus musculus
ggaaactatttctcctgaccgttgc

SEQ ID NO: 331573 - DNA, 25 bp, Mus musculus
tactgcgcgatggaaactatttctc

SEQ ID NO: 331574 - DNA, 25 bp, Mus musculus
ttccaattccagatactgcgcgatg

SEQ ID NO: 331575 - DNA, 25 bp, Mus musculus
gcgagcgagcgctttctagccaatt

SEQ ID NO: 331576 - DNA, 25 bp, Mus musculus
ggctcgcttagattaataacatttg

SEQ ID NO: 331577 - DNA, 25 bp, Mus musculus
tgatcctgcccattaggcaccgagg

SEQ ID NO: 331578 - DNA, 25 bp, Mus musculus
cattaggcaccgaggcagcgagcga

SEQ ID NO: 331579 - DNA, 25 bp, Mus musculus
ggtctcacacggctcgcttagatta

SEQ ID NO: 331580 - DNA, 25 bp, Mus musculus
gcgctttctagccaattccaattcc

SEQ ID NO: 331581 - DNA, 25 bp, Mus musculus
acggggtccctgcaagcttcgacac

SEQ ID NO: 331582 - DNA, 25 bp, Mus musculus
ccggagcggctgtcagctaaagcac

SEQ ID NO: 331583 - DNA, 25 bp, Mus musculus
ttgtatgcaaacagcgggccggagc

SEQ ID NO: 331584 - DNA, 25 bp, Mus musculus
tgcctttgtatgcaaacagcgggcc

SEQ ID NO: 331585 - DNA, 25 bp, Mus musculus
acgcgtgtggctgcctttgtatgca

SEQ ID NO: 331586 - DNA, 25 bp, Mus musculus
aggattcacgagcaggcgcgcacgc

SEQ ID NO: 331587 - DNA, 25 bp, Mus musculus
tcaccaagaggattcacgagcaggc

SEQ ID NO: 331588 - DNA, 25 bp, Mus musculus
ccattgctactcaccaagaggattc

SEQ ID NO: 331589 - DNA, 25 bp, Mus musculus
ctcagtaatgggctttggggcgcaa

SEQ ID NO: 331590 - DNA, 25 bp, Mus musculus
cccacgtctcagtaatgggctttgg

SEQ ID NO: 331591 - DNA, 25 bp, Mus musculus
acacggcccacatcgcctccctgcg

SEQ ID NO: 331592 - DNA, 25 bp, Mus musculus
aaggcctgtgtcacaacacggccca

SEQ ID NO: 331593 - DNA, 25 bp, Mus musculus
ccacgggaaggcctgtgtcacaaca

SEQ ID NO: 331594 - DNA, 25 bp, Mus musculus
tgtcagctaaagcacggcaaggggc

SEQ ID NO: 331595 - DNA, 25 bp, Mus musculus
ggccgcatgaaagccgtcctgtgat

SEQ ID NO: 331596 - DNA, 25 bp, Mus musculus
ttcgaacgcggaacgggacctgtca

SEQ ID NO: 331597 - DNA, 25 bp, Mus musculus
gaacgggacctgtcaaaggccgctc

SEQ ID NO: 331598 - DNA, 25 bp, Mus musculus
aggcccgcgtggacagttctctgcc

SEQ ID NO: 331599 - DNA, 25 bp, Mus musculus
tctcgttcccgctgtcaggttactc

SEQ ID NO: 331600 - DNA, 25 bp, Mus musculus
gttactccattcacctgggcccgga

SEQ ID NO: 331601 - DNA, 25 bp, Mus musculus
gcacagcggcttggagaatcccacc

SEQ ID NO: 331602 - DNA, 25 bp, Mus musculus
agccactcagaagccgggagacagc

SEQ ID NO: 331603 - DNA, 25 bp, Mus musculus
ggcccaatgcgaagaccgagctctg

SEQ ID NO: 331604 - DNA, 25 bp, Mus musculus
gaccgagctctgcaacgcagtcagc

SEQ ID NO: 331605 - DNA, 25 bp, Mus musculus
ggccggaatcctgaacgcgccgctg

SEQ ID NO: 331606 - DNA, 25 bp, Mus musculus
cggctcctttcccttcctgatgatg

SEQ ID NO: 331607 - DNA, 25 bp, Mus musculus
cttcctgatgatggcacacatcgcc

SEQ ID NO: 331608 - DNA, 25 bp, Mus musculus
ggcccgcgtggatacctcctgtctt

SEQ ID NO: 331609 - DNA, 25 bp, Mus musculus
ccgccacactgcaaatggggaacca

SEQ ID NO: 331610 - DNA, 25 bp, Mus musculus
ggcgagctcgtaattcccagaatgg

SEQ ID NO: 331611 - DNA, 25 bp, Mus musculus
gacattccgggacctgaggacctgt

SEQ ID NO: 331612 - DNA, 25 bp, Mus musculus
aggacctgtgagttgacaagtctgc

SEQ ID NO: 331613 - DNA, 25 bp, Mus musculus
acaagtctgccagcctctaaaggcg

SEQ ID NO: 331614 - DNA, 25 bp, Mus musculus
gggagaccgaagaagctacctggcc

SEQ ID NO: 331615 - DNA, 25 bp, Mus musculus
cactgcggcgtcttggggccaagac

SEQ ID NO: 331616 - DNA, 25 bp, Mus musculus
ggccaagactctagggtgcccagga

SEQ ID NO: 331617 - DNA, 25 bp, Mus musculus
ctctagggtgcccaggatttcgcag

SEQ ID NO: 331618 - DNA, 25 bp, Mus musculus
tgcatttgaaccgaagctccgcccg

SEQ ID NO: 331619 - DNA, 25 bp, Mus musculus
agatcccaggggacgcgtcaagaca

SEQ ID NO: 331620 - DNA, 25 bp, Mus musculus
caagacaggggtacgctggagaacc

SEQ ID NO: 331621 - DNA, 25 bp, Mus musculus
gctctccctggcgagctcgtaattc

SEQ ID NO: 331622 - DNA, 25 bp, Mus musculus
tcaccctgcccggagcagacggagt

SEQ ID NO: 331623 - DNA, 25 bp, Mus musculus
tgcccgcctagagtgtccacacggt

SEQ ID NO: 331624 - DNA, 25 bp, Mus musculus
acacggtatgtgttgcccgcctagc

SEQ ID NO: 331625 - DNA, 25 bp, Mus musculus
tgcccgcctagagtatccacacggt

SEQ ID NO: 331626 - DNA, 25 bp, Mus musculus
ctgcctagagtatccacacggtatg

SEQ ID NO: 331627 - DNA, 25 bp, Mus musculus
gcccgcctagagtatccacacggta

SEQ ID NO: 331628 - DNA, 25 bp, Mus musculus
cggtatgcactacccgcctagagta

SEQ ID NO: 331629 - DNA, 25 bp, Mus musculus
ccgcctagagtatccacacggtatg

SEQ ID NO: 331630 - DNA, 25 bp, Mus musculus
cggtatgcactacctgcctagagta

SEQ ID NO: 331631 - DNA, 25 bp, Mus musculus
ccgcctagcgtatccacacggtatg

SEQ ID NO: 331632 - DNA, 25 bp, Mus musculus
ccacacggtatgtgttgcccgccta

SEQ ID NO: 331633 - DNA, 25 bp, Mus musculus
gcctagcgtatccacacggtatgca

SEQ ID NO: 331634 - DNA, 25 bp, Mus musculus
gcccgcctagagtgtccacacggta

SEQ ID NO: 331635 - DNA, 25 bp, Mus musculus
cgcctagagtatccacacggtatgc

SEQ ID NO: 331636 - DNA, 25 bp, Mus musculus
tgcctagagtatccacacggtatgc

SEQ ID NO: 331637 - DNA, 25 bp, Mus musculus
ttcagcaacgccgtggtgcagattc

SEQ ID NO: 331638 - DNA, 25 bp, Mus musculus
ccttccctggttgtgtagccacatg

SEQ ID NO: 331639 - DNA, 25 bp, Mus musculus
ggaaggccacctcctctctggtgca

SEQ ID NO: 331640 - DNA, 25 bp, Mus musculus
taccggccgcgttaccgtagcaatc

SEQ ID NO: 331641 - DNA, 25 bp, Mus musculus
agctgcgtctggacgtgactccttc

SEQ ID NO: 331642 - DNA, 25 bp, Mus musculus
gcctgccctatcatcttggcgtatc

SEQ ID NO: 331643 - DNA, 25 bp, Mus musculus
gaaagccggcttcctctagtcacgc

SEQ ID NO: 331644 - DNA, 25 bp, Mus musculus
actatgcggcctacaacgtgctgga

SEQ ID NO: 331645 - DNA, 25 bp, Mus musculus
tcccagagcttgtccaatgagagcc

SEQ ID NO: 331646 - DNA, 25 bp, Mus musculus
ccctacggtgtaagcgatgtgattg

SEQ ID NO: 331647 - DNA, 25 bp, Mus musculus
agcggtcgtcctcgctcactagcaa

SEQ ID NO: 331648 - DNA, 25 bp, Mus musculus
tgtccaatcaacacgcaaagcggtc

SEQ ID NO: 331649 - DNA, 25 bp, Mus musculus
ttcaccgacggacgtccgatttgtc

SEQ ID NO: 331650 - DNA, 25 bp, Mus musculus
agatcccgaggagcaagggccttcc

SEQ ID NO: 331651 - DNA, 25 bp, Mus musculus
agcctgcagacccttcagctggttc

SEQ ID NO: 331652 - DNA, 25 bp, Mus musculus
taggtaacagggctagctccgcaga

SEQ ID NO: 331653 - DNA, 25 bp, Mus musculus
aacagcatgattgggttccggtgtc

SEQ ID NO: 331654 - DNA, 25 bp, Mus musculus
cctggatgccttaagggtggctatt

SEQ ID NO: 331655 - DNA, 25 bp, Mus musculus
gtggctattgccaccgcggagttgc

SEQ ID NO: 331656 - DNA, 25 bp, Mus musculus
ctgctggtaagctgcgatctggagc

SEQ ID NO: 331657 - DNA, 25 bp, Mus musculus
gcggaccggccatgtgctaaagttt

SEQ ID NO: 331658 - DNA, 25 bp, Mus musculus
tgtgctaaagtttctggggctcggc

SEQ ID NO: 331659 - DNA, 25 bp, Mus musculus
gcgcagctcagtgtgctctctcacg

SEQ ID NO: 331660 - DNA, 25 bp, Mus musculus
gggtgtcgcctgcagacaacccagc

SEQ ID NO: 331661 - DNA, 25 bp, Mus musculus
tcgccagtcgctgacagggacatga

SEQ ID NO: 331662 - DNA, 25 bp, Mus musculus
aatgaggcaggaacccacggcaacc

SEQ ID NO: 331663 - DNA, 25 bp, Mus musculus
tcccggagcgagtcgctaggtaaca

SEQ ID NO: 331664 - DNA, 25 bp, Mus musculus
tcggtaagccagacctttcgcctcg

SEQ ID NO: 331665 - DNA, 25 bp, Mus musculus
ctgaggcgagacaagactccgacgc

SEQ ID NO: 331666 - DNA, 25 bp, Mus musculus
atttgttgtcatctactgggcgcgc

SEQ ID NO: 331667 - DNA, 25 bp, Mus musculus
agactcccggcacgtactcgagcaa

SEQ ID NO: 331668 - DNA, 25 bp, Mus musculus
tcgagcaacgggcacaagcggaagt

SEQ ID NO: 331669 - DNA, 25 bp, Mus musculus
tgacgccatattgcggggctggaaa

SEQ ID NO: 331670 - DNA, 25 bp, Mus musculus
agcagtctccggacgaggaaggata

SEQ ID NO: 331671 - DNA, 25 bp, Mus musculus
aaggataagaacatgggcgctcgca

SEQ ID NO: 331672 - DNA, 25 bp, Mus musculus
cgggttctgaccgatgcctattgtc

SEQ ID NO: 331673 - DNA, 25 bp, Mus musculus
agtttgccgtttgcagagcgccacg

SEQ ID NO: 331674 - DNA, 25 bp, Mus musculus
gccacgccgacgaccaggaaacttg

SEQ ID NO: 331675 - DNA, 25 bp, Mus musculus
gcagtacggtttcctctgttaaatc

SEQ ID NO: 331676 - DNA, 25 bp, Mus musculus
ctgttaaatcctggcgcttcccgac

SEQ ID NO: 331677 - DNA, 25 bp, Mus musculus
tggagcctcaccttgcagtcgcggc

SEQ ID NO: 331678 - DNA, 25 bp, Mus musculus
cgacgcggcgcgactaatttgttgt

SEQ ID NO: 331679 - DNA, 25 bp, Mus musculus
acttcgacgagcttgaaattcaccc

SEQ ID NO: 331680 - DNA, 25 bp, Mus musculus
gaactcactacagccaggaccgatt

SEQ ID NO: 331681 - DNA, 25 bp, Mus musculus
tgtcgtggcaggaactcactacagc

SEQ ID NO: 331682 - DNA, 25 bp, Mus musculus
gaatctcccggagagtgtcgtggca

SEQ ID NO: 331683 - DNA, 25 bp, Mus musculus
ctgaaggagcgggtgatgaatctcc

SEQ ID NO: 331684 - DNA, 25 bp, Mus musculus
acgcatctgatgagttcctgaagga

SEQ ID NO: 331685 - DNA, 25 bp, Mus musculus
cggtctggacgcatctgatgagttc

SEQ ID NO: 331686 - DNA, 25 bp, Mus musculus
ggaccgattcctccggtctctgagc

SEQ ID NO: 331687 - DNA, 25 bp, Mus musculus
gtctctgagccactaccgggacatc

SEQ ID NO: 331688 - DNA, 25 bp, Mus musculus
gccactaccgggacatcaatacaga

SEQ ID NO: 331689 - DNA, 25 bp, Mus musculus
caatacagatgatgagacggtcttc

SEQ ID NO: 331690 - DNA, 25 bp, Mus musculus
agacggtcttcaactacttcgacga

SEQ ID NO: 331691 - DNA, 25 bp, Mus musculus
gcttgaaattcacccgatacatatc

SEQ ID NO: 331692 - DNA, 25 bp, Mus musculus
tacatatcggtacgaagtgacttcc

SEQ ID NO: 331693 - DNA, 25 bp, Mus musculus
gtagaactgtgctcaccttagaccc

SEQ ID NO: 331694 - DNA, 25 bp, Mus musculus
ctggaccatctctgtgctgtagtgc

SEQ ID NO: 331695 - DNA, 25 bp, Mus musculus
gctggacaccatgcgaagaagctta

SEQ ID NO: 331696 - DNA, 25 bp, Mus musculus
catgcgaagaagcttacctggcttg

SEQ ID NO: 331697 - DNA, 25 bp, Mus musculus
ttacctggcttggagaagatgcctg

SEQ ID NO: 331698 - DNA, 25 bp, Mus musculus
cttggagaagatgcctgggtacttc

SEQ ID NO: 331699 - DNA, 25 bp, Mus musculus
tgcctgggtacttcccgaggacagc

SEQ ID NO: 331700 - DNA, 25 bp, Mus musculus
ccaggggcctcccactttaactctg

SEQ ID NO: 331701 - DNA, 25 bp, Mus musculus
ggatgcctggaaaactcgaccgctg

SEQ ID NO: 331702 - DNA, 25 bp, Mus musculus
gctgctggacggactaagatgaagc

SEQ ID NO: 331703 - DNA, 25 bp, Mus musculus
ctaagatgaagctggggaatgagct

SEQ ID NO: 331704 - DNA, 25 bp, Mus musculus
cagcagggttggagctggaccatct

SEQ ID NO: 331705 - DNA, 25 bp, Mus musculus
gctgtagtgcctggtgactttttta

SEQ ID NO: 331706 - DNA, 25 bp, Mus musculus
cttcggtttgggtagaactgtgctc

SEQ ID NO: 331707 - DNA, 25 bp, Mus musculus
tccagccgggcttcagagagcacca

SEQ ID NO: 331708 - DNA, 25 bp, Mus musculus
gccattattgcctggtgcagaggtc

SEQ ID NO: 331709 - DNA, 25 bp, Mus musculus
ttattgcctggtgcagaggtcgaga

SEQ ID NO: 331710 - DNA, 25 bp, Mus musculus
cagagcggccgaggcgctaatgaaa

SEQ ID NO: 331711 - DNA, 25 bp, Mus musculus
gcgctaatgaaacacaaatgggaca

SEQ ID NO: 331712 - DNA, 25 bp, Mus musculus
acaaatgggacatctgtgttccgga

SEQ ID NO: 331713 - DNA, 25 bp, Mus musculus
gacatctgtgttccggagtttagca

SEQ ID NO: 331714 - DNA, 25 bp, Mus musculus
ctgtgttccggagtttagcaaacca

SEQ ID NO: 331715 - DNA, 25 bp, Mus musculus
gagtttagcaaaccacggaaagcca

SEQ ID NO: 331716 - DNA, 25 bp, Mus musculus
cggaaagccaactttgccaagagtt

SEQ ID NO: 331717 - DNA, 25 bp, Mus musculus
ctttgccaagagtttatgtactgtc

SEQ ID NO: 331718 - DNA, 25 bp, Mus musculus
aagagtttatgtactgtcgcgcgca

SEQ ID NO: 331719 - DNA, 25 bp, Mus musculus
atgggcccgcgccaggccattattg

SEQ ID NO: 331720 - DNA, 25 bp, Mus musculus
gtcgcgcgcagaacacacctccagc

SEQ ID NO: 331721 - DNA, 25 bp, Mus musculus
tcacgaggtagccaagactcgctct

SEQ ID NO: 331722 - DNA, 25 bp, Mus musculus
agccaagactcgctctgcgcgcaga

SEQ ID NO: 331723 - DNA, 25 bp, Mus musculus
acttgcaagtggagaggcatcacga

SEQ ID NO: 331724 - DNA, 25 bp, Mus musculus
tctgcgcgcagatggccatgattag

SEQ ID NO: 331725 - DNA, 25 bp, Mus musculus
cgcgcagatggccatgattaggtgc

SEQ ID NO: 331726 - DNA, 25 bp, Mus musculus
gccatgattaggtgccagttcgcca

SEQ ID NO: 331727 - DNA, 25 bp, Mus musculus
tgattaggtgccagttcgccagttc

SEQ ID NO: 331728 - DNA, 25 bp, Mus musculus
gtgccagttcgccagttcgcagaga

SEQ ID NO: 331729 - DNA, 25 bp, Mus musculus
ccagttcgccagttcgcagagaagc

SEQ ID NO: 331730 - DNA, 25 bp, Mus musculus
ttcgccagttcgcagagaagcttgg

SEQ ID NO: 331731 - DNA, 25 bp, Mus musculus
ccagttcgcagagaagcttggaatc

SEQ ID NO: 331732 - DNA, 25 bp, Mus musculus
agagaagcttggaatctgcagaggc

SEQ ID NO: 331733 - DNA, 25 bp, Mus musculus
cccggcgtcactttgaaaacttgca

SEQ ID NO: 331734 - DNA, 25 bp, Mus musculus
ggcgtcactttgaaaacttgcaagt

SEQ ID NO: 331735 - DNA, 25 bp, Mus musculus
aatgccaggcggtccctgttttacg

SEQ ID NO: 331736 - DNA, 25 bp, Mus musculus
agactgtgtctctcctggtcatgga

SEQ ID NO: 331737 - DNA, 25 bp, Mus musculus
cacgccagctcgtagactgtgtctc

SEQ ID NO: 331738 - DNA, 25 bp, Mus musculus
gaactacactccaagcgagccgctg

SEQ ID NO: 331739 - DNA, 25 bp, Mus musculus
ttaaggctcctttctcgtgttgccc

SEQ ID NO: 331740 - DNA, 25 bp, Mus musculus
gcggctctttccatgcttaaggctc

SEQ ID NO: 331741 - DNA, 25 bp, Mus musculus
aattgcctgctttgggcggctcttt

SEQ ID NO: 331742 - DNA, 25 bp, Mus musculus
ccacggtgggagatgctaattgcct

SEQ ID NO: 331743 - DNA, 25 bp, Mus musculus
acgtaattttgcacgatgctcctgc

SEQ ID NO: 331744 - DNA, 25 bp, Mus musculus
ctcctggagttggatacgtaatttt

SEQ ID NO: 331745 - DNA, 25 bp, Mus musculus
actccgttgctgagtgcactcgatg

SEQ ID NO: 331746 - DNA, 25 bp, Mus musculus
tgcaatcccttggtgtgcgagatga

SEQ ID NO: 331747 - DNA, 25 bp, Mus musculus
ctagcgttagtatctgggatcgtca

SEQ ID NO: 331748 - DNA, 25 bp, Mus musculus
ccttgcgctccctctagcgttagta

SEQ ID NO: 331749 - DNA, 25 bp, Mus musculus
tgtcactagtctgggtcgcctctct

SEQ ID NO: 331750 - DNA, 25 bp, Mus musculus
cgtgcccatggagctctacaacttc

SEQ ID NO: 331751 - DNA, 25 bp, Mus musculus
tctacaacttcgtgtggtcccacta

SEQ ID NO: 331752 - DNA, 25 bp, Mus musculus
atctcggctgtcgtggctattactt

SEQ ID NO: 331753 - DNA, 25 bp, Mus musculus
ctattacttcgtgcgtgagctgtgc

SEQ ID NO: 331754 - DNA, 25 bp, Mus musculus
taccacgtgctcagcctggcactgt

SEQ ID NO: 331755 - DNA, 25 bp, Mus musculus
acagccggcaatgcgctgtccgtgc

SEQ ID NO: 331756 - DNA, 25 bp, Mus musculus
ttcgctcatcttcgcgcttggcaca

SEQ ID NO: 331757 - DNA, 25 bp, Mus musculus
cacggtgctagtaagtcgcgccacg

SEQ ID NO: 331758 - DNA, 25 bp, Mus musculus
ctctgggccaaggtgctgttcaccg

SEQ ID NO: 331759 - DNA, 25 bp, Mus musculus
tgccctgcccatggcggttatcatg

SEQ ID NO: 331760 - DNA, 25 bp, Mus musculus
gctactgctgatcagcgtgcccatg

SEQ ID NO: 331761 - DNA, 25 bp, Mus musculus
cggttatcatgggacagaagcacga

SEQ ID NO: 331762 - DNA, 25 bp, Mus musculus
tgttcaccgcgctctattcgctcat

SEQ ID NO: 331763 - DNA, 25 bp, Mus musculus
cagggaagcgcggtcttcctctttc

SEQ ID NO: 331764 - DNA, 25 bp, Mus musculus
ccaacgggaaggctctgtactacgg

SEQ ID NO: 331765 - DNA, 25 bp, Mus musculus
ttagatgtagaactgcgccagagtc

SEQ ID NO: 331766 - DNA, 25 bp, Mus musculus
gttcgtactacgctgtggaccgcga

SEQ ID NO: 331767 - DNA, 25 bp, Mus musculus
actataggtccggtgttgcttcagg

SEQ ID NO: 331768 - DNA, 25 bp, Mus musculus
gggaatcctcgcttctctgcccgat

SEQ ID NO: 331769 - DNA, 25 bp, Mus musculus
gagcctgccacttccttagcactgg

SEQ ID NO: 331770 - DNA, 25 bp, Mus musculus
gcagtgtcttcagaggcagcaaaca

SEQ ID NO: 331771 - DNA, 25 bp, Mus musculus
cgtttccaggctaggtcgccttaga

SEQ ID NO: 331772 - DNA, 25 bp, Mus musculus
acacacgccagtcctggtcgggtta

SEQ ID NO: 331773 - DNA, 25 bp, Mus musculus
gttaaccattctttacgtctgcgtg

SEQ ID NO: 331774 - DNA, 25 bp, Mus musculus
gtgtgttcttcctttccgtccctca

SEQ ID NO: 331775 - DNA, 25 bp, Mus musculus
ccctcatcgcttttggagcaatttg

SEQ ID NO: 331776 - DNA, 25 bp, Mus musculus
gcagcccagcgccaaagtttgtttc

SEQ ID NO: 331777 - DNA, 25 bp, Mus musculus
agttcgcgtttgctaacttagctca

SEQ ID NO: 331778 - DNA, 25 bp, Mus musculus
acacgtgaccaccttctcttcaggg

SEQ ID NO: 331779 - DNA, 25 bp, Mus musculus
ccgagccaagctgcacacgtgacca

SEQ ID NO: 331780 - DNA, 25 bp, Mus musculus
gtgaccaccttctcttcagggtccg

SEQ ID NO: 331781 - DNA, 25 bp, Mus musculus
taacttagctcaggacgctcaccca

SEQ ID NO: 331782 - DNA, 25 bp, Mus musculus
tgtgtccacgtgacttctgcggagc

SEQ ID NO: 331783 - DNA, 25 bp, Mus musculus
tcagggaatgagtgaagttcgcgtt

SEQ ID NO: 331784 - DNA, 25 bp, Mus musculus
gtaacgtgactgacgtcagggaatg

SEQ ID NO: 331785 - DNA, 25 bp, Mus musculus
tttgaggcagcaggtaacgtgactg

SEQ ID NO: 331786 - DNA, 25 bp, Mus musculus
tcgtccgagccgtttgaggcagcag

SEQ ID NO: 331787 - DNA, 25 bp, Mus musculus
gtccacgttcctgtgtcgtccgagc

SEQ ID NO: 331788 - DNA, 25 bp, Mus musculus
agccgacagcgtccacgttcctgtg

SEQ ID NO: 331789 - DNA, 25 bp, Mus musculus
cacgtgacttctgcggagccgacag

SEQ ID NO: 331790 - DNA, 25 bp, Mus musculus
gctcacccaatctcgcaagcagagg

SEQ ID NO: 331791 - DNA, 25 bp, Mus musculus
tagcccacgagccactgcgagtaca

SEQ ID NO: 331792 - DNA, 25 bp, Mus musculus
gccggtgcacgatgagattgctctg

SEQ ID NO: 331793 - DNA, 25 bp, Mus musculus
cgcaggctgccgttctcagaggaat

SEQ ID NO: 331794 - DNA, 25 bp, Mus musculus
atgttccgacgatgtggcgaaaggc

SEQ ID NO: 331795 - DNA, 25 bp, Mus musculus
gcgcgcatccgtgaagcccaggaat

SEQ ID NO: 331796 - DNA, 25 bp, Mus musculus
aagcccaggaatgggtccttcatga

SEQ ID NO: 331797 - DNA, 25 bp, Mus musculus
tccttcatgaagtggcgcgatgctg

SEQ ID NO: 331798 - DNA, 25 bp, Mus musculus
ttgccgcagaactcacaggacttgc

SEQ ID NO: 331799 - DNA, 25 bp, Mus musculus
gtctttctccaccttgatgcgcttg

SEQ ID NO: 331800 - DNA, 25 bp, Mus musculus
cagctccgagtccatgctgaagctc

SEQ ID NO: 331801 - DNA, 25 bp, Mus musculus
ctgaagctcgactcaggccggctct

SEQ ID NO: 331802 - DNA, 25 bp, Mus musculus
tcggccgctttcaggtcacctggca

SEQ ID NO: 331803 - DNA, 25 bp, Mus musculus
cccgccttgtgcatgtgcgtcttca

SEQ ID NO: 331804 - DNA, 25 bp, Mus musculus
tgcgagtacacgttctcagatggga

SEQ ID NO: 331805 - DNA, 25 bp, Mus musculus
caccaacgtgtaggggtgcacatcg

SEQ ID NO: 331806 - DNA, 25 bp, Mus musculus
tgcggaaacccgcactgcaacttca

SEQ ID NO: 331807 - DNA, 25 bp, Mus musculus
tgcaacttcagtaggagcggatccg

SEQ ID NO: 331808 - DNA, 25 bp, Mus musculus
aggagtggcctttcggcttgcccaa

SEQ ID NO: 331809 - DNA, 25 bp, Mus musculus
tgcaagaatggaaactggaaggacg

SEQ ID NO: 331810 - DNA, 25 bp, Mus musculus
gctgctccattaagcccgggaatta

SEQ ID NO: 331811 - DNA, 25 bp, Mus musculus
taagcccgggaattatgcatggccc

SEQ ID NO: 331812 - DNA, 25 bp, Mus musculus
ccagggcgcaatcaacgtgcacggc

SEQ ID NO: 331813 - DNA, 25 bp, Mus musculus
gaatggcccgaagaggacctgaaga

SEQ ID NO: 331814 - DNA, 25 bp, Mus musculus
aaggcccgaaagcaacctgcgcgtc

SEQ ID NO: 331815 - DNA, 25 bp, Mus musculus
gcccgggtgcagtcaccaacgtgta

SEQ ID NO: 331816 - DNA, 25 bp, Mus musculus
tccgagcggctacgactcgatgctc

SEQ ID NO: 331817 - DNA, 25 bp, Mus musculus
gtcggaggtcctcagcagacccggc

SEQ ID NO: 331818 - DNA, 25 bp, Mus musculus
cttgtgcccggccatagcacgggac

SEQ ID NO: 331819 - DNA, 25 bp, Mus musculus
cccggctgcagagaaactttcccag

SEQ ID NO: 331820 - DNA, 25 bp, Mus musculus
ggcatctattctggcatcgcccgga

SEQ ID NO: 331821 - DNA, 25 bp, Mus musculus
gttgccctgtttgcggcgggacatt

SEQ ID NO: 331822 - DNA, 25 bp, Mus musculus
aagtgctgcgggttgccctgtttgc

SEQ ID NO: 331823 - DNA, 25 bp, Mus musculus
agttccctctgggacaagtgctgcg

SEQ ID NO: 331824 - DNA, 25 bp, Mus musculus
acgcgtgatgagttccctctgggac

SEQ ID NO: 331825 - DNA, 25 bp, Mus musculus
tcgcgcgtgcggcagacacttacgc

SEQ ID NO: 331826 - DNA, 25 bp, Mus musculus
cacacacgccgcttggagggccgag

SEQ ID NO: 331827 - DNA, 25 bp, Mus musculus
ggacccacgcgctcgccaacttttc

SEQ ID NO: 331828 - DNA, 25 bp, Mus musculus
tcggaatcctagcagcggcgcggtc

SEQ ID NO: 331829 - DNA, 25 bp, Mus musculus
ccggaaagctgcacagatgcgggcc

SEQ ID NO: 331830 - DNA, 25 bp, Mus musculus
atcgcccggaaagctgcacagatgc

SEQ ID NO: 331831 - DNA, 25 bp, Mus musculus
cggcggcttcggaatcctagcagcg

SEQ ID NO: 331832 - DNA, 25 bp, Mus musculus
tgcggcagacacttacgcgtgatga

SEQ ID NO: 331833 - DNA, 25 bp, Mus musculus
tctgctctagagacaaaaagaccca

SEQ ID NO: 331834 - DNA, 25 bp, Mus musculus
cgtggacgggagctatagattgcaa

SEQ ID NO: 331835 - DNA, 25 bp, Mus musculus
ttctccgggagctctcggtctctct

SEQ ID NO: 331836 - DNA, 25 bp, Mus musculus
cggacgtgacgtttaatctgctcta

SEQ ID NO: 331837 - DNA, 25 bp, Mus musculus
ctactgtttttgtaagctggtctta

SEQ ID NO: 331838 - DNA, 25 bp, Mus musculus
ctggtcttatcaccgagcaccggta

SEQ ID NO: 331839 - DNA, 25 bp, Mus musculus
aaagacccagagagtcggagcactg

SEQ ID NO: 331840 - DNA, 25 bp, Mus musculus
ggcgactagcggtggctttttaaca

SEQ ID NO: 331841 - DNA, 25 bp, Mus musculus
tggctttttaacattgtaccctgta

SEQ ID NO: 331842 - DNA, 25 bp, Mus musculus
gtaccctgtaagagaacaagaaagc

SEQ ID NO: 331843 - DNA, 25 bp, Mus musculus
attgcaacgtgaagatggcggagtc

SEQ ID NO: 331844 - DNA, 25 bp, Mus musculus
agaaagcacacaccgagacacgcgc

SEQ ID NO: 331845 - DNA, 25 bp, Mus musculus
cggccacacgtgcaaactactgttt

SEQ ID NO: 331846 - DNA, 25 bp, Mus musculus
ggctgcctctgtacaatgggataaa

SEQ ID NO: 331847 - DNA, 25 bp, Mus musculus
ccaatcagggcacggaaagctctcc

SEQ ID NO: 331848 - DNA, 25 bp, Mus musculus
agctctggccgaagcactgcgcgcg

SEQ ID NO: 331849 - DNA, 25 bp, Mus musculus
aagctctccggctagaagccgttta

SEQ ID NO: 331850 - DNA, 25 bp, Mus musculus
cggtgaccatcacagccaatcaggg

SEQ ID NO: 331851 - DNA, 25 bp, Mus musculus
tggagctgcgaaacggtgaccatca

SEQ ID NO: 331852 - DNA, 25 bp, Mus musculus
ccgctcaagggcagggcctgagaaa

SEQ ID NO: 331853 - DNA, 25 bp, Mus musculus
cgacggtaagcagcgcctcgagctc

SEQ ID NO: 331854 - DNA, 25 bp, Mus musculus
tctcctagctcaggcgacggtaagc

SEQ ID NO: 331855 - DNA, 25 bp, Mus musculus
tacacggcgcgacgcgaagcccgat

SEQ ID NO: 331856 - DNA, 25 bp, Mus musculus
aggccgcggaccaggtagagcctat

SEQ ID NO: 331857 - DNA, 25 bp, Mus musculus
gcatgcgagctacctccgcgctgga

SEQ ID NO: 331858 - DNA, 25 bp, Mus musculus
cgaactgtccggtcctctggccttt

SEQ ID NO: 331859 - DNA, 25 bp, Mus musculus
tagaagccgtttagcgtcgaagggc

SEQ ID NO: 331860 - DNA, 25 bp, Mus musculus
ccgggagccaatggagctgcgaaac

SEQ ID NO: 331861 - DNA, 25 bp, Mus musculus
tcctctcccaagaggcgcccgggcg

SEQ ID NO: 331862 - DNA, 25 bp, Mus musculus
ggccgccagcaagaggccgccctgc

SEQ ID NO: 331863 - DNA, 25 bp, Mus musculus
cagggcccgagctgtcgctgtcgcc

SEQ ID NO: 331864 - DNA, 25 bp, Mus musculus
cgctgaaggctggtgcagggcccga

SEQ ID NO: 331865 - DNA, 25 bp, Mus musculus
cacgcgctaccccgacggtgggaag

SEQ ID NO: 331866 - DNA, 25 bp, Mus musculus
agtccggactgaccccagcaggtcc

SEQ ID NO: 331867 - DNA, 25 bp, Mus musculus
cagcggccgcagtccggactgaccc

SEQ ID NO: 331868 - DNA, 25 bp, Mus musculus
caccttctgggggagatggctacga

SEQ ID NO: 331869 - DNA, 25 bp, Mus musculus
ccctcaccttctgggggagatggct

SEQ ID NO: 331870 - DNA, 25 bp, Mus musculus
acggccctcaccttctgggggagat

SEQ ID NO: 331871 - DNA, 25 bp, Mus musculus
gtcagctgcctgctagagcacgggg

SEQ ID NO: 331872 - DNA, 25 bp, Mus musculus
cgcgaaattcaaacacggccctcac

SEQ ID NO: 331873 - DNA, 25 bp, Mus musculus
ttaggggtccaggagtcagctgcct

SEQ ID NO: 331874 - DNA, 25 bp, Mus musculus
tcaaacacggccctcaccttctggg

SEQ ID NO: 331875 - DNA, 25 bp, Mus musculus
ggaagctgcagacgctcgccagtcc

SEQ ID NO: 331876 - DNA, 25 bp, Mus musculus
ttgacaggcacctgactttcgccgc

SEQ ID NO: 331877 - DNA, 25 bp, Mus musculus
aggaaaccaaggctgcagcccgccg

SEQ ID NO: 331878 - DNA, 25 bp, Mus musculus
ccagccagggtgctgatcagccatt

SEQ ID NO: 331879 - DNA, 25 bp, Mus musculus
gggtgctgatcagccattggacatc

SEQ ID NO: 331880 - DNA, 25 bp, Mus musculus
cattggacatcagcaaccggggcgg

SEQ ID NO: 331881 - DNA, 25 bp, Mus musculus
ggagccgtatccgaagactcgattg

SEQ ID NO: 331882 - DNA, 25 bp, Mus musculus
ccgaagactcgattggttagatctc

SEQ ID NO: 331883 - DNA, 25 bp, Mus musculus
tagatctcgcgctgtgattgaacga

SEQ ID NO: 331884 - DNA, 25 bp, Mus musculus
attgaacgacgggagccctggctcc

SEQ ID NO: 331885 - DNA, 25 bp, Mus musculus
cgcagtccacaaggccgcagggtag

SEQ ID NO: 331886 - DNA, 25 bp, Mus musculus
ctttcttctaattggttgacaggca

SEQ ID NO: 331887 - DNA, 25 bp, Mus musculus
gcctgccaccggaggaaggaaacca

SEQ ID NO: 331888 - DNA, 25 bp, Mus musculus
gcggcgactgttgacttgttacttt

SEQ ID NO: 331889 - DNA, 25 bp, Mus musculus
atttacgcgtcccttatccggccag

SEQ ID NO: 331890 - DNA, 25 bp, Mus musculus
tttctcacccttaataaacagatgc

SEQ ID NO: 331891 - DNA, 25 bp, Mus musculus
cgcgcgaatttacgcgtcccttatc

SEQ ID NO: 331892 - DNA, 25 bp, Mus musculus
gcttcccttaaaggcgacgcgcgaa

SEQ ID NO: 331893 - DNA, 25 bp, Mus musculus
tgggccaatcccaggactacaaggg

SEQ ID NO: 331894 - DNA, 25 bp, Mus musculus
aggacgcggcctgggccaatcccag

SEQ ID NO: 331895 - DNA, 25 bp, Mus musculus
cacactcccggttcaagtttcttcg

SEQ ID NO: 331896 - DNA, 25 bp, Mus musculus
agatggtatcttccaaccgcggggc

SEQ ID NO: 331897 - DNA, 25 bp, Mus musculus
gggaggctgaaaagatggtatcttc

SEQ ID NO: 331898 - DNA, 25 bp, Mus musculus
cccacaggtctgattggccaggttc

SEQ ID NO: 331899 - DNA, 25 bp, Mus musculus
cgcgcacgcctcaggactgaggaac

SEQ ID NO: 331900 - DNA, 25 bp, Mus musculus
agcagttcctcgtccgggacctggc

SEQ ID NO: 331901 - DNA, 25 bp, Mus musculus
taaacagatgcccacccggcgagca

SEQ ID NO: 331902 - DNA, 25 bp, Mus musculus
cacgcctccgaaagggaggcggtca

SEQ ID NO: 331903 - DNA, 25 bp, Mus musculus
acgtgtgccggctacgctctggacc

SEQ ID NO: 331904 - DNA, 25 bp, Mus musculus
tggccggcctttggctgctatttct

SEQ ID NO: 331905 - DNA, 25 bp, Mus musculus
ccggcctttggctgctatttctgca

SEQ ID NO: 331906 - DNA, 25 bp, Mus musculus
ctgctatttctgcagactgccagga

SEQ ID NO: 331907 - DNA, 25 bp, Mus musculus
tctgcagactgccaggagaatggcg

SEQ ID NO: 331908 - DNA, 25 bp, Mus musculus
cacccgcagtgcttggacttcaggc

SEQ ID NO: 331909 - DNA, 25 bp, Mus musculus
agtgcttggacttcaggccgccctt

SEQ ID NO: 331910 - DNA, 25 bp, Mus musculus
ccgctgagcttctgcgcgcagtact

SEQ ID NO: 331911 - DNA, 25 bp, Mus musculus
tcctggagacccgcatggatgccgg

SEQ ID NO: 331912 - DNA, 25 bp, Mus musculus
gtgcacggaggcacgtggaacacta

SEQ ID NO: 331913 - DNA, 25 bp, Mus musculus
gctctggacctgctgtgccaggtga

SEQ ID NO: 331914 - DNA, 25 bp, Mus musculus
cggaggcacgtggaacactagtcgc

SEQ ID NO: 331915 - DNA, 25 bp, Mus musculus
cagtactccgccttcggctgctgca

SEQ ID NO: 331916 - DNA, 25 bp, Mus musculus
acgtggaacactagtcgctggcggc

SEQ ID NO: 331917 - DNA, 25 bp, Mus musculus
gaagccttcaccatgtgccaggagc

SEQ ID NO: 331918 - DNA, 25 bp, Mus musculus
gtgtacacaacctggagcagtgctg

SEQ ID NO: 331919 - DNA, 25 bp, Mus musculus
gagcagtgctgtctttttcctaaag

SEQ ID NO: 331920 - DNA, 25 bp, Mus musculus
aacggagccgcggtgtacacaacct

SEQ ID NO: 331921 - DNA, 25 bp, Mus musculus
ctaaagttcttacctacgcagccga

SEQ ID NO: 331922 - DNA, 25 bp, Mus musculus
tgccaggagcgctctggctcgttct

SEQ ID NO: 331923 - DNA, 25 bp, Mus musculus
gctcgttctggctgtggctctagat

SEQ ID NO: 331924 - DNA, 25 bp, Mus musculus
ggctctagatggctctctcactcac

SEQ ID NO: 331925 - DNA, 25 bp, Mus musculus
acacgcgcacacactgacatggaca

SEQ ID NO: 331926 - DNA, 25 bp, Mus musculus
agagtccgcccgtccgggtcttgcg

SEQ ID NO: 331927 - DNA, 25 bp, Mus musculus
gacctgagctgggactgctgctccg

SEQ ID NO: 331928 - DNA, 25 bp, Mus musculus
ccggctccgtccaggtgtaggcaca

SEQ ID NO: 331929 - DNA, 25 bp, Mus musculus
tgtaggcacaggagattggcttgcc

SEQ ID NO: 331930 - DNA, 25 bp, Mus musculus
gtccgcgcggaagtcggaagcctcc

SEQ ID NO: 331931 - DNA, 25 bp, Mus musculus
ttcgagtgctacgaccgcaagctgt

SEQ ID NO: 331932 - DNA, 25 bp, Mus musculus
cgcatcgacgtggaccgtaaggagc

SEQ ID NO: 331933 - DNA, 25 bp, Mus musculus
cgggatagacacacagaaagagcct

SEQ ID NO: 331934 - DNA, 25 bp, Mus musculus
aagagcctgtgcaagtggttgagca

SEQ ID NO: 331935 - DNA, 25 bp, Mus musculus
tgcctccggcgcagactcaacgtaa

SEQ ID NO: 331936 - DNA, 25 bp, Mus musculus
actcaacgtaaccagccggggctct

SEQ ID NO: 331937 - DNA, 25 bp, Mus musculus
tgcgcaacatgtggcgctgctcctt

SEQ ID NO: 331938 - DNA, 25 bp, Mus musculus
cttcgaccgcggagacccaatgtct

SEQ ID NO: 331939 - DNA, 25 bp, Mus musculus
acgtgggccagaacaagtatgagga

SEQ ID NO: 331940 - DNA, 25 bp, Mus musculus
tccaaacaggatttgtccggtcctc

SEQ ID NO: 331941 - DNA, 25 bp, Mus musculus
ccttagctagatctgtcccggaccg

SEQ ID NO: 331942 - DNA, 25 bp, Mus musculus
ggaccgctcctatgtagaccctcga

SEQ ID NO: 331943 - DNA, 25 bp, Mus musculus
acccaatgtctggaactggccgtgg

SEQ ID NO: 331944 - DNA, 25 bp, Mus musculus
caacccgttcgtggatgatcccgga

SEQ ID NO: 331945 - DNA, 25 bp, Mus musculus
gcgacgacgcctgggacaccaaggc

SEQ ID NO: 331946 - DNA, 25 bp, Mus musculus
tgcagtatgcacgagccaggatgga

SEQ ID NO: 331947 - DNA, 25 bp, Mus musculus
tacctggcggtgctactctgggagt

SEQ ID NO: 331948 - DNA, 25 bp, Mus musculus
accaagacccgaacctgtagcctga

SEQ ID NO: 331949 - DNA, 25 bp, Mus musculus
tggcgtcgagtgcagccaccaagac

SEQ ID NO: 331950 - DNA, 25 bp, Mus musculus
attgcaagcacgacgaggacgctgg

SEQ ID NO: 331951 - DNA, 25 bp, Mus musculus
gcgtgggcacgcacaattgcaagca

SEQ ID NO: 331952 - DNA, 25 bp, Mus musculus
cgctccggatcttgctggacgacgt

SEQ ID NO: 331953 - DNA, 25 bp, Mus musculus
tgcgggcacgccgtgcagtatgcac

SEQ ID NO: 331954 - DNA, 25 bp, Mus musculus
cagccgccgtggtgtgtcgtcagct

SEQ ID NO: 331955 - DNA, 25 bp, Mus musculus
ccgcggtcgcgtggaagtgttcata

SEQ ID NO: 331956 - DNA, 25 bp, Mus musculus
atcggtgcgtctggtacggcccgca

SEQ ID NO: 331957 - DNA, 25 bp, Mus musculus
acccgagaacggatcggtgcgtctg

SEQ ID NO: 331958 - DNA, 25 bp, Mus musculus
gtcgtcagctgggttttgcgcacgc

SEQ ID NO: 331959 - DNA, 25 bp, Mus musculus
ggcttgcaccgacctgcaatgaagg

SEQ ID NO: 331960 - DNA, 25 bp, Mus musculus
cctccgggcggacgctggcacacag

SEQ ID NO: 331961 - DNA, 25 bp, Mus musculus
gcgcaaggcttgcaccgacctgcaa

SEQ ID NO: 331962 - DNA, 25 bp, Mus musculus
tgcaccgacctgcaatgaaggcgca

SEQ ID NO: 331963 - DNA, 25 bp, Mus musculus
cgacctgcaatgaaggcgcagcgcg

SEQ ID NO: 331964 - DNA, 25 bp, Mus musculus
cagcgcgaggacatttgggattgac

SEQ ID NO: 331965 - DNA, 25 bp, Mus musculus
cgcgaggacatttgggattgactaa

SEQ ID NO: 331966 - DNA, 25 bp, Mus musculus
ggacatttgggattgactaactttg

SEQ ID NO: 331967 - DNA, 25 bp, Mus musculus
gggattgactaactttggggcgcta

SEQ ID NO: 331968 - DNA, 25 bp, Mus musculus
attgactaactttggggcgctaagg

SEQ ID NO: 331969 - DNA, 25 bp, Mus musculus
gcgctaaggtttcagggagatgttt

SEQ ID NO: 331970 - DNA, 25 bp, Mus musculus
ttcagggagatgtttgagaacagtc

SEQ ID NO: 331971 - DNA, 25 bp, Mus musculus
gagatgtttgagaacagtcagcgca

SEQ ID NO: 331972 - DNA, 25 bp, Mus musculus
acacagcgggcgcaaggcttgcacc

SEQ ID NO: 331973 - DNA, 25 bp, Mus musculus
gtaacaaattactcacagccgcagc

SEQ ID NO: 331974 - DNA, 25 bp, Mus musculus
agaggggcgctaactattcttagta

SEQ ID NO: 331975 - DNA, 25 bp, Mus musculus
ttggctgggccgcacaaatgtgtcg

SEQ ID NO: 331976 - DNA, 25 bp, Mus musculus
acaaattactcacagccgcagcagc

SEQ ID NO: 331977 - DNA, 25 bp, Mus musculus
ggcgctaactattcttagtaacaaa

SEQ ID NO: 331978 - DNA, 25 bp, Mus musculus
ggggcgctaactattcttagtaaca

SEQ ID NO: 331979 - DNA, 25 bp, Mus musculus
ctggggaccgcgtcagagccagcgc

SEQ ID NO: 331980 - DNA, 25 bp, Mus musculus
acggccagcccggagacgcaggccc

SEQ ID NO: 331981 - DNA, 25 bp, Mus musculus
gtcttgtacgcacggccagcccgga

SEQ ID NO: 331982 - DNA, 25 bp, Mus musculus
accgcgcttggctgggccgcacaaa

SEQ ID NO: 331983 - DNA, 25 bp, Mus musculus
agcctcgtcttgtacgcacggccag

SEQ ID NO: 331984 - DNA, 25 bp, Mus musculus
cggagaggggcgctaactattctta

SEQ ID NO: 331985 - DNA, 25 bp, Mus musculus
ccaggacgggggtccagcctcgtct

SEQ ID NO: 331986 - DNA, 25 bp, Mus musculus
ctcgatcgcggggtctggggaccgc

SEQ ID NO: 331987 - DNA, 25 bp, Mus musculus
gatccgcgagagcatccgtctgctg

SEQ ID NO: 331988 - DNA, 25 bp, Mus musculus
cttactattggctgtgcctctggct

SEQ ID NO: 331989 - DNA, 25 bp, Mus musculus
tctggcttcagagaaagcgatgccc

SEQ ID NO: 331990 - DNA, 25 bp, Mus musculus
tcctcaaaggtgaggcggggcaccc

SEQ ID NO: 331991 - DNA, 25 bp, Mus musculus
cgggatgctcccgtcccactatcca

SEQ ID NO: 331992 - DNA, 25 bp, Mus musculus
agcgccgccgcgaagccctgaagag

SEQ ID NO: 331993 - DNA, 25 bp, Mus musculus
cgctccttactattggctgtgcctc

SEQ ID NO: 331994 - DNA, 25 bp, Mus musculus
tgtgcctctggcttcagagaaagcg

SEQ ID NO: 331995 - DNA, 25 bp, Mus musculus
tcacgcagatcctcaaaggtgaggc

SEQ ID NO: 331996 - DNA, 25 bp, Mus musculus
atcctcacgcagatcctcaaaggtg

SEQ ID NO: 331997 - DNA, 25 bp, Mus musculus
atgccggctgacatcctcacgcaga

SEQ ID NO: 331998 - DNA, 25 bp, Mus musculus
aggacatgccggctgacatcctcac

SEQ ID NO: 331999 - DNA, 25 bp, Mus musculus
cgagagcatccgtctgctgcgccag

SEQ ID NO: 332000 - DNA, 25 bp, Mus musculus
cactatccaacgctccttactattg

SEQ ID NO: 332001 - DNA, 25 bp, Mus musculus
gtccgctcctcagggaaccacaaga

SEQ ID NO: 332002 - DNA, 25 bp, Mus musculus
agcaatctgctgtgagctgagaccc

SEQ ID NO: 332003 - DNA, 25 bp, Mus musculus
ggtcacctctgtgctcgatcagatc

SEQ ID NO: 332004 - DNA, 25 bp, Mus musculus
ccttggtgcctggaatgctttagca

SEQ ID NO: 332005 - DNA, 25 bp, Mus musculus
atctagcggtcaatgccttggtgcc

SEQ ID NO: 332006 - DNA, 25 bp, Mus musculus
gcacagctggtgcagtctatatcta

SEQ ID NO: 332007 - DNA, 25 bp, Mus musculus
cccttggaacctaaagacgctgata

SEQ ID NO: 332008 - DNA, 25 bp, Mus musculus
cgcaatccgtcggtgcccttggaac

SEQ ID NO: 332009 - DNA, 25 bp, Mus musculus
gtccttggcgcgactacaaagctcc

SEQ ID NO: 332010 - DNA, 25 bp, Mus musculus
cgaaagcgggctgaattctccacta

SEQ ID NO: 332011 - DNA, 25 bp, Mus musculus
ttccggtgtcctgaagacgaaagcg

SEQ ID NO: 332012 - DNA, 25 bp, Mus musculus
tgcgcgttgaatcagccacaggcct

SEQ ID NO: 332013 - DNA, 25 bp, Mus musculus
agtcaggtaaccacgcctctccatg

SEQ ID NO: 332014 - DNA, 25 bp, Mus musculus
atctccaagtgtagagggcgcgtgc

SEQ ID NO: 332015 - DNA, 25 bp, Mus musculus
gtgttgctctttcgcttccaaactc

SEQ ID NO: 332016 - DNA, 25 bp, Mus musculus
cttttggggtcacttggatggaatc

SEQ ID NO: 332017 - DNA, 25 bp, Mus musculus
gatggacctccagaatccttttggg

SEQ ID NO: 332018 - DNA, 25 bp, Mus musculus
cccaagctccgggcgaaggcggatc

SEQ ID NO: 332019 - DNA, 25 bp, Mus musculus
gggacgtgttgctctttcgcttcca

SEQ ID NO: 332020 - DNA, 25 bp, Mus musculus
tctttcgcttccaaactcacatctg

SEQ ID NO: 332021 - DNA, 25 bp, Mus musculus
actcacatctgtttggacggtgctg

SEQ ID NO: 332022 - DNA, 25 bp, Mus musculus
catctgtttggacggtgctggatgc

SEQ ID NO: 332023 - DNA, 25 bp, Mus musculus
tgctggatgcagaactcagcaaaca

SEQ ID NO: 332024 - DNA, 25 bp, Mus musculus
gggtcacttggatggaatcatcacg

SEQ ID NO: 332025 - DNA, 25 bp, Mus musculus
actcagcaaacaaatcactgctgga

SEQ ID NO: 332026 - DNA, 25 bp, Mus musculus
cactgctggaacaaaacctttgcag

SEQ ID NO: 332027 - DNA, 25 bp, Mus musculus
aacctttgcaggatgcacgcagggc

SEQ ID NO: 332028 - DNA, 25 bp, Mus musculus
aaggcggatctgtggttcccagagc

SEQ ID NO: 332029 - DNA, 25 bp, Mus musculus
tctgccaacaaaccatcgtcttagg

SEQ ID NO: 332030 - DNA, 25 bp, Mus musculus
accgtctcacgtgattctgccaaca

SEQ ID NO: 332031 - DNA, 25 bp, Mus musculus
acgtggttcggaggctgaacatcac

SEQ ID NO: 332032 - DNA, 25 bp, Mus musculus
tcttaggtcggcagagtgtatcacg

SEQ ID NO: 332033 - DNA, 25 bp, Mus musculus
gtgtatcacgtgcaagcggtgtccc

SEQ ID NO: 332034 - DNA, 25 bp, Mus musculus
tgtcatgggctgtacgtcactcacc

SEQ ID NO: 332035 - DNA, 25 bp, Mus musculus
tctctggtctagatgacagcgcgtc

SEQ ID NO: 332036 - DNA, 25 bp, Mus musculus
cagcatggaggtgtcagaccgcatc

SEQ ID NO: 332037 - DNA, 25 bp, Mus musculus
cgtccacaaagtgaaccgtctcacg

SEQ ID NO: 332038 - DNA, 25 bp, Mus musculus
agaccgcatcgcctctctggagcag

SEQ ID NO: 332039 - DNA, 25 bp, Mus musculus
cgcgtccagatgcaggaggatgaca

SEQ ID NO: 332040 - DNA, 25 bp, Mus musculus
ggaggatgacattcaactgctcaag

SEQ ID NO: 332041 - DNA, 25 bp, Mus musculus
actgctcaagtcagcgctggccgac

SEQ ID NO: 332042 - DNA, 25 bp, Mus musculus
caagcccatagagcgtgcgtgatgc

SEQ ID NO: 332043 - DNA, 25 bp, Mus musculus
caccagaagacgctcaggccgcggg

SEQ ID NO: 332044 - DNA, 25 bp, Mus musculus
cggggcccagctgtcagtcgccacc

SEQ ID NO: 332045 - DNA, 25 bp, Mus musculus
cgccctcttagaggcgcggaccacg

SEQ ID NO: 332046 - DNA, 25 bp, Mus musculus
cgcgccttttgtgtggagcttcgct

SEQ ID NO: 332047 - DNA, 25 bp, Mus musculus
cttttgtgtggagcttcgctgcggc

SEQ ID NO: 332048 - DNA, 25 bp, Mus musculus
ggcgcgcgctcattccctccgcggc

SEQ ID NO: 332049 - DNA, 25 bp, Mus musculus
ctgcctcgcagctagcggcccggac

SEQ ID NO: 332050 - DNA, 25 bp, Mus musculus
gacgcccgccggagaagatgagccc

SEQ ID NO: 332051 - DNA, 25 bp, Mus musculus
ctagcgtcccgtcgcgccgcgcttt

SEQ ID NO: 332052 - DNA, 25 bp, Mus musculus
ccgcccggcagccacgatgaggtga

SEQ ID NO: 332053 - DNA, 25 bp, Mus musculus
ttgcggtgccttaccgctgcgcgcg

SEQ ID NO: 332054 - DNA, 25 bp, Mus musculus
agccggcggcccaagcaccagaaga

SEQ ID NO: 332055 - DNA, 25 bp, Mus musculus
gccggcggtccacactttgccatcc

SEQ ID NO: 332056 - DNA, 25 bp, Mus musculus
cccggcagccacgatgaggtgagtc

SEQ ID NO: 332057 - DNA, 25 bp, Mus musculus
ggaaagctactatcctccggtggga

SEQ ID NO: 332058 - DNA, 25 bp, Mus musculus
ggttgccttatcgtggagcgcagtt

SEQ ID NO: 332059 - DNA, 25 bp, Mus musculus
ccaggcaacttgtaggcggtgcgct

SEQ ID NO: 332060 - DNA, 25 bp, Mus musculus
aggggccgccagtaatcttggattc

SEQ ID NO: 332061 - DNA, 25 bp, Mus musculus
cgcagtgttcacctgtcacagcata

SEQ ID NO: 332062 - DNA, 25 bp, Mus musculus
gccgcgctattacccatggtgggga

SEQ ID NO: 332063 - DNA, 25 bp, Mus musculus
ggtcgctgtagacccactcgaagtc

SEQ ID NO: 332064 - DNA, 25 bp, Mus musculus
cattgtggctactgtgtcccagcta

SEQ ID NO: 332065 - DNA, 25 bp, Mus musculus
catactagctgcaggcgaagaaccc

SEQ ID NO: 332066 - DNA, 25 bp, Mus musculus
ctgcacacagcaggcgcatactagc

SEQ ID NO: 332067 - DNA, 25 bp, Mus musculus
aaaggcatatcctgcttcctgagca

SEQ ID NO: 332068 - DNA, 25 bp, Mus musculus
tcggagagatccaccgcaggaaagc

SEQ ID NO: 332069 - DNA, 25 bp, Mus musculus
cggggtatccgcatgacagtgccca

SEQ ID NO: 332070 - DNA, 25 bp, Mus musculus
ttcctgagcagggtctgcacacagc

SEQ ID NO: 332071 - DNA, 25 bp, Mus musculus
gcgaactcgcaacggggaagcaatc

SEQ ID NO: 332072 - DNA, 25 bp, Mus musculus
ctcgcaacggggaagcaatcctctc

SEQ ID NO: 332073 - DNA, 25 bp, Mus musculus
tcaggaaccgtggacccgatgactt

SEQ ID NO: 332074 - DNA, 25 bp, Mus musculus
acctcaggaaccgtggacccgatga

SEQ ID NO: 332075 - DNA, 25 bp, Mus musculus
cggagaggctgcgacctcaggaacc

SEQ ID NO: 332076 - DNA, 25 bp, Mus musculus
ggaagcaatcctctcagcgtccacg

SEQ ID NO: 332077 - DNA, 25 bp, Mus musculus
cgatgacttgttagcgcacgcacgg

SEQ ID NO: 332078 - DNA, 25 bp, Mus musculus
cttgttagcgcacgcacggtcgggc

SEQ ID NO: 332079 - DNA, 25 bp, Mus musculus
acccgatgacttgttagcgcacgca

SEQ ID NO: 332080 - DNA, 25 bp, Mus musculus
aactcaagcgaactcgcaacgggga

SEQ ID NO: 332081 - DNA, 25 bp, Mus musculus
tagtctggtcacgtgccgcgagaga

SEQ ID NO: 332082 - DNA, 25 bp, Mus musculus
attggctagtctggtcacgtgccgc

SEQ ID NO: 332083 - DNA, 25 bp, Mus musculus
cgcaggcattggctagtctggtcac

SEQ ID NO: 332084 - DNA, 25 bp, Mus musculus
acggggaagcaatcctctcagcgtc

SEQ ID NO: 332085 - DNA, 25 bp, Mus musculus
acggacggcgctgcgcatgtgcaaa

SEQ ID NO: 332086 - DNA, 25 bp, Mus musculus
gtcaagtgctgtgggacgcgctcct

SEQ ID NO: 332087 - DNA, 25 bp, Mus musculus
acgtggaaaacctactggtgagcgg

SEQ ID NO: 332088 - DNA, 25 bp, Mus musculus
cccatcaacgtggaaaacctactgg

SEQ ID NO: 332089 - DNA, 25 bp, Mus musculus
cggcgcggagacagcccagcctgct

SEQ ID NO: 332090 - DNA, 25 bp, Mus musculus
acagcatgagtcagcagcggacggc

SEQ ID NO: 332091 - DNA, 25 bp, Mus musculus
cgcctgggctcatcgctgcgcgagt

SEQ ID NO: 332092 - DNA, 25 bp, Mus musculus
tgggacgcgctccttgcatcgggcc

SEQ ID NO: 332093 - DNA, 25 bp, Mus musculus
gcgcatgtgcaaacgcgggtgcact

SEQ ID NO: 332094 - DNA, 25 bp, Mus musculus
agatctaacggacggcgctgcgcat

SEQ ID NO: 332095 - DNA, 25 bp, Mus musculus
gccctctgcacagtgtcgcttgctg

SEQ ID NO: 332096 - DNA, 25 bp, Mus musculus
ttgcatcgggccctctgcacagtgt

SEQ ID NO: 332097 - DNA, 25 bp, Mus musculus
aggatccatcctccggaacacccgg

SEQ ID NO: 332098 - DNA, 25 bp, Mus musculus
cactgcgcatgcggaaagatggccg

SEQ ID NO: 332099 - DNA, 25 bp, Mus musculus
agccgctggtgacggacgacccgac

SEQ ID NO: 332100 - DNA, 25 bp, Mus musculus
tacatggccacggacggctcgtata

SEQ ID NO: 332101 - DNA, 25 bp, Mus musculus
cggctcgtatatgccggccgatatc

SEQ ID NO: 332102 - DNA, 25 bp, Mus musculus
tatatgccggccgatatcgtggagc

SEQ ID NO: 332103 - DNA, 25 bp, Mus musculus
gccgatatcgtggagctgcatgaga

SEQ ID NO: 332104 - DNA, 25 bp, Mus musculus
ctgcatgagatcgaggtggagacca

SEQ ID NO: 332105 - DNA, 25 bp, Mus musculus
accatcccggtggagaccatcgaga

SEQ ID NO: 332106 - DNA, 25 bp, Mus musculus
cgaggaccagatcctcatcccggtg

SEQ ID NO: 332107 - DNA, 25 bp, Mus musculus
gcggcgacgacgactacatagagca

SEQ ID NO: 332108 - DNA, 25 bp, Mus musculus
cgactacatagagcagacgctggtc

SEQ ID NO: 332109 - DNA, 25 bp, Mus musculus
atagagcagacgctggtcaccgtgg

SEQ ID NO: 332110 - DNA, 25 bp, Mus musculus
gaagagcggcaagaagagttacctg

SEQ ID NO: 332111 - DNA, 25 bp, Mus musculus
tcgggcgacaccctctacatggcca

SEQ ID NO: 332112 - DNA, 25 bp, Mus musculus
agatcgaggtggagaccatcccggt

SEQ ID NO: 332113 - DNA, 25 bp, Mus musculus
attgatgccgcgcaggccctcatgc

SEQ ID NO: 332114 - DNA, 25 bp, Mus musculus
tgtggacaccatgcctcgattgatg

SEQ ID NO: 332115 - DNA, 25 bp, Mus musculus
gtctcccgcagaagtgtggacacca

SEQ ID NO: 332116 - DNA, 25 bp, Mus musculus
ccaaagcttggcgtctcccgcagaa

SEQ ID NO: 332117 - DNA, 25 bp, Mus musculus
catcataggtgaggaagtagacgcc

SEQ ID NO: 332118 - DNA, 25 bp, Mus musculus
tggcgcgggtcattacatcataggt

SEQ ID NO: 332119 - DNA, 25 bp, Mus musculus
ttaggcaccagcaggcggtcacctg

SEQ ID NO: 332120 - DNA, 25 bp, Mus musculus
taagtggagagccaggatgtgatcc

SEQ ID NO: 332121 - DNA, 25 bp, Mus musculus
gtgacttaaccacgtccatgggata

SEQ ID NO: 332122 - DNA, 25 bp, Mus musculus
ccgtcggcttgcagtcgtgacttaa

SEQ ID NO: 332123 - DNA, 25 bp, Mus musculus
gcatgcagtcgacgatgccgcggta

SEQ ID NO: 332124 - DNA, 25 bp, Mus musculus
cctggtagctctgccgcatgcagtc

SEQ ID NO: 332125 - DNA, 25 bp, Mus musculus
cagccctcgcgtgaagacttgccag

SEQ ID NO: 332126 - DNA, 25 bp, Mus musculus
gacttgccagccctcggcctggtag

SEQ ID NO: 332127 - DNA, 25 bp, Mus musculus
ggtgccgccgccaagtctcattggc

SEQ ID NO: 332128 - DNA, 25 bp, Mus musculus
tcaagaagacacctgtcgccgcgta

SEQ ID NO: 332129 - DNA, 25 bp, Mus musculus
tggcatgccggtcatctccttacct

SEQ ID NO: 332130 - DNA, 25 bp, Mus musculus
tgtgtcttactactcctcgggcccg

SEQ ID NO: 332131 - DNA, 25 bp, Mus musculus
atggcgactcctagaaaagcactcc

SEQ ID NO: 332132 - DNA, 25 bp, Mus musculus
tcccggctcagtagacaaagactgt

SEQ ID NO: 332133 - DNA, 25 bp, Mus musculus
ggcacactgcacactggagcccaga

SEQ ID NO: 332134 - DNA, 25 bp, Mus musculus
gcggcgctcgatctgcttcaatcct

SEQ ID NO: 332135 - DNA, 25 bp, Mus musculus
ctcacggtatttggatgcgactctc

SEQ ID NO: 332136 - DNA, 25 bp, Mus musculus
aacctcatcgtccttgcctgtgtca

SEQ ID NO: 332137 - DNA, 25 bp, Mus musculus
aaggcctactttggtcttggactca

SEQ ID NO: 332138 - DNA, 25 bp, Mus musculus
agttcgagaacgaccgcccacttgg

SEQ ID NO: 332139 - DNA, 25 bp, Mus musculus
cactcagtgcgcacggaagggtcaa

SEQ ID NO: 332140 - DNA, 25 bp, Mus musculus
acaaagactgtgcttctcgggcccg

SEQ ID NO: 332141 - DNA, 25 bp, Mus musculus
tcgtggtacaggtgcccagagaaca

SEQ ID NO: 332142 - DNA, 25 bp, Mus musculus
cggccgcatgcttctcgcttcttag

SEQ ID NO: 332143 - DNA, 25 bp, Mus musculus
gaccaagagcttccgtgtgtgtgtg

SEQ ID NO: 332144 - DNA, 25 bp, Mus musculus
attggctgaaattgctggcgtcgtg

SEQ ID NO: 332145 - DNA, 25 bp, Mus musculus
gcagagaccatctccgattggctga

SEQ ID NO: 332146 - DNA, 25 bp, Mus musculus
catgccgctattggctgtccaggca

SEQ ID NO: 332147 - DNA, 25 bp, Mus musculus
ttccggtctcggcatgccgctattg

SEQ ID NO: 332148 - DNA, 25 bp, Mus musculus
gccggctggaataacttccggtctc

SEQ ID NO: 332149 - DNA, 25 bp, Mus musculus
tccgtggaaacaccagccggctgga

SEQ ID NO: 332150 - DNA, 25 bp, Mus musculus
tacctcttgggcgtccgtggaaaca

SEQ ID NO: 332151 - DNA, 25 bp, Mus musculus
caagttcagccaccggtacctcttg

SEQ ID NO: 332152 - DNA, 25 bp, Mus musculus
agcccggttccgagctggatcctcg

SEQ ID NO: 332153 - DNA, 25 bp, Mus musculus
ttctcgcttcttagcgccgggctca

SEQ ID NO: 332154 - DNA, 25 bp, Mus musculus
ccagagaacagacagcccggttccg

SEQ ID NO: 332155 - DNA, 25 bp, Mus musculus
gcctgactgcgcttggcgctcatca

SEQ ID NO: 332156 - DNA, 25 bp, Mus musculus
agggactccaaacacggacagctcg

SEQ ID NO: 332157 - DNA, 25 bp, Mus musculus
ccagacgctcaaaccctagagaatg

SEQ ID NO: 332158 - DNA, 25 bp, Mus musculus
ctagccagcggaacgcacaaacttc

SEQ ID NO: 332159 - DNA, 25 bp, Mus musculus
ggtgtatgcctctgcttgcctagcc

SEQ ID NO: 332160 - DNA, 25 bp, Mus musculus
tcaagcgttgaccagaatgaggcca

SEQ ID NO: 332161 - DNA, 25 bp, Mus musculus
ggcggccactcactcaagcgttgac

SEQ ID NO: 332162 - DNA, 25 bp, Mus musculus
tcatcagcatcaaaggggaccgcgc

SEQ ID NO: 332163 - DNA, 25 bp, Mus musculus
ctcggttctttctcagccgtgacaa

SEQ ID NO: 332164 - DNA, 25 bp, Mus musculus
tgacgccatgcacttaacgatcttt

SEQ ID NO: 332165 - DNA, 25 bp, Mus musculus
acgcgcgcagttttgcctcaacagg

SEQ ID NO: 332166 - DNA, 25 bp, Mus musculus
gtacacaaagactagccggccaccg

SEQ ID NO: 332167 - DNA, 25 bp, Mus musculus
ccgcagagccgcttaagtctggcca

SEQ ID NO: 332168 - DNA, 25 bp, Mus musculus
gcctggagctgcagtggtacacaaa

SEQ ID NO: 332169 - DNA, 25 bp, Mus musculus
tgctcaggtagatggcctgctgcga

SEQ ID NO: 332170 - DNA, 25 bp, Mus musculus
cagcactttggcgatgacgcaggtg

SEQ ID NO: 332171 - DNA, 25 bp, Mus musculus
gaggcatccgacatgcgcgaggaca

SEQ ID NO: 332172 - DNA, 25 bp, Mus musculus
cgctgcagtagatgtctcccttgta

SEQ ID NO: 332173 - DNA, 25 bp, Mus musculus
ccttctcctcggacgtggcgctgaa

SEQ ID NO: 332174 - DNA, 25 bp, Mus musculus
ggcttgcggttgaagaactcgtcgc

SEQ ID NO: 332175 - DNA, 25 bp, Mus musculus
agacacagtccgagcaaagcctggg

SEQ ID NO: 332176 - DNA, 25 bp, Mus musculus
tccacaggtttggaggcatgagagc

SEQ ID NO: 332177 - DNA, 25 bp, Mus musculus
gcctggtaggagtaggcgcccacat

SEQ ID NO: 332178 - DNA, 25 bp, Mus musculus
cgtagtaacgttccgagtagttgca

SEQ ID NO: 332179 - DNA, 25 bp, Mus musculus
ctatcggccttgtaggtggcataga

SEQ ID NO: 332180 - DNA, 25 bp, Mus musculus
gccctccgagaaactatcggccttg

SEQ ID NO: 332181 - DNA, 25 bp, Mus musculus
tgagacaggtcatcgccctccgaga

SEQ ID NO: 332182 - DNA, 25 bp, Mus musculus
cggtggaattctgcgcccgcaggaa

SEQ ID NO: 332183 - DNA, 25 bp, Mus musculus
ggatcgcacttcctgcgcgcaacgg

SEQ ID NO: 332184 - DNA, 25 bp, Mus musculus
ctgccctccgatctcggggttcgga

SEQ ID NO: 332185 - DNA, 25 bp, Mus musculus
cggcactcacctgagtttctccatg

SEQ ID NO: 332186 - DNA, 25 bp, Mus musculus
gacccttctggctggacggtctatc

SEQ ID NO: 332187 - DNA, 25 bp, Mus musculus
gggctccgagtcactggcgcagacc

SEQ ID NO: 332188 - DNA, 25 bp, Mus musculus
ggacggtctatcctcgcgcccggga

SEQ ID NO: 332189 - DNA, 25 bp, Mus musculus
actcttgcttctgctcaggaccctg

SEQ ID NO: 332190 - DNA, 25 bp, Mus musculus
gcatcggaagcgaggcactcttgct

SEQ ID NO: 332191 - DNA, 25 bp, Mus musculus
tcacgcagctcgaggggaacggcat

SEQ ID NO: 332192 - DNA, 25 bp, Mus musculus
gagagtgttggaaccacgcacccgg

SEQ ID NO: 332193 - DNA, 25 bp, Mus musculus
agtcgctggagagtgttggaaccac

SEQ ID NO: 332194 - DNA, 25 bp, Mus musculus
ccgcggctgtgtaacaggtgagccc

SEQ ID NO: 332195 - DNA, 25 bp, Mus musculus
agtttctccatgtctgcggcagagg

SEQ ID NO: 332196 - DNA, 25 bp, Mus musculus
ccgcgtgcgctgtggagacccttct

SEQ ID NO: 332197 - DNA, 25 bp, Mus musculus
agctgaagccgtccctttccgaggg

SEQ ID NO: 332198 - DNA, 25 bp, Mus musculus
ttcttttgcaatctttcatctcggg

SEQ ID NO: 332199 - DNA, 25 bp, Mus musculus
tttcatctcgggagacacgcggttc

SEQ ID NO: 332200 - DNA, 25 bp, Mus musculus
gagcccgttgtgcagagcccaagtt

SEQ ID NO: 332201 - DNA, 25 bp, Mus musculus
cagagcccaagttggcgggatgtca

SEQ ID NO: 332202 - DNA, 25 bp, Mus musculus
ccaagttggcgggatgtcaagtctg

SEQ ID NO: 332203 - DNA, 25 bp, Mus musculus
tctggagtggtagggttctcccagc

SEQ ID NO: 332204 - DNA, 25 bp, Mus musculus
agggttctcccagcttctgcttaga

SEQ ID NO: 332205 - DNA, 25 bp, Mus musculus
tctgcttagagtacaaattcgtgga

SEQ ID NO: 332206 - DNA, 25 bp, Mus musculus
attcgtggaaacaggagcgagcgct

SEQ ID NO: 332207 - DNA, 25 bp, Mus musculus
ggagtcgtgctgttgaagtctaacc

SEQ ID NO: 332208 - DNA, 25 bp, Mus musculus
ttgaagtctaaccaggggccgtgga

SEQ ID NO: 332209 - DNA, 25 bp, Mus musculus
gggactccacaaaccgggacagctg

SEQ ID NO: 332210 - DNA, 25 bp, Mus musculus
acaaaccgggacagctgaagccgtc

SEQ ID NO: 332211 - DNA, 25 bp, Mus musculus
gcatctgtgatcatgtgcatcttcc

SEQ ID NO: 332212 - DNA, 25 bp, Mus musculus
caggtacccgtctagccaaagagtg

SEQ ID NO: 332213 - DNA, 25 bp, Mus musculus
aagtgtcttactgtgtctgtgagcg

SEQ ID NO: 332214 - DNA, 25 bp, Mus musculus
attctgagtgcgtgcaagggctttc

SEQ ID NO: 332215 - DNA, 25 bp, Mus musculus
gtggttttcgtgtgtgcatctgtga

SEQ ID NO: 332216 - DNA, 25 bp, Mus musculus
tccacatcttcgtggtgtgcgtttg

SEQ ID NO: 332217 - DNA, 25 bp, Mus musculus
tttgggtcctcctgggcttctgacc

SEQ ID NO: 332218 - DNA, 25 bp, Mus musculus
gggactccagccctaagtgtcttac

SEQ ID NO: 332219 - DNA, 25 bp, Mus musculus
gctttcggccacagcacctatggtg

SEQ ID NO: 332220 - DNA, 25 bp, Mus musculus
gtcctcttgctcctgctggctttcg

SEQ ID NO: 332221 - DNA, 25 bp, Mus musculus
ttcgtggtccgcaaccagaagccca

SEQ ID NO: 332222 - DNA, 25 bp, Mus musculus
tcggcagccgcacttagcagcgtgc

SEQ ID NO: 332223 - DNA, 25 bp, Mus musculus
acgacagtacgaaaaggcggcgcgc

SEQ ID NO: 332224 - DNA, 25 bp, Mus musculus
ttggttcctgagacttgcgctaagc

SEQ ID NO: 332225 - DNA, 25 bp, Mus musculus
tgcccagcggctatgggctcaccta

SEQ ID NO: 332226 - DNA, 25 bp, Mus musculus
ggctatgggctcacctaccgcctga

SEQ ID NO: 332227 - DNA, 25 bp, Mus musculus
atgggtcccacgtgcgcgaagaagc

SEQ ID NO: 332228 - DNA, 25 bp, Mus musculus
ccgttcatgggtcccacgtgcgcga

SEQ ID NO: 332229 - DNA, 25 bp, Mus musculus
gagcttcgagtgtctgtgcaagccc

SEQ ID NO: 332230 - DNA, 25 bp, Mus musculus
agcacacccaggtgagcttcgagtg

SEQ ID NO: 332231 - DNA, 25 bp, Mus musculus
ggggcacctgcctccagcacaccca

SEQ ID NO: 332232 - DNA, 25 bp, Mus musculus
tgcagccgcccggtgagcaactgcg

SEQ ID NO: 332233 - DNA, 25 bp, Mus musculus
attcgtcgacaagacctgcagccgc

SEQ ID NO: 332234 - DNA, 25 bp, Mus musculus
tgcccagctggattcgtcgacaaga

SEQ ID NO: 332235 - DNA, 25 bp, Mus musculus
gggtgacttccgttgccgctgccca

SEQ ID NO: 332236 - DNA, 25 bp, Mus musculus
cgatggcgtctgcaccgacatcggg

SEQ ID NO: 332237 - DNA, 25 bp, Mus musculus
gagaacgatggcgtctgcaccgaca

SEQ ID NO: 332238 - DNA, 25 bp, Mus musculus
aactgcgccagtggcccgtgccaga

SEQ ID NO: 332239 - DNA, 25 bp, Mus musculus
agtcagtgccgcagatcgctatgga

SEQ ID NO: 332240 - DNA, 25 bp, Mus musculus
taccgctgtgtacgcgtgccgcgaa

SEQ ID NO: 332241 - DNA, 25 bp, Mus musculus
gccgcttcgcgtaccgctgtgtacg

SEQ ID NO: 332242 - DNA, 25 bp, Mus musculus
ccgtgtactaatgccgcttcgcgta

SEQ ID NO: 332243 - DNA, 25 bp, Mus musculus
aggaggttcgccgtgtactaatgcc

SEQ ID NO: 332244 - DNA, 25 bp, Mus musculus
ctccgtgaactagcgaggaggttcg

SEQ ID NO: 332245 - DNA, 25 bp, Mus musculus
actagtgccgcggacctccgtgaac

SEQ ID NO: 332246 - DNA, 25 bp, Mus musculus
aaggttcgccatggactagtgccgc

SEQ ID NO: 332247 - DNA, 25 bp, Mus musculus
tcgctatggactggtgccaaggttc

SEQ ID NO: 332248 - DNA, 25 bp, Mus musculus
ttcatagtggacagtcagtgccgca

SEQ ID NO: 332249 - DNA, 25 bp, Mus musculus
ccgctacggttcatagtggacagtc

SEQ ID NO: 332250 - DNA, 25 bp, Mus musculus
ttcgctatgaactaccgctacggtt

SEQ ID NO: 332251 - DNA, 25 bp, Mus musculus
gcgaaccgccgtggaattgtgccgc

SEQ ID NO: 332252 - DNA, 25 bp, Mus musculus
tggtgccaaggttcgccatggacta

SEQ ID NO: 332253 - DNA, 25 bp, Mus musculus
agttcggcgcggcttgcatagctgc

SEQ ID NO: 332254 - DNA, 25 bp, Mus musculus
tggaggcgctcatccgagaccctcg

SEQ ID NO: 332255 - DNA, 25 bp, Mus musculus
ctgcgcgctgagtcagcgggacaca

SEQ ID NO: 332256 - DNA, 25 bp, Mus musculus
agctggagacccaggttccagagtg

SEQ ID NO: 332257 - DNA, 25 bp, Mus musculus
tcgctcgcccatcaacgtggagagt

SEQ ID NO: 332258 - DNA, 25 bp, Mus musculus
gacccaggttccagagtggagaccc

SEQ ID NO: 332259 - DNA, 25 bp, Mus musculus
agaagcctggctgctcagcccggtg

SEQ ID NO: 332260 - DNA, 25 bp, Mus musculus
ggaacggaaaagaagcctggctgct

SEQ ID NO: 332261 - DNA, 25 bp, Mus musculus
cccgacgaggcagggagactagcca

SEQ ID NO: 332262 - DNA, 25 bp, Mus musculus
gctgccatccgtcccgcctcccagt

SEQ ID NO: 332263 - DNA, 25 bp, Mus musculus
cggacgtcaactaggcctctgggtc

SEQ ID NO: 332264 - DNA, 25 bp, Mus musculus
gggcgcggacgtcaactaggcctct

SEQ ID NO: 332265 - DNA, 25 bp, Mus musculus
gcttgcatagctgcgcgctgagtca

SEQ ID NO: 332266 - DNA, 25 bp, Mus musculus
catcaacgtggagagtctgctggta

SEQ ID NO: 332267 - DNA, 25 bp, Mus musculus
tctgcaagcctagcccactggagca

SEQ ID NO: 332268 - DNA, 25 bp, Mus musculus
acttcggacccggatagcgatggca

SEQ ID NO: 332269 - DNA, 25 bp, Mus musculus
gatctttatcctcgggtgacacggc

SEQ ID NO: 332270 - DNA, 25 bp, Mus musculus
ttgtccctaattggggccggctgct

SEQ ID NO: 332271 - DNA, 25 bp, Mus musculus
ggccagttaaacgtttctcggagca

SEQ ID NO: 332272 - DNA, 25 bp, Mus musculus
gccggatttggggattcttttctca

SEQ ID NO: 332273 - DNA, 25 bp, Mus musculus
tctggaagcactcctaaggcaggtc

SEQ ID NO: 332274 - DNA, 25 bp, Mus musculus
tccctgagtcccgatgtgtccggaa

SEQ ID NO: 332275 - DNA, 25 bp, Mus musculus
ggcaactacttgacaggacgcacgg

SEQ ID NO: 332276 - DNA, 25 bp, Mus musculus
ttgtgctttactgtggacacccagg

SEQ ID NO: 332277 - DNA, 25 bp, Mus musculus
tttctggtctttggaactgcgccct

SEQ ID NO: 332278 - DNA, 25 bp, Mus musculus
ccgcctggacctgatcatgacttga

SEQ ID NO: 332279 - DNA, 25 bp, Mus musculus
gtgccacgtctgcaaaggctctgca

SEQ ID NO: 332280 - DNA, 25 bp, Mus musculus
cccgtggtgttggatcaccctctct

SEQ ID NO: 332281 - DNA, 25 bp, Mus musculus
ccttggaaattaatgcgaacggagc

SEQ ID NO: 332282 - DNA, 25 bp, Mus musculus
cccagtgccttggaaattaatgcga

SEQ ID NO: 332283 - DNA, 25 bp, Mus musculus
atcagtcaagctcgccgtttcaaga

SEQ ID NO: 332284 - DNA, 25 bp, Mus musculus
tctcgcagcggtgtccatcagtcaa

SEQ ID NO: 332285 - DNA, 25 bp, Mus musculus
gaccatctcgcagcggtgtccatca

SEQ ID NO: 332286 - DNA, 25 bp, Mus musculus
tgtccatcagtcaagctcgccgttt

SEQ ID NO: 332287 - DNA, 25 bp, Mus musculus
ttaatgcgaacggagccagggacgc

SEQ ID NO: 332288 - DNA, 25 bp, Mus musculus
gtggaccacaacttcggggaggaga

SEQ ID NO: 332289 - DNA, 25 bp, Mus musculus
aaactccagcgagccttgagacagc

SEQ ID NO: 332290 - DNA, 25 bp, Mus musculus
gtttcagagaacgaaaactccagcg

SEQ ID NO: 332291 - DNA, 25 bp, Mus musculus
agcctccgtgagtttcagagaacga

SEQ ID NO: 332292 - DNA, 25 bp, Mus musculus
ggtctgttcagagcctccgtgagtt

SEQ ID NO: 332293 - DNA, 25 bp, Mus musculus
ggtcatttgtctcctcccttcgctg

SEQ ID NO: 332294 - DNA, 25 bp, Mus musculus
aggaaccaggccgagcgcgtctcca

SEQ ID NO: 332295 - DNA, 25 bp, Mus musculus
cccgccaattcaagctttgactata

SEQ ID NO: 332296 - DNA, 25 bp, Mus musculus
gactcccgcggtacctgggcagcga

SEQ ID NO: 332297 - DNA, 25 bp, Mus musculus
atcgggctcctagtccctggacaca

SEQ ID NO: 332298 - DNA, 25 bp, Mus musculus
ccctccgggctcaagttgcaagggg

SEQ ID NO: 332299 - DNA, 25 bp, Mus musculus
cattggccgcgcctctgggtgatcc

SEQ ID NO: 332300 - DNA, 25 bp, Mus musculus
acccaagatttctggggcattggcc

SEQ ID NO: 332301 - DNA, 25 bp, Mus musculus
accgaggaccagatgcctcgccagg

SEQ ID NO: 332302 - DNA, 25 bp, Mus musculus
tccctggacacagcggcttcggggt

SEQ ID NO: 332303 - DNA, 25 bp, Mus musculus
tgctgcttcactcgctgaggctctg

SEQ ID NO: 332304 - DNA, 25 bp, Mus musculus
ttggctctgagatcgggctcctagt

SEQ ID NO: 332305 - DNA, 25 bp, Mus musculus
caccactgactgcttggctctgaga

SEQ ID NO: 332306 - DNA, 25 bp, Mus musculus
ccgccggggaactcagctcaggtgc

SEQ ID NO: 332307 - DNA, 25 bp, Mus musculus
tgactataaattgagctcccagagc

SEQ ID NO: 332308 - DNA, 25 bp, Mus musculus
tgcgcgggttacaccattgccacca

SEQ ID NO: 332309 - DNA, 25 bp, Mus musculus
ttaagttccagcgagacagaagttc

SEQ ID NO: 332310 - DNA, 25 bp, Mus musculus
cgcaaagccgacgactctaagactc

SEQ ID NO: 332311 - DNA, 25 bp, Mus musculus
gtgatgctcagcaagtcccggatga

SEQ ID NO: 332312 - DNA, 25 bp, Mus musculus
tcccggatgagaccaagcgaattct

SEQ ID NO: 332313 - DNA, 25 bp, Mus musculus
aagcgaattctctctgccctcggga

SEQ ID NO: 332314 - DNA, 25 bp, Mus musculus
ctcgggacaaatagcgcacctcgca

SEQ ID NO: 332315 - DNA, 25 bp, Mus musculus
cgcagcgccctcagctgaaagtaca

SEQ ID NO: 332316 - DNA, 25 bp, Mus musculus
tactcagacgaagagaggcgcgtgc

SEQ ID NO: 332317 - DNA, 25 bp, Mus musculus
ttgccgtagctactggagacgcgct

SEQ ID NO: 332318 - DNA, 25 bp, Mus musculus
tctcggcttcaggagaagaattctg

SEQ ID NO: 332319 - DNA, 25 bp, Mus musculus
agctggccgtctactcccgagagat

SEQ ID NO: 332320 - DNA, 25 bp, Mus musculus
gtcccgaggccgatcttaagttcca

SEQ ID NO: 332321 - DNA, 25 bp, Mus musculus
ctggtgccgacaaacccagtgatga

SEQ ID NO: 332322 - DNA, 25 bp, Mus musculus
ctcccgagagatcgctaccagaagg

SEQ ID NO: 332323 - DNA, 25 bp, Mus musculus
tgctcggtcaacatgaagagttccg

SEQ ID NO: 332324 - DNA, 25 bp, Mus musculus
ggtagtgctcggtcaacatgaagag

SEQ ID NO: 332325 - DNA, 25 bp, Mus musculus
aactctagcctgagagtttgcacgg

SEQ ID NO: 332326 - DNA, 25 bp, Mus musculus
gtgaactctagcctgagagtttgca

SEQ ID NO: 332327 - DNA, 25 bp, Mus musculus
ctctagcctgagagtttgcacggtc

SEQ ID NO: 332328 - DNA, 25 bp, Mus musculus
tctagcctgagagtttgcacggtct

SEQ ID NO: 332329 - DNA, 25 bp, Mus musculus
ctagcctgagagtttgcacggtctc

SEQ ID NO: 332330 - DNA, 25 bp, Mus musculus
tagcctgagagtttgcacggtctcc

SEQ ID NO: 332331 - DNA, 25 bp, Mus musculus
cggtagtgctcggtctcccggtact

SEQ ID NO: 332332 - DNA, 25 bp, Mus musculus
tagtgctcggtcaacatgaagagtt

SEQ ID NO: 332333 - DNA, 25 bp, Mus musculus
gtgctcggtcaacatgaagagttcc

SEQ ID NO: 332334 - DNA, 25 bp, Mus musculus
atctgcacgcgtccgaccttggact

SEQ ID NO: 332335 - DNA, 25 bp, Mus musculus
gtagtgctcggtcaacatgaagagt

SEQ ID NO: 332336 - DNA, 25 bp, Mus musculus
agtgctcggtcaacatgaagagttc

SEQ ID NO: 332337 - DNA, 25 bp, Mus musculus
cacggtctcccggtactgtcggtag

SEQ ID NO: 332338 - DNA, 25 bp, Mus musculus
ccgtgatggcctgctgcgccttgcg

SEQ ID NO: 332339 - DNA, 25 bp, Mus musculus
gcaggcgggtcatggcgggtcttgc

SEQ ID NO: 332340 - DNA, 25 bp, Mus musculus
tcccggtgctccgtgatggcctgct

SEQ ID NO: 332341 - DNA, 25 bp, Mus musculus
agctcccggtgctccgtgatggcct

SEQ ID NO: 332342 - DNA, 25 bp, Mus musculus
catcagctcccggtgctccgtgatg

SEQ ID NO: 332343 - DNA, 25 bp, Mus musculus
ttccgcagggtccacggcgggaggc

SEQ ID NO: 332344 - DNA, 25 bp, Mus musculus
cgtagctcctgcattcgccggttct

SEQ ID NO: 332345 - DNA, 25 bp, Mus musculus
gggcctcgtgcaatttccttcgcac

SEQ ID NO: 332346 - DNA, 25 bp, Mus musculus
aatttccttcgcacctccaacgtga

SEQ ID NO: 332347 - DNA, 25 bp, Mus musculus
gtagctcctgcattcgccggttctc

SEQ ID NO: 332348 - DNA, 25 bp, Mus musculus
ctccgtgatggcctgctgcgccttg

SEQ ID NO: 332349 - DNA, 25 bp, Mus musculus
ttcgcacctccaacgtgaactctag

SEQ ID NO: 332350 - DNA, 25 bp, Mus musculus
cacctccaacgtgaactctagcctg

SEQ ID NO: 332351 - DNA, 25 bp, Mus musculus
ctggatccttctagaagcagctacg

SEQ ID NO: 332352 - DNA, 25 bp, Mus musculus
gaagcacgccgcatgtcccgggaca

SEQ ID NO: 332353 - DNA, 25 bp, Mus musculus
acaagacggcttgtgggctcagcct

SEQ ID NO: 332354 - DNA, 25 bp, Mus musculus
cctgctggttatcagcaggaacgca

SEQ ID NO: 332355 - DNA, 25 bp, Mus musculus
ttatcagcaggaacgcagcagtcgc

SEQ ID NO: 332356 - DNA, 25 bp, Mus musculus
aggaacgcagcagtcgcaagcaccc

SEQ ID NO: 332357 - DNA, 25 bp, Mus musculus
actcctctggatccttctagaagca

SEQ ID NO: 332358 - DNA, 25 bp, Mus musculus
gctgcgcagaagcacgccgcatgtc

SEQ ID NO: 332359 - DNA, 25 bp, Mus musculus
ttctagaagcagctacgccacgggc

SEQ ID NO: 332360 - DNA, 25 bp, Mus musculus
aagcagctacgccacgggctgtcag

SEQ ID NO: 332361 - DNA, 25 bp, Mus musculus
tacgccacgggctgtcaggcgcctg

SEQ ID NO: 332362 - DNA, 25 bp, Mus musculus
gctgtcaggcgcctgcgctcttgtc

SEQ ID NO: 332363 - DNA, 25 bp, Mus musculus
cctgcgctcttgtcccgcatgaatt

SEQ ID NO: 332364 - DNA, 25 bp, Mus musculus
tccgcccagcgccagactcctctgg

SEQ ID NO: 332365 - DNA, 25 bp, Mus musculus
tagtcgccatacatctcacatgtgc

SEQ ID NO: 332366 - DNA, 25 bp, Mus musculus
gccatgccgaataaaaacaagaagg

SEQ ID NO: 332367 - DNA, 25 bp, Mus musculus
ccggagccagcagcattgccttcgt

SEQ ID NO: 332368 - DNA, 25 bp, Mus musculus
taatggcccaaggaaaccgccgctc

SEQ ID NO: 332369 - DNA, 25 bp, Mus musculus
gagcgtcaccgctaccaggcttatg

SEQ ID NO: 332370 - DNA, 25 bp, Mus musculus
caggcttatggggtagagtttttcg

SEQ ID NO: 332371 - DNA, 25 bp, Mus musculus
ggaaggctacagaatagtcgccata

SEQ ID NO: 332372 - DNA, 25 bp, Mus musculus
atacatctcacatgtgcattcccgc

SEQ ID NO: 332373 - DNA, 25 bp, Mus musculus
ggctcagcggccgtgactttatcac

SEQ ID NO: 332374 - DNA, 25 bp, Mus musculus
gactttatcacctccgttgtccgca

SEQ ID NO: 332375 - DNA, 25 bp, Mus musculus
tgatggctccaccaaaaccttcaca

SEQ ID NO: 332376 - DNA, 25 bp, Mus musculus
gagagcggacgagcgactcagtccc

SEQ ID NO: 332377 - DNA, 25 bp, Mus musculus
ccgcaccagccatgccgaataaaaa

SEQ ID NO: 332378 - DNA, 25 bp, Mus musculus
agagtttttcgtgcctggaaggcta

SEQ ID NO: 332379 - DNA, 25 bp, Mus musculus
ggcaaacaggcgtccgtggaactga

SEQ ID NO: 332380 - DNA, 25 bp, Mus musculus
gtgtctgactctgaatctcgcgata

SEQ ID NO: 332381 - DNA, 25 bp, Mus musculus
gacacgtgatcgacctgccactctg

SEQ ID NO: 332382 - DNA, 25 bp, Mus musculus
ctccacggcgcacgtgactggatga

SEQ ID NO: 332383 - DNA, 25 bp, Mus musculus
tcacatgatcgttcgaggccacacg

SEQ ID NO: 332384 - DNA, 25 bp, Mus musculus
actttccacttgataggcggggttg

SEQ ID NO: 332385 - DNA, 25 bp, Mus musculus
cgaccaatcgggaagtgtctgactc

SEQ ID NO: 332386 - DNA, 25 bp, Mus musculus
aatgacgcagcgcatcgaccaatcg

SEQ ID NO: 332387 - DNA, 25 bp, Mus musculus
accttcacctaaacgctggcgcagg

SEQ ID NO: 332388 - DNA, 25 bp, Mus musculus
gcacacaggacagggagaccgacta

SEQ ID NO: 332389 - DNA, 25 bp, Mus musculus
aagcttagacgcttggcccacggca

SEQ ID NO: 332390 - DNA, 25 bp, Mus musculus
ctcgaacgcaggctgacttaggaca

SEQ ID NO: 332391 - DNA, 25 bp, Mus musculus
cgaaacctcggttcggcagctcgaa

SEQ ID NO: 332392 - DNA, 25 bp, Mus musculus
agtggcttctggacagcggcaaaca

SEQ ID NO: 332393 - DNA, 25 bp, Mus musculus
cgccctggagcagatgcgcaagttc

SEQ ID NO: 332394 - DNA, 25 bp, Mus musculus
acctgcgtaagctggtgccgctgct

SEQ ID NO: 332395 - DNA, 25 bp, Mus musculus
tggagcgctccaccctcaaaggtgc

SEQ ID NO: 332396 - DNA, 25 bp, Mus musculus
tccacacggtcctggtggagcgctc

SEQ ID NO: 332397 - DNA, 25 bp, Mus musculus
tgtcagacccgcaggtccacacggt

SEQ ID NO: 332398 - DNA, 25 bp, Mus musculus
gatgcgcaagttcctgtcagacccg

SEQ ID NO: 332399 - DNA, 25 bp, Mus musculus
cggtgctgcagaagcacctgcgtaa

SEQ ID NO: 332400 - DNA, 25 bp, Mus musculus
tttctatctctctcccttccgtgga

SEQ ID NO: 332401 - DNA, 25 bp, Mus musculus
gctcactgctctctcgtgccggagg

SEQ ID NO: 332402 - DNA, 25 bp, Mus musculus
gcctccagtcgcatgcgtaacgtcg

SEQ ID NO: 332403 - DNA, 25 bp, Mus musculus
gcggttcctggaccacttttgcgca

SEQ ID NO: 332404 - DNA, 25 bp, Mus musculus
gtctccgcggcttctcaagatggcc

SEQ ID NO: 332405 - DNA, 25 bp, Mus musculus
cttttgcgcagagtaatgggtcccg

SEQ ID NO: 332406 - DNA, 25 bp, Mus musculus
ccttccgtggatccgccatgtcgga

SEQ ID NO: 332407 - DNA, 25 bp, Mus musculus
gccttatatagaggcgggcccgccc

SEQ ID NO: 332408 - DNA, 25 bp, Mus musculus
ggtggatgacaaagggatgacctca

SEQ ID NO: 332409 - DNA, 25 bp, Mus musculus
agggatgacctcatttcagaatgcg

SEQ ID NO: 332410 - DNA, 25 bp, Mus musculus
cggtaattacgaagcgcatgtgcgc

SEQ ID NO: 332411 - DNA, 25 bp, Mus musculus
tgcgccatcactcaccgtggctgaa

SEQ ID NO: 332412 - DNA, 25 bp, Mus musculus
tgacgctccgcaccaggacactgaa

SEQ ID NO: 332413 - DNA, 25 bp, Mus musculus
ccctgcgccggccttatatagaggc

SEQ ID NO: 332414 - DNA, 25 bp, Mus musculus
tgcacatgcgcagtccggaacgctc

SEQ ID NO: 332415 - DNA, 25 bp, Mus musculus
gcctgaagcctccatgtgagccctg

SEQ ID NO: 332416 - DNA, 25 bp, Mus musculus
tgtgagccctgtggtctaaggcttc

SEQ ID NO: 332417 - DNA, 25 bp, Mus musculus
tgttgtgtgaacctcgcggtcctct

SEQ ID NO: 332418 - DNA, 25 bp, Mus musculus
gcgctttaggtccttgcaggcaaaa

SEQ ID NO: 332419 - DNA, 25 bp, Mus musculus
tggctgaatgaacacgcacgagacg

SEQ ID NO: 332420 - DNA, 25 bp, Mus musculus
acccgcgcggagaacgaacgcaagc

SEQ ID NO: 332421 - DNA, 25 bp, Mus musculus
cggggtctgtcaggttccgatcccg

SEQ ID NO: 332422 - DNA, 25 bp, Mus musculus
aacggcgaccgcctctgcttcaatg

SEQ ID NO: 332423 - DNA, 25 bp, Mus musculus
gaccgcctctgcttcaatgtgggcc

SEQ ID NO: 332424 - DNA, 25 bp, Mus musculus
gcacttgtacttttgagtgggccgg

SEQ ID NO: 332425 - DNA, 25 bp, Mus musculus
cttcccgggaggctcgagagtcctg

SEQ ID NO: 332426 - DNA, 25 bp, Mus musculus
ggtaactccgctgaggtgctccgga

SEQ ID NO: 332427 - DNA, 25 bp, Mus musculus
tgtcaggttccgatcccgcccggga

SEQ ID NO: 332428 - DNA, 25 bp, Mus musculus
ttagggcaggatgaacgctgctttc

SEQ ID NO: 332429 - DNA, 25 bp, Mus musculus
gcagttggaccattaaaaactagcc

SEQ ID NO: 332430 - DNA, 25 bp, Mus musculus
gcgtgcgcagttggaccattaaaaa

SEQ ID NO: 332431 - DNA, 25 bp, Mus musculus
ttcgacccgcaccaggagggcggca

SEQ ID NO: 332432 - DNA, 25 bp, Mus musculus
ctcagcgaagctgcagagcgagaca

SEQ ID NO: 332433 - DNA, 25 bp, Mus musculus
tcaacgaccagtctggcaacggcga

SEQ ID NO: 332434 - DNA, 25 bp, Mus musculus
ttgagtgggccggtaactccgctga

SEQ ID NO: 332435 - DNA, 25 bp, Mus musculus
gtgcgtaaggacaccacaacccgcg

SEQ ID NO: 332436 - DNA, 25 bp, Mus musculus
tctccatgggcaacgccgaagtggg

SEQ ID NO: 332437 - DNA, 25 bp, Mus musculus
aagtcatctccatgggcaacgccga

SEQ ID NO: 332438 - DNA, 25 bp, Mus musculus
cgcatcaaagtcatctccatgggca

SEQ ID NO: 332439 - DNA, 25 bp, Mus musculus
aagtccctccgcatcaaagtcatct

SEQ ID NO: 332440 - DNA, 25 bp, Mus musculus
gcgatggagaccaacgtgccgaaga

SEQ ID NO: 332441 - DNA, 25 bp, Mus musculus
cacagcggctccgtcattgggcgag

SEQ ID NO: 332442 - DNA, 25 bp, Mus musculus
ggtgacgagcacagcggctccgtca

SEQ ID NO: 332443 - DNA, 25 bp, Mus musculus
ctcgccgcttcccaaccgccctcgt

SEQ ID NO: 332444 - DNA, 25 bp, Mus musculus
cacggcgcgcagtcatcgcgagact

SEQ ID NO: 332445 - DNA, 25 bp, Mus musculus
ccgcaatgacgtcacggcgcgcagt

SEQ ID NO: 332446 - DNA, 25 bp, Mus musculus
caggacctccgcgtgctgtgagagc

SEQ ID NO: 332447 - DNA, 25 bp, Mus musculus
ggaaagtgagtaccgcgtgctgcga

SEQ ID NO: 332448 - DNA, 25 bp, Mus musculus
ccaacgtgccgaagaggaaggagcc

SEQ ID NO: 332449 - DNA, 25 bp, Mus musculus
tcccggactcccaattcctcgcagg

SEQ ID NO: 332450 - DNA, 25 bp, Mus musculus
cccgccagctccaaaagtaaactag

SEQ ID NO: 332451 - DNA, 25 bp, Mus musculus
ctccaaaagtaaactagggaggctg

SEQ ID NO: 332452 - DNA, 25 bp, Mus musculus
gcgccgccagctgcgcgtaaatctg

SEQ ID NO: 332453 - DNA, 25 bp, Mus musculus
tgcgcgtaaatctgcggcagcttga

SEQ ID NO: 332454 - DNA, 25 bp, Mus musculus
aaatctgcggcagcttgagtgcggc

SEQ ID NO: 332455 - DNA, 25 bp, Mus musculus
agacgcccagcgtgctccagttgca

SEQ ID NO: 332456 - DNA, 25 bp, Mus musculus
agcgtgctccagttgcagaaccata

SEQ ID NO: 332457 - DNA, 25 bp, Mus musculus
agttgcagaaccatagcagtccggc

SEQ ID NO: 332458 - DNA, 25 bp, Mus musculus
gaaccatagcagtccggcctccatt

SEQ ID NO: 332459 - DNA, 25 bp, Mus musculus
ggcctccattctgcaatctcggacg

SEQ ID NO: 332460 - DNA, 25 bp, Mus musculus
ctgcaatctcggacgtgccgggcca

SEQ ID NO: 332461 - DNA, 25 bp, Mus musculus
ttcaggatcttataggtgagaaccg

SEQ ID NO: 332462 - DNA, 25 bp, Mus musculus
gagaaccggaggctcaaagtccaaa

SEQ ID NO: 332463 - DNA, 25 bp, Mus musculus
gagcgttaggatccggccgccatat

SEQ ID NO: 332464 - DNA, 25 bp, Mus musculus
gagccaccgtgtgagcgctcagagc

SEQ ID NO: 332465 - DNA, 25 bp, Mus musculus
gccgacggccaatgtcttgagattt

SEQ ID NO: 332466 - DNA, 25 bp, Mus musculus
cttgagatttcagatgcgatccgac

SEQ ID NO: 332467 - DNA, 25 bp, Mus musculus
tgcgatccgacaaacgaacgaacga

SEQ ID NO: 332468 - DNA, 25 bp, Mus musculus
atcctgaacgcggatgacgccgtca

SEQ ID NO: 332469 - DNA, 25 bp, Mus musculus
gccttctcccttccagaggtggctt

SEQ ID NO: 332470 - DNA, 25 bp, Mus musculus
tcggttcggtcgctacgcaacctct

SEQ ID NO: 332471 - DNA, 25 bp, Mus musculus
cagcgtccctctcgaacgcggttta

SEQ ID NO: 332472 - DNA, 25 bp, Mus musculus
gccatattgtattcctgtcgcctta

SEQ ID NO: 332473 - DNA, 25 bp, Mus musculus
tagcaaccgccagacccttaggagg

SEQ ID NO: 332474 - DNA, 25 bp, Mus musculus
cgttccggagacatgcgtatacgca

SEQ ID NO: 332475 - DNA, 25 bp, Mus musculus
cgcatgcgcaaaggagagggtttaa

SEQ ID NO: 332476 - DNA, 25 bp, Mus musculus
ggagactgtggtaccggccttctcc

SEQ ID NO: 332477 - DNA, 25 bp, Mus musculus
tcttgcccgagaaggagctagggac

SEQ ID NO: 332478 - DNA, 25 bp, Mus musculus
aaggcccggtgacactcagctcagc

SEQ ID NO: 332479 - DNA, 25 bp, Mus musculus
tcagccctgtccgtgcagacccggc

SEQ ID NO: 332480 - DNA, 25 bp, Mus musculus
acccggcgcagcatggtgtttgcaa

SEQ ID NO: 332481 - DNA, 25 bp, Mus musculus
cgcagcatggtgtttgcaaagcact

SEQ ID NO: 332482 - DNA, 25 bp, Mus musculus
tttgcaaagcacttgcgggctgtgg

SEQ ID NO: 332483 - DNA, 25 bp, Mus musculus
agacgagtttaggagccagcacctc

SEQ ID NO: 332484 - DNA, 25 bp, Mus musculus
gtttaggagccagcacctcaactcg

SEQ ID NO: 332485 - DNA, 25 bp, Mus musculus
agccagcacctcaactcgacggatg

SEQ ID NO: 332486 - DNA, 25 bp, Mus musculus
ctcaactcgacggatgccgctgata

SEQ ID NO: 332487 - DNA, 25 bp, Mus musculus
acggatgccgctgataagatggccc

SEQ ID NO: 332488 - DNA, 25 bp, Mus musculus
agactggacgaagatgaaggtagcc

SEQ ID NO: 332489 - DNA, 25 bp, Mus musculus
acgaagatgaaggtagccgcgctgc

SEQ ID NO: 332490 - DNA, 25 bp, Mus musculus
gctcaaccgtcccaaggcccggtga

SEQ ID NO: 332491 - DNA, 25 bp, Mus musculus
attcaccgcataaatacccggggtg

SEQ ID NO: 332492 - DNA, 25 bp, Mus musculus
actcgcagcgtttgctgaggtcggc

SEQ ID NO: 332493 - DNA, 25 bp, Mus musculus
ccggggtgtttaaacagattgcacg

SEQ ID NO: 332494 - DNA, 25 bp, Mus musculus
gggagaggattcaccgcataaatac

SEQ ID NO: 332495 - DNA, 25 bp, Mus musculus
tgcggccctttggagtgcacgacgt

SEQ ID NO: 332496 - DNA, 25 bp, Mus musculus
ccctagcgttccctcttagtcattg

SEQ ID NO: 332497 - DNA, 25 bp, Mus musculus
ccatcccttgggaaagtgggctcga

SEQ ID NO: 332498 - DNA, 25 bp, Mus musculus
agcgggttctgacccatcccttggg

SEQ ID NO: 332499 - DNA, 25 bp, Mus musculus
ggcactaagcgggttctgacccatc

SEQ ID NO: 332500 - DNA, 25 bp, Mus musculus
tgagcctgggcactaagcgggttct

SEQ ID NO: 332501 - DNA, 25 bp, Mus musculus
tttaaacagattgcacgcagggacg

SEQ ID NO: 332502 - DNA, 25 bp, Mus musculus
ctcttagtcattgtgcctggccgcg

SEQ ID NO: 332503 - DNA, 25 bp, Mus musculus
aagtgggctcgaactcgcagcgttt

SEQ ID NO: 332504 - DNA, 25 bp, Mus musculus
tagtcattgtgcctggccgcgtcct

SEQ ID NO: 332505 - DNA, 25 bp, Mus musculus
ccgtattctaagtttgattcagcta

SEQ ID NO: 332506 - DNA, 25 bp, Mus musculus
ctcgctgcaaatattctcggagctc

SEQ ID NO: 332507 - DNA, 25 bp, Mus musculus
ttccctagttttctcgctgcaaata

SEQ ID NO: 332508 - DNA, 25 bp, Mus musculus
tgacaacagcgttagttccctagtt

SEQ ID NO: 332509 - DNA, 25 bp, Mus musculus
tgattcagctatgacaacagcgtta

SEQ ID NO: 332510 - DNA, 25 bp, Mus musculus
ctaaggtcctagcagctgctggtga

SEQ ID NO: 332511 - DNA, 25 bp, Mus musculus
attctcggagctctgaccggcaacg

SEQ ID NO: 332512 - DNA, 25 bp, Mus musculus
gctgctggtgactcgatgctgttaa

SEQ ID NO: 332513 - DNA, 25 bp, Mus musculus
gctttctgtctggatttccgtattc

SEQ ID NO: 332514 - DNA, 25 bp, Mus musculus
ttcaggtccgcaggaaggcagctaa

SEQ ID NO: 332515 - DNA, 25 bp, Mus musculus
atgctgttaagttcgcggtcgttct

SEQ ID NO: 332516 - DNA, 25 bp, Mus musculus
ccgcaggaaggcagctaaggtccta

SEQ ID NO: 332517 - DNA, 25 bp, Mus musculus
gactagcacggggttcaggtccgca

SEQ ID NO: 332518 - DNA, 25 bp, Mus musculus
tctggatttccgtattctaagtttg

SEQ ID NO: 332519 - DNA, 25 bp, Mus musculus
ggcggcagcaatttagtacaagccc

SEQ ID NO: 332520 - DNA, 25 bp, Mus musculus
ccgcgcctgctgacaccgcaggtga

SEQ ID NO: 332521 - DNA, 25 bp, Mus musculus
cggcgacagtggctcgactcttccc

SEQ ID NO: 332522 - DNA, 25 bp, Mus musculus
gggcacgcgtaggttccgccctcta

SEQ ID NO: 332523 - DNA, 25 bp, Mus musculus
atgttttggcctgccgggcacgcgt

SEQ ID NO: 332524 - DNA, 25 bp, Mus musculus
ccatggagatgttttggcctgccgg

SEQ ID NO: 332525 - DNA, 25 bp, Mus musculus
cccggagccatggagatgttttggc

SEQ ID NO: 332526 - DNA, 25 bp, Mus musculus
cggcggcggcagcaatttagtacaa

SEQ ID NO: 332527 - DNA, 25 bp, Mus musculus
tcgaaacattaacagagcggcggcg

SEQ ID NO: 332528 - DNA, 25 bp, Mus musculus
gtgacacttggggatcgaaacatta

SEQ ID NO: 332529 - DNA, 25 bp, Mus musculus
catcagcatggagcgagtgacactt

SEQ ID NO: 332530 - DNA, 25 bp, Mus musculus
atccgatccgggacatcagcatgga

SEQ ID NO: 332531 - DNA, 25 bp, Mus musculus
acctccactgaggatccgatccggg

SEQ ID NO: 332532 - DNA, 25 bp, Mus musculus
tcgggaactccgaagacctccactg

SEQ ID NO: 332533 - DNA, 25 bp, Mus musculus
cgtaatgaacaaggctcccggcagc

SEQ ID NO: 332534 - DNA, 25 bp, Mus musculus
tgagaagacccaaaaacccgcctgc

SEQ ID NO: 332535 - DNA, 25 bp, Mus musculus
agtcactgctactctctgaggccta

SEQ ID NO: 332536 - DNA, 25 bp, Mus musculus
gttgcctaggcaacaggctcccagc

SEQ ID NO: 332537 - DNA, 25 bp, Mus musculus
ctccaatgtgctcagggatgctctg

SEQ ID NO: 332538 - DNA, 25 bp, Mus musculus
acccgcctgcgaactgaggaagtga

SEQ ID NO: 332539 - DNA, 25 bp, Mus musculus
tgacccatgcgacacgaaccgacag

SEQ ID NO: 332540 - DNA, 25 bp, Mus musculus
cggcggcccacaggtagattcctga

SEQ ID NO: 332541 - DNA, 25 bp, Mus musculus
ccacaactagggaaacacagcactg

SEQ ID NO: 332542 - DNA, 25 bp, Mus musculus
ctcagacgacactcacaccgtaatg

SEQ ID NO: 332543 - DNA, 25 bp, Mus musculus
gcacgtcaggcttggctccaatgtg

SEQ ID NO: 332544 - DNA, 25 bp, Mus musculus
ccgtcttactgaatgccggagttta

SEQ ID NO: 332545 - DNA, 25 bp, Mus musculus
ttattacacactgcaagctccacgg

SEQ ID NO: 332546 - DNA, 25 bp, Mus musculus
acacttgtggctctgccgctctagc

SEQ ID NO: 332547 - DNA, 25 bp, Mus musculus
tatgtcctcgagtagccaaactggc

SEQ ID NO: 332548 - DNA, 25 bp, Mus musculus
ctagcaggtagtgtgcataggcttg

SEQ ID NO: 332549 - DNA, 25 bp, Mus musculus
tgcgagctcacaggccacatgcagc

SEQ ID NO: 332550 - DNA, 25 bp, Mus musculus
ttccactgggaagtcctgcaccgtt

SEQ ID NO: 332551 - DNA, 25 bp, Mus musculus
tgcaccgttcgcaggatgcgccgca

SEQ ID NO: 332552 - DNA, 25 bp, Mus musculus
atgcccacgcggttgtagcgcaccg

SEQ ID NO: 332553 - DNA, 25 bp, Mus musculus
cacaccgcgggaaggtagctagcag

SEQ ID NO: 332554 - DNA, 25 bp, Mus musculus
gcacaagcgcatagagcagagcctc

SEQ ID NO: 332555 - DNA, 25 bp, Mus musculus
gcttcgctggcacgtatgtcctcga

SEQ ID NO: 332556 - DNA, 25 bp, Mus musculus
ccaaactggcagctgatctcgcact

SEQ ID NO: 332557 - DNA, 25 bp, Mus musculus
atctcgcactgccaggtagaaggcg

SEQ ID NO: 332558 - DNA, 25 bp, Mus musculus
gatgacttccggcactgcttctgca

SEQ ID NO: 332559 - DNA, 25 bp, Mus musculus
gcataggcttggtggtcgtgcacaa

SEQ ID NO: 332560 - DNA, 25 bp, Mus musculus
cccgctcatcacagtggaaggcttc

SEQ ID NO: 332561 - DNA, 25 bp, Mus musculus
tcggggcaggcgactcaccaagccg

SEQ ID NO: 332562 - DNA, 25 bp, Mus musculus
tcacggccgcggctctgtgactgga

SEQ ID NO: 332563 - DNA, 25 bp, Mus musculus
ctctcagagggacccgcggaaaact

SEQ ID NO: 332564 - DNA, 25 bp, Mus musculus
accaagccgcgcgaccctgtccctg

SEQ ID NO: 332565 - DNA, 25 bp, Mus musculus
cgccgtccatgcacgggcgagcaga

SEQ ID NO: 332566 - DNA, 25 bp, Mus musculus
ggcgagcagacagagatcccacgac

SEQ ID NO: 332567 - DNA, 25 bp, Mus musculus
acagagatcccacgacgccgggagc

SEQ ID NO: 332568 - DNA, 25 bp, Mus musculus
ggcagcgcccgctgcactctgagcc

SEQ ID NO: 332569 - DNA, 25 bp, Mus musculus
cacgtcactgggcagagtcacggcc

SEQ ID NO: 332570 - DNA, 25 bp, Mus musculus
cgcgacaccgtctcccgatgccggt

SEQ ID NO: 332571 - DNA, 25 bp, Mus musculus
ccgccattggctcacgccgccggcc

SEQ ID NO: 332572 - DNA, 25 bp, Mus musculus
gctacccattggtcgtcgcgctgca

SEQ ID NO: 332573 - DNA, 25 bp, Mus musculus
tcgtcgcgctgcaccattgttgcgt

SEQ ID NO: 332574 - DNA, 25 bp, Mus musculus
caccattgttgcgtcacgggccagg

SEQ ID NO: 332575 - DNA, 25 bp, Mus musculus
gggagctccatcgtctccaggcaca

SEQ ID NO: 332576 - DNA, 25 bp, Mus musculus
cattcaaactgtggcgcgtactcct

SEQ ID NO: 332577 - DNA, 25 bp, Mus musculus
gaacccattcaaactgtggcgcgta

SEQ ID NO: 332578 - DNA, 25 bp, Mus musculus
ccctctttgtatagaacccattcaa

SEQ ID NO: 332579 - DNA, 25 bp, Mus musculus
gggcgcaattagtttcttccaatta

SEQ ID NO: 332580 - DNA, 25 bp, Mus musculus
ttgctctagtacatctcgatcgccc

SEQ ID NO: 332581 - DNA, 25 bp, Mus musculus
gttcaggctcttagccctgcgggct

SEQ ID NO: 332582 - DNA, 25 bp, Mus musculus
aggcacaaccgctttccttccctcg

SEQ ID NO: 332583 - DNA, 25 bp, Mus musculus
ccaacccaattagcggggagctcca

SEQ ID NO: 332584 - DNA, 25 bp, Mus musculus
gtcgatctatgtccctcctgctgtc

SEQ ID NO: 332585 - DNA, 25 bp, Mus musculus
tggggactcaagctccttctttttc

SEQ ID NO: 332586 - DNA, 25 bp, Mus musculus
cctcttctaccgagctggggactca

SEQ ID NO: 332587 - DNA, 25 bp, Mus musculus
tgtggcgcgtactcctccgcgcgag

SEQ ID NO: 332588 - DNA, 25 bp, Mus musculus
ggttcccttgctctagtacatctcg

SEQ ID NO: 332589 - DNA, 25 bp, Mus musculus
catgcgggtgggaccccagtaccaa

SEQ ID NO: 332590 - DNA, 25 bp, Mus musculus
taccaagcggcggtgcccgacttcg

SEQ ID NO: 332591 - DNA, 25 bp, Mus musculus
cccgacttcgatcctggtgagtagc

SEQ ID NO: 332592 - DNA, 25 bp, Mus musculus
tcgatcctggtgagtagcgagtgac

SEQ ID NO: 332593 - DNA, 25 bp, Mus musculus
ctttgttttttgtgcgtgttggcct

SEQ ID NO: 332594 - DNA, 25 bp, Mus musculus
ttttgtgcgtgttggccttcggtcc

SEQ ID NO: 332595 - DNA, 25 bp, Mus musculus
ctcgcacacgagtgtgctgcagatt

SEQ ID NO: 332596 - DNA, 25 bp, Mus musculus
tgagaaagccacacctggccggggt

SEQ ID NO: 332597 - DNA, 25 bp, Mus musculus
gtggagtgggatgtctctgcctcca

SEQ ID NO: 332598 - DNA, 25 bp, Mus musculus
tctctgcctccaggtgtggtgtacc

SEQ ID NO: 332599 - DNA, 25 bp, Mus musculus
tgtaccggagctaggacgggatccc

SEQ ID NO: 332600 - DNA, 25 bp, Mus musculus
gcgcggcacgctcgcacacgagtgt

SEQ ID NO: 332601 - DNA, 25 bp, Mus musculus
cctccaggtgtggtgtaccggagct

SEQ ID NO: 332602 - DNA, 25 bp, Mus musculus
ccggctctgagaaagccacacctgg

SEQ ID NO: 332603 - DNA, 25 bp, Mus musculus
ggaaactttgtgtgtgcggccagct

SEQ ID NO: 332604 - DNA, 25 bp, Mus musculus
gtgcccgcatagatgagcgtgctcg

SEQ ID NO: 332605 - DNA, 25 bp, Mus musculus
acagggtgcccgcatagatgagcgt

SEQ ID NO: 332606 - DNA, 25 bp, Mus musculus
agccgtcagcatctccgaggcccgg

SEQ ID NO: 332607 - DNA, 25 bp, Mus musculus
gtgccgagccgtcagcatctccgag

SEQ ID NO: 332608 - DNA, 25 bp, Mus musculus
aactttgtgtgtgcggccagctccg

SEQ ID NO: 332609 - DNA, 25 bp, Mus musculus
actttggaaactttgtgtgtgcggc

SEQ ID NO: 332610 - DNA, 25 bp, Mus musculus
ccgcctcaccgtctgcggtgcggcc

SEQ ID NO: 332611 - DNA, 25 bp, Mus musculus
cgggtccttcgctgccaggcccggc

SEQ ID NO: 332612 - DNA, 25 bp, Mus musculus
agcccagcagggactttccagccgg

SEQ ID NO: 332613 - DNA, 25 bp, Mus musculus
gttgcagcccagcagggactttcca

SEQ ID NO: 332614 - DNA, 25 bp, Mus musculus
ttccagcgcgcgagaggaagtgcca

SEQ ID NO: 332615 - DNA, 25 bp, Mus musculus
cagcagggactttccagccggcggc

SEQ ID NO: 332616 - DNA, 25 bp, Mus musculus
caggcaggcctcgagccctgggtgc

SEQ ID NO: 332617 - DNA, 25 bp, Mus musculus
tcccggtcaaagtagaattcgcgct

SEQ ID NO: 332618 - DNA, 25 bp, Mus musculus
cgcagggcatgaagactccggcttc

SEQ ID NO: 332619 - DNA, 25 bp, Mus musculus
gtcgtccaagatgagctgcaccctg

SEQ ID NO: 332620 - DNA, 25 bp, Mus musculus
tgacacacttgaacgcgtctgggtc

SEQ ID NO: 332621 - DNA, 25 bp, Mus musculus
tccggcttctctaggaacttccaga

SEQ ID NO: 332622 - DNA, 25 bp, Mus musculus
gcccggatcgtaatcgtcgcacaga

SEQ ID NO: 332623 - DNA, 25 bp, Mus musculus
ttgatgagctctgccaaccgggtct

SEQ ID NO: 332624 - DNA, 25 bp, Mus musculus
aggtctccgtagagcacctgccgca

SEQ ID NO: 332625 - DNA, 25 bp, Mus musculus
tctcaatgtcttcgcctgccacgga

SEQ ID NO: 332626 - DNA, 25 bp, Mus musculus
gctttgctcagcagatgcgtccatg

SEQ ID NO: 332627 - DNA, 25 bp, Mus musculus
cttggttcttctcgtaggcagcgtc

SEQ ID NO: 332628 - DNA, 25 bp, Mus musculus
tccgggctgtatagagagctaactt

SEQ ID NO: 332629 - DNA, 25 bp, Mus musculus
gggcaaatgcccttcttcatgtgga

SEQ ID NO: 332630 - DNA, 25 bp, Mus musculus
cgcgcttctcgctcagatggctctt

SEQ ID NO: 332631 - DNA, 25 bp, Mus musculus
ctgcgagggttagcggttagaacca

SEQ ID NO: 332632 - DNA, 25 bp, Mus musculus
gcgggcacaacctcctgtccgagag

SEQ ID NO: 332633 - DNA, 25 bp, Mus musculus
cagcgcagcgcatccaagaggaccg

SEQ ID NO: 332634 - DNA, 25 bp, Mus musculus
gcgcttacataaacgcggccgcccg

SEQ ID NO: 332635 - DNA, 25 bp, Mus musculus
ctccaggagcggacgagccgtcctg

SEQ ID NO: 332636 - DNA, 25 bp, Mus musculus
cccggagccgacgtccggactcgct

SEQ ID NO: 332637 - DNA, 25 bp, Mus musculus
aaaacaggtcgtgcgtcgctaggga

SEQ ID NO: 332638 - DNA, 25 bp, Mus musculus
tcgtgcgtcgctagggagactcgaa

SEQ ID NO: 332639 - DNA, 25 bp, Mus musculus
agactcgaagcggaagggagcctcc

SEQ ID NO: 332640 - DNA, 25 bp, Mus musculus
gagcctccgacacgcaccgagaaga

SEQ ID NO: 332641 - DNA, 25 bp, Mus musculus
acacgcaccgagaagatcgacgggg

SEQ ID NO: 332642 - DNA, 25 bp, Mus musculus
ttctcgaactcgcgggcaggagcct

SEQ ID NO: 332643 - DNA, 25 bp, Mus musculus
gccgccttacctccgctcacgctgc

SEQ ID NO: 332644 - DNA, 25 bp, Mus musculus
ggcacaacctcctgtccgagaggcg

SEQ ID NO: 332645 - DNA, 25 bp, Mus musculus
agacagtcacgccatctcggatatg

SEQ ID NO: 332646 - DNA, 25 bp, Mus musculus
agagctctttcctaagggccgattc

SEQ ID NO: 332647 - DNA, 25 bp, Mus musculus
ccgggcagtcagagtgctgtgaata

SEQ ID NO: 332648 - DNA, 25 bp, Mus musculus
gctgtgaatagagacgacgttccga

SEQ ID NO: 332649 - DNA, 25 bp, Mus musculus
cgcgggttctgtagatcagctaaga

SEQ ID NO: 332650 - DNA, 25 bp, Mus musculus
cgcgcctctttggaaagtcgccttc

SEQ ID NO: 332651 - DNA, 25 bp, Mus musculus
tgtcggtcctggtacgagacagtca

SEQ ID NO: 332652 - DNA, 25 bp, Mus musculus
acaatcgggacagggtcgccaactc

SEQ ID NO: 332653 - DNA, 25 bp, Mus musculus
gcgcctcctctgtgcacaatcggga

SEQ ID NO: 332654 - DNA, 25 bp, Mus musculus
agaaaccgcagcctattcccgtgga

SEQ ID NO: 332655 - DNA, 25 bp, Mus musculus
ctcaatttcccggtcctctggcgtg

SEQ ID NO: 332656 - DNA, 25 bp, Mus musculus
ggtttctctaggaagggtcgcgatc

SEQ ID NO: 332657 - DNA, 25 bp, Mus musculus
ttctttagcaatgactcgggccgcc

SEQ ID NO: 332658 - DNA, 25 bp, Mus musculus
cgaagtccgcatctgtgagagcctc

SEQ ID NO: 332659 - DNA, 25 bp, Mus musculus
ctactgcctcaaggacaatgctgtg

SEQ ID NO: 332660 - DNA, 25 bp, Mus musculus
cctgaagcaggtaaggaagccacac

SEQ ID NO: 332661 - DNA, 25 bp, Mus musculus
caatgctgtgacctctgcggtgagc

SEQ ID NO: 332662 - DNA, 25 bp, Mus musculus
cgtgacgttaacctgtcctcctgtc

SEQ ID NO: 332663 - DNA, 25 bp, Mus musculus
cccaggagctatcgtgtcgttgacc

SEQ ID NO: 332664 - DNA, 25 bp, Mus musculus
cgcccacaccgagatccaggtggtg

SEQ ID NO: 332665 - DNA, 25 bp, Mus musculus
ggctgctggacctcttcctgaagca

SEQ ID NO: 332666 - DNA, 25 bp, Mus musculus
taccgtcccgcttggtcggatgaca

SEQ ID NO: 332667 - DNA, 25 bp, Mus musculus
tcggatgacagagtccggaccaacc

SEQ ID NO: 332668 - DNA, 25 bp, Mus musculus
cgacgaggacctgactgctttcctg

SEQ ID NO: 332669 - DNA, 25 bp, Mus musculus
aacccggtgcacgttcgcagcgtct

SEQ ID NO: 332670 - DNA, 25 bp, Mus musculus
cgatggatctttccgcgtggcgctt

SEQ ID NO: 332671 - DNA, 25 bp, Mus musculus
gggtcccaagcttgcaccgacgcgt

SEQ ID NO: 332672 - DNA, 25 bp, Mus musculus
cacatttgacctggagcggtaccga

SEQ ID NO: 332673 - DNA, 25 bp, Mus musculus
cttcttgcagtcagcagcgcggacg

SEQ ID NO: 332674 - DNA, 25 bp, Mus musculus
tgcacatggtggttccggccacaca

SEQ ID NO: 332675 - DNA, 25 bp, Mus musculus
cagctcgatctggtacaccttcttg

SEQ ID NO: 332676 - DNA, 25 bp, Mus musculus
gccacacaggaggatggcgatcttc

SEQ ID NO: 332677 - DNA, 25 bp, Mus musculus
tctgctccgtcgaaggaggaccagg

SEQ ID NO: 332678 - DNA, 25 bp, Mus musculus
aagttgctcgcttctgctccgtcga

SEQ ID NO: 332679 - DNA, 25 bp, Mus musculus
tccgggagcttgatgtcaaagttgc

SEQ ID NO: 332680 - DNA, 25 bp, Mus musculus
gcagccctttgtttccgggagcttg

SEQ ID NO: 332681 - DNA, 25 bp, Mus musculus
tgtcgctatgagctggcagcccttt

SEQ ID NO: 332682 - DNA, 25 bp, Mus musculus
acaaacaggcaggtggacgagctct

SEQ ID NO: 332683 - DNA, 25 bp, Mus musculus
gcttcacagcgacaaacaggcaggt

SEQ ID NO: 332684 - DNA, 25 bp, Mus musculus
agcaaaggattagtcgcttcacagc

SEQ ID NO: 332685 - DNA, 25 bp, Mus musculus
tcctcagcgtccctgtcgctatgag

SEQ ID NO: 332686 - DNA, 25 bp, Mus musculus
gcgatcttctccttgggcgccagct

SEQ ID NO: 332687 - DNA, 25 bp, Mus musculus
gacttttctaacttgtctttcagca

SEQ ID NO: 332688 - DNA, 25 bp, Mus musculus
atctcctgctgatgttccgacgcgg

SEQ ID NO: 332689 - DNA, 25 bp, Mus musculus
gactttcttctcgagctccgacctg

SEQ ID NO: 332690 - DNA, 25 bp, Mus musculus
gctcctcctcgtagaacaagacttt

SEQ ID NO: 332691 - DNA, 25 bp, Mus musculus
ttacttctagcacgtgggaggcctc

SEQ ID NO: 332692 - DNA, 25 bp, Mus musculus
ttcttcacgttctttacttctagca

SEQ ID NO: 332693 - DNA, 25 bp, Mus musculus
tcggagtcgtggacttccttcttca

SEQ ID NO: 332694 - DNA, 25 bp, Mus musculus
gccaactggtggctttcggagtcgt

SEQ ID NO: 332695 - DNA, 25 bp, Mus musculus
gtctttcagcatcaggacctctttc

SEQ ID NO: 332696 - DNA, 25 bp, Mus musculus
ggctgctgttttcacctgggcatca

SEQ ID NO: 332697 - DNA, 25 bp, Mus musculus
ccgacctgattttggagatctcctg

SEQ ID NO: 332698 - DNA, 25 bp, Mus musculus
gggcatcacatgcttaccgttctcg

SEQ ID NO: 332699 - DNA, 25 bp, Mus musculus
taccgttctcgctttgacttttcta

SEQ ID NO: 332700 - DNA, 25 bp, Mus musculus
gacctctttctgcagggccaactgg

SEQ ID NO: 332701 - DNA, 25 bp, Mus musculus
tctccacgctcagggcgctatcgtt

SEQ ID NO: 332702 - DNA, 25 bp, Mus musculus
tctgagctgtgaaccgacagtgctc

SEQ ID NO: 332703 - DNA, 25 bp, Mus musculus
ggtttcggttgagctcgtctgagct

SEQ ID NO: 332704 - DNA, 25 bp, Mus musculus
cccgggtcattactgctgggtttcg

SEQ ID NO: 332705 - DNA, 25 bp, Mus musculus
gttcggctctgttcccgatcctcgg

SEQ ID NO: 332706 - DNA, 25 bp, Mus musculus
gccctgggtcccatagttcggctct

SEQ ID NO: 332707 - DNA, 25 bp, Mus musculus
ggtacccagtgcgaaaccgagattg

SEQ ID NO: 332708 - DNA, 25 bp, Mus musculus
ctaggccgacatcttgggctccgtc

SEQ ID NO: 332709 - DNA, 25 bp, Mus musculus
gtccagtagccgcacagtccttgtc

SEQ ID NO: 332710 - DNA, 25 bp, Mus musculus
ttcttgagccgcaccttggccgaca

SEQ ID NO: 332711 - DNA, 25 bp, Mus musculus
gccacatacttgtcgcggcgcagcg

SEQ ID NO: 332712 - DNA, 25 bp, Mus musculus
tggctgcactcggtgtaaaggcaca

SEQ ID NO: 332713 - DNA, 25 bp, Mus musculus
taaaggcacaccagcacgtccagca

SEQ ID NO: 332714 - DNA, 25 bp, Mus musculus
acagtgctctgggtcccagtgcgca

SEQ ID NO: 332715 - DNA, 25 bp, Mus musculus
tagcccagcttctggctgagctcgg

SEQ ID NO: 332716 - DNA, 25 bp, Mus musculus
agcaggcaggcgcaaaagtcatccc

SEQ ID NO: 332717 - DNA, 25 bp, Mus musculus
cccgccactggcgtatgcattggga

SEQ ID NO: 332718 - DNA, 25 bp, Mus musculus
ggccgagggtgatttcttgagtaca

SEQ ID NO: 332719 - DNA, 25 bp, Mus musculus
tcgagacgctctagcggaactggcc

SEQ ID NO: 332720 - DNA, 25 bp, Mus musculus
tgtctacattacgacggaatggctg

SEQ ID NO: 332721 - DNA, 25 bp, Mus musculus
ccacgacctgcagaaggtgcgctta

SEQ ID NO: 332722 - DNA, 25 bp, Mus musculus
agctggtagccgacaaaacttcccg

SEQ ID NO: 332723 - DNA, 25 bp, Mus musculus
ggcgcgctatggacctttgtctaca

SEQ ID NO: 332724 - DNA, 25 bp, Mus musculus
acgaagccaccgacttcccagtgtg

SEQ ID NO: 332725 - DNA, 25 bp, Mus musculus
ttcccagtgtgggagacctacttgc

SEQ ID NO: 332726 - DNA, 25 bp, Mus musculus
ctgtggcccagcgtctacaggagct

SEQ ID NO: 332727 - DNA, 25 bp, Mus musculus
tgcgcttagagatgcagcccgctta

SEQ ID NO: 332728 - DNA, 25 bp, Mus musculus
tacttgcgtgccttccacagcgctg

SEQ ID NO: 332729 - DNA, 25 bp, Mus musculus
tgcgctctgtctctttgtgcccagg

SEQ ID NO: 332730 - DNA, 25 bp, Mus musculus
gtacctgggtgcttacattaacgcc

SEQ ID NO: 332731 - DNA, 25 bp, Mus musculus
tcgaaggcagtgagcgaatggtacc

SEQ ID NO: 332732 - DNA, 25 bp, Mus musculus
aaaggcttttctggcgtcgaaggca

SEQ ID NO: 332733 - DNA, 25 bp, Mus musculus
cctgaagtcagagaaatgatttttt

SEQ ID NO: 332734 - DNA, 25 bp, Mus musculus
tcatcacggtgacgacctaacgggg

SEQ ID NO: 332735 - DNA, 25 bp, Mus musculus
tggactgagtgtgaggccctcatca

SEQ ID NO: 332736 - DNA, 25 bp, Mus musculus
tgtccaggacggatacccgagaatg

SEQ ID NO: 332737 - DNA, 25 bp, Mus musculus
acgggtggcattctctgtccaggac

SEQ ID NO: 332738 - DNA, 25 bp, Mus musculus
ctttgtgcccaggtacgggtggcat

SEQ ID NO: 332739 - DNA, 25 bp, Mus musculus
agctccaggacgttgccgaacactg

SEQ ID NO: 332740 - DNA, 25 bp, Mus musculus
tggaggccactaccctgcagatctg

SEQ ID NO: 332741 - DNA, 25 bp, Mus musculus
acgttgccgaacactgccagcagga

SEQ ID NO: 332742 - DNA, 25 bp, Mus musculus
tacattaacgcctgcgtggagctga

SEQ ID NO: 332743 - DNA, 25 bp, Mus musculus
ctttagcaaagtgagtgcaggcgtg

SEQ ID NO: 332744 - DNA, 25 bp, Mus musculus
aagagcgagcttgtcagggccgaga

SEQ ID NO: 332745 - DNA, 25 bp, Mus musculus
gggccgagagaactgtggcttagtc

SEQ ID NO: 332746 - DNA, 25 bp, Mus musculus
cttagtcgggaagcgaaccgcgacg

SEQ ID NO: 332747 - DNA, 25 bp, Mus musculus
aagcgaaccgcgacggacccgtgtg

SEQ ID NO: 332748 - DNA, 25 bp, Mus musculus
aaccgcgacggacccgtgtgcgcat

SEQ ID NO: 332749 - DNA, 25 bp, Mus musculus
cccgtgtgcgcatgcccgcgaggaa

SEQ ID NO: 332750 - DNA, 25 bp, Mus musculus
cacagggaccgcaggcaagaggacc

SEQ ID NO: 332751 - DNA, 25 bp, Mus musculus
ggaccgcaggcaagaggaccatccc

SEQ ID NO: 332752 - DNA, 25 bp, Mus musculus
tccctcgtgttctccaccatctgtg

SEQ ID NO: 332753 - DNA, 25 bp, Mus musculus
ccaccatctgtggacggcgtggctc

SEQ ID NO: 332754 - DNA, 25 bp, Mus musculus
ctgtggacggcgtggctccactctc

SEQ ID NO: 332755 - DNA, 25 bp, Mus musculus
cgcgcctttagcaaagtgagtgcag

SEQ ID NO: 332756 - DNA, 25 bp, Mus musculus
ctgtggcttagtcgggaagcgaacc

SEQ ID NO: 332757 - DNA, 25 bp, Mus musculus
tcagagaccgtggtgcgacaacagc

SEQ ID NO: 332758 - DNA, 25 bp, Mus musculus
tgctagggacttacaggcgttactc

SEQ ID NO: 332759 - DNA, 25 bp, Mus musculus
cacagagtgtcggacaggattcgcc

SEQ ID NO: 332760 - DNA, 25 bp, Mus musculus
tacgtagcttcccttccagtcctga

SEQ ID NO: 332761 - DNA, 25 bp, Mus musculus
cagtaagtgacctctgccgctgtgc

SEQ ID NO: 332762 - DNA, 25 bp, Mus musculus
actaaggcgtcctgtcctggacaca

SEQ ID NO: 332763 - DNA, 25 bp, Mus musculus
ttgacctccagcatacgcactgcta

SEQ ID NO: 332764 - DNA, 25 bp, Mus musculus
gcggagcctgcgactattttaggag

SEQ ID NO: 332765 - DNA, 25 bp, Mus musculus
ctctttccaggctattgggaacagc

SEQ ID NO: 332766 - DNA, 25 bp, Mus musculus
tgcacgcacatcaagaccactcttt

SEQ ID NO: 332767 - DNA, 25 bp, Mus musculus
ggcgggatatttcgaggtcccttga

SEQ ID NO: 332768 - DNA, 25 bp, Mus musculus
cgacaacagctctccgctaagcgga

SEQ ID NO: 332769 - DNA, 25 bp, Mus musculus
ctgctaggtagccaatcagagaccg

SEQ ID NO: 332770 - DNA, 25 bp, Mus musculus
gaactcgtggctccctgtgcacgca

SEQ ID NO: 332771 - DNA, 25 bp, Mus musculus
tggagaggctgaagccgctgttccc

SEQ ID NO: 332772 - DNA, 25 bp, Mus musculus
taccacttcgccagccacctgtgcg

SEQ ID NO: 332773 - DNA, 25 bp, Mus musculus
acgccgaaagctaccactaccactt

SEQ ID NO: 332774 - DNA, 25 bp, Mus musculus
tcgtgcgcacctacgccgaaagcta

SEQ ID NO: 332775 - DNA, 25 bp, Mus musculus
cccgacgagttcaacgtcgtgcgca

SEQ ID NO: 332776 - DNA, 25 bp, Mus musculus
gtcgcaccatgaaggaggacctgga

SEQ ID NO: 332777 - DNA, 25 bp, Mus musculus
gttcctgcacatgggtcgcaccatg

SEQ ID NO: 332778 - DNA, 25 bp, Mus musculus
agcaggttcctgcacatgggtcgca

SEQ ID NO: 332779 - DNA, 25 bp, Mus musculus
aggcggagagcaggttcctgcacat

SEQ ID NO: 332780 - DNA, 25 bp, Mus musculus
tgctgctttgcgaccaggtgctcgg

SEQ ID NO: 332781 - DNA, 25 bp, Mus musculus
aggctctgtacgtgctgctttgcga

SEQ ID NO: 332782 - DNA, 25 bp, Mus musculus
tgtacgtgctgctttgcgaccaggt

SEQ ID NO: 332783 - DNA, 25 bp, Mus musculus
agttcaacgtcgtgcgcacctacgc

SEQ ID NO: 332784 - DNA, 25 bp, Mus musculus
cagcggaacgtctggacgcgcagcc

SEQ ID NO: 332785 - DNA, 25 bp, Mus musculus
aggcgcacgcaggagttttccctct

SEQ ID NO: 332786 - DNA, 25 bp, Mus musculus
cagtcgtgcgtgctggaagccagaa

SEQ ID NO: 332787 - DNA, 25 bp, Mus musculus
aagctggaatagtcaccgcgcgcac

SEQ ID NO: 332788 - DNA, 25 bp, Mus musculus
aaaacagtccaaacgctagcctggg

SEQ ID NO: 332789 - DNA, 25 bp, Mus musculus
tttccctctgcaggaatgacccgaa

SEQ ID NO: 332790 - DNA, 25 bp, Mus musculus
ggaagggcgactccacaactttgtg

SEQ ID NO: 332791 - DNA, 25 bp, Mus musculus
ccacaactttgtgcgcgagagctgc

SEQ ID NO: 332792 - DNA, 25 bp, Mus musculus
tgtgcgcgagagctgctcgccgctc

SEQ ID NO: 332793 - DNA, 25 bp, Mus musculus
ggggctcgcgtctcccagcacgaat

SEQ ID NO: 332794 - DNA, 25 bp, Mus musculus
gctcccagaacgtggcgcttcgggt

SEQ ID NO: 332795 - DNA, 25 bp, Mus musculus
tggcgcttcgggtcacctgaccgcg

SEQ ID NO: 332796 - DNA, 25 bp, Mus musculus
ggtcaatcagcgctagccctaggcg

SEQ ID NO: 332797 - DNA, 25 bp, Mus musculus
gcgcggtgcgagaatcccggaacca

SEQ ID NO: 332798 - DNA, 25 bp, Mus musculus
agaatcccggaaccagtcgtgcgtg

SEQ ID NO: 332799 - DNA, 25 bp, Mus musculus
ccgctttcaattggccacgcacatg

SEQ ID NO: 332800 - DNA, 25 bp, Mus musculus
agagaccaatgaaaggcggccacgg

SEQ ID NO: 332801 - DNA, 25 bp, Mus musculus
tgagcgaagtccacagagaccaatg

SEQ ID NO: 332802 - DNA, 25 bp, Mus musculus
cgcacatgagcgaagtccacagaga

SEQ ID NO: 332803 - DNA, 25 bp, Mus musculus
ttggccacgcacatgagcgaagtcc

SEQ ID NO: 332804 - DNA, 25 bp, Mus musculus
gaagccggtcggaggcagcctgaag

SEQ ID NO: 332805 - DNA, 25 bp, Mus musculus
tttcaattggccacgcacatgagcg

SEQ ID NO: 332806 - DNA, 25 bp, Mus musculus
atggctcgcctggtgctcggtaagc

SEQ ID NO: 332807 - DNA, 25 bp, Mus musculus
tccacagagaccaatgaaaggcggc

SEQ ID NO: 332808 - DNA, 25 bp, Mus musculus
ggagaggccaggtcgggcccactac

SEQ ID NO: 332809 - DNA, 25 bp, Mus musculus
cggccacggcgtggcgagcccttcc

SEQ ID NO: 332810 - DNA, 25 bp, Mus musculus
gcgcaccgcccgctagaagccgagg

SEQ ID NO: 332811 - DNA, 25 bp, Mus musculus
cacggacagaatgcgggtgatcggc

SEQ ID NO: 332812 - DNA, 25 bp, Mus musculus
tgatcggcatggctcgcctggtgct

SEQ ID NO: 332813 - DNA, 25 bp, Mus musculus
tgtagagcaccacgaagccgtcgct

SEQ ID NO: 332814 - DNA, 25 bp, Mus musculus
agccaatgaacctctcggcgggcca

SEQ ID NO: 332815 - DNA, 25 bp, Mus musculus
gcctcgtcgcacacgctgtagagca

SEQ ID NO: 332816 - DNA, 25 bp, Mus musculus
atctaggtcggccttggtgcccacc

SEQ ID NO: 332817 - DNA, 25 bp, Mus musculus
agaacctggcgctcggcatctaggt

SEQ ID NO: 332818 - DNA, 25 bp, Mus musculus
tgatttccaggaacgggcaacgcca

SEQ ID NO: 332819 - DNA, 25 bp, Mus musculus
accgtggcgcgctagccaatgaacc

SEQ ID NO: 332820 - DNA, 25 bp, Mus musculus
ctgcgtgaacacgtggtccaccatc

SEQ ID NO: 332821 - DNA, 25 bp, Mus musculus
aagccgtcgctgttcctgatgtaca

SEQ ID NO: 332822 - DNA, 25 bp, Mus musculus
ggggcgcagcactaagccctccatg

SEQ ID NO: 332823 - DNA, 25 bp, Mus musculus
cgttttgctcttggtcgtgatttcc

SEQ ID NO: 332824 - DNA, 25 bp, Mus musculus
gtgtccacgatttccagcagcgcgg

SEQ ID NO: 332825 - DNA, 25 bp, Mus musculus
cggttcacctcgatcaccttgctga

SEQ ID NO: 332826 - DNA, 25 bp, Mus musculus
tctttgagggtgaccagatgctcgg

SEQ ID NO: 332827 - DNA, 25 bp, Mus musculus
agcgagaacattccagaggtgagtc

SEQ ID NO: 332828 - DNA, 25 bp, Mus musculus
cgtggcccacagagaagcaccgtgg

SEQ ID NO: 332829 - DNA, 25 bp, Mus musculus
aagcaccgtggacatagccggcccg

SEQ ID NO: 332830 - DNA, 25 bp, Mus musculus
aggcgccatagtgcctgaacgcata

SEQ ID NO: 332831 - DNA, 25 bp, Mus musculus
cgcataaactcagagcgagccgggc

SEQ ID NO: 332832 - DNA, 25 bp, Mus musculus
gctatcgcgagaccgcgaaggcctc

SEQ ID NO: 332833 - DNA, 25 bp, Mus musculus
agatcgacgtgcatgcgagccaatg

SEQ ID NO: 332834 - DNA, 25 bp, Mus musculus
tgcgagccaatgacaagagaagttg

SEQ ID NO: 332835 - DNA, 25 bp, Mus musculus
ttatttgacgaaaacggtgagtcgc

SEQ ID NO: 332836 - DNA, 25 bp, Mus musculus
cggcgttgttcagtcagagcgagaa

SEQ ID NO: 332837 - DNA, 25 bp, Mus musculus
gagccgcgttgggtttatgtcttta

SEQ ID NO: 332838 - DNA, 25 bp, Mus musculus
tgtgactcagggaggccgcacctct

SEQ ID NO: 332839 - DNA, 25 bp, Mus musculus
cgggctgcgaccgtcgcgtagccat

SEQ ID NO: 332840 - DNA, 25 bp, Mus musculus
cctgcggccaataagcggtggctgc

SEQ ID NO: 332841 - DNA, 25 bp, Mus musculus
ggccagtgcgcggttgaacacaact

SEQ ID NO: 332842 - DNA, 25 bp, Mus musculus
gcgcggccatcttgagtctgtaagg

SEQ ID NO: 332843 - DNA, 25 bp, Mus musculus
ttgagtctgtaaggctcctgaggtg

SEQ ID NO: 332844 - DNA, 25 bp, Mus musculus
gggccaggccggagatctagactcc

SEQ ID NO: 332845 - DNA, 25 bp, Mus musculus
cgccttggcgttgtgcggaatcaaa

SEQ ID NO: 332846 - DNA, 25 bp, Mus musculus
aaagcgcaataagatgtccactagg

SEQ ID NO: 332847 - DNA, 25 bp, Mus musculus
ttgccaacggtgaatgaacgagaca

SEQ ID NO: 332848 - DNA, 25 bp, Mus musculus
tgaaaacgtgagtggactgcgctgc

SEQ ID NO: 332849 - DNA, 25 bp, Mus musculus
cccagatgctccaggcaggggtcaa

SEQ ID NO: 332850 - DNA, 25 bp, Mus musculus
tgagcattacccgtccgtgcgctgc

SEQ ID NO: 332851 - DNA, 25 bp, Mus musculus
tcctcttaacgtcgggcagggtctg

SEQ ID NO: 332852 - DNA, 25 bp, Mus musculus
gccagtcagacctaggtgcagatta

SEQ ID NO: 332853 - DNA, 25 bp, Mus musculus
tccgaccgcgctgattggcggaact

SEQ ID NO: 332854 - DNA, 25 bp, Mus musculus
ctgtccttacggtcggctgagcatt

SEQ ID NO: 332855 - DNA, 25 bp, Mus musculus
actgccagctttcaaggacagggtg

SEQ ID NO: 332856 - DNA, 25 bp, Mus musculus
ggcgaaggtgggtcttcgaccctca

SEQ ID NO: 332857 - DNA, 25 bp, Mus musculus
cgcgcagagaagagcgcagcagctc

SEQ ID NO: 332858 - DNA, 25 bp, Mus musculus
agcagctctggaggctgttacccga

SEQ ID NO: 332859 - DNA, 25 bp, Mus musculus
tgcgcactcgcgagctcagcacgta

SEQ ID NO: 332860 - DNA, 25 bp, Mus musculus
ccaggtcatcgccaccctgggaata

SEQ ID NO: 332861 - DNA, 25 bp, Mus musculus
ggggtgtgcatacccggattgtcta

SEQ ID NO: 332862 - DNA, 25 bp, Mus musculus
ccctgggaatacaaggtggtggcta

SEQ ID NO: 332863 - DNA, 25 bp, Mus musculus
tcaccgtcaggcaggagcaagccga

SEQ ID NO: 332864 - DNA, 25 bp, Mus musculus
gccgaggctcttaaggctaagcgcg

SEQ ID NO: 332865 - DNA, 25 bp, Mus musculus
ccagcccaccgaaggttcagggaag

SEQ ID NO: 332866 - DNA, 25 bp, Mus musculus
ttcagggaagagcagtgggatcctt

SEQ ID NO: 332867 - DNA, 25 bp, Mus musculus
gcctgacgctacaggggtgtgcata

SEQ ID NO: 332868 - DNA, 25 bp, Mus musculus
agcggggtcagaggagatttaaaca

SEQ ID NO: 332869 - DNA, 25 bp, Mus musculus
gagcaggggacttttatttcgcaca

SEQ ID NO: 332870 - DNA, 25 bp, Mus musculus
tatcccgcgggcagacacttcgtgc

SEQ ID NO: 332871 - DNA, 25 bp, Mus musculus
gccggtttatgctgcgtgagtttcc

SEQ ID NO: 332872 - DNA, 25 bp, Mus musculus
gcagccctaaaaggccgcgcgcgga

SEQ ID NO: 332873 - DNA, 25 bp, Mus musculus
agccctccgtggagactctgggcaa

SEQ ID NO: 332874 - DNA, 25 bp, Mus musculus
acttttatttcgcacagcgctcgga

SEQ ID NO: 332875 - DNA, 25 bp, Mus musculus
acagcgctcggatctcttaggcaac

SEQ ID NO: 332876 - DNA, 25 bp, Mus musculus
ctcttaggcaacgtgcaagcctgca

SEQ ID NO: 332877 - DNA, 25 bp, Mus musculus
gcctgcacagaagaacacagccgaa

SEQ ID NO: 332878 - DNA, 25 bp, Mus musculus
acagccgaagagacgccagccagaa

SEQ ID NO: 332879 - DNA, 25 bp, Mus musculus
aaaaggtcctctgggagcacgcaaa

SEQ ID NO: 332880 - DNA, 25 bp, Mus musculus
gccctgcgttggtttgacgtcatca

SEQ ID NO: 332881 - DNA, 25 bp, Mus musculus
acgtcatcaaaaagcaccggaagtg

SEQ ID NO: 332882 - DNA, 25 bp, Mus musculus
gcagacacttcgtgcaccgggcagc

SEQ ID NO: 332883 - DNA, 25 bp, Mus musculus
ttcccggctaggtctgacccgggca

SEQ ID NO: 332884 - DNA, 25 bp, Mus musculus
tacacttccgcagcgttgtcgccgt

SEQ ID NO: 332885 - DNA, 25 bp, Mus musculus
tccgtcccagggaatgcgcacggtc

SEQ ID NO: 332886 - DNA, 25 bp, Mus musculus
tcgggctttgcgacgccgccgtaac

SEQ ID NO: 332887 - DNA, 25 bp, Mus musculus
tgtcgcgatcctgccgtacgcgcgg

SEQ ID NO: 332888 - DNA, 25 bp, Mus musculus
ctttgcggcccggaagcagagcgct

SEQ ID NO: 332889 - DNA, 25 bp, Mus musculus
agcagagcgcttcgccggcttctct

SEQ ID NO: 332890 - DNA, 25 bp, Mus musculus
aagcccggccctcgcagagctttta

SEQ ID NO: 332891 - DNA, 25 bp, Mus musculus
ttaggttggcccgtgagcgccctac

SEQ ID NO: 332892 - DNA, 25 bp, Mus musculus
agcgccctacggatcacagggatgc

SEQ ID NO: 332893 - DNA, 25 bp, Mus musculus
gcctgacctcacaatgggcgcgcgg

SEQ ID NO: 332894 - DNA, 25 bp, Mus musculus
tggagagcgcgagccttgcttatcc

SEQ ID NO: 332895 - DNA, 25 bp, Mus musculus
ggactgatgatcactgcccgggatc

SEQ ID NO: 332896 - DNA, 25 bp, Mus musculus
ctgcacctctccgacggactgatga

SEQ ID NO: 332897 - DNA, 25 bp, Mus musculus
ttagagaggctcctggagagctccg

SEQ ID NO: 332898 - DNA, 25 bp, Mus musculus
gccgcctggcgatcttcccgtcctc

SEQ ID NO: 332899 - DNA, 25 bp, Mus musculus
cgtcctccacgggtggaggcgcggc

SEQ ID NO: 332900 - DNA, 25 bp, Mus musculus
agggaagcctcccggtctgaggcca

SEQ ID NO: 332901 - DNA, 25 bp, Mus musculus
ggtctgaggccaccacacacagatt

SEQ ID NO: 332902 - DNA, 25 bp, Mus musculus
tctgaggccaccacacacagattag

SEQ ID NO: 332903 - DNA, 25 bp, Mus musculus
gagcgagccgcagagggtgggtcct

SEQ ID NO: 332904 - DNA, 25 bp, Mus musculus
atgctgcggggcaaaaaaagtaggc

SEQ ID NO: 332905 - DNA, 25 bp, Mus musculus
cgacgccattttcggcggcggaggg

SEQ ID NO: 332906 - DNA, 25 bp, Mus musculus
cacacacagattagagaggctcctg

SEQ ID NO: 332907 - DNA, 25 bp, Mus musculus
gacgtcacggcgcacagcattgtgg

SEQ ID NO: 332908 - DNA, 25 bp, Mus musculus
cacagattagagaggctcctggaga

SEQ ID NO: 332909 - DNA, 25 bp, Mus musculus
cacacagattagagaggctcctgga

SEQ ID NO: 332910 - DNA, 25 bp, Mus musculus
cgccggcgacgccattttcggcggc

SEQ ID NO: 332911 - DNA, 25 bp, Mus musculus
ctgtctgcaccctggggttccctct

SEQ ID NO: 332912 - DNA, 25 bp, Mus musculus
tgaggcttctggacctttccgtcca

SEQ ID NO: 332913 - DNA, 25 bp, Mus musculus
acctttccgtccaccgccgcatctg

SEQ ID NO: 332914 - DNA, 25 bp, Mus musculus
gccgcatctgcacccggcccttcca

SEQ ID NO: 332915 - DNA, 25 bp, Mus musculus
cctcggcctgtgacagcgcgacgag

SEQ ID NO: 332916 - DNA, 25 bp, Mus musculus
ggcccttccaggctgcgattttgct

SEQ ID NO: 332917 - DNA, 25 bp, Mus musculus
tccaggctgcgattttgctcctccg

SEQ ID NO: 332918 - DNA, 25 bp, Mus musculus
cctggcctttccatccctgtctgca

SEQ ID NO: 332919 - DNA, 25 bp, Mus musculus
catcctccgggctgaggcttctgga

SEQ ID NO: 332920 - DNA, 25 bp, Mus musculus
gacgagcgcgactctcccgatcgga

SEQ ID NO: 332921 - DNA, 25 bp, Mus musculus
cgcgactctcccgatcggacggtga

SEQ ID NO: 332922 - DNA, 25 bp, Mus musculus
tgctccggtctcttgtcacctctgc

SEQ ID NO: 332923 - DNA, 25 bp, Mus musculus
tcacctctgcctgcgcgccagtagt

SEQ ID NO: 332924 - DNA, 25 bp, Mus musculus
ctctcccgatcggacggtgagtgcg

SEQ ID NO: 332925 - DNA, 25 bp, Mus musculus
ttcgacggctgtgccaggagaacca

SEQ ID NO: 332926 - DNA, 25 bp, Mus musculus
ggccacgcacgcctcgctctgctca

SEQ ID NO: 332927 - DNA, 25 bp, Mus musculus
ctcggtgagtgctcggccacgcacg

SEQ ID NO: 332928 - DNA, 25 bp, Mus musculus
aagaagtacgacgacgacatctccc

SEQ ID NO: 332929 - DNA, 25 bp, Mus musculus
gctgaagaagtacgacgacgacatc

SEQ ID NO: 332930 - DNA, 25 bp, Mus musculus
accagctgaagaagtacgacgacga

SEQ ID NO: 332931 - DNA, 25 bp, Mus musculus
agaagttgcagaagagcgagcagtc

SEQ ID NO: 332932 - DNA, 25 bp, Mus musculus
ctggagttcatgaaccagctgaaga

SEQ ID NO: 332933 - DNA, 25 bp, Mus musculus
agaaacacctggagttcatgaacca

SEQ ID NO: 332934 - DNA, 25 bp, Mus musculus
gagaagcaaaagctccgcgctcagg

SEQ ID NO: 332935 - DNA, 25 bp, Mus musculus
ggatgagctggccaacacgcagcag

SEQ ID NO: 332936 - DNA, 25 bp, Mus musculus
ctccgcgctcaggttcgacggctgt

SEQ ID NO: 332937 - DNA, 25 bp, Mus musculus
aaaagctccgcgctcaggttcgacg

SEQ ID NO: 332938 - DNA, 25 bp, Mus musculus
cacgcagcagaagttgcagaagagc

SEQ ID NO: 332939 - DNA, 25 bp, Mus musculus
gcaacgccgcctcactagtggaaga

SEQ ID NO: 332940 - DNA, 25 bp, Mus musculus
agtggaagagcctcccggaagtgct

SEQ ID NO: 332941 - DNA, 25 bp, Mus musculus
gtgctcccagacagccggaaataga

SEQ ID NO: 332942 - DNA, 25 bp, Mus musculus
tactcatgcgggtctctatgtgtgc

SEQ ID NO: 332943 - DNA, 25 bp, Mus musculus
tgcgcagttgcggtgcttacgtcgc

SEQ ID NO: 332944 - DNA, 25 bp, Mus musculus
catcttccctggaggtttccgcctg

SEQ ID NO: 332945 - DNA, 25 bp, Mus musculus
gcgctcccgctagcgcgttagacgt

SEQ ID NO: 332946 - DNA, 25 bp, Mus musculus
ctgcagccaagagccagggaagtaa

SEQ ID NO: 332947 - DNA, 25 bp, Mus musculus
agtaaaactattgaagcctcgggtg

SEQ ID NO: 332948 - DNA, 25 bp, Mus musculus
cgggtgcacgttacgccatgtttct

SEQ ID NO: 332949 - DNA, 25 bp, Mus musculus
gccatgtttctatcgcgcgcgtctg

SEQ ID NO: 332950 - DNA, 25 bp, Mus musculus
aggttcacgtcggttttactcatgc

SEQ ID NO: 332951 - DNA, 25 bp, Mus musculus
ctctatgtgtgcagcttggcgtttc

SEQ ID NO: 332952 - DNA, 25 bp, Mus musculus
aggtttccgcctgttagcaacgccg

SEQ ID NO: 332953 - DNA, 25 bp, Mus musculus
ggcgttttccattccttggcggtca

SEQ ID NO: 332954 - DNA, 25 bp, Mus musculus
cttccaatgagaggccagagtccga

SEQ ID NO: 332955 - DNA, 25 bp, Mus musculus
aggcgcctacgtggctgactaattg

SEQ ID NO: 332956 - DNA, 25 bp, Mus musculus
ttggccaatccgaagtcacactctc

SEQ ID NO: 332957 - DNA, 25 bp, Mus musculus
agctcgttcttgagtcccgacctgg

SEQ ID NO: 332958 - DNA, 25 bp, Mus musculus
gggcgctcgaaacccacagtgtcct

SEQ ID NO: 332959 - DNA, 25 bp, Mus musculus
tgttcggccactcgcgatcagctaa

SEQ ID NO: 332960 - DNA, 25 bp, Mus musculus
tcacactctccctagaggggcgagg

SEQ ID NO: 332961 - DNA, 25 bp, Mus musculus
ctccggtcttcaccgccgattggtg

SEQ ID NO: 332962 - DNA, 25 bp, Mus musculus
tggggcggatactactctccgattg

SEQ ID NO: 332963 - DNA, 25 bp, Mus musculus
ggttcatattacgagctctggctgc

SEQ ID NO: 332964 - DNA, 25 bp, Mus musculus
gccaagaagcttgtgcgctcgccaa

SEQ ID NO: 332965 - DNA, 25 bp, Mus musculus
cccagaagaaacgaagaggcgccta

SEQ ID NO: 332966 - DNA, 25 bp, Mus musculus
tccggacaaggaggtgcgtcctagc

SEQ ID NO: 332967 - DNA, 25 bp, Mus musculus
cctgatccttgtcgcagctcggctt

SEQ ID NO: 332968 - DNA, 25 bp, Mus musculus
cgccggtttcccatgttcccattga

SEQ ID NO: 332969 - DNA, 25 bp, Mus musculus
tcccattgagaaagtgcacacccgg

SEQ ID NO: 332970 - DNA, 25 bp, Mus musculus
agaaagtgcacacccggaccacgag

SEQ ID NO: 332971 - DNA, 25 bp, Mus musculus
cacggaagtacggattcgaccgagg

SEQ ID NO: 332972 - DNA, 25 bp, Mus musculus
attcgaccgagggaacgcgtgtcgc

SEQ ID NO: 332973 - DNA, 25 bp, Mus musculus
gctcggcttcgagtccttaccagga

SEQ ID NO: 332974 - DNA, 25 bp, Mus musculus
cccttgttcgttgcggcctcgacag

SEQ ID NO: 332975 - DNA, 25 bp, Mus musculus
tccttaccaggagcgacggaagact

SEQ ID NO: 332976 - DNA, 25 bp, Mus musculus
acggaagactgagctgtagaagaca

SEQ ID NO: 332977 - DNA, 25 bp, Mus musculus
cagcggcttctatggtccggtgcgc

SEQ ID NO: 332978 - DNA, 25 bp, Mus musculus
ttatcccagcgggaggggcaatcct

SEQ ID NO: 332979 - DNA, 25 bp, Mus musculus
tgatatttgcatacgggctgcccgc

SEQ ID NO: 332980 - DNA, 25 bp, Mus musculus
cctcccttgatgtccgtgtcggtgt

SEQ ID NO: 332981 - DNA, 25 bp, Mus musculus
gcatcagccgattgcataccgctca

SEQ ID NO: 332982 - DNA, 25 bp, Mus musculus
gcctacgccacctatgattggtccg

SEQ ID NO: 332983 - DNA, 25 bp, Mus musculus
ctcctcctgcataccagcaaagggg

SEQ ID NO: 332984 - DNA, 25 bp, Mus musculus
ccagggacctccgaaccttgtgtct

SEQ ID NO: 332985 - DNA, 25 bp, Mus musculus
ccttgtgtctgcgagacttcggctc

SEQ ID NO: 332986 - DNA, 25 bp, Mus musculus
ctcagggtcacctcggacgaatagg

SEQ ID NO: 332987 - DNA, 25 bp, Mus musculus
cccacagtcgcgaccggtggagact

SEQ ID NO: 332988 - DNA, 25 bp, Mus musculus
ggtggagactcgaacctctcaggtc

SEQ ID NO: 332989 - DNA, 25 bp, Mus musculus
gcgagctggccacagaccaactctg

SEQ ID NO: 332990 - DNA, 25 bp, Mus musculus
ctgaccgtaacatataccctaggtg

SEQ ID NO: 332991 - DNA, 25 bp, Mus musculus
accctaggtgtccagcgctatgcga

SEQ ID NO: 332992 - DNA, 25 bp, Mus musculus
tatgcgaggctacaggccggatcct

SEQ ID NO: 332993 - DNA, 25 bp, Mus musculus
gccggatcctatcaggcgggcacag

SEQ ID NO: 332994 - DNA, 25 bp, Mus musculus
cccgatgtgtctgcatcagccgatt

SEQ ID NO: 332995 - DNA, 25 bp, Mus musculus
actctctccgtcacagtcgcgggga

SEQ ID NO: 332996 - DNA, 25 bp, Mus musculus
gcaaaaagcccaggttccgctctta

SEQ ID NO: 332997 - DNA, 25 bp, Mus musculus
gcgtgatggagtcccggacactctt

SEQ ID NO: 332998 - DNA, 25 bp, Mus musculus
tctggatgactcagccgggcactct

SEQ ID NO: 332999 - DNA, 25 bp, Mus musculus
ttctgctacagaatgggaaaggtca

SEQ ID NO: 333000 - DNA, 25 bp, Mus musculus
accctccctgtagtaggcggcgcag

SEQ ID NO: 333001 - DNA, 25 bp, Mus musculus
gtatcgcagagtccttcgcccgcga

SEQ ID NO: 333002 - DNA, 25 bp, Mus musculus
aaaggtcacagagcacgcaggcgcc

SEQ ID NO: 333003 - DNA, 25 bp, Mus musculus
ccacaggcaacaccaaattctgcta

SEQ ID NO: 333004 - DNA, 25 bp, Mus musculus
tccgcgggaccaagaccacaggcaa

SEQ ID NO: 333005 - DNA, 25 bp, Mus musculus
ggttgggaacacagcaaaaagccca

SEQ ID NO: 333006 - DNA, 25 bp, Mus musculus
gtcagcgtgtatcgcagagtccttc

SEQ ID NO: 333007 - DNA, 25 bp, Mus musculus
tgacccaaggtcagcgtgtatcgca

SEQ ID NO: 333008 - DNA, 25 bp, Mus musculus
tggtcgcccgggtgttacaagcttc

SEQ ID NO: 333009 - DNA, 25 bp, Mus musculus
cccgacggccaaggtcggcttgaga

SEQ ID NO: 333010 - DNA, 25 bp, Mus musculus
cagaacttctgtgtgcaggcgcgcc

SEQ ID NO: 333011 - DNA, 25 bp, Mus musculus
cggggcgacctagacgcataaaagg

SEQ ID NO: 333012 - DNA, 25 bp, Mus musculus
cccggatcgccgagactcgtgcagt

SEQ ID NO: 333013 - DNA, 25 bp, Mus musculus
ggtccagtggttcttgacagttcaa

SEQ ID NO: 333014 - DNA, 25 bp, Mus musculus
gagctccgggctgtgcagaacttct

SEQ ID NO: 333015 - DNA, 25 bp, Mus musculus
tgggaagcagaaactcgccgcagcc

SEQ ID NO: 333016 - DNA, 25 bp, Mus musculus
tgcaaagccggctctcgggcttcca

SEQ ID NO: 333017 - DNA, 25 bp, Mus musculus
cccttggcgagcattgcaaagccgg

SEQ ID NO: 333018 - DNA, 25 bp, Mus musculus
ctctttgaagagagtccgcggtgcg

SEQ ID NO: 333019 - DNA, 25 bp, Mus musculus
cctcccacggagttctctttgaaga

SEQ ID NO: 333020 - DNA, 25 bp, Mus musculus
tggaaaaaccggtcaggccagcgcg

SEQ ID NO: 333021 - DNA, 25 bp, Mus musculus
tcaacagttctgtagcacaattgtg

SEQ ID NO: 333022 - DNA, 25 bp, Mus musculus
tgtttaggaccactagacccggcgc

SEQ ID NO: 333023 - DNA, 25 bp, Mus musculus
ctgtgcgatcttgggcaaaagcttc

SEQ ID NO: 333024 - DNA, 25 bp, Mus musculus
ctgcaaggacacttcgagacagttc

SEQ ID NO: 333025 - DNA, 25 bp, Mus musculus
tctcagcctcaagcggaaagctctg

SEQ ID NO: 333026 - DNA, 25 bp, Mus musculus
tccattttaaggcacaggcgcggct

SEQ ID NO: 333027 - DNA, 25 bp, Mus musculus
gcggctcagtgtgcaatccatttta

SEQ ID NO: 333028 - DNA, 25 bp, Mus musculus
cgggtcggagacaaacaggcaatta

SEQ ID NO: 333029 - DNA, 25 bp, Mus musculus
ctgacttgggcgagagcaacaactg

SEQ ID NO: 333030 - DNA, 25 bp, Mus musculus
tccgaccagggtctttccttgaatc

SEQ ID NO: 333031 - DNA, 25 bp, Mus musculus
ataccgtgcgaaggtctgactgctc

SEQ ID NO: 333032 - DNA, 25 bp, Mus musculus
cgtttgacagaccttataccgtgcg

SEQ ID NO: 333033 - DNA, 25 bp, Mus musculus
ggagcccgttcccagtttattcatg

SEQ ID NO: 333034 - DNA, 25 bp, Mus musculus
gcctgtcttcccttcgcaaggctga

SEQ ID NO: 333035 - DNA, 25 bp, Mus musculus
ctatctggggtttcgggttgatcca

SEQ ID NO: 333036 - DNA, 25 bp, Mus musculus
agttttcccgctcgcaaagtgatga

SEQ ID NO: 333037 - DNA, 25 bp, Mus musculus
cttctggcgggaattgacagtggcc

SEQ ID NO: 333038 - DNA, 25 bp, Mus musculus
agacaggtcagtgtggggaggacca

SEQ ID NO: 333039 - DNA, 25 bp, Mus musculus
tgcgggactcctgagacaggtcagt

SEQ ID NO: 333040 - DNA, 25 bp, Mus musculus
agtcacgtgcgggactcctgagaca

SEQ ID NO: 333041 - DNA, 25 bp, Mus musculus
gagccgagtcacgtgcgggactcct

SEQ ID NO: 333042 - DNA, 25 bp, Mus musculus
acggagccgtgttgtcatggcagct

SEQ ID NO: 333043 - DNA, 25 bp, Mus musculus
ccacaccaccgctgctgtgcgctcg

SEQ ID NO: 333044 - DNA, 25 bp, Mus musculus
tggcaatgtccaggctctctgcttc

SEQ ID NO: 333045 - DNA, 25 bp, Mus musculus
ctctctgcttctggcgggaattgac

SEQ ID NO: 333046 - DNA, 25 bp, Mus musculus
ccaggctctctgcttctggcgggaa

SEQ ID NO: 333047 - DNA, 25 bp, Mus musculus
ggacggcttcttttggcaatgtcca

SEQ ID NO: 333048 - DNA, 25 bp, Mus musculus
gctttgggacggcttcttttggcaa

SEQ ID NO: 333049 - DNA, 25 bp, Mus musculus
ctgtgcgctcgctttgggacggctt

SEQ ID NO: 333050 - DNA, 25 bp, Mus musculus
cgggaattgacagtggccgtcctga

SEQ ID NO: 333051 - DNA, 25 bp, Mus musculus
gggccctcaagccactgaagacacg

SEQ ID NO: 333052 - DNA, 25 bp, Mus musculus
gtggcttcaggcagccttcaggaca

SEQ ID NO: 333053 - DNA, 25 bp, Mus musculus
ctcacagctccagaaccagaacgag

SEQ ID NO: 333054 - DNA, 25 bp, Mus musculus
ccgtggaagtgtgcggccacgacca

SEQ ID NO: 333055 - DNA, 25 bp, Mus musculus
ctccatccgcgtgtctgccgtggaa

SEQ ID NO: 333056 - DNA, 25 bp, Mus musculus
tcaggacacccaatctccgggcgtg

SEQ ID NO: 333057 - DNA, 25 bp, Mus musculus
caatctccgggcgtgtacctccggg

SEQ ID NO: 333058 - DNA, 25 bp, Mus musculus
ggacacaggtgcagcaacgcctcca

SEQ ID NO: 333059 - DNA, 25 bp, Mus musculus
agacacgtccgtggcttctgctttc

SEQ ID NO: 333060 - DNA, 25 bp, Mus musculus
gacctgcttgccgaggtggcttcag

SEQ ID NO: 333061 - DNA, 25 bp, Mus musculus
agaaccagaacgagctgcgtgcacc

SEQ ID NO: 333062 - DNA, 25 bp, Mus musculus
tgcgtgcacccacagcagagaaggc

SEQ ID NO: 333063 - DNA, 25 bp, Mus musculus
agaaggcggccttctacctggacgc

SEQ ID NO: 333064 - DNA, 25 bp, Mus musculus
ccacgaccagagtctgcgggacctg

SEQ ID NO: 333065 - DNA, 25 bp, Mus musculus
cgacacggtcatctatgtgggtccc

SEQ ID NO: 333066 - DNA, 25 bp, Mus musculus
agtacgttcgccgagctgcaggagc

SEQ ID NO: 333067 - DNA, 25 bp, Mus musculus
cccgattactcatccagcagtgagc

SEQ ID NO: 333068 - DNA, 25 bp, Mus musculus
tcatctatgtgggtcccggtgggat

SEQ ID NO: 333069 - DNA, 25 bp, Mus musculus
agcagtcctgcgacacggtcatcta

SEQ ID NO: 333070 - DNA, 25 bp, Mus musculus
aacgagggcccacctgacttcgtgc

SEQ ID NO: 333071 - DNA, 25 bp, Mus musculus
acttccgctgcagtacgttcgccga

SEQ ID NO: 333072 - DNA, 25 bp, Mus musculus
gacgctgaccacttccgctgcagta

SEQ ID NO: 333073 - DNA, 25 bp, Mus musculus
tcccggtgggatggcactgtcagac

SEQ ID NO: 333074 - DNA, 25 bp, Mus musculus
tggcctgtccggagaccccgattac

SEQ ID NO: 333075 - DNA, 25 bp, Mus musculus
ggcactgtcagaccgtgagctcacg

SEQ ID NO: 333076 - DNA, 25 bp, Mus musculus
ccgctctgagccgacgcaggccctc

SEQ ID NO: 333077 - DNA, 25 bp, Mus musculus
tgagctcacggacaacgagggccca

SEQ ID NO: 333078 - DNA, 25 bp, Mus musculus
ctcatccagcagtgagcagtcctgc

SEQ ID NO: 333079 - DNA, 25 bp, Mus musculus
tacgagagcatgattcgggacagcg

SEQ ID NO: 333080 - DNA, 25 bp, Mus musculus
acagcggtgtgaacctggctgaaga

SEQ ID NO: 333081 - DNA, 25 bp, Mus musculus
agcagtggctacgagagcatgattc

SEQ ID NO: 333082 - DNA, 25 bp, Mus musculus
ttctaccacagtggcggcagcagtg

SEQ ID NO: 333083 - DNA, 25 bp, Mus musculus
acaacagcagcgtgctgagcggcga

SEQ ID NO: 333084 - DNA, 25 bp, Mus musculus
ccttacagcaaagtgaccgctccga

SEQ ID NO: 333085 - DNA, 25 bp, Mus musculus
ctcggacagcggcaacgacagcggt

SEQ ID NO: 333086 - DNA, 25 bp, Mus musculus
gcggcaacgacagcggtgtgaacct

SEQ ID NO: 333087 - DNA, 25 bp, Mus musculus
tgaagagcggcagccctcgagccct

SEQ ID NO: 333088 - DNA, 25 bp, Mus musculus
cgcactgctcttttctaccacagtg

SEQ ID NO: 333089 - DNA, 25 bp, Mus musculus
caaagtgaccgctccgaggagaccc

SEQ ID NO: 333090 - DNA, 25 bp, Mus musculus
cccagcgctacagcagtggccatgg

SEQ ID NO: 333091 - DNA, 25 bp, Mus musculus
agcagtggccatggcagtgacaaca

SEQ ID NO: 333092 - DNA, 25 bp, Mus musculus
ccatggcagtgacaacagcagcgtg

SEQ ID NO: 333093 - DNA, 25 bp, Mus musculus
gtggacacaagtcgcccacattctg

SEQ ID NO: 333094 - DNA, 25 bp, Mus musculus
tgaggcctgcatcaggttcccttcc

SEQ ID NO: 333095 - DNA, 25 bp, Mus musculus
gcggtcgctccctctgcttcagcgc

SEQ ID NO: 333096 - DNA, 25 bp, Mus musculus
ctccgcctcgagcaacgggagctcc

SEQ ID NO: 333097 - DNA, 25 bp, Mus musculus
gcccacattctgaggcctgcatcag

SEQ ID NO: 333098 - DNA, 25 bp, Mus musculus
cgttcacttttacgtggccattctc

SEQ ID NO: 333099 - DNA, 25 bp, Mus musculus
ggcgctgccgttggcttgcagctcc

SEQ ID NO: 333100 - DNA, 25 bp, Mus musculus
gtggccgcggcagcctcatcctttt

SEQ ID NO: 333101 - DNA, 25 bp, Mus musculus
ggacttcttgaaggaaaagcgcttc

SEQ ID NO: 333102 - DNA, 25 bp, Mus musculus
gccgctcagcttgaaggacttcttg

SEQ ID NO: 333103 - DNA, 25 bp, Mus musculus
cttcttgaaggagaagccgctcagc

SEQ ID NO: 333104 - DNA, 25 bp, Mus musculus
ccgactccttcttgctcttcttgaa

SEQ ID NO: 333105 - DNA, 25 bp, Mus musculus
gctgcggctgcagcctcgtccttgg

SEQ ID NO: 333106 - DNA, 25 bp, Mus musculus
ccggggagtggacacaagtcgccca

SEQ ID NO: 333107 - DNA, 25 bp, Mus musculus
tgctgttgcttctgtccggagcctc

SEQ ID NO: 333108 - DNA, 25 bp, Mus musculus
gaagttaacgtcgtgccctgaggca

SEQ ID NO: 333109 - DNA, 25 bp, Mus musculus
ccctgaggcacgaaagactcggcta

SEQ ID NO: 333110 - DNA, 25 bp, Mus musculus
tcacgccctcccttgaagctgggta

SEQ ID NO: 333111 - DNA, 25 bp, Mus musculus
agactcggctagtcggaaccgacgc

SEQ ID NO: 333112 - DNA, 25 bp, Mus musculus
acgccgcactgggtgatgctcctcg

SEQ ID NO: 333113 - DNA, 25 bp, Mus musculus
gctaaccttgggctgacgccgcact

SEQ ID NO: 333114 - DNA, 25 bp, Mus musculus
accatggcgcctgctaaccttgggc

SEQ ID NO: 333115 - DNA, 25 bp, Mus musculus
tggaaacatcctagctcggcgttgg

SEQ ID NO: 333116 - DNA, 25 bp, Mus musculus
gcggagcgcttactgtggaaacatc

SEQ ID NO: 333117 - DNA, 25 bp, Mus musculus
aagctccgcccgtctggctagctta

SEQ ID NO: 333118 - DNA, 25 bp, Mus musculus
cgcaggcgtgctaagcctcagctgc

SEQ ID NO: 333119 - DNA, 25 bp, Mus musculus
tgctctgacgctccggttattgctc

SEQ ID NO: 333120 - DNA, 25 bp, Mus musculus
cagcctctgctggaagttaacgtcg

SEQ ID NO: 333121 - DNA, 25 bp, Mus musculus
tcaggttggcactcagccacatacc

SEQ ID NO: 333122 - DNA, 25 bp, Mus musculus
agccacataccctcggtaaagagta

SEQ ID NO: 333123 - DNA, 25 bp, Mus musculus
ctcggtaaagagtaggcagcggcca

SEQ ID NO: 333124 - DNA, 25 bp, Mus musculus
aagtcgtggccgttctcggacaatg

SEQ ID NO: 333125 - DNA, 25 bp, Mus musculus
ggacaatggcaccaccaccacgaag

SEQ ID NO: 333126 - DNA, 25 bp, Mus musculus
ggccagaaagtaacagacgcactgc

SEQ ID NO: 333127 - DNA, 25 bp, Mus musculus
cgcactgcgcgaagaggaaattgtt

SEQ ID NO: 333128 - DNA, 25 bp, Mus musculus
attgttgagcgccatggtggtgcca

SEQ ID NO: 333129 - DNA, 25 bp, Mus musculus
ctgcatcgtcaggttggcactcagc

SEQ ID NO: 333130 - DNA, 25 bp, Mus musculus
gcgcctgcggtcagtaccgcggaca

SEQ ID NO: 333131 - DNA, 25 bp, Mus musculus
accggacagggacgcgatcgctcca

SEQ ID NO: 333132 - DNA, 25 bp, Mus musculus
gatcgctccagaagccgggccgcga

SEQ ID NO: 333133 - DNA, 25 bp, Mus musculus
gtgcgccatgcgtgcgcagcagcca

SEQ ID NO: 333134 - DNA, 25 bp, Mus musculus
cgttgcgcgcagacgcgtgcgcaca

SEQ ID NO: 333135 - DNA, 25 bp, Mus musculus
cttcgggctagcctggaacgcagag

SEQ ID NO: 333136 - DNA, 25 bp, Mus musculus
cggttagactgtgcggaaagcagcc

SEQ ID NO: 333137 - DNA, 25 bp, Mus musculus
tagactgtgcggaaagcagccgcga

SEQ ID NO: 333138 - DNA, 25 bp, Mus musculus
cgccgggacacagcactctgcacca

SEQ ID NO: 333139 - DNA, 25 bp, Mus musculus
taagtccgcggcttcgggctagcct

SEQ ID NO: 333140 - DNA, 25 bp, Mus musculus
gctagcctggaacgcagagggaaac

SEQ ID NO: 333141 - DNA, 25 bp, Mus musculus
agcctggaacgcagagggaaaccga

SEQ ID NO: 333142 - DNA, 25 bp, Mus musculus
ctggaacgcagagggaaaccgagtc

SEQ ID NO: 333143 - DNA, 25 bp, Mus musculus
cggactgccgcgtgtgcaccaaggt

SEQ ID NO: 333144 - DNA, 25 bp, Mus musculus
cgcgtgtgcaccaaggtggccaaga

SEQ ID NO: 333145 - DNA, 25 bp, Mus musculus
tgtgcaccaaggtggccaagaacct

SEQ ID NO: 333146 - DNA, 25 bp, Mus musculus
caagaacctggtcccgcgctcttgg

SEQ ID NO: 333147 - DNA, 25 bp, Mus musculus
tcccgcgctcttggccctcgactac

SEQ ID NO: 333148 - DNA, 25 bp, Mus musculus
tctgcaccatctctcggctgtaccc

SEQ ID NO: 333149 - DNA, 25 bp, Mus musculus
cctcgggtttggatgctagggtatt

SEQ ID NO: 333150 - DNA, 25 bp, Mus musculus
tctcttcccgaggtgagttctcgcc

SEQ ID NO: 333151 - DNA, 25 bp, Mus musculus
tgcggcaagtctcttcccgaggtga

SEQ ID NO: 333152 - DNA, 25 bp, Mus musculus
tcagctgcggcaagtctcttcccga

SEQ ID NO: 333153 - DNA, 25 bp, Mus musculus
tgaagatttacagcctcagctgcgg

SEQ ID NO: 333154 - DNA, 25 bp, Mus musculus
ccagcctcaacgaagtgaagattta

SEQ ID NO: 333155 - DNA, 25 bp, Mus musculus
tgcaggtctccagcctcaacgaagt

SEQ ID NO: 333156 - DNA, 25 bp, Mus musculus
ctgcgatgcaggtctccagcctcaa

SEQ ID NO: 333157 - DNA, 25 bp, Mus musculus
cgttctgtgactgcgtgccgggctc

SEQ ID NO: 333158 - DNA, 25 bp, Mus musculus
cacgttgtgccggttcgcctcgggt

SEQ ID NO: 333159 - DNA, 25 bp, Mus musculus
cagttcccgcacgttgtgccggttc

SEQ ID NO: 333160 - DNA, 25 bp, Mus musculus
ggcagcctagtgagcgcgcacttcc

SEQ ID NO: 333161 - DNA, 25 bp, Mus musculus
ttgccgcctctagtgcctccgccct

SEQ ID NO: 333162 - DNA, 25 bp, Mus musculus
ctgctccgcgctgcgatgcaggtct

SEQ ID NO: 333163 - DNA, 25 bp, Mus musculus
ctgtgcatccggctgctgcagatgc

SEQ ID NO: 333164 - DNA, 25 bp, Mus musculus
cggcgctgaaggagaagctggggcc

SEQ ID NO: 333165 - DNA, 25 bp, Mus musculus
agctggggccgcaggactcagaccc

SEQ ID NO: 333166 - DNA, 25 bp, Mus musculus
agagcgccgagcctgagctgtgcat

SEQ ID NO: 333167 - DNA, 25 bp, Mus musculus
ccgagcctgagctgtgcatccggct

SEQ ID NO: 333168 - DNA, 25 bp, Mus musculus
agcctgagctgtgcatccggctgct

SEQ ID NO: 333169 - DNA, 25 bp, Mus musculus
atccggctgctgcagatgccctcgg

SEQ ID NO: 333170 - DNA, 25 bp, Mus musculus
agatgccctcggtggtcaactactc

SEQ ID NO: 333171 - DNA, 25 bp, Mus musculus
tgccctcggtggtcaactactcggg

SEQ ID NO: 333172 - DNA, 25 bp, Mus musculus
tggtcaactactcgggcctgcgcaa

SEQ ID NO: 333173 - DNA, 25 bp, Mus musculus
gcgcaagcgcctggagagcagcgat

SEQ ID NO: 333174 - DNA, 25 bp, Mus musculus
atggcggctggatggtgcagttcct

SEQ ID NO: 333175 - DNA, 25 bp, Mus musculus
ctcaacgcaagtgggcggcgctgaa

SEQ ID NO: 333176 - DNA, 25 bp, Mus musculus
ctgcagatgccctcggtggtcaact

SEQ ID NO: 333177 - DNA, 25 bp, Mus musculus
ccgcatttaatggagcgagagctct

SEQ ID NO: 333178 - DNA, 25 bp, Mus musculus
tgctggccacggacgccgacatcgt

SEQ ID NO: 333179 - DNA, 25 bp, Mus musculus
acaggctcccgcgtgaccgtggtgc

SEQ ID NO: 333180 - DNA, 25 bp, Mus musculus
ctaagccagcatgtccgggacccga

SEQ ID NO: 333181 - DNA, 25 bp, Mus musculus
gagcagcagaggagctaagccagca

SEQ ID NO: 333182 - DNA, 25 bp, Mus musculus
gagtccctccctaacctgcccagcg

SEQ ID NO: 333183 - DNA, 25 bp, Mus musculus
ccgacatcgtcagtcgctgccaggt

SEQ ID NO: 333184 - DNA, 25 bp, Mus musculus
cgtgtcggggcgtctagcaccctaa

SEQ ID NO: 333185 - DNA, 25 bp, Mus musculus
tctaggcgtccgcatttaatggagc

SEQ ID NO: 333186 - DNA, 25 bp, Mus musculus
tctcgcttggcccagagcagcagag

SEQ ID NO: 333187 - DNA, 25 bp, Mus musculus
accgaggtgcgtcaccgcgtgcgca

SEQ ID NO: 333188 - DNA, 25 bp, Mus musculus
cgcaggtcaccgaggtgcgtcaccg

SEQ ID NO: 333189 - DNA, 25 bp, Mus musculus
tgcgcgccatctgcagcgacagcgg

SEQ ID NO: 333190 - DNA, 25 bp, Mus musculus
tagcaccctaagtgcgcgccatctg

SEQ ID NO: 333191 - DNA, 25 bp, Mus musculus
ccggcctatcctgagctgtgacata

SEQ ID NO: 333192 - DNA, 25 bp, Mus musculus
tgagccctcgcaagtggcctttgta

SEQ ID NO: 333193 - DNA, 25 bp, Mus musculus
gatggcgtagactgccctgagccct

SEQ ID NO: 333194 - DNA, 25 bp, Mus musculus
aatccgagtcggacccgagtgctgc

SEQ ID NO: 333195 - DNA, 25 bp, Mus musculus
ggcggctcccggagaaatccgagtc

SEQ ID NO: 333196 - DNA, 25 bp, Mus musculus
cagtgtaccgtagcttggcgcagtt

SEQ ID NO: 333197 - DNA, 25 bp, Mus musculus
tccctcgccgttaactgcgtaagtc

SEQ ID NO: 333198 - DNA, 25 bp, Mus musculus
ggatgttgctgagcattgccttgca

SEQ ID NO: 333199 - DNA, 25 bp, Mus musculus
ccctcgatctcgtgctggtttatgc

SEQ ID NO: 333200 - DNA, 25 bp, Mus musculus
agccttcaggcttttcgcgcgctga

SEQ ID NO: 333201 - DNA, 25 bp, Mus musculus
ttgccttgcagtgatggctttctgg

SEQ ID NO: 333202 - DNA, 25 bp, Mus musculus
ttggcgcagtttgcggccgtataac

SEQ ID NO: 333203 - DNA, 25 bp, Mus musculus
cgtataactttgagcggtgccgctg

SEQ ID NO: 333204 - DNA, 25 bp, Mus musculus
cgctactcacgcgaggtcttcggtg

SEQ ID NO: 333205 - DNA, 25 bp, Mus musculus
gtccgctccgctggtcccggactcg

SEQ ID NO: 333206 - DNA, 25 bp, Mus musculus
tgccggccacaggacgctgctcggt

SEQ ID NO: 333207 - DNA, 25 bp, Mus musculus
tcctaccctcgctggccgagtgccc

SEQ ID NO: 333208 - DNA, 25 bp, Mus musculus
aggccgcggggcgagcctttctcct

SEQ ID NO: 333209 - DNA, 25 bp, Mus musculus
gagcctttctcctaccctcgctggc

SEQ ID NO: 333210 - DNA, 25 bp, Mus musculus
cccaaggtcacgcagcggccgcccg

SEQ ID NO: 333211 - DNA, 25 bp, Mus musculus
cgcccgcaccctcgccggcgtgggc

SEQ ID NO: 333212 - DNA, 25 bp, Mus musculus
cgtgggcctcctgcgcgaccagccc

SEQ ID NO: 333213 - DNA, 25 bp, Mus musculus
acttcctgctcctactccgaggcgc

SEQ ID NO: 333214 - DNA, 25 bp, Mus musculus
cgtggagcggccacccaaggtcacg

SEQ ID NO: 333215 - DNA, 25 bp, Mus musculus
ccgcccgccgactcggtgctgccgc

SEQ ID NO: 333216 - DNA, 25 bp, Mus musculus
ccgagccagggccacgcgggtaacg

SEQ ID NO: 333217 - DNA, 25 bp, Mus musculus
ccggactcgcgtgcgctgccgcgct

SEQ ID NO: 333218 - DNA, 25 bp, Mus musculus
cacaggacgctgctcggtccgctcc

SEQ ID NO: 333219 - DNA, 25 bp, Mus musculus
tactggccgcgtgcagtgtctactt

SEQ ID NO: 333220 - DNA, 25 bp, Mus musculus
gtccgagctgcacgggaaagcttgc

SEQ ID NO: 333221 - DNA, 25 bp, Mus musculus
aagcttgcagaacgagcggagagcc

SEQ ID NO: 333222 - DNA, 25 bp, Mus musculus
cgaggcagcctgaagtcctgacttc

SEQ ID NO: 333223 - DNA, 25 bp, Mus musculus
tcctgacttctttctgtccgcgcgg

SEQ ID NO: 333224 - DNA, 25 bp, Mus musculus
gcggcttctgtttactttcgatcga

SEQ ID NO: 333225 - DNA, 25 bp, Mus musculus
gatcgagtttttcctgctccgggca

SEQ ID NO: 333226 - DNA, 25 bp, Mus musculus
acaggcgtcccgtttgtgcccaggt

SEQ ID NO: 333227 - DNA, 25 bp, Mus musculus
cgactgcactgttctggtgggcgac

SEQ ID NO: 333228 - DNA, 25 bp, Mus musculus
ttctacagggatcagcccgcgagca

SEQ ID NO: 333229 - DNA, 25 bp, Mus musculus
agctccagccgggagtttcgctctt

SEQ ID NO: 333230 - DNA, 25 bp, Mus musculus
gtctacttccatctcttctacaggg

SEQ ID NO: 333231 - DNA, 25 bp, Mus musculus
gggttcctgtgcgactgcactgttc

SEQ ID NO: 333232 - DNA, 25 bp, Mus musculus
gctcaacggcgacatcgtcacggta

SEQ ID NO: 333233 - DNA, 25 bp, Mus musculus
gtagagttccacctcacgaccctga

SEQ ID NO: 333234 - DNA, 25 bp, Mus musculus
cgctcgttcgcaccgaccggcaact

SEQ ID NO: 333235 - DNA, 25 bp, Mus musculus
actcgtgccttggagcgtccgcgag

SEQ ID NO: 333236 - DNA, 25 bp, Mus musculus
gaccggcaacttccgccggacagag

SEQ ID NO: 333237 - DNA, 25 bp, Mus musculus
ttagtcactcgtgccttggagcgtc

SEQ ID NO: 333238 - DNA, 25 bp, Mus musculus
gcctcctttagtcactcgtgccttg

SEQ ID NO: 333239 - DNA, 25 bp, Mus musculus
gttcctgctcgacccgtgcctcctt

SEQ ID NO: 333240 - DNA, 25 bp, Mus musculus
cgagccttggagaagctggttcctg

SEQ ID NO: 333241 - DNA, 25 bp, Mus musculus
gaccctgaacactcccggccttctg

SEQ ID NO: 333242 - DNA, 25 bp, Mus musculus
gcgacagcggtagagttccacctca

SEQ ID NO: 333243 - DNA, 25 bp, Mus musculus
ccaggacaccgtggcgacagcggta

SEQ ID NO: 333244 - DNA, 25 bp, Mus musculus
agcactcgccaggacaccgtggcga

SEQ ID NO: 333245 - DNA, 25 bp, Mus musculus
agagccggcgcagcactcgccagga

SEQ ID NO: 333246 - DNA, 25 bp, Mus musculus
cggccttctgcacactcgctgcgca

SEQ ID NO: 333247 - DNA, 25 bp, Mus musculus
tgattcaggatacaacgccgctccc

SEQ ID NO: 333248 - DNA, 25 bp, Mus musculus
cagggccagcgctgattcaggatac

SEQ ID NO: 333249 - DNA, 25 bp, Mus musculus
aggacgctgggcagccgtacgccct

SEQ ID NO: 333250 - DNA, 25 bp, Mus musculus
gccctttctcgcaaccctgggatag

SEQ ID NO: 333251 - DNA, 25 bp, Mus musculus
tctcgcaaccctgggatagccagcg

SEQ ID NO: 333252 - DNA, 25 bp, Mus musculus
ctgggatagccagcgccagagagaa

SEQ ID NO: 333253 - DNA, 25 bp, Mus musculus
ggacaaaggtgatcgcccgttcctg

SEQ ID NO: 333254 - DNA, 25 bp, Mus musculus
gatcgcccgttcctggttgcccgat

SEQ ID NO: 333255 - DNA, 25 bp, Mus musculus
ccgttcctggttgcccgatccggtg

SEQ ID NO: 333256 - DNA, 25 bp, Mus musculus
ctgcggagtccagctcacctgctga

SEQ ID NO: 333257 - DNA, 25 bp, Mus musculus
gagtccagctcacctgctgaggctg

SEQ ID NO: 333258 - DNA, 25 bp, Mus musculus
ccagcagggcacctgcgtgcctcca

SEQ ID NO: 333259 - DNA, 25 bp, Mus musculus
cagcgcttgccgatgctgcccatgt

SEQ ID NO: 333260 - DNA, 25 bp, Mus musculus
cttgccgatgctgcccatgtctgcg

SEQ ID NO: 333261 - DNA, 25 bp, Mus musculus
ctcgtgagagctgcaccggagtaag

SEQ ID NO: 333262 - DNA, 25 bp, Mus musculus
agtcttgcacccacatccggggtct

SEQ ID NO: 333263 - DNA, 25 bp, Mus musculus
gcctaggaccttgagtcgcgcgtcc

SEQ ID NO: 333264 - DNA, 25 bp, Mus musculus
gtgacgcattcgcaaccgtcctgaa

SEQ ID NO: 333265 - DNA, 25 bp, Mus musculus
cagcgcgccgggatttagggataaa

SEQ ID NO: 333266 - DNA, 25 bp, Mus musculus
ccgtcgctgcgcaaccatgtcggaa

SEQ ID NO: 333267 - DNA, 25 bp, Mus musculus
catgtcggaagagaagcccaaggta

SEQ ID NO: 333268 - DNA, 25 bp, Mus musculus
cccggtacgcaagccgcagcagatt

SEQ ID NO: 333269 - DNA, 25 bp, Mus musculus
ccacggctcgagaacccggaacttg

SEQ ID NO: 333270 - DNA, 25 bp, Mus musculus
ttcttggttcgcaagggcctcactc

SEQ ID NO: 333271 - DNA, 25 bp, Mus musculus
tgcgcacagttgcacgcgtggtgct

SEQ ID NO: 333272 - DNA, 25 bp, Mus musculus
caccggagtaagagcaaggctggcc

SEQ ID NO: 333273 - DNA, 25 bp, Mus musculus
ctccatcgccgtggtctcggcagtt

SEQ ID NO: 333274 - DNA, 25 bp, Mus musculus
atcctttcgcgtgccgtgcgcacag

SEQ ID NO: 333275 - DNA, 25 bp, Mus musculus
actgaggagcgactgggcaatactt

SEQ ID NO: 333276 - DNA, 25 bp, Mus musculus
cagagaccgtcctggtgtctcggtc

SEQ ID NO: 333277 - DNA, 25 bp, Mus musculus
tcctgggacttcagacagagaccgt

SEQ ID NO: 333278 - DNA, 25 bp, Mus musculus
caagcgtcggggtcctgggacttca

SEQ ID NO: 333279 - DNA, 25 bp, Mus musculus
cccaaggctgacaagcgtcggggtc

SEQ ID NO: 333280 - DNA, 25 bp, Mus musculus
agaaacgctcccagtcctttacaca

SEQ ID NO: 333281 - DNA, 25 bp, Mus musculus
cgagttcttcgatggggacacaccc

SEQ ID NO: 333282 - DNA, 25 bp, Mus musculus
tggtgtctcggtccgtgccactggc

SEQ ID NO: 333283 - DNA, 25 bp, Mus musculus
cactggcagcagctcaggaccacag

SEQ ID NO: 333284 - DNA, 25 bp, Mus musculus
acagagggccagctcgctcaagcga

SEQ ID NO: 333285 - DNA, 25 bp, Mus musculus
ctcaagcgagagaagactgaggagc

SEQ ID NO: 333286 - DNA, 25 bp, Mus musculus
gcgactgggcaatacttctcccgtc

SEQ ID NO: 333287 - DNA, 25 bp, Mus musculus
tccacccgctcctttggcagtgtgg

SEQ ID NO: 333288 - DNA, 25 bp, Mus musculus
gctcgctcaagcgagagaagactga

SEQ ID NO: 333289 - DNA, 25 bp, Mus musculus
gagcggatgtctgagagacagcatc

SEQ ID NO: 333290 - DNA, 25 bp, Mus musculus
gagagacagcatcgcccaacacctg

SEQ ID NO: 333291 - DNA, 25 bp, Mus musculus
atcgcccaacacctgcagacttggg

SEQ ID NO: 333292 - DNA, 25 bp, Mus musculus
cacctgcagacttgggccctggaga

SEQ ID NO: 333293 - DNA, 25 bp, Mus musculus
ttgggccctggagacacatcaaggc

SEQ ID NO: 333294 - DNA, 25 bp, Mus musculus
atcaaggcgcgcagccatgcggcga

SEQ ID NO: 333295 - DNA, 25 bp, Mus musculus
catgggtctcgagggtccctggact

SEQ ID NO: 333296 - DNA, 25 bp, Mus musculus
aagagcgaggttctggccttgccca

SEQ ID NO: 333297 - DNA, 25 bp, Mus musculus
gaggttctggccttgcccacttgcc

SEQ ID NO: 333298 - DNA, 25 bp, Mus musculus
cacttgcccagttctaaccacgaga

SEQ ID NO: 333299 - DNA, 25 bp, Mus musculus
cagaggctaccctggcaggccgaca

SEQ ID NO: 333300 - DNA, 25 bp, Mus musculus
cctggcaggccgacaaggacctcgt

SEQ ID NO: 333301 - DNA, 25 bp, Mus musculus
aggacctcgtcggaaaccagcggct

SEQ ID NO: 333302 - DNA, 25 bp, Mus musculus
ccagccgcacgggaggagcaaagcc

SEQ ID NO: 333303 - DNA, 25 bp, Mus musculus
agcccattggttgctgcagccttgg

SEQ ID NO: 333304 - DNA, 25 bp, Mus musculus
ccggtctcattcagcccattggttg

SEQ ID NO: 333305 - DNA, 25 bp, Mus musculus
gcgagcggcgctgccggtctcattc

SEQ ID NO: 333306 - DNA, 25 bp, Mus musculus
gaccactccgcaagggcgacgcgag

SEQ ID NO: 333307 - DNA, 25 bp, Mus musculus
cgtgctgaccactccgcaagggcga

SEQ ID NO: 333308 - DNA, 25 bp, Mus musculus
tggggtacctccagaccttggctcc

SEQ ID NO: 333309 - DNA, 25 bp, Mus musculus
ctgcagctaactcttggggtacctc

SEQ ID NO: 333310 - DNA, 25 bp, Mus musculus
gcagccgggttgtgactgcagctaa

SEQ ID NO: 333311 - DNA, 25 bp, Mus musculus
tcccagagctgatgcgccaggagaa

SEQ ID NO: 333312 - DNA, 25 bp, Mus musculus
tgcgcgtccagtcgcggtcccagag

SEQ ID NO: 333313 - DNA, 25 bp, Mus musculus
cagtcgcacatcttggcggctagtg

SEQ ID NO: 333314 - DNA, 25 bp, Mus musculus
acaccacgtggaagcagtcgcacat

SEQ ID NO: 333315 - DNA, 25 bp, Mus musculus
tccgggccaggtgggcaacaccacg

SEQ ID NO: 333316 - DNA, 25 bp, Mus musculus
cgaaggtccgaaagcacgcaagacc

SEQ ID NO: 333317 - DNA, 25 bp, Mus musculus
tgagctggtgcgtctccatgacgac

SEQ ID NO: 333318 - DNA, 25 bp, Mus musculus
ctccacttgcccgggtgatgatgga

SEQ ID NO: 333319 - DNA, 25 bp, Mus musculus
atgggagccctcttcgcgtcagccg

SEQ ID NO: 333320 - DNA, 25 bp, Mus musculus
ggacctcggctgcaagccctcggat

SEQ ID NO: 333321 - DNA, 25 bp, Mus musculus
tcgggctttgtcagtccctgcagcc

SEQ ID NO: 333322 - DNA, 25 bp, Mus musculus
cgcgtcgcaccgtcgggctttgtca

SEQ ID NO: 333323 - DNA, 25 bp, Mus musculus
tccatgacgacgtgctcggcgtata

SEQ ID NO: 333324 - DNA, 25 bp, Mus musculus
ctggtttgagctggtgcgtctccat

SEQ ID NO: 333325 - DNA, 25 bp, Mus musculus
ctgccgcagggcgtgtccgacacga

SEQ ID NO: 333326 - DNA, 25 bp, Mus musculus
gcccatagggccctgcggcatgctg

SEQ ID NO: 333327 - DNA, 25 bp, Mus musculus
tacatgtgcgcatgcaccagccgac

SEQ ID NO: 333328 - DNA, 25 bp, Mus musculus
gcgaccaggtacatgtgcgcatgca

SEQ ID NO: 333329 - DNA, 25 bp, Mus musculus
cgagagactggcgaccaggtacatg

SEQ ID NO: 333330 - DNA, 25 bp, Mus musculus
ctcggcgtataagtagcggcgcgtc

SEQ ID NO: 333331 - DNA, 25 bp, Mus musculus
gctcatccaccaggacttgcgtctg

SEQ ID NO: 333332 - DNA, 25 bp, Mus musculus
accaggacttgcgtctgcccacagg

SEQ ID NO: 333333 - DNA, 25 bp, Mus musculus
ggcgctgttggccacgccacacggt

SEQ ID NO: 333334 - DNA, 25 bp, Mus musculus
gagactcccgtctgggacgcgatcc

SEQ ID NO: 333335 - DNA, 25 bp, Mus musculus
ctagtcatccgcgagtgccaggagg

SEQ ID NO: 333336 - DNA, 25 bp, Mus musculus
gcctcacttgtttggccctaggata

SEQ ID NO: 333337 - DNA, 25 bp, Mus musculus
cggcctcgcagaccgggttctgcag

SEQ ID NO: 333338 - DNA, 25 bp, Mus musculus
tgccggctaagctggctgtagtatc

SEQ ID NO: 333339 - DNA, 25 bp, Mus musculus
ctggcacgcatcgttgccgggcaac

SEQ ID NO: 333340 - DNA, 25 bp, Mus musculus
ccggaagcctgctggcacgcatcgt

SEQ ID NO: 333341 - DNA, 25 bp, Mus musculus
cgacacttaaagcacgccggaagcc

SEQ ID NO: 333342 - DNA, 25 bp, Mus musculus
gtggcgtgctgacgacacttaaagc

SEQ ID NO: 333343 - DNA, 25 bp, Mus musculus
ccacacggtggcgtgctgacgacac

SEQ ID NO: 333344 - DNA, 25 bp, Mus musculus
gtgccggactagtcatccgcgagtg

SEQ ID NO: 333345 - DNA, 25 bp, Mus musculus
tttgttcaaacccacgcaaggcgga

SEQ ID NO: 333346 - DNA, 25 bp, Mus musculus
gaatcggtccctggccagcagacag

SEQ ID NO: 333347 - DNA, 25 bp, Mus musculus
ccggctctcggtatgtgtcactcaa

SEQ ID NO: 333348 - DNA, 25 bp, Mus musculus
tgtgtcactcaacacgccgcggcgt

SEQ ID NO: 333349 - DNA, 25 bp, Mus musculus
cgcccatgccgcagaagctcgaagg

SEQ ID NO: 333350 - DNA, 25 bp, Mus musculus
ctcgaaggcgcaaaccagctacaca

SEQ ID NO: 333351 - DNA, 25 bp, Mus musculus
ttcgggcacccggatcggtcagcgc

SEQ ID NO: 333352 - DNA, 25 bp, Mus musculus
cagccctcccggaatcgggaatcgg

SEQ ID NO: 333353 - DNA, 25 bp, Mus musculus
cggtgcccgagtctccttcgttatc

SEQ ID NO: 333354 - DNA, 25 bp, Mus musculus
tgcggggtggagctttgttcaaacc

SEQ ID NO: 333355 - DNA, 25 bp, Mus musculus
gcttcggcctcagccgttaggctcg

SEQ ID NO: 333356 - DNA, 25 bp, Mus musculus
gatcccttgtttgtcgacggctcga

SEQ ID NO: 333357 - DNA, 25 bp, Mus musculus
tcagcgcccacaaagggtcgccatg

SEQ ID NO: 333358 - DNA, 25 bp, Mus musculus
ccgaaactgcgcacagcaagcggcg

SEQ ID NO: 333359 - DNA, 25 bp, Mus musculus
cgcggtccttgagcttgttctggcg

SEQ ID NO: 333360 - DNA, 25 bp, Mus musculus
tggccgctgactccctcgggacaga

SEQ ID NO: 333361 - DNA, 25 bp, Mus musculus
ccgctgactccctcgggacagaatg

SEQ ID NO: 333362 - DNA, 25 bp, Mus musculus
ctccctcgggacagaatggagtagg

SEQ ID NO: 333363 - DNA, 25 bp, Mus musculus
ggacggggcccgcaagcagattcca

SEQ ID NO: 333364 - DNA, 25 bp, Mus musculus
gggcccgcaagcagattccagcacg

SEQ ID NO: 333365 - DNA, 25 bp, Mus musculus
caagcagattccagcacgggggtca

SEQ ID NO: 333366 - DNA, 25 bp, Mus musculus
acgggggtcagacaagcccgcgcct

SEQ ID NO: 333367 - DNA, 25 bp, Mus musculus
aggagaggaccctgatcgcgacaca

SEQ ID NO: 333368 - DNA, 25 bp, Mus musculus
gagaggaccctgatcgcgacacacc

SEQ ID NO: 333369 - DNA, 25 bp, Mus musculus
tttgtgcgcgcggtccttgagcttg

SEQ ID NO: 333370 - DNA, 25 bp, Mus musculus
ccttgagcttgttctggcgggccca

SEQ ID NO: 333371 - DNA, 25 bp, Mus musculus
gcgggcccagccgaccgcgctccag

SEQ ID NO: 333372 - DNA, 25 bp, Mus musculus
gtgcggcggaatgcgcctttgtgcg

SEQ ID NO: 333373 - DNA, 25 bp, Mus musculus
ggtgagtagagtatgtgtcttccta

SEQ ID NO: 333374 - DNA, 25 bp, Mus musculus
gtagagtatgtgtcttcctaggaaa

SEQ ID NO: 333375 - DNA, 25 bp, Mus musculus
cagcagtcccagtttcctacagaaa

SEQ ID NO: 333376 - DNA, 25 bp, Mus musculus
ttcctacagaaactagcaactgatc

SEQ ID NO: 333377 - DNA, 25 bp, Mus musculus
tgtgtcttcctaggaaagttttgtc

SEQ ID NO: 333378 - DNA, 25 bp, Mus musculus
aaagttttgtcactcaacagaggca

SEQ ID NO: 333379 - DNA, 25 bp, Mus musculus
gcatcacagcagtcccagtttccta

SEQ ID NO: 333380 - DNA, 25 bp, Mus musculus
aaactgagtggaaagggacctgatg

SEQ ID NO: 333381 - DNA, 25 bp, Mus musculus
ggaaagggacctgatgttcatctgc

SEQ ID NO: 333382 - DNA, 25 bp, Mus musculus
agctcatcactgcatcacagcagtc

SEQ ID NO: 333383 - DNA, 25 bp, Mus musculus
ggacctgatgttcatctgcacctca

SEQ ID NO: 333384 - DNA, 25 bp, Mus musculus
gttcatctgcacctcatcacaacag

SEQ ID NO: 333385 - DNA, 25 bp, Mus musculus
ttttgtcactcaacagaggcaaagg

SEQ ID NO: 333386 - DNA, 25 bp, Mus musculus
gcaactgatcctaaaattcatctga

SEQ ID NO: 333387 - DNA, 25 bp, Mus musculus
tttgcactggtagagtatgtccttg

SEQ ID NO: 333388 - DNA, 25 bp, Mus musculus
tacgcagataaccacacaggcgagc

SEQ ID NO: 333389 - DNA, 25 bp, Mus musculus
tcgtgtccaccatacgcagataacc

SEQ ID NO: 333390 - DNA, 25 bp, Mus musculus
gcggtgtgaagtttttgcactggta

SEQ ID NO: 333391 - DNA, 25 bp, Mus musculus
ctggtagagtatgtccttgtggccc

SEQ ID NO: 333392 - DNA, 25 bp, Mus musculus
cccagttcccagaccgctgccgcct

SEQ ID NO: 333393 - DNA, 25 bp, Mus musculus
ctggccgctcaatggggttgcggat

SEQ ID NO: 333394 - DNA, 25 bp, Mus musculus
gcccactggttgttggcgctctcat

SEQ ID NO: 333395 - DNA, 25 bp, Mus musculus
tggcgctctcatcccgtggtagccg

SEQ ID NO: 333396 - DNA, 25 bp, Mus musculus
gtagccggctcctctcacgttcttt

SEQ ID NO: 333397 - DNA, 25 bp, Mus musculus
acgttctttcctgcgctttcgtgtc

SEQ ID NO: 333398 - DNA, 25 bp, Mus musculus
agcacactgaacacgctgcacagca

SEQ ID NO: 333399 - DNA, 25 bp, Mus musculus
ttcctgcgctttcgtgtccaccata

SEQ ID NO: 333400 - DNA, 25 bp, Mus musculus
agataaccacacaggcgagccacag

SEQ ID NO: 333401 - DNA, 25 bp, Mus musculus
atgtgccaccgttgctgcaggtgta

SEQ ID NO: 333402 - DNA, 25 bp, Mus musculus
attgaccaggtcatagcagcggccg

SEQ ID NO: 333403 - DNA, 25 bp, Mus musculus
cacagtagaagtcattgaccaggtc

SEQ ID NO: 333404 - DNA, 25 bp, Mus musculus
cgtcacaggcacagtagaagtcatt

SEQ ID NO: 333405 - DNA, 25 bp, Mus musculus
tccagccatcgtcacaggcacagta

SEQ ID NO: 333406 - DNA, 25 bp, Mus musculus
gagtggcaggtcttgcccttccagc

SEQ ID NO: 333407 - DNA, 25 bp, Mus musculus
tcgctcgcttgctcatttgcaggga

SEQ ID NO: 333408 - DNA, 25 bp, Mus musculus
tggaactcgcctgcaagcacatggc

SEQ ID NO: 333409 - DNA, 25 bp, Mus musculus
ttgctgcaggtgtaggcgtcacact

SEQ ID NO: 333410 - DNA, 25 bp, Mus musculus
gctgtcatagcatgtgccaccgttg

SEQ ID NO: 333411 - DNA, 25 bp, Mus musculus
cagcggaaggtgtcgccgctgtcat

SEQ ID NO: 333412 - DNA, 25 bp, Mus musculus
ctgcaagcacatggccgctcagtgg

SEQ ID NO: 333413 - DNA, 25 bp, Mus musculus
cgtcacactggaactcgcctgcaag

SEQ ID NO: 333414 - DNA, 25 bp, Mus musculus
ggcacttacgtgagtggcaggtctt

SEQ ID NO: 333415 - DNA, 25 bp, Mus musculus
gatggccgagtataagcgtgagtca

SEQ ID NO: 333416 - DNA, 25 bp, Mus musculus
ctgcgcaaagcctcacggcggcgta

SEQ ID NO: 333417 - DNA, 25 bp, Mus musculus
acggcggcgtaggaaaccttcaatg

SEQ ID NO: 333418 - DNA, 25 bp, Mus musculus
aaccttcaatgctgagggtgtggcc

SEQ ID NO: 333419 - DNA, 25 bp, Mus musculus
caaagtttctcggacacgggctccg

SEQ ID NO: 333420 - DNA, 25 bp, Mus musculus
tctgccctcccgacagttgatgctg

SEQ ID NO: 333421 - DNA, 25 bp, Mus musculus
ttccgcgtgcggataaaaggccagg

SEQ ID NO: 333422 - DNA, 25 bp, Mus musculus
ttgaagaggctgatggccgagtata

SEQ ID NO: 333423 - DNA, 25 bp, Mus musculus
gctgctgaacgcaggttccgcggta

SEQ ID NO: 333424 - DNA, 25 bp, Mus musculus
tgaagcacccgggtgcgccacgtca

SEQ ID NO: 333425 - DNA, 25 bp, Mus musculus
cagcgagcctgtctgaagcacccgg

SEQ ID NO: 333426 - DNA, 25 bp, Mus musculus
cgagaagattctggaagccgagctc

SEQ ID NO: 333427 - DNA, 25 bp, Mus musculus
gccggccgagaagattctggaagcc

SEQ ID NO: 333428 - DNA, 25 bp, Mus musculus
taaaaggccaggctgtcgccgtcac

SEQ ID NO: 333429 - DNA, 25 bp, Mus musculus
ttgatcatgccagcgtgcgacaccc

SEQ ID NO: 333430 - DNA, 25 bp, Mus musculus
tgcgacacccgctcaatcagcagct

SEQ ID NO: 333431 - DNA, 25 bp, Mus musculus
gcggtcctcggggttgatcatgcca

SEQ ID NO: 333432 - DNA, 25 bp, Mus musculus
aagtgcaggctcttccagcggtcct

SEQ ID NO: 333433 - DNA, 25 bp, Mus musculus
ccacgtggccgctgaagtgcaggct

SEQ ID NO: 333434 - DNA, 25 bp, Mus musculus
ccaggtgtgccacgtggccgctgaa

SEQ ID NO: 333435 - DNA, 25 bp, Mus musculus
actcggatctgcagctccaggtgtg

SEQ ID NO: 333436 - DNA, 25 bp, Mus musculus
gcgtactcggatctgcagctccagg

SEQ ID NO: 333437 - DNA, 25 bp, Mus musculus
gtagttctcatcacagcgtactcgg

SEQ ID NO: 333438 - DNA, 25 bp, Mus musculus
gcaggtggcactgtagtagttctca

SEQ ID NO: 333439 - DNA, 25 bp, Mus musculus
ccggcagaacttgttgcaggtggca

SEQ ID NO: 333440 - DNA, 25 bp, Mus musculus
atagtggccaaagaagtcgttgcgg

SEQ ID NO: 333441 - DNA, 25 bp, Mus musculus
cgcaggtatagtggccaaagaagtc

SEQ ID NO: 333442 - DNA, 25 bp, Mus musculus
cgtactggtcgcaggtatagtggcc

SEQ ID NO: 333443 - DNA, 25 bp, Mus musculus
aggcgcgaacctggccgcaagagca

SEQ ID NO: 333444 - DNA, 25 bp, Mus musculus
tccttaaggcacacgcgcacgtacg

SEQ ID NO: 333445 - DNA, 25 bp, Mus musculus
cgtcaccttggcctggtactcctta

SEQ ID NO: 333446 - DNA, 25 bp, Mus musculus
gcacgtaccggccaggcgaactgaa

SEQ ID NO: 333447 - DNA, 25 bp, Mus musculus
aaggagttgccacccagcacgggcg

SEQ ID NO: 333448 - DNA, 25 bp, Mus musculus
cggcaggtagaaggagttgccaccc

SEQ ID NO: 333449 - DNA, 25 bp, Mus musculus
tggtactccttaaggcacacgcgca

SEQ ID NO: 333450 - DNA, 25 bp, Mus musculus
actgaaagggaatgacgacgaggcc

SEQ ID NO: 333451 - DNA, 25 bp, Mus musculus
acgcacagaaccagtagcagcagca

SEQ ID NO: 333452 - DNA, 25 bp, Mus musculus
ctaaaaataaggcagcgcagagtgc

SEQ ID NO: 333453 - DNA, 25 bp, Mus musculus
ggccgcgtcgcctaaaaataaggca

SEQ ID NO: 333454 - DNA, 25 bp, Mus musculus
ctcgaaatagcccatgggccgcgtc

SEQ ID NO: 333455 - DNA, 25 bp, Mus musculus
cgcgctcagctgcagctcgaaatag

SEQ ID NO: 333456 - DNA, 25 bp, Mus musculus
gcacgtacgtgtcgcactcgtcgcg

SEQ ID NO: 333457 - DNA, 25 bp, Mus musculus
cgcagagcagattcttccgcggatc

SEQ ID NO: 333458 - DNA, 25 bp, Mus musculus
gaatgggcacagaggcccacggcca

SEQ ID NO: 333459 - DNA, 25 bp, Mus musculus
tccatggtggcgcagagcagattct

SEQ ID NO: 333460 - DNA, 25 bp, Mus musculus
agctcaagctctgagaatccgctca

SEQ ID NO: 333461 - DNA, 25 bp, Mus musculus
agagcagattcttccgcggatcgaa

SEQ ID NO: 333462 - DNA, 25 bp, Mus musculus
cgtcgatgcgctccatggtggcgca

SEQ ID NO: 333463 - DNA, 25 bp, Mus musculus
tagtgcagcgtgaaaggccgcaggt

SEQ ID NO: 333464 - DNA, 25 bp, Mus musculus
agacacgcgagtggggcggatcacc

SEQ ID NO: 333465 - DNA, 25 bp, Mus musculus
ccgactggccgtcaggactgcagga

SEQ ID NO: 333466 - DNA, 25 bp, Mus musculus
ggttgaccgactggccgtcaggact

SEQ ID NO: 333467 - DNA, 25 bp, Mus musculus
attcttccgcggatcgaagccggcg

SEQ ID NO: 333468 - DNA, 25 bp, Mus musculus
agctctgagaatccgctcagggcgg

SEQ ID NO: 333469 - DNA, 25 bp, Mus musculus
atcacctggcggtagtgcagcgtga

SEQ ID NO: 333470 - DNA, 25 bp, Mus musculus
gggcggagctcaagctctgagaatc

SEQ ID NO: 333471 - DNA, 25 bp, Mus musculus
gatgcccgcgctgataagagcctgc

SEQ ID NO: 333472 - DNA, 25 bp, Mus musculus
gtgcgcttccacgatagcccacaga

SEQ ID NO: 333473 - DNA, 25 bp, Mus musculus
caaagcctggcatctctcgcagctt

SEQ ID NO: 333474 - DNA, 25 bp, Mus musculus
cttttggaccaatctcgggagcgcg

SEQ ID NO: 333475 - DNA, 25 bp, Mus musculus
agaccatagctcaccgaggcctgcg

SEQ ID NO: 333476 - DNA, 25 bp, Mus musculus
cggcgggaagaccatagctcaccga

SEQ ID NO: 333477 - DNA, 25 bp, Mus musculus
acgatagcccacagaagcgcggtgc

SEQ ID NO: 333478 - DNA, 25 bp, Mus musculus
acaatggccattgaattgggctggg

SEQ ID NO: 333479 - DNA, 25 bp, Mus musculus
gccggcggacaatggccattgaatt

SEQ ID NO: 333480 - DNA, 25 bp, Mus musculus
gaagtggccgcctcctgaacaaagg

SEQ ID NO: 333481 - DNA, 25 bp, Mus musculus
cccttctcgatcctgcaggaagtgg

SEQ ID NO: 333482 - DNA, 25 bp, Mus musculus
tggcctccgcatttcggtttcctgc

SEQ ID NO: 333483 - DNA, 25 bp, Mus musculus
gcgccgggcccagtacgacacggaa

SEQ ID NO: 333484 - DNA, 25 bp, Mus musculus
tacgacacggaaccgtgcgcgcgtc

SEQ ID NO: 333485 - DNA, 25 bp, Mus musculus
tccgttggaaacttgagtgcccgcc

SEQ ID NO: 333486 - DNA, 25 bp, Mus musculus
tccgcgcagtgcgtagctcaggaac

SEQ ID NO: 333487 - DNA, 25 bp, Mus musculus
tgggatgtgcacttttcagactacg

SEQ ID NO: 333488 - DNA, 25 bp, Mus musculus
atcgttgcgctcgatgggatgtgca

SEQ ID NO: 333489 - DNA, 25 bp, Mus musculus
tggctctagaatggcgtgtcctcgt

SEQ ID NO: 333490 - DNA, 25 bp, Mus musculus
tgtttctctgcgtagtgggcttgca

SEQ ID NO: 333491 - DNA, 25 bp, Mus musculus
ccggtactgatggtgcctgtttctc

SEQ ID NO: 333492 - DNA, 25 bp, Mus musculus
cgtccagctccagagccggtaggaa

SEQ ID NO: 333493 - DNA, 25 bp, Mus musculus
agaagccagcggaccgcgtccagct

SEQ ID NO: 333494 - DNA, 25 bp, Mus musculus
tccttttgtctctccgagcggcgaa

SEQ ID NO: 333495 - DNA, 25 bp, Mus musculus
actacgtttgtggaattgtgtgtca

SEQ ID NO: 333496 - DNA, 25 bp, Mus musculus
acctgagggtacgactagaatccga

SEQ ID NO: 333497 - DNA, 25 bp, Mus musculus
atccgatgggcaaagtgcctgcctg

SEQ ID NO: 333498 - DNA, 25 bp, Mus musculus
accgcagaacttgggctcgagaagc

SEQ ID NO: 333499 - DNA, 25 bp, Mus musculus
gccctggaacgaggagtcgcgtctt

SEQ ID NO: 333500 - DNA, 25 bp, Mus musculus
tggtgctcgcagagccgtttcccag

SEQ ID NO: 333501 - DNA, 25 bp, Mus musculus
cagtagcgaagatggccgcggaact

SEQ ID NO: 333502 - DNA, 25 bp, Mus musculus
ctggcagtccttccatcctacgctg

SEQ ID NO: 333503 - DNA, 25 bp, Mus musculus
acgaaggtcgggctttgctgcccgc

SEQ ID NO: 333504 - DNA, 25 bp, Mus musculus
acatcgccaacagcaacgcggcagg

SEQ ID NO: 333505 - DNA, 25 bp, Mus musculus
tgcagctactgccaccgacatcgcc

SEQ ID NO: 333506 - DNA, 25 bp, Mus musculus
gcagtgcctaacctccctgctggtg

SEQ ID NO: 333507 - DNA, 25 bp, Mus musculus
gggtggcgcagtgcctaacctccct

SEQ ID NO: 333508 - DNA, 25 bp, Mus musculus
cacagtgacgagagacgccggcgcc

SEQ ID NO: 333509 - DNA, 25 bp, Mus musculus
ttgacgcacagtgacgagagacgcc

SEQ ID NO: 333510 - DNA, 25 bp, Mus musculus
acgaggagtcgcgtcttgacgcaca

SEQ ID NO: 333511 - DNA, 25 bp, Mus musculus
taacctccctgctggtgctcgcaga

SEQ ID NO: 333512 - DNA, 25 bp, Mus musculus
agatggccgcggaactgtacccgcc

SEQ ID NO: 333513 - DNA, 25 bp, Mus musculus
cgcgggaccgataaaggaactcaag

SEQ ID NO: 333514 - DNA, 25 bp, Mus musculus
accgcgacgcttggaccgggcagat

SEQ ID NO: 333515 - DNA, 25 bp, Mus musculus
ggcagatcgcggagtttacatcggc

SEQ ID NO: 333516 - DNA, 25 bp, Mus musculus
tttacatcggcgtacgggactcgga

SEQ ID NO: 333517 - DNA, 25 bp, Mus musculus
cgactgcccacggtctgtcacagga

SEQ ID NO: 333518 - DNA, 25 bp, Mus musculus
gtcacaggacgacctacttcagttt

SEQ ID NO: 333519 - DNA, 25 bp, Mus musculus
agaactcaccgtccagcgacacgaa

SEQ ID NO: 333520 - DNA, 25 bp, Mus musculus
tgttctccacgaactgcacctcgga

SEQ ID NO: 333521 - DNA, 25 bp, Mus musculus
acgaactgcacctcggacacgatga

SEQ ID NO: 333522 - DNA, 25 bp, Mus musculus
gattcgtcgcggcagattcgcccag

SEQ ID NO: 333523 - DNA, 25 bp, Mus musculus
ctcaagaatcgttgggacgctggga

SEQ ID NO: 333524 - DNA, 25 bp, Mus musculus
gccggaagcaaagctccaaacctgg

SEQ ID NO: 333525 - DNA, 25 bp, Mus musculus
ggcctcgcgggccaaaagccaacaa

SEQ ID NO: 333526 - DNA, 25 bp, Mus musculus
cacgatgatgttgtcctcgagcacc

SEQ ID NO: 333527 - DNA, 25 bp, Mus musculus
tcggccttgtgtccggcgttgtgac

SEQ ID NO: 333528 - DNA, 25 bp, Mus musculus
cgttgtgacgagagctcccgagacc

SEQ ID NO: 333529 - DNA, 25 bp, Mus musculus
atgaacctgtttgccacctgggagg

SEQ ID NO: 333530 - DNA, 25 bp, Mus musculus
tgaggctcccgggacacgccgctgt

SEQ ID NO: 333531 - DNA, 25 bp, Mus musculus
gcctcacttccggtgggcggtgatt

SEQ ID NO: 333532 - DNA, 25 bp, Mus musculus
gacacgcaggatggcaaccggatga

SEQ ID NO: 333533 - DNA, 25 bp, Mus musculus
gtgaggtctgcgctctcttcacctg

SEQ ID NO: 333534 - DNA, 25 bp, Mus musculus
agctctcggctagtgccacagctct

SEQ ID NO: 333535 - DNA, 25 bp, Mus musculus
actccggtgcccatgaacctgtttg

SEQ ID NO: 333536 - DNA, 25 bp, Mus musculus
tgagtccctgagaggggcacagcct

SEQ ID NO: 333537 - DNA, 25 bp, Mus musculus
gttcgtagacctggtcactcccgca

SEQ ID NO: 333538 - DNA, 25 bp, Mus musculus
atacatggtcacgtccctaggcccg

SEQ ID NO: 333539 - DNA, 25 bp, Mus musculus
cggatgagagtcaccgggatacatg

SEQ ID NO: 333540 - DNA, 25 bp, Mus musculus
gctctcttcacctgtcggccttgtg

SEQ ID NO: 333541 - DNA, 25 bp, Mus musculus
gagcacgtgcctctggagctctggc

SEQ ID NO: 333542 - DNA, 25 bp, Mus musculus
ctgcggtcccgcgagcaggagtttc

SEQ ID NO: 333543 - DNA, 25 bp, Mus musculus
cccgcgagcaggagtttcggggtct

SEQ ID NO: 333544 - DNA, 25 bp, Mus musculus
taggtgtgcaggcaccgtgagtcct

SEQ ID NO: 333545 - DNA, 25 bp, Mus musculus
caggcaccgtgagtcctgttgcagg

SEQ ID NO: 333546 - DNA, 25 bp, Mus musculus
accgtgagtcctgttgcaggggcca

SEQ ID NO: 333547 - DNA, 25 bp, Mus musculus
agtcctgttgcaggggccacgagcc

SEQ ID NO: 333548 - DNA, 25 bp, Mus musculus
ctgagcaggagcacgtgcctctgga

SEQ ID NO: 333549 - DNA, 25 bp, Mus musculus
caggggccacgagcccgtcccagcc

SEQ ID NO: 333550 - DNA, 25 bp, Mus musculus
cccgctaggtgtgcaggcaccgtga

SEQ ID NO: 333551 - DNA, 25 bp, Mus musculus
tgttgcaggggccacgagcccgtcc

SEQ ID NO: 333552 - DNA, 25 bp, Mus musculus
gcccgcgggacgcaggcggagtagc

SEQ ID NO: 333553 - DNA, 25 bp, Mus musculus
ggccagggtggccagggcatcccgg

SEQ ID NO: 333554 - DNA, 25 bp, Mus musculus
tgcaggcaccgtgagtcctgttgca

SEQ ID NO: 333555 - DNA, 25 bp, Mus musculus
cccaggtctcggagccaatcgacgt

SEQ ID NO: 333556 - DNA, 25 bp, Mus musculus
tggccacccgcatgttcagcttatc

SEQ ID NO: 333557 - DNA, 25 bp, Mus musculus
ttctgtgctgcgagaccgttgctat

SEQ ID NO: 333558 - DNA, 25 bp, Mus musculus
gcccggacctcgagacctaaagctg

SEQ ID NO: 333559 - DNA, 25 bp, Mus musculus
ctggggatcccaagtccgttctaca

SEQ ID NO: 333560 - DNA, 25 bp, Mus musculus
tcactatgtggccatggaatcctcg

SEQ ID NO: 333561 - DNA, 25 bp, Mus musculus
agcttatcgcccttcttcagggacg

SEQ ID NO: 333562 - DNA, 25 bp, Mus musculus
ttcagcaccacagacaggaccgcgg

SEQ ID NO: 333563 - DNA, 25 bp, Mus musculus
cagccaccgtcttgggatgcgcgat

SEQ ID NO: 333564 - DNA, 25 bp, Mus musculus
gcgatccgatcggtagctaagctcg

SEQ ID NO: 333565 - DNA, 25 bp, Mus musculus
agctaagctcgccacgctgttttcg

SEQ ID NO: 333566 - DNA, 25 bp, Mus musculus
ggcactggtctaggtacgcaaagtc

SEQ ID NO: 333567 - DNA, 25 bp, Mus musculus
ggatccaatgaggtccgacgcccga

SEQ ID NO: 333568 - DNA, 25 bp, Mus musculus
cccggaatccgatgcttcgtgcttc

SEQ ID NO: 333569 - DNA, 25 bp, Mus musculus
tcctgtcctgcaggaggcctgaggt

SEQ ID NO: 333570 - DNA, 25 bp, Mus musculus
acagctgtcctgtcctgcaggaggc

SEQ ID NO: 333571 - DNA, 25 bp, Mus musculus
tgccttacagtccacagctgtcctg

SEQ ID NO: 333572 - DNA, 25 bp, Mus musculus
agaagcaggttgagaccggtcgcca

SEQ ID NO: 333573 - DNA, 25 bp, Mus musculus
ttcagaggcagcacacgggacaagg

SEQ ID NO: 333574 - DNA, 25 bp, Mus musculus
tcagcgatcactctgccttacagtc

SEQ ID NO: 333575 - DNA, 25 bp, Mus musculus
cttttatgggcagagaagcaggttg

SEQ ID NO: 333576 - DNA, 25 bp, Mus musculus
cgctttcatcttttatgggcagaga

SEQ ID NO: 333577 - DNA, 25 bp, Mus musculus
cggcatctcccgctttcatctttta

SEQ ID NO: 333578 - DNA, 25 bp, Mus musculus
acaccgggcggtcgctcagcgatca

SEQ ID NO: 333579 - DNA, 25 bp, Mus musculus
gcggggctgcaatgcctcccggcat

SEQ ID NO: 333580 - DNA, 25 bp, Mus musculus
ctggcgtcacttcgcaaacccggga

SEQ ID NO: 333581 - DNA, 25 bp, Mus musculus
gcaaacccgggagtcacactcggaa

SEQ ID NO: 333582 - DNA, 25 bp, Mus musculus
agagcgcacaggcttcagaggcagc

SEQ ID NO: 333583 - DNA, 25 bp, Mus musculus
agccacttgtgcaggaccaggtacc

SEQ ID NO: 333584 - DNA, 25 bp, Mus musculus
cggtgagcacgcttgggtatcccaa

SEQ ID NO: 333585 - DNA, 25 bp, Mus musculus
ctctctccacatgcccgcgggcgta

SEQ ID NO: 333586 - DNA, 25 bp, Mus musculus
agcacgcttgggtatcccaacctct

SEQ ID NO: 333587 - DNA, 25 bp, Mus musculus
caaggaggtgtatttcggtgagcac

SEQ ID NO: 333588 - DNA, 25 bp, Mus musculus
accaggtaccgccatgccgaagtgc

SEQ ID NO: 333589 - DNA, 25 bp, Mus musculus
tctagctgcagccacttgtgcagga

SEQ ID NO: 333590 - DNA, 25 bp, Mus musculus
gcaacctacttccttctagctgcag

SEQ ID NO: 333591 - DNA, 25 bp, Mus musculus
agagcctgcaacctacttccttcta

SEQ ID NO: 333592 - DNA, 25 bp, Mus musculus
ggtccctgaaaagcgcggaccaggc

SEQ ID NO: 333593 - DNA, 25 bp, Mus musculus
ccaggggtccaagtcccggactgag

SEQ ID NO: 333594 - DNA, 25 bp, Mus musculus
atcagcgttcccaggggtccaagtc

SEQ ID NO: 333595 - DNA, 25 bp, Mus musculus
gcctggatcagcgttcccaggggtc

SEQ ID NO: 333596 - DNA, 25 bp, Mus musculus
cccaagtgcgacaaggaggtgtatt

SEQ ID NO: 333597 - DNA, 25 bp, Mus musculus
ctacgggatagactggtaggcactc

SEQ ID NO: 333598 - DNA, 25 bp, Mus musculus
gaagagacttctggcgacgtggccc

SEQ ID NO: 333599 - DNA, 25 bp, Mus musculus
gcttcgcagagacactcccttcgtg

SEQ ID NO: 333600 - DNA, 25 bp, Mus musculus
ctgggtggagccacattgctccttc

SEQ ID NO: 333601 - DNA, 25 bp, Mus musculus
ctccagggaacacctcgggcgcatg

SEQ ID NO: 333602 - DNA, 25 bp, Mus musculus
gttgctaaggcggttgataagtcga

SEQ ID NO: 333603 - DNA, 25 bp, Mus musculus
tccaacggagttggcacctccaatc

SEQ ID NO: 333604 - DNA, 25 bp, Mus musculus
gccgcgccaagttcgatcgacctga

SEQ ID NO: 333605 - DNA, 25 bp, Mus musculus
tggtaggcactcaaacgccagagtc

SEQ ID NO: 333606 - DNA, 25 bp, Mus musculus
cagagtcatcgttcattgggcctga

SEQ ID NO: 333607 - DNA, 25 bp, Mus musculus
gcctcatccggaactgtgattggtc

SEQ ID NO: 333608 - DNA, 25 bp, Mus musculus
caatccgaggctgtctagtgctggc

SEQ ID NO: 333609 - DNA, 25 bp, Mus musculus
ctgctgggcccagcccagaaatctt

SEQ ID NO: 333610 - DNA, 25 bp, Mus musculus
cgaggtgctgattggtgagttccaa

SEQ ID NO: 333611 - DNA, 25 bp, Mus musculus
tttcagaactacaaggctgcgcggc

SEQ ID NO: 333612 - DNA, 25 bp, Mus musculus
gccaatatggcactcttccgcgata

SEQ ID NO: 333613 - DNA, 25 bp, Mus musculus
gctcagcctcgccactgtcaatgtg

SEQ ID NO: 333614 - DNA, 25 bp, Mus musculus
aagatgatgctgtacccggtgctca

SEQ ID NO: 333615 - DNA, 25 bp, Mus musculus
ctatatgctgctgttggtgctgccc

SEQ ID NO: 333616 - DNA, 25 bp, Mus musculus
ggcctcacctttttctattgctata

SEQ ID NO: 333617 - DNA, 25 bp, Mus musculus
ttgtggcactagaccgcatggaata

SEQ ID NO: 333618 - DNA, 25 bp, Mus musculus
ctctttgggacacagcaggacctcg

SEQ ID NO: 333619 - DNA, 25 bp, Mus musculus
tcgcaaggcgttgacactgctactg

SEQ ID NO: 333620 - DNA, 25 bp, Mus musculus
cgtgctggagatcaagctctatttc

SEQ ID NO: 333621 - DNA, 25 bp, Mus musculus
tggctacgctatgatcctctggttc

SEQ ID NO: 333622 - DNA, 25 bp, Mus musculus
ccgtcatggacgcatacctggtgga

SEQ ID NO: 333623 - DNA, 25 bp, Mus musculus
accacgctggtgatcatgggcagta

SEQ ID NO: 333624 - DNA, 25 bp, Mus musculus
actgctactgtctgtgtgcgtgcca

SEQ ID NO: 333625 - DNA, 25 bp, Mus musculus
cccacagtgccggtccgtgggctgt

SEQ ID NO: 333626 - DNA, 25 bp, Mus musculus
cgactgccacaacgggtgatggtgt

SEQ ID NO: 333627 - DNA, 25 bp, Mus musculus
tcgactgccacaacgggtgatggtg

SEQ ID NO: 333628 - DNA, 25 bp, Mus musculus
gtcgactgccacaacgggtgatggt

SEQ ID NO: 333629 - DNA, 25 bp, Mus musculus
ccggtccgtgggctgtgttctctta

SEQ ID NO: 333630 - DNA, 25 bp, Mus musculus
atggtcgactgccacaacgggtgat

SEQ ID NO: 333631 - DNA, 25 bp, Mus musculus
gttctcttagggtgcgctcgggcca

SEQ ID NO: 333632 - DNA, 25 bp, Mus musculus
cggtccgtgggctgtgttctcttag

SEQ ID NO: 333633 - DNA, 25 bp, Mus musculus
acgatggtcgactgccacaacgggt

SEQ ID NO: 333634 - DNA, 25 bp, Mus musculus
ccacgatggtcgactgccacaacgg

SEQ ID NO: 333635 - DNA, 25 bp, Mus musculus
gccacgatggtcgactgccacaacg

SEQ ID NO: 333636 - DNA, 25 bp, Mus musculus
cacaacgggtgatggtgtcggaggt

SEQ ID NO: 333637 - DNA, 25 bp, Mus musculus
cggccacgatggtcgactgccacaa

SEQ ID NO: 333638 - DNA, 25 bp, Mus musculus
ggccacgatggtcgactgccacaac

SEQ ID NO: 333639 - DNA, 25 bp, Mus musculus
tcctccttgcggtgctggtgccaag

SEQ ID NO: 333640 - DNA, 25 bp, Mus musculus
tggtgccaagctctggatccacgcg

SEQ ID NO: 333641 - DNA, 25 bp, Mus musculus
ccgggcccacaagagaggtaagcgc

SEQ ID NO: 333642 - DNA, 25 bp, Mus musculus
agctctggatccacgcgggttacag

SEQ ID NO: 333643 - DNA, 25 bp, Mus musculus
gtgcgctcgggccagtcctgcctcc

SEQ ID NO: 333644 - DNA, 25 bp, Mus musculus
tgccaagctctggatccacgcgggt

SEQ ID NO: 333645 - DNA, 25 bp, Mus musculus
tgctggtgccaagctctggatccac

SEQ ID NO: 333646 - DNA, 25 bp, Mus musculus
ccttgcggtgctggtgccaagctct

SEQ ID NO: 333647 - DNA, 25 bp, Mus musculus
atccacgcgggttacagggacgcct

SEQ ID NO: 333648 - DNA, 25 bp, Mus musculus
cccacaagagaggtaagcgcagccc

SEQ ID NO: 333649 - DNA, 25 bp, Mus musculus
tccgaagagaaacaaagcggcggcc

SEQ ID NO: 333650 - DNA, 25 bp, Mus musculus
ttctccgaagagaaacaaagcggcg

SEQ ID NO: 333651 - DNA, 25 bp, Mus musculus
cctagttttcgctttcgcttttgct

SEQ ID NO: 333652 - DNA, 25 bp, Mus musculus
caagctctggatccacgcgggttac

SEQ ID NO: 333653 - DNA, 25 bp, Mus musculus
acctttgtgttggaaaatgtgagcg

SEQ ID NO: 333654 - DNA, 25 bp, Mus musculus
catcccgtacgcgacctttgtgttg

SEQ ID NO: 333655 - DNA, 25 bp, Mus musculus
ctgcacggacctggcgtcctcgggt

SEQ ID NO: 333656 - DNA, 25 bp, Mus musculus
ttgagtaggcgggagtctgcgctcc

SEQ ID NO: 333657 - DNA, 25 bp, Mus musculus
agcaatggtcgcgaggctgcgcgga

SEQ ID NO: 333658 - DNA, 25 bp, Mus musculus
catggagatggtgagcaatggtcgc

SEQ ID NO: 333659 - DNA, 25 bp, Mus musculus
gagatgcaggagagccatggagatg

SEQ ID NO: 333660 - DNA, 25 bp, Mus musculus
cgaaatcacgggtgctggagatgca

SEQ ID NO: 333661 - DNA, 25 bp, Mus musculus
ccttacgaaatcacgggtgctggag

SEQ ID NO: 333662 - DNA, 25 bp, Mus musculus
gcgtgttttccagcttttggaagcc

SEQ ID NO: 333663 - DNA, 25 bp, Mus musculus
tacgcgacctttgtgttggaaaatg

SEQ ID NO: 333664 - DNA, 25 bp, Mus musculus
ttgtgttggaaaatgtgagcgtgtt

SEQ ID NO: 333665 - DNA, 25 bp, Mus musculus
cgcgacctttgtgttggaaaatgtg

SEQ ID NO: 333666 - DNA, 25 bp, Mus musculus
atgtgagcgtgttttccagcttttg

SEQ ID NO: 333667 - DNA, 25 bp, Mus musculus
acctccgagtcccagcacgagcggg

SEQ ID NO: 333668 - DNA, 25 bp, Mus musculus
acctgctactgctggttgctggtgc

SEQ ID NO: 333669 - DNA, 25 bp, Mus musculus
tggaccgcggggctcacctccgagt

SEQ ID NO: 333670 - DNA, 25 bp, Mus musculus
accgtgctgctgaggcgccaaggac

SEQ ID NO: 333671 - DNA, 25 bp, Mus musculus
atcctgcagtggaccgcggggctca

SEQ ID NO: 333672 - DNA, 25 bp, Mus musculus
aagaggcgcatcctgcagtggaccg

SEQ ID NO: 333673 - DNA, 25 bp, Mus musculus
acttcccgaagaggcgcatcctgca

SEQ ID NO: 333674 - DNA, 25 bp, Mus musculus
gggtgagtgaacccgcgcccacttc

SEQ ID NO: 333675 - DNA, 25 bp, Mus musculus
acgctgagcccaagatgagggcgtc

SEQ ID NO: 333676 - DNA, 25 bp, Mus musculus
gccaaggaccgaggcagcacgctga

SEQ ID NO: 333677 - DNA, 25 bp, Mus musculus
aggcagcacgctgagcccaagatga

SEQ ID NO: 333678 - DNA, 25 bp, Mus musculus
tcggtggtgctgacctgctactgct

SEQ ID NO: 333679 - DNA, 25 bp, Mus musculus
cgataggcgcgagactgaggaaatc

SEQ ID NO: 333680 - DNA, 25 bp, Mus musculus
cgcgagactgaggaaatccgcgctg

SEQ ID NO: 333681 - DNA, 25 bp, Mus musculus
cgtcgctcagctctaccagccagcc

SEQ ID NO: 333682 - DNA, 25 bp, Mus musculus
cgcgcccgtgttttctgcaaacacg

SEQ ID NO: 333683 - DNA, 25 bp, Mus musculus
tgcgcgcccgtgttttctgcaaaca

SEQ ID NO: 333684 - DNA, 25 bp, Mus musculus
ctgcgcgcccgtgttttctgcaaac

SEQ ID NO: 333685 - DNA, 25 bp, Mus musculus
tcctagcaacgggccgaaggcgctg

SEQ ID NO: 333686 - DNA, 25 bp, Mus musculus
gcctgctgcgacttgggtcccagga

SEQ ID NO: 333687 - DNA, 25 bp, Mus musculus
ggcgcaccgaccttcccaggctcca

SEQ ID NO: 333688 - DNA, 25 bp, Mus musculus
gccagccaggcctgctgcgacttgg

SEQ ID NO: 333689 - DNA, 25 bp, Mus musculus
ttcccaggctccatcgctcctcgag

SEQ ID NO: 333690 - DNA, 25 bp, Mus musculus
cgaggccgggacagccgcgtgtcct

SEQ ID NO: 333691 - DNA, 25 bp, Mus musculus
cagccaggcctgctgcgacttgggt

SEQ ID NO: 333692 - DNA, 25 bp, Mus musculus
aggctccatcgctcctcgaggccgg

SEQ ID NO: 333693 - DNA, 25 bp, Mus musculus
gaggaagataaacccgccgtcgctc

SEQ ID NO: 333694 - DNA, 25 bp, Mus musculus
ataaacccgccgtcgctcagctcta

SEQ ID NO: 333695 - DNA, 25 bp, Mus musculus
ccggagagtagcagcacagcaaccc

SEQ ID NO: 333696 - DNA, 25 bp, Mus musculus
tgattgcgtcaccaaaccacgcact

SEQ ID NO: 333697 - DNA, 25 bp, Mus musculus
caagtcccgcccgtttgaggagtgg

SEQ ID NO: 333698 - DNA, 25 bp, Mus musculus
ccggtgtacgccctgggctacctgg

SEQ ID NO: 333699 - DNA, 25 bp, Mus musculus
cctagattctttcagggtcggctgt

SEQ ID NO: 333700 - DNA, 25 bp, Mus musculus
tgtctctgaacagtggatcccagtg

SEQ ID NO: 333701 - DNA, 25 bp, Mus musculus
ggcgcatgctgattgcgtcaccaaa

SEQ ID NO: 333702 - DNA, 25 bp, Mus musculus
atgacggcaagtcccgcccgtttga

SEQ ID NO: 333703 - DNA, 25 bp, Mus musculus
ttcttggtgtaacgaccggagagta

SEQ ID NO: 333704 - DNA, 25 bp, Mus musculus
gccctgcgcactgtgatgacggcaa

SEQ ID NO: 333705 - DNA, 25 bp, Mus musculus
gaccgcgcgatgacaccaggcacag

SEQ ID NO: 333706 - DNA, 25 bp, Mus musculus
atccggttggcgactgacacgtcgc

SEQ ID NO: 333707 - DNA, 25 bp, Mus musculus
aggcacagaccattcgccgccgggg

SEQ ID NO: 333708 - DNA, 25 bp, Mus musculus
ccctgcgagccaagtccgggtgtgt

SEQ ID NO: 333709 - DNA, 25 bp, Mus musculus
tgtgtttgaatctggtccgagcgcg

SEQ ID NO: 333710 - DNA, 25 bp, Mus musculus
gcgcatcccgtgagcgcgctaaaga

SEQ ID NO: 333711 - DNA, 25 bp, Mus musculus
cgctaaagagactcccgccagaggc

SEQ ID NO: 333712 - DNA, 25 bp, Mus musculus
cagaggctctgagtcacgcccagga

SEQ ID NO: 333713 - DNA, 25 bp, Mus musculus
tatacgcgggtgtgtttgaatctgg

SEQ ID NO: 333714 - DNA, 25 bp, Mus musculus
tccgagcgcgggaaactatgggtct

SEQ ID NO: 333715 - DNA, 25 bp, Mus musculus
tgggaaggatcccagaccgagaagc

SEQ ID NO: 333716 - DNA, 25 bp, Mus musculus
cagggaggatctcagcctggaaccc

SEQ ID NO: 333717 - DNA, 25 bp, Mus musculus
cgggttcactaggtaggacctcaga

SEQ ID NO: 333718 - DNA, 25 bp, Mus musculus
gtaggacctcagactaggacgaccc

SEQ ID NO: 333719 - DNA, 25 bp, Mus musculus
cccgagtgtgactggcgaggactcc

SEQ ID NO: 333720 - DNA, 25 bp, Mus musculus
cgaggactccggaaaatgacctgcg

SEQ ID NO: 333721 - DNA, 25 bp, Mus musculus
gcgggaaacacagccagcagctctg

SEQ ID NO: 333722 - DNA, 25 bp, Mus musculus
gccgccatcggtttcgagcgcttgt

SEQ ID NO: 333723 - DNA, 25 bp, Mus musculus
ctaattgcgcttcccgccagctgcg

SEQ ID NO: 333724 - DNA, 25 bp, Mus musculus
ccgagcctttgaagtgctgcgcccg

SEQ ID NO: 333725 - DNA, 25 bp, Mus musculus
ctcctcggtcgcctgccggggaaag

SEQ ID NO: 333726 - DNA, 25 bp, Mus musculus
tcgcctgccggggaaagcaccgcga

SEQ ID NO: 333727 - DNA, 25 bp, Mus musculus
accgcgagccgccaggcgcttttat

SEQ ID NO: 333728 - DNA, 25 bp, Mus musculus
cgccaggcgcttttatggggctcac

SEQ ID NO: 333729 - DNA, 25 bp, Mus musculus
cttttatggggctcacggtaatgcg

SEQ ID NO: 333730 - DNA, 25 bp, Mus musculus
ggctcacggtaatgcgggttaatct

SEQ ID NO: 333731 - DNA, 25 bp, Mus musculus
gcgggttaatctgcaaagaatttta

SEQ ID NO: 333732 - DNA, 25 bp, Mus musculus
gaattttaagaacatgcttcgtgca

SEQ ID NO: 333733 - DNA, 25 bp, Mus musculus
aacatgcttcgtgcagcgggctttg

SEQ ID NO: 333734 - DNA, 25 bp, Mus musculus
aggggcctcgcaagccggaaatgaa

SEQ ID NO: 333735 - DNA, 25 bp, Mus musculus
gcaagccggaaatgaacgtgggacc

SEQ ID NO: 333736 - DNA, 25 bp, Mus musculus
gcccgcccgagcctttgaagtgctg

SEQ ID NO: 333737 - DNA, 25 bp, Mus musculus
ctcgctaagtccctatcggtccttg

SEQ ID NO: 333738 - DNA, 25 bp, Mus musculus
ccggtgaagactggaccgacatttt

SEQ ID NO: 333739 - DNA, 25 bp, Mus musculus
caaatcctcggtctgccggtgaaga

SEQ ID NO: 333740 - DNA, 25 bp, Mus musculus
gaggctgtcctctcctgctaccatg

SEQ ID NO: 333741 - DNA, 25 bp, Mus musculus
tgggtccttccatggaggctgtcct

SEQ ID NO: 333742 - DNA, 25 bp, Mus musculus
ccgcgtgctacctgaagggccagga

SEQ ID NO: 333743 - DNA, 25 bp, Mus musculus
tcgtgttccctacgtgtgtccgtgc

SEQ ID NO: 333744 - DNA, 25 bp, Mus musculus
atgagccctgcctgctctcgtgttc

SEQ ID NO: 333745 - DNA, 25 bp, Mus musculus
cccaagtgtctatgagccctgcctg

SEQ ID NO: 333746 - DNA, 25 bp, Mus musculus
ttgtgcatcccggagtgtccacgct

SEQ ID NO: 333747 - DNA, 25 bp, Mus musculus
ctgggacagctcaaccatacggttg

SEQ ID NO: 333748 - DNA, 25 bp, Mus musculus
cctgcgtcaaggacctgggacagct

SEQ ID NO: 333749 - DNA, 25 bp, Mus musculus
gacattttcctttcctgacacgcgg

SEQ ID NO: 333750 - DNA, 25 bp, Mus musculus
gccatggactgagcgccaaccggct

SEQ ID NO: 333751 - DNA, 25 bp, Mus musculus
ctcgtcagtggcttcaatgcaggga

SEQ ID NO: 333752 - DNA, 25 bp, Mus musculus
ggacgcgcggcacctttgtttccac

SEQ ID NO: 333753 - DNA, 25 bp, Mus musculus
ttccacccgcctcctgagaagtttg

SEQ ID NO: 333754 - DNA, 25 bp, Mus musculus
ccgcctcctgagaagtttgtggtca

SEQ ID NO: 333755 - DNA, 25 bp, Mus musculus
tttgtggtcagaagcaggatggccc

SEQ ID NO: 333756 - DNA, 25 bp, Mus musculus
ccctctcgtcagtggcttcaatgca

SEQ ID NO: 333757 - DNA, 25 bp, Mus musculus
tcaatgcagggaagcagttggttgc

SEQ ID NO: 333758 - DNA, 25 bp, Mus musculus
ttgcgatgatggcgctgtcgccagc

SEQ ID NO: 333759 - DNA, 25 bp, Mus musculus
cgctgagccccgaagcggcttagca

SEQ ID NO: 333760 - DNA, 25 bp, Mus musculus
cctgcacccgcccacgcagcgtcag

SEQ ID NO: 333761 - DNA, 25 bp, Mus musculus
gcagcgtcaggacccggtgcgccta

SEQ ID NO: 333762 - DNA, 25 bp, Mus musculus
gcctcgcagaactgcctgcaccctc

SEQ ID NO: 333763 - DNA, 25 bp, Mus musculus
accctcggctcggagcgagtgctac

SEQ ID NO: 333764 - DNA, 25 bp, Mus musculus
tcaggacccggtgcgcctagccagg

SEQ ID NO: 333765 - DNA, 25 bp, Mus musculus
gctctgtcaagatgcagccgccttg

SEQ ID NO: 333766 - DNA, 25 bp, Mus musculus
cgccgcaaccgtcagggcatcagga

SEQ ID NO: 333767 - DNA, 25 bp, Mus musculus
cgccctctcgctgcctggcgaaggc

SEQ ID NO: 333768 - DNA, 25 bp, Mus musculus
ccctagatgcacctgagcgcacccg

SEQ ID NO: 333769 - DNA, 25 bp, Mus musculus
gcctgagccgcagtcgcgccctctc

SEQ ID NO: 333770 - DNA, 25 bp, Mus musculus
cggtgggctctgtcaagatgcagcc

SEQ ID NO: 333771 - DNA, 25 bp, Mus musculus
tgcagccgccttgcgagagtccggc

SEQ ID NO: 333772 - DNA, 25 bp, Mus musculus
ccgatggccctctgcgccgcagccc

SEQ ID NO: 333773 - DNA, 25 bp, Mus musculus
ggccgcgcctcagggacctgcctgc

SEQ ID NO: 333774 - DNA, 25 bp, Mus musculus
gctcacgctgcggaggaagcggagc

SEQ ID NO: 333775 - DNA, 25 bp, Mus musculus
cgcgcacgtggagccctcgactgcc

SEQ ID NO: 333776 - DNA, 25 bp, Mus musculus
cccgccacgccgtggctggaagttg

SEQ ID NO: 333777 - DNA, 25 bp, Mus musculus
agtgtctcagccgtccggaggtgag

SEQ ID NO: 333778 - DNA, 25 bp, Mus musculus
ccctcgggctgcgacggccaccctt

SEQ ID NO: 333779 - DNA, 25 bp, Mus musculus
tcccgcgccggccttaaggcttgga

SEQ ID NO: 333780 - DNA, 25 bp, Mus musculus
cccatctgaactcagtgcgctgttc

SEQ ID NO: 333781 - DNA, 25 bp, Mus musculus
ccttaaggcttggaccgcaggtgga

SEQ ID NO: 333782 - DNA, 25 bp, Mus musculus
agtctcccgcgcgaacctgagcgga

SEQ ID NO: 333783 - DNA, 25 bp, Mus musculus
cgggagggcagcgtgcaatttctcc

SEQ ID NO: 333784 - DNA, 25 bp, Mus musculus
gtgcgctgttccacggcaaactccg

SEQ ID NO: 333785 - DNA, 25 bp, Mus musculus
tggaactcaggccacgaggacacgg

SEQ ID NO: 333786 - DNA, 25 bp, Mus musculus
tggggatgcctattctggagctgca

SEQ ID NO: 333787 - DNA, 25 bp, Mus musculus
gtgcgcgtggctccctgctgtacca

SEQ ID NO: 333788 - DNA, 25 bp, Mus musculus
tgctgggaacttaggtcctgtagga

SEQ ID NO: 333789 - DNA, 25 bp, Mus musculus
cacgcgctcccaggtgagggtttcc

SEQ ID NO: 333790 - DNA, 25 bp, Mus musculus
ctacgcaacactcctggaactcagg

SEQ ID NO: 333791 - DNA, 25 bp, Mus musculus
gaagatggagctggccacgcgctcc

SEQ ID NO: 333792 - DNA, 25 bp, Mus musculus
ctcagaggcgcgtgcagcctcagct

SEQ ID NO: 333793 - DNA, 25 bp, Mus musculus
agggcaaagcgttgcactctccttg

SEQ ID NO: 333794 - DNA, 25 bp, Mus musculus
tcgtcctcctgctctgaggggctga

SEQ ID NO: 333795 - DNA, 25 bp, Mus musculus
cctgtgctgccatctcgtacctaga

SEQ ID NO: 333796 - DNA, 25 bp, Mus musculus
agaggattcttggagtcgtgcgcca

SEQ ID NO: 333797 - DNA, 25 bp, Mus musculus
cgggaacctcaacgcctggcgcaga

SEQ ID NO: 333798 - DNA, 25 bp, Mus musculus
ggtggtcatcgctctccagatactg

SEQ ID NO: 333799 - DNA, 25 bp, Mus musculus
gtctcctaggacctgccggtggtca

SEQ ID NO: 333800 - DNA, 25 bp, Mus musculus
cgccaaggaggctatcaccgagcca

SEQ ID NO: 333801 - DNA, 25 bp, Mus musculus
ctctgcctgcagagctaggtgcact

SEQ ID NO: 333802 - DNA, 25 bp, Mus musculus
cagcgcgtcccgttgccagggagat

SEQ ID NO: 333803 - DNA, 25 bp, Mus musculus
agtgctctccaaaaagtctcctagg

SEQ ID NO: 333804 - DNA, 25 bp, Mus musculus
accaggctggcaggaccagtgctct

SEQ ID NO: 333805 - DNA, 25 bp, Mus musculus
gtcgcaacactaaacaccaggctgg

SEQ ID NO: 333806 - DNA, 25 bp, Mus musculus
ctcgtacctagagaggattcttgga

SEQ ID NO: 333807 - DNA, 25 bp, Mus musculus
ttaacaggacaaaccctctcagaga

SEQ ID NO: 333808 - DNA, 25 bp, Mus musculus
cagctcctctctccgccagagcccg

SEQ ID NO: 333809 - DNA, 25 bp, Mus musculus
gctgtggcgtagcagctcctctctc

SEQ ID NO: 333810 - DNA, 25 bp, Mus musculus
ttccgcagaaatggcgcgccgctgg

SEQ ID NO: 333811 - DNA, 25 bp, Mus musculus
tctttttccgcagaaatggcgcgcc

SEQ ID NO: 333812 - DNA, 25 bp, Mus musculus
ggctctgcctctttttccgcagaaa

SEQ ID NO: 333813 - DNA, 25 bp, Mus musculus
acaggctctgcctctttttccgcag

SEQ ID NO: 333814 - DNA, 25 bp, Mus musculus
gggtggagaatacgtaccgctcatc

SEQ ID NO: 333815 - DNA, 25 bp, Mus musculus
acaaaccctctcagagacactggga

SEQ ID NO: 333816 - DNA, 25 bp, Mus musculus
cgcattaacaggacaaaccctctca

SEQ ID NO: 333817 - DNA, 25 bp, Mus musculus
gctcatcccgcattaacaggacaaa

SEQ ID NO: 333818 - DNA, 25 bp, Mus musculus
atacgtaccgctcatcccgcattaa

SEQ ID NO: 333819 - DNA, 25 bp, Mus musculus
tggagaatacgtaccgctcatcccg

SEQ ID NO: 333820 - DNA, 25 bp, Mus musculus
ggctgtagctggcacaggctctgcc

SEQ ID NO: 333821 - DNA, 25 bp, Mus musculus
cgacccgattggtggctaggactgc

SEQ ID NO: 333822 - DNA, 25 bp, Mus musculus
tagcgtcgcccgcaccgggagggag

SEQ ID NO: 333823 - DNA, 25 bp, Mus musculus
tgccctctgagcaatgttggtagag

SEQ ID NO: 333824 - DNA, 25 bp, Mus musculus
atgccctctgagcaatgttggtaga

SEQ ID NO: 333825 - DNA, 25 bp, Mus musculus
catgccctctgagcaatgttggtag

SEQ ID NO: 333826 - DNA, 25 bp, Mus musculus
ccatgccctctgagcaatgttggta

SEQ ID NO: 333827 - DNA, 25 bp, Mus musculus
tccatgccctctgagcaatgttggt

SEQ ID NO: 333828 - DNA, 25 bp, Mus musculus
ctccatgccctctgagcaatgttgg

SEQ ID NO: 333829 - DNA, 25 bp, Mus musculus
gtggcggcttcgacccctgcgagct

SEQ ID NO: 333830 - DNA, 25 bp, Mus musculus
ttcccaccgagcaggagcttccatt

SEQ ID NO: 333831 - DNA, 25 bp, Mus musculus
gacttgtcttctagggtggccacga

SEQ ID NO: 333832 - DNA, 25 bp, Mus musculus
ggtgcagattagtgacttgtcttct

SEQ ID NO: 333833 - DNA, 25 bp, Mus musculus
ctggctgctggtgcagattagtgac

SEQ ID NO: 333834 - DNA, 25 bp, Mus musculus
tatttgtcgtatctctggctggctg

SEQ ID NO: 333835 - DNA, 25 bp, Mus musculus
gcaggagcttccattttatttgtcg

SEQ ID NO: 333836 - DNA, 25 bp, Mus musculus
agcgcgaggcctgtgttcccaccga

SEQ ID NO: 333837 - DNA, 25 bp, Mus musculus
ttgctcacctagcttgccggggcct

SEQ ID NO: 333838 - DNA, 25 bp, Mus musculus
ctgctttctttgctcacctagcttg

SEQ ID NO: 333839 - DNA, 25 bp, Mus musculus
atgaagctgacttggggtacatccc

SEQ ID NO: 333840 - DNA, 25 bp, Mus musculus
ccacgagtgcgccttagagtctgcg

SEQ ID NO: 333841 - DNA, 25 bp, Mus musculus
gtttgcctgggcctatcggccgagt

SEQ ID NO: 333842 - DNA, 25 bp, Mus musculus
gcgccttagagtctgcgttcttggc

SEQ ID NO: 333843 - DNA, 25 bp, Mus musculus
tcctcggggtttgaatgaagctgac

SEQ ID NO: 333844 - DNA, 25 bp, Mus musculus
agccctaaagccgagaatcccgacg

SEQ ID NO: 333845 - DNA, 25 bp, Mus musculus
taccgtgtctgtacagcaaggcggg

SEQ ID NO: 333846 - DNA, 25 bp, Mus musculus
ggcgagagcagacacggccctcagc

SEQ ID NO: 333847 - DNA, 25 bp, Mus musculus
ccctttggcgagagcagacacggcc

SEQ ID NO: 333848 - DNA, 25 bp, Mus musculus
ttcccgcccgcagggtgtgcaagct

SEQ ID NO: 333849 - DNA, 25 bp, Mus musculus
cgcaacaagcaacccggggcgtgct

SEQ ID NO: 333850 - DNA, 25 bp, Mus musculus
ccttcttcttcagagaagtcggacc

SEQ ID NO: 333851 - DNA, 25 bp, Mus musculus
accttggtccgggacgcgtgcgctc

SEQ ID NO: 333852 - DNA, 25 bp, Mus musculus
aggaaagagagcactactgaggacc

SEQ ID NO: 333853 - DNA, 25 bp, Mus musculus
ctgaggacctgaatattcggggagc

SEQ ID NO: 333854 - DNA, 25 bp, Mus musculus
gggagcagccctaaagccgagaatc

SEQ ID NO: 333855 - DNA, 25 bp, Mus musculus
catcgctcagagcaggtgtcaggtg

SEQ ID NO: 333856 - DNA, 25 bp, Mus musculus
gcctccaggacatcgctcagagcag

SEQ ID NO: 333857 - DNA, 25 bp, Mus musculus
agcctgaggctaccgtgtctgtaca

SEQ ID NO: 333858 - DNA, 25 bp, Mus musculus
cccggtcgcttagcaaagctgggga

SEQ ID NO: 333859 - DNA, 25 bp, Mus musculus
cccacttgctttatttagtagcctg

SEQ ID NO: 333860 - DNA, 25 bp, Mus musculus
ttgctttatttagtagcctgcgcgc

SEQ ID NO: 333861 - DNA, 25 bp, Mus musculus
ttatttagtagcctgcgcgcttccg

SEQ ID NO: 333862 - DNA, 25 bp, Mus musculus
accaggtgcccacactgaggagaga

SEQ ID NO: 333863 - DNA, 25 bp, Mus musculus
acactgaggagagagtgaagcaccc

SEQ ID NO: 333864 - DNA, 25 bp, Mus musculus
cagcgcgctcagtcgcggaggacag

SEQ ID NO: 333865 - DNA, 25 bp, Mus musculus
agctggggagttgcagccaagcctt

SEQ ID NO: 333866 - DNA, 25 bp, Mus musculus
cagccaagccttgggcaacccagaa

SEQ ID NO: 333867 - DNA, 25 bp, Mus musculus
cccagaagccagcagctggcttatc

SEQ ID NO: 333868 - DNA, 25 bp, Mus musculus
cagcagctggcttatccgtagcctg

SEQ ID NO: 333869 - DNA, 25 bp, Mus musculus
ttatccgtagcctgcggaggtacga

SEQ ID NO: 333870 - DNA, 25 bp, Mus musculus
agcctgcggaggtacgacgcgctcc

SEQ ID NO: 333871 - DNA, 25 bp, Mus musculus
cttcccacctttcctgccagggtcg

SEQ ID NO: 333872 - DNA, 25 bp, Mus musculus
cgtgcccaccgagcggccagtaaag

SEQ ID NO: 333873 - DNA, 25 bp, Mus musculus
ctctcgatctgtgcgagccaggtcg

SEQ ID NO: 333874 - DNA, 25 bp, Mus musculus
gccgcgcaccctgaagcagaagctt

SEQ ID NO: 333875 - DNA, 25 bp, Mus musculus
caagtggccgcgttcaccagtttgt

SEQ ID NO: 333876 - DNA, 25 bp, Mus musculus
gcactcggctacctgtgacacctta

SEQ ID NO: 333877 - DNA, 25 bp, Mus musculus
ctgtgacaccttaaagatcgcggtc

SEQ ID NO: 333878 - DNA, 25 bp, Mus musculus
agatcgcggtcatcaataaagctcg

SEQ ID NO: 333879 - DNA, 25 bp, Mus musculus
tgctggcggaggtcttccctctcga

SEQ ID NO: 333880 - DNA, 25 bp, Mus musculus
caccgagcggccagtaaagaaggga

SEQ ID NO: 333881 - DNA, 25 bp, Mus musculus
tgctcagcgccttccgagcttcccg

SEQ ID NO: 333882 - DNA, 25 bp, Mus musculus
caaagcagggacagtggagctccgc

SEQ ID NO: 333883 - DNA, 25 bp, Mus musculus
cttcatgcctgaggcgctggagaca

SEQ ID NO: 333884 - DNA, 25 bp, Mus musculus
agcagaagcttcatgcctgaggcgc

SEQ ID NO: 333885 - DNA, 25 bp, Mus musculus
ggtcatcaataaagctcgccgcgca

SEQ ID NO: 333886 - DNA, 25 bp, Mus musculus
tctgcccttgctaggtcacggtttt

SEQ ID NO: 333887 - DNA, 25 bp, Mus musculus
gttgtacgaccactctctgcccttg

SEQ ID NO: 333888 - DNA, 25 bp, Mus musculus
cccgctctcggtggttgtacgacca

SEQ ID NO: 333889 - DNA, 25 bp, Mus musculus
gtcacacacgtagttactcggcccg

SEQ ID NO: 333890 - DNA, 25 bp, Mus musculus
ggactcagttaccttacacactttc

SEQ ID NO: 333891 - DNA, 25 bp, Mus musculus
gctttctacactgctctctccgagg

SEQ ID NO: 333892 - DNA, 25 bp, Mus musculus
cccgggattgaacgtactgtcgctc

SEQ ID NO: 333893 - DNA, 25 bp, Mus musculus
tgctctctccgaggtgggtcacact

SEQ ID NO: 333894 - DNA, 25 bp, Mus musculus
ggtgggtcacactcgcgatcatttt

SEQ ID NO: 333895 - DNA, 25 bp, Mus musculus
gcgatcatttttcacgcgcgcgcac

SEQ ID NO: 333896 - DNA, 25 bp, Mus musculus
ctccgcggcacttcaaagccggaga

SEQ ID NO: 333897 - DNA, 25 bp, Mus musculus
caaagccggagagggagctacaatt

SEQ ID NO: 333898 - DNA, 25 bp, Mus musculus
tccctacggtagaaggactcagtta

SEQ ID NO: 333899 - DNA, 25 bp, Mus musculus
gtcgctcctgactccctacggtaga

SEQ ID NO: 333900 - DNA, 25 bp, Mus musculus
gccctttgccaacgactactctgtg

SEQ ID NO: 333901 - DNA, 25 bp, Mus musculus
ctgttctgcggtaagcgctttacgc

SEQ ID NO: 333902 - DNA, 25 bp, Mus musculus
ccgttcgtgtgcaattggctgttct

SEQ ID NO: 333903 - DNA, 25 bp, Mus musculus
agcctgcgtcgcaaagggctgcata

SEQ ID NO: 333904 - DNA, 25 bp, Mus musculus
cctcatggacggtttcaagccggta

SEQ ID NO: 333905 - DNA, 25 bp, Mus musculus
cattcagtagcggtgcctcgtcgca

SEQ ID NO: 333906 - DNA, 25 bp, Mus musculus
actcggattattccggcctgagcca

SEQ ID NO: 333907 - DNA, 25 bp, Mus musculus
tgcattcaccgctgggaggctacaa

SEQ ID NO: 333908 - DNA, 25 bp, Mus musculus
gggccttcagacgtcgctgcattca

SEQ ID NO: 333909 - DNA, 25 bp, Mus musculus
gcgcacccgtatgagtcctggttca

SEQ ID NO: 333910 - DNA, 25 bp, Mus musculus
agccagtgtttatctccaaggtgca

SEQ ID NO: 333911 - DNA, 25 bp, Mus musculus
ggatagctcccatcagccagtgttt

SEQ ID NO: 333912 - DNA, 25 bp, Mus musculus
ccggagcgcactcgcaggatagctc

SEQ ID NO: 333913 - DNA, 25 bp, Mus musculus
cccggtgtgcaacaaacgcttcatg

SEQ ID NO: 333914 - DNA, 25 bp, Mus musculus
ctctcagtaggcgatacaggtattc

SEQ ID NO: 333915 - DNA, 25 bp, Mus musculus
ataatgcaaagcagcccgcccggtg

SEQ ID NO: 333916 - DNA, 25 bp, Mus musculus
ccggtgcctactgcctagttgcttt

SEQ ID NO: 333917 - DNA, 25 bp, Mus musculus
gcctagttgctttcctgatgcgctc

SEQ ID NO: 333918 - DNA, 25 bp, Mus musculus
cctgatgcgctctcccgacttgaga

SEQ ID NO: 333919 - DNA, 25 bp, Mus musculus
ctcccgacttgagagcgcaccttga

SEQ ID NO: 333920 - DNA, 25 bp, Mus musculus
gttggccgacccagttgctctcagt

SEQ ID NO: 333921 - DNA, 25 bp, Mus musculus
tacaggtattcggtccagggcagct

SEQ ID NO: 333922 - DNA, 25 bp, Mus musculus
agggcagctctctgcatctcagggc

SEQ ID NO: 333923 - DNA, 25 bp, Mus musculus
gcggggcttgcagtctcaacaaaaa

SEQ ID NO: 333924 - DNA, 25 bp, Mus musculus
aagcacctccttggacagccgatgg

SEQ ID NO: 333925 - DNA, 25 bp, Mus musculus
gcgaagcaagtacgggctccacagt

SEQ ID NO: 333926 - DNA, 25 bp, Mus musculus
gtgggctgcgagtccctaggacctt

SEQ ID NO: 333927 - DNA, 25 bp, Mus musculus
ctctgcatctcagggcccttaaggc

SEQ ID NO: 333928 - DNA, 25 bp, Mus musculus
accgtggcggccatctagcttagcc

SEQ ID NO: 333929 - DNA, 25 bp, Mus musculus
ctgcggctcccctttgtcagagtcc

SEQ ID NO: 333930 - DNA, 25 bp, Mus musculus
gtggcggccatctagcttagcccgc

SEQ ID NO: 333931 - DNA, 25 bp, Mus musculus
acaggcacagacaggccctgagcac

SEQ ID NO: 333932 - DNA, 25 bp, Mus musculus
caggcacagacaggccctgagcaca

SEQ ID NO: 333933 - DNA, 25 bp, Mus musculus
agacaggccctgagcacacatcgcc

SEQ ID NO: 333934 - DNA, 25 bp, Mus musculus
cacaggcacagacaggccctgagca

SEQ ID NO: 333935 - DNA, 25 bp, Mus musculus
cggcggaggcggagtaggagtccgc

SEQ ID NO: 333936 - DNA, 25 bp, Mus musculus
ggagtccgcgccgtggggcgatgcc

SEQ ID NO: 333937 - DNA, 25 bp, Mus musculus
cgtggcggccatctagcttagcccg

SEQ ID NO: 333938 - DNA, 25 bp, Mus musculus
tggcggccatctagcttagcccgcg

SEQ ID NO: 333939 - DNA, 25 bp, Mus musculus
ggccatctagcttagcccgcgccgg

SEQ ID NO: 333940 - DNA, 25 bp, Mus musculus
atctagcttagcccgcgccgggagg

SEQ ID NO: 333941 - DNA, 25 bp, Mus musculus
acagacaggccctgagcacacatcg

SEQ ID NO: 333942 - DNA, 25 bp, Mus musculus
tcccgggctttgatcttccgtaaca

SEQ ID NO: 333943 - DNA, 25 bp, Mus musculus
cgttcctttctatctgccaccaatt

SEQ ID NO: 333944 - DNA, 25 bp, Mus musculus
atctgccaccaattcggcgtttcca

SEQ ID NO: 333945 - DNA, 25 bp, Mus musculus
attcggcgtttccacgcagtcgtcg

SEQ ID NO: 333946 - DNA, 25 bp, Mus musculus
gcgcagattcgcctcgttcctttct

SEQ ID NO: 333947 - DNA, 25 bp, Mus musculus
gatcttccgtaacacggcctgtttg

SEQ ID NO: 333948 - DNA, 25 bp, Mus musculus
cagggaagatacgtcccgggctttg

SEQ ID NO: 333949 - DNA, 25 bp, Mus musculus
cagcacgcctcaccttcagggaaga

SEQ ID NO: 333950 - DNA, 25 bp, Mus musculus
gtttccacgcagtcgtcgccgggcg

SEQ ID NO: 333951 - DNA, 25 bp, Mus musculus
cgtgtgaatcagtgtgcagagcgca

SEQ ID NO: 333952 - DNA, 25 bp, Mus musculus
gtcctctgcgcccaccgatgctgag

SEQ ID NO: 333953 - DNA, 25 bp, Mus musculus
tcccgcacaggtcagcgccaagcta

SEQ ID NO: 333954 - DNA, 25 bp, Mus musculus
gcctcaccttcagggaagatacgtc

SEQ ID NO: 333955 - DNA, 25 bp, Mus musculus
gggcaaggcgcagattcgcctcgtt

SEQ ID NO: 333956 - DNA, 25 bp, Mus musculus
tgactcagggtttcagcagttgaca

SEQ ID NO: 333957 - DNA, 25 bp, Mus musculus
cagggtttcagcagttgacaaaaca

SEQ ID NO: 333958 - DNA, 25 bp, Mus musculus
agttgacaaaacaggaattctgacc

SEQ ID NO: 333959 - DNA, 25 bp, Mus musculus
ttctgaccactctggttggttcttc

SEQ ID NO: 333960 - DNA, 25 bp, Mus musculus
ccactctggttggttcttctatgtc

SEQ ID NO: 333961 - DNA, 25 bp, Mus musculus
ctggttggttcttctatgtcctttc

SEQ ID NO: 333962 - DNA, 25 bp, Mus musculus
ggttcttctatgtcctttcactgta

SEQ ID NO: 333963 - DNA, 25 bp, Mus musculus
cactgtacagatgtgggtttcctta

SEQ ID NO: 333964 - DNA, 25 bp, Mus musculus
acagatgtgggtttccttagtgcaa

SEQ ID NO: 333965 - DNA, 25 bp, Mus musculus
gtgggtttccttagtgcaagtacta

SEQ ID NO: 333966 - DNA, 25 bp, Mus musculus
ccttagtgcaagtactaagtactta

SEQ ID NO: 333967 - DNA, 25 bp, Mus musculus
agtcatgtgactcagggtttcagca

SEQ ID NO: 333968 - DNA, 25 bp, Mus musculus
tactaagtacttattcagaattctg

SEQ ID NO: 333969 - DNA, 25 bp, Mus musculus
ggcggctgtggagtcatgtgactca

SEQ ID NO: 333970 - DNA, 25 bp, Mus musculus
ttgcatctgcggtcctgacgtgctg

SEQ ID NO: 333971 - DNA, 25 bp, Mus musculus
cggtcctgacgtgctgggattcaag

SEQ ID NO: 333972 - DNA, 25 bp, Mus musculus
gcgggcgcggaagtcctctgcaaat

SEQ ID NO: 333973 - DNA, 25 bp, Mus musculus
caaatgagaccagacccgggcgcgc

SEQ ID NO: 333974 - DNA, 25 bp, Mus musculus
tgcgcgtcaccaagccgctgcggac

SEQ ID NO: 333975 - DNA, 25 bp, Mus musculus
agctgcctagttgcatctgcggtcc

SEQ ID NO: 333976 - DNA, 25 bp, Mus musculus
aatgagaccagacccgggcgcgcac

SEQ ID NO: 333977 - DNA, 25 bp, Mus musculus
ctatgggcgcttggggcccgtcagt

SEQ ID NO: 333978 - DNA, 25 bp, Mus musculus
ctagttgcatctgcggtcctgacgt

SEQ ID NO: 333979 - DNA, 25 bp, Mus musculus
tgcctagttgcatctgcggtcctga

SEQ ID NO: 333980 - DNA, 25 bp, Mus musculus
tgtgagctgcctagttgcatctgcg

SEQ ID NO: 333981 - DNA, 25 bp, Mus musculus
tggctgtgagctgcctagttgcatc

SEQ ID NO: 333982 - DNA, 25 bp, Mus musculus
gtcagtggctgtgagctgcctagtt

SEQ ID NO: 333983 - DNA, 25 bp, Mus musculus
cccgtcagtggctgtgagctgccta

SEQ ID NO: 333984 - DNA, 25 bp, Mus musculus
gtcctgtcccgagccaaggcttcgg

SEQ ID NO: 333985 - DNA, 25 bp, Mus musculus
gcttcggagctgcacaacgtgcgga

SEQ ID NO: 333986 - DNA, 25 bp, Mus musculus
ctcaactgctggtgaggccggccag

SEQ ID NO: 333987 - DNA, 25 bp, Mus musculus
agctgacacgaaagatggtcctgtc

SEQ ID NO: 333988 - DNA, 25 bp, Mus musculus
ccctgtggccaccatgaagctgaca

SEQ ID NO: 333989 - DNA, 25 bp, Mus musculus
aggcctctcccgctagccgagtgta

SEQ ID NO: 333990 - DNA, 25 bp, Mus musculus
tcgcctgactgccaatgggacctca

SEQ ID NO: 333991 - DNA, 25 bp, Mus musculus
aatcgcgtatcacggaagtcgggcc

SEQ ID NO: 333992 - DNA, 25 bp, Mus musculus
agcaaagcccggagcctcgtgcatg

SEQ ID NO: 333993 - DNA, 25 bp, Mus musculus
cgcgcacgcaaacacgggatgcaga

SEQ ID NO: 333994 - DNA, 25 bp, Mus musculus
cactggaatcctaagggccgccctt

SEQ ID NO: 333995 - DNA, 25 bp, Mus musculus
ctcagactcttgcacactggaatcc

SEQ ID NO: 333996 - DNA, 25 bp, Mus musculus
gactcgaccttttctgtcctcgatg

SEQ ID NO: 333997 - DNA, 25 bp, Mus musculus
acaacgtgcggaagctcaactgctg

SEQ ID NO: 333998 - DNA, 25 bp, Mus musculus
attccagctggctgttcgcgctagc

SEQ ID NO: 333999 - DNA, 25 bp, Mus musculus
aattccagctggctgttcgcgctag

SEQ ID NO: 334000 - DNA, 25 bp, Mus musculus
cctgttggcgcgcaattccagctgg

SEQ ID NO: 334001 - DNA, 25 bp, Mus musculus
tgttggcgcgcaattccagctggct

SEQ ID NO: 334002 - DNA, 25 bp, Mus musculus
ttggcgcgcaattccagctggctgt

SEQ ID NO: 334003 - DNA, 25 bp, Mus musculus
tggcgcgcaattccagctggctgtt

SEQ ID NO: 334004 - DNA, 25 bp, Mus musculus
gcgcgcaattccagctggctgttcg

SEQ ID NO: 334005 - DNA, 25 bp, Mus musculus
cgcgcaattccagctggctgttcgc

SEQ ID NO: 334006 - DNA, 25 bp, Mus musculus
gcgcaattccagctggctgttcgcg

SEQ ID NO: 334007 - DNA, 25 bp, Mus musculus
cgcaattccagctggctgttcgcgc

SEQ ID NO: 334008 - DNA, 25 bp, Mus musculus
gcaattccagctggctgttcgcgct

SEQ ID NO: 334009 - DNA, 25 bp, Mus musculus
tcctggctgtccctggctctttgag

SEQ ID NO: 334010 - DNA, 25 bp, Mus musculus
ctgtccctggctctttgagttaggg

SEQ ID NO: 334011 - DNA, 25 bp, Mus musculus
cccgttacccagacagcaagcgcag

SEQ ID NO: 334012 - DNA, 25 bp, Mus musculus
ctggctgtccctggctctttgagtt

SEQ ID NO: 334013 - DNA, 25 bp, Mus musculus
gggtggccatcccacagtttcatcc

SEQ ID NO: 334014 - DNA, 25 bp, Mus musculus
ccaggcttcaagcaggcagtacagg

SEQ ID NO: 334015 - DNA, 25 bp, Mus musculus
ttgtgggactcacaacccaggcttc

SEQ ID NO: 334016 - DNA, 25 bp, Mus musculus
tgtgggactcacaacccaggcttca

SEQ ID NO: 334017 - DNA, 25 bp, Mus musculus
tgggactcacaacccaggcttcaag

SEQ ID NO: 334018 - DNA, 25 bp, Mus musculus
ggactcacaacccaggcttcaagca

SEQ ID NO: 334019 - DNA, 25 bp, Mus musculus
tcacaacccaggcttcaagcaggca

SEQ ID NO: 334020 - DNA, 25 bp, Mus musculus
caacccaggcttcaagcaggcagta

SEQ ID NO: 334021 - DNA, 25 bp, Mus musculus
acccaggcttcaagcaggcagtaca

SEQ ID NO: 334022 - DNA, 25 bp, Mus musculus
ggctgtccctggctctttgagttag

SEQ ID NO: 334023 - DNA, 25 bp, Mus musculus
acagcctctgcctttgcgttccagg

SEQ ID NO: 334024 - DNA, 25 bp, Mus musculus
ctctgcctttgcgttccaggagtct

SEQ ID NO: 334025 - DNA, 25 bp, Mus musculus
agtgacagagctcagacctacgagg

SEQ ID NO: 334026 - DNA, 25 bp, Mus musculus
cccagtgacagagctcagacctacg

SEQ ID NO: 334027 - DNA, 25 bp, Mus musculus
gcaggcagtacaggaccaggaccag

SEQ ID NO: 334028 - DNA, 25 bp, Mus musculus
aggagtcttctgtgctgcccttgtg

SEQ ID NO: 334029 - DNA, 25 bp, Mus musculus
gttccaggagtcttctgtgctgccc

SEQ ID NO: 334030 - DNA, 25 bp, Mus musculus
cagagcggacaagcagccaggttcc

SEQ ID NO: 334031 - DNA, 25 bp, Mus musculus
gcaacctcccagagcggacaagcag

SEQ ID NO: 334032 - DNA, 25 bp, Mus musculus
ctctgaacaaacactccacccaatc

SEQ ID NO: 334033 - DNA, 25 bp, Mus musculus
caaccagcatcaaagggagctttgc

SEQ ID NO: 334034 - DNA, 25 bp, Mus musculus
gcgcaaccagcatcaaagggagctt

SEQ ID NO: 334035 - DNA, 25 bp, Mus musculus
ctcacgcgcaaccagcatcaaaggg

SEQ ID NO: 334036 - DNA, 25 bp, Mus musculus
ctttgcgttccaggagtcttctgtg

SEQ ID NO: 334037 - DNA, 25 bp, Mus musculus
cggagcacggtcctcatatctgcta

SEQ ID NO: 334038 - DNA, 25 bp, Mus musculus
catcgccatggcaacagtgacgtcc

SEQ ID NO: 334039 - DNA, 25 bp, Mus musculus
caccctggatctaattggaggaaac

SEQ ID NO: 334040 - DNA, 25 bp, Mus musculus
tagaaggtgagtgcggacacagctc

SEQ ID NO: 334041 - DNA, 25 bp, Mus musculus
agatcaaagtggtgggactcgcgtc

SEQ ID NO: 334042 - DNA, 25 bp, Mus musculus
gggtcctcggctaaagcccaaagca

SEQ ID NO: 334043 - DNA, 25 bp, Mus musculus
ccctcattggacagaggagaagcta

SEQ ID NO: 334044 - DNA, 25 bp, Mus musculus
cgcggctctcaggaggactccggat

SEQ ID NO: 334045 - DNA, 25 bp, Mus musculus
tcatatctgctaggctaccgcgcgc

SEQ ID NO: 334046 - DNA, 25 bp, Mus musculus
aaggtgcggcaccaacggccgcttc

SEQ ID NO: 334047 - DNA, 25 bp, Mus musculus
cagtgacgtccattcaccctggatc

SEQ ID NO: 334048 - DNA, 25 bp, Mus musculus
gctgcattgtctgacgcgctctctc

SEQ ID NO: 334049 - DNA, 25 bp, Mus musculus
agctctgggactgcggctgcaacag

SEQ ID NO: 334050 - DNA, 25 bp, Mus musculus
gcgccgcctcgtgcgctgagacaaa

SEQ ID NO: 334051 - DNA, 25 bp, Mus musculus
tctcctcatcctgaccactttggtg

SEQ ID NO: 334052 - DNA, 25 bp, Mus musculus
atctccagggcactgtggccgactt

SEQ ID NO: 334053 - DNA, 25 bp, Mus musculus
ttcggggagcaaactgacttatctg

SEQ ID NO: 334054 - DNA, 25 bp, Mus musculus
cactttggtgcctttcgtcctggca

SEQ ID NO: 334055 - DNA, 25 bp, Mus musculus
cgctctttcggagaaggtttcccag

SEQ ID NO: 334056 - DNA, 25 bp, Mus musculus
cccaatgtgagcagtttcccgaacg

SEQ ID NO: 334057 - DNA, 25 bp, Mus musculus
ccgtgctgggaagatcacctccgct

SEQ ID NO: 334058 - DNA, 25 bp, Mus musculus
ggacgtgagcctagcttccctgtag

SEQ ID NO: 334059 - DNA, 25 bp, Mus musculus
gccggaaacgagttaagccgctctc

SEQ ID NO: 334060 - DNA, 25 bp, Mus musculus
tacggcacccttcttccggctgtgg

SEQ ID NO: 334061 - DNA, 25 bp, Mus musculus
ggtcgcacctgtctaaggacctgcc

SEQ ID NO: 334062 - DNA, 25 bp, Mus musculus
ttaatcacgaagaaggtcgcacctg

SEQ ID NO: 334063 - DNA, 25 bp, Mus musculus
gccagacttcacagacccttcaata

SEQ ID NO: 334064 - DNA, 25 bp, Mus musculus
ccatccgcgacttggtaaagagttc

SEQ ID NO: 334065 - DNA, 25 bp, Mus musculus
tgcgccgcagggacggcgctctgca

SEQ ID NO: 334066 - DNA, 25 bp, Mus musculus
ccagagcaagcaaagccaggacgga

SEQ ID NO: 334067 - DNA, 25 bp, Mus musculus
gcggatgctcgcactccactaacta

SEQ ID NO: 334068 - DNA, 25 bp, Mus musculus
gatgctcgcactccactaactaggg

SEQ ID NO: 334069 - DNA, 25 bp, Mus musculus
cgcactccactaactagggcaactg

SEQ ID NO: 334070 - DNA, 25 bp, Mus musculus
actagggcaactggagtgcgccgca

SEQ ID NO: 334071 - DNA, 25 bp, Mus musculus
ccagctggtgccgtgacagctgcga

SEQ ID NO: 334072 - DNA, 25 bp, Mus musculus
ggtgccgtgacagctgcgacctccg

SEQ ID NO: 334073 - DNA, 25 bp, Mus musculus
ccgcgccaggctagcgagggaactc

SEQ ID NO: 334074 - DNA, 25 bp, Mus musculus
ccaggctagcgagggaactcgagaa

SEQ ID NO: 334075 - DNA, 25 bp, Mus musculus
ctagcgagggaactcgagaaaagtg

SEQ ID NO: 334076 - DNA, 25 bp, Mus musculus
agatgggtcccagagcaagcaaagc

SEQ ID NO: 334077 - DNA, 25 bp, Mus musculus
gggtcccagagcaagcaaagccagg

SEQ ID NO: 334078 - DNA, 25 bp, Mus musculus
ctaactagggcaactggagtgcgcc

SEQ ID NO: 334079 - DNA, 25 bp, Mus musculus
gatcaaacctctttgcactcaggtc

SEQ ID NO: 334080 - DNA, 25 bp, Mus musculus
tcaggtctcctgaagcgagtgtccc

SEQ ID NO: 334081 - DNA, 25 bp, Mus musculus
gcgacatggtagaaagcccaaaacc

SEQ ID NO: 334082 - DNA, 25 bp, Mus musculus
agctcgctcgcacagcgacatggta

SEQ ID NO: 334083 - DNA, 25 bp, Mus musculus
gagcagagcgctcccgctagcagct

SEQ ID NO: 334084 - DNA, 25 bp, Mus musculus
ccgaagagcaacacgcgaggccaga

SEQ ID NO: 334085 - DNA, 25 bp, Mus musculus
tgctccgacacgcacgcggatgcag

SEQ ID NO: 334086 - DNA, 25 bp, Mus musculus
gagaaccgcgcctggactgctccga

SEQ ID NO: 334087 - DNA, 25 bp, Mus musculus
atccgtaccggctcgcggagcacgg

SEQ ID NO: 334088 - DNA, 25 bp, Mus musculus
ggcagctcgggatccgtaccggctc

SEQ ID NO: 334089 - DNA, 25 bp, Mus musculus
ggcggaccctttaagctcccgtgca

SEQ ID NO: 334090 - DNA, 25 bp, Mus musculus
ttgcaaccaagcgaaggcggaccct

SEQ ID NO: 334091 - DNA, 25 bp, Mus musculus
aacccgcaggaggttgcaaccaagc

SEQ ID NO: 334092 - DNA, 25 bp, Mus musculus
cgggtgagtcctgccaccggttcac

SEQ ID NO: 334093 - DNA, 25 bp, Mus musculus
aatgatagggaccattttcgttctg

SEQ ID NO: 334094 - DNA, 25 bp, Mus musculus
gccaccttgggccaagtagcctctc

SEQ ID NO: 334095 - DNA, 25 bp, Mus musculus
ctgagcattctcaaaaaaaggccca

SEQ ID NO: 334096 - DNA, 25 bp, Mus musculus
gactgagcattctcaaaaaaaggcc

SEQ ID NO: 334097 - DNA, 25 bp, Mus musculus
cagactctgcagttgacctctctga

SEQ ID NO: 334098 - DNA, 25 bp, Mus musculus
acagactctgcagttgacctctctg

SEQ ID NO: 334099 - DNA, 25 bp, Mus musculus
cacagactctgcagttgacctctct

SEQ ID NO: 334100 - DNA, 25 bp, Mus musculus
caaacctggccgccaattgggtcgc

SEQ ID NO: 334101 - DNA, 25 bp, Mus musculus
cagcttccgagtccttggcaaacga

SEQ ID NO: 334102 - DNA, 25 bp, Mus musculus
agcttccgagtccttggcaaacgag

SEQ ID NO: 334103 - DNA, 25 bp, Mus musculus
cttccgagtccttggcaaacgagcc

SEQ ID NO: 334104 - DNA, 25 bp, Mus musculus
ttccgagtccttggcaaacgagccc

SEQ ID NO: 334105 - DNA, 25 bp, Mus musculus
cgagtccttggcaaacgagcccaga

SEQ ID NO: 334106 - DNA, 25 bp, Mus musculus
ggcgcgcacagtcattgggaattac

SEQ ID NO: 334107 - DNA, 25 bp, Mus musculus
cgcgcacagtcattgggaattacgc

SEQ ID NO: 334108 - DNA, 25 bp, Mus musculus
cgcacagtcattgggaattacgcgc

SEQ ID NO: 334109 - DNA, 25 bp, Mus musculus
cacagtcattgggaattacgcgcca

SEQ ID NO: 334110 - DNA, 25 bp, Mus musculus
cagtcattgggaattacgcgccacc

SEQ ID NO: 334111 - DNA, 25 bp, Mus musculus
agtcattgggaattacgcgccacca

SEQ ID NO: 334112 - DNA, 25 bp, Mus musculus
cattgggaattacgcgccaccaagc

SEQ ID NO: 334113 - DNA, 25 bp, Mus musculus
gggcgcaaacctggccgccaattgg

SEQ ID NO: 334114 - DNA, 25 bp, Mus musculus
tggagaaggtagctgcgctaagaaa

SEQ ID NO: 334115 - DNA, 25 bp, Mus musculus
ccaaaccgggcggacctaggcagcg

SEQ ID NO: 334116 - DNA, 25 bp, Mus musculus
ccctaagtctgcgtgctgcgcggac

SEQ ID NO: 334117 - DNA, 25 bp, Mus musculus
tctacaaatgtctgcgcagcggttc

SEQ ID NO: 334118 - DNA, 25 bp, Mus musculus
ggacctgaagccacggtgctccaca

SEQ ID NO: 334119 - DNA, 25 bp, Mus musculus
gctccacaggagattggctggccaa

SEQ ID NO: 334120 - DNA, 25 bp, Mus musculus
cctctagtggctgctggagaaggta

SEQ ID NO: 334121 - DNA, 25 bp, Mus musculus
cccagatccctaggcgaggggcagt

SEQ ID NO: 334122 - DNA, 25 bp, Mus musculus
ggagcgcacgccagtctacaaatgt

SEQ ID NO: 334123 - DNA, 25 bp, Mus musculus
caagcccgaagggttccgaggacag

SEQ ID NO: 334124 - DNA, 25 bp, Mus musculus
ggtcagcactccaatggccttgcca

SEQ ID NO: 334125 - DNA, 25 bp, Mus musculus
tttctccaggtccacggtagccatg

SEQ ID NO: 334126 - DNA, 25 bp, Mus musculus
gtataacgtttgactgacaggctcg

SEQ ID NO: 334127 - DNA, 25 bp, Mus musculus
aaggcccgtggcctgcagcacgtac

SEQ ID NO: 334128 - DNA, 25 bp, Mus musculus
ccttgaagattataaggcgcccacg

SEQ ID NO: 334129 - DNA, 25 bp, Mus musculus
ctgactgtgcgtccccgcatctggg

SEQ ID NO: 334130 - DNA, 25 bp, Mus musculus
ggccgagacccttgaagattataag

SEQ ID NO: 334131 - DNA, 25 bp, Mus musculus
gccgagacccttgaagattataagg

SEQ ID NO: 334132 - DNA, 25 bp, Mus musculus
ccgagacccttgaagattataaggc

SEQ ID NO: 334133 - DNA, 25 bp, Mus musculus
cgagacccttgaagattataaggcg

SEQ ID NO: 334134 - DNA, 25 bp, Mus musculus
gagacccttgaagattataaggcgc

SEQ ID NO: 334135 - DNA, 25 bp, Mus musculus
cccttgaagattataaggcgcccac

SEQ ID NO: 334136 - DNA, 25 bp, Mus musculus
tccgcggctgtcccgaggcttgagt

SEQ ID NO: 334137 - DNA, 25 bp, Mus musculus
atcttgccttctacattttaagtac

SEQ ID NO: 334138 - DNA, 25 bp, Mus musculus
tcttgccttctacattttaagtacg

SEQ ID NO: 334139 - DNA, 25 bp, Mus musculus
ttggctggttgtcgattctcctcta

SEQ ID NO: 334140 - DNA, 25 bp, Mus musculus
tttggctggttgtcgattctcctct

SEQ ID NO: 334141 - DNA, 25 bp, Mus musculus
tgccttctacattttaagtacggtc

SEQ ID NO: 334142 - DNA, 25 bp, Mus musculus
aaaattttggctggttgtcgattct

SEQ ID NO: 334143 - DNA, 25 bp, Mus musculus
gctgtcccgaggcttgagtgagggt

SEQ ID NO: 334144 - DNA, 25 bp, Mus musculus
tggtggtcaggcctgcgcccggcac

SEQ ID NO: 334145 - DNA, 25 bp, Mus musculus
cttgccttctacattttaagtacgg

SEQ ID NO: 334146 - DNA, 25 bp, Mus musculus
attttggctggttgtcgattctcct

SEQ ID NO: 334147 - DNA, 25 bp, Mus musculus
aaattttggctggttgtcgattctc

SEQ ID NO: 334148 - DNA, 25 bp, Mus musculus
ttttggctggttgtcgattctcctc

SEQ ID NO: 334149 - DNA, 25 bp, Mus musculus
aattttggctggttgtcgattctcc

SEQ ID NO: 334150 - DNA, 25 bp, Mus musculus
gctcgcaggggtcgaagccgccaca

SEQ ID NO: 334151 - DNA, 25 bp, Mus musculus
ctaccaacattgctcagagggcatg

SEQ ID NO: 334152 - DNA, 25 bp, Mus musculus
tctaccaacattgctcagagggcat

SEQ ID NO: 334153 - DNA, 25 bp, Mus musculus
ctctaccaacattgctcagagggca

SEQ ID NO: 334154 - DNA, 25 bp, Mus musculus
gcagtcctagccaccaatcgggtcg

SEQ ID NO: 334155 - DNA, 25 bp, Mus musculus
ctccctcccggtgcgggcgacgcta

SEQ ID NO: 334156 - DNA, 25 bp, Mus musculus
ctcgcaggggtcgaagccgccacag

SEQ ID NO: 334157 - DNA, 25 bp, Mus musculus
accaacattgctcagagggcatgga

SEQ ID NO: 334158 - DNA, 25 bp, Mus musculus
taccaacattgctcagagggcatgg

SEQ ID NO: 334159 - DNA, 25 bp, Mus musculus
agctcgcaggggtcgaagccgccac

SEQ ID NO: 334160 - DNA, 25 bp, Mus musculus
ccaacattgctcagagggcatggag

SEQ ID NO: 334161 - DNA, 25 bp, Mus musculus
tagaggagaatcgacaaccagccaa

SEQ ID NO: 334162 - DNA, 25 bp, Mus musculus
accctcactcaagcctcgggacagc

SEQ ID NO: 334163 - DNA, 25 bp, Mus musculus
agaatcgacaaccagccaaaatttt

SEQ ID NO: 334164 - DNA, 25 bp, Mus musculus
gagaatcgacaaccagccaaaattt

SEQ ID NO: 334165 - DNA, 25 bp, Mus musculus
ggagaatcgacaaccagccaaaatt

SEQ ID NO: 334166 - DNA, 25 bp, Mus musculus
agaggagaatcgacaaccagccaaa

SEQ ID NO: 334167 - DNA, 25 bp, Mus musculus
gtacttaaaatgtagaaggcaagat

SEQ ID NO: 334168 - DNA, 25 bp, Mus musculus
cgtacttaaaatgtagaaggcaaga

SEQ ID NO: 334169 - DNA, 25 bp, Mus musculus
ccgtacttaaaatgtagaaggcaag

SEQ ID NO: 334170 - DNA, 25 bp, Mus musculus
gaccgtacttaaaatgtagaaggca

SEQ ID NO: 334171 - DNA, 25 bp, Mus musculus
actcaagcctcgggacagccgcgga

SEQ ID NO: 334172 - DNA, 25 bp, Mus musculus
cctcactcaagcctcgggacagccg

SEQ ID NO: 334173 - DNA, 25 bp, Mus musculus
gaggagaatcgacaaccagccaaaa

SEQ ID NO: 334174 - DNA, 25 bp, Mus musculus
tcaagcctcgggacagccgcggacc

SEQ ID NO: 334175 - DNA, 25 bp, Mus musculus
gcgcaccgccgggttcagtcctcgg

SEQ ID NO: 334176 - DNA, 25 bp, Mus musculus
ggagaagcatttcggcccacgcctt

SEQ ID NO: 334177 - DNA, 25 bp, Mus musculus
catttcggcccacgccttccacggt

SEQ ID NO: 334178 - DNA, 25 bp, Mus musculus
aggagcgccacgcagtgtcacgctc

SEQ ID NO: 334179 - DNA, 25 bp, Mus musculus
cgggaggagaagcatttcggcccac

SEQ ID NO: 334180 - DNA, 25 bp, Mus musculus
tgaggagtaggtgtcccgcggctag

SEQ ID NO: 334181 - DNA, 25 bp, Mus musculus
ctttccttaggggcatctgggctgg

SEQ ID NO: 334182 - DNA, 25 bp, Mus musculus
ttcagtcctcggaagcgcgtgcggc

SEQ ID NO: 334183 - DNA, 25 bp, Mus musculus
ccgcggcctcgcttggcaggtgacg

SEQ ID NO: 334184 - DNA, 25 bp, Mus musculus
aggtgacggcctccgcctatcgctg

SEQ ID NO: 334185 - DNA, 25 bp, Mus musculus
gacggcctccgcctatcgctggtgg

SEQ ID NO: 334186 - DNA, 25 bp, Mus musculus
ctatcgctggtggcgaccgggttcc

SEQ ID NO: 334187 - DNA, 25 bp, Mus musculus
tccgggctttccttaggggcatctg

SEQ ID NO: 334188 - DNA, 25 bp, Mus musculus
gtcacgctccccacggtgaggagta

SEQ ID NO: 334189 - DNA, 25 bp, Mus musculus
cccagatgcggggacgcacagtcag

SEQ ID NO: 334190 - DNA, 25 bp, Mus musculus
cgtgggcgccttataatcttcaagg

SEQ ID NO: 334191 - DNA, 25 bp, Mus musculus
gtgggcgccttataatcttcaaggg

SEQ ID NO: 334192 - DNA, 25 bp, Mus musculus
gcgccttataatcttcaagggtctc

SEQ ID NO: 334193 - DNA, 25 bp, Mus musculus
cgccttataatcttcaagggtctcg

SEQ ID NO: 334194 - DNA, 25 bp, Mus musculus
gccttataatcttcaagggtctcgg

SEQ ID NO: 334195 - DNA, 25 bp, Mus musculus
ccttataatcttcaagggtctcggc

SEQ ID NO: 334196 - DNA, 25 bp, Mus musculus
cttataatcttcaagggtctcggcc

SEQ ID NO: 334197 - DNA, 25 bp, Mus musculus
caccttcaagacgtagctgccagca

SEQ ID NO: 334198 - DNA, 25 bp, Mus musculus
tttctagagcaacagaactgataga

SEQ ID NO: 334199 - DNA, 25 bp, Mus musculus
actcaggtttttctagagcaacaga

SEQ ID NO: 334200 - DNA, 25 bp, Mus musculus
gctggtttcagtactcaggtttttc

SEQ ID NO: 334201 - DNA, 25 bp, Mus musculus
caactctccactgaagctggtttca

SEQ ID NO: 334202 - DNA, 25 bp, Mus musculus
cttccgctcctaaaacacattctta

SEQ ID NO: 334203 - DNA, 25 bp, Mus musculus
gtttccttgcggtaggcacgagtcc

SEQ ID NO: 334204 - DNA, 25 bp, Mus musculus
gtcatgtttccttgcggtaggcacg

SEQ ID NO: 334205 - DNA, 25 bp, Mus musculus
gatttcagagcagctgtcatgtttc

SEQ ID NO: 334206 - DNA, 25 bp, Mus musculus
tgcctggctctttgtgttaatagtg

SEQ ID NO: 334207 - DNA, 25 bp, Mus musculus
agacgtagctgccagcacagtcctt

SEQ ID NO: 334208 - DNA, 25 bp, Mus musculus
gctttaaaagagataagcaccttca

SEQ ID NO: 334209 - DNA, 25 bp, Mus musculus
ctgccttttcaatatcattagcttt

SEQ ID NO: 334210 - DNA, 25 bp, Mus musculus
cagtccttcactgcctggctctttg

SEQ ID NO: 334211 - DNA, 25 bp, Mus musculus
ttccgaggctttctcctgtagttgc

SEQ ID NO: 334212 - DNA, 25 bp, Mus musculus
tgcctctttggtagcgaggctaagg

SEQ ID NO: 334213 - DNA, 25 bp, Mus musculus
ctattctcagtagtgccggtcgcca

SEQ ID NO: 334214 - DNA, 25 bp, Mus musculus
cgaccttgaacgctgtttttgcacc

SEQ ID NO: 334215 - DNA, 25 bp, Mus musculus
ttcgcctggaaagataaggcgctta

SEQ ID NO: 334216 - DNA, 25 bp, Mus musculus
aaggcgcttattccgaggctttctc

SEQ ID NO: 334217 - DNA, 25 bp, Mus musculus
gcgctgtgcccttaccgctagagct

SEQ ID NO: 334218 - DNA, 25 bp, Mus musculus
cctgtagttgcctctttggtagcga

SEQ ID NO: 334219 - DNA, 25 bp, Mus musculus
tggccctcggctgagctgaattaca

SEQ ID NO: 334220 - DNA, 25 bp, Mus musculus
ctcggctgagctgaattacacattc

SEQ ID NO: 334221 - DNA, 25 bp, Mus musculus
tacacattcgtggaagcgccgactc

SEQ ID NO: 334222 - DNA, 25 bp, Mus musculus
actctgccaccctggaaggctgggc

SEQ ID NO: 334223 - DNA, 25 bp, Mus musculus
cgctagagctgcaacccacagcgtg

SEQ ID NO: 334224 - DNA, 25 bp, Mus musculus
acccacagcgtgagtcgaccttgaa

SEQ ID NO: 334225 - DNA, 25 bp, Mus musculus
aacctgggtcttgagtcccacaagg

SEQ ID NO: 334226 - DNA, 25 bp, Mus musculus
actgtgggcttgtgggttggccacc

SEQ ID NO: 334227 - DNA, 25 bp, Mus musculus
aatgggccagggatagccaggagga

SEQ ID NO: 334228 - DNA, 25 bp, Mus musculus
ctcaatgggccagggatagccagga

SEQ ID NO: 334229 - DNA, 25 bp, Mus musculus
aactcaatgggccagggatagccag

SEQ ID NO: 334230 - DNA, 25 bp, Mus musculus
acctgggtcttgagtcccacaaggg

SEQ ID NO: 334231 - DNA, 25 bp, Mus musculus
gaaacctgggtcttgagtcccacaa

SEQ ID NO: 334232 - DNA, 25 bp, Mus musculus
agaaacctgggtcttgagtcccaca

SEQ ID NO: 334233 - DNA, 25 bp, Mus musculus
ccagaaacctgggtcttgagtccca

SEQ ID NO: 334234 - DNA, 25 bp, Mus musculus
tgccagaaacctgggtcttgagtcc

SEQ ID NO: 334235 - DNA, 25 bp, Mus musculus
ctgccagaaacctgggtcttgagtc

SEQ ID NO: 334236 - DNA, 25 bp, Mus musculus
gcctgccagaaacctgggtcttgag

SEQ ID NO: 334237 - DNA, 25 bp, Mus musculus
tgcctgccagaaacctgggtcttga

SEQ ID NO: 334238 - DNA, 25 bp, Mus musculus
ccctaactcaatgggccagggatag

SEQ ID NO: 334239 - DNA, 25 bp, Mus musculus
gattgggtggagtgtttgttcagag

SEQ ID NO: 334240 - DNA, 25 bp, Mus musculus
aagctccctttgatgctggttgcgc

SEQ ID NO: 334241 - DNA, 25 bp, Mus musculus
ctgcttgtccgctctgggaggttgc

SEQ ID NO: 334242 - DNA, 25 bp, Mus musculus
cggaacctggctgcttgtccgctct

SEQ ID NO: 334243 - DNA, 25 bp, Mus musculus
gctcccactcgcgttccctaactca

SEQ ID NO: 334244 - DNA, 25 bp, Mus musculus
tcctggaacgcaaaggcagaggctg

SEQ ID NO: 334245 - DNA, 25 bp, Mus musculus
gcacagaagactcctggaacgcaaa

SEQ ID NO: 334246 - DNA, 25 bp, Mus musculus
cccacaagggcagcacagaagactc

SEQ ID NO: 334247 - DNA, 25 bp, Mus musculus
ctggtcctggtcctgtactgcctgc

SEQ ID NO: 334248 - DNA, 25 bp, Mus musculus
agctctgtcactggggcctggtcct

SEQ ID NO: 334249 - DNA, 25 bp, Mus musculus
taggtctgagctctgtcactggggc

SEQ ID NO: 334250 - DNA, 25 bp, Mus musculus
cctcgtaggtctgagctctgtcact

SEQ ID NO: 334251 - DNA, 25 bp, Mus musculus
gggcagcacagaagactcctggaac

SEQ ID NO: 334252 - DNA, 25 bp, Mus musculus
ccctttgatgctggttgcgcgtgag

SEQ ID NO: 334253 - DNA, 25 bp, Mus musculus
ttgggccggagctccgccagccaat

SEQ ID NO: 334254 - DNA, 25 bp, Mus musculus
gaactgaccgcgagagagaactgga

SEQ ID NO: 334255 - DNA, 25 bp, Mus musculus
agttccagaagctccgccttgggcc

SEQ ID NO: 334256 - DNA, 25 bp, Mus musculus
cgagccggctcagagcgagaaaagc

SEQ ID NO: 334257 - DNA, 25 bp, Mus musculus
gatcgggtgtactgtcccaacccga

SEQ ID NO: 334258 - DNA, 25 bp, Mus musculus
tgtactgtcccaacccgaaagtcca

SEQ ID NO: 334259 - DNA, 25 bp, Mus musculus
gaaggttgaagtgtccgctgcccgc

SEQ ID NO: 334260 - DNA, 25 bp, Mus musculus
agcgcgatgacacaggagtacgaca

SEQ ID NO: 334261 - DNA, 25 bp, Mus musculus
acacaggagtacgacaagtgagtga

SEQ ID NO: 334262 - DNA, 25 bp, Mus musculus
ggacactcggcctgtcgtctaaggg

SEQ ID NO: 334263 - DNA, 25 bp, Mus musculus
cctgtcgtctaagggctcccgggct

SEQ ID NO: 334264 - DNA, 25 bp, Mus musculus
gtggaccctgggcagcctcctgtca

SEQ ID NO: 334265 - DNA, 25 bp, Mus musculus
aaagtccagttctgcggcccggcag

SEQ ID NO: 334266 - DNA, 25 bp, Mus musculus
ccatctcaccaatcaggaggagctc

SEQ ID NO: 334267 - DNA, 25 bp, Mus musculus
cagctttgtctctggtccgctgcgg

SEQ ID NO: 334268 - DNA, 25 bp, Mus musculus
taccagatccgtccacggcgtgggg

SEQ ID NO: 334269 - DNA, 25 bp, Mus musculus
ccgaatccagaggaggaccgctgtt

SEQ ID NO: 334270 - DNA, 25 bp, Mus musculus
ccggcgcggctatttccagccatga

SEQ ID NO: 334271 - DNA, 25 bp, Mus musculus
tgtgggtcccgcctaccagatccgt

SEQ ID NO: 334272 - DNA, 25 bp, Mus musculus
cggcagcctgccttcagctttgtct

SEQ ID NO: 334273 - DNA, 25 bp, Mus musculus
ctgcggatttgctctggtccggaca

SEQ ID NO: 334274 - DNA, 25 bp, Mus musculus
ttgctgcctgcaggccatacggcac

SEQ ID NO: 334275 - DNA, 25 bp, Mus musculus
tcgcagcattgctgcctgcaggcca

SEQ ID NO: 334276 - DNA, 25 bp, Mus musculus
cgccgggaacagacgctcgggacac

SEQ ID NO: 334277 - DNA, 25 bp, Mus musculus
cggtgtattttggtttgcccgcgcg

SEQ ID NO: 334278 - DNA, 25 bp, Mus musculus
cttcttgccggcctggcgctgattg

SEQ ID NO: 334279 - DNA, 25 bp, Mus musculus
aagaggaccttactgcggtcgactg

SEQ ID NO: 334280 - DNA, 25 bp, Mus musculus
agccatgacgtcacccgaatccaga

SEQ ID NO: 334281 - DNA, 25 bp, Mus musculus
agcaggcgtagggtctcctcccggc

SEQ ID NO: 334282 - DNA, 25 bp, Mus musculus
gccagcaactgatccagcaggcgta

SEQ ID NO: 334283 - DNA, 25 bp, Mus musculus
caactgatccagcaggcgtagggtc

SEQ ID NO: 334284 - DNA, 25 bp, Mus musculus
actgatccagcaggcgtagggtctc

SEQ ID NO: 334285 - DNA, 25 bp, Mus musculus
atccagcaggcgtagggtctcctcc

SEQ ID NO: 334286 - DNA, 25 bp, Mus musculus
ccgtccgggcctggtcagccgtgcc

SEQ ID NO: 334287 - DNA, 25 bp, Mus musculus
agccgtgccgccctccgaggctgtc

SEQ ID NO: 334288 - DNA, 25 bp, Mus musculus
gaggctgtctctcccgggcctgtct

SEQ ID NO: 334289 - DNA, 25 bp, Mus musculus
ccgggcctgtctgacgcctgtcagg

SEQ ID NO: 334290 - DNA, 25 bp, Mus musculus
gactcggccagcaactgatccagca

SEQ ID NO: 334291 - DNA, 25 bp, Mus musculus
gccagatggggcgagggaacagcaa

SEQ ID NO: 334292 - DNA, 25 bp, Mus musculus
ctcgtggggtcagctcctggggccc

SEQ ID NO: 334293 - DNA, 25 bp, Mus musculus
gcccatggcgcgcacccagcctgga

SEQ ID NO: 334294 - DNA, 25 bp, Mus musculus
tcggccagcaactgatccagcaggc

SEQ ID NO: 334295 - DNA, 25 bp, Mus musculus
aggctctcgcaatcctaaccggttc

SEQ ID NO: 334296 - DNA, 25 bp, Mus musculus
agcgactcaccctggctgacaagga

SEQ ID NO: 334297 - DNA, 25 bp, Mus musculus
ggagggtgcctaccgccattcacca

SEQ ID NO: 334298 - DNA, 25 bp, Mus musculus
cgcgtcctggccagcaaagctgcga

SEQ ID NO: 334299 - DNA, 25 bp, Mus musculus
ctgcgaggagaatcttccaggactc

SEQ ID NO: 334300 - DNA, 25 bp, Mus musculus
gtcgcttaggctcccagtagagggc

SEQ ID NO: 334301 - DNA, 25 bp, Mus musculus
gcagtcggcggtgcaccggattcca

SEQ ID NO: 334302 - DNA, 25 bp, Mus musculus
aggcctgcggcgcaactcaaatctc

SEQ ID NO: 334303 - DNA, 25 bp, Mus musculus
ccggcgcaggctccttaaaggtctt

SEQ ID NO: 334304 - DNA, 25 bp, Mus musculus
gacagtcaaggcgacgtgtcccaga

SEQ ID NO: 334305 - DNA, 25 bp, Mus musculus
ctctacttgggacatgaagacagtc

SEQ ID NO: 334306 - DNA, 25 bp, Mus musculus
ccggattccagctgttttcgcctgc

SEQ ID NO: 334307 - DNA, 25 bp, Mus musculus
cagctgcagttgtcgccgctgaagc

SEQ ID NO: 334308 - DNA, 25 bp, Mus musculus
taaaggtctttgtgcggaaggcctg

SEQ ID NO: 334309 - DNA, 25 bp, Mus musculus
catcctcggcgtagctcggcacaga

SEQ ID NO: 334310 - DNA, 25 bp, Mus musculus
cgcgacgccattggaccgcggagct

SEQ ID NO: 334311 - DNA, 25 bp, Mus musculus
cgtgcaactgcccatcgatcaggta

SEQ ID NO: 334312 - DNA, 25 bp, Mus musculus
tgcccatcgatcaggtaccggcgtc

SEQ ID NO: 334313 - DNA, 25 bp, Mus musculus
gaagctgctggaaatcgggccgccc

SEQ ID NO: 334314 - DNA, 25 bp, Mus musculus
gcgacagccatggtcgagcctcagc

SEQ ID NO: 334315 - DNA, 25 bp, Mus musculus
aggcggaggcaaagccgccctcaca

SEQ ID NO: 334316 - DNA, 25 bp, Mus musculus
gacggcgcccaccattcctgagaaa

SEQ ID NO: 334317 - DNA, 25 bp, Mus musculus
tgttgtccaccgtcactgccagtga

SEQ ID NO: 334318 - DNA, 25 bp, Mus musculus
ccggcgctgcaactctttgtctggc

SEQ ID NO: 334319 - DNA, 25 bp, Mus musculus
tcttgtagcgcgtctccctgaagct

SEQ ID NO: 334320 - DNA, 25 bp, Mus musculus
tctgctttggggttcttgtagcgcg

SEQ ID NO: 334321 - DNA, 25 bp, Mus musculus
cagcccaggagacaaaggcactttc

SEQ ID NO: 334322 - DNA, 25 bp, Mus musculus
tagctcggcacagagcgagcaagca

SEQ ID NO: 334323 - DNA, 25 bp, Mus musculus
acctgtcagttcctgactcctagga

SEQ ID NO: 334324 - DNA, 25 bp, Mus musculus
tcctgactcctaggaagatggccgc

SEQ ID NO: 334325 - DNA, 25 bp, Mus musculus
actcctaggaagatggccgccgggc

SEQ ID NO: 334326 - DNA, 25 bp, Mus musculus
gcatagctgtgtgctcttggcgtct

SEQ ID NO: 334327 - DNA, 25 bp, Mus musculus
gctcttggcgtcttgtcctctgaca

SEQ ID NO: 334328 - DNA, 25 bp, Mus musculus
ttgtcctctgacaaggtctgcggcg

SEQ ID NO: 334329 - DNA, 25 bp, Mus musculus
ctgacaaggtctgcggcgctgttct

SEQ ID NO: 334330 - DNA, 25 bp, Mus musculus
gtctgcggcgctgttctgcagagct

SEQ ID NO: 334331 - DNA, 25 bp, Mus musculus
cgtcttcggccaggccgtgacacgg

SEQ ID NO: 334332 - DNA, 25 bp, Mus musculus
tcggccaggccgtgacacggtcagt

SEQ ID NO: 334333 - DNA, 25 bp, Mus musculus
aggcagagcgacagtgtccgaggct

SEQ ID NO: 334334 - DNA, 25 bp, Mus musculus
acgagtctgtcggtggcaccggaga

SEQ ID NO: 334335 - DNA, 25 bp, Mus musculus
tcggtgcagccaagcgcggaaggca

SEQ ID NO: 334336 - DNA, 25 bp, Mus musculus
gaccacgtgacctgtcagttcctga

SEQ ID NO: 334337 - DNA, 25 bp, Mus musculus
ttcccggcctccaggactcaggatt

SEQ ID NO: 334338 - DNA, 25 bp, Mus musculus
cctcgccgaacagcacggagcagtg

SEQ ID NO: 334339 - DNA, 25 bp, Mus musculus
ggctaccggcctcccatcaattagt

SEQ ID NO: 334340 - DNA, 25 bp, Mus musculus
aattagtcctccgaaggcagcggcg

SEQ ID NO: 334341 - DNA, 25 bp, Mus musculus
gcgcaggcttccacaggtccttcag

SEQ ID NO: 334342 - DNA, 25 bp, Mus musculus
cgttcggacctctgtctcctgggac

SEQ ID NO: 334343 - DNA, 25 bp, Mus musculus
gcagtggaactgtctcgcgctaaca

SEQ ID NO: 334344 - DNA, 25 bp, Mus musculus
tctcgcgctaacaggcagctatcgc

SEQ ID NO: 334345 - DNA, 25 bp, Mus musculus
gctatcgcagccaatcagcttttca

SEQ ID NO: 334346 - DNA, 25 bp, Mus musculus
atcagcttttcagatccgtgctacg

SEQ ID NO: 334347 - DNA, 25 bp, Mus musculus
tagcggagcctcgtctcctcttgta

SEQ ID NO: 334348 - DNA, 25 bp, Mus musculus
tactctgtgtttagttcccggcctc

SEQ ID NO: 334349 - DNA, 25 bp, Mus musculus
ctcaggattcagttaggctaccggc

SEQ ID NO: 334350 - DNA, 25 bp, Mus musculus
gcctcagcccgagaccttggattcg

SEQ ID NO: 334351 - DNA, 25 bp, Mus musculus
aattgccattggtggaagggctccc

SEQ ID NO: 334352 - DNA, 25 bp, Mus musculus
tctccgcacagcagacgggaagtca

SEQ ID NO: 334353 - DNA, 25 bp, Mus musculus
tgtgcccggagctagctatacccgc

SEQ ID NO: 334354 - DNA, 25 bp, Mus musculus
gtgtgcaattgtgcccgccttattc

SEQ ID NO: 334355 - DNA, 25 bp, Mus musculus
cgcgttcgcagccaatgcctgtagg

SEQ ID NO: 334356 - DNA, 25 bp, Mus musculus
agctctcggttcttccgcgttcgca

SEQ ID NO: 334357 - DNA, 25 bp, Mus musculus
aagggctcccgtccatcataccagg

SEQ ID NO: 334358 - DNA, 25 bp, Mus musculus
cgctcaatcgggcatccctgaattg

SEQ ID NO: 334359 - DNA, 25 bp, Mus musculus
cgtcttttatgtgcactcgccctgg

SEQ ID NO: 334360 - DNA, 25 bp, Mus musculus
cggcaccaggctcggttcagaatga

SEQ ID NO: 334361 - DNA, 25 bp, Mus musculus
gaaggctttcatgctgctcgtagga

SEQ ID NO: 334362 - DNA, 25 bp, Mus musculus
ctaacggacctcaccggactgaagg

SEQ ID NO: 334363 - DNA, 25 bp, Mus musculus
ctgtggtccgacaggctgtttttcc

SEQ ID NO: 334364 - DNA, 25 bp, Mus musculus
ctcccattggtgagtatgagctctc

SEQ ID NO: 334365 - DNA, 25 bp, Mus musculus
tgacaggtgatgaattggcagcagc

SEQ ID NO: 334366 - DNA, 25 bp, Mus musculus
ggccacgcgcggtaatcagaagcag

SEQ ID NO: 334367 - DNA, 25 bp, Mus musculus
atcaatgcctgcaaggcccggcggt

SEQ ID NO: 334368 - DNA, 25 bp, Mus musculus
cgcccagctgatcaatgcctgcaag

SEQ ID NO: 334369 - DNA, 25 bp, Mus musculus
gagcagactctctggcgccaggcgc

SEQ ID NO: 334370 - DNA, 25 bp, Mus musculus
cccgagtgatccctgacaggtgatg

SEQ ID NO: 334371 - DNA, 25 bp, Mus musculus
acagctgtgtccattccgcccgtga

SEQ ID NO: 334372 - DNA, 25 bp, Mus musculus
cctcggttttgttctcacagctgtg

SEQ ID NO: 334373 - DNA, 25 bp, Mus musculus
cgcaattgggagctctcgcctttct

SEQ ID NO: 334374 - DNA, 25 bp, Mus musculus
acatctggcgcaattgggagctctc

SEQ ID NO: 334375 - DNA, 25 bp, Mus musculus
ggtcttctctgcacatctggcgcaa

SEQ ID NO: 334376 - DNA, 25 bp, Mus musculus
ggttcctgctcagccaccttggcta

SEQ ID NO: 334377 - DNA, 25 bp, Mus musculus
tcaggcggctgccatagcaaccgcg

SEQ ID NO: 334378 - DNA, 25 bp, Mus musculus
cgggcgagtctcaaggtcttctctg

SEQ ID NO: 334379 - DNA, 25 bp, Mus musculus
accatcagtgtgtttcttctaaatc

SEQ ID NO: 334380 - DNA, 25 bp, Mus musculus
gcgcgacaaacaaactccacagcta

SEQ ID NO: 334381 - DNA, 25 bp, Mus musculus
gtgcgcgggcgcgacaaacaaactc

SEQ ID NO: 334382 - DNA, 25 bp, Mus musculus
ctccttgctcactgtaggtgcgcgg

SEQ ID NO: 334383 - DNA, 25 bp, Mus musculus
ccggctctccttgctcactgtaggt

SEQ ID NO: 334384 - DNA, 25 bp, Mus musculus
cggcagcgaaggaactgcaggagca

SEQ ID NO: 334385 - DNA, 25 bp, Mus musculus
ccggctacagagactcggagactgc

SEQ ID NO: 334386 - DNA, 25 bp, Mus musculus
gcacgggtccgcagggcaaccatca

SEQ ID NO: 334387 - DNA, 25 bp, Mus musculus
cgacccggctacagagactcggaga

SEQ ID NO: 334388 - DNA, 25 bp, Mus musculus
acagctaacttctgggctccggagc

SEQ ID NO: 334389 - DNA, 25 bp, Mus musculus
tgtttcttctaaatcgaataggttc

SEQ ID NO: 334390 - DNA, 25 bp, Mus musculus
ctcgccagtgttaccacatgccgga

SEQ ID NO: 334391 - DNA, 25 bp, Mus musculus
gtgttaccacatgccggaaggaggt

SEQ ID NO: 334392 - DNA, 25 bp, Mus musculus
tccgcagggcaaccatcagtgtgtt

SEQ ID NO: 334393 - DNA, 25 bp, Mus musculus
acggagcgatatgtcttggtaaaca

SEQ ID NO: 334394 - DNA, 25 bp, Mus musculus
ctgcagacagccaaatccaggactg

SEQ ID NO: 334395 - DNA, 25 bp, Mus musculus
cttggttggctccagcctcgtttgc

SEQ ID NO: 334396 - DNA, 25 bp, Mus musculus
ttggaagtccctaacaagaaacaca

SEQ ID NO: 334397 - DNA, 25 bp, Mus musculus
caaaagcaaaacctggcccggcttg

SEQ ID NO: 334398 - DNA, 25 bp, Mus musculus
cgggcttgtccggaatcaaactgct

SEQ ID NO: 334399 - DNA, 25 bp, Mus musculus
ccaagccgagagagtgcagcgcaca

SEQ ID NO: 334400 - DNA, 25 bp, Mus musculus
tgcgacttttattccggtcaccaaa

SEQ ID NO: 334401 - DNA, 25 bp, Mus musculus
tgcggccgcctttggcattcacaaa

SEQ ID NO: 334402 - DNA, 25 bp, Mus musculus
ctgtaaagtgctccgctccgatttg

SEQ ID NO: 334403 - DNA, 25 bp, Mus musculus
ccgatttaactatggagcgccgcaa

SEQ ID NO: 334404 - DNA, 25 bp, Mus musculus
tggtaaacaatctcggactgcctgc

SEQ ID NO: 334405 - DNA, 25 bp, Mus musculus
agcctgcaacaagggcgggcttgtc

SEQ ID NO: 334406 - DNA, 25 bp, Mus musculus
gtgggaacccgcaagcagcctgcaa

SEQ ID NO: 334407 - DNA, 25 bp, Mus musculus
ggcggccaggaagccttcagtttta

SEQ ID NO: 334408 - DNA, 25 bp, Mus musculus
cgcctagggtgaagaagtcgcctct

SEQ ID NO: 334409 - DNA, 25 bp, Mus musculus
ttttagcaggaggagcgatacaatc

SEQ ID NO: 334410 - DNA, 25 bp, Mus musculus
gcgatacaatctctgagctccacgg

SEQ ID NO: 334411 - DNA, 25 bp, Mus musculus
agctccacggatggtgtagaaaacc

SEQ ID NO: 334412 - DNA, 25 bp, Mus musculus
gacttccttgggcaagaggggtaca

SEQ ID NO: 334413 - DNA, 25 bp, Mus musculus
ggtacaagggacacggagactcctg

SEQ ID NO: 334414 - DNA, 25 bp, Mus musculus
ccagaggctagcagaggaccatgcc

SEQ ID NO: 334415 - DNA, 25 bp, Mus musculus
gtactcgcgactgccactggccaga

SEQ ID NO: 334416 - DNA, 25 bp, Mus musculus
tctgcccatgtccaggtcacggcgg

SEQ ID NO: 334417 - DNA, 25 bp, Mus musculus
ggagtccacccaaggcctgcagacg

SEQ ID NO: 334418 - DNA, 25 bp, Mus musculus
tcacccagcggaatcccggagcata

SEQ ID NO: 334419 - DNA, 25 bp, Mus musculus
ccgctcgggcgatgccgacacaaag

SEQ ID NO: 334420 - DNA, 25 bp, Mus musculus
gcagagccagtttgcacgccagcgc

SEQ ID NO: 334421 - DNA, 25 bp, Mus musculus
tgccgacagttaaaggcgcggctgt

SEQ ID NO: 334422 - DNA, 25 bp, Mus musculus
cgcgacttgctccagcttctgggct

SEQ ID NO: 334423 - DNA, 25 bp, Mus musculus
gatcaggccggcgaagcccagcatg

SEQ ID NO: 334424 - DNA, 25 bp, Mus musculus
gccaactgagcaagcttctgggcta

SEQ ID NO: 334425 - DNA, 25 bp, Mus musculus
ccggggtcctttacagagatgccaa

SEQ ID NO: 334426 - DNA, 25 bp, Mus musculus
cacagggatgcacgcctggcagagc

SEQ ID NO: 334427 - DNA, 25 bp, Mus musculus
gggatgcaacagaccacagggatgc

SEQ ID NO: 334428 - DNA, 25 bp, Mus musculus
tgccagattgctccctgactcactt

SEQ ID NO: 334429 - DNA, 25 bp, Mus musculus
gcttcactgtggagctgccagattg

SEQ ID NO: 334430 - DNA, 25 bp, Mus musculus
atggccctaataagccgccctcgag

SEQ ID NO: 334431 - DNA, 25 bp, Mus musculus
gccacagctgccttcactttcgttt

SEQ ID NO: 334432 - DNA, 25 bp, Mus musculus
ggccacactggaggtctcagccaca

SEQ ID NO: 334433 - DNA, 25 bp, Mus musculus
aagcccgggagtagctcggccacac

SEQ ID NO: 334434 - DNA, 25 bp, Mus musculus
gcgcccgcagttggccgagttccag

SEQ ID NO: 334435 - DNA, 25 bp, Mus musculus
taggcgcatttgctttcctcgtgcc

SEQ ID NO: 334436 - DNA, 25 bp, Mus musculus
ggcaccgacctggatccctactggt

SEQ ID NO: 334437 - DNA, 25 bp, Mus musculus
cgctggtgaaattattcgcggctta

SEQ ID NO: 334438 - DNA, 25 bp, Mus musculus
tctctatctgcagtgcctgtcttgc

SEQ ID NO: 334439 - DNA, 25 bp, Mus musculus
ttgggcaccgagtttcaattcactg

SEQ ID NO: 334440 - DNA, 25 bp, Mus musculus
tcaattcactgctgaagggctcctc

SEQ ID NO: 334441 - DNA, 25 bp, Mus musculus
atcctgcaccgtgaaggcggctcta

SEQ ID NO: 334442 - DNA, 25 bp, Mus musculus
cacgcgctatgagatcgcgctgctc

SEQ ID NO: 334443 - DNA, 25 bp, Mus musculus
ccacccgcgtggataacgctgaagg

SEQ ID NO: 334444 - DNA, 25 bp, Mus musculus
tcgtatctcattgagcgcgcgcgcg

SEQ ID NO: 334445 - DNA, 25 bp, Mus musculus
ggaggcctagccctgtggacactag

SEQ ID NO: 334446 - DNA, 25 bp, Mus musculus
ggacaccgggctgcaacctatggca

SEQ ID NO: 334447 - DNA, 25 bp, Mus musculus
aagggctccaaaaagcggcatccgc

SEQ ID NO: 334448 - DNA, 25 bp, Mus musculus
taagggccatgcgagcttctatccg

SEQ ID NO: 334449 - DNA, 25 bp, Mus musculus
aacgggatcttctcgctgtccttca

SEQ ID NO: 334450 - DNA, 25 bp, Mus musculus
aggaagacgcacttggctgccttgc

SEQ ID NO: 334451 - DNA, 25 bp, Mus musculus
cgccttgagcttggcgcacttcttg

SEQ ID NO: 334452 - DNA, 25 bp, Mus musculus
gtcgggataatcagccatgtgcttg

SEQ ID NO: 334453 - DNA, 25 bp, Mus musculus
tccgcctccctgatgaacgggatct

SEQ ID NO: 334454 - DNA, 25 bp, Mus musculus
gtccttcagcatcttccagcgcttg

SEQ ID NO: 334455 - DNA, 25 bp, Mus musculus
tgctccatgatcttcctgcgctcga

SEQ ID NO: 334456 - DNA, 25 bp, Mus musculus
gcgctcgatcttggaccacaccatg

SEQ ID NO: 334457 - DNA, 25 bp, Mus musculus
tctccggcaagttgcaaagtccttg

SEQ ID NO: 334458 - DNA, 25 bp, Mus musculus
cgcgcgcgcttcttctgcaaaaagt

SEQ ID NO: 334459 - DNA, 25 bp, Mus musculus
agggctctctctcaactcgttatca

SEQ ID NO: 334460 - DNA, 25 bp, Mus musculus
gactccgcctatctcccgttattaa

SEQ ID NO: 334461 - DNA, 25 bp, Mus musculus
ttcatcgtcgtcgtccaggaagacg

SEQ ID NO: 334462 - DNA, 25 bp, Mus musculus
gcttgcccagcctcttggagatctc

SEQ ID NO: 334463 - DNA, 25 bp, Mus musculus
actgtgcaaggaggcgcccagcaca

SEQ ID NO: 334464 - DNA, 25 bp, Mus musculus
tgggcgtgtagagcctccgcacacc

SEQ ID NO: 334465 - DNA, 25 bp, Mus musculus
tagagcctccgcacaccgaagggca

SEQ ID NO: 334466 - DNA, 25 bp, Mus musculus
ctgctcggtcagctgctccagcaga

SEQ ID NO: 334467 - DNA, 25 bp, Mus musculus
gtcagctgctccagcagagcctcga

SEQ ID NO: 334468 - DNA, 25 bp, Mus musculus
agagcctcgaagttggctacgcggc

SEQ ID NO: 334469 - DNA, 25 bp, Mus musculus
cggcgccgggagaacacgaacttgc

SEQ ID NO: 334470 - DNA, 25 bp, Mus musculus
gaacacgaacttgcggcccacatag

SEQ ID NO: 334471 - DNA, 25 bp, Mus musculus
ttgcggcccacatagaactggtccc

SEQ ID NO: 334472 - DNA, 25 bp, Mus musculus
cccgttgcggtacaccaagatggtc

SEQ ID NO: 334473 - DNA, 25 bp, Mus musculus
caccaagatggtcttggccggtgtg

SEQ ID NO: 334474 - DNA, 25 bp, Mus musculus
cggtgtggtgtccaccagcgcatag

SEQ ID NO: 334475 - DNA, 25 bp, Mus musculus
gtctgcagcgcgtccagtccgagca

SEQ ID NO: 334476 - DNA, 25 bp, Mus musculus
cctcgggacacgcagaactgtgcaa

SEQ ID NO: 334477 - DNA, 25 bp, Mus musculus
agacagagaacgtgggcgccatgcc

SEQ ID NO: 334478 - DNA, 25 bp, Mus musculus
gcttgttcccggtagtcgtcagcgt

SEQ ID NO: 334479 - DNA, 25 bp, Mus musculus
atgagcgtgccggtttcgcttgttc

SEQ ID NO: 334480 - DNA, 25 bp, Mus musculus
ttccctactgggaactaatgcggga

SEQ ID NO: 334481 - DNA, 25 bp, Mus musculus
gagttggaccgcctagagtgtaccg

SEQ ID NO: 334482 - DNA, 25 bp, Mus musculus
gggtggaaaccggaagctcttctga

SEQ ID NO: 334483 - DNA, 25 bp, Mus musculus
tcatatccgggtggcggaagaaaag

SEQ ID NO: 334484 - DNA, 25 bp, Mus musculus
tccgttggtgaaaattctccgctcc

SEQ ID NO: 334485 - DNA, 25 bp, Mus musculus
ctctgcgaaaaaccgcggccacatt

SEQ ID NO: 334486 - DNA, 25 bp, Mus musculus
aaggcggataatccgctgcatccca

SEQ ID NO: 334487 - DNA, 25 bp, Mus musculus
atctacgggcgcaaggcggataatc

SEQ ID NO: 334488 - DNA, 25 bp, Mus musculus
acccgggcgacaagctcacctgaga

SEQ ID NO: 334489 - DNA, 25 bp, Mus musculus
ggaccctgaggtcaagcgcgatcgc

SEQ ID NO: 334490 - DNA, 25 bp, Mus musculus
cagcgttcggctccgttggtgaaaa

SEQ ID NO: 334491 - DNA, 25 bp, Mus musculus
cgacgtctaagaaaccgaagacaca

SEQ ID NO: 334492 - DNA, 25 bp, Mus musculus
catttgcgggctcgggatgttctat

SEQ ID NO: 334493 - DNA, 25 bp, Mus musculus
gcgacgtcaccttcctgagccggaa

SEQ ID NO: 334494 - DNA, 25 bp, Mus musculus
tcgtacgcctgaggcgaggcatttg

SEQ ID NO: 334495 - DNA, 25 bp, Mus musculus
ttctatgcggtgaggagaggccgca

SEQ ID NO: 334496 - DNA, 25 bp, Mus musculus
cacagtgacactggccgtcgtacgc

SEQ ID NO: 334497 - DNA, 25 bp, Mus musculus
tgtcccgcacagtgacactggccgt

SEQ ID NO: 334498 - DNA, 25 bp, Mus musculus
gaaaccgaagacacaatcctcggcc

SEQ ID NO: 334499 - DNA, 25 bp, Mus musculus
tctccaccgacgtctaagaaaccga

SEQ ID NO: 334500 - DNA, 25 bp, Mus musculus
cgaacgtctccaccgacgtctaaga

SEQ ID NO: 334501 - DNA, 25 bp, Mus musculus
gaccggagtcttcctgagttggtga

SEQ ID NO: 334502 - DNA, 25 bp, Mus musculus
ttcctgagttggtgagacggagcct

SEQ ID NO: 334503 - DNA, 25 bp, Mus musculus
cttcctgagccggaagtgtgtcggc

SEQ ID NO: 334504 - DNA, 25 bp, Mus musculus
tgacactggccgtcgtacgcctgag

SEQ ID NO: 334505 - DNA, 25 bp, Mus musculus
ccctccaggtcgagaatttcactct

SEQ ID NO: 334506 - DNA, 25 bp, Mus musculus
cttgacgcctgctgcgttctgcatc

SEQ ID NO: 334507 - DNA, 25 bp, Mus musculus
tctccgccagctgccggatgttctt

SEQ ID NO: 334508 - DNA, 25 bp, Mus musculus
gatgttcttgctgcgcccatcgatg

SEQ ID NO: 334509 - DNA, 25 bp, Mus musculus
cccatcgatgaacaggtcgcggatg

SEQ ID NO: 334510 - DNA, 25 bp, Mus musculus
gcggatgcagcccacgtaaccgtag

SEQ ID NO: 334511 - DNA, 25 bp, Mus musculus
ggttctctggcagcccgcccagata

SEQ ID NO: 334512 - DNA, 25 bp, Mus musculus
ttcttgcaggggtagctgtcacact

SEQ ID NO: 334513 - DNA, 25 bp, Mus musculus
ccgtagttgagcatggcggtccaga

SEQ ID NO: 334514 - DNA, 25 bp, Mus musculus
cgtccttgcacaccgcgttgttctt

SEQ ID NO: 334515 - DNA, 25 bp, Mus musculus
atgaagcggttccagccgtccttgc

SEQ ID NO: 334516 - DNA, 25 bp, Mus musculus
gtgccagtgcagtcgcagatgaagc

SEQ ID NO: 334517 - DNA, 25 bp, Mus musculus
tgtcacactgcttggcgctcatgcg

SEQ ID NO: 334518 - DNA, 25 bp, Mus musculus
ctcatgcgtgaacaggaggacttga

SEQ ID NO: 334519 - DNA, 25 bp, Mus musculus
ttccgggttccgctgatcagaagcg

SEQ ID NO: 334520 - DNA, 25 bp, Mus musculus
gcggcagcgtgacattgaagacttc

SEQ ID NO: 334521 - DNA, 25 bp, Mus musculus
cattgaagacttccagttccgggtt

SEQ ID NO: 334522 - DNA, 25 bp, Mus musculus
gatcagaagcggacaagcaaacagc

SEQ ID NO: 334523 - DNA, 25 bp, Mus musculus
cagcggatgtgcagttcctctcttc

SEQ ID NO: 334524 - DNA, 25 bp, Mus musculus
ttttccctttcggagcagcgcgacc

SEQ ID NO: 334525 - DNA, 25 bp, Mus musculus
gcagcgcgaccgatttccggtttcc

SEQ ID NO: 334526 - DNA, 25 bp, Mus musculus
gcgacgtcaccggttcagctcctga

SEQ ID NO: 334527 - DNA, 25 bp, Mus musculus
gttcagctcctgacctttcggcgaa

SEQ ID NO: 334528 - DNA, 25 bp, Mus musculus
ttcggcgaaccgcagaaccacaggc

SEQ ID NO: 334529 - DNA, 25 bp, Mus musculus
aggcgacccgttcgacgtcatcact

SEQ ID NO: 334530 - DNA, 25 bp, Mus musculus
ccgcccagatgtcgctgtgacatca

SEQ ID NO: 334531 - DNA, 25 bp, Mus musculus
tttcacgtgagtgacacttggtccc

SEQ ID NO: 334532 - DNA, 25 bp, Mus musculus
cccacgggattgacagcgactagcg

SEQ ID NO: 334533 - DNA, 25 bp, Mus musculus
aacggctagccgcaaatgtgcttgc

SEQ ID NO: 334534 - DNA, 25 bp, Mus musculus
cgggaaccagatcggctgctgcttc

SEQ ID NO: 334535 - DNA, 25 bp, Mus musculus
gcagcgacgtgacttaaggccgccc

SEQ ID NO: 334536 - DNA, 25 bp, Mus musculus
cttgcgcagaagtcctggccgtaaa

SEQ ID NO: 334537 - DNA, 25 bp, Mus musculus
tggccgtaaagaaacaagggcatta

SEQ ID NO: 334538 - DNA, 25 bp, Mus musculus
agggcattacgacattggctacttg

SEQ ID NO: 334539 - DNA, 25 bp, Mus musculus
cattggctacttgcggcagcgacgt

SEQ ID NO: 334540 - DNA, 25 bp, Mus musculus
tagggcgtcgttgagctcgaaagct

SEQ ID NO: 334541 - DNA, 25 bp, Mus musculus
agctcgaaagctaaggcgggagttt

SEQ ID NO: 334542 - DNA, 25 bp, Mus musculus
cggaatgacccagtcggtggtcgta

SEQ ID NO: 334543 - DNA, 25 bp, Mus musculus
cggagccagtcacctggttgccttc

SEQ ID NO: 334544 - DNA, 25 bp, Mus musculus
tctcttcctcgctactggctgcagt

SEQ ID NO: 334545 - DNA, 25 bp, Mus musculus
agcacgcagcggtcaaccaggtacc

SEQ ID NO: 334546 - DNA, 25 bp, Mus musculus
tggttgccttcctaatgcacctctc

SEQ ID NO: 334547 - DNA, 25 bp, Mus musculus
tgtccgagagaagtgggaaaagctc

SEQ ID NO: 334548 - DNA, 25 bp, Mus musculus
tgggaaaagctcactggctcggaga

SEQ ID NO: 334549 - DNA, 25 bp, Mus musculus
ctcactggctcggagaaccttcggg

SEQ ID NO: 334550 - DNA, 25 bp, Mus musculus
aaccttcggggtgggtgagatcgct

SEQ ID NO: 334551 - DNA, 25 bp, Mus musculus
tgagatcgctggctactctgccacc

SEQ ID NO: 334552 - DNA, 25 bp, Mus musculus
aaggcagcggcacagtgtgcacacc

SEQ ID NO: 334553 - DNA, 25 bp, Mus musculus
gcggcacagtgtgcacaccgcaaca

SEQ ID NO: 334554 - DNA, 25 bp, Mus musculus
agtgtgcacaccgcaacacctcgtg

SEQ ID NO: 334555 - DNA, 25 bp, Mus musculus
acacctcgtgccatcgccacacaca

SEQ ID NO: 334556 - DNA, 25 bp, Mus musculus
agctcactggctcggagaaccttcg

SEQ ID NO: 334557 - DNA, 25 bp, Mus musculus
gagtcgagtctgcagagcaggattt

SEQ ID NO: 334558 - DNA, 25 bp, Mus musculus
tcgagtctgcagagcaggatttgca

SEQ ID NO: 334559 - DNA, 25 bp, Mus musculus
agattggtcctgtccgagagaagtg

SEQ ID NO: 334560 - DNA, 25 bp, Mus musculus
atttgcagcggagattggtcctgtc

SEQ ID NO: 334561 - DNA, 25 bp, Mus musculus
tcggaactgctcactacaaccaact

SEQ ID NO: 334562 - DNA, 25 bp, Mus musculus
ggtgagcggcttgacgaacacgccc

SEQ ID NO: 334563 - DNA, 25 bp, Mus musculus
tccctacggcctcctgattgggtga

SEQ ID NO: 334564 - DNA, 25 bp, Mus musculus
agacgcacgcaaggacgtacacccg

SEQ ID NO: 334565 - DNA, 25 bp, Mus musculus
tgcgcgcagcctgagacgcacgcaa

SEQ ID NO: 334566 - DNA, 25 bp, Mus musculus
gcgagccgacaagccctgctacata

SEQ ID NO: 334567 - DNA, 25 bp, Mus musculus
gagtcggtcgggacaaaatggcctc

SEQ ID NO: 334568 - DNA, 25 bp, Mus musculus
cccgatcaggagcagcttgaaaagc

SEQ ID NO: 334569 - DNA, 25 bp, Mus musculus
ctctcgagacggagcaggagacctt

SEQ ID NO: 334570 - DNA, 25 bp, Mus musculus
cccaagggatcggaactgctcacta

SEQ ID NO: 334571 - DNA, 25 bp, Mus musculus
gtacgtcttcttcgccattgggagg

SEQ ID NO: 334572 - DNA, 25 bp, Mus musculus
aaaggacgcaggtcttgcccactcc

SEQ ID NO: 334573 - DNA, 25 bp, Mus musculus
gagaccttccgaacggcctcgtcga

SEQ ID NO: 334574 - DNA, 25 bp, Mus musculus
cttgaaaagcaggtcgtacgtcttc

SEQ ID NO: 334575 - DNA, 25 bp, Mus musculus
tggaagggcaagtccacctccacct

SEQ ID NO: 334576 - DNA, 25 bp, Mus musculus
cgtgacccggatcgtgtccatcggg

SEQ ID NO: 334577 - DNA, 25 bp, Mus musculus
ggatcgtgtccatcgggcaccaggc

SEQ ID NO: 334578 - DNA, 25 bp, Mus musculus
agtcagggctcagcgagcctgctga

SEQ ID NO: 334579 - DNA, 25 bp, Mus musculus
cctgctgaggcaatgtggaaagtca

SEQ ID NO: 334580 - DNA, 25 bp, Mus musculus
acccgcgctcgaggcaatgattcac

SEQ ID NO: 334581 - DNA, 25 bp, Mus musculus
gaggcaatgattcaccgggtgtttc

SEQ ID NO: 334582 - DNA, 25 bp, Mus musculus
cgggtgtttcttcgcattccttaag

SEQ ID NO: 334583 - DNA, 25 bp, Mus musculus
gcattccttaaggtgcagtcacgtc

SEQ ID NO: 334584 - DNA, 25 bp, Mus musculus
cccggcagctacctgtggagtggaa

SEQ ID NO: 334585 - DNA, 25 bp, Mus musculus
gcctcagtcgctgcttgctgcttca

SEQ ID NO: 334586 - DNA, 25 bp, Mus musculus
ggcgacccttgggagacagcacgcc

SEQ ID NO: 334587 - DNA, 25 bp, Mus musculus
ctgctgatgcatcctgagcccggct

SEQ ID NO: 334588 - DNA, 25 bp, Mus musculus
gtgcagtcacgtcggcgcagcacgc

SEQ ID NO: 334589 - DNA, 25 bp, Mus musculus
acggaagcctcccagtcagtcagaa

SEQ ID NO: 334590 - DNA, 25 bp, Mus musculus
gcggcctgcagcgtacagtagtgac

SEQ ID NO: 334591 - DNA, 25 bp, Mus musculus
gtcacgtgaccacagaagctgcttg

SEQ ID NO: 334592 - DNA, 25 bp, Mus musculus
aagctgcttgtacagtaagaaccca

SEQ ID NO: 334593 - DNA, 25 bp, Mus musculus
agaacccaatatggcagcggcggta

SEQ ID NO: 334594 - DNA, 25 bp, Mus musculus
ctgagttgcttctcgggtccgactt

SEQ ID NO: 334595 - DNA, 25 bp, Mus musculus
agacatccgacccacagaccatggg

SEQ ID NO: 334596 - DNA, 25 bp, Mus musculus
taaccggttcttctcccttgtgcgc

SEQ ID NO: 334597 - DNA, 25 bp, Mus musculus
aaggctggcaggagttcgttttctc

SEQ ID NO: 334598 - DNA, 25 bp, Mus musculus
cccgtcgcaaggcaagggaggtcac

SEQ ID NO: 334599 - DNA, 25 bp, Mus musculus
actgcgacttctcgcggtggctacg

SEQ ID NO: 334600 - DNA, 25 bp, Mus musculus
ctacgactggacctcctcggtgttg

SEQ ID NO: 334601 - DNA, 25 bp, Mus musculus
cctcggtgttgtgaggttgcctttc

SEQ ID NO: 334602 - DNA, 25 bp, Mus musculus
tgtgcttgcccagtaaccggttctt

SEQ ID NO: 334603 - DNA, 25 bp, Mus musculus
cgcacagcgtccattcgccgatgta

SEQ ID NO: 334604 - DNA, 25 bp, Mus musculus
tgcgtcctttacagccagcgatgga

SEQ ID NO: 334605 - DNA, 25 bp, Mus musculus
gccttggattcctgtgcgtccttta

SEQ ID NO: 334606 - DNA, 25 bp, Mus musculus
actgttacttggtactgccgccggc

SEQ ID NO: 334607 - DNA, 25 bp, Mus musculus
gggctgcaggtacactatgtctaga

SEQ ID NO: 334608 - DNA, 25 bp, Mus musculus
ctcctgtttcttacgcgggctgcag

SEQ ID NO: 334609 - DNA, 25 bp, Mus musculus
ggcctcatgactctctctcggttcg

SEQ ID NO: 334610 - DNA, 25 bp, Mus musculus
ggcagagcctcgtgcgtcatctcca

SEQ ID NO: 334611 - DNA, 25 bp, Mus musculus
tccacccagaggctcggacactaga

SEQ ID NO: 334612 - DNA, 25 bp, Mus musculus
tagcaccgggtaaagtccacccaga

SEQ ID NO: 334613 - DNA, 25 bp, Mus musculus
ttgcggagcacattctggccgtagc

SEQ ID NO: 334614 - DNA, 25 bp, Mus musculus
ggcgcggattaaggacgtcaaaatc

SEQ ID NO: 334615 - DNA, 25 bp, Mus musculus
attgacagagtgaaagcgcggtgcc

SEQ ID NO: 334616 - DNA, 25 bp, Mus musculus
gtaagggtctgagttggtctcctgc

SEQ ID NO: 334617 - DNA, 25 bp, Mus musculus
agagcctgagctcaaacgtcgcgga

SEQ ID NO: 334618 - DNA, 25 bp, Mus musculus
ctacagaagccggtgccgcgaggcc

SEQ ID NO: 334619 - DNA, 25 bp, Mus musculus
accagagcgcctacagaagccggtg

SEQ ID NO: 334620 - DNA, 25 bp, Mus musculus
aaacagtgctttcgccaccagagcg

SEQ ID NO: 334621 - DNA, 25 bp, Mus musculus
actcaccagagggtagggaagctgc

SEQ ID NO: 334622 - DNA, 25 bp, Mus musculus
ctctgtgcgcgggtgctactcacca

SEQ ID NO: 334623 - DNA, 25 bp, Mus musculus
cccgcacaatctggcagcgggattg

SEQ ID NO: 334624 - DNA, 25 bp, Mus musculus
tcaaacgtcgcggagcacatctgca

SEQ ID NO: 334625 - DNA, 25 bp, Mus musculus
ggcggcagagcctgagctcaaacgt

SEQ ID NO: 334626 - DNA, 25 bp, Mus musculus
tcccagcttcgtctgggcggcagag

SEQ ID NO: 334627 - DNA, 25 bp, Mus musculus
cagggtcacaggctcgagtttcctc

SEQ ID NO: 334628 - DNA, 25 bp, Mus musculus
aaccacgtggtttcgccagctaggg

SEQ ID NO: 334629 - DNA, 25 bp, Mus musculus
tgcgagtcacctgaaccacgtggtt

SEQ ID NO: 334630 - DNA, 25 bp, Mus musculus
gtcgcggagcacatctgcaccggac

SEQ ID NO: 334631 - DNA, 25 bp, Mus musculus
caagcatgcatctggatcgccaaga

SEQ ID NO: 334632 - DNA, 25 bp, Mus musculus
agcgccaaaggagtcacatctcagc

SEQ ID NO: 334633 - DNA, 25 bp, Mus musculus
taatcctatatggagtaggcaggcc

SEQ ID NO: 334634 - DNA, 25 bp, Mus musculus
taggcaggccagattgtaacgcctc

SEQ ID NO: 334635 - DNA, 25 bp, Mus musculus
tgtaacgcctctacaagttccttag

SEQ ID NO: 334636 - DNA, 25 bp, Mus musculus
tttaataacctttccagaccctgca

SEQ ID NO: 334637 - DNA, 25 bp, Mus musculus
tgcaacaatctccacctgccagatt

SEQ ID NO: 334638 - DNA, 25 bp, Mus musculus
caaatatgtggcactcgagcatggc

SEQ ID NO: 334639 - DNA, 25 bp, Mus musculus
tggaagactcagtgggatgtgcctc

SEQ ID NO: 334640 - DNA, 25 bp, Mus musculus
tggatcgccaagacacaaaggcctt

SEQ ID NO: 334641 - DNA, 25 bp, Mus musculus
gaaaacccacttcatcaagaacacg

SEQ ID NO: 334642 - DNA, 25 bp, Mus musculus
cttcatcaagaacacgaggcagtat

SEQ ID NO: 334643 - DNA, 25 bp, Mus musculus
aaggagtcacatctcagcgctgttc

SEQ ID NO: 334644 - DNA, 25 bp, Mus musculus
cagcgctgttcccttgagtttctgg

SEQ ID NO: 334645 - DNA, 25 bp, Mus musculus
ggccggtgtagacgtgtccttgaaa

SEQ ID NO: 334646 - DNA, 25 bp, Mus musculus
tctgcacagtgaaggacgaggcctc

SEQ ID NO: 334647 - DNA, 25 bp, Mus musculus
agcagcaaggctggaaatgtctccg

SEQ ID NO: 334648 - DNA, 25 bp, Mus musculus
ctgaggcagactccccttgcataca

SEQ ID NO: 334649 - DNA, 25 bp, Mus musculus
gtagacgtgtccttgaaagcttcgc

SEQ ID NO: 334650 - DNA, 25 bp, Mus musculus
tgtccttgaaagcttcgcatctgca

SEQ ID NO: 334651 - DNA, 25 bp, Mus musculus
ttgaaagcttcgcatctgcacagtg

SEQ ID NO: 334652 - DNA, 25 bp, Mus musculus
catgttgccctcacctcaggagaca

SEQ ID NO: 334653 - DNA, 25 bp, Mus musculus
aggagacacccgagcctccgagcgg

SEQ ID NO: 334654 - DNA, 25 bp, Mus musculus
gccgcggtccgtgtcctgccctcac

SEQ ID NO: 334655 - DNA, 25 bp, Mus musculus
tactccacgccgtcttgccctccct

SEQ ID NO: 334656 - DNA, 25 bp, Mus musculus
ccctccctcgttggcgcggaccgag

SEQ ID NO: 334657 - DNA, 25 bp, Mus musculus
agcaaggctggaaatgtctccggtg

SEQ ID NO: 334658 - DNA, 25 bp, Mus musculus
acagtgaaggacgaggcctcgccga

SEQ ID NO: 334659 - DNA, 25 bp, Mus musculus
agcaggaggccgctgcagcctttat

SEQ ID NO: 334660 - DNA, 25 bp, Mus musculus
agaacgagagaaagtgtgacggacc

SEQ ID NO: 334661 - DNA, 25 bp, Mus musculus
ggctcggtcatccttaaacaacaga

SEQ ID NO: 334662 - DNA, 25 bp, Mus musculus
gctggctcggtcatccttaaacaac

SEQ ID NO: 334663 - DNA, 25 bp, Mus musculus
aggctggctcggtcatccttaaaca

SEQ ID NO: 334664 - DNA, 25 bp, Mus musculus
ggaaggctggctcggtcatccttaa

SEQ ID NO: 334665 - DNA, 25 bp, Mus musculus
gacggacctgccttttctacatcct

SEQ ID NO: 334666 - DNA, 25 bp, Mus musculus
gacaggaaggctggctcggtcatcc

SEQ ID NO: 334667 - DNA, 25 bp, Mus musculus
caccgccgctccgtctgggaaatgt

SEQ ID NO: 334668 - DNA, 25 bp, Mus musculus
ggcaccgccgctccgtctgggaaat

SEQ ID NO: 334669 - DNA, 25 bp, Mus musculus
caggaggccgctgcagcctttatag

SEQ ID NO: 334670 - DNA, 25 bp, Mus musculus
agacagaaagcaggaggccgctgca

SEQ ID NO: 334671 - DNA, 25 bp, Mus musculus
cggacctgccttttctacatccttg

SEQ ID NO: 334672 - DNA, 25 bp, Mus musculus
ttctacatccttgggatctttgggg

SEQ ID NO: 334673 - DNA, 25 bp, Mus musculus
gcaacatggtgcatctgggaggcct

SEQ ID NO: 334674 - DNA, 25 bp, Mus musculus
gagccatcctggaagcgcgaatctg

SEQ ID NO: 334675 - DNA, 25 bp, Mus musculus
tcctggaagcgcgaatctggtaccg

SEQ ID NO: 334676 - DNA, 25 bp, Mus musculus
agcgagggatgcaacatggtgcatc

SEQ ID NO: 334677 - DNA, 25 bp, Mus musculus
cgcccttgagcctaaggtcgccgaa

SEQ ID NO: 334678 - DNA, 25 bp, Mus musculus
ctgggaggcctgctaactggctaac

SEQ ID NO: 334679 - DNA, 25 bp, Mus musculus
tgctaactggctaacttctccggcg

SEQ ID NO: 334680 - DNA, 25 bp, Mus musculus
actggctaacttctccggcgttcct

SEQ ID NO: 334681 - DNA, 25 bp, Mus musculus
cacagaatagcgcaggtgaggccca

SEQ ID NO: 334682 - DNA, 25 bp, Mus musculus
aggtgaggcccagatatggtgtctc

SEQ ID NO: 334683 - DNA, 25 bp, Mus musculus
cccagatatggtgtctcgatacggc

SEQ ID NO: 334684 - DNA, 25 bp, Mus musculus
tatggtgtctcgatacggcgcggaa

SEQ ID NO: 334685 - DNA, 25 bp, Mus musculus
tgagcctaaggtcgccgaacgaccg

SEQ ID NO: 334686 - DNA, 25 bp, Mus musculus
gaagcgcgaatctggtaccgggact

SEQ ID NO: 334687 - DNA, 25 bp, Mus musculus
cctgttttggctttcggctttgacg

SEQ ID NO: 334688 - DNA, 25 bp, Mus musculus
cccgagaaggatgccaagccagaca

SEQ ID NO: 334689 - DNA, 25 bp, Mus musculus
tggaaccagcctacgtcgcactcaa

SEQ ID NO: 334690 - DNA, 25 bp, Mus musculus
ccgccctcagagatggtccttaaaa

SEQ ID NO: 334691 - DNA, 25 bp, Mus musculus
atgcccaacggctgcggaagttctt

SEQ ID NO: 334692 - DNA, 25 bp, Mus musculus
gttctttcctggtctccttcgctca

SEQ ID NO: 334693 - DNA, 25 bp, Mus musculus
ttccgcgggatagtctcctgttttg

SEQ ID NO: 334694 - DNA, 25 bp, Mus musculus
tcctggagacctaaactatggccta

SEQ ID NO: 334695 - DNA, 25 bp, Mus musculus
tgagccaagacccagcgagtgactg

SEQ ID NO: 334696 - DNA, 25 bp, Mus musculus
ggagctttcccaaggtgcttacagg

SEQ ID NO: 334697 - DNA, 25 bp, Mus musculus
gtacacgcgatccttgcacgaattg

SEQ ID NO: 334698 - DNA, 25 bp, Mus musculus
ccgagaccctgtagcgtcggtaaca

SEQ ID NO: 334699 - DNA, 25 bp, Mus musculus
agcgctttccctgttaggagctttc

SEQ ID NO: 334700 - DNA, 25 bp, Mus musculus
ttcgctcagtcccacaggcttgttc

SEQ ID NO: 334701 - DNA, 25 bp, Mus musculus
aggcacctgtaagcgtttatattta

SEQ ID NO: 334702 - DNA, 25 bp, Mus musculus
cggaaaggcgacgtttgtcttgctc

SEQ ID NO: 334703 - DNA, 25 bp, Mus musculus
tcgtggtcggctagagcatgcagca

SEQ ID NO: 334704 - DNA, 25 bp, Mus musculus
accgcgatctcggtgcggtgcagcc

SEQ ID NO: 334705 - DNA, 25 bp, Mus musculus
tgcagcctcagcagacggcgtagca

SEQ ID NO: 334706 - DNA, 25 bp, Mus musculus
agcagacggcgtagcattccatccc

SEQ ID NO: 334707 - DNA, 25 bp, Mus musculus
tgccatcttcctcacaggggctgcg

SEQ ID NO: 334708 - DNA, 25 bp, Mus musculus
tctcccttccttgggtgtcgtggtg

SEQ ID NO: 334709 - DNA, 25 bp, Mus musculus
ccggagaggcacctgtaagcgttta

SEQ ID NO: 334710 - DNA, 25 bp, Mus musculus
cggctagagcatgcagcagcggaaa

SEQ ID NO: 334711 - DNA, 25 bp, Mus musculus
tgcagcagcggaaaggcactgtcta

SEQ ID NO: 334712 - DNA, 25 bp, Mus musculus
aaggcactgtctatggccaccgcga

SEQ ID NO: 334713 - DNA, 25 bp, Mus musculus
tgtctatggccaccgcgatctcggt

SEQ ID NO: 334714 - DNA, 25 bp, Mus musculus
tcgtggtgctatccggagaggcacc

SEQ ID NO: 334715 - DNA, 25 bp, Mus musculus
tcaactttgggctgttataaactca

SEQ ID NO: 334716 - DNA, 25 bp, Mus musculus
cggcgggaaagtgacttcacaaatt

SEQ ID NO: 334717 - DNA, 25 bp, Mus musculus
cggcgggaaagtgatgtcacatatc

SEQ ID NO: 334718 - DNA, 25 bp, Mus musculus
ccctctctggatcggagccctataa

SEQ ID NO: 334719 - DNA, 25 bp, Mus musculus
gccctataaggaccgaaagcctgcg

SEQ ID NO: 334720 - DNA, 25 bp, Mus musculus
tacttgaaatcgtgtgtggctctga

SEQ ID NO: 334721 - DNA, 25 bp, Mus musculus
tggggaatatccaccgttatagaca

SEQ ID NO: 334722 - DNA, 25 bp, Mus musculus
tcagagatccgacctgtacacttta

SEQ ID NO: 334723 - DNA, 25 bp, Mus musculus
ctcctctcagccatgccgggaaaga

SEQ ID NO: 334724 - DNA, 25 bp, Mus musculus
gtacactttacgcatattccacggg

SEQ ID NO: 334725 - DNA, 25 bp, Mus musculus
tgcgagtaggtcacgtcagagatcc

SEQ ID NO: 334726 - DNA, 25 bp, Mus musculus
cagagctgagagtcggtcctttata

SEQ ID NO: 334727 - DNA, 25 bp, Mus musculus
tgccgcgacccgacatgtcttagga

SEQ ID NO: 334728 - DNA, 25 bp, Mus musculus
gcccgccggacggtgacgtcataaa

SEQ ID NO: 334729 - DNA, 25 bp, Mus musculus
ccacggagaaacctgctgctgcaaa

SEQ ID NO: 334730 - DNA, 25 bp, Mus musculus
ctgctgcaaagaagaccaagaagcc

SEQ ID NO: 334731 - DNA, 25 bp, Mus musculus
tctactgccacggagaaacctgctg

SEQ ID NO: 334732 - DNA, 25 bp, Mus musculus
gaagccggcaaaagctgccgctcct

SEQ ID NO: 334733 - DNA, 25 bp, Mus musculus
aagctgccgctcctcggaagaagcc

SEQ ID NO: 334734 - DNA, 25 bp, Mus musculus
gaccttcggtgtcggagctcatcgt

SEQ ID NO: 334735 - DNA, 25 bp, Mus musculus
ggagctcatcgtgcaggcagtttct

SEQ ID NO: 334736 - DNA, 25 bp, Mus musculus
tcatcgtgcaggcagtttcttcttc

SEQ ID NO: 334737 - DNA, 25 bp, Mus musculus
gtttcttcttccaaagagcgcagtg

SEQ ID NO: 334738 - DNA, 25 bp, Mus musculus
ccaaagagcgcagtggcgtgtcctt

SEQ ID NO: 334739 - DNA, 25 bp, Mus musculus
ccttggccgcgctcaagaagtcgct

SEQ ID NO: 334740 - DNA, 25 bp, Mus musculus
cgctcaagaagtcgctggctgcggc

SEQ ID NO: 334741 - DNA, 25 bp, Mus musculus
gccagtcgctcaggctgcttctact

SEQ ID NO: 334742 - DNA, 25 bp, Mus musculus
caggctgcttctactgccacggaga

SEQ ID NO: 334743 - DNA, 25 bp, Mus musculus
agcccgagagccatctgctggctgc

SEQ ID NO: 334744 - DNA, 25 bp, Mus musculus
gcagttgagagagcccgagagccat

SEQ ID NO: 334745 - DNA, 25 bp, Mus musculus
ttcggtgcagcagacgcttgcgtct

SEQ ID NO: 334746 - DNA, 25 bp, Mus musculus
tggctgctgccttgactgctgcggc

SEQ ID NO: 334747 - DNA, 25 bp, Mus musculus
tctgcgccgcaccttgggcgtaggt

SEQ ID NO: 334748 - DNA, 25 bp, Mus musculus
aaggcggctgcaacaccggcttctt

SEQ ID NO: 334749 - DNA, 25 bp, Mus musculus
ggccgaacgcaaggcggctgcaaca

SEQ ID NO: 334750 - DNA, 25 bp, Mus musculus
tcggctcgctgcttcaggggccgaa

SEQ ID NO: 334751 - DNA, 25 bp, Mus musculus
tgaaaatccgagctggctctgcggc

SEQ ID NO: 334752 - DNA, 25 bp, Mus musculus
cctaagagttgaaaatccgagctgg

SEQ ID NO: 334753 - DNA, 25 bp, Mus musculus
gcgttgatccaaggttgccgcgcgc

SEQ ID NO: 334754 - DNA, 25 bp, Mus musculus
cagaccctttaatgtttccgcgagg

SEQ ID NO: 334755 - DNA, 25 bp, Mus musculus
ggagatcccgggtcccactctctga

SEQ ID NO: 334756 - DNA, 25 bp, Mus musculus
gacatcggagctctcgtcggtcatg

SEQ ID NO: 334757 - DNA, 25 bp, Mus musculus
gcgttctcggcaggtaggtgcacgc

SEQ ID NO: 334758 - DNA, 25 bp, Mus musculus
ccgaggtggtacatgccacccggta

SEQ ID NO: 334759 - DNA, 25 bp, Mus musculus
cctcggacctttccctgttggctgg

SEQ ID NO: 334760 - DNA, 25 bp, Mus musculus
tttccctgttggctgggaggaacga

SEQ ID NO: 334761 - DNA, 25 bp, Mus musculus
gctgggaggaacgagcaccggtgtc

SEQ ID NO: 334762 - DNA, 25 bp, Mus musculus
ggtgccgaggtggtacatgccaccc

SEQ ID NO: 334763 - DNA, 25 bp, Mus musculus
tggtacatgccacccggtactaagc

SEQ ID NO: 334764 - DNA, 25 bp, Mus musculus
acatgccacccggtactaagcgtct

SEQ ID NO: 334765 - DNA, 25 bp, Mus musculus
cggtactaagcgtctccgggcacta

SEQ ID NO: 334766 - DNA, 25 bp, Mus musculus
tactaagcgtctccgggcactagga

SEQ ID NO: 334767 - DNA, 25 bp, Mus musculus
cactaggagcgttctcggcaggtag

SEQ ID NO: 334768 - DNA, 25 bp, Mus musculus
tggggccacgactgttaccctcgga

SEQ ID NO: 334769 - DNA, 25 bp, Mus musculus
cgtctccgggcactaggagcgttct

SEQ ID NO: 334770 - DNA, 25 bp, Mus musculus
gacctttccctgttggctgggagga

SEQ ID NO: 334771 - DNA, 25 bp, Mus musculus
tgagagccgcacaaggccctggcac

SEQ ID NO: 334772 - DNA, 25 bp, Mus musculus
aagagactctcactagcggcaaaca

SEQ ID NO: 334773 - DNA, 25 bp, Mus musculus
gactcgggtcccttcaaatcgtcgc

SEQ ID NO: 334774 - DNA, 25 bp, Mus musculus
gacagcaatgctcagttcccggcga

SEQ ID NO: 334775 - DNA, 25 bp, Mus musculus
cagctttgccttgcagtcgggccga

SEQ ID NO: 334776 - DNA, 25 bp, Mus musculus
caccggattcaacgacgccagaacg

SEQ ID NO: 334777 - DNA, 25 bp, Mus musculus
gaacgacccgaacctgcagactaac

SEQ ID NO: 334778 - DNA, 25 bp, Mus musculus
cgacccggtagctgacgcgccgaaa

SEQ ID NO: 334779 - DNA, 25 bp, Mus musculus
cggagcctcggcattcagccaatcg

SEQ ID NO: 334780 - DNA, 25 bp, Mus musculus
acccagccaaggtgcgtgcagtctc

SEQ ID NO: 334781 - DNA, 25 bp, Mus musculus
ggtcaccgaggttcctcttgcctta

SEQ ID NO: 334782 - DNA, 25 bp, Mus musculus
tcttgccttaggagtgtgtgccctc

SEQ ID NO: 334783 - DNA, 25 bp, Mus musculus
tgtgccctctgaccttgccgtctga

SEQ ID NO: 334784 - DNA, 25 bp, Mus musculus
gccctcggactcacagacagcaatg

SEQ ID NO: 334785 - DNA, 25 bp, Mus musculus
ttcttttcctcaaacgcgactcagc

SEQ ID NO: 334786 - DNA, 25 bp, Mus musculus
cgcagcagccgtcgctgccatttta

SEQ ID NO: 334787 - DNA, 25 bp, Mus musculus
gccgacgctcgaaccgagacaactt

SEQ ID NO: 334788 - DNA, 25 bp, Mus musculus
gccgtcgctgccattttaagttgtt

SEQ ID NO: 334789 - DNA, 25 bp, Mus musculus
cgctgccattttaagttgtttgttc

SEQ ID NO: 334790 - DNA, 25 bp, Mus musculus
cgctcgaaccgagacaactttgccg

SEQ ID NO: 334791 - DNA, 25 bp, Mus musculus
actccgcggacaggccgtagcgcag

SEQ ID NO: 334792 - DNA, 25 bp, Mus musculus
caggcctcgggagccgacgctcgaa

SEQ ID NO: 334793 - DNA, 25 bp, Mus musculus
tcctgaaccggactgttgggcgaag

SEQ ID NO: 334794 - DNA, 25 bp, Mus musculus
tggactatcttcctgaaccggactg

SEQ ID NO: 334795 - DNA, 25 bp, Mus musculus
ggggctctctcttggactatcttcc

SEQ ID NO: 334796 - DNA, 25 bp, Mus musculus
catccgtcggggctctctcttggac

SEQ ID NO: 334797 - DNA, 25 bp, Mus musculus
tcgacctcctcctccgttgcggctc

SEQ ID NO: 334798 - DNA, 25 bp, Mus musculus
aactttgccgggctcactccgcgga

SEQ ID NO: 334799 - DNA, 25 bp, Mus musculus
tgctcacacgaagataatcgaactc

SEQ ID NO: 334800 - DNA, 25 bp, Mus musculus
aaatgagtgagaacccgagtgatcc

SEQ ID NO: 334801 - DNA, 25 bp, Mus musculus
gtgagaacccgagtgatccagtgtc

SEQ ID NO: 334802 - DNA, 25 bp, Mus musculus
cgggaattgtttccacattgaaatg

SEQ ID NO: 334803 - DNA, 25 bp, Mus musculus
ccgggcgggaattgtttccacattg

SEQ ID NO: 334804 - DNA, 25 bp, Mus musculus
gaagataatcgaactccctaccatc

SEQ ID NO: 334805 - DNA, 25 bp, Mus musculus
cagccatgctcacacgaagataatc

SEQ ID NO: 334806 - DNA, 25 bp, Mus musculus
gccaccttagcctcagccatgctca

SEQ ID NO: 334807 - DNA, 25 bp, Mus musculus
tcgctgccgctgaaggccaggggtt

SEQ ID NO: 334808 - DNA, 25 bp, Mus musculus
ccagtgtctcccgtggtgcgagtga

SEQ ID NO: 334809 - DNA, 25 bp, Mus musculus
agtgatccagtgtctcccgtggtgc

SEQ ID NO: 334810 - DNA, 25 bp, Mus musculus
cccgagtgatccagtgtctcccgtg

SEQ ID NO: 334811 - DNA, 25 bp, Mus musculus
ccacattgaaatgagtgagaacccg

SEQ ID NO: 334812 - DNA, 25 bp, Mus musculus
agaacccgagtgatccagtgtctcc

SEQ ID NO: 334813 - DNA, 25 bp, Mus musculus
agctgccagagaacgaccaagggtg

SEQ ID NO: 334814 - DNA, 25 bp, Mus musculus
ccttcaagtccgaggcctagtaagc

SEQ ID NO: 334815 - DNA, 25 bp, Mus musculus
agcgcctacttcgagctgccagaga

SEQ ID NO: 334816 - DNA, 25 bp, Mus musculus
tttcagaaagccctgagcgcctact

SEQ ID NO: 334817 - DNA, 25 bp, Mus musculus
cagccttgtgcctttgcttttcaga

SEQ ID NO: 334818 - DNA, 25 bp, Mus musculus
aggtcagttcgcgtctctcgcttcc

SEQ ID NO: 334819 - DNA, 25 bp, Mus musculus
cctggtcctagatgatcacgggtta

SEQ ID NO: 334820 - DNA, 25 bp, Mus musculus
cacgggttaccttcactctttagcg

SEQ ID NO: 334821 - DNA, 25 bp, Mus musculus
tcctgcgggagaacgactggcagac

SEQ ID NO: 334822 - DNA, 25 bp, Mus musculus
ggcttcagtgcctgggctttgcgtt

SEQ ID NO: 334823 - DNA, 25 bp, Mus musculus
cagcagttccgatgcggcggagccc

SEQ ID NO: 334824 - DNA, 25 bp, Mus musculus
ttcgcgatcagtcgcgcgggaagca

SEQ ID NO: 334825 - DNA, 25 bp, Mus musculus
cttcttgccggaaggttgacgcgga

SEQ ID NO: 334826 - DNA, 25 bp, Mus musculus
acgactggcagacgcaggtcagttc

SEQ ID NO: 334827 - DNA, 25 bp, Mus musculus
gacatcagcggctggccagtctgga

SEQ ID NO: 334828 - DNA, 25 bp, Mus musculus
cgggctcgcagcgtctgtctgtgca

SEQ ID NO: 334829 - DNA, 25 bp, Mus musculus
ggcgctgaatcaccagcgcgggctc

SEQ ID NO: 334830 - DNA, 25 bp, Mus musculus
gtaagagccgcactcagctgcctgc

SEQ ID NO: 334831 - DNA, 25 bp, Mus musculus
ggcagaaaggcgctgaatcaccagc

SEQ ID NO: 334832 - DNA, 25 bp, Mus musculus
tcgccctggtaacccgggaggcaga

SEQ ID NO: 334833 - DNA, 25 bp, Mus musculus
cgtgcgtatgcgtcgccctggtaac

SEQ ID NO: 334834 - DNA, 25 bp, Mus musculus
ccagtctggagtaccgcggagcctg

SEQ ID NO: 334835 - DNA, 25 bp, Mus musculus
tctcaactggacatcagcggctggc

SEQ ID NO: 334836 - DNA, 25 bp, Mus musculus
gcctcgcaggtgtctcaactggaca

SEQ ID NO: 334837 - DNA, 25 bp, Mus musculus
tcgcctgcaggtgtgcctcgcaggt

SEQ ID NO: 334838 - DNA, 25 bp, Mus musculus
cgcagcgtctgtctgtgcagccgca

SEQ ID NO: 334839 - DNA, 25 bp, Mus musculus
agagccgcactcagctgcctgcgtt

SEQ ID NO: 334840 - DNA, 25 bp, Mus musculus
gcaggccatccctaggggcgtgtgt

SEQ ID NO: 334841 - DNA, 25 bp, Mus musculus
cgacaccggcaagggacaggcaagc

SEQ ID NO: 334842 - DNA, 25 bp, Mus musculus
gaaggcatcgtaggcggcgcgcaca

SEQ ID NO: 334843 - DNA, 25 bp, Mus musculus
aggatctcaggggtcgcgggaaagc

SEQ ID NO: 334844 - DNA, 25 bp, Mus musculus
acaccggcaagggacaggcaagcga

SEQ ID NO: 334845 - DNA, 25 bp, Mus musculus
tgaccgagacccctttccagctgtt

SEQ ID NO: 334846 - DNA, 25 bp, Mus musculus
cggcccagaagctccgcagcagaaa

SEQ ID NO: 334847 - DNA, 25 bp, Mus musculus
catggcccggcagtagcggcgacac

SEQ ID NO: 334848 - DNA, 25 bp, Mus musculus
tgcggtgctctcaccttgaccgaga

SEQ ID NO: 334849 - DNA, 25 bp, Mus musculus
ctttccagctgttgaaggcatcgta

SEQ ID NO: 334850 - DNA, 25 bp, Mus musculus
ttccagctgttgaaggcatcgtagg

SEQ ID NO: 334851 - DNA, 25 bp, Mus musculus
cagcggccgcccacgaagctgtccc

SEQ ID NO: 334852 - DNA, 25 bp, Mus musculus
cgggatcccgcacctgcggtgctct

SEQ ID NO: 334853 - DNA, 25 bp, Mus musculus
cagaagctccgcagcagaaagcagg

SEQ ID NO: 334854 - DNA, 25 bp, Mus musculus
agctccgcagcagaaagcaggtcgc

SEQ ID NO: 334855 - DNA, 25 bp, Mus musculus
agccggtactgaaggtgaaaactca

SEQ ID NO: 334856 - DNA, 25 bp, Mus musculus
aagtgagtccgttcgctgttgtgtc

SEQ ID NO: 334857 - DNA, 25 bp, Mus musculus
aaactcatagcagccatgggcactg

SEQ ID NO: 334858 - DNA, 25 bp, Mus musculus
cagatgtgcccagttccggacggct

SEQ ID NO: 334859 - DNA, 25 bp, Mus musculus
ctcagcagccgattgggttactttc

SEQ ID NO: 334860 - DNA, 25 bp, Mus musculus
gggatcccgcctgtgcccaattagc

SEQ ID NO: 334861 - DNA, 25 bp, Mus musculus
ctagcgagcgcagttacagcgggtc

SEQ ID NO: 334862 - DNA, 25 bp, Mus musculus
tacagcgggtctcctgccgccaaag

SEQ ID NO: 334863 - DNA, 25 bp, Mus musculus
agtctgcgctcgcaccatgcagcta

SEQ ID NO: 334864 - DNA, 25 bp, Mus musculus
agcggctctgtaccggcgcagatgt

SEQ ID NO: 334865 - DNA, 25 bp, Mus musculus
ccatgcagctaaagtgagtccgttc

SEQ ID NO: 334866 - DNA, 25 bp, Mus musculus
ggacccacccgaactaggactgaga

SEQ ID NO: 334867 - DNA, 25 bp, Mus musculus
acacctggacctgccggcttggacg

SEQ ID NO: 334868 - DNA, 25 bp, Mus musculus
aggactgagattgcccgacgctagc

SEQ ID NO: 334869 - DNA, 25 bp, Mus musculus
gccgtgacgtcaggcttgtgctaga

SEQ ID NO: 334870 - DNA, 25 bp, Mus musculus
ttcagagccacacgcagggcaagtg

SEQ ID NO: 334871 - DNA, 25 bp, Mus musculus
ttctttcagagccacacgcagggca

SEQ ID NO: 334872 - DNA, 25 bp, Mus musculus
tggagacctccagcgcttctttcag

SEQ ID NO: 334873 - DNA, 25 bp, Mus musculus
agggccgcaatcactcctggagacc

SEQ ID NO: 334874 - DNA, 25 bp, Mus musculus
gagtcgccaacaccctcgctcgggt

SEQ ID NO: 334875 - DNA, 25 bp, Mus musculus
cagctgtccactgggagtcgccaac

SEQ ID NO: 334876 - DNA, 25 bp, Mus musculus
ctagattggcaattggctggaggca

SEQ ID NO: 334877 - DNA, 25 bp, Mus musculus
agcagctagacgtgcgggccgtctc

SEQ ID NO: 334878 - DNA, 25 bp, Mus musculus
cgtcaggcttgtgctagattggcaa

SEQ ID NO: 334879 - DNA, 25 bp, Mus musculus
acgtgcgggccgtctcagctgtcca

SEQ ID NO: 334880 - DNA, 25 bp, Mus musculus
gcgagcgattggatatgctgttaga

SEQ ID NO: 334881 - DNA, 25 bp, Mus musculus
gcaagtggtgccaccgcgcgctaac

SEQ ID NO: 334882 - DNA, 25 bp, Mus musculus
acactggcgcgagcgattggatatg

SEQ ID NO: 334883 - DNA, 25 bp, Mus musculus
cagcgcaggcattccatggcgcgcg

SEQ ID NO: 334884 - DNA, 25 bp, Mus musculus
ctgcgtccgtaacagagccaggacg

SEQ ID NO: 334885 - DNA, 25 bp, Mus musculus
acccggtctgcgtccgtaacagagc

SEQ ID NO: 334886 - DNA, 25 bp, Mus musculus
tgtctggtgactgccgacccggtct

SEQ ID NO: 334887 - DNA, 25 bp, Mus musculus
cgctgccgtccacgcatgctccggc

SEQ ID NO: 334888 - DNA, 25 bp, Mus musculus
gtcaaccggctcaccgcgacaaccg

SEQ ID NO: 334889 - DNA, 25 bp, Mus musculus
gccggaactcgggtcaaccggctca

SEQ ID NO: 334890 - DNA, 25 bp, Mus musculus
caggacgccggtccgacatgccgga

SEQ ID NO: 334891 - DNA, 25 bp, Mus musculus
gcaggcagcgcaggcattccatggc

SEQ ID NO: 334892 - DNA, 25 bp, Mus musculus
tgctcgacgctttcgggctccggga

SEQ ID NO: 334893 - DNA, 25 bp, Mus musculus
cagcgcgggctgtgctcgacgcttt

SEQ ID NO: 334894 - DNA, 25 bp, Mus musculus
atcaagtcctcgcagtgctggccgg

SEQ ID NO: 334895 - DNA, 25 bp, Mus musculus
cgcaatcaagtcctcgcagtgctgg

SEQ ID NO: 334896 - DNA, 25 bp, Mus musculus
cgacatgccggaactcgggtcaacc

SEQ ID NO: 334897 - DNA, 25 bp, Mus musculus
gctgcagttgctatggaaacggcga

SEQ ID NO: 334898 - DNA, 25 bp, Mus musculus
gacgcgcggccgcttagggttcaca

SEQ ID NO: 334899 - DNA, 25 bp, Mus musculus
gcgctccaggcctagttcacaggct

SEQ ID NO: 334900 - DNA, 25 bp, Mus musculus
ccaggcctagttcacaggctagctc

SEQ ID NO: 334901 - DNA, 25 bp, Mus musculus
tagttcacaggctagctctgggcgc

SEQ ID NO: 334902 - DNA, 25 bp, Mus musculus
gttcacaggctagctctgggcgcga

SEQ ID NO: 334903 - DNA, 25 bp, Mus musculus
cgcgaggctgcagttgctatggaaa

SEQ ID NO: 334904 - DNA, 25 bp, Mus musculus
cagttgctatggaaacggcgagaaa

SEQ ID NO: 334905 - DNA, 25 bp, Mus musculus
ctaggcaggccctctgaagacacta

SEQ ID NO: 334906 - DNA, 25 bp, Mus musculus
gcaggccctctgaagacactaacgg

SEQ ID NO: 334907 - DNA, 25 bp, Mus musculus
gccctctgaagacactaacggcgga

SEQ ID NO: 334908 - DNA, 25 bp, Mus musculus
tctgaagacactaacggcggaggcg

SEQ ID NO: 334909 - DNA, 25 bp, Mus musculus
cgcgggcctaggcaggccctctgaa

SEQ ID NO: 334910 - DNA, 25 bp, Mus musculus
agcaccggtgctagagacgcgcggc

SEQ ID NO: 334911 - DNA, 25 bp, Mus musculus
ggcggcgtgtcgtcattcacgagaa

SEQ ID NO: 334912 - DNA, 25 bp, Mus musculus
cgtcattcacgagaagaaggtgtcc

SEQ ID NO: 334913 - DNA, 25 bp, Mus musculus
gccacctgtcgcagccggtggtgaa

SEQ ID NO: 334914 - DNA, 25 bp, Mus musculus
tgggttcccagactgcacacctgga

SEQ ID NO: 334915 - DNA, 25 bp, Mus musculus
ttcctcaaagaagtgactggcggtg

SEQ ID NO: 334916 - DNA, 25 bp, Mus musculus
aaggtgtccagcttcgatgtcttcc

SEQ ID NO: 334917 - DNA, 25 bp, Mus musculus
ttggggcggttaggaacatctacac

SEQ ID NO: 334918 - DNA, 25 bp, Mus musculus
tgaagagtgtgctggtgtaccgcaa

SEQ ID NO: 334919 - DNA, 25 bp, Mus musculus
atgaacggtcccagctccaggtcca

SEQ ID NO: 334920 - DNA, 25 bp, Mus musculus
cgtcccgcggagaagatgaacggtc

SEQ ID NO: 334921 - DNA, 25 bp, Mus musculus
cggtccacgagctgctgttgcaggc

SEQ ID NO: 334922 - DNA, 25 bp, Mus musculus
aattgctacctgctagggctggccc

SEQ ID NO: 334923 - DNA, 25 bp, Mus musculus
gtgccgcgccttccttgaattgcta

SEQ ID NO: 334924 - DNA, 25 bp, Mus musculus
ccagcttcgatgtcttcctcaaaga

SEQ ID NO: 334925 - DNA, 25 bp, Mus musculus
ctccgcgttgttggtctgttgtacc

SEQ ID NO: 334926 - DNA, 25 bp, Mus musculus
gaacggaatcttgtcgctgtccttg

SEQ ID NO: 334927 - DNA, 25 bp, Mus musculus
cagagcctcagtgttctccgcgttg

SEQ ID NO: 334928 - DNA, 25 bp, Mus musculus
ggccactgggcgtcttgcaccagct

SEQ ID NO: 334929 - DNA, 25 bp, Mus musculus
tcgatctgcgaccacaccataaagg

SEQ ID NO: 334930 - DNA, 25 bp, Mus musculus
tttgcctagccgcttggagatctcg

SEQ ID NO: 334931 - DNA, 25 bp, Mus musculus
ccgcctcctggatgaacggaatctt

SEQ ID NO: 334932 - DNA, 25 bp, Mus musculus
ttgctctggagagaacgatgcagcc

SEQ ID NO: 334933 - DNA, 25 bp, Mus musculus
agtccgcaccttgtagacggccgtg

SEQ ID NO: 334934 - DNA, 25 bp, Mus musculus
cgcttcactttcttgtcggcagggt

SEQ ID NO: 334935 - DNA, 25 bp, Mus musculus
gcgcccaggcttccaaacaggtaga

SEQ ID NO: 334936 - DNA, 25 bp, Mus musculus
gtccttgagcagcttccagcgtttg

SEQ ID NO: 334937 - DNA, 25 bp, Mus musculus
ccaaacaggtagacgcgcttcactt

SEQ ID NO: 334938 - DNA, 25 bp, Mus musculus
tgctccatgatcttgcgccgctcga

SEQ ID NO: 334939 - DNA, 25 bp, Mus musculus
ttcggatctggtaacctcactcggg

SEQ ID NO: 334940 - DNA, 25 bp, Mus musculus
aggtcacgggtcatctccctcgggc

SEQ ID NO: 334941 - DNA, 25 bp, Mus musculus
aggagtcccaaaggccaaccctgct

SEQ ID NO: 334942 - DNA, 25 bp, Mus musculus
agaatgcggtttctccgccagctgc

SEQ ID NO: 334943 - DNA, 25 bp, Mus musculus
ctgctcctgaaaagaaatggtttcc

SEQ ID NO: 334944 - DNA, 25 bp, Mus musculus
agctcagcaacaggggtcctgccca

SEQ ID NO: 334945 - DNA, 25 bp, Mus musculus
gggtcctgcccaagctcgcctagga

SEQ ID NO: 334946 - DNA, 25 bp, Mus musculus
tcgccttgcctctctgtgactctta

SEQ ID NO: 334947 - DNA, 25 bp, Mus musculus
ctgtgactcttactgggaggagcta

SEQ ID NO: 334948 - DNA, 25 bp, Mus musculus
agctaaattgcaatcgactccggtg

SEQ ID NO: 334949 - DNA, 25 bp, Mus musculus
atcgactccggtggtgcttttcgga

SEQ ID NO: 334950 - DNA, 25 bp, Mus musculus
ttcctactgtaaacgtggctcgggc

SEQ ID NO: 334951 - DNA, 25 bp, Mus musculus
cggcggcagaaacacacggtgcatg

SEQ ID NO: 334952 - DNA, 25 bp, Mus musculus
acggtgcatgaccacaggagtccca

SEQ ID NO: 334953 - DNA, 25 bp, Mus musculus
ccacgagcagctggcccggtggcgg

SEQ ID NO: 334954 - DNA, 25 bp, Mus musculus
gttctgcctggcactagggttcctt

SEQ ID NO: 334955 - DNA, 25 bp, Mus musculus
tttcaccttcggctaaccgcgcgtg

SEQ ID NO: 334956 - DNA, 25 bp, Mus musculus
accttcggctaaccgcgcgtgcgga

SEQ ID NO: 334957 - DNA, 25 bp, Mus musculus
ggctaaccgcgcgtgcggacagcac

SEQ ID NO: 334958 - DNA, 25 bp, Mus musculus
cgcgtgcggacagcaccgagacaca

SEQ ID NO: 334959 - DNA, 25 bp, Mus musculus
gcggacagcaccgagacacacattg

SEQ ID NO: 334960 - DNA, 25 bp, Mus musculus
ggacagcaccgagacacacattgcg

SEQ ID NO: 334961 - DNA, 25 bp, Mus musculus
caccgagacacacattgcgctgggg

SEQ ID NO: 334962 - DNA, 25 bp, Mus musculus
tgcggcaaggaccaaagagccctgt

SEQ ID NO: 334963 - DNA, 25 bp, Mus musculus
aaggaccaaagagccctgtgcctca

SEQ ID NO: 334964 - DNA, 25 bp, Mus musculus
aaagagccctgtgcctcacacagcg

SEQ ID NO: 334965 - DNA, 25 bp, Mus musculus
cagggcgcgctgcacacctggcacc

SEQ ID NO: 334966 - DNA, 25 bp, Mus musculus
ctgcctggcactagggttccttttt

SEQ ID NO: 334967 - DNA, 25 bp, Mus musculus
gccaagtcttttccaaactgcgaga

SEQ ID NO: 334968 - DNA, 25 bp, Mus musculus
cagccgccaagtcttttccaaactg

SEQ ID NO: 334969 - DNA, 25 bp, Mus musculus
caaaatgcagctcggcccacggtcg

SEQ ID NO: 334970 - DNA, 25 bp, Mus musculus
aggcagcgctccagagtccgactct

SEQ ID NO: 334971 - DNA, 25 bp, Mus musculus
ggaaacgaagctccgcccaaaatgc

SEQ ID NO: 334972 - DNA, 25 bp, Mus musculus
atcggcccaaaggagaaaacctgcg

SEQ ID NO: 334973 - DNA, 25 bp, Mus musculus
aaactgcgagaacaagcgggcgatc

SEQ ID NO: 334974 - DNA, 25 bp, Mus musculus
tccgactctccacgccagccgccaa

SEQ ID NO: 334975 - DNA, 25 bp, Mus musculus
cgcgtagcacaagtacattcacggg

SEQ ID NO: 334976 - DNA, 25 bp, Mus musculus
tacattcacgggtaaagcgagaggg

SEQ ID NO: 334977 - DNA, 25 bp, Mus musculus
tgaggctagagcagaatggaagtcc

SEQ ID NO: 334978 - DNA, 25 bp, Mus musculus
gcagaatggaagtccctgacgtcgc

SEQ ID NO: 334979 - DNA, 25 bp, Mus musculus
agccagcagtgtctgccgccacgcc

SEQ ID NO: 334980 - DNA, 25 bp, Mus musculus
acaagcgggcgatcggcccaaagga

SEQ ID NO: 334981 - DNA, 25 bp, Mus musculus
ctacgcccgagaaagaggaagcttc

SEQ ID NO: 334982 - DNA, 25 bp, Mus musculus
tttggagtgttggatgtggttctca

SEQ ID NO: 334983 - DNA, 25 bp, Mus musculus
aggaggcttgcacgcctcgggtccc

SEQ ID NO: 334984 - DNA, 25 bp, Mus musculus
aaagaggaagcttcgagttgcaagg

SEQ ID NO: 334985 - DNA, 25 bp, Mus musculus
agcaacgaggcccacgatgctcagc

SEQ ID NO: 334986 - DNA, 25 bp, Mus musculus
agtgaggatctggatgtacgtgccc

SEQ ID NO: 334987 - DNA, 25 bp, Mus musculus
gttcgtagtgaggatctggatgtac

SEQ ID NO: 334988 - DNA, 25 bp, Mus musculus
ccctttgttgcctggagctaggtcc

SEQ ID NO: 334989 - DNA, 25 bp, Mus musculus
tgcagcagcccgactctgctggagg

SEQ ID NO: 334990 - DNA, 25 bp, Mus musculus
atgtggttctcaaagagggactccc

SEQ ID NO: 334991 - DNA, 25 bp, Mus musculus
tccgcaggaaagcaccccgagtcta

SEQ ID NO: 334992 - DNA, 25 bp, Mus musculus
cacgtcctcccaacgtccgcaggaa

SEQ ID NO: 334993 - DNA, 25 bp, Mus musculus
gagtctaacaataagcacacgctgg

SEQ ID NO: 334994 - DNA, 25 bp, Mus musculus
cacacgctggaagggacagcaacga

SEQ ID NO: 334995 - DNA, 25 bp, Mus musculus
gccagtgtgcagctcccgggcgaca

SEQ ID NO: 334996 - DNA, 25 bp, Mus musculus
tcccgctggatcaggtaacagcgtc

SEQ ID NO: 334997 - DNA, 25 bp, Mus musculus
tgggcatcccgctggatcaggtaac

SEQ ID NO: 334998 - DNA, 25 bp, Mus musculus
ccagcctctcttaccgtaccaccgg

SEQ ID NO: 334999 - DNA, 25 bp, Mus musculus
atgcaggatggcagcacggccgccc

SEQ ID NO: 335000 - DNA, 25 bp, Mus musculus
ccctgaagatgcaggatggcagcac

SEQ ID NO: 335001 - DNA, 25 bp, Mus musculus
cgggcgacagagcaccctgaagatg

SEQ ID NO: 335002 - DNA, 25 bp, Mus musculus
gaactggggaacagactgggcgtct

SEQ ID NO: 335003 - DNA, 25 bp, Mus musculus
caggagccctcaaggtggccagtgt

SEQ ID NO: 335004 - DNA, 25 bp, Mus musculus
ctcaggagccctcaaggtggccagt

SEQ ID NO: 335005 - DNA, 25 bp, Mus musculus
ggttcccgcgaggtcctcaggagcc

SEQ ID NO: 335006 - DNA, 25 bp, Mus musculus
ccaggttcccgcgaggtcctcagga

SEQ ID NO: 335007 - DNA, 25 bp, Mus musculus
gatccgcgcccatctctgcccggct

SEQ ID NO: 335008 - DNA, 25 bp, Mus musculus
cagagcaccctgaagatgcaggatg

SEQ ID NO: 335009 - DNA, 25 bp, Mus musculus
ccaacacgcaattaccgagggaggg

SEQ ID NO: 335010 - DNA, 25 bp, Mus musculus
gccaatggaggagcgcgtaacaacc

SEQ ID NO: 335011 - DNA, 25 bp, Mus musculus
cgcctgcgcagtgaccgacggcgta

SEQ ID NO: 335012 - DNA, 25 bp, Mus musculus
agccatcacgaagggcagccagcca

SEQ ID NO: 335013 - DNA, 25 bp, Mus musculus
ctgacggcagccatcacgaagggca

SEQ ID NO: 335014 - DNA, 25 bp, Mus musculus
ttggcgccaccaaaaccctgacggc

SEQ ID NO: 335015 - DNA, 25 bp, Mus musculus
gaagccagccttggcgccaccaaaa

SEQ ID NO: 335016 - DNA, 25 bp, Mus musculus
taggagcgcagaagccagccttggc

SEQ ID NO: 335017 - DNA, 25 bp, Mus musculus
agggcagccagccacagtggtgtca

SEQ ID NO: 335018 - DNA, 25 bp, Mus musculus
ggcgagggcccaacacgcaattacc

SEQ ID NO: 335019 - DNA, 25 bp, Mus musculus
accttgggcggacagctggtcgacc

SEQ ID NO: 335020 - DNA, 25 bp, Mus musculus
cactcggcctgggagtctggctctg

SEQ ID NO: 335021 - DNA, 25 bp, Mus musculus
accaagagccgaccttgggcggaca

SEQ ID NO: 335022 - DNA, 25 bp, Mus musculus
gagtctggctctgcactcaccaacg

SEQ ID NO: 335023 - DNA, 25 bp, Mus musculus
atccagaacaggtggctccgaggcg

SEQ ID NO: 335024 - DNA, 25 bp, Mus musculus
aaagggcagggcctggagacactct

SEQ ID NO: 335025 - DNA, 25 bp, Mus musculus
tcacagggacgacctttcgttcgaa

SEQ ID NO: 335026 - DNA, 25 bp, Mus musculus
cctcgtcggtcacagggacgacctt

SEQ ID NO: 335027 - DNA, 25 bp, Mus musculus
atggcgacagctgctcaaaccacct

SEQ ID NO: 335028 - DNA, 25 bp, Mus musculus
agcgctcggcctgccaaggtagccg

SEQ ID NO: 335029 - DNA, 25 bp, Mus musculus
cgccttgcagcagaggacgcagcgc

SEQ ID NO: 335030 - DNA, 25 bp, Mus musculus
agggtcgcttcacatccagaacagg

SEQ ID NO: 335031 - DNA, 25 bp, Mus musculus
actcgcggcacaggaagggtcgctt

SEQ ID NO: 335032 - DNA, 25 bp, Mus musculus
tgcggcctggccactcagggactcg

SEQ ID NO: 335033 - DNA, 25 bp, Mus musculus
acactctggtgtctgactcggtcgc

SEQ ID NO: 335034 - DNA, 25 bp, Mus musculus
accgtggccaccaaaggccgggctg

SEQ ID NO: 335035 - DNA, 25 bp, Mus musculus
cggcgaccgacaacatggcgacagc

SEQ ID NO: 335036 - DNA, 25 bp, Mus musculus
tcggggtactccgaagccggctcac

SEQ ID NO: 335037 - DNA, 25 bp, Mus musculus
tgccggactcaagcgttacatcatt

SEQ ID NO: 335038 - DNA, 25 bp, Mus musculus
gggctccaaagggtgtttccagcca

SEQ ID NO: 335039 - DNA, 25 bp, Mus musculus
gggctctcaggaaacactgccctca

SEQ ID NO: 335040 - DNA, 25 bp, Mus musculus
ccaagagccgcggtagagatctgct

SEQ ID NO: 335041 - DNA, 25 bp, Mus musculus
gacaggcttctagtcccacagcgtc

SEQ ID NO: 335042 - DNA, 25 bp, Mus musculus
atttcctgaatgtccgcgaggcgtg

SEQ ID NO: 335043 - DNA, 25 bp, Mus musculus
tgacacaactttggctgccggactc

SEQ ID NO: 335044 - DNA, 25 bp, Mus musculus
gggacttccgctatccggcgtgaca

SEQ ID NO: 335045 - DNA, 25 bp, Mus musculus
tcttgaagttgtaatgcgccatgcc

SEQ ID NO: 335046 - DNA, 25 bp, Mus musculus
cttggcagacggcaccaccgtaatc

SEQ ID NO: 335047 - DNA, 25 bp, Mus musculus
ataggcggaaacgacctctgtcacc

SEQ ID NO: 335048 - DNA, 25 bp, Mus musculus
gtcgcgaggacaaagcctagcaagc

SEQ ID NO: 335049 - DNA, 25 bp, Mus musculus
acgcgtccgcctagacaggcttcta

SEQ ID NO: 335050 - DNA, 25 bp, Mus musculus
tccctggcgacttgtcggggaaatg

SEQ ID NO: 335051 - DNA, 25 bp, Mus musculus
ggatgagccaggtaacgtccggtcc

SEQ ID NO: 335052 - DNA, 25 bp, Mus musculus
cgcgtgcgcaaactgcagggttgta

SEQ ID NO: 335053 - DNA, 25 bp, Mus musculus
caccctcttttctgcagcctccgca

SEQ ID NO: 335054 - DNA, 25 bp, Mus musculus
atgagccaggtaacgtccggtcccg

SEQ ID NO: 335055 - DNA, 25 bp, Mus musculus
gcagcctccgcagccctgacccgca

SEQ ID NO: 335056 - DNA, 25 bp, Mus musculus
cggccatggggagtgggatgagcca

SEQ ID NO: 335057 - DNA, 25 bp, Mus musculus
gcgcccggtctcctcccgcgagcgc

SEQ ID NO: 335058 - DNA, 25 bp, Mus musculus
ccggacagtaatgccgcgtcccggg

SEQ ID NO: 335059 - DNA, 25 bp, Mus musculus
cacggccggacagtaatgccgcgtc

SEQ ID NO: 335060 - DNA, 25 bp, Mus musculus
tccgcacggccggacagtaatgccg

SEQ ID NO: 335061 - DNA, 25 bp, Mus musculus
ctcatgcgcgagcacgagcgcgtgc

SEQ ID NO: 335062 - DNA, 25 bp, Mus musculus
cagggttgtaggctggggctcatgc

SEQ ID NO: 335063 - DNA, 25 bp, Mus musculus
tgcgcaaactgcagggttgtaggct

SEQ ID NO: 335064 - DNA, 25 bp, Mus musculus
cggccgcaccctcttttctgcagcc

SEQ ID NO: 335065 - DNA, 25 bp, Mus musculus
ctcagagttcggcatgagcgcagtg

SEQ ID NO: 335066 - DNA, 25 bp, Mus musculus
cgcacgcgtcatgaacttggagacg

SEQ ID NO: 335067 - DNA, 25 bp, Mus musculus
caggactacaatcgtgaggaggacg

SEQ ID NO: 335068 - DNA, 25 bp, Mus musculus
tcatgaacttggagacgggcagccg

SEQ ID NO: 335069 - DNA, 25 bp, Mus musculus
cgggcaagcaggactacaatcgtga

SEQ ID NO: 335070 - DNA, 25 bp, Mus musculus
tcccgtggaaacacgcgggcaagca

SEQ ID NO: 335071 - DNA, 25 bp, Mus musculus
aggagaagagcgtcttccgcatccc

SEQ ID NO: 335072 - DNA, 25 bp, Mus musculus
gagaacgaggagaagagcgtcttcc

SEQ ID NO: 335073 - DNA, 25 bp, Mus musculus
accagatcgacagcggcaagtaccc

SEQ ID NO: 335074 - DNA, 25 bp, Mus musculus
cagtggttgatcgaccagatcgaca

SEQ ID NO: 335075 - DNA, 25 bp, Mus musculus
ctccgacagtggttgatcgaccaga

SEQ ID NO: 335076 - DNA, 25 bp, Mus musculus
tgggaaactccgacagtggttgatc

SEQ ID NO: 335077 - DNA, 25 bp, Mus musculus
agtgagctgcggcaatgggaaactc

SEQ ID NO: 335078 - DNA, 25 bp, Mus musculus
ttccgcatcccgtggaaacacgcgg

SEQ ID NO: 335079 - DNA, 25 bp, Mus musculus
agcttgcaggcggtgtcaggtccca

SEQ ID NO: 335080 - DNA, 25 bp, Mus musculus
acagattccaagcagaccctgcaca

SEQ ID NO: 335081 - DNA, 25 bp, Mus musculus
agcagaccctgcacaccagccgctc

SEQ ID NO: 335082 - DNA, 25 bp, Mus musculus
cggcccgcggctcccacactcagcc

SEQ ID NO: 335083 - DNA, 25 bp, Mus musculus
cgacggtcccgtgccaccgcggaat

SEQ ID NO: 335084 - DNA, 25 bp, Mus musculus
tgccaccgcggaattccactccgga

SEQ ID NO: 335085 - DNA, 25 bp, Mus musculus
ggggacttaaacagattccaagcag

SEQ ID NO: 335086 - DNA, 25 bp, Mus musculus
ggacgcgacactcacctgcagcttg

SEQ ID NO: 335087 - DNA, 25 bp, Mus musculus
gtgtcaggtcccagccaaccggttc

SEQ ID NO: 335088 - DNA, 25 bp, Mus musculus
ccaaccggttccaggccgccgcagc

SEQ ID NO: 335089 - DNA, 25 bp, Mus musculus
cactagggccgcacttccgcacgcc

SEQ ID NO: 335090 - DNA, 25 bp, Mus musculus
gagcgcgtcgatccgccgcctagcc

SEQ ID NO: 335091 - DNA, 25 bp, Mus musculus
gcctagccgagcaccgagtgctgga

SEQ ID NO: 335092 - DNA, 25 bp, Mus musculus
cggggcgtcctcacccaggacgcga

SEQ ID NO: 335093 - DNA, 25 bp, Mus musculus
atcccagcggaggagaacctttcgg

SEQ ID NO: 335094 - DNA, 25 bp, Mus musculus
cggaaaagcgtctctctcggaaaga

SEQ ID NO: 335095 - DNA, 25 bp, Mus musculus
cctcgcaggaaaggggtaactgtgc

SEQ ID NO: 335096 - DNA, 25 bp, Mus musculus
aaattggaggtgttcgtcccacgcg

SEQ ID NO: 335097 - DNA, 25 bp, Mus musculus
ctggtgacgactccttaggctcaga

SEQ ID NO: 335098 - DNA, 25 bp, Mus musculus
tccggaggcaactgatgacagcaga

SEQ ID NO: 335099 - DNA, 25 bp, Mus musculus
gtcggtgcctgagacctagacatcc

SEQ ID NO: 335100 - DNA, 25 bp, Mus musculus
ggtcctcccagcacgaaatcctaag

SEQ ID NO: 335101 - DNA, 25 bp, Mus musculus
atcctaaggctggtgtgtcctggcc

SEQ ID NO: 335102 - DNA, 25 bp, Mus musculus
gcttgtcttccgctcaaagtctcta

SEQ ID NO: 335103 - DNA, 25 bp, Mus musculus
acgagtacctcatgggcaagttccc

SEQ ID NO: 335104 - DNA, 25 bp, Mus musculus
ctcggagtaaggacagcactgcacc

SEQ ID NO: 335105 - DNA, 25 bp, Mus musculus
tgacactggccgagatcaacgagta

SEQ ID NO: 335106 - DNA, 25 bp, Mus musculus
tttggacgcccagaccgatagcata

SEQ ID NO: 335107 - DNA, 25 bp, Mus musculus
cggccacggaaatctgcccggattg

SEQ ID NO: 335108 - DNA, 25 bp, Mus musculus
aatccgcgcgtggaaagccgcggcc

SEQ ID NO: 335109 - DNA, 25 bp, Mus musculus
gaggaatctgctccctgggtttcag

SEQ ID NO: 335110 - DNA, 25 bp, Mus musculus
gcccggattgggaggaatctgctcc

SEQ ID NO: 335111 - DNA, 25 bp, Mus musculus
atctgcccggattgggaggaatctg

SEQ ID NO: 335112 - DNA, 25 bp, Mus musculus
ccacggaaatctgcccggattggga

SEQ ID NO: 335113 - DNA, 25 bp, Mus musculus
aatctgctccctgggtttcagggcc

SEQ ID NO: 335114 - DNA, 25 bp, Mus musculus
aaagccgcggccacggaaatctgcc

SEQ ID NO: 335115 - DNA, 25 bp, Mus musculus
tgctccctgggtttcagggccgacc

SEQ ID NO: 335116 - DNA, 25 bp, Mus musculus
cttcaccgagcactgcccaccggcc

SEQ ID NO: 335117 - DNA, 25 bp, Mus musculus
cactgcccaccggccgtgggtggaa

SEQ ID NO: 335118 - DNA, 25 bp, Mus musculus
aggaagggctcagcttgcacgaatt

SEQ ID NO: 335119 - DNA, 25 bp, Mus musculus
gaagggctcagcttgcacgaattcg

SEQ ID NO: 335120 - DNA, 25 bp, Mus musculus
aaatctgcccggattgggaggaatc

SEQ ID NO: 335121 - DNA, 25 bp, Mus musculus
ctggaggacaaaagaaatatttgga

SEQ ID NO: 335122 - DNA, 25 bp, Mus musculus
ctagtcggcctctgggcgcctagca

SEQ ID NO: 335123 - DNA, 25 bp, Mus musculus
ctgggcgcctagcacgttttattta

SEQ ID NO: 335124 - DNA, 25 bp, Mus musculus
ggcgcctagcacgttttatttatcc

SEQ ID NO: 335125 - DNA, 25 bp, Mus musculus
cacgttttatttatccctacagagg

SEQ ID NO: 335126 - DNA, 25 bp, Mus musculus
agaaatatttggacgtcagaactga

SEQ ID NO: 335127 - DNA, 25 bp, Mus musculus
tatatttttggaagagctacgtttc

SEQ ID NO: 335128 - DNA, 25 bp, Mus musculus
agagctacgtttccttttctgaaga

SEQ ID NO: 335129 - DNA, 25 bp, Mus musculus
cttttctgaagagaggcgagcgcgc

SEQ ID NO: 335130 - DNA, 25 bp, Mus musculus
gactgcagcgagtcttgatgcgcca

SEQ ID NO: 335131 - DNA, 25 bp, Mus musculus
gtcttgatgcgccaggaagttcatc

SEQ ID NO: 335132 - DNA, 25 bp, Mus musculus
aggaagttcatctgcgcggagtcgc

SEQ ID NO: 335133 - DNA, 25 bp, Mus musculus
ccgaggtccctagtcggcctctggg

SEQ ID NO: 335134 - DNA, 25 bp, Mus musculus
cgtcagaactgatttatatttttgg

SEQ ID NO: 335135 - DNA, 25 bp, Mus musculus
gcgcagtagggcactcgcccgattt

SEQ ID NO: 335136 - DNA, 25 bp, Mus musculus
ttgccacggtcaaggcggttatggt

SEQ ID NO: 335137 - DNA, 25 bp, Mus musculus
acccatgtaccatcgcgtggtgagc

SEQ ID NO: 335138 - DNA, 25 bp, Mus musculus
ttcatgtttgaggagggttcgttcc

SEQ ID NO: 335139 - DNA, 25 bp, Mus musculus
gacccggccagcgaattcatgtttg

SEQ ID NO: 335140 - DNA, 25 bp, Mus musculus
ggagacctggtaagggccactactg

SEQ ID NO: 335141 - DNA, 25 bp, Mus musculus
gctcagtgagatctaccagttccta

SEQ ID NO: 335142 - DNA, 25 bp, Mus musculus
accaagaaggcaacctcggggctgc

SEQ ID NO: 335143 - DNA, 25 bp, Mus musculus
tgcttgcaagagtgcggctagcagc

SEQ ID NO: 335144 - DNA, 25 bp, Mus musculus
ctggagtccacttcgtcgtcgtcat

SEQ ID NO: 335145 - DNA, 25 bp, Mus musculus
attcccagatgagcaccgagggcgg

SEQ ID NO: 335146 - DNA, 25 bp, Mus musculus
ggcctcgttcccgattcccagatga

SEQ ID NO: 335147 - DNA, 25 bp, Mus musculus
ttatggtggcctcgacatgatgccc

SEQ ID NO: 335148 - DNA, 25 bp, Mus musculus
ggcactcgcccgatttgtggaccga

SEQ ID NO: 335149 - DNA, 25 bp, Mus musculus
cgctggtgacatcgttggcagtgaa

SEQ ID NO: 335150 - DNA, 25 bp, Mus musculus
tggtaaagcctgtccctgtggcaga

SEQ ID NO: 335151 - DNA, 25 bp, Mus musculus
tccttggagcggagaaagcaaaagc

SEQ ID NO: 335152 - DNA, 25 bp, Mus musculus
tcaggtcgtggacaaccgctagaca

SEQ ID NO: 335153 - DNA, 25 bp, Mus musculus
cagttccctcgggtactccgtgtgc

SEQ ID NO: 335154 - DNA, 25 bp, Mus musculus
cgctgatcgcatgagccgattgctc

SEQ ID NO: 335155 - DNA, 25 bp, Mus musculus
cgccggtcgcacataagctttcctt

SEQ ID NO: 335156 - DNA, 25 bp, Mus musculus
gtgaccgccgtagggcttatacgtc

SEQ ID NO: 335157 - DNA, 25 bp, Mus musculus
acacccgctggtgagcggcctagta

SEQ ID NO: 335158 - DNA, 25 bp, Mus musculus
agcggtcccactttgccacagaggc

SEQ ID NO: 335159 - DNA, 25 bp, Mus musculus
atctgatcgattgtcccgcgcgttc

SEQ ID NO: 335160 - DNA, 25 bp, Mus musculus
cgcaagctctgatattcgctggtga

SEQ ID NO: 335161 - DNA, 25 bp, Mus musculus
gagtagtcggcgctcatcacgaagc

SEQ ID NO: 335162 - DNA, 25 bp, Mus musculus
tgggtcgcttctccagagccgaaac

SEQ ID NO: 335163 - DNA, 25 bp, Mus musculus
gaatacaaacaatctccggcgctta

SEQ ID NO: 335164 - DNA, 25 bp, Mus musculus
gcaaccctagtgtcctgggaagccc

SEQ ID NO: 335165 - DNA, 25 bp, Mus musculus
ggcggagccgcaaccctagtgtcct

SEQ ID NO: 335166 - DNA, 25 bp, Mus musculus
tgcctctacgcaggcgctgcgtagc

SEQ ID NO: 335167 - DNA, 25 bp, Mus musculus
gtaccgtactgcaaccacttccgga

SEQ ID NO: 335168 - DNA, 25 bp, Mus musculus
cggtgaactagctgagaccgctagg

SEQ ID NO: 335169 - DNA, 25 bp, Mus musculus
cggcgcttaaaacgcgcacttccgg

SEQ ID NO: 335170 - DNA, 25 bp, Mus musculus
gccgctcacccggtaagcgaatttc

SEQ ID NO: 335171 - DNA, 25 bp, Mus musculus
ccacttccggaatacaaacaatctc

SEQ ID NO: 335172 - DNA, 25 bp, Mus musculus
ctgcgtagcggtgaactagctgaga

SEQ ID NO: 335173 - DNA, 25 bp, Mus musculus
tttcatcctggaaccacacgtgggg

SEQ ID NO: 335174 - DNA, 25 bp, Mus musculus
cccggtaagcgaatttcatcctgga

SEQ ID NO: 335175 - DNA, 25 bp, Mus musculus
cgagatgacaacgacctcggtctct

SEQ ID NO: 335176 - DNA, 25 bp, Mus musculus
ccacacgtggggtaccgtactgcaa

SEQ ID NO: 335177 - DNA, 25 bp, Mus musculus
aatgcttccttaagcggccggcgca

SEQ ID NO: 335178 - DNA, 25 bp, Mus musculus
aaggacggagaaactcccggcgctg

SEQ ID NO: 335179 - DNA, 25 bp, Mus musculus
cgctggagacagcacggtagagtaa

SEQ ID NO: 335180 - DNA, 25 bp, Mus musculus
gtagagtaaggactgaggcagatcc

SEQ ID NO: 335181 - DNA, 25 bp, Mus musculus
cagatcctgtgtgactcgagggctc

SEQ ID NO: 335182 - DNA, 25 bp, Mus musculus
aacagtggacgcaggaagggtctcc

SEQ ID NO: 335183 - DNA, 25 bp, Mus musculus
ccggtgaggactccgaaagtccgca

SEQ ID NO: 335184 - DNA, 25 bp, Mus musculus
tccgaaagtccgcagaccgggagaa

SEQ ID NO: 335185 - DNA, 25 bp, Mus musculus
gcagaccgggagaaccgcagagtct

SEQ ID NO: 335186 - DNA, 25 bp, Mus musculus
agagctcggccgctggctcattcac

SEQ ID NO: 335187 - DNA, 25 bp, Mus musculus
tggctcattcacaggcgtctctcgc

SEQ ID NO: 335188 - DNA, 25 bp, Mus musculus
ctgcgtaaaaaagtcctcgcctggg

SEQ ID NO: 335189 - DNA, 25 bp, Mus musculus
cggatgctcaaaagttcagaagttt

SEQ ID NO: 335190 - DNA, 25 bp, Mus musculus
cctgggtgacggatgctcaaaagtt

SEQ ID NO: 335191 - DNA, 25 bp, Mus musculus
ttaccactgcaacctgcaggctatg

SEQ ID NO: 335192 - DNA, 25 bp, Mus musculus
ggtgcctactctccgggccagagct

SEQ ID NO: 335193 - DNA, 25 bp, Mus musculus
gggcttcagcgtggacaacatcatg

SEQ ID NO: 335194 - DNA, 25 bp, Mus musculus
gcgtggacaacatcatgacgtcgct

SEQ ID NO: 335195 - DNA, 25 bp, Mus musculus
cgccacagtgcccaaaatcgagagc

SEQ ID NO: 335196 - DNA, 25 bp, Mus musculus
gccgctcagcctggacgctgcagaa

SEQ ID NO: 335197 - DNA, 25 bp, Mus musculus
gagaacggtacgtgtccctcgcctc

SEQ ID NO: 335198 - DNA, 25 bp, Mus musculus
tgccccggacaagaagatcactctg

SEQ ID NO: 335199 - DNA, 25 bp, Mus musculus
cccgtgcgcatccaggacatcaaga

SEQ ID NO: 335200 - DNA, 25 bp, Mus musculus
cccttctatcgggacaataagcagg

SEQ ID NO: 335201 - DNA, 25 bp, Mus musculus
cagaacagcatacggcacaacctct

SEQ ID NO: 335202 - DNA, 25 bp, Mus musculus
caagaagaaggacgcagtgaaggac

SEQ ID NO: 335203 - DNA, 25 bp, Mus musculus
caggacatcaagacggagaacggta

SEQ ID NO: 335204 - DNA, 25 bp, Mus musculus
tgcaggctatgagcctgtacgcggc

SEQ ID NO: 335205 - DNA, 25 bp, Mus musculus
tgggatctgtgtgttctcatgcgaa

SEQ ID NO: 335206 - DNA, 25 bp, Mus musculus
tacaactggcgctccgactgctaca

SEQ ID NO: 335207 - DNA, 25 bp, Mus musculus
cggaagtgggatctgtgtgttctca

SEQ ID NO: 335208 - DNA, 25 bp, Mus musculus
tctcctgggcgccaaacgccagtcg

SEQ ID NO: 335209 - DNA, 25 bp, Mus musculus
tccatgacgctaggctctcctgggc

SEQ ID NO: 335210 - DNA, 25 bp, Mus musculus
tacgcagcgcctccatgacgctagg

SEQ ID NO: 335211 - DNA, 25 bp, Mus musculus
ttctcatgcgaacgggaaggagcgt

SEQ ID NO: 335212 - DNA, 25 bp, Mus musculus
aagctgcctacaactggcgctccga

SEQ ID NO: 335213 - DNA, 25 bp, Mus musculus
tgctcataagatgctaagctgccta

SEQ ID NO: 335214 - DNA, 25 bp, Mus musculus
cccagcacttgctcataagatgcta

SEQ ID NO: 335215 - DNA, 25 bp, Mus musculus
ctttcaggacgccaccagcctggga

SEQ ID NO: 335216 - DNA, 25 bp, Mus musculus
ggtgcgctttcaggacgccaccagc

SEQ ID NO: 335217 - DNA, 25 bp, Mus musculus
ccaatcacagatgccgcgagatggg

SEQ ID NO: 335218 - DNA, 25 bp, Mus musculus
ctccgactgctacagggcggggctt

SEQ ID NO: 335219 - DNA, 25 bp, Mus musculus
ggcacttcattgctcacgggtgaca

SEQ ID NO: 335220 - DNA, 25 bp, Mus musculus
cggttctcaggatgtccgttttcaa

SEQ ID NO: 335221 - DNA, 25 bp, Mus musculus
cggagttcggcaggttctcttctaa

SEQ ID NO: 335222 - DNA, 25 bp, Mus musculus
tgacagggacacgaattacttgggc

SEQ ID NO: 335223 - DNA, 25 bp, Mus musculus
ggtctactactcctaggccttgcgg

SEQ ID NO: 335224 - DNA, 25 bp, Mus musculus
cacacgtgtgcttaggagcccagcc

SEQ ID NO: 335225 - DNA, 25 bp, Mus musculus
tcgctcgccgcctttgttttggaga

SEQ ID NO: 335226 - DNA, 25 bp, Mus musculus
gtcgggatgcccaaaagactgtgcc

SEQ ID NO: 335227 - DNA, 25 bp, Mus musculus
atggcgtccaaaggagaagaccctc

SEQ ID NO: 335228 - DNA, 25 bp, Mus musculus
cccgaaaggagttgtctgtggagca

SEQ ID NO: 335229 - DNA, 25 bp, Mus musculus
tcggcagcggcctctttcccgaaag

SEQ ID NO: 335230 - DNA, 25 bp, Mus musculus
atgagctgtaattacccgctgcggc

SEQ ID NO: 335231 - DNA, 25 bp, Mus musculus
catgcatttcggagtggcgtccagc

SEQ ID NO: 335232 - DNA, 25 bp, Mus musculus
cttgggccatgtacgccagctttga

SEQ ID NO: 335233 - DNA, 25 bp, Mus musculus
tagctcgggcacttagcgggagctt

SEQ ID NO: 335234 - DNA, 25 bp, Mus musculus
cacttagcgggagcttgagccatgt

SEQ ID NO: 335235 - DNA, 25 bp, Mus musculus
agcttgagccatgtcgcctcaggcg

SEQ ID NO: 335236 - DNA, 25 bp, Mus musculus
gtgcgcgcgccagtcgtttcacgga

SEQ ID NO: 335237 - DNA, 25 bp, Mus musculus
ccagtcgtttcacggagctgcagcg

SEQ ID NO: 335238 - DNA, 25 bp, Mus musculus
cgtttcacggagctgcagcggccgc

SEQ ID NO: 335239 - DNA, 25 bp, Mus musculus
tctccgcgctgagccacgcctctct

SEQ ID NO: 335240 - DNA, 25 bp, Mus musculus
caccttcctgagcttgcccatctcg

SEQ ID NO: 335241 - DNA, 25 bp, Mus musculus
cacaccttccgggactcgtggagcg

SEQ ID NO: 335242 - DNA, 25 bp, Mus musculus
cttccgggactcgtggagcgcagtt

SEQ ID NO: 335243 - DNA, 25 bp, Mus musculus
acctgtccggtgatgccagtgatga

SEQ ID NO: 335244 - DNA, 25 bp, Mus musculus
tgatgccagtgatgagagccacctt

SEQ ID NO: 335245 - DNA, 25 bp, Mus musculus
gccagtgatgagagccaccttcctg

SEQ ID NO: 335246 - DNA, 25 bp, Mus musculus
tcactcgcccaagcagcgacgcgtc

SEQ ID NO: 335247 - DNA, 25 bp, Mus musculus
ggagactctgctccgctcgctactg

SEQ ID NO: 335248 - DNA, 25 bp, Mus musculus
atccgacagatgctggagggcaagc

SEQ ID NO: 335249 - DNA, 25 bp, Mus musculus
tgcgtccagacacgctgcaggacta

SEQ ID NO: 335250 - DNA, 25 bp, Mus musculus
tgcggagtcttctgcccgctttgga

SEQ ID NO: 335251 - DNA, 25 bp, Mus musculus
cgctggctgacaagatgcgtccaga

SEQ ID NO: 335252 - DNA, 25 bp, Mus musculus
gccgacgcctcgttcggagtcagcg

SEQ ID NO: 335253 - DNA, 25 bp, Mus musculus
agaccgagagccgtgagagctacga

SEQ ID NO: 335254 - DNA, 25 bp, Mus musculus
acccggcgccaagaggcgtcgactg

SEQ ID NO: 335255 - DNA, 25 bp, Mus musculus
agtgtgccagcagatgatgcccgcc

SEQ ID NO: 335256 - DNA, 25 bp, Mus musculus
ttgcaccaggtgcagtgcccagtgt

SEQ ID NO: 335257 - DNA, 25 bp, Mus musculus
ttcctgtcgcagttgcaccaggtgc

SEQ ID NO: 335258 - DNA, 25 bp, Mus musculus
ttcccgacacgactcgcgaggcgtt

SEQ ID NO: 335259 - DNA, 25 bp, Mus musculus
gctttggactacacttcccgacacg

SEQ ID NO: 335260 - DNA, 25 bp, Mus musculus
ctgcaggactacatcgggcagagta

SEQ ID NO: 335261 - DNA, 25 bp, Mus musculus
agcctgcgtctctggagtctccagg

SEQ ID NO: 335262 - DNA, 25 bp, Mus musculus
gctgggatcacaaggcgactcactt

SEQ ID NO: 335263 - DNA, 25 bp, Mus musculus
agtctccaggttcactccggatcga

SEQ ID NO: 335264 - DNA, 25 bp, Mus musculus
cactccggatcgaaggacatacgtg

SEQ ID NO: 335265 - DNA, 25 bp, Mus musculus
ggacatacgtgatcacctgtagccc

SEQ ID NO: 335266 - DNA, 25 bp, Mus musculus
tagccgtcgcctccaaggactctgg

SEQ ID NO: 335267 - DNA, 25 bp, Mus musculus
tcgcctccaaggactctggcagatc

SEQ ID NO: 335268 - DNA, 25 bp, Mus musculus
cgatgtcaccagatggctgggatca

SEQ ID NO: 335269 - DNA, 25 bp, Mus musculus
caaggcgactcacttggctgcgtca

SEQ ID NO: 335270 - DNA, 25 bp, Mus musculus
ttggctgcgtcacggcccgctgaag

SEQ ID NO: 335271 - DNA, 25 bp, Mus musculus
aagccgctgtgcagcagagggaacc

SEQ ID NO: 335272 - DNA, 25 bp, Mus musculus
agagggaacccgagtcaggtccaca

SEQ ID NO: 335273 - DNA, 25 bp, Mus musculus
agtcaggtccacagggctctcgccg

SEQ ID NO: 335274 - DNA, 25 bp, Mus musculus
gtcctagtgcgtcaccagcctgcgt

SEQ ID NO: 335275 - DNA, 25 bp, Mus musculus
tgctcagtagagctcaatgcccagc

SEQ ID NO: 335276 - DNA, 25 bp, Mus musculus
ggactcttcttgaggtcgttttagc

SEQ ID NO: 335277 - DNA, 25 bp, Mus musculus
gtcgttttagctcaagtcgagactg

SEQ ID NO: 335278 - DNA, 25 bp, Mus musculus
cacagcgctatctagcgggccaagc

SEQ ID NO: 335279 - DNA, 25 bp, Mus musculus
gcggtctccgccctgacatatagca

SEQ ID NO: 335280 - DNA, 25 bp, Mus musculus
tatagcagctatgaccgccgtatta

SEQ ID NO: 335281 - DNA, 25 bp, Mus musculus
gggctctctcagaactcgctcagaa

SEQ ID NO: 335282 - DNA, 25 bp, Mus musculus
tcgctcagaaagcaaggcaaaagtg

SEQ ID NO: 335283 - DNA, 25 bp, Mus musculus
tgctgcgaacctggcatgctcagta

SEQ ID NO: 335284 - DNA, 25 bp, Mus musculus
tcatctagcgggaggttggactctt

SEQ ID NO: 335285 - DNA, 25 bp, Mus musculus
agcgcggaacttgctgtcatctagc

SEQ ID NO: 335286 - DNA, 25 bp, Mus musculus
ctcagaagctggtttcccggaaggg

SEQ ID NO: 335287 - DNA, 25 bp, Mus musculus
gccgccgctagtttcctcagaagct

SEQ ID NO: 335288 - DNA, 25 bp, Mus musculus
ggctgggcgccacttcagcaccgaa

SEQ ID NO: 335289 - DNA, 25 bp, Mus musculus
gttgtcggcccttccttgctcaaac

SEQ ID NO: 335290 - DNA, 25 bp, Mus musculus
ggacgcctggcgttgtcggcccttc

SEQ ID NO: 335291 - DNA, 25 bp, Mus musculus
ccgtagccaccttcgggtaatggcg

SEQ ID NO: 335292 - DNA, 25 bp, Mus musculus
aaatcccggatctgcgtaccccagg

SEQ ID NO: 335293 - DNA, 25 bp, Mus musculus
gcgggacttcgagcttagcacttga

SEQ ID NO: 335294 - DNA, 25 bp, Mus musculus
cgcatgcgcgttccatggagcttgt

SEQ ID NO: 335295 - DNA, 25 bp, Mus musculus
gcgttccatggagcttgtgcgacct

SEQ ID NO: 335296 - DNA, 25 bp, Mus musculus
agcttgtgcgacctggagctatggc

SEQ ID NO: 335297 - DNA, 25 bp, Mus musculus
tggagctatggcgaccgcaacagtt

SEQ ID NO: 335298 - DNA, 25 bp, Mus musculus
atggcgaccgcaacagttcgcccgg

SEQ ID NO: 335299 - DNA, 25 bp, Mus musculus
tccagatcccgcagaactggtgtgc

SEQ ID NO: 335300 - DNA, 25 bp, Mus musculus
cagcggttgcggctgctcctctcgc

SEQ ID NO: 335301 - DNA, 25 bp, Mus musculus
tcgagcttagcacttgaagggtggc

SEQ ID NO: 335302 - DNA, 25 bp, Mus musculus
ttagcacttgaagggtggcatccag

SEQ ID NO: 335303 - DNA, 25 bp, Mus musculus
aatgcgacaccagccggggctcttc

SEQ ID NO: 335304 - DNA, 25 bp, Mus musculus
cgcaaccttgggaccctgaccggat

SEQ ID NO: 335305 - DNA, 25 bp, Mus musculus
gcccgcccagtagccagcggtggaa

SEQ ID NO: 335306 - DNA, 25 bp, Mus musculus
gaccctgaccggatgggactacctc

SEQ ID NO: 335307 - DNA, 25 bp, Mus musculus
cggatgggactacctcatccatttc

SEQ ID NO: 335308 - DNA, 25 bp, Mus musculus
catttcttccctaggggtgagccca

SEQ ID NO: 335309 - DNA, 25 bp, Mus musculus
gagcccaccttagcgccgatctggt

SEQ ID NO: 335310 - DNA, 25 bp, Mus musculus
tgcacgatctcgcgcatggtgctgg

SEQ ID NO: 335311 - DNA, 25 bp, Mus musculus
gaggctcttgccctcggagcagtgc

SEQ ID NO: 335312 - DNA, 25 bp, Mus musculus
ttgccctcggagcagtgcgtggaca

SEQ ID NO: 335313 - DNA, 25 bp, Mus musculus
ggctaaggagcgcaaaagaccagtc

SEQ ID NO: 335314 - DNA, 25 bp, Mus musculus
ggagcgcaaaagaccagtcgccctc

SEQ ID NO: 335315 - DNA, 25 bp, Mus musculus
gcccagtcccgctgacgtcatgggg

SEQ ID NO: 335316 - DNA, 25 bp, Mus musculus
tagccagcggtggaatgcgacacca

SEQ ID NO: 335317 - DNA, 25 bp, Mus musculus
tgtccgcgtagatgggagctgccaa

SEQ ID NO: 335318 - DNA, 25 bp, Mus musculus
ctcctacgaaaaaggccgcgtgccg

SEQ ID NO: 335319 - DNA, 25 bp, Mus musculus
tacaggtgacgatgggcttgttctc

SEQ ID NO: 335320 - DNA, 25 bp, Mus musculus
ccgatccctagcagcactgacagta

SEQ ID NO: 335321 - DNA, 25 bp, Mus musculus
acagtacagaacgagctgctccgga

SEQ ID NO: 335322 - DNA, 25 bp, Mus musculus
cgcccaggtcaggacccaaagcttg

SEQ ID NO: 335323 - DNA, 25 bp, Mus musculus
gacccaaagcttggcgtcggctgca

SEQ ID NO: 335324 - DNA, 25 bp, Mus musculus
ctgcacagcgggtcggaggtcaccc

SEQ ID NO: 335325 - DNA, 25 bp, Mus musculus
cccgccgcacttacaggtgacgatg

SEQ ID NO: 335326 - DNA, 25 bp, Mus musculus
ggcttgttctccatggtgtagacca

SEQ ID NO: 335327 - DNA, 25 bp, Mus musculus
cgccgaatgccctcctacgaaaaag

SEQ ID NO: 335328 - DNA, 25 bp, Mus musculus
cggggccgctgtagctgtcaatagc

SEQ ID NO: 335329 - DNA, 25 bp, Mus musculus
tgtcaatagcgggagccgcctctgc

SEQ ID NO: 335330 - DNA, 25 bp, Mus musculus
tagaccaccggtggctgtggctcct

SEQ ID NO: 335331 - DNA, 25 bp, Mus musculus
ccaggccgggttgacgtaatgctct

SEQ ID NO: 335332 - DNA, 25 bp, Mus musculus
ctggactatgggcttgtggccaatc

SEQ ID NO: 335333 - DNA, 25 bp, Mus musculus
ctctgagccccagggacggtcttgg

SEQ ID NO: 335334 - DNA, 25 bp, Mus musculus
tgacgtaatgctctgagccccaggg

SEQ ID NO: 335335 - DNA, 25 bp, Mus musculus
cgggttgacgtaatgctctgagccc

SEQ ID NO: 335336 - DNA, 25 bp, Mus musculus
aggccgggttgacgtaatgctctga

SEQ ID NO: 335337 - DNA, 25 bp, Mus musculus
tctccaggccgggttgacgtaatgc

SEQ ID NO: 335338 - DNA, 25 bp, Mus musculus
ccgttctcgctagcgctctccaggc

SEQ ID NO: 335339 - DNA, 25 bp, Mus musculus
ccagtcccgttctcgctagcgctct

SEQ ID NO: 335340 - DNA, 25 bp, Mus musculus
tggactatgggcttgtggccaatca

SEQ ID NO: 335341 - DNA, 25 bp, Mus musculus
gactatgggcttgtggccaatcagc

SEQ ID NO: 335342 - DNA, 25 bp, Mus musculus
ctatgggcttgtggccaatcagcgc

SEQ ID NO: 335343 - DNA, 25 bp, Mus musculus
atcagcgcgggcgtgaagaccttgc

SEQ ID NO: 335344 - DNA, 25 bp, Mus musculus
ccgggttgacgtaatgctctgagcc

SEQ ID NO: 335345 - DNA, 25 bp, Mus musculus
tctgaaagtgaaagagcgttccgct

SEQ ID NO: 335346 - DNA, 25 bp, Mus musculus
ctggtccactttcatgtcatgcggc

SEQ ID NO: 335347 - DNA, 25 bp, Mus musculus
tggccatgtgcagccgctacgtgag

SEQ ID NO: 335348 - DNA, 25 bp, Mus musculus
ggcgcgcgcatctgaaagtgaaaga

SEQ ID NO: 335349 - DNA, 25 bp, Mus musculus
tgggtgggagcaacgccgcatctac

SEQ ID NO: 335350 - DNA, 25 bp, Mus musculus
acaacttcagtgcaaggctgtggga

SEQ ID NO: 335351 - DNA, 25 bp, Mus musculus
gcgttccgcttttcggagctcgctc

SEQ ID NO: 335352 - DNA, 25 bp, Mus musculus
tctacgcaacctcgcagtggccatg

SEQ ID NO: 335353 - DNA, 25 bp, Mus musculus
attcgctcttcctgtgggtgggagc

SEQ ID NO: 335354 - DNA, 25 bp, Mus musculus
tcatgcggctgacggattcgctctt

SEQ ID NO: 335355 - DNA, 25 bp, Mus musculus
ctgtgggagcagctggtccactttc

SEQ ID NO: 335356 - DNA, 25 bp, Mus musculus
gcggacgtgtcgcttcacaacttca

SEQ ID NO: 335357 - DNA, 25 bp, Mus musculus
agctcgctctctctggtctgggagc

SEQ ID NO: 335358 - DNA, 25 bp, Mus musculus
caacctcgcagtggccatgtgcagc

SEQ ID NO: 335359 - DNA, 25 bp, Mus musculus
tccagaaggaaggagtccgagaact

SEQ ID NO: 335360 - DNA, 25 bp, Mus musculus
cgcggcaccagaaatcgggctggtc

SEQ ID NO: 335361 - DNA, 25 bp, Mus musculus
ccgagaactggctgaagccaatgaa

SEQ ID NO: 335362 - DNA, 25 bp, Mus musculus
agccaatgaacagtgccgggatcca

SEQ ID NO: 335363 - DNA, 25 bp, Mus musculus
gccgggatccaggtgagcaccacca

SEQ ID NO: 335364 - DNA, 25 bp, Mus musculus
accagggtcttctggtagccgccgc

SEQ ID NO: 335365 - DNA, 25 bp, Mus musculus
aagggcagcacggagccatcgtagt

SEQ ID NO: 335366 - DNA, 25 bp, Mus musculus
atcgtagtccagcaacaggaggctc

SEQ ID NO: 335367 - DNA, 25 bp, Mus musculus
cagcgcaggcagtggctggatctcc

SEQ ID NO: 335368 - DNA, 25 bp, Mus musculus
ggtctatcgccatggccagggcccg

SEQ ID NO: 335369 - DNA, 25 bp, Mus musculus
cgggcagaaaccgttcgagtcctca

SEQ ID NO: 335370 - DNA, 25 bp, Mus musculus
tagctacgaggctctccgctgatgc

SEQ ID NO: 335371 - DNA, 25 bp, Mus musculus
gttgggagatcctccacggacttcg

SEQ ID NO: 335372 - DNA, 25 bp, Mus musculus
ggtgacagtggcacccgccagctcg

SEQ ID NO: 335373 - DNA, 25 bp, Mus musculus
gaccggccagacagccgcgctcgct

SEQ ID NO: 335374 - DNA, 25 bp, Mus musculus
acctgactgacacggccctggccgg

SEQ ID NO: 335375 - DNA, 25 bp, Mus musculus
cctggccggggaggactggagcgaa

SEQ ID NO: 335376 - DNA, 25 bp, Mus musculus
cgaagtgagacgtgtgcagagtctt

SEQ ID NO: 335377 - DNA, 25 bp, Mus musculus
agtgagacgtgtgcagagtcttccc

SEQ ID NO: 335378 - DNA, 25 bp, Mus musculus
tgagacgtgtgcagagtcttcccgg

SEQ ID NO: 335379 - DNA, 25 bp, Mus musculus
agacgtgtgcagagtcttcccggag

SEQ ID NO: 335380 - DNA, 25 bp, Mus musculus
acgtgtgcagagtcttcccggaggc

SEQ ID NO: 335381 - DNA, 25 bp, Mus musculus
tgtgcagagtcttcccggaggccgc

SEQ ID NO: 335382 - DNA, 25 bp, Mus musculus
ctcttgggggtttgcctatgcagcc

SEQ ID NO: 335383 - DNA, 25 bp, Mus musculus
ggggtttgcctatgcagcccgagga

SEQ ID NO: 335384 - DNA, 25 bp, Mus musculus
gctggggtcgcaggccaccatcgcc

SEQ ID NO: 335385 - DNA, 25 bp, Mus musculus
cgggccggggtcagacctgactgac

SEQ ID NO: 335386 - DNA, 25 bp, Mus musculus
ggtcccgccggagaccggccagaca

SEQ ID NO: 335387 - DNA, 25 bp, Mus musculus
ttggatgagctcctcactaagttcc

SEQ ID NO: 335388 - DNA, 25 bp, Mus musculus
gcaaccgcgcacgaacatgttcacg

SEQ ID NO: 335389 - DNA, 25 bp, Mus musculus
ttcacgagcgacgtgccctcaaaca

SEQ ID NO: 335390 - DNA, 25 bp, Mus musculus
gctcgattcccgcaacggcggttaa

SEQ ID NO: 335391 - DNA, 25 bp, Mus musculus
gactgaacgggctgcggctttataa

SEQ ID NO: 335392 - DNA, 25 bp, Mus musculus
gcctgctgacgatgagcctgcggat

SEQ ID NO: 335393 - DNA, 25 bp, Mus musculus
ttataaggcacttcccatcgcgggc

SEQ ID NO: 335394 - DNA, 25 bp, Mus musculus
ctcggtgcggatttcgaagaactcc

SEQ ID NO: 335395 - DNA, 25 bp, Mus musculus
ccctggtctgccaactgctaggcga

SEQ ID NO: 335396 - DNA, 25 bp, Mus musculus
cgcgcaaggcgactttctcctcgtt

SEQ ID NO: 335397 - DNA, 25 bp, Mus musculus
agttgagcactctgccaggcccaca

SEQ ID NO: 335398 - DNA, 25 bp, Mus musculus
ttcccactctggatcctcgggattc

SEQ ID NO: 335399 - DNA, 25 bp, Mus musculus
cgggctcagaccaagcgggaatccg

SEQ ID NO: 335400 - DNA, 25 bp, Mus musculus
atcgacacgtcgctggagtccagag

SEQ ID NO: 335401 - DNA, 25 bp, Mus musculus
tcccgatgtggacacgagcttcctg

SEQ ID NO: 335402 - DNA, 25 bp, Mus musculus
gcgcaagcgcaagatctccaacctg

SEQ ID NO: 335403 - DNA, 25 bp, Mus musculus
acctgtctttcacgttggacgagga

SEQ ID NO: 335404 - DNA, 25 bp, Mus musculus
tcaccttcagctactgggatggctc

SEQ ID NO: 335405 - DNA, 25 bp, Mus musculus
gaggatctcatcctgccgcactatc

SEQ ID NO: 335406 - DNA, 25 bp, Mus musculus
tgaccaagaggacagccgccaagcc

SEQ ID NO: 335407 - DNA, 25 bp, Mus musculus
agcagttcctgaagcgggcgctgca

SEQ ID NO: 335408 - DNA, 25 bp, Mus musculus
gcccacagtgctggagccaagaaga

SEQ ID NO: 335409 - DNA, 25 bp, Mus musculus
tctacgacttcatcgtggccaaagc

SEQ ID NO: 335410 - DNA, 25 bp, Mus musculus
agagcggcccgctcttcagcttcga

SEQ ID NO: 335411 - DNA, 25 bp, Mus musculus
ctggtacgagaagaacaagcacatc

SEQ ID NO: 335412 - DNA, 25 bp, Mus musculus
ttcagcttcgacgtgcacgacgatg

SEQ ID NO: 335413 - DNA, 25 bp, Mus musculus
ccacgatggagaaagatgagtcaca

SEQ ID NO: 335414 - DNA, 25 bp, Mus musculus
tggagcagctcatgtacgtcaagga

SEQ ID NO: 335415 - DNA, 25 bp, Mus musculus
agacttccgggaagctggttccgct

SEQ ID NO: 335416 - DNA, 25 bp, Mus musculus
agcacgcatgcgtctctccggctgg

SEQ ID NO: 335417 - DNA, 25 bp, Mus musculus
acgcaatcttggcaagccgctgtgc

SEQ ID NO: 335418 - DNA, 25 bp, Mus musculus
ttggggtacgctcagacgcaatctt

SEQ ID NO: 335419 - DNA, 25 bp, Mus musculus
gcagctttgaacacgcccacgcttt

SEQ ID NO: 335420 - DNA, 25 bp, Mus musculus
ctctacttgagggatcttggggtac

SEQ ID NO: 335421 - DNA, 25 bp, Mus musculus
tgtcaccgaacaaggcggacctcta

SEQ ID NO: 335422 - DNA, 25 bp, Mus musculus
aagccgctgtgctgacgttgccgca

SEQ ID NO: 335423 - DNA, 25 bp, Mus musculus
ccgtggtctccacggtgtcaccgaa

SEQ ID NO: 335424 - DNA, 25 bp, Mus musculus
tctccggctggccaaaagacttccg

SEQ ID NO: 335425 - DNA, 25 bp, Mus musculus
tggttccgctgtgcagagctcactt

SEQ ID NO: 335426 - DNA, 25 bp, Mus musculus
tgcagagctcacttccgtcctgatc

SEQ ID NO: 335427 - DNA, 25 bp, Mus musculus
ttccgtcctgatccgcggaaactgc

SEQ ID NO: 335428 - DNA, 25 bp, Mus musculus
tccgcggaaactgcggctatgggtc

SEQ ID NO: 335429 - DNA, 25 bp, Mus musculus
ctaaagagacccgaggaatagtggc

SEQ ID NO: 335430 - DNA, 25 bp, Mus musculus
cgccgagtttttctatccggattct

SEQ ID NO: 335431 - DNA, 25 bp, Mus musculus
ccgctttcctaacgcatatgctatc

SEQ ID NO: 335432 - DNA, 25 bp, Mus musculus
tacgtgctccgcacatgcgcggctg

SEQ ID NO: 335433 - DNA, 25 bp, Mus musculus
ggactcccgagtgccgcttttctct

SEQ ID NO: 335434 - DNA, 25 bp, Mus musculus
cctcggtgatctccttccctaaaga

SEQ ID NO: 335435 - DNA, 25 bp, Mus musculus
agtgccgcttttctctacgtgctcc

SEQ ID NO: 335436 - DNA, 25 bp, Mus musculus
ggaagttcaagatggccgccacgga

SEQ ID NO: 335437 - DNA, 25 bp, Mus musculus
ccctgcgggagcaagctgagtaagt

SEQ ID NO: 335438 - DNA, 25 bp, Mus musculus
aagttcaggcctaacggcgacagcc

SEQ ID NO: 335439 - DNA, 25 bp, Mus musculus
aaactttgccttgccgcgcgccgtg

SEQ ID NO: 335440 - DNA, 25 bp, Mus musculus
agcggcctctacaggtccagttagc

SEQ ID NO: 335441 - DNA, 25 bp, Mus musculus
ggaccgtggagctctccgatctcaa

SEQ ID NO: 335442 - DNA, 25 bp, Mus musculus
tccggattcttagcgcggactcccg

SEQ ID NO: 335443 - DNA, 25 bp, Mus musculus
ctagccaggccagatgacaaagcgg

SEQ ID NO: 335444 - DNA, 25 bp, Mus musculus
cagcagaggaagaaccttcgaggtc

SEQ ID NO: 335445 - DNA, 25 bp, Mus musculus
ccttcgaggtcactctttagagctc

SEQ ID NO: 335446 - DNA, 25 bp, Mus musculus
tccttaccctttgggactcagcaga

SEQ ID NO: 335447 - DNA, 25 bp, Mus musculus
ctctcgctgggaaatcgtcaaagta

SEQ ID NO: 335448 - DNA, 25 bp, Mus musculus
cgtcaaagtaatatcctgctgtctc

SEQ ID NO: 335449 - DNA, 25 bp, Mus musculus
cgaaaattcccgctggcgactttgg

SEQ ID NO: 335450 - DNA, 25 bp, Mus musculus
agagtcgaggctgcaagcttacctc

SEQ ID NO: 335451 - DNA, 25 bp, Mus musculus
agcttacctcggacaccagcatcga

SEQ ID NO: 335452 - DNA, 25 bp, Mus musculus
actgccgccatagctagatactgtg

SEQ ID NO: 335453 - DNA, 25 bp, Mus musculus
cccggaggcttaggcccagcagaaa

SEQ ID NO: 335454 - DNA, 25 bp, Mus musculus
tgcgtgccctaggaagtcccgggct

SEQ ID NO: 335455 - DNA, 25 bp, Mus musculus
ggagcgcgtccatccttaccctttg

SEQ ID NO: 335456 - DNA, 25 bp, Mus musculus
atactgtggtcaaactgagcccgga

SEQ ID NO: 335457 - DNA, 25 bp, Mus musculus
aggtcccttactcaacttcggatcg

SEQ ID NO: 335458 - DNA, 25 bp, Mus musculus
gcaggtttttcggtcgcaagtagga

SEQ ID NO: 335459 - DNA, 25 bp, Mus musculus
tcaacttcggatcggtttacctgcc

SEQ ID NO: 335460 - DNA, 25 bp, Mus musculus
cgggcacagtcaccgttctccgcga

SEQ ID NO: 335461 - DNA, 25 bp, Mus musculus
ccgccctctgctgggcaactagcgc

SEQ ID NO: 335462 - DNA, 25 bp, Mus musculus
gaagctttttgcactacaccggaga

SEQ ID NO: 335463 - DNA, 25 bp, Mus musculus
ttttgcactacaccggagaccggga

SEQ ID NO: 335464 - DNA, 25 bp, Mus musculus
ctacaccggagaccgggagccacgg

SEQ ID NO: 335465 - DNA, 25 bp, Mus musculus
aagcgcaggccacgcagggacccaa

SEQ ID NO: 335466 - DNA, 25 bp, Mus musculus
gccacgcagggacccaactggaaca

SEQ ID NO: 335467 - DNA, 25 bp, Mus musculus
aactggaacaaagtgtctgccgccg

SEQ ID NO: 335468 - DNA, 25 bp, Mus musculus
aacaaagtgtctgccgccgggtgcc

SEQ ID NO: 335469 - DNA, 25 bp, Mus musculus
tccgaggagctgtacgaggtactcc

SEQ ID NO: 335470 - DNA, 25 bp, Mus musculus
cgcgaccctcaagcaccgcccggtc

SEQ ID NO: 335471 - DNA, 25 bp, Mus musculus
cctcggccaacggacagcaagcggg

SEQ ID NO: 335472 - DNA, 25 bp, Mus musculus
agcggcgaccgcctcggccaacgga

SEQ ID NO: 335473 - DNA, 25 bp, Mus musculus
gggacacgcgcggaccgacgcgcgg

SEQ ID NO: 335474 - DNA, 25 bp, Mus musculus
gcgatcccacagttccgccggcgcg

SEQ ID NO: 335475 - DNA, 25 bp, Mus musculus
cgccgccgccacttcctgtgcgcgg

SEQ ID NO: 335476 - DNA, 25 bp, Mus musculus
ccatctctacccgatcgcccgcatc

SEQ ID NO: 335477 - DNA, 25 bp, Mus musculus
ggggcctcagcgagtgcggcgcccg

SEQ ID NO: 335478 - DNA, 25 bp, Mus musculus
gagccgggagccgagcaaggttccc

SEQ ID NO: 335479 - DNA, 25 bp, Mus musculus
acctgctggtcgcggttctcgcgtc

SEQ ID NO: 335480 - DNA, 25 bp, Mus musculus
tgcactccacctgctggtcgcggtt

SEQ ID NO: 335481 - DNA, 25 bp, Mus musculus
gcgcggctcacctgcactccacctg

SEQ ID NO: 335482 - DNA, 25 bp, Mus musculus
cgggcaggccgacaggggcctgggc

SEQ ID NO: 335483 - DNA, 25 bp, Mus musculus
gccgcccaggccctctcgtcgggcc

SEQ ID NO: 335484 - DNA, 25 bp, Mus musculus
tgtgcgcggcgatcccacagttccg

SEQ ID NO: 335485 - DNA, 25 bp, Mus musculus
ggacctgactcaccctgtaattatg

SEQ ID NO: 335486 - DNA, 25 bp, Mus musculus
acagaccagtaagtgccgaggcgcc

SEQ ID NO: 335487 - DNA, 25 bp, Mus musculus
acgatctccgcccaccctcgcaagc

SEQ ID NO: 335488 - DNA, 25 bp, Mus musculus
cggcgtggttctaccttaaagctct

SEQ ID NO: 335489 - DNA, 25 bp, Mus musculus
ccgggtggacctgactcaccctgta

SEQ ID NO: 335490 - DNA, 25 bp, Mus musculus
ttctaccttaaagctctccagccta

SEQ ID NO: 335491 - DNA, 25 bp, Mus musculus
agtaagtgccgaggcgcctcttgca

SEQ ID NO: 335492 - DNA, 25 bp, Mus musculus
tggatttctcacagaccagtaagtg

SEQ ID NO: 335493 - DNA, 25 bp, Mus musculus
tggccgaagttggatttctcacaga

SEQ ID NO: 335494 - DNA, 25 bp, Mus musculus
cttatcgtggccgaagttggatttc

SEQ ID NO: 335495 - DNA, 25 bp, Mus musculus
tgcttatggcgagacttatcgtggc

SEQ ID NO: 335496 - DNA, 25 bp, Mus musculus
cacgagatgcttatggcgagactta

SEQ ID NO: 335497 - DNA, 25 bp, Mus musculus
cctgtaattatgatagtgcgtctcc

SEQ ID NO: 335498 - DNA, 25 bp, Mus musculus
atagtgcgtctccacgagatgctta

SEQ ID NO: 335499 - DNA, 25 bp, Mus musculus
gggactgctgctccaagtgtaagaa

SEQ ID NO: 335500 - DNA, 25 bp, Mus musculus
ctacaggaatatcgccgctctcgtg

SEQ ID NO: 335501 - DNA, 25 bp, Mus musculus
gccgaatccgctttctgccagggta

SEQ ID NO: 335502 - DNA, 25 bp, Mus musculus
gtaggcaagcccagccgacactatg

SEQ ID NO: 335503 - DNA, 25 bp, Mus musculus
tgctgcgggagtagataaaagtttc

SEQ ID NO: 335504 - DNA, 25 bp, Mus musculus
tttccagaggactctccgcggttcc

SEQ ID NO: 335505 - DNA, 25 bp, Mus musculus
acactgtcatggatccctcgggaga

SEQ ID NO: 335506 - DNA, 25 bp, Mus musculus
cctcgggagaacagctacacagatc

SEQ ID NO: 335507 - DNA, 25 bp, Mus musculus
tacacagatccgaggcgtccagctc

SEQ ID NO: 335508 - DNA, 25 bp, Mus musculus
tgcctgatcctctcttggtaccctg

SEQ ID NO: 335509 - DNA, 25 bp, Mus musculus
tcaatccgcggaggaactgtcggtc

SEQ ID NO: 335510 - DNA, 25 bp, Mus musculus
cctggccagcgtgaagcacttcagc

SEQ ID NO: 335511 - DNA, 25 bp, Mus musculus
cggtgcgctacactttcacggagtg

SEQ ID NO: 335512 - DNA, 25 bp, Mus musculus
gtacctttctggacgtgcctgctga

SEQ ID NO: 335513 - DNA, 25 bp, Mus musculus
aaaccagacatggtgccggagcctc

SEQ ID NO: 335514 - DNA, 25 bp, Mus musculus
tgggccaaacaaaccagacatggtg

SEQ ID NO: 335515 - DNA, 25 bp, Mus musculus
gtgccggagcctcgttcaccacccg

SEQ ID NO: 335516 - DNA, 25 bp, Mus musculus
cagatggaaggagatgccgaggacc

SEQ ID NO: 335517 - DNA, 25 bp, Mus musculus
tggatctcctctcggagacacttgc

SEQ ID NO: 335518 - DNA, 25 bp, Mus musculus
acttgcgagagttcacgggcagatg

SEQ ID NO: 335519 - DNA, 25 bp, Mus musculus
ggtgatctcgtaggcgcccgtcacc

SEQ ID NO: 335520 - DNA, 25 bp, Mus musculus
tctcggagacacttgcgagagttca

SEQ ID NO: 335521 - DNA, 25 bp, Mus musculus
ccagactggtcggtgatctcgtagg

SEQ ID NO: 335522 - DNA, 25 bp, Mus musculus
agctggggccgagcagcaacagaaa

SEQ ID NO: 335523 - DNA, 25 bp, Mus musculus
agcaacagaaagagccaggcggacg

SEQ ID NO: 335524 - DNA, 25 bp, Mus musculus
agacacttgcgagagttcacgggca

SEQ ID NO: 335525 - DNA, 25 bp, Mus musculus
ggagagtgggccaaacaaaccagac

SEQ ID NO: 335526 - DNA, 25 bp, Mus musculus
tcgtaggcgcccgtcaccagcaggt

SEQ ID NO: 335527 - DNA, 25 bp, Mus musculus
cagcgtctcggtagccagaggttaa

SEQ ID NO: 335528 - DNA, 25 bp, Mus musculus
ggaggctccgcgttcctcacaggct

SEQ ID NO: 335529 - DNA, 25 bp, Mus musculus
cgggctcgaacaccagggctcaaag

SEQ ID NO: 335530 - DNA, 25 bp, Mus musculus
gccgagatcccggtgtctcctgaca

SEQ ID NO: 335531 - DNA, 25 bp, Mus musculus
ctgcctgacctgctgtgcacgaaaa

SEQ ID NO: 335532 - DNA, 25 bp, Mus musculus
tgcacgaaaacgagggtgactttgc

SEQ ID NO: 335533 - DNA, 25 bp, Mus musculus
gtgactttgctttggatccgtctgg

SEQ ID NO: 335534 - DNA, 25 bp, Mus musculus
atccgtctggttggcagcctgagtt

SEQ ID NO: 335535 - DNA, 25 bp, Mus musculus
gcagcctgagtttatcagtgtcatc

SEQ ID NO: 335536 - DNA, 25 bp, Mus musculus
cggaggtaactagctggcgacttcc

SEQ ID NO: 335537 - DNA, 25 bp, Mus musculus
ctcaagggacctagggccctggcct

SEQ ID NO: 335538 - DNA, 25 bp, Mus musculus
tgtggccgctttgcggacttcgaaa

SEQ ID NO: 335539 - DNA, 25 bp, Mus musculus
tggcctcttcccgtcaagatggcgg

SEQ ID NO: 335540 - DNA, 25 bp, Mus musculus
ccagaggttaagctcagtgacggcg

SEQ ID NO: 335541 - DNA, 25 bp, Mus musculus
cgagcgcgctctcgaagtactcgct

SEQ ID NO: 335542 - DNA, 25 bp, Mus musculus
cgcgctctcgaagtactcgctggag

SEQ ID NO: 335543 - DNA, 25 bp, Mus musculus
cgctctcgaagtactcgctggaggc

SEQ ID NO: 335544 - DNA, 25 bp, Mus musculus
gctctcgaagtactcgctggaggcc

SEQ ID NO: 335545 - DNA, 25 bp, Mus musculus
ctctcgaagtactcgctggaggccc

SEQ ID NO: 335546 - DNA, 25 bp, Mus musculus
tcgaagtactcgctggaggccccgc

SEQ ID NO: 335547 - DNA, 25 bp, Mus musculus
gcgcgcgccttcttgttgcccggtg

SEQ ID NO: 335548 - DNA, 25 bp, Mus musculus
gcgcgccttcttgttgcccggtgcg

SEQ ID NO: 335549 - DNA, 25 bp, Mus musculus
gcgccttcttgttgcccggtgcgcg

SEQ ID NO: 335550 - DNA, 25 bp, Mus musculus
gctcgagagccctgtggccgtgacc

SEQ ID NO: 335551 - DNA, 25 bp, Mus musculus
tcgagagccctgtggccgtgaccgc

SEQ ID NO: 335552 - DNA, 25 bp, Mus musculus
ccgtgatccggtgccggccgagcgg

SEQ ID NO: 335553 - DNA, 25 bp, Mus musculus
gcgcgctctcgaagtactcgctgga

SEQ ID NO: 335554 - DNA, 25 bp, Mus musculus
gagcgcgctctcgaagtactcgctg

SEQ ID NO: 335555 - DNA, 25 bp, Mus musculus
gtccgcgctcaccagtggaggctgc

SEQ ID NO: 335556 - DNA, 25 bp, Mus musculus
tccgcgctcaccagtggaggctgcg

SEQ ID NO: 335557 - DNA, 25 bp, Mus musculus
atggcagcggagtccgcgctcacca

SEQ ID NO: 335558 - DNA, 25 bp, Mus musculus
cttagacagccgcaggatggcagcg

SEQ ID NO: 335559 - DNA, 25 bp, Mus musculus
gagccttagacagccgcaggatggc

SEQ ID NO: 335560 - DNA, 25 bp, Mus musculus
gcgagccttagacagccgcaggatg

SEQ ID NO: 335561 - DNA, 25 bp, Mus musculus
cagcgagccttagacagccgcagga

SEQ ID NO: 335562 - DNA, 25 bp, Mus musculus
ctccagccgggagctctgggtattt

SEQ ID NO: 335563 - DNA, 25 bp, Mus musculus
gcctccagccgggagctctgggtat

SEQ ID NO: 335564 - DNA, 25 bp, Mus musculus
gcagctctgtgtgcgcgccccaaga

SEQ ID NO: 335565 - DNA, 25 bp, Mus musculus
agtccgtgcgggcagctctgtgtgc

SEQ ID NO: 335566 - DNA, 25 bp, Mus musculus
ccctccacgcggtgcggagtccgtg

SEQ ID NO: 335567 - DNA, 25 bp, Mus musculus
cccattggccggcctgccctgagga

SEQ ID NO: 335568 - DNA, 25 bp, Mus musculus
tccagccgggagctctgggtatttg

SEQ ID NO: 335569 - DNA, 25 bp, Mus musculus
tgggtttgatttatgaacggttaca

SEQ ID NO: 335570 - DNA, 25 bp, Mus musculus
tgtatgctgccattaagaatccatg

SEQ ID NO: 335571 - DNA, 25 bp, Mus musculus
gagcccgtaatgtatgctgccatta

SEQ ID NO: 335572 - DNA, 25 bp, Mus musculus
taagaatccatgcagctttcagagc

SEQ ID NO: 335573 - DNA, 25 bp, Mus musculus
cagctttcagagctcggggcgcaag

SEQ ID NO: 335574 - DNA, 25 bp, Mus musculus
caaggacgcatgtgttgctggaatt

SEQ ID NO: 335575 - DNA, 25 bp, Mus musculus
tgcgtgaaccagagcccgtaatgta

SEQ ID NO: 335576 - DNA, 25 bp, Mus musculus
tgttgctggaattcaatccgtgggg

SEQ ID NO: 335577 - DNA, 25 bp, Mus musculus
atgcagattgggctgcgacccactg

SEQ ID NO: 335578 - DNA, 25 bp, Mus musculus
cgacccactgggtttgatttatgaa

SEQ ID NO: 335579 - DNA, 25 bp, Mus musculus
ttgcatttcagagtcccggcacacc

SEQ ID NO: 335580 - DNA, 25 bp, Mus musculus
tacacattgcatttcagagtcccgg

SEQ ID NO: 335581 - DNA, 25 bp, Mus musculus
cactagcgattgtttacacattgca

SEQ ID NO: 335582 - DNA, 25 bp, Mus musculus
gaacggttacactagcgattgttta

SEQ ID NO: 335583 - DNA, 25 bp, Mus musculus
gacaccaggagcacggaaagcgccg

SEQ ID NO: 335584 - DNA, 25 bp, Mus musculus
gctaaagctgccgagagagacacca

SEQ ID NO: 335585 - DNA, 25 bp, Mus musculus
cgtcctcagagaacgaatggctatt

SEQ ID NO: 335586 - DNA, 25 bp, Mus musculus
tgccgagagagacaccaggagcacg

SEQ ID NO: 335587 - DNA, 25 bp, Mus musculus
ctcagagaacgaatggctattcctc

SEQ ID NO: 335588 - DNA, 25 bp, Mus musculus
cgaatggctattcctctcgatttcc

SEQ ID NO: 335589 - DNA, 25 bp, Mus musculus
attcctctcgatttccgggagcatg

SEQ ID NO: 335590 - DNA, 25 bp, Mus musculus
ggtcccgcgctcagaaggaaaacca

SEQ ID NO: 335591 - DNA, 25 bp, Mus musculus
ccgcgctcagaaggaaaaccaggtc

SEQ ID NO: 335592 - DNA, 25 bp, Mus musculus
gctcagaaggaaaaccaggtcgcta

SEQ ID NO: 335593 - DNA, 25 bp, Mus musculus
aggaaaaccaggtcgctaaagctgc

SEQ ID NO: 335594 - DNA, 25 bp, Mus musculus
ccaggtcgctaaagctgccgagaga

SEQ ID NO: 335595 - DNA, 25 bp, Mus musculus
ctcgatttccgggagcatggtgtga

SEQ ID NO: 335596 - DNA, 25 bp, Mus musculus
tggctattcctctcgatttccggga

SEQ ID NO: 335597 - DNA, 25 bp, Mus musculus
cgagctcgcccgcacactccgcacg

SEQ ID NO: 335598 - DNA, 25 bp, Mus musculus
cactattcgcgacgctcacccaccg

SEQ ID NO: 335599 - DNA, 25 bp, Mus musculus
tagagcgcgtgagcacataacccgg

SEQ ID NO: 335600 - DNA, 25 bp, Mus musculus
tcacaaaagcgcacgcccgggagcg

SEQ ID NO: 335601 - DNA, 25 bp, Mus musculus
ccgcacactccgcacgcgagcgcgc

SEQ ID NO: 335602 - DNA, 25 bp, Mus musculus
cctagagcgcgtgagcacataaccc

SEQ ID NO: 335603 - DNA, 25 bp, Mus musculus
cgagcgcgcgtacacacccaggccc

SEQ ID NO: 335604 - DNA, 25 bp, Mus musculus
ccagaaatagactctgcgtgccctc

SEQ ID NO: 335605 - DNA, 25 bp, Mus musculus
tctgcgtgccctcttgtgaatgtca

SEQ ID NO: 335606 - DNA, 25 bp, Mus musculus
gcgtgccctcttgtgaatgtcacta

SEQ ID NO: 335607 - DNA, 25 bp, Mus musculus
gccctcttgtgaatgtcactattcg

SEQ ID NO: 335608 - DNA, 25 bp, Mus musculus
gtgaatgtcactattcgcgacgctc

SEQ ID NO: 335609 - DNA, 25 bp, Mus musculus
aatgtcactattcgcgacgctcacc

SEQ ID NO: 335610 - DNA, 25 bp, Mus musculus
gagcgcgtgagcacataacccggcc

SEQ ID NO: 335611 - DNA, 25 bp, Mus musculus
ctagaagctgaaaagcgcgcaccga

SEQ ID NO: 335612 - DNA, 25 bp, Mus musculus
cgagggtcttgaggcaactagaagc

SEQ ID NO: 335613 - DNA, 25 bp, Mus musculus
aaagcgcgcaccgaggggacccaag

SEQ ID NO: 335614 - DNA, 25 bp, Mus musculus
acgtccctgcccctggtgatgtcag

SEQ ID NO: 335615 - DNA, 25 bp, Mus musculus
gaccgcgagggtcttgaggcaacta

SEQ ID NO: 335616 - DNA, 25 bp, Mus musculus
gggtcttgaggcaactagaagctga

SEQ ID NO: 335617 - DNA, 25 bp, Mus musculus
ttgaggcaactagaagctgaaaagc

SEQ ID NO: 335618 - DNA, 25 bp, Mus musculus
gcaactagaagctgaaaagcgcgca

SEQ ID NO: 335619 - DNA, 25 bp, Mus musculus
ctgaaaagcgcgcaccgaggggacc

SEQ ID NO: 335620 - DNA, 25 bp, Mus musculus
cgcaccgaggggacccaagcttgca

SEQ ID NO: 335621 - DNA, 25 bp, Mus musculus
gaggggacccaagcttgcagccctg

SEQ ID NO: 335622 - DNA, 25 bp, Mus musculus
gcagaaccagggcaagctgccacgg

SEQ ID NO: 335623 - DNA, 25 bp, Mus musculus
aaccagggcaagctgccacggctgt

SEQ ID NO: 335624 - DNA, 25 bp, Mus musculus
cggtggagggactgagtaggaccgc

SEQ ID NO: 335625 - DNA, 25 bp, Mus musculus
tccgggaaccatggtgaggagaacc

SEQ ID NO: 335626 - DNA, 25 bp, Mus musculus
cggaagagcaccagcaagctacaga

SEQ ID NO: 335627 - DNA, 25 bp, Mus musculus
aacgtcctggacgatgctggcgtac

SEQ ID NO: 335628 - DNA, 25 bp, Mus musculus
tgaggcgacacaacccagctagacg

SEQ ID NO: 335629 - DNA, 25 bp, Mus musculus
gtcaccactgaacgtcacactgagg

SEQ ID NO: 335630 - DNA, 25 bp, Mus musculus
gctcgagtgacgacacgcgctcgtc

SEQ ID NO: 335631 - DNA, 25 bp, Mus musculus
ggagaaccctgagaccacgcactcg

SEQ ID NO: 335632 - DNA, 25 bp, Mus musculus
tggcgtacgctaccgcctctcagtg

SEQ ID NO: 335633 - DNA, 25 bp, Mus musculus
cgggtcagcctaagccagtagaaca

SEQ ID NO: 335634 - DNA, 25 bp, Mus musculus
gacaccagtaaaggccggcggaaga

SEQ ID NO: 335635 - DNA, 25 bp, Mus musculus
cacctttaagaacacgggacaccag

SEQ ID NO: 335636 - DNA, 25 bp, Mus musculus
gggtgtcgagaacacacctttaaga

SEQ ID NO: 335637 - DNA, 25 bp, Mus musculus
tagaacagcagacgaaggccggatc

SEQ ID NO: 335638 - DNA, 25 bp, Mus musculus
gacctggcctcgatgtacttccgca

SEQ ID NO: 335639 - DNA, 25 bp, Mus musculus
agagtaccgcgcgttctcctcaagg

SEQ ID NO: 335640 - DNA, 25 bp, Mus musculus
ttaacaatttatgcgagctggaccg

SEQ ID NO: 335641 - DNA, 25 bp, Mus musculus
tggaccgcggttaccgaagcactgc

SEQ ID NO: 335642 - DNA, 25 bp, Mus musculus
actgcctcggactgcaagatgctcg

SEQ ID NO: 335643 - DNA, 25 bp, Mus musculus
taggagcctagcagtaaccgcctgg

SEQ ID NO: 335644 - DNA, 25 bp, Mus musculus
cgcgtaggtgctccctgtaatgtaa

SEQ ID NO: 335645 - DNA, 25 bp, Mus musculus
gttgcagctgcgaaggctgcttccc

SEQ ID NO: 335646 - DNA, 25 bp, Mus musculus
gttgccaacaggtgctcatgagctc

SEQ ID NO: 335647 - DNA, 25 bp, Mus musculus
cggcctgggactgaagttgccaaca

SEQ ID NO: 335648 - DNA, 25 bp, Mus musculus
gcttggatcgcacacccagtggtca

SEQ ID NO: 335649 - DNA, 25 bp, Mus musculus
tgcaaacgggagtcaatgggcgtcc

SEQ ID NO: 335650 - DNA, 25 bp, Mus musculus
acccaggtttccagagcagtccggc

SEQ ID NO: 335651 - DNA, 25 bp, Mus musculus
ccatgggtccctgagccctacgtag

SEQ ID NO: 335652 - DNA, 25 bp, Mus musculus
tacacagtttcacaggctttgccgc

SEQ ID NO: 335653 - DNA, 25 bp, Mus musculus
ctgaaactcggcgtttggcagaaag

SEQ ID NO: 335654 - DNA, 25 bp, Mus musculus
agagcgcggtgtacttctgaaactc

SEQ ID NO: 335655 - DNA, 25 bp, Mus musculus
gcgtattgttggtgactccgaggct

SEQ ID NO: 335656 - DNA, 25 bp, Mus musculus
ggcattgccggagcgaccttttaaa

SEQ ID NO: 335657 - DNA, 25 bp, Mus musculus
ttggcagaaaggacccgcgcaccct

SEQ ID NO: 335658 - DNA, 25 bp, Mus musculus
tgcgcatccatattagccgtccgag

SEQ ID NO: 335659 - DNA, 25 bp, Mus musculus
ccggcgccgtcacgagcacaggaag

SEQ ID NO: 335660 - DNA, 25 bp, Mus musculus
ctgtgagcgaccaccgtcgctggga

SEQ ID NO: 335661 - DNA, 25 bp, Mus musculus
ctctgcggactttgatcctcccggg

SEQ ID NO: 335662 - DNA, 25 bp, Mus musculus
tacatactttctagtccctctcggg

SEQ ID NO: 335663 - DNA, 25 bp, Mus musculus
ttaaccagccctgccgggactcgga

SEQ ID NO: 335664 - DNA, 25 bp, Mus musculus
attagccgtccgagcgcaggaatcc

SEQ ID NO: 335665 - DNA, 25 bp, Mus musculus
cagcaggacctgatgcgcatccata

SEQ ID NO: 335666 - DNA, 25 bp, Mus musculus
gcaccctggcagcatgcgctcggtt

SEQ ID NO: 335667 - DNA, 25 bp, Mus musculus
agccctcagtgtacgctttaaacga

SEQ ID NO: 335668 - DNA, 25 bp, Mus musculus
ccattatagaggcacgcgtaggcgg

SEQ ID NO: 335669 - DNA, 25 bp, Mus musculus
ttcggcttcccagagaagggcttga

SEQ ID NO: 335670 - DNA, 25 bp, Mus musculus
catctctcccgggttgggttcggct

SEQ ID NO: 335671 - DNA, 25 bp, Mus musculus
ctttaaacgagcctgggcgtcctca

SEQ ID NO: 335672 - DNA, 25 bp, Mus musculus
ttgccgaagaaacccgaagccctca

SEQ ID NO: 335673 - DNA, 25 bp, Mus musculus
gtctgctccgaccacaggggcagta

SEQ ID NO: 335674 - DNA, 25 bp, Mus musculus
tcggtcgctcctgggtctgctccga

SEQ ID NO: 335675 - DNA, 25 bp, Mus musculus
tcgccttgctgtttgcccagcggtc

SEQ ID NO: 335676 - DNA, 25 bp, Mus musculus
gggtcgcccactcgccttgctgttt

SEQ ID NO: 335677 - DNA, 25 bp, Mus musculus
cgcggataactaagctgccctcttc

SEQ ID NO: 335678 - DNA, 25 bp, Mus musculus
agccgctaagccaggccctctagga

SEQ ID NO: 335679 - DNA, 25 bp, Mus musculus
cacaggggcagtaaccttgaggtta

SEQ ID NO: 335680 - DNA, 25 bp, Mus musculus
ctgtccttgtcaggacgcgccgggt

SEQ ID NO: 335681 - DNA, 25 bp, Mus musculus
cccagagaccgtgtgcagactgtgc

SEQ ID NO: 335682 - DNA, 25 bp, Mus musculus
tggccaagcgcaactgcatccatca

SEQ ID NO: 335683 - DNA, 25 bp, Mus musculus
ccttcgtggccaagcgcaactgcat

SEQ ID NO: 335684 - DNA, 25 bp, Mus musculus
atgcaacgctcccttcgtggccaag

SEQ ID NO: 335685 - DNA, 25 bp, Mus musculus
ttcgagtgcaaggaatgcaacgctc

SEQ ID NO: 335686 - DNA, 25 bp, Mus musculus
aggccggaaacccttcgagtgcaag

SEQ ID NO: 335687 - DNA, 25 bp, Mus musculus
ggcggctgccacaaaggccggaaac

SEQ ID NO: 335688 - DNA, 25 bp, Mus musculus
tgcggggaggatctgaagcactacc

SEQ ID NO: 335689 - DNA, 25 bp, Mus musculus
aagcagcacctgcacgtgcccgaga

SEQ ID NO: 335690 - DNA, 25 bp, Mus musculus
gaagcactaccgagctctacgcatc

SEQ ID NO: 335691 - DNA, 25 bp, Mus musculus
aggacatcgagagctacgtgcttgc

SEQ ID NO: 335692 - DNA, 25 bp, Mus musculus
agctacgtgcttgccaccaacagtg

SEQ ID NO: 335693 - DNA, 25 bp, Mus musculus
tgcacgtgcccgagaaggacatcga

SEQ ID NO: 335694 - DNA, 25 bp, Mus musculus
ccaccgcagagctggtggacgcctt

SEQ ID NO: 335695 - DNA, 25 bp, Mus musculus
agaatctacagtgggcgaatgaatg

SEQ ID NO: 335696 - DNA, 25 bp, Mus musculus
ggccatactctacggtagcggctga

SEQ ID NO: 335697 - DNA, 25 bp, Mus musculus
tactctacggtagcggctgacaagc

SEQ ID NO: 335698 - DNA, 25 bp, Mus musculus
ggacggatttggacaccgagcctcg

SEQ ID NO: 335699 - DNA, 25 bp, Mus musculus
cacacagaccgcgatgggcgagcga

SEQ ID NO: 335700 - DNA, 25 bp, Mus musculus
cgcgccgaggagaagaatctacagt

SEQ ID NO: 335701 - DNA, 25 bp, Mus musculus
ccggcgtgtggctagcgacacgtca

SEQ ID NO: 335702 - DNA, 25 bp, Mus musculus
tagcgacacgtcagcgcagagcttg

SEQ ID NO: 335703 - DNA, 25 bp, Mus musculus
aggagtctcatggtacggccggtca

SEQ ID NO: 335704 - DNA, 25 bp, Mus musculus
gtccgctagggctctcggaggctct

SEQ ID NO: 335705 - DNA, 25 bp, Mus musculus
gctctggcggtaatggcgttactct

SEQ ID NO: 335706 - DNA, 25 bp, Mus musculus
gcgttactcttcatccgggccgcgg

SEQ ID NO: 335707 - DNA, 25 bp, Mus musculus
gtcgacgtggcctctaagcgcccag

SEQ ID NO: 335708 - DNA, 25 bp, Mus musculus
gcgaacacgatccacgcgccgagga

SEQ ID NO: 335709 - DNA, 25 bp, Mus musculus
gctcgctcactcaccgcgtctcctc

SEQ ID NO: 335710 - DNA, 25 bp, Mus musculus
ctgctcctcacgtcagccggaggta

SEQ ID NO: 335711 - DNA, 25 bp, Mus musculus
acgtcagccggaggtacaaggtgct

SEQ ID NO: 335712 - DNA, 25 bp, Mus musculus
acaaggtgctggacagaggaaacgc

SEQ ID NO: 335713 - DNA, 25 bp, Mus musculus
gctggacagaggaaacgcgcccacc

SEQ ID NO: 335714 - DNA, 25 bp, Mus musculus
caccacagctcaggccgcgctgccg

SEQ ID NO: 335715 - DNA, 25 bp, Mus musculus
cccaccattatgctgcgctccgtcg

SEQ ID NO: 335716 - DNA, 25 bp, Mus musculus
ccgctcctaccttccctcgacctgt

SEQ ID NO: 335717 - DNA, 25 bp, Mus musculus
gggcaaagttggcatcccccaacca

SEQ ID NO: 335718 - DNA, 25 bp, Mus musculus
aaccaagaggcggttcacacggtgc

SEQ ID NO: 335719 - DNA, 25 bp, Mus musculus
tcgcggcctcctcggagttcattgt

SEQ ID NO: 335720 - DNA, 25 bp, Mus musculus
tcctcggagttcattgtgtgcgctt

SEQ ID NO: 335721 - DNA, 25 bp, Mus musculus
cattgtgtgcgcttgagtgtttccc

SEQ ID NO: 335722 - DNA, 25 bp, Mus musculus
gcggcggcttccaccacagaaaaaa

SEQ ID NO: 335723 - DNA, 25 bp, Mus musculus
cccgggcaatttgacgacgcggatt

SEQ ID NO: 335724 - DNA, 25 bp, Mus musculus
tccgcgggagggagaacaccttcca

SEQ ID NO: 335725 - DNA, 25 bp, Mus musculus
actgcagtctggacaggatggcttc

SEQ ID NO: 335726 - DNA, 25 bp, Mus musculus
acgacgcggattcctcagacaggta

SEQ ID NO: 335727 - DNA, 25 bp, Mus musculus
ggctgacttcctatgaccgtaaacg

SEQ ID NO: 335728 - DNA, 25 bp, Mus musculus
ccgtaaacgccatggtggagcaaga

SEQ ID NO: 335729 - DNA, 25 bp, Mus musculus
ggggagcaacaagagctacacatcc

SEQ ID NO: 335730 - DNA, 25 bp, Mus musculus
acgcaagtcttcaggagcagccgga

SEQ ID NO: 335731 - DNA, 25 bp, Mus musculus
atcgcggattggtctttcccggcca

SEQ ID NO: 335732 - DNA, 25 bp, Mus musculus
tggtggcatacttccggcgttgcac

SEQ ID NO: 335733 - DNA, 25 bp, Mus musculus
cgtttgccgaaaccctgtatcctga

SEQ ID NO: 335734 - DNA, 25 bp, Mus musculus
ctctaggtgggaagcaggctcttcc

SEQ ID NO: 335735 - DNA, 25 bp, Mus musculus
gagacgcgtttggatcctctaggtg

SEQ ID NO: 335736 - DNA, 25 bp, Mus musculus
acgcccacttcacatcgcggattgg

SEQ ID NO: 335737 - DNA, 25 bp, Mus musculus
cggatcaacacgctgggtcgcatga

SEQ ID NO: 335738 - DNA, 25 bp, Mus musculus
gacctgcgctacgagatgacctaca

SEQ ID NO: 335739 - DNA, 25 bp, Mus musculus
gggcaccagcaggacgttctactcc

SEQ ID NO: 335740 - DNA, 25 bp, Mus musculus
ggcgctgcaccgtcaacgaccagaa

SEQ ID NO: 335741 - DNA, 25 bp, Mus musculus
cgacggctactggtgggtatcagcc

SEQ ID NO: 335742 - DNA, 25 bp, Mus musculus
cacctagctcagtcccaaatcttgg

SEQ ID NO: 335743 - DNA, 25 bp, Mus musculus
aggtctaggccgaggaaagtgcttt

SEQ ID NO: 335744 - DNA, 25 bp, Mus musculus
cagacatgagctgcaacggcggctc

SEQ ID NO: 335745 - DNA, 25 bp, Mus musculus
caaatcttgggtcaggtagtggccc

SEQ ID NO: 335746 - DNA, 25 bp, Mus musculus
cggctctcttgagtgaccgcagaca

SEQ ID NO: 335747 - DNA, 25 bp, Mus musculus
ctctgctcaggcttcggtggcgcag

SEQ ID NO: 335748 - DNA, 25 bp, Mus musculus
gagtccctcgcgtgctccgaggcga

SEQ ID NO: 335749 - DNA, 25 bp, Mus musculus
tccgacggggatccagtcgccaggt

SEQ ID NO: 335750 - DNA, 25 bp, Mus musculus
caggaacgggtgtccctacgcccag

SEQ ID NO: 335751 - DNA, 25 bp, Mus musculus
cagtgttcacttttctctatcttaa

SEQ ID NO: 335752 - DNA, 25 bp, Mus musculus
gctcttcccgataggctggcgccat

SEQ ID NO: 335753 - DNA, 25 bp, Mus musculus
gcctcttcctgcctgaggtgagctg

SEQ ID NO: 335754 - DNA, 25 bp, Mus musculus
gctgccatcatggagaccgaacctc

SEQ ID NO: 335755 - DNA, 25 bp, Mus musculus
ctcctcctctggaagagcggcgtcg

SEQ ID NO: 335756 - DNA, 25 bp, Mus musculus
gatggagcctggatcagctggaccc

SEQ ID NO: 335757 - DNA, 25 bp, Mus musculus
ccgctgacttctcgccgtgggaaag

SEQ ID NO: 335758 - DNA, 25 bp, Mus musculus
ctctccatcccggtgcgatgcaggg

SEQ ID NO: 335759 - DNA, 25 bp, Mus musculus
ctgaggttggcgatttgcttcgtca

SEQ ID NO: 335760 - DNA, 25 bp, Mus musculus
cttcgtcatgatataaggattctgc

SEQ ID NO: 335761 - DNA, 25 bp, Mus musculus
gcattgcgttagattcagtgttcac

SEQ ID NO: 335762 - DNA, 25 bp, Mus musculus
gcttcccactcggacaggaccgatt

SEQ ID NO: 335763 - DNA, 25 bp, Mus musculus
caggaccgattgtgggacgattaaa

SEQ ID NO: 335764 - DNA, 25 bp, Mus musculus
tctctatcttaaacccggacgcttc

SEQ ID NO: 335765 - DNA, 25 bp, Mus musculus
tgctggatctctacaacgccctgtc

SEQ ID NO: 335766 - DNA, 25 bp, Mus musculus
ggcggctgaagtccgctccactctt

SEQ ID NO: 335767 - DNA, 25 bp, Mus musculus
cgggagatgcaaaaggagatcctgt

SEQ ID NO: 335768 - DNA, 25 bp, Mus musculus
ggcggctcaagacccacgagaagcg

SEQ ID NO: 335769 - DNA, 25 bp, Mus musculus
ggcttcctctatcggcggctcaaga

SEQ ID NO: 335770 - DNA, 25 bp, Mus musculus
agtcctcttcttcgggcttcctcta

SEQ ID NO: 335771 - DNA, 25 bp, Mus musculus
ccatgagagataaggactgagtgcc

SEQ ID NO: 335772 - DNA, 25 bp, Mus musculus
cgccgcggatgaccatgagagataa

SEQ ID NO: 335773 - DNA, 25 bp, Mus musculus
cgcctccagagacctgcgggagagt

SEQ ID NO: 335774 - DNA, 25 bp, Mus musculus
cacgtgtgcagactgcgagtgaccg

SEQ ID NO: 335775 - DNA, 25 bp, Mus musculus
cacgactgtcctacaagccaggaga

SEQ ID NO: 335776 - DNA, 25 bp, Mus musculus
acgccctgtccaatgacgacgaaga

SEQ ID NO: 335777 - DNA, 25 bp, Mus musculus
caggggagtaaacttcacgactgtc

SEQ ID NO: 335778 - DNA, 25 bp, Mus musculus
tttttaggacgcagggacgccacag

SEQ ID NO: 335779 - DNA, 25 bp, Mus musculus
tggtcaggtcctgcagcgggtttcc

SEQ ID NO: 335780 - DNA, 25 bp, Mus musculus
cccaggtcaggccagtctgagccag

SEQ ID NO: 335781 - DNA, 25 bp, Mus musculus
atctgtcttcagcttctccgtgcta

SEQ ID NO: 335782 - DNA, 25 bp, Mus musculus
ccgagacgcaggaggtcgccgacca

SEQ ID NO: 335783 - DNA, 25 bp, Mus musculus
tgtggcgcgccatctgccacaatgc

SEQ ID NO: 335784 - DNA, 25 bp, Mus musculus
tctcctagttggatctgtcttcagc

SEQ ID NO: 335785 - DNA, 25 bp, Mus musculus
tcgctctgtcacgtgctacgggtcc

SEQ ID NO: 335786 - DNA, 25 bp, Mus musculus
gcggagccaagccaggtttttctag

SEQ ID NO: 335787 - DNA, 25 bp, Mus musculus
gccaggtttttctagggtccaggca

SEQ ID NO: 335788 - DNA, 25 bp, Mus musculus
tttctagggtccaggcacccaggtc

SEQ ID NO: 335789 - DNA, 25 bp, Mus musculus
caggcacccaggtctcctagttgga

SEQ ID NO: 335790 - DNA, 25 bp, Mus musculus
ccaagatgatgtgtggcgcgccatc

SEQ ID NO: 335791 - DNA, 25 bp, Mus musculus
ctgcccagactggtcaggtcctgca

SEQ ID NO: 335792 - DNA, 25 bp, Mus musculus
cccgactactgctgccaagatgatg

SEQ ID NO: 335793 - DNA, 25 bp, Mus musculus
atgcctggactccagcagtgtggcg

SEQ ID NO: 335794 - DNA, 25 bp, Mus musculus
cggcctgctggagctgcagttacca

SEQ ID NO: 335795 - DNA, 25 bp, Mus musculus
agctgcagttaccagggcgcgaaga

SEQ ID NO: 335796 - DNA, 25 bp, Mus musculus
ttaccagggcgcgaagaacatgacg

SEQ ID NO: 335797 - DNA, 25 bp, Mus musculus
cagggcgcgaagaacatgacgaagt

SEQ ID NO: 335798 - DNA, 25 bp, Mus musculus
aacatgacgaagtgcgcggcgctct

SEQ ID NO: 335799 - DNA, 25 bp, Mus musculus
aagtgcgcggcgctctggatcccgt

SEQ ID NO: 335800 - DNA, 25 bp, Mus musculus
ctctggatcccgtgcgtgaacatgt

SEQ ID NO: 335801 - DNA, 25 bp, Mus musculus
tgcgtgaacatgtcggccgtataca

SEQ ID NO: 335802 - DNA, 25 bp, Mus musculus
catgtcggccgtatacaggtgcttg

SEQ ID NO: 335803 - DNA, 25 bp, Mus musculus
tcggccgtatacaggtgcttggcgt

SEQ ID NO: 335804 - DNA, 25 bp, Mus musculus
cgaccgcagagccacgcctcaatca

SEQ ID NO: 335805 - DNA, 25 bp, Mus musculus
ggcccgcccttcctagctcgcaggc

SEQ ID NO: 335806 - DNA, 25 bp, Mus musculus
cccggtcccagatcgggctccgccg

SEQ ID NO: 335807 - DNA, 25 bp, Mus musculus
ccatgctggatgagggcagatgatc

SEQ ID NO: 335808 - DNA, 25 bp, Mus musculus
gtccacggcgcaggcacggaccttt

SEQ ID NO: 335809 - DNA, 25 bp, Mus musculus
actcactatggttggagcaaggcgc

SEQ ID NO: 335810 - DNA, 25 bp, Mus musculus
cggacctttagggagagagacgctc

SEQ ID NO: 335811 - DNA, 25 bp, Mus musculus
gccggtaggaactaaactcactatg

SEQ ID NO: 335812 - DNA, 25 bp, Mus musculus
tcggttatcccatcctacgccggta

SEQ ID NO: 335813 - DNA, 25 bp, Mus musculus
tctgcgtatgggaggtgtttgaaaa

SEQ ID NO: 335814 - DNA, 25 bp, Mus musculus
tacgtcatcacagggcgtcggagtc

SEQ ID NO: 335815 - DNA, 25 bp, Mus musculus
tgcgagctgggacctttcgtctcga

SEQ ID NO: 335816 - DNA, 25 bp, Mus musculus
gacgctctggtgttacgtcatcaca

SEQ ID NO: 335817 - DNA, 25 bp, Mus musculus
ctccactccgtacccttgataatga

SEQ ID NO: 335818 - DNA, 25 bp, Mus musculus
ttcgcccattgcacgtaactgggtc

SEQ ID NO: 335819 - DNA, 25 bp, Mus musculus
ccttgataatgaggtgcgccgcacc

SEQ ID NO: 335820 - DNA, 25 bp, Mus musculus
tcgcacgctacaggggtctcggtgc

SEQ ID NO: 335821 - DNA, 25 bp, Mus musculus
aacggccgcctacagggatctgaac

SEQ ID NO: 335822 - DNA, 25 bp, Mus musculus
aggcctccgcgaactggctttctgc

SEQ ID NO: 335823 - DNA, 25 bp, Mus musculus
acggtgacatttgcctggaggtcca

SEQ ID NO: 335824 - DNA, 25 bp, Mus musculus
ctggaggtccagaccgagccacgcg

SEQ ID NO: 335825 - DNA, 25 bp, Mus musculus
gggagcggagtccattccgatgccc

SEQ ID NO: 335826 - DNA, 25 bp, Mus musculus
gcctgcacagctaggaccttgattg

SEQ ID NO: 335827 - DNA, 25 bp, Mus musculus
atgaaaggaccaggcacggctaacg

SEQ ID NO: 335828 - DNA, 25 bp, Mus musculus
ctggaaaggcggtcgctgaatgaaa

SEQ ID NO: 335829 - DNA, 25 bp, Mus musculus
ggcttccaggaatctgtaccgctcg

SEQ ID NO: 335830 - DNA, 25 bp, Mus musculus
tgagcagggtcctattccgtgttcc

SEQ ID NO: 335831 - DNA, 25 bp, Mus musculus
tcgccagaatgagcagggtcctatt

SEQ ID NO: 335832 - DNA, 25 bp, Mus musculus
ccttgattgagcaggaagtccggcc

SEQ ID NO: 335833 - DNA, 25 bp, Mus musculus
acagatgtctcccacgattggctgg

SEQ ID NO: 335834 - DNA, 25 bp, Mus musculus
ctcgccctgagcactgtacttattc

SEQ ID NO: 335835 - DNA, 25 bp, Mus musculus
tgccaaggtttagagtgctcgagcc

SEQ ID NO: 335836 - DNA, 25 bp, Mus musculus
gaaggtcttcacacgccggaccctg

SEQ ID NO: 335837 - DNA, 25 bp, Mus musculus
ttctcaggccaacagggaacgatgc

SEQ ID NO: 335838 - DNA, 25 bp, Mus musculus
agggaacgatgctcttcccggaagc

SEQ ID NO: 335839 - DNA, 25 bp, Mus musculus
ccttctctgttgacacggtgtggga

SEQ ID NO: 335840 - DNA, 25 bp, Mus musculus
tgtgggagcccacccgagttctgcc

SEQ ID NO: 335841 - DNA, 25 bp, Mus musculus
gagttctgcctgacgacgcctggcc

SEQ ID NO: 335842 - DNA, 25 bp, Mus musculus
ttccgcctaggcgtctctgtgcgcg

SEQ ID NO: 335843 - DNA, 25 bp, Mus musculus
tcctgcgtgctctgagcaagggtcc

SEQ ID NO: 335844 - DNA, 25 bp, Mus musculus
caagggtcctgtccatctcgtggct

SEQ ID NO: 335845 - DNA, 25 bp, Mus musculus
atctcgtggcttctgcgacccagtt

SEQ ID NO: 335846 - DNA, 25 bp, Mus musculus
tgcgacccagttgacttcacatccg

SEQ ID NO: 335847 - DNA, 25 bp, Mus musculus
cgtgtgaaggatgccaaggtttaga

SEQ ID NO: 335848 - DNA, 25 bp, Mus musculus
ttcacatccgcgatcgtgagccggg

SEQ ID NO: 335849 - DNA, 25 bp, Mus musculus
ctcggagactccgtaatgacccggg

SEQ ID NO: 335850 - DNA, 25 bp, Mus musculus
tgcgccctgaccctttgtgatggcg

SEQ ID NO: 335851 - DNA, 25 bp, Mus musculus
acgtctgggagctgattactggtgc

SEQ ID NO: 335852 - DNA, 25 bp, Mus musculus
tgattactggtgctctgaaagcctc

SEQ ID NO: 335853 - DNA, 25 bp, Mus musculus
tggtgctctgaaagcctcgccattc

SEQ ID NO: 335854 - DNA, 25 bp, Mus musculus
cgcacggtgggtaagtcctttatcg

SEQ ID NO: 335855 - DNA, 25 bp, Mus musculus
ctgaccctttgtgatggcgccgata

SEQ ID NO: 335856 - DNA, 25 bp, Mus musculus
gcccgcagccatccgttgcccgaag

SEQ ID NO: 335857 - DNA, 25 bp, Mus musculus
atccgttgcccgaaggcgcgcgctg

SEQ ID NO: 335858 - DNA, 25 bp, Mus musculus
ggagctgctcggagactccgtaatg

SEQ ID NO: 335859 - DNA, 25 bp, Mus musculus
atgacccgggttcgccgcagctgcg

SEQ ID NO: 335860 - DNA, 25 bp, Mus musculus
cagctgcgccctgaccctttgtgat

SEQ ID NO: 335861 - DNA, 25 bp, Mus musculus
accctttgtgatggcgccgatagcg

SEQ ID NO: 335862 - DNA, 25 bp, Mus musculus
gtaatgacccgggttcgccgcagct

SEQ ID NO: 335863 - DNA, 25 bp, Mus musculus
aagcatatgtttggcctggggcgac

SEQ ID NO: 335864 - DNA, 25 bp, Mus musculus
cacgcagggtgttttgttaaacgct

SEQ ID NO: 335865 - DNA, 25 bp, Mus musculus
ttgttaaacgctcccgtcgttcgca

SEQ ID NO: 335866 - DNA, 25 bp, Mus musculus
cggcagaacacgcagggtgttttgt

SEQ ID NO: 335867 - DNA, 25 bp, Mus musculus
ccggctgagcttagagaatgggaac

SEQ ID NO: 335868 - DNA, 25 bp, Mus musculus
gcgcagagaatccatggacactcga

SEQ ID NO: 335869 - DNA, 25 bp, Mus musculus
ttagcgcgctggaaagaagcatatg

SEQ ID NO: 335870 - DNA, 25 bp, Mus musculus
agcgagggacaaagcgcagagaatc

SEQ ID NO: 335871 - DNA, 25 bp, Mus musculus
cgttcgcacgggctgcgacttgata

SEQ ID NO: 335872 - DNA, 25 bp, Mus musculus
ctccacgctgaaggtggattagcgc

SEQ ID NO: 335873 - DNA, 25 bp, Mus musculus
gatttgattgaaatggcgtgtgcca

SEQ ID NO: 335874 - DNA, 25 bp, Mus musculus
cttgataaaaggagacagttttctg

SEQ ID NO: 335875 - DNA, 25 bp, Mus musculus
cacgggctgcgacttgataaaagga

SEQ ID NO: 335876 - DNA, 25 bp, Mus musculus
ggacactcgagcaattacgcctcca

SEQ ID NO: 335877 - DNA, 25 bp, Mus musculus
ggtcaggttcgctgctagcctctct

SEQ ID NO: 335878 - DNA, 25 bp, Mus musculus
aacctcggtctctcgcagcagggag

SEQ ID NO: 335879 - DNA, 25 bp, Mus musculus
accgcactggggctcggttagtccg

SEQ ID NO: 335880 - DNA, 25 bp, Mus musculus
ccggcttctgggtgcaagcgcagct

SEQ ID NO: 335881 - DNA, 25 bp, Mus musculus
aggttcgctcgtgcctcggagccgc

SEQ ID NO: 335882 - DNA, 25 bp, Mus musculus
gcgactgtcctcaggttcgctcgtg

SEQ ID NO: 335883 - DNA, 25 bp, Mus musculus
agttcggagacagcgactgtcctca

SEQ ID NO: 335884 - DNA, 25 bp, Mus musculus
tctcgcagcagggagttcggagaca

SEQ ID NO: 335885 - DNA, 25 bp, Mus musculus
gctgcagccgacttggcccgcggtt

SEQ ID NO: 335886 - DNA, 25 bp, Mus musculus
agccgtgctccaggtggctgtccca

SEQ ID NO: 335887 - DNA, 25 bp, Mus musculus
tagcgagcagcgcacgtccttacct

SEQ ID NO: 335888 - DNA, 25 bp, Mus musculus
ggttcgctgctagcctctctgcact

SEQ ID NO: 335889 - DNA, 25 bp, Mus musculus
cctctctgcactgcgcggtagcgag

SEQ ID NO: 335890 - DNA, 25 bp, Mus musculus
ggactgtccagtccgctctaccgaa

SEQ ID NO: 335891 - DNA, 25 bp, Mus musculus
cccagacgtagaaaactgcgcctgc

SEQ ID NO: 335892 - DNA, 25 bp, Mus musculus
accttgtacttcgaggtggagctga

SEQ ID NO: 335893 - DNA, 25 bp, Mus musculus
acaggcgacccggaactgaacagaa

SEQ ID NO: 335894 - DNA, 25 bp, Mus musculus
caccgaagaggttgtccttgttaat

SEQ ID NO: 335895 - DNA, 25 bp, Mus musculus
tccttgttaatagggatggcggaga

SEQ ID NO: 335896 - DNA, 25 bp, Mus musculus
acagcattgctgttggacttggaca

SEQ ID NO: 335897 - DNA, 25 bp, Mus musculus
cgagcgctgctcagctcaggaatcc

SEQ ID NO: 335898 - DNA, 25 bp, Mus musculus
gagaggcgccgctgtacttccgcca

SEQ ID NO: 335899 - DNA, 25 bp, Mus musculus
cgacgcgttaagacactcgggcggt

SEQ ID NO: 335900 - DNA, 25 bp, Mus musculus
actccgcccaggagcgacgcgttaa

SEQ ID NO: 335901 - DNA, 25 bp, Mus musculus
tcacgtcgcgcgtgcagtacagcta

SEQ ID NO: 335902 - DNA, 25 bp, Mus musculus
agaaagcggagttcccgagtgcgca

SEQ ID NO: 335903 - DNA, 25 bp, Mus musculus
gtacttccgccaccgtgaccttgta

SEQ ID NO: 335904 - DNA, 25 bp, Mus musculus
cctgcgtgctgcagaaagcggagtt

SEQ ID NO: 335905 - DNA, 25 bp, Mus musculus
tcccgttgctggtgccgtcgtgacg

SEQ ID NO: 335906 - DNA, 25 bp, Mus musculus
gcaaccgtgccgtcccgttgctggt

SEQ ID NO: 335907 - DNA, 25 bp, Mus musculus
ggagattgacctacagtgcccagct

SEQ ID NO: 335908 - DNA, 25 bp, Mus musculus
ctggtgtagggagattgacctacag

SEQ ID NO: 335909 - DNA, 25 bp, Mus musculus
gattcaggctgtaggggtcgttgac

SEQ ID NO: 335910 - DNA, 25 bp, Mus musculus
agattcctggctctgcctctgaccg

SEQ ID NO: 335911 - DNA, 25 bp, Mus musculus
gtaagagcccagattcctggctctg

SEQ ID NO: 335912 - DNA, 25 bp, Mus musculus
ctgcgagggtccaggcccgacagtt

SEQ ID NO: 335913 - DNA, 25 bp, Mus musculus
cgccgatagtccctgcgagggtcca

SEQ ID NO: 335914 - DNA, 25 bp, Mus musculus
aagaggtcctcgtgccgccgatagt

SEQ ID NO: 335915 - DNA, 25 bp, Mus musculus
gccgtgcaagaggtcctcgtgccgc

SEQ ID NO: 335916 - DNA, 25 bp, Mus musculus
taccgggacgtcctcgatggcgtga

SEQ ID NO: 335917 - DNA, 25 bp, Mus musculus
gcctcttaccgggacgtcctcgatg

SEQ ID NO: 335918 - DNA, 25 bp, Mus musculus
acgtgggagtaaggatcttgcgact

SEQ ID NO: 335919 - DNA, 25 bp, Mus musculus
ggcggcttcacttcagcttctaata

SEQ ID NO: 335920 - DNA, 25 bp, Mus musculus
agcttctaataaccgcgctgggcag

SEQ ID NO: 335921 - DNA, 25 bp, Mus musculus
gcgcgtgttccttaatccgtgtctc

SEQ ID NO: 335922 - DNA, 25 bp, Mus musculus
cattttaaaaggttgcagggcctgc

SEQ ID NO: 335923 - DNA, 25 bp, Mus musculus
aatgcctggaaatcgagcgtgaagc

SEQ ID NO: 335924 - DNA, 25 bp, Mus musculus
agccggctctcaatgcagtcattga

SEQ ID NO: 335925 - DNA, 25 bp, Mus musculus
gacgggagtctcagtgtagcaaatc

SEQ ID NO: 335926 - DNA, 25 bp, Mus musculus
gcggcgtctggcgaatcacagcaaa

SEQ ID NO: 335927 - DNA, 25 bp, Mus musculus
tcctggagcctcctaatagcagata

SEQ ID NO: 335928 - DNA, 25 bp, Mus musculus
gcagggcctgcaaaagtgaaagaga

SEQ ID NO: 335929 - DNA, 25 bp, Mus musculus
gcgaaggaggacaatcggacctaaa

SEQ ID NO: 335930 - DNA, 25 bp, Mus musculus
gacctaaaaggctagggcagacctc

SEQ ID NO: 335931 - DNA, 25 bp, Mus musculus
tgcccaccgagttctgcgcctggga

SEQ ID NO: 335932 - DNA, 25 bp, Mus musculus
cttccctaggacctcggagccgtga

SEQ ID NO: 335933 - DNA, 25 bp, Mus musculus
ctgctccgagcgctttaagcacgcg

SEQ ID NO: 335934 - DNA, 25 bp, Mus musculus
ctcggattctgctccgagcgcttta

SEQ ID NO: 335935 - DNA, 25 bp, Mus musculus
cacggacaacatggctctggatgga

SEQ ID NO: 335936 - DNA, 25 bp, Mus musculus
atggccgctctgttacccacgtagc

SEQ ID NO: 335937 - DNA, 25 bp, Mus musculus
gaacatggccgctctgttacccacg

SEQ ID NO: 335938 - DNA, 25 bp, Mus musculus
cgcaagtgagcagcccggcccggtt

SEQ ID NO: 335939 - DNA, 25 bp, Mus musculus
ctgcctgcgccaggatctgccctca

SEQ ID NO: 335940 - DNA, 25 bp, Mus musculus
gaaaaggccacgcagcgaacccgta

SEQ ID NO: 335941 - DNA, 25 bp, Mus musculus
gcccagcgctcaatagggacccaaa

SEQ ID NO: 335942 - DNA, 25 bp, Mus musculus
tcagcgcgcccagcgctcaataggg

SEQ ID NO: 335943 - DNA, 25 bp, Mus musculus
ctgctaacccgcgagtcccgcgcgg

SEQ ID NO: 335944 - DNA, 25 bp, Mus musculus
cgtagacccgcaagtgagcagcccg

SEQ ID NO: 335945 - DNA, 25 bp, Mus musculus
agcgaacccgtagacccgcaagtga

SEQ ID NO: 335946 - DNA, 25 bp, Mus musculus
tgaaggcggtgcctcacgcaggccc

SEQ ID NO: 335947 - DNA, 25 bp, Mus musculus
gggtgttaagtttgtcccactcgca

SEQ ID NO: 335948 - DNA, 25 bp, Mus musculus
gtttgtcccactcgcatttcgcgtg

SEQ ID NO: 335949 - DNA, 25 bp, Mus musculus
ctcgcatttcgcgtggagagaagga

SEQ ID NO: 335950 - DNA, 25 bp, Mus musculus
ctgcgcgggtgttaagtttgtccca

SEQ ID NO: 335951 - DNA, 25 bp, Mus musculus
agggagggtcgatctccaagcctgt

SEQ ID NO: 335952 - DNA, 25 bp, Mus musculus
gatattatccgtcagtttccaaagc

SEQ ID NO: 335953 - DNA, 25 bp, Mus musculus
ccgcaaggatgactgagtcggcgcc

SEQ ID NO: 335954 - DNA, 25 bp, Mus musculus
gcgcttacctcgcagtcttcgtact

SEQ ID NO: 335955 - DNA, 25 bp, Mus musculus
ctcgcagtcttcgtacttgatatta

SEQ ID NO: 335956 - DNA, 25 bp, Mus musculus
gtcttcgtacttgatattatccgtc

SEQ ID NO: 335957 - DNA, 25 bp, Mus musculus
cgtcagtttccaaagcattttcatg

SEQ ID NO: 335958 - DNA, 25 bp, Mus musculus
tggatcggcgtgatcggatttgccc

SEQ ID NO: 335959 - DNA, 25 bp, Mus musculus
tactctctgggttagcgcaaagtgc

SEQ ID NO: 335960 - DNA, 25 bp, Mus musculus
agcattttcatggatcggcgtgatc

SEQ ID NO: 335961 - DNA, 25 bp, Mus musculus
ggtttgtccagtcttccctctcttg

SEQ ID NO: 335962 - DNA, 25 bp, Mus musculus
gccggactctttcccggattctggc

SEQ ID NO: 335963 - DNA, 25 bp, Mus musculus
cagctccgaggctgttgcctgcgct

SEQ ID NO: 335964 - DNA, 25 bp, Mus musculus
gttgcctgcgctggtttgtccagtc

SEQ ID NO: 335965 - DNA, 25 bp, Mus musculus
cctgcgctggtttgtccagtcttcc

SEQ ID NO: 335966 - DNA, 25 bp, Mus musculus
gtccagtcttccctctcttgggagc

SEQ ID NO: 335967 - DNA, 25 bp, Mus musculus
cactcttgggcgctgccaggcgtgc

SEQ ID NO: 335968 - DNA, 25 bp, Mus musculus
tgccaggcgtgcctcaccgaggact

SEQ ID NO: 335969 - DNA, 25 bp, Mus musculus
tgccctgggccacggtacttcttct

SEQ ID NO: 335970 - DNA, 25 bp, Mus musculus
cccattttggcaagtatggacatcg

SEQ ID NO: 335971 - DNA, 25 bp, Mus musculus
ttggcaagtatggacatcgcggctc

SEQ ID NO: 335972 - DNA, 25 bp, Mus musculus
aagtatggacatcgcggctcggcgc

SEQ ID NO: 335973 - DNA, 25 bp, Mus musculus
acctgtggcgcctgagccggactct

SEQ ID NO: 335974 - DNA, 25 bp, Mus musculus
ccctctcttgggagcactcttgggc

SEQ ID NO: 335975 - DNA, 25 bp, Mus musculus
aagctgcaggaggaaaacgggtgca

SEQ ID NO: 335976 - DNA, 25 bp, Mus musculus
tggcaggcccgggctcgcaatccag

SEQ ID NO: 335977 - DNA, 25 bp, Mus musculus
tcgcaatccagcgaggggacactgc

SEQ ID NO: 335978 - DNA, 25 bp, Mus musculus
atccagcgaggggacactgccaact

SEQ ID NO: 335979 - DNA, 25 bp, Mus musculus
cgaggggacactgccaactccgggt

SEQ ID NO: 335980 - DNA, 25 bp, Mus musculus
ccaactccgggtcccgcgagccctg

SEQ ID NO: 335981 - DNA, 25 bp, Mus musculus
cccgggccgaccctaatctgctctc

SEQ ID NO: 335982 - DNA, 25 bp, Mus musculus
ctaatctgctctctctcggcacgaa

SEQ ID NO: 335983 - DNA, 25 bp, Mus musculus
tctgctctctctcggcacgaaaaca

SEQ ID NO: 335984 - DNA, 25 bp, Mus musculus
tctctctcggcacgaaaacaaaacc

SEQ ID NO: 335985 - DNA, 25 bp, Mus musculus
caaaaccctttgcttgtgatccgag

SEQ ID NO: 335986 - DNA, 25 bp, Mus musculus
ccctttgcttgtgatccgagccatg

SEQ ID NO: 335987 - DNA, 25 bp, Mus musculus
cttgcctgcaggcgggacacggact

SEQ ID NO: 335988 - DNA, 25 bp, Mus musculus
cttgtgatccgagccatggggaagc

SEQ ID NO: 335989 - DNA, 25 bp, Mus musculus
agcaggtcctgtttgggttcacggt

SEQ ID NO: 335990 - DNA, 25 bp, Mus musculus
ttgcccggcacgagtgctgcggaat

SEQ ID NO: 335991 - DNA, 25 bp, Mus musculus
cggagcgcgtcctccgttattgcca

SEQ ID NO: 335992 - DNA, 25 bp, Mus musculus
gcgtcctccgttattgccatttgca

SEQ ID NO: 335993 - DNA, 25 bp, Mus musculus
cgttattgccatttgcaggcgccta

SEQ ID NO: 335994 - DNA, 25 bp, Mus musculus
atttgcaggcgcctaaaaggtgccc

SEQ ID NO: 335995 - DNA, 25 bp, Mus musculus
cccgggcggtgacgtataactcgcg

SEQ ID NO: 335996 - DNA, 25 bp, Mus musculus
tgacgtataactcgcgcgccggctg

SEQ ID NO: 335997 - DNA, 25 bp, Mus musculus
ggcccgcgaagagtggccatcagga

SEQ ID NO: 335998 - DNA, 25 bp, Mus musculus
tctcttgcccggcacgagtgctgcg

SEQ ID NO: 335999 - DNA, 25 bp, Mus musculus
aatggagctggtcgccggcagctac

SEQ ID NO: 336000 - DNA, 25 bp, Mus musculus
cggcagctacgagcaggtcctgttt

SEQ ID NO: 336001 - DNA, 25 bp, Mus musculus
cctgtttgggttcacggtacagcgc

SEQ ID NO: 336002 - DNA, 25 bp, Mus musculus
agcctccgcagccatcgggtctcca

SEQ ID NO: 336003 - DNA, 25 bp, Mus musculus
atgttctctaactgcggttccggga

SEQ ID NO: 336004 - DNA, 25 bp, Mus musculus
tcactttgtagggttgtagcgcgtc

SEQ ID NO: 336005 - DNA, 25 bp, Mus musculus
ctccagtgttggttgggtgtgttct

SEQ ID NO: 336006 - DNA, 25 bp, Mus musculus
cagcgcacgctgtgacgtctgcaca

SEQ ID NO: 336007 - DNA, 25 bp, Mus musculus
ttgtagcgcgtctaagtgcagttgc

SEQ ID NO: 336008 - DNA, 25 bp, Mus musculus
aagtgcagttgcgactagggttccg

SEQ ID NO: 336009 - DNA, 25 bp, Mus musculus
tccgtaagagagcaggagtcacttt

SEQ ID NO: 336010 - DNA, 25 bp, Mus musculus
agtggaaacctaaacgcgcgtgcgc

SEQ ID NO: 336011 - DNA, 25 bp, Mus musculus
tcccgcctctctaaaatgttctcta

SEQ ID NO: 336012 - DNA, 25 bp, Mus musculus
cgtgcacactctgctgagctcgctt

SEQ ID NO: 336013 - DNA, 25 bp, Mus musculus
caggggaatcgttccgtgcacactc

SEQ ID NO: 336014 - DNA, 25 bp, Mus musculus
tgccgactctatcaccaggggaatc

SEQ ID NO: 336015 - DNA, 25 bp, Mus musculus
gtgtgttcttactttgccgactcta

SEQ ID NO: 336016 - DNA, 25 bp, Mus musculus
tgcttccgcgccacggagggctttt

SEQ ID NO: 336017 - DNA, 25 bp, Mus musculus
cgcccaccatcgttagcctcgcttt

SEQ ID NO: 336018 - DNA, 25 bp, Mus musculus
agcgccgtgtgtgtttcgtatccta

SEQ ID NO: 336019 - DNA, 25 bp, Mus musculus
gcccgctcacgccacgcccatggag

SEQ ID NO: 336020 - DNA, 25 bp, Mus musculus
ccggcttcgaagctcaggtcgggct

SEQ ID NO: 336021 - DNA, 25 bp, Mus musculus
caggcccttgcccacgtccactcat

SEQ ID NO: 336022 - DNA, 25 bp, Mus musculus
cgcctcctggaggagagtagccctg

SEQ ID NO: 336023 - DNA, 25 bp, Mus musculus
taggaaacggccagggcgcgccacc

SEQ ID NO: 336024 - DNA, 25 bp, Mus musculus
atgcccgccggcttcgaagctcagg

SEQ ID NO: 336025 - DNA, 25 bp, Mus musculus
tgtttcgtatcctaggaaacggcca

SEQ ID NO: 336026 - DNA, 25 bp, Mus musculus
gggtcccgcagcctactcgggatta

SEQ ID NO: 336027 - DNA, 25 bp, Mus musculus
gcttacctcgatcgctcccttgtga

SEQ ID NO: 336028 - DNA, 25 bp, Mus musculus
gatcgctcccttgtgaagctccagc

SEQ ID NO: 336029 - DNA, 25 bp, Mus musculus
cccttgtgaagctccagcgccgtgt

SEQ ID NO: 336030 - DNA, 25 bp, Mus musculus
gtctgggtaccgaggccacatgccc

SEQ ID NO: 336031 - DNA, 25 bp, Mus musculus
cgccgcccgcgctagtcactcgccc

SEQ ID NO: 336032 - DNA, 25 bp, Mus musculus
tgggatcgctgcctgcccaggaacc

SEQ ID NO: 336033 - DNA, 25 bp, Mus musculus
ggatcgctgcctgcccaggaaccgg

SEQ ID NO: 336034 - DNA, 25 bp, Mus musculus
ggaaccggctggctccctgcgagct

SEQ ID NO: 336035 - DNA, 25 bp, Mus musculus
cacagtcttcgcctttgtgcccagg

SEQ ID NO: 336036 - DNA, 25 bp, Mus musculus
agtcttcgcctttgtgcccaggcgc

SEQ ID NO: 336037 - DNA, 25 bp, Mus musculus
ccgcgatgcgctgtccagggtagcc

SEQ ID NO: 336038 - DNA, 25 bp, Mus musculus
gctgtccagggtagccgccttcctt

SEQ ID NO: 336039 - DNA, 25 bp, Mus musculus
cgccttccttctgcgccgcgccacg

SEQ ID NO: 336040 - DNA, 25 bp, Mus musculus
cagggtgtctcaccgtggcccaggc

SEQ ID NO: 336041 - DNA, 25 bp, Mus musculus
cagcagcacacagtcttcgcctttg

SEQ ID NO: 336042 - DNA, 25 bp, Mus musculus
gacagggtgtctcaccgtggcccag

SEQ ID NO: 336043 - DNA, 25 bp, Mus musculus
tccctcagggctgggatcgctgcct

SEQ ID NO: 336044 - DNA, 25 bp, Mus musculus
ctcagctccctcagggctgggatcg

SEQ ID NO: 336045 - DNA, 25 bp, Mus musculus
gaccgcggccacttatgctgctgct

SEQ ID NO: 336046 - DNA, 25 bp, Mus musculus
cgaagaggtccctggccaattcagc

SEQ ID NO: 336047 - DNA, 25 bp, Mus musculus
cccggctgctgcaggtaatccgcag

SEQ ID NO: 336048 - DNA, 25 bp, Mus musculus
tccaacggctgctactcgggtcgct

SEQ ID NO: 336049 - DNA, 25 bp, Mus musculus
ccaggatgttctaggggctccaacg

SEQ ID NO: 336050 - DNA, 25 bp, Mus musculus
gctctagtcactgctaaccaggatg

SEQ ID NO: 336051 - DNA, 25 bp, Mus musculus
gcggcttctctggacgctctagtca

SEQ ID NO: 336052 - DNA, 25 bp, Mus musculus
cagccggttgtcactctacggggac

SEQ ID NO: 336053 - DNA, 25 bp, Mus musculus
tgcacacatgtggtgatgcagaccc

SEQ ID NO: 336054 - DNA, 25 bp, Mus musculus
ttggttttccacatgcgcgcacaga

SEQ ID NO: 336055 - DNA, 25 bp, Mus musculus
gctgtcaccgcactgagtcctcttg

SEQ ID NO: 336056 - DNA, 25 bp, Mus musculus
caccctagcctgagtcggtcgaaga

SEQ ID NO: 336057 - DNA, 25 bp, Mus musculus
cactgagtcctcttggttttccaca

SEQ ID NO: 336058 - DNA, 25 bp, Mus musculus
ccgcgacgtggcacttacagttctc

SEQ ID NO: 336059 - DNA, 25 bp, Mus musculus
agacctggagctctcgccgatcttt

SEQ ID NO: 336060 - DNA, 25 bp, Mus musculus
gaaagctcgcgtggacaagtgtcca

SEQ ID NO: 336061 - DNA, 25 bp, Mus musculus
acgctgctgatcgtcctgttgctga

SEQ ID NO: 336062 - DNA, 25 bp, Mus musculus
ccagctctcaaaatgtggcacaacg

SEQ ID NO: 336063 - DNA, 25 bp, Mus musculus
gacaagtgtccacggtgatcacctc

SEQ ID NO: 336064 - DNA, 25 bp, Mus musculus
gccgatctttgcactacattaccca

SEQ ID NO: 336065 - DNA, 25 bp, Mus musculus
tcatgcctcttgctcagggcaggtc

SEQ ID NO: 336066 - DNA, 25 bp, Mus musculus
actcctgggagtggtagttcgttgc

SEQ ID NO: 336067 - DNA, 25 bp, Mus musculus
agtggttgacatctggcgtctccga

SEQ ID NO: 336068 - DNA, 25 bp, Mus musculus
atcacctcggtggtctcggtggcca

SEQ ID NO: 336069 - DNA, 25 bp, Mus musculus
accgagtttagaggagtcatgcctc

SEQ ID NO: 336070 - DNA, 25 bp, Mus musculus
cgggcatcacgaaccttcaggctca

SEQ ID NO: 336071 - DNA, 25 bp, Mus musculus
aaccttcaggctcagcgaaccttcg

SEQ ID NO: 336072 - DNA, 25 bp, Mus musculus
cgggctcccaagaccgagtttagag

SEQ ID NO: 336073 - DNA, 25 bp, Mus musculus
ctggatggaaatgagaagccttcgc

SEQ ID NO: 336074 - DNA, 25 bp, Mus musculus
tctgagctcacagcccagatccaga

SEQ ID NO: 336075 - DNA, 25 bp, Mus musculus
cagatccagaccagcacggcgcggg

SEQ ID NO: 336076 - DNA, 25 bp, Mus musculus
tggcggtgaaggtaacgcctccacc

SEQ ID NO: 336077 - DNA, 25 bp, Mus musculus
accctccgacaaagagcgtgtaata

SEQ ID NO: 336078 - DNA, 25 bp, Mus musculus
gcgtgtaatacgatcatttcttttc

SEQ ID NO: 336079 - DNA, 25 bp, Mus musculus
gcacagctgcctctagcttctcagg

SEQ ID NO: 336080 - DNA, 25 bp, Mus musculus
ctctagcttctcaggagacggcgta

SEQ ID NO: 336081 - DNA, 25 bp, Mus musculus
agacggcgtacaaggcactcttacc

SEQ ID NO: 336082 - DNA, 25 bp, Mus musculus
cttaccttgtacttcatctcggcgg

SEQ ID NO: 336083 - DNA, 25 bp, Mus musculus
atcacacagtgagtgaggcactgca

SEQ ID NO: 336084 - DNA, 25 bp, Mus musculus
atctcggcggtgatctgatgagccc

SEQ ID NO: 336085 - DNA, 25 bp, Mus musculus
tgagccctggtcctatcgaatcaca

SEQ ID NO: 336086 - DNA, 25 bp, Mus musculus
ccgcgcactgcggagtctctgagct

SEQ ID NO: 336087 - DNA, 25 bp, Mus musculus
cagcccgagcatcagcgagagtagc

SEQ ID NO: 336088 - DNA, 25 bp, Mus musculus
caggcaccggggtgtctttcctcgg

SEQ ID NO: 336089 - DNA, 25 bp, Mus musculus
cccgcgacgcaggacactgatgcgg

SEQ ID NO: 336090 - DNA, 25 bp, Mus musculus
tgagcgccaagccaagcaggtaagc

SEQ ID NO: 336091 - DNA, 25 bp, Mus musculus
accatgtgaatgtgctccggagctg

SEQ ID NO: 336092 - DNA, 25 bp, Mus musculus
ctagccggagcgtttcgaggactcc

SEQ ID NO: 336093 - DNA, 25 bp, Mus musculus
caagagctcagcgaggccgcctcta

SEQ ID NO: 336094 - DNA, 25 bp, Mus musculus
tgcagttgcgccatctgtcaggagc

SEQ ID NO: 336095 - DNA, 25 bp, Mus musculus
acctgacagtctcagggcgtgtccc

SEQ ID NO: 336096 - DNA, 25 bp, Mus musculus
tagggcagaaagacctgacagtctc

SEQ ID NO: 336097 - DNA, 25 bp, Mus musculus
cctcagcgggccctttgatagggca

SEQ ID NO: 336098 - DNA, 25 bp, Mus musculus
attcaccaatggctgccggcgctca

SEQ ID NO: 336099 - DNA, 25 bp, Mus musculus
tgtaaagctcaacccactcggcggc

SEQ ID NO: 336100 - DNA, 25 bp, Mus musculus
ccatctgtcaggagcgcagccggcg

SEQ ID NO: 336101 - DNA, 25 bp, Mus musculus
gtgtcgcgcttaatgctgctgaggc

SEQ ID NO: 336102 - DNA, 25 bp, Mus musculus
tgtccttgcccatgatctccagctg

SEQ ID NO: 336103 - DNA, 25 bp, Mus musculus
tgccctgctcgaacatgtcctcaat

SEQ ID NO: 336104 - DNA, 25 bp, Mus musculus
gttctcggagaatacatcccacttg

SEQ ID NO: 336105 - DNA, 25 bp, Mus musculus
cgcccttcaagtcggccagcaggtt

SEQ ID NO: 336106 - DNA, 25 bp, Mus musculus
tctgtaggaagagctcgtgcacatc

SEQ ID NO: 336107 - DNA, 25 bp, Mus musculus
ttctccactagcacggccatctgta

SEQ ID NO: 336108 - DNA, 25 bp, Mus musculus
ctgctcgctcagctccttcatggag

SEQ ID NO: 336109 - DNA, 25 bp, Mus musculus
gctcgatgacgttcagcgtgtcctc

SEQ ID NO: 336110 - DNA, 25 bp, Mus musculus
agggtcttctgcacgttaagctcga

SEQ ID NO: 336111 - DNA, 25 bp, Mus musculus
agttgtcgcgctgtttcatctcggc

SEQ ID NO: 336112 - DNA, 25 bp, Mus musculus
tcatctcggcctggttgtactcgta

SEQ ID NO: 336113 - DNA, 25 bp, Mus musculus
ctcgcccgtgtaatcgagggtcttc

SEQ ID NO: 336114 - DNA, 25 bp, Mus musculus
gtactcgtacatggcttgctggaaa

SEQ ID NO: 336115 - DNA, 25 bp, Mus musculus
ccagctcaccggtttcaggtttccg

SEQ ID NO: 336116 - DNA, 25 bp, Mus musculus
cccgactggatcacagttcatgttt

SEQ ID NO: 336117 - DNA, 25 bp, Mus musculus
tgaggaacctcacgggtaatgcgcc

SEQ ID NO: 336118 - DNA, 25 bp, Mus musculus
ccatggcacggtgctgaggaacctc

SEQ ID NO: 336119 - DNA, 25 bp, Mus musculus
cgatgatcaacctgtcggtgcagca

SEQ ID NO: 336120 - DNA, 25 bp, Mus musculus
agcagccaatgagcggcgagaccca

SEQ ID NO: 336121 - DNA, 25 bp, Mus musculus
ttggctacccaaaggccgagcggca

SEQ ID NO: 336122 - DNA, 25 bp, Mus musculus
ggctcctcgagtgttggctacccaa

SEQ ID NO: 336123 - DNA, 25 bp, Mus musculus
cgccagtgacgtaggtggcgctccc

SEQ ID NO: 336124 - DNA, 25 bp, Mus musculus
gggacctatacacagctctctcatc

SEQ ID NO: 336125 - DNA, 25 bp, Mus musculus
gaagcgcaggctccaaaaatcctgg

SEQ ID NO: 336126 - DNA, 25 bp, Mus musculus
gagtctgttccctcggagcagccaa

SEQ ID NO: 336127 - DNA, 25 bp, Mus musculus
ggcagctcccgggacctatacacag

SEQ ID NO: 336128 - DNA, 25 bp, Mus musculus
agggcgccgaccactcgatgatcaa

SEQ ID NO: 336129 - DNA, 25 bp, Mus musculus
cgggagagataaggtcagagtaccc

SEQ ID NO: 336130 - DNA, 25 bp, Mus musculus
gaaaacccagctcgcagggtgaagg

SEQ ID NO: 336131 - DNA, 25 bp, Mus musculus
ttcctccctccgttcttttgtctgc

SEQ ID NO: 336132 - DNA, 25 bp, Mus musculus
agttgaaccaggaagcttgggagca

SEQ ID NO: 336133 - DNA, 25 bp, Mus musculus
aacctccgggatctccgcgtggcgg

SEQ ID NO: 336134 - DNA, 25 bp, Mus musculus
caacaggaggaacctccgggatctc

SEQ ID NO: 336135 - DNA, 25 bp, Mus musculus
ccctagatgctcagcgggagagata

SEQ ID NO: 336136 - DNA, 25 bp, Mus musculus
tcagagtacccacaggaccctacgt

SEQ ID NO: 336137 - DNA, 25 bp, Mus musculus
ctacgtctcccaaggggcgcaacaa

SEQ ID NO: 336138 - DNA, 25 bp, Mus musculus
aggggcgcaacaaagactcttactt

SEQ ID NO: 336139 - DNA, 25 bp, Mus musculus
agactcttacttggcctgctggatg

SEQ ID NO: 336140 - DNA, 25 bp, Mus musculus
acttggcctgctggatggagagaaa

SEQ ID NO: 336141 - DNA, 25 bp, Mus musculus
gaatctctctgccttcccagtctag

SEQ ID NO: 336142 - DNA, 25 bp, Mus musculus
gcctcgggttggaccgatgctctcc

SEQ ID NO: 336143 - DNA, 25 bp, Mus musculus
ctccagccggagttgcggctagaga

SEQ ID NO: 336144 - DNA, 25 bp, Mus musculus
ggagtgcctgtttactccgggccac

SEQ ID NO: 336145 - DNA, 25 bp, Mus musculus
ggaggagtctcaaggctgctgctct

SEQ ID NO: 336146 - DNA, 25 bp, Mus musculus
agtctcaaggctgctgctctcgccg

SEQ ID NO: 336147 - DNA, 25 bp, Mus musculus
ctttgcccggagtgcctgtttactc

SEQ ID NO: 336148 - DNA, 25 bp, Mus musculus
ttgtcaagtgcagcgcagttcccga

SEQ ID NO: 336149 - DNA, 25 bp, Mus musculus
gctgatgtcccggttgtcaagtgca

SEQ ID NO: 336150 - DNA, 25 bp, Mus musculus
cttgtgctgatgtcccggttgtcaa

SEQ ID NO: 336151 - DNA, 25 bp, Mus musculus
aggaggctccgcttgtgctgatgtc

SEQ ID NO: 336152 - DNA, 25 bp, Mus musculus
aagtgcagcgcagttcccgacgggt

SEQ ID NO: 336153 - DNA, 25 bp, Mus musculus
acctcccggctttgtggctcgcttt

SEQ ID NO: 336154 - DNA, 25 bp, Mus musculus
gagccgcttgccacttcggcgggtc

SEQ ID NO: 336155 - DNA, 25 bp, Mus musculus
ctttcggtctttgcccggagtgcct

SEQ ID NO: 336156 - DNA, 25 bp, Mus musculus
gctcgctttccctttcggtctttgc

SEQ ID NO: 336157 - DNA, 25 bp, Mus musculus
atgcagccggtgctgtgatgcagcc

SEQ ID NO: 336158 - DNA, 25 bp, Mus musculus
tgatgtagccagtgctgtgatgtag

SEQ ID NO: 336159 - DNA, 25 bp, Mus musculus
tgatgcagccggtgctgtgatgcag

SEQ ID NO: 336160 - DNA, 25 bp, Mus musculus
gatgcagccggtgctgtgatgcagc

SEQ ID NO: 336161 - DNA, 25 bp, Mus musculus
cagccggtgctgtgatgcagccggt

SEQ ID NO: 336162 - DNA, 25 bp, Mus musculus
tgctgtgatgcagccggtgctgtga

SEQ ID NO: 336163 - DNA, 25 bp, Mus musculus
tgcagccggtgctgtgatgcagccg

SEQ ID NO: 336164 - DNA, 25 bp, Mus musculus
atgtagccggtgctgtgatgtagcc

SEQ ID NO: 336165 - DNA, 25 bp, Mus musculus
gtgatgtagccggtgctgtgatgta

SEQ ID NO: 336166 - DNA, 25 bp, Mus musculus
gtagccggtgctgtgatgtagccgg

SEQ ID NO: 336167 - DNA, 25 bp, Mus musculus
gatgtagccggtgctgtgatgtagc

SEQ ID NO: 336168 - DNA, 25 bp, Mus musculus
tgctgtgatgtagccagtgctgtga

SEQ ID NO: 336169 - DNA, 25 bp, Mus musculus
tgctgtgatgtagccggtgctgtga

SEQ ID NO: 336170 - DNA, 25 bp, Mus musculus
gtgatgcagccggtgctgtgatgca

SEQ ID NO: 336171 - DNA, 25 bp, Mus musculus
caggagacccagagcttcgctgata

SEQ ID NO: 336172 - DNA, 25 bp, Mus musculus
gctgacggaatctgccacctggaca

SEQ ID NO: 336173 - DNA, 25 bp, Mus musculus
tggctctgtcagtccacggacccgg

SEQ ID NO: 336174 - DNA, 25 bp, Mus musculus
acatttgcagcaactgcagccgggg

SEQ ID NO: 336175 - DNA, 25 bp, Mus musculus
ctgggcaaggagatcaagcacattt

SEQ ID NO: 336176 - DNA, 25 bp, Mus musculus
tgatccactgtcaactgggcaagga

SEQ ID NO: 336177 - DNA, 25 bp, Mus musculus
acaacgtgtcgtttgtgatccactg

SEQ ID NO: 336178 - DNA, 25 bp, Mus musculus
gaaagctttttatttgctgagcatg

SEQ ID NO: 336179 - DNA, 25 bp, Mus musculus
cacctggacaactgtggagaccttc

SEQ ID NO: 336180 - DNA, 25 bp, Mus musculus
gcgccgccgtgaagcccaaaaagaa

SEQ ID NO: 336181 - DNA, 25 bp, Mus musculus
aggtcaagacctcgagcgcgccatc

SEQ ID NO: 336182 - DNA, 25 bp, Mus musculus
tccaggctcgaagaggtcaagacct

SEQ ID NO: 336183 - DNA, 25 bp, Mus musculus
gtctcgggatttgtccaggctcgaa

SEQ ID NO: 336184 - DNA, 25 bp, Mus musculus
cttcgctgatagaagagcggattca

SEQ ID NO: 336185 - DNA, 25 bp, Mus musculus
gagtcccacccacacgtggatgtta

SEQ ID NO: 336186 - DNA, 25 bp, Mus musculus
cggtatgcacgcttcacctcgagta

SEQ ID NO: 336187 - DNA, 25 bp, Mus musculus
cctcgagtagagcaaacacacccgg

SEQ ID NO: 336188 - DNA, 25 bp, Mus musculus
aacacacccggctcagactcagaga

SEQ ID NO: 336189 - DNA, 25 bp, Mus musculus
ctaccggcaggcagacggaaccata

SEQ ID NO: 336190 - DNA, 25 bp, Mus musculus
aaccataagcgtcagggccgagcga

SEQ ID NO: 336191 - DNA, 25 bp, Mus musculus
gaggacatctgctgggagtcccacc

SEQ ID NO: 336192 - DNA, 25 bp, Mus musculus
ttaaccgggtgaagctgaagccctg

SEQ ID NO: 336193 - DNA, 25 bp, Mus musculus
atcccgaaaccctggtgatcgtctc

SEQ ID NO: 336194 - DNA, 25 bp, Mus musculus
agtgcttgcttagggcactcttctg

SEQ ID NO: 336195 - DNA, 25 bp, Mus musculus
tcaggcggtgtttcttccacctcgc

SEQ ID NO: 336196 - DNA, 25 bp, Mus musculus
aatcggaaacgagcctttgctaatc

SEQ ID NO: 336197 - DNA, 25 bp, Mus musculus
tgcgcccttgagtatccacgtctgt

SEQ ID NO: 336198 - DNA, 25 bp, Mus musculus
gagcgatgccatgagacacccggcc

SEQ ID NO: 336199 - DNA, 25 bp, Mus musculus
cagccatggtaagaggccggccgtc

SEQ ID NO: 336200 - DNA, 25 bp, Mus musculus
cccagcggaacccaccacggtcacg

SEQ ID NO: 336201 - DNA, 25 bp, Mus musculus
atagaggtcggtgcccaccgccagg

SEQ ID NO: 336202 - DNA, 25 bp, Mus musculus
ctgtccatagaggtcggtgcccacc

SEQ ID NO: 336203 - DNA, 25 bp, Mus musculus
cgctattgcgctgtccatagaggtc

SEQ ID NO: 336204 - DNA, 25 bp, Mus musculus
agctcctgctctggggcgctattgc

SEQ ID NO: 336205 - DNA, 25 bp, Mus musculus
tgaagcagcagctcctgctctgggg

SEQ ID NO: 336206 - DNA, 25 bp, Mus musculus
cacggatgtagtgtcctgaagcagc

SEQ ID NO: 336207 - DNA, 25 bp, Mus musculus
cagcagggagttgctcacggatgta

SEQ ID NO: 336208 - DNA, 25 bp, Mus musculus
ggcagtcgtcgaaggtggcagccat

SEQ ID NO: 336209 - DNA, 25 bp, Mus musculus
gtcccacgtgcgccggtcatcttga

SEQ ID NO: 336210 - DNA, 25 bp, Mus musculus
aggcctggcgcactgcctgcatcat

SEQ ID NO: 336211 - DNA, 25 bp, Mus musculus
ggggatgtcgctgaatgccttctca

SEQ ID NO: 336212 - DNA, 25 bp, Mus musculus
tgaatgccttctcaggcagcaggga

SEQ ID NO: 336213 - DNA, 25 bp, Mus musculus
tcctcaatcagctgcttcatgcgta

SEQ ID NO: 336214 - DNA, 25 bp, Mus musculus
gtcgtcgcagctccagttgtatttc

SEQ ID NO: 336215 - DNA, 25 bp, Mus musculus
ccagttgtatttcttgcccagcaga

SEQ ID NO: 336216 - DNA, 25 bp, Mus musculus
tcttgcccagcagactaccgctgtg

SEQ ID NO: 336217 - DNA, 25 bp, Mus musculus
agcagactaccgctgtgcacctgca

SEQ ID NO: 336218 - DNA, 25 bp, Mus musculus
agctcgcccacgtagccctcctcaa

SEQ ID NO: 336219 - DNA, 25 bp, Mus musculus
tgcttcatgcgtacgaaggctggga

SEQ ID NO: 336220 - DNA, 25 bp, Mus musculus
aggaagcgcagcacgttgcccatga

SEQ ID NO: 336221 - DNA, 25 bp, Mus musculus
agcacgttgcccatgatgctcatga

SEQ ID NO: 336222 - DNA, 25 bp, Mus musculus
ccatgatgctcatgagcttcgggta

SEQ ID NO: 336223 - DNA, 25 bp, Mus musculus
tgctcatgagcttcgggtagtagtg

SEQ ID NO: 336224 - DNA, 25 bp, Mus musculus
ccatcaggtcgtcgcagctccagtt

SEQ ID NO: 336225 - DNA, 25 bp, Mus musculus
tgacatcatgcggaaggcgtccagc

SEQ ID NO: 336226 - DNA, 25 bp, Mus musculus
agtagtgggccgctgacatcatgcg

SEQ ID NO: 336227 - DNA, 25 bp, Mus musculus
ccgcagcgacagactaaaggaattg

SEQ ID NO: 336228 - DNA, 25 bp, Mus musculus
gcagggaaggcttgatctccaaaga

SEQ ID NO: 336229 - DNA, 25 bp, Mus musculus
cacagaaccgctagacctggatgga

SEQ ID NO: 336230 - DNA, 25 bp, Mus musculus
gccgttagctctccgctcaatctag

SEQ ID NO: 336231 - DNA, 25 bp, Mus musculus
tgctagaagttgcagcgctaaaggc

SEQ ID NO: 336232 - DNA, 25 bp, Mus musculus
tggtcgttacccaatcgccggaggc

SEQ ID NO: 336233 - DNA, 25 bp, Mus musculus
tctccaaagaattccaccgcgggcg

SEQ ID NO: 336234 - DNA, 25 bp, Mus musculus
tctggcctgacgaactgacaagatc

SEQ ID NO: 336235 - DNA, 25 bp, Mus musculus
gggcacgcgcttcttacggaactcc

SEQ ID NO: 336236 - DNA, 25 bp, Mus musculus
tacggaactcccaagcgcagagctc

SEQ ID NO: 336237 - DNA, 25 bp, Mus musculus
aattgacgacgtagagacggccgcc

SEQ ID NO: 336238 - DNA, 25 bp, Mus musculus
cccggcatgtgattggccctcaaca

SEQ ID NO: 336239 - DNA, 25 bp, Mus musculus
ccgtgtataggctgttggtcgttac

SEQ ID NO: 336240 - DNA, 25 bp, Mus musculus
ttaccgagtgacaacagcgcaggcg

SEQ ID NO: 336241 - DNA, 25 bp, Mus musculus
gtgtccttcccggagacagcggcag

SEQ ID NO: 336242 - DNA, 25 bp, Mus musculus
cgaagccctcatctttcagcagcgg

SEQ ID NO: 336243 - DNA, 25 bp, Mus musculus
gaagcatggctgctcaggtccgccc

SEQ ID NO: 336244 - DNA, 25 bp, Mus musculus
ggatctccagtcgaacaccggcgca

SEQ ID NO: 336245 - DNA, 25 bp, Mus musculus
agcctcagcgcggtgactgctgcag

SEQ ID NO: 336246 - DNA, 25 bp, Mus musculus
accaccctctgtgggctgcggatct

SEQ ID NO: 336247 - DNA, 25 bp, Mus musculus
tccttggtaacgaatggaacccaga

SEQ ID NO: 336248 - DNA, 25 bp, Mus musculus
cacccggaggccgactaaggatgag

SEQ ID NO: 336249 - DNA, 25 bp, Mus musculus
ctaaggatgaggctcgtagtgtacc

SEQ ID NO: 336250 - DNA, 25 bp, Mus musculus
tcgtagtgtaccaggcgccgatccc

SEQ ID NO: 336251 - DNA, 25 bp, Mus musculus
gcggagttggcgactttgactgtca

SEQ ID NO: 336252 - DNA, 25 bp, Mus musculus
ttctgctgccatattcgctcgctcg

SEQ ID NO: 336253 - DNA, 25 bp, Mus musculus
cggcagaatctctctcccggatggc

SEQ ID NO: 336254 - DNA, 25 bp, Mus musculus
gcgtgacagcgcaccgaaccacaga

SEQ ID NO: 336255 - DNA, 25 bp, Mus musculus
gttccctctgcaggttcatgcctcg

SEQ ID NO: 336256 - DNA, 25 bp, Mus musculus
accctggggttcctatcgggagctg

SEQ ID NO: 336257 - DNA, 25 bp, Mus musculus
tcagttcacccaagtccaaaaacta

SEQ ID NO: 336258 - DNA, 25 bp, Mus musculus
agggacaagcgagctgatccgcaga

SEQ ID NO: 336259 - DNA, 25 bp, Mus musculus
caagcgagctgatccgcagaccgta

SEQ ID NO: 336260 - DNA, 25 bp, Mus musculus
tccgcagaccgtaacagcaactgtg

SEQ ID NO: 336261 - DNA, 25 bp, Mus musculus
aactgtgacctcagcaaccaaggct

SEQ ID NO: 336262 - DNA, 25 bp, Mus musculus
gcgggactccaagactcagttcacc

SEQ ID NO: 336263 - DNA, 25 bp, Mus musculus
aggttcatgcctcgccacttctata

SEQ ID NO: 336264 - DNA, 25 bp, Mus musculus
ccacttctataacccagcccggccg

SEQ ID NO: 336265 - DNA, 25 bp, Mus musculus
cagcccggccgctagtgtgcaaggc

SEQ ID NO: 336266 - DNA, 25 bp, Mus musculus
cggcggcgatgacgttggttccctt

SEQ ID NO: 336267 - DNA, 25 bp, Mus musculus
gatgacgttggttcccttggggcca

SEQ ID NO: 336268 - DNA, 25 bp, Mus musculus
cgtaacagcaactgtgacctcagca

SEQ ID NO: 336269 - DNA, 25 bp, Mus musculus
cgggtctccggcaggggccgctgca

SEQ ID NO: 336270 - DNA, 25 bp, Mus musculus
ggtctgggctttgtttcggctccgc

SEQ ID NO: 336271 - DNA, 25 bp, Mus musculus
caggtgcgtgtctggcactggtggg

SEQ ID NO: 336272 - DNA, 25 bp, Mus musculus
ttgcaggtgcgtgtctggcactggt

SEQ ID NO: 336273 - DNA, 25 bp, Mus musculus
tccccaccgctttttgcaggtgcgt

SEQ ID NO: 336274 - DNA, 25 bp, Mus musculus
cggtccccaccgctttttgcaggtg

SEQ ID NO: 336275 - DNA, 25 bp, Mus musculus
cctctcctgctccacggtccccacc

SEQ ID NO: 336276 - DNA, 25 bp, Mus musculus
cttggcaccaggacgtggagcgccc

SEQ ID NO: 336277 - DNA, 25 bp, Mus musculus
cagccagggcttggcaccaggacgt

SEQ ID NO: 336278 - DNA, 25 bp, Mus musculus
ctgcagccagggcttggcaccagga

SEQ ID NO: 336279 - DNA, 25 bp, Mus musculus
tctgggctttgtttcggctccgcgc

SEQ ID NO: 336280 - DNA, 25 bp, Mus musculus
atcccgcgcatgcgcgatggggtgc

SEQ ID NO: 336281 - DNA, 25 bp, Mus musculus
tgcagccagggcttggcaccaggac

SEQ ID NO: 336282 - DNA, 25 bp, Mus musculus
tgggctttgtttcggctccgcgcgc

SEQ ID NO: 336283 - DNA, 25 bp, Mus musculus
gtttcgcggcctccgaaccagcaga

SEQ ID NO: 336284 - DNA, 25 bp, Mus musculus
tccgggtcaagggtcagacagccgc

SEQ ID NO: 336285 - DNA, 25 bp, Mus musculus
acagccgcctttccgtttgccatgg

SEQ ID NO: 336286 - DNA, 25 bp, Mus musculus
tttccgtttgccatggtgcagctcc

SEQ ID NO: 336287 - DNA, 25 bp, Mus musculus
ttgtcgcgtattcccgcgccggctg

SEQ ID NO: 336288 - DNA, 25 bp, Mus musculus
tgctgctcgcgcagcctagcagtgg

SEQ ID NO: 336289 - DNA, 25 bp, Mus musculus
gagctgactttcgccagcgcccagg

SEQ ID NO: 336290 - DNA, 25 bp, Mus musculus
cagcgcccgggaatgttggcgcctc

SEQ ID NO: 336291 - DNA, 25 bp, Mus musculus
tccttccagggataaaacgctgttg

SEQ ID NO: 336292 - DNA, 25 bp, Mus musculus
aaacgctgttgaaggagaagaggaa

SEQ ID NO: 336293 - DNA, 25 bp, Mus musculus
ggcgcgaggagctgttcatcgaaca

SEQ ID NO: 336294 - DNA, 25 bp, Mus musculus
ttcatcgaacagaaggttggacgcg

SEQ ID NO: 336295 - DNA, 25 bp, Mus musculus
ggacgcgggacttgtcgcttatgta

SEQ ID NO: 336296 - DNA, 25 bp, Mus musculus
cttgtcgcttatgtaaactcggccg

SEQ ID NO: 336297 - DNA, 25 bp, Mus musculus
cgcagacctgccctttccgccgtcg

SEQ ID NO: 336298 - DNA, 25 bp, Mus musculus
cccgactccgagtcgcctcgggagc

SEQ ID NO: 336299 - DNA, 25 bp, Mus musculus
cagcttcgtccaccgggcagcgtgg

SEQ ID NO: 336300 - DNA, 25 bp, Mus musculus
tccgcgaggcctcagccagcttcgt

SEQ ID NO: 336301 - DNA, 25 bp, Mus musculus
cacgagcaggaggaacaacagcgga

SEQ ID NO: 336302 - DNA, 25 bp, Mus musculus
cgagcgctcagccagcgtcctacgc

SEQ ID NO: 336303 - DNA, 25 bp, Mus musculus
ggcgcccagccgcagacggcccagc

SEQ ID NO: 336304 - DNA, 25 bp, Mus musculus
ggctgctcgcaagcgcggccacacg

SEQ ID NO: 336305 - DNA, 25 bp, Mus musculus
tttctcacctctccggctgctcgca

SEQ ID NO: 336306 - DNA, 25 bp, Mus musculus
gtcacctgtgtgacccgctgtccct

SEQ ID NO: 336307 - DNA, 25 bp, Mus musculus
ggctacagcccggtcacctgtgtga

SEQ ID NO: 336308 - DNA, 25 bp, Mus musculus
aaccctcgccctggcggcgtggcta

SEQ ID NO: 336309 - DNA, 25 bp, Mus musculus
gtgtcatccggagccaggacaccgg

SEQ ID NO: 336310 - DNA, 25 bp, Mus musculus
cgagtacgcgtgtcatccggagcca

SEQ ID NO: 336311 - DNA, 25 bp, Mus musculus
tgatgccacccaccgtcacggcctc

SEQ ID NO: 336312 - DNA, 25 bp, Mus musculus
atctgtcccgaccaagttgaggggc

SEQ ID NO: 336313 - DNA, 25 bp, Mus musculus
cgcctgatctgtcccgaccaagttg

SEQ ID NO: 336314 - DNA, 25 bp, Mus musculus
cagagccctcgacaccgcctgatct

SEQ ID NO: 336315 - DNA, 25 bp, Mus musculus
agcacccgtagcaaacttcgggccg

SEQ ID NO: 336316 - DNA, 25 bp, Mus musculus
gggagcccagcacccgtagcaaact

SEQ ID NO: 336317 - DNA, 25 bp, Mus musculus
tgcggggctaccctgatgccaccca

SEQ ID NO: 336318 - DNA, 25 bp, Mus musculus
tgcaccggatgccctgcggggctac

SEQ ID NO: 336319 - DNA, 25 bp, Mus musculus
atcgatcctccagtccgtcctccca

SEQ ID NO: 336320 - DNA, 25 bp, Mus musculus
cgccggagtggctctcgatcctccc

SEQ ID NO: 336321 - DNA, 25 bp, Mus musculus
tgcgccgtagagacaaagcggcccg

SEQ ID NO: 336322 - DNA, 25 bp, Mus musculus
cggctgtgcgccgtagagacaaagc

SEQ ID NO: 336323 - DNA, 25 bp, Mus musculus
tgccttaggggttcaggctctcggc

SEQ ID NO: 336324 - DNA, 25 bp, Mus musculus
ttgccatggtgacgtagggtcggct

SEQ ID NO: 336325 - DNA, 25 bp, Mus musculus
tgacggtggcttgctccgagaccgc

SEQ ID NO: 336326 - DNA, 25 bp, Mus musculus
tctcttgtagcctgcagcctggcac

SEQ ID NO: 336327 - DNA, 25 bp, Mus musculus
ctctctcttgtagcctgcagcctgg

SEQ ID NO: 336328 - DNA, 25 bp, Mus musculus
tggccttgcttacgccgctctgttt

SEQ ID NO: 336329 - DNA, 25 bp, Mus musculus
aagcccgatcgctcggtgctacccg

SEQ ID NO: 336330 - DNA, 25 bp, Mus musculus
ttctaggctgcggtacggcccccaa

SEQ ID NO: 336331 - DNA, 25 bp, Mus musculus
cgctccagccatgtcgcaaggcctc

SEQ ID NO: 336332 - DNA, 25 bp, Mus musculus
cccggacagtgtcgcagcgctccag

SEQ ID NO: 336333 - DNA, 25 bp, Mus musculus
ggtacaagagcacggcgcgcgccca

SEQ ID NO: 336334 - DNA, 25 bp, Mus musculus
tcccaagcgcgggtacaagagcacg

SEQ ID NO: 336335 - DNA, 25 bp, Mus musculus
agccgcagcagcaacgcggacttgg

SEQ ID NO: 336336 - DNA, 25 bp, Mus musculus
tggccagccgcagcagcaacgcgga

SEQ ID NO: 336337 - DNA, 25 bp, Mus musculus
ttccgcggagctgcttgttgccgct

SEQ ID NO: 336338 - DNA, 25 bp, Mus musculus
gagaccgccgacttgccttgcacag

SEQ ID NO: 336339 - DNA, 25 bp, Mus musculus
tgctgcctgttgctaacccacgtga

SEQ ID NO: 336340 - DNA, 25 bp, Mus musculus
cagccttggtctggcaaaagttttc

SEQ ID NO: 336341 - DNA, 25 bp, Mus musculus
ttccagtctttccagcagatgcgcc

SEQ ID NO: 336342 - DNA, 25 bp, Mus musculus
tggaagcaccggaccagccttggtc

SEQ ID NO: 336343 - DNA, 25 bp, Mus musculus
ccacaaggtggcagtgccgtgctgc

SEQ ID NO: 336344 - DNA, 25 bp, Mus musculus
tgctagcctagtgctttcctgcgga

SEQ ID NO: 336345 - DNA, 25 bp, Mus musculus
ctagcgcggtcattggctgctgcct

SEQ ID NO: 336346 - DNA, 25 bp, Mus musculus
cgccacctgactagcgcggtcattg

SEQ ID NO: 336347 - DNA, 25 bp, Mus musculus
tgcagaggcagagccttccacgcct

SEQ ID NO: 336348 - DNA, 25 bp, Mus musculus
caggcagcctgctctgcagaggcag

SEQ ID NO: 336349 - DNA, 25 bp, Mus musculus
cgccagctctacagcgaggtcggaa

SEQ ID NO: 336350 - DNA, 25 bp, Mus musculus
ctgttgctaacccacgtgaccggcg

SEQ ID NO: 336351 - DNA, 25 bp, Mus musculus
gaggtcggaactccaaccacaacga

SEQ ID NO: 336352 - DNA, 25 bp, Mus musculus
tgctgctggctgtcgtcagcgatgc

SEQ ID NO: 336353 - DNA, 25 bp, Mus musculus
gcttggagccgtgacctcggaccac

SEQ ID NO: 336354 - DNA, 25 bp, Mus musculus
agccagcctctagcagtgtcgcacg

SEQ ID NO: 336355 - DNA, 25 bp, Mus musculus
cgcgggacacgtccaagcgtttgtt

SEQ ID NO: 336356 - DNA, 25 bp, Mus musculus
gtagttcttcgcttccgtggccata

SEQ ID NO: 336357 - DNA, 25 bp, Mus musculus
ggccatagccattttgtagtcaagg

SEQ ID NO: 336358 - DNA, 25 bp, Mus musculus
ttccagaagatcaaggggactattc

SEQ ID NO: 336359 - DNA, 25 bp, Mus musculus
cgaaggtttgcatgcggcgactgtt

SEQ ID NO: 336360 - DNA, 25 bp, Mus musculus
gaccgagcgtgccatgcattgagct

SEQ ID NO: 336361 - DNA, 25 bp, Mus musculus
cagtttggctgaggacccgctccaa

SEQ ID NO: 336362 - DNA, 25 bp, Mus musculus
atccctcttggtgcgtggcccagtt

SEQ ID NO: 336363 - DNA, 25 bp, Mus musculus
tgccgatcagcgagttcgcaccgag

SEQ ID NO: 336364 - DNA, 25 bp, Mus musculus
tgacaccgccggcaacggctgaagc

SEQ ID NO: 336365 - DNA, 25 bp, Mus musculus
attcctcgattccacaggcggttcg

SEQ ID NO: 336366 - DNA, 25 bp, Mus musculus
gcgcttgtcctgaggtgacaccgcc

SEQ ID NO: 336367 - DNA, 25 bp, Mus musculus
ttaagcaggagagacgtcagcgcgc

SEQ ID NO: 336368 - DNA, 25 bp, Mus musculus
agccgagtctgctcacgcggtgctc

SEQ ID NO: 336369 - DNA, 25 bp, Mus musculus
ggcccacagcgctttgggccgtagc

SEQ ID NO: 336370 - DNA, 25 bp, Mus musculus
gcagactccgggttgtgctctggct

SEQ ID NO: 336371 - DNA, 25 bp, Mus musculus
cgccgcgcgtaaggctcagctctta

SEQ ID NO: 336372 - DNA, 25 bp, Mus musculus
cgcagtctcgagcaacaggttaagc

SEQ ID NO: 336373 - DNA, 25 bp, Mus musculus
gccttcttttgccttgcgcctttgc

SEQ ID NO: 336374 - DNA, 25 bp, Mus musculus
ccttcgcgagctgccgctgtctgtt

SEQ ID NO: 336375 - DNA, 25 bp, Mus musculus
tgtctgttgtcattgtgacgtcaca

SEQ ID NO: 336376 - DNA, 25 bp, Mus musculus
tgacgtcacaaagggacagcccagt

SEQ ID NO: 336377 - DNA, 25 bp, Mus musculus
tttcctccgtgctgtcaaaagtcgg

SEQ ID NO: 336378 - DNA, 25 bp, Mus musculus
tccaggcgctgcctgagtaggagct

SEQ ID NO: 336379 - DNA, 25 bp, Mus musculus
ctgccgctgtctgttgtcattgtga

SEQ ID NO: 336380 - DNA, 25 bp, Mus musculus
cgggctccagcgcagtctcgagcaa

SEQ ID NO: 336381 - DNA, 25 bp, Mus musculus
caaaggtccatttaggtgccagtct

SEQ ID NO: 336382 - DNA, 25 bp, Mus musculus
gtgccagtctttgctttatgttttg

SEQ ID NO: 336383 - DNA, 25 bp, Mus musculus
cccaaaggtccatttaggtgccagt

SEQ ID NO: 336384 - DNA, 25 bp, Mus musculus
aggtccatttaggtgccagtctttg

SEQ ID NO: 336385 - DNA, 25 bp, Mus musculus
gtccatttaggtgccagtctttgct

SEQ ID NO: 336386 - DNA, 25 bp, Mus musculus
tttaggtgccagtctttgctttatg

SEQ ID NO: 336387 - DNA, 25 bp, Mus musculus
ggtccatttaggtgccagtctttgc

SEQ ID NO: 336388 - DNA, 25 bp, Mus musculus
ccaaaggtccatttaggtgccagtc

SEQ ID NO: 336389 - DNA, 25 bp, Mus musculus
catttaggtgccagtctttgcttta

SEQ ID NO: 336390 - DNA, 25 bp, Mus musculus
ccagtctttgctttatgttttgaga

SEQ ID NO: 336391 - DNA, 25 bp, Mus musculus
tcccaaaggtccatttaggtgccag

SEQ ID NO: 336392 - DNA, 25 bp, Mus musculus
tctttgctttatgttttgagacagt

SEQ ID NO: 336393 - DNA, 25 bp, Mus musculus
ctcccaaaggtccatttaggtgcca

SEQ ID NO: 336394 - DNA, 25 bp, Mus musculus
taggtgccagtctttgctttatgtt

SEQ ID NO: 336395 - DNA, 25 bp, Mus musculus
gtagcccagctgcagtttccgcctt

SEQ ID NO: 336396 - DNA, 25 bp, Mus musculus
acaccttggcgcgagagtcaggcac

SEQ ID NO: 336397 - DNA, 25 bp, Mus musculus
gggcgatgcacgtacacctctcaaa

SEQ ID NO: 336398 - DNA, 25 bp, Mus musculus
cacctctcaaagtcccaagggcgga

SEQ ID NO: 336399 - DNA, 25 bp, Mus musculus
tggcccgaagcctaaacaaccgtgc

SEQ ID NO: 336400 - DNA, 25 bp, Mus musculus
caacgaggctgccaaccttcggaga

SEQ ID NO: 336401 - DNA, 25 bp, Mus musculus
gtttccgccttgttcctcctattca

SEQ ID NO: 336402 - DNA, 25 bp, Mus musculus
gcccataccacaggagcacaagacg

SEQ ID NO: 336403 - DNA, 25 bp, Mus musculus
aagatggcagcagtccgcccttctc

SEQ ID NO: 336404 - DNA, 25 bp, Mus musculus
ctgctcttctcttcccgttgaggtg

SEQ ID NO: 336405 - DNA, 25 bp, Mus musculus
atacgacgtgatcgtgctgggcacc

SEQ ID NO: 336406 - DNA, 25 bp, Mus musculus
atgcagtgatttgaaggcgtcggta

SEQ ID NO: 336407 - DNA, 25 bp, Mus musculus
cgccatgaatgaggaatacgacgtg

SEQ ID NO: 336408 - DNA, 25 bp, Mus musculus
tcaactagaccctcagcttcgcatg

SEQ ID NO: 336409 - DNA, 25 bp, Mus musculus
cgcggtgtaatgttagccaattaga

SEQ ID NO: 336410 - DNA, 25 bp, Mus musculus
agactccagtttggcgcacgcgcgt

SEQ ID NO: 336411 - DNA, 25 bp, Mus musculus
cgcgcgtctcgttgaactacggggc

SEQ ID NO: 336412 - DNA, 25 bp, Mus musculus
gcacgcgcgtctcgttgaactacgg

SEQ ID NO: 336413 - DNA, 25 bp, Mus musculus
agcgagactccagtttggcgcacgc

SEQ ID NO: 336414 - DNA, 25 bp, Mus musculus
tcggatagctttttcagcgagactc

SEQ ID NO: 336415 - DNA, 25 bp, Mus musculus
acgtctctttcggatagctttttca

SEQ ID NO: 336416 - DNA, 25 bp, Mus musculus
gcgaccaatgataaacgtctctttc

SEQ ID NO: 336417 - DNA, 25 bp, Mus musculus
gttagccaattagaggcgagagaga

SEQ ID NO: 336418 - DNA, 25 bp, Mus musculus
gaaggcgcggtgtaatgttagccaa

SEQ ID NO: 336419 - DNA, 25 bp, Mus musculus
gaacgtgccgcgagatggttctcgc

SEQ ID NO: 336420 - DNA, 25 bp, Mus musculus
acgcccgtggaacgtgccgcgagat

SEQ ID NO: 336421 - DNA, 25 bp, Mus musculus
tgtgtcacagtccacgcccgtggaa

SEQ ID NO: 336422 - DNA, 25 bp, Mus musculus
agaagcgaccaatgataaacgtctc

SEQ ID NO: 336423 - DNA, 25 bp, Mus musculus
cgctgtattgccagagcatgagccc

SEQ ID NO: 336424 - DNA, 25 bp, Mus musculus
taacgcaattgctgtggtgggtcct

SEQ ID NO: 336425 - DNA, 25 bp, Mus musculus
gtcggggaagcaagtttctgtgtcc

SEQ ID NO: 336426 - DNA, 25 bp, Mus musculus
gcaagtttctgtgtcctcgaaagga

SEQ ID NO: 336427 - DNA, 25 bp, Mus musculus
cctcgaaaggactgagcgctgtatt

SEQ ID NO: 336428 - DNA, 25 bp, Mus musculus
ctgcggaggcgtagttaacgcaatt

SEQ ID NO: 336429 - DNA, 25 bp, Mus musculus
gcctgccatctgttaaggcgcctga

SEQ ID NO: 336430 - DNA, 25 bp, Mus musculus
ctgttaaggcgcctgacgtttccta

SEQ ID NO: 336431 - DNA, 25 bp, Mus musculus
tttcacgctgttcgttcttagccgg

SEQ ID NO: 336432 - DNA, 25 bp, Mus musculus
tcttagccggtgttttgagacatcc

SEQ ID NO: 336433 - DNA, 25 bp, Mus musculus
tgttttgagacatccgcctccgtgc

SEQ ID NO: 336434 - DNA, 25 bp, Mus musculus
gcctccgtgcaagatgacgtcctta

SEQ ID NO: 336435 - DNA, 25 bp, Mus musculus
gatgacgtccttagcccagcagctc

SEQ ID NO: 336436 - DNA, 25 bp, Mus musculus
atgagccctggcctgccatctgtta

SEQ ID NO: 336437 - DNA, 25 bp, Mus musculus
acatccataagctgggccggcgctg

SEQ ID NO: 336438 - DNA, 25 bp, Mus musculus
cggctggcaagaatatgctgggcaa

SEQ ID NO: 336439 - DNA, 25 bp, Mus musculus
tcgagtcagtacgtgctcaggtgga

SEQ ID NO: 336440 - DNA, 25 bp, Mus musculus
agactggcggccagagtgcaagctc

SEQ ID NO: 336441 - DNA, 25 bp, Mus musculus
tatgctgggcaaacaagcacatggc

SEQ ID NO: 336442 - DNA, 25 bp, Mus musculus
gctcaacgatgagatgcgctttgtc

SEQ ID NO: 336443 - DNA, 25 bp, Mus musculus
gtacgggatgtgtcgcgtgattccc

SEQ ID NO: 336444 - DNA, 25 bp, Mus musculus
cgctttgtcacgcagatccagcaca

SEQ ID NO: 336445 - DNA, 25 bp, Mus musculus
tgacccacagggcaagccagagaag

SEQ ID NO: 336446 - DNA, 25 bp, Mus musculus
gcgatggacgagatccctgtcctca

SEQ ID NO: 336447 - DNA, 25 bp, Mus musculus
cctgtgaaaatcgttctacctcgca

SEQ ID NO: 336448 - DNA, 25 bp, Mus musculus
gcacatggcaagacagagggcaccc

SEQ ID NO: 336449 - DNA, 25 bp, Mus musculus
cccgctcatctacatcgagtcagta

SEQ ID NO: 336450 - DNA, 25 bp, Mus musculus
aggagttccacgacccgctcatcta

SEQ ID NO: 336451 - DNA, 25 bp, Mus musculus
ccgctgcgaccaaagtgactcggtg

SEQ ID NO: 336452 - DNA, 25 bp, Mus musculus
aagttcgttgtctccgcgcgccgac

SEQ ID NO: 336453 - DNA, 25 bp, Mus musculus
cgacagggcaggagggcatccctcc

SEQ ID NO: 336454 - DNA, 25 bp, Mus musculus
ctccctcaggcctcgcgccaccgcg

SEQ ID NO: 336455 - DNA, 25 bp, Mus musculus
caccgcgtactcacccggaggtgaa

SEQ ID NO: 336456 - DNA, 25 bp, Mus musculus
cacccggaggtgaaatcctgctgta

SEQ ID NO: 336457 - DNA, 25 bp, Mus musculus
cttccagagcagaggacacagcctc

SEQ ID NO: 336458 - DNA, 25 bp, Mus musculus
gaggtgaaatcctgctgtacgctca

SEQ ID NO: 336459 - DNA, 25 bp, Mus musculus
gtcggctctcgcttcaccgcgccgc

SEQ ID NO: 336460 - DNA, 25 bp, Mus musculus
caccgggaagttcgttgtctccgcg

SEQ ID NO: 336461 - DNA, 25 bp, Mus musculus
aatcctgctgtacgctcagcagccg

SEQ ID NO: 336462 - DNA, 25 bp, Mus musculus
gaggacacagcctctcacgtgacca

SEQ ID NO: 336463 - DNA, 25 bp, Mus musculus
gaccaaagtgactcggtgccgccgc

SEQ ID NO: 336464 - DNA, 25 bp, Mus musculus
tcgcgcagggtctccagcatcgcgt

SEQ ID NO: 336465 - DNA, 25 bp, Mus musculus
cgaaagtgatcggaatggtgatctc

SEQ ID NO: 336466 - DNA, 25 bp, Mus musculus
gtcctgcctttcttcgtgcttgcca

SEQ ID NO: 336467 - DNA, 25 bp, Mus musculus
tgtagccatgttcgtcctgcctttc

SEQ ID NO: 336468 - DNA, 25 bp, Mus musculus
agcaccgagagatgtagccatgttc

SEQ ID NO: 336469 - DNA, 25 bp, Mus musculus
tccgggtgaagcaccgagagatgta

SEQ ID NO: 336470 - DNA, 25 bp, Mus musculus
gagcgtgtatttccgggtgaagcac

SEQ ID NO: 336471 - DNA, 25 bp, Mus musculus
tccacacctggagggagcgtgtatt

SEQ ID NO: 336472 - DNA, 25 bp, Mus musculus
cacggtaagtgtgccctcaggggat

SEQ ID NO: 336473 - DNA, 25 bp, Mus musculus
agcctccacggtaagtgtgccctca

SEQ ID NO: 336474 - DNA, 25 bp, Mus musculus
cgtgactgctttgggcaacggagcc

SEQ ID NO: 336475 - DNA, 25 bp, Mus musculus
tgactgcgtgactgctttgggcaac

SEQ ID NO: 336476 - DNA, 25 bp, Mus musculus
gtgatctccgctgactgcgtgactg

SEQ ID NO: 336477 - DNA, 25 bp, Mus musculus
tcggaatggtgatctccgctgactg

SEQ ID NO: 336478 - DNA, 25 bp, Mus musculus
ttcgtgcttgccagtgatctccacc

SEQ ID NO: 336479 - DNA, 25 bp, Mus musculus
cctctataaaagacgcgtgcctgta

SEQ ID NO: 336480 - DNA, 25 bp, Mus musculus
cttcagcccaccgagactgggaatt

SEQ ID NO: 336481 - DNA, 25 bp, Mus musculus
cggggcctctataaaagacgcgtgc

SEQ ID NO: 336482 - DNA, 25 bp, Mus musculus
cccagccatgctgtgctatgtgacg

SEQ ID NO: 336483 - DNA, 25 bp, Mus musculus
aaagacgcgtgcctgtagcggcgca

SEQ ID NO: 336484 - DNA, 25 bp, Mus musculus
cgcggccgtgtagctcccgggaact

SEQ ID NO: 336485 - DNA, 25 bp, Mus musculus
tagctcccgggaactggctgtcgtg

SEQ ID NO: 336486 - DNA, 25 bp, Mus musculus
cacggctgcaccttcctcacggagc

SEQ ID NO: 336487 - DNA, 25 bp, Mus musculus
catgctgtgctatgtgacgaggccg

SEQ ID NO: 336488 - DNA, 25 bp, Mus musculus
agcccggagtcgacttggagcaatt

SEQ ID NO: 336489 - DNA, 25 bp, Mus musculus
agtcgacttggagcaattgcggtga

SEQ ID NO: 336490 - DNA, 25 bp, Mus musculus
caattgcggtgaggcgacagctccg

SEQ ID NO: 336491 - DNA, 25 bp, Mus musculus
agctccggcgcacacccgagaagaa

SEQ ID NO: 336492 - DNA, 25 bp, Mus musculus
cgcacacccgagaagaagcggcggt

SEQ ID NO: 336493 - DNA, 25 bp, Mus musculus
ttcgcggagcaccagtctgcgcaca

SEQ ID NO: 336494 - DNA, 25 bp, Mus musculus
gcagcctcaagagccgatccgaggt

SEQ ID NO: 336495 - DNA, 25 bp, Mus musculus
agcggagcagcctcaagagccgatc

SEQ ID NO: 336496 - DNA, 25 bp, Mus musculus
tgttctgctgcgacctaagcggagc

SEQ ID NO: 336497 - DNA, 25 bp, Mus musculus
ctcgacttcaaggatgttctgctgc

SEQ ID NO: 336498 - DNA, 25 bp, Mus musculus
gacgcggaccttaaactcgacttca

SEQ ID NO: 336499 - DNA, 25 bp, Mus musculus
cgcatagacgcggaccttaaactcg

SEQ ID NO: 336500 - DNA, 25 bp, Mus musculus
cgggcataagaacaaggcgtgcgca

SEQ ID NO: 336501 - DNA, 25 bp, Mus musculus
tgcgcacagccacccgggcgccact

SEQ ID NO: 336502 - DNA, 25 bp, Mus musculus
tggggccgctggcataccgccttcg

SEQ ID NO: 336503 - DNA, 25 bp, Mus musculus
agaacaaggcgtgcgcaccgggttc

SEQ ID NO: 336504 - DNA, 25 bp, Mus musculus
cgacctaagcggagcagcctcaaga

SEQ ID NO: 336505 - DNA, 25 bp, Mus musculus
aggaagctaccgcgcaccgctagca

SEQ ID NO: 336506 - DNA, 25 bp, Mus musculus
ttcaaggatgttctgctgcgaccta

SEQ ID NO: 336507 - DNA, 25 bp, Mus musculus
aggcattcgttgctccgctcttggt

SEQ ID NO: 336508 - DNA, 25 bp, Mus musculus
cacgtttcttgggaggcaggcattc

SEQ ID NO: 336509 - DNA, 25 bp, Mus musculus
atctcacgtttcttgggaggcaggc

SEQ ID NO: 336510 - DNA, 25 bp, Mus musculus
tggtggcggggatctcacgtttctt

SEQ ID NO: 336511 - DNA, 25 bp, Mus musculus
gggcagagcagtggccttctcctcc

SEQ ID NO: 336512 - DNA, 25 bp, Mus musculus
tcgctgggcagagcagtggccttct

SEQ ID NO: 336513 - DNA, 25 bp, Mus musculus
ggcaggcattcgttgctccgctctt

SEQ ID NO: 336514 - DNA, 25 bp, Mus musculus
accctccacgcagtggttgtcgctg

SEQ ID NO: 336515 - DNA, 25 bp, Mus musculus
tgctggggagccaggccacaccctc

SEQ ID NO: 336516 - DNA, 25 bp, Mus musculus
cgttgctccgctcttggttggattt

SEQ ID NO: 336517 - DNA, 25 bp, Mus musculus
gctccgctcttggttggatttcatt

SEQ ID NO: 336518 - DNA, 25 bp, Mus musculus
cgctcttggttggatttcatttttc

SEQ ID NO: 336519 - DNA, 25 bp, Mus musculus
tggttggatttcatttttcgccgtc

SEQ ID NO: 336520 - DNA, 25 bp, Mus musculus
tccacgcagtggttgtcgctgggca

SEQ ID NO: 336521 - DNA, 25 bp, Mus musculus
ccaagctcggggttgcctctgtcaa

SEQ ID NO: 336522 - DNA, 25 bp, Mus musculus
cagctgcagctagggccggtcttct

SEQ ID NO: 336523 - DNA, 25 bp, Mus musculus
agcgaagagggcagcgcgaccctcc

SEQ ID NO: 336524 - DNA, 25 bp, Mus musculus
aggaggaccgggctctatccgctcg

SEQ ID NO: 336525 - DNA, 25 bp, Mus musculus
agccgggcactagtgtatgtacaca

SEQ ID NO: 336526 - DNA, 25 bp, Mus musculus
gctcctcttccagctgttttccgtg

SEQ ID NO: 336527 - DNA, 25 bp, Mus musculus
ctgttttccgtgcagcccattgaga

SEQ ID NO: 336528 - DNA, 25 bp, Mus musculus
agccacttactgtaaagtgtaaatg

SEQ ID NO: 336529 - DNA, 25 bp, Mus musculus
aaagtgtaaatggatctggggttgc

SEQ ID NO: 336530 - DNA, 25 bp, Mus musculus
agacacagtgtcctgcggctgctgt

SEQ ID NO: 336531 - DNA, 25 bp, Mus musculus
ctgctgtagctctagctgcggctcc

SEQ ID NO: 336532 - DNA, 25 bp, Mus musculus
ggctccacagggcttgttttggatc

SEQ ID NO: 336533 - DNA, 25 bp, Mus musculus
tgctgctctggatcaggaagcggcc

SEQ ID NO: 336534 - DNA, 25 bp, Mus musculus
ttgcctctgtcaagctaggcgaccc

SEQ ID NO: 336535 - DNA, 25 bp, Mus musculus
ctcagccaagcgtaagctcgaggga

SEQ ID NO: 336536 - DNA, 25 bp, Mus musculus
tcaccttgccaacaggtgtggcacc

SEQ ID NO: 336537 - DNA, 25 bp, Mus musculus
tgtggcacccgaaagaagagccatc

SEQ ID NO: 336538 - DNA, 25 bp, Mus musculus
gccaacaggtgtggcacccgaaaga

SEQ ID NO: 336539 - DNA, 25 bp, Mus musculus
ggtaacctgtgcactgagcagtcag

SEQ ID NO: 336540 - DNA, 25 bp, Mus musculus
taagctcgagggaagaactcttctc

SEQ ID NO: 336541 - DNA, 25 bp, Mus musculus
tggaggcgttcaccttgccaacagg

SEQ ID NO: 336542 - DNA, 25 bp, Mus musculus
cggctacacctcagccaagcgtaag

SEQ ID NO: 336543 - DNA, 25 bp, Mus musculus
ggtggctaaacgcagacgtggactc

SEQ ID NO: 336544 - DNA, 25 bp, Mus musculus
caccttgtcccggtggctaaacgca

SEQ ID NO: 336545 - DNA, 25 bp, Mus musculus
tcgatggtggttctcggggaaacca

SEQ ID NO: 336546 - DNA, 25 bp, Mus musculus
tgagcagtcagtcgatggtggttct

SEQ ID NO: 336547 - DNA, 25 bp, Mus musculus
acccgaaagaagagccatcacatcc

SEQ ID NO: 336548 - DNA, 25 bp, Mus musculus
ctcttctctggaggcgttcaccttg

SEQ ID NO: 336549 - DNA, 25 bp, Mus musculus
tcccactaagccactcgattttttg

SEQ ID NO: 336550 - DNA, 25 bp, Mus musculus
ggcgtgagtgcaaaaggctcccaca

SEQ ID NO: 336551 - DNA, 25 bp, Mus musculus
agcgtcaatcagctcactctgggtc

SEQ ID NO: 336552 - DNA, 25 bp, Mus musculus
ggacacggtagcctctgagccaacc

SEQ ID NO: 336553 - DNA, 25 bp, Mus musculus
gctactaagcagaagggacggttcc

SEQ ID NO: 336554 - DNA, 25 bp, Mus musculus
ccaggggtctttgcgactttgacca

SEQ ID NO: 336555 - DNA, 25 bp, Mus musculus
gaaccatctacctcttctggacttg

SEQ ID NO: 336556 - DNA, 25 bp, Mus musculus
ttatttttactttcacgcggcgtga

SEQ ID NO: 336557 - DNA, 25 bp, Mus musculus
tccgcactggtgtggcagctactaa

SEQ ID NO: 336558 - DNA, 25 bp, Mus musculus
ctttgaccagtaggagcaggcaaca

SEQ ID NO: 336559 - DNA, 25 bp, Mus musculus
cgccagcctgcgcaagtactttgag

SEQ ID NO: 336560 - DNA, 25 bp, Mus musculus
ggcgcgaagatgcacaccacccaga

SEQ ID NO: 336561 - DNA, 25 bp, Mus musculus
cgatccggaaggtctggacagtgac

SEQ ID NO: 336562 - DNA, 25 bp, Mus musculus
ctacggagctggttacccggacgat

SEQ ID NO: 336563 - DNA, 25 bp, Mus musculus
ctagatgcgtctgtgggcgtggcct

SEQ ID NO: 336564 - DNA, 25 bp, Mus musculus
ctttaagtccagtctagatgcgtct

SEQ ID NO: 336565 - DNA, 25 bp, Mus musculus
aggtccggcggacgatcctgcttcc

SEQ ID NO: 336566 - DNA, 25 bp, Mus musculus
ggtccggcggacgatcctgcttccg

SEQ ID NO: 336567 - DNA, 25 bp, Mus musculus
ccaggtccggcggacgatcctgctt

SEQ ID NO: 336568 - DNA, 25 bp, Mus musculus
tccagtctagatgcgtctgtgggcg

SEQ ID NO: 336569 - DNA, 25 bp, Mus musculus
agtccagtctagatgcgtctgtggg

SEQ ID NO: 336570 - DNA, 25 bp, Mus musculus
tttaagtccagtctagatgcgtctg

SEQ ID NO: 336571 - DNA, 25 bp, Mus musculus
gctttaagtccagtctagatgcgtc

SEQ ID NO: 336572 - DNA, 25 bp, Mus musculus
ggctttaagtccagtctagatgcgt

SEQ ID NO: 336573 - DNA, 25 bp, Mus musculus
tggctttaagtccagtctagatgcg

SEQ ID NO: 336574 - DNA, 25 bp, Mus musculus
gtggctttaagtccagtctagatgc

SEQ ID NO: 336575 - DNA, 25 bp, Mus musculus
cgtggctttaagtccagtctagatg

SEQ ID NO: 336576 - DNA, 25 bp, Mus musculus
taagtccagtctagatgcgtctgtg

SEQ ID NO: 336577 - DNA, 25 bp, Mus musculus
accttgtttcggtgctactgcgatc

SEQ ID NO: 336578 - DNA, 25 bp, Mus musculus
ggtgtggccttacgactcaatgatg

SEQ ID NO: 336579 - DNA, 25 bp, Mus musculus
cgactcaatgatgtaagcgcgaggc

SEQ ID NO: 336580 - DNA, 25 bp, Mus musculus
ctgagccccagtccagcgttgagga

SEQ ID NO: 336581 - DNA, 25 bp, Mus musculus
cgtaccctaggctgcgcgatccgat

SEQ ID NO: 336582 - DNA, 25 bp, Mus musculus
gaatttcaaccttgtttcggtgcta

SEQ ID NO: 336583 - DNA, 25 bp, Mus musculus
tgggttctgcatgggctcgttaaca

SEQ ID NO: 336584 - DNA, 25 bp, Mus musculus
gtgctactgcgatcgccttgacctg

SEQ ID NO: 336585 - DNA, 25 bp, Mus musculus
cttgacctgctgtggcctactttta

SEQ ID NO: 336586 - DNA, 25 bp, Mus musculus
ctgtggcctacttttagtttgaagg

SEQ ID NO: 336587 - DNA, 25 bp, Mus musculus
cttagcctcactggggcgtggcttt

SEQ ID NO: 336588 - DNA, 25 bp, Mus musculus
ctcactggggcgtggctttaagtcc

SEQ ID NO: 336589 - DNA, 25 bp, Mus musculus
gcatgggctcgttaacagataggta

SEQ ID NO: 336590 - DNA, 25 bp, Mus musculus
cagataggtaagtaggaatttcaac

SEQ ID NO: 336591 - DNA, 25 bp, Mus musculus
tgcacgaatggctgtggcagtccta

SEQ ID NO: 336592 - DNA, 25 bp, Mus musculus
attgttgacgcccactgctgctgtg

SEQ ID NO: 336593 - DNA, 25 bp, Mus musculus
tacctgacctggcacagcggcctgg

SEQ ID NO: 336594 - DNA, 25 bp, Mus musculus
tactgcggctacctgacctggcaca

SEQ ID NO: 336595 - DNA, 25 bp, Mus musculus
tggctgtggcagtcctactgcggct

SEQ ID NO: 336596 - DNA, 25 bp, Mus musculus
cgcacacgtggttgtgcgatgccgc

SEQ ID NO: 336597 - DNA, 25 bp, Mus musculus
tgccgcgacgcgttacgttaccgaa

SEQ ID NO: 336598 - DNA, 25 bp, Mus musculus
cgcgttacgttaccgaatatgccac

SEQ ID NO: 336599 - DNA, 25 bp, Mus musculus
ccgaatatgccacaatttatgatta

SEQ ID NO: 336600 - DNA, 25 bp, Mus musculus
tgattaaaacgtaccacagaggacc

SEQ ID NO: 336601 - DNA, 25 bp, Mus musculus
cccgagaaacatcgcgtagcccagg

SEQ ID NO: 336602 - DNA, 25 bp, Mus musculus
tagcccaggaaccaactcacaaagc

SEQ ID NO: 336603 - DNA, 25 bp, Mus musculus
cttccggaggcggattgttgacgcc

SEQ ID NO: 336604 - DNA, 25 bp, Mus musculus
ccttctacttcctgagcgctgcggg

SEQ ID NO: 336605 - DNA, 25 bp, Mus musculus
agacggcgggatgccgtgtccacac

SEQ ID NO: 336606 - DNA, 25 bp, Mus musculus
tttccgcgagaacgactgcaggggc

SEQ ID NO: 336607 - DNA, 25 bp, Mus musculus
ggccgtttccgcgagaacgactgca

SEQ ID NO: 336608 - DNA, 25 bp, Mus musculus
aagcgctttgctccgacttgtgtcc

SEQ ID NO: 336609 - DNA, 25 bp, Mus musculus
ccggtggtagtaagcgctttgctcc

SEQ ID NO: 336610 - DNA, 25 bp, Mus musculus
tggtatcccgatgtccctgagcccg

SEQ ID NO: 336611 - DNA, 25 bp, Mus musculus
ggaacagtggtatcccgatgtccct

SEQ ID NO: 336612 - DNA, 25 bp, Mus musculus
tgccgtgtccacactcggattccgg

SEQ ID NO: 336613 - DNA, 25 bp, Mus musculus
cccgtgcatgtgtcacggaggagac

SEQ ID NO: 336614 - DNA, 25 bp, Mus musculus
actacggtcccagtacaagcctcaa

SEQ ID NO: 336615 - DNA, 25 bp, Mus musculus
ttgtcccgacactacggtcccagta

SEQ ID NO: 336616 - DNA, 25 bp, Mus musculus
agcagtcagcgttgtcccgacacta

SEQ ID NO: 336617 - DNA, 25 bp, Mus musculus
ggagagccctcaccgcagcagtcag

SEQ ID NO: 336618 - DNA, 25 bp, Mus musculus
ctcggattccggtccgggaacagtg

SEQ ID NO: 336619 - DNA, 25 bp, Mus musculus
ctgagatttcttttcccgccctgtg

SEQ ID NO: 336620 - DNA, 25 bp, Mus musculus
gcccgaatatccgaagcctgagatt

SEQ ID NO: 336621 - DNA, 25 bp, Mus musculus
ctgtgcccgccagggaaagcccttg

SEQ ID NO: 336622 - DNA, 25 bp, Mus musculus
ggtggcaacgacgagtccggatctt

SEQ ID NO: 336623 - DNA, 25 bp, Mus musculus
tatgcctccggcttccgaggccatg

SEQ ID NO: 336624 - DNA, 25 bp, Mus musculus
ggccctaggcgacacacagacacag

SEQ ID NO: 336625 - DNA, 25 bp, Mus musculus
cccgcgtctgtgtttgtcaccgtct

SEQ ID NO: 336626 - DNA, 25 bp, Mus musculus
tctatggagatctcccgccgaggcc

SEQ ID NO: 336627 - DNA, 25 bp, Mus musculus
agaggctcctcttcagtcgccctgg

SEQ ID NO: 336628 - DNA, 25 bp, Mus musculus
gctcttgcgcctattaccgctgttg

SEQ ID NO: 336629 - DNA, 25 bp, Mus musculus
tattaccgctgttgaggcggccgcc

SEQ ID NO: 336630 - DNA, 25 bp, Mus musculus
ggtcgcgagccagaacaccgtcact

SEQ ID NO: 336631 - DNA, 25 bp, Mus musculus
gtgtttgtcaccgtctctatggaga

SEQ ID NO: 336632 - DNA, 25 bp, Mus musculus
cgtgaggtcgtgaggaataccattt

SEQ ID NO: 336633 - DNA, 25 bp, Mus musculus
aggatattctccacctgcagcacgc

SEQ ID NO: 336634 - DNA, 25 bp, Mus musculus
cccgcgtgtacttctcgatgtatgt

SEQ ID NO: 336635 - DNA, 25 bp, Mus musculus
gtgtacttctcgatgtatgtctccc

SEQ ID NO: 336636 - DNA, 25 bp, Mus musculus
cccatccaaagtgccctcgttctca

SEQ ID NO: 336637 - DNA, 25 bp, Mus musculus
tcaatctcctcggtcgcctaaggca

SEQ ID NO: 336638 - DNA, 25 bp, Mus musculus
cctaaggcacagaaaggaggcgact

SEQ ID NO: 336639 - DNA, 25 bp, Mus musculus
ggaggcgactgtttttctgtgaatg

SEQ ID NO: 336640 - DNA, 25 bp, Mus musculus
tctgtgaatggtgtttccggaagtg

SEQ ID NO: 336641 - DNA, 25 bp, Mus musculus
aagtgtctccacgtgctctcaaagc

SEQ ID NO: 336642 - DNA, 25 bp, Mus musculus
ggctcaggatattctccacctgcag

SEQ ID NO: 336643 - DNA, 25 bp, Mus musculus
tcaaagcgttgagagctaccgctcc

SEQ ID NO: 336644 - DNA, 25 bp, Mus musculus
gttctcactccgcgctgccaggagg

SEQ ID NO: 336645 - DNA, 25 bp, Mus musculus
tctccacgtgctctcaaagcgttga

SEQ ID NO: 336646 - DNA, 25 bp, Mus musculus
tcctcggtcgcctaaggcacagaaa

SEQ ID NO: 336647 - DNA, 25 bp, Mus musculus
ccggccgccctgcagtttgcaaagt

SEQ ID NO: 336648 - DNA, 25 bp, Mus musculus
acggcgctcattttctttcccttgc

SEQ ID NO: 336649 - DNA, 25 bp, Mus musculus
cgtgtgtttgtaaatacggcgctca

SEQ ID NO: 336650 - DNA, 25 bp, Mus musculus
tgcaatggaccaccaaaaccgtgtg

SEQ ID NO: 336651 - DNA, 25 bp, Mus musculus
ggagccaaggctagacatgaatttg

SEQ ID NO: 336652 - DNA, 25 bp, Mus musculus
gtgcgcaggcctaatccacgctatc

SEQ ID NO: 336653 - DNA, 25 bp, Mus musculus
ctcctggagctcgagtcaccttcag

SEQ ID NO: 336654 - DNA, 25 bp, Mus musculus
ggggacgtcacagacacctcctgga

SEQ ID NO: 336655 - DNA, 25 bp, Mus musculus
ctttacaaaggcgagcgtctccggc

SEQ ID NO: 336656 - DNA, 25 bp, Mus musculus
ctgtaaggccgctgcagaccgggaa

SEQ ID NO: 336657 - DNA, 25 bp, Mus musculus
ttaccttcgtatccgacatgttggc

SEQ ID NO: 336658 - DNA, 25 bp, Mus musculus
gagcggctcacctcttcggttcatg

SEQ ID NO: 336659 - DNA, 25 bp, Mus musculus
gcgcccttgtaatgggagggatcta

SEQ ID NO: 336660 - DNA, 25 bp, Mus musculus
ctcggccggagcagaaatgcaaaag

SEQ ID NO: 336661 - DNA, 25 bp, Mus musculus
aaagacatgccggaacttgctctgc

SEQ ID NO: 336662 - DNA, 25 bp, Mus musculus
cgggagacgcggatgtcatcatagc

SEQ ID NO: 336663 - DNA, 25 bp, Mus musculus
cgcggatgtcatcatagcactgatc

SEQ ID NO: 336664 - DNA, 25 bp, Mus musculus
gtcatcatagcactgatcattcttc

SEQ ID NO: 336665 - DNA, 25 bp, Mus musculus
agcactgatcattcttcaccgcctg

SEQ ID NO: 336666 - DNA, 25 bp, Mus musculus
gatcattcttcaccgcctgtccaaa

SEQ ID NO: 336667 - DNA, 25 bp, Mus musculus
ctgtccaaagacatgccggaacttg

SEQ ID NO: 336668 - DNA, 25 bp, Mus musculus
acatgccggaacttgctctgccgca

SEQ ID NO: 336669 - DNA, 25 bp, Mus musculus
tgctctgccgcaccactcgccgcat

SEQ ID NO: 336670 - DNA, 25 bp, Mus musculus
tcgccgcatcgtgtcagagcccggg

SEQ ID NO: 336671 - DNA, 25 bp, Mus musculus
cgcatcgtgtcagagcccgggtgcc

SEQ ID NO: 336672 - DNA, 25 bp, Mus musculus
cgagaagcctccatccatccgctgc

SEQ ID NO: 336673 - DNA, 25 bp, Mus musculus
cgcggcaaccgctgcccagtccttc

SEQ ID NO: 336674 - DNA, 25 bp, Mus musculus
tcttcaccgcctgtccaaagacatg

SEQ ID NO: 336675 - DNA, 25 bp, Mus musculus
tgcaagccctgtggggttcactagg

SEQ ID NO: 336676 - DNA, 25 bp, Mus musculus
ccacatggcagtcgttggtgacggc

SEQ ID NO: 336677 - DNA, 25 bp, Mus musculus
gacgcacgacgcagtcgtccgcatg

SEQ ID NO: 336678 - DNA, 25 bp, Mus musculus
gcgcagacctgggataatcacgtca

SEQ ID NO: 336679 - DNA, 25 bp, Mus musculus
catgcgctctgacgcagggcgcaca

SEQ ID NO: 336680 - DNA, 25 bp, Mus musculus
gaagcacaccttgcactccagcagg

SEQ ID NO: 336681 - DNA, 25 bp, Mus musculus
gccagtggccgaacctctcgaagca

SEQ ID NO: 336682 - DNA, 25 bp, Mus musculus
aggcaatcgctggtgtcacaggctc

SEQ ID NO: 336683 - DNA, 25 bp, Mus musculus
tcctcctccggagtcaaagatcttg

SEQ ID NO: 336684 - DNA, 25 bp, Mus musculus
ttttctccaaactggtgtgcacctc

SEQ ID NO: 336685 - DNA, 25 bp, Mus musculus
ggtacttcacgtcgtgcgctgcgtc

SEQ ID NO: 336686 - DNA, 25 bp, Mus musculus
acggcgacatccagtgggtacttca

SEQ ID NO: 336687 - DNA, 25 bp, Mus musculus
cgccagcgtcggtgacaaccacatg

SEQ ID NO: 336688 - DNA, 25 bp, Mus musculus
gcgacacaggccaagcagaccacgt

SEQ ID NO: 336689 - DNA, 25 bp, Mus musculus
ttagcagctgccgagattgcgcagt

SEQ ID NO: 336690 - DNA, 25 bp, Mus musculus
attatccaggctccggtcctatagg

SEQ ID NO: 336691 - DNA, 25 bp, Mus musculus
atgtggtctgatcccaccccggaaa

SEQ ID NO: 336692 - DNA, 25 bp, Mus musculus
cccggaaaagattatccaggctccg

SEQ ID NO: 336693 - DNA, 25 bp, Mus musculus
ggcgtgagaactctgcccaggacac

SEQ ID NO: 336694 - DNA, 25 bp, Mus musculus
cgaagcaaggtctccgcccagaacg

SEQ ID NO: 336695 - DNA, 25 bp, Mus musculus
ccgcccttagcagctgccgagattg

SEQ ID NO: 336696 - DNA, 25 bp, Mus musculus
agattgcgcagtggcggaaatcatc

SEQ ID NO: 336697 - DNA, 25 bp, Mus musculus
cccactccgggtcacggcgtgatag

SEQ ID NO: 336698 - DNA, 25 bp, Mus musculus
ccagcgctctgaggtagggactcga

SEQ ID NO: 336699 - DNA, 25 bp, Mus musculus
tctgaggtagggactcgagcctcac

SEQ ID NO: 336700 - DNA, 25 bp, Mus musculus
ggaccctgtgcaagccggggcttcc

SEQ ID NO: 336701 - DNA, 25 bp, Mus musculus
tttcccactcgtcgctctcttggaa

SEQ ID NO: 336702 - DNA, 25 bp, Mus musculus
ggtctccgcccagaacgcgtagggc

SEQ ID NO: 336703 - DNA, 25 bp, Mus musculus
tccgccgaagtctttctcgactcga

SEQ ID NO: 336704 - DNA, 25 bp, Mus musculus
ggaagccgcacgcttcggttctctc

SEQ ID NO: 336705 - DNA, 25 bp, Mus musculus
gggcctcagtgcttctggccgcgtc

SEQ ID NO: 336706 - DNA, 25 bp, Mus musculus
tcctcaccgcgggtgcgcacgagaa

SEQ ID NO: 336707 - DNA, 25 bp, Mus musculus
cccgctcctcagaatcaacaagatt

SEQ ID NO: 336708 - DNA, 25 bp, Mus musculus
ttcaaaatggcggttcgggaagcag

SEQ ID NO: 336709 - DNA, 25 bp, Mus musculus
tgacgaagttgagggatccgccgaa

SEQ ID NO: 336710 - DNA, 25 bp, Mus musculus
tcgactcgacttcacgcggcgatca

SEQ ID NO: 336711 - DNA, 25 bp, Mus musculus
ggttgattcggagccaccacgtttg

SEQ ID NO: 336712 - DNA, 25 bp, Mus musculus
cggagccaccacgtttgtttccgag

SEQ ID NO: 336713 - DNA, 25 bp, Mus musculus
tttccgaggggtcgttcgagatgaa

SEQ ID NO: 336714 - DNA, 25 bp, Mus musculus
gtcgttcgagatgaaggcttccaaa

SEQ ID NO: 336715 - DNA, 25 bp, Mus musculus
ggcttccaaatgagacctacttgcg

SEQ ID NO: 336716 - DNA, 25 bp, Mus musculus
ctccgcgctgaacggttggacgcta

SEQ ID NO: 336717 - DNA, 25 bp, Mus musculus
gaaagcctttgatgccagaagattc

SEQ ID NO: 336718 - DNA, 25 bp, Mus musculus
cggatttcctggaccactcgcgctg

SEQ ID NO: 336719 - DNA, 25 bp, Mus musculus
actcgcgctgcctgcttactaagga

SEQ ID NO: 336720 - DNA, 25 bp, Mus musculus
tgcttactaaggagtgcgcctccgg

SEQ ID NO: 336721 - DNA, 25 bp, Mus musculus
gggcctggctccgagaataaacagc

SEQ ID NO: 336722 - DNA, 25 bp, Mus musculus
aagattctggctggagacgctgaca

SEQ ID NO: 336723 - DNA, 25 bp, Mus musculus
tcaggctgtggctcagaccttaagg

SEQ ID NO: 336724 - DNA, 25 bp, Mus musculus
caggactcgccgtaccctgtacgtt

SEQ ID NO: 336725 - DNA, 25 bp, Mus musculus
ttcttcctctgctcttctccggggt

SEQ ID NO: 336726 - DNA, 25 bp, Mus musculus
caagctgacgccctgtgctgggttt

SEQ ID NO: 336727 - DNA, 25 bp, Mus musculus
cgttttctccaggaccgcaccagga

SEQ ID NO: 336728 - DNA, 25 bp, Mus musculus
aggaaccctgcaccctgactctggg

SEQ ID NO: 336729 - DNA, 25 bp, Mus musculus
ttttctcaagttgcccgcgtccgga

SEQ ID NO: 336730 - DNA, 25 bp, Mus musculus
tgaccctccgggagtctcaggctgt

SEQ ID NO: 336731 - DNA, 25 bp, Mus musculus
tgcccacagcgatcggtcagaaggt

SEQ ID NO: 336732 - DNA, 25 bp, Mus musculus
tgattgatgagcaggcccttgcgca

SEQ ID NO: 336733 - DNA, 25 bp, Mus musculus
gcacctcgctgagcctgcggtcagt

SEQ ID NO: 336734 - DNA, 25 bp, Mus musculus
agctgcccattgatctggtgctgtg

SEQ ID NO: 336735 - DNA, 25 bp, Mus musculus
accacctcggcggtttgctgggcac

SEQ ID NO: 336736 - DNA, 25 bp, Mus musculus
gggcttcatcttccctttccatagg

SEQ ID NO: 336737 - DNA, 25 bp, Mus musculus
tttccatagggtgacgccttctccg

SEQ ID NO: 336738 - DNA, 25 bp, Mus musculus
tttgagcatctctacccgaaagcgc

SEQ ID NO: 336739 - DNA, 25 bp, Mus musculus
ccgaaagcgccagggttccatgtag

SEQ ID NO: 336740 - DNA, 25 bp, Mus musculus
gccacgttcgggtccagtacactgt

SEQ ID NO: 336741 - DNA, 25 bp, Mus musculus
ttgggctgccacatggtcaccgcct

SEQ ID NO: 336742 - DNA, 25 bp, Mus musculus
cgcaacttgacgctctgctgattga

SEQ ID NO: 336743 - DNA, 25 bp, Mus musculus
cttctcacacttaggtcggtagccc

SEQ ID NO: 336744 - DNA, 25 bp, Mus musculus
ggagggtcgcaccttctcacactta

SEQ ID NO: 336745 - DNA, 25 bp, Mus musculus
tctaggccgccgagccaatgaatca

SEQ ID NO: 336746 - DNA, 25 bp, Mus musculus
tcccaagccttgttgcctgtgaacg

SEQ ID NO: 336747 - DNA, 25 bp, Mus musculus
cccggctccttgatccgctgcagct

SEQ ID NO: 336748 - DNA, 25 bp, Mus musculus
actccgctggctcctccagcccttg

SEQ ID NO: 336749 - DNA, 25 bp, Mus musculus
aggaggatgcaggaatgcagcccta

SEQ ID NO: 336750 - DNA, 25 bp, Mus musculus
gacggcgccaggcactctaggccgc

SEQ ID NO: 336751 - DNA, 25 bp, Mus musculus
tgcgttgtcagagcgaccgcccggc

SEQ ID NO: 336752 - DNA, 25 bp, Mus musculus
ctagcgtctgcgttgtcagagcgac

SEQ ID NO: 336753 - DNA, 25 bp, Mus musculus
cattgtgaaggctagcgtctgcgtt

SEQ ID NO: 336754 - DNA, 25 bp, Mus musculus
tccagctggaagtcattgtgaaggc

SEQ ID NO: 336755 - DNA, 25 bp, Mus musculus
gctgctccagctggaagtcattgtg

SEQ ID NO: 336756 - DNA, 25 bp, Mus musculus
ccttgttgcctgtgaacgcgcgcgc

SEQ ID NO: 336757 - DNA, 25 bp, Mus musculus
cggcgttcccaagccttgttgcctg

SEQ ID NO: 336758 - DNA, 25 bp, Mus musculus
atgcaggaatgcagccctagccgcc

SEQ ID NO: 336759 - DNA, 25 bp, Mus musculus
tacatcctggacctgcagctggcgc

SEQ ID NO: 336760 - DNA, 25 bp, Mus musculus
agcacgttatcgactacatcctgga

SEQ ID NO: 336761 - DNA, 25 bp, Mus musculus
ctgcctagttttccaggacgtctcc

SEQ ID NO: 336762 - DNA, 25 bp, Mus musculus
tgtcccttgcatcacaggaggcttc

SEQ ID NO: 336763 - DNA, 25 bp, Mus musculus
ttggtgatccactggtccctgagcc

SEQ ID NO: 336764 - DNA, 25 bp, Mus musculus
tctcagggaatgacagccgcttctc

SEQ ID NO: 336765 - DNA, 25 bp, Mus musculus
ggagactcaccctgctttgctgaga

SEQ ID NO: 336766 - DNA, 25 bp, Mus musculus
tgcgatatgaacgactgctacagtc

SEQ ID NO: 336767 - DNA, 25 bp, Mus musculus
cgctgtgcctgcagtgcgatatgaa

SEQ ID NO: 336768 - DNA, 25 bp, Mus musculus
cagctctccggtcgatttctggagc

SEQ ID NO: 336769 - DNA, 25 bp, Mus musculus
cgggccgattgtcgctcacaaaaaa

SEQ ID NO: 336770 - DNA, 25 bp, Mus musculus
tcttgtcttttgcttcgggccgatt

SEQ ID NO: 336771 - DNA, 25 bp, Mus musculus
gcgacactgtgatatgcgcactcta

SEQ ID NO: 336772 - DNA, 25 bp, Mus musculus
cgcgctcaacactgacccggtgaga

SEQ ID NO: 336773 - DNA, 25 bp, Mus musculus
gggacaccaaagcactcccagcgtg

SEQ ID NO: 336774 - DNA, 25 bp, Mus musculus
gtcttaccacggaggtcccacgcga

SEQ ID NO: 336775 - DNA, 25 bp, Mus musculus
ccacgcgatcgcaactgggagagcc

SEQ ID NO: 336776 - DNA, 25 bp, Mus musculus
tgggagagcctttcagctagccttc

SEQ ID NO: 336777 - DNA, 25 bp, Mus musculus
tggctttcccggctcctaatctcgt

SEQ ID NO: 336778 - DNA, 25 bp, Mus musculus
ggctcctaatctcgtcctcagctgg

SEQ ID NO: 336779 - DNA, 25 bp, Mus musculus
cggcgcgagtctctccagaactctg

SEQ ID NO: 336780 - DNA, 25 bp, Mus musculus
ctgaacggcggcatgaccgcacacg

SEQ ID NO: 336781 - DNA, 25 bp, Mus musculus
cctgccggcgatttgatgtttgaac

SEQ ID NO: 336782 - DNA, 25 bp, Mus musculus
ctgctggtacctagggcgtagaacc

SEQ ID NO: 336783 - DNA, 25 bp, Mus musculus
ggagcacttgccctgctggtaccta

SEQ ID NO: 336784 - DNA, 25 bp, Mus musculus
tctccagaactctggagaggattcc

SEQ ID NO: 336785 - DNA, 25 bp, Mus musculus
gtttcctaatcttcaggcagcctga

SEQ ID NO: 336786 - DNA, 25 bp, Mus musculus
tcgtcctcagctgggacaccaaagc

SEQ ID NO: 336787 - DNA, 25 bp, Mus musculus
acacctgaaccttgtgggtggccca

SEQ ID NO: 336788 - DNA, 25 bp, Mus musculus
tcaccagaaccgcagtagaatcgtc

SEQ ID NO: 336789 - DNA, 25 bp, Mus musculus
tttcgctcaccagaaccgcagtaga

SEQ ID NO: 336790 - DNA, 25 bp, Mus musculus
aggacgtctgcactttcgctcacca

SEQ ID NO: 336791 - DNA, 25 bp, Mus musculus
accgcagtagaatcgtccacaggca

SEQ ID NO: 336792 - DNA, 25 bp, Mus musculus
tctgcaagagccgaggacgtctgca

SEQ ID NO: 336793 - DNA, 25 bp, Mus musculus
gtagaatcgtccacaggcacaggtg

SEQ ID NO: 336794 - DNA, 25 bp, Mus musculus
aaccttgtgggtggcccacgccagc

SEQ ID NO: 336795 - DNA, 25 bp, Mus musculus
gcgcgcgcacttcactacccacgca

SEQ ID NO: 336796 - DNA, 25 bp, Mus musculus
cagcggcagacacctgaaccttgtg

SEQ ID NO: 336797 - DNA, 25 bp, Mus musculus
cccgcctggagggatctgcaagagc

SEQ ID NO: 336798 - DNA, 25 bp, Mus musculus
tgacgactgcaggatgcggaagtac

SEQ ID NO: 336799 - DNA, 25 bp, Mus musculus
tgcaggatgcggaagtacaccgacc

SEQ ID NO: 336800 - DNA, 25 bp, Mus musculus
tccacaggcacaggtgacgactgca

SEQ ID NO: 336801 - DNA, 25 bp, Mus musculus
tgacgtcatagaggcccggctacgt

SEQ ID NO: 336802 - DNA, 25 bp, Mus musculus
cgccacgggaaatggtctggctttc

SEQ ID NO: 336803 - DNA, 25 bp, Mus musculus
tcccgctgccgccacgggaaatggt

SEQ ID NO: 336804 - DNA, 25 bp, Mus musculus
ctcgcggataaaggcgtcccgctgc

SEQ ID NO: 336805 - DNA, 25 bp, Mus musculus
agtacccacctcaagctcgcggata

SEQ ID NO: 336806 - DNA, 25 bp, Mus musculus
tgttgacggacgtgtgcctcgccct

SEQ ID NO: 336807 - DNA, 25 bp, Mus musculus
cgtccgccgcaagtttgattgaagc

SEQ ID NO: 336808 - DNA, 25 bp, Mus musculus
agcagccagcgttggctctccgttc

SEQ ID NO: 336809 - DNA, 25 bp, Mus musculus
atagaggcccggctacgtccgcagc

SEQ ID NO: 336810 - DNA, 25 bp, Mus musculus
cccacaaacctgacggcggaagtga

SEQ ID NO: 336811 - DNA, 25 bp, Mus musculus
aggtgaggaatgtgaagaatgaccc

SEQ ID NO: 336812 - DNA, 25 bp, Mus musculus
ggcagcgcgcattcctattggcgga

SEQ ID NO: 336813 - DNA, 25 bp, Mus musculus
ttcctattggcggacgctgttgacg

SEQ ID NO: 336814 - DNA, 25 bp, Mus musculus
ccagtcacgccacagcggggaggta

SEQ ID NO: 336815 - DNA, 25 bp, Mus musculus
ggactccgaacctcttggcgcgctt

SEQ ID NO: 336816 - DNA, 25 bp, Mus musculus
gcttcgctcacggaaccacgtgttc

SEQ ID NO: 336817 - DNA, 25 bp, Mus musculus
ctgctctggagcttcgctcacggaa

SEQ ID NO: 336818 - DNA, 25 bp, Mus musculus
ccggaggaccctcagggccatgaga

SEQ ID NO: 336819 - DNA, 25 bp, Mus musculus
gttttcgaacatgtgggagccgctg

SEQ ID NO: 336820 - DNA, 25 bp, Mus musculus
gacgcggcggacagcttctaaggtt

SEQ ID NO: 336821 - DNA, 25 bp, Mus musculus
agccaatggagactcgaggcggccc

SEQ ID NO: 336822 - DNA, 25 bp, Mus musculus
ccgacgggtcggtgtctcacgtcta

SEQ ID NO: 336823 - DNA, 25 bp, Mus musculus
cgcctaactggctgcggactccgaa

SEQ ID NO: 336824 - DNA, 25 bp, Mus musculus
ccgccgcgtaaggacaaccgtctgg

SEQ ID NO: 336825 - DNA, 25 bp, Mus musculus
tccaaataacgcctccctggataac

SEQ ID NO: 336826 - DNA, 25 bp, Mus musculus
gcctctagggatgcgcctccaaata

SEQ ID NO: 336827 - DNA, 25 bp, Mus musculus
atccgagtgtcgcagcacttgagca

SEQ ID NO: 336828 - DNA, 25 bp, Mus musculus
gtgcacgtgatacgcgccagccaat

SEQ ID NO: 336829 - DNA, 25 bp, Mus musculus
gagtccttcgttgctgggccacccg

SEQ ID NO: 336830 - DNA, 25 bp, Mus musculus
ctcctgcggcctggagtccttcgtt

SEQ ID NO: 336831 - DNA, 25 bp, Mus musculus
caaggatctcctgcggcctggagtc

SEQ ID NO: 336832 - DNA, 25 bp, Mus musculus
gcggaagaaactgcgccaaggatct

SEQ ID NO: 336833 - DNA, 25 bp, Mus musculus
ccctcttggcggaagaaactgcgcc

SEQ ID NO: 336834 - DNA, 25 bp, Mus musculus
cttccgggttcgcaagtgggaaatg

SEQ ID NO: 336835 - DNA, 25 bp, Mus musculus
tgggacgctgaggtcaccttttcca

SEQ ID NO: 336836 - DNA, 25 bp, Mus musculus
gctgaggtcaccttttccaccgtgc

SEQ ID NO: 336837 - DNA, 25 bp, Mus musculus
gaggtcaccttttccaccgtgcctg

SEQ ID NO: 336838 - DNA, 25 bp, Mus musculus
cttttccaccgtgcctgcctctccc

SEQ ID NO: 336839 - DNA, 25 bp, Mus musculus
tcccagagcggccagtttccgggat

SEQ ID NO: 336840 - DNA, 25 bp, Mus musculus
tagtttaggcgacaggcgggaggcc

SEQ ID NO: 336841 - DNA, 25 bp, Mus musculus
ctggagtccttcgttgctgggccac

SEQ ID NO: 336842 - DNA, 25 bp, Mus musculus
cagagcggccagtttccgggatttt

SEQ ID NO: 336843 - DNA, 25 bp, Mus musculus
gtgcggatcaccgaccgcatcgcta

SEQ ID NO: 336844 - DNA, 25 bp, Mus musculus
cttcgcgcactccaacgggaaagtg

SEQ ID NO: 336845 - DNA, 25 bp, Mus musculus
atcgaagagatcctcactgagcctc

SEQ ID NO: 336846 - DNA, 25 bp, Mus musculus
gtgcgagcaatgagctaggcagaaa

SEQ ID NO: 336847 - DNA, 25 bp, Mus musculus
aaccaggccttgtgtcctcgcgtca

SEQ ID NO: 336848 - DNA, 25 bp, Mus musculus
tcgcgtcagaccagaagagagtttg

SEQ ID NO: 336849 - DNA, 25 bp, Mus musculus
tcagggcggcttcgagttttttcga

SEQ ID NO: 336850 - DNA, 25 bp, Mus musculus
acctgggatgcagctcagcgcaggc

SEQ ID NO: 336851 - DNA, 25 bp, Mus musculus
ccctgtttctggagcgacctgggat

SEQ ID NO: 336852 - DNA, 25 bp, Mus musculus
ctggggttgtccgtaattcatcctc

SEQ ID NO: 336853 - DNA, 25 bp, Mus musculus
ttccacagccacctgggtacgtgca

SEQ ID NO: 336854 - DNA, 25 bp, Mus musculus
gcgagctgctcaagttcggcgtaca

SEQ ID NO: 336855 - DNA, 25 bp, Mus musculus
gctaccgcagcttcatgatcgaaga

SEQ ID NO: 336856 - DNA, 25 bp, Mus musculus
agagtttgtcttctgcttcagggcg

SEQ ID NO: 336857 - DNA, 25 bp, Mus musculus
agacagagaagccagcggagacgcc

SEQ ID NO: 336858 - DNA, 25 bp, Mus musculus
tccagcgtggccgaagcttctggtc

SEQ ID NO: 336859 - DNA, 25 bp, Mus musculus
tgaatgcggacaattaagggccaga

SEQ ID NO: 336860 - DNA, 25 bp, Mus musculus
ttaagggccagacaaggaaggacac

SEQ ID NO: 336861 - DNA, 25 bp, Mus musculus
acaggcccggaagccaatcccaggt

SEQ ID NO: 336862 - DNA, 25 bp, Mus musculus
caatcccaggtgtcagcgagcttct

SEQ ID NO: 336863 - DNA, 25 bp, Mus musculus
ccagtctgggagacttgtgtccagc

SEQ ID NO: 336864 - DNA, 25 bp, Mus musculus
tggtctttctcggacctccgcagtg

SEQ ID NO: 336865 - DNA, 25 bp, Mus musculus
gtgtgcggcgctccacgctcattca

SEQ ID NO: 336866 - DNA, 25 bp, Mus musculus
acacacttacttccgcgccttgggg

SEQ ID NO: 336867 - DNA, 25 bp, Mus musculus
cgcgtccatgccgtttgctttctaa

SEQ ID NO: 336868 - DNA, 25 bp, Mus musculus
cgagcccagcgaccgaaattgcgag

SEQ ID NO: 336869 - DNA, 25 bp, Mus musculus
agctcacggagcaagagcgtgccaa

SEQ ID NO: 336870 - DNA, 25 bp, Mus musculus
accgaaattgcgaggactgagcgtc

SEQ ID NO: 336871 - DNA, 25 bp, Mus musculus
agctctgagtctggtcgtttggaga

SEQ ID NO: 336872 - DNA, 25 bp, Mus musculus
gcaagggctgattgccggaagacct

SEQ ID NO: 336873 - DNA, 25 bp, Mus musculus
ggactcgcttccacgggtcctgagc

SEQ ID NO: 336874 - DNA, 25 bp, Mus musculus
ttgccggaagacctggaattctacg

SEQ ID NO: 336875 - DNA, 25 bp, Mus musculus
cgggtggtgtttcacgaagccctct

SEQ ID NO: 336876 - DNA, 25 bp, Mus musculus
gagcccggcttcattgggcctctgg

SEQ ID NO: 336877 - DNA, 25 bp, Mus musculus
cttccacgggtcctgagctctgagt

SEQ ID NO: 336878 - DNA, 25 bp, Mus musculus
ttggcaatgagcagaactcggggac

SEQ ID NO: 336879 - DNA, 25 bp, Mus musculus
tggcggcttggcaatgagcagaact

SEQ ID NO: 336880 - DNA, 25 bp, Mus musculus
acactctaggtctgcgctgcgtgca

SEQ ID NO: 336881 - DNA, 25 bp, Mus musculus
atcgacagcgctcgcggacactcta

SEQ ID NO: 336882 - DNA, 25 bp, Mus musculus
ggaaccgggcaaatcgacagcgctc

SEQ ID NO: 336883 - DNA, 25 bp, Mus musculus
gtgtttcacgaagccctctgaggga

SEQ ID NO: 336884 - DNA, 25 bp, Mus musculus
acctggaattctacgctgctctcgg

SEQ ID NO: 336885 - DNA, 25 bp, Mus musculus
tggagggtccctgcggacccggcca

SEQ ID NO: 336886 - DNA, 25 bp, Mus musculus
cggccaggtccttcagcgggttctg

SEQ ID NO: 336887 - DNA, 25 bp, Mus musculus
aacgcagacacagcgcgggtccctg

SEQ ID NO: 336888 - DNA, 25 bp, Mus musculus
gcgtcgctctctctgtcttcgggtc

SEQ ID NO: 336889 - DNA, 25 bp, Mus musculus
gcgcatccctgttccgcgtcgctct

SEQ ID NO: 336890 - DNA, 25 bp, Mus musculus
tgcatagcgcatccctgttccgcgt

SEQ ID NO: 336891 - DNA, 25 bp, Mus musculus
gattgcatagcgcatccctgttccg

SEQ ID NO: 336892 - DNA, 25 bp, Mus musculus
attcctccgattgcatagcgcatcc

SEQ ID NO: 336893 - DNA, 25 bp, Mus musculus
tgcattcctccgattgcatagcgca

SEQ ID NO: 336894 - DNA, 25 bp, Mus musculus
cagcctgcattcctccgattgcata

SEQ ID NO: 336895 - DNA, 25 bp, Mus musculus
aggccagcctgcattcctccgattg

SEQ ID NO: 336896 - DNA, 25 bp, Mus musculus
cccgcacccacgtgagctcaaggcc

SEQ ID NO: 336897 - DNA, 25 bp, Mus musculus
tccgattgcatagcgcatccctgtt

SEQ ID NO: 336898 - DNA, 25 bp, Mus musculus
ccaggtccttcagcgggttctggct

SEQ ID NO: 336899 - DNA, 25 bp, Mus musculus
ggcaatccatttgccgagggccggc

SEQ ID NO: 336900 - DNA, 25 bp, Mus musculus
aatgcggccgcctagcagatggccc

SEQ ID NO: 336901 - DNA, 25 bp, Mus musculus
gcggttccgtatttacactacatta

SEQ ID NO: 336902 - DNA, 25 bp, Mus musculus
cattaataatggtttaaacgctctc

SEQ ID NO: 336903 - DNA, 25 bp, Mus musculus
tgctgattaattggcaatccatttg

SEQ ID NO: 336904 - DNA, 25 bp, Mus musculus
ggccgccagcggttccgtatttaca

SEQ ID NO: 336905 - DNA, 25 bp, Mus musculus
ccggcctgccagacggtttcctgga

SEQ ID NO: 336906 - DNA, 25 bp, Mus musculus
ctgccagacggtttcctggaggccc

SEQ ID NO: 336907 - DNA, 25 bp, Mus musculus
gctccacatccagataaacacgctg

SEQ ID NO: 336908 - DNA, 25 bp, Mus musculus
tccagataaacacgctggggccggg

SEQ ID NO: 336909 - DNA, 25 bp, Mus musculus
agtccgcgggctgagctgctcagct

SEQ ID NO: 336910 - DNA, 25 bp, Mus musculus
ctcagctgcgcctcctggggagcag

SEQ ID NO: 336911 - DNA, 25 bp, Mus musculus
acgtgcgtcccgcagtggctggctc

SEQ ID NO: 336912 - DNA, 25 bp, Mus musculus
cgctctcataaatacatgctgatta

SEQ ID NO: 336913 - DNA, 25 bp, Mus musculus
tggatgatggagctgacttggctcc

SEQ ID NO: 336914 - DNA, 25 bp, Mus musculus
ttgcaccgcgtgtcgcgttccctag

SEQ ID NO: 336915 - DNA, 25 bp, Mus musculus
tcgcgttccctaggaggaggaatgt

SEQ ID NO: 336916 - DNA, 25 bp, Mus musculus
tccctaggaggaggaatgtgtcgta

SEQ ID NO: 336917 - DNA, 25 bp, Mus musculus
gaatgtgtcgtagcgcttgtgatga

SEQ ID NO: 336918 - DNA, 25 bp, Mus musculus
atggagctgacttggctccatggcc

SEQ ID NO: 336919 - DNA, 25 bp, Mus musculus
cgcggacgagctgctgaaaacccca

SEQ ID NO: 336920 - DNA, 25 bp, Mus musculus
gtgctagcggccaggtcaccagcct

SEQ ID NO: 336921 - DNA, 25 bp, Mus musculus
cactccatttgctgcgggtggatga

SEQ ID NO: 336922 - DNA, 25 bp, Mus musculus
aaacacactccatttgctgcgggtg

SEQ ID NO: 336923 - DNA, 25 bp, Mus musculus
cggcgacgcaaaacacactccattt

SEQ ID NO: 336924 - DNA, 25 bp, Mus musculus
catggcctctgtggtctttgcaccg

SEQ ID NO: 336925 - DNA, 25 bp, Mus musculus
cccgcaggtgctagcggccaggtca

SEQ ID NO: 336926 - DNA, 25 bp, Mus musculus
gcctggcggcgacgcaaaacacact

SEQ ID NO: 336927 - DNA, 25 bp, Mus musculus
atgcgcgcgcatctgctgcacaatc

SEQ ID NO: 336928 - DNA, 25 bp, Mus musculus
ctccagtagctccttggccgctttg

SEQ ID NO: 336929 - DNA, 25 bp, Mus musculus
agtctcgggactcgtcacgtggttc

SEQ ID NO: 336930 - DNA, 25 bp, Mus musculus
tctgctcggagcaggcgctccagta

SEQ ID NO: 336931 - DNA, 25 bp, Mus musculus
aagccagtggctttgggtatggttc

SEQ ID NO: 336932 - DNA, 25 bp, Mus musculus
gtaaagcacgcgtcctctgctcgga

SEQ ID NO: 336933 - DNA, 25 bp, Mus musculus
ctgcagcgtaagaagccagtggctt

SEQ ID NO: 336934 - DNA, 25 bp, Mus musculus
tgacagaccgagcaggcgcagtctc

SEQ ID NO: 336935 - DNA, 25 bp, Mus musculus
tttaagccgtgagcctgacagaccg

SEQ ID NO: 336936 - DNA, 25 bp, Mus musculus
caaggtcccagacgcggctctttaa

SEQ ID NO: 336937 - DNA, 25 bp, Mus musculus
ccctgtggctgagcctccgatcatt

SEQ ID NO: 336938 - DNA, 25 bp, Mus musculus
ctccgatcattcgtagggcctatga

SEQ ID NO: 336939 - DNA, 25 bp, Mus musculus
cagcgggaaccagcctgcgcaaggt

SEQ ID NO: 336940 - DNA, 25 bp, Mus musculus
ccctggcgctgcagcgtaagaagcc

SEQ ID NO: 336941 - DNA, 25 bp, Mus musculus
agcttcctctcaagtctggtcaaga

SEQ ID NO: 336942 - DNA, 25 bp, Mus musculus
cgtgatcataactgaggacgccggg

SEQ ID NO: 336943 - DNA, 25 bp, Mus musculus
ctggtacatcagtcgctgctgctgc

SEQ ID NO: 336944 - DNA, 25 bp, Mus musculus
tgctgctgcgaacggtagagtgttc

SEQ ID NO: 336945 - DNA, 25 bp, Mus musculus
agagtgttccttgcccgagaccggc

SEQ ID NO: 336946 - DNA, 25 bp, Mus musculus
tcaggtaagcccgaggaccaaaggc

SEQ ID NO: 336947 - DNA, 25 bp, Mus musculus
tgcaactgcttgtcaccctgagctt

SEQ ID NO: 336948 - DNA, 25 bp, Mus musculus
tctggtcaagactcaggtaagcccg

SEQ ID NO: 336949 - DNA, 25 bp, Mus musculus
ccagccagggattgagaaccgcgcc

SEQ ID NO: 336950 - DNA, 25 bp, Mus musculus
ctagtgcgggaaacgtctgtaaagc

SEQ ID NO: 336951 - DNA, 25 bp, Mus musculus
cacgacacgcgtggtgatggtttac

SEQ ID NO: 336952 - DNA, 25 bp, Mus musculus
atggtgacggccagtaagcgctagc

SEQ ID NO: 336953 - DNA, 25 bp, Mus musculus
gaggtcaccatgagtccggggttcc

SEQ ID NO: 336954 - DNA, 25 bp, Mus musculus
ggcgcgcagcactggtacatcagtc

SEQ ID NO: 336955 - DNA, 25 bp, Mus musculus
ctcgagcgcgccattgaagaagacg

SEQ ID NO: 336956 - DNA, 25 bp, Mus musculus
tctcgatgtagtcctggaagccctg

SEQ ID NO: 336957 - DNA, 25 bp, Mus musculus
ccaggtagccgagcatgtggttcca

SEQ ID NO: 336958 - DNA, 25 bp, Mus musculus
caccgtacaggcgatgcaggcagtt

SEQ ID NO: 336959 - DNA, 25 bp, Mus musculus
cccagtcggtgtagaagccaccgta

SEQ ID NO: 336960 - DNA, 25 bp, Mus musculus
cgccgctcacccagtcggtgtagaa

SEQ ID NO: 336961 - DNA, 25 bp, Mus musculus
atgtggttccactggccgccgctca

SEQ ID NO: 336962 - DNA, 25 bp, Mus musculus
tccgaagcaggccttggccagagcc

SEQ ID NO: 336963 - DNA, 25 bp, Mus musculus
cgacaagatggcgtcgctcccggga

SEQ ID NO: 336964 - DNA, 25 bp, Mus musculus
ctactcggcttgtcgggccctttag

SEQ ID NO: 336965 - DNA, 25 bp, Mus musculus
ggcagttgtcggcatccaccagcag

SEQ ID NO: 336966 - DNA, 25 bp, Mus musculus
cgctcggacagtgcttctcgatgta

SEQ ID NO: 336967 - DNA, 25 bp, Mus musculus
agagctcgatgttgcctccgaagca

SEQ ID NO: 336968 - DNA, 25 bp, Mus musculus
tggaagccctgcacgcccatggcgg

SEQ ID NO: 336969 - DNA, 25 bp, Mus musculus
gacgacctgctaggtgtccctgagg

SEQ ID NO: 336970 - DNA, 25 bp, Mus musculus
cgaacgggagagctcgatactcaca

SEQ ID NO: 336971 - DNA, 25 bp, Mus musculus
agcaggctccacaaaggacgcgggc

SEQ ID NO: 336972 - DNA, 25 bp, Mus musculus
aagcaccggacaggagcaggctcca

SEQ ID NO: 336973 - DNA, 25 bp, Mus musculus
tccctgagggctcaaaggagctaca

SEQ ID NO: 336974 - DNA, 25 bp, Mus musculus
ctgtctctagctgtcccagggactc

SEQ ID NO: 336975 - DNA, 25 bp, Mus musculus
gagccgggaacacggcctgtctcta

SEQ ID NO: 336976 - DNA, 25 bp, Mus musculus
tgcttcactcagctccgagccggga

SEQ ID NO: 336977 - DNA, 25 bp, Mus musculus
ttgcaaggggatgccctgcttcact

SEQ ID NO: 336978 - DNA, 25 bp, Mus musculus
ggccaaggacacacggaccctgcgt

SEQ ID NO: 336979 - DNA, 25 bp, Mus musculus
gccgtccatctctgcgggccaagga

SEQ ID NO: 336980 - DNA, 25 bp, Mus musculus
cggcgcgtcttgcagagtagaagca

SEQ ID NO: 336981 - DNA, 25 bp, Mus musculus
agtagaagcaccctgcgctgcagag

SEQ ID NO: 336982 - DNA, 25 bp, Mus musculus
gtcaaggccagtactggagcgaccc

SEQ ID NO: 336983 - DNA, 25 bp, Mus musculus
tcgggcactgaggagtatgagctca

SEQ ID NO: 336984 - DNA, 25 bp, Mus musculus
gctgcttccgggcaaagtcgtgctt

SEQ ID NO: 336985 - DNA, 25 bp, Mus musculus
agtcgtgcttgacctgtctctagcg

SEQ ID NO: 336986 - DNA, 25 bp, Mus musculus
gtctctagcgcaagtggtggcccac

SEQ ID NO: 336987 - DNA, 25 bp, Mus musculus
ggcggtctagcttgctgccgtcgcc

SEQ ID NO: 336988 - DNA, 25 bp, Mus musculus
tgcagagcccgcgtctggctggcac

SEQ ID NO: 336989 - DNA, 25 bp, Mus musculus
ctggcaccactcctcgggtggagaa

SEQ ID NO: 336990 - DNA, 25 bp, Mus musculus
gagaaggctggcattccgctctccg

SEQ ID NO: 336991 - DNA, 25 bp, Mus musculus
ggcgggagaagagtcaccgcctcct

SEQ ID NO: 336992 - DNA, 25 bp, Mus musculus
cgcctcctggttggaagctagcatc

SEQ ID NO: 336993 - DNA, 25 bp, Mus musculus
ctagcatcaggcagacagctacgtc

SEQ ID NO: 336994 - DNA, 25 bp, Mus musculus
agacagctacgtcaccacacggtga

SEQ ID NO: 336995 - DNA, 25 bp, Mus musculus
agtatgagctcaacggcgacctgcg

SEQ ID NO: 336996 - DNA, 25 bp, Mus musculus
ccgacgccttggtaagctctcagca

SEQ ID NO: 336997 - DNA, 25 bp, Mus musculus
tctccaatagctacccgggtcggcg

SEQ ID NO: 336998 - DNA, 25 bp, Mus musculus
cataagtgacctagcggagaaactc

SEQ ID NO: 336999 - DNA, 25 bp, Mus musculus
cgggagtcccgctccagctagcata

SEQ ID NO: 337000 - DNA, 25 bp, Mus musculus
aggagcttctcctgtagcgacgccg

SEQ ID NO: 337001 - DNA, 25 bp, Mus musculus
ctatactacgcgcagcagagagctc

SEQ ID NO: 337002 - DNA, 25 bp, Mus musculus
ccctttctgtacttcgcactggaga

SEQ ID NO: 337003 - DNA, 25 bp, Mus musculus
cccacctgtcatggcggaggacacg

SEQ ID NO: 337004 - DNA, 25 bp, Mus musculus
ggcgccagctgacgccaaggtcaca

SEQ ID NO: 337005 - DNA, 25 bp, Mus musculus
agcagactggcgaggagcaccattt

SEQ ID NO: 337006 - DNA, 25 bp, Mus musculus
agcggcgctctaaagtctcagcaga

SEQ ID NO: 337007 - DNA, 25 bp, Mus musculus
agctacccaggtttgcagcgccggt

SEQ ID NO: 337008 - DNA, 25 bp, Mus musculus
ggcgtctccctggtactacaagcta

SEQ ID NO: 337009 - DNA, 25 bp, Mus musculus
gagaaactcagtacccaagtccttg

SEQ ID NO: 337010 - DNA, 25 bp, Mus musculus
cccaagtccttgtctggaccagaga

SEQ ID NO: 337011 - DNA, 25 bp, Mus musculus
cgcgccctccaagacgctagagttg

SEQ ID NO: 337012 - DNA, 25 bp, Mus musculus
gcgaccgtcgccgaatccgtgcaaa

SEQ ID NO: 337013 - DNA, 25 bp, Mus musculus
tccgtgcaaacgctaagaggtgccc

SEQ ID NO: 337014 - DNA, 25 bp, Mus musculus
aaagttcgttctcgagaaggccctg

SEQ ID NO: 337015 - DNA, 25 bp, Mus musculus
agaaggccctggcagtgcgatgcac

SEQ ID NO: 337016 - DNA, 25 bp, Mus musculus
gacttccgcaggcacctgggactgc

SEQ ID NO: 337017 - DNA, 25 bp, Mus musculus
cttctccgtcggtgaagagggcact

SEQ ID NO: 337018 - DNA, 25 bp, Mus musculus
gggcactgagaactgcggccctagc

SEQ ID NO: 337019 - DNA, 25 bp, Mus musculus
tagccctcacctgtctggttcactg

SEQ ID NO: 337020 - DNA, 25 bp, Mus musculus
agacgttcggcgcatcctgagcgct

SEQ ID NO: 337021 - DNA, 25 bp, Mus musculus
tggctgtctctagccacacccaggt

SEQ ID NO: 337022 - DNA, 25 bp, Mus musculus
gctagagttgaactttagtccggtc

SEQ ID NO: 337023 - DNA, 25 bp, Mus musculus
aggtgaagccggctccgacttccgc

SEQ ID NO: 337024 - DNA, 25 bp, Mus musculus
ctccgcagtgttctgtggagcttgc

SEQ ID NO: 337025 - DNA, 25 bp, Mus musculus
ccgagaccacgcgtgagaagatcca

SEQ ID NO: 337026 - DNA, 25 bp, Mus musculus
ctcaagctgcagttcgaggagctcg

SEQ ID NO: 337027 - DNA, 25 bp, Mus musculus
accagccatgctctgacgtttcagg

SEQ ID NO: 337028 - DNA, 25 bp, Mus musculus
gcggcccgccacaagtcattcaaat

SEQ ID NO: 337029 - DNA, 25 bp, Mus musculus
ctcgaggtggactatgaggccatcc

SEQ ID NO: 337030 - DNA, 25 bp, Mus musculus
tccatgctcagtgggactgcagccc

SEQ ID NO: 337031 - DNA, 25 bp, Mus musculus
ccgcagcgagatggagcagctcaaa

SEQ ID NO: 337032 - DNA, 25 bp, Mus musculus
tttagaccaatcacaagcgcggacc

SEQ ID NO: 337033 - DNA, 25 bp, Mus musculus
cgggcaaagcagtgagcgtaaaata

SEQ ID NO: 337034 - DNA, 25 bp, Mus musculus
agacgcgcccgccaatcaacgattg

SEQ ID NO: 337035 - DNA, 25 bp, Mus musculus
ctacttttgtcacgtcagacgcgcc

SEQ ID NO: 337036 - DNA, 25 bp, Mus musculus
ctacgggttgtgtagtccatgctca

SEQ ID NO: 337037 - DNA, 25 bp, Mus musculus
actcgtgatatccacagctcggatc

SEQ ID NO: 337038 - DNA, 25 bp, Mus musculus
caggacgcgaatcttactcgtgata

SEQ ID NO: 337039 - DNA, 25 bp, Mus musculus
ccctgaggggtgtgtttgccacctt

SEQ ID NO: 337040 - DNA, 25 bp, Mus musculus
tggtcaccatcgtccgcatctctaa

SEQ ID NO: 337041 - DNA, 25 bp, Mus musculus
gcatctctaacgcacactggccaga

SEQ ID NO: 337042 - DNA, 25 bp, Mus musculus
acgcacactggccagagggaccgag

SEQ ID NO: 337043 - DNA, 25 bp, Mus musculus
gagtgtgcacctgggaaaaagtccc

SEQ ID NO: 337044 - DNA, 25 bp, Mus musculus
ccaggatcacatggcggtggagact

SEQ ID NO: 337045 - DNA, 25 bp, Mus musculus
acagctacaggtagacaggcagccc

SEQ ID NO: 337046 - DNA, 25 bp, Mus musculus
gtgtgtttgccaccttgacccgggc

SEQ ID NO: 337047 - DNA, 25 bp, Mus musculus
cacccggggctgaggctcttaccga

SEQ ID NO: 337048 - DNA, 25 bp, Mus musculus
gctcacagggaagtgtaaagcattg

SEQ ID NO: 337049 - DNA, 25 bp, Mus musculus
tgtgagtcacatcgctccgcggcac

SEQ ID NO: 337050 - DNA, 25 bp, Mus musculus
ctcgagcgacttcctgctgccagga

SEQ ID NO: 337051 - DNA, 25 bp, Mus musculus
acccaggaacagctacaggtagaca

SEQ ID NO: 337052 - DNA, 25 bp, Mus musculus
gtgtaaagcattggtcaccatcgtc

SEQ ID NO: 337053 - DNA, 25 bp, Mus musculus
cgactattatcgtgagggccagggc

SEQ ID NO: 337054 - DNA, 25 bp, Mus musculus
tatgaacatctacaacctgatcgcc

SEQ ID NO: 337055 - DNA, 25 bp, Mus musculus
agctgtcccggcagcggattgcctc

SEQ ID NO: 337056 - DNA, 25 bp, Mus musculus
tggaccgtacgaccgagctgtcccg

SEQ ID NO: 337057 - DNA, 25 bp, Mus musculus
accagatcaagcacctgcaggcagc

SEQ ID NO: 337058 - DNA, 25 bp, Mus musculus
ctgatcgccatcatccgagaccaga

SEQ ID NO: 337059 - DNA, 25 bp, Mus musculus
cccgccgggaacctatgaacatcta

SEQ ID NO: 337060 - DNA, 25 bp, Mus musculus
tcttcactgccgtcacctctgagtg

SEQ ID NO: 337061 - DNA, 25 bp, Mus musculus
gggacaacagtccttcacccagttc

SEQ ID NO: 337062 - DNA, 25 bp, Mus musculus
tgcccaaggggctgttggccacaga

SEQ ID NO: 337063 - DNA, 25 bp, Mus musculus
aaggctggccgcaccagcccagagg

SEQ ID NO: 337064 - DNA, 25 bp, Mus musculus
agacgcccaaccgtgtcatgctcga

SEQ ID NO: 337065 - DNA, 25 bp, Mus musculus
ggtcacctgtcctcttgcccaaggg

SEQ ID NO: 337066 - DNA, 25 bp, Mus musculus
accgtgtcatgctcgactattatcg

SEQ ID NO: 337067 - DNA, 25 bp, Mus musculus
gcatttactgtgattagggctgtgg

SEQ ID NO: 337068 - DNA, 25 bp, Mus musculus
gcagcgagaagcacagcatttactg

SEQ ID NO: 337069 - DNA, 25 bp, Mus musculus
accaggtgttctgcagcgagaagca

SEQ ID NO: 337070 - DNA, 25 bp, Mus musculus
ctggccaaccaggtgttctgcagcg

SEQ ID NO: 337071 - DNA, 25 bp, Mus musculus
agcgtaagtcacacctgcgcctgcg

SEQ ID NO: 337072 - DNA, 25 bp, Mus musculus
tcaccgagcgtaagtcacacctgcg

SEQ ID NO: 337073 - DNA, 25 bp, Mus musculus
aagccagcctcaccgagcgtaagtc

SEQ ID NO: 337074 - DNA, 25 bp, Mus musculus
tgtggggcgccgcacacctaacgtc

SEQ ID NO: 337075 - DNA, 25 bp, Mus musculus
tgctaggccgctcctaacgtgacta

SEQ ID NO: 337076 - DNA, 25 bp, Mus musculus
aggccgctcctaacgtgactaacgc

SEQ ID NO: 337077 - DNA, 25 bp, Mus musculus
gacagcagtgctaggccgctcctaa

SEQ ID NO: 337078 - DNA, 25 bp, Mus musculus
taacgtgactaacgcacagagggcg

SEQ ID NO: 337079 - DNA, 25 bp, Mus musculus
ctgcagcagcgggacagcagtgcta

SEQ ID NO: 337080 - DNA, 25 bp, Mus musculus
cctaacgtccgcttcacctcaacta

SEQ ID NO: 337081 - DNA, 25 bp, Mus musculus
aacaagagccttgtggtggcccacg

SEQ ID NO: 337082 - DNA, 25 bp, Mus musculus
tccgcgtttcggaagtgagtcactc

SEQ ID NO: 337083 - DNA, 25 bp, Mus musculus
actctttcctcatgcgctgtgcgtg

SEQ ID NO: 337084 - DNA, 25 bp, Mus musculus
gtcccgtcagtactctttcctcatg

SEQ ID NO: 337085 - DNA, 25 bp, Mus musculus
ggttctctctgtcccgtcagtactc

SEQ ID NO: 337086 - DNA, 25 bp, Mus musculus
tagtgtcccttctcggttctctctg

SEQ ID NO: 337087 - DNA, 25 bp, Mus musculus
gctcccgaagctctgtgcctggtac

SEQ ID NO: 337088 - DNA, 25 bp, Mus musculus
ccatggcgaaggcaacaagagcctt

SEQ ID NO: 337089 - DNA, 25 bp, Mus musculus
atggacgagaatgaatggagttacc

SEQ ID NO: 337090 - DNA, 25 bp, Mus musculus
ggagcagatccggaaacctcccttc

SEQ ID NO: 337091 - DNA, 25 bp, Mus musculus
aagatccagccgtggccctaggaca

SEQ ID NO: 337092 - DNA, 25 bp, Mus musculus
gtcactctgccagcacataatatgg

SEQ ID NO: 337093 - DNA, 25 bp, Mus musculus
taccgtccaggtacccaggtcgtga

SEQ ID NO: 337094 - DNA, 25 bp, Mus musculus
tgacaggcgcttttcttcagacggc

SEQ ID NO: 337095 - DNA, 25 bp, Mus musculus
cccagcgttttgcagcattctgcac

SEQ ID NO: 337096 - DNA, 25 bp, Mus musculus
aagtagcccggagaatggcagtctg

SEQ ID NO: 337097 - DNA, 25 bp, Mus musculus
cggaatccatggctaccgacgtgga

SEQ ID NO: 337098 - DNA, 25 bp, Mus musculus
attctgcactctcgctgcagcgctg

SEQ ID NO: 337099 - DNA, 25 bp, Mus musculus
tggaaccctgaaggtgaagtagccc

SEQ ID NO: 337100 - DNA, 25 bp, Mus musculus
ctgacggcccgcgaaatgtcgcgtc

SEQ ID NO: 337101 - DNA, 25 bp, Mus musculus
cctcgggcagccaggagacttcaag

SEQ ID NO: 337102 - DNA, 25 bp, Mus musculus
atgtcgcgtcgagcgtctagacacc

SEQ ID NO: 337103 - DNA, 25 bp, Mus musculus
cctctgcgagttggttcgttccaaa

SEQ ID NO: 337104 - DNA, 25 bp, Mus musculus
tgggccagccgagctcttacgtcac

SEQ ID NO: 337105 - DNA, 25 bp, Mus musculus
tcggaagcacgaggaaaggagtctc

SEQ ID NO: 337106 - DNA, 25 bp, Mus musculus
ttcacttccgcctacttgaaccgga

SEQ ID NO: 337107 - DNA, 25 bp, Mus musculus
ttgaaccggaaatcaggaaccacgc

SEQ ID NO: 337108 - DNA, 25 bp, Mus musculus
gcagttcgcgggtctcggaatccat

SEQ ID NO: 337109 - DNA, 25 bp, Mus musculus
agctgaagcctggtctgggctccaa

SEQ ID NO: 337110 - DNA, 25 bp, Mus musculus
accacatgatctgctgggcggcctt

SEQ ID NO: 337111 - DNA, 25 bp, Mus musculus
cagtgcgtgatcctaacctgtgtgc

SEQ ID NO: 337112 - DNA, 25 bp, Mus musculus
ccacgggccaagtctagggtgattc

SEQ ID NO: 337113 - DNA, 25 bp, Mus musculus
ctgcggctgggaaaacatctgtgcc

SEQ ID NO: 337114 - DNA, 25 bp, Mus musculus
gggctccaatgccaagaatcctgtg

SEQ ID NO: 337115 - DNA, 25 bp, Mus musculus
tctcacctgcgtgaagtacaagttc

SEQ ID NO: 337116 - DNA, 25 bp, Mus musculus
tgtgcatgggcctttcaggacctca

SEQ ID NO: 337117 - DNA, 25 bp, Mus musculus
aacgagttggctgccacgaagtctc

SEQ ID NO: 337118 - DNA, 25 bp, Mus musculus
agacgctctggtagctgagccgctt

SEQ ID NO: 337119 - DNA, 25 bp, Mus musculus
agccgcttgtgacggtagcgcagca

SEQ ID NO: 337120 - DNA, 25 bp, Mus musculus
gccagagctgcgcatagatgaacac

SEQ ID NO: 337121 - DNA, 25 bp, Mus musculus
gcttcatcagggctcgcagccgttc

SEQ ID NO: 337122 - DNA, 25 bp, Mus musculus
tagccgggaaaacaagccgcacttc

SEQ ID NO: 337123 - DNA, 25 bp, Mus musculus
gaccaatcgccacacgtgttgtttg

SEQ ID NO: 337124 - DNA, 25 bp, Mus musculus
gtgtaacaacctccagacagcacga

SEQ ID NO: 337125 - DNA, 25 bp, Mus musculus
ccttctgggccgcagagtgaggccc

SEQ ID NO: 337126 - DNA, 25 bp, Mus musculus
gccgcaccctcttgtccttctgggc

SEQ ID NO: 337127 - DNA, 25 bp, Mus musculus
tctccgggttcccaggtaagccgca

SEQ ID NO: 337128 - DNA, 25 bp, Mus musculus
cgagctctccgggttcccaggtaag

SEQ ID NO: 337129 - DNA, 25 bp, Mus musculus
aggctgcaacctgagcgagctctcc

SEQ ID NO: 337130 - DNA, 25 bp, Mus musculus
aacgtggtcgcaggctgcaacctga

SEQ ID NO: 337131 - DNA, 25 bp, Mus musculus
gcatcacctccagacgcggaacgtg

SEQ ID NO: 337132 - DNA, 25 bp, Mus musculus
tccagacagcacgaggcggtgaaaa

SEQ ID NO: 337133 - DNA, 25 bp, Mus musculus
tttgtaggtgttggatggcacacgc

SEQ ID NO: 337134 - DNA, 25 bp, Mus musculus
gtattgcatcacctccagacgcgga

SEQ ID NO: 337135 - DNA, 25 bp, Mus musculus
gcctggcactgtcagtattgcatca

SEQ ID NO: 337136 - DNA, 25 bp, Mus musculus
atggcacacgctgattgggcgccgc

SEQ ID NO: 337137 - DNA, 25 bp, Mus musculus
gtggagaaggtcatcgaccgatgtc

SEQ ID NO: 337138 - DNA, 25 bp, Mus musculus
tggaacgcttgccttgcaaaagtca

SEQ ID NO: 337139 - DNA, 25 bp, Mus musculus
cccagcacctgatcgctggtgtgcg

SEQ ID NO: 337140 - DNA, 25 bp, Mus musculus
aggacagcctttccggagagggaca

SEQ ID NO: 337141 - DNA, 25 bp, Mus musculus
acgaggagcccgagtcccaggacag

SEQ ID NO: 337142 - DNA, 25 bp, Mus musculus
ggactgccgcgcatagcacacgagc

SEQ ID NO: 337143 - DNA, 25 bp, Mus musculus
accgatgtcaccgagtcattcctga

SEQ ID NO: 337144 - DNA, 25 bp, Mus musculus
tttcaccgttacaaggcagcagagc

SEQ ID NO: 337145 - DNA, 25 bp, Mus musculus
tcaccgacaggctgtggagaaggtc

SEQ ID NO: 337146 - DNA, 25 bp, Mus musculus
gacaccttgtggagcaggtggccca

SEQ ID NO: 337147 - DNA, 25 bp, Mus musculus
gctggagagtttcaagtgggacacc

SEQ ID NO: 337148 - DNA, 25 bp, Mus musculus
gctcttcctggtggcactcatgctg

SEQ ID NO: 337149 - DNA, 25 bp, Mus musculus
caaaagtcatagttgcggctgatgg

SEQ ID NO: 337150 - DNA, 25 bp, Mus musculus
ttcctgaagcggttgtacttggtgc

SEQ ID NO: 337151 - DNA, 25 bp, Mus musculus
tgctgccagtgcgtgggtgaagtag

SEQ ID NO: 337152 - DNA, 25 bp, Mus musculus
gctgcaggtgcacgtgggtgttgct

SEQ ID NO: 337153 - DNA, 25 bp, Mus musculus
ttgaccggttatcctagaaacgctg

SEQ ID NO: 337154 - DNA, 25 bp, Mus musculus
ccggttatcctagaaacgctgctaa

SEQ ID NO: 337155 - DNA, 25 bp, Mus musculus
tcctagaaacgctgctaaacctccg

SEQ ID NO: 337156 - DNA, 25 bp, Mus musculus
tagaaacgctgctaaacctccgcct

SEQ ID NO: 337157 - DNA, 25 bp, Mus musculus
acgctgctaaacctccgcctcctaa

SEQ ID NO: 337158 - DNA, 25 bp, Mus musculus
gcctcctaactctggcggactgtgg

SEQ ID NO: 337159 - DNA, 25 bp, Mus musculus
taactctggcggactgtggcatcct

SEQ ID NO: 337160 - DNA, 25 bp, Mus musculus
ggactgtggcatcctcccttgcgca

SEQ ID NO: 337161 - DNA, 25 bp, Mus musculus
gtggcatcctcccttgcgcactttg

SEQ ID NO: 337162 - DNA, 25 bp, Mus musculus
ccttgcgcactttgcgggcgcggca

SEQ ID NO: 337163 - DNA, 25 bp, Mus musculus
aggcaggcgcatgtgggtgctgcca

SEQ ID NO: 337164 - DNA, 25 bp, Mus musculus
gttgctggctcacgaggctgctgct

SEQ ID NO: 337165 - DNA, 25 bp, Mus musculus
tctcaatatctcttggggtcgccgg

SEQ ID NO: 337166 - DNA, 25 bp, Mus musculus
ggtaacggctccagacgctgtaaca

SEQ ID NO: 337167 - DNA, 25 bp, Mus musculus
agttcacgaccgcaaaccgcactgg

SEQ ID NO: 337168 - DNA, 25 bp, Mus musculus
cagcgcctagtctgggagttcacga

SEQ ID NO: 337169 - DNA, 25 bp, Mus musculus
tccgggcagccttgctttgtgtagt

SEQ ID NO: 337170 - DNA, 25 bp, Mus musculus
tcgatgagcactacgagtaccggtg

SEQ ID NO: 337171 - DNA, 25 bp, Mus musculus
ggatggcccacaagcagatctacta

SEQ ID NO: 337172 - DNA, 25 bp, Mus musculus
tcgttggcctcattcgagtcgttgc

SEQ ID NO: 337173 - DNA, 25 bp, Mus musculus
ttcaaatccagagcgttgggcctgc

SEQ ID NO: 337174 - DNA, 25 bp, Mus musculus
gccaagcgtaattagcgttgccatc

SEQ ID NO: 337175 - DNA, 25 bp, Mus musculus
ggcgctcctcgctgaatcgttagcc

SEQ ID NO: 337176 - DNA, 25 bp, Mus musculus
cacgcgctgcgaggcacttaacgac

SEQ ID NO: 337177 - DNA, 25 bp, Mus musculus
cacccgacgggcattatcgagtgtc

SEQ ID NO: 337178 - DNA, 25 bp, Mus musculus
tcgcaatcttgcaacaggcttctga

SEQ ID NO: 337179 - DNA, 25 bp, Mus musculus
cacgtaagagctcagccgcgccctt

SEQ ID NO: 337180 - DNA, 25 bp, Mus musculus
atccactctaaattggccaaacgcg

SEQ ID NO: 337181 - DNA, 25 bp, Mus musculus
ggccgtcccagaaatccactctaaa

SEQ ID NO: 337182 - DNA, 25 bp, Mus musculus
cgcgcctgccatgaccgctagatgg

SEQ ID NO: 337183 - DNA, 25 bp, Mus musculus
cataggctacctacggcctcgggca

SEQ ID NO: 337184 - DNA, 25 bp, Mus musculus
gcgaaatgataacacataggctacc

SEQ ID NO: 337185 - DNA, 25 bp, Mus musculus
cctctcacggttcggccagcgaaat

SEQ ID NO: 337186 - DNA, 25 bp, Mus musculus
ttaggcgcgccgctagcttcacggc

SEQ ID NO: 337187 - DNA, 25 bp, Mus musculus
aaacgctgagtcgttggttaggcgc

SEQ ID NO: 337188 - DNA, 25 bp, Mus musculus
tcggtgacgtacgtcctggcgccgc

SEQ ID NO: 337189 - DNA, 25 bp, Mus musculus
tccgtcgcgcctcggtgacgtacgt

SEQ ID NO: 337190 - DNA, 25 bp, Mus musculus
ccagtcttccacgtgcggctccgga

SEQ ID NO: 337191 - DNA, 25 bp, Mus musculus
ctagagctgtcgctgccccagtctt

SEQ ID NO: 337192 - DNA, 25 bp, Mus musculus
cgcgcccttcctggcccaccacaag

SEQ ID NO: 337193 - DNA, 25 bp, Mus musculus
cgcgcatgcgcaccatagccgagat

SEQ ID NO: 337194 - DNA, 25 bp, Mus musculus
tcgcgcactgtgcagagttccagta

SEQ ID NO: 337195 - DNA, 25 bp, Mus musculus
tgcagagttccagtaccggagtggc

SEQ ID NO: 337196 - DNA, 25 bp, Mus musculus
ccagtaccggagtggcggattcgca

SEQ ID NO: 337197 - DNA, 25 bp, Mus musculus
tggtcccggagttcagcggccgcac

SEQ ID NO: 337198 - DNA, 25 bp, Mus musculus
tcagctctgggctgtgcgccgcagc

SEQ ID NO: 337199 - DNA, 25 bp, Mus musculus
gcgcgaaactttccgctcgcagaga

SEQ ID NO: 337200 - DNA, 25 bp, Mus musculus
acggggctcatgctccgcccggtaa

SEQ ID NO: 337201 - DNA, 25 bp, Mus musculus
atgctccgcccggtaatagtgggga

SEQ ID NO: 337202 - DNA, 25 bp, Mus musculus
accaggtcgacccagggcagtgtgt

SEQ ID NO: 337203 - DNA, 25 bp, Mus musculus
cccggatgcggtgccgcgcgcttat

SEQ ID NO: 337204 - DNA, 25 bp, Mus musculus
gagcggagatctatagcctgggtcc

SEQ ID NO: 337205 - DNA, 25 bp, Mus musculus
tctatagcctgggtccggtgtaccc

SEQ ID NO: 337206 - DNA, 25 bp, Mus musculus
agacgaactccacgcgcgaaacttt

SEQ ID NO: 337207 - DNA, 25 bp, Mus musculus
gcaccgatcaaggagtcagcacccg

SEQ ID NO: 337208 - DNA, 25 bp, Mus musculus
ttccgggcggttctagaataacgca

SEQ ID NO: 337209 - DNA, 25 bp, Mus musculus
tcgagctaaagctggtggtggttcc

SEQ ID NO: 337210 - DNA, 25 bp, Mus musculus
aacgcagcccgaatcttccaggaag

SEQ ID NO: 337211 - DNA, 25 bp, Mus musculus
gcctgggagaccgaaatagaagctg

SEQ ID NO: 337212 - DNA, 25 bp, Mus musculus
ccagcaacaggtgcagctcgagcta

SEQ ID NO: 337213 - DNA, 25 bp, Mus musculus
tggtcaagtcgcatccgctgcctgt

SEQ ID NO: 337214 - DNA, 25 bp, Mus musculus
ctggaaaacgcggtggaaatgtaga

SEQ ID NO: 337215 - DNA, 25 bp, Mus musculus
aggggacccaaaggatcctgatgcg

SEQ ID NO: 337216 - DNA, 25 bp, Mus musculus
tcctgatgcgaacgcagagggagtc

SEQ ID NO: 337217 - DNA, 25 bp, Mus musculus
ccaggtgggaatgcagactaggtcc

SEQ ID NO: 337218 - DNA, 25 bp, Mus musculus
gagaggctccaacagggttcctagg

SEQ ID NO: 337219 - DNA, 25 bp, Mus musculus
agtcgcttacctggagcgcgcgtcc

SEQ ID NO: 337220 - DNA, 25 bp, Mus musculus
ttccaggaagccaccgccttgcagt

SEQ ID NO: 337221 - DNA, 25 bp, Mus musculus
cagcacctgatcgtagttggggagc

SEQ ID NO: 337222 - DNA, 25 bp, Mus musculus
gccagatcatgactagggtgccaga

SEQ ID NO: 337223 - DNA, 25 bp, Mus musculus
gagcctgatatacgggcgccagatc

SEQ ID NO: 337224 - DNA, 25 bp, Mus musculus
cattcgattcgtgtctagagctaga

SEQ ID NO: 337225 - DNA, 25 bp, Mus musculus
ggcgcgggaccagaattactgcatt

SEQ ID NO: 337226 - DNA, 25 bp, Mus musculus
ggccttgtctggtagtggtcttaca

SEQ ID NO: 337227 - DNA, 25 bp, Mus musculus
ttcgtggatcgcacaatgactctgg

SEQ ID NO: 337228 - DNA, 25 bp, Mus musculus
ggttccctccgcactcttttggata

SEQ ID NO: 337229 - DNA, 25 bp, Mus musculus
gcgcatcggactctgggaatcttta

SEQ ID NO: 337230 - DNA, 25 bp, Mus musculus
gcgcgccgagcctgtctataaaagg

SEQ ID NO: 337231 - DNA, 25 bp, Mus musculus
ggcctgccgcctcatttgcatcaga

SEQ ID NO: 337232 - DNA, 25 bp, Mus musculus
gcggcagatttgaggctgtgtcatc

SEQ ID NO: 337233 - DNA, 25 bp, Mus musculus
ggggcttttacattctccaagtgtg

SEQ ID NO: 337234 - DNA, 25 bp, Mus musculus
gtctgcctggtaacaccctgacaaa

SEQ ID NO: 337235 - DNA, 25 bp, Mus musculus
tgctggctctggagtggccctccga

SEQ ID NO: 337236 - DNA, 25 bp, Mus musculus
agtgtccggagaggctgctagcaca

SEQ ID NO: 337237 - DNA, 25 bp, Mus musculus
gaaggcctaggcgaggacgttggcc

SEQ ID NO: 337238 - DNA, 25 bp, Mus musculus
tgctagcacaggaaggcctaggcga

SEQ ID NO: 337239 - DNA, 25 bp, Mus musculus
gctgctagcacaggaaggcctaggc

SEQ ID NO: 337240 - DNA, 25 bp, Mus musculus
gaggctgctagcacaggaaggccta

SEQ ID NO: 337241 - DNA, 25 bp, Mus musculus
tccggagaggctgctagcacaggaa

SEQ ID NO: 337242 - DNA, 25 bp, Mus musculus
ccagtgtccggagaggctgctagca

SEQ ID NO: 337243 - DNA, 25 bp, Mus musculus
actctgccagtgtccggagaggctg

SEQ ID NO: 337244 - DNA, 25 bp, Mus musculus
ccaggactctgccagtgtccggaga

SEQ ID NO: 337245 - DNA, 25 bp, Mus musculus
agcccaggactctgccagtgtccgg

SEQ ID NO: 337246 - DNA, 25 bp, Mus musculus
gcaggcgatgttgcctggagagcga

SEQ ID NO: 337247 - DNA, 25 bp, Mus musculus
cctccgagggcgctcgagtgcgcgt

SEQ ID NO: 337248 - DNA, 25 bp, Mus musculus
tggagactggcaggcgatgttgcct

SEQ ID NO: 337249 - DNA, 25 bp, Mus musculus
gggcacccgcgagctgtatccagct

SEQ ID NO: 337250 - DNA, 25 bp, Mus musculus
agctgtatccagctccagccgagag

SEQ ID NO: 337251 - DNA, 25 bp, Mus musculus
ctgtgcagtcctcccacgcggtgct

SEQ ID NO: 337252 - DNA, 25 bp, Mus musculus
ccgagctctctgcacagccttacaa

SEQ ID NO: 337253 - DNA, 25 bp, Mus musculus
tctgccttatgcacccgcccgagct

SEQ ID NO: 337254 - DNA, 25 bp, Mus musculus
gtgcaacgcccaatgcaacgtcctg

SEQ ID NO: 337255 - DNA, 25 bp, Mus musculus
agagccctgcacctccagtgcaacg

SEQ ID NO: 337256 - DNA, 25 bp, Mus musculus
ccgcaccgccctgtgcaccgcaccc

SEQ ID NO: 337257 - DNA, 25 bp, Mus musculus
cctgatgacgctgtcagctgccctg

SEQ ID NO: 337258 - DNA, 25 bp, Mus musculus
tgctcccgcctgatgacgctgtcag

SEQ ID NO: 337259 - DNA, 25 bp, Mus musculus
gagccggctcagagccgcaggtctc

SEQ ID NO: 337260 - DNA, 25 bp, Mus musculus
gagagccgtggtggcttgcttacct

SEQ ID NO: 337261 - DNA, 25 bp, Mus musculus
tgcttacctggggagagccggctca

SEQ ID NO: 337262 - DNA, 25 bp, Mus musculus
acgcggtgctctctggctctagcct

SEQ ID NO: 337263 - DNA, 25 bp, Mus musculus
cttggctaaactaggctggaccgca

SEQ ID NO: 337264 - DNA, 25 bp, Mus musculus
ttggatctccgggtacttcccagcg

SEQ ID NO: 337265 - DNA, 25 bp, Mus musculus
ttttctcaggttcggttcagcatgc

SEQ ID NO: 337266 - DNA, 25 bp, Mus musculus
ttcagcatgctgtcccgattgtagc

SEQ ID NO: 337267 - DNA, 25 bp, Mus musculus
ccgattgtagctcgagttcagggtg

SEQ ID NO: 337268 - DNA, 25 bp, Mus musculus
ggggtgttactatattggatctccg

SEQ ID NO: 337269 - DNA, 25 bp, Mus musculus
cgtgctgtcctgtctaagttccgga

SEQ ID NO: 337270 - DNA, 25 bp, Mus musculus
ggcgctgcctaaccctgctgggttc

SEQ ID NO: 337271 - DNA, 25 bp, Mus musculus
tcctggcgcattgaggaagttctcc

SEQ ID NO: 337272 - DNA, 25 bp, Mus musculus
agttccggatcctaattttctcagg

SEQ ID NO: 337273 - DNA, 25 bp, Mus musculus
cccaggcgacagaccttggctaaac

SEQ ID NO: 337274 - DNA, 25 bp, Mus musculus
gaccgcagttttgctccagtgactg

SEQ ID NO: 337275 - DNA, 25 bp, Mus musculus
tttgctccagtgactgcggctgagc

SEQ ID NO: 337276 - DNA, 25 bp, Mus musculus
gacgcggccacctgcccaggtagga

SEQ ID NO: 337277 - DNA, 25 bp, Mus musculus
catctagaggatcgcattgcttgtc

SEQ ID NO: 337278 - DNA, 25 bp, Mus musculus
tctggggacctcgagtagagttttc

SEQ ID NO: 337279 - DNA, 25 bp, Mus musculus
gcctgagctgctaaaccgccgggat

SEQ ID NO: 337280 - DNA, 25 bp, Mus musculus
atccggaatgctgggaaccaacgcc

SEQ ID NO: 337281 - DNA, 25 bp, Mus musculus
tccgggatccactcatctatgcgcg

SEQ ID NO: 337282 - DNA, 25 bp, Mus musculus
cgtagggttatatctgcgcctcctc

SEQ ID NO: 337283 - DNA, 25 bp, Mus musculus
actcgaagtttagggtggcatctgc

SEQ ID NO: 337284 - DNA, 25 bp, Mus musculus
cctggaactgatcggagaactgagc

SEQ ID NO: 337285 - DNA, 25 bp, Mus musculus
ctgagcttctatgatcgtacggaca

SEQ ID NO: 337286 - DNA, 25 bp, Mus musculus
cgtacggacatcacgtcggtctatg

SEQ ID NO: 337287 - DNA, 25 bp, Mus musculus
tcgccagtccagagagacagatgtg

SEQ ID NO: 337288 - DNA, 25 bp, Mus musculus
cccgagtgctagctgtcccagtgag

SEQ ID NO: 337289 - DNA, 25 bp, Mus musculus
gggctctccgttgaatctgcgcatc

SEQ ID NO: 337290 - DNA, 25 bp, Mus musculus
ctcgctgccattggtagacgggaca

SEQ ID NO: 337291 - DNA, 25 bp, Mus musculus
ctacattgtgcgcatgatcggaatc

SEQ ID NO: 337292 - DNA, 25 bp, Mus musculus
tgcgcatgatcggaatctgcgaggc

SEQ ID NO: 337293 - DNA, 25 bp, Mus musculus
cgaggccaacgacccggctttgaag

SEQ ID NO: 337294 - DNA, 25 bp, Mus musculus
gacccggctttgaaggacgagctgc

SEQ ID NO: 337295 - DNA, 25 bp, Mus musculus
tggcagaggcgaacgtcatgcagca

SEQ ID NO: 337296 - DNA, 25 bp, Mus musculus
gcgaacgtcatgcagcagctggaca

SEQ ID NO: 337297 - DNA, 25 bp, Mus musculus
gcagctggacaacccctacattgtg

SEQ ID NO: 337298 - DNA, 25 bp, Mus musculus
gagtcctggatgctggtgatggaga

SEQ ID NO: 337299 - DNA, 25 bp, Mus musculus
agctggggccgctcaacaagtacct

SEQ ID NO: 337300 - DNA, 25 bp, Mus musculus
ctcaacaagtacctgcagcagaaca

SEQ ID NO: 337301 - DNA, 25 bp, Mus musculus
agtacctgcagcagaacaggtgacc

SEQ ID NO: 337302 - DNA, 25 bp, Mus musculus
catgcgagttgtgtgcggtgccacc

SEQ ID NO: 337303 - DNA, 25 bp, Mus musculus
acgtcatgcagcagctggacaaccc

SEQ ID NO: 337304 - DNA, 25 bp, Mus musculus
atcggaatctgcgaggcggagtcct

SEQ ID NO: 337305 - DNA, 25 bp, Mus musculus
caggcggacgccaaccgttctcaag

SEQ ID NO: 337306 - DNA, 25 bp, Mus musculus
ccgcattgaccttggctggagagac

SEQ ID NO: 337307 - DNA, 25 bp, Mus musculus
cccaggcgcgagcatcatcactgag

SEQ ID NO: 337308 - DNA, 25 bp, Mus musculus
tcatcactgagcaggctgaacccgg

SEQ ID NO: 337309 - DNA, 25 bp, Mus musculus
gagcaggctgaacccggaaggccac

SEQ ID NO: 337310 - DNA, 25 bp, Mus musculus
taccctcggggacgcagtgacagcc

SEQ ID NO: 337311 - DNA, 25 bp, Mus musculus
tgcctgcagctcacctcggttctcc

SEQ ID NO: 337312 - DNA, 25 bp, Mus musculus
tccgtcttcacctccgagctgtagc

SEQ ID NO: 337313 - DNA, 25 bp, Mus musculus
cgccgccatgttgtatgtttacagc

SEQ ID NO: 337314 - DNA, 25 bp, Mus musculus
gttgtatgtttacagcgggcgcccg

SEQ ID NO: 337315 - DNA, 25 bp, Mus musculus
gcgcacgcacacgacaggcgtcggt

SEQ ID NO: 337316 - DNA, 25 bp, Mus musculus
cacacgacaggcgtcggtcgctttg

SEQ ID NO: 337317 - DNA, 25 bp, Mus musculus
tcccaggcactctttacctcggccg

SEQ ID NO: 337318 - DNA, 25 bp, Mus musculus
cctcctccaggtgccgcacgcgcaa

SEQ ID NO: 337319 - DNA, 25 bp, Mus musculus
cgaggcgcgtccagttgctgcccaa

SEQ ID NO: 337320 - DNA, 25 bp, Mus musculus
ggcgagcgcagctcaccgaactcgg

SEQ ID NO: 337321 - DNA, 25 bp, Mus musculus
ctagcggtgctccggagtagagtca

SEQ ID NO: 337322 - DNA, 25 bp, Mus musculus
agtagagtcagcttctggctcggtc

SEQ ID NO: 337323 - DNA, 25 bp, Mus musculus
tcagcttctggctcggtctgcctga

SEQ ID NO: 337324 - DNA, 25 bp, Mus musculus
ctcggtctgcctgaggctgcactgt

SEQ ID NO: 337325 - DNA, 25 bp, Mus musculus
aggcacgcctgctctccgcctcagg

SEQ ID NO: 337326 - DNA, 25 bp, Mus musculus
cgcgccagaacaaaggaatgcggga

SEQ ID NO: 337327 - DNA, 25 bp, Mus musculus
aggctgcactgtcccgaggcccaag

SEQ ID NO: 337328 - DNA, 25 bp, Mus musculus
agttgctgcccaaggggagcgtctt

SEQ ID NO: 337329 - DNA, 25 bp, Mus musculus
gcgcaaggacgcatgatgaaaggtg

SEQ ID NO: 337330 - DNA, 25 bp, Mus musculus
gcctgccactgccaggcgcgtgccc

SEQ ID NO: 337331 - DNA, 25 bp, Mus musculus
ggtcgaggtctctgcctgccactgc

SEQ ID NO: 337332 - DNA, 25 bp, Mus musculus
agcgtcttgggtcgaggtctctgcc

SEQ ID NO: 337333 - DNA, 25 bp, Mus musculus
gagcccaggacccttttgcccattg

SEQ ID NO: 337334 - DNA, 25 bp, Mus musculus
tcctgaaatccggagacattatgca

SEQ ID NO: 337335 - DNA, 25 bp, Mus musculus
gcgccagggcgctgcaatcaaagca

SEQ ID NO: 337336 - DNA, 25 bp, Mus musculus
cagctaccttaaggtggcgagtccc

SEQ ID NO: 337337 - DNA, 25 bp, Mus musculus
agcgcttaccgtggttctgctccct

SEQ ID NO: 337338 - DNA, 25 bp, Mus musculus
ccgcgccgagagatgtgtgttagta

SEQ ID NO: 337339 - DNA, 25 bp, Mus musculus
tgttagtaggtcagttccgagcgcc

SEQ ID NO: 337340 - DNA, 25 bp, Mus musculus
ccaggccgagcgctatgttgcgcaa

SEQ ID NO: 337341 - DNA, 25 bp, Mus musculus
cttcgccaccgaaacatcaattttc

SEQ ID NO: 337342 - DNA, 25 bp, Mus musculus
ggagcaacccgaggcacgcctaaga

SEQ ID NO: 337343 - DNA, 25 bp, Mus musculus
tcgctccgtggtgccagcacctttt

SEQ ID NO: 337344 - DNA, 25 bp, Mus musculus
tttgtttcccggagagccacagagg

SEQ ID NO: 337345 - DNA, 25 bp, Mus musculus
gccgggctacctgttgccaatagaa

SEQ ID NO: 337346 - DNA, 25 bp, Mus musculus
tatgttgcgcaacgggacgcaccgc

SEQ ID NO: 337347 - DNA, 25 bp, Mus musculus
gtagccctgcgggacaagcggcgac

SEQ ID NO: 337348 - DNA, 25 bp, Mus musculus
agcaattgatgctccgggcatcaca

SEQ ID NO: 337349 - DNA, 25 bp, Mus musculus
tgatgctccgggcatcacagggccg

SEQ ID NO: 337350 - DNA, 25 bp, Mus musculus
ccgggcatcacagggccggtcatac

SEQ ID NO: 337351 - DNA, 25 bp, Mus musculus
atcacagggccggtcatacaggccc

SEQ ID NO: 337352 - DNA, 25 bp, Mus musculus
tcatacaggccctcggccgccagca

SEQ ID NO: 337353 - DNA, 25 bp, Mus musculus
caggcgggcctgagcagcctcgtac

SEQ ID NO: 337354 - DNA, 25 bp, Mus musculus
tgagcagcctcgtactcggccagca

SEQ ID NO: 337355 - DNA, 25 bp, Mus musculus
ccctggtgcccatcttcactgtgtg

SEQ ID NO: 337356 - DNA, 25 bp, Mus musculus
tggtgcccatcttcactgtgtgctc

SEQ ID NO: 337357 - DNA, 25 bp, Mus musculus
gtgcccatcttcactgtgtgctctc

SEQ ID NO: 337358 - DNA, 25 bp, Mus musculus
gctctccacgtggtgcctggccaga

SEQ ID NO: 337359 - DNA, 25 bp, Mus musculus
cacgtggtgcctggccagactccgg

SEQ ID NO: 337360 - DNA, 25 bp, Mus musculus
cgcagcaattgatgctccgggcatc

SEQ ID NO: 337361 - DNA, 25 bp, Mus musculus
cgacgcctaggaggcagacgatgtt

SEQ ID NO: 337362 - DNA, 25 bp, Mus musculus
tagctgaagatcatgctcaagggtt

SEQ ID NO: 337363 - DNA, 25 bp, Mus musculus
gatctgcgccaccacgtgcacgaag

SEQ ID NO: 337364 - DNA, 25 bp, Mus musculus
gccaccacgtgcacgaagtccgggg

SEQ ID NO: 337365 - DNA, 25 bp, Mus musculus
ggctccagggctgacttcacggtgc

SEQ ID NO: 337366 - DNA, 25 bp, Mus musculus
ctgacttcacggtgcggtcgtcatc

SEQ ID NO: 337367 - DNA, 25 bp, Mus musculus
cggtcgtcatcggtgctgcccacat

SEQ ID NO: 337368 - DNA, 25 bp, Mus musculus
ctgcccacatcggagtgcggcgagc

SEQ ID NO: 337369 - DNA, 25 bp, Mus musculus
cggagcatcgcctcttgccggaact

SEQ ID NO: 337370 - DNA, 25 bp, Mus musculus
ctcaagggttggtccttggtcacga

SEQ ID NO: 337371 - DNA, 25 bp, Mus musculus
accaggaactcatggaggtcgccat

SEQ ID NO: 337372 - DNA, 25 bp, Mus musculus
tcgccatgggaacagtagctgaaga

SEQ ID NO: 337373 - DNA, 25 bp, Mus musculus
tggtccttggtcacgacgcctagga

SEQ ID NO: 337374 - DNA, 25 bp, Mus musculus
tgcggcgagcgcatgaccaggaact

SEQ ID NO: 337375 - DNA, 25 bp, Mus musculus
gatcccgatgcgcatgcagttcgca

SEQ ID NO: 337376 - DNA, 25 bp, Mus musculus
atcccggcacagttcccgaggcttg

SEQ ID NO: 337377 - DNA, 25 bp, Mus musculus
cgccgggatcccgatgcgcatgcag

SEQ ID NO: 337378 - DNA, 25 bp, Mus musculus
gcacagttcccgaggcttgggcgcc

SEQ ID NO: 337379 - DNA, 25 bp, Mus musculus
tgcgcatgcagttcgcagcatccgg

SEQ ID NO: 337380 - DNA, 25 bp, Mus musculus
atgcagttcgcagcatccgggctct

SEQ ID NO: 337381 - DNA, 25 bp, Mus musculus
agttcgcagcatccgggctctcggg

SEQ ID NO: 337382 - DNA, 25 bp, Mus musculus
cgggcatgggcagcgcttcgcactt

SEQ ID NO: 337383 - DNA, 25 bp, Mus musculus
gcgatggtgtactcctggcggcaca

SEQ ID NO: 337384 - DNA, 25 bp, Mus musculus
tactcctggcggcacaggtcgttct

SEQ ID NO: 337385 - DNA, 25 bp, Mus musculus
aggtcgttctccagcacctcacatt

SEQ ID NO: 337386 - DNA, 25 bp, Mus musculus
attcatcccggcacagttcccgagg

SEQ ID NO: 337387 - DNA, 25 bp, Mus musculus
agcgtgcgtcgcacagagggaagac

SEQ ID NO: 337388 - DNA, 25 bp, Mus musculus
cttcgcacttgggcagctggagccg

SEQ ID NO: 337389 - DNA, 25 bp, Mus musculus
tggagtccaggtcttgggtcacaca

SEQ ID NO: 337390 - DNA, 25 bp, Mus musculus
acttagtggtccctagagcgcagct

SEQ ID NO: 337391 - DNA, 25 bp, Mus musculus
tagagcgcagctcattggaaccagc

SEQ ID NO: 337392 - DNA, 25 bp, Mus musculus
ttacctgccgtccagggtgtccaga

SEQ ID NO: 337393 - DNA, 25 bp, Mus musculus
tcgagggccactctggtgtcccttt

SEQ ID NO: 337394 - DNA, 25 bp, Mus musculus
ccgatgcaccgattcactgcagaga

SEQ ID NO: 337395 - DNA, 25 bp, Mus musculus
cctctgccggagtgactcaagggca

SEQ ID NO: 337396 - DNA, 25 bp, Mus musculus
ctcgactgtgatgtacttaagaaaa

SEQ ID NO: 337397 - DNA, 25 bp, Mus musculus
aaagactaactcaggaccgcatctg

SEQ ID NO: 337398 - DNA, 25 bp, Mus musculus
tcttgggtcacacagagcacgtcta

SEQ ID NO: 337399 - DNA, 25 bp, Mus musculus
acctgggaagaaacgatggagtcca

SEQ ID NO: 337400 - DNA, 25 bp, Mus musculus
ccggcctctggaaacacttagtggt

SEQ ID NO: 337401 - DNA, 25 bp, Mus musculus
gtctaccggtgcacatctcgactgt

SEQ ID NO: 337402 - DNA, 25 bp, Mus musculus
tcaagggatgcatgtggactggaac

SEQ ID NO: 337403 - DNA, 25 bp, Mus musculus
cagcgtgtcaaatagtgcgcggcgc

SEQ ID NO: 337404 - DNA, 25 bp, Mus musculus
gcgctcccggggaacacaaagcact

SEQ ID NO: 337405 - DNA, 25 bp, Mus musculus
cggggaacacaaagcactgcggacc

SEQ ID NO: 337406 - DNA, 25 bp, Mus musculus
caaagcactgcggacccggggcgca

SEQ ID NO: 337407 - DNA, 25 bp, Mus musculus
tccggtggcgaacgcacctcgtaca

SEQ ID NO: 337408 - DNA, 25 bp, Mus musculus
gtggcgaacgcacctcgtacagcgc

SEQ ID NO: 337409 - DNA, 25 bp, Mus musculus
tcgtacagcgcctgcaccatctcca

SEQ ID NO: 337410 - DNA, 25 bp, Mus musculus
agcacccactgctccgccactgtcg

SEQ ID NO: 337411 - DNA, 25 bp, Mus musculus
cggcgcgagctagtgacgcaatgaa

SEQ ID NO: 337412 - DNA, 25 bp, Mus musculus
gccactgtcgccatggtcaggcagc

SEQ ID NO: 337413 - DNA, 25 bp, Mus musculus
gtcgccatggtcaggcagccgactt

SEQ ID NO: 337414 - DNA, 25 bp, Mus musculus
tcaggcagccgacttccggcaggcg

SEQ ID NO: 337415 - DNA, 25 bp, Mus musculus
cgggtcgcagcgtgtcaaatagtgc

SEQ ID NO: 337416 - DNA, 25 bp, Mus musculus
ctcctcgttcgggtgtgctcgttcg

SEQ ID NO: 337417 - DNA, 25 bp, Mus musculus
tgagaccttcgggatccagctgggt

SEQ ID NO: 337418 - DNA, 25 bp, Mus musculus
taaatgtgattaggctgagaccttc

SEQ ID NO: 337419 - DNA, 25 bp, Mus musculus
gcccggtgtcagtgcacatttattg

SEQ ID NO: 337420 - DNA, 25 bp, Mus musculus
ttgataacccgactgcattcctgcc

SEQ ID NO: 337421 - DNA, 25 bp, Mus musculus
gcacatttattgatggcaggtattt

SEQ ID NO: 337422 - DNA, 25 bp, Mus musculus
cgagaatgggcctccacgagcaatt

SEQ ID NO: 337423 - DNA, 25 bp, Mus musculus
gtacctggtcggctgggatctcttg

SEQ ID NO: 337424 - DNA, 25 bp, Mus musculus
gggcctccacgagcaattaaatgtg

SEQ ID NO: 337425 - DNA, 25 bp, Mus musculus
tccagctgggtgattgataacccga

SEQ ID NO: 337426 - DNA, 25 bp, Mus musculus
tgcccggctcgcgacttcaaacggg

SEQ ID NO: 337427 - DNA, 25 bp, Mus musculus
cgcgacttcaaacgggcggctggct

SEQ ID NO: 337428 - DNA, 25 bp, Mus musculus
tcggtccgaggctagctagccaggt

SEQ ID NO: 337429 - DNA, 25 bp, Mus musculus
ctagccaggtgcagaccgagagaga

SEQ ID NO: 337430 - DNA, 25 bp, Mus musculus
agagagcgcagtgccgagccaccct

SEQ ID NO: 337431 - DNA, 25 bp, Mus musculus
ctcctcatccgacgaaaacaagtca

SEQ ID NO: 337432 - DNA, 25 bp, Mus musculus
actcggctcaaccaactggcgacgg

SEQ ID NO: 337433 - DNA, 25 bp, Mus musculus
acaagtcaccgcctttagtcggaga

SEQ ID NO: 337434 - DNA, 25 bp, Mus musculus
aagccatgactttctgcgccgcgta

SEQ ID NO: 337435 - DNA, 25 bp, Mus musculus
gactccgctggcaactctcaagcga

SEQ ID NO: 337436 - DNA, 25 bp, Mus musculus
ttccttgggcggcttcttgtcggac

SEQ ID NO: 337437 - DNA, 25 bp, Mus musculus
gtgctccgtcttcggaattttccga

SEQ ID NO: 337438 - DNA, 25 bp, Mus musculus
ggctcctgtatccacggtgctccgt

SEQ ID NO: 337439 - DNA, 25 bp, Mus musculus
tctcaagcgaagactccaacttttg

SEQ ID NO: 337440 - DNA, 25 bp, Mus musculus
gtatctgccgggctcctgtatccac

SEQ ID NO: 337441 - DNA, 25 bp, Mus musculus
cgcctttagtcggagaagccatgac

SEQ ID NO: 337442 - DNA, 25 bp, Mus musculus
gaagtgggagactcggctcaaccaa

SEQ ID NO: 337443 - DNA, 25 bp, Mus musculus
ttcttgtcggacatgagcgcctcca

SEQ ID NO: 337444 - DNA, 25 bp, Mus musculus
ctggagaccttgaccctgcgttcct

SEQ ID NO: 337445 - DNA, 25 bp, Mus musculus
cagcctgcccggtccttcccagcag

SEQ ID NO: 337446 - DNA, 25 bp, Mus musculus
ttcccagcaggtgacagcgggagct

SEQ ID NO: 337447 - DNA, 25 bp, Mus musculus
ctgacaggttcagggcgtctcactt

SEQ ID NO: 337448 - DNA, 25 bp, Mus musculus
gttcagggcgtctcacttcgcgccg

SEQ ID NO: 337449 - DNA, 25 bp, Mus musculus
tcgcgccgcgggtccatctgtcatt

SEQ ID NO: 337450 - DNA, 25 bp, Mus musculus
ccaccctggtgcttcggagtccttg

SEQ ID NO: 337451 - DNA, 25 bp, Mus musculus
tgcttcggagtccttgctgtccctt

SEQ ID NO: 337452 - DNA, 25 bp, Mus musculus
tgcccgtgacacctgctgcgggact

SEQ ID NO: 337453 - DNA, 25 bp, Mus musculus
ctgctgcgggactctgcaaacaacc

SEQ ID NO: 337454 - DNA, 25 bp, Mus musculus
ggactctgcaaacaacccttcgtgg

SEQ ID NO: 337455 - DNA, 25 bp, Mus musculus
tcgggaagcgcttgtcccggaccgc

SEQ ID NO: 337456 - DNA, 25 bp, Mus musculus
aacaacccttcgtggttcgcgcgca

SEQ ID NO: 337457 - DNA, 25 bp, Mus musculus
agctctgccagttgctgattgaggc

SEQ ID NO: 337458 - DNA, 25 bp, Mus musculus
gcttcacctcgggaagcgcttgtcc

SEQ ID NO: 337459 - DNA, 25 bp, Mus musculus
gtttgcaacccggaggacggatcgc

SEQ ID NO: 337460 - DNA, 25 bp, Mus musculus
gcgttaattgctctcggcccggcac

SEQ ID NO: 337461 - DNA, 25 bp, Mus musculus
gcacgcgcaccaggagctccaaggt

SEQ ID NO: 337462 - DNA, 25 bp, Mus musculus
gcactcagccttcgcggagccagga

SEQ ID NO: 337463 - DNA, 25 bp, Mus musculus
agccaggacaacctcgctccaggag

SEQ ID NO: 337464 - DNA, 25 bp, Mus musculus
agtcccagtaaaccgtgaagcgttg

SEQ ID NO: 337465 - DNA, 25 bp, Mus musculus
ggaatgacaattcgccctaatggga

SEQ ID NO: 337466 - DNA, 25 bp, Mus musculus
ctaatgggacaacctcactcccgga

SEQ ID NO: 337467 - DNA, 25 bp, Mus musculus
cccggaggagtgacaattccttcta

SEQ ID NO: 337468 - DNA, 25 bp, Mus musculus
attccttctaatgggccgcttgtta

SEQ ID NO: 337469 - DNA, 25 bp, Mus musculus
ggccgcttgttagaggcctattctc

SEQ ID NO: 337470 - DNA, 25 bp, Mus musculus
gcctattctccgaacccgggtatca

SEQ ID NO: 337471 - DNA, 25 bp, Mus musculus
ttgagcacagacctgggcgtttgca

SEQ ID NO: 337472 - DNA, 25 bp, Mus musculus
ctccaaggtgaaggcagtcccagta

SEQ ID NO: 337473 - DNA, 25 bp, Mus musculus
tgctagtcctggacactgcccacgt

SEQ ID NO: 337474 - DNA, 25 bp, Mus musculus
tgtgggacgcctacctaatcgctgt

SEQ ID NO: 337475 - DNA, 25 bp, Mus musculus
ccacacgtggttcactgaaggcaca

SEQ ID NO: 337476 - DNA, 25 bp, Mus musculus
acctgaggaacaaatcctgatgctc

SEQ ID NO: 337477 - DNA, 25 bp, Mus musculus
gctgtgccctctctggctacctgat

SEQ ID NO: 337478 - DNA, 25 bp, Mus musculus
gttccacccaaagctcggggtcaga

SEQ ID NO: 337479 - DNA, 25 bp, Mus musculus
ggggaccctggcacaagacagaacc

SEQ ID NO: 337480 - DNA, 25 bp, Mus musculus
gcccacgtcgctgagttgtcactga

SEQ ID NO: 337481 - DNA, 25 bp, Mus musculus
cccaggacgagagtgctcaccgatc

SEQ ID NO: 337482 - DNA, 25 bp, Mus musculus
gctcaccgatctgggagaccacgct

SEQ ID NO: 337483 - DNA, 25 bp, Mus musculus
ccaaggcgcttctgcggtcaactca

SEQ ID NO: 337484 - DNA, 25 bp, Mus musculus
ggtcaactcacgagtgcagcccgtg

SEQ ID NO: 337485 - DNA, 25 bp, Mus musculus
acggtgccgcactctcagcaggtac

SEQ ID NO: 337486 - DNA, 25 bp, Mus musculus
gtaaaccaaactctcgttcagcgcc

SEQ ID NO: 337487 - DNA, 25 bp, Mus musculus
tgcctgaggcgggttacgtacgccc

SEQ ID NO: 337488 - DNA, 25 bp, Mus musculus
ctcttagtagctgggacccggaggt

SEQ ID NO: 337489 - DNA, 25 bp, Mus musculus
aaggggagcatcacgcaccgtgcca

SEQ ID NO: 337490 - DNA, 25 bp, Mus musculus
gccatgaatgacaccgaggcagagg

SEQ ID NO: 337491 - DNA, 25 bp, Mus musculus
gacctcgtgagtccgcagctctaga

SEQ ID NO: 337492 - DNA, 25 bp, Mus musculus
tccgcagctctagactggggctagg

SEQ ID NO: 337493 - DNA, 25 bp, Mus musculus
agcgtggaactgatcttgtggaaca

SEQ ID NO: 337494 - DNA, 25 bp, Mus musculus
cctagccaccgcgtgacgaaacatg

SEQ ID NO: 337495 - DNA, 25 bp, Mus musculus
caagatggctgccaggggactgtct

SEQ ID NO: 337496 - DNA, 25 bp, Mus musculus
tctccacgaggatgggcgcgcgcaa

SEQ ID NO: 337497 - DNA, 25 bp, Mus musculus
gcgcgcgcaattgccaggtgaccag

SEQ ID NO: 337498 - DNA, 25 bp, Mus musculus
aggtgaccaggtggctcttagtagc

SEQ ID NO: 337499 - DNA, 25 bp, Mus musculus
acccagtagggtccactgtgcgcgc

SEQ ID NO: 337500 - DNA, 25 bp, Mus musculus
ctcagcagccaaagccatgaatgac

SEQ ID NO: 337501 - DNA, 25 bp, Mus musculus
gggcctacgagacagtctcctggtt

SEQ ID NO: 337502 - DNA, 25 bp, Mus musculus
gaacgcggagctaggctacagcccg

SEQ ID NO: 337503 - DNA, 25 bp, Mus musculus
agctaggctacagcccggcgcagct

SEQ ID NO: 337504 - DNA, 25 bp, Mus musculus
tacagcccggcgcagctgcgagcga

SEQ ID NO: 337505 - DNA, 25 bp, Mus musculus
cggtagcgcagtggccagctctcct

SEQ ID NO: 337506 - DNA, 25 bp, Mus musculus
tctcggcgcgggaaaccgcccacca

SEQ ID NO: 337507 - DNA, 25 bp, Mus musculus
accaagccgtattcctccgattgcg

SEQ ID NO: 337508 - DNA, 25 bp, Mus musculus
agccgtattcctccgattgcggccg

SEQ ID NO: 337509 - DNA, 25 bp, Mus musculus
ccgactccctgtgcgccgggtatgg

SEQ ID NO: 337510 - DNA, 25 bp, Mus musculus
cgcccgcgtcctcgcaatccgcgag

SEQ ID NO: 337511 - DNA, 25 bp, Mus musculus
cctgggcccggtgcagcgaactgac

SEQ ID NO: 337512 - DNA, 25 bp, Mus musculus
acgagacagtctcctggttcaagct

SEQ ID NO: 337513 - DNA, 25 bp, Mus musculus
gtattcctccgattgcggccgcgcg

SEQ ID NO: 337514 - DNA, 25 bp, Mus musculus
ctccggaacgcggagctaggctaca

SEQ ID NO: 337515 - DNA, 25 bp, Mus musculus
ctcctggcagacgtcgcctcgggat

SEQ ID NO: 337516 - DNA, 25 bp, Mus musculus
aaggtaaggtgaccgacgcctcctg

SEQ ID NO: 337517 - DNA, 25 bp, Mus musculus
tttggctgcctgcttcagattcctg

SEQ ID NO: 337518 - DNA, 25 bp, Mus musculus
ggccactttggctgcctgcttcaga

SEQ ID NO: 337519 - DNA, 25 bp, Mus musculus
gctgcctgcttcagattcctgccga

SEQ ID NO: 337520 - DNA, 25 bp, Mus musculus
gtgaccgacgcctcctggcagacgt

SEQ ID NO: 337521 - DNA, 25 bp, Mus musculus
gcagcagcaccaggtaaggtaaggt

SEQ ID NO: 337522 - DNA, 25 bp, Mus musculus
agccggtggcgcacagcagcagcac

SEQ ID NO: 337523 - DNA, 25 bp, Mus musculus
taagcgacccggtacagccggtggc

SEQ ID NO: 337524 - DNA, 25 bp, Mus musculus
gcgcagtcctaagcgacccggtaca

SEQ ID NO: 337525 - DNA, 25 bp, Mus musculus
tgcaagcgcgcagtcctaagcgacc

SEQ ID NO: 337526 - DNA, 25 bp, Mus musculus
cagccagtgcaagcgcgcagtccta

SEQ ID NO: 337527 - DNA, 25 bp, Mus musculus
ctgaggaaaggagcggctttcagaa

SEQ ID NO: 337528 - DNA, 25 bp, Mus musculus
agaccaggctgtggcgtggccactt

SEQ ID NO: 337529 - DNA, 25 bp, Mus musculus
cccgcacccttccacaccgcacggg

SEQ ID NO: 337530 - DNA, 25 bp, Mus musculus
tgggcctagtctgcactgggaggca

SEQ ID NO: 337531 - DNA, 25 bp, Mus musculus
tccagcggggcgagctgggcctagt

SEQ ID NO: 337532 - DNA, 25 bp, Mus musculus
ctcagctaggactgggagagagggt

SEQ ID NO: 337533 - DNA, 25 bp, Mus musculus
gcaatggcggggctcagctaggact

SEQ ID NO: 337534 - DNA, 25 bp, Mus musculus
acccaggcctagtcaccgctgcggc

SEQ ID NO: 337535 - DNA, 25 bp, Mus musculus
ctcccggggcgaaaggcttgccctg

SEQ ID NO: 337536 - DNA, 25 bp, Mus musculus
gaaaggcttgccctgtcggggactc

SEQ ID NO: 337537 - DNA, 25 bp, Mus musculus
cagcgccagggcctgaacgctcccg

SEQ ID NO: 337538 - DNA, 25 bp, Mus musculus
tctctcacggggactcgccgggacg

SEQ ID NO: 337539 - DNA, 25 bp, Mus musculus
tgagctctctcacggggactcgccg

SEQ ID NO: 337540 - DNA, 25 bp, Mus musculus
tctgagctctctcacggggactcgc

SEQ ID NO: 337541 - DNA, 25 bp, Mus musculus
agtctgcactgggaggcaggagtgc

SEQ ID NO: 337542 - DNA, 25 bp, Mus musculus
cgggcgcgctggacccaggcctagt

SEQ ID NO: 337543 - DNA, 25 bp, Mus musculus
cctacccgctcgctgtggtgctgaa

SEQ ID NO: 337544 - DNA, 25 bp, Mus musculus
gtgtgaacctggagaacaacttcga

SEQ ID NO: 337545 - DNA, 25 bp, Mus musculus
gaacaacttcgagcccgcaagacta

SEQ ID NO: 337546 - DNA, 25 bp, Mus musculus
acttcgagcccgcaagactagggtg

SEQ ID NO: 337547 - DNA, 25 bp, Mus musculus
attggagggcgccttaggcatccgc

SEQ ID NO: 337548 - DNA, 25 bp, Mus musculus
cccgagtgcggagactcaagtgtga

SEQ ID NO: 337549 - DNA, 25 bp, Mus musculus
cccagcttgcctggcggagttacac

SEQ ID NO: 337550 - DNA, 25 bp, Mus musculus
agttacaccaggcagcggcgcgagc

SEQ ID NO: 337551 - DNA, 25 bp, Mus musculus
cgcgagctggctgagcacacggcac

SEQ ID NO: 337552 - DNA, 25 bp, Mus musculus
tgagcacacggcaccgcctgctgga

SEQ ID NO: 337553 - DNA, 25 bp, Mus musculus
accgcctgctggagtcagccggagc

SEQ ID NO: 337554 - DNA, 25 bp, Mus musculus
ccctgcagtggcttagacggttgct

SEQ ID NO: 337555 - DNA, 25 bp, Mus musculus
ggaacgctctggctccggaacagcg

SEQ ID NO: 337556 - DNA, 25 bp, Mus musculus
tgcggagactcaagtgtgaacctgg

SEQ ID NO: 337557 - DNA, 25 bp, Mus musculus
atactctgagtctggcgccgtcgcc

SEQ ID NO: 337558 - DNA, 25 bp, Mus musculus
gaattcgcgcgtcttgctgtggcct

SEQ ID NO: 337559 - DNA, 25 bp, Mus musculus
agtgcaccttagcactgtgcgccgg

SEQ ID NO: 337560 - DNA, 25 bp, Mus musculus
agctccaggcgaccgagtgcacctt

SEQ ID NO: 337561 - DNA, 25 bp, Mus musculus
aagcgacggccatcgcagctccagg

SEQ ID NO: 337562 - DNA, 25 bp, Mus musculus
acacgctggcagtcttgtcgaagga

SEQ ID NO: 337563 - DNA, 25 bp, Mus musculus
cctgcatcccgagcacgtaacgaga

SEQ ID NO: 337564 - DNA, 25 bp, Mus musculus
cacgtaacgagacgggccactgctc

SEQ ID NO: 337565 - DNA, 25 bp, Mus musculus
tccttctccagcaagaacacgctgg

SEQ ID NO: 337566 - DNA, 25 bp, Mus musculus
ccggaagctggatactctgagtctg

SEQ ID NO: 337567 - DNA, 25 bp, Mus musculus
gtcgccctgcacatgcgccgaaaaa

SEQ ID NO: 337568 - DNA, 25 bp, Mus musculus
tgcgccgaaaaagcgccgcgtcgct

SEQ ID NO: 337569 - DNA, 25 bp, Mus musculus
ggccactgctcactgagcaccaggg

SEQ ID NO: 337570 - DNA, 25 bp, Mus musculus
tggcctcggaagagctcctgcatcc

SEQ ID NO: 337571 - DNA, 25 bp, Mus musculus
ccctacagggttgtgctgcggagcc

SEQ ID NO: 337572 - DNA, 25 bp, Mus musculus
gtttggcttatgatgggcacagatg

SEQ ID NO: 337573 - DNA, 25 bp, Mus musculus
cgggagcgcgtaattgtttggctta

SEQ ID NO: 337574 - DNA, 25 bp, Mus musculus
gacgccttcgctgcagtcgcttcag

SEQ ID NO: 337575 - DNA, 25 bp, Mus musculus
gcccgtagccatggaggactttatc

SEQ ID NO: 337576 - DNA, 25 bp, Mus musculus
aggactttatcgtgatctccgacga

SEQ ID NO: 337577 - DNA, 25 bp, Mus musculus
tgatctccgacgacagtggctccga

SEQ ID NO: 337578 - DNA, 25 bp, Mus musculus
cgccgaaccgtggtgagtgaatcca

SEQ ID NO: 337579 - DNA, 25 bp, Mus musculus
cagcgctgagccctacagggttgtg

SEQ ID NO: 337580 - DNA, 25 bp, Mus musculus
cggccgagcacatgggcgacacact

SEQ ID NO: 337581 - DNA, 25 bp, Mus musculus
ccgagctggctccagagctttggca

SEQ ID NO: 337582 - DNA, 25 bp, Mus musculus
agcaccagtgcgagctgccaagcgg

SEQ ID NO: 337583 - DNA, 25 bp, Mus musculus
tgggcgacacactgagcaccagtgc

SEQ ID NO: 337584 - DNA, 25 bp, Mus musculus
gggcctcagcgttgcgaccctggct

SEQ ID NO: 337585 - DNA, 25 bp, Mus musculus
ttcccgcactaaagaggctccgagg

SEQ ID NO: 337586 - DNA, 25 bp, Mus musculus
ctggttcgcagcgagcagatgctcc

SEQ ID NO: 337587 - DNA, 25 bp, Mus musculus
agcagatgctccgaggctcactgtg

SEQ ID NO: 337588 - DNA, 25 bp, Mus musculus
ctcactgtgcgggtctttctggtgt

SEQ ID NO: 337589 - DNA, 25 bp, Mus musculus
aggccgcggtcggttacctgctcgc

SEQ ID NO: 337590 - DNA, 25 bp, Mus musculus
ctccgaggctccagatggcccaaga

SEQ ID NO: 337591 - DNA, 25 bp, Mus musculus
agccatcgtgagagcgcgacgaacg

SEQ ID NO: 337592 - DNA, 25 bp, Mus musculus
agactgtcgcaggtcgcgcgagacc

SEQ ID NO: 337593 - DNA, 25 bp, Mus musculus
tcgcgcgagacctgactcgaagatc

SEQ ID NO: 337594 - DNA, 25 bp, Mus musculus
cctgactcgaagatccgcggggcat

SEQ ID NO: 337595 - DNA, 25 bp, Mus musculus
ttgtagtccgagatctgagcgtgcc

SEQ ID NO: 337596 - DNA, 25 bp, Mus musculus
agatctgagcgtgcctccgtaccca

SEQ ID NO: 337597 - DNA, 25 bp, Mus musculus
ccctcaaggcgaagccggctggttc

SEQ ID NO: 337598 - DNA, 25 bp, Mus musculus
ctgggctgaacagagcagagccatc

SEQ ID NO: 337599 - DNA, 25 bp, Mus musculus
tcagggaggcctacgcatgctgtga

SEQ ID NO: 337600 - DNA, 25 bp, Mus musculus
gcaatacaagcgcagccttcgctgg

SEQ ID NO: 337601 - DNA, 25 bp, Mus musculus
cgcggccacagctccatcttccacc

SEQ ID NO: 337602 - DNA, 25 bp, Mus musculus
atcttccaccgcaggctggtcggtc

SEQ ID NO: 337603 - DNA, 25 bp, Mus musculus
tggtcggtcttgctcccaggccaaa

SEQ ID NO: 337604 - DNA, 25 bp, Mus musculus
tcccaggccaaatggcgccgcggcc

SEQ ID NO: 337605 - DNA, 25 bp, Mus musculus
ggcgcggacactgcccgcctccctc

SEQ ID NO: 337606 - DNA, 25 bp, Mus musculus
cctcattcccggtgccggataatcg

SEQ ID NO: 337607 - DNA, 25 bp, Mus musculus
gggatccctggtagagccctcattc

SEQ ID NO: 337608 - DNA, 25 bp, Mus musculus
tgcagtaagcgcagtggcgccgccc

SEQ ID NO: 337609 - DNA, 25 bp, Mus musculus
acagtgcagtaagcgcagtggcgcc

SEQ ID NO: 337610 - DNA, 25 bp, Mus musculus
agccagccaggcgacagtgcagtaa

SEQ ID NO: 337611 - DNA, 25 bp, Mus musculus
gcctccctcagtgggacgagtggga

SEQ ID NO: 337612 - DNA, 25 bp, Mus musculus
cctacgcatgctgtgagcgcggagt

SEQ ID NO: 337613 - DNA, 25 bp, Mus musculus
agcgacgtctgcgtaagattggtgc

SEQ ID NO: 337614 - DNA, 25 bp, Mus musculus
tcttgcccgcgttgcttagcgacgt

SEQ ID NO: 337615 - DNA, 25 bp, Mus musculus
gattggtgcgcatttccagatgttc

SEQ ID NO: 337616 - DNA, 25 bp, Mus musculus
tgttcagcatctgcgctaacagcgc

SEQ ID NO: 337617 - DNA, 25 bp, Mus musculus
ccaggtgaagtaccctgagctggcc

SEQ ID NO: 337618 - DNA, 25 bp, Mus musculus
tggggatctgcctcgagccataaac

SEQ ID NO: 337619 - DNA, 25 bp, Mus musculus
gggtcaccgtcttgcacccagtggg

SEQ ID NO: 337620 - DNA, 25 bp, Mus musculus
acagctccgagagaccctgggcgaa

SEQ ID NO: 337621 - DNA, 25 bp, Mus musculus
ccctgggcgaaatctaaaagtctca

SEQ ID NO: 337622 - DNA, 25 bp, Mus musculus
gagatattctagctcctgggtcttc

SEQ ID NO: 337623 - DNA, 25 bp, Mus musculus
ggtgcctcagcacgcttcacaaaga

SEQ ID NO: 337624 - DNA, 25 bp, Mus musculus
cttcacaaagacctgtggttcgttg

SEQ ID NO: 337625 - DNA, 25 bp, Mus musculus
ctaatgtccacaggtagcccgagtc

SEQ ID NO: 337626 - DNA, 25 bp, Mus musculus
agcgatgccgcttggcctggccaac

SEQ ID NO: 337627 - DNA, 25 bp, Mus musculus
gtaaccgaacttctgcctccgagtc

SEQ ID NO: 337628 - DNA, 25 bp, Mus musculus
tgccttccgacgagcattccggttc

SEQ ID NO: 337629 - DNA, 25 bp, Mus musculus
cgtggcgctgccttccgacgagcat

SEQ ID NO: 337630 - DNA, 25 bp, Mus musculus
ttaatagtctccgtccacccgtgcg

SEQ ID NO: 337631 - DNA, 25 bp, Mus musculus
ctcagagccgcgtgttaatagtctc

SEQ ID NO: 337632 - DNA, 25 bp, Mus musculus
agaaccacgctctcagagccgcgtg

SEQ ID NO: 337633 - DNA, 25 bp, Mus musculus
agcagctcaaactcaagaaccacgc

SEQ ID NO: 337634 - DNA, 25 bp, Mus musculus
cccttgaaacagcagctcaaactca

SEQ ID NO: 337635 - DNA, 25 bp, Mus musculus
ccaacagcagctcaaacccttgaaa

SEQ ID NO: 337636 - DNA, 25 bp, Mus musculus
cgagcattccggttcagacgctttc

SEQ ID NO: 337637 - DNA, 25 bp, Mus musculus
ctccgagtctttcccttagccttgg

SEQ ID NO: 337638 - DNA, 25 bp, Mus musculus
ttgacgttgtaaccgaacttctgcc

SEQ ID NO: 337639 - DNA, 25 bp, Mus musculus
cagacgctttcggttgacgttgtaa

SEQ ID NO: 337640 - DNA, 25 bp, Mus musculus
tagccttgggcatctcgctaactgc

SEQ ID NO: 337641 - DNA, 25 bp, Mus musculus
ttctcgatgccagcaatctcgcttt

SEQ ID NO: 337642 - DNA, 25 bp, Mus musculus
gaagcccaccttcggctccagagcg

SEQ ID NO: 337643 - DNA, 25 bp, Mus musculus
acccgcccggcttgcctgtcactgc

SEQ ID NO: 337644 - DNA, 25 bp, Mus musculus
tggctgctgtcacctcccgcccgcg

SEQ ID NO: 337645 - DNA, 25 bp, Mus musculus
gaagccgaagtcctcagccatcttc

SEQ ID NO: 337646 - DNA, 25 bp, Mus musculus
acgatgagaagaagccgaagtcctc

SEQ ID NO: 337647 - DNA, 25 bp, Mus musculus
ccgctctccgacgatgagaagaagc

SEQ ID NO: 337648 - DNA, 25 bp, Mus musculus
cgggtcattctcgatgccagcaatc

SEQ ID NO: 337649 - DNA, 25 bp, Mus musculus
atctcgctttcctgctgggccagga

SEQ ID NO: 337650 - DNA, 25 bp, Mus musculus
gcaatctcgctttcctgctgggcca

SEQ ID NO: 337651 - DNA, 25 bp, Mus musculus
gatgccagcaatctcgctttcctgc

SEQ ID NO: 337652 - DNA, 25 bp, Mus musculus
tccgacgatgagaagaagccgaagt

SEQ ID NO: 337653 - DNA, 25 bp, Mus musculus
ggttccaggccgctgcgctgactca

SEQ ID NO: 337654 - DNA, 25 bp, Mus musculus
gggtctgaccgagactgggcctccc

SEQ ID NO: 337655 - DNA, 25 bp, Mus musculus
cgacgaacgcgcgagggcttctctc

SEQ ID NO: 337656 - DNA, 25 bp, Mus musculus
gcctctcgcccggagcgtctgagga

SEQ ID NO: 337657 - DNA, 25 bp, Mus musculus
ggcgaacatgttttctgtgcggata

SEQ ID NO: 337658 - DNA, 25 bp, Mus musculus
accgaggagcccgtgtgattcccgg

SEQ ID NO: 337659 - DNA, 25 bp, Mus musculus
ccctgtcaagaaggtgccggtggta

SEQ ID NO: 337660 - DNA, 25 bp, Mus musculus
caaaaaatatcctctccgcggcagc

SEQ ID NO: 337661 - DNA, 25 bp, Mus musculus
tgcggatagtgactgccgactacta

SEQ ID NO: 337662 - DNA, 25 bp, Mus musculus
tcatcatggcaacaagagctgcagc

SEQ ID NO: 337663 - DNA, 25 bp, Mus musculus
tggttgcgtccgtgacatcatcatc

SEQ ID NO: 337664 - DNA, 25 bp, Mus musculus
aatcatcgattcctcggcgcgcggc

SEQ ID NO: 337665 - DNA, 25 bp, Mus musculus
ggcccacaggccgaatcatcgattc

SEQ ID NO: 337666 - DNA, 25 bp, Mus musculus
cccgcctcttccgtaagatgtgaca

SEQ ID NO: 337667 - DNA, 25 bp, Mus musculus
tggcggcttcccttaccttgtgaaa

SEQ ID NO: 337668 - DNA, 25 bp, Mus musculus
tctgagcctatccatgctatcggcg

SEQ ID NO: 337669 - DNA, 25 bp, Mus musculus
atgcaaccagccgtgcgccggcttg

SEQ ID NO: 337670 - DNA, 25 bp, Mus musculus
cgcgcgtactggagactgggttcct

SEQ ID NO: 337671 - DNA, 25 bp, Mus musculus
ctcacttggctcttggggtccaaga

SEQ ID NO: 337672 - DNA, 25 bp, Mus musculus
gcgcactcacccgaacgatgtaaga

SEQ ID NO: 337673 - DNA, 25 bp, Mus musculus
ccaggaccctggcatcgggatgcaa

SEQ ID NO: 337674 - DNA, 25 bp, Mus musculus
cttgtgaatgaagccgcccttgcgc

SEQ ID NO: 337675 - DNA, 25 bp, Mus musculus
gcatccgcggcagcagtgcgcagaa

SEQ ID NO: 337676 - DNA, 25 bp, Mus musculus
tgagcctggtccagagccgtgcgct

SEQ ID NO: 337677 - DNA, 25 bp, Mus musculus
cgagtgatgtcaccgctccgcgcag

SEQ ID NO: 337678 - DNA, 25 bp, Mus musculus
ccgagggaatgtccagtcaggctca

SEQ ID NO: 337679 - DNA, 25 bp, Mus musculus
caggctcagaccgatggggaaactg

SEQ ID NO: 337680 - DNA, 25 bp, Mus musculus
aaactgaggacaggggtcgcataca

SEQ ID NO: 337681 - DNA, 25 bp, Mus musculus
ccacgtgacgccgtgagaacccgga

SEQ ID NO: 337682 - DNA, 25 bp, Mus musculus
gcgctgcgaacttccactgcggcat

SEQ ID NO: 337683 - DNA, 25 bp, Mus musculus
ggagcgcaaaaccatcctcaggttg

SEQ ID NO: 337684 - DNA, 25 bp, Mus musculus
tagacacgcgaacgtcgccctctgg

SEQ ID NO: 337685 - DNA, 25 bp, Mus musculus
ttagcgcgcgcagacgcagttgagt

SEQ ID NO: 337686 - DNA, 25 bp, Mus musculus
ttcaggccggaagtggttacacctg

SEQ ID NO: 337687 - DNA, 25 bp, Mus musculus
ggttacacctgagatcacttccggc

SEQ ID NO: 337688 - DNA, 25 bp, Mus musculus
gagcaggatctaactcaggagcaga

SEQ ID NO: 337689 - DNA, 25 bp, Mus musculus
tgcagtttcaggtagcagcgagttc

SEQ ID NO: 337690 - DNA, 25 bp, Mus musculus
tgggaccctagaggagcgcaaaacc

SEQ ID NO: 337691 - DNA, 25 bp, Mus musculus
tgggaccagtttcaaacccgcaggc

SEQ ID NO: 337692 - DNA, 25 bp, Mus musculus
ccacagtgggtcagctgccttgatt

SEQ ID NO: 337693 - DNA, 25 bp, Mus musculus
ccttgatttcccgtagcgtcgctgg

SEQ ID NO: 337694 - DNA, 25 bp, Mus musculus
tcgctggtctgcaatccttgccggc

SEQ ID NO: 337695 - DNA, 25 bp, Mus musculus
ttgccggcctgattaacccgccaga

SEQ ID NO: 337696 - DNA, 25 bp, Mus musculus
agcagcgagttctcggtgcagccca

SEQ ID NO: 337697 - DNA, 25 bp, Mus musculus
tggccctttaagaactgtccgcggc

SEQ ID NO: 337698 - DNA, 25 bp, Mus musculus
ctcgctttctgttccgttagacggc

SEQ ID NO: 337699 - DNA, 25 bp, Mus musculus
aggcctgcgatgacctcatagctca

SEQ ID NO: 337700 - DNA, 25 bp, Mus musculus
atgacgtcaccacaagcccggcagg

SEQ ID NO: 337701 - DNA, 25 bp, Mus musculus
cggcaagcacacttcccggagatga

SEQ ID NO: 337702 - DNA, 25 bp, Mus musculus
aggaccgctcttagctcggcaagca

SEQ ID NO: 337703 - DNA, 25 bp, Mus musculus
tggcacgcactaacaggtcaaggtt

SEQ ID NO: 337704 - DNA, 25 bp, Mus musculus
aggctggctaaaaaagcctcttcgc

SEQ ID NO: 337705 - DNA, 25 bp, Mus musculus
attcacaacattcggatcggcgggg

SEQ ID NO: 337706 - DNA, 25 bp, Mus musculus
acgcgggctcctttgttcgcgatgc

SEQ ID NO: 337707 - DNA, 25 bp, Mus musculus
tcgacgcctacgaggccggcaaaca

SEQ ID NO: 337708 - DNA, 25 bp, Mus musculus
ccgcagcgctctgcaaggcagaaga

SEQ ID NO: 337709 - DNA, 25 bp, Mus musculus
catgtgctcggcgtgagacaaaagc

SEQ ID NO: 337710 - DNA, 25 bp, Mus musculus
ctagcgggtcgccatcttgaaaggc

SEQ ID NO: 337711 - DNA, 25 bp, Mus musculus
tctgggcacactaccttccggggac

SEQ ID NO: 337712 - DNA, 25 bp, Mus musculus
tcacaggaactcgtccagctcggcg

SEQ ID NO: 337713 - DNA, 25 bp, Mus musculus
cgccctagcacttggaccgagagac

SEQ ID NO: 337714 - DNA, 25 bp, Mus musculus
agagaccggcccaggtgacgactag

SEQ ID NO: 337715 - DNA, 25 bp, Mus musculus
cccgaataggcagcggcgcgttgct

SEQ ID NO: 337716 - DNA, 25 bp, Mus musculus
tgcgcccgcaatggaacctctcagt

SEQ ID NO: 337717 - DNA, 25 bp, Mus musculus
cccagtgctcgctatgggctggtcg

SEQ ID NO: 337718 - DNA, 25 bp, Mus musculus
cgcctcacagcgtgcaatgggccgg

SEQ ID NO: 337719 - DNA, 25 bp, Mus musculus
tcaacacgggcgaaacccatggagc

SEQ ID NO: 337720 - DNA, 25 bp, Mus musculus
aacccatggagctgaacgtcatctc

SEQ ID NO: 337721 - DNA, 25 bp, Mus musculus
acaatggtcccgtcgggctgtacca

SEQ ID NO: 337722 - DNA, 25 bp, Mus musculus
gtcgcgctctcagtgcctctttgac

SEQ ID NO: 337723 - DNA, 25 bp, Mus musculus
agtgcctctttgacccggcatgagg

SEQ ID NO: 337724 - DNA, 25 bp, Mus musculus
atggaacctctcagtggcgacgacc

SEQ ID NO: 337725 - DNA, 25 bp, Mus musculus
ttctgtgcccacgtttctcccaggg

SEQ ID NO: 337726 - DNA, 25 bp, Mus musculus
gcgagtcctagcgtccttgaaaccc

SEQ ID NO: 337727 - DNA, 25 bp, Mus musculus
gcccgcttagcgctttccttttctg

SEQ ID NO: 337728 - DNA, 25 bp, Mus musculus
atcagagaggacagacgcgcatcct

SEQ ID NO: 337729 - DNA, 25 bp, Mus musculus
gtccacccagactgtagcaatcaga

SEQ ID NO: 337730 - DNA, 25 bp, Mus musculus
tttagaagcgcatggacactccggc

SEQ ID NO: 337731 - DNA, 25 bp, Mus musculus
ccatggacatgctcacgtgcacaca

SEQ ID NO: 337732 - DNA, 25 bp, Mus musculus
cccagttcggtgctctttccggagc

SEQ ID NO: 337733 - DNA, 25 bp, Mus musculus
gtcacacggtctgcatacaaacaca

SEQ ID NO: 337734 - DNA, 25 bp, Mus musculus
ggggcctgtctgtacacacaacagt

SEQ ID NO: 337735 - DNA, 25 bp, Mus musculus
cgcagaaccggaagctaggctcggc

SEQ ID NO: 337736 - DNA, 25 bp, Mus musculus
gttatccggagatctgcaacctgca

SEQ ID NO: 337737 - DNA, 25 bp, Mus musculus
aggggccagcacctcagttatccgg

SEQ ID NO: 337738 - DNA, 25 bp, Mus musculus
agcggctgctactgcgagcagatgc

SEQ ID NO: 337739 - DNA, 25 bp, Mus musculus
aggcggagctcgagaacagaagtta

SEQ ID NO: 337740 - DNA, 25 bp, Mus musculus
tctcagttgctggtgagggagatcc

SEQ ID NO: 337741 - DNA, 25 bp, Mus musculus
atcccgtctcaggagcttgcgacca

SEQ ID NO: 337742 - DNA, 25 bp, Mus musculus
actattctggggagctactgggata

SEQ ID NO: 337743 - DNA, 25 bp, Mus musculus
ggacccagtcccagcaggaggtgct

SEQ ID NO: 337744 - DNA, 25 bp, Mus musculus
tgctgggagtctctctttgcagccc

SEQ ID NO: 337745 - DNA, 25 bp, Mus musculus
caacattgtcttctgggtgagcgcg

SEQ ID NO: 337746 - DNA, 25 bp, Mus musculus
cttcctgtttggcttcaacattgtc

SEQ ID NO: 337747 - DNA, 25 bp, Mus musculus
cggctgctgcgggaaatacttcctg

SEQ ID NO: 337748 - DNA, 25 bp, Mus musculus
agcaccagcaattccaggaccctga

SEQ ID NO: 337749 - DNA, 25 bp, Mus musculus
tgagctgtgtggctttgaccatgaa

SEQ ID NO: 337750 - DNA, 25 bp, Mus musculus
gctccaagaagaccgagccttgctg

SEQ ID NO: 337751 - DNA, 25 bp, Mus musculus
cgcttctcgctctgcgctgaggata

SEQ ID NO: 337752 - DNA, 25 bp, Mus musculus
ccgtgaggactgaacttgactggga

SEQ ID NO: 337753 - DNA, 25 bp, Mus musculus
gctccagtccggattttgcggcgcc

SEQ ID NO: 337754 - DNA, 25 bp, Mus musculus
cgtgcgcgcgaacgcttagctctgg

SEQ ID NO: 337755 - DNA, 25 bp, Mus musculus
tcctcactgcctggcttcgtggttc

SEQ ID NO: 337756 - DNA, 25 bp, Mus musculus
ggccagcgctcctgggcatagtcct

SEQ ID NO: 337757 - DNA, 25 bp, Mus musculus
ccggctgcattgctgcgctccgggt

SEQ ID NO: 337758 - DNA, 25 bp, Mus musculus
accacggcgcgctgacgatctcgga

SEQ ID NO: 337759 - DNA, 25 bp, Mus musculus
agcctcaggcgttgcccgaagggat

SEQ ID NO: 337760 - DNA, 25 bp, Mus musculus
cggaaaagcaatccactccgggatc

SEQ ID NO: 337761 - DNA, 25 bp, Mus musculus
ccagggtgatgccagatccggaaaa

SEQ ID NO: 337762 - DNA, 25 bp, Mus musculus
agctgctctccgcaggctggcgctg

SEQ ID NO: 337763 - DNA, 25 bp, Mus musculus
ggcactccagagtcgagctgctctc

SEQ ID NO: 337764 - DNA, 25 bp, Mus musculus
agcggaacctgcctggggcactcca

SEQ ID NO: 337765 - DNA, 25 bp, Mus musculus
gcaagcagggactgcagcggaacct

SEQ ID NO: 337766 - DNA, 25 bp, Mus musculus
ggctgaggcgctgacagcctctctc

SEQ ID NO: 337767 - DNA, 25 bp, Mus musculus
tggctcgcagttgcccgagccagtg

SEQ ID NO: 337768 - DNA, 25 bp, Mus musculus
cctaattaatgcgtggcgagctggg

SEQ ID NO: 337769 - DNA, 25 bp, Mus musculus
cccgcgcggcctaattaatgcgtgg

SEQ ID NO: 337770 - DNA, 25 bp, Mus musculus
gcccgggatgtaattagctgctgcg

SEQ ID NO: 337771 - DNA, 25 bp, Mus musculus
tcgcagttgcccgagccagtgagcc

SEQ ID NO: 337772 - DNA, 25 bp, Mus musculus
cggagcccgacgaagccgagacatt

SEQ ID NO: 337773 - DNA, 25 bp, Mus musculus
ccgcgacgcgaccgtcaaggtggct

SEQ ID NO: 337774 - DNA, 25 bp, Mus musculus
gacccacagcctccagacccgttca

SEQ ID NO: 337775 - DNA, 25 bp, Mus musculus
gatcgtgcccgctgtgtgacccgac

SEQ ID NO: 337776 - DNA, 25 bp, Mus musculus
cttctctcgtgatcgtgcccgctgt

SEQ ID NO: 337777 - DNA, 25 bp, Mus musculus
aggtctgcgtttctttcccactcct

SEQ ID NO: 337778 - DNA, 25 bp, Mus musculus
aagccgagacattgaagatcctccc

SEQ ID NO: 337779 - DNA, 25 bp, Mus musculus
cccgacgaagccgagacattgaaga

SEQ ID NO: 337780 - DNA, 25 bp, Mus musculus
ccagagcccgggatgtaattagctg

SEQ ID NO: 337781 - DNA, 25 bp, Mus musculus
tccgaaatgaggacctcgtggaccc

SEQ ID NO: 337782 - DNA, 25 bp, Mus musculus
caagaacatcgtggcccgtcgccga

SEQ ID NO: 337783 - DNA, 25 bp, Mus musculus
acctgcgtggccaagaacatcgtgg

SEQ ID NO: 337784 - DNA, 25 bp, Mus musculus
ctacacctgcgtggccaagaacatc

SEQ ID NO: 337785 - DNA, 25 bp, Mus musculus
gacactgccaactacacctgcgtgg

SEQ ID NO: 337786 - DNA, 25 bp, Mus musculus
gcccgcctggccgacactgccaact

SEQ ID NO: 337787 - DNA, 25 bp, Mus musculus
cccgtcgccgaagcgcctctgcggc

SEQ ID NO: 337788 - DNA, 25 bp, Mus musculus
cacgggagcacagcctagtcgtgcg

SEQ ID NO: 337789 - DNA, 25 bp, Mus musculus
gtggctccgaaatgaggacctcgtg

SEQ ID NO: 337790 - DNA, 25 bp, Mus musculus
cctaggtggagtggctccgaaatga

SEQ ID NO: 337791 - DNA, 25 bp, Mus musculus
gtcacggcttctccccctaggtgga

SEQ ID NO: 337792 - DNA, 25 bp, Mus musculus
cagccgtgtagtgtcacggcttctc

SEQ ID NO: 337793 - DNA, 25 bp, Mus musculus
tgtgtacatcacacgggagcacagc

SEQ ID NO: 337794 - DNA, 25 bp, Mus musculus
catcacacgggagcacagcctagtc

SEQ ID NO: 337795 - DNA, 25 bp, Mus musculus
gcgcgaacactcctggtggcactcg

SEQ ID NO: 337796 - DNA, 25 bp, Mus musculus
ttcttatcagcgtgtgctcagcggc

SEQ ID NO: 337797 - DNA, 25 bp, Mus musculus
gcatgctcagtgtgccgctaaggca

SEQ ID NO: 337798 - DNA, 25 bp, Mus musculus
tgagcgctgaggtgccatacaaacc

SEQ ID NO: 337799 - DNA, 25 bp, Mus musculus
agacgcgcatgcttcgtgtgtgcac

SEQ ID NO: 337800 - DNA, 25 bp, Mus musculus
ttcgcctccagcgttgcgtagcagc

SEQ ID NO: 337801 - DNA, 25 bp, Mus musculus
aggtcatgcgccctgcagcaatgtc

SEQ ID NO: 337802 - DNA, 25 bp, Mus musculus
ggtcaggggagcacactattatttc

SEQ ID NO: 337803 - DNA, 25 bp, Mus musculus
tctcgggcttacaatctcaggcacg

SEQ ID NO: 337804 - DNA, 25 bp, Mus musculus
cggacggaacaagcgagtctttctt

SEQ ID NO: 337805 - DNA, 25 bp, Mus musculus
tagtgtcgggcgaacccaactgttc

SEQ ID NO: 337806 - DNA, 25 bp, Mus musculus
cgctgcgcttcttatgggataggtc

SEQ ID NO: 337807 - DNA, 25 bp, Mus musculus
gggtcgtacagcaacttgagcagtt

SEQ ID NO: 337808 - DNA, 25 bp, Mus musculus
cacgcatagctctctgggaaacgta

SEQ ID NO: 337809 - DNA, 25 bp, Mus musculus
ccagtgaacggtgggtggtcgacgt

SEQ ID NO: 337810 - DNA, 25 bp, Mus musculus
cgttcctcaccacgccatctccgtg

SEQ ID NO: 337811 - DNA, 25 bp, Mus musculus
acgtggaccgagtggtccgtctgca

SEQ ID NO: 337812 - DNA, 25 bp, Mus musculus
accgagtggtccgtctgcagtgcca

SEQ ID NO: 337813 - DNA, 25 bp, Mus musculus
tggtccgtctgcagtgccagctgtg

SEQ ID NO: 337814 - DNA, 25 bp, Mus musculus
aaacggagccggagctgcaccaacc

SEQ ID NO: 337815 - DNA, 25 bp, Mus musculus
gcaccaacccggcacctctcaacgg

SEQ ID NO: 337816 - DNA, 25 bp, Mus musculus
tgtgaggggcagaatgtccagaaaa

SEQ ID NO: 337817 - DNA, 25 bp, Mus musculus
tgtccagaaaacagcctgcgccact

SEQ ID NO: 337818 - DNA, 25 bp, Mus musculus
agaaaacagcctgcgccactctgtg

SEQ ID NO: 337819 - DNA, 25 bp, Mus musculus
actctgtgcccaggtaccggcagcc

SEQ ID NO: 337820 - DNA, 25 bp, Mus musculus
ggcagccaccgactcctgcatcgtt

SEQ ID NO: 337821 - DNA, 25 bp, Mus musculus
gactcctgcatcgttcctcaccacg

SEQ ID NO: 337822 - DNA, 25 bp, Mus musculus
cgccttctgtgaggggcagaatgtc

SEQ ID NO: 337823 - DNA, 25 bp, Mus musculus
gggaacctaagcacgagccttcttc

SEQ ID NO: 337824 - DNA, 25 bp, Mus musculus
ttagagagctaagcagactcgcggg

SEQ ID NO: 337825 - DNA, 25 bp, Mus musculus
cccgatgtcgaaagagttagagagc

SEQ ID NO: 337826 - DNA, 25 bp, Mus musculus
tcgcgggacaaaacgaaccgtgatc

SEQ ID NO: 337827 - DNA, 25 bp, Mus musculus
acgctgcgggttgctgggaacctaa

SEQ ID NO: 337828 - DNA, 25 bp, Mus musculus
gaacttgctctttcttcttccttgc

SEQ ID NO: 337829 - DNA, 25 bp, Mus musculus
gatccatcggactttccgcgggaaa

SEQ ID NO: 337830 - DNA, 25 bp, Mus musculus
ctcagcgcggatgacttttgcagtc

SEQ ID NO: 337831 - DNA, 25 bp, Mus musculus
cttttgcagtccagagtagttccga

SEQ ID NO: 337832 - DNA, 25 bp, Mus musculus
gtagttccgaaactagggcactaga

SEQ ID NO: 337833 - DNA, 25 bp, Mus musculus
tagaaaccgtttctgagcgtgggtg

SEQ ID NO: 337834 - DNA, 25 bp, Mus musculus
cgcacgactgcctaacccgaggttg

SEQ ID NO: 337835 - DNA, 25 bp, Mus musculus
ctgatccagcgtccggacgccggga

SEQ ID NO: 337836 - DNA, 25 bp, Mus musculus
cccgaggttgtggaccacgtagaca

SEQ ID NO: 337837 - DNA, 25 bp, Mus musculus
gaagccaactaccacaagacaagca

SEQ ID NO: 337838 - DNA, 25 bp, Mus musculus
acaagacaagcaaagtaacgtgggg

SEQ ID NO: 337839 - DNA, 25 bp, Mus musculus
gacgcgtactcaccgcggatctggc

SEQ ID NO: 337840 - DNA, 25 bp, Mus musculus
aggcgacgcgtactcaccgcggatc

SEQ ID NO: 337841 - DNA, 25 bp, Mus musculus
agtgcagaggcgacgcgtactcacc

SEQ ID NO: 337842 - DNA, 25 bp, Mus musculus
cagacagcgagaagcaggcggcccc

SEQ ID NO: 337843 - DNA, 25 bp, Mus musculus
ttccgcccggccgagaggcctagtc

SEQ ID NO: 337844 - DNA, 25 bp, Mus musculus
gacccggccggcatcggcttccgcc

SEQ ID NO: 337845 - DNA, 25 bp, Mus musculus
cgggcggccgaagaactaatgaagc

SEQ ID NO: 337846 - DNA, 25 bp, Mus musculus
caggctaccaggaagctcggatagc

SEQ ID NO: 337847 - DNA, 25 bp, Mus musculus
gccgaagaactaatgaagccaacta

SEQ ID NO: 337848 - DNA, 25 bp, Mus musculus
tctcgggcggccgaagaactaatga

SEQ ID NO: 337849 - DNA, 25 bp, Mus musculus
ctccggacgacgaccgccgcccgca

SEQ ID NO: 337850 - DNA, 25 bp, Mus musculus
ccaggaagctcggatagcaagagag

SEQ ID NO: 337851 - DNA, 25 bp, Mus musculus
cgcagcttcttaacggcgcgtcttg

SEQ ID NO: 337852 - DNA, 25 bp, Mus musculus
cgtcttgccggaaagatggagtgtc

SEQ ID NO: 337853 - DNA, 25 bp, Mus musculus
ccactgctcgtggtagcaggccgca

SEQ ID NO: 337854 - DNA, 25 bp, Mus musculus
atggagtgtcctgcgcccgatgcta

SEQ ID NO: 337855 - DNA, 25 bp, Mus musculus
cccgatgctacggatgctgcggacc

SEQ ID NO: 337856 - DNA, 25 bp, Mus musculus
agccggaccgtacaagggctccgag

SEQ ID NO: 337857 - DNA, 25 bp, Mus musculus
aaccggacggagtgcgctttgaccg

SEQ ID NO: 337858 - DNA, 25 bp, Mus musculus
atgggatggccctgcctcctgtcac

SEQ ID NO: 337859 - DNA, 25 bp, Mus musculus
agcctctgcacgacgttccggagct

SEQ ID NO: 337860 - DNA, 25 bp, Mus musculus
gggtgctggacctagtaactcgtta

SEQ ID NO: 337861 - DNA, 25 bp, Mus musculus
tgcggaatttgtccgtcctcctttc

SEQ ID NO: 337862 - DNA, 25 bp, Mus musculus
tcctcctttccagggcgttcacttg

SEQ ID NO: 337863 - DNA, 25 bp, Mus musculus
cgggactctgcagagcccaaacttc

SEQ ID NO: 337864 - DNA, 25 bp, Mus musculus
cccaaacttcgcgagagttgctggc

SEQ ID NO: 337865 - DNA, 25 bp, Mus musculus
tatgcaactccgcacggggaccgct

SEQ ID NO: 337866 - DNA, 25 bp, Mus musculus
tgggccagctgtctatgcaactccg

SEQ ID NO: 337867 - DNA, 25 bp, Mus musculus
ctctggttacttattgcccaccggg

SEQ ID NO: 337868 - DNA, 25 bp, Mus musculus
ccctggtcaccgctctggttactta

SEQ ID NO: 337869 - DNA, 25 bp, Mus musculus
gcagcgcacacagggccttttgtcc

SEQ ID NO: 337870 - DNA, 25 bp, Mus musculus
gtaaatcagtaacccgcagcgcaca

SEQ ID NO: 337871 - DNA, 25 bp, Mus musculus
ggccagttgggccacacaccgtact

SEQ ID NO: 337872 - DNA, 25 bp, Mus musculus
gagccctctagctctgggccagttg

SEQ ID NO: 337873 - DNA, 25 bp, Mus musculus
cgctgcagttgcagggacattcctg

SEQ ID NO: 337874 - DNA, 25 bp, Mus musculus
cgcctctcagatcagaagtggtcca

SEQ ID NO: 337875 - DNA, 25 bp, Mus musculus
gacatttgccgggtctcggaccacg

SEQ ID NO: 337876 - DNA, 25 bp, Mus musculus
cccgcactagggtaccgggctgaca

SEQ ID NO: 337877 - DNA, 25 bp, Mus musculus
gcgatccagtcccaacggggagctc

SEQ ID NO: 337878 - DNA, 25 bp, Mus musculus
cggaacgactgagactgggcgatcc

SEQ ID NO: 337879 - DNA, 25 bp, Mus musculus
cctgtggcagccatgtgacaaagac

SEQ ID NO: 337880 - DNA, 25 bp, Mus musculus
atccggggcgaactggtctggacaa

SEQ ID NO: 337881 - DNA, 25 bp, Mus musculus
ctttatcgcgggtttgcaggacgcc

SEQ ID NO: 337882 - DNA, 25 bp, Mus musculus
tgtctgcagctttatcgcgggtttg

SEQ ID NO: 337883 - DNA, 25 bp, Mus musculus
cgaatgcagtcccacgtgtggccgc

SEQ ID NO: 337884 - DNA, 25 bp, Mus musculus
acaaagacgagtcttagccaccctc

SEQ ID NO: 337885 - DNA, 25 bp, Mus musculus
agccatgtgacaaagacgagtctta

SEQ ID NO: 337886 - DNA, 25 bp, Mus musculus
gccgattggcctgtggcagccatgt

SEQ ID NO: 337887 - DNA, 25 bp, Mus musculus
cgcaccaacgtcatggccttggctg

SEQ ID NO: 337888 - DNA, 25 bp, Mus musculus
gcaaagctcacctttttcccaaggc

SEQ ID NO: 337889 - DNA, 25 bp, Mus musculus
gactccgcccagtttgcaaagctca

SEQ ID NO: 337890 - DNA, 25 bp, Mus musculus
aattggcagtctcttcccgactccg

SEQ ID NO: 337891 - DNA, 25 bp, Mus musculus
ctggtctggacaagaattggcagtc

SEQ ID NO: 337892 - DNA, 25 bp, Mus musculus
ccggggagctgaggcttagcctccc

SEQ ID NO: 337893 - DNA, 25 bp, Mus musculus
ttgcccagcataaccaccttaacgt

SEQ ID NO: 337894 - DNA, 25 bp, Mus musculus
accaggctcgtcttgcccacgtatt

SEQ ID NO: 337895 - DNA, 25 bp, Mus musculus
tgcgccggggttaccgactgaatct

SEQ ID NO: 337896 - DNA, 25 bp, Mus musculus
aatctggggtcctcgtagctaactc

SEQ ID NO: 337897 - DNA, 25 bp, Mus musculus
agctaactccaaacagcacctctgg

SEQ ID NO: 337898 - DNA, 25 bp, Mus musculus
gcacctctgggactggaagccaaga

SEQ ID NO: 337899 - DNA, 25 bp, Mus musculus
cggaagtggccgatcctatgcatcc

SEQ ID NO: 337900 - DNA, 25 bp, Mus musculus
ccggaagcgtcgtgcagtcctataa

SEQ ID NO: 337901 - DNA, 25 bp, Mus musculus
ggctcttcaccctgatgctgcacgg

SEQ ID NO: 337902 - DNA, 25 bp, Mus musculus
ccgaatccctataggtacgtggcgt

SEQ ID NO: 337903 - DNA, 25 bp, Mus musculus
gagcgagtcgccttcctctcttctt

SEQ ID NO: 337904 - DNA, 25 bp, Mus musculus
ctctcttcttctggagatcgcaccg

SEQ ID NO: 337905 - DNA, 25 bp, Mus musculus
cgatcctatgcatccggcgccggaa

SEQ ID NO: 337906 - DNA, 25 bp, Mus musculus
tgcacgtatcgttccaccaggctcg

SEQ ID NO: 337907 - DNA, 25 bp, Mus musculus
ctccaatagatgtgcgggcggcagc

SEQ ID NO: 337908 - DNA, 25 bp, Mus musculus
tgcctgcgaactccaatagatgtgc

SEQ ID NO: 337909 - DNA, 25 bp, Mus musculus
tagccacgggttccatgtcggcgac

SEQ ID NO: 337910 - DNA, 25 bp, Mus musculus
atgtcggcgacagccgacgaccagc

SEQ ID NO: 337911 - DNA, 25 bp, Mus musculus
gcgccagcagccctccagccttgct

SEQ ID NO: 337912 - DNA, 25 bp, Mus musculus
tccctccaggttgggagccaaattc

SEQ ID NO: 337913 - DNA, 25 bp, Mus musculus
tccaggttgggagccaaattcagcc

SEQ ID NO: 337914 - DNA, 25 bp, Mus musculus
gagccaaattcagcccgcgcgcggg

SEQ ID NO: 337915 - DNA, 25 bp, Mus musculus
gggtctgtcctcacctctctcgcgc

SEQ ID NO: 337916 - DNA, 25 bp, Mus musculus
gcctctccaggaactccgctgcctg

SEQ ID NO: 337917 - DNA, 25 bp, Mus musculus
ctgcctgcagcaggacctggatgtt

SEQ ID NO: 337918 - DNA, 25 bp, Mus musculus
acctggatgttgctagccacgggtt

SEQ ID NO: 337919 - DNA, 25 bp, Mus musculus
ttgggagccaaattcagcccgcgcg

SEQ ID NO: 337920 - DNA, 25 bp, Mus musculus
caggacctggatgttgctagccacg

SEQ ID NO: 337921 - DNA, 25 bp, Mus musculus
ggacgcaggacacggtacgggccgc

SEQ ID NO: 337922 - DNA, 25 bp, Mus musculus
ttggtcttcgaatgggaatccctcc

SEQ ID NO: 337923 - DNA, 25 bp, Mus musculus
tcattggtcttcgaatgggaatccc

SEQ ID NO: 337924 - DNA, 25 bp, Mus musculus
gcccttcattggtcttcgaatggga

SEQ ID NO: 337925 - DNA, 25 bp, Mus musculus
tctgcccttcattggtcttcgaatg

SEQ ID NO: 337926 - DNA, 25 bp, Mus musculus
acgagagacggcgatgcgcacgcgc

SEQ ID NO: 337927 - DNA, 25 bp, Mus musculus
cccgtatctgcccttcattggtctt

SEQ ID NO: 337928 - DNA, 25 bp, Mus musculus
ttcgaatgggaatccctcctagctc

SEQ ID NO: 337929 - DNA, 25 bp, Mus musculus
ccttcgcagggaggttaatggcgtc

SEQ ID NO: 337930 - DNA, 25 bp, Mus musculus
gtatctgcccttcattggtcttcga

SEQ ID NO: 337931 - DNA, 25 bp, Mus musculus
tagctctcccgtccttcgcagggag

SEQ ID NO: 337932 - DNA, 25 bp, Mus musculus
ccgtccttcgcagggaggttaatgg

SEQ ID NO: 337933 - DNA, 25 bp, Mus musculus
gaatgggaatccctcctagctctcc

SEQ ID NO: 337934 - DNA, 25 bp, Mus musculus
tctcccgtccttcgcagggaggtta

SEQ ID NO: 337935 - DNA, 25 bp, Mus musculus
cacgctggaaccgacacactggtta

SEQ ID NO: 337936 - DNA, 25 bp, Mus musculus
ctaggaaggtgtcatggtcccggtt

SEQ ID NO: 337937 - DNA, 25 bp, Mus musculus
atggtcccggttgcggaagtcagcc

SEQ ID NO: 337938 - DNA, 25 bp, Mus musculus
gaagtcagccgtgcagcctgccaac

SEQ ID NO: 337939 - DNA, 25 bp, Mus musculus
cactccatcgtccatctttgctatg

SEQ ID NO: 337940 - DNA, 25 bp, Mus musculus
ccatctttgctatgatcgtacgaca

SEQ ID NO: 337941 - DNA, 25 bp, Mus musculus
atcgtacgacagagagccattgttc

SEQ ID NO: 337942 - DNA, 25 bp, Mus musculus
gagccattgttcaccatcaccgaga

SEQ ID NO: 337943 - DNA, 25 bp, Mus musculus
atgtacgggaacacacgctggaacc

SEQ ID NO: 337944 - DNA, 25 bp, Mus musculus
tggttacttcgtgcctgccagcccg

SEQ ID NO: 337945 - DNA, 25 bp, Mus musculus
cgacacactggttacttcgtgcctg

SEQ ID NO: 337946 - DNA, 25 bp, Mus musculus
agcgtacagctaggaaggtgtcatg

SEQ ID NO: 337947 - DNA, 25 bp, Mus musculus
ccgggaatagcgtacagctaggaag

SEQ ID NO: 337948 - DNA, 25 bp, Mus musculus
catcaccgagatgtacgggaacaca

SEQ ID NO: 337949 - DNA, 25 bp, Mus musculus
tccgggtgtcttttctaatggtctc

SEQ ID NO: 337950 - DNA, 25 bp, Mus musculus
atcgtgctgccttggaagtcccaga

SEQ ID NO: 337951 - DNA, 25 bp, Mus musculus
ccagaaatctactgcgctgcgctgc

SEQ ID NO: 337952 - DNA, 25 bp, Mus musculus
gctctgctcgacagaacgggccatg

SEQ ID NO: 337953 - DNA, 25 bp, Mus musculus
tacaggcctccctcaccttggtagg

SEQ ID NO: 337954 - DNA, 25 bp, Mus musculus
ttgccgtcggtgatatccgcagcca

SEQ ID NO: 337955 - DNA, 25 bp, Mus musculus
tggccagcctcctatcccagtagag

SEQ ID NO: 337956 - DNA, 25 bp, Mus musculus
tagagcgcggctccataactttgga

SEQ ID NO: 337957 - DNA, 25 bp, Mus musculus
aactttggaggttcctggtcgcctg

SEQ ID NO: 337958 - DNA, 25 bp, Mus musculus
gccgagggttctcatgagcgacaag

SEQ ID NO: 337959 - DNA, 25 bp, Mus musculus
tcatggagcagcacgttaggcttgc

SEQ ID NO: 337960 - DNA, 25 bp, Mus musculus
ggccaacgaaatgcagaggtctctc

SEQ ID NO: 337961 - DNA, 25 bp, Mus musculus
cgcacgtactggctcgtcagcatcg

SEQ ID NO: 337962 - DNA, 25 bp, Mus musculus
gccggaagccctccaaactaggatc

SEQ ID NO: 337963 - DNA, 25 bp, Mus musculus
ccctattgtcgcgaagtgctggtaa

SEQ ID NO: 337964 - DNA, 25 bp, Mus musculus
cccagccgaccggagaagtctcgga

SEQ ID NO: 337965 - DNA, 25 bp, Mus musculus
gtctcggagcagaaagcacacactc

SEQ ID NO: 337966 - DNA, 25 bp, Mus musculus
ctgccggtctgtcagcacccagaga

SEQ ID NO: 337967 - DNA, 25 bp, Mus musculus
gagaccctcacgcaatcagcgacga

SEQ ID NO: 337968 - DNA, 25 bp, Mus musculus
atcagcgacgaagctttcggctcta

SEQ ID NO: 337969 - DNA, 25 bp, Mus musculus
ctttcggctctaggcggaagtatct

SEQ ID NO: 337970 - DNA, 25 bp, Mus musculus
aagtatctggagaccggaagtccca

SEQ ID NO: 337971 - DNA, 25 bp, Mus musculus
gcgcactagccttccgctgggtcag

SEQ ID NO: 337972 - DNA, 25 bp, Mus musculus
cttccaaacgcgaaccctattgtcg

SEQ ID NO: 337973 - DNA, 25 bp, Mus musculus
tgctggtaaggtagacaccggaact

SEQ ID NO: 337974 - DNA, 25 bp, Mus musculus
ttgcgtactgtagttgattcaagac

SEQ ID NO: 337975 - DNA, 25 bp, Mus musculus
ctgtgggaccagtcgattttgcgta

SEQ ID NO: 337976 - DNA, 25 bp, Mus musculus
ctccgcagaggaagtgatgaaaacc

SEQ ID NO: 337977 - DNA, 25 bp, Mus musculus
cagcggccaatttcccggacagtgg

SEQ ID NO: 337978 - DNA, 25 bp, Mus musculus
tcgcatcgatttcgcctgcagtgtg

SEQ ID NO: 337979 - DNA, 25 bp, Mus musculus
cttgcgcttgttactatcgagattc

SEQ ID NO: 337980 - DNA, 25 bp, Mus musculus
gtttaaggttctcggcacgcctcgc

SEQ ID NO: 337981 - DNA, 25 bp, Mus musculus
tcggcttgaggcaggtttaaggttc

SEQ ID NO: 337982 - DNA, 25 bp, Mus musculus
gcctggctcaccactcgcagaggtg

SEQ ID NO: 337983 - DNA, 25 bp, Mus musculus
gctgcctctgcccttaacaaaaatg

SEQ ID NO: 337984 - DNA, 25 bp, Mus musculus
agaacatgggtctacgctcgccgac

SEQ ID NO: 337985 - DNA, 25 bp, Mus musculus
cttggcgcactacttcgagaacatg

SEQ ID NO: 337986 - DNA, 25 bp, Mus musculus
tcctaaaggtgctggagatccggcc

SEQ ID NO: 337987 - DNA, 25 bp, Mus musculus
atgctgcgcgcagccctcctaaagg

SEQ ID NO: 337988 - DNA, 25 bp, Mus musculus
tcatcgcgccgtgaattatggcggc

SEQ ID NO: 337989 - DNA, 25 bp, Mus musculus
agcgaggaggacttcctacggcagc

SEQ ID NO: 337990 - DNA, 25 bp, Mus musculus
ccggcagtagcaccagcggccaatt

SEQ ID NO: 337991 - DNA, 25 bp, Mus musculus
gtgtggcccacacagattgcacgcc

SEQ ID NO: 337992 - DNA, 25 bp, Mus musculus
ggtgcgcgcatccagtacgccgtca

SEQ ID NO: 337993 - DNA, 25 bp, Mus musculus
gtcaccctcggccagcaggtagtca

SEQ ID NO: 337994 - DNA, 25 bp, Mus musculus
tcgtctgcccatgagcaccaggagc

SEQ ID NO: 337995 - DNA, 25 bp, Mus musculus
cggccagcaggtagtcacggataac

SEQ ID NO: 337996 - DNA, 25 bp, Mus musculus
tagtcacggataacgcagcagcggc

SEQ ID NO: 337997 - DNA, 25 bp, Mus musculus
cgtctgcagaaaggtgtgccggtct

SEQ ID NO: 337998 - DNA, 25 bp, Mus musculus
acacccacctcctgcggggagatgg

SEQ ID NO: 337999 - DNA, 25 bp, Mus musculus
acctcctgcggggagatggcagcca

SEQ ID NO: 338000 - DNA, 25 bp, Mus musculus
gccgtgatgcccacacacagcgatt

SEQ ID NO: 338001 - DNA, 25 bp, Mus musculus
acacagcgattgtccgagtggccca

SEQ ID NO: 338002 - DNA, 25 bp, Mus musculus
gattgtccgagtggcccacgatagc

SEQ ID NO: 338003 - DNA, 25 bp, Mus musculus
tggcccacgatagccacgtcatcga

SEQ ID NO: 338004 - DNA, 25 bp, Mus musculus
ctcagacccgtctgcagaaaggtgt

SEQ ID NO: 338005 - DNA, 25 bp, Mus musculus
gcgacccaggcagagccactagtcc

SEQ ID NO: 338006 - DNA, 25 bp, Mus musculus
accgagggtggcacttgccgattct

SEQ ID NO: 338007 - DNA, 25 bp, Mus musculus
cacttgccgattctgcaggcagtga

SEQ ID NO: 338008 - DNA, 25 bp, Mus musculus
gccgattctgcaggcagtgagccgc

SEQ ID NO: 338009 - DNA, 25 bp, Mus musculus
agtgagccgcggtcagcacccaaca

SEQ ID NO: 338010 - DNA, 25 bp, Mus musculus
agccgcggtcagcacccaacagggg

SEQ ID NO: 338011 - DNA, 25 bp, Mus musculus
ccaacagggggcgatgagactgccc

SEQ ID NO: 338012 - DNA, 25 bp, Mus musculus
ccgcgcagaagttgttaccccagta

SEQ ID NO: 338013 - DNA, 25 bp, Mus musculus
cgcgcatgaacgaggacagtccctt

SEQ ID NO: 338014 - DNA, 25 bp, Mus musculus
cccagtacagtgcagcgatgtaggg

SEQ ID NO: 338015 - DNA, 25 bp, Mus musculus
agagccactagtccgcccaccacgc

SEQ ID NO: 338016 - DNA, 25 bp, Mus musculus
ccaccacgcgcatgaacgaggacag

SEQ ID NO: 338017 - DNA, 25 bp, Mus musculus
aggacagtcccttgcggaacctctg

SEQ ID NO: 338018 - DNA, 25 bp, Mus musculus
cggaacctctgtccgcagcccatcg

SEQ ID NO: 338019 - DNA, 25 bp, Mus musculus
ggtcgacacgtctttaatccaatca

SEQ ID NO: 338020 - DNA, 25 bp, Mus musculus
cccttgggagctcgagaacatcgta

SEQ ID NO: 338021 - DNA, 25 bp, Mus musculus
ggcaatagcttccttcggtcctctg

SEQ ID NO: 338022 - DNA, 25 bp, Mus musculus
tcggtcctctgctagctttggaagc

SEQ ID NO: 338023 - DNA, 25 bp, Mus musculus
cgcccttctgaagcagctgacctaa

SEQ ID NO: 338024 - DNA, 25 bp, Mus musculus
gggacgacggcaggacacccattct

SEQ ID NO: 338025 - DNA, 25 bp, Mus musculus
atcgcaaagctggatggtcgacacg

SEQ ID NO: 338026 - DNA, 25 bp, Mus musculus
cctccgatttctcggcagaggctcg

SEQ ID NO: 338027 - DNA, 25 bp, Mus musculus
tccgcagtccaaccagaaatcggcg

SEQ ID NO: 338028 - DNA, 25 bp, Mus musculus
gctcggcatcctacgaaggcctaga

SEQ ID NO: 338029 - DNA, 25 bp, Mus musculus
gctcgcccattgactgagccaagta

SEQ ID NO: 338030 - DNA, 25 bp, Mus musculus
gcgaacacggtgctactcaaggccc

SEQ ID NO: 338031 - DNA, 25 bp, Mus musculus
agttatcctcgtgccctggagtctg

SEQ ID NO: 338032 - DNA, 25 bp, Mus musculus
cccggactcttaagcgcagacatga

SEQ ID NO: 338033 - DNA, 25 bp, Mus musculus
cccgaggcaggaagacgagttcgaa

SEQ ID NO: 338034 - DNA, 25 bp, Mus musculus
ctccaagcttgggttctgtccgttg

SEQ ID NO: 338035 - DNA, 25 bp, Mus musculus
atgcctgggcccgtgagtaccgcga

SEQ ID NO: 338036 - DNA, 25 bp, Mus musculus
atggtcttcgggctgatgaccctcc

SEQ ID NO: 338037 - DNA, 25 bp, Mus musculus
tgatgaccctccctgcgggtggctc

SEQ ID NO: 338038 - DNA, 25 bp, Mus musculus
tggctcagaaccctagcctggtatc

SEQ ID NO: 338039 - DNA, 25 bp, Mus musculus
gagcggccaccagttcgcttggaaa

SEQ ID NO: 338040 - DNA, 25 bp, Mus musculus
ttgccacagcaacggggttgcgctc

SEQ ID NO: 338041 - DNA, 25 bp, Mus musculus
gtgcactgtggagagagcatcgctc

SEQ ID NO: 338042 - DNA, 25 bp, Mus musculus
gagcatcgctcttctggccagtctg

SEQ ID NO: 338043 - DNA, 25 bp, Mus musculus
gtgcctgcctcagcacgtcgagggt

SEQ ID NO: 338044 - DNA, 25 bp, Mus musculus
gagccggctcccacgtggctgcagt

SEQ ID NO: 338045 - DNA, 25 bp, Mus musculus
ttcgcttggaaaccgttgccacagc

SEQ ID NO: 338046 - DNA, 25 bp, Mus musculus
cgagcggctttcgttgccactgtct

SEQ ID NO: 338047 - DNA, 25 bp, Mus musculus
gcttctggctcatctggggtctcat

SEQ ID NO: 338048 - DNA, 25 bp, Mus musculus
cctcgccggcatgtgcgcctattga

SEQ ID NO: 338049 - DNA, 25 bp, Mus musculus
gaaggagcgggaaccacagttgccc

SEQ ID NO: 338050 - DNA, 25 bp, Mus musculus
agggcacctacacgttcctcacttg

SEQ ID NO: 338051 - DNA, 25 bp, Mus musculus
ccgcgccaaggtaaggctgcgtttc

SEQ ID NO: 338052 - DNA, 25 bp, Mus musculus
aaacggcgccaggaggagcgactaa

SEQ ID NO: 338053 - DNA, 25 bp, Mus musculus
actaagggagcagaacttgcgtgcc

SEQ ID NO: 338054 - DNA, 25 bp, Mus musculus
ccctggagctatccgcgccaaggta

SEQ ID NO: 338055 - DNA, 25 bp, Mus musculus
ccacccttagcaccgggagaagcgg

SEQ ID NO: 338056 - DNA, 25 bp, Mus musculus
cggacatgtctaagccgccgtgcta

SEQ ID NO: 338057 - DNA, 25 bp, Mus musculus
ctacagcgaggtgctcacggacact

SEQ ID NO: 338058 - DNA, 25 bp, Mus musculus
gaggacctgccgcttgtgccgcagc

SEQ ID NO: 338059 - DNA, 25 bp, Mus musculus
gttccgcagcggaatcggacatgtc

SEQ ID NO: 338060 - DNA, 25 bp, Mus musculus
aaggaccctggcgagcctcgctgag

SEQ ID NO: 338061 - DNA, 25 bp, Mus musculus
aggtgcccttggctggcccgtgcac

SEQ ID NO: 338062 - DNA, 25 bp, Mus musculus
gccgttgcaccatttcggggtctcc

SEQ ID NO: 338063 - DNA, 25 bp, Mus musculus
ctgcgctctcctcccggatcacctc

SEQ ID NO: 338064 - DNA, 25 bp, Mus musculus
tcccgagccgttgcaccatttcggg

SEQ ID NO: 338065 - DNA, 25 bp, Mus musculus
atgggctccgacaggaccgtaggac

SEQ ID NO: 338066 - DNA, 25 bp, Mus musculus
cggacagacgcacgcacaggcggac

SEQ ID NO: 338067 - DNA, 25 bp, Mus musculus
cccgctcgaagtggcgaaggtgccc

SEQ ID NO: 338068 - DNA, 25 bp, Mus musculus
gtcctcgcccgctcgaagtggcgaa

SEQ ID NO: 338069 - DNA, 25 bp, Mus musculus
acaggcggaccgaccgacaccggag

SEQ ID NO: 338070 - DNA, 25 bp, Mus musculus
agagcctctgcagcgctgagagcga

SEQ ID NO: 338071 - DNA, 25 bp, Mus musculus
cctctgcagcgctgagagcgagcga

SEQ ID NO: 338072 - DNA, 25 bp, Mus musculus
ggatcacctcctcgtacgccgccag

SEQ ID NO: 338073 - DNA, 25 bp, Mus musculus
cgctgaagctgacgccggccatgct

SEQ ID NO: 338074 - DNA, 25 bp, Mus musculus
acgtctgggcttcacacccgcgtgg

SEQ ID NO: 338075 - DNA, 25 bp, Mus musculus
cggccgaagccagccgagggaatct

SEQ ID NO: 338076 - DNA, 25 bp, Mus musculus
ctcggactatataaggcgtgtaagc

SEQ ID NO: 338077 - DNA, 25 bp, Mus musculus
agctgacactgtagagagcccgagg

SEQ ID NO: 338078 - DNA, 25 bp, Mus musculus
gagcgggtcctagccattttgggac

SEQ ID NO: 338079 - DNA, 25 bp, Mus musculus
cattttgggacaggtcgaggctgct

SEQ ID NO: 338080 - DNA, 25 bp, Mus musculus
gtgtcccttacgcacggccagagag

SEQ ID NO: 338081 - DNA, 25 bp, Mus musculus
gaggggatcctttctggaagccaga

SEQ ID NO: 338082 - DNA, 25 bp, Mus musculus
aaagtggtgccacccacgcacgatg

SEQ ID NO: 338083 - DNA, 25 bp, Mus musculus
ccggagcctgctcggactatataag

SEQ ID NO: 338084 - DNA, 25 bp, Mus musculus
cacagtggcgcaggcgccaatcagc

SEQ ID NO: 338085 - DNA, 25 bp, Mus musculus
ggaatctggcactcttcacgaccac

SEQ ID NO: 338086 - DNA, 25 bp, Mus musculus
ccgcgccttttgagcccgcggaagg

SEQ ID NO: 338087 - DNA, 25 bp, Mus musculus
ccaggccaaacgagtggacatcccg

SEQ ID NO: 338088 - DNA, 25 bp, Mus musculus
gcacgatgctcccttgccaacatga

SEQ ID NO: 338089 - DNA, 25 bp, Mus musculus
ggatgaatctgttgaacacgcccta

SEQ ID NO: 338090 - DNA, 25 bp, Mus musculus
gccgcaacggcacatagggtacgta

SEQ ID NO: 338091 - DNA, 25 bp, Mus musculus
gacatgtcgccgttgcaccagggat

SEQ ID NO: 338092 - DNA, 25 bp, Mus musculus
caagtcgtgggttaaaggatgaatc

SEQ ID NO: 338093 - DNA, 25 bp, Mus musculus
gcatgcgcagaagatccaagtcgtg

SEQ ID NO: 338094 - DNA, 25 bp, Mus musculus
tccggttccgaatcctccatcttag

SEQ ID NO: 338095 - DNA, 25 bp, Mus musculus
ccctgcaagcggtgctcgcaaaata

SEQ ID NO: 338096 - DNA, 25 bp, Mus musculus
agccaattgggtctggcgaagcctt

SEQ ID NO: 338097 - DNA, 25 bp, Mus musculus
aatcttcttccagcgcgtttacgga

SEQ ID NO: 338098 - DNA, 25 bp, Mus musculus
atcgcgaaccgggacaatcttcttc

SEQ ID NO: 338099 - DNA, 25 bp, Mus musculus
ggaaaaactgctgtggtcgcctagc

SEQ ID NO: 338100 - DNA, 25 bp, Mus musculus
caatgccagggcatctgagctccaa

SEQ ID NO: 338101 - DNA, 25 bp, Mus musculus
tcttaggctgcacacatgcgcaatg

SEQ ID NO: 338102 - DNA, 25 bp, Mus musculus
ttaacgtgagataacaccgctgttc

SEQ ID NO: 338103 - DNA, 25 bp, Mus musculus
taagcagcccggcagtcggagtcgt

SEQ ID NO: 338104 - DNA, 25 bp, Mus musculus
cacaggacaacagccaatatggcgg

SEQ ID NO: 338105 - DNA, 25 bp, Mus musculus
gggcgagatcctgtcctaagcacta

SEQ ID NO: 338106 - DNA, 25 bp, Mus musculus
taataaggccacctcgctgggcttc

SEQ ID NO: 338107 - DNA, 25 bp, Mus musculus
gtcagagggcacactcagtccgcgc

SEQ ID NO: 338108 - DNA, 25 bp, Mus musculus
gagtcatgctgcctcttgcgccgct

SEQ ID NO: 338109 - DNA, 25 bp, Mus musculus
tctcggggaccgtcgcaatccagct

SEQ ID NO: 338110 - DNA, 25 bp, Mus musculus
ttgggctcttcttcctctcggggac

SEQ ID NO: 338111 - DNA, 25 bp, Mus musculus
gcactagtccgaaaggctgcgatcg

SEQ ID NO: 338112 - DNA, 25 bp, Mus musculus
gtcggagtcgttttgctcgatccta

SEQ ID NO: 338113 - DNA, 25 bp, Mus musculus
gccgccagcgccatttttaataagg

SEQ ID NO: 338114 - DNA, 25 bp, Mus musculus
ccgctcccgctctggggaggtgtaa

SEQ ID NO: 338115 - DNA, 25 bp, Mus musculus
ttgctcgatcctacctgagggcctg

SEQ ID NO: 338116 - DNA, 25 bp, Mus musculus
cctgctgccaacaggtcagagggca

SEQ ID NO: 338117 - DNA, 25 bp, Mus musculus
ggaactcgcagtcccggcaggcact

SEQ ID NO: 338118 - DNA, 25 bp, Mus musculus
acttgtagtccatgcggcggaactc

SEQ ID NO: 338119 - DNA, 25 bp, Mus musculus
ttgtcggaagctcaccgggtctctt

SEQ ID NO: 338120 - DNA, 25 bp, Mus musculus
cttcctgctactgctgtggcttgca

SEQ ID NO: 338121 - DNA, 25 bp, Mus musculus
cggaagcgcgctgtatttccacatc

SEQ ID NO: 338122 - DNA, 25 bp, Mus musculus
ttccacatcggagaaacagaaaaga

SEQ ID NO: 338123 - DNA, 25 bp, Mus musculus
cattgaggagattccggacgagacc

SEQ ID NO: 338124 - DNA, 25 bp, Mus musculus
agcgtttgggacaagtcagtggtcc

SEQ ID NO: 338125 - DNA, 25 bp, Mus musculus
gatgcgacctgttccgggtagctag

SEQ ID NO: 338126 - DNA, 25 bp, Mus musculus
cgggtagctagcctggccgcgaacc

SEQ ID NO: 338127 - DNA, 25 bp, Mus musculus
cgcacctcttcgagcttatttcatc

SEQ ID NO: 338128 - DNA, 25 bp, Mus musculus
tttcatcttcctttttccgcctgtc

SEQ ID NO: 338129 - DNA, 25 bp, Mus musculus
cgcctgtctccaggaaattaccgga

SEQ ID NO: 338130 - DNA, 25 bp, Mus musculus
cgtggtgtatctagggacttgtagt

SEQ ID NO: 338131 - DNA, 25 bp, Mus musculus
ggcgcacgtacagcgagctgctgaa

SEQ ID NO: 338132 - DNA, 25 bp, Mus musculus
gtggcgccactgcttcgcaagatcc

SEQ ID NO: 338133 - DNA, 25 bp, Mus musculus
gcaagatccagtgccgggaccatga

SEQ ID NO: 338134 - DNA, 25 bp, Mus musculus
ccatgaggctgtgcctctgggcatc

SEQ ID NO: 338135 - DNA, 25 bp, Mus musculus
tctgggcatcttcagaaccggcatg

SEQ ID NO: 338136 - DNA, 25 bp, Mus musculus
aaccggcatgctgtcctgctttgtg

SEQ ID NO: 338137 - DNA, 25 bp, Mus musculus
ctttgtgctgctggaattcgtggca

SEQ ID NO: 338138 - DNA, 25 bp, Mus musculus
gaccctggtcaagcggtggccgatc

SEQ ID NO: 338139 - DNA, 25 bp, Mus musculus
gcgcaggagacatggcaacagcacc

SEQ ID NO: 338140 - DNA, 25 bp, Mus musculus
cgccttcaacaacaacgtgagcgtg

SEQ ID NO: 338141 - DNA, 25 bp, Mus musculus
cacgcactacctggaggccggttcg

SEQ ID NO: 338142 - DNA, 25 bp, Mus musculus
cttgggccctgacaacctggcgcgt

SEQ ID NO: 338143 - DNA, 25 bp, Mus musculus
ctacgagtgtctgagtgccagcggc

SEQ ID NO: 338144 - DNA, 25 bp, Mus musculus
tgccagcggccgcaagaagaaaccg

SEQ ID NO: 338145 - DNA, 25 bp, Mus musculus
agggcaaagctagctccggattgga

SEQ ID NO: 338146 - DNA, 25 bp, Mus musculus
ctcgtgcgcacggagaaagagagca

SEQ ID NO: 338147 - DNA, 25 bp, Mus musculus
gattggacgacccagccttccttgg

SEQ ID NO: 338148 - DNA, 25 bp, Mus musculus
tgcttttccagtaggcgcaggcgca

SEQ ID NO: 338149 - DNA, 25 bp, Mus musculus
atccacgttgctcctgcttttccag

SEQ ID NO: 338150 - DNA, 25 bp, Mus musculus
atcacaaggagcacagcgacgcgca

SEQ ID NO: 338151 - DNA, 25 bp, Mus musculus
agcaggctccgaagacagaaagtga

SEQ ID NO: 338152 - DNA, 25 bp, Mus musculus
gaccggaagtgaaacctcgtgcgca

SEQ ID NO: 338153 - DNA, 25 bp, Mus musculus
tcactcagcctcacaagcgagaagc

SEQ ID NO: 338154 - DNA, 25 bp, Mus musculus
ggtgtcctcctcatgcttttccagc

SEQ ID NO: 338155 - DNA, 25 bp, Mus musculus
cgccttccctgaagagacgagctca

SEQ ID NO: 338156 - DNA, 25 bp, Mus musculus
cttagcttctgcaaggcggagctga

SEQ ID NO: 338157 - DNA, 25 bp, Mus musculus
ggaacgcagacacccatccggacga

SEQ ID NO: 338158 - DNA, 25 bp, Mus musculus
agtgaaaactaaagcgccgtgctcg

SEQ ID NO: 338159 - DNA, 25 bp, Mus musculus
gagcggccgccaaacaaaggtacca

SEQ ID NO: 338160 - DNA, 25 bp, Mus musculus
ggcattgcggtcttggtagttctaa

SEQ ID NO: 338161 - DNA, 25 bp, Mus musculus
atgtccgtcagtttaccgattggcc

SEQ ID NO: 338162 - DNA, 25 bp, Mus musculus
ccgattggcctagaagactggacta

SEQ ID NO: 338163 - DNA, 25 bp, Mus musculus
tctgtttccatagaactggtgggta

SEQ ID NO: 338164 - DNA, 25 bp, Mus musculus
ggcgtcgttgtttgcatcgctcaaa

SEQ ID NO: 338165 - DNA, 25 bp, Mus musculus
tagaaacttggaagaggcgggctcc

SEQ ID NO: 338166 - DNA, 25 bp, Mus musculus
ggcgggctccaaagaatcctaccca

SEQ ID NO: 338167 - DNA, 25 bp, Mus musculus
tcctacccaatcctaggtcgtctga

SEQ ID NO: 338168 - DNA, 25 bp, Mus musculus
tgttcctctggagggctgtgagacc

SEQ ID NO: 338169 - DNA, 25 bp, Mus musculus
acaaaggtaccagtcgccgccacgg

SEQ ID NO: 338170 - DNA, 25 bp, Mus musculus
ctgtgcccgaggtagggacattctt

SEQ ID NO: 338171 - DNA, 25 bp, Mus musculus
ctctctcgtcgaacgcaggcaagtg

SEQ ID NO: 338172 - DNA, 25 bp, Mus musculus
ggaaagcgatgtttgcccgtcagtc

SEQ ID NO: 338173 - DNA, 25 bp, Mus musculus
gggctttgagccagagccccatgtc

SEQ ID NO: 338174 - DNA, 25 bp, Mus musculus
agacgccgcgtaggctgggcaggcc

SEQ ID NO: 338175 - DNA, 25 bp, Mus musculus
ggtgagcggccgcaacgggcaggag

SEQ ID NO: 338176 - DNA, 25 bp, Mus musculus
agccagagccccatgtcctgctgtg

SEQ ID NO: 338177 - DNA, 25 bp, Mus musculus
atgtcctgctgtgtcccgccacgat

SEQ ID NO: 338178 - DNA, 25 bp, Mus musculus
gtcctgctgtgtcccgccacgatgt

SEQ ID NO: 338179 - DNA, 25 bp, Mus musculus
ctgctgtgtcccgccacgatgttgc

SEQ ID NO: 338180 - DNA, 25 bp, Mus musculus
cgatgttgccctcccggaggaaagc

SEQ ID NO: 338181 - DNA, 25 bp, Mus musculus
ttgccctcccggaggaaagcggcgc

SEQ ID NO: 338182 - DNA, 25 bp, Mus musculus
tgccctcccggaggaaagcggcgca

SEQ ID NO: 338183 - DNA, 25 bp, Mus musculus
cctcccggaggaaagcggcgcagct

SEQ ID NO: 338184 - DNA, 25 bp, Mus musculus
gccctgggaggatggcaggtgagcg

SEQ ID NO: 338185 - DNA, 25 bp, Mus musculus
gcagcggggctttgagccagagccc

SEQ ID NO: 338186 - DNA, 25 bp, Mus musculus
cacgatgttgccctcccggaggaaa

SEQ ID NO: 338187 - DNA, 25 bp, Mus musculus
ccgtcagcctgatctagaccgtaga

SEQ ID NO: 338188 - DNA, 25 bp, Mus musculus
ttagcgcatgctcacgcttcagttc

SEQ ID NO: 338189 - DNA, 25 bp, Mus musculus
ggagcgaactctgcggccctgccat

SEQ ID NO: 338190 - DNA, 25 bp, Mus musculus
gcggccctgccataagtcatccttg

SEQ ID NO: 338191 - DNA, 25 bp, Mus musculus
taagtcatccttgcctttaccgtca

SEQ ID NO: 338192 - DNA, 25 bp, Mus musculus
tagaccgtagagaaagcatggagcc

SEQ ID NO: 338193 - DNA, 25 bp, Mus musculus
ctgcggaggagaaagctgctcatga

SEQ ID NO: 338194 - DNA, 25 bp, Mus musculus
agaaagctgctcatgaactccgagc

SEQ ID NO: 338195 - DNA, 25 bp, Mus musculus
tgaactccgagcaacgcatcaaccg

SEQ ID NO: 338196 - DNA, 25 bp, Mus musculus
cgcatcaaccggatcatgggctttc

SEQ ID NO: 338197 - DNA, 25 bp, Mus musculus
catgggctttcacaggcccgggagc

SEQ ID NO: 338198 - DNA, 25 bp, Mus musculus
tgagagcttcggtttcccgtctccc

SEQ ID NO: 338199 - DNA, 25 bp, Mus musculus
cctggcgcagccgattagcgcatgc

SEQ ID NO: 338200 - DNA, 25 bp, Mus musculus
gcctgtcggcttctcagcggcgagc

SEQ ID NO: 338201 - DNA, 25 bp, Mus musculus
aaaagtaagttgttgctgccggcgc

SEQ ID NO: 338202 - DNA, 25 bp, Mus musculus
tgtccatttcgtaggaccggtcctc

SEQ ID NO: 338203 - DNA, 25 bp, Mus musculus
tcctcgctcggtaccgtgagagctt

SEQ ID NO: 338204 - DNA, 25 bp, Mus musculus
gtcctcttcataggcctgcgcatcg

SEQ ID NO: 338205 - DNA, 25 bp, Mus musculus
ccgattgccgtgagcttgcgaccac

SEQ ID NO: 338206 - DNA, 25 bp, Mus musculus
cgggtcaacccagagccggttcact

SEQ ID NO: 338207 - DNA, 25 bp, Mus musculus
gttcctcttcgtcttcacaacattg

SEQ ID NO: 338208 - DNA, 25 bp, Mus musculus
cattgtttgcctccactctgggtta

SEQ ID NO: 338209 - DNA, 25 bp, Mus musculus
actctgggttactttcgtgcgcacg

SEQ ID NO: 338210 - DNA, 25 bp, Mus musculus
ccacgctctgatggcggtcactgct

SEQ ID NO: 338211 - DNA, 25 bp, Mus musculus
cctgttttcgttggccacgctctga

SEQ ID NO: 338212 - DNA, 25 bp, Mus musculus
ggcaccagcacatcctgttttcgtt

SEQ ID NO: 338213 - DNA, 25 bp, Mus musculus
tcactgctggagctctgtccatttc

SEQ ID NO: 338214 - DNA, 25 bp, Mus musculus
tgcgggttgcgctagaaaagtaagt

SEQ ID NO: 338215 - DNA, 25 bp, Mus musculus
tctcgcgatacttaggcgtgcctgc

SEQ ID NO: 338216 - DNA, 25 bp, Mus musculus
accctgcattctgggaagtcaccga

SEQ ID NO: 338217 - DNA, 25 bp, Mus musculus
tgttgtgtaaacttctcgggaggcg

SEQ ID NO: 338218 - DNA, 25 bp, Mus musculus
aggagaccgttatttatgttgtgta

SEQ ID NO: 338219 - DNA, 25 bp, Mus musculus
cacggctaaggagcgcagagaagac

SEQ ID NO: 338220 - DNA, 25 bp, Mus musculus
cccgttaggatgctgacttggggaa

SEQ ID NO: 338221 - DNA, 25 bp, Mus musculus
cggcctcgcggcaagcggaagtcac

SEQ ID NO: 338222 - DNA, 25 bp, Mus musculus
gagctttcctgcctatgggcggccc

SEQ ID NO: 338223 - DNA, 25 bp, Mus musculus
actggagctccgcacagggaccgtc

SEQ ID NO: 338224 - DNA, 25 bp, Mus musculus
tgggaagtcaccgagccgaccatcc

SEQ ID NO: 338225 - DNA, 25 bp, Mus musculus
tgcgtcacggagtgaccctgcattc

SEQ ID NO: 338226 - DNA, 25 bp, Mus musculus
cgggcttcaaacgatgcctgcgtca

SEQ ID NO: 338227 - DNA, 25 bp, Mus musculus
ggccgcgcgaagagtctcgcgatac

SEQ ID NO: 338228 - DNA, 25 bp, Mus musculus
ccgctcgctcatcttggcgggactg

SEQ ID NO: 338229 - DNA, 25 bp, Mus musculus
ctctgcgatgcgcactttatgatca

SEQ ID NO: 338230 - DNA, 25 bp, Mus musculus
gatgcgcactttatgatcagccgtc

SEQ ID NO: 338231 - DNA, 25 bp, Mus musculus
ggcctggcccgataccctctgcgat

SEQ ID NO: 338232 - DNA, 25 bp, Mus musculus
gtgctgggccttccggcccacggcc

SEQ ID NO: 338233 - DNA, 25 bp, Mus musculus
ctctgctggtggcaagtcctgctgt

SEQ ID NO: 338234 - DNA, 25 bp, Mus musculus
tcctctgctggtggcaagtcctgct

SEQ ID NO: 338235 - DNA, 25 bp, Mus musculus
cgccgattttcttccaccgcggtgg

SEQ ID NO: 338236 - DNA, 25 bp, Mus musculus
tgccggtgcgccgattttcttccac

SEQ ID NO: 338237 - DNA, 25 bp, Mus musculus
ctccggttgccggtgcgccgatttt

SEQ ID NO: 338238 - DNA, 25 bp, Mus musculus
tgcagcgtcggccaggagtcaagat

SEQ ID NO: 338239 - DNA, 25 bp, Mus musculus
ctccaagatggcgtctgcagcgtcg

SEQ ID NO: 338240 - DNA, 25 bp, Mus musculus
gcccgactccaagatggcgtctgca

SEQ ID NO: 338241 - DNA, 25 bp, Mus musculus
gcactttatgatcagccgtcaaacg

SEQ ID NO: 338242 - DNA, 25 bp, Mus musculus
gcgccatgcaactcctctgctggtg

SEQ ID NO: 338243 - DNA, 25 bp, Mus musculus
cggcggaacccatggaggcctctct

SEQ ID NO: 338244 - DNA, 25 bp, Mus musculus
cggagatcccatggtggtgctgtca

SEQ ID NO: 338245 - DNA, 25 bp, Mus musculus
cgagagaacctcttcgggctgcagg

SEQ ID NO: 338246 - DNA, 25 bp, Mus musculus
tggccgagagaacctcttcgggctg

SEQ ID NO: 338247 - DNA, 25 bp, Mus musculus
aggacccgagctgtggccgagagaa

SEQ ID NO: 338248 - DNA, 25 bp, Mus musculus
ccacgatggcacctgcagtgcgcag

SEQ ID NO: 338249 - DNA, 25 bp, Mus musculus
cgaggcccacgatggcacctgcagt

SEQ ID NO: 338250 - DNA, 25 bp, Mus musculus
cagctgaggaccaacggagccccga

SEQ ID NO: 338251 - DNA, 25 bp, Mus musculus
agatcccatggtggtgctgtcagtg

SEQ ID NO: 338252 - DNA, 25 bp, Mus musculus
gcctctctgggtccgcgcggagatc

SEQ ID NO: 338253 - DNA, 25 bp, Mus musculus
cggaacccatggaggcctctctggg

SEQ ID NO: 338254 - DNA, 25 bp, Mus musculus
gaccaggcaagagcggcggaaccca

SEQ ID NO: 338255 - DNA, 25 bp, Mus musculus
acccatggaggcctctctgggtccg

SEQ ID NO: 338256 - DNA, 25 bp, Mus musculus
gctgtcagtggtccctggggcagct

SEQ ID NO: 338257 - DNA, 25 bp, Mus musculus
cagccgggtctttaagccctgagca

SEQ ID NO: 338258 - DNA, 25 bp, Mus musculus
cgcggcagccgggtctttaagccct

SEQ ID NO: 338259 - DNA, 25 bp, Mus musculus
cgtcaggcagcacgccgggcagccc

SEQ ID NO: 338260 - DNA, 25 bp, Mus musculus
ccgggtctttaagccctgagcacag

SEQ ID NO: 338261 - DNA, 25 bp, Mus musculus
cctgagcacagcagcggtggcccgg

SEQ ID NO: 338262 - DNA, 25 bp, Mus musculus
ggcgctcggtctgcaaagagttccc

SEQ ID NO: 338263 - DNA, 25 bp, Mus musculus
gctcggtctgcaaagagttcccgcg

SEQ ID NO: 338264 - DNA, 25 bp, Mus musculus
cggtctgcaaagagttcccgcgggc

SEQ ID NO: 338265 - DNA, 25 bp, Mus musculus
tctgcaaagagttcccgcgggcgcg

SEQ ID NO: 338266 - DNA, 25 bp, Mus musculus
tgcctgcgccgcgtcaggcagcacg

SEQ ID NO: 338267 - DNA, 25 bp, Mus musculus
cagcccgggaccatggtggcggcag

SEQ ID NO: 338268 - DNA, 25 bp, Mus musculus
cgggccttcgttccttctgctgcgt

SEQ ID NO: 338269 - DNA, 25 bp, Mus musculus
ccttcgttccttctgctgcgtgggg

SEQ ID NO: 338270 - DNA, 25 bp, Mus musculus
ctgcagagaggagcgagctcagcgc

SEQ ID NO: 338271 - DNA, 25 bp, Mus musculus
ccaggttccctacattcagttcacg

SEQ ID NO: 338272 - DNA, 25 bp, Mus musculus
tcttgaccgggtgaacgatcccagg

SEQ ID NO: 338273 - DNA, 25 bp, Mus musculus
atcccgggtttgaacgcaccatctg

SEQ ID NO: 338274 - DNA, 25 bp, Mus musculus
ccatcgccagggacattgcaactta

SEQ ID NO: 338275 - DNA, 25 bp, Mus musculus
tccagcatttttctccgacgtcttt

SEQ ID NO: 338276 - DNA, 25 bp, Mus musculus
cggtcagctgttgtactggcaagcg

SEQ ID NO: 338277 - DNA, 25 bp, Mus musculus
cccgccatgtcccattggtgtagtg

SEQ ID NO: 338278 - DNA, 25 bp, Mus musculus
gcaaggctcgagttgcacgtgtccc

SEQ ID NO: 338279 - DNA, 25 bp, Mus musculus
aaagctcttggtagacagcggcgcc

SEQ ID NO: 338280 - DNA, 25 bp, Mus musculus
ccgcccagttgttgtaggagtagcc

SEQ ID NO: 338281 - DNA, 25 bp, Mus musculus
tacacgtcctcgtagggctgcacca

SEQ ID NO: 338282 - DNA, 25 bp, Mus musculus
ccaggccgctgaactgcggcacata

SEQ ID NO: 338283 - DNA, 25 bp, Mus musculus
aacgacgagtgctgcttggacttga

SEQ ID NO: 338284 - DNA, 25 bp, Mus musculus
tgcagaccgccatagccaaacgacg

SEQ ID NO: 338285 - DNA, 25 bp, Mus musculus
cccgggtgtggcacgcaagcgcttt

SEQ ID NO: 338286 - DNA, 25 bp, Mus musculus
gcagccgcactctaggcccgggtgt

SEQ ID NO: 338287 - DNA, 25 bp, Mus musculus
ttctagacccggcagtggcgcgcag

SEQ ID NO: 338288 - DNA, 25 bp, Mus musculus
acaggcgcattctagacccggcagt

SEQ ID NO: 338289 - DNA, 25 bp, Mus musculus
aggcgtcgcacaggcgcattctaga

SEQ ID NO: 338290 - DNA, 25 bp, Mus musculus
acacattccggacccggtggaggcg

SEQ ID NO: 338291 - DNA, 25 bp, Mus musculus
gcgcagacacattccggacccggtg

SEQ ID NO: 338292 - DNA, 25 bp, Mus musculus
gctcccgcacaagccacgcccaatt

SEQ ID NO: 338293 - DNA, 25 bp, Mus musculus
gcacacaggcatccgcggagctctt

SEQ ID NO: 338294 - DNA, 25 bp, Mus musculus
atccgcggagctcttccggccggag

SEQ ID NO: 338295 - DNA, 25 bp, Mus musculus
acgcaagcgctttcggggcccgaag

SEQ ID NO: 338296 - DNA, 25 bp, Mus musculus
ggcctccggagcttcggaaacgcaa

SEQ ID NO: 338297 - DNA, 25 bp, Mus musculus
gacgacgactacacttcccggtgtg

SEQ ID NO: 338298 - DNA, 25 bp, Mus musculus
cttcggaaacgcaaggcgcctgcgc

SEQ ID NO: 338299 - DNA, 25 bp, Mus musculus
accgcgctccttgtctgcagcaggt

SEQ ID NO: 338300 - DNA, 25 bp, Mus musculus
ctactgagtgccagccggtagccct

SEQ ID NO: 338301 - DNA, 25 bp, Mus musculus
cccgcactcgcggttcagtgaggtt

SEQ ID NO: 338302 - DNA, 25 bp, Mus musculus
cctctctcatgctcatgtcggggta

SEQ ID NO: 338303 - DNA, 25 bp, Mus musculus
ctcatgtcggggtagcggttccttt

SEQ ID NO: 338304 - DNA, 25 bp, Mus musculus
ggaacgtggcctccagctcttgcaa

SEQ ID NO: 338305 - DNA, 25 bp, Mus musculus
gctcttgcaactgctggcttgtgaa

SEQ ID NO: 338306 - DNA, 25 bp, Mus musculus
tgccgccgctgtttcttcttcttag

SEQ ID NO: 338307 - DNA, 25 bp, Mus musculus
tccttgtctgcagcaggtaggaatg

SEQ ID NO: 338308 - DNA, 25 bp, Mus musculus
cgcgagtcacctcgggctaacacta

SEQ ID NO: 338309 - DNA, 25 bp, Mus musculus
tcgggctaacactatcgcgcccggt

SEQ ID NO: 338310 - DNA, 25 bp, Mus musculus
cttgtgaagtgagtgcgttgccgcc

SEQ ID NO: 338311 - DNA, 25 bp, Mus musculus
ccgcgaggtcagagttgtaagtcta

SEQ ID NO: 338312 - DNA, 25 bp, Mus musculus
ttgtaagtctaagctactgagtgcc

SEQ ID NO: 338313 - DNA, 25 bp, Mus musculus
ggagccgcgtttacctggcagatca

SEQ ID NO: 338314 - DNA, 25 bp, Mus musculus
gaaagctcctcgctgcagagacgca

SEQ ID NO: 338315 - DNA, 25 bp, Mus musculus
cgtgttcatcgtcaggttaagacca

SEQ ID NO: 338316 - DNA, 25 bp, Mus musculus
ccaggctgcgacctgttggggacaa

SEQ ID NO: 338317 - DNA, 25 bp, Mus musculus
gcgcgtgtaaatttccgtgttcatc

SEQ ID NO: 338318 - DNA, 25 bp, Mus musculus
tgtgcgtgcgaacgcgcgtgtaaat

SEQ ID NO: 338319 - DNA, 25 bp, Mus musculus
tcggacgattcgctggcggagttct

SEQ ID NO: 338320 - DNA, 25 bp, Mus musculus
tgcctcccttgaaggcgtccatgga

SEQ ID NO: 338321 - DNA, 25 bp, Mus musculus
cctggcagatcagcgtcggacgatt

SEQ ID NO: 338322 - DNA, 25 bp, Mus musculus
attcgaggccggtttctaaggctcg

SEQ ID NO: 338323 - DNA, 25 bp, Mus musculus
ggagcccgcagagtctgtctgaaaa

SEQ ID NO: 338324 - DNA, 25 bp, Mus musculus
tctgaaaacgacagtgcgcgcagcc

SEQ ID NO: 338325 - DNA, 25 bp, Mus musculus
aggttccagcagtccctgcgccagg

SEQ ID NO: 338326 - DNA, 25 bp, Mus musculus
agcgacgccgttcgagctccatcga

SEQ ID NO: 338327 - DNA, 25 bp, Mus musculus
ccgcaggttccatgcgtcgcagatc

SEQ ID NO: 338328 - DNA, 25 bp, Mus musculus
tgcagagtcatgttccgtgccaggc

SEQ ID NO: 338329 - DNA, 25 bp, Mus musculus
accggccatggtagtgaaagcagca

SEQ ID NO: 338330 - DNA, 25 bp, Mus musculus
cccagacatggtcccgtgtgtcgga

SEQ ID NO: 338331 - DNA, 25 bp, Mus musculus
cgctgactacattcaggtattcggg

SEQ ID NO: 338332 - DNA, 25 bp, Mus musculus
cgcggttacagcttctcgctgacta

SEQ ID NO: 338333 - DNA, 25 bp, Mus musculus
tggctgtgttccgactttccgggta

SEQ ID NO: 338334 - DNA, 25 bp, Mus musculus
cctaggtgactctcctccaatcaga

SEQ ID NO: 338335 - DNA, 25 bp, Mus musculus
agaccgctgtgatccaaaaactcca

SEQ ID NO: 338336 - DNA, 25 bp, Mus musculus
gcgcatgcgttaagtccgcccactt

SEQ ID NO: 338337 - DNA, 25 bp, Mus musculus
tcttctcaagacagagcgggacgcg

SEQ ID NO: 338338 - DNA, 25 bp, Mus musculus
gcagcaacgaaggagccatgatctt

SEQ ID NO: 338339 - DNA, 25 bp, Mus musculus
agcatacttactgcgcatgtgcgtg

SEQ ID NO: 338340 - DNA, 25 bp, Mus musculus
acggagctggactcgtagctttgca

SEQ ID NO: 338341 - DNA, 25 bp, Mus musculus
attcccaggggccagcgtttccatt

SEQ ID NO: 338342 - DNA, 25 bp, Mus musculus
cgaactaactaacgaatgaagcagt

SEQ ID NO: 338343 - DNA, 25 bp, Mus musculus
ccagtccgctcacgggccactgtct

SEQ ID NO: 338344 - DNA, 25 bp, Mus musculus
gatgcggcagctgccagtccgctca

SEQ ID NO: 338345 - DNA, 25 bp, Mus musculus
ccagcgtttccatttgcggtggggc

SEQ ID NO: 338346 - DNA, 25 bp, Mus musculus
tatgtcccaagtccttagccattcc

SEQ ID NO: 338347 - DNA, 25 bp, Mus musculus
cgcgaagctatgtcccaagtcctta

SEQ ID NO: 338348 - DNA, 25 bp, Mus musculus
cccttgtgacgcgaagctatgtccc

SEQ ID NO: 338349 - DNA, 25 bp, Mus musculus
gaaaaatacccttgtgacgcgaagc

SEQ ID NO: 338350 - DNA, 25 bp, Mus musculus
cgaatgaagcagtttcgtttgggaa

SEQ ID NO: 338351 - DNA, 25 bp, Mus musculus
ccctactactttttggcggcattgc

SEQ ID NO: 338352 - DNA, 25 bp, Mus musculus
cattgctaccctaacgaactaacta

SEQ ID NO: 338353 - DNA, 25 bp, Mus musculus
gcggcattgctaccctaacgaacta

SEQ ID NO: 338354 - DNA, 25 bp, Mus musculus
ccattcctggatgcggcagctgcca

SEQ ID NO: 338355 - DNA, 25 bp, Mus musculus
gcgcggagtcccacgggcgtggggc

SEQ ID NO: 338356 - DNA, 25 bp, Mus musculus
gacgtcggtacagctcaccgccaaa

SEQ ID NO: 338357 - DNA, 25 bp, Mus musculus
tccacgcgcaggagacgtcggtaca

SEQ ID NO: 338358 - DNA, 25 bp, Mus musculus
acgcgcaggagacgtcggtacagct

SEQ ID NO: 338359 - DNA, 25 bp, Mus musculus
cgcaggagacgtcggtacagctcac

SEQ ID NO: 338360 - DNA, 25 bp, Mus musculus
aggagacgtcggtacagctcaccgc

SEQ ID NO: 338361 - DNA, 25 bp, Mus musculus
gagacgtcggtacagctcaccgcca

SEQ ID NO: 338362 - DNA, 25 bp, Mus musculus
acgtcggtacagctcaccgccaaag

SEQ ID NO: 338363 - DNA, 25 bp, Mus musculus
gtacagctcaccgccaaagccgggg

SEQ ID NO: 338364 - DNA, 25 bp, Mus musculus
tttctccacgcgcaggagacgtcgg

SEQ ID NO: 338365 - DNA, 25 bp, Mus musculus
ggggcctttctccacgcgcaggaga

SEQ ID NO: 338366 - DNA, 25 bp, Mus musculus
cgctcgcctggacccaaggggaggg

SEQ ID NO: 338367 - DNA, 25 bp, Mus musculus
tctccacgcgcaggagacgtcggta

SEQ ID NO: 338368 - DNA, 25 bp, Mus musculus
ggcctttctccacgcgcaggagacg

SEQ ID NO: 338369 - DNA, 25 bp, Mus musculus
gtccggcctcagaaaggtgcctgta

SEQ ID NO: 338370 - DNA, 25 bp, Mus musculus
agcctcggttgtacccaggccttgg

SEQ ID NO: 338371 - DNA, 25 bp, Mus musculus
tcagaaaggtgcctgtaggtagcgc

SEQ ID NO: 338372 - DNA, 25 bp, Mus musculus
ttgtacccaggccttggtgctctgc

SEQ ID NO: 338373 - DNA, 25 bp, Mus musculus
agtgaactggaaccactcgcggcgg

SEQ ID NO: 338374 - DNA, 25 bp, Mus musculus
gcccggctaccgctggaaccagtga

SEQ ID NO: 338375 - DNA, 25 bp, Mus musculus
agagccgcggggcttccatagctcc

SEQ ID NO: 338376 - DNA, 25 bp, Mus musculus
tgctttccgaacaaaaccatccgga

SEQ ID NO: 338377 - DNA, 25 bp, Mus musculus
ctgggattccgtccgcgagtggtcc

SEQ ID NO: 338378 - DNA, 25 bp, Mus musculus
ccactttattgtgcccgggagggca

SEQ ID NO: 338379 - DNA, 25 bp, Mus musculus
gcggcgcacgagcaagtaaactctg

SEQ ID NO: 338380 - DNA, 25 bp, Mus musculus
taaactctgagcacagcagctccgg

SEQ ID NO: 338381 - DNA, 25 bp, Mus musculus
cgtctccgagcgaagttggtttccg

SEQ ID NO: 338382 - DNA, 25 bp, Mus musculus
gccaacgacgccagcctcggttgta

SEQ ID NO: 338383 - DNA, 25 bp, Mus musculus
tctccgaaaacgtcgcacaaagctg

SEQ ID NO: 338384 - DNA, 25 bp, Mus musculus
cgcggactcgtctaacgccctgttt

SEQ ID NO: 338385 - DNA, 25 bp, Mus musculus
ggcgagggcgctcaatctttgaacc

SEQ ID NO: 338386 - DNA, 25 bp, Mus musculus
aatcttcgggctttctacggctggc

SEQ ID NO: 338387 - DNA, 25 bp, Mus musculus
ctggccgagctattagcgccgttta

SEQ ID NO: 338388 - DNA, 25 bp, Mus musculus
caaaggcctagctagcgtaatggtc

SEQ ID NO: 338389 - DNA, 25 bp, Mus musculus
aatggtcacgctagcacgaaagggc

SEQ ID NO: 338390 - DNA, 25 bp, Mus musculus
ctcttccggtctcaatagcacttta

SEQ ID NO: 338391 - DNA, 25 bp, Mus musculus
ggtccgcacgcattttttcacattg

SEQ ID NO: 338392 - DNA, 25 bp, Mus musculus
cttgtgctacacactccagctgctg

SEQ ID NO: 338393 - DNA, 25 bp, Mus musculus
gcgttctgagagacttcggatcttt

SEQ ID NO: 338394 - DNA, 25 bp, Mus musculus
tcggatcttttcaggtccacaaagg

SEQ ID NO: 338395 - DNA, 25 bp, Mus musculus
gccggttgttccacctctgcatgca

SEQ ID NO: 338396 - DNA, 25 bp, Mus musculus
cgccgtttacccaagcgcaaacaga

SEQ ID NO: 338397 - DNA, 25 bp, Mus musculus
ctggagcagtcgagatcagagatgc

SEQ ID NO: 338398 - DNA, 25 bp, Mus musculus
tcctcgtcggtgaggaagctggaca

SEQ ID NO: 338399 - DNA, 25 bp, Mus musculus
tgtagcctggcacagtcctcctcgt

SEQ ID NO: 338400 - DNA, 25 bp, Mus musculus
tcgttggctttgacgcgacgactcc

SEQ ID NO: 338401 - DNA, 25 bp, Mus musculus
caatcttggtgagcttggtgtcgtc

SEQ ID NO: 338402 - DNA, 25 bp, Mus musculus
cccttgatctgccaggcgcagtgtc

SEQ ID NO: 338403 - DNA, 25 bp, Mus musculus
cataatttatgctcgcgggaggccg

SEQ ID NO: 338404 - DNA, 25 bp, Mus musculus
ctcctgtgagcaccaagtgtggcac

SEQ ID NO: 338405 - DNA, 25 bp, Mus musculus
catcttgcagtgtgcaggaccgaca

SEQ ID NO: 338406 - DNA, 25 bp, Mus musculus
atgtcgccggcgatcagatcagctc

SEQ ID NO: 338407 - DNA, 25 bp, Mus musculus
gcggcgcctgctatttgcataattt

SEQ ID NO: 338408 - DNA, 25 bp, Mus musculus
tggagcgtgcccgtaattaccgccg

SEQ ID NO: 338409 - DNA, 25 bp, Mus musculus
tctccaaaggggcaggcatcttgca

SEQ ID NO: 338410 - DNA, 25 bp, Mus musculus
tcggccttcgaagcgcacttactgt

SEQ ID NO: 338411 - DNA, 25 bp, Mus musculus
accgggagggcttcaatggtctcca

SEQ ID NO: 338412 - DNA, 25 bp, Mus musculus
atggtctccaacacgctaatccttg

SEQ ID NO: 338413 - DNA, 25 bp, Mus musculus
gcctatagccacgtgaggaccggga

SEQ ID NO: 338414 - DNA, 25 bp, Mus musculus
cgcacgagacgcgactgagcctata

SEQ ID NO: 338415 - DNA, 25 bp, Mus musculus
agcgggttcctctcgtgagcgaatt

SEQ ID NO: 338416 - DNA, 25 bp, Mus musculus
cccgtctgcatttgaagggccgcgc

SEQ ID NO: 338417 - DNA, 25 bp, Mus musculus
ctgggaacgcgcaaagtgatccggc

SEQ ID NO: 338418 - DNA, 25 bp, Mus musculus
taatccttgttatcccacggcgcgg

SEQ ID NO: 338419 - DNA, 25 bp, Mus musculus
ctgggagtcaaaggcgaccttgttc

SEQ ID NO: 338420 - DNA, 25 bp, Mus musculus
aaggcgaccttgttccactcctgtc

SEQ ID NO: 338421 - DNA, 25 bp, Mus musculus
ccgcaccagagaggctgactagatt

SEQ ID NO: 338422 - DNA, 25 bp, Mus musculus
cgcaaggatgaattccggggacacc

SEQ ID NO: 338423 - DNA, 25 bp, Mus musculus
ggacaccgaggcatagcgaccttgg

SEQ ID NO: 338424 - DNA, 25 bp, Mus musculus
tgatccggcgcctgatcaagcacgc

SEQ ID NO: 338425 - DNA, 25 bp, Mus musculus
ccagctacgcccgtcgatgggtgct

SEQ ID NO: 338426 - DNA, 25 bp, Mus musculus
tacacttggaccctgcggaagagcg

SEQ ID NO: 338427 - DNA, 25 bp, Mus musculus
tttaaattcgctcctgccctctcgg

SEQ ID NO: 338428 - DNA, 25 bp, Mus musculus
caccctggcctcttttaaattcgct

SEQ ID NO: 338429 - DNA, 25 bp, Mus musculus
ggaacacttacacttggaccctgcg

SEQ ID NO: 338430 - DNA, 25 bp, Mus musculus
tgagtcgccgccgtacaggtctccg

SEQ ID NO: 338431 - DNA, 25 bp, Mus musculus
aggtctccgcgaccgcccaaggtgt

SEQ ID NO: 338432 - DNA, 25 bp, Mus musculus
cgccaggagcctcatgctggccgga

SEQ ID NO: 338433 - DNA, 25 bp, Mus musculus
gggaggagatctcccagaccgccct

SEQ ID NO: 338434 - DNA, 25 bp, Mus musculus
tcggtttcaagcacgcctctctctg

SEQ ID NO: 338435 - DNA, 25 bp, Mus musculus
gccctctcggagagcgagctcatta

SEQ ID NO: 338436 - DNA, 25 bp, Mus musculus
cattaatatgcagaaccactcggtg

SEQ ID NO: 338437 - DNA, 25 bp, Mus musculus
ccactcggtgactcactgagatttc

SEQ ID NO: 338438 - DNA, 25 bp, Mus musculus
ccggcttggttctcggtttcaagca

SEQ ID NO: 338439 - DNA, 25 bp, Mus musculus
gtgcctactccctgtgtgcctggcg

SEQ ID NO: 338440 - DNA, 25 bp, Mus musculus
ctggcgctggccttcacgctcttga

SEQ ID NO: 338441 - DNA, 25 bp, Mus musculus
tcacgctcttgagcggccaaggcgc

SEQ ID NO: 338442 - DNA, 25 bp, Mus musculus
ggtcacggacttaaggtgagcctcc

SEQ ID NO: 338443 - DNA, 25 bp, Mus musculus
cttaaggtgagcctccgatttcggg

SEQ ID NO: 338444 - DNA, 25 bp, Mus musculus
agcctccgatttcggggactcggtg

SEQ ID NO: 338445 - DNA, 25 bp, Mus musculus
cgcccttcttatagagccgcagtgg

SEQ ID NO: 338446 - DNA, 25 bp, Mus musculus
cagctcctggacgaggcgacatggc

SEQ ID NO: 338447 - DNA, 25 bp, Mus musculus
gacgctgggtacgtgcctactccct

SEQ ID NO: 338448 - DNA, 25 bp, Mus musculus
ctccgctcctgtagcgcgagcggga

SEQ ID NO: 338449 - DNA, 25 bp, Mus musculus
gtggtcacgtgccaacgcttctcca

SEQ ID NO: 338450 - DNA, 25 bp, Mus musculus
tgtggcctgtgtggtcacgtgccaa

SEQ ID NO: 338451 - DNA, 25 bp, Mus musculus
agctcaagggcagtccaggctccag

SEQ ID NO: 338452 - DNA, 25 bp, Mus musculus
ctcggtggttccctactcgggctcg

SEQ ID NO: 338453 - DNA, 25 bp, Mus musculus
tgaacactagcacactggggcaagg

SEQ ID NO: 338454 - DNA, 25 bp, Mus musculus
cgagacctagtctgctcggaaccga

SEQ ID NO: 338455 - DNA, 25 bp, Mus musculus
aggtaacatttgtggcgcagcacta

SEQ ID NO: 338456 - DNA, 25 bp, Mus musculus
ggcatctttaagaggcagccacttc

SEQ ID NO: 338457 - DNA, 25 bp, Mus musculus
cctcaggagcgcgttcggaggtaac

SEQ ID NO: 338458 - DNA, 25 bp, Mus musculus
cggggattcgagaggctgaacacta

SEQ ID NO: 338459 - DNA, 25 bp, Mus musculus
tctcaccgctttcagctagggtccg

SEQ ID NO: 338460 - DNA, 25 bp, Mus musculus
gcgtcagggtctacctctcggtgaa

SEQ ID NO: 338461 - DNA, 25 bp, Mus musculus
gggcctggcctgtgatgcccattta

SEQ ID NO: 338462 - DNA, 25 bp, Mus musculus
ggggcttttcagctctctcaccgct

SEQ ID NO: 338463 - DNA, 25 bp, Mus musculus
tagctgctggcgttcgtcacgcaga

SEQ ID NO: 338464 - DNA, 25 bp, Mus musculus
gatgcccatttagtctctcactgtc

SEQ ID NO: 338465 - DNA, 25 bp, Mus musculus
gtctctcactgtccgcggctttatg

SEQ ID NO: 338466 - DNA, 25 bp, Mus musculus
acgcagagttctgcgcttgaccggc

SEQ ID NO: 338467 - DNA, 25 bp, Mus musculus
cataggacaggtcactgaactgcca

SEQ ID NO: 338468 - DNA, 25 bp, Mus musculus
gcgcctgctttcatcgtgggtccgc

SEQ ID NO: 338469 - DNA, 25 bp, Mus musculus
tgctcagctggggacatcatacctg

SEQ ID NO: 338470 - DNA, 25 bp, Mus musculus
tgaactgccagtgtgctcagctggg

SEQ ID NO: 338471 - DNA, 25 bp, Mus musculus
aggcgtgagcataggacaggtcact

SEQ ID NO: 338472 - DNA, 25 bp, Mus musculus
tcccagccgctctgtgatgggaggc

SEQ ID NO: 338473 - DNA, 25 bp, Mus musculus
agcacgggtaagtcccagccgctct

SEQ ID NO: 338474 - DNA, 25 bp, Mus musculus
agcatagccggctccggggtcgcca

SEQ ID NO: 338475 - DNA, 25 bp, Mus musculus
taccagctggtgctgcagcatagcc

SEQ ID NO: 338476 - DNA, 25 bp, Mus musculus
caagtcaccctaccagctggtgctg

SEQ ID NO: 338477 - DNA, 25 bp, Mus musculus
tgaccctcgctctggcactgtctgt

SEQ ID NO: 338478 - DNA, 25 bp, Mus musculus
atgcgactgctgaccctcgctctgg

SEQ ID NO: 338479 - DNA, 25 bp, Mus musculus
atggcgctcctcatgcgactgctga

SEQ ID NO: 338480 - DNA, 25 bp, Mus musculus
atcatacctggccaggggtgcgcgc

SEQ ID NO: 338481 - DNA, 25 bp, Mus musculus
gccagcgatccgaagcgtgtctctg

SEQ ID NO: 338482 - DNA, 25 bp, Mus musculus
tgggaattacactccggccagccgg

SEQ ID NO: 338483 - DNA, 25 bp, Mus musculus
aagtgccacttccaggctcgctgcg

SEQ ID NO: 338484 - DNA, 25 bp, Mus musculus
ctgcggacagcagaagccaggcctc

SEQ ID NO: 338485 - DNA, 25 bp, Mus musculus
ctgctaataaagttgcggcgcgtgc

SEQ ID NO: 338486 - DNA, 25 bp, Mus musculus
tctgggagataaggatccgcgctta

SEQ ID NO: 338487 - DNA, 25 bp, Mus musculus
ccgcgcttatcggtgggaattacac

SEQ ID NO: 338488 - DNA, 25 bp, Mus musculus
cgtcactctccggacgtcgcagagg

SEQ ID NO: 338489 - DNA, 25 bp, Mus musculus
ccctcgctgcgctaaactttgtgtg

SEQ ID NO: 338490 - DNA, 25 bp, Mus musculus
agcgaagcagcttttgtctctgccc

SEQ ID NO: 338491 - DNA, 25 bp, Mus musculus
gcatgcgtgcccaagttcagactcc

SEQ ID NO: 338492 - DNA, 25 bp, Mus musculus
gagccgggaaccctaagctctggga

SEQ ID NO: 338493 - DNA, 25 bp, Mus musculus
tggcccggacttttcggttgcagaa

SEQ ID NO: 338494 - DNA, 25 bp, Mus musculus
ccgtcttagggtcagagcatgctca

SEQ ID NO: 338495 - DNA, 25 bp, Mus musculus
ctgtggatttgggacctgacagcca

SEQ ID NO: 338496 - DNA, 25 bp, Mus musculus
ccggtgactcagagggatcagatta

SEQ ID NO: 338497 - DNA, 25 bp, Mus musculus
gagcagagtctgaccacatctgtga

SEQ ID NO: 338498 - DNA, 25 bp, Mus musculus
cgcggcggagctcaacttttgcaac

SEQ ID NO: 338499 - DNA, 25 bp, Mus musculus
ctcaacttttgcaaccggggcgctc

SEQ ID NO: 338500 - DNA, 25 bp, Mus musculus
tcgttgaaaagtcgacttgacggtc

SEQ ID NO: 338501 - DNA, 25 bp, Mus musculus
ccgcggttgaaccaaatcagaactg

SEQ ID NO: 338502 - DNA, 25 bp, Mus musculus
tacaggatccctgaaactgatgcgc

SEQ ID NO: 338503 - DNA, 25 bp, Mus musculus
ccctgaaactgatgcgcgggctgca

SEQ ID NO: 338504 - DNA, 25 bp, Mus musculus
tcaggccatccacggtagcccgagt

SEQ ID NO: 338505 - DNA, 25 bp, Mus musculus
gctcctccgagtggcggaaattaga

SEQ ID NO: 338506 - DNA, 25 bp, Mus musculus
aagccgcaggtacgtcccgcctgaa

SEQ ID NO: 338507 - DNA, 25 bp, Mus musculus
cccgcctgaagttctttgttttgcg

SEQ ID NO: 338508 - DNA, 25 bp, Mus musculus
cgcacgctgggatcagtcaggccat

SEQ ID NO: 338509 - DNA, 25 bp, Mus musculus
cacttctgatgctgtagaccggcgc

SEQ ID NO: 338510 - DNA, 25 bp, Mus musculus
tataccggtcgcgtcttccagggcg

SEQ ID NO: 338511 - DNA, 25 bp, Mus musculus
gtgtattatagcgaacctgtcctca

SEQ ID NO: 338512 - DNA, 25 bp, Mus musculus
agctggcagccgataaagaggacga

SEQ ID NO: 338513 - DNA, 25 bp, Mus musculus
cccgctagtggcgttgaacacgtcg

SEQ ID NO: 338514 - DNA, 25 bp, Mus musculus
aacacgtcgccgtacatgatccgcg

SEQ ID NO: 338515 - DNA, 25 bp, Mus musculus
cggcaggaccacctcacttctgatg

SEQ ID NO: 338516 - DNA, 25 bp, Mus musculus
gtcgtccgccgctcaagatgctcag

SEQ ID NO: 338517 - DNA, 25 bp, Mus musculus
gagttcccgcttctgtctgttgcta

SEQ ID NO: 338518 - DNA, 25 bp, Mus musculus
tctgttgctacctggagagttctga

SEQ ID NO: 338519 - DNA, 25 bp, Mus musculus
agccgctcttcagctccggtgagct

SEQ ID NO: 338520 - DNA, 25 bp, Mus musculus
cctcccagacgcctggtgtattata

SEQ ID NO: 338521 - DNA, 25 bp, Mus musculus
ccggcgctgctaagagcctccatga

SEQ ID NO: 338522 - DNA, 25 bp, Mus musculus
ccttttggagcggtcctgcagcctc

SEQ ID NO: 338523 - DNA, 25 bp, Mus musculus
cgtgggagaagcgcgtgccatcctc

SEQ ID NO: 338524 - DNA, 25 bp, Mus musculus
atggctgaggatggcctccacaatg

SEQ ID NO: 338525 - DNA, 25 bp, Mus musculus
ctgaggatggcctccacaatgcgca

SEQ ID NO: 338526 - DNA, 25 bp, Mus musculus
gcgcgtcgcccacccgcgccaagtt

SEQ ID NO: 338527 - DNA, 25 bp, Mus musculus
gcgccaagttctctttcttcagcaa

SEQ ID NO: 338528 - DNA, 25 bp, Mus musculus
gccaagttctctttcttcagcaaca

SEQ ID NO: 338529 - DNA, 25 bp, Mus musculus
ctctttcttcagcaacagttcagtg

SEQ ID NO: 338530 - DNA, 25 bp, Mus musculus
tcttcagcaacagttcagtgacctc

SEQ ID NO: 338531 - DNA, 25 bp, Mus musculus
gcaacagttcagtgacctccaagtg

SEQ ID NO: 338532 - DNA, 25 bp, Mus musculus
gttcagtgacctccaagtgctcgtt

SEQ ID NO: 338533 - DNA, 25 bp, Mus musculus
gtgacctccaagtgctcgttgccca

SEQ ID NO: 338534 - DNA, 25 bp, Mus musculus
aagtgctcgttgcccacggccagct

SEQ ID NO: 338535 - DNA, 25 bp, Mus musculus
atagaagtcatcatcccgcagctcc

SEQ ID NO: 338536 - DNA, 25 bp, Mus musculus
ggccctgcgcgaaggccggatggct

SEQ ID NO: 338537 - DNA, 25 bp, Mus musculus
gaaggtcccaactacgccaaatatg

SEQ ID NO: 338538 - DNA, 25 bp, Mus musculus
gtcccatccgggagcgtgattcatt

SEQ ID NO: 338539 - DNA, 25 bp, Mus musculus
gctcagtgttctgcggacacgtacc

SEQ ID NO: 338540 - DNA, 25 bp, Mus musculus
aggcaaaggtctctctgctcccggc

SEQ ID NO: 338541 - DNA, 25 bp, Mus musculus
gcttcccgttcccagctaaggcaaa

SEQ ID NO: 338542 - DNA, 25 bp, Mus musculus
acggcgctctgagcatcatcccagg

SEQ ID NO: 338543 - DNA, 25 bp, Mus musculus
ccggatgctcaatgtgccagccgca

SEQ ID NO: 338544 - DNA, 25 bp, Mus musculus
tgtccacttggaggaagcaccacgc

SEQ ID NO: 338545 - DNA, 25 bp, Mus musculus
cagctacaaacgcagagcctaggtc

SEQ ID NO: 338546 - DNA, 25 bp, Mus musculus
gcccttatgcatggaaacagctaca

SEQ ID NO: 338547 - DNA, 25 bp, Mus musculus
aggttgcacctggagagcccttatg

SEQ ID NO: 338548 - DNA, 25 bp, Mus musculus
tctcacacctgggacggaggttgca

SEQ ID NO: 338549 - DNA, 25 bp, Mus musculus
gccggtgacaacagggctacctcaa

SEQ ID NO: 338550 - DNA, 25 bp, Mus musculus
ggggccgccgtcaaactactgaaga

SEQ ID NO: 338551 - DNA, 25 bp, Mus musculus
tgcccgccgaagcaagcccatgaga

SEQ ID NO: 338552 - DNA, 25 bp, Mus musculus
ttgcgagccacgcaggatttattcg

SEQ ID NO: 338553 - DNA, 25 bp, Mus musculus
ggacatgttccttgcgagccacgca

SEQ ID NO: 338554 - DNA, 25 bp, Mus musculus
gcagcgagctcctgcggacatgttc

SEQ ID NO: 338555 - DNA, 25 bp, Mus musculus
gccctgtgaactcagcagcgagctc

SEQ ID NO: 338556 - DNA, 25 bp, Mus musculus
cgctggcgatgctccgccctgtgaa

SEQ ID NO: 338557 - DNA, 25 bp, Mus musculus
tgagaccgggtaacccagaccaggc

SEQ ID NO: 338558 - DNA, 25 bp, Mus musculus
caagcccatgagagggaacaccacc

SEQ ID NO: 338559 - DNA, 25 bp, Mus musculus
ggctggtggctccattaatccaatg

SEQ ID NO: 338560 - DNA, 25 bp, Mus musculus
cgttcccaacggatcagcccgggtg

SEQ ID NO: 338561 - DNA, 25 bp, Mus musculus
tcgcgggaattctggccgttcccaa

SEQ ID NO: 338562 - DNA, 25 bp, Mus musculus
tgacctgccggccaatcagcggctg

SEQ ID NO: 338563 - DNA, 25 bp, Mus musculus
tctccgtggagcgtttcctggcgac

SEQ ID NO: 338564 - DNA, 25 bp, Mus musculus
gggaacaccaccaaagcccttgaga

SEQ ID NO: 338565 - DNA, 25 bp, Mus musculus
tgaccttcatgatcttgggctctgc

SEQ ID NO: 338566 - DNA, 25 bp, Mus musculus
gcgtctcccgttcttcgttgaaaga

SEQ ID NO: 338567 - DNA, 25 bp, Mus musculus
tgcaaacggggtttctgccaggcac

SEQ ID NO: 338568 - DNA, 25 bp, Mus musculus
caccgtgatggtgcgctaagatgac

SEQ ID NO: 338569 - DNA, 25 bp, Mus musculus
gacgtcacggccagcgaaattgcta

SEQ ID NO: 338570 - DNA, 25 bp, Mus musculus
aacgtctggcccattgctcacggtc

SEQ ID NO: 338571 - DNA, 25 bp, Mus musculus
agcggcgagctactttattttaata

SEQ ID NO: 338572 - DNA, 25 bp, Mus musculus
gatccttttctagccggcggacgaa

SEQ ID NO: 338573 - DNA, 25 bp, Mus musculus
gggcatggcgggagaacttaaccca

SEQ ID NO: 338574 - DNA, 25 bp, Mus musculus
ccgtgggcgtctgcttatgaaatag

SEQ ID NO: 338575 - DNA, 25 bp, Mus musculus
ctcacctgctggaccgagctgttct

SEQ ID NO: 338576 - DNA, 25 bp, Mus musculus
catggcagcgctcgatccttttcta

SEQ ID NO: 338577 - DNA, 25 bp, Mus musculus
cgcgttggccaaggagccgactcat

SEQ ID NO: 338578 - DNA, 25 bp, Mus musculus
ttctctttaggcgtcttcaccgtga

SEQ ID NO: 338579 - DNA, 25 bp, Mus musculus
cccttgagaaatgtcgccagtggag

SEQ ID NO: 338580 - DNA, 25 bp, Mus musculus
ctccaccgacatcccttgagaaatg

SEQ ID NO: 338581 - DNA, 25 bp, Mus musculus
tgcttgtgtttttccagcgcctctg

SEQ ID NO: 338582 - DNA, 25 bp, Mus musculus
ccttcacataaacagacgaggctga

SEQ ID NO: 338583 - DNA, 25 bp, Mus musculus
tcgggaaccgaagccaaatctcacg

SEQ ID NO: 338584 - DNA, 25 bp, Mus musculus
acgaggctgaagaacaatgcttgtg

SEQ ID NO: 338585 - DNA, 25 bp, Mus musculus
gggcgcaagcgccttcacataaaca

SEQ ID NO: 338586 - DNA, 25 bp, Mus musculus
ttgtgcgagagcctgcgcatctacc

SEQ ID NO: 338587 - DNA, 25 bp, Mus musculus
tctcacgcacgagcagttccgggtg

SEQ ID NO: 338588 - DNA, 25 bp, Mus musculus
gggtgctccaaaacttgttcgcgaa

SEQ ID NO: 338589 - DNA, 25 bp, Mus musculus
tgttcgcgaagtacccggagaaaga

SEQ ID NO: 338590 - DNA, 25 bp, Mus musculus
cgagacgcggtgtccaagcctgcaa

SEQ ID NO: 338591 - DNA, 25 bp, Mus musculus
aagcctgcaagcgacaccggcgtcg

SEQ ID NO: 338592 - DNA, 25 bp, Mus musculus
gcagacaatgggataaacttttgcc

SEQ ID NO: 338593 - DNA, 25 bp, Mus musculus
ctcagggccagggtctgagcgcata

SEQ ID NO: 338594 - DNA, 25 bp, Mus musculus
caagttctccctgcggatgttcggc

SEQ ID NO: 338595 - DNA, 25 bp, Mus musculus
tcccgcgcgccctagttgcagtggg

SEQ ID NO: 338596 - DNA, 25 bp, Mus musculus
gccctagttgcagtgggcgagaacc

SEQ ID NO: 338597 - DNA, 25 bp, Mus musculus
accctggtgtgcagagggtccgccc

SEQ ID NO: 338598 - DNA, 25 bp, Mus musculus
ccacgtcccggatggtgacctcggg

SEQ ID NO: 338599 - DNA, 25 bp, Mus musculus
cgtcaacaagttctccctgcggatg

SEQ ID NO: 338600 - DNA, 25 bp, Mus musculus
tgcagcccggcgtcaacaagttctc

SEQ ID NO: 338601 - DNA, 25 bp, Mus musculus
caattcggggcgcttctgcagcccg

SEQ ID NO: 338602 - DNA, 25 bp, Mus musculus
tcctgcagcgccaattcggggcgct

SEQ ID NO: 338603 - DNA, 25 bp, Mus musculus
ggcagccaggctagcttcctgcagc

SEQ ID NO: 338604 - DNA, 25 bp, Mus musculus
caaggtttcgttctcatgccgcggg

SEQ ID NO: 338605 - DNA, 25 bp, Mus musculus
ccgcccttttggaggcctggagtga

SEQ ID NO: 338606 - DNA, 25 bp, Mus musculus
cagttcgagtcaccgggccgaggat

SEQ ID NO: 338607 - DNA, 25 bp, Mus musculus
ttctcaaggcaacggcgcagcacgc

SEQ ID NO: 338608 - DNA, 25 bp, Mus musculus
ttgtcacctgttctcaaggcaacgg

SEQ ID NO: 338609 - DNA, 25 bp, Mus musculus
tccggacagcccaggtcttcgcagg

SEQ ID NO: 338610 - DNA, 25 bp, Mus musculus
tcacggcggcgccatcctcacgccg

SEQ ID NO: 338611 - DNA, 25 bp, Mus musculus
ggcttccctcgcgagggcaggctca

SEQ ID NO: 338612 - DNA, 25 bp, Mus musculus
gcggcaggcaccgtccctcagcgcc

SEQ ID NO: 338613 - DNA, 25 bp, Mus musculus
actcacgactgcataacggagtctg

SEQ ID NO: 338614 - DNA, 25 bp, Mus musculus
cgccttttgttgtcacctgttctca

SEQ ID NO: 338615 - DNA, 25 bp, Mus musculus
cgcaacaactcacgactgcataacg

SEQ ID NO: 338616 - DNA, 25 bp, Mus musculus
acagcccaggtcttcgcaggcgagc

SEQ ID NO: 338617 - DNA, 25 bp, Mus musculus
ctgttctcaaggcaacggcgcagca

SEQ ID NO: 338618 - DNA, 25 bp, Mus musculus
ggcgcagcacgcctcccgccacctc

SEQ ID NO: 338619 - DNA, 25 bp, Mus musculus
acccacgccttttgttgtcacctgt

SEQ ID NO: 338620 - DNA, 25 bp, Mus musculus
gcataacggagtctgagtgtgagcc

SEQ ID NO: 338621 - DNA, 25 bp, Mus musculus
cgctcggcccagaaggagaagttga

SEQ ID NO: 338622 - DNA, 25 bp, Mus musculus
acttgcgcccacttccgggtctgag

SEQ ID NO: 338623 - DNA, 25 bp, Mus musculus
gttgagcgagtccaccaggaacacc

SEQ ID NO: 338624 - DNA, 25 bp, Mus musculus
ttgagctcgtgcagggacttccact

SEQ ID NO: 338625 - DNA, 25 bp, Mus musculus
tccacgagcacgtcgcgactgttct

SEQ ID NO: 338626 - DNA, 25 bp, Mus musculus
catgctgtttcgaacccggagcctc

SEQ ID NO: 338627 - DNA, 25 bp, Mus musculus
ccggaagttgccctgcgggaagctt

SEQ ID NO: 338628 - DNA, 25 bp, Mus musculus
gcctctgggactccttgtgttcggc

SEQ ID NO: 338629 - DNA, 25 bp, Mus musculus
gccgtcgtgtttcttgtcgcgtccc

SEQ ID NO: 338630 - DNA, 25 bp, Mus musculus
cgtcgcactcccgtctttgaggaag

SEQ ID NO: 338631 - DNA, 25 bp, Mus musculus
ccgtctttgaggaaggcttgggatc

SEQ ID NO: 338632 - DNA, 25 bp, Mus musculus
tcgcagcacccacccaggtttaagg

SEQ ID NO: 338633 - DNA, 25 bp, Mus musculus
cccagtagccagtgtagggcgtccc

SEQ ID NO: 338634 - DNA, 25 bp, Mus musculus
tttaaggctggcacccaccttggtc

SEQ ID NO: 338635 - DNA, 25 bp, Mus musculus
atggggatagcccaagccgccatcc

SEQ ID NO: 338636 - DNA, 25 bp, Mus musculus
tcctttctcgttcgcgcactctgtg

SEQ ID NO: 338637 - DNA, 25 bp, Mus musculus
acggtcggtcactgctagacagaga

SEQ ID NO: 338638 - DNA, 25 bp, Mus musculus
ctagacagagaacgaggacaaaccc

SEQ ID NO: 338639 - DNA, 25 bp, Mus musculus
cgattggcccgtggccgcgtcaatt

SEQ ID NO: 338640 - DNA, 25 bp, Mus musculus
actccctttgggctggaaggccgcg

SEQ ID NO: 338641 - DNA, 25 bp, Mus musculus
aaggccgcgggcctgagaaaactcg

SEQ ID NO: 338642 - DNA, 25 bp, Mus musculus
agaaaactcgggcatggggatagcc

SEQ ID NO: 338643 - DNA, 25 bp, Mus musculus
ccagatacctacaggccgcaatcga

SEQ ID NO: 338644 - DNA, 25 bp, Mus musculus
tacaggccgcaatcgagtgggagac

SEQ ID NO: 338645 - DNA, 25 bp, Mus musculus
ggataatggcgtctgcagcgctgtc

SEQ ID NO: 338646 - DNA, 25 bp, Mus musculus
gagtagtgacagacctctcgcgaga

SEQ ID NO: 338647 - DNA, 25 bp, Mus musculus
cgcgagacttcagcggcgctgctca

SEQ ID NO: 338648 - DNA, 25 bp, Mus musculus
agcacgacggcgacgtccgtgcagc

SEQ ID NO: 338649 - DNA, 25 bp, Mus musculus
cctaatgcggtggtagcaatggccc

SEQ ID NO: 338650 - DNA, 25 bp, Mus musculus
gccagggtcggtgcaaagcatttag

SEQ ID NO: 338651 - DNA, 25 bp, Mus musculus
agtgaagctgtgatcctcaaatggc

SEQ ID NO: 338652 - DNA, 25 bp, Mus musculus
agggtacacgttggcgcacatgcac

SEQ ID NO: 338653 - DNA, 25 bp, Mus musculus
gcctctcggtagctggaagcacatc

SEQ ID NO: 338654 - DNA, 25 bp, Mus musculus
gtttgtcactcgaccctccggaatc

SEQ ID NO: 338655 - DNA, 25 bp, Mus musculus
tggcccgcagcgaccatttaactgc

SEQ ID NO: 338656 - DNA, 25 bp, Mus musculus
gaggctcagatcaggctcgcgaatg

SEQ ID NO: 338657 - DNA, 25 bp, Mus musculus
gcggtcgcagctacaaatggtgaga

SEQ ID NO: 338658 - DNA, 25 bp, Mus musculus
cccttttaaatgactgcggatgtgc

SEQ ID NO: 338659 - DNA, 25 bp, Mus musculus
gcactgcggcgcatctaccagattc

SEQ ID NO: 338660 - DNA, 25 bp, Mus musculus
caaatggctgcatcctgccaggtta

SEQ ID NO: 338661 - DNA, 25 bp, Mus musculus
ccagagccctcgaaagtgtcaggca

SEQ ID NO: 338662 - DNA, 25 bp, Mus musculus
gcgccggtagcgcagttcctaatgc

SEQ ID NO: 338663 - DNA, 25 bp, Mus musculus
agtgacctgtttacctgccctcttg

SEQ ID NO: 338664 - DNA, 25 bp, Mus musculus
gaatccggctgacgcttcactcctt

SEQ ID NO: 338665 - DNA, 25 bp, Mus musculus
gaagcctccaagacggatggcccta

SEQ ID NO: 338666 - DNA, 25 bp, Mus musculus
gcctgatgatcggtttcctctcttc

SEQ ID NO: 338667 - DNA, 25 bp, Mus musculus
tccgcttccgtcttcgtgtactggg

SEQ ID NO: 338668 - DNA, 25 bp, Mus musculus
tctccgggaagaccgttgacgactg

SEQ ID NO: 338669 - DNA, 25 bp, Mus musculus
agctctgcggcttcgtttcctgata

SEQ ID NO: 338670 - DNA, 25 bp, Mus musculus
cgcccaccattcttccattgagtga

SEQ ID NO: 338671 - DNA, 25 bp, Mus musculus
cttggacgatcctgttcaaccgagt

SEQ ID NO: 338672 - DNA, 25 bp, Mus musculus
gccctcttgcagaaacttggtgaga

SEQ ID NO: 338673 - DNA, 25 bp, Mus musculus
cggaacctttgtgcagccggaacta

SEQ ID NO: 338674 - DNA, 25 bp, Mus musculus
tcctgatatgcaccgaccgaatttt

SEQ ID NO: 338675 - DNA, 25 bp, Mus musculus
accagtttccttctggcggttgatc

SEQ ID NO: 338676 - DNA, 25 bp, Mus musculus
gctgcggccggagatttagtttccc

SEQ ID NO: 338677 - DNA, 25 bp, Mus musculus
tataggactatgcagccgccttgtg

SEQ ID NO: 338678 - DNA, 25 bp, Mus musculus
ccgcagcctctttggagggtccttg

SEQ ID NO: 338679 - DNA, 25 bp, Mus musculus
gtttagcggttctgcgacccaaaga

SEQ ID NO: 338680 - DNA, 25 bp, Mus musculus
tatcgatattcgtgccggtttagcg

SEQ ID NO: 338681 - DNA, 25 bp, Mus musculus
cctgaggtgcgcaccgatatcgata

SEQ ID NO: 338682 - DNA, 25 bp, Mus musculus
catgtctgtttgtcctcagccctga

SEQ ID NO: 338683 - DNA, 25 bp, Mus musculus
ggggtctattagtctcatccatgtc

SEQ ID NO: 338684 - DNA, 25 bp, Mus musculus
gagctgggcactcagacattcattc

SEQ ID NO: 338685 - DNA, 25 bp, Mus musculus
tagggacacgcactccgactgactg

SEQ ID NO: 338686 - DNA, 25 bp, Mus musculus
gaaccatttggtcagcgccaacctg

SEQ ID NO: 338687 - DNA, 25 bp, Mus musculus
ggaatctgctctcaaagacccgtta

SEQ ID NO: 338688 - DNA, 25 bp, Mus musculus
ttggcctatgccatggaatctgctc

SEQ ID NO: 338689 - DNA, 25 bp, Mus musculus
cggcactgtcctgctaccgcagttg

SEQ ID NO: 338690 - DNA, 25 bp, Mus musculus
tgtcccagccactgtgaaccatttg

SEQ ID NO: 338691 - DNA, 25 bp, Mus musculus
ccagtgtaaacgtgttagcccgcta

SEQ ID NO: 338692 - DNA, 25 bp, Mus musculus
aactgccgggtacctgatgggcacc

SEQ ID NO: 338693 - DNA, 25 bp, Mus musculus
atgggcaccgttaccattccgaaca

SEQ ID NO: 338694 - DNA, 25 bp, Mus musculus
ttccgaacacctggagagggcttgc

SEQ ID NO: 338695 - DNA, 25 bp, Mus musculus
ggcttgccacagacagcctgccatg

SEQ ID NO: 338696 - DNA, 25 bp, Mus musculus
gggatcgccgtcgttacctcacacg

SEQ ID NO: 338697 - DNA, 25 bp, Mus musculus
acacgccgtgcgagacctgcatcat

SEQ ID NO: 338698 - DNA, 25 bp, Mus musculus
cggaccagcatacacagtcaacgtc

SEQ ID NO: 338699 - DNA, 25 bp, Mus musculus
ccgtccacggcgctaaactgtcagg

SEQ ID NO: 338700 - DNA, 25 bp, Mus musculus
tgtcagggagcagccaatcaaaggg

SEQ ID NO: 338701 - DNA, 25 bp, Mus musculus
tccgccaagtgaaccgaggagccgc

SEQ ID NO: 338702 - DNA, 25 bp, Mus musculus
aagacggccgcggaacatgcccgca

SEQ ID NO: 338703 - DNA, 25 bp, Mus musculus
agggaaaggactccactctggcgtg

SEQ ID NO: 338704 - DNA, 25 bp, Mus musculus
gcccgctagcagatcgacacgttca

SEQ ID NO: 338705 - DNA, 25 bp, Mus musculus
gcccagggcgtacgcatgcgtgcac

SEQ ID NO: 338706 - DNA, 25 bp, Mus musculus
tccggtctcgcgatgtgctataatc

SEQ ID NO: 338707 - DNA, 25 bp, Mus musculus
aaaatggtgcatggtttccggtctc

SEQ ID NO: 338708 - DNA, 25 bp, Mus musculus
agctttgagggtggctctgattccc

SEQ ID NO: 338709 - DNA, 25 bp, Mus musculus
cgagaagagaggatgcgcgcctacc

SEQ ID NO: 338710 - DNA, 25 bp, Mus musculus
cgacggtattgtcggtgtcgttatc

SEQ ID NO: 338711 - DNA, 25 bp, Mus musculus
ttgtcggtgtcgttatctccgtggc

SEQ ID NO: 338712 - DNA, 25 bp, Mus musculus
tcgttatctccgtggcgcggacggt

SEQ ID NO: 338713 - DNA, 25 bp, Mus musculus
tccgcctcgatctcggtctcagtgg

SEQ ID NO: 338714 - DNA, 25 bp, Mus musculus
tcgatctcggtctcagtggcgctcg

SEQ ID NO: 338715 - DNA, 25 bp, Mus musculus
cgaggcaaggccctggtcttgcgaa

SEQ ID NO: 338716 - DNA, 25 bp, Mus musculus
cctggtcttgcgaagcccgccaggt

SEQ ID NO: 338717 - DNA, 25 bp, Mus musculus
cccgccaggtgaaggatgctcggtc

SEQ ID NO: 338718 - DNA, 25 bp, Mus musculus
atgtgctataatcccgcgagaagag

SEQ ID NO: 338719 - DNA, 25 bp, Mus musculus
cctgctagccggtcccatttgatta

SEQ ID NO: 338720 - DNA, 25 bp, Mus musculus
agcgtggggactcaacttctctcca

SEQ ID NO: 338721 - DNA, 25 bp, Mus musculus
cttctctccatggacacggcgggca

SEQ ID NO: 338722 - DNA, 25 bp, Mus musculus
gcgggcactttgacgccacaagctc

SEQ ID NO: 338723 - DNA, 25 bp, Mus musculus
ggccgattggccgtcatcactgacg

SEQ ID NO: 338724 - DNA, 25 bp, Mus musculus
ggctccttccgtatggcgtacacta

SEQ ID NO: 338725 - DNA, 25 bp, Mus musculus
ctgtgactctggagctgcttcgata

SEQ ID NO: 338726 - DNA, 25 bp, Mus musculus
cgggtagacaccatacgacaggttt

SEQ ID NO: 338727 - DNA, 25 bp, Mus musculus
gtacgtagctaccagcctcgcatgg

SEQ ID NO: 338728 - DNA, 25 bp, Mus musculus
gcgctacgttagcatcggttcttga

SEQ ID NO: 338729 - DNA, 25 bp, Mus musculus
gggctgcagttttctcttgctcaca

SEQ ID NO: 338730 - DNA, 25 bp, Mus musculus
ttcgcggcccgtgatgacgtaagaa

SEQ ID NO: 338731 - DNA, 25 bp, Mus musculus
ccatttgattagctgtgcgcctgtc

SEQ ID NO: 338732 - DNA, 25 bp, Mus musculus
cccgtgcacatttggctagcctttc

SEQ ID NO: 338733 - DNA, 25 bp, Mus musculus
ggctcctcaccgtgttttccttcag

SEQ ID NO: 338734 - DNA, 25 bp, Mus musculus
ctgggcgaagggacagcacttccca

SEQ ID NO: 338735 - DNA, 25 bp, Mus musculus
ggttgctccctagctacctgcgaga

SEQ ID NO: 338736 - DNA, 25 bp, Mus musculus
gtaccgctctaagggtccaggcttc

SEQ ID NO: 338737 - DNA, 25 bp, Mus musculus
gccgtctcattgtgcgcgattggaa

SEQ ID NO: 338738 - DNA, 25 bp, Mus musculus
atccgtcgcccagtgctttcgggtt

SEQ ID NO: 338739 - DNA, 25 bp, Mus musculus
cgacacaaagtgaagacgcggactc

SEQ ID NO: 338740 - DNA, 25 bp, Mus musculus
aagcgcccggccattgacagggttc

SEQ ID NO: 338741 - DNA, 25 bp, Mus musculus
ggttccgcgctactggccacgaagc

SEQ ID NO: 338742 - DNA, 25 bp, Mus musculus
tcctccgcaggatgacactcctttt

SEQ ID NO: 338743 - DNA, 25 bp, Mus musculus
ccagacaagtccagtttcgtcacca

SEQ ID NO: 338744 - DNA, 25 bp, Mus musculus
ggacaacgccagctgacttacccga

SEQ ID NO: 338745 - DNA, 25 bp, Mus musculus
tccaggcttccgaccaagggacaac

SEQ ID NO: 338746 - DNA, 25 bp, Mus musculus
cgcgattggaagactgcggtgtccc

SEQ ID NO: 338747 - DNA, 25 bp, Mus musculus
ttccgcaccggcattgttattgagg

SEQ ID NO: 338748 - DNA, 25 bp, Mus musculus
ggtggactacatcttcctcatagtg

SEQ ID NO: 338749 - DNA, 25 bp, Mus musculus
cctcatggacttggtgttgaacttc

SEQ ID NO: 338750 - DNA, 25 bp, Mus musculus
ggacactttcttcctcatggacttg

SEQ ID NO: 338751 - DNA, 25 bp, Mus musculus
cttcaacgtggtctcggacactttc

SEQ ID NO: 338752 - DNA, 25 bp, Mus musculus
tcgtgtcatccatcccggtggacta

SEQ ID NO: 338753 - DNA, 25 bp, Mus musculus
tgctgcggctatcacggctcatccg

SEQ ID NO: 338754 - DNA, 25 bp, Mus musculus
aagatcctcagtctgctgcggctgc

SEQ ID NO: 338755 - DNA, 25 bp, Mus musculus
gcgcatcgtgcgcttcaccaagatc

SEQ ID NO: 338756 - DNA, 25 bp, Mus musculus
ggtctacaagacagcgcgtgctctg

SEQ ID NO: 338757 - DNA, 25 bp, Mus musculus
ggaatcgactccgaggtctacaaga

SEQ ID NO: 338758 - DNA, 25 bp, Mus musculus
cctcatagtggagaagggaatcgac

SEQ ID NO: 338759 - DNA, 25 bp, Mus musculus
tattgaggacaacacggagatcatc

SEQ ID NO: 338760 - DNA, 25 bp, Mus musculus
ttcgtggtggacttcgtgtcatcca

SEQ ID NO: 338761 - DNA, 25 bp, Mus musculus
aaagcttgccgcagtaggccaggta

SEQ ID NO: 338762 - DNA, 25 bp, Mus musculus
acctgcagtgttcgtcctgcgcgca

SEQ ID NO: 338763 - DNA, 25 bp, Mus musculus
cgtagcacttcgcagctctggcatc

SEQ ID NO: 338764 - DNA, 25 bp, Mus musculus
ttgagctggataagcgccgagatgc

SEQ ID NO: 338765 - DNA, 25 bp, Mus musculus
gcagcgcagcccgttgaaaagcttg

SEQ ID NO: 338766 - DNA, 25 bp, Mus musculus
cgtactggctgtaggcgtagctgca

SEQ ID NO: 338767 - DNA, 25 bp, Mus musculus
tgcagtcgggctcgccctgacactg

SEQ ID NO: 338768 - DNA, 25 bp, Mus musculus
cgcggtgccgagcacagcagctgca

SEQ ID NO: 338769 - DNA, 25 bp, Mus musculus
tgcagcagcgccatcaggcacagca

SEQ ID NO: 338770 - DNA, 25 bp, Mus musculus
aaagtttgtccgagttccgcgcact

SEQ ID NO: 338771 - DNA, 25 bp, Mus musculus
gcggcactcgtctgtgcagcgcagc

SEQ ID NO: 338772 - DNA, 25 bp, Mus musculus
gctccctgagaagcgcggcgacgca

SEQ ID NO: 338773 - DNA, 25 bp, Mus musculus
tgcatggtgctaggcgcctgcagac

SEQ ID NO: 338774 - DNA, 25 bp, Mus musculus
gcacttctggcatgggcgtcctcat

SEQ ID NO: 338775 - DNA, 25 bp, Mus musculus
tcaggcaggaaaacgtggacgacta

SEQ ID NO: 338776 - DNA, 25 bp, Mus musculus
ctatcatgactgtgttcaggcagga

SEQ ID NO: 338777 - DNA, 25 bp, Mus musculus
gcctggcccacacggatccttgggt

SEQ ID NO: 338778 - DNA, 25 bp, Mus musculus
acggatccttgggttcacactctga

SEQ ID NO: 338779 - DNA, 25 bp, Mus musculus
cacactctgagaggacgaaagcctc

SEQ ID NO: 338780 - DNA, 25 bp, Mus musculus
tccggcttcttcgaagcgggcggca

SEQ ID NO: 338781 - DNA, 25 bp, Mus musculus
gctcagggcgcacgaagcgacagct

SEQ ID NO: 338782 - DNA, 25 bp, Mus musculus
ggcagggcgctttgtgtcccttccc

SEQ ID NO: 338783 - DNA, 25 bp, Mus musculus
ctagacttaacaaagggcgcgtggc

SEQ ID NO: 338784 - DNA, 25 bp, Mus musculus
gaggcctcgagatcgggacccagcc

SEQ ID NO: 338785 - DNA, 25 bp, Mus musculus
tagagtttaccgtctcattcttctc

SEQ ID NO: 338786 - DNA, 25 bp, Mus musculus
ccatgtctttcagaggtctgcggct

SEQ ID NO: 338787 - DNA, 25 bp, Mus musculus
ggtgaggcgtgacagtctatcatga

SEQ ID NO: 338788 - DNA, 25 bp, Mus musculus
acgactactacgacaccggcgagga

SEQ ID NO: 338789 - DNA, 25 bp, Mus musculus
tggagtcttgataccgtggccacta

SEQ ID NO: 338790 - DNA, 25 bp, Mus musculus
ctggcgcgtgttgatgacgcaatta

SEQ ID NO: 338791 - DNA, 25 bp, Mus musculus
attagtgtttgcctggtagcccgtg

SEQ ID NO: 338792 - DNA, 25 bp, Mus musculus
caccgcagctgagacaggtaacctg

SEQ ID NO: 338793 - DNA, 25 bp, Mus musculus
aggtaacctgcagctccggtgtcaa

SEQ ID NO: 338794 - DNA, 25 bp, Mus musculus
gttatgcggacccacgacctctggt

SEQ ID NO: 338795 - DNA, 25 bp, Mus musculus
gtgctcatggtagacggaaaccaca

SEQ ID NO: 338796 - DNA, 25 bp, Mus musculus
tgggatcctgttcgcctcttgtgaa

SEQ ID NO: 338797 - DNA, 25 bp, Mus musculus
cgagcccttgggatgctgtcacata

SEQ ID NO: 338798 - DNA, 25 bp, Mus musculus
tgtcacataaattgtagccgcagta

SEQ ID NO: 338799 - DNA, 25 bp, Mus musculus
gccgcagtattagcgctcagcactt

SEQ ID NO: 338800 - DNA, 25 bp, Mus musculus
tgcggcgaccgctacctgcaaaggt

SEQ ID NO: 338801 - DNA, 25 bp, Mus musculus
aggatccgatccgtcttgccctgtg

SEQ ID NO: 338802 - DNA, 25 bp, Mus musculus
gtagttcacgcgtctggagtcttga

SEQ ID NO: 338803 - DNA, 25 bp, Mus musculus
cctcggcctgcttgaaatgctgttg

SEQ ID NO: 338804 - DNA, 25 bp, Mus musculus
ccgtacctcggcctgcttgaaatgc

SEQ ID NO: 338805 - DNA, 25 bp, Mus musculus
ctgggctcggtgaacttgacttgtt

SEQ ID NO: 338806 - DNA, 25 bp, Mus musculus
ctcggtgaacttgacttgttctccc

SEQ ID NO: 338807 - DNA, 25 bp, Mus musculus
agcgcaaggccgaggactgctcgcc

SEQ ID NO: 338808 - DNA, 25 bp, Mus musculus
ccgaggactgctcgccgagtaggct

SEQ ID NO: 338809 - DNA, 25 bp, Mus musculus
agtaggctcgcacggcaagtaggct

SEQ ID NO: 338810 - DNA, 25 bp, Mus musculus
tccgaggtaagtaccagcgggcaga

SEQ ID NO: 338811 - DNA, 25 bp, Mus musculus
ttgggttttgacttcaggtggcgaa

SEQ ID NO: 338812 - DNA, 25 bp, Mus musculus
cggcaagtaggctccgaggtaagta

SEQ ID NO: 338813 - DNA, 25 bp, Mus musculus
acttcaggtggcgaaatggattcga

SEQ ID NO: 338814 - DNA, 25 bp, Mus musculus
atggattcgagtcaaccgcagaccc

SEQ ID NO: 338815 - DNA, 25 bp, Mus musculus
acgcaaacgagggaagcgagaagtc

SEQ ID NO: 338816 - DNA, 25 bp, Mus musculus
tgaaatgctgttgggttttgacttc

SEQ ID NO: 338817 - DNA, 25 bp, Mus musculus
atctgaatctctcctggaggaagtg

SEQ ID NO: 338818 - DNA, 25 bp, Mus musculus
gcgagtcttctctgccctagcagga

SEQ ID NO: 338819 - DNA, 25 bp, Mus musculus
gccctagcaggaaacggcggtcttc

SEQ ID NO: 338820 - DNA, 25 bp, Mus musculus
gccgcggcggaaaagaagccaccgc

SEQ ID NO: 338821 - DNA, 25 bp, Mus musculus
ctgcggcttgaaaacttggcacagc

SEQ ID NO: 338822 - DNA, 25 bp, Mus musculus
tggcacagcctcacggaactttttt

SEQ ID NO: 338823 - DNA, 25 bp, Mus musculus
tgtttggaattttcccgcggccgca

SEQ ID NO: 338824 - DNA, 25 bp, Mus musculus
ggcgcacgttctcgcgagtcttctc

SEQ ID NO: 338825 - DNA, 25 bp, Mus musculus
catgatgggaagatctgaatctctc

SEQ ID NO: 338826 - DNA, 25 bp, Mus musculus
cagagctgcctcagcagactgggcc

SEQ ID NO: 338827 - DNA, 25 bp, Mus musculus
ggcgactacgggctatagctaactc

SEQ ID NO: 338828 - DNA, 25 bp, Mus musculus
acgcgcagtgcactctggggcccag

SEQ ID NO: 338829 - DNA, 25 bp, Mus musculus
cccacgttgagactcgggcgcacgt

SEQ ID NO: 338830 - DNA, 25 bp, Mus musculus
accgcccggcttctgcggcttgaaa

SEQ ID NO: 338831 - DNA, 25 bp, Mus musculus
cgcttgacctccagaggagggcccg

SEQ ID NO: 338832 - DNA, 25 bp, Mus musculus
tcctcgtactccaccagcggggtca

SEQ ID NO: 338833 - DNA, 25 bp, Mus musculus
gccagccgcttgacctccagaggag

SEQ ID NO: 338834 - DNA, 25 bp, Mus musculus
gacaggaatcgcctccgcttgcggc

SEQ ID NO: 338835 - DNA, 25 bp, Mus musculus
ggcgctcctccaacttcttctcggc

SEQ ID NO: 338836 - DNA, 25 bp, Mus musculus
agcgccgtgtccgagctactcggca

SEQ ID NO: 338837 - DNA, 25 bp, Mus musculus
gagtcgcgccacgataatccgggtc

SEQ ID NO: 338838 - DNA, 25 bp, Mus musculus
cgccacgataatccgggtcgggacg

SEQ ID NO: 338839 - DNA, 25 bp, Mus musculus
cctggcgcgggaggatcctatcctc

SEQ ID NO: 338840 - DNA, 25 bp, Mus musculus
aggatcctatcctcggcggaaagcc

SEQ ID NO: 338841 - DNA, 25 bp, Mus musculus
atcctcggcggaaagccggccgtgc

SEQ ID NO: 338842 - DNA, 25 bp, Mus musculus
cgagctactcggcatcgcctagagc

SEQ ID NO: 338843 - DNA, 25 bp, Mus musculus
ggcagccagaacacccggcgcttct

SEQ ID NO: 338844 - DNA, 25 bp, Mus musculus
ttcactccatcgtcctgacgtcggg

SEQ ID NO: 338845 - DNA, 25 bp, Mus musculus
agggacaatctacagcaaccgtggt

SEQ ID NO: 338846 - DNA, 25 bp, Mus musculus
gtccactcaggacggtttccaaagc

SEQ ID NO: 338847 - DNA, 25 bp, Mus musculus
cgccgaactttaggctgcaaccgtg

SEQ ID NO: 338848 - DNA, 25 bp, Mus musculus
tccgcacacccgtaccgaagattta

SEQ ID NO: 338849 - DNA, 25 bp, Mus musculus
ttcagccagcctcgtaaacacaatg

SEQ ID NO: 338850 - DNA, 25 bp, Mus musculus
gggcggccacaaggatctttcctcc

SEQ ID NO: 338851 - DNA, 25 bp, Mus musculus
tgcggcagccatctacaacttacac

SEQ ID NO: 338852 - DNA, 25 bp, Mus musculus
caccgcgggagctcagttaggaaat

SEQ ID NO: 338853 - DNA, 25 bp, Mus musculus
gttcggtccacactcttttccacag

SEQ ID NO: 338854 - DNA, 25 bp, Mus musculus
ccaaagctccggaaaaggcacacca

SEQ ID NO: 338855 - DNA, 25 bp, Mus musculus
ctcctggtgaactctttaaaatagc

SEQ ID NO: 338856 - DNA, 25 bp, Mus musculus
ggcgcaagcgcacttagggacaatc

SEQ ID NO: 338857 - DNA, 25 bp, Mus musculus
ttccacagccttaggagacaccgcg

SEQ ID NO: 338858 - DNA, 25 bp, Mus musculus
acactatttgtgctcggaagagggc

SEQ ID NO: 338859 - DNA, 25 bp, Mus musculus
gcgttcctgtcttcggcctgctcgt

SEQ ID NO: 338860 - DNA, 25 bp, Mus musculus
tcagctgccagccaatggctgcgtt

SEQ ID NO: 338861 - DNA, 25 bp, Mus musculus
taccgccgcggacagacgtgccgga

SEQ ID NO: 338862 - DNA, 25 bp, Mus musculus
cgttgcccaatgaacgcgcggcttc

SEQ ID NO: 338863 - DNA, 25 bp, Mus musculus
tcctgaatcccaaacccgcagaatt

SEQ ID NO: 338864 - DNA, 25 bp, Mus musculus
agtacattcctgaaggcggcccggc

SEQ ID NO: 338865 - DNA, 25 bp, Mus musculus
ccggacacgccgtagtacattcctg

SEQ ID NO: 338866 - DNA, 25 bp, Mus musculus
ctaggacgccttgccatcctgaatc

SEQ ID NO: 338867 - DNA, 25 bp, Mus musculus
gggcttccctaggacgccttgccat

SEQ ID NO: 338868 - DNA, 25 bp, Mus musculus
gttgcggtccttcatcgctgcccag

SEQ ID NO: 338869 - DNA, 25 bp, Mus musculus
aatggctgcgttccggcccttccat

SEQ ID NO: 338870 - DNA, 25 bp, Mus musculus
caccacgtgacctggaccgagaggc

SEQ ID NO: 338871 - DNA, 25 bp, Mus musculus
atgcggacgcacaggtaacagggtc

SEQ ID NO: 338872 - DNA, 25 bp, Mus musculus
tgaacgcgcggcttctcagctgcca

SEQ ID NO: 338873 - DNA, 25 bp, Mus musculus
gtgtctgcgcatgccgctgccagct

SEQ ID NO: 338874 - DNA, 25 bp, Mus musculus
ggcgaccctttcaagcgtgcaaatg

SEQ ID NO: 338875 - DNA, 25 bp, Mus musculus
agccaaggtggcgaccctttcaagc

SEQ ID NO: 338876 - DNA, 25 bp, Mus musculus
ctcaaagagcggaagccaaggtggc

SEQ ID NO: 338877 - DNA, 25 bp, Mus musculus
caccacccggctcaaagagcggaag

SEQ ID NO: 338878 - DNA, 25 bp, Mus musculus
ctgcgcccagaaaagcgtctgcggc

SEQ ID NO: 338879 - DNA, 25 bp, Mus musculus
ttgcgttcagccaggtgtctgcgca

SEQ ID NO: 338880 - DNA, 25 bp, Mus musculus
ggcgcatctctccaatctaggtgtt

SEQ ID NO: 338881 - DNA, 25 bp, Mus musculus
ttcaagcgtgcaaatggaatcccag

SEQ ID NO: 338882 - DNA, 25 bp, Mus musculus
tcaaagcgcccttggcctcttttct

SEQ ID NO: 338883 - DNA, 25 bp, Mus musculus
ttccgtaggcgcaagagtcagcaca

SEQ ID NO: 338884 - DNA, 25 bp, Mus musculus
ccaatctaggtgttgcgttcagcca

SEQ ID NO: 338885 - DNA, 25 bp, Mus musculus
ccaagccgggcggtgaactcaaagc

SEQ ID NO: 338886 - DNA, 25 bp, Mus musculus
cgcctttgagaaggcgcatctctcc

SEQ ID NO: 338887 - DNA, 25 bp, Mus musculus
agcgcagccctcctgggtaaacagg

SEQ ID NO: 338888 - DNA, 25 bp, Mus musculus
tttctattaagcaggtccatggccc

SEQ ID NO: 338889 - DNA, 25 bp, Mus musculus
attaagcaggtccatggccctcggc

SEQ ID NO: 338890 - DNA, 25 bp, Mus musculus
tctgccgcgccataggcaggacctg

SEQ ID NO: 338891 - DNA, 25 bp, Mus musculus
cgccataggcaggacctgtcagggt

SEQ ID NO: 338892 - DNA, 25 bp, Mus musculus
tcacgtgacggatccgaaaacttta

SEQ ID NO: 338893 - DNA, 25 bp, Mus musculus
ccaaggaaggcaaagtaaactggag

SEQ ID NO: 338894 - DNA, 25 bp, Mus musculus
agtaaactggaggaacgtgctatca

SEQ ID NO: 338895 - DNA, 25 bp, Mus musculus
ggaacgtgctatcagcgcagccctc

SEQ ID NO: 338896 - DNA, 25 bp, Mus musculus
caagcctgtttctattaagcaggtc

SEQ ID NO: 338897 - DNA, 25 bp, Mus musculus
ggactcacaattacaagcctgtttc

SEQ ID NO: 338898 - DNA, 25 bp, Mus musculus
gcgcggactcacaattacaagcctg

SEQ ID NO: 338899 - DNA, 25 bp, Mus musculus
gtgcggcgcggactcacaattacaa

SEQ ID NO: 338900 - DNA, 25 bp, Mus musculus
acaggctgccctcccagccgtcctg

SEQ ID NO: 338901 - DNA, 25 bp, Mus musculus
tccaacttgtgacccttgagcgccg

SEQ ID NO: 338902 - DNA, 25 bp, Mus musculus
ccattccgcgcaataaacgacagca

SEQ ID NO: 338903 - DNA, 25 bp, Mus musculus
aatgtactgacgagccgaggcagca

SEQ ID NO: 338904 - DNA, 25 bp, Mus musculus
aaacgacagcattggcgccgagcgc

SEQ ID NO: 338905 - DNA, 25 bp, Mus musculus
agtccggaccgcagggactcagcct

SEQ ID NO: 338906 - DNA, 25 bp, Mus musculus
ccgtgcccgtgcagaagccatagag

SEQ ID NO: 338907 - DNA, 25 bp, Mus musculus
ggcggggccgtcatccacaccaaag

SEQ ID NO: 338908 - DNA, 25 bp, Mus musculus
cccgccgtcgccatgaatgtactga

SEQ ID NO: 338909 - DNA, 25 bp, Mus musculus
ctggcaagctcacgcaataaccagc

SEQ ID NO: 338910 - DNA, 25 bp, Mus musculus
tcaagtgcaatactcggcccgccgg

SEQ ID NO: 338911 - DNA, 25 bp, Mus musculus
tggcctccgaggaagaatatggatc

SEQ ID NO: 338912 - DNA, 25 bp, Mus musculus
ggtgcgatcacctcggtgcctcagc

SEQ ID NO: 338913 - DNA, 25 bp, Mus musculus
gccatagagggacgtaggtagctta

SEQ ID NO: 338914 - DNA, 25 bp, Mus musculus
ggacctcaccctacggtgtgcctgg

SEQ ID NO: 338915 - DNA, 25 bp, Mus musculus
cgaggtcgccgactaatgccaaatc

SEQ ID NO: 338916 - DNA, 25 bp, Mus musculus
atctcgcgatatttgggacgttcgc

SEQ ID NO: 338917 - DNA, 25 bp, Mus musculus
cgcccgctgaaaggctagtccatct

SEQ ID NO: 338918 - DNA, 25 bp, Mus musculus
acgttcgcgaactgcgcgaggctga

SEQ ID NO: 338919 - DNA, 25 bp, Mus musculus
aaggctagtccatcttctcgcgata

SEQ ID NO: 338920 - DNA, 25 bp, Mus musculus
acctcgtctggaagggaagccgctt

SEQ ID NO: 338921 - DNA, 25 bp, Mus musculus
tccctcagcgaagagggtcgaggtc

SEQ ID NO: 338922 - DNA, 25 bp, Mus musculus
aggcgctcgttctcgcgggatttac

SEQ ID NO: 338923 - DNA, 25 bp, Mus musculus
tcccgcaaaggtatgagctccgagc

SEQ ID NO: 338924 - DNA, 25 bp, Mus musculus
caggcacacgtcttcagggcacttc

SEQ ID NO: 338925 - DNA, 25 bp, Mus musculus
cccgcgtgcttcctgtgattgacag

SEQ ID NO: 338926 - DNA, 25 bp, Mus musculus
tgacagctgcgggtttcgaactctt

SEQ ID NO: 338927 - DNA, 25 bp, Mus musculus
gaagtcctcggctttgcgactcagc

SEQ ID NO: 338928 - DNA, 25 bp, Mus musculus
cttctcgcgatatctggagggaggc

SEQ ID NO: 338929 - DNA, 25 bp, Mus musculus
tacatttcgcgcctgggcggaacca

SEQ ID NO: 338930 - DNA, 25 bp, Mus musculus
ggccaactgcgttcgaaagtctgta

SEQ ID NO: 338931 - DNA, 25 bp, Mus musculus
cgggtccttactgccacgtcattgg

SEQ ID NO: 338932 - DNA, 25 bp, Mus musculus
tcttgtcctgacacacccgtcggga

SEQ ID NO: 338933 - DNA, 25 bp, Mus musculus
ccaatagccgggtccaggctgtgtt

SEQ ID NO: 338934 - DNA, 25 bp, Mus musculus
ggccgccgctctcatacttttttgt

SEQ ID NO: 338935 - DNA, 25 bp, Mus musculus
cgcttcggcttttcccgcgttacat

SEQ ID NO: 338936 - DNA, 25 bp, Mus musculus
cgagaataacaacctgccgccgcgg

SEQ ID NO: 338937 - DNA, 25 bp, Mus musculus
ttgctgacaggaaaacgggacgcga

SEQ ID NO: 338938 - DNA, 25 bp, Mus musculus
atgaccgataccagtacgcgcttcg

SEQ ID NO: 338939 - DNA, 25 bp, Mus musculus
ccggcgtggtcctgatgaccgatac

SEQ ID NO: 338940 - DNA, 25 bp, Mus musculus
cacgggtacaccatgaagtcgctga

SEQ ID NO: 338941 - DNA, 25 bp, Mus musculus
agcgtcacgttatgcgcgttctcac

SEQ ID NO: 338942 - DNA, 25 bp, Mus musculus
gaaccaattcgagcgcgggtcctta

SEQ ID NO: 338943 - DNA, 25 bp, Mus musculus
gcttcgctgaacctcactggcctgg

SEQ ID NO: 338944 - DNA, 25 bp, Mus musculus
gcgtgtccaccagcgctcattggct

SEQ ID NO: 338945 - DNA, 25 bp, Mus musculus
cgttcgacatcatgcgggaggccga

SEQ ID NO: 338946 - DNA, 25 bp, Mus musculus
agatgcagcgcaagcgtcgcgatga

SEQ ID NO: 338947 - DNA, 25 bp, Mus musculus
gagcccggctgtggcctcaggacac

SEQ ID NO: 338948 - DNA, 25 bp, Mus musculus
cctcaggacacaggcctggcgcagg

SEQ ID NO: 338949 - DNA, 25 bp, Mus musculus
gcacagcagccagacagccctgggg

SEQ ID NO: 338950 - DNA, 25 bp, Mus musculus
gtacgccgtgggcaccgaggtcacc

SEQ ID NO: 338951 - DNA, 25 bp, Mus musculus
agccgctagctccagtcgcggggac

SEQ ID NO: 338952 - DNA, 25 bp, Mus musculus
tccagtcgcggggaccgatcccgga

SEQ ID NO: 338953 - DNA, 25 bp, Mus musculus
tcacagacaccggtctcccattggg

SEQ ID NO: 338954 - DNA, 25 bp, Mus musculus
gtctcccattgggtcttcgtgcgcc

SEQ ID NO: 338955 - DNA, 25 bp, Mus musculus
cgacgagtcggacccgttcgacatc

SEQ ID NO: 338956 - DNA, 25 bp, Mus musculus
gtcgcagaaggagcgcaagagcctc

SEQ ID NO: 338957 - DNA, 25 bp, Mus musculus
ggctcttcttcacgccgggagagga

SEQ ID NO: 338958 - DNA, 25 bp, Mus musculus
gatgttccgtggagcttcattcaca

SEQ ID NO: 338959 - DNA, 25 bp, Mus musculus
gtgacgtcacgcaactggagccttc

SEQ ID NO: 338960 - DNA, 25 bp, Mus musculus
cttcctacaggcaggtactcggtga

SEQ ID NO: 338961 - DNA, 25 bp, Mus musculus
ctcggtgacgccataaagaaaagtc

SEQ ID NO: 338962 - DNA, 25 bp, Mus musculus
agcgcttccgccaatcgggcagaaa

SEQ ID NO: 338963 - DNA, 25 bp, Mus musculus
cttgtgtccaggtgttgacgcctca

SEQ ID NO: 338964 - DNA, 25 bp, Mus musculus
tgagtctccgagttcctgcacaacc

SEQ ID NO: 338965 - DNA, 25 bp, Mus musculus
ggctcacccgtgatgtccaggtaca

SEQ ID NO: 338966 - DNA, 25 bp, Mus musculus
ctcggcccatctccggtaaagttgc

SEQ ID NO: 338967 - DNA, 25 bp, Mus musculus
ggacagcaaagaccagcgggactca

SEQ ID NO: 338968 - DNA, 25 bp, Mus musculus
ggatcccacgcgttgctaaggctca

SEQ ID NO: 338969 - DNA, 25 bp, Mus musculus
gccgctcgctcttacgcttcatgga

SEQ ID NO: 338970 - DNA, 25 bp, Mus musculus
cccagttcctcgagtgagtctccga

SEQ ID NO: 338971 - DNA, 25 bp, Mus musculus
tctcccagacgcgtccagcacgggc

SEQ ID NO: 338972 - DNA, 25 bp, Mus musculus
cagccgctgacctgccgcgtcaccg

SEQ ID NO: 338973 - DNA, 25 bp, Mus musculus
tcggttccaggcgaggtgctgcacc

SEQ ID NO: 338974 - DNA, 25 bp, Mus musculus
gagggcgaccgctcaggtcagccac

SEQ ID NO: 338975 - DNA, 25 bp, Mus musculus
tccagcacgggcagctccgctacgg

SEQ ID NO: 338976 - DNA, 25 bp, Mus musculus
gaacgtcacccgtctcccagacgcg

SEQ ID NO: 338977 - DNA, 25 bp, Mus musculus
aacagcgctccgaacgtcacccgtc

SEQ ID NO: 338978 - DNA, 25 bp, Mus musculus
gctctcggaacagcgctccgaacgt

SEQ ID NO: 338979 - DNA, 25 bp, Mus musculus
cacggctcgccgctctcggaacagc

SEQ ID NO: 338980 - DNA, 25 bp, Mus musculus
cccgtgctcaccctcacaaacacca

SEQ ID NO: 338981 - DNA, 25 bp, Mus musculus
cgccctacccgtgctcaccctcaca

SEQ ID NO: 338982 - DNA, 25 bp, Mus musculus
cccaggatctgggcggccaacgaga

SEQ ID NO: 338983 - DNA, 25 bp, Mus musculus
gttccaggcgaggtgctgcacccgc

SEQ ID NO: 338984 - DNA, 25 bp, Mus musculus
ctgcccgcgctctgtgaccgagcca

SEQ ID NO: 338985 - DNA, 25 bp, Mus musculus
gctagctgcgcacaagaagtctgca

SEQ ID NO: 338986 - DNA, 25 bp, Mus musculus
tccgagaatctggaggaacagcgcc

SEQ ID NO: 338987 - DNA, 25 bp, Mus musculus
tatggttcccacattctagattccc

SEQ ID NO: 338988 - DNA, 25 bp, Mus musculus
ggttgcagatgctatggttcccaca

SEQ ID NO: 338989 - DNA, 25 bp, Mus musculus
agcgccgggctcaggctttaaagcc

SEQ ID NO: 338990 - DNA, 25 bp, Mus musculus
gaggacacatcctcgagatcctggc

SEQ ID NO: 338991 - DNA, 25 bp, Mus musculus
agcccggagtcacatgacctgatga

SEQ ID NO: 338992 - DNA, 25 bp, Mus musculus
cacaaggagccctgggtcccgtgac

SEQ ID NO: 338993 - DNA, 25 bp, Mus musculus
cgcccgcgaatgttatggcggcaca

SEQ ID NO: 338994 - DNA, 25 bp, Mus musculus
atgcctccttatgcgatctcagttc

SEQ ID NO: 338995 - DNA, 25 bp, Mus musculus
ctccagtccgggttgcagatgctat

SEQ ID NO: 338996 - DNA, 25 bp, Mus musculus
cgtcattggctatgcctgcctcggg

SEQ ID NO: 338997 - DNA, 25 bp, Mus musculus
atctcagttcgggttaggggccaag

SEQ ID NO: 338998 - DNA, 25 bp, Mus musculus
acaagggcctatcacttcggggagg

SEQ ID NO: 338999 - DNA, 25 bp, Mus musculus
cggcaacactggagcgcgctggctc

SEQ ID NO: 339000 - DNA, 25 bp, Mus musculus
agacatcgcccggaacaccacgagt

SEQ ID NO: 339001 - DNA, 25 bp, Mus musculus
tcgcgttctccggagccgctcgaaa

SEQ ID NO: 339002 - DNA, 25 bp, Mus musculus
tggtctccagggctcgcgttctccg

SEQ ID NO: 339003 - DNA, 25 bp, Mus musculus
tcgtcaaacacgtcctggtctccag

SEQ ID NO: 339004 - DNA, 25 bp, Mus musculus
gcttcctcgtcaaacacgtcctggt

SEQ ID NO: 339005 - DNA, 25 bp, Mus musculus
gagactcgtccgcttcctcgtcaaa

SEQ ID NO: 339006 - DNA, 25 bp, Mus musculus
cgctgcgctaacagagactcgtccg

SEQ ID NO: 339007 - DNA, 25 bp, Mus musculus
tgccattcccgctgcgctaacagag

SEQ ID NO: 339008 - DNA, 25 bp, Mus musculus
gtttccgcatgtgaccctgccattc

SEQ ID NO: 339009 - DNA, 25 bp, Mus musculus
gctcgaaaccaagacatcgcccgga

SEQ ID NO: 339010 - DNA, 25 bp, Mus musculus
ttggactcgtttccgcatgtgaccc

SEQ ID NO: 339011 - DNA, 25 bp, Mus musculus
cgcgtcccgtccatttacttggact

SEQ ID NO: 339012 - DNA, 25 bp, Mus musculus
ccatttacttggactcgtttccgca

SEQ ID NO: 339013 - DNA, 25 bp, Mus musculus
cttcaaagccaagcacgtagaggtg

SEQ ID NO: 339014 - DNA, 25 bp, Mus musculus
gggcgcccacggcatcgtcttcaaa

SEQ ID NO: 339015 - DNA, 25 bp, Mus musculus
tctctttaggatacttggcggggtc

SEQ ID NO: 339016 - DNA, 25 bp, Mus musculus
gcgcgcctcagaggtctctttagga

SEQ ID NO: 339017 - DNA, 25 bp, Mus musculus
gctccctctgcagtctttccgtgta

SEQ ID NO: 339018 - DNA, 25 bp, Mus musculus
ggagcctatgctggatccctgtaga

SEQ ID NO: 339019 - DNA, 25 bp, Mus musculus
cagcgtttcttgtcacgtggtgcta

SEQ ID NO: 339020 - DNA, 25 bp, Mus musculus
gcagctgctagacgcgttattgcta

SEQ ID NO: 339021 - DNA, 25 bp, Mus musculus
ccggtcacgtgctttacggagcagc

SEQ ID NO: 339022 - DNA, 25 bp, Mus musculus
tcagcactggtctttccggtcacgt

SEQ ID NO: 339023 - DNA, 25 bp, Mus musculus
tgcctagaggggatgcagattcctg

SEQ ID NO: 339024 - DNA, 25 bp, Mus musculus
ggccacgtcctggagcgttagatta

SEQ ID NO: 339025 - DNA, 25 bp, Mus musculus
cgggccgacatggaccagtattgca

SEQ ID NO: 339026 - DNA, 25 bp, Mus musculus
tttccgtgtagagatctgctagcgc

SEQ ID NO: 339027 - DNA, 25 bp, Mus musculus
cccgacactggcagtgagtagtttt

SEQ ID NO: 339028 - DNA, 25 bp, Mus musculus
cttctcaggcatggttgacgccttg

SEQ ID NO: 339029 - DNA, 25 bp, Mus musculus
tcatgccgccgtcatgccagagcag

SEQ ID NO: 339030 - DNA, 25 bp, Mus musculus
cgcccagactgcgtagcgcatcaaa

SEQ ID NO: 339031 - DNA, 25 bp, Mus musculus
ccagagcaggttcggagcgctccaa

SEQ ID NO: 339032 - DNA, 25 bp, Mus musculus
gagcgctccaagacactggcgacgc

SEQ ID NO: 339033 - DNA, 25 bp, Mus musculus
acaccggctgctgagaggacgccga

SEQ ID NO: 339034 - DNA, 25 bp, Mus musculus
gctggatccgtgcaggaagcgaaca

SEQ ID NO: 339035 - DNA, 25 bp, Mus musculus
ctattcagtggtggtcgtgaacaca

SEQ ID NO: 339036 - DNA, 25 bp, Mus musculus
gagtagttttcagtagcgcccgaac

SEQ ID NO: 339037 - DNA, 25 bp, Mus musculus
gtcccgcccggagaactcagcaaag

SEQ ID NO: 339038 - DNA, 25 bp, Mus musculus
gagaactcagcaaaggcagctcccg

SEQ ID NO: 339039 - DNA, 25 bp, Mus musculus
tctccagaagctcgggcaagctccg

SEQ ID NO: 339040 - DNA, 25 bp, Mus musculus
gaacagggccctcaactattcagtg

SEQ ID NO: 339041 - DNA, 25 bp, Mus musculus
cagccctcttctttcagtgcaggga

SEQ ID NO: 339042 - DNA, 25 bp, Mus musculus
agagatttccacgatatcccgtgtc

SEQ ID NO: 339043 - DNA, 25 bp, Mus musculus
tctttcagtgcagggacgaggcagt

SEQ ID NO: 339044 - DNA, 25 bp, Mus musculus
acgaggcagtctggcgtcccacgga

SEQ ID NO: 339045 - DNA, 25 bp, Mus musculus
cgtcccacggacatcccgggatggg

SEQ ID NO: 339046 - DNA, 25 bp, Mus musculus
acatcccgggatgggccagcctcgg

SEQ ID NO: 339047 - DNA, 25 bp, Mus musculus
gccctcgaggtctcatgaggtctca

SEQ ID NO: 339048 - DNA, 25 bp, Mus musculus
ctcagggcggatggagcgtccatcc

SEQ ID NO: 339049 - DNA, 25 bp, Mus musculus
ccatccctgcggctcagaaagagac

SEQ ID NO: 339050 - DNA, 25 bp, Mus musculus
gaaagagactgcgtcccgcggaaca

SEQ ID NO: 339051 - DNA, 25 bp, Mus musculus
ccgcggaacacggtgcatgcacgct

SEQ ID NO: 339052 - DNA, 25 bp, Mus musculus
acgctggctccggtcagcagagatt

SEQ ID NO: 339053 - DNA, 25 bp, Mus musculus
cgatatcccgtgtcgtgcgcatgtc

SEQ ID NO: 339054 - DNA, 25 bp, Mus musculus
gggtcatgccgtgtcacgtctcctc

SEQ ID NO: 339055 - DNA, 25 bp, Mus musculus
ggaagtccatgttgtgcggcaacca

SEQ ID NO: 339056 - DNA, 25 bp, Mus musculus
tcactgcccaggtggttgaagtgtg

SEQ ID NO: 339057 - DNA, 25 bp, Mus musculus
gagccaccttgaggcaacgcgccag

SEQ ID NO: 339058 - DNA, 25 bp, Mus musculus
tgtgcggcaaccagaagacacggtg

SEQ ID NO: 339059 - DNA, 25 bp, Mus musculus
caaccagaagacacggtggcgtagg

SEQ ID NO: 339060 - DNA, 25 bp, Mus musculus
gcacgcgctaggtcactgcccaggt

SEQ ID NO: 339061 - DNA, 25 bp, Mus musculus
ccagcgacaggcgatacagggcctc

SEQ ID NO: 339062 - DNA, 25 bp, Mus musculus
gatacagggcctcgctgcgcagact

SEQ ID NO: 339063 - DNA, 25 bp, Mus musculus
ctcgctgcgcagactgtgcatctct

SEQ ID NO: 339064 - DNA, 25 bp, Mus musculus
gtgcatctctcgagccaccttgagg

SEQ ID NO: 339065 - DNA, 25 bp, Mus musculus
ccgcagctcagacttgtgcactggt

SEQ ID NO: 339066 - DNA, 25 bp, Mus musculus
cagacttgtgcactggtgtggagcc

SEQ ID NO: 339067 - DNA, 25 bp, Mus musculus
tgctgtgccagcgacaggcgataca

SEQ ID NO: 339068 - DNA, 25 bp, Mus musculus
cgcagactgtgcatctctcgagcca

SEQ ID NO: 339069 - DNA, 25 bp, Mus musculus
gtcagcaccgcctctttgttgtctt

SEQ ID NO: 339070 - DNA, 25 bp, Mus musculus
acagtcggggtcacaaggcaatata

SEQ ID NO: 339071 - DNA, 25 bp, Mus musculus
acatctgaggtcatgggaatcccta

SEQ ID NO: 339072 - DNA, 25 bp, Mus musculus
gacccttgacctctctaaccgtgaa

SEQ ID NO: 339073 - DNA, 25 bp, Mus musculus
gcctcggctgcagattaagatgtac

SEQ ID NO: 339074 - DNA, 25 bp, Mus musculus
agcctcagatcttagcggttgttcc

SEQ ID NO: 339075 - DNA, 25 bp, Mus musculus
cactagtaccagagcgcggttttta

SEQ ID NO: 339076 - DNA, 25 bp, Mus musculus
gccgcgccggaatagatcactagta

SEQ ID NO: 339077 - DNA, 25 bp, Mus musculus
gccctgtaagttatcgctcagcgtg

SEQ ID NO: 339078 - DNA, 25 bp, Mus musculus
gcctggttatagtctcagccctgta

SEQ ID NO: 339079 - DNA, 25 bp, Mus musculus
ctttagccgaaagcaacgccgcctg

SEQ ID NO: 339080 - DNA, 25 bp, Mus musculus
tcgaaacttgacagcagccaccttg

SEQ ID NO: 339081 - DNA, 25 bp, Mus musculus
gggtcacaggttaggagttcacgta

SEQ ID NO: 339082 - DNA, 25 bp, Mus musculus
gcgcccgcttttagtaccctgtgaa

SEQ ID NO: 339083 - DNA, 25 bp, Mus musculus
ccagcagcaccgtccattccatggc

SEQ ID NO: 339084 - DNA, 25 bp, Mus musculus
cattggcggagtccacagctcatca

SEQ ID NO: 339085 - DNA, 25 bp, Mus musculus
ggagtccacagctcatcacgcactg

SEQ ID NO: 339086 - DNA, 25 bp, Mus musculus
gtccacagctcatcacgcactgagt

SEQ ID NO: 339087 - DNA, 25 bp, Mus musculus
gctcatcacgcactgagttggcgga

SEQ ID NO: 339088 - DNA, 25 bp, Mus musculus
cacgcactgagttggcggagccgcc

SEQ ID NO: 339089 - DNA, 25 bp, Mus musculus
tctgcccggcgggaccaccatggtg

SEQ ID NO: 339090 - DNA, 25 bp, Mus musculus
attccatggcctccaggtctcgcgg

SEQ ID NO: 339091 - DNA, 25 bp, Mus musculus
cgccggcccgatgcccagcagcacc

SEQ ID NO: 339092 - DNA, 25 bp, Mus musculus
accaccatggtgctaggttccgtcc

SEQ ID NO: 339093 - DNA, 25 bp, Mus musculus
gggcttggctgaccgccaatcattg

SEQ ID NO: 339094 - DNA, 25 bp, Mus musculus
caatcattggcggagtccacagctc

SEQ ID NO: 339095 - DNA, 25 bp, Mus musculus
gcgggaccaccatggtgctaggttc

SEQ ID NO: 339096 - DNA, 25 bp, Mus musculus
aggtctcgcggacctcagctctgcc

SEQ ID NO: 339097 - DNA, 25 bp, Mus musculus
gccgctgctgagaaaagtccttctg

SEQ ID NO: 339098 - DNA, 25 bp, Mus musculus
ggacatctcacaggggtccacccga

SEQ ID NO: 339099 - DNA, 25 bp, Mus musculus
gacgtctagaaaccgctgtccacca

SEQ ID NO: 339100 - DNA, 25 bp, Mus musculus
tagaaaccgctgtccaccaaggcgc

SEQ ID NO: 339101 - DNA, 25 bp, Mus musculus
aagtccttctgttccaagcctcgga

SEQ ID NO: 339102 - DNA, 25 bp, Mus musculus
tgttccaagcctcggaattcgggcc

SEQ ID NO: 339103 - DNA, 25 bp, Mus musculus
aattcgggccgggacatctcacagg

SEQ ID NO: 339104 - DNA, 25 bp, Mus musculus
tctcacaggggtccacccgagttgc

SEQ ID NO: 339105 - DNA, 25 bp, Mus musculus
cccgagttgccgaggttagttctct

SEQ ID NO: 339106 - DNA, 25 bp, Mus musculus
cgaggttagttctctgtgtgtggcc

SEQ ID NO: 339107 - DNA, 25 bp, Mus musculus
tgtgtggccatgagcaccgcggtcc

SEQ ID NO: 339108 - DNA, 25 bp, Mus musculus
atgagcaccgcggtccagcaaccag

SEQ ID NO: 339109 - DNA, 25 bp, Mus musculus
agccttcccgccaggcgcgactccg

SEQ ID NO: 339110 - DNA, 25 bp, Mus musculus
agcctcggaattcgggccgggacat

SEQ ID NO: 339111 - DNA, 25 bp, Mus musculus
agaggaggcgactacccagagtctg

SEQ ID NO: 339112 - DNA, 25 bp, Mus musculus
gaggcgactacccagagtctgcgtg

SEQ ID NO: 339113 - DNA, 25 bp, Mus musculus
ggcgactacccagagtctgcgtgac

SEQ ID NO: 339114 - DNA, 25 bp, Mus musculus
gcgactacccagagtctgcgtgacc

SEQ ID NO: 339115 - DNA, 25 bp, Mus musculus
gactacccagagtctgcgtgacctg

SEQ ID NO: 339116 - DNA, 25 bp, Mus musculus
aggcgactacccagagtctgcgtga

SEQ ID NO: 339117 - DNA, 25 bp, Mus musculus
tacccagagtctgcgtgacctggga

SEQ ID NO: 339118 - DNA, 25 bp, Mus musculus
aggaggcgactacccagagtctgcg

SEQ ID NO: 339119 - DNA, 25 bp, Mus musculus
cccagagtctgcgtgacctgggaag

SEQ ID NO: 339120 - DNA, 25 bp, Mus musculus
agagtctgcgtgacctgggaaggtc

SEQ ID NO: 339121 - DNA, 25 bp, Mus musculus
caagaggaggcgactacccagagtc

SEQ ID NO: 339122 - DNA, 25 bp, Mus musculus
gcaagaggaggcgactacccagagt

SEQ ID NO: 339123 - DNA, 25 bp, Mus musculus
ccaagtggcttgagcggcctgaggc

SEQ ID NO: 339124 - DNA, 25 bp, Mus musculus
actacccagagtctgcgtgacctgg

SEQ ID NO: 339125 - DNA, 25 bp, Mus musculus
cccacccgggcgtctctagcaagcc

SEQ ID NO: 339126 - DNA, 25 bp, Mus musculus
cacgtcctccgagtggcacatggca

SEQ ID NO: 339127 - DNA, 25 bp, Mus musculus
atggcaggacaaggcagtgccctga

SEQ ID NO: 339128 - DNA, 25 bp, Mus musculus
tctagcaagcccactgccatgctgg

SEQ ID NO: 339129 - DNA, 25 bp, Mus musculus
cactgccatgctggaactccaacga

SEQ ID NO: 339130 - DNA, 25 bp, Mus musculus
tgctggaactccaacgagctgatgc

SEQ ID NO: 339131 - DNA, 25 bp, Mus musculus
ctggaactccaacgagctgatgccc

SEQ ID NO: 339132 - DNA, 25 bp, Mus musculus
gagctgatgccccaactcccgaagg

SEQ ID NO: 339133 - DNA, 25 bp, Mus musculus
tcccgaaggctccacaggcctagtg

SEQ ID NO: 339134 - DNA, 25 bp, Mus musculus
cacaggcctagtgtggctctcacgg

SEQ ID NO: 339135 - DNA, 25 bp, Mus musculus
ggctctcacggacctgtgtccgctg

SEQ ID NO: 339136 - DNA, 25 bp, Mus musculus
tgccgccgcgggtgtgacaccaagt

SEQ ID NO: 339137 - DNA, 25 bp, Mus musculus
ccgcgggtgtgacaccaagtggctt

SEQ ID NO: 339138 - DNA, 25 bp, Mus musculus
tccgagtggcacatggcaggacaag

SEQ ID NO: 339139 - DNA, 25 bp, Mus musculus
tgtttcatttgcagcctccggagtc

SEQ ID NO: 339140 - DNA, 25 bp, Mus musculus
cgcttacggacttcggcttagcctg

SEQ ID NO: 339141 - DNA, 25 bp, Mus musculus
ggcatcccgttctagatggggaaca

SEQ ID NO: 339142 - DNA, 25 bp, Mus musculus
tccggatcctgaggaggcatcccgt

SEQ ID NO: 339143 - DNA, 25 bp, Mus musculus
agcctccggagtccagtgtcggctt

SEQ ID NO: 339144 - DNA, 25 bp, Mus musculus
ggggacaactcctatcttctgtttc

SEQ ID NO: 339145 - DNA, 25 bp, Mus musculus
agcccgtcggggacaactcctatct

SEQ ID NO: 339146 - DNA, 25 bp, Mus musculus
gcaagcactcgtaacgctgcgtgaa

SEQ ID NO: 339147 - DNA, 25 bp, Mus musculus
gccattgtgtttatcgcaagcactc

SEQ ID NO: 339148 - DNA, 25 bp, Mus musculus
cgacaggcaagagccattgtgttta

SEQ ID NO: 339149 - DNA, 25 bp, Mus musculus
actcaggggctagaccgacaggcaa

SEQ ID NO: 339150 - DNA, 25 bp, Mus musculus
tagtccggaccagcgagccgactca

SEQ ID NO: 339151 - DNA, 25 bp, Mus musculus
tcggcttagcctgccaacaggaagg

SEQ ID NO: 339152 - DNA, 25 bp, Mus musculus
ttagtggctccacttctatggaccc

SEQ ID NO: 339153 - DNA, 25 bp, Mus musculus
ttccagaaccgcgacaggaattgga

SEQ ID NO: 339154 - DNA, 25 bp, Mus musculus
agaaccgcgacaggaattggaagtc

SEQ ID NO: 339155 - DNA, 25 bp, Mus musculus
aaccttcaccactcaggtgcggatc

SEQ ID NO: 339156 - DNA, 25 bp, Mus musculus
tccagaaccgcgacaggaattggaa

SEQ ID NO: 339157 - DNA, 25 bp, Mus musculus
cttagacctgctccctcaaccttca

SEQ ID NO: 339158 - DNA, 25 bp, Mus musculus
ctgcttccagaaccgcgacaggaat

SEQ ID NO: 339159 - DNA, 25 bp, Mus musculus
gctgcttccagaaccgcgacaggaa

SEQ ID NO: 339160 - DNA, 25 bp, Mus musculus
agctgcttccagaaccgcgacagga

SEQ ID NO: 339161 - DNA, 25 bp, Mus musculus
cagctgcttccagaaccgcgacagg

SEQ ID NO: 339162 - DNA, 25 bp, Mus musculus
ccagaaccgcgacaggaattggaag

SEQ ID NO: 339163 - DNA, 25 bp, Mus musculus
cttcaccactcaggtgcggatccgg

SEQ ID NO: 339164 - DNA, 25 bp, Mus musculus
cagaaccgcgacaggaattggaagt

SEQ ID NO: 339165 - DNA, 25 bp, Mus musculus
caaccttcaccactcaggtgcggat

SEQ ID NO: 339166 - DNA, 25 bp, Mus musculus
tcaaccttcaccactcaggtgcgga

SEQ ID NO: 339167 - DNA, 25 bp, Mus musculus
gatccgcacctgagtggtgaaggtt

SEQ ID NO: 339168 - DNA, 25 bp, Mus musculus
tccaattcctgtcgcggttctggaa

SEQ ID NO: 339169 - DNA, 25 bp, Mus musculus
gacttccaattcctgtcgcggttct

SEQ ID NO: 339170 - DNA, 25 bp, Mus musculus
acttccaattcctgtcgcggttctg

SEQ ID NO: 339171 - DNA, 25 bp, Mus musculus
cttccaattcctgtcgcggttctgg

SEQ ID NO: 339172 - DNA, 25 bp, Mus musculus
ttccaattcctgtcgcggttctgga

SEQ ID NO: 339173 - DNA, 25 bp, Mus musculus
attcctgtcgcggttctggaagcag

SEQ ID NO: 339174 - DNA, 25 bp, Mus musculus
ttcctgtcgcggttctggaagcagc

SEQ ID NO: 339175 - DNA, 25 bp, Mus musculus
tcctgtcgcggttctggaagcagct

SEQ ID NO: 339176 - DNA, 25 bp, Mus musculus
cctgtcgcggttctggaagcagctg

SEQ ID NO: 339177 - DNA, 25 bp, Mus musculus
ccggatccgcacctgagtggtgaag

SEQ ID NO: 339178 - DNA, 25 bp, Mus musculus
tccgcacctgagtggtgaaggttga

SEQ ID NO: 339179 - DNA, 25 bp, Mus musculus
tgaaggttgagggagcaggtctaag

SEQ ID NO: 339180 - DNA, 25 bp, Mus musculus
agtctcggggatcacgggaggggcg

SEQ ID NO: 339181 - DNA, 25 bp, Mus musculus
tggccgacatcaagacgggcatctt

SEQ ID NO: 339182 - DNA, 25 bp, Mus musculus
caggtgcagttgctctctggctgca

SEQ ID NO: 339183 - DNA, 25 bp, Mus musculus
tgtggctatttgagtgaagtcggtc

SEQ ID NO: 339184 - DNA, 25 bp, Mus musculus
gacgggcatcttcgccaaaaacgtg

SEQ ID NO: 339185 - DNA, 25 bp, Mus musculus
atccgggagggagattgtcgcatct

SEQ ID NO: 339186 - DNA, 25 bp, Mus musculus
tgagctcaagctctcccgcaagcag

SEQ ID NO: 339187 - DNA, 25 bp, Mus musculus
attgtcgcatctcttcttgggtggg

SEQ ID NO: 339188 - DNA, 25 bp, Mus musculus
agtgctatagactcccagagcccgc

SEQ ID NO: 339189 - DNA, 25 bp, Mus musculus
gaccctccaggcactgagtgctata

SEQ ID NO: 339190 - DNA, 25 bp, Mus musculus
aggcaggatccattcaggcagcgtg

SEQ ID NO: 339191 - DNA, 25 bp, Mus musculus
tcaacgattgcagccaggcaggatc

SEQ ID NO: 339192 - DNA, 25 bp, Mus musculus
ctcaaccgcgcgcaggaaaaggtca

SEQ ID NO: 339193 - DNA, 25 bp, Mus musculus
gccaaaaacgtgcaaaagcgcctca

SEQ ID NO: 339194 - DNA, 25 bp, Mus musculus
agctcaggcgtccacgaccgcagat

SEQ ID NO: 339195 - DNA, 25 bp, Mus musculus
ggcaacagcgggagcgcggaagtgt

SEQ ID NO: 339196 - DNA, 25 bp, Mus musculus
agacaccttgtcaacttcgcagttc

SEQ ID NO: 339197 - DNA, 25 bp, Mus musculus
cctctgagacaccttgtcaacttcg

SEQ ID NO: 339198 - DNA, 25 bp, Mus musculus
gaccctctgagacaccttgtcaact

SEQ ID NO: 339199 - DNA, 25 bp, Mus musculus
gtgaccctctgagacaccttgtcaa

SEQ ID NO: 339200 - DNA, 25 bp, Mus musculus
aagtgtgaccctctgagacaccttg

SEQ ID NO: 339201 - DNA, 25 bp, Mus musculus
tgagacaccttgtcaacttcgcagt

SEQ ID NO: 339202 - DNA, 25 bp, Mus musculus
gtgtgaccctctgagacaccttgtc

SEQ ID NO: 339203 - DNA, 25 bp, Mus musculus
ccttgtcaacttcgcagttctcttc

SEQ ID NO: 339204 - DNA, 25 bp, Mus musculus
atgcggtgaatcaggcagcgcagcc

SEQ ID NO: 339205 - DNA, 25 bp, Mus musculus
tccatgcggtgaatcaggcagcgca

SEQ ID NO: 339206 - DNA, 25 bp, Mus musculus
gtcgtccaggtcgtggtgcagggat

SEQ ID NO: 339207 - DNA, 25 bp, Mus musculus
cttcgcagttctcttcccggttact

SEQ ID NO: 339208 - DNA, 25 bp, Mus musculus
gtcaacttcgcagttctcttcccgg

SEQ ID NO: 339209 - DNA, 25 bp, Mus musculus
cacccggactgagaatgaaggggac

SEQ ID NO: 339210 - DNA, 25 bp, Mus musculus
ctcgagtttgcagatgggctgtacc

SEQ ID NO: 339211 - DNA, 25 bp, Mus musculus
agaacacacccggactgagaatgaa

SEQ ID NO: 339212 - DNA, 25 bp, Mus musculus
gctctccacgatcctgctgagaaca

SEQ ID NO: 339213 - DNA, 25 bp, Mus musculus
gtgcgcccaggaccacagggactaa

SEQ ID NO: 339214 - DNA, 25 bp, Mus musculus
gtggaactgcctgcacccatggctc

SEQ ID NO: 339215 - DNA, 25 bp, Mus musculus
gtcttcctgggaccgcggagaagca

SEQ ID NO: 339216 - DNA, 25 bp, Mus musculus
gggtgaggagcacccgctctccacg

SEQ ID NO: 339217 - DNA, 25 bp, Mus musculus
gtggctttcctactctcgccggcta

SEQ ID NO: 339218 - DNA, 25 bp, Mus musculus
cacccatggctcagtggctttccta

SEQ ID NO: 339219 - DNA, 25 bp, Mus musculus
ctccgctgctcggtggaactgcctg

SEQ ID NO: 339220 - DNA, 25 bp, Mus musculus
cgcgtcagcgggatctccagctgct

SEQ ID NO: 339221 - DNA, 25 bp, Mus musculus
gcaggtggctgcagcttaccttggt

SEQ ID NO: 339222 - DNA, 25 bp, Mus musculus
ctagccgtcttcctgggaccgcgga

SEQ ID NO: 339223 - DNA, 25 bp, Mus musculus
gggagccaacaacgccaggacctgc

SEQ ID NO: 339224 - DNA, 25 bp, Mus musculus
cggcacaaagcaccacggtggtgaa

SEQ ID NO: 339225 - DNA, 25 bp, Mus musculus
cagcgcagcacgctttgggcacggc

SEQ ID NO: 339226 - DNA, 25 bp, Mus musculus
tttgggcacggcctttccgcacgga

SEQ ID NO: 339227 - DNA, 25 bp, Mus musculus
ccgcacggaggccaccgcttctgac

SEQ ID NO: 339228 - DNA, 25 bp, Mus musculus
ttctgactcattctctgcgcccggg

SEQ ID NO: 339229 - DNA, 25 bp, Mus musculus
ggcccgggagccaacaacgccagga

SEQ ID NO: 339230 - DNA, 25 bp, Mus musculus
cgcaggcgcggtgtccctcacggta

SEQ ID NO: 339231 - DNA, 25 bp, Mus musculus
tgtccctcacggtagcagagcgcct

SEQ ID NO: 339232 - DNA, 25 bp, Mus musculus
tagcagagcgcctgcatggatcaca

SEQ ID NO: 339233 - DNA, 25 bp, Mus musculus
ctgcatggatcacaggccggaaata

SEQ ID NO: 339234 - DNA, 25 bp, Mus musculus
tcacaggccggaaataaagccgccg

SEQ ID NO: 339235 - DNA, 25 bp, Mus musculus
gtgtggcggctccacctgccgtgct

SEQ ID NO: 339236 - DNA, 25 bp, Mus musculus
ctccaactccagtgtggcggctcca

SEQ ID NO: 339237 - DNA, 25 bp, Mus musculus
ctgtagttctgcgactgccggaagc

SEQ ID NO: 339238 - DNA, 25 bp, Mus musculus
agcccggctgcgcttcgggtccacc

SEQ ID NO: 339239 - DNA, 25 bp, Mus musculus
tcgggtccaccggagcgccgacatg

SEQ ID NO: 339240 - DNA, 25 bp, Mus musculus
gccgcctgcagggagctgtagttct

SEQ ID NO: 339241 - DNA, 25 bp, Mus musculus
cgctcttagggtctgtcctgtgaga

SEQ ID NO: 339242 - DNA, 25 bp, Mus musculus
cgactgccggaagcgctcttagggt

SEQ ID NO: 339243 - DNA, 25 bp, Mus musculus
cagaacccggccaagcccggctgcg

SEQ ID NO: 339244 - DNA, 25 bp, Mus musculus
agcgctcttagggtctgtcctgtga

SEQ ID NO: 339245 - DNA, 25 bp, Mus musculus
cagggagctgtagttctgcgactgc

SEQ ID NO: 339246 - DNA, 25 bp, Mus musculus
tcttagggtctgtcctgtgagagga

SEQ ID NO: 339247 - DNA, 25 bp, Mus musculus
tgagaggagtcgaaggagaactaca

SEQ ID NO: 339248 - DNA, 25 bp, Mus musculus
gaggagtcgaaggagaactacaact

SEQ ID NO: 339249 - DNA, 25 bp, Mus musculus
cagcgtggcggcaagagagcatgcg

SEQ ID NO: 339250 - DNA, 25 bp, Mus musculus
agctgtagttctgcgactgccggaa

SEQ ID NO: 339251 - DNA, 25 bp, Mus musculus
cggggccttagtctgaagctgatga

SEQ ID NO: 339252 - DNA, 25 bp, Mus musculus
gctttatccgggaaggacttccgca

SEQ ID NO: 339253 - DNA, 25 bp, Mus musculus
tgcacttcgtaataaagggcctctg

SEQ ID NO: 339254 - DNA, 25 bp, Mus musculus
gctccgatgatgaaagatgcacttc

SEQ ID NO: 339255 - DNA, 25 bp, Mus musculus
gtgagagctctacgatgtcgcccta

SEQ ID NO: 339256 - DNA, 25 bp, Mus musculus
gctgatgaacaagcccggcgacgtt

SEQ ID NO: 339257 - DNA, 25 bp, Mus musculus
ggcgacgttgccaccacaaggttta

SEQ ID NO: 339258 - DNA, 25 bp, Mus musculus
gcagccgcagtccttagactcttta

SEQ ID NO: 339259 - DNA, 25 bp, Mus musculus
agcgtcaggcaccttcgctgctgcg

SEQ ID NO: 339260 - DNA, 25 bp, Mus musculus
tgtcgccctactaggctgcttcttc

SEQ ID NO: 339261 - DNA, 25 bp, Mus musculus
ggatcagtcactccgccgtaatgtg

SEQ ID NO: 339262 - DNA, 25 bp, Mus musculus
ccgtagcttcgcaagccggcgattc

SEQ ID NO: 339263 - DNA, 25 bp, Mus musculus
gaccgtgcaacctacgccggggata

SEQ ID NO: 339264 - DNA, 25 bp, Mus musculus
taggtaccgaccgatcgagcccgaa

SEQ ID NO: 339265 - DNA, 25 bp, Mus musculus
cccaactttggagaagaccgccaga

SEQ ID NO: 339266 - DNA, 25 bp, Mus musculus
tctgcgagcgagtttcacaaagccg

SEQ ID NO: 339267 - DNA, 25 bp, Mus musculus
tggctgcgctacatcctgggaccaa

SEQ ID NO: 339268 - DNA, 25 bp, Mus musculus
ccgcaacgtccctctggctgcgcta

SEQ ID NO: 339269 - DNA, 25 bp, Mus musculus
tccatgccagagatgctaccagagc

SEQ ID NO: 339270 - DNA, 25 bp, Mus musculus
aggacccgacactggcccaactttg

SEQ ID NO: 339271 - DNA, 25 bp, Mus musculus
gaccaacctccatgccagagatgct

SEQ ID NO: 339272 - DNA, 25 bp, Mus musculus
cacacacaggcgcagaagaaacacg

SEQ ID NO: 339273 - DNA, 25 bp, Mus musculus
gcagaagaaacacggaagcgccctt

SEQ ID NO: 339274 - DNA, 25 bp, Mus musculus
ccagagtccctgtttgtgacgtcgc

SEQ ID NO: 339275 - DNA, 25 bp, Mus musculus
tccctgtttgtgacgtcgccgcgga

SEQ ID NO: 339276 - DNA, 25 bp, Mus musculus
tcgccgcggacgagactacatttcc

SEQ ID NO: 339277 - DNA, 25 bp, Mus musculus
atttcccacaattctctgcgagcga

SEQ ID NO: 339278 - DNA, 25 bp, Mus musculus
agatgctaccagagcgcgcacagga

SEQ ID NO: 339279 - DNA, 25 bp, Mus musculus
tcgcccaactttgagagaaaatgca

SEQ ID NO: 339280 - DNA, 25 bp, Mus musculus
tgcactagtgcagtcgcaatgcgga

SEQ ID NO: 339281 - DNA, 25 bp, Mus musculus
ctttgagagaaaatgcactagtgca

SEQ ID NO: 339282 - DNA, 25 bp, Mus musculus
caggaccagagaatcgcccaacttt

SEQ ID NO: 339283 - DNA, 25 bp, Mus musculus
cggagcaggaccagagaatcgccca

SEQ ID NO: 339284 - DNA, 25 bp, Mus musculus
tccatgtcagcgatgcaagccgagc

SEQ ID NO: 339285 - DNA, 25 bp, Mus musculus
gaccaacctccatgtcagcgatgca

SEQ ID NO: 339286 - DNA, 25 bp, Mus musculus
agtcgcaatgcggaagtgccgtttc

SEQ ID NO: 339287 - DNA, 25 bp, Mus musculus
cggtccctccgacctgcagcggtac

SEQ ID NO: 339288 - DNA, 25 bp, Mus musculus
agcggtacgcgacaccctggaccaa

SEQ ID NO: 339289 - DNA, 25 bp, Mus musculus
gtgccgtttccacaatggctccttg

SEQ ID NO: 339290 - DNA, 25 bp, Mus musculus
tggctccttgtgaagcgatccaacg

SEQ ID NO: 339291 - DNA, 25 bp, Mus musculus
gcgatccaacggaagactacacttc

SEQ ID NO: 339292 - DNA, 25 bp, Mus musculus
tgcggaagtgccgtttccacaatgg

SEQ ID NO: 339293 - DNA, 25 bp, Mus musculus
acgcacggtgccaggagcgaatgct

SEQ ID NO: 339294 - DNA, 25 bp, Mus musculus
agcgaatgctctgttaggacggagc

SEQ ID NO: 339295 - DNA, 25 bp, Mus musculus
cagatctaggcttggccagagtgca

SEQ ID NO: 339296 - DNA, 25 bp, Mus musculus
caatgcagatctaggcttggccaga

SEQ ID NO: 339297 - DNA, 25 bp, Mus musculus
cccacttggatgtgcaatgcagatc

SEQ ID NO: 339298 - DNA, 25 bp, Mus musculus
cggagagaagcccacttggatgtgc

SEQ ID NO: 339299 - DNA, 25 bp, Mus musculus
cctcatgaactctgaggttgggcgg

SEQ ID NO: 339300 - DNA, 25 bp, Mus musculus
gcagcctagacttgcaaacctcatg

SEQ ID NO: 339301 - DNA, 25 bp, Mus musculus
cccgggtgcagcctagacttgcaaa

SEQ ID NO: 339302 - DNA, 25 bp, Mus musculus
ttcgcgcttaacatggaggttggtc

SEQ ID NO: 339303 - DNA, 25 bp, Mus musculus
tggcttgttcttcgcgcttaacatg

SEQ ID NO: 339304 - DNA, 25 bp, Mus musculus
gttcggacagtgtggcttgttcttc

SEQ ID NO: 339305 - DNA, 25 bp, Mus musculus
gcgttctcaaagttcggacagtgtg

SEQ ID NO: 339306 - DNA, 25 bp, Mus musculus
gacttgcaaacctcatgaactctga

SEQ ID NO: 339307 - DNA, 25 bp, Mus musculus
gccgaatacctccaggcgcgaattc

SEQ ID NO: 339308 - DNA, 25 bp, Mus musculus
gcccggctcatacccggagtttgaa

SEQ ID NO: 339309 - DNA, 25 bp, Mus musculus
gaattaccatgctttgcccggctca

SEQ ID NO: 339310 - DNA, 25 bp, Mus musculus
cttttctgtgattgtgcgtgagccc

SEQ ID NO: 339311 - DNA, 25 bp, Mus musculus
ccctgctccgcttgcttttctgtga

SEQ ID NO: 339312 - DNA, 25 bp, Mus musculus
ccgctcggtaagtgtctcgggatta

SEQ ID NO: 339313 - DNA, 25 bp, Mus musculus
aagctccgtgtctgtcctgtcccgg

SEQ ID NO: 339314 - DNA, 25 bp, Mus musculus
cacgcgccggaatgttctccaggta

SEQ ID NO: 339315 - DNA, 25 bp, Mus musculus
ctgggccaatcgctgatcgccggat

SEQ ID NO: 339316 - DNA, 25 bp, Mus musculus
ccgacaggcacagtccgggagcact

SEQ ID NO: 339317 - DNA, 25 bp, Mus musculus
ggtccggaaaactcagcggctcatc

SEQ ID NO: 339318 - DNA, 25 bp, Mus musculus
gtttgaatcttgtcggctgctcctc

SEQ ID NO: 339319 - DNA, 25 bp, Mus musculus
tgcgagctcacgaggttttgggaaa

SEQ ID NO: 339320 - DNA, 25 bp, Mus musculus
gccaacagacatgcgggcggacctg

SEQ ID NO: 339321 - DNA, 25 bp, Mus musculus
ggtgctgctggctcatgcagtagta

SEQ ID NO: 339322 - DNA, 25 bp, Mus musculus
cccggagctgagctaatgggcctcg

SEQ ID NO: 339323 - DNA, 25 bp, Mus musculus
ctgcccgcccggagctgagctaatg

SEQ ID NO: 339324 - DNA, 25 bp, Mus musculus
ggctcatgcagtagtaggactcgta

SEQ ID NO: 339325 - DNA, 25 bp, Mus musculus
cgcccatgacgatgagcagcaggaa

SEQ ID NO: 339326 - DNA, 25 bp, Mus musculus
aggcaggcgcccatgacgatgagca

SEQ ID NO: 339327 - DNA, 25 bp, Mus musculus
tattttgggcaaagccttccaagga

SEQ ID NO: 339328 - DNA, 25 bp, Mus musculus
tggcaactttattttgggcaaagcc

SEQ ID NO: 339329 - DNA, 25 bp, Mus musculus
gcaagccctggcaactttattttgg

SEQ ID NO: 339330 - DNA, 25 bp, Mus musculus
cacctggagcaagccctggcaactt

SEQ ID NO: 339331 - DNA, 25 bp, Mus musculus
ggcgcagagatgctgaacccacacg

SEQ ID NO: 339332 - DNA, 25 bp, Mus musculus
ccaaggaagcctgaggactgcctct

SEQ ID NO: 339333 - DNA, 25 bp, Mus musculus
cagctagcgcgccaaggaagcctga

SEQ ID NO: 339334 - DNA, 25 bp, Mus musculus
taggactcgtagagccagtcccggg

SEQ ID NO: 339335 - DNA, 25 bp, Mus musculus
gcccgactcggcgttggacgacgac

SEQ ID NO: 339336 - DNA, 25 bp, Mus musculus
cgacggggacttgtgcaagcgtctt

SEQ ID NO: 339337 - DNA, 25 bp, Mus musculus
cttgtgcaagcgtcttgcgctgtcc

SEQ ID NO: 339338 - DNA, 25 bp, Mus musculus
acgccctgcgaggtctcccagatct

SEQ ID NO: 339339 - DNA, 25 bp, Mus musculus
gatctgcatccacagggcattggcc

SEQ ID NO: 339340 - DNA, 25 bp, Mus musculus
ttctgctccggctggatccaggcca

SEQ ID NO: 339341 - DNA, 25 bp, Mus musculus
aggccacgcgcggatccatccacgc

SEQ ID NO: 339342 - DNA, 25 bp, Mus musculus
gagcgtcgggccgtcagtcagtcac

SEQ ID NO: 339343 - DNA, 25 bp, Mus musculus
gggccgtcagtcagtcacggcgctc

SEQ ID NO: 339344 - DNA, 25 bp, Mus musculus
gccgcctcagctccaatgaggggcg

SEQ ID NO: 339345 - DNA, 25 bp, Mus musculus
ttggttaccgcgcttgcgcactgcg

SEQ ID NO: 339346 - DNA, 25 bp, Mus musculus
ttcaaatcctcactagacagcgccg

SEQ ID NO: 339347 - DNA, 25 bp, Mus musculus
cgcacgcgcggggatttcaaatcct

SEQ ID NO: 339348 - DNA, 25 bp, Mus musculus
gcgggcgcatgcagaccagacagac

SEQ ID NO: 339349 - DNA, 25 bp, Mus musculus
tttggcttcacgacctgcccagcag

SEQ ID NO: 339350 - DNA, 25 bp, Mus musculus
cagtagatggctcataaaggaggca

SEQ ID NO: 339351 - DNA, 25 bp, Mus musculus
tcggacgaccagtagatggctcata

SEQ ID NO: 339352 - DNA, 25 bp, Mus musculus
agaactgtcagttttcggacgacca

SEQ ID NO: 339353 - DNA, 25 bp, Mus musculus
ggcgggttggtttacagaactgtca

SEQ ID NO: 339354 - DNA, 25 bp, Mus musculus
ctgcggcttgctggaaaagtgaata

SEQ ID NO: 339355 - DNA, 25 bp, Mus musculus
ggtcacgcaaagacgctgcggcttg

SEQ ID NO: 339356 - DNA, 25 bp, Mus musculus
gacgtcaacgcgctggtcacgcaaa

SEQ ID NO: 339357 - DNA, 25 bp, Mus musculus
acctgcccagcagggcgcggaaaga

SEQ ID NO: 339358 - DNA, 25 bp, Mus musculus
acctcaggcatttggcttcacgacc

SEQ ID NO: 339359 - DNA, 25 bp, Mus musculus
caccttggacttgatgcggatgcaa

SEQ ID NO: 339360 - DNA, 25 bp, Mus musculus
acacccgcatgtcaccttggacttg

SEQ ID NO: 339361 - DNA, 25 bp, Mus musculus
ggcaaaccctggaacctcaggcatt

SEQ ID NO: 339362 - DNA, 25 bp, Mus musculus
ggcgcggaaagacagcctacctcct

SEQ ID NO: 339363 - DNA, 25 bp, Mus musculus
tcccgcccgtaatccaaacgagaga

SEQ ID NO: 339364 - DNA, 25 bp, Mus musculus
ctctgtgtaagacggggagattcac

SEQ ID NO: 339365 - DNA, 25 bp, Mus musculus
tcgtccatgcaggtgcctgagtctc

SEQ ID NO: 339366 - DNA, 25 bp, Mus musculus
agtctaacccggacagcgacagatc

SEQ ID NO: 339367 - DNA, 25 bp, Mus musculus
ggccgtaggaagagcccaccatctg

SEQ ID NO: 339368 - DNA, 25 bp, Mus musculus
tccaggtagactagcgcatccagta

SEQ ID NO: 339369 - DNA, 25 bp, Mus musculus
tccaactccatagctgaggtcgagc

SEQ ID NO: 339370 - DNA, 25 bp, Mus musculus
cacaggctagcaccaccagaagata

SEQ ID NO: 339371 - DNA, 25 bp, Mus musculus
gatcttggagcgctacacacattgg

SEQ ID NO: 339372 - DNA, 25 bp, Mus musculus
cacacattggctgagagctcctttg

SEQ ID NO: 339373 - DNA, 25 bp, Mus musculus
cgggagcatgttgtgtctttcaggc

SEQ ID NO: 339374 - DNA, 25 bp, Mus musculus
ggacaacactccatgactctctgcg

SEQ ID NO: 339375 - DNA, 25 bp, Mus musculus
agcgtgctccatgctcggatgtcca

SEQ ID NO: 339376 - DNA, 25 bp, Mus musculus
tcgcgaaaagttctgccggagctcc

SEQ ID NO: 339377 - DNA, 25 bp, Mus musculus
cctggctgctgttggcgcgggcacc

SEQ ID NO: 339378 - DNA, 25 bp, Mus musculus
tacccgcatctggagggcgacgtgc

SEQ ID NO: 339379 - DNA, 25 bp, Mus musculus
gcgacgtgcgctggcgccgcctctt

SEQ ID NO: 339380 - DNA, 25 bp, Mus musculus
ccacgcgtccattggacggcagctg

SEQ ID NO: 339381 - DNA, 25 bp, Mus musculus
tggctgggcctagcctggctgctgt

SEQ ID NO: 339382 - DNA, 25 bp, Mus musculus
tcgggatgcgcagccgcctctggct

SEQ ID NO: 339383 - DNA, 25 bp, Mus musculus
cacaggtcgggatgcgcagccgcct

SEQ ID NO: 339384 - DNA, 25 bp, Mus musculus
tgcagctggaacaccgcgcgctgtc

SEQ ID NO: 339385 - DNA, 25 bp, Mus musculus
cgtgcagctggaacaccgcgcgctg

SEQ ID NO: 339386 - DNA, 25 bp, Mus musculus
tccattggacggcagctgccctaac

SEQ ID NO: 339387 - DNA, 25 bp, Mus musculus
gcgtccattggacggcagctgccct

SEQ ID NO: 339388 - DNA, 25 bp, Mus musculus
tgtggaccttggtggtcgggtgcag

SEQ ID NO: 339389 - DNA, 25 bp, Mus musculus
acaccgcgcgctgtccggcacaggt

SEQ ID NO: 339390 - DNA, 25 bp, Mus musculus
cttctcctccactcactttttcctg

SEQ ID NO: 339391 - DNA, 25 bp, Mus musculus
cagtcgaagaggttctcgtttacca

SEQ ID NO: 339392 - DNA, 25 bp, Mus musculus
tcgtttaccagctccaccgagatga

SEQ ID NO: 339393 - DNA, 25 bp, Mus musculus
tccaccgagatgaagcggtcgctga

SEQ ID NO: 339394 - DNA, 25 bp, Mus musculus
tggagctccttcatgagccgccggc

SEQ ID NO: 339395 - DNA, 25 bp, Mus musculus
tgcttgtggccgctgctcttaccac

SEQ ID NO: 339396 - DNA, 25 bp, Mus musculus
ttgccgcgcagcgatgcgctctgct

SEQ ID NO: 339397 - DNA, 25 bp, Mus musculus
cccggttgtgcaggcgaatgagccc

SEQ ID NO: 339398 - DNA, 25 bp, Mus musculus
ccgattttacggagcagcgtggcca

SEQ ID NO: 339399 - DNA, 25 bp, Mus musculus
gcgtggccatcttaggctcggctct

SEQ ID NO: 339400 - DNA, 25 bp, Mus musculus
cccgagccggatagctgggacgcac

SEQ ID NO: 339401 - DNA, 25 bp, Mus musculus
ggccaccttatgagccggcggccgt

SEQ ID NO: 339402 - DNA, 25 bp, Mus musculus
cgccgctgtcatatgacgggtcttc

SEQ ID NO: 339403 - DNA, 25 bp, Mus musculus
gtcttctcgggcaagggctccggta

SEQ ID NO: 339404 - DNA, 25 bp, Mus musculus
cccgctggtcccgagtctaagagct

SEQ ID NO: 339405 - DNA, 25 bp, Mus musculus
acctcacaggggaggcgagttccgt

SEQ ID NO: 339406 - DNA, 25 bp, Mus musculus
tatcctgaccggacctcacagggga

SEQ ID NO: 339407 - DNA, 25 bp, Mus musculus
ggttctatcctgaccggacctcaca

SEQ ID NO: 339408 - DNA, 25 bp, Mus musculus
ggaggccggttctatcctgaccgga

SEQ ID NO: 339409 - DNA, 25 bp, Mus musculus
actggggctctaacgttcatcccgg

SEQ ID NO: 339410 - DNA, 25 bp, Mus musculus
agccagaagctgtgagtgacggccc

SEQ ID NO: 339411 - DNA, 25 bp, Mus musculus
ggcatcatcgtcagcgacttccagc

SEQ ID NO: 339412 - DNA, 25 bp, Mus musculus
ggcagctcggcatcatcgtcagcga

SEQ ID NO: 339413 - DNA, 25 bp, Mus musculus
gaacattcggcagctcggcatcatc

SEQ ID NO: 339414 - DNA, 25 bp, Mus musculus
gttcgtggagaacattcggcagctc

SEQ ID NO: 339415 - DNA, 25 bp, Mus musculus
cacctggagaagttcgtggagaaca

SEQ ID NO: 339416 - DNA, 25 bp, Mus musculus
aagtttgaccatctggaggagcacc

SEQ ID NO: 339417 - DNA, 25 bp, Mus musculus
tggcggagaagtttgaccatctgga

SEQ ID NO: 339418 - DNA, 25 bp, Mus musculus
gagcactgtggacccggagtcgctc

SEQ ID NO: 339419 - DNA, 25 bp, Mus musculus
cggcatcgcagcagctgaaccaatt

SEQ ID NO: 339420 - DNA, 25 bp, Mus musculus
ccgcagatccgcctgatcaaaaagc

SEQ ID NO: 339421 - DNA, 25 bp, Mus musculus
ccctgcaaaccctgagtcgggaaga

SEQ ID NO: 339422 - DNA, 25 bp, Mus musculus
caaagcgacgacagcacacgaggtc

SEQ ID NO: 339423 - DNA, 25 bp, Mus musculus
agaccagcgaagcagcccagggcac

SEQ ID NO: 339424 - DNA, 25 bp, Mus musculus
gcctagggctcagaccagcgaagca

SEQ ID NO: 339425 - DNA, 25 bp, Mus musculus
cagggatcctgcgtacctgctgcag

SEQ ID NO: 339426 - DNA, 25 bp, Mus musculus
cgcaaaagggtcagccagggatcct

SEQ ID NO: 339427 - DNA, 25 bp, Mus musculus
ctgaaccaattctgtccgtgattaa

SEQ ID NO: 339428 - DNA, 25 bp, Mus musculus
tgaagagcacgctcactctgtccgc

SEQ ID NO: 339429 - DNA, 25 bp, Mus musculus
cgaggagtcctgaagagcacgctca

SEQ ID NO: 339430 - DNA, 25 bp, Mus musculus
caggtccatgcgtgcgccaaggtcc

SEQ ID NO: 339431 - DNA, 25 bp, Mus musculus
tgattaaacaaagcaccggcacccg

SEQ ID NO: 339432 - DNA, 25 bp, Mus musculus
caaaaagccagaacgaagcgtggtc

SEQ ID NO: 339433 - DNA, 25 bp, Mus musculus
atgctctccaggtcgatctcctcgt

SEQ ID NO: 339434 - DNA, 25 bp, Mus musculus
ccatagggataataagcaggcgttg

SEQ ID NO: 339435 - DNA, 25 bp, Mus musculus
agccaggctttcagcgtgctggtgc

SEQ ID NO: 339436 - DNA, 25 bp, Mus musculus
cgatctgatcgatgtcaatgctctc

SEQ ID NO: 339437 - DNA, 25 bp, Mus musculus
tggtcgccatcacgctcgtcgatct

SEQ ID NO: 339438 - DNA, 25 bp, Mus musculus
tcttcgtcttcgttgctctggtcgc

SEQ ID NO: 339439 - DNA, 25 bp, Mus musculus
ctcagcagccgacaatggggagctc

SEQ ID NO: 339440 - DNA, 25 bp, Mus musculus
tgccgggctctgagacctccttaac

SEQ ID NO: 339441 - DNA, 25 bp, Mus musculus
tgcctatgtgacaggtgtacagtcc

SEQ ID NO: 339442 - DNA, 25 bp, Mus musculus
ggtccagttggaaaacttgcctatg

SEQ ID NO: 339443 - DNA, 25 bp, Mus musculus
cgcatgttcagcagcgagccctgtg

SEQ ID NO: 339444 - DNA, 25 bp, Mus musculus
tgacgcccaggaaagatcgcatgtt

SEQ ID NO: 339445 - DNA, 25 bp, Mus musculus
cccaagggcgaatcttgagacttga

SEQ ID NO: 339446 - DNA, 25 bp, Mus musculus
cccgtattgaaactgaccataggga

SEQ ID NO: 339447 - DNA, 25 bp, Mus musculus
cacagtggtcactgcctgggcctct

SEQ ID NO: 339448 - DNA, 25 bp, Mus musculus
aagttgatgctttgattggcatccc

SEQ ID NO: 339449 - DNA, 25 bp, Mus musculus
gcggggctctcagacacaatttgaa

SEQ ID NO: 339450 - DNA, 25 bp, Mus musculus
ggctgcgcccgtatccgagatcgcg

SEQ ID NO: 339451 - DNA, 25 bp, Mus musculus
caagaagaccggctggcgatccgag

SEQ ID NO: 339452 - DNA, 25 bp, Mus musculus
ggcaacactaactgcgcgggcaaga

SEQ ID NO: 339453 - DNA, 25 bp, Mus musculus
ccagctgcgggaaggacatgtccgc

SEQ ID NO: 339454 - DNA, 25 bp, Mus musculus
catctgcgagaagaggctgaggtcc

SEQ ID NO: 339455 - DNA, 25 bp, Mus musculus
tctgcaggacccttctcgttccttt

SEQ ID NO: 339456 - DNA, 25 bp, Mus musculus
cactgcctgcggatcctctgtttct

SEQ ID NO: 339457 - DNA, 25 bp, Mus musculus
cctctgtttctctgttgggccagcc

SEQ ID NO: 339458 - DNA, 25 bp, Mus musculus
catagggcaagaaggcgctgtagtt

SEQ ID NO: 339459 - DNA, 25 bp, Mus musculus
gcgcttaggtattgcgggtagccca

SEQ ID NO: 339460 - DNA, 25 bp, Mus musculus
gcatacatgcctagcaccgaggtga

SEQ ID NO: 339461 - DNA, 25 bp, Mus musculus
accagcagacaagggtgagaacagc

SEQ ID NO: 339462 - DNA, 25 bp, Mus musculus
agcctgtctaaagcggggcttctac

SEQ ID NO: 339463 - DNA, 25 bp, Mus musculus
aagcggggcttctaccggagaatgc

SEQ ID NO: 339464 - DNA, 25 bp, Mus musculus
tcaggaagcctgtctaaagcggggc

SEQ ID NO: 339465 - DNA, 25 bp, Mus musculus
ggagagaaacttcaggaagcctgtc

SEQ ID NO: 339466 - DNA, 25 bp, Mus musculus
tgagaacagcgaccgaatggccaga

SEQ ID NO: 339467 - DNA, 25 bp, Mus musculus
aaggagcgacagaagcatgacacca

SEQ ID NO: 339468 - DNA, 25 bp, Mus musculus
ggcgcctcagactcccggatctggc

SEQ ID NO: 339469 - DNA, 25 bp, Mus musculus
caggatcgcagttgggagacagaca

SEQ ID NO: 339470 - DNA, 25 bp, Mus musculus
tcgtggacgcctttcccaggacacg

SEQ ID NO: 339471 - DNA, 25 bp, Mus musculus
ccctggaccgggtctctcgtggacg

SEQ ID NO: 339472 - DNA, 25 bp, Mus musculus
taggccacctcctggaggggcgcaa

SEQ ID NO: 339473 - DNA, 25 bp, Mus musculus
cggatctggccagctaggccacctc

SEQ ID NO: 339474 - DNA, 25 bp, Mus musculus
cagcgaccgaatggccagatgtgga

SEQ ID NO: 339475 - DNA, 25 bp, Mus musculus
ttccaacccagagaagcctagcagg

SEQ ID NO: 339476 - DNA, 25 bp, Mus musculus
accaccggaatgactggcgccatca

SEQ ID NO: 339477 - DNA, 25 bp, Mus musculus
ttgcagacactgttcgcgctactcg

SEQ ID NO: 339478 - DNA, 25 bp, Mus musculus
agacccaggccgaagctctttagtg

SEQ ID NO: 339479 - DNA, 25 bp, Mus musculus
ggcgccatcagctaccatccatatg

SEQ ID NO: 339480 - DNA, 25 bp, Mus musculus
cactcacaggctgttgtgggttcca

SEQ ID NO: 339481 - DNA, 25 bp, Mus musculus
gcgctactcgggaaactatgtcgtt

SEQ ID NO: 339482 - DNA, 25 bp, Mus musculus
ctacttgctgtagtgcgggactatc

SEQ ID NO: 339483 - DNA, 25 bp, Mus musculus
attggaaacgctgactggcttctga

SEQ ID NO: 339484 - DNA, 25 bp, Mus musculus
ccgggatctgtctgagcatctctga

SEQ ID NO: 339485 - DNA, 25 bp, Mus musculus
tccagctccgtagatccgggatctg

SEQ ID NO: 339486 - DNA, 25 bp, Mus musculus
tcgtagtaggcctatgggttccagc

SEQ ID NO: 339487 - DNA, 25 bp, Mus musculus
tcgctgacccggctttcagggaaaa

SEQ ID NO: 339488 - DNA, 25 bp, Mus musculus
agtgcggcctatccataccagctca

SEQ ID NO: 339489 - DNA, 25 bp, Mus musculus
cttgcgagggatagaacagcttgtg

SEQ ID NO: 339490 - DNA, 25 bp, Mus musculus
ccgggtgggagcaactcgctcgctc

SEQ ID NO: 339491 - DNA, 25 bp, Mus musculus
gctccgcctggaaatgtctccatta

SEQ ID NO: 339492 - DNA, 25 bp, Mus musculus
gtctccattagttgtcgcttgctcc

SEQ ID NO: 339493 - DNA, 25 bp, Mus musculus
gccggctctttcctggcgcaggtaa

SEQ ID NO: 339494 - DNA, 25 bp, Mus musculus
tgctcaaactttgcgaggatcgctc

SEQ ID NO: 339495 - DNA, 25 bp, Mus musculus
actttgcgaggatcgctcttgcgcc

SEQ ID NO: 339496 - DNA, 25 bp, Mus musculus
ctcttgcgccggaggggacaaagtt

SEQ ID NO: 339497 - DNA, 25 bp, Mus musculus
ggacaaagtttgcttctagcggata

SEQ ID NO: 339498 - DNA, 25 bp, Mus musculus
ctttggaggtcgctgcatttgatgc

SEQ ID NO: 339499 - DNA, 25 bp, Mus musculus
tgctctccaggtgctccgcctggaa

SEQ ID NO: 339500 - DNA, 25 bp, Mus musculus
cccggcatccgggtacgggatgctc

SEQ ID NO: 339501 - DNA, 25 bp, Mus musculus
tagaacagcttgtgctgttggaccc

SEQ ID NO: 339502 - DNA, 25 bp, Mus musculus
ttgatgcaagtttttggtaagcgga

SEQ ID NO: 339503 - DNA, 25 bp, Mus musculus
cgcaggtctgaacccaggaatcttt

SEQ ID NO: 339504 - DNA, 25 bp, Mus musculus
tggtacaccaaactccgcgcacaga

SEQ ID NO: 339505 - DNA, 25 bp, Mus musculus
ccaggctctgggaagatcgcggcat

SEQ ID NO: 339506 - DNA, 25 bp, Mus musculus
atctttaggagcaagtctgcacagc

SEQ ID NO: 339507 - DNA, 25 bp, Mus musculus
agggcgcgaacgtcatcattaatta

SEQ ID NO: 339508 - DNA, 25 bp, Mus musculus
tcgtttctgggaggcagccttgcag

SEQ ID NO: 339509 - DNA, 25 bp, Mus musculus
tcagggccggcagatttcgtttctg

SEQ ID NO: 339510 - DNA, 25 bp, Mus musculus
tcactttcaaccaagctgtcagggc

SEQ ID NO: 339511 - DNA, 25 bp, Mus musculus
tgcggtctccagatagtcatccatc

SEQ ID NO: 339512 - DNA, 25 bp, Mus musculus
ttatatgatgtgtactgcggtctcc

SEQ ID NO: 339513 - DNA, 25 bp, Mus musculus
cggagaactcgtattttcatctgta

SEQ ID NO: 339514 - DNA, 25 bp, Mus musculus
ccagcgcgatcggagaactcgtatt

SEQ ID NO: 339515 - DNA, 25 bp, Mus musculus
cgcggcatgaaagccctgagaattc

SEQ ID NO: 339516 - DNA, 25 bp, Mus musculus
acagctccgcgatgagcggctctgc

SEQ ID NO: 339517 - DNA, 25 bp, Mus musculus
cccagttcaggcctctctcgatttt

SEQ ID NO: 339518 - DNA, 25 bp, Mus musculus
accggcctgggaaagccgcgtgaat

SEQ ID NO: 339519 - DNA, 25 bp, Mus musculus
ttccaagctgcctacctcttgcagg

SEQ ID NO: 339520 - DNA, 25 bp, Mus musculus
aggcctctctcgattttccgttcca

SEQ ID NO: 339521 - DNA, 25 bp, Mus musculus
cttctctgcgccctggcgaaaggtg

SEQ ID NO: 339522 - DNA, 25 bp, Mus musculus
gactagtcgcgtgagccttctctgc

SEQ ID NO: 339523 - DNA, 25 bp, Mus musculus
cgaggccctgcgttggactagtcgc

SEQ ID NO: 339524 - DNA, 25 bp, Mus musculus
gctggtacagaacctggcgtccctc

SEQ ID NO: 339525 - DNA, 25 bp, Mus musculus
ttgtgcccgctgctctgctggtaca

SEQ ID NO: 339526 - DNA, 25 bp, Mus musculus
ttgagaccatcgtaggacaccaggg

SEQ ID NO: 339527 - DNA, 25 bp, Mus musculus
acccgcacgcgctggttgagaccat

SEQ ID NO: 339528 - DNA, 25 bp, Mus musculus
tgcaggggatcagcgctttcctctc

SEQ ID NO: 339529 - DNA, 25 bp, Mus musculus
tgcctacctcttgcaggggatcagc

SEQ ID NO: 339530 - DNA, 25 bp, Mus musculus
ttccgttccacaggctcctggcttg

SEQ ID NO: 339531 - DNA, 25 bp, Mus musculus
aggagtgatcccagcatcggcaagc

SEQ ID NO: 339532 - DNA, 25 bp, Mus musculus
ccgcgcctgcacgaactgaggtttt

SEQ ID NO: 339533 - DNA, 25 bp, Mus musculus
cttccgcctaggaaaagactgtcta

SEQ ID NO: 339534 - DNA, 25 bp, Mus musculus
taggcaactccaatcccgcgacaga

SEQ ID NO: 339535 - DNA, 25 bp, Mus musculus
cggcccagtgtttcctaggcaactc

SEQ ID NO: 339536 - DNA, 25 bp, Mus musculus
acactcttcgaagtaggcgggctcc

SEQ ID NO: 339537 - DNA, 25 bp, Mus musculus
tactgctcctacatgggccacttcg

SEQ ID NO: 339538 - DNA, 25 bp, Mus musculus
ttcgccattgccgagaacgagagca

SEQ ID NO: 339539 - DNA, 25 bp, Mus musculus
cctgcatctcgaccattccgtgttg

SEQ ID NO: 339540 - DNA, 25 bp, Mus musculus
gtccgctccttgtgaactgtgcaga

SEQ ID NO: 339541 - DNA, 25 bp, Mus musculus
cggcagcttctcgtctgtgtcctga

SEQ ID NO: 339542 - DNA, 25 bp, Mus musculus
actgcacgagagtgatgcgcatttc

SEQ ID NO: 339543 - DNA, 25 bp, Mus musculus
actgtctactcctgcgtctcggtgg

SEQ ID NO: 339544 - DNA, 25 bp, Mus musculus
agcggcagcgtctctcacttgaacg

SEQ ID NO: 339545 - DNA, 25 bp, Mus musculus
ctgaggccaggccaagccacagagt

SEQ ID NO: 339546 - DNA, 25 bp, Mus musculus
tgacctgtctgaggccaggccaagc

SEQ ID NO: 339547 - DNA, 25 bp, Mus musculus
tgggctgacgtcaacgcttctgtcg

SEQ ID NO: 339548 - DNA, 25 bp, Mus musculus
cgtgactaaggagaaacaccgttcg

SEQ ID NO: 339549 - DNA, 25 bp, Mus musculus
aacaccgttcgtcggggcgatattg

SEQ ID NO: 339550 - DNA, 25 bp, Mus musculus
gggcgatattgactccttggatgga

SEQ ID NO: 339551 - DNA, 25 bp, Mus musculus
ccttggatggagttcatttgttaaa

SEQ ID NO: 339552 - DNA, 25 bp, Mus musculus
ttgttaaagctcgatggccctcagc

SEQ ID NO: 339553 - DNA, 25 bp, Mus musculus
tcagccctgctatcgcagacatgga

SEQ ID NO: 339554 - DNA, 25 bp, Mus musculus
gccagcatccctgtgacctgtctga

SEQ ID NO: 339555 - DNA, 25 bp, Mus musculus
cgtcctccgtgactaaggagaaaca

SEQ ID NO: 339556 - DNA, 25 bp, Mus musculus
caagccacagagtgggctgacgtca

SEQ ID NO: 339557 - DNA, 25 bp, Mus musculus
caacgcttctgtcgcttaaagccgc

SEQ ID NO: 339558 - DNA, 25 bp, Mus musculus
tcgcagacatggatcgtctgtgccc

SEQ ID NO: 339559 - DNA, 25 bp, Mus musculus
gcttgcgaagccaaactgacctttg

SEQ ID NO: 339560 - DNA, 25 bp, Mus musculus
gcacagtggtcgttcctgactctgg

SEQ ID NO: 339561 - DNA, 25 bp, Mus musculus
cgttcctgactctggcgccgagggc

SEQ ID NO: 339562 - DNA, 25 bp, Mus musculus
agggcggcccacctgcttgcgaagc

SEQ ID NO: 339563 - DNA, 25 bp, Mus musculus
ctgaaacgccaaggtccaacgggtg

SEQ ID NO: 339564 - DNA, 25 bp, Mus musculus
ctgacctttgctcaggcgggagcgc

SEQ ID NO: 339565 - DNA, 25 bp, Mus musculus
agcgccgccgaacctggagaccaag

SEQ ID NO: 339566 - DNA, 25 bp, Mus musculus
cccgcatctggtccttggcacacac

SEQ ID NO: 339567 - DNA, 25 bp, Mus musculus
ggtccaacgggtgtatctgcgacga

SEQ ID NO: 339568 - DNA, 25 bp, Mus musculus
gctgcagccacagctctgagccaga

SEQ ID NO: 339569 - DNA, 25 bp, Mus musculus
cagctctgagccagactgagtttcc

SEQ ID NO: 339570 - DNA, 25 bp, Mus musculus
gactgagtttccctcctgcatgctg

SEQ ID NO: 339571 - DNA, 25 bp, Mus musculus
ctgcatgctgaaacgccaaggtcca

SEQ ID NO: 339572 - DNA, 25 bp, Mus musculus
acgggtgtatctgcgacgacgccag

SEQ ID NO: 339573 - DNA, 25 bp, Mus musculus
cacaccgagaggagaggctaaatta

SEQ ID NO: 339574 - DNA, 25 bp, Mus musculus
cggccggcccagtctaagataattc

SEQ ID NO: 339575 - DNA, 25 bp, Mus musculus
aacaggcgcgggaaatatacggctc

SEQ ID NO: 339576 - DNA, 25 bp, Mus musculus
cgctcagtcgctcaggcgtggcgat

SEQ ID NO: 339577 - DNA, 25 bp, Mus musculus
tcagactcgacaagggaacaggcgc

SEQ ID NO: 339578 - DNA, 25 bp, Mus musculus
gacagcagcatattcagactcgaca

SEQ ID NO: 339579 - DNA, 25 bp, Mus musculus
ttcattaagcgagtctgacagcagc

SEQ ID NO: 339580 - DNA, 25 bp, Mus musculus
atcagcggcgcgttacttttcatta

SEQ ID NO: 339581 - DNA, 25 bp, Mus musculus
ggcgctctttacatagagccaaata

SEQ ID NO: 339582 - DNA, 25 bp, Mus musculus
cgtggcgatcgcaaacacaccgaga

SEQ ID NO: 339583 - DNA, 25 bp, Mus musculus
tccattaacaacacgtagccgcagg

SEQ ID NO: 339584 - DNA, 25 bp, Mus musculus
gagccaaataaaactgtaatcagcg

SEQ ID NO: 339585 - DNA, 25 bp, Mus musculus
gccgcaggaaactggctccgaaaac

SEQ ID NO: 339586 - DNA, 25 bp, Mus musculus
gaggctaaattaacggcgctcttta

SEQ ID NO: 339587 - DNA, 25 bp, Mus musculus
ttttcgtcctatgcctgagcggctg

SEQ ID NO: 339588 - DNA, 25 bp, Mus musculus
gcgcgctagcctggcagaagcacac

SEQ ID NO: 339589 - DNA, 25 bp, Mus musculus
gcctggcagaagcacaccttgctgc

SEQ ID NO: 339590 - DNA, 25 bp, Mus musculus
ctccctgctaccgtcagtcttgggt

SEQ ID NO: 339591 - DNA, 25 bp, Mus musculus
taccgtcagtcttgggttccaggca

SEQ ID NO: 339592 - DNA, 25 bp, Mus musculus
gtcagtcttgggttccaggcatggc

SEQ ID NO: 339593 - DNA, 25 bp, Mus musculus
cgcggccgttacctggccggtatgc

SEQ ID NO: 339594 - DNA, 25 bp, Mus musculus
tggccggtatgcgtgatcttttccc

SEQ ID NO: 339595 - DNA, 25 bp, Mus musculus
tgcagccctggggagagtcaacagc

SEQ ID NO: 339596 - DNA, 25 bp, Mus musculus
gccatcttgccggtgacccttgacc

SEQ ID NO: 339597 - DNA, 25 bp, Mus musculus
acgcgtcgtaccaagtgccggcgca

SEQ ID NO: 339598 - DNA, 25 bp, Mus musculus
tgtggaacttttttcgtcctatgcc

SEQ ID NO: 339599 - DNA, 25 bp, Mus musculus
ataggatgcggagctgcggcttaac

SEQ ID NO: 339600 - DNA, 25 bp, Mus musculus
caagtgccggcgcaggcgcacagca

SEQ ID NO: 339601 - DNA, 25 bp, Mus musculus
ggtggacccgttcctgcacctgagt

SEQ ID NO: 339602 - DNA, 25 bp, Mus musculus
caaaccctgcgcagaggtgcgctca

SEQ ID NO: 339603 - DNA, 25 bp, Mus musculus
tggggacattgccacgcgccaaacc

SEQ ID NO: 339604 - DNA, 25 bp, Mus musculus
cacctgagtcgcctcgcggtgaagc

SEQ ID NO: 339605 - DNA, 25 bp, Mus musculus
catggccgcactgcttgtacggagc

SEQ ID NO: 339606 - DNA, 25 bp, Mus musculus
gcacaggatgaccacgcttctcttc

SEQ ID NO: 339607 - DNA, 25 bp, Mus musculus
atgtgtgctctgacctctgatgcca

SEQ ID NO: 339608 - DNA, 25 bp, Mus musculus
cagagtgcaaccctggcatgtgtgc

SEQ ID NO: 339609 - DNA, 25 bp, Mus musculus
gtgagcctccggaatctgcggcttc

SEQ ID NO: 339610 - DNA, 25 bp, Mus musculus
cggcgcccgaagttgattaaggact

SEQ ID NO: 339611 - DNA, 25 bp, Mus musculus
gaagcttcgctaaccggcgcccgaa

SEQ ID NO: 339612 - DNA, 25 bp, Mus musculus
ctccactgcgcagacgcggaagctt

SEQ ID NO: 339613 - DNA, 25 bp, Mus musculus
gctcagttctctgtggccgtccctt

SEQ ID NO: 339614 - DNA, 25 bp, Mus musculus
tctcctcgttcctgctggggacatt

SEQ ID NO: 339615 - DNA, 25 bp, Mus musculus
tctatccaggatgcgctcgggatgc

SEQ ID NO: 339616 - DNA, 25 bp, Mus musculus
gcgctgctgtactctatccaggatg

SEQ ID NO: 339617 - DNA, 25 bp, Mus musculus
cgcgcaggcgcattcatagcccaga

SEQ ID NO: 339618 - DNA, 25 bp, Mus musculus
gggttctccgcagcgctgctgtact

SEQ ID NO: 339619 - DNA, 25 bp, Mus musculus
agcactcttccaacccgcgccaggg

SEQ ID NO: 339620 - DNA, 25 bp, Mus musculus
tgcagaaggcccaggtgggttctcc

SEQ ID NO: 339621 - DNA, 25 bp, Mus musculus
agctgcgactgagcgccctgcagaa

SEQ ID NO: 339622 - DNA, 25 bp, Mus musculus
cccttcgtgcacgagctgcgactga

SEQ ID NO: 339623 - DNA, 25 bp, Mus musculus
tgctctactccttgctcaggcgcgg

SEQ ID NO: 339624 - DNA, 25 bp, Mus musculus
ggtcggctgagctccatctgctcta

SEQ ID NO: 339625 - DNA, 25 bp, Mus musculus
ttcagctgagctcggtcggctgagc

SEQ ID NO: 339626 - DNA, 25 bp, Mus musculus
tgcttggctcggttcagctgagctc

SEQ ID NO: 339627 - DNA, 25 bp, Mus musculus
tgctgctctcggctcttctgtgctt

SEQ ID NO: 339628 - DNA, 25 bp, Mus musculus
gcattcatagcccagagcggtctgg

SEQ ID NO: 339629 - DNA, 25 bp, Mus musculus
caagaaccgggtgccgccaaggttg

SEQ ID NO: 339630 - DNA, 25 bp, Mus musculus
agtacggcgcaagaggctgacgtca

SEQ ID NO: 339631 - DNA, 25 bp, Mus musculus
acgtggtgcatacctgctgggtcat

SEQ ID NO: 339632 - DNA, 25 bp, Mus musculus
gctgggtcatgtacggtatcgtcta

SEQ ID NO: 339633 - DNA, 25 bp, Mus musculus
gtatcgtctatacccgtccgtgctc

SEQ ID NO: 339634 - DNA, 25 bp, Mus musculus
ctcgggtgactccaactgcatccag

SEQ ID NO: 339635 - DNA, 25 bp, Mus musculus
tgcggcccaaactgcaggtgagcgt

SEQ ID NO: 339636 - DNA, 25 bp, Mus musculus
tccgggagccctaagaaggcgcctc

SEQ ID NO: 339637 - DNA, 25 bp, Mus musculus
gttcctggtgtacgtggtgcatacc

SEQ ID NO: 339638 - DNA, 25 bp, Mus musculus
ctgggctcccacaggcatgccggga

SEQ ID NO: 339639 - DNA, 25 bp, Mus musculus
cggtggccggcaaatccggccaatc

SEQ ID NO: 339640 - DNA, 25 bp, Mus musculus
gccagctgctcggttcccggaagcg

SEQ ID NO: 339641 - DNA, 25 bp, Mus musculus
cggccgcagctcttttaccagcttg

SEQ ID NO: 339642 - DNA, 25 bp, Mus musculus
tgcacagggccttaagaagagcaac

SEQ ID NO: 339643 - DNA, 25 bp, Mus musculus
ttttcgtcgtggactctcagtggcc

SEQ ID NO: 339644 - DNA, 25 bp, Mus musculus
tgcatcttggttcccgcacgtggga

SEQ ID NO: 339645 - DNA, 25 bp, Mus musculus
tggactctcagtggcctgggtcctg

SEQ ID NO: 339646 - DNA, 25 bp, Mus musculus
ccagcctcatctttttcgtcgtgga

SEQ ID NO: 339647 - DNA, 25 bp, Mus musculus
cgctacaacgcttggtccgcctgaa

SEQ ID NO: 339648 - DNA, 25 bp, Mus musculus
cctgggtcctggctgttttctaagc

SEQ ID NO: 339649 - DNA, 25 bp, Mus musculus
tggctgttttctaagcacacccttg

SEQ ID NO: 339650 - DNA, 25 bp, Mus musculus
taagcacacccttgcatcttggttc

SEQ ID NO: 339651 - DNA, 25 bp, Mus musculus
tgcgctctctgctgcgcagccgata

SEQ ID NO: 339652 - DNA, 25 bp, Mus musculus
ctctgctgcgcagccgataccggga

SEQ ID NO: 339653 - DNA, 25 bp, Mus musculus
aggtgtggccgctggcaacctttgt

SEQ ID NO: 339654 - DNA, 25 bp, Mus musculus
cgctggcaacctttgtgcggcgcct

SEQ ID NO: 339655 - DNA, 25 bp, Mus musculus
tacaacgcttggtccgcctgaatcc

SEQ ID NO: 339656 - DNA, 25 bp, Mus musculus
cccatcccggccttgagcacaatga

SEQ ID NO: 339657 - DNA, 25 bp, Mus musculus
caagaagtagatgcgctgcccattc

SEQ ID NO: 339658 - DNA, 25 bp, Mus musculus
aaggcggcaaccagcgcctgtgctc

SEQ ID NO: 339659 - DNA, 25 bp, Mus musculus
gaaccagggcagaaggcggcaacca

SEQ ID NO: 339660 - DNA, 25 bp, Mus musculus
cccagcacaaagcgggacaggggac

SEQ ID NO: 339661 - DNA, 25 bp, Mus musculus
atgtcccagcgcttcgtggtgaccc

SEQ ID NO: 339662 - DNA, 25 bp, Mus musculus
gcttggcggccgctctgaaaataca

SEQ ID NO: 339663 - DNA, 25 bp, Mus musculus
ggccgctctgaaaatacaagaagta

SEQ ID NO: 339664 - DNA, 25 bp, Mus musculus
atgcgctgcccattctgcgctactg

SEQ ID NO: 339665 - DNA, 25 bp, Mus musculus
ggtcagcaccggcagtcttcgcatc

SEQ ID NO: 339666 - DNA, 25 bp, Mus musculus
cggcagtcttcgcatccagcagtca

SEQ ID NO: 339667 - DNA, 25 bp, Mus musculus
gccaacatgtcccagcgcttcgtgg

SEQ ID NO: 339668 - DNA, 25 bp, Mus musculus
gcctggcgttccgacgccaacatgt

SEQ ID NO: 339669 - DNA, 25 bp, Mus musculus
accagcgcctgtgctcggattccga

SEQ ID NO: 339670 - DNA, 25 bp, Mus musculus
atccagcagtcatcgcggcgcctgg

SEQ ID NO: 339671 - DNA, 25 bp, Mus musculus
ggaagaacccgagtctcccgagagc

SEQ ID NO: 339672 - DNA, 25 bp, Mus musculus
ctgagcgcacggaagaacccgagtc

SEQ ID NO: 339673 - DNA, 25 bp, Mus musculus
tgggcccttctgctgccgctgggcc

SEQ ID NO: 339674 - DNA, 25 bp, Mus musculus
cgagtctcccgagagcgtggatcaa

SEQ ID NO: 339675 - DNA, 25 bp, Mus musculus
cgaagctgctgagcgcacggaagaa

SEQ ID NO: 339676 - DNA, 25 bp, Mus musculus
tgcccacgaactttacggtggtgcc

SEQ ID NO: 339677 - DNA, 25 bp, Mus musculus
ggagccatgcccacgaactttacgg

SEQ ID NO: 339678 - DNA, 25 bp, Mus musculus
agagtctaacggagccatgcccacg

SEQ ID NO: 339679 - DNA, 25 bp, Mus musculus
gacagcagagtctaacggagccatg

SEQ ID NO: 339680 - DNA, 25 bp, Mus musculus
gacaaaggcagaggctgggcccttc

SEQ ID NO: 339681 - DNA, 25 bp, Mus musculus
gcttggccgcacctgcaacgggaca

SEQ ID NO: 339682 - DNA, 25 bp, Mus musculus
cctacgccgggtgagcttggccgca

SEQ ID NO: 339683 - DNA, 25 bp, Mus musculus
taacggagccatgcccacgaacttt

SEQ ID NO: 339684 - DNA, 25 bp, Mus musculus
tcccgagagcgtggatcaaacctcc

SEQ ID NO: 339685 - DNA, 25 bp, Mus musculus
cggtggccgcactaggacaaaataa

SEQ ID NO: 339686 - DNA, 25 bp, Mus musculus
cctggaatccgcctaggaatttggc

SEQ ID NO: 339687 - DNA, 25 bp, Mus musculus
cagcgacgggaccaatcctggaatc

SEQ ID NO: 339688 - DNA, 25 bp, Mus musculus
tttccatggtgacgagacagcgacg

SEQ ID NO: 339689 - DNA, 25 bp, Mus musculus
gaaagctttagggtccgcaggctga

SEQ ID NO: 339690 - DNA, 25 bp, Mus musculus
acctgtaggcaactggaaagcttta

SEQ ID NO: 339691 - DNA, 25 bp, Mus musculus
tcgccttggcgatgactttaggagg

SEQ ID NO: 339692 - DNA, 25 bp, Mus musculus
gactttttggcaacctgcgtgggac

SEQ ID NO: 339693 - DNA, 25 bp, Mus musculus
agcagcagtggcagaagtaccgtcc

SEQ ID NO: 339694 - DNA, 25 bp, Mus musculus
taagtatttccggaagccagagacc

SEQ ID NO: 339695 - DNA, 25 bp, Mus musculus
cggagcctagtctccttagtaaccg

SEQ ID NO: 339696 - DNA, 25 bp, Mus musculus
cacgcttgaagagtgcggaagtcca

SEQ ID NO: 339697 - DNA, 25 bp, Mus musculus
gcggcacgatctctaccgagcagca

SEQ ID NO: 339698 - DNA, 25 bp, Mus musculus
gcccgggatgtctctttggcaacct

SEQ ID NO: 339699 - DNA, 25 bp, Mus musculus
gggagccggctttgctctcgccgct

SEQ ID NO: 339700 - DNA, 25 bp, Mus musculus
gggttccacaatggccgtggcccgc

SEQ ID NO: 339701 - DNA, 25 bp, Mus musculus
ctgcgctccgagctgcgggactcga

SEQ ID NO: 339702 - DNA, 25 bp, Mus musculus
ctgcgggactcgagactggagcttc

SEQ ID NO: 339703 - DNA, 25 bp, Mus musculus
cggccgagatgatgtcatcgcttct

SEQ ID NO: 339704 - DNA, 25 bp, Mus musculus
cgcgtctggataaatagggttccac

SEQ ID NO: 339705 - DNA, 25 bp, Mus musculus
tcaggggacgcgtctggataaatag

SEQ ID NO: 339706 - DNA, 25 bp, Mus musculus
cccacgtcaggggacgcgtctggat

SEQ ID NO: 339707 - DNA, 25 bp, Mus musculus
atgatgtcatcgcttctgcaggaga

SEQ ID NO: 339708 - DNA, 25 bp, Mus musculus
tctcgccgctgccaaggctgctgag

SEQ ID NO: 339709 - DNA, 25 bp, Mus musculus
tcatcgcttctgcaggagaggctgg

SEQ ID NO: 339710 - DNA, 25 bp, Mus musculus
gtcgttgctctggaggctgagtgct

SEQ ID NO: 339711 - DNA, 25 bp, Mus musculus
taaatagggttccacaatggccgtg

SEQ ID NO: 339712 - DNA, 25 bp, Mus musculus
ccaaggctgctgagcccacgtcagg

SEQ ID NO: 339713 - DNA, 25 bp, Mus musculus
gtacgcaggcaccacgaagctgtcc

SEQ ID NO: 339714 - DNA, 25 bp, Mus musculus
tttaacaggggttctcgcagcgccc

SEQ ID NO: 339715 - DNA, 25 bp, Mus musculus
ggcttggcccggcaaccggagacac

SEQ ID NO: 339716 - DNA, 25 bp, Mus musculus
agagcaactcgtggagcctggatcc

SEQ ID NO: 339717 - DNA, 25 bp, Mus musculus
tgcgtgaatcccgagctgagagcaa

SEQ ID NO: 339718 - DNA, 25 bp, Mus musculus
gctcctcaccgtgcttggactgaaa

SEQ ID NO: 339719 - DNA, 25 bp, Mus musculus
ccaagcttggagctctgcgcatccg

SEQ ID NO: 339720 - DNA, 25 bp, Mus musculus
tgtcccaatcgagggcgcgaggcaa

SEQ ID NO: 339721 - DNA, 25 bp, Mus musculus
ccggagacccaaggcgtgtcccaat

SEQ ID NO: 339722 - DNA, 25 bp, Mus musculus
cgtaacctacctgcttgtcccgtga

SEQ ID NO: 339723 - DNA, 25 bp, Mus musculus
gcgcgggaaacaaggcacccacgga

SEQ ID NO: 339724 - DNA, 25 bp, Mus musculus
tgtcccgtgagcgatgttccacacc

SEQ ID NO: 339725 - DNA, 25 bp, Mus musculus
gaccgtagcgcagtggaccttagcg

SEQ ID NO: 339726 - DNA, 25 bp, Mus musculus
accgtgagcttcgtggagtgcgctt

SEQ ID NO: 339727 - DNA, 25 bp, Mus musculus
ccgcgtggtcggactccgtatatac

SEQ ID NO: 339728 - DNA, 25 bp, Mus musculus
ctgtgcgacagccttctccgatgta

SEQ ID NO: 339729 - DNA, 25 bp, Mus musculus
acctccacatggaccgcgggcgatt

SEQ ID NO: 339730 - DNA, 25 bp, Mus musculus
tcgtcctacgaaggtgcggatccca

SEQ ID NO: 339731 - DNA, 25 bp, Mus musculus
acaaggcggaatggcgctcgtccta

SEQ ID NO: 339732 - DNA, 25 bp, Mus musculus
tcagccatgggcaaaaagcacaaga

SEQ ID NO: 339733 - DNA, 25 bp, Mus musculus
ggatcccgtgctatctcagccatgg

SEQ ID NO: 339734 - DNA, 25 bp, Mus musculus
gctacttccgactggcgcaggtcga

SEQ ID NO: 339735 - DNA, 25 bp, Mus musculus
ctccgatgtaggaggatccaccttg

SEQ ID NO: 339736 - DNA, 25 bp, Mus musculus
gaagcgcttgcttcaggtcgcccac

SEQ ID NO: 339737 - DNA, 25 bp, Mus musculus
attcggcaacacagggaagcgcttg

SEQ ID NO: 339738 - DNA, 25 bp, Mus musculus
gtatatacgctcaccttccgctgcg

SEQ ID NO: 339739 - DNA, 25 bp, Mus musculus
taaggtcgtgccactcggagtcacg

SEQ ID NO: 339740 - DNA, 25 bp, Mus musculus
atccaccttggctaagggccggcca

SEQ ID NO: 339741 - DNA, 25 bp, Mus musculus
accgcccggagctgtgcataccgga

SEQ ID NO: 339742 - DNA, 25 bp, Mus musculus
ctctgcagtggctagatcaggtcta

SEQ ID NO: 339743 - DNA, 25 bp, Mus musculus
tgaagcaactagttcctttgagatc

SEQ ID NO: 339744 - DNA, 25 bp, Mus musculus
ggtatgcgtttacactgagccaggc

SEQ ID NO: 339745 - DNA, 25 bp, Mus musculus
ggcgcattgcgtcggcacttgatac

SEQ ID NO: 339746 - DNA, 25 bp, Mus musculus
ttcatgggtccagaatcctgagcgc

SEQ ID NO: 339747 - DNA, 25 bp, Mus musculus
tcgagcctgcatctctcattcgaga

SEQ ID NO: 339748 - DNA, 25 bp, Mus musculus
tgtcagggtcgcatgttgaatgccc

SEQ ID NO: 339749 - DNA, 25 bp, Mus musculus
tgaatgcccacgtttgcgcgaagga

SEQ ID NO: 339750 - DNA, 25 bp, Mus musculus
tgctcggcggtttcggttatgtaaa

SEQ ID NO: 339751 - DNA, 25 bp, Mus musculus
agtaccctttgtggcgcagctttgg

SEQ ID NO: 339752 - DNA, 25 bp, Mus musculus
ggcccagagcccacttgcgtatctg

SEQ ID NO: 339753 - DNA, 25 bp, Mus musculus
tggccacctgtcactctctgcagtg

SEQ ID NO: 339754 - DNA, 25 bp, Mus musculus
ggtgacagcgccagttctctatgtc

SEQ ID NO: 339755 - DNA, 25 bp, Mus musculus
accaagcctgcaaggggcgggccca

SEQ ID NO: 339756 - DNA, 25 bp, Mus musculus
cctgcgctgtgacgtgatctggaac

SEQ ID NO: 339757 - DNA, 25 bp, Mus musculus
gttttcaaaccggacgctggcgcgc

SEQ ID NO: 339758 - DNA, 25 bp, Mus musculus
tcccacagaaaacccaggccgcgtc

SEQ ID NO: 339759 - DNA, 25 bp, Mus musculus
cgtttgtggtcaagtgccattcgca

SEQ ID NO: 339760 - DNA, 25 bp, Mus musculus
cacgggccgagaccgtttgtggtca

SEQ ID NO: 339761 - DNA, 25 bp, Mus musculus
tccaggaccttagccacgcccttcc

SEQ ID NO: 339762 - DNA, 25 bp, Mus musculus
tcttcacacaaaaccaaccgctggc

SEQ ID NO: 339763 - DNA, 25 bp, Mus musculus
gctctcgtacagtctcttcacacaa

SEQ ID NO: 339764 - DNA, 25 bp, Mus musculus
ccggcaggccaacccagtctgtccc

SEQ ID NO: 339765 - DNA, 25 bp, Mus musculus
gcagagctatcaggcccggcaggcc

SEQ ID NO: 339766 - DNA, 25 bp, Mus musculus
cattcgcacggaggcagagctatca

SEQ ID NO: 339767 - DNA, 25 bp, Mus musculus
cgcgtccaccggctctccaggacct

SEQ ID NO: 339768 - DNA, 25 bp, Mus musculus
tggcctggcgccatgttttcaaacc

SEQ ID NO: 339769 - DNA, 25 bp, Mus musculus
accaaggtatgcgtgttggctcccg

SEQ ID NO: 339770 - DNA, 25 bp, Mus musculus
agctgagcagcagcgatgtggcacc

SEQ ID NO: 339771 - DNA, 25 bp, Mus musculus
actgccagtgggctagatgtcactc

SEQ ID NO: 339772 - DNA, 25 bp, Mus musculus
cctggggacctgactgctgccagct

SEQ ID NO: 339773 - DNA, 25 bp, Mus musculus
cgggtagaatcgacaatggtatgcc

SEQ ID NO: 339774 - DNA, 25 bp, Mus musculus
cgcagcaggtactcaccaaggtatg

SEQ ID NO: 339775 - DNA, 25 bp, Mus musculus
tccgctgggaaggaagcgactgcca

SEQ ID NO: 339776 - DNA, 25 bp, Mus musculus
atgtcactcgaccttggggaggagc

SEQ ID NO: 339777 - DNA, 25 bp, Mus musculus
agcggcctcgaatccacaggttcta

SEQ ID NO: 339778 - DNA, 25 bp, Mus musculus
tctagctgctggcttaggagcccac

SEQ ID NO: 339779 - DNA, 25 bp, Mus musculus
ttaggagcccacagcacccagagag

SEQ ID NO: 339780 - DNA, 25 bp, Mus musculus
gcttctaacgcagcaggactgtttg

SEQ ID NO: 339781 - DNA, 25 bp, Mus musculus
gactgtttgcgttcacgtgtgcgca

SEQ ID NO: 339782 - DNA, 25 bp, Mus musculus
aatggtatgccggacctcgcactgc

SEQ ID NO: 339783 - DNA, 25 bp, Mus musculus
atgctcggtcggcagctgcacgccg

SEQ ID NO: 339784 - DNA, 25 bp, Mus musculus
tctgagcgcacctcgactgtcactt

SEQ ID NO: 339785 - DNA, 25 bp, Mus musculus
gagcgcacctcgactgtcacttttg

SEQ ID NO: 339786 - DNA, 25 bp, Mus musculus
cgactgtcacttttgcctctggtga

SEQ ID NO: 339787 - DNA, 25 bp, Mus musculus
acttttgcctctggtgatcccggga

SEQ ID NO: 339788 - DNA, 25 bp, Mus musculus
cccacccagtgcacatgctcggtcg

SEQ ID NO: 339789 - DNA, 25 bp, Mus musculus
cacgccgggtacacagtaggcgctc

SEQ ID NO: 339790 - DNA, 25 bp, Mus musculus
cacagtaggcgctcattccaaaggc

SEQ ID NO: 339791 - DNA, 25 bp, Mus musculus
taggcgctcattccaaaggcctcgc

SEQ ID NO: 339792 - DNA, 25 bp, Mus musculus
gcgccgacgaccagctctgctaaaa

SEQ ID NO: 339793 - DNA, 25 bp, Mus musculus
gacgaccagctctgctaaaactcgc

SEQ ID NO: 339794 - DNA, 25 bp, Mus musculus
gctctgctaaaactcgcttctcttc

SEQ ID NO: 339795 - DNA, 25 bp, Mus musculus
tcggcagctgcacgccgggtacaca

SEQ ID NO: 339796 - DNA, 25 bp, Mus musculus
gcctctggtgatcccgggacagagc

SEQ ID NO: 339797 - DNA, 25 bp, Mus musculus
acccgcactagagggtgtcgcatcc

SEQ ID NO: 339798 - DNA, 25 bp, Mus musculus
atgggctctgggtaaccttgaaggc

SEQ ID NO: 339799 - DNA, 25 bp, Mus musculus
tgcaacgcggtcacttccgtttccg

SEQ ID NO: 339800 - DNA, 25 bp, Mus musculus
accggaagtgtgcaacgcggtcact

SEQ ID NO: 339801 - DNA, 25 bp, Mus musculus
gtcagagcagagcttcctcaccgtc

SEQ ID NO: 339802 - DNA, 25 bp, Mus musculus
ggctgtcagagcagagcttcctcac

SEQ ID NO: 339803 - DNA, 25 bp, Mus musculus
actgtgccacagtcgagggcccagc

SEQ ID NO: 339804 - DNA, 25 bp, Mus musculus
cccactaaggggtacactgtgccac

SEQ ID NO: 339805 - DNA, 25 bp, Mus musculus
agggtgtcgcatcccgccagaaacg

SEQ ID NO: 339806 - DNA, 25 bp, Mus musculus
ctcgccaaggacaaacccactaagg

SEQ ID NO: 339807 - DNA, 25 bp, Mus musculus
cccagggacccgcactagagggtgt

SEQ ID NO: 339808 - DNA, 25 bp, Mus musculus
tgggtaaccttgaaggcgctgtacg

SEQ ID NO: 339809 - DNA, 25 bp, Mus musculus
ggccgatgctgtccctcgccaagga

SEQ ID NO: 339810 - DNA, 25 bp, Mus musculus
cgccagaaacgtcggccgatgctgt

SEQ ID NO: 339811 - DNA, 25 bp, Mus musculus
actaaacgcggctaagtccagccta

SEQ ID NO: 339812 - DNA, 25 bp, Mus musculus
gaaactcctgccttgctccggtagc

SEQ ID NO: 339813 - DNA, 25 bp, Mus musculus
tcgggtccaggaaactcctgccttg

SEQ ID NO: 339814 - DNA, 25 bp, Mus musculus
gaggtcgggtccaggaaactcctgc

SEQ ID NO: 339815 - DNA, 25 bp, Mus musculus
gcacctcgaggtcgggtccaggaaa

SEQ ID NO: 339816 - DNA, 25 bp, Mus musculus
ttgttgcacctcgaggtcgggtcca

SEQ ID NO: 339817 - DNA, 25 bp, Mus musculus
ttttggattgttgcacctcgaggtc

SEQ ID NO: 339818 - DNA, 25 bp, Mus musculus
tcacgcgatggctgcgattgcgtgc

SEQ ID NO: 339819 - DNA, 25 bp, Mus musculus
gcctccggcttcctcctgcggccac

SEQ ID NO: 339820 - DNA, 25 bp, Mus musculus
catcgcgtgcctggcgcctccggct

SEQ ID NO: 339821 - DNA, 25 bp, Mus musculus
aagctgagcttctgggactccgcca

SEQ ID NO: 339822 - DNA, 25 bp, Mus musculus
cctaagctgagcttctgggactccg

SEQ ID NO: 339823 - DNA, 25 bp, Mus musculus
aagtccagcctaagctgagcttctg

SEQ ID NO: 339824 - DNA, 25 bp, Mus musculus
cgcggctaagtccagcctaagctga

SEQ ID NO: 339825 - DNA, 25 bp, Mus musculus
agctctctcatctctgggacctggc

SEQ ID NO: 339826 - DNA, 25 bp, Mus musculus
ggcgcacgcacatccttgtccctgc

SEQ ID NO: 339827 - DNA, 25 bp, Mus musculus
agagggcgcacgcacatccttgtcc

SEQ ID NO: 339828 - DNA, 25 bp, Mus musculus
gcagagggcgcacgcacatccttgt

SEQ ID NO: 339829 - DNA, 25 bp, Mus musculus
ccgaagcggcagacgcaagggaaaa

SEQ ID NO: 339830 - DNA, 25 bp, Mus musculus
cccgaagcggcagacgcaagggaaa

SEQ ID NO: 339831 - DNA, 25 bp, Mus musculus
cggaggccaggagctgtcagctctc

SEQ ID NO: 339832 - DNA, 25 bp, Mus musculus
tctcatctctgggacctggcctcag

SEQ ID NO: 339833 - DNA, 25 bp, Mus musculus
ggcgcagaagatcgggcgcgcccgc

SEQ ID NO: 339834 - DNA, 25 bp, Mus musculus
tgtcagctctctcatctctgggacc

SEQ ID NO: 339835 - DNA, 25 bp, Mus musculus
gctgtcagctctctcatctctggga

SEQ ID NO: 339836 - DNA, 25 bp, Mus musculus
ggagctgtcagctctctcatctctg

SEQ ID NO: 339837 - DNA, 25 bp, Mus musculus
aggccaggagctgtcagctctctca

SEQ ID NO: 339838 - DNA, 25 bp, Mus musculus
ctcagactagagaaggaaagcccca

SEQ ID NO: 339839 - DNA, 25 bp, Mus musculus
tgtggccgctgctttggggagccct

SEQ ID NO: 339840 - DNA, 25 bp, Mus musculus
cgccgtgatgggctccgaggattct

SEQ ID NO: 339841 - DNA, 25 bp, Mus musculus
atgggctccgaggattctgtgcccg

SEQ ID NO: 339842 - DNA, 25 bp, Mus musculus
ggccctgcgcctcggggacacgtcc

SEQ ID NO: 339843 - DNA, 25 bp, Mus musculus
cagtgggatccgtgggcgccgtgat

SEQ ID NO: 339844 - DNA, 25 bp, Mus musculus
agccctggtctggacagtgggatcc

SEQ ID NO: 339845 - DNA, 25 bp, Mus musculus
tcgccatgcgttctggggcactgtg

SEQ ID NO: 339846 - DNA, 25 bp, Mus musculus
cactcgccatgcgttctggggcact

SEQ ID NO: 339847 - DNA, 25 bp, Mus musculus
aacactcgccatgcgttctggggca

SEQ ID NO: 339848 - DNA, 25 bp, Mus musculus
cccgctgctgcccaacactcgccat

SEQ ID NO: 339849 - DNA, 25 bp, Mus musculus
gaggcgtctgcactcgctgagtccc

SEQ ID NO: 339850 - DNA, 25 bp, Mus musculus
aggccgaggcgtctgcactcgctga

SEQ ID NO: 339851 - DNA, 25 bp, Mus musculus
ctcggggacacgtccgtcccgctgc

SEQ ID NO: 339852 - DNA, 25 bp, Mus musculus
ccctggtctggacagtgggatccgt

SEQ ID NO: 339853 - DNA, 25 bp, Mus musculus
ccgcatgaagtcctcggcggaaacg

SEQ ID NO: 339854 - DNA, 25 bp, Mus musculus
cctgtaacggaaagtggtgaaagct

SEQ ID NO: 339855 - DNA, 25 bp, Mus musculus
gaatgtgatgtgcaccaaccgcatg

SEQ ID NO: 339856 - DNA, 25 bp, Mus musculus
cgtctgcattagtatttagtgcgaa

SEQ ID NO: 339857 - DNA, 25 bp, Mus musculus
acggcttccctttacgtctgcatta

SEQ ID NO: 339858 - DNA, 25 bp, Mus musculus
acgcctcgacctgtaacggaaagtg

SEQ ID NO: 339859 - DNA, 25 bp, Mus musculus
ccatgaggggccgacccaagcttac

SEQ ID NO: 339860 - DNA, 25 bp, Mus musculus
tgagctcagaagagaccacgccatg

SEQ ID NO: 339861 - DNA, 25 bp, Mus musculus
ctcctgtgtgtctcagcccgaagct

SEQ ID NO: 339862 - DNA, 25 bp, Mus musculus
cttggggttagtctgagctccgcct

SEQ ID NO: 339863 - DNA, 25 bp, Mus musculus
tgccacgcaacgtctggagggcctt

SEQ ID NO: 339864 - DNA, 25 bp, Mus musculus
cggaagcgcgcacctttgagtcact

SEQ ID NO: 339865 - DNA, 25 bp, Mus musculus
acctttgagtcacttggcaggcgtg

SEQ ID NO: 339866 - DNA, 25 bp, Mus musculus
gacccaagcttacaaaacgcctcga

SEQ ID NO: 339867 - DNA, 25 bp, Mus musculus
ctctgagtcacaaggccggtagaca

SEQ ID NO: 339868 - DNA, 25 bp, Mus musculus
atgtctgtcgccctgtttctagccg

SEQ ID NO: 339869 - DNA, 25 bp, Mus musculus
ccgacgtttaatgtctgtcgccctg

SEQ ID NO: 339870 - DNA, 25 bp, Mus musculus
cctggtcatctcagaccgacgttta

SEQ ID NO: 339871 - DNA, 25 bp, Mus musculus
cccggacgatcctggtcatctcaga

SEQ ID NO: 339872 - DNA, 25 bp, Mus musculus
gcgccgttccaagttggtggtcaga

SEQ ID NO: 339873 - DNA, 25 bp, Mus musculus
ccagagatgggcatcgcgcgccgtt

SEQ ID NO: 339874 - DNA, 25 bp, Mus musculus
ctcatgggtggcctttgtcccagag

SEQ ID NO: 339875 - DNA, 25 bp, Mus musculus
cagagcaagctcatgggtggccttt

SEQ ID NO: 339876 - DNA, 25 bp, Mus musculus
tgtttcgcgccgcaaccgccaagga

SEQ ID NO: 339877 - DNA, 25 bp, Mus musculus
cggtggccatggtagcaatcaggcc

SEQ ID NO: 339878 - DNA, 25 bp, Mus musculus
caactcccagcggtggccatggtag

SEQ ID NO: 339879 - DNA, 25 bp, Mus musculus
cacgcggcggatacagaaactacaa

SEQ ID NO: 339880 - DNA, 25 bp, Mus musculus
caggagatcagcacttggggacaga

SEQ ID NO: 339881 - DNA, 25 bp, Mus musculus
cgacgtatatcttcagacctggtgt

SEQ ID NO: 339882 - DNA, 25 bp, Mus musculus
ccgacgtatatcttcagacctggtg

SEQ ID NO: 339883 - DNA, 25 bp, Mus musculus
gaccaaattcccgacgtatatcttc

SEQ ID NO: 339884 - DNA, 25 bp, Mus musculus
caaattcccgacgtatatcttcaga

SEQ ID NO: 339885 - DNA, 25 bp, Mus musculus
aattcccgacgtatatcttcagacc

SEQ ID NO: 339886 - DNA, 25 bp, Mus musculus
acgtatatcttcagacctggtgtcg

SEQ ID NO: 339887 - DNA, 25 bp, Mus musculus
tcccgacgtatatcttcagacctgg

SEQ ID NO: 339888 - DNA, 25 bp, Mus musculus
gacgtatatcttcagacctggtgtc

SEQ ID NO: 339889 - DNA, 25 bp, Mus musculus
gtatatcttcagacctggtgtcgtc

SEQ ID NO: 339890 - DNA, 25 bp, Mus musculus
tatatcttcagacctggtgtcgtcc

SEQ ID NO: 339891 - DNA, 25 bp, Mus musculus
atatcttcagacctggtgtcgtccg

SEQ ID NO: 339892 - DNA, 25 bp, Mus musculus
gagctcgggcaaaccggcggcggct

SEQ ID NO: 339893 - DNA, 25 bp, Mus musculus
ttcccgacgtatatcttcagacctg

SEQ ID NO: 339894 - DNA, 25 bp, Mus musculus
gctaacgagctcgggcaaaccggcg

SEQ ID NO: 339895 - DNA, 25 bp, Mus musculus
gccatttcgtggcactaactcaccg

SEQ ID NO: 339896 - DNA, 25 bp, Mus musculus
aagcagtcggcttcggcccactgca

SEQ ID NO: 339897 - DNA, 25 bp, Mus musculus
gcctgcgccctgtaaacgcggcggt

SEQ ID NO: 339898 - DNA, 25 bp, Mus musculus
cgcccgcgaagaagcctcgaaactg

SEQ ID NO: 339899 - DNA, 25 bp, Mus musculus
actcaggccaactcgggtggaatcg

SEQ ID NO: 339900 - DNA, 25 bp, Mus musculus
ccttcgccggaaagcagtcggcttc

SEQ ID NO: 339901 - DNA, 25 bp, Mus musculus
caagacggggaaggccagactccac

SEQ ID NO: 339902 - DNA, 25 bp, Mus musculus
ggattactcgcagacccgtccgcat

SEQ ID NO: 339903 - DNA, 25 bp, Mus musculus
agacccgtccgcatccagaatgcaa

SEQ ID NO: 339904 - DNA, 25 bp, Mus musculus
tccagaatgcaacaggccggtccct

SEQ ID NO: 339905 - DNA, 25 bp, Mus musculus
ctttaaccttggagaacttcgctag

SEQ ID NO: 339906 - DNA, 25 bp, Mus musculus
gaacttcgctagaccaagacgggga

SEQ ID NO: 339907 - DNA, 25 bp, Mus musculus
actcctagcgcctgccatttcgtgg

SEQ ID NO: 339908 - DNA, 25 bp, Mus musculus
aatcgtggcgcactcctagcgcctg

SEQ ID NO: 339909 - DNA, 25 bp, Mus musculus
tcagaattattccaccgaggtggaa

SEQ ID NO: 339910 - DNA, 25 bp, Mus musculus
gttagctcctactccggatcagcca

SEQ ID NO: 339911 - DNA, 25 bp, Mus musculus
agtctgcaccgtctcttcgcggtta

SEQ ID NO: 339912 - DNA, 25 bp, Mus musculus
gtctcttcgcggttagctcctactc

SEQ ID NO: 339913 - DNA, 25 bp, Mus musculus
agccgcctttacaagtctctccagt

SEQ ID NO: 339914 - DNA, 25 bp, Mus musculus
ggatcagccatgacctctcagattc

SEQ ID NO: 339915 - DNA, 25 bp, Mus musculus
aagctgccgtgaaccgcctggtcaa

SEQ ID NO: 339916 - DNA, 25 bp, Mus musculus
ctggtcaacttgcacctgcgggcct

SEQ ID NO: 339917 - DNA, 25 bp, Mus musculus
cgtaggccacttcttccgcgaattg

SEQ ID NO: 339918 - DNA, 25 bp, Mus musculus
tcttccgcgaattggccgaggagaa

SEQ ID NO: 339919 - DNA, 25 bp, Mus musculus
cggagcgtctcctcgagtttcagaa

SEQ ID NO: 339920 - DNA, 25 bp, Mus musculus
ctcgagtttcagaacgatcgcgggg

SEQ ID NO: 339921 - DNA, 25 bp, Mus musculus
cttcggctcctaggaccagtctgca

SEQ ID NO: 339922 - DNA, 25 bp, Mus musculus
gggattcccactgtactcgcttcca

SEQ ID NO: 339923 - DNA, 25 bp, Mus musculus
ggatcgggagcaggagtctgagcac

SEQ ID NO: 339924 - DNA, 25 bp, Mus musculus
agtcactggcaggagctgaccacga

SEQ ID NO: 339925 - DNA, 25 bp, Mus musculus
actggcaggagctgaccacgagccg

SEQ ID NO: 339926 - DNA, 25 bp, Mus musculus
cgctggctcgagtgagtcactggca

SEQ ID NO: 339927 - DNA, 25 bp, Mus musculus
tactcgctggctcgagtgagtcact

SEQ ID NO: 339928 - DNA, 25 bp, Mus musculus
cccggcccggagaaagccgaggctg

SEQ ID NO: 339929 - DNA, 25 bp, Mus musculus
ctgagcacgccgaggagcgtgaagc

SEQ ID NO: 339930 - DNA, 25 bp, Mus musculus
tgagggtgggctctggctaaccgac

SEQ ID NO: 339931 - DNA, 25 bp, Mus musculus
cccgcacggtacagggctgtgggca

SEQ ID NO: 339932 - DNA, 25 bp, Mus musculus
tgatgaaggtgaggagtctcggcct

SEQ ID NO: 339933 - DNA, 25 bp, Mus musculus
ccagactggcggctgtgatgaaggt

SEQ ID NO: 339934 - DNA, 25 bp, Mus musculus
cggtccaccttcactttcactttcg

SEQ ID NO: 339935 - DNA, 25 bp, Mus musculus
gtgccctgccggtccaccttcactt

SEQ ID NO: 339936 - DNA, 25 bp, Mus musculus
ccgggctcaagtgcgcaggacgggc

SEQ ID NO: 339937 - DNA, 25 bp, Mus musculus
gagtacgactcacctcctgggtgtg

SEQ ID NO: 339938 - DNA, 25 bp, Mus musculus
cagccacctcgggacaggaggagcg

SEQ ID NO: 339939 - DNA, 25 bp, Mus musculus
aaacgcagcgaaattgtttgcgggg

SEQ ID NO: 339940 - DNA, 25 bp, Mus musculus
cttccgggaaaacgcagcgaaattg

SEQ ID NO: 339941 - DNA, 25 bp, Mus musculus
cagcttccgggaaaacgcagcgaaa

SEQ ID NO: 339942 - DNA, 25 bp, Mus musculus
ctgcgggcgcagcttccgggaaaac

SEQ ID NO: 339943 - DNA, 25 bp, Mus musculus
catttttcggtgaagccgctgcggg

SEQ ID NO: 339944 - DNA, 25 bp, Mus musculus
tcacctcctgggtgtggcgagctgc

SEQ ID NO: 339945 - DNA, 25 bp, Mus musculus
ctcagtctggagtacgactcacctc

SEQ ID NO: 339946 - DNA, 25 bp, Mus musculus
cgcggctcagtctggagtacgactc

SEQ ID NO: 339947 - DNA, 25 bp, Mus musculus
gacttaggccttttgccgcttgccc

SEQ ID NO: 339948 - DNA, 25 bp, Mus musculus
ggcgggacactccaggacttaggcc

SEQ ID NO: 339949 - DNA, 25 bp, Mus musculus
agactgcggcgggacactccaggac

SEQ ID NO: 339950 - DNA, 25 bp, Mus musculus
ctgggacatttttcggtgaagccgc

SEQ ID NO: 339951 - DNA, 25 bp, Mus musculus
gggacacaccttgcactctcgggga

SEQ ID NO: 339952 - DNA, 25 bp, Mus musculus
gggtgaagacataactagtactctc

SEQ ID NO: 339953 - DNA, 25 bp, Mus musculus
accaatgaacagagtccagggcggg

SEQ ID NO: 339954 - DNA, 25 bp, Mus musculus
tgtacatggtgtactcgggaaggcc

SEQ ID NO: 339955 - DNA, 25 bp, Mus musculus
tactctcagggactcggagacactg

SEQ ID NO: 339956 - DNA, 25 bp, Mus musculus
cgagcggtcagagttttctgggaaa

SEQ ID NO: 339957 - DNA, 25 bp, Mus musculus
ggcgcacggagctaccagtaaagaa

SEQ ID NO: 339958 - DNA, 25 bp, Mus musculus
aagtgtggcgatcgccttaccctcg

SEQ ID NO: 339959 - DNA, 25 bp, Mus musculus
ggccactgatctttctgccgggcgc

SEQ ID NO: 339960 - DNA, 25 bp, Mus musculus
ttaccagagccacaaggtgagcggc

SEQ ID NO: 339961 - DNA, 25 bp, Mus musculus
tgaagctcaccgagacggcgatccg

SEQ ID NO: 339962 - DNA, 25 bp, Mus musculus
caccgtgctgcatgtgaagctcacc

SEQ ID NO: 339963 - DNA, 25 bp, Mus musculus
tgcgcgcagtatatgacagtacgtc

SEQ ID NO: 339964 - DNA, 25 bp, Mus musculus
cctattgcaggcgagagtgtacatg

SEQ ID NO: 339965 - DNA, 25 bp, Mus musculus
aacgccacgatgtggatggacctgc

SEQ ID NO: 339966 - DNA, 25 bp, Mus musculus
cctcaactcggaaggctgaaacctg

SEQ ID NO: 339967 - DNA, 25 bp, Mus musculus
aatccgcctgcagcaagtttcctca

SEQ ID NO: 339968 - DNA, 25 bp, Mus musculus
cgggcgacgctctcactgcagtcag

SEQ ID NO: 339969 - DNA, 25 bp, Mus musculus
cgtacgtacatgatcgcggctggca

SEQ ID NO: 339970 - DNA, 25 bp, Mus musculus
gtcccggacccagaccgtggcagaa

SEQ ID NO: 339971 - DNA, 25 bp, Mus musculus
ttcccaggtatgtgcggatgagccc

SEQ ID NO: 339972 - DNA, 25 bp, Mus musculus
tacccagacgggacagtcgtgcacc

SEQ ID NO: 339973 - DNA, 25 bp, Mus musculus
tggccgcgttcagcaacaagctact

SEQ ID NO: 339974 - DNA, 25 bp, Mus musculus
ctggtactcagtgaacaccgggcgc

SEQ ID NO: 339975 - DNA, 25 bp, Mus musculus
gttcccgaacgcactggcctggtac

SEQ ID NO: 339976 - DNA, 25 bp, Mus musculus
gtcgtgcaccaccagcttgacgttc

SEQ ID NO: 339977 - DNA, 25 bp, Mus musculus
tggtggaacgtgtcgccctcgttcc

SEQ ID NO: 339978 - DNA, 25 bp, Mus musculus
aacggcgacgcgtacgtacatgatc

SEQ ID NO: 339979 - DNA, 25 bp, Mus musculus
cgacggccatcccaggagaatattt

SEQ ID NO: 339980 - DNA, 25 bp, Mus musculus
tgggacgtcagaaggattcgctttc

SEQ ID NO: 339981 - DNA, 25 bp, Mus musculus
gtgcggaaaagcctatttaaatggc

SEQ ID NO: 339982 - DNA, 25 bp, Mus musculus
gacagcacggcaaccagcagtcgtc

SEQ ID NO: 339983 - DNA, 25 bp, Mus musculus
tatttaaatggctgcaggtcccggc

SEQ ID NO: 339984 - DNA, 25 bp, Mus musculus
tgtggcccaactgtcaaggcgaaca

SEQ ID NO: 339985 - DNA, 25 bp, Mus musculus
ggcgaacagttcactgaggctcttg

SEQ ID NO: 339986 - DNA, 25 bp, Mus musculus
ggctcttgccaatgccagtccacga

SEQ ID NO: 339987 - DNA, 25 bp, Mus musculus
gccagtccacgagggtccaaacgct

SEQ ID NO: 339988 - DNA, 25 bp, Mus musculus
tcagacacccgaggactcggaaccg

SEQ ID NO: 339989 - DNA, 25 bp, Mus musculus
gaagcagcagcgtgccagaaatctc

SEQ ID NO: 339990 - DNA, 25 bp, Mus musculus
cgcaccgcgagaacctaacttactg

SEQ ID NO: 339991 - DNA, 25 bp, Mus musculus
taacttactgtgctggggtcctcgc

SEQ ID NO: 339992 - DNA, 25 bp, Mus musculus
ttcatagtttatggcacaagtgcgg

SEQ ID NO: 339993 - DNA, 25 bp, Mus musculus
tctgcggctctgatggcgccaccta

SEQ ID NO: 339994 - DNA, 25 bp, Mus musculus
tcctcagattcctgcgacggagtgg

SEQ ID NO: 339995 - DNA, 25 bp, Mus musculus
tcagattcctgcgacggagtggagt

SEQ ID NO: 339996 - DNA, 25 bp, Mus musculus
cgctgtcaaagtaagagctgtgacc

SEQ ID NO: 339997 - DNA, 25 bp, Mus musculus
ccgcggccgctgtcaaagtaagagc

SEQ ID NO: 339998 - DNA, 25 bp, Mus musculus
gtgcccaactgcgaggggcttcccg

SEQ ID NO: 339999 - DNA, 25 bp, Mus musculus
ggccgtccacactgcgagtgcgtgc

SEQ ID NO: 340000 - DNA, 25 bp, Mus musculus
ccacctaccgggacgaatgcgaact

SEQ ID NO: 340001 - DNA, 25 bp, Mus musculus
taccgggacgaatgcgaactgcgca

SEQ ID NO: 340002 - DNA, 25 bp, Mus musculus
acgaatgcgaactgcgcaccgcgcg

SEQ ID NO: 340003 - DNA, 25 bp, Mus musculus
gcgctgtcgcggacacccagacttg

SEQ ID NO: 340004 - DNA, 25 bp, Mus musculus
gacacccagacttgcgcgtcatgta

SEQ ID NO: 340005 - DNA, 25 bp, Mus musculus
ttgcgcgtcatgtaccgcggccgct

SEQ ID NO: 340006 - DNA, 25 bp, Mus musculus
cacactgcgagtgcgtgcccaactg

SEQ ID NO: 340007 - DNA, 25 bp, Mus musculus
tgcagcaatgcttccctggccaggc

SEQ ID NO: 340008 - DNA, 25 bp, Mus musculus
gttcctccacttgcgtacaggtcag

SEQ ID NO: 340009 - DNA, 25 bp, Mus musculus
tcccaagccagctgcgacaatgctg

SEQ ID NO: 340010 - DNA, 25 bp, Mus musculus
gaagtccatcttgcgacgcttggga

SEQ ID NO: 340011 - DNA, 25 bp, Mus musculus
ccacgatagcttcatagagcgcgta

SEQ ID NO: 340012 - DNA, 25 bp, Mus musculus
gagcacagtggtgttgccagctacc

SEQ ID NO: 340013 - DNA, 25 bp, Mus musculus
gcatcctagccaccggagcctgaga

SEQ ID NO: 340014 - DNA, 25 bp, Mus musculus
aggctctggccatactgggcgacca

SEQ ID NO: 340015 - DNA, 25 bp, Mus musculus
tttgcaccttggcttggggcaacgc

SEQ ID NO: 340016 - DNA, 25 bp, Mus musculus
tgttggccacctctaggacgcgcat

SEQ ID NO: 340017 - DNA, 25 bp, Mus musculus
cccgcctggaagaaaaggtagatca

SEQ ID NO: 340018 - DNA, 25 bp, Mus musculus
cccattcgctgatatcggcttcttc

SEQ ID NO: 340019 - DNA, 25 bp, Mus musculus
atcccagcgcaccacgaaggtcgga

SEQ ID NO: 340020 - DNA, 25 bp, Mus musculus
tcagccgctgctagctgcacaagca

SEQ ID NO: 340021 - DNA, 25 bp, Mus musculus
ccgcagccgttttgctccgagctgg

SEQ ID NO: 340022 - DNA, 25 bp, Mus musculus
ctggggtgcacctgtgccaccaaaa

SEQ ID NO: 340023 - DNA, 25 bp, Mus musculus
gaccgcgtccgtgatgagagtacac

SEQ ID NO: 340024 - DNA, 25 bp, Mus musculus
ggctaaggggtcctcgacagccaca

SEQ ID NO: 340025 - DNA, 25 bp, Mus musculus
tacgcgaacatctgctgcccgtggc

SEQ ID NO: 340026 - DNA, 25 bp, Mus musculus
aagtgctggaccgagtgttctcctc

SEQ ID NO: 340027 - DNA, 25 bp, Mus musculus
cccggctctggaagaacctgcagct

SEQ ID NO: 340028 - DNA, 25 bp, Mus musculus
tgtgccaccaaaagagctcctctct

SEQ ID NO: 340029 - DNA, 25 bp, Mus musculus
agccggccgcttgcagctttccgag

SEQ ID NO: 340030 - DNA, 25 bp, Mus musculus
tagaaactttgcaggacggccgcgc

SEQ ID NO: 340031 - DNA, 25 bp, Mus musculus
agcagttgctggaaccggcgccacc

SEQ ID NO: 340032 - DNA, 25 bp, Mus musculus
cagcggagttccctgctagaaactt

SEQ ID NO: 340033 - DNA, 25 bp, Mus musculus
tcccagtgcagctggaagcccgagc

SEQ ID NO: 340034 - DNA, 25 bp, Mus musculus
cttcaagaagcggaagcaagtgctg

SEQ ID NO: 340035 - DNA, 25 bp, Mus musculus
ggctgcctgagatgccgactatttg

SEQ ID NO: 340036 - DNA, 25 bp, Mus musculus
actatttggttctggccagcgcgtc

SEQ ID NO: 340037 - DNA, 25 bp, Mus musculus
gcgtcctaggcggttctatggaaac

SEQ ID NO: 340038 - DNA, 25 bp, Mus musculus
accagttccgggtggttgtcagtga

SEQ ID NO: 340039 - DNA, 25 bp, Mus musculus
gcccttgcaggatcagcgccataga

SEQ ID NO: 340040 - DNA, 25 bp, Mus musculus
ttgtcagtgacgctctcgagcggtc

SEQ ID NO: 340041 - DNA, 25 bp, Mus musculus
ggactccctgctccaataaactagg

SEQ ID NO: 340042 - DNA, 25 bp, Mus musculus
ggcgacgactaccaccgtaggactc

SEQ ID NO: 340043 - DNA, 25 bp, Mus musculus
ctgtgaaagcacgagcgccaagcgc

SEQ ID NO: 340044 - DNA, 25 bp, Mus musculus
gaagcttctgggctggtttcgtctt

SEQ ID NO: 340045 - DNA, 25 bp, Mus musculus
cttccgagctgaggcgctttacctt

SEQ ID NO: 340046 - DNA, 25 bp, Mus musculus
gcgctgcctgagaacgcggtaaatg

SEQ ID NO: 340047 - DNA, 25 bp, Mus musculus
gtttcgtcttgcgaagctgccggtg

SEQ ID NO: 340048 - DNA, 25 bp, Mus musculus
tcgccagggacctgtctgcccagaa

SEQ ID NO: 340049 - DNA, 25 bp, Mus musculus
gcggcttagaggaagaggaaaccca

SEQ ID NO: 340050 - DNA, 25 bp, Mus musculus
tttgtaaagtttgctgggctggcgc

SEQ ID NO: 340051 - DNA, 25 bp, Mus musculus
cgccgcggaggcacttttgtttcct

SEQ ID NO: 340052 - DNA, 25 bp, Mus musculus
ggctcagtgcaaggacccgtggaaa

SEQ ID NO: 340053 - DNA, 25 bp, Mus musculus
acctggcagagtgctcctgggacct

SEQ ID NO: 340054 - DNA, 25 bp, Mus musculus
ccctgaaggcgttcgctaaggaaga

SEQ ID NO: 340055 - DNA, 25 bp, Mus musculus
gtcaggaagcggctccgagtttacc

SEQ ID NO: 340056 - DNA, 25 bp, Mus musculus
ctccgagtttaccagcgaggacacc

SEQ ID NO: 340057 - DNA, 25 bp, Mus musculus
ggcacgagatagaggcagagccacc

SEQ ID NO: 340058 - DNA, 25 bp, Mus musculus
cgacccgagtctaagtgcgtgcgtt

SEQ ID NO: 340059 - DNA, 25 bp, Mus musculus
ctgggtcttcgatagagagaggcta

SEQ ID NO: 340060 - DNA, 25 bp, Mus musculus
ctcctgggaccttgcggccagcagt

SEQ ID NO: 340061 - DNA, 25 bp, Mus musculus
cctctgggaaccctcgttgcggcgt

SEQ ID NO: 340062 - DNA, 25 bp, Mus musculus
cagagcctcgggcaccggtctacgt

SEQ ID NO: 340063 - DNA, 25 bp, Mus musculus
atgacgtttaaattccctgcagacc

SEQ ID NO: 340064 - DNA, 25 bp, Mus musculus
tcaggtaggactgcgctggccacct

SEQ ID NO: 340065 - DNA, 25 bp, Mus musculus
acagagctcaggtaggactgcgctg

SEQ ID NO: 340066 - DNA, 25 bp, Mus musculus
agcattgcagctggggacagagctc

SEQ ID NO: 340067 - DNA, 25 bp, Mus musculus
ctaccctctcagcattgcagctggg

SEQ ID NO: 340068 - DNA, 25 bp, Mus musculus
cagagatctggaaggccacgcctcc

SEQ ID NO: 340069 - DNA, 25 bp, Mus musculus
cgcaagggagttcgcccagagatct

SEQ ID NO: 340070 - DNA, 25 bp, Mus musculus
agagaaagtccgagccagggcgcaa

SEQ ID NO: 340071 - DNA, 25 bp, Mus musculus
gcgcggatcttgagagagaaagtcc

SEQ ID NO: 340072 - DNA, 25 bp, Mus musculus
cctgcagacccggaagtgcaatcga

SEQ ID NO: 340073 - DNA, 25 bp, Mus musculus
gccgtcgcatgcgtaatgacgttta

SEQ ID NO: 340074 - DNA, 25 bp, Mus musculus
ccatttccgggttcttggcgccgcg

SEQ ID NO: 340075 - DNA, 25 bp, Mus musculus
gcgccgggatcctgactgtcagaag

SEQ ID NO: 340076 - DNA, 25 bp, Mus musculus
aagtgcaatcgaacttggtcggggc

SEQ ID NO: 340077 - DNA, 25 bp, Mus musculus
gattgctttctttctccagcgcagg

SEQ ID NO: 340078 - DNA, 25 bp, Mus musculus
gaccgtcacgagctcacttcctgga

SEQ ID NO: 340079 - DNA, 25 bp, Mus musculus
taacccggtgtgtgtttccgcaggc

SEQ ID NO: 340080 - DNA, 25 bp, Mus musculus
ttcctggaagagcttcccgtctatc

SEQ ID NO: 340081 - DNA, 25 bp, Mus musculus
cgtctatcttcaagttcttcgcgga

SEQ ID NO: 340082 - DNA, 25 bp, Mus musculus
ctaattgcccggctgatccgcgggc

SEQ ID NO: 340083 - DNA, 25 bp, Mus musculus
aagttcttcgcggaagcctcggagg

SEQ ID NO: 340084 - DNA, 25 bp, Mus musculus
cctcggaggccaagagcagctcgca

SEQ ID NO: 340085 - DNA, 25 bp, Mus musculus
tccgtctaaatagcgttttgcatta

SEQ ID NO: 340086 - DNA, 25 bp, Mus musculus
tcgcaccggatcaagcacgaggagc

SEQ ID NO: 340087 - DNA, 25 bp, Mus musculus
gggtcgtgatgtgtccgtctaaata

SEQ ID NO: 340088 - DNA, 25 bp, Mus musculus
gcaactgtcaaagcaatatggcttc

SEQ ID NO: 340089 - DNA, 25 bp, Mus musculus
aatatggcttcagcggccgagttgc

SEQ ID NO: 340090 - DNA, 25 bp, Mus musculus
ttatttctagatgagtgcaactgtc

SEQ ID NO: 340091 - DNA, 25 bp, Mus musculus
cagggccctttgttaagcaccgccg

SEQ ID NO: 340092 - DNA, 25 bp, Mus musculus
gagagatgggagatgcagcttctcc

SEQ ID NO: 340093 - DNA, 25 bp, Mus musculus
gcttctccttggctgagccagacgg

SEQ ID NO: 340094 - DNA, 25 bp, Mus musculus
tgagccagacgggaacttctcaccc

SEQ ID NO: 340095 - DNA, 25 bp, Mus musculus
cgggcagttctttttatggtggcta

SEQ ID NO: 340096 - DNA, 25 bp, Mus musculus
tatggtggctatcaggcaccctggc

SEQ ID NO: 340097 - DNA, 25 bp, Mus musculus
ggctatcaggcaccctggctgcagc

SEQ ID NO: 340098 - DNA, 25 bp, Mus musculus
ccgcagggccctttgttaagcaccg

SEQ ID NO: 340099 - DNA, 25 bp, Mus musculus
gctcgctcgtcacgtgcctgatttc

SEQ ID NO: 340100 - DNA, 25 bp, Mus musculus
tcgtcacgtgcctgatttccgagcc

SEQ ID NO: 340101 - DNA, 25 bp, Mus musculus
gccgcacacacagtttcttccaagt

SEQ ID NO: 340102 - DNA, 25 bp, Mus musculus
ggcaccaacacaccagcgggccctg

SEQ ID NO: 340103 - DNA, 25 bp, Mus musculus
tcccggttgcgggacagcgaccctg

SEQ ID NO: 340104 - DNA, 25 bp, Mus musculus
cagtttcttccaagtgctggagaga

SEQ ID NO: 340105 - DNA, 25 bp, Mus musculus
cagtggcgtgataattaatggaata

SEQ ID NO: 340106 - DNA, 25 bp, Mus musculus
cccaggataagccagtggcgtgata

SEQ ID NO: 340107 - DNA, 25 bp, Mus musculus
acgccggcgcccaggataagccagt

SEQ ID NO: 340108 - DNA, 25 bp, Mus musculus
catttgccctgcgtcgctcgaggac

SEQ ID NO: 340109 - DNA, 25 bp, Mus musculus
tccggaagcgtcctcatttgccctg

SEQ ID NO: 340110 - DNA, 25 bp, Mus musculus
tacgctccggaagcgtcctcatttg

SEQ ID NO: 340111 - DNA, 25 bp, Mus musculus
cagccgagaagtacgctccggaagc

SEQ ID NO: 340112 - DNA, 25 bp, Mus musculus
gggttcccagccgagaagtacgctc

SEQ ID NO: 340113 - DNA, 25 bp, Mus musculus
caggcaccacggaaatttcagcggg

SEQ ID NO: 340114 - DNA, 25 bp, Mus musculus
gctcggaattcccaggcaccacgga

SEQ ID NO: 340115 - DNA, 25 bp, Mus musculus
ccgaggcaagtacgccgcgtagaca

SEQ ID NO: 340116 - DNA, 25 bp, Mus musculus
ttatggcccaatgtattgactccga

SEQ ID NO: 340117 - DNA, 25 bp, Mus musculus
ggaatacaatatttatggcccaatg

SEQ ID NO: 340118 - DNA, 25 bp, Mus musculus
cccaatgtattgactccgaggcaag

SEQ ID NO: 340119 - DNA, 25 bp, Mus musculus
gcactggctgccataacgcgacgtg

SEQ ID NO: 340120 - DNA, 25 bp, Mus musculus
tgccagctcgcagatgttctcgatg

SEQ ID NO: 340121 - DNA, 25 bp, Mus musculus
tgatctgcagatccgggaagaacgg

SEQ ID NO: 340122 - DNA, 25 bp, Mus musculus
ccgcgttgagcacgaacagctcgct

SEQ ID NO: 340123 - DNA, 25 bp, Mus musculus
gacaaccacatacccgggctgcaga

SEQ ID NO: 340124 - DNA, 25 bp, Mus musculus
ggcgcggtcggcgacaaccacatac

SEQ ID NO: 340125 - DNA, 25 bp, Mus musculus
ctgacgtgaatagcacgatggcttt

SEQ ID NO: 340126 - DNA, 25 bp, Mus musculus
tccatgaaggccacgacgcggtccg

SEQ ID NO: 340127 - DNA, 25 bp, Mus musculus
ttcctgaaagatgcggatgtggtcc

SEQ ID NO: 340128 - DNA, 25 bp, Mus musculus
ggatgccagggactcgcctcgccat

SEQ ID NO: 340129 - DNA, 25 bp, Mus musculus
accgcatcctcacctgacgtgaata

SEQ ID NO: 340130 - DNA, 25 bp, Mus musculus
cttctccacctgttcctgaaagatg

SEQ ID NO: 340131 - DNA, 25 bp, Mus musculus
ctttgaggcagctgtactcggcaga

SEQ ID NO: 340132 - DNA, 25 bp, Mus musculus
gcgctgggtccaggccatccatcag

SEQ ID NO: 340133 - DNA, 25 bp, Mus musculus
acactttgctctttttgttgtgcgg

SEQ ID NO: 340134 - DNA, 25 bp, Mus musculus
tgccttcttctttcgggaggtgacg

SEQ ID NO: 340135 - DNA, 25 bp, Mus musculus
ttcacgccagcgacgaattcacagc

SEQ ID NO: 340136 - DNA, 25 bp, Mus musculus
tacgagataattcacgccagcgacg

SEQ ID NO: 340137 - DNA, 25 bp, Mus musculus
ggggagaaaaatacgagataattca

SEQ ID NO: 340138 - DNA, 25 bp, Mus musculus
agccctcgcccggtttcaagagtgc

SEQ ID NO: 340139 - DNA, 25 bp, Mus musculus
gccgggttctctctgccttcttctt

SEQ ID NO: 340140 - DNA, 25 bp, Mus musculus
cgggctgagccgacatagaggaagc

SEQ ID NO: 340141 - DNA, 25 bp, Mus musculus
agtcgagcaggatcgggacgaagct

SEQ ID NO: 340142 - DNA, 25 bp, Mus musculus
agggccggacgcagccagccattca

SEQ ID NO: 340143 - DNA, 25 bp, Mus musculus
ctctttttgttgtgcgggtggcgcc

SEQ ID NO: 340144 - DNA, 25 bp, Mus musculus
agccattcaggaaggcagcgctgga

SEQ ID NO: 340145 - DNA, 25 bp, Mus musculus
gcgaggaagatcacacactttgctc

SEQ ID NO: 340146 - DNA, 25 bp, Mus musculus
gccggcgaggaagatcacacacttt

SEQ ID NO: 340147 - DNA, 25 bp, Mus musculus
tgcccagctgcaaaagggaaggatc

SEQ ID NO: 340148 - DNA, 25 bp, Mus musculus
ctcgcgggagatggagtgagtaccc

SEQ ID NO: 340149 - DNA, 25 bp, Mus musculus
caacggggaacctagaggcgacgcg

SEQ ID NO: 340150 - DNA, 25 bp, Mus musculus
caccgcccacggacctcgcgggaga

SEQ ID NO: 340151 - DNA, 25 bp, Mus musculus
ccaggccctagagtcggccctgccc

SEQ ID NO: 340152 - DNA, 25 bp, Mus musculus
cggggagaccgtgcccagctgcaaa

SEQ ID NO: 340153 - DNA, 25 bp, Mus musculus
agaccgtgcccagctgcaaaaggga

SEQ ID NO: 340154 - DNA, 25 bp, Mus musculus
gatctctgcgacgttttggggtgca

SEQ ID NO: 340155 - DNA, 25 bp, Mus musculus
ccagctgcaaaagggaaggatcgag

SEQ ID NO: 340156 - DNA, 25 bp, Mus musculus
caaaagggaaggatcgagctgggcc

SEQ ID NO: 340157 - DNA, 25 bp, Mus musculus
gcgagggatacagggaacgcgcaga

SEQ ID NO: 340158 - DNA, 25 bp, Mus musculus
ctctgcgacgttttggggtgcagct

SEQ ID NO: 340159 - DNA, 25 bp, Mus musculus
gcccggacaatacccggcgcgctgg

SEQ ID NO: 340160 - DNA, 25 bp, Mus musculus
ggcgcgcacacgagcccacccggcc

SEQ ID NO: 340161 - DNA, 25 bp, Mus musculus
cccgaataaaataaggcaatcgatg

SEQ ID NO: 340162 - DNA, 25 bp, Mus musculus
agagcttcaattaaaaccaacagga

SEQ ID NO: 340163 - DNA, 25 bp, Mus musculus
gtcgcctcccaggagtgggaaccga

SEQ ID NO: 340164 - DNA, 25 bp, Mus musculus
gagctagattctactcgctgggcta

SEQ ID NO: 340165 - DNA, 25 bp, Mus musculus
tgtgaggtagagtagagctagattc

SEQ ID NO: 340166 - DNA, 25 bp, Mus musculus
cacagaacctcggtggccgtgcaga

SEQ ID NO: 340167 - DNA, 25 bp, Mus musculus
ggacagcggttctccaaagcacaga

SEQ ID NO: 340168 - DNA, 25 bp, Mus musculus
tgggcgatagtgtcagcggattaaa

SEQ ID NO: 340169 - DNA, 25 bp, Mus musculus
agtcgcgctcagtcgccagcctgag

SEQ ID NO: 340170 - DNA, 25 bp, Mus musculus
cgccgcagacaggacttcgcgagtc

SEQ ID NO: 340171 - DNA, 25 bp, Mus musculus
gcggccagcctgcagcttgcagaga

SEQ ID NO: 340172 - DNA, 25 bp, Mus musculus
gggacccgagattgcatcaagttta

SEQ ID NO: 340173 - DNA, 25 bp, Mus musculus
gcaatcgatggctgcccgtttgatg

SEQ ID NO: 340174 - DNA, 25 bp, Mus musculus
cccgtttgatgtgggcgatagtgtc

SEQ ID NO: 340175 - DNA, 25 bp, Mus musculus
ggatcctggacgtcacccgctctgg

SEQ ID NO: 340176 - DNA, 25 bp, Mus musculus
cagccagaggctgccgggctccgtg

SEQ ID NO: 340177 - DNA, 25 bp, Mus musculus
gtagcgctcgcctgactcagcgctg

SEQ ID NO: 340178 - DNA, 25 bp, Mus musculus
ggcacgtagcgctcgcctgactcag

SEQ ID NO: 340179 - DNA, 25 bp, Mus musculus
aggccgagccctcagtgctgcagac

SEQ ID NO: 340180 - DNA, 25 bp, Mus musculus
tgggacgcccttcctgacagccggt

SEQ ID NO: 340181 - DNA, 25 bp, Mus musculus
cgaggccgagccctcagtgctgcag

SEQ ID NO: 340182 - DNA, 25 bp, Mus musculus
cagtgctgcagaccggtctctgcgc

SEQ ID NO: 340183 - DNA, 25 bp, Mus musculus
ggtctctgcgcttcccggagcagcg

SEQ ID NO: 340184 - DNA, 25 bp, Mus musculus
cccttcctgacagccggtctcccgg

SEQ ID NO: 340185 - DNA, 25 bp, Mus musculus
agccctcagtgctgcagaccggtct

SEQ ID NO: 340186 - DNA, 25 bp, Mus musculus
agcgctcgcctgactcagcgctgag

SEQ ID NO: 340187 - DNA, 25 bp, Mus musculus
cgagccctcagtgctgcagaccggt

SEQ ID NO: 340188 - DNA, 25 bp, Mus musculus
ctcagtgctgcagaccggtctctgc

SEQ ID NO: 340189 - DNA, 25 bp, Mus musculus
gcctaagagatgctgtagccctccc

SEQ ID NO: 340190 - DNA, 25 bp, Mus musculus
tcctacctccagcaacaggtgcaag

SEQ ID NO: 340191 - DNA, 25 bp, Mus musculus
ctccagcaacaggtgcaagcggcgg

SEQ ID NO: 340192 - DNA, 25 bp, Mus musculus
caacaggtgcaagcggcggctgccc

SEQ ID NO: 340193 - DNA, 25 bp, Mus musculus
cgggaactgcctaagagatgctgta

SEQ ID NO: 340194 - DNA, 25 bp, Mus musculus
tcccttcacacccagcgcaaccctc

SEQ ID NO: 340195 - DNA, 25 bp, Mus musculus
tcctacctggttctgaggtcaccga

SEQ ID NO: 340196 - DNA, 25 bp, Mus musculus
cctggttctgaggtcaccgacatct

SEQ ID NO: 340197 - DNA, 25 bp, Mus musculus
tctgaggtcaccgacatctgcgtgc

SEQ ID NO: 340198 - DNA, 25 bp, Mus musculus
cccgccacccgcttgtccgtgcggc

SEQ ID NO: 340199 - DNA, 25 bp, Mus musculus
gaggtcaccgacatctgcgtgccct

SEQ ID NO: 340200 - DNA, 25 bp, Mus musculus
caccgctgccgttcctcccttcaca

SEQ ID NO: 340201 - DNA, 25 bp, Mus musculus
gctgcccgggaactgcctaagagat

SEQ ID NO: 340202 - DNA, 25 bp, Mus musculus
gcaaccctctgcaacgctaatcctt

SEQ ID NO: 340203 - DNA, 25 bp, Mus musculus
tggtggaggacataaccgtgtcgcc

SEQ ID NO: 340204 - DNA, 25 bp, Mus musculus
agaaatcagagatgtaatctttgcg

SEQ ID NO: 340205 - DNA, 25 bp, Mus musculus
ccggagaacctagagtcggtcatga

SEQ ID NO: 340206 - DNA, 25 bp, Mus musculus
ggcagaagcggacccagacaccgga

SEQ ID NO: 340207 - DNA, 25 bp, Mus musculus
acggtggcagaagcggacccagaca

SEQ ID NO: 340208 - DNA, 25 bp, Mus musculus
tcatgaacgtctccggggccgcggc

SEQ ID NO: 340209 - DNA, 25 bp, Mus musculus
ccctgctagaggacaggtgacggtg

SEQ ID NO: 340210 - DNA, 25 bp, Mus musculus
ccctttccgggccattctgcctgtc

SEQ ID NO: 340211 - DNA, 25 bp, Mus musculus
gcacctccgcctactctacgcgatg

SEQ ID NO: 340212 - DNA, 25 bp, Mus musculus
tacgcgatgacgcaccgcaggtttg

SEQ ID NO: 340213 - DNA, 25 bp, Mus musculus
tgacgcaccgcaggtttgcggacgt

SEQ ID NO: 340214 - DNA, 25 bp, Mus musculus
cgtcccagtctgacgcggcgactta

SEQ ID NO: 340215 - DNA, 25 bp, Mus musculus
cgcggcgacttagaaatcagagatg

SEQ ID NO: 340216 - DNA, 25 bp, Mus musculus
cctagagtcggtcatgaacgtctcc

SEQ ID NO: 340217 - DNA, 25 bp, Mus musculus
agctggtgaagcagctgcgcaccga

SEQ ID NO: 340218 - DNA, 25 bp, Mus musculus
ctgtgcagaggaaacccgctttccc

SEQ ID NO: 340219 - DNA, 25 bp, Mus musculus
ccgtgtgccttcagtacttcgtgga

SEQ ID NO: 340220 - DNA, 25 bp, Mus musculus
cagtacttcgtggagcctatgatgc

SEQ ID NO: 340221 - DNA, 25 bp, Mus musculus
cctatgatgctcgactgcggccaca

SEQ ID NO: 340222 - DNA, 25 bp, Mus musculus
acaacatctgttgcgcgtgcctggc

SEQ ID NO: 340223 - DNA, 25 bp, Mus musculus
tggccaacgtgacccagctggtgaa

SEQ ID NO: 340224 - DNA, 25 bp, Mus musculus
caccgggagcctctgaagctgtact

SEQ ID NO: 340225 - DNA, 25 bp, Mus musculus
gtactgcgagcaggaccagatgccc

SEQ ID NO: 340226 - DNA, 25 bp, Mus musculus
ccagatgcccatctgcgtggtgtgc

SEQ ID NO: 340227 - DNA, 25 bp, Mus musculus
ggggcttcctggtttgataccgaga

SEQ ID NO: 340228 - DNA, 25 bp, Mus musculus
tcatttcctccctgtcggctgcgga

SEQ ID NO: 340229 - DNA, 25 bp, Mus musculus
ggagcctccgcactcagactgggaa

SEQ ID NO: 340230 - DNA, 25 bp, Mus musculus
ccgcggagactaacgtgtcgtgtcc

SEQ ID NO: 340231 - DNA, 25 bp, Mus musculus
acgtgcacttcgatcactccggcgg

SEQ ID NO: 340232 - DNA, 25 bp, Mus musculus
gggacaactttgagaccgtgacctg

SEQ ID NO: 340233 - DNA, 25 bp, Mus musculus
agctttttagcccttggcaggcgcc

SEQ ID NO: 340234 - DNA, 25 bp, Mus musculus
actccggcggtctctatcagttcga

SEQ ID NO: 340235 - DNA, 25 bp, Mus musculus
ccgtgacctggctttctgacagcga

SEQ ID NO: 340236 - DNA, 25 bp, Mus musculus
cctcttgcaggattgcgggtctaaa

SEQ ID NO: 340237 - DNA, 25 bp, Mus musculus
caagaacggttctacgagtcaggca

SEQ ID NO: 340238 - DNA, 25 bp, Mus musculus
gggcgatggcatcttctggattcaa

SEQ ID NO: 340239 - DNA, 25 bp, Mus musculus
ccacaagtctctgggcgatggcatc

SEQ ID NO: 340240 - DNA, 25 bp, Mus musculus
cgctcgagtggtatgcccacaagtc

SEQ ID NO: 340241 - DNA, 25 bp, Mus musculus
cctcctccggagctgagagtagctc

SEQ ID NO: 340242 - DNA, 25 bp, Mus musculus
aacaggtgatctgggcagtgtcgca

SEQ ID NO: 340243 - DNA, 25 bp, Mus musculus
ggcgccgtagtcagcctccaacagg

SEQ ID NO: 340244 - DNA, 25 bp, Mus musculus
atcagttcgaccaggtggctgtgca

SEQ ID NO: 340245 - DNA, 25 bp, Mus musculus
cacgtgctgtatcctcgtttacaca

SEQ ID NO: 340246 - DNA, 25 bp, Mus musculus
tggtgactctaatacgcgcgcaagg

SEQ ID NO: 340247 - DNA, 25 bp, Mus musculus
ccatcttttagaacgtgcggataca

SEQ ID NO: 340248 - DNA, 25 bp, Mus musculus
cgagcagttagttagccgagtttca

SEQ ID NO: 340249 - DNA, 25 bp, Mus musculus
cagacgtaaatagcgcgagcagtta

SEQ ID NO: 340250 - DNA, 25 bp, Mus musculus
gcccgacggcgtccagacgtaaata

SEQ ID NO: 340251 - DNA, 25 bp, Mus musculus
ttgcccatctacagttaaaggtgcc

SEQ ID NO: 340252 - DNA, 25 bp, Mus musculus
gtggagctcgtttccgtgacaccgt

SEQ ID NO: 340253 - DNA, 25 bp, Mus musculus
aggcacgctgtgctctaggcgtctc

SEQ ID NO: 340254 - DNA, 25 bp, Mus musculus
ggactcagccctggttgcctgattc

SEQ ID NO: 340255 - DNA, 25 bp, Mus musculus
gtgaagtctcgcgaggtttccctca

SEQ ID NO: 340256 - DNA, 25 bp, Mus musculus
cgagtggaacatctctgtcggaaga

SEQ ID NO: 340257 - DNA, 25 bp, Mus musculus
gccaatccagggagccagactgaca

SEQ ID NO: 340258 - DNA, 25 bp, Mus musculus
gagtcgggaaagaacctggccaatc

SEQ ID NO: 340259 - DNA, 25 bp, Mus musculus
ctagagcagctcttagggtcgcgct

SEQ ID NO: 340260 - DNA, 25 bp, Mus musculus
gaagtggctactgagaatctaaagg

SEQ ID NO: 340261 - DNA, 25 bp, Mus musculus
cgctgggatcgaggcttgcagacat

SEQ ID NO: 340262 - DNA, 25 bp, Mus musculus
gatcgaggcttgcagacatcctgga

SEQ ID NO: 340263 - DNA, 25 bp, Mus musculus
acatcctggatcgtggcttttacgc

SEQ ID NO: 340264 - DNA, 25 bp, Mus musculus
atcgtggcttttacgcgtgagtaac

SEQ ID NO: 340265 - DNA, 25 bp, Mus musculus
ctattggtcagaaggaagatctcga

SEQ ID NO: 340266 - DNA, 25 bp, Mus musculus
ccggagcaaggatgaagtggctact

SEQ ID NO: 340267 - DNA, 25 bp, Mus musculus
ggggagtcactagagcagctcttag

SEQ ID NO: 340268 - DNA, 25 bp, Mus musculus
cttagggtcgcgctcctattggtca

SEQ ID NO: 340269 - DNA, 25 bp, Mus musculus
gatctcgacttcagaaggactttcc

SEQ ID NO: 340270 - DNA, 25 bp, Mus musculus
aggactttcctgctagctggcttgc

SEQ ID NO: 340271 - DNA, 25 bp, Mus musculus
caggagcctagcgtcctctgtagcg

SEQ ID NO: 340272 - DNA, 25 bp, Mus musculus
ttttacgcgtgagtaacggaggcgc

SEQ ID NO: 340273 - DNA, 25 bp, Mus musculus
aggccagtccggagctgacgcacca

SEQ ID NO: 340274 - DNA, 25 bp, Mus musculus
gtcctgcggtgctagcttttgtacc

SEQ ID NO: 340275 - DNA, 25 bp, Mus musculus
ctgaactgggtggaagccctcgcag

SEQ ID NO: 340276 - DNA, 25 bp, Mus musculus
ctcgcccgagcaaggaggctgcctg

SEQ ID NO: 340277 - DNA, 25 bp, Mus musculus
tggagagtcacctcgcccgagcaag

SEQ ID NO: 340278 - DNA, 25 bp, Mus musculus
gcgggcttccgcacttttctgaaac

SEQ ID NO: 340279 - DNA, 25 bp, Mus musculus
atgccctgcgggcttccgcactttt

SEQ ID NO: 340280 - DNA, 25 bp, Mus musculus
ggccacggcgttaagccgccagtga

SEQ ID NO: 340281 - DNA, 25 bp, Mus musculus
agccgctcaggccacggcgttaagc

SEQ ID NO: 340282 - DNA, 25 bp, Mus musculus
ggaacaggactcaaccgaccgcagc

SEQ ID NO: 340283 - DNA, 25 bp, Mus musculus
ctggaggtggaacaggactcaaccg

SEQ ID NO: 340284 - DNA, 25 bp, Mus musculus
cgcacttttctgaaaccaaacagga

SEQ ID NO: 340285 - DNA, 25 bp, Mus musculus
aaccaaacaggatggctaggctccc

SEQ ID NO: 340286 - DNA, 25 bp, Mus musculus
gtttgaaggccgtggagagtcacct

SEQ ID NO: 340287 - DNA, 25 bp, Mus musculus
cgctgggcatcacaaggcccgtcag

SEQ ID NO: 340288 - DNA, 25 bp, Mus musculus
gttcgcggagctcacgtgctcgcac

SEQ ID NO: 340289 - DNA, 25 bp, Mus musculus
aagtctccctggttcgcggagctca

SEQ ID NO: 340290 - DNA, 25 bp, Mus musculus
cctagctgctggagctagtgcgccg

SEQ ID NO: 340291 - DNA, 25 bp, Mus musculus
ctgccctagctgctggagctagtgc

SEQ ID NO: 340292 - DNA, 25 bp, Mus musculus
agcgtctgattggtgtttcccggga

SEQ ID NO: 340293 - DNA, 25 bp, Mus musculus
agctagcgtctgattggtgtttccc

SEQ ID NO: 340294 - DNA, 25 bp, Mus musculus
gcgacagaaagctagcgtctgattg

SEQ ID NO: 340295 - DNA, 25 bp, Mus musculus
cgggcgacagaaagctagcgtctga

SEQ ID NO: 340296 - DNA, 25 bp, Mus musculus
agctgccgctactcgcggcgggcga

SEQ ID NO: 340297 - DNA, 25 bp, Mus musculus
gagtcctccctgagctgccgctact

SEQ ID NO: 340298 - DNA, 25 bp, Mus musculus
aacagcctgagtcctccctgagctg

SEQ ID NO: 340299 - DNA, 25 bp, Mus musculus
gtcagcaccggccaacagcctgagt

SEQ ID NO: 340300 - DNA, 25 bp, Mus musculus
tgggcatcacaaggcccgtcagcac

SEQ ID NO: 340301 - DNA, 25 bp, Mus musculus
ggatccagcctctaagttcctccga

SEQ ID NO: 340302 - DNA, 25 bp, Mus musculus
actcgcagaggatgtcaccaggacc

SEQ ID NO: 340303 - DNA, 25 bp, Mus musculus
agcgccggcctgctaacactctctc

SEQ ID NO: 340304 - DNA, 25 bp, Mus musculus
ctcggggactcgcagaggatgtcac

SEQ ID NO: 340305 - DNA, 25 bp, Mus musculus
tcacactgagcgaggcagggtccac

SEQ ID NO: 340306 - DNA, 25 bp, Mus musculus
cgatgaggtcacactgagcgaggca

SEQ ID NO: 340307 - DNA, 25 bp, Mus musculus
tcacaaggccgatgaggtcacactg

SEQ ID NO: 340308 - DNA, 25 bp, Mus musculus
acggcatcgctgagaacgggatcca

SEQ ID NO: 340309 - DNA, 25 bp, Mus musculus
tgagaacgggatccagcctctaagt

SEQ ID NO: 340310 - DNA, 25 bp, Mus musculus
gacgaactcattcacaaggccgatg

SEQ ID NO: 340311 - DNA, 25 bp, Mus musculus
cccacgcagtggtccatgccgtgga

SEQ ID NO: 340312 - DNA, 25 bp, Mus musculus
tcctccgaggtggacgaactcattc

SEQ ID NO: 340313 - DNA, 25 bp, Mus musculus
agcctctaagttcctccgaggtgga

SEQ ID NO: 340314 - DNA, 25 bp, Mus musculus
tgccgtggacggcatcgctgagaac

SEQ ID NO: 340315 - DNA, 25 bp, Mus musculus
ccacggaagtggctttagagaacgc

SEQ ID NO: 340316 - DNA, 25 bp, Mus musculus
tcccttcgcggtttcgagagctccg

SEQ ID NO: 340317 - DNA, 25 bp, Mus musculus
tttcccttcgcggtttcgagagctc

SEQ ID NO: 340318 - DNA, 25 bp, Mus musculus
ccatgcgggcaggacttccggccga

SEQ ID NO: 340319 - DNA, 25 bp, Mus musculus
cttcctgtcccatgcgggcaggact

SEQ ID NO: 340320 - DNA, 25 bp, Mus musculus
aggaacttcctgtcccatgcgggca

SEQ ID NO: 340321 - DNA, 25 bp, Mus musculus
ggctttagagaacgccttgcggctc

SEQ ID NO: 340322 - DNA, 25 bp, Mus musculus
gcctcacacccacggaagtggcttt

SEQ ID NO: 340323 - DNA, 25 bp, Mus musculus
tgcgcccctgcgttctcaaggtcag

SEQ ID NO: 340324 - DNA, 25 bp, Mus musculus
cgcccacctacctgtgcgcctgcgc

SEQ ID NO: 340325 - DNA, 25 bp, Mus musculus
acctaggaatcctgcgggcatgccg

SEQ ID NO: 340326 - DNA, 25 bp, Mus musculus
ataccgcacctacctaggaatcctg

SEQ ID NO: 340327 - DNA, 25 bp, Mus musculus
accagcgcccgcgaaaaataccgca

SEQ ID NO: 340328 - DNA, 25 bp, Mus musculus
cctcctctctgcgtggcgtggggtc

SEQ ID NO: 340329 - DNA, 25 bp, Mus musculus
agtgcaaagctgtggctaacgggaa

SEQ ID NO: 340330 - DNA, 25 bp, Mus musculus
accggctccggaaactccagagcag

SEQ ID NO: 340331 - DNA, 25 bp, Mus musculus
ctccagagcagacgctggcacgtga

SEQ ID NO: 340332 - DNA, 25 bp, Mus musculus
gtgaccgggacgtcacgcacgcgtc

SEQ ID NO: 340333 - DNA, 25 bp, Mus musculus
gctcgtggtcgctgtctctcggagt

SEQ ID NO: 340334 - DNA, 25 bp, Mus musculus
ctctcggagtgtcgctgtttttgtc

SEQ ID NO: 340335 - DNA, 25 bp, Mus musculus
tcgctgtttttgtcgcggccctgcg

SEQ ID NO: 340336 - DNA, 25 bp, Mus musculus
cccgtgagggctacagcatgtatca

SEQ ID NO: 340337 - DNA, 25 bp, Mus musculus
agcatgtatcacagcagcagccaga

SEQ ID NO: 340338 - DNA, 25 bp, Mus musculus
agcagcagccagaaacggcactgga

SEQ ID NO: 340339 - DNA, 25 bp, Mus musculus
accttcgctagcgaggagcagctgg

SEQ ID NO: 340340 - DNA, 25 bp, Mus musculus
cgggcggacgccaaccgcaaattca

SEQ ID NO: 340341 - DNA, 25 bp, Mus musculus
aacggcactggaccttcgctagcga

SEQ ID NO: 340342 - DNA, 25 bp, Mus musculus
ccgcaaattcaagtgcaaagctgtg

SEQ ID NO: 340343 - DNA, 25 bp, Mus musculus
ccgagggccgcaaccaagtcggcgt

SEQ ID NO: 340344 - DNA, 25 bp, Mus musculus
cgggtaacttgacccggcacgctgc

SEQ ID NO: 340345 - DNA, 25 bp, Mus musculus
acaacaaaaggagagcgcccgccgc

SEQ ID NO: 340346 - DNA, 25 bp, Mus musculus
agcgacgcgggcaaaaaacccagcg

SEQ ID NO: 340347 - DNA, 25 bp, Mus musculus
aaacccagcgcctgcagaaacgcta

SEQ ID NO: 340348 - DNA, 25 bp, Mus musculus
gaaacgctaggcaaacctcgccgcg

SEQ ID NO: 340349 - DNA, 25 bp, Mus musculus
cacacatgcacaggggcgccaaact

SEQ ID NO: 340350 - DNA, 25 bp, Mus musculus
ggcgccaaacttcctggctacgcta

SEQ ID NO: 340351 - DNA, 25 bp, Mus musculus
tacctgcggctctccggagcgaaac

SEQ ID NO: 340352 - DNA, 25 bp, Mus musculus
acagaggagaaggaaaagcagcctg

SEQ ID NO: 340353 - DNA, 25 bp, Mus musculus
agcagcagcactgccggtcagcgcg

SEQ ID NO: 340354 - DNA, 25 bp, Mus musculus
ctggctacgctaaagaggaagggaa

SEQ ID NO: 340355 - DNA, 25 bp, Mus musculus
caccagtggggctgcctatgccaga

SEQ ID NO: 340356 - DNA, 25 bp, Mus musculus
gctgcctatgccagagccaccgtag

SEQ ID NO: 340357 - DNA, 25 bp, Mus musculus
actctggcccaacatgtcgctgctg

SEQ ID NO: 340358 - DNA, 25 bp, Mus musculus
tgggagttacaacaggaacttcctg

SEQ ID NO: 340359 - DNA, 25 bp, Mus musculus
aagcgctaataaccagccacaggcc

SEQ ID NO: 340360 - DNA, 25 bp, Mus musculus
aggccctcttcttttgtttccaatg

SEQ ID NO: 340361 - DNA, 25 bp, Mus musculus
gtttccaatgaccttcaatctccga

SEQ ID NO: 340362 - DNA, 25 bp, Mus musculus
accctcctcatagtggctgcgacgg

SEQ ID NO: 340363 - DNA, 25 bp, Mus musculus
gtgaacctccggatactctggccca

SEQ ID NO: 340364 - DNA, 25 bp, Mus musculus
catgtcgctgctggaagttctgcga

SEQ ID NO: 340365 - DNA, 25 bp, Mus musculus
ctacacgaccttgctcggcagagcg

SEQ ID NO: 340366 - DNA, 25 bp, Mus musculus
agtttagataataccgggcgccata

SEQ ID NO: 340367 - DNA, 25 bp, Mus musculus
ggcttgctggtttaaagcgctaata

SEQ ID NO: 340368 - DNA, 25 bp, Mus musculus
ctctgaggtttgtgggctttgtagt

SEQ ID NO: 340369 - DNA, 25 bp, Mus musculus
cttcctgaaacgtactcaaccggcg

SEQ ID NO: 340370 - DNA, 25 bp, Mus musculus
ggatcgccgcttcaaacgtggcttg

SEQ ID NO: 340371 - DNA, 25 bp, Mus musculus
tctctagggccaccactcttttatc

SEQ ID NO: 340372 - DNA, 25 bp, Mus musculus
gacgtcctcttgaatctctgacagg

SEQ ID NO: 340373 - DNA, 25 bp, Mus musculus
tcctcttgaatctctgacagggcgg

SEQ ID NO: 340374 - DNA, 25 bp, Mus musculus
cagctctcgcttcattgttctccaa

SEQ ID NO: 340375 - DNA, 25 bp, Mus musculus
tcattgttctccaagtcagaagccc

SEQ ID NO: 340376 - DNA, 25 bp, Mus musculus
cggcagcagcgtgagccgtagtcac

SEQ ID NO: 340377 - DNA, 25 bp, Mus musculus
tgagccgtagtcactgctggccgct

SEQ ID NO: 340378 - DNA, 25 bp, Mus musculus
agtgaggggtgaatcaccctttctc

SEQ ID NO: 340379 - DNA, 25 bp, Mus musculus
cgcccttcccaagaatttgaggaag

SEQ ID NO: 340380 - DNA, 25 bp, Mus musculus
cccaagaatttgaggaagcgctgcg

SEQ ID NO: 340381 - DNA, 25 bp, Mus musculus
cgctgcgggaggaaagacgtcctct

SEQ ID NO: 340382 - DNA, 25 bp, Mus musculus
tgtttgtacacagtgcgctcctggc

SEQ ID NO: 340383 - DNA, 25 bp, Mus musculus
gcctactgtgccctccgctacgacc

SEQ ID NO: 340384 - DNA, 25 bp, Mus musculus
gtagtcactgctggccgcttcgcct

SEQ ID NO: 340385 - DNA, 25 bp, Mus musculus
gagacgactgcggaccgcgaaaaaa

SEQ ID NO: 340386 - DNA, 25 bp, Mus musculus
aagcgcggctatggttttgaggacg

SEQ ID NO: 340387 - DNA, 25 bp, Mus musculus
tgtctgcccgctgcgggagacgact

SEQ ID NO: 340388 - DNA, 25 bp, Mus musculus
ctgcggaccgcgaaaaaactgatcc

SEQ ID NO: 340389 - DNA, 25 bp, Mus musculus
cgcgaaaaaactgatcctggaggtc

SEQ ID NO: 340390 - DNA, 25 bp, Mus musculus
cctggaggtctggtcaccgaatatc

SEQ ID NO: 340391 - DNA, 25 bp, Mus musculus
gtctggtcaccgaatatcacctaca

SEQ ID NO: 340392 - DNA, 25 bp, Mus musculus
aatatcacctacaccgccgcggttg

SEQ ID NO: 340393 - DNA, 25 bp, Mus musculus
cgcgcctagcccacgagtgccgcaa

SEQ ID NO: 340394 - DNA, 25 bp, Mus musculus
gtgccgcaaccctgaagcactgcga

SEQ ID NO: 340395 - DNA, 25 bp, Mus musculus
tgaagcactgcgatctccacagcgc

SEQ ID NO: 340396 - DNA, 25 bp, Mus musculus
tccacagcgcctccttgcgggccac

SEQ ID NO: 340397 - DNA, 25 bp, Mus musculus
ctttgcggtactgtctgcccgctgc

SEQ ID NO: 340398 - DNA, 25 bp, Mus musculus
agtggctttgcggtactgtctgccc

SEQ ID NO: 340399 - DNA, 25 bp, Mus musculus
tcgaaacgagttcttccggctcctg

SEQ ID NO: 340400 - DNA, 25 bp, Mus musculus
acccgtctcgcgcactgagctgaag

SEQ ID NO: 340401 - DNA, 25 bp, Mus musculus
ggagcccaggaagtcacacccgtct

SEQ ID NO: 340402 - DNA, 25 bp, Mus musculus
actcgcccgagcagctgtgcagctg

SEQ ID NO: 340403 - DNA, 25 bp, Mus musculus
gacctaggctaagcgactcgcccga

SEQ ID NO: 340404 - DNA, 25 bp, Mus musculus
ggctcctggctattgcatccatctg

SEQ ID NO: 340405 - DNA, 25 bp, Mus musculus
ttccgcataacagacacgaaagtga

SEQ ID NO: 340406 - DNA, 25 bp, Mus musculus
cgctatcattatcgttttccgcata

SEQ ID NO: 340407 - DNA, 25 bp, Mus musculus
ggcaaggatgcgctcgctatcatta

SEQ ID NO: 340408 - DNA, 25 bp, Mus musculus
cccaggccagcaccaggcaaggatg

SEQ ID NO: 340409 - DNA, 25 bp, Mus musculus
cctctgtttctgtagctgcttccca

SEQ ID NO: 340410 - DNA, 25 bp, Mus musculus
ctcctccaaaccagggtgagtttag

SEQ ID NO: 340411 - DNA, 25 bp, Mus musculus
agcccacgtggcgaatagcgaaccc

SEQ ID NO: 340412 - DNA, 25 bp, Mus musculus
tgagctgaagctccagcccacgtgg

SEQ ID NO: 340413 - DNA, 25 bp, Mus musculus
cccggaagatcacataggaagcgcg

SEQ ID NO: 340414 - DNA, 25 bp, Mus musculus
agttcttcgcccagaaaggctcggg

SEQ ID NO: 340415 - DNA, 25 bp, Mus musculus
ccaccgtcattatatcactgtaccg

SEQ ID NO: 340416 - DNA, 25 bp, Mus musculus
gcgctccttgagttcttcgcccaga

SEQ ID NO: 340417 - DNA, 25 bp, Mus musculus
cgcccagaaaggctcggggcagctc

SEQ ID NO: 340418 - DNA, 25 bp, Mus musculus
gcacctaatgctcacagctgctgcg

SEQ ID NO: 340419 - DNA, 25 bp, Mus musculus
ttggccacagcacctaatgctcaca

SEQ ID NO: 340420 - DNA, 25 bp, Mus musculus
tagcggcagatccttgtcccagcgc

SEQ ID NO: 340421 - DNA, 25 bp, Mus musculus
ggggcagctcgcctgcaagttcaaa

SEQ ID NO: 340422 - DNA, 25 bp, Mus musculus
atcacataggaagcgcggtggcctg

SEQ ID NO: 340423 - DNA, 25 bp, Mus musculus
cctgcaagttcaaatgcgggttgtg

SEQ ID NO: 340424 - DNA, 25 bp, Mus musculus
cgggttgtgacacccaccgtcatta

SEQ ID NO: 340425 - DNA, 25 bp, Mus musculus
ttatatcactgtaccgtcagagccg

SEQ ID NO: 340426 - DNA, 25 bp, Mus musculus
gatgcgctggtagcggcagatcctt

SEQ ID NO: 340427 - DNA, 25 bp, Mus musculus
ccgatgcgcccaatgagagaatccg

SEQ ID NO: 340428 - DNA, 25 bp, Mus musculus
caggccaacagtcctaggaagaacc

SEQ ID NO: 340429 - DNA, 25 bp, Mus musculus
atcccggagcatcaggccaacagtc

SEQ ID NO: 340430 - DNA, 25 bp, Mus musculus
atgcggccgcgatgcacatcccgga

SEQ ID NO: 340431 - DNA, 25 bp, Mus musculus
ctagcgtgattctccggggatccga

SEQ ID NO: 340432 - DNA, 25 bp, Mus musculus
ccggcctcactatggtaagaacctg

SEQ ID NO: 340433 - DNA, 25 bp, Mus musculus
tgtggctggaccagcaccggcctca

SEQ ID NO: 340434 - DNA, 25 bp, Mus musculus
cgataggtccaaccggaccgctgga

SEQ ID NO: 340435 - DNA, 25 bp, Mus musculus
agaagcctatcacggagtctgaatg

SEQ ID NO: 340436 - DNA, 25 bp, Mus musculus
cacctcttccggtaacagaagccta

SEQ ID NO: 340437 - DNA, 25 bp, Mus musculus
tttgcgagtcgtcggccaagtccca

SEQ ID NO: 340438 - DNA, 25 bp, Mus musculus
taataccgtggtttgcgagtcgtcg

SEQ ID NO: 340439 - DNA, 25 bp, Mus musculus
gagaatccgctaataccgtggtttg

SEQ ID NO: 340440 - DNA, 25 bp, Mus musculus
cgccagagataaaccgatgcgccca

SEQ ID NO: 340441 - DNA, 25 bp, Mus musculus
atacggcctatcgtggggagataga

SEQ ID NO: 340442 - DNA, 25 bp, Mus musculus
ctcggtttgcggagcattcagtgat

SEQ ID NO: 340443 - DNA, 25 bp, Mus musculus
ccttctgctgaagctcgtgtgcgga

SEQ ID NO: 340444 - DNA, 25 bp, Mus musculus
tctggcgcaaacgtcccttctgctg

SEQ ID NO: 340445 - DNA, 25 bp, Mus musculus
cgtgctaagaggagccacaggtctc

SEQ ID NO: 340446 - DNA, 25 bp, Mus musculus
tcgagggtaattggcccacgtgcta

SEQ ID NO: 340447 - DNA, 25 bp, Mus musculus
cccagcctgggtttgtgtgcagctc

SEQ ID NO: 340448 - DNA, 25 bp, Mus musculus
cgcagggctctagagctcgggatac

SEQ ID NO: 340449 - DNA, 25 bp, Mus musculus
ctctctctttctcttgggcccgtgg

SEQ ID NO: 340450 - DNA, 25 bp, Mus musculus
gcaatgccttgtgggtccttcctgc

SEQ ID NO: 340451 - DNA, 25 bp, Mus musculus
tcagtgatgtgtgttttttaggcaa

SEQ ID NO: 340452 - DNA, 25 bp, Mus musculus
ttttaggcaagtgtcgtggtctccg

SEQ ID NO: 340453 - DNA, 25 bp, Mus musculus
tggtctccgaactgcccggaagctc

SEQ ID NO: 340454 - DNA, 25 bp, Mus musculus
tgcagctccgagttaggggatttcg

SEQ ID NO: 340455 - DNA, 25 bp, Mus musculus
gcacctctcaatggcagcgctgctg

SEQ ID NO: 340456 - DNA, 25 bp, Mus musculus
tcaatggcagcgctgctgagctccc

SEQ ID NO: 340457 - DNA, 25 bp, Mus musculus
tgagctcccggccaccaaggaggag

SEQ ID NO: 340458 - DNA, 25 bp, Mus musculus
gccaccaaggaggagaaccagacgg

SEQ ID NO: 340459 - DNA, 25 bp, Mus musculus
gagaaccagacggggcccacgacca

SEQ ID NO: 340460 - DNA, 25 bp, Mus musculus
cagcgacacccaggatcttgacatg

SEQ ID NO: 340461 - DNA, 25 bp, Mus musculus
cccaggatcttgacatgaagaagcc

SEQ ID NO: 340462 - DNA, 25 bp, Mus musculus
cttgacatgaagaagcctcgctgta

SEQ ID NO: 340463 - DNA, 25 bp, Mus musculus
cctcgctgtagatgttgttctgtca

SEQ ID NO: 340464 - DNA, 25 bp, Mus musculus
tgttgttctgtcatgtgagccgtcg

SEQ ID NO: 340465 - DNA, 25 bp, Mus musculus
tcatgtgagccgtcggggcacccta

SEQ ID NO: 340466 - DNA, 25 bp, Mus musculus
cccagacacgtgtgtgatccctatg

SEQ ID NO: 340467 - DNA, 25 bp, Mus musculus
tgatccctatgcacctcgagtctcg

SEQ ID NO: 340468 - DNA, 25 bp, Mus musculus
agggagcccgcacctctcaatggca

SEQ ID NO: 340469 - DNA, 25 bp, Mus musculus
tgacaagtagagtgcgagccaggat

SEQ ID NO: 340470 - DNA, 25 bp, Mus musculus
aggcctgttactggctggccgatcc

SEQ ID NO: 340471 - DNA, 25 bp, Mus musculus
aaacaggggactcgtgacaagtaga

SEQ ID NO: 340472 - DNA, 25 bp, Mus musculus
tggctataaacaggggactcgtgac

SEQ ID NO: 340473 - DNA, 25 bp, Mus musculus
ctagacgcctggctataaacagggg

SEQ ID NO: 340474 - DNA, 25 bp, Mus musculus
cagtcattctagacgcctggctata

SEQ ID NO: 340475 - DNA, 25 bp, Mus musculus
cacacgcagtcattctagacgcctg

SEQ ID NO: 340476 - DNA, 25 bp, Mus musculus
gagcctaacccgcttggtgctctcg

SEQ ID NO: 340477 - DNA, 25 bp, Mus musculus
ggcgccagcagccttcactttcccg

SEQ ID NO: 340478 - DNA, 25 bp, Mus musculus
acgtccgggcgagaccttcctgcaa

SEQ ID NO: 340479 - DNA, 25 bp, Mus musculus
ctcgctcgccctgacctggagccgg

SEQ ID NO: 340480 - DNA, 25 bp, Mus musculus
acccttctcaggtcccaggaggcgg

SEQ ID NO: 340481 - DNA, 25 bp, Mus musculus
tcgccgaggttaggtgtactcaccc

SEQ ID NO: 340482 - DNA, 25 bp, Mus musculus
cgagccagggtatctgcactccctt

SEQ ID NO: 340483 - DNA, 25 bp, Mus musculus
cctcccagggagagacagaggttcg

SEQ ID NO: 340484 - DNA, 25 bp, Mus musculus
gccgccgcgactcccgttccgcagt

SEQ ID NO: 340485 - DNA, 25 bp, Mus musculus
gccagttgtttaaaatccttctaga

SEQ ID NO: 340486 - DNA, 25 bp, Mus musculus
cccgcgccttctttccagtgaggag

SEQ ID NO: 340487 - DNA, 25 bp, Mus musculus
tgccaggcactccaggccgcacttt

SEQ ID NO: 340488 - DNA, 25 bp, Mus musculus
tccttctagagcagtttctaattcc

SEQ ID NO: 340489 - DNA, 25 bp, Mus musculus
tgagatcaaccgcgggtacggaccc

SEQ ID NO: 340490 - DNA, 25 bp, Mus musculus
cgggattggggcgacaccccagaca

SEQ ID NO: 340491 - DNA, 25 bp, Mus musculus
cctgctggccctccgggaacgggat

SEQ ID NO: 340492 - DNA, 25 bp, Mus musculus
gacagaggttcgctcagtccttgag

SEQ ID NO: 340493 - DNA, 25 bp, Mus musculus
acggtgcctcccagggagagacaga

SEQ ID NO: 340494 - DNA, 25 bp, Mus musculus
gcctgtcagtctcgcgcgttgccag

SEQ ID NO: 340495 - DNA, 25 bp, Mus musculus
ccttgagccagaaggtcgagggttc

SEQ ID NO: 340496 - DNA, 25 bp, Mus musculus
aggagactgccgcttaggccgagcc

SEQ ID NO: 340497 - DNA, 25 bp, Mus musculus
agagatgctgggcacaagccgctcc

SEQ ID NO: 340498 - DNA, 25 bp, Mus musculus
agccgaggtgccacggtcgcggcac

SEQ ID NO: 340499 - DNA, 25 bp, Mus musculus
gatacaggtggtaacttcggtggga

SEQ ID NO: 340500 - DNA, 25 bp, Mus musculus
gcacaagccgctccgctgggtcgtg

SEQ ID NO: 340501 - DNA, 25 bp, Mus musculus
agatgctgggcacaagccgctccgc

SEQ ID NO: 340502 - DNA, 25 bp, Mus musculus
tgcccgcggtgtggacccgacgcgg

SEQ ID NO: 340503 - DNA, 25 bp, Mus musculus
gaactttttgagacttgcggtgtcc

SEQ ID NO: 340504 - DNA, 25 bp, Mus musculus
ccagaactttttgagacttgcggtg

SEQ ID NO: 340505 - DNA, 25 bp, Mus musculus
cccagaactttttgagacttgcggt

SEQ ID NO: 340506 - DNA, 25 bp, Mus musculus
cgagagcttggcgctcctgcctccc

SEQ ID NO: 340507 - DNA, 25 bp, Mus musculus
agttcccggagggagagtgtgtgct

SEQ ID NO: 340508 - DNA, 25 bp, Mus musculus
tccgcgggttctcccggcgcaggcc

SEQ ID NO: 340509 - DNA, 25 bp, Mus musculus
cagagacgcgggtccgcgggttctc

SEQ ID NO: 340510 - DNA, 25 bp, Mus musculus
atgctgggcacaagccgctccgctg

SEQ ID NO: 340511 - DNA, 25 bp, Mus musculus
ttctctcagccaggacgatggagtc

SEQ ID NO: 340512 - DNA, 25 bp, Mus musculus
gctgctcaagtggatggacaccacc

SEQ ID NO: 340513 - DNA, 25 bp, Mus musculus
tcaagtggatggacaccaccgcttg

SEQ ID NO: 340514 - DNA, 25 bp, Mus musculus
agtggatggacaccaccgcttgcct

SEQ ID NO: 340515 - DNA, 25 bp, Mus musculus
taggtgccggcccacgcgagggcac

SEQ ID NO: 340516 - DNA, 25 bp, Mus musculus
ctgagcgcagggcagctgctcaagt

SEQ ID NO: 340517 - DNA, 25 bp, Mus musculus
ctcatgccgactcccgcggcgagct

SEQ ID NO: 340518 - DNA, 25 bp, Mus musculus
ccaggccatccagccggctcatgcc

SEQ ID NO: 340519 - DNA, 25 bp, Mus musculus
gtgctcatgagccaggccatccagc

SEQ ID NO: 340520 - DNA, 25 bp, Mus musculus
ggcagctgctcaagtggatggacac

SEQ ID NO: 340521 - DNA, 25 bp, Mus musculus
ctcagccaggacgatggagtcgatg

SEQ ID NO: 340522 - DNA, 25 bp, Mus musculus
ctggggttctctcagccaggacgat

SEQ ID NO: 340523 - DNA, 25 bp, Mus musculus
caggggatcgggatggcctgctgct

SEQ ID NO: 340524 - DNA, 25 bp, Mus musculus
tgaggtgctcatgagccaggccatc

SEQ ID NO: 340525 - DNA, 25 bp, Mus musculus
cccagtcggccaaggtagcacagag

SEQ ID NO: 340526 - DNA, 25 bp, Mus musculus
cgcacacccggaatgtgagactctg

SEQ ID NO: 340527 - DNA, 25 bp, Mus musculus
gtcaccaagagggcggatcctcctc

SEQ ID NO: 340528 - DNA, 25 bp, Mus musculus
agccggcgatccgacaagctagctc

SEQ ID NO: 340529 - DNA, 25 bp, Mus musculus
aggtagcacagaggcgcccacgcct

SEQ ID NO: 340530 - DNA, 25 bp, Mus musculus
ccttaccgggtctgaatcctccaga

SEQ ID NO: 340531 - DNA, 25 bp, Mus musculus
ggtctgaatcctccagagcagctga

SEQ ID NO: 340532 - DNA, 25 bp, Mus musculus
ccagagcagctgagacaacgaacca

SEQ ID NO: 340533 - DNA, 25 bp, Mus musculus
cccggatgagatcgcggccatagag

SEQ ID NO: 340534 - DNA, 25 bp, Mus musculus
ccatagagaccggaagtgcaccgtc

SEQ ID NO: 340535 - DNA, 25 bp, Mus musculus
ggaagtgcaccgtctccacgcgtca

SEQ ID NO: 340536 - DNA, 25 bp, Mus musculus
tatgccactttacagtgcaccggtc

SEQ ID NO: 340537 - DNA, 25 bp, Mus musculus
cggtgagtgacgctgtatgccactt

SEQ ID NO: 340538 - DNA, 25 bp, Mus musculus
cccggaatgtgagactctgggtgtc

SEQ ID NO: 340539 - DNA, 25 bp, Mus musculus
agcggcttggagaccgatttaaagg

SEQ ID NO: 340540 - DNA, 25 bp, Mus musculus
ttgcgcgccagcatggccaggtaca

SEQ ID NO: 340541 - DNA, 25 bp, Mus musculus
ctcacagctgcagccctctagaagg

SEQ ID NO: 340542 - DNA, 25 bp, Mus musculus
tctagaaggtacatgcccgctggcc

SEQ ID NO: 340543 - DNA, 25 bp, Mus musculus
cgctctgctcgccttcgaagtaaaa

SEQ ID NO: 340544 - DNA, 25 bp, Mus musculus
agcacattctggtagagagcgaacc

SEQ ID NO: 340545 - DNA, 25 bp, Mus musculus
agcgaaccacttctcgtgccagcgg

SEQ ID NO: 340546 - DNA, 25 bp, Mus musculus
ctcgttgtagcgcacgctcttctgc

SEQ ID NO: 340547 - DNA, 25 bp, Mus musculus
tcgagtcgtagcctcagcttcttgg

SEQ ID NO: 340548 - DNA, 25 bp, Mus musculus
ggtcatcgcagattgccctccggga

SEQ ID NO: 340549 - DNA, 25 bp, Mus musculus
gcctatccgggctggagcaccagca

SEQ ID NO: 340550 - DNA, 25 bp, Mus musculus
cagtgtcactccacccgaagtattg

SEQ ID NO: 340551 - DNA, 25 bp, Mus musculus
aacgtcacgtgggagatcagcagta

SEQ ID NO: 340552 - DNA, 25 bp, Mus musculus
gaagtattgcgggagcccagcctct

SEQ ID NO: 340553 - DNA, 25 bp, Mus musculus
ttcctgggagggctggattcccttc

SEQ ID NO: 340554 - DNA, 25 bp, Mus musculus
cttagaaagatgcttggaaccgggg

SEQ ID NO: 340555 - DNA, 25 bp, Mus musculus
ggagggtgctccctgctacctagac

SEQ ID NO: 340556 - DNA, 25 bp, Mus musculus
tgcgctgcggctgcctatgggtccc

SEQ ID NO: 340557 - DNA, 25 bp, Mus musculus
cggccttagaaagatgcttggaacc

SEQ ID NO: 340558 - DNA, 25 bp, Mus musculus
ctctcggccttagaaagatgcttgg

SEQ ID NO: 340559 - DNA, 25 bp, Mus musculus
tagactctcggccttagaaagatgc

SEQ ID NO: 340560 - DNA, 25 bp, Mus musculus
tacctagactctcggccttagaaag

SEQ ID NO: 340561 - DNA, 25 bp, Mus musculus
gggtgctccctgctacctagactct

SEQ ID NO: 340562 - DNA, 25 bp, Mus musculus
acgcggtgagcgagctcgtgctcca

SEQ ID NO: 340563 - DNA, 25 bp, Mus musculus
atgacttccggttcctgggagggct

SEQ ID NO: 340564 - DNA, 25 bp, Mus musculus
ccgcgatgacttccggttcctggga

SEQ ID NO: 340565 - DNA, 25 bp, Mus musculus
tgctacctagactctcggccttaga

SEQ ID NO: 340566 - DNA, 25 bp, Mus musculus
agtccgcgatgacttccggttcctg

SEQ ID NO: 340567 - DNA, 25 bp, Mus musculus
tgacggcaatcctagcgtgaaggct

SEQ ID NO: 340568 - DNA, 25 bp, Mus musculus
tcagccagagaccaagctaccggtt

SEQ ID NO: 340569 - DNA, 25 bp, Mus musculus
cactgagtagggtcatgcacttggc

SEQ ID NO: 340570 - DNA, 25 bp, Mus musculus
ttggcaagaacggagacctaccctg

SEQ ID NO: 340571 - DNA, 25 bp, Mus musculus
tcgtcgccgtgtcccaaaatatggg

SEQ ID NO: 340572 - DNA, 25 bp, Mus musculus
accattgaactgcatcgtcgccgtg

SEQ ID NO: 340573 - DNA, 25 bp, Mus musculus
cgtgaaggctggtaggattttatcc

SEQ ID NO: 340574 - DNA, 25 bp, Mus musculus
cgatttcgcgccaaacttgacggca

SEQ ID NO: 340575 - DNA, 25 bp, Mus musculus
gcctaagctgcgcaagtggtacaca

SEQ ID NO: 340576 - DNA, 25 bp, Mus musculus
cggggccttagctgcacaaatagga

SEQ ID NO: 340577 - DNA, 25 bp, Mus musculus
cccgcagacctgaagaaccggctta

SEQ ID NO: 340578 - DNA, 25 bp, Mus musculus
ctggatcttaggcttcccgcagacc

SEQ ID NO: 340579 - DNA, 25 bp, Mus musculus
gcggagccgtactttaccttctctg

SEQ ID NO: 340580 - DNA, 25 bp, Mus musculus
ccgctgccatcatggttcgaccatt

SEQ ID NO: 340581 - DNA, 25 bp, Mus musculus
atttgacaccgcagctgccagtgtg

SEQ ID NO: 340582 - DNA, 25 bp, Mus musculus
agtgctaggctacgcggggaccact

SEQ ID NO: 340583 - DNA, 25 bp, Mus musculus
gtcgccgccgaatcgtcgacagtca

SEQ ID NO: 340584 - DNA, 25 bp, Mus musculus
agtcacccagctcggacggagcgtc

SEQ ID NO: 340585 - DNA, 25 bp, Mus musculus
cgtccgagcaggagccgatcaggaa

SEQ ID NO: 340586 - DNA, 25 bp, Mus musculus
ccgatcaggaaggtgaaggaccact

SEQ ID NO: 340587 - DNA, 25 bp, Mus musculus
tgaaggaccactgccgagccgacag

SEQ ID NO: 340588 - DNA, 25 bp, Mus musculus
agccgacagcgcgtcccaggtcagt

SEQ ID NO: 340589 - DNA, 25 bp, Mus musculus
agtccgcccgctgcacttggggaaa

SEQ ID NO: 340590 - DNA, 25 bp, Mus musculus
aaactttgggatgcggtgacagctg

SEQ ID NO: 340591 - DNA, 25 bp, Mus musculus
gaacaggcacctgccgcacatttga

SEQ ID NO: 340592 - DNA, 25 bp, Mus musculus
cgattgcaacctcgggctgcaggaa

SEQ ID NO: 340593 - DNA, 25 bp, Mus musculus
acatccttggcaccgggcatccaga

SEQ ID NO: 340594 - DNA, 25 bp, Mus musculus
gaccagtgctgcctgctctctggca

SEQ ID NO: 340595 - DNA, 25 bp, Mus musculus
ggcactccggtttgcaccagccaaa

SEQ ID NO: 340596 - DNA, 25 bp, Mus musculus
acgctgttccaaggacgctcttctg

SEQ ID NO: 340597 - DNA, 25 bp, Mus musculus
gcctcaggaggtgactagtgccaca

SEQ ID NO: 340598 - DNA, 25 bp, Mus musculus
cgcctaggctttcgagagattacaa

SEQ ID NO: 340599 - DNA, 25 bp, Mus musculus
gaaaattagtatccggaccagcttg

SEQ ID NO: 340600 - DNA, 25 bp, Mus musculus
ggccttcgcattttcaccacgagtt

SEQ ID NO: 340601 - DNA, 25 bp, Mus musculus
ctcggaaggagatgcccgatgcctc

SEQ ID NO: 340602 - DNA, 25 bp, Mus musculus
agaagccagctaccctctcggaagg

SEQ ID NO: 340603 - DNA, 25 bp, Mus musculus
ccagagcggctgctgtctaaaacca

SEQ ID NO: 340604 - DNA, 25 bp, Mus musculus
ccctgcacttctggctgtacttctg

SEQ ID NO: 340605 - DNA, 25 bp, Mus musculus
cagctcctaaatgccggtccttggg

SEQ ID NO: 340606 - DNA, 25 bp, Mus musculus
gacactgtatctcacctccgggcag

SEQ ID NO: 340607 - DNA, 25 bp, Mus musculus
ccgcagtgaggcgtgaagagtaacc

SEQ ID NO: 340608 - DNA, 25 bp, Mus musculus
tccgggaggcttgatctatgcgcat

SEQ ID NO: 340609 - DNA, 25 bp, Mus musculus
gcttccagtgcctgcttgcaatatg

SEQ ID NO: 340610 - DNA, 25 bp, Mus musculus
gagcaatgtcgcttcgcacgccgca

SEQ ID NO: 340611 - DNA, 25 bp, Mus musculus
ccgtgtgccatggacgggtaagtcc

SEQ ID NO: 340612 - DNA, 25 bp, Mus musculus
ttgggtcggtttctgctattcctgc

SEQ ID NO: 340613 - DNA, 25 bp, Mus musculus
gcgtctccgccatcttgtgagtcta

SEQ ID NO: 340614 - DNA, 25 bp, Mus musculus
accgcagcgggaaccaatgaggatc

SEQ ID NO: 340615 - DNA, 25 bp, Mus musculus
cttttgaccaatagaaggccctggc

SEQ ID NO: 340616 - DNA, 25 bp, Mus musculus
tctcacgttggaggctaacggcttc

SEQ ID NO: 340617 - DNA, 25 bp, Mus musculus
aggcaacctccagaatgcacgcttc

SEQ ID NO: 340618 - DNA, 25 bp, Mus musculus
tcccacgggtcgaacaaaggctcgc

SEQ ID NO: 340619 - DNA, 25 bp, Mus musculus
cgtttccgtcttccgtcttgactga

SEQ ID NO: 340620 - DNA, 25 bp, Mus musculus
gctcagatggtatcacgtgcgtcta

SEQ ID NO: 340621 - DNA, 25 bp, Mus musculus
tgctgtctggatgcgtttcgccctt

SEQ ID NO: 340622 - DNA, 25 bp, Mus musculus
aaaggctcgctcattggctcagatg

SEQ ID NO: 340623 - DNA, 25 bp, Mus musculus
ctcgagttctggaaaccctgtgggc

SEQ ID NO: 340624 - DNA, 25 bp, Mus musculus
aaggcgatcgcagtcccataccagt

SEQ ID NO: 340625 - DNA, 25 bp, Mus musculus
gcattcgggagggagtcttcctcta

SEQ ID NO: 340626 - DNA, 25 bp, Mus musculus
tttaactaccaaaggcaagcggatc

SEQ ID NO: 340627 - DNA, 25 bp, Mus musculus
tctagtttactggatccggggcgga

SEQ ID NO: 340628 - DNA, 25 bp, Mus musculus
cccgagagcttgtaaagactgcatt

SEQ ID NO: 340629 - DNA, 25 bp, Mus musculus
ccttggtctaactccggcggaagtg

SEQ ID NO: 340630 - DNA, 25 bp, Mus musculus
agaagcccactgtgctgcccggaaa

SEQ ID NO: 340631 - DNA, 25 bp, Mus musculus
caagacgagcttcttcagtcgcgcg

SEQ ID NO: 340632 - DNA, 25 bp, Mus musculus
gcgggttatcagaatcgcggacacc

SEQ ID NO: 340633 - DNA, 25 bp, Mus musculus
ggacaccgacgcgagccaagctcga

SEQ ID NO: 340634 - DNA, 25 bp, Mus musculus
ggatcccatcggttcccaggacgtg

SEQ ID NO: 340635 - DNA, 25 bp, Mus musculus
ctctcggtcagagttccgcgggaac

SEQ ID NO: 340636 - DNA, 25 bp, Mus musculus
cccgaacgtggatctggtagatgcc

SEQ ID NO: 340637 - DNA, 25 bp, Mus musculus
cccatttgccaggaagagcggggac

SEQ ID NO: 340638 - DNA, 25 bp, Mus musculus
ccctgagggctgtgcaggcgacaat

SEQ ID NO: 340639 - DNA, 25 bp, Mus musculus
gcagacacagaagtgtgctgaggaa

SEQ ID NO: 340640 - DNA, 25 bp, Mus musculus
agcggaggaggcctcttctggtccc

SEQ ID NO: 340641 - DNA, 25 bp, Mus musculus
tcttctggtcccctagccttgagca

SEQ ID NO: 340642 - DNA, 25 bp, Mus musculus
aggaagccacttaccctggggtgtg

SEQ ID NO: 340643 - DNA, 25 bp, Mus musculus
agcccgcgctttatggtccagccgc

SEQ ID NO: 340644 - DNA, 25 bp, Mus musculus
ccaccgagggaaacgctggtgtgga

SEQ ID NO: 340645 - DNA, 25 bp, Mus musculus
cagacggaatggaatgaggtggaca

SEQ ID NO: 340646 - DNA, 25 bp, Mus musculus
ctgccacggctgcaggaccaggtgc

SEQ ID NO: 340647 - DNA, 25 bp, Mus musculus
cacggctgcaggaccaggtgcagca

SEQ ID NO: 340648 - DNA, 25 bp, Mus musculus
ggccggcatggtgactcttctgctc

SEQ ID NO: 340649 - DNA, 25 bp, Mus musculus
tgactcttctgctccctgagggctg

SEQ ID NO: 340650 - DNA, 25 bp, Mus musculus
aggcgacaatgtggcgtggctttgc

SEQ ID NO: 340651 - DNA, 25 bp, Mus musculus
ctgcatccgaggtccccaggagcgg

SEQ ID NO: 340652 - DNA, 25 bp, Mus musculus
gagtacttccgggtgacagaggtca

SEQ ID NO: 340653 - DNA, 25 bp, Mus musculus
acttccgggtgacagaggtcagccc

SEQ ID NO: 340654 - DNA, 25 bp, Mus musculus
atggcggcccccatggagctcagct

SEQ ID NO: 340655 - DNA, 25 bp, Mus musculus
gctggggtctcccttcggtccacag

SEQ ID NO: 340656 - DNA, 25 bp, Mus musculus
ggtctcccttcggtccacagcgagt

SEQ ID NO: 340657 - DNA, 25 bp, Mus musculus
cttcggtccacagcgagtccttggt

SEQ ID NO: 340658 - DNA, 25 bp, Mus musculus
ccacagcgagtccttggtggtgctg

SEQ ID NO: 340659 - DNA, 25 bp, Mus musculus
cgggccgcttgcaagcgtcaggtcc

SEQ ID NO: 340660 - DNA, 25 bp, Mus musculus
ttgcaagcgtcaggtcccggcggcc

SEQ ID NO: 340661 - DNA, 25 bp, Mus musculus
cggcgctgttcctgcagttggagaa

SEQ ID NO: 340662 - DNA, 25 bp, Mus musculus
gagagtgggcggtacgagtacttcc

SEQ ID NO: 340663 - DNA, 25 bp, Mus musculus
tcctgcagttggagaagcacacacg

SEQ ID NO: 340664 - DNA, 25 bp, Mus musculus
agttggagaagcacacacgcggccc

SEQ ID NO: 340665 - DNA, 25 bp, Mus musculus
gcagccgacactggagagcgcgttt

SEQ ID NO: 340666 - DNA, 25 bp, Mus musculus
tctcagccaagtttcacgcgcccgg

SEQ ID NO: 340667 - DNA, 25 bp, Mus musculus
aaggtcagacttccggcagccgaca

SEQ ID NO: 340668 - DNA, 25 bp, Mus musculus
atcagcgggagcgaaaggtcagact

SEQ ID NO: 340669 - DNA, 25 bp, Mus musculus
ccggaaaggaatcatcagcgggagc

SEQ ID NO: 340670 - DNA, 25 bp, Mus musculus
tggcgccgcctcctaagttacgtgc

SEQ ID NO: 340671 - DNA, 25 bp, Mus musculus
cacaggacccggaagatcaacgtga

SEQ ID NO: 340672 - DNA, 25 bp, Mus musculus
ccctgtcacaggacccggaagatca

SEQ ID NO: 340673 - DNA, 25 bp, Mus musculus
aggcggcgtagacaaccctgtcaca

SEQ ID NO: 340674 - DNA, 25 bp, Mus musculus
agtcgccgaaaaggcggcgtagaca

SEQ ID NO: 340675 - DNA, 25 bp, Mus musculus
cggagagtcacgagcctaaggccag

SEQ ID NO: 340676 - DNA, 25 bp, Mus musculus
ggaccggggcctgcactcgtgcatc

SEQ ID NO: 340677 - DNA, 25 bp, Mus musculus
aaaacacagcgccagtctcagccaa

SEQ ID NO: 340678 - DNA, 25 bp, Mus musculus
ggcccttccgcagggcagtaggcca

SEQ ID NO: 340679 - DNA, 25 bp, Mus musculus
gattcattcattctccgccgtcggg

SEQ ID NO: 340680 - DNA, 25 bp, Mus musculus
ccgcgagcggggctccattgtgctc

SEQ ID NO: 340681 - DNA, 25 bp, Mus musculus
taatttagcagtacttccggccgcg

SEQ ID NO: 340682 - DNA, 25 bp, Mus musculus
ttagcagtacttccggccgcgtgac

SEQ ID NO: 340683 - DNA, 25 bp, Mus musculus
cccgcacaagctgacgtgagcggag

SEQ ID NO: 340684 - DNA, 25 bp, Mus musculus
ggagcgcgctgacgttgctatttaa

SEQ ID NO: 340685 - DNA, 25 bp, Mus musculus
ggggttgggttctctgattcattca

SEQ ID NO: 340686 - DNA, 25 bp, Mus musculus
gacgagccgccagcctctcgcctca

SEQ ID NO: 340687 - DNA, 25 bp, Mus musculus
cgcgctgacgttgctatttaaaggt

SEQ ID NO: 340688 - DNA, 25 bp, Mus musculus
cggaccgacggaccggccagctcat

SEQ ID NO: 340689 - DNA, 25 bp, Mus musculus
gagacacagcgcgagcacccggcgt

SEQ ID NO: 340690 - DNA, 25 bp, Mus musculus
tgctatttaaaggtccttctgcggg

SEQ ID NO: 340691 - DNA, 25 bp, Mus musculus
ccagctctttccctaatttagcagt

SEQ ID NO: 340692 - DNA, 25 bp, Mus musculus
aggatggagacacagcgcgagcacc

SEQ ID NO: 340693 - DNA, 25 bp, Mus musculus
ccagcgcgaacgacatggtagctcc

SEQ ID NO: 340694 - DNA, 25 bp, Mus musculus
atgcacggctcgcagatcctggaag

SEQ ID NO: 340695 - DNA, 25 bp, Mus musculus
ccagctgcattcttcggccggagac

SEQ ID NO: 340696 - DNA, 25 bp, Mus musculus
tccaggacctcgatctcctcggaga

SEQ ID NO: 340697 - DNA, 25 bp, Mus musculus
tcgcatctcgggattcggcgcttct

SEQ ID NO: 340698 - DNA, 25 bp, Mus musculus
ccgtccggttgtgacaggttatagc

SEQ ID NO: 340699 - DNA, 25 bp, Mus musculus
agacacggctccagctgggagttta

SEQ ID NO: 340700 - DNA, 25 bp, Mus musculus
tgggagtttaccgagcacagctgct

SEQ ID NO: 340701 - DNA, 25 bp, Mus musculus
ctcagaagagacaatacgcggcccg

SEQ ID NO: 340702 - DNA, 25 bp, Mus musculus
actcgagtgtctcctccagcgcgaa

SEQ ID NO: 340703 - DNA, 25 bp, Mus musculus
ttcgatctcgttccaggccacaatg

SEQ ID NO: 340704 - DNA, 25 bp, Mus musculus
gtgcggccggatctgtttacaagcc

SEQ ID NO: 340705 - DNA, 25 bp, Mus musculus
aacttgtgcttctcgcgctcgtcga

SEQ ID NO: 340706 - DNA, 25 bp, Mus musculus
ccggagcaggtagttcacatggtca

SEQ ID NO: 340707 - DNA, 25 bp, Mus musculus
tgggctggaacgacttgggttttca

SEQ ID NO: 340708 - DNA, 25 bp, Mus musculus
gctatcaggtactaggcggcctcca

SEQ ID NO: 340709 - DNA, 25 bp, Mus musculus
ctctgcaggctgctaaggatgggca

SEQ ID NO: 340710 - DNA, 25 bp, Mus musculus
ctaaggatgggcaagcttagcccgt

SEQ ID NO: 340711 - DNA, 25 bp, Mus musculus
tggtcttcgtgctggcggacgacct

SEQ ID NO: 340712 - DNA, 25 bp, Mus musculus
aagcttagcccgtgcactggcagga

SEQ ID NO: 340713 - DNA, 25 bp, Mus musculus
gctcaccggccgctatcaggtacta

SEQ ID NO: 340714 - DNA, 25 bp, Mus musculus
aactactacgtgcagccgctgtgca

SEQ ID NO: 340715 - DNA, 25 bp, Mus musculus
tggtcctggacaactactacgtgca

SEQ ID NO: 340716 - DNA, 25 bp, Mus musculus
gcggcgtggtcctggacaactacta

SEQ ID NO: 340717 - DNA, 25 bp, Mus musculus
gagctacccagcctccgcatgtggt

SEQ ID NO: 340718 - DNA, 25 bp, Mus musculus
ggccgctcagttcccgattctgtcg

SEQ ID NO: 340719 - DNA, 25 bp, Mus musculus
agcctccgcatgtggtcttcgtgct

SEQ ID NO: 340720 - DNA, 25 bp, Mus musculus
ggttttcacggctcggtcatccgca

SEQ ID NO: 340721 - DNA, 25 bp, Mus musculus
ttctcggcgccactaggccgcggag

SEQ ID NO: 340722 - DNA, 25 bp, Mus musculus
tggccaccgagtttatcttctcggc

SEQ ID NO: 340723 - DNA, 25 bp, Mus musculus
cgagaatcccatcgccaaacgccct

SEQ ID NO: 340724 - DNA, 25 bp, Mus musculus
gccaaacgccctgagactgaccaga

SEQ ID NO: 340725 - DNA, 25 bp, Mus musculus
agactgaccagacacccggaaccgg

SEQ ID NO: 340726 - DNA, 25 bp, Mus musculus
agacacccggaaccggcctgaggcg

SEQ ID NO: 340727 - DNA, 25 bp, Mus musculus
cccaagtggccaccgagtttatctt

SEQ ID NO: 340728 - DNA, 25 bp, Mus musculus
gccgcggaggaagatgttttgtccc

SEQ ID NO: 340729 - DNA, 25 bp, Mus musculus
gcagtcacaaaagtgtcgaaagtcc

SEQ ID NO: 340730 - DNA, 25 bp, Mus musculus
gcggaggaagatgttttgtcccacc

SEQ ID NO: 340731 - DNA, 25 bp, Mus musculus
cctgcgggaggacggtaacaggacg

SEQ ID NO: 340732 - DNA, 25 bp, Mus musculus
cccgcgaacgcagcacctcgtagca

SEQ ID NO: 340733 - DNA, 25 bp, Mus musculus
cccgcagtcacaaaagtgtcgaaag

SEQ ID NO: 340734 - DNA, 25 bp, Mus musculus
aagtggccaccgagtttatcttctc

SEQ ID NO: 340735 - DNA, 25 bp, Mus musculus
gccgccgaccctcgtctgctcccgc

SEQ ID NO: 340736 - DNA, 25 bp, Mus musculus
aagttgagcctggaagcgctttttc

SEQ ID NO: 340737 - DNA, 25 bp, Mus musculus
cgcagacgtggaagaagttgagcct

SEQ ID NO: 340738 - DNA, 25 bp, Mus musculus
ttgagcctggaagcgctttttcccg

SEQ ID NO: 340739 - DNA, 25 bp, Mus musculus
aggaaggatccgctgcagcgccggc

SEQ ID NO: 340740 - DNA, 25 bp, Mus musculus
ccgccggggccagatcgaggctgca

SEQ ID NO: 340741 - DNA, 25 bp, Mus musculus
cgcccacactctcccgggccctgta

SEQ ID NO: 340742 - DNA, 25 bp, Mus musculus
cccttctcagggatcgcgcgcgtcg

SEQ ID NO: 340743 - DNA, 25 bp, Mus musculus
cacgataggcactgggacagcgtga

SEQ ID NO: 340744 - DNA, 25 bp, Mus musculus
gccggctctggtccacgataggcac

SEQ ID NO: 340745 - DNA, 25 bp, Mus musculus
cgctttttcccggggagctgtagtg

SEQ ID NO: 340746 - DNA, 25 bp, Mus musculus
gacagcgtgaggagagaaccccgca

SEQ ID NO: 340747 - DNA, 25 bp, Mus musculus
ctctggtccacgataggcactggga

SEQ ID NO: 340748 - DNA, 25 bp, Mus musculus
tccacgataggcactgggacagcgt

SEQ ID NO: 340749 - DNA, 25 bp, Mus musculus
acactgtgcgggacctacgccaaga

SEQ ID NO: 340750 - DNA, 25 bp, Mus musculus
tgtcattgtcacctgccgctcgatg

SEQ ID NO: 340751 - DNA, 25 bp, Mus musculus
tctggaccctcctgagtatcgtggt

SEQ ID NO: 340752 - DNA, 25 bp, Mus musculus
gcctttgctgagctcgttgccttca

SEQ ID NO: 340753 - DNA, 25 bp, Mus musculus
tacctgggcatcctctgcatccgta

SEQ ID NO: 340754 - DNA, 25 bp, Mus musculus
tgccatgcagcaagtctctcgggac

SEQ ID NO: 340755 - DNA, 25 bp, Mus musculus
acagctgtctttctggattgaccca

SEQ ID NO: 340756 - DNA, 25 bp, Mus musculus
cattttcaacgtctgcgggctccta

SEQ ID NO: 340757 - DNA, 25 bp, Mus musculus
ttcattctctgcgtagtggccttgg

SEQ ID NO: 340758 - DNA, 25 bp, Mus musculus
cttctggcaggctaccgctattttc

SEQ ID NO: 340759 - DNA, 25 bp, Mus musculus
gttgccttcatgagcgccgactggc

SEQ ID NO: 340760 - DNA, 25 bp, Mus musculus
ttcaccatgtgcgtgcaaagcatca

SEQ ID NO: 340761 - DNA, 25 bp, Mus musculus
ggctcctacagggaatcgcaggtga

SEQ ID NO: 340762 - DNA, 25 bp, Mus musculus
cgccaagagcttcggggagatagcc

SEQ ID NO: 340763 - DNA, 25 bp, Mus musculus
agctcactgcgcgtcgctgggacct

SEQ ID NO: 340764 - DNA, 25 bp, Mus musculus
cccggcgactaagatctgggcgcag

SEQ ID NO: 340765 - DNA, 25 bp, Mus musculus
cgactaagatctgggcgcagcccgc

SEQ ID NO: 340766 - DNA, 25 bp, Mus musculus
cagcttggcggctcggaaaggctct

SEQ ID NO: 340767 - DNA, 25 bp, Mus musculus
ctccagttctagctccagcttggcg

SEQ ID NO: 340768 - DNA, 25 bp, Mus musculus
ggcgctccagttctagctccagctt

SEQ ID NO: 340769 - DNA, 25 bp, Mus musculus
tcgctgggacctcggcgtcctgcag

SEQ ID NO: 340770 - DNA, 25 bp, Mus musculus
aggctctggactccctcaatctctc

SEQ ID NO: 340771 - DNA, 25 bp, Mus musculus
ccagcgtggtgagccagagcagcac

SEQ ID NO: 340772 - DNA, 25 bp, Mus musculus
cgtacaggaccagcgtggtgagcca

SEQ ID NO: 340773 - DNA, 25 bp, Mus musculus
gcacctctactggtctcccgggtca

SEQ ID NO: 340774 - DNA, 25 bp, Mus musculus
gcggtgctcgcacctctactggtct

SEQ ID NO: 340775 - DNA, 25 bp, Mus musculus
gccgcctcgcaagccaccggtccac

SEQ ID NO: 340776 - DNA, 25 bp, Mus musculus
gcgtcctgcaggagacgctgcccag

SEQ ID NO: 340777 - DNA, 25 bp, Mus musculus
ggaccgcaatctgggtctcgtccct

SEQ ID NO: 340778 - DNA, 25 bp, Mus musculus
tgcgtctcacggtcgccgattcctc

SEQ ID NO: 340779 - DNA, 25 bp, Mus musculus
cttgcgcgtgccttctgtgcgcctt

SEQ ID NO: 340780 - DNA, 25 bp, Mus musculus
agctctttgtctgcgcgctctgcag

SEQ ID NO: 340781 - DNA, 25 bp, Mus musculus
tgtgcggcgcgtgagctctttgtct

SEQ ID NO: 340782 - DNA, 25 bp, Mus musculus
aaagcgcggacacaaagccagggtc

SEQ ID NO: 340783 - DNA, 25 bp, Mus musculus
cggagtcccttgcaaagcgcggaca

SEQ ID NO: 340784 - DNA, 25 bp, Mus musculus
caaggagggcggagtcccttgcaaa

SEQ ID NO: 340785 - DNA, 25 bp, Mus musculus
agcacggttgatctccgggacctag

SEQ ID NO: 340786 - DNA, 25 bp, Mus musculus
cggctcgttcacctggagggagcaa

SEQ ID NO: 340787 - DNA, 25 bp, Mus musculus
gcgcacgcggctcgttcacctggag

SEQ ID NO: 340788 - DNA, 25 bp, Mus musculus
ctccagttgcctccctgcgtctcac

SEQ ID NO: 340789 - DNA, 25 bp, Mus musculus
cgccttgcgcgagcacggttgatct

SEQ ID NO: 340790 - DNA, 25 bp, Mus musculus
ttgatctccgggacctaggagcgcg

SEQ ID NO: 340791 - DNA, 25 bp, Mus musculus
atccggatccgcaaacgggttgctg

SEQ ID NO: 340792 - DNA, 25 bp, Mus musculus
ccagagaggataggaaccctaaagc

SEQ ID NO: 340793 - DNA, 25 bp, Mus musculus
agcaacttaaaacatcgctgcccga

SEQ ID NO: 340794 - DNA, 25 bp, Mus musculus
gtcctccgatcccaggttactgcga

SEQ ID NO: 340795 - DNA, 25 bp, Mus musculus
ttactgcgaagtcacggaaagcggc

SEQ ID NO: 340796 - DNA, 25 bp, Mus musculus
cgaccggactagtggcggccacaca

SEQ ID NO: 340797 - DNA, 25 bp, Mus musculus
tggtgacgctgcgtcccgagaccct

SEQ ID NO: 340798 - DNA, 25 bp, Mus musculus
tagctgaggtgcgaaaacatccgcc

SEQ ID NO: 340799 - DNA, 25 bp, Mus musculus
caagacttggagagcgagtagctga

SEQ ID NO: 340800 - DNA, 25 bp, Mus musculus
gacccacctagtgcggcttggggaa

SEQ ID NO: 340801 - DNA, 25 bp, Mus musculus
cgggttgttgagatccggatccgca

SEQ ID NO: 340802 - DNA, 25 bp, Mus musculus
cgggttgctgtcaaaatccgacatt

SEQ ID NO: 340803 - DNA, 25 bp, Mus musculus
gcgctcaccttgaacgggttgttga

SEQ ID NO: 340804 - DNA, 25 bp, Mus musculus
cgccgcagacaccaaagattccaga

SEQ ID NO: 340805 - DNA, 25 bp, Mus musculus
aggcaaagcttgcaggcggatgatc

SEQ ID NO: 340806 - DNA, 25 bp, Mus musculus
tttcgcctacaacgagcagtcggga

SEQ ID NO: 340807 - DNA, 25 bp, Mus musculus
cgcccgcgatgtctagcaacagttt

SEQ ID NO: 340808 - DNA, 25 bp, Mus musculus
ccgaacgccagccatccgtagagga

SEQ ID NO: 340809 - DNA, 25 bp, Mus musculus
agcttcctgttaagggtcccgagtg

SEQ ID NO: 340810 - DNA, 25 bp, Mus musculus
agggcctcatatccagttctttacg

SEQ ID NO: 340811 - DNA, 25 bp, Mus musculus
cgaaccctggaggatctgagatctc

SEQ ID NO: 340812 - DNA, 25 bp, Mus musculus
tgcaccgcgtttcaggagccatcgg

SEQ ID NO: 340813 - DNA, 25 bp, Mus musculus
aagttcttccgacctgtgcaccgcg

SEQ ID NO: 340814 - DNA, 25 bp, Mus musculus
acgtctagaacgtcaggccactctg

SEQ ID NO: 340815 - DNA, 25 bp, Mus musculus
ccttcggcctcttcagcagcgattg

SEQ ID NO: 340816 - DNA, 25 bp, Mus musculus
atcgcctccgcgcagatcctgaaag

SEQ ID NO: 340817 - DNA, 25 bp, Mus musculus
ggacgcaagcctcgaacttcaagta

SEQ ID NO: 340818 - DNA, 25 bp, Mus musculus
tccgaaggaggagctttcacgtcta

SEQ ID NO: 340819 - DNA, 25 bp, Mus musculus
gcagagtaactctccagctcatttc

SEQ ID NO: 340820 - DNA, 25 bp, Mus musculus
aggaaacagtgctcattgtggggtt

SEQ ID NO: 340821 - DNA, 25 bp, Mus musculus
ggggacttcactgcgccgagccaca

SEQ ID NO: 340822 - DNA, 25 bp, Mus musculus
atcatctagcttttgactaacaaga

SEQ ID NO: 340823 - DNA, 25 bp, Mus musculus
ctgtgaactcgtctttaacctaata

SEQ ID NO: 340824 - DNA, 25 bp, Mus musculus
cacgcgatttaccatctgtgaactc

SEQ ID NO: 340825 - DNA, 25 bp, Mus musculus
agctcatttctctccacgcgattta

SEQ ID NO: 340826 - DNA, 25 bp, Mus musculus
tgcgggcccggcttttgttgcgccc

SEQ ID NO: 340827 - DNA, 25 bp, Mus musculus
agaattgaaaaggaaggccaggagc

SEQ ID NO: 340828 - DNA, 25 bp, Mus musculus
ctcctaattccacctgagatcgggg

SEQ ID NO: 340829 - DNA, 25 bp, Mus musculus
tcgcctcatttactcgcctctttaa

SEQ ID NO: 340830 - DNA, 25 bp, Mus musculus
gaaaggagtcattttgcacactcgc

SEQ ID NO: 340831 - DNA, 25 bp, Mus musculus
cgcctgggtgcagagtaactctcca

SEQ ID NO: 340832 - DNA, 25 bp, Mus musculus
cggagcatgccgtttggttcagaaa

SEQ ID NO: 340833 - DNA, 25 bp, Mus musculus
cgatctcgctcacactacattcaag

SEQ ID NO: 340834 - DNA, 25 bp, Mus musculus
ggcggcaaatacttccgggtgaagc

SEQ ID NO: 340835 - DNA, 25 bp, Mus musculus
gagccagggtgtcgcgcttagccac

SEQ ID NO: 340836 - DNA, 25 bp, Mus musculus
gtgtcgcgcttagccacagcctggc

SEQ ID NO: 340837 - DNA, 25 bp, Mus musculus
ccctttgctttgtttcagttaattg

SEQ ID NO: 340838 - DNA, 25 bp, Mus musculus
gctttgtttcagttaattgggtggc

SEQ ID NO: 340839 - DNA, 25 bp, Mus musculus
gtgaagcgagagagagtcctacgaa

SEQ ID NO: 340840 - DNA, 25 bp, Mus musculus
agtcctacgaatgctccgacttctg

SEQ ID NO: 340841 - DNA, 25 bp, Mus musculus
ctccgacttctggaagtgttcagcc

SEQ ID NO: 340842 - DNA, 25 bp, Mus musculus
gtgcatccgtgcacatcaccgatct

SEQ ID NO: 340843 - DNA, 25 bp, Mus musculus
tgcttggtgtcacgcaagcccaggc

SEQ ID NO: 340844 - DNA, 25 bp, Mus musculus
attcaagtcacacgcctcaagcagg

SEQ ID NO: 340845 - DNA, 25 bp, Mus musculus
agtcacacgcctcaagcaggcaggc

SEQ ID NO: 340846 - DNA, 25 bp, Mus musculus
tgcacgcctgtgcatccgtgcacat

SEQ ID NO: 340847 - DNA, 25 bp, Mus musculus
aggtgcgcacccagccgtgcgcggt

SEQ ID NO: 340848 - DNA, 25 bp, Mus musculus
tgcagaccgccagggctattcacta

SEQ ID NO: 340849 - DNA, 25 bp, Mus musculus
gacagaacaaaaggacggcagcaac

SEQ ID NO: 340850 - DNA, 25 bp, Mus musculus
acaaaaggacggcagcaacgcagcc

SEQ ID NO: 340851 - DNA, 25 bp, Mus musculus
aaggacggcagcaacgcagccgtag

SEQ ID NO: 340852 - DNA, 25 bp, Mus musculus
aacgcagccgtaggggcgagcgcga

SEQ ID NO: 340853 - DNA, 25 bp, Mus musculus
tgtgcagaccgccagggctattcac

SEQ ID NO: 340854 - DNA, 25 bp, Mus musculus
aaggcattggcttcggctcgccgag

SEQ ID NO: 340855 - DNA, 25 bp, Mus musculus
ctaaggcattggcttcggctcgccg

SEQ ID NO: 340856 - DNA, 25 bp, Mus musculus
tcactaaggcattggcttcggctcg

SEQ ID NO: 340857 - DNA, 25 bp, Mus musculus
gccagggctattcactaaggcattg

SEQ ID NO: 340858 - DNA, 25 bp, Mus musculus
agaccgccagggctattcactaagg

SEQ ID NO: 340859 - DNA, 25 bp, Mus musculus
aaagggaccgcttcgctgggagcgc

SEQ ID NO: 340860 - DNA, 25 bp, Mus musculus
accgccagggctattcactaaggca

SEQ ID NO: 340861 - DNA, 25 bp, Mus musculus
cgcggctgacgctcgctcttccctt

SEQ ID NO: 340862 - DNA, 25 bp, Mus musculus
cctcgcgtgaggcagatcaagatca

SEQ ID NO: 340863 - DNA, 25 bp, Mus musculus
tccaggtacgcatgcgcgcactctg

SEQ ID NO: 340864 - DNA, 25 bp, Mus musculus
atgcgcgcactctgggctccacgcc

SEQ ID NO: 340865 - DNA, 25 bp, Mus musculus
ttcctgcggcgccttagggaccatg

SEQ ID NO: 340866 - DNA, 25 bp, Mus musculus
cccgcacacgcctaggctggcgctg

SEQ ID NO: 340867 - DNA, 25 bp, Mus musculus
cttagggaccatggccgatcctcgc

SEQ ID NO: 340868 - DNA, 25 bp, Mus musculus
ccctgaactttgcagtagggaggcg

SEQ ID NO: 340869 - DNA, 25 bp, Mus musculus
gcagatcaagatcaagaccggagta

SEQ ID NO: 340870 - DNA, 25 bp, Mus musculus
tcaagatcaagaccggagtagtgag

SEQ ID NO: 340871 - DNA, 25 bp, Mus musculus
gctcttcccttctcaccgccgggga

SEQ ID NO: 340872 - DNA, 25 bp, Mus musculus
cctggccgccttccgtgcgaggctc

SEQ ID NO: 340873 - DNA, 25 bp, Mus musculus
tcggaggcgtcctccgcgctcgtag

SEQ ID NO: 340874 - DNA, 25 bp, Mus musculus
cgccttagggaccatggccgatcct

SEQ ID NO: 340875 - DNA, 25 bp, Mus musculus
gctgcagcttggctctccgcgggcc

SEQ ID NO: 340876 - DNA, 25 bp, Mus musculus
agaagtccggtctgatcctgcctca

SEQ ID NO: 340877 - DNA, 25 bp, Mus musculus
gaggcgactccacctgctcgcagaa

SEQ ID NO: 340878 - DNA, 25 bp, Mus musculus
ggcgactccacctgctcgcagaagt

SEQ ID NO: 340879 - DNA, 25 bp, Mus musculus
acctgctcgcagaagtccggtctga

SEQ ID NO: 340880 - DNA, 25 bp, Mus musculus
tgctcgcagaagtccggtctgatcc

SEQ ID NO: 340881 - DNA, 25 bp, Mus musculus
gccatccgctcacccagcctgctgt

SEQ ID NO: 340882 - DNA, 25 bp, Mus musculus
agcctgctgtcctccatgtagtctg

SEQ ID NO: 340883 - DNA, 25 bp, Mus musculus
tgctgtcctccatgtagtctgggga

SEQ ID NO: 340884 - DNA, 25 bp, Mus musculus
tccatgtagtctggggaaaggagac

SEQ ID NO: 340885 - DNA, 25 bp, Mus musculus
gacccggctgggctacagagccgcg

SEQ ID NO: 340886 - DNA, 25 bp, Mus musculus
gcccagtggccgctttgcagggcgg

SEQ ID NO: 340887 - DNA, 25 bp, Mus musculus
aagtccggtctgatcctgcctcaca

SEQ ID NO: 340888 - DNA, 25 bp, Mus musculus
gtcctccatgtagtctggggaaagg

SEQ ID NO: 340889 - DNA, 25 bp, Mus musculus
cccgaggctcccaggcgtgctagag

SEQ ID NO: 340890 - DNA, 25 bp, Mus musculus
tcccaggcgtgctagagtcgcctag

SEQ ID NO: 340891 - DNA, 25 bp, Mus musculus
gctagagtcgcctaggctcctccta

SEQ ID NO: 340892 - DNA, 25 bp, Mus musculus
tcacaagcgagtgtgccccggtgca

SEQ ID NO: 340893 - DNA, 25 bp, Mus musculus
gctcctgctaggcccggttggtacc

SEQ ID NO: 340894 - DNA, 25 bp, Mus musculus
gttggtacccgctgcccggcggcca

SEQ ID NO: 340895 - DNA, 25 bp, Mus musculus
tcccgagctgcggagtgagcgttct

SEQ ID NO: 340896 - DNA, 25 bp, Mus musculus
ccggcgctctgcgacacccacgtag

SEQ ID NO: 340897 - DNA, 25 bp, Mus musculus
cgacacccacgtagcccagaccctg

SEQ ID NO: 340898 - DNA, 25 bp, Mus musculus
cagaccctgcactcacaagcgagtg

SEQ ID NO: 340899 - DNA, 25 bp, Mus musculus
accctgcactcacaagcgagtgtgc

SEQ ID NO: 340900 - DNA, 25 bp, Mus musculus
agtgagcgttctccggcgctctgcg

SEQ ID NO: 340901 - DNA, 25 bp, Mus musculus
cagacgcgcgcacccgggttgggca

SEQ ID NO: 340902 - DNA, 25 bp, Mus musculus
agtcgcctaggctcctcctagagcg

SEQ ID NO: 340903 - DNA, 25 bp, Mus musculus
tagatgtacctgtagtgccttcgcc

SEQ ID NO: 340904 - DNA, 25 bp, Mus musculus
gcacgtacctgatacccaacaaaga

SEQ ID NO: 340905 - DNA, 25 bp, Mus musculus
agaccggacgaacgtaatagatgta

SEQ ID NO: 340906 - DNA, 25 bp, Mus musculus
tgttagtctccgagcccgcgacgat

SEQ ID NO: 340907 - DNA, 25 bp, Mus musculus
cagcctggcggttcttgctgttagt

SEQ ID NO: 340908 - DNA, 25 bp, Mus musculus
caagaggccagagcgccacagcctg

SEQ ID NO: 340909 - DNA, 25 bp, Mus musculus
cctgcccagatctacgctaaaatta

SEQ ID NO: 340910 - DNA, 25 bp, Mus musculus
gaggatgtgccgaagctcatgaaaa

SEQ ID NO: 340911 - DNA, 25 bp, Mus musculus
tttagggaacgtgtgctacgaggac

SEQ ID NO: 340912 - DNA, 25 bp, Mus musculus
gggtgtctatttgctgcttaaaagt

SEQ ID NO: 340913 - DNA, 25 bp, Mus musculus
cgcccagcagctaagggtgtctatt

SEQ ID NO: 340914 - DNA, 25 bp, Mus musculus
ctaaaattatatacgccagcgccca

SEQ ID NO: 340915 - DNA, 25 bp, Mus musculus
ctcatgaaaaaagcctgcgaccaga

SEQ ID NO: 340916 - DNA, 25 bp, Mus musculus
gtgccttcgccagggctctaacctg

SEQ ID NO: 340917 - DNA, 25 bp, Mus musculus
gcaggctgccctcctgattggtccc

SEQ ID NO: 340918 - DNA, 25 bp, Mus musculus
ctgacatttgcaggctgccctcctg

SEQ ID NO: 340919 - DNA, 25 bp, Mus musculus
gctgacatttgcaggctgccctcct

SEQ ID NO: 340920 - DNA, 25 bp, Mus musculus
gcccagaggcccagggcgaggccaa

SEQ ID NO: 340921 - DNA, 25 bp, Mus musculus
ggcccagggcgaggccaaggtggcc

SEQ ID NO: 340922 - DNA, 25 bp, Mus musculus
actctccgggcgctgacatttgcag

SEQ ID NO: 340923 - DNA, 25 bp, Mus musculus
ctctccgggcgctgacatttgcagg

SEQ ID NO: 340924 - DNA, 25 bp, Mus musculus
ctccgggcgctgacatttgcaggct

SEQ ID NO: 340925 - DNA, 25 bp, Mus musculus
ccgggcgctgacatttgcaggctgc

SEQ ID NO: 340926 - DNA, 25 bp, Mus musculus
cgggcgctgacatttgcaggctgcc

SEQ ID NO: 340927 - DNA, 25 bp, Mus musculus
gtggccgctgctgctttagcggctg

SEQ ID NO: 340928 - DNA, 25 bp, Mus musculus
ggcgctgacatttgcaggctgccct

SEQ ID NO: 340929 - DNA, 25 bp, Mus musculus
gcgctgacatttgcaggctgccctc

SEQ ID NO: 340930 - DNA, 25 bp, Mus musculus
tgattggtcccctcgccgagctgct

SEQ ID NO: 340931 - DNA, 25 bp, Mus musculus
tggtcaccttcctatgccgggaaca

SEQ ID NO: 340932 - DNA, 25 bp, Mus musculus
tcctatgccgggaacacaacgtgtg

SEQ ID NO: 340933 - DNA, 25 bp, Mus musculus
acgtcacggtggtcaccttcctatg

SEQ ID NO: 340934 - DNA, 25 bp, Mus musculus
ccgggaacacaacgtgtgcacgctg

SEQ ID NO: 340935 - DNA, 25 bp, Mus musculus
aacgtgtgcacgctggtgccacgga

SEQ ID NO: 340936 - DNA, 25 bp, Mus musculus
ccacggagggcagcaggcatatgct

SEQ ID NO: 340937 - DNA, 25 bp, Mus musculus
caggcatatgcttcgtgagtactca

SEQ ID NO: 340938 - DNA, 25 bp, Mus musculus
ttcgtgagtactcagctcggtcgca

SEQ ID NO: 340939 - DNA, 25 bp, Mus musculus
tactcagctcggtcgcaggaggcgt

SEQ ID NO: 340940 - DNA, 25 bp, Mus musculus
ggcgtggcctgtgatggatccccat

SEQ ID NO: 340941 - DNA, 25 bp, Mus musculus
gtccaagggcgaggcgattctttgg

SEQ ID NO: 340942 - DNA, 25 bp, Mus musculus
tggggctggcttatgattcggttcc

SEQ ID NO: 340943 - DNA, 25 bp, Mus musculus
ccgtgtgctgcaggaactgaacgtc

SEQ ID NO: 340944 - DNA, 25 bp, Mus musculus
caggaactgaacgtcacggtggtca

SEQ ID NO: 340945 - DNA, 25 bp, Mus musculus
ggacagtactgatcgagatcccttt

SEQ ID NO: 340946 - DNA, 25 bp, Mus musculus
gccggccaacagcagggccaacaga

SEQ ID NO: 340947 - DNA, 25 bp, Mus musculus
cccgacatcttcatgcgtgaggagc

SEQ ID NO: 340948 - DNA, 25 bp, Mus musculus
aggagcttcgccaagactcactacc

SEQ ID NO: 340949 - DNA, 25 bp, Mus musculus
ccagcacagctcaacgaattggaga

SEQ ID NO: 340950 - DNA, 25 bp, Mus musculus
aacagaaacagaagcgccaccggac

SEQ ID NO: 340951 - DNA, 25 bp, Mus musculus
gtgagcgccaaagacccagacaagc

SEQ ID NO: 340952 - DNA, 25 bp, Mus musculus
gaggacatcaccaccgtgggctcta

SEQ ID NO: 340953 - DNA, 25 bp, Mus musculus
acccggtcgaaggagccactctgct

SEQ ID NO: 340954 - DNA, 25 bp, Mus musculus
tccctcctcaggtatgaaagatgcc

SEQ ID NO: 340955 - DNA, 25 bp, Mus musculus
ggctcctcacgtcgccaggacagta

SEQ ID NO: 340956 - DNA, 25 bp, Mus musculus
aacctctcagggaagtcaccggctc

SEQ ID NO: 340957 - DNA, 25 bp, Mus musculus
tggggctgaagcagaacctctcagg

SEQ ID NO: 340958 - DNA, 25 bp, Mus musculus
ggtatgaaagatgccgccgagcttc

SEQ ID NO: 340959 - DNA, 25 bp, Mus musculus
gcagaaagcatccttcccgccattt

SEQ ID NO: 340960 - DNA, 25 bp, Mus musculus
gccattttacttaccagggagtcga

SEQ ID NO: 340961 - DNA, 25 bp, Mus musculus
acagtgcatcttggtcacacatgga

SEQ ID NO: 340962 - DNA, 25 bp, Mus musculus
cacatggacgtgttcaaggtacagc

SEQ ID NO: 340963 - DNA, 25 bp, Mus musculus
gcattgctaccaaccgcctcatttg

SEQ ID NO: 340964 - DNA, 25 bp, Mus musculus
ggcccaactgatgccatttgattta

SEQ ID NO: 340965 - DNA, 25 bp, Mus musculus
tcactgtccatgcaaccctcgattg

SEQ ID NO: 340966 - DNA, 25 bp, Mus musculus
cgattggcttgcaaaagaccgcttt

SEQ ID NO: 340967 - DNA, 25 bp, Mus musculus
ggagcggacttaggcacttatgtga

SEQ ID NO: 340968 - DNA, 25 bp, Mus musculus
agaggtggtctttcccattttgata

SEQ ID NO: 340969 - DNA, 25 bp, Mus musculus
tctagatccttcaagactggcgttc

SEQ ID NO: 340970 - DNA, 25 bp, Mus musculus
ctgctctgtgcccttggttgttttg

SEQ ID NO: 340971 - DNA, 25 bp, Mus musculus
ggcggacatctacaaccctgcaact

SEQ ID NO: 340972 - DNA, 25 bp, Mus musculus
agctctttctgcatgtgctggtcaa

SEQ ID NO: 340973 - DNA, 25 bp, Mus musculus
cccgatgctgcgctggctgatcgga

SEQ ID NO: 340974 - DNA, 25 bp, Mus musculus
ccggcccgatgctgcgctggctgat

SEQ ID NO: 340975 - DNA, 25 bp, Mus musculus
aacgagacttctgttttcccgctgc

SEQ ID NO: 340976 - DNA, 25 bp, Mus musculus
gtgcgggcgccccaacgagacttct

SEQ ID NO: 340977 - DNA, 25 bp, Mus musculus
cgcctccgccgtcgcggccttcagt

SEQ ID NO: 340978 - DNA, 25 bp, Mus musculus
tgctcactggggacgcggaacctcc

SEQ ID NO: 340979 - DNA, 25 bp, Mus musculus
gagctcttgcgccaaccgcgcggcg

SEQ ID NO: 340980 - DNA, 25 bp, Mus musculus
cgagcgacctgagctcttgcgccaa

SEQ ID NO: 340981 - DNA, 25 bp, Mus musculus
gacatggccgcagcgcacgcccact

SEQ ID NO: 340982 - DNA, 25 bp, Mus musculus
acaagcgctggtcctgcggcgacat

SEQ ID NO: 340983 - DNA, 25 bp, Mus musculus
tttagacaagcgctggtcctgcggc

SEQ ID NO: 340984 - DNA, 25 bp, Mus musculus
cacaggatttagacaagcgctggtc

SEQ ID NO: 340985 - DNA, 25 bp, Mus musculus
gctacacaggatttagacaagcgct

SEQ ID NO: 340986 - DNA, 25 bp, Mus musculus
cgccgtagctacacaggatttagac

SEQ ID NO: 340987 - DNA, 25 bp, Mus musculus
taccttgacgctggtgtagctagtc

SEQ ID NO: 340988 - DNA, 25 bp, Mus musculus
ccaacagccaggatttaccttgacg

SEQ ID NO: 340989 - DNA, 25 bp, Mus musculus
tccgagtcccggcagtagatcacac

SEQ ID NO: 340990 - DNA, 25 bp, Mus musculus
gggcgagttggactcatccgagtcc

SEQ ID NO: 340991 - DNA, 25 bp, Mus musculus
ggccctgcgacacgctgctggtctg

SEQ ID NO: 340992 - DNA, 25 bp, Mus musculus
tcggtctgcacgaagaggccgtgca

SEQ ID NO: 340993 - DNA, 25 bp, Mus musculus
ccacttaaggcagacccgacggata

SEQ ID NO: 340994 - DNA, 25 bp, Mus musculus
gatctgcggactcggacagcgcccg

SEQ ID NO: 340995 - DNA, 25 bp, Mus musculus
agttcagcccgggatctgcggactc

SEQ ID NO: 340996 - DNA, 25 bp, Mus musculus
tgtagctagtctgggtctcggcctc

SEQ ID NO: 340997 - DNA, 25 bp, Mus musculus
cagtagatcacaccgctctgcgaga

SEQ ID NO: 340998 - DNA, 25 bp, Mus musculus
accgctctgcgagacatggatgctg

SEQ ID NO: 340999 - DNA, 25 bp, Mus musculus
agtctgggtggccaccgctctgtcg

SEQ ID NO: 341000 - DNA, 25 bp, Mus musculus
gctgcccagttcagcccgggatctg

SEQ ID NO: 341001 - DNA, 25 bp, Mus musculus
gacaaaatgtctgcgaggagcccgg

SEQ ID NO: 341002 - DNA, 25 bp, Mus musculus
tggacccgctgaatccaagggcttg

SEQ ID NO: 341003 - DNA, 25 bp, Mus musculus
cttccggaaccttctggagcgtctc

SEQ ID NO: 341004 - DNA, 25 bp, Mus musculus
gacaccaggggctgcagtgatctca

SEQ ID NO: 341005 - DNA, 25 bp, Mus musculus
gaatcggccttttccgtccaggaca

SEQ ID NO: 341006 - DNA, 25 bp, Mus musculus
tgcgcccagctgaggatctggaccc

SEQ ID NO: 341007 - DNA, 25 bp, Mus musculus
cgcgcaaattgagcgctgtgtcttt

SEQ ID NO: 341008 - DNA, 25 bp, Mus musculus
acctccgacagatttcaattcgtta

SEQ ID NO: 341009 - DNA, 25 bp, Mus musculus
ccctgcgctattattgcaccgttta

SEQ ID NO: 341010 - DNA, 25 bp, Mus musculus
aaacgctttcagcatccctgcgcta

SEQ ID NO: 341011 - DNA, 25 bp, Mus musculus
gcagagccacggttaaaacgctttc

SEQ ID NO: 341012 - DNA, 25 bp, Mus musculus
ttaacgcgcaaacgtgcagagccac

SEQ ID NO: 341013 - DNA, 25 bp, Mus musculus
caagggcttggaaggttaacgcgca

SEQ ID NO: 341014 - DNA, 25 bp, Mus musculus
acgccacgcaggacctcggggactt

SEQ ID NO: 341015 - DNA, 25 bp, Mus musculus
aagaagagcgctgctccgagctcgc

SEQ ID NO: 341016 - DNA, 25 bp, Mus musculus
cctgccgcctgtgcgggctgcaagt

SEQ ID NO: 341017 - DNA, 25 bp, Mus musculus
ggcctggggctacttccatctggac

SEQ ID NO: 341018 - DNA, 25 bp, Mus musculus
ccagctcagcctaggcaccggatga

SEQ ID NO: 341019 - DNA, 25 bp, Mus musculus
tcagcctaggcaccggatgatgagc

SEQ ID NO: 341020 - DNA, 25 bp, Mus musculus
accggatgatgagcgcctgggccac

SEQ ID NO: 341021 - DNA, 25 bp, Mus musculus
cccaacttccagatgtggacgcggg

SEQ ID NO: 341022 - DNA, 25 bp, Mus musculus
acttccagatgtggacgcgggcgct

SEQ ID NO: 341023 - DNA, 25 bp, Mus musculus
cgctgtgccagcacctgagtgatgt

SEQ ID NO: 341024 - DNA, 25 bp, Mus musculus
cggagctgaagaagagcgctgctcc

SEQ ID NO: 341025 - DNA, 25 bp, Mus musculus
catcatactccgaggcctggggcta

SEQ ID NO: 341026 - DNA, 25 bp, Mus musculus
aggcggccctaatgcaggcggaact

SEQ ID NO: 341027 - DNA, 25 bp, Mus musculus
taatgcaggcggaactcgagctgga

SEQ ID NO: 341028 - DNA, 25 bp, Mus musculus
acctgagtgatgtgcacctgccgga

SEQ ID NO: 341029 - DNA, 25 bp, Mus musculus
cttaggacgacaccggggcccactg

SEQ ID NO: 341030 - DNA, 25 bp, Mus musculus
agcttggggacgaagccgactctac

SEQ ID NO: 341031 - DNA, 25 bp, Mus musculus
tgcggagctcctggttgtcgctctc

SEQ ID NO: 341032 - DNA, 25 bp, Mus musculus
tcgctctcggcgttgcggtagagtc

SEQ ID NO: 341033 - DNA, 25 bp, Mus musculus
tagagtcgctccgtgtgctgcagca

SEQ ID NO: 341034 - DNA, 25 bp, Mus musculus
cggaccgggctgcttaggacgacac

SEQ ID NO: 341035 - DNA, 25 bp, Mus musculus
aagcgacggaaagctagaagggtct

SEQ ID NO: 341036 - DNA, 25 bp, Mus musculus
gctgagccggaaacgctaagccgga

SEQ ID NO: 341037 - DNA, 25 bp, Mus musculus
aagcctctagttccgggctgagccg

SEQ ID NO: 341038 - DNA, 25 bp, Mus musculus
cgaacccagcggaagcctctagttc

SEQ ID NO: 341039 - DNA, 25 bp, Mus musculus
gagaactaaagcgaacccagcggaa

SEQ ID NO: 341040 - DNA, 25 bp, Mus musculus
cccggtgacagtctccgggaagcca

SEQ ID NO: 341041 - DNA, 25 bp, Mus musculus
gaagggtctgatcgcgctggtacac

SEQ ID NO: 341042 - DNA, 25 bp, Mus musculus
gaagccagcggacgggagaactaaa

SEQ ID NO: 341043 - DNA, 25 bp, Mus musculus
tggcacttaggtgtcccggctgatt

SEQ ID NO: 341044 - DNA, 25 bp, Mus musculus
gccatcaaactgctataatccgggg

SEQ ID NO: 341045 - DNA, 25 bp, Mus musculus
agaccctataggacgtagttcgcag

SEQ ID NO: 341046 - DNA, 25 bp, Mus musculus
cagggtccgcgaaaaccaattactg

SEQ ID NO: 341047 - DNA, 25 bp, Mus musculus
cccgaaccacgtcgacgagtagaga

SEQ ID NO: 341048 - DNA, 25 bp, Mus musculus
ccaggattgtttctagcgcgtcttt

SEQ ID NO: 341049 - DNA, 25 bp, Mus musculus
ctcacccggtgcaaggttctcggtc

SEQ ID NO: 341050 - DNA, 25 bp, Mus musculus
aggccgccagaagggtgatacctcc

SEQ ID NO: 341051 - DNA, 25 bp, Mus musculus
cgccaccagtggttcgaaactcgga

SEQ ID NO: 341052 - DNA, 25 bp, Mus musculus
ctcggagccctactctgagcacagg

SEQ ID NO: 341053 - DNA, 25 bp, Mus musculus
ttcccttaacacgagcttcactgag

SEQ ID NO: 341054 - DNA, 25 bp, Mus musculus
atccactgcgatgccaggtaccgta

SEQ ID NO: 341055 - DNA, 25 bp, Mus musculus
acgtgacattcaaaccgcctgagtc

SEQ ID NO: 341056 - DNA, 25 bp, Mus musculus
ttggaagtgcccagaccaggattgt

SEQ ID NO: 341057 - DNA, 25 bp, Mus musculus
tgctccttgaggagaaggggcacca

SEQ ID NO: 341058 - DNA, 25 bp, Mus musculus
tagcagaccgtggaaacgatcaacg

SEQ ID NO: 341059 - DNA, 25 bp, Mus musculus
ccggatgatggacgtgtagcagacc

SEQ ID NO: 341060 - DNA, 25 bp, Mus musculus
agcggcacattccagacccgaactg

SEQ ID NO: 341061 - DNA, 25 bp, Mus musculus
ccgcgacttcttgctccggttggca

SEQ ID NO: 341062 - DNA, 25 bp, Mus musculus
tggatcggatacaccaccgccagga

SEQ ID NO: 341063 - DNA, 25 bp, Mus musculus
cgccaggaaccggtcaatgcttatg

SEQ ID NO: 341064 - DNA, 25 bp, Mus musculus
ctggtcagatatccggaggcgtcct

SEQ ID NO: 341065 - DNA, 25 bp, Mus musculus
tggaggcgtacatgttcccgtaaaa

SEQ ID NO: 341066 - DNA, 25 bp, Mus musculus
gccatggccaggtgcagcatgtaca

SEQ ID NO: 341067 - DNA, 25 bp, Mus musculus
gcatgtacaccacggccggcttctt

SEQ ID NO: 341068 - DNA, 25 bp, Mus musculus
tcctcaagacgaacactgcgatggc

SEQ ID NO: 341069 - DNA, 25 bp, Mus musculus
gtagtacgagtaaaagccttgcatc

SEQ ID NO: 341070 - DNA, 25 bp, Mus musculus
actgccaatcagtgccggagaagta

SEQ ID NO: 341071 - DNA, 25 bp, Mus musculus
cgaaccgtggcgctgagcctccgat

SEQ ID NO: 341072 - DNA, 25 bp, Mus musculus
cgaggtgatcggctagtctgtaacg

SEQ ID NO: 341073 - DNA, 25 bp, Mus musculus
gaccgctgaggagagagccgaaacc

SEQ ID NO: 341074 - DNA, 25 bp, Mus musculus
tgggctctccgagaaacgtcgtcgt

SEQ ID NO: 341075 - DNA, 25 bp, Mus musculus
acgtcgtcgtttctgagagcccaga

SEQ ID NO: 341076 - DNA, 25 bp, Mus musculus
gagagcccagagtgtcctcattagg

SEQ ID NO: 341077 - DNA, 25 bp, Mus musculus
agcggtagcggtcgttctccagacc

SEQ ID NO: 341078 - DNA, 25 bp, Mus musculus
ctcattagggcgagatcgggataca

SEQ ID NO: 341079 - DNA, 25 bp, Mus musculus
aggcgacatggtccgccttcaatca

SEQ ID NO: 341080 - DNA, 25 bp, Mus musculus
ttcaatcaaccaccgcggtggcggt

SEQ ID NO: 341081 - DNA, 25 bp, Mus musculus
cggtggcggttattccagaagtcac

SEQ ID NO: 341082 - DNA, 25 bp, Mus musculus
gtcacaacacagagagcacgcagct

SEQ ID NO: 341083 - DNA, 25 bp, Mus musculus
tctgtaacgccgacggtgggctctc

SEQ ID NO: 341084 - DNA, 25 bp, Mus musculus
gtgcagccctagtccgaaccgtggc

SEQ ID NO: 341085 - DNA, 25 bp, Mus musculus
aggccagcgctaagcctgcgggtaa

SEQ ID NO: 341086 - DNA, 25 bp, Mus musculus
tgccatcctggaaggccagcgctaa

SEQ ID NO: 341087 - DNA, 25 bp, Mus musculus
catgtgcacgctgccatcctggaag

SEQ ID NO: 341088 - DNA, 25 bp, Mus musculus
ggtgcaccatgtgcacgctgccatc

SEQ ID NO: 341089 - DNA, 25 bp, Mus musculus
tctgcagggacagtcggtgcaccat

SEQ ID NO: 341090 - DNA, 25 bp, Mus musculus
aacaccgccatggtctgcagggaca

SEQ ID NO: 341091 - DNA, 25 bp, Mus musculus
ggggctgagctgtagaacaccgcca

SEQ ID NO: 341092 - DNA, 25 bp, Mus musculus
tttagggccggctcatccagcgagc

SEQ ID NO: 341093 - DNA, 25 bp, Mus musculus
ctttaaagtgtacggcagggcatgt

SEQ ID NO: 341094 - DNA, 25 bp, Mus musculus
ctgcatggctttaaagtgtacggca

SEQ ID NO: 341095 - DNA, 25 bp, Mus musculus
ccaggacagctgcatggctttaaag

SEQ ID NO: 341096 - DNA, 25 bp, Mus musculus
ccacgagggccagcgaagtccagga

SEQ ID NO: 341097 - DNA, 25 bp, Mus musculus
catggttatcgatgcccacgagggc

SEQ ID NO: 341098 - DNA, 25 bp, Mus musculus
gcatgctcaccttcccatggttatc

SEQ ID NO: 341099 - DNA, 25 bp, Mus musculus
agcggcagaccgcaccagatgctcg

SEQ ID NO: 341100 - DNA, 25 bp, Mus musculus
gccgtcgcctacttctttctgagta

SEQ ID NO: 341101 - DNA, 25 bp, Mus musculus
cgggaagacagcaagggaccgcaca

SEQ ID NO: 341102 - DNA, 25 bp, Mus musculus
cgagtccaaaagagcatcggccgtg

SEQ ID NO: 341103 - DNA, 25 bp, Mus musculus
acatggatgtgactaggggaacctc

SEQ ID NO: 341104 - DNA, 25 bp, Mus musculus
gaacctctagatctcggcccaaatg

SEQ ID NO: 341105 - DNA, 25 bp, Mus musculus
gcggccgcttcaatgactctcctgg

SEQ ID NO: 341106 - DNA, 25 bp, Mus musculus
gcagctcttacctggctggctcata

SEQ ID NO: 341107 - DNA, 25 bp, Mus musculus
gtggtggtgctccaagtctcttctc

SEQ ID NO: 341108 - DNA, 25 bp, Mus musculus
ccgagggcgacgatcagcaagcgcc

SEQ ID NO: 341109 - DNA, 25 bp, Mus musculus
tctttctgagtagctcggtcggagc

SEQ ID NO: 341110 - DNA, 25 bp, Mus musculus
ttgtcccacccggtgtggttgagct

SEQ ID NO: 341111 - DNA, 25 bp, Mus musculus
tgactctcctgggacgtggagcaag

SEQ ID NO: 341112 - DNA, 25 bp, Mus musculus
cggagctggcgcaacctaaaacttc

SEQ ID NO: 341113 - DNA, 25 bp, Mus musculus
gccgttgcaacgacggcagctcttc

SEQ ID NO: 341114 - DNA, 25 bp, Mus musculus
acggcagctcttcgtgcggcatcct

SEQ ID NO: 341115 - DNA, 25 bp, Mus musculus
ttcgtgcggcatcctgcgctgctct

SEQ ID NO: 341116 - DNA, 25 bp, Mus musculus
cgtggtttccctcgctggccaggct

SEQ ID NO: 341117 - DNA, 25 bp, Mus musculus
gcgctccgatcccacctctgggctg

SEQ ID NO: 341118 - DNA, 25 bp, Mus musculus
cgaacactcacagccgtagcggggc

SEQ ID NO: 341119 - DNA, 25 bp, Mus musculus
cccgttattcaccgcggtgggagcg

SEQ ID NO: 341120 - DNA, 25 bp, Mus musculus
caccggggcaaaagtgaactatctc

SEQ ID NO: 341121 - DNA, 25 bp, Mus musculus
actcacagccgtagcggggccgttg

SEQ ID NO: 341122 - DNA, 25 bp, Mus musculus
aaaagtgaactatctcctccctcgc

SEQ ID NO: 341123 - DNA, 25 bp, Mus musculus
ccggcttctcggagctgaccgctcc

SEQ ID NO: 341124 - DNA, 25 bp, Mus musculus
gctccctcggtgctccttcactcgc

SEQ ID NO: 341125 - DNA, 25 bp, Mus musculus
agatcaacgggagcccgaacactca

SEQ ID NO: 341126 - DNA, 25 bp, Mus musculus
gcgtctcgctgacaccggggcaaaa

SEQ ID NO: 341127 - DNA, 25 bp, Mus musculus
cacgtcacatcagaacctgggttcg

SEQ ID NO: 341128 - DNA, 25 bp, Mus musculus
ccgctttacagagggcgttcaagaa

SEQ ID NO: 341129 - DNA, 25 bp, Mus musculus
gagccgaagattaagtttcccagga

SEQ ID NO: 341130 - DNA, 25 bp, Mus musculus
agggaatggcttttgtcacgtcaca

SEQ ID NO: 341131 - DNA, 25 bp, Mus musculus
ttgtcacgtcacatcagaacctggg

SEQ ID NO: 341132 - DNA, 25 bp, Mus musculus
atcagaacctgggttcgtgtgtcgg

SEQ ID NO: 341133 - DNA, 25 bp, Mus musculus
gagtcctccacacacgagcacagtg

SEQ ID NO: 341134 - DNA, 25 bp, Mus musculus
cacacgagcacagtggaagccagca

SEQ ID NO: 341135 - DNA, 25 bp, Mus musculus
cgagcacagtggaagccagcaggat

SEQ ID NO: 341136 - DNA, 25 bp, Mus musculus
agccagcaggatggggatggctttg

SEQ ID NO: 341137 - DNA, 25 bp, Mus musculus
ctttggtgatgctgaccaaggagcc

SEQ ID NO: 341138 - DNA, 25 bp, Mus musculus
atgctgaccaaggagccgaagatta

SEQ ID NO: 341139 - DNA, 25 bp, Mus musculus
cggccgccgctttacagagggcgtt

SEQ ID NO: 341140 - DNA, 25 bp, Mus musculus
atggcttttgtcacgtcacatcaga

SEQ ID NO: 341141 - DNA, 25 bp, Mus musculus
ggagcctttgacgcacacacgcgcg

SEQ ID NO: 341142 - DNA, 25 bp, Mus musculus
gcgtggcggactgaggttcccgcac

SEQ ID NO: 341143 - DNA, 25 bp, Mus musculus
cagtcgctgccgtctgcacagggcg

SEQ ID NO: 341144 - DNA, 25 bp, Mus musculus
acagggcgcgccacagggcatccat

SEQ ID NO: 341145 - DNA, 25 bp, Mus musculus
gcatccatcactccggagcctttga

SEQ ID NO: 341146 - DNA, 25 bp, Mus musculus
ccttgcggggctgtatttgcatcac

SEQ ID NO: 341147 - DNA, 25 bp, Mus musculus
gctgtatttgcatcacgcccacacg

SEQ ID NO: 341148 - DNA, 25 bp, Mus musculus
ttgcatcacgcccacacgtagaggg

SEQ ID NO: 341149 - DNA, 25 bp, Mus musculus
catcacgcccacacgtagagggtga

SEQ ID NO: 341150 - DNA, 25 bp, Mus musculus
cgctcccatggtccaggcggtactt

SEQ ID NO: 341151 - DNA, 25 bp, Mus musculus
tggtccaggcggtacttccagagct

SEQ ID NO: 341152 - DNA, 25 bp, Mus musculus
cggtacttccagagctggtgactca

SEQ ID NO: 341153 - DNA, 25 bp, Mus musculus
agagctggtgactcagctcctccct

SEQ ID NO: 341154 - DNA, 25 bp, Mus musculus
gggcatccatcactccggagccttt

SEQ ID NO: 341155 - DNA, 25 bp, Mus musculus
tcccggcacagaagaaaaacctagc

SEQ ID NO: 341156 - DNA, 25 bp, Mus musculus
ggactccttactcaccgtttcaggc

SEQ ID NO: 341157 - DNA, 25 bp, Mus musculus
tgggtctcccggcacagaagaaaaa

SEQ ID NO: 341158 - DNA, 25 bp, Mus musculus
aaacctagcacggaacgagcccttg

SEQ ID NO: 341159 - DNA, 25 bp, Mus musculus
gaacgagcccttgccacggttgcgg

SEQ ID NO: 341160 - DNA, 25 bp, Mus musculus
tcggtctgccactctctcctgcagc

SEQ ID NO: 341161 - DNA, 25 bp, Mus musculus
tactcaccgtttcaggcgccgggga

SEQ ID NO: 341162 - DNA, 25 bp, Mus musculus
gcgcagtggtgactcctttgagcta

SEQ ID NO: 341163 - DNA, 25 bp, Mus musculus
ctgcagcgcgcgcagtggtgactcc

SEQ ID NO: 341164 - DNA, 25 bp, Mus musculus
tcctttgagctagtcggcagcgaga

SEQ ID NO: 341165 - DNA, 25 bp, Mus musculus
tgcactgcagccgtcgccttgcgag

SEQ ID NO: 341166 - DNA, 25 bp, Mus musculus
tcctcccttcggtgctgcagtggcg

SEQ ID NO: 341167 - DNA, 25 bp, Mus musculus
gtggctagagtacaagcgatgcgca

SEQ ID NO: 341168 - DNA, 25 bp, Mus musculus
tgccctgagccaccgctctgcactg

SEQ ID NO: 341169 - DNA, 25 bp, Mus musculus
aaacacgcaaggcagaatcggaagc

SEQ ID NO: 341170 - DNA, 25 bp, Mus musculus
agggttctcacgtcccggctcgctg

SEQ ID NO: 341171 - DNA, 25 bp, Mus musculus
tttccggaaagcagcgtcgcacagc

SEQ ID NO: 341172 - DNA, 25 bp, Mus musculus
gctttccggaaagcagcgtcgcaca

SEQ ID NO: 341173 - DNA, 25 bp, Mus musculus
gtcacaaacacgcaaggcagaatcg

SEQ ID NO: 341174 - DNA, 25 bp, Mus musculus
ttccggaaagcagcgtcgcacagcc

SEQ ID NO: 341175 - DNA, 25 bp, Mus musculus
cagcgtcgcacagcccaccatcctc

SEQ ID NO: 341176 - DNA, 25 bp, Mus musculus
atcctcacctgagggttctcacgtc

SEQ ID NO: 341177 - DNA, 25 bp, Mus musculus
acctgagggttctcacgtcccggct

SEQ ID NO: 341178 - DNA, 25 bp, Mus musculus
ggctcgctggctcgtcacaaacacg

SEQ ID NO: 341179 - DNA, 25 bp, Mus musculus
gctggctcgtcacaaacacgcaagg

SEQ ID NO: 341180 - DNA, 25 bp, Mus musculus
tggctcgtcacaaacacgcaaggca

SEQ ID NO: 341181 - DNA, 25 bp, Mus musculus
gctcgtcacaaacacgcaaggcaga

SEQ ID NO: 341182 - DNA, 25 bp, Mus musculus
tcacctgagggttctcacgtcccgg

SEQ ID NO: 341183 - DNA, 25 bp, Mus musculus
agcggcttccctgttcagctttctc

SEQ ID NO: 341184 - DNA, 25 bp, Mus musculus
gcagcgcagcggcttccctgttcag

SEQ ID NO: 341185 - DNA, 25 bp, Mus musculus
gagcgccagccttcccagaatgcag

SEQ ID NO: 341186 - DNA, 25 bp, Mus musculus
gacggagcgccagccttcccagaat

SEQ ID NO: 341187 - DNA, 25 bp, Mus musculus
ctaggattgcgactacaactcccag

SEQ ID NO: 341188 - DNA, 25 bp, Mus musculus
ccagttgcctaggattgcgactaca

SEQ ID NO: 341189 - DNA, 25 bp, Mus musculus
gacacacaccagttgcctaggattg

SEQ ID NO: 341190 - DNA, 25 bp, Mus musculus
ccaggacacacaccagttgcctagg

SEQ ID NO: 341191 - DNA, 25 bp, Mus musculus
aaccagcctttaggcgcgcccagga

SEQ ID NO: 341192 - DNA, 25 bp, Mus musculus
cctaggcaaccagcctttaggcgcg

SEQ ID NO: 341193 - DNA, 25 bp, Mus musculus
agcccacttgccttcagaaggttcc

SEQ ID NO: 341194 - DNA, 25 bp, Mus musculus
gcaactctcaaaagaagcccacttg

SEQ ID NO: 341195 - DNA, 25 bp, Mus musculus
ggggcacgcaactctcaaaagaagc

SEQ ID NO: 341196 - DNA, 25 bp, Mus musculus
acggaaaggggcacgcaactctcaa

SEQ ID NO: 341197 - DNA, 25 bp, Mus musculus
tgtcgcgtctccatgtcggataacc

SEQ ID NO: 341198 - DNA, 25 bp, Mus musculus
cgcgtctccatgtcggataaccaga

SEQ ID NO: 341199 - DNA, 25 bp, Mus musculus
tctccatgtcggataaccagagctg

SEQ ID NO: 341200 - DNA, 25 bp, Mus musculus
tgtcggataaccagagctggaactc

SEQ ID NO: 341201 - DNA, 25 bp, Mus musculus
cggataaccagagctggaactcgtc

SEQ ID NO: 341202 - DNA, 25 bp, Mus musculus
taaccagagctggaactcgtcgggc

SEQ ID NO: 341203 - DNA, 25 bp, Mus musculus
accgtggatccgctgccgggactca

SEQ ID NO: 341204 - DNA, 25 bp, Mus musculus
ctcagcaaggtgagctgccccgcgg

SEQ ID NO: 341205 - DNA, 25 bp, Mus musculus
gaggatccggagacggagtccgggc

SEQ ID NO: 341206 - DNA, 25 bp, Mus musculus
aactcgtcgggctcggaggaggatc

SEQ ID NO: 341207 - DNA, 25 bp, Mus musculus
ccagagctggaactcgtcgggctcg

SEQ ID NO: 341208 - DNA, 25 bp, Mus musculus
ggactggaggcaccgactgtcccgg

SEQ ID NO: 341209 - DNA, 25 bp, Mus musculus
ctgctcggctgtcgcgtctccatgt

SEQ ID NO: 341210 - DNA, 25 bp, Mus musculus
gctgtcgcgtctccatgtcggataa

SEQ ID NO: 341211 - DNA, 25 bp, Mus musculus
ggcccactaggaagagcacaacctg

SEQ ID NO: 341212 - DNA, 25 bp, Mus musculus
tgcagcctacatctccatcacttta

SEQ ID NO: 341213 - DNA, 25 bp, Mus musculus
tcactttaaagacgggtcctgccgc

SEQ ID NO: 341214 - DNA, 25 bp, Mus musculus
gcggatcgggtcaatttgcagccta

SEQ ID NO: 341215 - DNA, 25 bp, Mus musculus
gctgtgcctgtacagacctcgcatc

SEQ ID NO: 341216 - DNA, 25 bp, Mus musculus
ctgccaggcactcgtacacggatga

SEQ ID NO: 341217 - DNA, 25 bp, Mus musculus
aactcagagtttgacctgcagggtc

SEQ ID NO: 341218 - DNA, 25 bp, Mus musculus
gccttcctattggtctccgagccga

SEQ ID NO: 341219 - DNA, 25 bp, Mus musculus
cggcagagccaaccaatgacgggtc

SEQ ID NO: 341220 - DNA, 25 bp, Mus musculus
gacggcctacgtcacgaacggtctc

SEQ ID NO: 341221 - DNA, 25 bp, Mus musculus
gggccgccaataaggaaggatcgtc

SEQ ID NO: 341222 - DNA, 25 bp, Mus musculus
cctgggcgtgaacccttgttctcta

SEQ ID NO: 341223 - DNA, 25 bp, Mus musculus
ccaccgtgttagagttggagcgtga

SEQ ID NO: 341224 - DNA, 25 bp, Mus musculus
tccggatctcaatggaggccaagcc

SEQ ID NO: 341225 - DNA, 25 bp, Mus musculus
cgacgaccatgctgcctattgtgtg

SEQ ID NO: 341226 - DNA, 25 bp, Mus musculus
tggattttggcgtcttcggcgccca

SEQ ID NO: 341227 - DNA, 25 bp, Mus musculus
ttttggcgtcttcggcgcccagaga

SEQ ID NO: 341228 - DNA, 25 bp, Mus musculus
attgtgtgtggattttggcgtcttc

SEQ ID NO: 341229 - DNA, 25 bp, Mus musculus
cctattgtgtgtggattttggcgtc

SEQ ID NO: 341230 - DNA, 25 bp, Mus musculus
gaccatgctgcctattgtgtgtgga

SEQ ID NO: 341231 - DNA, 25 bp, Mus musculus
ttcgacgaccatgctgcctattgtg

SEQ ID NO: 341232 - DNA, 25 bp, Mus musculus
gcttcgacgaccatgctgcctattg

SEQ ID NO: 341233 - DNA, 25 bp, Mus musculus
tgaccaagcttcgacgaccatgctg

SEQ ID NO: 341234 - DNA, 25 bp, Mus musculus
gcgtgaccaagcttcgacgaccatg

SEQ ID NO: 341235 - DNA, 25 bp, Mus musculus
agcaggcgtgaccaagcttcgacga

SEQ ID NO: 341236 - DNA, 25 bp, Mus musculus
agagcaggcgtgaccaagcttcgac

SEQ ID NO: 341237 - DNA, 25 bp, Mus musculus
ttgcgcgcgcagcactgtggtgtgc

SEQ ID NO: 341238 - DNA, 25 bp, Mus musculus
tgctgcctattgtgtgtggattttg

SEQ ID NO: 341239 - DNA, 25 bp, Mus musculus
agagccgcgccaggaaacttcggtc

SEQ ID NO: 341240 - DNA, 25 bp, Mus musculus
tctgcccacgcctagttgtgtcttg

SEQ ID NO: 341241 - DNA, 25 bp, Mus musculus
agcgtccagcagatgccgcagcttc

SEQ ID NO: 341242 - DNA, 25 bp, Mus musculus
aggtcaagttttcctgccgcagagc

SEQ ID NO: 341243 - DNA, 25 bp, Mus musculus
cagggacgagcttcctgcgttttaa

SEQ ID NO: 341244 - DNA, 25 bp, Mus musculus
agcttcaggttgagtgtgtcccagc

SEQ ID NO: 341245 - DNA, 25 bp, Mus musculus
gaggtcctgggagaatcaagcttca

SEQ ID NO: 341246 - DNA, 25 bp, Mus musculus
ggctccacgcgggatttctccagag

SEQ ID NO: 341247 - DNA, 25 bp, Mus musculus
ccgggactaactggatctaggcttc

SEQ ID NO: 341248 - DNA, 25 bp, Mus musculus
cctctccgggactttggacaaatca

SEQ ID NO: 341249 - DNA, 25 bp, Mus musculus
agacgtgagttgctttgtcaccgcc

SEQ ID NO: 341250 - DNA, 25 bp, Mus musculus
ctgcatccgaccaagggcgagtcct

SEQ ID NO: 341251 - DNA, 25 bp, Mus musculus
gcccagagtggaatagcagacgtga

SEQ ID NO: 341252 - DNA, 25 bp, Mus musculus
agcttcgcaaccgtgagtggtaccc

SEQ ID NO: 341253 - DNA, 25 bp, Mus musculus
ctctaccactgctgcgcgcgcccag

SEQ ID NO: 341254 - DNA, 25 bp, Mus musculus
gaacgacctcgttctggcctgcgct

SEQ ID NO: 341255 - DNA, 25 bp, Mus musculus
cgagcaaggctgctctgcgcccgcc

SEQ ID NO: 341256 - DNA, 25 bp, Mus musculus
tctttggggtccaagcaaggtgccc

SEQ ID NO: 341257 - DNA, 25 bp, Mus musculus
cgcgttccctcagcgcgggaagttt

SEQ ID NO: 341258 - DNA, 25 bp, Mus musculus
cctcagcgcgggaagtttagtaagt

SEQ ID NO: 341259 - DNA, 25 bp, Mus musculus
agtttagtaagtgtggggactctgc

SEQ ID NO: 341260 - DNA, 25 bp, Mus musculus
actctgcggcgacaagggaacgacc

SEQ ID NO: 341261 - DNA, 25 bp, Mus musculus
tggcctgcgctcagttggctgcgcc

SEQ ID NO: 341262 - DNA, 25 bp, Mus musculus
acgtgtcgcgcgcagagccatcact

SEQ ID NO: 341263 - DNA, 25 bp, Mus musculus
gtcgcgcgcagagccatcactgggc

SEQ ID NO: 341264 - DNA, 25 bp, Mus musculus
gccgcctttgtgtgcacctcacaac

SEQ ID NO: 341265 - DNA, 25 bp, Mus musculus
acacgggagccagcaggggacccac

SEQ ID NO: 341266 - DNA, 25 bp, Mus musculus
caggggacccacttactgccggagt

SEQ ID NO: 341267 - DNA, 25 bp, Mus musculus
tgcagccgctaagttccaaaccctt

SEQ ID NO: 341268 - DNA, 25 bp, Mus musculus
agttccaaacccttggagccgcaga

SEQ ID NO: 341269 - DNA, 25 bp, Mus musculus
tgactggcgatgaggagagccatcc

SEQ ID NO: 341270 - DNA, 25 bp, Mus musculus
agacgcgacggacaccgaacccgag

SEQ ID NO: 341271 - DNA, 25 bp, Mus musculus
cgaggagacgcgacggacaccgaac

SEQ ID NO: 341272 - DNA, 25 bp, Mus musculus
cggcacagcgcggacagggaagcgc

SEQ ID NO: 341273 - DNA, 25 bp, Mus musculus
cggcccagcgcactcaccgagagct

SEQ ID NO: 341274 - DNA, 25 bp, Mus musculus
tcagcggcggcaggccctgaaccga

SEQ ID NO: 341275 - DNA, 25 bp, Mus musculus
atgaggagagccatcccgtaggaag

SEQ ID NO: 341276 - DNA, 25 bp, Mus musculus
cgggccggctttacaagtaagagcg

SEQ ID NO: 341277 - DNA, 25 bp, Mus musculus
ctttacaagtaagagcgagtgcaaa

SEQ ID NO: 341278 - DNA, 25 bp, Mus musculus
aagagcgagtgcaaaattatataca

SEQ ID NO: 341279 - DNA, 25 bp, Mus musculus
attatatacatgatgactggcgatg

SEQ ID NO: 341280 - DNA, 25 bp, Mus musculus
caaacccttggagccgcagagccgg

SEQ ID NO: 341281 - DNA, 25 bp, Mus musculus
cgatttttccagaggcccgaggcgg

SEQ ID NO: 341282 - DNA, 25 bp, Mus musculus
aagccaaggtcactctttaatacgg

SEQ ID NO: 341283 - DNA, 25 bp, Mus musculus
ccggctaagccaaggtcactcttta

SEQ ID NO: 341284 - DNA, 25 bp, Mus musculus
tactcgcttctattcccggctaagc

SEQ ID NO: 341285 - DNA, 25 bp, Mus musculus
gcggcttactcgcttctattcccgg

SEQ ID NO: 341286 - DNA, 25 bp, Mus musculus
aaaggagccggctcgctcagcgcga

SEQ ID NO: 341287 - DNA, 25 bp, Mus musculus
gaccttaaaggagccggctcgctca

SEQ ID NO: 341288 - DNA, 25 bp, Mus musculus
tcgaccttaaaggagccggctcgct

SEQ ID NO: 341289 - DNA, 25 bp, Mus musculus
gatgccgcgcaggtcgaccttaaag

SEQ ID NO: 341290 - DNA, 25 bp, Mus musculus
ttctattcccggctaagccaaggtc

SEQ ID NO: 341291 - DNA, 25 bp, Mus musculus
ggcgatttttccagaggcccgaggc

SEQ ID NO: 341292 - DNA, 25 bp, Mus musculus
tcactctttaatacggcccgaccga

SEQ ID NO: 341293 - DNA, 25 bp, Mus musculus
cgcgcaggtcgaccttaaaggagcc

SEQ ID NO: 341294 - DNA, 25 bp, Mus musculus
gcttactcgcttctattcccggcta

SEQ ID NO: 341295 - DNA, 25 bp, Mus musculus
gtattgtatggagtcctcgcttctc

SEQ ID NO: 341296 - DNA, 25 bp, Mus musculus
tctcttagaattcgggtcactgctg

SEQ ID NO: 341297 - DNA, 25 bp, Mus musculus
gcccatcacgcagagcttggagaga

SEQ ID NO: 341298 - DNA, 25 bp, Mus musculus
ttcgggtcactgctgttccgtccca

SEQ ID NO: 341299 - DNA, 25 bp, Mus musculus
tgttccgtcccagggttctcagccg

SEQ ID NO: 341300 - DNA, 25 bp, Mus musculus
ggatctgggtcgtattttactacga

SEQ ID NO: 341301 - DNA, 25 bp, Mus musculus
gtgcatgggcaagaatgacggaata

SEQ ID NO: 341302 - DNA, 25 bp, Mus musculus
tgacggaatagatgaatcccttctg

SEQ ID NO: 341303 - DNA, 25 bp, Mus musculus
ccttctgggaatttacgcggctatc

SEQ ID NO: 341304 - DNA, 25 bp, Mus musculus
acgcggctatcttatcaaaagtaga

SEQ ID NO: 341305 - DNA, 25 bp, Mus musculus
tagactctaacgtaaccacctgatg

SEQ ID NO: 341306 - DNA, 25 bp, Mus musculus
aacgtaaccacctgatgccggtctc

SEQ ID NO: 341307 - DNA, 25 bp, Mus musculus
ggagtcctcgcttctcttagaattc

SEQ ID NO: 341308 - DNA, 25 bp, Mus musculus
tttactacgattattgtgcatgggc

SEQ ID NO: 341309 - DNA, 25 bp, Mus musculus
ttaccatgatgacagccgcggagca

SEQ ID NO: 341310 - DNA, 25 bp, Mus musculus
tcgtagctgctactgacagcgggtt

SEQ ID NO: 341311 - DNA, 25 bp, Mus musculus
tctgccactgctgacctcgtagctg

SEQ ID NO: 341312 - DNA, 25 bp, Mus musculus
gcggacactagcagaaccagccagg

SEQ ID NO: 341313 - DNA, 25 bp, Mus musculus
cttttgtaagctgggagatccgcgg

SEQ ID NO: 341314 - DNA, 25 bp, Mus musculus
agacgccaccggaactgcttagagg

SEQ ID NO: 341315 - DNA, 25 bp, Mus musculus
ggagaattttagctgagacgccacc

SEQ ID NO: 341316 - DNA, 25 bp, Mus musculus
tcctaggcagatgggcggaaattga

SEQ ID NO: 341317 - DNA, 25 bp, Mus musculus
tgacgtctttccgttcctaggcaga

SEQ ID NO: 341318 - DNA, 25 bp, Mus musculus
cgcacagcagttccgtgacgtcttt

SEQ ID NO: 341319 - DNA, 25 bp, Mus musculus
tggatgtcactggtccacgagcctg

SEQ ID NO: 341320 - DNA, 25 bp, Mus musculus
aggaggcctccttaccatgatgaca

SEQ ID NO: 341321 - DNA, 25 bp, Mus musculus
acagcgggttccagacgagcactcc

SEQ ID NO: 341322 - DNA, 25 bp, Mus musculus
cctcgttcagcccaggacgggaaag

SEQ ID NO: 341323 - DNA, 25 bp, Mus musculus
ccatagcgcaggttgcagtcgggcc

SEQ ID NO: 341324 - DNA, 25 bp, Mus musculus
gaaagcatccgtgcccgggtcacca

SEQ ID NO: 341325 - DNA, 25 bp, Mus musculus
tcaccaagtcagatgaccgagctcc

SEQ ID NO: 341326 - DNA, 25 bp, Mus musculus
acagccgcgggaacatctgcaccga

SEQ ID NO: 341327 - DNA, 25 bp, Mus musculus
aacatctgcaccgagcgcgggaagg

SEQ ID NO: 341328 - DNA, 25 bp, Mus musculus
agggccagcgacactagcgacacca

SEQ ID NO: 341329 - DNA, 25 bp, Mus musculus
tgcggcatgactgctccgcgagtct

SEQ ID NO: 341330 - DNA, 25 bp, Mus musculus
cgagtctggctaggcagtctttgga

SEQ ID NO: 341331 - DNA, 25 bp, Mus musculus
gcagtctttggaccaaccttccagt

SEQ ID NO: 341332 - DNA, 25 bp, Mus musculus
aaccttccagtctgggtcgctggga

SEQ ID NO: 341333 - DNA, 25 bp, Mus musculus
tcgctgggaagaaagcatccgtgcc

SEQ ID NO: 341334 - DNA, 25 bp, Mus musculus
acgcctcctgtagcagcgagcagga

SEQ ID NO: 341335 - DNA, 25 bp, Mus musculus
actgtggtcgatgctgaagtcctcc

SEQ ID NO: 341336 - DNA, 25 bp, Mus musculus
tcctccgcggagatgtacaacagcc

SEQ ID NO: 341337 - DNA, 25 bp, Mus musculus
ggccagccgccactactgtaagttt

SEQ ID NO: 341338 - DNA, 25 bp, Mus musculus
tgcccgcgtagtggacgcgcttcct

SEQ ID NO: 341339 - DNA, 25 bp, Mus musculus
gcgcaacttataggccggcgcacgg

SEQ ID NO: 341340 - DNA, 25 bp, Mus musculus
ccgtagcagcagatccggagaccga

SEQ ID NO: 341341 - DNA, 25 bp, Mus musculus
gaggtcagctgcctgccgaaaccag

SEQ ID NO: 341342 - DNA, 25 bp, Mus musculus
ccgaggcaagaaccgcagccggttg

SEQ ID NO: 341343 - DNA, 25 bp, Mus musculus
actactgtaagtttgccctgcaacc

SEQ ID NO: 341344 - DNA, 25 bp, Mus musculus
gcttaagcccaggaggtgctctcga

SEQ ID NO: 341345 - DNA, 25 bp, Mus musculus
tgctctcgaggcagaacagtcgctg

SEQ ID NO: 341346 - DNA, 25 bp, Mus musculus
cggcactgggagagcaacttgcctc

SEQ ID NO: 341347 - DNA, 25 bp, Mus musculus
cctctgcggtgtaacgcccgggcaa

SEQ ID NO: 341348 - DNA, 25 bp, Mus musculus
tggggataatatcccggctcctagc

SEQ ID NO: 341349 - DNA, 25 bp, Mus musculus
cggctcctagcagtctccaggaagc

SEQ ID NO: 341350 - DNA, 25 bp, Mus musculus
gccaccgcttcctggaacagagacg

SEQ ID NO: 341351 - DNA, 25 bp, Mus musculus
tcccgtttgcgcttcacagctgctg

SEQ ID NO: 341352 - DNA, 25 bp, Mus musculus
tcgggaacgccaggagccctggcca

SEQ ID NO: 341353 - DNA, 25 bp, Mus musculus
ggatggctcccgtaatccgccttta

SEQ ID NO: 341354 - DNA, 25 bp, Mus musculus
gacaagagggatggctcccgtaatc

SEQ ID NO: 341355 - DNA, 25 bp, Mus musculus
gtgggcaaacttcgcccagggctgc

SEQ ID NO: 341356 - DNA, 25 bp, Mus musculus
ctgagaactccggtgggcaaacttc

SEQ ID NO: 341357 - DNA, 25 bp, Mus musculus
agagtgcagcctttcaccacctctg

SEQ ID NO: 341358 - DNA, 25 bp, Mus musculus
gccgacagagtgcagcctttcacca

SEQ ID NO: 341359 - DNA, 25 bp, Mus musculus
ctcgggctgcccagccgacagagtg

SEQ ID NO: 341360 - DNA, 25 bp, Mus musculus
caggtaccaggaggcggcgcccatt

SEQ ID NO: 341361 - DNA, 25 bp, Mus musculus
gcagcgccatgcacttgttgccatc

SEQ ID NO: 341362 - DNA, 25 bp, Mus musculus
acccggcagcgccatgcacttgttg

SEQ ID NO: 341363 - DNA, 25 bp, Mus musculus
gtttgcgcttcacagctgctgcctc

SEQ ID NO: 341364 - DNA, 25 bp, Mus musculus
ccgcctttacctggagctgtggctc

SEQ ID NO: 341365 - DNA, 25 bp, Mus musculus
ggcgatccatggttctccgagagga

SEQ ID NO: 341366 - DNA, 25 bp, Mus musculus
ggaccgatctggctaggccaggcca

SEQ ID NO: 341367 - DNA, 25 bp, Mus musculus
gataaaagataggaagtgacgtctg

SEQ ID NO: 341368 - DNA, 25 bp, Mus musculus
ctgggctttttccagaggagataaa

SEQ ID NO: 341369 - DNA, 25 bp, Mus musculus
cttcaccgaacgctctgggcttttt

SEQ ID NO: 341370 - DNA, 25 bp, Mus musculus
atccctgggagtcgtctcgccttca

SEQ ID NO: 341371 - DNA, 25 bp, Mus musculus
aaacaagaagcgatccctgggagtc

SEQ ID NO: 341372 - DNA, 25 bp, Mus musculus
ggcgctagggaaacaagaagcgatc

SEQ ID NO: 341373 - DNA, 25 bp, Mus musculus
tgacccggaactgaggcgatccatg

SEQ ID NO: 341374 - DNA, 25 bp, Mus musculus
cgctctccaatgacccggaactgag

SEQ ID NO: 341375 - DNA, 25 bp, Mus musculus
agaactacaagaaagcgccctggtg

SEQ ID NO: 341376 - DNA, 25 bp, Mus musculus
gcgcagaaggtttacgacccaaaga

SEQ ID NO: 341377 - DNA, 25 bp, Mus musculus
cggacagtccaggagccggaaacgc

SEQ ID NO: 341378 - DNA, 25 bp, Mus musculus
tcgctcaaaatcacgcggacagtcc

SEQ ID NO: 341379 - DNA, 25 bp, Mus musculus
tctttcctttcgtccagcggcgggc

SEQ ID NO: 341380 - DNA, 25 bp, Mus musculus
accttgtcggagtggaaatggcgcc

SEQ ID NO: 341381 - DNA, 25 bp, Mus musculus
gcggtacctgagactcccgtcctcg

SEQ ID NO: 341382 - DNA, 25 bp, Mus musculus
tccgtcgcatcgctttcctcagctc

SEQ ID NO: 341383 - DNA, 25 bp, Mus musculus
tcctgggaaaggccgcggatagatc

SEQ ID NO: 341384 - DNA, 25 bp, Mus musculus
acacacgcggggacgcaagatggca

SEQ ID NO: 341385 - DNA, 25 bp, Mus musculus
aggccggaagtaacgcgacgccact

SEQ ID NO: 341386 - DNA, 25 bp, Mus musculus
gacgccacttcctccagaattcagg

SEQ ID NO: 341387 - DNA, 25 bp, Mus musculus
ccagaattcaggaagcggagttggc

SEQ ID NO: 341388 - DNA, 25 bp, Mus musculus
aaggcgcacacacgcggggacgcaa

SEQ ID NO: 341389 - DNA, 25 bp, Mus musculus
ctaaggttcacgctcagggggtctc

SEQ ID NO: 341390 - DNA, 25 bp, Mus musculus
cttttttctgtaccttgtcggagtg

SEQ ID NO: 341391 - DNA, 25 bp, Mus musculus
gtctcgggcagaccagctgagagaa

SEQ ID NO: 341392 - DNA, 25 bp, Mus musculus
tgtttctttcctttcgtccagcggc

SEQ ID NO: 341393 - DNA, 25 bp, Mus musculus
ttcggctaccggtcacacgcgctgg

SEQ ID NO: 341394 - DNA, 25 bp, Mus musculus
tcttacgccggggaggacgatctcg

SEQ ID NO: 341395 - DNA, 25 bp, Mus musculus
aggacgatctcgaggacctggagga

SEQ ID NO: 341396 - DNA, 25 bp, Mus musculus
ggcgctaagaatccgctggtgaagc

SEQ ID NO: 341397 - DNA, 25 bp, Mus musculus
gctcgacccggagtccgcagatatg

SEQ ID NO: 341398 - DNA, 25 bp, Mus musculus
taagaatccgctggtgaagccgccc

SEQ ID NO: 341399 - DNA, 25 bp, Mus musculus
tcccggttgccgagctcggcccagc

SEQ ID NO: 341400 - DNA, 25 bp, Mus musculus
tgcgcctacggcctgcagctgccac

SEQ ID NO: 341401 - DNA, 25 bp, Mus musculus
gctacggagcctacggctgcgccta

SEQ ID NO: 341402 - DNA, 25 bp, Mus musculus
cctgcggctacggagcctacggctg

SEQ ID NO: 341403 - DNA, 25 bp, Mus musculus
cgcttcaagcgccagccgctactcg

SEQ ID NO: 341404 - DNA, 25 bp, Mus musculus
gtccgcagatatgttcgacaacggc

SEQ ID NO: 341405 - DNA, 25 bp, Mus musculus
gccctttgcaggcggccgcagtcaa

SEQ ID NO: 341406 - DNA, 25 bp, Mus musculus
acccggagtccgcagatatgttcga

SEQ ID NO: 341407 - DNA, 25 bp, Mus musculus
aacttcacgggtgacgcgctgctgc

SEQ ID NO: 341408 - DNA, 25 bp, Mus musculus
gtcggtggtgcagcgcataaacagt

SEQ ID NO: 341409 - DNA, 25 bp, Mus musculus
acaatgttcccaccgcccgtgaagg

SEQ ID NO: 341410 - DNA, 25 bp, Mus musculus
acaggctctccgtggacgtcagcac

SEQ ID NO: 341411 - DNA, 25 bp, Mus musculus
gcgccactctaccacgcagccggca

SEQ ID NO: 341412 - DNA, 25 bp, Mus musculus
accgcccgtgaaggcgatgtcagcc

SEQ ID NO: 341413 - DNA, 25 bp, Mus musculus
tgacgcgctgctgccatctgcagca

SEQ ID NO: 341414 - DNA, 25 bp, Mus musculus
ccttatagaacttcacgggtgacgc

SEQ ID NO: 341415 - DNA, 25 bp, Mus musculus
cataaacagtgagggcaggatctcc

SEQ ID NO: 341416 - DNA, 25 bp, Mus musculus
gctgacgcacaccttatagaacttc

SEQ ID NO: 341417 - DNA, 25 bp, Mus musculus
tgaccacgctgacgcacaccttata

SEQ ID NO: 341418 - DNA, 25 bp, Mus musculus
ctccgtgtcgatgcggcacttctcg

SEQ ID NO: 341419 - DNA, 25 bp, Mus musculus
caggatctccgtgtcgatgcggcac

SEQ ID NO: 341420 - DNA, 25 bp, Mus musculus
ggcgatgtcagccagcgccactcta

SEQ ID NO: 341421 - DNA, 25 bp, Mus musculus
ccctgggctgtttatttggttgtca

SEQ ID NO: 341422 - DNA, 25 bp, Mus musculus
tgtcagcggactttggagatgtttt

SEQ ID NO: 341423 - DNA, 25 bp, Mus musculus
tcccggctgtttttacacctgcaca

SEQ ID NO: 341424 - DNA, 25 bp, Mus musculus
acggtccaacattccacgctgcaga

SEQ ID NO: 341425 - DNA, 25 bp, Mus musculus
ttaaagtctcagtgctctgcgcgcc

SEQ ID NO: 341426 - DNA, 25 bp, Mus musculus
ccctcactccttggcctgatttata

SEQ ID NO: 341427 - DNA, 25 bp, Mus musculus
gcgggcgacagcacagtcactactg

SEQ ID NO: 341428 - DNA, 25 bp, Mus musculus
gggcgagcaactttctgagcacagc

SEQ ID NO: 341429 - DNA, 25 bp, Mus musculus
gtcactactggggtgcttctgcagc

SEQ ID NO: 341430 - DNA, 25 bp, Mus musculus
ggaatttgctgcgttctccctggtc

SEQ ID NO: 341431 - DNA, 25 bp, Mus musculus
tctccggttgcaaatcgcggttgtg

SEQ ID NO: 341432 - DNA, 25 bp, Mus musculus
gcggcccttgtgtcccgcgataatg

SEQ ID NO: 341433 - DNA, 25 bp, Mus musculus
gcacgagtcgctatagggatgcaca

SEQ ID NO: 341434 - DNA, 25 bp, Mus musculus
accgctagccttcgagaccaagggg

SEQ ID NO: 341435 - DNA, 25 bp, Mus musculus
cagctgagttatgtctggacgcggc

SEQ ID NO: 341436 - DNA, 25 bp, Mus musculus
aaagttaatgactgttctggctgca

SEQ ID NO: 341437 - DNA, 25 bp, Mus musculus
tacgtcatgtactaacagtccaatc

SEQ ID NO: 341438 - DNA, 25 bp, Mus musculus
tcaggcatactgagaggatgaagtg

SEQ ID NO: 341439 - DNA, 25 bp, Mus musculus
cggctatgccgaacctgaatcacca

SEQ ID NO: 341440 - DNA, 25 bp, Mus musculus
cgaacctgaatcaccatacgtcatg

SEQ ID NO: 341441 - DNA, 25 bp, Mus musculus
gcggtggttatctacagctgagtta

SEQ ID NO: 341442 - DNA, 25 bp, Mus musculus
gattttcaaaaccagggcgccattg

SEQ ID NO: 341443 - DNA, 25 bp, Mus musculus
accagggcgccattggtaaccaatg

SEQ ID NO: 341444 - DNA, 25 bp, Mus musculus
aaatctctccgttttcgcgtccagc

SEQ ID NO: 341445 - DNA, 25 bp, Mus musculus
tcgcgtccagccttgactatatata

SEQ ID NO: 341446 - DNA, 25 bp, Mus musculus
atgcgtataccgtttttgcttctta

SEQ ID NO: 341447 - DNA, 25 bp, Mus musculus
tttgcttcttactgcggtggttatc

SEQ ID NO: 341448 - DNA, 25 bp, Mus musculus
ttaaacaaacttacggctatgccga

SEQ ID NO: 341449 - DNA, 25 bp, Mus musculus
tgcggcgcacatgctaaacagatta

SEQ ID NO: 341450 - DNA, 25 bp, Mus musculus
ccgggctcgctgagagcggttccta

SEQ ID NO: 341451 - DNA, 25 bp, Mus musculus
ctcgatacatttacttgccttaagc

SEQ ID NO: 341452 - DNA, 25 bp, Mus musculus
tgccttaagctctttattaactccc

SEQ ID NO: 341453 - DNA, 25 bp, Mus musculus
tggtctggctcctccgtgcggcgca

SEQ ID NO: 341454 - DNA, 25 bp, Mus musculus
gccgcgcgcaagctcgatacattta

SEQ ID NO: 341455 - DNA, 25 bp, Mus musculus
aacatgccttggctgacccacgctt

SEQ ID NO: 341456 - DNA, 25 bp, Mus musculus
cacgcttcgcaacccgcggataggg

SEQ ID NO: 341457 - DNA, 25 bp, Mus musculus
aacccgcggatagggtttctgcagc

SEQ ID NO: 341458 - DNA, 25 bp, Mus musculus
tagggtttctgcagctccatgtgga

SEQ ID NO: 341459 - DNA, 25 bp, Mus musculus
ctgcagctccatgtggaaattaacc

SEQ ID NO: 341460 - DNA, 25 bp, Mus musculus
tgtggaaattaacctatctgtaccc

SEQ ID NO: 341461 - DNA, 25 bp, Mus musculus
tatctgtacccgtggtcagctgcgc

SEQ ID NO: 341462 - DNA, 25 bp, Mus musculus
tgctaaacagattaacatgccttgg

SEQ ID NO: 341463 - DNA, 25 bp, Mus musculus
tttagcaagcaaacgcggagccgtc

SEQ ID NO: 341464 - DNA, 25 bp, Mus musculus
ccagggcgttcacagtcccgctggg

SEQ ID NO: 341465 - DNA, 25 bp, Mus musculus
aagcaaacgcggagccgtcttcccg

SEQ ID NO: 341466 - DNA, 25 bp, Mus musculus
ctcttgtgtagaaagtttagcaagc

SEQ ID NO: 341467 - DNA, 25 bp, Mus musculus
caacttcatttgctcttgtgtagaa

SEQ ID NO: 341468 - DNA, 25 bp, Mus musculus
cgtgaatgtcaaacaacttcatttg

SEQ ID NO: 341469 - DNA, 25 bp, Mus musculus
cgtttcgtgaatgtcaaacaacttc

SEQ ID NO: 341470 - DNA, 25 bp, Mus musculus
cccgaaagcgtttcgtgaatgtcaa

SEQ ID NO: 341471 - DNA, 25 bp, Mus musculus
agcgaagggccaacaaaacaatctc

SEQ ID NO: 341472 - DNA, 25 bp, Mus musculus
gttggatgcttttcctcctggaagc

SEQ ID NO: 341473 - DNA, 25 bp, Mus musculus
ccgggcgccatttctgttggatgct

SEQ ID NO: 341474 - DNA, 25 bp, Mus musculus
ttataaactccttgcgggcaacgcc

SEQ ID NO: 341475 - DNA, 25 bp, Mus musculus
gccgcggacagttgtttataaactc

SEQ ID NO: 341476 - DNA, 25 bp, Mus musculus
aaacaatctcccagggcactgccgg

SEQ ID NO: 341477 - DNA, 25 bp, Mus musculus
cccgtgtgaggtccgcgccattgtc

SEQ ID NO: 341478 - DNA, 25 bp, Mus musculus
aaccgagaacctgtactgcctctga

SEQ ID NO: 341479 - DNA, 25 bp, Mus musculus
ctcctagaaattccgagggccgagg

SEQ ID NO: 341480 - DNA, 25 bp, Mus musculus
ctcccagaatgggttcggctggctg

SEQ ID NO: 341481 - DNA, 25 bp, Mus musculus
acagctcccagaatgggttcggctg

SEQ ID NO: 341482 - DNA, 25 bp, Mus musculus
tgatctcttcgcacagctcccagaa

SEQ ID NO: 341483 - DNA, 25 bp, Mus musculus
gtactgcctctgatctcttcgcaca

SEQ ID NO: 341484 - DNA, 25 bp, Mus musculus
cgcctgaaggttcatttaaccgaga

SEQ ID NO: 341485 - DNA, 25 bp, Mus musculus
gctctcccgggtcagcccattggtt

SEQ ID NO: 341486 - DNA, 25 bp, Mus musculus
gccgtaggagactccggaggattca

SEQ ID NO: 341487 - DNA, 25 bp, Mus musculus
taggagactccggaggattcacctc

SEQ ID NO: 341488 - DNA, 25 bp, Mus musculus
tggaataaaagaacggggcagctga

SEQ ID NO: 341489 - DNA, 25 bp, Mus musculus
attcacctcgtggaataaaagaacg

SEQ ID NO: 341490 - DNA, 25 bp, Mus musculus
tccggaggattcacctcgtggaata

SEQ ID NO: 341491 - DNA, 25 bp, Mus musculus
actttgtcgtccaggaattgcggtc

SEQ ID NO: 341492 - DNA, 25 bp, Mus musculus
aatgacatgaaagcgcccgggcctc

SEQ ID NO: 341493 - DNA, 25 bp, Mus musculus
ccacatctggatgcgttcttaaagc

SEQ ID NO: 341494 - DNA, 25 bp, Mus musculus
cacatttggagacacccgaggcaca

SEQ ID NO: 341495 - DNA, 25 bp, Mus musculus
tagtcaaattcacaggcccagcagc

SEQ ID NO: 341496 - DNA, 25 bp, Mus musculus
ggcctcagactgtgcgattacacta

SEQ ID NO: 341497 - DNA, 25 bp, Mus musculus
ctagcactgcgccaccaggcgaatg

SEQ ID NO: 341498 - DNA, 25 bp, Mus musculus
cgcagaggtttcctacggcctcaga

SEQ ID NO: 341499 - DNA, 25 bp, Mus musculus
ccgatcgcaaacactgcggactttg

SEQ ID NO: 341500 - DNA, 25 bp, Mus musculus
accacattcgtgtgcgcgctttgcc

SEQ ID NO: 341501 - DNA, 25 bp, Mus musculus
gggacgtgtccacgcaccacattcg

SEQ ID NO: 341502 - DNA, 25 bp, Mus musculus
accagcggcttggatcgctgaccga

SEQ ID NO: 341503 - DNA, 25 bp, Mus musculus
ccctgttttgacagctggaccagcg

SEQ ID NO: 341504 - DNA, 25 bp, Mus musculus
gggccgcacagaacccactgagctt

SEQ ID NO: 341505 - DNA, 25 bp, Mus musculus
ccattctgtcgtggacgcaccctag

SEQ ID NO: 341506 - DNA, 25 bp, Mus musculus
tccgagaagggctccggtccctgca

SEQ ID NO: 341507 - DNA, 25 bp, Mus musculus
tggacgcaccctagggcctcctggt

SEQ ID NO: 341508 - DNA, 25 bp, Mus musculus
ggtccctgcagctgtgtcccagaca

SEQ ID NO: 341509 - DNA, 25 bp, Mus musculus
ctgcagctgtgtcccagacagatca

SEQ ID NO: 341510 - DNA, 25 bp, Mus musculus
tgtcccagacagatcagccagctga

SEQ ID NO: 341511 - DNA, 25 bp, Mus musculus
acagatcagccagctgacgccaggc

SEQ ID NO: 341512 - DNA, 25 bp, Mus musculus
aaggatgagtgggaaaacggctcca

SEQ ID NO: 341513 - DNA, 25 bp, Mus musculus
ctgaaaggagccgagtccgagaagg

SEQ ID NO: 341514 - DNA, 25 bp, Mus musculus
ggattgtagcgaagccgaaggatga

SEQ ID NO: 341515 - DNA, 25 bp, Mus musculus
tgagtgattaattaacggaaaacca

SEQ ID NO: 341516 - DNA, 25 bp, Mus musculus
ggaaaacggctccacggacgcaggc

SEQ ID NO: 341517 - DNA, 25 bp, Mus musculus
gaaaatgttttctgaaaggagccga

SEQ ID NO: 341518 - DNA, 25 bp, Mus musculus
cggacgcaggcccatgagtgattaa

SEQ ID NO: 341519 - DNA, 25 bp, Mus musculus
aacccagggattcggaccagtcgca

SEQ ID NO: 341520 - DNA, 25 bp, Mus musculus
ggacccagctgcgtctcttcactgt

SEQ ID NO: 341521 - DNA, 25 bp, Mus musculus
ggggcaccgagcagaaaaactgtcg

SEQ ID NO: 341522 - DNA, 25 bp, Mus musculus
cgccaccaggagctgggttgacctg

SEQ ID NO: 341523 - DNA, 25 bp, Mus musculus
atgggagacacttgagttagtgcag

SEQ ID NO: 341524 - DNA, 25 bp, Mus musculus
ttgacctgcggcctcgagcctcttt

SEQ ID NO: 341525 - DNA, 25 bp, Mus musculus
gccgcgccagcagaacccagggatt

SEQ ID NO: 341526 - DNA, 25 bp, Mus musculus
ggtcacttaggaccagcgctgccgc

SEQ ID NO: 341527 - DNA, 25 bp, Mus musculus
ccgcagacccgatgggagacacttg

SEQ ID NO: 341528 - DNA, 25 bp, Mus musculus
tggccattcagggaaaaccgcgtgg

SEQ ID NO: 341529 - DNA, 25 bp, Mus musculus
aaaccgcgtgggtctctcggtcact

SEQ ID NO: 341530 - DNA, 25 bp, Mus musculus
aaaactgtcgattgggtgacgccga

SEQ ID NO: 341531 - DNA, 25 bp, Mus musculus
tgggtctctcggtcacttaggacca

SEQ ID NO: 341532 - DNA, 25 bp, Mus musculus
cctcgtggccattcagggaaaaccg

SEQ ID NO: 341533 - DNA, 25 bp, Mus musculus
ttcttcagatagcagaacaaacctc

SEQ ID NO: 341534 - DNA, 25 bp, Mus musculus
gccgaggaagatctgcctaactgga

SEQ ID NO: 341535 - DNA, 25 bp, Mus musculus
agcgcagctccttccagtcgtccaa

SEQ ID NO: 341536 - DNA, 25 bp, Mus musculus
atccttctgcggtgttcgggcttct

SEQ ID NO: 341537 - DNA, 25 bp, Mus musculus
acaatggtccatggtgcggagccgc

SEQ ID NO: 341538 - DNA, 25 bp, Mus musculus
cctcaggttaagacaatggtccatg

SEQ ID NO: 341539 - DNA, 25 bp, Mus musculus
caatgttctttcaacctcaggttaa

SEQ ID NO: 341540 - DNA, 25 bp, Mus musculus
atccctctcatactaatcttcaatg

SEQ ID NO: 341541 - DNA, 25 bp, Mus musculus
agcagaacaaacctcagaatccctc

SEQ ID NO: 341542 - DNA, 25 bp, Mus musculus
gctggtcacccagagtccttaaatg

SEQ ID NO: 341543 - DNA, 25 bp, Mus musculus
cctaactggatagaagaggtgacag

SEQ ID NO: 341544 - DNA, 25 bp, Mus musculus
gtgagggctaatagctcagagcctg

SEQ ID NO: 341545 - DNA, 25 bp, Mus musculus
aggtgacaggcctaggcattggcac

SEQ ID NO: 341546 - DNA, 25 bp, Mus musculus
acccagagtccttaaatgttcttca

SEQ ID NO: 341547 - DNA, 25 bp, Mus musculus
cgctgccctcctgaggcaccggcgc

SEQ ID NO: 341548 - DNA, 25 bp, Mus musculus
tcgcggccctgggaccataagactt

SEQ ID NO: 341549 - DNA, 25 bp, Mus musculus
ctcctccgtgtgcagagagccaggc

SEQ ID NO: 341550 - DNA, 25 bp, Mus musculus
gcctcctccgtgtgcagagagccag

SEQ ID NO: 341551 - DNA, 25 bp, Mus musculus
atgggcacgctccaccaagttgtgg

SEQ ID NO: 341552 - DNA, 25 bp, Mus musculus
cataagacttggcagtgcaagcgag

SEQ ID NO: 341553 - DNA, 25 bp, Mus musculus
acgctccaccaagttgtgggtgcca

SEQ ID NO: 341554 - DNA, 25 bp, Mus musculus
aactagggtcagcttcgcggccctg

SEQ ID NO: 341555 - DNA, 25 bp, Mus musculus
acagaactagggtcagcttcgcggc

SEQ ID NO: 341556 - DNA, 25 bp, Mus musculus
ggagcacagaactagggtcagcttc

SEQ ID NO: 341557 - DNA, 25 bp, Mus musculus
gctccggagcacagaactagggtca

SEQ ID NO: 341558 - DNA, 25 bp, Mus musculus
gcgccgctccggagcacagaactag

SEQ ID NO: 341559 - DNA, 25 bp, Mus musculus
ctggccggtaggatctggccgccac

SEQ ID NO: 341560 - DNA, 25 bp, Mus musculus
gaggcagatgggcacgctccaccaa

SEQ ID NO: 341561 - DNA, 25 bp, Mus musculus
cttccgctcgcggttttagcctgaa

SEQ ID NO: 341562 - DNA, 25 bp, Mus musculus
ccgccatctctaggcccgcgccggc

SEQ ID NO: 341563 - DNA, 25 bp, Mus musculus
tccgacgccgccatctctaggcccg

SEQ ID NO: 341564 - DNA, 25 bp, Mus musculus
aacgcccgggatccgacgccgccat

SEQ ID NO: 341565 - DNA, 25 bp, Mus musculus
cgcacgccgtactaacctgtccgcc

SEQ ID NO: 341566 - DNA, 25 bp, Mus musculus
acgcaccagccacgagtcccgtacc

SEQ ID NO: 341567 - DNA, 25 bp, Mus musculus
agcctgaaacgcaccagccacgagt

SEQ ID NO: 341568 - DNA, 25 bp, Mus musculus
tttagcctgaaacgcaccagccacg

SEQ ID NO: 341569 - DNA, 25 bp, Mus musculus
cgcggttttagcctgaaacgcacca

SEQ ID NO: 341570 - DNA, 25 bp, Mus musculus
tccgctcgcggttttagcctgaaac

SEQ ID NO: 341571 - DNA, 25 bp, Mus musculus
tcggccttccgctcgcggttttagc

SEQ ID NO: 341572 - DNA, 25 bp, Mus musculus
gctcgcggttttagcctgaaacgca

SEQ ID NO: 341573 - DNA, 25 bp, Mus musculus
ccgctcgcggttttagcctgaaacg

SEQ ID NO: 341574 - DNA, 25 bp, Mus musculus
ggttttagcctgaaacgcaccagcc

SEQ ID NO: 341575 - DNA, 25 bp, Mus musculus
caagttcggccaagatacctgagta

SEQ ID NO: 341576 - DNA, 25 bp, Mus musculus
ccgagcgttcgcaaggaatggtaca

SEQ ID NO: 341577 - DNA, 25 bp, Mus musculus
acacgtaactttcctgttcatggca

SEQ ID NO: 341578 - DNA, 25 bp, Mus musculus
cctgttcatggcagaagcgtacttg

SEQ ID NO: 341579 - DNA, 25 bp, Mus musculus
gcgtacttgccacgatcggctaaca

SEQ ID NO: 341580 - DNA, 25 bp, Mus musculus
cggctaacagcaactgcacgaaatc

SEQ ID NO: 341581 - DNA, 25 bp, Mus musculus
tgcacgaaatcacacggcgaggaga

SEQ ID NO: 341582 - DNA, 25 bp, Mus musculus
ctgaaggcaaagtcctgggcgcagc

SEQ ID NO: 341583 - DNA, 25 bp, Mus musculus
gaaattctccacgaaatgcgccatg

SEQ ID NO: 341584 - DNA, 25 bp, Mus musculus
aaatgcgccatgaccatcttgccgc

SEQ ID NO: 341585 - DNA, 25 bp, Mus musculus
cgccgctgtgtaaacacggaccggc

SEQ ID NO: 341586 - DNA, 25 bp, Mus musculus
agagcctgactgtcgctcccgagtg

SEQ ID NO: 341587 - DNA, 25 bp, Mus musculus
acagagcttagtctgcgcgagcctc

SEQ ID NO: 341588 - DNA, 25 bp, Mus musculus
gctttgtgagcaggcctgaaggcaa

SEQ ID NO: 341589 - DNA, 25 bp, Mus musculus
tagtgccacggagcacacgcagacc

SEQ ID NO: 341590 - DNA, 25 bp, Mus musculus
ttcaggcgcctctgcagaaagctcc

SEQ ID NO: 341591 - DNA, 25 bp, Mus musculus
gactgggactccttgagcagctgca

SEQ ID NO: 341592 - DNA, 25 bp, Mus musculus
ggatctgctgaagcccttgctcgtc

SEQ ID NO: 341593 - DNA, 25 bp, Mus musculus
cttgctcgtcaggtttccactcata

SEQ ID NO: 341594 - DNA, 25 bp, Mus musculus
tccactcatactccatcttggtttg

SEQ ID NO: 341595 - DNA, 25 bp, Mus musculus
ccagacacaggaagagacgagcaga

SEQ ID NO: 341596 - DNA, 25 bp, Mus musculus
cgagcagatgttagtcccacgcaga

SEQ ID NO: 341597 - DNA, 25 bp, Mus musculus
ccaacgtccgccgtgtctgtgctgt

SEQ ID NO: 341598 - DNA, 25 bp, Mus musculus
tacaggaataactacgacgactttc

SEQ ID NO: 341599 - DNA, 25 bp, Mus musculus
tgagtcaccgcgaatttgcaatctg

SEQ ID NO: 341600 - DNA, 25 bp, Mus musculus
tgcagccaggctgcttacacgaagg

SEQ ID NO: 341601 - DNA, 25 bp, Mus musculus
cccggtcgaaatctgattcggatta

SEQ ID NO: 341602 - DNA, 25 bp, Mus musculus
cgccaggagctgaccagactgagtc

SEQ ID NO: 341603 - DNA, 25 bp, Mus musculus
caaggcgccgggcttttcttctgag

SEQ ID NO: 341604 - DNA, 25 bp, Mus musculus
agcacgcacgcagagctcaggagtc

SEQ ID NO: 341605 - DNA, 25 bp, Mus musculus
acgcacgcagagctcaggagtccgg

SEQ ID NO: 341606 - DNA, 25 bp, Mus musculus
ggacccacgtgactcccgataactg

SEQ ID NO: 341607 - DNA, 25 bp, Mus musculus
cacgtgactcccgataactgcggag

SEQ ID NO: 341608 - DNA, 25 bp, Mus musculus
actcccgataactgcggaggggcgc

SEQ ID NO: 341609 - DNA, 25 bp, Mus musculus
ctaggctgctccgcgagagcccgga

SEQ ID NO: 341610 - DNA, 25 bp, Mus musculus
tccgctcgcggtggagctctgcttc

SEQ ID NO: 341611 - DNA, 25 bp, Mus musculus
agctgcctgagctaagccggtccct

SEQ ID NO: 341612 - DNA, 25 bp, Mus musculus
gccgggcttttcttctgagagctca

SEQ ID NO: 341613 - DNA, 25 bp, Mus musculus
tcttctgagagctcagcctggcccg

SEQ ID NO: 341614 - DNA, 25 bp, Mus musculus
agccatgcgcccatgcctccgctcg

SEQ ID NO: 341615 - DNA, 25 bp, Mus musculus
cggtggagctctgcttctgcaaagg

SEQ ID NO: 341616 - DNA, 25 bp, Mus musculus
cccggagctgcctgagctaagccgg

SEQ ID NO: 341617 - DNA, 25 bp, Mus musculus
cagaggcagacgtgcaaaacccaca

SEQ ID NO: 341618 - DNA, 25 bp, Mus musculus
cagaaaccggagtgtgcgaggctcc

SEQ ID NO: 341619 - DNA, 25 bp, Mus musculus
accgtgcggcctgacgggcatcgca

SEQ ID NO: 341620 - DNA, 25 bp, Mus musculus
attatgttcacaggtcgcgaggcca

SEQ ID NO: 341621 - DNA, 25 bp, Mus musculus
gaccgcagctgttgggcttagaacc

SEQ ID NO: 341622 - DNA, 25 bp, Mus musculus
ttgggcttagaaccgcgccgtcgcc

SEQ ID NO: 341623 - DNA, 25 bp, Mus musculus
ggcctttctgccgaagcggcgctgc

SEQ ID NO: 341624 - DNA, 25 bp, Mus musculus
gcctgaaatggctgcggaacaaaga

SEQ ID NO: 341625 - DNA, 25 bp, Mus musculus
aacaaagagaatccgggctccggcg

SEQ ID NO: 341626 - DNA, 25 bp, Mus musculus
ccagcccgttgagtgtgaacgccca

SEQ ID NO: 341627 - DNA, 25 bp, Mus musculus
gtgaacgcccagatgcacggccctt

SEQ ID NO: 341628 - DNA, 25 bp, Mus musculus
gcgtgcccggagtgcactcgtgtcc

SEQ ID NO: 341629 - DNA, 25 bp, Mus musculus
cgctcgtcccacagtcgaactgtta

SEQ ID NO: 341630 - DNA, 25 bp, Mus musculus
gacggatcagctggctgcagaaacc

SEQ ID NO: 341631 - DNA, 25 bp, Mus musculus
aaaccgggctgctcacgcgtgcagc

SEQ ID NO: 341632 - DNA, 25 bp, Mus musculus
gatgctcctggctcggcgactagac

SEQ ID NO: 341633 - DNA, 25 bp, Mus musculus
gccttccacttggtgcgctccaaga

SEQ ID NO: 341634 - DNA, 25 bp, Mus musculus
acctctgaggtggtaggaccacttc

SEQ ID NO: 341635 - DNA, 25 bp, Mus musculus
cactgtagccatgttgttccgggcc

SEQ ID NO: 341636 - DNA, 25 bp, Mus musculus
ttccaggggccgaaacactgtagcc

SEQ ID NO: 341637 - DNA, 25 bp, Mus musculus
aaggacgcggcacccgcaggcgttc

SEQ ID NO: 341638 - DNA, 25 bp, Mus musculus
atgcagcgaaggacgcggcacccgc

SEQ ID NO: 341639 - DNA, 25 bp, Mus musculus
tacctccgagagtgcagcggcagca

SEQ ID NO: 341640 - DNA, 25 bp, Mus musculus
tgcggccgctcgtacctccgagagt

SEQ ID NO: 341641 - DNA, 25 bp, Mus musculus
tcctccaaaaagagaggccgcggtg

SEQ ID NO: 341642 - DNA, 25 bp, Mus musculus
aagggcgcacgagcctcctccaaaa

SEQ ID NO: 341643 - DNA, 25 bp, Mus musculus
gcgactagacgcgtctcgcctttgc

SEQ ID NO: 341644 - DNA, 25 bp, Mus musculus
gctcacgcgtgcagcaaaagggaaa

SEQ ID NO: 341645 - DNA, 25 bp, Mus musculus
ccctctctgggtctcaaataaaata

SEQ ID NO: 341646 - DNA, 25 bp, Mus musculus
tccctcagggctattataaagatcc

SEQ ID NO: 341647 - DNA, 25 bp, Mus musculus
ccaggtgacctatccctcagggcta

SEQ ID NO: 341648 - DNA, 25 bp, Mus musculus
tccgcctgcggttgcggttttatta

SEQ ID NO: 341649 - DNA, 25 bp, Mus musculus
gacgatttccatgcgggccttggca

SEQ ID NO: 341650 - DNA, 25 bp, Mus musculus
ggtgactgtgataaagacgatttcc

SEQ ID NO: 341651 - DNA, 25 bp, Mus musculus
ctagcctagtcattcccaggaaaga

SEQ ID NO: 341652 - DNA, 25 bp, Mus musculus
ctgggcttcgtctagaaacagagcg

SEQ ID NO: 341653 - DNA, 25 bp, Mus musculus
gcagacgggttccatgcctgtatcc

SEQ ID NO: 341654 - DNA, 25 bp, Mus musculus
ttctgaaagctgcagccaggacctc

SEQ ID NO: 341655 - DNA, 25 bp, Mus musculus
atggctcctgaagctaagacttttc

SEQ ID NO: 341656 - DNA, 25 bp, Mus musculus
cgtggcccaaggactagcctagtca

SEQ ID NO: 341657 - DNA, 25 bp, Mus musculus
tggggtcccattgtcctttctgaaa

SEQ ID NO: 341658 - DNA, 25 bp, Mus musculus
ggaaccgctattccgctaccgcaga

SEQ ID NO: 341659 - DNA, 25 bp, Mus musculus
gggacgcatcatccacggcagagta

SEQ ID NO: 341660 - DNA, 25 bp, Mus musculus
gaccagctccttctcgtgggacgca

SEQ ID NO: 341661 - DNA, 25 bp, Mus musculus
gtcagccgtctgtaggcagcgctcc

SEQ ID NO: 341662 - DNA, 25 bp, Mus musculus
cgggaacgaggctctgcgcacagat

SEQ ID NO: 341663 - DNA, 25 bp, Mus musculus
cacagatgggctagagcgcagaaaa

SEQ ID NO: 341664 - DNA, 25 bp, Mus musculus
tttgacgtcaatgcccgccgggctc

SEQ ID NO: 341665 - DNA, 25 bp, Mus musculus
acggcagagtagatgtccagggctc

SEQ ID NO: 341666 - DNA, 25 bp, Mus musculus
cgggcacccagcaaaggtagcagta

SEQ ID NO: 341667 - DNA, 25 bp, Mus musculus
cgggagctctccatggttctggacc

SEQ ID NO: 341668 - DNA, 25 bp, Mus musculus
atggttctggacctcctcgctgctc

SEQ ID NO: 341669 - DNA, 25 bp, Mus musculus
aggcgagggaaatactgaccagctc

SEQ ID NO: 341670 - DNA, 25 bp, Mus musculus
gcactgcgctctccggcttcttata

SEQ ID NO: 341671 - DNA, 25 bp, Mus musculus
ttatagccggttgaaatcgggtgcc

SEQ ID NO: 341672 - DNA, 25 bp, Mus musculus
gctccgctgccgtttgacgtcaatg

SEQ ID NO: 341673 - DNA, 25 bp, Mus musculus
caggaaggcgaacaggcctccagga

SEQ ID NO: 341674 - DNA, 25 bp, Mus musculus
aacactgggccgagtagagcgaaca

SEQ ID NO: 341675 - DNA, 25 bp, Mus musculus
cagctgcgcgagtccaggttccatc

SEQ ID NO: 341676 - DNA, 25 bp, Mus musculus
aggttccatcgcgagcccaggaaca

SEQ ID NO: 341677 - DNA, 25 bp, Mus musculus
ccaatgaggcgcagaagagcagctg

SEQ ID NO: 341678 - DNA, 25 bp, Mus musculus
gacgctcgctcaacctacctggtag

SEQ ID NO: 341679 - DNA, 25 bp, Mus musculus
gtacagcagcccgacagcacggtcg

SEQ ID NO: 341680 - DNA, 25 bp, Mus musculus
cagcacggtcgcagagctgacctca

SEQ ID NO: 341681 - DNA, 25 bp, Mus musculus
ccacatggcgatggcaaacacccaa

SEQ ID NO: 341682 - DNA, 25 bp, Mus musculus
tgcagctcggttctgcagctcctgg

SEQ ID NO: 341683 - DNA, 25 bp, Mus musculus
agagtccttgcagcaccagccctgg

SEQ ID NO: 341684 - DNA, 25 bp, Mus musculus
acctccaattggtcggcgctgcgcg

SEQ ID NO: 341685 - DNA, 25 bp, Mus musculus
agataagtggctgctgtcctgccga

SEQ ID NO: 341686 - DNA, 25 bp, Mus musculus
tctctactccgccaatgaggcgcag

SEQ ID NO: 341687 - DNA, 25 bp, Mus musculus
aggcgccggaagcaatgcgtaatca

SEQ ID NO: 341688 - DNA, 25 bp, Mus musculus
gggagccatagcaactgcaacgctc

SEQ ID NO: 341689 - DNA, 25 bp, Mus musculus
cgccgggagccatagcaactgcaac

SEQ ID NO: 341690 - DNA, 25 bp, Mus musculus
acgatgacgtcagactccgggcgcc

SEQ ID NO: 341691 - DNA, 25 bp, Mus musculus
attcggcgccgacgatgacgtcaga

SEQ ID NO: 341692 - DNA, 25 bp, Mus musculus
atgcgtaatcattcggcgccgacga

SEQ ID NO: 341693 - DNA, 25 bp, Mus musculus
tcccggctcgcgaaaggcgccggaa

SEQ ID NO: 341694 - DNA, 25 bp, Mus musculus
tgccacactaaaagctaagtttctc

SEQ ID NO: 341695 - DNA, 25 bp, Mus musculus
tcatgaccctgccacactaaaagct

SEQ ID NO: 341696 - DNA, 25 bp, Mus musculus
gtccacaaccaccagtccagcgctg

SEQ ID NO: 341697 - DNA, 25 bp, Mus musculus
acgctaaggcgtgccctgcggaaca

SEQ ID NO: 341698 - DNA, 25 bp, Mus musculus
gagcctctggtccacgctggggatt

SEQ ID NO: 341699 - DNA, 25 bp, Mus musculus
ggtccctacaccaggcctgacattt

SEQ ID NO: 341700 - DNA, 25 bp, Mus musculus
ggcctgacatttggcttcacgctaa

SEQ ID NO: 341701 - DNA, 25 bp, Mus musculus
ctccgtagacatggggcggtgtcac

SEQ ID NO: 341702 - DNA, 25 bp, Mus musculus
aacagccgcggttgctgggctagaa

SEQ ID NO: 341703 - DNA, 25 bp, Mus musculus
gacagtctaggaacagccgcggttg

SEQ ID NO: 341704 - DNA, 25 bp, Mus musculus
tgagttgtccagagccaccatggcc

SEQ ID NO: 341705 - DNA, 25 bp, Mus musculus
cgggccgccttctgagttgtccaga

SEQ ID NO: 341706 - DNA, 25 bp, Mus musculus
ggccctgctcacagcctggtctccc

SEQ ID NO: 341707 - DNA, 25 bp, Mus musculus
cggtttccctctccgtagacatggg

SEQ ID NO: 341708 - DNA, 25 bp, Mus musculus
ctgcggagatgcgaaaggctccttg

SEQ ID NO: 341709 - DNA, 25 bp, Mus musculus
aagtctgagccacccgggaggagac

SEQ ID NO: 341710 - DNA, 25 bp, Mus musculus
aggacaaagtctgagccacccggga

SEQ ID NO: 341711 - DNA, 25 bp, Mus musculus
gctgaggacaaagtctgagccaccc

SEQ ID NO: 341712 - DNA, 25 bp, Mus musculus
caccaggacgtgctggctgaggaca

SEQ ID NO: 341713 - DNA, 25 bp, Mus musculus
tgggctagaagctctgcctcggttt

SEQ ID NO: 341714 - DNA, 25 bp, Mus musculus
gcggtgtcacccaccaggacgtgct

SEQ ID NO: 341715 - DNA, 25 bp, Mus musculus
ttgtggggctcagccttcttcagcg

SEQ ID NO: 341716 - DNA, 25 bp, Mus musculus
aggaggaagagacgcaaacgccacc

SEQ ID NO: 341717 - DNA, 25 bp, Mus musculus
cgcggacgcctcgctgacaagggac

SEQ ID NO: 341718 - DNA, 25 bp, Mus musculus
cacgcgcagtggctcaccggccacg

SEQ ID NO: 341719 - DNA, 25 bp, Mus musculus
acatcgagggcccttgtggggctca

SEQ ID NO: 341720 - DNA, 25 bp, Mus musculus
cggcaacggctgagcgtgcaaagcc

SEQ ID NO: 341721 - DNA, 25 bp, Mus musculus
aagccgccgtttgcttctccaggtc

SEQ ID NO: 341722 - DNA, 25 bp, Mus musculus
tctccaggtcgctgtcttccagtct

SEQ ID NO: 341723 - DNA, 25 bp, Mus musculus
aggtcgctgtcttccagtctccggc

SEQ ID NO: 341724 - DNA, 25 bp, Mus musculus
tctccggccggtggacagcatggcc

SEQ ID NO: 341725 - DNA, 25 bp, Mus musculus
cagcatggcccgtgagtctgcgggc

SEQ ID NO: 341726 - DNA, 25 bp, Mus musculus
acgccacctcgtgcttgtggcgggc

SEQ ID NO: 341727 - DNA, 25 bp, Mus musculus
agacgcaaacgccacctcgtgcttg

SEQ ID NO: 341728 - DNA, 25 bp, Mus musculus
aggcgtcgccacatcgagggccctt

SEQ ID NO: 341729 - DNA, 25 bp, Mus musculus
ctcgggccacatccgcaggcggctc

SEQ ID NO: 341730 - DNA, 25 bp, Mus musculus
gccaccgtactcttccggtcccaga

SEQ ID NO: 341731 - DNA, 25 bp, Mus musculus
tcccagaagccccatgacggaagtc

SEQ ID NO: 341732 - DNA, 25 bp, Mus musculus
gacggaagtcgtcattgagtgagcc

SEQ ID NO: 341733 - DNA, 25 bp, Mus musculus
aagtcgtcattgagtgagcccggca

SEQ ID NO: 341734 - DNA, 25 bp, Mus musculus
gtcattgagtgagcccggcagcgtc

SEQ ID NO: 341735 - DNA, 25 bp, Mus musculus
ggcagcgtccgtggtagcaggccat

SEQ ID NO: 341736 - DNA, 25 bp, Mus musculus
ctccgagcaggaagatacggtgctg

SEQ ID NO: 341737 - DNA, 25 bp, Mus musculus
atacggtgctgttccggcgtggcac

SEQ ID NO: 341738 - DNA, 25 bp, Mus musculus
ctcggcgctagcactcggagcgctg

SEQ ID NO: 341739 - DNA, 25 bp, Mus musculus
actcggagcgctgcccgagaccgag

SEQ ID NO: 341740 - DNA, 25 bp, Mus musculus
caggaagatacggtgctgttccggc

SEQ ID NO: 341741 - DNA, 25 bp, Mus musculus
ctagcactcggagcgctgcccgaga

SEQ ID NO: 341742 - DNA, 25 bp, Mus musculus
tgctgttccggcgtggcaccggcca

SEQ ID NO: 341743 - DNA, 25 bp, Mus musculus
gcaaactcgcttcgggccacacaga

SEQ ID NO: 341744 - DNA, 25 bp, Mus musculus
agactcacggcaaacggcagccctg

SEQ ID NO: 341745 - DNA, 25 bp, Mus musculus
agccctgcagcgagaactttcctca

SEQ ID NO: 341746 - DNA, 25 bp, Mus musculus
gggctttgcacctcggtcctcagct

SEQ ID NO: 341747 - DNA, 25 bp, Mus musculus
gacgagacgaccctcaccggaagta

SEQ ID NO: 341748 - DNA, 25 bp, Mus musculus
ggcagtctgagtgcgccgccaaaat

SEQ ID NO: 341749 - DNA, 25 bp, Mus musculus
gccaaaattcttccgcagcgcgctg

SEQ ID NO: 341750 - DNA, 25 bp, Mus musculus
cgcacactttttggctgggtatacg

SEQ ID NO: 341751 - DNA, 25 bp, Mus musculus
cggggcctctttatgatggagaatc

SEQ ID NO: 341752 - DNA, 25 bp, Mus musculus
gcagccagatcacccgtttcttaga

SEQ ID NO: 341753 - DNA, 25 bp, Mus musculus
atgctcacggtgagctcctcgcgtg

SEQ ID NO: 341754 - DNA, 25 bp, Mus musculus
ccgaggtcaagggtgatttactgtc

SEQ ID NO: 341755 - DNA, 25 bp, Mus musculus
gacagctcggggctgcaaactcgct

SEQ ID NO: 341756 - DNA, 25 bp, Mus musculus
cccgtgttcagagagggacagctcg

SEQ ID NO: 341757 - DNA, 25 bp, Mus musculus
ttcaactgagccaggaggaccgtcc

SEQ ID NO: 341758 - DNA, 25 bp, Mus musculus
attcacctgaaactccgatgggagg

SEQ ID NO: 341759 - DNA, 25 bp, Mus musculus
ggcatgcgcaccaatttctggccga

SEQ ID NO: 341760 - DNA, 25 bp, Mus musculus
gcgctgccaatccacagttcaactg

SEQ ID NO: 341761 - DNA, 25 bp, Mus musculus
gccggaatcccaaggtgctcacctg

SEQ ID NO: 341762 - DNA, 25 bp, Mus musculus
gtccagggcgaaactgccaccgaaa

SEQ ID NO: 341763 - DNA, 25 bp, Mus musculus
ctctggtttccgtgagagccgagtc

SEQ ID NO: 341764 - DNA, 25 bp, Mus musculus
caggcacacgcgcttctctggtttc

SEQ ID NO: 341765 - DNA, 25 bp, Mus musculus
catttctggtggacaaggtttcgcc

SEQ ID NO: 341766 - DNA, 25 bp, Mus musculus
acgctcccgcctcggcaaaagtaga

SEQ ID NO: 341767 - DNA, 25 bp, Mus musculus
cagaagggccacagggatctttatc

SEQ ID NO: 341768 - DNA, 25 bp, Mus musculus
tgagcagcttccctcgaaatccagc

SEQ ID NO: 341769 - DNA, 25 bp, Mus musculus
ccgcggtcacggatgagaatccacc

SEQ ID NO: 341770 - DNA, 25 bp, Mus musculus
actccaccgctgtcgcctaaggaaa

SEQ ID NO: 341771 - DNA, 25 bp, Mus musculus
acagcgtgtatatagggcgttcact

SEQ ID NO: 341772 - DNA, 25 bp, Mus musculus
tcgcctcctctatacagacaaattg

SEQ ID NO: 341773 - DNA, 25 bp, Mus musculus
gggcgttcacttcgcctcctctata

SEQ ID NO: 341774 - DNA, 25 bp, Mus musculus
gtctctatttgcataacagcgtgta

SEQ ID NO: 341775 - DNA, 25 bp, Mus musculus
gtaacatgcctgagccaacgaagtc

SEQ ID NO: 341776 - DNA, 25 bp, Mus musculus
tgcgactatctctcgtctctatttg

SEQ ID NO: 341777 - DNA, 25 bp, Mus musculus
gcagtttatctgtgttgtaacatgc

SEQ ID NO: 341778 - DNA, 25 bp, Mus musculus
atggcgctaaaaatgaagacgtagc

SEQ ID NO: 341779 - DNA, 25 bp, Mus musculus
cgcgaaccttgccactgcgactgga

SEQ ID NO: 341780 - DNA, 25 bp, Mus musculus
tgcgactggacaaaacaaaatgctg

SEQ ID NO: 341781 - DNA, 25 bp, Mus musculus
ctttgttattgactgaatggcgcta

SEQ ID NO: 341782 - DNA, 25 bp, Mus musculus
atgcattctcattggataggtgtaa

SEQ ID NO: 341783 - DNA, 25 bp, Mus musculus
cgtagcattggctaagggtctaata

SEQ ID NO: 341784 - DNA, 25 bp, Mus musculus
gctgaggcggaagagtagctcactc

SEQ ID NO: 341785 - DNA, 25 bp, Mus musculus
agctgcagccgcgagcggaccgaca

SEQ ID NO: 341786 - DNA, 25 bp, Mus musculus
ccgccttcgctttcttctctggaaa

SEQ ID NO: 341787 - DNA, 25 bp, Mus musculus
gcggaccgacagatacccagcaatc

SEQ ID NO: 341788 - DNA, 25 bp, Mus musculus
gcgactatacccacccggtgcgtgt

SEQ ID NO: 341789 - DNA, 25 bp, Mus musculus
ggcaccgaaactgggaccgagctcc

SEQ ID NO: 341790 - DNA, 25 bp, Mus musculus
ctctgccgcgggcaccgaaactggg

SEQ ID NO: 341791 - DNA, 25 bp, Mus musculus
ccgttgtctcggtcaggccagccgg

SEQ ID NO: 341792 - DNA, 25 bp, Mus musculus
ggaacagcacgctctgccgcgggca

SEQ ID NO: 341793 - DNA, 25 bp, Mus musculus
tcttctctggaaaatccactctggc

SEQ ID NO: 341794 - DNA, 25 bp, Mus musculus
cccaaggtggccgttgtctcggtca

SEQ ID NO: 341795 - DNA, 25 bp, Mus musculus
ccgcacctgtcgctgcagcgaaacc

SEQ ID NO: 341796 - DNA, 25 bp, Mus musculus
gctgcagcgaaacccgcccacgccg

SEQ ID NO: 341797 - DNA, 25 bp, Mus musculus
gatgtgtgcccagggcgaaaggccc

SEQ ID NO: 341798 - DNA, 25 bp, Mus musculus
tggaaaatccactctggcttccgcc

SEQ ID NO: 341799 - DNA, 25 bp, Mus musculus
gacgtaggcgtccagcgcactgcct

SEQ ID NO: 341800 - DNA, 25 bp, Mus musculus
cggcgtccttactttccgggagctg

SEQ ID NO: 341801 - DNA, 25 bp, Mus musculus
tatctttgcctggagaacgggctgc

SEQ ID NO: 341802 - DNA, 25 bp, Mus musculus
tggggaccttcctcacggacggcgc

SEQ ID NO: 341803 - DNA, 25 bp, Mus musculus
ctgagcctttgtcgcggtcgggctt

SEQ ID NO: 341804 - DNA, 25 bp, Mus musculus
tgcctgacccgaaacgcaggcgggt

SEQ ID NO: 341805 - DNA, 25 bp, Mus musculus
ggcccggcttcccaccattagatgg

SEQ ID NO: 341806 - DNA, 25 bp, Mus musculus
cattagatggaagcgtaggacccga

SEQ ID NO: 341807 - DNA, 25 bp, Mus musculus
aggacccgaggccagcggagttcct

SEQ ID NO: 341808 - DNA, 25 bp, Mus musculus
cctcgagggaacctagccgcgtaca

SEQ ID NO: 341809 - DNA, 25 bp, Mus musculus
tagccgcgtacaggcgcacgagacc

SEQ ID NO: 341810 - DNA, 25 bp, Mus musculus
cgccggacgcttggcctttgtcaat

SEQ ID NO: 341811 - DNA, 25 bp, Mus musculus
ggcctttgtcaatctggtatctttg

SEQ ID NO: 341812 - DNA, 25 bp, Mus musculus
gagaaccggggctgtacttcgccac

SEQ ID NO: 341813 - DNA, 25 bp, Mus musculus
cacggaggcacggatactgggctca

SEQ ID NO: 341814 - DNA, 25 bp, Mus musculus
ggctcaggagagctgaagcgccgct

SEQ ID NO: 341815 - DNA, 25 bp, Mus musculus
cgccgctggcccacccggacctggc

SEQ ID NO: 341816 - DNA, 25 bp, Mus musculus
ccctgcggtggtcgtgcagtcacgt

SEQ ID NO: 341817 - DNA, 25 bp, Mus musculus
ctgcgcagcggaaggttcgatcctt

SEQ ID NO: 341818 - DNA, 25 bp, Mus musculus
cagcggaaggttcgatccttgggac

SEQ ID NO: 341819 - DNA, 25 bp, Mus musculus
aaggttcgatccttgggacggatgc

SEQ ID NO: 341820 - DNA, 25 bp, Mus musculus
tcgatccttgggacggatgcgcaga

SEQ ID NO: 341821 - DNA, 25 bp, Mus musculus
acggatgcgcagagtgccagcgtca

SEQ ID NO: 341822 - DNA, 25 bp, Mus musculus
tgcgcagagtgccagcgtcaggcca

SEQ ID NO: 341823 - DNA, 25 bp, Mus musculus
atactgggctcaggagagctgaagc

SEQ ID NO: 341824 - DNA, 25 bp, Mus musculus
tcaggccaggacaccgggaacccgc

SEQ ID NO: 341825 - DNA, 25 bp, Mus musculus
agtgccagcgtcaggccaggacacc

SEQ ID NO: 341826 - DNA, 25 bp, Mus musculus
cagagtgccagcgtcaggccaggac

SEQ ID NO: 341827 - DNA, 25 bp, Mus musculus
cgctgccacgtgcacacagtacccg

SEQ ID NO: 341828 - DNA, 25 bp, Mus musculus
taaagcgtccgaaagctgcccaaca

SEQ ID NO: 341829 - DNA, 25 bp, Mus musculus
cgcaggaatttaaagcgtccgaaag

SEQ ID NO: 341830 - DNA, 25 bp, Mus musculus
agctacttccggtcgctggacgcac

SEQ ID NO: 341831 - DNA, 25 bp, Mus musculus
gctggacgcacacgacctacgggtc

SEQ ID NO: 341832 - DNA, 25 bp, Mus musculus
tcctacggaagctgagttgggccgc

SEQ ID NO: 341833 - DNA, 25 bp, Mus musculus
gaaagctgcccaacagctacttccg

SEQ ID NO: 341834 - DNA, 25 bp, Mus musculus
ctctccgaggaagtccagtttctca

SEQ ID NO: 341835 - DNA, 25 bp, Mus musculus
tgagaaaccagacccgggcacccaa

SEQ ID NO: 341836 - DNA, 25 bp, Mus musculus
cgtccacagccatgcgagtgagaaa

SEQ ID NO: 341837 - DNA, 25 bp, Mus musculus
agacttcacgtccacagccatgcga

SEQ ID NO: 341838 - DNA, 25 bp, Mus musculus
agcgcttcgctcgagacttcacgtc

SEQ ID NO: 341839 - DNA, 25 bp, Mus musculus
agtccagtttctcatagcgcttcgc

SEQ ID NO: 341840 - DNA, 25 bp, Mus musculus
ggtcccgcccatacttccgctgtgg

SEQ ID NO: 341841 - DNA, 25 bp, Mus musculus
gttttacctgcacgaccctggtggc

SEQ ID NO: 341842 - DNA, 25 bp, Mus musculus
gaagccatcttgctgcccatcgtga

SEQ ID NO: 341843 - DNA, 25 bp, Mus musculus
accctggtggcggaagccatcttgc

SEQ ID NO: 341844 - DNA, 25 bp, Mus musculus
cgcggtcacgatgcattctctggca

SEQ ID NO: 341845 - DNA, 25 bp, Mus musculus
ttatcagacacatacacccgctggc

SEQ ID NO: 341846 - DNA, 25 bp, Mus musculus
gctacggccttcctccggattggct

SEQ ID NO: 341847 - DNA, 25 bp, Mus musculus
tggcgccagacccaatttactccgg

SEQ ID NO: 341848 - DNA, 25 bp, Mus musculus
gagcggacacgaccagaggccacca

SEQ ID NO: 341849 - DNA, 25 bp, Mus musculus
gctggcgaacatcacggacaatatt

SEQ ID NO: 341850 - DNA, 25 bp, Mus musculus
attaaacagcgattggccggactgc

SEQ ID NO: 341851 - DNA, 25 bp, Mus musculus
gtccgcagactacgagggctaagga

SEQ ID NO: 341852 - DNA, 25 bp, Mus musculus
tgctggggaatcctccgacctccga

SEQ ID NO: 341853 - DNA, 25 bp, Mus musculus
gacctccgacgagcacgagcggaca

SEQ ID NO: 341854 - DNA, 25 bp, Mus musculus
ggagcccgtaggttccattatcaga

SEQ ID NO: 341855 - DNA, 25 bp, Mus musculus
cctgggctattattgtgcttgtgtg

SEQ ID NO: 341856 - DNA, 25 bp, Mus musculus
ggaccgagctgcaactcacactgtg

SEQ ID NO: 341857 - DNA, 25 bp, Mus musculus
tgggttcacacttcagacaggcctt

SEQ ID NO: 341858 - DNA, 25 bp, Mus musculus
tcggcgctcaatccgctgctctatg

SEQ ID NO: 341859 - DNA, 25 bp, Mus musculus
tgggctcactgcatgtcctacagca

SEQ ID NO: 341860 - DNA, 25 bp, Mus musculus
tacgcggtcaagatctgggctcact

SEQ ID NO: 341861 - DNA, 25 bp, Mus musculus
tccagctgttcctggtgcttcaagc

SEQ ID NO: 341862 - DNA, 25 bp, Mus musculus
ctggctctatatctgctgccgctgc

SEQ ID NO: 341863 - DNA, 25 bp, Mus musculus
cacaacgttcgtgctcatgcgcgca

SEQ ID NO: 341864 - DNA, 25 bp, Mus musculus
cgctctacaacctgctggctctata

SEQ ID NO: 341865 - DNA, 25 bp, Mus musculus
ctcatgcgcgcagtatgggaatctg

SEQ ID NO: 341866 - DNA, 25 bp, Mus musculus
cgcacctactgcagcgaggcgtttc

SEQ ID NO: 341867 - DNA, 25 bp, Mus musculus
ggagggagtcggaattacacacaca

SEQ ID NO: 341868 - DNA, 25 bp, Mus musculus
ggtgatctgttccttcccgctaaca

SEQ ID NO: 341869 - DNA, 25 bp, Mus musculus
cgcggctgctcctccattgcaaagg

SEQ ID NO: 341870 - DNA, 25 bp, Mus musculus
ctccattgcaaaggcccgcaggttt

SEQ ID NO: 341871 - DNA, 25 bp, Mus musculus
agccctaaatcagccagggaacctg

SEQ ID NO: 341872 - DNA, 25 bp, Mus musculus
gccacagaaaataacccagcagttc

SEQ ID NO: 341873 - DNA, 25 bp, Mus musculus
tgatacggtcctcgatacgctcctc

SEQ ID NO: 341874 - DNA, 25 bp, Mus musculus
agcagcaggctgatacggtcctcga

SEQ ID NO: 341875 - DNA, 25 bp, Mus musculus
aacctgaataggaaccctgagcctc

SEQ ID NO: 341876 - DNA, 25 bp, Mus musculus
tgaaactgatggtgccgcaagcttc

SEQ ID NO: 341877 - DNA, 25 bp, Mus musculus
ctgacaggcctaaagcggtgaaact

SEQ ID NO: 341878 - DNA, 25 bp, Mus musculus
agggcatcttttgcggctctcttcc

SEQ ID NO: 341879 - DNA, 25 bp, Mus musculus
agcgccacgtcctcctgcagaatgt

SEQ ID NO: 341880 - DNA, 25 bp, Mus musculus
gcaagcctggctcaagacgggcaca

SEQ ID NO: 341881 - DNA, 25 bp, Mus musculus
ccgcaggtttgaacgccacagaaaa

SEQ ID NO: 341882 - DNA, 25 bp, Mus musculus
ccgcaagcttcggagccctaaatca

SEQ ID NO: 341883 - DNA, 25 bp, Mus musculus
tccacagctaaacactaacagccgt

SEQ ID NO: 341884 - DNA, 25 bp, Mus musculus
ggcgatcccgcgatcccaagttcgg

SEQ ID NO: 341885 - DNA, 25 bp, Mus musculus
aggctctatgcctgcgcacaagtcg

SEQ ID NO: 341886 - DNA, 25 bp, Mus musculus
acctctggctatccacagctaaaca

SEQ ID NO: 341887 - DNA, 25 bp, Mus musculus
gagaagacaccctaacctctggcta

SEQ ID NO: 341888 - DNA, 25 bp, Mus musculus
ccgattcgagaagacaccctaacct

SEQ ID NO: 341889 - DNA, 25 bp, Mus musculus
gcgccatggctcctccaaaatcaga

SEQ ID NO: 341890 - DNA, 25 bp, Mus musculus
accctagtgaccctgagcgccatgg

SEQ ID NO: 341891 - DNA, 25 bp, Mus musculus
cctcgcgaggtcaggctctatgcct

SEQ ID NO: 341892 - DNA, 25 bp, Mus musculus
gctcgctcctcattggccagttcgt

SEQ ID NO: 341893 - DNA, 25 bp, Mus musculus
gttcctccgcagcacgccgggagga

SEQ ID NO: 341894 - DNA, 25 bp, Mus musculus
gccagttcgtggcactcgctctctt

SEQ ID NO: 341895 - DNA, 25 bp, Mus musculus
tctcttcccattggcgccgcgggtt

SEQ ID NO: 341896 - DNA, 25 bp, Mus musculus
cgtagaatgcgtttcctgggcgatc

SEQ ID NO: 341897 - DNA, 25 bp, Mus musculus
gttcatcggcttgtactttggtttc

SEQ ID NO: 341898 - DNA, 25 bp, Mus musculus
cgaatccccgtacggcatgagtttt

SEQ ID NO: 341899 - DNA, 25 bp, Mus musculus
ggaacgtacatttcgtactattaga

SEQ ID NO: 341900 - DNA, 25 bp, Mus musculus
catttcgtactattagaataagccc

SEQ ID NO: 341901 - DNA, 25 bp, Mus musculus
aaaccacggcaacgaaaactcgatg

SEQ ID NO: 341902 - DNA, 25 bp, Mus musculus
gcaacgaaaactcgatgacagggtt

SEQ ID NO: 341903 - DNA, 25 bp, Mus musculus
ctcgatgacagggttgcatttttgc

SEQ ID NO: 341904 - DNA, 25 bp, Mus musculus
tgctgtatacccaagttcatcggct

SEQ ID NO: 341905 - DNA, 25 bp, Mus musculus
tactttggtttcttcgcctgagacg

SEQ ID NO: 341906 - DNA, 25 bp, Mus musculus
tcttcgcctgagacggtgacacctt

SEQ ID NO: 341907 - DNA, 25 bp, Mus musculus
ctgagacggtgacaccttgcgcata

SEQ ID NO: 341908 - DNA, 25 bp, Mus musculus
cttgcgcatatcctctgggcgagcc

SEQ ID NO: 341909 - DNA, 25 bp, Mus musculus
tatcctctgggcgagccgtgggaca

SEQ ID NO: 341910 - DNA, 25 bp, Mus musculus
gcatttttgctgtgctgtataccca

SEQ ID NO: 341911 - DNA, 25 bp, Mus musculus
gcaggaacgttaccgggccacgtca

SEQ ID NO: 341912 - DNA, 25 bp, Mus musculus
gctggtggacacgtggcttcgcttc

SEQ ID NO: 341913 - DNA, 25 bp, Mus musculus
ggcttcgcttcactcaggctcctcc

SEQ ID NO: 341914 - DNA, 25 bp, Mus musculus
ttcactcaggctcctcccaccgctg

SEQ ID NO: 341915 - DNA, 25 bp, Mus musculus
actcaggctcctcccaccgctggga

SEQ ID NO: 341916 - DNA, 25 bp, Mus musculus
aggctcctcccaccgctgggaaggc

SEQ ID NO: 341917 - DNA, 25 bp, Mus musculus
tcccaccgctgggaaggctccgctc

SEQ ID NO: 341918 - DNA, 25 bp, Mus musculus
caccgctgggaaggctccgctcgac

SEQ ID NO: 341919 - DNA, 25 bp, Mus musculus
gctgggaaggctccgctcgacccgc

SEQ ID NO: 341920 - DNA, 25 bp, Mus musculus
gagtgaccaatcctgcgcctgcgcg

SEQ ID NO: 341921 - DNA, 25 bp, Mus musculus
ggagtgaccaatcctgcgcctgcgc

SEQ ID NO: 341922 - DNA, 25 bp, Mus musculus
gcagccctcactcccgggggagtga

SEQ ID NO: 341923 - DNA, 25 bp, Mus musculus
ggggagtgaccaatcctgcgcctgc

SEQ ID NO: 341924 - DNA, 25 bp, Mus musculus
cgctggtggacacgtggcttcgctt

SEQ ID NO: 341925 - DNA, 25 bp, Mus musculus
agcgtcctcgcaagctcggcagtct

SEQ ID NO: 341926 - DNA, 25 bp, Mus musculus
caagcaggcacacgcacgctgggcg

SEQ ID NO: 341927 - DNA, 25 bp, Mus musculus
ctagcccgggctcggcaagcaggca

SEQ ID NO: 341928 - DNA, 25 bp, Mus musculus
atgtcagcagcgtcctcgcaagctc

SEQ ID NO: 341929 - DNA, 25 bp, Mus musculus
ctctcctcatggctcgccgccgctg

SEQ ID NO: 341930 - DNA, 25 bp, Mus musculus
tacttctcctccatgcaggctcagg

SEQ ID NO: 341931 - DNA, 25 bp, Mus musculus
tggaatcccaccttaccgggcgctg

SEQ ID NO: 341932 - DNA, 25 bp, Mus musculus
aggcgggaagcttgtccgcaccgcc

SEQ ID NO: 341933 - DNA, 25 bp, Mus musculus
agcaaggcgggaagcttgtccgcac

SEQ ID NO: 341934 - DNA, 25 bp, Mus musculus
agccacggaccgcagaggtagcccg

SEQ ID NO: 341935 - DNA, 25 bp, Mus musculus
tctcaagccacggaccgcagaggta

SEQ ID NO: 341936 - DNA, 25 bp, Mus musculus
cgcccgctcgccgatctcaagccac

SEQ ID NO: 341937 - DNA, 25 bp, Mus musculus
tcccgagcccagactcccgcccgct

SEQ ID NO: 341938 - DNA, 25 bp, Mus musculus
tcggcaagcaggcacacgcacgctg

SEQ ID NO: 341939 - DNA, 25 bp, Mus musculus
tcgagctactgcaccggggaagaaa

SEQ ID NO: 341940 - DNA, 25 bp, Mus musculus
gtaccggcagtaaagaacctagctg

SEQ ID NO: 341941 - DNA, 25 bp, Mus musculus
accggcagtaaagaacctagctgga

SEQ ID NO: 341942 - DNA, 25 bp, Mus musculus
ggcagtaaagaacctagctggagga

SEQ ID NO: 341943 - DNA, 25 bp, Mus musculus
gtaaagaacctagctggaggagagc

SEQ ID NO: 341944 - DNA, 25 bp, Mus musculus
aacctagctggaggagagcgcgcaa

SEQ ID NO: 341945 - DNA, 25 bp, Mus musculus
ccctgggtcgagctactgcaccggg

SEQ ID NO: 341946 - DNA, 25 bp, Mus musculus
ggctaggctgcagcgggtccctccg

SEQ ID NO: 341947 - DNA, 25 bp, Mus musculus
gctccgcgagaagagccccctgggt

SEQ ID NO: 341948 - DNA, 25 bp, Mus musculus
gcacgtctcgctcagataaagatcg

SEQ ID NO: 341949 - DNA, 25 bp, Mus musculus
cgcacgtctcgctcagataaagatc

SEQ ID NO: 341950 - DNA, 25 bp, Mus musculus
gctcgcacgtctcgctcagataaag

SEQ ID NO: 341951 - DNA, 25 bp, Mus musculus
cgagctactgcaccggggaagaaag

SEQ ID NO: 341952 - DNA, 25 bp, Mus musculus
gcgctcgcacgtctcgctcagataa

SEQ ID NO: 341953 - DNA, 25 bp, Mus musculus
agtgcagtcatgtctggcagaggta

SEQ ID NO: 341954 - DNA, 25 bp, Mus musculus
tgcaggttctcatttcggtccgccc

SEQ ID NO: 341955 - DNA, 25 bp, Mus musculus
gcaggttctcatttcggtccgcccg

SEQ ID NO: 341956 - DNA, 25 bp, Mus musculus
gtcagcatctctgttctgagctgtc

SEQ ID NO: 341957 - DNA, 25 bp, Mus musculus
tcagcatctctgttctgagctgtcc

SEQ ID NO: 341958 - DNA, 25 bp, Mus musculus
gcatctctgttctgagctgtcctga

SEQ ID NO: 341959 - DNA, 25 bp, Mus musculus
catctctgttctgagctgtcctgag

SEQ ID NO: 341960 - DNA, 25 bp, Mus musculus
gtctggcagaggtaagggcgggaaa

SEQ ID NO: 341961 - DNA, 25 bp, Mus musculus
cctgagtgcagtcatgtctggcaga

SEQ ID NO: 341962 - DNA, 25 bp, Mus musculus
tgcagtcatgtctggcagaggtaag

SEQ ID NO: 341963 - DNA, 25 bp, Mus musculus
ccctgcaggttctcatttcggtccg

SEQ ID NO: 341964 - DNA, 25 bp, Mus musculus
tccctgcaggttctcatttcggtcc

SEQ ID NO: 341965 - DNA, 25 bp, Mus musculus
tcctgagtgcagtcatgtctggcag

SEQ ID NO: 341966 - DNA, 25 bp, Mus musculus
ctgcaggttctcatttcggtccgcc

SEQ ID NO: 341967 - DNA, 25 bp, Mus musculus
agcctgggcttcagcggcctctgaa

SEQ ID NO: 341968 - DNA, 25 bp, Mus musculus
aggagctacgctctgtgctgccgac

SEQ ID NO: 341969 - DNA, 25 bp, Mus musculus
ctaccaaggtctaggagctacgctc

SEQ ID NO: 341970 - DNA, 25 bp, Mus musculus
ctctgccagtctccgggagggctac

SEQ ID NO: 341971 - DNA, 25 bp, Mus musculus
tcgcttcgctgtcccggttccttgg

SEQ ID NO: 341972 - DNA, 25 bp, Mus musculus
ccttgagtggctcggcagcagaagt

SEQ ID NO: 341973 - DNA, 25 bp, Mus musculus
caaaggcagcgatccaggcactctc

SEQ ID NO: 341974 - DNA, 25 bp, Mus musculus
agaaggcttccaagtggccgagaga

SEQ ID NO: 341975 - DNA, 25 bp, Mus musculus
cgctcccggcttcggaaagctgcag

SEQ ID NO: 341976 - DNA, 25 bp, Mus musculus
ccaagcaagctggtcactggccgga

SEQ ID NO: 341977 - DNA, 25 bp, Mus musculus
ggtacgccgcgctaacgcaaaggca

SEQ ID NO: 341978 - DNA, 25 bp, Mus musculus
aacgctccgggtaacgagcacagcc

SEQ ID NO: 341979 - DNA, 25 bp, Mus musculus
tgaccgctggcaactccaggaccga

SEQ ID NO: 341980 - DNA, 25 bp, Mus musculus
gatacacaccaatcaacgcccgaga

SEQ ID NO: 341981 - DNA, 25 bp, Mus musculus
ttcctccgacagagtttccgagcca

SEQ ID NO: 341982 - DNA, 25 bp, Mus musculus
gtcgccaagttcactgccgccgtgg

SEQ ID NO: 341983 - DNA, 25 bp, Mus musculus
gcggacttaactcggtctgggactc

SEQ ID NO: 341984 - DNA, 25 bp, Mus musculus
cgctaaacctgcctccgggacggag

SEQ ID NO: 341985 - DNA, 25 bp, Mus musculus
gggactgcggcttctcccgctaaac

SEQ ID NO: 341986 - DNA, 25 bp, Mus musculus
gctcggctgctgacatggactcccg

SEQ ID NO: 341987 - DNA, 25 bp, Mus musculus
ttggaccacaggagcgcgtcgccaa

SEQ ID NO: 341988 - DNA, 25 bp, Mus musculus
gccggcgactacatgacagaggttg

SEQ ID NO: 341989 - DNA, 25 bp, Mus musculus
catgtcccttttcggcccaaagtgc

SEQ ID NO: 341990 - DNA, 25 bp, Mus musculus
ggctcaggcgcctcggaaactttct

SEQ ID NO: 341991 - DNA, 25 bp, Mus musculus
ctgccgccgaagagactagggtccg

SEQ ID NO: 341992 - DNA, 25 bp, Mus musculus
tttccgagccagaggatgactccgc

SEQ ID NO: 341993 - DNA, 25 bp, Mus musculus
cagggtagggactccacgctccaga

SEQ ID NO: 341994 - DNA, 25 bp, Mus musculus
atgactccgctgaggaagcgccctc

SEQ ID NO: 341995 - DNA, 25 bp, Mus musculus
gaggccgaagcctaagcccaagccg

SEQ ID NO: 341996 - DNA, 25 bp, Mus musculus
ggcgttctccacgattctcccagtg

SEQ ID NO: 341997 - DNA, 25 bp, Mus musculus
catttgccatgaggactgtcgccgg

SEQ ID NO: 341998 - DNA, 25 bp, Mus musculus
cacctgcggccatcttaagttcggg

SEQ ID NO: 341999 - DNA, 25 bp, Mus musculus
tcgaaggccgggcatcaaccacagt

SEQ ID NO: 342000 - DNA, 25 bp, Mus musculus
cccgcgtggagctcaattaacaaaa

SEQ ID NO: 342001 - DNA, 25 bp, Mus musculus
gcagcgctagcagcctgacattaag

SEQ ID NO: 342002 - DNA, 25 bp, Mus musculus
gtcaccgccgacgagaggttcgtca

SEQ ID NO: 342003 - DNA, 25 bp, Mus musculus
agcgtcctcatctgctcgctggtca

SEQ ID NO: 342004 - DNA, 25 bp, Mus musculus
gccgggtgccctcatcaaacatggc

SEQ ID NO: 342005 - DNA, 25 bp, Mus musculus
gctcctcgatttctcctaggaagga

SEQ ID NO: 342006 - DNA, 25 bp, Mus musculus
ggtagagccgtagctcctcgatttc

SEQ ID NO: 342007 - DNA, 25 bp, Mus musculus
gttcgtcacctgaatcaccgtcgta

SEQ ID NO: 342008 - DNA, 25 bp, Mus musculus
accacagtcccggaggctcgagaga

SEQ ID NO: 342009 - DNA, 25 bp, Mus musculus
ctgcctgggtgaaaagcaggctcca

SEQ ID NO: 342010 - DNA, 25 bp, Mus musculus
tgcgaaactcacttcctgcctgggt

SEQ ID NO: 342011 - DNA, 25 bp, Mus musculus
ccgcccggaattgccgtgcgaaact

SEQ ID NO: 342012 - DNA, 25 bp, Mus musculus
tcactcgtgacaccgcccggaattg

SEQ ID NO: 342013 - DNA, 25 bp, Mus musculus
cggctcgcttctccgccgaaggaaa

SEQ ID NO: 342014 - DNA, 25 bp, Mus musculus
acttgtgtcaggagtttcccagccc

SEQ ID NO: 342015 - DNA, 25 bp, Mus musculus
cttcctgctcgcgacttgtgtcagg

SEQ ID NO: 342016 - DNA, 25 bp, Mus musculus
ggcttgacatggttccctgcccttc

SEQ ID NO: 342017 - DNA, 25 bp, Mus musculus
ttggctcgacgcttcccgtaaaaga

SEQ ID NO: 342018 - DNA, 25 bp, Mus musculus
ggcccacgaacttggctcgacgctt

SEQ ID NO: 342019 - DNA, 25 bp, Mus musculus
cgaggtggactaaagtaccgtcgct

SEQ ID NO: 342020 - DNA, 25 bp, Mus musculus
ctattcggcggctaaaatgccaagg

SEQ ID NO: 342021 - DNA, 25 bp, Mus musculus
gccaccttcactctcgagcgggaga

SEQ ID NO: 342022 - DNA, 25 bp, Mus musculus
ccgtcccgaggctcggcttgacatg

SEQ ID NO: 342023 - DNA, 25 bp, Mus musculus
ggctgagtatgcgacttgacggatc

SEQ ID NO: 342024 - DNA, 25 bp, Mus musculus
tccaaagttaggcaaagacgcgcgc

SEQ ID NO: 342025 - DNA, 25 bp, Mus musculus
gacaattgcggggtctccaaagtta

SEQ ID NO: 342026 - DNA, 25 bp, Mus musculus
agggcaccctggaaaccgacaattg

SEQ ID NO: 342027 - DNA, 25 bp, Mus musculus
tctagcgatctctcctaaaggtggc

SEQ ID NO: 342028 - DNA, 25 bp, Mus musculus
taaggccttttgcagcgcggctcta

SEQ ID NO: 342029 - DNA, 25 bp, Mus musculus
agagcaatttgtcacacggcgattc

SEQ ID NO: 342030 - DNA, 25 bp, Mus musculus
accggcgaggtatttgcatctgaga

SEQ ID NO: 342031 - DNA, 25 bp, Mus musculus
accgtggacgtcctcagattgagtt

SEQ ID NO: 342032 - DNA, 25 bp, Mus musculus
gacctgaagttttccgtccactctg

SEQ ID NO: 342033 - DNA, 25 bp, Mus musculus
tgcactttgcgcacggtccctaaga

SEQ ID NO: 342034 - DNA, 25 bp, Mus musculus
gcccaggtgactttccgctcagagg

SEQ ID NO: 342035 - DNA, 25 bp, Mus musculus
cccatttcagagacgtggagcctca

SEQ ID NO: 342036 - DNA, 25 bp, Mus musculus
tccatcttgcgttccgggtgaaacc

SEQ ID NO: 342037 - DNA, 25 bp, Mus musculus
acgctttcgggcgtgcagtcgttca

SEQ ID NO: 342038 - DNA, 25 bp, Mus musculus
gacgcctctaatggcacgctcaagg

SEQ ID NO: 342039 - DNA, 25 bp, Mus musculus
tggcacgctcaaggtgcaggaaacc

SEQ ID NO: 342040 - DNA, 25 bp, Mus musculus
ggtgcaggaaaccaccgccgctgct

SEQ ID NO: 342041 - DNA, 25 bp, Mus musculus
gggccggcctccgagcttgctgcaa

SEQ ID NO: 342042 - DNA, 25 bp, Mus musculus
ctccgagcttgctgcaagcggcgac

SEQ ID NO: 342043 - DNA, 25 bp, Mus musculus
cctccgaggagacaaagctggtgct

SEQ ID NO: 342044 - DNA, 25 bp, Mus musculus
cgcgaaattgcctcaagacggtgcc

SEQ ID NO: 342045 - DNA, 25 bp, Mus musculus
gcctcaagacggtgcctttgttaga

SEQ ID NO: 342046 - DNA, 25 bp, Mus musculus
cggtgcctttgttagaggaaacatt

SEQ ID NO: 342047 - DNA, 25 bp, Mus musculus
ctttgttagaggaaacattggatgc

SEQ ID NO: 342048 - DNA, 25 bp, Mus musculus
ggatgcactccgagcgccgcgaagc

SEQ ID NO: 342049 - DNA, 25 bp, Mus musculus
gcgtgcagtcgttcagtcagtcgcg

SEQ ID NO: 342050 - DNA, 25 bp, Mus musculus
aacattggatgcactccgagcgccg

SEQ ID NO: 342051 - DNA, 25 bp, Mus musculus
tctgcgatccagaacaccgctcaag

SEQ ID NO: 342052 - DNA, 25 bp, Mus musculus
agtacctgtggaggcctcgcagagc

SEQ ID NO: 342053 - DNA, 25 bp, Mus musculus
ggaaagggtgcgtctcccgcagccc

SEQ ID NO: 342054 - DNA, 25 bp, Mus musculus
atctcgtgtcctctcgtggtaaggg

SEQ ID NO: 342055 - DNA, 25 bp, Mus musculus
cttctctctggaaagggtgcgtctc

SEQ ID NO: 342056 - DNA, 25 bp, Mus musculus
tcgtccgagagccttgcgagcagcc

SEQ ID NO: 342057 - DNA, 25 bp, Mus musculus
aagcactgtcgtccgagagccttgc

SEQ ID NO: 342058 - DNA, 25 bp, Mus musculus
ggcggatccagcaagcactgtcgtc

SEQ ID NO: 342059 - DNA, 25 bp, Mus musculus
atctcgagactgaggccgctagcca

SEQ ID NO: 342060 - DNA, 25 bp, Mus musculus
ccagatctcgagactgaggccgcta

SEQ ID NO: 342061 - DNA, 25 bp, Mus musculus
cagagcggagcagaccagatctcga

SEQ ID NO: 342062 - DNA, 25 bp, Mus musculus
cagctggcgcgtggtcctccggctt

SEQ ID NO: 342063 - DNA, 25 bp, Mus musculus
taacccgcccactagagtacctgtg

SEQ ID NO: 342064 - DNA, 25 bp, Mus musculus
tcctctcgtggtaaggggcttctct

SEQ ID NO: 342065 - DNA, 25 bp, Mus musculus
ggcttctgggtaggacgctcaaccc

SEQ ID NO: 342066 - DNA, 25 bp, Mus musculus
acctggccgcgactgtgtggcccag

SEQ ID NO: 342067 - DNA, 25 bp, Mus musculus
ttcgtcctggagacctggccgcgac

SEQ ID NO: 342068 - DNA, 25 bp, Mus musculus
gcctcccttcggttcgtcctggaga

SEQ ID NO: 342069 - DNA, 25 bp, Mus musculus
gggaacttgcgtgctctgttctcca

SEQ ID NO: 342070 - DNA, 25 bp, Mus musculus
cgcgcaagccgtacagccaatgact

SEQ ID NO: 342071 - DNA, 25 bp, Mus musculus
aaaaggctctcctgcagctgtggcg

SEQ ID NO: 342072 - DNA, 25 bp, Mus musculus
cgccatctatcctgcgcatgcgtga

SEQ ID NO: 342073 - DNA, 25 bp, Mus musculus
ctcctctcagtaaaaggctctcctg

SEQ ID NO: 342074 - DNA, 25 bp, Mus musculus
cctctggtgggcgttacaagccttt

SEQ ID NO: 342075 - DNA, 25 bp, Mus musculus
cgctgtaaacaagcccggagccgga

SEQ ID NO: 342076 - DNA, 25 bp, Mus musculus
gggaccgaacggctcgccatctatc

SEQ ID NO: 342077 - DNA, 25 bp, Mus musculus
gatggctgccctcgctgtaaacaag

SEQ ID NO: 342078 - DNA, 25 bp, Mus musculus
agccaatgactgacgggagagaaaa

SEQ ID NO: 342079 - DNA, 25 bp, Mus musculus
tgaaaccggctctgactggcaaagg

SEQ ID NO: 342080 - DNA, 25 bp, Mus musculus
tgggcgtgcttgagatcaaccctcc

SEQ ID NO: 342081 - DNA, 25 bp, Mus musculus
gctgctacctttcctcttcttggca

SEQ ID NO: 342082 - DNA, 25 bp, Mus musculus
gttctcgctcgctcagttccgtttt

SEQ ID NO: 342083 - DNA, 25 bp, Mus musculus
tttctgatccctctgggtctcggcg

SEQ ID NO: 342084 - DNA, 25 bp, Mus musculus
ccatgtcgtccgaggcgttagaaga

SEQ ID NO: 342085 - DNA, 25 bp, Mus musculus
agagacgcgacgaccgagtgaacta

SEQ ID NO: 342086 - DNA, 25 bp, Mus musculus
agcttttgtccgtcagctgccggaa

SEQ ID NO: 342087 - DNA, 25 bp, Mus musculus
gcgcagctggtccaatcagcgagca

SEQ ID NO: 342088 - DNA, 25 bp, Mus musculus
tttctgtcaaggaggatggcagctc

SEQ ID NO: 342089 - DNA, 25 bp, Mus musculus
ccctagatcggacgcttacgcctta

SEQ ID NO: 342090 - DNA, 25 bp, Mus musculus
ttacgccttacgaactggaggtctc

SEQ ID NO: 342091 - DNA, 25 bp, Mus musculus
ctcgggccaatgctgttctagaacc

SEQ ID NO: 342092 - DNA, 25 bp, Mus musculus
ccggaagcgctttttgattggctgc

SEQ ID NO: 342093 - DNA, 25 bp, Mus musculus
gagctaaagggccaatccgtaaatc

SEQ ID NO: 342094 - DNA, 25 bp, Mus musculus
cggacctgaacctaacgtgatctcg

SEQ ID NO: 342095 - DNA, 25 bp, Mus musculus
gcgctgtcctcgcaacggacctgaa

SEQ ID NO: 342096 - DNA, 25 bp, Mus musculus
atccctttgggaatgcgctgtcctc

SEQ ID NO: 342097 - DNA, 25 bp, Mus musculus
ccctgcccggtgaagttgtagtggc

SEQ ID NO: 342098 - DNA, 25 bp, Mus musculus
accctagatgtgcatcgggccttcc

SEQ ID NO: 342099 - DNA, 25 bp, Mus musculus
tagttccgccaaccctagatgtgca

SEQ ID NO: 342100 - DNA, 25 bp, Mus musculus
accgcgtgtgctccgcggtaggaca

SEQ ID NO: 342101 - DNA, 25 bp, Mus musculus
cgaaatggttccgaccgcgtgtgct

SEQ ID NO: 342102 - DNA, 25 bp, Mus musculus
tcacctcccgaagcgggccgaaatg

SEQ ID NO: 342103 - DNA, 25 bp, Mus musculus
tgcagatagcactcacctcccgaag

SEQ ID NO: 342104 - DNA, 25 bp, Mus musculus
tccaggtcaggcgattgcagatagc

SEQ ID NO: 342105 - DNA, 25 bp, Mus musculus
aaatcccggggctgcgtccaggtca

SEQ ID NO: 342106 - DNA, 25 bp, Mus musculus
acgtgatctcgaaagcccaggactc

SEQ ID NO: 342107 - DNA, 25 bp, Mus musculus
tgctggcgcgggcttgcaccgcctt

SEQ ID NO: 342108 - DNA, 25 bp, Mus musculus
tgctcagcagcattgccggccctgt

SEQ ID NO: 342109 - DNA, 25 bp, Mus musculus
actggcagacgcacggagtcggtcc

SEQ ID NO: 342110 - DNA, 25 bp, Mus musculus
gatcccagatgaatccgtggcggga

SEQ ID NO: 342111 - DNA, 25 bp, Mus musculus
gcttggctgtgtgaggatcccagat

SEQ ID NO: 342112 - DNA, 25 bp, Mus musculus
cttgatccctggtctccctgggctt

SEQ ID NO: 342113 - DNA, 25 bp, Mus musculus
gcggctccgagtttccattcagatg

SEQ ID NO: 342114 - DNA, 25 bp, Mus musculus
tggcgctaatcggtccgccttgatc

SEQ ID NO: 342115 - DNA, 25 bp, Mus musculus
ccgcagcagtcaattggcgctaatc

SEQ ID NO: 342116 - DNA, 25 bp, Mus musculus
gagctgttccgcagcagtcaattgg

SEQ ID NO: 342117 - DNA, 25 bp, Mus musculus
tccacggctcgccagacctggaagg

SEQ ID NO: 342118 - DNA, 25 bp, Mus musculus
gcggcgttcaaagcctgcgctgcaa

SEQ ID NO: 342119 - DNA, 25 bp, Mus musculus
cgcgatcaagttctgctcagcagca

SEQ ID NO: 342120 - DNA, 25 bp, Mus musculus
gctcttgcttcggtgtcttcccgca

SEQ ID NO: 342121 - DNA, 25 bp, Mus musculus
tacctctgccagacatgactgcact

SEQ ID NO: 342122 - DNA, 25 bp, Mus musculus
ggaccgaaatgagaacctgcaggga

SEQ ID NO: 342123 - DNA, 25 bp, Mus musculus
gcggaccgaaatgagaacctgcagg

SEQ ID NO: 342124 - DNA, 25 bp, Mus musculus
gggcggaccgaaatgagaacctgca

SEQ ID NO: 342125 - DNA, 25 bp, Mus musculus
cgggcggaccgaaatgagaacctgc

SEQ ID NO: 342126 - DNA, 25 bp, Mus musculus
gacagctcagaacagagatgctgac

SEQ ID NO: 342127 - DNA, 25 bp, Mus musculus
ggacagctcagaacagagatgctga

SEQ ID NO: 342128 - DNA, 25 bp, Mus musculus
tcaggacagctcagaacagagatgc

SEQ ID NO: 342129 - DNA, 25 bp, Mus musculus
ctcaggacagctcagaacagagatg

SEQ ID NO: 342130 - DNA, 25 bp, Mus musculus
ctgccagacatgactgcactcagga

SEQ ID NO: 342131 - DNA, 25 bp, Mus musculus
ctctgccagacatgactgcactcag

SEQ ID NO: 342132 - DNA, 25 bp, Mus musculus
cttacctctgccagacatgactgca

SEQ ID NO: 342133 - DNA, 25 bp, Mus musculus
tttcccgcccttacctctgccagac

SEQ ID NO: 342134 - DNA, 25 bp, Mus musculus
tctgccagacatgactgcactcagg

SEQ ID NO: 342135 - DNA, 25 bp, Mus musculus
tccgcgtctcccacgagccgcgcgt

SEQ ID NO: 342136 - DNA, 25 bp, Mus musculus
gaaagcgctggagatgctcccgcag

SEQ ID NO: 342137 - DNA, 25 bp, Mus musculus
cgcctccgcccagccgcttgcagcc

SEQ ID NO: 342138 - DNA, 25 bp, Mus musculus
tcggcgcccaacatccgcctgcgct

SEQ ID NO: 342139 - DNA, 25 bp, Mus musculus
ccttggcctgggattcggcgcccaa

SEQ ID NO: 342140 - DNA, 25 bp, Mus musculus
cgcggaaagcgctggagatgctccc

SEQ ID NO: 342141 - DNA, 25 bp, Mus musculus
gcaggagacaaaccccgcggaaagc

SEQ ID NO: 342142 - DNA, 25 bp, Mus musculus
ccggctccagagacgggaagcggca

SEQ ID NO: 342143 - DNA, 25 bp, Mus musculus
cggctcccagcactcacggcgaggc

SEQ ID NO: 342144 - DNA, 25 bp, Mus musculus
ttgagcctccgagcgtcacctgggg

SEQ ID NO: 342145 - DNA, 25 bp, Mus musculus
ggaaagttgagcctccgagcgtcac

SEQ ID NO: 342146 - DNA, 25 bp, Mus musculus
atcaggtgcggaaagttgagcctcc

SEQ ID NO: 342147 - DNA, 25 bp, Mus musculus
cccgcatcaggtgcggaaagttgag

SEQ ID NO: 342148 - DNA, 25 bp, Mus musculus
tggcctgggattcggcgcccaacat

SEQ ID NO: 342149 - DNA, 25 bp, Mus musculus
gcaccatcagcaaggaccacgggta

SEQ ID NO: 342150 - DNA, 25 bp, Mus musculus
tagactacgtgaacaagaggacgcc

SEQ ID NO: 342151 - DNA, 25 bp, Mus musculus
gggcaatcaccgaccctatagacta

SEQ ID NO: 342152 - DNA, 25 bp, Mus musculus
gcgctgatctcgctcacttggctca

SEQ ID NO: 342153 - DNA, 25 bp, Mus musculus
atcccgcctatgctgggctggcgca

SEQ ID NO: 342154 - DNA, 25 bp, Mus musculus
cccaagaagagcctgaatggtcagc

SEQ ID NO: 342155 - DNA, 25 bp, Mus musculus
gggtacaccatctactccactttcg

SEQ ID NO: 342156 - DNA, 25 bp, Mus musculus
gctttctatattccgctgctgctca

SEQ ID NO: 342157 - DNA, 25 bp, Mus musculus
ctcatgctggtcctctatgggcgca

SEQ ID NO: 342158 - DNA, 25 bp, Mus musculus
ttccgaatccgcaagacggtcaaga

SEQ ID NO: 342159 - DNA, 25 bp, Mus musculus
gggcaccagcttcggaacatcgtcg

SEQ ID NO: 342160 - DNA, 25 bp, Mus musculus
acgacgccaccctggaggtgatcga

SEQ ID NO: 342161 - DNA, 25 bp, Mus musculus
cgcgctagacaggtactgggcaatc

SEQ ID NO: 342162 - DNA, 25 bp, Mus musculus
ttggctcattggctttctcatctcc

SEQ ID NO: 342163 - DNA, 25 bp, Mus musculus
tgcgcttgcgtggtacccggagcaa

SEQ ID NO: 342164 - DNA, 25 bp, Mus musculus
taaaattacgtcacaggttcccaga

SEQ ID NO: 342165 - DNA, 25 bp, Mus musculus
gagggcgcgctaaaattacgtcaca

SEQ ID NO: 342166 - DNA, 25 bp, Mus musculus
tccaaacgacgagggcgcgctaaaa

SEQ ID NO: 342167 - DNA, 25 bp, Mus musculus
gcgtcgccactccaaacgacgaggg

SEQ ID NO: 342168 - DNA, 25 bp, Mus musculus
ctaggaacgcgccatgttccgcgtc

SEQ ID NO: 342169 - DNA, 25 bp, Mus musculus
tgccgaaaacggcttctaggaacgc

SEQ ID NO: 342170 - DNA, 25 bp, Mus musculus
cgctgccgcctactgatgccgaaaa

SEQ ID NO: 342171 - DNA, 25 bp, Mus musculus
acgaagcggcgttggttgcttcctc

SEQ ID NO: 342172 - DNA, 25 bp, Mus musculus
tttccacttgtccacacgaagcggc

SEQ ID NO: 342173 - DNA, 25 bp, Mus musculus
agccaatagggttgtgtgcgcttgc

SEQ ID NO: 342174 - DNA, 25 bp, Mus musculus
aaatcgatagtctcctgcgctgatc

SEQ ID NO: 342175 - DNA, 25 bp, Mus musculus
ctcgagttcgaacccgaaggcgcgc

SEQ ID NO: 342176 - DNA, 25 bp, Mus musculus
ccgtaggtccggagaaaatcgatag

SEQ ID NO: 342177 - DNA, 25 bp, Mus musculus
cccagagccgcgaactttttacgca

SEQ ID NO: 342178 - DNA, 25 bp, Mus musculus
ttacgcatgcgcacgttagggctcc

SEQ ID NO: 342179 - DNA, 25 bp, Mus musculus
acgcatgtgcaggtcgtctggctac

SEQ ID NO: 342180 - DNA, 25 bp, Mus musculus
gatcgatggcgaatccgcttttgca

SEQ ID NO: 342181 - DNA, 25 bp, Mus musculus
ctcctcggcttggtgaagctaccgc

SEQ ID NO: 342182 - DNA, 25 bp, Mus musculus
ccgcgcatgcgtagactttccagtt

SEQ ID NO: 342183 - DNA, 25 bp, Mus musculus
tagggctcctggaacccgtaaagca

SEQ ID NO: 342184 - DNA, 25 bp, Mus musculus
cggccaggagccatcttaacagtct

SEQ ID NO: 342185 - DNA, 25 bp, Mus musculus
gtctctctaaggatgatgggattca

SEQ ID NO: 342186 - DNA, 25 bp, Mus musculus
gcctggcgctactcaatggcgagta

SEQ ID NO: 342187 - DNA, 25 bp, Mus musculus
ggcgcagcagggcaagaactacatc

SEQ ID NO: 342188 - DNA, 25 bp, Mus musculus
ttctcctagggagatggcgccaacg

SEQ ID NO: 342189 - DNA, 25 bp, Mus musculus
acgcacgcgtgctcagatgaagatc

SEQ ID NO: 342190 - DNA, 25 bp, Mus musculus
ttcgcgcactggcttgtacgcatgt

SEQ ID NO: 342191 - DNA, 25 bp, Mus musculus
caagtccgcagcgagtagccgccgg

SEQ ID NO: 342192 - DNA, 25 bp, Mus musculus
ctgcttctctgggacggcctgagat

SEQ ID NO: 342193 - DNA, 25 bp, Mus musculus
gaagatgccgaaggccaagtccgca

SEQ ID NO: 342194 - DNA, 25 bp, Mus musculus
gagcagaaaccgtcccgggtccatc

SEQ ID NO: 342195 - DNA, 25 bp, Mus musculus
tggatgcattggagcagaaaccgtc

SEQ ID NO: 342196 - DNA, 25 bp, Mus musculus
ggatggatggactcaaagatacatc

SEQ ID NO: 342197 - DNA, 25 bp, Mus musculus
cgggtccatcctgcttctctgggac

SEQ ID NO: 342198 - DNA, 25 bp, Mus musculus
ggtgggcgctcagcgctgacccttc

SEQ ID NO: 342199 - DNA, 25 bp, Mus musculus
aggagcccataagagactacaattc

SEQ ID NO: 342200 - DNA, 25 bp, Mus musculus
agggactcctccgagaagatgccga

SEQ ID NO: 342201 - DNA, 25 bp, Mus musculus
ctgctttcgcttggcacagggactc

SEQ ID NO: 342202 - DNA, 25 bp, Mus musculus
ctctcgggcgcctagtcgtgacggc

SEQ ID NO: 342203 - DNA, 25 bp, Mus musculus
actgagggcgacttccacgcggttc

SEQ ID NO: 342204 - DNA, 25 bp, Mus musculus
cgcctggtcttccttgccagcagga

SEQ ID NO: 342205 - DNA, 25 bp, Mus musculus
ggctcaccatcgctgcgcttgatct

SEQ ID NO: 342206 - DNA, 25 bp, Mus musculus
cccacaacccgtagagcaatcaaag

SEQ ID NO: 342207 - DNA, 25 bp, Mus musculus
agaggcgcggctcaccatcgctgcg

SEQ ID NO: 342208 - DNA, 25 bp, Mus musculus
ccgtagagcaatcaaaggggcagcc

SEQ ID NO: 342209 - DNA, 25 bp, Mus musculus
gcttgatctccacgtaaatcccgat

SEQ ID NO: 342210 - DNA, 25 bp, Mus musculus
gatctccacgtaaatcccgatctgg

SEQ ID NO: 342211 - DNA, 25 bp, Mus musculus
cccgatctggatcttgccgaagttg

SEQ ID NO: 342212 - DNA, 25 bp, Mus musculus
gatcttcacgctaccaccctttcca

SEQ ID NO: 342213 - DNA, 25 bp, Mus musculus
gatctggatcttgccgaagttggcc

SEQ ID NO: 342214 - DNA, 25 bp, Mus musculus
atcaaaggggcagccggcccgacgc

SEQ ID NO: 342215 - DNA, 25 bp, Mus musculus
cagcgcgaggcacgggcaaccctaa

SEQ ID NO: 342216 - DNA, 25 bp, Mus musculus
gcagagaccggtaaaaggcagagta

SEQ ID NO: 342217 - DNA, 25 bp, Mus musculus
cgccaccgaggcagagaccggtaaa

SEQ ID NO: 342218 - DNA, 25 bp, Mus musculus
cgaggcacgggcaaccctaacggag

SEQ ID NO: 342219 - DNA, 25 bp, Mus musculus
cgcgccgggtttgattccgcacgcg

SEQ ID NO: 342220 - DNA, 25 bp, Mus musculus
agggccgagtgggatcgaggctttc

SEQ ID NO: 342221 - DNA, 25 bp, Mus musculus
gcacgctgccgcaggaacgggttga

SEQ ID NO: 342222 - DNA, 25 bp, Mus musculus
ctcccgctccgcgtgcacgctgccg

SEQ ID NO: 342223 - DNA, 25 bp, Mus musculus
actcgcgacgtccttccagagctcc

SEQ ID NO: 342224 - DNA, 25 bp, Mus musculus
aacgactcgcgacgtccttccagag

SEQ ID NO: 342225 - DNA, 25 bp, Mus musculus
cggggctgagccgtccgcgggaacg

SEQ ID NO: 342226 - DNA, 25 bp, Mus musculus
cgccgggtttgattccgcacgcggc

SEQ ID NO: 342227 - DNA, 25 bp, Mus musculus
gtttgattccgcacgcggcggacta

SEQ ID NO: 342228 - DNA, 25 bp, Mus musculus
tttgattccgcacgcggcggactac

SEQ ID NO: 342229 - DNA, 25 bp, Mus musculus
gaaacgactcgcgacgtccttccag

SEQ ID NO: 342230 - DNA, 25 bp, Mus musculus
gcggcggactacgaggcgcgggaaa

SEQ ID NO: 342231 - DNA, 25 bp, Mus musculus
cgcaggaacgggttgagggccgagt

SEQ ID NO: 342232 - DNA, 25 bp, Mus musculus
ccgcggcttcctgccgtgcgcccgc

SEQ ID NO: 342233 - DNA, 25 bp, Mus musculus
actaatcaaaccatctagtagtttc

SEQ ID NO: 342234 - DNA, 25 bp, Mus musculus
tgtctcggccacctggtggaggtcc

SEQ ID NO: 342235 - DNA, 25 bp, Mus musculus
aaccatctagtagtttccctcagga

SEQ ID NO: 342236 - DNA, 25 bp, Mus musculus
tctcggccacctggtggaggtccgt

SEQ ID NO: 342237 - DNA, 25 bp, Mus musculus
gtgcaaatcggtcgtgacgtgcaaa

SEQ ID NO: 342238 - DNA, 25 bp, Mus musculus
taatcaaaccatctagtagtttccc

SEQ ID NO: 342239 - DNA, 25 bp, Mus musculus
tgcaaatcggtcgtgacgtgcaaat

SEQ ID NO: 342240 - DNA, 25 bp, Mus musculus
accatctagtagtttccctcaggat

SEQ ID NO: 342241 - DNA, 25 bp, Mus musculus
gcaaatcggtcgtgacgtgcaaatc

SEQ ID NO: 342242 - DNA, 25 bp, Mus musculus
caaatcggtcgtgacgtgcaaatcg

SEQ ID NO: 342243 - DNA, 25 bp, Mus musculus
aaatcggtcgtgacgtgcaaatcgg

SEQ ID NO: 342244 - DNA, 25 bp, Mus musculus
aaaccatctagtagtttccctcagg

SEQ ID NO: 342245 - DNA, 25 bp, Mus musculus
gcaccaccggcctgtctcggccacc

SEQ ID NO: 342246 - DNA, 25 bp, Mus musculus
atcaaaccatctagtagtttccctc

SEQ ID NO: 342247 - DNA, 25 bp, Mus musculus
aaggagccggggaaactgactcctg

SEQ ID NO: 342248 - DNA, 25 bp, Mus musculus
actgactcctgactcggtgaaccga

SEQ ID NO: 342249 - DNA, 25 bp, Mus musculus
tcggatcccatcacctccgagaagg

SEQ ID NO: 342250 - DNA, 25 bp, Mus musculus
catcacctccgagaaggactggggt

SEQ ID NO: 342251 - DNA, 25 bp, Mus musculus
aggtcccgcgcccaaaccactgccg

SEQ ID NO: 342252 - DNA, 25 bp, Mus musculus
aagatgatcaacgaaaggagccggg

SEQ ID NO: 342253 - DNA, 25 bp, Mus musculus
cccgccgccattgagaagatgatca

SEQ ID NO: 342254 - DNA, 25 bp, Mus musculus
gcactgagcccagtgtccgggcaca

SEQ ID NO: 342255 - DNA, 25 bp, Mus musculus
caggaggtgcactgagcccagtgtc

SEQ ID NO: 342256 - DNA, 25 bp, Mus musculus
ggagtttccactgcccacgccgtgg

SEQ ID NO: 342257 - DNA, 25 bp, Mus musculus
tgaaccgaggtgaaggtcccgcgcc

SEQ ID NO: 342258 - DNA, 25 bp, Mus musculus
gggtcctgctcatgagcccgcaaaa

SEQ ID NO: 342259 - DNA, 25 bp, Mus musculus
aaggactggggtcctgctcatgagc

SEQ ID NO: 342260 - DNA, 25 bp, Mus musculus
atgagcccgcaaaaccttggcgttt

SEQ ID NO: 342261 - DNA, 25 bp, Mus musculus
tgttttccacttcacttttcgccga

SEQ ID NO: 342262 - DNA, 25 bp, Mus musculus
gctgagctcagccactgttttccac

SEQ ID NO: 342263 - DNA, 25 bp, Mus musculus
aggaagcgcgacacgcacacgccgt

SEQ ID NO: 342264 - DNA, 25 bp, Mus musculus
gcctaggccgtgacgacatcgccga

SEQ ID NO: 342265 - DNA, 25 bp, Mus musculus
acatcgccgaggaggagcgccgata

SEQ ID NO: 342266 - DNA, 25 bp, Mus musculus
gggcctatgcaaatcactgggctga

SEQ ID NO: 342267 - DNA, 25 bp, Mus musculus
cactgggctgaaacataaatagagc

SEQ ID NO: 342268 - DNA, 25 bp, Mus musculus
taaatagagcgctccgtggacacgg

SEQ ID NO: 342269 - DNA, 25 bp, Mus musculus
ctgtgagaatgtcaggctgctgtga

SEQ ID NO: 342270 - DNA, 25 bp, Mus musculus
ctccttttgatgtccgccgagcgtg

SEQ ID NO: 342271 - DNA, 25 bp, Mus musculus
gcactctttcagtccttcgggccaa

SEQ ID NO: 342272 - DNA, 25 bp, Mus musculus
aacaaagaaatgctgcgtgaagccc

SEQ ID NO: 342273 - DNA, 25 bp, Mus musculus
cggacacgcgcagcgctcggatgct

SEQ ID NO: 342274 - DNA, 25 bp, Mus musculus
gcggaggaggcgctttcaaaacaaa

SEQ ID NO: 342275 - DNA, 25 bp, Mus musculus
tctagctgcggctctctgggctgag

SEQ ID NO: 342276 - DNA, 25 bp, Mus musculus
cgagttagggaacacgccagtcctt

SEQ ID NO: 342277 - DNA, 25 bp, Mus musculus
agggaacacgccagtccttccacgg

SEQ ID NO: 342278 - DNA, 25 bp, Mus musculus
cttccacggcctcgagaaggctcta

SEQ ID NO: 342279 - DNA, 25 bp, Mus musculus
cctcgtgtctagctgcggctctctg

SEQ ID NO: 342280 - DNA, 25 bp, Mus musculus
cacgcaggacgcgaggccacgatgc

SEQ ID NO: 342281 - DNA, 25 bp, Mus musculus
ctcccgctatggctctagacattgc

SEQ ID NO: 342282 - DNA, 25 bp, Mus musculus
gctctagacattgcgccgccggaaa

SEQ ID NO: 342283 - DNA, 25 bp, Mus musculus
gacctgagcggagcggcttccgctt

SEQ ID NO: 342284 - DNA, 25 bp, Mus musculus
cttgctgtagcctaagctgagcgtg

SEQ ID NO: 342285 - DNA, 25 bp, Mus musculus
tgtagcctaagctgagcgtgtggcc

SEQ ID NO: 342286 - DNA, 25 bp, Mus musculus
gctctctgagctcctgaccgcgggt

SEQ ID NO: 342287 - DNA, 25 bp, Mus musculus
tccttagccggtgaggccgactgat

SEQ ID NO: 342288 - DNA, 25 bp, Mus musculus
ctcgagaaggctctaaggagactgc

SEQ ID NO: 342289 - DNA, 25 bp, Mus musculus
agggttgctttctatcaagggcctc

SEQ ID NO: 342290 - DNA, 25 bp, Mus musculus
aagggttgctttctatcaagggcct

SEQ ID NO: 342291 - DNA, 25 bp, Mus musculus
tatcaagggcctcacttccccttgg

SEQ ID NO: 342292 - DNA, 25 bp, Mus musculus
gggttgctttctatcaagggcctca

SEQ ID NO: 342293 - DNA, 25 bp, Mus musculus
ggttgctttctatcaagggcctcac

SEQ ID NO: 342294 - DNA, 25 bp, Mus musculus
gttgctttctatcaagggcctcact

SEQ ID NO: 342295 - DNA, 25 bp, Mus musculus
ttgctttctatcaagggcctcactt

SEQ ID NO: 342296 - DNA, 25 bp, Mus musculus
tgctttctatcaagggcctcacttc

SEQ ID NO: 342297 - DNA, 25 bp, Mus musculus
gctttctatcaagggcctcacttcc

SEQ ID NO: 342298 - DNA, 25 bp, Mus musculus
ctttctatcaagggcctcacttccc

SEQ ID NO: 342299 - DNA, 25 bp, Mus musculus
tttctatcaagggcctcacttcccc

SEQ ID NO: 342300 - DNA, 25 bp, Mus musculus
atcaagggcctcacttccccttggc

SEQ ID NO: 342301 - DNA, 25 bp, Mus musculus
caactcctccaagtgtttttgtagg

SEQ ID NO: 342302 - DNA, 25 bp, Mus musculus
gaaagggttgctttctatcaagggc

SEQ ID NO: 342303 - DNA, 25 bp, Mus musculus
gcttgcctcttcctgacatggtaga

SEQ ID NO: 342304 - DNA, 25 bp, Mus musculus
gtttgaaggcaaagctgacagtatt

SEQ ID NO: 342305 - DNA, 25 bp, Mus musculus
acctagaatataagcctgctcagta

SEQ ID NO: 342306 - DNA, 25 bp, Mus musculus
tggtagaacctagaatataagcctg

SEQ ID NO: 342307 - DNA, 25 bp, Mus musculus
ctgcttgcctcttcctgacatggta

SEQ ID NO: 342308 - DNA, 25 bp, Mus musculus
tcctgacatggtagaacctagaata

SEQ ID NO: 342309 - DNA, 25 bp, Mus musculus
cctcttcctgacatggtagaaccta

SEQ ID NO: 342310 - DNA, 25 bp, Mus musculus
tttcattggttacatagaagcattg

SEQ ID NO: 342311 - DNA, 25 bp, Mus musculus
gtaggaatttcattggttacataga

SEQ ID NO: 342312 - DNA, 25 bp, Mus musculus
gtatttatagtcaatgcagggcatg

SEQ ID NO: 342313 - DNA, 25 bp, Mus musculus
gcagggcatgaaaaagtaggaattt

SEQ ID NO: 342314 - DNA, 25 bp, Mus musculus
tcagtaagtggtttgaaggcaaagc

SEQ ID NO: 342315 - DNA, 25 bp, Mus musculus
aagcctgctcagtaagtggtttgaa

SEQ ID NO: 342316 - DNA, 25 bp, Mus musculus
ggcaaagctgacagtatttatagtc

SEQ ID NO: 342317 - DNA, 25 bp, Mus musculus
tttcctcttccggtgccaagggaga

SEQ ID NO: 342318 - DNA, 25 bp, Mus musculus
agtcacgcgcgtgtcttttcctctt

SEQ ID NO: 342319 - DNA, 25 bp, Mus musculus
gaggaccctcttcgcttgcgtagag

SEQ ID NO: 342320 - DNA, 25 bp, Mus musculus
tttgtccgctcgacagtcgggtttg

SEQ ID NO: 342321 - DNA, 25 bp, Mus musculus
tggacccgagatgttgagctttttg

SEQ ID NO: 342322 - DNA, 25 bp, Mus musculus
caatgagagcccgtgttgttgcatc

SEQ ID NO: 342323 - DNA, 25 bp, Mus musculus
cagtaacgccgctctccgttggtca

SEQ ID NO: 342324 - DNA, 25 bp, Mus musculus
tgcctgcgccgaactcaaggtctga

SEQ ID NO: 342325 - DNA, 25 bp, Mus musculus
ctcggcgacgtagtagtatttgttc

SEQ ID NO: 342326 - DNA, 25 bp, Mus musculus
tcacctctccagttcttgtactcgg

SEQ ID NO: 342327 - DNA, 25 bp, Mus musculus
gggacgcgcatccatcgaccggtat

SEQ ID NO: 342328 - DNA, 25 bp, Mus musculus
ggtccaaacttcgtcgcccaaggca

SEQ ID NO: 342329 - DNA, 25 bp, Mus musculus
gttggtcaggccacatcgctgattg

SEQ ID NO: 342330 - DNA, 25 bp, Mus musculus
gcggacaacccggatctgaagacca

SEQ ID NO: 342331 - DNA, 25 bp, Mus musculus
gaacagcatcccgtcccggtgactg

SEQ ID NO: 342332 - DNA, 25 bp, Mus musculus
cctgcccgagggaactcagggcgct

SEQ ID NO: 342333 - DNA, 25 bp, Mus musculus
agactcctcttcacaaaccagctat

SEQ ID NO: 342334 - DNA, 25 bp, Mus musculus
gctccgggtcctggcttcccagact

SEQ ID NO: 342335 - DNA, 25 bp, Mus musculus
ctctttggctccgggaacagcatcc

SEQ ID NO: 342336 - DNA, 25 bp, Mus musculus
gaggtcactttctcggctccgggtc

SEQ ID NO: 342337 - DNA, 25 bp, Mus musculus
gaactcagggcgctgtctctttggc

SEQ ID NO: 342338 - DNA, 25 bp, Mus musculus
aggtcttgctcgaccttggaccgcg

SEQ ID NO: 342339 - DNA, 25 bp, Mus musculus
ttgagactcaaggagggaaggtctt

SEQ ID NO: 342340 - DNA, 25 bp, Mus musculus
agctgctgcggttgagactcaagga

SEQ ID NO: 342341 - DNA, 25 bp, Mus musculus
atcccgtcccggtgactgctgcggg

SEQ ID NO: 342342 - DNA, 25 bp, Mus musculus
ccacggctgtggaacaggtcgttct

SEQ ID NO: 342343 - DNA, 25 bp, Mus musculus
aggatgagtccacggctgtggaaca

SEQ ID NO: 342344 - DNA, 25 bp, Mus musculus
ccttggaccgcggaggtcactttct

SEQ ID NO: 342345 - DNA, 25 bp, Mus musculus
tccggcggctggacttcgaccctgg

SEQ ID NO: 342346 - DNA, 25 bp, Mus musculus
tacatgaccgcggtggagaaccagc

SEQ ID NO: 342347 - DNA, 25 bp, Mus musculus
ggtctccgcctggtggagcctctgt

SEQ ID NO: 342348 - DNA, 25 bp, Mus musculus
ggtggagcctctgtgccgcagccac

SEQ ID NO: 342349 - DNA, 25 bp, Mus musculus
actctccatcttgcagaatcgtggc

SEQ ID NO: 342350 - DNA, 25 bp, Mus musculus
aggggtgcagcctcggctctcacca

SEQ ID NO: 342351 - DNA, 25 bp, Mus musculus
atcttgcagaatcgtggcggttccc

SEQ ID NO: 342352 - DNA, 25 bp, Mus musculus
cagctggccaccgagttatgttcac

SEQ ID NO: 342353 - DNA, 25 bp, Mus musculus
gaggtccctcctgatagcactgtcc

SEQ ID NO: 342354 - DNA, 25 bp, Mus musculus
cagtctccgaggtccctcctgatag

SEQ ID NO: 342355 - DNA, 25 bp, Mus musculus
ccaggaaggcggcatacatgaccgc

SEQ ID NO: 342356 - DNA, 25 bp, Mus musculus
ggtgcaccctctggggctcggcact

SEQ ID NO: 342357 - DNA, 25 bp, Mus musculus
gtcttcacgtccagctccagcttgg

SEQ ID NO: 342358 - DNA, 25 bp, Mus musculus
cgagttatgttcactctccatcttg

SEQ ID NO: 342359 - DNA, 25 bp, Mus musculus
tgcagttcctggcagctgccacaga

SEQ ID NO: 342360 - DNA, 25 bp, Mus musculus
cttccatcgggatggagtgtgtgca

SEQ ID NO: 342361 - DNA, 25 bp, Mus musculus
gccgcacaacctgagtctggagcta

SEQ ID NO: 342362 - DNA, 25 bp, Mus musculus
tctggagctagtggccgtcgcgtcc

SEQ ID NO: 342363 - DNA, 25 bp, Mus musculus
cccgaggtctgtgccaggttctggc

SEQ ID NO: 342364 - DNA, 25 bp, Mus musculus
tgtgccaggttctggcaccgcccgg

SEQ ID NO: 342365 - DNA, 25 bp, Mus musculus
ggcgtggtggcctctataacctttc

SEQ ID NO: 342366 - DNA, 25 bp, Mus musculus
ccctcgcacagcacagtggtaactt

SEQ ID NO: 342367 - DNA, 25 bp, Mus musculus
tacggctattgcagttcctggcagc

SEQ ID NO: 342368 - DNA, 25 bp, Mus musculus
agcacagtggtaacttccatcggga

SEQ ID NO: 342369 - DNA, 25 bp, Mus musculus
ctcggagctccggtacgctgagagc

SEQ ID NO: 342370 - DNA, 25 bp, Mus musculus
cggcctgagctacggctattgcagt

SEQ ID NO: 342371 - DNA, 25 bp, Mus musculus
tgggatgtctccttaccctcgcaca

SEQ ID NO: 342372 - DNA, 25 bp, Mus musculus
gtgtgcagacgctgtggctcagcct

SEQ ID NO: 342373 - DNA, 25 bp, Mus musculus
ccaaggtggcatgaactacttctgc

SEQ ID NO: 342374 - DNA, 25 bp, Mus musculus
cccattggcgaggagaaagtgttct

SEQ ID NO: 342375 - DNA, 25 bp, Mus musculus
cccgggtagtgaaatccaggacaca

SEQ ID NO: 342376 - DNA, 25 bp, Mus musculus
cttgtgattcaaactgcggcgcggc

SEQ ID NO: 342377 - DNA, 25 bp, Mus musculus
cgcgttggcaatggagcaccgcgta

SEQ ID NO: 342378 - DNA, 25 bp, Mus musculus
cggagtcagccctaccaaggtggca

SEQ ID NO: 342379 - DNA, 25 bp, Mus musculus
cttctgccgccggtagttggatgct

SEQ ID NO: 342380 - DNA, 25 bp, Mus musculus
tttggacggcgccttcagccttaac

SEQ ID NO: 342381 - DNA, 25 bp, Mus musculus
gtgttctttcctcctaggtgctgga

SEQ ID NO: 342382 - DNA, 25 bp, Mus musculus
tgtcaccgccaagactcgggcagtg

SEQ ID NO: 342383 - DNA, 25 bp, Mus musculus
cgaagctccgggcttgtgattcaaa

SEQ ID NO: 342384 - DNA, 25 bp, Mus musculus
taggttttgggcagcgccatccact

SEQ ID NO: 342385 - DNA, 25 bp, Mus musculus
cgccatccactgtgtgccggcggta

SEQ ID NO: 342386 - DNA, 25 bp, Mus musculus
gcgatcagtcatgtccgcaagcatc

SEQ ID NO: 342387 - DNA, 25 bp, Mus musculus
gtcgctacgcctcaagcggggccag

SEQ ID NO: 342388 - DNA, 25 bp, Mus musculus
atggaccgcacctcctacgcggtgg

SEQ ID NO: 342389 - DNA, 25 bp, Mus musculus
tttctgcctctgctacggagcaagg

SEQ ID NO: 342390 - DNA, 25 bp, Mus musculus
ggacaccgagcgctacctgtactgc

SEQ ID NO: 342391 - DNA, 25 bp, Mus musculus
tcctacgcggtggagacaggtcacc

SEQ ID NO: 342392 - DNA, 25 bp, Mus musculus
ggagctacccgtggtcgctacgcct

SEQ ID NO: 342393 - DNA, 25 bp, Mus musculus
tggaggcacgagcagcaccaccagt

SEQ ID NO: 342394 - DNA, 25 bp, Mus musculus
cctaagcatctctggaggcacgagc

SEQ ID NO: 342395 - DNA, 25 bp, Mus musculus
cagcgaagagggcaatgacagcgct

SEQ ID NO: 342396 - DNA, 25 bp, Mus musculus
ctacaagtcggaagctgagcccagc

SEQ ID NO: 342397 - DNA, 25 bp, Mus musculus
caggagcctctgaccgctacaagtc

SEQ ID NO: 342398 - DNA, 25 bp, Mus musculus
gtggcgatcgctcccgctaacagag

SEQ ID NO: 342399 - DNA, 25 bp, Mus musculus
cggagcaaggatccctgtggcgatc

SEQ ID NO: 342400 - DNA, 25 bp, Mus musculus
gctacctgtactgccgtgccatgga

SEQ ID NO: 342401 - DNA, 25 bp, Mus musculus
cgaacgatcgacgtgggttcctctc

SEQ ID NO: 342402 - DNA, 25 bp, Mus musculus
gggacccgagatctcgcggattata

SEQ ID NO: 342403 - DNA, 25 bp, Mus musculus
agcgaccgcagcagccttctgaaga

SEQ ID NO: 342404 - DNA, 25 bp, Mus musculus
cacacagtcaggagggcggtgccaa

SEQ ID NO: 342405 - DNA, 25 bp, Mus musculus
gactcaaagaagaagcgaccgcagc

SEQ ID NO: 342406 - DNA, 25 bp, Mus musculus
ccgccggcaccaagatgtgcgagca

SEQ ID NO: 342407 - DNA, 25 bp, Mus musculus
acgatggagctcctgcggactatca

SEQ ID NO: 342408 - DNA, 25 bp, Mus musculus
ctcgcacaagcgaagcaggacgtca

SEQ ID NO: 342409 - DNA, 25 bp, Mus musculus
aaagcttcgctgctcgctcttgctc

SEQ ID NO: 342410 - DNA, 25 bp, Mus musculus
ccagccggcgcgtatttaaagcttc

SEQ ID NO: 342411 - DNA, 25 bp, Mus musculus
aggtcgaagcccacgacatccaggc

SEQ ID NO: 342412 - DNA, 25 bp, Mus musculus
tctcgctccttcagctgtctggttc

SEQ ID NO: 342413 - DNA, 25 bp, Mus musculus
tctgtttcccacgtccaaagtcagg

SEQ ID NO: 342414 - DNA, 25 bp, Mus musculus
ccaaagtcagggcacgcgacgaact

SEQ ID NO: 342415 - DNA, 25 bp, Mus musculus
cccaggggactgtgttaccttctgc

SEQ ID NO: 342416 - DNA, 25 bp, Mus musculus
ttctggcccaagtagcagctcacgc

SEQ ID NO: 342417 - DNA, 25 bp, Mus musculus
acagaaccttctggcccaagtagca

SEQ ID NO: 342418 - DNA, 25 bp, Mus musculus
aggagggcctccaccacagaacctt

SEQ ID NO: 342419 - DNA, 25 bp, Mus musculus
tgcaaacgaacccactgggcggagc

SEQ ID NO: 342420 - DNA, 25 bp, Mus musculus
cgcggtgcaaacgaacccactgggc

SEQ ID NO: 342421 - DNA, 25 bp, Mus musculus
ggaagccgcggtgcaaacgaaccca

SEQ ID NO: 342422 - DNA, 25 bp, Mus musculus
aatgttctgggccaagtctcgcgag

SEQ ID NO: 342423 - DNA, 25 bp, Mus musculus
tggcgccgacccgatccgcaatgtt

SEQ ID NO: 342424 - DNA, 25 bp, Mus musculus
cacaaccagtctcagtcccaaaatg

SEQ ID NO: 342425 - DNA, 25 bp, Mus musculus
accctcacgcctcgcgccaccaacg

SEQ ID NO: 342426 - DNA, 25 bp, Mus musculus
cgatccgcaatgttctgggccaagt

SEQ ID NO: 342427 - DNA, 25 bp, Mus musculus
agtctcagtcccaaaatggcgccga

SEQ ID NO: 342428 - DNA, 25 bp, Mus musculus
acgcagcggagaggttgagaagtaa

SEQ ID NO: 342429 - DNA, 25 bp, Mus musculus
gcgctgctcgttcgccctaaaggta

SEQ ID NO: 342430 - DNA, 25 bp, Mus musculus
agactcagtggtcgcggctcctccg

SEQ ID NO: 342431 - DNA, 25 bp, Mus musculus
aggacccggctggtcccagactcag

SEQ ID NO: 342432 - DNA, 25 bp, Mus musculus
gccgagcggcccgagagtctcttta

SEQ ID NO: 342433 - DNA, 25 bp, Mus musculus
gcgcagagaccgacccacacctcga

SEQ ID NO: 342434 - DNA, 25 bp, Mus musculus
tctctaccccgaagcctgcgaggtg

SEQ ID NO: 342435 - DNA, 25 bp, Mus musculus
agcggagcgggactctctaccccga

SEQ ID NO: 342436 - DNA, 25 bp, Mus musculus
gagcggtctcccttcgggactaggc

SEQ ID NO: 342437 - DNA, 25 bp, Mus musculus
agccacggctcctcccgcgggtcct

SEQ ID NO: 342438 - DNA, 25 bp, Mus musculus
cgcagccggcccgagagccacggct

SEQ ID NO: 342439 - DNA, 25 bp, Mus musculus
aaaggtaccaatatggcggaggtga

SEQ ID NO: 342440 - DNA, 25 bp, Mus musculus
gccctaaaggtaccaatatggcgga

SEQ ID NO: 342441 - DNA, 25 bp, Mus musculus
tcggcgctgctcgttcgccctaaag

SEQ ID NO: 342442 - DNA, 25 bp, Mus musculus
cgttcgccctaaaggtaccaatatg

SEQ ID NO: 342443 - DNA, 25 bp, Mus musculus
acgtcgtgaggtcctgccattccgt

SEQ ID NO: 342444 - DNA, 25 bp, Mus musculus
aggcgcttgtgtctgtctcactttc

SEQ ID NO: 342445 - DNA, 25 bp, Mus musculus
tctgctcttttctacgcgttaatga

SEQ ID NO: 342446 - DNA, 25 bp, Mus musculus
gtctcactttcagccgagtcttccg

SEQ ID NO: 342447 - DNA, 25 bp, Mus musculus
tcttccgctgcatagactgcagatc

SEQ ID NO: 342448 - DNA, 25 bp, Mus musculus
tgcagatcagcagcacgctcacaaa

SEQ ID NO: 342449 - DNA, 25 bp, Mus musculus
ttccgtcctctcacttcgggttgta

SEQ ID NO: 342450 - DNA, 25 bp, Mus musculus
taacagctttggcagcagcgagggc

SEQ ID NO: 342451 - DNA, 25 bp, Mus musculus
gcatcccggggcttcaagtacttca

SEQ ID NO: 342452 - DNA, 25 bp, Mus musculus
gcttgctcgagtcagcccagggcat

SEQ ID NO: 342453 - DNA, 25 bp, Mus musculus
tactaaaggaaaaaagcgcgcgcgc

SEQ ID NO: 342454 - DNA, 25 bp, Mus musculus
cagcatccttgtaagggcggagtta

SEQ ID NO: 342455 - DNA, 25 bp, Mus musculus
gactaagccttgacttttccgagga

SEQ ID NO: 342456 - DNA, 25 bp, Mus musculus
agcagcctgctctcgctgtgcgttt

SEQ ID NO: 342457 - DNA, 25 bp, Mus musculus
ggtcgcccacaagttctcttttctc

SEQ ID NO: 342458 - DNA, 25 bp, Mus musculus
ccggatgtttcagcagctctctgga

SEQ ID NO: 342459 - DNA, 25 bp, Mus musculus
ttagcggcatggtcgcccacaagtt

SEQ ID NO: 342460 - DNA, 25 bp, Mus musculus
tctctccgcgttgcatatcctgtct

SEQ ID NO: 342461 - DNA, 25 bp, Mus musculus
cgcgttgcatatcctgtctccatta

SEQ ID NO: 342462 - DNA, 25 bp, Mus musculus
cctgtctccattagagctgatctga

SEQ ID NO: 342463 - DNA, 25 bp, Mus musculus
ccattagagctgatctgaacaatta

SEQ ID NO: 342464 - DNA, 25 bp, Mus musculus
ctgaacaattaactaccacgtggta

SEQ ID NO: 342465 - DNA, 25 bp, Mus musculus
ccacgtggtacggaagaccggatgt

SEQ ID NO: 342466 - DNA, 25 bp, Mus musculus
ggaagaccggatgtttcagcagctc

SEQ ID NO: 342467 - DNA, 25 bp, Mus musculus
ccggtcctgaggctgaagttctaag

SEQ ID NO: 342468 - DNA, 25 bp, Mus musculus
tgaagttctaagcagcgcagcgcca

SEQ ID NO: 342469 - DNA, 25 bp, Mus musculus
ttctaagcagcgcagcgccacgtcg

SEQ ID NO: 342470 - DNA, 25 bp, Mus musculus
cccgtttctggctgttcagtggcgt

SEQ ID NO: 342471 - DNA, 25 bp, Mus musculus
aacactgtctcttcgctgggtatga

SEQ ID NO: 342472 - DNA, 25 bp, Mus musculus
tccaccggcgtgaacactgtctctt

SEQ ID NO: 342473 - DNA, 25 bp, Mus musculus
tgcacttgtcctccaccggcgtgaa

SEQ ID NO: 342474 - DNA, 25 bp, Mus musculus
gagctcggtgttcacatctaacctg

SEQ ID NO: 342475 - DNA, 25 bp, Mus musculus
cttcaagaaggtcctcgatgctgga

SEQ ID NO: 342476 - DNA, 25 bp, Mus musculus
ctgtcgtgtcacttgaaggcatgga

SEQ ID NO: 342477 - DNA, 25 bp, Mus musculus
cggacttgaaagtgactgtcgtgtc

SEQ ID NO: 342478 - DNA, 25 bp, Mus musculus
cgtcgtctttgtaggtgtcgtcatt

SEQ ID NO: 342479 - DNA, 25 bp, Mus musculus
tcattttcggccttttccggagaga

SEQ ID NO: 342480 - DNA, 25 bp, Mus musculus
tttgtaggtgtcgtcattttcggcc

SEQ ID NO: 342481 - DNA, 25 bp, Mus musculus
gtatgacggcgttgccactgttgcc

SEQ ID NO: 342482 - DNA, 25 bp, Mus musculus
tcctcgatgctggagttgagctcgg

SEQ ID NO: 342483 - DNA, 25 bp, Mus musculus
aggacggcgacttcggacttgaaag

SEQ ID NO: 342484 - DNA, 25 bp, Mus musculus
aaggcatggatgcttcaagaaggtc

SEQ ID NO: 342485 - DNA, 25 bp, Mus musculus
cactttcaactaaaaaaggctgttg

SEQ ID NO: 342486 - DNA, 25 bp, Mus musculus
tgtattcactttggggttcctctaa

SEQ ID NO: 342487 - DNA, 25 bp, Mus musculus
ctgtattcactttggggttcctcta

SEQ ID NO: 342488 - DNA, 25 bp, Mus musculus
cctgtattcactttggggttcctct

SEQ ID NO: 342489 - DNA, 25 bp, Mus musculus
tgccctgtattcactttggggttcc

SEQ ID NO: 342490 - DNA, 25 bp, Mus musculus
tgttgccctgtattcactttggggt

SEQ ID NO: 342491 - DNA, 25 bp, Mus musculus
ttcactttggggttcctctaactca

SEQ ID NO: 342492 - DNA, 25 bp, Mus musculus
gctgttgccctgtattcactttggg

SEQ ID NO: 342493 - DNA, 25 bp, Mus musculus
ggctgttgccctgtattcactttgg

SEQ ID NO: 342494 - DNA, 25 bp, Mus musculus
aggctgttgccctgtattcactttg

SEQ ID NO: 342495 - DNA, 25 bp, Mus musculus
aaaaaggctgttgccctgtattcac

SEQ ID NO: 342496 - DNA, 25 bp, Mus musculus
taaaaaaggctgttgccctgtattc

SEQ ID NO: 342497 - DNA, 25 bp, Mus musculus
tcactttggggttcctctaactcac

SEQ ID NO: 342498 - DNA, 25 bp, Mus musculus
tcaactaaaaaaggctgttgccctg

SEQ ID NO: 342499 - DNA, 25 bp, Mus musculus
gacgactgctaattcgcgatagcta

SEQ ID NO: 342500 - DNA, 25 bp, Mus musculus
ggtatttggtggatgacgactgcta

SEQ ID NO: 342501 - DNA, 25 bp, Mus musculus
ctaccatgcctgaacccgctaagtc

SEQ ID NO: 342502 - DNA, 25 bp, Mus musculus
cttttggtcagttcctaccatgcct

SEQ ID NO: 342503 - DNA, 25 bp, Mus musculus
aggcttttggtcagttcctaccatg

SEQ ID NO: 342504 - DNA, 25 bp, Mus musculus
tctttctgtatctttaggcttttgg

SEQ ID NO: 342505 - DNA, 25 bp, Mus musculus
gtgcagacacactttacatttcttt

SEQ ID NO: 342506 - DNA, 25 bp, Mus musculus
cgcgatagctatagccacaagtttg

SEQ ID NO: 342507 - DNA, 25 bp, Mus musculus
aggcagcctgtgcagacacacttta

SEQ ID NO: 342508 - DNA, 25 bp, Mus musculus
agtttgtttaaaaggcagcctgtgc

SEQ ID NO: 342509 - DNA, 25 bp, Mus musculus
gccacaagtttgtttaaaaggcagc

SEQ ID NO: 342510 - DNA, 25 bp, Mus musculus
ggatgacgactgctaattcgcgata

SEQ ID NO: 342511 - DNA, 25 bp, Mus musculus
ctaattcgcgatagctatagccaca

SEQ ID NO: 342512 - DNA, 25 bp, Mus musculus
tttggtggatgacgactgctaattc

SEQ ID NO: 342513 - DNA, 25 bp, Mus musculus
tcgcttcattcattgcccgcccggc

SEQ ID NO: 342514 - DNA, 25 bp, Mus musculus
ccgaggggctctaggctgtcacagc

SEQ ID NO: 342515 - DNA, 25 bp, Mus musculus
taggctgtcacagcgcgcagaccca

SEQ ID NO: 342516 - DNA, 25 bp, Mus musculus
cgccattttctctcgcgggctacat

SEQ ID NO: 342517 - DNA, 25 bp, Mus musculus
tctctcgcgggctacattcgctcgt

SEQ ID NO: 342518 - DNA, 25 bp, Mus musculus
aatcccgacgacgaggcgcgatcgc

SEQ ID NO: 342519 - DNA, 25 bp, Mus musculus
accttcgcggcttccacgcctgtca

SEQ ID NO: 342520 - DNA, 25 bp, Mus musculus
gcctgtcacatgtccgcaaacaata

SEQ ID NO: 342521 - DNA, 25 bp, Mus musculus
acaataacaaactctcccgcacgtt

SEQ ID NO: 342522 - DNA, 25 bp, Mus musculus
gctacattcgctcgtgcctgcgggg

SEQ ID NO: 342523 - DNA, 25 bp, Mus musculus
gggctggaagcgactcgctcctgca

SEQ ID NO: 342524 - DNA, 25 bp, Mus musculus
ggctgctccggcagctggtccagct

SEQ ID NO: 342525 - DNA, 25 bp, Mus musculus
ccgcttccctggagagctcctcctc

SEQ ID NO: 342526 - DNA, 25 bp, Mus musculus
tgtccgcaaacaataacaaactctc

SEQ ID NO: 342527 - DNA, 25 bp, Mus musculus
ccaaggaggagcaacctgcagccga

SEQ ID NO: 342528 - DNA, 25 bp, Mus musculus
ctgcaattaaatagcgtggaacgtg

SEQ ID NO: 342529 - DNA, 25 bp, Mus musculus
tgcgtttcctgctggaacctgggga

SEQ ID NO: 342530 - DNA, 25 bp, Mus musculus
gaccatccgtggctctgctccaatg

SEQ ID NO: 342531 - DNA, 25 bp, Mus musculus
cccgccgagagctgaggaactacac

SEQ ID NO: 342532 - DNA, 25 bp, Mus musculus
tgaggaactacacggccacactgtc

SEQ ID NO: 342533 - DNA, 25 bp, Mus musculus
tgtccacgacagtttattctatata

SEQ ID NO: 342534 - DNA, 25 bp, Mus musculus
gcatcgtgagccaccacctgctagt

SEQ ID NO: 342535 - DNA, 25 bp, Mus musculus
gccagagttgttgttgaggtcgtca

SEQ ID NO: 342536 - DNA, 25 bp, Mus musculus
aacctaggtcactgccggatactga

SEQ ID NO: 342537 - DNA, 25 bp, Mus musculus
ctgcagaccacagctctcttgggct

SEQ ID NO: 342538 - DNA, 25 bp, Mus musculus
cccgacaggaaggatgcgtcagaga

SEQ ID NO: 342539 - DNA, 25 bp, Mus musculus
cgccgctccaggagagaggcgctca

SEQ ID NO: 342540 - DNA, 25 bp, Mus musculus
acacgactctgtacactgcaattaa

SEQ ID NO: 342541 - DNA, 25 bp, Mus musculus
catcgtcgttgtccagttaagcgta

SEQ ID NO: 342542 - DNA, 25 bp, Mus musculus
cgtacgcagttgcaggctgttatta

SEQ ID NO: 342543 - DNA, 25 bp, Mus musculus
gctgttattaatgagggtgcgcact

SEQ ID NO: 342544 - DNA, 25 bp, Mus musculus
gcactcgctgggaaggcttccgtca

SEQ ID NO: 342545 - DNA, 25 bp, Mus musculus
gcttccggctgctcactgcaagctg

SEQ ID NO: 342546 - DNA, 25 bp, Mus musculus
ctgcaagctgctgtggttttactga

SEQ ID NO: 342547 - DNA, 25 bp, Mus musculus
tactgaacttcgagtctcacccagc

SEQ ID NO: 342548 - DNA, 25 bp, Mus musculus
tctcacccagcagagagacaaggtc

SEQ ID NO: 342549 - DNA, 25 bp, Mus musculus
cagagagacaaggtcccggcagaag

SEQ ID NO: 342550 - DNA, 25 bp, Mus musculus
agcactccgccaggcagagtttcaa

SEQ ID NO: 342551 - DNA, 25 bp, Mus musculus
acccgccggaccgtgtgcagctaag

SEQ ID NO: 342552 - DNA, 25 bp, Mus musculus
cgtgtgcagctaagaaggcggctca

SEQ ID NO: 342553 - DNA, 25 bp, Mus musculus
gaaggcggctcagaagtcacagaca

SEQ ID NO: 342554 - DNA, 25 bp, Mus musculus
agacacactcctgtcatcgtcgttg

SEQ ID NO: 342555 - DNA, 25 bp, Mus musculus
cggggaagccttcgatctagtctag

SEQ ID NO: 342556 - DNA, 25 bp, Mus musculus
tctagtctaggaaaggcgaccaggc

SEQ ID NO: 342557 - DNA, 25 bp, Mus musculus
cacccacccaagtgcggcggggaag

SEQ ID NO: 342558 - DNA, 25 bp, Mus musculus
cgcgttacgggaatcgcagaggcct

SEQ ID NO: 342559 - DNA, 25 bp, Mus musculus
ctccgagactgaccagagccaatga

SEQ ID NO: 342560 - DNA, 25 bp, Mus musculus
agagccaatgagctcgcggtctctg

SEQ ID NO: 342561 - DNA, 25 bp, Mus musculus
ccagagcttcgagccatccgggctg

SEQ ID NO: 342562 - DNA, 25 bp, Mus musculus
ctcgcgtccggaaggtgagaagaac

SEQ ID NO: 342563 - DNA, 25 bp, Mus musculus
gggctccgacttccctgatgttgtc

SEQ ID NO: 342564 - DNA, 25 bp, Mus musculus
cgttcctgacgcacagttccgaagc

SEQ ID NO: 342565 - DNA, 25 bp, Mus musculus
ccaaagtcctctcgggatcgcgcgt

SEQ ID NO: 342566 - DNA, 25 bp, Mus musculus
gtcctgcgttcttccagttcccgtg

SEQ ID NO: 342567 - DNA, 25 bp, Mus musculus
aggccctctggggaagacagcccag

SEQ ID NO: 342568 - DNA, 25 bp, Mus musculus
tgtccgcgacccattaccctagaga

SEQ ID NO: 342569 - DNA, 25 bp, Mus musculus
tccacctttgttgaggccgaggccg

SEQ ID NO: 342570 - DNA, 25 bp, Mus musculus
ctgcgcgttctccacctttgttgag

SEQ ID NO: 342571 - DNA, 25 bp, Mus musculus
cccatggacggacggcctgcgcgtt

SEQ ID NO: 342572 - DNA, 25 bp, Mus musculus
acaaatagcatcaggcgaccgggcc

SEQ ID NO: 342573 - DNA, 25 bp, Mus musculus
ttggcgcggggacaacaaatagcat

SEQ ID NO: 342574 - DNA, 25 bp, Mus musculus
ccgggacgccgactgcgtcattggc

SEQ ID NO: 342575 - DNA, 25 bp, Mus musculus
acgcggcttaaacggctgcacgtgc

SEQ ID NO: 342576 - DNA, 25 bp, Mus musculus
ggccgacgcggcttaaacggctgca

SEQ ID NO: 342577 - DNA, 25 bp, Mus musculus
ggcccactcacctctccgctccagg

SEQ ID NO: 342578 - DNA, 25 bp, Mus musculus
gctgcaggtttccatgggcctccct

SEQ ID NO: 342579 - DNA, 25 bp, Mus musculus
aggcgctgagctgcaggtttccatg

SEQ ID NO: 342580 - DNA, 25 bp, Mus musculus
ccaacaccgtttcttcggagaaatg

SEQ ID NO: 342581 - DNA, 25 bp, Mus musculus
gcttcccgagcaccgccaacaccgt

SEQ ID NO: 342582 - DNA, 25 bp, Mus musculus
gccgtagggccaagcgcttcccgag

SEQ ID NO: 342583 - DNA, 25 bp, Mus musculus
tgatttgcgtgttgctgggtacgta

SEQ ID NO: 342584 - DNA, 25 bp, Mus musculus
ttaaccagcttccagattcggggcg

SEQ ID NO: 342585 - DNA, 25 bp, Mus musculus
ggtgttcctccagtcctcatcctta

SEQ ID NO: 342586 - DNA, 25 bp, Mus musculus
gcgacgagccagcactgagagagca

SEQ ID NO: 342587 - DNA, 25 bp, Mus musculus
cagatcggcggccactggcccagta

SEQ ID NO: 342588 - DNA, 25 bp, Mus musculus
aaagtccgggacacgattgccctcg

SEQ ID NO: 342589 - DNA, 25 bp, Mus musculus
ggcagggcggcccaatccaaactgc

SEQ ID NO: 342590 - DNA, 25 bp, Mus musculus
gtccctgctcccgtcagtctaagag

SEQ ID NO: 342591 - DNA, 25 bp, Mus musculus
agtctaagaggctcgcagtcgcttg

SEQ ID NO: 342592 - DNA, 25 bp, Mus musculus
ctgggaattgggtatctggaccgcc

SEQ ID NO: 342593 - DNA, 25 bp, Mus musculus
tcgcaccaggtggtgacaccatcca

SEQ ID NO: 342594 - DNA, 25 bp, Mus musculus
ccatccagccggtgaccatgttcga

SEQ ID NO: 342595 - DNA, 25 bp, Mus musculus
ccatgttcgacaagacgcggctgcc

SEQ ID NO: 342596 - DNA, 25 bp, Mus musculus
gtacgtggccctcgatgtgatttgc

SEQ ID NO: 342597 - DNA, 25 bp, Mus musculus
gtcgagtggacgaccttccctcaga

SEQ ID NO: 342598 - DNA, 25 bp, Mus musculus
gagccttgtcgagtggacgaccttc

SEQ ID NO: 342599 - DNA, 25 bp, Mus musculus
cgttcggcatcctgtgttcacctgg

SEQ ID NO: 342600 - DNA, 25 bp, Mus musculus
ctgtgttcacctggagagcgagcta

SEQ ID NO: 342601 - DNA, 25 bp, Mus musculus
agcgagctagctgtgaggcacttga

SEQ ID NO: 342602 - DNA, 25 bp, Mus musculus
tctctctcttcagtgtgggcgttcg

SEQ ID NO: 342603 - DNA, 25 bp, Mus musculus
cacttgaggcgtggcgtttgtatcc

SEQ ID NO: 342604 - DNA, 25 bp, Mus musculus
gtggcgtttgtatcctagcgttgtc

SEQ ID NO: 342605 - DNA, 25 bp, Mus musculus
tagcgttgtccttttctagtgttca

SEQ ID NO: 342606 - DNA, 25 bp, Mus musculus
agtgttcattcgttttttccagaga

SEQ ID NO: 342607 - DNA, 25 bp, Mus musculus
cgttttttccagagaatgcgtagcg

SEQ ID NO: 342608 - DNA, 25 bp, Mus musculus
tggtcttcgccgagttttctctctc

SEQ ID NO: 342609 - DNA, 25 bp, Mus musculus
ttccctcagagctcatggtcttcgc

SEQ ID NO: 342610 - DNA, 25 bp, Mus musculus
cgagctgtgagaaaggagccttgtc

SEQ ID NO: 342611 - DNA, 25 bp, Mus musculus
cgccatctttcggaactctgagacc

SEQ ID NO: 342612 - DNA, 25 bp, Mus musculus
catcctcgaaaacgctgaaaagctc

SEQ ID NO: 342613 - DNA, 25 bp, Mus musculus
cagctgaaacatgggcggcaaaaat

SEQ ID NO: 342614 - DNA, 25 bp, Mus musculus
ttccagagccagaagtgcagaggcc

SEQ ID NO: 342615 - DNA, 25 bp, Mus musculus
ccgtaccctacagtgacgccgaatg

SEQ ID NO: 342616 - DNA, 25 bp, Mus musculus
tcaaaagtgagcgagccttgagccc

SEQ ID NO: 342617 - DNA, 25 bp, Mus musculus
cccgcgtgacttttctcctttctag

SEQ ID NO: 342618 - DNA, 25 bp, Mus musculus
tgcgagtccggcagttcaatgacta

SEQ ID NO: 342619 - DNA, 25 bp, Mus musculus
acttagcgaccagtggcgcacgaca

SEQ ID NO: 342620 - DNA, 25 bp, Mus musculus
agtctgaggacacgggccaattgag

SEQ ID NO: 342621 - DNA, 25 bp, Mus musculus
agccggcaaacgtgaagagctctcg

SEQ ID NO: 342622 - DNA, 25 bp, Mus musculus
gaagactactctcctgcagctgaaa

SEQ ID NO: 342623 - DNA, 25 bp, Mus musculus
ttttctcttccaaccactgcgagtc

SEQ ID NO: 342624 - DNA, 25 bp, Mus musculus
gggatctggatctggaagactactc

SEQ ID NO: 342625 - DNA, 25 bp, Mus musculus
tggatctccagaccttccgagaata

SEQ ID NO: 342626 - DNA, 25 bp, Mus musculus
cgctaggagcgctacccgattgtaa

SEQ ID NO: 342627 - DNA, 25 bp, Mus musculus
ggaggcgagacagccaccagaacct

SEQ ID NO: 342628 - DNA, 25 bp, Mus musculus
agtgaagaagagcagacgcccgtgc

SEQ ID NO: 342629 - DNA, 25 bp, Mus musculus
aacgcgtgttcgctcccgggagact

SEQ ID NO: 342630 - DNA, 25 bp, Mus musculus
cttccgagaatacggccagagctgc

SEQ ID NO: 342631 - DNA, 25 bp, Mus musculus
cccttgacagcgctggatctccaga

SEQ ID NO: 342632 - DNA, 25 bp, Mus musculus
gggaccggatcttcctcgcagctct

SEQ ID NO: 342633 - DNA, 25 bp, Mus musculus
gctgaaccgctcagacggcccatgg

SEQ ID NO: 342634 - DNA, 25 bp, Mus musculus
ggcgtctgtgaccttttcgagtccc

SEQ ID NO: 342635 - DNA, 25 bp, Mus musculus
aggcgggagttgcaacgcctcctcc

SEQ ID NO: 342636 - DNA, 25 bp, Mus musculus
tcttccaccgagctcaagcagctgg

SEQ ID NO: 342637 - DNA, 25 bp, Mus musculus
gtggccagtgatctttacgctcttc

SEQ ID NO: 342638 - DNA, 25 bp, Mus musculus
ggaaggcacagtccgggtacttaga

SEQ ID NO: 342639 - DNA, 25 bp, Mus musculus
tcgctgtgtctgaccgtgaatactc

SEQ ID NO: 342640 - DNA, 25 bp, Mus musculus
tgaccgtgaatactctggaccgttt

SEQ ID NO: 342641 - DNA, 25 bp, Mus musculus
tctgcctctctggattgttttgttc

SEQ ID NO: 342642 - DNA, 25 bp, Mus musculus
tctctggattgttttgttcgggcgc

SEQ ID NO: 342643 - DNA, 25 bp, Mus musculus
gattgttttgttcgggcgcgcgctt

SEQ ID NO: 342644 - DNA, 25 bp, Mus musculus
gctcccggccaggtgactgccgaat

SEQ ID NO: 342645 - DNA, 25 bp, Mus musculus
ggtgactgccgaatcgcgctgtaaa

SEQ ID NO: 342646 - DNA, 25 bp, Mus musculus
atcgcgctgtaaactgctcagctgg

SEQ ID NO: 342647 - DNA, 25 bp, Mus musculus
cgctgtaaactgctcagctggctcc

SEQ ID NO: 342648 - DNA, 25 bp, Mus musculus
ggctcctgcaagtccaccgccagtt

SEQ ID NO: 342649 - DNA, 25 bp, Mus musculus
cgccagttcggcctctctttcgagt

SEQ ID NO: 342650 - DNA, 25 bp, Mus musculus
cagttcggcctctctttcgagtcgc

SEQ ID NO: 342651 - DNA, 25 bp, Mus musculus
tactctggaccgttttctcctcacg

SEQ ID NO: 342652 - DNA, 25 bp, Mus musculus
tctttcgagtcgctgtgtctgaccg

SEQ ID NO: 342653 - DNA, 25 bp, Mus musculus
aggtcaccgaagctctagaggctca

SEQ ID NO: 342654 - DNA, 25 bp, Mus musculus
ctcagtggcgcatggaagccggcca

SEQ ID NO: 342655 - DNA, 25 bp, Mus musculus
ggagcacttcactcagtggcgcatg

SEQ ID NO: 342656 - DNA, 25 bp, Mus musculus
catcaacttcttcctggagcacttc

SEQ ID NO: 342657 - DNA, 25 bp, Mus musculus
taagctccacttcagcctgggcgcg

SEQ ID NO: 342658 - DNA, 25 bp, Mus musculus
gcatcgtgctgcataagctccactt

SEQ ID NO: 342659 - DNA, 25 bp, Mus musculus
aacctggagtgcatcgtgctgcata

SEQ ID NO: 342660 - DNA, 25 bp, Mus musculus
cagcagctgtgcaacctggagtgca

SEQ ID NO: 342661 - DNA, 25 bp, Mus musculus
tgcagcaccagcacgagatggacct

SEQ ID NO: 342662 - DNA, 25 bp, Mus musculus
ctggctgacggattgctgcagcacc

SEQ ID NO: 342663 - DNA, 25 bp, Mus musculus
tgatggctatctgctgcctggcgct

SEQ ID NO: 342664 - DNA, 25 bp, Mus musculus
acacgccgtccctgatggctatctg

SEQ ID NO: 342665 - DNA, 25 bp, Mus musculus
acggattacgcgttcactacctaca

SEQ ID NO: 342666 - DNA, 25 bp, Mus musculus
cggagctgagcctaacggattacgc

SEQ ID NO: 342667 - DNA, 25 bp, Mus musculus
tcttcttggcgggagacttctctac

SEQ ID NO: 342668 - DNA, 25 bp, Mus musculus
cagaaacagccttagtgatgagctc

SEQ ID NO: 342669 - DNA, 25 bp, Mus musculus
aagcttgctagttgcgagaaaacta

SEQ ID NO: 342670 - DNA, 25 bp, Mus musculus
atctaacgcgaagagcaaattttgc

SEQ ID NO: 342671 - DNA, 25 bp, Mus musculus
ttgcgatgctcctttgctcaggctc

SEQ ID NO: 342672 - DNA, 25 bp, Mus musculus
gctcaggctcctggtttatataagc

SEQ ID NO: 342673 - DNA, 25 bp, Mus musculus
ttatataagccggtgctgggctgtg

SEQ ID NO: 342674 - DNA, 25 bp, Mus musculus
ctgtgattggtggagcggccaatcc

SEQ ID NO: 342675 - DNA, 25 bp, Mus musculus
tctcagcgggagcagtctcagacat

SEQ ID NO: 342676 - DNA, 25 bp, Mus musculus
acttctctacaggagccggagccgc

SEQ ID NO: 342677 - DNA, 25 bp, Mus musculus
tttcgttgtcttcttcttggcggga

SEQ ID NO: 342678 - DNA, 25 bp, Mus musculus
cgccgcgccagcttttttcgttgtc

SEQ ID NO: 342679 - DNA, 25 bp, Mus musculus
ccgccgcgctccttagaggcagaaa

SEQ ID NO: 342680 - DNA, 25 bp, Mus musculus
catggcgagaacaaaaagcttgcta

SEQ ID NO: 342681 - DNA, 25 bp, Mus musculus
gggtcctcaccgacgagagccagga

SEQ ID NO: 342682 - DNA, 25 bp, Mus musculus
cgagtatcgcaacagcatggacacg

SEQ ID NO: 342683 - DNA, 25 bp, Mus musculus
ccggctgggactcaccgatgaagac

SEQ ID NO: 342684 - DNA, 25 bp, Mus musculus
atctggtggtgcgagtatcgcaaca

SEQ ID NO: 342685 - DNA, 25 bp, Mus musculus
tgggactcaccgatgaagacgaaga

SEQ ID NO: 342686 - DNA, 25 bp, Mus musculus
cctcaccgacgagagccaggatgac

SEQ ID NO: 342687 - DNA, 25 bp, Mus musculus
tctgcagcaggtccactgcgggcac

SEQ ID NO: 342688 - DNA, 25 bp, Mus musculus
tgcgagtatcgcaacagcatggaca

SEQ ID NO: 342689 - DNA, 25 bp, Mus musculus
tccagcatctgcagcaggtccactg

SEQ ID NO: 342690 - DNA, 25 bp, Mus musculus
gttcatctccagcatctgcagcagg

SEQ ID NO: 342691 - DNA, 25 bp, Mus musculus
gggaaggcgatggccatgttcatct

SEQ ID NO: 342692 - DNA, 25 bp, Mus musculus
cgagagccaggatgacggtcagcaa

SEQ ID NO: 342693 - DNA, 25 bp, Mus musculus
acgaagatctggtggtgcgagtatc

SEQ ID NO: 342694 - DNA, 25 bp, Mus musculus
ctcaccgatgaagacgaagatctgg

SEQ ID NO: 342695 - DNA, 25 bp, Mus musculus
gtctcctagtggtgattcgtccgcg

SEQ ID NO: 342696 - DNA, 25 bp, Mus musculus
ggttccgaggtcctcactgagggtc

SEQ ID NO: 342697 - DNA, 25 bp, Mus musculus
ccgattatccatgccgggtgggtga

SEQ ID NO: 342698 - DNA, 25 bp, Mus musculus
gaggcacctgcacaacccgattatc

SEQ ID NO: 342699 - DNA, 25 bp, Mus musculus
ttcgtggaagtccttttcgggatgc

SEQ ID NO: 342700 - DNA, 25 bp, Mus musculus
ctggccagttcgttccttcgtggaa

SEQ ID NO: 342701 - DNA, 25 bp, Mus musculus
gctccgaacgctgaccatgtgcatc

SEQ ID NO: 342702 - DNA, 25 bp, Mus musculus
cccaacaggatgctggacctgtcgc

SEQ ID NO: 342703 - DNA, 25 bp, Mus musculus
gctctcacaaccatagacctgcagg

SEQ ID NO: 342704 - DNA, 25 bp, Mus musculus
ctgctcggaaccgaagcgtctccta

SEQ ID NO: 342705 - DNA, 25 bp, Mus musculus
gtgtgggtcttcatcccaggatgca

SEQ ID NO: 342706 - DNA, 25 bp, Mus musculus
ttgccaggttggttaacgcctccgc

SEQ ID NO: 342707 - DNA, 25 bp, Mus musculus
gtggcatctgcgctctctctcctat

SEQ ID NO: 342708 - DNA, 25 bp, Mus musculus
ccgcaaactggaaggctagggaccg

SEQ ID NO: 342709 - DNA, 25 bp, Mus musculus
cgctgcgaggaagccctgcacaatc

SEQ ID NO: 342710 - DNA, 25 bp, Mus musculus
tgtccctcgagtagcgcgcacctga

SEQ ID NO: 342711 - DNA, 25 bp, Mus musculus
tgcacaatcgtgaccctaagcggcc

SEQ ID NO: 342712 - DNA, 25 bp, Mus musculus
gccgagcccttccagatcaaggcaa

SEQ ID NO: 342713 - DNA, 25 bp, Mus musculus
ctttcacagaagctgatgatcacgc

SEQ ID NO: 342714 - DNA, 25 bp, Mus musculus
agggctctccctcatctttcacaga

SEQ ID NO: 342715 - DNA, 25 bp, Mus musculus
agtggacgccatcctcagagacatc

SEQ ID NO: 342716 - DNA, 25 bp, Mus musculus
gacacggtcggaactgtgacagtga

SEQ ID NO: 342717 - DNA, 25 bp, Mus musculus
gacagcaaggactgcagctccagga

SEQ ID NO: 342718 - DNA, 25 bp, Mus musculus
ctcagtgctggatgtaagtggaccg

SEQ ID NO: 342719 - DNA, 25 bp, Mus musculus
ccggcacctggcctcagtgctggat

SEQ ID NO: 342720 - DNA, 25 bp, Mus musculus
gaacgtgcagctgaaagaactcgcc

SEQ ID NO: 342721 - DNA, 25 bp, Mus musculus
cgcagaagcaggaggagatagcctc

SEQ ID NO: 342722 - DNA, 25 bp, Mus musculus
atgatcacgcagtctcctgccgagc

SEQ ID NO: 342723 - DNA, 25 bp, Mus musculus
cgccgactccgcacctcctgcgggc

SEQ ID NO: 342724 - DNA, 25 bp, Mus musculus
aggcaaggcgtccaggaacagcgca

SEQ ID NO: 342725 - DNA, 25 bp, Mus musculus
gtttgggaagtcgtggtcctgctta

SEQ ID NO: 342726 - DNA, 25 bp, Mus musculus
ctggggaatacgctccaggagctgt

SEQ ID NO: 342727 - DNA, 25 bp, Mus musculus
ttaccctggggaatacgctccagga

SEQ ID NO: 342728 - DNA, 25 bp, Mus musculus
gaggttcccgctttgattgccgccc

SEQ ID NO: 342729 - DNA, 25 bp, Mus musculus
cggaaggaggttcccgctttgattg

SEQ ID NO: 342730 - DNA, 25 bp, Mus musculus
tgacgtcatcgaggcgctggcctgt

SEQ ID NO: 342731 - DNA, 25 bp, Mus musculus
actgctcgcggcaaagcttggcgct

SEQ ID NO: 342732 - DNA, 25 bp, Mus musculus
cagcgcactcactcggagatggagt

SEQ ID NO: 342733 - DNA, 25 bp, Mus musculus
caggaacagcgcactcactcggaga

SEQ ID NO: 342734 - DNA, 25 bp, Mus musculus
caccgcccggaggaagatccggacg

SEQ ID NO: 342735 - DNA, 25 bp, Mus musculus
tggaaactgcaacgcaccgcccgga

SEQ ID NO: 342736 - DNA, 25 bp, Mus musculus
ccagacttgacgtcatcgaggcgct

SEQ ID NO: 342737 - DNA, 25 bp, Mus musculus
cgcgcaacagctgcaggtcgcagaa

SEQ ID NO: 342738 - DNA, 25 bp, Mus musculus
cgcaacagctgcaggtcgcagaagt

SEQ ID NO: 342739 - DNA, 25 bp, Mus musculus
tgttgctcaccgcctttctggggct

SEQ ID NO: 342740 - DNA, 25 bp, Mus musculus
agccaagcggcgctacgcggagagg

SEQ ID NO: 342741 - DNA, 25 bp, Mus musculus
tccggtccggtcgagtcggaggctg

SEQ ID NO: 342742 - DNA, 25 bp, Mus musculus
tcctgttgctcaccgcctttctggg

SEQ ID NO: 342743 - DNA, 25 bp, Mus musculus
gcgcggccctcggtccctcaggccc

SEQ ID NO: 342744 - DNA, 25 bp, Mus musculus
gggaggacgcgacgcggccctgctc

SEQ ID NO: 342745 - DNA, 25 bp, Mus musculus
ggccctgctcacaggcttgctggcg

SEQ ID NO: 342746 - DNA, 25 bp, Mus musculus
gccctgctcacaggcttgctggcgg

SEQ ID NO: 342747 - DNA, 25 bp, Mus musculus
ggggcctgcggcctcctgttgctca

SEQ ID NO: 342748 - DNA, 25 bp, Mus musculus
tcgcgggccgcgcaggtagagctcg

SEQ ID NO: 342749 - DNA, 25 bp, Mus musculus
ctctccaggctttggggcgcgcagg

SEQ ID NO: 342750 - DNA, 25 bp, Mus musculus
acagctgcaggtcgcagaagtgccc

SEQ ID NO: 342751 - DNA, 25 bp, Mus musculus
tcggacttaaagtcgtagagcgccc

SEQ ID NO: 342752 - DNA, 25 bp, Mus musculus
gatctcaccggggttctcggactta

SEQ ID NO: 342753 - DNA, 25 bp, Mus musculus
ctcgtgctcccgcagggagatctca

SEQ ID NO: 342754 - DNA, 25 bp, Mus musculus
tcgatgtcctgctcgctgcacaggc

SEQ ID NO: 342755 - DNA, 25 bp, Mus musculus
cgcggctgttgatcccttcgagcca

SEQ ID NO: 342756 - DNA, 25 bp, Mus musculus
gcgcacggatcacctgcacgtagga

SEQ ID NO: 342757 - DNA, 25 bp, Mus musculus
tggcctggtatccaccgtagagctg

SEQ ID NO: 342758 - DNA, 25 bp, Mus musculus
agtcatcgtcgctgcccaggctggc

SEQ ID NO: 342759 - DNA, 25 bp, Mus musculus
tcatcggccaccgtggagctgtcgt

SEQ ID NO: 342760 - DNA, 25 bp, Mus musculus
agctcttggctccagacgcttggtg

SEQ ID NO: 342761 - DNA, 25 bp, Mus musculus
gaagcgattgaggttgcggctcacc

SEQ ID NO: 342762 - DNA, 25 bp, Mus musculus
cgcccgacttgacgaaggtggagaa

SEQ ID NO: 342763 - DNA, 25 bp, Mus musculus
gcccttgaacttggtctgcttggtg

SEQ ID NO: 342764 - DNA, 25 bp, Mus musculus
gagatgtagctcttcatgcccttga

SEQ ID NO: 342765 - DNA, 25 bp, Mus musculus
aggtccagggcgtttcaaggccaca

SEQ ID NO: 342766 - DNA, 25 bp, Mus musculus
ctgaggcgtttctgtacatggatta

SEQ ID NO: 342767 - DNA, 25 bp, Mus musculus
ccttttatagacactccggccaatg

SEQ ID NO: 342768 - DNA, 25 bp, Mus musculus
gccgctgctcttcaatctcaggcag

SEQ ID NO: 342769 - DNA, 25 bp, Mus musculus
aatgagcgcgctccttttcctcggc

SEQ ID NO: 342770 - DNA, 25 bp, Mus musculus
gccaatcgtcgcttccctggtgtaa

SEQ ID NO: 342771 - DNA, 25 bp, Mus musculus
atgctttaggctgccggatgtctga

SEQ ID NO: 342772 - DNA, 25 bp, Mus musculus
tggtgtaatcttcggctcctcggct

SEQ ID NO: 342773 - DNA, 25 bp, Mus musculus
cggcgatcttcgctgttgctggctt

SEQ ID NO: 342774 - DNA, 25 bp, Mus musculus
ttgctggctttttcaggagctgctc

SEQ ID NO: 342775 - DNA, 25 bp, Mus musculus
gttcggagccattccggatgcttta

SEQ ID NO: 342776 - DNA, 25 bp, Mus musculus
ggatgccttgggttgctttctcccg

SEQ ID NO: 342777 - DNA, 25 bp, Mus musculus
tctcggctttctttctttgggatgg

SEQ ID NO: 342778 - DNA, 25 bp, Mus musculus
catgtcgcctctcggatctcgcggt

SEQ ID NO: 342779 - DNA, 25 bp, Mus musculus
gctagggactcacttcctccgttct

SEQ ID NO: 342780 - DNA, 25 bp, Mus musculus
cccgcatcccgaggaagggtcaagg

SEQ ID NO: 342781 - DNA, 25 bp, Mus musculus
acgccaggatgcgagtacggatccc

SEQ ID NO: 342782 - DNA, 25 bp, Mus musculus
ttcctgtaggcaaacgccaggatgc

SEQ ID NO: 342783 - DNA, 25 bp, Mus musculus
agcgacactgacattgagaccgccg

SEQ ID NO: 342784 - DNA, 25 bp, Mus musculus
acatcgcctgtctcagcgacactga

SEQ ID NO: 342785 - DNA, 25 bp, Mus musculus
acggcagctgtagccattgcccttc

SEQ ID NO: 342786 - DNA, 25 bp, Mus musculus
actctacagacggaaacggcagctg

SEQ ID NO: 342787 - DNA, 25 bp, Mus musculus
tgttacctggatggaactctacaga

SEQ ID NO: 342788 - DNA, 25 bp, Mus musculus
cgacaaggctgacagttatgttacc

SEQ ID NO: 342789 - DNA, 25 bp, Mus musculus
ctgaatgaatagctcgacaaggctg

SEQ ID NO: 342790 - DNA, 25 bp, Mus musculus
cctgggaaccctgaatgaatagctc

SEQ ID NO: 342791 - DNA, 25 bp, Mus musculus
caaagtggagcgacctgggaaccct

SEQ ID NO: 342792 - DNA, 25 bp, Mus musculus
tcctccgttctcaaagcaatgcggc

SEQ ID NO: 342793 - DNA, 25 bp, Mus musculus
gcaaggctggtagcccagcctagtg

SEQ ID NO: 342794 - DNA, 25 bp, Mus musculus
cgaaatttccgagggctgctttctc

SEQ ID NO: 342795 - DNA, 25 bp, Mus musculus
gtctttcgaaatttccgagggctgc

SEQ ID NO: 342796 - DNA, 25 bp, Mus musculus
gcagccaccgcggtctttcgaaatt

SEQ ID NO: 342797 - DNA, 25 bp, Mus musculus
gttttgcaatccgccagcccggagc

SEQ ID NO: 342798 - DNA, 25 bp, Mus musculus
acgggcccgttttgcaatccgccag

SEQ ID NO: 342799 - DNA, 25 bp, Mus musculus
aggcagcgcccctatcagcaaggct

SEQ ID NO: 342800 - DNA, 25 bp, Mus musculus
tggtagcccagcctagtgtcgggca

SEQ ID NO: 342801 - DNA, 25 bp, Mus musculus
ccagcctagtgtcgggcagacggct

SEQ ID NO: 342802 - DNA, 25 bp, Mus musculus
gggagggcagcttacgacacacaaa

SEQ ID NO: 342803 - DNA, 25 bp, Mus musculus
gcagcttacgacacacaaaacctta

SEQ ID NO: 342804 - DNA, 25 bp, Mus musculus
ctccaacaggcaacgcagcagggtt

SEQ ID NO: 342805 - DNA, 25 bp, Mus musculus
caacgcagcagggttagaacccgga

SEQ ID NO: 342806 - DNA, 25 bp, Mus musculus
gctgctttctctggcgcccacgtcc

SEQ ID NO: 342807 - DNA, 25 bp, Mus musculus
ggcgcagccgcgctttaaatctaga

SEQ ID NO: 342808 - DNA, 25 bp, Mus musculus
tcagtgtgaatcaggtgacatttcc

SEQ ID NO: 342809 - DNA, 25 bp, Mus musculus
ttatctgtcggaggtgcccgaaatc

SEQ ID NO: 342810 - DNA, 25 bp, Mus musculus
ccgagttcttatttgcgtaggagcg

SEQ ID NO: 342811 - DNA, 25 bp, Mus musculus
gggaggaacatccacttcagtcctg

SEQ ID NO: 342812 - DNA, 25 bp, Mus musculus
gctccgggatgagacttctgcaacc

SEQ ID NO: 342813 - DNA, 25 bp, Mus musculus
ccgcaggatccctgagctgcttcaa

SEQ ID NO: 342814 - DNA, 25 bp, Mus musculus
ggagcagtttcaggagcctccctgc

SEQ ID NO: 342815 - DNA, 25 bp, Mus musculus
tcccgaggtctcttacgtgtcttac

SEQ ID NO: 342816 - DNA, 25 bp, Mus musculus
cgtgtcttactttgcggccaccctg

SEQ ID NO: 342817 - DNA, 25 bp, Mus musculus
cccagcctggagtaggttgctaaga

SEQ ID NO: 342818 - DNA, 25 bp, Mus musculus
atgtttaacacctcggagccggccg

SEQ ID NO: 342819 - DNA, 25 bp, Mus musculus
ctttcacttcgtcgcgtctggagtc

SEQ ID NO: 342820 - DNA, 25 bp, Mus musculus
ttcaatggacgtcagaagccgggcg

SEQ ID NO: 342821 - DNA, 25 bp, Mus musculus
cacccagaaggtggagcatccggct

SEQ ID NO: 342822 - DNA, 25 bp, Mus musculus
ctctgagtcaccggcgcctctaggg

SEQ ID NO: 342823 - DNA, 25 bp, Mus musculus
gtcttgcgcctgctgctcgctgaat

SEQ ID NO: 342824 - DNA, 25 bp, Mus musculus
cctgctgctcgctgaatgtcaagtt

SEQ ID NO: 342825 - DNA, 25 bp, Mus musculus
aactctggtgtccaggtcatggcct

SEQ ID NO: 342826 - DNA, 25 bp, Mus musculus
gtgtccaggtcatggccttcacgac

SEQ ID NO: 342827 - DNA, 25 bp, Mus musculus
catggccttcacgaccgattaccta

SEQ ID NO: 342828 - DNA, 25 bp, Mus musculus
gccttcacgaccgattacctagacg

SEQ ID NO: 342829 - DNA, 25 bp, Mus musculus
ctctaggggttggagaactggcttc

SEQ ID NO: 342830 - DNA, 25 bp, Mus musculus
ccgggttccgggtcttgcgcctgct

SEQ ID NO: 342831 - DNA, 25 bp, Mus musculus
gatggttcctaggtgccaggtaaga

SEQ ID NO: 342832 - DNA, 25 bp, Mus musculus
gcccggggttgagcaccacccagaa

SEQ ID NO: 342833 - DNA, 25 bp, Mus musculus
gcgcagtgtccacacgcccggggtt

SEQ ID NO: 342834 - DNA, 25 bp, Mus musculus
ctaggtgccaggtaagagttggttc

SEQ ID NO: 342835 - DNA, 25 bp, Mus musculus
cgccttataaggacatttgctctgc

SEQ ID NO: 342836 - DNA, 25 bp, Mus musculus
ctctcggccgaggtcaagaaccggg

SEQ ID NO: 342837 - DNA, 25 bp, Mus musculus
ctcagtttcccgcaactacaaacgg

SEQ ID NO: 342838 - DNA, 25 bp, Mus musculus
gaagtcgcggccacaggaattcggc

SEQ ID NO: 342839 - DNA, 25 bp, Mus musculus
tcggcgcttccacgccttataagga

SEQ ID NO: 342840 - DNA, 25 bp, Mus musculus
agcctcgaacgcacgaccaatggga

SEQ ID NO: 342841 - DNA, 25 bp, Mus musculus
aggacatttgctctgccagccaatc

SEQ ID NO: 342842 - DNA, 25 bp, Mus musculus
gcgccatgagctccacgcagttcaa

SEQ ID NO: 342843 - DNA, 25 bp, Mus musculus
cgcagttcaacaagggcccgtccta

SEQ ID NO: 342844 - DNA, 25 bp, Mus musculus
cctacgggctctcggccgaggtcaa

SEQ ID NO: 342845 - DNA, 25 bp, Mus musculus
aagcccacgcccttcgctgcctcag

SEQ ID NO: 342846 - DNA, 25 bp, Mus musculus
cggccacaggaattcggcgcttcca

SEQ ID NO: 342847 - DNA, 25 bp, Mus musculus
gttgcggggcttgccagcctcgaac

SEQ ID NO: 342848 - DNA, 25 bp, Mus musculus
ctcgaacgcgcgaccgatgcatgag

SEQ ID NO: 342849 - DNA, 25 bp, Mus musculus
tttgaacaccttaggaggatgtagc

SEQ ID NO: 342850 - DNA, 25 bp, Mus musculus
tggacagtaaactgctgacatcata

SEQ ID NO: 342851 - DNA, 25 bp, Mus musculus
agcccaagtatatatataacaagcc

SEQ ID NO: 342852 - DNA, 25 bp, Mus musculus
gtgttgagatggaaaagcccaagta

SEQ ID NO: 342853 - DNA, 25 bp, Mus musculus
gtacgagccatctcagtacactaga

SEQ ID NO: 342854 - DNA, 25 bp, Mus musculus
agagccttttgttattaacaggtag

SEQ ID NO: 342855 - DNA, 25 bp, Mus musculus
acagccgctttttggtgacaaagga

SEQ ID NO: 342856 - DNA, 25 bp, Mus musculus
cctgaggtaggtaaacagccgcttt

SEQ ID NO: 342857 - DNA, 25 bp, Mus musculus
catgatagatgttggacctgaggta

SEQ ID NO: 342858 - DNA, 25 bp, Mus musculus
aggatgtagcacatatgctcagata

SEQ ID NO: 342859 - DNA, 25 bp, Mus musculus
ttccagacaggggattggtccgcgt

SEQ ID NO: 342860 - DNA, 25 bp, Mus musculus
gctgacatcatagttccagacaggg

SEQ ID NO: 342861 - DNA, 25 bp, Mus musculus
tgctcagatactggaaaacatgata

SEQ ID NO: 342862 - DNA, 25 bp, Mus musculus
agccacccttttggattggacagta

SEQ ID NO: 342863 - DNA, 25 bp, Mus musculus
gctcagcacgagtcaactctcggga

SEQ ID NO: 342864 - DNA, 25 bp, Mus musculus
gctcaggcccggaaggaaacactac

SEQ ID NO: 342865 - DNA, 25 bp, Mus musculus
cgcatctggtaaagtcgctcacaag

SEQ ID NO: 342866 - DNA, 25 bp, Mus musculus
tcgctcacaaggatccggcagggaa

SEQ ID NO: 342867 - DNA, 25 bp, Mus musculus
tttttctcaagtctccgcgcgctgg

SEQ ID NO: 342868 - DNA, 25 bp, Mus musculus
aactctcgggacttccagtcgccgg

SEQ ID NO: 342869 - DNA, 25 bp, Mus musculus
cgcgaaaccggctgacgcggcgatc

SEQ ID NO: 342870 - DNA, 25 bp, Mus musculus
ctcccggcgcaagtctgttgtgggt

SEQ ID NO: 342871 - DNA, 25 bp, Mus musculus
tgttgtgggtccctaccagagaggc

SEQ ID NO: 342872 - DNA, 25 bp, Mus musculus
cgcagtaaaaggaaaggctcgccct

SEQ ID NO: 342873 - DNA, 25 bp, Mus musculus
ggctcgccctagataaacgtcaaag

SEQ ID NO: 342874 - DNA, 25 bp, Mus musculus
taaacgtcaaaggaggcggtcagcg

SEQ ID NO: 342875 - DNA, 25 bp, Mus musculus
ctacctctaactcttgcagctcggg

SEQ ID NO: 342876 - DNA, 25 bp, Mus musculus
tgcagctcgggacagcacttttacc

SEQ ID NO: 342877 - DNA, 25 bp, Mus musculus
tttctgccgcccgtggcgagtagct

SEQ ID NO: 342878 - DNA, 25 bp, Mus musculus
gcgcgctacgcgttaggggacaaac

SEQ ID NO: 342879 - DNA, 25 bp, Mus musculus
atctgctggagctagcagcgcgcta

SEQ ID NO: 342880 - DNA, 25 bp, Mus musculus
tggccaatttcgctgcctgcgggaa

SEQ ID NO: 342881 - DNA, 25 bp, Mus musculus
acagcccagggctggccaatttcgc

SEQ ID NO: 342882 - DNA, 25 bp, Mus musculus
tttccttcactgactcccgtgctgg

SEQ ID NO: 342883 - DNA, 25 bp, Mus musculus
gaacgggccgctttccttcactgac

SEQ ID NO: 342884 - DNA, 25 bp, Mus musculus
agtagctggtgggtaggtccttcct

SEQ ID NO: 342885 - DNA, 25 bp, Mus musculus
agcccgcaggagaggattaagcctc

SEQ ID NO: 342886 - DNA, 25 bp, Mus musculus
tccatcgccattggtctgacgcagc

SEQ ID NO: 342887 - DNA, 25 bp, Mus musculus
ggctcggggcacctctcttccttat

SEQ ID NO: 342888 - DNA, 25 bp, Mus musculus
agtccgatttaagccggcggagttg

SEQ ID NO: 342889 - DNA, 25 bp, Mus musculus
ccctcgcagatctgggagtccgatt

SEQ ID NO: 342890 - DNA, 25 bp, Mus musculus
gtccttcctgtgaagcgggtcccta

SEQ ID NO: 342891 - DNA, 25 bp, Mus musculus
gcagcctcgggagttaaaggcaatc

SEQ ID NO: 342892 - DNA, 25 bp, Mus musculus
aagcgcgctttctcaatttccaaag

SEQ ID NO: 342893 - DNA, 25 bp, Mus musculus
gggctgtcggcagacgatgcacaaa

SEQ ID NO: 342894 - DNA, 25 bp, Mus musculus
tgcgcaattatcctgggacgaggtg

SEQ ID NO: 342895 - DNA, 25 bp, Mus musculus
aaaggcaatcgggtctctgtcggag

SEQ ID NO: 342896 - DNA, 25 bp, Mus musculus
ctctgtcggagaaaagctagcgctg

SEQ ID NO: 342897 - DNA, 25 bp, Mus musculus
agctagcgctgggactgaacttcca

SEQ ID NO: 342898 - DNA, 25 bp, Mus musculus
actgaacttccagcggccgcctgag

SEQ ID NO: 342899 - DNA, 25 bp, Mus musculus
tctgcacactttccgagctgtgatc

SEQ ID NO: 342900 - DNA, 25 bp, Mus musculus
cgagctgtgatctccagccgggtcc

SEQ ID NO: 342901 - DNA, 25 bp, Mus musculus
cccgcaggcgtctagggaaaaggca

SEQ ID NO: 342902 - DNA, 25 bp, Mus musculus
cgatgcacaaatgaaagcgcgcttt

SEQ ID NO: 342903 - DNA, 25 bp, Mus musculus
atcaggagggaacccggccttgcaa

SEQ ID NO: 342904 - DNA, 25 bp, Mus musculus
agctctaaatgtagagaaatgcgca

SEQ ID NO: 342905 - DNA, 25 bp, Mus musculus
tttccaaatgcacccggaatgggga

SEQ ID NO: 342906 - DNA, 25 bp, Mus musculus
tctgggcaccgccaatggctggaac

SEQ ID NO: 342907 - DNA, 25 bp, Mus musculus
acgccgctgcagctatttccaaatg

SEQ ID NO: 342908 - DNA, 25 bp, Mus musculus
acaggcagtctttctcggctcttga

SEQ ID NO: 342909 - DNA, 25 bp, Mus musculus
cgcgtcgcggtcagaaatctgggca

SEQ ID NO: 342910 - DNA, 25 bp, Mus musculus
cccaggatccgagaggcaagaactc

SEQ ID NO: 342911 - DNA, 25 bp, Mus musculus
cttgacttctggatcacgacgtcga

SEQ ID NO: 342912 - DNA, 25 bp, Mus musculus
ccctggaaaagaagcagccgctatt

SEQ ID NO: 342913 - DNA, 25 bp, Mus musculus
cgcacgcttccagctttcgtaaata

SEQ ID NO: 342914 - DNA, 25 bp, Mus musculus
ggtcggctttgcattcccagatgtg

SEQ ID NO: 342915 - DNA, 25 bp, Mus musculus
gccgctgctggattccaatttcctc

SEQ ID NO: 342916 - DNA, 25 bp, Mus musculus
cctgttctgacaatggatggtgatg

SEQ ID NO: 342917 - DNA, 25 bp, Mus musculus
ctcctctttgggtttcagctcacgc

SEQ ID NO: 342918 - DNA, 25 bp, Mus musculus
acgacgtcgatatccttctgaattc

SEQ ID NO: 342919 - DNA, 25 bp, Mus musculus
gcaagtgtacacagggaccaacgga

SEQ ID NO: 342920 - DNA, 25 bp, Mus musculus
ctgggttcaccggaagaggctcagt

SEQ ID NO: 342921 - DNA, 25 bp, Mus musculus
gctgcgggctgcataattgatggaa

SEQ ID NO: 342922 - DNA, 25 bp, Mus musculus
gcataattgatggaaggccggcgca

SEQ ID NO: 342923 - DNA, 25 bp, Mus musculus
gcagtgggcgcccagttaccagcaa

SEQ ID NO: 342924 - DNA, 25 bp, Mus musculus
gaccaacggagacggatcgcagcga

SEQ ID NO: 342925 - DNA, 25 bp, Mus musculus
cgccgaggttgcacagcacatccgg

SEQ ID NO: 342926 - DNA, 25 bp, Mus musculus
atcgcagcgagctgagggtgcctta

SEQ ID NO: 342927 - DNA, 25 bp, Mus musculus
gagggtgccttagcgacctcctgga

SEQ ID NO: 342928 - DNA, 25 bp, Mus musculus
catgcgctcgcacactggcctgagg

SEQ ID NO: 342929 - DNA, 25 bp, Mus musculus
tggttacccgctcctccttctatgt

SEQ ID NO: 342930 - DNA, 25 bp, Mus musculus
ccttctatgtcttctggcggcgacg

SEQ ID NO: 342931 - DNA, 25 bp, Mus musculus
gctgagggcgatcccacaggtacct

SEQ ID NO: 342932 - DNA, 25 bp, Mus musculus
cggtttattctcgagtgtcctgtcc

SEQ ID NO: 342933 - DNA, 25 bp, Mus musculus
ggcaaacccaactccgcgtccaaca

SEQ ID NO: 342934 - DNA, 25 bp, Mus musculus
ggagttcaatgtcacgctgggcaga

SEQ ID NO: 342935 - DNA, 25 bp, Mus musculus
tgtcacgctgggcagaagtggcaca

SEQ ID NO: 342936 - DNA, 25 bp, Mus musculus
cagcctcagtaccaggcgcggcgga

SEQ ID NO: 342937 - DNA, 25 bp, Mus musculus
cggcagcgcagccactgagggcagc

SEQ ID NO: 342938 - DNA, 25 bp, Mus musculus
ccggtcgcgtcctccgggcatggaa

SEQ ID NO: 342939 - DNA, 25 bp, Mus musculus
ctccgtgtgcttcaaggtggacggc

SEQ ID NO: 342940 - DNA, 25 bp, Mus musculus
catggaaggcggcggcaaacccaac

SEQ ID NO: 342941 - DNA, 25 bp, Mus musculus
ggctcaggagttcaatgtcacgctg

SEQ ID NO: 342942 - DNA, 25 bp, Mus musculus
tggcaactccgtgtgcttcaaggtg

SEQ ID NO: 342943 - DNA, 25 bp, Mus musculus
tccaacagccgcgacgatggcaaca

SEQ ID NO: 342944 - DNA, 25 bp, Mus musculus
gcgacgatggcaacagcgtcttccc

SEQ ID NO: 342945 - DNA, 25 bp, Mus musculus
cggccgggaaggaacatggcaactc

SEQ ID NO: 342946 - DNA, 25 bp, Mus musculus
ggaacatggcaactccgtgtgcttc

SEQ ID NO: 342947 - DNA, 25 bp, Mus musculus
gcctcatttgaataacgccttatta

SEQ ID NO: 342948 - DNA, 25 bp, Mus musculus
tcagaaatgtgtatctctaagcctc

SEQ ID NO: 342949 - DNA, 25 bp, Mus musculus
tcctgacctaacatgcctgagcctg

SEQ ID NO: 342950 - DNA, 25 bp, Mus musculus
gcaagttgtagcgtggtagagttcc

SEQ ID NO: 342951 - DNA, 25 bp, Mus musculus
gggcgctacgccatgaaaatttgaa

SEQ ID NO: 342952 - DNA, 25 bp, Mus musculus
ttaaaaagcgaagggctcacggcgc

SEQ ID NO: 342953 - DNA, 25 bp, Mus musculus
ctgacaactgcaaaggccaaaagtg

SEQ ID NO: 342954 - DNA, 25 bp, Mus musculus
gcgtttatgccgaagcgtagttcca

SEQ ID NO: 342955 - DNA, 25 bp, Mus musculus
tcgtctagaccaatgggaggcgttt

SEQ ID NO: 342956 - DNA, 25 bp, Mus musculus
ctggcttcttcttttcgtctagacc

SEQ ID NO: 342957 - DNA, 25 bp, Mus musculus
agcctacgcgattggctggcttctt

SEQ ID NO: 342958 - DNA, 25 bp, Mus musculus
ttctccaagcgcgaaaaagagccta

SEQ ID NO: 342959 - DNA, 25 bp, Mus musculus
tggcctttataggattctccaagcg

SEQ ID NO: 342960 - DNA, 25 bp, Mus musculus
caaaagtggaggagcttggccttta

SEQ ID NO: 342961 - DNA, 25 bp, Mus musculus
gcgtacggttttcagaagctgtcta

SEQ ID NO: 342962 - DNA, 25 bp, Mus musculus
tgctctttgcaagcgtacggttttc

SEQ ID NO: 342963 - DNA, 25 bp, Mus musculus
taggcccttttttgcgcccagagaa

SEQ ID NO: 342964 - DNA, 25 bp, Mus musculus
agccaatcgcataggcccttttttg

SEQ ID NO: 342965 - DNA, 25 bp, Mus musculus
gaatgcttcccattcgtctagaaga

SEQ ID NO: 342966 - DNA, 25 bp, Mus musculus
ttgtccaattgacgtgcgcccgcga

SEQ ID NO: 342967 - DNA, 25 bp, Mus musculus
gcgacatccgaagtcttgtccaatt

SEQ ID NO: 342968 - DNA, 25 bp, Mus musculus
ttcatgatatacatggcgacatccg

SEQ ID NO: 342969 - DNA, 25 bp, Mus musculus
tcgggcgcctatgattggttcatga

SEQ ID NO: 342970 - DNA, 25 bp, Mus musculus
acttggtcctgtctatttgatgagg

SEQ ID NO: 342971 - DNA, 25 bp, Mus musculus
ctctagcacggaagcgacttggtcc

SEQ ID NO: 342972 - DNA, 25 bp, Mus musculus
ctcaggcatgatgagactggaactc

SEQ ID NO: 342973 - DNA, 25 bp, Mus musculus
ggaactctggaactctagcacggaa

SEQ ID NO: 342974 - DNA, 25 bp, Mus musculus
gctgtctactttctaccatgtctgg

SEQ ID NO: 342975 - DNA, 25 bp, Mus musculus
cagtcgctgtgcagccctcggtgca

SEQ ID NO: 342976 - DNA, 25 bp, Mus musculus
ggatttgaaaatggcggctgcccag

SEQ ID NO: 342977 - DNA, 25 bp, Mus musculus
ggctgcttctgagccgccggctctg

SEQ ID NO: 342978 - DNA, 25 bp, Mus musculus
ccgtcatccggggatttgaaaatgg

SEQ ID NO: 342979 - DNA, 25 bp, Mus musculus
ctacgcagggccgagcagtcgctgt

SEQ ID NO: 342980 - DNA, 25 bp, Mus musculus
ctgagcattgagaccctgcggcttc

SEQ ID NO: 342981 - DNA, 25 bp, Mus musculus
cggctgcccagagatcggccaatca

SEQ ID NO: 342982 - DNA, 25 bp, Mus musculus
cggctctggctccatgtccggagaa

SEQ ID NO: 342983 - DNA, 25 bp, Mus musculus
cccagtgcccaggagaccgatcgtg

SEQ ID NO: 342984 - DNA, 25 bp, Mus musculus
atcggccaatcagagagtgggaagc

SEQ ID NO: 342985 - DNA, 25 bp, Mus musculus
ccgccagcttctgcgaggcagcaag

SEQ ID NO: 342986 - DNA, 25 bp, Mus musculus
gcagcaagtcgccttctagcagaga

SEQ ID NO: 342987 - DNA, 25 bp, Mus musculus
ccttctagcagagagcggctaccgc

SEQ ID NO: 342988 - DNA, 25 bp, Mus musculus
gcaggttcctcgctgagcattgaga

SEQ ID NO: 342989 - DNA, 25 bp, Mus musculus
gcgatttgtcactcagcttgggctg

SEQ ID NO: 342990 - DNA, 25 bp, Mus musculus
ctttgcgcatacagccgatgagtca

SEQ ID NO: 342991 - DNA, 25 bp, Mus musculus
tgcccgtgtgctatgcggcacttaa

SEQ ID NO: 342992 - DNA, 25 bp, Mus musculus
cggcacttaagtggcggtctttaca

SEQ ID NO: 342993 - DNA, 25 bp, Mus musculus
ggtctttacaacctggcgacacttg

SEQ ID NO: 342994 - DNA, 25 bp, Mus musculus
ccgagccttgatttagccggggctg

SEQ ID NO: 342995 - DNA, 25 bp, Mus musculus
aagcccacggcatctgcgatttgtc

SEQ ID NO: 342996 - DNA, 25 bp, Mus musculus
cttcgggctccgaggtgataaactc

SEQ ID NO: 342997 - DNA, 25 bp, Mus musculus
tgataaactctgaacctgggtgccc

SEQ ID NO: 342998 - DNA, 25 bp, Mus musculus
tgcagcaaaaggctccgggtcgatc

SEQ ID NO: 342999 - DNA, 25 bp, Mus musculus
tccgggtcgatccaaatgggcactc

SEQ ID NO: 343000 - DNA, 25 bp, Mus musculus
gtgccgcgctagctttcacccgtgt

SEQ ID NO: 343001 - DNA, 25 bp, Mus musculus
gcggcacctaggagaccttggcttt

SEQ ID NO: 343002 - DNA, 25 bp, Mus musculus
taagtagtgacaaccggggccattg

SEQ ID NO: 343003 - DNA, 25 bp, Mus musculus
agagcttctttctcaactaaaggcc

SEQ ID NO: 343004 - DNA, 25 bp, Mus musculus
cgggcaagttttcctaatgaggctc

SEQ ID NO: 343005 - DNA, 25 bp, Mus musculus
cgggcgggcaagttttcctaatgag

SEQ ID NO: 343006 - DNA, 25 bp, Mus musculus
tgcaacattgcagtacgggcgggca

SEQ ID NO: 343007 - DNA, 25 bp, Mus musculus
ccaaagggttgcaacattgcagtac

SEQ ID NO: 343008 - DNA, 25 bp, Mus musculus
atcctccaaagggttgcaacattgc

SEQ ID NO: 343009 - DNA, 25 bp, Mus musculus
tccaattaatcctccaaagggttgc

SEQ ID NO: 343010 - DNA, 25 bp, Mus musculus
tttcagggccatccaattaatcctc

SEQ ID NO: 343011 - DNA, 25 bp, Mus musculus
gttttcctaatgaggctctttccag

SEQ ID NO: 343012 - DNA, 25 bp, Mus musculus
cctagagcttctttctcaactaaag

SEQ ID NO: 343013 - DNA, 25 bp, Mus musculus
ggctaattatgctcacctagagctt

SEQ ID NO: 343014 - DNA, 25 bp, Mus musculus
cggcggctaattatgctcacctaga

SEQ ID NO: 343015 - DNA, 25 bp, Mus musculus
ggattcggcggctaattatgctcac

SEQ ID NO: 343016 - DNA, 25 bp, Mus musculus
gggccatccaattaatcctccaaag

SEQ ID NO: 343017 - DNA, 25 bp, Mus musculus
ccctttggaggattaattggatggc

SEQ ID NO: 343018 - DNA, 25 bp, Mus musculus
cgtactgcaatgttgcaaccctttg

SEQ ID NO: 343019 - DNA, 25 bp, Mus musculus
gtgagcataattagccgccgaatcc

SEQ ID NO: 343020 - DNA, 25 bp, Mus musculus
ctctaggtgagcataattagccgcc

SEQ ID NO: 343021 - DNA, 25 bp, Mus musculus
ctttagttgagaaagaagctctagg

SEQ ID NO: 343022 - DNA, 25 bp, Mus musculus
gcctttagttgagaaagaagctcta

SEQ ID NO: 343023 - DNA, 25 bp, Mus musculus
gaggattaattggatggccctgaaa

SEQ ID NO: 343024 - DNA, 25 bp, Mus musculus
tgcaatgttgcaaccctttggagga

SEQ ID NO: 343025 - DNA, 25 bp, Mus musculus
gcccgcccgtactgcaatgttgcaa

SEQ ID NO: 343026 - DNA, 25 bp, Mus musculus
cttgcccgcccgtactgcaatgttg

SEQ ID NO: 343027 - DNA, 25 bp, Mus musculus
ctcattaggaaaacttgcccgcccg

SEQ ID NO: 343028 - DNA, 25 bp, Mus musculus
gagcctcattaggaaaacttgcccg

SEQ ID NO: 343029 - DNA, 25 bp, Mus musculus
ctggaaagagcctcattaggaaaac

SEQ ID NO: 343030 - DNA, 25 bp, Mus musculus
tgcaaccctttggaggattaattgg

SEQ ID NO: 343031 - DNA, 25 bp, Mus musculus
ccgcgtccagacatggtagaaagta

SEQ ID NO: 343032 - DNA, 25 bp, Mus musculus
aaaaaagggcctatgcgattggctg

SEQ ID NO: 343033 - DNA, 25 bp, Mus musculus
acagcttctgaaaaccgtacgcttg

SEQ ID NO: 343034 - DNA, 25 bp, Mus musculus
tcttctagacgaatgggaagcattc

SEQ ID NO: 343035 - DNA, 25 bp, Mus musculus
gcgggcgcacgtcaattggacaaga

SEQ ID NO: 343036 - DNA, 25 bp, Mus musculus
tcaattggacaagacttcggatgtc

SEQ ID NO: 343037 - DNA, 25 bp, Mus musculus
ttcggatgtcgccatgtatatcatg

SEQ ID NO: 343038 - DNA, 25 bp, Mus musculus
tgaaccaatcataggcgcccgatcc

SEQ ID NO: 343039 - DNA, 25 bp, Mus musculus
ctcatcaaatagacaggaccaagtc

SEQ ID NO: 343040 - DNA, 25 bp, Mus musculus
aggaccaagtcgcttccgtgctaga

SEQ ID NO: 343041 - DNA, 25 bp, Mus musculus
ttccgtgctagagttccagagttcc

SEQ ID NO: 343042 - DNA, 25 bp, Mus musculus
agagttccagtctcatcatgcctga

SEQ ID NO: 343043 - DNA, 25 bp, Mus musculus
ccgtacgcttgcaaagagcaagagc

SEQ ID NO: 343044 - DNA, 25 bp, Mus musculus
ttctctgggcgcaaaaaagggccta

SEQ ID NO: 343045 - DNA, 25 bp, Mus musculus
tcccaggtcatctggatccaggatc

SEQ ID NO: 343046 - DNA, 25 bp, Mus musculus
tgacgtcaccttgcgggctcgcgta

SEQ ID NO: 343047 - DNA, 25 bp, Mus musculus
atggcaaccaccagcgccttgggtg

SEQ ID NO: 343048 - DNA, 25 bp, Mus musculus
tgagttttgatgaccatcccaggtc

SEQ ID NO: 343049 - DNA, 25 bp, Mus musculus
aggtatcaccatggcaaccaccagc

SEQ ID NO: 343050 - DNA, 25 bp, Mus musculus
actggagtccaggtatcaccatggc

SEQ ID NO: 343051 - DNA, 25 bp, Mus musculus
cgccttgggtgtgtgacgtcacctt

SEQ ID NO: 343052 - DNA, 25 bp, Mus musculus
tggatccaggatccttggagtgcgt

SEQ ID NO: 343053 - DNA, 25 bp, Mus musculus
ccacggcgtaaactcacagcctgag

SEQ ID NO: 343054 - DNA, 25 bp, Mus musculus
cgaccggaagtgaccgctaagccga

SEQ ID NO: 343055 - DNA, 25 bp, Mus musculus
agtgaccgctaagccgactgtgggc

SEQ ID NO: 343056 - DNA, 25 bp, Mus musculus
tggctcgtcccacggcgtaaactca

SEQ ID NO: 343057 - DNA, 25 bp, Mus musculus
cacagcctgagttttgatgaccatc

SEQ ID NO: 343058 - DNA, 25 bp, Mus musculus
tggagtgcgtcacaagactggagtc

SEQ ID NO: 343059 - DNA, 25 bp, Mus musculus
caatgcgcatccaggtccaaggccg

SEQ ID NO: 343060 - DNA, 25 bp, Mus musculus
agctacctgggcaaagcggggtcct

SEQ ID NO: 343061 - DNA, 25 bp, Mus musculus
tgaaacggggctagaagtcaccgcc

SEQ ID NO: 343062 - DNA, 25 bp, Mus musculus
cagcggatgcttggattcggccgcc

SEQ ID NO: 343063 - DNA, 25 bp, Mus musculus
ccaaccgtcactcgagcagcggatg

SEQ ID NO: 343064 - DNA, 25 bp, Mus musculus
gcttttctggcgctcgtggcccaac

SEQ ID NO: 343065 - DNA, 25 bp, Mus musculus
cgcagatcccagagcgggctgacgt

SEQ ID NO: 343066 - DNA, 25 bp, Mus musculus
tcgttccctcgtacgttcactcgta

SEQ ID NO: 343067 - DNA, 25 bp, Mus musculus
gtcctgcctggatgctagacaccga

SEQ ID NO: 343068 - DNA, 25 bp, Mus musculus
actgggacgcgcaccaatgcgcatc

SEQ ID NO: 343069 - DNA, 25 bp, Mus musculus
agagtcgcttccagctcagagtttg

SEQ ID NO: 343070 - DNA, 25 bp, Mus musculus
ggattcaaatcacccagagtcgctt

SEQ ID NO: 343071 - DNA, 25 bp, Mus musculus
tcactcgtacgatgaagggattcaa

SEQ ID NO: 343072 - DNA, 25 bp, Mus musculus
ccagtgtggtgctcagaccgcagat

SEQ ID NO: 343073 - DNA, 25 bp, Mus musculus
gcttacctgtacagcccggcgaagc

SEQ ID NO: 343074 - DNA, 25 bp, Mus musculus
tctgaactcggtgaaggtggacgct

SEQ ID NO: 343075 - DNA, 25 bp, Mus musculus
gaaggtggacgctcagctttggccc

SEQ ID NO: 343076 - DNA, 25 bp, Mus musculus
ctttggcccattagtctctggctta

SEQ ID NO: 343077 - DNA, 25 bp, Mus musculus
gtccgggtggcttacctgtacagcc

SEQ ID NO: 343078 - DNA, 25 bp, Mus musculus
cacttcccgagcaggagaccgcaga

SEQ ID NO: 343079 - DNA, 25 bp, Mus musculus
agctggcgcacgcttagcggcgctc

SEQ ID NO: 343080 - DNA, 25 bp, Mus musculus
agcagctccgcctggtcttccgtaa

SEQ ID NO: 343081 - DNA, 25 bp, Mus musculus
tccgcctggtcttccgtaaggtcca

SEQ ID NO: 343082 - DNA, 25 bp, Mus musculus
gcgcccagttcctccctcagcacag

SEQ ID NO: 343083 - DNA, 25 bp, Mus musculus
aggccgccgccagacacttcggaaa

SEQ ID NO: 343084 - DNA, 25 bp, Mus musculus
cttcggaaagcgagaagcgactttc

SEQ ID NO: 343085 - DNA, 25 bp, Mus musculus
tctctggcttacaagcgcgtccggg

SEQ ID NO: 343086 - DNA, 25 bp, Mus musculus
cgctccacctccgtgaaggcggtgg

SEQ ID NO: 343087 - DNA, 25 bp, Mus musculus
ctgccactgagctcttacctggtta

SEQ ID NO: 343088 - DNA, 25 bp, Mus musculus
aggacgtccggaaactgcaggtttg

SEQ ID NO: 343089 - DNA, 25 bp, Mus musculus
tccaagggctggaagaagacacatt

SEQ ID NO: 343090 - DNA, 25 bp, Mus musculus
aggagcctccgaagcagatccaagg

SEQ ID NO: 343091 - DNA, 25 bp, Mus musculus
gccagcgagccagcgtaggagcctc

SEQ ID NO: 343092 - DNA, 25 bp, Mus musculus
attctgaggaccttcagccgggccc

SEQ ID NO: 343093 - DNA, 25 bp, Mus musculus
ccgcccacccgaggaattctgagga

SEQ ID NO: 343094 - DNA, 25 bp, Mus musculus
agtacactcgcgctacctctggtcg

SEQ ID NO: 343095 - DNA, 25 bp, Mus musculus
tacctggttataggcggagaagtcc

SEQ ID NO: 343096 - DNA, 25 bp, Mus musculus
agaagtccactacagcgctcagcgg

SEQ ID NO: 343097 - DNA, 25 bp, Mus musculus
ctacgaaaggaggagcgtcagccta

SEQ ID NO: 343098 - DNA, 25 bp, Mus musculus
cgtcagcctagtacaagaagcggtg

SEQ ID NO: 343099 - DNA, 25 bp, Mus musculus
ggagcgtggtagtacactcgcgcta

SEQ ID NO: 343100 - DNA, 25 bp, Mus musculus
gctacctctggtcgggaccctgcag

SEQ ID NO: 343101 - DNA, 25 bp, Mus musculus
cccgtggtgttcctatctgcttgtc

SEQ ID NO: 343102 - DNA, 25 bp, Mus musculus
gctcagccttttctctgagtgacca

SEQ ID NO: 343103 - DNA, 25 bp, Mus musculus
tgagtgaccactacccagacaaggg

SEQ ID NO: 343104 - DNA, 25 bp, Mus musculus
tctagataaagagtacccgtggtgt

SEQ ID NO: 343105 - DNA, 25 bp, Mus musculus
atctgcttgtcctgttgggtgttca

SEQ ID NO: 343106 - DNA, 25 bp, Mus musculus
tattcatttctacgccatgcctgag

SEQ ID NO: 343107 - DNA, 25 bp, Mus musculus
cgaggttttgggagttgtgtattct

SEQ ID NO: 343108 - DNA, 25 bp, Mus musculus
gcccgtcattggttagcattgtgag

SEQ ID NO: 343109 - DNA, 25 bp, Mus musculus
gcgcgaaaaaggaggcccgtcattg

SEQ ID NO: 343110 - DNA, 25 bp, Mus musculus
atttttatagtcaagccagggcgcg

SEQ ID NO: 343111 - DNA, 25 bp, Mus musculus
ccctggtaagcgttagctaaacagc

SEQ ID NO: 343112 - DNA, 25 bp, Mus musculus
ctcattgggtaaaagcaggctcagc

SEQ ID NO: 343113 - DNA, 25 bp, Mus musculus
gcttaccgcgtccagacatattgta

SEQ ID NO: 343114 - DNA, 25 bp, Mus musculus
gggcatttcactttatttgcatacg

SEQ ID NO: 343115 - DNA, 25 bp, Mus musculus
ctttgtggagaaggccggtccctct

SEQ ID NO: 343116 - DNA, 25 bp, Mus musculus
ctaagacgaagcagatggctttgtg

SEQ ID NO: 343117 - DNA, 25 bp, Mus musculus
gctttgtggagaaggccggtccctc

SEQ ID NO: 343118 - DNA, 25 bp, Mus musculus
ccggagtgaaaacagaaacgtcagg

SEQ ID NO: 343119 - DNA, 25 bp, Mus musculus
cggagtgaaaacagaaacgtcaggc

SEQ ID NO: 343120 - DNA, 25 bp, Mus musculus
ggagtgaaaacagaaacgtcaggcg

SEQ ID NO: 343121 - DNA, 25 bp, Mus musculus
agtgaaaacagaaacgtcaggcgga

SEQ ID NO: 343122 - DNA, 25 bp, Mus musculus
acgtcaggcggaagtgcctgcgggc

SEQ ID NO: 343123 - DNA, 25 bp, Mus musculus
aaaacagaaacgtcaggcggaagtg

SEQ ID NO: 343124 - DNA, 25 bp, Mus musculus
aaacagaaacgtcaggcggaagtgc

SEQ ID NO: 343125 - DNA, 25 bp, Mus musculus
aacagaaacgtcaggcggaagtgcc

SEQ ID NO: 343126 - DNA, 25 bp, Mus musculus
acagaaacgtcaggcggaagtgcct

SEQ ID NO: 343127 - DNA, 25 bp, Mus musculus
tgaaaacagaaacgtcaggcggaag

SEQ ID NO: 343128 - DNA, 25 bp, Mus musculus
aagacgaagcagatggctttgtgga

SEQ ID NO: 343129 - DNA, 25 bp, Mus musculus
gacgtcatcaaaccaatcacccaat

SEQ ID NO: 343130 - DNA, 25 bp, Mus musculus
cttctgtggtatagctctacgtaga

SEQ ID NO: 343131 - DNA, 25 bp, Mus musculus
agccgatcagcttctgtggtatagc

SEQ ID NO: 343132 - DNA, 25 bp, Mus musculus
ctttaaaagggaagagccgatcagc

SEQ ID NO: 343133 - DNA, 25 bp, Mus musculus
tcctaagctttatttgaataaggcc

SEQ ID NO: 343134 - DNA, 25 bp, Mus musculus
caatcatcattttgctttcctaagc

SEQ ID NO: 343135 - DNA, 25 bp, Mus musculus
ggccaaagcctatatgacgtcatca

SEQ ID NO: 343136 - DNA, 25 bp, Mus musculus
caagtattttgattgggccaaagcc

SEQ ID NO: 343137 - DNA, 25 bp, Mus musculus
tagaccaatggaaagcgattatagc

SEQ ID NO: 343138 - DNA, 25 bp, Mus musculus
tcgggattggctgcgttcttttcat

SEQ ID NO: 343139 - DNA, 25 bp, Mus musculus
ctctgggcgcgaaaaggaacgttcg

SEQ ID NO: 343140 - DNA, 25 bp, Mus musculus
cagccttagtgacaactgtacgttc

SEQ ID NO: 343141 - DNA, 25 bp, Mus musculus
ttgtaaagattaaacagccttagtg

SEQ ID NO: 343142 - DNA, 25 bp, Mus musculus
actgtacgttcccaaagagcaagag

SEQ ID NO: 343143 - DNA, 25 bp, Mus musculus
gcacaccgcagcatgggctactgtc

SEQ ID NO: 343144 - DNA, 25 bp, Mus musculus
atgccatcttcgacctgctgaccgg

SEQ ID NO: 343145 - DNA, 25 bp, Mus musculus
gtccctgtgctaaccaggacctcat

SEQ ID NO: 343146 - DNA, 25 bp, Mus musculus
tacagcggaggcaacaaacggaagc

SEQ ID NO: 343147 - DNA, 25 bp, Mus musculus
cgggtacctacagcggaggcaacaa

SEQ ID NO: 343148 - DNA, 25 bp, Mus musculus
tagctatgcagaccgacccgcgggt

SEQ ID NO: 343149 - DNA, 25 bp, Mus musculus
tgcccgaggcccaagttgcccaggt

SEQ ID NO: 343150 - DNA, 25 bp, Mus musculus
agttgcccaggtgaacatgcccggt

SEQ ID NO: 343151 - DNA, 25 bp, Mus musculus
tgaacatgcccggtccctgtgctaa

SEQ ID NO: 343152 - DNA, 25 bp, Mus musculus
tcacctggctccgttctgcagactg

SEQ ID NO: 343153 - DNA, 25 bp, Mus musculus
tgcagactgcgctctctggcctggt

SEQ ID NO: 343154 - DNA, 25 bp, Mus musculus
gcctgggccttcctagctatgcaga

SEQ ID NO: 343155 - DNA, 25 bp, Mus musculus
atctggaactgtttgctcgcctgcg

SEQ ID NO: 343156 - DNA, 25 bp, Mus musculus
ccggccgggaacatctggaactgtt

SEQ ID NO: 343157 - DNA, 25 bp, Mus musculus
cgggaacagtttctgctcggactcc

SEQ ID NO: 343158 - DNA, 25 bp, Mus musculus
cgcacttctgcaacgttgggctgta

SEQ ID NO: 343159 - DNA, 25 bp, Mus musculus
gctctgccgtccctggaggaatatt

SEQ ID NO: 343160 - DNA, 25 bp, Mus musculus
ttgtgcacgaaacgggctacttctc

SEQ ID NO: 343161 - DNA, 25 bp, Mus musculus
ttcccgacagcgaggactgtctttt

SEQ ID NO: 343162 - DNA, 25 bp, Mus musculus
gaaactttcacctgcgctcccggga

SEQ ID NO: 343163 - DNA, 25 bp, Mus musculus
gcagcgccatccagtttgcatgaaa

SEQ ID NO: 343164 - DNA, 25 bp, Mus musculus
gtcagtccgctgtttgcaaatattg

SEQ ID NO: 343165 - DNA, 25 bp, Mus musculus
attggtgcgagctgacatcatcgtc

SEQ ID NO: 343166 - DNA, 25 bp, Mus musculus
aggccgagttcgaattgcaccaata

SEQ ID NO: 343167 - DNA, 25 bp, Mus musculus
tctttccaatcagcgcaggccgagt

SEQ ID NO: 343168 - DNA, 25 bp, Mus musculus
tagcctgtgagacgtctttccaatc

SEQ ID NO: 343169 - DNA, 25 bp, Mus musculus
tgcgccgtagccctcgccttatata

SEQ ID NO: 343170 - DNA, 25 bp, Mus musculus
acccgacatggatgtgctcccaatg

SEQ ID NO: 343171 - DNA, 25 bp, Mus musculus
ccgctgttttcttcttattaggact

SEQ ID NO: 343172 - DNA, 25 bp, Mus musculus
gaaagcacgggcacacataagcaca

SEQ ID NO: 343173 - DNA, 25 bp, Mus musculus
tttgattttcaaaggaacgtggtgc

SEQ ID NO: 343174 - DNA, 25 bp, Mus musculus
tctggcttgtctatcccgcatttga

SEQ ID NO: 343175 - DNA, 25 bp, Mus musculus
cgtcggcacggagagaccttgattt

SEQ ID NO: 343176 - DNA, 25 bp, Mus musculus
ttattaggacttgatccctggcgtc

SEQ ID NO: 343177 - DNA, 25 bp, Mus musculus
gacagtactcagaatccgctgtttt

SEQ ID NO: 343178 - DNA, 25 bp, Mus musculus
cgctggattagagtagacagtactc

SEQ ID NO: 343179 - DNA, 25 bp, Mus musculus
tcctggaaaagtggtcgctggatta

SEQ ID NO: 343180 - DNA, 25 bp, Mus musculus
tctccggggagctagttcctggaaa

SEQ ID NO: 343181 - DNA, 25 bp, Mus musculus
agcccgtgacctgtgcggatttcca

SEQ ID NO: 343182 - DNA, 25 bp, Mus musculus
cgggaacatccggaaggagcatcct

SEQ ID NO: 343183 - DNA, 25 bp, Mus musculus
agtcgtgatctggacgggaacatcc

SEQ ID NO: 343184 - DNA, 25 bp, Mus musculus
ggcgtcttttcccaggccgtcggca

SEQ ID NO: 343185 - DNA, 25 bp, Mus musculus
tggctctttcgcgtccgacaactac

SEQ ID NO: 343186 - DNA, 25 bp, Mus musculus
ctggaatttgggactgcagcagctc

SEQ ID NO: 343187 - DNA, 25 bp, Mus musculus
gcagctccggtacccactgaattga

SEQ ID NO: 343188 - DNA, 25 bp, Mus musculus
gacaactaccttttcagctcctgga

SEQ ID NO: 343189 - DNA, 25 bp, Mus musculus
ataagcaccggacctcccgaaatgg

SEQ ID NO: 343190 - DNA, 25 bp, Mus musculus
ctgcaccgggattccgggccaataa

SEQ ID NO: 343191 - DNA, 25 bp, Mus musculus
ccgctctcaccagcaaggacaggga

SEQ ID NO: 343192 - DNA, 25 bp, Mus musculus
caaccgccggataccaacctggaga

SEQ ID NO: 343193 - DNA, 25 bp, Mus musculus
atgctgagaggtcggcaagccaacc

SEQ ID NO: 343194 - DNA, 25 bp, Mus musculus
tgactggaccctcaagccggagctt

SEQ ID NO: 343195 - DNA, 25 bp, Mus musculus
gaggacccgctgaacgcttactccg

SEQ ID NO: 343196 - DNA, 25 bp, Mus musculus
ctctcacggccaaggacctcgagga

SEQ ID NO: 343197 - DNA, 25 bp, Mus musculus
actgaattgaaaccgtgccctgcgc

SEQ ID NO: 343198 - DNA, 25 bp, Mus musculus
ttgacagcgacaagaagggcgccgc

SEQ ID NO: 343199 - DNA, 25 bp, Mus musculus
gaccagcggtgtcttttcaccaaaa

SEQ ID NO: 343200 - DNA, 25 bp, Mus musculus
cgagaggactcgttcttgagacgta

SEQ ID NO: 343201 - DNA, 25 bp, Mus musculus
tggcaaatcctagttcaagctgagc

SEQ ID NO: 343202 - DNA, 25 bp, Mus musculus
cttccggttcccactgaggcagata

SEQ ID NO: 343203 - DNA, 25 bp, Mus musculus
ccgaatgacaccgagggcatccctg

SEQ ID NO: 343204 - DNA, 25 bp, Mus musculus
acttcggagtcacagatattcgttg

SEQ ID NO: 343205 - DNA, 25 bp, Mus musculus
gcagcgacttcacggacctcgacag

SEQ ID NO: 343206 - DNA, 25 bp, Mus musculus
gttgccacagcaaggtcaccagtta

SEQ ID NO: 343207 - DNA, 25 bp, Mus musculus
cgcgtctacttttgtggttgttgcc

SEQ ID NO: 343208 - DNA, 25 bp, Mus musculus
gtgacgtttctcaaagccgtgcctc

SEQ ID NO: 343209 - DNA, 25 bp, Mus musculus
ccaagcctggcggtaaaagcagttt

SEQ ID NO: 343210 - DNA, 25 bp, Mus musculus
tcttggacccgcagtcggagacctt

SEQ ID NO: 343211 - DNA, 25 bp, Mus musculus
tgcgcacgcacaggttttctaactt

SEQ ID NO: 343212 - DNA, 25 bp, Mus musculus
tctgggcgacccgaaaatactcatt

SEQ ID NO: 343213 - DNA, 25 bp, Mus musculus
cgcctcattcgtgtacagccaagaa

SEQ ID NO: 343214 - DNA, 25 bp, Mus musculus
aagaaaatgagtcgcgcccggctgc

SEQ ID NO: 343215 - DNA, 25 bp, Mus musculus
acctctcctttcgacgcagggctta

SEQ ID NO: 343216 - DNA, 25 bp, Mus musculus
cagggcttaccctcggcctggaaga

SEQ ID NO: 343217 - DNA, 25 bp, Mus musculus
tcggcctggaagaaaacgcgtccca

SEQ ID NO: 343218 - DNA, 25 bp, Mus musculus
cacctcgccgtaggcgctgagcagg

SEQ ID NO: 343219 - DNA, 25 bp, Mus musculus
ggacgtggcccaggtacacaatccc

SEQ ID NO: 343220 - DNA, 25 bp, Mus musculus
tcccgctttcaccatggcaagatct

SEQ ID NO: 343221 - DNA, 25 bp, Mus musculus
catggcaagatctggggagcacgac

SEQ ID NO: 343222 - DNA, 25 bp, Mus musculus
tggggagcacgacagccgtgaatct

SEQ ID NO: 343223 - DNA, 25 bp, Mus musculus
gccgtgaatctgtcgccatctgatg

SEQ ID NO: 343224 - DNA, 25 bp, Mus musculus
tcgccatctgatgacgcacatcctg

SEQ ID NO: 343225 - DNA, 25 bp, Mus musculus
ccaatctgcggtcggggccaagaaa

SEQ ID NO: 343226 - DNA, 25 bp, Mus musculus
gcacatcctgcgagccaatctgcgg

SEQ ID NO: 343227 - DNA, 25 bp, Mus musculus
cgacgtgaaaagagatcgggtcctt

SEQ ID NO: 343228 - DNA, 25 bp, Mus musculus
gaaacctgcagggatgaacgcggcc

SEQ ID NO: 343229 - DNA, 25 bp, Mus musculus
atgaacgcggccgagctctgggcat

SEQ ID NO: 343230 - DNA, 25 bp, Mus musculus
gcgggcgaccgccttttccagattc

SEQ ID NO: 343231 - DNA, 25 bp, Mus musculus
cttttccagattccgccttcacgag

SEQ ID NO: 343232 - DNA, 25 bp, Mus musculus
tccgccttcacgagaacatttgtgg

SEQ ID NO: 343233 - DNA, 25 bp, Mus musculus
catttgtggaaaagcccgggcttct

SEQ ID NO: 343234 - DNA, 25 bp, Mus musculus
gccatcacgcggaggccgtcaggct

SEQ ID NO: 343235 - DNA, 25 bp, Mus musculus
gaggccgtcaggctctcacctagag

SEQ ID NO: 343236 - DNA, 25 bp, Mus musculus
ctcacctagagcgactccgggttga

SEQ ID NO: 343237 - DNA, 25 bp, Mus musculus
accggaaggagcctcggatacgctt

SEQ ID NO: 343238 - DNA, 25 bp, Mus musculus
aggagcctcggatacgcttccggcc

SEQ ID NO: 343239 - DNA, 25 bp, Mus musculus
atcgggtccttcagactaccctcgg

SEQ ID NO: 343240 - DNA, 25 bp, Mus musculus
ctcggcccgaaacctgcagggatga

SEQ ID NO: 343241 - DNA, 25 bp, Mus musculus
atttggagaatgaacacgatgattc

SEQ ID NO: 343242 - DNA, 25 bp, Mus musculus
gacctcgtctgtcgaaaccacagca

SEQ ID NO: 343243 - DNA, 25 bp, Mus musculus
atagaagtaccgctgtcgacctcgt

SEQ ID NO: 343244 - DNA, 25 bp, Mus musculus
tgctcctggccatcccggtatagaa

SEQ ID NO: 343245 - DNA, 25 bp, Mus musculus
ggccgtctagaagcccggctgtcgc

SEQ ID NO: 343246 - DNA, 25 bp, Mus musculus
atcagcagagtagcgcggccgtcta

SEQ ID NO: 343247 - DNA, 25 bp, Mus musculus
gaccctgacatctcggatcagcaga

SEQ ID NO: 343248 - DNA, 25 bp, Mus musculus
tgtctttgaaaaggcaccggtactc

SEQ ID NO: 343249 - DNA, 25 bp, Mus musculus
ggcctcctcgaagtcgtcgttgtct

SEQ ID NO: 343250 - DNA, 25 bp, Mus musculus
ctttgaggtatacggcggcctcctc

SEQ ID NO: 343251 - DNA, 25 bp, Mus musculus
cccaccagccactttgaggtatacg

SEQ ID NO: 343252 - DNA, 25 bp, Mus musculus
gacgaggcgacacatcccgtctgta

SEQ ID NO: 343253 - DNA, 25 bp, Mus musculus
accacagcagctccatgtattctga

SEQ ID NO: 343254 - DNA, 25 bp, Mus musculus
cccaaagtgagagtctccgcgcgga

SEQ ID NO: 343255 - DNA, 25 bp, Mus musculus
tccaggttggcaaattcttaaatta

SEQ ID NO: 343256 - DNA, 25 bp, Mus musculus
tggttggctgtttctgtgctttgga

SEQ ID NO: 343257 - DNA, 25 bp, Mus musculus
tgagtgcacagcaccgacggtggtt

SEQ ID NO: 343258 - DNA, 25 bp, Mus musculus
ttgcaaggacaaagcgcgagagcta

SEQ ID NO: 343259 - DNA, 25 bp, Mus musculus
cgggcagcgtgcatttattgaagta

SEQ ID NO: 343260 - DNA, 25 bp, Mus musculus
cttaaattatattcgggcagcgtgc

SEQ ID NO: 343261 - DNA, 25 bp, Mus musculus
tcaggtatttacaatccaggttggc

SEQ ID NO: 343262 - DNA, 25 bp, Mus musculus
cgttaatcgactcactattcaggta

SEQ ID NO: 343263 - DNA, 25 bp, Mus musculus
gcagcgttgtgtaagtacgttaatc

SEQ ID NO: 343264 - DNA, 25 bp, Mus musculus
gcgaacatgtgttttacgttttgaa

SEQ ID NO: 343265 - DNA, 25 bp, Mus musculus
gcgaatcttgcttctgacctacaaa

SEQ ID NO: 343266 - DNA, 25 bp, Mus musculus
taaaggtcttggcaaaggcggcgcc

SEQ ID NO: 343267 - DNA, 25 bp, Mus musculus
agcgtctgcgcagactgcggaaatc

SEQ ID NO: 343268 - DNA, 25 bp, Mus musculus
ttcggcggttaagcgaatcttgctt

SEQ ID NO: 343269 - DNA, 25 bp, Mus musculus
ccgttttcgcgccagaagttgagta

SEQ ID NO: 343270 - DNA, 25 bp, Mus musculus
agtaagccagtgagctaagtttttt

SEQ ID NO: 343271 - DNA, 25 bp, Mus musculus
cccaagggaaagtaagccagtgagc

SEQ ID NO: 343272 - DNA, 25 bp, Mus musculus
gagccaccataagcccaagggaaag

SEQ ID NO: 343273 - DNA, 25 bp, Mus musculus
gcaaggtacctacaatgtctggacg

SEQ ID NO: 343274 - DNA, 25 bp, Mus musculus
tcctgacagcaaggtacctacaatg

SEQ ID NO: 343275 - DNA, 25 bp, Mus musculus
tatacgctgaacagatcctgacagc

SEQ ID NO: 343276 - DNA, 25 bp, Mus musculus
ctgtggctgcatcattatacgctga

SEQ ID NO: 343277 - DNA, 25 bp, Mus musculus
gcgccagaagttgagtattagaatg

SEQ ID NO: 343278 - DNA, 25 bp, Mus musculus
gagatcactccgttttcgcgccaga

SEQ ID NO: 343279 - DNA, 25 bp, Mus musculus
ctatgtgtagccaacgagatcactc

SEQ ID NO: 343280 - DNA, 25 bp, Mus musculus
tttaggtaaaactctatgtgtagcc

SEQ ID NO: 343281 - DNA, 25 bp, Mus musculus
tacaagctaccattggtttaggtaa

SEQ ID NO: 343282 - DNA, 25 bp, Mus musculus
attagaatggtgctgtggctgcatc

SEQ ID NO: 343283 - DNA, 25 bp, Mus musculus
ggccaaagtgcgctacttaggtatc

SEQ ID NO: 343284 - DNA, 25 bp, Mus musculus
tttccctacggttacttgccatggc

SEQ ID NO: 343285 - DNA, 25 bp, Mus musculus
cttaggtatctcacttttccctacg

SEQ ID NO: 343286 - DNA, 25 bp, Mus musculus
cgcgggacacttgaaaagcagacac

SEQ ID NO: 343287 - DNA, 25 bp, Mus musculus
gacacttgaaaagcagacacgccta

SEQ ID NO: 343288 - DNA, 25 bp, Mus musculus
ttgaaaagcagacacgcctatcagg

SEQ ID NO: 343289 - DNA, 25 bp, Mus musculus
gcagacacgcctatcaggatgcttc

SEQ ID NO: 343290 - DNA, 25 bp, Mus musculus
acgcctatcaggatgcttctcggtg

SEQ ID NO: 343291 - DNA, 25 bp, Mus musculus
ctatcaggatgcttctcggtgggaa

SEQ ID NO: 343292 - DNA, 25 bp, Mus musculus
ttgcgcgtgtgcgaacgcaagcgta

SEQ ID NO: 343293 - DNA, 25 bp, Mus musculus
cgtgtgcgaacgcaagcgtacttaa

SEQ ID NO: 343294 - DNA, 25 bp, Mus musculus
cgaacgcaagcgtacttaaaggcca

SEQ ID NO: 343295 - DNA, 25 bp, Mus musculus
gcgctacttaggtatctcacttttc

SEQ ID NO: 343296 - DNA, 25 bp, Mus musculus
cttaaaggccaaagtgcgctactta

SEQ ID NO: 343297 - DNA, 25 bp, Mus musculus
actttccacgacaggctgcgcgttg

SEQ ID NO: 343298 - DNA, 25 bp, Mus musculus
gctgtctaaggtgaacgccggaata

SEQ ID NO: 343299 - DNA, 25 bp, Mus musculus
cgcccaggttcgtgctgtctaaggt

SEQ ID NO: 343300 - DNA, 25 bp, Mus musculus
gagcctgcgccggacgcacaaaatg

SEQ ID NO: 343301 - DNA, 25 bp, Mus musculus
caaacaactgtgcacgcgcgctcgt

SEQ ID NO: 343302 - DNA, 25 bp, Mus musculus
tgctgtcgcgcttcccaaacaactg

SEQ ID NO: 343303 - DNA, 25 bp, Mus musculus
agccggtaggtctcctcctcgtcgt

SEQ ID NO: 343304 - DNA, 25 bp, Mus musculus
ttgcggatcttccacagccggtagg

SEQ ID NO: 343305 - DNA, 25 bp, Mus musculus
cacctgcatgatcgtcttgcggatc

SEQ ID NO: 343306 - DNA, 25 bp, Mus musculus
tcctcacgcttgatcacctgcatga

SEQ ID NO: 343307 - DNA, 25 bp, Mus musculus
gctcgcataaagctcctcacgcttg

SEQ ID NO: 343308 - DNA, 25 bp, Mus musculus
cgcaactgaacgctcgctcgcataa

SEQ ID NO: 343309 - DNA, 25 bp, Mus musculus
caacccgcagttagtccgcaactga

SEQ ID NO: 343310 - DNA, 25 bp, Mus musculus
ggcctcggcggacaacccgcagtta

SEQ ID NO: 343311 - DNA, 25 bp, Mus musculus
agtcttgagcactcacttggagctg

SEQ ID NO: 343312 - DNA, 25 bp, Mus musculus
gagatattgaactgttccgttcctt

SEQ ID NO: 343313 - DNA, 25 bp, Mus musculus
ggccaagaaaagagatattgaactg

SEQ ID NO: 343314 - DNA, 25 bp, Mus musculus
cagagaatgaaggtaggccaagaaa

SEQ ID NO: 343315 - DNA, 25 bp, Mus musculus
gcatagtgaacagagaatgaaggta

SEQ ID NO: 343316 - DNA, 25 bp, Mus musculus
gtcagcattaaagctccaattttga

SEQ ID NO: 343317 - DNA, 25 bp, Mus musculus
ctccaattttgaagtcttgagtggc

SEQ ID NO: 343318 - DNA, 25 bp, Mus musculus
gtcactaagtcagcattaaagctcc

SEQ ID NO: 343319 - DNA, 25 bp, Mus musculus
gctgagtcttgagcactcacttgga

SEQ ID NO: 343320 - DNA, 25 bp, Mus musculus
ctttgggttaagagctgagtcttga

SEQ ID NO: 343321 - DNA, 25 bp, Mus musculus
gagcctttgggttaagagctgagtc

SEQ ID NO: 343322 - DNA, 25 bp, Mus musculus
tttgaagtcttgagtggctctgaaa

SEQ ID NO: 343323 - DNA, 25 bp, Mus musculus
ttttcccggtagtcactaagtcagc

SEQ ID NO: 343324 - DNA, 25 bp, Mus musculus
cccggtagtcactaagtcagcatta

SEQ ID NO: 343325 - DNA, 25 bp, Mus musculus
gttttcctggaccgcccatcactta

SEQ ID NO: 343326 - DNA, 25 bp, Mus musculus
agacactcctggtggcaacagcgaa

SEQ ID NO: 343327 - DNA, 25 bp, Mus musculus
gggtgagacactcctggtggcaaca

SEQ ID NO: 343328 - DNA, 25 bp, Mus musculus
tcacatgccatgtggcgcttcagcg

SEQ ID NO: 343329 - DNA, 25 bp, Mus musculus
cccacgctggtcacatgccatgtgg

SEQ ID NO: 343330 - DNA, 25 bp, Mus musculus
gttaaaggcagtcccacactggccc

SEQ ID NO: 343331 - DNA, 25 bp, Mus musculus
ggaggatcctccctccagcctatta

SEQ ID NO: 343332 - DNA, 25 bp, Mus musculus
cccgcgtcgtgcgtcaggttaaagg

SEQ ID NO: 343333 - DNA, 25 bp, Mus musculus
caatgagagtctcgagaccgttccc

SEQ ID NO: 343334 - DNA, 25 bp, Mus musculus
ttccacctgtccaatgagagtctcg

SEQ ID NO: 343335 - DNA, 25 bp, Mus musculus
tagagacgtcgtctccattccacct

SEQ ID NO: 343336 - DNA, 25 bp, Mus musculus
tccagcctattagagacgtcgtctc

SEQ ID NO: 343337 - DNA, 25 bp, Mus musculus
gcgtcaggttaaaggcagtcccaca

SEQ ID NO: 343338 - DNA, 25 bp, Mus musculus
tcctggtggcaacagcgaacgggca

SEQ ID NO: 343339 - DNA, 25 bp, Mus musculus
ttttatgacaaagtgggtggccctg

SEQ ID NO: 343340 - DNA, 25 bp, Mus musculus
gctccaggtgagcttaaccgccgaa

SEQ ID NO: 343341 - DNA, 25 bp, Mus musculus
gctatggagcactgagttgaaattc

SEQ ID NO: 343342 - DNA, 25 bp, Mus musculus
gcgccctctacagctggtatatata

SEQ ID NO: 343343 - DNA, 25 bp, Mus musculus
attacaagtcgagaaatgcaaacag

SEQ ID NO: 343344 - DNA, 25 bp, Mus musculus
tggcgaatgcggaccttttagagga

SEQ ID NO: 343345 - DNA, 25 bp, Mus musculus
cacgaccagacatggctatggagca

SEQ ID NO: 343346 - DNA, 25 bp, Mus musculus
tgcggaccttttagaggactgaaaa

SEQ ID NO: 343347 - DNA, 25 bp, Mus musculus
cagctggtatatatatggcgaatgc

SEQ ID NO: 343348 - DNA, 25 bp, Mus musculus
tttagggacagaacaattacaagtc

SEQ ID NO: 343349 - DNA, 25 bp, Mus musculus
taccttttgaaaagtctcagccgcc

SEQ ID NO: 343350 - DNA, 25 bp, Mus musculus
gttgaaattccttaagcgccctcta

SEQ ID NO: 343351 - DNA, 25 bp, Mus musculus
cgccattttgaactttagggacaga

SEQ ID NO: 343352 - DNA, 25 bp, Mus musculus
ttgaaaagtctcagccgccattttg

SEQ ID NO: 343353 - DNA, 25 bp, Mus musculus
aagacacctgtgaagaagaaggcga

SEQ ID NO: 343354 - DNA, 25 bp, Mus musculus
cctgtggagaagacacctgtgaaga

SEQ ID NO: 343355 - DNA, 25 bp, Mus musculus
cctgcacctgtggagaagacacctg

SEQ ID NO: 343356 - DNA, 25 bp, Mus musculus
cagggaaccaatcaccacgcagctt

SEQ ID NO: 343357 - DNA, 25 bp, Mus musculus
accttctctgactgtttgtgcttac

SEQ ID NO: 343358 - DNA, 25 bp, Mus musculus
tagaacatgtccgagaccgctcccg

SEQ ID NO: 343359 - DNA, 25 bp, Mus musculus
ttactagtaaagcttagaacatgtc

SEQ ID NO: 343360 - DNA, 25 bp, Mus musculus
gtgcttactttttgctttactagta

SEQ ID NO: 343361 - DNA, 25 bp, Mus musculus
ctgactgtttgtgcttactttttgc

SEQ ID NO: 343362 - DNA, 25 bp, Mus musculus
gggaacaaccttctctgactgtttg

SEQ ID NO: 343363 - DNA, 25 bp, Mus musculus
gcactgggaacaaccttctctgact

SEQ ID NO: 343364 - DNA, 25 bp, Mus musculus
accacgcagcttctctctatataaa

SEQ ID NO: 343365 - DNA, 25 bp, Mus musculus
gcgcacggcgcagggaaccaatcac

SEQ ID NO: 343366 - DNA, 25 bp, Mus musculus
tctctctatataaacccagagcctg

SEQ ID NO: 343367 - DNA, 25 bp, Mus musculus
gaaatgcgtcgctctgattggattc

SEQ ID NO: 343368 - DNA, 25 bp, Mus musculus
acgattggccgattcctgtagtacg

SEQ ID NO: 343369 - DNA, 25 bp, Mus musculus
tggggattgacgattggccgattcc

SEQ ID NO: 343370 - DNA, 25 bp, Mus musculus
tgcatctggggattgacgattggcc

SEQ ID NO: 343371 - DNA, 25 bp, Mus musculus
atttgcggaagtgcatctggggatt

SEQ ID NO: 343372 - DNA, 25 bp, Mus musculus
cattcggaatttgcggaagtgcatc

SEQ ID NO: 343373 - DNA, 25 bp, Mus musculus
tggattctggccagcagcactcagg

SEQ ID NO: 343374 - DNA, 25 bp, Mus musculus
ctgctatttatgctggaaatgcgtc

SEQ ID NO: 343375 - DNA, 25 bp, Mus musculus
ggctgctgctatttatgctggaaat

SEQ ID NO: 343376 - DNA, 25 bp, Mus musculus
acgagccattgcagaggaggagaaa

SEQ ID NO: 343377 - DNA, 25 bp, Mus musculus
ttagtacgagccattgcagaggagg

SEQ ID NO: 343378 - DNA, 25 bp, Mus musculus
cgctctgattggattctggccagca

SEQ ID NO: 343379 - DNA, 25 bp, Mus musculus
cactcaggcgtcattcggaatttgc

SEQ ID NO: 343380 - DNA, 25 bp, Mus musculus
cagcagcactcaggcgtcattcgga

SEQ ID NO: 343381 - DNA, 25 bp, Mus musculus
taatggtgtcactaactggccttca

SEQ ID NO: 343382 - DNA, 25 bp, Mus musculus
tgttgcttgtttctaccatgcccga

SEQ ID NO: 343383 - DNA, 25 bp, Mus musculus
gtttgccacgtccagacattgacgc

SEQ ID NO: 343384 - DNA, 25 bp, Mus musculus
tctaccatgcccgagcctgcgaagt

SEQ ID NO: 343385 - DNA, 25 bp, Mus musculus
tggcaagaacgaagcttctcccaca

SEQ ID NO: 343386 - DNA, 25 bp, Mus musculus
gtcccttatttgcatagaacctcta

SEQ ID NO: 343387 - DNA, 25 bp, Mus musculus
gagttgactacttttgagtccctta

SEQ ID NO: 343388 - DNA, 25 bp, Mus musculus
ctggccttcaaatcagagttgacta

SEQ ID NO: 343389 - DNA, 25 bp, Mus musculus
gctgatgtgtgattggttaaaacta

SEQ ID NO: 343390 - DNA, 25 bp, Mus musculus
ctcgtacatggaagtggaaaagctg

SEQ ID NO: 343391 - DNA, 25 bp, Mus musculus
ggccagacgagaagctacttatact

SEQ ID NO: 343392 - DNA, 25 bp, Mus musculus
cgaagcggtactaaaaggccagacg

SEQ ID NO: 343393 - DNA, 25 bp, Mus musculus
tatctttcctctgcagccaataagg

SEQ ID NO: 343394 - DNA, 25 bp, Mus musculus
tgacgcaagaaggtaggaaattata

SEQ ID NO: 343395 - DNA, 25 bp, Mus musculus
tcgcgcccagcgaataatataaagg

SEQ ID NO: 343396 - DNA, 25 bp, Mus musculus
ctggtcttgtctagttgatgaggtc

SEQ ID NO: 343397 - DNA, 25 bp, Mus musculus
tttcacggaggcaactggtcttgtc

SEQ ID NO: 343398 - DNA, 25 bp, Mus musculus
ctcaggcatggttggtgagaatttc

SEQ ID NO: 343399 - DNA, 25 bp, Mus musculus
cccgaatgcttctcattggtctagg

SEQ ID NO: 343400 - DNA, 25 bp, Mus musculus
tggtctaggaaaaaagacgtcagcc

SEQ ID NO: 343401 - DNA, 25 bp, Mus musculus
tgacggatggcatacgaagtcttgc

SEQ ID NO: 343402 - DNA, 25 bp, Mus musculus
ataggtcctttttcgcgcccagcga

SEQ ID NO: 343403 - DNA, 25 bp, Mus musculus
actgcttaatctgtacaatgtctgg

SEQ ID NO: 343404 - DNA, 25 bp, Mus musculus
caaatgagggatgtgaaagggcacc

SEQ ID NO: 343405 - DNA, 25 bp, Mus musculus
tctggaactttcacggaggcaactg

SEQ ID NO: 343406 - DNA, 25 bp, Mus musculus
cagccaatggcataggtcctttttc

SEQ ID NO: 343407 - DNA, 25 bp, Mus musculus
agggcacctttgattggtttatgac

SEQ ID NO: 343408 - DNA, 25 bp, Mus musculus
aagtcttgcccaatcaacgtgcgcc

SEQ ID NO: 343409 - DNA, 25 bp, Mus musculus
agggcgggaattgaccatggttcac

SEQ ID NO: 343410 - DNA, 25 bp, Mus musculus
aggtccgcattggtattataaaagc

SEQ ID NO: 343411 - DNA, 25 bp, Mus musculus
ttataaaagccaggaaggccgcttg

SEQ ID NO: 343412 - DNA, 25 bp, Mus musculus
ggccgcttgttacagtcactggcta

SEQ ID NO: 343413 - DNA, 25 bp, Mus musculus
cactggctagtgagcttccttccta

SEQ ID NO: 343414 - DNA, 25 bp, Mus musculus
gagcttccttcctagtttgctaaca

SEQ ID NO: 343415 - DNA, 25 bp, Mus musculus
tagtttgctaacatgtctggacgcg

SEQ ID NO: 343416 - DNA, 25 bp, Mus musculus
tagtatctgtttaggcaggtccacc

SEQ ID NO: 343417 - DNA, 25 bp, Mus musculus
gctgggactggctcgatacatagta

SEQ ID NO: 343418 - DNA, 25 bp, Mus musculus
ttcggcggctaaacgtactcattta

SEQ ID NO: 343419 - DNA, 25 bp, Mus musculus
gctgctcttaggtggttttctggaa

SEQ ID NO: 343420 - DNA, 25 bp, Mus musculus
caggttttcaaacaggtccgcattg

SEQ ID NO: 343421 - DNA, 25 bp, Mus musculus
ttctcacttaaaggagctgctctta

SEQ ID NO: 343422 - DNA, 25 bp, Mus musculus
agggccactaccttctcacttaaag

SEQ ID NO: 343423 - DNA, 25 bp, Mus musculus
cctgataggcatctccggggttgaa

SEQ ID NO: 343424 - DNA, 25 bp, Mus musculus
tgcaggcaacctcgcggataactgt

SEQ ID NO: 343425 - DNA, 25 bp, Mus musculus
gcgtccctatcactgggcatgcgca

SEQ ID NO: 343426 - DNA, 25 bp, Mus musculus
gcatgcgcagttgctgataacaaca

SEQ ID NO: 343427 - DNA, 25 bp, Mus musculus
gtcccttcattcaggcttcccattg

SEQ ID NO: 343428 - DNA, 25 bp, Mus musculus
gcgcaggcgcatctgaccaataaga

SEQ ID NO: 343429 - DNA, 25 bp, Mus musculus
ataagagacgtcagtgggcgtgccc

SEQ ID NO: 343430 - DNA, 25 bp, Mus musculus
ggggccgtctgagccgcttacttaa

SEQ ID NO: 343431 - DNA, 25 bp, Mus musculus
gtcaccgtatccagggtggagatca

SEQ ID NO: 343432 - DNA, 25 bp, Mus musculus
ttgaacaaggctaggcctcggcgcg

SEQ ID NO: 343433 - DNA, 25 bp, Mus musculus
tgagaaccggtgtcggggtcaccat

SEQ ID NO: 343434 - DNA, 25 bp, Mus musculus
accatagcgggctctgacctggtca

SEQ ID NO: 343435 - DNA, 25 bp, Mus musculus
ggacctggacgccaaagtcctagga

SEQ ID NO: 343436 - DNA, 25 bp, Mus musculus
gcttacttaagccagcactgctgtg

SEQ ID NO: 343437 - DNA, 25 bp, Mus musculus
ggcgacctgaacgtcactgaaaacc

SEQ ID NO: 343438 - DNA, 25 bp, Mus musculus
taaaatggcgacctgaacgtcactg

SEQ ID NO: 343439 - DNA, 25 bp, Mus musculus
gccgcataaaatggcgacctgaacg

SEQ ID NO: 343440 - DNA, 25 bp, Mus musculus
gaactctctccattcagggcggcgc

SEQ ID NO: 343441 - DNA, 25 bp, Mus musculus
ggcggcgccgcataaaatggcgacc

SEQ ID NO: 343442 - DNA, 25 bp, Mus musculus
agctggcccttcgtgctgagacttt

SEQ ID NO: 343443 - DNA, 25 bp, Mus musculus
gtcactgaaaaccagtttaacaagc

SEQ ID NO: 343444 - DNA, 25 bp, Mus musculus
cccttcgtgctgagactttcgcttt

SEQ ID NO: 343445 - DNA, 25 bp, Mus musculus
tcgtgctgagactttcgctttcagg

SEQ ID NO: 343446 - DNA, 25 bp, Mus musculus
gagactttcgctttcagggagctga

SEQ ID NO: 343447 - DNA, 25 bp, Mus musculus
actttcgctttcagggagctgaaca

SEQ ID NO: 343448 - DNA, 25 bp, Mus musculus
tcagggagctgaacagaactctctc

SEQ ID NO: 343449 - DNA, 25 bp, Mus musculus
gagctgaacagaactctctccattc

SEQ ID NO: 343450 - DNA, 25 bp, Mus musculus
gaacagaactctctccattcagggc

SEQ ID NO: 343451 - DNA, 25 bp, Mus musculus
ccgagcggacaacactgcgttttga

SEQ ID NO: 343452 - DNA, 25 bp, Mus musculus
agctaaaccaggcagtaaacccacg

SEQ ID NO: 343453 - DNA, 25 bp, Mus musculus
tgtagcttagctaaaccaggcagta

SEQ ID NO: 343454 - DNA, 25 bp, Mus musculus
tcgccttcccgtgccaatgttaatt

SEQ ID NO: 343455 - DNA, 25 bp, Mus musculus
aattaagttttgtgtagcttagcta

SEQ ID NO: 343456 - DNA, 25 bp, Mus musculus
ggagacgctgctaaattaagttttg

SEQ ID NO: 343457 - DNA, 25 bp, Mus musculus
gacttagaacaaaagaccggatgtg

SEQ ID NO: 343458 - DNA, 25 bp, Mus musculus
cactgcgttttgatccaaattagga

SEQ ID NO: 343459 - DNA, 25 bp, Mus musculus
agtttaacaagcaccgagcggacaa

SEQ ID NO: 343460 - DNA, 25 bp, Mus musculus
tgatccaaattaggagacgctgcta

SEQ ID NO: 343461 - DNA, 25 bp, Mus musculus
atgtgtgcgccacggatctggacgc

SEQ ID NO: 343462 - DNA, 25 bp, Mus musculus
tcggagatgccagtgtgaaacgttc

SEQ ID NO: 343463 - DNA, 25 bp, Mus musculus
caaaagaccggatgtgtgcgccacg

SEQ ID NO: 343464 - DNA, 25 bp, Mus musculus
gccacggatctggacgctcggagat

SEQ ID NO: 343465 - DNA, 25 bp, Mus musculus
cttggctggctcaggcatcttcaga

SEQ ID NO: 343466 - DNA, 25 bp, Mus musculus
ggctcaggcatcttcagatctcttt

SEQ ID NO: 343467 - DNA, 25 bp, Mus musculus
gacttggctggctcaggcatcttca

SEQ ID NO: 343468 - DNA, 25 bp, Mus musculus
gctggctcaggcatcttcagatctc

SEQ ID NO: 343469 - DNA, 25 bp, Mus musculus
ctgtgaacggtttccttatttgtag

SEQ ID NO: 343470 - DNA, 25 bp, Mus musculus
ctgctgtgaacggtttccttatttg

SEQ ID NO: 343471 - DNA, 25 bp, Mus musculus
agctgctgtgaacggtttccttatt

SEQ ID NO: 343472 - DNA, 25 bp, Mus musculus
tgagctgctgtgaacggtttcctta

SEQ ID NO: 343473 - DNA, 25 bp, Mus musculus
aagtgagctgctgtgaacggtttcc

SEQ ID NO: 343474 - DNA, 25 bp, Mus musculus
ggaagaaaaagaaagtgagctgctg

SEQ ID NO: 343475 - DNA, 25 bp, Mus musculus
tcagatctctttcttaggaagaaaa

SEQ ID NO: 343476 - DNA, 25 bp, Mus musculus
cttcagatctctttcttaggaagaa

SEQ ID NO: 343477 - DNA, 25 bp, Mus musculus
ggcatcttcagatctctttcttagg

SEQ ID NO: 343478 - DNA, 25 bp, Mus musculus
ggctggctcaggcatcttcagatct

SEQ ID NO: 343479 - DNA, 25 bp, Mus musculus
agcactgaagccctggcccacgcgc

SEQ ID NO: 343480 - DNA, 25 bp, Mus musculus
tcccgtactcagcaagcactgaagc

SEQ ID NO: 343481 - DNA, 25 bp, Mus musculus
ggtagagacgccagacactcccgta

SEQ ID NO: 343482 - DNA, 25 bp, Mus musculus
tcatgatgaggaggtagagacgcca

SEQ ID NO: 343483 - DNA, 25 bp, Mus musculus
agaatccaagtcactcatgatgagg

SEQ ID NO: 343484 - DNA, 25 bp, Mus musculus
ggagctcgaagaatccaagtcactc

SEQ ID NO: 343485 - DNA, 25 bp, Mus musculus
ctccaggtacttcggataggcgctg

SEQ ID NO: 343486 - DNA, 25 bp, Mus musculus
ccagagaggtgctccaggtacttcg

SEQ ID NO: 343487 - DNA, 25 bp, Mus musculus
aggacaccgatagctttgccatccc

SEQ ID NO: 343488 - DNA, 25 bp, Mus musculus
cgagagagctggtaggcacgcacct

SEQ ID NO: 343489 - DNA, 25 bp, Mus musculus
ggtaggcacgcaccttgggcatccc

SEQ ID NO: 343490 - DNA, 25 bp, Mus musculus
tgcccggcccttggagaccagcgag

SEQ ID NO: 343491 - DNA, 25 bp, Mus musculus
ccgctggtcaggacaccgatagctt

SEQ ID NO: 343492 - DNA, 25 bp, Mus musculus
gcccttggagaccagcgagagagct

SEQ ID NO: 343493 - DNA, 25 bp, Mus musculus
tcttcttgacgggtgtcttctcggc

SEQ ID NO: 343494 - DNA, 25 bp, Mus musculus
tgcgcccgcccgtttatatagggcg

SEQ ID NO: 343495 - DNA, 25 bp, Mus musculus
cgtgtgaggagagagaactcgagcc

SEQ ID NO: 343496 - DNA, 25 bp, Mus musculus
gccgtgattggtgcgctgtccagcc

SEQ ID NO: 343497 - DNA, 25 bp, Mus musculus
cccgtttatatagggcggagctgcg

SEQ ID NO: 343498 - DNA, 25 bp, Mus musculus
tgtccagcccgcctcgctggcagcc

SEQ ID NO: 343499 - DNA, 25 bp, Mus musculus
cggtctcggacatggcgaagcgtgt

SEQ ID NO: 343500 - DNA, 25 bp, Mus musculus
ggccttcttcttgacgggtgtcttc

SEQ ID NO: 343501 - DNA, 25 bp, Mus musculus
cacctgcggccttgcgggccttctt

SEQ ID NO: 343502 - DNA, 25 bp, Mus musculus
aggttttgcgcttcgcgccacctgc

SEQ ID NO: 343503 - DNA, 25 bp, Mus musculus
tccggaggttttgcgcttcgcgcca

SEQ ID NO: 343504 - DNA, 25 bp, Mus musculus
cgcgcctgccctttttgctttgggc

SEQ ID NO: 343505 - DNA, 25 bp, Mus musculus
ttggccgcgcctgccctttttgctt

SEQ ID NO: 343506 - DNA, 25 bp, Mus musculus
tgcgccgtgattggtgcgctgtcca

SEQ ID NO: 343507 - DNA, 25 bp, Mus musculus
tctgcttctggaaacttcatttgca

SEQ ID NO: 343508 - DNA, 25 bp, Mus musculus
gcccacactgaggttcctgtgtttg

SEQ ID NO: 343509 - DNA, 25 bp, Mus musculus
aggagaagtccgttcccagcccaca

SEQ ID NO: 343510 - DNA, 25 bp, Mus musculus
cgccctataagtaggagaagtccgt

SEQ ID NO: 343511 - DNA, 25 bp, Mus musculus
gaaatccttcattagcataaacgcc

SEQ ID NO: 343512 - DNA, 25 bp, Mus musculus
agctgagactggttcgaaatccttc

SEQ ID NO: 343513 - DNA, 25 bp, Mus musculus
tgattggttacaagtgagctcattg

SEQ ID NO: 343514 - DNA, 25 bp, Mus musculus
cgcggcagcttttatagtaggttcc

SEQ ID NO: 343515 - DNA, 25 bp, Mus musculus
ccaagactgtacagacgcggcagct

SEQ ID NO: 343516 - DNA, 25 bp, Mus musculus
ttggaaatccgaagatgcctgagcc

SEQ ID NO: 343517 - DNA, 25 bp, Mus musculus
ccacgtccagacatagtaatagtgc

SEQ ID NO: 343518 - DNA, 25 bp, Mus musculus
tgagctcattgatatagccaataga

SEQ ID NO: 343519 - DNA, 25 bp, Mus musculus
gtgctgtgtaagtaacagaacagta

SEQ ID NO: 343520 - DNA, 25 bp, Mus musculus
cctgggtagtaaacgctactacttg

SEQ ID NO: 343521 - DNA, 25 bp, Mus musculus
agcaggctcgattaaagcttcggta

SEQ ID NO: 343522 - DNA, 25 bp, Mus musculus
gctgcatggcataattactacccac

SEQ ID NO: 343523 - DNA, 25 bp, Mus musculus
cacttaaactacctagcaggctcga

SEQ ID NO: 343524 - DNA, 25 bp, Mus musculus
agcttcggtaagtgaacaactccta

SEQ ID NO: 343525 - DNA, 25 bp, Mus musculus
cctaggaatttgtgggtggccctga

SEQ ID NO: 343526 - DNA, 25 bp, Mus musculus
gggccttttgttgacagtggaaatc

SEQ ID NO: 343527 - DNA, 25 bp, Mus musculus
acagtggaaatcgtttgttagtcga

SEQ ID NO: 343528 - DNA, 25 bp, Mus musculus
tgttagtcgattaaccgccgaatcc

SEQ ID NO: 343529 - DNA, 25 bp, Mus musculus
cacgtccagacatggttatgacagc

SEQ ID NO: 343530 - DNA, 25 bp, Mus musculus
cagggagacagcaatcgtcccttta

SEQ ID NO: 343531 - DNA, 25 bp, Mus musculus
tcgtccctttaaataggccttctgc

SEQ ID NO: 343532 - DNA, 25 bp, Mus musculus
ggccttctgcggacctggttgaaaa

SEQ ID NO: 343533 - DNA, 25 bp, Mus musculus
ctggttgaaaactagagcgttaggc

SEQ ID NO: 343534 - DNA, 25 bp, Mus musculus
acccaccacataagtataggacaga

SEQ ID NO: 343535 - DNA, 25 bp, Mus musculus
ggcatcctggtgcaaaccaagggca

SEQ ID NO: 343536 - DNA, 25 bp, Mus musculus
tgagcaagggcatcctggtgcaaac

SEQ ID NO: 343537 - DNA, 25 bp, Mus musculus
cctgccaaaaagaaggccgccaaga

SEQ ID NO: 343538 - DNA, 25 bp, Mus musculus
ggagaaggcgcctgccaaaaagaag

SEQ ID NO: 343539 - DNA, 25 bp, Mus musculus
ctcatcatgtctgaggctgctcctg

SEQ ID NO: 343540 - DNA, 25 bp, Mus musculus
gccactagttcctgacttccagaga

SEQ ID NO: 343541 - DNA, 25 bp, Mus musculus
tctatcggcgtactgccactagttc

SEQ ID NO: 343542 - DNA, 25 bp, Mus musculus
gggcccgcgctactctatcggcgta

SEQ ID NO: 343543 - DNA, 25 bp, Mus musculus
ctctatatatacagcgccgggcccg

SEQ ID NO: 343544 - DNA, 25 bp, Mus musculus
gcgcgcctgcgctctatatatacag

SEQ ID NO: 343545 - DNA, 25 bp, Mus musculus
gcaggccgctggagcaccaatcagc

SEQ ID NO: 343546 - DNA, 25 bp, Mus musculus
tgctcagagcttgccaggcaggccg

SEQ ID NO: 343547 - DNA, 25 bp, Mus musculus
cagcgcggctgctcagagcttgcca

SEQ ID NO: 343548 - DNA, 25 bp, Mus musculus
ctgacttccagagactcatcatgtc

SEQ ID NO: 343549 - DNA, 25 bp, Mus musculus
cagcaactttacatgacatcttagg

SEQ ID NO: 343550 - DNA, 25 bp, Mus musculus
ttcattggctgggaaatagcccgtg

SEQ ID NO: 343551 - DNA, 25 bp, Mus musculus
tcgcgcgctacaaattcattggctg

SEQ ID NO: 343552 - DNA, 25 bp, Mus musculus
aactttttgaaagtcgcgcgctaca

SEQ ID NO: 343553 - DNA, 25 bp, Mus musculus
gattggccttgcaactttttgaaag

SEQ ID NO: 343554 - DNA, 25 bp, Mus musculus
gaaacattttgattggccttgcaac

SEQ ID NO: 343555 - DNA, 25 bp, Mus musculus
caggacgaaagaaatcttgccctta

SEQ ID NO: 343556 - DNA, 25 bp, Mus musculus
cttgggaggagatacacaaaagtgc

SEQ ID NO: 343557 - DNA, 25 bp, Mus musculus
ttagtacgagccattcttgggagga

SEQ ID NO: 343558 - DNA, 25 bp, Mus musculus
catgacatcttaggtggctcttaaa

SEQ ID NO: 343559 - DNA, 25 bp, Mus musculus
actgcggtactaagtaaaaatcaga

SEQ ID NO: 343560 - DNA, 25 bp, Mus musculus
tgttgcaacataaactgtaactgcg

SEQ ID NO: 343561 - DNA, 25 bp, Mus musculus
tgtaaagaactactagcttttgttg

SEQ ID NO: 343562 - DNA, 25 bp, Mus musculus
taaaaaccattatgccctctctccg

SEQ ID NO: 343563 - DNA, 25 bp, Mus musculus
gatcttgggaaaaagtgcatagctc

SEQ ID NO: 343564 - DNA, 25 bp, Mus musculus
gatacgtcaatagtagaatttcttg

SEQ ID NO: 343565 - DNA, 25 bp, Mus musculus
tagtagaatttcttgacttgaatct

SEQ ID NO: 343566 - DNA, 25 bp, Mus musculus
cttgacttgaatctatttcccttgg

SEQ ID NO: 343567 - DNA, 25 bp, Mus musculus
cttgaatctatttcccttggccttg

SEQ ID NO: 343568 - DNA, 25 bp, Mus musculus
tccatgatctcggccgccaggtaca

SEQ ID NO: 343569 - DNA, 25 bp, Mus musculus
gggaaaaagtgcatagctcttaaga

SEQ ID NO: 343570 - DNA, 25 bp, Mus musculus
agagccgttagatacgtcaatagta

SEQ ID NO: 343571 - DNA, 25 bp, Mus musculus
ctcttaagagccgttagatacgtca

SEQ ID NO: 343572 - DNA, 25 bp, Mus musculus
catagctcttaagagccgttagata

SEQ ID NO: 343573 - DNA, 25 bp, Mus musculus
agtgcatagctcttaagagccgtta

SEQ ID NO: 343574 - DNA, 25 bp, Mus musculus
cttgggaaaaagtgcatagctctta

SEQ ID NO: 343575 - DNA, 25 bp, Mus musculus
aaaaagtgcatagctcttaagagcc

SEQ ID NO: 343576 - DNA, 25 bp, Mus musculus
gccgttagatacgtcaatagtagaa

SEQ ID NO: 343577 - DNA, 25 bp, Mus musculus
cctattggtcaaaatggtcttcttc

SEQ ID NO: 343578 - DNA, 25 bp, Mus musculus
cgctgtcctattggtcaaaatggtc

SEQ ID NO: 343579 - DNA, 25 bp, Mus musculus
gtcacgaaatatcgctgtcctattg

SEQ ID NO: 343580 - DNA, 25 bp, Mus musculus
tgtgtagtgtcacgaaatatcgctg

SEQ ID NO: 343581 - DNA, 25 bp, Mus musculus
ccacatagattgtgtagtgtcacga

SEQ ID NO: 343582 - DNA, 25 bp, Mus musculus
ctgttaacataccacatagattgtg

SEQ ID NO: 343583 - DNA, 25 bp, Mus musculus
gaaacactgtaacctactgttaaca

SEQ ID NO: 343584 - DNA, 25 bp, Mus musculus
gtccagacattactaaaagttccca

SEQ ID NO: 343585 - DNA, 25 bp, Mus musculus
cactgcttgcagtgtccagacatta

SEQ ID NO: 343586 - DNA, 25 bp, Mus musculus
ggagccttgtcgcactgcttgcagt

SEQ ID NO: 343587 - DNA, 25 bp, Mus musculus
gctttggcgggagccttgtcgcact

SEQ ID NO: 343588 - DNA, 25 bp, Mus musculus
cacgaggaactaactgtaggccggc

SEQ ID NO: 343589 - DNA, 25 bp, Mus musculus
cacggctcacgaggaactaactgta

SEQ ID NO: 343590 - DNA, 25 bp, Mus musculus
ggtcttcttctcttgcccaattgta

SEQ ID NO: 343591 - DNA, 25 bp, Mus musculus
gggctcacaacaaacccaaaggctc

SEQ ID NO: 343592 - DNA, 25 bp, Mus musculus
atgtctttatgaaaagtggaattga

SEQ ID NO: 343593 - DNA, 25 bp, Mus musculus
gccaaatatgtctttatgaaaagtg

SEQ ID NO: 343594 - DNA, 25 bp, Mus musculus
tttgttagccaaatatgtctttatg

SEQ ID NO: 343595 - DNA, 25 bp, Mus musculus
cctaactttgttagccaaatatgtc

SEQ ID NO: 343596 - DNA, 25 bp, Mus musculus
atatatgacctaactttgttagcca

SEQ ID NO: 343597 - DNA, 25 bp, Mus musculus
aagaagttgtaatatatgacctaac

SEQ ID NO: 343598 - DNA, 25 bp, Mus musculus
agccacccacacttttcagaaaaga

SEQ ID NO: 343599 - DNA, 25 bp, Mus musculus
cgtagggctcacaacaaacccaaag

SEQ ID NO: 343600 - DNA, 25 bp, Mus musculus
gctcgtagggctcacaacaaaccca

SEQ ID NO: 343601 - DNA, 25 bp, Mus musculus
gagctcgtagggctcacaacaaacc

SEQ ID NO: 343602 - DNA, 25 bp, Mus musculus
aagtgagctcgtagggctcacaaca

SEQ ID NO: 343603 - DNA, 25 bp, Mus musculus
tccaagtgagctcgtagggctcaca

SEQ ID NO: 343604 - DNA, 25 bp, Mus musculus
cccacacttttcagaaaagaagttg

SEQ ID NO: 343605 - DNA, 25 bp, Mus musculus
ccgcaaggaagcgtaatcgcacgtg

SEQ ID NO: 343606 - DNA, 25 bp, Mus musculus
tgcatccatcagctgcagttcctgc

SEQ ID NO: 343607 - DNA, 25 bp, Mus musculus
cggaggtgttgggaaagcctcagct

SEQ ID NO: 343608 - DNA, 25 bp, Mus musculus
atccctcggggatcttgatgcctgt

SEQ ID NO: 343609 - DNA, 25 bp, Mus musculus
cggtgaacgcatccctcggggatct

SEQ ID NO: 343610 - DNA, 25 bp, Mus musculus
tgcagttcctgcagtacgcggtgaa

SEQ ID NO: 343611 - DNA, 25 bp, Mus musculus
ggcgcttcacttctgcatccatcag

SEQ ID NO: 343612 - DNA, 25 bp, Mus musculus
gtgctgcggcgcttcacttctgcat

SEQ ID NO: 343613 - DNA, 25 bp, Mus musculus
ccaacccatgggtgctgcggcgctt

SEQ ID NO: 343614 - DNA, 25 bp, Mus musculus
gcgcgctgccaacccatgggtgctg

SEQ ID NO: 343615 - DNA, 25 bp, Mus musculus
tgtaggtcaagtccagcacctcacc

SEQ ID NO: 343616 - DNA, 25 bp, Mus musculus
tcacccggaccgcaaggaagcgtaa

SEQ ID NO: 343617 - DNA, 25 bp, Mus musculus
gggactgtaggtcaagtccagcacc

SEQ ID NO: 343618 - DNA, 25 bp, Mus musculus
tgcagtacgcggtgaacgcatccct

SEQ ID NO: 343619 - DNA, 25 bp, Mus musculus
aaattctggctttctattgggtacg

SEQ ID NO: 343620 - DNA, 25 bp, Mus musculus
gcttgctgttcagttgcagaattta

SEQ ID NO: 343621 - DNA, 25 bp, Mus musculus
ctggctttctattgggtacgatata

SEQ ID NO: 343622 - DNA, 25 bp, Mus musculus
gggtacgatatattaaccaatggga

SEQ ID NO: 343623 - DNA, 25 bp, Mus musculus
tacctccagttagtataaatgcttg

SEQ ID NO: 343624 - DNA, 25 bp, Mus musculus
gtactgcccagttgaaagttaacca

SEQ ID NO: 343625 - DNA, 25 bp, Mus musculus
cagttgcagaatttactatatattc

SEQ ID NO: 343626 - DNA, 25 bp, Mus musculus
ctgctttgcctttactgatacttaa

SEQ ID NO: 343627 - DNA, 25 bp, Mus musculus
gcctttactgatacttaaacgcata

SEQ ID NO: 343628 - DNA, 25 bp, Mus musculus
cttaaacgcatacatgtctggacgc

SEQ ID NO: 343629 - DNA, 25 bp, Mus musculus
ccaaggggaagtaatctggcgattg

SEQ ID NO: 343630 - DNA, 25 bp, Mus musculus
taatctggcgattgtctgtactgcc

SEQ ID NO: 343631 - DNA, 25 bp, Mus musculus
gcgattgtctgtactgcccagttga

SEQ ID NO: 343632 - DNA, 25 bp, Mus musculus
tgggagaaacacaaacagaatacct

SEQ ID NO: 343633 - DNA, 25 bp, Mus musculus
cactgaattccttaaaaagctgtgc

SEQ ID NO: 343634 - DNA, 25 bp, Mus musculus
agcttcctactgaaagcttgtaaga

SEQ ID NO: 343635 - DNA, 25 bp, Mus musculus
ggccctcactaatagcttcagcttt

SEQ ID NO: 343636 - DNA, 25 bp, Mus musculus
tggcagcggccctcactaatagctt

SEQ ID NO: 343637 - DNA, 25 bp, Mus musculus
aagctgtgcattttgctccctcacc

SEQ ID NO: 343638 - DNA, 25 bp, Mus musculus
ccgccctgaaatgggctgagcaaaa

SEQ ID NO: 343639 - DNA, 25 bp, Mus musculus
cttttcaggaccactcactgaattc

SEQ ID NO: 343640 - DNA, 25 bp, Mus musculus
taaagcgattttcttaactgttaca

SEQ ID NO: 343641 - DNA, 25 bp, Mus musculus
cgcccacttgaagttctcaaccagg

SEQ ID NO: 343642 - DNA, 25 bp, Mus musculus
ttgaagttctcaaccaggtccgata

SEQ ID NO: 343643 - DNA, 25 bp, Mus musculus
ccaggtccgataagagcctataata

SEQ ID NO: 343644 - DNA, 25 bp, Mus musculus
gagcctataataacacagcgaattc

SEQ ID NO: 343645 - DNA, 25 bp, Mus musculus
acacagcgaattcttagttcaccag

SEQ ID NO: 343646 - DNA, 25 bp, Mus musculus
aatttaactatgtctggtcgcggca

SEQ ID NO: 343647 - DNA, 25 bp, Mus musculus
agcctacaaccctgcagtttgcgca

SEQ ID NO: 343648 - DNA, 25 bp, Mus musculus
ggaccggacgttacctggctcatcc

SEQ ID NO: 343649 - DNA, 25 bp, Mus musculus
gacgttacctggctcatcccactcc

SEQ ID NO: 343650 - DNA, 25 bp, Mus musculus
ctcgcgggaggagaccgggcgcgca

SEQ ID NO: 343651 - DNA, 25 bp, Mus musculus
ctgcgcgctccacccgggacgcggc

SEQ ID NO: 343652 - DNA, 25 bp, Mus musculus
cccgggacgcggcattactgtccgg

SEQ ID NO: 343653 - DNA, 25 bp, Mus musculus
cgggacgcggcattactgtccggcc

SEQ ID NO: 343654 - DNA, 25 bp, Mus musculus
acgcggcattactgtccggccgtgc

SEQ ID NO: 343655 - DNA, 25 bp, Mus musculus
cggcattactgtccggccgtgcgga

SEQ ID NO: 343656 - DNA, 25 bp, Mus musculus
attactgtccggccgtgcggacgtc

SEQ ID NO: 343657 - DNA, 25 bp, Mus musculus
gcacgcgctcgtgctcgcgcatgag

SEQ ID NO: 343658 - DNA, 25 bp, Mus musculus
tacaaccctgcagtttgcgcacgcg

SEQ ID NO: 343659 - DNA, 25 bp, Mus musculus
aggctgcagaaaagagggtgcggcc

SEQ ID NO: 343660 - DNA, 25 bp, Mus musculus
cgggaccggacgttacctggctcat

SEQ ID NO: 343661 - DNA, 25 bp, Mus musculus
tgcagctcgcgcatgaagtccaaca

SEQ ID NO: 343662 - DNA, 25 bp, Mus musculus
ccaccgtgccctcccgggtcaccag

SEQ ID NO: 343663 - DNA, 25 bp, Mus musculus
aaagctaccaccttgttctgcagcg

SEQ ID NO: 343664 - DNA, 25 bp, Mus musculus
cgcaaagtacaaagctaccaccttg

SEQ ID NO: 343665 - DNA, 25 bp, Mus musculus
cggcccgccgcaaagtacaaagcta

SEQ ID NO: 343666 - DNA, 25 bp, Mus musculus
agctccgtgtagaagtcgcagagca

SEQ ID NO: 343667 - DNA, 25 bp, Mus musculus
accagctccgtgtagaagtcgcaga

SEQ ID NO: 343668 - DNA, 25 bp, Mus musculus
tcgctcaccagctccgtgtagaagt

SEQ ID NO: 343669 - DNA, 25 bp, Mus musculus
cacgaaaaccacctcgaagggagcg

SEQ ID NO: 343670 - DNA, 25 bp, Mus musculus
tgccgacacgaaaaccacctcgaag

SEQ ID NO: 343671 - DNA, 25 bp, Mus musculus
gcactgccgtctgccgacacgaaaa

SEQ ID NO: 343672 - DNA, 25 bp, Mus musculus
gtccaacatctcctccgcactgccg

SEQ ID NO: 343673 - DNA, 25 bp, Mus musculus
cgcccagcacgtccaccatcgccac

SEQ ID NO: 343674 - DNA, 25 bp, Mus musculus
gctcgcgcatgaagtccaacatctc

SEQ ID NO: 343675 - DNA, 25 bp, Mus musculus
cagggcgtcaccgggatgacccgtc

SEQ ID NO: 343676 - DNA, 25 bp, Mus musculus
agaacgcaccatccgtgcaggaagc

SEQ ID NO: 343677 - DNA, 25 bp, Mus musculus
aaaggcccagaacgcaccatccgtg

SEQ ID NO: 343678 - DNA, 25 bp, Mus musculus
gtggatgactgaagccatttctcaa

SEQ ID NO: 343679 - DNA, 25 bp, Mus musculus
gacgaacaaggaactcgcgcacgcc

SEQ ID NO: 343680 - DNA, 25 bp, Mus musculus
cgtcgtggatgactgaagccatttc

SEQ ID NO: 343681 - DNA, 25 bp, Mus musculus
gtatccgcaccgcacatctatcggg

SEQ ID NO: 343682 - DNA, 25 bp, Mus musculus
atccgtgcaggaagccgccagggac

SEQ ID NO: 343683 - DNA, 25 bp, Mus musculus
gcgcattcggggaggcaaacccaag

SEQ ID NO: 343684 - DNA, 25 bp, Mus musculus
cgcaggcaacgtcgtggatgactga

SEQ ID NO: 343685 - DNA, 25 bp, Mus musculus
gggcgacgaacaaggaactcgcgca

SEQ ID NO: 343686 - DNA, 25 bp, Mus musculus
cagggaccccgcagcgccatgtttg

SEQ ID NO: 343687 - DNA, 25 bp, Mus musculus
ccgcccggcacggaacaaagcgcgc

SEQ ID NO: 343688 - DNA, 25 bp, Mus musculus
accgcacatctatcgggcgcattcg

SEQ ID NO: 343689 - DNA, 25 bp, Mus musculus
ttgtcctgggaccttacgtctgctg

SEQ ID NO: 343690 - DNA, 25 bp, Mus musculus
gccggcctctcttacaagcggagca

SEQ ID NO: 343691 - DNA, 25 bp, Mus musculus
tagcgggcgttggtatttactcttg

SEQ ID NO: 343692 - DNA, 25 bp, Mus musculus
gcgggctatgctcacctgggtccgc

SEQ ID NO: 343693 - DNA, 25 bp, Mus musculus
atttactcttgcacgggaggacggc

SEQ ID NO: 343694 - DNA, 25 bp, Mus musculus
tttcctgcggagcagcagctttgga

SEQ ID NO: 343695 - DNA, 25 bp, Mus musculus
ccgcgcaggtgcactttcctgcgga

SEQ ID NO: 343696 - DNA, 25 bp, Mus musculus
tcacatgaccgtgcgccgcgcaggt

SEQ ID NO: 343697 - DNA, 25 bp, Mus musculus
atgcaggaggctaggtcacatgacc

SEQ ID NO: 343698 - DNA, 25 bp, Mus musculus
ccttacgtctgctgtctcgggtagc

SEQ ID NO: 343699 - DNA, 25 bp, Mus musculus
gctatcctgactctttgtcctggga

SEQ ID NO: 343700 - DNA, 25 bp, Mus musculus
ggacggcttccaggagctatcctga

SEQ ID NO: 343701 - DNA, 25 bp, Mus musculus
cagcagctttggactgcaggacgcg

SEQ ID NO: 343702 - DNA, 25 bp, Mus musculus
tagctgcctggctagctgcggagat

SEQ ID NO: 343703 - DNA, 25 bp, Mus musculus
gagcgtcctcactacctggtccagg

SEQ ID NO: 343704 - DNA, 25 bp, Mus musculus
gaattgttcctcttcgcttgccgta

SEQ ID NO: 343705 - DNA, 25 bp, Mus musculus
cgtagacctgctcctgcaagatgca

SEQ ID NO: 343706 - DNA, 25 bp, Mus musculus
cggcaggcccgagacaaacacggtc

SEQ ID NO: 343707 - DNA, 25 bp, Mus musculus
caaacacggtcttggtgaagctctg

SEQ ID NO: 343708 - DNA, 25 bp, Mus musculus
tgcggatgcaccacgtacttcttga

SEQ ID NO: 343709 - DNA, 25 bp, Mus musculus
ctgcatcttggtgagaatccgtatc

SEQ ID NO: 343710 - DNA, 25 bp, Mus musculus
atccgtatcttctcgtccaccgagg

SEQ ID NO: 343711 - DNA, 25 bp, Mus musculus
tagcagcggcattctgggacaatcc

SEQ ID NO: 343712 - DNA, 25 bp, Mus musculus
gcggggcaccagcttccaatacctg

SEQ ID NO: 343713 - DNA, 25 bp, Mus musculus
acccggaacttgaggtcaactggca

SEQ ID NO: 343714 - DNA, 25 bp, Mus musculus
ttgccgtagggaccaatcgcttctt

SEQ ID NO: 343715 - DNA, 25 bp, Mus musculus
tcagggtgggagttccaagctcacc

SEQ ID NO: 343716 - DNA, 25 bp, Mus musculus
agctcaccgagagcggcagtgctca

SEQ ID NO: 343717 - DNA, 25 bp, Mus musculus
gtcttcatctctctcgcttcaactt

SEQ ID NO: 343718 - DNA, 25 bp, Mus musculus
agcaagaacgacacgaccaccagtc

SEQ ID NO: 343719 - DNA, 25 bp, Mus musculus
aggttccagagcagcctggactata

SEQ ID NO: 343720 - DNA, 25 bp, Mus musculus
caccagtccttctaacagcagttta

SEQ ID NO: 343721 - DNA, 25 bp, Mus musculus
cgcttcaactttatctctctttctc

SEQ ID NO: 343722 - DNA, 25 bp, Mus musculus
gtccactcttgaccagcaagaacga

SEQ ID NO: 343723 - DNA, 25 bp, Mus musculus
tcccaattgtcacgtccactcttga

SEQ ID NO: 343724 - DNA, 25 bp, Mus musculus
gtcatcttgacacaagcaaggaggc

SEQ ID NO: 343725 - DNA, 25 bp, Mus musculus
tagttgtcttggttagtcatcttga

SEQ ID NO: 343726 - DNA, 25 bp, Mus musculus
gcagcctggactatatagttgtctt

SEQ ID NO: 343727 - DNA, 25 bp, Mus musculus
ttcagcaaacttccgtcttcatctc

SEQ ID NO: 343728 - DNA, 25 bp, Mus musculus
ggcatgaccaatgtcagagacctga

SEQ ID NO: 343729 - DNA, 25 bp, Mus musculus
cagcagtttattcagcaaacttccg

SEQ ID NO: 343730 - DNA, 25 bp, Mus musculus
ctgaggaaggaggattacaggttcc

SEQ ID NO: 343731 - DNA, 25 bp, Mus musculus
actattggggcaagaccgagactga

SEQ ID NO: 343732 - DNA, 25 bp, Mus musculus
gggtctcgcctcacagagagagatg

SEQ ID NO: 343733 - DNA, 25 bp, Mus musculus
gtcaggactattggggcaagaccga

SEQ ID NO: 343734 - DNA, 25 bp, Mus musculus
accgagactgaggtccacgcggaac

SEQ ID NO: 343735 - DNA, 25 bp, Mus musculus
tccacgcggaacgtggggtctcgcc

SEQ ID NO: 343736 - DNA, 25 bp, Mus musculus
ctcacagagagagatggggcgcaca

SEQ ID NO: 343737 - DNA, 25 bp, Mus musculus
tcgcgaaagggtcacagtggcgtct

SEQ ID NO: 343738 - DNA, 25 bp, Mus musculus
cgcgcacttccgcttctgcgaaggg

SEQ ID NO: 343739 - DNA, 25 bp, Mus musculus
agacctgatcgctgagcccgcgacg

SEQ ID NO: 343740 - DNA, 25 bp, Mus musculus
gccggcgcctcacctcagacctgat

SEQ ID NO: 343741 - DNA, 25 bp, Mus musculus
gaaccagagcctggccgcacgagtc

SEQ ID NO: 343742 - DNA, 25 bp, Mus musculus
cggccgcgagaagcccggaaccaga

SEQ ID NO: 343743 - DNA, 25 bp, Mus musculus
tgcagccaaggaacggccgcgagaa

SEQ ID NO: 343744 - DNA, 25 bp, Mus musculus
cacttccgcttctgcgaaggggcgc

SEQ ID NO: 343745 - DNA, 25 bp, Mus musculus
caattttctcatgtgggcgggctca

SEQ ID NO: 343746 - DNA, 25 bp, Mus musculus
gcgcaggtgaacaaggtgaggtcct

SEQ ID NO: 343747 - DNA, 25 bp, Mus musculus
gggaccaaggggcatctcctccagg

SEQ ID NO: 343748 - DNA, 25 bp, Mus musculus
tcttctccttcctggaggcccggga

SEQ ID NO: 343749 - DNA, 25 bp, Mus musculus
ctcctccagggactggcttggctga

SEQ ID NO: 343750 - DNA, 25 bp, Mus musculus
actggcttggctgatgccctccggt

SEQ ID NO: 343751 - DNA, 25 bp, Mus musculus
ggaagtaaccggcacaattttctca

SEQ ID NO: 343752 - DNA, 25 bp, Mus musculus
ttggctgatgccctccggtggcacc

SEQ ID NO: 343753 - DNA, 25 bp, Mus musculus
attttctcatgtgggcgggctcatc

SEQ ID NO: 343754 - DNA, 25 bp, Mus musculus
gcgggctcatctaactgtggaggaa

SEQ ID NO: 343755 - DNA, 25 bp, Mus musculus
taactgtggaggaagcagacgcacg

SEQ ID NO: 343756 - DNA, 25 bp, Mus musculus
agcttggcccgcacgaactgcagca

SEQ ID NO: 343757 - DNA, 25 bp, Mus musculus
ttggcccgcacgaactgcagcacat

SEQ ID NO: 343758 - DNA, 25 bp, Mus musculus
caggagcggaagtaaccggcacaat

SEQ ID NO: 343759 - DNA, 25 bp, Mus musculus
accacgtgacacagggctgcctaga

SEQ ID NO: 343760 - DNA, 25 bp, Mus musculus
gggctgcgagcaaacgccacgccga

SEQ ID NO: 343761 - DNA, 25 bp, Mus musculus
ctggttggctcacctggaccggcag

SEQ ID NO: 343762 - DNA, 25 bp, Mus musculus
acctggaccggcaggcgggacagat

SEQ ID NO: 343763 - DNA, 25 bp, Mus musculus
cgctgcagggctggttggctcacct

SEQ ID NO: 343764 - DNA, 25 bp, Mus musculus
gcgttgtgcctccaacccggaagaa

SEQ ID NO: 343765 - DNA, 25 bp, Mus musculus
gagcaaacgccacgccgagctagca

SEQ ID NO: 343766 - DNA, 25 bp, Mus musculus
tgacacagggctgcctagacccgga

SEQ ID NO: 343767 - DNA, 25 bp, Mus musculus
acgccgagctagcagacccggggtt

SEQ ID NO: 343768 - DNA, 25 bp, Mus musculus
ttggcccgcggcgttgtgcctccaa

SEQ ID NO: 343769 - DNA, 25 bp, Mus musculus
cggcgaccacgtgacacagggctgc

SEQ ID NO: 343770 - DNA, 25 bp, Mus musculus
acagccccaactttgaggcggcggc

SEQ ID NO: 343771 - DNA, 25 bp, Mus musculus
ttgtgcctccaacccggaagaacag

SEQ ID NO: 343772 - DNA, 25 bp, Mus musculus
cgagcctcctgccaaacccgcttgg

SEQ ID NO: 343773 - DNA, 25 bp, Mus musculus
ctagctgatcgtccgagcgtccctg

SEQ ID NO: 343774 - DNA, 25 bp, Mus musculus
tcctccttccctgagtgagtgccgg

SEQ ID NO: 343775 - DNA, 25 bp, Mus musculus
gtcgacgtaagtgacgcgcaggccc

SEQ ID NO: 343776 - DNA, 25 bp, Mus musculus
gtggtgacgcagcacgtcgacgtaa

SEQ ID NO: 343777 - DNA, 25 bp, Mus musculus
ccaggcttcgcagggattggcgctc

SEQ ID NO: 343778 - DNA, 25 bp, Mus musculus
gcagagcccacggaagccttcgaag

SEQ ID NO: 343779 - DNA, 25 bp, Mus musculus
agctcgcgtctccaggctccgatta

SEQ ID NO: 343780 - DNA, 25 bp, Mus musculus
gctgcctgggtacccgagcagctgc

SEQ ID NO: 343781 - DNA, 25 bp, Mus musculus
gtattccaccgggagttcgcgatcg

SEQ ID NO: 343782 - DNA, 25 bp, Mus musculus
agttcgcgatcggaagtgcagctac

SEQ ID NO: 343783 - DNA, 25 bp, Mus musculus
cggtgctcagactgccttgctctac

SEQ ID NO: 343784 - DNA, 25 bp, Mus musculus
tccaggctccgattaggtcaggctc

SEQ ID NO: 343785 - DNA, 25 bp, Mus musculus
ttgctctactgggagaagccgcagc

SEQ ID NO: 343786 - DNA, 25 bp, Mus musculus
caccgccgggcagacatcggggaca

SEQ ID NO: 343787 - DNA, 25 bp, Mus musculus
taagcggggctcgtcgccagcgcct

SEQ ID NO: 343788 - DNA, 25 bp, Mus musculus
ttgtgccagcgtctgccactctgct

SEQ ID NO: 343789 - DNA, 25 bp, Mus musculus
ctgcgaagccctcggctctggtggc

SEQ ID NO: 343790 - DNA, 25 bp, Mus musculus
aggagcttgtgccagcgtctgccac

SEQ ID NO: 343791 - DNA, 25 bp, Mus musculus
acacaggagcttgtgccagcgtctg

SEQ ID NO: 343792 - DNA, 25 bp, Mus musculus
cccgggacacaggagcttgtgccag

SEQ ID NO: 343793 - DNA, 25 bp, Mus musculus
taggagcgacccagacgtctgcgcc

SEQ ID NO: 343794 - DNA, 25 bp, Mus musculus
tgccgtaggagcgacccagacgtct

SEQ ID NO: 343795 - DNA, 25 bp, Mus musculus
atctgctgccgtaggagcgacccag

SEQ ID NO: 343796 - DNA, 25 bp, Mus musculus
gtcagatctgctgccgtaggagcga

SEQ ID NO: 343797 - DNA, 25 bp, Mus musculus
ccctgtgggtcagatctgctgccgt

SEQ ID NO: 343798 - DNA, 25 bp, Mus musculus
caacggggtttgccacggccctgtg

SEQ ID NO: 343799 - DNA, 25 bp, Mus musculus
cgcagacaggcaacggggtttgcca

SEQ ID NO: 343800 - DNA, 25 bp, Mus musculus
tgccactctgctcctcgcctggccg

SEQ ID NO: 343801 - DNA, 25 bp, Mus musculus
tatgtcatcagaacacggagccctc

SEQ ID NO: 343802 - DNA, 25 bp, Mus musculus
acgcctccacttcggtggtcacagg

SEQ ID NO: 343803 - DNA, 25 bp, Mus musculus
gagccttccggcctggtcaaggaca

SEQ ID NO: 343804 - DNA, 25 bp, Mus musculus
gccttagcccagaccagagcgcaga

SEQ ID NO: 343805 - DNA, 25 bp, Mus musculus
ggcgactccggcttctgactatgtc

SEQ ID NO: 343806 - DNA, 25 bp, Mus musculus
gcgggacactcacccaaaggggatc

SEQ ID NO: 343807 - DNA, 25 bp, Mus musculus
gcaaggagaccgcagactgtgcctc

SEQ ID NO: 343808 - DNA, 25 bp, Mus musculus
agatagagaccaatggcgactcggc

SEQ ID NO: 343809 - DNA, 25 bp, Mus musculus
gagaggttctccgaccaattgaagg

SEQ ID NO: 343810 - DNA, 25 bp, Mus musculus
tggcccgagaacaagcctgccaatg

SEQ ID NO: 343811 - DNA, 25 bp, Mus musculus
cgctagggttttccctcgctgccgg

SEQ ID NO: 343812 - DNA, 25 bp, Mus musculus
cccgatccgctttcagccaatgaga

SEQ ID NO: 343813 - DNA, 25 bp, Mus musculus
tgccaatcccgggactcagagtcgc

SEQ ID NO: 343814 - DNA, 25 bp, Mus musculus
gggacagcggctacctctgccaatc

SEQ ID NO: 343815 - DNA, 25 bp, Mus musculus
gcctatctttcaatagcctaaattt

SEQ ID NO: 343816 - DNA, 25 bp, Mus musculus
ggcctcccttgcctatctttcaata

SEQ ID NO: 343817 - DNA, 25 bp, Mus musculus
gaggcctcccttgcctatctttcaa

SEQ ID NO: 343818 - DNA, 25 bp, Mus musculus
atagtagcggaaagcattgatgacc

SEQ ID NO: 343819 - DNA, 25 bp, Mus musculus
ggtgccatagtagcggaaagcattg

SEQ ID NO: 343820 - DNA, 25 bp, Mus musculus
gctggtgccatagtagcggaaagca

SEQ ID NO: 343821 - DNA, 25 bp, Mus musculus
tagcctaaatttctgtcttccaaca

SEQ ID NO: 343822 - DNA, 25 bp, Mus musculus
ttctgctggttatctggaagtgatc

SEQ ID NO: 343823 - DNA, 25 bp, Mus musculus
cctcctctttctgttctatttcttc

SEQ ID NO: 343824 - DNA, 25 bp, Mus musculus
ttatctggaagtgatcgaaactgtc

SEQ ID NO: 343825 - DNA, 25 bp, Mus musculus
aaatttctgtcttccaacactaagc

SEQ ID NO: 343826 - DNA, 25 bp, Mus musculus
tccaacactaagcaaggatttcttc

SEQ ID NO: 343827 - DNA, 25 bp, Mus musculus
caacactaagcaaggatttcttccc

SEQ ID NO: 343828 - DNA, 25 bp, Mus musculus
ttcatacttttgctcctcctctttc

SEQ ID NO: 343829 - DNA, 25 bp, Mus musculus
cacagctgtgagttaggcctctggc

SEQ ID NO: 343830 - DNA, 25 bp, Mus musculus
tgagttaggcctctggctgccgcat

SEQ ID NO: 343831 - DNA, 25 bp, Mus musculus
tctggctgccgcatcttatccgtta

SEQ ID NO: 343832 - DNA, 25 bp, Mus musculus
ctgccgcatcttatccgttagaacg

SEQ ID NO: 343833 - DNA, 25 bp, Mus musculus
attcgctctgcaccgcgatcaaagc

SEQ ID NO: 343834 - DNA, 25 bp, Mus musculus
agccatctcgtctgcggtgcgccag

SEQ ID NO: 343835 - DNA, 25 bp, Mus musculus
atcaaagccatctcgtctgcggtgc

SEQ ID NO: 343836 - DNA, 25 bp, Mus musculus
acccagctgctgaattcgctctgca

SEQ ID NO: 343837 - DNA, 25 bp, Mus musculus
ccaggcgggcatcgcacagctgtga

SEQ ID NO: 343838 - DNA, 25 bp, Mus musculus
ggggagttgacccagctgctgaatt

SEQ ID NO: 343839 - DNA, 25 bp, Mus musculus
ttcgaaacggatatcagcaccctga

SEQ ID NO: 343840 - DNA, 25 bp, Mus musculus
tgcgcccttcgaaacggatatcagc

SEQ ID NO: 343841 - DNA, 25 bp, Mus musculus
aaccatgcgcccttcgaaacggata

SEQ ID NO: 343842 - DNA, 25 bp, Mus musculus
tgcaccgcgatcaaagccatctcgt

SEQ ID NO: 343843 - DNA, 25 bp, Mus musculus
acgcggacaactcgcgctggtggcc

SEQ ID NO: 343844 - DNA, 25 bp, Mus musculus
cgccggagggcagcaaaattcggaa

SEQ ID NO: 343845 - DNA, 25 bp, Mus musculus
cggagggcagcaaaattcggaaagc

SEQ ID NO: 343846 - DNA, 25 bp, Mus musculus
attcggaaagcacgcggacaactcg

SEQ ID NO: 343847 - DNA, 25 bp, Mus musculus
aactcgcgctggtggccagcgctgc

SEQ ID NO: 343848 - DNA, 25 bp, Mus musculus
gccagcgctgcgagcacaggacgcc

SEQ ID NO: 343849 - DNA, 25 bp, Mus musculus
cacaggacgccggagccgcaattag

SEQ ID NO: 343850 - DNA, 25 bp, Mus musculus
ccggagccgcaattagcaggagctg

SEQ ID NO: 343851 - DNA, 25 bp, Mus musculus
gcaattagcaggagctgcaggctgc

SEQ ID NO: 343852 - DNA, 25 bp, Mus musculus
cccagctcagagcaaaggcatcgcg

SEQ ID NO: 343853 - DNA, 25 bp, Mus musculus
gagcaaaggcatcgcgcactcctct

SEQ ID NO: 343854 - DNA, 25 bp, Mus musculus
tcgcgcactcctctcgcccaagatc

SEQ ID NO: 343855 - DNA, 25 bp, Mus musculus
gcaaaattcggaaagcacgcggaca

SEQ ID NO: 343856 - DNA, 25 bp, Mus musculus
tcagagcaaaggcatcgcgcactcc

SEQ ID NO: 343857 - DNA, 25 bp, Mus musculus
gctcaacccgcgactctggtctgtg

SEQ ID NO: 343858 - DNA, 25 bp, Mus musculus
aaggcaaacttttgccactgccctc

SEQ ID NO: 343859 - DNA, 25 bp, Mus musculus
gctcacctcgttctgcaaggcgcat

SEQ ID NO: 343860 - DNA, 25 bp, Mus musculus
caaggcgcatctgggctggttgcat

SEQ ID NO: 343861 - DNA, 25 bp, Mus musculus
aacccgcgactctggtctgtgcaac

SEQ ID NO: 343862 - DNA, 25 bp, Mus musculus
cccagagaatccgaaggcaaacttt

SEQ ID NO: 343863 - DNA, 25 bp, Mus musculus
tgctgccgtgtctcagctaagactc

SEQ ID NO: 343864 - DNA, 25 bp, Mus musculus
taagactcccgtctaggggctcctc

SEQ ID NO: 343865 - DNA, 25 bp, Mus musculus
gtcgctcgtggcctcaggtttctct

SEQ ID NO: 343866 - DNA, 25 bp, Mus musculus
tcaggtttctctcccgctaggcttg

SEQ ID NO: 343867 - DNA, 25 bp, Mus musculus
taggcttgtccagccaccttgctca

SEQ ID NO: 343868 - DNA, 25 bp, Mus musculus
tggttgcatgctgccgtgtctcagc

SEQ ID NO: 343869 - DNA, 25 bp, Mus musculus
agtctctggattacttctctgcatc

SEQ ID NO: 343870 - DNA, 25 bp, Mus musculus
aacccaagcttcagagcttcgcggg

SEQ ID NO: 343871 - DNA, 25 bp, Mus musculus
gtgttttgttcctcgcgtcgccgat

SEQ ID NO: 343872 - DNA, 25 bp, Mus musculus
gaaactcggcgcttccgtgccgaca

SEQ ID NO: 343873 - DNA, 25 bp, Mus musculus
ctcaagaaatgcttctcggtagtta

SEQ ID NO: 343874 - DNA, 25 bp, Mus musculus
tgccgacactgagcacccgatacgt

SEQ ID NO: 343875 - DNA, 25 bp, Mus musculus
cagaggactggaccggtgtttcaac

SEQ ID NO: 343876 - DNA, 25 bp, Mus musculus
cccttccaggtgcagaacaacttcg

SEQ ID NO: 343877 - DNA, 25 bp, Mus musculus
cagcacagttcgtgccacttgagca

SEQ ID NO: 343878 - DNA, 25 bp, Mus musculus
agcgctacgcaaacagcacagttcg

SEQ ID NO: 343879 - DNA, 25 bp, Mus musculus
aggaaccgtggagaagcgctacgca

SEQ ID NO: 343880 - DNA, 25 bp, Mus musculus
acccgatacgtggagaccagagtcc

SEQ ID NO: 343881 - DNA, 25 bp, Mus musculus
gtcttttccggaactgctctttgca

SEQ ID NO: 343882 - DNA, 25 bp, Mus musculus
ggctccaactgctgcctcgctttgt

SEQ ID NO: 343883 - DNA, 25 bp, Mus musculus
cacttgagcaaaatagaggtcggtc

SEQ ID NO: 343884 - DNA, 25 bp, Mus musculus
ccgtgtttttccgtagatgtgatta

SEQ ID NO: 343885 - DNA, 25 bp, Mus musculus
tttctctgcggccacgtcggagaca

SEQ ID NO: 343886 - DNA, 25 bp, Mus musculus
acaccctgagcccacaggtgattgg

SEQ ID NO: 343887 - DNA, 25 bp, Mus musculus
tggatgccaaacaccgacccgttgc

SEQ ID NO: 343888 - DNA, 25 bp, Mus musculus
aggggtgtccaatgaccgcccgcgc

SEQ ID NO: 343889 - DNA, 25 bp, Mus musculus
attgggcatccgcaagcggaggctc

SEQ ID NO: 343890 - DNA, 25 bp, Mus musculus
ggcgtggccaccagagggccttaca

SEQ ID NO: 343891 - DNA, 25 bp, Mus musculus
agaggacttgacacaccggctgccc

SEQ ID NO: 343892 - DNA, 25 bp, Mus musculus
gcctaaggcggccagaggacttgac

SEQ ID NO: 343893 - DNA, 25 bp, Mus musculus
ggcgagaggcgcacaccgcagacac

SEQ ID NO: 343894 - DNA, 25 bp, Mus musculus
caccgagaaagcttgcgggcgcaag

SEQ ID NO: 343895 - DNA, 25 bp, Mus musculus
ggctcctcctgggacggcaccatgt

SEQ ID NO: 343896 - DNA, 25 bp, Mus musculus
cacgtcggagacatccgagggtccc

SEQ ID NO: 343897 - DNA, 25 bp, Mus musculus
ccgtcgggcaccgagaaagcttgcg

SEQ ID NO: 343898 - DNA, 25 bp, Mus musculus
ggcgttctggatgccaaacaccgac

SEQ ID NO: 343899 - DNA, 25 bp, Mus musculus
tagcccaatcctcgttggcgattga

SEQ ID NO: 343900 - DNA, 25 bp, Mus musculus
taaagctacagccaactgccgcgca

SEQ ID NO: 343901 - DNA, 25 bp, Mus musculus
gtccaccgttgcgacgtgcgacgac

SEQ ID NO: 343902 - DNA, 25 bp, Mus musculus
tctctcgcgggcagcatctttctgc

SEQ ID NO: 343903 - DNA, 25 bp, Mus musculus
tctttctgcctggagttcgattccc

SEQ ID NO: 343904 - DNA, 25 bp, Mus musculus
cggaagatttcctgtccggatttcg

SEQ ID NO: 343905 - DNA, 25 bp, Mus musculus
gggcgcccacctagatccaaatagc

SEQ ID NO: 343906 - DNA, 25 bp, Mus musculus
tccggatttcgtgtccgcgacttgc

SEQ ID NO: 343907 - DNA, 25 bp, Mus musculus
aaaagtgaagaattggcgcccagga

SEQ ID NO: 343908 - DNA, 25 bp, Mus musculus
tctccctgagcacctagaagaaaag

SEQ ID NO: 343909 - DNA, 25 bp, Mus musculus
agagttgtggaggtcgttcctgttt

SEQ ID NO: 343910 - DNA, 25 bp, Mus musculus
ggaccgtcgcctccgtcggaagcag

SEQ ID NO: 343911 - DNA, 25 bp, Mus musculus
gcccaagtggcgaacatgacctagc

SEQ ID NO: 343912 - DNA, 25 bp, Mus musculus
acttgaaaagaattggcgctcccga

SEQ ID NO: 343913 - DNA, 25 bp, Mus musculus
ctgtgccaaccgtcttcgctgggct

SEQ ID NO: 343914 - DNA, 25 bp, Mus musculus
gactactactattcatccgggcgga

SEQ ID NO: 343915 - DNA, 25 bp, Mus musculus
ggaaggccatgtgtcttcgccagcc

SEQ ID NO: 343916 - DNA, 25 bp, Mus musculus
cagcaaggactcatgggagcccgcc

SEQ ID NO: 343917 - DNA, 25 bp, Mus musculus
atcaagaagcatcgttcggggaaca

SEQ ID NO: 343918 - DNA, 25 bp, Mus musculus
tccacgtccggtagttcgcacgtcg

SEQ ID NO: 343919 - DNA, 25 bp, Mus musculus
gtgacgtggcacagccgaacactta

SEQ ID NO: 343920 - DNA, 25 bp, Mus musculus
actccagccagcgagacaggtcttc

SEQ ID NO: 343921 - DNA, 25 bp, Mus musculus
gacaggtcttcagcgttttctcctc

SEQ ID NO: 343922 - DNA, 25 bp, Mus musculus
cgcccactcggttgtgagccggaac

SEQ ID NO: 343923 - DNA, 25 bp, Mus musculus
ttttgaccgtcaagtgccaccaccg

SEQ ID NO: 343924 - DNA, 25 bp, Mus musculus
ctcttctcgcgcctgttcggcaaga

SEQ ID NO: 343925 - DNA, 25 bp, Mus musculus
ttcggcaagaagcagatgcgcattt

SEQ ID NO: 343926 - DNA, 25 bp, Mus musculus
cccattggacgagatgcagcaagga

SEQ ID NO: 343927 - DNA, 25 bp, Mus musculus
cccattgcccggtgtacagtgaagc

SEQ ID NO: 343928 - DNA, 25 bp, Mus musculus
ggtttgacttccttgtaccagcgga

SEQ ID NO: 343929 - DNA, 25 bp, Mus musculus
ttccacgccgagtttggggcacaca

SEQ ID NO: 343930 - DNA, 25 bp, Mus musculus
agcgcggcaactgcagctccgtgaa

SEQ ID NO: 343931 - DNA, 25 bp, Mus musculus
caccttgtacttgacgtcgccgatc

SEQ ID NO: 343932 - DNA, 25 bp, Mus musculus
gccaggcgtccacattgagcacatc

SEQ ID NO: 343933 - DNA, 25 bp, Mus musculus
gccgctacctttgcgtgtcccttga

SEQ ID NO: 343934 - DNA, 25 bp, Mus musculus
gctctggtccctctgcatgtttttg

SEQ ID NO: 343935 - DNA, 25 bp, Mus musculus
cgggagcctccacatgaacctggca

SEQ ID NO: 343936 - DNA, 25 bp, Mus musculus
ctggcagccgacgagatcagagatc

SEQ ID NO: 343937 - DNA, 25 bp, Mus musculus
caccggtctcgatccaagctgaagg

SEQ ID NO: 343938 - DNA, 25 bp, Mus musculus
tgccagctccttcttgtcttgaccg

SEQ ID NO: 343939 - DNA, 25 bp, Mus musculus
cgtggccgggtacaagacccattca

SEQ ID NO: 343940 - DNA, 25 bp, Mus musculus
agagatccagagtcgcccgctgtca

SEQ ID NO: 343941 - DNA, 25 bp, Mus musculus
tcgggcgcgcgtagttgaatacgta

SEQ ID NO: 343942 - DNA, 25 bp, Mus musculus
gctgtctgagtcacgctagcgcaca

SEQ ID NO: 343943 - DNA, 25 bp, Mus musculus
ccgcgggttctctaccagagcagtg

SEQ ID NO: 343944 - DNA, 25 bp, Mus musculus
ctcttcaatgggcagcttgtcgatc

SEQ ID NO: 343945 - DNA, 25 bp, Mus musculus
ctcccgtgaaatgcaaaggcgactc

SEQ ID NO: 343946 - DNA, 25 bp, Mus musculus
gcgataaaaacagcacctcccgtga

SEQ ID NO: 343947 - DNA, 25 bp, Mus musculus
cgccacgaacaggacttatctcaca

SEQ ID NO: 343948 - DNA, 25 bp, Mus musculus
ttcctaagaaaactagccactgccg

SEQ ID NO: 343949 - DNA, 25 bp, Mus musculus
gggagcaaggcacgcactcctgctt

SEQ ID NO: 343950 - DNA, 25 bp, Mus musculus
ctgagactcgggcaccgacacagca

SEQ ID NO: 343951 - DNA, 25 bp, Mus musculus
agtgacagccaccagcctgagactc

SEQ ID NO: 343952 - DNA, 25 bp, Mus musculus
cccgcagtgcacagctcaagtgaca

SEQ ID NO: 343953 - DNA, 25 bp, Mus musculus
tcgaagcagcgtaggcgccttccgt

SEQ ID NO: 343954 - DNA, 25 bp, Mus musculus
gcacagctaacctgagcccggagtg

SEQ ID NO: 343955 - DNA, 25 bp, Mus musculus
gccaagaccgaagggccgggctaca

SEQ ID NO: 343956 - DNA, 25 bp, Mus musculus
ctgcaggtcccggacaggatgaaag

SEQ ID NO: 343957 - DNA, 25 bp, Mus musculus
ccgggctacaggatcagaaccagga

SEQ ID NO: 343958 - DNA, 25 bp, Mus musculus
aaagctgagattgagggcggaacct

SEQ ID NO: 343959 - DNA, 25 bp, Mus musculus
ccactcgggactagagagcgagcta

SEQ ID NO: 343960 - DNA, 25 bp, Mus musculus
gagcgagctacaggcagcaacctag

SEQ ID NO: 343961 - DNA, 25 bp, Mus musculus
aacctagcggagaccggcccaactg

SEQ ID NO: 343962 - DNA, 25 bp, Mus musculus
cccaactgggcgagcgtacggccat

SEQ ID NO: 343963 - DNA, 25 bp, Mus musculus
ttcttcactgtcaacgcctgtctca

SEQ ID NO: 343964 - DNA, 25 bp, Mus musculus
aggcgaaggcttctccgggttccag

SEQ ID NO: 343965 - DNA, 25 bp, Mus musculus
gatccgcgagcaacggggttctcag

SEQ ID NO: 343966 - DNA, 25 bp, Mus musculus
tagccgctcatcctgcgtctggatc

SEQ ID NO: 343967 - DNA, 25 bp, Mus musculus
ccctggctttgtgttgttaatgagg

SEQ ID NO: 343968 - DNA, 25 bp, Mus musculus
ggttctcagcttttctagccgctca

SEQ ID NO: 343969 - DNA, 25 bp, Mus musculus
gccctgtcgcaggacttctccaagt

SEQ ID NO: 343970 - DNA, 25 bp, Mus musculus
gacgcacggggactgagccttgcct

SEQ ID NO: 343971 - DNA, 25 bp, Mus musculus
ttacgcccgagaccgcatctgagac

SEQ ID NO: 343972 - DNA, 25 bp, Mus musculus
ttctccaagtcagtgtctctggcca

SEQ ID NO: 343973 - DNA, 25 bp, Mus musculus
ccgatagctactgggagaaagttcc

SEQ ID NO: 343974 - DNA, 25 bp, Mus musculus
ggtagatagtgtcaccgcctgcttc

SEQ ID NO: 343975 - DNA, 25 bp, Mus musculus
cgcgttgggtagatagtgtcaccgc

SEQ ID NO: 343976 - DNA, 25 bp, Mus musculus
tccaagagtctaggtcagtcctccg

SEQ ID NO: 343977 - DNA, 25 bp, Mus musculus
caactgggacatcgcgtcgcgtgac

SEQ ID NO: 343978 - DNA, 25 bp, Mus musculus
ttgcctgcaagtctccaagagtcta

SEQ ID NO: 343979 - DNA, 25 bp, Mus musculus
ccgaggtaagagcaactgggacatc

SEQ ID NO: 343980 - DNA, 25 bp, Mus musculus
ggccctgtgcttcaacccagcaggg

SEQ ID NO: 343981 - DNA, 25 bp, Mus musculus
cccatagccactttggggcgcgttg

SEQ ID NO: 343982 - DNA, 25 bp, Mus musculus
tctctggccacttggcaggaacccg

SEQ ID NO: 343983 - DNA, 25 bp, Mus musculus
ctcactgtcaagagggcaaactgca

SEQ ID NO: 343984 - DNA, 25 bp, Mus musculus
cagccgccatggtggccaaggatta

SEQ ID NO: 343985 - DNA, 25 bp, Mus musculus
gtgacatctcaaagggcaggcccgg

SEQ ID NO: 343986 - DNA, 25 bp, Mus musculus
cgcctgaaattagcggtgacatctc

SEQ ID NO: 343987 - DNA, 25 bp, Mus musculus
taggcgtcaggtccactctgcaaga

SEQ ID NO: 343988 - DNA, 25 bp, Mus musculus
tccctcagtgggcatggcttaaagc

SEQ ID NO: 343989 - DNA, 25 bp, Mus musculus
tctttccttccgagcgactggcaga

SEQ ID NO: 343990 - DNA, 25 bp, Mus musculus
aagttcgcacctggcgctccttgga

SEQ ID NO: 343991 - DNA, 25 bp, Mus musculus
aagcagctgtaggtgttcgcatcgc

SEQ ID NO: 343992 - DNA, 25 bp, Mus musculus
ccagtctctgtctagagcctgcaaa

SEQ ID NO: 343993 - DNA, 25 bp, Mus musculus
tacccgctgccctgttaggaaggcc

SEQ ID NO: 343994 - DNA, 25 bp, Mus musculus
agagagagcctcgtaaagcaatgtc

SEQ ID NO: 343995 - DNA, 25 bp, Mus musculus
gctcgggaaccgcagatctttgatg

SEQ ID NO: 343996 - DNA, 25 bp, Mus musculus
acgccttctctgtgggtcctctatc

SEQ ID NO: 343997 - DNA, 25 bp, Mus musculus
agcgcttccggagcttgagtcctcc

SEQ ID NO: 343998 - DNA, 25 bp, Mus musculus
tacggccacgagcagcctcagcaaa

SEQ ID NO: 343999 - DNA, 25 bp, Mus musculus
cgctctgcccaaaggcgccgaagag

SEQ ID NO: 344000 - DNA, 25 bp, Mus musculus
gacgacgggatgaagccagcgcttc

SEQ ID NO: 344001 - DNA, 25 bp, Mus musculus
cccttcgacggacgcgagctggaaa

SEQ ID NO: 344002 - DNA, 25 bp, Mus musculus
tttctattggtagagcgggtccgcc

SEQ ID NO: 344003 - DNA, 25 bp, Mus musculus
ggcgggctctgcatttctattggta

SEQ ID NO: 344004 - DNA, 25 bp, Mus musculus
ggcactctcctcttttggcgggctc

SEQ ID NO: 344005 - DNA, 25 bp, Mus musculus
cctcactctgaagcgatggcgtcga

SEQ ID NO: 344006 - DNA, 25 bp, Mus musculus
gccttttaggcggagttttcagatc

SEQ ID NO: 344007 - DNA, 25 bp, Mus musculus
tccgagacacgtaaacacgcacgca

SEQ ID NO: 344008 - DNA, 25 bp, Mus musculus
ccaggaatccgcagaatgctgccaa

SEQ ID NO: 344009 - DNA, 25 bp, Mus musculus
ctcctggaacggtctctctgcagtc

SEQ ID NO: 344010 - DNA, 25 bp, Mus musculus
tgagtcctccctacaaaatggcggc

SEQ ID NO: 344011 - DNA, 25 bp, Mus musculus
tttgtttacgcagctagagggaacc

SEQ ID NO: 344012 - DNA, 25 bp, Mus musculus
cgcaagtcgcgcctggcttctttgg

SEQ ID NO: 344013 - DNA, 25 bp, Mus musculus
cctggcttctttggcgggcgttgcc

SEQ ID NO: 344014 - DNA, 25 bp, Mus musculus
tggctagtttgtttacgcagctaga

SEQ ID NO: 344015 - DNA, 25 bp, Mus musculus
tttacgcagctagagggaaccggtg

SEQ ID NO: 344016 - DNA, 25 bp, Mus musculus
tagccggccagtgcttgcgcaggtc

SEQ ID NO: 344017 - DNA, 25 bp, Mus musculus
cggccagtgcttgcgcaggtccctg

SEQ ID NO: 344018 - DNA, 25 bp, Mus musculus
tccctgcggtgtcgtgcgcgtagtt

SEQ ID NO: 344019 - DNA, 25 bp, Mus musculus
tgtcgtgcgcgtagttggcgtcgtt

SEQ ID NO: 344020 - DNA, 25 bp, Mus musculus
ttggcccgtggggactctttatcgc

SEQ ID NO: 344021 - DNA, 25 bp, Mus musculus
tggggactctttatcgcctgctagg

SEQ ID NO: 344022 - DNA, 25 bp, Mus musculus
gggactctttatcgcctgctaggct

SEQ ID NO: 344023 - DNA, 25 bp, Mus musculus
tctttatcgcctgctaggcttggcg

SEQ ID NO: 344024 - DNA, 25 bp, Mus musculus
cgggtggctagtttgtttacgcagc

SEQ ID NO: 344025 - DNA, 25 bp, Mus musculus
cagctcgctcaggtcacttgtgtac

SEQ ID NO: 344026 - DNA, 25 bp, Mus musculus
cgtgatcaccgccaaccttggggag

SEQ ID NO: 344027 - DNA, 25 bp, Mus musculus
tcttcgtgatcaccgccaaccttgg

SEQ ID NO: 344028 - DNA, 25 bp, Mus musculus
cgtctgcggtttcttcgtgatcacc

SEQ ID NO: 344029 - DNA, 25 bp, Mus musculus
tctagatccctctccgggggcgtct

SEQ ID NO: 344030 - DNA, 25 bp, Mus musculus
ggtccgttcgttgatgccggcctcc

SEQ ID NO: 344031 - DNA, 25 bp, Mus musculus
acatgctggcgggtccgttcgttga

SEQ ID NO: 344032 - DNA, 25 bp, Mus musculus
caatcacagtgggacatgctggcgg

SEQ ID NO: 344033 - DNA, 25 bp, Mus musculus
ccgctgctcaacaaacgctatgctg

SEQ ID NO: 344034 - DNA, 25 bp, Mus musculus
aaagttacagcccagcgagtccccg

SEQ ID NO: 344035 - DNA, 25 bp, Mus musculus
aacgctatgctgattggttgccggg

SEQ ID NO: 344036 - DNA, 25 bp, Mus musculus
gctccaacaccacggtccgcgctgg

SEQ ID NO: 344037 - DNA, 25 bp, Mus musculus
ggccagccgagccaatcacagtggg

SEQ ID NO: 344038 - DNA, 25 bp, Mus musculus
gtcacttgtgtacccagcttgctgc

SEQ ID NO: 344039 - DNA, 25 bp, Mus musculus
gagcgggcgcgcactcgactctctg

SEQ ID NO: 344040 - DNA, 25 bp, Mus musculus
aatgctgggaatgtgagtcaaggcc

SEQ ID NO: 344041 - DNA, 25 bp, Mus musculus
tgcccgcgctccaccgtctcgcgct

SEQ ID NO: 344042 - DNA, 25 bp, Mus musculus
cgtctcgcgctcctgatcgctccag

SEQ ID NO: 344043 - DNA, 25 bp, Mus musculus
ccacgcgaggttgtaaaaatccatg

SEQ ID NO: 344044 - DNA, 25 bp, Mus musculus
taaaaatccatgtgggaccgcgccg

SEQ ID NO: 344045 - DNA, 25 bp, Mus musculus
cgagcatcgctaaggtgagacgccg

SEQ ID NO: 344046 - DNA, 25 bp, Mus musculus
atcgctaaggtgagacgccgacgct

SEQ ID NO: 344047 - DNA, 25 bp, Mus musculus
tgaggggagacgcagccgccttcct

SEQ ID NO: 344048 - DNA, 25 bp, Mus musculus
ccttcctcggggctatttcaggcgg

SEQ ID NO: 344049 - DNA, 25 bp, Mus musculus
ggcctaagggcggatttgcctctct

SEQ ID NO: 344050 - DNA, 25 bp, Mus musculus
ctaagggcggatttgcctctctctc

SEQ ID NO: 344051 - DNA, 25 bp, Mus musculus
cccggattggaacaagtgcacagtt

SEQ ID NO: 344052 - DNA, 25 bp, Mus musculus
attggaacaagtgcacagttcctca

SEQ ID NO: 344053 - DNA, 25 bp, Mus musculus
caccgcggagctctgcgccctccgt

SEQ ID NO: 344054 - DNA, 25 bp, Mus musculus
tctggagttgagtcgccaccgcgga

SEQ ID NO: 344055 - DNA, 25 bp, Mus musculus
gacctctggagttgagtcgccaccg

SEQ ID NO: 344056 - DNA, 25 bp, Mus musculus
catggacctctggagttgagtcgcc

SEQ ID NO: 344057 - DNA, 25 bp, Mus musculus
ccgccatggacctctggagttgagt

SEQ ID NO: 344058 - DNA, 25 bp, Mus musculus
tgcattgccatctccttccgcggcc

SEQ ID NO: 344059 - DNA, 25 bp, Mus musculus
tgtgcggccgctgcattgccatctc

SEQ ID NO: 344060 - DNA, 25 bp, Mus musculus
attgtgcggccgctgcattgccatc

SEQ ID NO: 344061 - DNA, 25 bp, Mus musculus
tccgccgtccggagtccggattgtg

SEQ ID NO: 344062 - DNA, 25 bp, Mus musculus
gttgctgcaggctccgaggcaccgc

SEQ ID NO: 344063 - DNA, 25 bp, Mus musculus
aaagttgctgcaggctccgaggcac

SEQ ID NO: 344064 - DNA, 25 bp, Mus musculus
cttggaaagttgctgcaggctccga

SEQ ID NO: 344065 - DNA, 25 bp, Mus musculus
ggcaccgcatcgcttggaaagttgc

SEQ ID NO: 344066 - DNA, 25 bp, Mus musculus
ccagtcagtctgtggggcaccgcat

SEQ ID NO: 344067 - DNA, 25 bp, Mus musculus
aacgctcatttcaccggcacgcgga

SEQ ID NO: 344068 - DNA, 25 bp, Mus musculus
gacactgcctctgcgtccttggaga

SEQ ID NO: 344069 - DNA, 25 bp, Mus musculus
tccaggtcgagtaacccgagcgttc

SEQ ID NO: 344070 - DNA, 25 bp, Mus musculus
ggttcctgggcacatttccacgcta

SEQ ID NO: 344071 - DNA, 25 bp, Mus musculus
ccttggagactttttgcaccggcta

SEQ ID NO: 344072 - DNA, 25 bp, Mus musculus
gccggcagggactcctatcttttcg

SEQ ID NO: 344073 - DNA, 25 bp, Mus musculus
gctaaactccaatatcgccggcagg

SEQ ID NO: 344074 - DNA, 25 bp, Mus musculus
taactgcctggagaaagctaaactc

SEQ ID NO: 344075 - DNA, 25 bp, Mus musculus
tgcgcacggacgctccctacttttt

SEQ ID NO: 344076 - DNA, 25 bp, Mus musculus
cctcgccatgaaggtaagtgttctg

SEQ ID NO: 344077 - DNA, 25 bp, Mus musculus
ttcgcttgaattcctcggccgcctt

SEQ ID NO: 344078 - DNA, 25 bp, Mus musculus
tccgcagccctgctttggattgtcc

SEQ ID NO: 344079 - DNA, 25 bp, Mus musculus
accgccgtcgctgatggacgttaga

SEQ ID NO: 344080 - DNA, 25 bp, Mus musculus
gcgcgcctttttacctcgagaactg

SEQ ID NO: 344081 - DNA, 25 bp, Mus musculus
ttcacgtacgcggtgagcgcagctg

SEQ ID NO: 344082 - DNA, 25 bp, Mus musculus
ccacgctaagggttcctatgagagc

SEQ ID NO: 344083 - DNA, 25 bp, Mus musculus
cgaatccacgctaagggttcctatg

SEQ ID NO: 344084 - DNA, 25 bp, Mus musculus
ctagagaaagggaacgaatccacgc

SEQ ID NO: 344085 - DNA, 25 bp, Mus musculus
ttcgtggacgctagagaaagggaac

SEQ ID NO: 344086 - DNA, 25 bp, Mus musculus
cgccaaggagttcgtggacgctaga

SEQ ID NO: 344087 - DNA, 25 bp, Mus musculus
acgccatgagccgagcatgccggga

SEQ ID NO: 344088 - DNA, 25 bp, Mus musculus
caacatcgactatggctaccgcttc

SEQ ID NO: 344089 - DNA, 25 bp, Mus musculus
agacggccttcacgtacgcggtgag

SEQ ID NO: 344090 - DNA, 25 bp, Mus musculus
tggtgaacgccatgagccgagcatg

SEQ ID NO: 344091 - DNA, 25 bp, Mus musculus
cggctgcggagacaacatcgactat

SEQ ID NO: 344092 - DNA, 25 bp, Mus musculus
tggctaccgcttcgccaaggagttc

SEQ ID NO: 344093 - DNA, 25 bp, Mus musculus
tcgcaggcagccgagagacggcctt

SEQ ID NO: 344094 - DNA, 25 bp, Mus musculus
gcggagacaacatcgactatggcta

SEQ ID NO: 344095 - DNA, 25 bp, Mus musculus
aggcagaagtctggaagaagccagc

SEQ ID NO: 344096 - DNA, 25 bp, Mus musculus
cagtagttgatctggtcaggagccc

SEQ ID NO: 344097 - DNA, 25 bp, Mus musculus
ccacactttgccagtagttgatctg

SEQ ID NO: 344098 - DNA, 25 bp, Mus musculus
agttctttacaactccgcagtccgc

SEQ ID NO: 344099 - DNA, 25 bp, Mus musculus
ggccgctgagttctttacaactccg

SEQ ID NO: 344100 - DNA, 25 bp, Mus musculus
actcaagtgtccttggccgccacgg

SEQ ID NO: 344101 - DNA, 25 bp, Mus musculus
gcggagactcgcaaactcaagtgtc

SEQ ID NO: 344102 - DNA, 25 bp, Mus musculus
gaaagtccaacctgaccggcagaca

SEQ ID NO: 344103 - DNA, 25 bp, Mus musculus
gcaaacgcagcggaaagtccaacct

SEQ ID NO: 344104 - DNA, 25 bp, Mus musculus
tgctacacggtgcacccagggacca

SEQ ID NO: 344105 - DNA, 25 bp, Mus musculus
tccggggtccgcactgctacacggt

SEQ ID NO: 344106 - DNA, 25 bp, Mus musculus
ccggggtgctttcaagcctactgaa

SEQ ID NO: 344107 - DNA, 25 bp, Mus musculus
gcacagctaccgctggcgttccgga

SEQ ID NO: 344108 - DNA, 25 bp, Mus musculus
gaccggctcgtatagcggcagaacg

SEQ ID NO: 344109 - DNA, 25 bp, Mus musculus
cggtccggatacaacgcgcttttgt

SEQ ID NO: 344110 - DNA, 25 bp, Mus musculus
cgaatggtgagtgagagccttaccc

SEQ ID NO: 344111 - DNA, 25 bp, Mus musculus
tggtttacatctcgaatggtgagtg

SEQ ID NO: 344112 - DNA, 25 bp, Mus musculus
agccgaggcgcagcccagaaggtcc

SEQ ID NO: 344113 - DNA, 25 bp, Mus musculus
tgaagcctcctggtacagccaattt

SEQ ID NO: 344114 - DNA, 25 bp, Mus musculus
tgtcgctaggaagcaggcaaccgga

SEQ ID NO: 344115 - DNA, 25 bp, Mus musculus
gtccggtcttctctgtcgctaggaa

SEQ ID NO: 344116 - DNA, 25 bp, Mus musculus
gacaacaggggcgtccggtcttctc

SEQ ID NO: 344117 - DNA, 25 bp, Mus musculus
ccaattttccgattgtgggtttgcg

SEQ ID NO: 344118 - DNA, 25 bp, Mus musculus
ttgtgggtttgcgatagtgatcccg

SEQ ID NO: 344119 - DNA, 25 bp, Mus musculus
cttaacccgggaatgacagagacgc

SEQ ID NO: 344120 - DNA, 25 bp, Mus musculus
ctgactcgccgggtcctgagcttgg

SEQ ID NO: 344121 - DNA, 25 bp, Mus musculus
cagagacgctaacccggtccggata

SEQ ID NO: 344122 - DNA, 25 bp, Mus musculus
gcaaccggagggaagatggtttaca

SEQ ID NO: 344123 - DNA, 25 bp, Mus musculus
gcggccattttgactgtgggcagcc

SEQ ID NO: 344124 - DNA, 25 bp, Mus musculus
ttccttgtgcaaagtagcgcggtgc

SEQ ID NO: 344125 - DNA, 25 bp, Mus musculus
ccctcccataggttccttgtgcaaa

SEQ ID NO: 344126 - DNA, 25 bp, Mus musculus
ttagaccactgctagcctgggcctc

SEQ ID NO: 344127 - DNA, 25 bp, Mus musculus
gctggccttggttagaccactgcta

SEQ ID NO: 344128 - DNA, 25 bp, Mus musculus
agcggcccatcgtacccgcgttggt

SEQ ID NO: 344129 - DNA, 25 bp, Mus musculus
gtgaagcggcccatcgtacccgcgt

SEQ ID NO: 344130 - DNA, 25 bp, Mus musculus
ctgtggcgtcggtgtcccagagccc

SEQ ID NO: 344131 - DNA, 25 bp, Mus musculus
ctcagctataagacgtcacgattta

SEQ ID NO: 344132 - DNA, 25 bp, Mus musculus
ttctcctctgactgctgtggcgtcg

SEQ ID NO: 344133 - DNA, 25 bp, Mus musculus
gcctccaggtctcagctataagacg

SEQ ID NO: 344134 - DNA, 25 bp, Mus musculus
caatggttctcctctgactgctgtg

SEQ ID NO: 344135 - DNA, 25 bp, Mus musculus
gcctgcgcaatggttctcctctgac

SEQ ID NO: 344136 - DNA, 25 bp, Mus musculus
gcagagatgacccaagccgagaagg

SEQ ID NO: 344137 - DNA, 25 bp, Mus musculus
acgccagttaaagagcagcgggcga

SEQ ID NO: 344138 - DNA, 25 bp, Mus musculus
gctctcgaggcagggcgctcctgca

SEQ ID NO: 344139 - DNA, 25 bp, Mus musculus
gatgcagccaagatcagcaacacta

SEQ ID NO: 344140 - DNA, 25 bp, Mus musculus
agcaacactagcaacatggcccggc

SEQ ID NO: 344141 - DNA, 25 bp, Mus musculus
gccagaggtccagggtcctcttatc

SEQ ID NO: 344142 - DNA, 25 bp, Mus musculus
gtccagggtcctcttatccaggcgc

SEQ ID NO: 344143 - DNA, 25 bp, Mus musculus
cgctggcctggtcccaagacagtaa

SEQ ID NO: 344144 - DNA, 25 bp, Mus musculus
cccaagacagtaaagtggccgcctt

SEQ ID NO: 344145 - DNA, 25 bp, Mus musculus
actcaggcccgggaggactgaactc

SEQ ID NO: 344146 - DNA, 25 bp, Mus musculus
gaggactgaactcccagcagggcgc

SEQ ID NO: 344147 - DNA, 25 bp, Mus musculus
cgcctggagccagacggagcagctc

SEQ ID NO: 344148 - DNA, 25 bp, Mus musculus
gccagacggagcagctcgcggcact

SEQ ID NO: 344149 - DNA, 25 bp, Mus musculus
aggatcagcggccactgccttctcg

SEQ ID NO: 344150 - DNA, 25 bp, Mus musculus
gcgctcctgcacgatgcagccaaga

SEQ ID NO: 344151 - DNA, 25 bp, Mus musculus
gccgtcctctctgttgccattgctt

SEQ ID NO: 344152 - DNA, 25 bp, Mus musculus
aggctcctcctcgatgacaggaatg

SEQ ID NO: 344153 - DNA, 25 bp, Mus musculus
aatggatgggtcatcacccgtgatg

SEQ ID NO: 344154 - DNA, 25 bp, Mus musculus
gcacgaaggctccacaggtcacggt

SEQ ID NO: 344155 - DNA, 25 bp, Mus musculus
cccacggcgtaatggcgcacgtgta

SEQ ID NO: 344156 - DNA, 25 bp, Mus musculus
ttgccattgcttccgcgcatgagtg

SEQ ID NO: 344157 - DNA, 25 bp, Mus musculus
cggtgcatcgtcaaaatgagggtca

SEQ ID NO: 344158 - DNA, 25 bp, Mus musculus
ctcatggaaaagagcgtccgtcttc

SEQ ID NO: 344159 - DNA, 25 bp, Mus musculus
tgctcgcatagccactgtccatctg

SEQ ID NO: 344160 - DNA, 25 bp, Mus musculus
ggcttcgccgtccttaggcctcaaa

SEQ ID NO: 344161 - DNA, 25 bp, Mus musculus
actgatgccatgctccggaggagtc

SEQ ID NO: 344162 - DNA, 25 bp, Mus musculus
cctcaaagcaggtggagactccgga

SEQ ID NO: 344163 - DNA, 25 bp, Mus musculus
cgtccgtcttctcgtcgatgctgta

SEQ ID NO: 344164 - DNA, 25 bp, Mus musculus
cgcacggccttcaggaggacaatca

SEQ ID NO: 344165 - DNA, 25 bp, Mus musculus
ccaaagccaaccagtgggtgagtga

SEQ ID NO: 344166 - DNA, 25 bp, Mus musculus
gggaactttgcctggatggcacttt

SEQ ID NO: 344167 - DNA, 25 bp, Mus musculus
gctcggctctgagatccaagatgga

SEQ ID NO: 344168 - DNA, 25 bp, Mus musculus
tcgagctgagcaagagatgagtctg

SEQ ID NO: 344169 - DNA, 25 bp, Mus musculus
agtctggcggccttgaaacaacacg

SEQ ID NO: 344170 - DNA, 25 bp, Mus musculus
gcatcgcagacctcacgggccaggt

SEQ ID NO: 344171 - DNA, 25 bp, Mus musculus
gccaggtcgccctgtacactttctg

SEQ ID NO: 344172 - DNA, 25 bp, Mus musculus
gatggcactttcctgttccacagtc

SEQ ID NO: 344173 - DNA, 25 bp, Mus musculus
ttcattcagggaaccggttcacacc

SEQ ID NO: 344174 - DNA, 25 bp, Mus musculus
gctgaagtaccacgctcggcaaggc

SEQ ID NO: 344175 - DNA, 25 bp, Mus musculus
agaaaatcggaaccagggctcctgg

SEQ ID NO: 344176 - DNA, 25 bp, Mus musculus
gaggtctccggactatcagctcacg

SEQ ID NO: 344177 - DNA, 25 bp, Mus musculus
cccggcaggagtcaggttcattcag

SEQ ID NO: 344178 - DNA, 25 bp, Mus musculus
gattctgcgccggaacccgagttag

SEQ ID NO: 344179 - DNA, 25 bp, Mus musculus
tcctaaggagtcttaacgcgcccgc

SEQ ID NO: 344180 - DNA, 25 bp, Mus musculus
agccagatcagcagaagctccaggc

SEQ ID NO: 344181 - DNA, 25 bp, Mus musculus
agtccactaaatgcggggcgtggcc

SEQ ID NO: 344182 - DNA, 25 bp, Mus musculus
gtcactgctggtcgcttcctgagcc

SEQ ID NO: 344183 - DNA, 25 bp, Mus musculus
tgtgtctctgtcctcagcgttctcg

SEQ ID NO: 344184 - DNA, 25 bp, Mus musculus
tggaaggttaccataagccagatca

SEQ ID NO: 344185 - DNA, 25 bp, Mus musculus
gcgacttccgagagtccactaaatg

SEQ ID NO: 344186 - DNA, 25 bp, Mus musculus
cctgaaggacacagccaatcgcctg

SEQ ID NO: 344187 - DNA, 25 bp, Mus musculus
caccaccgcggcaggctcagggtga

SEQ ID NO: 344188 - DNA, 25 bp, Mus musculus
ctggctccgtgtcgcgtagcacgat

SEQ ID NO: 344189 - DNA, 25 bp, Mus musculus
tcgcgtagcacgatgtcgccacgag

SEQ ID NO: 344190 - DNA, 25 bp, Mus musculus
agatggcggagccttccgctgctcc

SEQ ID NO: 344191 - DNA, 25 bp, Mus musculus
tgggcctcaggtctcgcgagcacct

SEQ ID NO: 344192 - DNA, 25 bp, Mus musculus
ctcgtcctaccacgccatggaaggt

SEQ ID NO: 344193 - DNA, 25 bp, Mus musculus
cctgggacccaagcactggaggcta

SEQ ID NO: 344194 - DNA, 25 bp, Mus musculus
cgaagctccgcccacgtgagctggg

SEQ ID NO: 344195 - DNA, 25 bp, Mus musculus
aggggctgcgcgacctcacccaggt

SEQ ID NO: 344196 - DNA, 25 bp, Mus musculus
gcgccgcggcacacggaagtgcaaa

SEQ ID NO: 344197 - DNA, 25 bp, Mus musculus
tcccggctcgaagggtagatgtcca

SEQ ID NO: 344198 - DNA, 25 bp, Mus musculus
gcacaagtctgatccggacgggtcc

SEQ ID NO: 344199 - DNA, 25 bp, Mus musculus
cgctgcgccctcgagttaactcgga

SEQ ID NO: 344200 - DNA, 25 bp, Mus musculus
tggctcagtttctcagtttcagaac

SEQ ID NO: 344201 - DNA, 25 bp, Mus musculus
agaccgaccagggtatggaggcacc

SEQ ID NO: 344202 - DNA, 25 bp, Mus musculus
cagccgtcgaagagagggtcagacc

SEQ ID NO: 344203 - DNA, 25 bp, Mus musculus
cctcggcggggataaagacacacag

SEQ ID NO: 344204 - DNA, 25 bp, Mus musculus
atttgagaagatcggacggtccctc

SEQ ID NO: 344205 - DNA, 25 bp, Mus musculus
aaaaggaccggagactggactggca

SEQ ID NO: 344206 - DNA, 25 bp, Mus musculus
ccctgagagatttgagaagatcgga

SEQ ID NO: 344207 - DNA, 25 bp, Mus musculus
tgggtcccccgcactgcacagggtt

SEQ ID NO: 344208 - DNA, 25 bp, Mus musculus
tgcacagggttccacgggggaccac

SEQ ID NO: 344209 - DNA, 25 bp, Mus musculus
ctcccggggaagctgctctgggtcc

SEQ ID NO: 344210 - DNA, 25 bp, Mus musculus
tgccgcggccaagcctcccggggaa

SEQ ID NO: 344211 - DNA, 25 bp, Mus musculus
ctccagcgcgtggtgccgcggccaa

SEQ ID NO: 344212 - DNA, 25 bp, Mus musculus
ctgcaggtactctgctgcgcccgct

SEQ ID NO: 344213 - DNA, 25 bp, Mus musculus
agcctgtccgtgacgccatttttcc

SEQ ID NO: 344214 - DNA, 25 bp, Mus musculus
gctatgggcagccaggaggtgctag

SEQ ID NO: 344215 - DNA, 25 bp, Mus musculus
ccgtttcctcctcggagctgtggct

SEQ ID NO: 344216 - DNA, 25 bp, Mus musculus
atttttccgcgacgaagcgggcgcg

SEQ ID NO: 344217 - DNA, 25 bp, Mus musculus
tgacgccatttttccgcgacgaagc

SEQ ID NO: 344218 - DNA, 25 bp, Mus musculus
tgtccgtgacgccatttttccgcga

SEQ ID NO: 344219 - DNA, 25 bp, Mus musculus
cgagcctgtccgtgacgccattttt

SEQ ID NO: 344220 - DNA, 25 bp, Mus musculus
ggttggcctcctcgggtctcctgct

SEQ ID NO: 344221 - DNA, 25 bp, Mus musculus
ggatcagaggctcacgccgcgacgc

SEQ ID NO: 344222 - DNA, 25 bp, Mus musculus
gaggacgccgtctccaagccgttct

SEQ ID NO: 344223 - DNA, 25 bp, Mus musculus
agcaaggccaggacgcgcctccgga

SEQ ID NO: 344224 - DNA, 25 bp, Mus musculus
tttccagaatcccaagcaaggccag

SEQ ID NO: 344225 - DNA, 25 bp, Mus musculus
ggtcccgagccgctctgtccagaag

SEQ ID NO: 344226 - DNA, 25 bp, Mus musculus
cgcttcgccagggacggatggatca

SEQ ID NO: 344227 - DNA, 25 bp, Mus musculus
ccatcttgctcgaggtggtcacgtg

SEQ ID NO: 344228 - DNA, 25 bp, Mus musculus
tacgtagaggcgttcgagtcggact

SEQ ID NO: 344229 - DNA, 25 bp, Mus musculus
ctcggtagacgagcactagagtgcc

SEQ ID NO: 344230 - DNA, 25 bp, Mus musculus
agagtgccctgctagatctcaaaga

SEQ ID NO: 344231 - DNA, 25 bp, Mus musculus
tctcaaagaacgtgtaggattcccg

SEQ ID NO: 344232 - DNA, 25 bp, Mus musculus
cagaactgctgcctctctgctaata

SEQ ID NO: 344233 - DNA, 25 bp, Mus musculus
tctgctaataccatcttgctcgagg

SEQ ID NO: 344234 - DNA, 25 bp, Mus musculus
gcccgaggtgaggtctttctttcca

SEQ ID NO: 344235 - DNA, 25 bp, Mus musculus
cgagccctgtgtcctgggaagcaag

SEQ ID NO: 344236 - DNA, 25 bp, Mus musculus
cgcggaaaggatagacgtcgtgtta

SEQ ID NO: 344237 - DNA, 25 bp, Mus musculus
attcccgcggaaaggatagacgtcg

SEQ ID NO: 344238 - DNA, 25 bp, Mus musculus
ccttgtgagactcgggataaattcc

SEQ ID NO: 344239 - DNA, 25 bp, Mus musculus
cagaaaagccttgtgagactcggga

SEQ ID NO: 344240 - DNA, 25 bp, Mus musculus
ggtggccgagtctgagcctccaccg

SEQ ID NO: 344241 - DNA, 25 bp, Mus musculus
ggaagcaaggcctgctctttgcgga

SEQ ID NO: 344242 - DNA, 25 bp, Mus musculus
ttgttcgctgtaaagacgctggagg

SEQ ID NO: 344243 - DNA, 25 bp, Mus musculus
cccaagtcttgttttgttcgctgta

SEQ ID NO: 344244 - DNA, 25 bp, Mus musculus
ctcggcaggtccgtgaccgtttcgt

SEQ ID NO: 344245 - DNA, 25 bp, Mus musculus
tcctgaggccgctcggcaggtccgt

SEQ ID NO: 344246 - DNA, 25 bp, Mus musculus
gcctctcaggcgcttcgcctgggga

SEQ ID NO: 344247 - DNA, 25 bp, Mus musculus
ggtggctccggcctctcaggcgctt

SEQ ID NO: 344248 - DNA, 25 bp, Mus musculus
ctctttgcggagcagaaaagccttg

SEQ ID NO: 344249 - DNA, 25 bp, Mus musculus
tcaggccgccatgcaaggcccggga

SEQ ID NO: 344250 - DNA, 25 bp, Mus musculus
gcctggctcaaccaatcaagctcta

SEQ ID NO: 344251 - DNA, 25 bp, Mus musculus
gagataccggcacccagctccaggt

SEQ ID NO: 344252 - DNA, 25 bp, Mus musculus
ccggagggaatcgaagcccgcctca

SEQ ID NO: 344253 - DNA, 25 bp, Mus musculus
ggcgcgctcatgcacagtttcggca

SEQ ID NO: 344254 - DNA, 25 bp, Mus musculus
tcaagctctacgatctcggacgtcg

SEQ ID NO: 344255 - DNA, 25 bp, Mus musculus
tacgatctcggacgtcgggttacgc

SEQ ID NO: 344256 - DNA, 25 bp, Mus musculus
tctcccgcgagacggtgctggttat

SEQ ID NO: 344257 - DNA, 25 bp, Mus musculus
tcctgcccttagagttccggcctgg

SEQ ID NO: 344258 - DNA, 25 bp, Mus musculus
cacattgatgcgtgagtccgggacc

SEQ ID NO: 344259 - DNA, 25 bp, Mus musculus
cgtcgtggccttcagcacattgatg

SEQ ID NO: 344260 - DNA, 25 bp, Mus musculus
cacagtttcggcatcttcctgcagg

SEQ ID NO: 344261 - DNA, 25 bp, Mus musculus
gagagcggcgcgctcatgcacagtt

SEQ ID NO: 344262 - DNA, 25 bp, Mus musculus
cgggctgagataccggcacccagct

SEQ ID NO: 344263 - DNA, 25 bp, Mus musculus
agcgaagctctatggcaggtcctcc

SEQ ID NO: 344264 - DNA, 25 bp, Mus musculus
gaaccatacgcgtaactcgcttaga

SEQ ID NO: 344265 - DNA, 25 bp, Mus musculus
catactgctacatgcgggtcgtggg

SEQ ID NO: 344266 - DNA, 25 bp, Mus musculus
tgtagaaccaaaacgcaggaagtgc

SEQ ID NO: 344267 - DNA, 25 bp, Mus musculus
tctggccttccaggagcgaagctct

SEQ ID NO: 344268 - DNA, 25 bp, Mus musculus
cccaagcacgaggagcagctctggc

SEQ ID NO: 344269 - DNA, 25 bp, Mus musculus
ggccaccgctaggtcgactctatgg

SEQ ID NO: 344270 - DNA, 25 bp, Mus musculus
atggcgcgtcttccaactctgagca

SEQ ID NO: 344271 - DNA, 25 bp, Mus musculus
ccagtatcgctatggtagcggcgtc

SEQ ID NO: 344272 - DNA, 25 bp, Mus musculus
tgggccgcgtttatggagtacttca

SEQ ID NO: 344273 - DNA, 25 bp, Mus musculus
agtacttcacctcccgtctggcatg

SEQ ID NO: 344274 - DNA, 25 bp, Mus musculus
gctgccacagcttcccgactgtagg

SEQ ID NO: 344275 - DNA, 25 bp, Mus musculus
cgactgtaggcctccttcgggaaca

SEQ ID NO: 344276 - DNA, 25 bp, Mus musculus
ctcgcttagaaccagaaaggattca

SEQ ID NO: 344277 - DNA, 25 bp, Mus musculus
ccgagcgtttcacttcggccgtggc

SEQ ID NO: 344278 - DNA, 25 bp, Mus musculus
caggaatcacttgcgggctgcgcct

SEQ ID NO: 344279 - DNA, 25 bp, Mus musculus
gcggctctaacctgacctgtcagtg

SEQ ID NO: 344280 - DNA, 25 bp, Mus musculus
cgacgattcgtctgacgcggctcta

SEQ ID NO: 344281 - DNA, 25 bp, Mus musculus
gcccagcctcggaaggcgacgattc

SEQ ID NO: 344282 - DNA, 25 bp, Mus musculus
ctcctcccagcgcaggtaagggcga

SEQ ID NO: 344283 - DNA, 25 bp, Mus musculus
catagcgacggcctttactcgggga

SEQ ID NO: 344284 - DNA, 25 bp, Mus musculus
tagaaccctgtacactgctcacgag

SEQ ID NO: 344285 - DNA, 25 bp, Mus musculus
cgcgccatcgacaagggaggtacgt

SEQ ID NO: 344286 - DNA, 25 bp, Mus musculus
tcgatatcgagagcaaggccgacca

SEQ ID NO: 344287 - DNA, 25 bp, Mus musculus
tgctgaagaccgataccgacaacga

SEQ ID NO: 344288 - DNA, 25 bp, Mus musculus
ggcagcgaactcaggtgttccagca

SEQ ID NO: 344289 - DNA, 25 bp, Mus musculus
cccggagctgtaattgcggcaggaa

SEQ ID NO: 344290 - DNA, 25 bp, Mus musculus
ggaggtacgtctcttagctttccta

SEQ ID NO: 344291 - DNA, 25 bp, Mus musculus
tcaagtgcagctaggggtgctgcaa

SEQ ID NO: 344292 - DNA, 25 bp, Mus musculus
gctcatccgctcacacactcactcg

SEQ ID NO: 344293 - DNA, 25 bp, Mus musculus
ctcagcacgcgcctgtgcgcaccta

SEQ ID NO: 344294 - DNA, 25 bp, Mus musculus
tgtgcgcacctacgcctgggcgtta

SEQ ID NO: 344295 - DNA, 25 bp, Mus musculus
cgcacctacgcctgggcgttaagga

SEQ ID NO: 344296 - DNA, 25 bp, Mus musculus
cgcctgggcgttaaggaaacagaga

SEQ ID NO: 344297 - DNA, 25 bp, Mus musculus
ggcgttaaggaaacagagatgagtc

SEQ ID NO: 344298 - DNA, 25 bp, Mus musculus
atgagtcggactcgaactgcgccca

SEQ ID NO: 344299 - DNA, 25 bp, Mus musculus
cacagtcaagtgcagctaggggtgc

SEQ ID NO: 344300 - DNA, 25 bp, Mus musculus
cgggaggcacagtcaagtgcagcta

SEQ ID NO: 344301 - DNA, 25 bp, Mus musculus
gggcactcgctcatccgctcacaca

SEQ ID NO: 344302 - DNA, 25 bp, Mus musculus
tcggactcgaactgcgcccagtctg

SEQ ID NO: 344303 - DNA, 25 bp, Mus musculus
aaggaaacagagatgagtcggactc

SEQ ID NO: 344304 - DNA, 25 bp, Mus musculus
tcactcgctctcagcacgcgcctgt

SEQ ID NO: 344305 - DNA, 25 bp, Mus musculus
gaggtctcgggatcaccacgacttc

SEQ ID NO: 344306 - DNA, 25 bp, Mus musculus
tccaggacctgccggaaagtgtgtc

SEQ ID NO: 344307 - DNA, 25 bp, Mus musculus
taggcctcttcatcctggccgcgga

SEQ ID NO: 344308 - DNA, 25 bp, Mus musculus
agcagaggaggtctcgggatcacca

SEQ ID NO: 344309 - DNA, 25 bp, Mus musculus
acacacatacactgtcgcgccgagc

SEQ ID NO: 344310 - DNA, 25 bp, Mus musculus
ctcgggatcaccacgacttctcggg

SEQ ID NO: 344311 - DNA, 25 bp, Mus musculus
gggatcaccacgacttctcgggcgc

SEQ ID NO: 344312 - DNA, 25 bp, Mus musculus
cgggcgccacgtgcgaactggaact

SEQ ID NO: 344313 - DNA, 25 bp, Mus musculus
cacgtgcgaactggaactgcggttc

SEQ ID NO: 344314 - DNA, 25 bp, Mus musculus
tgcgaactggaactgcggttcaacg

SEQ ID NO: 344315 - DNA, 25 bp, Mus musculus
ctggaactgcggttcaacgtcacgc

SEQ ID NO: 344316 - DNA, 25 bp, Mus musculus
aactgcggttcaacgtcacgcgctc

SEQ ID NO: 344317 - DNA, 25 bp, Mus musculus
ggttcaacgtcacgcgctccaggac

SEQ ID NO: 344318 - DNA, 25 bp, Mus musculus
cctggccgcggacgcttcaggagca

SEQ ID NO: 344319 - DNA, 25 bp, Mus musculus
ccaatcagaatgtggcgggactctc

SEQ ID NO: 344320 - DNA, 25 bp, Mus musculus
tcacctgggccctggagaacatgac

SEQ ID NO: 344321 - DNA, 25 bp, Mus musculus
agaacatgaccgaggcctcccagtg

SEQ ID NO: 344322 - DNA, 25 bp, Mus musculus
aaccaggcagactggtgttcccgga

SEQ ID NO: 344323 - DNA, 25 bp, Mus musculus
attctggagacggagaaccttcggg

SEQ ID NO: 344324 - DNA, 25 bp, Mus musculus
tgttcccggaggcagtacaaataac

SEQ ID NO: 344325 - DNA, 25 bp, Mus musculus
tcccgtggactgagcaccaagactc

SEQ ID NO: 344326 - DNA, 25 bp, Mus musculus
ttaggacagacccaaagcctggtcg

SEQ ID NO: 344327 - DNA, 25 bp, Mus musculus
ggcgggactctcagactctccaatc

SEQ ID NO: 344328 - DNA, 25 bp, Mus musculus
caatcagagtgctgtttgagcgcgc

SEQ ID NO: 344329 - DNA, 25 bp, Mus musculus
gcgcacgcgcctagattctggagac

SEQ ID NO: 344330 - DNA, 25 bp, Mus musculus
tcggtctgaagaagcctgcgcacgc

SEQ ID NO: 344331 - DNA, 25 bp, Mus musculus
ggcactcgctgaagagctcgcctca

SEQ ID NO: 344332 - DNA, 25 bp, Mus musculus
cgcaagagttaggtcgcggaagtta

SEQ ID NO: 344333 - DNA, 25 bp, Mus musculus
tcaagggaggaaaggtaccgccatc

SEQ ID NO: 344334 - DNA, 25 bp, Mus musculus
gggctttttgtcttctggcggcaga

SEQ ID NO: 344335 - DNA, 25 bp, Mus musculus
catcgccaccgagacgaccaaaggg

SEQ ID NO: 344336 - DNA, 25 bp, Mus musculus
gtgtctctgcaggacaccgctactc

SEQ ID NO: 344337 - DNA, 25 bp, Mus musculus
gctctgcgacttcccgctcaaggga

SEQ ID NO: 344338 - DNA, 25 bp, Mus musculus
ccctgagccgatcttgttacaagga

SEQ ID NO: 344339 - DNA, 25 bp, Mus musculus
gcgcgcacttatgggctcgttacca

SEQ ID NO: 344340 - DNA, 25 bp, Mus musculus
tcgttaccaggacatgcggaggctg

SEQ ID NO: 344341 - DNA, 25 bp, Mus musculus
tctggcggcagaagcttggaatgcc

SEQ ID NO: 344342 - DNA, 25 bp, Mus musculus
gtgagccgtaggtcgtcagacgaac

SEQ ID NO: 344343 - DNA, 25 bp, Mus musculus
tcagacgaacggtgcccaacagacg

SEQ ID NO: 344344 - DNA, 25 bp, Mus musculus
tcccaaaacctgagggctaaatggc

SEQ ID NO: 344345 - DNA, 25 bp, Mus musculus
tggcgttttagaaaaggctccatcg

SEQ ID NO: 344346 - DNA, 25 bp, Mus musculus
ctccatcgggttgttaggaggtgtc

SEQ ID NO: 344347 - DNA, 25 bp, Mus musculus
acttgacggcctccgagggcgcgca

SEQ ID NO: 344348 - DNA, 25 bp, Mus musculus
aagcggtagcccacgagcagctcga

SEQ ID NO: 344349 - DNA, 25 bp, Mus musculus
gatggcagcggacttgacggcctcc

SEQ ID NO: 344350 - DNA, 25 bp, Mus musculus
ccttgatgacgttgagatgctggga

SEQ ID NO: 344351 - DNA, 25 bp, Mus musculus
ttgaagtcggccttgatgacgttga

SEQ ID NO: 344352 - DNA, 25 bp, Mus musculus
taagcttgaagctgttgcggttgcg

SEQ ID NO: 344353 - DNA, 25 bp, Mus musculus
ggacgcggctaagcttgaagctgtt

SEQ ID NO: 344354 - DNA, 25 bp, Mus musculus
atggcggtaacgaagcggtagccca

SEQ ID NO: 344355 - DNA, 25 bp, Mus musculus
tttctcgtggggcagcacaaagatg

SEQ ID NO: 344356 - DNA, 25 bp, Mus musculus
gtggaatttctcgtggggcagcaca

SEQ ID NO: 344357 - DNA, 25 bp, Mus musculus
gtagactcgcaggaagtggaatttc

SEQ ID NO: 344358 - DNA, 25 bp, Mus musculus
aggcgcgtagctgattgtagactcg

SEQ ID NO: 344359 - DNA, 25 bp, Mus musculus
agcagctcgagcacatggccatcag

SEQ ID NO: 344360 - DNA, 25 bp, Mus musculus
gcacatggccatcagcgaaggcacc

SEQ ID NO: 344361 - DNA, 25 bp, Mus musculus
agctgagtgtcgcagccgccatgtt

SEQ ID NO: 344362 - DNA, 25 bp, Mus musculus
ccgctcagggccgaagctgagtgtc

SEQ ID NO: 344363 - DNA, 25 bp, Mus musculus
gtgtccacgagctcagaacccacga

SEQ ID NO: 344364 - DNA, 25 bp, Mus musculus
ccgtgtacgtgtccacgagctcaga

SEQ ID NO: 344365 - DNA, 25 bp, Mus musculus
ttccaggcgctaagcccgctctgga

SEQ ID NO: 344366 - DNA, 25 bp, Mus musculus
gagaactccgggttccaggcgctaa

SEQ ID NO: 344367 - DNA, 25 bp, Mus musculus
actcatcgaatgtgctacccaggcc

SEQ ID NO: 344368 - DNA, 25 bp, Mus musculus
gaaccttccacgcactcatcgaatg

SEQ ID NO: 344369 - DNA, 25 bp, Mus musculus
ctgggtcgagaactccgggttccag

SEQ ID NO: 344370 - DNA, 25 bp, Mus musculus
cctcgtcgctacctcgcagaacctt

SEQ ID NO: 344371 - DNA, 25 bp, Mus musculus
tgcgacccggcccttcctccgaatc

SEQ ID NO: 344372 - DNA, 25 bp, Mus musculus
agatcctcctccagaacctatgcga

SEQ ID NO: 344373 - DNA, 25 bp, Mus musculus
atgttgccggctccaccgctgccga

SEQ ID NO: 344374 - DNA, 25 bp, Mus musculus
cagcacaccgtgtacgtgtccacga

SEQ ID NO: 344375 - DNA, 25 bp, Mus musculus
ctcaaggagcattccgcgcatgcca

SEQ ID NO: 344376 - DNA, 25 bp, Mus musculus
cggtcgtggcaaatgcaagctgctc

SEQ ID NO: 344377 - DNA, 25 bp, Mus musculus
tgcaagctgctcagtccgcgatttc

SEQ ID NO: 344378 - DNA, 25 bp, Mus musculus
ccgcgatttcctaacccggcggatg

SEQ ID NO: 344379 - DNA, 25 bp, Mus musculus
tgctcgctcgaaacgcttaccaagt

SEQ ID NO: 344380 - DNA, 25 bp, Mus musculus
cgccgccgcaagaataaacgattta

SEQ ID NO: 344381 - DNA, 25 bp, Mus musculus
gtaacagtcagaagagggctcaagg

SEQ ID NO: 344382 - DNA, 25 bp, Mus musculus
tgctcgctctcacggaagctacggg

SEQ ID NO: 344383 - DNA, 25 bp, Mus musculus
tcccggagctttagtcgttgacaca

SEQ ID NO: 344384 - DNA, 25 bp, Mus musculus
tgacacaagacgtggtaactacttc

SEQ ID NO: 344385 - DNA, 25 bp, Mus musculus
actgtggccaaaacgaggaccgcta

SEQ ID NO: 344386 - DNA, 25 bp, Mus musculus
tcgtgtgatgatgacgttgtacgtc

SEQ ID NO: 344387 - DNA, 25 bp, Mus musculus
gccgctccgcgggaagatgaataag

SEQ ID NO: 344388 - DNA, 25 bp, Mus musculus
atacgtcagtgtggccacaaccgtc

SEQ ID NO: 344389 - DNA, 25 bp, Mus musculus
gccgctactctgaggcggtgtttta

SEQ ID NO: 344390 - DNA, 25 bp, Mus musculus
tgcccgccgctttgctgcttgtggc

SEQ ID NO: 344391 - DNA, 25 bp, Mus musculus
ccgcgtcacccgatcgagtgttggc

SEQ ID NO: 344392 - DNA, 25 bp, Mus musculus
tgaggacaagcactcggctccggcc

SEQ ID NO: 344393 - DNA, 25 bp, Mus musculus
ccgatcgagtgttggcggaacccaa

SEQ ID NO: 344394 - DNA, 25 bp, Mus musculus
tctgaggcggtgttttactacaagg

SEQ ID NO: 344395 - DNA, 25 bp, Mus musculus
tgcagcgcgaccacgaaggccgcta

SEQ ID NO: 344396 - DNA, 25 bp, Mus musculus
gctggcagtgcagcgcgaccacgaa

SEQ ID NO: 344397 - DNA, 25 bp, Mus musculus
ggttccgcgtcagggcctgtctgcc

SEQ ID NO: 344398 - DNA, 25 bp, Mus musculus
ctcgaaagtaaactttgccactcca

SEQ ID NO: 344399 - DNA, 25 bp, Mus musculus
tagtggggctccgtcatctcttccg

SEQ ID NO: 344400 - DNA, 25 bp, Mus musculus
agctcgcagtcctccgggcgggtct

SEQ ID NO: 344401 - DNA, 25 bp, Mus musculus
cgggctgctcggagctcgcagtcct

SEQ ID NO: 344402 - DNA, 25 bp, Mus musculus
tactacaaggtgaggacaagcactc

SEQ ID NO: 344403 - DNA, 25 bp, Mus musculus
atccacgcaggtgggataacgctgc

SEQ ID NO: 344404 - DNA, 25 bp, Mus musculus
ggctccgtttcagcgccgtgtccat

SEQ ID NO: 344405 - DNA, 25 bp, Mus musculus
ttgacaatgaagaggacggcagccc

SEQ ID NO: 344406 - DNA, 25 bp, Mus musculus
tgccgacttccacggtagccctggt

SEQ ID NO: 344407 - DNA, 25 bp, Mus musculus
tgtgtctgcgttagatgccgacttc

SEQ ID NO: 344408 - DNA, 25 bp, Mus musculus
gcgaccgcgaacacgcgaggctgta

SEQ ID NO: 344409 - DNA, 25 bp, Mus musculus
ttccaacccttggtgaagatcctga

SEQ ID NO: 344410 - DNA, 25 bp, Mus musculus
gccttccgcagggagaccgtgaaat

SEQ ID NO: 344411 - DNA, 25 bp, Mus musculus
ccgcaataatcaggccgcgttcacg

SEQ ID NO: 344412 - DNA, 25 bp, Mus musculus
tcctttgttgcaatccgcctgaaca

SEQ ID NO: 344413 - DNA, 25 bp, Mus musculus
actacaggggcaagcgacagccacc

SEQ ID NO: 344414 - DNA, 25 bp, Mus musculus
gacgcccaccatgtgttgacaatga

SEQ ID NO: 344415 - DNA, 25 bp, Mus musculus
accggtgcagcccacactacagggg

SEQ ID NO: 344416 - DNA, 25 bp, Mus musculus
cgcctgaacagctggtcgtgtagta

SEQ ID NO: 344417 - DNA, 25 bp, Mus musculus
atccaggaggccaaggcgacaacgc

SEQ ID NO: 344418 - DNA, 25 bp, Mus musculus
cacgtgaccgcgttggcggtgctcc

SEQ ID NO: 344419 - DNA, 25 bp, Mus musculus
cgtctggctcgcactgcgatggcca

SEQ ID NO: 344420 - DNA, 25 bp, Mus musculus
ctacctggtgctgcaatgtcccaga

SEQ ID NO: 344421 - DNA, 25 bp, Mus musculus
tgcaatgtcccagaacccggtgcgg

SEQ ID NO: 344422 - DNA, 25 bp, Mus musculus
cggagccgacggagaatttatgaat

SEQ ID NO: 344423 - DNA, 25 bp, Mus musculus
ctcccggttggctctggagctcggt

SEQ ID NO: 344424 - DNA, 25 bp, Mus musculus
gcggcagatacacggctctcccggt

SEQ ID NO: 344425 - DNA, 25 bp, Mus musculus
gcggaccctggaactggtcgccatc

SEQ ID NO: 344426 - DNA, 25 bp, Mus musculus
aagcgcagagaacgcgacgccaggc

SEQ ID NO: 344427 - DNA, 25 bp, Mus musculus
acgctctcgccctgtcactagggta

SEQ ID NO: 344428 - DNA, 25 bp, Mus musculus
acgccaggctcgtgaggatccagga

SEQ ID NO: 344429 - DNA, 25 bp, Mus musculus
tttatgaatggggagagcagcgcac

SEQ ID NO: 344430 - DNA, 25 bp, Mus musculus
cctgtcactagggtaaactgaggcc

SEQ ID NO: 344431 - DNA, 25 bp, Mus musculus
ccgaaagcgggtagacgattgccta

SEQ ID NO: 344432 - DNA, 25 bp, Mus musculus
attgcctaacagacacgggatcgcg

SEQ ID NO: 344433 - DNA, 25 bp, Mus musculus
cccataaactgaaggaagcgtcgtc

SEQ ID NO: 344434 - DNA, 25 bp, Mus musculus
tgcccgtgggaaacgtgacttcaaa

SEQ ID NO: 344435 - DNA, 25 bp, Mus musculus
tcgggcatgtccagggacactcata

SEQ ID NO: 344436 - DNA, 25 bp, Mus musculus
tcgtcggccaggagaactgaaatcc

SEQ ID NO: 344437 - DNA, 25 bp, Mus musculus
tcgctctctgaaccctcggataaag

SEQ ID NO: 344438 - DNA, 25 bp, Mus musculus
gcaaagaacaggtcagggcgcactc

SEQ ID NO: 344439 - DNA, 25 bp, Mus musculus
ggcgtcggcagcagaatcttctagc

SEQ ID NO: 344440 - DNA, 25 bp, Mus musculus
atcttctagctgacctgggctcctc

SEQ ID NO: 344441 - DNA, 25 bp, Mus musculus
ggctcctccttagaccagaaaactg

SEQ ID NO: 344442 - DNA, 25 bp, Mus musculus
gccttacttccgcagagtctctcga

SEQ ID NO: 344443 - DNA, 25 bp, Mus musculus
gccggggtttctgatcgtacccata

SEQ ID NO: 344444 - DNA, 25 bp, Mus musculus
tgaaatcctctcatcgcaaccatgg

SEQ ID NO: 344445 - DNA, 25 bp, Mus musculus
aggcaagctacgcaaaggctgctgg

SEQ ID NO: 344446 - DNA, 25 bp, Mus musculus
gccgcgtcctatgcgaagcaggtaa

SEQ ID NO: 344447 - DNA, 25 bp, Mus musculus
atacagctcagtccggtatggaggg

SEQ ID NO: 344448 - DNA, 25 bp, Mus musculus
tagcgatacagctcagtccggtatg

SEQ ID NO: 344449 - DNA, 25 bp, Mus musculus
ctagggtagcgatacagctcagtcc

SEQ ID NO: 344450 - DNA, 25 bp, Mus musculus
atctggagggtgactgcagagacca

SEQ ID NO: 344451 - DNA, 25 bp, Mus musculus
actccgccatcagcaggaggcggga

SEQ ID NO: 344452 - DNA, 25 bp, Mus musculus
ccgctgattggaggcaagctacgca

SEQ ID NO: 344453 - DNA, 25 bp, Mus musculus
tcctccactagggtagcgatacagc

SEQ ID NO: 344454 - DNA, 25 bp, Mus musculus
tggttttgtcctccactagggtagc

SEQ ID NO: 344455 - DNA, 25 bp, Mus musculus
tctctgaggatgctcgccttggttt

SEQ ID NO: 344456 - DNA, 25 bp, Mus musculus
aggtaagaaacccaatctctgagga

SEQ ID NO: 344457 - DNA, 25 bp, Mus musculus
cctatgcgaagcaggtaagaaaccc

SEQ ID NO: 344458 - DNA, 25 bp, Mus musculus
cttcccgctgattggaggcaagcta

SEQ ID NO: 344459 - DNA, 25 bp, Mus musculus
acacgggcttttattagggacatga

SEQ ID NO: 344460 - DNA, 25 bp, Mus musculus
caccgagtctgttttggaaatgttc

SEQ ID NO: 344461 - DNA, 25 bp, Mus musculus
ctgcccgccgcgttagaaaaccgag

SEQ ID NO: 344462 - DNA, 25 bp, Mus musculus
acgcagctctacgtgtttggagaga

SEQ ID NO: 344463 - DNA, 25 bp, Mus musculus
cgggcgagtgtaattgccaggatta

SEQ ID NO: 344464 - DNA, 25 bp, Mus musculus
agctgcgaaagttcagtccttggca

SEQ ID NO: 344465 - DNA, 25 bp, Mus musculus
agtccttggcagctttccttattca

SEQ ID NO: 344466 - DNA, 25 bp, Mus musculus
ttattcagctcttctctcctgccgg

SEQ ID NO: 344467 - DNA, 25 bp, Mus musculus
ctcctgccggttcgtttcagattta

SEQ ID NO: 344468 - DNA, 25 bp, Mus musculus
gtctgcattatgtctggagcccgca

SEQ ID NO: 344469 - DNA, 25 bp, Mus musculus
ctgagtactacgtggctgctgtgta

SEQ ID NO: 344470 - DNA, 25 bp, Mus musculus
gtgtacgagcatccatcggtcctga

SEQ ID NO: 344471 - DNA, 25 bp, Mus musculus
gtctattaacacagcgagccgtttg

SEQ ID NO: 344472 - DNA, 25 bp, Mus musculus
gcagtgcgctgtgtagcaaggctac

SEQ ID NO: 344473 - DNA, 25 bp, Mus musculus
gtggcgtgcacaagctcagctcagt

SEQ ID NO: 344474 - DNA, 25 bp, Mus musculus
tacctggtcgcggagtttgaggaac

SEQ ID NO: 344475 - DNA, 25 bp, Mus musculus
caagctcagctcagtcaggtgcgga

SEQ ID NO: 344476 - DNA, 25 bp, Mus musculus
ccagagtaagccgagcgcccattgg

SEQ ID NO: 344477 - DNA, 25 bp, Mus musculus
atccaaactccactccacaatatta

SEQ ID NO: 344478 - DNA, 25 bp, Mus musculus
tcacctacctggtcgcggagtttga

SEQ ID NO: 344479 - DNA, 25 bp, Mus musculus
ctcctccgactcctcggtggcgcga

SEQ ID NO: 344480 - DNA, 25 bp, Mus musculus
cctcacctggcaggaaagaggaggc

SEQ ID NO: 344481 - DNA, 25 bp, Mus musculus
gcccgagcctcacctggcaggaaag

SEQ ID NO: 344482 - DNA, 25 bp, Mus musculus
gcaaagccacctgttaggcccgagc

SEQ ID NO: 344483 - DNA, 25 bp, Mus musculus
ggcggtcgccgctgttcggccacta

SEQ ID NO: 344484 - DNA, 25 bp, Mus musculus
tttgaggaacgccatggcggtcgcc

SEQ ID NO: 344485 - DNA, 25 bp, Mus musculus
tttctcggagctggggctgcactga

SEQ ID NO: 344486 - DNA, 25 bp, Mus musculus
ctcagctcagtcaggtgcggagaag

SEQ ID NO: 344487 - DNA, 25 bp, Mus musculus
gaccaatagtgtgaagggctccctc

SEQ ID NO: 344488 - DNA, 25 bp, Mus musculus
ggtcggcaccgcatcagcttgccta

SEQ ID NO: 344489 - DNA, 25 bp, Mus musculus
cctctcatggcggttacgtcagtcc

SEQ ID NO: 344490 - DNA, 25 bp, Mus musculus
ttgcgcagttctccgtccactgggt

SEQ ID NO: 344491 - DNA, 25 bp, Mus musculus
gaaagatggtgcttcctgcgcagca

SEQ ID NO: 344492 - DNA, 25 bp, Mus musculus
cgcacaggcgatgacgtaacttcta

SEQ ID NO: 344493 - DNA, 25 bp, Mus musculus
accctggcgcaggaacagtcacttc

SEQ ID NO: 344494 - DNA, 25 bp, Mus musculus
ccgagtcctcgtcatattgaaagtc

SEQ ID NO: 344495 - DNA, 25 bp, Mus musculus
ggtagaaatatgtctccgagtcctc

SEQ ID NO: 344496 - DNA, 25 bp, Mus musculus
ggccctttagagtaccttggtgatg

SEQ ID NO: 344497 - DNA, 25 bp, Mus musculus
cgacaatgcgcaagctcgagggatc

SEQ ID NO: 344498 - DNA, 25 bp, Mus musculus
gaacacgtgggtaactgagccttcc

SEQ ID NO: 344499 - DNA, 25 bp, Mus musculus
ccgaccctgtatgctagacagccta

SEQ ID NO: 344500 - DNA, 25 bp, Mus musculus
tcgtcgtgaaacaccgccatggtca

SEQ ID NO: 344501 - DNA, 25 bp, Mus musculus
ctaaggtccgctcggatcaccggaa

SEQ ID NO: 344502 - DNA, 25 bp, Mus musculus
cggatcaccggaaggagcgctgcca

SEQ ID NO: 344503 - DNA, 25 bp, Mus musculus
cgtctgctgtgatcgcctctccagt

SEQ ID NO: 344504 - DNA, 25 bp, Mus musculus
cccaggtcacgtctgctgtgatcgc

SEQ ID NO: 344505 - DNA, 25 bp, Mus musculus
gtccggatccttccacggctaagtg

SEQ ID NO: 344506 - DNA, 25 bp, Mus musculus
aggccatcctatcgcgagaactctg

SEQ ID NO: 344507 - DNA, 25 bp, Mus musculus
gtcggtctaaggtccgctcggatca

SEQ ID NO: 344508 - DNA, 25 bp, Mus musculus
atctcgcgagactgtcagaacacta

SEQ ID NO: 344509 - DNA, 25 bp, Mus musculus
aagcgtggtagggaggccatcctat

SEQ ID NO: 344510 - DNA, 25 bp, Mus musculus
tcgcgagaactctgtcttcagggtc

SEQ ID NO: 344511 - DNA, 25 bp, Mus musculus
ccttccacggctaagtgtctgggtc

SEQ ID NO: 344512 - DNA, 25 bp, Mus musculus
cttcagggtccggatccttccacgg

SEQ ID NO: 344513 - DNA, 25 bp, Mus musculus
cggctaagtgtctgggtcggtctaa

SEQ ID NO: 344514 - DNA, 25 bp, Mus musculus
cagaacactaccgagaagcgtggta

SEQ ID NO: 344515 - DNA, 25 bp, Mus musculus
cggagtagcaggtgtgtttgcggag

SEQ ID NO: 344516 - DNA, 25 bp, Mus musculus
cagcctcgcgcccacggaggccctg

SEQ ID NO: 344517 - DNA, 25 bp, Mus musculus
tgagacctcttgaccgccgctgggc

SEQ ID NO: 344518 - DNA, 25 bp, Mus musculus
ttgctgctgagacctcttgaccgcc

SEQ ID NO: 344519 - DNA, 25 bp, Mus musculus
gggccccgcttgttctctgtagtta

SEQ ID NO: 344520 - DNA, 25 bp, Mus musculus
accgttatcgcggtcgctgcgggcc

SEQ ID NO: 344521 - DNA, 25 bp, Mus musculus
gctgctggaccgttatcgcggtcgc

SEQ ID NO: 344522 - DNA, 25 bp, Mus musculus
tagggtataaacctggccgtcgagc

SEQ ID NO: 344523 - DNA, 25 bp, Mus musculus
tgctgagacctcttgaccgccgctg

SEQ ID NO: 344524 - DNA, 25 bp, Mus musculus
ctggaccgttatcgcggtcgctgcg

SEQ ID NO: 344525 - DNA, 25 bp, Mus musculus
aacctggccgtcgagcgtgttctcg

SEQ ID NO: 344526 - DNA, 25 bp, Mus musculus
gtcgagcgtgttctcgcagcagttt

SEQ ID NO: 344527 - DNA, 25 bp, Mus musculus
gcgtgttctcgcagcagttttcgtc

SEQ ID NO: 344528 - DNA, 25 bp, Mus musculus
ataaacctggccgtcgagcgtgttc

SEQ ID NO: 344529 - DNA, 25 bp, Mus musculus
ccggctcccgtgaagtatcgcactt

SEQ ID NO: 344530 - DNA, 25 bp, Mus musculus
ggacattttgtgtttcctctcgaaa

SEQ ID NO: 344531 - DNA, 25 bp, Mus musculus
ctaggtcactaaaagagcttcccgg

SEQ ID NO: 344532 - DNA, 25 bp, Mus musculus
ttcagccttgaaacccaatcaccgg

SEQ ID NO: 344533 - DNA, 25 bp, Mus musculus
caccggcggtgaatctcgtaaaggc

SEQ ID NO: 344534 - DNA, 25 bp, Mus musculus
gttacacatttctagctgtcccagg

SEQ ID NO: 344535 - DNA, 25 bp, Mus musculus
ggacgctcccgtccagttcagggtc

SEQ ID NO: 344536 - DNA, 25 bp, Mus musculus
atcgcacttccgctttacggctgtg

SEQ ID NO: 344537 - DNA, 25 bp, Mus musculus
gagcccgatctcgagccgagtggaa

SEQ ID NO: 344538 - DNA, 25 bp, Mus musculus
cagcgagggtctcgctcgaaggccc

SEQ ID NO: 344539 - DNA, 25 bp, Mus musculus
ctgtccgggttagtgaatgaggctc

SEQ ID NO: 344540 - DNA, 25 bp, Mus musculus
gctggaacttctgcgccgactgcct

SEQ ID NO: 344541 - DNA, 25 bp, Mus musculus
cccggagcttccctggcaggcagag

SEQ ID NO: 344542 - DNA, 25 bp, Mus musculus
caggcgaggcccgatactcacgcgg

SEQ ID NO: 344543 - DNA, 25 bp, Mus musculus
tgatacagcgcgctgctcgtgaccc

SEQ ID NO: 344544 - DNA, 25 bp, Mus musculus
cggccgtgtcacgtgacctaggtaa

SEQ ID NO: 344545 - DNA, 25 bp, Mus musculus
ccgagacgtcacgacgcgcggaatc

SEQ ID NO: 344546 - DNA, 25 bp, Mus musculus
gtctaccgagacgtcacgacgcgcg

SEQ ID NO: 344547 - DNA, 25 bp, Mus musculus
ggggcgtctaccgagacgtcacgac

SEQ ID NO: 344548 - DNA, 25 bp, Mus musculus
tcacgacgcgcggaatcccgagggt

SEQ ID NO: 344549 - DNA, 25 bp, Mus musculus
tcacggcggccgtgtcacgtgacct

SEQ ID NO: 344550 - DNA, 25 bp, Mus musculus
cgtgtcacgtgacctaggtaattga

SEQ ID NO: 344551 - DNA, 25 bp, Mus musculus
tcacgtgacctaggtaattgataca

SEQ ID NO: 344552 - DNA, 25 bp, Mus musculus
cgtgacctaggtaattgatacagcg

SEQ ID NO: 344553 - DNA, 25 bp, Mus musculus
aggtaattgatacagcgcgctgctc

SEQ ID NO: 344554 - DNA, 25 bp, Mus musculus
tgctcgtgaccctccgctcagtccc

SEQ ID NO: 344555 - DNA, 25 bp, Mus musculus
ccggaacctcggccagccggtgaga

SEQ ID NO: 344556 - DNA, 25 bp, Mus musculus
cctaggtaattgatacagcgcgctg

SEQ ID NO: 344557 - DNA, 25 bp, Mus musculus
gcctacatgggcgtgcttgccagct

SEQ ID NO: 344558 - DNA, 25 bp, Mus musculus
ttgcagctctgcaaactcgctcgta

SEQ ID NO: 344559 - DNA, 25 bp, Mus musculus
ctgcctattggcacgcttgtgcaaa

SEQ ID NO: 344560 - DNA, 25 bp, Mus musculus
gcctcaggcgacctatttgggcccg

SEQ ID NO: 344561 - DNA, 25 bp, Mus musculus
cagatcacggtgttccgggcctcag

SEQ ID NO: 344562 - DNA, 25 bp, Mus musculus
ctcagaaactgggtgcttgcagatc

SEQ ID NO: 344563 - DNA, 25 bp, Mus musculus
tgggaatcctttctctgtggcggca

SEQ ID NO: 344564 - DNA, 25 bp, Mus musculus
agcccgagttttgcggcatgagccg

SEQ ID NO: 344565 - DNA, 25 bp, Mus musculus
gattttaaaagtaccagctggcgcc

SEQ ID NO: 344566 - DNA, 25 bp, Mus musculus
tgccagctccatcagcaactttggg

SEQ ID NO: 344567 - DNA, 25 bp, Mus musculus
tgtgtccatcacagactttcaggca

SEQ ID NO: 344568 - DNA, 25 bp, Mus musculus
cttgttttccggaaggtgtgcactc

SEQ ID NO: 344569 - DNA, 25 bp, Mus musculus
gtagagcgcgcctaaatcctagaga

SEQ ID NO: 344570 - DNA, 25 bp, Mus musculus
ctttcaggcagaagtcggagctgtc

SEQ ID NO: 344571 - DNA, 25 bp, Mus musculus
gcgctccggctacaacagcgatgta

SEQ ID NO: 344572 - DNA, 25 bp, Mus musculus
ccgagccgcagctgagaaaggctta

SEQ ID NO: 344573 - DNA, 25 bp, Mus musculus
aaaggcttagccaccgccaggagta

SEQ ID NO: 344574 - DNA, 25 bp, Mus musculus
ttgcccgcgaactcgtagaggatgc

SEQ ID NO: 344575 - DNA, 25 bp, Mus musculus
ggcgccactaggcttccaaagctga

SEQ ID NO: 344576 - DNA, 25 bp, Mus musculus
tcctcgggatacttgtcggcgatca

SEQ ID NO: 344577 - DNA, 25 bp, Mus musculus
cgtggcatagtcttctgcaaaggca

SEQ ID NO: 344578 - DNA, 25 bp, Mus musculus
cggcacgtcgtagctcatgcgatca

SEQ ID NO: 344579 - DNA, 25 bp, Mus musculus
cttaaggggttcaccagaagctgca

SEQ ID NO: 344580 - DNA, 25 bp, Mus musculus
gtgggttcccacacctcagagatca

SEQ ID NO: 344581 - DNA, 25 bp, Mus musculus
cccgcgcatgtgagcgatatagtcg

SEQ ID NO: 344582 - DNA, 25 bp, Mus musculus
gggcacgatgaccatgtacaacatg

SEQ ID NO: 344583 - DNA, 25 bp, Mus musculus
cgccattgtgtgcttcatccacgtg

SEQ ID NO: 344584 - DNA, 25 bp, Mus musculus
tgttacaagttgtgagcgctccggc

SEQ ID NO: 344585 - DNA, 25 bp, Mus musculus
ctctagacctcctcctcagcctgga

SEQ ID NO: 344586 - DNA, 25 bp, Mus musculus
cccgcagcctggtgggagacgggag

SEQ ID NO: 344587 - DNA, 25 bp, Mus musculus
tcagcctggacttcggcgcacagcg

SEQ ID NO: 344588 - DNA, 25 bp, Mus musculus
cagcctggacttcggcgcacagcgg

SEQ ID NO: 344589 - DNA, 25 bp, Mus musculus
tgcctccatctgttctcgcagctgg

SEQ ID NO: 344590 - DNA, 25 bp, Mus musculus
cctccatctgttctcgcagctggaa

SEQ ID NO: 344591 - DNA, 25 bp, Mus musculus
tccatctgttctcgcagctggaaca

SEQ ID NO: 344592 - DNA, 25 bp, Mus musculus
atctgttctcgcagctggaacacgc

SEQ ID NO: 344593 - DNA, 25 bp, Mus musculus
tgttctcgcagctggaacacgcagc

SEQ ID NO: 344594 - DNA, 25 bp, Mus musculus
ttctcgcagctggaacacgcagccg

SEQ ID NO: 344595 - DNA, 25 bp, Mus musculus
tcgcagctggaacacgcagccggga

SEQ ID NO: 344596 - DNA, 25 bp, Mus musculus
agctggaacacgcagccgggaccca

SEQ ID NO: 344597 - DNA, 25 bp, Mus musculus
gctggaacacgcagccgggacccag

SEQ ID NO: 344598 - DNA, 25 bp, Mus musculus
cccagaggcacagcgcaagcaaccc

SEQ ID NO: 344599 - DNA, 25 bp, Mus musculus
gatatcttccggcaggcgcacctga

SEQ ID NO: 344600 - DNA, 25 bp, Mus musculus
gcgcacctgaaaccggaagtgacgt

SEQ ID NO: 344601 - DNA, 25 bp, Mus musculus
cgcacgtggcaaacccttgcttaca

SEQ ID NO: 344602 - DNA, 25 bp, Mus musculus
cttacaaacggctcagcaaggcgca

SEQ ID NO: 344603 - DNA, 25 bp, Mus musculus
cttagcacaggcctagggcgcatgc

SEQ ID NO: 344604 - DNA, 25 bp, Mus musculus
ggcgcatgcgctaaggtttgtctca

SEQ ID NO: 344605 - DNA, 25 bp, Mus musculus
ggtttgtctcaacgctccgtcgcgg

SEQ ID NO: 344606 - DNA, 25 bp, Mus musculus
cggcggtagcgacgaagaattcgtt

SEQ ID NO: 344607 - DNA, 25 bp, Mus musculus
aagaattcgtttgggcagccgcgtg

SEQ ID NO: 344608 - DNA, 25 bp, Mus musculus
gtgagagtacttgcgcctcgggctc

SEQ ID NO: 344609 - DNA, 25 bp, Mus musculus
gcctcgggctctccatgaggctgtg

SEQ ID NO: 344610 - DNA, 25 bp, Mus musculus
gcgtctagccttctgcggcggagcc

SEQ ID NO: 344611 - DNA, 25 bp, Mus musculus
ggcttcgcccgtgggccggatatct

SEQ ID NO: 344612 - DNA, 25 bp, Mus musculus
gctccctttggtcaacgcacgtggc

SEQ ID NO: 344613 - DNA, 25 bp, Mus musculus
gctgttttcccaggggtgtccactg

SEQ ID NO: 344614 - DNA, 25 bp, Mus musculus
cgctccgagccgagcagtcattttc

SEQ ID NO: 344615 - DNA, 25 bp, Mus musculus
gccgcgtttcttcctggctgttttc

SEQ ID NO: 344616 - DNA, 25 bp, Mus musculus
ccgcttgagtgcaagaggcccagcc

SEQ ID NO: 344617 - DNA, 25 bp, Mus musculus
gctgagcctagaaagggccgcttga

SEQ ID NO: 344618 - DNA, 25 bp, Mus musculus
gcagtcattttccagcctcttcttg

SEQ ID NO: 344619 - DNA, 25 bp, Mus musculus
cgggcctcgaagctgtgtactggcc

SEQ ID NO: 344620 - DNA, 25 bp, Mus musculus
accagttgcagagagcgggatgctc

SEQ ID NO: 344621 - DNA, 25 bp, Mus musculus
ctcggctcctggaaccagttgcaga

SEQ ID NO: 344622 - DNA, 25 bp, Mus musculus
tcgactcccagagtgcgcaaggcgc

SEQ ID NO: 344623 - DNA, 25 bp, Mus musculus
aggctcccgcggataatgcaagtgc

SEQ ID NO: 344624 - DNA, 25 bp, Mus musculus
caacgcggcagtcggtactaggttg

SEQ ID NO: 344625 - DNA, 25 bp, Mus musculus
ggccagagcctcagcactcagttct

SEQ ID NO: 344626 - DNA, 25 bp, Mus musculus
gatgctccctgagccggacctggag

SEQ ID NO: 344627 - DNA, 25 bp, Mus musculus
tgcgtgagattataaaggcgagtgc

SEQ ID NO: 344628 - DNA, 25 bp, Mus musculus
tgtagacagacagcaagacatctgg

SEQ ID NO: 344629 - DNA, 25 bp, Mus musculus
gacagcaagacatctggccacttcc

SEQ ID NO: 344630 - DNA, 25 bp, Mus musculus
cagtcacttctctggtcctgcgggc

SEQ ID NO: 344631 - DNA, 25 bp, Mus musculus
cgcgtgcggactagaggcgagcgca

SEQ ID NO: 344632 - DNA, 25 bp, Mus musculus
gctccctgcgctgggccttgggact

SEQ ID NO: 344633 - DNA, 25 bp, Mus musculus
ctgggccttgggacttcaccggctt

SEQ ID NO: 344634 - DNA, 25 bp, Mus musculus
gacttcaccggcttttggcccgagc

SEQ ID NO: 344635 - DNA, 25 bp, Mus musculus
tcaccggcttttggcccgagctgct

SEQ ID NO: 344636 - DNA, 25 bp, Mus musculus
gcccgagctgctgcgcttgcagatg

SEQ ID NO: 344637 - DNA, 25 bp, Mus musculus
ctgctgcgcttgcagatggccttgc

SEQ ID NO: 344638 - DNA, 25 bp, Mus musculus
ttgcagatggccttgcgcgatcgcc

SEQ ID NO: 344639 - DNA, 25 bp, Mus musculus
gtgagattataaaggcgagtgctga

SEQ ID NO: 344640 - DNA, 25 bp, Mus musculus
cggcgcgcgctgtagacagacagca

SEQ ID NO: 344641 - DNA, 25 bp, Mus musculus
ttttctcatctgagacgtgggcgtg

SEQ ID NO: 344642 - DNA, 25 bp, Mus musculus
ctcctggacgccttagctctgtaca

SEQ ID NO: 344643 - DNA, 25 bp, Mus musculus
tttaactatctttggagacgctccg

SEQ ID NO: 344644 - DNA, 25 bp, Mus musculus
tgctgccagcaccaactttccttta

SEQ ID NO: 344645 - DNA, 25 bp, Mus musculus
tttcgtagtagtcgagacccgcagc

SEQ ID NO: 344646 - DNA, 25 bp, Mus musculus
cggcgccttctttctgtctttcgta

SEQ ID NO: 344647 - DNA, 25 bp, Mus musculus
agctcctggtcccttctgagtcgca

SEQ ID NO: 344648 - DNA, 25 bp, Mus musculus
acctgctctcgggacagctcctggt

SEQ ID NO: 344649 - DNA, 25 bp, Mus musculus
ggggtcctggagactcactcgtacc

SEQ ID NO: 344650 - DNA, 25 bp, Mus musculus
tagacccagagacccagcagcgctg

SEQ ID NO: 344651 - DNA, 25 bp, Mus musculus
tccagctcggcgtagacccagagac

SEQ ID NO: 344652 - DNA, 25 bp, Mus musculus
ctccagggtcacctcagttttctca

SEQ ID NO: 344653 - DNA, 25 bp, Mus musculus
caacgttacaacgtcctcctggacg

SEQ ID NO: 344654 - DNA, 25 bp, Mus musculus
ctgtacaacgtgaatctccagggtc

SEQ ID NO: 344655 - DNA, 25 bp, Mus musculus
tttccaaagtcgcagcggaacctgc

SEQ ID NO: 344656 - DNA, 25 bp, Mus musculus
ctgcttctggaatgtagccggcttg

SEQ ID NO: 344657 - DNA, 25 bp, Mus musculus
ttgcgcccagcgatctggcttcggt

SEQ ID NO: 344658 - DNA, 25 bp, Mus musculus
tctgaagcggactaggaagaatgta

SEQ ID NO: 344659 - DNA, 25 bp, Mus musculus
gaatgtagtgattgactcagcgccc

SEQ ID NO: 344660 - DNA, 25 bp, Mus musculus
gtgatctgcgcgttcgcgaggacca

SEQ ID NO: 344661 - DNA, 25 bp, Mus musculus
tgctgcaaggactggagaggacacc

SEQ ID NO: 344662 - DNA, 25 bp, Mus musculus
ccaaaggtaactccgggcgcgcacg

SEQ ID NO: 344663 - DNA, 25 bp, Mus musculus
atgagcggcaggtccatcaagtcca

SEQ ID NO: 344664 - DNA, 25 bp, Mus musculus
atcaagtccaccgaggcacagggct

SEQ ID NO: 344665 - DNA, 25 bp, Mus musculus
agcacggcagtagcagaccggttcc

SEQ ID NO: 344666 - DNA, 25 bp, Mus musculus
ccgcctctgtcacagacttggacta

SEQ ID NO: 344667 - DNA, 25 bp, Mus musculus
agagatgaacgctcgggacaccagc

SEQ ID NO: 344668 - DNA, 25 bp, Mus musculus
gggcctgactcagacttttccaaag

SEQ ID NO: 344669 - DNA, 25 bp, Mus musculus
aactcaaagcgcctgataccgcggc

SEQ ID NO: 344670 - DNA, 25 bp, Mus musculus
tgctgcgaactcaaagcgcctgata

SEQ ID NO: 344671 - DNA, 25 bp, Mus musculus
accgggagctcccagcgctaagagc

SEQ ID NO: 344672 - DNA, 25 bp, Mus musculus
tcccagcgctaagagctgcctggca

SEQ ID NO: 344673 - DNA, 25 bp, Mus musculus
agctgcctggcaggaggtatcccag

SEQ ID NO: 344674 - DNA, 25 bp, Mus musculus
caggaggtatcccaggcactcgatc

SEQ ID NO: 344675 - DNA, 25 bp, Mus musculus
ggaggtatcccaggcactcgatcct

SEQ ID NO: 344676 - DNA, 25 bp, Mus musculus
aagacgctacctgtgcgcgtgccgg

SEQ ID NO: 344677 - DNA, 25 bp, Mus musculus
tacctgtgcgcgtgccgggcattcc

SEQ ID NO: 344678 - DNA, 25 bp, Mus musculus
gggctttctcgagctgccgcgcctg

SEQ ID NO: 344679 - DNA, 25 bp, Mus musculus
cgccctgccatctgcccgcctgctg

SEQ ID NO: 344680 - DNA, 25 bp, Mus musculus
tggctatatcgtgggagtcggggat

SEQ ID NO: 344681 - DNA, 25 bp, Mus musculus
cgggcaagacgctacctgtgcgcgt

SEQ ID NO: 344682 - DNA, 25 bp, Mus musculus
tggagagctgctgcgaactcaaagc

SEQ ID NO: 344683 - DNA, 25 bp, Mus musculus
cggccgctccgctgactaacagaga

SEQ ID NO: 344684 - DNA, 25 bp, Mus musculus
aaagtcaaaaggtcagcggcaggcg

SEQ ID NO: 344685 - DNA, 25 bp, Mus musculus
agaaaccgcccacagtcaaaacacg

SEQ ID NO: 344686 - DNA, 25 bp, Mus musculus
gtcgcttcggcccaacctcctccca

SEQ ID NO: 344687 - DNA, 25 bp, Mus musculus
cacctccgaacttgccgcccacccg

SEQ ID NO: 344688 - DNA, 25 bp, Mus musculus
cggcagtgcagccaacggcgacctg

SEQ ID NO: 344689 - DNA, 25 bp, Mus musculus
gccaacggcgacctggaagcccgta

SEQ ID NO: 344690 - DNA, 25 bp, Mus musculus
acctggaagcccgtagcggagaacg

SEQ ID NO: 344691 - DNA, 25 bp, Mus musculus
ccgtagcggagaacggcgccgtcct

SEQ ID NO: 344692 - DNA, 25 bp, Mus musculus
tcctgttcgcggctccgcgtttcgg

SEQ ID NO: 344693 - DNA, 25 bp, Mus musculus
gcacgcccgcccacgtcatcgcgca

SEQ ID NO: 344694 - DNA, 25 bp, Mus musculus
gcggcactcacgtccgcacaaagaa

SEQ ID NO: 344695 - DNA, 25 bp, Mus musculus
cccgcgacttgggcgtggctacact

SEQ ID NO: 344696 - DNA, 25 bp, Mus musculus
ggccgctactcaatcctgttcgcgg

SEQ ID NO: 344697 - DNA, 25 bp, Mus musculus
ccaaagccttcaggactggaaactc

SEQ ID NO: 344698 - DNA, 25 bp, Mus musculus
ccgctaggctgtagccggaagttgc

SEQ ID NO: 344699 - DNA, 25 bp, Mus musculus
gcaaggagccaatcgccggcgagcc

SEQ ID NO: 344700 - DNA, 25 bp, Mus musculus
agcacgtcacacgatggcggggcaa

SEQ ID NO: 344701 - DNA, 25 bp, Mus musculus
acagggctagggcagcacgtcacac

SEQ ID NO: 344702 - DNA, 25 bp, Mus musculus
ctccacacgtgggtccacagggcta

SEQ ID NO: 344703 - DNA, 25 bp, Mus musculus
catgatgaggcagggacaccctctc

SEQ ID NO: 344704 - DNA, 25 bp, Mus musculus
gagcaccgcggttttctcaccatga

SEQ ID NO: 344705 - DNA, 25 bp, Mus musculus
cacgcggccagtggcctaagtcagc

SEQ ID NO: 344706 - DNA, 25 bp, Mus musculus
agtgacaggactcggggcaccaagc

SEQ ID NO: 344707 - DNA, 25 bp, Mus musculus
cttctgcgtcacagggacggagtta

SEQ ID NO: 344708 - DNA, 25 bp, Mus musculus
tgagcccgcggtgacagaaccttcc

SEQ ID NO: 344709 - DNA, 25 bp, Mus musculus
ctaagtcagccgcagggagcggctc

SEQ ID NO: 344710 - DNA, 25 bp, Mus musculus
tcacagggacggagttacccaaagc

SEQ ID NO: 344711 - DNA, 25 bp, Mus musculus
tcccgatacctcgagtggggtcatc

SEQ ID NO: 344712 - DNA, 25 bp, Mus musculus
cgctgctacagagagccaatcccga

SEQ ID NO: 344713 - DNA, 25 bp, Mus musculus
atgctcggcgcacagcgctgctaca

SEQ ID NO: 344714 - DNA, 25 bp, Mus musculus
ctcaggatagccgtggtcgctggcc

SEQ ID NO: 344715 - DNA, 25 bp, Mus musculus
cggctgagctccacgcggctcagga

SEQ ID NO: 344716 - DNA, 25 bp, Mus musculus
tgcaaagtttgcagcgcgaggccgt

SEQ ID NO: 344717 - DNA, 25 bp, Mus musculus
acagaccgtctcttggcggcggcga

SEQ ID NO: 344718 - DNA, 25 bp, Mus musculus
aggcagcgacactccggagccggct

SEQ ID NO: 344719 - DNA, 25 bp, Mus musculus
ggctcagctgcaggcagcgacactc

SEQ ID NO: 344720 - DNA, 25 bp, Mus musculus
ggtcatccgggctgtccgagtccca

SEQ ID NO: 344721 - DNA, 25 bp, Mus musculus
cgctccgtgggctgcaaagtttgca

SEQ ID NO: 344722 - DNA, 25 bp, Mus musculus
ctgcggggctagtctccggctctcg

SEQ ID NO: 344723 - DNA, 25 bp, Mus musculus
accggggccacagaccgtctcttgg

SEQ ID NO: 344724 - DNA, 25 bp, Mus musculus
cgggctgtccgagtcccacagggac

SEQ ID NO: 344725 - DNA, 25 bp, Mus musculus
aggtatgggagcctttgcaggacac

SEQ ID NO: 344726 - DNA, 25 bp, Mus musculus
tgctgccgggcaatgtgggctacct

SEQ ID NO: 344727 - DNA, 25 bp, Mus musculus
aatgtgggctacctgcgctttgata

SEQ ID NO: 344728 - DNA, 25 bp, Mus musculus
gggctacctgcgctttgatagattt

SEQ ID NO: 344729 - DNA, 25 bp, Mus musculus
tttgatagatttgcagacgccgctg

SEQ ID NO: 344730 - DNA, 25 bp, Mus musculus
tagatttgcagacgccgctgtgctg

SEQ ID NO: 344731 - DNA, 25 bp, Mus musculus
agacgctgggcccttacgtgctgaa

SEQ ID NO: 344732 - DNA, 25 bp, Mus musculus
gcccttacgtgctgaagcaggtatg

SEQ ID NO: 344733 - DNA, 25 bp, Mus musculus
cctttgcaggacacggaacacctca

SEQ ID NO: 344734 - DNA, 25 bp, Mus musculus
ggaacacctcatcatggacctgcgt

SEQ ID NO: 344735 - DNA, 25 bp, Mus musculus
atggacctgcgtcataaccctgggg

SEQ ID NO: 344736 - DNA, 25 bp, Mus musculus
tccggcctcggcgatgcctctggtg

SEQ ID NO: 344737 - DNA, 25 bp, Mus musculus
gcctctggtgctgtccgacttccag

SEQ ID NO: 344738 - DNA, 25 bp, Mus musculus
gctgtccgacttccagggacctgga

SEQ ID NO: 344739 - DNA, 25 bp, Mus musculus
ggggcgcatctcacctgggctctct

SEQ ID NO: 344740 - DNA, 25 bp, Mus musculus
tcagcaaggcaggttgagtgtacca

SEQ ID NO: 344741 - DNA, 25 bp, Mus musculus
tcgcagcatcagcaaggcaggttga

SEQ ID NO: 344742 - DNA, 25 bp, Mus musculus
tctctcgcagcatcagcaaggcagg

SEQ ID NO: 344743 - DNA, 25 bp, Mus musculus
tgggctctctcgcagcatcagcaag

SEQ ID NO: 344744 - DNA, 25 bp, Mus musculus
agtctgtccggtgagtctgtcccgt

SEQ ID NO: 344745 - DNA, 25 bp, Mus musculus
cccggtgagtctgtccggtgagtct

SEQ ID NO: 344746 - DNA, 25 bp, Mus musculus
aaggcaggttgagtgtaccagctgc

SEQ ID NO: 344747 - DNA, 25 bp, Mus musculus
cgtgcgtgttgttgaacttggctgc

SEQ ID NO: 344748 - DNA, 25 bp, Mus musculus
ctgcgggtccttcagcgtgcgtgtt

SEQ ID NO: 344749 - DNA, 25 bp, Mus musculus
cggtgagtctgtcccgtaggaccgc

SEQ ID NO: 344750 - DNA, 25 bp, Mus musculus
ccttcagcgtgcgtgttgttgaact

SEQ ID NO: 344751 - DNA, 25 bp, Mus musculus
ctcgagggcgggaccttcaagcccg

SEQ ID NO: 344752 - DNA, 25 bp, Mus musculus
ttcaagcccgtagagggtcctcacc

SEQ ID NO: 344753 - DNA, 25 bp, Mus musculus
tcgccaagatggagccgcactgggt

SEQ ID NO: 344754 - DNA, 25 bp, Mus musculus
gcctcttcacggctcagcgtcccgg

SEQ ID NO: 344755 - DNA, 25 bp, Mus musculus
ggggcgactcactcacctaggcgcg

SEQ ID NO: 344756 - DNA, 25 bp, Mus musculus
agctgtcaccggtacccggagcagg

SEQ ID NO: 344757 - DNA, 25 bp, Mus musculus
cagaaggggaagctgtcaccggtac

SEQ ID NO: 344758 - DNA, 25 bp, Mus musculus
agcctgcgctgccaagggccagaag

SEQ ID NO: 344759 - DNA, 25 bp, Mus musculus
gatggagccgcactgggtctagccc

SEQ ID NO: 344760 - DNA, 25 bp, Mus musculus
tgcccgtcgccaagatggagccgca

SEQ ID NO: 344761 - DNA, 25 bp, Mus musculus
ccacaggtgcccgtcgccaagatgg

SEQ ID NO: 344762 - DNA, 25 bp, Mus musculus
ctgtcgcctccagggccgcaaaggc

SEQ ID NO: 344763 - DNA, 25 bp, Mus musculus
cggctcgtgttgagccagcctctca

SEQ ID NO: 344764 - DNA, 25 bp, Mus musculus
caaccgtgcggaggaatgcggcgca

SEQ ID NO: 344765 - DNA, 25 bp, Mus musculus
gagactgggcaaagggaacgtggaa

SEQ ID NO: 344766 - DNA, 25 bp, Mus musculus
cagcacccaccacggctcgtgttga

SEQ ID NO: 344767 - DNA, 25 bp, Mus musculus
ctgcgagctccggtctttacagctc

SEQ ID NO: 344768 - DNA, 25 bp, Mus musculus
catcgtagaggacaagctggtggaa

SEQ ID NO: 344769 - DNA, 25 bp, Mus musculus
tcatcgaaggctaccgggcccagca

SEQ ID NO: 344770 - DNA, 25 bp, Mus musculus
cctgcaagggaggtgagcgccctcc

SEQ ID NO: 344771 - DNA, 25 bp, Mus musculus
agacaagcaggaagccgcggcttaa

SEQ ID NO: 344772 - DNA, 25 bp, Mus musculus
gatcatcaagccctgcaaccatgtg

SEQ ID NO: 344773 - DNA, 25 bp, Mus musculus
ccatgtaccgccgtctgggcgaagc

SEQ ID NO: 344774 - DNA, 25 bp, Mus musculus
agggcttcttcgaccgcggcgccag

SEQ ID NO: 344775 - DNA, 25 bp, Mus musculus
tgcaaccatgtgttgagcctctcct

SEQ ID NO: 344776 - DNA, 25 bp, Mus musculus
gtgcgcggcatcctgaggatcatca

SEQ ID NO: 344777 - DNA, 25 bp, Mus musculus
cggcgccagcatcgtagaggacaag

SEQ ID NO: 344778 - DNA, 25 bp, Mus musculus
cttcaagatggtggagggcttcttc

SEQ ID NO: 344779 - DNA, 25 bp, Mus musculus
gggctctgcggctgcagactcagcc

SEQ ID NO: 344780 - DNA, 25 bp, Mus musculus
ctcctgggaggtcatcgaaggctac

SEQ ID NO: 344781 - DNA, 25 bp, Mus musculus
ggatcccgagaaactcatcctccgg

SEQ ID NO: 344782 - DNA, 25 bp, Mus musculus
gatcggttgcccgtctcgtagttgt

SEQ ID NO: 344783 - DNA, 25 bp, Mus musculus
tgcgaaggcgaacaaaagggcaagc

SEQ ID NO: 344784 - DNA, 25 bp, Mus musculus
gccgtacagtcgtcgtctcgcgcgg

SEQ ID NO: 344785 - DNA, 25 bp, Mus musculus
cggcgggcaagcagattccaatctc

SEQ ID NO: 344786 - DNA, 25 bp, Mus musculus
agccgcggaggacgctcgctcgttc

SEQ ID NO: 344787 - DNA, 25 bp, Mus musculus
cggacacgaaccgagccgagagctc

SEQ ID NO: 344788 - DNA, 25 bp, Mus musculus
caaagctgcgtgaagtggacgatgc

SEQ ID NO: 344789 - DNA, 25 bp, Mus musculus
actccttctagagccggagctcggg

SEQ ID NO: 344790 - DNA, 25 bp, Mus musculus
cccgtctcgtagttgtggttgcaaa

SEQ ID NO: 344791 - DNA, 25 bp, Mus musculus
gtggttgcaaagaaagatgtaaggc

SEQ ID NO: 344792 - DNA, 25 bp, Mus musculus
gatgtaaggcacactgcattcatta

SEQ ID NO: 344793 - DNA, 25 bp, Mus musculus
aggcacactgcattcattactcacc

SEQ ID NO: 344794 - DNA, 25 bp, Mus musculus
gacgatgcgggcacactccttctag

SEQ ID NO: 344795 - DNA, 25 bp, Mus musculus
aaaggccttggctcctgccggtctc

SEQ ID NO: 344796 - DNA, 25 bp, Mus musculus
gctccaaatgccgtaagaaacctga

SEQ ID NO: 344797 - DNA, 25 bp, Mus musculus
agaaacctgatatcccatctccgag

SEQ ID NO: 344798 - DNA, 25 bp, Mus musculus
ccgggctgttgctatttctacgtga

SEQ ID NO: 344799 - DNA, 25 bp, Mus musculus
agccggttcgaattagaaggtgata

SEQ ID NO: 344800 - DNA, 25 bp, Mus musculus
aggtgatatttcatctctaattggc

SEQ ID NO: 344801 - DNA, 25 bp, Mus musculus
ctaattggcacgttcaaagggctcc

SEQ ID NO: 344802 - DNA, 25 bp, Mus musculus
aaagggctcctatcgcacttggcgg

SEQ ID NO: 344803 - DNA, 25 bp, Mus musculus
gatctgagtcacttagcccgggcta

SEQ ID NO: 344804 - DNA, 25 bp, Mus musculus
tctggggaaacggatgcccagccca

SEQ ID NO: 344805 - DNA, 25 bp, Mus musculus
ccagagataagatgccggctcgaac

SEQ ID NO: 344806 - DNA, 25 bp, Mus musculus
acccagcctccctggagagaaggaa

SEQ ID NO: 344807 - DNA, 25 bp, Mus musculus
tccaggcagggatgagttaacgtct

SEQ ID NO: 344808 - DNA, 25 bp, Mus musculus
ttaacgtctgcacagtctgggaacc

SEQ ID NO: 344809 - DNA, 25 bp, Mus musculus
ctccggctacttgatttgacttctc

SEQ ID NO: 344810 - DNA, 25 bp, Mus musculus
gaaacgattgacacagctgcctgca

SEQ ID NO: 344811 - DNA, 25 bp, Mus musculus
gcgcaaatggcgttgagatggttca

SEQ ID NO: 344812 - DNA, 25 bp, Mus musculus
ccacgcggtccgaccaatggtggta

SEQ ID NO: 344813 - DNA, 25 bp, Mus musculus
ccttgcggaagagagaactacaact

SEQ ID NO: 344814 - DNA, 25 bp, Mus musculus
cgggctttagacaccaggaccttgc

SEQ ID NO: 344815 - DNA, 25 bp, Mus musculus
gccagctccggaaccgggctttaga

SEQ ID NO: 344816 - DNA, 25 bp, Mus musculus
agcaggcccttagccagaacctata

SEQ ID NO: 344817 - DNA, 25 bp, Mus musculus
agcgctgaccattcaccggcggagg

SEQ ID NO: 344818 - DNA, 25 bp, Mus musculus
ttcctatttaccgaagcggagccgc

SEQ ID NO: 344819 - DNA, 25 bp, Mus musculus
ggctcgttgctcacctggcttctaa

SEQ ID NO: 344820 - DNA, 25 bp, Mus musculus
gcttctaaggaagttgggcaccgga

SEQ ID NO: 344821 - DNA, 25 bp, Mus musculus
ggccctgttcaaactccagcgctga

SEQ ID NO: 344822 - DNA, 25 bp, Mus musculus
ccggaggatcgcaagaaactctttc

SEQ ID NO: 344823 - DNA, 25 bp, Mus musculus
cgggaacctgcgtgtccaggtgtcc

SEQ ID NO: 344824 - DNA, 25 bp, Mus musculus
agcttggatgtctgtctgggctgtc

SEQ ID NO: 344825 - DNA, 25 bp, Mus musculus
cagcttggatgtctgtctgggctgt

SEQ ID NO: 344826 - DNA, 25 bp, Mus musculus
gctttgcgctcctgagcccctccca

SEQ ID NO: 344827 - DNA, 25 bp, Mus musculus
acccgctctgaagcgcatgagtgca

SEQ ID NO: 344828 - DNA, 25 bp, Mus musculus
cagaatccgccaccacacctgtctc

SEQ ID NO: 344829 - DNA, 25 bp, Mus musculus
gccacccgctctgaagcgcatgagt

SEQ ID NO: 344830 - DNA, 25 bp, Mus musculus
gcttggatgtctgtctgggctgtct

SEQ ID NO: 344831 - DNA, 25 bp, Mus musculus
ccacccgctctgaagcgcatgagtg

SEQ ID NO: 344832 - DNA, 25 bp, Mus musculus
cacccgctctgaagcgcatgagtgc

SEQ ID NO: 344833 - DNA, 25 bp, Mus musculus
tgctgtgtccacaggactccgggtc

SEQ ID NO: 344834 - DNA, 25 bp, Mus musculus
ttcggatgagccctatgactttggc

SEQ ID NO: 344835 - DNA, 25 bp, Mus musculus
atgactgccctcgtgcgtggtcagc

SEQ ID NO: 344836 - DNA, 25 bp, Mus musculus
gtcagagtatccaccacgcaccgtg

SEQ ID NO: 344837 - DNA, 25 bp, Mus musculus
cccagaggagtgcatccgcccaagt

SEQ ID NO: 344838 - DNA, 25 bp, Mus musculus
gcacgtctccgctctgatcttgatt

SEQ ID NO: 344839 - DNA, 25 bp, Mus musculus
cttgattttcctggaggtcgaccca

SEQ ID NO: 344840 - DNA, 25 bp, Mus musculus
cttggccgaggctttctcgactgta

SEQ ID NO: 344841 - DNA, 25 bp, Mus musculus
ctttctcgactgtagcgggcactgt

SEQ ID NO: 344842 - DNA, 25 bp, Mus musculus
gacatgcgcagtcggccagccagaa

SEQ ID NO: 344843 - DNA, 25 bp, Mus musculus
tcacatggcgcaagactctcaacgc

SEQ ID NO: 344844 - DNA, 25 bp, Mus musculus
tcgcgcgacgagttccgcatcttta

SEQ ID NO: 344845 - DNA, 25 bp, Mus musculus
acgcggatccagctcacatggcgca

SEQ ID NO: 344846 - DNA, 25 bp, Mus musculus
cgaggtcacccgaatgctgtgtcca

SEQ ID NO: 344847 - DNA, 25 bp, Mus musculus
cggtgcacttctttcctggcacgac

SEQ ID NO: 344848 - DNA, 25 bp, Mus musculus
gtgcacttctttcctggcacgacct

SEQ ID NO: 344849 - DNA, 25 bp, Mus musculus
agtacatctccaggtttcgcgcgcc

SEQ ID NO: 344850 - DNA, 25 bp, Mus musculus
agagcgagtacatctccaggtttcg

SEQ ID NO: 344851 - DNA, 25 bp, Mus musculus
ctgcggagaagagcgagtacatctc

SEQ ID NO: 344852 - DNA, 25 bp, Mus musculus
gactgcggagaagagcgagtacatc

SEQ ID NO: 344853 - DNA, 25 bp, Mus musculus
cgggctcctgcgtcagtggcacgca

SEQ ID NO: 344854 - DNA, 25 bp, Mus musculus
gccatccggtgcacttctttcctgg

SEQ ID NO: 344855 - DNA, 25 bp, Mus musculus
ctgcgcggacaagactggcgtcagt

SEQ ID NO: 344856 - DNA, 25 bp, Mus musculus
acgtcatgaccgagagcgaggctgc

SEQ ID NO: 344857 - DNA, 25 bp, Mus musculus
atgacgtcatgaccgagagcgaggc

SEQ ID NO: 344858 - DNA, 25 bp, Mus musculus
cggaggccggaacctgcgtgagtgc

SEQ ID NO: 344859 - DNA, 25 bp, Mus musculus
cagggtgatgacgtcatgaccgaga

SEQ ID NO: 344860 - DNA, 25 bp, Mus musculus
ctgcgcacgggctcctgcgtcagtg

SEQ ID NO: 344861 - DNA, 25 bp, Mus musculus
aagcgttgacgctgtggcttcttcc

SEQ ID NO: 344862 - DNA, 25 bp, Mus musculus
tcagggacaggactgcaaaatctcg

SEQ ID NO: 344863 - DNA, 25 bp, Mus musculus
gccacctaatagagccgatgatgcg

SEQ ID NO: 344864 - DNA, 25 bp, Mus musculus
catcatccacatcggtgagctggga

SEQ ID NO: 344865 - DNA, 25 bp, Mus musculus
gctgtggcttcttccctggatatgc

SEQ ID NO: 344866 - DNA, 25 bp, Mus musculus
cgcgcggctaggctaaggctccgca

SEQ ID NO: 344867 - DNA, 25 bp, Mus musculus
aggctcgccgcagacagaccaagtc

SEQ ID NO: 344868 - DNA, 25 bp, Mus musculus
tttctccagcgaacccagaggccgg

SEQ ID NO: 344869 - DNA, 25 bp, Mus musculus
tgtgcctactccgtttctccagcga

SEQ ID NO: 344870 - DNA, 25 bp, Mus musculus
actgcaaaatctcggctgaagtccc

SEQ ID NO: 344871 - DNA, 25 bp, Mus musculus
tgatccgttctggtcagggacagga

SEQ ID NO: 344872 - DNA, 25 bp, Mus musculus
cccggtctgtagtctctttgcaggc

SEQ ID NO: 344873 - DNA, 25 bp, Mus musculus
tggatatgccagtgcgttacggtgc

SEQ ID NO: 344874 - DNA, 25 bp, Mus musculus
agggtagtcgatggctgtgcctact

SEQ ID NO: 344875 - DNA, 25 bp, Mus musculus
tgcggtctgggcaagcagagagcct

SEQ ID NO: 344876 - DNA, 25 bp, Mus musculus
ggtctttgtttctcgcgtgtttgtg

SEQ ID NO: 344877 - DNA, 25 bp, Mus musculus
cgctaccgagcaggcgtgtggctca

SEQ ID NO: 344878 - DNA, 25 bp, Mus musculus
tctgcgccgctaccgagcaggcgtg

SEQ ID NO: 344879 - DNA, 25 bp, Mus musculus
tgcgcgtgtgcgctctgcgccgcta

SEQ ID NO: 344880 - DNA, 25 bp, Mus musculus
tctttccggccaggtggatgcgcgt

SEQ ID NO: 344881 - DNA, 25 bp, Mus musculus
tgtggcttctttccggccaggtgga

SEQ ID NO: 344882 - DNA, 25 bp, Mus musculus
actgtgtggcttctttccggccagg

SEQ ID NO: 344883 - DNA, 25 bp, Mus musculus
aggactgtgtggcttctttccggcc

SEQ ID NO: 344884 - DNA, 25 bp, Mus musculus
gctctcctggcaggactgtgtggct

SEQ ID NO: 344885 - DNA, 25 bp, Mus musculus
tacgcacctcaaacggctctcctgg

SEQ ID NO: 344886 - DNA, 25 bp, Mus musculus
agagagcctctacgcacctcaaacg

SEQ ID NO: 344887 - DNA, 25 bp, Mus musculus
tgggtgtgtcttcgtgtcgggttcc

SEQ ID NO: 344888 - DNA, 25 bp, Mus musculus
gcagagagcctctacgcacctcaaa

SEQ ID NO: 344889 - DNA, 25 bp, Mus musculus
cgggcccgcgaacagagcatgaaat

SEQ ID NO: 344890 - DNA, 25 bp, Mus musculus
gcagcctatgctgcgctagcggccg

SEQ ID NO: 344891 - DNA, 25 bp, Mus musculus
ccggcgttcccacaaacgcagccta

SEQ ID NO: 344892 - DNA, 25 bp, Mus musculus
ataaatcggctctctctcggcgcgg

SEQ ID NO: 344893 - DNA, 25 bp, Mus musculus
ttctccagcataaatcggctctctc

SEQ ID NO: 344894 - DNA, 25 bp, Mus musculus
gatgttttctccagcataaatcggc

SEQ ID NO: 344895 - DNA, 25 bp, Mus musculus
tcaccctcagaacaaagatgttttc

SEQ ID NO: 344896 - DNA, 25 bp, Mus musculus
cccttcaccctcagaacaaagatgt

SEQ ID NO: 344897 - DNA, 25 bp, Mus musculus
cccgcgaacagagcatgaaattgtt

SEQ ID NO: 344898 - DNA, 25 bp, Mus musculus
gcctcgaagaacaagcctctcgctg

SEQ ID NO: 344899 - DNA, 25 bp, Mus musculus
tgcggctctgcctcgaagaacaagc

SEQ ID NO: 344900 - DNA, 25 bp, Mus musculus
gcctcattatgtgcggctctgcctc

SEQ ID NO: 344901 - DNA, 25 bp, Mus musculus
cgccagtgagaagcctcattatgtg

SEQ ID NO: 344902 - DNA, 25 bp, Mus musculus
catgaaattgttggaaatggctccc

SEQ ID NO: 344903 - DNA, 25 bp, Mus musculus
tccgagggtcgtcccagagcgctgc

SEQ ID NO: 344904 - DNA, 25 bp, Mus musculus
cctccagggccctcgcactacgcgt

SEQ ID NO: 344905 - DNA, 25 bp, Mus musculus
tcgccctgatttcccggtgcaggaa

SEQ ID NO: 344906 - DNA, 25 bp, Mus musculus
caggaaggctgcagcccgggcatcc

SEQ ID NO: 344907 - DNA, 25 bp, Mus musculus
gcgcgagtctcactggactagaccc

SEQ ID NO: 344908 - DNA, 25 bp, Mus musculus
cgcctcccggtctgtccttgcgcag

SEQ ID NO: 344909 - DNA, 25 bp, Mus musculus
taggccggcaccctcctggactccg

SEQ ID NO: 344910 - DNA, 25 bp, Mus musculus
ggcagttccgtcacatcccggtctg

SEQ ID NO: 344911 - DNA, 25 bp, Mus musculus
aggcgagaggcagttccgtcacatc

SEQ ID NO: 344912 - DNA, 25 bp, Mus musculus
ccgtgcggaggtcgcgttgcctcct

SEQ ID NO: 344913 - DNA, 25 bp, Mus musculus
cgactctcaccgtgcggaggtcgcg

SEQ ID NO: 344914 - DNA, 25 bp, Mus musculus
cgtcccagagcgctgctggccaagg

SEQ ID NO: 344915 - DNA, 25 bp, Mus musculus
agcaccaccgagcaggggcatccgg

SEQ ID NO: 344916 - DNA, 25 bp, Mus musculus
caggcgcgagtctcactggactaga

SEQ ID NO: 344917 - DNA, 25 bp, Mus musculus
ccgacactggcaaacgctttgggca

SEQ ID NO: 344918 - DNA, 25 bp, Mus musculus
cagcgtcctttctgggtccgagtaa

SEQ ID NO: 344919 - DNA, 25 bp, Mus musculus
gtgtttcgaaaacgtcacagtcagc

SEQ ID NO: 344920 - DNA, 25 bp, Mus musculus
tggagaccggaccaatggaagtttg

SEQ ID NO: 344921 - DNA, 25 bp, Mus musculus
gcagccaatcgagagcaggcttcta

SEQ ID NO: 344922 - DNA, 25 bp, Mus musculus
gcgcgactcacagcgtcacgcaata

SEQ ID NO: 344923 - DNA, 25 bp, Mus musculus
ttccgggtcaccgaaactcagagtg

SEQ ID NO: 344924 - DNA, 25 bp, Mus musculus
cgaggcagtacctcagctccggtca

SEQ ID NO: 344925 - DNA, 25 bp, Mus musculus
ctggaattctcaggcctcgcgaggc

SEQ ID NO: 344926 - DNA, 25 bp, Mus musculus
acgcttccttgagcttgagtgttcg

SEQ ID NO: 344927 - DNA, 25 bp, Mus musculus
tagtggcgacccttcctaacgcttc

SEQ ID NO: 344928 - DNA, 25 bp, Mus musculus
ctgggtctctacgaactagtggcga

SEQ ID NO: 344929 - DNA, 25 bp, Mus musculus
cgacgcccgtcacaaggactggaat

SEQ ID NO: 344930 - DNA, 25 bp, Mus musculus
aaactcagagtgtgcgacctccctc

SEQ ID NO: 344931 - DNA, 25 bp, Mus musculus
cgtgaccgctgctccaagcgttttc

SEQ ID NO: 344932 - DNA, 25 bp, Mus musculus
ctcggtcaacgctctccgggagaaa

SEQ ID NO: 344933 - DNA, 25 bp, Mus musculus
tgaggtgcacctgttcttcagccgg

SEQ ID NO: 344934 - DNA, 25 bp, Mus musculus
tacgcagcgttgcacggtggttact

SEQ ID NO: 344935 - DNA, 25 bp, Mus musculus
tgggcgccgacaagccgcattccga

SEQ ID NO: 344936 - DNA, 25 bp, Mus musculus
ctgatgctgccttggatgctgatgc

SEQ ID NO: 344937 - DNA, 25 bp, Mus musculus
accagcacgcagaggataccaaaca

SEQ ID NO: 344938 - DNA, 25 bp, Mus musculus
cccgggctagcaaaaatgggagata

SEQ ID NO: 344939 - DNA, 25 bp, Mus musculus
gcggcggccgcatgcaaatcggctc

SEQ ID NO: 344940 - DNA, 25 bp, Mus musculus
gctctccgggagaaaccaatcctag

SEQ ID NO: 344941 - DNA, 25 bp, Mus musculus
ccgtgagtcaaactccagcaagcta

SEQ ID NO: 344942 - DNA, 25 bp, Mus musculus
aagcgttttcttgcactcaaccagg

SEQ ID NO: 344943 - DNA, 25 bp, Mus musculus
ccaatcctagagcagcgcggagggc

SEQ ID NO: 344944 - DNA, 25 bp, Mus musculus
cttgcactcaaccaggcggcttcgg

SEQ ID NO: 344945 - DNA, 25 bp, Mus musculus
gccgcagagttgagcgctcggccaa

SEQ ID NO: 344946 - DNA, 25 bp, Mus musculus
ctttgtccggctctgggcggtgccc

SEQ ID NO: 344947 - DNA, 25 bp, Mus musculus
ttccgccctctctgtggctcccgga

SEQ ID NO: 344948 - DNA, 25 bp, Mus musculus
gctcccggacgctggcgaagtcgat

SEQ ID NO: 344949 - DNA, 25 bp, Mus musculus
acgctggcgaagtcgatcgcttgtg

SEQ ID NO: 344950 - DNA, 25 bp, Mus musculus
aagtcgatcgcttgtggccgcagag

SEQ ID NO: 344951 - DNA, 25 bp, Mus musculus
agagttgagcgctcggccaagttac

SEQ ID NO: 344952 - DNA, 25 bp, Mus musculus
tcggccaagttacgccgcgcaaatg

SEQ ID NO: 344953 - DNA, 25 bp, Mus musculus
gcaaatgctcctctggtattagctc

SEQ ID NO: 344954 - DNA, 25 bp, Mus musculus
gctcctctggtattagctcttaacc

SEQ ID NO: 344955 - DNA, 25 bp, Mus musculus
tattagctcttaacccggcgggagc

SEQ ID NO: 344956 - DNA, 25 bp, Mus musculus
taatgaggcggatcgctgacccgcc

SEQ ID NO: 344957 - DNA, 25 bp, Mus musculus
tcatccataggtaatgaggcggatc

SEQ ID NO: 344958 - DNA, 25 bp, Mus musculus
ccgccctacaaatggtcatccatag

SEQ ID NO: 344959 - DNA, 25 bp, Mus musculus
tcagcgaggccacgcgttctactta

SEQ ID NO: 344960 - DNA, 25 bp, Mus musculus
aaagacaggcccgacgcttcagcga

SEQ ID NO: 344961 - DNA, 25 bp, Mus musculus
ggccggcccgagacaataaagacag

SEQ ID NO: 344962 - DNA, 25 bp, Mus musculus
cgctgtcccgagaggacgctcacga

SEQ ID NO: 344963 - DNA, 25 bp, Mus musculus
gcgttctacttacccgggcgcggca

SEQ ID NO: 344964 - DNA, 25 bp, Mus musculus
ggagcagacacaccttccgggtagc

SEQ ID NO: 344965 - DNA, 25 bp, Mus musculus
agcaagttcagcagctccgagcggg

SEQ ID NO: 344966 - DNA, 25 bp, Mus musculus
aataaagagccttccgctgggttcg

SEQ ID NO: 344967 - DNA, 25 bp, Mus musculus
tccgggaccggagctgaataaagag

SEQ ID NO: 344968 - DNA, 25 bp, Mus musculus
ccgcgacagcgtgcacattcagggt

SEQ ID NO: 344969 - DNA, 25 bp, Mus musculus
ccttaaactcttgccggacagcgtg

SEQ ID NO: 344970 - DNA, 25 bp, Mus musculus
cgactagcaccgagaagccaggatc

SEQ ID NO: 344971 - DNA, 25 bp, Mus musculus
gcgggcggtctcagcagacaaagcc

SEQ ID NO: 344972 - DNA, 25 bp, Mus musculus
ttggccgaggaagttagagcaagtt

SEQ ID NO: 344973 - DNA, 25 bp, Mus musculus
acgccactttcacgtgacagacacg

SEQ ID NO: 344974 - DNA, 25 bp, Mus musculus
gaggatcgggtcacatcctctatcc

SEQ ID NO: 344975 - DNA, 25 bp, Mus musculus
tctatccagcatctagtctccgcgg

SEQ ID NO: 344976 - DNA, 25 bp, Mus musculus
agcatctagtctccgcggtccctgg

SEQ ID NO: 344977 - DNA, 25 bp, Mus musculus
tggcctgcctcgatcctcacctgcg

SEQ ID NO: 344978 - DNA, 25 bp, Mus musculus
caggtgcctcctcggttgtagtgca

SEQ ID NO: 344979 - DNA, 25 bp, Mus musculus
aagcgtggagtctgtcctgatcgct

SEQ ID NO: 344980 - DNA, 25 bp, Mus musculus
ctcctcggttgtagtgcagttttga

SEQ ID NO: 344981 - DNA, 25 bp, Mus musculus
gcagctcagcgcctacgccaccacg

SEQ ID NO: 344982 - DNA, 25 bp, Mus musculus
cccgcagctccagactggggactgg

SEQ ID NO: 344983 - DNA, 25 bp, Mus musculus
gggcacttctttgctcgctgatttc

SEQ ID NO: 344984 - DNA, 25 bp, Mus musculus
gtcgccttcgggcacttctttgctc

SEQ ID NO: 344985 - DNA, 25 bp, Mus musculus
tggagtctgtcctgatcgctgtggt

SEQ ID NO: 344986 - DNA, 25 bp, Mus musculus
gactgggtagaactgggtcgccttc

SEQ ID NO: 344987 - DNA, 25 bp, Mus musculus
cgagcgatcagctcctagagccttt

SEQ ID NO: 344988 - DNA, 25 bp, Mus musculus
agcgatcagctcctagagcctttgc

SEQ ID NO: 344989 - DNA, 25 bp, Mus musculus
atcagctcctagagcctttgctgcc

SEQ ID NO: 344990 - DNA, 25 bp, Mus musculus
gatcagctcctagagcctttgctgc

SEQ ID NO: 344991 - DNA, 25 bp, Mus musculus
cgatcagctcctagagcctttgctg

SEQ ID NO: 344992 - DNA, 25 bp, Mus musculus
ccatggcacagtggcgagcgatcag

SEQ ID NO: 344993 - DNA, 25 bp, Mus musculus
gagcgatcagctcctagagcctttg

SEQ ID NO: 344994 - DNA, 25 bp, Mus musculus
gcgagcgatcagctcctagagcctt

SEQ ID NO: 344995 - DNA, 25 bp, Mus musculus
cagtggcgagcgatcagctcctaga

SEQ ID NO: 344996 - DNA, 25 bp, Mus musculus
acagtggcgagcgatcagctcctag

SEQ ID NO: 344997 - DNA, 25 bp, Mus musculus
gcacagtggcgagcgatcagctcct

SEQ ID NO: 344998 - DNA, 25 bp, Mus musculus
ggcacagtggcgagcgatcagctcc

SEQ ID NO: 344999 - DNA, 25 bp, Mus musculus
tggcacagtggcgagcgatcagctc

SEQ ID NO: 345000 - DNA, 25 bp, Mus musculus
gcgatcagctcctagagcctttgct

SEQ ID NO: 345001 - DNA, 25 bp, Mus musculus
gctagagtccactgacttttccgcc

SEQ ID NO: 345002 - DNA, 25 bp, Mus musculus
gtgcgttcttgtgggaactgcgcct

SEQ ID NO: 345003 - DNA, 25 bp, Mus musculus
tactgcatcgcgcagccttcggaga

SEQ ID NO: 345004 - DNA, 25 bp, Mus musculus
aatcctgtgcgcgtgcgttcttgtg

SEQ ID NO: 345005 - DNA, 25 bp, Mus musculus
gcgtcgtccttctccctccctgaag

SEQ ID NO: 345006 - DNA, 25 bp, Mus musculus
aaggccgcctcgcttgcccagtgtg

SEQ ID NO: 345007 - DNA, 25 bp, Mus musculus
gttgcccgcctcactgcttcgtcac

SEQ ID NO: 345008 - DNA, 25 bp, Mus musculus
ggcctgcgccgcctgatgcttcagg

SEQ ID NO: 345009 - DNA, 25 bp, Mus musculus
cctgatgcttcaggcgcgtacatac

SEQ ID NO: 345010 - DNA, 25 bp, Mus musculus
tcaggcgcgtacatacgccgaggcc

SEQ ID NO: 345011 - DNA, 25 bp, Mus musculus
gccgggcccggacagatgtccttca

SEQ ID NO: 345012 - DNA, 25 bp, Mus musculus
gacagatgtccttcacctttgcctc

SEQ ID NO: 345013 - DNA, 25 bp, Mus musculus
gcgcagccttcggagaatcctgtgc

SEQ ID NO: 345014 - DNA, 25 bp, Mus musculus
gacttttccgccaccatgttgcccg

SEQ ID NO: 345015 - DNA, 25 bp, Mus musculus
ttgcgagtcataacccggaggcgga

SEQ ID NO: 345016 - DNA, 25 bp, Mus musculus
caggtggccagaacgtgcatcagct

SEQ ID NO: 345017 - DNA, 25 bp, Mus musculus
gacgcgactcactggcaggtggcca

SEQ ID NO: 345018 - DNA, 25 bp, Mus musculus
agcgtgctctcgttgccaggcaacg

SEQ ID NO: 345019 - DNA, 25 bp, Mus musculus
acacttgagcgtgctctcgttgcca

SEQ ID NO: 345020 - DNA, 25 bp, Mus musculus
tagcgctacacttgagcgtgctctc

SEQ ID NO: 345021 - DNA, 25 bp, Mus musculus
aacgtgcatcagctgcgtggaccaa

SEQ ID NO: 345022 - DNA, 25 bp, Mus musculus
atcagctgcgtggaccaaggaggct

SEQ ID NO: 345023 - DNA, 25 bp, Mus musculus
tccttcgaaccggttctctagtgtc

SEQ ID NO: 345024 - DNA, 25 bp, Mus musculus
gaaccggttctctagtgtctctgca

SEQ ID NO: 345025 - DNA, 25 bp, Mus musculus
tctctagtgtctctgcagaagcagt

SEQ ID NO: 345026 - DNA, 25 bp, Mus musculus
gtgtctctgcagaagcagttgtcaa

SEQ ID NO: 345027 - DNA, 25 bp, Mus musculus
ttcaccttgcgagtcataacccgga

SEQ ID NO: 345028 - DNA, 25 bp, Mus musculus
tcaaattttcaccttgcgagtcata

SEQ ID NO: 345029 - DNA, 25 bp, Mus musculus
acggacactcctaggccctccaaga

SEQ ID NO: 345030 - DNA, 25 bp, Mus musculus
agccggtgcttgtcttcagcggctc

SEQ ID NO: 345031 - DNA, 25 bp, Mus musculus
tgcttgtcttcagcggctctgaccg

SEQ ID NO: 345032 - DNA, 25 bp, Mus musculus
ggctctgaccgctacacccgtaaaa

SEQ ID NO: 345033 - DNA, 25 bp, Mus musculus
gttcgcgccctttcatagggacggc

SEQ ID NO: 345034 - DNA, 25 bp, Mus musculus
gcgccctttcatagggacggcggca

SEQ ID NO: 345035 - DNA, 25 bp, Mus musculus
agactgccgggcatcaagctttgcc

SEQ ID NO: 345036 - DNA, 25 bp, Mus musculus
gcagggcgtctcagcctctgcggtc

SEQ ID NO: 345037 - DNA, 25 bp, Mus musculus
tcaccgcactggagcggaccacgct

SEQ ID NO: 345038 - DNA, 25 bp, Mus musculus
cgtcagtctccctgcgggtcaaagc

SEQ ID NO: 345039 - DNA, 25 bp, Mus musculus
aaacgtggccggaccaacgcctctg

SEQ ID NO: 345040 - DNA, 25 bp, Mus musculus
cctccaagaccctgcccggccagac

SEQ ID NO: 345041 - DNA, 25 bp, Mus musculus
gccaggccaaacgtggccggaccaa

SEQ ID NO: 345042 - DNA, 25 bp, Mus musculus
gggcatcaagctttgccgcccggct

SEQ ID NO: 345043 - DNA, 25 bp, Mus musculus
gggttcatgcgtgagaagctgcctc

SEQ ID NO: 345044 - DNA, 25 bp, Mus musculus
ccgtgacatggacgctcagttccca

SEQ ID NO: 345045 - DNA, 25 bp, Mus musculus
gagaagctgcctcgggaagttccca

SEQ ID NO: 345046 - DNA, 25 bp, Mus musculus
tggaatccaacatccgggctctcgg

SEQ ID NO: 345047 - DNA, 25 bp, Mus musculus
aggcgcagggatggaatccaacatc

SEQ ID NO: 345048 - DNA, 25 bp, Mus musculus
tttatggaaatgaaggaccaggcgc

SEQ ID NO: 345049 - DNA, 25 bp, Mus musculus
cggagcgctgcccttttatggaaat

SEQ ID NO: 345050 - DNA, 25 bp, Mus musculus
cacccgcgtcgctgctcgggaggaa

SEQ ID NO: 345051 - DNA, 25 bp, Mus musculus
cgcctagcggacttgggcgccttca

SEQ ID NO: 345052 - DNA, 25 bp, Mus musculus
ggctacgcgcgcacaaccaagggcg

SEQ ID NO: 345053 - DNA, 25 bp, Mus musculus
gaaatggctctcgtcagcgtcactc

SEQ ID NO: 345054 - DNA, 25 bp, Mus musculus
agcctcgcgccgctgctaatggagt

SEQ ID NO: 345055 - DNA, 25 bp, Mus musculus
gtccgcgtagcagccatctggcatc

SEQ ID NO: 345056 - DNA, 25 bp, Mus musculus
tctggcatccttatcccgtccagag

SEQ ID NO: 345057 - DNA, 25 bp, Mus musculus
gctcgatgcgcagagagtcgtagcc

SEQ ID NO: 345058 - DNA, 25 bp, Mus musculus
agtcgtagccgatgaagggcttcca

SEQ ID NO: 345059 - DNA, 25 bp, Mus musculus
cattgttacgcagccctgcgtgggc

SEQ ID NO: 345060 - DNA, 25 bp, Mus musculus
ggagcttgggccacacacccggtct

SEQ ID NO: 345061 - DNA, 25 bp, Mus musculus
tcttgtcttccttgtagaaccagcg

SEQ ID NO: 345062 - DNA, 25 bp, Mus musculus
gtagaaccagcgcacctcctcgggg

SEQ ID NO: 345063 - DNA, 25 bp, Mus musculus
tctcgccctcgctgtagtagcgcaa

SEQ ID NO: 345064 - DNA, 25 bp, Mus musculus
tagtagcgcaacgacgagccggact

SEQ ID NO: 345065 - DNA, 25 bp, Mus musculus
ccgagctgaagtcgtaggtctcgtc

SEQ ID NO: 345066 - DNA, 25 bp, Mus musculus
agggcttccaggtcttcttgtcttc

SEQ ID NO: 345067 - DNA, 25 bp, Mus musculus
cacgggtccagagccaggtggctca

SEQ ID NO: 345068 - DNA, 25 bp, Mus musculus
ccggctggtgctcgaagcagcagcc

SEQ ID NO: 345069 - DNA, 25 bp, Mus musculus
tcggcccggactttataatctttca

SEQ ID NO: 345070 - DNA, 25 bp, Mus musculus
taatctttcaaatcccgagcagggc

SEQ ID NO: 345071 - DNA, 25 bp, Mus musculus
gcaccgtcaagactgaaaacaaagt

SEQ ID NO: 345072 - DNA, 25 bp, Mus musculus
ccaaggaagccggttgcagtttaag

SEQ ID NO: 345073 - DNA, 25 bp, Mus musculus
ttaagttccaaggaagccggttgca

SEQ ID NO: 345074 - DNA, 25 bp, Mus musculus
ctgagcgaattacgcaatgaaagcc

SEQ ID NO: 345075 - DNA, 25 bp, Mus musculus
aaacaaagtcagcaggtcacctggc

SEQ ID NO: 345076 - DNA, 25 bp, Mus musculus
gtggaatgaagcaccgtcaagactg

SEQ ID NO: 345077 - DNA, 25 bp, Mus musculus
atcttgaagtctgtccaaagcctgg

SEQ ID NO: 345078 - DNA, 25 bp, Mus musculus
gggaagccggatcttgaagtctgtc

SEQ ID NO: 345079 - DNA, 25 bp, Mus musculus
gtggtgccaccaggtgcaggctctc

SEQ ID NO: 345080 - DNA, 25 bp, Mus musculus
gtaagcttcacctagcctggtccgc

SEQ ID NO: 345081 - DNA, 25 bp, Mus musculus
gcctgtctccgtaagcttcacctag

SEQ ID NO: 345082 - DNA, 25 bp, Mus musculus
atcagaaccgcctgtctccgtaagc

SEQ ID NO: 345083 - DNA, 25 bp, Mus musculus
agcatgctctaatcagaaccgcctg

SEQ ID NO: 345084 - DNA, 25 bp, Mus musculus
cacctggcaggttctgagcgaatta

SEQ ID NO: 345085 - DNA, 25 bp, Mus musculus
ctggcgggacgctccgggtactcaa

SEQ ID NO: 345086 - DNA, 25 bp, Mus musculus
ttttcttcccggtctcaggtatcaa

SEQ ID NO: 345087 - DNA, 25 bp, Mus musculus
tggccctgaatctcggcgacttttt

SEQ ID NO: 345088 - DNA, 25 bp, Mus musculus
agctcatggctctgccctgagcggc

SEQ ID NO: 345089 - DNA, 25 bp, Mus musculus
cgaagtcccgcaggagctcatggct

SEQ ID NO: 345090 - DNA, 25 bp, Mus musculus
tagaagtgtcgcctcgaagtcccgc

SEQ ID NO: 345091 - DNA, 25 bp, Mus musculus
aacatctgtagaagtgtcgcctcga

SEQ ID NO: 345092 - DNA, 25 bp, Mus musculus
gcggcgcagcccaaacatctgtaga

SEQ ID NO: 345093 - DNA, 25 bp, Mus musculus
acggcgctcttgctaggctgcggac

SEQ ID NO: 345094 - DNA, 25 bp, Mus musculus
gtaatccggaatgacggcgctcttg

SEQ ID NO: 345095 - DNA, 25 bp, Mus musculus
agatccctcatgtaatccggaatga

SEQ ID NO: 345096 - DNA, 25 bp, Mus musculus
gccggtaaagatccctcatgtaatc

SEQ ID NO: 345097 - DNA, 25 bp, Mus musculus
ctcaggtatcaaactagcatggctc

SEQ ID NO: 345098 - DNA, 25 bp, Mus musculus
gactggagccggtaaagatccctca

SEQ ID NO: 345099 - DNA, 25 bp, Mus musculus
tctaacctcggaagcgcaactcttg

SEQ ID NO: 345100 - DNA, 25 bp, Mus musculus
tgcttctagcgacaggcagccgacc

SEQ ID NO: 345101 - DNA, 25 bp, Mus musculus
gcggcttctgaagtactgtctagta

SEQ ID NO: 345102 - DNA, 25 bp, Mus musculus
tgagcttctaactccggacagattc

SEQ ID NO: 345103 - DNA, 25 bp, Mus musculus
cgagaacagctttcggcctgcactc

SEQ ID NO: 345104 - DNA, 25 bp, Mus musculus
tccctctggcttggcttacttttta

SEQ ID NO: 345105 - DNA, 25 bp, Mus musculus
ttttgcaccagctacagaatcgcgg

SEQ ID NO: 345106 - DNA, 25 bp, Mus musculus
tcgcggctaagattcctccaagaaa

SEQ ID NO: 345107 - DNA, 25 bp, Mus musculus
ggggtgacctgactatcctaagatg

SEQ ID NO: 345108 - DNA, 25 bp, Mus musculus
agatgcctggcctgttctaacctcg

SEQ ID NO: 345109 - DNA, 25 bp, Mus musculus
ccaacaggtctttgcacggggtcca

SEQ ID NO: 345110 - DNA, 25 bp, Mus musculus
actcgacgtgtccagctggttttca

SEQ ID NO: 345111 - DNA, 25 bp, Mus musculus
tctccgagaggccaaataatgcttc

SEQ ID NO: 345112 - DNA, 25 bp, Mus musculus
ttgcctcacttaggaactcgacgtg

SEQ ID NO: 345113 - DNA, 25 bp, Mus musculus
accaatgagtagtcagaggctgagc

SEQ ID NO: 345114 - DNA, 25 bp, Mus musculus
tcttcgcgggcggtgtcctaaaggc

SEQ ID NO: 345115 - DNA, 25 bp, Mus musculus
actgcggttcgctgcccacctgagg

SEQ ID NO: 345116 - DNA, 25 bp, Mus musculus
tggcagatctgtggcactgcggttc

SEQ ID NO: 345117 - DNA, 25 bp, Mus musculus
tgcgattcgcacagtaaccgccctg

SEQ ID NO: 345118 - DNA, 25 bp, Mus musculus
aaggatcctcgccacggggccagac

SEQ ID NO: 345119 - DNA, 25 bp, Mus musculus
tgtccgggacccgaaggatcctcgc

SEQ ID NO: 345120 - DNA, 25 bp, Mus musculus
cacctcctacgtgggcggaccaatg

SEQ ID NO: 345121 - DNA, 25 bp, Mus musculus
gatatgattggtttctggaacgccc

SEQ ID NO: 345122 - DNA, 25 bp, Mus musculus
acagagcgaggatatgattggtttc

SEQ ID NO: 345123 - DNA, 25 bp, Mus musculus
cccggagtaagaaacagagcgagga

SEQ ID NO: 345124 - DNA, 25 bp, Mus musculus
aagacttcctctgaaccaatgagta

SEQ ID NO: 345125 - DNA, 25 bp, Mus musculus
ccttccgcgcgtctttcaaagactt

SEQ ID NO: 345126 - DNA, 25 bp, Mus musculus
tccacgccctcaactggcggagggg

SEQ ID NO: 345127 - DNA, 25 bp, Mus musculus
ctcacgtgccagatggcgaagaaga

SEQ ID NO: 345128 - DNA, 25 bp, Mus musculus
gcccggcgtagacacggagccgccc

SEQ ID NO: 345129 - DNA, 25 bp, Mus musculus
tcggtgcgcactgggcatccatcga

SEQ ID NO: 345130 - DNA, 25 bp, Mus musculus
gccctgctcgcgaatagcggagcgc

SEQ ID NO: 345131 - DNA, 25 bp, Mus musculus
cccgcacgccatgccctccggaccc

SEQ ID NO: 345132 - DNA, 25 bp, Mus musculus
gcgcagcgtccacggccctagcagc

SEQ ID NO: 345133 - DNA, 25 bp, Mus musculus
agctgcaagaggctgcgccgtcgct

SEQ ID NO: 345134 - DNA, 25 bp, Mus musculus
ccggctactcacgtgccagatggcg

SEQ ID NO: 345135 - DNA, 25 bp, Mus musculus
cagaaggccgcgaaagtgaacgcca

SEQ ID NO: 345136 - DNA, 25 bp, Mus musculus
ccgcgaaagtgaacgccatggccgg

SEQ ID NO: 345137 - DNA, 25 bp, Mus musculus
ccagcatatagcagaaggccgcgaa

SEQ ID NO: 345138 - DNA, 25 bp, Mus musculus
gagagtcaccgctcggtgcgcactg

SEQ ID NO: 345139 - DNA, 25 bp, Mus musculus
tcacgccgagagtcaccgctcggtg

SEQ ID NO: 345140 - DNA, 25 bp, Mus musculus
gcagcagcgccagcatatagcagaa

SEQ ID NO: 345141 - DNA, 25 bp, Mus musculus
atgctgcgccgttaccaaggaatga

SEQ ID NO: 345142 - DNA, 25 bp, Mus musculus
gtcttccgcgctgccgctggaagtc

SEQ ID NO: 345143 - DNA, 25 bp, Mus musculus
gaacggactgcgagtccgtccaacc

SEQ ID NO: 345144 - DNA, 25 bp, Mus musculus
accattttccttccggtcgtcagcg

SEQ ID NO: 345145 - DNA, 25 bp, Mus musculus
cgttgccgtgcgatctcttgggccc

SEQ ID NO: 345146 - DNA, 25 bp, Mus musculus
ccctttaagaatggctcggcagcca

SEQ ID NO: 345147 - DNA, 25 bp, Mus musculus
gaatggctcggcagccaactccctt

SEQ ID NO: 345148 - DNA, 25 bp, Mus musculus
ttcctgtttcggctggcgcaccgct

SEQ ID NO: 345149 - DNA, 25 bp, Mus musculus
ccaaaatttggcgaaatgcggacgc

SEQ ID NO: 345150 - DNA, 25 bp, Mus musculus
ggcgcctctggtgcctgttaagtaa

SEQ ID NO: 345151 - DNA, 25 bp, Mus musculus
ctgttaagtaaggatgctgcgccgt

SEQ ID NO: 345152 - DNA, 25 bp, Mus musculus
taccaaggaatgagccagccaagcg

SEQ ID NO: 345153 - DNA, 25 bp, Mus musculus
gggcgaagccggaatgcaaccagaa

SEQ ID NO: 345154 - DNA, 25 bp, Mus musculus
aatgcaaccagaaccctgacactcg

SEQ ID NO: 345155 - DNA, 25 bp, Mus musculus
gagcagtggtgacccaggacctacg

SEQ ID NO: 345156 - DNA, 25 bp, Mus musculus
gaaggcggcgcggataaaggctcag

SEQ ID NO: 345157 - DNA, 25 bp, Mus musculus
cacggccacctcttgccaggaccca

SEQ ID NO: 345158 - DNA, 25 bp, Mus musculus
ctcttgccaggacccatacgcaggt

SEQ ID NO: 345159 - DNA, 25 bp, Mus musculus
tgccaggacccatacgcaggtcatc

SEQ ID NO: 345160 - DNA, 25 bp, Mus musculus
aggacccatacgcaggtcatctgga

SEQ ID NO: 345161 - DNA, 25 bp, Mus musculus
acccatacgcaggtcatctggagca

SEQ ID NO: 345162 - DNA, 25 bp, Mus musculus
catacgcaggtcatctggagcagtg

SEQ ID NO: 345163 - DNA, 25 bp, Mus musculus
gataaaggctcaggggccgcccgcc

SEQ ID NO: 345164 - DNA, 25 bp, Mus musculus
catctggagcagtggtgacccagga

SEQ ID NO: 345165 - DNA, 25 bp, Mus musculus
agtggtgacccaggacctacggagc

SEQ ID NO: 345166 - DNA, 25 bp, Mus musculus
gacccaggacctacggagccggtga

SEQ ID NO: 345167 - DNA, 25 bp, Mus musculus
ccaggacctacggagccggtgagta

SEQ ID NO: 345168 - DNA, 25 bp, Mus musculus
tacgcaggtcatctggagcagtggt

SEQ ID NO: 345169 - DNA, 25 bp, Mus musculus
tcaccaccggcctggtattaggatg

SEQ ID NO: 345170 - DNA, 25 bp, Mus musculus
ccgcagtgttcctggtaacgctcta

SEQ ID NO: 345171 - DNA, 25 bp, Mus musculus
gtccctccctgttacgtagccagta

SEQ ID NO: 345172 - DNA, 25 bp, Mus musculus
atcgctcgcggtagtgacctctttt

SEQ ID NO: 345173 - DNA, 25 bp, Mus musculus
ttccgcgacaatccgcaaatcgaga

SEQ ID NO: 345174 - DNA, 25 bp, Mus musculus
gagaccattcctttcgtagaccatt

SEQ ID NO: 345175 - DNA, 25 bp, Mus musculus
ttgtctagggtttgcagggtttcca

SEQ ID NO: 345176 - DNA, 25 bp, Mus musculus
ctcgtgtatctgaggatctgcatta

SEQ ID NO: 345177 - DNA, 25 bp, Mus musculus
ctcttctacatagcggtggtcttca

SEQ ID NO: 345178 - DNA, 25 bp, Mus musculus
ggaattccgcggatcgccaccaatc

SEQ ID NO: 345179 - DNA, 25 bp, Mus musculus
gtggtcttcacctgcttcatcgtca

SEQ ID NO: 345180 - DNA, 25 bp, Mus musculus
tggcatacctgctatcaaccttgtg

SEQ ID NO: 345181 - DNA, 25 bp, Mus musculus
attggcattccgtctccagtggccg

SEQ ID NO: 345182 - DNA, 25 bp, Mus musculus
gctctatgaatactcgccgctcttc

SEQ ID NO: 345183 - DNA, 25 bp, Mus musculus
aggaatctgcatttccctcggggtc

SEQ ID NO: 345184 - DNA, 25 bp, Mus musculus
cggcctaaatccagaggggagcctg

SEQ ID NO: 345185 - DNA, 25 bp, Mus musculus
tgcggctgctcacggcctaaatcca

SEQ ID NO: 345186 - DNA, 25 bp, Mus musculus
ctgacaccgcctctgctttgcatta

SEQ ID NO: 345187 - DNA, 25 bp, Mus musculus
tatttttgtctcgagctgtcgctgc

SEQ ID NO: 345188 - DNA, 25 bp, Mus musculus
ccgagctttggatagggagagttta

SEQ ID NO: 345189 - DNA, 25 bp, Mus musculus
gtcaagcaggcccagggaaacctcc

SEQ ID NO: 345190 - DNA, 25 bp, Mus musculus
acatctgatggtcgtgggtcaagca

SEQ ID NO: 345191 - DNA, 25 bp, Mus musculus
aggatgcctaaatcacacgcgcgcg

SEQ ID NO: 345192 - DNA, 25 bp, Mus musculus
caaccgcatcgccttgggcctggga

SEQ ID NO: 345193 - DNA, 25 bp, Mus musculus
gctggaaccctggttgcctctgaca

SEQ ID NO: 345194 - DNA, 25 bp, Mus musculus
cctgggaaagccgtgatacgggctc

SEQ ID NO: 345195 - DNA, 25 bp, Mus musculus
gcgaggcacccagtggttcctccga

SEQ ID NO: 345196 - DNA, 25 bp, Mus musculus
ttcgctcttctacccagaagttctg

SEQ ID NO: 345197 - DNA, 25 bp, Mus musculus
tttcattggccggagcctcttgcgt

SEQ ID NO: 345198 - DNA, 25 bp, Mus musculus
gaaagttcccggagctgcccacgct

SEQ ID NO: 345199 - DNA, 25 bp, Mus musculus
agcctcttgcgtcatggatctctcc

SEQ ID NO: 345200 - DNA, 25 bp, Mus musculus
ggccggcgccgcgagatattttcat

SEQ ID NO: 345201 - DNA, 25 bp, Mus musculus
ctctctttttatggcagggcgactc

SEQ ID NO: 345202 - DNA, 25 bp, Mus musculus
acactctcggagtctagggcagtcg

SEQ ID NO: 345203 - DNA, 25 bp, Mus musculus
gggctcagcacctagggacactctc

SEQ ID NO: 345204 - DNA, 25 bp, Mus musculus
accctagggtgctaacaagcgctgc

SEQ ID NO: 345205 - DNA, 25 bp, Mus musculus
ctcggagaacccattggtgcacctg

SEQ ID NO: 345206 - DNA, 25 bp, Mus musculus
gttcacctggttttcctcctcgctg

SEQ ID NO: 345207 - DNA, 25 bp, Mus musculus
ctcgcccagcgagagcagaatggac

SEQ ID NO: 345208 - DNA, 25 bp, Mus musculus
atcccttggtgaagtactgcatggc

SEQ ID NO: 345209 - DNA, 25 bp, Mus musculus
atggtctcctggtatcccttggtga

SEQ ID NO: 345210 - DNA, 25 bp, Mus musculus
cacgcacggacctgagatggtctcc

SEQ ID NO: 345211 - DNA, 25 bp, Mus musculus
acgcccgggagatgacaagctttcc

SEQ ID NO: 345212 - DNA, 25 bp, Mus musculus
atctttccctacctgagccgttttg

SEQ ID NO: 345213 - DNA, 25 bp, Mus musculus
caaagcagacttcggtgtgcccttc

SEQ ID NO: 345214 - DNA, 25 bp, Mus musculus
gtgtgcccttccgtatgtccgtacc

SEQ ID NO: 345215 - DNA, 25 bp, Mus musculus
tgtccgtacctcatgggcttctgtg

SEQ ID NO: 345216 - DNA, 25 bp, Mus musculus
tttcagtagggcgatcgtcctctcc

SEQ ID NO: 345217 - DNA, 25 bp, Mus musculus
gggtttgacgcctgccctttcagga

SEQ ID NO: 345218 - DNA, 25 bp, Mus musculus
tgcagcggaaggtatgtcacacacg

SEQ ID NO: 345219 - DNA, 25 bp, Mus musculus
caagtctgactctgggctgaccgtg

SEQ ID NO: 345220 - DNA, 25 bp, Mus musculus
caccagcgtctgctctgatggaagc

SEQ ID NO: 345221 - DNA, 25 bp, Mus musculus
ctggggccgctctgaaagaaaaggt

SEQ ID NO: 345222 - DNA, 25 bp, Mus musculus
ggctaacattcacgctggacccgtc

SEQ ID NO: 345223 - DNA, 25 bp, Mus musculus
gaccggctgtccataccgagaatga

SEQ ID NO: 345224 - DNA, 25 bp, Mus musculus
gagccaccgtagtcgcctccttgaa

SEQ ID NO: 345225 - DNA, 25 bp, Mus musculus
ccctgcctgcagtttcgtgggcggc

SEQ ID NO: 345226 - DNA, 25 bp, Mus musculus
agggatctaatgtcgcgcccgtcgg

SEQ ID NO: 345227 - DNA, 25 bp, Mus musculus
ttcagcgggtctccattgcccgtct

SEQ ID NO: 345228 - DNA, 25 bp, Mus musculus
ccaggcgaccgagggatctaatgtc

SEQ ID NO: 345229 - DNA, 25 bp, Mus musculus
cctggcggctctagagctttcgatg

SEQ ID NO: 345230 - DNA, 25 bp, Mus musculus
agacgatgcgaagacgcggggtccc

SEQ ID NO: 345231 - DNA, 25 bp, Mus musculus
ccgcttccttttccggtgccaggag

SEQ ID NO: 345232 - DNA, 25 bp, Mus musculus
catcaggccttcagcgggtctccat

SEQ ID NO: 345233 - DNA, 25 bp, Mus musculus
attgcccgtctctctggactcaccg

SEQ ID NO: 345234 - DNA, 25 bp, Mus musculus
actgtgccgcgcctaggactcggat

SEQ ID NO: 345235 - DNA, 25 bp, Mus musculus
gcgcctaggactcggatcctgccgg

SEQ ID NO: 345236 - DNA, 25 bp, Mus musculus
gactcggatcctgccgggtgagtcc

SEQ ID NO: 345237 - DNA, 25 bp, Mus musculus
cttttccggtgccaggaggagccgt

SEQ ID NO: 345238 - DNA, 25 bp, Mus musculus
gctgtcgtctcggtccatcaggcct

SEQ ID NO: 345239 - DNA, 25 bp, Mus musculus
cgcccagctctgacagctagcggag

SEQ ID NO: 345240 - DNA, 25 bp, Mus musculus
tcctgcgggtaactctcggagaaag

SEQ ID NO: 345241 - DNA, 25 bp, Mus musculus
aggcgctggtctaccgccttggctc

SEQ ID NO: 345242 - DNA, 25 bp, Mus musculus
gacggaggtgaccttcagggtccca

SEQ ID NO: 345243 - DNA, 25 bp, Mus musculus
tgcaccaagaaagggctgggctccc

SEQ ID NO: 345244 - DNA, 25 bp, Mus musculus
agagcactacccaggtgagcggcgc

SEQ ID NO: 345245 - DNA, 25 bp, Mus musculus
gcactaatcaggtgagcggcacaga

SEQ ID NO: 345246 - DNA, 25 bp, Mus musculus
aaagagtactagaagcggccgagcc

SEQ ID NO: 345247 - DNA, 25 bp, Mus musculus
tcccagtccactgtggggaagctcc

SEQ ID NO: 345248 - DNA, 25 bp, Mus musculus
cggagaaagttattcacgacctaca

SEQ ID NO: 345249 - DNA, 25 bp, Mus musculus
actaagtctctttgggatggcggga

SEQ ID NO: 345250 - DNA, 25 bp, Mus musculus
cgacctacatactaagtctctttgg

SEQ ID NO: 345251 - DNA, 25 bp, Mus musculus
gcgggccctgggcactccttcgaag

SEQ ID NO: 345252 - DNA, 25 bp, Mus musculus
gcggcacagagagcactacccaggt

SEQ ID NO: 345253 - DNA, 25 bp, Mus musculus
ttcacggaactgaaatttcccgctg

SEQ ID NO: 345254 - DNA, 25 bp, Mus musculus
cgtggcagcgacacactataaactc

SEQ ID NO: 345255 - DNA, 25 bp, Mus musculus
cggtaaacccgctaggcgtggcagc

SEQ ID NO: 345256 - DNA, 25 bp, Mus musculus
cgacatttaaattgtttggaaggca

SEQ ID NO: 345257 - DNA, 25 bp, Mus musculus
ttggttctgtgcgacatttaaattg

SEQ ID NO: 345258 - DNA, 25 bp, Mus musculus
cgataggttggttctgtgcgacatt

SEQ ID NO: 345259 - DNA, 25 bp, Mus musculus
ctcgaacgaggcttgcgataggttg

SEQ ID NO: 345260 - DNA, 25 bp, Mus musculus
ccagccgctgattggagggactttt

SEQ ID NO: 345261 - DNA, 25 bp, Mus musculus
tccgcagaaggaactcccggaccga

SEQ ID NO: 345262 - DNA, 25 bp, Mus musculus
accgatccgcagaaggaactcccgg

SEQ ID NO: 345263 - DNA, 25 bp, Mus musculus
ttggagggacttttgccaacacttc

SEQ ID NO: 345264 - DNA, 25 bp, Mus musculus
acacactataaactcagtggggcgg

SEQ ID NO: 345265 - DNA, 25 bp, Mus musculus
ttttgccaacacttccggaagctcc

SEQ ID NO: 345266 - DNA, 25 bp, Mus musculus
tgaaatttcccgctgccagccgctg

SEQ ID NO: 345267 - DNA, 25 bp, Mus musculus
gtcacgccggtttagccaacaaatg

SEQ ID NO: 345268 - DNA, 25 bp, Mus musculus
cacgccggtttagccaacaaatggg

SEQ ID NO: 345269 - DNA, 25 bp, Mus musculus
caacaaatgggtttcggggcgagcg

SEQ ID NO: 345270 - DNA, 25 bp, Mus musculus
ctgagctcctggtccgcctcagtgt

SEQ ID NO: 345271 - DNA, 25 bp, Mus musculus
tcctggtccgcctcagtgtcgggga

SEQ ID NO: 345272 - DNA, 25 bp, Mus musculus
gccctggcccggcagaagcacaggt

SEQ ID NO: 345273 - DNA, 25 bp, Mus musculus
gcagcgtcctccagagagccgtcct

SEQ ID NO: 345274 - DNA, 25 bp, Mus musculus
gtccggcgacccaagctaggccgcc

SEQ ID NO: 345275 - DNA, 25 bp, Mus musculus
tgaggtcacagtgccgaggctcggc

SEQ ID NO: 345276 - DNA, 25 bp, Mus musculus
gtgatgtcagggctctaccgagaca

SEQ ID NO: 345277 - DNA, 25 bp, Mus musculus
ggctctaccgagacagaccgtgatg

SEQ ID NO: 345278 - DNA, 25 bp, Mus musculus
taccgagacagaccgtgatgtcact

SEQ ID NO: 345279 - DNA, 25 bp, Mus musculus
actgcaggccccgagtggcgacctt

SEQ ID NO: 345280 - DNA, 25 bp, Mus musculus
cggcgcgtgatgtcacgccggttta

SEQ ID NO: 345281 - DNA, 25 bp, Mus musculus
tcggcgtcgtccaccgagtccacca

SEQ ID NO: 345282 - DNA, 25 bp, Mus musculus
cgcggccgtcgaaatagacgaaatc

SEQ ID NO: 345283 - DNA, 25 bp, Mus musculus
tagacgaaatcaccgctctggacgc

SEQ ID NO: 345284 - DNA, 25 bp, Mus musculus
aatcaccgctctggacgcacttggc

SEQ ID NO: 345285 - DNA, 25 bp, Mus musculus
ctggacgcacttggcgcaagtcaac

SEQ ID NO: 345286 - DNA, 25 bp, Mus musculus
cttggcgcaagtcaaccgccggcga

SEQ ID NO: 345287 - DNA, 25 bp, Mus musculus
aaccgccggcgagtggtgttgcaca

SEQ ID NO: 345288 - DNA, 25 bp, Mus musculus
tggtgttgcacagaggacaccgctc

SEQ ID NO: 345289 - DNA, 25 bp, Mus musculus
tgcacagaggacaccgctcaacagc

SEQ ID NO: 345290 - DNA, 25 bp, Mus musculus
acagccacgtaaaggccctcggcgt

SEQ ID NO: 345291 - DNA, 25 bp, Mus musculus
gagtccaccaggtcccgtgctagcg

SEQ ID NO: 345292 - DNA, 25 bp, Mus musculus
cgcggcccaaaaccaggagcctcgg

SEQ ID NO: 345293 - DNA, 25 bp, Mus musculus
ccggtcgcggccgtcgaaatagacg

SEQ ID NO: 345294 - DNA, 25 bp, Mus musculus
tcaacagccacgtaaaggccctcgg

SEQ ID NO: 345295 - DNA, 25 bp, Mus musculus
gcatccatagctgcaagatccctta

SEQ ID NO: 345296 - DNA, 25 bp, Mus musculus
gagaatcggccgagccgactccttc

SEQ ID NO: 345297 - DNA, 25 bp, Mus musculus
agcacgaccggaaagagcgacagcg

SEQ ID NO: 345298 - DNA, 25 bp, Mus musculus
ccacacacttacagaactttgtcca

SEQ ID NO: 345299 - DNA, 25 bp, Mus musculus
actttgtccaaagcatccatagctg

SEQ ID NO: 345300 - DNA, 25 bp, Mus musculus
agatcccttagcgaatgcacgtgta

SEQ ID NO: 345301 - DNA, 25 bp, Mus musculus
gcacgtgtaccgattacttccggga

SEQ ID NO: 345302 - DNA, 25 bp, Mus musculus
acggtgccggaagtgcgaaatacca

SEQ ID NO: 345303 - DNA, 25 bp, Mus musculus
ccacttcaatggacagcccggctgt

SEQ ID NO: 345304 - DNA, 25 bp, Mus musculus
ccattttgggaaggcatggcgttcc

SEQ ID NO: 345305 - DNA, 25 bp, Mus musculus
gaacgttgtttgattgttctccgga

SEQ ID NO: 345306 - DNA, 25 bp, Mus musculus
ggtcataagccgatcacagcgtccg

SEQ ID NO: 345307 - DNA, 25 bp, Mus musculus
catggcgttccgtctcccttggtta

SEQ ID NO: 345308 - DNA, 25 bp, Mus musculus
tcccagggaccactagcaaagcacg

SEQ ID NO: 345309 - DNA, 25 bp, Mus musculus
ggtcgctgtcatccgcccttgaaaa

SEQ ID NO: 345310 - DNA, 25 bp, Mus musculus
cctcttggcatctccattggacgca

SEQ ID NO: 345311 - DNA, 25 bp, Mus musculus
cggcgattctcattggcccggtagc

SEQ ID NO: 345312 - DNA, 25 bp, Mus musculus
ccgcccattggaacgttgatacatg

SEQ ID NO: 345313 - DNA, 25 bp, Mus musculus
tagcacgacccgagagggatccagg

SEQ ID NO: 345314 - DNA, 25 bp, Mus musculus
caccgtgcgaaccaggatagcttgc

SEQ ID NO: 345315 - DNA, 25 bp, Mus musculus
cgtgccgtacccaggtcgctgtcat

SEQ ID NO: 345316 - DNA, 25 bp, Mus musculus
ctcggattcttgattgccggctcaa

SEQ ID NO: 345317 - DNA, 25 bp, Mus musculus
gccggctcaattcctaacgttggga

SEQ ID NO: 345318 - DNA, 25 bp, Mus musculus
acgcctggcgctgcttcacaaagac

SEQ ID NO: 345319 - DNA, 25 bp, Mus musculus
cccggagcaccactcggattcttga

SEQ ID NO: 345320 - DNA, 25 bp, Mus musculus
ggctgcgcaaaaggttgtcccaacg

SEQ ID NO: 345321 - DNA, 25 bp, Mus musculus
atgagcctggcgatccacagcacta

SEQ ID NO: 345322 - DNA, 25 bp, Mus musculus
aagacacgtaggtagagcgccgccc

SEQ ID NO: 345323 - DNA, 25 bp, Mus musculus
ctatttttagctgggctcgcaggcc

SEQ ID NO: 345324 - DNA, 25 bp, Mus musculus
gctgtttagtgtcttcgggtccttc

SEQ ID NO: 345325 - DNA, 25 bp, Mus musculus
tttaggtcaaaaagtgcgctgttta

SEQ ID NO: 345326 - DNA, 25 bp, Mus musculus
aaggtccgatcccaggtccgcgagt

SEQ ID NO: 345327 - DNA, 25 bp, Mus musculus
ggtgaccgaggagcctatttttagc

SEQ ID NO: 345328 - DNA, 25 bp, Mus musculus
gctgcgcggacctgtccctttaagg

SEQ ID NO: 345329 - DNA, 25 bp, Mus musculus
attaaggctctgatgagggtgacca

SEQ ID NO: 345330 - DNA, 25 bp, Mus musculus
ttaggggaaatcctgcgaagttctc

SEQ ID NO: 345331 - DNA, 25 bp, Mus musculus
gtgtccgccttggtgtccaacaata

SEQ ID NO: 345332 - DNA, 25 bp, Mus musculus
tccaacaatagaatttggggtgtcc

SEQ ID NO: 345333 - DNA, 25 bp, Mus musculus
cggatctggccgcttttggcgtaag

SEQ ID NO: 345334 - DNA, 25 bp, Mus musculus
agcagcgttctcttctttgtccggc

SEQ ID NO: 345335 - DNA, 25 bp, Mus musculus
ccggctgcctctcggtttaggtcaa

SEQ ID NO: 345336 - DNA, 25 bp, Mus musculus
ccatctcctctgagggcgaggtcga

SEQ ID NO: 345337 - DNA, 25 bp, Mus musculus
agccagtggctactggggacttctc

SEQ ID NO: 345338 - DNA, 25 bp, Mus musculus
gggttacgcattgttccagtctgtg

SEQ ID NO: 345339 - DNA, 25 bp, Mus musculus
gggtttccattctcgagtctccgca

SEQ ID NO: 345340 - DNA, 25 bp, Mus musculus
tcccgggtttccattctcgagtctc

SEQ ID NO: 345341 - DNA, 25 bp, Mus musculus
cctccgctttttgcgccgggagtga

SEQ ID NO: 345342 - DNA, 25 bp, Mus musculus
ccgctggttggcctccgctttttgc

SEQ ID NO: 345343 - DNA, 25 bp, Mus musculus
attgttccagtctgtgacccgggcc

SEQ ID NO: 345344 - DNA, 25 bp, Mus musculus
ggtcccgctcgtagcggccaacgta

SEQ ID NO: 345345 - DNA, 25 bp, Mus musculus
tagcggccaacgtacggatagctcc

SEQ ID NO: 345346 - DNA, 25 bp, Mus musculus
caacgtacggatagctccggggaag

SEQ ID NO: 345347 - DNA, 25 bp, Mus musculus
gacgcgcacagccacgacggagcag

SEQ ID NO: 345348 - DNA, 25 bp, Mus musculus
tcgctcggtgaagcccggagccagt

SEQ ID NO: 345349 - DNA, 25 bp, Mus musculus
gacgaccgcgaacgcggagccctgt

SEQ ID NO: 345350 - DNA, 25 bp, Mus musculus
gctactggggacttctctttcccga

SEQ ID NO: 345351 - DNA, 25 bp, Mus musculus
aggtatggtgcgctcggccctgcta

SEQ ID NO: 345352 - DNA, 25 bp, Mus musculus
tcgggtaaagtactcgcaggccgcc

SEQ ID NO: 345353 - DNA, 25 bp, Mus musculus
gggagactcgggtaaagtactcgca

SEQ ID NO: 345354 - DNA, 25 bp, Mus musculus
tggctgccgtgttcaccctcacgct

SEQ ID NO: 345355 - DNA, 25 bp, Mus musculus
cgtggccgtgttcgcctccgtggct

SEQ ID NO: 345356 - DNA, 25 bp, Mus musculus
gcagcgtggccgtgttcgcctccgt

SEQ ID NO: 345357 - DNA, 25 bp, Mus musculus
tcggccagggaaggtccgcaccgct

SEQ ID NO: 345358 - DNA, 25 bp, Mus musculus
actcctaagccgtgccggagtgcgc

SEQ ID NO: 345359 - DNA, 25 bp, Mus musculus
ccagaagactcctaagccgtgccgg

SEQ ID NO: 345360 - DNA, 25 bp, Mus musculus
agacacagtaccacgcgcagtgacc

SEQ ID NO: 345361 - DNA, 25 bp, Mus musculus
tgacgcagacacagtaccacgcgca

SEQ ID NO: 345362 - DNA, 25 bp, Mus musculus
ctgtgcgcgcctctcggccagggaa

SEQ ID NO: 345363 - DNA, 25 bp, Mus musculus
cgtccgggcccatgggtctccatgg

SEQ ID NO: 345364 - DNA, 25 bp, Mus musculus
cgcaccgctgcgaggggtcacggtc

SEQ ID NO: 345365 - DNA, 25 bp, Mus musculus
cccattgactgcgtaaggcggttgc

SEQ ID NO: 345366 - DNA, 25 bp, Mus musculus
ccgaagtggtcagactcagcccatt

SEQ ID NO: 345367 - DNA, 25 bp, Mus musculus
tccatacccgaagtggtcagactca

SEQ ID NO: 345368 - DNA, 25 bp, Mus musculus
cagcaagtccatacccgaagtggtc

SEQ ID NO: 345369 - DNA, 25 bp, Mus musculus
cggagggatgcagcaagtccatacc

SEQ ID NO: 345370 - DNA, 25 bp, Mus musculus
tagaaggccgcggactcacttaccg

SEQ ID NO: 345371 - DNA, 25 bp, Mus musculus
tccaacctcggagctccagaggggc

SEQ ID NO: 345372 - DNA, 25 bp, Mus musculus
cccgccttgagcttgagtgaggaca

SEQ ID NO: 345373 - DNA, 25 bp, Mus musculus
ggaggcgcaaagtcggcccaaattg

SEQ ID NO: 345374 - DNA, 25 bp, Mus musculus
taaggttgtttggaggcgcaaagtc

SEQ ID NO: 345375 - DNA, 25 bp, Mus musculus
gataagacatcatgctaaggttgtt

SEQ ID NO: 345376 - DNA, 25 bp, Mus musculus
ggcggttgctttagataagacatca

SEQ ID NO: 345377 - DNA, 25 bp, Mus musculus
tcagactcagcccattgactgcgta

SEQ ID NO: 345378 - DNA, 25 bp, Mus musculus
ctgcgtaaggcggttgctttagata

SEQ ID NO: 345379 - DNA, 25 bp, Mus musculus
gcaaatagcgatagcgcggcgactc

SEQ ID NO: 345380 - DNA, 25 bp, Mus musculus
ggcttccgagagctcatacctagga

SEQ ID NO: 345381 - DNA, 25 bp, Mus musculus
acaaaacttcgctgactggcggctc

SEQ ID NO: 345382 - DNA, 25 bp, Mus musculus
ccgctctcgaggagagatggcttcc

SEQ ID NO: 345383 - DNA, 25 bp, Mus musculus
tcctccaggagcaagcgactgggtc

SEQ ID NO: 345384 - DNA, 25 bp, Mus musculus
tgcagtccggcagatcagcagctct

SEQ ID NO: 345385 - DNA, 25 bp, Mus musculus
gccggcctgcacagccttatatcta

SEQ ID NO: 345386 - DNA, 25 bp, Mus musculus
gtcaattcgtgcaatctgtcgcttc

SEQ ID NO: 345387 - DNA, 25 bp, Mus musculus
ttccaagaagcccatctaccagttg

SEQ ID NO: 345388 - DNA, 25 bp, Mus musculus
gttgctgtgtcctcgctcaataata

SEQ ID NO: 345389 - DNA, 25 bp, Mus musculus
cgagataatccgaggggcacacgtc

SEQ ID NO: 345390 - DNA, 25 bp, Mus musculus
gggcacacgtcccttaattacaggc

SEQ ID NO: 345391 - DNA, 25 bp, Mus musculus
ctctgcttctcgtcctggctgatta

SEQ ID NO: 345392 - DNA, 25 bp, Mus musculus
aattacaggccgtcgtgctcagctc

SEQ ID NO: 345393 - DNA, 25 bp, Mus musculus
cagaagtgcttaacgggccacgatg

SEQ ID NO: 345394 - DNA, 25 bp, Mus musculus
aaaccgaggagtctagaggcagccc

SEQ ID NO: 345395 - DNA, 25 bp, Mus musculus
cgccgataatggagagccggccttc

SEQ ID NO: 345396 - DNA, 25 bp, Mus musculus
cggttatccgctccgatttcggctc

SEQ ID NO: 345397 - DNA, 25 bp, Mus musculus
gggagtaacaagacgccagcgctgt

SEQ ID NO: 345398 - DNA, 25 bp, Mus musculus
taaaagattcaagagccctagcggc

SEQ ID NO: 345399 - DNA, 25 bp, Mus musculus
cccgactttcagtgtacagttctgg

SEQ ID NO: 345400 - DNA, 25 bp, Mus musculus
aaacctgtccaactagcggcctcgg

SEQ ID NO: 345401 - DNA, 25 bp, Mus musculus
agaactcgaagtccttcctagggag

SEQ ID NO: 345402 - DNA, 25 bp, Mus musculus
cccaagccagaaaaggcagtacaga

SEQ ID NO: 345403 - DNA, 25 bp, Mus musculus
ttcggctcccgttgcaaaccgagga

SEQ ID NO: 345404 - DNA, 25 bp, Mus musculus
ccctccgtataaggtcagccttgac

SEQ ID NO: 345405 - DNA, 25 bp, Mus musculus
agccttgacctacgacacttcattg

SEQ ID NO: 345406 - DNA, 25 bp, Mus musculus
ggtctctgaccaggagcatccaggc

SEQ ID NO: 345407 - DNA, 25 bp, Mus musculus
gattttccagcctgtgtggcgcggc

SEQ ID NO: 345408 - DNA, 25 bp, Mus musculus
ctagaccctggcatggcgacccatt

SEQ ID NO: 345409 - DNA, 25 bp, Mus musculus
cttcgtggacgaaaggaagctactg

SEQ ID NO: 345410 - DNA, 25 bp, Mus musculus
agcaagttttgctcccaggcatggg

SEQ ID NO: 345411 - DNA, 25 bp, Mus musculus
cccaggcatggggagcaaagcatac

SEQ ID NO: 345412 - DNA, 25 bp, Mus musculus
gtgcccgagcgtggcgcaaaattcc

SEQ ID NO: 345413 - DNA, 25 bp, Mus musculus
acacccggccaaagcagcaagtttt

SEQ ID NO: 345414 - DNA, 25 bp, Mus musculus
tgtgaagggcactagaacacccggc

SEQ ID NO: 345415 - DNA, 25 bp, Mus musculus
cccgagatcgtgttgggcaagaatg

SEQ ID NO: 345416 - DNA, 25 bp, Mus musculus
gtggatttagccacccgagatcgtg

SEQ ID NO: 345417 - DNA, 25 bp, Mus musculus
gcgacccattctgagcgttgccttc

SEQ ID NO: 345418 - DNA, 25 bp, Mus musculus
cccagagtcacctgatacactttga

SEQ ID NO: 345419 - DNA, 25 bp, Mus musculus
ggtcgcgacctgtcctagaccctgg

SEQ ID NO: 345420 - DNA, 25 bp, Mus musculus
cggccttctgagtggagaagttacc

SEQ ID NO: 345421 - DNA, 25 bp, Mus musculus
gatccgcacagcaagacccggctcg

SEQ ID NO: 345422 - DNA, 25 bp, Mus musculus
gctcccattgtcaccgcctcgcacg

SEQ ID NO: 345423 - DNA, 25 bp, Mus musculus
aagcggagccgcagacgcctgtcag

SEQ ID NO: 345424 - DNA, 25 bp, Mus musculus
agcagccatgaagcggagccgcaga

SEQ ID NO: 345425 - DNA, 25 bp, Mus musculus
ccggtcctcacacagcgaaggcaga

SEQ ID NO: 345426 - DNA, 25 bp, Mus musculus
cacctcgaagagctcggccgtcgtg

SEQ ID NO: 345427 - DNA, 25 bp, Mus musculus
tttcgactgtaaggtaagacggcag

SEQ ID NO: 345428 - DNA, 25 bp, Mus musculus
tcgtttgcgacagggtgacgcgtct

SEQ ID NO: 345429 - DNA, 25 bp, Mus musculus
tagcaccgtcgcgaggatccgcaca

SEQ ID NO: 345430 - DNA, 25 bp, Mus musculus
cttgtcggaacctcggcaccgagga

SEQ ID NO: 345431 - DNA, 25 bp, Mus musculus
tgacgcgtcttgagcctcgcgggcc

SEQ ID NO: 345432 - DNA, 25 bp, Mus musculus
ccgcttctgagcttgtcggaacctc

SEQ ID NO: 345433 - DNA, 25 bp, Mus musculus
ctgtaaggtaagacggcaggcaccc

SEQ ID NO: 345434 - DNA, 25 bp, Mus musculus
ggccgtctccgcttcacatgctgcg

SEQ ID NO: 345435 - DNA, 25 bp, Mus musculus
ttgctgcctttgtagccggcgctcc

SEQ ID NO: 345436 - DNA, 25 bp, Mus musculus
gtccaggccgggatttgctgccttt

SEQ ID NO: 345437 - DNA, 25 bp, Mus musculus
ttggatgtcaacagccagcagctcc

SEQ ID NO: 345438 - DNA, 25 bp, Mus musculus
ccagcagctcccagggcacctagcc

SEQ ID NO: 345439 - DNA, 25 bp, Mus musculus
gccgggatttgctgcctttgtagcc

SEQ ID NO: 345440 - DNA, 25 bp, Mus musculus
gaagccctccggagacacctcgggc

SEQ ID NO: 345441 - DNA, 25 bp, Mus musculus
ggaacctctggaaccccaggctaga

SEQ ID NO: 345442 - DNA, 25 bp, Mus musculus
cccacgcgccaggtcagagcaaaag

SEQ ID NO: 345443 - DNA, 25 bp, Mus musculus
gcgccaggtcagagcaaaagttgta

SEQ ID NO: 345444 - DNA, 25 bp, Mus musculus
gcaaaagttgtaacagtacagctgc

SEQ ID NO: 345445 - DNA, 25 bp, Mus musculus
tgtaacagtacagctgcataaaggc

SEQ ID NO: 345446 - DNA, 25 bp, Mus musculus
cagctgcataaaggcactagaggtt

SEQ ID NO: 345447 - DNA, 25 bp, Mus musculus
cactagaggttggatgtcaacagcc

SEQ ID NO: 345448 - DNA, 25 bp, Mus musculus
ggcgagttccgcaggaacctctgga

SEQ ID NO: 345449 - DNA, 25 bp, Mus musculus
tcattggtgaaacctcctttccgtc

SEQ ID NO: 345450 - DNA, 25 bp, Mus musculus
gtcttctagaagtaccaatagctcg

SEQ ID NO: 345451 - DNA, 25 bp, Mus musculus
caatagctcgaggttgccttctgga

SEQ ID NO: 345452 - DNA, 25 bp, Mus musculus
ttgccttctggaggcgggactttag

SEQ ID NO: 345453 - DNA, 25 bp, Mus musculus
cgccaggaggggctcccgacgtcat

SEQ ID NO: 345454 - DNA, 25 bp, Mus musculus
tcctttccgtcttctagaagtacca

SEQ ID NO: 345455 - DNA, 25 bp, Mus musculus
aggcgggactttagcctggcaaagc

SEQ ID NO: 345456 - DNA, 25 bp, Mus musculus
ctggcaaagccgaatgcgcgagcgc

SEQ ID NO: 345457 - DNA, 25 bp, Mus musculus
actgcccgcgtgtatgcaaacttgg

SEQ ID NO: 345458 - DNA, 25 bp, Mus musculus
gcgggattcgcaacgcaggcttgac

SEQ ID NO: 345459 - DNA, 25 bp, Mus musculus
aacgcaggcttgacggctgctactg

SEQ ID NO: 345460 - DNA, 25 bp, Mus musculus
tgggaaagggctcattggtgaaacc

SEQ ID NO: 345461 - DNA, 25 bp, Mus musculus
cggaaacccgatgagatggaaacgc

SEQ ID NO: 345462 - DNA, 25 bp, Mus musculus
cgatgagatggaaacgcggttgtca

SEQ ID NO: 345463 - DNA, 25 bp, Mus musculus
cagtttaaggagctcccagggcagg

SEQ ID NO: 345464 - DNA, 25 bp, Mus musculus
ccggctgcagtttaaggagctccca

SEQ ID NO: 345465 - DNA, 25 bp, Mus musculus
cgtctctgaccaccggctgcagttt

SEQ ID NO: 345466 - DNA, 25 bp, Mus musculus
cggctgctgtcttcgtctctgacca

SEQ ID NO: 345467 - DNA, 25 bp, Mus musculus
tgactgccacaaaaggagccgaggg

SEQ ID NO: 345468 - DNA, 25 bp, Mus musculus
gacggggcctccaaagtgactgcca

SEQ ID NO: 345469 - DNA, 25 bp, Mus musculus
tcaagagtaaggttctgagtgcagc

SEQ ID NO: 345470 - DNA, 25 bp, Mus musculus
ccgcggcgaccctcaagagtaaggt

SEQ ID NO: 345471 - DNA, 25 bp, Mus musculus
tgatcggcccagaactgcgacacct

SEQ ID NO: 345472 - DNA, 25 bp, Mus musculus
agctcaacggcttgatcggcccaga

SEQ ID NO: 345473 - DNA, 25 bp, Mus musculus
aaggcgcgttcttgccttcgctgcc

SEQ ID NO: 345474 - DNA, 25 bp, Mus musculus
gcgacctcggccaaggcgcgttctt

SEQ ID NO: 345475 - DNA, 25 bp, Mus musculus
ccgcgctcgcttgctgcagcgagga

SEQ ID NO: 345476 - DNA, 25 bp, Mus musculus
gaggtaccgcctgggcctagcagcc

SEQ ID NO: 345477 - DNA, 25 bp, Mus musculus
tgcccatcccacttgcacgggcttg

SEQ ID NO: 345478 - DNA, 25 bp, Mus musculus
tgcctgtcgccacactctctgccca

SEQ ID NO: 345479 - DNA, 25 bp, Mus musculus
cagcgtgtctctgtgcggtgccgaa

SEQ ID NO: 345480 - DNA, 25 bp, Mus musculus
gtctctgtgcggtgccgaaccatcc

SEQ ID NO: 345481 - DNA, 25 bp, Mus musculus
aaccatcccaccctgagtgttacag

SEQ ID NO: 345482 - DNA, 25 bp, Mus musculus
agcattcacaaaatcctggggccca

SEQ ID NO: 345483 - DNA, 25 bp, Mus musculus
tgtctggcaccaggcgccaagcgca

SEQ ID NO: 345484 - DNA, 25 bp, Mus musculus
ttgcacgggcttgaccctcccatgg

SEQ ID NO: 345485 - DNA, 25 bp, Mus musculus
cctccctacatctggcgctccggcg

SEQ ID NO: 345486 - DNA, 25 bp, Mus musculus
ttccaccacaactggggaaccgcca

SEQ ID NO: 345487 - DNA, 25 bp, Mus musculus
cccaaggagctcgtaagacttagag

SEQ ID NO: 345488 - DNA, 25 bp, Mus musculus
tcgtaagacttagagacaaacggcg

SEQ ID NO: 345489 - DNA, 25 bp, Mus musculus
agcacgctgcgaaaacttctctacc

SEQ ID NO: 345490 - DNA, 25 bp, Mus musculus
tggcagcacgctgcgaaaacttctc

SEQ ID NO: 345491 - DNA, 25 bp, Mus musculus
ggcacctggcatgctgcagctaaaa

SEQ ID NO: 345492 - DNA, 25 bp, Mus musculus
gcgctggcatggtacccaccggttc

SEQ ID NO: 345493 - DNA, 25 bp, Mus musculus
ggcgctggcatggtacccaccggtt

SEQ ID NO: 345494 - DNA, 25 bp, Mus musculus
ctgggatccaaacccggggcgcaga

SEQ ID NO: 345495 - DNA, 25 bp, Mus musculus
cgctggcccgcgctcactgaccgac

SEQ ID NO: 345496 - DNA, 25 bp, Mus musculus
cctggcatgctgcagctaaaagagg

SEQ ID NO: 345497 - DNA, 25 bp, Mus musculus
tgggatccaaacccggggcgcagat

SEQ ID NO: 345498 - DNA, 25 bp, Mus musculus
gtctgcccaagcgtagagccctgct

SEQ ID NO: 345499 - DNA, 25 bp, Mus musculus
ccaggctcctgtgctagacaagaag

SEQ ID NO: 345500 - DNA, 25 bp, Mus musculus
actttcaggatgtagaccggccgcc

SEQ ID NO: 345501 - DNA, 25 bp, Mus musculus
cgggaggcccaagtctcagaccttc

SEQ ID NO: 345502 - DNA, 25 bp, Mus musculus
tcgtccttcaagagcgatggcgccg

SEQ ID NO: 345503 - DNA, 25 bp, Mus musculus
tgctagacaagaagcccgcgcatcc

SEQ ID NO: 345504 - DNA, 25 bp, Mus musculus
cgcgtaatttgcatgcgctctaccc

SEQ ID NO: 345505 - DNA, 25 bp, Mus musculus
tcccacaaagcacagcgcgtaattt

SEQ ID NO: 345506 - DNA, 25 bp, Mus musculus
ttagggtgatttcccacaaagcaca

SEQ ID NO: 345507 - DNA, 25 bp, Mus musculus
ggccgccactataaggctcgaaaga

SEQ ID NO: 345508 - DNA, 25 bp, Mus musculus
gggatgatgacgtcgtccttcaaga

SEQ ID NO: 345509 - DNA, 25 bp, Mus musculus
ggggccgaagagtgacacgcactca

SEQ ID NO: 345510 - DNA, 25 bp, Mus musculus
ttcctccgcccactttcaggatgta

SEQ ID NO: 345511 - DNA, 25 bp, Mus musculus
agtctcagaccttcccaggggccga

SEQ ID NO: 345512 - DNA, 25 bp, Mus musculus
actgcttcggtgctccaggagccta

SEQ ID NO: 345513 - DNA, 25 bp, Mus musculus
agcctaagggctttcgtcacagcga

SEQ ID NO: 345514 - DNA, 25 bp, Mus musculus
caggcagcgcagtaaacactgcttc

SEQ ID NO: 345515 - DNA, 25 bp, Mus musculus
tcatcgtttcttatctgcaggcagc

SEQ ID NO: 345516 - DNA, 25 bp, Mus musculus
cgaccctgctcgctgaagggcctaa

SEQ ID NO: 345517 - DNA, 25 bp, Mus musculus
caggtaccttgttctagcgcgtttc

SEQ ID NO: 345518 - DNA, 25 bp, Mus musculus
tcgcccacgtgggaacaggcagact

SEQ ID NO: 345519 - DNA, 25 bp, Mus musculus
ggagccctcgaatcacgtgaccaca

SEQ ID NO: 345520 - DNA, 25 bp, Mus musculus
tcatcgcgctccagaaccacgtggg

SEQ ID NO: 345521 - DNA, 25 bp, Mus musculus
ccagaagttatgtcacgaggtgcca

SEQ ID NO: 345522 - DNA, 25 bp, Mus musculus
tgacgagctgtaaccggcactacca

SEQ ID NO: 345523 - DNA, 25 bp, Mus musculus
atcttgttggcgctgccttcgaacc

SEQ ID NO: 345524 - DNA, 25 bp, Mus musculus
gcagactccattctttgtgccgtga

SEQ ID NO: 345525 - DNA, 25 bp, Mus musculus
tcacagcgatgccaaagcggggaaa

SEQ ID NO: 345526 - DNA, 25 bp, Mus musculus
tctgagtaagctcgatccgctgctc

SEQ ID NO: 345527 - DNA, 25 bp, Mus musculus
ggcccaaatttagcgccagaacgtg

SEQ ID NO: 345528 - DNA, 25 bp, Mus musculus
agtcgctcctcattgggcccaagtc

SEQ ID NO: 345529 - DNA, 25 bp, Mus musculus
gctgagtccgtaaacactgcacgtg

SEQ ID NO: 345530 - DNA, 25 bp, Mus musculus
catggtcttcccgtagctgctgagt

SEQ ID NO: 345531 - DNA, 25 bp, Mus musculus
cgtgtcacgtcactgtcacatggtc

SEQ ID NO: 345532 - DNA, 25 bp, Mus musculus
tccattggagagagacgtgtcacgt

SEQ ID NO: 345533 - DNA, 25 bp, Mus musculus
tctgcgctgtcattcgtggacctga

SEQ ID NO: 345534 - DNA, 25 bp, Mus musculus
catgtttaccggctccgtacggagg

SEQ ID NO: 345535 - DNA, 25 bp, Mus musculus
aacccgctttcaggccaggcttagg

SEQ ID NO: 345536 - DNA, 25 bp, Mus musculus
cgtggggaaccctctgagtaagctc

SEQ ID NO: 345537 - DNA, 25 bp, Mus musculus
ttcccacggatgctccacggacgtg

SEQ ID NO: 345538 - DNA, 25 bp, Mus musculus
cgccctaaaacctggacaagaatcg

SEQ ID NO: 345539 - DNA, 25 bp, Mus musculus
agcgctcagatcagtttcctcaaaa

SEQ ID NO: 345540 - DNA, 25 bp, Mus musculus
tgctgcgaggcccggtccccatcga

SEQ ID NO: 345541 - DNA, 25 bp, Mus musculus
gctacccgctgcgtcgctggtctgt

SEQ ID NO: 345542 - DNA, 25 bp, Mus musculus
agctacccgctgcgtcgctggtctg

SEQ ID NO: 345543 - DNA, 25 bp, Mus musculus
gagctacccgctgcgtcgctggtct

SEQ ID NO: 345544 - DNA, 25 bp, Mus musculus
ggagctacccgctgcgtcgctggtc

SEQ ID NO: 345545 - DNA, 25 bp, Mus musculus
tctcgggggagctacccgctgcgtc

SEQ ID NO: 345546 - DNA, 25 bp, Mus musculus
cctcctgaagtcgccgcgtgtgagg

SEQ ID NO: 345547 - DNA, 25 bp, Mus musculus
gcctcctgaagtcgccgcgtgtgag

SEQ ID NO: 345548 - DNA, 25 bp, Mus musculus
gcgggcgctgctccccgatcccagc

SEQ ID NO: 345549 - DNA, 25 bp, Mus musculus
cgggcgctgctccccgatcccagcg

SEQ ID NO: 345550 - DNA, 25 bp, Mus musculus
ggcctcctgaagtcgccgcgtgtga

SEQ ID NO: 345551 - DNA, 25 bp, Mus musculus
ccggcggatgtagctcgggggtagc

SEQ ID NO: 345552 - DNA, 25 bp, Mus musculus
gcggatgtagctcgggggtagcggc

SEQ ID NO: 345553 - DNA, 25 bp, Mus musculus
gagaaggtggggcgcggatgtgcgt

SEQ ID NO: 345554 - DNA, 25 bp, Mus musculus
aggagcagagtcagccgtggccgcc

SEQ ID NO: 345555 - DNA, 25 bp, Mus musculus
actttaaagtgaagctgagcagcga

SEQ ID NO: 345556 - DNA, 25 bp, Mus musculus
gtgacaatggactatgactttaaag

SEQ ID NO: 345557 - DNA, 25 bp, Mus musculus
tgactttaaagtgaagctgagcagc

SEQ ID NO: 345558 - DNA, 25 bp, Mus musculus
ctatgactttaaagtgaagctgagc

SEQ ID NO: 345559 - DNA, 25 bp, Mus musculus
ggactatgactttaaagtgaagctg

SEQ ID NO: 345560 - DNA, 25 bp, Mus musculus
atggactatgactttaaagtgaagc

SEQ ID NO: 345561 - DNA, 25 bp, Mus musculus
caatggactatgactttaaagtgaa

SEQ ID NO: 345562 - DNA, 25 bp, Mus musculus
ccagcgcgtccctcggctgtcgcgc

SEQ ID NO: 345563 - DNA, 25 bp, Mus musculus
gacaatggactatgactttaaagtg

SEQ ID NO: 345564 - DNA, 25 bp, Mus musculus
ctgtgacaatggactatgactttaa

SEQ ID NO: 345565 - DNA, 25 bp, Mus musculus
ggctgtgacaatggactatgacttt

SEQ ID NO: 345566 - DNA, 25 bp, Mus musculus
cgtccctcggctgtcgcgcgcccgc

SEQ ID NO: 345567 - DNA, 25 bp, Mus musculus
gctgtgacaatggactatgacttta

SEQ ID NO: 345568 - DNA, 25 bp, Mus musculus
tgtgagagttgccaaacaggacctc

SEQ ID NO: 345569 - DNA, 25 bp, Mus musculus
cgacccgtgttctctcgcacgtaga

SEQ ID NO: 345570 - DNA, 25 bp, Mus musculus
taggggtttaatggacacggcgatc

SEQ ID NO: 345571 - DNA, 25 bp, Mus musculus
ttcgtgacagggttactcaaggtta

SEQ ID NO: 345572 - DNA, 25 bp, Mus musculus
cccatgttacgtgtggtgccgtgtt

SEQ ID NO: 345573 - DNA, 25 bp, Mus musculus
ggaagtcactcgtgtgtcacccatg

SEQ ID NO: 345574 - DNA, 25 bp, Mus musculus
aggacctcaccgtgactcctggtgc

SEQ ID NO: 345575 - DNA, 25 bp, Mus musculus
ggcagacatgtctccgcaggacgtg

SEQ ID NO: 345576 - DNA, 25 bp, Mus musculus
gaccttctcgcccttgagtggacgg

SEQ ID NO: 345577 - DNA, 25 bp, Mus musculus
cgtgagacccacaacacgcatgtga

SEQ ID NO: 345578 - DNA, 25 bp, Mus musculus
cacgtagattctcctggcgagctgc

SEQ ID NO: 345579 - DNA, 25 bp, Mus musculus
cgcgtatgtgagtcatgggaagtca

SEQ ID NO: 345580 - DNA, 25 bp, Mus musculus
gcatgttacccagacacacgtgaga

SEQ ID NO: 345581 - DNA, 25 bp, Mus musculus
tgcgttcccgtgtacgcagggctca

SEQ ID NO: 345582 - DNA, 25 bp, Mus musculus
atgcctcgggcagcaagcacctgca

SEQ ID NO: 345583 - DNA, 25 bp, Mus musculus
ctcattagttgataccgtccgggtc

SEQ ID NO: 345584 - DNA, 25 bp, Mus musculus
actgggtttccagagacatctctcg

SEQ ID NO: 345585 - DNA, 25 bp, Mus musculus
ccgggtcgaagttccacggaagatg

SEQ ID NO: 345586 - DNA, 25 bp, Mus musculus
aagtgcatcttcctctgctggcgga

SEQ ID NO: 345587 - DNA, 25 bp, Mus musculus
agatgctcttagctgcttgggctga

SEQ ID NO: 345588 - DNA, 25 bp, Mus musculus
acaggcatgtgtacttccgtttccg

SEQ ID NO: 345589 - DNA, 25 bp, Mus musculus
cccagtcccgagtaagtgcatcttc

SEQ ID NO: 345590 - DNA, 25 bp, Mus musculus
cgtttccggtgtgtcctgaagccat

SEQ ID NO: 345591 - DNA, 25 bp, Mus musculus
agccacgctcagcattgagaccacg

SEQ ID NO: 345592 - DNA, 25 bp, Mus musculus
caccgccaggacaccgagatttctg

SEQ ID NO: 345593 - DNA, 25 bp, Mus musculus
tggctgttagcaaatactccctctt

SEQ ID NO: 345594 - DNA, 25 bp, Mus musculus
gccttcttcgcagagacgtacataa

SEQ ID NO: 345595 - DNA, 25 bp, Mus musculus
gtttctttcgctgtctgcaggcata

SEQ ID NO: 345596 - DNA, 25 bp, Mus musculus
cttattaccatctcccgcccggtca

SEQ ID NO: 345597 - DNA, 25 bp, Mus musculus
gtcgtctctatagcgacgcccagca

SEQ ID NO: 345598 - DNA, 25 bp, Mus musculus
cgcgcctttcatcccgggccacgcc

SEQ ID NO: 345599 - DNA, 25 bp, Mus musculus
gacgcttattaccatctcccgcccg

SEQ ID NO: 345600 - DNA, 25 bp, Mus musculus
aacgcgcctttcatcccgggccacg

SEQ ID NO: 345601 - DNA, 25 bp, Mus musculus
cgcccggtcattagcctgggtccgg

SEQ ID NO: 345602 - DNA, 25 bp, Mus musculus
ggtcattagcctgggtccgggagga

SEQ ID NO: 345603 - DNA, 25 bp, Mus musculus
tcgtcgtctctatagcgacgcccag

SEQ ID NO: 345604 - DNA, 25 bp, Mus musculus
gtctctatagcgacgcccagcagcg

SEQ ID NO: 345605 - DNA, 25 bp, Mus musculus
cggtcccacttgtgcgcccccgccg

SEQ ID NO: 345606 - DNA, 25 bp, Mus musculus
ccgccgggcagaggccaggtgcagt

SEQ ID NO: 345607 - DNA, 25 bp, Mus musculus
gggcagaggccaggtgcagtgtccc

SEQ ID NO: 345608 - DNA, 25 bp, Mus musculus
ccaacgcgcctttcatcccgggcca

SEQ ID NO: 345609 - DNA, 25 bp, Mus musculus
ccaacccagacgcttattaccatct

SEQ ID NO: 345610 - DNA, 25 bp, Mus musculus
ctgccgttcctcgtccgaaccaaca

SEQ ID NO: 345611 - DNA, 25 bp, Mus musculus
agctcttctgcctttgtgcgcagca

SEQ ID NO: 345612 - DNA, 25 bp, Mus musculus
tctcgctgccgttcctcgtccgaac

SEQ ID NO: 345613 - DNA, 25 bp, Mus musculus
cgaaccaacaccctctcacggcggg

SEQ ID NO: 345614 - DNA, 25 bp, Mus musculus
tctcacggcgggcacgtagtgccca

SEQ ID NO: 345615 - DNA, 25 bp, Mus musculus
ttctgcctttgtgcgcagcagcgga

SEQ ID NO: 345616 - DNA, 25 bp, Mus musculus
gcacgtagtgcccaggaccctgtac

SEQ ID NO: 345617 - DNA, 25 bp, Mus musculus
gtagtgcccaggaccctgtacatca

SEQ ID NO: 345618 - DNA, 25 bp, Mus musculus
gtgcccaggaccctgtacatcatct

SEQ ID NO: 345619 - DNA, 25 bp, Mus musculus
ccaggaccctgtacatcatctcaag

SEQ ID NO: 345620 - DNA, 25 bp, Mus musculus
ggaccctgtacatcatctcaagagc

SEQ ID NO: 345621 - DNA, 25 bp, Mus musculus
ttgcagctcttctgcctttgtgcgc

SEQ ID NO: 345622 - DNA, 25 bp, Mus musculus
ccgaactacagccaggagaccagaa

SEQ ID NO: 345623 - DNA, 25 bp, Mus musculus
accctgtacatcatctcaagagcgc

SEQ ID NO: 345624 - DNA, 25 bp, Mus musculus
tcccgccgcttgctctccgactgct

SEQ ID NO: 345625 - DNA, 25 bp, Mus musculus
acctcctcagccgagtcccgccgct

SEQ ID NO: 345626 - DNA, 25 bp, Mus musculus
gtgctggtacctcctcagccgagtc

SEQ ID NO: 345627 - DNA, 25 bp, Mus musculus
aacaattggggtgctggtacctcct

SEQ ID NO: 345628 - DNA, 25 bp, Mus musculus
taggaattcccaacaattggggtgc

SEQ ID NO: 345629 - DNA, 25 bp, Mus musculus
agggcataggaattcccaacaattg

SEQ ID NO: 345630 - DNA, 25 bp, Mus musculus
gcgtcgagggcataggaattcccaa

SEQ ID NO: 345631 - DNA, 25 bp, Mus musculus
tatgggtagtggtgacagcgtgtct

SEQ ID NO: 345632 - DNA, 25 bp, Mus musculus
tcagacccggtctcggggcaggtat

SEQ ID NO: 345633 - DNA, 25 bp, Mus musculus
aacagagagctagatcaaggaaggg

SEQ ID NO: 345634 - DNA, 25 bp, Mus musculus
gcccggaaacagagagctagatcaa

SEQ ID NO: 345635 - DNA, 25 bp, Mus musculus
gcccgcccggaaacagagagctaga

SEQ ID NO: 345636 - DNA, 25 bp, Mus musculus
acgatttcagctccgcccgcccgga

SEQ ID NO: 345637 - DNA, 25 bp, Mus musculus
ctacgtcccacgatttcagctccgc

SEQ ID NO: 345638 - DNA, 25 bp, Mus musculus
gtcccgagctgaggctgaactgatc

SEQ ID NO: 345639 - DNA, 25 bp, Mus musculus
tgtgcccgcttagcgctccttggcg

SEQ ID NO: 345640 - DNA, 25 bp, Mus musculus
tcttgtgcccgcttagcgctccttg

SEQ ID NO: 345641 - DNA, 25 bp, Mus musculus
gccatggtgagtcccgcgaagcacc

SEQ ID NO: 345642 - DNA, 25 bp, Mus musculus
ctcccgacgccgagccatggtgagt

SEQ ID NO: 345643 - DNA, 25 bp, Mus musculus
gccggagagtgggacacctcccgac

SEQ ID NO: 345644 - DNA, 25 bp, Mus musculus
tagacccggcgagactgagcgcccg

SEQ ID NO: 345645 - DNA, 25 bp, Mus musculus
tcctgcagctagacccggcgagact

SEQ ID NO: 345646 - DNA, 25 bp, Mus musculus
cgcgagttgtcctgcagctagaccc

SEQ ID NO: 345647 - DNA, 25 bp, Mus musculus
cgtcctcagctgggcggttctcgga

SEQ ID NO: 345648 - DNA, 25 bp, Mus musculus
cagagcgaagaagacgcgggaaacc

SEQ ID NO: 345649 - DNA, 25 bp, Mus musculus
tgatcccgcagagcgaagaagacgc

SEQ ID NO: 345650 - DNA, 25 bp, Mus musculus
gctgaggctgaactgatcccgcaga

SEQ ID NO: 345651 - DNA, 25 bp, Mus musculus
ggctgaactgatcccgcagagcgaa

SEQ ID NO: 345652 - DNA, 25 bp, Mus musculus
cacacaggacaagggaagcgccgtt

SEQ ID NO: 345653 - DNA, 25 bp, Mus musculus
gcagatccagctcgccgtcgaaggc

SEQ ID NO: 345654 - DNA, 25 bp, Mus musculus
actgcatgccgcctgagcttctggc

SEQ ID NO: 345655 - DNA, 25 bp, Mus musculus
tgcctttgcagaaagggcaacggaa

SEQ ID NO: 345656 - DNA, 25 bp, Mus musculus
gaagcagggcgcgttcctccaactc

SEQ ID NO: 345657 - DNA, 25 bp, Mus musculus
aagcgctttccgcacacaggacaag

SEQ ID NO: 345658 - DNA, 25 bp, Mus musculus
gctctcccgagtcgggcttcgcgaa

SEQ ID NO: 345659 - DNA, 25 bp, Mus musculus
gttcgcctgcacgagtctcagacca

SEQ ID NO: 345660 - DNA, 25 bp, Mus musculus
ccgctgaggtgcgaaacttgccttt

SEQ ID NO: 345661 - DNA, 25 bp, Mus musculus
gtcctggagtcccactgacacctgg

SEQ ID NO: 345662 - DNA, 25 bp, Mus musculus
ctctcaggtgcaaagccaagatgga

SEQ ID NO: 345663 - DNA, 25 bp, Mus musculus
acacctggtccgttggagtagcgct

SEQ ID NO: 345664 - DNA, 25 bp, Mus musculus
actccagcaacagccgtgcagcagg

SEQ ID NO: 345665 - DNA, 25 bp, Mus musculus
atggaattgaatcggaagcgctttc

SEQ ID NO: 345666 - DNA, 25 bp, Mus musculus
ccaccctttccaaggcgggagcagg

SEQ ID NO: 345667 - DNA, 25 bp, Mus musculus
gggagcaaggcctagccgagttttc

SEQ ID NO: 345668 - DNA, 25 bp, Mus musculus
gctgtgcatctgctgagtgacgcca

SEQ ID NO: 345669 - DNA, 25 bp, Mus musculus
tgcaaaataaagagccttccctcgg

SEQ ID NO: 345670 - DNA, 25 bp, Mus musculus
cccgtgacctactgcaaaataaaga

SEQ ID NO: 345671 - DNA, 25 bp, Mus musculus
gtcctgcctaattcacccgagacta

SEQ ID NO: 345672 - DNA, 25 bp, Mus musculus
ttggatccgggtcctgcctaattca

SEQ ID NO: 345673 - DNA, 25 bp, Mus musculus
ggctgcgggtctctagccctcgtgc

SEQ ID NO: 345674 - DNA, 25 bp, Mus musculus
cgcagctgccggtactgacaaaggc

SEQ ID NO: 345675 - DNA, 25 bp, Mus musculus
cgcgagtgcccaggttcaaagtcct

SEQ ID NO: 345676 - DNA, 25 bp, Mus musculus
atgatgagtcagaggcgccggccct

SEQ ID NO: 345677 - DNA, 25 bp, Mus musculus
cctctagcgagcacgctggtggacc

SEQ ID NO: 345678 - DNA, 25 bp, Mus musculus
gagttttcctcggacgcgaccactg

SEQ ID NO: 345679 - DNA, 25 bp, Mus musculus
ttgtgctccaggtctcccttggatc

SEQ ID NO: 345680 - DNA, 25 bp, Mus musculus
aggtccggccagatcaccgcatttc

SEQ ID NO: 345681 - DNA, 25 bp, Mus musculus
gccggagctacaacagcgaagaacc

SEQ ID NO: 345682 - DNA, 25 bp, Mus musculus
tgttgcctcccgcatgagacccaag

SEQ ID NO: 345683 - DNA, 25 bp, Mus musculus
attttcgtacgcaccgtggcctgga

SEQ ID NO: 345684 - DNA, 25 bp, Mus musculus
agcgcgcagacagggtattttcgta

SEQ ID NO: 345685 - DNA, 25 bp, Mus musculus
cctcgttcctggaggcgttcctatt

SEQ ID NO: 345686 - DNA, 25 bp, Mus musculus
tcctattggctgtgacttttctcgc

SEQ ID NO: 345687 - DNA, 25 bp, Mus musculus
ttccgtccaatcataatccgaggtg

SEQ ID NO: 345688 - DNA, 25 bp, Mus musculus
tgcgagaatttccacatgcgtaaca

SEQ ID NO: 345689 - DNA, 25 bp, Mus musculus
tggttcagcttcatgccacttagtg

SEQ ID NO: 345690 - DNA, 25 bp, Mus musculus
ccacttagtgactgacggatggtta

SEQ ID NO: 345691 - DNA, 25 bp, Mus musculus
ttttcgcctttgtatcgcgcacagc

SEQ ID NO: 345692 - DNA, 25 bp, Mus musculus
gcgcacagcttctcatccgggtatc

SEQ ID NO: 345693 - DNA, 25 bp, Mus musculus
tgacggccgcatcgtcctatcagtg

SEQ ID NO: 345694 - DNA, 25 bp, Mus musculus
aaggacgaacgtgcagcgatccaca

SEQ ID NO: 345695 - DNA, 25 bp, Mus musculus
cctcgaccgcggtaggcagtgcaca

SEQ ID NO: 345696 - DNA, 25 bp, Mus musculus
cggtaggcagtgcacagcctcgagt

SEQ ID NO: 345697 - DNA, 25 bp, Mus musculus
gcgaaggacgaacgtgcagcgatcc

SEQ ID NO: 345698 - DNA, 25 bp, Mus musculus
gacgaacgtgcagcgatccacaact

SEQ ID NO: 345699 - DNA, 25 bp, Mus musculus
gaacgtgcagcgatccacaactacc

SEQ ID NO: 345700 - DNA, 25 bp, Mus musculus
agcgatccacaactacccaaccgga

SEQ ID NO: 345701 - DNA, 25 bp, Mus musculus
caaccggacctacggacacttgctg

SEQ ID NO: 345702 - DNA, 25 bp, Mus musculus
ccggacctacggacacttgctgtgc

SEQ ID NO: 345703 - DNA, 25 bp, Mus musculus
acctacggacacttgctgtgctcca

SEQ ID NO: 345704 - DNA, 25 bp, Mus musculus
acggacacttgctgtgctccaggag

SEQ ID NO: 345705 - DNA, 25 bp, Mus musculus
catgtgcagcgcctgtgtccctcga

SEQ ID NO: 345706 - DNA, 25 bp, Mus musculus
ctgtgtccctcgaccgcggtaggca

SEQ ID NO: 345707 - DNA, 25 bp, Mus musculus
accgcggtaggcagtgcacagcctc

SEQ ID NO: 345708 - DNA, 25 bp, Mus musculus
ctgccgacatgggaaaccggctttg

SEQ ID NO: 345709 - DNA, 25 bp, Mus musculus
tttgtccagagtcacagccattgcc

SEQ ID NO: 345710 - DNA, 25 bp, Mus musculus
ggaaggcactctcaaccaaacactg

SEQ ID NO: 345711 - DNA, 25 bp, Mus musculus
cgggtccctagagcgtcgaagattt

SEQ ID NO: 345712 - DNA, 25 bp, Mus musculus
ccgcactctctgtgacccggaagta

SEQ ID NO: 345713 - DNA, 25 bp, Mus musculus
cgagaatcacgcgaggtcccagctc

SEQ ID NO: 345714 - DNA, 25 bp, Mus musculus
ccggtagtacgcgtctttgtccaga

SEQ ID NO: 345715 - DNA, 25 bp, Mus musculus
tgtacaatctcttcactcgccggta

SEQ ID NO: 345716 - DNA, 25 bp, Mus musculus
caaacggtaattgtggcgggacctg

SEQ ID NO: 345717 - DNA, 25 bp, Mus musculus
aagagctccgggcacagctttcgcg

SEQ ID NO: 345718 - DNA, 25 bp, Mus musculus
gcgcgggagcagcatttctcaactc

SEQ ID NO: 345719 - DNA, 25 bp, Mus musculus
gtctgtgacccacgcagggcctaag

SEQ ID NO: 345720 - DNA, 25 bp, Mus musculus
gaggcgtcccatcaattaattctta

SEQ ID NO: 345721 - DNA, 25 bp, Mus musculus
attcttaggagagcccgcaggttcc

SEQ ID NO: 345722 - DNA, 25 bp, Mus musculus
tcgcccagcagtgccatgacaagct

SEQ ID NO: 345723 - DNA, 25 bp, Mus musculus
ccgcagatatgcctgcttggaaatc

SEQ ID NO: 345724 - DNA, 25 bp, Mus musculus
agcaagcttgctagtcctccatgcg

SEQ ID NO: 345725 - DNA, 25 bp, Mus musculus
tccatctaccaatggcgtggccgga

SEQ ID NO: 345726 - DNA, 25 bp, Mus musculus
gggcgccatccaggaagtctccgaa

SEQ ID NO: 345727 - DNA, 25 bp, Mus musculus
cgagcaagcgaggacgttgttaccc

SEQ ID NO: 345728 - DNA, 25 bp, Mus musculus
gggtacgtaggcaaccgcagatatg

SEQ ID NO: 345729 - DNA, 25 bp, Mus musculus
gacaagctccaaaactccacgctgg

SEQ ID NO: 345730 - DNA, 25 bp, Mus musculus
cagcgcctgcctctcacaaaggaga

SEQ ID NO: 345731 - DNA, 25 bp, Mus musculus
ctcacaaaggagagtggttcagccc

SEQ ID NO: 345732 - DNA, 25 bp, Mus musculus
gcaagagttgcaacccaccgtccgg

SEQ ID NO: 345733 - DNA, 25 bp, Mus musculus
cggcttccttccctgggcaagagtt

SEQ ID NO: 345734 - DNA, 25 bp, Mus musculus
acctgctacctgtctcgggaggcca

SEQ ID NO: 345735 - DNA, 25 bp, Mus musculus
tgccgcaggcttacctgagccagtc

SEQ ID NO: 345736 - DNA, 25 bp, Mus musculus
cggccaggaaagattccagccaatc

SEQ ID NO: 345737 - DNA, 25 bp, Mus musculus
ttccagccaatcaaaacactcagcg

SEQ ID NO: 345738 - DNA, 25 bp, Mus musculus
tagggcaaagccaacggagtcccgc

SEQ ID NO: 345739 - DNA, 25 bp, Mus musculus
accgaggcgcagatgccgaatctaa

SEQ ID NO: 345740 - DNA, 25 bp, Mus musculus
cgaatctaaggcgtcggattggtca

SEQ ID NO: 345741 - DNA, 25 bp, Mus musculus
ctccaggagtggagtatatcaggcg

SEQ ID NO: 345742 - DNA, 25 bp, Mus musculus
tcgcactcgcgccttaggaagcttg

SEQ ID NO: 345743 - DNA, 25 bp, Mus musculus
gctgtcttcccgctcgcgtcaggga

SEQ ID NO: 345744 - DNA, 25 bp, Mus musculus
aagtgggtcagctccgcctccaaat

SEQ ID NO: 345745 - DNA, 25 bp, Mus musculus
acgcttgtcggagggcgtcctccac

SEQ ID NO: 345746 - DNA, 25 bp, Mus musculus
ggccgccgcgatgctttgaaaagct

SEQ ID NO: 345747 - DNA, 25 bp, Mus musculus
gctttgaaaagcttcgccggcgaaa

SEQ ID NO: 345748 - DNA, 25 bp, Mus musculus
tccaaagtccggttgtccgcagatg

SEQ ID NO: 345749 - DNA, 25 bp, Mus musculus
atatcaggcgggactcttgcgctcc

SEQ ID NO: 345750 - DNA, 25 bp, Mus musculus
taagcgtaagtcatggtcccgaggc

SEQ ID NO: 345751 - DNA, 25 bp, Mus musculus
ctagctcaagctgcgtctctattgc

SEQ ID NO: 345752 - DNA, 25 bp, Mus musculus
gggttacctgtgtctccgatgatga

SEQ ID NO: 345753 - DNA, 25 bp, Mus musculus
aaatcttcgctggatcggctgtacc

SEQ ID NO: 345754 - DNA, 25 bp, Mus musculus
cccagtgctcttctacatgccatta

SEQ ID NO: 345755 - DNA, 25 bp, Mus musculus
atcgagactggttgcgtccctgact

SEQ ID NO: 345756 - DNA, 25 bp, Mus musculus
gtccctgactcggtccaatcatcgg

SEQ ID NO: 345757 - DNA, 25 bp, Mus musculus
ccaatcatcggagagcgacgctttc

SEQ ID NO: 345758 - DNA, 25 bp, Mus musculus
ttctccttgaggaagtgacgcgctc

SEQ ID NO: 345759 - DNA, 25 bp, Mus musculus
tcccggaggaaatgacaattacctg

SEQ ID NO: 345760 - DNA, 25 bp, Mus musculus
ttacctgacgatcactgggccctcg

SEQ ID NO: 345761 - DNA, 25 bp, Mus musculus
tcaggagccgaggtgagcaaaagct

SEQ ID NO: 345762 - DNA, 25 bp, Mus musculus
gccactcaatctacgggtctcctta

SEQ ID NO: 345763 - DNA, 25 bp, Mus musculus
gatttctacagccacttacctccga

SEQ ID NO: 345764 - DNA, 25 bp, Mus musculus
aagtgcccagagtcctgcttccgtc

SEQ ID NO: 345765 - DNA, 25 bp, Mus musculus
actgcaagctttcccgcaggtgggc

SEQ ID NO: 345766 - DNA, 25 bp, Mus musculus
ccagccggacgtaatcctcacggta

SEQ ID NO: 345767 - DNA, 25 bp, Mus musculus
aagccacttccggttggcgaaccag

SEQ ID NO: 345768 - DNA, 25 bp, Mus musculus
gccagccggatagagccaagatgaa

SEQ ID NO: 345769 - DNA, 25 bp, Mus musculus
atagagctccacgtgtccgacatcc

SEQ ID NO: 345770 - DNA, 25 bp, Mus musculus
ttcttatgggcctggatagagctcc

SEQ ID NO: 345771 - DNA, 25 bp, Mus musculus
gtagttctctctcgtgtttccggga

SEQ ID NO: 345772 - DNA, 25 bp, Mus musculus
gtcgccgctgcaatctctcgcgaag

SEQ ID NO: 345773 - DNA, 25 bp, Mus musculus
tgtcttcctctccaggagtctctcg

SEQ ID NO: 345774 - DNA, 25 bp, Mus musculus
gagtccaataaagggctgctccgga

SEQ ID NO: 345775 - DNA, 25 bp, Mus musculus
tggggtaaccaacaatcgaggagtc

SEQ ID NO: 345776 - DNA, 25 bp, Mus musculus
ggcatgcgtttcagctactcgggaa

SEQ ID NO: 345777 - DNA, 25 bp, Mus musculus
gcgaagcgagtccagctgtttctta

SEQ ID NO: 345778 - DNA, 25 bp, Mus musculus
gtggagctcaagtactcctccagga

SEQ ID NO: 345779 - DNA, 25 bp, Mus musculus
gacggacaccacagacgccgacatg

SEQ ID NO: 345780 - DNA, 25 bp, Mus musculus
ccgacatgacgaacacggggacttc

SEQ ID NO: 345781 - DNA, 25 bp, Mus musculus
ttcggataccggacgaccacagacg

SEQ ID NO: 345782 - DNA, 25 bp, Mus musculus
tggctccggcgtaaaggccagcctt

SEQ ID NO: 345783 - DNA, 25 bp, Mus musculus
ggccagccttggtgcgtcacaatta

SEQ ID NO: 345784 - DNA, 25 bp, Mus musculus
gacacaggctgcatacccagactga

SEQ ID NO: 345785 - DNA, 25 bp, Mus musculus
taaattaatgctcctgcgcagggcc

SEQ ID NO: 345786 - DNA, 25 bp, Mus musculus
ccctctggagacgtgtactatagcc

SEQ ID NO: 345787 - DNA, 25 bp, Mus musculus
actatagccttatttccgccctgcg

SEQ ID NO: 345788 - DNA, 25 bp, Mus musculus
gccctgcgtttgttgacgccctctg

SEQ ID NO: 345789 - DNA, 25 bp, Mus musculus
tgctctggcgacgagatttgtgacc

SEQ ID NO: 345790 - DNA, 25 bp, Mus musculus
ggacagagacgcttcccagagagtt

SEQ ID NO: 345791 - DNA, 25 bp, Mus musculus
aggagataggcgtccagcaacttca

SEQ ID NO: 345792 - DNA, 25 bp, Mus musculus
ttcggtaacaggatgcgggagaccc

SEQ ID NO: 345793 - DNA, 25 bp, Mus musculus
tggtcagtaccatagcgtcgcagtg

SEQ ID NO: 345794 - DNA, 25 bp, Mus musculus
ttcccttcctttcacatggtcagta

SEQ ID NO: 345795 - DNA, 25 bp, Mus musculus
gcctgtagtctgtgcgagcagagtt

SEQ ID NO: 345796 - DNA, 25 bp, Mus musculus
tgtttggaaactgcctgcgaccctg

SEQ ID NO: 345797 - DNA, 25 bp, Mus musculus
cgagtcatgacctccggtcgcgtga

SEQ ID NO: 345798 - DNA, 25 bp, Mus musculus
ggtcactgcgacctgcgagtcatga

SEQ ID NO: 345799 - DNA, 25 bp, Mus musculus
tcacgagcagatgctgacctggtca

SEQ ID NO: 345800 - DNA, 25 bp, Mus musculus
tgtcacctgagctgaggtcacgagc

SEQ ID NO: 345801 - DNA, 25 bp, Mus musculus
atgctgccttgtccttgtcacctga

SEQ ID NO: 345802 - DNA, 25 bp, Mus musculus
tcccggcaagatggcgaggaattta

SEQ ID NO: 345803 - DNA, 25 bp, Mus musculus
gtgcgcgagagtaagttccctcttc

SEQ ID NO: 345804 - DNA, 25 bp, Mus musculus
cccgcagcgtcaaagttctgagtgc

SEQ ID NO: 345805 - DNA, 25 bp, Mus musculus
ggctgggactcaaggccttcccttc

SEQ ID NO: 345806 - DNA, 25 bp, Mus musculus
acttggaaacagctgcgaaggattc

SEQ ID NO: 345807 - DNA, 25 bp, Mus musculus
ggaccggcgattgaaaaccacattc

SEQ ID NO: 345808 - DNA, 25 bp, Mus musculus
ggcaggacctagtatcccgccgcgt

SEQ ID NO: 345809 - DNA, 25 bp, Mus musculus
cgaaggattcggtcacaggtatctc

SEQ ID NO: 345810 - DNA, 25 bp, Mus musculus
agctgactcccacttccgtacgata

SEQ ID NO: 345811 - DNA, 25 bp, Mus musculus
tgtccggagattgcactgcagcgta

SEQ ID NO: 345812 - DNA, 25 bp, Mus musculus
taactccctgctcttccattaggtg

SEQ ID NO: 345813 - DNA, 25 bp, Mus musculus
cctggctgtccagtgagtgattgtg

SEQ ID NO: 345814 - DNA, 25 bp, Mus musculus
ttccggttcccttgctccggcatgg

SEQ ID NO: 345815 - DNA, 25 bp, Mus musculus
ggtatctcaaccacctcggagggtg

SEQ ID NO: 345816 - DNA, 25 bp, Mus musculus
tacgataacgcaagatggtgggacc

SEQ ID NO: 345817 - DNA, 25 bp, Mus musculus
gttcagaacactcagcccacagctg

SEQ ID NO: 345818 - DNA, 25 bp, Mus musculus
ggggcagttcctcctgttcagaaca

SEQ ID NO: 345819 - DNA, 25 bp, Mus musculus
tcaagatgtcggcttccggttttcc

SEQ ID NO: 345820 - DNA, 25 bp, Mus musculus
tgtgtcgccaagcaacgcggctcag

SEQ ID NO: 345821 - DNA, 25 bp, Mus musculus
actgtagctacagcgccgacactcg

SEQ ID NO: 345822 - DNA, 25 bp, Mus musculus
gtggagctgtcccaccgcgcagtat

SEQ ID NO: 345823 - DNA, 25 bp, Mus musculus
accgcgcagtatccagcgaggtatc

SEQ ID NO: 345824 - DNA, 25 bp, Mus musculus
tccagcgaggtatctgggcactgcc

SEQ ID NO: 345825 - DNA, 25 bp, Mus musculus
tctgggcactgcctggctttcacct

SEQ ID NO: 345826 - DNA, 25 bp, Mus musculus
ggcacacccaaagcccaggcaggat

SEQ ID NO: 345827 - DNA, 25 bp, Mus musculus
ggcgcctcctcctggaccaaaagat

SEQ ID NO: 345828 - DNA, 25 bp, Mus musculus
gatcctcttcatagggacgcccaga

SEQ ID NO: 345829 - DNA, 25 bp, Mus musculus
cgcccgcctccttagagagctttga

SEQ ID NO: 345830 - DNA, 25 bp, Mus musculus
ctttgaaataaagccagcccgtctc

SEQ ID NO: 345831 - DNA, 25 bp, Mus musculus
ccgccacaggggtcaacggttctgt

SEQ ID NO: 345832 - DNA, 25 bp, Mus musculus
tcaacggttctgtgtctggccaacc

SEQ ID NO: 345833 - DNA, 25 bp, Mus musculus
gtgaggaaacgctccactgtagcta

SEQ ID NO: 345834 - DNA, 25 bp, Mus musculus
tgcacggacgcatccgtaccaagtg

SEQ ID NO: 345835 - DNA, 25 bp, Mus musculus
agttgatccaacttttgcctgcctc

SEQ ID NO: 345836 - DNA, 25 bp, Mus musculus
ccttccctggaagaactctgcagcg

SEQ ID NO: 345837 - DNA, 25 bp, Mus musculus
aagctctgcgcgcactgtggcacaa

SEQ ID NO: 345838 - DNA, 25 bp, Mus musculus
ggtgtcacacgcgagttgttccttc

SEQ ID NO: 345839 - DNA, 25 bp, Mus musculus
ttctgcattgatcgcggggagacta

SEQ ID NO: 345840 - DNA, 25 bp, Mus musculus
cgaccgcgctctaggaatccacatt

SEQ ID NO: 345841 - DNA, 25 bp, Mus musculus
atccacattccgttcctttagaaga

SEQ ID NO: 345842 - DNA, 25 bp, Mus musculus
gggcctcgcttttccaagctctgcg

SEQ ID NO: 345843 - DNA, 25 bp, Mus musculus
gaacttccgcgcacacaaagctctt

SEQ ID NO: 345844 - DNA, 25 bp, Mus musculus
ctcttcttgtgagcagcggggctca

SEQ ID NO: 345845 - DNA, 25 bp, Mus musculus
ggctgggcccaaggcagcaacttca

SEQ ID NO: 345846 - DNA, 25 bp, Mus musculus
cgaagtaagtgagctcctccggccc

SEQ ID NO: 345847 - DNA, 25 bp, Mus musculus
tgttccttcagtttggcagcgctca

SEQ ID NO: 345848 - DNA, 25 bp, Mus musculus
tccacaaagtttggtccgcggagga

SEQ ID NO: 345849 - DNA, 25 bp, Mus musculus
gatccggagcgtgacggcaaaagca

SEQ ID NO: 345850 - DNA, 25 bp, Mus musculus
agcgtgacggcaaaagcaacccgga

SEQ ID NO: 345851 - DNA, 25 bp, Mus musculus
aagcaacccggaaaggagctgagcg

SEQ ID NO: 345852 - DNA, 25 bp, Mus musculus
gggcactggtaaggagcgatcaact

SEQ ID NO: 345853 - DNA, 25 bp, Mus musculus
gacgggcagtccacaaagtttggtc

SEQ ID NO: 345854 - DNA, 25 bp, Mus musculus
gacctttcggcgaggtcacgcacct

SEQ ID NO: 345855 - DNA, 25 bp, Mus musculus
tgttcaacccaggatgctatcggcc

SEQ ID NO: 345856 - DNA, 25 bp, Mus musculus
tcctgccaggtagacaagaggcgcc

SEQ ID NO: 345857 - DNA, 25 bp, Mus musculus
cgaggagcttcctgccaggtagaca

SEQ ID NO: 345858 - DNA, 25 bp, Mus musculus
gcaagaggcgtcacgcctgttcctc

SEQ ID NO: 345859 - DNA, 25 bp, Mus musculus
tgaagttagcaagaggcgtcacgcc

SEQ ID NO: 345860 - DNA, 25 bp, Mus musculus
ggagcgatcaactctgaagttagca

SEQ ID NO: 345861 - DNA, 25 bp, Mus musculus
accgcgagctgtgcaaagccgccgt

SEQ ID NO: 345862 - DNA, 25 bp, Mus musculus
cctcaccaagaaagctaagcgcttc

SEQ ID NO: 345863 - DNA, 25 bp, Mus musculus
ggacgctgagctgcaagcacatcga

SEQ ID NO: 345864 - DNA, 25 bp, Mus musculus
agcacatcgagacgtcggccgctct

SEQ ID NO: 345865 - DNA, 25 bp, Mus musculus
ttcgagggtgctgtgcgtcagatca

SEQ ID NO: 345866 - DNA, 25 bp, Mus musculus
ctcgtgagctcttcgagggtgctgt

SEQ ID NO: 345867 - DNA, 25 bp, Mus musculus
tacgcgccgtgagagcctcaccaag

SEQ ID NO: 345868 - DNA, 25 bp, Mus musculus
tggtgccgcgcaacgctaagttctt

SEQ ID NO: 345869 - DNA, 25 bp, Mus musculus
cgctaagttcttcaagcaacgctcc

SEQ ID NO: 345870 - DNA, 25 bp, Mus musculus
agcaacgctccaggtcatgtcacga

SEQ ID NO: 345871 - DNA, 25 bp, Mus musculus
gtcatgtcacgacctctctgtgctc

SEQ ID NO: 345872 - DNA, 25 bp, Mus musculus
tctctgtgctctgagccacggtcgc

SEQ ID NO: 345873 - DNA, 25 bp, Mus musculus
ccacggtcgccatggtcactgcagt

SEQ ID NO: 345874 - DNA, 25 bp, Mus musculus
taagcgcttcctcgccaacctggtg

SEQ ID NO: 345875 - DNA, 25 bp, Mus musculus
accacaacactcgtgagctcttcga

SEQ ID NO: 345876 - DNA, 25 bp, Mus musculus
aggtccctcccgctggacacgcggc

SEQ ID NO: 345877 - DNA, 25 bp, Mus musculus
gaccaagccgctgctcccaccaatc

SEQ ID NO: 345878 - DNA, 25 bp, Mus musculus
accagagcgtctttacagctccaga

SEQ ID NO: 345879 - DNA, 25 bp, Mus musculus
cgccttaacaaccagagcgtcttta

SEQ ID NO: 345880 - DNA, 25 bp, Mus musculus
gggacaagtcgccttaacaaccaga

SEQ ID NO: 345881 - DNA, 25 bp, Mus musculus
ccaggaggcgggacaagtcgcctta

SEQ ID NO: 345882 - DNA, 25 bp, Mus musculus
tccaatcacgaagcggtgaagagtc

SEQ ID NO: 345883 - DNA, 25 bp, Mus musculus
actagagtccaatcacgaagcggtg

SEQ ID NO: 345884 - DNA, 25 bp, Mus musculus
ggacacgcggctgccaccagcacct

SEQ ID NO: 345885 - DNA, 25 bp, Mus musculus
ttcggggacgcaattcaggtccctc

SEQ ID NO: 345886 - DNA, 25 bp, Mus musculus
aatccgcaattctcacagtgacgtg

SEQ ID NO: 345887 - DNA, 25 bp, Mus musculus
gccgggattccttgatactagagtc

SEQ ID NO: 345888 - DNA, 25 bp, Mus musculus
ggcccacgccgggattccttgatac

SEQ ID NO: 345889 - DNA, 25 bp, Mus musculus
gccatcttttccctcgcgcggccca

SEQ ID NO: 345890 - DNA, 25 bp, Mus musculus
aacactttcgctcgcgctcgtgtcg

SEQ ID NO: 345891 - DNA, 25 bp, Mus musculus
cggcagaggcctcgcccagtacagg

SEQ ID NO: 345892 - DNA, 25 bp, Mus musculus
ctcgcgctcgtgtcgcatccctccg

SEQ ID NO: 345893 - DNA, 25 bp, Mus musculus
gaggtaacactttcgctcgcgctcg

SEQ ID NO: 345894 - DNA, 25 bp, Mus musculus
gtgcctcgaggtaacactttcgctc

SEQ ID NO: 345895 - DNA, 25 bp, Mus musculus
tggcctgtgcctcgaggtaacactt

SEQ ID NO: 345896 - DNA, 25 bp, Mus musculus
ctagctctgcagctggcctgtgcct

SEQ ID NO: 345897 - DNA, 25 bp, Mus musculus
gcgagccacagaccctccgagactc

SEQ ID NO: 345898 - DNA, 25 bp, Mus musculus
cccgccagttccaggcattctctgc

SEQ ID NO: 345899 - DNA, 25 bp, Mus musculus
ctcgcccagtacagggccgggtgca

SEQ ID NO: 345900 - DNA, 25 bp, Mus musculus
ggcattctctgctagcctccgaagc

SEQ ID NO: 345901 - DNA, 25 bp, Mus musculus
ggggacagacgcgagccacagaccc

SEQ ID NO: 345902 - DNA, 25 bp, Mus musculus
accctccgagactcgcccgctgctc

SEQ ID NO: 345903 - DNA, 25 bp, Mus musculus
ccgctagctctgcagctggcctgtg

SEQ ID NO: 345904 - DNA, 25 bp, Mus musculus
gctgccgccagcgtagaaacaactg

SEQ ID NO: 345905 - DNA, 25 bp, Mus musculus
ccacaggacgtgaccttaggcttca

SEQ ID NO: 345906 - DNA, 25 bp, Mus musculus
cgctcagcgcaactgtcgcggtagc

SEQ ID NO: 345907 - DNA, 25 bp, Mus musculus
aaccgcccaggggtcctcagcggag

SEQ ID NO: 345908 - DNA, 25 bp, Mus musculus
ctgggtcttaaatcagccgggcaca

SEQ ID NO: 345909 - DNA, 25 bp, Mus musculus
tcgtcgagcgctaacctgcacggct

SEQ ID NO: 345910 - DNA, 25 bp, Mus musculus
ccaaggagtcctaaagggcgagcgc

SEQ ID NO: 345911 - DNA, 25 bp, Mus musculus
gacctaccgtctgggtcgccaagga

SEQ ID NO: 345912 - DNA, 25 bp, Mus musculus
ctgttttcacaagaggtgaccctta

SEQ ID NO: 345913 - DNA, 25 bp, Mus musculus
ggtgacccttacaaggccggagata

SEQ ID NO: 345914 - DNA, 25 bp, Mus musculus
gaactctgacgcaggcgtgcttcga

SEQ ID NO: 345915 - DNA, 25 bp, Mus musculus
acgctgtgctggacgcagattgatc

SEQ ID NO: 345916 - DNA, 25 bp, Mus musculus
cagattgatcgtcctgactgttttc

SEQ ID NO: 345917 - DNA, 25 bp, Mus musculus
taatcaagatgcagacgcgctctcc

SEQ ID NO: 345918 - DNA, 25 bp, Mus musculus
ggccggttccaaaggttcatctcca

SEQ ID NO: 345919 - DNA, 25 bp, Mus musculus
ggcgatgggtaaccgcacacattga

SEQ ID NO: 345920 - DNA, 25 bp, Mus musculus
cacggtgtcctgacttcctaggtcc

SEQ ID NO: 345921 - DNA, 25 bp, Mus musculus
cgcttcaaaggagccgcgtgcgttc

SEQ ID NO: 345922 - DNA, 25 bp, Mus musculus
gaaaggacccttcgaagcgctgcgc

SEQ ID NO: 345923 - DNA, 25 bp, Mus musculus
agccgtggtctccagccgaaaatca

SEQ ID NO: 345924 - DNA, 25 bp, Mus musculus
catcgctggccgagctactggcgaa

SEQ ID NO: 345925 - DNA, 25 bp, Mus musculus
cccacggaccgatgggcacatagtc

SEQ ID NO: 345926 - DNA, 25 bp, Mus musculus
gcaatgctgttagctcgtcctggta

SEQ ID NO: 345927 - DNA, 25 bp, Mus musculus
gtagccacggtcaaacgcagcaatg

SEQ ID NO: 345928 - DNA, 25 bp, Mus musculus
ctctggctcccgtatccgtgatcgg

SEQ ID NO: 345929 - DNA, 25 bp, Mus musculus
agtaatcttctctggcctctggctc

SEQ ID NO: 345930 - DNA, 25 bp, Mus musculus
ggtctctcggttccctagcttcttc

SEQ ID NO: 345931 - DNA, 25 bp, Mus musculus
cccgtagcctgtaaccgagtgtcgt

SEQ ID NO: 345932 - DNA, 25 bp, Mus musculus
cgggtccgaagtgcctcatgatact

SEQ ID NO: 345933 - DNA, 25 bp, Mus musculus
acaggtgctggtcctcgggtccgaa

SEQ ID NO: 345934 - DNA, 25 bp, Mus musculus
cattaagactgtcctcctcgtcgga

SEQ ID NO: 345935 - DNA, 25 bp, Mus musculus
ttccacaggtgctggtcctcgggtc

SEQ ID NO: 345936 - DNA, 25 bp, Mus musculus
ttctgtcacgtccttccacaggtgc

SEQ ID NO: 345937 - DNA, 25 bp, Mus musculus
cggacatcagctcttctgtcacgtc

SEQ ID NO: 345938 - DNA, 25 bp, Mus musculus
ccgaagtgcctcatgatactggatc

SEQ ID NO: 345939 - DNA, 25 bp, Mus musculus
ctttggtgccgtgcttagagttagc

SEQ ID NO: 345940 - DNA, 25 bp, Mus musculus
gtgcctcatgatactggatcgattg

SEQ ID NO: 345941 - DNA, 25 bp, Mus musculus
tggctcattaagactgtcctcctcg

SEQ ID NO: 345942 - DNA, 25 bp, Mus musculus
ccacacacctggctcattaagactg

SEQ ID NO: 345943 - DNA, 25 bp, Mus musculus
ctctgtgaggcgctgggccctgaat

SEQ ID NO: 345944 - DNA, 25 bp, Mus musculus
gcttagagttagcatccaggtggta

SEQ ID NO: 345945 - DNA, 25 bp, Mus musculus
cctcgtcggacatcagctcttctgt

SEQ ID NO: 345946 - DNA, 25 bp, Mus musculus
ctcgcgctgataggcggttgaacca

SEQ ID NO: 345947 - DNA, 25 bp, Mus musculus
aggccgcgtcccatcgagcaagaag

SEQ ID NO: 345948 - DNA, 25 bp, Mus musculus
ccgggtcctcacgagtggacctcaa

SEQ ID NO: 345949 - DNA, 25 bp, Mus musculus
agtggacctcaagggcagcctctag

SEQ ID NO: 345950 - DNA, 25 bp, Mus musculus
gtttccgagactgccgcacccgtgt

SEQ ID NO: 345951 - DNA, 25 bp, Mus musculus
cggttgaaccaaaaggatgcagggc

SEQ ID NO: 345952 - DNA, 25 bp, Mus musculus
accaaaaggatgcagggccagggac

SEQ ID NO: 345953 - DNA, 25 bp, Mus musculus
gacgctattggcgtgcgctcccagt

SEQ ID NO: 345954 - DNA, 25 bp, Mus musculus
gtgcgctcccagtcactcaacgagg

SEQ ID NO: 345955 - DNA, 25 bp, Mus musculus
ccagtcactcaacgaggcggaggga

SEQ ID NO: 345956 - DNA, 25 bp, Mus musculus
tcctcaggcacggacacgaccaaga

SEQ ID NO: 345957 - DNA, 25 bp, Mus musculus
cggacacgaccaagagaggcttttt

SEQ ID NO: 345958 - DNA, 25 bp, Mus musculus
agagaggctttttcaaggacgccgg

SEQ ID NO: 345959 - DNA, 25 bp, Mus musculus
tcaagggcagcctctagagcccact

SEQ ID NO: 345960 - DNA, 25 bp, Mus musculus
gtctgagcaccttgaaggccagggt

SEQ ID NO: 345961 - DNA, 25 bp, Mus musculus
gggcaaccacacctctaaataccag

SEQ ID NO: 345962 - DNA, 25 bp, Mus musculus
gccatttttactccgggcaaccaca

SEQ ID NO: 345963 - DNA, 25 bp, Mus musculus
cttcacgtccagctaagtctagacg

SEQ ID NO: 345964 - DNA, 25 bp, Mus musculus
taggagccaacccacgctgtccgtc

SEQ ID NO: 345965 - DNA, 25 bp, Mus musculus
gccacggtccgctgttcccaggtag

SEQ ID NO: 345966 - DNA, 25 bp, Mus musculus
ctgttcccaggtagggctcctgaaa

SEQ ID NO: 345967 - DNA, 25 bp, Mus musculus
agggctcctgaaaaggggcaaactg

SEQ ID NO: 345968 - DNA, 25 bp, Mus musculus
ggcggcgccatttttactccgggca

SEQ ID NO: 345969 - DNA, 25 bp, Mus musculus
gcaaactggggtcgcctaggagcca

SEQ ID NO: 345970 - DNA, 25 bp, Mus musculus
agctgtctgagcaccttgaaggcca

SEQ ID NO: 345971 - DNA, 25 bp, Mus musculus
tctcctttcttaaggctacgagaca

SEQ ID NO: 345972 - DNA, 25 bp, Mus musculus
tacgagacagtgaacccgccaaggg

SEQ ID NO: 345973 - DNA, 25 bp, Mus musculus
gaagcgcgagctgtctgagcacctt

SEQ ID NO: 345974 - DNA, 25 bp, Mus musculus
agccgtacacctgcaccgagtcata

SEQ ID NO: 345975 - DNA, 25 bp, Mus musculus
gtgtcctcctctccgccaccctcgt

SEQ ID NO: 345976 - DNA, 25 bp, Mus musculus
ctctgccagagtgcggaagagtgga

SEQ ID NO: 345977 - DNA, 25 bp, Mus musculus
acaccgccagcctcactgcccgagc

SEQ ID NO: 345978 - DNA, 25 bp, Mus musculus
tcactgcccgagcccagggagctga

SEQ ID NO: 345979 - DNA, 25 bp, Mus musculus
ttcatagccgtacacctgcaccgag

SEQ ID NO: 345980 - DNA, 25 bp, Mus musculus
tccgcctcgcgcagccgcaacgcca

SEQ ID NO: 345981 - DNA, 25 bp, Mus musculus
agcaactgcaccacatcggcggggc

SEQ ID NO: 345982 - DNA, 25 bp, Mus musculus
gagcggctccatccgggttctgcaa

SEQ ID NO: 345983 - DNA, 25 bp, Mus musculus
aggctgtgatgtcgaaggcctccgt

SEQ ID NO: 345984 - DNA, 25 bp, Mus musculus
gccaccctcgtcatcataggtgatg

SEQ ID NO: 345985 - DNA, 25 bp, Mus musculus
ctcgtcatcataggtgatgatgttc

SEQ ID NO: 345986 - DNA, 25 bp, Mus musculus
tacacctgcaccgagtcatacgggg

SEQ ID NO: 345987 - DNA, 25 bp, Mus musculus
tctgcaaggctgtgatgtcgaaggc

SEQ ID NO: 345988 - DNA, 25 bp, Mus musculus
cccttggggcttttcatctcagtcc

SEQ ID NO: 345989 - DNA, 25 bp, Mus musculus
acgccgtggactcaagtaccaaatc

SEQ ID NO: 345990 - DNA, 25 bp, Mus musculus
tgctgaccctaatgacaacgccgtg

SEQ ID NO: 345991 - DNA, 25 bp, Mus musculus
gggtgggttaagcactcagaccttc

SEQ ID NO: 345992 - DNA, 25 bp, Mus musculus
acataggcctttccgcggtgccatc

SEQ ID NO: 345993 - DNA, 25 bp, Mus musculus
gccaggccctaaatttgcagtaatc

SEQ ID NO: 345994 - DNA, 25 bp, Mus musculus
ctggagttcctagaccacgaaagca

SEQ ID NO: 345995 - DNA, 25 bp, Mus musculus
cagcggcccaccttcagacagatga

SEQ ID NO: 345996 - DNA, 25 bp, Mus musculus
gccagaagcgcatgcaccacaagta

SEQ ID NO: 345997 - DNA, 25 bp, Mus musculus
ctcagtccctgcagctcgttgtttc

SEQ ID NO: 345998 - DNA, 25 bp, Mus musculus
gcggctagtatagcagcgctttcta

SEQ ID NO: 345999 - DNA, 25 bp, Mus musculus
agtcctgatcctgttgcggctagta

SEQ ID NO: 346000 - DNA, 25 bp, Mus musculus
cgcagctaaggagttcgcttctata

SEQ ID NO: 346001 - DNA, 25 bp, Mus musculus
tgtgaataaacgcatcgggaacctg

SEQ ID NO: 346002 - DNA, 25 bp, Mus musculus
cagcccgcagcacggcaaggtacag

SEQ ID NO: 346003 - DNA, 25 bp, Mus musculus
gggcaggcgcccttacctggcacta

SEQ ID NO: 346004 - DNA, 25 bp, Mus musculus
tcaggaccttgtgcgggtcacgacg

SEQ ID NO: 346005 - DNA, 25 bp, Mus musculus
tgcgaggctaccgactcaggacctt

SEQ ID NO: 346006 - DNA, 25 bp, Mus musculus
tcacgttctggattcgggtgcggct

SEQ ID NO: 346007 - DNA, 25 bp, Mus musculus
agacccggcttcacgttctggattc

SEQ ID NO: 346008 - DNA, 25 bp, Mus musculus
agcactgcgggagacccggcttcac

SEQ ID NO: 346009 - DNA, 25 bp, Mus musculus
acagcacctgcggaggcacaccgtg

SEQ ID NO: 346010 - DNA, 25 bp, Mus musculus
gactcaacacgatcggccagcacag

SEQ ID NO: 346011 - DNA, 25 bp, Mus musculus
cctggcggaggagactcaacacgat

SEQ ID NO: 346012 - DNA, 25 bp, Mus musculus
taggctattattcccagggcctggc

SEQ ID NO: 346013 - DNA, 25 bp, Mus musculus
tacaggggtagcacggctaggctat

SEQ ID NO: 346014 - DNA, 25 bp, Mus musculus
gagccggcacggctctcagccagag

SEQ ID NO: 346015 - DNA, 25 bp, Mus musculus
gcacggctaggctattattcccagg

SEQ ID NO: 346016 - DNA, 25 bp, Mus musculus
agcctgaagaggcttcccgtccaga

SEQ ID NO: 346017 - DNA, 25 bp, Mus musculus
agagtagcgcgcaccctcccatttt

SEQ ID NO: 346018 - DNA, 25 bp, Mus musculus
gaaccggcgttatctctatcccagc

SEQ ID NO: 346019 - DNA, 25 bp, Mus musculus
gagactcgtctctaccgggtccgct

SEQ ID NO: 346020 - DNA, 25 bp, Mus musculus
tcggtcacccgcagagcctgaagag

SEQ ID NO: 346021 - DNA, 25 bp, Mus musculus
ttcggaagccctcgaatctggcata

SEQ ID NO: 346022 - DNA, 25 bp, Mus musculus
ctccgccatcttgcgtgaggtactc

SEQ ID NO: 346023 - DNA, 25 bp, Mus musculus
cggcttcgggcatcttcggtaattt

SEQ ID NO: 346024 - DNA, 25 bp, Mus musculus
cacatcggtaccaatcggctttttc

SEQ ID NO: 346025 - DNA, 25 bp, Mus musculus
cggctttttccatctacctagcggc

SEQ ID NO: 346026 - DNA, 25 bp, Mus musculus
cccatctggctttcaggctcgtttg

SEQ ID NO: 346027 - DNA, 25 bp, Mus musculus
gatattcggctatctccggacctgg

SEQ ID NO: 346028 - DNA, 25 bp, Mus musculus
ttgccggggctttgaatcgaatctc

SEQ ID NO: 346029 - DNA, 25 bp, Mus musculus
gccgcttgaccagggcactcttctg

SEQ ID NO: 346030 - DNA, 25 bp, Mus musculus
acggcgctgcatgtgcatcagtgta

SEQ ID NO: 346031 - DNA, 25 bp, Mus musculus
atcagtgtatgagtgcccgtgagcc

SEQ ID NO: 346032 - DNA, 25 bp, Mus musculus
cagtgtatgagtgcccgtgagccac

SEQ ID NO: 346033 - DNA, 25 bp, Mus musculus
ggcgctgcatgtgcatcagtgtatg

SEQ ID NO: 346034 - DNA, 25 bp, Mus musculus
gccacggcgctgcatgtgcatctat

SEQ ID NO: 346035 - DNA, 25 bp, Mus musculus
catctatgtgtgagtgcccgtgagc

SEQ ID NO: 346036 - DNA, 25 bp, Mus musculus
gcgctgcatgtgcatcagtgtatga

SEQ ID NO: 346037 - DNA, 25 bp, Mus musculus
agccacggcgctgcatgtgcatcag

SEQ ID NO: 346038 - DNA, 25 bp, Mus musculus
ccacggcgctgcatgtgcatctatg

SEQ ID NO: 346039 - DNA, 25 bp, Mus musculus
tgcatcagtgtatgagtgcccgtga

SEQ ID NO: 346040 - DNA, 25 bp, Mus musculus
cgtgagccacggcactgcatgtgca

SEQ ID NO: 346041 - DNA, 25 bp, Mus musculus
agccacggcgctgcatgtgcatcta

SEQ ID NO: 346042 - DNA, 25 bp, Mus musculus
cacggcgctgcatgtgcatctatgt

SEQ ID NO: 346043 - DNA, 25 bp, Mus musculus
acggcgctgcatgtgcatctatgtg

SEQ ID NO: 346044 - DNA, 25 bp, Mus musculus
cgcggcgcaaacaagcacttcgcta

SEQ ID NO: 346045 - DNA, 25 bp, Mus musculus
agatctgatctgacactgtagccta

SEQ ID NO: 346046 - DNA, 25 bp, Mus musculus
gatggcctggaactcgcgtcaatcc

SEQ ID NO: 346047 - DNA, 25 bp, Mus musculus
actgagatgccaggcgcggcgcaaa

SEQ ID NO: 346048 - DNA, 25 bp, Mus musculus
ggcgcaaacaagcacttcgctacaa

SEQ ID NO: 346049 - DNA, 25 bp, Mus musculus
cttcgctacaacctacccagggtgg

SEQ ID NO: 346050 - DNA, 25 bp, Mus musculus
cggcagatctccaagcgcgcgcggc

SEQ ID NO: 346051 - DNA, 25 bp, Mus musculus
gtccccttcccgatgcgggaggcta

SEQ ID NO: 346052 - DNA, 25 bp, Mus musculus
ctccaagacgctccagcggggacaa

SEQ ID NO: 346053 - DNA, 25 bp, Mus musculus
caagacgctccagcggggacaaagg

SEQ ID NO: 346054 - DNA, 25 bp, Mus musculus
agagcgccttgcgcagtgcaccgct

SEQ ID NO: 346055 - DNA, 25 bp, Mus musculus
cagtgcaccgctcgggcctctgccc

SEQ ID NO: 346056 - DNA, 25 bp, Mus musculus
gatctgacactgtagcctaggatgg

SEQ ID NO: 346057 - DNA, 25 bp, Mus musculus
tcagcctcctaagtactgagatgcc

SEQ ID NO: 346058 - DNA, 25 bp, Mus musculus
acgctcgtgcgtgtaaacgtataga

SEQ ID NO: 346059 - DNA, 25 bp, Mus musculus
ggacctggactcacctacaatgata

SEQ ID NO: 346060 - DNA, 25 bp, Mus musculus
aatccgatctctttcttcagggcta

SEQ ID NO: 346061 - DNA, 25 bp, Mus musculus
cttttccgaaaacagagtgcgctcc

SEQ ID NO: 346062 - DNA, 25 bp, Mus musculus
agtgcgctcctaccctctaaaagtg

SEQ ID NO: 346063 - DNA, 25 bp, Mus musculus
tgagagtcacacgtgtcactgccta

SEQ ID NO: 346064 - DNA, 25 bp, Mus musculus
ctgcctaacaaacaagggccgtgtt

SEQ ID NO: 346065 - DNA, 25 bp, Mus musculus
tggaattctccggaaagcgtttatc

SEQ ID NO: 346066 - DNA, 25 bp, Mus musculus
agcgtttatcttcagaagcccagga

SEQ ID NO: 346067 - DNA, 25 bp, Mus musculus
cggcttgctctggtcaggatttccc

SEQ ID NO: 346068 - DNA, 25 bp, Mus musculus
ggatttccctgcagccctcctaatg

SEQ ID NO: 346069 - DNA, 25 bp, Mus musculus
agtagttcttcttagctgagggagc

SEQ ID NO: 346070 - DNA, 25 bp, Mus musculus
gccgtgctcaggtactttcttgctc

SEQ ID NO: 346071 - DNA, 25 bp, Mus musculus
gctgcggcgtttatttgcggaccga

SEQ ID NO: 346072 - DNA, 25 bp, Mus musculus
caccgcgtgctggttcaatctggcg

SEQ ID NO: 346073 - DNA, 25 bp, Mus musculus
cggaggctgcttgttttcccgccgt

SEQ ID NO: 346074 - DNA, 25 bp, Mus musculus
cgtttcctgtgcctcgtgagggaga

SEQ ID NO: 346075 - DNA, 25 bp, Mus musculus
gagagaaccggatggtctgagaaca

SEQ ID NO: 346076 - DNA, 25 bp, Mus musculus
tctgagaacagaaacgttggaaccc

SEQ ID NO: 346077 - DNA, 25 bp, Mus musculus
cagaaacgttggaacccggctgcca

SEQ ID NO: 346078 - DNA, 25 bp, Mus musculus
ttggaacccggctgccaagctggta

SEQ ID NO: 346079 - DNA, 25 bp, Mus musculus
ccgcgtgaaggctggcggcctctta

SEQ ID NO: 346080 - DNA, 25 bp, Mus musculus
aaggctggcggcctcttacccaagc

SEQ ID NO: 346081 - DNA, 25 bp, Mus musculus
ggcctcttacccaagccaggcatgg

SEQ ID NO: 346082 - DNA, 25 bp, Mus musculus
caggcatggccgcttaccacttaag

SEQ ID NO: 346083 - DNA, 25 bp, Mus musculus
tggccgcttaccacttaagtgtagc

SEQ ID NO: 346084 - DNA, 25 bp, Mus musculus
ttcaatctggcgtgcgcagcttcga

SEQ ID NO: 346085 - DNA, 25 bp, Mus musculus
gcagcttcgaacctggtggccgtgc

SEQ ID NO: 346086 - DNA, 25 bp, Mus musculus
caacgtactgggtccgccattggct

SEQ ID NO: 346087 - DNA, 25 bp, Mus musculus
cgacgacttccaacggaggattctc

SEQ ID NO: 346088 - DNA, 25 bp, Mus musculus
ggctgatgcacaacgtactgggtcc

SEQ ID NO: 346089 - DNA, 25 bp, Mus musculus
cggcagccgtgacgaaacgcttaaa

SEQ ID NO: 346090 - DNA, 25 bp, Mus musculus
agcacaagcgctaccagcagcggca

SEQ ID NO: 346091 - DNA, 25 bp, Mus musculus
cagtcaaactggagcacaagcgcta

SEQ ID NO: 346092 - DNA, 25 bp, Mus musculus
cgcaggaaggccctcggaagacctt

SEQ ID NO: 346093 - DNA, 25 bp, Mus musculus
tccaaagttctttactgaactggcc

SEQ ID NO: 346094 - DNA, 25 bp, Mus musculus
gcatcctgtggtccttccaaagttc

SEQ ID NO: 346095 - DNA, 25 bp, Mus musculus
ctgcagtggacctctgcatcctgtg

SEQ ID NO: 346096 - DNA, 25 bp, Mus musculus
cctggactcggcgtctgcagtggac

SEQ ID NO: 346097 - DNA, 25 bp, Mus musculus
gctgggaacatgtcttcctggactc

SEQ ID NO: 346098 - DNA, 25 bp, Mus musculus
gaggattctcctcccaccacgagga

SEQ ID NO: 346099 - DNA, 25 bp, Mus musculus
tcccagcagaggtccgcgattggct

SEQ ID NO: 346100 - DNA, 25 bp, Mus musculus
taccctgcctgctcggtttccttga

SEQ ID NO: 346101 - DNA, 25 bp, Mus musculus
aagagcagcgttccgccgaccggag

SEQ ID NO: 346102 - DNA, 25 bp, Mus musculus
ttctcgtaggccaggtccagcacgc

SEQ ID NO: 346103 - DNA, 25 bp, Mus musculus
tctgcgcgctccaggcagatgcgct

SEQ ID NO: 346104 - DNA, 25 bp, Mus musculus
agggcgtccctctgcagttgcacct

SEQ ID NO: 346105 - DNA, 25 bp, Mus musculus
cgcgtcggcgaaacgcactctcttg

SEQ ID NO: 346106 - DNA, 25 bp, Mus musculus
actctcttgcgagtgtcagggctgc

SEQ ID NO: 346107 - DNA, 25 bp, Mus musculus
gtagtacgcccgctcggtcaatgcc

SEQ ID NO: 346108 - DNA, 25 bp, Mus musculus
ggtcaatgccgctataaagctcagg

SEQ ID NO: 346109 - DNA, 25 bp, Mus musculus
aaagctcaggttgcggggtatatcc

SEQ ID NO: 346110 - DNA, 25 bp, Mus musculus
tgccggctctatgcccgagcataag

SEQ ID NO: 346111 - DNA, 25 bp, Mus musculus
cataaggtgtaggtagggctgctca

SEQ ID NO: 346112 - DNA, 25 bp, Mus musculus
gctgcggactctccttgctgtcagc

SEQ ID NO: 346113 - DNA, 25 bp, Mus musculus
gctcggtttccttgaccatctttcc

SEQ ID NO: 346114 - DNA, 25 bp, Mus musculus
ccgggtcatgggaggcccagagcac

SEQ ID NO: 346115 - DNA, 25 bp, Mus musculus
acggcgccattgaggacccggtgag

SEQ ID NO: 346116 - DNA, 25 bp, Mus musculus
aataacgtggctggtggcgggccga

SEQ ID NO: 346117 - DNA, 25 bp, Mus musculus
aagagccgggactggttgaggccga

SEQ ID NO: 346118 - DNA, 25 bp, Mus musculus
cgcaggggactacgggaacggcctg

SEQ ID NO: 346119 - DNA, 25 bp, Mus musculus
gcgccatcttgtgcccggggccggt

SEQ ID NO: 346120 - DNA, 25 bp, Mus musculus
cagttctccaatcgccgatcggcgg

SEQ ID NO: 346121 - DNA, 25 bp, Mus musculus
ggctcagttctccaatcgccgatcg

SEQ ID NO: 346122 - DNA, 25 bp, Mus musculus
actaatgaatcctcggcgtggccgg

SEQ ID NO: 346123 - DNA, 25 bp, Mus musculus
ctgactaatgaatcctcggcgtggc

SEQ ID NO: 346124 - DNA, 25 bp, Mus musculus
ggctgactgactaatgaatcctcgg

SEQ ID NO: 346125 - DNA, 25 bp, Mus musculus
gggcaggctgactgactaatgaatc

SEQ ID NO: 346126 - DNA, 25 bp, Mus musculus
taacgggcaggctgactgactaatg

SEQ ID NO: 346127 - DNA, 25 bp, Mus musculus
gcgtggccggctcagttctccaatc

SEQ ID NO: 346128 - DNA, 25 bp, Mus musculus
tgcagtcgcatgaggcagggtcctc

SEQ ID NO: 346129 - DNA, 25 bp, Mus musculus
cggcgacactgacgccgctggagtt

SEQ ID NO: 346130 - DNA, 25 bp, Mus musculus
cagcacaggccgagctgcagctgct

SEQ ID NO: 346131 - DNA, 25 bp, Mus musculus
tactcggggagccagcttgccgacc

SEQ ID NO: 346132 - DNA, 25 bp, Mus musculus
gcgccgagagaatgagctgctgtct

SEQ ID NO: 346133 - DNA, 25 bp, Mus musculus
aagccactgcacgaggggtccgtac

SEQ ID NO: 346134 - DNA, 25 bp, Mus musculus
cgcagacacttactccattggagcc

SEQ ID NO: 346135 - DNA, 25 bp, Mus musculus
cctcacctggccgatggcattggtg

SEQ ID NO: 346136 - DNA, 25 bp, Mus musculus
ccacgaaaagcacgggcaggcagca

SEQ ID NO: 346137 - DNA, 25 bp, Mus musculus
aggccatgcccagcgccacgaaaag

SEQ ID NO: 346138 - DNA, 25 bp, Mus musculus
tctccacggcgctgtcgattttgtt

SEQ ID NO: 346139 - DNA, 25 bp, Mus musculus
ggtccgtactggtgacgactccgct

SEQ ID NO: 346140 - DNA, 25 bp, Mus musculus
tcccagtccttcaggcagtggttga

SEQ ID NO: 346141 - DNA, 25 bp, Mus musculus
gggcagtccgttatagtcccagtcc

SEQ ID NO: 346142 - DNA, 25 bp, Mus musculus
ggcaccgagcaaaagggaacagaga

SEQ ID NO: 346143 - DNA, 25 bp, Mus musculus
aggagcgacaactgagctgcgtgtc

SEQ ID NO: 346144 - DNA, 25 bp, Mus musculus
cgtgtcgccaaactcgctcaagtca

SEQ ID NO: 346145 - DNA, 25 bp, Mus musculus
tcaagtcagcgcaaaggccggcgcc

SEQ ID NO: 346146 - DNA, 25 bp, Mus musculus
gccggcgccaaaaggcctaagagcg

SEQ ID NO: 346147 - DNA, 25 bp, Mus musculus
cagtctcagcgctcaagggcgcgca

SEQ ID NO: 346148 - DNA, 25 bp, Mus musculus
ctcggcgcgtcccaaagcttaggga

SEQ ID NO: 346149 - DNA, 25 bp, Mus musculus
ctccaggtgtcttgggaaatgaaga

SEQ ID NO: 346150 - DNA, 25 bp, Mus musculus
gcaggcccattcctctcgcgagggg

SEQ ID NO: 346151 - DNA, 25 bp, Mus musculus
acgatcctttccgaggcggtgttga

SEQ ID NO: 346152 - DNA, 25 bp, Mus musculus
tgagtttcagctccagaccctcggg

SEQ ID NO: 346153 - DNA, 25 bp, Mus musculus
ccacatctgtctttcccgagggagg

SEQ ID NO: 346154 - DNA, 25 bp, Mus musculus
gcttagggaagctccaggtgtcttg

SEQ ID NO: 346155 - DNA, 25 bp, Mus musculus
ctccttctcaaacagccgggtcttg

SEQ ID NO: 346156 - DNA, 25 bp, Mus musculus
tccggggagggatactgactgtatc

SEQ ID NO: 346157 - DNA, 25 bp, Mus musculus
tcactgaggtaggtctggtgagcga

SEQ ID NO: 346158 - DNA, 25 bp, Mus musculus
aacgggcagcaggaccgcggtcact

SEQ ID NO: 346159 - DNA, 25 bp, Mus musculus
ccactgccgagagcgagagtgcgca

SEQ ID NO: 346160 - DNA, 25 bp, Mus musculus
aagccaagcccactgccgagagcga

SEQ ID NO: 346161 - DNA, 25 bp, Mus musculus
ttaaggagtcaagccaagcccactg

SEQ ID NO: 346162 - DNA, 25 bp, Mus musculus
cgcctttaaggagtcaagccaagcc

SEQ ID NO: 346163 - DNA, 25 bp, Mus musculus
agcgagtgcgttgcgcctttaagga

SEQ ID NO: 346164 - DNA, 25 bp, Mus musculus
ctgagacgacgcctgatgcgggctg

SEQ ID NO: 346165 - DNA, 25 bp, Mus musculus
tccaaacaaattccagctgctgaga

SEQ ID NO: 346166 - DNA, 25 bp, Mus musculus
gagcgtcctccaaacaaattccagc

SEQ ID NO: 346167 - DNA, 25 bp, Mus musculus
ccctggagagcgtcctccaaacaaa

SEQ ID NO: 346168 - DNA, 25 bp, Mus musculus
actgactgtatctccgggtttgata

SEQ ID NO: 346169 - DNA, 25 bp, Mus musculus
tatctccgggtttgatattttttga

SEQ ID NO: 346170 - DNA, 25 bp, Mus musculus
cgtctaggctctcgctgccctctgt

SEQ ID NO: 346171 - DNA, 25 bp, Mus musculus
atccatcagcccttccgcccgggtt

SEQ ID NO: 346172 - DNA, 25 bp, Mus musculus
ggtacgtctaggctctcgctgccct

SEQ ID NO: 346173 - DNA, 25 bp, Mus musculus
cgcggtacgtctaggctctcgctgc

SEQ ID NO: 346174 - DNA, 25 bp, Mus musculus
ctcggcgcggtacgtctaggctctc

SEQ ID NO: 346175 - DNA, 25 bp, Mus musculus
tgatagctcagagccctcgcactca

SEQ ID NO: 346176 - DNA, 25 bp, Mus musculus
agctgagatcctatgcgctgcaggc

SEQ ID NO: 346177 - DNA, 25 bp, Mus musculus
aggctgatagctcagagccctcgca

SEQ ID NO: 346178 - DNA, 25 bp, Mus musculus
tccaggctgatagctcagagccctc

SEQ ID NO: 346179 - DNA, 25 bp, Mus musculus
tgcaggcccctccaggctgatagct

SEQ ID NO: 346180 - DNA, 25 bp, Mus musculus
ctgagatcctatgcgctgcaggccc

SEQ ID NO: 346181 - DNA, 25 bp, Mus musculus
gccagctgagatcctatgcgctgca

SEQ ID NO: 346182 - DNA, 25 bp, Mus musculus
ggcgcgctagcccatccatcagccc

SEQ ID NO: 346183 - DNA, 25 bp, Mus musculus
ctcagccagctgagatcctatgcgc

SEQ ID NO: 346184 - DNA, 25 bp, Mus musculus
taggtcctgaagtctcaacgaatgc

SEQ ID NO: 346185 - DNA, 25 bp, Mus musculus
tctcgaagggattgcgtcccaccgc

SEQ ID NO: 346186 - DNA, 25 bp, Mus musculus
cttgtgccaagatctcgaagggatt

SEQ ID NO: 346187 - DNA, 25 bp, Mus musculus
cggttggatagaattgccttgtgcc

SEQ ID NO: 346188 - DNA, 25 bp, Mus musculus
ctttatttcaacacgttctagccgg

SEQ ID NO: 346189 - DNA, 25 bp, Mus musculus
atttgggcgcactccttctggatca

SEQ ID NO: 346190 - DNA, 25 bp, Mus musculus
tcaacgaatgcaccaccatcctggg

SEQ ID NO: 346191 - DNA, 25 bp, Mus musculus
tcaacacgttctagccggttggata

SEQ ID NO: 346192 - DNA, 25 bp, Mus musculus
aggcccgaatttgggcgcactcctt

SEQ ID NO: 346193 - DNA, 25 bp, Mus musculus
gcgaatctcttcgattaggtcctga

SEQ ID NO: 346194 - DNA, 25 bp, Mus musculus
ttctggatcacctcccgttcctggg

SEQ ID NO: 346195 - DNA, 25 bp, Mus musculus
tgcaccaccatcctggggacagagc

SEQ ID NO: 346196 - DNA, 25 bp, Mus musculus
catcgcggaaggaggcccgaatttg

SEQ ID NO: 346197 - DNA, 25 bp, Mus musculus
cagagcccgggagttgaaaagactt

SEQ ID NO: 346198 - DNA, 25 bp, Mus musculus
ccgtggaggtgagcatcaacgacta

SEQ ID NO: 346199 - DNA, 25 bp, Mus musculus
cagcgaggcttcaagcgctgggaat

SEQ ID NO: 346200 - DNA, 25 bp, Mus musculus
gtgaccaccggcagcgaggcttcaa

SEQ ID NO: 346201 - DNA, 25 bp, Mus musculus
tggtgagggccacgcctcctgtgac

SEQ ID NO: 346202 - DNA, 25 bp, Mus musculus
acatcctgtacatggtgaatggtga

SEQ ID NO: 346203 - DNA, 25 bp, Mus musculus
gcgcatggagcggtacatcctgtac

SEQ ID NO: 346204 - DNA, 25 bp, Mus musculus
atatctactgcccacactacggggc

SEQ ID NO: 346205 - DNA, 25 bp, Mus musculus
atgggtgtggacctcagatccgtct

SEQ ID NO: 346206 - DNA, 25 bp, Mus musculus
gtgagcatcaacgactacctggata

SEQ ID NO: 346207 - DNA, 25 bp, Mus musculus
cggctataccgtggaggtgagcatc

SEQ ID NO: 346208 - DNA, 25 bp, Mus musculus
accggctctccctggcaggtttcag

SEQ ID NO: 346209 - DNA, 25 bp, Mus musculus
gctaaccggctctccctggcaggtt

SEQ ID NO: 346210 - DNA, 25 bp, Mus musculus
tcagatccgtctcccgctaaccggc

SEQ ID NO: 346211 - DNA, 25 bp, Mus musculus
cgactacctggatatctactgccca

SEQ ID NO: 346212 - DNA, 25 bp, Mus musculus
ccttcatctcctggtaggggtaggg

SEQ ID NO: 346213 - DNA, 25 bp, Mus musculus
gggacggacggcaatactggaaaca

SEQ ID NO: 346214 - DNA, 25 bp, Mus musculus
aaacagaaggctggcgcaccgcacg

SEQ ID NO: 346215 - DNA, 25 bp, Mus musculus
agcaggctacaagctgacttgaaga

SEQ ID NO: 346216 - DNA, 25 bp, Mus musculus
cacgtgacaggcaagcaggacagca

SEQ ID NO: 346217 - DNA, 25 bp, Mus musculus
ctgacaggtggcagtgtgtaaaaaa

SEQ ID NO: 346218 - DNA, 25 bp, Mus musculus
ctcagagaccgtgatgctcaagctg

SEQ ID NO: 346219 - DNA, 25 bp, Mus musculus
ggattttggcaatgtcagtggactg

SEQ ID NO: 346220 - DNA, 25 bp, Mus musculus
ctagagtagcataaacacgtggatt

SEQ ID NO: 346221 - DNA, 25 bp, Mus musculus
tctgggaaagaacaggccaggcttc

SEQ ID NO: 346222 - DNA, 25 bp, Mus musculus
cttggaagctcaagtgacaggtgga

SEQ ID NO: 346223 - DNA, 25 bp, Mus musculus
cttggtaagtgcctgtgggtgtata

SEQ ID NO: 346224 - DNA, 25 bp, Mus musculus
cccggcttgccactggccttggtaa

SEQ ID NO: 346225 - DNA, 25 bp, Mus musculus
gtggtagggtacactttggcgcacc

SEQ ID NO: 346226 - DNA, 25 bp, Mus musculus
tccgggcttctcacgaggtagtccg

SEQ ID NO: 346227 - DNA, 25 bp, Mus musculus
catggccaaggccagcgtggagctc

SEQ ID NO: 346228 - DNA, 25 bp, Mus musculus
agacccagtgctttcctgcggtaca

SEQ ID NO: 346229 - DNA, 25 bp, Mus musculus
tccgcgagcatcgagacccagtgct

SEQ ID NO: 346230 - DNA, 25 bp, Mus musculus
ttgccttcatctccggacaccgggt

SEQ ID NO: 346231 - DNA, 25 bp, Mus musculus
acgaggttgccttcatctccggaca

SEQ ID NO: 346232 - DNA, 25 bp, Mus musculus
agctgcaaggtacgaggttgccttc

SEQ ID NO: 346233 - DNA, 25 bp, Mus musculus
gagctcacccgcgagctgcaaggta

SEQ ID NO: 346234 - DNA, 25 bp, Mus musculus
gtctcacgcggctcggaagctcagc

SEQ ID NO: 346235 - DNA, 25 bp, Mus musculus
cgggactagcatgtgcggcgcctct

SEQ ID NO: 346236 - DNA, 25 bp, Mus musculus
tccattggccaactctccgggaggg

SEQ ID NO: 346237 - DNA, 25 bp, Mus musculus
gctcggaagctcagcgcgcatgctc

SEQ ID NO: 346238 - DNA, 25 bp, Mus musculus
cttctcacgaggtagtccgcgggag

SEQ ID NO: 346239 - DNA, 25 bp, Mus musculus
ggtggcacgccagtagaaacgctgc

SEQ ID NO: 346240 - DNA, 25 bp, Mus musculus
ctgttgcagccgcttggagcgacaa

SEQ ID NO: 346241 - DNA, 25 bp, Mus musculus
gcttggagcgacaagcctgagcgta

SEQ ID NO: 346242 - DNA, 25 bp, Mus musculus
acaagcctgagcgtagccgcggttc

SEQ ID NO: 346243 - DNA, 25 bp, Mus musculus
ctgcttcagccgcagagcctcgtcg

SEQ ID NO: 346244 - DNA, 25 bp, Mus musculus
gttcaactcgcgcacagacatcgag

SEQ ID NO: 346245 - DNA, 25 bp, Mus musculus
agacatcgagaccagcgcggcgtcc

SEQ ID NO: 346246 - DNA, 25 bp, Mus musculus
tccgaaaatctctcgggcagctgcg

SEQ ID NO: 346247 - DNA, 25 bp, Mus musculus
ccttatagaggtcgcgctcgcgagc

SEQ ID NO: 346248 - DNA, 25 bp, Mus musculus
aagagtgcagggaccagattggtac

SEQ ID NO: 346249 - DNA, 25 bp, Mus musculus
gaccagattggtacgggtgtcaccc

SEQ ID NO: 346250 - DNA, 25 bp, Mus musculus
tcacagcgggccttatagaggtcgc

SEQ ID NO: 346251 - DNA, 25 bp, Mus musculus
gtacgggtgtcacccggctacacac

SEQ ID NO: 346252 - DNA, 25 bp, Mus musculus
tcagccggtcacagcgggccttata

SEQ ID NO: 346253 - DNA, 25 bp, Mus musculus
aaatctctcgggcagctgcggagga

SEQ ID NO: 346254 - DNA, 25 bp, Mus musculus
gcccgggctagtgagccggcctaca

SEQ ID NO: 346255 - DNA, 25 bp, Mus musculus
tgagtgacccatagcccggggccca

SEQ ID NO: 346256 - DNA, 25 bp, Mus musculus
cccggcctgcggtgagtgacccata

SEQ ID NO: 346257 - DNA, 25 bp, Mus musculus
gtgccatggctgctatgtacctccc

SEQ ID NO: 346258 - DNA, 25 bp, Mus musculus
gtccaggtgccatggctgctatgta

SEQ ID NO: 346259 - DNA, 25 bp, Mus musculus
cagcgccagtccaggtgccatggct

SEQ ID NO: 346260 - DNA, 25 bp, Mus musculus
aactccctctggctttgctatgctc

SEQ ID NO: 346261 - DNA, 25 bp, Mus musculus
ctcaactccctctggctttgctatg

SEQ ID NO: 346262 - DNA, 25 bp, Mus musculus
ccggcctacagaagggcgagagaac

SEQ ID NO: 346263 - DNA, 25 bp, Mus musculus
tacagaagggcgagagaaccagcta

SEQ ID NO: 346264 - DNA, 25 bp, Mus musculus
cgagagaaccagctaggttccgccc

SEQ ID NO: 346265 - DNA, 25 bp, Mus musculus
gactgcccgcctcctttttaagcgc

SEQ ID NO: 346266 - DNA, 25 bp, Mus musculus
actccgcgctccaccttccgggctt

SEQ ID NO: 346267 - DNA, 25 bp, Mus musculus
cgactgcgctcgttcctgtggccat

SEQ ID NO: 346268 - DNA, 25 bp, Mus musculus
cgtgcgcactaaggcaaccggaaag

SEQ ID NO: 346269 - DNA, 25 bp, Mus musculus
tagtcgctgtaaacagggcctcgcc

SEQ ID NO: 346270 - DNA, 25 bp, Mus musculus
actgcttggagcgtcgagtgacgtc

SEQ ID NO: 346271 - DNA, 25 bp, Mus musculus
aggtctcagctatccaatcagaggg

SEQ ID NO: 346272 - DNA, 25 bp, Mus musculus
ggtcgcagccaattccagtccgcta

SEQ ID NO: 346273 - DNA, 25 bp, Mus musculus
ttccgctacgtctaatgcaggtcgc

SEQ ID NO: 346274 - DNA, 25 bp, Mus musculus
agacttgatgtctagttccgctacg

SEQ ID NO: 346275 - DNA, 25 bp, Mus musculus
aagggaccacctcgcagacttgatg

SEQ ID NO: 346276 - DNA, 25 bp, Mus musculus
accactcgaggccaagcgaccttaa

SEQ ID NO: 346277 - DNA, 25 bp, Mus musculus
cgctagcgctacagccaggggaaaa

SEQ ID NO: 346278 - DNA, 25 bp, Mus musculus
actgctttcgacaggccgctagcgc

SEQ ID NO: 346279 - DNA, 25 bp, Mus musculus
gtcccaccagtgaggactgctttcg

SEQ ID NO: 346280 - DNA, 25 bp, Mus musculus
cacttagggagcgtatgcaaagacc

SEQ ID NO: 346281 - DNA, 25 bp, Mus musculus
gggaggtgcttctccattttccctc

SEQ ID NO: 346282 - DNA, 25 bp, Mus musculus
tttcgagctgtgctttcgctttccc

SEQ ID NO: 346283 - DNA, 25 bp, Mus musculus
aagcccaagccaaggtgagcgttgc

SEQ ID NO: 346284 - DNA, 25 bp, Mus musculus
tggccacactgagggtccatcccga

SEQ ID NO: 346285 - DNA, 25 bp, Mus musculus
tctggccatggccacactgagggtc

SEQ ID NO: 346286 - DNA, 25 bp, Mus musculus
cggctctggccatggccacactgag

SEQ ID NO: 346287 - DNA, 25 bp, Mus musculus
gagctgtgctttcgctttcccttcc

SEQ ID NO: 346288 - DNA, 25 bp, Mus musculus
ggctgccaaacggagagacccgagc

SEQ ID NO: 346289 - DNA, 25 bp, Mus musculus
ccgtgcaggtttcgagctgtgcttt

SEQ ID NO: 346290 - DNA, 25 bp, Mus musculus
caaacccaggaaggccgtgcaggtt

SEQ ID NO: 346291 - DNA, 25 bp, Mus musculus
ggcggaaacgctactccggctgctg

SEQ ID NO: 346292 - DNA, 25 bp, Mus musculus
gagcgccgggcggaaacgctactcc

SEQ ID NO: 346293 - DNA, 25 bp, Mus musculus
ctgagggtccatcccgaagcccaag

SEQ ID NO: 346294 - DNA, 25 bp, Mus musculus
ccaaacggagagacccgagcgccgg

SEQ ID NO: 346295 - DNA, 25 bp, Mus musculus
caggttcctcgtgcggcgctcacca

SEQ ID NO: 346296 - DNA, 25 bp, Mus musculus
acgccggacgcttggtccgctgcaa

SEQ ID NO: 346297 - DNA, 25 bp, Mus musculus
ggagcagctcatgccgcttctggcc

SEQ ID NO: 346298 - DNA, 25 bp, Mus musculus
aggtgggattctgcgcaggtttttc

SEQ ID NO: 346299 - DNA, 25 bp, Mus musculus
ccagtctcaggatgccgggagacga

SEQ ID NO: 346300 - DNA, 25 bp, Mus musculus
tgagcctgtctccagtctcaggatg

SEQ ID NO: 346301 - DNA, 25 bp, Mus musculus
ttttcctctaaagtggcccacagtc

SEQ ID NO: 346302 - DNA, 25 bp, Mus musculus
tacctgcagctggacgccggacgct

SEQ ID NO: 346303 - DNA, 25 bp, Mus musculus
tggcttaagtgacccgggctgctgt

SEQ ID NO: 346304 - DNA, 25 bp, Mus musculus
aagagagcctgattcggaaggaaaa

SEQ ID NO: 346305 - DNA, 25 bp, Mus musculus
ttccgtagcattatgggaggagccc

SEQ ID NO: 346306 - DNA, 25 bp, Mus musculus
gatctcagctttaccgtcactccga

SEQ ID NO: 346307 - DNA, 25 bp, Mus musculus
tgccaggacttcctgttcccggtaa

SEQ ID NO: 346308 - DNA, 25 bp, Mus musculus
tccgctgcaacgctcatggggaggt

SEQ ID NO: 346309 - DNA, 25 bp, Mus musculus
ccgcggcttcttcattggcggcgac

SEQ ID NO: 346310 - DNA, 25 bp, Mus musculus
tcaggcctgcccatacccggcggat

SEQ ID NO: 346311 - DNA, 25 bp, Mus musculus
ggatctgttccaaacccgcaggctc

SEQ ID NO: 346312 - DNA, 25 bp, Mus musculus
ggatcggcacgtggagactccgaca

SEQ ID NO: 346313 - DNA, 25 bp, Mus musculus
tggagactccgacagcaacttccgg

SEQ ID NO: 346314 - DNA, 25 bp, Mus musculus
cggaaagggcgttactctgcgtctc

SEQ ID NO: 346315 - DNA, 25 bp, Mus musculus
gcgttactctgcgtctctcctgtcg

SEQ ID NO: 346316 - DNA, 25 bp, Mus musculus
ctctcctgtcgcctgggtgattcag

SEQ ID NO: 346317 - DNA, 25 bp, Mus musculus
tgggtgattcagcttgcttcccttc

SEQ ID NO: 346318 - DNA, 25 bp, Mus musculus
tcccttcaaaaactgcggaaagctg

SEQ ID NO: 346319 - DNA, 25 bp, Mus musculus
gtctgcctgagcacccgctgacaga

SEQ ID NO: 346320 - DNA, 25 bp, Mus musculus
ctgacagagcctcggcaccgtgggt

SEQ ID NO: 346321 - DNA, 25 bp, Mus musculus
agcctcggcaccgtgggttccctgt

SEQ ID NO: 346322 - DNA, 25 bp, Mus musculus
atgcgctccgtgtcgggcagcagca

SEQ ID NO: 346323 - DNA, 25 bp, Mus musculus
tccttcaggatctgttccaaacccg

SEQ ID NO: 346324 - DNA, 25 bp, Mus musculus
cgcggttattccagtgatcctctcc

SEQ ID NO: 346325 - DNA, 25 bp, Mus musculus
tagagggcgcagaacctgttcgtcc

SEQ ID NO: 346326 - DNA, 25 bp, Mus musculus
ctgctgtagtgtcagtctgagagcc

SEQ ID NO: 346327 - DNA, 25 bp, Mus musculus
tgatcctctccgtcctgggccgagg

SEQ ID NO: 346328 - DNA, 25 bp, Mus musculus
ttaggtcccggatacaggcggtgac

SEQ ID NO: 346329 - DNA, 25 bp, Mus musculus
tgcaagagtcaggaacgcggttatt

SEQ ID NO: 346330 - DNA, 25 bp, Mus musculus
tgccgaattctagcggcgtgcaaga

SEQ ID NO: 346331 - DNA, 25 bp, Mus musculus
tgggaactccgacccatgccgaatt

SEQ ID NO: 346332 - DNA, 25 bp, Mus musculus
ttttccaggtccgaacttgggctgc

SEQ ID NO: 346333 - DNA, 25 bp, Mus musculus
tggggcggtgcgaatgtaaatatca

SEQ ID NO: 346334 - DNA, 25 bp, Mus musculus
cgccacgtcctgttatgcgtctgtg

SEQ ID NO: 346335 - DNA, 25 bp, Mus musculus
cactagttcagtgaccgacgcggcg

SEQ ID NO: 346336 - DNA, 25 bp, Mus musculus
ccgctgagggttacgcactagttca

SEQ ID NO: 346337 - DNA, 25 bp, Mus musculus
tcaggttcttcgctgctgtagtgtc

SEQ ID NO: 346338 - DNA, 25 bp, Mus musculus
gtttctatagcaacgcccggcgggc

SEQ ID NO: 346339 - DNA, 25 bp, Mus musculus
aagagctctggttcgcccgcaatcc

SEQ ID NO: 346340 - DNA, 25 bp, Mus musculus
ctgagccaagagctccgcgatgctc

SEQ ID NO: 346341 - DNA, 25 bp, Mus musculus
ggacacgtcagtcttaccacttccg

SEQ ID NO: 346342 - DNA, 25 bp, Mus musculus
ccaccgagcgatgccagtggtcgtc

SEQ ID NO: 346343 - DNA, 25 bp, Mus musculus
ggccacggattccacgatgctcgct

SEQ ID NO: 346344 - DNA, 25 bp, Mus musculus
ggctcattcgaatgctcctggaaga

SEQ ID NO: 346345 - DNA, 25 bp, Mus musculus
ggaggacctgacgacggacctcctc

SEQ ID NO: 346346 - DNA, 25 bp, Mus musculus
ccaaagaggcgccagtggcctcacg

SEQ ID NO: 346347 - DNA, 25 bp, Mus musculus
ctgcgaggtactggctggccaaaga

SEQ ID NO: 346348 - DNA, 25 bp, Mus musculus
ctcgctgctacggaaggggcactcg

SEQ ID NO: 346349 - DNA, 25 bp, Mus musculus
tgggctgtcctctctaggatggaga

SEQ ID NO: 346350 - DNA, 25 bp, Mus musculus
gctccagggtcctcactgcgaggta

SEQ ID NO: 346351 - DNA, 25 bp, Mus musculus
tgcgcgtgccaacccgtttctatag

SEQ ID NO: 346352 - DNA, 25 bp, Mus musculus
tcaaaacaagactcgtgcgcaaatg

SEQ ID NO: 346353 - DNA, 25 bp, Mus musculus
tcctggaaccgggactctgcaggcg

SEQ ID NO: 346354 - DNA, 25 bp, Mus musculus
tccaagttaactggagagaaaccaa

SEQ ID NO: 346355 - DNA, 25 bp, Mus musculus
ctttctggctctccaagttaactgg

SEQ ID NO: 346356 - DNA, 25 bp, Mus musculus
cgtttctcggaactttctggctctc

SEQ ID NO: 346357 - DNA, 25 bp, Mus musculus
aatggcgtttctcggaactttctgg

SEQ ID NO: 346358 - DNA, 25 bp, Mus musculus
gactcgtgcgcaaatggcgtttctc

SEQ ID NO: 346359 - DNA, 25 bp, Mus musculus
cctttttcaaaacaagactcgtgcg

SEQ ID NO: 346360 - DNA, 25 bp, Mus musculus
cggacaccgaggtctggcccatggc

SEQ ID NO: 346361 - DNA, 25 bp, Mus musculus
gctctcgaagtttcgccctttttca

SEQ ID NO: 346362 - DNA, 25 bp, Mus musculus
tcctgctctcgaagtttcgcccttt

SEQ ID NO: 346363 - DNA, 25 bp, Mus musculus
tgtttctcctgctctcgaagtttcg

SEQ ID NO: 346364 - DNA, 25 bp, Mus musculus
gcgggaatgtttctcctgctctcga

SEQ ID NO: 346365 - DNA, 25 bp, Mus musculus
tgcgcaaatggcgtttctcggaact

SEQ ID NO: 346366 - DNA, 25 bp, Mus musculus
gtcccaattctatggcggccaagta

SEQ ID NO: 346367 - DNA, 25 bp, Mus musculus
ctgccgttccttacccagatcaaaa

SEQ ID NO: 346368 - DNA, 25 bp, Mus musculus
agaatagctgcaaccggcgaccaca

SEQ ID NO: 346369 - DNA, 25 bp, Mus musculus
ctctgcggggagaatagctgcaacc

SEQ ID NO: 346370 - DNA, 25 bp, Mus musculus
tccgacagcgcaagagcgccttcgg

SEQ ID NO: 346371 - DNA, 25 bp, Mus musculus
gtgactagagcgtcgctcggcctcc

SEQ ID NO: 346372 - DNA, 25 bp, Mus musculus
cgggcgagccacagagaaccggcaa

SEQ ID NO: 346373 - DNA, 25 bp, Mus musculus
cccagatcaaaaaccgcaagctttg

SEQ ID NO: 346374 - DNA, 25 bp, Mus musculus
accgcaagctttggcagccgcgtca

SEQ ID NO: 346375 - DNA, 25 bp, Mus musculus
tttggcagccgcgtcatgatccacc

SEQ ID NO: 346376 - DNA, 25 bp, Mus musculus
tgatccacccgcaaatccaaacttg

SEQ ID NO: 346377 - DNA, 25 bp, Mus musculus
ccaaacttggcgctgagtgtgtccc

SEQ ID NO: 346378 - DNA, 25 bp, Mus musculus
tggcgctgagtgtgtcccaattcta

SEQ ID NO: 346379 - DNA, 25 bp, Mus musculus
gcaaagcccgggtgactagagcgtc

SEQ ID NO: 346380 - DNA, 25 bp, Mus musculus
ctgcttccgggtcactctctggacc

SEQ ID NO: 346381 - DNA, 25 bp, Mus musculus
gccgctgccgcttcccagcactcca

SEQ ID NO: 346382 - DNA, 25 bp, Mus musculus
agcactccacggcaaggaacacttc

SEQ ID NO: 346383 - DNA, 25 bp, Mus musculus
tctggacccaccctctcctctttcc

SEQ ID NO: 346384 - DNA, 25 bp, Mus musculus
cggcaaggaacacttctgcttccgg

SEQ ID NO: 346385 - DNA, 25 bp, Mus musculus
gggttcccgaaacgctcaggagtgc

SEQ ID NO: 346386 - DNA, 25 bp, Mus musculus
ttcccgaaacgctcaggagtgccct

SEQ ID NO: 346387 - DNA, 25 bp, Mus musculus
accgaactggtgttagcggcgagct

SEQ ID NO: 346388 - DNA, 25 bp, Mus musculus
ttctgtgtcagtggggttgtaaaga

SEQ ID NO: 346389 - DNA, 25 bp, Mus musculus
tgtaaagagaaaggcaagtcggcta

SEQ ID NO: 346390 - DNA, 25 bp, Mus musculus
ggcaagtcggctaggaacagccaga

SEQ ID NO: 346391 - DNA, 25 bp, Mus musculus
taggaacagccagacggcgccctga

SEQ ID NO: 346392 - DNA, 25 bp, Mus musculus
cgcgtggccaccgaactggtgttag

SEQ ID NO: 346393 - DNA, 25 bp, Mus musculus
gagtgccctcgtgttctgtgtcagt

SEQ ID NO: 346394 - DNA, 25 bp, Mus musculus
cctctcaggcggtgacttaagtgta

SEQ ID NO: 346395 - DNA, 25 bp, Mus musculus
gtgtctgaatcagcgtctgccaagc

SEQ ID NO: 346396 - DNA, 25 bp, Mus musculus
taagtgtatcaacctgtccagatca

SEQ ID NO: 346397 - DNA, 25 bp, Mus musculus
cgctcccaggaaaaattctgccatt

SEQ ID NO: 346398 - DNA, 25 bp, Mus musculus
tctcgcgaaacagaagagggcgctc

SEQ ID NO: 346399 - DNA, 25 bp, Mus musculus
gagggcgctcgctcgtttcaaaaaa

SEQ ID NO: 346400 - DNA, 25 bp, Mus musculus
ctgtgaaagtgacgtacgacctagc

SEQ ID NO: 346401 - DNA, 25 bp, Mus musculus
acacaggcctgagtggtaactccgc

SEQ ID NO: 346402 - DNA, 25 bp, Mus musculus
ttctctcatctgcaccggaaggtcg

SEQ ID NO: 346403 - DNA, 25 bp, Mus musculus
cgccactgagggaaacgcaggagta

SEQ ID NO: 346404 - DNA, 25 bp, Mus musculus
cctgcaagctgtaaacctaggtgtc

SEQ ID NO: 346405 - DNA, 25 bp, Mus musculus
aggcgttcatggtgccggtagcaaa

SEQ ID NO: 346406 - DNA, 25 bp, Mus musculus
cagcgcgcaaggactgcagaaactc

SEQ ID NO: 346407 - DNA, 25 bp, Mus musculus
tgcagaaactccaccactttcggga

SEQ ID NO: 346408 - DNA, 25 bp, Mus musculus
gcacacgccgcgcatatagagagca

SEQ ID NO: 346409 - DNA, 25 bp, Mus musculus
ggtccggaggcagcccgttcaatct

SEQ ID NO: 346410 - DNA, 25 bp, Mus musculus
agcccgttcaatctgccgaaagaga

SEQ ID NO: 346411 - DNA, 25 bp, Mus musculus
tctgccgaaagagatgtcaatcaca

SEQ ID NO: 346412 - DNA, 25 bp, Mus musculus
cgaaagagatgtcaatcacagaacc

SEQ ID NO: 346413 - DNA, 25 bp, Mus musculus
cggaagctgccagcaggcccaggat

SEQ ID NO: 346414 - DNA, 25 bp, Mus musculus
tgaggtcaggaggaagcgctcacca

SEQ ID NO: 346415 - DNA, 25 bp, Mus musculus
ggccgaggcacacgccgcgcatata

SEQ ID NO: 346416 - DNA, 25 bp, Mus musculus
gcatatagagagcagtgcccgcccg

SEQ ID NO: 346417 - DNA, 25 bp, Mus musculus
accggcgaactcacctgctcaggga

SEQ ID NO: 346418 - DNA, 25 bp, Mus musculus
ctcacctgctcagggaggaggtgcc

SEQ ID NO: 346419 - DNA, 25 bp, Mus musculus
aggaggtgccaggacgtgcaactcc

SEQ ID NO: 346420 - DNA, 25 bp, Mus musculus
caccgagtcccagtgtggctagagc

SEQ ID NO: 346421 - DNA, 25 bp, Mus musculus
gaggaagcgctcaccacaaccacgg

SEQ ID NO: 346422 - DNA, 25 bp, Mus musculus
ctgcaaccgggaagcgtgaacggct

SEQ ID NO: 346423 - DNA, 25 bp, Mus musculus
gcgctgtcagcgctaaaagtggctc

SEQ ID NO: 346424 - DNA, 25 bp, Mus musculus
gcgacctgcagccacgcccatcatg

SEQ ID NO: 346425 - DNA, 25 bp, Mus musculus
aagcgtgaacggctggtcccaaagc

SEQ ID NO: 346426 - DNA, 25 bp, Mus musculus
tggtcccaaagcacgcatggggttg

SEQ ID NO: 346427 - DNA, 25 bp, Mus musculus
tggggccgcgttccgctcacaaagc

SEQ ID NO: 346428 - DNA, 25 bp, Mus musculus
tcacaaagcgcgacgccagttctcg

SEQ ID NO: 346429 - DNA, 25 bp, Mus musculus
agcccggaggctcttggatatttcc

SEQ ID NO: 346430 - DNA, 25 bp, Mus musculus
tggatatttccgacgggcgctgtca

SEQ ID NO: 346431 - DNA, 25 bp, Mus musculus
cagctaacgccgtgggttaagtgga

SEQ ID NO: 346432 - DNA, 25 bp, Mus musculus
gaacgaggtaggagcagctaacgcc

SEQ ID NO: 346433 - DNA, 25 bp, Mus musculus
ccgacgccgccgaagaacgaggtag

SEQ ID NO: 346434 - DNA, 25 bp, Mus musculus
agcgctaaaagtggctcccgacgcc

SEQ ID NO: 346435 - DNA, 25 bp, Mus musculus
agcgcgacgccagttctcgggtgcc

SEQ ID NO: 346436 - DNA, 25 bp, Mus musculus
gctcatctgagcctggagaccctga

SEQ ID NO: 346437 - DNA, 25 bp, Mus musculus
ccaggcaatggcttcgtagtatgga

SEQ ID NO: 346438 - DNA, 25 bp, Mus musculus
accggcactgcctttctactgctgg

SEQ ID NO: 346439 - DNA, 25 bp, Mus musculus
ctcggttccttactcgactcttcga

SEQ ID NO: 346440 - DNA, 25 bp, Mus musculus
agtgctctatgtcttcactgcgggg

SEQ ID NO: 346441 - DNA, 25 bp, Mus musculus
gttccagcgtcaacccagtgctcta

SEQ ID NO: 346442 - DNA, 25 bp, Mus musculus
agccttggctttcttcagttccagc

SEQ ID NO: 346443 - DNA, 25 bp, Mus musculus
cgcgctggaactacagccttggctt

SEQ ID NO: 346444 - DNA, 25 bp, Mus musculus
tgctcacgccgctctttgtggcttt

SEQ ID NO: 346445 - DNA, 25 bp, Mus musculus
ttcgtcttgccttttgggaccgtgc

SEQ ID NO: 346446 - DNA, 25 bp, Mus musculus
ggcggccacacttgtgctgcacctg

SEQ ID NO: 346447 - DNA, 25 bp, Mus musculus
ggagaccctgactgccttcgtcttg

SEQ ID NO: 346448 - DNA, 25 bp, Mus musculus
tcaatctcctacaggcggtggccgc

SEQ ID NO: 346449 - DNA, 25 bp, Mus musculus
cgctcagcatgtacgccagcgtgct

SEQ ID NO: 346450 - DNA, 25 bp, Mus musculus
tggccggctgggacaagaacagccc

SEQ ID NO: 346451 - DNA, 25 bp, Mus musculus
tggccttcctgagcagcagcgtgaa

SEQ ID NO: 346452 - DNA, 25 bp, Mus musculus
gccttaccacctggtgaacctggtg

SEQ ID NO: 346453 - DNA, 25 bp, Mus musculus
gccgcctggtggtgctcattatcct

SEQ ID NO: 346454 - DNA, 25 bp, Mus musculus
cactggctcggaggtgtccagcacc

SEQ ID NO: 346455 - DNA, 25 bp, Mus musculus
gcagcagcgtgaacccggtgctgta

SEQ ID NO: 346456 - DNA, 25 bp, Mus musculus
tgctcatcgcgctggccttcctgag

SEQ ID NO: 346457 - DNA, 25 bp, Mus musculus
tggcccgctatgtgctcatcgcgct

SEQ ID NO: 346458 - DNA, 25 bp, Mus musculus
agcgtctgaggctggcccgctatgt

SEQ ID NO: 346459 - DNA, 25 bp, Mus musculus
aagaacagccctgcggggcagcgtc

SEQ ID NO: 346460 - DNA, 25 bp, Mus musculus
gaacctggtggaagccggccgcaca

SEQ ID NO: 346461 - DNA, 25 bp, Mus musculus
ttctggctgccttaccacctggtga

SEQ ID NO: 346462 - DNA, 25 bp, Mus musculus
gtgctcattatcctggccttcgccg

SEQ ID NO: 346463 - DNA, 25 bp, Mus musculus
cttcgtggtcaagctactggagggc

SEQ ID NO: 346464 - DNA, 25 bp, Mus musculus
gaacattcttctctcccgcccgcca

SEQ ID NO: 346465 - DNA, 25 bp, Mus musculus
gcagagcctgtttctcattagagta

SEQ ID NO: 346466 - DNA, 25 bp, Mus musculus
cgtctgaccagagggccggcgctta

SEQ ID NO: 346467 - DNA, 25 bp, Mus musculus
tcattagagtaatgggcgcggtccc

SEQ ID NO: 346468 - DNA, 25 bp, Mus musculus
tcccgagtgtttgtaaacgtctgac

SEQ ID NO: 346469 - DNA, 25 bp, Mus musculus
tttgtaaacgtctgaccagagggcc

SEQ ID NO: 346470 - DNA, 25 bp, Mus musculus
taaacgtctgaccagagggccggcg

SEQ ID NO: 346471 - DNA, 25 bp, Mus musculus
cggcgcttaaccctttaggtgctgg

SEQ ID NO: 346472 - DNA, 25 bp, Mus musculus
cagcgccgcacgtcactggggtccc

SEQ ID NO: 346473 - DNA, 25 bp, Mus musculus
cccaggactggctcgagggaggact

SEQ ID NO: 346474 - DNA, 25 bp, Mus musculus
cgcctccgccgccaaggagctgagg

SEQ ID NO: 346475 - DNA, 25 bp, Mus musculus
gctcggcctcggaacattcttctct

SEQ ID NO: 346476 - DNA, 25 bp, Mus musculus
tcccgcccgccaagcttctcctccc

SEQ ID NO: 346477 - DNA, 25 bp, Mus musculus
cttaaccctttaggtgctggactgg

SEQ ID NO: 346478 - DNA, 25 bp, Mus musculus
tctgccagcaccatttgggggtttg

SEQ ID NO: 346479 - DNA, 25 bp, Mus musculus
cagttgcgatggtaactggggtttc

SEQ ID NO: 346480 - DNA, 25 bp, Mus musculus
cccaggccacagttgcgatggtaac

SEQ ID NO: 346481 - DNA, 25 bp, Mus musculus
agggaggagtcacctcccctcgtca

SEQ ID NO: 346482 - DNA, 25 bp, Mus musculus
ccgcacgcatcacccttcgactgca

SEQ ID NO: 346483 - DNA, 25 bp, Mus musculus
cggccgccgcttgcacggaatccgc

SEQ ID NO: 346484 - DNA, 25 bp, Mus musculus
caatgagaggcagatggcggggaac

SEQ ID NO: 346485 - DNA, 25 bp, Mus musculus
ctgtctggccgcaatgagaggcaga

SEQ ID NO: 346486 - DNA, 25 bp, Mus musculus
ttctgcagacgcgacgcctggggct

SEQ ID NO: 346487 - DNA, 25 bp, Mus musculus
gcctggttctgcagacgcgacgcct

SEQ ID NO: 346488 - DNA, 25 bp, Mus musculus
ctttaggacctaggcctggttctgc

SEQ ID NO: 346489 - DNA, 25 bp, Mus musculus
cggctaggccgactgtctctgggat

SEQ ID NO: 346490 - DNA, 25 bp, Mus musculus
ttggctatgcgccgcctgccggcta

SEQ ID NO: 346491 - DNA, 25 bp, Mus musculus
acggaatccgcgctgcccgctaccc

SEQ ID NO: 346492 - DNA, 25 bp, Mus musculus
gcaagggacataatgcctctgactg

SEQ ID NO: 346493 - DNA, 25 bp, Mus musculus
cccgaggccaggagctcacagtact

SEQ ID NO: 346494 - DNA, 25 bp, Mus musculus
gcctctgactgcaaccatgggacga

SEQ ID NO: 346495 - DNA, 25 bp, Mus musculus
ctgcaaccatgggacgacgatagca

SEQ ID NO: 346496 - DNA, 25 bp, Mus musculus
tgggacgacgatagcagtcacctac

SEQ ID NO: 346497 - DNA, 25 bp, Mus musculus
gatagcagtcacctaccctgccgtg

SEQ ID NO: 346498 - DNA, 25 bp, Mus musculus
taccctgccgtgaagaacggcgcta

SEQ ID NO: 346499 - DNA, 25 bp, Mus musculus
aggcgccaagagagcaagggacata

SEQ ID NO: 346500 - DNA, 25 bp, Mus musculus
taggacccagcgaggtcgggcagac

SEQ ID NO: 346501 - DNA, 25 bp, Mus musculus
acagtactgagtatacgctgcgggg

SEQ ID NO: 346502 - DNA, 25 bp, Mus musculus
ccaggagctcacagtactgagtata

SEQ ID NO: 346503 - DNA, 25 bp, Mus musculus
aggcagagacgaccggcgctaggac

SEQ ID NO: 346504 - DNA, 25 bp, Mus musculus
gcagactggtgttgacagccggcag

SEQ ID NO: 346505 - DNA, 25 bp, Mus musculus
tgccgtgaagaacggcgctaggacc

SEQ ID NO: 346506 - DNA, 25 bp, Mus musculus
gaatgtcggcgttcgtgaccagcct

SEQ ID NO: 346507 - DNA, 25 bp, Mus musculus
gggatcccgagagcaacgctaccaa

SEQ ID NO: 346508 - DNA, 25 bp, Mus musculus
gcagagtccgtgcaaaagccaggca

SEQ ID NO: 346509 - DNA, 25 bp, Mus musculus
cgcgtctttgtcttttccacctgaa

SEQ ID NO: 346510 - DNA, 25 bp, Mus musculus
atcggtatgctggtcccgcgtcttt

SEQ ID NO: 346511 - DNA, 25 bp, Mus musculus
cgaggccggaaactcaggacttgtc

SEQ ID NO: 346512 - DNA, 25 bp, Mus musculus
cccaagcgcaagctgcagagtccgt

SEQ ID NO: 346513 - DNA, 25 bp, Mus musculus
gcaccgaggacgagtgctaggctca

SEQ ID NO: 346514 - DNA, 25 bp, Mus musculus
cgcggaccgtacaaaggaccttgtg

SEQ ID NO: 346515 - DNA, 25 bp, Mus musculus
acgcttcctaatgaggccgcggacc

SEQ ID NO: 346516 - DNA, 25 bp, Mus musculus
aattcagccgcgttgggccctgcaa

SEQ ID NO: 346517 - DNA, 25 bp, Mus musculus
ggcgacgctccgagcgcattaattc

SEQ ID NO: 346518 - DNA, 25 bp, Mus musculus
ggcacagttagctgaggcgacgctc

SEQ ID NO: 346519 - DNA, 25 bp, Mus musculus
caaggccatgcaagtctgtgaccca

SEQ ID NO: 346520 - DNA, 25 bp, Mus musculus
agccctgtatgcagcgtgcgacgag

SEQ ID NO: 346521 - DNA, 25 bp, Mus musculus
ttctccctgcggcaagcggcgctat

SEQ ID NO: 346522 - DNA, 25 bp, Mus musculus
gatagctggctactcctcagcgctc

SEQ ID NO: 346523 - DNA, 25 bp, Mus musculus
ccgagcgccagaggatagctggcta

SEQ ID NO: 346524 - DNA, 25 bp, Mus musculus
ctatacggtccaagctcgggaggcc

SEQ ID NO: 346525 - DNA, 25 bp, Mus musculus
gatccctggagcctatacggtccaa

SEQ ID NO: 346526 - DNA, 25 bp, Mus musculus
tttggcttgagctctccgctgccct

SEQ ID NO: 346527 - DNA, 25 bp, Mus musculus
gcctcccgttttggcttgagctctc

SEQ ID NO: 346528 - DNA, 25 bp, Mus musculus
ggagcttcttctcggacgcctccga

SEQ ID NO: 346529 - DNA, 25 bp, Mus musculus
aggtggagtctgaacttaatgaagc

SEQ ID NO: 346530 - DNA, 25 bp, Mus musculus
gcggcgctattccagttccggaacc

SEQ ID NO: 346531 - DNA, 25 bp, Mus musculus
ctccgacgaggcagccctgtatgca

SEQ ID NO: 346532 - DNA, 25 bp, Mus musculus
cagcagcctgtcttcgtggagcttc

SEQ ID NO: 346533 - DNA, 25 bp, Mus musculus
cttaatgaagcagcctcccgttttg

SEQ ID NO: 346534 - DNA, 25 bp, Mus musculus
cgggtgggtcgcagaacccacagca

SEQ ID NO: 346535 - DNA, 25 bp, Mus musculus
acttctcacgctttccaggggccgg

SEQ ID NO: 346536 - DNA, 25 bp, Mus musculus
ctagctacaacccttagcaggaagg

SEQ ID NO: 346537 - DNA, 25 bp, Mus musculus
tagcaggaagggtttgtctcccgtg

SEQ ID NO: 346538 - DNA, 25 bp, Mus musculus
aggaagggtttgtctcccgtgctgc

SEQ ID NO: 346539 - DNA, 25 bp, Mus musculus
tcgcagaacccacagcagggaggcg

SEQ ID NO: 346540 - DNA, 25 bp, Mus musculus
gtgctgggacccgtgacacttctca

SEQ ID NO: 346541 - DNA, 25 bp, Mus musculus
tgacacttctcacgctttccagggg

SEQ ID NO: 346542 - DNA, 25 bp, Mus musculus
cggagggacagccatgcttttgtcg

SEQ ID NO: 346543 - DNA, 25 bp, Mus musculus
acagccatgcttttgtcggggggta

SEQ ID NO: 346544 - DNA, 25 bp, Mus musculus
cccagcgcaggaatggttcatggtg

SEQ ID NO: 346545 - DNA, 25 bp, Mus musculus
cgcaggaatggttcatggtgcagac

SEQ ID NO: 346546 - DNA, 25 bp, Mus musculus
catggtgcagacaaaatcgaagccc

SEQ ID NO: 346547 - DNA, 25 bp, Mus musculus
tacaccggcagcggctgcaagtcca

SEQ ID NO: 346548 - DNA, 25 bp, Mus musculus
tgagtgtctgtgacccggtaggccc

SEQ ID NO: 346549 - DNA, 25 bp, Mus musculus
gcttgacagtggacaaacgaggagg

SEQ ID NO: 346550 - DNA, 25 bp, Mus musculus
cccttccgggcgatcgggagctgaa

SEQ ID NO: 346551 - DNA, 25 bp, Mus musculus
aactcgcggctttggcggtaggcgt

SEQ ID NO: 346552 - DNA, 25 bp, Mus musculus
ggccctcccagattcgggctcccag

SEQ ID NO: 346553 - DNA, 25 bp, Mus musculus
aggatccgagaaggccctcccagat

SEQ ID NO: 346554 - DNA, 25 bp, Mus musculus
tgaaggatccgagaaggccctccca

SEQ ID NO: 346555 - DNA, 25 bp, Mus musculus
gaagtctaggttgggtgaaggatcc

SEQ ID NO: 346556 - DNA, 25 bp, Mus musculus
ttgttgacgagagaagtctaggttg

SEQ ID NO: 346557 - DNA, 25 bp, Mus musculus
acgcgttgttgacgagagaagtcta

SEQ ID NO: 346558 - DNA, 25 bp, Mus musculus
ccacaacgcgttgttgacgagagaa

SEQ ID NO: 346559 - DNA, 25 bp, Mus musculus
actccaaagccacaacgcgttgttg

SEQ ID NO: 346560 - DNA, 25 bp, Mus musculus
agtgactccaaagccacaacgcgtt

SEQ ID NO: 346561 - DNA, 25 bp, Mus musculus
gggccggaaagtgactccaaagcca

SEQ ID NO: 346562 - DNA, 25 bp, Mus musculus
tagcgaaggaccataaatttctctg

SEQ ID NO: 346563 - DNA, 25 bp, Mus musculus
tacaagcacccgcatagcgacaggg

SEQ ID NO: 346564 - DNA, 25 bp, Mus musculus
catagcgacagggagctagcacgcc

SEQ ID NO: 346565 - DNA, 25 bp, Mus musculus
cacgcctgcgcgagatttaaacacc

SEQ ID NO: 346566 - DNA, 25 bp, Mus musculus
ttaaacaccggacgcgactacgagc

SEQ ID NO: 346567 - DNA, 25 bp, Mus musculus
tcacctcacgcgaatctcagtacta

SEQ ID NO: 346568 - DNA, 25 bp, Mus musculus
cccggaaggagttatagtaatagcg

SEQ ID NO: 346569 - DNA, 25 bp, Mus musculus
ccataaatttctctgggaagagggg

SEQ ID NO: 346570 - DNA, 25 bp, Mus musculus
caaaagagatggaggacgaagtgca

SEQ ID NO: 346571 - DNA, 25 bp, Mus musculus
acgaagtgcagaaaggatccgctcc

SEQ ID NO: 346572 - DNA, 25 bp, Mus musculus
ggatccgctcctaaagaacaactct

SEQ ID NO: 346573 - DNA, 25 bp, Mus musculus
gaacaactctagaccgcgaagcgct

SEQ ID NO: 346574 - DNA, 25 bp, Mus musculus
ctctagaccgcgaagcgctgggcgt

SEQ ID NO: 346575 - DNA, 25 bp, Mus musculus
gcgaatctcagtactaggtgtgccc

SEQ ID NO: 346576 - DNA, 25 bp, Mus musculus
aaccggctggacctggtctccagac

SEQ ID NO: 346577 - DNA, 25 bp, Mus musculus
gtgcgtgatatctccaggtctagtg

SEQ ID NO: 346578 - DNA, 25 bp, Mus musculus
gggttggaccaccagtcacagtatg

SEQ ID NO: 346579 - DNA, 25 bp, Mus musculus
tcatcatttgccagcgggttggacc

SEQ ID NO: 346580 - DNA, 25 bp, Mus musculus
cgccagcatccggtgtctttcatca

SEQ ID NO: 346581 - DNA, 25 bp, Mus musculus
aacgcgcgtcctcatacttaccggg

SEQ ID NO: 346582 - DNA, 25 bp, Mus musculus
atcggacctgtctctaggaaccaca

SEQ ID NO: 346583 - DNA, 25 bp, Mus musculus
cggcagccgccaccgaaagatcgga

SEQ ID NO: 346584 - DNA, 25 bp, Mus musculus
ccggggtccgactgacagaaaggca

SEQ ID NO: 346585 - DNA, 25 bp, Mus musculus
gttggtgccttgtctctgtaacgcc

SEQ ID NO: 346586 - DNA, 25 bp, Mus musculus
ctagtggggaccttagacgaccatc

SEQ ID NO: 346587 - DNA, 25 bp, Mus musculus
ccagccaggtatcaagaggagtccc

SEQ ID NO: 346588 - DNA, 25 bp, Mus musculus
ctgtaacgccaacatcgtcgctgtc

SEQ ID NO: 346589 - DNA, 25 bp, Mus musculus
cgcgtgccactgttgttgcgcaacc

SEQ ID NO: 346590 - DNA, 25 bp, Mus musculus
cgccggagtcctgtgattggttctt

SEQ ID NO: 346591 - DNA, 25 bp, Mus musculus
tgtccgttgcctccggtgaggagcc

SEQ ID NO: 346592 - DNA, 25 bp, Mus musculus
tggaaggaaggtgtccgttgcctcc

SEQ ID NO: 346593 - DNA, 25 bp, Mus musculus
tcagtgcactcggtgtggaaggaag

SEQ ID NO: 346594 - DNA, 25 bp, Mus musculus
tcacctagtggagagtaagagtgga

SEQ ID NO: 346595 - DNA, 25 bp, Mus musculus
tcctgtcacctagtggagagtaaga

SEQ ID NO: 346596 - DNA, 25 bp, Mus musculus
ctggcttcctgtcacctagtggaga

SEQ ID NO: 346597 - DNA, 25 bp, Mus musculus
aggcttcgtcgaccgggctggcttc

SEQ ID NO: 346598 - DNA, 25 bp, Mus musculus
caatggcggcagaggcttcgtcgac

SEQ ID NO: 346599 - DNA, 25 bp, Mus musculus
cctcagcgctgagaggagcaatggc

SEQ ID NO: 346600 - DNA, 25 bp, Mus musculus
ctgggacttgcacgtgctgctgccc

SEQ ID NO: 346601 - DNA, 25 bp, Mus musculus
gctgctgggacttgcacgtgctgct

SEQ ID NO: 346602 - DNA, 25 bp, Mus musculus
attggttcttgacgcgagggctgct

SEQ ID NO: 346603 - DNA, 25 bp, Mus musculus
tcctgtgattggttcttgacgcgag

SEQ ID NO: 346604 - DNA, 25 bp, Mus musculus
ccataaacgttgctaggggatgctc

SEQ ID NO: 346605 - DNA, 25 bp, Mus musculus
gtgtcgcccggaacagaaacacgca

SEQ ID NO: 346606 - DNA, 25 bp, Mus musculus
gggatgctctatgcgcgctcttttg

SEQ ID NO: 346607 - DNA, 25 bp, Mus musculus
aggcgcctcggacacatgcaaacta

SEQ ID NO: 346608 - DNA, 25 bp, Mus musculus
tgtagttcctacagtccgtgtgagc

SEQ ID NO: 346609 - DNA, 25 bp, Mus musculus
aactctggtccagtgactcctggga

SEQ ID NO: 346610 - DNA, 25 bp, Mus musculus
gaatgagccgccacaaccatcgctg

SEQ ID NO: 346611 - DNA, 25 bp, Mus musculus
ctggcccggcatttacgaatgagcc

SEQ ID NO: 346612 - DNA, 25 bp, Mus musculus
caccacttagctggcccggcattta

SEQ ID NO: 346613 - DNA, 25 bp, Mus musculus
tccgaccagcgatagtcaccactta

SEQ ID NO: 346614 - DNA, 25 bp, Mus musculus
gaaacagctgttcagaccgctccga

SEQ ID NO: 346615 - DNA, 25 bp, Mus musculus
cgcccatcagttaccgttcttcgaa

SEQ ID NO: 346616 - DNA, 25 bp, Mus musculus
caagctggcctctcaggaaccgggc

SEQ ID NO: 346617 - DNA, 25 bp, Mus musculus
tgctcggaagaacaaagcgggctta

SEQ ID NO: 346618 - DNA, 25 bp, Mus musculus
ttccgctcttccctgaggcagcgtt

SEQ ID NO: 346619 - DNA, 25 bp, Mus musculus
agaggatcctggacatgaagtgcga

SEQ ID NO: 346620 - DNA, 25 bp, Mus musculus
acgttttcgaggtggagaggatcct

SEQ ID NO: 346621 - DNA, 25 bp, Mus musculus
gaaggacgcagccaccaaaggaacg

SEQ ID NO: 346622 - DNA, 25 bp, Mus musculus
cgttctcccgagtccgaaggagttg

SEQ ID NO: 346623 - DNA, 25 bp, Mus musculus
cagttcccgacagcattggccgttc

SEQ ID NO: 346624 - DNA, 25 bp, Mus musculus
gcggccgctctagttatgtcagttc

SEQ ID NO: 346625 - DNA, 25 bp, Mus musculus
cgttggttttgcactgcgtctgtga

SEQ ID NO: 346626 - DNA, 25 bp, Mus musculus
cgagtcacgccgctggagcggatta

SEQ ID NO: 346627 - DNA, 25 bp, Mus musculus
acaattggctggcttgcctcacggt

SEQ ID NO: 346628 - DNA, 25 bp, Mus musculus
tgtgtgtcaatccagagctcggcgc

SEQ ID NO: 346629 - DNA, 25 bp, Mus musculus
cgtgattggccgttctgtgtgtcaa

SEQ ID NO: 346630 - DNA, 25 bp, Mus musculus
tgggacgccgaacagcctggaacag

SEQ ID NO: 346631 - DNA, 25 bp, Mus musculus
agcgttcttcctcagagtccgtcga

SEQ ID NO: 346632 - DNA, 25 bp, Mus musculus
gcggtggccgaacgctcaaaatggc

SEQ ID NO: 346633 - DNA, 25 bp, Mus musculus
caggttacccacgaagaggcggcag

SEQ ID NO: 346634 - DNA, 25 bp, Mus musculus
atagcagcgcgctcccgaagtgagc

SEQ ID NO: 346635 - DNA, 25 bp, Mus musculus
tcaccaggcggatgaagccgaagcc

SEQ ID NO: 346636 - DNA, 25 bp, Mus musculus
tcgcccggcttgaggaaactcttga

SEQ ID NO: 346637 - DNA, 25 bp, Mus musculus
ctcttgatgtcgatggtgaagccca

SEQ ID NO: 346638 - DNA, 25 bp, Mus musculus
tcaaaatggcgctgcttcaaactgc

SEQ ID NO: 346639 - DNA, 25 bp, Mus musculus
ctcggtcgcggttgatgaagacctc

SEQ ID NO: 346640 - DNA, 25 bp, Mus musculus
ccacatgtatctatggaaacgaagc

SEQ ID NO: 346641 - DNA, 25 bp, Mus musculus
ttgaagtcctcctccgtgatgtctg

SEQ ID NO: 346642 - DNA, 25 bp, Mus musculus
gtcaaggtacacacgtctccacatg

SEQ ID NO: 346643 - DNA, 25 bp, Mus musculus
atacgtacttgcttcaggtttcctc

SEQ ID NO: 346644 - DNA, 25 bp, Mus musculus
tgaagcccaattcctcgtccgggtg

SEQ ID NO: 346645 - DNA, 25 bp, Mus musculus
tacccgcgaaccgtttgctagcatg

SEQ ID NO: 346646 - DNA, 25 bp, Mus musculus
ccgctcgcagcacagaaaggaaaac

SEQ ID NO: 346647 - DNA, 25 bp, Mus musculus
cagaaaggaaaacactcttcgacct

SEQ ID NO: 346648 - DNA, 25 bp, Mus musculus
gaagccgccctggacatcagcgcgg

SEQ ID NO: 346649 - DNA, 25 bp, Mus musculus
tctccgcggccctcgacaggaaaga

SEQ ID NO: 346650 - DNA, 25 bp, Mus musculus
ccagtcccggctttagcgctggtga

SEQ ID NO: 346651 - DNA, 25 bp, Mus musculus
ggctgtccgtcagacctgggccacg

SEQ ID NO: 346652 - DNA, 25 bp, Mus musculus
cacggaatgcctcgggcaggctcca

SEQ ID NO: 346653 - DNA, 25 bp, Mus musculus
ggcaggctccattggcccagtcggc

SEQ ID NO: 346654 - DNA, 25 bp, Mus musculus
ggcccagtcggccttctttcaggac

SEQ ID NO: 346655 - DNA, 25 bp, Mus musculus
tttcaggaccctcctcggtgaggta

SEQ ID NO: 346656 - DNA, 25 bp, Mus musculus
ccctcctcggtgaggtagtcacggc

SEQ ID NO: 346657 - DNA, 25 bp, Mus musculus
tagtcacggcggctgtccgtcagac

SEQ ID NO: 346658 - DNA, 25 bp, Mus musculus
gctcggtccagtcccggctttagcg

SEQ ID NO: 346659 - DNA, 25 bp, Mus musculus
aagcctcaccgggttctggctgcag

SEQ ID NO: 346660 - DNA, 25 bp, Mus musculus
gcgcgattccatgaataaaacagga

SEQ ID NO: 346661 - DNA, 25 bp, Mus musculus
gagcggagcgcgattccatgaataa

SEQ ID NO: 346662 - DNA, 25 bp, Mus musculus
gcaggcctaggcctccgtgttaaaa

SEQ ID NO: 346663 - DNA, 25 bp, Mus musculus
gggaaccgctactccacaccctgca

SEQ ID NO: 346664 - DNA, 25 bp, Mus musculus
tggaccgcagggaaccgctactcca

SEQ ID NO: 346665 - DNA, 25 bp, Mus musculus
tcccacagcgaatgcataatcaggc

SEQ ID NO: 346666 - DNA, 25 bp, Mus musculus
tcctctcccacagcgaatgcataat

SEQ ID NO: 346667 - DNA, 25 bp, Mus musculus
taatcaggccgcaggctgagagacg

SEQ ID NO: 346668 - DNA, 25 bp, Mus musculus
cgcagagacgcccaggcagcaatca

SEQ ID NO: 346669 - DNA, 25 bp, Mus musculus
gacgcccaggcagcaatcaatgagc

SEQ ID NO: 346670 - DNA, 25 bp, Mus musculus
ccaggcagcaatcaatgagccgtcg

SEQ ID NO: 346671 - DNA, 25 bp, Mus musculus
aaaacaggaggcttgcagccagctc

SEQ ID NO: 346672 - DNA, 25 bp, Mus musculus
aggaggcttgcagccagctctcctc

SEQ ID NO: 346673 - DNA, 25 bp, Mus musculus
gaatgcataatcaggccgcaggctg

SEQ ID NO: 346674 - DNA, 25 bp, Mus musculus
caacggctagtttcgacgcctgcga

SEQ ID NO: 346675 - DNA, 25 bp, Mus musculus
cctctgcatgcgtagccaacggcta

SEQ ID NO: 346676 - DNA, 25 bp, Mus musculus
tagcaaggcgctatttcataggccc

SEQ ID NO: 346677 - DNA, 25 bp, Mus musculus
ttaccaatatgaatggcaccgggcg

SEQ ID NO: 346678 - DNA, 25 bp, Mus musculus
gccgagcggtgaaaacgcctcttca

SEQ ID NO: 346679 - DNA, 25 bp, Mus musculus
gtgtcctctactagctgccgaatga

SEQ ID NO: 346680 - DNA, 25 bp, Mus musculus
gcccgtctgacgcagccaatagtag

SEQ ID NO: 346681 - DNA, 25 bp, Mus musculus
tgagagtcccgtcttcctgaggaag

SEQ ID NO: 346682 - DNA, 25 bp, Mus musculus
caatagaatggtaactgagagtccc

SEQ ID NO: 346683 - DNA, 25 bp, Mus musculus
tacgtcccacctctgttcggcaaag

SEQ ID NO: 346684 - DNA, 25 bp, Mus musculus
tgccgaatgacaacacagaagcgcc

SEQ ID NO: 346685 - DNA, 25 bp, Mus musculus
gcctcgaagggatggttaccaatat

SEQ ID NO: 346686 - DNA, 25 bp, Mus musculus
gttcagaaagggcacagggcctaca

SEQ ID NO: 346687 - DNA, 25 bp, Mus musculus
tagtagggcgtgacacctttacgtc

SEQ ID NO: 346688 - DNA, 25 bp, Mus musculus
aaagttacactaggagcggacgcgc

SEQ ID NO: 346689 - DNA, 25 bp, Mus musculus
agttacactaggagcggacgcgcca

SEQ ID NO: 346690 - DNA, 25 bp, Mus musculus
agaaaagttacactaggagcggacg

SEQ ID NO: 346691 - DNA, 25 bp, Mus musculus
gttacactaggagcggacgcgccag

SEQ ID NO: 346692 - DNA, 25 bp, Mus musculus
ctgcgcgctgaggatcatgagatga

SEQ ID NO: 346693 - DNA, 25 bp, Mus musculus
gcgcgctgaggatcatgagatgata

SEQ ID NO: 346694 - DNA, 25 bp, Mus musculus
cgcgctgaggatcatgagatgataa

SEQ ID NO: 346695 - DNA, 25 bp, Mus musculus
cgctgaggatcatgagatgataatg

SEQ ID NO: 346696 - DNA, 25 bp, Mus musculus
ctgaggatcatgagatgataatggg

SEQ ID NO: 346697 - DNA, 25 bp, Mus musculus
atgataatggggccccggatgaccc

SEQ ID NO: 346698 - DNA, 25 bp, Mus musculus
ctttggaaaaccagagattgtcttc

SEQ ID NO: 346699 - DNA, 25 bp, Mus musculus
tttggaaaaccagagattgtcttct

SEQ ID NO: 346700 - DNA, 25 bp, Mus musculus
tgcagaacttaagtaaacttgcctt

SEQ ID NO: 346701 - DNA, 25 bp, Mus musculus
cttaagaaaagttacactaggagcg

SEQ ID NO: 346702 - DNA, 25 bp, Mus musculus
cccacggagccaggactgaagcgaa

SEQ ID NO: 346703 - DNA, 25 bp, Mus musculus
ctatgagagggtcactgcccacgga

SEQ ID NO: 346704 - DNA, 25 bp, Mus musculus
tgggtgtagacgaggaacaaaagac

SEQ ID NO: 346705 - DNA, 25 bp, Mus musculus
gaggaacaaaagaccctcgtgccgc

SEQ ID NO: 346706 - DNA, 25 bp, Mus musculus
cgaatgcgcccggtgggactcctat

SEQ ID NO: 346707 - DNA, 25 bp, Mus musculus
cgatcggactcgttccgggccaagt

SEQ ID NO: 346708 - DNA, 25 bp, Mus musculus
cccgccaacgtggaggacaggcgct

SEQ ID NO: 346709 - DNA, 25 bp, Mus musculus
acggccgaggccagacagcccaggt

SEQ ID NO: 346710 - DNA, 25 bp, Mus musculus
cagtctggggtcaccactgtcgtgt

SEQ ID NO: 346711 - DNA, 25 bp, Mus musculus
aatctcggcgcgcaaactcttggcg

SEQ ID NO: 346712 - DNA, 25 bp, Mus musculus
acaaggcctatggtagagcgcgatc

SEQ ID NO: 346713 - DNA, 25 bp, Mus musculus
cccacaaaatggaggccgacgtctc

SEQ ID NO: 346714 - DNA, 25 bp, Mus musculus
ttctcccaacagatcccacaaaatg

SEQ ID NO: 346715 - DNA, 25 bp, Mus musculus
tgggactcctatgagagggtcactg

SEQ ID NO: 346716 - DNA, 25 bp, Mus musculus
tgcaggtgaagtccgattgctcgtc

SEQ ID NO: 346717 - DNA, 25 bp, Mus musculus
cgcggtcgtagcagacgttctcaca

SEQ ID NO: 346718 - DNA, 25 bp, Mus musculus
cgcccagaagcggatgtgcgaaatg

SEQ ID NO: 346719 - DNA, 25 bp, Mus musculus
acgaagatgatttgcagcgcccaga

SEQ ID NO: 346720 - DNA, 25 bp, Mus musculus
cgatgtgtagcacgtggcccagata

SEQ ID NO: 346721 - DNA, 25 bp, Mus musculus
tcttctcctccatgcgcacgatgtg

SEQ ID NO: 346722 - DNA, 25 bp, Mus musculus
gctccctgtacgcattggctcgcga

SEQ ID NO: 346723 - DNA, 25 bp, Mus musculus
cccacttcgaagagtgtcttgaaga

SEQ ID NO: 346724 - DNA, 25 bp, Mus musculus
accttgccacggtcatcgcgtagtg

SEQ ID NO: 346725 - DNA, 25 bp, Mus musculus
atgttgaagacgtaggtccgcagca

SEQ ID NO: 346726 - DNA, 25 bp, Mus musculus
gtatagaaagtactggcccgcgatg

SEQ ID NO: 346727 - DNA, 25 bp, Mus musculus
ccctaacaccagaatgcggaagatg

SEQ ID NO: 346728 - DNA, 25 bp, Mus musculus
ccgtgctgagggttgtctctcctca

SEQ ID NO: 346729 - DNA, 25 bp, Mus musculus
gctgcagctggaagccgtatagaaa

SEQ ID NO: 346730 - DNA, 25 bp, Mus musculus
gcagacacccgagggccgggtccta

SEQ ID NO: 346731 - DNA, 25 bp, Mus musculus
gcggacacaaattagccgacagctc

SEQ ID NO: 346732 - DNA, 25 bp, Mus musculus
cagcctgcttccaggcggacacaaa

SEQ ID NO: 346733 - DNA, 25 bp, Mus musculus
cccgcgggcaacaagctataaatag

SEQ ID NO: 346734 - DNA, 25 bp, Mus musculus
cctgtctcaccctgtcggatagaga

SEQ ID NO: 346735 - DNA, 25 bp, Mus musculus
gagtcccagccggaatcctgtctca

SEQ ID NO: 346736 - DNA, 25 bp, Mus musculus
agacttgttcctcgggcgagtccca

SEQ ID NO: 346737 - DNA, 25 bp, Mus musculus
cctggggatgcagacttgttcctcg

SEQ ID NO: 346738 - DNA, 25 bp, Mus musculus
gcgggagcaaggcacaaccgactgc

SEQ ID NO: 346739 - DNA, 25 bp, Mus musculus
gtcccgtctggggaagctggcacct

SEQ ID NO: 346740 - DNA, 25 bp, Mus musculus
cctgctctgtaaaggaggctccctc

SEQ ID NO: 346741 - DNA, 25 bp, Mus musculus
gtcgggctcggcctgctctgtaaag

SEQ ID NO: 346742 - DNA, 25 bp, Mus musculus
atatggccctggaactcccagtttg

SEQ ID NO: 346743 - DNA, 25 bp, Mus musculus
acaaccgactgccagagcggcctgg

SEQ ID NO: 346744 - DNA, 25 bp, Mus musculus
ttcctgctcagctttcggttagcta

SEQ ID NO: 346745 - DNA, 25 bp, Mus musculus
cggaggcttcctgcttaacaaatga

SEQ ID NO: 346746 - DNA, 25 bp, Mus musculus
gcctctctcaccctggagcgattga

SEQ ID NO: 346747 - DNA, 25 bp, Mus musculus
tttcaatggcggcagacaacgcagc

SEQ ID NO: 346748 - DNA, 25 bp, Mus musculus
aggaggcctcgggaaaattctagcg

SEQ ID NO: 346749 - DNA, 25 bp, Mus musculus
agcgaaggaatactggcgacacgtc

SEQ ID NO: 346750 - DNA, 25 bp, Mus musculus
acacgtcgcagtcgtgcgcggaaca

SEQ ID NO: 346751 - DNA, 25 bp, Mus musculus
acgcgttcacagctcgggtccctat

SEQ ID NO: 346752 - DNA, 25 bp, Mus musculus
ccagtgctttaggtggtaaaggtca

SEQ ID NO: 346753 - DNA, 25 bp, Mus musculus
tcacgcgtccctactggctgagtct

SEQ ID NO: 346754 - DNA, 25 bp, Mus musculus
ttacaccagtgtgactcggtggcgc

SEQ ID NO: 346755 - DNA, 25 bp, Mus musculus
ctgcgatcctggacacctgttggcc

SEQ ID NO: 346756 - DNA, 25 bp, Mus musculus
gcctgcagccgaagaaacgcgttca

SEQ ID NO: 346757 - DNA, 25 bp, Mus musculus
aaaggtcagtgtcttcccacggagg

SEQ ID NO: 346758 - DNA, 25 bp, Mus musculus
gggccgcctggagatacttgccacc

SEQ ID NO: 346759 - DNA, 25 bp, Mus musculus
gcgagaaagggaacagaccacttcc

SEQ ID NO: 346760 - DNA, 25 bp, Mus musculus
ttccagttcccggtgggctcgcaaa

SEQ ID NO: 346761 - DNA, 25 bp, Mus musculus
tcaagactgtctgtaaccgccgggc

SEQ ID NO: 346762 - DNA, 25 bp, Mus musculus
tcgtcccacaaatctggcgagaaag

SEQ ID NO: 346763 - DNA, 25 bp, Mus musculus
actcgacgcgccttctgtggtgcgc

SEQ ID NO: 346764 - DNA, 25 bp, Mus musculus
ccacctgtggcttcttttaaccgcg

SEQ ID NO: 346765 - DNA, 25 bp, Mus musculus
accctgagcgtaggttggatcaggc

SEQ ID NO: 346766 - DNA, 25 bp, Mus musculus
tcagagctcctaccctgagcgtagg

SEQ ID NO: 346767 - DNA, 25 bp, Mus musculus
tccaggctcgcagcggcactcagag

SEQ ID NO: 346768 - DNA, 25 bp, Mus musculus
actcgcgcttacctgctcggtggga

SEQ ID NO: 346769 - DNA, 25 bp, Mus musculus
ggaggaaatgctcccactcgcgctt

SEQ ID NO: 346770 - DNA, 25 bp, Mus musculus
ctgcccgggtttctcggaggaaatg

SEQ ID NO: 346771 - DNA, 25 bp, Mus musculus
cccgcatggtcaagactgtctgtaa

SEQ ID NO: 346772 - DNA, 25 bp, Mus musculus
ctggctgtacagctgcgttagcgga

SEQ ID NO: 346773 - DNA, 25 bp, Mus musculus
gagacctttacctgcctacgatcac

SEQ ID NO: 346774 - DNA, 25 bp, Mus musculus
cactgagacctttacctgcctacga

SEQ ID NO: 346775 - DNA, 25 bp, Mus musculus
acggcgccactgagacctttacctg

SEQ ID NO: 346776 - DNA, 25 bp, Mus musculus
agcacggcgccactgagacctttac

SEQ ID NO: 346777 - DNA, 25 bp, Mus musculus
agccattgcagcacggcgccactga

SEQ ID NO: 346778 - DNA, 25 bp, Mus musculus
tgccagggcgccagccattgcagca

SEQ ID NO: 346779 - DNA, 25 bp, Mus musculus
aggtacagcctgatgcccacccgag

SEQ ID NO: 346780 - DNA, 25 bp, Mus musculus
tgatgcccacccgaggcacccacgg

SEQ ID NO: 346781 - DNA, 25 bp, Mus musculus
aggtcccgcgttcgggacgctgcca

SEQ ID NO: 346782 - DNA, 25 bp, Mus musculus
cgcgccagaataaggctgggcgcct

SEQ ID NO: 346783 - DNA, 25 bp, Mus musculus
gcgagcaaagcagagcgggtcgcgc

SEQ ID NO: 346784 - DNA, 25 bp, Mus musculus
cagatccgggcctggctgtacagct

SEQ ID NO: 346785 - DNA, 25 bp, Mus musculus
aggagcgaggtacagcctgatgccc

SEQ ID NO: 346786 - DNA, 25 bp, Mus musculus
agcagccctgcacttccggtcacga

SEQ ID NO: 346787 - DNA, 25 bp, Mus musculus
cttccttggagtcgcgcctggcaac

SEQ ID NO: 346788 - DNA, 25 bp, Mus musculus
ccgctctggcctgcctaggatcagg

SEQ ID NO: 346789 - DNA, 25 bp, Mus musculus
acccgggctaatgtcacacggcttg

SEQ ID NO: 346790 - DNA, 25 bp, Mus musculus
ccggcacggctacccgggctaatgt

SEQ ID NO: 346791 - DNA, 25 bp, Mus musculus
cacttggatggtgctcctctcaggg

SEQ ID NO: 346792 - DNA, 25 bp, Mus musculus
agccaacacttggatggtgctcctc

SEQ ID NO: 346793 - DNA, 25 bp, Mus musculus
gagcggcttccttggagtcgcgcct

SEQ ID NO: 346794 - DNA, 25 bp, Mus musculus
ctgttggcggaccacaggtcccagc

SEQ ID NO: 346795 - DNA, 25 bp, Mus musculus
atcactccgctgttggcggaccaca

SEQ ID NO: 346796 - DNA, 25 bp, Mus musculus
ggctcctggcgactgcgcttccgta

SEQ ID NO: 346797 - DNA, 25 bp, Mus musculus
cctcgagaatcactccgctgttggc

SEQ ID NO: 346798 - DNA, 25 bp, Mus musculus
tgcctaggatcaggcgtcgcttctt

SEQ ID NO: 346799 - DNA, 25 bp, Mus musculus
tgcgcttccgtagccaacacttgga

SEQ ID NO: 346800 - DNA, 25 bp, Mus musculus
gcgcccttatttacttcgcagaaga

SEQ ID NO: 346801 - DNA, 25 bp, Mus musculus
ccactggtccgtgccgaggcgtcga

SEQ ID NO: 346802 - DNA, 25 bp, Mus musculus
ggatgctcgcggtcggcttcctgct

SEQ ID NO: 346803 - DNA, 25 bp, Mus musculus
aggcggaccgccagtccacttctgt

SEQ ID NO: 346804 - DNA, 25 bp, Mus musculus
tccacttctgtaggggcgacaccca

SEQ ID NO: 346805 - DNA, 25 bp, Mus musculus
tgtaggggcgacacccagcccgcag

SEQ ID NO: 346806 - DNA, 25 bp, Mus musculus
tgtgcggcgcccttatttacttcgc

SEQ ID NO: 346807 - DNA, 25 bp, Mus musculus
ttacttcgcagaagagccttcagcc

SEQ ID NO: 346808 - DNA, 25 bp, Mus musculus
cctcctaacaagtctggaaagcatc

SEQ ID NO: 346809 - DNA, 25 bp, Mus musculus
tctggaaagcatcacggcgacgcga

SEQ ID NO: 346810 - DNA, 25 bp, Mus musculus
aagcatcacggcgacgcgatgttgg

SEQ ID NO: 346811 - DNA, 25 bp, Mus musculus
cccgcaggtctggatgctcgcggtc

SEQ ID NO: 346812 - DNA, 25 bp, Mus musculus
gagaggcgtctcacaggcactcgca

SEQ ID NO: 346813 - DNA, 25 bp, Mus musculus
tgagctcggcctgtcccgcaggtct

SEQ ID NO: 346814 - DNA, 25 bp, Mus musculus
agatggcgacgccaggcttccgtaa

SEQ ID NO: 346815 - DNA, 25 bp, Mus musculus
cacgtggagactcgacacgctccga

SEQ ID NO: 346816 - DNA, 25 bp, Mus musculus
ccacccaggggtggctcaaccaaga

SEQ ID NO: 346817 - DNA, 25 bp, Mus musculus
caggcttccgtaagtgggtcccacg

SEQ ID NO: 346818 - DNA, 25 bp, Mus musculus
cttccggccagaaagcaagatggcg

SEQ ID NO: 346819 - DNA, 25 bp, Mus musculus
agcggcgtccggcttccggccagaa

SEQ ID NO: 346820 - DNA, 25 bp, Mus musculus
tcctccaagtcctcccaaatgggat

SEQ ID NO: 346821 - DNA, 25 bp, Mus musculus
ccctgtggatgccattttggatacg

SEQ ID NO: 346822 - DNA, 25 bp, Mus musculus
ttcggagacgccatcactggccacg

SEQ ID NO: 346823 - DNA, 25 bp, Mus musculus
tgccgccgccatagcgttcggagac

SEQ ID NO: 346824 - DNA, 25 bp, Mus musculus
cttcggaaagccagcgagctgtcta

SEQ ID NO: 346825 - DNA, 25 bp, Mus musculus
gcttctcgggcttcggaaagccagc

SEQ ID NO: 346826 - DNA, 25 bp, Mus musculus
ccattttggatacgggcagcggcgt

SEQ ID NO: 346827 - DNA, 25 bp, Mus musculus
tgggtcccacgtggagactcgacac

SEQ ID NO: 346828 - DNA, 25 bp, Mus musculus
gactacgggctgaggcgtggtctag

SEQ ID NO: 346829 - DNA, 25 bp, Mus musculus
gccgcgcactccacaagttgggcag

SEQ ID NO: 346830 - DNA, 25 bp, Mus musculus
actccacaagttgggcaggagggaa

SEQ ID NO: 346831 - DNA, 25 bp, Mus musculus
gaggcgcaggtacgcagttcccatt

SEQ ID NO: 346832 - DNA, 25 bp, Mus musculus
gcgcaggtacgcagttcccattggg

SEQ ID NO: 346833 - DNA, 25 bp, Mus musculus
accgccgcggcctggtcgctcaggc

SEQ ID NO: 346834 - DNA, 25 bp, Mus musculus
ctcaggctcggacgccgcgtcaggc

SEQ ID NO: 346835 - DNA, 25 bp, Mus musculus
gaccagctgggccgcgtccggttct

SEQ ID NO: 346836 - DNA, 25 bp, Mus musculus
gtccggttctgcgcagggcccacgt

SEQ ID NO: 346837 - DNA, 25 bp, Mus musculus
ccggtctaccctgcctcgggcccag

SEQ ID NO: 346838 - DNA, 25 bp, Mus musculus
gacttggagcgggcctcccggtcta

SEQ ID NO: 346839 - DNA, 25 bp, Mus musculus
catcttcttattggccagcagcggg

SEQ ID NO: 346840 - DNA, 25 bp, Mus musculus
tgatgtgagctccatcttcttattg

SEQ ID NO: 346841 - DNA, 25 bp, Mus musculus
gagctccatcttcttattggccagc

SEQ ID NO: 346842 - DNA, 25 bp, Mus musculus
caagtccgcggacagtgcgaactcc

SEQ ID NO: 346843 - DNA, 25 bp, Mus musculus
ctctacggggaggaggacttccgct

SEQ ID NO: 346844 - DNA, 25 bp, Mus musculus
ctccagcatggacaagctgctgctg

SEQ ID NO: 346845 - DNA, 25 bp, Mus musculus
cggacagtgcgaactccagcatgga

SEQ ID NO: 346846 - DNA, 25 bp, Mus musculus
ttccgaggtacctgcccgaagccta

SEQ ID NO: 346847 - DNA, 25 bp, Mus musculus
cgaggctgcctgaccgggctctacg

SEQ ID NO: 346848 - DNA, 25 bp, Mus musculus
tacgaccctgctcgctttccgaggt

SEQ ID NO: 346849 - DNA, 25 bp, Mus musculus
ggaggacttccgctttcgcagcaca

SEQ ID NO: 346850 - DNA, 25 bp, Mus musculus
cgtcttctctccagccgtggtgctg

SEQ ID NO: 346851 - DNA, 25 bp, Mus musculus
gccgctctgtgtacgccgaacacta

SEQ ID NO: 346852 - DNA, 25 bp, Mus musculus
gaacactacatcaccatcccggtgg

SEQ ID NO: 346853 - DNA, 25 bp, Mus musculus
atcccggtgggctgcacctgcgtgc

SEQ ID NO: 346854 - DNA, 25 bp, Mus musculus
tgcccgagccggacaagtccgcgga

SEQ ID NO: 346855 - DNA, 25 bp, Mus musculus
ccgaagcctactgcctgtgccgagg

SEQ ID NO: 346856 - DNA, 25 bp, Mus musculus
gaaaaagagaaagctcggccgcatc

SEQ ID NO: 346857 - DNA, 25 bp, Mus musculus
gggcttcgggactgctgcagagccc

SEQ ID NO: 346858 - DNA, 25 bp, Mus musculus
cagagtgcccgcggcgatccggctt

SEQ ID NO: 346859 - DNA, 25 bp, Mus musculus
gcgatccggcttcccggccttcgcc

SEQ ID NO: 346860 - DNA, 25 bp, Mus musculus
gcgtccgcgttctcggcgccgcgac

SEQ ID NO: 346861 - DNA, 25 bp, Mus musculus
ctcggcgccgcgactctgctgagaa

SEQ ID NO: 346862 - DNA, 25 bp, Mus musculus
cagctggagccgcaactccgggctc

SEQ ID NO: 346863 - DNA, 25 bp, Mus musculus
gggaagtcgggctgaggagaacggc

SEQ ID NO: 346864 - DNA, 25 bp, Mus musculus
gggctccggctcactcgtcccctct

SEQ ID NO: 346865 - DNA, 25 bp, Mus musculus
aaagagaaagctcggccgcatcggg

SEQ ID NO: 346866 - DNA, 25 bp, Mus musculus
aaagctcggccgcatcgggctttgg

SEQ ID NO: 346867 - DNA, 25 bp, Mus musculus
gagaccgcggagtagggaccagcgg

SEQ ID NO: 346868 - DNA, 25 bp, Mus musculus
tctcccggccgggtcgcctccgcgc

SEQ ID NO: 346869 - DNA, 25 bp, Mus musculus
gcctccgcgctcgtgcagtgagtgg

SEQ ID NO: 346870 - DNA, 25 bp, Mus musculus
tcttagccttggaagcgctctccta

SEQ ID NO: 346871 - DNA, 25 bp, Mus musculus
tgtggagcaggatctcttagccttg

SEQ ID NO: 346872 - DNA, 25 bp, Mus musculus
tccgctgtgagaaaagggcatccgt

SEQ ID NO: 346873 - DNA, 25 bp, Mus musculus
gcgctctcctaagggtgcgtctacg

SEQ ID NO: 346874 - DNA, 25 bp, Mus musculus
cggcgtcctcaccatcagaactttg

SEQ ID NO: 346875 - DNA, 25 bp, Mus musculus
aactttggccgcgttctccagctga

SEQ ID NO: 346876 - DNA, 25 bp, Mus musculus
gggagcttcctctcgctcccatagg

SEQ ID NO: 346877 - DNA, 25 bp, Mus musculus
tgcgtctacgcccagaattcatgcc

SEQ ID NO: 346878 - DNA, 25 bp, Mus musculus
gctcccataggctgtccggtgtgga

SEQ ID NO: 346879 - DNA, 25 bp, Mus musculus
ttctccagctgagcgatcacttctg

SEQ ID NO: 346880 - DNA, 25 bp, Mus musculus
gcgcagcccgttagctgcgggttaa

SEQ ID NO: 346881 - DNA, 25 bp, Mus musculus
gacgggaccgccgattcctgagcag

SEQ ID NO: 346882 - DNA, 25 bp, Mus musculus
atgacgcgccatgcgctgcattctg

SEQ ID NO: 346883 - DNA, 25 bp, Mus musculus
ccgccatcatggtctctcttcaatg

SEQ ID NO: 346884 - DNA, 25 bp, Mus musculus
accggaagggatagccgttgtcatc

SEQ ID NO: 346885 - DNA, 25 bp, Mus musculus
tctgcactctctgcgggctctgagg

SEQ ID NO: 346886 - DNA, 25 bp, Mus musculus
cttcgtgatgaggtctcgggcctca

SEQ ID NO: 346887 - DNA, 25 bp, Mus musculus
agcctcacctgcgtagggatatgca

SEQ ID NO: 346888 - DNA, 25 bp, Mus musculus
gccgttgtcatcgaagaacctgcgg

SEQ ID NO: 346889 - DNA, 25 bp, Mus musculus
acctgcggaaggtgaactcatagaa

SEQ ID NO: 346890 - DNA, 25 bp, Mus musculus
ctcatagaaggcgtgctctggatgc

SEQ ID NO: 346891 - DNA, 25 bp, Mus musculus
gggctttcttcatccaccgggtcaa

SEQ ID NO: 346892 - DNA, 25 bp, Mus musculus
ccgggtcaaaattggaggtgtccat

SEQ ID NO: 346893 - DNA, 25 bp, Mus musculus
aggctgctttcggatgtcacgggaa

SEQ ID NO: 346894 - DNA, 25 bp, Mus musculus
tgtcacgggaaaagtcgatggtgtt

SEQ ID NO: 346895 - DNA, 25 bp, Mus musculus
cagccgcgcagcacagcttcgtgat

SEQ ID NO: 346896 - DNA, 25 bp, Mus musculus
ctggcctcgtgccaggggctttctt

SEQ ID NO: 346897 - DNA, 25 bp, Mus musculus
aagaacgggtgtgccttgaggtcat

SEQ ID NO: 346898 - DNA, 25 bp, Mus musculus
gcgaggcttctagaccctgcttctg

SEQ ID NO: 346899 - DNA, 25 bp, Mus musculus
cgcacgctcttcacagggtgaagga

SEQ ID NO: 346900 - DNA, 25 bp, Mus musculus
tcttcacagggtgaaggatgtgtgc

SEQ ID NO: 346901 - DNA, 25 bp, Mus musculus
ttgttgaaggagttggtcctgctgg

SEQ ID NO: 346902 - DNA, 25 bp, Mus musculus
tggggccagcccgaaaagccacatg

SEQ ID NO: 346903 - DNA, 25 bp, Mus musculus
agaccctgcttctgcagcgagtcgc

SEQ ID NO: 346904 - DNA, 25 bp, Mus musculus
acatgcggccgcgaggcttctagac

SEQ ID NO: 346905 - DNA, 25 bp, Mus musculus
gcacacgcacgctcttcacagggtg

SEQ ID NO: 346906 - DNA, 25 bp, Mus musculus
cgccatagtccacatccagcgggtg

SEQ ID NO: 346907 - DNA, 25 bp, Mus musculus
cgaaaagccacatgcggccgcgagg

SEQ ID NO: 346908 - DNA, 25 bp, Mus musculus
ttcgtctccaggctctcagtggcag

SEQ ID NO: 346909 - DNA, 25 bp, Mus musculus
agtccacatccagcgggtgtgggcc

SEQ ID NO: 346910 - DNA, 25 bp, Mus musculus
ccaggctctcagtggcaggtgctgt

SEQ ID NO: 346911 - DNA, 25 bp, Mus musculus
ctgcgctgccctccttcgtctccag

SEQ ID NO: 346912 - DNA, 25 bp, Mus musculus
tcgtaccagtgggtgagaaaagtaa

SEQ ID NO: 346913 - DNA, 25 bp, Mus musculus
ctcgtgcgtgaccagcgctacggac

SEQ ID NO: 346914 - DNA, 25 bp, Mus musculus
cgctacggactcaggccgtggagtc

SEQ ID NO: 346915 - DNA, 25 bp, Mus musculus
gtcggctcaaaagagacgttacgca

SEQ ID NO: 346916 - DNA, 25 bp, Mus musculus
cggacgggttgtccctgtcccgcag

SEQ ID NO: 346917 - DNA, 25 bp, Mus musculus
tcacgccgcggttccgaagcgcaga

SEQ ID NO: 346918 - DNA, 25 bp, Mus musculus
aagcgcagacccgagcgggacattc

SEQ ID NO: 346919 - DNA, 25 bp, Mus musculus
cgggacattcgctacattgttggca

SEQ ID NO: 346920 - DNA, 25 bp, Mus musculus
gagacccgggcatcaaataataaac

SEQ ID NO: 346921 - DNA, 25 bp, Mus musculus
cctaaacgcctcgtaccagtgggtg

SEQ ID NO: 346922 - DNA, 25 bp, Mus musculus
cccggtgccagccacggaaagtgca

SEQ ID NO: 346923 - DNA, 25 bp, Mus musculus
gccacggaaagtgcagccggctgct

SEQ ID NO: 346924 - DNA, 25 bp, Mus musculus
ccggctgctgagacccgggcatcaa

SEQ ID NO: 346925 - DNA, 25 bp, Mus musculus
cattgttggcattccacgggcgtca

SEQ ID NO: 346926 - DNA, 25 bp, Mus musculus
caactaagaacgatcaagacgcctg

SEQ ID NO: 346927 - DNA, 25 bp, Mus musculus
cctcgcgagagacgactagctcatg

SEQ ID NO: 346928 - DNA, 25 bp, Mus musculus
atattacgttaagctgacctgggca

SEQ ID NO: 346929 - DNA, 25 bp, Mus musculus
ttcgtgatcgctacacattttcatc

SEQ ID NO: 346930 - DNA, 25 bp, Mus musculus
tgtggccgcccggtacaaaaggata

SEQ ID NO: 346931 - DNA, 25 bp, Mus musculus
cccgccgtgtgacgcctttcgggag

SEQ ID NO: 346932 - DNA, 25 bp, Mus musculus
aaacctcgtgcctttcctcgcgaga

SEQ ID NO: 346933 - DNA, 25 bp, Mus musculus
gccttgccactcgtttcctataaaa

SEQ ID NO: 346934 - DNA, 25 bp, Mus musculus
ggaaatacgcctgcgccatgcgatg

SEQ ID NO: 346935 - DNA, 25 bp, Mus musculus
gtgtgcacccacacatacggaaata

SEQ ID NO: 346936 - DNA, 25 bp, Mus musculus
agacgcctgtagagcactgcgcatg

SEQ ID NO: 346937 - DNA, 25 bp, Mus musculus
cctgggcagtgagcacgtaagaaaa

SEQ ID NO: 346938 - DNA, 25 bp, Mus musculus
catcactacgcatgaaaatattacg

SEQ ID NO: 346939 - DNA, 25 bp, Mus musculus
tcagagtgaactgaccggcgtcgct

SEQ ID NO: 346940 - DNA, 25 bp, Mus musculus
agagcatgatccgtcgcctggaggt

SEQ ID NO: 346941 - DNA, 25 bp, Mus musculus
ttccaagcgaaggagagcatgatcc

SEQ ID NO: 346942 - DNA, 25 bp, Mus musculus
cggccgcgtaccgtgtctttccaag

SEQ ID NO: 346943 - DNA, 25 bp, Mus musculus
tgccctacatgacagcagagcagga

SEQ ID NO: 346944 - DNA, 25 bp, Mus musculus
cctgcggccacaaggagaatttgtc

SEQ ID NO: 346945 - DNA, 25 bp, Mus musculus
ctactggctcagcatgccctacatg

SEQ ID NO: 346946 - DNA, 25 bp, Mus musculus
ccgcggctttcgtgtcatttcctca

SEQ ID NO: 346947 - DNA, 25 bp, Mus musculus
atatcctgcagtgtagtcggctccc

SEQ ID NO: 346948 - DNA, 25 bp, Mus musculus
gagcggaactctagcatcagggccc

SEQ ID NO: 346949 - DNA, 25 bp, Mus musculus
cgtctctcgcgagagcggaactcta

SEQ ID NO: 346950 - DNA, 25 bp, Mus musculus
cgaacgaacgcgctacacatttgaa

SEQ ID NO: 346951 - DNA, 25 bp, Mus musculus
gaaactctggatggggttcatgctg

SEQ ID NO: 346952 - DNA, 25 bp, Mus musculus
cccgcagcttacagtggaaactctg

SEQ ID NO: 346953 - DNA, 25 bp, Mus musculus
gtccgcacagtttccatcacagatc

SEQ ID NO: 346954 - DNA, 25 bp, Mus musculus
agctccaccacgtacgcgtagtagg

SEQ ID NO: 346955 - DNA, 25 bp, Mus musculus
cccacgattctgtaggaccacaaga

SEQ ID NO: 346956 - DNA, 25 bp, Mus musculus
tggcgaagggcgacgccacaactcc

SEQ ID NO: 346957 - DNA, 25 bp, Mus musculus
tgatgaagagcaccggaacccagcc

SEQ ID NO: 346958 - DNA, 25 bp, Mus musculus
tcccgctgcccacgattctgtagga

SEQ ID NO: 346959 - DNA, 25 bp, Mus musculus
gcagcgagccgtgggcagaaaccca

SEQ ID NO: 346960 - DNA, 25 bp, Mus musculus
cctcggacgtggaacccacgggctg

SEQ ID NO: 346961 - DNA, 25 bp, Mus musculus
cgcgtagtaggaccagacgaccaca

SEQ ID NO: 346962 - DNA, 25 bp, Mus musculus
accacgcgttggcagcagcgccaga

SEQ ID NO: 346963 - DNA, 25 bp, Mus musculus
cgccagagtgtccagggcgccatgt

SEQ ID NO: 346964 - DNA, 25 bp, Mus musculus
gccatgttcctctgctgactgccgg

SEQ ID NO: 346965 - DNA, 25 bp, Mus musculus
tgaagggcgacgctgcaactccgcc

SEQ ID NO: 346966 - DNA, 25 bp, Mus musculus
ctctcatcccgctgcgagctgtgaa

SEQ ID NO: 346967 - DNA, 25 bp, Mus musculus
gcagccacccggaagcttggagcgt

SEQ ID NO: 346968 - DNA, 25 bp, Mus musculus
aggcgcctagggtctcctgtgcctc

SEQ ID NO: 346969 - DNA, 25 bp, Mus musculus
gggctgagccgtacctgcgccgaca

SEQ ID NO: 346970 - DNA, 25 bp, Mus musculus
gtacctgcgccgacaccgttcggga

SEQ ID NO: 346971 - DNA, 25 bp, Mus musculus
gcggctgctttcacgcggccgtgat

SEQ ID NO: 346972 - DNA, 25 bp, Mus musculus
tttcacgcggccgtgatgccatgcc

SEQ ID NO: 346973 - DNA, 25 bp, Mus musculus
gccatctttgcggaagcgcccgagc

SEQ ID NO: 346974 - DNA, 25 bp, Mus musculus
tcaccgtctgttgcccgagaacaga

SEQ ID NO: 346975 - DNA, 25 bp, Mus musculus
tgcccgagaacagagttgggctctc

SEQ ID NO: 346976 - DNA, 25 bp, Mus musculus
tgggctctcgcgagagctcatcacc

SEQ ID NO: 346977 - DNA, 25 bp, Mus musculus
ctccaccgtgctctgcgcgtgtgtt

SEQ ID NO: 346978 - DNA, 25 bp, Mus musculus
tgttgctaggtgtggctgcttcctc

SEQ ID NO: 346979 - DNA, 25 bp, Mus musculus
gctgcttcctcgacgttcaagcgtg

SEQ ID NO: 346980 - DNA, 25 bp, Mus musculus
cctcgacgttcaagcgtggttttga

SEQ ID NO: 346981 - DNA, 25 bp, Mus musculus
caagcgtggttttgaggtgaccctc

SEQ ID NO: 346982 - DNA, 25 bp, Mus musculus
ttccgctggtgtctatttgggcgtt

SEQ ID NO: 346983 - DNA, 25 bp, Mus musculus
gcgcggacgcgaccacaggtataaa

SEQ ID NO: 346984 - DNA, 25 bp, Mus musculus
ccacaggtataaagcgggtcagaac

SEQ ID NO: 346985 - DNA, 25 bp, Mus musculus
ggtataaagcgggtcagaaccactc

SEQ ID NO: 346986 - DNA, 25 bp, Mus musculus
agcgggtcagaaccactcggcttgt

SEQ ID NO: 346987 - DNA, 25 bp, Mus musculus
tggactagaaccggaactctttgga

SEQ ID NO: 346988 - DNA, 25 bp, Mus musculus
accactcggcttgtggtgcgggttt

SEQ ID NO: 346989 - DNA, 25 bp, Mus musculus
tgcgggtttccgctggtgtctattt

SEQ ID NO: 346990 - DNA, 25 bp, Mus musculus
cgaccgtggcgcactctgcgcggac

SEQ ID NO: 346991 - DNA, 25 bp, Mus musculus
tagtcctgggctccgagctggcgct

SEQ ID NO: 346992 - DNA, 25 bp, Mus musculus
agtgaagcccttgcggtcgggagag

SEQ ID NO: 346993 - DNA, 25 bp, Mus musculus
accgcagaggttgtctgaaggccga

SEQ ID NO: 346994 - DNA, 25 bp, Mus musculus
ctatttgggcgttggactagaaccg

SEQ ID NO: 346995 - DNA, 25 bp, Mus musculus
aactctttggaggacggaccgcaga

SEQ ID NO: 346996 - DNA, 25 bp, Mus musculus
gagcgagccctgagcagcgaacagc

SEQ ID NO: 346997 - DNA, 25 bp, Mus musculus
gcttccaagtcacccgcggcagcga

SEQ ID NO: 346998 - DNA, 25 bp, Mus musculus
ggaccagagctccggcttccaagtc

SEQ ID NO: 346999 - DNA, 25 bp, Mus musculus
ctgctggcctcgagcaaaagccctg

SEQ ID NO: 347000 - DNA, 25 bp, Mus musculus
tcaaaggctgctggcctcgagcaaa

SEQ ID NO: 347001 - DNA, 25 bp, Mus musculus
ttgtccctgcatggggctgggctca

SEQ ID NO: 347002 - DNA, 25 bp, Mus musculus
tgcgtttctttgtccctgcatgggg

SEQ ID NO: 347003 - DNA, 25 bp, Mus musculus
cctgggcagtgcgtttctttgtccc

SEQ ID NO: 347004 - DNA, 25 bp, Mus musculus
acaatgtgaacaaagaggagcgtgg

SEQ ID NO: 347005 - DNA, 25 bp, Mus musculus
cccgagagtctaagacaatgtgaac

SEQ ID NO: 347006 - DNA, 25 bp, Mus musculus
cttgacccgagagtctaagacaatg

SEQ ID NO: 347007 - DNA, 25 bp, Mus musculus
gcaactttcaccatcttgacccgag

SEQ ID NO: 347008 - DNA, 25 bp, Mus musculus
tgcgctcaagtcttagcaactttca

SEQ ID NO: 347009 - DNA, 25 bp, Mus musculus
tcgggagctgcgctcaagtcttagc

SEQ ID NO: 347010 - DNA, 25 bp, Mus musculus
gcgtctccggcgtctctaaagccgg

SEQ ID NO: 347011 - DNA, 25 bp, Mus musculus
agcgttctggatactagctttggac

SEQ ID NO: 347012 - DNA, 25 bp, Mus musculus
atgcgacgcaaggttacagagtccg

SEQ ID NO: 347013 - DNA, 25 bp, Mus musculus
gcaaggttacagagtccgcgcgaaa

SEQ ID NO: 347014 - DNA, 25 bp, Mus musculus
cagagtccgcgcgaaaactgctttc

SEQ ID NO: 347015 - DNA, 25 bp, Mus musculus
cgcgcgaaaactgctttctcagttc

SEQ ID NO: 347016 - DNA, 25 bp, Mus musculus
cctgcgtctctagcaagctagattt

SEQ ID NO: 347017 - DNA, 25 bp, Mus musculus
agagcctctgcagcgttctggatac

SEQ ID NO: 347018 - DNA, 25 bp, Mus musculus
tggccgaatgtcttcgggctgctgc

SEQ ID NO: 347019 - DNA, 25 bp, Mus musculus
tcgtcctcccggagaagtcccgcgc

SEQ ID NO: 347020 - DNA, 25 bp, Mus musculus
cggcgacacctgttcgcggcagccc

SEQ ID NO: 347021 - DNA, 25 bp, Mus musculus
ccgcttgccgctcgcctcactgcaa

SEQ ID NO: 347022 - DNA, 25 bp, Mus musculus
tgcaagccgctggacctccgcagag

SEQ ID NO: 347023 - DNA, 25 bp, Mus musculus
aagctagatttcttgtggccgaatg

SEQ ID NO: 347024 - DNA, 25 bp, Mus musculus
ctgcagctacctccgggcacaaacc

SEQ ID NO: 347025 - DNA, 25 bp, Mus musculus
gcgtgtaacctacgtgaccgccctg

SEQ ID NO: 347026 - DNA, 25 bp, Mus musculus
ggctttgctactgcgcccattggct

SEQ ID NO: 347027 - DNA, 25 bp, Mus musculus
ccggggctttgctactgcgcccatt

SEQ ID NO: 347028 - DNA, 25 bp, Mus musculus
tacgtgaccgccctgcagctacctc

SEQ ID NO: 347029 - DNA, 25 bp, Mus musculus
gtgtaacctacgtgaccgccctgca

SEQ ID NO: 347030 - DNA, 25 bp, Mus musculus
actgcgtgtaacctacgtgaccgcc

SEQ ID NO: 347031 - DNA, 25 bp, Mus musculus
tgactgcgtgtaacctacgtgaccg

SEQ ID NO: 347032 - DNA, 25 bp, Mus musculus
gagtgactgcgtgtaacctacgtga

SEQ ID NO: 347033 - DNA, 25 bp, Mus musculus
ccgagtgactgcgtgtaacctacgt

SEQ ID NO: 347034 - DNA, 25 bp, Mus musculus
ccgccgagtgactgcgtgtaaccta

SEQ ID NO: 347035 - DNA, 25 bp, Mus musculus
agccgccgacccgcgccattctggt

SEQ ID NO: 347036 - DNA, 25 bp, Mus musculus
cgcctgcagtcagctgagcctccag

SEQ ID NO: 347037 - DNA, 25 bp, Mus musculus
tgtaacctacgtgaccgccctgcag

SEQ ID NO: 347038 - DNA, 25 bp, Mus musculus
aggcatccggatctagtctcacagg

SEQ ID NO: 347039 - DNA, 25 bp, Mus musculus
tgccactcaccctcgttcggatgga

SEQ ID NO: 347040 - DNA, 25 bp, Mus musculus
ttaagtctttcatccggttgcagtg

SEQ ID NO: 347041 - DNA, 25 bp, Mus musculus
tggaactgagctttgcggtctcacg

SEQ ID NO: 347042 - DNA, 25 bp, Mus musculus
ctattgttaaccactagcctaggga

SEQ ID NO: 347043 - DNA, 25 bp, Mus musculus
gccaaagccacctttattgtgtgca

SEQ ID NO: 347044 - DNA, 25 bp, Mus musculus
ttgtgtgcatttcccggtcccaacc

SEQ ID NO: 347045 - DNA, 25 bp, Mus musculus
actggatagccctcacacttcggac

SEQ ID NO: 347046 - DNA, 25 bp, Mus musculus
ttaagataggacgtttgccacgcgc

SEQ ID NO: 347047 - DNA, 25 bp, Mus musculus
tgccacgcgcacttgatacatcaga

SEQ ID NO: 347048 - DNA, 25 bp, Mus musculus
tcagcgaagaaggactgcaggtacc

SEQ ID NO: 347049 - DNA, 25 bp, Mus musculus
gacatctctactttctggttccgca

SEQ ID NO: 347050 - DNA, 25 bp, Mus musculus
tgcaagtatagcaggtcggcccggt

SEQ ID NO: 347051 - DNA, 25 bp, Mus musculus
cttctttctgaagcgcgcagcaggg

SEQ ID NO: 347052 - DNA, 25 bp, Mus musculus
aggctgactgctgcagagcgccgaa

SEQ ID NO: 347053 - DNA, 25 bp, Mus musculus
gcgctccggtgtcacgtgacgcgac

SEQ ID NO: 347054 - DNA, 25 bp, Mus musculus
attaaagctcgtggtgggcaaaaca

SEQ ID NO: 347055 - DNA, 25 bp, Mus musculus
tggtgggcaaaacaatcggagtttc

SEQ ID NO: 347056 - DNA, 25 bp, Mus musculus
agtttctgagactggcgtgcgctgt

SEQ ID NO: 347057 - DNA, 25 bp, Mus musculus
aaacccgagcgggaacctgagcaga

SEQ ID NO: 347058 - DNA, 25 bp, Mus musculus
tcctgaagaccagcggcctgggatg

SEQ ID NO: 347059 - DNA, 25 bp, Mus musculus
ggcacccgcggattccgtcttgcgg

SEQ ID NO: 347060 - DNA, 25 bp, Mus musculus
aggaacccggagcacgcaggttagc

SEQ ID NO: 347061 - DNA, 25 bp, Mus musculus
cccgttactgctacgaggattaaag

SEQ ID NO: 347062 - DNA, 25 bp, Mus musculus
tacagcttgcttttagaaacattca

SEQ ID NO: 347063 - DNA, 25 bp, Mus musculus
accgggcagagacacgtgtcctgaa

SEQ ID NO: 347064 - DNA, 25 bp, Mus musculus
ccgagggttgcagttttataagaca

SEQ ID NO: 347065 - DNA, 25 bp, Mus musculus
gaaacattcatagtctccctcgcct

SEQ ID NO: 347066 - DNA, 25 bp, Mus musculus
ccacgaaagtgagcgccgcaagacg

SEQ ID NO: 347067 - DNA, 25 bp, Mus musculus
ttctcggcagccaagtgaggcactt

SEQ ID NO: 347068 - DNA, 25 bp, Mus musculus
ggccaatcgggttctcggcagccaa

SEQ ID NO: 347069 - DNA, 25 bp, Mus musculus
gactgctacggccaatcgggttctc

SEQ ID NO: 347070 - DNA, 25 bp, Mus musculus
tctcgcgcggactgctacggccaat

SEQ ID NO: 347071 - DNA, 25 bp, Mus musculus
gactctctcggtttgtctcgcgcgg

SEQ ID NO: 347072 - DNA, 25 bp, Mus musculus
tcggcgactctctcggtttgtctcg

SEQ ID NO: 347073 - DNA, 25 bp, Mus musculus
ggcctcctgattggtcggcgactct

SEQ ID NO: 347074 - DNA, 25 bp, Mus musculus
ccaagggagctccacacagtttccg

SEQ ID NO: 347075 - DNA, 25 bp, Mus musculus
cccgctactgagacagcgggttgag

SEQ ID NO: 347076 - DNA, 25 bp, Mus musculus
ccaagtgaggcacttcgctggagtg

SEQ ID NO: 347077 - DNA, 25 bp, Mus musculus
gtctgcagtcccgaggcggcttcac

SEQ ID NO: 347078 - DNA, 25 bp, Mus musculus
gcaccagagtctgcagtcccgaggc

SEQ ID NO: 347079 - DNA, 25 bp, Mus musculus
ttgcactgtccgcaccagagtctgc

SEQ ID NO: 347080 - DNA, 25 bp, Mus musculus
caaccgcttgttctgcgcagcaaga

SEQ ID NO: 347081 - DNA, 25 bp, Mus musculus
ccaggacagcttgcccggtcaggca

SEQ ID NO: 347082 - DNA, 25 bp, Mus musculus
cccggtcaggcatgataggttcctt

SEQ ID NO: 347083 - DNA, 25 bp, Mus musculus
gtctgcgtgccgactgacctctcgg

SEQ ID NO: 347084 - DNA, 25 bp, Mus musculus
taatgtgacgtcagagtccggcgca

SEQ ID NO: 347085 - DNA, 25 bp, Mus musculus
tctgcggcctgtcaacaaccgcttg

SEQ ID NO: 347086 - DNA, 25 bp, Mus musculus
cgcagcaagatgacgtctcggtatg

SEQ ID NO: 347087 - DNA, 25 bp, Mus musculus
catgataggttccttgaagctcgcc

SEQ ID NO: 347088 - DNA, 25 bp, Mus musculus
gttccttgaagctcgcctacggcca

SEQ ID NO: 347089 - DNA, 25 bp, Mus musculus
ccaaactctgcatctgatccgtttc

SEQ ID NO: 347090 - DNA, 25 bp, Mus musculus
gcatctgatccgtttctttcatccc

SEQ ID NO: 347091 - DNA, 25 bp, Mus musculus
gggagagaaggccaccgcactcacc

SEQ ID NO: 347092 - DNA, 25 bp, Mus musculus
actcgggcaagcgtgcagagcgcca

SEQ ID NO: 347093 - DNA, 25 bp, Mus musculus
gcttccggcgcttaatgtgacgtca

SEQ ID NO: 347094 - DNA, 25 bp, Mus musculus
gtcactcgcaaggagggatgactta

SEQ ID NO: 347095 - DNA, 25 bp, Mus musculus
cgcctcagaggggagtgttcctcac

SEQ ID NO: 347096 - DNA, 25 bp, Mus musculus
gggatcgccgaaccataacttcttg

SEQ ID NO: 347097 - DNA, 25 bp, Mus musculus
gtgacctctagagacatcaccggtg

SEQ ID NO: 347098 - DNA, 25 bp, Mus musculus
ggatgacttagaccctggctctgca

SEQ ID NO: 347099 - DNA, 25 bp, Mus musculus
cgagtactgccacggctggctggac

SEQ ID NO: 347100 - DNA, 25 bp, Mus musculus
cagaaacgtttcttctgtgatgccc

SEQ ID NO: 347101 - DNA, 25 bp, Mus musculus
aggtcggatcacaagccaagctttc

SEQ ID NO: 347102 - DNA, 25 bp, Mus musculus
gatgcccaaagaaggtcggatcaca

SEQ ID NO: 347103 - DNA, 25 bp, Mus musculus
tctgatgctgaaacgctccagccgc

SEQ ID NO: 347104 - DNA, 25 bp, Mus musculus
ctgcttctcgcaggggaagtgaata

SEQ ID NO: 347105 - DNA, 25 bp, Mus musculus
cggagccatgaggaccgagcacaga

SEQ ID NO: 347106 - DNA, 25 bp, Mus musculus
agcccgagggactgaaacttccgtg

SEQ ID NO: 347107 - DNA, 25 bp, Mus musculus
gccgaacctagcagggacgtggtca

SEQ ID NO: 347108 - DNA, 25 bp, Mus musculus
ccctggagactagaccgtagccaca

SEQ ID NO: 347109 - DNA, 25 bp, Mus musculus
gagactagaccgtagccacagccgc

SEQ ID NO: 347110 - DNA, 25 bp, Mus musculus
tagctggtctccaacagacgtggcc

SEQ ID NO: 347111 - DNA, 25 bp, Mus musculus
gtgcctctagctggtctccaacaga

SEQ ID NO: 347112 - DNA, 25 bp, Mus musculus
aagaacgaacgggtcctgcagaatc

SEQ ID NO: 347113 - DNA, 25 bp, Mus musculus
tggggccgcctatgcacctagcctg

SEQ ID NO: 347114 - DNA, 25 bp, Mus musculus
ggacatctcatcctctgccttcttg

SEQ ID NO: 347115 - DNA, 25 bp, Mus musculus
ccgcagaagaacgaacgggtcctgc

SEQ ID NO: 347116 - DNA, 25 bp, Mus musculus
aacacaaagaaatcagcctccaggc

SEQ ID NO: 347117 - DNA, 25 bp, Mus musculus
tccaacagacgtggcccgggacatc

SEQ ID NO: 347118 - DNA, 25 bp, Mus musculus
ctgccttcttgtagcccgcagaaga

SEQ ID NO: 347119 - DNA, 25 bp, Mus musculus
ctctggagagactggggccgcctat

SEQ ID NO: 347120 - DNA, 25 bp, Mus musculus
aaagaaatcagcctccaggcccgag

SEQ ID NO: 347121 - DNA, 25 bp, Mus musculus
aacgggtcctgcagaatcgaggcgc

SEQ ID NO: 347122 - DNA, 25 bp, Mus musculus
ttaaaagcctggtccaggcccgcgc

SEQ ID NO: 347123 - DNA, 25 bp, Mus musculus
tgtaagggcgcacagacaggcacgc

SEQ ID NO: 347124 - DNA, 25 bp, Mus musculus
gcgccgttcagcatcgcgcgtggct

SEQ ID NO: 347125 - DNA, 25 bp, Mus musculus
agctcacccacggacgcgccgatcc

SEQ ID NO: 347126 - DNA, 25 bp, Mus musculus
tccgcggtaacgacatcttaaaagc

SEQ ID NO: 347127 - DNA, 25 bp, Mus musculus
gcgcgcgtgcaccaacacgcaaacg

SEQ ID NO: 347128 - DNA, 25 bp, Mus musculus
gacatcttaaaagcctggtccaggc

SEQ ID NO: 347129 - DNA, 25 bp, Mus musculus
cggagcagtgtctcccagccctggg

SEQ ID NO: 347130 - DNA, 25 bp, Mus musculus
aagggcggagcagtgtctcccagcc

SEQ ID NO: 347131 - DNA, 25 bp, Mus musculus
ccttccgcacggtgtgaggactttt

SEQ ID NO: 347132 - DNA, 25 bp, Mus musculus
ggtgagacttctctcacgctcgccg

SEQ ID NO: 347133 - DNA, 25 bp, Mus musculus
cgaacacacatggatacacgcatac

SEQ ID NO: 347134 - DNA, 25 bp, Mus musculus
acgcaaacgcgcacgcggacggaca

SEQ ID NO: 347135 - DNA, 25 bp, Mus musculus
gccctccgcggtaacgacatcttaa

SEQ ID NO: 347136 - DNA, 25 bp, Mus musculus
agcgggctagctgcagaagagctca

SEQ ID NO: 347137 - DNA, 25 bp, Mus musculus
cgtgtcagacgcgtcataggccgcg

SEQ ID NO: 347138 - DNA, 25 bp, Mus musculus
agctcatggtgaggctgtgcaaacc

SEQ ID NO: 347139 - DNA, 25 bp, Mus musculus
tgcaggtgcgtgtcagacgcgtcat

SEQ ID NO: 347140 - DNA, 25 bp, Mus musculus
ctgtgcaaaccaggccgggagcgca

SEQ ID NO: 347141 - DNA, 25 bp, Mus musculus
ctagctgcagaagagctcatggtga

SEQ ID NO: 347142 - DNA, 25 bp, Mus musculus
ccatcactggcttgcccaggatttg

SEQ ID NO: 347143 - DNA, 25 bp, Mus musculus
atatagggggtctcccaacgctcca

SEQ ID NO: 347144 - DNA, 25 bp, Mus musculus
cgccgctagcgcatgcatatagggg

SEQ ID NO: 347145 - DNA, 25 bp, Mus musculus
gggcggtgcctctgcacagagatta

SEQ ID NO: 347146 - DNA, 25 bp, Mus musculus
tagccttgcactcaagtgggtggga

SEQ ID NO: 347147 - DNA, 25 bp, Mus musculus
ggcggggcctatgcgccctaaagaa

SEQ ID NO: 347148 - DNA, 25 bp, Mus musculus
cctatgcgccctaaagaactccgtg

SEQ ID NO: 347149 - DNA, 25 bp, Mus musculus
gcacagagattagccttgcactcaa

SEQ ID NO: 347150 - DNA, 25 bp, Mus musculus
ggcctaggacgcttctgtcccttca

SEQ ID NO: 347151 - DNA, 25 bp, Mus musculus
tcgcgggatttcgtgctttacttcc

SEQ ID NO: 347152 - DNA, 25 bp, Mus musculus
tctaccttttgagggtccagaaatg

SEQ ID NO: 347153 - DNA, 25 bp, Mus musculus
ggacgtgccacatagctggtgccca

SEQ ID NO: 347154 - DNA, 25 bp, Mus musculus
ttttaagtcgcacacgcttccggtc

SEQ ID NO: 347155 - DNA, 25 bp, Mus musculus
ggcctcctgtcaaaagccatgcgta

SEQ ID NO: 347156 - DNA, 25 bp, Mus musculus
tgcacgcttgtgcttcctgcacgga

SEQ ID NO: 347157 - DNA, 25 bp, Mus musculus
ctgagtttcatttgggtgtcgctgc

SEQ ID NO: 347158 - DNA, 25 bp, Mus musculus
aaggcaggcctcgatgtgcagacct

SEQ ID NO: 347159 - DNA, 25 bp, Mus musculus
tctagagttggagaagaccttggtc

SEQ ID NO: 347160 - DNA, 25 bp, Mus musculus
aggcggcaccattacctagacgcga

SEQ ID NO: 347161 - DNA, 25 bp, Mus musculus
ttcctgaatgaaggccctggagtgc

SEQ ID NO: 347162 - DNA, 25 bp, Mus musculus
ttcactgccgaagagggacgtgcca

SEQ ID NO: 347163 - DNA, 25 bp, Mus musculus
tcctccaaggggacgtctgagtttc

SEQ ID NO: 347164 - DNA, 25 bp, Mus musculus
gtgctctcctgaggccagctgcctg

SEQ ID NO: 347165 - DNA, 25 bp, Mus musculus
tgcggaagtgtttctaggcgacaga

SEQ ID NO: 347166 - DNA, 25 bp, Mus musculus
gtgtttctaggcgacagagctctca

SEQ ID NO: 347167 - DNA, 25 bp, Mus musculus
acagagctctcagatgacgcctgcg

SEQ ID NO: 347168 - DNA, 25 bp, Mus musculus
gtttctctcccgatggtgctctcct

SEQ ID NO: 347169 - DNA, 25 bp, Mus musculus
ggagcacatccggacaaccaaggta

SEQ ID NO: 347170 - DNA, 25 bp, Mus musculus
caaccaaggtagtcggcgggagatc

SEQ ID NO: 347171 - DNA, 25 bp, Mus musculus
agtcggcaaacggtggccgcccagc

SEQ ID NO: 347172 - DNA, 25 bp, Mus musculus
gccgcccagcgagctttgctctttt

SEQ ID NO: 347173 - DNA, 25 bp, Mus musculus
gcgagctttgctcttttggacaaga

SEQ ID NO: 347174 - DNA, 25 bp, Mus musculus
ctcttttggacaagactggggctgc

SEQ ID NO: 347175 - DNA, 25 bp, Mus musculus
agactggggctgctttttactttgg

SEQ ID NO: 347176 - DNA, 25 bp, Mus musculus
ggatttcggccgatcgccgcctggc

SEQ ID NO: 347177 - DNA, 25 bp, Mus musculus
agttcctgcgggtggctgtcaccgc

SEQ ID NO: 347178 - DNA, 25 bp, Mus musculus
acgcctcgcgacacgcagcaggtga

SEQ ID NO: 347179 - DNA, 25 bp, Mus musculus
cctgctgaaaaagaacgggcgatcg

SEQ ID NO: 347180 - DNA, 25 bp, Mus musculus
tgaaagggatcttcagcagcatgcg

SEQ ID NO: 347181 - DNA, 25 bp, Mus musculus
tacggctgacgacagcggctgatcc

SEQ ID NO: 347182 - DNA, 25 bp, Mus musculus
tcaccgccagcctggagtgcgtcaa

SEQ ID NO: 347183 - DNA, 25 bp, Mus musculus
cggtggccaagtcccacagcttctt

SEQ ID NO: 347184 - DNA, 25 bp, Mus musculus
cccacgacggactagccgaggtgtt

SEQ ID NO: 347185 - DNA, 25 bp, Mus musculus
gggcaccatgcccagcatttttggg

SEQ ID NO: 347186 - DNA, 25 bp, Mus musculus
aaggctgcgttcaagttattcaaga

SEQ ID NO: 347187 - DNA, 25 bp, Mus musculus
ccgtcggggaagatcaataaggctg

SEQ ID NO: 347188 - DNA, 25 bp, Mus musculus
actcgcattgtgagtgcgccgcgga

SEQ ID NO: 347189 - DNA, 25 bp, Mus musculus
tcgctgcagacatggactcgcattg

SEQ ID NO: 347190 - DNA, 25 bp, Mus musculus
cggctgatcccactcggtttccatg

SEQ ID NO: 347191 - DNA, 25 bp, Mus musculus
cggctctggcgatcaaagctcccgg

SEQ ID NO: 347192 - DNA, 25 bp, Mus musculus
tgaccagacgcgcacagaaacccag

SEQ ID NO: 347193 - DNA, 25 bp, Mus musculus
cagggatactgaccagacgcgcaca

SEQ ID NO: 347194 - DNA, 25 bp, Mus musculus
cgggccgcagggatactgaccagac

SEQ ID NO: 347195 - DNA, 25 bp, Mus musculus
cactatcaggcaagcggtgctggcc

SEQ ID NO: 347196 - DNA, 25 bp, Mus musculus
atggccactatcaggcaagcggtgc

SEQ ID NO: 347197 - DNA, 25 bp, Mus musculus
ttctcctgtcagatggccactatca

SEQ ID NO: 347198 - DNA, 25 bp, Mus musculus
agcgagttctcctgtcagatggcca

SEQ ID NO: 347199 - DNA, 25 bp, Mus musculus
cgtctcatcaggtgagcgagttctc

SEQ ID NO: 347200 - DNA, 25 bp, Mus musculus
ccgagacgtctcatcaggtgagcga

SEQ ID NO: 347201 - DNA, 25 bp, Mus musculus
tgagtccatcccgagacgtctcatc

SEQ ID NO: 347202 - DNA, 25 bp, Mus musculus
gagctggggcgcctgagtccatccc

SEQ ID NO: 347203 - DNA, 25 bp, Mus musculus
aggctaggacatgtgctcgagagct

SEQ ID NO: 347204 - DNA, 25 bp, Mus musculus
tggacctgctatcgcgacccggtgc

SEQ ID NO: 347205 - DNA, 25 bp, Mus musculus
tcgtggacctgctatcgcgacccgg

SEQ ID NO: 347206 - DNA, 25 bp, Mus musculus
ctgctctttcttggaggccacggcg

SEQ ID NO: 347207 - DNA, 25 bp, Mus musculus
agcgcctctgtgacccaagggtgcc

SEQ ID NO: 347208 - DNA, 25 bp, Mus musculus
acctcttggacacgctggctttgga

SEQ ID NO: 347209 - DNA, 25 bp, Mus musculus
gaccgtcgaggtgaggctacccaga

SEQ ID NO: 347210 - DNA, 25 bp, Mus musculus
gctacccagagaggcgcaaggctct

SEQ ID NO: 347211 - DNA, 25 bp, Mus musculus
tgcgccaggacgacggacaaaggtt

SEQ ID NO: 347212 - DNA, 25 bp, Mus musculus
agggattaccctgaaactctatcta

SEQ ID NO: 347213 - DNA, 25 bp, Mus musculus
cggaggaactgagcgcctctgtgac

SEQ ID NO: 347214 - DNA, 25 bp, Mus musculus
ctgggcagcaggacctcttggacac

SEQ ID NO: 347215 - DNA, 25 bp, Mus musculus
tgtgctgttcttgccggtgcctttc

SEQ ID NO: 347216 - DNA, 25 bp, Mus musculus
gcggaatcagcgctgctctttcttg

SEQ ID NO: 347217 - DNA, 25 bp, Mus musculus
agctcctgcttgtggctcgtgggac

SEQ ID NO: 347218 - DNA, 25 bp, Mus musculus
gacggactgggactgctcacctgtt

SEQ ID NO: 347219 - DNA, 25 bp, Mus musculus
tgctcacctgttgcgccaccgtgag

SEQ ID NO: 347220 - DNA, 25 bp, Mus musculus
ggagggcgacgctcttcctaacgat

SEQ ID NO: 347221 - DNA, 25 bp, Mus musculus
gcgacgctcttcctaacgattgtta

SEQ ID NO: 347222 - DNA, 25 bp, Mus musculus
taacgattgttagcgtgctcaagtc

SEQ ID NO: 347223 - DNA, 25 bp, Mus musculus
cgctacgaaactggagctgctcaga

SEQ ID NO: 347224 - DNA, 25 bp, Mus musculus
acacgagggcgctacgaaactggag

SEQ ID NO: 347225 - DNA, 25 bp, Mus musculus
ttgttagcgtgctcaagtccgggtc

SEQ ID NO: 347226 - DNA, 25 bp, Mus musculus
ggactgtgccgggataagcgcaccc

SEQ ID NO: 347227 - DNA, 25 bp, Mus musculus
ccgggacgtcagtactagctggtcc

SEQ ID NO: 347228 - DNA, 25 bp, Mus musculus
cgtctggctgaaaagggactgtgcc

SEQ ID NO: 347229 - DNA, 25 bp, Mus musculus
agctgcgcccgggacgtcagtacta

SEQ ID NO: 347230 - DNA, 25 bp, Mus musculus
gtctgccctgcgagttccgcggcgt

SEQ ID NO: 347231 - DNA, 25 bp, Mus musculus
gctcaagtccgggtctgccctgcga

SEQ ID NO: 347232 - DNA, 25 bp, Mus musculus
ctccgcgtctggctgaaaagggact

SEQ ID NO: 347233 - DNA, 25 bp, Mus musculus
cagagccacctatggaacctgttgg

SEQ ID NO: 347234 - DNA, 25 bp, Mus musculus
gcttctagcacgtgcgcctcggcaa

SEQ ID NO: 347235 - DNA, 25 bp, Mus musculus
cggcgccggactgcagtttgaggct

SEQ ID NO: 347236 - DNA, 25 bp, Mus musculus
cagaggcacctaccttccccttgtc

SEQ ID NO: 347237 - DNA, 25 bp, Mus musculus
cggcaccaggctgcaccggaatccc

SEQ ID NO: 347238 - DNA, 25 bp, Mus musculus
gccctgccgccactcttctctgtag

SEQ ID NO: 347239 - DNA, 25 bp, Mus musculus
tgccgccactcttctctgtagcccg

SEQ ID NO: 347240 - DNA, 25 bp, Mus musculus
actcttctctgtagcccggcaaccg

SEQ ID NO: 347241 - DNA, 25 bp, Mus musculus
ctgtagcccggcaaccgctgcagct

SEQ ID NO: 347242 - DNA, 25 bp, Mus musculus
tctggtccccttgcagaggcaccta

SEQ ID NO: 347243 - DNA, 25 bp, Mus musculus
cctggggctatctggtccccttgca

SEQ ID NO: 347244 - DNA, 25 bp, Mus musculus
cttggctccgatcccctggggctat

SEQ ID NO: 347245 - DNA, 25 bp, Mus musculus
aggcagccgcctccccttggctccg

SEQ ID NO: 347246 - DNA, 25 bp, Mus musculus
gtgcgcctcggcaacgagccctccc

SEQ ID NO: 347247 - DNA, 25 bp, Mus musculus
tagcacgtgcgcctcggcaacgagc

SEQ ID NO: 347248 - DNA, 25 bp, Mus musculus
cgcatccctttcatctcgctgagtg

SEQ ID NO: 347249 - DNA, 25 bp, Mus musculus
ttccgcagcttggtagcacttccgc

SEQ ID NO: 347250 - DNA, 25 bp, Mus musculus
gcggctggatctgcagctctctctc

SEQ ID NO: 347251 - DNA, 25 bp, Mus musculus
ctagaaagttcgctaccgtctggtt

SEQ ID NO: 347252 - DNA, 25 bp, Mus musculus
tgagtttactcgctacgcgcgcaga

SEQ ID NO: 347253 - DNA, 25 bp, Mus musculus
gtgctgtgctccagactcacgcttt

SEQ ID NO: 347254 - DNA, 25 bp, Mus musculus
cgcatcaaaggcaaggctgagttta

SEQ ID NO: 347255 - DNA, 25 bp, Mus musculus
agcctgatttctagtcgcgttggtc

SEQ ID NO: 347256 - DNA, 25 bp, Mus musculus
cgccgatcagttgctgcgcatcaaa

SEQ ID NO: 347257 - DNA, 25 bp, Mus musculus
gtgcctgtaatctgatcgccgatca

SEQ ID NO: 347258 - DNA, 25 bp, Mus musculus
ggaaaatggattacccgcgcagatc

SEQ ID NO: 347259 - DNA, 25 bp, Mus musculus
ggcgcaagcccagacaaacttcaaa

SEQ ID NO: 347260 - DNA, 25 bp, Mus musculus
ccaaaaatgtgtgtgggcgcaagcc

SEQ ID NO: 347261 - DNA, 25 bp, Mus musculus
ccgggagaagccagtcagcctgatt

SEQ ID NO: 347262 - DNA, 25 bp, Mus musculus
ggggcctgaggctcctccaagaaca

SEQ ID NO: 347263 - DNA, 25 bp, Mus musculus
gcgggacgtgagtctcctcagaaca

SEQ ID NO: 347264 - DNA, 25 bp, Mus musculus
ggtccgtcctttgccatccacgaga

SEQ ID NO: 347265 - DNA, 25 bp, Mus musculus
cctccaagaacagtagcggccctta

SEQ ID NO: 347266 - DNA, 25 bp, Mus musculus
ggctgctccgcagataacggtccca

SEQ ID NO: 347267 - DNA, 25 bp, Mus musculus
ggcgacgcctacatggccctttgca

SEQ ID NO: 347268 - DNA, 25 bp, Mus musculus
gtacaggcctctgccatgaggatcc

SEQ ID NO: 347269 - DNA, 25 bp, Mus musculus
gtccgtccctttgcctgtcgcaggt

SEQ ID NO: 347270 - DNA, 25 bp, Mus musculus
cgggacctcaaggagcgcatcttcg

SEQ ID NO: 347271 - DNA, 25 bp, Mus musculus
cgcatcttcgctgagaccagctttc

SEQ ID NO: 347272 - DNA, 25 bp, Mus musculus
agcgccaggcctgccttcttagatg

SEQ ID NO: 347273 - DNA, 25 bp, Mus musculus
gccttcttagatgggcgcagtcgcc

SEQ ID NO: 347274 - DNA, 25 bp, Mus musculus
gcctactggcggcaggaaattcacc

SEQ ID NO: 347275 - DNA, 25 bp, Mus musculus
ctcctcagaacaaccgcagtgtgcg

SEQ ID NO: 347276 - DNA, 25 bp, Mus musculus
ccagaaggattagattcgacagggc

SEQ ID NO: 347277 - DNA, 25 bp, Mus musculus
gcatttcccagaaggattagattcg

SEQ ID NO: 347278 - DNA, 25 bp, Mus musculus
accaagattcgcgagtggataaagg

SEQ ID NO: 347279 - DNA, 25 bp, Mus musculus
tggataaaggggaacccgcgtctgc

SEQ ID NO: 347280 - DNA, 25 bp, Mus musculus
gcatgcacgcgtacgcacgcacgtg

SEQ ID NO: 347281 - DNA, 25 bp, Mus musculus
gcgtacgcacgcacgtggctgtctc

SEQ ID NO: 347282 - DNA, 25 bp, Mus musculus
aggccagataatgcagaggactgca

SEQ ID NO: 347283 - DNA, 25 bp, Mus musculus
ggcggaaacgcatgtctcggttgtc

SEQ ID NO: 347284 - DNA, 25 bp, Mus musculus
atgtctcggttgtccgtgttgcgca

SEQ ID NO: 347285 - DNA, 25 bp, Mus musculus
ccgcgcgccttctgaaggccagata

SEQ ID NO: 347286 - DNA, 25 bp, Mus musculus
agagctctgcgtccctctcgcaagc

SEQ ID NO: 347287 - DNA, 25 bp, Mus musculus
catgaacagcgcgggcgccgacgaa

SEQ ID NO: 347288 - DNA, 25 bp, Mus musculus
cgccgacgaaatcgggtgaggctgt

SEQ ID NO: 347289 - DNA, 25 bp, Mus musculus
tcgacagggcggaaacgcatgtctc

SEQ ID NO: 347290 - DNA, 25 bp, Mus musculus
tctaagtccctgcagtgctcacggc

SEQ ID NO: 347291 - DNA, 25 bp, Mus musculus
ccctccacgtggatgctgcgtgtgg

SEQ ID NO: 347292 - DNA, 25 bp, Mus musculus
tgacctccacgctcctctaagtccc

SEQ ID NO: 347293 - DNA, 25 bp, Mus musculus
cactctttttctgacctccacgctc

SEQ ID NO: 347294 - DNA, 25 bp, Mus musculus
gtagcgggacccatcactctttttc

SEQ ID NO: 347295 - DNA, 25 bp, Mus musculus
tcacaagtaagtagcgggacccatc

SEQ ID NO: 347296 - DNA, 25 bp, Mus musculus
tccggcagtcgtcacaagtaagtag

SEQ ID NO: 347297 - DNA, 25 bp, Mus musculus
tgcacaccctgggaatccggcagtc

SEQ ID NO: 347298 - DNA, 25 bp, Mus musculus
gggatcactgcacaccctgggaatc

SEQ ID NO: 347299 - DNA, 25 bp, Mus musculus
gggagaaggggatcactgcacaccc

SEQ ID NO: 347300 - DNA, 25 bp, Mus musculus
attctggtcacagctttcccagggc

SEQ ID NO: 347301 - DNA, 25 bp, Mus musculus
cgggcgcacacatcccggggattct

SEQ ID NO: 347302 - DNA, 25 bp, Mus musculus
gggaatccggcagtcgtcacaagta

SEQ ID NO: 347303 - DNA, 25 bp, Mus musculus
atcccggggattctggtcacagctt

SEQ ID NO: 347304 - DNA, 25 bp, Mus musculus
gggagcctgcgagctagcctcttgt

SEQ ID NO: 347305 - DNA, 25 bp, Mus musculus
gacggggcgacacttaccagcacaa

SEQ ID NO: 347306 - DNA, 25 bp, Mus musculus
tgaaccagtgagtcgtagcagagcc

SEQ ID NO: 347307 - DNA, 25 bp, Mus musculus
ccagtgagtcgtagcagagccaggc

SEQ ID NO: 347308 - DNA, 25 bp, Mus musculus
agagccaggcgagcacccaacgctc

SEQ ID NO: 347309 - DNA, 25 bp, Mus musculus
ggccagcagcgctgagcacaacagc

SEQ ID NO: 347310 - DNA, 25 bp, Mus musculus
gcagcgctgagcacaacagcaagga

SEQ ID NO: 347311 - DNA, 25 bp, Mus musculus
tgagcacaacagcaaggaggagcct

SEQ ID NO: 347312 - DNA, 25 bp, Mus musculus
cacagcacaccacggcgagcgggga

SEQ ID NO: 347313 - DNA, 25 bp, Mus musculus
ctagcctcttgtgggcggagcttct

SEQ ID NO: 347314 - DNA, 25 bp, Mus musculus
gcacaaagtgaaccagtgagtcgta

SEQ ID NO: 347315 - DNA, 25 bp, Mus musculus
cttaccagcacaaagtgaaccagtg

SEQ ID NO: 347316 - DNA, 25 bp, Mus musculus
aaggaggagcctgcctccgggccca

SEQ ID NO: 347317 - DNA, 25 bp, Mus musculus
gggcgacacttaccagcacaaagtg

SEQ ID NO: 347318 - DNA, 25 bp, Mus musculus
atggagcccgacctagtcgctttta

SEQ ID NO: 347319 - DNA, 25 bp, Mus musculus
tgtgctagaaatggagcccgaccta

SEQ ID NO: 347320 - DNA, 25 bp, Mus musculus
ccacagccgctagtcatgtgctaga

SEQ ID NO: 347321 - DNA, 25 bp, Mus musculus
ctccaagccggggttctcggccatg

SEQ ID NO: 347322 - DNA, 25 bp, Mus musculus
cttgatgcggtggttctccaagccg

SEQ ID NO: 347323 - DNA, 25 bp, Mus musculus
atcgcggcccttgttcttgaagctc

SEQ ID NO: 347324 - DNA, 25 bp, Mus musculus
gctccctacagcttggaaaattaga

SEQ ID NO: 347325 - DNA, 25 bp, Mus musculus
cttgaagctcttgatgcggtggttc

SEQ ID NO: 347326 - DNA, 25 bp, Mus musculus
ttagaaaaagaacggccacgcgtgc

SEQ ID NO: 347327 - DNA, 25 bp, Mus musculus
cacgccgtgagaggacgagaagcat

SEQ ID NO: 347328 - DNA, 25 bp, Mus musculus
tggagatggcaccttgcggcctatc

SEQ ID NO: 347329 - DNA, 25 bp, Mus musculus
accttgcggcctatcgggagagaga

SEQ ID NO: 347330 - DNA, 25 bp, Mus musculus
ttcccagcatgccaggcgcgggtct

SEQ ID NO: 347331 - DNA, 25 bp, Mus musculus
tagtcgcttttaccgccaccgctga

SEQ ID NO: 347332 - DNA, 25 bp, Mus musculus
gcccgggcttgactgactgaaagag

SEQ ID NO: 347333 - DNA, 25 bp, Mus musculus
cgcattttccatgcaccggcgttta

SEQ ID NO: 347334 - DNA, 25 bp, Mus musculus
tgcggcgaggctcttcgcattttcc

SEQ ID NO: 347335 - DNA, 25 bp, Mus musculus
acctcctttgggcatggagctaata

SEQ ID NO: 347336 - DNA, 25 bp, Mus musculus
tttagggatcggcagacctcctttg

SEQ ID NO: 347337 - DNA, 25 bp, Mus musculus
gcggctccgcagtgatttttaggga

SEQ ID NO: 347338 - DNA, 25 bp, Mus musculus
agcctccgtagtagctccgtgctgt

SEQ ID NO: 347339 - DNA, 25 bp, Mus musculus
ttgttgctggtttgacagggccttc

SEQ ID NO: 347340 - DNA, 25 bp, Mus musculus
cagcggccagcccaagtcaaagagg

SEQ ID NO: 347341 - DNA, 25 bp, Mus musculus
gcggccatggcgtagctacacagcc

SEQ ID NO: 347342 - DNA, 25 bp, Mus musculus
gtgtccaactgtacggccggcatct

SEQ ID NO: 347343 - DNA, 25 bp, Mus musculus
tacccatgtgctgcgtgtccaactg

SEQ ID NO: 347344 - DNA, 25 bp, Mus musculus
gctgtttatagggtctggaactcca

SEQ ID NO: 347345 - DNA, 25 bp, Mus musculus
cggccggcatctccttgagaggaat

SEQ ID NO: 347346 - DNA, 25 bp, Mus musculus
gtgtccattttgcaccggcgcagcc

SEQ ID NO: 347347 - DNA, 25 bp, Mus musculus
ggcgtcaccagagcacttatccaga

SEQ ID NO: 347348 - DNA, 25 bp, Mus musculus
cgtcaccagagcacttatccagagg

SEQ ID NO: 347349 - DNA, 25 bp, Mus musculus
caccagagcacttatccagaggctg

SEQ ID NO: 347350 - DNA, 25 bp, Mus musculus
cagagcacttatccagaggctgggc

SEQ ID NO: 347351 - DNA, 25 bp, Mus musculus
agcacttatccagaggctgggcgac

SEQ ID NO: 347352 - DNA, 25 bp, Mus musculus
gctgggcgacctaggtggtgcgcag

SEQ ID NO: 347353 - DNA, 25 bp, Mus musculus
tactgtcgcggtcgggaaggtcagc

SEQ ID NO: 347354 - DNA, 25 bp, Mus musculus
cgtggtcgccgtgtccattttgcac

SEQ ID NO: 347355 - DNA, 25 bp, Mus musculus
cggcagcggtgctactgtcgcggtc

SEQ ID NO: 347356 - DNA, 25 bp, Mus musculus
cgtgtccattttgcaccggcgcagc

SEQ ID NO: 347357 - DNA, 25 bp, Mus musculus
tgagcagtgtgctccgagtagggac

SEQ ID NO: 347358 - DNA, 25 bp, Mus musculus
gtgggcgtcaccagagcacttatcc

SEQ ID NO: 347359 - DNA, 25 bp, Mus musculus
ggtcgccgtgtccattttgcaccgg

SEQ ID NO: 347360 - DNA, 25 bp, Mus musculus
ccacaactttcaggagcatggactg

SEQ ID NO: 347361 - DNA, 25 bp, Mus musculus
cctgcctttctcttttcgatgtgcg

SEQ ID NO: 347362 - DNA, 25 bp, Mus musculus
cctcgctcggaagcaagaacttatt

SEQ ID NO: 347363 - DNA, 25 bp, Mus musculus
cgagccgtgaaagcctccaggctta

SEQ ID NO: 347364 - DNA, 25 bp, Mus musculus
ctagcttggctttgcattcccggtc

SEQ ID NO: 347365 - DNA, 25 bp, Mus musculus
cctccgagaggatcgtccctagctt

SEQ ID NO: 347366 - DNA, 25 bp, Mus musculus
tgtctgagcggaaagcagcccttct

SEQ ID NO: 347367 - DNA, 25 bp, Mus musculus
tgagatcctttgtgtttccctgcgc

SEQ ID NO: 347368 - DNA, 25 bp, Mus musculus
tgcttcattatgtggtgtgcttccc

SEQ ID NO: 347369 - DNA, 25 bp, Mus musculus
cctgtatggaggcatggccagtttc

SEQ ID NO: 347370 - DNA, 25 bp, Mus musculus
cgttttcggacatgcggaggttact

SEQ ID NO: 347371 - DNA, 25 bp, Mus musculus
actggaaccgtgttggtggattttg

SEQ ID NO: 347372 - DNA, 25 bp, Mus musculus
tgccaggatccatgctcacatgtta

SEQ ID NO: 347373 - DNA, 25 bp, Mus musculus
gcgctgccgactcaacttggggctc

SEQ ID NO: 347374 - DNA, 25 bp, Mus musculus
ggacacccaacttacagcaaccgga

SEQ ID NO: 347375 - DNA, 25 bp, Mus musculus
cccgcttcgctacttgaggctctta

SEQ ID NO: 347376 - DNA, 25 bp, Mus musculus
gaggctcttaccgactgcgccgcat

SEQ ID NO: 347377 - DNA, 25 bp, Mus musculus
ccgactgccctctgctctaagttaa

SEQ ID NO: 347378 - DNA, 25 bp, Mus musculus
gattttccggcgtgatcctagcgtc

SEQ ID NO: 347379 - DNA, 25 bp, Mus musculus
ctaggctcggacaggttatcccttc

SEQ ID NO: 347380 - DNA, 25 bp, Mus musculus
ggtggtcagctttcggacactactc

SEQ ID NO: 347381 - DNA, 25 bp, Mus musculus
cgccgaaagcgctgagactcctcat

SEQ ID NO: 347382 - DNA, 25 bp, Mus musculus
gcgacccaagtttcccggcaggaga

SEQ ID NO: 347383 - DNA, 25 bp, Mus musculus
tgagatcaggcatcactcgaaaatg

SEQ ID NO: 347384 - DNA, 25 bp, Mus musculus
ctccggtgacacactagtgatgaaa

SEQ ID NO: 347385 - DNA, 25 bp, Mus musculus
ccctcccgctagattgatgagatca

SEQ ID NO: 347386 - DNA, 25 bp, Mus musculus
cctgctgcgcatgcggaaacttcta

SEQ ID NO: 347387 - DNA, 25 bp, Mus musculus
gtggcgcaaggctctctacttcctc

SEQ ID NO: 347388 - DNA, 25 bp, Mus musculus
acctgtcagcgacggaggaagaccc

SEQ ID NO: 347389 - DNA, 25 bp, Mus musculus
ttgcgtcaacattgcgaaaagaaga

SEQ ID NO: 347390 - DNA, 25 bp, Mus musculus
tcttcgctccgtgcacgccggggtt

SEQ ID NO: 347391 - DNA, 25 bp, Mus musculus
cacgccggggttacagctttgcttt

SEQ ID NO: 347392 - DNA, 25 bp, Mus musculus
tcgctgctgctcctcgttctatttc

SEQ ID NO: 347393 - DNA, 25 bp, Mus musculus
ttcccttctaaaagtggaggctgga

SEQ ID NO: 347394 - DNA, 25 bp, Mus musculus
gggagaaaagcagcctagagtcgaa

SEQ ID NO: 347395 - DNA, 25 bp, Mus musculus
gcacacgacctaagtacacagcgcg

SEQ ID NO: 347396 - DNA, 25 bp, Mus musculus
ctcgattttttgtgcagtttcagca

SEQ ID NO: 347397 - DNA, 25 bp, Mus musculus
tttgtgcagtttcagcaaagctccg

SEQ ID NO: 347398 - DNA, 25 bp, Mus musculus
agctccgaggaagttggtccttttg

SEQ ID NO: 347399 - DNA, 25 bp, Mus musculus
ccactatttatagattgcgtcaaca

SEQ ID NO: 347400 - DNA, 25 bp, Mus musculus
gtcacgtgccctctcgggaaaacca

SEQ ID NO: 347401 - DNA, 25 bp, Mus musculus
tgcgcactgacctgtcagcgacgga

SEQ ID NO: 347402 - DNA, 25 bp, Mus musculus
gtacataggggtccaactcggtcgc

SEQ ID NO: 347403 - DNA, 25 bp, Mus musculus
gcgtcagcgtgaccaggatatattc

SEQ ID NO: 347404 - DNA, 25 bp, Mus musculus
catgggaagttcagagcagcacgtc

SEQ ID NO: 347405 - DNA, 25 bp, Mus musculus
cagcacgtctgcttcgcaattgggg

SEQ ID NO: 347406 - DNA, 25 bp, Mus musculus
ccgaaacgcttgagtcattctggga

SEQ ID NO: 347407 - DNA, 25 bp, Mus musculus
ctccttgcgggagaatcctggatcc

SEQ ID NO: 347408 - DNA, 25 bp, Mus musculus
cctggatccctgtgtctagttcaaa

SEQ ID NO: 347409 - DNA, 25 bp, Mus musculus
cagtgtccttacctccctgtttggc

SEQ ID NO: 347410 - DNA, 25 bp, Mus musculus
agctcacgatgacttgcgacccgtc

SEQ ID NO: 347411 - DNA, 25 bp, Mus musculus
ctgagatttgagctcggccctgaac

SEQ ID NO: 347412 - DNA, 25 bp, Mus musculus
cccggattgccttcgtagagctttc

SEQ ID NO: 347413 - DNA, 25 bp, Mus musculus
gagctttcccatttgagtacatagg

SEQ ID NO: 347414 - DNA, 25 bp, Mus musculus
tcgcgtctgcccgaactgacagtgt

SEQ ID NO: 347415 - DNA, 25 bp, Mus musculus
tgctccgcagccatgcaggtatccg

SEQ ID NO: 347416 - DNA, 25 bp, Mus musculus
tccgaggtcgagtccaccacccgag

SEQ ID NO: 347417 - DNA, 25 bp, Mus musculus
cccactcctgctgtagtagctgcag

SEQ ID NO: 347418 - DNA, 25 bp, Mus musculus
gtccaccacccgagccagagcgctg

SEQ ID NO: 347419 - DNA, 25 bp, Mus musculus
tccttggggcgctaggaccgtcgcc

SEQ ID NO: 347420 - DNA, 25 bp, Mus musculus
gcaggcaaaggagcctggcggcgtt

SEQ ID NO: 347421 - DNA, 25 bp, Mus musculus
gcgctgacgagcaggtggagcgcag

SEQ ID NO: 347422 - DNA, 25 bp, Mus musculus
catagccggctagcagctgggcgct

SEQ ID NO: 347423 - DNA, 25 bp, Mus musculus
gctgatggaagccactaagggcgca

SEQ ID NO: 347424 - DNA, 25 bp, Mus musculus
ccaccatttggtggctgatggaagc

SEQ ID NO: 347425 - DNA, 25 bp, Mus musculus
cgcagctggcctgggcgacgagctt

SEQ ID NO: 347426 - DNA, 25 bp, Mus musculus
ctcctgctgtagtagctgcagggtc

SEQ ID NO: 347427 - DNA, 25 bp, Mus musculus
atccgcgccaaggtacagggcccgc

SEQ ID NO: 347428 - DNA, 25 bp, Mus musculus
gcgcatcgccatccgcgccaaggta

SEQ ID NO: 347429 - DNA, 25 bp, Mus musculus
agccagagcgctgcgcatcgccatc

SEQ ID NO: 347430 - DNA, 25 bp, Mus musculus
tcacgcaggccgaagtggagcagaa

SEQ ID NO: 347431 - DNA, 25 bp, Mus musculus
tcccggcagagctcgcgataactgc

SEQ ID NO: 347432 - DNA, 25 bp, Mus musculus
ccttttccgagtaaccgccaagatg

SEQ ID NO: 347433 - DNA, 25 bp, Mus musculus
ccgccaagatggtgagtattcgtgc

SEQ ID NO: 347434 - DNA, 25 bp, Mus musculus
agtattcgtgcacggcggtctgtgc

SEQ ID NO: 347435 - DNA, 25 bp, Mus musculus
tgtgctcccgggtatccgtcgccat

SEQ ID NO: 347436 - DNA, 25 bp, Mus musculus
gggccctttcgcaagactctggact

SEQ ID NO: 347437 - DNA, 25 bp, Mus musculus
cgtccgccgtagcttagaggagcgc

SEQ ID NO: 347438 - DNA, 25 bp, Mus musculus
cgcttttgctctggcctccggacag

SEQ ID NO: 347439 - DNA, 25 bp, Mus musculus
ccgcaagttcacctaccgtggcgta

SEQ ID NO: 347440 - DNA, 25 bp, Mus musculus
tggcgtagacctcgaccaactgctc

SEQ ID NO: 347441 - DNA, 25 bp, Mus musculus
ctcgacatgtcctagtaagaggccc

SEQ ID NO: 347442 - DNA, 25 bp, Mus musculus
gcaagactctggactcgctgcctgg

SEQ ID NO: 347443 - DNA, 25 bp, Mus musculus
caatggcgagtatccgcagagcgga

SEQ ID NO: 347444 - DNA, 25 bp, Mus musculus
cgcgctttgctaagcatcctggtca

SEQ ID NO: 347445 - DNA, 25 bp, Mus musculus
tgtatgaaatacacgcacgagcagc

SEQ ID NO: 347446 - DNA, 25 bp, Mus musculus
cacgcacgagcagcgcccgtagaat

SEQ ID NO: 347447 - DNA, 25 bp, Mus musculus
tgagaaaaacgaggagctccacacc

SEQ ID NO: 347448 - DNA, 25 bp, Mus musculus
cggccaggcagctagtgttcctact

SEQ ID NO: 347449 - DNA, 25 bp, Mus musculus
gctagtgttcctacttccaggtaaa

SEQ ID NO: 347450 - DNA, 25 bp, Mus musculus
cagggcccgcgcagatttcaaaaaa

SEQ ID NO: 347451 - DNA, 25 bp, Mus musculus
gctcgcccgcattaggaacctcaat

SEQ ID NO: 347452 - DNA, 25 bp, Mus musculus
cgcaaggtcctagcgagcgcggacc

SEQ ID NO: 347453 - DNA, 25 bp, Mus musculus
cgcccgtagaatgagagtgagaaaa

SEQ ID NO: 347454 - DNA, 25 bp, Mus musculus
agcatcctggtcacgtgtcacaaca

SEQ ID NO: 347455 - DNA, 25 bp, Mus musculus
cgtgtcacaacacgcgggaaaactc

SEQ ID NO: 347456 - DNA, 25 bp, Mus musculus
aacccggaagcgacggcagcgtttg

SEQ ID NO: 347457 - DNA, 25 bp, Mus musculus
agcaccggtccgcaaggtcctagcg

SEQ ID NO: 347458 - DNA, 25 bp, Mus musculus
gagctcagtacttgcgctcgggagc

SEQ ID NO: 347459 - DNA, 25 bp, Mus musculus
aggcgggttgcaagataaatactgc

SEQ ID NO: 347460 - DNA, 25 bp, Mus musculus
agataaatactgcacgcccactgca

SEQ ID NO: 347461 - DNA, 25 bp, Mus musculus
cgcccactgcactccacgcccactg

SEQ ID NO: 347462 - DNA, 25 bp, Mus musculus
cactgcactcctcgctcatggagag

SEQ ID NO: 347463 - DNA, 25 bp, Mus musculus
tcctcgctcatggagagagtccatc

SEQ ID NO: 347464 - DNA, 25 bp, Mus musculus
gcgctcgtgcacacgcgcgcatccc

SEQ ID NO: 347465 - DNA, 25 bp, Mus musculus
gcgcatcccgtgcacccgctcggat

SEQ ID NO: 347466 - DNA, 25 bp, Mus musculus
tcggatcctcgcctggtggcacccg

SEQ ID NO: 347467 - DNA, 25 bp, Mus musculus
ggcacgcgcgccatgaacccgaagg

SEQ ID NO: 347468 - DNA, 25 bp, Mus musculus
acgcgcgccatgaacccgaaggcgg

SEQ ID NO: 347469 - DNA, 25 bp, Mus musculus
actgcgtggactctggcgccgagac

SEQ ID NO: 347470 - DNA, 25 bp, Mus musculus
gcacagcgctggcatgcaccaggcg

SEQ ID NO: 347471 - DNA, 25 bp, Mus musculus
caccaggcgggttgcaagataaata

SEQ ID NO: 347472 - DNA, 25 bp, Mus musculus
gcatattcaaacagctcaggggcgg

SEQ ID NO: 347473 - DNA, 25 bp, Mus musculus
acgtactcgggtcatgtgatccaca

SEQ ID NO: 347474 - DNA, 25 bp, Mus musculus
gcccagatggctgcgctggttcata

SEQ ID NO: 347475 - DNA, 25 bp, Mus musculus
ccactgccctattggctggtcctta

SEQ ID NO: 347476 - DNA, 25 bp, Mus musculus
ggtccttacagcctcattagcatat

SEQ ID NO: 347477 - DNA, 25 bp, Mus musculus
ccgagaggacagttattgagcacgc

SEQ ID NO: 347478 - DNA, 25 bp, Mus musculus
tcacactccggttttaactcgggca

SEQ ID NO: 347479 - DNA, 25 bp, Mus musculus
agaagtttgagagactccctccgca

SEQ ID NO: 347480 - DNA, 25 bp, Mus musculus
aacaccagctatggggagtttctcc

SEQ ID NO: 347481 - DNA, 25 bp, Mus musculus
cccgggaggaaaacaccagctatgg

SEQ ID NO: 347482 - DNA, 25 bp, Mus musculus
ctgggttagtcggtaccttcatgaa

SEQ ID NO: 347483 - DNA, 25 bp, Mus musculus
gctggttcatagaggcagacgtgtc

SEQ ID NO: 347484 - DNA, 25 bp, Mus musculus
tgaaggtctctaccgcgcctttggc

SEQ ID NO: 347485 - DNA, 25 bp, Mus musculus
gcagacgtgtctatcaggaacagta

SEQ ID NO: 347486 - DNA, 25 bp, Mus musculus
ggtgctggcaagagccgtttctcta

SEQ ID NO: 347487 - DNA, 25 bp, Mus musculus
caacatggcggtgattgtacctaaa

SEQ ID NO: 347488 - DNA, 25 bp, Mus musculus
cttagcggtgagtcatctgcgcgca

SEQ ID NO: 347489 - DNA, 25 bp, Mus musculus
cacgtcccaactagtttagcctcta

SEQ ID NO: 347490 - DNA, 25 bp, Mus musculus
atccttcctgcaggcgcttttccgg

SEQ ID NO: 347491 - DNA, 25 bp, Mus musculus
tgggcacgcgcattcacagattttt

SEQ ID NO: 347492 - DNA, 25 bp, Mus musculus
ctgctagtgcccatcctccggaagt

SEQ ID NO: 347493 - DNA, 25 bp, Mus musculus
cacagcgccctctccggtgtgttat

SEQ ID NO: 347494 - DNA, 25 bp, Mus musculus
tttggaagccagagcgggcacattc

SEQ ID NO: 347495 - DNA, 25 bp, Mus musculus
tcatcagcgtctcggaggacaggta

SEQ ID NO: 347496 - DNA, 25 bp, Mus musculus
tgagcgttctcttcagccaagtccc

SEQ ID NO: 347497 - DNA, 25 bp, Mus musculus
tcctgagcgcaagcctgagcgttct

SEQ ID NO: 347498 - DNA, 25 bp, Mus musculus
cctactctcttaggtggcgccggct

SEQ ID NO: 347499 - DNA, 25 bp, Mus musculus
agggtagaccgcacctactggttca

SEQ ID NO: 347500 - DNA, 25 bp, Mus musculus
ggtgatcggcttctttccagtggcc

SEQ ID NO: 347501 - DNA, 25 bp, Mus musculus
ctccatggcggaagtcactttggct

SEQ ID NO: 347502 - DNA, 25 bp, Mus musculus
ctttcacgctttagggccgagcctg

SEQ ID NO: 347503 - DNA, 25 bp, Mus musculus
agagctccagctttcacgctttagg

SEQ ID NO: 347504 - DNA, 25 bp, Mus musculus
gctagaccggcagagctccagcttt

SEQ ID NO: 347505 - DNA, 25 bp, Mus musculus
cggtcttaggctcccgcaggctaga

SEQ ID NO: 347506 - DNA, 25 bp, Mus musculus
tccagtggccttggcgcacttcaag

SEQ ID NO: 347507 - DNA, 25 bp, Mus musculus
acagtggctccatggcggaagtcac

SEQ ID NO: 347508 - DNA, 25 bp, Mus musculus
tttgcccggggcacagtggctccat

SEQ ID NO: 347509 - DNA, 25 bp, Mus musculus
tcgcgctgcgctcggtgagtttgcc

SEQ ID NO: 347510 - DNA, 25 bp, Mus musculus
tcaagcatcacgtgacgaatcagcc

SEQ ID NO: 347511 - DNA, 25 bp, Mus musculus
ggcgcggtcaagcatcacgtgacga

SEQ ID NO: 347512 - DNA, 25 bp, Mus musculus
cggatcgcggtcttaggctcccgca

SEQ ID NO: 347513 - DNA, 25 bp, Mus musculus
ctagatgctgctcgccctggcggat

SEQ ID NO: 347514 - DNA, 25 bp, Mus musculus
agctgctcgcaccaggaaaacgtta

SEQ ID NO: 347515 - DNA, 25 bp, Mus musculus
ttatagaactcctccgggtggccta

SEQ ID NO: 347516 - DNA, 25 bp, Mus musculus
cagcagagagcctttgttcctgcgt

SEQ ID NO: 347517 - DNA, 25 bp, Mus musculus
gggtggcctagacacttgacgaact

SEQ ID NO: 347518 - DNA, 25 bp, Mus musculus
ttgacgaactccatccttgcgactg

SEQ ID NO: 347519 - DNA, 25 bp, Mus musculus
gctcccacctgtgtttagacgccgg

SEQ ID NO: 347520 - DNA, 25 bp, Mus musculus
gactgacggacgttgattggccaga

SEQ ID NO: 347521 - DNA, 25 bp, Mus musculus
ggaatcgcagcaggttatagaactc

SEQ ID NO: 347522 - DNA, 25 bp, Mus musculus
acgttgattggccagagctgctcgc

SEQ ID NO: 347523 - DNA, 25 bp, Mus musculus
ggcgcgatgaccacaccctagaatt

SEQ ID NO: 347524 - DNA, 25 bp, Mus musculus
ggaaagcagccagcgaacacgattg

SEQ ID NO: 347525 - DNA, 25 bp, Mus musculus
acacgattggtacccagcagagagc

SEQ ID NO: 347526 - DNA, 25 bp, Mus musculus
gcatgcgtggacgttctggagttcc

SEQ ID NO: 347527 - DNA, 25 bp, Mus musculus
ccctagaatttgattggagagctgg

SEQ ID NO: 347528 - DNA, 25 bp, Mus musculus
ctcgcttcaaaaggcagagtttttc

SEQ ID NO: 347529 - DNA, 25 bp, Mus musculus
agtacgcaaacatggctgcctgacc

SEQ ID NO: 347530 - DNA, 25 bp, Mus musculus
tgaccacgcccaggtcttgcgcagg

SEQ ID NO: 347531 - DNA, 25 bp, Mus musculus
cagagctcgggcgtccggtcgccat

SEQ ID NO: 347532 - DNA, 25 bp, Mus musculus
caggtcttgcgcaggcgtcgtccat

SEQ ID NO: 347533 - DNA, 25 bp, Mus musculus
gcagtgtggtcacagcccgtagccc

SEQ ID NO: 347534 - DNA, 25 bp, Mus musculus
tttcttgaactgctcccgaaggaga

SEQ ID NO: 347535 - DNA, 25 bp, Mus musculus
cgttgggcgcttcctcgcttcaaaa

SEQ ID NO: 347536 - DNA, 25 bp, Mus musculus
tccatggcgcgttcccggaagagct

SEQ ID NO: 347537 - DNA, 25 bp, Mus musculus
ccaggtgaccagaaaggttttccag

SEQ ID NO: 347538 - DNA, 25 bp, Mus musculus
gtagctgggactctgactgacgtca

SEQ ID NO: 347539 - DNA, 25 bp, Mus musculus
gacgctgccctggtcggctgcaaac

SEQ ID NO: 347540 - DNA, 25 bp, Mus musculus
ggtcgccatccgatcctgagcgagc

SEQ ID NO: 347541 - DNA, 25 bp, Mus musculus
ctgacgtcaggagcgtaaagtacgc

SEQ ID NO: 347542 - DNA, 25 bp, Mus musculus
agctgccacccgaggtggttccagc

SEQ ID NO: 347543 - DNA, 25 bp, Mus musculus
ctaccctgctgggtcccaggccctg

SEQ ID NO: 347544 - DNA, 25 bp, Mus musculus
cagcggccgccagggacccagtagt

SEQ ID NO: 347545 - DNA, 25 bp, Mus musculus
cgccactgccgtaggctgcagcttc

SEQ ID NO: 347546 - DNA, 25 bp, Mus musculus
ccgtactgctctcggccagccagac

SEQ ID NO: 347547 - DNA, 25 bp, Mus musculus
gcgaagcccggacgcccgtactgct

SEQ ID NO: 347548 - DNA, 25 bp, Mus musculus
tgccaccgccctgcaggtaggacag

SEQ ID NO: 347549 - DNA, 25 bp, Mus musculus
agggccacctgcttcgtaggcgccg

SEQ ID NO: 347550 - DNA, 25 bp, Mus musculus
ccctgcaggtaggacaggcccagca

SEQ ID NO: 347551 - DNA, 25 bp, Mus musculus
taggacaggcccagcacagaggacg

SEQ ID NO: 347552 - DNA, 25 bp, Mus musculus
cagcacagaggacggcacccgcgga

SEQ ID NO: 347553 - DNA, 25 bp, Mus musculus
gcccgcgctgtgcatgaaggcgcca

SEQ ID NO: 347554 - DNA, 25 bp, Mus musculus
atgaaggcgccagggccacctgctt

SEQ ID NO: 347555 - DNA, 25 bp, Mus musculus
cccacgtcggccatgtaggctgggt

SEQ ID NO: 347556 - DNA, 25 bp, Mus musculus
ggcaaagtccatgcgcgcggaactc

SEQ ID NO: 347557 - DNA, 25 bp, Mus musculus
tgacctcgcacactgggctcatggt

SEQ ID NO: 347558 - DNA, 25 bp, Mus musculus
cgatcgcctgcgctgactggcctaa

SEQ ID NO: 347559 - DNA, 25 bp, Mus musculus
ctctcggggaaggaaagcactcagt

SEQ ID NO: 347560 - DNA, 25 bp, Mus musculus
cccgacgtccttgcggtttgctgct

SEQ ID NO: 347561 - DNA, 25 bp, Mus musculus
tactctcagtggtccacgtccagcg

SEQ ID NO: 347562 - DNA, 25 bp, Mus musculus
gctgctctgccaaggatcgtgttta

SEQ ID NO: 347563 - DNA, 25 bp, Mus musculus
accagcccaggagtttatgtattta

SEQ ID NO: 347564 - DNA, 25 bp, Mus musculus
tttctccttcccacgagccggtgga

SEQ ID NO: 347565 - DNA, 25 bp, Mus musculus
tgcctagagacgcaagcgctctttt

SEQ ID NO: 347566 - DNA, 25 bp, Mus musculus
ctggcccttaaggtcagtgcctaga

SEQ ID NO: 347567 - DNA, 25 bp, Mus musculus
gcactaaaacctgaactggccctta

SEQ ID NO: 347568 - DNA, 25 bp, Mus musculus
ccgggatgccttgctagcctcagat

SEQ ID NO: 347569 - DNA, 25 bp, Mus musculus
gcctcagatctacggggcccttgaa

SEQ ID NO: 347570 - DNA, 25 bp, Mus musculus
tttggccaacccgtggggatctcag

SEQ ID NO: 347571 - DNA, 25 bp, Mus musculus
tgccgccagtttgagcccttgggcg

SEQ ID NO: 347572 - DNA, 25 bp, Mus musculus
ctctggcttgatttaccgaagtagc

SEQ ID NO: 347573 - DNA, 25 bp, Mus musculus
gctgcccgcactctggcttgattta

SEQ ID NO: 347574 - DNA, 25 bp, Mus musculus
tctagaggagagaaaactgaggccc

SEQ ID NO: 347575 - DNA, 25 bp, Mus musculus
gccagtgcaaaagcaacccaggcgc

SEQ ID NO: 347576 - DNA, 25 bp, Mus musculus
caacccgtggggatctcaggaaaat

SEQ ID NO: 347577 - DNA, 25 bp, Mus musculus
gtggggatctcaggaaaatcccaga

SEQ ID NO: 347578 - DNA, 25 bp, Mus musculus
ggacgccgagccaattgaaagggaa

SEQ ID NO: 347579 - DNA, 25 bp, Mus musculus
caacccaggcgctaggaacaggctg

SEQ ID NO: 347580 - DNA, 25 bp, Mus musculus
ttcgaggactgactgcagattgcta

SEQ ID NO: 347581 - DNA, 25 bp, Mus musculus
ctgcagattgctattgctattgccc

SEQ ID NO: 347582 - DNA, 25 bp, Mus musculus
gcccgaggtccagagcggctctaga

SEQ ID NO: 347583 - DNA, 25 bp, Mus musculus
tccagagcggctctagaggagagaa

SEQ ID NO: 347584 - DNA, 25 bp, Mus musculus
aggagcgcttcggtacctccgacga

SEQ ID NO: 347585 - DNA, 25 bp, Mus musculus
cagatggatctgattcggcagcagc

SEQ ID NO: 347586 - DNA, 25 bp, Mus musculus
gctggagttcgaggcccagcacatc

SEQ ID NO: 347587 - DNA, 25 bp, Mus musculus
cagcagttttcgatgcagatggatc

SEQ ID NO: 347588 - DNA, 25 bp, Mus musculus
agcacatccgctcgctgatggagga

SEQ ID NO: 347589 - DNA, 25 bp, Mus musculus
ccgctcgctgatggaggagcgcttc

SEQ ID NO: 347590 - DNA, 25 bp, Mus musculus
tacctccgacgagatggtgcagcgg

SEQ ID NO: 347591 - DNA, 25 bp, Mus musculus
ccctcccagcagttttcgatgcaga

SEQ ID NO: 347592 - DNA, 25 bp, Mus musculus
gggtcagaacgcacctcatcacagc

SEQ ID NO: 347593 - DNA, 25 bp, Mus musculus
taaggaggccgggtcagaacgcacc

SEQ ID NO: 347594 - DNA, 25 bp, Mus musculus
cgcacctaaggaaggttcagggatg

SEQ ID NO: 347595 - DNA, 25 bp, Mus musculus
tgccgcacgtggacacggtgagctc

SEQ ID NO: 347596 - DNA, 25 bp, Mus musculus
tctgattcggcagcagctggagttc

SEQ ID NO: 347597 - DNA, 25 bp, Mus musculus
cttggatgagctgccgcacgtggac

SEQ ID NO: 347598 - DNA, 25 bp, Mus musculus
gttctaagcgtcagcttggccctgc

SEQ ID NO: 347599 - DNA, 25 bp, Mus musculus
tgcttccgcataggaggcctactgc

SEQ ID NO: 347600 - DNA, 25 bp, Mus musculus
agcttggccctgcttccgcatagga

SEQ ID NO: 347601 - DNA, 25 bp, Mus musculus
gcacccttcacctcacccgcgcgga

SEQ ID NO: 347602 - DNA, 25 bp, Mus musculus
acctactgttctaagcgtcagcttg

SEQ ID NO: 347603 - DNA, 25 bp, Mus musculus
ccagagacctactgttctaagcgtc

SEQ ID NO: 347604 - DNA, 25 bp, Mus musculus
catcagggacgacccggagagaccc

SEQ ID NO: 347605 - DNA, 25 bp, Mus musculus
acgcacacatcagggacgacccgga

SEQ ID NO: 347606 - DNA, 25 bp, Mus musculus
taggaggcctactgcctcacaccga

SEQ ID NO: 347607 - DNA, 25 bp, Mus musculus
cctcacaccgaggtggccggaaaga

SEQ ID NO: 347608 - DNA, 25 bp, Mus musculus
gccggaaagaaagcctgcgacccta

SEQ ID NO: 347609 - DNA, 25 bp, Mus musculus
gaaagaaagcctgcgaccctagcac

SEQ ID NO: 347610 - DNA, 25 bp, Mus musculus
ccgagccagagacgcccaagtaggc

SEQ ID NO: 347611 - DNA, 25 bp, Mus musculus
gacgcccaagtaggcgccgcgactt

SEQ ID NO: 347612 - DNA, 25 bp, Mus musculus
ccagcggtgcgagcatcgcgagcct

SEQ ID NO: 347613 - DNA, 25 bp, Mus musculus
tggcctccgctcttaccgctccgca

SEQ ID NO: 347614 - DNA, 25 bp, Mus musculus
agccgagtgaggtgtcgtactctgc

SEQ ID NO: 347615 - DNA, 25 bp, Mus musculus
gccagcgccctactggcgcgtcccg

SEQ ID NO: 347616 - DNA, 25 bp, Mus musculus
agcgctgcccgccacccagcggtgc

SEQ ID NO: 347617 - DNA, 25 bp, Mus musculus
ctcgccacccggcttgatggatggc

SEQ ID NO: 347618 - DNA, 25 bp, Mus musculus
ccacccggcttgatggatggccgcg

SEQ ID NO: 347619 - DNA, 25 bp, Mus musculus
agccggcggcctgtcaggtcttatt

SEQ ID NO: 347620 - DNA, 25 bp, Mus musculus
gcggcctgtcaggtcttattgatga

SEQ ID NO: 347621 - DNA, 25 bp, Mus musculus
caggtcttattgatgaggtgcgcac

SEQ ID NO: 347622 - DNA, 25 bp, Mus musculus
tattgatgaggtgcgcactgaccgc

SEQ ID NO: 347623 - DNA, 25 bp, Mus musculus
atgaggtgcgcactgaccgccgccg

SEQ ID NO: 347624 - DNA, 25 bp, Mus musculus
agggcgcagactcgccggcgctcga

SEQ ID NO: 347625 - DNA, 25 bp, Mus musculus
aggtgtcgtactctgctggagagca

SEQ ID NO: 347626 - DNA, 25 bp, Mus musculus
tagctctacggtcgccaggcaaccg

SEQ ID NO: 347627 - DNA, 25 bp, Mus musculus
acccgggtgcactcggaccagcggt

SEQ ID NO: 347628 - DNA, 25 bp, Mus musculus
gaggccgacctgccgcggcttgaat

SEQ ID NO: 347629 - DNA, 25 bp, Mus musculus
ctggcggcggactagctctacggtc

SEQ ID NO: 347630 - DNA, 25 bp, Mus musculus
ggactagctctacggtcgccaggca

SEQ ID NO: 347631 - DNA, 25 bp, Mus musculus
ttaggacccgggtgcactcggacca

SEQ ID NO: 347632 - DNA, 25 bp, Mus musculus
cgcaacgcaaaagaacgtcccttca

SEQ ID NO: 347633 - DNA, 25 bp, Mus musculus
aagaacggtgcggagaattcgcacc

SEQ ID NO: 347634 - DNA, 25 bp, Mus musculus
cggagaattcgcaccgctacggagc

SEQ ID NO: 347635 - DNA, 25 bp, Mus musculus
gaattcgcaccgctacggagcccgg

SEQ ID NO: 347636 - DNA, 25 bp, Mus musculus
ttcgcaccgctacggagcccgggag

SEQ ID NO: 347637 - DNA, 25 bp, Mus musculus
aggacgcgcgactggagctcaagaa

SEQ ID NO: 347638 - DNA, 25 bp, Mus musculus
accgcgacagctccgaggacgcgcg

SEQ ID NO: 347639 - DNA, 25 bp, Mus musculus
accgccctgacgcaacgcaaaagaa

SEQ ID NO: 347640 - DNA, 25 bp, Mus musculus
tgatctggaagtcaggcgcgtgctt

SEQ ID NO: 347641 - DNA, 25 bp, Mus musculus
gttgtaggttctcatggacaggcgc

SEQ ID NO: 347642 - DNA, 25 bp, Mus musculus
cgctgatgttgtaggttctcatgga

SEQ ID NO: 347643 - DNA, 25 bp, Mus musculus
cccactaggctggcgatttggagct

SEQ ID NO: 347644 - DNA, 25 bp, Mus musculus
catggcgctgatgttgtaggttctc

SEQ ID NO: 347645 - DNA, 25 bp, Mus musculus
atttggagctggagtggactggcgt

SEQ ID NO: 347646 - DNA, 25 bp, Mus musculus
aagctcatggcgctgatgttgtagg

SEQ ID NO: 347647 - DNA, 25 bp, Mus musculus
ggaccaccgcagctcctcagcctta

SEQ ID NO: 347648 - DNA, 25 bp, Mus musculus
aagcatccgcggatggaccaccgca

SEQ ID NO: 347649 - DNA, 25 bp, Mus musculus
acacggaagcatccgcggatggacc

SEQ ID NO: 347650 - DNA, 25 bp, Mus musculus
tcacctatggcctgtcggaggggat

SEQ ID NO: 347651 - DNA, 25 bp, Mus musculus
cctgtcggaggggatccacgcagta

SEQ ID NO: 347652 - DNA, 25 bp, Mus musculus
ccacgcagtaggtgatctggaagtc

SEQ ID NO: 347653 - DNA, 25 bp, Mus musculus
cgtgcgggctcacctatggcctgtc

SEQ ID NO: 347654 - DNA, 25 bp, Mus musculus
caattcccgggcacaggcgcagcag

SEQ ID NO: 347655 - DNA, 25 bp, Mus musculus
gagtcaagagtttggttctgccttt

SEQ ID NO: 347656 - DNA, 25 bp, Mus musculus
gcagcacgtgcggagtcaagagttt

SEQ ID NO: 347657 - DNA, 25 bp, Mus musculus
gactggatgctgagaacgccacgcg

SEQ ID NO: 347658 - DNA, 25 bp, Mus musculus
ctgcagacacagaagactggatgct

SEQ ID NO: 347659 - DNA, 25 bp, Mus musculus
ggggaccatctcctacactgacctg

SEQ ID NO: 347660 - DNA, 25 bp, Mus musculus
gcgcagcaggggaccatctcctaca

SEQ ID NO: 347661 - DNA, 25 bp, Mus musculus
gaaagaggtccaattcccgggcaca

SEQ ID NO: 347662 - DNA, 25 bp, Mus musculus
ttcgctggtcgtcccgtgcccggaa

SEQ ID NO: 347663 - DNA, 25 bp, Mus musculus
cagcagatttcgctggtcgtcccgt

SEQ ID NO: 347664 - DNA, 25 bp, Mus musculus
caacccagacagcagatttcgctgg

SEQ ID NO: 347665 - DNA, 25 bp, Mus musculus
tgccttttatcttcagtctgctctg

SEQ ID NO: 347666 - DNA, 25 bp, Mus musculus
cggggctactcaggggcccatctct

SEQ ID NO: 347667 - DNA, 25 bp, Mus musculus
ccacaaagcagtggcgccctgcggt

SEQ ID NO: 347668 - DNA, 25 bp, Mus musculus
agcgtctgttccgttccaggctcct

SEQ ID NO: 347669 - DNA, 25 bp, Mus musculus
gagccagagctcctccgtgttgtcc

SEQ ID NO: 347670 - DNA, 25 bp, Mus musculus
ggcctgtcagacacagggtcccttc

SEQ ID NO: 347671 - DNA, 25 bp, Mus musculus
ggccggtgcagcaccacattgtcta

SEQ ID NO: 347672 - DNA, 25 bp, Mus musculus
cgtggggttttaatcagctccgcaa

SEQ ID NO: 347673 - DNA, 25 bp, Mus musculus
caaactccatattgggcgcagccta

SEQ ID NO: 347674 - DNA, 25 bp, Mus musculus
gtgcccggcggttaatccgcagacc

SEQ ID NO: 347675 - DNA, 25 bp, Mus musculus
tcgcagagaaggcttcccgccaggc

SEQ ID NO: 347676 - DNA, 25 bp, Mus musculus
aagtagctgctgagcgttgcacccg

SEQ ID NO: 347677 - DNA, 25 bp, Mus musculus
gttgcacccggcaggaactcctgca

SEQ ID NO: 347678 - DNA, 25 bp, Mus musculus
cctgcacaattagagggactcgaga

SEQ ID NO: 347679 - DNA, 25 bp, Mus musculus
ctcgagactcggaagacatagaaac

SEQ ID NO: 347680 - DNA, 25 bp, Mus musculus
tcaccgtttgtcgatggcgtcgata

SEQ ID NO: 347681 - DNA, 25 bp, Mus musculus
cgtcgatatttgaatggaggagcca

SEQ ID NO: 347682 - DNA, 25 bp, Mus musculus
tctgaaacgccgaggggtcaacctg

SEQ ID NO: 347683 - DNA, 25 bp, Mus musculus
tcactcaacccagcgggattctgaa

SEQ ID NO: 347684 - DNA, 25 bp, Mus musculus
caacccagcgggattctgaaacgcc

SEQ ID NO: 347685 - DNA, 25 bp, Mus musculus
acccagcgggattctgaaacgccga

SEQ ID NO: 347686 - DNA, 25 bp, Mus musculus
ccagcgggattctgaaacgccgagg

SEQ ID NO: 347687 - DNA, 25 bp, Mus musculus
tcaacccagcgggattctgaaacgc

SEQ ID NO: 347688 - DNA, 25 bp, Mus musculus
ctgaaacgccgaggggtcaacctga

SEQ ID NO: 347689 - DNA, 25 bp, Mus musculus
aaacgccgaggggtcaacctgatgg

SEQ ID NO: 347690 - DNA, 25 bp, Mus musculus
tcaacctgatgggtttcggggtcaa

SEQ ID NO: 347691 - DNA, 25 bp, Mus musculus
ggcggccatcttggccggtagggta

SEQ ID NO: 347692 - DNA, 25 bp, Mus musculus
catcttggccggtagggtagggcca

SEQ ID NO: 347693 - DNA, 25 bp, Mus musculus
tctcactcaacccagcgggattctg

SEQ ID NO: 347694 - DNA, 25 bp, Mus musculus
ctcactcaacccagcgggattctga

SEQ ID NO: 347695 - DNA, 25 bp, Mus musculus
cccagcgggattctgaaacgccgag

SEQ ID NO: 347696 - DNA, 25 bp, Mus musculus
ccctcaactcggaggctgcgtggaa

SEQ ID NO: 347697 - DNA, 25 bp, Mus musculus
atcatttcatcagcgtgcacggcgg

SEQ ID NO: 347698 - DNA, 25 bp, Mus musculus
ggtcattacttagaaagcaagcgtg

SEQ ID NO: 347699 - DNA, 25 bp, Mus musculus
gaagggtctctgttttctctcttaa

SEQ ID NO: 347700 - DNA, 25 bp, Mus musculus
tgtaatgctgtttgaagggtctctg

SEQ ID NO: 347701 - DNA, 25 bp, Mus musculus
ctagattcggatcaaacggggcggc

SEQ ID NO: 347702 - DNA, 25 bp, Mus musculus
acgcgccagtaatccgagctcttga

SEQ ID NO: 347703 - DNA, 25 bp, Mus musculus
tcaccgcgctgatattaaaagtgtg

SEQ ID NO: 347704 - DNA, 25 bp, Mus musculus
gggtcagcgctcagcagttctcacc

SEQ ID NO: 347705 - DNA, 25 bp, Mus musculus
gccgcgtttcctctggtgtagaaga

SEQ ID NO: 347706 - DNA, 25 bp, Mus musculus
aagtgggctaactgcgtggtaatca

SEQ ID NO: 347707 - DNA, 25 bp, Mus musculus
taatcacgaccagggaggacacatc

SEQ ID NO: 347708 - DNA, 25 bp, Mus musculus
tccagaagacgtgggctgaatcacc

SEQ ID NO: 347709 - DNA, 25 bp, Mus musculus
cacggcggcagagatagctattgag

SEQ ID NO: 347710 - DNA, 25 bp, Mus musculus
gcctgtggatcgtgctcgcgctgct

SEQ ID NO: 347711 - DNA, 25 bp, Mus musculus
ttgactgcctgtggatcgtgctcgc

SEQ ID NO: 347712 - DNA, 25 bp, Mus musculus
tgtggctggccctcgactactaccg

SEQ ID NO: 347713 - DNA, 25 bp, Mus musculus
tggccctcgactactaccgcaaggg

SEQ ID NO: 347714 - DNA, 25 bp, Mus musculus
taccgcaagggggactacggctgct

SEQ ID NO: 347715 - DNA, 25 bp, Mus musculus
actacggctgcttcgggctgaccct

SEQ ID NO: 347716 - DNA, 25 bp, Mus musculus
gcttcgggctgaccctgttcttcgt

SEQ ID NO: 347717 - DNA, 25 bp, Mus musculus
accctgttcttcgtgctggtgccgt

SEQ ID NO: 347718 - DNA, 25 bp, Mus musculus
ttcttcgtgctggtgccgtcgctgc

SEQ ID NO: 347719 - DNA, 25 bp, Mus musculus
ccgtcgctgctggtgcagagcctga

SEQ ID NO: 347720 - DNA, 25 bp, Mus musculus
cttccgctggttcgtgcaggactac

SEQ ID NO: 347721 - DNA, 25 bp, Mus musculus
ctggttcgtgcaggactacacgggc

SEQ ID NO: 347722 - DNA, 25 bp, Mus musculus
ggctgaccctgttcttcgtgctggt

SEQ ID NO: 347723 - DNA, 25 bp, Mus musculus
cgtggcttgactgcctgtggatcgt

SEQ ID NO: 347724 - DNA, 25 bp, Mus musculus
agactcagttcctggtactaaaggc

SEQ ID NO: 347725 - DNA, 25 bp, Mus musculus
ggcttcttccttaaccgcgcttcag

SEQ ID NO: 347726 - DNA, 25 bp, Mus musculus
caaacttgagacaatgtcgatgcta

SEQ ID NO: 347727 - DNA, 25 bp, Mus musculus
tcgatgctagcagagcgtgagtgtc

SEQ ID NO: 347728 - DNA, 25 bp, Mus musculus
tcgcgcgtggtgacgtcagtagtac

SEQ ID NO: 347729 - DNA, 25 bp, Mus musculus
tgagtgtctgccgagctggacgacc

SEQ ID NO: 347730 - DNA, 25 bp, Mus musculus
agagaacagcaacgtcccgcagact

SEQ ID NO: 347731 - DNA, 25 bp, Mus musculus
tcctcataaccgctgggcgtcaggc

SEQ ID NO: 347732 - DNA, 25 bp, Mus musculus
aaccgcgcttcaggttcctcataac

SEQ ID NO: 347733 - DNA, 25 bp, Mus musculus
cctggtactaaaggctcgggtcgtg

SEQ ID NO: 347734 - DNA, 25 bp, Mus musculus
gcacgcgtgcattccgacattcagg

SEQ ID NO: 347735 - DNA, 25 bp, Mus musculus
gaggcagcgttcgacaaacttgaga

SEQ ID NO: 347736 - DNA, 25 bp, Mus musculus
cttcatgcagttggtagcgagtcgc

SEQ ID NO: 347737 - DNA, 25 bp, Mus musculus
gcgtgctttccgagccggcttcttc

SEQ ID NO: 347738 - DNA, 25 bp, Mus musculus
tgtgctgcatgtgctggagcagatc

SEQ ID NO: 347739 - DNA, 25 bp, Mus musculus
ctgcgagacctgctgggactggctt

SEQ ID NO: 347740 - DNA, 25 bp, Mus musculus
ccaggaagatactgcgcgcacactg

SEQ ID NO: 347741 - DNA, 25 bp, Mus musculus
atgtgctggagcagatccgagccta

SEQ ID NO: 347742 - DNA, 25 bp, Mus musculus
atcagggcctggcacgcaaggagat

SEQ ID NO: 347743 - DNA, 25 bp, Mus musculus
tgcggccctgcacaacatcgttttc

SEQ ID NO: 347744 - DNA, 25 bp, Mus musculus
gcgcctggtgccaaagatgcacgca

SEQ ID NO: 347745 - DNA, 25 bp, Mus musculus
cagatccttcatggcactgaggctg

SEQ ID NO: 347746 - DNA, 25 bp, Mus musculus
tgctccagatccttcatggcactga

SEQ ID NO: 347747 - DNA, 25 bp, Mus musculus
gctcgggctgtctgccactgctgct

SEQ ID NO: 347748 - DNA, 25 bp, Mus musculus
tctccagagagctgtgtagccatgc

SEQ ID NO: 347749 - DNA, 25 bp, Mus musculus
ctgtgtagccatgcgccgctcgggc

SEQ ID NO: 347750 - DNA, 25 bp, Mus musculus
atcgttttctcccagccggatcagg

SEQ ID NO: 347751 - DNA, 25 bp, Mus musculus
gatccgagcctactgcgagacctgc

SEQ ID NO: 347752 - DNA, 25 bp, Mus musculus
ctcagaggggcagatacgtttagtc

SEQ ID NO: 347753 - DNA, 25 bp, Mus musculus
tcgcggagctgagactccggtctca

SEQ ID NO: 347754 - DNA, 25 bp, Mus musculus
tacgtttagtctgggtggaatcggc

SEQ ID NO: 347755 - DNA, 25 bp, Mus musculus
tggaactagggcttaaggactcaga

SEQ ID NO: 347756 - DNA, 25 bp, Mus musculus
actttaggaacagcacggggctccg

SEQ ID NO: 347757 - DNA, 25 bp, Mus musculus
cgcgggtgacaacgctgttcggaaa

SEQ ID NO: 347758 - DNA, 25 bp, Mus musculus
tcagcaagatgctgggtaagtgcgc

SEQ ID NO: 347759 - DNA, 25 bp, Mus musculus
agaacccggacctgcacaacgcgga

SEQ ID NO: 347760 - DNA, 25 bp, Mus musculus
ccaaggatgagaggaaacgtctggc

SEQ ID NO: 347761 - DNA, 25 bp, Mus musculus
gaccttcaggggacaagagttcgga

SEQ ID NO: 347762 - DNA, 25 bp, Mus musculus
gaggcgaagccaagtgacccgcgtt

SEQ ID NO: 347763 - DNA, 25 bp, Mus musculus
ctggccaagttggacgtcgcgacct

SEQ ID NO: 347764 - DNA, 25 bp, Mus musculus
ccggtggcccgaagctgataaataa

SEQ ID NO: 347765 - DNA, 25 bp, Mus musculus
ctccggactggtccctactctgggt

SEQ ID NO: 347766 - DNA, 25 bp, Mus musculus
tttcgaagctgagtcgcccatcctc

SEQ ID NO: 347767 - DNA, 25 bp, Mus musculus
cgctgcttctttgcgcacgcgtaga

SEQ ID NO: 347768 - DNA, 25 bp, Mus musculus
gcacgcgtagactccgacctgggac

SEQ ID NO: 347769 - DNA, 25 bp, Mus musculus
tgtgcgcaggctccacgcgcatgct

SEQ ID NO: 347770 - DNA, 25 bp, Mus musculus
agcagccgtgccaccttacctgtta

SEQ ID NO: 347771 - DNA, 25 bp, Mus musculus
acctgttacagggatcggctcggtg

SEQ ID NO: 347772 - DNA, 25 bp, Mus musculus
tctgcggagatgactttcgaagctg

SEQ ID NO: 347773 - DNA, 25 bp, Mus musculus
agaggagctggagagcccttctaga

SEQ ID NO: 347774 - DNA, 25 bp, Mus musculus
ctgtctctgagggacaaagttccca

SEQ ID NO: 347775 - DNA, 25 bp, Mus musculus
ttcccagagtacgtgaagccgcgcg

SEQ ID NO: 347776 - DNA, 25 bp, Mus musculus
agccgcgcgggccaaaattgatgct

SEQ ID NO: 347777 - DNA, 25 bp, Mus musculus
ccaaaattgatgctggctgggcgcc

SEQ ID NO: 347778 - DNA, 25 bp, Mus musculus
ggtcagagttgctgccgtttctcca

SEQ ID NO: 347779 - DNA, 25 bp, Mus musculus
ccggcaaggcttcctctgcggagat

SEQ ID NO: 347780 - DNA, 25 bp, Mus musculus
gaagtggctctccacgtccgcagga

SEQ ID NO: 347781 - DNA, 25 bp, Mus musculus
ggtgcggtgaaagcacccacttctc

SEQ ID NO: 347782 - DNA, 25 bp, Mus musculus
ggagggctctgaccactgcagatgc

SEQ ID NO: 347783 - DNA, 25 bp, Mus musculus
acccagaggactttggcagggtctg

SEQ ID NO: 347784 - DNA, 25 bp, Mus musculus
ctggagaccatgaagctattcaggc

SEQ ID NO: 347785 - DNA, 25 bp, Mus musculus
ccactccattgaccgaagctcaaga

SEQ ID NO: 347786 - DNA, 25 bp, Mus musculus
acaagcagaaggtgtgcaagtgccc

SEQ ID NO: 347787 - DNA, 25 bp, Mus musculus
cggcaattcgggctgaggacgacaa

SEQ ID NO: 347788 - DNA, 25 bp, Mus musculus
cgacaagagactatggtcctccatc

SEQ ID NO: 347789 - DNA, 25 bp, Mus musculus
cttcactttcaccttgactgcgggg

SEQ ID NO: 347790 - DNA, 25 bp, Mus musculus
cacgcaactagaggcgcgagcacgc

SEQ ID NO: 347791 - DNA, 25 bp, Mus musculus
ttgtgcctctgtaatctcggacgtc

SEQ ID NO: 347792 - DNA, 25 bp, Mus musculus
tggctggacgtgtagacgcactttt

SEQ ID NO: 347793 - DNA, 25 bp, Mus musculus
acttctcccaggatctaaacggata

SEQ ID NO: 347794 - DNA, 25 bp, Mus musculus
ttgtaaaacggcgacagatgactac

SEQ ID NO: 347795 - DNA, 25 bp, Mus musculus
acgcagctcttagggcggacagccc

SEQ ID NO: 347796 - DNA, 25 bp, Mus musculus
cggcgacagatgactacaagttcca

SEQ ID NO: 347797 - DNA, 25 bp, Mus musculus
acaagttccagagagcggcgcgcga

SEQ ID NO: 347798 - DNA, 25 bp, Mus musculus
gagcggcgcgcgaattttcccgcca

SEQ ID NO: 347799 - DNA, 25 bp, Mus musculus
ctcggcctgacttgtgggaactaca

SEQ ID NO: 347800 - DNA, 25 bp, Mus musculus
cggtagcacgatgggagactccaaa

SEQ ID NO: 347801 - DNA, 25 bp, Mus musculus
ctcttagggcggacagccctacttt

SEQ ID NO: 347802 - DNA, 25 bp, Mus musculus
tgggagactccaaagtgaaagtggc

SEQ ID NO: 347803 - DNA, 25 bp, Mus musculus
ccaatgaaccgacgaggtgagcgct

SEQ ID NO: 347804 - DNA, 25 bp, Mus musculus
aaccgacgaggtgagcgcttgtccc

SEQ ID NO: 347805 - DNA, 25 bp, Mus musculus
tcgcagtcctcctgtgtacgcagct

SEQ ID NO: 347806 - DNA, 25 bp, Mus musculus
tcctcctgtgtacgcagctcttagg

SEQ ID NO: 347807 - DNA, 25 bp, Mus musculus
cagcggcacaattgtaaaacggcga

SEQ ID NO: 347808 - DNA, 25 bp, Mus musculus
ttctaccagcacctgatccagcttg

SEQ ID NO: 347809 - DNA, 25 bp, Mus musculus
cctttagggtggcaatgatgcgatc

SEQ ID NO: 347810 - DNA, 25 bp, Mus musculus
tgacgcgaggcttgggcaccaccag

SEQ ID NO: 347811 - DNA, 25 bp, Mus musculus
atccagcttgctgtcctgtacggcc

SEQ ID NO: 347812 - DNA, 25 bp, Mus musculus
gatgcgatcgtcatagtcggccgga

SEQ ID NO: 347813 - DNA, 25 bp, Mus musculus
tgcaagtgaattctaccagcacctg

SEQ ID NO: 347814 - DNA, 25 bp, Mus musculus
tcggctggtttttgcaagtgaattc

SEQ ID NO: 347815 - DNA, 25 bp, Mus musculus
agtgcccactcagtcggcaggctgg

SEQ ID NO: 347816 - DNA, 25 bp, Mus musculus
cacccagatgaaatgagcaggtgcg

SEQ ID NO: 347817 - DNA, 25 bp, Mus musculus
agccgcgtggcacacccagatgaaa

SEQ ID NO: 347818 - DNA, 25 bp, Mus musculus
tggtacgggagctgcacctgctccc

SEQ ID NO: 347819 - DNA, 25 bp, Mus musculus
cactgcagcatgtcgtggtacggga

SEQ ID NO: 347820 - DNA, 25 bp, Mus musculus
ggcctcgttccactgcagcatgtcg

SEQ ID NO: 347821 - DNA, 25 bp, Mus musculus
tgctgtcctgtacggcctttagggt

SEQ ID NO: 347822 - DNA, 25 bp, Mus musculus
tcttgcccactctgatcacgtcgga

SEQ ID NO: 347823 - DNA, 25 bp, Mus musculus
ccgaagatgcgcttgccagcctcgt

SEQ ID NO: 347824 - DNA, 25 bp, Mus musculus
gcctgtcatgagttcgctgtgcctc

SEQ ID NO: 347825 - DNA, 25 bp, Mus musculus
tgccgcttggcttcgagctgtagaa

SEQ ID NO: 347826 - DNA, 25 bp, Mus musculus
gtagaagctcttcgctcacagactc

SEQ ID NO: 347827 - DNA, 25 bp, Mus musculus
tcacagactcacgaatccgacagag

SEQ ID NO: 347828 - DNA, 25 bp, Mus musculus
attccgcaacatggtatagcctgtc

SEQ ID NO: 347829 - DNA, 25 bp, Mus musculus
gacgtgctttacctcacagagctca

SEQ ID NO: 347830 - DNA, 25 bp, Mus musculus
tcgtctgcctcgtccagagtggtga

SEQ ID NO: 347831 - DNA, 25 bp, Mus musculus
atgatgaacagcgtgaaactcagcc

SEQ ID NO: 347832 - DNA, 25 bp, Mus musculus
tcagccatgtcagccggatgcgatt

SEQ ID NO: 347833 - DNA, 25 bp, Mus musculus
gatgcgattggaccagcgcagcata

SEQ ID NO: 347834 - DNA, 25 bp, Mus musculus
gcgcagcatacaggtctgaccaccg

SEQ ID NO: 347835 - DNA, 25 bp, Mus musculus
cgacagagatcgaggacgtgcttta

SEQ ID NO: 347836 - DNA, 25 bp, Mus musculus
gcaagctcaaggctgcccggtgctt

SEQ ID NO: 347837 - DNA, 25 bp, Mus musculus
cctgcgtctgccgagcgagaggaaa

SEQ ID NO: 347838 - DNA, 25 bp, Mus musculus
gctgcgcttccacgggagatgttcc

SEQ ID NO: 347839 - DNA, 25 bp, Mus musculus
agatgttcccgtgggccgctagtgc

SEQ ID NO: 347840 - DNA, 25 bp, Mus musculus
cattcgtgactttccggacgcgtcc

SEQ ID NO: 347841 - DNA, 25 bp, Mus musculus
acttgccgaagatgggccggaaacg

SEQ ID NO: 347842 - DNA, 25 bp, Mus musculus
ttccggacgcgtccgaaggcacagg

SEQ ID NO: 347843 - DNA, 25 bp, Mus musculus
tcctaccggcttccagtcagtaacg

SEQ ID NO: 347844 - DNA, 25 bp, Mus musculus
agcgcagagacattcgtgactttcc

SEQ ID NO: 347845 - DNA, 25 bp, Mus musculus
ccggaaacggccgaacctgcgtctg

SEQ ID NO: 347846 - DNA, 25 bp, Mus musculus
ctgcgtgaaagtccgcttcccacaa

SEQ ID NO: 347847 - DNA, 25 bp, Mus musculus
caccgccgttgcctgcgtgaaagtc

SEQ ID NO: 347848 - DNA, 25 bp, Mus musculus
agtcagtaacgagccaccgccgttg

SEQ ID NO: 347849 - DNA, 25 bp, Mus musculus
cgcgccggcggaacttgccgaagat

SEQ ID NO: 347850 - DNA, 25 bp, Mus musculus
gagagtcacgtccattcccacgaga

SEQ ID NO: 347851 - DNA, 25 bp, Mus musculus
accttgcttgaagcccggtgcattg

SEQ ID NO: 347852 - DNA, 25 bp, Mus musculus
cccacgagagggacagcttggagct

SEQ ID NO: 347853 - DNA, 25 bp, Mus musculus
tggtgtcccgagaccttggaaatgc

SEQ ID NO: 347854 - DNA, 25 bp, Mus musculus
ggacatcccgccctcaagatatgaa

SEQ ID NO: 347855 - DNA, 25 bp, Mus musculus
agccgaggtctgcaacacccatgga

SEQ ID NO: 347856 - DNA, 25 bp, Mus musculus
atggacctccacattcgcagaactc

SEQ ID NO: 347857 - DNA, 25 bp, Mus musculus
attcgcagaactcttggtccggccc

SEQ ID NO: 347858 - DNA, 25 bp, Mus musculus
aaacgttcaggtcgcacccttgatg

SEQ ID NO: 347859 - DNA, 25 bp, Mus musculus
ccgcagtttgaggttctgccgcaca

SEQ ID NO: 347860 - DNA, 25 bp, Mus musculus
acaggcgcagcagcaactctgactg

SEQ ID NO: 347861 - DNA, 25 bp, Mus musculus
actggcccgcctaccttgcttgaag

SEQ ID NO: 347862 - DNA, 25 bp, Mus musculus
ggtgcattgtgggacactcaggcca

SEQ ID NO: 347863 - DNA, 25 bp, Mus musculus
gcgccctcgaatccacggttctaat

SEQ ID NO: 347864 - DNA, 25 bp, Mus musculus
ctccgcgtgagatcactgtctttta

SEQ ID NO: 347865 - DNA, 25 bp, Mus musculus
cgtcttggccatgatgcgctcgata

SEQ ID NO: 347866 - DNA, 25 bp, Mus musculus
ccagctattgccctgggactatgaa

SEQ ID NO: 347867 - DNA, 25 bp, Mus musculus
ctgggcactgaaagagcaaagttaa

SEQ ID NO: 347868 - DNA, 25 bp, Mus musculus
gcagcgtgtctcttctgtcacattt

SEQ ID NO: 347869 - DNA, 25 bp, Mus musculus
ccgcgctcccttcgggaaagtgcga

SEQ ID NO: 347870 - DNA, 25 bp, Mus musculus
ggcagagttccttgggtgattcaca

SEQ ID NO: 347871 - DNA, 25 bp, Mus musculus
cgcgcaaaggaacccaccagctatt

SEQ ID NO: 347872 - DNA, 25 bp, Mus musculus
ggcccggtcacccatttgcattcaa

SEQ ID NO: 347873 - DNA, 25 bp, Mus musculus
taataagcacctagtcggcccggtc

SEQ ID NO: 347874 - DNA, 25 bp, Mus musculus
ctctaagtctgcattccggaaaagg

SEQ ID NO: 347875 - DNA, 25 bp, Mus musculus
gggcaccatggtctccagggaagct

SEQ ID NO: 347876 - DNA, 25 bp, Mus musculus
cgctcgatagagaaagctagtgttt

SEQ ID NO: 347877 - DNA, 25 bp, Mus musculus
ccaccgccaaggagatgcgttccga

SEQ ID NO: 347878 - DNA, 25 bp, Mus musculus
cttcttgcaaagtccgcctgagcca

SEQ ID NO: 347879 - DNA, 25 bp, Mus musculus
gggagcctccgactttgcaaactga

SEQ ID NO: 347880 - DNA, 25 bp, Mus musculus
cagcaagggacaacttttgggcgct

SEQ ID NO: 347881 - DNA, 25 bp, Mus musculus
ttcccagggcatcctcgcttagagc

SEQ ID NO: 347882 - DNA, 25 bp, Mus musculus
atgcgcgctacggtcagcctcctat

SEQ ID NO: 347883 - DNA, 25 bp, Mus musculus
cgctgaccggcttcgttgttctcag

SEQ ID NO: 347884 - DNA, 25 bp, Mus musculus
gttgttctcagcctggcgtcctagg

SEQ ID NO: 347885 - DNA, 25 bp, Mus musculus
cctaggtgatagtgacgtcttgagc

SEQ ID NO: 347886 - DNA, 25 bp, Mus musculus
tgtgcccagtccttcttgcaaagtc

SEQ ID NO: 347887 - DNA, 25 bp, Mus musculus
agccaagttctcagtgcgggtccag

SEQ ID NO: 347888 - DNA, 25 bp, Mus musculus
ggaagccagtgtgccaacctcggac

SEQ ID NO: 347889 - DNA, 25 bp, Mus musculus
cgcgcacaggtagcaagggacaccc

SEQ ID NO: 347890 - DNA, 25 bp, Mus musculus
acacccggtctgttgcaacgctgca

SEQ ID NO: 347891 - DNA, 25 bp, Mus musculus
tcccagcgctggaggcattcatcca

SEQ ID NO: 347892 - DNA, 25 bp, Mus musculus
tgtcgagaaagatgccagccgccct

SEQ ID NO: 347893 - DNA, 25 bp, Mus musculus
gtcctgagccgttgtagttccgtga

SEQ ID NO: 347894 - DNA, 25 bp, Mus musculus
ttcagcctgcagtgggaaagctatg

SEQ ID NO: 347895 - DNA, 25 bp, Mus musculus
tgaagcgcttcctagacatcgcaga

SEQ ID NO: 347896 - DNA, 25 bp, Mus musculus
gcagcgttcgcttcacagtggagaa

SEQ ID NO: 347897 - DNA, 25 bp, Mus musculus
tgagaatttctcctgcgcctccagc

SEQ ID NO: 347898 - DNA, 25 bp, Mus musculus
gtgcactggcccttcatgagctgta

SEQ ID NO: 347899 - DNA, 25 bp, Mus musculus
tctagggctcggtcagcaactgata

SEQ ID NO: 347900 - DNA, 25 bp, Mus musculus
tccctgtgtacatgttagtgcccgc

SEQ ID NO: 347901 - DNA, 25 bp, Mus musculus
agctcatctgagaactgcgtccagg

SEQ ID NO: 347902 - DNA, 25 bp, Mus musculus
cgcagagggcacacccgttaacttt

SEQ ID NO: 347903 - DNA, 25 bp, Mus musculus
ttttccagtgcagcctcgctcagtg

SEQ ID NO: 347904 - DNA, 25 bp, Mus musculus
gccgctcattgccagtccctgtgta

SEQ ID NO: 347905 - DNA, 25 bp, Mus musculus
ggcagcttcgagagccgctccattg

SEQ ID NO: 347906 - DNA, 25 bp, Mus musculus
cgactttaagaggttcagccgagca

SEQ ID NO: 347907 - DNA, 25 bp, Mus musculus
accgaaaggccgattctggggctca

SEQ ID NO: 347908 - DNA, 25 bp, Mus musculus
ttctggggctcaggcagcgacttta

SEQ ID NO: 347909 - DNA, 25 bp, Mus musculus
gagcaaagcgcgttgcgcctgcaga

SEQ ID NO: 347910 - DNA, 25 bp, Mus musculus
ctcaggcagcgactttaagaggttc

SEQ ID NO: 347911 - DNA, 25 bp, Mus musculus
cgccgccggaatgtatacgtttaag

SEQ ID NO: 347912 - DNA, 25 bp, Mus musculus
ctatagggaagatggagcaaagcgc

SEQ ID NO: 347913 - DNA, 25 bp, Mus musculus
aacgtggcccggagttccaagctga

SEQ ID NO: 347914 - DNA, 25 bp, Mus musculus
agagcaagcgcgaaaacgtggcccg

SEQ ID NO: 347915 - DNA, 25 bp, Mus musculus
ctccggctgcttgtttactcctggc

SEQ ID NO: 347916 - DNA, 25 bp, Mus musculus
agcttatttttctctccggcccata

SEQ ID NO: 347917 - DNA, 25 bp, Mus musculus
aagcggcatacacgccgccacgaag

SEQ ID NO: 347918 - DNA, 25 bp, Mus musculus
cgcctgcagaaacagaagcggcata

SEQ ID NO: 347919 - DNA, 25 bp, Mus musculus
ttcagccgagcagaggctataggga

SEQ ID NO: 347920 - DNA, 25 bp, Mus musculus
agtgggtcacaactcggtcaggttc

SEQ ID NO: 347921 - DNA, 25 bp, Mus musculus
tggggcgcgctggaaaaacaacagc

SEQ ID NO: 347922 - DNA, 25 bp, Mus musculus
ctttggttgggtttgcagttcagtt

SEQ ID NO: 347923 - DNA, 25 bp, Mus musculus
gtagcagatacgctagttcggttcc

SEQ ID NO: 347924 - DNA, 25 bp, Mus musculus
agatacgctagttcggttccgggtg

SEQ ID NO: 347925 - DNA, 25 bp, Mus musculus
caactcggtcaggttcaagtgcgca

SEQ ID NO: 347926 - DNA, 25 bp, Mus musculus
gtcaggttcaagtgcgcatgtgtga

SEQ ID NO: 347927 - DNA, 25 bp, Mus musculus
cgcatgtgtgagaggagtcgctcca

SEQ ID NO: 347928 - DNA, 25 bp, Mus musculus
gaggagtcgctccagcacttattga

SEQ ID NO: 347929 - DNA, 25 bp, Mus musculus
gtcgctccagcacttattgagcgcc

SEQ ID NO: 347930 - DNA, 25 bp, Mus musculus
gtgtccctgcgtctggctggctcgc

SEQ ID NO: 347931 - DNA, 25 bp, Mus musculus
ccctggcgcctagagcttctggctt

SEQ ID NO: 347932 - DNA, 25 bp, Mus musculus
ctgtgtaccgccaagcagggtgtgt

SEQ ID NO: 347933 - DNA, 25 bp, Mus musculus
acaacagccagaaactttggttggg

SEQ ID NO: 347934 - DNA, 25 bp, Mus musculus
actgacctgttaacctgctcccttt

SEQ ID NO: 347935 - DNA, 25 bp, Mus musculus
agccgtcagccctgcgctatgcgcg

SEQ ID NO: 347936 - DNA, 25 bp, Mus musculus
ttggctctaagccttccgggctcac

SEQ ID NO: 347937 - DNA, 25 bp, Mus musculus
ctccctttccggctgagccgtcagc

SEQ ID NO: 347938 - DNA, 25 bp, Mus musculus
tgttaacctgctccctttccggctg

SEQ ID NO: 347939 - DNA, 25 bp, Mus musculus
tcgcggggccacactgacctgttaa

SEQ ID NO: 347940 - DNA, 25 bp, Mus musculus
cggggccacactgacctgttaacct

SEQ ID NO: 347941 - DNA, 25 bp, Mus musculus
ctgccctctccataaccagagagtg

SEQ ID NO: 347942 - DNA, 25 bp, Mus musculus
tctccataaccagagagtgccgtgc

SEQ ID NO: 347943 - DNA, 25 bp, Mus musculus
ccataaccagagagtgccgtgctgc

SEQ ID NO: 347944 - DNA, 25 bp, Mus musculus
ataaccagagagtgccgtgctgcgg

SEQ ID NO: 347945 - DNA, 25 bp, Mus musculus
tgctgcgggactggcctcgcgacac

SEQ ID NO: 347946 - DNA, 25 bp, Mus musculus
ggcctcgcgacacaccctctctcaa

SEQ ID NO: 347947 - DNA, 25 bp, Mus musculus
ttaacctgctccctttccggctgag

SEQ ID NO: 347948 - DNA, 25 bp, Mus musculus
acgcgcaggcggcacagactgagca

SEQ ID NO: 347949 - DNA, 25 bp, Mus musculus
gtggtctcaaccacagcctgtccta

SEQ ID NO: 347950 - DNA, 25 bp, Mus musculus
ggtgcgctccgtggtctcaaccaca

SEQ ID NO: 347951 - DNA, 25 bp, Mus musculus
ctggtgagcaatgccagcgcagaca

SEQ ID NO: 347952 - DNA, 25 bp, Mus musculus
cacgtggctacaggacctgcaggtg

SEQ ID NO: 347953 - DNA, 25 bp, Mus musculus
tggccctgcacagcacgtggctaca

SEQ ID NO: 347954 - DNA, 25 bp, Mus musculus
agctactgctgcagcgccacgcggg

SEQ ID NO: 347955 - DNA, 25 bp, Mus musculus
agcaatcgaagccagctactgctgc

SEQ ID NO: 347956 - DNA, 25 bp, Mus musculus
ctgcaggtggaaagcaatcgaagcc

SEQ ID NO: 347957 - DNA, 25 bp, Mus musculus
gtgactccgcacagctggaactcta

SEQ ID NO: 347958 - DNA, 25 bp, Mus musculus
agcagagtgactccgcacagctgga

SEQ ID NO: 347959 - DNA, 25 bp, Mus musculus
ccctgctgcgggaccgaacaggaca

SEQ ID NO: 347960 - DNA, 25 bp, Mus musculus
accgaacaggacagcagagtgactc

SEQ ID NO: 347961 - DNA, 25 bp, Mus musculus
gcctgtcctatgacgtggccctgca

SEQ ID NO: 347962 - DNA, 25 bp, Mus musculus
agctgagcctgcactttccggacta

SEQ ID NO: 347963 - DNA, 25 bp, Mus musculus
ccgactcgaaggtggttggcagact

SEQ ID NO: 347964 - DNA, 25 bp, Mus musculus
acctttttacccgagcgtgcgagcg

SEQ ID NO: 347965 - DNA, 25 bp, Mus musculus
ccggactaggtgtccagacagcttt

SEQ ID NO: 347966 - DNA, 25 bp, Mus musculus
gcgccctaaacgctgcggcggttac

SEQ ID NO: 347967 - DNA, 25 bp, Mus musculus
ggcctttgaaaatgcgcgcgcccta

SEQ ID NO: 347968 - DNA, 25 bp, Mus musculus
ctgcttttagttagaactccagtgc

SEQ ID NO: 347969 - DNA, 25 bp, Mus musculus
ggagcgagtcttctgactgctttta

SEQ ID NO: 347970 - DNA, 25 bp, Mus musculus
cctgcattttctggagcgagtcttc

SEQ ID NO: 347971 - DNA, 25 bp, Mus musculus
gagggagctgttcctgcattttctg

SEQ ID NO: 347972 - DNA, 25 bp, Mus musculus
tgcttcttacacaccgcggcggtta

SEQ ID NO: 347973 - DNA, 25 bp, Mus musculus
acgcgtgagttttgaccctagtgcc

SEQ ID NO: 347974 - DNA, 25 bp, Mus musculus
ctggcgggacctttgaaaaagcgtg

SEQ ID NO: 347975 - DNA, 25 bp, Mus musculus
agctttgagccagcccgtcactttc

SEQ ID NO: 347976 - DNA, 25 bp, Mus musculus
gcttcctagagcctgcgccgcgatt

SEQ ID NO: 347977 - DNA, 25 bp, Mus musculus
caacccgagcgtctacggggcaaca

SEQ ID NO: 347978 - DNA, 25 bp, Mus musculus
gaagccctctccttgcctgcgtgag

SEQ ID NO: 347979 - DNA, 25 bp, Mus musculus
cagcgggctacgttcaaggcccttg

SEQ ID NO: 347980 - DNA, 25 bp, Mus musculus
ttgacgttaccttcgttcctcagtc

SEQ ID NO: 347981 - DNA, 25 bp, Mus musculus
tgcacctcagcaagcttacgacctt

SEQ ID NO: 347982 - DNA, 25 bp, Mus musculus
gccgcgattggcttctcgctagtca

SEQ ID NO: 347983 - DNA, 25 bp, Mus musculus
cgtcactgctcaggcgcttcctaga

SEQ ID NO: 347984 - DNA, 25 bp, Mus musculus
aacgctgctgcgtactgattcgtca

SEQ ID NO: 347985 - DNA, 25 bp, Mus musculus
gcgctacttgagaccaacgctgctg

SEQ ID NO: 347986 - DNA, 25 bp, Mus musculus
tgttcaaattcacgcgcgctacttg

SEQ ID NO: 347987 - DNA, 25 bp, Mus musculus
gcgctccgccagtgtgttcaaattc

SEQ ID NO: 347988 - DNA, 25 bp, Mus musculus
tacgaccttgctcacaggaacccgg

SEQ ID NO: 347989 - DNA, 25 bp, Mus musculus
gttcctcagtctccttctggaccgg

SEQ ID NO: 347990 - DNA, 25 bp, Mus musculus
cttcgcgttttgagtaggagtcgcc

SEQ ID NO: 347991 - DNA, 25 bp, Mus musculus
cttcccttcgccaggactaaagatg

SEQ ID NO: 347992 - DNA, 25 bp, Mus musculus
acgcgacggcacgtccgccggaagt

SEQ ID NO: 347993 - DNA, 25 bp, Mus musculus
ccggcggtatctcaagcttcgcgtt

SEQ ID NO: 347994 - DNA, 25 bp, Mus musculus
acgcttgagcggaatcctcaaaatc

SEQ ID NO: 347995 - DNA, 25 bp, Mus musculus
aggagtcgccactcttctaccagga

SEQ ID NO: 347996 - DNA, 25 bp, Mus musculus
cttctaccaggatcatggtgttcta

SEQ ID NO: 347997 - DNA, 25 bp, Mus musculus
atggtgttctacttcaccagcagca

SEQ ID NO: 347998 - DNA, 25 bp, Mus musculus
gacttagtcctgaaccgcgtccttc

SEQ ID NO: 347999 - DNA, 25 bp, Mus musculus
tatacccggtaatcattctcgtccc

SEQ ID NO: 348000 - DNA, 25 bp, Mus musculus
ctggacgtgtgtgcgttccagccta

SEQ ID NO: 348001 - DNA, 25 bp, Mus musculus
tcgcaagcctttgccctagcgttct

SEQ ID NO: 348002 - DNA, 25 bp, Mus musculus
ccgcaccttggagcgatgcttgacc

SEQ ID NO: 348003 - DNA, 25 bp, Mus musculus
gagagcctggaagccggctcaccct

SEQ ID NO: 348004 - DNA, 25 bp, Mus musculus
ccgcggcgctcgagtagccttggat

SEQ ID NO: 348005 - DNA, 25 bp, Mus musculus
ctcgagtagccttggatggagcggg

SEQ ID NO: 348006 - DNA, 25 bp, Mus musculus
acacatgcggcgctgtgccgctgct

SEQ ID NO: 348007 - DNA, 25 bp, Mus musculus
acatgcggcgctgtgccgctgctcg

SEQ ID NO: 348008 - DNA, 25 bp, Mus musculus
cggcgaagcaggagaaggatcccgg

SEQ ID NO: 348009 - DNA, 25 bp, Mus musculus
aggctggggacaccacgctgcccgc

SEQ ID NO: 348010 - DNA, 25 bp, Mus musculus
ccctccctcgtcgtcaccgcttggg

SEQ ID NO: 348011 - DNA, 25 bp, Mus musculus
ccggcccagatcaacttccttgata

SEQ ID NO: 348012 - DNA, 25 bp, Mus musculus
ggcccagatcaacttccttgatatt

SEQ ID NO: 348013 - DNA, 25 bp, Mus musculus
ccagatcaacttccttgatattttc

SEQ ID NO: 348014 - DNA, 25 bp, Mus musculus
tcaacttccttgatattttcaaaac

SEQ ID NO: 348015 - DNA, 25 bp, Mus musculus
agggccctttgtgcccctgatgcgt

SEQ ID NO: 348016 - DNA, 25 bp, Mus musculus
tggttacagttgtggtgggcgggga

SEQ ID NO: 348017 - DNA, 25 bp, Mus musculus
aactgccgctgccagggccctttgt

SEQ ID NO: 348018 - DNA, 25 bp, Mus musculus
tggcaggagcaacgcgggtcttccc

SEQ ID NO: 348019 - DNA, 25 bp, Mus musculus
aacgcgggtcttcccgctgttgctt

SEQ ID NO: 348020 - DNA, 25 bp, Mus musculus
ggtggcgagcccaccgccgtttgct

SEQ ID NO: 348021 - DNA, 25 bp, Mus musculus
gtggcggaggaagtagcaacaaatc

SEQ ID NO: 348022 - DNA, 25 bp, Mus musculus
cggaggaagtagcaacaaatccacc

SEQ ID NO: 348023 - DNA, 25 bp, Mus musculus
gtagcaacaaatccaccagcgggtt

SEQ ID NO: 348024 - DNA, 25 bp, Mus musculus
gcaacaaatccaccagcgggttagc

SEQ ID NO: 348025 - DNA, 25 bp, Mus musculus
caccagcgggttagctggcttcttc

SEQ ID NO: 348026 - DNA, 25 bp, Mus musculus
cagcgggttagctggcttcttcgga

SEQ ID NO: 348027 - DNA, 25 bp, Mus musculus
ttagctggcttcttcggagccggag

SEQ ID NO: 348028 - DNA, 25 bp, Mus musculus
ggagcgggttactcgaacgctgatt

SEQ ID NO: 348029 - DNA, 25 bp, Mus musculus
cgggttactcgaacgctgatttggc

SEQ ID NO: 348030 - DNA, 25 bp, Mus musculus
ctcgaacgctgatttggccggcgtc

SEQ ID NO: 348031 - DNA, 25 bp, Mus musculus
ttactcgaacgctgatttggccggc

SEQ ID NO: 348032 - DNA, 25 bp, Mus musculus
gctcaccaccgacgggctagggctg

SEQ ID NO: 348033 - DNA, 25 bp, Mus musculus
tcacgaacacgtacagctgcagcct

SEQ ID NO: 348034 - DNA, 25 bp, Mus musculus
ttcccgcgccacttaggtcacagag

SEQ ID NO: 348035 - DNA, 25 bp, Mus musculus
ttaggtcacagagcgagcgggactt

SEQ ID NO: 348036 - DNA, 25 bp, Mus musculus
agcgagcgggactttcccgcctggc

SEQ ID NO: 348037 - DNA, 25 bp, Mus musculus
gacatctcccgagtcaagctgggcg

SEQ ID NO: 348038 - DNA, 25 bp, Mus musculus
tgcgccgcgggttcctattgttcgc

SEQ ID NO: 348039 - DNA, 25 bp, Mus musculus
tcctcttcgctggacgaagggtcca

SEQ ID NO: 348040 - DNA, 25 bp, Mus musculus
cgatgcagcgcatcacgaacacgta

SEQ ID NO: 348041 - DNA, 25 bp, Mus musculus
gatctcatctgactcctcttcgctg

SEQ ID NO: 348042 - DNA, 25 bp, Mus musculus
cgggtaggcgcttcttcctaggtca

SEQ ID NO: 348043 - DNA, 25 bp, Mus musculus
caagggcgagaatcaattgcgagcc

SEQ ID NO: 348044 - DNA, 25 bp, Mus musculus
cgagaatcaattgcgagcccggagc

SEQ ID NO: 348045 - DNA, 25 bp, Mus musculus
gcttgccgggcgacaataaggcgcc

SEQ ID NO: 348046 - DNA, 25 bp, Mus musculus
cctggcgctgcacaaccaagcggga

SEQ ID NO: 348047 - DNA, 25 bp, Mus musculus
tgctcccgaacgtccagggaagatc

SEQ ID NO: 348048 - DNA, 25 bp, Mus musculus
gtccagggaagatcgccatacggcg

SEQ ID NO: 348049 - DNA, 25 bp, Mus musculus
atacggcgatcctcacctgccgggg

SEQ ID NO: 348050 - DNA, 25 bp, Mus musculus
gagccacccttacctgagccggaga

SEQ ID NO: 348051 - DNA, 25 bp, Mus musculus
ttacctgagccggagatgtggactc

SEQ ID NO: 348052 - DNA, 25 bp, Mus musculus
ctcgaggctgacgacaggtcgctct

SEQ ID NO: 348053 - DNA, 25 bp, Mus musculus
gggacatctcaggactcctgccggc

SEQ ID NO: 348054 - DNA, 25 bp, Mus musculus
gccatccgctctaggcgccaggagg

SEQ ID NO: 348055 - DNA, 25 bp, Mus musculus
gcacaggaaggagccgcctacagcc

SEQ ID NO: 348056 - DNA, 25 bp, Mus musculus
gcgaaaatcgcgctgtgggcacccg

SEQ ID NO: 348057 - DNA, 25 bp, Mus musculus
tgccgctcagccaagggacaccaag

SEQ ID NO: 348058 - DNA, 25 bp, Mus musculus
tggggactacagctttcgcccttgc

SEQ ID NO: 348059 - DNA, 25 bp, Mus musculus
accaagcctttgaagcccagcagga

SEQ ID NO: 348060 - DNA, 25 bp, Mus musculus
tgcgcaagacttccgggtgagcacc

SEQ ID NO: 348061 - DNA, 25 bp, Mus musculus
actgcagtgggacgacagatccttc

SEQ ID NO: 348062 - DNA, 25 bp, Mus musculus
agcccatcaaggacactgcgcaaga

SEQ ID NO: 348063 - DNA, 25 bp, Mus musculus
ccaagagcatcgtgtgcagcccatc

SEQ ID NO: 348064 - DNA, 25 bp, Mus musculus
ggccttcgcgctccttcaaagagga

SEQ ID NO: 348065 - DNA, 25 bp, Mus musculus
gacaacgcccgcaggctaggcatga

SEQ ID NO: 348066 - DNA, 25 bp, Mus musculus
ccagatcttcagcagggacaacgcc

SEQ ID NO: 348067 - DNA, 25 bp, Mus musculus
gagccgccttaagctcccagatctt

SEQ ID NO: 348068 - DNA, 25 bp, Mus musculus
ccatccgtgattggttggagccgcc

SEQ ID NO: 348069 - DNA, 25 bp, Mus musculus
cacacgctcaacaacctggtggaga

SEQ ID NO: 348070 - DNA, 25 bp, Mus musculus
agatccttccgccttggagctaacg

SEQ ID NO: 348071 - DNA, 25 bp, Mus musculus
agtaactctgcgctgtggccacaac

SEQ ID NO: 348072 - DNA, 25 bp, Mus musculus
ggcccgtggcttcacttcctatttg

SEQ ID NO: 348073 - DNA, 25 bp, Mus musculus
gctaacggagatcgcggaccacacc

SEQ ID NO: 348074 - DNA, 25 bp, Mus musculus
cagagggttccacgggtcctccgcg

SEQ ID NO: 348075 - DNA, 25 bp, Mus musculus
attgtctggaaccagccgggccatc

SEQ ID NO: 348076 - DNA, 25 bp, Mus musculus
ggtcctccgcgtccacaaaaagctc

SEQ ID NO: 348077 - DNA, 25 bp, Mus musculus
cagcctcaaaccagagggttccacg

SEQ ID NO: 348078 - DNA, 25 bp, Mus musculus
gagagccggaaaccctgccaagacc

SEQ ID NO: 348079 - DNA, 25 bp, Mus musculus
agcccgctttgtatgcgccaccacg

SEQ ID NO: 348080 - DNA, 25 bp, Mus musculus
agcgccattacctccgcgagcttgc

SEQ ID NO: 348081 - DNA, 25 bp, Mus musculus
aaccagccgggccatctgcgtgaga

SEQ ID NO: 348082 - DNA, 25 bp, Mus musculus
cggccaccacgatcattgtctggaa

SEQ ID NO: 348083 - DNA, 25 bp, Mus musculus
ggcatctcggccaccacgatcattg

SEQ ID NO: 348084 - DNA, 25 bp, Mus musculus
agaggacggcatctcggccaccacg

SEQ ID NO: 348085 - DNA, 25 bp, Mus musculus
aattcctcgcagaggtgcttgtcgg

SEQ ID NO: 348086 - DNA, 25 bp, Mus musculus
cccgaagcatcgtaaattcctcgca

SEQ ID NO: 348087 - DNA, 25 bp, Mus musculus
ccatctgcgtgagacgcgagtcgca

SEQ ID NO: 348088 - DNA, 25 bp, Mus musculus
ccacaatggaggggtgatcgtcccg

SEQ ID NO: 348089 - DNA, 25 bp, Mus musculus
gacgaggacagcatccgggaaagtc

SEQ ID NO: 348090 - DNA, 25 bp, Mus musculus
cgcttcgcgagaggcgctcactgat

SEQ ID NO: 348091 - DNA, 25 bp, Mus musculus
tgactgcgcagagccaatggcctcg

SEQ ID NO: 348092 - DNA, 25 bp, Mus musculus
gcatccgggaaagtcttgggctacc

SEQ ID NO: 348093 - DNA, 25 bp, Mus musculus
atctgcaatgcaggccacaatggag

SEQ ID NO: 348094 - DNA, 25 bp, Mus musculus
cagatgcttcatctgcaatgcaggc

SEQ ID NO: 348095 - DNA, 25 bp, Mus musculus
tttcgcgccctttctgtgagcccgg

SEQ ID NO: 348096 - DNA, 25 bp, Mus musculus
cgcccaggcagcaactgctgcagtg

SEQ ID NO: 348097 - DNA, 25 bp, Mus musculus
cgtgggatatgcaaattagatgggc

SEQ ID NO: 348098 - DNA, 25 bp, Mus musculus
tcagaatcgtgggatatgcaaatta

SEQ ID NO: 348099 - DNA, 25 bp, Mus musculus
cgctcactgattggtcagaatcgtg

SEQ ID NO: 348100 - DNA, 25 bp, Mus musculus
ggcaaaagccatccgcttcgcgaga

SEQ ID NO: 348101 - DNA, 25 bp, Mus musculus
caatggcctcgctgacggcgagcgc

SEQ ID NO: 348102 - DNA, 25 bp, Mus musculus
cggcccactgaaagcgagtcgaagt

SEQ ID NO: 348103 - DNA, 25 bp, Mus musculus
agaggatgccagttcccggcaacgc

SEQ ID NO: 348104 - DNA, 25 bp, Mus musculus
ccacctccgagcaaagttggatctg

SEQ ID NO: 348105 - DNA, 25 bp, Mus musculus
tgcctaccgcaaggtgcacagaaag

SEQ ID NO: 348106 - DNA, 25 bp, Mus musculus
ctccctagctgggtgtgcactagcc

SEQ ID NO: 348107 - DNA, 25 bp, Mus musculus
gtggtttcctaagtctccctagctg

SEQ ID NO: 348108 - DNA, 25 bp, Mus musculus
aggcagggacctcttcgtcctctgc

SEQ ID NO: 348109 - DNA, 25 bp, Mus musculus
gtcttgttctccgaggacccttcca

SEQ ID NO: 348110 - DNA, 25 bp, Mus musculus
tccggctcgattcaacagatggctc

SEQ ID NO: 348111 - DNA, 25 bp, Mus musculus
atcatagatgttctgcagggcttcc

SEQ ID NO: 348112 - DNA, 25 bp, Mus musculus
aagcaaagctcttggtgccgcgtgc

SEQ ID NO: 348113 - DNA, 25 bp, Mus musculus
tgcgcgtgcaaatgcgggaagcaaa

SEQ ID NO: 348114 - DNA, 25 bp, Mus musculus
cagggcagaacatgccgcagaattt

SEQ ID NO: 348115 - DNA, 25 bp, Mus musculus
cgcagaatttctgccgcggcttggg

SEQ ID NO: 348116 - DNA, 25 bp, Mus musculus
ggacgacagtatccggctctcgagc

SEQ ID NO: 348117 - DNA, 25 bp, Mus musculus
tctcgagcagcaacacaacaagtcg

SEQ ID NO: 348118 - DNA, 25 bp, Mus musculus
agctaggaagttggcattggattga

SEQ ID NO: 348119 - DNA, 25 bp, Mus musculus
cggcggctcgactaagtgagacatg

SEQ ID NO: 348120 - DNA, 25 bp, Mus musculus
cggtcccaaccaatgagctgtcgtc

SEQ ID NO: 348121 - DNA, 25 bp, Mus musculus
agtcatacgcacaatctcggtccca

SEQ ID NO: 348122 - DNA, 25 bp, Mus musculus
agcgcgccgctgtcagtcatacgca

SEQ ID NO: 348123 - DNA, 25 bp, Mus musculus
agtccctcccttcgtgacgtcaggg

SEQ ID NO: 348124 - DNA, 25 bp, Mus musculus
cctcccggaccatgtgatgacaaca

SEQ ID NO: 348125 - DNA, 25 bp, Mus musculus
tgtgatgacaacacaggcagctgga

SEQ ID NO: 348126 - DNA, 25 bp, Mus musculus
tgatacgggcgccaggaaagaattc

SEQ ID NO: 348127 - DNA, 25 bp, Mus musculus
gaaagaattcctgcgagtcagtcgc

SEQ ID NO: 348128 - DNA, 25 bp, Mus musculus
agtcagtcgcaatagccggaagggc

SEQ ID NO: 348129 - DNA, 25 bp, Mus musculus
taggaggcgagctccgcaagcacac

SEQ ID NO: 348130 - DNA, 25 bp, Mus musculus
cgcacccgtgccgtgttcctgtagt

SEQ ID NO: 348131 - DNA, 25 bp, Mus musculus
ctgtgttagccacgcctccttcttg

SEQ ID NO: 348132 - DNA, 25 bp, Mus musculus
caggcgactccactttcaaaatggc

SEQ ID NO: 348133 - DNA, 25 bp, Mus musculus
cagggacaggcgactccactttcaa

SEQ ID NO: 348134 - DNA, 25 bp, Mus musculus
ccttctctcgcggtggagacggcag

SEQ ID NO: 348135 - DNA, 25 bp, Mus musculus
ggcgttcactcaggggcgtcccgtc

SEQ ID NO: 348136 - DNA, 25 bp, Mus musculus
tcggcaggatggtggcgttcactca

SEQ ID NO: 348137 - DNA, 25 bp, Mus musculus
aaatggtgaccctgccgggctcgtc

SEQ ID NO: 348138 - DNA, 25 bp, Mus musculus
tgtcgcgctgcaaatggtgaccctg

SEQ ID NO: 348139 - DNA, 25 bp, Mus musculus
tacctgccatgtcgcgctgcaaatg

SEQ ID NO: 348140 - DNA, 25 bp, Mus musculus
ggccgtttcttctttacctgccatg

SEQ ID NO: 348141 - DNA, 25 bp, Mus musculus
tgtcagccgcccaagggccgtttct

SEQ ID NO: 348142 - DNA, 25 bp, Mus musculus
gaggaagcggcacggcaccctgtca

SEQ ID NO: 348143 - DNA, 25 bp, Mus musculus
gccgtgttcctgtagtgccaggccc

SEQ ID NO: 348144 - DNA, 25 bp, Mus musculus
aacataatcaaagccaaggcggttg

SEQ ID NO: 348145 - DNA, 25 bp, Mus musculus
atttgtgtttcaggttcctaatgga

SEQ ID NO: 348146 - DNA, 25 bp, Mus musculus
cctccctaagaccttgacaaacata

SEQ ID NO: 348147 - DNA, 25 bp, Mus musculus
cctaatggagggttattctcacgta

SEQ ID NO: 348148 - DNA, 25 bp, Mus musculus
gcacgggtggtcaattcttccgcca

SEQ ID NO: 348149 - DNA, 25 bp, Mus musculus
tattctcacgtagctggaggcgaag

SEQ ID NO: 348150 - DNA, 25 bp, Mus musculus
caaggcggttggcagaaccgctctc

SEQ ID NO: 348151 - DNA, 25 bp, Mus musculus
ggcgaaggagatggaagcaaccctc

SEQ ID NO: 348152 - DNA, 25 bp, Mus musculus
cggacccggcggcatttgtgtttca

SEQ ID NO: 348153 - DNA, 25 bp, Mus musculus
aaggagatggaagcaaccctctggg

SEQ ID NO: 348154 - DNA, 25 bp, Mus musculus
accagcaccgcttctttagcacggg

SEQ ID NO: 348155 - DNA, 25 bp, Mus musculus
ccgcttctttagcacgggtggtcaa

SEQ ID NO: 348156 - DNA, 25 bp, Mus musculus
ctttagcacgggtggtcaattcttc

SEQ ID NO: 348157 - DNA, 25 bp, Mus musculus
tcaggttcctaatggagggttattc

SEQ ID NO: 348158 - DNA, 25 bp, Mus musculus
ctccagccgtctagggtttcagcta

SEQ ID NO: 348159 - DNA, 25 bp, Mus musculus
tgtgagcgctcacctacagctaggg

SEQ ID NO: 348160 - DNA, 25 bp, Mus musculus
gcgaactctcgcagctcgtctgtga

SEQ ID NO: 348161 - DNA, 25 bp, Mus musculus
gctgtgtcctctagcggcgaactct

SEQ ID NO: 348162 - DNA, 25 bp, Mus musculus
aagcttccttttcgctcgccgggca

SEQ ID NO: 348163 - DNA, 25 bp, Mus musculus
agactcccgactgtaatgatgctga

SEQ ID NO: 348164 - DNA, 25 bp, Mus musculus
ccacggcagatggtctttgagcaca

SEQ ID NO: 348165 - DNA, 25 bp, Mus musculus
tttcaacagcagatctacgcgcaga

SEQ ID NO: 348166 - DNA, 25 bp, Mus musculus
agctattttgtggagcctcggcttc

SEQ ID NO: 348167 - DNA, 25 bp, Mus musculus
agcgctcggcggacaaagtttccag

SEQ ID NO: 348168 - DNA, 25 bp, Mus musculus
aggacttcttcacagacgcctcgtg

SEQ ID NO: 348169 - DNA, 25 bp, Mus musculus
gcctcgtgtctctaacgcagggttc

SEQ ID NO: 348170 - DNA, 25 bp, Mus musculus
tccggtcaggagtcaattgacactc

SEQ ID NO: 348171 - DNA, 25 bp, Mus musculus
cgcgctggcgttctagatttcaaca

SEQ ID NO: 348172 - DNA, 25 bp, Mus musculus
actctggtcgggactcggtgcttgt

SEQ ID NO: 348173 - DNA, 25 bp, Mus musculus
actcggtgcttgtggcttgctgtag

SEQ ID NO: 348174 - DNA, 25 bp, Mus musculus
ttgctgtagcctttcacctcccgga

SEQ ID NO: 348175 - DNA, 25 bp, Mus musculus
ccggacttcgggcaaagcaaagctt

SEQ ID NO: 348176 - DNA, 25 bp, Mus musculus
cttcgggcaaagcaaagcttggcta

SEQ ID NO: 348177 - DNA, 25 bp, Mus musculus
gcaaagcttggctaacgccgcggga

SEQ ID NO: 348178 - DNA, 25 bp, Mus musculus
caatcccgggcgtccatgcaaatga

SEQ ID NO: 348179 - DNA, 25 bp, Mus musculus
atcccgggcgtccatgcaaatgagg

SEQ ID NO: 348180 - DNA, 25 bp, Mus musculus
gcaaatgaggctccttatcgggcct

SEQ ID NO: 348181 - DNA, 25 bp, Mus musculus
gaggctccttatcgggcctcggctc

SEQ ID NO: 348182 - DNA, 25 bp, Mus musculus
cgcggcctgggttgtagtaaccatt

SEQ ID NO: 348183 - DNA, 25 bp, Mus musculus
gcctgggttgtagtaaccattcatg

SEQ ID NO: 348184 - DNA, 25 bp, Mus musculus
agtaaccattcatggggcccgcgcg

SEQ ID NO: 348185 - DNA, 25 bp, Mus musculus
tctgcggcgctctcagccaccgcct

SEQ ID NO: 348186 - DNA, 25 bp, Mus musculus
cactgtcgctactgaactgagattc

SEQ ID NO: 348187 - DNA, 25 bp, Mus musculus
tcgtggcgtttactcttggactcta

SEQ ID NO: 348188 - DNA, 25 bp, Mus musculus
ccagttttgcgggttcctcaagttg

SEQ ID NO: 348189 - DNA, 25 bp, Mus musculus
agggttccatcccacgaagacattc

SEQ ID NO: 348190 - DNA, 25 bp, Mus musculus
actgagattcatggccctcgtgtcc

SEQ ID NO: 348191 - DNA, 25 bp, Mus musculus
cccgcagtcgacactgtagtttctg

SEQ ID NO: 348192 - DNA, 25 bp, Mus musculus
tgcgttctgcgccaacctccttaaa

SEQ ID NO: 348193 - DNA, 25 bp, Mus musculus
ctccggacttcacgttgagaaatga

SEQ ID NO: 348194 - DNA, 25 bp, Mus musculus
cacatctccaggtgtcccgggtaga

SEQ ID NO: 348195 - DNA, 25 bp, Mus musculus
aactggctgccacccttcaaggagt

SEQ ID NO: 348196 - DNA, 25 bp, Mus musculus
ctccgaagccgaatgctcagttgtc

SEQ ID NO: 348197 - DNA, 25 bp, Mus musculus
atggtacttcgcagaggccttggct

SEQ ID NO: 348198 - DNA, 25 bp, Mus musculus
gtagcgttcaagctcacatcgtggc

SEQ ID NO: 348199 - DNA, 25 bp, Mus musculus
tcgtgtccagactacaagagccagc

SEQ ID NO: 348200 - DNA, 25 bp, Mus musculus
tccagtggcagcgagtcctcggatc

SEQ ID NO: 348201 - DNA, 25 bp, Mus musculus
cggtacgcatccctgccacatatta

SEQ ID NO: 348202 - DNA, 25 bp, Mus musculus
ctgagacagtcaagcggtacgcatc

SEQ ID NO: 348203 - DNA, 25 bp, Mus musculus
ttctctgctcctctcgttgcgatga

SEQ ID NO: 348204 - DNA, 25 bp, Mus musculus
gtggacggcctgcactccctgctgt

SEQ ID NO: 348205 - DNA, 25 bp, Mus musculus
agagctgtcctctgcggactccacg

SEQ ID NO: 348206 - DNA, 25 bp, Mus musculus
gtctccttcggcgtcgcagatcaga

SEQ ID NO: 348207 - DNA, 25 bp, Mus musculus
cagctgactttcatcaaggaatccc

SEQ ID NO: 348208 - DNA, 25 bp, Mus musculus
gtcctcggatcgctcaggcttccga

SEQ ID NO: 348209 - DNA, 25 bp, Mus musculus
cctggtgcgtatggcttcagctcgc

SEQ ID NO: 348210 - DNA, 25 bp, Mus musculus
gcaggtccgatagcgctgtctctgt

SEQ ID NO: 348211 - DNA, 25 bp, Mus musculus
aggccaatgccactcgccggggaag

SEQ ID NO: 348212 - DNA, 25 bp, Mus musculus
aggcttccgaagacagctgactttc

SEQ ID NO: 348213 - DNA, 25 bp, Mus musculus
atattagtgtgtcccgcaggtccga

SEQ ID NO: 348214 - DNA, 25 bp, Mus musculus
gccatcctcccttcctgagctctgg

SEQ ID NO: 348215 - DNA, 25 bp, Mus musculus
ctcccacaatgcagccgggtaaaca

SEQ ID NO: 348216 - DNA, 25 bp, Mus musculus
gcctgacgctccaggtgacctctgt

SEQ ID NO: 348217 - DNA, 25 bp, Mus musculus
tccaggtgacctctgtcccgggctg

SEQ ID NO: 348218 - DNA, 25 bp, Mus musculus
tccgacttttgagtcgcgccggcgc

SEQ ID NO: 348219 - DNA, 25 bp, Mus musculus
aacccgtattcttgaggcgggcgcg

SEQ ID NO: 348220 - DNA, 25 bp, Mus musculus
ccatgctggcgccttaccttgtaag

SEQ ID NO: 348221 - DNA, 25 bp, Mus musculus
cagccgggtaaacagtcatggagga

SEQ ID NO: 348222 - DNA, 25 bp, Mus musculus
ggcgaaggtcaaactcccacaatgc

SEQ ID NO: 348223 - DNA, 25 bp, Mus musculus
ttggcggcgaaggtcaaactcccac

SEQ ID NO: 348224 - DNA, 25 bp, Mus musculus
gtcagtcacggctcccatggcgtgc

SEQ ID NO: 348225 - DNA, 25 bp, Mus musculus
tacacttcccgaccggccctccaga

SEQ ID NO: 348226 - DNA, 25 bp, Mus musculus
cttaccttgtaagtcgcccagatac

SEQ ID NO: 348227 - DNA, 25 bp, Mus musculus
cgtgggtctcgaacccgtattcttg

SEQ ID NO: 348228 - DNA, 25 bp, Mus musculus
gcctagcgaggagctgattggtcta

SEQ ID NO: 348229 - DNA, 25 bp, Mus musculus
gttccgcggagcaacacttcaaatg

SEQ ID NO: 348230 - DNA, 25 bp, Mus musculus
ggccgaagcggtcaagcttcacttg

SEQ ID NO: 348231 - DNA, 25 bp, Mus musculus
accctcgtgctttcgaacggcgcag

SEQ ID NO: 348232 - DNA, 25 bp, Mus musculus
ccctaaatgaccctggcgagacaga

SEQ ID NO: 348233 - DNA, 25 bp, Mus musculus
acagcgtgttgattggcgcagctca

SEQ ID NO: 348234 - DNA, 25 bp, Mus musculus
ttggctaaatactggccggtacagc

SEQ ID NO: 348235 - DNA, 25 bp, Mus musculus
ccaccgccgtctagtgttactctga

SEQ ID NO: 348236 - DNA, 25 bp, Mus musculus
agtaggttcttctctgattcgctga

SEQ ID NO: 348237 - DNA, 25 bp, Mus musculus
tgcgcctgctcagtaacgcttagag

SEQ ID NO: 348238 - DNA, 25 bp, Mus musculus
gccggatggctagtttaccctatta

SEQ ID NO: 348239 - DNA, 25 bp, Mus musculus
tggctgctggaaacttcgaaaatga

SEQ ID NO: 348240 - DNA, 25 bp, Mus musculus
cagcaaaaaggtgtcctggggtcta

SEQ ID NO: 348241 - DNA, 25 bp, Mus musculus
agagcggccctttgcccagtaggtt

SEQ ID NO: 348242 - DNA, 25 bp, Mus musculus
cgcagagaactggtgcaagggacac

SEQ ID NO: 348243 - DNA, 25 bp, Mus musculus
agccgagcttcaaggtccgcagaga

SEQ ID NO: 348244 - DNA, 25 bp, Mus musculus
cgttcccacagtgtgcgccactaga

SEQ ID NO: 348245 - DNA, 25 bp, Mus musculus
tgttgaatgaatgagccgtgagctc

SEQ ID NO: 348246 - DNA, 25 bp, Mus musculus
ggcgcttcagaagtagacgtatcca

SEQ ID NO: 348247 - DNA, 25 bp, Mus musculus
cgcctccggacgctcagtaaatatt

SEQ ID NO: 348248 - DNA, 25 bp, Mus musculus
aaacttggacgactttggcgcgccg

SEQ ID NO: 348249 - DNA, 25 bp, Mus musculus
ctccgccatgttccggcaaaacttg

SEQ ID NO: 348250 - DNA, 25 bp, Mus musculus
ctagcggctacagacactcgtgctc

SEQ ID NO: 348251 - DNA, 25 bp, Mus musculus
atccaacgggccatggcgacgacct

SEQ ID NO: 348252 - DNA, 25 bp, Mus musculus
tctgcctcttggtagggatccaacg

SEQ ID NO: 348253 - DNA, 25 bp, Mus musculus
cacttttacaccagagcgggctaga

SEQ ID NO: 348254 - DNA, 25 bp, Mus musculus
cgccactagagttggggttcggata

SEQ ID NO: 348255 - DNA, 25 bp, Mus musculus
accctccgttaggacactgttgaca

SEQ ID NO: 348256 - DNA, 25 bp, Mus musculus
ccagcttcatcgagcgcgtgcacga

SEQ ID NO: 348257 - DNA, 25 bp, Mus musculus
tggccgccaagaacatgcagaacgc

SEQ ID NO: 348258 - DNA, 25 bp, Mus musculus
ctcagtacgagaagctggccgccaa

SEQ ID NO: 348259 - DNA, 25 bp, Mus musculus
ctctcaaggacatccgcgctcagta

SEQ ID NO: 348260 - DNA, 25 bp, Mus musculus
caggctcagatccagtatgctcaga

SEQ ID NO: 348261 - DNA, 25 bp, Mus musculus
cagcctgatggacgagatagctttc

SEQ ID NO: 348262 - DNA, 25 bp, Mus musculus
cctgcaggctcgctatgaggaagaa

SEQ ID NO: 348263 - DNA, 25 bp, Mus musculus
ttggtgctgcgccagaaacactctg

SEQ ID NO: 348264 - DNA, 25 bp, Mus musculus
aatctcgatctgagccaggtagccg

SEQ ID NO: 348265 - DNA, 25 bp, Mus musculus
atgcccagcctggagaatctcgatc

SEQ ID NO: 348266 - DNA, 25 bp, Mus musculus
tcgacctcctacaagcggcgctatg

SEQ ID NO: 348267 - DNA, 25 bp, Mus musculus
ccgccaccatgagttcgttcggcta

SEQ ID NO: 348268 - DNA, 25 bp, Mus musculus
tcccggcgtataaatagaggtggca

SEQ ID NO: 348269 - DNA, 25 bp, Mus musculus
ccgcgccctgtacgagcaggagatc

SEQ ID NO: 348270 - DNA, 25 bp, Mus musculus
tgcagcgactgcaccttcttgtcca

SEQ ID NO: 348271 - DNA, 25 bp, Mus musculus
ggatgtcttcctccaagtgatcgga

SEQ ID NO: 348272 - DNA, 25 bp, Mus musculus
gtcggccacctcctcttcgtgattg

SEQ ID NO: 348273 - DNA, 25 bp, Mus musculus
cggagtccagctgcacttgagcctt

SEQ ID NO: 348274 - DNA, 25 bp, Mus musculus
ttgagccttctcgtggttcaccatc

SEQ ID NO: 348275 - DNA, 25 bp, Mus musculus
ctcggatctcctggtcgtaagcatc

SEQ ID NO: 348276 - DNA, 25 bp, Mus musculus
gcgagtccagcgtgtagctcatctt

SEQ ID NO: 348277 - DNA, 25 bp, Mus musculus
cagtgcctggatctctgcttcgatc

SEQ ID NO: 348278 - DNA, 25 bp, Mus musculus
tcgatgctcttggactgcagctggc

SEQ ID NO: 348279 - DNA, 25 bp, Mus musculus
ttccttggcagagcgaatggcctcc

SEQ ID NO: 348280 - DNA, 25 bp, Mus musculus
gcactttctcgatgtagccggcgaa

SEQ ID NO: 348281 - DNA, 25 bp, Mus musculus
cgtagcggcatttgaaccactcttc

SEQ ID NO: 348282 - DNA, 25 bp, Mus musculus
gtcttcaggtaatctttgcgctcta

SEQ ID NO: 348283 - DNA, 25 bp, Mus musculus
ttcgtgattgctccgcaggaaagcc

SEQ ID NO: 348284 - DNA, 25 bp, Mus musculus
aagtcccgcgtgctattctcccagg

SEQ ID NO: 348285 - DNA, 25 bp, Mus musculus
cgcttcaagcagcagcgatacctga

SEQ ID NO: 348286 - DNA, 25 bp, Mus musculus
gcgatacctgactgcgcccgagcgt

SEQ ID NO: 348287 - DNA, 25 bp, Mus musculus
cgggcacgatctcccgacttggagc

SEQ ID NO: 348288 - DNA, 25 bp, Mus musculus
accggcgctacaagtccaagagtca

SEQ ID NO: 348289 - DNA, 25 bp, Mus musculus
gctagctatgcgagccgctgcacca

SEQ ID NO: 348290 - DNA, 25 bp, Mus musculus
accagactctggaactggccggcca

SEQ ID NO: 348291 - DNA, 25 bp, Mus musculus
ggcaacctgagtggcgacatgcgcc

SEQ ID NO: 348292 - DNA, 25 bp, Mus musculus
cggtttcaaccagaacgcggccaca

SEQ ID NO: 348293 - DNA, 25 bp, Mus musculus
ggcactccctacgacgctagctatg

SEQ ID NO: 348294 - DNA, 25 bp, Mus musculus
gagccaggaacccaatgaccgatcg

SEQ ID NO: 348295 - DNA, 25 bp, Mus musculus
cctattcctgcttcggtggctacgc

SEQ ID NO: 348296 - DNA, 25 bp, Mus musculus
tggatcccgacgtagccgcattcct

SEQ ID NO: 348297 - DNA, 25 bp, Mus musculus
tactggacggcaagccctgcctgga

SEQ ID NO: 348298 - DNA, 25 bp, Mus musculus
cccgagtctggtaagcggagtagac

SEQ ID NO: 348299 - DNA, 25 bp, Mus musculus
gagacaccgactgaacccgagtctg

SEQ ID NO: 348300 - DNA, 25 bp, Mus musculus
cagccaatcggggagcagccgtgtc

SEQ ID NO: 348301 - DNA, 25 bp, Mus musculus
ggctccggaggacccaccaagtatc

SEQ ID NO: 348302 - DNA, 25 bp, Mus musculus
gctccagagcccgacaaagcagggg

SEQ ID NO: 348303 - DNA, 25 bp, Mus musculus
accctaggagggactccgctccaga

SEQ ID NO: 348304 - DNA, 25 bp, Mus musculus
agcactcgccggaccctaggaggga

SEQ ID NO: 348305 - DNA, 25 bp, Mus musculus
ggacactcaggcaatccgcagcact

SEQ ID NO: 348306 - DNA, 25 bp, Mus musculus
atccaggacatcctgcgggaccgcg

SEQ ID NO: 348307 - DNA, 25 bp, Mus musculus
ccggtgatagcaaaagcggcgcgca

SEQ ID NO: 348308 - DNA, 25 bp, Mus musculus
cgcgcggcccggtgatagcaaaagc

SEQ ID NO: 348309 - DNA, 25 bp, Mus musculus
gcatggctataagtgcgcgcggccc

SEQ ID NO: 348310 - DNA, 25 bp, Mus musculus
cgcggcgctcagcatggctataagt

SEQ ID NO: 348311 - DNA, 25 bp, Mus musculus
ggacccaccaagtatccggcatagc

SEQ ID NO: 348312 - DNA, 25 bp, Mus musculus
tccctggcggaatctaggggtactc

SEQ ID NO: 348313 - DNA, 25 bp, Mus musculus
agggcacccacctctctgtgtgacg

SEQ ID NO: 348314 - DNA, 25 bp, Mus musculus
ccgagcggccagaagcaccaatagc

SEQ ID NO: 348315 - DNA, 25 bp, Mus musculus
ctggtcggtaggttctcgtagtcct

SEQ ID NO: 348316 - DNA, 25 bp, Mus musculus
tcccgctgtcatgtgggtggacacc

SEQ ID NO: 348317 - DNA, 25 bp, Mus musculus
ggagtgctccagaatcccggccatc

SEQ ID NO: 348318 - DNA, 25 bp, Mus musculus
ccaccgggtacatgatggagtgctc

SEQ ID NO: 348319 - DNA, 25 bp, Mus musculus
tcaccttcacggagtccaccgggta

SEQ ID NO: 348320 - DNA, 25 bp, Mus musculus
cgacatggtgcgctttcctggagcc

SEQ ID NO: 348321 - DNA, 25 bp, Mus musculus
cgagcgatcggacggctcagagcca

SEQ ID NO: 348322 - DNA, 25 bp, Mus musculus
tgtgtgacgtcgctgcccgctgcac

SEQ ID NO: 348323 - DNA, 25 bp, Mus musculus
cagaagtgcaagactccctggcgga

SEQ ID NO: 348324 - DNA, 25 bp, Mus musculus
aactgcgcgggatgcaaacgcgcgc

SEQ ID NO: 348325 - DNA, 25 bp, Mus musculus
cggcgaaacggcgtccctggctctt

SEQ ID NO: 348326 - DNA, 25 bp, Mus musculus
tcagcaccgagggagcctagcagga

SEQ ID NO: 348327 - DNA, 25 bp, Mus musculus
tcgggaggctaacccagcactcggt

SEQ ID NO: 348328 - DNA, 25 bp, Mus musculus
agcactcggtgccaatcatccggta

SEQ ID NO: 348329 - DNA, 25 bp, Mus musculus
ggtgccaatcatccggtaggccctg

SEQ ID NO: 348330 - DNA, 25 bp, Mus musculus
aaggagccgaacctccggaaagctg

SEQ ID NO: 348331 - DNA, 25 bp, Mus musculus
cgaacctccggaaagctggtggccg

SEQ ID NO: 348332 - DNA, 25 bp, Mus musculus
aggtcacggtcctgtccagccgtct

SEQ ID NO: 348333 - DNA, 25 bp, Mus musculus
tgacccgggtgacaggtgcttgtcc

SEQ ID NO: 348334 - DNA, 25 bp, Mus musculus
cccgggctgcatggcttatgcctgc

SEQ ID NO: 348335 - DNA, 25 bp, Mus musculus
gcttatgcctgccttccgaaatctg

SEQ ID NO: 348336 - DNA, 25 bp, Mus musculus
ttccgaaatctgacaccgacgcatg

SEQ ID NO: 348337 - DNA, 25 bp, Mus musculus
ccgacgcatgtagcatcacgtattt

SEQ ID NO: 348338 - DNA, 25 bp, Mus musculus
atcacgtatttgctttgctctacgc

SEQ ID NO: 348339 - DNA, 25 bp, Mus musculus
tcgttcactcagcaccgagggagcc

SEQ ID NO: 348340 - DNA, 25 bp, Mus musculus
cccagcggaattagcgccatcgtga

SEQ ID NO: 348341 - DNA, 25 bp, Mus musculus
aacacgcagtcgtccttccctttcg

SEQ ID NO: 348342 - DNA, 25 bp, Mus musculus
cggcagctcggaaagttgccgccgc

SEQ ID NO: 348343 - DNA, 25 bp, Mus musculus
cgatcccaggaggaaacacccaaca

SEQ ID NO: 348344 - DNA, 25 bp, Mus musculus
ttcgcgatcccaggaggaaacaccc

SEQ ID NO: 348345 - DNA, 25 bp, Mus musculus
cttccctttcgcgatcccaggagga

SEQ ID NO: 348346 - DNA, 25 bp, Mus musculus
tggggcgcagcccactgaaaccgtc

SEQ ID NO: 348347 - DNA, 25 bp, Mus musculus
ccgggcttttcagttctggggcgca

SEQ ID NO: 348348 - DNA, 25 bp, Mus musculus
accgcctcgtctcgccgcgtgttac

SEQ ID NO: 348349 - DNA, 25 bp, Mus musculus
gagtgcgctcacgtccagagccagg

SEQ ID NO: 348350 - DNA, 25 bp, Mus musculus
gtggagccgagtgcgctcacgtcca

SEQ ID NO: 348351 - DNA, 25 bp, Mus musculus
aggagatattgcacgtgccgcagag

SEQ ID NO: 348352 - DNA, 25 bp, Mus musculus
actcaccgcggcagctcggaaagtt

SEQ ID NO: 348353 - DNA, 25 bp, Mus musculus
aattagcgccatcgtgaggccggga

SEQ ID NO: 348354 - DNA, 25 bp, Mus musculus
tttggggatagttccgcttgacttg

SEQ ID NO: 348355 - DNA, 25 bp, Mus musculus
cctggaatagtctcggcggagctta

SEQ ID NO: 348356 - DNA, 25 bp, Mus musculus
cttcccttgtctggtccctggaata

SEQ ID NO: 348357 - DNA, 25 bp, Mus musculus
gctcttcccacctgcagattcgggg

SEQ ID NO: 348358 - DNA, 25 bp, Mus musculus
ctgcaaactgcaacccgggtggctg

SEQ ID NO: 348359 - DNA, 25 bp, Mus musculus
acacggcgcgcttgagcaaacttcg

SEQ ID NO: 348360 - DNA, 25 bp, Mus musculus
gtccagactgtcctatttggggata

SEQ ID NO: 348361 - DNA, 25 bp, Mus musculus
accgctgttggggtgttgtccagac

SEQ ID NO: 348362 - DNA, 25 bp, Mus musculus
cgcaggactgctcctagctggagca

SEQ ID NO: 348363 - DNA, 25 bp, Mus musculus
taaagcgctgacttgctgatttggg

SEQ ID NO: 348364 - DNA, 25 bp, Mus musculus
cccgggtcactcctataaagcgctg

SEQ ID NO: 348365 - DNA, 25 bp, Mus musculus
gcacagcttctagactcccgggtca

SEQ ID NO: 348366 - DNA, 25 bp, Mus musculus
acggatggggcacagcttctagact

SEQ ID NO: 348367 - DNA, 25 bp, Mus musculus
gcaaacttcgcggagctgcaaactg

SEQ ID NO: 348368 - DNA, 25 bp, Mus musculus
ttggagttcatcttgtaggtggagc

SEQ ID NO: 348369 - DNA, 25 bp, Mus musculus
cactcgggagtctcacgttctccta

SEQ ID NO: 348370 - DNA, 25 bp, Mus musculus
tgaacgccactacgttccggcactt

SEQ ID NO: 348371 - DNA, 25 bp, Mus musculus
gcttcctgcttgaacgccactacgt

SEQ ID NO: 348372 - DNA, 25 bp, Mus musculus
gttccaagaacctaggcggccgcca

SEQ ID NO: 348373 - DNA, 25 bp, Mus musculus
ccgctgcctatcttcgttccaagaa

SEQ ID NO: 348374 - DNA, 25 bp, Mus musculus
cgcgccagtttgctcttggaacacc

SEQ ID NO: 348375 - DNA, 25 bp, Mus musculus
cggaacctcggagtttggctcgatc

SEQ ID NO: 348376 - DNA, 25 bp, Mus musculus
gcgtttcttcgccttggagttcatc

SEQ ID NO: 348377 - DNA, 25 bp, Mus musculus
agtgggcagtaccacgcgtttcttc

SEQ ID NO: 348378 - DNA, 25 bp, Mus musculus
ctccaggatctgctccaccgtggga

SEQ ID NO: 348379 - DNA, 25 bp, Mus musculus
ccagggcagtgaaaacaggatcttg

SEQ ID NO: 348380 - DNA, 25 bp, Mus musculus
aaaacaggatcttgagcgggtgccc

SEQ ID NO: 348381 - DNA, 25 bp, Mus musculus
tttggctcgatctccgcgccagttt

SEQ ID NO: 348382 - DNA, 25 bp, Mus musculus
tctcgcccgagagaggcagaacgca

SEQ ID NO: 348383 - DNA, 25 bp, Mus musculus
cgcgtgcgccacaaccatagagttt

SEQ ID NO: 348384 - DNA, 25 bp, Mus musculus
tcccgcaagtcttcagggcgcaggc

SEQ ID NO: 348385 - DNA, 25 bp, Mus musculus
caccgccgcctgtgcgataaaagtc

SEQ ID NO: 348386 - DNA, 25 bp, Mus musculus
cgccaaggaaccgaacacaagcctg

SEQ ID NO: 348387 - DNA, 25 bp, Mus musculus
acagaaaagacatgcgctcctcatc

SEQ ID NO: 348388 - DNA, 25 bp, Mus musculus
actcctcttaaaggcggagaacaga

SEQ ID NO: 348389 - DNA, 25 bp, Mus musculus
gttcacctcgcgactcctcttaaag

SEQ ID NO: 348390 - DNA, 25 bp, Mus musculus
gtcccagtcggtgctgttcacctcg

SEQ ID NO: 348391 - DNA, 25 bp, Mus musculus
gcccatcttgctgtcccagtcggtg

SEQ ID NO: 348392 - DNA, 25 bp, Mus musculus
tggctcagcaccaacggagcccaga

SEQ ID NO: 348393 - DNA, 25 bp, Mus musculus
ccttgcgctggaaggcctcctgcaa

SEQ ID NO: 348394 - DNA, 25 bp, Mus musculus
agcaggtcctgcagcaccgtagcca

SEQ ID NO: 348395 - DNA, 25 bp, Mus musculus
gaccttctctccgtggcctttgtgc

SEQ ID NO: 348396 - DNA, 25 bp, Mus musculus
ggctgcgtttccgacttcgccctgg

SEQ ID NO: 348397 - DNA, 25 bp, Mus musculus
cgatgctgggacagtcgtggaatct

SEQ ID NO: 348398 - DNA, 25 bp, Mus musculus
gctttcgttactgcgccggggccga

SEQ ID NO: 348399 - DNA, 25 bp, Mus musculus
ccgaccggcaggctcttccataggt

SEQ ID NO: 348400 - DNA, 25 bp, Mus musculus
ctcttccataggtggctgcgtttcc

SEQ ID NO: 348401 - DNA, 25 bp, Mus musculus
tggaagcttccaaacttcctgggaa

SEQ ID NO: 348402 - DNA, 25 bp, Mus musculus
ctgtgggtggaagcttccaaacttc

SEQ ID NO: 348403 - DNA, 25 bp, Mus musculus
gcctgggcgacgctttcgttactgc

SEQ ID NO: 348404 - DNA, 25 bp, Mus musculus
ggggcttgacgtgcaaacttcgccg

SEQ ID NO: 348405 - DNA, 25 bp, Mus musculus
caaacttcgccggagcgagcagaga

SEQ ID NO: 348406 - DNA, 25 bp, Mus musculus
acaggaggcgcctccgcttaaggga

SEQ ID NO: 348407 - DNA, 25 bp, Mus musculus
tggtgagtgtccacgcctcctggtt

SEQ ID NO: 348408 - DNA, 25 bp, Mus musculus
cccagtcccgaagcgatgctgggac

SEQ ID NO: 348409 - DNA, 25 bp, Mus musculus
ccctttttgttacattgtaggagcg

SEQ ID NO: 348410 - DNA, 25 bp, Mus musculus
cgccgcgacaagaatccagaacttt

SEQ ID NO: 348411 - DNA, 25 bp, Mus musculus
ccagaacttttctgggagtgaggaa

SEQ ID NO: 348412 - DNA, 25 bp, Mus musculus
ggagtgaggaaatccagagaacttt

SEQ ID NO: 348413 - DNA, 25 bp, Mus musculus
cactaagcgtcaagtcgccgcgaca

SEQ ID NO: 348414 - DNA, 25 bp, Mus musculus
ccagagaacttttttaggagtgagg

SEQ ID NO: 348415 - DNA, 25 bp, Mus musculus
gagtgaggggacagccatccttcgt

SEQ ID NO: 348416 - DNA, 25 bp, Mus musculus
caaggaaatgtcctgagagccgggc

SEQ ID NO: 348417 - DNA, 25 bp, Mus musculus
aggttggaggtaccactaagcgtca

SEQ ID NO: 348418 - DNA, 25 bp, Mus musculus
agggtttcggatgagctgacaccat

SEQ ID NO: 348419 - DNA, 25 bp, Mus musculus
ctcccgaagcgcagacttctatata

SEQ ID NO: 348420 - DNA, 25 bp, Mus musculus
cttctatatagctttgcgttgctgc

SEQ ID NO: 348421 - DNA, 25 bp, Mus musculus
tttgcgttgctgcttgctgtgctac

SEQ ID NO: 348422 - DNA, 25 bp, Mus musculus
ctgcttgctgtgctacaggtgagtg

SEQ ID NO: 348423 - DNA, 25 bp, Mus musculus
atccttcgtggcttttgggagctga

SEQ ID NO: 348424 - DNA, 25 bp, Mus musculus
gcgctcctgcagcaccaggatgaca

SEQ ID NO: 348425 - DNA, 25 bp, Mus musculus
attgcgcagatgtgatttccagaac

SEQ ID NO: 348426 - DNA, 25 bp, Mus musculus
ctgcacattgcgcagatgtgatttc

SEQ ID NO: 348427 - DNA, 25 bp, Mus musculus
gccgctgcacattgcgcagatgtga

SEQ ID NO: 348428 - DNA, 25 bp, Mus musculus
gaggccgctgcacattgcgcagatg

SEQ ID NO: 348429 - DNA, 25 bp, Mus musculus
agtagaggccgctgcacattgcgca

SEQ ID NO: 348430 - DNA, 25 bp, Mus musculus
tgcttgcagtagaggccgctgcaca

SEQ ID NO: 348431 - DNA, 25 bp, Mus musculus
catccgcacagagcgggtcttccag

SEQ ID NO: 348432 - DNA, 25 bp, Mus musculus
ctgcagcaccaggatgacatccgca

SEQ ID NO: 348433 - DNA, 25 bp, Mus musculus
agcaccaggatgacatccgcacaga

SEQ ID NO: 348434 - DNA, 25 bp, Mus musculus
ccaggatgacatccgcacagagcgg

SEQ ID NO: 348435 - DNA, 25 bp, Mus musculus
tgacatccgcacagagcgggtcttc

SEQ ID NO: 348436 - DNA, 25 bp, Mus musculus
gggcggggcactcctcgctgctgga

SEQ ID NO: 348437 - DNA, 25 bp, Mus musculus
gggatcgggcaccacgatgatgggg

SEQ ID NO: 348438 - DNA, 25 bp, Mus musculus
acgctgctgctctgtgctggagacc

SEQ ID NO: 348439 - DNA, 25 bp, Mus musculus
acgcgcgcagccttaagacgccgag

SEQ ID NO: 348440 - DNA, 25 bp, Mus musculus
gcccaatgtcatggaggctcgcgga

SEQ ID NO: 348441 - DNA, 25 bp, Mus musculus
gacccgggcgcccaatgtcatggag

SEQ ID NO: 348442 - DNA, 25 bp, Mus musculus
tccggatcagcatctccgcgcgacc

SEQ ID NO: 348443 - DNA, 25 bp, Mus musculus
gcagccactgcctcttccggatcag

SEQ ID NO: 348444 - DNA, 25 bp, Mus musculus
tcggaccgcggcacgtgagcagcct

SEQ ID NO: 348445 - DNA, 25 bp, Mus musculus
tctggcacaggagccctggtcggac

SEQ ID NO: 348446 - DNA, 25 bp, Mus musculus
aaactctggcacaggagccctggtc

SEQ ID NO: 348447 - DNA, 25 bp, Mus musculus
tcagaagaaactctggcacaggagc

SEQ ID NO: 348448 - DNA, 25 bp, Mus musculus
gttcaggtacgatcagaagaaactc

SEQ ID NO: 348449 - DNA, 25 bp, Mus musculus
ggtcccggttcaggtacgatcagaa

SEQ ID NO: 348450 - DNA, 25 bp, Mus musculus
ctggagacccagactcctggggtcc

SEQ ID NO: 348451 - DNA, 25 bp, Mus musculus
tctgtgctggagacccagactcctg

SEQ ID NO: 348452 - DNA, 25 bp, Mus musculus
cggatccgctccttgtatggctctt

SEQ ID NO: 348453 - DNA, 25 bp, Mus musculus
gctgcatgccctgattccggccgaa

SEQ ID NO: 348454 - DNA, 25 bp, Mus musculus
tcacaatgcgcagctagggagttcc

SEQ ID NO: 348455 - DNA, 25 bp, Mus musculus
gagggagtgaggttgtcatccaccc

SEQ ID NO: 348456 - DNA, 25 bp, Mus musculus
ccttccctaagagctagaggagatc

SEQ ID NO: 348457 - DNA, 25 bp, Mus musculus
cctctagagcacaggaatgggtagc

SEQ ID NO: 348458 - DNA, 25 bp, Mus musculus
accggaatctgcagccaaatagagc

SEQ ID NO: 348459 - DNA, 25 bp, Mus musculus
ccgttcttcccttttccactggatg

SEQ ID NO: 348460 - DNA, 25 bp, Mus musculus
gctacagtctgtgcggttcctttaa

SEQ ID NO: 348461 - DNA, 25 bp, Mus musculus
cgcctctctaggtgacgctacagtc

SEQ ID NO: 348462 - DNA, 25 bp, Mus musculus
gccagagctcgaggctaatttttca

SEQ ID NO: 348463 - DNA, 25 bp, Mus musculus
cgcggccactgaggagggaatcctc

SEQ ID NO: 348464 - DNA, 25 bp, Mus musculus
gtgcccaaagcttgcgggtacccta

SEQ ID NO: 348465 - DNA, 25 bp, Mus musculus
caaaatatgcaaatccggggaccgg

SEQ ID NO: 348466 - DNA, 25 bp, Mus musculus
tagcctcatgagtgccggcatcttg

SEQ ID NO: 348467 - DNA, 25 bp, Mus musculus
tcaaagacaagcagatccacccggg

SEQ ID NO: 348468 - DNA, 25 bp, Mus musculus
tggagaccatcaaggccttcaaaga

SEQ ID NO: 348469 - DNA, 25 bp, Mus musculus
gacatgggctccattccggaacata

SEQ ID NO: 348470 - DNA, 25 bp, Mus musculus
gccggccttggacagcaatcttttc

SEQ ID NO: 348471 - DNA, 25 bp, Mus musculus
tctctactcggagcccgtgtctttc

SEQ ID NO: 348472 - DNA, 25 bp, Mus musculus
tccttattccaactgcggcgatctc

SEQ ID NO: 348473 - DNA, 25 bp, Mus musculus
tacgcagacgtccacggctagcatg

SEQ ID NO: 348474 - DNA, 25 bp, Mus musculus
ctggtgccaggacaacatcattagc

SEQ ID NO: 348475 - DNA, 25 bp, Mus musculus
ggtctgaccaacgagaagcccaatc

SEQ ID NO: 348476 - DNA, 25 bp, Mus musculus
ctccgcagagaatgtgatggacatc

SEQ ID NO: 348477 - DNA, 25 bp, Mus musculus
aacaatgctctcttgcgcgcgtgcg

SEQ ID NO: 348478 - DNA, 25 bp, Mus musculus
cccacctcgggaagaacaacaatgc

SEQ ID NO: 348479 - DNA, 25 bp, Mus musculus
cggctagcatggtgcagcctcctca

SEQ ID NO: 348480 - DNA, 25 bp, Mus musculus
gtcccgcaaagaaagtccgcctcaa

SEQ ID NO: 348481 - DNA, 25 bp, Mus musculus
ccagactcccgaggaggatccctta

SEQ ID NO: 348482 - DNA, 25 bp, Mus musculus
agccctgctcctaagcggttccggg

SEQ ID NO: 348483 - DNA, 25 bp, Mus musculus
tttaggaccatgagctggtgagtga

SEQ ID NO: 348484 - DNA, 25 bp, Mus musculus
tgatcctcgagaacctacttttcta

SEQ ID NO: 348485 - DNA, 25 bp, Mus musculus
tccggaagtgatcctcgagaaccta

SEQ ID NO: 348486 - DNA, 25 bp, Mus musculus
ggaggctccatctctcggccagact

SEQ ID NO: 348487 - DNA, 25 bp, Mus musculus
gactggccgaatccggaagtgatcc

SEQ ID NO: 348488 - DNA, 25 bp, Mus musculus
tcatcacttcctggagactggccga

SEQ ID NO: 348489 - DNA, 25 bp, Mus musculus
ggcgtgtccctcatcacttcctgga

SEQ ID NO: 348490 - DNA, 25 bp, Mus musculus
gttccgggagcctcctcggtgctct

SEQ ID NO: 348491 - DNA, 25 bp, Mus musculus
gtccgcctcaaacaacaagagaaca

SEQ ID NO: 348492 - DNA, 25 bp, Mus musculus
ggagcgcaaccacgtcccgcaaaga

SEQ ID NO: 348493 - DNA, 25 bp, Mus musculus
gagaacaaagtgttaacgcgtgggc

SEQ ID NO: 348494 - DNA, 25 bp, Mus musculus
cctcgccacccgagagagacggaga

SEQ ID NO: 348495 - DNA, 25 bp, Mus musculus
gccttcccagatccgataatgcctt

SEQ ID NO: 348496 - DNA, 25 bp, Mus musculus
catcccgctccaactgtggaacgga

SEQ ID NO: 348497 - DNA, 25 bp, Mus musculus
ggatatggtacctccctcttctcca

SEQ ID NO: 348498 - DNA, 25 bp, Mus musculus
cggaaacgcctctccggaagagaga

SEQ ID NO: 348499 - DNA, 25 bp, Mus musculus
actggcgcatcttcgccgttcggac

SEQ ID NO: 348500 - DNA, 25 bp, Mus musculus
ggctctttccgcgactggcgcatct

SEQ ID NO: 348501 - DNA, 25 bp, Mus musculus
agtccagaggggctcggctctttcc

SEQ ID NO: 348502 - DNA, 25 bp, Mus musculus
ttcacggcgcgaggtttctcctcct

SEQ ID NO: 348503 - DNA, 25 bp, Mus musculus
ggaagcccgccaggcgtctttagga

SEQ ID NO: 348504 - DNA, 25 bp, Mus musculus
aacactccacgcagggccggggcaa

SEQ ID NO: 348505 - DNA, 25 bp, Mus musculus
aactgtggaacggaagtgcgccttc

SEQ ID NO: 348506 - DNA, 25 bp, Mus musculus
gaccactggtcggaagctgccactc

SEQ ID NO: 348507 - DNA, 25 bp, Mus musculus
ccgataatgccttcggaagccgagc

SEQ ID NO: 348508 - DNA, 25 bp, Mus musculus
gggtcggttcaaatgacaaaccatc

SEQ ID NO: 348509 - DNA, 25 bp, Mus musculus
gaagagcagaccctcctgaaaaccg

SEQ ID NO: 348510 - DNA, 25 bp, Mus musculus
acctggctgccgcttgcctgtcggg

SEQ ID NO: 348511 - DNA, 25 bp, Mus musculus
agccgtctgtccgactctagggaga

SEQ ID NO: 348512 - DNA, 25 bp, Mus musculus
tccgactctagggagagctcgcccg

SEQ ID NO: 348513 - DNA, 25 bp, Mus musculus
ggcgagcgagaagagcagaccctcc

SEQ ID NO: 348514 - DNA, 25 bp, Mus musculus
cctgaaaaccgcctctagactgaga

SEQ ID NO: 348515 - DNA, 25 bp, Mus musculus
tctagactgagacccttccgaggtg

SEQ ID NO: 348516 - DNA, 25 bp, Mus musculus
gagacccttccgaggtgtccacatc

SEQ ID NO: 348517 - DNA, 25 bp, Mus musculus
tccggactgtccctaagcacagggg

SEQ ID NO: 348518 - DNA, 25 bp, Mus musculus
agtatacagagactgcgtcccaccc

SEQ ID NO: 348519 - DNA, 25 bp, Mus musculus
cccacaataggaaaggatccctcga

SEQ ID NO: 348520 - DNA, 25 bp, Mus musculus
caataggaaaggatccctcgatgtc

SEQ ID NO: 348521 - DNA, 25 bp, Mus musculus
aggtgtccacatcctccggactgtc

SEQ ID NO: 348522 - DNA, 25 bp, Mus musculus
ggggcattctgcctaccttggacta

SEQ ID NO: 348523 - DNA, 25 bp, Mus musculus
gaaagctggacctgcacgtgctcga

SEQ ID NO: 348524 - DNA, 25 bp, Mus musculus
gcgagccatctgagcactgcggtca

SEQ ID NO: 348525 - DNA, 25 bp, Mus musculus
actgcggtcacgttcttcggcacca

SEQ ID NO: 348526 - DNA, 25 bp, Mus musculus
ttcggcaccagcatccaagtcagga

SEQ ID NO: 348527 - DNA, 25 bp, Mus musculus
tgtctaagggcctgagggcactctt

SEQ ID NO: 348528 - DNA, 25 bp, Mus musculus
aaactgaggtttcggggcattctgc

SEQ ID NO: 348529 - DNA, 25 bp, Mus musculus
tacaacaaagcgcaaggtggagacc

SEQ ID NO: 348530 - DNA, 25 bp, Mus musculus
tggagacctggacagaatcgcccgc

SEQ ID NO: 348531 - DNA, 25 bp, Mus musculus
gtgcaccacccgaatggcacatttc

SEQ ID NO: 348532 - DNA, 25 bp, Mus musculus
catttcttctgaggcttagtgggca

SEQ ID NO: 348533 - DNA, 25 bp, Mus musculus
cgtccagcagcccatagccataatg

SEQ ID NO: 348534 - DNA, 25 bp, Mus musculus
ctgtaggtccctccaggtcaggagc

SEQ ID NO: 348535 - DNA, 25 bp, Mus musculus
gggcactctttcctcggatgggtaa

SEQ ID NO: 348536 - DNA, 25 bp, Mus musculus
atccctggaactgcgactagggtcg

SEQ ID NO: 348537 - DNA, 25 bp, Mus musculus
cttgggatccctggaactgcgacta

SEQ ID NO: 348538 - DNA, 25 bp, Mus musculus
ctccaagccgggctgctcaaggggc

SEQ ID NO: 348539 - DNA, 25 bp, Mus musculus
gctgccgcgagccttcacgcaggga

SEQ ID NO: 348540 - DNA, 25 bp, Mus musculus
ccttcacgcagggaggaggcgccaa

SEQ ID NO: 348541 - DNA, 25 bp, Mus musculus
ccactaaagtcctcctcggcttagg

SEQ ID NO: 348542 - DNA, 25 bp, Mus musculus
ctcggcttaggacaggtggcctcag

SEQ ID NO: 348543 - DNA, 25 bp, Mus musculus
gagcctctaccactcaccgggctga

SEQ ID NO: 348544 - DNA, 25 bp, Mus musculus
tcgtggagcctgagagttctgcaca

SEQ ID NO: 348545 - DNA, 25 bp, Mus musculus
tctgcacagggacaccggacgtgat

SEQ ID NO: 348546 - DNA, 25 bp, Mus musculus
accggacgtgatcagagcctgggac

SEQ ID NO: 348547 - DNA, 25 bp, Mus musculus
agtgacaccacctcctccggaaaag

SEQ ID NO: 348548 - DNA, 25 bp, Mus musculus
cctgagagttctgcacagggacacc

SEQ ID NO: 348549 - DNA, 25 bp, Mus musculus
ctccggaaaagttcgcagctcggga

SEQ ID NO: 348550 - DNA, 25 bp, Mus musculus
tcacggccctcgtgactggtcagga

SEQ ID NO: 348551 - DNA, 25 bp, Mus musculus
ccctcgtgactggtcaggacgctgg

SEQ ID NO: 348552 - DNA, 25 bp, Mus musculus
cctttgcatcgctgaacctaccttc

SEQ ID NO: 348553 - DNA, 25 bp, Mus musculus
ctcggcgcccaacaaggaagagagc

SEQ ID NO: 348554 - DNA, 25 bp, Mus musculus
ctaggaggcaggaccctgagatgaa

SEQ ID NO: 348555 - DNA, 25 bp, Mus musculus
gcaggaccctgagatgaatgcggca

SEQ ID NO: 348556 - DNA, 25 bp, Mus musculus
tttgggacttggatttgaactgtga

SEQ ID NO: 348557 - DNA, 25 bp, Mus musculus
atttgaactgtgagccggggctatg

SEQ ID NO: 348558 - DNA, 25 bp, Mus musculus
ctatgctggagtaaagtggagatgc

SEQ ID NO: 348559 - DNA, 25 bp, Mus musculus
agtggagatgcctgctactccctca

SEQ ID NO: 348560 - DNA, 25 bp, Mus musculus
tctgtccggcgacgcgccacgggaa

SEQ ID NO: 348561 - DNA, 25 bp, Mus musculus
gacgcgccacgggaacactgtggcc

SEQ ID NO: 348562 - DNA, 25 bp, Mus musculus
ggagggactctacgccttcgctccg

SEQ ID NO: 348563 - DNA, 25 bp, Mus musculus
tccggtccacgccaggctatgtctt

SEQ ID NO: 348564 - DNA, 25 bp, Mus musculus
agagccgccagtctgacttccggtc

SEQ ID NO: 348565 - DNA, 25 bp, Mus musculus
cacaggagccggctgacagaaccaa

SEQ ID NO: 348566 - DNA, 25 bp, Mus musculus
tttctagcggcatggctacagcaca

SEQ ID NO: 348567 - DNA, 25 bp, Mus musculus
tgggcagtccctcttcttctaggtt

SEQ ID NO: 348568 - DNA, 25 bp, Mus musculus
tgctccggcaggctaagcagaaacc

SEQ ID NO: 348569 - DNA, 25 bp, Mus musculus
tggcctcactgttttcccggacggc

SEQ ID NO: 348570 - DNA, 25 bp, Mus musculus
tccatgaagcctcgaccggagacgc

SEQ ID NO: 348571 - DNA, 25 bp, Mus musculus
gcctccctaggggtctccatgaagc

SEQ ID NO: 348572 - DNA, 25 bp, Mus musculus
ggggaagaacccactaaggcaagca

SEQ ID NO: 348573 - DNA, 25 bp, Mus musculus
gacaagcacccgaggcttccctgga

SEQ ID NO: 348574 - DNA, 25 bp, Mus musculus
ggcatcactaaagccgcggcgcctt

SEQ ID NO: 348575 - DNA, 25 bp, Mus musculus
ggcagctaaacaccgacaggcatca

SEQ ID NO: 348576 - DNA, 25 bp, Mus musculus
agaaccctgactgtcccttggccgg

SEQ ID NO: 348577 - DNA, 25 bp, Mus musculus
cgattcgactcgactactagggaca

SEQ ID NO: 348578 - DNA, 25 bp, Mus musculus
cgcctccgcgctcacaacttcccgg

SEQ ID NO: 348579 - DNA, 25 bp, Mus musculus
tcgtggagaactgagggcgcctcac

SEQ ID NO: 348580 - DNA, 25 bp, Mus musculus
taggtacccgtccagcagtcaccgg

SEQ ID NO: 348581 - DNA, 25 bp, Mus musculus
gcgcgctcggcacctttgatgacgc

SEQ ID NO: 348582 - DNA, 25 bp, Mus musculus
ggcacctttgatgacgcgctcggtc

SEQ ID NO: 348583 - DNA, 25 bp, Mus musculus
atgacgcgctcggtcgtggagaact

SEQ ID NO: 348584 - DNA, 25 bp, Mus musculus
ggtcgctctatccacctcccgctag

SEQ ID NO: 348585 - DNA, 25 bp, Mus musculus
actgagggcgcctcacggacatggt

SEQ ID NO: 348586 - DNA, 25 bp, Mus musculus
cgaccgcgtcgagagctacggcgac

SEQ ID NO: 348587 - DNA, 25 bp, Mus musculus
acacaactagggagaccgcggctgc

SEQ ID NO: 348588 - DNA, 25 bp, Mus musculus
gcgcacgcgcggatctcgggtctca

SEQ ID NO: 348589 - DNA, 25 bp, Mus musculus
tcgggtctcagctccggattcactg

SEQ ID NO: 348590 - DNA, 25 bp, Mus musculus
tcagctccggattcactgctgaccg

SEQ ID NO: 348591 - DNA, 25 bp, Mus musculus
cgaccgcggctgagggacacaacta

SEQ ID NO: 348592 - DNA, 25 bp, Mus musculus
cacagctactgagtgggtgcgtccc

SEQ ID NO: 348593 - DNA, 25 bp, Mus musculus
ttctctggttcacacatcccgggcc

SEQ ID NO: 348594 - DNA, 25 bp, Mus musculus
gccctgcagctgaagggacagcgca

SEQ ID NO: 348595 - DNA, 25 bp, Mus musculus
tcgccaccgtggcacggcaatcagg

SEQ ID NO: 348596 - DNA, 25 bp, Mus musculus
cggcaatcaggtgctaccaggactg

SEQ ID NO: 348597 - DNA, 25 bp, Mus musculus
tcaggtgctaccaggactgggctca

SEQ ID NO: 348598 - DNA, 25 bp, Mus musculus
gcgcggcctcccgaaaagactctgg

SEQ ID NO: 348599 - DNA, 25 bp, Mus musculus
tgccacgtgggaccgccagctaaca

SEQ ID NO: 348600 - DNA, 25 bp, Mus musculus
ggaccgccagctaacagcgtcgtta

SEQ ID NO: 348601 - DNA, 25 bp, Mus musculus
agcgtcgttaccctggccaacctgg

SEQ ID NO: 348602 - DNA, 25 bp, Mus musculus
tggccaacctggtcctccagcgttg

SEQ ID NO: 348603 - DNA, 25 bp, Mus musculus
acctggtcctccagcgttgtgcatc

SEQ ID NO: 348604 - DNA, 25 bp, Mus musculus
aaaagactctgggtcctcggcgtgc

SEQ ID NO: 348605 - DNA, 25 bp, Mus musculus
ggtcctcggcgtgccggtgtctcca

SEQ ID NO: 348606 - DNA, 25 bp, Mus musculus
agatgccaacccaaaagggtgggcg

SEQ ID NO: 348607 - DNA, 25 bp, Mus musculus
tgggcgggccctggctgagagcgcc

SEQ ID NO: 348608 - DNA, 25 bp, Mus musculus
gggcagatgccaacccaaaagggtg

SEQ ID NO: 348609 - DNA, 25 bp, Mus musculus
cccaggccacctcgtgcccgtgggg

SEQ ID NO: 348610 - DNA, 25 bp, Mus musculus
ataacgaattccagtccaccctgac

SEQ ID NO: 348611 - DNA, 25 bp, Mus musculus
gaataacgaattccagtccaccctg

SEQ ID NO: 348612 - DNA, 25 bp, Mus musculus
acactcggcctggaataacgaattc

SEQ ID NO: 348613 - DNA, 25 bp, Mus musculus
ccagcccctgcgttcctcccacaca

SEQ ID NO: 348614 - DNA, 25 bp, Mus musculus
ctctctcctggagccacctcctttc

SEQ ID NO: 348615 - DNA, 25 bp, Mus musculus
tctcgctctctcctggagccacctc

SEQ ID NO: 348616 - DNA, 25 bp, Mus musculus
cccgatgcgagcgctccctctctcg

SEQ ID NO: 348617 - DNA, 25 bp, Mus musculus
cacacactcggcctggaataacgaa

SEQ ID NO: 348618 - DNA, 25 bp, Mus musculus
cggcctggaataacgaattccagtc

SEQ ID NO: 348619 - DNA, 25 bp, Mus musculus
actcggcctggaataacgaattcca

SEQ ID NO: 348620 - DNA, 25 bp, Mus musculus
agtatttatccgacggtgcctcgcc

SEQ ID NO: 348621 - DNA, 25 bp, Mus musculus
gtggtcattgcaccttcgggctcga

SEQ ID NO: 348622 - DNA, 25 bp, Mus musculus
ccctgcgttgaccttggcgtggtca

SEQ ID NO: 348623 - DNA, 25 bp, Mus musculus
tccggacatagggagcttagagccc

SEQ ID NO: 348624 - DNA, 25 bp, Mus musculus
tttctatacaaacgcgctcgcaggt

SEQ ID NO: 348625 - DNA, 25 bp, Mus musculus
ctacctgctgtatgtggagtccaca

SEQ ID NO: 348626 - DNA, 25 bp, Mus musculus
gggcgtgacctgaccatagtattta

SEQ ID NO: 348627 - DNA, 25 bp, Mus musculus
tgccatcttaccctggggcggaagt

SEQ ID NO: 348628 - DNA, 25 bp, Mus musculus
aggctctgcgccgagtatcacaacc

SEQ ID NO: 348629 - DNA, 25 bp, Mus musculus
ggcaacaaagtgactccaagggctg

SEQ ID NO: 348630 - DNA, 25 bp, Mus musculus
ccgacatggttcctagaagaaagta

SEQ ID NO: 348631 - DNA, 25 bp, Mus musculus
cgccgcgtttccttccgacatggtt

SEQ ID NO: 348632 - DNA, 25 bp, Mus musculus
gcaggtaccttcttgactccgccaa

SEQ ID NO: 348633 - DNA, 25 bp, Mus musculus
gtccacactgcgcagcctctgggag

SEQ ID NO: 348634 - DNA, 25 bp, Mus musculus
agggtctttgtagttgaggagctcc

SEQ ID NO: 348635 - DNA, 25 bp, Mus musculus
gaggacgagagtagcaccgcccgcc

SEQ ID NO: 348636 - DNA, 25 bp, Mus musculus
tcttagacactggatcagcgatcga

SEQ ID NO: 348637 - DNA, 25 bp, Mus musculus
gtccgttccttcctcttagacactg

SEQ ID NO: 348638 - DNA, 25 bp, Mus musculus
gacacgctgtcaggtccgttccttc

SEQ ID NO: 348639 - DNA, 25 bp, Mus musculus
agtgcctccgggcacgggacacgct

SEQ ID NO: 348640 - DNA, 25 bp, Mus musculus
gagcctcgatcccagcctgcccacg

SEQ ID NO: 348641 - DNA, 25 bp, Mus musculus
tacaggccgctgtcctgtaccaggc

SEQ ID NO: 348642 - DNA, 25 bp, Mus musculus
ctcacccgccttgcaagggtctttg

SEQ ID NO: 348643 - DNA, 25 bp, Mus musculus
agggcgggttttcgcccagctcagc

SEQ ID NO: 348644 - DNA, 25 bp, Mus musculus
tagtcggccaagtccagcggccggc

SEQ ID NO: 348645 - DNA, 25 bp, Mus musculus
tcgtaggtgtagtcggccaagtcca

SEQ ID NO: 348646 - DNA, 25 bp, Mus musculus
tcctcgcccaggtcgtaggtgtagt

SEQ ID NO: 348647 - DNA, 25 bp, Mus musculus
taccaggcggagtgcctccgggcac

SEQ ID NO: 348648 - DNA, 25 bp, Mus musculus
tgaaaggactgcaatcagcgcccga

SEQ ID NO: 348649 - DNA, 25 bp, Mus musculus
gcagcccggaggtggaagctctcga

SEQ ID NO: 348650 - DNA, 25 bp, Mus musculus
tcaggaggaataggtggcgcctaga

SEQ ID NO: 348651 - DNA, 25 bp, Mus musculus
ggactgcaatcagcgcccgaggtca

SEQ ID NO: 348652 - DNA, 25 bp, Mus musculus
gcagccagtagttgcggtcccagtt

SEQ ID NO: 348653 - DNA, 25 bp, Mus musculus
agttgcggtcccagttccgcgcagc

SEQ ID NO: 348654 - DNA, 25 bp, Mus musculus
cctagagagcgggtggcaccagagt

SEQ ID NO: 348655 - DNA, 25 bp, Mus musculus
tcatggccgggctacgagccaggcg

SEQ ID NO: 348656 - DNA, 25 bp, Mus musculus
accctgcaggagtcatggccgggct

SEQ ID NO: 348657 - DNA, 25 bp, Mus musculus
aagctctcgagaggggcagaacagc

SEQ ID NO: 348658 - DNA, 25 bp, Mus musculus
agtagttgcggtcccagttccgcgc

SEQ ID NO: 348659 - DNA, 25 bp, Mus musculus
cggagctgaaaggactgcaatcagc

SEQ ID NO: 348660 - DNA, 25 bp, Mus musculus
ggcaccagagttgcggcagcccgga

SEQ ID NO: 348661 - DNA, 25 bp, Mus musculus
ctcgagaggggcagaacagcctgca

SEQ ID NO: 348662 - DNA, 25 bp, Mus musculus
agtgcgccgagcatcgccgctttaa

SEQ ID NO: 348663 - DNA, 25 bp, Mus musculus
gtccttttgtctccctgacctcgtc

SEQ ID NO: 348664 - DNA, 25 bp, Mus musculus
cgcctgcgcctggagcttgagcgct

SEQ ID NO: 348665 - DNA, 25 bp, Mus musculus
caggatctggttccgtgcaactttt

SEQ ID NO: 348666 - DNA, 25 bp, Mus musculus
ctggttccgtgcaacttttaagtga

SEQ ID NO: 348667 - DNA, 25 bp, Mus musculus
tgagttacaaactccgccccgagac

SEQ ID NO: 348668 - DNA, 25 bp, Mus musculus
acgaacggttctccgcggcaggaat

SEQ ID NO: 348669 - DNA, 25 bp, Mus musculus
ttctccgcggcaggaattgtgggac

SEQ ID NO: 348670 - DNA, 25 bp, Mus musculus
attgtgggactgagccgccaggatt

SEQ ID NO: 348671 - DNA, 25 bp, Mus musculus
gcctcgatcacaaggcggcttcctc

SEQ ID NO: 348672 - DNA, 25 bp, Mus musculus
tcaggggtggtgatctccgcctaca

SEQ ID NO: 348673 - DNA, 25 bp, Mus musculus
ccgtgcaacttttaagtgagttaca

SEQ ID NO: 348674 - DNA, 25 bp, Mus musculus
gcttcctctgctaggccctcggtcc

SEQ ID NO: 348675 - DNA, 25 bp, Mus musculus
tgagagctgaggtccggcctgccac

SEQ ID NO: 348676 - DNA, 25 bp, Mus musculus
ccggaccttgggacacaatcgcaca

SEQ ID NO: 348677 - DNA, 25 bp, Mus musculus
tcaggtctccgccacaggccgatcg

SEQ ID NO: 348678 - DNA, 25 bp, Mus musculus
atgcgctcgggaggtgcctcccagc

SEQ ID NO: 348679 - DNA, 25 bp, Mus musculus
caacaggccgccacacgggaacaaa

SEQ ID NO: 348680 - DNA, 25 bp, Mus musculus
ttgggacacaatcgcacaacaggcc

SEQ ID NO: 348681 - DNA, 25 bp, Mus musculus
cccatcgcagccggggcagtttgac

SEQ ID NO: 348682 - DNA, 25 bp, Mus musculus
gggcagtttgactcccagggctgca

SEQ ID NO: 348683 - DNA, 25 bp, Mus musculus
gtttgactcccagggctgcacagcg

SEQ ID NO: 348684 - DNA, 25 bp, Mus musculus
cagggctgcacagcgtgcccgactg

SEQ ID NO: 348685 - DNA, 25 bp, Mus musculus
tgcccgactgcccagtgggactctg

SEQ ID NO: 348686 - DNA, 25 bp, Mus musculus
cgactgcccagtgggactctgggct

SEQ ID NO: 348687 - DNA, 25 bp, Mus musculus
gctcagctgcccatgcgctcgggag

SEQ ID NO: 348688 - DNA, 25 bp, Mus musculus
tcgggaggtgcctcccagccagcag

SEQ ID NO: 348689 - DNA, 25 bp, Mus musculus
agcaggccggaccttgggacacaat

SEQ ID NO: 348690 - DNA, 25 bp, Mus musculus
acagccttggcccagaagctggtgc

SEQ ID NO: 348691 - DNA, 25 bp, Mus musculus
atcctgcaaattccggagtccgacc

SEQ ID NO: 348692 - DNA, 25 bp, Mus musculus
gagtacccagcaccggctagcacga

SEQ ID NO: 348693 - DNA, 25 bp, Mus musculus
cgccgtgtgccgcatcctgcaaatt

SEQ ID NO: 348694 - DNA, 25 bp, Mus musculus
gagtctcggcgtcccatggcgcaac

SEQ ID NO: 348695 - DNA, 25 bp, Mus musculus
cccaaagcgcagcacggagtctcgg

SEQ ID NO: 348696 - DNA, 25 bp, Mus musculus
ggatccttctctccctccggggaca

SEQ ID NO: 348697 - DNA, 25 bp, Mus musculus
attagccgcgctacgcggtgctgcg

SEQ ID NO: 348698 - DNA, 25 bp, Mus musculus
ccactctcagttgcgcgtctggcga

SEQ ID NO: 348699 - DNA, 25 bp, Mus musculus
gccgccgaatcacgggctcctgttt

SEQ ID NO: 348700 - DNA, 25 bp, Mus musculus
cggctgggaagctggcacactgccc

SEQ ID NO: 348701 - DNA, 25 bp, Mus musculus
agttcccgggcttggcacctatagt

SEQ ID NO: 348702 - DNA, 25 bp, Mus musculus
tcactgacccgtgagaacccgactg

SEQ ID NO: 348703 - DNA, 25 bp, Mus musculus
ccggcccatggggagcgagtaccca

SEQ ID NO: 348704 - DNA, 25 bp, Mus musculus
cggagtctgggcttccgtaatgtca

SEQ ID NO: 348705 - DNA, 25 bp, Mus musculus
ttcgtcgtgagcacttctgtggttc

SEQ ID NO: 348706 - DNA, 25 bp, Mus musculus
gccgtgttcctcaacgagcaggtga

SEQ ID NO: 348707 - DNA, 25 bp, Mus musculus
accctggtcacagtggtgttcatca

SEQ ID NO: 348708 - DNA, 25 bp, Mus musculus
tcaccctacaggcaggatgacatca

SEQ ID NO: 348709 - DNA, 25 bp, Mus musculus
gcggctgcggaagaatgtctgctac

SEQ ID NO: 348710 - DNA, 25 bp, Mus musculus
gatgacatcaccgtcggaacccgcg

SEQ ID NO: 348711 - DNA, 25 bp, Mus musculus
cgtgctgggtgaattagctaatcgc

SEQ ID NO: 348712 - DNA, 25 bp, Mus musculus
ccgataaccgctgcgagctggccaa

SEQ ID NO: 348713 - DNA, 25 bp, Mus musculus
catcggacgagtgacgccatcgacc

SEQ ID NO: 348714 - DNA, 25 bp, Mus musculus
atctgaacaggcgagccaacggccg

SEQ ID NO: 348715 - DNA, 25 bp, Mus musculus
gttccgtgttagtcttggccctcaa

SEQ ID NO: 348716 - DNA, 25 bp, Mus musculus
gcgcagcctatcagcgaccaggtct

SEQ ID NO: 348717 - DNA, 25 bp, Mus musculus
gtgccgcctgccctgatctgaacag

SEQ ID NO: 348718 - DNA, 25 bp, Mus musculus
gcacagggaacgttaaagaagccga

SEQ ID NO: 348719 - DNA, 25 bp, Mus musculus
aagcacaacaggaagcagtgcggag

SEQ ID NO: 348720 - DNA, 25 bp, Mus musculus
ctctcgaggcacagggaacgttaaa

SEQ ID NO: 348721 - DNA, 25 bp, Mus musculus
ctcaggatcacgagagtcgggctta

SEQ ID NO: 348722 - DNA, 25 bp, Mus musculus
tcgagggatcgggactcaggatcaa

SEQ ID NO: 348723 - DNA, 25 bp, Mus musculus
actcaggatcaagggagcatggctc

SEQ ID NO: 348724 - DNA, 25 bp, Mus musculus
tcaagggagcatggctcaggatcac

SEQ ID NO: 348725 - DNA, 25 bp, Mus musculus
cggaagctctcgaggcacagggaac

SEQ ID NO: 348726 - DNA, 25 bp, Mus musculus
gacacaggaagcacaacaggaagca

SEQ ID NO: 348727 - DNA, 25 bp, Mus musculus
aacgttaaagaagccgagcggagcg

SEQ ID NO: 348728 - DNA, 25 bp, Mus musculus
tcagaagagcgaggcgcaagatcga

SEQ ID NO: 348729 - DNA, 25 bp, Mus musculus
gccgcgacgcgggactgtacccgaa

SEQ ID NO: 348730 - DNA, 25 bp, Mus musculus
cgcgggactgtacccgaagacgaag

SEQ ID NO: 348731 - DNA, 25 bp, Mus musculus
cttaggatcagaagagcgaggcgca

SEQ ID NO: 348732 - DNA, 25 bp, Mus musculus
aaagagaatggaccgagagagaccc

SEQ ID NO: 348733 - DNA, 25 bp, Mus musculus
cccttagccactggaggcggtcgct

SEQ ID NO: 348734 - DNA, 25 bp, Mus musculus
ccaggagaagcaccgtgagtgcagt

SEQ ID NO: 348735 - DNA, 25 bp, Mus musculus
gtcgcaggcccaggagaagcaccgt

SEQ ID NO: 348736 - DNA, 25 bp, Mus musculus
agaccgctactcacgcgggtaagga

SEQ ID NO: 348737 - DNA, 25 bp, Mus musculus
ccggcgagcagatgagaccgctact

SEQ ID NO: 348738 - DNA, 25 bp, Mus musculus
gttgcctctctctcccggagaacgt

SEQ ID NO: 348739 - DNA, 25 bp, Mus musculus
cgccggacctggtgcctaacaggca

SEQ ID NO: 348740 - DNA, 25 bp, Mus musculus
ggctgatacgaatgtctgtcttctt

SEQ ID NO: 348741 - DNA, 25 bp, Mus musculus
tgctgattggctgatacgaatgtct

SEQ ID NO: 348742 - DNA, 25 bp, Mus musculus
tcctcctccgggctccatagaaaga

SEQ ID NO: 348743 - DNA, 25 bp, Mus musculus
accgtgagtgcagtgtcctcctccg

SEQ ID NO: 348744 - DNA, 25 bp, Mus musculus
ctccgggctccatagaaagagaatg

SEQ ID NO: 348745 - DNA, 25 bp, Mus musculus
gcgacagacccttccgagctgctga

SEQ ID NO: 348746 - DNA, 25 bp, Mus musculus
ttccatgcggcagccactggccggc

SEQ ID NO: 348747 - DNA, 25 bp, Mus musculus
cacagcgctctgtggtgtcctcatc

SEQ ID NO: 348748 - DNA, 25 bp, Mus musculus
tggtgtcctcatcccttgggcctct

SEQ ID NO: 348749 - DNA, 25 bp, Mus musculus
cgcacttggagaggacagacgtcag

SEQ ID NO: 348750 - DNA, 25 bp, Mus musculus
ccttctgcagacgttccatgcggca

SEQ ID NO: 348751 - DNA, 25 bp, Mus musculus
gctcaccttctgcagacgttccatg

SEQ ID NO: 348752 - DNA, 25 bp, Mus musculus
gggtgcaagccgctcaccttctgca

SEQ ID NO: 348753 - DNA, 25 bp, Mus musculus
actctagcacggacctgggagagca

SEQ ID NO: 348754 - DNA, 25 bp, Mus musculus
tggcgccggcgactctagcacggac

SEQ ID NO: 348755 - DNA, 25 bp, Mus musculus
ctcctgcagcgagggcgtcacagcg

SEQ ID NO: 348756 - DNA, 25 bp, Mus musculus
tcagccccagggagttgtgcgtgca

SEQ ID NO: 348757 - DNA, 25 bp, Mus musculus
ttaggctgtcaggttccgcggcgct

SEQ ID NO: 348758 - DNA, 25 bp, Mus musculus
cccagtaagggcgttaggctgtcag

SEQ ID NO: 348759 - DNA, 25 bp, Mus musculus
agaggacagacgtcaggctcggccc

SEQ ID NO: 348760 - DNA, 25 bp, Mus musculus
tccgagtgcgcttggtcctgcgagt

SEQ ID NO: 348761 - DNA, 25 bp, Mus musculus
ttcgaactgcttctgcctttcagcg

SEQ ID NO: 348762 - DNA, 25 bp, Mus musculus
gaacacgcagtctttgctcttcccg

SEQ ID NO: 348763 - DNA, 25 bp, Mus musculus
tctcggtgaacacgcagtctttgct

SEQ ID NO: 348764 - DNA, 25 bp, Mus musculus
ttctccagtacgatctcggtgaaca

SEQ ID NO: 348765 - DNA, 25 bp, Mus musculus
tgaaccagccctcgtgccgggcgtt

SEQ ID NO: 348766 - DNA, 25 bp, Mus musculus
ccctgccgagtgaaagccatgaacc

SEQ ID NO: 348767 - DNA, 25 bp, Mus musculus
aggcgcttgatgaagtgggcctctc

SEQ ID NO: 348768 - DNA, 25 bp, Mus musculus
cttctgcctttcagcgtggttggga

SEQ ID NO: 348769 - DNA, 25 bp, Mus musculus
tgaaagccatgaaccagccctcgtg

SEQ ID NO: 348770 - DNA, 25 bp, Mus musculus
ggcctctcgctggttctggcggctc

SEQ ID NO: 348771 - DNA, 25 bp, Mus musculus
gccggccctgccgagtgaaagccat

SEQ ID NO: 348772 - DNA, 25 bp, Mus musculus
atgaagtgggcctctcgctggttct

SEQ ID NO: 348773 - DNA, 25 bp, Mus musculus
gggcggagcccacaaattcgaactg

SEQ ID NO: 348774 - DNA, 25 bp, Mus musculus
ccgcaccaacctgccggtctccgtg

SEQ ID NO: 348775 - DNA, 25 bp, Mus musculus
tgatttattcctgacccgcaccaac

SEQ ID NO: 348776 - DNA, 25 bp, Mus musculus
tcttgatttattcctgacccgcacc

SEQ ID NO: 348777 - DNA, 25 bp, Mus musculus
ccctacgatctctcttgatttattc

SEQ ID NO: 348778 - DNA, 25 bp, Mus musculus
gcgtcctctatcaggaggctggccc

SEQ ID NO: 348779 - DNA, 25 bp, Mus musculus
cgagagcgtcctctatcaggaggct

SEQ ID NO: 348780 - DNA, 25 bp, Mus musculus
ggagctgcgagagcgtcctctatca

SEQ ID NO: 348781 - DNA, 25 bp, Mus musculus
tccccgggcgcaaaggattggagct

SEQ ID NO: 348782 - DNA, 25 bp, Mus musculus
tcttgggctactggcttcgggcaga

SEQ ID NO: 348783 - DNA, 25 bp, Mus musculus
actcgctctcttgggctactggctt

SEQ ID NO: 348784 - DNA, 25 bp, Mus musculus
ttggcgtactcgctctcttgggcta

SEQ ID NO: 348785 - DNA, 25 bp, Mus musculus
agctggtccgattggcgtactcgct

SEQ ID NO: 348786 - DNA, 25 bp, Mus musculus
ctgcgaagccggagctggtccgatt

SEQ ID NO: 348787 - DNA, 25 bp, Mus musculus
cgaggtgtccaccttccgggccagt

SEQ ID NO: 348788 - DNA, 25 bp, Mus musculus
cgcgcagacgcaggctttgatttca

SEQ ID NO: 348789 - DNA, 25 bp, Mus musculus
caaccgggcacatgagtccttactg

SEQ ID NO: 348790 - DNA, 25 bp, Mus musculus
ttacagccggaaacaaccgggcaca

SEQ ID NO: 348791 - DNA, 25 bp, Mus musculus
agccgctgcgcttggtgtcagctgc

SEQ ID NO: 348792 - DNA, 25 bp, Mus musculus
cgcaggctttgatttcagccgctgc

SEQ ID NO: 348793 - DNA, 25 bp, Mus musculus
aagggccgcgcaggatcacttccgg

SEQ ID NO: 348794 - DNA, 25 bp, Mus musculus
cttccgacgcaagggccgcgcagga

SEQ ID NO: 348795 - DNA, 25 bp, Mus musculus
gtgcggcgtctccttccgacgcaag

SEQ ID NO: 348796 - DNA, 25 bp, Mus musculus
atgcaacctaggtgcggcgtctcct

SEQ ID NO: 348797 - DNA, 25 bp, Mus musculus
tgcgcagcccagatgcaacctaggt

SEQ ID NO: 348798 - DNA, 25 bp, Mus musculus
gggactctgcgcagcccagatgcaa

SEQ ID NO: 348799 - DNA, 25 bp, Mus musculus
ccttactgcgcgtgcgtggaacaaa

SEQ ID NO: 348800 - DNA, 25 bp, Mus musculus
ggcacatgagtccttactgcgcgtg

SEQ ID NO: 348801 - DNA, 25 bp, Mus musculus
atttcagccgctgcgcttggtgtca

SEQ ID NO: 348802 - DNA, 25 bp, Mus musculus
cttccagcgcctcgcgtgaggcgtg

SEQ ID NO: 348803 - DNA, 25 bp, Mus musculus
taggacagtcacgaggggtcctctc

SEQ ID NO: 348804 - DNA, 25 bp, Mus musculus
tttgttaatcgctgagggccggcgc

SEQ ID NO: 348805 - DNA, 25 bp, Mus musculus
aggcgctctttttgttaatcgctga

SEQ ID NO: 348806 - DNA, 25 bp, Mus musculus
ttcgcgtggtaaggcgctctttttg

SEQ ID NO: 348807 - DNA, 25 bp, Mus musculus
cctcccggctgtgccaatgggaagt

SEQ ID NO: 348808 - DNA, 25 bp, Mus musculus
ttcgggtgctgtcatggctccaccc

SEQ ID NO: 348809 - DNA, 25 bp, Mus musculus
tgcctgtcgtttcgggtgctgtcat

SEQ ID NO: 348810 - DNA, 25 bp, Mus musculus
agcggagcacgctgcctgtcgtttc

SEQ ID NO: 348811 - DNA, 25 bp, Mus musculus
tacgctcgtggcgtagcgccgctct

SEQ ID NO: 348812 - DNA, 25 bp, Mus musculus
ttgctccattcatgctcctctcagg

SEQ ID NO: 348813 - DNA, 25 bp, Mus musculus
aattgtccacagtttgtgacctgga

SEQ ID NO: 348814 - DNA, 25 bp, Mus musculus
gatccgccattttgctccattcatg

SEQ ID NO: 348815 - DNA, 25 bp, Mus musculus
gcggctcgggaattgtccacagttt

SEQ ID NO: 348816 - DNA, 25 bp, Mus musculus
ttccggccaaggcagcaggctggtc

SEQ ID NO: 348817 - DNA, 25 bp, Mus musculus
tcaccgccgagtcgctaccactgct

SEQ ID NO: 348818 - DNA, 25 bp, Mus musculus
tctagtcggttttccggccaaggca

SEQ ID NO: 348819 - DNA, 25 bp, Mus musculus
ctgcagagtgtagctgctccgccgc

SEQ ID NO: 348820 - DNA, 25 bp, Mus musculus
taccactgctgctgcagagtgtagc

SEQ ID NO: 348821 - DNA, 25 bp, Mus musculus
tgtagcttccatcaccgccgagtcg

SEQ ID NO: 348822 - DNA, 25 bp, Mus musculus
agcgccactccggtgtagcttccat

SEQ ID NO: 348823 - DNA, 25 bp, Mus musculus
cctaggccagtgttcctgggcgcca

SEQ ID NO: 348824 - DNA, 25 bp, Mus musculus
agccagcggtggagctcacccctag

SEQ ID NO: 348825 - DNA, 25 bp, Mus musculus
cccaagggcgggcagttgagccgag

SEQ ID NO: 348826 - DNA, 25 bp, Mus musculus
ggttttccggccaaggcagcaggct

SEQ ID NO: 348827 - DNA, 25 bp, Mus musculus
ttcgttggtttgagcgtggacactg

SEQ ID NO: 348828 - DNA, 25 bp, Mus musculus
gcttcgttggtttgagcgtggacac

SEQ ID NO: 348829 - DNA, 25 bp, Mus musculus
tgctgctgcagagtgtagctgctcc

SEQ ID NO: 348830 - DNA, 25 bp, Mus musculus
accgttgtccctgcttcacctggtg

SEQ ID NO: 348831 - DNA, 25 bp, Mus musculus
aagtcacattccagaagccggcgaa

SEQ ID NO: 348832 - DNA, 25 bp, Mus musculus
gccctcggggatcaaagtcacattc

SEQ ID NO: 348833 - DNA, 25 bp, Mus musculus
agtcagcctgtgctcgcgaaaaccg

SEQ ID NO: 348834 - DNA, 25 bp, Mus musculus
ccgcgggtaaccagcgctgcaaaga

SEQ ID NO: 348835 - DNA, 25 bp, Mus musculus
cccatcaccgttgagcacgtagtgc

SEQ ID NO: 348836 - DNA, 25 bp, Mus musculus
agctaaccgacctcagtgtgcctgt

SEQ ID NO: 348837 - DNA, 25 bp, Mus musculus
ccacctgtaacagcagctcctggga

SEQ ID NO: 348838 - DNA, 25 bp, Mus musculus
gggcagccagaactcgaagtgtacg

SEQ ID NO: 348839 - DNA, 25 bp, Mus musculus
gcacctgagcctgaaaggggccata

SEQ ID NO: 348840 - DNA, 25 bp, Mus musculus
cctcggggactacaggagtctctgc

SEQ ID NO: 348841 - DNA, 25 bp, Mus musculus
tcacctggtggcagggatgcaacac

SEQ ID NO: 348842 - DNA, 25 bp, Mus musculus
gagcagggatactctggggtacaca

SEQ ID NO: 348843 - DNA, 25 bp, Mus musculus
ggtgtaaaccactcgggtgcccgca

SEQ ID NO: 348844 - DNA, 25 bp, Mus musculus
aagggctgggctgacctcaggacca

SEQ ID NO: 348845 - DNA, 25 bp, Mus musculus
gccagacacatagctacgtgtgttt

SEQ ID NO: 348846 - DNA, 25 bp, Mus musculus
ccctggactcgggatcttcaaccgg

SEQ ID NO: 348847 - DNA, 25 bp, Mus musculus
agcgagaatccctggactcgggatc

SEQ ID NO: 348848 - DNA, 25 bp, Mus musculus
ccagccagcagcgagaatccctgga

SEQ ID NO: 348849 - DNA, 25 bp, Mus musculus
gacgtcgagaggcagcccaccgccc

SEQ ID NO: 348850 - DNA, 25 bp, Mus musculus
acatagctacgtgtgtttgatttca

SEQ ID NO: 348851 - DNA, 25 bp, Mus musculus
aggcagccagacacatagctacgtg

SEQ ID NO: 348852 - DNA, 25 bp, Mus musculus
ggcttagaaggcagccagacacata

SEQ ID NO: 348853 - DNA, 25 bp, Mus musculus
ctgttggcttagaaggcagccagac

SEQ ID NO: 348854 - DNA, 25 bp, Mus musculus
gaccaggctgttggcttagaaggca

SEQ ID NO: 348855 - DNA, 25 bp, Mus musculus
actcgggatcttcaaccggcggccg

SEQ ID NO: 348856 - DNA, 25 bp, Mus musculus
ctgacctcaggaccaggctgttggc

SEQ ID NO: 348857 - DNA, 25 bp, Mus musculus
ctcaggaccaggctgttggcttaga

SEQ ID NO: 348858 - DNA, 25 bp, Mus musculus
tcagtcgcccactggaagctgggca

SEQ ID NO: 348859 - DNA, 25 bp, Mus musculus
acactcttacttgcaggccgtgata

SEQ ID NO: 348860 - DNA, 25 bp, Mus musculus
acacactcttacttgcaggccgtga

SEQ ID NO: 348861 - DNA, 25 bp, Mus musculus
attcaaaccatctccgcacgcactc

SEQ ID NO: 348862 - DNA, 25 bp, Mus musculus
ggagacttccaacattcaaaccatc

SEQ ID NO: 348863 - DNA, 25 bp, Mus musculus
ccgagaaggagacttccaacattca

SEQ ID NO: 348864 - DNA, 25 bp, Mus musculus
cggaggaccgagaaggagacttcca

SEQ ID NO: 348865 - DNA, 25 bp, Mus musculus
ctgtgcagcggctagctggttgcgc

SEQ ID NO: 348866 - DNA, 25 bp, Mus musculus
gccgaactgcctgggaggctctaga

SEQ ID NO: 348867 - DNA, 25 bp, Mus musculus
gagccgaactgcctgggaggctcta

SEQ ID NO: 348868 - DNA, 25 bp, Mus musculus
agacaccgggagatcgcgccaggct

SEQ ID NO: 348869 - DNA, 25 bp, Mus musculus
gcgcgcgttcagtcgcccactggaa

SEQ ID NO: 348870 - DNA, 25 bp, Mus musculus
cgttcagtcgcccactggaagctgg

SEQ ID NO: 348871 - DNA, 25 bp, Mus musculus
tcgcccactggaagctgggcatgcg

SEQ ID NO: 348872 - DNA, 25 bp, Mus musculus
tccacactgagtgcggtcttgggca

SEQ ID NO: 348873 - DNA, 25 bp, Mus musculus
ttgccagtaccgctcagagtgcagg

SEQ ID NO: 348874 - DNA, 25 bp, Mus musculus
gctcctgcagccttggttccatatt

SEQ ID NO: 348875 - DNA, 25 bp, Mus musculus
tggtggattcattcacttgccagta

SEQ ID NO: 348876 - DNA, 25 bp, Mus musculus
tcccgccgcaggaaatgcacttgga

SEQ ID NO: 348877 - DNA, 25 bp, Mus musculus
acgccgagcagcagcatgagaacca

SEQ ID NO: 348878 - DNA, 25 bp, Mus musculus
cacatgtcctggtagcgcccaatca

SEQ ID NO: 348879 - DNA, 25 bp, Mus musculus
taggtgcagccctcgcccaaataga

SEQ ID NO: 348880 - DNA, 25 bp, Mus musculus
cggatgacaaggacccgcgctgaca

SEQ ID NO: 348881 - DNA, 25 bp, Mus musculus
ggacatcttgatggacgcccaccca

SEQ ID NO: 348882 - DNA, 25 bp, Mus musculus
tttgccaagtgtgatccaggtccgc

SEQ ID NO: 348883 - DNA, 25 bp, Mus musculus
tcactagttggttgcgctcagtctc

SEQ ID NO: 348884 - DNA, 25 bp, Mus musculus
acagcgttggtgtcctcgaggaccc

SEQ ID NO: 348885 - DNA, 25 bp, Mus musculus
cccaggtacaggttggtgatgatcc

SEQ ID NO: 348886 - DNA, 25 bp, Mus musculus
cgcagacccgaagggcgtgttttcg

SEQ ID NO: 348887 - DNA, 25 bp, Mus musculus
cgaagtgggctcagaccttcccact

SEQ ID NO: 348888 - DNA, 25 bp, Mus musculus
tcgaggatttaaccctcaggtgcgc

SEQ ID NO: 348889 - DNA, 25 bp, Mus musculus
tcgtcctctcactcgcttggcggtg

SEQ ID NO: 348890 - DNA, 25 bp, Mus musculus
ccgccgctgcgctgactgctgtgga

SEQ ID NO: 348891 - DNA, 25 bp, Mus musculus
gcgtagctcccgctttctgtttcac

SEQ ID NO: 348892 - DNA, 25 bp, Mus musculus
tctgtttcacccgagggaccgcgaa

SEQ ID NO: 348893 - DNA, 25 bp, Mus musculus
cgccatgattactacggagccggga

SEQ ID NO: 348894 - DNA, 25 bp, Mus musculus
ggcatgcgagctccggtgccgctct

SEQ ID NO: 348895 - DNA, 25 bp, Mus musculus
gaactgtgcggatgattgacgtatc

SEQ ID NO: 348896 - DNA, 25 bp, Mus musculus
tccgaatgcagtttagaaagcgccc

SEQ ID NO: 348897 - DNA, 25 bp, Mus musculus
tcccgccgctccgaagcgaaggaag

SEQ ID NO: 348898 - DNA, 25 bp, Mus musculus
ccggcaggtgcttttagaggcaagc

SEQ ID NO: 348899 - DNA, 25 bp, Mus musculus
ccagaacttaggatgccggcaggtg

SEQ ID NO: 348900 - DNA, 25 bp, Mus musculus
ggctggcgtctttgcgcgctgccac

SEQ ID NO: 348901 - DNA, 25 bp, Mus musculus
ccggaacctcactggaggaggagac

SEQ ID NO: 348902 - DNA, 25 bp, Mus musculus
tcactggaggaggagacaaagatgc

SEQ ID NO: 348903 - DNA, 25 bp, Mus musculus
gggaggcagaaagctactcgccaac

SEQ ID NO: 348904 - DNA, 25 bp, Mus musculus
tactcgccaacgtgcaggcggctca

SEQ ID NO: 348905 - DNA, 25 bp, Mus musculus
acgtgcaggcggctcagtcactaga

SEQ ID NO: 348906 - DNA, 25 bp, Mus musculus
tcagtcactagaggggactcgcctc

SEQ ID NO: 348907 - DNA, 25 bp, Mus musculus
ctagaggggactcgcctccaaacct

SEQ ID NO: 348908 - DNA, 25 bp, Mus musculus
ccaaacctggactgggaatggagga

SEQ ID NO: 348909 - DNA, 25 bp, Mus musculus
gcttcagggacgagctagagcgagt

SEQ ID NO: 348910 - DNA, 25 bp, Mus musculus
acgacttggcttttactgctgcggc

SEQ ID NO: 348911 - DNA, 25 bp, Mus musculus
tctttgcgcgctgccaccgagtgag

SEQ ID NO: 348912 - DNA, 25 bp, Mus musculus
ttggcttttactgctgcggcggccg

SEQ ID NO: 348913 - DNA, 25 bp, Mus musculus
tggggcacgacttggcttttactgc

SEQ ID NO: 348914 - DNA, 25 bp, Mus musculus
aatttaaacacaagtcacccagagg

SEQ ID NO: 348915 - DNA, 25 bp, Mus musculus
ggagcctggagctgtaaacatagcc

SEQ ID NO: 348916 - DNA, 25 bp, Mus musculus
tgtaaacatagcctggccacgggtc

SEQ ID NO: 348917 - DNA, 25 bp, Mus musculus
gggctcgcggtccaaccacgcaagt

SEQ ID NO: 348918 - DNA, 25 bp, Mus musculus
ggacggagagtcagccttggcaaac

SEQ ID NO: 348919 - DNA, 25 bp, Mus musculus
agcgtggcctcgactccactgggcg

SEQ ID NO: 348920 - DNA, 25 bp, Mus musculus
gggagttgcaagtggcacaatgctt

SEQ ID NO: 348921 - DNA, 25 bp, Mus musculus
caagtggcacaatgcttgcatgtcc

SEQ ID NO: 348922 - DNA, 25 bp, Mus musculus
atgcttgcatgtccacctcccatga

SEQ ID NO: 348923 - DNA, 25 bp, Mus musculus
aaacctcctaaacacggtgctactg

SEQ ID NO: 348924 - DNA, 25 bp, Mus musculus
ggtgctactgactgggaaccaaatc

SEQ ID NO: 348925 - DNA, 25 bp, Mus musculus
gggaaccaaatcctcgattatctga

SEQ ID NO: 348926 - DNA, 25 bp, Mus musculus
tgcgactcacagtttcaaatttaaa

SEQ ID NO: 348927 - DNA, 25 bp, Mus musculus
gccatcttgtttgcgactcacagtt

SEQ ID NO: 348928 - DNA, 25 bp, Mus musculus
aaccctcccgtgcacgcggcgcgag

SEQ ID NO: 348929 - DNA, 25 bp, Mus musculus
tgaactcgagctcagcccgccaggc

SEQ ID NO: 348930 - DNA, 25 bp, Mus musculus
ggcgccaagtgtctgctgttcttgg

SEQ ID NO: 348931 - DNA, 25 bp, Mus musculus
gtgacgtttccaggactttccgctc

SEQ ID NO: 348932 - DNA, 25 bp, Mus musculus
gagctagcggtgacgtttccaggac

SEQ ID NO: 348933 - DNA, 25 bp, Mus musculus
gccaagtgtctgctgttcttggccc

SEQ ID NO: 348934 - DNA, 25 bp, Mus musculus
gaaggccaggcggaggcctcaccct

SEQ ID NO: 348935 - DNA, 25 bp, Mus musculus
gggcagggcgcagcgccaacccacc

SEQ ID NO: 348936 - DNA, 25 bp, Mus musculus
tggaccaggtcgctggggtagctct

SEQ ID NO: 348937 - DNA, 25 bp, Mus musculus
gtagctctgggttcacgtcccttcc

SEQ ID NO: 348938 - DNA, 25 bp, Mus musculus
cctgggaccgcgtagcggtgcgcat

SEQ ID NO: 348939 - DNA, 25 bp, Mus musculus
tccgttttgtgcgtcgccccgaggc

SEQ ID NO: 348940 - DNA, 25 bp, Mus musculus
tggtgtctccaaccctcccgtgcac

SEQ ID NO: 348941 - DNA, 25 bp, Mus musculus
acggctgtggggttcccgcttccag

SEQ ID NO: 348942 - DNA, 25 bp, Mus musculus
gaagatgggcgatgcacgcacagac

SEQ ID NO: 348943 - DNA, 25 bp, Mus musculus
gccattggtggccttctggagacaa

SEQ ID NO: 348944 - DNA, 25 bp, Mus musculus
gatcttagcgggaaagtagcttttg

SEQ ID NO: 348945 - DNA, 25 bp, Mus musculus
gcgatgcacgcacagactatagtct

SEQ ID NO: 348946 - DNA, 25 bp, Mus musculus
actatagtcttttgatggggaaaca

SEQ ID NO: 348947 - DNA, 25 bp, Mus musculus
cggtccgagcgggacagatcttagc

SEQ ID NO: 348948 - DNA, 25 bp, Mus musculus
cgggacagatcttagcgggaaagta

SEQ ID NO: 348949 - DNA, 25 bp, Mus musculus
gtagcttttgaaaaccagtttgcca

SEQ ID NO: 348950 - DNA, 25 bp, Mus musculus
ttgccaggcggacccgactttgaaa

SEQ ID NO: 348951 - DNA, 25 bp, Mus musculus
aaaatcgcttacaaacgcgtttgag

SEQ ID NO: 348952 - DNA, 25 bp, Mus musculus
caaacgcgtttgagacgaaagcaga

SEQ ID NO: 348953 - DNA, 25 bp, Mus musculus
tgagacgaaagcagaaaaccagttg

SEQ ID NO: 348954 - DNA, 25 bp, Mus musculus
caaaaacaaacgtgccgggccagtg

SEQ ID NO: 348955 - DNA, 25 bp, Mus musculus
tgaaaaccagtttgccaggcggacc

SEQ ID NO: 348956 - DNA, 25 bp, Mus musculus
cctgtcgctgcaggttcccgggcta

SEQ ID NO: 348957 - DNA, 25 bp, Mus musculus
gccttgtcggccgagctcagggcac

SEQ ID NO: 348958 - DNA, 25 bp, Mus musculus
tcccggctgcgaaggcagccttgtc

SEQ ID NO: 348959 - DNA, 25 bp, Mus musculus
gtcaccttcaccatggtgcggcctg

SEQ ID NO: 348960 - DNA, 25 bp, Mus musculus
cagcgccgagttgaacgtcaccttc

SEQ ID NO: 348961 - DNA, 25 bp, Mus musculus
ttcttggcctccttctgggccagcg

SEQ ID NO: 348962 - DNA, 25 bp, Mus musculus
gctgctcttgggctcgtccttcttg

SEQ ID NO: 348963 - DNA, 25 bp, Mus musculus
atgagcgcctcctcgctgctcttgg

SEQ ID NO: 348964 - DNA, 25 bp, Mus musculus
atccggagggacgatgagcgcctcc

SEQ ID NO: 348965 - DNA, 25 bp, Mus musculus
accgccacggcatccggagggacga

SEQ ID NO: 348966 - DNA, 25 bp, Mus musculus
gggacctcgtacacctgtgcaactg

SEQ ID NO: 348967 - DNA, 25 bp, Mus musculus
accaagccaagtgcaaagccgcggg

SEQ ID NO: 348968 - DNA, 25 bp, Mus musculus
ctcagggcacgactctgcagcggag

SEQ ID NO: 348969 - DNA, 25 bp, Mus musculus
ttcccgggctaccaagccaagtgca

SEQ ID NO: 348970 - DNA, 25 bp, Mus musculus
cccaaagtgcgggactgcgaactcg

SEQ ID NO: 348971 - DNA, 25 bp, Mus musculus
ccgggcctcctaggcgcgcccaggc

SEQ ID NO: 348972 - DNA, 25 bp, Mus musculus
cacccgggcctcctaggcgcgccca

SEQ ID NO: 348973 - DNA, 25 bp, Mus musculus
gcgaactcggtcgatccctcccacc

SEQ ID NO: 348974 - DNA, 25 bp, Mus musculus
ctgcgaactcggtcgatccctccca

SEQ ID NO: 348975 - DNA, 25 bp, Mus musculus
ggactgcgaactcggtcgatccctc

SEQ ID NO: 348976 - DNA, 25 bp, Mus musculus
gggactgcgaactcggtcgatccct

SEQ ID NO: 348977 - DNA, 25 bp, Mus musculus
cgggactgcgaactcggtcgatccc

SEQ ID NO: 348978 - DNA, 25 bp, Mus musculus
gcgggactgcgaactcggtcgatcc

SEQ ID NO: 348979 - DNA, 25 bp, Mus musculus
tgcgggactgcgaactcggtcgatc

SEQ ID NO: 348980 - DNA, 25 bp, Mus musculus
aaagtgcgggactgcgaactcggtc

SEQ ID NO: 348981 - DNA, 25 bp, Mus musculus
caaagtgcgggactgcgaactcggt

SEQ ID NO: 348982 - DNA, 25 bp, Mus musculus
ccaaagtgcgggactgcgaactcgg

SEQ ID NO: 348983 - DNA, 25 bp, Mus musculus
ggcgcgcccaggctggggtcaccga

SEQ ID NO: 348984 - DNA, 25 bp, Mus musculus
gcccagcgttggtcctgatatcctg

SEQ ID NO: 348985 - DNA, 25 bp, Mus musculus
gttggtcctgatatcctgggtgcca

SEQ ID NO: 348986 - DNA, 25 bp, Mus musculus
tggtcctgatatcctgggtgccagt

SEQ ID NO: 348987 - DNA, 25 bp, Mus musculus
tcctgggtgccagtgaccttgggaa

SEQ ID NO: 348988 - DNA, 25 bp, Mus musculus
tgccagtgaccttgggaagtgcagc

SEQ ID NO: 348989 - DNA, 25 bp, Mus musculus
cagtgaccttgggaagtgcagctgc

SEQ ID NO: 348990 - DNA, 25 bp, Mus musculus
gtgactggactgctattccgggcgc

SEQ ID NO: 348991 - DNA, 25 bp, Mus musculus
ggcgcacgcgttgggcccggacctg

SEQ ID NO: 348992 - DNA, 25 bp, Mus musculus
ggggctgacctactgtgtctgacag

SEQ ID NO: 348993 - DNA, 25 bp, Mus musculus
ctgacctactgtgtctgacagcgca

SEQ ID NO: 348994 - DNA, 25 bp, Mus musculus
cctactgtgtctgacagcgcagctc

SEQ ID NO: 348995 - DNA, 25 bp, Mus musculus
ctgtgtctgacagcgcagctcagcg

SEQ ID NO: 348996 - DNA, 25 bp, Mus musculus
agcggcccagcgttggtcctgatat

SEQ ID NO: 348997 - DNA, 25 bp, Mus musculus
agctcagcggcccagcgttggtcct

SEQ ID NO: 348998 - DNA, 25 bp, Mus musculus
ttctgtctgcgctggaagatctgga

SEQ ID NO: 348999 - DNA, 25 bp, Mus musculus
ctctagccggacctctccgtcccga

SEQ ID NO: 349000 - DNA, 25 bp, Mus musculus
tccgtcccgacctctattactcttc

SEQ ID NO: 349001 - DNA, 25 bp, Mus musculus
tcctgtggctagctcacactgcgca

SEQ ID NO: 349002 - DNA, 25 bp, Mus musculus
tggctagctcacactgcgcatgcga

SEQ ID NO: 349003 - DNA, 25 bp, Mus musculus
ctcacactgcgcatgcgacggctgg

SEQ ID NO: 349004 - DNA, 25 bp, Mus musculus
ggcgatggcggcttcttcaagtggt

SEQ ID NO: 349005 - DNA, 25 bp, Mus musculus
cttcaagtggtgagaaggaaaagga

SEQ ID NO: 349006 - DNA, 25 bp, Mus musculus
aatggccggccttggcagtacgcga

SEQ ID NO: 349007 - DNA, 25 bp, Mus musculus
cagtacgcgagagcggcttctgtct

SEQ ID NO: 349008 - DNA, 25 bp, Mus musculus
agagcggcttctgtctgcgctggaa

SEQ ID NO: 349009 - DNA, 25 bp, Mus musculus
cggcttctgtctgcgctggaagatc

SEQ ID NO: 349010 - DNA, 25 bp, Mus musculus
atctggaggtcttgtcgaggtaacc

SEQ ID NO: 349011 - DNA, 25 bp, Mus musculus
ctgcgctggaagatctggaggtctt

SEQ ID NO: 349012 - DNA, 25 bp, Mus musculus
tcctgctcacccgaattccaaatgg

SEQ ID NO: 349013 - DNA, 25 bp, Mus musculus
agcctcgctgattgctcgctgagtg

SEQ ID NO: 349014 - DNA, 25 bp, Mus musculus
gtgacgttgaagctgtacgggaacc

SEQ ID NO: 349015 - DNA, 25 bp, Mus musculus
gccgtagagagctcgcggaactcaa

SEQ ID NO: 349016 - DNA, 25 bp, Mus musculus
gcggaactcaactgcgcactgaagc

SEQ ID NO: 349017 - DNA, 25 bp, Mus musculus
tagcggccatagcatttggctgacc

SEQ ID NO: 349018 - DNA, 25 bp, Mus musculus
gtgatattcccgaagcttccgcttc

SEQ ID NO: 349019 - DNA, 25 bp, Mus musculus
cgaggatgctcgcagctcagcacca

SEQ ID NO: 349020 - DNA, 25 bp, Mus musculus
cgctgagtgttgtgtctcacgaatc

SEQ ID NO: 349021 - DNA, 25 bp, Mus musculus
ccaggaagctggaaactgccggctc

SEQ ID NO: 349022 - DNA, 25 bp, Mus musculus
aactgccggctccaaacgatccttt

SEQ ID NO: 349023 - DNA, 25 bp, Mus musculus
cccagaaggacgcagcgaggatgct

SEQ ID NO: 349024 - DNA, 25 bp, Mus musculus
tgaagcgcgtcacacggaccgagaa

SEQ ID NO: 349025 - DNA, 25 bp, Mus musculus
atggcgtgcggactagtgatattcc

SEQ ID NO: 349026 - DNA, 25 bp, Mus musculus
attgtccttgtctcgggccgggagc

SEQ ID NO: 349027 - DNA, 25 bp, Mus musculus
cgagagcaactgcgtctctgcgcct

SEQ ID NO: 349028 - DNA, 25 bp, Mus musculus
gtcggactcagaaatggcggcgtcc

SEQ ID NO: 349029 - DNA, 25 bp, Mus musculus
aatggcggcgtccatgttctacggc

SEQ ID NO: 349030 - DNA, 25 bp, Mus musculus
cgtccatgttctacggccggcagtt

SEQ ID NO: 349031 - DNA, 25 bp, Mus musculus
accggccgcagactacgctgcgagc

SEQ ID NO: 349032 - DNA, 25 bp, Mus musculus
ggtaagctcgccctgttcgctttgg

SEQ ID NO: 349033 - DNA, 25 bp, Mus musculus
tcgccctgttcgctttggccgcggg

SEQ ID NO: 349034 - DNA, 25 bp, Mus musculus
cgggatgccctgctctgcacagagg

SEQ ID NO: 349035 - DNA, 25 bp, Mus musculus
atgccctgctctgcacagaggctgc

SEQ ID NO: 349036 - DNA, 25 bp, Mus musculus
ctggcagtcggcctcacctgcggga

SEQ ID NO: 349037 - DNA, 25 bp, Mus musculus
agtcggcctcacctgcgggagcctg

SEQ ID NO: 349038 - DNA, 25 bp, Mus musculus
gctcctccggcagcgacggggttaa

SEQ ID NO: 349039 - DNA, 25 bp, Mus musculus
ccgaggattgtccttgtctcgggcc

SEQ ID NO: 349040 - DNA, 25 bp, Mus musculus
ccgcagggcctgctaatcgctttaa

SEQ ID NO: 349041 - DNA, 25 bp, Mus musculus
ccctcaccgaggtaagatggaatgg

SEQ ID NO: 349042 - DNA, 25 bp, Mus musculus
ctactacctggttttcgggcggctg

SEQ ID NO: 349043 - DNA, 25 bp, Mus musculus
cggggaatggtgacgatctctgcac

SEQ ID NO: 349044 - DNA, 25 bp, Mus musculus
ggtcgtgagtcccaagcattctcta

SEQ ID NO: 349045 - DNA, 25 bp, Mus musculus
taatcgctttaacttcggggagctg

SEQ ID NO: 349046 - DNA, 25 bp, Mus musculus
cttcggggagctggaaacaatgtgt

SEQ ID NO: 349047 - DNA, 25 bp, Mus musculus
aaacaatgtgtgacctggggcgcca

SEQ ID NO: 349048 - DNA, 25 bp, Mus musculus
cgggacggcatttcgccgagcattc

SEQ ID NO: 349049 - DNA, 25 bp, Mus musculus
tccgggatcccagcctgggctgcag

SEQ ID NO: 349050 - DNA, 25 bp, Mus musculus
gccactagggccctgaggtgtcttg

SEQ ID NO: 349051 - DNA, 25 bp, Mus musculus
ggccgtgcccagtggtaaaaattca

SEQ ID NO: 349052 - DNA, 25 bp, Mus musculus
caaccttcttccctggcgagttaga

SEQ ID NO: 349053 - DNA, 25 bp, Mus musculus
gacgcctagacctgcggtggtgata

SEQ ID NO: 349054 - DNA, 25 bp, Mus musculus
ctcctgccgagccaatctagtaaca

SEQ ID NO: 349055 - DNA, 25 bp, Mus musculus
acaaccaccgtgctcgttgcagaac

SEQ ID NO: 349056 - DNA, 25 bp, Mus musculus
aggaggaccaccgtgcccgctacaa

SEQ ID NO: 349057 - DNA, 25 bp, Mus musculus
ggaacagctcctaggcgcatccctg

SEQ ID NO: 349058 - DNA, 25 bp, Mus musculus
cttccatgtagaggtccacgacttg

SEQ ID NO: 349059 - DNA, 25 bp, Mus musculus
gcgcgctccaaaccacggttcaagg

SEQ ID NO: 349060 - DNA, 25 bp, Mus musculus
ccaggacgcagaatgcttccatgta

SEQ ID NO: 349061 - DNA, 25 bp, Mus musculus
cttcagcttcctggcgctcaggttc

SEQ ID NO: 349062 - DNA, 25 bp, Mus musculus
cgtagtcctgggaaactccttcagc

SEQ ID NO: 349063 - DNA, 25 bp, Mus musculus
cgaaccgtgtccgagaggtcatgtc

SEQ ID NO: 349064 - DNA, 25 bp, Mus musculus
tctagtaacacattcgggcccggcg

SEQ ID NO: 349065 - DNA, 25 bp, Mus musculus
ggagagccagacaccagcctctgct

SEQ ID NO: 349066 - DNA, 25 bp, Mus musculus
ctcgcacaggcgcagaaccaaggtt

SEQ ID NO: 349067 - DNA, 25 bp, Mus musculus
gcagcagttcgatcgccaaggtttc

SEQ ID NO: 349068 - DNA, 25 bp, Mus musculus
ttctcgcagtctcaggcttcgcttt

SEQ ID NO: 349069 - DNA, 25 bp, Mus musculus
gtcgagagaacttcggtttctattg

SEQ ID NO: 349070 - DNA, 25 bp, Mus musculus
ccgagcttttcagatcacgagtgtc

SEQ ID NO: 349071 - DNA, 25 bp, Mus musculus
agaacctcggagctgttggcacacg

SEQ ID NO: 349072 - DNA, 25 bp, Mus musculus
aaaactttctgtattcgttggcagc

SEQ ID NO: 349073 - DNA, 25 bp, Mus musculus
ggcagttgcacgttcgaagtcgaga

SEQ ID NO: 349074 - DNA, 25 bp, Mus musculus
tctctgcaccatcagaacctcggag

SEQ ID NO: 349075 - DNA, 25 bp, Mus musculus
aggtgatccgaacctgtcgctgcca

SEQ ID NO: 349076 - DNA, 25 bp, Mus musculus
tggctatttggtggataaaacggcc

SEQ ID NO: 349077 - DNA, 25 bp, Mus musculus
aggttctctgacttgagctcctaca

SEQ ID NO: 349078 - DNA, 25 bp, Mus musculus
tcctacacatccgagttgggaggtg

SEQ ID NO: 349079 - DNA, 25 bp, Mus musculus
gtgtctccgcgttctcgcagtctca

SEQ ID NO: 349080 - DNA, 25 bp, Mus musculus
ggcgtgggtctaaaggcgcccactc

SEQ ID NO: 349081 - DNA, 25 bp, Mus musculus
accgtgcgccacctagaggagctga

SEQ ID NO: 349082 - DNA, 25 bp, Mus musculus
cctgatgtcagaggtcagacgctcc

SEQ ID NO: 349083 - DNA, 25 bp, Mus musculus
aggtcagacgctccggccagagctt

SEQ ID NO: 349084 - DNA, 25 bp, Mus musculus
cgtttccgcccggtgcctgatgtca

SEQ ID NO: 349085 - DNA, 25 bp, Mus musculus
cgcactcatccgcagcgcagcgttt

SEQ ID NO: 349086 - DNA, 25 bp, Mus musculus
tgaaacaagcctttgcgggcgccca

SEQ ID NO: 349087 - DNA, 25 bp, Mus musculus
agtcactacctgaaacaagcctttg

SEQ ID NO: 349088 - DNA, 25 bp, Mus musculus
ggtgcacactgcagtcactacctga

SEQ ID NO: 349089 - DNA, 25 bp, Mus musculus
ctctcagggattcacagccacgcga

SEQ ID NO: 349090 - DNA, 25 bp, Mus musculus
cagcgttaggagctctcagggattc

SEQ ID NO: 349091 - DNA, 25 bp, Mus musculus
taacttcccgagctcagcgttagga

SEQ ID NO: 349092 - DNA, 25 bp, Mus musculus
ggccgggtgtaacttcccgagctca

SEQ ID NO: 349093 - DNA, 25 bp, Mus musculus
agcaccgccgtattaggaaggccgg

SEQ ID NO: 349094 - DNA, 25 bp, Mus musculus
cccagcaccgccgtattaggaaggc

SEQ ID NO: 349095 - DNA, 25 bp, Mus musculus
ctgaaacccgggtgcacactgcagt

SEQ ID NO: 349096 - DNA, 25 bp, Mus musculus
ccagctagcccggtaagaagcgcag

SEQ ID NO: 349097 - DNA, 25 bp, Mus musculus
agctagcccggtaagaagcgcaggc

SEQ ID NO: 349098 - DNA, 25 bp, Mus musculus
ctagcccggtaagaagcgcaggcgc

SEQ ID NO: 349099 - DNA, 25 bp, Mus musculus
agcccggtaagaagcgcaggcgcac

SEQ ID NO: 349100 - DNA, 25 bp, Mus musculus
gtaagaagcgcaggcgcacgagggt

SEQ ID NO: 349101 - DNA, 25 bp, Mus musculus
gcccactcgatccacccactgattt

SEQ ID NO: 349102 - DNA, 25 bp, Mus musculus
actcgatccacccactgatttcgcc

SEQ ID NO: 349103 - DNA, 25 bp, Mus musculus
atttcgccaccttaggccagtggcc

SEQ ID NO: 349104 - DNA, 25 bp, Mus musculus
ggaggctgaagtggtggagccggga

SEQ ID NO: 349105 - DNA, 25 bp, Mus musculus
tgcgggcagcgcaggatgcccggag

SEQ ID NO: 349106 - DNA, 25 bp, Mus musculus
ggcccctaattctgctgcgggcagc

SEQ ID NO: 349107 - DNA, 25 bp, Mus musculus
ggccagtggcccctaattctgctgc

SEQ ID NO: 349108 - DNA, 25 bp, Mus musculus
tgatttcgccaccttaggccagtgg

SEQ ID NO: 349109 - DNA, 25 bp, Mus musculus
cgcacgagggttgggcacgtcggga

SEQ ID NO: 349110 - DNA, 25 bp, Mus musculus
ttagatgctgccagtgtagcggcca

SEQ ID NO: 349111 - DNA, 25 bp, Mus musculus
tctcgtgtccggagctctccagagc

SEQ ID NO: 349112 - DNA, 25 bp, Mus musculus
acgggcggttgtcaaaatctgcagc

SEQ ID NO: 349113 - DNA, 25 bp, Mus musculus
ggacgtcctgaagactgcgcttaca

SEQ ID NO: 349114 - DNA, 25 bp, Mus musculus
caggcagagttgtggtcttagcgtt

SEQ ID NO: 349115 - DNA, 25 bp, Mus musculus
gacttccgtcggcttttagatgctg

SEQ ID NO: 349116 - DNA, 25 bp, Mus musculus
gtcgggcaaactcgcgacttccgtc

SEQ ID NO: 349117 - DNA, 25 bp, Mus musculus
gcggggcttactcgatgacgactaa

SEQ ID NO: 349118 - DNA, 25 bp, Mus musculus
ggcgtcaggaacacactccgcactg

SEQ ID NO: 349119 - DNA, 25 bp, Mus musculus
cccagaccttagtaaacaggcgtca

SEQ ID NO: 349120 - DNA, 25 bp, Mus musculus
tatgcgatggaaaacggtgaaaacc

SEQ ID NO: 349121 - DNA, 25 bp, Mus musculus
caggctggtggttactgccgaaaca

SEQ ID NO: 349122 - DNA, 25 bp, Mus musculus
tctgcagcttcgaaacgcaccaggc

SEQ ID NO: 349123 - DNA, 25 bp, Mus musculus
tcttagcgttgctctgcagtggctt

SEQ ID NO: 349124 - DNA, 25 bp, Mus musculus
agtccgtctgcctgtctgtcagcgg

SEQ ID NO: 349125 - DNA, 25 bp, Mus musculus
ccggagcaaggctcgggccaaccgt

SEQ ID NO: 349126 - DNA, 25 bp, Mus musculus
gctgctgacagcagggcacacacgg

SEQ ID NO: 349127 - DNA, 25 bp, Mus musculus
gaacccgccacggtggctcagagga

SEQ ID NO: 349128 - DNA, 25 bp, Mus musculus
tggctcagaggaccggccagatccc

SEQ ID NO: 349129 - DNA, 25 bp, Mus musculus
ttgagctccagcaccgagtccgtct

SEQ ID NO: 349130 - DNA, 25 bp, Mus musculus
tcagcggcgccatcgagtcgggtct

SEQ ID NO: 349131 - DNA, 25 bp, Mus musculus
agtcgggtctcccatcccagagaga

SEQ ID NO: 349132 - DNA, 25 bp, Mus musculus
agagacagcttctcgcgggcgtccc

SEQ ID NO: 349133 - DNA, 25 bp, Mus musculus
aggaccgggacttccagcgccgcag

SEQ ID NO: 349134 - DNA, 25 bp, Mus musculus
cgggaccgaggccaaaacagacgtg

SEQ ID NO: 349135 - DNA, 25 bp, Mus musculus
aacagacgtggctttcgacggaggc

SEQ ID NO: 349136 - DNA, 25 bp, Mus musculus
tggctttcgacggaggccaaacagt

SEQ ID NO: 349137 - DNA, 25 bp, Mus musculus
acctcggcgggcaccggcaggttct

SEQ ID NO: 349138 - DNA, 25 bp, Mus musculus
gtagcctcccggcagccgggcagaa

SEQ ID NO: 349139 - DNA, 25 bp, Mus musculus
ccgggcagaaggacgccgcactgcg

SEQ ID NO: 349140 - DNA, 25 bp, Mus musculus
tagcctcccggcagccgggcagaag

SEQ ID NO: 349141 - DNA, 25 bp, Mus musculus
ttcgtgtagcctcccggcagccggg

SEQ ID NO: 349142 - DNA, 25 bp, Mus musculus
cccatcgccttcgtgtagcctcccg

SEQ ID NO: 349143 - DNA, 25 bp, Mus musculus
ttgtggaccccctgaccccatcgcc

SEQ ID NO: 349144 - DNA, 25 bp, Mus musculus
cactctgccagcctcttgtggaccc

SEQ ID NO: 349145 - DNA, 25 bp, Mus musculus
ggcactctgccagcctcttgtggac

SEQ ID NO: 349146 - DNA, 25 bp, Mus musculus
cggcactctgccagcctcttgtgga

SEQ ID NO: 349147 - DNA, 25 bp, Mus musculus
tcagtttcccattcccggcactctg

SEQ ID NO: 349148 - DNA, 25 bp, Mus musculus
ccgcctcagtttcccattcccggca

SEQ ID NO: 349149 - DNA, 25 bp, Mus musculus
actggttttggcctcaagccctccg

SEQ ID NO: 349150 - DNA, 25 bp, Mus musculus
tccactggttttggcctcaagccct

SEQ ID NO: 349151 - DNA, 25 bp, Mus musculus
cagccgggcagaaggacgccgcact

SEQ ID NO: 349152 - DNA, 25 bp, Mus musculus
cagcgcacttcagcccggagcaaac

SEQ ID NO: 349153 - DNA, 25 bp, Mus musculus
tctctggccaggtccacaaggcagc

SEQ ID NO: 349154 - DNA, 25 bp, Mus musculus
cgcagatcccgcagaaccactagaa

SEQ ID NO: 349155 - DNA, 25 bp, Mus musculus
agctcgcgggtgctgaagctgcacc

SEQ ID NO: 349156 - DNA, 25 bp, Mus musculus
acgttctcattggtcactgtcgaca

SEQ ID NO: 349157 - DNA, 25 bp, Mus musculus
aggtccacaaggcagcagcgcggcc

SEQ ID NO: 349158 - DNA, 25 bp, Mus musculus
attggtcactgtcgacaccggctcc

SEQ ID NO: 349159 - DNA, 25 bp, Mus musculus
cgccgcagcggttctctggccaggt

SEQ ID NO: 349160 - DNA, 25 bp, Mus musculus
cagaaccactagaacccgggagcga

SEQ ID NO: 349161 - DNA, 25 bp, Mus musculus
gggtgcaacccttgagcctcccgga

SEQ ID NO: 349162 - DNA, 25 bp, Mus musculus
agtgtcgcagcaaagggtgcaaccc

SEQ ID NO: 349163 - DNA, 25 bp, Mus musculus
accgtctctgcccacggatgggagg

SEQ ID NO: 349164 - DNA, 25 bp, Mus musculus
gtgctgaagctgcaccgtctctgcc

SEQ ID NO: 349165 - DNA, 25 bp, Mus musculus
tgctactcctcggagccagtgcagc

SEQ ID NO: 349166 - DNA, 25 bp, Mus musculus
gcctccaggcggaggagacgctctt

SEQ ID NO: 349167 - DNA, 25 bp, Mus musculus
acgtagccgagcgtgccctctatat

SEQ ID NO: 349168 - DNA, 25 bp, Mus musculus
tttctagaaaagtggaggcggagcc

SEQ ID NO: 349169 - DNA, 25 bp, Mus musculus
gccgctggaactcgtgcaatcctcg

SEQ ID NO: 349170 - DNA, 25 bp, Mus musculus
ttcgctttcagatgacgagctgttc

SEQ ID NO: 349171 - DNA, 25 bp, Mus musculus
gcggctctctctgttcgctttcaga

SEQ ID NO: 349172 - DNA, 25 bp, Mus musculus
gggacctcatcagccgtaagtcccg

SEQ ID NO: 349173 - DNA, 25 bp, Mus musculus
ttcacgtcaccgctgacgacagttc

SEQ ID NO: 349174 - DNA, 25 bp, Mus musculus
ctccgcattgtgtcccagcagagtc

SEQ ID NO: 349175 - DNA, 25 bp, Mus musculus
cacccaggggcactccgcattgtgt

SEQ ID NO: 349176 - DNA, 25 bp, Mus musculus
tccgattctgctgacattttctttc

SEQ ID NO: 349177 - DNA, 25 bp, Mus musculus
gcccgacaacagtcatccgattctg

SEQ ID NO: 349178 - DNA, 25 bp, Mus musculus
gcgactcaagcgtccggccatcggt

SEQ ID NO: 349179 - DNA, 25 bp, Mus musculus
gcctggaaataggtccgcgaactca

SEQ ID NO: 349180 - DNA, 25 bp, Mus musculus
tgactcccggcaacgtgcaatcttg

SEQ ID NO: 349181 - DNA, 25 bp, Mus musculus
caatttcctagatgggcgtgactcc

SEQ ID NO: 349182 - DNA, 25 bp, Mus musculus
acagcgcgccgagagggacaaactt

SEQ ID NO: 349183 - DNA, 25 bp, Mus musculus
tgcgcacgactacgtcaggacagcg

SEQ ID NO: 349184 - DNA, 25 bp, Mus musculus
gccgccgaatgaagaactgcgcctg

SEQ ID NO: 349185 - DNA, 25 bp, Mus musculus
gcttctcagaacagcggtggcccga

SEQ ID NO: 349186 - DNA, 25 bp, Mus musculus
ccgggaaccaggaacttagatgaga

SEQ ID NO: 349187 - DNA, 25 bp, Mus musculus
tagaccgcgaaaagccggcgtcgca

SEQ ID NO: 349188 - DNA, 25 bp, Mus musculus
ctgaaaggcagagagcgacagtcca

SEQ ID NO: 349189 - DNA, 25 bp, Mus musculus
cgctccgccatgagcttgtcgcgtg

SEQ ID NO: 349190 - DNA, 25 bp, Mus musculus
acacgccggtgttctgtttggcgcc

SEQ ID NO: 349191 - DNA, 25 bp, Mus musculus
ccgagcaagacggacccagaacttt

SEQ ID NO: 349192 - DNA, 25 bp, Mus musculus
ggacaaacttcctgctccggcaatt

SEQ ID NO: 349193 - DNA, 25 bp, Mus musculus
ttagatgagaagaacacgccgccga

SEQ ID NO: 349194 - DNA, 25 bp, Mus musculus
cgcgatgggctcattggccagatta

SEQ ID NO: 349195 - DNA, 25 bp, Mus musculus
cggaagtgacgcttaatgatagttc

SEQ ID NO: 349196 - DNA, 25 bp, Mus musculus
ttccacagttgcactttgggctcgc

SEQ ID NO: 349197 - DNA, 25 bp, Mus musculus
tgtctgatgacgtaagcccgcgatg

SEQ ID NO: 349198 - DNA, 25 bp, Mus musculus
atgctcagattcttcccgcggcgca

SEQ ID NO: 349199 - DNA, 25 bp, Mus musculus
atcaggtccctagccattcgctgcg

SEQ ID NO: 349200 - DNA, 25 bp, Mus musculus
gcgcttccaccgttcgatgctcaga

SEQ ID NO: 349201 - DNA, 25 bp, Mus musculus
aggtttttccggctttgtctgatga

SEQ ID NO: 349202 - DNA, 25 bp, Mus musculus
gatttgctgcaaggcccgaaggttt

SEQ ID NO: 349203 - DNA, 25 bp, Mus musculus
ctggacggtgtagaccaggatttgc

SEQ ID NO: 349204 - DNA, 25 bp, Mus musculus
gacgcacagtcgctcaaagcccaag

SEQ ID NO: 349205 - DNA, 25 bp, Mus musculus
gttcctcgtcctcaactgtcgcgtg

SEQ ID NO: 349206 - DNA, 25 bp, Mus musculus
tcgggtcccaaacactcaggcgttg

SEQ ID NO: 349207 - DNA, 25 bp, Mus musculus
agtttagctaaacccaggctggacg

SEQ ID NO: 349208 - DNA, 25 bp, Mus musculus
tcctctcttgatgccgcgagagacc

SEQ ID NO: 349209 - DNA, 25 bp, Mus musculus
gctccgcgaggatccggcgtctctg

SEQ ID NO: 349210 - DNA, 25 bp, Mus musculus
gaggaaaatgctcgggctccatggc

SEQ ID NO: 349211 - DNA, 25 bp, Mus musculus
cttcctctccgaggacgtgtggcga

SEQ ID NO: 349212 - DNA, 25 bp, Mus musculus
ccgagaagaggacgcgagctcgccc

SEQ ID NO: 349213 - DNA, 25 bp, Mus musculus
ggagcagctcggtgccgaaccagcc

SEQ ID NO: 349214 - DNA, 25 bp, Mus musculus
tctcatttctttgaacggcgtcggc

SEQ ID NO: 349215 - DNA, 25 bp, Mus musculus
acggagcagcccgagaagagcacta

SEQ ID NO: 349216 - DNA, 25 bp, Mus musculus
gggcgctggtccctcctctcttgat

SEQ ID NO: 349217 - DNA, 25 bp, Mus musculus
gcgcctcgttgctgggctcaccgta

SEQ ID NO: 349218 - DNA, 25 bp, Mus musculus
gagcactagtaacaaccatcacagc

SEQ ID NO: 349219 - DNA, 25 bp, Mus musculus
tggccaaagaaggtgggcatttctc

SEQ ID NO: 349220 - DNA, 25 bp, Mus musculus
ctccatggctgccagtgatggagcg

SEQ ID NO: 349221 - DNA, 25 bp, Mus musculus
tccgcgctgcctcggtgcaggacga

SEQ ID NO: 349222 - DNA, 25 bp, Mus musculus
ctgggtctggttgcaaagagcaagc

SEQ ID NO: 349223 - DNA, 25 bp, Mus musculus
agacgcgccgggtcactcgagccag

SEQ ID NO: 349224 - DNA, 25 bp, Mus musculus
ccgagtaggaccgagctgctgcaga

SEQ ID NO: 349225 - DNA, 25 bp, Mus musculus
cagccgagtaggaccgagctgctgc

SEQ ID NO: 349226 - DNA, 25 bp, Mus musculus
tcctctagaggagtggagccggcag

SEQ ID NO: 349227 - DNA, 25 bp, Mus musculus
cccgcctatatgtggcgctggggcc

SEQ ID NO: 349228 - DNA, 25 bp, Mus musculus
aaccctgacgcgagcgagccttgga

SEQ ID NO: 349229 - DNA, 25 bp, Mus musculus
gagctttcgggaaccctgacgcgag

SEQ ID NO: 349230 - DNA, 25 bp, Mus musculus
ttcctgagtcttagtggtgggactg

SEQ ID NO: 349231 - DNA, 25 bp, Mus musculus
gttgcaaagagcaagcttgcgggca

SEQ ID NO: 349232 - DNA, 25 bp, Mus musculus
ccttagacgtaagcgtgcgggcacc

SEQ ID NO: 349233 - DNA, 25 bp, Mus musculus
ggtcactcgagccagcaccaccgtt

SEQ ID NO: 349234 - DNA, 25 bp, Mus musculus
ctcccttagacgtaagcgtgcgggc

SEQ ID NO: 349235 - DNA, 25 bp, Mus musculus
agacgccggcgttcctgagtcttag

SEQ ID NO: 349236 - DNA, 25 bp, Mus musculus
tctcgttagccatccggatccgctg

SEQ ID NO: 349237 - DNA, 25 bp, Mus musculus
cgcttggggatgctctcgactccca

SEQ ID NO: 349238 - DNA, 25 bp, Mus musculus
tggggatgctctcgactcccacctg

SEQ ID NO: 349239 - DNA, 25 bp, Mus musculus
tcccacctgcaacgatggccggggt

SEQ ID NO: 349240 - DNA, 25 bp, Mus musculus
ccagccggctccagagagaggccag

SEQ ID NO: 349241 - DNA, 25 bp, Mus musculus
cgcgcggacggaagtaatctctcat

SEQ ID NO: 349242 - DNA, 25 bp, Mus musculus
acggaagtaatctctcatctcagga

SEQ ID NO: 349243 - DNA, 25 bp, Mus musculus
taatctctcatctcaggaaaccctc

SEQ ID NO: 349244 - DNA, 25 bp, Mus musculus
cccagctacctaccctgcgcggcca

SEQ ID NO: 349245 - DNA, 25 bp, Mus musculus
gcgcgccaagcccaagggcaccgtg

SEQ ID NO: 349246 - DNA, 25 bp, Mus musculus
tgtccgggtcctgagatcgaacgct

SEQ ID NO: 349247 - DNA, 25 bp, Mus musculus
cctgagatcgaacgctgcggggcat

SEQ ID NO: 349248 - DNA, 25 bp, Mus musculus
gttagccatccggatccgctgtttg

SEQ ID NO: 349249 - DNA, 25 bp, Mus musculus
gatccgctgtttggccaccatggct

SEQ ID NO: 349250 - DNA, 25 bp, Mus musculus
cagttaaacgttcacgccgagtttg

SEQ ID NO: 349251 - DNA, 25 bp, Mus musculus
gccacactgggcagctcgtcgagct

SEQ ID NO: 349252 - DNA, 25 bp, Mus musculus
tgggcagctcgtcgagctctgcgtc

SEQ ID NO: 349253 - DNA, 25 bp, Mus musculus
gccgtggccgagctatgccagaaca

SEQ ID NO: 349254 - DNA, 25 bp, Mus musculus
ccggagacctttctggaggcctcca

SEQ ID NO: 349255 - DNA, 25 bp, Mus musculus
ctacgccgacaacatcctgaggtgc

SEQ ID NO: 349256 - DNA, 25 bp, Mus musculus
acaacatcctgaggtgcagccgggg

SEQ ID NO: 349257 - DNA, 25 bp, Mus musculus
ccgaggctgtcactgagtttgacag

SEQ ID NO: 349258 - DNA, 25 bp, Mus musculus
tcactgagtttgacagctgtgctgt

SEQ ID NO: 349259 - DNA, 25 bp, Mus musculus
gctgtgctgtcccatctcgctgcag

SEQ ID NO: 349260 - DNA, 25 bp, Mus musculus
atctcgctgcaggatcccggcgctg

SEQ ID NO: 349261 - DNA, 25 bp, Mus musculus
gtggctcagcccgagtgccagttaa

SEQ ID NO: 349262 - DNA, 25 bp, Mus musculus
gcagccatggcgtcggccacactgg

SEQ ID NO: 349263 - DNA, 25 bp, Mus musculus
agcccgagtgccagttaaacgttca

SEQ ID NO: 349264 - DNA, 25 bp, Mus musculus
acctcggaggagcctggactgcacg

SEQ ID NO: 349265 - DNA, 25 bp, Mus musculus
cgcagtcaccgtggaggccgcctga

SEQ ID NO: 349266 - DNA, 25 bp, Mus musculus
cccgtagggcactggcgccttcatt

SEQ ID NO: 349267 - DNA, 25 bp, Mus musculus
agggcactggcgccttcattcattc

SEQ ID NO: 349268 - DNA, 25 bp, Mus musculus
cgccagccgtgcaggcgacctcgga

SEQ ID NO: 349269 - DNA, 25 bp, Mus musculus
agcctggactgcacggtgtgcgtcc

SEQ ID NO: 349270 - DNA, 25 bp, Mus musculus
actgcacggtgtgcgtccgtccgtc

SEQ ID NO: 349271 - DNA, 25 bp, Mus musculus
tccgtccgtcccgtcgccgcgccga

SEQ ID NO: 349272 - DNA, 25 bp, Mus musculus
aggctcggcgctcgaaccccagtgg

SEQ ID NO: 349273 - DNA, 25 bp, Mus musculus
agtggctcccaaagtcaccggccgg

SEQ ID NO: 349274 - DNA, 25 bp, Mus musculus
aggtggcgccctggagacgcaaggc

SEQ ID NO: 349275 - DNA, 25 bp, Mus musculus
agttccgggtcagcgcccgcagtca

SEQ ID NO: 349276 - DNA, 25 bp, Mus musculus
ggtcagcgcccgcagtcaccgtgga

SEQ ID NO: 349277 - DNA, 25 bp, Mus musculus
attctttccgccagccgtgcaggcg

SEQ ID NO: 349278 - DNA, 25 bp, Mus musculus
gaaactttcctctctgcccgatctg

SEQ ID NO: 349279 - DNA, 25 bp, Mus musculus
ttttgcctcggtccctacgagcatc

SEQ ID NO: 349280 - DNA, 25 bp, Mus musculus
gcgacgaattttgcctcggtcccta

SEQ ID NO: 349281 - DNA, 25 bp, Mus musculus
tctggcgcgggccagaaactttcct

SEQ ID NO: 349282 - DNA, 25 bp, Mus musculus
tgccttggcgttctctactctggcg

SEQ ID NO: 349283 - DNA, 25 bp, Mus musculus
ttgcatagcatctccctgccttggc

SEQ ID NO: 349284 - DNA, 25 bp, Mus musculus
tcctgtcttgcatagcatctccctg

SEQ ID NO: 349285 - DNA, 25 bp, Mus musculus
cggttgttccgttcttcccatagtg

SEQ ID NO: 349286 - DNA, 25 bp, Mus musculus
gctcttttttatcgctggccggcta

SEQ ID NO: 349287 - DNA, 25 bp, Mus musculus
cacagatgtactccgctctttttta

SEQ ID NO: 349288 - DNA, 25 bp, Mus musculus
ctcgggctcccgcacttttatgagc

SEQ ID NO: 349289 - DNA, 25 bp, Mus musculus
cagtcgcttcttcgggccagacagg

SEQ ID NO: 349290 - DNA, 25 bp, Mus musculus
cagtctagccgggtctggctgctcg

SEQ ID NO: 349291 - DNA, 25 bp, Mus musculus
gcgccctggacagagtccggcagaa

SEQ ID NO: 349292 - DNA, 25 bp, Mus musculus
aggcagcactggcttgcgcagtccc

SEQ ID NO: 349293 - DNA, 25 bp, Mus musculus
cgctgagcatcctctgggtgcacag

SEQ ID NO: 349294 - DNA, 25 bp, Mus musculus
tttcccgcgttagcgcgggcgctga

SEQ ID NO: 349295 - DNA, 25 bp, Mus musculus
cgatggcgaggcgagaaccgcactt

SEQ ID NO: 349296 - DNA, 25 bp, Mus musculus
acacgcgcgcgcgagttcaaagcgc

SEQ ID NO: 349297 - DNA, 25 bp, Mus musculus
tccgcacgcagtggcgggctgtcat

SEQ ID NO: 349298 - DNA, 25 bp, Mus musculus
ctcagatcggcagcgctgcaggcag

SEQ ID NO: 349299 - DNA, 25 bp, Mus musculus
ctcaggcccaacctgcgcagatgga

SEQ ID NO: 349300 - DNA, 25 bp, Mus musculus
gggagttcccgcgtccgtacacaca

SEQ ID NO: 349301 - DNA, 25 bp, Mus musculus
ggagccgccagcttgtggccacctt

SEQ ID NO: 349302 - DNA, 25 bp, Mus musculus
agcttgtggccaccttcctgcgcga

SEQ ID NO: 349303 - DNA, 25 bp, Mus musculus
gaaccgcacttggtgctctgtctga

SEQ ID NO: 349304 - DNA, 25 bp, Mus musculus
cgccatagctggagccttgggtccc

SEQ ID NO: 349305 - DNA, 25 bp, Mus musculus
gggctgtcatctccacggtgggccc

SEQ ID NO: 349306 - DNA, 25 bp, Mus musculus
tggcggccggcagactcaccgctgt

SEQ ID NO: 349307 - DNA, 25 bp, Mus musculus
gtcgatgtcggcgtccgacctttgg

SEQ ID NO: 349308 - DNA, 25 bp, Mus musculus
cagaaggaggcaggtattcggcgta

SEQ ID NO: 349309 - DNA, 25 bp, Mus musculus
cgcggggacaaattagtgcggaccg

SEQ ID NO: 349310 - DNA, 25 bp, Mus musculus
actgagttgtctacggggcgtccgc

SEQ ID NO: 349311 - DNA, 25 bp, Mus musculus
cgcactgagttgtctacggggcgtc

SEQ ID NO: 349312 - DNA, 25 bp, Mus musculus
ctccgaggacgcactgagttgtcta

SEQ ID NO: 349313 - DNA, 25 bp, Mus musculus
cactgcaggactccgaggacgcact

SEQ ID NO: 349314 - DNA, 25 bp, Mus musculus
actcaccgctgtgtggtcgatgtcg

SEQ ID NO: 349315 - DNA, 25 bp, Mus musculus
gtattcggcgtagcgcagcccctct

SEQ ID NO: 349316 - DNA, 25 bp, Mus musculus
ccctctctggaggtcacgccgccac

SEQ ID NO: 349317 - DNA, 25 bp, Mus musculus
tagccatggcactgcaggactccga

SEQ ID NO: 349318 - DNA, 25 bp, Mus musculus
tcggcgtccgacctttgggcagaag

SEQ ID NO: 349319 - DNA, 25 bp, Mus musculus
cagactcaccgctgtgtggtcgatg

SEQ ID NO: 349320 - DNA, 25 bp, Mus musculus
cacccaccgccgagcagactcccgg

SEQ ID NO: 349321 - DNA, 25 bp, Mus musculus
gcggatgttctctcccttcctcggc

SEQ ID NO: 349322 - DNA, 25 bp, Mus musculus
ttgccgtagtctcggctggcccggc

SEQ ID NO: 349323 - DNA, 25 bp, Mus musculus
tacttgccgtagtctcggctggccc

SEQ ID NO: 349324 - DNA, 25 bp, Mus musculus
accggttcacagaggtcctggcagt

SEQ ID NO: 349325 - DNA, 25 bp, Mus musculus
caggtacttgccgtagtctcggctg

SEQ ID NO: 349326 - DNA, 25 bp, Mus musculus
atctcctccgagctgcgcaggtact

SEQ ID NO: 349327 - DNA, 25 bp, Mus musculus
gtgcagcggaccctcgtgtgggacg

SEQ ID NO: 349328 - DNA, 25 bp, Mus musculus
ccctgctccgcggatgttctctccc

SEQ ID NO: 349329 - DNA, 25 bp, Mus musculus
ctgcgcaggtacttgccgtagtctc

SEQ ID NO: 349330 - DNA, 25 bp, Mus musculus
cccgaccggttcacagaggtcctgg

SEQ ID NO: 349331 - DNA, 25 bp, Mus musculus
cacagaggtcctggcagtggctccc

SEQ ID NO: 349332 - DNA, 25 bp, Mus musculus
ttcacagaggtcctggcagtggctc

SEQ ID NO: 349333 - DNA, 25 bp, Mus musculus
cgccgagcagactcccggccaggcg

SEQ ID NO: 349334 - DNA, 25 bp, Mus musculus
cgacgtgacagcgatgcaaacagcg

SEQ ID NO: 349335 - DNA, 25 bp, Mus musculus
gtgcgttgccttgggaacggcttaa

SEQ ID NO: 349336 - DNA, 25 bp, Mus musculus
tgcaaacagcggcatctggggttag

SEQ ID NO: 349337 - DNA, 25 bp, Mus musculus
gctgcggaggacaaagtgcaccgtc

SEQ ID NO: 349338 - DNA, 25 bp, Mus musculus
agagccgtcgcacctctcgcgagaa

SEQ ID NO: 349339 - DNA, 25 bp, Mus musculus
gccgagcccgcgcaaaaggaacaag

SEQ ID NO: 349340 - DNA, 25 bp, Mus musculus
cttcccacgtgctctggagggcaaa

SEQ ID NO: 349341 - DNA, 25 bp, Mus musculus
caaagctgcgggtcgcccgtcacgt

SEQ ID NO: 349342 - DNA, 25 bp, Mus musculus
ggaggcgccctctccattggccagg

SEQ ID NO: 349343 - DNA, 25 bp, Mus musculus
ccgtgggagctttaaacctcgagct

SEQ ID NO: 349344 - DNA, 25 bp, Mus musculus
gagctgacctacgaactctcggctg

SEQ ID NO: 349345 - DNA, 25 bp, Mus musculus
aactctcggctgacgtcttgcgcgc

SEQ ID NO: 349346 - DNA, 25 bp, Mus musculus
cggcttaaccctttcctctggcaag

SEQ ID NO: 349347 - DNA, 25 bp, Mus musculus
gcaattcggatgcttggccagcctg

SEQ ID NO: 349348 - DNA, 25 bp, Mus musculus
gggatctcccagagcgttccctctg

SEQ ID NO: 349349 - DNA, 25 bp, Mus musculus
ctcctccggataccagttccaggga

SEQ ID NO: 349350 - DNA, 25 bp, Mus musculus
tagctggcgccatcttccgtggtcc

SEQ ID NO: 349351 - DNA, 25 bp, Mus musculus
aacgtctgagccctgcgcctagctg

SEQ ID NO: 349352 - DNA, 25 bp, Mus musculus
tgggctctgcccgaacgtctgagcc

SEQ ID NO: 349353 - DNA, 25 bp, Mus musculus
cctctctgattcctgcagggacaca

SEQ ID NO: 349354 - DNA, 25 bp, Mus musculus
ggccatcctctctgattcctgcagg

SEQ ID NO: 349355 - DNA, 25 bp, Mus musculus
actgtcggacgaatcctctcccggt

SEQ ID NO: 349356 - DNA, 25 bp, Mus musculus
ctgctccgcttcactgtcggacgaa

SEQ ID NO: 349357 - DNA, 25 bp, Mus musculus
ctttacggatcagcttctggggccc

SEQ ID NO: 349358 - DNA, 25 bp, Mus musculus
tccagaggtggacactttacggatc

SEQ ID NO: 349359 - DNA, 25 bp, Mus musculus
cttggtccgcatctgtccagaggtg

SEQ ID NO: 349360 - DNA, 25 bp, Mus musculus
ggataccagttccagggatctccca

SEQ ID NO: 349361 - DNA, 25 bp, Mus musculus
ggccgagccttaccttggtccgcat

SEQ ID NO: 349362 - DNA, 25 bp, Mus musculus
cctgaacggaacatgggccgggagg

SEQ ID NO: 349363 - DNA, 25 bp, Mus musculus
agccacgggccctcccgcgttctct

SEQ ID NO: 349364 - DNA, 25 bp, Mus musculus
tgcccggggccagccacgggccctc

SEQ ID NO: 349365 - DNA, 25 bp, Mus musculus
gtcgctgccgccctggctcctgccc

SEQ ID NO: 349366 - DNA, 25 bp, Mus musculus
gtgctgaggctccatcgcgccggcc

SEQ ID NO: 349367 - DNA, 25 bp, Mus musculus
tccacaggcggcggtccttgggaac

SEQ ID NO: 349368 - DNA, 25 bp, Mus musculus
agcctccacaggcggcggtccttgg

SEQ ID NO: 349369 - DNA, 25 bp, Mus musculus
cctcccgcgttctctggcttccgcc

SEQ ID NO: 349370 - DNA, 25 bp, Mus musculus
tataaggcgcggaaccgaaagcagc

SEQ ID NO: 349371 - DNA, 25 bp, Mus musculus
ccacggccgcagaatccgcccctct

SEQ ID NO: 349372 - DNA, 25 bp, Mus musculus
ctgaccgcgcaaccccgtcgcctcc

SEQ ID NO: 349373 - DNA, 25 bp, Mus musculus
caggccatataaggcgcggaaccga

SEQ ID NO: 349374 - DNA, 25 bp, Mus musculus
taaggcgcggaaccgaaagcagcca

SEQ ID NO: 349375 - DNA, 25 bp, Mus musculus
agccaccgggtggtcacgggcaccg

SEQ ID NO: 349376 - DNA, 25 bp, Mus musculus
ctcgctgctttgtgatgtggggcaa

SEQ ID NO: 349377 - DNA, 25 bp, Mus musculus
gtagccgatcctaccggctggcgct

SEQ ID NO: 349378 - DNA, 25 bp, Mus musculus
ttcctgtcccgctcgccgatcgcct

SEQ ID NO: 349379 - DNA, 25 bp, Mus musculus
tcctgcccggtccagggactgtgct

SEQ ID NO: 349380 - DNA, 25 bp, Mus musculus
cagggactgtgcttgtccgaagccc

SEQ ID NO: 349381 - DNA, 25 bp, Mus musculus
gaagcccctggaggtcccacgcatg

SEQ ID NO: 349382 - DNA, 25 bp, Mus musculus
tcccacgcatgcctcctgcaccatg

SEQ ID NO: 349383 - DNA, 25 bp, Mus musculus
ctgcaccatgcagtcacgcctcctc

SEQ ID NO: 349384 - DNA, 25 bp, Mus musculus
ctcccggcgagtgcggctgctcttg

SEQ ID NO: 349385 - DNA, 25 bp, Mus musculus
tcaggctgctgcactctggggcgac

SEQ ID NO: 349386 - DNA, 25 bp, Mus musculus
tctggggcgaccgactcaggtaact

SEQ ID NO: 349387 - DNA, 25 bp, Mus musculus
gaccgactcaggtaactgggccctc

SEQ ID NO: 349388 - DNA, 25 bp, Mus musculus
taactgggccctccgccttcgctgc

SEQ ID NO: 349389 - DNA, 25 bp, Mus musculus
gctgccctcgctgctttgtgatgtg

SEQ ID NO: 349390 - DNA, 25 bp, Mus musculus
gtcgaactcgcacagcacgtcggtc

SEQ ID NO: 349391 - DNA, 25 bp, Mus musculus
gcctgagcgctagctactcgcctga

SEQ ID NO: 349392 - DNA, 25 bp, Mus musculus
tcagtgacacgcgtagcagagatgc

SEQ ID NO: 349393 - DNA, 25 bp, Mus musculus
tacttgcaggctccagctctcaggg

SEQ ID NO: 349394 - DNA, 25 bp, Mus musculus
tggaagaagaccttagcgacctctg

SEQ ID NO: 349395 - DNA, 25 bp, Mus musculus
ttacgtgtcagactccggttccttg

SEQ ID NO: 349396 - DNA, 25 bp, Mus musculus
agtctgagtcagcaggcacccgtta

SEQ ID NO: 349397 - DNA, 25 bp, Mus musculus
ctgaaagtctggaagtcacctagcc

SEQ ID NO: 349398 - DNA, 25 bp, Mus musculus
cctccgtgggttgagctgaaagtct

SEQ ID NO: 349399 - DNA, 25 bp, Mus musculus
agcgcctgtcaccagacacggagga

SEQ ID NO: 349400 - DNA, 25 bp, Mus musculus
tgctgagtaagtcccagacgaccta

SEQ ID NO: 349401 - DNA, 25 bp, Mus musculus
tgcctttgccagtgacagccacgca

SEQ ID NO: 349402 - DNA, 25 bp, Mus musculus
gctcctcatagtggaagtggcgctc

SEQ ID NO: 349403 - DNA, 25 bp, Mus musculus
cagccacgcagtcagttactccgta

SEQ ID NO: 349404 - DNA, 25 bp, Mus musculus
gcctagtcatttactcgccctaatc

SEQ ID NO: 349405 - DNA, 25 bp, Mus musculus
cgcatgcgcagtctcgcggccaaga

SEQ ID NO: 349406 - DNA, 25 bp, Mus musculus
cgcggccaagagaaagactagactc

SEQ ID NO: 349407 - DNA, 25 bp, Mus musculus
gactagactcttctcacccgggagg

SEQ ID NO: 349408 - DNA, 25 bp, Mus musculus
gctgtggctcctgtcacgtcttaag

SEQ ID NO: 349409 - DNA, 25 bp, Mus musculus
gtcacgtcttaagcgcctagtcatt

SEQ ID NO: 349410 - DNA, 25 bp, Mus musculus
cgccctaatctctggactgttcgtc

SEQ ID NO: 349411 - DNA, 25 bp, Mus musculus
ggacccgaagcagctcggactactc

SEQ ID NO: 349412 - DNA, 25 bp, Mus musculus
cgccaagatggcgaccagggctcgc

SEQ ID NO: 349413 - DNA, 25 bp, Mus musculus
aagcggaacacagcgcactccagtg

SEQ ID NO: 349414 - DNA, 25 bp, Mus musculus
cgctcaccagcacgcgcttgaagag

SEQ ID NO: 349415 - DNA, 25 bp, Mus musculus
aactctcccgcacagaggcatgggc

SEQ ID NO: 349416 - DNA, 25 bp, Mus musculus
gggcccgcacaaacatgcaaactct

SEQ ID NO: 349417 - DNA, 25 bp, Mus musculus
cgcgcttgaagagggcgctctcctt

SEQ ID NO: 349418 - DNA, 25 bp, Mus musculus
cttgaggagaagcagcggctcattc

SEQ ID NO: 349419 - DNA, 25 bp, Mus musculus
ggttgactgacagccggtgaccacc

SEQ ID NO: 349420 - DNA, 25 bp, Mus musculus
tcctagtcctcgaccactctgtagg

SEQ ID NO: 349421 - DNA, 25 bp, Mus musculus
agttgctacccgcaatgacgttttc

SEQ ID NO: 349422 - DNA, 25 bp, Mus musculus
gcctgaaattttgggattggtcgaa

SEQ ID NO: 349423 - DNA, 25 bp, Mus musculus
tgacaaggctgtgattggacgatcc

SEQ ID NO: 349424 - DNA, 25 bp, Mus musculus
ttggacgatccatggttgactgaca

SEQ ID NO: 349425 - DNA, 25 bp, Mus musculus
gtgtgccgtgttatgccggactaaa

SEQ ID NO: 349426 - DNA, 25 bp, Mus musculus
tgccggactaaagggaggccaccac

SEQ ID NO: 349427 - DNA, 25 bp, Mus musculus
actgtgctccggaggaccggttcag

SEQ ID NO: 349428 - DNA, 25 bp, Mus musculus
acccaagtctgcctctcagttgcta

SEQ ID NO: 349429 - DNA, 25 bp, Mus musculus
ctcattcctgtcagggctctggctc

SEQ ID NO: 349430 - DNA, 25 bp, Mus musculus
ggaatgactcttgacagccgcctgc

SEQ ID NO: 349431 - DNA, 25 bp, Mus musculus
ggctctgtttattgtccctcttgga

SEQ ID NO: 349432 - DNA, 25 bp, Mus musculus
agcggcttcggcctcttcatatagt

SEQ ID NO: 349433 - DNA, 25 bp, Mus musculus
ctcttcatatagtccgtgagccgga

SEQ ID NO: 349434 - DNA, 25 bp, Mus musculus
tatagtccgtgagccggaggatccc

SEQ ID NO: 349435 - DNA, 25 bp, Mus musculus
tgagccggaggatcccgtcatgcat

SEQ ID NO: 349436 - DNA, 25 bp, Mus musculus
aggatcccgtcatgcatcgaggcgc

SEQ ID NO: 349437 - DNA, 25 bp, Mus musculus
cgtcatgcatcgaggcgcgcgaaag

SEQ ID NO: 349438 - DNA, 25 bp, Mus musculus
ccgcgagccgagtttgttctgggac

SEQ ID NO: 349439 - DNA, 25 bp, Mus musculus
actacgcgataaaggcagacggctc

SEQ ID NO: 349440 - DNA, 25 bp, Mus musculus
agtcagccggggactacgcgataaa

SEQ ID NO: 349441 - DNA, 25 bp, Mus musculus
gaagagtagttcgtccgggcatcta

SEQ ID NO: 349442 - DNA, 25 bp, Mus musculus
cgcgaaaggcaacctgggaagagta

SEQ ID NO: 349443 - DNA, 25 bp, Mus musculus
ggcatctacccgtctcgcccgctcg

SEQ ID NO: 349444 - DNA, 25 bp, Mus musculus
tttgttctgggacgccgctgagtcg

SEQ ID NO: 349445 - DNA, 25 bp, Mus musculus
cgtgaagggaaacagtgagtcagcc

SEQ ID NO: 349446 - DNA, 25 bp, Mus musculus
tgtcgctcagcgaggccaacgtgca

SEQ ID NO: 349447 - DNA, 25 bp, Mus musculus
cttctcgtgcaaccgcaacgtgctg

SEQ ID NO: 349448 - DNA, 25 bp, Mus musculus
tctccaccatgcagtcccgggaaga

SEQ ID NO: 349449 - DNA, 25 bp, Mus musculus
agaggatttccaagccctcggtgtc

SEQ ID NO: 349450 - DNA, 25 bp, Mus musculus
cctggcacagctcaagtctttctac

SEQ ID NO: 349451 - DNA, 25 bp, Mus musculus
tcaagtctttctacgacgcgcggct

SEQ ID NO: 349452 - DNA, 25 bp, Mus musculus
ggctgctgtgcgatgtgaccatcga

SEQ ID NO: 349453 - DNA, 25 bp, Mus musculus
ctacttcaagagcatgttcacgggg

SEQ ID NO: 349454 - DNA, 25 bp, Mus musculus
ggcatgtacgagagccagcaggcca

SEQ ID NO: 349455 - DNA, 25 bp, Mus musculus
agcaggccagcgtgacgatccacga

SEQ ID NO: 349456 - DNA, 25 bp, Mus musculus
tggatgccgagtccttcgaggtctt

SEQ ID NO: 349457 - DNA, 25 bp, Mus musculus
tgctacactggtcgcgtgtcgctca

SEQ ID NO: 349458 - DNA, 25 bp, Mus musculus
cctcggatatgctgcagctggagta

SEQ ID NO: 349459 - DNA, 25 bp, Mus musculus
tcgaggtcttggtggactactgcta

SEQ ID NO: 349460 - DNA, 25 bp, Mus musculus
ctggctgcagctcctaacaggtcta

SEQ ID NO: 349461 - DNA, 25 bp, Mus musculus
tccttgcgcccagtcacgatgaaga

SEQ ID NO: 349462 - DNA, 25 bp, Mus musculus
gaagtgctcagcagccgacaggatc

SEQ ID NO: 349463 - DNA, 25 bp, Mus musculus
gccttgctacgtgtggctcggatta

SEQ ID NO: 349464 - DNA, 25 bp, Mus musculus
cgtcctttgctggatccgtttgatg

SEQ ID NO: 349465 - DNA, 25 bp, Mus musculus
cacgatgtacgtgtgcgtcctttgc

SEQ ID NO: 349466 - DNA, 25 bp, Mus musculus
gggcatcccagtcacagcgaacact

SEQ ID NO: 349467 - DNA, 25 bp, Mus musculus
acggtcaacgttctcgggcatccca

SEQ ID NO: 349468 - DNA, 25 bp, Mus musculus
tgtgagcctcaatctcttcccgtgc

SEQ ID NO: 349469 - DNA, 25 bp, Mus musculus
gacacacgtcggtaccattggcatg

SEQ ID NO: 349470 - DNA, 25 bp, Mus musculus
tccacggctgcccacatagaagggc

SEQ ID NO: 349471 - DNA, 25 bp, Mus musculus
acccactggatctgggacgcttcga

SEQ ID NO: 349472 - DNA, 25 bp, Mus musculus
catggaagtcactgtcgggacccga

SEQ ID NO: 349473 - DNA, 25 bp, Mus musculus
cggctctctcgaagggcgcccaaat

SEQ ID NO: 349474 - DNA, 25 bp, Mus musculus
tcgtccgcgctggtgtgaagatgct

SEQ ID NO: 349475 - DNA, 25 bp, Mus musculus
ggccgtcggctacgcgataaaggga

SEQ ID NO: 349476 - DNA, 25 bp, Mus musculus
tgcgcttttgcggtgtcgtccgcgc

SEQ ID NO: 349477 - DNA, 25 bp, Mus musculus
cgtcggctacgcgataaagggaggc

SEQ ID NO: 349478 - DNA, 25 bp, Mus musculus
gcgcttttgcggtgtcgtccgcgct

SEQ ID NO: 349479 - DNA, 25 bp, Mus musculus
cgcttttgcggtgtcgtccgcgctg

SEQ ID NO: 349480 - DNA, 25 bp, Mus musculus
cttttgcggtgtcgtccgcgctggt

SEQ ID NO: 349481 - DNA, 25 bp, Mus musculus
ccgcccctgtgttggcgagggaggc

SEQ ID NO: 349482 - DNA, 25 bp, Mus musculus
cgctgtgccgcccctgtgttggcga

SEQ ID NO: 349483 - DNA, 25 bp, Mus musculus
tctgttctgggtcgccgctgtgccg

SEQ ID NO: 349484 - DNA, 25 bp, Mus musculus
agtctgttctgggtcgccgctgtgc

SEQ ID NO: 349485 - DNA, 25 bp, Mus musculus
ccgcgagcggagtctgttctgggtc

SEQ ID NO: 349486 - DNA, 25 bp, Mus musculus
cggctacgcgataaagggaggcggc

SEQ ID NO: 349487 - DNA, 25 bp, Mus musculus
tgtgaagatgctggccgtcggctac

SEQ ID NO: 349488 - DNA, 25 bp, Mus musculus
tctccaccatgcagtcccgggaaga

SEQ ID NO: 349489 - DNA, 25 bp, Mus musculus
cctcggatatgctgcagctggagta

SEQ ID NO: 349490 - DNA, 25 bp, Mus musculus
tgtcgctcagcgaggccaacgtgca

SEQ ID NO: 349491 - DNA, 25 bp, Mus musculus
tgctacactggtcgcgtgtcgctca

SEQ ID NO: 349492 - DNA, 25 bp, Mus musculus
tcgaggtcttggtggactactgcta

SEQ ID NO: 349493 - DNA, 25 bp, Mus musculus
tggatgccgagtccttcgaggtctt

SEQ ID NO: 349494 - DNA, 25 bp, Mus musculus
agcaggccagcgtgacgatccacga

SEQ ID NO: 349495 - DNA, 25 bp, Mus musculus
ggcatgtacgagagccagcaggcca

SEQ ID NO: 349496 - DNA, 25 bp, Mus musculus
ctacttcaagagcatgttcacgggg

SEQ ID NO: 349497 - DNA, 25 bp, Mus musculus
cttctcgtgcaaccgcaacgtgctg

SEQ ID NO: 349498 - DNA, 25 bp, Mus musculus
ggctgctgtgcgatgtgaccatcga

SEQ ID NO: 349499 - DNA, 25 bp, Mus musculus
tcaagtctttctacgacgcgcggct

SEQ ID NO: 349500 - DNA, 25 bp, Mus musculus
agaggatttccaagccctcggtgtc

SEQ ID NO: 349501 - DNA, 25 bp, Mus musculus
cctggcacagctcaagtctttctac

SEQ ID NO: 349502 - DNA, 25 bp, Mus musculus
ccatatggtctagcggttaggattc

SEQ ID NO: 349503 - DNA, 25 bp, Mus musculus
gctgacttctgcagccgtgttcggg

SEQ ID NO: 349504 - DNA, 25 bp, Mus musculus
tacttgcttagtggctctggctgac

SEQ ID NO: 349505 - DNA, 25 bp, Mus musculus
cagtgtcactttttgctctagttga

SEQ ID NO: 349506 - DNA, 25 bp, Mus musculus
cccgctgcgagaggagtttcgcttt

SEQ ID NO: 349507 - DNA, 25 bp, Mus musculus
gattcctggttttcacccaggcggc

SEQ ID NO: 349508 - DNA, 25 bp, Mus musculus
ttgtagcagcacttcccatatggtc

SEQ ID NO: 349509 - DNA, 25 bp, Mus musculus
gacgctagtcaggtgggtcacagca

SEQ ID NO: 349510 - DNA, 25 bp, Mus musculus
ccggcttcggctcagaactttccag

SEQ ID NO: 349511 - DNA, 25 bp, Mus musculus
agcccgggacctgacggctgagaaa

SEQ ID NO: 349512 - DNA, 25 bp, Mus musculus
cacccagaagggacgaaagcgcgac

SEQ ID NO: 349513 - DNA, 25 bp, Mus musculus
agcaggcagtgtagttgctcccgtg

SEQ ID NO: 349514 - DNA, 25 bp, Mus musculus
tcaagccaggacctctcggtctcgg

SEQ ID NO: 349515 - DNA, 25 bp, Mus musculus
tcccggtatgggaacagtgtcactt

SEQ ID NO: 349516 - DNA, 25 bp, Mus musculus
gaagccagaactacctcccgacgga

SEQ ID NO: 349517 - DNA, 25 bp, Mus musculus
gaaaactccgtcctccatgccggta

SEQ ID NO: 349518 - DNA, 25 bp, Mus musculus
agctcagttggggtttctttagaag

SEQ ID NO: 349519 - DNA, 25 bp, Mus musculus
cgaccgctgattggctacggaggac

SEQ ID NO: 349520 - DNA, 25 bp, Mus musculus
aagcttacaagccatgccggatccc

SEQ ID NO: 349521 - DNA, 25 bp, Mus musculus
cagtaccttacagtgggctccgaga

SEQ ID NO: 349522 - DNA, 25 bp, Mus musculus
gtaaacggagcttaacgtgacactc

SEQ ID NO: 349523 - DNA, 25 bp, Mus musculus
ccgccggcggtagccatgatgaaaa

SEQ ID NO: 349524 - DNA, 25 bp, Mus musculus
agtgacgtcacgcacaacttggccg

SEQ ID NO: 349525 - DNA, 25 bp, Mus musculus
gctgccggaaaagacctggctgcca

SEQ ID NO: 349526 - DNA, 25 bp, Mus musculus
atgcgaactgatgcgccatcccggg

SEQ ID NO: 349527 - DNA, 25 bp, Mus musculus
ctccacggagagagtcatgcgaact

SEQ ID NO: 349528 - DNA, 25 bp, Mus musculus
cggtaacgtgacttccggcgagcca

SEQ ID NO: 349529 - DNA, 25 bp, Mus musculus
gtgggctccgagacaatatttcaaa

SEQ ID NO: 349530 - DNA, 25 bp, Mus musculus
gctcctaccttgagcagccgtgttg

SEQ ID NO: 349531 - DNA, 25 bp, Mus musculus
ccttgagcagccgtgttgggctccc

SEQ ID NO: 349532 - DNA, 25 bp, Mus musculus
atccctgcatcctgtcccgggggaa

SEQ ID NO: 349533 - DNA, 25 bp, Mus musculus
gtgccacccacactcgcgatccctg

SEQ ID NO: 349534 - DNA, 25 bp, Mus musculus
agatggactggttgccgtgccaccc

SEQ ID NO: 349535 - DNA, 25 bp, Mus musculus
gtcactcgttgaacttacgtgattg

SEQ ID NO: 349536 - DNA, 25 bp, Mus musculus
ttcacggtgacggtggtgtacgcct

SEQ ID NO: 349537 - DNA, 25 bp, Mus musculus
cagtaccgcgccagaaatgaggacc

SEQ ID NO: 349538 - DNA, 25 bp, Mus musculus
actggggagtcactcgttgaactta

SEQ ID NO: 349539 - DNA, 25 bp, Mus musculus
ttgcatcccaactggggagtcactc

SEQ ID NO: 349540 - DNA, 25 bp, Mus musculus
gaaatgaggaccacagctcctacct

SEQ ID NO: 349541 - DNA, 25 bp, Mus musculus
ctggctccacctaggggttcggcca

SEQ ID NO: 349542 - DNA, 25 bp, Mus musculus
cgcgccagaaatgaggaccacagct

SEQ ID NO: 349543 - DNA, 25 bp, Mus musculus
gcggcccttgcatcccaactgggga

SEQ ID NO: 349544 - DNA, 25 bp, Mus musculus
ctcatagactggcttggtgaagatc

SEQ ID NO: 349545 - DNA, 25 bp, Mus musculus
cggctgcagcctaaagtgctcgtgc

SEQ ID NO: 349546 - DNA, 25 bp, Mus musculus
tcaccaccaggtagctgccagcata

SEQ ID NO: 349547 - DNA, 25 bp, Mus musculus
cggccaccagcgtcaggttgtactc

SEQ ID NO: 349548 - DNA, 25 bp, Mus musculus
ttggcatctagcacacgcacgctga

SEQ ID NO: 349549 - DNA, 25 bp, Mus musculus
cggtccagagatgcagcggtcacca

SEQ ID NO: 349550 - DNA, 25 bp, Mus musculus
accagcgaggtgataccggcttcct

SEQ ID NO: 349551 - DNA, 25 bp, Mus musculus
cggccagaggagtgatagaaatttc

SEQ ID NO: 349552 - DNA, 25 bp, Mus musculus
cgcacgtccagctcgtaggtgtcct

SEQ ID NO: 349553 - DNA, 25 bp, Mus musculus
tgacttgaccgttgcgacccacgtc

SEQ ID NO: 349554 - DNA, 25 bp, Mus musculus
ctaccaggcggtaggtgacttgacc

SEQ ID NO: 349555 - DNA, 25 bp, Mus musculus
ctgagacgtaagtggacacggcttc

SEQ ID NO: 349556 - DNA, 25 bp, Mus musculus
ttcgcggaccgacacctcatagact

SEQ ID NO: 349557 - DNA, 25 bp, Mus musculus
gtctcggatgcgcacgataaccttg

SEQ ID NO: 349558 - DNA, 25 bp, Mus musculus
cacagctccacaatggccgcgtttt

SEQ ID NO: 349559 - DNA, 25 bp, Mus musculus
atgcctgcattgtgaagctcgcgtg

SEQ ID NO: 349560 - DNA, 25 bp, Mus musculus
gtcaccgcgtctaatgcctgcattg

SEQ ID NO: 349561 - DNA, 25 bp, Mus musculus
gccgcgttttctcgagatgcaaatg

SEQ ID NO: 349562 - DNA, 25 bp, Mus musculus
tcgcgcaatcctgagaacaaacaca

SEQ ID NO: 349563 - DNA, 25 bp, Mus musculus
tctctcggttttagcaactttgccc

SEQ ID NO: 349564 - DNA, 25 bp, Mus musculus
cgcctggttaccatgccaaaaggtc

SEQ ID NO: 349565 - DNA, 25 bp, Mus musculus
aaaagctgccctgatcgcctggtta

SEQ ID NO: 349566 - DNA, 25 bp, Mus musculus
ctcccggaggaaaagaaatgtctag

SEQ ID NO: 349567 - DNA, 25 bp, Mus musculus
tagcggtcactgcaactcccggagg

SEQ ID NO: 349568 - DNA, 25 bp, Mus musculus
taaagcagcgtgttagcggtcactg

SEQ ID NO: 349569 - DNA, 25 bp, Mus musculus
tggccgcccgcattcgccagataat

SEQ ID NO: 349570 - DNA, 25 bp, Mus musculus
gctgggtttctgtcaccgcgtctaa

SEQ ID NO: 349571 - DNA, 25 bp, Mus musculus
cgccagataatggaaagacgattta

SEQ ID NO: 349572 - DNA, 25 bp, Mus musculus
ggctctgcgggccttgatgctctcc

SEQ ID NO: 349573 - DNA, 25 bp, Mus musculus
agcaagagacgctggggagagaatc

SEQ ID NO: 349574 - DNA, 25 bp, Mus musculus
tcagtatcaatgtttaagcggcggc

SEQ ID NO: 349575 - DNA, 25 bp, Mus musculus
gctagtcaatgactctaaagagctg

SEQ ID NO: 349576 - DNA, 25 bp, Mus musculus
gccgccgagacttagcgcgggctct

SEQ ID NO: 349577 - DNA, 25 bp, Mus musculus
ccttgatgctctccggtcggactca

SEQ ID NO: 349578 - DNA, 25 bp, Mus musculus
ctctccggtcggactcaagctagtc

SEQ ID NO: 349579 - DNA, 25 bp, Mus musculus
ccggtcggactcaagctagtcaatg

SEQ ID NO: 349580 - DNA, 25 bp, Mus musculus
cgtgaggtgaatagagtcagtcagc

SEQ ID NO: 349581 - DNA, 25 bp, Mus musculus
ggactcaagctagtcaatgactcta

SEQ ID NO: 349582 - DNA, 25 bp, Mus musculus
tgactctaaagagctggggctgctg

SEQ ID NO: 349583 - DNA, 25 bp, Mus musculus
agagaatccggactgcgagcccggc

SEQ ID NO: 349584 - DNA, 25 bp, Mus musculus
tagagtcagtcagcaagagacgctg

SEQ ID NO: 349585 - DNA, 25 bp, Mus musculus
atcaatgtttaagcggcggcgtgag

SEQ ID NO: 349586 - DNA, 25 bp, Mus musculus
atgagaacacctgcatttctggatg

SEQ ID NO: 349587 - DNA, 25 bp, Mus musculus
atacgattcgttccgctgcttctga

SEQ ID NO: 349588 - DNA, 25 bp, Mus musculus
ggagagtgaatacgattcgttccgc

SEQ ID NO: 349589 - DNA, 25 bp, Mus musculus
aataatgtgtagatcaacccgtgcc

SEQ ID NO: 349590 - DNA, 25 bp, Mus musculus
tgcatttctggatgtgtcattcccg

SEQ ID NO: 349591 - DNA, 25 bp, Mus musculus
tctggatgtgtcattcccgtatacc

SEQ ID NO: 349592 - DNA, 25 bp, Mus musculus
cccgtataccgaggcgctgggagaa

SEQ ID NO: 349593 - DNA, 25 bp, Mus musculus
tgtgtagatcaacccgtgcctaacc

SEQ ID NO: 349594 - DNA, 25 bp, Mus musculus
cccgcagatgagaacacctgcattt

SEQ ID NO: 349595 - DNA, 25 bp, Mus musculus
tcattcccgtataccgaggcgctgg

SEQ ID NO: 349596 - DNA, 25 bp, Mus musculus
gattcgttccgctgcttctgactca

SEQ ID NO: 349597 - DNA, 25 bp, Mus musculus
ctgggagaagcggaaataatgtgta

SEQ ID NO: 349598 - DNA, 25 bp, Mus musculus
tgcttctgactcatcccgcagatga

SEQ ID NO: 349599 - DNA, 25 bp, Mus musculus
tgtgtcattcccgtataccgaggcg

SEQ ID NO: 349600 - DNA, 25 bp, Mus musculus
tccgtcatacttggtggaactgccc

SEQ ID NO: 349601 - DNA, 25 bp, Mus musculus
gaactgcccgagaacgctccactgg

SEQ ID NO: 349602 - DNA, 25 bp, Mus musculus
acccgcgatgatcatggcctctttg

SEQ ID NO: 349603 - DNA, 25 bp, Mus musculus
gtccagtcttcgaggctccgtcata

SEQ ID NO: 349604 - DNA, 25 bp, Mus musculus
cgacggcaccaagttcccagagctg

SEQ ID NO: 349605 - DNA, 25 bp, Mus musculus
tcccagagctggtcatccaaaaggc

SEQ ID NO: 349606 - DNA, 25 bp, Mus musculus
gctccgccaccgtacagatcaatgt

SEQ ID NO: 349607 - DNA, 25 bp, Mus musculus
ccactgatgctgatgaaggtcccaa

SEQ ID NO: 349608 - DNA, 25 bp, Mus musculus
ctataccgtggtgactgaccgtcca

SEQ ID NO: 349609 - DNA, 25 bp, Mus musculus
gccgtccattggtttcgtctccgtg

SEQ ID NO: 349610 - DNA, 25 bp, Mus musculus
ccggaacgataacgcgccgtccatt

SEQ ID NO: 349611 - DNA, 25 bp, Mus musculus
ctgcaaggtcacagtcaagcttatc

SEQ ID NO: 349612 - DNA, 25 bp, Mus musculus
cctgatccgcgttaagggcaacctg

SEQ ID NO: 349613 - DNA, 25 bp, Mus musculus
gtcctctactccttcagcagctatg

SEQ ID NO: 349614 - DNA, 25 bp, Mus musculus
tgcaagagccttcagccagcgagtc

SEQ ID NO: 349615 - DNA, 25 bp, Mus musculus
tgcggtttgcgccttttcatcggcc

SEQ ID NO: 349616 - DNA, 25 bp, Mus musculus
ccacggctcagcgtgcaaacaatgc

SEQ ID NO: 349617 - DNA, 25 bp, Mus musculus
tctcacagcgcttaaaaactcccag

SEQ ID NO: 349618 - DNA, 25 bp, Mus musculus
actcccaggattctcacagcgctta

SEQ ID NO: 349619 - DNA, 25 bp, Mus musculus
accttcaaatgacccaaccagtctg

SEQ ID NO: 349620 - DNA, 25 bp, Mus musculus
ttcccgggctgctaaccttcaaatg

SEQ ID NO: 349621 - DNA, 25 bp, Mus musculus
tgcgagtgaactttcggtgaaccct

SEQ ID NO: 349622 - DNA, 25 bp, Mus musculus
ttgaattgcctaatatatgcgagtg

SEQ ID NO: 349623 - DNA, 25 bp, Mus musculus
ttctgtcacacggaatgaaagattg

SEQ ID NO: 349624 - DNA, 25 bp, Mus musculus
aaagaatagaccctcctgcctcgga

SEQ ID NO: 349625 - DNA, 25 bp, Mus musculus
atcccagtcttgtggccgcggcgca

SEQ ID NO: 349626 - DNA, 25 bp, Mus musculus
cgtcctctgcatcccagtcttgtgg

SEQ ID NO: 349627 - DNA, 25 bp, Mus musculus
gcaaacaatgccaggagcgcaggga

SEQ ID NO: 349628 - DNA, 25 bp, Mus musculus
atctccgcgacatgctccgagctgg

SEQ ID NO: 349629 - DNA, 25 bp, Mus musculus
gacagctggtccagcgccaggcgca

SEQ ID NO: 349630 - DNA, 25 bp, Mus musculus
atcgagggtcccacgcccatcgagg

SEQ ID NO: 349631 - DNA, 25 bp, Mus musculus
cacagccatgcagggtgcacaagtc

SEQ ID NO: 349632 - DNA, 25 bp, Mus musculus
cgtcaccgagggtgccacagccatg

SEQ ID NO: 349633 - DNA, 25 bp, Mus musculus
tgtcagtgccattgagggtgccacc

SEQ ID NO: 349634 - DNA, 25 bp, Mus musculus
aagccacggccatcgtgggtgccag

SEQ ID NO: 349635 - DNA, 25 bp, Mus musculus
ggggccaccgaagaagccacggcca

SEQ ID NO: 349636 - DNA, 25 bp, Mus musculus
ctcacgtcggggtccaaaagaggca

SEQ ID NO: 349637 - DNA, 25 bp, Mus musculus
tcagccagcagcgtcgagggaccca

SEQ ID NO: 349638 - DNA, 25 bp, Mus musculus
atcacgttcaactgctcagccagca

SEQ ID NO: 349639 - DNA, 25 bp, Mus musculus
tgcgactcccgatcacgttcaactg

SEQ ID NO: 349640 - DNA, 25 bp, Mus musculus
gttcacgcttttcttgcgactcccg

SEQ ID NO: 349641 - DNA, 25 bp, Mus musculus
agcccggcatggctttagcgctcgg

SEQ ID NO: 349642 - DNA, 25 bp, Mus musculus
acgttgtggctctggcccacactta

SEQ ID NO: 349643 - DNA, 25 bp, Mus musculus
tctggcccacacttaccaacttggg

SEQ ID NO: 349644 - DNA, 25 bp, Mus musculus
cacttaccaacttgggtcgcttctc

SEQ ID NO: 349645 - DNA, 25 bp, Mus musculus
cgacgacttgctgtcccggccgaga

SEQ ID NO: 349646 - DNA, 25 bp, Mus musculus
catcttcccgggtctaggtcgcgac

SEQ ID NO: 349647 - DNA, 25 bp, Mus musculus
tcgcgacctgatctggggctttgct

SEQ ID NO: 349648 - DNA, 25 bp, Mus musculus
tggggctttgctccgcgggctcaac

SEQ ID NO: 349649 - DNA, 25 bp, Mus musculus
taaccgctgcacacggctgggccaa

SEQ ID NO: 349650 - DNA, 25 bp, Mus musculus
cggctgggccaatctatctgaaatc

SEQ ID NO: 349651 - DNA, 25 bp, Mus musculus
ggccaatctatctgaaatctcccgc

SEQ ID NO: 349652 - DNA, 25 bp, Mus musculus
ccgcggaacctgtgacgcaagggcc

SEQ ID NO: 349653 - DNA, 25 bp, Mus musculus
ccttttccggggatgccaaagcctg

SEQ ID NO: 349654 - DNA, 25 bp, Mus musculus
tgattggcccttcggcctgtccatc

SEQ ID NO: 349655 - DNA, 25 bp, Mus musculus
aaagcctgggcctgattggcccttc

SEQ ID NO: 349656 - DNA, 25 bp, Mus musculus
aacagctaaccatggccgaggtgtc

SEQ ID NO: 349657 - DNA, 25 bp, Mus musculus
cccgagcctgaacagctaaccatgg

SEQ ID NO: 349658 - DNA, 25 bp, Mus musculus
gcacagtcgaacagaggagtttttt

SEQ ID NO: 349659 - DNA, 25 bp, Mus musculus
atgcccagtggcacagtcgaacaga

SEQ ID NO: 349660 - DNA, 25 bp, Mus musculus
gaagcgcccgtctcactgagcatgc

SEQ ID NO: 349661 - DNA, 25 bp, Mus musculus
tgcgagccgcagtctctgagcctcg

SEQ ID NO: 349662 - DNA, 25 bp, Mus musculus
caaaacgcggcgagcggaacccgca

SEQ ID NO: 349663 - DNA, 25 bp, Mus musculus
tgcggccgctcacaaaacgcggcga

SEQ ID NO: 349664 - DNA, 25 bp, Mus musculus
tgtgcaacttagaaagtgaccaagc

SEQ ID NO: 349665 - DNA, 25 bp, Mus musculus
ggctcccgcatgtgtgtgcaactta

SEQ ID NO: 349666 - DNA, 25 bp, Mus musculus
taatccctgggatgcgcggctcccg

SEQ ID NO: 349667 - DNA, 25 bp, Mus musculus
aaccatggccgaggtgtccggcgcc

SEQ ID NO: 349668 - DNA, 25 bp, Mus musculus
caacagccagctcgggtgcagaatg

SEQ ID NO: 349669 - DNA, 25 bp, Mus musculus
caaacgtggccgtggtagcatcatc

SEQ ID NO: 349670 - DNA, 25 bp, Mus musculus
atgcggatcggctttcccttcatca

SEQ ID NO: 349671 - DNA, 25 bp, Mus musculus
ctttcccttcatcacgtcgaagttc

SEQ ID NO: 349672 - DNA, 25 bp, Mus musculus
ggctttcccttcatcacgtcgaagt

SEQ ID NO: 349673 - DNA, 25 bp, Mus musculus
tcggctttcccttcatcacgtcgaa

SEQ ID NO: 349674 - DNA, 25 bp, Mus musculus
gatcggctttcccttcatcacgtcg

SEQ ID NO: 349675 - DNA, 25 bp, Mus musculus
cggatcggctttcccttcatcacgt

SEQ ID NO: 349676 - DNA, 25 bp, Mus musculus
tgcggatcggctttcccttcatcac

SEQ ID NO: 349677 - DNA, 25 bp, Mus musculus
gatgcggatcggctttcccttcatc

SEQ ID NO: 349678 - DNA, 25 bp, Mus musculus
catgatgcggatcggctttcccttc

SEQ ID NO: 349679 - DNA, 25 bp, Mus musculus
cacatgatgcggatcggctttccct

SEQ ID NO: 349680 - DNA, 25 bp, Mus musculus
ccacatgatgcggatcggctttccc

SEQ ID NO: 349681 - DNA, 25 bp, Mus musculus
cgagggatccctctgcgaccacatg

SEQ ID NO: 349682 - DNA, 25 bp, Mus musculus
aacgagggatccctctgcgaccaca

SEQ ID NO: 349683 - DNA, 25 bp, Mus musculus
gcggatcggctttcccttcatcacg

SEQ ID NO: 349684 - DNA, 25 bp, Mus musculus
gacttctaacaaggcctactgcagg

SEQ ID NO: 349685 - DNA, 25 bp, Mus musculus
gatggctcaccaccggacggacaga

SEQ ID NO: 349686 - DNA, 25 bp, Mus musculus
aaccaaatctttgcgggtgccggcg

SEQ ID NO: 349687 - DNA, 25 bp, Mus musculus
cgcgtttcgtgataaatataggccc

SEQ ID NO: 349688 - DNA, 25 bp, Mus musculus
cgccttgggaacacgcgtttcgtga

SEQ ID NO: 349689 - DNA, 25 bp, Mus musculus
tcacggccgccttgggaacacgcgt

SEQ ID NO: 349690 - DNA, 25 bp, Mus musculus
tttgtactctccagctgtcctggct

SEQ ID NO: 349691 - DNA, 25 bp, Mus musculus
tcctggagtttgtactctccagctg

SEQ ID NO: 349692 - DNA, 25 bp, Mus musculus
gacaaaaggctctcaaaaacaatat

SEQ ID NO: 349693 - DNA, 25 bp, Mus musculus
cccgcagggctaaacttttcataca

SEQ ID NO: 349694 - DNA, 25 bp, Mus musculus
ctactgcaggacaaaaggggctccg

SEQ ID NO: 349695 - DNA, 25 bp, Mus musculus
ccaggaggacttctaacaaggccta

SEQ ID NO: 349696 - DNA, 25 bp, Mus musculus
ggctcaccaccggacggacagacag

SEQ ID NO: 349697 - DNA, 25 bp, Mus musculus
ccgaggagctatggcacgcgccgca

SEQ ID NO: 349698 - DNA, 25 bp, Mus musculus
agcatgcccggcaggggccagcacc

SEQ ID NO: 349699 - DNA, 25 bp, Mus musculus
gccgcgaaaacctggaggaacgatc

SEQ ID NO: 349700 - DNA, 25 bp, Mus musculus
agctcttacccagcttgcggcggcg

SEQ ID NO: 349701 - DNA, 25 bp, Mus musculus
tgcggttgcaccggagcgaaacccg

SEQ ID NO: 349702 - DNA, 25 bp, Mus musculus
agctctggagctcttacccagcttg

SEQ ID NO: 349703 - DNA, 25 bp, Mus musculus
ctgttttcaggacgcgcactgagca

SEQ ID NO: 349704 - DNA, 25 bp, Mus musculus
tcccgggagagctgttttcaggacg

SEQ ID NO: 349705 - DNA, 25 bp, Mus musculus
ctcggcagccgcgaaaacctggagg

SEQ ID NO: 349706 - DNA, 25 bp, Mus musculus
aaggcgctgactgtcttcagcctcc

SEQ ID NO: 349707 - DNA, 25 bp, Mus musculus
cggaacaaggcgctgactgtcttca

SEQ ID NO: 349708 - DNA, 25 bp, Mus musculus
ccagcatcttgcagtgcgggaggct

SEQ ID NO: 349709 - DNA, 25 bp, Mus musculus
ctgattggccagcatcttgcagtgc

SEQ ID NO: 349710 - DNA, 25 bp, Mus musculus
acctccgggtcctgattggccagca

SEQ ID NO: 349711 - DNA, 25 bp, Mus musculus
agagctgttttcaggacgcgcactg

SEQ ID NO: 349712 - DNA, 25 bp, Mus musculus
aatttggagcctcgttcccttgcgc

SEQ ID NO: 349713 - DNA, 25 bp, Mus musculus
gtggggccctatacgacgcctccat

SEQ ID NO: 349714 - DNA, 25 bp, Mus musculus
atggtctccctcaccgcgttcaggt

SEQ ID NO: 349715 - DNA, 25 bp, Mus musculus
aggcctgacccggaactggagcgcc

SEQ ID NO: 349716 - DNA, 25 bp, Mus musculus
cgccggaccgcgttgatttgaattt

SEQ ID NO: 349717 - DNA, 25 bp, Mus musculus
cgcgttgatttgaatttggagcctc

SEQ ID NO: 349718 - DNA, 25 bp, Mus musculus
gttgcccacgagtgtaggtacgttc

SEQ ID NO: 349719 - DNA, 25 bp, Mus musculus
ttcccttgcgcggaacgtagagcga

SEQ ID NO: 349720 - DNA, 25 bp, Mus musculus
agcgaggagttagcgttcgaattca

SEQ ID NO: 349721 - DNA, 25 bp, Mus musculus
ttagcgttcgaattcacccggccgc

SEQ ID NO: 349722 - DNA, 25 bp, Mus musculus
aggcccggtcagacgagaacgacgc

SEQ ID NO: 349723 - DNA, 25 bp, Mus musculus
tctgcagggtgatgctagaacttcc

SEQ ID NO: 349724 - DNA, 25 bp, Mus musculus
ggtgatgctagaacttccacgttgc

SEQ ID NO: 349725 - DNA, 25 bp, Mus musculus
cgcctcgacgccattggctggttcg

SEQ ID NO: 349726 - DNA, 25 bp, Mus musculus
ccgcgcgggtcttcttcaagaacgt

SEQ ID NO: 349727 - DNA, 25 bp, Mus musculus
cggggctttcctctggactacagct

SEQ ID NO: 349728 - DNA, 25 bp, Mus musculus
cgcgagaaaacacgaaggcgcgttc

SEQ ID NO: 349729 - DNA, 25 bp, Mus musculus
tggtgaggtcactctcgcgagaaaa

SEQ ID NO: 349730 - DNA, 25 bp, Mus musculus
attcccgcttttgcccgctggctgg

SEQ ID NO: 349731 - DNA, 25 bp, Mus musculus
aacgtcttggacctgagcatctcgc

SEQ ID NO: 349732 - DNA, 25 bp, Mus musculus
gcaggtagtgctcgcgcacgatctt

SEQ ID NO: 349733 - DNA, 25 bp, Mus musculus
cgcagccgatgtcatcccgcaggta

SEQ ID NO: 349734 - DNA, 25 bp, Mus musculus
agcagcacattggtgtccggcagaa

SEQ ID NO: 349735 - DNA, 25 bp, Mus musculus
gggtagccacggtacttgcctctct

SEQ ID NO: 349736 - DNA, 25 bp, Mus musculus
gcgagtgttggttgtttcctcccgc

SEQ ID NO: 349737 - DNA, 25 bp, Mus musculus
tggttgtcttggtgaccgatcctaa

SEQ ID NO: 349738 - DNA, 25 bp, Mus musculus
ggatcccggccgtcagctaagaaac

SEQ ID NO: 349739 - DNA, 25 bp, Mus musculus
ttcttccgacttcttctggggcacg

SEQ ID NO: 349740 - DNA, 25 bp, Mus musculus
actgccctcggaggagctggtccag

SEQ ID NO: 349741 - DNA, 25 bp, Mus musculus
cgtgggccttctttcctactggcta

SEQ ID NO: 349742 - DNA, 25 bp, Mus musculus
tactggctaccctctggccctgggg

SEQ ID NO: 349743 - DNA, 25 bp, Mus musculus
tggggccttgccattggccacaacg

SEQ ID NO: 349744 - DNA, 25 bp, Mus musculus
cacaacgctgccagtccggtgagct

SEQ ID NO: 349745 - DNA, 25 bp, Mus musculus
ggcccacccggatctgtccagagga

SEQ ID NO: 349746 - DNA, 25 bp, Mus musculus
aggtacgcgctctcttaggttgctg

SEQ ID NO: 349747 - DNA, 25 bp, Mus musculus
gagaaagtggctgcccgaggacctc

SEQ ID NO: 349748 - DNA, 25 bp, Mus musculus
acgagcccgtgttcgcgcagctcaa

SEQ ID NO: 349749 - DNA, 25 bp, Mus musculus
cggcgctcttctccggagacgatct

SEQ ID NO: 349750 - DNA, 25 bp, Mus musculus
ctgtccagaggagctaaagagagcc

SEQ ID NO: 349751 - DNA, 25 bp, Mus musculus
gagacgatctgaaacacgcgcacca

SEQ ID NO: 349752 - DNA, 25 bp, Mus musculus
ccgccggcccaatctgtcagagaag

SEQ ID NO: 349753 - DNA, 25 bp, Mus musculus
gttgtgtacaaactgcgccgcagcc

SEQ ID NO: 349754 - DNA, 25 bp, Mus musculus
agaggactccgggtcaagcctcccg

SEQ ID NO: 349755 - DNA, 25 bp, Mus musculus
tttaggaaagcagtgaaagaggaca

SEQ ID NO: 349756 - DNA, 25 bp, Mus musculus
cttgggcaacaatggggtcccgacg

SEQ ID NO: 349757 - DNA, 25 bp, Mus musculus
cctgcgcgcacggagcagtggattc

SEQ ID NO: 349758 - DNA, 25 bp, Mus musculus
catgagtagggacagatcggtgctc

SEQ ID NO: 349759 - DNA, 25 bp, Mus musculus
agcaagctggccatttaggaaagca

SEQ ID NO: 349760 - DNA, 25 bp, Mus musculus
ggcgcctaagcaagctggccattta

SEQ ID NO: 349761 - DNA, 25 bp, Mus musculus
gctgagattcaccttggcgggatga

SEQ ID NO: 349762 - DNA, 25 bp, Mus musculus
ccactcgctgagattcaccttggcg

SEQ ID NO: 349763 - DNA, 25 bp, Mus musculus
cacgttgcaagagaagccagggcgc

SEQ ID NO: 349764 - DNA, 25 bp, Mus musculus
ttcgagtgcgttgcacgttgcaaga

SEQ ID NO: 349765 - DNA, 25 bp, Mus musculus
cattatttaggttcgagtgcgttgc

SEQ ID NO: 349766 - DNA, 25 bp, Mus musculus
gggcagagagactctactagagatg

SEQ ID NO: 349767 - DNA, 25 bp, Mus musculus
acagatcggtgctccgtcctcggag

SEQ ID NO: 349768 - DNA, 25 bp, Mus musculus
cggatctcggccatgagccaaggga

SEQ ID NO: 349769 - DNA, 25 bp, Mus musculus
agccttgtgctcgaagatgaacacc

SEQ ID NO: 349770 - DNA, 25 bp, Mus musculus
gcgtggtcctgcgatccaagcaaga

SEQ ID NO: 349771 - DNA, 25 bp, Mus musculus
taccatagccggaagcgcttgtcgc

SEQ ID NO: 349772 - DNA, 25 bp, Mus musculus
ccaactctcactgtgcaggagccga

SEQ ID NO: 349773 - DNA, 25 bp, Mus musculus
agctaggcgactccataactcgcgc

SEQ ID NO: 349774 - DNA, 25 bp, Mus musculus
tggtgccaccagttcttaaagtccg

SEQ ID NO: 349775 - DNA, 25 bp, Mus musculus
taaagtccgtgcttcagcggccctg

SEQ ID NO: 349776 - DNA, 25 bp, Mus musculus
tttggctgcagctcagtggactagc

SEQ ID NO: 349777 - DNA, 25 bp, Mus musculus
cggagctgactcctagcagggtgac

SEQ ID NO: 349778 - DNA, 25 bp, Mus musculus
tgaccggctgtcacctggaaggtcg

SEQ ID NO: 349779 - DNA, 25 bp, Mus musculus
gcccgctcagtcctggagaactagt

SEQ ID NO: 349780 - DNA, 25 bp, Mus musculus
tgcgggaaaggctcatcctgaatgc

SEQ ID NO: 349781 - DNA, 25 bp, Mus musculus
ggagccgaggaaactgctaactgtc

SEQ ID NO: 349782 - DNA, 25 bp, Mus musculus
ccaccggccagcacttccgcttccg

SEQ ID NO: 349783 - DNA, 25 bp, Mus musculus
cagcccgtactcacctccgacttgg

SEQ ID NO: 349784 - DNA, 25 bp, Mus musculus
agagaaacgcagtccgggcgccagc

SEQ ID NO: 349785 - DNA, 25 bp, Mus musculus
cgagttagagaaacgcagtccgggc

SEQ ID NO: 349786 - DNA, 25 bp, Mus musculus
cagagacacgagttagagaaacgca

SEQ ID NO: 349787 - DNA, 25 bp, Mus musculus
cggaagcagagacacgagttagaga

SEQ ID NO: 349788 - DNA, 25 bp, Mus musculus
acctggaacggaagcagagacacga

SEQ ID NO: 349789 - DNA, 25 bp, Mus musculus
gcccgtgacctggaacggaagcaga

SEQ ID NO: 349790 - DNA, 25 bp, Mus musculus
tcacctggcccgtgacctggaacgg

SEQ ID NO: 349791 - DNA, 25 bp, Mus musculus
agcggccatcccctcgggtgcaaga

SEQ ID NO: 349792 - DNA, 25 bp, Mus musculus
tccgacttggcatccagcacgggct

SEQ ID NO: 349793 - DNA, 25 bp, Mus musculus
tggcatccagcacgggctccctgaa

SEQ ID NO: 349794 - DNA, 25 bp, Mus musculus
cagtgtgatccaccggccagcactt

SEQ ID NO: 349795 - DNA, 25 bp, Mus musculus
ctgaacccagactcctccatgacca

SEQ ID NO: 349796 - DNA, 25 bp, Mus musculus
ggacgcctgggtccgtccgcaaata

SEQ ID NO: 349797 - DNA, 25 bp, Mus musculus
gtgtcttccgtccacctggcctgga

SEQ ID NO: 349798 - DNA, 25 bp, Mus musculus
ggcgctaggtgctctccagaaacca

SEQ ID NO: 349799 - DNA, 25 bp, Mus musculus
gtgctctccagaaaccacagacgtt

SEQ ID NO: 349800 - DNA, 25 bp, Mus musculus
ccacagacgtttctctgagcagagg

SEQ ID NO: 349801 - DNA, 25 bp, Mus musculus
tctgagcagaggttgtggcttaagc

SEQ ID NO: 349802 - DNA, 25 bp, Mus musculus
cctgaccagagtagttgagcaaatg

SEQ ID NO: 349803 - DNA, 25 bp, Mus musculus
agccgccgcttactgatccgggacg

SEQ ID NO: 349804 - DNA, 25 bp, Mus musculus
gtccgcaaatagctcccgggtgcct

SEQ ID NO: 349805 - DNA, 25 bp, Mus musculus
gtcttttcccgtcctcctggaagca

SEQ ID NO: 349806 - DNA, 25 bp, Mus musculus
tggtgtccgtacaggagacggaaaa

SEQ ID NO: 349807 - DNA, 25 bp, Mus musculus
gtggatgctgagagcgcaaactttc

SEQ ID NO: 349808 - DNA, 25 bp, Mus musculus
tcccggccatatcctgaccagagta

SEQ ID NO: 349809 - DNA, 25 bp, Mus musculus
actagagcggagcagcgacgctttc

SEQ ID NO: 349810 - DNA, 25 bp, Mus musculus
gagcgcgctcctggctttacctttc

SEQ ID NO: 349811 - DNA, 25 bp, Mus musculus
cctgccgctgccttcaccagccacc

SEQ ID NO: 349812 - DNA, 25 bp, Mus musculus
ggacccttcgggttggcaccgcagc

SEQ ID NO: 349813 - DNA, 25 bp, Mus musculus
ttcgggttggcaccgcagcctctgg

SEQ ID NO: 349814 - DNA, 25 bp, Mus musculus
cctctgggcaagaggctggcgagcg

SEQ ID NO: 349815 - DNA, 25 bp, Mus musculus
ctggcgagcgcgctcctggctttac

SEQ ID NO: 349816 - DNA, 25 bp, Mus musculus
tcaccagccaccagctggagccagg

SEQ ID NO: 349817 - DNA, 25 bp, Mus musculus
gccgcccgctggctgtgccctcagc

SEQ ID NO: 349818 - DNA, 25 bp, Mus musculus
ctttcgcgggctgctgggagtccac

SEQ ID NO: 349819 - DNA, 25 bp, Mus musculus
ggctttacctttcgcgggctgctgg

SEQ ID NO: 349820 - DNA, 25 bp, Mus musculus
ctggctttacctttcgcgggctgct

SEQ ID NO: 349821 - DNA, 25 bp, Mus musculus
gcgctcctggctttacctttcgcgg

SEQ ID NO: 349822 - DNA, 25 bp, Mus musculus
gcgagcgcgctcctggctttacctt

SEQ ID NO: 349823 - DNA, 25 bp, Mus musculus
ctcctggctttacctttcgcgggct

SEQ ID NO: 349824 - DNA, 25 bp, Mus musculus
ccagggatctcatcccgggcgggca

SEQ ID NO: 349825 - DNA, 25 bp, Mus musculus
ctcttctgtgtctcgtttcaggtca

SEQ ID NO: 349826 - DNA, 25 bp, Mus musculus
gtgtctcgtttcaggtcaccaacca

SEQ ID NO: 349827 - DNA, 25 bp, Mus musculus
tttcaggtcaccaaccaggtgagtg

SEQ ID NO: 349828 - DNA, 25 bp, Mus musculus
caaggatccagggatctcatcccgg

SEQ ID NO: 349829 - DNA, 25 bp, Mus musculus
cagcgagcgtcctctgtccctccgt

SEQ ID NO: 349830 - DNA, 25 bp, Mus musculus
tttggtagcccctcgcctggtatcc

SEQ ID NO: 349831 - DNA, 25 bp, Mus musculus
catcttggttcgtctccttgccgtt

SEQ ID NO: 349832 - DNA, 25 bp, Mus musculus
gcgcgtcgctaaaccctcttctgtg

SEQ ID NO: 349833 - DNA, 25 bp, Mus musculus
tcaacgctggctgccgctggaggcc

SEQ ID NO: 349834 - DNA, 25 bp, Mus musculus
cagtcatggagggtcaacgctggct

SEQ ID NO: 349835 - DNA, 25 bp, Mus musculus
tcgtggaagtccattcgttggtttc

SEQ ID NO: 349836 - DNA, 25 bp, Mus musculus
ctccgtagggagagatcaagcgtct

SEQ ID NO: 349837 - DNA, 25 bp, Mus musculus
tgagtgcggtcggtgcctgtcaccc

SEQ ID NO: 349838 - DNA, 25 bp, Mus musculus
ttcttggcccggaaaggtgcaattg

SEQ ID NO: 349839 - DNA, 25 bp, Mus musculus
ggttcctgaactcaaactgcacgtc

SEQ ID NO: 349840 - DNA, 25 bp, Mus musculus
ctgcaaattcttctaggttcctgaa

SEQ ID NO: 349841 - DNA, 25 bp, Mus musculus
tggagaaagcaactcctgcaaattc

SEQ ID NO: 349842 - DNA, 25 bp, Mus musculus
cttgagccgatttctagagtttgga

SEQ ID NO: 349843 - DNA, 25 bp, Mus musculus
tcctgctccagtcaggctgaacttg

SEQ ID NO: 349844 - DNA, 25 bp, Mus musculus
gcgacttttgaagttcccaggagtc

SEQ ID NO: 349845 - DNA, 25 bp, Mus musculus
cggtgacagcgcttgcgacttttga

SEQ ID NO: 349846 - DNA, 25 bp, Mus musculus
gcccagataattctgaccagagagg

SEQ ID NO: 349847 - DNA, 25 bp, Mus musculus
gcgacgccagcccagactaggggac

SEQ ID NO: 349848 - DNA, 25 bp, Mus musculus
caattgtgtgcagctattcctggta

SEQ ID NO: 349849 - DNA, 25 bp, Mus musculus
aactgcacgtcgctacaaagggcgg

SEQ ID NO: 349850 - DNA, 25 bp, Mus musculus
catctgggaccggtcagcgagctcc

SEQ ID NO: 349851 - DNA, 25 bp, Mus musculus
ttcctggtatgtcaggccgcaggca

SEQ ID NO: 349852 - DNA, 25 bp, Mus musculus
tccggcagctcgaagtactcggcct

SEQ ID NO: 349853 - DNA, 25 bp, Mus musculus
tgcaagtcccgcaggtaatccagga

SEQ ID NO: 349854 - DNA, 25 bp, Mus musculus
catacgccagagcagcgagtcgggc

SEQ ID NO: 349855 - DNA, 25 bp, Mus musculus
gtgcagcgccgggtcacatacacct

SEQ ID NO: 349856 - DNA, 25 bp, Mus musculus
cagctctacgatgtccgggaagagc

SEQ ID NO: 349857 - DNA, 25 bp, Mus musculus
gtaatcctcgggtgctgtccgccag

SEQ ID NO: 349858 - DNA, 25 bp, Mus musculus
cagagccatggccaaaaagaggtgg

SEQ ID NO: 349859 - DNA, 25 bp, Mus musculus
agcggctcttatcggggagccctgc

SEQ ID NO: 349860 - DNA, 25 bp, Mus musculus
ccggtccagaaagaagcggcctttg

SEQ ID NO: 349861 - DNA, 25 bp, Mus musculus
agtcgggcagcacgagctgcaagtc

SEQ ID NO: 349862 - DNA, 25 bp, Mus musculus
cggcagcagctcatcgcccagagag

SEQ ID NO: 349863 - DNA, 25 bp, Mus musculus
ggctgctgctgcgtgaacatacgcc

SEQ ID NO: 349864 - DNA, 25 bp, Mus musculus
tccaaagactgggacggcgtgagca

SEQ ID NO: 349865 - DNA, 25 bp, Mus musculus
gccgcttaagtagagccgcccgctt

SEQ ID NO: 349866 - DNA, 25 bp, Mus musculus
ggatctcagggagccgcggatgctg

SEQ ID NO: 349867 - DNA, 25 bp, Mus musculus
agcgcacgcgcgctggaacagaggc

SEQ ID NO: 349868 - DNA, 25 bp, Mus musculus
cggcgctggtgcttggctggctcct

SEQ ID NO: 349869 - DNA, 25 bp, Mus musculus
agggcggatccgataccttagcgcg

SEQ ID NO: 349870 - DNA, 25 bp, Mus musculus
gggccatgtggagcgcactggcgcc

SEQ ID NO: 349871 - DNA, 25 bp, Mus musculus
cgctgctcgggctggcgacgattct

SEQ ID NO: 349872 - DNA, 25 bp, Mus musculus
gtccccgacgtctgggcaacgctgg

SEQ ID NO: 349873 - DNA, 25 bp, Mus musculus
caacgctggccggtgccctacaagt

SEQ ID NO: 349874 - DNA, 25 bp, Mus musculus
ctggccggtgccctacaagtgagtg

SEQ ID NO: 349875 - DNA, 25 bp, Mus musculus
cgcccggaggtcacacggccaagcc

SEQ ID NO: 349876 - DNA, 25 bp, Mus musculus
cctacaagtgagtgagacggagcgg

SEQ ID NO: 349877 - DNA, 25 bp, Mus musculus
tccgataccttagcgcgcccgggga

SEQ ID NO: 349878 - DNA, 25 bp, Mus musculus
gatccgataccttagcgcgcccggg

SEQ ID NO: 349879 - DNA, 25 bp, Mus musculus
ttggagagggcggatccgatacctt

SEQ ID NO: 349880 - DNA, 25 bp, Mus musculus
cggctcccgcgcctctcacatgagg

SEQ ID NO: 349881 - DNA, 25 bp, Mus musculus
gctgtccctggccaagtttgtttag

SEQ ID NO: 349882 - DNA, 25 bp, Mus musculus
caccaagttttccaccgtgcgcctc

SEQ ID NO: 349883 - DNA, 25 bp, Mus musculus
cgagcccgaagcttcggcccagtta

SEQ ID NO: 349884 - DNA, 25 bp, Mus musculus
tgttgacagacaccgaggcccgggc

SEQ ID NO: 349885 - DNA, 25 bp, Mus musculus
gagagcgtcgcgtcccttctctgtc

SEQ ID NO: 349886 - DNA, 25 bp, Mus musculus
ccgagacgccctaggcgagcagcga

SEQ ID NO: 349887 - DNA, 25 bp, Mus musculus
agcagcgatcgacagcagcgagccc

SEQ ID NO: 349888 - DNA, 25 bp, Mus musculus
gttcgccagacgtggctggcctttc

SEQ ID NO: 349889 - DNA, 25 bp, Mus musculus
ccagacgtggctggcctttcccagg

SEQ ID NO: 349890 - DNA, 25 bp, Mus musculus
aaatggcgcccgcagttcgcggccg

SEQ ID NO: 349891 - DNA, 25 bp, Mus musculus
ttagggaatccaaaatggcgcccgc

SEQ ID NO: 349892 - DNA, 25 bp, Mus musculus
agcttcggcccagttagggaatcca

SEQ ID NO: 349893 - DNA, 25 bp, Mus musculus
ggccacgccttgttgacagacaccg

SEQ ID NO: 349894 - DNA, 25 bp, Mus musculus
tgacagcagcagctgatagtgaccc

SEQ ID NO: 349895 - DNA, 25 bp, Mus musculus
ttacgagcagcacgaggaagagcct

SEQ ID NO: 349896 - DNA, 25 bp, Mus musculus
caagcaatccgctgctccgggtttt

SEQ ID NO: 349897 - DNA, 25 bp, Mus musculus
ctgagtggtgccaaagcgacaagca

SEQ ID NO: 349898 - DNA, 25 bp, Mus musculus
tccgcctccgagctgtggatgtcca

SEQ ID NO: 349899 - DNA, 25 bp, Mus musculus
tgctcagtaataggacccgtctctc

SEQ ID NO: 349900 - DNA, 25 bp, Mus musculus
accaccggagttgcccgcaatggga

SEQ ID NO: 349901 - DNA, 25 bp, Mus musculus
gggacactacaaagacagcgacctc

SEQ ID NO: 349902 - DNA, 25 bp, Mus musculus
ccgagccatcaggaaccggcatgaa

SEQ ID NO: 349903 - DNA, 25 bp, Mus musculus
aatcctccggtagcgatctgccaag

SEQ ID NO: 349904 - DNA, 25 bp, Mus musculus
actgagcgccgtggtgtaaatcctc

SEQ ID NO: 349905 - DNA, 25 bp, Mus musculus
cacggatgcacacgcggcaaggaag

SEQ ID NO: 349906 - DNA, 25 bp, Mus musculus
cgggtgccaattacgcggacacaca

SEQ ID NO: 349907 - DNA, 25 bp, Mus musculus
ggctccgccaacgacgacggctgga

SEQ ID NO: 349908 - DNA, 25 bp, Mus musculus
gctaaaacccggagccgctagagca

SEQ ID NO: 349909 - DNA, 25 bp, Mus musculus
gcgggaagttcaggccaggtccaat

SEQ ID NO: 349910 - DNA, 25 bp, Mus musculus
ttcaggccaggtccaatcaggcacc

SEQ ID NO: 349911 - DNA, 25 bp, Mus musculus
gacacatccatcaccagaagctccg

SEQ ID NO: 349912 - DNA, 25 bp, Mus musculus
acccggagccgctagagcagagcac

SEQ ID NO: 349913 - DNA, 25 bp, Mus musculus
gctgcttcttcctcggccggaggct

SEQ ID NO: 349914 - DNA, 25 bp, Mus musculus
agcaggtgaaatgcgcctcgccggt

SEQ ID NO: 349915 - DNA, 25 bp, Mus musculus
cgttcccgggcacctactgcttgcc

SEQ ID NO: 349916 - DNA, 25 bp, Mus musculus
ttcgtctactccaagccggcggcgg

SEQ ID NO: 349917 - DNA, 25 bp, Mus musculus
gccgttgccgcctccaacgctgctg

SEQ ID NO: 349918 - DNA, 25 bp, Mus musculus
cctggagcgaggaggacgactacac

SEQ ID NO: 349919 - DNA, 25 bp, Mus musculus
gaggaggacgactacacctggtata

SEQ ID NO: 349920 - DNA, 25 bp, Mus musculus
tacacctggtatagccgagctccgc

SEQ ID NO: 349921 - DNA, 25 bp, Mus musculus
gtccaatcaggcacctgaggttagg

SEQ ID NO: 349922 - DNA, 25 bp, Mus musculus
cctgacctcacggaacacgatgtaa

SEQ ID NO: 349923 - DNA, 25 bp, Mus musculus
gatccctcgcgggtctggatgccgt

SEQ ID NO: 349924 - DNA, 25 bp, Mus musculus
caaacttgtccacgggtacgctggc

SEQ ID NO: 349925 - DNA, 25 bp, Mus musculus
cacgatgtaagttctgtcgccttcc

SEQ ID NO: 349926 - DNA, 25 bp, Mus musculus
aagttctgtcgccttcctgtgtcgg

SEQ ID NO: 349927 - DNA, 25 bp, Mus musculus
cttcctgtgtcggacagcctctggc

SEQ ID NO: 349928 - DNA, 25 bp, Mus musculus
ggacacaaactcgccctaccggtga

SEQ ID NO: 349929 - DNA, 25 bp, Mus musculus
cagttctgcccaagggacattccga

SEQ ID NO: 349930 - DNA, 25 bp, Mus musculus
ctccaggagctggatccctcgcggg

SEQ ID NO: 349931 - DNA, 25 bp, Mus musculus
tctggatgccgtggagaaaactgtg

SEQ ID NO: 349932 - DNA, 25 bp, Mus musculus
ccgtggagaaaactgtgaggcagtc

SEQ ID NO: 349933 - DNA, 25 bp, Mus musculus
ctgtgaggcagtcagtccaagtccg

SEQ ID NO: 349934 - DNA, 25 bp, Mus musculus
cagtcagtccaagtccgggagtgcg

SEQ ID NO: 349935 - DNA, 25 bp, Mus musculus
acattccgaagatgcagaagggcgc

SEQ ID NO: 349936 - DNA, 25 bp, Mus musculus
agcgcgcttcggagacgcgccgtca

SEQ ID NO: 349937 - DNA, 25 bp, Mus musculus
gcagctcctcgccacgctgggaatg

SEQ ID NO: 349938 - DNA, 25 bp, Mus musculus
agaccagggacctcggacaaggctc

SEQ ID NO: 349939 - DNA, 25 bp, Mus musculus
tcctcgccacgctgggaatgcgcga

SEQ ID NO: 349940 - DNA, 25 bp, Mus musculus
tcagaatcccgccaacacggaagtc

SEQ ID NO: 349941 - DNA, 25 bp, Mus musculus
tgggaacctgcctcgggcgctgcac

SEQ ID NO: 349942 - DNA, 25 bp, Mus musculus
ctccgaacaaccacactggggcggt

SEQ ID NO: 349943 - DNA, 25 bp, Mus musculus
gacctcggacaaggctcctgggaac

SEQ ID NO: 349944 - DNA, 25 bp, Mus musculus
cccaagcaaatgtggcacgtgatgg

SEQ ID NO: 349945 - DNA, 25 bp, Mus musculus
cagagtgagggacaatgtaacgttc

SEQ ID NO: 349946 - DNA, 25 bp, Mus musculus
tgtaacgttctgcacggtctgagcc

SEQ ID NO: 349947 - DNA, 25 bp, Mus musculus
agccatggcagcgttcagaatcccg

SEQ ID NO: 349948 - DNA, 25 bp, Mus musculus
acggtctgagccatggcagcgttca

SEQ ID NO: 349949 - DNA, 25 bp, Mus musculus
cacactggggcggttccggagacca

SEQ ID NO: 349950 - DNA, 25 bp, Mus musculus
tgcgtcggactgctgtctggaaaac

SEQ ID NO: 349951 - DNA, 25 bp, Mus musculus
ttcccgttaggagagttgagcgagc

SEQ ID NO: 349952 - DNA, 25 bp, Mus musculus
cagtctcttgtagtccgctgctttc

SEQ ID NO: 349953 - DNA, 25 bp, Mus musculus
ttcccggctattttcgtgagcgaaa

SEQ ID NO: 349954 - DNA, 25 bp, Mus musculus
gttccagctgtgttactaaagttca

SEQ ID NO: 349955 - DNA, 25 bp, Mus musculus
tcaccgtgagactagcgaacaacca

SEQ ID NO: 349956 - DNA, 25 bp, Mus musculus
tctccgtcccttcgaaaaaatgtgc

SEQ ID NO: 349957 - DNA, 25 bp, Mus musculus
cgacaggccaggaagtgacgccatc

SEQ ID NO: 349958 - DNA, 25 bp, Mus musculus
ccaccttgggatggtacgaagatcc

SEQ ID NO: 349959 - DNA, 25 bp, Mus musculus
gtaacaggttacacagcccaaggtc

SEQ ID NO: 349960 - DNA, 25 bp, Mus musculus
ccatactgtgtaagcgagggttctg

SEQ ID NO: 349961 - DNA, 25 bp, Mus musculus
tgcgtgagcgcagaccttatataag

SEQ ID NO: 349962 - DNA, 25 bp, Mus musculus
gcgctagctaatgtcgccggccata

SEQ ID NO: 349963 - DNA, 25 bp, Mus musculus
aatgtgcagcttccatcaccgtgag

SEQ ID NO: 349964 - DNA, 25 bp, Mus musculus
cacacgctggcgactcttattcatc

SEQ ID NO: 349965 - DNA, 25 bp, Mus musculus
agttgtggcttgctgcggaacttct

SEQ ID NO: 349966 - DNA, 25 bp, Mus musculus
tccgcccaggtaacgtgccagttgt

SEQ ID NO: 349967 - DNA, 25 bp, Mus musculus
gaggtccatggatccgcccaggtaa

SEQ ID NO: 349968 - DNA, 25 bp, Mus musculus
tcgaaggtgctgaggtccatggatc

SEQ ID NO: 349969 - DNA, 25 bp, Mus musculus
ttcatcaacatctttccggtgcgga

SEQ ID NO: 349970 - DNA, 25 bp, Mus musculus
aacttcttcccgctggggctgcgga

SEQ ID NO: 349971 - DNA, 25 bp, Mus musculus
tggaagaatcatagcgcacacgctg

SEQ ID NO: 349972 - DNA, 25 bp, Mus musculus
ccttgacctggttggaagaatcata

SEQ ID NO: 349973 - DNA, 25 bp, Mus musculus
atcaccctcaccttgacctggttgg

SEQ ID NO: 349974 - DNA, 25 bp, Mus musculus
cgatagacgctaacccagagggccc

SEQ ID NO: 349975 - DNA, 25 bp, Mus musculus
gtactgactcgatggcgatagacgc

SEQ ID NO: 349976 - DNA, 25 bp, Mus musculus
cttccgccagcagaggtactgactc

SEQ ID NO: 349977 - DNA, 25 bp, Mus musculus
gcgactcttattcatcttgttcatc

SEQ ID NO: 349978 - DNA, 25 bp, Mus musculus
acggtgttaatagttagcatgagac

SEQ ID NO: 349979 - DNA, 25 bp, Mus musculus
ataacggcttcacccaagagtgtgg

SEQ ID NO: 349980 - DNA, 25 bp, Mus musculus
tgcgcaaacaagaaaataacggctt

SEQ ID NO: 349981 - DNA, 25 bp, Mus musculus
ctcctgggagactgttgcgcaaaca

SEQ ID NO: 349982 - DNA, 25 bp, Mus musculus
tggaagtcaccgcatgtggtattac

SEQ ID NO: 349983 - DNA, 25 bp, Mus musculus
gtgacgctctgtacaccggggaaat

SEQ ID NO: 349984 - DNA, 25 bp, Mus musculus
ttagcatgagacgtggcagaaagcg

SEQ ID NO: 349985 - DNA, 25 bp, Mus musculus
ctgtacaccggggaaatcgtgagtg

SEQ ID NO: 349986 - DNA, 25 bp, Mus musculus
gcttcacccaagagtgtggcgacgc

SEQ ID NO: 349987 - DNA, 25 bp, Mus musculus
ccgagtatggagctgttgaaagtga

SEQ ID NO: 349988 - DNA, 25 bp, Mus musculus
gcatgtggtattacctcctgggaga

SEQ ID NO: 349989 - DNA, 25 bp, Mus musculus
ctgttgaaagtgaggacggtgttaa

SEQ ID NO: 349990 - DNA, 25 bp, Mus musculus
aaagcgagggtgaagtccacgtctg

SEQ ID NO: 349991 - DNA, 25 bp, Mus musculus
ccacgtctgtgggatggaagtcacc

SEQ ID NO: 349992 - DNA, 25 bp, Mus musculus
ggagctgacaccctagtccctagta

SEQ ID NO: 349993 - DNA, 25 bp, Mus musculus
cacaaggcgccgttaccgcagagtc

SEQ ID NO: 349994 - DNA, 25 bp, Mus musculus
tgggtcctccggagtcggagactcc

SEQ ID NO: 349995 - DNA, 25 bp, Mus musculus
ttgacaggtcaagggaatagggctc

SEQ ID NO: 349996 - DNA, 25 bp, Mus musculus
cggcgggattaactttgcatggcta

SEQ ID NO: 349997 - DNA, 25 bp, Mus musculus
tggctaatacgagcaccagagctga

SEQ ID NO: 349998 - DNA, 25 bp, Mus musculus
agcgacgcgctctgtccttgaagct

SEQ ID NO: 349999 - DNA, 25 bp, Mus musculus
gctgctgggagaatcgaacaggcta

SEQ ID NO: 350000 - DNA, 25 bp, Mus musculus
aagctggcctctgagaccggctcct

SEQ ID NO: 350001 - DNA, 25 bp, Mus musculus
tccagcgctctggtaacttggcagg

SEQ ID NO: 350002 - DNA, 25 bp, Mus musculus
cccggaagccatttcgtctctgata

SEQ ID NO: 350003 - DNA, 25 bp, Mus musculus
gacatttgcacataagcggcaggtg

SEQ ID NO: 350004 - DNA, 25 bp, Mus musculus
cgtctctgatactctggcggagcca

SEQ ID NO: 350005 - DNA, 25 bp, Mus musculus
agtccctagtaaggctaccgcgctg

SEQ ID NO: 350006 - DNA, 25 bp, Mus musculus
tggctgccggtaaatctcgcgagaa

SEQ ID NO: 350007 - DNA, 25 bp, Mus musculus
tcctctcagctttgggattaggtgc

SEQ ID NO: 350008 - DNA, 25 bp, Mus musculus
ccagtgaatcttcccgaaggggagc

SEQ ID NO: 350009 - DNA, 25 bp, Mus musculus
agcgccgtcttacttcaccaggatg

SEQ ID NO: 350010 - DNA, 25 bp, Mus musculus
tggtgaataagcacaagcgccgtct

SEQ ID NO: 350011 - DNA, 25 bp, Mus musculus
ccatcggccttcgtggtgaataagc

SEQ ID NO: 350012 - DNA, 25 bp, Mus musculus
tccagtagtggatcgaggattgacc

SEQ ID NO: 350013 - DNA, 25 bp, Mus musculus
catgctgggaagagacgcaagttcg

SEQ ID NO: 350014 - DNA, 25 bp, Mus musculus
gcttcggcctccaccactgagtaaa

SEQ ID NO: 350015 - DNA, 25 bp, Mus musculus
tactcacatgggctcgagggtcttg

SEQ ID NO: 350016 - DNA, 25 bp, Mus musculus
ttgctgagccaggacttgagcgcct

SEQ ID NO: 350017 - DNA, 25 bp, Mus musculus
agcgcctcgaagttttcgatgatca

SEQ ID NO: 350018 - DNA, 25 bp, Mus musculus
tcatcttagaaaccatccaccgcgg

SEQ ID NO: 350019 - DNA, 25 bp, Mus musculus
cgcggcagagcagacgtgaagaaaa

SEQ ID NO: 350020 - DNA, 25 bp, Mus musculus
atcggcgagcgacgcggagctctcc

SEQ ID NO: 350021 - DNA, 25 bp, Mus musculus
agccagagagcatgcgcgtccgcgc

SEQ ID NO: 350022 - DNA, 25 bp, Mus musculus
ctggtcgctaccaggtggtgagtgc

SEQ ID NO: 350023 - DNA, 25 bp, Mus musculus
agctccggcgccgatcggcgagcga

SEQ ID NO: 350024 - DNA, 25 bp, Mus musculus
cccggccgcagtcgacggccagcgc

SEQ ID NO: 350025 - DNA, 25 bp, Mus musculus
acgcggagctctccgctggagccga

SEQ ID NO: 350026 - DNA, 25 bp, Mus musculus
ggagcgacaggaagtgaagcggccc

SEQ ID NO: 350027 - DNA, 25 bp, Mus musculus
ccgccaggcgacctcggcggcagaa

SEQ ID NO: 350028 - DNA, 25 bp, Mus musculus
ctcggcggcagaacccgaggcggcg

SEQ ID NO: 350029 - DNA, 25 bp, Mus musculus
gccgaggggacacgcccgctcggaa

SEQ ID NO: 350030 - DNA, 25 bp, Mus musculus
gacacgcccgctcggaagccggacc

SEQ ID NO: 350031 - DNA, 25 bp, Mus musculus
aggcgggcaggatggatcaccacca

SEQ ID NO: 350032 - DNA, 25 bp, Mus musculus
ccagctggggactggtcgctaccag

SEQ ID NO: 350033 - DNA, 25 bp, Mus musculus
agagcatgcgcgtccgcgccgagca

SEQ ID NO: 350034 - DNA, 25 bp, Mus musculus
cctccgaaggggacgtgtcatgaaa

SEQ ID NO: 350035 - DNA, 25 bp, Mus musculus
ggacgtgtcatgaaaggcacgagca

SEQ ID NO: 350036 - DNA, 25 bp, Mus musculus
caccacaaggtgtttctgggaaggc

SEQ ID NO: 350037 - DNA, 25 bp, Mus musculus
gtcatgaaaggcacgagcacacttt

SEQ ID NO: 350038 - DNA, 25 bp, Mus musculus
atgaaaggcacgagcacactttccc

SEQ ID NO: 350039 - DNA, 25 bp, Mus musculus
caacccaagaggaactgccatccgg

SEQ ID NO: 350040 - DNA, 25 bp, Mus musculus
agggggagccactctaacacgccca

SEQ ID NO: 350041 - DNA, 25 bp, Mus musculus
caaggtgtttctgggaaggccctca

SEQ ID NO: 350042 - DNA, 25 bp, Mus musculus
gccctcaaaacggccgtcctcacta

SEQ ID NO: 350043 - DNA, 25 bp, Mus musculus
cctcactagtttccaaagccgacgg

SEQ ID NO: 350044 - DNA, 25 bp, Mus musculus
gcctccgaaggggacgtgtcatgaa

SEQ ID NO: 350045 - DNA, 25 bp, Mus musculus
cggcccgaggaagagccgggcttag

SEQ ID NO: 350046 - DNA, 25 bp, Mus musculus
tccaaagccgacggcccgaggaaga

SEQ ID NO: 350047 - DNA, 25 bp, Mus musculus
tcactagtttccaaagccgacggcc

SEQ ID NO: 350048 - DNA, 25 bp, Mus musculus
cccggattccgggatagatgacctc

SEQ ID NO: 350049 - DNA, 25 bp, Mus musculus
ctcccttaaagctctcggcgactga

SEQ ID NO: 350050 - DNA, 25 bp, Mus musculus
ctgaatcgtcgccaatgcagggata

SEQ ID NO: 350051 - DNA, 25 bp, Mus musculus
ggatactgcataggcgtaccctgta

SEQ ID NO: 350052 - DNA, 25 bp, Mus musculus
cctgttctaggcgaaggagatccgc

SEQ ID NO: 350053 - DNA, 25 bp, Mus musculus
agatccgcggggtagttccctaatg

SEQ ID NO: 350054 - DNA, 25 bp, Mus musculus
tgctcccgagaagcaagctggttta

SEQ ID NO: 350055 - DNA, 25 bp, Mus musculus
tcctcaccgtgatcgcggctttgca

SEQ ID NO: 350056 - DNA, 25 bp, Mus musculus
tggaacccagtcctccaccgttgga

SEQ ID NO: 350057 - DNA, 25 bp, Mus musculus
tccagaagcgcacgcggagtatttc

SEQ ID NO: 350058 - DNA, 25 bp, Mus musculus
aagcggcaacgttggcgagtctctt

SEQ ID NO: 350059 - DNA, 25 bp, Mus musculus
cgagcacggccttacaaagaaccta

SEQ ID NO: 350060 - DNA, 25 bp, Mus musculus
ctctcgctcgtgcatactgggcgtt

SEQ ID NO: 350061 - DNA, 25 bp, Mus musculus
cttccagcgatgtgcaaataaatcc

SEQ ID NO: 350062 - DNA, 25 bp, Mus musculus
actctgggctcaggacagcagggcc

SEQ ID NO: 350063 - DNA, 25 bp, Mus musculus
ctcacgcggcgtcggaatccgtgga

SEQ ID NO: 350064 - DNA, 25 bp, Mus musculus
cgcgggcctcgagctgctttcttct

SEQ ID NO: 350065 - DNA, 25 bp, Mus musculus
ctgcgcttcccgaaggagccgccag

SEQ ID NO: 350066 - DNA, 25 bp, Mus musculus
tccgtggagtctccagcaggcgagc

SEQ ID NO: 350067 - DNA, 25 bp, Mus musculus
cggaatccgtggagtctccagcagg

SEQ ID NO: 350068 - DNA, 25 bp, Mus musculus
gtcggaatccgtggagtctccagca

SEQ ID NO: 350069 - DNA, 25 bp, Mus musculus
aagacgctcgatcggccgactcagt

SEQ ID NO: 350070 - DNA, 25 bp, Mus musculus
gctcaggacagcagggcctctccgg

SEQ ID NO: 350071 - DNA, 25 bp, Mus musculus
atgcgttatttccgggcgctggcct

SEQ ID NO: 350072 - DNA, 25 bp, Mus musculus
cggcgtcggaatccgtggagtctcc

SEQ ID NO: 350073 - DNA, 25 bp, Mus musculus
gtggaagacgctcgatcggccgact

SEQ ID NO: 350074 - DNA, 25 bp, Mus musculus
actcagtcgcgtcccagccactctg

SEQ ID NO: 350075 - DNA, 25 bp, Mus musculus
gctcgatcggccgactcagtcgcgt

SEQ ID NO: 350076 - DNA, 25 bp, Mus musculus
ggcctactgcgtttgcgcccaacga

SEQ ID NO: 350077 - DNA, 25 bp, Mus musculus
caaggaggtcttagtcctcagcgcc

SEQ ID NO: 350078 - DNA, 25 bp, Mus musculus
cgtgccgtgagttggtcttcctcag

SEQ ID NO: 350079 - DNA, 25 bp, Mus musculus
tggcagcaggttgtagtcgtctaca

SEQ ID NO: 350080 - DNA, 25 bp, Mus musculus
acaaaacctgttggagtcgctcctg

SEQ ID NO: 350081 - DNA, 25 bp, Mus musculus
tgtcacccgttagccgggcagcgaa

SEQ ID NO: 350082 - DNA, 25 bp, Mus musculus
gcagtgcggcctaccgcatttggga

SEQ ID NO: 350083 - DNA, 25 bp, Mus musculus
ccatcggcttggcagcaaggcctac

SEQ ID NO: 350084 - DNA, 25 bp, Mus musculus
ccaacgacagggcagcaaggaggtc

SEQ ID NO: 350085 - DNA, 25 bp, Mus musculus
gaagaacctatgttagagcgccttg

SEQ ID NO: 350086 - DNA, 25 bp, Mus musculus
agcgccttgacgtcacttccaggtg

SEQ ID NO: 350087 - DNA, 25 bp, Mus musculus
aggtgccttttatagcggagctgcc

SEQ ID NO: 350088 - DNA, 25 bp, Mus musculus
agtcagctgcgtgcttctgtgccag

SEQ ID NO: 350089 - DNA, 25 bp, Mus musculus
ggccttgagtccttagcgcccatcg

SEQ ID NO: 350090 - DNA, 25 bp, Mus musculus
tttcggacgcagaggaattggcatc

SEQ ID NO: 350091 - DNA, 25 bp, Mus musculus
cacgagcatgcccaccacggtgaag

SEQ ID NO: 350092 - DNA, 25 bp, Mus musculus
gaggaattggcatcccttctcttgg

SEQ ID NO: 350093 - DNA, 25 bp, Mus musculus
ggaccgctttcggttcctcaggata

SEQ ID NO: 350094 - DNA, 25 bp, Mus musculus
gttcctcaggataaacacgagcatg

SEQ ID NO: 350095 - DNA, 25 bp, Mus musculus
agcagtcccgggaccaacacggaga

SEQ ID NO: 350096 - DNA, 25 bp, Mus musculus
gaccaacacggagatggacaccctg

SEQ ID NO: 350097 - DNA, 25 bp, Mus musculus
ccctgctggtgtctaggtaggagtt

SEQ ID NO: 350098 - DNA, 25 bp, Mus musculus
agttggagtgtgtcccggtctccgc

SEQ ID NO: 350099 - DNA, 25 bp, Mus musculus
ggtctccgccaacccagtgctgttt

SEQ ID NO: 350100 - DNA, 25 bp, Mus musculus
gtgctgtttttactgtgcgaagtta

SEQ ID NO: 350101 - DNA, 25 bp, Mus musculus
tgcgaagttaacgtgggcgagatcc

SEQ ID NO: 350102 - DNA, 25 bp, Mus musculus
ggcatcccttctcttggaccgcttt

SEQ ID NO: 350103 - DNA, 25 bp, Mus musculus
ggaggtgacgaacaccagcagcagt

SEQ ID NO: 350104 - DNA, 25 bp, Mus musculus
catctggggagggatagcaaaaatc

SEQ ID NO: 350105 - DNA, 25 bp, Mus musculus
agcgagcgctcgaccaggctgacca

SEQ ID NO: 350106 - DNA, 25 bp, Mus musculus
agtgcagatgggaacagtaagtacc

SEQ ID NO: 350107 - DNA, 25 bp, Mus musculus
atcgctgggtcggagaaagttgccc

SEQ ID NO: 350108 - DNA, 25 bp, Mus musculus
tgaagacgccgacccggagaggcta

SEQ ID NO: 350109 - DNA, 25 bp, Mus musculus
ccactccttctggttcgtcctgggg

SEQ ID NO: 350110 - DNA, 25 bp, Mus musculus
acagtgtgcgctgcaagaagaaggc

SEQ ID NO: 350111 - DNA, 25 bp, Mus musculus
cgattgcaggtttgccttggggaca

SEQ ID NO: 350112 - DNA, 25 bp, Mus musculus
caaatactaattaggggccgcgatt

SEQ ID NO: 350113 - DNA, 25 bp, Mus musculus
gcgggagcctttcaaatactaatta

SEQ ID NO: 350114 - DNA, 25 bp, Mus musculus
ccctcactaccatgtacagtgtgcg

SEQ ID NO: 350115 - DNA, 25 bp, Mus musculus
ccgccaagaggatgcgggagccttt

SEQ ID NO: 350116 - DNA, 25 bp, Mus musculus
agctgcctttccagcgagtcgccgg

SEQ ID NO: 350117 - DNA, 25 bp, Mus musculus
gggcgatgaacgcacaccctcgagc

SEQ ID NO: 350118 - DNA, 25 bp, Mus musculus
ctagactccggaagcacagtgtgtg

SEQ ID NO: 350119 - DNA, 25 bp, Mus musculus
aaaagacatccctgtggccggccga

SEQ ID NO: 350120 - DNA, 25 bp, Mus musculus
tgtaccaagctggagcagtttcgcc

SEQ ID NO: 350121 - DNA, 25 bp, Mus musculus
gtgtgctgcacctggtctgtaccaa

SEQ ID NO: 350122 - DNA, 25 bp, Mus musculus
acaaccattgcgtttgcgctctaga

SEQ ID NO: 350123 - DNA, 25 bp, Mus musculus
tgctctgagacaaggacagccaatc

SEQ ID NO: 350124 - DNA, 25 bp, Mus musculus
agaacctcgttctgtgcttaacttc

SEQ ID NO: 350125 - DNA, 25 bp, Mus musculus
ccacagggcatggagaccaatcagc

SEQ ID NO: 350126 - DNA, 25 bp, Mus musculus
cctcggcttaaaatgcacagttggc

SEQ ID NO: 350127 - DNA, 25 bp, Mus musculus
ccggcgcgctcattcacctatagta

SEQ ID NO: 350128 - DNA, 25 bp, Mus musculus
gcgcactgaccacagctggcacgta

SEQ ID NO: 350129 - DNA, 25 bp, Mus musculus
cactgggttcaacgcatgcgcgctg

SEQ ID NO: 350130 - DNA, 25 bp, Mus musculus
ccaaggctgtgaagccaatcagatc

SEQ ID NO: 350131 - DNA, 25 bp, Mus musculus
cagatcacttcagctcctcggctta

SEQ ID NO: 350132 - DNA, 25 bp, Mus musculus
cgccgcccttcattcacccacatgg

SEQ ID NO: 350133 - DNA, 25 bp, Mus musculus
tggccgccaagaacgagccgccgtg

SEQ ID NO: 350134 - DNA, 25 bp, Mus musculus
aagtactttgttttttatgctaatg

SEQ ID NO: 350135 - DNA, 25 bp, Mus musculus
tatttacgttgaggcgggagccgcc

SEQ ID NO: 350136 - DNA, 25 bp, Mus musculus
acccacatggtccttcgaggtgccg

SEQ ID NO: 350137 - DNA, 25 bp, Mus musculus
caaaagggtgcacggcgcaaggtcc

SEQ ID NO: 350138 - DNA, 25 bp, Mus musculus
gctcgcaaaagggtgcacggcgcaa

SEQ ID NO: 350139 - DNA, 25 bp, Mus musculus
atgtgactcgtctcccactcgcgtg

SEQ ID NO: 350140 - DNA, 25 bp, Mus musculus
ccaaaggatccgtgatctacggaga

SEQ ID NO: 350141 - DNA, 25 bp, Mus musculus
cacgcggccaggtttaaggagactt

SEQ ID NO: 350142 - DNA, 25 bp, Mus musculus
tactggtcgcgaagctccgagccca

SEQ ID NO: 350143 - DNA, 25 bp, Mus musculus
gcgagtggatgtgactcgtctccca

SEQ ID NO: 350144 - DNA, 25 bp, Mus musculus
tggggcttgtccgtatttacgttga

SEQ ID NO: 350145 - DNA, 25 bp, Mus musculus
cggctcaggtactggtcgcgaagct

SEQ ID NO: 350146 - DNA, 25 bp, Mus musculus
ccgcaggctggcacagcctaggtta

SEQ ID NO: 350147 - DNA, 25 bp, Mus musculus
agccttaggcggctgcagcgatacc

SEQ ID NO: 350148 - DNA, 25 bp, Mus musculus
ataccggccagtgccggatgcttgc

SEQ ID NO: 350149 - DNA, 25 bp, Mus musculus
gacccgggcgatgctaagcatgaga

SEQ ID NO: 350150 - DNA, 25 bp, Mus musculus
ctaagcatgagaagtgcagcgtctc

SEQ ID NO: 350151 - DNA, 25 bp, Mus musculus
cagcctcagggcttcaggggagaaa

SEQ ID NO: 350152 - DNA, 25 bp, Mus musculus
aagcggagctcttgcaggtgaagcc

SEQ ID NO: 350153 - DNA, 25 bp, Mus musculus
ctgcgcatcgaacccttgccagatt

SEQ ID NO: 350154 - DNA, 25 bp, Mus musculus
acccgaacaccgaggatggatgccc

SEQ ID NO: 350155 - DNA, 25 bp, Mus musculus
ggctctccttggatctacccgaagc

SEQ ID NO: 350156 - DNA, 25 bp, Mus musculus
gacctcttgggcttgcgaccacggt

SEQ ID NO: 350157 - DNA, 25 bp, Mus musculus
ggtctctggggcatccatccattca

SEQ ID NO: 350158 - DNA, 25 bp, Mus musculus
atccattcagagatggtccttggtg

SEQ ID NO: 350159 - DNA, 25 bp, Mus musculus
gtccttggtgagacgacgacctttc

SEQ ID NO: 350160 - DNA, 25 bp, Mus musculus
gcgttcagctccatggcgctggaca

SEQ ID NO: 350161 - DNA, 25 bp, Mus musculus
ctcctacatttacctgcgttcagct

SEQ ID NO: 350162 - DNA, 25 bp, Mus musculus
tggacgcacagacacgcatccctga

SEQ ID NO: 350163 - DNA, 25 bp, Mus musculus
cccacgcgagatggacgcacagaca

SEQ ID NO: 350164 - DNA, 25 bp, Mus musculus
aaacacaccgtgcacgtggccagtg

SEQ ID NO: 350165 - DNA, 25 bp, Mus musculus
atgtaatgctgcgtcactcgcccgc

SEQ ID NO: 350166 - DNA, 25 bp, Mus musculus
ccacccagctcgcattatgtaatgc

SEQ ID NO: 350167 - DNA, 25 bp, Mus musculus
gggcctcgcgcagactatgggctcc

SEQ ID NO: 350168 - DNA, 25 bp, Mus musculus
tccctgtctagcaaggtcagccctg

SEQ ID NO: 350169 - DNA, 25 bp, Mus musculus
tgagcgagaacgacctacgcactcc

SEQ ID NO: 350170 - DNA, 25 bp, Mus musculus
tcccgcaagactctgagcgagaacg

SEQ ID NO: 350171 - DNA, 25 bp, Mus musculus
aaggtgctgcgcgactcccgcaaga

SEQ ID NO: 350172 - DNA, 25 bp, Mus musculus
tgtacacgctgtccatccggaaggt

SEQ ID NO: 350173 - DNA, 25 bp, Mus musculus
cgaattgctctgtacacgctgtcca

SEQ ID NO: 350174 - DNA, 25 bp, Mus musculus
ttgcaccatgccttcttggatccgg

SEQ ID NO: 350175 - DNA, 25 bp, Mus musculus
tctgctctccaggtcctttccaggg

SEQ ID NO: 350176 - DNA, 25 bp, Mus musculus
tcgctggggcaaacttgggagaact

SEQ ID NO: 350177 - DNA, 25 bp, Mus musculus
ctcattgtgtgcacacgcgggagca

SEQ ID NO: 350178 - DNA, 25 bp, Mus musculus
cactttctgcgggtacctcccaggg

SEQ ID NO: 350179 - DNA, 25 bp, Mus musculus
tgttgctcagttggtgctcactttc

SEQ ID NO: 350180 - DNA, 25 bp, Mus musculus
ccctaccaggagatcgcaggtaagc

SEQ ID NO: 350181 - DNA, 25 bp, Mus musculus
tttgctcagcgccaccgtctgagtg

SEQ ID NO: 350182 - DNA, 25 bp, Mus musculus
tgtgattcttcctctctccgggctg

SEQ ID NO: 350183 - DNA, 25 bp, Mus musculus
ccgaggtggacttgcatgttgcacc

SEQ ID NO: 350184 - DNA, 25 bp, Mus musculus
cctccatctggcttataaaagtttg

SEQ ID NO: 350185 - DNA, 25 bp, Mus musculus
tggttggcttgccatcctccatctg

SEQ ID NO: 350186 - DNA, 25 bp, Mus musculus
caacgattttctaccggagtggcta

SEQ ID NO: 350187 - DNA, 25 bp, Mus musculus
ttacggtgccaagggattcagcctg

SEQ ID NO: 350188 - DNA, 25 bp, Mus musculus
agcagcttcacgacgctttacgaca

SEQ ID NO: 350189 - DNA, 25 bp, Mus musculus
cgttcaaaggaagtcgcagaggctt

SEQ ID NO: 350190 - DNA, 25 bp, Mus musculus
gcttcacgacgctttacgacatgcc

SEQ ID NO: 350191 - DNA, 25 bp, Mus musculus
agggaagcagcttcacgacgcttta

SEQ ID NO: 350192 - DNA, 25 bp, Mus musculus
gtctgaagaaccgagggaagcagct

SEQ ID NO: 350193 - DNA, 25 bp, Mus musculus
ctctgcagagccagcgccgtaaagc

SEQ ID NO: 350194 - DNA, 25 bp, Mus musculus
gcggacatcttcagctctgcagagc

SEQ ID NO: 350195 - DNA, 25 bp, Mus musculus
cagcggacatcttcagctctgcaga

SEQ ID NO: 350196 - DNA, 25 bp, Mus musculus
cggctcgcagcggacatcttcagct

SEQ ID NO: 350197 - DNA, 25 bp, Mus musculus
cagaacgctcctcccggctcgcagc

SEQ ID NO: 350198 - DNA, 25 bp, Mus musculus
aagctgccgggaggaccagaacgct

SEQ ID NO: 350199 - DNA, 25 bp, Mus musculus
gacccgcttcgcgaagctgccggga

SEQ ID NO: 350200 - DNA, 25 bp, Mus musculus
tcgcagaggcttccgggttctccca

SEQ ID NO: 350201 - DNA, 25 bp, Mus musculus
cccgacacgttcaaaggaagtcgca

SEQ ID NO: 350202 - DNA, 25 bp, Mus musculus
gaacatgtgtcccaactttgaggcc

SEQ ID NO: 350203 - DNA, 25 bp, Mus musculus
cgggctgcagcctaattgcacctga

SEQ ID NO: 350204 - DNA, 25 bp, Mus musculus
cggccatttcgagttccacggtagg

SEQ ID NO: 350205 - DNA, 25 bp, Mus musculus
ccagggccagagcatcggccatttc

SEQ ID NO: 350206 - DNA, 25 bp, Mus musculus
cacggccgatgattggttactgtcc

SEQ ID NO: 350207 - DNA, 25 bp, Mus musculus
ctggagggctccatttaaaacaggc

SEQ ID NO: 350208 - DNA, 25 bp, Mus musculus
tccgtaaacagcatccctggagggc

SEQ ID NO: 350209 - DNA, 25 bp, Mus musculus
gctaccacggtgattgtttccagta

SEQ ID NO: 350210 - DNA, 25 bp, Mus musculus
tccaggaaagcctcggacgtcaatg

SEQ ID NO: 350211 - DNA, 25 bp, Mus musculus
tgaggccgttttcctgccagctata

SEQ ID NO: 350212 - DNA, 25 bp, Mus musculus
cgtgtgatgtatcctcgcaacatta

SEQ ID NO: 350213 - DNA, 25 bp, Mus musculus
cggccacgtatttctcagttctttc

SEQ ID NO: 350214 - DNA, 25 bp, Mus musculus
gccagctatacatttcggccacgta

SEQ ID NO: 350215 - DNA, 25 bp, Mus musculus
acgtcaatgacaggcgcgcgcacga

SEQ ID NO: 350216 - DNA, 25 bp, Mus musculus
acagccagcacgcaggtgtgcctga

SEQ ID NO: 350217 - DNA, 25 bp, Mus musculus
aatcgccttaatccgggcgctggca

SEQ ID NO: 350218 - DNA, 25 bp, Mus musculus
agtcgcagagcagaccgctccagtg

SEQ ID NO: 350219 - DNA, 25 bp, Mus musculus
agaccgctccagtgggactcgacac

SEQ ID NO: 350220 - DNA, 25 bp, Mus musculus
ttcatcgtcatcacacaggtgagcg

SEQ ID NO: 350221 - DNA, 25 bp, Mus musculus
tgggactcgacacccgcgtccacgg

SEQ ID NO: 350222 - DNA, 25 bp, Mus musculus
gcagtcttcatcgtcatcacacagg

SEQ ID NO: 350223 - DNA, 25 bp, Mus musculus
cgtccacgggcatcgcagtcttcat

SEQ ID NO: 350224 - DNA, 25 bp, Mus musculus
ttaaactgcaggtgaaataatcgcc

SEQ ID NO: 350225 - DNA, 25 bp, Mus musculus
tgcaggtgaaataatcgccttaatc

SEQ ID NO: 350226 - DNA, 25 bp, Mus musculus
ccgtggaagtgtggagttaaactgc

SEQ ID NO: 350227 - DNA, 25 bp, Mus musculus
ccgatgacagccagcacgcaggtgt

SEQ ID NO: 350228 - DNA, 25 bp, Mus musculus
atcacacaggtgagcgagccgatga

SEQ ID NO: 350229 - DNA, 25 bp, Mus musculus
tgagcgagccgatgacagccagcac

SEQ ID NO: 350230 - DNA, 25 bp, Mus musculus
agcgaagttgcagggactctgttcc

SEQ ID NO: 350231 - DNA, 25 bp, Mus musculus
cgaagatccgggagccagcgtgcac

SEQ ID NO: 350232 - DNA, 25 bp, Mus musculus
cggcaatccggaataagcgaagttg

SEQ ID NO: 350233 - DNA, 25 bp, Mus musculus
ttccctccgagctggcgatgcttag

SEQ ID NO: 350234 - DNA, 25 bp, Mus musculus
cagcaccgcggcaatccggaataag

SEQ ID NO: 350235 - DNA, 25 bp, Mus musculus
agggactctgttccctccgagctgg

SEQ ID NO: 350236 - DNA, 25 bp, Mus musculus
ggggcgcacagagactcgctcaagc

SEQ ID NO: 350237 - DNA, 25 bp, Mus musculus
cgatgcttagcgagaggatacaccc

SEQ ID NO: 350238 - DNA, 25 bp, Mus musculus
cgagaggatacacccgctcatgttt

SEQ ID NO: 350239 - DNA, 25 bp, Mus musculus
cgctcatgtttattcacgctcctta

SEQ ID NO: 350240 - DNA, 25 bp, Mus musculus
gccgggttctcatacatattcatca

SEQ ID NO: 350241 - DNA, 25 bp, Mus musculus
acagccgggttctcatacatattca

SEQ ID NO: 350242 - DNA, 25 bp, Mus musculus
agactcgctcaagctcaggcggccg

SEQ ID NO: 350243 - DNA, 25 bp, Mus musculus
tcacgctccttaaacagccgggttc

SEQ ID NO: 350244 - DNA, 25 bp, Mus musculus
ttctccgactcggtgagcagcttcc

SEQ ID NO: 350245 - DNA, 25 bp, Mus musculus
ggcggcggacagaaacacaaacact

SEQ ID NO: 350246 - DNA, 25 bp, Mus musculus
ggcgaacttgtcctttttgagcagc

SEQ ID NO: 350247 - DNA, 25 bp, Mus musculus
tccttcatgtgcatggctcgcaggc

SEQ ID NO: 350248 - DNA, 25 bp, Mus musculus
tccaccaagttgagccgagaagccc

SEQ ID NO: 350249 - DNA, 25 bp, Mus musculus
ccaatcctgtagttctgctgagggc

SEQ ID NO: 350250 - DNA, 25 bp, Mus musculus
cccggtgactttctcatttgacaga

SEQ ID NO: 350251 - DNA, 25 bp, Mus musculus
ttcagcgccttaaaagccaagcagc

SEQ ID NO: 350252 - DNA, 25 bp, Mus musculus
tgtcccgttgctttggctcgccaac

SEQ ID NO: 350253 - DNA, 25 bp, Mus musculus
tgcttttttgtcctctgtcccgttg

SEQ ID NO: 350254 - DNA, 25 bp, Mus musculus
ggtctgtctggtcgagctctaagaa

SEQ ID NO: 350255 - DNA, 25 bp, Mus musculus
ctccgcccggaggaaatcaatgttg

SEQ ID NO: 350256 - DNA, 25 bp, Mus musculus
tccacaggcttggacatgctgtcgc

SEQ ID NO: 350257 - DNA, 25 bp, Mus musculus
tgtcactctgccctctgcttttttg

SEQ ID NO: 350258 - DNA, 25 bp, Mus musculus
ctagctttcttctctattttcccgc

SEQ ID NO: 350259 - DNA, 25 bp, Mus musculus
gagcccgtgaatcctcccgacaggg

SEQ ID NO: 350260 - DNA, 25 bp, Mus musculus
tgggacgcttgctcggcttgtctct

SEQ ID NO: 350261 - DNA, 25 bp, Mus musculus
ggcggccagacgcaatcatccgcag

SEQ ID NO: 350262 - DNA, 25 bp, Mus musculus
tgcacactgttagcaaccggcttcc

SEQ ID NO: 350263 - DNA, 25 bp, Mus musculus
ttagcaaccggcttcccgaggtcga

SEQ ID NO: 350264 - DNA, 25 bp, Mus musculus
tcccgaggtcgagcccgtgaatcct

SEQ ID NO: 350265 - DNA, 25 bp, Mus musculus
ctcccgacagggcaagactccggcc

SEQ ID NO: 350266 - DNA, 25 bp, Mus musculus
gaggcactggagttcagcaccgtcc

SEQ ID NO: 350267 - DNA, 25 bp, Mus musculus
actggagttcagcaccgtccacagc

SEQ ID NO: 350268 - DNA, 25 bp, Mus musculus
gtccacagccctgccagtactggcg

SEQ ID NO: 350269 - DNA, 25 bp, Mus musculus
gggtcgccgctgcttgtccctctag

SEQ ID NO: 350270 - DNA, 25 bp, Mus musculus
tcttctctattttcccgctgccatg

SEQ ID NO: 350271 - DNA, 25 bp, Mus musculus
agtactggcgtccttcccgcttggc

SEQ ID NO: 350272 - DNA, 25 bp, Mus musculus
gcagggtctcaatactcagggtcac

SEQ ID NO: 350273 - DNA, 25 bp, Mus musculus
ggaggagagaaagacgttactgatc

SEQ ID NO: 350274 - DNA, 25 bp, Mus musculus
cattgacatctacttccggggagga

SEQ ID NO: 350275 - DNA, 25 bp, Mus musculus
cgctgccctggagcactacgcatgt

SEQ ID NO: 350276 - DNA, 25 bp, Mus musculus
tcgctgcagggtctcaatactcagg

SEQ ID NO: 350277 - DNA, 25 bp, Mus musculus
gaaacctgctcagcatcgctgcagg

SEQ ID NO: 350278 - DNA, 25 bp, Mus musculus
tgcgtgaaggcgatcgctccacctt

SEQ ID NO: 350279 - DNA, 25 bp, Mus musculus
gtggcgccgaagacattgacatcta

SEQ ID NO: 350280 - DNA, 25 bp, Mus musculus
ggagcactacgcatgtgcagacgta

SEQ ID NO: 350281 - DNA, 25 bp, Mus musculus
gaaggcgatcgctccaccttttccg

SEQ ID NO: 350282 - DNA, 25 bp, Mus musculus
cgggcctagaaacctgctcagcatc

SEQ ID NO: 350283 - DNA, 25 bp, Mus musculus
tatagcgcatgcgtgaaggcgatcg

SEQ ID NO: 350284 - DNA, 25 bp, Mus musculus
tgtgcagacgtatagcgcatgcgtg

SEQ ID NO: 350285 - DNA, 25 bp, Mus musculus
tagcgcgggcctagaaacctgctca

SEQ ID NO: 350286 - DNA, 25 bp, Mus musculus
agaccctgtgatcgcgcgccaagcg

SEQ ID NO: 350287 - DNA, 25 bp, Mus musculus
gcctgtgatcgcgcgccagggagca

SEQ ID NO: 350288 - DNA, 25 bp, Mus musculus
cctcccggccctcagggtgcggagc

SEQ ID NO: 350289 - DNA, 25 bp, Mus musculus
cgcctgtgatctgcagccagggagc

SEQ ID NO: 350290 - DNA, 25 bp, Mus musculus
cctgtgatctgcagccagggagcgc

SEQ ID NO: 350291 - DNA, 25 bp, Mus musculus
cggagaccctgtgatcgcgcgccaa

SEQ ID NO: 350292 - DNA, 25 bp, Mus musculus
ctgcccggagctcccgctgaaagtg

SEQ ID NO: 350293 - DNA, 25 bp, Mus musculus
ccggagctcccgctgaaagtgtccc

SEQ ID NO: 350294 - DNA, 25 bp, Mus musculus
gggaacgcgccagccattgctctcc

SEQ ID NO: 350295 - DNA, 25 bp, Mus musculus
tcccgctgaaagtgtccccggatga

SEQ ID NO: 350296 - DNA, 25 bp, Mus musculus
cgctgaaagtgtccccggatgaaag

SEQ ID NO: 350297 - DNA, 25 bp, Mus musculus
agcaggcgggttcccgtgctggccg

SEQ ID NO: 350298 - DNA, 25 bp, Mus musculus
cagccattgctctcctcaagggctg

SEQ ID NO: 350299 - DNA, 25 bp, Mus musculus
gcgcgccaagcgcatccccgaccta

SEQ ID NO: 350300 - DNA, 25 bp, Mus musculus
caatggtatgaggatccaagggatc

SEQ ID NO: 350301 - DNA, 25 bp, Mus musculus
ctgcgttaccaagcccattaccgta

SEQ ID NO: 350302 - DNA, 25 bp, Mus musculus
agcccattaccgtatccatccaaga

SEQ ID NO: 350303 - DNA, 25 bp, Mus musculus
cccgggtactcacttgtggattcca

SEQ ID NO: 350304 - DNA, 25 bp, Mus musculus
ttgtggattccaggcgcttgacatc

SEQ ID NO: 350305 - DNA, 25 bp, Mus musculus
ggcgcttgacatcccgtgacgtctc

SEQ ID NO: 350306 - DNA, 25 bp, Mus musculus
cgtgacgtctctaagaagtatctcc

SEQ ID NO: 350307 - DNA, 25 bp, Mus musculus
acggatgctctctgcgttaccaagc

SEQ ID NO: 350308 - DNA, 25 bp, Mus musculus
cgactgagagcggaaccaatggtat

SEQ ID NO: 350309 - DNA, 25 bp, Mus musculus
atccaagggatcacggccgcggcca

SEQ ID NO: 350310 - DNA, 25 bp, Mus musculus
gcggccacagcgatcacacttacga

SEQ ID NO: 350311 - DNA, 25 bp, Mus musculus
cctcgattacggatgctctctgcgt

SEQ ID NO: 350312 - DNA, 25 bp, Mus musculus
gcgatcacacttacgacgaggagca

SEQ ID NO: 350313 - DNA, 25 bp, Mus musculus
taagaagtatctccgaagaaccagg

SEQ ID NO: 350314 - DNA, 25 bp, Mus musculus
gacgaggaaagactcagcgtttctc

SEQ ID NO: 350315 - DNA, 25 bp, Mus musculus
cggaagagcaggcacgcccacttaa

SEQ ID NO: 350316 - DNA, 25 bp, Mus musculus
tcctgcccggcagctttacgtcaga

SEQ ID NO: 350317 - DNA, 25 bp, Mus musculus
tcctgcgtgaagagagacgaggaaa

SEQ ID NO: 350318 - DNA, 25 bp, Mus musculus
gtcctccagaagctgcaggtcctgc

SEQ ID NO: 350319 - DNA, 25 bp, Mus musculus
aggttcacccgagctttctggcctc

SEQ ID NO: 350320 - DNA, 25 bp, Mus musculus
agcaagttaccgtgccaggttcacc

SEQ ID NO: 350321 - DNA, 25 bp, Mus musculus
caatggctgcggaaagcaagttacc

SEQ ID NO: 350322 - DNA, 25 bp, Mus musculus
tcctcatcaaggcacatgcacaatg

SEQ ID NO: 350323 - DNA, 25 bp, Mus musculus
ggcctcgttcctgaatcctcatcaa

SEQ ID NO: 350324 - DNA, 25 bp, Mus musculus
ctgagcagacaacgcaggcctcgtt

SEQ ID NO: 350325 - DNA, 25 bp, Mus musculus
acggtactgaggtgctgagcagaca

SEQ ID NO: 350326 - DNA, 25 bp, Mus musculus
atccgcggcacacggtactgaggtg

SEQ ID NO: 350327 - DNA, 25 bp, Mus musculus
cagctttacgtcagaggcaggcggt

SEQ ID NO: 350328 - DNA, 25 bp, Mus musculus
gctccgcccacttcctctatacagg

SEQ ID NO: 350329 - DNA, 25 bp, Mus musculus
tcccgttgctcctgttcaagcctcg

SEQ ID NO: 350330 - DNA, 25 bp, Mus musculus
tttggatacgtctctccctggactt

SEQ ID NO: 350331 - DNA, 25 bp, Mus musculus
cctctgtttggatacgtctctccct

SEQ ID NO: 350332 - DNA, 25 bp, Mus musculus
actctggctctggactttcccttct

SEQ ID NO: 350333 - DNA, 25 bp, Mus musculus
cttacactctggctctggactttcc

SEQ ID NO: 350334 - DNA, 25 bp, Mus musculus
tccattccttacactctggctctgg

SEQ ID NO: 350335 - DNA, 25 bp, Mus musculus
cagcagtttcctgtggcaggggctc

SEQ ID NO: 350336 - DNA, 25 bp, Mus musculus
aacgagcggtcctgacctcttcttc

SEQ ID NO: 350337 - DNA, 25 bp, Mus musculus
agggctcctcgaccatgtgatccgc

SEQ ID NO: 350338 - DNA, 25 bp, Mus musculus
ctggagggctcctcgaccatgtgat

SEQ ID NO: 350339 - DNA, 25 bp, Mus musculus
cacggcagctgacctggagggctcc

SEQ ID NO: 350340 - DNA, 25 bp, Mus musculus
agcggtcctgacctcttcttccaat

SEQ ID NO: 350341 - DNA, 25 bp, Mus musculus
tcgactctcccgctcgtacccttgg

SEQ ID NO: 350342 - DNA, 25 bp, Mus musculus
cgacagagaccaaccgcgcgcaggt

SEQ ID NO: 350343 - DNA, 25 bp, Mus musculus
ggcactcaccagaagaacacgcgcg

SEQ ID NO: 350344 - DNA, 25 bp, Mus musculus
aagccgcacgtgcttgagacccgtt

SEQ ID NO: 350345 - DNA, 25 bp, Mus musculus
cgaagtttaagatcagcacccaagc

SEQ ID NO: 350346 - DNA, 25 bp, Mus musculus
ccgctggggaaacgacagagaccaa

SEQ ID NO: 350347 - DNA, 25 bp, Mus musculus
ctcctcgagcctgggagaagcgtgt

SEQ ID NO: 350348 - DNA, 25 bp, Mus musculus
agcctcgcaggcaagcagcggcttc

SEQ ID NO: 350349 - DNA, 25 bp, Mus musculus
ttcacctcggtgtgcaccggcagca

SEQ ID NO: 350350 - DNA, 25 bp, Mus musculus
tcctgcagcgggttgggtttcacct

SEQ ID NO: 350351 - DNA, 25 bp, Mus musculus
tgtaaggctgtgcaggaaacgcatc

SEQ ID NO: 350352 - DNA, 25 bp, Mus musculus
tgagacccgttgcaaactttgccga

SEQ ID NO: 350353 - DNA, 25 bp, Mus musculus
tgagcatcggacacgcggctaagcc

SEQ ID NO: 350354 - DNA, 25 bp, Mus musculus
gaaacgcatcctccgaccatcaggg

SEQ ID NO: 350355 - DNA, 25 bp, Mus musculus
cggctaagccgacgcggagcatctc

SEQ ID NO: 350356 - DNA, 25 bp, Mus musculus
ctttgcgattgcagacgacgggcca

SEQ ID NO: 350357 - DNA, 25 bp, Mus musculus
aatcgtcgccttcgtagtctccatc

SEQ ID NO: 350358 - DNA, 25 bp, Mus musculus
ctgacagtactgtgagtgcgggtcc

SEQ ID NO: 350359 - DNA, 25 bp, Mus musculus
cgcgctctgggtgccctgacagtac

SEQ ID NO: 350360 - DNA, 25 bp, Mus musculus
tgagagatttgggaacctcgggccc

SEQ ID NO: 350361 - DNA, 25 bp, Mus musculus
ctggtctgagggctttgcgattgca

SEQ ID NO: 350362 - DNA, 25 bp, Mus musculus
cggctcctctgtgagagatttggga

SEQ ID NO: 350363 - DNA, 25 bp, Mus musculus
cagcaccaataaaagagccggtttc

SEQ ID NO: 350364 - DNA, 25 bp, Mus musculus
gttgtccctggacagcaccaataaa

SEQ ID NO: 350365 - DNA, 25 bp, Mus musculus
aggcgcagcaggctatccacatctg

SEQ ID NO: 350366 - DNA, 25 bp, Mus musculus
gctatccacatctggttgtccctgg

SEQ ID NO: 350367 - DNA, 25 bp, Mus musculus
gctgcagcccagcatggctagcacg

SEQ ID NO: 350368 - DNA, 25 bp, Mus musculus
ggctagcacggccttggaaatcgtc

SEQ ID NO: 350369 - DNA, 25 bp, Mus musculus
ccctcaagtgcccagtgggcgggac

SEQ ID NO: 350370 - DNA, 25 bp, Mus musculus
caaaggccatgggagccgcgcctat

SEQ ID NO: 350371 - DNA, 25 bp, Mus musculus
agccgcgcctatggcagaggcgtca

SEQ ID NO: 350372 - DNA, 25 bp, Mus musculus
gccagagggtagtagacgtgcttct

SEQ ID NO: 350373 - DNA, 25 bp, Mus musculus
tagtagacgtgcttctggaagggct

SEQ ID NO: 350374 - DNA, 25 bp, Mus musculus
ggagagacaagagtccaggcgaacc

SEQ ID NO: 350375 - DNA, 25 bp, Mus musculus
ggcctcgtgcatcttaccatgcttg

SEQ ID NO: 350376 - DNA, 25 bp, Mus musculus
agtccgccgcctaggcttgcgctgg

SEQ ID NO: 350377 - DNA, 25 bp, Mus musculus
cactctcctcgtgagcctctgatgg

SEQ ID NO: 350378 - DNA, 25 bp, Mus musculus
tcgtgagcctctgatggcccagacc

SEQ ID NO: 350379 - DNA, 25 bp, Mus musculus
gatctgggcgtccaggacgttgcta

SEQ ID NO: 350380 - DNA, 25 bp, Mus musculus
gcgtccaggacgttgctatggcagc

SEQ ID NO: 350381 - DNA, 25 bp, Mus musculus
ccgacctggagtacagggcgtgtcc

SEQ ID NO: 350382 - DNA, 25 bp, Mus musculus
ttgtccacgtcgatggcgctcagcc

SEQ ID NO: 350383 - DNA, 25 bp, Mus musculus
ccggcaaccttgtccacgtcgatgg

SEQ ID NO: 350384 - DNA, 25 bp, Mus musculus
tccagggcgcaagataaagcgtgtc

SEQ ID NO: 350385 - DNA, 25 bp, Mus musculus
gcccgacttcgccaacagagatgcg

SEQ ID NO: 350386 - DNA, 25 bp, Mus musculus
cttcgccaacagagatgcgagatgc

SEQ ID NO: 350387 - DNA, 25 bp, Mus musculus
atgcgagatgctctgtgtggctgaa

SEQ ID NO: 350388 - DNA, 25 bp, Mus musculus
agatgctctgtgtggctgaagtccg

SEQ ID NO: 350389 - DNA, 25 bp, Mus musculus
ggcggacgcccggagcatcctagac

SEQ ID NO: 350390 - DNA, 25 bp, Mus musculus
ccagatcccgggattgctgctggcg

SEQ ID NO: 350391 - DNA, 25 bp, Mus musculus
gctccttcttccagggcgcaagata

SEQ ID NO: 350392 - DNA, 25 bp, Mus musculus
gataaagcgtgtctggtccgggcaa

SEQ ID NO: 350393 - DNA, 25 bp, Mus musculus
aggcgggtagcccagcgtcgctcct

SEQ ID NO: 350394 - DNA, 25 bp, Mus musculus
ctctacggtcttctggtggcctctt

SEQ ID NO: 350395 - DNA, 25 bp, Mus musculus
gcgcctagaccgcagcactaaaaaa

SEQ ID NO: 350396 - DNA, 25 bp, Mus musculus
gcagctgctgcagacacgtgatgct

SEQ ID NO: 350397 - DNA, 25 bp, Mus musculus
aggccgaggagcaactgagcagcaa

SEQ ID NO: 350398 - DNA, 25 bp, Mus musculus
gacgcagcctcgtcttgtgcttcca

SEQ ID NO: 350399 - DNA, 25 bp, Mus musculus
acactacccgaaggaatctgggctc

SEQ ID NO: 350400 - DNA, 25 bp, Mus musculus
aatctgggctcgctccaggaacccg

SEQ ID NO: 350401 - DNA, 25 bp, Mus musculus
tttggagcccgctgacagctccacg

SEQ ID NO: 350402 - DNA, 25 bp, Mus musculus
tgtgcttccacgttatcctatcaga

SEQ ID NO: 350403 - DNA, 25 bp, Mus musculus
acgttatcctatcagaggcggggcg

SEQ ID NO: 350404 - DNA, 25 bp, Mus musculus
ctctgtggccagaaggaaggcgatt

SEQ ID NO: 350405 - DNA, 25 bp, Mus musculus
ctcaggcgcccttggacatggtggc

SEQ ID NO: 350406 - DNA, 25 bp, Mus musculus
tcctgctggtcctggtggacctgca

SEQ ID NO: 350407 - DNA, 25 bp, Mus musculus
cctgcagtacgaaggtgagtcccgc

SEQ ID NO: 350408 - DNA, 25 bp, Mus musculus
acttaggctggtgcctggagaagcc

SEQ ID NO: 350409 - DNA, 25 bp, Mus musculus
ctggagaagcccacctctgggctcg

SEQ ID NO: 350410 - DNA, 25 bp, Mus musculus
cgcggtgttcccgttcctgctggtc

SEQ ID NO: 350411 - DNA, 25 bp, Mus musculus
cagaagggctctagggcccgcgcat

SEQ ID NO: 350412 - DNA, 25 bp, Mus musculus
gctacggtctggtcctcccggtgct

SEQ ID NO: 350413 - DNA, 25 bp, Mus musculus
gcatgcgtggccagcgaggtccagg

SEQ ID NO: 350414 - DNA, 25 bp, Mus musculus
cagtccgttagtccgccggtcgtgg

SEQ ID NO: 350415 - DNA, 25 bp, Mus musculus
tgcagtccgttagtccgccggtcgt

SEQ ID NO: 350416 - DNA, 25 bp, Mus musculus
agctgcagtccgttagtccgccggt

SEQ ID NO: 350417 - DNA, 25 bp, Mus musculus
cctcccggtgctccgccgtccactt

SEQ ID NO: 350418 - DNA, 25 bp, Mus musculus
acgctacggtctggtcctcccggtg

SEQ ID NO: 350419 - DNA, 25 bp, Mus musculus
agacgccacgctacggtctggtcct

SEQ ID NO: 350420 - DNA, 25 bp, Mus musculus
cgagacgccacgctacggtctggtc

SEQ ID NO: 350421 - DNA, 25 bp, Mus musculus
agcgcgagacgccacgctacggtct

SEQ ID NO: 350422 - DNA, 25 bp, Mus musculus
agggaagcgcgagacgccacgctac

SEQ ID NO: 350423 - DNA, 25 bp, Mus musculus
caccaaggcacgccgagggaagcgc

SEQ ID NO: 350424 - DNA, 25 bp, Mus musculus
gctctggcccgcaccaaggcacgcc

SEQ ID NO: 350425 - DNA, 25 bp, Mus musculus
gggagctgcagtccgttagtccgcc

SEQ ID NO: 350426 - DNA, 25 bp, Mus musculus
cctccgcgtgcgctcacctgctggg

SEQ ID NO: 350427 - DNA, 25 bp, Mus musculus
ttttctcatgcactaagcagagggg

SEQ ID NO: 350428 - DNA, 25 bp, Mus musculus
ttttttctcatgcactaagcagagg

SEQ ID NO: 350429 - DNA, 25 bp, Mus musculus
acccgagagagacccagaggcaact

SEQ ID NO: 350430 - DNA, 25 bp, Mus musculus
ccgcggacccgagagagacccagag

SEQ ID NO: 350431 - DNA, 25 bp, Mus musculus
agacagagaacaatgcgccgccggg

SEQ ID NO: 350432 - DNA, 25 bp, Mus musculus
cgcgcaaagttgaagacagagaaca

SEQ ID NO: 350433 - DNA, 25 bp, Mus musculus
agttgaagacagagaacaatgcgcc

SEQ ID NO: 350434 - DNA, 25 bp, Mus musculus
acagagaacaatgcgccgccgggcc

SEQ ID NO: 350435 - DNA, 25 bp, Mus musculus
ccaggcgcgcaaagttgaagacaga

SEQ ID NO: 350436 - DNA, 25 bp, Mus musculus
tctccaggcgcgcaaagttgaagac

SEQ ID NO: 350437 - DNA, 25 bp, Mus musculus
ctccaggcgcgcaaagttgaagaca

SEQ ID NO: 350438 - DNA, 25 bp, Mus musculus
tgaagacagagaacaatgcgccgcc

SEQ ID NO: 350439 - DNA, 25 bp, Mus musculus
cggacccgagagagacccagaggca

SEQ ID NO: 350440 - DNA, 25 bp, Mus musculus
ctctcctcttcgtggtcatcatgta

SEQ ID NO: 350441 - DNA, 25 bp, Mus musculus
cccggttcgtgcctcgattcaactt

SEQ ID NO: 350442 - DNA, 25 bp, Mus musculus
tggtgagcctcatgcagctcctgtg

SEQ ID NO: 350443 - DNA, 25 bp, Mus musculus
cgggaccatggatgaaaggttcaac

SEQ ID NO: 350444 - DNA, 25 bp, Mus musculus
ttcaacttcaccctcaaggacctga

SEQ ID NO: 350445 - DNA, 25 bp, Mus musculus
atgcaccaacttcggggagcagctc

SEQ ID NO: 350446 - DNA, 25 bp, Mus musculus
tggtcatcatgtaccagtacgtgtc

SEQ ID NO: 350447 - DNA, 25 bp, Mus musculus
tgaaaggttcaacaagtggctgctg

SEQ ID NO: 350448 - DNA, 25 bp, Mus musculus
ctgccggcctgagaacgggaccatg

SEQ ID NO: 350449 - DNA, 25 bp, Mus musculus
cgaaacttccgagcaggcgcccgat

SEQ ID NO: 350450 - DNA, 25 bp, Mus musculus
gggcagccagacagccgttctcttc

SEQ ID NO: 350451 - DNA, 25 bp, Mus musculus
cgccgcgtccaggtacaagaggagc

SEQ ID NO: 350452 - DNA, 25 bp, Mus musculus
gatgctccgtgtcgcctgagagcgc

SEQ ID NO: 350453 - DNA, 25 bp, Mus musculus
gacccgcttcgtggacttcaacatc

SEQ ID NO: 350454 - DNA, 25 bp, Mus musculus
ctccgagccgactgttgtgttagac

SEQ ID NO: 350455 - DNA, 25 bp, Mus musculus
agccgactgttgtgttagaccccga

SEQ ID NO: 350456 - DNA, 25 bp, Mus musculus
cccgagccgactgttgtgttagacc

SEQ ID NO: 350457 - DNA, 25 bp, Mus musculus
ccgagccgactgttgtgttagactc

SEQ ID NO: 350458 - DNA, 25 bp, Mus musculus
agccgactgttgtgttagactccga

SEQ ID NO: 350459 - DNA, 25 bp, Mus musculus
tgttgtgttagactccgagccgact

SEQ ID NO: 350460 - DNA, 25 bp, Mus musculus
gttagactccgagccgactgttgtg

SEQ ID NO: 350461 - DNA, 25 bp, Mus musculus
tccgagccgactgttgtgttagacc

SEQ ID NO: 350462 - DNA, 25 bp, Mus musculus
gactgttgtgttagaccccgagccg

SEQ ID NO: 350463 - DNA, 25 bp, Mus musculus
cccgagccgactgttgtgttagact

SEQ ID NO: 350464 - DNA, 25 bp, Mus musculus
ctgttgtgttagactccgagccgac

SEQ ID NO: 350465 - DNA, 25 bp, Mus musculus
ccgagccgactgttgtgttagaccc

SEQ ID NO: 350466 - DNA, 25 bp, Mus musculus
ccgactgttgtgttagactccgagc

SEQ ID NO: 350467 - DNA, 25 bp, Mus musculus
agactccgagccgactgttgtgtta

SEQ ID NO: 350468 - DNA, 25 bp, Mus musculus
ttcagggacgatgcgcgagtacaaa

SEQ ID NO: 350469 - DNA, 25 bp, Mus musculus
aaatccgccctgaccgtgcagttcg

SEQ ID NO: 350470 - DNA, 25 bp, Mus musculus
cggccgtgagccgacgagtccgtaa

SEQ ID NO: 350471 - DNA, 25 bp, Mus musculus
agggccgcgcacgactcgttcagct

SEQ ID NO: 350472 - DNA, 25 bp, Mus musculus
gtcgagctctgttgctgctctcgcc

SEQ ID NO: 350473 - DNA, 25 bp, Mus musculus
ctccggctcgaggtcgagctctgtt

SEQ ID NO: 350474 - DNA, 25 bp, Mus musculus
atgtatgtcagccataggccggccc

SEQ ID NO: 350475 - DNA, 25 bp, Mus musculus
acgggatcaagccaaagctctccga

SEQ ID NO: 350476 - DNA, 25 bp, Mus musculus
cacgtcgttacgtataacgggatca

SEQ ID NO: 350477 - DNA, 25 bp, Mus musculus
cggcggcccttaaggctcacgtcgt

SEQ ID NO: 350478 - DNA, 25 bp, Mus musculus
atttgcttgtgtaactcatggcggc

SEQ ID NO: 350479 - DNA, 25 bp, Mus musculus
cggaagccggtcttctctggagcgc

SEQ ID NO: 350480 - DNA, 25 bp, Mus musculus
ttcgtgaccggcaccttcattgaga

SEQ ID NO: 350481 - DNA, 25 bp, Mus musculus
acggactagccgagcttcgatttgc

SEQ ID NO: 350482 - DNA, 25 bp, Mus musculus
ctacagagctggttctctatgatag

SEQ ID NO: 350483 - DNA, 25 bp, Mus musculus
cagagctggttctctatgataggct

SEQ ID NO: 350484 - DNA, 25 bp, Mus musculus
agctggttctctatgataggctggg

SEQ ID NO: 350485 - DNA, 25 bp, Mus musculus
ctggttctctatgataggctgggcg

SEQ ID NO: 350486 - DNA, 25 bp, Mus musculus
ctctatgataggctgggcggggcaa

SEQ ID NO: 350487 - DNA, 25 bp, Mus musculus
gggcaacgctccagagctggttctc

SEQ ID NO: 350488 - DNA, 25 bp, Mus musculus
cagagctggttctctatgataggcg

SEQ ID NO: 350489 - DNA, 25 bp, Mus musculus
agagctggttctctatgataggcgg

SEQ ID NO: 350490 - DNA, 25 bp, Mus musculus
acagagctggttctctatgataggc

SEQ ID NO: 350491 - DNA, 25 bp, Mus musculus
gctacagagctggttctctatgata

SEQ ID NO: 350492 - DNA, 25 bp, Mus musculus
acgctacagagctggttctctatga

SEQ ID NO: 350493 - DNA, 25 bp, Mus musculus
gctacgctacagagctggttctcta

SEQ ID NO: 350494 - DNA, 25 bp, Mus musculus
ggggctacgctacagagctggttct

SEQ ID NO: 350495 - DNA, 25 bp, Mus musculus
gggctacgctacagagctggttctc

SEQ ID NO: 350496 - DNA, 25 bp, Mus musculus
cgccagaactggcagcagggttata

SEQ ID NO: 350497 - DNA, 25 bp, Mus musculus
aagaccaggagagcttcgtcccacc

SEQ ID NO: 350498 - DNA, 25 bp, Mus musculus
gtatcctcactaggcgctcgtgcga

SEQ ID NO: 350499 - DNA, 25 bp, Mus musculus
tggctgaagactagcgcgattcgcg

SEQ ID NO: 350500 - DNA, 25 bp, Mus musculus
ttcgcgacggatagacacacaaaca

SEQ ID NO: 350501 - DNA, 25 bp, Mus musculus
ggaagaaggctttctcccacaatcc

SEQ ID NO: 350502 - DNA, 25 bp, Mus musculus
tgtagtcccgacatccaacctggtg

SEQ ID NO: 350503 - DNA, 25 bp, Mus musculus
gagcgatcgctgtcaaggacattga

SEQ ID NO: 350504 - DNA, 25 bp, Mus musculus
agcagtgctcctgagctgccaaggc

SEQ ID NO: 350505 - DNA, 25 bp, Mus musculus
ggacattgactacggcctctccatc

SEQ ID NO: 350506 - DNA, 25 bp, Mus musculus
ctgcagtgtcaggttggtgtttcca

SEQ ID NO: 350507 - DNA, 25 bp, Mus musculus
acgcgtggaccttgcgtgtccttaa

SEQ ID NO: 350508 - DNA, 25 bp, Mus musculus
ctgggcgggactgactattccatac

SEQ ID NO: 350509 - DNA, 25 bp, Mus musculus
actgtgcctcttggggcttgtagtc

SEQ ID NO: 350510 - DNA, 25 bp, Mus musculus
acctcgtcctaacagcggccctctg

SEQ ID NO: 350511 - DNA, 25 bp, Mus musculus
acctgctcctgggaaacctgctcag

SEQ ID NO: 350512 - DNA, 25 bp, Mus musculus
agccggatcggctcctcccaacccg

SEQ ID NO: 350513 - DNA, 25 bp, Mus musculus
gcgccgaaatctcccgcgctcagga

SEQ ID NO: 350514 - DNA, 25 bp, Mus musculus
agaacgcgtgtcctgcctgtcgctg

SEQ ID NO: 350515 - DNA, 25 bp, Mus musculus
cccgacaatgtggtccggaaacagg

SEQ ID NO: 350516 - DNA, 25 bp, Mus musculus
tgtcgctgccttacggcgtctttcc

SEQ ID NO: 350517 - DNA, 25 bp, Mus musculus
agcaacagttctacctgctcctggg

SEQ ID NO: 350518 - DNA, 25 bp, Mus musculus
cggcggagcagcaacagttctacct

SEQ ID NO: 350519 - DNA, 25 bp, Mus musculus
tctctcacgcctagcgcaatggcgg

SEQ ID NO: 350520 - DNA, 25 bp, Mus musculus
tgaccaatcggcgtggccctcgagg

SEQ ID NO: 350521 - DNA, 25 bp, Mus musculus
acaccgcagggtgcgtgaccaatcg

SEQ ID NO: 350522 - DNA, 25 bp, Mus musculus
cgcgcgctggagtgacgacaccgca

SEQ ID NO: 350523 - DNA, 25 bp, Mus musculus
tcccagctcagggagaacgcgtgtc

SEQ ID NO: 350524 - DNA, 25 bp, Mus musculus
gccacctttgatggctcggacctcg

SEQ ID NO: 350525 - DNA, 25 bp, Mus musculus
cagcttggcttcctctccttgggcg

SEQ ID NO: 350526 - DNA, 25 bp, Mus musculus
gcttggtggtgcagctcagacacca

SEQ ID NO: 350527 - DNA, 25 bp, Mus musculus
ggtgcagctcagacaccagctcttg

SEQ ID NO: 350528 - DNA, 25 bp, Mus musculus
tgccacacgcccaagtaaggcacag

SEQ ID NO: 350529 - DNA, 25 bp, Mus musculus
agtggtggccctcatttcccgctca

SEQ ID NO: 350530 - DNA, 25 bp, Mus musculus
cgcggcggcaacttgtgcgagtccc

SEQ ID NO: 350531 - DNA, 25 bp, Mus musculus
ctgcggagtccacgggaacggtcct

SEQ ID NO: 350532 - DNA, 25 bp, Mus musculus
gtcctttttgtagccggcggccgca

SEQ ID NO: 350533 - DNA, 25 bp, Mus musculus
cgcttcttcccgctcttggcttggt

SEQ ID NO: 350534 - DNA, 25 bp, Mus musculus
cgcaacaatagcagaagccacggtt

SEQ ID NO: 350535 - DNA, 25 bp, Mus musculus
tggacaccagcgactagcgctcgcg

SEQ ID NO: 350536 - DNA, 25 bp, Mus musculus
agaagccacggttcctcgggcaccg

SEQ ID NO: 350537 - DNA, 25 bp, Mus musculus
tgcccacggtccacctttctgcgca

SEQ ID NO: 350538 - DNA, 25 bp, Mus musculus
gacttttgctaactgaggacggacc

SEQ ID NO: 350539 - DNA, 25 bp, Mus musculus
cctccacgtgcatacacccgagatc

SEQ ID NO: 350540 - DNA, 25 bp, Mus musculus
gtctcaacgaaggttggcgggccgc

SEQ ID NO: 350541 - DNA, 25 bp, Mus musculus
acgtctcgagactgcggctgcttct

SEQ ID NO: 350542 - DNA, 25 bp, Mus musculus
gcatgcccggcaggcccgactgcac

SEQ ID NO: 350543 - DNA, 25 bp, Mus musculus
gttgacaccgccaagttgcccgctt

SEQ ID NO: 350544 - DNA, 25 bp, Mus musculus
gggcgtgttgacaccgccaagttgc

SEQ ID NO: 350545 - DNA, 25 bp, Mus musculus
ccgagtcggcgaagatcccggagaa

SEQ ID NO: 350546 - DNA, 25 bp, Mus musculus
ttggggagcgcaaagctcctgcacc

SEQ ID NO: 350547 - DNA, 25 bp, Mus musculus
tagttcagactcctgcccgggatgg

SEQ ID NO: 350548 - DNA, 25 bp, Mus musculus
cggggcctccaaggacactagttca

SEQ ID NO: 350549 - DNA, 25 bp, Mus musculus
agagtgccgctatccctgtcccagg

SEQ ID NO: 350550 - DNA, 25 bp, Mus musculus
ctgcgctcgggtctcccgcttgagg

SEQ ID NO: 350551 - DNA, 25 bp, Mus musculus
cacatagggcccaggcaccaaagcg

SEQ ID NO: 350552 - DNA, 25 bp, Mus musculus
cctcgagactagtcgggcgtatttg

SEQ ID NO: 350553 - DNA, 25 bp, Mus musculus
tagctccggacgatcctacgcgcag

SEQ ID NO: 350554 - DNA, 25 bp, Mus musculus
tgggcaggacctgactctggaatct

SEQ ID NO: 350555 - DNA, 25 bp, Mus musculus
ggagggcacagaccctacatcctga

SEQ ID NO: 350556 - DNA, 25 bp, Mus musculus
cccgggtctccaaagagactgtcga

SEQ ID NO: 350557 - DNA, 25 bp, Mus musculus
gtgcggactcgctggcaccataatg

SEQ ID NO: 350558 - DNA, 25 bp, Mus musculus
gaggcaccggacaacgtagtcttta

SEQ ID NO: 350559 - DNA, 25 bp, Mus musculus
agaagatacaagtcctcgccctcga

SEQ ID NO: 350560 - DNA, 25 bp, Mus musculus
gcgtatttgggtccaccttactgtc

SEQ ID NO: 350561 - DNA, 25 bp, Mus musculus
cagcgtgactcctggacctcgatta

SEQ ID NO: 350562 - DNA, 25 bp, Mus musculus
gctacagcctgaggacagcgaactg

SEQ ID NO: 350563 - DNA, 25 bp, Mus musculus
ggcgtacctccgagaggaccatctc

SEQ ID NO: 350564 - DNA, 25 bp, Mus musculus
ttccgagtctccgtcgacacaggga

SEQ ID NO: 350565 - DNA, 25 bp, Mus musculus
caaacatgtggctcgcggtggaact

SEQ ID NO: 350566 - DNA, 25 bp, Mus musculus
tgagtaccggttccctcatccttgg

SEQ ID NO: 350567 - DNA, 25 bp, Mus musculus
acgcacgcacttggcgactcgagtg

SEQ ID NO: 350568 - DNA, 25 bp, Mus musculus
cgagccttgtcagttcttgctctta

SEQ ID NO: 350569 - DNA, 25 bp, Mus musculus
gccgacttcgctcgctggttgacag

SEQ ID NO: 350570 - DNA, 25 bp, Mus musculus
ggctccagtgggctttgtgagtacc

SEQ ID NO: 350571 - DNA, 25 bp, Mus musculus
gggaccatgttcaccagcaccggct

SEQ ID NO: 350572 - DNA, 25 bp, Mus musculus
acctacgcacttcctctctgggaag

SEQ ID NO: 350573 - DNA, 25 bp, Mus musculus
ccgtctcgcccagtgaaaggtcaga

SEQ ID NO: 350574 - DNA, 25 bp, Mus musculus
aggtctcgagaaaggcctggtgttc

SEQ ID NO: 350575 - DNA, 25 bp, Mus musculus
gcgcttcacgccgtaaggttctgta

SEQ ID NO: 350576 - DNA, 25 bp, Mus musculus
tactgggaattctggcatgcgccaa

SEQ ID NO: 350577 - DNA, 25 bp, Mus musculus
ccgaactaccggaagcagctaccat

SEQ ID NO: 350578 - DNA, 25 bp, Mus musculus
ggcccacacggaagtactgagcatg

SEQ ID NO: 350579 - DNA, 25 bp, Mus musculus
ggcgtctcccacaaggtgcgcagca

SEQ ID NO: 350580 - DNA, 25 bp, Mus musculus
gccgcgagaaactcaacgggaaggc

SEQ ID NO: 350581 - DNA, 25 bp, Mus musculus
cagcagaggcgggattctcagagca

SEQ ID NO: 350582 - DNA, 25 bp, Mus musculus
atcatctgcgttcccgccctacagc

SEQ ID NO: 350583 - DNA, 25 bp, Mus musculus
agtatcatctgcgttcccgccctac

SEQ ID NO: 350584 - DNA, 25 bp, Mus musculus
ccgcgagaaactcaacgggaaggcg

SEQ ID NO: 350585 - DNA, 25 bp, Mus musculus
aggccgcgagaaactcaacgggaag

SEQ ID NO: 350586 - DNA, 25 bp, Mus musculus
gaggccgcgagaaactcaacgggaa

SEQ ID NO: 350587 - DNA, 25 bp, Mus musculus
agaggccgcgagaaactcaacggga

SEQ ID NO: 350588 - DNA, 25 bp, Mus musculus
caagaggccgcgagaaactcaacgg

SEQ ID NO: 350589 - DNA, 25 bp, Mus musculus
gcaagaggccgcgagaaactcaacg

SEQ ID NO: 350590 - DNA, 25 bp, Mus musculus
ggcgggattctcagagcaagaggcc

SEQ ID NO: 350591 - DNA, 25 bp, Mus musculus
cagaggcgggattctcagagcaaga

SEQ ID NO: 350592 - DNA, 25 bp, Mus musculus
agcagaggcgggattctcagagcaa

SEQ ID NO: 350593 - DNA, 25 bp, Mus musculus
ttcgggttcttatgcccgccggcgc

SEQ ID NO: 350594 - DNA, 25 bp, Mus musculus
agattgaaagataaggaccgctaca

SEQ ID NO: 350595 - DNA, 25 bp, Mus musculus
ttggcagaactcaaaccatttattg

SEQ ID NO: 350596 - DNA, 25 bp, Mus musculus
ccattagattgaaagataaggaccg

SEQ ID NO: 350597 - DNA, 25 bp, Mus musculus
cggcggtatacacgcactgagcgaa

SEQ ID NO: 350598 - DNA, 25 bp, Mus musculus
cacgcactgagcgaagcgtccttga

SEQ ID NO: 350599 - DNA, 25 bp, Mus musculus
gcactgagcgaagcgtccttgacgc

SEQ ID NO: 350600 - DNA, 25 bp, Mus musculus
cgaagcgtccttgacgcaagcggga

SEQ ID NO: 350601 - DNA, 25 bp, Mus musculus
tgacgcaagcgggaaggaccattag

SEQ ID NO: 350602 - DNA, 25 bp, Mus musculus
cgcaagcgggaaggaccattagatt

SEQ ID NO: 350603 - DNA, 25 bp, Mus musculus
tggagaggttagattggcagaactc

SEQ ID NO: 350604 - DNA, 25 bp, Mus musculus
ggaccgctacaaataaccaatggga

SEQ ID NO: 350605 - DNA, 25 bp, Mus musculus
ctacaaataaccaatgggaaggtgg

SEQ ID NO: 350606 - DNA, 25 bp, Mus musculus
tttattgcgaagtatcatctgcgtt

SEQ ID NO: 350607 - DNA, 25 bp, Mus musculus
accatttattgcgaagtatcatctg

SEQ ID NO: 350608 - DNA, 25 bp, Mus musculus
cgcggtgtctcctagcgtaaccgga

SEQ ID NO: 350609 - DNA, 25 bp, Mus musculus
aggtacgcggtgacccgatgcccac

SEQ ID NO: 350610 - DNA, 25 bp, Mus musculus
cacggtggaacctggaacccgactg

SEQ ID NO: 350611 - DNA, 25 bp, Mus musculus
aggcggaagtcacccagatcccgga

SEQ ID NO: 350612 - DNA, 25 bp, Mus musculus
tcccggaacgcggatctcttggccg

SEQ ID NO: 350613 - DNA, 25 bp, Mus musculus
ctagcgtaaccggaactagccgttg

SEQ ID NO: 350614 - DNA, 25 bp, Mus musculus
gccttgaggtgatctccgagcgccc

SEQ ID NO: 350615 - DNA, 25 bp, Mus musculus
caaggctccaggttgctgctgctgt

SEQ ID NO: 350616 - DNA, 25 bp, Mus musculus
ctgctcctgctagggacggtcccag

SEQ ID NO: 350617 - DNA, 25 bp, Mus musculus
cgccggtcaacttctgcgccgaaga

SEQ ID NO: 350618 - DNA, 25 bp, Mus musculus
cgccgaagagaagagcaacgagtgc

SEQ ID NO: 350619 - DNA, 25 bp, Mus musculus
gccttctctgcgctcgggccttgag

SEQ ID NO: 350620 - DNA, 25 bp, Mus musculus
cttggactggcctgcacgcaggtac

SEQ ID NO: 350621 - DNA, 25 bp, Mus musculus
gtcgcatttcgagccgcgacgggac

SEQ ID NO: 350622 - DNA, 25 bp, Mus musculus
atgcgatttctgtttccgactccgg

SEQ ID NO: 350623 - DNA, 25 bp, Mus musculus
tcgggccctggtcagcaatcatttt

SEQ ID NO: 350624 - DNA, 25 bp, Mus musculus
cctggtcagcaatcattttgtaacg

SEQ ID NO: 350625 - DNA, 25 bp, Mus musculus
ttttgtaacggagtctcgagactta

SEQ ID NO: 350626 - DNA, 25 bp, Mus musculus
ctcgagacttaggttgtcagattca

SEQ ID NO: 350627 - DNA, 25 bp, Mus musculus
tgtcagattcacaagcgtgccttta

SEQ ID NO: 350628 - DNA, 25 bp, Mus musculus
tcacaagcgtgcctttaagtgtggc

SEQ ID NO: 350629 - DNA, 25 bp, Mus musculus
tgcctttaagtgtggcgggcacgca

SEQ ID NO: 350630 - DNA, 25 bp, Mus musculus
cgggcacgcacgttgccattattga

SEQ ID NO: 350631 - DNA, 25 bp, Mus musculus
ccattattgactacgtgttgtgaca

SEQ ID NO: 350632 - DNA, 25 bp, Mus musculus
ctacgtgttgtgacaatgcgatttc

SEQ ID NO: 350633 - DNA, 25 bp, Mus musculus
cgatttctgtttccgactccggctg

SEQ ID NO: 350634 - DNA, 25 bp, Mus musculus
cggacagacgggcttacgaacctga

SEQ ID NO: 350635 - DNA, 25 bp, Mus musculus
ttacgaacctgagtgtcgggccctg

SEQ ID NO: 350636 - DNA, 25 bp, Mus musculus
gcgtgatgacttacaccggtgtagc

SEQ ID NO: 350637 - DNA, 25 bp, Mus musculus
aataacgtctttctcggggctcctg

SEQ ID NO: 350638 - DNA, 25 bp, Mus musculus
tgtcaggagcgagttaatcagactc

SEQ ID NO: 350639 - DNA, 25 bp, Mus musculus
cctggttgctaggagccgaagaaac

SEQ ID NO: 350640 - DNA, 25 bp, Mus musculus
agccggggacaatccttcgcctttg

SEQ ID NO: 350641 - DNA, 25 bp, Mus musculus
tgcgagatcaaaggctgcccgtgtc

SEQ ID NO: 350642 - DNA, 25 bp, Mus musculus
cgggctgtaatggtgcgagatcaaa

SEQ ID NO: 350643 - DNA, 25 bp, Mus musculus
gcacatttcggagaccgctgccctt

SEQ ID NO: 350644 - DNA, 25 bp, Mus musculus
tagagaccaggccttgggcacattt

SEQ ID NO: 350645 - DNA, 25 bp, Mus musculus
cacgcgtgtaggtagatgttcttct

SEQ ID NO: 350646 - DNA, 25 bp, Mus musculus
gtgctcaaacggtcaggacacgcgt

SEQ ID NO: 350647 - DNA, 25 bp, Mus musculus
taccgcttaggaaggagacgtgctc

SEQ ID NO: 350648 - DNA, 25 bp, Mus musculus
tctttcgctccttcggacgggaaga

SEQ ID NO: 350649 - DNA, 25 bp, Mus musculus
gcaaggcaagcctggaactcccgta

SEQ ID NO: 350650 - DNA, 25 bp, Mus musculus
tgctgtggcctttgccgctgctgct

SEQ ID NO: 350651 - DNA, 25 bp, Mus musculus
gccggggacagacacccacctgtat

SEQ ID NO: 350652 - DNA, 25 bp, Mus musculus
acccacctgtatgagtgcgcttgtg

SEQ ID NO: 350653 - DNA, 25 bp, Mus musculus
tcctctgggtccagccacttgcaga

SEQ ID NO: 350654 - DNA, 25 bp, Mus musculus
ttgcagatgagctcccgcttgattg

SEQ ID NO: 350655 - DNA, 25 bp, Mus musculus
atgagctcccgcttgattggctgcc

SEQ ID NO: 350656 - DNA, 25 bp, Mus musculus
ctgccgcatgtagcgcaggaaggcc

SEQ ID NO: 350657 - DNA, 25 bp, Mus musculus
ttcggcgcggccgtaaagctcggcc

SEQ ID NO: 350658 - DNA, 25 bp, Mus musculus
cagcccaaggcgcatctggtcgttt

SEQ ID NO: 350659 - DNA, 25 bp, Mus musculus
cccaaggcgcatctggtcgtttttt

SEQ ID NO: 350660 - DNA, 25 bp, Mus musculus
tttggccaccgggagctcttggaga

SEQ ID NO: 350661 - DNA, 25 bp, Mus musculus
ccaccgggagctcttggagagtcgt

SEQ ID NO: 350662 - DNA, 25 bp, Mus musculus
ccgagatgaacatcccggccgggtg

SEQ ID NO: 350663 - DNA, 25 bp, Mus musculus
tgccgctggccgagatgaacatccc

SEQ ID NO: 350664 - DNA, 25 bp, Mus musculus
gcagcaaccgcgaagccgaacaata

SEQ ID NO: 350665 - DNA, 25 bp, Mus musculus
gccgcagctcctttaatacactttg

SEQ ID NO: 350666 - DNA, 25 bp, Mus musculus
ctcgccgatccgaagaggaaatcca

SEQ ID NO: 350667 - DNA, 25 bp, Mus musculus
agtcgccagtatttccaccgccggt

SEQ ID NO: 350668 - DNA, 25 bp, Mus musculus
gctcccgagactgcagtcgccagta

SEQ ID NO: 350669 - DNA, 25 bp, Mus musculus
tctccgcctggctttggactcttct

SEQ ID NO: 350670 - DNA, 25 bp, Mus musculus
aatacactttggttctccgcctggc

SEQ ID NO: 350671 - DNA, 25 bp, Mus musculus
cattcggcggatgccgctgatctca

SEQ ID NO: 350672 - DNA, 25 bp, Mus musculus
tccctgccagcttgtgtgcgcacag

SEQ ID NO: 350673 - DNA, 25 bp, Mus musculus
tcgccaatgccaagctcggagggcc

SEQ ID NO: 350674 - DNA, 25 bp, Mus musculus
tgcaagtttactactccgggcgtcg

SEQ ID NO: 350675 - DNA, 25 bp, Mus musculus
ctaggggaattcgtgaccgctgcaa

SEQ ID NO: 350676 - DNA, 25 bp, Mus musculus
gacgcgcccgtttccttcatctagg

SEQ ID NO: 350677 - DNA, 25 bp, Mus musculus
ccgcagccgcgttgacttcattcgg

SEQ ID NO: 350678 - DNA, 25 bp, Mus musculus
cctcttttagctgcagcatgccagg

SEQ ID NO: 350679 - DNA, 25 bp, Mus musculus
ttttagctgcagcatgccaggtgcc

SEQ ID NO: 350680 - DNA, 25 bp, Mus musculus
gaaccggtgggtaccatgccagcgc

SEQ ID NO: 350681 - DNA, 25 bp, Mus musculus
accggtgggtaccatgccagcgccc

SEQ ID NO: 350682 - DNA, 25 bp, Mus musculus
cggtgggtaccatgccagcgcccgc

SEQ ID NO: 350683 - DNA, 25 bp, Mus musculus
aaccggtgggtaccatgccagcgcc

SEQ ID NO: 350684 - DNA, 25 bp, Mus musculus
catcagcgccctcagcaggtcattg

SEQ ID NO: 350685 - DNA, 25 bp, Mus musculus
caccgtcaagggtcgagcagccctg

SEQ ID NO: 350686 - DNA, 25 bp, Mus musculus
ctggcctttgtcttcgcttcggtta

SEQ ID NO: 350687 - DNA, 25 bp, Mus musculus
tgacagttcacacccgcctctggcc

SEQ ID NO: 350688 - DNA, 25 bp, Mus musculus
tcaggccgaagccactgacagttca

SEQ ID NO: 350689 - DNA, 25 bp, Mus musculus
gagcaccagcccgttcccagcccga

SEQ ID NO: 350690 - DNA, 25 bp, Mus musculus
gccgcacaagtgcacagccacctgc

SEQ ID NO: 350691 - DNA, 25 bp, Mus musculus
ctgtgaccgccaccgtcaagggtcg

SEQ ID NO: 350692 - DNA, 25 bp, Mus musculus
caaagccaatatggccgctcgggcc

SEQ ID NO: 350693 - DNA, 25 bp, Mus musculus
gcctgccggcaaagccaatatggcc

SEQ ID NO: 350694 - DNA, 25 bp, Mus musculus
accctggagcagtggcctgccggca

SEQ ID NO: 350695 - DNA, 25 bp, Mus musculus
ggcactgtccgcaccctggagcagt

SEQ ID NO: 350696 - DNA, 25 bp, Mus musculus
cctcagcaggtcattgccgctcaga

SEQ ID NO: 350697 - DNA, 25 bp, Mus musculus
attgccgctcagacccgggcactgt

SEQ ID NO: 350698 - DNA, 25 bp, Mus musculus
aggcaagacggaatcctccatcaca

SEQ ID NO: 350699 - DNA, 25 bp, Mus musculus
cggctcgctcgagggcatctaaact

SEQ ID NO: 350700 - DNA, 25 bp, Mus musculus
aaaggttctgggtccgcgcacctga

SEQ ID NO: 350701 - DNA, 25 bp, Mus musculus
agggcatctaaactgtcctttgaca

SEQ ID NO: 350702 - DNA, 25 bp, Mus musculus
ccttagatgctaccgcggagagccc

SEQ ID NO: 350703 - DNA, 25 bp, Mus musculus
acttccttctgggagccttagatgc

SEQ ID NO: 350704 - DNA, 25 bp, Mus musculus
cagctttcaactctggaagtgaggc

SEQ ID NO: 350705 - DNA, 25 bp, Mus musculus
gacggctttccagctttcaactctg

SEQ ID NO: 350706 - DNA, 25 bp, Mus musculus
tcctctgtgcagaaccgacggcttt

SEQ ID NO: 350707 - DNA, 25 bp, Mus musculus
agcggctggtagctcgctcccgact

SEQ ID NO: 350708 - DNA, 25 bp, Mus musculus
caattattttcatcagcggctggta

SEQ ID NO: 350709 - DNA, 25 bp, Mus musculus
cagtgcgtgcgagaacaattatttt

SEQ ID NO: 350710 - DNA, 25 bp, Mus musculus
cacgtgcgcctctgggcacaggaca

SEQ ID NO: 350711 - DNA, 25 bp, Mus musculus
ggcattcgagaaccgaaaggttctg

SEQ ID NO: 350712 - DNA, 25 bp, Mus musculus
cttcgggcttgcatcccagagtctc

SEQ ID NO: 350713 - DNA, 25 bp, Mus musculus
ctgtcctgccactgggcatctcttg

SEQ ID NO: 350714 - DNA, 25 bp, Mus musculus
gagctttacctgcactccttcggga

SEQ ID NO: 350715 - DNA, 25 bp, Mus musculus
acaggcttaagtggtccgagcttta

SEQ ID NO: 350716 - DNA, 25 bp, Mus musculus
cgcgcatatccgagggacaggctta

SEQ ID NO: 350717 - DNA, 25 bp, Mus musculus
tgggcatctcttgaacgcgcatatc

SEQ ID NO: 350718 - DNA, 25 bp, Mus musculus
agcagcaattgctggggacgctgaa

SEQ ID NO: 350719 - DNA, 25 bp, Mus musculus
gcggtcctcgcagcagcaattgctg

SEQ ID NO: 350720 - DNA, 25 bp, Mus musculus
tgagaggtcagcagccggcaagtct

SEQ ID NO: 350721 - DNA, 25 bp, Mus musculus
aaggctcctgattggccgtcccgcg

SEQ ID NO: 350722 - DNA, 25 bp, Mus musculus
gtgcggttctcatcccatatgcgta

SEQ ID NO: 350723 - DNA, 25 bp, Mus musculus
ctccgggtcctagtgcggttctcat

SEQ ID NO: 350724 - DNA, 25 bp, Mus musculus
agcttagagctcaaggctcctgatt

SEQ ID NO: 350725 - DNA, 25 bp, Mus musculus
tatgcgtaagccctaggcgaccggc

SEQ ID NO: 350726 - DNA, 25 bp, Mus musculus
gcgcaggtaagaacccgaagccaca

SEQ ID NO: 350727 - DNA, 25 bp, Mus musculus
agcaagcatcagctccgctccggta

SEQ ID NO: 350728 - DNA, 25 bp, Mus musculus
atcagctccgctccggtagcagtca

SEQ ID NO: 350729 - DNA, 25 bp, Mus musculus
ggtagcagtcacagcacgggccgcc

SEQ ID NO: 350730 - DNA, 25 bp, Mus musculus
ggcagacccatacgccgggacgcta

SEQ ID NO: 350731 - DNA, 25 bp, Mus musculus
catacgccgggacgctagcggacat

SEQ ID NO: 350732 - DNA, 25 bp, Mus musculus
ctagcggacattcgctggctggtga

SEQ ID NO: 350733 - DNA, 25 bp, Mus musculus
acattcgctggctggtgacagagtc

SEQ ID NO: 350734 - DNA, 25 bp, Mus musculus
tggtgacagagtccctaagccgccc

SEQ ID NO: 350735 - DNA, 25 bp, Mus musculus
cgcgcccggaccacggagcggaaat

SEQ ID NO: 350736 - DNA, 25 bp, Mus musculus
accacggagcggaaatgcccagctg

SEQ ID NO: 350737 - DNA, 25 bp, Mus musculus
agctgggcgggtgtcgcaaccaaac

SEQ ID NO: 350738 - DNA, 25 bp, Mus musculus
ccatgtgccggaaccgcgcaggtaa

SEQ ID NO: 350739 - DNA, 25 bp, Mus musculus
cgcgagagcaagcatcagctccgct

SEQ ID NO: 350740 - DNA, 25 bp, Mus musculus
gccatcgatcgattggcgctgctga

SEQ ID NO: 350741 - DNA, 25 bp, Mus musculus
aaagtgctcaatacgccatcgatcg

SEQ ID NO: 350742 - DNA, 25 bp, Mus musculus
aggcggtcagagcagaccctcacca

SEQ ID NO: 350743 - DNA, 25 bp, Mus musculus
atcgattggcgctgctgatcggtgc

SEQ ID NO: 350744 - DNA, 25 bp, Mus musculus
tgctcaatacgccatcgatcgattg

SEQ ID NO: 350745 - DNA, 25 bp, Mus musculus
ccctgcacagggtgcagagctgtca

SEQ ID NO: 350746 - DNA, 25 bp, Mus musculus
cccgcgcccaggtcgatgagagtgg

SEQ ID NO: 350747 - DNA, 25 bp, Mus musculus
gcccaacctgcggtttacactgaat

SEQ ID NO: 350748 - DNA, 25 bp, Mus musculus
caacctgcggtttacactgaatccg

SEQ ID NO: 350749 - DNA, 25 bp, Mus musculus
gcggtttacactgaatccgcaaaac

SEQ ID NO: 350750 - DNA, 25 bp, Mus musculus
tgaatccgcaaaactcacccgagct

SEQ ID NO: 350751 - DNA, 25 bp, Mus musculus
tccgcaaaactcacccgagcttgaa

SEQ ID NO: 350752 - DNA, 25 bp, Mus musculus
cccgagcttgaaaagtgctcaatac

SEQ ID NO: 350753 - DNA, 25 bp, Mus musculus
actcacccgagcttgaaaagtgctc

SEQ ID NO: 350754 - DNA, 25 bp, Mus musculus
ccgcgctttacctgcaaggagcacg

SEQ ID NO: 350755 - DNA, 25 bp, Mus musculus
tattcctggcttgtctcgcacgttc

SEQ ID NO: 350756 - DNA, 25 bp, Mus musculus
ccgtgcgttctaagcctattcctgg

SEQ ID NO: 350757 - DNA, 25 bp, Mus musculus
ttccctgcggatccgtgcgttctaa

SEQ ID NO: 350758 - DNA, 25 bp, Mus musculus
cagacaggctttgctgggaagagaa

SEQ ID NO: 350759 - DNA, 25 bp, Mus musculus
ggaacagagcgctcgccacgaagga

SEQ ID NO: 350760 - DNA, 25 bp, Mus musculus
tccgtgtcggagtgacgtcggaaca

SEQ ID NO: 350761 - DNA, 25 bp, Mus musculus
cctcttccgcttattggtccgtgtc

SEQ ID NO: 350762 - DNA, 25 bp, Mus musculus
caaggagcacgagccgcgatctcat

SEQ ID NO: 350763 - DNA, 25 bp, Mus musculus
tcgagtgtcggagctaactctagta

SEQ ID NO: 350764 - DNA, 25 bp, Mus musculus
gtgcggcttctacccaggcgcagac

SEQ ID NO: 350765 - DNA, 25 bp, Mus musculus
acagtagcaggcaagggtctggctc

SEQ ID NO: 350766 - DNA, 25 bp, Mus musculus
actcccgggttacaaagctgttgca

SEQ ID NO: 350767 - DNA, 25 bp, Mus musculus
ggaccatcggttgccctttccatca

SEQ ID NO: 350768 - DNA, 25 bp, Mus musculus
cagcgaagggatagcaggacgcctc

SEQ ID NO: 350769 - DNA, 25 bp, Mus musculus
ctttgctgcgcgagctacggaggat

SEQ ID NO: 350770 - DNA, 25 bp, Mus musculus
ttgccttttgctgttggctttgctg

SEQ ID NO: 350771 - DNA, 25 bp, Mus musculus
gcgtttattcgcttgccttttgctg

SEQ ID NO: 350772 - DNA, 25 bp, Mus musculus
aggagtcctggccttgcgtttattc

SEQ ID NO: 350773 - DNA, 25 bp, Mus musculus
catctgccgcacgagcgaggggcac

SEQ ID NO: 350774 - DNA, 25 bp, Mus musculus
gttctgcactagcatctgccgcacg

SEQ ID NO: 350775 - DNA, 25 bp, Mus musculus
tcccggcctccggtgtaagacgctg

SEQ ID NO: 350776 - DNA, 25 bp, Mus musculus
tcagctccgtgctggttctgcacta

SEQ ID NO: 350777 - DNA, 25 bp, Mus musculus
ggccagcggccataaccaacctgta

SEQ ID NO: 350778 - DNA, 25 bp, Mus musculus
gtgtaagacgctgtgcccgccttgc

SEQ ID NO: 350779 - DNA, 25 bp, Mus musculus
acctgtaaccgcagcgcgcggagta

SEQ ID NO: 350780 - DNA, 25 bp, Mus musculus
acctatggcggctcagtcagctccg

SEQ ID NO: 350781 - DNA, 25 bp, Mus musculus
tacggaggatgctcaaggcagcgcc

SEQ ID NO: 350782 - DNA, 25 bp, Mus musculus
tgctggccctcgaatcgtcatccga

SEQ ID NO: 350783 - DNA, 25 bp, Mus musculus
gcagcaacagcaactattaaccagg

SEQ ID NO: 350784 - DNA, 25 bp, Mus musculus
agcggaagtgcagcaacagcaacta

SEQ ID NO: 350785 - DNA, 25 bp, Mus musculus
ctctcactgggagagaagcggaagt

SEQ ID NO: 350786 - DNA, 25 bp, Mus musculus
ctcgtgtctcgctctcactgggaga

SEQ ID NO: 350787 - DNA, 25 bp, Mus musculus
tttgtgtctggctgctccgtgccgc

SEQ ID NO: 350788 - DNA, 25 bp, Mus musculus
acctctctttgtgtctggctgctcc

SEQ ID NO: 350789 - DNA, 25 bp, Mus musculus
cccggcgtccgctcgagtttggcga

SEQ ID NO: 350790 - DNA, 25 bp, Mus musculus
cccaccgccgcaccggccgaagaga

SEQ ID NO: 350791 - DNA, 25 bp, Mus musculus
caaagagggaaggaactccgctgtc

SEQ ID NO: 350792 - DNA, 25 bp, Mus musculus
cagaaacacagaccatgcaggcgct

SEQ ID NO: 350793 - DNA, 25 bp, Mus musculus
ggccctcgaatcgtcatccgacata

SEQ ID NO: 350794 - DNA, 25 bp, Mus musculus
caactattaaccaggcaatggcttc

SEQ ID NO: 350795 - DNA, 25 bp, Mus musculus
aatcgtcatccgacatagcgaaccc

SEQ ID NO: 350796 - DNA, 25 bp, Mus musculus
ctccgacgccgagtccgggagtgaa

SEQ ID NO: 350797 - DNA, 25 bp, Mus musculus
agccgggcactttgcgccgcgacat

SEQ ID NO: 350798 - DNA, 25 bp, Mus musculus
ccatcctggactttgcggagactta

SEQ ID NO: 350799 - DNA, 25 bp, Mus musculus
gcacgaattaaagggacacgcgggc

SEQ ID NO: 350800 - DNA, 25 bp, Mus musculus
gccgcgacatccatcctggactttg

SEQ ID NO: 350801 - DNA, 25 bp, Mus musculus
cttgaggagcgcacgaattaaaggg

SEQ ID NO: 350802 - DNA, 25 bp, Mus musculus
caaaagtaaagtgacagctgagtcc

SEQ ID NO: 350803 - DNA, 25 bp, Mus musculus
cgcgagcccgcgacgcgatttagcc

SEQ ID NO: 350804 - DNA, 25 bp, Mus musculus
cggagacttagttcctggctgcggt

SEQ ID NO: 350805 - DNA, 25 bp, Mus musculus
ttgcgcttcaataaggtgcagtgcg

SEQ ID NO: 350806 - DNA, 25 bp, Mus musculus
tcacctactcacctcgcggcgtcgc

SEQ ID NO: 350807 - DNA, 25 bp, Mus musculus
gaaggacggccacactctgcgggac

SEQ ID NO: 350808 - DNA, 25 bp, Mus musculus
tggggttgcgcttcaataaggtgca

SEQ ID NO: 350809 - DNA, 25 bp, Mus musculus
ggtgcgcgcgcaaaagtaaagtgac

SEQ ID NO: 350810 - DNA, 25 bp, Mus musculus
gcccagttcagcagcctctacgtaa

SEQ ID NO: 350811 - DNA, 25 bp, Mus musculus
gccgctggcgaactttctcagagtc

SEQ ID NO: 350812 - DNA, 25 bp, Mus musculus
tctcagagtcgctgattggtcagtg

SEQ ID NO: 350813 - DNA, 25 bp, Mus musculus
cagtggccgagagctgtagccaatc

SEQ ID NO: 350814 - DNA, 25 bp, Mus musculus
gcccgtattgcggaccagaggtcca

SEQ ID NO: 350815 - DNA, 25 bp, Mus musculus
agtgagcatgtttcgggacccgaca

SEQ ID NO: 350816 - DNA, 25 bp, Mus musculus
agccgggtggctaacaccgccatca

SEQ ID NO: 350817 - DNA, 25 bp, Mus musculus
tacgtaagttcagctcccggaggtg

SEQ ID NO: 350818 - DNA, 25 bp, Mus musculus
ctgcgtttctacgatgcccagttca

SEQ ID NO: 350819 - DNA, 25 bp, Mus musculus
cagcagctgtgaagctggcaatacc

SEQ ID NO: 350820 - DNA, 25 bp, Mus musculus
ggcgacgacgaaagctcagcagctg

SEQ ID NO: 350821 - DNA, 25 bp, Mus musculus
tgcgtcccgacgagctctttcctta

SEQ ID NO: 350822 - DNA, 25 bp, Mus musculus
agctctttccttacggggagtcgtg

SEQ ID NO: 350823 - DNA, 25 bp, Mus musculus
cgctatcgctgctggtgatgctgtt

SEQ ID NO: 350824 - DNA, 25 bp, Mus musculus
tcctgcacagcggaatgaggccctg

SEQ ID NO: 350825 - DNA, 25 bp, Mus musculus
gcttctaccggtgcgtcctgcacag

SEQ ID NO: 350826 - DNA, 25 bp, Mus musculus
cccgcaggactggaatatctttttt

SEQ ID NO: 350827 - DNA, 25 bp, Mus musculus
gctggccaatcatcgctgctgctta

SEQ ID NO: 350828 - DNA, 25 bp, Mus musculus
atcgcggcttaggaacgcccgcagc

SEQ ID NO: 350829 - DNA, 25 bp, Mus musculus
gacggagccaatcgcggcttaggaa

SEQ ID NO: 350830 - DNA, 25 bp, Mus musculus
ccgtgagcttgcgtcggaacatggt

SEQ ID NO: 350831 - DNA, 25 bp, Mus musculus
ttgtggtaatccagggccgtgagct

SEQ ID NO: 350832 - DNA, 25 bp, Mus musculus
aagcctgaggggttgtggtaatcca

SEQ ID NO: 350833 - DNA, 25 bp, Mus musculus
ccacctttgcagttgaagcctgagg

SEQ ID NO: 350834 - DNA, 25 bp, Mus musculus
tggcagccggccacgaactttctgc

SEQ ID NO: 350835 - DNA, 25 bp, Mus musculus
tgaacggttccacttccctggcagc

SEQ ID NO: 350836 - DNA, 25 bp, Mus musculus
ccactggcccgcaggactggaatat

SEQ ID NO: 350837 - DNA, 25 bp, Mus musculus
caatcatcgctgctgcttaggaggc

SEQ ID NO: 350838 - DNA, 25 bp, Mus musculus
agcttcaaggtgcaggcctctctcc

SEQ ID NO: 350839 - DNA, 25 bp, Mus musculus
tgggctaccagactggcccgtttgc

SEQ ID NO: 350840 - DNA, 25 bp, Mus musculus
ctcggctaaccgctgttccatggtg

SEQ ID NO: 350841 - DNA, 25 bp, Mus musculus
cctctgttgcgcctgcgcgttgcat

SEQ ID NO: 350842 - DNA, 25 bp, Mus musculus
catgagcccgggtcggaattttcca

SEQ ID NO: 350843 - DNA, 25 bp, Mus musculus
caaggctttgtgacgtctggtgacc

SEQ ID NO: 350844 - DNA, 25 bp, Mus musculus
tggtgaccctcctgtacctggagcg

SEQ ID NO: 350845 - DNA, 25 bp, Mus musculus
gagtgtcccatctcctccggctaaa

SEQ ID NO: 350846 - DNA, 25 bp, Mus musculus
accgtcagatgttccggctcttgcc

SEQ ID NO: 350847 - DNA, 25 bp, Mus musculus
cccgggccgcagaactcagttctga

SEQ ID NO: 350848 - DNA, 25 bp, Mus musculus
ctcagttctgacgtgtttgctcctc

SEQ ID NO: 350849 - DNA, 25 bp, Mus musculus
agccagtggtcagcaccgcagaaaa

SEQ ID NO: 350850 - DNA, 25 bp, Mus musculus
gctttccgtttcaggaagcgtgtca

SEQ ID NO: 350851 - DNA, 25 bp, Mus musculus
ccgaggtctgtacgctctgactgga

SEQ ID NO: 350852 - DNA, 25 bp, Mus musculus
cccgggacagttgcttggccaagtt

SEQ ID NO: 350853 - DNA, 25 bp, Mus musculus
cggggaactgcgtggatcacgttct

SEQ ID NO: 350854 - DNA, 25 bp, Mus musculus
ggatcacgttctcacaggccagggt

SEQ ID NO: 350855 - DNA, 25 bp, Mus musculus
aggccagggtgagcgcacatcaaaa

SEQ ID NO: 350856 - DNA, 25 bp, Mus musculus
cccaatctctcgatcctgaagggta

SEQ ID NO: 350857 - DNA, 25 bp, Mus musculus
gtgaaactcaggacccacaccagca

SEQ ID NO: 350858 - DNA, 25 bp, Mus musculus
agcagacacgtgtgccgcctctgcg

SEQ ID NO: 350859 - DNA, 25 bp, Mus musculus
cgcagggctctttaagcagctctca

SEQ ID NO: 350860 - DNA, 25 bp, Mus musculus
ccctgaaaggggtggagtccattcg

SEQ ID NO: 350861 - DNA, 25 bp, Mus musculus
gcccagcgcgcctgaagtcattaca

SEQ ID NO: 350862 - DNA, 25 bp, Mus musculus
tgaagtcattacaccaaacaccggg

SEQ ID NO: 350863 - DNA, 25 bp, Mus musculus
acacagtcgcgggatttgcggtctg

SEQ ID NO: 350864 - DNA, 25 bp, Mus musculus
tggccaagttggctccctgaacgcg

SEQ ID NO: 350865 - DNA, 25 bp, Mus musculus
tctgcgggactccagttgcgtatta

SEQ ID NO: 350866 - DNA, 25 bp, Mus musculus
agccgcactttacggcagccgcaaa

SEQ ID NO: 350867 - DNA, 25 bp, Mus musculus
cgtcttctggagaggaggcacgccc

SEQ ID NO: 350868 - DNA, 25 bp, Mus musculus
ccaaataactctgggcgcctgcgtc

SEQ ID NO: 350869 - DNA, 25 bp, Mus musculus
cacaagtccgggcagcagtccgaac

SEQ ID NO: 350870 - DNA, 25 bp, Mus musculus
acgcgggcccacaaacctggaagcg

SEQ ID NO: 350871 - DNA, 25 bp, Mus musculus
tctttctggtcctcctctactcggt

SEQ ID NO: 350872 - DNA, 25 bp, Mus musculus
tcctctactcggtcggggtgcactt

SEQ ID NO: 350873 - DNA, 25 bp, Mus musculus
ggtgcacttgcagggacactttgtg

SEQ ID NO: 350874 - DNA, 25 bp, Mus musculus
acactttgtggtagccgcgtcggac

SEQ ID NO: 350875 - DNA, 25 bp, Mus musculus
tagaggtcggcggtgccaaacacct

SEQ ID NO: 350876 - DNA, 25 bp, Mus musculus
cccatgccagggaagaggctgctcc

SEQ ID NO: 350877 - DNA, 25 bp, Mus musculus
aacccggggaagctgtagccacagc

SEQ ID NO: 350878 - DNA, 25 bp, Mus musculus
tagccacagccgctctgctggacag

SEQ ID NO: 350879 - DNA, 25 bp, Mus musculus
cgcctgcgtcacaggagaagcgccg

SEQ ID NO: 350880 - DNA, 25 bp, Mus musculus
cacagagcctgaagcccggaagagc

SEQ ID NO: 350881 - DNA, 25 bp, Mus musculus
agccggaaagccctctgcggaagcc

SEQ ID NO: 350882 - DNA, 25 bp, Mus musculus
agcgagacggactgagacgaagctc

SEQ ID NO: 350883 - DNA, 25 bp, Mus musculus
tctgcggaagcctccggccgatcgg

SEQ ID NO: 350884 - DNA, 25 bp, Mus musculus
gctttctcttccaatgcgcacggga

SEQ ID NO: 350885 - DNA, 25 bp, Mus musculus
cttccaatgcgcacgggagggcaac

SEQ ID NO: 350886 - DNA, 25 bp, Mus musculus
ccggtgactgatccttgactgctac

SEQ ID NO: 350887 - DNA, 25 bp, Mus musculus
acgaagctccgctggaaggcgatgt

SEQ ID NO: 350888 - DNA, 25 bp, Mus musculus
ttgactgctacggaagaggcgtgtc

SEQ ID NO: 350889 - DNA, 25 bp, Mus musculus
gctggcggtcttcagctgagtgcct

SEQ ID NO: 350890 - DNA, 25 bp, Mus musculus
cgtgcgggagactttcctgtccgcg

SEQ ID NO: 350891 - DNA, 25 bp, Mus musculus
tgagttccttgcaggccgttccatc

SEQ ID NO: 350892 - DNA, 25 bp, Mus musculus
aggccgttccatcctgcgacggttc

SEQ ID NO: 350893 - DNA, 25 bp, Mus musculus
tcactgagctggaccatggtgcctg

SEQ ID NO: 350894 - DNA, 25 bp, Mus musculus
atggcggcagaggagctatattgac

SEQ ID NO: 350895 - DNA, 25 bp, Mus musculus
cagaggagctatattgacccgtttc

SEQ ID NO: 350896 - DNA, 25 bp, Mus musculus
cggtccgcgatcgtgctcccagttg

SEQ ID NO: 350897 - DNA, 25 bp, Mus musculus
cgcggtcagccggtcagcgcagctc

SEQ ID NO: 350898 - DNA, 25 bp, Mus musculus
gagctatattgacccgtttcttatc

SEQ ID NO: 350899 - DNA, 25 bp, Mus musculus
taggcaaccactgtgtgcgcgctcc

SEQ ID NO: 350900 - DNA, 25 bp, Mus musculus
gttgctaggcaaccactgtgtgcgc

SEQ ID NO: 350901 - DNA, 25 bp, Mus musculus
ctctgcccacgggttgctaggcaac

SEQ ID NO: 350902 - DNA, 25 bp, Mus musculus
gttgcgcatgctccgcatcgaccgc

SEQ ID NO: 350903 - DNA, 25 bp, Mus musculus
ctccctcaacgggtcgttatcctgg

SEQ ID NO: 350904 - DNA, 25 bp, Mus musculus
gaggctccctcaacgggtcgttatc

SEQ ID NO: 350905 - DNA, 25 bp, Mus musculus
cgatcgtgctcccagttgggccggc

SEQ ID NO: 350906 - DNA, 25 bp, Mus musculus
cgtttcttatctcagggatgcaggg

SEQ ID NO: 350907 - DNA, 25 bp, Mus musculus
aaaaccaagagcgggacagtgctgc

SEQ ID NO: 350908 - DNA, 25 bp, Mus musculus
ctcgttaggacacgcgcggggctct

SEQ ID NO: 350909 - DNA, 25 bp, Mus musculus
gggctctacgactacggttggaaga

SEQ ID NO: 350910 - DNA, 25 bp, Mus musculus
aagaccagaccagggactgggaacg

SEQ ID NO: 350911 - DNA, 25 bp, Mus musculus
ggaggcccacctcgttaggacacgc

SEQ ID NO: 350912 - DNA, 25 bp, Mus musculus
ttcctgcaatatggagccagagggc

SEQ ID NO: 350913 - DNA, 25 bp, Mus musculus
cgactacggttggaagaccagacca

SEQ ID NO: 350914 - DNA, 25 bp, Mus musculus
cctagcccgctttcctgcaatatgg

SEQ ID NO: 350915 - DNA, 25 bp, Mus musculus
gagaaagcagcgtcacaccctagcc

SEQ ID NO: 350916 - DNA, 25 bp, Mus musculus
ctcacctgaacgagaaagcagcgtc

SEQ ID NO: 350917 - DNA, 25 bp, Mus musculus
gtgcgagtcctcacctgaacgagaa

SEQ ID NO: 350918 - DNA, 25 bp, Mus musculus
ctgaccgacggaagaacagcaaggg

SEQ ID NO: 350919 - DNA, 25 bp, Mus musculus
agggtgctagctgcttggaccgccc

SEQ ID NO: 350920 - DNA, 25 bp, Mus musculus
acgagctgactgaccgacggaagaa

SEQ ID NO: 350921 - DNA, 25 bp, Mus musculus
actgggaacgagctgactgaccgac

SEQ ID NO: 350922 - DNA, 25 bp, Mus musculus
ctaagaccgtcatgcatcgcgcgtg

SEQ ID NO: 350923 - DNA, 25 bp, Mus musculus
agctgtcgaggagccggaagctctt

SEQ ID NO: 350924 - DNA, 25 bp, Mus musculus
cggaagctcttaacgcgggcgccgc

SEQ ID NO: 350925 - DNA, 25 bp, Mus musculus
cgccgcgccgaccacaggcaaagca

SEQ ID NO: 350926 - DNA, 25 bp, Mus musculus
ccctgagcccgcgttagcgacagcc

SEQ ID NO: 350927 - DNA, 25 bp, Mus musculus
cccaagggaggcagccagtcactcg

SEQ ID NO: 350928 - DNA, 25 bp, Mus musculus
aggcttcgggtacctctcacctttg

SEQ ID NO: 350929 - DNA, 25 bp, Mus musculus
cgggtacctctcacctttgacgacg

SEQ ID NO: 350930 - DNA, 25 bp, Mus musculus
tctcacctttgacgacgcggtcggc

SEQ ID NO: 350931 - DNA, 25 bp, Mus musculus
ctctttcccttcagaggggctaaga

SEQ ID NO: 350932 - DNA, 25 bp, Mus musculus
ccttcagaggggctaagaccgtcat

SEQ ID NO: 350933 - DNA, 25 bp, Mus musculus
accgtcatgcatcgcgcgtgcaggg

SEQ ID NO: 350934 - DNA, 25 bp, Mus musculus
tggcgctagctaggcgttgtcaccc

SEQ ID NO: 350935 - DNA, 25 bp, Mus musculus
agctaggcgttgtcacccgggagca

SEQ ID NO: 350936 - DNA, 25 bp, Mus musculus
cgtacggaacgcgagtgcctcctaa

SEQ ID NO: 350937 - DNA, 25 bp, Mus musculus
actaaacttgggctgtgcgctcgct

SEQ ID NO: 350938 - DNA, 25 bp, Mus musculus
gactctctgctgaactaaacttggg

SEQ ID NO: 350939 - DNA, 25 bp, Mus musculus
tcccgccggggacagttattatggc

SEQ ID NO: 350940 - DNA, 25 bp, Mus musculus
atggagtcgaagaacgccggccagc

SEQ ID NO: 350941 - DNA, 25 bp, Mus musculus
aggccaactgttctgatggagtcga

SEQ ID NO: 350942 - DNA, 25 bp, Mus musculus
tcgcgataatcgtgtgtaagatggc

SEQ ID NO: 350943 - DNA, 25 bp, Mus musculus
gacggctgaggacgtatcgcgataa

SEQ ID NO: 350944 - DNA, 25 bp, Mus musculus
agactcgctggaaaatgagcctggc

SEQ ID NO: 350945 - DNA, 25 bp, Mus musculus
agaaccgtggaaaagagactcgctg

SEQ ID NO: 350946 - DNA, 25 bp, Mus musculus
gccaaggcaaccaactctcgcgata

SEQ ID NO: 350947 - DNA, 25 bp, Mus musculus
ctgctatagctacagggagccaagg

SEQ ID NO: 350948 - DNA, 25 bp, Mus musculus
ctcaggttccgtttccctgacattt

SEQ ID NO: 350949 - DNA, 25 bp, Mus musculus
aaccgccgcggctgctatagctaca

SEQ ID NO: 350950 - DNA, 25 bp, Mus musculus
aaagcgtcctcctccggaccagatt

SEQ ID NO: 350951 - DNA, 25 bp, Mus musculus
ccggaacatctgcttgcgggtgccc

SEQ ID NO: 350952 - DNA, 25 bp, Mus musculus
gcctagcctcctgcaggatgccggt

SEQ ID NO: 350953 - DNA, 25 bp, Mus musculus
gagttcttcgtctcttccttcccag

SEQ ID NO: 350954 - DNA, 25 bp, Mus musculus
cacagagatgcgctgctcccgaacg

SEQ ID NO: 350955 - DNA, 25 bp, Mus musculus
tgcgctgctcccgaacgctggcagg

SEQ ID NO: 350956 - DNA, 25 bp, Mus musculus
gaggcttaaagcgtcctcctccgga

SEQ ID NO: 350957 - DNA, 25 bp, Mus musculus
actagtgacagcagctccgggttgg

SEQ ID NO: 350958 - DNA, 25 bp, Mus musculus
tccaggttctgcactagtgacagca

SEQ ID NO: 350959 - DNA, 25 bp, Mus musculus
ggtttttcatccaggttctgcacta

SEQ ID NO: 350960 - DNA, 25 bp, Mus musculus
cccgaggtttttcatccaggttctg

SEQ ID NO: 350961 - DNA, 25 bp, Mus musculus
tccggaccagattccgcaccgcccg

SEQ ID NO: 350962 - DNA, 25 bp, Mus musculus
gttgggcgagttcttcgtctcttcc

SEQ ID NO: 350963 - DNA, 25 bp, Mus musculus
cttcccaggccggaacatctgcttg

SEQ ID NO: 350964 - DNA, 25 bp, Mus musculus
gccagggtatttttggcctgatcgc

SEQ ID NO: 350965 - DNA, 25 bp, Mus musculus
acctctcgcatctgtggccggcgat

SEQ ID NO: 350966 - DNA, 25 bp, Mus musculus
gcctgatcgctgtccggttttagag

SEQ ID NO: 350967 - DNA, 25 bp, Mus musculus
gaacgaagtcgaacctggatctgga

SEQ ID NO: 350968 - DNA, 25 bp, Mus musculus
ctgggagccttgacgttaggaacga

SEQ ID NO: 350969 - DNA, 25 bp, Mus musculus
ccctcggaaccggaagttgagcctg

SEQ ID NO: 350970 - DNA, 25 bp, Mus musculus
gaacttccggggacggcacgccagc

SEQ ID NO: 350971 - DNA, 25 bp, Mus musculus
gccctagagcatggggcggaacttc

SEQ ID NO: 350972 - DNA, 25 bp, Mus musculus
agaaggagtggcctagccctagagc

SEQ ID NO: 350973 - DNA, 25 bp, Mus musculus
tttccggaagcgtgcctaaggccga

SEQ ID NO: 350974 - DNA, 25 bp, Mus musculus
tacgcatgcgcaacatccgggtttc

SEQ ID NO: 350975 - DNA, 25 bp, Mus musculus
acgggatacaccacatacgcatgcg

SEQ ID NO: 350976 - DNA, 25 bp, Mus musculus
cgtccatgacgggatacaccacata

SEQ ID NO: 350977 - DNA, 25 bp, Mus musculus
gggcctagaaagagaccctcacctc

SEQ ID NO: 350978 - DNA, 25 bp, Mus musculus
gcccaccgtgcgattacaggacaca

SEQ ID NO: 350979 - DNA, 25 bp, Mus musculus
cgagctcatgcgctacatcccggtg

SEQ ID NO: 350980 - DNA, 25 bp, Mus musculus
ggaccgatacgtacgcgagctcatg

SEQ ID NO: 350981 - DNA, 25 bp, Mus musculus
agtcccattgcgatgtgccttccga

SEQ ID NO: 350982 - DNA, 25 bp, Mus musculus
acgcgccgttgctctatttgcagtc

SEQ ID NO: 350983 - DNA, 25 bp, Mus musculus
tttcagccgccactcggattatccg

SEQ ID NO: 350984 - DNA, 25 bp, Mus musculus
ggagtcgccgctcaataacttccta

SEQ ID NO: 350985 - DNA, 25 bp, Mus musculus
ctcagtgtctgttcggccagcagct

SEQ ID NO: 350986 - DNA, 25 bp, Mus musculus
gcggtggacctaccagtgttgctgt

SEQ ID NO: 350987 - DNA, 25 bp, Mus musculus
ggtctgtttccgcacttcccaggtg

SEQ ID NO: 350988 - DNA, 25 bp, Mus musculus
ttcccaggtgactcggagcgcatac

SEQ ID NO: 350989 - DNA, 25 bp, Mus musculus
gttgctcttttacggcacggacttc

SEQ ID NO: 350990 - DNA, 25 bp, Mus musculus
tgctctgactcgcttaggtggattc

SEQ ID NO: 350991 - DNA, 25 bp, Mus musculus
tatggcaagtgcctgcagaaccgcg

SEQ ID NO: 350992 - DNA, 25 bp, Mus musculus
atactgaaacccaacaagcctctta

SEQ ID NO: 350993 - DNA, 25 bp, Mus musculus
cacgccaagcgcgtagaggtcaaga

SEQ ID NO: 350994 - DNA, 25 bp, Mus musculus
aatggcgacgcccagtctacgcggc

SEQ ID NO: 350995 - DNA, 25 bp, Mus musculus
atcctaacctgctgtcggctgccgg

SEQ ID NO: 350996 - DNA, 25 bp, Mus musculus
acgctgtgcaaaatggcgacgccca

SEQ ID NO: 350997 - DNA, 25 bp, Mus musculus
gagcctactgggaacgctgtgcaaa

SEQ ID NO: 350998 - DNA, 25 bp, Mus musculus
ccgagcacgcaaagggcgcgcacaa

SEQ ID NO: 350999 - DNA, 25 bp, Mus musculus
ggcgcgcacaacctatagcatccta

SEQ ID NO: 351000 - DNA, 25 bp, Mus musculus
cgacggggttcgaatccagtgtcac

SEQ ID NO: 351001 - DNA, 25 bp, Mus musculus
ctgccgggtcccgagcacgcaaagg

SEQ ID NO: 351002 - DNA, 25 bp, Mus musculus
ttcgaatccagtgtcaccgtgaggc

SEQ ID NO: 351003 - DNA, 25 bp, Mus musculus
tcaccgtgaggccaagacccggaaa

SEQ ID NO: 351004 - DNA, 25 bp, Mus musculus
gacccggaaagtgcgcgcacagctg

SEQ ID NO: 351005 - DNA, 25 bp, Mus musculus
cttatcttagctaaccgcgtcggga

SEQ ID NO: 351006 - DNA, 25 bp, Mus musculus
tccagtcctcgagcacgcgagggcg

SEQ ID NO: 351007 - DNA, 25 bp, Mus musculus
actggcgaggatggcgcaaacagtc

SEQ ID NO: 351008 - DNA, 25 bp, Mus musculus
cggccggaagttcggatcagctgat

SEQ ID NO: 351009 - DNA, 25 bp, Mus musculus
gagtctcgcaggctggccacaatcc

SEQ ID NO: 351010 - DNA, 25 bp, Mus musculus
ccgctcgcacctcgctgttgggtga

SEQ ID NO: 351011 - DNA, 25 bp, Mus musculus
acggcgagcgcttctcgtttgagga

SEQ ID NO: 351012 - DNA, 25 bp, Mus musculus
cgtttgaggattccgaccgctttga

SEQ ID NO: 351013 - DNA, 25 bp, Mus musculus
ccgaccgctttgaggaggattcact

SEQ ID NO: 351014 - DNA, 25 bp, Mus musculus
gaggattcactctgttcgttcattt

SEQ ID NO: 351015 - DNA, 25 bp, Mus musculus
tcgttcatttccgaggccgagagcc

SEQ ID NO: 351016 - DNA, 25 bp, Mus musculus
aggccgagagcctttgccagaactg

SEQ ID NO: 351017 - DNA, 25 bp, Mus musculus
ccagaactggcgaggatggcgcaaa

SEQ ID NO: 351018 - DNA, 25 bp, Mus musculus
cgcaaacagtcagcggggcccaatt

SEQ ID NO: 351019 - DNA, 25 bp, Mus musculus
gtacgcggtccagtcctcgagcacg

SEQ ID NO: 351020 - DNA, 25 bp, Mus musculus
gggcatcagtgatgggcacggtacc

SEQ ID NO: 351021 - DNA, 25 bp, Mus musculus
gtacctgcgcatgggcatcagtgat

SEQ ID NO: 351022 - DNA, 25 bp, Mus musculus
atcagtgatgggcacggtacctgcg

SEQ ID NO: 351023 - DNA, 25 bp, Mus musculus
ggcacggtacctgcgcatgggcatc

SEQ ID NO: 351024 - DNA, 25 bp, Mus musculus
atgggcacggtacctgcgcatgggc

SEQ ID NO: 351025 - DNA, 25 bp, Mus musculus
catgggcatcagtgatgggcacggt

SEQ ID NO: 351026 - DNA, 25 bp, Mus musculus
acctgcgcatgggcatcagtgatgg

SEQ ID NO: 351027 - DNA, 25 bp, Mus musculus
catcagtgatgggcacggtacctgc

SEQ ID NO: 351028 - DNA, 25 bp, Mus musculus
gcacggtacctgcgcatgggcatca

SEQ ID NO: 351029 - DNA, 25 bp, Mus musculus
ggcatcagtgatgggcacggtacct

SEQ ID NO: 351030 - DNA, 25 bp, Mus musculus
gtgatgggcacggtacctgcgcatg

SEQ ID NO: 351031 - DNA, 25 bp, Mus musculus
acggtacctgcgcatgggcttcagt

SEQ ID NO: 351032 - DNA, 25 bp, Mus musculus
tcagtgatgggcacggtacctgcgc

SEQ ID NO: 351033 - DNA, 25 bp, Mus musculus
cagtgatgggcacggtacctgcgca

SEQ ID NO: 351034 - DNA, 25 bp, Mus musculus
cgccctggaacttgagcggtcgagg

SEQ ID NO: 351035 - DNA, 25 bp, Mus musculus
gacgcccgacatccttgctggtgct

SEQ ID NO: 351036 - DNA, 25 bp, Mus musculus
ccaggagcgaagcagtcacaggccc

SEQ ID NO: 351037 - DNA, 25 bp, Mus musculus
gagctgccaggagcgaagcagtcac

SEQ ID NO: 351038 - DNA, 25 bp, Mus musculus
gggcacaactgtcgcggaacagccc

SEQ ID NO: 351039 - DNA, 25 bp, Mus musculus
tcgggcacaactgtcgcggaacagc

SEQ ID NO: 351040 - DNA, 25 bp, Mus musculus
atcgatcgggcacaactgtcgcgga

SEQ ID NO: 351041 - DNA, 25 bp, Mus musculus
agtgacgcccgacatccttgctggt

SEQ ID NO: 351042 - DNA, 25 bp, Mus musculus
ccgtcggggatcgatcgggcacaac

SEQ ID NO: 351043 - DNA, 25 bp, Mus musculus
gattcgatggagacgcggggccgtc

SEQ ID NO: 351044 - DNA, 25 bp, Mus musculus
cggcccagagcgatggggattcgat

SEQ ID NO: 351045 - DNA, 25 bp, Mus musculus
aaacaagcgggtgtttgcgcagcgc

SEQ ID NO: 351046 - DNA, 25 bp, Mus musculus
cccgctgcaaacaagcgggtgtttg

SEQ ID NO: 351047 - DNA, 25 bp, Mus musculus
cgcggcccgctgcaaacaagcgggt

SEQ ID NO: 351048 - DNA, 25 bp, Mus musculus
ccgtggacgggagactgctctcaaa

SEQ ID NO: 351049 - DNA, 25 bp, Mus musculus
gtttcggtggcgacactcgcaggaa

SEQ ID NO: 351050 - DNA, 25 bp, Mus musculus
ggcgacactcgcaggaagtctgatc

SEQ ID NO: 351051 - DNA, 25 bp, Mus musculus
tccgccatctccgagcgaacgctcc

SEQ ID NO: 351052 - DNA, 25 bp, Mus musculus
atcgcgaaaaccgagggcgaccgtg

SEQ ID NO: 351053 - DNA, 25 bp, Mus musculus
tccacgccgggtggcacagtctgcg

SEQ ID NO: 351054 - DNA, 25 bp, Mus musculus
tgctctcaaagatggctcacccggt

SEQ ID NO: 351055 - DNA, 25 bp, Mus musculus
ctgtccactcagacccgcggaggag

SEQ ID NO: 351056 - DNA, 25 bp, Mus musculus
tcaaagatggctcacccggtggagt

SEQ ID NO: 351057 - DNA, 25 bp, Mus musculus
tcaagtaccgctcccaccaggggga

SEQ ID NO: 351058 - DNA, 25 bp, Mus musculus
tgaccgggacctgggataagccgac

SEQ ID NO: 351059 - DNA, 25 bp, Mus musculus
tgggataagccgacggccctccgca

SEQ ID NO: 351060 - DNA, 25 bp, Mus musculus
gcaggaagtctgatcgcgaaaaccg

SEQ ID NO: 351061 - DNA, 25 bp, Mus musculus
gccgcagtcgggctcaagtaccgct

SEQ ID NO: 351062 - DNA, 25 bp, Mus musculus
gtcggtgcacagtcaccgccgcccg

SEQ ID NO: 351063 - DNA, 25 bp, Mus musculus
cggcgcacggctcctgggaccactg

SEQ ID NO: 351064 - DNA, 25 bp, Mus musculus
aaaagctggtagtcgtcggtgaagc

SEQ ID NO: 351065 - DNA, 25 bp, Mus musculus
cgcgagactttaccggagagagcga

SEQ ID NO: 351066 - DNA, 25 bp, Mus musculus
gcaccgcgagactttaccggagaga

SEQ ID NO: 351067 - DNA, 25 bp, Mus musculus
agcccggcagcaccgcgagacttta

SEQ ID NO: 351068 - DNA, 25 bp, Mus musculus
tgccgagctcctcgaaaagctggta

SEQ ID NO: 351069 - DNA, 25 bp, Mus musculus
gccgtacttgccgagctcctcgaaa

SEQ ID NO: 351070 - DNA, 25 bp, Mus musculus
accgcagcggggctggaactgcaga

SEQ ID NO: 351071 - DNA, 25 bp, Mus musculus
gcggggcccggcactaaacatctcc

SEQ ID NO: 351072 - DNA, 25 bp, Mus musculus
ctgggatcctggaagccgcactagc

SEQ ID NO: 351073 - DNA, 25 bp, Mus musculus
ggggtgccgcagcactgcccagcag

SEQ ID NO: 351074 - DNA, 25 bp, Mus musculus
gctgcagtggccaggctctgcaccg

SEQ ID NO: 351075 - DNA, 25 bp, Mus musculus
ggcagcaccgcgagactttaccgga

SEQ ID NO: 351076 - DNA, 25 bp, Mus musculus
gacagcccagacagacatccaagct

SEQ ID NO: 351077 - DNA, 25 bp, Mus musculus
agacagcccagacagacatccaagc

SEQ ID NO: 351078 - DNA, 25 bp, Mus musculus
acagcccagacagacatccaagctg

SEQ ID NO: 351079 - DNA, 25 bp, Mus musculus
agacaggtgtggtggcggattctgg

SEQ ID NO: 351080 - DNA, 25 bp, Mus musculus
tgcactcatgcgcttcagagcgggt

SEQ ID NO: 351081 - DNA, 25 bp, Mus musculus
gcactcatgcgcttcagagcgggtg

SEQ ID NO: 351082 - DNA, 25 bp, Mus musculus
cactcatgcgcttcagagcgggtgg

SEQ ID NO: 351083 - DNA, 25 bp, Mus musculus
catgcgcttcagagcgggtggcgga

SEQ ID NO: 351084 - DNA, 25 bp, Mus musculus
ctcatgcgcttcagagcgggtggcg

SEQ ID NO: 351085 - DNA, 25 bp, Mus musculus
ggacacctggacacgcaggttcccg

SEQ ID NO: 351086 - DNA, 25 bp, Mus musculus
actcatgcgcttcagagcgggtggc

SEQ ID NO: 351087 - DNA, 25 bp, Mus musculus
atgcgcttcagagcgggtggcggag

SEQ ID NO: 351088 - DNA, 25 bp, Mus musculus
tgcttgcattcgcaggcgcttggag

SEQ ID NO: 351089 - DNA, 25 bp, Mus musculus
ccgtcagcaacctcgtccgggtgag

SEQ ID NO: 351090 - DNA, 25 bp, Mus musculus
cgaggtggacggcaaagccattcct

SEQ ID NO: 351091 - DNA, 25 bp, Mus musculus
atgccggtgtttcacacgcgtacga

SEQ ID NO: 351092 - DNA, 25 bp, Mus musculus
cggccctacggatcccagttttctg

SEQ ID NO: 351093 - DNA, 25 bp, Mus musculus
tctagtcgccgctccgagtcagtca

SEQ ID NO: 351094 - DNA, 25 bp, Mus musculus
tccggctctgagttgcgttaccatt

SEQ ID NO: 351095 - DNA, 25 bp, Mus musculus
aggtgaggatatcccgccctactga

SEQ ID NO: 351096 - DNA, 25 bp, Mus musculus
cgccctactgaggtgatcctgcgga

SEQ ID NO: 351097 - DNA, 25 bp, Mus musculus
acgcgtacgatcgagagcatcctgg

SEQ ID NO: 351098 - DNA, 25 bp, Mus musculus
ttcgggaatccggtcgcaatccctg

SEQ ID NO: 351099 - DNA, 25 bp, Mus musculus
ggcggagcttatcgaagtaagacca

SEQ ID NO: 351100 - DNA, 25 bp, Mus musculus
taagaccaataggagccacagtccg

SEQ ID NO: 351101 - DNA, 25 bp, Mus musculus
cagcagatctcgcacctggtgatta

SEQ ID NO: 351102 - DNA, 25 bp, Mus musculus
ctcttccacattactcaggggctga

SEQ ID NO: 351103 - DNA, 25 bp, Mus musculus
gagccggagctatgcggtctactcc

SEQ ID NO: 351104 - DNA, 25 bp, Mus musculus
cgacacctgggcgactcagtgattc

SEQ ID NO: 351105 - DNA, 25 bp, Mus musculus
gggtcctctctgcaccgcagctgaa

SEQ ID NO: 351106 - DNA, 25 bp, Mus musculus
cggagtgcccagcagattgcctgac

SEQ ID NO: 351107 - DNA, 25 bp, Mus musculus
attgcctgactagcagccgcagagg

SEQ ID NO: 351108 - DNA, 25 bp, Mus musculus
tcggtgtctacagaggttgaagatc

SEQ ID NO: 351109 - DNA, 25 bp, Mus musculus
ttaccgtagtaatcgaggtcctgta

SEQ ID NO: 351110 - DNA, 25 bp, Mus musculus
gaagcgcgtagagccaatggttatg

SEQ ID NO: 351111 - DNA, 25 bp, Mus musculus
gcgcggcagagccaaactacggtga

SEQ ID NO: 351112 - DNA, 25 bp, Mus musculus
gcccaagcccaaaaagctcaaggtg

SEQ ID NO: 351113 - DNA, 25 bp, Mus musculus
cagtgccctcttgttctggactctg

SEQ ID NO: 351114 - DNA, 25 bp, Mus musculus
ctggactctgctcaggtgcattctc

SEQ ID NO: 351115 - DNA, 25 bp, Mus musculus
tcggctggactagatagacacaacg

SEQ ID NO: 351116 - DNA, 25 bp, Mus musculus
gctcgccgaggtagagcgtgcccat

SEQ ID NO: 351117 - DNA, 25 bp, Mus musculus
tccaccaggtaagcagagggcggcc

SEQ ID NO: 351118 - DNA, 25 bp, Mus musculus
gcagtcatgacgtccaccaggtaag

SEQ ID NO: 351119 - DNA, 25 bp, Mus musculus
cctgggcagacgctgagcatcggac

SEQ ID NO: 351120 - DNA, 25 bp, Mus musculus
tggtacctactgctacctgggcaga

SEQ ID NO: 351121 - DNA, 25 bp, Mus musculus
gggagcagttgctgtggtacctact

SEQ ID NO: 351122 - DNA, 25 bp, Mus musculus
agctctccgacgctgagtgccagag

SEQ ID NO: 351123 - DNA, 25 bp, Mus musculus
tgtgtaaggacgagctctccgacgc

SEQ ID NO: 351124 - DNA, 25 bp, Mus musculus
ctctggctggtcagctagcccgcgt

SEQ ID NO: 351125 - DNA, 25 bp, Mus musculus
tcaagatggccaccgtgcccgctag

SEQ ID NO: 351126 - DNA, 25 bp, Mus musculus
gaggtggttaccaggactcaagatg

SEQ ID NO: 351127 - DNA, 25 bp, Mus musculus
tgaggcgggcactcaaccttattgc

SEQ ID NO: 351128 - DNA, 25 bp, Mus musculus
gcccatgtgactgcgaaccgggttg

SEQ ID NO: 351129 - DNA, 25 bp, Mus musculus
gagggcggccgcttcagctatgccc

SEQ ID NO: 351130 - DNA, 25 bp, Mus musculus
tgtacagccaataaggccaagcgcc

SEQ ID NO: 351131 - DNA, 25 bp, Mus musculus
agtgttcgtgctctcgtccaatgga

SEQ ID NO: 351132 - DNA, 25 bp, Mus musculus
caacggttggccctaagtgttcgtg

SEQ ID NO: 351133 - DNA, 25 bp, Mus musculus
cgagatgaccggcaggaacttgccc

SEQ ID NO: 351134 - DNA, 25 bp, Mus musculus
ttggtactggcagtcgaccctccct

SEQ ID NO: 351135 - DNA, 25 bp, Mus musculus
tcgaattttaacttcgcgtgcccgc

SEQ ID NO: 351136 - DNA, 25 bp, Mus musculus
tcctgcgcctagatccaatccattt

SEQ ID NO: 351137 - DNA, 25 bp, Mus musculus
ccgcgtcttgggtttaatgagactc

SEQ ID NO: 351138 - DNA, 25 bp, Mus musculus
aggcttctgattggcgtcgtgtaca

SEQ ID NO: 351139 - DNA, 25 bp, Mus musculus
gcaggcgactgagaacctcgaattt

SEQ ID NO: 351140 - DNA, 25 bp, Mus musculus
gaggctgcagtgagatcgttccgcc

SEQ ID NO: 351141 - DNA, 25 bp, Mus musculus
agcggcgaatagtgcacgtgcttgc

SEQ ID NO: 351142 - DNA, 25 bp, Mus musculus
gagacccggtctgcagcaacaaagg

SEQ ID NO: 351143 - DNA, 25 bp, Mus musculus
gctggaccaataggtgcccggaaaa

SEQ ID NO: 351144 - DNA, 25 bp, Mus musculus
gtgtccacattccagcggccgtgcg

SEQ ID NO: 351145 - DNA, 25 bp, Mus musculus
catgtctcggtagtagtccggcccg

SEQ ID NO: 351146 - DNA, 25 bp, Mus musculus
cgatggccatgtctcggtagtagtc

SEQ ID NO: 351147 - DNA, 25 bp, Mus musculus
gccgtggtactcgatggccatgtct

SEQ ID NO: 351148 - DNA, 25 bp, Mus musculus
agcccatagcggtccagcgccgtgg

SEQ ID NO: 351149 - DNA, 25 bp, Mus musculus
tcgtcggcctcgacgccgtggtact

SEQ ID NO: 351150 - DNA, 25 bp, Mus musculus
tggtgcacggctttcaacgctggac

SEQ ID NO: 351151 - DNA, 25 bp, Mus musculus
acgtgcgtgaaacccgccttctgca

SEQ ID NO: 351152 - DNA, 25 bp, Mus musculus
ttctgcagcccatagcggtccagcg

SEQ ID NO: 351153 - DNA, 25 bp, Mus musculus
cggctttcaacgctggacccagtaa

SEQ ID NO: 351154 - DNA, 25 bp, Mus musculus
tagaaaaagatgctgaggtcgaagg

SEQ ID NO: 351155 - DNA, 25 bp, Mus musculus
ccgcagcggagtagaaaaagatgct

SEQ ID NO: 351156 - DNA, 25 bp, Mus musculus
agtgccgagtcgatgaaggccgcag

SEQ ID NO: 351157 - DNA, 25 bp, Mus musculus
gccgcgttcagcacgtgcgtgaaac

SEQ ID NO: 351158 - DNA, 25 bp, Mus musculus
acggcgacttagacaccggctccga

SEQ ID NO: 351159 - DNA, 25 bp, Mus musculus
ctgacccgcgggcaacaagggacga

SEQ ID NO: 351160 - DNA, 25 bp, Mus musculus
gcgtctgactctcaaggcgctgcgc

SEQ ID NO: 351161 - DNA, 25 bp, Mus musculus
aaatcagggggttgagctgacccgc

SEQ ID NO: 351162 - DNA, 25 bp, Mus musculus
cggccttcgcgtctgactctcaagg

SEQ ID NO: 351163 - DNA, 25 bp, Mus musculus
gactccaacggcgacttagacaccg

SEQ ID NO: 351164 - DNA, 25 bp, Mus musculus
aagcagttccggttcggctggccgc

SEQ ID NO: 351165 - DNA, 25 bp, Mus musculus
ttagacaccggctccgagctgggtc

SEQ ID NO: 351166 - DNA, 25 bp, Mus musculus
gcgcctgcaaccaagggtgagtgga

SEQ ID NO: 351167 - DNA, 25 bp, Mus musculus
aggccgctctggaatggaatccgga

SEQ ID NO: 351168 - DNA, 25 bp, Mus musculus
tctggaatggaatccggagaaaatc

SEQ ID NO: 351169 - DNA, 25 bp, Mus musculus
aatggaatccggagaaaatcagggg

SEQ ID NO: 351170 - DNA, 25 bp, Mus musculus
cgctgctggcggcacggctccaaag

SEQ ID NO: 351171 - DNA, 25 bp, Mus musculus
agcgatgcccgctggtagccgagcc

SEQ ID NO: 351172 - DNA, 25 bp, Mus musculus
ccgcgacttcgccatggctgagtgc

SEQ ID NO: 351173 - DNA, 25 bp, Mus musculus
gacccacgtggtcactccggagcag

SEQ ID NO: 351174 - DNA, 25 bp, Mus musculus
ctgtcctggacattgcctaacccga

SEQ ID NO: 351175 - DNA, 25 bp, Mus musculus
gtccgagaccgctcacccaaggaga

SEQ ID NO: 351176 - DNA, 25 bp, Mus musculus
gggcgcaacggtgtctccttcactt

SEQ ID NO: 351177 - DNA, 25 bp, Mus musculus
gtggctgcagcgcaactttcagata

SEQ ID NO: 351178 - DNA, 25 bp, Mus musculus
tttcagatagcggagtggcctcagc

SEQ ID NO: 351179 - DNA, 25 bp, Mus musculus
tcaggacacccgcaggtactatggt

SEQ ID NO: 351180 - DNA, 25 bp, Mus musculus
cctgagtgaactcagggcggccctg

SEQ ID NO: 351181 - DNA, 25 bp, Mus musculus
tgctgtgtaccggtatgcccacggc

SEQ ID NO: 351182 - DNA, 25 bp, Mus musculus
tgcccacggcgtaagtagcacaaga

SEQ ID NO: 351183 - DNA, 25 bp, Mus musculus
tgtccctttcacagatcaccttttc

SEQ ID NO: 351184 - DNA, 25 bp, Mus musculus
gcaggtactatggtgcccgcctctt

SEQ ID NO: 351185 - DNA, 25 bp, Mus musculus
cctcttgccgactctggggccttag

SEQ ID NO: 351186 - DNA, 25 bp, Mus musculus
cgctgcagccgaagagatcaacacc

SEQ ID NO: 351187 - DNA, 25 bp, Mus musculus
ggggacaaactactgccacctgccg

SEQ ID NO: 351188 - DNA, 25 bp, Mus musculus
cacctggccggggacaaactactgc

SEQ ID NO: 351189 - DNA, 25 bp, Mus musculus
cgcttgccgcttacggggctccggt

SEQ ID NO: 351190 - DNA, 25 bp, Mus musculus
ggagctgcccaccatggggtcgcca

SEQ ID NO: 351191 - DNA, 25 bp, Mus musculus
gctggcctcggtgggccacctgtac

SEQ ID NO: 351192 - DNA, 25 bp, Mus musculus
tttgggtggcacctacaccacgctc

SEQ ID NO: 351193 - DNA, 25 bp, Mus musculus
ctgcacccggccatgggtatggcgt

SEQ ID NO: 351194 - DNA, 25 bp, Mus musculus
aagcctagtggcatcggggcgccca

SEQ ID NO: 351195 - DNA, 25 bp, Mus musculus
ggcccaacaccgaagcctagtggca

SEQ ID NO: 351196 - DNA, 25 bp, Mus musculus
tgacacacgcgcaagccggcgagct

SEQ ID NO: 351197 - DNA, 25 bp, Mus musculus
gctgcacggggtgacacacgcgcaa

SEQ ID NO: 351198 - DNA, 25 bp, Mus musculus
cacccaggatggagttgagcttgga

SEQ ID NO: 351199 - DNA, 25 bp, Mus musculus
ttgagcacacacgaagaggacaccc

SEQ ID NO: 351200 - DNA, 25 bp, Mus musculus
ctggtgctcacccaatgtctgcagg

SEQ ID NO: 351201 - DNA, 25 bp, Mus musculus
ggagctgcagacagcgctcgtagta

SEQ ID NO: 351202 - DNA, 25 bp, Mus musculus
tcgtagtaggcggtacagttctctt

SEQ ID NO: 351203 - DNA, 25 bp, Mus musculus
gtacagttctctttgtccgcgtcca

SEQ ID NO: 351204 - DNA, 25 bp, Mus musculus
ttgtccgcgtccaccacggctatgt

SEQ ID NO: 351205 - DNA, 25 bp, Mus musculus
cggctatgtcgaaggttccggcctc

SEQ ID NO: 351206 - DNA, 25 bp, Mus musculus
gcccgccgctaggagctcatcttaa

SEQ ID NO: 351207 - DNA, 25 bp, Mus musculus
ctcatcttaacagggacagagggca

SEQ ID NO: 351208 - DNA, 25 bp, Mus musculus
ttggacagtgctgtctgggtccctc

SEQ ID NO: 351209 - DNA, 25 bp, Mus musculus
gctgcagccgaaggtcgatcttctg

SEQ ID NO: 351210 - DNA, 25 bp, Mus musculus
ccacttctgcctgcggaaggaggcc

SEQ ID NO: 351211 - DNA, 25 bp, Mus musculus
gggctctcacctgcttccacatggg

SEQ ID NO: 351212 - DNA, 25 bp, Mus musculus
gggctctgcgtcaacctcgcaggtc

SEQ ID NO: 351213 - DNA, 25 bp, Mus musculus
gctcagggtcgccagttttgttccc

SEQ ID NO: 351214 - DNA, 25 bp, Mus musculus
gcagcaggcgctcttgccgcctgga

SEQ ID NO: 351215 - DNA, 25 bp, Mus musculus
cgtcctcgggcaccatctggtgaca

SEQ ID NO: 351216 - DNA, 25 bp, Mus musculus
acccggtggctgcatgcggaactgc

SEQ ID NO: 351217 - DNA, 25 bp, Mus musculus
gctgagaacatctcgccacccggtg

SEQ ID NO: 351218 - DNA, 25 bp, Mus musculus
actgccacaggggattgtcctcagg

SEQ ID NO: 351219 - DNA, 25 bp, Mus musculus
tctggtgacacatggccgtattgca

SEQ ID NO: 351220 - DNA, 25 bp, Mus musculus
ctgggaccagtaagccgacagggct

SEQ ID NO: 351221 - DNA, 25 bp, Mus musculus
ctgagccatggtgcaggttagcagc

SEQ ID NO: 351222 - DNA, 25 bp, Mus musculus
agaccagtagcgaaggcggcgccca

SEQ ID NO: 351223 - DNA, 25 bp, Mus musculus
cagctcacccagcaagagaccagta

SEQ ID NO: 351224 - DNA, 25 bp, Mus musculus
ggcctgcatttctgaccgggttctc

SEQ ID NO: 351225 - DNA, 25 bp, Mus musculus
atggaggccaccgtttccctgccgg

SEQ ID NO: 351226 - DNA, 25 bp, Mus musculus
attgtcctcaggtggcagcaggcgc

SEQ ID NO: 351227 - DNA, 25 bp, Mus musculus
ccgtattgcaaggtcaggctgagaa

SEQ ID NO: 351228 - DNA, 25 bp, Mus musculus
ccgtatccttgggaaagatgccaga

SEQ ID NO: 351229 - DNA, 25 bp, Mus musculus
ctccttcttatctgaaccgggtttg

SEQ ID NO: 351230 - DNA, 25 bp, Mus musculus
acgccgatgtcgctcagcttcaagg

SEQ ID NO: 351231 - DNA, 25 bp, Mus musculus
ggtccggcttccctatctgcgaaca

SEQ ID NO: 351232 - DNA, 25 bp, Mus musculus
gaacatgtttgagccagcagcgcca

SEQ ID NO: 351233 - DNA, 25 bp, Mus musculus
tagtgcccttcgtaacagcccgcga

SEQ ID NO: 351234 - DNA, 25 bp, Mus musculus
tccaggcgcaattctaagtggcacc

SEQ ID NO: 351235 - DNA, 25 bp, Mus musculus
ctggtcgctctaggatccttcctga

SEQ ID NO: 351236 - DNA, 25 bp, Mus musculus
cctccgaggctgtgtaaatatacta

SEQ ID NO: 351237 - DNA, 25 bp, Mus musculus
ctttggaacagtatacaggcccttg

SEQ ID NO: 351238 - DNA, 25 bp, Mus musculus
gagggctaggtacatagggacttta

SEQ ID NO: 351239 - DNA, 25 bp, Mus musculus
aaggtccttacctcgatggggctga

SEQ ID NO: 351240 - DNA, 25 bp, Mus musculus
cgttgctctctactgactaaggttg

SEQ ID NO: 351241 - DNA, 25 bp, Mus musculus
agcccgcgaaaagcatttcaacttc

SEQ ID NO: 351242 - DNA, 25 bp, Mus musculus
tgctgagtacctaagaacgacgctg

SEQ ID NO: 351243 - DNA, 25 bp, Mus musculus
acttgtacctggatctgggtgcaca

SEQ ID NO: 351244 - DNA, 25 bp, Mus musculus
aggcgctgtgcatgctgacttgtac

SEQ ID NO: 351245 - DNA, 25 bp, Mus musculus
gctggacggcatgatgtagaccatc

SEQ ID NO: 351246 - DNA, 25 bp, Mus musculus
ataggcaaacaggtctcaggctcgc

SEQ ID NO: 351247 - DNA, 25 bp, Mus musculus
gagaagaggcctgaccatgtgcata

SEQ ID NO: 351248 - DNA, 25 bp, Mus musculus
acccgtgttcgtagcgagagttgaa

SEQ ID NO: 351249 - DNA, 25 bp, Mus musculus
ctccttaattctgtgacccgtgttc

SEQ ID NO: 351250 - DNA, 25 bp, Mus musculus
gcccgagttctggaggttacttgta

SEQ ID NO: 351251 - DNA, 25 bp, Mus musculus
gccatcaaatatagcccgagttctg

SEQ ID NO: 351252 - DNA, 25 bp, Mus musculus
ccagttgtcgacctcggtagtgttc

SEQ ID NO: 351253 - DNA, 25 bp, Mus musculus
gaggtttcccgcctctctggcataa

SEQ ID NO: 351254 - DNA, 25 bp, Mus musculus
cgctgggcgacttccataacgtccg

SEQ ID NO: 351255 - DNA, 25 bp, Mus musculus
cccgggaatgtaacttgaggatgtc

SEQ ID NO: 351256 - DNA, 25 bp, Mus musculus
tccgagccaggatcctccttctaga

SEQ ID NO: 351257 - DNA, 25 bp, Mus musculus
cccgcggataaccgagaaaggatgg

SEQ ID NO: 351258 - DNA, 25 bp, Mus musculus
cagagagcagccagttgttccgagc

SEQ ID NO: 351259 - DNA, 25 bp, Mus musculus
cagccagttgttccgagccaggatc

SEQ ID NO: 351260 - DNA, 25 bp, Mus musculus
ttgttccgagccaggatcctccttc

SEQ ID NO: 351261 - DNA, 25 bp, Mus musculus
aggatcctccttctagacccgaagc

SEQ ID NO: 351262 - DNA, 25 bp, Mus musculus
tcctccttctagacccgaagctggg

SEQ ID NO: 351263 - DNA, 25 bp, Mus musculus
cttctagacccgaagctggggtgca

SEQ ID NO: 351264 - DNA, 25 bp, Mus musculus
ctggggtgcaggtttaagtcgctct

SEQ ID NO: 351265 - DNA, 25 bp, Mus musculus
tgcaggtttaagtcgctctaggagc

SEQ ID NO: 351266 - DNA, 25 bp, Mus musculus
agtcgctctaggagctgaattgagc

SEQ ID NO: 351267 - DNA, 25 bp, Mus musculus
cgctctaggagctgaattgagcgcg

SEQ ID NO: 351268 - DNA, 25 bp, Mus musculus
cccagggccagcagcacttccgctg

SEQ ID NO: 351269 - DNA, 25 bp, Mus musculus
ccagttgttccgagccaggatcctc

SEQ ID NO: 351270 - DNA, 25 bp, Mus musculus
gcgggccacccgctgcgagctgccc

SEQ ID NO: 351271 - DNA, 25 bp, Mus musculus
agtagtcgcgtggggttcccacgct

SEQ ID NO: 351272 - DNA, 25 bp, Mus musculus
cccggaggtgcaggttcacgtgcac

SEQ ID NO: 351273 - DNA, 25 bp, Mus musculus
tgcaggttcacgtgcaccgggttga

SEQ ID NO: 351274 - DNA, 25 bp, Mus musculus
cacgtgcaccgggttgagccagcca

SEQ ID NO: 351275 - DNA, 25 bp, Mus musculus
cggcagcgctgctgcgcacagttct

SEQ ID NO: 351276 - DNA, 25 bp, Mus musculus
acagttcttggtggccgaccggagt

SEQ ID NO: 351277 - DNA, 25 bp, Mus musculus
cgaccggagtctagggcttccgttg

SEQ ID NO: 351278 - DNA, 25 bp, Mus musculus
agtctagggcttccgttggtcagct

SEQ ID NO: 351279 - DNA, 25 bp, Mus musculus
agggcttccgttggtcagctgacct

SEQ ID NO: 351280 - DNA, 25 bp, Mus musculus
ccgttggtcagctgacctcccagtg

SEQ ID NO: 351281 - DNA, 25 bp, Mus musculus
tgacctcccagtgcggaactgcgcc

SEQ ID NO: 351282 - DNA, 25 bp, Mus musculus
ctgcgcacagttcttggtggccgac

SEQ ID NO: 351283 - DNA, 25 bp, Mus musculus
aaccggacaggaactgggcaggaga

SEQ ID NO: 351284 - DNA, 25 bp, Mus musculus
ggcagcaaacggtccacaggtactt

SEQ ID NO: 351285 - DNA, 25 bp, Mus musculus
gaggcccccgaagaaagtcaccatg

SEQ ID NO: 351286 - DNA, 25 bp, Mus musculus
ccgcagtggcagcaaacggtccaca

SEQ ID NO: 351287 - DNA, 25 bp, Mus musculus
gggcgcgcgttaccttcgtcttgcc

SEQ ID NO: 351288 - DNA, 25 bp, Mus musculus
tccacaggtacttgagcgtccgcca

SEQ ID NO: 351289 - DNA, 25 bp, Mus musculus
aggtacttgagcgtccgccagagca

SEQ ID NO: 351290 - DNA, 25 bp, Mus musculus
agcgtccgccagagcaagatgatga

SEQ ID NO: 351291 - DNA, 25 bp, Mus musculus
gccaagaaagcccaccacatgcgtt

SEQ ID NO: 351292 - DNA, 25 bp, Mus musculus
agaaagcccaccacatgcgttggcc

SEQ ID NO: 351293 - DNA, 25 bp, Mus musculus
cggcacctccatggtcaccggtatg

SEQ ID NO: 351294 - DNA, 25 bp, Mus musculus
acctccatggtcaccggtatgatga

SEQ ID NO: 351295 - DNA, 25 bp, Mus musculus
tatgatgagcgcatccatcttgggc

SEQ ID NO: 351296 - DNA, 25 bp, Mus musculus
caccggtatgatgagcgcatccatc

SEQ ID NO: 351297 - DNA, 25 bp, Mus musculus
tggtcaccggtatgatgagcgcatc

SEQ ID NO: 351298 - DNA, 25 bp, Mus musculus
cttcgggccgggtctctgtgaccct

SEQ ID NO: 351299 - DNA, 25 bp, Mus musculus
gcagccgccagcagtggcagctgca

SEQ ID NO: 351300 - DNA, 25 bp, Mus musculus
cgggcgcgggctcaaacagcccgaa

SEQ ID NO: 351301 - DNA, 25 bp, Mus musculus
ctgtgaccctgagcttcctcggcct

SEQ ID NO: 351302 - DNA, 25 bp, Mus musculus
ccagctagccgatgctctgcgggac

SEQ ID NO: 351303 - DNA, 25 bp, Mus musculus
ttggttgcggcggtctgccctgcct

SEQ ID NO: 351304 - DNA, 25 bp, Mus musculus
taggatcggagaatccgcgccctcc

SEQ ID NO: 351305 - DNA, 25 bp, Mus musculus
cagctccttaggatcggagaatccg

SEQ ID NO: 351306 - DNA, 25 bp, Mus musculus
tgaggcgacagctccttaggatcgg

SEQ ID NO: 351307 - DNA, 25 bp, Mus musculus
agctctctcgggtgatgaggcgaca

SEQ ID NO: 351308 - DNA, 25 bp, Mus musculus
ccgcacagctctctcgggtgatgag

SEQ ID NO: 351309 - DNA, 25 bp, Mus musculus
gaagctccgtgagcgcgatcccgcg

SEQ ID NO: 351310 - DNA, 25 bp, Mus musculus
cgggctcaaacagcccgaagcggga

SEQ ID NO: 351311 - DNA, 25 bp, Mus musculus
tctgtgcctcccgaagctccgtgag

SEQ ID NO: 351312 - DNA, 25 bp, Mus musculus
cagcaggtgaggctgagtcttctcc

SEQ ID NO: 351313 - DNA, 25 bp, Mus musculus
catggcctgggccaggctctgctga

SEQ ID NO: 351314 - DNA, 25 bp, Mus musculus
cccgcgccatacaggtagagcggtg

SEQ ID NO: 351315 - DNA, 25 bp, Mus musculus
cccttggtgagctgcagagagaagg

SEQ ID NO: 351316 - DNA, 25 bp, Mus musculus
tcacccgcgccctctgtagactgcg

SEQ ID NO: 351317 - DNA, 25 bp, Mus musculus
cccgacgacgccgttcaggtagaga

SEQ ID NO: 351318 - DNA, 25 bp, Mus musculus
ccgttcaggtagagaataggcagca

SEQ ID NO: 351319 - DNA, 25 bp, Mus musculus
ctgagtcttctccagggcggcgcgc

SEQ ID NO: 351320 - DNA, 25 bp, Mus musculus
cacctcggtcatggcctgggccagg

SEQ ID NO: 351321 - DNA, 25 bp, Mus musculus
cgagctcccacaccgccgcctgcac

SEQ ID NO: 351322 - DNA, 25 bp, Mus musculus
gacgatcgggcagctctcaacggcc

SEQ ID NO: 351323 - DNA, 25 bp, Mus musculus
tctgctgacactgggcgagcagctc

SEQ ID NO: 351324 - DNA, 25 bp, Mus musculus
aggctctgctgacactgggcgagca

SEQ ID NO: 351325 - DNA, 25 bp, Mus musculus
aagtggtcctgctccttggccagga

SEQ ID NO: 351326 - DNA, 25 bp, Mus musculus
cggtcctatgggctttacctgatgc

SEQ ID NO: 351327 - DNA, 25 bp, Mus musculus
ctttggctatataaggccgtcgtgc

SEQ ID NO: 351328 - DNA, 25 bp, Mus musculus
gagtctccgctgtaatctttggcta

SEQ ID NO: 351329 - DNA, 25 bp, Mus musculus
ctggctggaaatgcaccgcgagtct

SEQ ID NO: 351330 - DNA, 25 bp, Mus musculus
cgggtgcagcttcgcaatcttgagc

SEQ ID NO: 351331 - DNA, 25 bp, Mus musculus
gtcctgagaaccttccggcaccgga

SEQ ID NO: 351332 - DNA, 25 bp, Mus musculus
cgtgattatatgcttctggtcctga

SEQ ID NO: 351333 - DNA, 25 bp, Mus musculus
ttacaatgtcgtctcccgcggaact

SEQ ID NO: 351334 - DNA, 25 bp, Mus musculus
tctggctgagcaagggaaacatgta

SEQ ID NO: 351335 - DNA, 25 bp, Mus musculus
gaggtctagacatttgcacagcatc

SEQ ID NO: 351336 - DNA, 25 bp, Mus musculus
tcgctccgtcgtgaccgtctttatg

SEQ ID NO: 351337 - DNA, 25 bp, Mus musculus
gcgttcgtaaacaaggtatgccaca

SEQ ID NO: 351338 - DNA, 25 bp, Mus musculus
aagccggtagaacgtagcatggtcc

SEQ ID NO: 351339 - DNA, 25 bp, Mus musculus
gctgactgaagtgcgcctgcttaca

SEQ ID NO: 351340 - DNA, 25 bp, Mus musculus
gcccttctcggagctgcgactacaa

SEQ ID NO: 351341 - DNA, 25 bp, Mus musculus
gccatctagcggctccttcacgaaa

SEQ ID NO: 351342 - DNA, 25 bp, Mus musculus
tatgaagagaggcttggcagacgct

SEQ ID NO: 351343 - DNA, 25 bp, Mus musculus
ttgagccctccttctagatcgccat

SEQ ID NO: 351344 - DNA, 25 bp, Mus musculus
gcagacgctgctttgagccctcctt

SEQ ID NO: 351345 - DNA, 25 bp, Mus musculus
ggagctgcgactacaaaaaccactg

SEQ ID NO: 351346 - DNA, 25 bp, Mus musculus
gactacaaaaaccactgtcgccgca

SEQ ID NO: 351347 - DNA, 25 bp, Mus musculus
ttaggagtaaggaagctgcagcagc

SEQ ID NO: 351348 - DNA, 25 bp, Mus musculus
tccgccgccggactttatgaagaga

SEQ ID NO: 351349 - DNA, 25 bp, Mus musculus
gggcgtccttacattttcttagcca

SEQ ID NO: 351350 - DNA, 25 bp, Mus musculus
ttttcttagccacatccgtctcgcg

SEQ ID NO: 351351 - DNA, 25 bp, Mus musculus
tagccacatccgtctcgcggaactg

SEQ ID NO: 351352 - DNA, 25 bp, Mus musculus
gctccttcacgaaaatgcacctagg

SEQ ID NO: 351353 - DNA, 25 bp, Mus musculus
gcggaactgctccttcaccatggtg

SEQ ID NO: 351354 - DNA, 25 bp, Mus musculus
ggtgagtctcctcgggctctcagca

SEQ ID NO: 351355 - DNA, 25 bp, Mus musculus
ccttccttgcgcgttgatatgattg

SEQ ID NO: 351356 - DNA, 25 bp, Mus musculus
cggcgccgtagccatcatggtgagt

SEQ ID NO: 351357 - DNA, 25 bp, Mus musculus
ggctctcagcactatccgtcgctta

SEQ ID NO: 351358 - DNA, 25 bp, Mus musculus
ccactagagctgcagccatccgggg

SEQ ID NO: 351359 - DNA, 25 bp, Mus musculus
caaggtgacgaaggcgcctccggct

SEQ ID NO: 351360 - DNA, 25 bp, Mus musculus
gaccgccaaaaagtggccttgtcca

SEQ ID NO: 351361 - DNA, 25 bp, Mus musculus
agtggccttgtccacttctctgagg

SEQ ID NO: 351362 - DNA, 25 bp, Mus musculus
ggaggactgagccttccgccacgcg

SEQ ID NO: 351363 - DNA, 25 bp, Mus musculus
gcgggctgttctttgactcgtgcat

SEQ ID NO: 351364 - DNA, 25 bp, Mus musculus
tttgactcgtgcatggtgctatcga

SEQ ID NO: 351365 - DNA, 25 bp, Mus musculus
gtgctatcgaggtgacttaatcccg

SEQ ID NO: 351366 - DNA, 25 bp, Mus musculus
ttaatcccgattcctcgagtcgagc

SEQ ID NO: 351367 - DNA, 25 bp, Mus musculus
gcagtgagcggtcctcttttcctcc

SEQ ID NO: 351368 - DNA, 25 bp, Mus musculus
aggcgccttctcttcctcgctgcag

SEQ ID NO: 351369 - DNA, 25 bp, Mus musculus
ggtgcagctgccacactgccagctt

SEQ ID NO: 351370 - DNA, 25 bp, Mus musculus
gcgcggccattgtctgagccagccg

SEQ ID NO: 351371 - DNA, 25 bp, Mus musculus
gccacactgccagcttttctctgtt

SEQ ID NO: 351372 - DNA, 25 bp, Mus musculus
cagccgccgccttggcagcagaagg

SEQ ID NO: 351373 - DNA, 25 bp, Mus musculus
cccactgttcctcttgcggggctgg

SEQ ID NO: 351374 - DNA, 25 bp, Mus musculus
ccttggcagcagaaggtgacatctg

SEQ ID NO: 351375 - DNA, 25 bp, Mus musculus
acatctggtgactaatggccgcggc

SEQ ID NO: 351376 - DNA, 25 bp, Mus musculus
gtgccttgtgtctctcgactcctta

SEQ ID NO: 351377 - DNA, 25 bp, Mus musculus
gtctctcgactccttaacgcgcagg

SEQ ID NO: 351378 - DNA, 25 bp, Mus musculus
taggccctccctgcgggtgccttgt

SEQ ID NO: 351379 - DNA, 25 bp, Mus musculus
gttttttccagctcgctaggccctc

SEQ ID NO: 351380 - DNA, 25 bp, Mus musculus
gcaggacagataccagcgttttttc

SEQ ID NO: 351381 - DNA, 25 bp, Mus musculus
ggacctggaagcaggacagatacca

SEQ ID NO: 351382 - DNA, 25 bp, Mus musculus
aggccggctccacaataaacaatga

SEQ ID NO: 351383 - DNA, 25 bp, Mus musculus
tcccaacctgtgatttggctgccgg

SEQ ID NO: 351384 - DNA, 25 bp, Mus musculus
accggcggatcccaacctgtgattt

SEQ ID NO: 351385 - DNA, 25 bp, Mus musculus
ggtacctcggcatcaccggcggatc

SEQ ID NO: 351386 - DNA, 25 bp, Mus musculus
ttaaagaccgggtacctcggcatca

SEQ ID NO: 351387 - DNA, 25 bp, Mus musculus
cttcccgcccatcatcggggaaccg

SEQ ID NO: 351388 - DNA, 25 bp, Mus musculus
gccgtaattggatcttcgtctcctc

SEQ ID NO: 351389 - DNA, 25 bp, Mus musculus
ccgcctgcccgaggctctctgtccc

SEQ ID NO: 351390 - DNA, 25 bp, Mus musculus
ggagaggccggctccacaataaaca

SEQ ID NO: 351391 - DNA, 25 bp, Mus musculus
caataaacaatgaggcagctgaggc

SEQ ID NO: 351392 - DNA, 25 bp, Mus musculus
cctgtgatttggctgccgggcttcc

SEQ ID NO: 351393 - DNA, 25 bp, Mus musculus
taattggatcttcgtctcctcctcc

SEQ ID NO: 351394 - DNA, 25 bp, Mus musculus
cggcccaggcatcccaggcccgcct

SEQ ID NO: 351395 - DNA, 25 bp, Mus musculus
cggagcagccgtaattggatcttcg

SEQ ID NO: 351396 - DNA, 25 bp, Mus musculus
ggtgcgctctgatcaccacccagga

SEQ ID NO: 351397 - DNA, 25 bp, Mus musculus
ctcgtcaatcaaactgccgccttgg

SEQ ID NO: 351398 - DNA, 25 bp, Mus musculus
ttggcgaggccaagacttcatccgc

SEQ ID NO: 351399 - DNA, 25 bp, Mus musculus
ttgcgctcttcccaacttgcctttg

SEQ ID NO: 351400 - DNA, 25 bp, Mus musculus
cctgcggacctcgtcaatcaaactg

SEQ ID NO: 351401 - DNA, 25 bp, Mus musculus
agtctgcgtggcacgtctgcgctcc

SEQ ID NO: 351402 - DNA, 25 bp, Mus musculus
tcaggactcacgagtctgcgtggca

SEQ ID NO: 351403 - DNA, 25 bp, Mus musculus
cacccaggaggctcaggactcacga

SEQ ID NO: 351404 - DNA, 25 bp, Mus musculus
tgatcaccacccaggaggctcagga

SEQ ID NO: 351405 - DNA, 25 bp, Mus musculus
agcggtgtcattgttctctgacgtc

SEQ ID NO: 351406 - DNA, 25 bp, Mus musculus
tgccgccttggcgaggccaagactt

SEQ ID NO: 351407 - DNA, 25 bp, Mus musculus
caacttgcctttgttattccagctc

SEQ ID NO: 351408 - DNA, 25 bp, Mus musculus
tttgttattccagctcccttcctcg

SEQ ID NO: 351409 - DNA, 25 bp, Mus musculus
cattgttctctgacgtcacgcggcg

SEQ ID NO: 351410 - DNA, 25 bp, Mus musculus
cgcccagcttgtgtagagcggctcc

SEQ ID NO: 351411 - DNA, 25 bp, Mus musculus
tggctgaagcaggacacgttgaaga

SEQ ID NO: 351412 - DNA, 25 bp, Mus musculus
cgttgaagagatgtgtcgaggcttc

SEQ ID NO: 351413 - DNA, 25 bp, Mus musculus
acacacttttgtacatgggagatgg

SEQ ID NO: 351414 - DNA, 25 bp, Mus musculus
gtgttaagttgtgcctccgaatttc

SEQ ID NO: 351415 - DNA, 25 bp, Mus musculus
tcctgtgtgcgtaggagaacctccg

SEQ ID NO: 351416 - DNA, 25 bp, Mus musculus
tgcttctcccttgcctcttttggaa

SEQ ID NO: 351417 - DNA, 25 bp, Mus musculus
tgcgagcgccgtgtactatactagg

SEQ ID NO: 351418 - DNA, 25 bp, Mus musculus
aggcttctcgttcgggcttcggaag

SEQ ID NO: 351419 - DNA, 25 bp, Mus musculus
cgaaggggctttcaggccaacgcct

SEQ ID NO: 351420 - DNA, 25 bp, Mus musculus
cgcgcgcgttgcaaatacgaaagta

SEQ ID NO: 351421 - DNA, 25 bp, Mus musculus
agcttgtttcacattcctggcgtca

SEQ ID NO: 351422 - DNA, 25 bp, Mus musculus
caagcgcccgttaacaccgaggctt

SEQ ID NO: 351423 - DNA, 25 bp, Mus musculus
atgtgaagttgtgctcctgtgtgcg

SEQ ID NO: 351424 - DNA, 25 bp, Mus musculus
tgtgattggcttcgcccgggaagct

SEQ ID NO: 351425 - DNA, 25 bp, Mus musculus
cttccaattaattgccgaggcgggg

SEQ ID NO: 351426 - DNA, 25 bp, Mus musculus
gatgccaagctgctgatctccgtcc

SEQ ID NO: 351427 - DNA, 25 bp, Mus musculus
tttaaacccaagttgccactggatg

SEQ ID NO: 351428 - DNA, 25 bp, Mus musculus
ccgctgcggaccctcattagcatga

SEQ ID NO: 351429 - DNA, 25 bp, Mus musculus
tgacctcttgagaagattcgctggc

SEQ ID NO: 351430 - DNA, 25 bp, Mus musculus
aggagcccactctcacaagtgttgc

SEQ ID NO: 351431 - DNA, 25 bp, Mus musculus
agctccactcgtcgggtcgtgcgtt

SEQ ID NO: 351432 - DNA, 25 bp, Mus musculus
tgtgagctgcctcagatccctagtc

SEQ ID NO: 351433 - DNA, 25 bp, Mus musculus
gtcaccagtccctcgcagtgaagtg

SEQ ID NO: 351434 - DNA, 25 bp, Mus musculus
cccattagtggagcctccgcctgtg

SEQ ID NO: 351435 - DNA, 25 bp, Mus musculus
ctggagacgggcgatgaataattga

SEQ ID NO: 351436 - DNA, 25 bp, Mus musculus
aataattgatgtgtgcggtgcggta

SEQ ID NO: 351437 - DNA, 25 bp, Mus musculus
agacagggccgttcgcctttcatcg

SEQ ID NO: 351438 - DNA, 25 bp, Mus musculus
cctaggtatcgcttcctgggtcgta

SEQ ID NO: 351439 - DNA, 25 bp, Mus musculus
cgatgctagcgctgcgttgcggccc

SEQ ID NO: 351440 - DNA, 25 bp, Mus musculus
gacccgtacctgcagcgacggcgga

SEQ ID NO: 351441 - DNA, 25 bp, Mus musculus
cggggcacaacgcacgagccgatta

SEQ ID NO: 351442 - DNA, 25 bp, Mus musculus
acccgcgacagcgatgctagcgctg

SEQ ID NO: 351443 - DNA, 25 bp, Mus musculus
cttgcctgtgtctgctctgagttct

SEQ ID NO: 351444 - DNA, 25 bp, Mus musculus
tgggtcgtacgaccttgcctgtgtc

SEQ ID NO: 351445 - DNA, 25 bp, Mus musculus
ccgaccaataaaggcggcggcgcgc

SEQ ID NO: 351446 - DNA, 25 bp, Mus musculus
gcgcgcggcctaggtatcgcttcct

SEQ ID NO: 351447 - DNA, 25 bp, Mus musculus
tggtctcgaagccagccgaccaata

SEQ ID NO: 351448 - DNA, 25 bp, Mus musculus
caggggacgctagcgaacaggttcc

SEQ ID NO: 351449 - DNA, 25 bp, Mus musculus
attacgctgccagcggcaaccggca

SEQ ID NO: 351450 - DNA, 25 bp, Mus musculus
aacgcacgagccgattacgctgcca

SEQ ID NO: 351451 - DNA, 25 bp, Mus musculus
gaacccgctcgtgtacttggacgtg

SEQ ID NO: 351452 - DNA, 25 bp, Mus musculus
gggcttcctacaaagctaccactga

SEQ ID NO: 351453 - DNA, 25 bp, Mus musculus
gctatccgagctcagtgtcccggtc

SEQ ID NO: 351454 - DNA, 25 bp, Mus musculus
tcatcctgaggtctagagcggcttt

SEQ ID NO: 351455 - DNA, 25 bp, Mus musculus
accgtgcgcagacactctcgggtta

SEQ ID NO: 351456 - DNA, 25 bp, Mus musculus
ctagagcggctttgctccggaaagc

SEQ ID NO: 351457 - DNA, 25 bp, Mus musculus
gctccggaaagctcggggcttccta

SEQ ID NO: 351458 - DNA, 25 bp, Mus musculus
gcttccgcatgaggggtattcgcgc

SEQ ID NO: 351459 - DNA, 25 bp, Mus musculus
ctctcgggttaggatccaggaaagc

SEQ ID NO: 351460 - DNA, 25 bp, Mus musculus
taggaaggagttgctatccgagctc

SEQ ID NO: 351461 - DNA, 25 bp, Mus musculus
tgaagcgcaaccctcacctgtgggc

SEQ ID NO: 351462 - DNA, 25 bp, Mus musculus
gcgcccggagagttttccgccttgc

SEQ ID NO: 351463 - DNA, 25 bp, Mus musculus
agctgtctttgggaactttgctccg

SEQ ID NO: 351464 - DNA, 25 bp, Mus musculus
ccagcgggccgagaaagctgtcttt

SEQ ID NO: 351465 - DNA, 25 bp, Mus musculus
aggtcttacctcagtgcgcttccgg

SEQ ID NO: 351466 - DNA, 25 bp, Mus musculus
agtcccttgctgaaggcggaccgcg

SEQ ID NO: 351467 - DNA, 25 bp, Mus musculus
gctcccgaggaggtagcacaactca

SEQ ID NO: 351468 - DNA, 25 bp, Mus musculus
gcttggctgaagagttaccggtttg

SEQ ID NO: 351469 - DNA, 25 bp, Mus musculus
tggtggaacttccaatcggcgcagc

SEQ ID NO: 351470 - DNA, 25 bp, Mus musculus
ctaactcggaggcactggtgctgcc

SEQ ID NO: 351471 - DNA, 25 bp, Mus musculus
gcatgtctacaaggcgaggcggaaa

SEQ ID NO: 351472 - DNA, 25 bp, Mus musculus
acgcggcacctacgggcatgtctac

SEQ ID NO: 351473 - DNA, 25 bp, Mus musculus
ttatgatttcaaggcgaagctggcg

SEQ ID NO: 351474 - DNA, 25 bp, Mus musculus
gcgggacgcttggttccttaatgag

SEQ ID NO: 351475 - DNA, 25 bp, Mus musculus
ccttaatgagttcgagaaagccgcg

SEQ ID NO: 351476 - DNA, 25 bp, Mus musculus
cacgagccctcttgaactacatttc

SEQ ID NO: 351477 - DNA, 25 bp, Mus musculus
ttcccagaatggctcgcgaccttgg

SEQ ID NO: 351478 - DNA, 25 bp, Mus musculus
agcgcaggcgtacatgccttgtgga

SEQ ID NO: 351479 - DNA, 25 bp, Mus musculus
agtcgcggctgcgtgattaacagcg

SEQ ID NO: 351480 - DNA, 25 bp, Mus musculus
gcctggtgtcatctctggcgtcatc

SEQ ID NO: 351481 - DNA, 25 bp, Mus musculus
cacggttccagacgggaaggacctg

SEQ ID NO: 351482 - DNA, 25 bp, Mus musculus
tgggagcgcctttcgggcaaccacg

SEQ ID NO: 351483 - DNA, 25 bp, Mus musculus
cctccaaggtgggagcgcctttcgg

SEQ ID NO: 351484 - DNA, 25 bp, Mus musculus
ccggcctccaaggtgggagcgcctt

SEQ ID NO: 351485 - DNA, 25 bp, Mus musculus
tgcagcggcgttcgtcgtaccggcc

SEQ ID NO: 351486 - DNA, 25 bp, Mus musculus
ttctgcagcggcgttcgtcgtaccg

SEQ ID NO: 351487 - DNA, 25 bp, Mus musculus
cgtcattctgcagcggcgttcgtcg

SEQ ID NO: 351488 - DNA, 25 bp, Mus musculus
tctgcgtcattctgcagcggcgttc

SEQ ID NO: 351489 - DNA, 25 bp, Mus musculus
ggcgtcatctgcgtcattctgcagc

SEQ ID NO: 351490 - DNA, 25 bp, Mus musculus
tctggcgtcatctgcgtcattctgc

SEQ ID NO: 351491 - DNA, 25 bp, Mus musculus
atctctggcgtcatctgcgtcattc

SEQ ID NO: 351492 - DNA, 25 bp, Mus musculus
gtcatctctggcgtcatctgcgtca

SEQ ID NO: 351493 - DNA, 25 bp, Mus musculus
tccagacgggaaggacctgaccgaa

SEQ ID NO: 351494 - DNA, 25 bp, Mus musculus
agccaccgagtgaagcagtttgtcc

SEQ ID NO: 351495 - DNA, 25 bp, Mus musculus
tttctggcgctagagaacccgcccg

SEQ ID NO: 351496 - DNA, 25 bp, Mus musculus
ctccgggtttctggcgctagagaac

SEQ ID NO: 351497 - DNA, 25 bp, Mus musculus
ccgagccaaaattcctgggcggctc

SEQ ID NO: 351498 - DNA, 25 bp, Mus musculus
tgcagtccgagccaaaattcctggg

SEQ ID NO: 351499 - DNA, 25 bp, Mus musculus
cccgaggaaatgcagtccgagccaa

SEQ ID NO: 351500 - DNA, 25 bp, Mus musculus
cccggcccgaggaaatgcagtccga

SEQ ID NO: 351501 - DNA, 25 bp, Mus musculus
gtccgtagtcgcctcccggggatca

SEQ ID NO: 351502 - DNA, 25 bp, Mus musculus
gaagcagtttgtccgtagtcgcctc

SEQ ID NO: 351503 - DNA, 25 bp, Mus musculus
cccattcgcccgtcccggcacggag

SEQ ID NO: 351504 - DNA, 25 bp, Mus musculus
agcgcctgcatggtacgtagccacc

SEQ ID NO: 351505 - DNA, 25 bp, Mus musculus
atggtacgtagccaccggagccacc

SEQ ID NO: 351506 - DNA, 25 bp, Mus musculus
ccggagccaccgagtgaagcagttt

SEQ ID NO: 351507 - DNA, 25 bp, Mus musculus
accgtgccctgcaagaaggcgcagc

SEQ ID NO: 351508 - DNA, 25 bp, Mus musculus
caccagacccggaaggttttggctg

SEQ ID NO: 351509 - DNA, 25 bp, Mus musculus
gagcggtttcctgtgcaccagaccc

SEQ ID NO: 351510 - DNA, 25 bp, Mus musculus
ttgcatccagtgcaaggtggcccgg

SEQ ID NO: 351511 - DNA, 25 bp, Mus musculus
ggccagaatcgcttccagcccaggt

SEQ ID NO: 351512 - DNA, 25 bp, Mus musculus
tccagcccaggtccacacagggaaa

SEQ ID NO: 351513 - DNA, 25 bp, Mus musculus
ccaggcttagccctgactagccagt

SEQ ID NO: 351514 - DNA, 25 bp, Mus musculus
aacactgagtcgcagggccagaatc

SEQ ID NO: 351515 - DNA, 25 bp, Mus musculus
tctcgagagacctaaacactgagtc

SEQ ID NO: 351516 - DNA, 25 bp, Mus musculus
cggatggtcacttgcatccagtgca

SEQ ID NO: 351517 - DNA, 25 bp, Mus musculus
ccctctggaagtagccggcgcctgt

SEQ ID NO: 351518 - DNA, 25 bp, Mus musculus
gctttaccgtgtagtagccgaagga

SEQ ID NO: 351519 - DNA, 25 bp, Mus musculus
tgactgtgaaccagaacaagctgcc

SEQ ID NO: 351520 - DNA, 25 bp, Mus musculus
ctgcagcgatcccaccggatggtca

SEQ ID NO: 351521 - DNA, 25 bp, Mus musculus
ccacacagggaaagcctggcgaacc

SEQ ID NO: 351522 - DNA, 25 bp, Mus musculus
cggggatgtcagtgctccgcagccg

SEQ ID NO: 351523 - DNA, 25 bp, Mus musculus
gcagccggggatgtcagtgctccgc

SEQ ID NO: 351524 - DNA, 25 bp, Mus musculus
gccggggatgtcagtgctccgcagc

SEQ ID NO: 351525 - DNA, 25 bp, Mus musculus
cagccggggatgtcagtgctccgca

SEQ ID NO: 351526 - DNA, 25 bp, Mus musculus
agccggggatgtcagtgctccgcag

SEQ ID NO: 351527 - DNA, 25 bp, Mus musculus
tccgcagccggggatgtcagtgctc

SEQ ID NO: 351528 - DNA, 25 bp, Mus musculus
ccgcagccggggatgtcagtgctcc

SEQ ID NO: 351529 - DNA, 25 bp, Mus musculus
atgtcagtgctctgcagccggggat

SEQ ID NO: 351530 - DNA, 25 bp, Mus musculus
cagtgctctgcagccggggatgtca

SEQ ID NO: 351531 - DNA, 25 bp, Mus musculus
tctgcagccggggatgtcagtgctc

SEQ ID NO: 351532 - DNA, 25 bp, Mus musculus
ctgcagccggggatgtcagtgctcc

SEQ ID NO: 351533 - DNA, 25 bp, Mus musculus
cggggatgtcagtgctccgcagcca

SEQ ID NO: 351534 - DNA, 25 bp, Mus musculus
gctccgcagccggggatgtcagtgc

SEQ ID NO: 351535 - DNA, 25 bp, Mus musculus
ccggggatgtcagtgctccgcagcc

SEQ ID NO: 351536 - DNA, 25 bp, Mus musculus
agcgtcctcgcgagggtcgcatcgc

SEQ ID NO: 351537 - DNA, 25 bp, Mus musculus
cacgggaacgcgcacccttttcaag

SEQ ID NO: 351538 - DNA, 25 bp, Mus musculus
ctctgactgaaacctaccgggtgca

SEQ ID NO: 351539 - DNA, 25 bp, Mus musculus
tggccgccatagtgactctgactga

SEQ ID NO: 351540 - DNA, 25 bp, Mus musculus
taccttgccagcgttggccgccata

SEQ ID NO: 351541 - DNA, 25 bp, Mus musculus
gcctcagcttaccttgccagcgttg

SEQ ID NO: 351542 - DNA, 25 bp, Mus musculus
acaaacggcagtcagggaccggcgc

SEQ ID NO: 351543 - DNA, 25 bp, Mus musculus
ctcgggctctgctgctcagcacatg

SEQ ID NO: 351544 - DNA, 25 bp, Mus musculus
aagttggtttctcggagctctcggg

SEQ ID NO: 351545 - DNA, 25 bp, Mus musculus
actcgcgcagccaggaaggtccttc

SEQ ID NO: 351546 - DNA, 25 bp, Mus musculus
actgcagcatgaagagggttgactc

SEQ ID NO: 351547 - DNA, 25 bp, Mus musculus
gcggacgaggcaggaaactttccga

SEQ ID NO: 351548 - DNA, 25 bp, Mus musculus
agccaggacggaacgtcggctcctt

SEQ ID NO: 351549 - DNA, 25 bp, Mus musculus
tccttgctcaggctacgggattccg

SEQ ID NO: 351550 - DNA, 25 bp, Mus musculus
gcagcagagatagccgcggcttgta

SEQ ID NO: 351551 - DNA, 25 bp, Mus musculus
cgagcagcagagatagccgcggctt

SEQ ID NO: 351552 - DNA, 25 bp, Mus musculus
atagccgcggcttgtagggaaacca

SEQ ID NO: 351553 - DNA, 25 bp, Mus musculus
gcggcttgtagggaaaccactgaac

SEQ ID NO: 351554 - DNA, 25 bp, Mus musculus
gctcccagggtcacgtgcctcgtgg

SEQ ID NO: 351555 - DNA, 25 bp, Mus musculus
cagcggaggcggctcaagcgcctag

SEQ ID NO: 351556 - DNA, 25 bp, Mus musculus
ctgggacggcttctcggcctggcta

SEQ ID NO: 351557 - DNA, 25 bp, Mus musculus
ggcttctcggcctggctacactgcg

SEQ ID NO: 351558 - DNA, 25 bp, Mus musculus
cctggctacactgcgtgtgtgtggt

SEQ ID NO: 351559 - DNA, 25 bp, Mus musculus
tgggcttcgacctggagctgggcca

SEQ ID NO: 351560 - DNA, 25 bp, Mus musculus
ctgctcatccgggcgtggctcgcag

SEQ ID NO: 351561 - DNA, 25 bp, Mus musculus
tcagctgggcggtgcttctcgaccc

SEQ ID NO: 351562 - DNA, 25 bp, Mus musculus
ttctcgacccttcggtgggaggatc

SEQ ID NO: 351563 - DNA, 25 bp, Mus musculus
accctgtgtctccacccttgggcgg

SEQ ID NO: 351564 - DNA, 25 bp, Mus musculus
gggttcccaggccagaagatccaaa

SEQ ID NO: 351565 - DNA, 25 bp, Mus musculus
cacttagaacatggaggcgcttgct

SEQ ID NO: 351566 - DNA, 25 bp, Mus musculus
tcgctcgccagaaactccacttaga

SEQ ID NO: 351567 - DNA, 25 bp, Mus musculus
acaaacggcccgaggactcagactc

SEQ ID NO: 351568 - DNA, 25 bp, Mus musculus
tagtcgcagattcgccacaaacggc

SEQ ID NO: 351569 - DNA, 25 bp, Mus musculus
cgctgcctgtccgtagtcgcagatt

SEQ ID NO: 351570 - DNA, 25 bp, Mus musculus
ctcaagctcctcagtagaccggcga

SEQ ID NO: 351571 - DNA, 25 bp, Mus musculus
accgtggcgaaagtgcgtctataca

SEQ ID NO: 351572 - DNA, 25 bp, Mus musculus
tctatacagcgccacgggaccacgt

SEQ ID NO: 351573 - DNA, 25 bp, Mus musculus
cttcctcggagaccaaggccaggtc

SEQ ID NO: 351574 - DNA, 25 bp, Mus musculus
gccagcttcgcttccgagagttcgg

SEQ ID NO: 351575 - DNA, 25 bp, Mus musculus
ccgacaggttggtctcaagctcctc

SEQ ID NO: 351576 - DNA, 25 bp, Mus musculus
cagagatctttttcagaccgacagg

SEQ ID NO: 351577 - DNA, 25 bp, Mus musculus
gccctttaaggtgtccagagatctt

SEQ ID NO: 351578 - DNA, 25 bp, Mus musculus
gcacgtggtcagttgcgaccaatga

SEQ ID NO: 351579 - DNA, 25 bp, Mus musculus
caaagtcaggacttcgccggtcacc

SEQ ID NO: 351580 - DNA, 25 bp, Mus musculus
ggacttcgccggtcaccactaggca

SEQ ID NO: 351581 - DNA, 25 bp, Mus musculus
gcggctccgcactgctcacgaggag

SEQ ID NO: 351582 - DNA, 25 bp, Mus musculus
gcctcccgtgaattcccgactgctg

SEQ ID NO: 351583 - DNA, 25 bp, Mus musculus
gcctcaccggctttctcaggacccg

SEQ ID NO: 351584 - DNA, 25 bp, Mus musculus
tccggttccgtcttcgtctcgttca

SEQ ID NO: 351585 - DNA, 25 bp, Mus musculus
tcttcgtctcgttcaaaccgtcgga

SEQ ID NO: 351586 - DNA, 25 bp, Mus musculus
cccggccttttatagagacggactg

SEQ ID NO: 351587 - DNA, 25 bp, Mus musculus
tttatagagacggactggcctgcga

SEQ ID NO: 351588 - DNA, 25 bp, Mus musculus
ggggccgaatgcttgatcgacagct

SEQ ID NO: 351589 - DNA, 25 bp, Mus musculus
gcttgatcgacagctggcatgcccg

SEQ ID NO: 351590 - DNA, 25 bp, Mus musculus
agcaagcctgttgggcacgtggtca

SEQ ID NO: 351591 - DNA, 25 bp, Mus musculus
acgcgccgacgcaggggctcgtcat

SEQ ID NO: 351592 - DNA, 25 bp, Mus musculus
tgacaaagcgcctcgtccctggact

SEQ ID NO: 351593 - DNA, 25 bp, Mus musculus
ggctcactcacgctccttaagacgg

SEQ ID NO: 351594 - DNA, 25 bp, Mus musculus
cggccgtcaatctccttgtgctcta

SEQ ID NO: 351595 - DNA, 25 bp, Mus musculus
tgtgctctagcagcttcttgcgata

SEQ ID NO: 351596 - DNA, 25 bp, Mus musculus
cttgcgatagtcctgaagcgcctta

SEQ ID NO: 351597 - DNA, 25 bp, Mus musculus
cttatctctagggtccgccatgatg

SEQ ID NO: 351598 - DNA, 25 bp, Mus musculus
tccgccatgatgagaagccgtcgct

SEQ ID NO: 351599 - DNA, 25 bp, Mus musculus
tcagtcacctagagcggcagaaagc

SEQ ID NO: 351600 - DNA, 25 bp, Mus musculus
cctcgaaagcgcagaagatcgtctc

SEQ ID NO: 351601 - DNA, 25 bp, Mus musculus
ccgaagccggtccaggcactagaga

SEQ ID NO: 351602 - DNA, 25 bp, Mus musculus
agcctccgctctatcagagaccgaa

SEQ ID NO: 351603 - DNA, 25 bp, Mus musculus
tgttttcgggctcagccgaagcctc

SEQ ID NO: 351604 - DNA, 25 bp, Mus musculus
gcactagagagtgtgtcaaggctca

SEQ ID NO: 351605 - DNA, 25 bp, Mus musculus
gccttcccaagccaggcgctgtttt

SEQ ID NO: 351606 - DNA, 25 bp, Mus musculus
ctggagacaatcagctgagaaaccc

SEQ ID NO: 351607 - DNA, 25 bp, Mus musculus
gctctggtaactgagccgccgctcg

SEQ ID NO: 351608 - DNA, 25 bp, Mus musculus
ggcccggacactgataccctcatga

SEQ ID NO: 351609 - DNA, 25 bp, Mus musculus
agcaaacaactctcggctggagaca

SEQ ID NO: 351610 - DNA, 25 bp, Mus musculus
tgagaaacccgagcttttgaggcgc

SEQ ID NO: 351611 - DNA, 25 bp, Mus musculus
tcggaataccacaggcctcagagcc

SEQ ID NO: 351612 - DNA, 25 bp, Mus musculus
gagcctgtcactccagaagcctttg

SEQ ID NO: 351613 - DNA, 25 bp, Mus musculus
gatctgattggccttctgctttctc

SEQ ID NO: 351614 - DNA, 25 bp, Mus musculus
ttggcccagcaactgcaagacttcc

SEQ ID NO: 351615 - DNA, 25 bp, Mus musculus
gcgggaggactccagattctgtcac

SEQ ID NO: 351616 - DNA, 25 bp, Mus musculus
cgtccattggttggaggatctctta

SEQ ID NO: 351617 - DNA, 25 bp, Mus musculus
ctcttacgtaaggagcacgaggagc

SEQ ID NO: 351618 - DNA, 25 bp, Mus musculus
gctgcccacgcgagacacaggaaga

SEQ ID NO: 351619 - DNA, 25 bp, Mus musculus
gggcgcctcactcggaataccacag

SEQ ID NO: 351620 - DNA, 25 bp, Mus musculus
ccgcccgtccgcgagcgcgcagacg

SEQ ID NO: 351621 - DNA, 25 bp, Mus musculus
cgagtggtcaagagtactctccggg

SEQ ID NO: 351622 - DNA, 25 bp, Mus musculus
agtactctccgggttggctcctccg

SEQ ID NO: 351623 - DNA, 25 bp, Mus musculus
tctccgggttggctcctccgatagg

SEQ ID NO: 351624 - DNA, 25 bp, Mus musculus
gttggctcctccgatagggtcccgc

SEQ ID NO: 351625 - DNA, 25 bp, Mus musculus
gctcctccgatagggtcccgcggga

SEQ ID NO: 351626 - DNA, 25 bp, Mus musculus
aagagtctgggacagttgggccaga

SEQ ID NO: 351627 - DNA, 25 bp, Mus musculus
ccgaggcgagtggtcaagagtactc

SEQ ID NO: 351628 - DNA, 25 bp, Mus musculus
ccagaggcgctgcttggccggagac

SEQ ID NO: 351629 - DNA, 25 bp, Mus musculus
tccgacccaggcacgagcccataac

SEQ ID NO: 351630 - DNA, 25 bp, Mus musculus
ggcacgagcccataaccgtctcctc

SEQ ID NO: 351631 - DNA, 25 bp, Mus musculus
gcggcccagccaatcccagcccacg

SEQ ID NO: 351632 - DNA, 25 bp, Mus musculus
cgggaggaggacctcactgacgccc

SEQ ID NO: 351633 - DNA, 25 bp, Mus musculus
tcaagagtactctccgggttggctc

SEQ ID NO: 351634 - DNA, 25 bp, Mus musculus
tttcacgtcctccatggtcccaggg

SEQ ID NO: 351635 - DNA, 25 bp, Mus musculus
cctcggcgtcgtctttgcactgcgg

SEQ ID NO: 351636 - DNA, 25 bp, Mus musculus
cgtcgtctttgcactgcgggagcga

SEQ ID NO: 351637 - DNA, 25 bp, Mus musculus
ggagcgaggggaactccagtttcac

SEQ ID NO: 351638 - DNA, 25 bp, Mus musculus
gcgaggggaactccagtttcacgtc

SEQ ID NO: 351639 - DNA, 25 bp, Mus musculus
gggaactccagtttcacgtcctcca

SEQ ID NO: 351640 - DNA, 25 bp, Mus musculus
agtttcacgtcctccatggtcccag

SEQ ID NO: 351641 - DNA, 25 bp, Mus musculus
gcgcggcaggctcacagcaagcact

SEQ ID NO: 351642 - DNA, 25 bp, Mus musculus
gcggaccacaggatccaagcggctg

SEQ ID NO: 351643 - DNA, 25 bp, Mus musculus
acagcaagcactcgcggaccacagg

SEQ ID NO: 351644 - DNA, 25 bp, Mus musculus
aagcactcgcggaccacaggatcca

SEQ ID NO: 351645 - DNA, 25 bp, Mus musculus
actcgcggaccacaggatccaagcg

SEQ ID NO: 351646 - DNA, 25 bp, Mus musculus
caggctcacagcaagcactcgcgga

SEQ ID NO: 351647 - DNA, 25 bp, Mus musculus
aactccagtttcacgtcctccatgg

SEQ ID NO: 351648 - DNA, 25 bp, Mus musculus
agtaaccagtgagcacgtgagcgcg

SEQ ID NO: 351649 - DNA, 25 bp, Mus musculus
tcgggtgaaccgcttggtacacagg

SEQ ID NO: 351650 - DNA, 25 bp, Mus musculus
ccagctcatcagaacgggcgaactt

SEQ ID NO: 351651 - DNA, 25 bp, Mus musculus
cagaacgggcgaacttcttgtcaca

SEQ ID NO: 351652 - DNA, 25 bp, Mus musculus
gaacgggcgaacttcttgtcacagc

SEQ ID NO: 351653 - DNA, 25 bp, Mus musculus
gcaccaggtcgtcgcaggagttccg

SEQ ID NO: 351654 - DNA, 25 bp, Mus musculus
cttcttgtcacagccaggccagtcg

SEQ ID NO: 351655 - DNA, 25 bp, Mus musculus
cacagccaggccagtcgcaggcaaa

SEQ ID NO: 351656 - DNA, 25 bp, Mus musculus
ccagtcgcaggcaaagggccgctca

SEQ ID NO: 351657 - DNA, 25 bp, Mus musculus
agggccgctcacctggacaaggaag

SEQ ID NO: 351658 - DNA, 25 bp, Mus musculus
ctggacaaggaagagtaaccagtga

SEQ ID NO: 351659 - DNA, 25 bp, Mus musculus
ggaagagtaaccagtgagcacgtga

SEQ ID NO: 351660 - DNA, 25 bp, Mus musculus
tcgcttcgggtgaaccgcttggtac

SEQ ID NO: 351661 - DNA, 25 bp, Mus musculus
acgctgcgggcaccaggtcgtcgca

SEQ ID NO: 351662 - DNA, 25 bp, Mus musculus
gcggacacgtaacccaggctcggga

SEQ ID NO: 351663 - DNA, 25 bp, Mus musculus
gctcgggatttcctagtgttgagaa

SEQ ID NO: 351664 - DNA, 25 bp, Mus musculus
gcagccagagcacggcggacacgta

SEQ ID NO: 351665 - DNA, 25 bp, Mus musculus
gaccgcgtctttgcgccggacgagc

SEQ ID NO: 351666 - DNA, 25 bp, Mus musculus
cttgctcgttggactcctgggcgtc

SEQ ID NO: 351667 - DNA, 25 bp, Mus musculus
cggagacagcggcacagcgctgctt

SEQ ID NO: 351668 - DNA, 25 bp, Mus musculus
gcacagcgctgcttctgccaggtga

SEQ ID NO: 351669 - DNA, 25 bp, Mus musculus
gcctggccagcttgtcacactgctt

SEQ ID NO: 351670 - DNA, 25 bp, Mus musculus
tgtcacactgcttccttgcatcctg

SEQ ID NO: 351671 - DNA, 25 bp, Mus musculus
cttggctgctccgtgtccacaggac

SEQ ID NO: 351672 - DNA, 25 bp, Mus musculus
gggttctgaatggacccggcacctg

SEQ ID NO: 351673 - DNA, 25 bp, Mus musculus
cacctgggcacctcgtgcgagcggt

SEQ ID NO: 351674 - DNA, 25 bp, Mus musculus
cgagatgaactccaacatcctttta

SEQ ID NO: 351675 - DNA, 25 bp, Mus musculus
ttaaaaggcttaggcagccagagca

SEQ ID NO: 351676 - DNA, 25 bp, Mus musculus
tcagcccgatggtcctggctgccta

SEQ ID NO: 351677 - DNA, 25 bp, Mus musculus
tctgatcagcccgatggtcctggct

SEQ ID NO: 351678 - DNA, 25 bp, Mus musculus
caagtgtctgatcagcccgatggtc

SEQ ID NO: 351679 - DNA, 25 bp, Mus musculus
cttgctgggcaagtgtctgatcagc

SEQ ID NO: 351680 - DNA, 25 bp, Mus musculus
tgacggtcaccgacttgctgggcaa

SEQ ID NO: 351681 - DNA, 25 bp, Mus musculus
tgtgtggcttgacggtcaccgactt

SEQ ID NO: 351682 - DNA, 25 bp, Mus musculus
cttttatgtgctcgtgtgtggcttg

SEQ ID NO: 351683 - DNA, 25 bp, Mus musculus
gccctcggtcttttatgtgctcgtg

SEQ ID NO: 351684 - DNA, 25 bp, Mus musculus
cgccgccctcggtcttttatgtgct

SEQ ID NO: 351685 - DNA, 25 bp, Mus musculus
ggtcttgccggccagggccactaca

SEQ ID NO: 351686 - DNA, 25 bp, Mus musculus
tgggcaatcttctggcgctggtgct

SEQ ID NO: 351687 - DNA, 25 bp, Mus musculus
ggcttctgggcaatcttctggcgct

SEQ ID NO: 351688 - DNA, 25 bp, Mus musculus
gtgcggggcttctgggcaatcttct

SEQ ID NO: 351689 - DNA, 25 bp, Mus musculus
gacgatgggcgctgtgctcttcggt

SEQ ID NO: 351690 - DNA, 25 bp, Mus musculus
gcttcttctgctccgacggtgcatg

SEQ ID NO: 351691 - DNA, 25 bp, Mus musculus
tcgtggcgtacagctgaaggtatgc

SEQ ID NO: 351692 - DNA, 25 bp, Mus musculus
tgaaggtatgcagtcctcccgtgcc

SEQ ID NO: 351693 - DNA, 25 bp, Mus musculus
cccgtgccggataaagcaccatgtc

SEQ ID NO: 351694 - DNA, 25 bp, Mus musculus
cctgtagaagtaagggtacccgatg

SEQ ID NO: 351695 - DNA, 25 bp, Mus musculus
tacccgatggagaggtagcgttcca

SEQ ID NO: 351696 - DNA, 25 bp, Mus musculus
ttccagggccatagcgaagagcatg

SEQ ID NO: 351697 - DNA, 25 bp, Mus musculus
gcatgagcatcgtggccagactaaa

SEQ ID NO: 351698 - DNA, 25 bp, Mus musculus
accagggtctggtttcttgaatatg

SEQ ID NO: 351699 - DNA, 25 bp, Mus musculus
tgaatatgaagccagcaccaccggg

SEQ ID NO: 351700 - DNA, 25 bp, Mus musculus
gttcccagcaggtcagtgagcacca

SEQ ID NO: 351701 - DNA, 25 bp, Mus musculus
gtgagcaccaattccgttaccagca

SEQ ID NO: 351702 - DNA, 25 bp, Mus musculus
caacagtgccagtgcgatgagattc

SEQ ID NO: 351703 - DNA, 25 bp, Mus musculus
gtacacgcgtgactttcgggagcca

SEQ ID NO: 351704 - DNA, 25 bp, Mus musculus
cgcctcggggatccaggctgcctag

SEQ ID NO: 351705 - DNA, 25 bp, Mus musculus
ggttcagtaacagccgtcgccgcca

SEQ ID NO: 351706 - DNA, 25 bp, Mus musculus
accgccgctgtagcagccgcctctg

SEQ ID NO: 351707 - DNA, 25 bp, Mus musculus
ctcctcttcccatggctgcgccctg

SEQ ID NO: 351708 - DNA, 25 bp, Mus musculus
acagaacgcgggttcgtgtccgctt

SEQ ID NO: 351709 - DNA, 25 bp, Mus musculus
ccctgcttggcagctcgtgggttgt

SEQ ID NO: 351710 - DNA, 25 bp, Mus musculus
ccgctactcagtccgcagggctggg

SEQ ID NO: 351711 - DNA, 25 bp, Mus musculus
ccgcagggctgggatgaagctttct

SEQ ID NO: 351712 - DNA, 25 bp, Mus musculus
atgaagctttctggcgaggagttgc

SEQ ID NO: 351713 - DNA, 25 bp, Mus musculus
cgagttggtgcgtgtcgctctcaat

SEQ ID NO: 351714 - DNA, 25 bp, Mus musculus
tggtgcgtgtcgctctcaattgggc

SEQ ID NO: 351715 - DNA, 25 bp, Mus musculus
cggctgccggggttcagtaacagcc

SEQ ID NO: 351716 - DNA, 25 bp, Mus musculus
gtttcgcctcgggagacagaacgcg

SEQ ID NO: 351717 - DNA, 25 bp, Mus musculus
cggagtttcgcctcgggagacagaa

SEQ ID NO: 351718 - DNA, 25 bp, Mus musculus
ggccaccgaataccagaaggtcctc

SEQ ID NO: 351719 - DNA, 25 bp, Mus musculus
accgaataccagaaggtcctccagc

SEQ ID NO: 351720 - DNA, 25 bp, Mus musculus
gtcagcgcgctcgtctcctccgccg

SEQ ID NO: 351721 - DNA, 25 bp, Mus musculus
ctgcggcctcggctcaccggcagcc

SEQ ID NO: 351722 - DNA, 25 bp, Mus musculus
gctccttggccaccgaataccagaa

SEQ ID NO: 351723 - DNA, 25 bp, Mus musculus
cttggccaccgaataccagaaggtc

SEQ ID NO: 351724 - DNA, 25 bp, Mus musculus
aggccgtcggcgtcgcccgctcctt

SEQ ID NO: 351725 - DNA, 25 bp, Mus musculus
agccatggtcgcaggctccgcgcga

SEQ ID NO: 351726 - DNA, 25 bp, Mus musculus
agccgctcaggatggctgcctccag

SEQ ID NO: 351727 - DNA, 25 bp, Mus musculus
gggctcgcttccagccatggtcgca

SEQ ID NO: 351728 - DNA, 25 bp, Mus musculus
tcgcttccagccatggtcgcaggct

SEQ ID NO: 351729 - DNA, 25 bp, Mus musculus
ccgctggtacgacccgggctggtcg

SEQ ID NO: 351730 - DNA, 25 bp, Mus musculus
aagtggctgccctgccggcccaggc

SEQ ID NO: 351731 - DNA, 25 bp, Mus musculus
cgaggtggcccggaatgactcaccc

SEQ ID NO: 351732 - DNA, 25 bp, Mus musculus
gccgccgcttcattgtgtaccttgt

SEQ ID NO: 351733 - DNA, 25 bp, Mus musculus
aaacccgtcaatatggcggcgatcg

SEQ ID NO: 351734 - DNA, 25 bp, Mus musculus
ccgctctctgaagaacctccgaata

SEQ ID NO: 351735 - DNA, 25 bp, Mus musculus
ctccgaatacgaggtaagcccgctc

SEQ ID NO: 351736 - DNA, 25 bp, Mus musculus
ccggcctgcgatggattctaactgg

SEQ ID NO: 351737 - DNA, 25 bp, Mus musculus
tctaactggggttgtgtgtcttgtc

SEQ ID NO: 351738 - DNA, 25 bp, Mus musculus
tcttgtctcgcacagggcggaatga

SEQ ID NO: 351739 - DNA, 25 bp, Mus musculus
gtcccgctcgatctgacccgaggta

SEQ ID NO: 351740 - DNA, 25 bp, Mus musculus
tgggaagagcgaccacatcctgccc

SEQ ID NO: 351741 - DNA, 25 bp, Mus musculus
ccggcttcttgctcactgcgggact

SEQ ID NO: 351742 - DNA, 25 bp, Mus musculus
cgcagctttttgagaacccggagag

SEQ ID NO: 351743 - DNA, 25 bp, Mus musculus
gagcccgtgatgactgctaagtgtc

SEQ ID NO: 351744 - DNA, 25 bp, Mus musculus
tccggtgttgtgactgaaacccgtc

SEQ ID NO: 351745 - DNA, 25 bp, Mus musculus
ctaagtgtctggttcacgccgcagc

SEQ ID NO: 351746 - DNA, 25 bp, Mus musculus
gccgggtccctagcaaagttgctgt

SEQ ID NO: 351747 - DNA, 25 bp, Mus musculus
cctctccgtgcgatgtggctcggct

SEQ ID NO: 351748 - DNA, 25 bp, Mus musculus
ggaaggcgctgcgactcaccgccag

SEQ ID NO: 351749 - DNA, 25 bp, Mus musculus
tcccgctccctgctagaggagggaa

SEQ ID NO: 351750 - DNA, 25 bp, Mus musculus
ggtttaaagcttgttggtccctgca

SEQ ID NO: 351751 - DNA, 25 bp, Mus musculus
cagcctggggcgtatcggtttaaag

SEQ ID NO: 351752 - DNA, 25 bp, Mus musculus
tctctagccaccagcctggggcgta

SEQ ID NO: 351753 - DNA, 25 bp, Mus musculus
cgacgtccctgacccggggagagca

SEQ ID NO: 351754 - DNA, 25 bp, Mus musculus
agcaaagttgctgtctcctctctag

SEQ ID NO: 351755 - DNA, 25 bp, Mus musculus
ggggagagcatgctccggacattcc

SEQ ID NO: 351756 - DNA, 25 bp, Mus musculus
ctttctctttaaaacgcagcggatt

SEQ ID NO: 351757 - DNA, 25 bp, Mus musculus
agcttttcactgtggactctgcagg

SEQ ID NO: 351758 - DNA, 25 bp, Mus musculus
cagcggatttctgccgcaggttcca

SEQ ID NO: 351759 - DNA, 25 bp, Mus musculus
ccgcgaggttccagacacgagaatc

SEQ ID NO: 351760 - DNA, 25 bp, Mus musculus
tctacagcggacctgcgactgactc

SEQ ID NO: 351761 - DNA, 25 bp, Mus musculus
gaagcgactgcgacatttacctcac

SEQ ID NO: 351762 - DNA, 25 bp, Mus musculus
gcagtaccagagcacttcaagcctg

SEQ ID NO: 351763 - DNA, 25 bp, Mus musculus
cgtaagttcagtccgcagtaccaga

SEQ ID NO: 351764 - DNA, 25 bp, Mus musculus
tcggcgcctgaaagatccgcctttc

SEQ ID NO: 351765 - DNA, 25 bp, Mus musculus
ggcacgctactctcggcgcctgaaa

SEQ ID NO: 351766 - DNA, 25 bp, Mus musculus
gatcagatcgtcctgtgcgaacctc

SEQ ID NO: 351767 - DNA, 25 bp, Mus musculus
gcacagtgtttctgacggcgacgaa

SEQ ID NO: 351768 - DNA, 25 bp, Mus musculus
agagccacccgagctgaggaactga

SEQ ID NO: 351769 - DNA, 25 bp, Mus musculus
aagcctgttctttagcgtcgcatga

SEQ ID NO: 351770 - DNA, 25 bp, Mus musculus
gcagcaacctaaagtccgggcgtga

SEQ ID NO: 351771 - DNA, 25 bp, Mus musculus
cggcgacgaataaaatactactcta

SEQ ID NO: 351772 - DNA, 25 bp, Mus musculus
ggcgcttcctttcggcctgcacagt

SEQ ID NO: 351773 - DNA, 25 bp, Mus musculus
cgcggccgaccaaatcctagtagga

SEQ ID NO: 351774 - DNA, 25 bp, Mus musculus
agcgcgcgtcactggcgacgaaccg

SEQ ID NO: 351775 - DNA, 25 bp, Mus musculus
ccatccgcattgtctgtctcaattc

SEQ ID NO: 351776 - DNA, 25 bp, Mus musculus
ggctccgccgagttcaacgaggctc

SEQ ID NO: 351777 - DNA, 25 bp, Mus musculus
gcggcccgaggctcccaagtttggc

SEQ ID NO: 351778 - DNA, 25 bp, Mus musculus
agtttggcccacaccgggcctacag

SEQ ID NO: 351779 - DNA, 25 bp, Mus musculus
tacctgtcattgagctggtcctcgg

SEQ ID NO: 351780 - DNA, 25 bp, Mus musculus
cccggcagcgggtggaccacgaaat

SEQ ID NO: 351781 - DNA, 25 bp, Mus musculus
gaccacgaaatggatggacgtcatg

SEQ ID NO: 351782 - DNA, 25 bp, Mus musculus
gggaacgagccgctcccgctgtcgt

SEQ ID NO: 351783 - DNA, 25 bp, Mus musculus
cgattgggccgcttaacgttgtcgg

SEQ ID NO: 351784 - DNA, 25 bp, Mus musculus
acgttgtcgggccacggtgctgtaa

SEQ ID NO: 351785 - DNA, 25 bp, Mus musculus
tgctgtaaggtgctcgcctattggc

SEQ ID NO: 351786 - DNA, 25 bp, Mus musculus
atggacgtcatggtaccgcctgcgc

SEQ ID NO: 351787 - DNA, 25 bp, Mus musculus
gactaatatggattcctcgggcctg

SEQ ID NO: 351788 - DNA, 25 bp, Mus musculus
tctaaaccgcgcttccagggagaca

SEQ ID NO: 351789 - DNA, 25 bp, Mus musculus
caagagtaatctataggcagccacc

SEQ ID NO: 351790 - DNA, 25 bp, Mus musculus
ttcctggtgcagacaggggcatctc

SEQ ID NO: 351791 - DNA, 25 bp, Mus musculus
tgtgtgaggcctcagccaatgagct

SEQ ID NO: 351792 - DNA, 25 bp, Mus musculus
ctgagagtcctccttgtctcctgga

SEQ ID NO: 351793 - DNA, 25 bp, Mus musculus
gccctcgatgatattccagcctgca

SEQ ID NO: 351794 - DNA, 25 bp, Mus musculus
cctgggttctcaggcgtggcttatt

SEQ ID NO: 351795 - DNA, 25 bp, Mus musculus
ttatttaggggctcatgcttcgcgc

SEQ ID NO: 351796 - DNA, 25 bp, Mus musculus
aggaccagcatcctcaggtaactta

SEQ ID NO: 351797 - DNA, 25 bp, Mus musculus
gctgcttagttagccacagacggga

SEQ ID NO: 351798 - DNA, 25 bp, Mus musculus
cacagacgggagcactgagacacta

SEQ ID NO: 351799 - DNA, 25 bp, Mus musculus
tgagacactagacgtcgacgccacc

SEQ ID NO: 351800 - DNA, 25 bp, Mus musculus
accaatcagcggcaaaggtgtgtga

SEQ ID NO: 351801 - DNA, 25 bp, Mus musculus
ggcagaccgtgagtagtccttgtca

SEQ ID NO: 351802 - DNA, 25 bp, Mus musculus
ccacgcgccacgcagtttcggggtt

SEQ ID NO: 351803 - DNA, 25 bp, Mus musculus
ggagctcacactgccagctgccggt

SEQ ID NO: 351804 - DNA, 25 bp, Mus musculus
gcaaagtaatccacacacgccacgg

SEQ ID NO: 351805 - DNA, 25 bp, Mus musculus
gcacgtcggcggcaaagtaatccac

SEQ ID NO: 351806 - DNA, 25 bp, Mus musculus
ctcccgaggagatggccatgagcac

SEQ ID NO: 351807 - DNA, 25 bp, Mus musculus
ggtgcgaagacttgtaataggcttt

SEQ ID NO: 351808 - DNA, 25 bp, Mus musculus
atgcaccacggctcccgaggagatg

SEQ ID NO: 351809 - DNA, 25 bp, Mus musculus
cgcctctcagatcggccaggatgct

SEQ ID NO: 351810 - DNA, 25 bp, Mus musculus
aaatacgaggggcttacctgtgtga

SEQ ID NO: 351811 - DNA, 25 bp, Mus musculus
cagtttcggggttccaagtgagatg

SEQ ID NO: 351812 - DNA, 25 bp, Mus musculus
cgagacctctttaatgcactccctg

SEQ ID NO: 351813 - DNA, 25 bp, Mus musculus
ccctgcatcccacctgtgtaaaata

SEQ ID NO: 351814 - DNA, 25 bp, Mus musculus
gccaccgctgatgggcggagctcac

SEQ ID NO: 351815 - DNA, 25 bp, Mus musculus
ctttggcgcagccatggaagggaca

SEQ ID NO: 351816 - DNA, 25 bp, Mus musculus
tccctcggcctcatgacttctggta

SEQ ID NO: 351817 - DNA, 25 bp, Mus musculus
cggggtgacattggccctcccttct

SEQ ID NO: 351818 - DNA, 25 bp, Mus musculus
tggcagcaagctgcgcttcggaaac

SEQ ID NO: 351819 - DNA, 25 bp, Mus musculus
cagatgcccgcagcggctcgaggct

SEQ ID NO: 351820 - DNA, 25 bp, Mus musculus
tggcagctgctcgagccacctgcag

SEQ ID NO: 351821 - DNA, 25 bp, Mus musculus
gcctcatgacttctggtaaaggccc

SEQ ID NO: 351822 - DNA, 25 bp, Mus musculus
gctgcgcttcggaaactgttgactc

SEQ ID NO: 351823 - DNA, 25 bp, Mus musculus
gaaactgttgactcagagggtggcc

SEQ ID NO: 351824 - DNA, 25 bp, Mus musculus
agcgtctgatgtcagcctggagccc

SEQ ID NO: 351825 - DNA, 25 bp, Mus musculus
gactcacgatgcgtcacggagcaga

SEQ ID NO: 351826 - DNA, 25 bp, Mus musculus
atgcgtcacggagcagatgcccgca

SEQ ID NO: 351827 - DNA, 25 bp, Mus musculus
ctgctgactcatcagaaagctgtgc

SEQ ID NO: 351828 - DNA, 25 bp, Mus musculus
tcatcagaaagctgtgcgcggcccg

SEQ ID NO: 351829 - DNA, 25 bp, Mus musculus
agccgcatggctggcagctgctcga

SEQ ID NO: 351830 - DNA, 25 bp, Mus musculus
ccacccgtccctggcgcgccctgag

SEQ ID NO: 351831 - DNA, 25 bp, Mus musculus
tccaaagtgcgagccagatgcagcc

SEQ ID NO: 351832 - DNA, 25 bp, Mus musculus
caggggcaggcacgggagtggtccc

SEQ ID NO: 351833 - DNA, 25 bp, Mus musculus
ggaaggctgcgccaggggcaggcac

SEQ ID NO: 351834 - DNA, 25 bp, Mus musculus
tgcgagccagatgcagcccggccag

SEQ ID NO: 351835 - DNA, 25 bp, Mus musculus
aagtgcgagccagatgcagcccggc

SEQ ID NO: 351836 - DNA, 25 bp, Mus musculus
caaagtgcgagccagatgcagcccg

SEQ ID NO: 351837 - DNA, 25 bp, Mus musculus
aggtcgccgcgaggcaggcaacgcc

SEQ ID NO: 351838 - DNA, 25 bp, Mus musculus
ctccaaagtgcgagccagatgcagc

SEQ ID NO: 351839 - DNA, 25 bp, Mus musculus
agtctcggcggtcacgtctccccat

SEQ ID NO: 351840 - DNA, 25 bp, Mus musculus
ccgaggaacgcgaactgccccaggt

SEQ ID NO: 351841 - DNA, 25 bp, Mus musculus
aatgcacgcggggacgcagagctgg

SEQ ID NO: 351842 - DNA, 25 bp, Mus musculus
cgttcttggagaatgcacgcgggga

SEQ ID NO: 351843 - DNA, 25 bp, Mus musculus
ccggctccaaagtgcgagccagatg

SEQ ID NO: 351844 - DNA, 25 bp, Mus musculus
cgagagggaacagcgaccaccgcca

SEQ ID NO: 351845 - DNA, 25 bp, Mus musculus
ccctaagtccggtactcacgtgaga

SEQ ID NO: 351846 - DNA, 25 bp, Mus musculus
cacgtgagataacggcccaaagagt

SEQ ID NO: 351847 - DNA, 25 bp, Mus musculus
gcggtgccagagacgccagtattta

SEQ ID NO: 351848 - DNA, 25 bp, Mus musculus
ggaaacagcaatgcaccacgggagt

SEQ ID NO: 351849 - DNA, 25 bp, Mus musculus
agcgtcttctctttttcggcggaat

SEQ ID NO: 351850 - DNA, 25 bp, Mus musculus
gatgtggttaccttgagcagaaata

SEQ ID NO: 351851 - DNA, 25 bp, Mus musculus
agcagaaatacccaaggcggcctgg

SEQ ID NO: 351852 - DNA, 25 bp, Mus musculus
ggcaccgacaccagctgagcagcag

SEQ ID NO: 351853 - DNA, 25 bp, Mus musculus
ggattcagcctcgtcactccgcaga

SEQ ID NO: 351854 - DNA, 25 bp, Mus musculus
cactccgcagagcagcagagcgaga

SEQ ID NO: 351855 - DNA, 25 bp, Mus musculus
aagagcagagcaggagacaaccaga

SEQ ID NO: 351856 - DNA, 25 bp, Mus musculus
acaccgcggcgagagttgagccaga

SEQ ID NO: 351857 - DNA, 25 bp, Mus musculus
caaagagtcgggtaaagcgtcttct

SEQ ID NO: 351858 - DNA, 25 bp, Mus musculus
ttctccggaggcctggccgcatcgt

SEQ ID NO: 351859 - DNA, 25 bp, Mus musculus
gcctcctgagacacctcgggtcagt

SEQ ID NO: 351860 - DNA, 25 bp, Mus musculus
cgtgcgccgcggtcagctgactgct

SEQ ID NO: 351861 - DNA, 25 bp, Mus musculus
gtcagctgactgctccggctggcac

SEQ ID NO: 351862 - DNA, 25 bp, Mus musculus
ctccggctggcacgtgacttgctct

SEQ ID NO: 351863 - DNA, 25 bp, Mus musculus
tggcacgtgacttgctctgggcgca

SEQ ID NO: 351864 - DNA, 25 bp, Mus musculus
gagcgctgagcggttaacgtctacc

SEQ ID NO: 351865 - DNA, 25 bp, Mus musculus
gttaacgtctaccaggcttcctgcc

SEQ ID NO: 351866 - DNA, 25 bp, Mus musculus
tcggacctgcaaccggcctgggtgc

SEQ ID NO: 351867 - DNA, 25 bp, Mus musculus
ctagactgtggcgtcggacctgcaa

SEQ ID NO: 351868 - DNA, 25 bp, Mus musculus
cctcgggtcagtgagcgatagccct

SEQ ID NO: 351869 - DNA, 25 bp, Mus musculus
agacacctcgggtcagtgagcgata

SEQ ID NO: 351870 - DNA, 25 bp, Mus musculus
ccgcatcgtgattgcgcgcagtggt

SEQ ID NO: 351871 - DNA, 25 bp, Mus musculus
gaagcccgctctgcgcgctctctca

SEQ ID NO: 351872 - DNA, 25 bp, Mus musculus
acacacagtggcaccgggaacaggg

SEQ ID NO: 351873 - DNA, 25 bp, Mus musculus
cgcacacacagtggcaccgggaaca

SEQ ID NO: 351874 - DNA, 25 bp, Mus musculus
acagggtttcgtgcaggaccgcaca

SEQ ID NO: 351875 - DNA, 25 bp, Mus musculus
tgcaggaccgcacacacagtggcac

SEQ ID NO: 351876 - DNA, 25 bp, Mus musculus
accgcacacacagtggcaccgggaa

SEQ ID NO: 351877 - DNA, 25 bp, Mus musculus
gcaccgggaacagggtttcgtgcag

SEQ ID NO: 351878 - DNA, 25 bp, Mus musculus
tttcgtgcaggaccgcacacacagt

SEQ ID NO: 351879 - DNA, 25 bp, Mus musculus
gtgcaggaccgcacacacagtggca

SEQ ID NO: 351880 - DNA, 25 bp, Mus musculus
cgtgcaggaccgcacacacagtggc

SEQ ID NO: 351881 - DNA, 25 bp, Mus musculus
ggtttcgtgcaggaccgcacacaca

SEQ ID NO: 351882 - DNA, 25 bp, Mus musculus
ggcaccgggaacagggtttcgtgca

SEQ ID NO: 351883 - DNA, 25 bp, Mus musculus
gaacagggtttcgtgcaggaccgca

SEQ ID NO: 351884 - DNA, 25 bp, Mus musculus
cacacagtggcaccgggaacagggt

SEQ ID NO: 351885 - DNA, 25 bp, Mus musculus
gaccgcacacacagtggcaccggga

SEQ ID NO: 351886 - DNA, 25 bp, Mus musculus
gcgcgtggtgactgcaagtagcccc

SEQ ID NO: 351887 - DNA, 25 bp, Mus musculus
gtggtgactgcaagtagccccgcga

SEQ ID NO: 351888 - DNA, 25 bp, Mus musculus
ggtgactgcaagtagccccgcgagt

SEQ ID NO: 351889 - DNA, 25 bp, Mus musculus
tgactgcaagtagccccgcgagtca

SEQ ID NO: 351890 - DNA, 25 bp, Mus musculus
ccgcgagtcacgctccaatatggtc

SEQ ID NO: 351891 - DNA, 25 bp, Mus musculus
cgcgagtcacgctccaatatggtcc

SEQ ID NO: 351892 - DNA, 25 bp, Mus musculus
gcgagtcacgctccaatatggtccg

SEQ ID NO: 351893 - DNA, 25 bp, Mus musculus
cgagtcacgctccaatatggtccgc

SEQ ID NO: 351894 - DNA, 25 bp, Mus musculus
agtcacgctccaatatggtccgccg

SEQ ID NO: 351895 - DNA, 25 bp, Mus musculus
gtcacgctccaatatggtccgccga

SEQ ID NO: 351896 - DNA, 25 bp, Mus musculus
tcacgctccaatatggtccgccgag

SEQ ID NO: 351897 - DNA, 25 bp, Mus musculus
acgctccaatatggtccgccgaggg

SEQ ID NO: 351898 - DNA, 25 bp, Mus musculus
cgctccaatatggtccgccgagggc

SEQ ID NO: 351899 - DNA, 25 bp, Mus musculus
gctccaatatggtccgccgagggcg

SEQ ID NO: 351900 - DNA, 25 bp, Mus musculus
ccatgtcgtggctcttcggcatcaa

SEQ ID NO: 351901 - DNA, 25 bp, Mus musculus
acgggcctggaacgtgcggccaaag

SEQ ID NO: 351902 - DNA, 25 bp, Mus musculus
gagcaacttcgacccgacgggcctg

SEQ ID NO: 351903 - DNA, 25 bp, Mus musculus
atggagcaacttcgacccgacgggc

SEQ ID NO: 351904 - DNA, 25 bp, Mus musculus
ggacaaatggagcaacttcgacccg

SEQ ID NO: 351905 - DNA, 25 bp, Mus musculus
cccaaggacaaatggagcaacttcg

SEQ ID NO: 351906 - DNA, 25 bp, Mus musculus
cgcccaaggacaaatggagcaactt

SEQ ID NO: 351907 - DNA, 25 bp, Mus musculus
ggagaccggccatcgcccaaggaca

SEQ ID NO: 351908 - DNA, 25 bp, Mus musculus
cagaccatgtcgtggctcttcggca

SEQ ID NO: 351909 - DNA, 25 bp, Mus musculus
tgtcgtggctcttcggcatcaaggg

SEQ ID NO: 351910 - DNA, 25 bp, Mus musculus
aagggcgaaggcacagggcctccgc

SEQ ID NO: 351911 - DNA, 25 bp, Mus musculus
gcttgcagaccatgtcgtggctctt

SEQ ID NO: 351912 - DNA, 25 bp, Mus musculus
cggccatcgcccaaggacaaatgga

SEQ ID NO: 351913 - DNA, 25 bp, Mus musculus
tccgctgcccttgccgcccgctcaa

SEQ ID NO: 351914 - DNA, 25 bp, Mus musculus
ccagctatgaatcaactacggggca

SEQ ID NO: 351915 - DNA, 25 bp, Mus musculus
aaactaacgcaggacagggcagagg

SEQ ID NO: 351916 - DNA, 25 bp, Mus musculus
ggggcagcaaagctctcggctcgcc

SEQ ID NO: 351917 - DNA, 25 bp, Mus musculus
ggtcccgtactcacccgcctggcga

SEQ ID NO: 351918 - DNA, 25 bp, Mus musculus
tcaactacggggcaagtgtccaggg

SEQ ID NO: 351919 - DNA, 25 bp, Mus musculus
ccgaggggccaagtactgttgcaat

SEQ ID NO: 351920 - DNA, 25 bp, Mus musculus
ctgttgcaatttcccgtctcgctga

SEQ ID NO: 351921 - DNA, 25 bp, Mus musculus
tttcccgtctcgctgagcacttttg

SEQ ID NO: 351922 - DNA, 25 bp, Mus musculus
agcacttttggcactcctgggaccc

SEQ ID NO: 351923 - DNA, 25 bp, Mus musculus
ttttggcactcctgggacccacagg

SEQ ID NO: 351924 - DNA, 25 bp, Mus musculus
gggacccacaggaatttgctcctgg

SEQ ID NO: 351925 - DNA, 25 bp, Mus musculus
ctcgcccgtcggaaagtggatggag

SEQ ID NO: 351926 - DNA, 25 bp, Mus musculus
tgctcctggtcccaaggggatgtag

SEQ ID NO: 351927 - DNA, 25 bp, Mus musculus
aggaatttgctcctggtcccaaggg

SEQ ID NO: 351928 - DNA, 25 bp, Mus musculus
ctcctggaaagtgactctgggtccc

SEQ ID NO: 351929 - DNA, 25 bp, Mus musculus
aagtgtgctctgcagggcacttccc

SEQ ID NO: 351930 - DNA, 25 bp, Mus musculus
aggtgcgtcgcctcggagtcccacg

SEQ ID NO: 351931 - DNA, 25 bp, Mus musculus
gacgccgagggacagccaccttcct

SEQ ID NO: 351932 - DNA, 25 bp, Mus musculus
cccgcccgacctggcggcgcagtct

SEQ ID NO: 351933 - DNA, 25 bp, Mus musculus
ttccagaacggaaagtgtgctctgc

SEQ ID NO: 351934 - DNA, 25 bp, Mus musculus
tctcacgcctgggtccgcggtgcga

SEQ ID NO: 351935 - DNA, 25 bp, Mus musculus
taaggctcctcgcttccagaacgga

SEQ ID NO: 351936 - DNA, 25 bp, Mus musculus
cggctaaggctcctcgcttccagaa

SEQ ID NO: 351937 - DNA, 25 bp, Mus musculus
cctcgcttccagaacggaaagtgtg

SEQ ID NO: 351938 - DNA, 25 bp, Mus musculus
cagccaccttcctctgccgcccgag

SEQ ID NO: 351939 - DNA, 25 bp, Mus musculus
agtcccacgcaactcctggaaagtg

SEQ ID NO: 351940 - DNA, 25 bp, Mus musculus
cccatgagctgaccgtggaaggttt

SEQ ID NO: 351941 - DNA, 25 bp, Mus musculus
cgcaactcctggaaagtgactctgg

SEQ ID NO: 351942 - DNA, 25 bp, Mus musculus
ctcggtctcttccttgtgctgctgc

SEQ ID NO: 351943 - DNA, 25 bp, Mus musculus
gctgctacagttgtccgcaccgatc

SEQ ID NO: 351944 - DNA, 25 bp, Mus musculus
agctgctgctcggtctcttccttgt

SEQ ID NO: 351945 - DNA, 25 bp, Mus musculus
gcttcgcagccaccgcacaccatgc

SEQ ID NO: 351946 - DNA, 25 bp, Mus musculus
tttacctcctgctccgcgcttcgca

SEQ ID NO: 351947 - DNA, 25 bp, Mus musculus
gccagacgctgagcagggtcaggct

SEQ ID NO: 351948 - DNA, 25 bp, Mus musculus
cagtgaaaggcgcattgatgcggca

SEQ ID NO: 351949 - DNA, 25 bp, Mus musculus
cggcgctcagtgaaaggcgcattga

SEQ ID NO: 351950 - DNA, 25 bp, Mus musculus
agtatgcaagctccgggcgtccagg

SEQ ID NO: 351951 - DNA, 25 bp, Mus musculus
taacagtatgcaagctccgggcgtc

SEQ ID NO: 351952 - DNA, 25 bp, Mus musculus
cccaggcctataacagtatgcaagc

SEQ ID NO: 351953 - DNA, 25 bp, Mus musculus
cgggacccaggcctataacagtatg

SEQ ID NO: 351954 - DNA, 25 bp, Mus musculus
gctagacccgggacccaggcctata

SEQ ID NO: 351955 - DNA, 25 bp, Mus musculus
tgctacagttgtccgcaccgatcag

SEQ ID NO: 351956 - DNA, 25 bp, Mus musculus
aagcggatcttcacgaggtcgagcg

SEQ ID NO: 351957 - DNA, 25 bp, Mus musculus
gtctggccagctttcgagcagtaaa

SEQ ID NO: 351958 - DNA, 25 bp, Mus musculus
ctcccggattctttgggtctggcca

SEQ ID NO: 351959 - DNA, 25 bp, Mus musculus
ccaagctggacatacaaagaggtga

SEQ ID NO: 351960 - DNA, 25 bp, Mus musculus
actatgtccgcgaaaccaagctgga

SEQ ID NO: 351961 - DNA, 25 bp, Mus musculus
tgctgagccgaaaccctgacaacta

SEQ ID NO: 351962 - DNA, 25 bp, Mus musculus
taaaggctcgtggagtccgacaccc

SEQ ID NO: 351963 - DNA, 25 bp, Mus musculus
ctagccggagagactacggaacgcc

SEQ ID NO: 351964 - DNA, 25 bp, Mus musculus
aacctcagagcggagcttgcttagc

SEQ ID NO: 351965 - DNA, 25 bp, Mus musculus
gcaggcaagtcacacccgcggcaaa

SEQ ID NO: 351966 - DNA, 25 bp, Mus musculus
gttcgtcgacactacggcgtccagc

SEQ ID NO: 351967 - DNA, 25 bp, Mus musculus
tgcagcgccaggttggacaagaccc

SEQ ID NO: 351968 - DNA, 25 bp, Mus musculus
caggctcttaccagcgaagcggatc

SEQ ID NO: 351969 - DNA, 25 bp, Mus musculus
agccaccaggttctcgtaccggacg

SEQ ID NO: 351970 - DNA, 25 bp, Mus musculus
gcgctcatacagtgccagcccgtga

SEQ ID NO: 351971 - DNA, 25 bp, Mus musculus
ctctgtgccgtggatgatgagcacc

SEQ ID NO: 351972 - DNA, 25 bp, Mus musculus
agcggctccacagcctttgggcagc

SEQ ID NO: 351973 - DNA, 25 bp, Mus musculus
cgtaggcgctccaggtattgactgt

SEQ ID NO: 351974 - DNA, 25 bp, Mus musculus
agcaccggtgacgtgatcttcgaca

SEQ ID NO: 351975 - DNA, 25 bp, Mus musculus
gatcacctcgtcctctgtgccgtgg

SEQ ID NO: 351976 - DNA, 25 bp, Mus musculus
aagtcgatcacctcgtcctctgtgc

SEQ ID NO: 351977 - DNA, 25 bp, Mus musculus
gccagcccgtgagagaagtcgatca

SEQ ID NO: 351978 - DNA, 25 bp, Mus musculus
acagcctttgggcagcgctcataca

SEQ ID NO: 351979 - DNA, 25 bp, Mus musculus
gcgccctccacccacagcggctcca

SEQ ID NO: 351980 - DNA, 25 bp, Mus musculus
tcaatgtcattgtgcccagcgccct

SEQ ID NO: 351981 - DNA, 25 bp, Mus musculus
ggtattgactgtacagctcaatgtc

SEQ ID NO: 351982 - DNA, 25 bp, Mus musculus
ctccaggtattgactgtacagctca

SEQ ID NO: 351983 - DNA, 25 bp, Mus musculus
tgacgtgatcttcgacaccttctcg

SEQ ID NO: 351984 - DNA, 25 bp, Mus musculus
ctccctgcttccctagggtggttcg

SEQ ID NO: 351985 - DNA, 25 bp, Mus musculus
gcgaaccgctcacttggcagccctt

SEQ ID NO: 351986 - DNA, 25 bp, Mus musculus
aggagaaggagcagtccgtgctcaa

SEQ ID NO: 351987 - DNA, 25 bp, Mus musculus
gtccgtgctcaagtaaggacccggc

SEQ ID NO: 351988 - DNA, 25 bp, Mus musculus
gaggaaaatcatcctggctgtcatg

SEQ ID NO: 351989 - DNA, 25 bp, Mus musculus
cacggaagaggagaggaaaatcatc

SEQ ID NO: 351990 - DNA, 25 bp, Mus musculus
gttcggctccgccaaacatgtcggc

SEQ ID NO: 351991 - DNA, 25 bp, Mus musculus
ctggctgtcatggatcgtcagaaga

SEQ ID NO: 351992 - DNA, 25 bp, Mus musculus
tgccagcggagttgcctccctgctt

SEQ ID NO: 351993 - DNA, 25 bp, Mus musculus
gatttgtatgcatttgtcccagccc

SEQ ID NO: 351994 - DNA, 25 bp, Mus musculus
cggattgaaggccattgatttgtat

SEQ ID NO: 351995 - DNA, 25 bp, Mus musculus
ctgtcgcctcggattgaaggccatt

SEQ ID NO: 351996 - DNA, 25 bp, Mus musculus
tcatggatcgtcagaagaaagaaga

SEQ ID NO: 351997 - DNA, 25 bp, Mus musculus
acctcagccacctcacggaagagga

SEQ ID NO: 351998 - DNA, 25 bp, Mus musculus
ttgacaatgcgacccccgcggatga

SEQ ID NO: 351999 - DNA, 25 bp, Mus musculus
gaagtcgtcattgacaatgcgaccc

SEQ ID NO: 352000 - DNA, 25 bp, Mus musculus
tagcacatcggccacctgtgagaag

SEQ ID NO: 352001 - DNA, 25 bp, Mus musculus
cgcaccacgccgtcctccactagca

SEQ ID NO: 352002 - DNA, 25 bp, Mus musculus
aggaggcagcaggtcccgtcccagc

SEQ ID NO: 352003 - DNA, 25 bp, Mus musculus
agcccccgagatgcgtcctcaggag

SEQ ID NO: 352004 - DNA, 25 bp, Mus musculus
tgcccgctgcatctaggattcgcag

SEQ ID NO: 352005 - DNA, 25 bp, Mus musculus
agcttgcccgctgcatctaggattc

SEQ ID NO: 352006 - DNA, 25 bp, Mus musculus
ggcaggacgagcttgcccgctgcat

SEQ ID NO: 352007 - DNA, 25 bp, Mus musculus
catgaacgggaattgcatgtgcgtg

SEQ ID NO: 352008 - DNA, 25 bp, Mus musculus
cgagcccatgaacgggaattgcatg

SEQ ID NO: 352009 - DNA, 25 bp, Mus musculus
actgcgagcccatgaacgggaattg

SEQ ID NO: 352010 - DNA, 25 bp, Mus musculus
cgtccactgactgcgagcccatgaa

SEQ ID NO: 352011 - DNA, 25 bp, Mus musculus
cggccacctgtgagaagtcgtcatt

SEQ ID NO: 352012 - DNA, 25 bp, Mus musculus
agctcgggcggatttcgccgcgcct

SEQ ID NO: 352013 - DNA, 25 bp, Mus musculus
ccggagatcctctaggctgatgagc

SEQ ID NO: 352014 - DNA, 25 bp, Mus musculus
gggatgtgctctgaccgagctccgc

SEQ ID NO: 352015 - DNA, 25 bp, Mus musculus
atcgatgtgcgagcacgcgaacgcc

SEQ ID NO: 352016 - DNA, 25 bp, Mus musculus
ggcagtgccaatcgatgtgcgagca

SEQ ID NO: 352017 - DNA, 25 bp, Mus musculus
ccggagtagcgaggcagtgccaatc

SEQ ID NO: 352018 - DNA, 25 bp, Mus musculus
ggcgctcatccgtgcactcggcaat

SEQ ID NO: 352019 - DNA, 25 bp, Mus musculus
catacccacggcagatggagggagc

SEQ ID NO: 352020 - DNA, 25 bp, Mus musculus
ggaaaagcaagagccacgccgaccc

SEQ ID NO: 352021 - DNA, 25 bp, Mus musculus
tctaggctgatgagctacgcgtgga

SEQ ID NO: 352022 - DNA, 25 bp, Mus musculus
tcgcccaagcacagcccgtcctgga

SEQ ID NO: 352023 - DNA, 25 bp, Mus musculus
gagactcttttgtgctccagcgacg

SEQ ID NO: 352024 - DNA, 25 bp, Mus musculus
tccatcgctccgaaggatcggcggc

SEQ ID NO: 352025 - DNA, 25 bp, Mus musculus
cccagcgaggaaaagcaagagccac

SEQ ID NO: 352026 - DNA, 25 bp, Mus musculus
cgggttctcggttatttcaactctg

SEQ ID NO: 352027 - DNA, 25 bp, Mus musculus
tggccgatcgctcctagattcccat

SEQ ID NO: 352028 - DNA, 25 bp, Mus musculus
tcaactctggtttgctgcaatcgtc

SEQ ID NO: 352029 - DNA, 25 bp, Mus musculus
gccgcagacagatgcacagccagtt

SEQ ID NO: 352030 - DNA, 25 bp, Mus musculus
ctatcagggaaaaccagacggccgc

SEQ ID NO: 352031 - DNA, 25 bp, Mus musculus
tgtcaaactttgcaagctatcaggg

SEQ ID NO: 352032 - DNA, 25 bp, Mus musculus
ggagatccgctcctagtcctcgaga

SEQ ID NO: 352033 - DNA, 25 bp, Mus musculus
caaacgtaagtttgcgcgcgggact

SEQ ID NO: 352034 - DNA, 25 bp, Mus musculus
tgtcccggcgaaagcagagtaaacc

SEQ ID NO: 352035 - DNA, 25 bp, Mus musculus
gaggagcctagctccgggatcccga

SEQ ID NO: 352036 - DNA, 25 bp, Mus musculus
ttgcttgctcatctccaaacgtgga

SEQ ID NO: 352037 - DNA, 25 bp, Mus musculus
ctgtgagtttgcatccggactggct

SEQ ID NO: 352038 - DNA, 25 bp, Mus musculus
ctggctttggatgcagccaatcctc

SEQ ID NO: 352039 - DNA, 25 bp, Mus musculus
tcctcctttcgctgatggcatagtc

SEQ ID NO: 352040 - DNA, 25 bp, Mus musculus
atggctcttggtagcttccacgcgg

SEQ ID NO: 352041 - DNA, 25 bp, Mus musculus
ccgccgacccgcaagtaagtttgtg

SEQ ID NO: 352042 - DNA, 25 bp, Mus musculus
ctgcgtcaggctgagcgcagtccgc

SEQ ID NO: 352043 - DNA, 25 bp, Mus musculus
ctgagcaagtctgcaagcgctccgc

SEQ ID NO: 352044 - DNA, 25 bp, Mus musculus
tggtagcttccacgcgggcaggtcc

SEQ ID NO: 352045 - DNA, 25 bp, Mus musculus
cccgccgcggatggctcttggtagc

SEQ ID NO: 352046 - DNA, 25 bp, Mus musculus
agctcgtggccgtcgctctgcagct

SEQ ID NO: 352047 - DNA, 25 bp, Mus musculus
agcgggcagccttctgcctccggag

SEQ ID NO: 352048 - DNA, 25 bp, Mus musculus
aagagcgcctggacacccggagagc

SEQ ID NO: 352049 - DNA, 25 bp, Mus musculus
cgcaagtaagtttgtgcggctgctg

SEQ ID NO: 352050 - DNA, 25 bp, Mus musculus
gtggtcgcctccagctcgtggccgt

SEQ ID NO: 352051 - DNA, 25 bp, Mus musculus
ccttccgcaggagctatttttagca

SEQ ID NO: 352052 - DNA, 25 bp, Mus musculus
cagccggtagcttccttccgcagga

SEQ ID NO: 352053 - DNA, 25 bp, Mus musculus
ggtccggaaactgagcaagtctgca

SEQ ID NO: 352054 - DNA, 25 bp, Mus musculus
tcaccggcaagagcggccggctgct

SEQ ID NO: 352055 - DNA, 25 bp, Mus musculus
tgcgcttcgaggactacctgaggga

SEQ ID NO: 352056 - DNA, 25 bp, Mus musculus
gcggcggcatggactacctgaccac

SEQ ID NO: 352057 - DNA, 25 bp, Mus musculus
ggcatggactacctgaccacgttca

SEQ ID NO: 352058 - DNA, 25 bp, Mus musculus
tgaccacgttcaccggcaagagcgg

SEQ ID NO: 352059 - DNA, 25 bp, Mus musculus
gcggcagcgactggcagaacttttt

SEQ ID NO: 352060 - DNA, 25 bp, Mus musculus
tggaaactttgtgcgtccggactcc

SEQ ID NO: 352061 - DNA, 25 bp, Mus musculus
gccctcgccggccagtcccgaggga

SEQ ID NO: 352062 - DNA, 25 bp, Mus musculus
ccccgagccttgcagctgcgtggtg

SEQ ID NO: 352063 - DNA, 25 bp, Mus musculus
ccgactcgtcccgattcagcgtgcg

SEQ ID NO: 352064 - DNA, 25 bp, Mus musculus
agcgactggcagaactttttggaaa

SEQ ID NO: 352065 - DNA, 25 bp, Mus musculus
ctggcagaactttttggaaactttg

SEQ ID NO: 352066 - DNA, 25 bp, Mus musculus
tacctgaccacgttcaccggcaaga

SEQ ID NO: 352067 - DNA, 25 bp, Mus musculus
gcttcgaggactacctgagggagcc

SEQ ID NO: 352068 - DNA, 25 bp, Mus musculus
attcctagtcgaggggcgcgtccac

SEQ ID NO: 352069 - DNA, 25 bp, Mus musculus
gcgcgtccactctcttcttggtgtc

SEQ ID NO: 352070 - DNA, 25 bp, Mus musculus
tccgcctgcgagagcgattcctagt

SEQ ID NO: 352071 - DNA, 25 bp, Mus musculus
gcgctgagatgctgggtctccgcct

SEQ ID NO: 352072 - DNA, 25 bp, Mus musculus
ctggcggcgcctagcaaaagcgcgc

SEQ ID NO: 352073 - DNA, 25 bp, Mus musculus
cagctttaggattccgccggctgca

SEQ ID NO: 352074 - DNA, 25 bp, Mus musculus
cgccgggagctcttggcagctttag

SEQ ID NO: 352075 - DNA, 25 bp, Mus musculus
agtttgcggacacccgccgggagct

SEQ ID NO: 352076 - DNA, 25 bp, Mus musculus
tcagcacgtgggctcggaaaaagtt

SEQ ID NO: 352077 - DNA, 25 bp, Mus musculus
gcggcgctccatgccaggctctgga

SEQ ID NO: 352078 - DNA, 25 bp, Mus musculus
tgtagatcgcctaccgtgcgctcgc

SEQ ID NO: 352079 - DNA, 25 bp, Mus musculus
cccagcaccaggtgtagatcgccta

SEQ ID NO: 352080 - DNA, 25 bp, Mus musculus
tttcaaggggcgctctgaagccttt

SEQ ID NO: 352081 - DNA, 25 bp, Mus musculus
gctctgcagaaggaaaggcgctcta

SEQ ID NO: 352082 - DNA, 25 bp, Mus musculus
ctccgcgcacggcttgcaaagtgca

SEQ ID NO: 352083 - DNA, 25 bp, Mus musculus
cacgcgggctacaccgcgggaaact

SEQ ID NO: 352084 - DNA, 25 bp, Mus musculus
gcagtaattggcgtccgtgtgcctt

SEQ ID NO: 352085 - DNA, 25 bp, Mus musculus
tcggggcgacacgagtttcctcctc

SEQ ID NO: 352086 - DNA, 25 bp, Mus musculus
ttgcaaagtgcaatgacagcggttt

SEQ ID NO: 352087 - DNA, 25 bp, Mus musculus
ctggcctttccggaggctttgcacc

SEQ ID NO: 352088 - DNA, 25 bp, Mus musculus
cgccgctcggtgaccttgcaaggct

SEQ ID NO: 352089 - DNA, 25 bp, Mus musculus
gagtctcggcagaggcacctccctg

SEQ ID NO: 352090 - DNA, 25 bp, Mus musculus
cgttatcgtcgcctggcgctgcggt

SEQ ID NO: 352091 - DNA, 25 bp, Mus musculus
actgctccttcaggactgcagtcct

SEQ ID NO: 352092 - DNA, 25 bp, Mus musculus
ctgcagtcctgtgctgcagggtccg

SEQ ID NO: 352093 - DNA, 25 bp, Mus musculus
tggggcaacgccactcgggctcacg

SEQ ID NO: 352094 - DNA, 25 bp, Mus musculus
gccagccgaggggtcaaccctgcag

SEQ ID NO: 352095 - DNA, 25 bp, Mus musculus
cgtgtgccttttcggggcgacacga

SEQ ID NO: 352096 - DNA, 25 bp, Mus musculus
acagcgctacgatacgcgggaagct

SEQ ID NO: 352097 - DNA, 25 bp, Mus musculus
cccaagcgtgctgatgacaacggca

SEQ ID NO: 352098 - DNA, 25 bp, Mus musculus
cccgcactgcgcatgtgcagtagtg

SEQ ID NO: 352099 - DNA, 25 bp, Mus musculus
actttattgacagctccgagaggcg

SEQ ID NO: 352100 - DNA, 25 bp, Mus musculus
ggagcgcttgttcgctaaaacttta

SEQ ID NO: 352101 - DNA, 25 bp, Mus musculus
agtcaggtcgtactccgccatcttg

SEQ ID NO: 352102 - DNA, 25 bp, Mus musculus
aatgcgcgatgcgagtagtcaggtc

SEQ ID NO: 352103 - DNA, 25 bp, Mus musculus
ccaggtgccgatccagaaaatgcgc

SEQ ID NO: 352104 - DNA, 25 bp, Mus musculus
tcaagaagcggaaagaccaggtgcc

SEQ ID NO: 352105 - DNA, 25 bp, Mus musculus
tccggctcgcacgtgtgtaggccct

SEQ ID NO: 352106 - DNA, 25 bp, Mus musculus
agcctcgggccaggaagcaaagacc

SEQ ID NO: 352107 - DNA, 25 bp, Mus musculus
gcaaaaacagacatggccgcccgca

SEQ ID NO: 352108 - DNA, 25 bp, Mus musculus
cctctttcacagagagaaactcaag

SEQ ID NO: 352109 - DNA, 25 bp, Mus musculus
gccaacgcagcttcaggcaaaaaca

SEQ ID NO: 352110 - DNA, 25 bp, Mus musculus
gattgctggcccgtacaccgatcca

SEQ ID NO: 352111 - DNA, 25 bp, Mus musculus
agatggcgaaggtcactgagcgtta

SEQ ID NO: 352112 - DNA, 25 bp, Mus musculus
ctctgcgcaccggttttgtcatcta

SEQ ID NO: 352113 - DNA, 25 bp, Mus musculus
ggagagattcgtacccggttgtgtc

SEQ ID NO: 352114 - DNA, 25 bp, Mus musculus
gcgtaccagtgtcgcgattgctggc

SEQ ID NO: 352115 - DNA, 25 bp, Mus musculus
cggccacaatctgcggcgtaccagt

SEQ ID NO: 352116 - DNA, 25 bp, Mus musculus
catttgccacttcccggtcgcgggt

SEQ ID NO: 352117 - DNA, 25 bp, Mus musculus
ctgaactgcccgaaccgagtggaca

SEQ ID NO: 352118 - DNA, 25 bp, Mus musculus
ttgtgtcctccgtcgggcagctctc

SEQ ID NO: 352119 - DNA, 25 bp, Mus musculus
ctgagcgttacgatgtgacttggga

SEQ ID NO: 352120 - DNA, 25 bp, Mus musculus
tgcaggaagacccaaagccctggga

SEQ ID NO: 352121 - DNA, 25 bp, Mus musculus
ctccgggttctaggaagatggcgaa

SEQ ID NO: 352122 - DNA, 25 bp, Mus musculus
tggacactggggctggttccttcct

SEQ ID NO: 352123 - DNA, 25 bp, Mus musculus
gtcatctactgtttaggaggcagga

SEQ ID NO: 352124 - DNA, 25 bp, Mus musculus
tacacagcgcacatacatgcaggcg

SEQ ID NO: 352125 - DNA, 25 bp, Mus musculus
ggcagcagagctcgctcaccgacag

SEQ ID NO: 352126 - DNA, 25 bp, Mus musculus
tcaggttcaggtaccagagagtagg

SEQ ID NO: 352127 - DNA, 25 bp, Mus musculus
cccggctcaggttcaggtaccagag

SEQ ID NO: 352128 - DNA, 25 bp, Mus musculus
caggtggatcttccagcgcccgggt

SEQ ID NO: 352129 - DNA, 25 bp, Mus musculus
cacgctccgtcaggtggatcttcca

SEQ ID NO: 352130 - DNA, 25 bp, Mus musculus
ctggccgtactggaagtcagcacgc

SEQ ID NO: 352131 - DNA, 25 bp, Mus musculus
tcgatggtatccagctcgcgctggc

SEQ ID NO: 352132 - DNA, 25 bp, Mus musculus
cttggtcacgaagacctcgatggta

SEQ ID NO: 352133 - DNA, 25 bp, Mus musculus
cacatacatgcaggcgatgcggttg

SEQ ID NO: 352134 - DNA, 25 bp, Mus musculus
accgacaggccgttcatggcgggca

SEQ ID NO: 352135 - DNA, 25 bp, Mus musculus
tggaagtcagcacgctccgtcaggt

SEQ ID NO: 352136 - DNA, 25 bp, Mus musculus
cgcgcgcgctcttggtcacgaagac

SEQ ID NO: 352137 - DNA, 25 bp, Mus musculus
ccagctcgcgctggccgtactggaa

SEQ ID NO: 352138 - DNA, 25 bp, Mus musculus
gctcttgttgaaaggtccgcgcttc

SEQ ID NO: 352139 - DNA, 25 bp, Mus musculus
tcgtcagcgcaagggtcatttcgtc

SEQ ID NO: 352140 - DNA, 25 bp, Mus musculus
gcccgagctactgagggtctaagtc

SEQ ID NO: 352141 - DNA, 25 bp, Mus musculus
cccggaaatgcgtggtctagctttc

SEQ ID NO: 352142 - DNA, 25 bp, Mus musculus
ttctcacattataggcagggtggcc

SEQ ID NO: 352143 - DNA, 25 bp, Mus musculus
ggcccgcgctagttgaattctcaca

SEQ ID NO: 352144 - DNA, 25 bp, Mus musculus
cccaggctcctttcgatgtgctgtc

SEQ ID NO: 352145 - DNA, 25 bp, Mus musculus
gtccgcgcttcactcctggaactga

SEQ ID NO: 352146 - DNA, 25 bp, Mus musculus
cgcagagagcaattggccgcctcca

SEQ ID NO: 352147 - DNA, 25 bp, Mus musculus
cacctgcatcaagctccagctggta

SEQ ID NO: 352148 - DNA, 25 bp, Mus musculus
cgccacgtctcttctgggaagtgta

SEQ ID NO: 352149 - DNA, 25 bp, Mus musculus
gttcgagagacagcttgtagccctc

SEQ ID NO: 352150 - DNA, 25 bp, Mus musculus
tgcgccaatggcagcctcaacaaga

SEQ ID NO: 352151 - DNA, 25 bp, Mus musculus
agaggtcttttcacccgcagagagc

SEQ ID NO: 352152 - DNA, 25 bp, Mus musculus
caccgggcgtgggattgcgtaacca

SEQ ID NO: 352153 - DNA, 25 bp, Mus musculus
cgcccggctttgaatgagcggagct

SEQ ID NO: 352154 - DNA, 25 bp, Mus musculus
ccgagccaccactctggggtactgt

SEQ ID NO: 352155 - DNA, 25 bp, Mus musculus
caccactctggggtactgtttccgg

SEQ ID NO: 352156 - DNA, 25 bp, Mus musculus
actgtttccgggtcagggtgacctg

SEQ ID NO: 352157 - DNA, 25 bp, Mus musculus
cgtggcttggaaccggctcgtccct

SEQ ID NO: 352158 - DNA, 25 bp, Mus musculus
tgggattgcgtaaccagaaagctcg

SEQ ID NO: 352159 - DNA, 25 bp, Mus musculus
ccctcgctatgctgcggtcccgcac

SEQ ID NO: 352160 - DNA, 25 bp, Mus musculus
ccacgttcagtctttcccaagggca

SEQ ID NO: 352161 - DNA, 25 bp, Mus musculus
ttcccaagggcaatgtgccgccttc

SEQ ID NO: 352162 - DNA, 25 bp, Mus musculus
ggggccgatctgcccaacatccaaa

SEQ ID NO: 352163 - DNA, 25 bp, Mus musculus
cggctcccaccttcagcagtttaga

SEQ ID NO: 352164 - DNA, 25 bp, Mus musculus
tcagcagtttagaacgcctcacatg

SEQ ID NO: 352165 - DNA, 25 bp, Mus musculus
agtttagaacgcctcacatgccgcc

SEQ ID NO: 352166 - DNA, 25 bp, Mus musculus
gaacagctgcctagcacctcggagc

SEQ ID NO: 352167 - DNA, 25 bp, Mus musculus
agctgcctagcacctcggagcgcag

SEQ ID NO: 352168 - DNA, 25 bp, Mus musculus
aaggcccgacccactgcgggcaggc

SEQ ID NO: 352169 - DNA, 25 bp, Mus musculus
cttccaaggcccgacccactgcggg

SEQ ID NO: 352170 - DNA, 25 bp, Mus musculus
gtcactcgccacgtcccgctttcag

SEQ ID NO: 352171 - DNA, 25 bp, Mus musculus
cggagcgcagcacccaccaggtcac

SEQ ID NO: 352172 - DNA, 25 bp, Mus musculus
cgccttcacctgcggcccggaacag

SEQ ID NO: 352173 - DNA, 25 bp, Mus musculus
gccaccttccgtggcggctccggag

SEQ ID NO: 352174 - DNA, 25 bp, Mus musculus
gtggtgccaccttccgtggcggctc

SEQ ID NO: 352175 - DNA, 25 bp, Mus musculus
cacgtggtgccaccttccgtggcgg

SEQ ID NO: 352176 - DNA, 25 bp, Mus musculus
cgggcacgtggtgccaccttccgtg

SEQ ID NO: 352177 - DNA, 25 bp, Mus musculus
cccgccagcggtcgcgctcggctcc

SEQ ID NO: 352178 - DNA, 25 bp, Mus musculus
cggaacagctgcctagcacctcgga

SEQ ID NO: 352179 - DNA, 25 bp, Mus musculus
cacccaccaggtcactcgccacgtc

SEQ ID NO: 352180 - DNA, 25 bp, Mus musculus
tcttgacttctggagccagcacggc

SEQ ID NO: 352181 - DNA, 25 bp, Mus musculus
cgccagcccggttagcacacgtggt

SEQ ID NO: 352182 - DNA, 25 bp, Mus musculus
cgacacagcgcgtggcaagcggttt

SEQ ID NO: 352183 - DNA, 25 bp, Mus musculus
atagacgctagcgaccagaggaccg

SEQ ID NO: 352184 - DNA, 25 bp, Mus musculus
ggcgcatagacgctagcgaccagag

SEQ ID NO: 352185 - DNA, 25 bp, Mus musculus
gccggagactctgtacgggtaggtg

SEQ ID NO: 352186 - DNA, 25 bp, Mus musculus
cttcggaacacgtggggacagtcgc

SEQ ID NO: 352187 - DNA, 25 bp, Mus musculus
gacttctggagccagcacggcggca

SEQ ID NO: 352188 - DNA, 25 bp, Mus musculus
cccggttagcacacgtggtgcggca

SEQ ID NO: 352189 - DNA, 25 bp, Mus musculus
ggcctcttgacttctggagccagca

SEQ ID NO: 352190 - DNA, 25 bp, Mus musculus
cggcacctggggcttcggaacacgt

SEQ ID NO: 352191 - DNA, 25 bp, Mus musculus
agcacacgtggtgcggcagctgcca

SEQ ID NO: 352192 - DNA, 25 bp, Mus musculus
ctcggcctcttgacttctggagcca

SEQ ID NO: 352193 - DNA, 25 bp, Mus musculus
cagcccggttagcacacgtggtgcg

SEQ ID NO: 352194 - DNA, 25 bp, Mus musculus
taggaggccaccactacggccagtt

SEQ ID NO: 352195 - DNA, 25 bp, Mus musculus
catcctgaccgccttggcctgaagg

SEQ ID NO: 352196 - DNA, 25 bp, Mus musculus
tgcggggtgacagatccatcctgac

SEQ ID NO: 352197 - DNA, 25 bp, Mus musculus
ctgtccagcgacgacgagtccagta

SEQ ID NO: 352198 - DNA, 25 bp, Mus musculus
ccagtgaggtcagagaaccgctgtc

SEQ ID NO: 352199 - DNA, 25 bp, Mus musculus
ttcgccctcgctacagaagacactg

SEQ ID NO: 352200 - DNA, 25 bp, Mus musculus
ccgcccacgttgactgtaaagcagt

SEQ ID NO: 352201 - DNA, 25 bp, Mus musculus
cagtgcgatagtagtgcaggacata

SEQ ID NO: 352202 - DNA, 25 bp, Mus musculus
acagagcttgctgcgagagcacgaa

SEQ ID NO: 352203 - DNA, 25 bp, Mus musculus
ttcgcatcatcgcaaagctccaggg

SEQ ID NO: 352204 - DNA, 25 bp, Mus musculus
gtactcgttgtccaccggattcgca

SEQ ID NO: 352205 - DNA, 25 bp, Mus musculus
cctgagagctgcgatcaaagaagta

SEQ ID NO: 352206 - DNA, 25 bp, Mus musculus
ggacataacggaacgcctgagagct

SEQ ID NO: 352207 - DNA, 25 bp, Mus musculus
acgaagcggctaccgcccacgttga

SEQ ID NO: 352208 - DNA, 25 bp, Mus musculus
gttttggctcaacaggtatctcatg

SEQ ID NO: 352209 - DNA, 25 bp, Mus musculus
taaaatacggtaggtgctggcagcc

SEQ ID NO: 352210 - DNA, 25 bp, Mus musculus
tgctggcagccagagctgaaattgc

SEQ ID NO: 352211 - DNA, 25 bp, Mus musculus
ctgaaattgcaagcggcccagctct

SEQ ID NO: 352212 - DNA, 25 bp, Mus musculus
ctctgcgtttctctggctgacgtgc

SEQ ID NO: 352213 - DNA, 25 bp, Mus musculus
ctgacgtgctctgccgctttggcaa

SEQ ID NO: 352214 - DNA, 25 bp, Mus musculus
cgctttggcaactcactccttctaa

SEQ ID NO: 352215 - DNA, 25 bp, Mus musculus
atgaaaattcgcacttaaccctcgg

SEQ ID NO: 352216 - DNA, 25 bp, Mus musculus
aaccctcggtcatcttcttgaagga

SEQ ID NO: 352217 - DNA, 25 bp, Mus musculus
tcttgaaggagacacttctacgttt

SEQ ID NO: 352218 - DNA, 25 bp, Mus musculus
acgtttcttccctcagccggggctg

SEQ ID NO: 352219 - DNA, 25 bp, Mus musculus
cggcgcattttcttcgtaaaatacg

SEQ ID NO: 352220 - DNA, 25 bp, Mus musculus
caggaaaactaagcccagacgtgtc

SEQ ID NO: 352221 - DNA, 25 bp, Mus musculus
cccactccgagtggcaggaaaacta

SEQ ID NO: 352222 - DNA, 25 bp, Mus musculus
ggtttgcacagcgatcgcaggtgaa

SEQ ID NO: 352223 - DNA, 25 bp, Mus musculus
cactgttgataaacccatcttgggg

SEQ ID NO: 352224 - DNA, 25 bp, Mus musculus
tctccaccgtggcaactcttgcggt

SEQ ID NO: 352225 - DNA, 25 bp, Mus musculus
ggttctacagccctgagccgctgca

SEQ ID NO: 352226 - DNA, 25 bp, Mus musculus
aggcctgacccggttctacagccct

SEQ ID NO: 352227 - DNA, 25 bp, Mus musculus
ccctgcacgcgcgagcgcctgggct

SEQ ID NO: 352228 - DNA, 25 bp, Mus musculus
atcgcaggtgaagaacacggtttta

SEQ ID NO: 352229 - DNA, 25 bp, Mus musculus
ggaggaaatccgagcgccccgtcat

SEQ ID NO: 352230 - DNA, 25 bp, Mus musculus
agatgagtcactgttgataaaccca

SEQ ID NO: 352231 - DNA, 25 bp, Mus musculus
cgtggcaactcttgcggtttgcaca

SEQ ID NO: 352232 - DNA, 25 bp, Mus musculus
cacagcgatcgcaggtgaagaacac

SEQ ID NO: 352233 - DNA, 25 bp, Mus musculus
aacacggttttaagatgagtcactg

SEQ ID NO: 352234 - DNA, 25 bp, Mus musculus
cggttttaagatgagtcactgttga

SEQ ID NO: 352235 - DNA, 25 bp, Mus musculus
aggccagtgccgaacggggaggcct

SEQ ID NO: 352236 - DNA, 25 bp, Mus musculus
gaaggctgcggtgtctttcgagcaa

SEQ ID NO: 352237 - DNA, 25 bp, Mus musculus
tctcgtcggaaaacagggaaggctg

SEQ ID NO: 352238 - DNA, 25 bp, Mus musculus
cagggatcagcctcacacgtgggcc

SEQ ID NO: 352239 - DNA, 25 bp, Mus musculus
tcacacgtgggcctgtggccgcaac

SEQ ID NO: 352240 - DNA, 25 bp, Mus musculus
atctgcacctgcttcacggccgaat

SEQ ID NO: 352241 - DNA, 25 bp, Mus musculus
tgcttcacggccgaatctccggagc

SEQ ID NO: 352242 - DNA, 25 bp, Mus musculus
ttccttgcgcgacgccatgtttcca

SEQ ID NO: 352243 - DNA, 25 bp, Mus musculus
acgccatgtttccagccagacagga

SEQ ID NO: 352244 - DNA, 25 bp, Mus musculus
cgccggaagcggaactacgaggctc

SEQ ID NO: 352245 - DNA, 25 bp, Mus musculus
tacgaggctccgtgacgctatgtta

SEQ ID NO: 352246 - DNA, 25 bp, Mus musculus
tccgtgacgctatgttaaggctttg

SEQ ID NO: 352247 - DNA, 25 bp, Mus musculus
cccaaccctccctgagattgtggga

SEQ ID NO: 352248 - DNA, 25 bp, Mus musculus
gattgtgggaatcctctgcgcacgc

SEQ ID NO: 352249 - DNA, 25 bp, Mus musculus
ctcagcactcaggtctctcgtcgga

SEQ ID NO: 352250 - DNA, 25 bp, Mus musculus
gcgcactgagtgctttacctgattt

SEQ ID NO: 352251 - DNA, 25 bp, Mus musculus
ggtgggaccgacttcgacactcgcc

SEQ ID NO: 352252 - DNA, 25 bp, Mus musculus
caatctagtggaagaacgaggggca

SEQ ID NO: 352253 - DNA, 25 bp, Mus musculus
gctcgacccgcaggagatggaatta

SEQ ID NO: 352254 - DNA, 25 bp, Mus musculus
aaccaggagccactcgggagtccga

SEQ ID NO: 352255 - DNA, 25 bp, Mus musculus
acccagggagctgaaccaggagcca

SEQ ID NO: 352256 - DNA, 25 bp, Mus musculus
tcaccaacggcgtctgcaaagtttc

SEQ ID NO: 352257 - DNA, 25 bp, Mus musculus
ttaaatccatctcaccaacggcgtc

SEQ ID NO: 352258 - DNA, 25 bp, Mus musculus
ctgcaggccaggagcaagaaatgga

SEQ ID NO: 352259 - DNA, 25 bp, Mus musculus
gaggggcagggtctgaatcaattca

SEQ ID NO: 352260 - DNA, 25 bp, Mus musculus
ttacctgattttcgcagagccgttc

SEQ ID NO: 352261 - DNA, 25 bp, Mus musculus
agagcggctgcctgctctgcgaacc

SEQ ID NO: 352262 - DNA, 25 bp, Mus musculus
cgaggctcgtgcctcggctgagctc

SEQ ID NO: 352263 - DNA, 25 bp, Mus musculus
tcgcagagccgttcggagtgacaca

SEQ ID NO: 352264 - DNA, 25 bp, Mus musculus
gtgcatgtgccaacctgcgccaatt

SEQ ID NO: 352265 - DNA, 25 bp, Mus musculus
cccgctaccttatgggagagaccca

SEQ ID NO: 352266 - DNA, 25 bp, Mus musculus
atccttctggatggcactttctgcc

SEQ ID NO: 352267 - DNA, 25 bp, Mus musculus
gcgagccctaccagatccttctgga

SEQ ID NO: 352268 - DNA, 25 bp, Mus musculus
acaatttcggagtccgcgagcccta

SEQ ID NO: 352269 - DNA, 25 bp, Mus musculus
agcatctcggctttttccgcaacaa

SEQ ID NO: 352270 - DNA, 25 bp, Mus musculus
gtccggtggcttaaacaggcatgaa

SEQ ID NO: 352271 - DNA, 25 bp, Mus musculus
ggagtggtcgttcctttgcgaacta

SEQ ID NO: 352272 - DNA, 25 bp, Mus musculus
cgaggctcctctgcacagaaagctc

SEQ ID NO: 352273 - DNA, 25 bp, Mus musculus
tgaagatcaccaggcagaaacacgc

SEQ ID NO: 352274 - DNA, 25 bp, Mus musculus
ctaaagctcgcgctaggaagtggga

SEQ ID NO: 352275 - DNA, 25 bp, Mus musculus
gttctccacggtgccaaccaagtcg

SEQ ID NO: 352276 - DNA, 25 bp, Mus musculus
ttgcgaactacagaatccgagaggc

SEQ ID NO: 352277 - DNA, 25 bp, Mus musculus
agacccagctgtgcaccacgaggtg

SEQ ID NO: 352278 - DNA, 25 bp, Mus musculus
gtccctcaggtgagcagccgccgta

SEQ ID NO: 352279 - DNA, 25 bp, Mus musculus
acagaccgcgtagcctgagagggtt

SEQ ID NO: 352280 - DNA, 25 bp, Mus musculus
cgtgcgcgagtagtcaacgctagta

SEQ ID NO: 352281 - DNA, 25 bp, Mus musculus
acgctagtacgcgtgtgcacagggc

SEQ ID NO: 352282 - DNA, 25 bp, Mus musculus
aggccttatcgggacagaccgcgta

SEQ ID NO: 352283 - DNA, 25 bp, Mus musculus
ttcgccgttccgaatccgccatggg

SEQ ID NO: 352284 - DNA, 25 bp, Mus musculus
acttggataagcgtggcgttcgctc

SEQ ID NO: 352285 - DNA, 25 bp, Mus musculus
gcccggttgctaggacttggataag

SEQ ID NO: 352286 - DNA, 25 bp, Mus musculus
catggaactacgctcccgtggtgcc

SEQ ID NO: 352287 - DNA, 25 bp, Mus musculus
gaaatgtagtcgcatcgcgcaggcc

SEQ ID NO: 352288 - DNA, 25 bp, Mus musculus
cgcgcacggccttaagggaaatgta

SEQ ID NO: 352289 - DNA, 25 bp, Mus musculus
tgtgcacagggcttttcgcccaccg

SEQ ID NO: 352290 - DNA, 25 bp, Mus musculus
ccctatgccgttggtttgcggcgca

SEQ ID NO: 352291 - DNA, 25 bp, Mus musculus
gtggacagggaaagaaggccttatc

SEQ ID NO: 352292 - DNA, 25 bp, Mus musculus
agtgagtccacgatccctgcggcca

SEQ ID NO: 352293 - DNA, 25 bp, Mus musculus
cggagcgtcagagttggcaaatgca

SEQ ID NO: 352294 - DNA, 25 bp, Mus musculus
cgcccaaatcctcggttcaaatcgg

SEQ ID NO: 352295 - DNA, 25 bp, Mus musculus
ccgcgtctttgcagacagccatctt

SEQ ID NO: 352296 - DNA, 25 bp, Mus musculus
ccgagagcgggctcgttcaaacctc

SEQ ID NO: 352297 - DNA, 25 bp, Mus musculus
ctgcggcggaaccattaggaagtca

SEQ ID NO: 352298 - DNA, 25 bp, Mus musculus
tcggcaggatgtttacggtcaaaaa

SEQ ID NO: 352299 - DNA, 25 bp, Mus musculus
aaaaggtacgtgtgcgcctgcgcaa

SEQ ID NO: 352300 - DNA, 25 bp, Mus musculus
cgctgaccacttccttgtctctgga

SEQ ID NO: 352301 - DNA, 25 bp, Mus musculus
ccattaggaagtcagcaggcgcggt

SEQ ID NO: 352302 - DNA, 25 bp, Mus musculus
ggaccagccacctattggccacgga

SEQ ID NO: 352303 - DNA, 25 bp, Mus musculus
gagcaggcgcaaagggttccttgaa

SEQ ID NO: 352304 - DNA, 25 bp, Mus musculus
tccttgaagaggtttgcggagcgtc

SEQ ID NO: 352305 - DNA, 25 bp, Mus musculus
ttggcaaatgcagcgcctgcgcaac

SEQ ID NO: 352306 - DNA, 25 bp, Mus musculus
tggccgggcagtaacagcgtccact

SEQ ID NO: 352307 - DNA, 25 bp, Mus musculus
gtaacagcgtccactgccagggtcc

SEQ ID NO: 352308 - DNA, 25 bp, Mus musculus
ggtcctgcctgttccgttaactgcc

SEQ ID NO: 352309 - DNA, 25 bp, Mus musculus
accacgatgggcttgggtgactaca

SEQ ID NO: 352310 - DNA, 25 bp, Mus musculus
agcgctgcagaaaaggaccacgatg

SEQ ID NO: 352311 - DNA, 25 bp, Mus musculus
tcccggggactctacggagtctctg

SEQ ID NO: 352312 - DNA, 25 bp, Mus musculus
ctctacggagtctctggaagggctg

SEQ ID NO: 352313 - DNA, 25 bp, Mus musculus
atgccttgcggcacctggcgcatcg

SEQ ID NO: 352314 - DNA, 25 bp, Mus musculus
ggcgcatcggcatcgaagtgccaga

SEQ ID NO: 352315 - DNA, 25 bp, Mus musculus
aagtgccagagcacgtccgggcgtc

SEQ ID NO: 352316 - DNA, 25 bp, Mus musculus
tgctggagcacctccgcaggcagct

SEQ ID NO: 352317 - DNA, 25 bp, Mus musculus
ttcgcgctctggagtccgtgacttc

SEQ ID NO: 352318 - DNA, 25 bp, Mus musculus
tcggccttaaaaagctccaacttgc

SEQ ID NO: 352319 - DNA, 25 bp, Mus musculus
agccactgcagacagaggatgtccc

SEQ ID NO: 352320 - DNA, 25 bp, Mus musculus
aactgcggagcccaatcgcgtcagg

SEQ ID NO: 352321 - DNA, 25 bp, Mus musculus
acagagctggtgaaagcgggcctcc

SEQ ID NO: 352322 - DNA, 25 bp, Mus musculus
ccagctgctcaggaacatgcaggtg

SEQ ID NO: 352323 - DNA, 25 bp, Mus musculus
ccatggagatcttccagctgctcag

SEQ ID NO: 352324 - DNA, 25 bp, Mus musculus
ccgcaccatggagatcttccagctg

SEQ ID NO: 352325 - DNA, 25 bp, Mus musculus
aggacatcgtgtaccgcaccatgga

SEQ ID NO: 352326 - DNA, 25 bp, Mus musculus
gagaccgtgcaggacatcgtgtacc

SEQ ID NO: 352327 - DNA, 25 bp, Mus musculus
cgcttttttgaaatcggccgagtgg

SEQ ID NO: 352328 - DNA, 25 bp, Mus musculus
aagtggcgccgcttttttgaaatcg

SEQ ID NO: 352329 - DNA, 25 bp, Mus musculus
ccggtacagcgcttgcatcgcggcg

SEQ ID NO: 352330 - DNA, 25 bp, Mus musculus
tcttccggtacagcgcttgcatcgc

SEQ ID NO: 352331 - DNA, 25 bp, Mus musculus
cgcgaggcgccagtcttccggtaca

SEQ ID NO: 352332 - DNA, 25 bp, Mus musculus
cgcgaggtcaacacggccacgctgt

SEQ ID NO: 352333 - DNA, 25 bp, Mus musculus
aatcgcgtcaggctccgcgaggcgc

SEQ ID NO: 352334 - DNA, 25 bp, Mus musculus
tttctgctgcgggtacacgtagact

SEQ ID NO: 352335 - DNA, 25 bp, Mus musculus
gcaggactccatgcggcacttcttg

SEQ ID NO: 352336 - DNA, 25 bp, Mus musculus
tgctgcgggtacacgtagactttga

SEQ ID NO: 352337 - DNA, 25 bp, Mus musculus
gcgggtacacgtagactttgaagcc

SEQ ID NO: 352338 - DNA, 25 bp, Mus musculus
gactttgaagccgtttttcttgcaa

SEQ ID NO: 352339 - DNA, 25 bp, Mus musculus
ttcttgcaaagggtgaaatcgaagc

SEQ ID NO: 352340 - DNA, 25 bp, Mus musculus
ggtgaaatcgaagcaggactccatg

SEQ ID NO: 352341 - DNA, 25 bp, Mus musculus
tcgaagcaggactccatgcggcact

SEQ ID NO: 352342 - DNA, 25 bp, Mus musculus
ccatgcggcacttcttgcctttgta

SEQ ID NO: 352343 - DNA, 25 bp, Mus musculus
acttcttgcctttgtagatgctcga

SEQ ID NO: 352344 - DNA, 25 bp, Mus musculus
cttgcctttgtagatgctcgagttg

SEQ ID NO: 352345 - DNA, 25 bp, Mus musculus
ctttgtagatgctcgagttggcgtc

SEQ ID NO: 352346 - DNA, 25 bp, Mus musculus
ttcggcgattttctcccctttctgc

SEQ ID NO: 352347 - DNA, 25 bp, Mus musculus
gcggcacttcttgcctttgtagatg

SEQ ID NO: 352348 - DNA, 25 bp, Mus musculus
aaagctcccgatacccaatcaatgg

SEQ ID NO: 352349 - DNA, 25 bp, Mus musculus
gcccggggaaagcaacttcaactca

SEQ ID NO: 352350 - DNA, 25 bp, Mus musculus
atccacactccggtgcagagcacta

SEQ ID NO: 352351 - DNA, 25 bp, Mus musculus
cagagcactacggttccaacaagtc

SEQ ID NO: 352352 - DNA, 25 bp, Mus musculus
cttcagccggctagtgcatcttgca

SEQ ID NO: 352353 - DNA, 25 bp, Mus musculus
tggggcgccgtaacctcacaaatcc

SEQ ID NO: 352354 - DNA, 25 bp, Mus musculus
tcacaaatccctgcatgtctcttta

SEQ ID NO: 352355 - DNA, 25 bp, Mus musculus
ccggtgtttactcctgcgctcacgg

SEQ ID NO: 352356 - DNA, 25 bp, Mus musculus
gccgcgttcggtcgccgaatgttac

SEQ ID NO: 352357 - DNA, 25 bp, Mus musculus
gtcgccgaatgttacccggttctga

SEQ ID NO: 352358 - DNA, 25 bp, Mus musculus
cccggttctgaatgttacacttaca

SEQ ID NO: 352359 - DNA, 25 bp, Mus musculus
ggggcttccgctgcgcccattcata

SEQ ID NO: 352360 - DNA, 25 bp, Mus musculus
cccaatcaatggcaagacgaagtga

SEQ ID NO: 352361 - DNA, 25 bp, Mus musculus
gaagtgactgcctctccgctcggat

SEQ ID NO: 352362 - DNA, 25 bp, Mus musculus
tcgatttcgccaccacagtaggagc

SEQ ID NO: 352363 - DNA, 25 bp, Mus musculus
gcagctcgatttcgccaccacagta

SEQ ID NO: 352364 - DNA, 25 bp, Mus musculus
atttgtcccgtgcagctcgatttcg

SEQ ID NO: 352365 - DNA, 25 bp, Mus musculus
gaagcctcccatttgtcccgtgcag

SEQ ID NO: 352366 - DNA, 25 bp, Mus musculus
agtccgttcttgcacaatctcccaa

SEQ ID NO: 352367 - DNA, 25 bp, Mus musculus
agttgtagtccgttcttgcacaatc

SEQ ID NO: 352368 - DNA, 25 bp, Mus musculus
gcaaagcgaacagccagctcctgct

SEQ ID NO: 352369 - DNA, 25 bp, Mus musculus
gtcacgcaaagcgaacagccagctc

SEQ ID NO: 352370 - DNA, 25 bp, Mus musculus
ctgctgcggtcacgcaaagcgaaca

SEQ ID NO: 352371 - DNA, 25 bp, Mus musculus
aggaccaacctgctgcggtcacgca

SEQ ID NO: 352372 - DNA, 25 bp, Mus musculus
tgctccaggaccaacctgctgcggt

SEQ ID NO: 352373 - DNA, 25 bp, Mus musculus
tattctgcgctcatctgctccagga

SEQ ID NO: 352374 - DNA, 25 bp, Mus musculus
gcctaaatattctgcgctcatctgc

SEQ ID NO: 352375 - DNA, 25 bp, Mus musculus
ccttgctttcgcctaaatattctgc

SEQ ID NO: 352376 - DNA, 25 bp, Mus musculus
ctcacctgtgcccacgtgacggggc

SEQ ID NO: 352377 - DNA, 25 bp, Mus musculus
acatcctaaggacgtactccggagc

SEQ ID NO: 352378 - DNA, 25 bp, Mus musculus
atcctaaggacgtactccggagctt

SEQ ID NO: 352379 - DNA, 25 bp, Mus musculus
cgacatcctaaggacgtactccgga

SEQ ID NO: 352380 - DNA, 25 bp, Mus musculus
ccgacatcctaaggacgtactccgg

SEQ ID NO: 352381 - DNA, 25 bp, Mus musculus
tagcagcggcagcatgtcggccggc

SEQ ID NO: 352382 - DNA, 25 bp, Mus musculus
acgtagcagcggcagcatgtcggcc

SEQ ID NO: 352383 - DNA, 25 bp, Mus musculus
gcctgaaccccacggatcggatcgg

SEQ ID NO: 352384 - DNA, 25 bp, Mus musculus
accctttccgcgagcagcacgcctg

SEQ ID NO: 352385 - DNA, 25 bp, Mus musculus
ggccacaccctttccgcgagcagca

SEQ ID NO: 352386 - DNA, 25 bp, Mus musculus
cagagggcccgtggccacacccttt

SEQ ID NO: 352387 - DNA, 25 bp, Mus musculus
ctaaggacgtactccggagctttcg

SEQ ID NO: 352388 - DNA, 25 bp, Mus musculus
gcgggcctctgtcggcagagggccc

SEQ ID NO: 352389 - DNA, 25 bp, Mus musculus
ttccgcgagcagcacgcctgaaccc

SEQ ID NO: 352390 - DNA, 25 bp, Mus musculus
atcttcctaggtctctgcatctctg

SEQ ID NO: 352391 - DNA, 25 bp, Mus musculus
cgcacgcttaagatgcccccgatta

SEQ ID NO: 352392 - DNA, 25 bp, Mus musculus
agatgcccccgattacttggacctc

SEQ ID NO: 352393 - DNA, 25 bp, Mus musculus
tggactgcctctggtccgtcccggg

SEQ ID NO: 352394 - DNA, 25 bp, Mus musculus
cgggctcaccctgccttggttcgcc

SEQ ID NO: 352395 - DNA, 25 bp, Mus musculus
ccctgataacctgagttcgttttct

SEQ ID NO: 352396 - DNA, 25 bp, Mus musculus
agttcgttttcttgtctcgtcgatc

SEQ ID NO: 352397 - DNA, 25 bp, Mus musculus
tcgtcgatcttcctaggtctctgca

SEQ ID NO: 352398 - DNA, 25 bp, Mus musculus
ctaggtctctgcatctctgcgctgc

SEQ ID NO: 352399 - DNA, 25 bp, Mus musculus
tgcccttctcggtgcccacccaagt

SEQ ID NO: 352400 - DNA, 25 bp, Mus musculus
tggacggctgctcctgctgtccggt

SEQ ID NO: 352401 - DNA, 25 bp, Mus musculus
gctgctcctgctgtccggtgtgcgc

SEQ ID NO: 352402 - DNA, 25 bp, Mus musculus
cccagtatatcaccgacctgcgccc

SEQ ID NO: 352403 - DNA, 25 bp, Mus musculus
tgtctcgtcgatcttcctaggtctc

SEQ ID NO: 352404 - DNA, 25 bp, Mus musculus
gccgaggcccctttgcaggctttgc

SEQ ID NO: 352405 - DNA, 25 bp, Mus musculus
tgactgcgcttgtttgcgctggacc

SEQ ID NO: 352406 - DNA, 25 bp, Mus musculus
actgccggctcctgactgcgcttgt

SEQ ID NO: 352407 - DNA, 25 bp, Mus musculus
acctgggagctaagcccggcactgc

SEQ ID NO: 352408 - DNA, 25 bp, Mus musculus
agccagggcgctgcggacacagcct

SEQ ID NO: 352409 - DNA, 25 bp, Mus musculus
tggaacccggtccagctgagggcac

SEQ ID NO: 352410 - DNA, 25 bp, Mus musculus
accctaccggatcggcgtggcggct

SEQ ID NO: 352411 - DNA, 25 bp, Mus musculus
gtttttccggctgctgccgaggccc

SEQ ID NO: 352412 - DNA, 25 bp, Mus musculus
ctttgccccggctgcatgcacagtg

SEQ ID NO: 352413 - DNA, 25 bp, Mus musculus
catgcacagtgcagccgcccgtgac

SEQ ID NO: 352414 - DNA, 25 bp, Mus musculus
cgcagagaggggttgcctaccctac

SEQ ID NO: 352415 - DNA, 25 bp, Mus musculus
ttgcctaccctaccggatcggcgtg

SEQ ID NO: 352416 - DNA, 25 bp, Mus musculus
gtttgtgagcctggaacccggtcca

SEQ ID NO: 352417 - DNA, 25 bp, Mus musculus
ccggacgtttttccggctgctgccg

SEQ ID NO: 352418 - DNA, 25 bp, Mus musculus
attgcgtgctcttgctcccgacctt

SEQ ID NO: 352419 - DNA, 25 bp, Mus musculus
gaaagcgccgaggtagcctccagca

SEQ ID NO: 352420 - DNA, 25 bp, Mus musculus
agcgccagacgcttttaccaagttg

SEQ ID NO: 352421 - DNA, 25 bp, Mus musculus
agctcagcgcacgttcctgtggatc

SEQ ID NO: 352422 - DNA, 25 bp, Mus musculus
cctgtggatctaccctgctagaaaa

SEQ ID NO: 352423 - DNA, 25 bp, Mus musculus
tcctggcgccctcatgtcttcaagg

SEQ ID NO: 352424 - DNA, 25 bp, Mus musculus
atgtcttcaagggactgccagcgcg

SEQ ID NO: 352425 - DNA, 25 bp, Mus musculus
gtctcgttcggatctccaggcaaga

SEQ ID NO: 352426 - DNA, 25 bp, Mus musculus
caggcaagacctcggcagcatcaga

SEQ ID NO: 352427 - DNA, 25 bp, Mus musculus
ggcggctgctcagacttagtcttct

SEQ ID NO: 352428 - DNA, 25 bp, Mus musculus
gacttagtcttcttggggtccagga

SEQ ID NO: 352429 - DNA, 25 bp, Mus musculus
ttcgggccacttggagttaatgtcc

SEQ ID NO: 352430 - DNA, 25 bp, Mus musculus
tctgtcctgcagaaaaccgggaggg

SEQ ID NO: 352431 - DNA, 25 bp, Mus musculus
acactcggaggaggaaggacagcct

SEQ ID NO: 352432 - DNA, 25 bp, Mus musculus
caggaggtgcacagtcatcggatct

SEQ ID NO: 352433 - DNA, 25 bp, Mus musculus
gtcatcggatctgctgctgtgcttg

SEQ ID NO: 352434 - DNA, 25 bp, Mus musculus
acgtggcctgggcacacctttcctg

SEQ ID NO: 352435 - DNA, 25 bp, Mus musculus
acacctttcctggtgcctgtgcctg

SEQ ID NO: 352436 - DNA, 25 bp, Mus musculus
ccctcacccgaagccagtttgagga

SEQ ID NO: 352437 - DNA, 25 bp, Mus musculus
ccagtttgaggaggcacgagcccac

SEQ ID NO: 352438 - DNA, 25 bp, Mus musculus
actggcctacatccttccatgaaga

SEQ ID NO: 352439 - DNA, 25 bp, Mus musculus
ttccatgaagacaagcaggtgacca

SEQ ID NO: 352440 - DNA, 25 bp, Mus musculus
tgaccagtgctctggccgggcaact

SEQ ID NO: 352441 - DNA, 25 bp, Mus musculus
gcaactcttctccacgcaggagcga

SEQ ID NO: 352442 - DNA, 25 bp, Mus musculus
gcgagctgccatgcaaacccacatg

SEQ ID NO: 352443 - DNA, 25 bp, Mus musculus
aacccacatggaacgggcggtatgt

SEQ ID NO: 352444 - DNA, 25 bp, Mus musculus
ggaggtgtctgctgtctatccactt

SEQ ID NO: 352445 - DNA, 25 bp, Mus musculus
ccagccgcagtgcaggaggtgcaca

SEQ ID NO: 352446 - DNA, 25 bp, Mus musculus
tctgaccggtgacgtcagaggaagt

SEQ ID NO: 352447 - DNA, 25 bp, Mus musculus
atgaagagctcctgcggggctcgcc

SEQ ID NO: 352448 - DNA, 25 bp, Mus musculus
gcggggctcgcctttcaggctgcac

SEQ ID NO: 352449 - DNA, 25 bp, Mus musculus
cgcctttcaggctgcacggggcgct

SEQ ID NO: 352450 - DNA, 25 bp, Mus musculus
tgcacggggcgctgcagcgcattcc

SEQ ID NO: 352451 - DNA, 25 bp, Mus musculus
agcgcattcccggtagcggcccgtg

SEQ ID NO: 352452 - DNA, 25 bp, Mus musculus
ggagcgcctagccacccgtcctccg

SEQ ID NO: 352453 - DNA, 25 bp, Mus musculus
cctgtcacacagatgagccgcgcta

SEQ ID NO: 352454 - DNA, 25 bp, Mus musculus
tcacacagatgagccgcgctacagg

SEQ ID NO: 352455 - DNA, 25 bp, Mus musculus
gagccgcgctacaggagctctaagc

SEQ ID NO: 352456 - DNA, 25 bp, Mus musculus
aggcagaacccggaagtcttgtccg

SEQ ID NO: 352457 - DNA, 25 bp, Mus musculus
ccgcggaggcagaacccggaagtct

SEQ ID NO: 352458 - DNA, 25 bp, Mus musculus
gcgctacaggagctctaagcggccg

SEQ ID NO: 352459 - DNA, 25 bp, Mus musculus
cttgccggtcacctctgaccggtga

SEQ ID NO: 352460 - DNA, 25 bp, Mus musculus
ctcaggcagtgcaccgtgggcagca

SEQ ID NO: 352461 - DNA, 25 bp, Mus musculus
gctcggcggggacatctcgcagcac

SEQ ID NO: 352462 - DNA, 25 bp, Mus musculus
aagtcggaaagtatctggactcgcg

SEQ ID NO: 352463 - DNA, 25 bp, Mus musculus
tgtcccgaggaagtcggaaagtatc

SEQ ID NO: 352464 - DNA, 25 bp, Mus musculus
ccaaatccgcccgagccgacttccg

SEQ ID NO: 352465 - DNA, 25 bp, Mus musculus
cgggacttcaaaagcgcgccaaatc

SEQ ID NO: 352466 - DNA, 25 bp, Mus musculus
tcccgggacttcaaaagcgcgccaa

SEQ ID NO: 352467 - DNA, 25 bp, Mus musculus
gagaggggtgtgtcctcgacctaaa

SEQ ID NO: 352468 - DNA, 25 bp, Mus musculus
gcctccagctgctggcacagtgctg

SEQ ID NO: 352469 - DNA, 25 bp, Mus musculus
tcccggagctgaagctcaggcagtg

SEQ ID NO: 352470 - DNA, 25 bp, Mus musculus
agctcggtggcgttcagcttggcaa

SEQ ID NO: 352471 - DNA, 25 bp, Mus musculus
gttcagcttggcaacctgcagcgtc

SEQ ID NO: 352472 - DNA, 25 bp, Mus musculus
ttggcaacctgcagcgtcgcgtcca

SEQ ID NO: 352473 - DNA, 25 bp, Mus musculus
tggcacagtgctggttccagctcca

SEQ ID NO: 352474 - DNA, 25 bp, Mus musculus
gcactcagtagatgggctctcgatt

SEQ ID NO: 352475 - DNA, 25 bp, Mus musculus
agctggactgctgcagccatgcgtc

SEQ ID NO: 352476 - DNA, 25 bp, Mus musculus
cacacgccatctggctcgtggcagg

SEQ ID NO: 352477 - DNA, 25 bp, Mus musculus
ctccggtaaggaaaggcactcagta

SEQ ID NO: 352478 - DNA, 25 bp, Mus musculus
ctgaagtcctagttacgggagagca

SEQ ID NO: 352479 - DNA, 25 bp, Mus musculus
agagctggaacgcatggctgaagtc

SEQ ID NO: 352480 - DNA, 25 bp, Mus musculus
agtggtagcagcgacagcaacgccg

SEQ ID NO: 352481 - DNA, 25 bp, Mus musculus
caaccgcgcggtcaggaacatggaa

SEQ ID NO: 352482 - DNA, 25 bp, Mus musculus
acagcaaaggcagagtggcaaccgc

SEQ ID NO: 352483 - DNA, 25 bp, Mus musculus
tcggggagggcacattgatccaaac

SEQ ID NO: 352484 - DNA, 25 bp, Mus musculus
agccaatcgcgtctgagccacggca

SEQ ID NO: 352485 - DNA, 25 bp, Mus musculus
agccgaagttccagacccggactcg

SEQ ID NO: 352486 - DNA, 25 bp, Mus musculus
cgaccatgagagagcccaggccacg

SEQ ID NO: 352487 - DNA, 25 bp, Mus musculus
gcccggaggctagcagcttcagcca

SEQ ID NO: 352488 - DNA, 25 bp, Mus musculus
tggatcggtacttgctgctggtcac

SEQ ID NO: 352489 - DNA, 25 bp, Mus musculus
tggagagcaccgacaaacagcccgg

SEQ ID NO: 352490 - DNA, 25 bp, Mus musculus
actgaggcgacatccctggagagca

SEQ ID NO: 352491 - DNA, 25 bp, Mus musculus
acctaacactgagtccgggcgcgaa

SEQ ID NO: 352492 - DNA, 25 bp, Mus musculus
cgcgcggctcttttgagacctaaca

SEQ ID NO: 352493 - DNA, 25 bp, Mus musculus
ttttgcagccaacctgagcggcagg

SEQ ID NO: 352494 - DNA, 25 bp, Mus musculus
ccgacgtaggacattattttgcagc

SEQ ID NO: 352495 - DNA, 25 bp, Mus musculus
ccgccggtagcggtttcgttatgag

SEQ ID NO: 352496 - DNA, 25 bp, Mus musculus
atgaaggttcctactgccgtcgcgt

SEQ ID NO: 352497 - DNA, 25 bp, Mus musculus
cacagacacccgagcatgaaggttc

SEQ ID NO: 352498 - DNA, 25 bp, Mus musculus
agaagctggacatgctctccgaccc

SEQ ID NO: 352499 - DNA, 25 bp, Mus musculus
gcaaactcacctggggcgccctaga

SEQ ID NO: 352500 - DNA, 25 bp, Mus musculus
gccagcgtactgagcacactatcct

SEQ ID NO: 352501 - DNA, 25 bp, Mus musculus
gacccgcggcgtcctttactttgca

SEQ ID NO: 352502 - DNA, 25 bp, Mus musculus
gaggatcaacagtttgttgagctca

SEQ ID NO: 352503 - DNA, 25 bp, Mus musculus
agccctagcgccctgcggtctcacg

SEQ ID NO: 352504 - DNA, 25 bp, Mus musculus
cgccgggtcgtgctcaatagtcaat

SEQ ID NO: 352505 - DNA, 25 bp, Mus musculus
tattgcaccgagagggtttggccgc

SEQ ID NO: 352506 - DNA, 25 bp, Mus musculus
aatgggtattgcaccgagagggttt

SEQ ID NO: 352507 - DNA, 25 bp, Mus musculus
tcataaagaaaatgggtattgcacc

SEQ ID NO: 352508 - DNA, 25 bp, Mus musculus
gtgacaccttgaacttttcataaag

SEQ ID NO: 352509 - DNA, 25 bp, Mus musculus
ccgggtcgtgctcaatagtcaatga

SEQ ID NO: 352510 - DNA, 25 bp, Mus musculus
gttgagctcatcagtgacaccttga

SEQ ID NO: 352511 - DNA, 25 bp, Mus musculus
cgtgctcaatagtcaatgatctcgc

SEQ ID NO: 352512 - DNA, 25 bp, Mus musculus
ccacgtggtgaggatcaacagtttg

SEQ ID NO: 352513 - DNA, 25 bp, Mus musculus
ccactccacgtggtgaggatcaaca

SEQ ID NO: 352514 - DNA, 25 bp, Mus musculus
cggtctcacggtccgccactccacg

SEQ ID NO: 352515 - DNA, 25 bp, Mus musculus
catcagtgacaccttgaacttttca

SEQ ID NO: 352516 - DNA, 25 bp, Mus musculus
tccgctttcgacagggcgttacgta

SEQ ID NO: 352517 - DNA, 25 bp, Mus musculus
ttccattttggaacgcccgtgcctc

SEQ ID NO: 352518 - DNA, 25 bp, Mus musculus
aagcatgacgccgtgttgaggctgc

SEQ ID NO: 352519 - DNA, 25 bp, Mus musculus
cgccgctcccgaaaatgtgttgtta

SEQ ID NO: 352520 - DNA, 25 bp, Mus musculus
aatgtgttgttaatgggacttggcc

SEQ ID NO: 352521 - DNA, 25 bp, Mus musculus
tttggataaatggaagccagaccga

SEQ ID NO: 352522 - DNA, 25 bp, Mus musculus
gtctacgtttccctatgtcgacata

SEQ ID NO: 352523 - DNA, 25 bp, Mus musculus
ggggagccagcagagttccattttg

SEQ ID NO: 352524 - DNA, 25 bp, Mus musculus
gcttcctgccttcttggccaaactg

SEQ ID NO: 352525 - DNA, 25 bp, Mus musculus
ttcttggccaaactgcggcgctttg

SEQ ID NO: 352526 - DNA, 25 bp, Mus musculus
gctttgtgcaaaccgggcaggtccc

SEQ ID NO: 352527 - DNA, 25 bp, Mus musculus
cgtctcggcgctttttggaagcctg

SEQ ID NO: 352528 - DNA, 25 bp, Mus musculus
ctcctggtgacgattcgccgtaatg

SEQ ID NO: 352529 - DNA, 25 bp, Mus musculus
ggcgttacgtagactcgactctgtt

SEQ ID NO: 352530 - DNA, 25 bp, Mus musculus
atggccgggatgctcctgaaccagt

SEQ ID NO: 352531 - DNA, 25 bp, Mus musculus
gacgtggcgccaccgaattcggaca

SEQ ID NO: 352532 - DNA, 25 bp, Mus musculus
tttgcagctcagtaccgggactcga

SEQ ID NO: 352533 - DNA, 25 bp, Mus musculus
ccagtgccgtttttgcagctcagta

SEQ ID NO: 352534 - DNA, 25 bp, Mus musculus
gaccagaagtgtcccggcggcttaa

SEQ ID NO: 352535 - DNA, 25 bp, Mus musculus
aggcagcgatcacaagagaaacttc

SEQ ID NO: 352536 - DNA, 25 bp, Mus musculus
ggcagcaaaccagtagcgcgtgatg

SEQ ID NO: 352537 - DNA, 25 bp, Mus musculus
aattcggacaagctaggcagcgatc

SEQ ID NO: 352538 - DNA, 25 bp, Mus musculus
cgcggtccacgtgaccagaagtgtc

SEQ ID NO: 352539 - DNA, 25 bp, Mus musculus
ctgatgatgccgagcttgccgatca

SEQ ID NO: 352540 - DNA, 25 bp, Mus musculus
cctggaagcgatagaggaaggcttc

SEQ ID NO: 352541 - DNA, 25 bp, Mus musculus
cgccagctactacctggaagcgata

SEQ ID NO: 352542 - DNA, 25 bp, Mus musculus
cttgccgatcaaggggacagcaacg

SEQ ID NO: 352543 - DNA, 25 bp, Mus musculus
cgatgtccgacatggtcgcccgtca

SEQ ID NO: 352544 - DNA, 25 bp, Mus musculus
ccgcgtgattggcacagtccttggg

SEQ ID NO: 352545 - DNA, 25 bp, Mus musculus
cccgtcctgattggttgtaactaga

SEQ ID NO: 352546 - DNA, 25 bp, Mus musculus
ctgattggttgtaactagaaggggc

SEQ ID NO: 352547 - DNA, 25 bp, Mus musculus
tagctctcgggacggttaccctcac

SEQ ID NO: 352548 - DNA, 25 bp, Mus musculus
ctcaccgggtcagccgcggatcgga

SEQ ID NO: 352549 - DNA, 25 bp, Mus musculus
gcaacaaggagagcggcaagatatg

SEQ ID NO: 352550 - DNA, 25 bp, Mus musculus
gtcggggttcgacatgcagagcact

SEQ ID NO: 352551 - DNA, 25 bp, Mus musculus
gcggcaagatatggcaccgcaagcc

SEQ ID NO: 352552 - DNA, 25 bp, Mus musculus
atatggcaccgcaagccatcgccag

SEQ ID NO: 352553 - DNA, 25 bp, Mus musculus
atcgccagccactcacgacgggtga

SEQ ID NO: 352554 - DNA, 25 bp, Mus musculus
tgctggcccggggattctgactctg

SEQ ID NO: 352555 - DNA, 25 bp, Mus musculus
ccggggattctgactctggccgtgc

SEQ ID NO: 352556 - DNA, 25 bp, Mus musculus
ttcgacatgcagagcactgacctgg

SEQ ID NO: 352557 - DNA, 25 bp, Mus musculus
agagcactgacctgggcaacaagga

SEQ ID NO: 352558 - DNA, 25 bp, Mus musculus
gtccagccatgcctctgtgcgtgtc

SEQ ID NO: 352559 - DNA, 25 bp, Mus musculus
tgcgtgtcgtcatgcagtgacttca

SEQ ID NO: 352560 - DNA, 25 bp, Mus musculus
gccatgcctctgtgcgtgtcgtcat

SEQ ID NO: 352561 - DNA, 25 bp, Mus musculus
atgcgtccagccatgcctctgtgcg

SEQ ID NO: 352562 - DNA, 25 bp, Mus musculus
tcgtcatgcagtgacttcactcccg

SEQ ID NO: 352563 - DNA, 25 bp, Mus musculus
cctctgtgcgtgtcgtcatgcagtg

SEQ ID NO: 352564 - DNA, 25 bp, Mus musculus
ccatgcctctgtgcgtgtcgtcatg

SEQ ID NO: 352565 - DNA, 25 bp, Mus musculus
gtgtcgtcatgcagtgacttcactc

SEQ ID NO: 352566 - DNA, 25 bp, Mus musculus
ttcactcccggaccatgcgtccagc

SEQ ID NO: 352567 - DNA, 25 bp, Mus musculus
tgcgtccagccatgcctctgtgcgt

SEQ ID NO: 352568 - DNA, 25 bp, Mus musculus
atgcctctgtgcgtgtcgtcatgca

SEQ ID NO: 352569 - DNA, 25 bp, Mus musculus
tgtcgtcatgcagtgacttcactcc

SEQ ID NO: 352570 - DNA, 25 bp, Mus musculus
cgtcatgcagtgacttcactcccgg

SEQ ID NO: 352571 - DNA, 25 bp, Mus musculus
tcactcccggaccatgcgtccagcc

SEQ ID NO: 352572 - DNA, 25 bp, Mus musculus
agcatccggtctccatcgcgcggaa

SEQ ID NO: 352573 - DNA, 25 bp, Mus musculus
gaagtgcaactggacctcgaaacga

SEQ ID NO: 352574 - DNA, 25 bp, Mus musculus
acctcgaaacgaggcgacacctaga

SEQ ID NO: 352575 - DNA, 25 bp, Mus musculus
gaggcgacacctagagcgacgccca

SEQ ID NO: 352576 - DNA, 25 bp, Mus musculus
gcgacgcccatcacccagcctccaa

SEQ ID NO: 352577 - DNA, 25 bp, Mus musculus
ccagcctccaaagcgcgcgacagca

SEQ ID NO: 352578 - DNA, 25 bp, Mus musculus
gcaaggtagagtgtagagcggcacc

SEQ ID NO: 352579 - DNA, 25 bp, Mus musculus
ccatcgcgcggaagtgcaactggac

SEQ ID NO: 352580 - DNA, 25 bp, Mus musculus
gaacaccgagtcctcaaattcgccg

SEQ ID NO: 352581 - DNA, 25 bp, Mus musculus
tctgctcgaacaccgagtcctcaaa

SEQ ID NO: 352582 - DNA, 25 bp, Mus musculus
agtgaagtcgccgtgcttggttgca

SEQ ID NO: 352583 - DNA, 25 bp, Mus musculus
cccgagggtacaagagtgaagtcgc

SEQ ID NO: 352584 - DNA, 25 bp, Mus musculus
gacggagacagacaacccgagggta

SEQ ID NO: 352585 - DNA, 25 bp, Mus musculus
cccgcctgcaggacacgtgggttga

SEQ ID NO: 352586 - DNA, 25 bp, Mus musculus
ggtccgctgctggtcctataaacag

SEQ ID NO: 352587 - DNA, 25 bp, Mus musculus
ctccatggcaacgaaagggtgctgc

SEQ ID NO: 352588 - DNA, 25 bp, Mus musculus
taaacagctcaggtacgctcccgta

SEQ ID NO: 352589 - DNA, 25 bp, Mus musculus
cgctcccgtagtcatcagtctctgg

SEQ ID NO: 352590 - DNA, 25 bp, Mus musculus
gtagcgcggcgaatccttaccaaca

SEQ ID NO: 352591 - DNA, 25 bp, Mus musculus
ccaacaggcgccgtcgcaaaatggc

SEQ ID NO: 352592 - DNA, 25 bp, Mus musculus
aaatggcgtgtccacttctcggtca

SEQ ID NO: 352593 - DNA, 25 bp, Mus musculus
cctattgtggtaaagctacgcccta

SEQ ID NO: 352594 - DNA, 25 bp, Mus musculus
aagcgctcaacttgcctctaggcca

SEQ ID NO: 352595 - DNA, 25 bp, Mus musculus
ccttgtggttaaaataccgcgctca

SEQ ID NO: 352596 - DNA, 25 bp, Mus musculus
gccacgccttcacactgtcgtaaaa

SEQ ID NO: 352597 - DNA, 25 bp, Mus musculus
gtaaaacttcaccttcgcctcagag

SEQ ID NO: 352598 - DNA, 25 bp, Mus musculus
cactgtcgtaaagccgcgttccgtt

SEQ ID NO: 352599 - DNA, 25 bp, Mus musculus
cctacgttttgataaagcttcgctc

SEQ ID NO: 352600 - DNA, 25 bp, Mus musculus
gggactgccagccatttcgcacgca

SEQ ID NO: 352601 - DNA, 25 bp, Mus musculus
gtcccgcgtctctcagagaagagtg

SEQ ID NO: 352602 - DNA, 25 bp, Mus musculus
gatgctgcccgcttacaataagatg

SEQ ID NO: 352603 - DNA, 25 bp, Mus musculus
cccagatggactccttggaagagca

SEQ ID NO: 352604 - DNA, 25 bp, Mus musculus
caacgcttcagggtagaaatcggta

SEQ ID NO: 352605 - DNA, 25 bp, Mus musculus
cctcttaatgcggaagggaaatctg

SEQ ID NO: 352606 - DNA, 25 bp, Mus musculus
agagtgttcctgcacctcctcggga

SEQ ID NO: 352607 - DNA, 25 bp, Mus musculus
tccgtgagccaaactgagatagata

SEQ ID NO: 352608 - DNA, 25 bp, Mus musculus
atggggttcacttagcagagtcaac

SEQ ID NO: 352609 - DNA, 25 bp, Mus musculus
ccggctttccaagtccgagagagaa

SEQ ID NO: 352610 - DNA, 25 bp, Mus musculus
agatgcagagtagaaccggctttcc

SEQ ID NO: 352611 - DNA, 25 bp, Mus musculus
tggtgcccaaatgcacagagcgatc

SEQ ID NO: 352612 - DNA, 25 bp, Mus musculus
tcgaggctcgccatgtccaatttta

SEQ ID NO: 352613 - DNA, 25 bp, Mus musculus
ttaagcacgcgcagcaaaggccacg

SEQ ID NO: 352614 - DNA, 25 bp, Mus musculus
gccgccatcttgcatttcagagcga

SEQ ID NO: 352615 - DNA, 25 bp, Mus musculus
gacctcggtcgctttcttcccttga

SEQ ID NO: 352616 - DNA, 25 bp, Mus musculus
ccagcggtcgtcagaagtcggaccc

SEQ ID NO: 352617 - DNA, 25 bp, Mus musculus
ccgttcaagcgattgctcggccagc

SEQ ID NO: 352618 - DNA, 25 bp, Mus musculus
gggccacgcctctgtcactagaagc

SEQ ID NO: 352619 - DNA, 25 bp, Mus musculus
ccgccctctgtcagggagagtcacg

SEQ ID NO: 352620 - DNA, 25 bp, Mus musculus
gccgcgagttcctgctcgggttcca

SEQ ID NO: 352621 - DNA, 25 bp, Mus musculus
gctcctctagaaccgggcgctgcgg

SEQ ID NO: 352622 - DNA, 25 bp, Mus musculus
cctgaacccacaagggccgcgagga

SEQ ID NO: 352623 - DNA, 25 bp, Mus musculus
tgcgagagagactccgctccctgaa

SEQ ID NO: 352624 - DNA, 25 bp, Mus musculus
ctgcagcccggcagaagcgccgaga

SEQ ID NO: 352625 - DNA, 25 bp, Mus musculus
gggagtcaactctgacccgtgaacc

SEQ ID NO: 352626 - DNA, 25 bp, Mus musculus
tgaaactgcctaggtcctccgaaac

SEQ ID NO: 352627 - DNA, 25 bp, Mus musculus
ttcagagcgactgcacttttcaggg

SEQ ID NO: 352628 - DNA, 25 bp, Mus musculus
ggagcacaaggtcggcccaaagctc

SEQ ID NO: 352629 - DNA, 25 bp, Mus musculus
cggctctccgccctcagtggaagga

SEQ ID NO: 352630 - DNA, 25 bp, Mus musculus
ttccagctgtagttccggctctccg

SEQ ID NO: 352631 - DNA, 25 bp, Mus musculus
atttgcgacgtcgttcttccagctg

SEQ ID NO: 352632 - DNA, 25 bp, Mus musculus
ccctcacaggaatttgcgacgtcgt

SEQ ID NO: 352633 - DNA, 25 bp, Mus musculus
ctccaatccgaagagcgcgggaacc

SEQ ID NO: 352634 - DNA, 25 bp, Mus musculus
ccagatcgacgaacccgaaattctc

SEQ ID NO: 352635 - DNA, 25 bp, Mus musculus
tcacgcgctctgaattctggcgcca

SEQ ID NO: 352636 - DNA, 25 bp, Mus musculus
ccgcttgcagaagccggaacccgag

SEQ ID NO: 352637 - DNA, 25 bp, Mus musculus
gcgactgtgcagctccaggctgctg

SEQ ID NO: 352638 - DNA, 25 bp, Mus musculus
ctgaggaactcactggacaggtcca

SEQ ID NO: 352639 - DNA, 25 bp, Mus musculus
agaggtggcgaccaacttgctctgc

SEQ ID NO: 352640 - DNA, 25 bp, Mus musculus
cggtgcagcgtcttgtttggaattt

SEQ ID NO: 352641 - DNA, 25 bp, Mus musculus
gcgcttcggctctaggtttcctctt

SEQ ID NO: 352642 - DNA, 25 bp, Mus musculus
ccggaaccacgcaggcttcgtcatc

SEQ ID NO: 352643 - DNA, 25 bp, Mus musculus
ggaaactgtcctggccgcctactct

SEQ ID NO: 352644 - DNA, 25 bp, Mus musculus
tgtcctggccgcctactctgttgtc

SEQ ID NO: 352645 - DNA, 25 bp, Mus musculus
tactctgttgtcctctcctcctggg

SEQ ID NO: 352646 - DNA, 25 bp, Mus musculus
ctcctcctgggagactggcgacaat

SEQ ID NO: 352647 - DNA, 25 bp, Mus musculus
acaattgcggccagcgggttgttta

SEQ ID NO: 352648 - DNA, 25 bp, Mus musculus
ttgtttagttgacctgtgagccaca

SEQ ID NO: 352649 - DNA, 25 bp, Mus musculus
ctgtgagccacagcttcgggtcatg

SEQ ID NO: 352650 - DNA, 25 bp, Mus musculus
agtaccagccggtctgtcctacgcg

SEQ ID NO: 352651 - DNA, 25 bp, Mus musculus
gtcctacgcgggacgcatgtgtcta

SEQ ID NO: 352652 - DNA, 25 bp, Mus musculus
catgtgtctacaacagctgctattg

SEQ ID NO: 352653 - DNA, 25 bp, Mus musculus
acagctgctattggtgagagagcgc

SEQ ID NO: 352654 - DNA, 25 bp, Mus musculus
gaatctgcgcggtttcgcgcgccgc

SEQ ID NO: 352655 - DNA, 25 bp, Mus musculus
gccagcgggttgtttagttgacctg

SEQ ID NO: 352656 - DNA, 25 bp, Mus musculus
ccgaggccacgtggctttgtttata

SEQ ID NO: 352657 - DNA, 25 bp, Mus musculus
ggctctcgctctgctcgcagttgca

SEQ ID NO: 352658 - DNA, 25 bp, Mus musculus
gcggctgcccgagcgcagtatttat

SEQ ID NO: 352659 - DNA, 25 bp, Mus musculus
cgcagtatttatcccgggccgctgc

SEQ ID NO: 352660 - DNA, 25 bp, Mus musculus
ggatccttgcactcacaggggcgca

SEQ ID NO: 352661 - DNA, 25 bp, Mus musculus
cccgtctctttgttgccggaagagc

SEQ ID NO: 352662 - DNA, 25 bp, Mus musculus
cgcctcctgactctgggaatgctga

SEQ ID NO: 352663 - DNA, 25 bp, Mus musculus
agttgcacaaccttgcgtccgtgga

SEQ ID NO: 352664 - DNA, 25 bp, Mus musculus
gtccgtggaaacttgaagccgcatg

SEQ ID NO: 352665 - DNA, 25 bp, Mus musculus
cggcgaatgtcctcacctgctgagg

SEQ ID NO: 352666 - DNA, 25 bp, Mus musculus
gtcgctcacgaagctgccgcttttc

SEQ ID NO: 352667 - DNA, 25 bp, Mus musculus
tttctcatccaagaagcgcttccag

SEQ ID NO: 352668 - DNA, 25 bp, Mus musculus
cctgcccaaggaacggcatggtaca

SEQ ID NO: 352669 - DNA, 25 bp, Mus musculus
ccgggacaagagtgggtcaactagt

SEQ ID NO: 352670 - DNA, 25 bp, Mus musculus
atcgacgttgagttccacatccggc

SEQ ID NO: 352671 - DNA, 25 bp, Mus musculus
ctcccaagaaggctggacgggtgtc

SEQ ID NO: 352672 - DNA, 25 bp, Mus musculus
ctgggcgtgcgctgtctcccaagaa

SEQ ID NO: 352673 - DNA, 25 bp, Mus musculus
agcaggtatggctccgccctgcttc

SEQ ID NO: 352674 - DNA, 25 bp, Mus musculus
tgccaacgaacgtgaagcaggtatg

SEQ ID NO: 352675 - DNA, 25 bp, Mus musculus
cacatccggcacaattatccttgga

SEQ ID NO: 352676 - DNA, 25 bp, Mus musculus
tgggctccggcatcatgaacatcga

SEQ ID NO: 352677 - DNA, 25 bp, Mus musculus
caggccgaaactaggaagaaacttg

SEQ ID NO: 352678 - DNA, 25 bp, Mus musculus
acagagccatttccggcaggccgaa

SEQ ID NO: 352679 - DNA, 25 bp, Mus musculus
acctaggccagtgagcggaagtgac

SEQ ID NO: 352680 - DNA, 25 bp, Mus musculus
ggcggagctccacgctcggacctag

SEQ ID NO: 352681 - DNA, 25 bp, Mus musculus
tcgcaccgttcaaccacgtgcgggg

SEQ ID NO: 352682 - DNA, 25 bp, Mus musculus
gagggtctctgagtcccgccttcct

SEQ ID NO: 352683 - DNA, 25 bp, Mus musculus
ttatccttggagcaagttgccaacg

SEQ ID NO: 352684 - DNA, 25 bp, Mus musculus
cgtgagcccgggaaaactttctgcg

SEQ ID NO: 352685 - DNA, 25 bp, Mus musculus
tgcgccgtgttcagcgcctccatgg

SEQ ID NO: 352686 - DNA, 25 bp, Mus musculus
cagcggtcccaagggaagacggctt

SEQ ID NO: 352687 - DNA, 25 bp, Mus musculus
cggcgagcgtgtctgatcttccaga

SEQ ID NO: 352688 - DNA, 25 bp, Mus musculus
atcttccagagggatgagtcaccgc

SEQ ID NO: 352689 - DNA, 25 bp, Mus musculus
tcggtagggctgctgcgccctcaaa

SEQ ID NO: 352690 - DNA, 25 bp, Mus musculus
aaatagagttcagggctggatgccc

SEQ ID NO: 352691 - DNA, 25 bp, Mus musculus
ctccatgggctccttcttggggtgt

SEQ ID NO: 352692 - DNA, 25 bp, Mus musculus
ctccgaagcaccgtcctaaatctgg

SEQ ID NO: 352693 - DNA, 25 bp, Mus musculus
agcaaccgcgccgtgacaatcaggc

SEQ ID NO: 352694 - DNA, 25 bp, Mus musculus
ctgtgttaaatgcacggcagagagc

SEQ ID NO: 352695 - DNA, 25 bp, Mus musculus
gtcagacggcatccgcctgtgttaa

SEQ ID NO: 352696 - DNA, 25 bp, Mus musculus
gagggagctcatcctggagtctcca

SEQ ID NO: 352697 - DNA, 25 bp, Mus musculus
cacgcaggcgcatagccgcttggga

SEQ ID NO: 352698 - DNA, 25 bp, Mus musculus
tcgcagtaatacttcgagatctggc

SEQ ID NO: 352699 - DNA, 25 bp, Mus musculus
actacctggaggagcagaaactctt

SEQ ID NO: 352700 - DNA, 25 bp, Mus musculus
ttcacgcagagataccgagactacc

SEQ ID NO: 352701 - DNA, 25 bp, Mus musculus
cgacggggtacaaacactagcgaca

SEQ ID NO: 352702 - DNA, 25 bp, Mus musculus
agaatctcgctgatggacggcgacg

SEQ ID NO: 352703 - DNA, 25 bp, Mus musculus
agcgagtttagctcttccggttgta

SEQ ID NO: 352704 - DNA, 25 bp, Mus musculus
gatctggctttgtttattgacgtca

SEQ ID NO: 352705 - DNA, 25 bp, Mus musculus
cgaaattccattccctgatcgcagt

SEQ ID NO: 352706 - DNA, 25 bp, Mus musculus
cggttccagaaagcaacccactgca

SEQ ID NO: 352707 - DNA, 25 bp, Mus musculus
agaaactcttggacaggctgcaccg

SEQ ID NO: 352708 - DNA, 25 bp, Mus musculus
ttgacgtcacttccgatgcgccgta

SEQ ID NO: 352709 - DNA, 25 bp, Mus musculus
ccgggttcgttcacctgctcagata

SEQ ID NO: 352710 - DNA, 25 bp, Mus musculus
agttgtcgcagttgtgactgagccc

SEQ ID NO: 352711 - DNA, 25 bp, Mus musculus
ttctgagcagcatctgcaggagctg

SEQ ID NO: 352712 - DNA, 25 bp, Mus musculus
tctccggctccttggtaaggacggc

SEQ ID NO: 352713 - DNA, 25 bp, Mus musculus
ggaccatggcaacgctcgaggctcg

SEQ ID NO: 352714 - DNA, 25 bp, Mus musculus
ggctccgcgttctcgagtgaccgcg

SEQ ID NO: 352715 - DNA, 25 bp, Mus musculus
cgcaacggcagcaacggccgaggca

SEQ ID NO: 352716 - DNA, 25 bp, Mus musculus
gagccagaccctagccggccggaaa

SEQ ID NO: 352717 - DNA, 25 bp, Mus musculus
tctacatcatcgacgccatcttcaa

SEQ ID NO: 352718 - DNA, 25 bp, Mus musculus
aacaccgaggggcagccactcacag

SEQ ID NO: 352719 - DNA, 25 bp, Mus musculus
agccggttctgcatcgggcttcaga

SEQ ID NO: 352720 - DNA, 25 bp, Mus musculus
tacgattccagccaaagccggttct

SEQ ID NO: 352721 - DNA, 25 bp, Mus musculus
gacccgtggtactcgtgccagcgtt

SEQ ID NO: 352722 - DNA, 25 bp, Mus musculus
tcgtgccagcgttgacagctgagtg

SEQ ID NO: 352723 - DNA, 25 bp, Mus musculus
tgccctgctcggttggcacctggat

SEQ ID NO: 352724 - DNA, 25 bp, Mus musculus
gccatcttcaactcctactacgatt

SEQ ID NO: 352725 - DNA, 25 bp, Mus musculus
cgggcttcagatctttctccggctc

SEQ ID NO: 352726 - DNA, 25 bp, Mus musculus
tgctgcggctgtataagcgcgcgct

SEQ ID NO: 352727 - DNA, 25 bp, Mus musculus
ctgcccttacccacgaacttgaaga

SEQ ID NO: 352728 - DNA, 25 bp, Mus musculus
cttacccacgaacttgaagagactc

SEQ ID NO: 352729 - DNA, 25 bp, Mus musculus
tcgagtcatggtgtatccacaggtg

SEQ ID NO: 352730 - DNA, 25 bp, Mus musculus
ttgaagagactcatgacggcgcggc

SEQ ID NO: 352731 - DNA, 25 bp, Mus musculus
aaaagcggaagtggctcagagcacg

SEQ ID NO: 352732 - DNA, 25 bp, Mus musculus
ctgcgccacctcgagtcatggtgta

SEQ ID NO: 352733 - DNA, 25 bp, Mus musculus
ggacgctatggcgttctgcgctccc

SEQ ID NO: 352734 - DNA, 25 bp, Mus musculus
tcagagcacgctcgtccttccggtt

SEQ ID NO: 352735 - DNA, 25 bp, Mus musculus
tcccagggaaaagcggaagtggctc

SEQ ID NO: 352736 - DNA, 25 bp, Mus musculus
cgggcatcttccgtgccctggaaag

SEQ ID NO: 352737 - DNA, 25 bp, Mus musculus
ccctggaaaggccatgccgcgaaaa

SEQ ID NO: 352738 - DNA, 25 bp, Mus musculus
acccgggactgtcagcgaggctcac

SEQ ID NO: 352739 - DNA, 25 bp, Mus musculus
cagcgaggctcacgaccaagacaaa

SEQ ID NO: 352740 - DNA, 25 bp, Mus musculus
cctgtgagcgtacccgggtgtcaat

SEQ ID NO: 352741 - DNA, 25 bp, Mus musculus
acttatggattttgacaagaaagga

SEQ ID NO: 352742 - DNA, 25 bp, Mus musculus
accgggagcaatggtgtactaggcc

SEQ ID NO: 352743 - DNA, 25 bp, Mus musculus
cgcgagctcaggtttcgcactcgga

SEQ ID NO: 352744 - DNA, 25 bp, Mus musculus
tttcgcactcggatctcacggcaga

SEQ ID NO: 352745 - DNA, 25 bp, Mus musculus
tctcacggcagagtcaccgtggaga

SEQ ID NO: 352746 - DNA, 25 bp, Mus musculus
ccgtggagaggccagggtaccacaa

SEQ ID NO: 352747 - DNA, 25 bp, Mus musculus
ggtaccacaaacttatggattttga

SEQ ID NO: 352748 - DNA, 25 bp, Mus musculus
tcggagcaaccacggcgtccgcagt

SEQ ID NO: 352749 - DNA, 25 bp, Mus musculus
aaaccggcacgagtcggagcaacca

SEQ ID NO: 352750 - DNA, 25 bp, Mus musculus
agaatgtccaaaaccggcacgagtc

SEQ ID NO: 352751 - DNA, 25 bp, Mus musculus
ggagggcaggagaatgtccaaaacc

SEQ ID NO: 352752 - DNA, 25 bp, Mus musculus
tacccgggtgtcaatagccgggagc

SEQ ID NO: 352753 - DNA, 25 bp, Mus musculus
ggccaccgggagcaatggtgtacta

SEQ ID NO: 352754 - DNA, 25 bp, Mus musculus
cgcccacaatggcagctagcgtgca

SEQ ID NO: 352755 - DNA, 25 bp, Mus musculus
cgtcctaccttcatgtcgctgatga

SEQ ID NO: 352756 - DNA, 25 bp, Mus musculus
tgcgtctcccggacgttcagagcgc

SEQ ID NO: 352757 - DNA, 25 bp, Mus musculus
tcgcccggatctgttgctcgcagac

SEQ ID NO: 352758 - DNA, 25 bp, Mus musculus
ttggtgcagagaaaaccgcccgctg

SEQ ID NO: 352759 - DNA, 25 bp, Mus musculus
aaggcgaagcccatcttggtgcaga

SEQ ID NO: 352760 - DNA, 25 bp, Mus musculus
agccaccaagagtgcccacgacgga

SEQ ID NO: 352761 - DNA, 25 bp, Mus musculus
tgctcggctcctggtctcaaaaatg

SEQ ID NO: 352762 - DNA, 25 bp, Mus musculus
ggcgagtcacctatgtgcagtgctc

SEQ ID NO: 352763 - DNA, 25 bp, Mus musculus
agcacgcggtgctcgcaatttactg

SEQ ID NO: 352764 - DNA, 25 bp, Mus musculus
agcggtttcaccctgggagcgacct

SEQ ID NO: 352765 - DNA, 25 bp, Mus musculus
aagcgcgctgcattccttctcgatc

SEQ ID NO: 352766 - DNA, 25 bp, Mus musculus
tgatgatggtctggaagaggcctcc

SEQ ID NO: 352767 - DNA, 25 bp, Mus musculus
tgcccggagaagactgacaatcaag

SEQ ID NO: 352768 - DNA, 25 bp, Mus musculus
aagttatgggatgtcgtggctgtct

SEQ ID NO: 352769 - DNA, 25 bp, Mus musculus
gaccagtgactgtaagaaccgttcc

SEQ ID NO: 352770 - DNA, 25 bp, Mus musculus
cagtgactgtaagaaccgttccctc

SEQ ID NO: 352771 - DNA, 25 bp, Mus musculus
gcccttcgcgctgaccagtgactgt

SEQ ID NO: 352772 - DNA, 25 bp, Mus musculus
ctgaagaccactccctcggccaccg

SEQ ID NO: 352773 - DNA, 25 bp, Mus musculus
aggcttctcgaagcgcccgctgaag

SEQ ID NO: 352774 - DNA, 25 bp, Mus musculus
gcccgccggtaagaggcttctcgaa

SEQ ID NO: 352775 - DNA, 25 bp, Mus musculus
tggtgttgctccacaccgcgtctgc

SEQ ID NO: 352776 - DNA, 25 bp, Mus musculus
ccgccggacgggactctaagatgaa

SEQ ID NO: 352777 - DNA, 25 bp, Mus musculus
atgtcgtggctgtctgcctggtgtt

SEQ ID NO: 352778 - DNA, 25 bp, Mus musculus
ctctaagatgaagttatgggatgtc

SEQ ID NO: 352779 - DNA, 25 bp, Mus musculus
ccagggcaccctaccgcagcatgca

SEQ ID NO: 352780 - DNA, 25 bp, Mus musculus
ctgtctgcctggtgttgctccacac

SEQ ID NO: 352781 - DNA, 25 bp, Mus musculus
ttcgcgctgaccagtgactgtaaga

SEQ ID NO: 352782 - DNA, 25 bp, Mus musculus
ttcactctcgaggaaggcaagtgtc

SEQ ID NO: 352783 - DNA, 25 bp, Mus musculus
cccgccattggacaaacgctctata

SEQ ID NO: 352784 - DNA, 25 bp, Mus musculus
ttctagcccgtgatcatccagtccg

SEQ ID NO: 352785 - DNA, 25 bp, Mus musculus
agtccgcccggatgactcctgtagc

SEQ ID NO: 352786 - DNA, 25 bp, Mus musculus
actcctgtagctctcttgcgtttga

SEQ ID NO: 352787 - DNA, 25 bp, Mus musculus
tgagccaccaggagccaccaagagt

SEQ ID NO: 352788 - DNA, 25 bp, Mus musculus
caccaagagttcctccagagcgagc

SEQ ID NO: 352789 - DNA, 25 bp, Mus musculus
aaacgctctatagcgccatctcagc

SEQ ID NO: 352790 - DNA, 25 bp, Mus musculus
cgcgctctcattggttcggacggcg

SEQ ID NO: 352791 - DNA, 25 bp, Mus musculus
gcgcgcagcggttactctggttact

SEQ ID NO: 352792 - DNA, 25 bp, Mus musculus
tactctggttactgtccgcgaggga

SEQ ID NO: 352793 - DNA, 25 bp, Mus musculus
ggacgctcatccgagacagccattc

SEQ ID NO: 352794 - DNA, 25 bp, Mus musculus
gggcttgcttgaggaggaatctcca

SEQ ID NO: 352795 - DNA, 25 bp, Mus musculus
ttcgcctcgctctgaaggacgctca

SEQ ID NO: 352796 - DNA, 25 bp, Mus musculus
ttcggctagatatcaccgagctagg

SEQ ID NO: 352797 - DNA, 25 bp, Mus musculus
aaggaatggacctcgaacccgcagg

SEQ ID NO: 352798 - DNA, 25 bp, Mus musculus
aggtgggacagccaggtaagatcca

SEQ ID NO: 352799 - DNA, 25 bp, Mus musculus
taagatccaggaggaaccgtgatag

SEQ ID NO: 352800 - DNA, 25 bp, Mus musculus
tatcaccgagctaggtgggacagcc

SEQ ID NO: 352801 - DNA, 25 bp, Mus musculus
gcgtgcgacgttcggctagatatca

SEQ ID NO: 352802 - DNA, 25 bp, Mus musculus
cagccacagaagtgggctgaggaaa

SEQ ID NO: 352803 - DNA, 25 bp, Mus musculus
cgggtcgtttcagccacagaagtgg

SEQ ID NO: 352804 - DNA, 25 bp, Mus musculus
cgccaagtgatgacgcagagcgcgc

SEQ ID NO: 352805 - DNA, 25 bp, Mus musculus
ctcgcgggcgccaagtgatgacgca

SEQ ID NO: 352806 - DNA, 25 bp, Mus musculus
atcatgtgatcgctcgcgggcgcca

SEQ ID NO: 352807 - DNA, 25 bp, Mus musculus
cgggcccgggcatcatgtgatcgct

SEQ ID NO: 352808 - DNA, 25 bp, Mus musculus
ctagcccgtcacgtgaccaaggggc

SEQ ID NO: 352809 - DNA, 25 bp, Mus musculus
tccgactcacctgtcagccgtccga

SEQ ID NO: 352810 - DNA, 25 bp, Mus musculus
gtcctcgaggctcaacacccgggaa

SEQ ID NO: 352811 - DNA, 25 bp, Mus musculus
ggagtcgtcgcagccacctcattgc

SEQ ID NO: 352812 - DNA, 25 bp, Mus musculus
gtgaccactgggtctcagccagctg

SEQ ID NO: 352813 - DNA, 25 bp, Mus musculus
ctcggtgctccattgtgttgtgtga

SEQ ID NO: 352814 - DNA, 25 bp, Mus musculus
gcgcaccaatcagcggtcgtttcgc

SEQ ID NO: 352815 - DNA, 25 bp, Mus musculus
tgacgtcacgggagctttgcctccg

SEQ ID NO: 352816 - DNA, 25 bp, Mus musculus
caactgtttacacagcccgggctgt

SEQ ID NO: 352817 - DNA, 25 bp, Mus musculus
gtgcggcacacacactcatagtcgg

SEQ ID NO: 352818 - DNA, 25 bp, Mus musculus
ttgtaccggcttttacgccagacta

SEQ ID NO: 352819 - DNA, 25 bp, Mus musculus
ggagcctgtggaatcctgtcctcga

SEQ ID NO: 352820 - DNA, 25 bp, Mus musculus
gcctcggcaacaatagcggcggcca

SEQ ID NO: 352821 - DNA, 25 bp, Mus musculus
ccaacgtggttctggtggacaacgc

SEQ ID NO: 352822 - DNA, 25 bp, Mus musculus
tggacaacgccagcgtcctggaacg

SEQ ID NO: 352823 - DNA, 25 bp, Mus musculus
ccagactaattgctttgggaagtgc

SEQ ID NO: 352824 - DNA, 25 bp, Mus musculus
aggttccacatcctcgtcgtcattg

SEQ ID NO: 352825 - DNA, 25 bp, Mus musculus
ggacgtgcttcctcgcgtttctaca

SEQ ID NO: 352826 - DNA, 25 bp, Mus musculus
tggacccagccaaagccattgcatc

SEQ ID NO: 352827 - DNA, 25 bp, Mus musculus
acctgctaggctaccttggcgtgga

SEQ ID NO: 352828 - DNA, 25 bp, Mus musculus
caagttctccggtgtgtaggtgctc

SEQ ID NO: 352829 - DNA, 25 bp, Mus musculus
cctggcgcgaagcttttctgataga

SEQ ID NO: 352830 - DNA, 25 bp, Mus musculus
tgggtcagtttttccacctggttgc

SEQ ID NO: 352831 - DNA, 25 bp, Mus musculus
actccggatcctaactagccctttg

SEQ ID NO: 352832 - DNA, 25 bp, Mus musculus
acctggttgcccattacgctgtgga

SEQ ID NO: 352833 - DNA, 25 bp, Mus musculus
acgctgtggactctcgttcacaaga

SEQ ID NO: 352834 - DNA, 25 bp, Mus musculus
tgagcctccggactagactcacctg

SEQ ID NO: 352835 - DNA, 25 bp, Mus musculus
gtgccactccagaaaaagacgtttg

SEQ ID NO: 352836 - DNA, 25 bp, Mus musculus
acgatcactggagacatggccactc

SEQ ID NO: 352837 - DNA, 25 bp, Mus musculus
agcgaaaccaccgtcagagtcattg

SEQ ID NO: 352838 - DNA, 25 bp, Mus musculus
gacagggatgtgaccgattcgttga

SEQ ID NO: 352839 - DNA, 25 bp, Mus musculus
gaagacgccctgcacccagtgctga

SEQ ID NO: 352840 - DNA, 25 bp, Mus musculus
tgatagccggagactgagctctctc

SEQ ID NO: 352841 - DNA, 25 bp, Mus musculus
atgcattttgaagcggggttcccga

SEQ ID NO: 352842 - DNA, 25 bp, Mus musculus
ggttccgtaacagctgctaccctcg

SEQ ID NO: 352843 - DNA, 25 bp, Mus musculus
tcccgaggttactatgggctgacgc

SEQ ID NO: 352844 - DNA, 25 bp, Mus musculus
ggccggttggacattcttgctttgc

SEQ ID NO: 352845 - DNA, 25 bp, Mus musculus
ggtcgcttcgtggtggccaaagaaa

SEQ ID NO: 352846 - DNA, 25 bp, Mus musculus
cccttggaatcctgaggtctttgga

SEQ ID NO: 352847 - DNA, 25 bp, Mus musculus
taccttttgcgtttgggagcgagaa

SEQ ID NO: 352848 - DNA, 25 bp, Mus musculus
agtcgtgatctgagcggttccgtaa

SEQ ID NO: 352849 - DNA, 25 bp, Mus musculus
cgtccctgagccttttaagaagttg

SEQ ID NO: 352850 - DNA, 25 bp, Mus musculus
tcctacttgggatccgcgggtatcc

SEQ ID NO: 352851 - DNA, 25 bp, Mus musculus
aggctccgtagcttctgacttacca

SEQ ID NO: 352852 - DNA, 25 bp, Mus musculus
cgctctaccaggcagagcgcgtgtg

SEQ ID NO: 352853 - DNA, 25 bp, Mus musculus
tacgaacttagcattcccagagccc

SEQ ID NO: 352854 - DNA, 25 bp, Mus musculus
cccgagtggatatccgcgtggaaag

SEQ ID NO: 352855 - DNA, 25 bp, Mus musculus
acacacgcggcctgcccggtggcgc

SEQ ID NO: 352856 - DNA, 25 bp, Mus musculus
tctaccaggcagagcgcgtgtggcc

SEQ ID NO: 352857 - DNA, 25 bp, Mus musculus
tgtggccgccgagcacatggaccca

SEQ ID NO: 352858 - DNA, 25 bp, Mus musculus
gccgagcacatggacccactggtca

SEQ ID NO: 352859 - DNA, 25 bp, Mus musculus
agcacatggacccactggtcaagcg

SEQ ID NO: 352860 - DNA, 25 bp, Mus musculus
atggacccactggtcaagcgggctc

SEQ ID NO: 352861 - DNA, 25 bp, Mus musculus
cccactggtcaagcgggctcggcaa

SEQ ID NO: 352862 - DNA, 25 bp, Mus musculus
aaggccaggatgaagagaagctacg

SEQ ID NO: 352863 - DNA, 25 bp, Mus musculus
gagaagctacgaacttagcattccc

SEQ ID NO: 352864 - DNA, 25 bp, Mus musculus
tatccgcgtggaaaggatgttggca

SEQ ID NO: 352865 - DNA, 25 bp, Mus musculus
ccaggatgaagagaagctacgaact

SEQ ID NO: 352866 - DNA, 25 bp, Mus musculus
cgcggccacgccatacgagaccacg

SEQ ID NO: 352867 - DNA, 25 bp, Mus musculus
agagacccggatgtacagggtaacg

SEQ ID NO: 352868 - DNA, 25 bp, Mus musculus
gcaagagacccggatgtacagggta

SEQ ID NO: 352869 - DNA, 25 bp, Mus musculus
gagccgcgaagagccaggcgacagc

SEQ ID NO: 352870 - DNA, 25 bp, Mus musculus
ctcacccgccgcgagctcgggcact

SEQ ID NO: 352871 - DNA, 25 bp, Mus musculus
gaggagacgaccggccggtcactca

SEQ ID NO: 352872 - DNA, 25 bp, Mus musculus
cggaagagcggacgccgagaatgaa

SEQ ID NO: 352873 - DNA, 25 bp, Mus musculus
agagctggcccggaaagcagggaac

SEQ ID NO: 352874 - DNA, 25 bp, Mus musculus
caaagcgtggcatggtccgaggaaa

SEQ ID NO: 352875 - DNA, 25 bp, Mus musculus
tgtcccggcaaagcgtggcatggtc

SEQ ID NO: 352876 - DNA, 25 bp, Mus musculus
cgcgcgaccgctgcgcaaggtaaag

SEQ ID NO: 352877 - DNA, 25 bp, Mus musculus
taaaggggcagcaccttcgcgggag

SEQ ID NO: 352878 - DNA, 25 bp, Mus musculus
gcaaggtaaagcctggaccgtcctc

SEQ ID NO: 352879 - DNA, 25 bp, Mus musculus
accgctgcgcaaggtaaagcctgga

SEQ ID NO: 352880 - DNA, 25 bp, Mus musculus
ggccagaaatcgctataaaaggaag

SEQ ID NO: 352881 - DNA, 25 bp, Mus musculus
gggtctgggctacccacacggtcac

SEQ ID NO: 352882 - DNA, 25 bp, Mus musculus
tgggctacccacacggtcacacggt

SEQ ID NO: 352883 - DNA, 25 bp, Mus musculus
tccagtggtgcaagcccgggcacca

SEQ ID NO: 352884 - DNA, 25 bp, Mus musculus
caagcccgggcaccaataaagcaga

SEQ ID NO: 352885 - DNA, 25 bp, Mus musculus
caccaataaagcagaggcgatgcga

SEQ ID NO: 352886 - DNA, 25 bp, Mus musculus
tgcagcgctcacctggcctgcaaga

SEQ ID NO: 352887 - DNA, 25 bp, Mus musculus
ctcacctggcctgcaagaggggtgt

SEQ ID NO: 352888 - DNA, 25 bp, Mus musculus
ccggcgcggccagaaatcgctataa

SEQ ID NO: 352889 - DNA, 25 bp, Mus musculus
cgcacagtgactgtgggcgagtccc

SEQ ID NO: 352890 - DNA, 25 bp, Mus musculus
tccctcacctgggacaaggggtcga

SEQ ID NO: 352891 - DNA, 25 bp, Mus musculus
ggagccgggcagaaaaacacccatg

SEQ ID NO: 352892 - DNA, 25 bp, Mus musculus
aacacccatggggtccagtggtgca

SEQ ID NO: 352893 - DNA, 25 bp, Mus musculus
tgtgcccggggacaaccactcggac

SEQ ID NO: 352894 - DNA, 25 bp, Mus musculus
cgcacttgggcaaaggtgagcagcc

SEQ ID NO: 352895 - DNA, 25 bp, Mus musculus
caagagcctcatctaccgtgacgtg

SEQ ID NO: 352896 - DNA, 25 bp, Mus musculus
gtacgtgcacaccaagagcctcatc

SEQ ID NO: 352897 - DNA, 25 bp, Mus musculus
ggctggccaaggagtacatcgaccc

SEQ ID NO: 352898 - DNA, 25 bp, Mus musculus
atcacgcgcatggagtacgtgcaca

SEQ ID NO: 352899 - DNA, 25 bp, Mus musculus
aggcgctgggacacatgttcatgta

SEQ ID NO: 352900 - DNA, 25 bp, Mus musculus
ccgtgacgtgaagcccgagaacttc

SEQ ID NO: 352901 - DNA, 25 bp, Mus musculus
gaggctgcttctgaacccgtgctgt

SEQ ID NO: 352902 - DNA, 25 bp, Mus musculus
acatcatcgactttgggctggccaa

SEQ ID NO: 352903 - DNA, 25 bp, Mus musculus
catgagcatcaacacgcacttgggc

SEQ ID NO: 352904 - DNA, 25 bp, Mus musculus
aggcactgcgcgctacatgagcatc

SEQ ID NO: 352905 - DNA, 25 bp, Mus musculus
cgaccctgagactaagaagcacatc

SEQ ID NO: 352906 - DNA, 25 bp, Mus musculus
aagcacatcccatatcgcgagcaca

SEQ ID NO: 352907 - DNA, 25 bp, Mus musculus
cgcgagcacaagagcctgacaggca

SEQ ID NO: 352908 - DNA, 25 bp, Mus musculus
tgacaagcggcgaggctcgaccgac

SEQ ID NO: 352909 - DNA, 25 bp, Mus musculus
tcacggggacaaacacggaagtgct

SEQ ID NO: 352910 - DNA, 25 bp, Mus musculus
cttcaaactgcaagcggcgcgcgca

SEQ ID NO: 352911 - DNA, 25 bp, Mus musculus
atctggtccggcatcctgccgcggg

SEQ ID NO: 352912 - DNA, 25 bp, Mus musculus
acacggaagtgctctgcgcacgcgc

SEQ ID NO: 352913 - DNA, 25 bp, Mus musculus
agcggttacttcagcgagctggtta

SEQ ID NO: 352914 - DNA, 25 bp, Mus musculus
ggaaagccgtctcccttctgcgcgg

SEQ ID NO: 352915 - DNA, 25 bp, Mus musculus
tttttagtcccgagtgggtgcagga

SEQ ID NO: 352916 - DNA, 25 bp, Mus musculus
tcggcgatgaactcggacacggaga

SEQ ID NO: 352917 - DNA, 25 bp, Mus musculus
agctggttacgcgagcgtttttgca

SEQ ID NO: 352918 - DNA, 25 bp, Mus musculus
tcctcggtggtctcggcgatgaact

SEQ ID NO: 352919 - DNA, 25 bp, Mus musculus
ccagcagcgtgacggtgttcctgca

SEQ ID NO: 352920 - DNA, 25 bp, Mus musculus
cgagcgtttttgcaagagagggacc

SEQ ID NO: 352921 - DNA, 25 bp, Mus musculus
ttcctgcagttgtgcagccgcgtgg

SEQ ID NO: 352922 - DNA, 25 bp, Mus musculus
atccaaacacttcggcaggaaatcg

SEQ ID NO: 352923 - DNA, 25 bp, Mus musculus
aggacagagaaagcgccccagcgga

SEQ ID NO: 352924 - DNA, 25 bp, Mus musculus
gccgaggggaactttcctccgctgc

SEQ ID NO: 352925 - DNA, 25 bp, Mus musculus
gcccgagacaatgcggcggccaatg

SEQ ID NO: 352926 - DNA, 25 bp, Mus musculus
ctggagaaccgggaaaagtgccgag

SEQ ID NO: 352927 - DNA, 25 bp, Mus musculus
ccaagggccgggagagcaccccaga

SEQ ID NO: 352928 - DNA, 25 bp, Mus musculus
aaatcggaatcctgactaagcactc

SEQ ID NO: 352929 - DNA, 25 bp, Mus musculus
acacttcggcaggaaatcggaatcc

SEQ ID NO: 352930 - DNA, 25 bp, Mus musculus
ctgcaggaaatccaaacacttcggc

SEQ ID NO: 352931 - DNA, 25 bp, Mus musculus
gggccgctgggcattattccatcgc

SEQ ID NO: 352932 - DNA, 25 bp, Mus musculus
tgggcattattccatcgcgggcgcg

SEQ ID NO: 352933 - DNA, 25 bp, Mus musculus
gagcgggctgcaggaaatccaaaca

SEQ ID NO: 352934 - DNA, 25 bp, Mus musculus
ggaatcctgactaagcactcccggc

SEQ ID NO: 352935 - DNA, 25 bp, Mus musculus
aagtgccgaggagaaggaaagcgcc

SEQ ID NO: 352936 - DNA, 25 bp, Mus musculus
accgagaccgcgtcgccaagagcgg

SEQ ID NO: 352937 - DNA, 25 bp, Mus musculus
taggcaggctttcggactctcgccc

SEQ ID NO: 352938 - DNA, 25 bp, Mus musculus
acggaagtgtcgtcaccgagaccgc

SEQ ID NO: 352939 - DNA, 25 bp, Mus musculus
cggcaagcccgacggaagtgtcgtc

SEQ ID NO: 352940 - DNA, 25 bp, Mus musculus
ggctggcccgcctaacccacaccca

SEQ ID NO: 352941 - DNA, 25 bp, Mus musculus
ctccagtgcccagcacggccctcca

SEQ ID NO: 352942 - DNA, 25 bp, Mus musculus
acaaaggacagaccggccgtcagcc

SEQ ID NO: 352943 - DNA, 25 bp, Mus musculus
cctgtcactggagcaagaaacaaag

SEQ ID NO: 352944 - DNA, 25 bp, Mus musculus
gggcagtcactcaccgaatcctgtg

SEQ ID NO: 352945 - DNA, 25 bp, Mus musculus
agtggcagctctcctaccctttact

SEQ ID NO: 352946 - DNA, 25 bp, Mus musculus
gtcaaaagtggcagctctcctaccc

SEQ ID NO: 352947 - DNA, 25 bp, Mus musculus
cgattcggatttggcacggcggaag

SEQ ID NO: 352948 - DNA, 25 bp, Mus musculus
tggagcaagaaacaaaggacagacc

SEQ ID NO: 352949 - DNA, 25 bp, Mus musculus
cggagggaatgcgctgacaagccac

SEQ ID NO: 352950 - DNA, 25 bp, Mus musculus
tgtccgcgaaatcctcagcgctctg

SEQ ID NO: 352951 - DNA, 25 bp, Mus musculus
ctaagctcagcgtcttggcgcagtc

SEQ ID NO: 352952 - DNA, 25 bp, Mus musculus
tcctgagcctgagaaacgagccttg

SEQ ID NO: 352953 - DNA, 25 bp, Mus musculus
cgattctgatgggtcgcagcacaca

SEQ ID NO: 352954 - DNA, 25 bp, Mus musculus
cagcctccgctacaggactaagtca

SEQ ID NO: 352955 - DNA, 25 bp, Mus musculus
tcctcaaggaagatcgtggcgctgc

SEQ ID NO: 352956 - DNA, 25 bp, Mus musculus
cgggttctggactgatgcattcctc

SEQ ID NO: 352957 - DNA, 25 bp, Mus musculus
tcttcggttccttcctcattgtggc

SEQ ID NO: 352958 - DNA, 25 bp, Mus musculus
cggataactccattgcgccggcatg

SEQ ID NO: 352959 - DNA, 25 bp, Mus musculus
ggcggcaatcatcgcccttcggata

SEQ ID NO: 352960 - DNA, 25 bp, Mus musculus
tcaagtcatagtgagcccaggagca

SEQ ID NO: 352961 - DNA, 25 bp, Mus musculus
ggcgcagtcttccttctccaagagg

SEQ ID NO: 352962 - DNA, 25 bp, Mus musculus
cccgccaatcagctcagcttggata

SEQ ID NO: 352963 - DNA, 25 bp, Mus musculus
taagttagcagctgtggcggcaatc

SEQ ID NO: 352964 - DNA, 25 bp, Mus musculus
cggcgaactcgggtcgccatgccta

SEQ ID NO: 352965 - DNA, 25 bp, Mus musculus
tcccggctgtcccagagggacgata

SEQ ID NO: 352966 - DNA, 25 bp, Mus musculus
actcatagcaagcatcccggctgtc

SEQ ID NO: 352967 - DNA, 25 bp, Mus musculus
ggacccgggctccactcatagcaag

SEQ ID NO: 352968 - DNA, 25 bp, Mus musculus
tctgactacttcttggctgacttgg

SEQ ID NO: 352969 - DNA, 25 bp, Mus musculus
cccgaagtgtgtcagtctgactact

SEQ ID NO: 352970 - DNA, 25 bp, Mus musculus
acttaggtccgagggacaggctgca

SEQ ID NO: 352971 - DNA, 25 bp, Mus musculus
gtgctgccttagtttgagggactta

SEQ ID NO: 352972 - DNA, 25 bp, Mus musculus
cgcggtaacggagaccagtgcgacc

SEQ ID NO: 352973 - DNA, 25 bp, Mus musculus
ctctgtgcaccctcggggaaactga

SEQ ID NO: 352974 - DNA, 25 bp, Mus musculus
gggacgataggtttcgagatgaccc

SEQ ID NO: 352975 - DNA, 25 bp, Mus musculus
gtccgccctgagttagtttcgctta

SEQ ID NO: 352976 - DNA, 25 bp, Mus musculus
ggcgtccgctctctcggcaattcgt

SEQ ID NO: 352977 - DNA, 25 bp, Mus musculus
ttcgcttagacttcagcgtcccgtg

SEQ ID NO: 352978 - DNA, 25 bp, Mus musculus
ggtcacatcccgagcgggtcctctg

SEQ ID NO: 352979 - DNA, 25 bp, Mus musculus
acttggcgttgttcctcttgactgg

SEQ ID NO: 352980 - DNA, 25 bp, Mus musculus
tccagcagcagggtcccgtctttgt

SEQ ID NO: 352981 - DNA, 25 bp, Mus musculus
cctagcgccaaggtgacttgctcca

SEQ ID NO: 352982 - DNA, 25 bp, Mus musculus
gtgacttgctccacgtctcctggcg

SEQ ID NO: 352983 - DNA, 25 bp, Mus musculus
ctgctccgggaagtaggagcacttg

SEQ ID NO: 352984 - DNA, 25 bp, Mus musculus
ctccagggcgtcatagatcaaagtt

SEQ ID NO: 352985 - DNA, 25 bp, Mus musculus
ccaaaagcaggcaaaggcgggcctc

SEQ ID NO: 352986 - DNA, 25 bp, Mus musculus
tcaaagtttggatgcgcctgtactt

SEQ ID NO: 352987 - DNA, 25 bp, Mus musculus
gagcctggcaccgaagctccaggga

SEQ ID NO: 352988 - DNA, 25 bp, Mus musculus
ccgagacagcatcgcagtttattta

SEQ ID NO: 352989 - DNA, 25 bp, Mus musculus
atttacaagccctgtgccagccgtc

SEQ ID NO: 352990 - DNA, 25 bp, Mus musculus
gcccgggaactccaatgccatgatc

SEQ ID NO: 352991 - DNA, 25 bp, Mus musculus
gtctttgccaggagcccgatgccct

SEQ ID NO: 352992 - DNA, 25 bp, Mus musculus
tagcttcgcggtctttccctcaccg

SEQ ID NO: 352993 - DNA, 25 bp, Mus musculus
ggccctcgcgtaccacgtgactcaa

SEQ ID NO: 352994 - DNA, 25 bp, Mus musculus
tgagggcttcctcccgcgtttcctc

SEQ ID NO: 352995 - DNA, 25 bp, Mus musculus
tctgcttagcttcgcggtctttccc

SEQ ID NO: 352996 - DNA, 25 bp, Mus musculus
ccctctgcttagcttcgcggtcttt

SEQ ID NO: 352997 - DNA, 25 bp, Mus musculus
cggctgtcaacctgcagctcccggg

SEQ ID NO: 352998 - DNA, 25 bp, Mus musculus
accctattgtctgcgcgccgccgcg

SEQ ID NO: 352999 - DNA, 25 bp, Mus musculus
tgccatccgctgaccctattgtctg

SEQ ID NO: 353000 - DNA, 25 bp, Mus musculus
gctcgcgcccgcgttgctctcggcc

SEQ ID NO: 353001 - DNA, 25 bp, Mus musculus
ctgctgtgcggagacgaggccgagt

SEQ ID NO: 353002 - DNA, 25 bp, Mus musculus
cagactcgaacgaggcccgcgctgg

SEQ ID NO: 353003 - DNA, 25 bp, Mus musculus
ctgctgcccgggcagactcgaacga

SEQ ID NO: 353004 - DNA, 25 bp, Mus musculus
tgactcaacccagcccgcttccggc

SEQ ID NO: 353005 - DNA, 25 bp, Mus musculus
atccgctgaccctattgtctgcgcg

SEQ ID NO: 353006 - DNA, 25 bp, Mus musculus
tagtaatcgaaacccgctccagtga

SEQ ID NO: 353007 - DNA, 25 bp, Mus musculus
tggtcttcgcaagggccacaaaaga

SEQ ID NO: 353008 - DNA, 25 bp, Mus musculus
cccaattagagagaaagcgagaccc

SEQ ID NO: 353009 - DNA, 25 bp, Mus musculus
cacgcacagcttggagagagcactg

SEQ ID NO: 353010 - DNA, 25 bp, Mus musculus
tgagcaatctgcctgcaacgcgaga

SEQ ID NO: 353011 - DNA, 25 bp, Mus musculus
gtccttgtcttgctccggaggaaga

SEQ ID NO: 353012 - DNA, 25 bp, Mus musculus
gttccaccgaagaccaccagttgtg

SEQ ID NO: 353013 - DNA, 25 bp, Mus musculus
gcgagacccaacacgtctttttgtg

SEQ ID NO: 353014 - DNA, 25 bp, Mus musculus
cttgagcccagtggacagagaagtc

SEQ ID NO: 353015 - DNA, 25 bp, Mus musculus
gcgctacagtcgctcttttcctagt

SEQ ID NO: 353016 - DNA, 25 bp, Mus musculus
ttcgggaccaggctccagagtagac

SEQ ID NO: 353017 - DNA, 25 bp, Mus musculus
ctcagatcacactggttcgggacca

SEQ ID NO: 353018 - DNA, 25 bp, Mus musculus
ctggatgggaacctggactcagatc

SEQ ID NO: 353019 - DNA, 25 bp, Mus musculus
cgtccggagggcttacctaatgagc

SEQ ID NO: 353020 - DNA, 25 bp, Mus musculus
tactccaaccaagtcgctttgtccg

SEQ ID NO: 353021 - DNA, 25 bp, Mus musculus
tgaagcaaggcgaagggccccacgc

SEQ ID NO: 353022 - DNA, 25 bp, Mus musculus
acgagggctgaaagttgcttgcgca

SEQ ID NO: 353023 - DNA, 25 bp, Mus musculus
tcccgagctaatagtactccaacca

SEQ ID NO: 353024 - DNA, 25 bp, Mus musculus
ggtccgaatcccgagctaatagtac

SEQ ID NO: 353025 - DNA, 25 bp, Mus musculus
cgcaaaggtccgaatcccgagctaa

SEQ ID NO: 353026 - DNA, 25 bp, Mus musculus
ttgcttgcgcaaaggtccgaatccc

SEQ ID NO: 353027 - DNA, 25 bp, Mus musculus
ccacgcgtagaaaaacgagggctga

SEQ ID NO: 353028 - DNA, 25 bp, Mus musculus
cactcaaacacccacgcgtagaaaa

SEQ ID NO: 353029 - DNA, 25 bp, Mus musculus
gctgcctcccgcaaggtcacactca

SEQ ID NO: 353030 - DNA, 25 bp, Mus musculus
cttctcgagttcagccgcgctgcct

SEQ ID NO: 353031 - DNA, 25 bp, Mus musculus
gcaggcaccgggagacttaatcccc

SEQ ID NO: 353032 - DNA, 25 bp, Mus musculus
cccacgctttacctgtactacgagg

SEQ ID NO: 353033 - DNA, 25 bp, Mus musculus
tacctgtactacgaggcaggcaccg

SEQ ID NO: 353034 - DNA, 25 bp, Mus musculus
cttctctagagagtggggacaatct

SEQ ID NO: 353035 - DNA, 25 bp, Mus musculus
agactccatccggacactgtccaga

SEQ ID NO: 353036 - DNA, 25 bp, Mus musculus
agagtggggacaatctgcgcctgat

SEQ ID NO: 353037 - DNA, 25 bp, Mus musculus
cgagacctccgcttctctagagagt

SEQ ID NO: 353038 - DNA, 25 bp, Mus musculus
tgtcccggggaccaacagcctcctc

SEQ ID NO: 353039 - DNA, 25 bp, Mus musculus
cgcctgcccacagctgatcgggaga

SEQ ID NO: 353040 - DNA, 25 bp, Mus musculus
tcgggagactccatccggacactgt

SEQ ID NO: 353041 - DNA, 25 bp, Mus musculus
ggacactgtccagacctctggtctg

SEQ ID NO: 353042 - DNA, 25 bp, Mus musculus
tctggtctggaaaaccaacgctttc

SEQ ID NO: 353043 - DNA, 25 bp, Mus musculus
ctggaaaaccaacgctttccaagcg

SEQ ID NO: 353044 - DNA, 25 bp, Mus musculus
cccagtgtcccagcccgagacctcc

SEQ ID NO: 353045 - DNA, 25 bp, Mus musculus
gcctgatggagtctcctacccgcgg

SEQ ID NO: 353046 - DNA, 25 bp, Mus musculus
aatctgcgcctgatggagtctccta

SEQ ID NO: 353047 - DNA, 25 bp, Mus musculus
gcccacagctgatcgggagactcca

SEQ ID NO: 353048 - DNA, 25 bp, Mus musculus
aacgcttctctgcaggcggctggga

SEQ ID NO: 353049 - DNA, 25 bp, Mus musculus
cggctgggcaggataaggttacgcc

SEQ ID NO: 353050 - DNA, 25 bp, Mus musculus
ctgctgtgcccagggcgggcttctc

SEQ ID NO: 353051 - DNA, 25 bp, Mus musculus
ccagaaggaggcaggtgacctacgt

SEQ ID NO: 353052 - DNA, 25 bp, Mus musculus
acacacctactgtcggcgcccggct

SEQ ID NO: 353053 - DNA, 25 bp, Mus musculus
ctttgcatggagttgcgccacgcgg

SEQ ID NO: 353054 - DNA, 25 bp, Mus musculus
cctacggctttgcatggagttgcgc

SEQ ID NO: 353055 - DNA, 25 bp, Mus musculus
ctgcttctgggcctacggctttgca

SEQ ID NO: 353056 - DNA, 25 bp, Mus musculus
ggtccgttgggaacgcttctctgca

SEQ ID NO: 353057 - DNA, 25 bp, Mus musculus
ccacagttgtcagcccggtccgttg

SEQ ID NO: 353058 - DNA, 25 bp, Mus musculus
agttgccacagttgtcagcccggtc

SEQ ID NO: 353059 - DNA, 25 bp, Mus musculus
cgctggggagttgccacagttgtca

SEQ ID NO: 353060 - DNA, 25 bp, Mus musculus
catggccactgtcaagcctcccggg

SEQ ID NO: 353061 - DNA, 25 bp, Mus musculus
tggctgctcggtgccgcgctgcttc

SEQ ID NO: 353062 - DNA, 25 bp, Mus musculus
ctgcgcagaagggtactgaaggctt

SEQ ID NO: 353063 - DNA, 25 bp, Mus musculus
cggagcgtgaaaagatactcgactg

SEQ ID NO: 353064 - DNA, 25 bp, Mus musculus
ctcctgtgtcacagttggcccgctg

SEQ ID NO: 353065 - DNA, 25 bp, Mus musculus
gaatgcagaatacggctgcgcgctc

SEQ ID NO: 353066 - DNA, 25 bp, Mus musculus
cagcgaccgtgttggcgactccaaa

SEQ ID NO: 353067 - DNA, 25 bp, Mus musculus
gcgaagcttcaagcgcgcctgcgca

SEQ ID NO: 353068 - DNA, 25 bp, Mus musculus
gccacctttataggcgcggtcccga

SEQ ID NO: 353069 - DNA, 25 bp, Mus musculus
atactcgactgcagccgcgtgacct

SEQ ID NO: 353070 - DNA, 25 bp, Mus musculus
tggtgaccagcctccggagtcgcct

SEQ ID NO: 353071 - DNA, 25 bp, Mus musculus
ctgaaggcttcagtttgggccgtga

SEQ ID NO: 353072 - DNA, 25 bp, Mus musculus
ctgctccctgtccttgagccgggtg

SEQ ID NO: 353073 - DNA, 25 bp, Mus musculus
gtctccgcctttctcagggaacaga

SEQ ID NO: 353074 - DNA, 25 bp, Mus musculus
gcttccaggagcgtcgaaggccgca

SEQ ID NO: 353075 - DNA, 25 bp, Mus musculus
tccaaacacggctgcgcacttcgag

SEQ ID NO: 353076 - DNA, 25 bp, Mus musculus
agggcctttcctttgcggatggata

SEQ ID NO: 353077 - DNA, 25 bp, Mus musculus
gccgcagagcaggtcactataagca

SEQ ID NO: 353078 - DNA, 25 bp, Mus musculus
aaagccaccgctttttctgagggcg

SEQ ID NO: 353079 - DNA, 25 bp, Mus musculus
ggcgatcaggcaaagccaccgcttt

SEQ ID NO: 353080 - DNA, 25 bp, Mus musculus
cccattcagggtcgcagtggagaga

SEQ ID NO: 353081 - DNA, 25 bp, Mus musculus
ctagggaagaactcccgagaggctc

SEQ ID NO: 353082 - DNA, 25 bp, Mus musculus
ctcaagagagggatctgcgggaaca

SEQ ID NO: 353083 - DNA, 25 bp, Mus musculus
gcgcgggaacaatatcactgcctca

SEQ ID NO: 353084 - DNA, 25 bp, Mus musculus
atatagctcagccaagccacgtgga

SEQ ID NO: 353085 - DNA, 25 bp, Mus musculus
tggggcttcctgcaagctcaatata

SEQ ID NO: 353086 - DNA, 25 bp, Mus musculus
cggctttcctctagcttggggcttc

SEQ ID NO: 353087 - DNA, 25 bp, Mus musculus
cagcacggctcttcggctctaggtt

SEQ ID NO: 353088 - DNA, 25 bp, Mus musculus
atgggagccgcctctggaacacctt

SEQ ID NO: 353089 - DNA, 25 bp, Mus musculus
tggatagacagcttcgcagaccagc

SEQ ID NO: 353090 - DNA, 25 bp, Mus musculus
tcctgcggcaggatcaagccagctt

SEQ ID NO: 353091 - DNA, 25 bp, Mus musculus
ctcggcacgcaaggcacagtgcgca

SEQ ID NO: 353092 - DNA, 25 bp, Mus musculus
gggatccgacgcctacgtagcgacg

SEQ ID NO: 353093 - DNA, 25 bp, Mus musculus
ccaacatggcggatggagtcttcgc

SEQ ID NO: 353094 - DNA, 25 bp, Mus musculus
gcgaatctgcggcatccaacatggc

SEQ ID NO: 353095 - DNA, 25 bp, Mus musculus
caccctgaggaaacttcgctcttta

SEQ ID NO: 353096 - DNA, 25 bp, Mus musculus
ccagcttccaaacgtgggccgcaga

SEQ ID NO: 353097 - DNA, 25 bp, Mus musculus
tgggagtcaggacccggaatgtcct

SEQ ID NO: 353098 - DNA, 25 bp, Mus musculus
actcgaacacctatgcagccagacg

SEQ ID NO: 353099 - DNA, 25 bp, Mus musculus
gcaggcaacgggactcgaacaccta

SEQ ID NO: 353100 - DNA, 25 bp, Mus musculus
ctgagcgagaaagtcggacaccctg

SEQ ID NO: 353101 - DNA, 25 bp, Mus musculus
tgtcctgaatcctcttccgtgcggg

SEQ ID NO: 353102 - DNA, 25 bp, Mus musculus
cctttgcatactagcttttccgggg

SEQ ID NO: 353103 - DNA, 25 bp, Mus musculus
atgctcgcggctaccctaggtgccg

SEQ ID NO: 353104 - DNA, 25 bp, Mus musculus
ggagtctctagaatccctgcaagca

SEQ ID NO: 353105 - DNA, 25 bp, Mus musculus
cctgcaagcagggataaagtctatc

SEQ ID NO: 353106 - DNA, 25 bp, Mus musculus
agtctatctagcaggggcaacgggc

SEQ ID NO: 353107 - DNA, 25 bp, Mus musculus
ggcccagctaatcgcctccagtgtg

SEQ ID NO: 353108 - DNA, 25 bp, Mus musculus
tgaacccgggacaccctatgccagg

SEQ ID NO: 353109 - DNA, 25 bp, Mus musculus
agcggtggtagcagcagatgccaca

SEQ ID NO: 353110 - DNA, 25 bp, Mus musculus
agtttgctaagtgaaggagtctcta

SEQ ID NO: 353111 - DNA, 25 bp, Mus musculus
ttcggtctcctcttgggcatcatca

SEQ ID NO: 353112 - DNA, 25 bp, Mus musculus
gggcatcatcactttcacgaacttc

SEQ ID NO: 353113 - DNA, 25 bp, Mus musculus
accacctgaaggctgaggggtctcc

SEQ ID NO: 353114 - DNA, 25 bp, Mus musculus
tgggactcaacgacctcaccgggct

SEQ ID NO: 353115 - DNA, 25 bp, Mus musculus
agcacccagtgcaacggattccgcg

SEQ ID NO: 353116 - DNA, 25 bp, Mus musculus
tgacattgctttggcgcggaggcca

SEQ ID NO: 353117 - DNA, 25 bp, Mus musculus
gctgatgttggaaatttcggtctcc

SEQ ID NO: 353118 - DNA, 25 bp, Mus musculus
gcctccctgcaggaagctttggaaa

SEQ ID NO: 353119 - DNA, 25 bp, Mus musculus
aaccggaagtgcgtcatgacctggc

SEQ ID NO: 353120 - DNA, 25 bp, Mus musculus
tgacctggcgcccagttattcgttt

SEQ ID NO: 353121 - DNA, 25 bp, Mus musculus
cagttattcgttttccgcgcgcgtt

SEQ ID NO: 353122 - DNA, 25 bp, Mus musculus
tgggctctcttcgtttttctcacgg

SEQ ID NO: 353123 - DNA, 25 bp, Mus musculus
tctcacggttctccacgggtttgga

SEQ ID NO: 353124 - DNA, 25 bp, Mus musculus
cggggaggcttatcgatcgacagtt

SEQ ID NO: 353125 - DNA, 25 bp, Mus musculus
aatgtccgacactcaactgcttcct

SEQ ID NO: 353126 - DNA, 25 bp, Mus musculus
gctctatgatggtggcctctacgtc

SEQ ID NO: 353127 - DNA, 25 bp, Mus musculus
acgattgccgacatgccatcggtgc

SEQ ID NO: 353128 - DNA, 25 bp, Mus musculus
tctataaggcggtggccacgattgc

SEQ ID NO: 353129 - DNA, 25 bp, Mus musculus
tcgacagttgcaagaagaccgcatg

SEQ ID NO: 353130 - DNA, 25 bp, Mus musculus
tccacgggtttggagtgtttctata

SEQ ID NO: 353131 - DNA, 25 bp, Mus musculus
cagaagcggcgtcttccagtgccgg

SEQ ID NO: 353132 - DNA, 25 bp, Mus musculus
gctctccgttgcatcgcaagctgca

SEQ ID NO: 353133 - DNA, 25 bp, Mus musculus
tgtgctcgaaggtatctcaacgctc

SEQ ID NO: 353134 - DNA, 25 bp, Mus musculus
ctcgaaggtatcctcgcacgaactg

SEQ ID NO: 353135 - DNA, 25 bp, Mus musculus
ccgacacagatatctgggctttttc

SEQ ID NO: 353136 - DNA, 25 bp, Mus musculus
gcagtgtcgcaggtcttctatccaa

SEQ ID NO: 353137 - DNA, 25 bp, Mus musculus
gagacacattctgcggcgccctcta

SEQ ID NO: 353138 - DNA, 25 bp, Mus musculus
cgtctacatagcaccagcgcttgga

SEQ ID NO: 353139 - DNA, 25 bp, Mus musculus
gacgtctgtcgagatctggaatgca

SEQ ID NO: 353140 - DNA, 25 bp, Mus musculus
gagtccgctcagacttcagtgcgca

SEQ ID NO: 353141 - DNA, 25 bp, Mus musculus
cggcaatctgctcggtggagacaca

SEQ ID NO: 353142 - DNA, 25 bp, Mus musculus
tggatgagctatcacacaaggccta

SEQ ID NO: 353143 - DNA, 25 bp, Mus musculus
gtcctcttcggttcgtggtcacaga

SEQ ID NO: 353144 - DNA, 25 bp, Mus musculus
tcacagagctgtagtaaaggggttc

SEQ ID NO: 353145 - DNA, 25 bp, Mus musculus
agccgcggcaatgatcgtctacata

SEQ ID NO: 353146 - DNA, 25 bp, Mus musculus
tccttctgcacgtggaacttctcga

SEQ ID NO: 353147 - DNA, 25 bp, Mus musculus
acttctcgaaggtctgtggccagtc

SEQ ID NO: 353148 - DNA, 25 bp, Mus musculus
ccgcttgtagatcctgaagaagttc

SEQ ID NO: 353149 - DNA, 25 bp, Mus musculus
tggccagtctttgggcgagaagcaa

SEQ ID NO: 353150 - DNA, 25 bp, Mus musculus
gtgatgaggcctaccaccttgcggt

SEQ ID NO: 353151 - DNA, 25 bp, Mus musculus
gcgtggaaccgtagatctccttctg

SEQ ID NO: 353152 - DNA, 25 bp, Mus musculus
accctgcagcccgaacacgaagagg

SEQ ID NO: 353153 - DNA, 25 bp, Mus musculus
ctggctcacggagcagatccgcttg

SEQ ID NO: 353154 - DNA, 25 bp, Mus musculus
tgtcgcgcacactgagctggctcac

SEQ ID NO: 353155 - DNA, 25 bp, Mus musculus
ttctcctcagagacgatgcccacgg

SEQ ID NO: 353156 - DNA, 25 bp, Mus musculus
tggtgatcctctgcgcactgcatgt

SEQ ID NO: 353157 - DNA, 25 bp, Mus musculus
cgatgaagtcttcgatgcgcttctc

SEQ ID NO: 353158 - DNA, 25 bp, Mus musculus
tcgcagtcatcgtagttgggataga

SEQ ID NO: 353159 - DNA, 25 bp, Mus musculus
gcgcttctccactgaatcgcagtca

SEQ ID NO: 353160 - DNA, 25 bp, Mus musculus
cagcctggaacctccgaaccaccgg

SEQ ID NO: 353161 - DNA, 25 bp, Mus musculus
taaccgggcacttacacagcgcagc

SEQ ID NO: 353162 - DNA, 25 bp, Mus musculus
accgggcacttacacagcgcagcgg

SEQ ID NO: 353163 - DNA, 25 bp, Mus musculus
ccgaggcctggagggcagcgggact

SEQ ID NO: 353164 - DNA, 25 bp, Mus musculus
ttttcccgaagacctggagcctgcg

SEQ ID NO: 353165 - DNA, 25 bp, Mus musculus
cagcgggactgagcagcctggaacc

SEQ ID NO: 353166 - DNA, 25 bp, Mus musculus
tgagcagcctggaacctccgaacca

SEQ ID NO: 353167 - DNA, 25 bp, Mus musculus
accaccggccgagccggcgcagctc

SEQ ID NO: 353168 - DNA, 25 bp, Mus musculus
cgcaagtcgtgcttcggcctaagat

SEQ ID NO: 353169 - DNA, 25 bp, Mus musculus
caagtcgtgcttcggcctaagatct

SEQ ID NO: 353170 - DNA, 25 bp, Mus musculus
tcgtgcttcggcctaagatctgccc

SEQ ID NO: 353171 - DNA, 25 bp, Mus musculus
cttcggcctaagatctgccccgggt

SEQ ID NO: 353172 - DNA, 25 bp, Mus musculus
gttttcccgaagacctggagcctgc

SEQ ID NO: 353173 - DNA, 25 bp, Mus musculus
ggactgagcagcctggaacctccga

SEQ ID NO: 353174 - DNA, 25 bp, Mus musculus
acacacgcgccttggcctttggctg

SEQ ID NO: 353175 - DNA, 25 bp, Mus musculus
tcatgaagagctctcccgaggtgtc

SEQ ID NO: 353176 - DNA, 25 bp, Mus musculus
cacgcgtagttaagggttcggctgc

SEQ ID NO: 353177 - DNA, 25 bp, Mus musculus
cctcgcgcacgcgtagttaagggtt

SEQ ID NO: 353178 - DNA, 25 bp, Mus musculus
tgcaggatcgtctggctcccagcgt

SEQ ID NO: 353179 - DNA, 25 bp, Mus musculus
ttctcttgcgtctgcgcgctacaca

SEQ ID NO: 353180 - DNA, 25 bp, Mus musculus
gggactgcccgagcaagcactcgga

SEQ ID NO: 353181 - DNA, 25 bp, Mus musculus
catcaaccaggaggcgctggtgctc

SEQ ID NO: 353182 - DNA, 25 bp, Mus musculus
ctcccgaggtgtcgagcatcaacca

SEQ ID NO: 353183 - DNA, 25 bp, Mus musculus
gtcccgcatccgagtcatcatgaag

SEQ ID NO: 353184 - DNA, 25 bp, Mus musculus
ggaccagcggctcgtgtcattgccc

SEQ ID NO: 353185 - DNA, 25 bp, Mus musculus
agagcgcttcttccgggagactgcc

SEQ ID NO: 353186 - DNA, 25 bp, Mus musculus
actcggacgcctgagagcgcttctt

SEQ ID NO: 353187 - DNA, 25 bp, Mus musculus
ctgcgccgctttcgctctgcaggat

SEQ ID NO: 353188 - DNA, 25 bp, Mus musculus
caagtacagcctggcggacaaaggg

SEQ ID NO: 353189 - DNA, 25 bp, Mus musculus
ggcgccaagtacagcctggcggaca

SEQ ID NO: 353190 - DNA, 25 bp, Mus musculus
agccgggaaatggagccacgtgcct

SEQ ID NO: 353191 - DNA, 25 bp, Mus musculus
acccgctccgctaggaaatcgcagg

SEQ ID NO: 353192 - DNA, 25 bp, Mus musculus
ttttccagagaaacgggcacgctgg

SEQ ID NO: 353193 - DNA, 25 bp, Mus musculus
tcgcagggcgattagcacttgaatg

SEQ ID NO: 353194 - DNA, 25 bp, Mus musculus
ctgcccggcgtgaaactgcgtccaa

SEQ ID NO: 353195 - DNA, 25 bp, Mus musculus
tgaaactgcgtccaagcgaccgatc

SEQ ID NO: 353196 - DNA, 25 bp, Mus musculus
tgcgtccaagcgaccgatcgcggtc

SEQ ID NO: 353197 - DNA, 25 bp, Mus musculus
cacagctatgcgctcgggaacggcg

SEQ ID NO: 353198 - DNA, 25 bp, Mus musculus
aggacggagacccatagcagcccga

SEQ ID NO: 353199 - DNA, 25 bp, Mus musculus
gagacccatagcagcccgagcctgg

SEQ ID NO: 353200 - DNA, 25 bp, Mus musculus
tggaacttttccagagaaacgggca

SEQ ID NO: 353201 - DNA, 25 bp, Mus musculus
ccgctaggaaatcgcagggcgatta

SEQ ID NO: 353202 - DNA, 25 bp, Mus musculus
agaagcgacccagggcacgcgagcc

SEQ ID NO: 353203 - DNA, 25 bp, Mus musculus
cacgcgagccgagaccttccctgcg

SEQ ID NO: 353204 - DNA, 25 bp, Mus musculus
ccggcactgcgaccagagtcggagt

SEQ ID NO: 353205 - DNA, 25 bp, Mus musculus
cccacccagagcttgaacttggacg

SEQ ID NO: 353206 - DNA, 25 bp, Mus musculus
cctcccgcgccgagtggcagagcct

SEQ ID NO: 353207 - DNA, 25 bp, Mus musculus
ggccagacccgtgcgcgtgaccaca

SEQ ID NO: 353208 - DNA, 25 bp, Mus musculus
cgcgtgcttgccctgaatgagggac

SEQ ID NO: 353209 - DNA, 25 bp, Mus musculus
cttgaacttggacgcggccagaccc

SEQ ID NO: 353210 - DNA, 25 bp, Mus musculus
ccgagcgaggcgacgtctggtttcc

SEQ ID NO: 353211 - DNA, 25 bp, Mus musculus
cgcgtgaccacaccgccacctcccg

SEQ ID NO: 353212 - DNA, 25 bp, Mus musculus
tgcgaccagagtcggagtcctcccg

SEQ ID NO: 353213 - DNA, 25 bp, Mus musculus
ccagagcttgaacttggacgcggcc

SEQ ID NO: 353214 - DNA, 25 bp, Mus musculus
acgaaacggcgacgggaagctagct

SEQ ID NO: 353215 - DNA, 25 bp, Mus musculus
gcctggctctttaagttattaacga

SEQ ID NO: 353216 - DNA, 25 bp, Mus musculus
tagtaacttctgttcggggaggcgc

SEQ ID NO: 353217 - DNA, 25 bp, Mus musculus
gcgcactcctcctagtaacttctgt

SEQ ID NO: 353218 - DNA, 25 bp, Mus musculus
cggagatctcggctccgaggcaaga

SEQ ID NO: 353219 - DNA, 25 bp, Mus musculus
gctgccaggaataacccggtgcgtc

SEQ ID NO: 353220 - DNA, 25 bp, Mus musculus
tggtttttctggttcagcctccctc

SEQ ID NO: 353221 - DNA, 25 bp, Mus musculus
catctcctaacagtgtccgaaaata

SEQ ID NO: 353222 - DNA, 25 bp, Mus musculus
gctggcctgctccagactggttttt

SEQ ID NO: 353223 - DNA, 25 bp, Mus musculus
gtggcaagccgatacccgctctcag

SEQ ID NO: 353224 - DNA, 25 bp, Mus musculus
tcgccagtgtttctgcgtggcaagc

SEQ ID NO: 353225 - DNA, 25 bp, Mus musculus
ctgtccttaaggaaatgctaccaga

SEQ ID NO: 353226 - DNA, 25 bp, Mus musculus
cagacacgctcagcctgggcgagga

SEQ ID NO: 353227 - DNA, 25 bp, Mus musculus
tcctcctgcgctgcggtgactttac

SEQ ID NO: 353228 - DNA, 25 bp, Mus musculus
gtcgctggctgagtctctccctctt

SEQ ID NO: 353229 - DNA, 25 bp, Mus musculus
gccgcagcaagaacaagggcaccgg

SEQ ID NO: 353230 - DNA, 25 bp, Mus musculus
gcggagggaacttggacagcacaat

SEQ ID NO: 353231 - DNA, 25 bp, Mus musculus
actccggggttcgtgcggtcgcact

SEQ ID NO: 353232 - DNA, 25 bp, Mus musculus
ccctcacggtcacaggagatcctta

SEQ ID NO: 353233 - DNA, 25 bp, Mus musculus
agtgcgcacacagacacgatcgctc

SEQ ID NO: 353234 - DNA, 25 bp, Mus musculus
gacacaagtgcgcacacagacacga

SEQ ID NO: 353235 - DNA, 25 bp, Mus musculus
aggagatccttagccgcacacacgc

SEQ ID NO: 353236 - DNA, 25 bp, Mus musculus
gcggtgccacaaaagcagccggcga

SEQ ID NO: 353237 - DNA, 25 bp, Mus musculus
tcctccgagcggtgccacaaaagca

SEQ ID NO: 353238 - DNA, 25 bp, Mus musculus
gacagcacaatgactccggggttcg

SEQ ID NO: 353239 - DNA, 25 bp, Mus musculus
cgtcgtccgcggatagcgctgttcc

SEQ ID NO: 353240 - DNA, 25 bp, Mus musculus
taaagtgtatcccagctgtgcgggc

SEQ ID NO: 353241 - DNA, 25 bp, Mus musculus
cgcccggctcctagtaaagtgtatc

SEQ ID NO: 353242 - DNA, 25 bp, Mus musculus
tgcctcacctcagcgcagagctcta

SEQ ID NO: 353243 - DNA, 25 bp, Mus musculus
ggctgctcagcactccgcctgccac

SEQ ID NO: 353244 - DNA, 25 bp, Mus musculus
agaggccacacccacgcaggtccgg

SEQ ID NO: 353245 - DNA, 25 bp, Mus musculus
cacccacgcaggtccggccagacac

SEQ ID NO: 353246 - DNA, 25 bp, Mus musculus
ggccagacacgcctccatagaagtc

SEQ ID NO: 353247 - DNA, 25 bp, Mus musculus
agacacgcctccatagaagtcctgc

SEQ ID NO: 353248 - DNA, 25 bp, Mus musculus
catagaagtcctgcccctgccaaat

SEQ ID NO: 353249 - DNA, 25 bp, Mus musculus
tgccaaatcacagaccaggctcgtt

SEQ ID NO: 353250 - DNA, 25 bp, Mus musculus
tcacagaccaggctcgttcacgcta

SEQ ID NO: 353251 - DNA, 25 bp, Mus musculus
accaggctcgttcacgctatccagg

SEQ ID NO: 353252 - DNA, 25 bp, Mus musculus
cgcctcctaggtcccgtccacaccg

SEQ ID NO: 353253 - DNA, 25 bp, Mus musculus
cccattccgcggacgcggctggctg

SEQ ID NO: 353254 - DNA, 25 bp, Mus musculus
ccggcccgacaatcgagggctcgga

SEQ ID NO: 353255 - DNA, 25 bp, Mus musculus
agcccgcggcgcgacacctgtcgct

SEQ ID NO: 353256 - DNA, 25 bp, Mus musculus
cgacacctgtcgctgccctcggggc

SEQ ID NO: 353257 - DNA, 25 bp, Mus musculus
tgctgggcgcctctcaagacagcct

SEQ ID NO: 353258 - DNA, 25 bp, Mus musculus
tgatgcactgaccttcggtaagagc

SEQ ID NO: 353259 - DNA, 25 bp, Mus musculus
ccaccgtctgtttgatgcactgacc

SEQ ID NO: 353260 - DNA, 25 bp, Mus musculus
gccgtcattatccaccgtctgtttg

SEQ ID NO: 353261 - DNA, 25 bp, Mus musculus
gggatcgtgaaggacgccgtcatta

SEQ ID NO: 353262 - DNA, 25 bp, Mus musculus
actttgtgaagcgagtccaggagtc

SEQ ID NO: 353263 - DNA, 25 bp, Mus musculus
tgcccaagaagcacatgcaactcaa

SEQ ID NO: 353264 - DNA, 25 bp, Mus musculus
ttcgaactgcccaagaagcacatgc

SEQ ID NO: 353265 - DNA, 25 bp, Mus musculus
gcagatgacgccgtgaagaacttcg

SEQ ID NO: 353266 - DNA, 25 bp, Mus musculus
cccaaggcagatgacgccgtgaaga

SEQ ID NO: 353267 - DNA, 25 bp, Mus musculus
gtctttgataagcacggcgaggccc

SEQ ID NO: 353268 - DNA, 25 bp, Mus musculus
cacagaggtctttgataagcacggc

SEQ ID NO: 353269 - DNA, 25 bp, Mus musculus
ctcaggcggctcatcacagaggtct

SEQ ID NO: 353270 - DNA, 25 bp, Mus musculus
caggccgagcggacgcctgagctca

SEQ ID NO: 353271 - DNA, 25 bp, Mus musculus
gtggaatccatgtcggcctctgagc

SEQ ID NO: 353272 - DNA, 25 bp, Mus musculus
cgggtccgtcagtcagcttctcgga

SEQ ID NO: 353273 - DNA, 25 bp, Mus musculus
caggtcggaaacagccgctgcgcgc

SEQ ID NO: 353274 - DNA, 25 bp, Mus musculus
cggcctgcgcctcatgactatgcag

SEQ ID NO: 353275 - DNA, 25 bp, Mus musculus
cctcatgactatgcagtggactcta

SEQ ID NO: 353276 - DNA, 25 bp, Mus musculus
tgactatgcagtggactctaggggc

SEQ ID NO: 353277 - DNA, 25 bp, Mus musculus
ctgagccgcggacgtccattggtca

SEQ ID NO: 353278 - DNA, 25 bp, Mus musculus
cgtccattggtcaggagcggcctgt

SEQ ID NO: 353279 - DNA, 25 bp, Mus musculus
tcagtcagcttctcggacggggtgc

SEQ ID NO: 353280 - DNA, 25 bp, Mus musculus
ctctagaagcggttgtgcgtttggc

SEQ ID NO: 353281 - DNA, 25 bp, Mus musculus
gttttcctgccagacaccctcaagg

SEQ ID NO: 353282 - DNA, 25 bp, Mus musculus
tccaggccgcagctgtgtagcgcgc

SEQ ID NO: 353283 - DNA, 25 bp, Mus musculus
tgtgtagcgcgctgtgctcaccctc

SEQ ID NO: 353284 - DNA, 25 bp, Mus musculus
cgccgctttatcaggtcggaaacag

SEQ ID NO: 353285 - DNA, 25 bp, Mus musculus
gcgcggggacaacgccgctttatca

SEQ ID NO: 353286 - DNA, 25 bp, Mus musculus
tccttctttgggtcgcaggcgtccc

SEQ ID NO: 353287 - DNA, 25 bp, Mus musculus
gatggacgcgggttcctagcatcct

SEQ ID NO: 353288 - DNA, 25 bp, Mus musculus
cacgaggaaacctctgaggagaccc

SEQ ID NO: 353289 - DNA, 25 bp, Mus musculus
tcacacctccacaggggacctccgg

SEQ ID NO: 353290 - DNA, 25 bp, Mus musculus
cgcccaggtccttctttgggtcgca

SEQ ID NO: 353291 - DNA, 25 bp, Mus musculus
gctagctgtggggacttccgttttc

SEQ ID NO: 353292 - DNA, 25 bp, Mus musculus
ctcccagggtctccgggctagctgt

SEQ ID NO: 353293 - DNA, 25 bp, Mus musculus
ttcgcagcctctgcggtcctcggtg

SEQ ID NO: 353294 - DNA, 25 bp, Mus musculus
agggctcagcggcttcgcagcctct

SEQ ID NO: 353295 - DNA, 25 bp, Mus musculus
acgcgtcgcctggacacggctctgg

SEQ ID NO: 353296 - DNA, 25 bp, Mus musculus
ccggcgcaaagctggctacgccgag

SEQ ID NO: 353297 - DNA, 25 bp, Mus musculus
cgggttcctagcatcctccgtagca

SEQ ID NO: 353298 - DNA, 25 bp, Mus musculus
ttcctagcatcctccgtagcacaaa

SEQ ID NO: 353299 - DNA, 25 bp, Mus musculus
tgcggccacagccacgaggaaacct

SEQ ID NO: 353300 - DNA, 25 bp, Mus musculus
ccacacaaagatgcacacggccttg

SEQ ID NO: 353301 - DNA, 25 bp, Mus musculus
tggcgtagcagacccggcctcgaca

SEQ ID NO: 353302 - DNA, 25 bp, Mus musculus
gacagcgcacacatgatccggcctg

SEQ ID NO: 353303 - DNA, 25 bp, Mus musculus
atccggcctgtgaacacgctgatga

SEQ ID NO: 353304 - DNA, 25 bp, Mus musculus
tgtgaacacgctgatgaccagcaga

SEQ ID NO: 353305 - DNA, 25 bp, Mus musculus
gcaggaactccagaacggtcagagc

SEQ ID NO: 353306 - DNA, 25 bp, Mus musculus
gtcagagcaaagacacggcagcatg

SEQ ID NO: 353307 - DNA, 25 bp, Mus musculus
ggcagcatgatcgtccacccgactt

SEQ ID NO: 353308 - DNA, 25 bp, Mus musculus
gacttcacacccagcacagacaggg

SEQ ID NO: 353309 - DNA, 25 bp, Mus musculus
gacagggtcacgactcctgctgcca

SEQ ID NO: 353310 - DNA, 25 bp, Mus musculus
tgctgccagccacacaaagatgcac

SEQ ID NO: 353311 - DNA, 25 bp, Mus musculus
gaaccctcgggttgcacaatggcca

SEQ ID NO: 353312 - DNA, 25 bp, Mus musculus
ccgctgacggccctggcgtagcaga

SEQ ID NO: 353313 - DNA, 25 bp, Mus musculus
ttgcacaatggccaggtagcggtcc

SEQ ID NO: 353314 - DNA, 25 bp, Mus musculus
gtcggggagctgtgtgccctcccca

SEQ ID NO: 353315 - DNA, 25 bp, Mus musculus
agccgctgtgagtcgggtcgcccgc

SEQ ID NO: 353316 - DNA, 25 bp, Mus musculus
ctatctttaggcagcaggtgcggga

SEQ ID NO: 353317 - DNA, 25 bp, Mus musculus
cgtgctatctttaggcagcaggtgc

SEQ ID NO: 353318 - DNA, 25 bp, Mus musculus
tgtttgcgtgctatctttaggcagc

SEQ ID NO: 353319 - DNA, 25 bp, Mus musculus
cgcgcctttgtttgcgtgctatctt

SEQ ID NO: 353320 - DNA, 25 bp, Mus musculus
aaccctactgggatgggccctgcac

SEQ ID NO: 353321 - DNA, 25 bp, Mus musculus
cacgtgacgccgggcgctataaata

SEQ ID NO: 353322 - DNA, 25 bp, Mus musculus
gaagtcccgctgaggtcggggagct

SEQ ID NO: 353323 - DNA, 25 bp, Mus musculus
cctaaccctactgggatgggccctg

SEQ ID NO: 353324 - DNA, 25 bp, Mus musculus
gccctgcacgggatggcggctccct

SEQ ID NO: 353325 - DNA, 25 bp, Mus musculus
gctataaatagctgggcggcgggcg

SEQ ID NO: 353326 - DNA, 25 bp, Mus musculus
gcctcgaggacgctcccgaacccta

SEQ ID NO: 353327 - DNA, 25 bp, Mus musculus
tccgcggtggtcctctcccttcctc

SEQ ID NO: 353328 - DNA, 25 bp, Mus musculus
gacacgtcatactcggcagggtcga

SEQ ID NO: 353329 - DNA, 25 bp, Mus musculus
cacgcgtttggggtcgttgtactga

SEQ ID NO: 353330 - DNA, 25 bp, Mus musculus
tggggtcgttgtactgaagcagata

SEQ ID NO: 353331 - DNA, 25 bp, Mus musculus
taagccgggcccttatgctcaagcg

SEQ ID NO: 353332 - DNA, 25 bp, Mus musculus
gactcccggcgcacatctgcgcctg

SEQ ID NO: 353333 - DNA, 25 bp, Mus musculus
ctgaagcagatactcccgtttaagc

SEQ ID NO: 353334 - DNA, 25 bp, Mus musculus
tggaacccgacatcttgactcccgg

SEQ ID NO: 353335 - DNA, 25 bp, Mus musculus
ggcttatacttggaacccgacatct

SEQ ID NO: 353336 - DNA, 25 bp, Mus musculus
ggggcgcaggcttatacttggaacc

SEQ ID NO: 353337 - DNA, 25 bp, Mus musculus
tcatactcggcagggtcgagggtac

SEQ ID NO: 353338 - DNA, 25 bp, Mus musculus
tggtctccggagacacgtcatactc

SEQ ID NO: 353339 - DNA, 25 bp, Mus musculus
tgcgcccttctggtctccggagaca

SEQ ID NO: 353340 - DNA, 25 bp, Mus musculus
gggcccttatgctcaagcgctcgac

SEQ ID NO: 353341 - DNA, 25 bp, Mus musculus
gcagatactcccgtttaagccgggc

SEQ ID NO: 353342 - DNA, 25 bp, Mus musculus
cctggcgctgagctacgccggcgct

SEQ ID NO: 353343 - DNA, 25 bp, Mus musculus
cccgtgacagtgaataaagcctctg

SEQ ID NO: 353344 - DNA, 25 bp, Mus musculus
ccgtgacagtgaataaagcctctgc

SEQ ID NO: 353345 - DNA, 25 bp, Mus musculus
cgtgacagtgaataaagcctctgct

SEQ ID NO: 353346 - DNA, 25 bp, Mus musculus
acagtgaataaagcctctgcttctc

SEQ ID NO: 353347 - DNA, 25 bp, Mus musculus
cgaagctggccgtcctgcttggcgc

SEQ ID NO: 353348 - DNA, 25 bp, Mus musculus
aagctggccgtcctgcttggcgcgc

SEQ ID NO: 353349 - DNA, 25 bp, Mus musculus
gcgcccttccccgtgacagtgaata

SEQ ID NO: 353350 - DNA, 25 bp, Mus musculus
cctgtaccgtgaaccagggaagccg

SEQ ID NO: 353351 - DNA, 25 bp, Mus musculus
gcaagcggcgcctggagcgcctggc

SEQ ID NO: 353352 - DNA, 25 bp, Mus musculus
gcctctgcttctcccgttcccgcgt

SEQ ID NO: 353353 - DNA, 25 bp, Mus musculus
ccgttcccgcgtctggcctcgccct

SEQ ID NO: 353354 - DNA, 25 bp, Mus musculus
tcgccctgtaccgtgaaccagggaa

SEQ ID NO: 353355 - DNA, 25 bp, Mus musculus
tgacagtgaataaagcctctgcttc

SEQ ID NO: 353356 - DNA, 25 bp, Mus musculus
gtaagtctctatcctatgctctgca

SEQ ID NO: 353357 - DNA, 25 bp, Mus musculus
gaagaagacatcctgacggcggctg

SEQ ID NO: 353358 - DNA, 25 bp, Mus musculus
gaggactgcgagtcccagcgtacca

SEQ ID NO: 353359 - DNA, 25 bp, Mus musculus
ttctgcacgccaagcggaggactgc

SEQ ID NO: 353360 - DNA, 25 bp, Mus musculus
cgccaatggtacgtggccttctgca

SEQ ID NO: 353361 - DNA, 25 bp, Mus musculus
caaacatcacgtggcgaagaaaccc

SEQ ID NO: 353362 - DNA, 25 bp, Mus musculus
gcagcaagccggtcatccaaacatc

SEQ ID NO: 353363 - DNA, 25 bp, Mus musculus
cacctctggggcgtgctccaacatt

SEQ ID NO: 353364 - DNA, 25 bp, Mus musculus
ttccaagccaggcacaccggtcttg

SEQ ID NO: 353365 - DNA, 25 bp, Mus musculus
tgagttcgcggacgcttcaggtaca

SEQ ID NO: 353366 - DNA, 25 bp, Mus musculus
tcaggtacagcgcagtcctcaaagg

SEQ ID NO: 353367 - DNA, 25 bp, Mus musculus
tagcaagtacactagccagacccgg

SEQ ID NO: 353368 - DNA, 25 bp, Mus musculus
accctagcgctgcatctgtgatgta

SEQ ID NO: 353369 - DNA, 25 bp, Mus musculus
cctcaaaggtgggtagcaagtacac

SEQ ID NO: 353370 - DNA, 25 bp, Mus musculus
gactgctcggtgcagccatcgctga

SEQ ID NO: 353371 - DNA, 25 bp, Mus musculus
ttgtgtagttcgaagcgctgcgtgc

SEQ ID NO: 353372 - DNA, 25 bp, Mus musculus
tgcctgtgcacgcttgtgtagttcg

SEQ ID NO: 353373 - DNA, 25 bp, Mus musculus
gcccgcattaagagatgcctgtgca

SEQ ID NO: 353374 - DNA, 25 bp, Mus musculus
aaccgcagatccaggcccgcattaa

SEQ ID NO: 353375 - DNA, 25 bp, Mus musculus
tcgttgagatcttcacctggcggca

SEQ ID NO: 353376 - DNA, 25 bp, Mus musculus
acgtgcacggcaacccagtcgttga

SEQ ID NO: 353377 - DNA, 25 bp, Mus musculus
ttgaagaaatccaccacgtgcacgg

SEQ ID NO: 353378 - DNA, 25 bp, Mus musculus
ccatcgctgatggtaccgtagatga

SEQ ID NO: 353379 - DNA, 25 bp, Mus musculus
tcctgccagcggtactcgtacttgg

SEQ ID NO: 353380 - DNA, 25 bp, Mus musculus
cgctgcgtgccaggctcgaacttgc

SEQ ID NO: 353381 - DNA, 25 bp, Mus musculus
cccggacatgactgggcacgactgc

SEQ ID NO: 353382 - DNA, 25 bp, Mus musculus
ccgtagatgaggttgatgcgattga

SEQ ID NO: 353383 - DNA, 25 bp, Mus musculus
cttccggaagcgttgctcgtcctgc

SEQ ID NO: 353384 - DNA, 25 bp, Mus musculus
ttccaagtttctctcggagcgcgcg

SEQ ID NO: 353385 - DNA, 25 bp, Mus musculus
ctgccctgaactttgggtcggcccg

SEQ ID NO: 353386 - DNA, 25 bp, Mus musculus
tggctcctgcttggtcactcccagg

SEQ ID NO: 353387 - DNA, 25 bp, Mus musculus
atcgcagcgaagctaggtggcttga

SEQ ID NO: 353388 - DNA, 25 bp, Mus musculus
tctggtcctctgtgcagcctaagca

SEQ ID NO: 353389 - DNA, 25 bp, Mus musculus
cctgaaattctgagggctcgggatc

SEQ ID NO: 353390 - DNA, 25 bp, Mus musculus
tctccgaccgaagcagcggagctgg

SEQ ID NO: 353391 - DNA, 25 bp, Mus musculus
gcactcccggttgcgtttctccagt

SEQ ID NO: 353392 - DNA, 25 bp, Mus musculus
gtgttctttcctgttcggttggaca

SEQ ID NO: 353393 - DNA, 25 bp, Mus musculus
gcagattccttagcggcaactcgga

SEQ ID NO: 353394 - DNA, 25 bp, Mus musculus
ctacagacccgacaatggcagagga

SEQ ID NO: 353395 - DNA, 25 bp, Mus musculus
ccggaggcttatctccaaattcgga

SEQ ID NO: 353396 - DNA, 25 bp, Mus musculus
cgtgccgttgcctctaggaatgagc

SEQ ID NO: 353397 - DNA, 25 bp, Mus musculus
agccgctcggcatacgtgttgagga

SEQ ID NO: 353398 - DNA, 25 bp, Mus musculus
cgctctacatgaaggtggccaaggc

SEQ ID NO: 353399 - DNA, 25 bp, Mus musculus
ctttcttggagtctacacgcaccta

SEQ ID NO: 353400 - DNA, 25 bp, Mus musculus
ctgggacagagcagtgcaccacgtt

SEQ ID NO: 353401 - DNA, 25 bp, Mus musculus
ccacgttggtgcagggaaagttctt

SEQ ID NO: 353402 - DNA, 25 bp, Mus musculus
agttcttcggctacttctcggcggc

SEQ ID NO: 353403 - DNA, 25 bp, Mus musculus
cctcgtcgttacacgctctacatga

SEQ ID NO: 353404 - DNA, 25 bp, Mus musculus
aggtggccaaggcacctgcaccctg

SEQ ID NO: 353405 - DNA, 25 bp, Mus musculus
gccgagttcgtacctaccagttcga

SEQ ID NO: 353406 - DNA, 25 bp, Mus musculus
cctaccagttcgactctttcttgga

SEQ ID NO: 353407 - DNA, 25 bp, Mus musculus
gcggctgctgtatttccggccaacg

SEQ ID NO: 353408 - DNA, 25 bp, Mus musculus
tgtggagagctttgacgaagttctg

SEQ ID NO: 353409 - DNA, 25 bp, Mus musculus
tttgacgaagttctgcggctctgcg

SEQ ID NO: 353410 - DNA, 25 bp, Mus musculus
ctgcctctggggcagacatagggcc

SEQ ID NO: 353411 - DNA, 25 bp, Mus musculus
ctacacgcacctacctgggtgtgga

SEQ ID NO: 353412 - DNA, 25 bp, Mus musculus
cccgttgaagtcctggagatggtga

SEQ ID NO: 353413 - DNA, 25 bp, Mus musculus
tggcagtgtggagtttagagaccct

SEQ ID NO: 353414 - DNA, 25 bp, Mus musculus
tttagagaccctcaggaagtgactg

SEQ ID NO: 353415 - DNA, 25 bp, Mus musculus
cagtgtcccgttgaagtcctggaga

SEQ ID NO: 353416 - DNA, 25 bp, Mus musculus
ccctcgatgccctccggacgcgctg

SEQ ID NO: 353417 - DNA, 25 bp, Mus musculus
tgtggagtttagagaccctcaggaa

SEQ ID NO: 353418 - DNA, 25 bp, Mus musculus
acgcgctgcctgtgtgaccggctct

SEQ ID NO: 353419 - DNA, 25 bp, Mus musculus
tccaccttcgccatcttagcccagc

SEQ ID NO: 353420 - DNA, 25 bp, Mus musculus
atcttagcccagctcagcgccgacg

SEQ ID NO: 353421 - DNA, 25 bp, Mus musculus
caggggtctcagcgcctggcagcca

SEQ ID NO: 353422 - DNA, 25 bp, Mus musculus
cgccgctgacgctgtctcccgtccc

SEQ ID NO: 353423 - DNA, 25 bp, Mus musculus
cagccacagtgtcccgttgaagtcc

SEQ ID NO: 353424 - DNA, 25 bp, Mus musculus
gagaccctcaggaagtgactgtcag

SEQ ID NO: 353425 - DNA, 25 bp, Mus musculus
ctggcagccacagtgtcccgttgaa

SEQ ID NO: 353426 - DNA, 25 bp, Mus musculus
tatttgccgcccatggactccaggc

SEQ ID NO: 353427 - DNA, 25 bp, Mus musculus
cgggagaactcgcttgagctctgca

SEQ ID NO: 353428 - DNA, 25 bp, Mus musculus
tcgccgctgaagctagagaggccca

SEQ ID NO: 353429 - DNA, 25 bp, Mus musculus
tgcggctccgaacaggctaagaact

SEQ ID NO: 353430 - DNA, 25 bp, Mus musculus
ccggtggtcatatggtccagctcca

SEQ ID NO: 353431 - DNA, 25 bp, Mus musculus
gctcggcacttaccaatctgcagga

SEQ ID NO: 353432 - DNA, 25 bp, Mus musculus
ggtcctccgtacgtgttccagcatc

SEQ ID NO: 353433 - DNA, 25 bp, Mus musculus
ttcggtcaacagatgccggtgggtc

SEQ ID NO: 353434 - DNA, 25 bp, Mus musculus
ccacctgcttggacacttcggtcaa

SEQ ID NO: 353435 - DNA, 25 bp, Mus musculus
agttgttctccagcttgcccaccga

SEQ ID NO: 353436 - DNA, 25 bp, Mus musculus
gcacgtagccgtccaagttgttctc

SEQ ID NO: 353437 - DNA, 25 bp, Mus musculus
tgatggacttcttccagcgctgtga

SEQ ID NO: 353438 - DNA, 25 bp, Mus musculus
gcccacctctccagacggtagaaga

SEQ ID NO: 353439 - DNA, 25 bp, Mus musculus
tgactaatgtgctctgctgcgcgcc

SEQ ID NO: 353440 - DNA, 25 bp, Mus musculus
aatcttcgagcggagcgtccgatcc

SEQ ID NO: 353441 - DNA, 25 bp, Mus musculus
aaggctgggtccaacgccaccttgc

SEQ ID NO: 353442 - DNA, 25 bp, Mus musculus
gccaccttgcggtgggaggtaccca

SEQ ID NO: 353443 - DNA, 25 bp, Mus musculus
ccacagggcgcttcgcgtttcctga

SEQ ID NO: 353444 - DNA, 25 bp, Mus musculus
agccaggaataaccgagcttgcccg

SEQ ID NO: 353445 - DNA, 25 bp, Mus musculus
acctgagaagggatgctcgagtccc

SEQ ID NO: 353446 - DNA, 25 bp, Mus musculus
gtcccgaatgcgactcgattcccga

SEQ ID NO: 353447 - DNA, 25 bp, Mus musculus
ttcccgagcgcagaaacaacgatga

SEQ ID NO: 353448 - DNA, 25 bp, Mus musculus
caacgatgatcgtccggctctggga

SEQ ID NO: 353449 - DNA, 25 bp, Mus musculus
tctgggatgagcctccaagtcagtc

SEQ ID NO: 353450 - DNA, 25 bp, Mus musculus
ggacgctctagaccaccgggagact

SEQ ID NO: 353451 - DNA, 25 bp, Mus musculus
gagacttctgtctcggtggtgtcta

SEQ ID NO: 353452 - DNA, 25 bp, Mus musculus
gctcagcctccggtagaacaacaaa

SEQ ID NO: 353453 - DNA, 25 bp, Mus musculus
cgtttcctgaggaacggaatcttcg

SEQ ID NO: 353454 - DNA, 25 bp, Mus musculus
aaggccgcgccttctggccaccgag

SEQ ID NO: 353455 - DNA, 25 bp, Mus musculus
tatttagttcctcccagtggccctc

SEQ ID NO: 353456 - DNA, 25 bp, Mus musculus
gagacataggctccgggctacgacc

SEQ ID NO: 353457 - DNA, 25 bp, Mus musculus
gcccgccctgtccacgtgaccacgt

SEQ ID NO: 353458 - DNA, 25 bp, Mus musculus
tgtatgtgagcctgagccaggtccc

SEQ ID NO: 353459 - DNA, 25 bp, Mus musculus
aggtgctgtatgtgagcctgagcca

SEQ ID NO: 353460 - DNA, 25 bp, Mus musculus
gcggcttcgctaaggtgctgtatgt

SEQ ID NO: 353461 - DNA, 25 bp, Mus musculus
cccacaatcccgtgctgcgaggggc

SEQ ID NO: 353462 - DNA, 25 bp, Mus musculus
cgccttctaatttcaaccaatcgga

SEQ ID NO: 353463 - DNA, 25 bp, Mus musculus
gatgtaagggcacacctctctcccg

SEQ ID NO: 353464 - DNA, 25 bp, Mus musculus
ccagtcgatgatgtaagggcacacc

SEQ ID NO: 353465 - DNA, 25 bp, Mus musculus
cccgagctgagccaataggacatcg

SEQ ID NO: 353466 - DNA, 25 bp, Mus musculus
ggaagccgaccatgccccgagctga

SEQ ID NO: 353467 - DNA, 25 bp, Mus musculus
caataggacatcgactctctccgcg

SEQ ID NO: 353468 - DNA, 25 bp, Mus musculus
atttacctgggcgaatcggcgtctg

SEQ ID NO: 353469 - DNA, 25 bp, Mus musculus
cgtctgaatccgaagcggaggccga

SEQ ID NO: 353470 - DNA, 25 bp, Mus musculus
agcgagactataatccgggccggga

SEQ ID NO: 353471 - DNA, 25 bp, Mus musculus
ttccgtctcctcagtgcggggaaca

SEQ ID NO: 353472 - DNA, 25 bp, Mus musculus
aaatcgcggcttcttcttcgtcctc

SEQ ID NO: 353473 - DNA, 25 bp, Mus musculus
cgggaaccaatcctcctggcggcgg

SEQ ID NO: 353474 - DNA, 25 bp, Mus musculus
cgtctctccctctcagaacaaaatg

SEQ ID NO: 353475 - DNA, 25 bp, Mus musculus
acaaaatgccgaccggaagtgcagc

SEQ ID NO: 353476 - DNA, 25 bp, Mus musculus
gtgcagctgcaggaatgactccctc

SEQ ID NO: 353477 - DNA, 25 bp, Mus musculus
gttctgctccgtgcccttgtcctgt

SEQ ID NO: 353478 - DNA, 25 bp, Mus musculus
cttgtcctgtgcaacggacggccgt

SEQ ID NO: 353479 - DNA, 25 bp, Mus musculus
ggtcgcttctgcaagacggcgtcta

SEQ ID NO: 353480 - DNA, 25 bp, Mus musculus
ttgctcgggtgaccggcttgatttt

SEQ ID NO: 353481 - DNA, 25 bp, Mus musculus
aggccgggatctccctcttctcagg

SEQ ID NO: 353482 - DNA, 25 bp, Mus musculus
tttgagccgttcgaggtacacacgc

SEQ ID NO: 353483 - DNA, 25 bp, Mus musculus
ctcgccttctttgcgctgctggacg

SEQ ID NO: 353484 - DNA, 25 bp, Mus musculus
ggggaaccagtatctgtgcgagcta

SEQ ID NO: 353485 - DNA, 25 bp, Mus musculus
ggacctggacctgctgctacacatg

SEQ ID NO: 353486 - DNA, 25 bp, Mus musculus
ctgctggaagagttggtgcgctcca

SEQ ID NO: 353487 - DNA, 25 bp, Mus musculus
tgctacacatgaacaacgcgcgcta

SEQ ID NO: 353488 - DNA, 25 bp, Mus musculus
aggacccagactaggccatcgagga

SEQ ID NO: 353489 - DNA, 25 bp, Mus musculus
cgccggatcgagtagtacagcactt

SEQ ID NO: 353490 - DNA, 25 bp, Mus musculus
gcgccttgctgcgtttccgacagca

SEQ ID NO: 353491 - DNA, 25 bp, Mus musculus
tgcccgctgccaagatgctggagct

SEQ ID NO: 353492 - DNA, 25 bp, Mus musculus
tttgtcagccttcgcgatggtttcg

SEQ ID NO: 353493 - DNA, 25 bp, Mus musculus
ccttctacctggaggcgcgttttgt

SEQ ID NO: 353494 - DNA, 25 bp, Mus musculus
gaaagccgctaacgcagaggaccca

SEQ ID NO: 353495 - DNA, 25 bp, Mus musculus
tacacacgcgactgcaaggctggga

SEQ ID NO: 353496 - DNA, 25 bp, Mus musculus
tcagcgtgtccacgggtccctgcgt

SEQ ID NO: 353497 - DNA, 25 bp, Mus musculus
agctagtttggggtcgctcttccca

SEQ ID NO: 353498 - DNA, 25 bp, Mus musculus
ttctggaacattccggctcccgcag

SEQ ID NO: 353499 - DNA, 25 bp, Mus musculus
tcggagactcagctagtttggggtc

SEQ ID NO: 353500 - DNA, 25 bp, Mus musculus
tctgactggcgaagtcggagactca

SEQ ID NO: 353501 - DNA, 25 bp, Mus musculus
gtccctgcgtctgactggcgaagtc

SEQ ID NO: 353502 - DNA, 25 bp, Mus musculus
gtctcattgaggtccgcccagggag

SEQ ID NO: 353503 - DNA, 25 bp, Mus musculus
aatttgctggcaaccctcaaccaca

SEQ ID NO: 353504 - DNA, 25 bp, Mus musculus
acttcctcagcagcccgtgcctcag

SEQ ID NO: 353505 - DNA, 25 bp, Mus musculus
acggttaatttgctggcaaccctca

SEQ ID NO: 353506 - DNA, 25 bp, Mus musculus
tgaaacgaacggttaatttgctggc

SEQ ID NO: 353507 - DNA, 25 bp, Mus musculus
cgcttgccggcccttgaaacgaacg

SEQ ID NO: 353508 - DNA, 25 bp, Mus musculus
cgatgttctggaccgcttgccggcc

SEQ ID NO: 353509 - DNA, 25 bp, Mus musculus
agcctccgcgtctcattgaggtccg

SEQ ID NO: 353510 - DNA, 25 bp, Mus musculus
ccaagccaagggcacagccggagtt

SEQ ID NO: 353511 - DNA, 25 bp, Mus musculus
ttcagcctttggtgatcctccagga

SEQ ID NO: 353512 - DNA, 25 bp, Mus musculus
gcctgcttgggtgcattcagccttt

SEQ ID NO: 353513 - DNA, 25 bp, Mus musculus
tgttcactcgtcacgcgagggcctg

SEQ ID NO: 353514 - DNA, 25 bp, Mus musculus
ggccttgaccgcagcgtgtaggatc

SEQ ID NO: 353515 - DNA, 25 bp, Mus musculus
acagccggagttgccagaggccagc

SEQ ID NO: 353516 - DNA, 25 bp, Mus musculus
tgagtctgctgagcccgacctcagg

SEQ ID NO: 353517 - DNA, 25 bp, Mus musculus
ccctgtcgtagtctcagaggagcag

SEQ ID NO: 353518 - DNA, 25 bp, Mus musculus
ctcagaggagcagttgtgcagccaa

SEQ ID NO: 353519 - DNA, 25 bp, Mus musculus
gagcagttgtgcagccaagccaagg

SEQ ID NO: 353520 - DNA, 25 bp, Mus musculus
tgatcctccaggacctaaggtttcg

SEQ ID NO: 353521 - DNA, 25 bp, Mus musculus
cttcacccggaggtgagtctgctga

SEQ ID NO: 353522 - DNA, 25 bp, Mus musculus
cgacctcaggtgttcactcgtcacg

SEQ ID NO: 353523 - DNA, 25 bp, Mus musculus
cggtattatcttcggggcctcttca

SEQ ID NO: 353524 - DNA, 25 bp, Mus musculus
ggctgtccggaaccgtctctcgctt

SEQ ID NO: 353525 - DNA, 25 bp, Mus musculus
tctcgcttcgcccagtctccggccg

SEQ ID NO: 353526 - DNA, 25 bp, Mus musculus
cactctgggccggtcgctggacact

SEQ ID NO: 353527 - DNA, 25 bp, Mus musculus
ctggacactgtcaccctgagggatg

SEQ ID NO: 353528 - DNA, 25 bp, Mus musculus
accctgagggatgaagtcccgctgc

SEQ ID NO: 353529 - DNA, 25 bp, Mus musculus
ggaggacccacctggctgtccggaa

SEQ ID NO: 353530 - DNA, 25 bp, Mus musculus
acgggcgctgctaattggctgtagt

SEQ ID NO: 353531 - DNA, 25 bp, Mus musculus
ccaggacgggcgctgctaattggct

SEQ ID NO: 353532 - DNA, 25 bp, Mus musculus
tgaaaggcaggcggcactccgcgcc

SEQ ID NO: 353533 - DNA, 25 bp, Mus musculus
gagttcggaggatcacggtgtgaaa

SEQ ID NO: 353534 - DNA, 25 bp, Mus musculus
cttaaagggaagcagcccggatgga

SEQ ID NO: 353535 - DNA, 25 bp, Mus musculus
cccttaaagggaagcagcccggatg

SEQ ID NO: 353536 - DNA, 25 bp, Mus musculus
cgcgcccgcagagggacacgcccgc

SEQ ID NO: 353537 - DNA, 25 bp, Mus musculus
gagggatgaagtcccgctgcccgcc

SEQ ID NO: 353538 - DNA, 25 bp, Mus musculus
tcggcgcctttcgtccgcgcgcaac

SEQ ID NO: 353539 - DNA, 25 bp, Mus musculus
ggaggccactcagcaggtcgcccta

SEQ ID NO: 353540 - DNA, 25 bp, Mus musculus
tttcggggaacgcagccgcagacgc

SEQ ID NO: 353541 - DNA, 25 bp, Mus musculus
agcttcgtctttcggggaacgcagc

SEQ ID NO: 353542 - DNA, 25 bp, Mus musculus
cgcagcttcgtctttcggggaacgc

SEQ ID NO: 353543 - DNA, 25 bp, Mus musculus
gaaccggggcgcagcttcgtctttc

SEQ ID NO: 353544 - DNA, 25 bp, Mus musculus
ggagcgatgcccttcggtctccctg

SEQ ID NO: 353545 - DNA, 25 bp, Mus musculus
cgcgcctcggcgctcaccgcgaatc

SEQ ID NO: 353546 - DNA, 25 bp, Mus musculus
agggagcgcaccttacctgccggcg

SEQ ID NO: 353547 - DNA, 25 bp, Mus musculus
gaggagggagcgcaccttacctgcc

SEQ ID NO: 353548 - DNA, 25 bp, Mus musculus
ctgtaggtgcgtccggacaggaaaa

SEQ ID NO: 353549 - DNA, 25 bp, Mus musculus
ttctctccccaaggagctgtaggtg

SEQ ID NO: 353550 - DNA, 25 bp, Mus musculus
cctgcgtggggagattgtcttctct

SEQ ID NO: 353551 - DNA, 25 bp, Mus musculus
cttcgccctgcacctgcgtggggag

SEQ ID NO: 353552 - DNA, 25 bp, Mus musculus
tggcaaacccgatgactgagaaata

SEQ ID NO: 353553 - DNA, 25 bp, Mus musculus
cagcatcacaaggagcgagggcagt

SEQ ID NO: 353554 - DNA, 25 bp, Mus musculus
ttagcatcctctcaagcgaagctcg

SEQ ID NO: 353555 - DNA, 25 bp, Mus musculus
cgttaaggacagagcaggggaccct

SEQ ID NO: 353556 - DNA, 25 bp, Mus musculus
tcccggcgtgccacagatggcaaac

SEQ ID NO: 353557 - DNA, 25 bp, Mus musculus
agtcgtttctctgtggaccacctcg

SEQ ID NO: 353558 - DNA, 25 bp, Mus musculus
gcccagaagcttgcacaggcacaga

SEQ ID NO: 353559 - DNA, 25 bp, Mus musculus
gcagtgtctcctagagccgacccga

SEQ ID NO: 353560 - DNA, 25 bp, Mus musculus
tgctcctagagcgacaccagaaggg

SEQ ID NO: 353561 - DNA, 25 bp, Mus musculus
tcaagtgggcattgttaacggtcgc

SEQ ID NO: 353562 - DNA, 25 bp, Mus musculus
cggtcagcctgcttacggccacgtt

SEQ ID NO: 353563 - DNA, 25 bp, Mus musculus
ctgtgctcggcacccatcaggtact

SEQ ID NO: 353564 - DNA, 25 bp, Mus musculus
atcaggtactctctgcgtgtgtgca

SEQ ID NO: 353565 - DNA, 25 bp, Mus musculus
gaaggccggcttctgagtcgtttct

SEQ ID NO: 353566 - DNA, 25 bp, Mus musculus
ggcctcctcccattcgcaaggtgag

SEQ ID NO: 353567 - DNA, 25 bp, Mus musculus
tcggctaatttgaaagcagatcgtc

SEQ ID NO: 353568 - DNA, 25 bp, Mus musculus
ttgaaagcagatcgtccagaccgga

SEQ ID NO: 353569 - DNA, 25 bp, Mus musculus
ccagaccggactgtgttgggccgtt

SEQ ID NO: 353570 - DNA, 25 bp, Mus musculus
ttgggccgttggacagacaccctct

SEQ ID NO: 353571 - DNA, 25 bp, Mus musculus
ctgtcgggcttttcggctaatttga

SEQ ID NO: 353572 - DNA, 25 bp, Mus musculus
accctctgcggggaagctacacggc

SEQ ID NO: 353573 - DNA, 25 bp, Mus musculus
agctacacggctcaatagctttgag

SEQ ID NO: 353574 - DNA, 25 bp, Mus musculus
tagctttgagcgtcaagaggccacc

SEQ ID NO: 353575 - DNA, 25 bp, Mus musculus
aagaggccaccgaggtgtggtcctc

SEQ ID NO: 353576 - DNA, 25 bp, Mus musculus
gaaatgagggcctctgtcgggcttt

SEQ ID NO: 353577 - DNA, 25 bp, Mus musculus
agagaccgagcacttccggccggcg

SEQ ID NO: 353578 - DNA, 25 bp, Mus musculus
ctcccattcgcaaggtgagtggtcg

SEQ ID NO: 353579 - DNA, 25 bp, Mus musculus
ggggcctcccagagaccgagcactt

SEQ ID NO: 353580 - DNA, 25 bp, Mus musculus
cggcacagggctctgagccacagca

SEQ ID NO: 353581 - DNA, 25 bp, Mus musculus
tgagctccgtcccacccgccttacc

SEQ ID NO: 353582 - DNA, 25 bp, Mus musculus
cgccttacccggctctgttcgcctt

SEQ ID NO: 353583 - DNA, 25 bp, Mus musculus
tctgttcgccttcgcgacccgggac

SEQ ID NO: 353584 - DNA, 25 bp, Mus musculus
cacctgacaggaagggacgcggcag

SEQ ID NO: 353585 - DNA, 25 bp, Mus musculus
acatgctggaaacgccggcacaggg

SEQ ID NO: 353586 - DNA, 25 bp, Mus musculus
acagggctctgagccacagcagcag

SEQ ID NO: 353587 - DNA, 25 bp, Mus musculus
acagcagcagcatgcgtgtgcgtgc

SEQ ID NO: 353588 - DNA, 25 bp, Mus musculus
tgcatgcgtgggctctgcccgcttt

SEQ ID NO: 353589 - DNA, 25 bp, Mus musculus
tgcgtgggctctgcccgctttccga

SEQ ID NO: 353590 - DNA, 25 bp, Mus musculus
gccacgcccttctgacagagctccg

SEQ ID NO: 353591 - DNA, 25 bp, Mus musculus
acacgtccaggagtcccgccctgcc

SEQ ID NO: 353592 - DNA, 25 bp, Mus musculus
tgcccgcccaccttgggaaggcgtc

SEQ ID NO: 353593 - DNA, 25 bp, Mus musculus
gggacatgctggaaacgccggcaca

SEQ ID NO: 353594 - DNA, 25 bp, Mus musculus
cgttgcgcatgcgtaccctgatcgg

SEQ ID NO: 353595 - DNA, 25 bp, Mus musculus
cccagttctgcttgtcttttcctaa

SEQ ID NO: 353596 - DNA, 25 bp, Mus musculus
gataaagccttgaagtccctgcaga

SEQ ID NO: 353597 - DNA, 25 bp, Mus musculus
gcagggatatgggtcttcagcctcc

SEQ ID NO: 353598 - DNA, 25 bp, Mus musculus
aggacgacggcagcatccgcaaggt

SEQ ID NO: 353599 - DNA, 25 bp, Mus musculus
cgaggaaagctctcggccgcaggac

SEQ ID NO: 353600 - DNA, 25 bp, Mus musculus
agcgagcagcgatgatccttgagga

SEQ ID NO: 353601 - DNA, 25 bp, Mus musculus
acatcaagttttgcaggcggggccc

SEQ ID NO: 353602 - DNA, 25 bp, Mus musculus
ggagtagccctcacctctgattgga

SEQ ID NO: 353603 - DNA, 25 bp, Mus musculus
gtagtagtttctatccatcggagta

SEQ ID NO: 353604 - DNA, 25 bp, Mus musculus
tctcactctggttggtagtagtttc

SEQ ID NO: 353605 - DNA, 25 bp, Mus musculus
cgcctaacacctagcgttgcgcatg

SEQ ID NO: 353606 - DNA, 25 bp, Mus musculus
gagttaccagatcccttacctggag

SEQ ID NO: 353607 - DNA, 25 bp, Mus musculus
agcggccctggttgctaagagttac

SEQ ID NO: 353608 - DNA, 25 bp, Mus musculus
ggagactctccagtcctcatcgctg

SEQ ID NO: 353609 - DNA, 25 bp, Mus musculus
tcacgctgcgcggagactctccagt

SEQ ID NO: 353610 - DNA, 25 bp, Mus musculus
gtcaggctgaggtaaaggccctcta

SEQ ID NO: 353611 - DNA, 25 bp, Mus musculus
aaaggccctctagcccggggtgctg

SEQ ID NO: 353612 - DNA, 25 bp, Mus musculus
ctctagcccggggtgctggaatcct

SEQ ID NO: 353613 - DNA, 25 bp, Mus musculus
catgactcgaggagagggaagcttc

SEQ ID NO: 353614 - DNA, 25 bp, Mus musculus
gaggaccgctagatactgccaccac

SEQ ID NO: 353615 - DNA, 25 bp, Mus musculus
tgccaccacctcaccgatccacatt

SEQ ID NO: 353616 - DNA, 25 bp, Mus musculus
attctccgcagtccgctggcctgaa

SEQ ID NO: 353617 - DNA, 25 bp, Mus musculus
ctggcctgaaggagggcgactacat

SEQ ID NO: 353618 - DNA, 25 bp, Mus musculus
agggcgactacatcgtgtccgtgaa

SEQ ID NO: 353619 - DNA, 25 bp, Mus musculus
acatcgtgtccgtgaacgggcagcc

SEQ ID NO: 353620 - DNA, 25 bp, Mus musculus
ctcatcgctgctgtcgtccctgggg

SEQ ID NO: 353621 - DNA, 25 bp, Mus musculus
gctggaatcctagaggaccgctaga

SEQ ID NO: 353622 - DNA, 25 bp, Mus musculus
cgacggcgcacatccactccgactg

SEQ ID NO: 353623 - DNA, 25 bp, Mus musculus
actgtcctcttccttcggctctgta

SEQ ID NO: 353624 - DNA, 25 bp, Mus musculus
ttccttcggctctgtacttcagtcc

SEQ ID NO: 353625 - DNA, 25 bp, Mus musculus
aagggttatcttccaaaggcgcaca

SEQ ID NO: 353626 - DNA, 25 bp, Mus musculus
ttatcttccaaaggcgcacagctgc

SEQ ID NO: 353627 - DNA, 25 bp, Mus musculus
ccaaaggcgcacagctgcgtgcaga

SEQ ID NO: 353628 - DNA, 25 bp, Mus musculus
ctgacatgctgccatctgtcggcaa

SEQ ID NO: 353629 - DNA, 25 bp, Mus musculus
cctccagatgcgcagagcccagggc

SEQ ID NO: 353630 - DNA, 25 bp, Mus musculus
gtggcagttcatcgtgtcacctccc

SEQ ID NO: 353631 - DNA, 25 bp, Mus musculus
ctgcgtgcagacagctgtgtgatcc

SEQ ID NO: 353632 - DNA, 25 bp, Mus musculus
catctgtcggcaatggaaccgcgcc

SEQ ID NO: 353633 - DNA, 25 bp, Mus musculus
tcggcaatggaaccgcgccaggcca

SEQ ID NO: 353634 - DNA, 25 bp, Mus musculus
cactggcggtggcagttcatcgtgt

SEQ ID NO: 353635 - DNA, 25 bp, Mus musculus
cagctgtgtgatccgcggttcccac

SEQ ID NO: 353636 - DNA, 25 bp, Mus musculus
gctccaccaggaagcaaacaactgc

SEQ ID NO: 353637 - DNA, 25 bp, Mus musculus
caactgctttcctgcccagctggga

SEQ ID NO: 353638 - DNA, 25 bp, Mus musculus
acagccctcgtggaagcgtttcaag

SEQ ID NO: 353639 - DNA, 25 bp, Mus musculus
tgggcgtttgttgctgtgttaatta

SEQ ID NO: 353640 - DNA, 25 bp, Mus musculus
cggggctcgtgttacactccctttg

SEQ ID NO: 353641 - DNA, 25 bp, Mus musculus
ggaaggcaagcaattggcccaattc

SEQ ID NO: 353642 - DNA, 25 bp, Mus musculus
acctgcctgcggttagcatcgctct

SEQ ID NO: 353643 - DNA, 25 bp, Mus musculus
tccagcgacggctgcgaaactgttc

SEQ ID NO: 353644 - DNA, 25 bp, Mus musculus
tcgcgctactagctgaaagcgagtc

SEQ ID NO: 353645 - DNA, 25 bp, Mus musculus
accggttctacttgtcttgctaagg

SEQ ID NO: 353646 - DNA, 25 bp, Mus musculus
tggagagcagacagaccggttctac

SEQ ID NO: 353647 - DNA, 25 bp, Mus musculus
ccaagcttgatctcagggacgcagc

SEQ ID NO: 353648 - DNA, 25 bp, Mus musculus
tgcggaaccaaaacagaccaaatcg

SEQ ID NO: 353649 - DNA, 25 bp, Mus musculus
ctccagttggatgagtgcggaacca

SEQ ID NO: 353650 - DNA, 25 bp, Mus musculus
cacagaaagaagtcgggtgcgcctt

SEQ ID NO: 353651 - DNA, 25 bp, Mus musculus
ggtacccgctcatccagtacagatc

SEQ ID NO: 353652 - DNA, 25 bp, Mus musculus
ccggaaggcctcataggccgcagca

SEQ ID NO: 353653 - DNA, 25 bp, Mus musculus
tcctccaagcgcacgtggtggcctg

SEQ ID NO: 353654 - DNA, 25 bp, Mus musculus
ggtcgtcggagaagcgctcctccaa

SEQ ID NO: 353655 - DNA, 25 bp, Mus musculus
acatggataccagctggtcgtcgga

SEQ ID NO: 353656 - DNA, 25 bp, Mus musculus
ttcagctcccgcacggacatggata

SEQ ID NO: 353657 - DNA, 25 bp, Mus musculus
ccgcttctgtttcagtcggatgacc

SEQ ID NO: 353658 - DNA, 25 bp, Mus musculus
tctcgctctccagaatgtgccgctg

SEQ ID NO: 353659 - DNA, 25 bp, Mus musculus
tccttgtacaggtcccgctccttgg

SEQ ID NO: 353660 - DNA, 25 bp, Mus musculus
cagggtccggcactcacagaaagaa

SEQ ID NO: 353661 - DNA, 25 bp, Mus musculus
tcccgggcctcagagtctgaaccga

SEQ ID NO: 353662 - DNA, 25 bp, Mus musculus
gtacagatcctccagcaccgctttt

SEQ ID NO: 353663 - DNA, 25 bp, Mus musculus
ccacctggctctggagctggcactt

SEQ ID NO: 353664 - DNA, 25 bp, Mus musculus
tctgtcacgcgagggccgaacccga

SEQ ID NO: 353665 - DNA, 25 bp, Mus musculus
cagctcaccctgcaggaggcgtatc

SEQ ID NO: 353666 - DNA, 25 bp, Mus musculus
gggagaccgcaaccgacagcactcg

SEQ ID NO: 353667 - DNA, 25 bp, Mus musculus
cgtcatcttgaagcgcccggaagtg

SEQ ID NO: 353668 - DNA, 25 bp, Mus musculus
cgcatgcgcagaacgagaaaaatcc

SEQ ID NO: 353669 - DNA, 25 bp, Mus musculus
gcaaccctggaaggacgcatgcgca

SEQ ID NO: 353670 - DNA, 25 bp, Mus musculus
ggagagaacgccgaacttcactatg

SEQ ID NO: 353671 - DNA, 25 bp, Mus musculus
gggtctacggcgatcacaagaaaca

SEQ ID NO: 353672 - DNA, 25 bp, Mus musculus
cagcactcgcttcggagagggtcta

SEQ ID NO: 353673 - DNA, 25 bp, Mus musculus
ccatgacgaccatcgggagaccgca

SEQ ID NO: 353674 - DNA, 25 bp, Mus musculus
agaccaccgtgctatcatctcctga

SEQ ID NO: 353675 - DNA, 25 bp, Mus musculus
ctgccgcgaccactcgctggtaaga

SEQ ID NO: 353676 - DNA, 25 bp, Mus musculus
agagaaacgcttccgagccagccga

SEQ ID NO: 353677 - DNA, 25 bp, Mus musculus
cttcactatgcgtggacacggggtt

SEQ ID NO: 353678 - DNA, 25 bp, Mus musculus
tgtttctgggcatgacagcggcgct

SEQ ID NO: 353679 - DNA, 25 bp, Mus musculus
gccagggtccacagcgcgagctgtt

SEQ ID NO: 353680 - DNA, 25 bp, Mus musculus
aggcaccgttggttggtgcgcggct

SEQ ID NO: 353681 - DNA, 25 bp, Mus musculus
cggcgccgatgtttgggcaaggcag

SEQ ID NO: 353682 - DNA, 25 bp, Mus musculus
caggccatggccctgctgttgtttc

SEQ ID NO: 353683 - DNA, 25 bp, Mus musculus
cctgctgttgtttctgggcatgaca

SEQ ID NO: 353684 - DNA, 25 bp, Mus musculus
cccaatttcgcggagaagttctcct

SEQ ID NO: 353685 - DNA, 25 bp, Mus musculus
ttcgcggagaagttctccttctatc

SEQ ID NO: 353686 - DNA, 25 bp, Mus musculus
cggagaagttctccttctatcgtca

SEQ ID NO: 353687 - DNA, 25 bp, Mus musculus
gttctccttctatcgtcaccacgtg

SEQ ID NO: 353688 - DNA, 25 bp, Mus musculus
ttctatcgtcaccacgtgaacctca

SEQ ID NO: 353689 - DNA, 25 bp, Mus musculus
tcgtcaccacgtgaacctcaagtcg

SEQ ID NO: 353690 - DNA, 25 bp, Mus musculus
tccacagcgcgagctgttggttggt

SEQ ID NO: 353691 - DNA, 25 bp, Mus musculus
gccatggccctgctgttgtttctgg

SEQ ID NO: 353692 - DNA, 25 bp, Mus musculus
aagaaagcgaagctcccggatcgca

SEQ ID NO: 353693 - DNA, 25 bp, Mus musculus
tcccgggttgagcagacaatagacc

SEQ ID NO: 353694 - DNA, 25 bp, Mus musculus
ttgctcccgggttgagcagacaata

SEQ ID NO: 353695 - DNA, 25 bp, Mus musculus
tcttggtcgtggctcccgttgctcc

SEQ ID NO: 353696 - DNA, 25 bp, Mus musculus
acttttgtgtcctgccgcctgagtt

SEQ ID NO: 353697 - DNA, 25 bp, Mus musculus
gtcgggctgaagctttacggtttca

SEQ ID NO: 353698 - DNA, 25 bp, Mus musculus
cgcccgctacgtcgggctgaagctt

SEQ ID NO: 353699 - DNA, 25 bp, Mus musculus
gagggctccttgaaagcaccgcgcc

SEQ ID NO: 353700 - DNA, 25 bp, Mus musculus
ctcccggatcgcagggaattcccga

SEQ ID NO: 353701 - DNA, 25 bp, Mus musculus
tgcgaacttggaggaacccgaacta

SEQ ID NO: 353702 - DNA, 25 bp, Mus musculus
ctgagttccgctcttggtcgtggct

SEQ ID NO: 353703 - DNA, 25 bp, Mus musculus
ggcatcccagcaggtcctcgcttcg

SEQ ID NO: 353704 - DNA, 25 bp, Mus musculus
cagggaattcccgaagcccaggcgg

SEQ ID NO: 353705 - DNA, 25 bp, Mus musculus
tacggtttcacttttgtgtcctgcc

SEQ ID NO: 353706 - DNA, 25 bp, Mus musculus
cacaaatctggataccgggcctggc

SEQ ID NO: 353707 - DNA, 25 bp, Mus musculus
cgacagcgttgatagcgcccacaaa

SEQ ID NO: 353708 - DNA, 25 bp, Mus musculus
tggataccgggcctggctcaatgag

SEQ ID NO: 353709 - DNA, 25 bp, Mus musculus
cgaggaaaccgcagactccgggtcg

SEQ ID NO: 353710 - DNA, 25 bp, Mus musculus
tgcgctgccgaggaaaccgcagact

SEQ ID NO: 353711 - DNA, 25 bp, Mus musculus
gctcaatgaggttcaagacagctcc

SEQ ID NO: 353712 - DNA, 25 bp, Mus musculus
cacctgctgggcagacacgtgcgct

SEQ ID NO: 353713 - DNA, 25 bp, Mus musculus
atcgtcatagagtggatggggcctt

SEQ ID NO: 353714 - DNA, 25 bp, Mus musculus
cgtaggaacggactatcgtcataga

SEQ ID NO: 353715 - DNA, 25 bp, Mus musculus
ctccggcgtaggaacggactatcgt

SEQ ID NO: 353716 - DNA, 25 bp, Mus musculus
catcggcctgcaaggctccggcgta

SEQ ID NO: 353717 - DNA, 25 bp, Mus musculus
aagacagctccatcggcctgcaagg

SEQ ID NO: 353718 - DNA, 25 bp, Mus musculus
tagcgcccacaaatctggataccgg

SEQ ID NO: 353719 - DNA, 25 bp, Mus musculus
cagacacgtgcgctgccgaggaaac

SEQ ID NO: 353720 - DNA, 25 bp, Mus musculus
gcatacagtcctgcaagccagcgga

SEQ ID NO: 353721 - DNA, 25 bp, Mus musculus
agagctcgaactctgctgcctcgca

SEQ ID NO: 353722 - DNA, 25 bp, Mus musculus
tcctgcaagccagcggaaagggcga

SEQ ID NO: 353723 - DNA, 25 bp, Mus musculus
ggcgcgaagaaagcgcatacagtcc

SEQ ID NO: 353724 - DNA, 25 bp, Mus musculus
tggcggaagaagagctcgaactctg

SEQ ID NO: 353725 - DNA, 25 bp, Mus musculus
gggagcggggattttcttccagtca

SEQ ID NO: 353726 - DNA, 25 bp, Mus musculus
cttccagtcagaggagtacggtacg

SEQ ID NO: 353727 - DNA, 25 bp, Mus musculus
gtgctggtcgcggaactacctgcat

SEQ ID NO: 353728 - DNA, 25 bp, Mus musculus
ggaactacctgcatcccgcagacgg

SEQ ID NO: 353729 - DNA, 25 bp, Mus musculus
ccaactcacacgaaaggagggcctt

SEQ ID NO: 353730 - DNA, 25 bp, Mus musculus
ggcactggtccagagaaccaactca

SEQ ID NO: 353731 - DNA, 25 bp, Mus musculus
ggtacacaggctcccgactaatggc

SEQ ID NO: 353732 - DNA, 25 bp, Mus musculus
cgccatggtagcctgatagaggtcg

SEQ ID NO: 353733 - DNA, 25 bp, Mus musculus
acgccagtagcccagcgccatggta

SEQ ID NO: 353734 - DNA, 25 bp, Mus musculus
ggcctactcaatcaaagacaagctg

SEQ ID NO: 353735 - DNA, 25 bp, Mus musculus
gtaccttcaaggctagccacggctg

SEQ ID NO: 353736 - DNA, 25 bp, Mus musculus
tgccctcagagcgtgcatcacgatg

SEQ ID NO: 353737 - DNA, 25 bp, Mus musculus
tgcatgcaggaaccaccatggtaga

SEQ ID NO: 353738 - DNA, 25 bp, Mus musculus
agagctaccttgagagccgcgcttc

SEQ ID NO: 353739 - DNA, 25 bp, Mus musculus
gccgcgcttcacctcaagagttgtc

SEQ ID NO: 353740 - DNA, 25 bp, Mus musculus
cctcagctcgaagagtggatccgtc

SEQ ID NO: 353741 - DNA, 25 bp, Mus musculus
taatgaagctgatgtgcgcacgcgc

SEQ ID NO: 353742 - DNA, 25 bp, Mus musculus
cgtgaagatgactttccgcaaggcc

SEQ ID NO: 353743 - DNA, 25 bp, Mus musculus
caagctgcaagccatcgagcgcgtc

SEQ ID NO: 353744 - DNA, 25 bp, Mus musculus
cgtctactcgtggttcctcaccttg

SEQ ID NO: 353745 - DNA, 25 bp, Mus musculus
tatccgggccagttatccaagcgca

SEQ ID NO: 353746 - DNA, 25 bp, Mus musculus
ccaagctgcgctggtttttggacca

SEQ ID NO: 353747 - DNA, 25 bp, Mus musculus
ctgaggcctttgctcgccagatcta

SEQ ID NO: 353748 - DNA, 25 bp, Mus musculus
tcccacctgcttggatgaggcctcg

SEQ ID NO: 353749 - DNA, 25 bp, Mus musculus
tagaactgctttgaccgacagaagc

SEQ ID NO: 353750 - DNA, 25 bp, Mus musculus
gtcccgcccactagaactgctttga

SEQ ID NO: 353751 - DNA, 25 bp, Mus musculus
tctctcgtccttgcggcagcgggtc

SEQ ID NO: 353752 - DNA, 25 bp, Mus musculus
tggccttctctcgtccttgcggcag

SEQ ID NO: 353753 - DNA, 25 bp, Mus musculus
atcctgctctgagctggccttctct

SEQ ID NO: 353754 - DNA, 25 bp, Mus musculus
ggcttacgaactcctcccattagaa

SEQ ID NO: 353755 - DNA, 25 bp, Mus musculus
tcgcctcccacctgcttggatgagg

SEQ ID NO: 353756 - DNA, 25 bp, Mus musculus
ctgcttggatgaggcctcgggcaat

SEQ ID NO: 353757 - DNA, 25 bp, Mus musculus
tcgggcaatggcctccgccatgcgg

SEQ ID NO: 353758 - DNA, 25 bp, Mus musculus
acgaagcccacacgccgaggttcag

SEQ ID NO: 353759 - DNA, 25 bp, Mus musculus
cacacgccgaggttcagacattgtc

SEQ ID NO: 353760 - DNA, 25 bp, Mus musculus
ttcagacattgtcgccgccatcctg

SEQ ID NO: 353761 - DNA, 25 bp, Mus musculus
actcctcccattagaacgaaagctc

SEQ ID NO: 353762 - DNA, 25 bp, Mus musculus
catggctccaccgttaccaagatga

SEQ ID NO: 353763 - DNA, 25 bp, Mus musculus
tcacggccatctgggaaaccgagtc

SEQ ID NO: 353764 - DNA, 25 bp, Mus musculus
tacggccctgaccagcctgcgagat

SEQ ID NO: 353765 - DNA, 25 bp, Mus musculus
tgcgagacgtactcttacggccctg

SEQ ID NO: 353766 - DNA, 25 bp, Mus musculus
taccaagatgagcaagggcccgggc

SEQ ID NO: 353767 - DNA, 25 bp, Mus musculus
ctcaggacgctggaattttttacgg

SEQ ID NO: 353768 - DNA, 25 bp, Mus musculus
tggagtctttgtcacgcgccagtga

SEQ ID NO: 353769 - DNA, 25 bp, Mus musculus
gctgcgccgaatccaactgtaaatc

SEQ ID NO: 353770 - DNA, 25 bp, Mus musculus
aactgtaaatctcacctgcgatggg

SEQ ID NO: 353771 - DNA, 25 bp, Mus musculus
tgcgatgggttccaccagcccaaga

SEQ ID NO: 353772 - DNA, 25 bp, Mus musculus
gcccaagagctacttccggtgcaca

SEQ ID NO: 353773 - DNA, 25 bp, Mus musculus
ccggtgcacaattctccagctattc

SEQ ID NO: 353774 - DNA, 25 bp, Mus musculus
tctccagctattcccggttcaagtg

SEQ ID NO: 353775 - DNA, 25 bp, Mus musculus
ccacgtagacccacaatgcgagacg

SEQ ID NO: 353776 - DNA, 25 bp, Mus musculus
ctaagccgctcaggtgatggaatgc

SEQ ID NO: 353777 - DNA, 25 bp, Mus musculus
atggaatgcaggtgcgcgccacgct

SEQ ID NO: 353778 - DNA, 25 bp, Mus musculus
gtcctccggctgaccgcaggaatct

SEQ ID NO: 353779 - DNA, 25 bp, Mus musculus
ccggatggctgcttgaaggctaagc

SEQ ID NO: 353780 - DNA, 25 bp, Mus musculus
gcggtagatgcatggaccgatcgtc

SEQ ID NO: 353781 - DNA, 25 bp, Mus musculus
agggttgcacactcggcctcggcgc

SEQ ID NO: 353782 - DNA, 25 bp, Mus musculus
catcgaggccctcgagggttgcaca

SEQ ID NO: 353783 - DNA, 25 bp, Mus musculus
accgatcgtccgcagacatcgaggc

SEQ ID NO: 353784 - DNA, 25 bp, Mus musculus
ttcgctttggcctctgtccgtagct

SEQ ID NO: 353785 - DNA, 25 bp, Mus musculus
ggccggctgcacttcgctttggcct

SEQ ID NO: 353786 - DNA, 25 bp, Mus musculus
acccgcctggatgctgctcggcttg

SEQ ID NO: 353787 - DNA, 25 bp, Mus musculus
gaatctggcccggaagtctgtgaca

SEQ ID NO: 353788 - DNA, 25 bp, Mus musculus
tcctagagtgcctacggatgtcctc

SEQ ID NO: 353789 - DNA, 25 bp, Mus musculus
gtccgtagctcctcgcttggttcgg

SEQ ID NO: 353790 - DNA, 25 bp, Mus musculus
tgcgcttgcgctgaagccgacccta

SEQ ID NO: 353791 - DNA, 25 bp, Mus musculus
tccgctggagagttgaagtcagtgc

SEQ ID NO: 353792 - DNA, 25 bp, Mus musculus
tttaagtagccggaagacgcttctg

SEQ ID NO: 353793 - DNA, 25 bp, Mus musculus
ctgattggcgtatttccgctggaga

SEQ ID NO: 353794 - DNA, 25 bp, Mus musculus
ctaacggcgatgctcctccggtgag

SEQ ID NO: 353795 - DNA, 25 bp, Mus musculus
gcgcgcacgggagttgacgtttaaa

SEQ ID NO: 353796 - DNA, 25 bp, Mus musculus
agttgacgtttaaaggtgcaggagc

SEQ ID NO: 353797 - DNA, 25 bp, Mus musculus
gatgctcctccggtgagctcggacc

SEQ ID NO: 353798 - DNA, 25 bp, Mus musculus
ctcttcccgagcgagctaacggcga

SEQ ID NO: 353799 - DNA, 25 bp, Mus musculus
cgaagctcgacgagagcgctgcttc

SEQ ID NO: 353800 - DNA, 25 bp, Mus musculus
agctgctgctctcggcgaagctcga

SEQ ID NO: 353801 - DNA, 25 bp, Mus musculus
cggccttcagatgcgccggcgtctt

SEQ ID NO: 353802 - DNA, 25 bp, Mus musculus
gtgctgctttgggttgctctgctcc

SEQ ID NO: 353803 - DNA, 25 bp, Mus musculus
tcgggtttcctgcttctggcaggta

SEQ ID NO: 353804 - DNA, 25 bp, Mus musculus
gctcgacaatccctgctccgaggga

SEQ ID NO: 353805 - DNA, 25 bp, Mus musculus
cagctgatacggcttcttcatttcg

SEQ ID NO: 353806 - DNA, 25 bp, Mus musculus
tgtctgccacgggtttctccggttc

SEQ ID NO: 353807 - DNA, 25 bp, Mus musculus
ctccggttcattgtcctgggcaatc

SEQ ID NO: 353808 - DNA, 25 bp, Mus musculus
atcttggtttcgctgtctgccacgg

SEQ ID NO: 353809 - DNA, 25 bp, Mus musculus
ctgggcaatcagctgatacggcttc

SEQ ID NO: 353810 - DNA, 25 bp, Mus musculus
ggcttcttcatttcgttctcctcaa

SEQ ID NO: 353811 - DNA, 25 bp, Mus musculus
ttcgttctcctcaatcaccgagttc

SEQ ID NO: 353812 - DNA, 25 bp, Mus musculus
cccatttcaacatctcggttcttca

SEQ ID NO: 353813 - DNA, 25 bp, Mus musculus
gtctacatcttggtttcgctgtctg

SEQ ID NO: 353814 - DNA, 25 bp, Mus musculus
gtcgggacaagtgctcgacaatccc

SEQ ID NO: 353815 - DNA, 25 bp, Mus musculus
ctccgagggagtcacccagtacgtt

SEQ ID NO: 353816 - DNA, 25 bp, Mus musculus
tcacccagtacgttggtggtggttc

SEQ ID NO: 353817 - DNA, 25 bp, Mus musculus
cggttcttcagttcatgtcgggaca

SEQ ID NO: 353818 - DNA, 25 bp, Mus musculus
tgcggcacaagctcgtgcacaccgg

SEQ ID NO: 353819 - DNA, 25 bp, Mus musculus
agaagccctacacctgcggggagtg

SEQ ID NO: 353820 - DNA, 25 bp, Mus musculus
ggattcacagcggagagaagcccta

SEQ ID NO: 353821 - DNA, 25 bp, Mus musculus
ggagaagcccttctactgcgacacc

SEQ ID NO: 353822 - DNA, 25 bp, Mus musculus
ccaggtcctttgagtgcctcgagtg

SEQ ID NO: 353823 - DNA, 25 bp, Mus musculus
agaagtcgaacctcctgcggcacaa

SEQ ID NO: 353824 - DNA, 25 bp, Mus musculus
tgaacaccggccctacgagtgcggc

SEQ ID NO: 353825 - DNA, 25 bp, Mus musculus
gcctggcgcagcatcgcaaaatcca

SEQ ID NO: 353826 - DNA, 25 bp, Mus musculus
cttcagcttgaaggaccgcctggcg

SEQ ID NO: 353827 - DNA, 25 bp, Mus musculus
tcacacaagcgaaaagcccttctgc

SEQ ID NO: 353828 - DNA, 25 bp, Mus musculus
cagtccacacgggaaccaggtcctt

SEQ ID NO: 353829 - DNA, 25 bp, Mus musculus
cttctgcgccaccagaggaatcaca

SEQ ID NO: 353830 - DNA, 25 bp, Mus musculus
gttccgctgggcttcaaaccttctg

SEQ ID NO: 353831 - DNA, 25 bp, Mus musculus
gcggcaaggcctttcggactaagga

SEQ ID NO: 353832 - DNA, 25 bp, Mus musculus
ggctcacctcgtcctccttgtggtt

SEQ ID NO: 353833 - DNA, 25 bp, Mus musculus
tgaccatcttgagggccatcgcggc

SEQ ID NO: 353834 - DNA, 25 bp, Mus musculus
cttgaccatcttgagggccatcgcg

SEQ ID NO: 353835 - DNA, 25 bp, Mus musculus
gatactgcccttgaccatcttgagg

SEQ ID NO: 353836 - DNA, 25 bp, Mus musculus
gaacatgcggtcgatactgcccttg

SEQ ID NO: 353837 - DNA, 25 bp, Mus musculus
agatcctgcaggttcttatcgaaca

SEQ ID NO: 353838 - DNA, 25 bp, Mus musculus
gcggaccagatcctgcaggttctta

SEQ ID NO: 353839 - DNA, 25 bp, Mus musculus
cggatgccgcggaccagatcctgca

SEQ ID NO: 353840 - DNA, 25 bp, Mus musculus
acccggcgaccgcacctcaggcaac

SEQ ID NO: 353841 - DNA, 25 bp, Mus musculus
acctcgtcctccttgtggttgcgga

SEQ ID NO: 353842 - DNA, 25 bp, Mus musculus
atggggtcgaggaagacggctccac

SEQ ID NO: 353843 - DNA, 25 bp, Mus musculus
gtcgatactgcccttgaccatcttg

SEQ ID NO: 353844 - DNA, 25 bp, Mus musculus
tcctccttgtggttgcggatgccgc

SEQ ID NO: 353845 - DNA, 25 bp, Mus musculus
aggttcttatcgaacatgcggtcga

SEQ ID NO: 353846 - DNA, 25 bp, Mus musculus
tagaaggacgctagctccgctcgct

SEQ ID NO: 353847 - DNA, 25 bp, Mus musculus
gtgcgcgctcacgtaaccgacataa

SEQ ID NO: 353848 - DNA, 25 bp, Mus musculus
atccatgcggttctggtcttcgacg

SEQ ID NO: 353849 - DNA, 25 bp, Mus musculus
gcgcttcttcatttcctgcagctga

SEQ ID NO: 353850 - DNA, 25 bp, Mus musculus
ctgcgtcatgttttccgcgcgcttc

SEQ ID NO: 353851 - DNA, 25 bp, Mus musculus
ccagctgcagctcctacatggggtg

SEQ ID NO: 353852 - DNA, 25 bp, Mus musculus
tcgaaagccgtcttctcatctagga

SEQ ID NO: 353853 - DNA, 25 bp, Mus musculus
gagatacccgttgtccgccttgagg

SEQ ID NO: 353854 - DNA, 25 bp, Mus musculus
ggttgctctgtagtttcctgcttgc

SEQ ID NO: 353855 - DNA, 25 bp, Mus musculus
gcaacgcgtactcgcgctgtaggta

SEQ ID NO: 353856 - DNA, 25 bp, Mus musculus
ccaggctttctgagagcaacgcgta

SEQ ID NO: 353857 - DNA, 25 bp, Mus musculus
gctgcgcctctctgttcaggaactc

SEQ ID NO: 353858 - DNA, 25 bp, Mus musculus
ataaagccggttctcttcgcgcagg

SEQ ID NO: 353859 - DNA, 25 bp, Mus musculus
gttttgtccgcgcttcttcttgggc

SEQ ID NO: 353860 - DNA, 25 bp, Mus musculus
tgcctctcgccatgtgtgctgccga

SEQ ID NO: 353861 - DNA, 25 bp, Mus musculus
cgcgcgtgcagcactgactaggaga

SEQ ID NO: 353862 - DNA, 25 bp, Mus musculus
tgcagcactgactaggagaaaccga

SEQ ID NO: 353863 - DNA, 25 bp, Mus musculus
agatacctgatcaagcggaggcttg

SEQ ID NO: 353864 - DNA, 25 bp, Mus musculus
ctgactaggagaaaccgagtggaga

SEQ ID NO: 353865 - DNA, 25 bp, Mus musculus
gagcatcgcggctgctggttcccaa

SEQ ID NO: 353866 - DNA, 25 bp, Mus musculus
tagcccagagatacctgatcaagcg

SEQ ID NO: 353867 - DNA, 25 bp, Mus musculus
tggaccgtcatgtagcccagagata

SEQ ID NO: 353868 - DNA, 25 bp, Mus musculus
ctccagagaaagaatcggtggaccc

SEQ ID NO: 353869 - DNA, 25 bp, Mus musculus
tcgcggctgctggttcccaagccaa

SEQ ID NO: 353870 - DNA, 25 bp, Mus musculus
caagccaacggatcaacaggtccag

SEQ ID NO: 353871 - DNA, 25 bp, Mus musculus
ggatcaacaggtccagctccagaga

SEQ ID NO: 353872 - DNA, 25 bp, Mus musculus
caggtccagctccagagaaagaatc

SEQ ID NO: 353873 - DNA, 25 bp, Mus musculus
tgctgccgaggtggaccgtcatgta

SEQ ID NO: 353874 - DNA, 25 bp, Mus musculus
ccgcagattatcctggagcaaagtg

SEQ ID NO: 353875 - DNA, 25 bp, Mus musculus
ggacacggaagagcctcctgcagtc

SEQ ID NO: 353876 - DNA, 25 bp, Mus musculus
tgcagtccctttccgtgaccctgtg

SEQ ID NO: 353877 - DNA, 25 bp, Mus musculus
cccttccaggtgaagactcaagtga

SEQ ID NO: 353878 - DNA, 25 bp, Mus musculus
gtattgtctggcctcctctgagcgc

SEQ ID NO: 353879 - DNA, 25 bp, Mus musculus
tgtagggccaccaacgtgtgcagct

SEQ ID NO: 353880 - DNA, 25 bp, Mus musculus
aaacctccgcgtagccctggtcatg

SEQ ID NO: 353881 - DNA, 25 bp, Mus musculus
taccaggtgctggagctgtgaactc

SEQ ID NO: 353882 - DNA, 25 bp, Mus musculus
tgcaccagagtatcgcaaacgcctg

SEQ ID NO: 353883 - DNA, 25 bp, Mus musculus
caatcgctcaagtcgggagtcctcc

SEQ ID NO: 353884 - DNA, 25 bp, Mus musculus
cacagaagttcgcaggcagagctca

SEQ ID NO: 353885 - DNA, 25 bp, Mus musculus
gacttcacaggcagaggctcaggcg

SEQ ID NO: 353886 - DNA, 25 bp, Mus musculus
tcaggcggccaatcaggctctgatc

SEQ ID NO: 353887 - DNA, 25 bp, Mus musculus
gctgtgaactcccatcgtccgcttt

SEQ ID NO: 353888 - DNA, 25 bp, Mus musculus
gctggtctggaaacggaagtcatca

SEQ ID NO: 353889 - DNA, 25 bp, Mus musculus
gacccagagtttcactgactgtttg

SEQ ID NO: 353890 - DNA, 25 bp, Mus musculus
gggagccagcacctcgtcttcacaa

SEQ ID NO: 353891 - DNA, 25 bp, Mus musculus
ttgcttggcatggaaaacgctggcc

SEQ ID NO: 353892 - DNA, 25 bp, Mus musculus
tggatggcacgtattccagccgttg

SEQ ID NO: 353893 - DNA, 25 bp, Mus musculus
ggtgaccagcacctaaggcaaagtc

SEQ ID NO: 353894 - DNA, 25 bp, Mus musculus
aggcaaagtcatcagggtccgcaaa

SEQ ID NO: 353895 - DNA, 25 bp, Mus musculus
tgctgctgatagagctggtcccgtt

SEQ ID NO: 353896 - DNA, 25 bp, Mus musculus
ccctcagcctgggacgcaaagatga

SEQ ID NO: 353897 - DNA, 25 bp, Mus musculus
tcaccgtgactgaggaatgtttgtc

SEQ ID NO: 353898 - DNA, 25 bp, Mus musculus
cactgctccagctccatcgggtgtt

SEQ ID NO: 353899 - DNA, 25 bp, Mus musculus
ggtcccactggtaatgctgctgata

SEQ ID NO: 353900 - DNA, 25 bp, Mus musculus
cggtgtccaggccttgtctcaaggt

SEQ ID NO: 353901 - DNA, 25 bp, Mus musculus
gcttgaaggcatccatttccaggtg

SEQ ID NO: 353902 - DNA, 25 bp, Mus musculus
aggtacaggtcatgtcctgacaata

SEQ ID NO: 353903 - DNA, 25 bp, Mus musculus
ctccgggaaaggtacaggtcatgtc

SEQ ID NO: 353904 - DNA, 25 bp, Mus musculus
tcctgacaatacctaggccgccaga

SEQ ID NO: 353905 - DNA, 25 bp, Mus musculus
ggccgccagagcgaatcgcactgtt

SEQ ID NO: 353906 - DNA, 25 bp, Mus musculus
atcgcactgttcagtctcctacttg

SEQ ID NO: 353907 - DNA, 25 bp, Mus musculus
cttgccagcgtgaccctggaaaatc

SEQ ID NO: 353908 - DNA, 25 bp, Mus musculus
gtccagagaccagacccaggtggca

SEQ ID NO: 353909 - DNA, 25 bp, Mus musculus
gccagcgccgctccggatttctaga

SEQ ID NO: 353910 - DNA, 25 bp, Mus musculus
cttagtcgctaggaaactggccagc

SEQ ID NO: 353911 - DNA, 25 bp, Mus musculus
ccggatttctagagcctcgtctttc

SEQ ID NO: 353912 - DNA, 25 bp, Mus musculus
agcctcgtctttccggacactgaag

SEQ ID NO: 353913 - DNA, 25 bp, Mus musculus
ttgaacctatttgaaaaccgatcgc

SEQ ID NO: 353914 - DNA, 25 bp, Mus musculus
ggaagttccggcttagtcgctagga

SEQ ID NO: 353915 - DNA, 25 bp, Mus musculus
cgatcccgggttcccagtgtggctt

SEQ ID NO: 353916 - DNA, 25 bp, Mus musculus
ccaccgtggagtgcgaggacagcca

SEQ ID NO: 353917 - DNA, 25 bp, Mus musculus
atgtacgcggatgacgggagcaccc

SEQ ID NO: 353918 - DNA, 25 bp, Mus musculus
agcttctgaagatcggagcagaccc

SEQ ID NO: 353919 - DNA, 25 bp, Mus musculus
caacaccaaggtgggctcagtgcgc

SEQ ID NO: 353920 - DNA, 25 bp, Mus musculus
ccatggccatccagctgctggcaga

SEQ ID NO: 353921 - DNA, 25 bp, Mus musculus
cgaggacagccacgggaacacgcct

SEQ ID NO: 353922 - DNA, 25 bp, Mus musculus
tcaaggaggtctgtgcttccttagc

SEQ ID NO: 353923 - DNA, 25 bp, Mus musculus
agatccgccaggtgctcaaggaggt

SEQ ID NO: 353924 - DNA, 25 bp, Mus musculus
acctggccttggtgcgccaggagca

SEQ ID NO: 353925 - DNA, 25 bp, Mus musculus
tgtcttgcaggcctacctggccttg

SEQ ID NO: 353926 - DNA, 25 bp, Mus musculus
atgaccgcgggtcatgtcttgcagg

SEQ ID NO: 353927 - DNA, 25 bp, Mus musculus
ccctacagcagtggcgctggggaca

SEQ ID NO: 353928 - DNA, 25 bp, Mus musculus
cgcgagctgcggaccctacagcagt

SEQ ID NO: 353929 - DNA, 25 bp, Mus musculus
gggaacacgcctctctccgaggcgg

SEQ ID NO: 353930 - DNA, 25 bp, Mus musculus
agcgcctgctgagatctcgctccag

SEQ ID NO: 353931 - DNA, 25 bp, Mus musculus
tgctcaaaactacagctcccaaagg

SEQ ID NO: 353932 - DNA, 25 bp, Mus musculus
gcctgacccggcagcgctttcttag

SEQ ID NO: 353933 - DNA, 25 bp, Mus musculus
atacgagctgtaggctccgacggcg

SEQ ID NO: 353934 - DNA, 25 bp, Mus musculus
cggcccgcgttcaatacgagctgta

SEQ ID NO: 353935 - DNA, 25 bp, Mus musculus
cacttcagcatgatgcgggcgggca

SEQ ID NO: 353936 - DNA, 25 bp, Mus musculus
ggttacaacgccagagcgggatgca

SEQ ID NO: 353937 - DNA, 25 bp, Mus musculus
tccacgtgccggttacaacgccaga

SEQ ID NO: 353938 - DNA, 25 bp, Mus musculus
gagcagtgccgcttatccaccgact

SEQ ID NO: 353939 - DNA, 25 bp, Mus musculus
ctggcacaacctgcagcgagcagtg

SEQ ID NO: 353940 - DNA, 25 bp, Mus musculus
gtagcggtaaatctcctctggcaca

SEQ ID NO: 353941 - DNA, 25 bp, Mus musculus
gcagctcctcgaggctacgactgta

SEQ ID NO: 353942 - DNA, 25 bp, Mus musculus
tggcgtctccgacgacccgtagcgg

SEQ ID NO: 353943 - DNA, 25 bp, Mus musculus
tcaccttaggtagctcgcgcagctg

SEQ ID NO: 353944 - DNA, 25 bp, Mus musculus
gggaaaccctcgtctctgcaccatg

SEQ ID NO: 353945 - DNA, 25 bp, Mus musculus
cggagcaggccgttaatgtaccgga

SEQ ID NO: 353946 - DNA, 25 bp, Mus musculus
agagcggagaccgaaacgcatttcc

SEQ ID NO: 353947 - DNA, 25 bp, Mus musculus
tacggcatagctacgagagcggaga

SEQ ID NO: 353948 - DNA, 25 bp, Mus musculus
cggaaatctcgcgacgtacggcata

SEQ ID NO: 353949 - DNA, 25 bp, Mus musculus
gagagctatagtcgccgtcgccatc

SEQ ID NO: 353950 - DNA, 25 bp, Mus musculus
gccgcgagggactcacttacgagag

SEQ ID NO: 353951 - DNA, 25 bp, Mus musculus
gacgactcactcctccgagctgagg

SEQ ID NO: 353952 - DNA, 25 bp, Mus musculus
ggaaactggagtcctcgagccggaa

SEQ ID NO: 353953 - DNA, 25 bp, Mus musculus
acagttgtcgcccagtctcggcaga

SEQ ID NO: 353954 - DNA, 25 bp, Mus musculus
gccaccggacgcctagacagttgtc

SEQ ID NO: 353955 - DNA, 25 bp, Mus musculus
gagcaggcaccaggacaccctaatg

SEQ ID NO: 353956 - DNA, 25 bp, Mus musculus
tgcaccatggcgcagagcaaatgct

SEQ ID NO: 353957 - DNA, 25 bp, Mus musculus
agagcaaatgctaacgggtccgccc

SEQ ID NO: 353958 - DNA, 25 bp, Mus musculus
ttgcgggtgggtctccatgctgccc

SEQ ID NO: 353959 - DNA, 25 bp, Mus musculus
gcttccaggcctggcagcggacgca

SEQ ID NO: 353960 - DNA, 25 bp, Mus musculus
gcacgactccgtcgggtgggcacca

SEQ ID NO: 353961 - DNA, 25 bp, Mus musculus
cactactgtccctaagttctgctgg

SEQ ID NO: 353962 - DNA, 25 bp, Mus musculus
aagttctgctggactccctccagtc

SEQ ID NO: 353963 - DNA, 25 bp, Mus musculus
catacccgggcgttcatggccttgt

SEQ ID NO: 353964 - DNA, 25 bp, Mus musculus
catggccttgtggttcttcttggtc

SEQ ID NO: 353965 - DNA, 25 bp, Mus musculus
tcttcttggtctttttgaggaactg

SEQ ID NO: 353966 - DNA, 25 bp, Mus musculus
tttgaggaactgcttgaggctgcca

SEQ ID NO: 353967 - DNA, 25 bp, Mus musculus
tgaggctgccagacgacacgtattc

SEQ ID NO: 353968 - DNA, 25 bp, Mus musculus
tctgtgatgaagatgacctgcgggc

SEQ ID NO: 353969 - DNA, 25 bp, Mus musculus
gcctgtggcttcactccgcccttca

SEQ ID NO: 353970 - DNA, 25 bp, Mus musculus
cagcggacgcacgactccgtcgggt

SEQ ID NO: 353971 - DNA, 25 bp, Mus musculus
cgacacgtattctgtgatgaagatg

SEQ ID NO: 353972 - DNA, 25 bp, Mus musculus
aggctgcgcttaccttttctgactc

SEQ ID NO: 353973 - DNA, 25 bp, Mus musculus
cccaacctcgatcgactgaatttca

SEQ ID NO: 353974 - DNA, 25 bp, Mus musculus
cgatcgactgaatttcaaacccaga

SEQ ID NO: 353975 - DNA, 25 bp, Mus musculus
ccagagaggactgggcttgcatagt

SEQ ID NO: 353976 - DNA, 25 bp, Mus musculus
ttgcatagttagcacacgccggctg

SEQ ID NO: 353977 - DNA, 25 bp, Mus musculus
tgctctcggtccgaacaggacctta

SEQ ID NO: 353978 - DNA, 25 bp, Mus musculus
aggaccttacctaccaatatggcta

SEQ ID NO: 353979 - DNA, 25 bp, Mus musculus
aatatggctagctttactccggcgc

SEQ ID NO: 353980 - DNA, 25 bp, Mus musculus
tttactccggcgctcagcaaacaga

SEQ ID NO: 353981 - DNA, 25 bp, Mus musculus
cccagcaggtagctcggagtaacag

SEQ ID NO: 353982 - DNA, 25 bp, Mus musculus
ggctacagaaggctgcgcttacctt

SEQ ID NO: 353983 - DNA, 25 bp, Mus musculus
actctgggatgggaggaagacaccc

SEQ ID NO: 353984 - DNA, 25 bp, Mus musculus
tcggagtaacagcttagcgagcggc

SEQ ID NO: 353985 - DNA, 25 bp, Mus musculus
tcagcaaacagaaaagtgggacgca

SEQ ID NO: 353986 - DNA, 25 bp, Mus musculus
agcaagcctgtgcaactgggatttg

SEQ ID NO: 353987 - DNA, 25 bp, Mus musculus
agggacgcgaagcaagcctgtgcaa

SEQ ID NO: 353988 - DNA, 25 bp, Mus musculus
gcctgtgcaactgggatttgaactt

SEQ ID NO: 353989 - DNA, 25 bp, Mus musculus
gatttgaacttgaccccgcctggtc

SEQ ID NO: 353990 - DNA, 25 bp, Mus musculus
tctctcgctttcctccgcagggttt

SEQ ID NO: 353991 - DNA, 25 bp, Mus musculus
cccggctcattgtgccttctcctca

SEQ ID NO: 353992 - DNA, 25 bp, Mus musculus
gccttctcctcacgccggcccaaga

SEQ ID NO: 353993 - DNA, 25 bp, Mus musculus
tgactcctacaaagaggggagctgg

SEQ ID NO: 353994 - DNA, 25 bp, Mus musculus
ccaaccgcccgcctagcatggtgcg

SEQ ID NO: 353995 - DNA, 25 bp, Mus musculus
cgcgcgccgacatgggcgagaagct

SEQ ID NO: 353996 - DNA, 25 bp, Mus musculus
ctcaagtcgcctgtgggcgccgagc

SEQ ID NO: 353997 - DNA, 25 bp, Mus musculus
gctgccggtctacgtgagtgtactt

SEQ ID NO: 353998 - DNA, 25 bp, Mus musculus
ccggtctacgtgagtgtacttgcgg

SEQ ID NO: 353999 - DNA, 25 bp, Mus musculus
cccggctctgtgactcctacaaaga

SEQ ID NO: 354000 - DNA, 25 bp, Mus musculus
gctccgggaattgggaggcgcgggc

SEQ ID NO: 354001 - DNA, 25 bp, Mus musculus
cggtgctggactgtagctcgatcca

SEQ ID NO: 354002 - DNA, 25 bp, Mus musculus
actgtagctcgatccagggcggcag

SEQ ID NO: 354003 - DNA, 25 bp, Mus musculus
gtcctcccagaccactcctgcttcc

SEQ ID NO: 354004 - DNA, 25 bp, Mus musculus
caaagctccgcctcaaagagacgcg

SEQ ID NO: 354005 - DNA, 25 bp, Mus musculus
cccaggcacgcctcgtcctcccaga

SEQ ID NO: 354006 - DNA, 25 bp, Mus musculus
tgtagctcgatccagggcggcagaa

SEQ ID NO: 354007 - DNA, 25 bp, Mus musculus
gcctcgtcctcccagaccactcctg

SEQ ID NO: 354008 - DNA, 25 bp, Mus musculus
gactgtagctcgatccagggcggca

SEQ ID NO: 354009 - DNA, 25 bp, Mus musculus
ctggactgtagctcgatccagggcg

SEQ ID NO: 354010 - DNA, 25 bp, Mus musculus
tgctggactgtagctcgatccaggg

SEQ ID NO: 354011 - DNA, 25 bp, Mus musculus
gtgctggactgtagctcgatccagg

SEQ ID NO: 354012 - DNA, 25 bp, Mus musculus
gccggtgctggactgtagctcgatc

SEQ ID NO: 354013 - DNA, 25 bp, Mus musculus
gtagctcgatccagggcggcagaac

SEQ ID NO: 354014 - DNA, 25 bp, Mus musculus
ttgctggactgtgccgcagcctcca

SEQ ID NO: 354015 - DNA, 25 bp, Mus musculus
ttggagtaagcactgacatcacgca

SEQ ID NO: 354016 - DNA, 25 bp, Mus musculus
agccggcggtcgagccagagccact

SEQ ID NO: 354017 - DNA, 25 bp, Mus musculus
gccagagccactgacgctgtacggg

SEQ ID NO: 354018 - DNA, 25 bp, Mus musculus
cgctgtacgggctgtagtagccctt

SEQ ID NO: 354019 - DNA, 25 bp, Mus musculus
gtagtagcccttgctggactgtgcc

SEQ ID NO: 354020 - DNA, 25 bp, Mus musculus
ccatgctacggtccagagcgtcctt

SEQ ID NO: 354021 - DNA, 25 bp, Mus musculus
agagcgtccttgtaggagatcttga

SEQ ID NO: 354022 - DNA, 25 bp, Mus musculus
agatcttgagcttggtcttggggca

SEQ ID NO: 354023 - DNA, 25 bp, Mus musculus
gcacgtgaggtacttggagtaagca

SEQ ID NO: 354024 - DNA, 25 bp, Mus musculus
tgcgggcatccacagtgccacgttg

SEQ ID NO: 354025 - DNA, 25 bp, Mus musculus
gtgccacgttgcagagcttcgtcga

SEQ ID NO: 354026 - DNA, 25 bp, Mus musculus
acatcacgcagcttctgggctgtgc

SEQ ID NO: 354027 - DNA, 25 bp, Mus musculus
ccctggagccggtgcgtgaaccagt

SEQ ID NO: 354028 - DNA, 25 bp, Mus musculus
acttgacgacgccatctgaggagga

SEQ ID NO: 354029 - DNA, 25 bp, Mus musculus
tgatggcgtcgtcgatgtcatactg

SEQ ID NO: 354030 - DNA, 25 bp, Mus musculus
tgtcatactggcgaccagagcggcg

SEQ ID NO: 354031 - DNA, 25 bp, Mus musculus
cggcggtcgatgatcatagacttga

SEQ ID NO: 354032 - DNA, 25 bp, Mus musculus
agatggtgatctcttcccactcaca

SEQ ID NO: 354033 - DNA, 25 bp, Mus musculus
caggtacgtctggtggtcaatgaga

SEQ ID NO: 354034 - DNA, 25 bp, Mus musculus
actggtccagtgctgagcggtcaat

SEQ ID NO: 354035 - DNA, 25 bp, Mus musculus
caatgagacccttgcggtaggcctc

SEQ ID NO: 354036 - DNA, 25 bp, Mus musculus
taccagcgcggtactggtccagtgc

SEQ ID NO: 354037 - DNA, 25 bp, Mus musculus
ggcctcgtacacagacatctccttg

SEQ ID NO: 354038 - DNA, 25 bp, Mus musculus
acttggaggatgtcttccgttcccg

SEQ ID NO: 354039 - DNA, 25 bp, Mus musculus
ctcagtgatcgaaagcgtaccagcg

SEQ ID NO: 354040 - DNA, 25 bp, Mus musculus
caatgaggttcttggtgatggcgtc

SEQ ID NO: 354041 - DNA, 25 bp, Mus musculus
gctccgacaactccaggtacgtctg

SEQ ID NO: 354042 - DNA, 25 bp, Mus musculus
gtagcgccaggcagattccatctcc

SEQ ID NO: 354043 - DNA, 25 bp, Mus musculus
tggttaccctcccagcctgaaagtc

SEQ ID NO: 354044 - DNA, 25 bp, Mus musculus
ccttattgaggtagccgcgttggta

SEQ ID NO: 354045 - DNA, 25 bp, Mus musculus
agggatcagctccttcttcatggcc

SEQ ID NO: 354046 - DNA, 25 bp, Mus musculus
aaccagttacagctcgctcggcaga

SEQ ID NO: 354047 - DNA, 25 bp, Mus musculus
ttccagcaataagcgggccacctcg

SEQ ID NO: 354048 - DNA, 25 bp, Mus musculus
cgcctgtgccgtaaaggtagcgcca

SEQ ID NO: 354049 - DNA, 25 bp, Mus musculus
cttcacggaggttcttggtgccttc

SEQ ID NO: 354050 - DNA, 25 bp, Mus musculus
aatgatcatgcgttccttggttacc

SEQ ID NO: 354051 - DNA, 25 bp, Mus musculus
cacgtagtcataggaggccaggttc

SEQ ID NO: 354052 - DNA, 25 bp, Mus musculus
ctccgggatcatgtttgactgcatc

SEQ ID NO: 354053 - DNA, 25 bp, Mus musculus
cacccgggatgtcaatctgcgtctc

SEQ ID NO: 354054 - DNA, 25 bp, Mus musculus
tcccggaagaggttgtaggtctcaa

SEQ ID NO: 354055 - DNA, 25 bp, Mus musculus
cggatgatctcggtcttctcgatga

SEQ ID NO: 354056 - DNA, 25 bp, Mus musculus
tccgccgtgaagtactccgagttga

SEQ ID NO: 354057 - DNA, 25 bp, Mus musculus
tggctgtgcacaggatcaatgatgc

SEQ ID NO: 354058 - DNA, 25 bp, Mus musculus
tgcggttcatctcttcatcgaagta

SEQ ID NO: 354059 - DNA, 25 bp, Mus musculus
tgggtcagacaagatgcggttcatc

SEQ ID NO: 354060 - DNA, 25 bp, Mus musculus
ctggtagagttcgtggctgatgacc

SEQ ID NO: 354061 - DNA, 25 bp, Mus musculus
cacggaggccctcaaagcagagctg

SEQ ID NO: 354062 - DNA, 25 bp, Mus musculus
tgatgattttctccaccgtgatgtg

SEQ ID NO: 354063 - DNA, 25 bp, Mus musculus
atctcccagatggtcacggtcctgc

SEQ ID NO: 354064 - DNA, 25 bp, Mus musculus
cctggaacttgccaaacggtgcaga

SEQ ID NO: 354065 - DNA, 25 bp, Mus musculus
cacggtggccttttcgaagacgtca

SEQ ID NO: 354066 - DNA, 25 bp, Mus musculus
cgggcctccgtatcggtgtacacca

SEQ ID NO: 354067 - DNA, 25 bp, Mus musculus
cccttggcagccttatctgtgagtg

SEQ ID NO: 354068 - DNA, 25 bp, Mus musculus
gcccttggtgtcatcgcttgggtca

SEQ ID NO: 354069 - DNA, 25 bp, Mus musculus
tcgtgttcctccaccactgtgatga

SEQ ID NO: 354070 - DNA, 25 bp, Mus musculus
tctgcccggaccttagccagttcag

SEQ ID NO: 354071 - DNA, 25 bp, Mus musculus
aggcgccgtgcttcttcaaccttgg

SEQ ID NO: 354072 - DNA, 25 bp, Mus musculus
caaccttggccttgagtcgctcgac

SEQ ID NO: 354073 - DNA, 25 bp, Mus musculus
ctgctccttgctgcgcattgtgtcc

SEQ ID NO: 354074 - DNA, 25 bp, Mus musculus
ggcggctttctcaaagctcaccttc

SEQ ID NO: 354075 - DNA, 25 bp, Mus musculus
ctgtcgcagggtgtcctccaccaag

SEQ ID NO: 354076 - DNA, 25 bp, Mus musculus
agctcgctctctgatgccttgcgca

SEQ ID NO: 354077 - DNA, 25 bp, Mus musculus
gccttgctggccagaagtacctcca

SEQ ID NO: 354078 - DNA, 25 bp, Mus musculus
cgctcctcgatgtcagccttgtgca

SEQ ID NO: 354079 - DNA, 25 bp, Mus musculus
tccttctctttgagtgcaatctctg

SEQ ID NO: 354080 - DNA, 25 bp, Mus musculus
atggcagccagcttctcagtaagca

SEQ ID NO: 354081 - DNA, 25 bp, Mus musculus
cctctgcttagacttttcgctggta

SEQ ID NO: 354082 - DNA, 25 bp, Mus musculus
cgctggtagagcgagactcttcctc

SEQ ID NO: 354083 - DNA, 25 bp, Mus musculus
cgctgctgcaccacaaaggcgtgtg

SEQ ID NO: 354084 - DNA, 25 bp, Mus musculus
ttggctattggcacggcctggatct

SEQ ID NO: 354085 - DNA, 25 bp, Mus musculus
agtgacacgttctcgccagcgctca

SEQ ID NO: 354086 - DNA, 25 bp, Mus musculus
gctccagcaactgagtgacacgttc

SEQ ID NO: 354087 - DNA, 25 bp, Mus musculus
tgggctagaacagcctgccagcgct

SEQ ID NO: 354088 - DNA, 25 bp, Mus musculus
ccgcacatctgtctgggctagaaca

SEQ ID NO: 354089 - DNA, 25 bp, Mus musculus
agctggcggcccagctgctcgagct

SEQ ID NO: 354090 - DNA, 25 bp, Mus musculus
atagtagcgaagctggcggcccagc

SEQ ID NO: 354091 - DNA, 25 bp, Mus musculus
gctgttctcgcgcagcctgacagtt

SEQ ID NO: 354092 - DNA, 25 bp, Mus musculus
gcacggcctggatctgctcttgccg

SEQ ID NO: 354093 - DNA, 25 bp, Mus musculus
ttggcatcctgcagccaggcgctca

SEQ ID NO: 354094 - DNA, 25 bp, Mus musculus
aggcgctcagaggatccgcgctctc

SEQ ID NO: 354095 - DNA, 25 bp, Mus musculus
ggatccgcgctctcacgatagtagc

SEQ ID NO: 354096 - DNA, 25 bp, Mus musculus
ctctcacgatagtagcgaagctggc

SEQ ID NO: 354097 - DNA, 25 bp, Mus musculus
cctgacagttggctattggcacggc

SEQ ID NO: 354098 - DNA, 25 bp, Mus musculus
gcgaagtgaagactcccttcgccgc

SEQ ID NO: 354099 - DNA, 25 bp, Mus musculus
agcaaactagctcgcgggaactcga

SEQ ID NO: 354100 - DNA, 25 bp, Mus musculus
ggacgcaatacccagacccggagaa

SEQ ID NO: 354101 - DNA, 25 bp, Mus musculus
tgaaggccctggcttccacgttcgc

SEQ ID NO: 354102 - DNA, 25 bp, Mus musculus
tgttgaaggctgaaggccctggctt

SEQ ID NO: 354103 - DNA, 25 bp, Mus musculus
tgccctgggctgctcgcagacgaca

SEQ ID NO: 354104 - DNA, 25 bp, Mus musculus
cgaaagccgtgcttgtgttgaaggc

SEQ ID NO: 354105 - DNA, 25 bp, Mus musculus
gctcgcagacgacacgaaagccgtg

SEQ ID NO: 354106 - DNA, 25 bp, Mus musculus
cacctacacaacagagttgcccgta

SEQ ID NO: 354107 - DNA, 25 bp, Mus musculus
acagagttgcccgtagaggtagccc

SEQ ID NO: 354108 - DNA, 25 bp, Mus musculus
agcagggacgctccagcaggacctc

SEQ ID NO: 354109 - DNA, 25 bp, Mus musculus
agcaggacctccctctgcgaagtga

SEQ ID NO: 354110 - DNA, 25 bp, Mus musculus
ccctctgcgaagtgaagactccctt

SEQ ID NO: 354111 - DNA, 25 bp, Mus musculus
actagctcgcgggaactcgagggaa

SEQ ID NO: 354112 - DNA, 25 bp, Mus musculus
ccagacgtcagcagatgggccatgc

SEQ ID NO: 354113 - DNA, 25 bp, Mus musculus
cgaatgactgagctctgttgggaca

SEQ ID NO: 354114 - DNA, 25 bp, Mus musculus
cagaggctccgtacctttgtacttc

SEQ ID NO: 354115 - DNA, 25 bp, Mus musculus
ctcctcgtaggcctggatgaaatcc

SEQ ID NO: 354116 - DNA, 25 bp, Mus musculus
atgaaatcctgttcgtcgggtggtg

SEQ ID NO: 354117 - DNA, 25 bp, Mus musculus
cgcgcgcacggcttaaagaggcctc

SEQ ID NO: 354118 - DNA, 25 bp, Mus musculus
tgacaggactcggtctaaggtggcc

SEQ ID NO: 354119 - DNA, 25 bp, Mus musculus
gccgtttcctttggccggctgcgac

SEQ ID NO: 354120 - DNA, 25 bp, Mus musculus
acttcacctggccaccggagtgagg

SEQ ID NO: 354121 - DNA, 25 bp, Mus musculus
tccctccgtcctaacagtggagata

SEQ ID NO: 354122 - DNA, 25 bp, Mus musculus
gagatacagttttggcatcgccgaa

SEQ ID NO: 354123 - DNA, 25 bp, Mus musculus
tcgccgaaatataagaggcgcttga

SEQ ID NO: 354124 - DNA, 25 bp, Mus musculus
ttggtgagacttgaggcgaatgact

SEQ ID NO: 354125 - DNA, 25 bp, Mus musculus
acatccagttgcaaacacttccctg

SEQ ID NO: 354126 - DNA, 25 bp, Mus musculus
tagcaacccaccagcttactgcgtg

SEQ ID NO: 354127 - DNA, 25 bp, Mus musculus
ccggagccgaagatatgactagatc

SEQ ID NO: 354128 - DNA, 25 bp, Mus musculus
accgggctacgtgccaagagtactg

SEQ ID NO: 354129 - DNA, 25 bp, Mus musculus
cgggcgcctccgaaaacgagcaaag

SEQ ID NO: 354130 - DNA, 25 bp, Mus musculus
agttctacgctcctggtggttccgc

SEQ ID NO: 354131 - DNA, 25 bp, Mus musculus
gctgtgaagcagcacctaattccgg

SEQ ID NO: 354132 - DNA, 25 bp, Mus musculus
ccagggaggtgttgatctctgcata

SEQ ID NO: 354133 - DNA, 25 bp, Mus musculus
agttccgcaatttcctgatcccagg

SEQ ID NO: 354134 - DNA, 25 bp, Mus musculus
gcggcgttttctgcccacactcaag

SEQ ID NO: 354135 - DNA, 25 bp, Mus musculus
gagcctgccttcatcgcggcgtttt

SEQ ID NO: 354136 - DNA, 25 bp, Mus musculus
gggcccttcagtggctgtctctgtt

SEQ ID NO: 354137 - DNA, 25 bp, Mus musculus
tcaacggtcctcaagctggtgcctc

SEQ ID NO: 354138 - DNA, 25 bp, Mus musculus
atgactagatcaggcggcactcacc

SEQ ID NO: 354139 - DNA, 25 bp, Mus musculus
ctgctccaagagcactggcgtgcga

SEQ ID NO: 354140 - DNA, 25 bp, Mus musculus
gccagcgccacaaaagtctcagaga

SEQ ID NO: 354141 - DNA, 25 bp, Mus musculus
tttcctcttgtcacgatagccggcg

SEQ ID NO: 354142 - DNA, 25 bp, Mus musculus
tgtcagcgcggaactgttctcattc

SEQ ID NO: 354143 - DNA, 25 bp, Mus musculus
taaacccggatagcgaggccttagc

SEQ ID NO: 354144 - DNA, 25 bp, Mus musculus
cgcctaccgaagacggaagtccatc

SEQ ID NO: 354145 - DNA, 25 bp, Mus musculus
actccacgatgagcgaagcgccttc

SEQ ID NO: 354146 - DNA, 25 bp, Mus musculus
gttagactcagagcactccacgatg

SEQ ID NO: 354147 - DNA, 25 bp, Mus musculus
ccagacatactaagcgtgaggtgta

SEQ ID NO: 354148 - DNA, 25 bp, Mus musculus
ctgcgcggttgaacagagtcagacg

SEQ ID NO: 354149 - DNA, 25 bp, Mus musculus
tctcagagagcgatctcggaagtcc

SEQ ID NO: 354150 - DNA, 25 bp, Mus musculus
ggacagcgcctgcaactctttctcg

SEQ ID NO: 354151 - DNA, 25 bp, Mus musculus
accagtcgccgcttggccactgtag

SEQ ID NO: 354152 - DNA, 25 bp, Mus musculus
cctaatttatgggtctgcgcggttg

SEQ ID NO: 354153 - DNA, 25 bp, Mus musculus
ctttgctcccggaagggatcgcttc

SEQ ID NO: 354154 - DNA, 25 bp, Mus musculus
ctacgagttcgagcagcagcggtac

SEQ ID NO: 354155 - DNA, 25 bp, Mus musculus
agcggcctccctgaaagggtgaaga

SEQ ID NO: 354156 - DNA, 25 bp, Mus musculus
cgcaggcgcccaagaaaacggataa

SEQ ID NO: 354157 - DNA, 25 bp, Mus musculus
gcacttaacctgtgcgcggccggcg

SEQ ID NO: 354158 - DNA, 25 bp, Mus musculus
gacttgggaagccacgtgtgtcctc

SEQ ID NO: 354159 - DNA, 25 bp, Mus musculus
gacaaccttcctccgattgcctgtg

SEQ ID NO: 354160 - DNA, 25 bp, Mus musculus
attagctgacagatctggcccgggg

SEQ ID NO: 354161 - DNA, 25 bp, Mus musculus
cagcggtaccgctacgcggagctct

SEQ ID NO: 354162 - DNA, 25 bp, Mus musculus
tggtggcgaaaaccacccgctacga

SEQ ID NO: 354163 - DNA, 25 bp, Mus musculus
accttcccgacctctgattagctga

SEQ ID NO: 354164 - DNA, 25 bp, Mus musculus
tcgggcagctcgaaagccaaataga

SEQ ID NO: 354165 - DNA, 25 bp, Mus musculus
ccaactggatttcttcgggcagctc

SEQ ID NO: 354166 - DNA, 25 bp, Mus musculus
gatcatgacttgctaccggggcttc

SEQ ID NO: 354167 - DNA, 25 bp, Mus musculus
tctcggaggaggacctgaagcagct

SEQ ID NO: 354168 - DNA, 25 bp, Mus musculus
cgaccgcctcgggtcagttggttcg

SEQ ID NO: 354169 - DNA, 25 bp, Mus musculus
accctcggggcgcattctgtggcca

SEQ ID NO: 354170 - DNA, 25 bp, Mus musculus
caagacgaccaatccaccctcgggg

SEQ ID NO: 354171 - DNA, 25 bp, Mus musculus
tgtagcggcccagacccgaagccca

SEQ ID NO: 354172 - DNA, 25 bp, Mus musculus
ctcacccagactggtggcatcattg

SEQ ID NO: 354173 - DNA, 25 bp, Mus musculus
tcagttggttcggtcaggactcgcg

SEQ ID NO: 354174 - DNA, 25 bp, Mus musculus
ctgtgttactgagcgcgaccgcctc

SEQ ID NO: 354175 - DNA, 25 bp, Mus musculus
cccttccctgtgttactgagcgcga

SEQ ID NO: 354176 - DNA, 25 bp, Mus musculus
atcccaagagtgtaccgccgccgta

SEQ ID NO: 354177 - DNA, 25 bp, Mus musculus
gaccaatcccaagagtgtaccgccg

SEQ ID NO: 354178 - DNA, 25 bp, Mus musculus
ggcaccgtaagcaccggtctctggc

SEQ ID NO: 354179 - DNA, 25 bp, Mus musculus
tgcgcagcgggcaccgtaagcaccg

SEQ ID NO: 354180 - DNA, 25 bp, Mus musculus
caggcgcaggcccaagcaatccggc

SEQ ID NO: 354181 - DNA, 25 bp, Mus musculus
gttcggtcaggactcgcggcccgct

SEQ ID NO: 354182 - DNA, 25 bp, Mus musculus
cgtcacagtatagggtttccgaatg

SEQ ID NO: 354183 - DNA, 25 bp, Mus musculus
gtctccctgacatttcgcggcgaag

SEQ ID NO: 354184 - DNA, 25 bp, Mus musculus
agccctctacagtttatcccgcgtg

SEQ ID NO: 354185 - DNA, 25 bp, Mus musculus
gggcaccaagcgtccgatccaaaag

SEQ ID NO: 354186 - DNA, 25 bp, Mus musculus
cggcgctgctttgtctttctcactg

SEQ ID NO: 354187 - DNA, 25 bp, Mus musculus
cccacgggctggctcattttaacaa

SEQ ID NO: 354188 - DNA, 25 bp, Mus musculus
gggccgcactgctagatagccttca

SEQ ID NO: 354189 - DNA, 25 bp, Mus musculus
tacctatgggcttggacttcgtgtg

SEQ ID NO: 354190 - DNA, 25 bp, Mus musculus
cgtcttgtgcgtgtcttggtaccaa

SEQ ID NO: 354191 - DNA, 25 bp, Mus musculus
cccggtgatatatgatgtgggcaca

SEQ ID NO: 354192 - DNA, 25 bp, Mus musculus
tggcttaatggctgggccgtacatc

SEQ ID NO: 354193 - DNA, 25 bp, Mus musculus
gtgccaccttccgttgctttcctaa

SEQ ID NO: 354194 - DNA, 25 bp, Mus musculus
cgccgccgctggaaaccaatgagtc

SEQ ID NO: 354195 - DNA, 25 bp, Mus musculus
tgtctgcaggaagtgttcgacctcc

SEQ ID NO: 354196 - DNA, 25 bp, Mus musculus
cggaagtcgtagtcctgaaggtcca

SEQ ID NO: 354197 - DNA, 25 bp, Mus musculus
gccagtcttcttggcgtacctactc

SEQ ID NO: 354198 - DNA, 25 bp, Mus musculus
actgaaaggcttaagtcgaacattc

SEQ ID NO: 354199 - DNA, 25 bp, Mus musculus
cagaaagccggggatgccacaagcc

SEQ ID NO: 354200 - DNA, 25 bp, Mus musculus
gcagttccctttgaccggaaagcga

SEQ ID NO: 354201 - DNA, 25 bp, Mus musculus
ggaagctatagttcaccgagactga

SEQ ID NO: 354202 - DNA, 25 bp, Mus musculus
tcctgaaggtccaggtcgagctgtc

SEQ ID NO: 354203 - DNA, 25 bp, Mus musculus
gactgtacatcatggccgggctgga

SEQ ID NO: 354204 - DNA, 25 bp, Mus musculus
cctgtccgatcagggttaccggata

SEQ ID NO: 354205 - DNA, 25 bp, Mus musculus
gcaggccgatggctcggcttacatc

SEQ ID NO: 354206 - DNA, 25 bp, Mus musculus
tcggcttacatcgagcagggcaaca

SEQ ID NO: 354207 - DNA, 25 bp, Mus musculus
caacaccaaggcactggcggtggtc

SEQ ID NO: 354208 - DNA, 25 bp, Mus musculus
cacatcaagggaggagacctaagtc

SEQ ID NO: 354209 - DNA, 25 bp, Mus musculus
agcgactaggctaccggaagctata

SEQ ID NO: 354210 - DNA, 25 bp, Mus musculus
gggtccgacaggaaccctgctcttg

SEQ ID NO: 354211 - DNA, 25 bp, Mus musculus
gcgatggatcctgggaccggaaatt

SEQ ID NO: 354212 - DNA, 25 bp, Mus musculus
accaagagtagtggcgcgatggatc

SEQ ID NO: 354213 - DNA, 25 bp, Mus musculus
ctccgtctgccgctaccaagagtag

SEQ ID NO: 354214 - DNA, 25 bp, Mus musculus
tgagcatgcgcacaatctggtttcc

SEQ ID NO: 354215 - DNA, 25 bp, Mus musculus
ctggcgacctcagttgtgagcatgc

SEQ ID NO: 354216 - DNA, 25 bp, Mus musculus
cggaaattaaggcagcaccgggcgc

SEQ ID NO: 354217 - DNA, 25 bp, Mus musculus
cctcagttttgagcacgcgcagagc

SEQ ID NO: 354218 - DNA, 25 bp, Mus musculus
cttctccagcctacctcagttttga

SEQ ID NO: 354219 - DNA, 25 bp, Mus musculus
caggcacactgtcgctgctctgtcg

SEQ ID NO: 354220 - DNA, 25 bp, Mus musculus
ctgcgttacactcccgagaaccttt

SEQ ID NO: 354221 - DNA, 25 bp, Mus musculus
tggccatgactgcatcccgtacttc

SEQ ID NO: 354222 - DNA, 25 bp, Mus musculus
ctgctctgtcgtgagatccgccagc

SEQ ID NO: 354223 - DNA, 25 bp, Mus musculus
cgagaacctttaggcaggcacactg

SEQ ID NO: 354224 - DNA, 25 bp, Mus musculus
tttgcccgggacttcgctgcccacc

SEQ ID NO: 354225 - DNA, 25 bp, Mus musculus
gggacttcgctgcccaccgcaagaa

SEQ ID NO: 354226 - DNA, 25 bp, Mus musculus
tggagaccgcgctcggagctttgcc

SEQ ID NO: 354227 - DNA, 25 bp, Mus musculus
ggagaccgcgctcggagctttgccc

SEQ ID NO: 354228 - DNA, 25 bp, Mus musculus
agaccgcgctcggagctttgcccgg

SEQ ID NO: 354229 - DNA, 25 bp, Mus musculus
cgctcggagctttgcccgggacttc

SEQ ID NO: 354230 - DNA, 25 bp, Mus musculus
agctttgcccgggacttcgctgccc

SEQ ID NO: 354231 - DNA, 25 bp, Mus musculus
tttgtaggtggagaccgcgctcgga

SEQ ID NO: 354232 - DNA, 25 bp, Mus musculus
gctgcccaccgcaagaagccggggt

SEQ ID NO: 354233 - DNA, 25 bp, Mus musculus
ctgcccaccgcaagaagccggggtg

SEQ ID NO: 354234 - DNA, 25 bp, Mus musculus
gctcggagctttgcccgggacttcg

SEQ ID NO: 354235 - DNA, 25 bp, Mus musculus
cctagcagcgggctggggatttcag

SEQ ID NO: 354236 - DNA, 25 bp, Mus musculus
tgcccaccgcaagaagccggggtga

SEQ ID NO: 354237 - DNA, 25 bp, Mus musculus
aagccggggtgagtgcctagcagcg

SEQ ID NO: 354238 - DNA, 25 bp, Mus musculus
ttccaggtcgggctaattccgagcc

SEQ ID NO: 354239 - DNA, 25 bp, Mus musculus
cagcgcacttacatgtctgagaatg

SEQ ID NO: 354240 - DNA, 25 bp, Mus musculus
catgtctgagaatgccatgggctcc

SEQ ID NO: 354241 - DNA, 25 bp, Mus musculus
gagctagcgttccaggtcgggctaa

SEQ ID NO: 354242 - DNA, 25 bp, Mus musculus
tgagaatgccatgggctccaccatg

SEQ ID NO: 354243 - DNA, 25 bp, Mus musculus
gggctaattccgagcccactctgta

SEQ ID NO: 354244 - DNA, 25 bp, Mus musculus
ccactctgtactctctcgcagtgtg

SEQ ID NO: 354245 - DNA, 25 bp, Mus musculus
actctctcgcagtgtgctgagctac

SEQ ID NO: 354246 - DNA, 25 bp, Mus musculus
tcgcagtgtgctgagctacgtggcc

SEQ ID NO: 354247 - DNA, 25 bp, Mus musculus
ctacgtggccgggatcgcctggttt

SEQ ID NO: 354248 - DNA, 25 bp, Mus musculus
atcgcctggtttctggcgctggctt

SEQ ID NO: 354249 - DNA, 25 bp, Mus musculus
tggcgctggcttttccgccgttaac

SEQ ID NO: 354250 - DNA, 25 bp, Mus musculus
gccgttaacccagcgcacttacatg

SEQ ID NO: 354251 - DNA, 25 bp, Mus musculus
atgccatgggctccaccatggtgga

SEQ ID NO: 354252 - DNA, 25 bp, Mus musculus
gcggcttcgcttcgccggacggtac

SEQ ID NO: 354253 - DNA, 25 bp, Mus musculus
cccactgtgttgctctcgcgtggtc

SEQ ID NO: 354254 - DNA, 25 bp, Mus musculus
ctaggtccgcccactgtgttgctct

SEQ ID NO: 354255 - DNA, 25 bp, Mus musculus
gtcccggcagcttccattgcggaca

SEQ ID NO: 354256 - DNA, 25 bp, Mus musculus
agcgactgccgaagccggctgtccg

SEQ ID NO: 354257 - DNA, 25 bp, Mus musculus
tctgagcccagggtcccactgtgat

SEQ ID NO: 354258 - DNA, 25 bp, Mus musculus
tggcagggcattgttgctctgagcc

SEQ ID NO: 354259 - DNA, 25 bp, Mus musculus
cccacgccttggagtggcagggcat

SEQ ID NO: 354260 - DNA, 25 bp, Mus musculus
ccagaaagccggtctgggtgcccac

SEQ ID NO: 354261 - DNA, 25 bp, Mus musculus
tgcgttcctcctacaactcgacggg

SEQ ID NO: 354262 - DNA, 25 bp, Mus musculus
ttgctctcgcgtggtctgagctctc

SEQ ID NO: 354263 - DNA, 25 bp, Mus musculus
cttccattgcggacaccgcaggtga

SEQ ID NO: 354264 - DNA, 25 bp, Mus musculus
gtctgagctctcgtcggcccgcagg

SEQ ID NO: 354265 - DNA, 25 bp, Mus musculus
gcttccaggtgcaagtgctccgggt

SEQ ID NO: 354266 - DNA, 25 bp, Mus musculus
gccctgtggttaaagtggaccattc

SEQ ID NO: 354267 - DNA, 25 bp, Mus musculus
agaggctcttcgtaaccgtggacca

SEQ ID NO: 354268 - DNA, 25 bp, Mus musculus
caataaggtttctcgtggtctggcc

SEQ ID NO: 354269 - DNA, 25 bp, Mus musculus
tccgagagtgcttccgtgatagaga

SEQ ID NO: 354270 - DNA, 25 bp, Mus musculus
gggcgggcatggttctaaccaatca

SEQ ID NO: 354271 - DNA, 25 bp, Mus musculus
agtcacctttcagcaggacccgaga

SEQ ID NO: 354272 - DNA, 25 bp, Mus musculus
tcgctgtttcgttctctggctggta

SEQ ID NO: 354273 - DNA, 25 bp, Mus musculus
ggtccggccaagctagtcacctttc

SEQ ID NO: 354274 - DNA, 25 bp, Mus musculus
ctcgctaagcgataggaatggtccc

SEQ ID NO: 354275 - DNA, 25 bp, Mus musculus
tgctgcgcactaccagagcctgatg

SEQ ID NO: 354276 - DNA, 25 bp, Mus musculus
aactgtcgagtacttccgccggcca

SEQ ID NO: 354277 - DNA, 25 bp, Mus musculus
ggcgacatttctgatccggcggagt

SEQ ID NO: 354278 - DNA, 25 bp, Mus musculus
agctgctgccctacacaagacaata

SEQ ID NO: 354279 - DNA, 25 bp, Mus musculus
cgccggccagaaactcggactgtga

SEQ ID NO: 354280 - DNA, 25 bp, Mus musculus
ccgtgtgctgcgttaatggagaagc

SEQ ID NO: 354281 - DNA, 25 bp, Mus musculus
tcagccaggttctcagcctcggaag

SEQ ID NO: 354282 - DNA, 25 bp, Mus musculus
ggacccagacaggtgaaacccagtc

SEQ ID NO: 354283 - DNA, 25 bp, Mus musculus
cgctcgtgaacttggctgctgatcc

SEQ ID NO: 354284 - DNA, 25 bp, Mus musculus
tgctggccaacctgagtcgcgagcc

SEQ ID NO: 354285 - DNA, 25 bp, Mus musculus
gcgacttgtcaacgcgctgtgcacg

SEQ ID NO: 354286 - DNA, 25 bp, Mus musculus
tgtgcacgccgagctacaacgcggc

SEQ ID NO: 354287 - DNA, 25 bp, Mus musculus
tggggccgctgctctccaaccttag

SEQ ID NO: 354288 - DNA, 25 bp, Mus musculus
tccaaccttagccagcaggcggagg

SEQ ID NO: 354289 - DNA, 25 bp, Mus musculus
tgcgtgcttttctcctggacccaga

SEQ ID NO: 354290 - DNA, 25 bp, Mus musculus
acagccagagttgttgcgggccttg

SEQ ID NO: 354291 - DNA, 25 bp, Mus musculus
ggaactgctgcccttcctggtgctc

SEQ ID NO: 354292 - DNA, 25 bp, Mus musculus
cccggcacgagaagtgactgagact

SEQ ID NO: 354293 - DNA, 25 bp, Mus musculus
tgatcccaatgtgcactggcagctg

SEQ ID NO: 354294 - DNA, 25 bp, Mus musculus
cgaatactctcgagaacagcgcttg

SEQ ID NO: 354295 - DNA, 25 bp, Mus musculus
cgagtccgaatactctcgagaacag

SEQ ID NO: 354296 - DNA, 25 bp, Mus musculus
cgcttgcgcagacggcgtctggcgc

SEQ ID NO: 354297 - DNA, 25 bp, Mus musculus
tccgaatactctcgagaacagcgct

SEQ ID NO: 354298 - DNA, 25 bp, Mus musculus
aatactctcgagaacagcgcttgcg

SEQ ID NO: 354299 - DNA, 25 bp, Mus musculus
atactctcgagaacagcgcttgcgc

SEQ ID NO: 354300 - DNA, 25 bp, Mus musculus
tactctcgagaacagcgcttgcgca

SEQ ID NO: 354301 - DNA, 25 bp, Mus musculus
actctcgagaacagcgcttgcgcag

SEQ ID NO: 354302 - DNA, 25 bp, Mus musculus
ctctcgagaacagcgcttgcgcaga

SEQ ID NO: 354303 - DNA, 25 bp, Mus musculus
tcgagaacagcgcttgcgcagacgg

SEQ ID NO: 354304 - DNA, 25 bp, Mus musculus
cgagaacagcgcttgcgcagacggc

SEQ ID NO: 354305 - DNA, 25 bp, Mus musculus
agaacagcgcttgcgcagacggcgt

SEQ ID NO: 354306 - DNA, 25 bp, Mus musculus
acagcgcttgcgcagacggcgtctg

SEQ ID NO: 354307 - DNA, 25 bp, Mus musculus
agtccgaatactctcgagaacagcg

SEQ ID NO: 354308 - DNA, 25 bp, Mus musculus
gtctggcgcagcagcagtactcaca

SEQ ID NO: 354309 - DNA, 25 bp, Mus musculus
agtaggtgtacctaggcgctccatg

SEQ ID NO: 354310 - DNA, 25 bp, Mus musculus
tggggcgctgctccgcctactctga

SEQ ID NO: 354311 - DNA, 25 bp, Mus musculus
gaccaatgagtgtggagatcgcacg

SEQ ID NO: 354312 - DNA, 25 bp, Mus musculus
cagaactctgaccaatgagtgtgga

SEQ ID NO: 354313 - DNA, 25 bp, Mus musculus
cggagttaacgtgagggacagaact

SEQ ID NO: 354314 - DNA, 25 bp, Mus musculus
acctaggcgctccatggagcggaga

SEQ ID NO: 354315 - DNA, 25 bp, Mus musculus
gaacaggaagaagtaggtgtaccta

SEQ ID NO: 354316 - DNA, 25 bp, Mus musculus
cccagcagagaacaggaagaagtag

SEQ ID NO: 354317 - DNA, 25 bp, Mus musculus
ctggggtacccagcagagaacagga

SEQ ID NO: 354318 - DNA, 25 bp, Mus musculus
tgtgaaatggtcaccggaccgctgg

SEQ ID NO: 354319 - DNA, 25 bp, Mus musculus
cacttgtcttgtgaaatggtcaccg

SEQ ID NO: 354320 - DNA, 25 bp, Mus musculus
ggcgcagcagcagtactcacacttg

SEQ ID NO: 354321 - DNA, 25 bp, Mus musculus
agcagcagtactcacacttgtcttg

SEQ ID NO: 354322 - DNA, 25 bp, Mus musculus
ctgctaaaggcgctgcagggcttac

SEQ ID NO: 354323 - DNA, 25 bp, Mus musculus
tgcccaacatggtagccaccgagtg

SEQ ID NO: 354324 - DNA, 25 bp, Mus musculus
aggagcgcatcagcgcgcaccacgt

SEQ ID NO: 354325 - DNA, 25 bp, Mus musculus
ctcatcagcctgtccgaggagcgca

SEQ ID NO: 354326 - DNA, 25 bp, Mus musculus
tggccgcagtctgaccgtaatccgc

SEQ ID NO: 354327 - DNA, 25 bp, Mus musculus
taatccgcgctacgggaaccacgtg

SEQ ID NO: 354328 - DNA, 25 bp, Mus musculus
tgctaaaaatgcaggctcgcggggc

SEQ ID NO: 354329 - DNA, 25 bp, Mus musculus
gagggaacctatgccgctgcacggc

SEQ ID NO: 354330 - DNA, 25 bp, Mus musculus
aagccaacaactgccaaggcgcctg

SEQ ID NO: 354331 - DNA, 25 bp, Mus musculus
tacgcgggcaagctgctcatcagcc

SEQ ID NO: 354332 - DNA, 25 bp, Mus musculus
cggagacctaccaagccaacaactg

SEQ ID NO: 354333 - DNA, 25 bp, Mus musculus
gagcgttcagtgctcatcccggaga

SEQ ID NO: 354334 - DNA, 25 bp, Mus musculus
ctgcgcgagctgagtgtagatctgc

SEQ ID NO: 354335 - DNA, 25 bp, Mus musculus
tgctagcgctgtgtcccaacgactc

SEQ ID NO: 354336 - DNA, 25 bp, Mus musculus
agccactcgtctttctgtattctcg

SEQ ID NO: 354337 - DNA, 25 bp, Mus musculus
tcagggacttgcaaagcgagtgctc

SEQ ID NO: 354338 - DNA, 25 bp, Mus musculus
attcagggacttgcaaagcgagtgc

SEQ ID NO: 354339 - DNA, 25 bp, Mus musculus
gggacttgcaaagcgagtgctcacc

SEQ ID NO: 354340 - DNA, 25 bp, Mus musculus
acttgcaaagcgagtgctcaccgca

SEQ ID NO: 354341 - DNA, 25 bp, Mus musculus
tgcaaagcgagtgctcaccgcaccg

SEQ ID NO: 354342 - DNA, 25 bp, Mus musculus
aaagcgagtgctcaccgcaccgcag

SEQ ID NO: 354343 - DNA, 25 bp, Mus musculus
cgcagccactcgtctttctgtattc

SEQ ID NO: 354344 - DNA, 25 bp, Mus musculus
ttctcgttgcggattaaaggaggcg

SEQ ID NO: 354345 - DNA, 25 bp, Mus musculus
actcgtctttctgtattctcgttgc

SEQ ID NO: 354346 - DNA, 25 bp, Mus musculus
cgtctttctgtattctcgttgcgga

SEQ ID NO: 354347 - DNA, 25 bp, Mus musculus
ctttctgtattctcgttgcggatta

SEQ ID NO: 354348 - DNA, 25 bp, Mus musculus
ctgtattctcgttgcggattaaagg

SEQ ID NO: 354349 - DNA, 25 bp, Mus musculus
accgcagccactcgtctttctgtat

SEQ ID NO: 354350 - DNA, 25 bp, Mus musculus
ccggcttcgcatcttacacctggaa

SEQ ID NO: 354351 - DNA, 25 bp, Mus musculus
tgggctaccggcatttctgtctctt

SEQ ID NO: 354352 - DNA, 25 bp, Mus musculus
tttgacctccgcaactgggctaccg

SEQ ID NO: 354353 - DNA, 25 bp, Mus musculus
gggctacgtgttcaggtctttgacc

SEQ ID NO: 354354 - DNA, 25 bp, Mus musculus
tcggtgactcaagaccctggtcctt

SEQ ID NO: 354355 - DNA, 25 bp, Mus musculus
tcccttccgggaactcggtgactca

SEQ ID NO: 354356 - DNA, 25 bp, Mus musculus
gatccatgtcctagtcccttccggg

SEQ ID NO: 354357 - DNA, 25 bp, Mus musculus
tgggtcgcgtgatccatgtcctagt

SEQ ID NO: 354358 - DNA, 25 bp, Mus musculus
gtccctgctgtctcgtgggtcgcgt

SEQ ID NO: 354359 - DNA, 25 bp, Mus musculus
acttgtcagacatcggcgcgtggtc

SEQ ID NO: 354360 - DNA, 25 bp, Mus musculus
gcttgcgattcaattctgacttgtc

SEQ ID NO: 354361 - DNA, 25 bp, Mus musculus
agggatctcggagcttgcgattcaa

SEQ ID NO: 354362 - DNA, 25 bp, Mus musculus
ttacacctggaagggatctcggagc

SEQ ID NO: 354363 - DNA, 25 bp, Mus musculus
gtctctttcataaaactgagcctta

SEQ ID NO: 354364 - DNA, 25 bp, Mus musculus
ggaattgtagttccgagcctagctc

SEQ ID NO: 354365 - DNA, 25 bp, Mus musculus
agcctttttcgagctaaagcgcagc

SEQ ID NO: 354366 - DNA, 25 bp, Mus musculus
atcaaatcagcgtgcgaggggaagc

SEQ ID NO: 354367 - DNA, 25 bp, Mus musculus
tgtaaactaggctcgaggacgcggc

SEQ ID NO: 354368 - DNA, 25 bp, Mus musculus
gacgcgatcctttcctcacttgtaa

SEQ ID NO: 354369 - DNA, 25 bp, Mus musculus
cagtccctggcggacatagacttgg

SEQ ID NO: 354370 - DNA, 25 bp, Mus musculus
ctgagtcccttccagacgctgtctg

SEQ ID NO: 354371 - DNA, 25 bp, Mus musculus
cggacgcgaagcttctgagtccctt

SEQ ID NO: 354372 - DNA, 25 bp, Mus musculus
agctcacgggccttcgggtgatcac

SEQ ID NO: 354373 - DNA, 25 bp, Mus musculus
ccgattgactgggagcaggttttcc

SEQ ID NO: 354374 - DNA, 25 bp, Mus musculus
gcctgggttcttccactctgatttc

SEQ ID NO: 354375 - DNA, 25 bp, Mus musculus
ttggacccgcgaactagcaacgttc

SEQ ID NO: 354376 - DNA, 25 bp, Mus musculus
ttttaaggcggcaggagccagcagt

SEQ ID NO: 354377 - DNA, 25 bp, Mus musculus
gctccaagaggagcgatggtttatt

SEQ ID NO: 354378 - DNA, 25 bp, Mus musculus
agagctcgggctccgacgagaaacc

SEQ ID NO: 354379 - DNA, 25 bp, Mus musculus
catgttcttcgccatgctgcgttca

SEQ ID NO: 354380 - DNA, 25 bp, Mus musculus
cgacgggcaaccatgccactcggga

SEQ ID NO: 354381 - DNA, 25 bp, Mus musculus
ctcacctgggcaatgtgctgctggt

SEQ ID NO: 354382 - DNA, 25 bp, Mus musculus
agctacatttctcacctgggcaatg

SEQ ID NO: 354383 - DNA, 25 bp, Mus musculus
cgggaccgcaccaacagcgtgaaca

SEQ ID NO: 354384 - DNA, 25 bp, Mus musculus
cggcagcggcacacagcgaatgcgc

SEQ ID NO: 354385 - DNA, 25 bp, Mus musculus
gggtcgctacctgtaccctgaggtg

SEQ ID NO: 354386 - DNA, 25 bp, Mus musculus
atgaggaccgctgtatcgagagctc

SEQ ID NO: 354387 - DNA, 25 bp, Mus musculus
ctaaagaggcggcatgagcagcgca

SEQ ID NO: 354388 - DNA, 25 bp, Mus musculus
tataaaggcactgctcggctggcgg

SEQ ID NO: 354389 - DNA, 25 bp, Mus musculus
cttccacagcggtcgtgcgggcagc

SEQ ID NO: 354390 - DNA, 25 bp, Mus musculus
agaaaccctgccgtgtgcatgctgc

SEQ ID NO: 354391 - DNA, 25 bp, Mus musculus
ggaggagctgactgctataaaggca

SEQ ID NO: 354392 - DNA, 25 bp, Mus musculus
ccggtgacatgtggggcttaccaca

SEQ ID NO: 354393 - DNA, 25 bp, Mus musculus
acctgcttcggagaaagcggcctgc

SEQ ID NO: 354394 - DNA, 25 bp, Mus musculus
caggctctgattggtgagcagcccg

SEQ ID NO: 354395 - DNA, 25 bp, Mus musculus
cgggttcagccatcctggcatccta

SEQ ID NO: 354396 - DNA, 25 bp, Mus musculus
agcagcccgggtgaagccatcttgc

SEQ ID NO: 354397 - DNA, 25 bp, Mus musculus
cctgcgcacagaggctacaggtctg

SEQ ID NO: 354398 - DNA, 25 bp, Mus musculus
gcagcgacgacactagctcagcctt

SEQ ID NO: 354399 - DNA, 25 bp, Mus musculus
tcagccttcagccactcttctaaaa

SEQ ID NO: 354400 - DNA, 25 bp, Mus musculus
cctggcatcctagagggaggacgcc

SEQ ID NO: 354401 - DNA, 25 bp, Mus musculus
tgcctgctttcgtccgagatggatc

SEQ ID NO: 354402 - DNA, 25 bp, Mus musculus
cccagagccactcacggagagtagg

SEQ ID NO: 354403 - DNA, 25 bp, Mus musculus
ccggccttcctaaccaagctgtgga

SEQ ID NO: 354404 - DNA, 25 bp, Mus musculus
aaccaagctgtggaccctcgtgagc

SEQ ID NO: 354405 - DNA, 25 bp, Mus musculus
gacacagacgcgctcatctgctgga

SEQ ID NO: 354406 - DNA, 25 bp, Mus musculus
gtcctcttctaccttgggcccacta

SEQ ID NO: 354407 - DNA, 25 bp, Mus musculus
cggagcctaatcgaagacgcggagc

SEQ ID NO: 354408 - DNA, 25 bp, Mus musculus
catttgtagtccgaggccgagcgga

SEQ ID NO: 354409 - DNA, 25 bp, Mus musculus
cctaatcgaagacgcggagcacgct

SEQ ID NO: 354410 - DNA, 25 bp, Mus musculus
gcgtctcgcacctcgtcctcttcta

SEQ ID NO: 354411 - DNA, 25 bp, Mus musculus
tcctccgacgccgagagcttcccgc

SEQ ID NO: 354412 - DNA, 25 bp, Mus musculus
ccgccggctctcagcgcttggagcc

SEQ ID NO: 354413 - DNA, 25 bp, Mus musculus
cgtagccggcgcagcgcacgactac

SEQ ID NO: 354414 - DNA, 25 bp, Mus musculus
gcacgactacctctgcgacgctgag

SEQ ID NO: 354415 - DNA, 25 bp, Mus musculus
tctgcgacgctgaggctgcgatgct

SEQ ID NO: 354416 - DNA, 25 bp, Mus musculus
cagctgactggctgtggcgtcaact

SEQ ID NO: 354417 - DNA, 25 bp, Mus musculus
tgtggcgtcaactggagagtccatt

SEQ ID NO: 354418 - DNA, 25 bp, Mus musculus
gagagtccatttgtagtccgaggcc

SEQ ID NO: 354419 - DNA, 25 bp, Mus musculus
cggcgcccaagtcggggctcacagc

SEQ ID NO: 354420 - DNA, 25 bp, Mus musculus
cgcgaagctcttcttgcagcgcttg

SEQ ID NO: 354421 - DNA, 25 bp, Mus musculus
caggctgactcgtagtgcttgttga

SEQ ID NO: 354422 - DNA, 25 bp, Mus musculus
gccatggccggcatggacacgtaca

SEQ ID NO: 354423 - DNA, 25 bp, Mus musculus
ccctcaggaccctattgcttgaagg

SEQ ID NO: 354424 - DNA, 25 bp, Mus musculus
ggcccgtattgctgagagccgacct

SEQ ID NO: 354425 - DNA, 25 bp, Mus musculus
ctggtcgaccctattgctgggagaa

SEQ ID NO: 354426 - DNA, 25 bp, Mus musculus
ccaactaagagatgaggttcggttc

SEQ ID NO: 354427 - DNA, 25 bp, Mus musculus
cctgtcttcagagacccaactaaga

SEQ ID NO: 354428 - DNA, 25 bp, Mus musculus
ctgactccctggacgccggactgaa

SEQ ID NO: 354429 - DNA, 25 bp, Mus musculus
caaatcgtctagcactcccgggagg

SEQ ID NO: 354430 - DNA, 25 bp, Mus musculus
acctgagtctctgcaacgcgatcca

SEQ ID NO: 354431 - DNA, 25 bp, Mus musculus
aagcctgcggaacagaacgcctctg

SEQ ID NO: 354432 - DNA, 25 bp, Mus musculus
actcccgggaggtttgcaaagcctg

SEQ ID NO: 354433 - DNA, 25 bp, Mus musculus
ttgccacacgttgggcaacgccttg

SEQ ID NO: 354434 - DNA, 25 bp, Mus musculus
attccgcttcactggtggtttccgc

SEQ ID NO: 354435 - DNA, 25 bp, Mus musculus
agcggtgctgagctcagctcctttc

SEQ ID NO: 354436 - DNA, 25 bp, Mus musculus
cgcgcgtctgcagcttcttcaggaa

SEQ ID NO: 354437 - DNA, 25 bp, Mus musculus
aacgcaagcggacctcagtcgagtc

SEQ ID NO: 354438 - DNA, 25 bp, Mus musculus
ctcggggaatggtgacctgatactt

SEQ ID NO: 354439 - DNA, 25 bp, Mus musculus
ccaaaggagtgaatgctgaggcagc

SEQ ID NO: 354440 - DNA, 25 bp, Mus musculus
tgaccttatacggactggcccggcg

SEQ ID NO: 354441 - DNA, 25 bp, Mus musculus
cgagtccacgctgcctcctttaagg

SEQ ID NO: 354442 - DNA, 25 bp, Mus musculus
agactgcagcgtggtgaccttatac

SEQ ID NO: 354443 - DNA, 25 bp, Mus musculus
ctgatacttggtggcataatcgggc

SEQ ID NO: 354444 - DNA, 25 bp, Mus musculus
tgacgtcaggcccaacggccaatgg

SEQ ID NO: 354445 - DNA, 25 bp, Mus musculus
agcctgctccggctatcgacgatgg

SEQ ID NO: 354446 - DNA, 25 bp, Mus musculus
cttcttcaggaagcccgcaaccagg

SEQ ID NO: 354447 - DNA, 25 bp, Mus musculus
ccaggctctcgttcttttggggaga

SEQ ID NO: 354448 - DNA, 25 bp, Mus musculus
gtctagcgcattagccggcgtctta

SEQ ID NO: 354449 - DNA, 25 bp, Mus musculus
gcccgttctcagtgctaggctttga

SEQ ID NO: 354450 - DNA, 25 bp, Mus musculus
ctgatgcaccgcactcagccgagga

SEQ ID NO: 354451 - DNA, 25 bp, Mus musculus
agccgaggagcccagaatcgaatca

SEQ ID NO: 354452 - DNA, 25 bp, Mus musculus
ggccttttgcgggtaatgcctacaa

SEQ ID NO: 354453 - DNA, 25 bp, Mus musculus
agcggtcttaaagcctgccgtcgcc

SEQ ID NO: 354454 - DNA, 25 bp, Mus musculus
cgctgttggtgtacctgccaagaaa

SEQ ID NO: 354455 - DNA, 25 bp, Mus musculus
atgggcccatgagccgcaaccaaca

SEQ ID NO: 354456 - DNA, 25 bp, Mus musculus
gcaccaggacttctaagggaatacg

SEQ ID NO: 354457 - DNA, 25 bp, Mus musculus
acgagcaacatgctgtccgcttgca

SEQ ID NO: 354458 - DNA, 25 bp, Mus musculus
ggccgcttggagcttcgaactcgac

SEQ ID NO: 354459 - DNA, 25 bp, Mus musculus
ctcgacgtctaactcgcctagaggc

SEQ ID NO: 354460 - DNA, 25 bp, Mus musculus
gcgtcttactacaaccctttggctg

SEQ ID NO: 354461 - DNA, 25 bp, Mus musculus
caatggagtgttttaggagcagcgc

SEQ ID NO: 354462 - DNA, 25 bp, Mus musculus
agcatctaccgagtatttcgcagcg

SEQ ID NO: 354463 - DNA, 25 bp, Mus musculus
tcgctgctggcgtggctattcaggt

SEQ ID NO: 354464 - DNA, 25 bp, Mus musculus
caaggtggcgatcagttccatgtta

SEQ ID NO: 354465 - DNA, 25 bp, Mus musculus
ggcgatcagttccatgttacacagc

SEQ ID NO: 354466 - DNA, 25 bp, Mus musculus
tccatgttacacagcggaggccggc

SEQ ID NO: 354467 - DNA, 25 bp, Mus musculus
ttacacagcggaggccggccagcac

SEQ ID NO: 354468 - DNA, 25 bp, Mus musculus
cagcactgctcgctgctggcgtggc

SEQ ID NO: 354469 - DNA, 25 bp, Mus musculus
tggctattcaggtgggctctctgct

SEQ ID NO: 354470 - DNA, 25 bp, Mus musculus
ctcctaccagcatctaccgagtatt

SEQ ID NO: 354471 - DNA, 25 bp, Mus musculus
ccctttcaggtactctcatgggtcc

SEQ ID NO: 354472 - DNA, 25 bp, Mus musculus
gtactctcatgggtcctgtgcgcag

SEQ ID NO: 354473 - DNA, 25 bp, Mus musculus
ctgtgcgcaggcacgttctcgtata

SEQ ID NO: 354474 - DNA, 25 bp, Mus musculus
ttctcgtatatcaaggtggcgatca

SEQ ID NO: 354475 - DNA, 25 bp, Mus musculus
gcaggcacgttctcgtatatcaagg

SEQ ID NO: 354476 - DNA, 25 bp, Mus musculus
ctctttcgcggggtcgtctgggcac

SEQ ID NO: 354477 - DNA, 25 bp, Mus musculus
ccgaggcggtcacgtcacgttttgg

SEQ ID NO: 354478 - DNA, 25 bp, Mus musculus
cacgccgaggcggtcacgtcacgtt

SEQ ID NO: 354479 - DNA, 25 bp, Mus musculus
ttccactctacccaggtctgtgtgg

SEQ ID NO: 354480 - DNA, 25 bp, Mus musculus
ctctacccaggtctgtgtggcgcgt

SEQ ID NO: 354481 - DNA, 25 bp, Mus musculus
attgcctactctttcgcggggtcgt

SEQ ID NO: 354482 - DNA, 25 bp, Mus musculus
ggccggtgcgcaagcgcattgccta

SEQ ID NO: 354483 - DNA, 25 bp, Mus musculus
tcgtctgggcaccagggacgtctgc

SEQ ID NO: 354484 - DNA, 25 bp, Mus musculus
caccagggacgtctgcggcgaaacc

SEQ ID NO: 354485 - DNA, 25 bp, Mus musculus
gaagagagcactgccggggacatgt

SEQ ID NO: 354486 - DNA, 25 bp, Mus musculus
cccgcacgccctggtccctgactct

SEQ ID NO: 354487 - DNA, 25 bp, Mus musculus
tgactctgcgctccgcatccctgcg

SEQ ID NO: 354488 - DNA, 25 bp, Mus musculus
tgcgcaagcgcattgcctactcttt

SEQ ID NO: 354489 - DNA, 25 bp, Mus musculus
agcgcattgcctactctttcgcggg

SEQ ID NO: 354490 - DNA, 25 bp, Mus musculus
tcgcggactcggatttgggattcga

SEQ ID NO: 354491 - DNA, 25 bp, Mus musculus
ctcacgtcataaagcctcgagggcg

SEQ ID NO: 354492 - DNA, 25 bp, Mus musculus
tcccacagagtgacgcaaacacgcg

SEQ ID NO: 354493 - DNA, 25 bp, Mus musculus
cgtcctggaggcgactacagaagcc

SEQ ID NO: 354494 - DNA, 25 bp, Mus musculus
accttccagaaacagcgtccgcgta

SEQ ID NO: 354495 - DNA, 25 bp, Mus musculus
ggcgggcttgtcagaactccaacca

SEQ ID NO: 354496 - DNA, 25 bp, Mus musculus
cattgaccgatcagagccttgtagg

SEQ ID NO: 354497 - DNA, 25 bp, Mus musculus
ttgattggaggaccgggaacatttc

SEQ ID NO: 354498 - DNA, 25 bp, Mus musculus
gccgggattctcctatcgccaacta

SEQ ID NO: 354499 - DNA, 25 bp, Mus musculus
gcctccggcgccagataagtctcgg

SEQ ID NO: 354500 - DNA, 25 bp, Mus musculus
ggcctgccgtgacgacgcatataaa

SEQ ID NO: 354501 - DNA, 25 bp, Mus musculus
gtcgcctcacactgctgcgtttacg

SEQ ID NO: 354502 - DNA, 25 bp, Mus musculus
tcgccaatcagaagccggagtaggt

SEQ ID NO: 354503 - DNA, 25 bp, Mus musculus
acgcgtctggcttttctgtcttccc

SEQ ID NO: 354504 - DNA, 25 bp, Mus musculus
tgcgctcactgttgttgaagaagtt

SEQ ID NO: 354505 - DNA, 25 bp, Mus musculus
atggtaaactccagcccggtgggcg

SEQ ID NO: 354506 - DNA, 25 bp, Mus musculus
acacatagagctgcgaggtgccggc

SEQ ID NO: 354507 - DNA, 25 bp, Mus musculus
ctgttgttgaagaagttgcagtaca

SEQ ID NO: 354508 - DNA, 25 bp, Mus musculus
gaatgactgcggcactgcctcgaca

SEQ ID NO: 354509 - DNA, 25 bp, Mus musculus
cggttcaggcggtacacatagagct

SEQ ID NO: 354510 - DNA, 25 bp, Mus musculus
gccaccacgaggttgcgctcactgt

SEQ ID NO: 354511 - DNA, 25 bp, Mus musculus
ggttccgggccgcttcgcatctgcg

SEQ ID NO: 354512 - DNA, 25 bp, Mus musculus
ttctaagaggaccaggtggttgaga

SEQ ID NO: 354513 - DNA, 25 bp, Mus musculus
tgcccggaccgccttctaagaggac

SEQ ID NO: 354514 - DNA, 25 bp, Mus musculus
agccaccgggttccgaagtactgcg

SEQ ID NO: 354515 - DNA, 25 bp, Mus musculus
ttgtacaccgcgtacatgtcgccgc

SEQ ID NO: 354516 - DNA, 25 bp, Mus musculus
tgcgcctgcttgtacaccgcgtaca

SEQ ID NO: 354517 - DNA, 25 bp, Mus musculus
ttgcagtacatggtaaactccagcc

SEQ ID NO: 354518 - DNA, 25 bp, Mus musculus
tgagccttgggagcagcccacacgt

SEQ ID NO: 354519 - DNA, 25 bp, Mus musculus
ggagcagcccacacgtttggaaata

SEQ ID NO: 354520 - DNA, 25 bp, Mus musculus
actgccgaagagaatggcgcgctga

SEQ ID NO: 354521 - DNA, 25 bp, Mus musculus
ccacggggcggatgtcactgccgaa

SEQ ID NO: 354522 - DNA, 25 bp, Mus musculus
cttgctctgtgagccaagccacggg

SEQ ID NO: 354523 - DNA, 25 bp, Mus musculus
gaaggtcccacgaagttacctcagc

SEQ ID NO: 354524 - DNA, 25 bp, Mus musculus
gcggggccagcagtgcgccatcctt

SEQ ID NO: 354525 - DNA, 25 bp, Mus musculus
acctcatcgttgctctgcagcacgt

SEQ ID NO: 354526 - DNA, 25 bp, Mus musculus
gcctagcaaacagagccggcctatg

SEQ ID NO: 354527 - DNA, 25 bp, Mus musculus
agcagccctgcggagcctagcaaac

SEQ ID NO: 354528 - DNA, 25 bp, Mus musculus
tgtacgtgtatgtggtgagcagccc

SEQ ID NO: 354529 - DNA, 25 bp, Mus musculus
cacacgtttggaaatagcgctgggc

SEQ ID NO: 354530 - DNA, 25 bp, Mus musculus
gttacctcagctaacacctagagtg

SEQ ID NO: 354531 - DNA, 25 bp, Mus musculus
agctaacacctagagtgtacgtgta

SEQ ID NO: 354532 - DNA, 25 bp, Mus musculus
gagacttcgccaaaagtcccgcaga

SEQ ID NO: 354533 - DNA, 25 bp, Mus musculus
gcctggtagatgaagagacttcgcc

SEQ ID NO: 354534 - DNA, 25 bp, Mus musculus
ctccgaagtttcgaagcctggtaga

SEQ ID NO: 354535 - DNA, 25 bp, Mus musculus
taattcccagtacccagagaggcgg

SEQ ID NO: 354536 - DNA, 25 bp, Mus musculus
gcaaactcgtgtcccgtgcggggcc

SEQ ID NO: 354537 - DNA, 25 bp, Mus musculus
gcggcgctggctttaattcccagta

SEQ ID NO: 354538 - DNA, 25 bp, Mus musculus
ttgagcctcgggactcccaaacaga

SEQ ID NO: 354539 - DNA, 25 bp, Mus musculus
accacagcaaccatgccggggaagc

SEQ ID NO: 354540 - DNA, 25 bp, Mus musculus
ccatgccggggaagcaaactcctaa

SEQ ID NO: 354541 - DNA, 25 bp, Mus musculus
gtctcccgccgtggcaaactcgtgt

SEQ ID NO: 354542 - DNA, 25 bp, Mus musculus
cgcgagcgggcctgtttaaaagcct

SEQ ID NO: 354543 - DNA, 25 bp, Mus musculus
ccagcgcctcgtagtgacacttcat

SEQ ID NO: 354544 - DNA, 25 bp, Mus musculus
cgtagtgacacttcatggcggggct

SEQ ID NO: 354545 - DNA, 25 bp, Mus musculus
gaagcaaactcctaaggaacctcgc

SEQ ID NO: 354546 - DNA, 25 bp, Mus musculus
ctcactccacccataacacgcaagg

SEQ ID NO: 354547 - DNA, 25 bp, Mus musculus
gaatcgagtctaacccaggacccga

SEQ ID NO: 354548 - DNA, 25 bp, Mus musculus
caggacccgatccacaccctgcgtc

SEQ ID NO: 354549 - DNA, 25 bp, Mus musculus
accctgcgtcccgacatgcactccc

SEQ ID NO: 354550 - DNA, 25 bp, Mus musculus
ccaaaatactcacggcgaagctcct

SEQ ID NO: 354551 - DNA, 25 bp, Mus musculus
actcacggcgaagctcctgttccag

SEQ ID NO: 354552 - DNA, 25 bp, Mus musculus
cctgttccagggtcatagccagaca

SEQ ID NO: 354553 - DNA, 25 bp, Mus musculus
tccagggtcatagccagacaagcca

SEQ ID NO: 354554 - DNA, 25 bp, Mus musculus
accgccgccgcgaaaatctgcactt

SEQ ID NO: 354555 - DNA, 25 bp, Mus musculus
cccactcttctgagcgcatgcttaa

SEQ ID NO: 354556 - DNA, 25 bp, Mus musculus
ttccctgagcccacgcccattttct

SEQ ID NO: 354557 - DNA, 25 bp, Mus musculus
cacgcaaggcccacccactcttctg

SEQ ID NO: 354558 - DNA, 25 bp, Mus musculus
cggaagagagaatcgagtctaaccc

SEQ ID NO: 354559 - DNA, 25 bp, Mus musculus
gcgaaaatctgcacttcccgcgctt

SEQ ID NO: 354560 - DNA, 25 bp, Mus musculus
tcctgatcacgtgggcctcgcgcaa

SEQ ID NO: 354561 - DNA, 25 bp, Mus musculus
tgcgcactgtgcagctgcctcagtg

SEQ ID NO: 354562 - DNA, 25 bp, Mus musculus
gccatctttgttttcgctgcggacc

SEQ ID NO: 354563 - DNA, 25 bp, Mus musculus
gggcctcgcgcaagccaatggaagc

SEQ ID NO: 354564 - DNA, 25 bp, Mus musculus
cgcaagccaatggaagcgccgcgag

SEQ ID NO: 354565 - DNA, 25 bp, Mus musculus
gcggcggccacctccaatggacgag

SEQ ID NO: 354566 - DNA, 25 bp, Mus musculus
ctccaatggacgagcgaggacgcca

SEQ ID NO: 354567 - DNA, 25 bp, Mus musculus
gagcgaggacgccagagagcccacc

SEQ ID NO: 354568 - DNA, 25 bp, Mus musculus
cccaccctcgaaggtgaacagaagg

SEQ ID NO: 354569 - DNA, 25 bp, Mus musculus
agtccgcccttggagaggtaccatc

SEQ ID NO: 354570 - DNA, 25 bp, Mus musculus
cccttggagaggtaccatcagcttc

SEQ ID NO: 354571 - DNA, 25 bp, Mus musculus
taccatcagcttcggggtctggaga

SEQ ID NO: 354572 - DNA, 25 bp, Mus musculus
cccagacttcagactcctcgagagt

SEQ ID NO: 354573 - DNA, 25 bp, Mus musculus
gactcctcgagagtgcaaagcgccc

SEQ ID NO: 354574 - DNA, 25 bp, Mus musculus
ttacatccactaacgagaggagctc

SEQ ID NO: 354575 - DNA, 25 bp, Mus musculus
ccactaacgagaggagctccggcta

SEQ ID NO: 354576 - DNA, 25 bp, Mus musculus
ggagcagccggcttacatccactaa

SEQ ID NO: 354577 - DNA, 25 bp, Mus musculus
ggagcacaggcagcgcacaacacct

SEQ ID NO: 354578 - DNA, 25 bp, Mus musculus
aggcagcgcacaacacctggagacg

SEQ ID NO: 354579 - DNA, 25 bp, Mus musculus
agcgcacaacacctggagacgcgga

SEQ ID NO: 354580 - DNA, 25 bp, Mus musculus
cacaacacctggagacgcggagctg

SEQ ID NO: 354581 - DNA, 25 bp, Mus musculus
aacacctggagacgcggagctgaag

SEQ ID NO: 354582 - DNA, 25 bp, Mus musculus
agctgaaggcccgaacccgcccaca

SEQ ID NO: 354583 - DNA, 25 bp, Mus musculus
taacgagaggagctccggctagagc

SEQ ID NO: 354584 - DNA, 25 bp, Mus musculus
gcggattggagcagccggcttacat

SEQ ID NO: 354585 - DNA, 25 bp, Mus musculus
ccggcttacatccactaacgagagg

SEQ ID NO: 354586 - DNA, 25 bp, Mus musculus
gcagccggcttacatccactaacga

SEQ ID NO: 354587 - DNA, 25 bp, Mus musculus
cccgaacccgcccacaacagtctgc

SEQ ID NO: 354588 - DNA, 25 bp, Mus musculus
gggccttaagtacaagttttgcagc

SEQ ID NO: 354589 - DNA, 25 bp, Mus musculus
gcgcgaagaggtgctctctgccgcc

SEQ ID NO: 354590 - DNA, 25 bp, Mus musculus
ctccgcccgtggaagatcgtccgtg

SEQ ID NO: 354591 - DNA, 25 bp, Mus musculus
cagtgagggccctccgcccgtggaa

SEQ ID NO: 354592 - DNA, 25 bp, Mus musculus
agtacaagttttgcagctcttcgca

SEQ ID NO: 354593 - DNA, 25 bp, Mus musculus
tgcgggattcccaaaagagactaga

SEQ ID NO: 354594 - DNA, 25 bp, Mus musculus
gcttgatagggccttaagtacaagt

SEQ ID NO: 354595 - DNA, 25 bp, Mus musculus
agagggactaaaaaccgcttgatag

SEQ ID NO: 354596 - DNA, 25 bp, Mus musculus
agaggtctttgcgaaagagggacta

SEQ ID NO: 354597 - DNA, 25 bp, Mus musculus
agcggctagaggtctttgcgaaaga

SEQ ID NO: 354598 - DNA, 25 bp, Mus musculus
actagacagcggctagaggtctttg

SEQ ID NO: 354599 - DNA, 25 bp, Mus musculus
ggattcccaaaagagactagacagc

SEQ ID NO: 354600 - DNA, 25 bp, Mus musculus
gtcttgatgcgggattcccaaaaga

SEQ ID NO: 354601 - DNA, 25 bp, Mus musculus
gttttgcagctcttcgcagtcgccc

SEQ ID NO: 354602 - DNA, 25 bp, Mus musculus
tgtagatctccacaagggcggaaga

SEQ ID NO: 354603 - DNA, 25 bp, Mus musculus
tcaagttcgccgagcgagtgggtca

SEQ ID NO: 354604 - DNA, 25 bp, Mus musculus
agaccatctgctcgctcaagttcgc

SEQ ID NO: 354605 - DNA, 25 bp, Mus musculus
aagatctcggggagaccatctgctc

SEQ ID NO: 354606 - DNA, 25 bp, Mus musculus
tcaaccgctccttgctggcactagg

SEQ ID NO: 354607 - DNA, 25 bp, Mus musculus
tgccaccgggacagtgtatgagttc

SEQ ID NO: 354608 - DNA, 25 bp, Mus musculus
gtgaggcccaggcaatcaaccgctc

SEQ ID NO: 354609 - DNA, 25 bp, Mus musculus
cggtccagagagacccgaatggcgc

SEQ ID NO: 354610 - DNA, 25 bp, Mus musculus
tccttgctggcactaggaggagtga

SEQ ID NO: 354611 - DNA, 25 bp, Mus musculus
agctcggaggcctcatgtgcccttc

SEQ ID NO: 354612 - DNA, 25 bp, Mus musculus
cgactcacagcttacgcgcctgtta

SEQ ID NO: 354613 - DNA, 25 bp, Mus musculus
aggcaccactgcagttctgctgctg

SEQ ID NO: 354614 - DNA, 25 bp, Mus musculus
ggtcccttgggctagtgcaagcctg

SEQ ID NO: 354615 - DNA, 25 bp, Mus musculus
tagtgcaagcctggggtgctgccac

SEQ ID NO: 354616 - DNA, 25 bp, Mus musculus
cgcggcttccgctcgggacacctcg

SEQ ID NO: 354617 - DNA, 25 bp, Mus musculus
gcccagcacggctgggcggggcata

SEQ ID NO: 354618 - DNA, 25 bp, Mus musculus
ctggcccggcaatggagcgggtcgt

SEQ ID NO: 354619 - DNA, 25 bp, Mus musculus
agcgccggttcttctgcggcccggt

SEQ ID NO: 354620 - DNA, 25 bp, Mus musculus
gagccagcgccggttcttctgcggc

SEQ ID NO: 354621 - DNA, 25 bp, Mus musculus
agcgggtcgtgaggggcctgcagaa

SEQ ID NO: 354622 - DNA, 25 bp, Mus musculus
ttgtgagtgagggtcgggtctatct

SEQ ID NO: 354623 - DNA, 25 bp, Mus musculus
gagaaggccggcgattgtgagtgag

SEQ ID NO: 354624 - DNA, 25 bp, Mus musculus
cggccagggaggttccaggtgagaa

SEQ ID NO: 354625 - DNA, 25 bp, Mus musculus
gccggttcttctgcggcccggtgct

SEQ ID NO: 354626 - DNA, 25 bp, Mus musculus
cacctcgggccggaagtgtcgcgtt

SEQ ID NO: 354627 - DNA, 25 bp, Mus musculus
ttcccgcccagcaccgcggcttccg

SEQ ID NO: 354628 - DNA, 25 bp, Mus musculus
tcgcaaaacgactcagcccagcctt

SEQ ID NO: 354629 - DNA, 25 bp, Mus musculus
aagtgtcgcgttgccatggcgagga

SEQ ID NO: 354630 - DNA, 25 bp, Mus musculus
ctctgtgccaggcacgtgaccgctg

SEQ ID NO: 354631 - DNA, 25 bp, Mus musculus
ttcccattcctcagtacccactgta

SEQ ID NO: 354632 - DNA, 25 bp, Mus musculus
ggacgccgtgcaagtggactactac

SEQ ID NO: 354633 - DNA, 25 bp, Mus musculus
ccgtgcaagtggactactacctgga

SEQ ID NO: 354634 - DNA, 25 bp, Mus musculus
caagtggactactacctggacgaag

SEQ ID NO: 354635 - DNA, 25 bp, Mus musculus
agcgcgcctgggctcttgacatcgc

SEQ ID NO: 354636 - DNA, 25 bp, Mus musculus
ctgctgccctcgagtactatgcgtc

SEQ ID NO: 354637 - DNA, 25 bp, Mus musculus
tcttgacatcgctgagctgcggcgc

SEQ ID NO: 354638 - DNA, 25 bp, Mus musculus
aaccggtgtactcattcccattcct

SEQ ID NO: 354639 - DNA, 25 bp, Mus musculus
tgccctcgagtactatgcgtcatca

SEQ ID NO: 354640 - DNA, 25 bp, Mus musculus
tgggctcttgacatcgctgagctgc

SEQ ID NO: 354641 - DNA, 25 bp, Mus musculus
gcgaaccggtgtactcattcccatt

SEQ ID NO: 354642 - DNA, 25 bp, Mus musculus
ctcgagtactatgcgtcatcaaccc

SEQ ID NO: 354643 - DNA, 25 bp, Mus musculus
gtgcgcgaaccggtgtactcattcc

SEQ ID NO: 354644 - DNA, 25 bp, Mus musculus
agaggaccgatcttcggggccaagg

SEQ ID NO: 354645 - DNA, 25 bp, Mus musculus
ccaaggcggatgtggcgccgacctc

SEQ ID NO: 354646 - DNA, 25 bp, Mus musculus
gccgacctcgcctccggtgcacctc

SEQ ID NO: 354647 - DNA, 25 bp, Mus musculus
cgcctccggtgcacctcaggtacac

SEQ ID NO: 354648 - DNA, 25 bp, Mus musculus
cgttggggtcgaacttgggcggcat

SEQ ID NO: 354649 - DNA, 25 bp, Mus musculus
gctggtgtcggatgaacccggattc

SEQ ID NO: 354650 - DNA, 25 bp, Mus musculus
ctggtgtcggatgaacccggattcg

SEQ ID NO: 354651 - DNA, 25 bp, Mus musculus
tcggatgaacccggattcgggacga

SEQ ID NO: 354652 - DNA, 25 bp, Mus musculus
tcgggacgaccgaagaaagttgcac

SEQ ID NO: 354653 - DNA, 25 bp, Mus musculus
cgaccgaagaaagttgcaccgttgc

SEQ ID NO: 354654 - DNA, 25 bp, Mus musculus
ccgaagaaagttgcaccgttgcctc

SEQ ID NO: 354655 - DNA, 25 bp, Mus musculus
aagaaagttgcaccgttgcctcctc

SEQ ID NO: 354656 - DNA, 25 bp, Mus musculus
gaaagttgcaccgttgcctcctccg

SEQ ID NO: 354657 - DNA, 25 bp, Mus musculus
aagttgcaccgttgcctcctccgag

SEQ ID NO: 354658 - DNA, 25 bp, Mus musculus
cccaagaggatgcttcattcaattg

SEQ ID NO: 354659 - DNA, 25 bp, Mus musculus
tgggtgcagcatctgcggctctcac

SEQ ID NO: 354660 - DNA, 25 bp, Mus musculus
gtcctgacgagggaactgttctcca

SEQ ID NO: 354661 - DNA, 25 bp, Mus musculus
cgagtctctcaggattttgtccctt

SEQ ID NO: 354662 - DNA, 25 bp, Mus musculus
ttcgcggtgagcacgagtctctcag

SEQ ID NO: 354663 - DNA, 25 bp, Mus musculus
ccgccgaagcatgtagaaggggtac

SEQ ID NO: 354664 - DNA, 25 bp, Mus musculus
taagttcagagacctgggacccgtc

SEQ ID NO: 354665 - DNA, 25 bp, Mus musculus
ggggagagtgcgaatcctaagttca

SEQ ID NO: 354666 - DNA, 25 bp, Mus musculus
cgccgtacgccctgcagggttcgag

SEQ ID NO: 354667 - DNA, 25 bp, Mus musculus
taagtgggtggatgctcattctccc

SEQ ID NO: 354668 - DNA, 25 bp, Mus musculus
ctcttgcccacggacgggtaagtgg

SEQ ID NO: 354669 - DNA, 25 bp, Mus musculus
tcgggcaataccacagagcctcagg

SEQ ID NO: 354670 - DNA, 25 bp, Mus musculus
ggatgtcatcttccctcattcccga

SEQ ID NO: 354671 - DNA, 25 bp, Mus musculus
cccaaagtgcggatcgggcaatacc

SEQ ID NO: 354672 - DNA, 25 bp, Mus musculus
cgcaccaggtctctgaaggagccgc

SEQ ID NO: 354673 - DNA, 25 bp, Mus musculus
aaggcctgcggctcgatgacagcca

SEQ ID NO: 354674 - DNA, 25 bp, Mus musculus
tgcgggagatgaacaccaggtcatt

SEQ ID NO: 354675 - DNA, 25 bp, Mus musculus
cagtgatgtgagattgcagcgctcc

SEQ ID NO: 354676 - DNA, 25 bp, Mus musculus
cggccagttgtcgatctccagatgc

SEQ ID NO: 354677 - DNA, 25 bp, Mus musculus
ggacaacgacgtgaggttcagccca

SEQ ID NO: 354678 - DNA, 25 bp, Mus musculus
gctcctgctaggtgcagctcacgca

SEQ ID NO: 354679 - DNA, 25 bp, Mus musculus
atccagcaggatgaccagcttgttc

SEQ ID NO: 354680 - DNA, 25 bp, Mus musculus
ggaatgtgttctcctccagtgtgga

SEQ ID NO: 354681 - DNA, 25 bp, Mus musculus
tcgagcgtgttcaccgagtggaatg

SEQ ID NO: 354682 - DNA, 25 bp, Mus musculus
gcacgatccacagcaggcgacagtc

SEQ ID NO: 354683 - DNA, 25 bp, Mus musculus
aagttcagggtcttccgcctctgca

SEQ ID NO: 354684 - DNA, 25 bp, Mus musculus
cgcaggtcctggaagctgaaatcca

SEQ ID NO: 354685 - DNA, 25 bp, Mus musculus
ggcttgcggcacacgaagtactcga

SEQ ID NO: 354686 - DNA, 25 bp, Mus musculus
cccaccatgcgataggaccggtcta

SEQ ID NO: 354687 - DNA, 25 bp, Mus musculus
gggattgtatgctccatggctgtta

SEQ ID NO: 354688 - DNA, 25 bp, Mus musculus
tccctaacgcgcgtgggtctaacca

SEQ ID NO: 354689 - DNA, 25 bp, Mus musculus
taggaccggtctatcgctccgcatt

SEQ ID NO: 354690 - DNA, 25 bp, Mus musculus
cttcccattttactgcgggcccgtg

SEQ ID NO: 354691 - DNA, 25 bp, Mus musculus
gcagtccagtttgcttcccatttta

SEQ ID NO: 354692 - DNA, 25 bp, Mus musculus
gccggcctctatcttgtgcagggtc

SEQ ID NO: 354693 - DNA, 25 bp, Mus musculus
ccgcatttttctcccagcttcggta

SEQ ID NO: 354694 - DNA, 25 bp, Mus musculus
actgttcatcctgagccgtccgatc

SEQ ID NO: 354695 - DNA, 25 bp, Mus musculus
gaggaccagaccctgactgttcatc

SEQ ID NO: 354696 - DNA, 25 bp, Mus musculus
cccggccctatgtaggaggaccaga

SEQ ID NO: 354697 - DNA, 25 bp, Mus musculus
tcccagtgtgcgtgtcgggattaca

SEQ ID NO: 354698 - DNA, 25 bp, Mus musculus
agggtctgccctatggactgcagtc

SEQ ID NO: 354699 - DNA, 25 bp, Mus musculus
agcttcggtacttccgggatttctg

SEQ ID NO: 354700 - DNA, 25 bp, Mus musculus
ctgacgcaccgcctgctttaggtta

SEQ ID NO: 354701 - DNA, 25 bp, Mus musculus
ccctaggagagaagcttgtcagcaa

SEQ ID NO: 354702 - DNA, 25 bp, Mus musculus
tgcaaaagcgcgttcccactcctgt

SEQ ID NO: 354703 - DNA, 25 bp, Mus musculus
catggcagcccgaacgtgagtttag

SEQ ID NO: 354704 - DNA, 25 bp, Mus musculus
cgccaccgtaaagtcctgtccttag

SEQ ID NO: 354705 - DNA, 25 bp, Mus musculus
gtcctgtccttagccaatgagagcg

SEQ ID NO: 354706 - DNA, 25 bp, Mus musculus
cgggcctatgagttgttgcgtcatc

SEQ ID NO: 354707 - DNA, 25 bp, Mus musculus
ttcgagtcgagctgagagtcaagca

SEQ ID NO: 354708 - DNA, 25 bp, Mus musculus
cagccgttagtggtcagggcacttg

SEQ ID NO: 354709 - DNA, 25 bp, Mus musculus
actggcgcttgaagaccacggctga

SEQ ID NO: 354710 - DNA, 25 bp, Mus musculus
ccagggtcagttgatgttccgggct

SEQ ID NO: 354711 - DNA, 25 bp, Mus musculus
tgttttctccaaggatccgagcgtg

SEQ ID NO: 354712 - DNA, 25 bp, Mus musculus
ttacggtactcacggtagagcgctg

SEQ ID NO: 354713 - DNA, 25 bp, Mus musculus
gcggtcaggggcatacccactaaca

SEQ ID NO: 354714 - DNA, 25 bp, Mus musculus
cggtcaatgacgaacatctcgtgtc

SEQ ID NO: 354715 - DNA, 25 bp, Mus musculus
gggttcatgtcccacagggcgtgta

SEQ ID NO: 354716 - DNA, 25 bp, Mus musculus
gggcactcgagctttgccacctgca

SEQ ID NO: 354717 - DNA, 25 bp, Mus musculus
cattggcggcctcgcattcgtactt

SEQ ID NO: 354718 - DNA, 25 bp, Mus musculus
ttcgtacttgcctgcgtgagccagt

SEQ ID NO: 354719 - DNA, 25 bp, Mus musculus
aagagcatgccgctgccagtatctc

SEQ ID NO: 354720 - DNA, 25 bp, Mus musculus
ttgaccagtagatgaaagggcactc

SEQ ID NO: 354721 - DNA, 25 bp, Mus musculus
ccatggtcatcacggagctcctcga

SEQ ID NO: 354722 - DNA, 25 bp, Mus musculus
aggtgcaaggcccatccgaataatc

SEQ ID NO: 354723 - DNA, 25 bp, Mus musculus
tcgttgacaaatagggtgccttctc

SEQ ID NO: 354724 - DNA, 25 bp, Mus musculus
tcatagctgccaacaacagcgcggt

SEQ ID NO: 354725 - DNA, 25 bp, Mus musculus
atcgctgtctgcgttgctaggccca

SEQ ID NO: 354726 - DNA, 25 bp, Mus musculus
ggaaagccatgctacctgcctcatg

SEQ ID NO: 354727 - DNA, 25 bp, Mus musculus
tgctgccgagatgcgttgaccagta

SEQ ID NO: 354728 - DNA, 25 bp, Mus musculus
ggagtcgggcctcttaccttgcaaa

SEQ ID NO: 354729 - DNA, 25 bp, Mus musculus
ccggacctggaatacgatctctatt

SEQ ID NO: 354730 - DNA, 25 bp, Mus musculus
ccggcatctttcgagctcctttttg

SEQ ID NO: 354731 - DNA, 25 bp, Mus musculus
ccgatctctatggtagcccacgtta

SEQ ID NO: 354732 - DNA, 25 bp, Mus musculus
cccacgttaggctgtgagttaagtc

SEQ ID NO: 354733 - DNA, 25 bp, Mus musculus
cgaagtcgcgttctcctgcaagcca

SEQ ID NO: 354734 - DNA, 25 bp, Mus musculus
tcgcttccggtctcgaggtagactc

SEQ ID NO: 354735 - DNA, 25 bp, Mus musculus
gaggtgctaagcaagcccggttacc

SEQ ID NO: 354736 - DNA, 25 bp, Mus musculus
tagagctaccctgtgaactgcattc

SEQ ID NO: 354737 - DNA, 25 bp, Mus musculus
gtcgccagtcctgtccgcactgata

SEQ ID NO: 354738 - DNA, 25 bp, Mus musculus
gcgaggtttgttgttccgtgtctca

SEQ ID NO: 354739 - DNA, 25 bp, Mus musculus
ggagcatccttcttctcggagccga

SEQ ID NO: 354740 - DNA, 25 bp, Mus musculus
gtagactctctaggcacacggcggc

SEQ ID NO: 354741 - DNA, 25 bp, Mus musculus
cctggcttgctagctttttggacgc

SEQ ID NO: 354742 - DNA, 25 bp, Mus musculus
accgtaggggagctaggcccatact

SEQ ID NO: 354743 - DNA, 25 bp, Mus musculus
gcgaccttgccagtgtacgtgagag

SEQ ID NO: 354744 - DNA, 25 bp, Mus musculus
aggaagttacgctctctgccgcaaa

SEQ ID NO: 354745 - DNA, 25 bp, Mus musculus
ctgacgtgaccagcgcaggccaatc

SEQ ID NO: 354746 - DNA, 25 bp, Mus musculus
ccggtcttcacagcgcaggaagtta

SEQ ID NO: 354747 - DNA, 25 bp, Mus musculus
ggcccatactcgaagcaagcgctga

SEQ ID NO: 354748 - DNA, 25 bp, Mus musculus
gccagatccatagttagggcgatgc

SEQ ID NO: 354749 - DNA, 25 bp, Mus musculus
cgagtactacaaaacccagagtttg

SEQ ID NO: 354750 - DNA, 25 bp, Mus musculus
cagaggggtaacctgcgagtactac

SEQ ID NO: 354751 - DNA, 25 bp, Mus musculus
caggtgacagcggacatctaagtta

SEQ ID NO: 354752 - DNA, 25 bp, Mus musculus
gctctcagtcaccagcgtgcaggtg

SEQ ID NO: 354753 - DNA, 25 bp, Mus musculus
cagggcagcaccagaaccttggaca

SEQ ID NO: 354754 - DNA, 25 bp, Mus musculus
gccaatccgtgggacgcaaagccgg

SEQ ID NO: 354755 - DNA, 25 bp, Mus musculus
tcgccaccgccacagtaggagagac

SEQ ID NO: 354756 - DNA, 25 bp, Mus musculus
ccctgtgtgtaggagacacgctcga

SEQ ID NO: 354757 - DNA, 25 bp, Mus musculus
cctcgccaagactagagccaagtta

SEQ ID NO: 354758 - DNA, 25 bp, Mus musculus
tcagcgagtgtgcacttgaacttta

SEQ ID NO: 354759 - DNA, 25 bp, Mus musculus
cctggccttggtgatccacatagta

SEQ ID NO: 354760 - DNA, 25 bp, Mus musculus
tatcccaggtctcgcctctagaact

SEQ ID NO: 354761 - DNA, 25 bp, Mus musculus
tgaaaggttcaaagccacgcgtagc

SEQ ID NO: 354762 - DNA, 25 bp, Mus musculus
tccagcctgggctttgaaaggttca

SEQ ID NO: 354763 - DNA, 25 bp, Mus musculus
ctgctgctaggacaggctagtgtgc

SEQ ID NO: 354764 - DNA, 25 bp, Mus musculus
aagtagctgccagacgtggactccc

SEQ ID NO: 354765 - DNA, 25 bp, Mus musculus
aaatactcgcgggttctgggctccg

SEQ ID NO: 354766 - DNA, 25 bp, Mus musculus
tgaactttattcacacggagcactg

SEQ ID NO: 354767 - DNA, 25 bp, Mus musculus
tcgagccacacgtacgagggagcgc

SEQ ID NO: 354768 - DNA, 25 bp, Mus musculus
accggaagcggatcacacagtgttg

SEQ ID NO: 354769 - DNA, 25 bp, Mus musculus
caagcactcggctctgggactgctg

SEQ ID NO: 354770 - DNA, 25 bp, Mus musculus
cacttctcggggctggcttgcgact

SEQ ID NO: 354771 - DNA, 25 bp, Mus musculus
cctgcaggaactggccgcgagatat

SEQ ID NO: 354772 - DNA, 25 bp, Mus musculus
ctccgggaaacagaaggcacttctc

SEQ ID NO: 354773 - DNA, 25 bp, Mus musculus
cggtatgtgcttcagccgaccagga

SEQ ID NO: 354774 - DNA, 25 bp, Mus musculus
tgtcgctcggctccgggaaacagaa

SEQ ID NO: 354775 - DNA, 25 bp, Mus musculus
cctccatgaagctggtatctaaatg

SEQ ID NO: 354776 - DNA, 25 bp, Mus musculus
acgcgaggatcatccgactggcagc

SEQ ID NO: 354777 - DNA, 25 bp, Mus musculus
tgagcactcgaaggaaggacatctc

SEQ ID NO: 354778 - DNA, 25 bp, Mus musculus
tatctaaatgctgaatgagcactcg

SEQ ID NO: 354779 - DNA, 25 bp, Mus musculus
ggtgtcaccctagcaggcgtccata

SEQ ID NO: 354780 - DNA, 25 bp, Mus musculus
ggacatctcctttcgtgtattctcg

SEQ ID NO: 354781 - DNA, 25 bp, Mus musculus
cgtgctatagcacgccctccatgaa

SEQ ID NO: 354782 - DNA, 25 bp, Mus musculus
tctcgaagatgacgcgaggatcatc

SEQ ID NO: 354783 - DNA, 25 bp, Mus musculus
caggcgtccatagcccgcgtgctat

SEQ ID NO: 354784 - DNA, 25 bp, Mus musculus
aggcgcccagggagttccaagtctt

SEQ ID NO: 354785 - DNA, 25 bp, Mus musculus
agggctcgcacacaactatcttggc

SEQ ID NO: 354786 - DNA, 25 bp, Mus musculus
ctatcttggccagggacacacacgc

SEQ ID NO: 354787 - DNA, 25 bp, Mus musculus
gggcacgcgtgcagaccatggcacc

SEQ ID NO: 354788 - DNA, 25 bp, Mus musculus
cccgatttctagcacgactggactg

SEQ ID NO: 354789 - DNA, 25 bp, Mus musculus
agccagcgcttcacgtcctgggtct

SEQ ID NO: 354790 - DNA, 25 bp, Mus musculus
gggctgactacacacacctgtctgc

SEQ ID NO: 354791 - DNA, 25 bp, Mus musculus
tctgggcctggacacagaacgcacg

SEQ ID NO: 354792 - DNA, 25 bp, Mus musculus
aaagggcacaagcacaccaccggct

SEQ ID NO: 354793 - DNA, 25 bp, Mus musculus
atcctcgttcggcaagcactatctc

SEQ ID NO: 354794 - DNA, 25 bp, Mus musculus
aaccacctcaagcaaagggctcgca

SEQ ID NO: 354795 - DNA, 25 bp, Mus musculus
cgggcatcgcggacaaagcctagcc

SEQ ID NO: 354796 - DNA, 25 bp, Mus musculus
cggagcccagtgcacagaaagggca

SEQ ID NO: 354797 - DNA, 25 bp, Mus musculus
aagcctagcccgcaagatcctcgtt

SEQ ID NO: 354798 - DNA, 25 bp, Mus musculus
ggcagttccagccatgcgccaggac

SEQ ID NO: 354799 - DNA, 25 bp, Mus musculus
cttctggagtgtcctaaagccgcga

SEQ ID NO: 354800 - DNA, 25 bp, Mus musculus
tcccgtgccgctatccaaactgaga

SEQ ID NO: 354801 - DNA, 25 bp, Mus musculus
ccaggacacccagagtggacgcata

SEQ ID NO: 354802 - DNA, 25 bp, Mus musculus
cttgcttcggaagtggccttctgga

SEQ ID NO: 354803 - DNA, 25 bp, Mus musculus
agacgacgacagaccttgcttcgga

SEQ ID NO: 354804 - DNA, 25 bp, Mus musculus
ctcagctttagagggccagcctgga

SEQ ID NO: 354805 - DNA, 25 bp, Mus musculus
agggctagctctgggcaaaaactta

SEQ ID NO: 354806 - DNA, 25 bp, Mus musculus
aaagtcatcgtccttcacatccatg

SEQ ID NO: 354807 - DNA, 25 bp, Mus musculus
atcatcggcgcccttggccagaagc

SEQ ID NO: 354808 - DNA, 25 bp, Mus musculus
cttgcccacctgcagagcgatggga

SEQ ID NO: 354809 - DNA, 25 bp, Mus musculus
gcgcacttccggagcttctttaggg

SEQ ID NO: 354810 - DNA, 25 bp, Mus musculus
tctttagggtctccgagaacggcgc

SEQ ID NO: 354811 - DNA, 25 bp, Mus musculus
ggacgcatagcaccacctcagcttt

SEQ ID NO: 354812 - DNA, 25 bp, Mus musculus
ggctctcttgttgggatccaccacg

SEQ ID NO: 354813 - DNA, 25 bp, Mus musculus
gcaagggacacttggcttttactcc

SEQ ID NO: 354814 - DNA, 25 bp, Mus musculus
atgcctggccgaagacgtgatccca

SEQ ID NO: 354815 - DNA, 25 bp, Mus musculus
ccgaagacgtgatcccagcggagta

SEQ ID NO: 354816 - DNA, 25 bp, Mus musculus
tgatcccagcggagtagaatagccg

SEQ ID NO: 354817 - DNA, 25 bp, Mus musculus
cggctcggtgctgttgtgaatgcct

SEQ ID NO: 354818 - DNA, 25 bp, Mus musculus
gtgctgttgtgaatgcctggccgaa

SEQ ID NO: 354819 - DNA, 25 bp, Mus musculus
ttgggatccaccacgcgccggggca

SEQ ID NO: 354820 - DNA, 25 bp, Mus musculus
agccctttccggtggctctcttgtt

SEQ ID NO: 354821 - DNA, 25 bp, Mus musculus
taagcttgcaaagccctttccggtg

SEQ ID NO: 354822 - DNA, 25 bp, Mus musculus
gggcacagtgggataagcttgcaaa

SEQ ID NO: 354823 - DNA, 25 bp, Mus musculus
agttagagaacaaacggggcgcgct

SEQ ID NO: 354824 - DNA, 25 bp, Mus musculus
ggcgcagtcgctttccttgttttta

SEQ ID NO: 354825 - DNA, 25 bp, Mus musculus
gtgagtaggcgcagtcgctttcctt

SEQ ID NO: 354826 - DNA, 25 bp, Mus musculus
cagtttgtcccgttggaacgttctg

SEQ ID NO: 354827 - DNA, 25 bp, Mus musculus
cgttggaacgttctggaaattgcca

SEQ ID NO: 354828 - DNA, 25 bp, Mus musculus
tctggaaattgccaactttccgccg

SEQ ID NO: 354829 - DNA, 25 bp, Mus musculus
cccagatacgacagtttgtcccgtt

SEQ ID NO: 354830 - DNA, 25 bp, Mus musculus
cgcagacactgagtaccgagaaata

SEQ ID NO: 354831 - DNA, 25 bp, Mus musculus
aattcacctcgtgcgcatcgccctg

SEQ ID NO: 354832 - DNA, 25 bp, Mus musculus
tgccgcagtgcgcatcaccattcca

SEQ ID NO: 354833 - DNA, 25 bp, Mus musculus
gactgcagcgctgtcactcacctgg

SEQ ID NO: 354834 - DNA, 25 bp, Mus musculus
agcgctgtcactcacctgggcggct

SEQ ID NO: 354835 - DNA, 25 bp, Mus musculus
agctgcaagggacgcgcgcgacaac

SEQ ID NO: 354836 - DNA, 25 bp, Mus musculus
cgcgcgcgacaacacgtgttggagc

SEQ ID NO: 354837 - DNA, 25 bp, Mus musculus
acaacacgtgttggagcaggtctgg

SEQ ID NO: 354838 - DNA, 25 bp, Mus musculus
agtgcctccgcagacactgagtacc

SEQ ID NO: 354839 - DNA, 25 bp, Mus musculus
actgagtaccgagaaatacttgggg

SEQ ID NO: 354840 - DNA, 25 bp, Mus musculus
gtccgctgcgggttttgaaattatc

SEQ ID NO: 354841 - DNA, 25 bp, Mus musculus
gggatccctaccgattcaagaagcg

SEQ ID NO: 354842 - DNA, 25 bp, Mus musculus
acatcattcatgaccctggccgcgg

SEQ ID NO: 354843 - DNA, 25 bp, Mus musculus
accctgacccgtaggacatcattca

SEQ ID NO: 354844 - DNA, 25 bp, Mus musculus
tcgcggagcgacacggctacattaa

SEQ ID NO: 354845 - DNA, 25 bp, Mus musculus
ggatccacactggacagttcgtgta

SEQ ID NO: 354846 - DNA, 25 bp, Mus musculus
ttggacgctgaactcgaaccatttc

SEQ ID NO: 354847 - DNA, 25 bp, Mus musculus
tggcccactcgtccaggatcagaag

SEQ ID NO: 354848 - DNA, 25 bp, Mus musculus
tttgaaattatccaccgccatccgc

SEQ ID NO: 354849 - DNA, 25 bp, Mus musculus
cttgccggcaggtaagttgtgctct

SEQ ID NO: 354850 - DNA, 25 bp, Mus musculus
aaggctgcgttgacccgtctatttc

SEQ ID NO: 354851 - DNA, 25 bp, Mus musculus
ctcgagcaggccttagaatacaata

SEQ ID NO: 354852 - DNA, 25 bp, Mus musculus
ccgttaactacttggcggtctgtca

SEQ ID NO: 354853 - DNA, 25 bp, Mus musculus
ttccgtgcgcacgtgaagcaccgta

SEQ ID NO: 354854 - DNA, 25 bp, Mus musculus
tcgtagcacgcgtagggcttctcct

SEQ ID NO: 354855 - DNA, 25 bp, Mus musculus
ctcctgcgtgtgaatcctctcgtga

SEQ ID NO: 354856 - DNA, 25 bp, Mus musculus
ctctcgtgattcatcagggtggagc

SEQ ID NO: 354857 - DNA, 25 bp, Mus musculus
agcggtggctaaaggtcttgccgca

SEQ ID NO: 354858 - DNA, 25 bp, Mus musculus
ccgcactcgctgcacgtgtagggct

SEQ ID NO: 354859 - DNA, 25 bp, Mus musculus
agcagcgtcctcttcacgctgaagg

SEQ ID NO: 354860 - DNA, 25 bp, Mus musculus
acacaagggacacacgtagggccgc

SEQ ID NO: 354861 - DNA, 25 bp, Mus musculus
agagctgggtgaacgccttcccaca

SEQ ID NO: 354862 - DNA, 25 bp, Mus musculus
tccagacactcgtgaggcttctctc

SEQ ID NO: 354863 - DNA, 25 bp, Mus musculus
caaggtcggaactcacgcgaaaggc

SEQ ID NO: 354864 - DNA, 25 bp, Mus musculus
cgcgaaaggctttcccacattcgtt

SEQ ID NO: 354865 - DNA, 25 bp, Mus musculus
caggacggaactctggctgaaagcc

SEQ ID NO: 354866 - DNA, 25 bp, Mus musculus
gctgaaagcctttccgcatacatgg

SEQ ID NO: 354867 - DNA, 25 bp, Mus musculus
acatggcatacgtagggcttctcgc

SEQ ID NO: 354868 - DNA, 25 bp, Mus musculus
gcggcttcggctccctaagacaaag

SEQ ID NO: 354869 - DNA, 25 bp, Mus musculus
atctgccgcaacctctcgccctgtg

SEQ ID NO: 354870 - DNA, 25 bp, Mus musculus
agagcgccactcaccatctgccgca

SEQ ID NO: 354871 - DNA, 25 bp, Mus musculus
cccgcgcagccgacagagcgccact

SEQ ID NO: 354872 - DNA, 25 bp, Mus musculus
cggatgaaggagagggtcccgcgca

SEQ ID NO: 354873 - DNA, 25 bp, Mus musculus
gcgcggagctttgggtgcggatgaa

SEQ ID NO: 354874 - DNA, 25 bp, Mus musculus
gaagggctggcatacgcgagggcgc

SEQ ID NO: 354875 - DNA, 25 bp, Mus musculus
cagcccggccgcagccatccatcgg

SEQ ID NO: 354876 - DNA, 25 bp, Mus musculus
gagggtgcagcctgggtcagcagcc

SEQ ID NO: 354877 - DNA, 25 bp, Mus musculus
ctagcgggagccaccgcgaagggtc

SEQ ID NO: 354878 - DNA, 25 bp, Mus musculus
tctgaactccggaccgggctagcgg

SEQ ID NO: 354879 - DNA, 25 bp, Mus musculus
cagaaccgtctgaactccggaccgg

SEQ ID NO: 354880 - DNA, 25 bp, Mus musculus
tgcacatcagaaccgtctgaactcc

SEQ ID NO: 354881 - DNA, 25 bp, Mus musculus
cgtatgcacatcagaaccgtctgaa

SEQ ID NO: 354882 - DNA, 25 bp, Mus musculus
gctgcgctttctgcggaaccttgtg

SEQ ID NO: 354883 - DNA, 25 bp, Mus musculus
gttcagtgcaacctgcatgcgactc

SEQ ID NO: 354884 - DNA, 25 bp, Mus musculus
tccctgcgagctttctgggcgctaa

SEQ ID NO: 354885 - DNA, 25 bp, Mus musculus
aggcccaggcaaggatggtactccc

SEQ ID NO: 354886 - DNA, 25 bp, Mus musculus
cggacgaagctcctcctagcgctga

SEQ ID NO: 354887 - DNA, 25 bp, Mus musculus
agcgaaaagccctcggagaaacctg

SEQ ID NO: 354888 - DNA, 25 bp, Mus musculus
tcccgtaggcaacacagtagcgatg

SEQ ID NO: 354889 - DNA, 25 bp, Mus musculus
ggaacctcctctccgcagttcagtg

SEQ ID NO: 354890 - DNA, 25 bp, Mus musculus
ccagcagcctcaagtcggaaaactc

SEQ ID NO: 354891 - DNA, 25 bp, Mus musculus
tcacgatttttcaggagccagggcg

SEQ ID NO: 354892 - DNA, 25 bp, Mus musculus
accctgtgaatttcgtcctgtctca

SEQ ID NO: 354893 - DNA, 25 bp, Mus musculus
gatttaccagcttccggcggccgct

SEQ ID NO: 354894 - DNA, 25 bp, Mus musculus
accttgtgtcgtagacgtgtttcca

SEQ ID NO: 354895 - DNA, 25 bp, Mus musculus
cgtgtttccagaggagtgagttcgc

SEQ ID NO: 354896 - DNA, 25 bp, Mus musculus
ccaaattccgggagtcaggtgacct

SEQ ID NO: 354897 - DNA, 25 bp, Mus musculus
tccaagttcagtcaagaggtgggtc

SEQ ID NO: 354898 - DNA, 25 bp, Mus musculus
ccgtctccggcttttccaagttcag

SEQ ID NO: 354899 - DNA, 25 bp, Mus musculus
agatccgcggtatgcgggttccacc

SEQ ID NO: 354900 - DNA, 25 bp, Mus musculus
gtcctctcgggtccggtcattcatt

SEQ ID NO: 354901 - DNA, 25 bp, Mus musculus
tcttccgtggtcagtgagcggccaa

SEQ ID NO: 354902 - DNA, 25 bp, Mus musculus
agcggccaaagctctgtccagacca

SEQ ID NO: 354903 - DNA, 25 bp, Mus musculus
cacaaaggcggggaccgagtccaga

SEQ ID NO: 354904 - DNA, 25 bp, Mus musculus
ctccaggagggagttgctagccact

SEQ ID NO: 354905 - DNA, 25 bp, Mus musculus
acgtccacgcttgcgtttctgcgga

SEQ ID NO: 354906 - DNA, 25 bp, Mus musculus
aatccttctgcgtgggtctgtctca

SEQ ID NO: 354907 - DNA, 25 bp, Mus musculus
tgggtctgtctcacaccttaacttg

SEQ ID NO: 354908 - DNA, 25 bp, Mus musculus
cttgaagttagtgagatccgcggta

SEQ ID NO: 354909 - DNA, 25 bp, Mus musculus
tttctgcggatcgtgggaatccttc

SEQ ID NO: 354910 - DNA, 25 bp, Mus musculus
ttcactaccgctccgactcaggtta

SEQ ID NO: 354911 - DNA, 25 bp, Mus musculus
cgggcaccggcaactccacctccga

SEQ ID NO: 354912 - DNA, 25 bp, Mus musculus
cttcggcttcggcttcactaccgct

SEQ ID NO: 354913 - DNA, 25 bp, Mus musculus
ccctcggcaatctccgtcgcctccg

SEQ ID NO: 354914 - DNA, 25 bp, Mus musculus
cgctccgactcaggttatggctccg

SEQ ID NO: 354915 - DNA, 25 bp, Mus musculus
ctcaggttatggctccggcttcggc

SEQ ID NO: 354916 - DNA, 25 bp, Mus musculus
tcgctctctcactcgcacgcgcgtg

SEQ ID NO: 354917 - DNA, 25 bp, Mus musculus
tcccttggtccttcagtcccgcgct

SEQ ID NO: 354918 - DNA, 25 bp, Mus musculus
ccagcttggggagggctgtttattt

SEQ ID NO: 354919 - DNA, 25 bp, Mus musculus
cagcgagctgactggtcgggatcct

SEQ ID NO: 354920 - DNA, 25 bp, Mus musculus
tgactggtcgggatcctccgtcccg

SEQ ID NO: 354921 - DNA, 25 bp, Mus musculus
ggactcggaaaagctcgggaagctc

SEQ ID NO: 354922 - DNA, 25 bp, Mus musculus
gcctcggtgccgacagtcgcgacag

SEQ ID NO: 354923 - DNA, 25 bp, Mus musculus
gagagagaaggggccgcctctttta

SEQ ID NO: 354924 - DNA, 25 bp, Mus musculus
agctggcgatttcccgcatgtctgc

SEQ ID NO: 354925 - DNA, 25 bp, Mus musculus
ttaggagatttcactcgtccttacc

SEQ ID NO: 354926 - DNA, 25 bp, Mus musculus
actcgtccttacctgttcgatggtc

SEQ ID NO: 354927 - DNA, 25 bp, Mus musculus
ccttacctgttcgatggtctctttg

SEQ ID NO: 354928 - DNA, 25 bp, Mus musculus
ttcgatggtctctttggtcggcagg

SEQ ID NO: 354929 - DNA, 25 bp, Mus musculus
tttcccgcatgtctgccttgtctgc

SEQ ID NO: 354930 - DNA, 25 bp, Mus musculus
ccattttcttacaacacgtggattc

SEQ ID NO: 354931 - DNA, 25 bp, Mus musculus
tcttacaacacgtggattctctttc

SEQ ID NO: 354932 - DNA, 25 bp, Mus musculus
cacgtggattctctttccgagctcg

SEQ ID NO: 354933 - DNA, 25 bp, Mus musculus
attctctttccgagctcgcgcttgc

SEQ ID NO: 354934 - DNA, 25 bp, Mus musculus
ttggtcggcagggtgttattctcct

SEQ ID NO: 354935 - DNA, 25 bp, Mus musculus
gggtgttattctcctgcgtctcggt

SEQ ID NO: 354936 - DNA, 25 bp, Mus musculus
ctaggctttttaggagatttcactc

SEQ ID NO: 354937 - DNA, 25 bp, Mus musculus
tattctcctgcgtctcggttttctt

SEQ ID NO: 354938 - DNA, 25 bp, Mus musculus
ccggcccaagggctgacggacaaat

SEQ ID NO: 354939 - DNA, 25 bp, Mus musculus
tccgagtggactttctcgagcgctc

SEQ ID NO: 354940 - DNA, 25 bp, Mus musculus
atcctgactcaggaggacgccctga

SEQ ID NO: 354941 - DNA, 25 bp, Mus musculus
tgccaaacttacaaaggagctgctg

SEQ ID NO: 354942 - DNA, 25 bp, Mus musculus
aaaagtttgccggagctggccgtcg

SEQ ID NO: 354943 - DNA, 25 bp, Mus musculus
aaggactcgagtcttgtcgccgcgc

SEQ ID NO: 354944 - DNA, 25 bp, Mus musculus
gggacataccggcaaagctcgctca

SEQ ID NO: 354945 - DNA, 25 bp, Mus musculus
gaacaggcgctggttcttccgagtg

SEQ ID NO: 354946 - DNA, 25 bp, Mus musculus
cgagactggaagctgcagcaggtca

SEQ ID NO: 354947 - DNA, 25 bp, Mus musculus
cagcaggtcaggttcttgagccttc

SEQ ID NO: 354948 - DNA, 25 bp, Mus musculus
actgcccaatccaacaggagtctgg

SEQ ID NO: 354949 - DNA, 25 bp, Mus musculus
gtctggcctaaactgacagattttc

SEQ ID NO: 354950 - DNA, 25 bp, Mus musculus
tcggcctataaacagacaagagatg

SEQ ID NO: 354951 - DNA, 25 bp, Mus musculus
gctcgctcacctgaacctgggtctg

SEQ ID NO: 354952 - DNA, 25 bp, Mus musculus
gcatgtaaattactccgttcctacg

SEQ ID NO: 354953 - DNA, 25 bp, Mus musculus
ggttgcaaaggccaaacaggttggc

SEQ ID NO: 354954 - DNA, 25 bp, Mus musculus
gccaccaatggttgcaaaggccaaa

SEQ ID NO: 354955 - DNA, 25 bp, Mus musculus
gagcgagccggtgccgttccgcaca

SEQ ID NO: 354956 - DNA, 25 bp, Mus musculus
aacaggttggccaggtttccgctct

SEQ ID NO: 354957 - DNA, 25 bp, Mus musculus
cgttcctacggccaccaatggttgc

SEQ ID NO: 354958 - DNA, 25 bp, Mus musculus
gagaatgcgcatgtaaattactccg

SEQ ID NO: 354959 - DNA, 25 bp, Mus musculus
ccctagccaatagagaatgcgcatg

SEQ ID NO: 354960 - DNA, 25 bp, Mus musculus
gtatagttggctgggcccgcctact

SEQ ID NO: 354961 - DNA, 25 bp, Mus musculus
ccacccgccggcaggtatagttggc

SEQ ID NO: 354962 - DNA, 25 bp, Mus musculus
ctgtggagaaggtgcccacgctcca

SEQ ID NO: 354963 - DNA, 25 bp, Mus musculus
accttgtctgtggagaaggtgccca

SEQ ID NO: 354964 - DNA, 25 bp, Mus musculus
ttcccgcctgactccgagcactggc

SEQ ID NO: 354965 - DNA, 25 bp, Mus musculus
ccgctctgagcgagccggtgccgtt

SEQ ID NO: 354966 - DNA, 25 bp, Mus musculus
gtctagcgtcatttccgggaaagac

SEQ ID NO: 354967 - DNA, 25 bp, Mus musculus
cgagcagagggatgcagagcccagc

SEQ ID NO: 354968 - DNA, 25 bp, Mus musculus
ctacctcccggcagtgcgagcagag

SEQ ID NO: 354969 - DNA, 25 bp, Mus musculus
ttcctgcagagaagcgcgccgccag

SEQ ID NO: 354970 - DNA, 25 bp, Mus musculus
cgatcgccttcctgcagagaagcgc

SEQ ID NO: 354971 - DNA, 25 bp, Mus musculus
gggcactcctgttgtcacttcctca

SEQ ID NO: 354972 - DNA, 25 bp, Mus musculus
cccgtcaagggcactcctgttgtca

SEQ ID NO: 354973 - DNA, 25 bp, Mus musculus
gcaggtctagcgtcatttccgggaa

SEQ ID NO: 354974 - DNA, 25 bp, Mus musculus
cgggaaagactatgcggacgacgtt

SEQ ID NO: 354975 - DNA, 25 bp, Mus musculus
gcggacgacgtttctctgcaacttg

SEQ ID NO: 354976 - DNA, 25 bp, Mus musculus
gacgacgtttctctgcaacttgggg

SEQ ID NO: 354977 - DNA, 25 bp, Mus musculus
ttttttcaccaatgaggaggacgga

SEQ ID NO: 354978 - DNA, 25 bp, Mus musculus
ccaatgaggaggacggaaaaatgta

SEQ ID NO: 354979 - DNA, 25 bp, Mus musculus
tgtcacttcctcaggggcaggtcta

SEQ ID NO: 354980 - DNA, 25 bp, Mus musculus
ccggccacccgagggcagaggcaaa

SEQ ID NO: 354981 - DNA, 25 bp, Mus musculus
gagttcaagatcaggtccggcgcgc

SEQ ID NO: 354982 - DNA, 25 bp, Mus musculus
tccaccgaagaagatcccggctttc

SEQ ID NO: 354983 - DNA, 25 bp, Mus musculus
cgtcacgccctttctcgagagttca

SEQ ID NO: 354984 - DNA, 25 bp, Mus musculus
ttctcgagagttcatagggtttccc

SEQ ID NO: 354985 - DNA, 25 bp, Mus musculus
ttcatagggtttcccggcagctgct

SEQ ID NO: 354986 - DNA, 25 bp, Mus musculus
gcccgggcgaagaactttcacaaga

SEQ ID NO: 354987 - DNA, 25 bp, Mus musculus
cacaagagttgggacgaagggctcc

SEQ ID NO: 354988 - DNA, 25 bp, Mus musculus
gaggctgagatcaccaggctcctga

SEQ ID NO: 354989 - DNA, 25 bp, Mus musculus
acagaggaccgtcctgcaggcgcag

SEQ ID NO: 354990 - DNA, 25 bp, Mus musculus
cgctctctgcgttgttgccctcaag

SEQ ID NO: 354991 - DNA, 25 bp, Mus musculus
cgagagcagaaacccgcagagcttg

SEQ ID NO: 354992 - DNA, 25 bp, Mus musculus
cttgggtgaaggagctccgaacgca

SEQ ID NO: 354993 - DNA, 25 bp, Mus musculus
ctaggcgttcagaggacagaggacc

SEQ ID NO: 354994 - DNA, 25 bp, Mus musculus
ccgtgtgccgcttgttgatgctgat

SEQ ID NO: 354995 - DNA, 25 bp, Mus musculus
gacagccggctttcccgaggaacga

SEQ ID NO: 354996 - DNA, 25 bp, Mus musculus
gagggacccatcctgcagcacagta

SEQ ID NO: 354997 - DNA, 25 bp, Mus musculus
gaacacactgccaggtgcaaggcta

SEQ ID NO: 354998 - DNA, 25 bp, Mus musculus
cgatgctcccacgacaggctgcagt

SEQ ID NO: 354999 - DNA, 25 bp, Mus musculus
gtgcggactcgcgttcgaatacctc

SEQ ID NO: 355000 - DNA, 25 bp, Mus musculus
gaagctacggctgactcgcgccaca

SEQ ID NO: 355001 - DNA, 25 bp, Mus musculus
agggtgtcagactcccttattgtca

SEQ ID NO: 355002 - DNA, 25 bp, Mus musculus
gaatacctcgtagtccctgccggct

SEQ ID NO: 355003 - DNA, 25 bp, Mus musculus
ccactcattttggatgtgccctgca

SEQ ID NO: 355004 - DNA, 25 bp, Mus musculus
ctccatagtccactttcctagggtg

SEQ ID NO: 355005 - DNA, 25 bp, Mus musculus
tttcaggtaggatcaagggcccaca

SEQ ID NO: 355006 - DNA, 25 bp, Mus musculus
tcagaggttctggttggtctaccca

SEQ ID NO: 355007 - DNA, 25 bp, Mus musculus
taggggctcatctatcccgtctcca

SEQ ID NO: 355008 - DNA, 25 bp, Mus musculus
tgtcccataatgcttcgcgccaggc

SEQ ID NO: 355009 - DNA, 25 bp, Mus musculus
tcagaactgaatcgtggtcacgctc

SEQ ID NO: 355010 - DNA, 25 bp, Mus musculus
cagacacaagtgaggggattacgtc

SEQ ID NO: 355011 - DNA, 25 bp, Mus musculus
aagtgtgtcacagctctcggcttta

SEQ ID NO: 355012 - DNA, 25 bp, Mus musculus
ccttcttagtcagcggaaaaatgtc

SEQ ID NO: 355013 - DNA, 25 bp, Mus musculus
acaaggtccggtgtcctgcattctg

SEQ ID NO: 355014 - DNA, 25 bp, Mus musculus
aaaaactgcgattgccgggatactc

SEQ ID NO: 355015 - DNA, 25 bp, Mus musculus
agcgctgtcgtaaatggccctacca

SEQ ID NO: 355016 - DNA, 25 bp, Mus musculus
ctgatcgttatctggagagtggccc

SEQ ID NO: 355017 - DNA, 25 bp, Mus musculus
cgagcgagggatccacacacaaggt

SEQ ID NO: 355018 - DNA, 25 bp, Mus musculus
gcaaaagccttcacgggcccggatg

SEQ ID NO: 355019 - DNA, 25 bp, Mus musculus
agggtcccacgaaacaagccgctca

SEQ ID NO: 355020 - DNA, 25 bp, Mus musculus
gcgacaggacgtaaaggaaggctct

SEQ ID NO: 355021 - DNA, 25 bp, Mus musculus
gcattctgagtcgtgcctgggacca

SEQ ID NO: 355022 - DNA, 25 bp, Mus musculus
cgtggagagagtccttgctgtcctt

SEQ ID NO: 355023 - DNA, 25 bp, Mus musculus
atccctgtccgagttgtaggtggcg

SEQ ID NO: 355024 - DNA, 25 bp, Mus musculus
gtcccacggtcttcatacgggcgtg

SEQ ID NO: 355025 - DNA, 25 bp, Mus musculus
ataaacatgtgcacggccagcaccc
